United States Patent 10,706,955 (BIOINFORMATIC PROCESSES FOR DETERMINATION OF PEPTIDE BINDING) - sequence listing, part 63

SEQ ID NO: 2398104 - protein, 18 aa, Entamoeba dispar
ILVMLFFGYQLLSIMIFT

SEQ ID NO: 2398105 - protein, 35 aa, Entamoeba dispar
ILVSEHPFVSMVLLTVTMILIGLIVMWWSSEYDDE

SEQ ID NO: 2398106 - protein, 17 aa, Entamoeba dispar
ILYSLIVFSISVIIFIV

SEQ ID NO: 2398107 - protein, 23 aa, Entamoeba dispar
ILYYKEVLMPIYMLPINEIITNL

SEQ ID NO: 2398108 - protein, 28 aa, Entamoeba dispar
ILYYQQFQILTQLFISPLRNLLMAKESI

SEQ ID NO: 2398109 - protein, 18 aa, Entamoeba dispar
IMCKPFTGTIRPGDYVEL

SEQ ID NO: 2398110 - protein, 18 aa, Entamoeba dispar
IMCTMPVIFIIFTVVMVT

SEQ ID NO: 2398111 - protein, 28 aa, Entamoeba dispar
IMEREHFFHGLLIRQYIKLIVKDIQETD

SEQ ID NO: 2398112 - protein, 26 aa, Entamoeba dispar
IMIDKEKHMYLIPKYYYKDTKIDVPT

SEQ ID NO: 2398113 - protein, 28 aa, Entamoeba dispar
IMIDKEKHMYLIPKYYYKNLKIDVPTEI

SEQ ID NO: 2398114 - protein, 28 aa, Entamoeba dispar
IMIDKEKHMYLIPKYYYKNVKIDIPTEI

SEQ ID NO: 2398115 - protein, 26 aa, Entamoeba dispar
IMIESSLFIPIFSFGIETQKFAYQNN

SEQ ID NO: 2398116 - protein, 20 aa, Entamoeba dispar
IMIIFAFQIKRLSLRHFIFT

SEQ ID NO: 2398117 - protein, 31 aa, Entamoeba dispar
IMIIVMVILPFILFIFTAIPFMNWRNLSTYL

SEQ ID NO: 2398118 - protein, 17 aa, Entamoeba dispar
IMIYPESLNSTHLEIIK

SEQ ID NO: 2398119 - protein, 25 aa, Entamoeba dispar
IMKIPKYIIISFISSQILVFNNENN

SEQ ID NO: 2398120 - protein, 19 aa, Entamoeba dispar
IMLFVCFGEGKSLSRQSKR

SEQ ID NO: 2398121 - protein, 21 aa, Entamoeba dispar
IMLIILLFPLPPFIARKIPFF

SEQ ID NO: 2398122 - protein, 18 aa, Entamoeba dispar
IMNFLKYCRFNGFFNKED

SEQ ID NO: 2398123 - protein, 18 aa, Entamoeba dispar
IMQFPVLYLEMQKGQNLS

SEQ ID NO: 2398124 - protein, 23 aa, Entamoeba dispar
IMQLWNCYLKEYVPIIPVLQEEI

SEQ ID NO: 2398125 - protein, 17 aa, Entamoeba dispar
IMRSYLAVRLDVFAKEF

SEQ ID NO: 2398126 - protein, 18 aa, Entamoeba dispar
IMRVIRFSIWYQGDFSIV

SEQ ID NO: 2398127 - protein, 30 aa, Entamoeba dispar
IMSLLCILLLLHIYWFTLILKMVYKIITER

SEQ ID NO: 2398128 - protein, 19 aa, Entamoeba dispar
IMVTPFTSQLLSLGNDFIR

SEQ ID NO: 2398129 - protein, 18 aa, Entamoeba dispar
INAEQIFKFFSMTINQRA

SEQ ID NO: 2398130 - protein, 24 aa, Entamoeba dispar
INAIKYTLLIEKIKFELNHQNIIC

SEQ ID NO: 2398131 - protein, 23 aa, Entamoeba dispar
INAPKCIILMKDTKDWKIRRISI

SEQ ID NO: 2398132 - protein, 17 aa, Entamoeba dispar
INCFIACSFHPYSKVSY

SEQ ID NO: 2398133 - protein, 25 aa, Entamoeba dispar
INCKYIPFIIPMILEFVLVLSFVLN

SEQ ID NO: 2398134 - protein, 29 aa, Entamoeba dispar
INCPEPSFPWFYKLWRVQGYYNLLILKCY

SEQ ID NO: 2398135 - protein, 25 aa, Entamoeba dispar
INCQRNCNVVLRWALLHGTYPIKKL

SEQ ID NO: 2398136 - protein, 20 aa, Entamoeba dispar
INDIDPIKFLLSFAKKYGSY

SEQ ID NO: 2398137 - protein, 28 aa, Entamoeba dispar
INDIKVMYLCMFFVLKNISYSTMKSWLE

SEQ ID NO: 2398138 - protein, 19 aa, Entamoeba dispar
INDLIYYFILICCILGCFK

SEQ ID NO: 2398139 - protein, 23 aa, Entamoeba dispar
INDSFLISLLNIIDTMFASSNPK

SEQ ID NO: 2398140 - protein, 39 aa, Entamoeba dispar
INDSTPVGWIIFGVLFYILFVIVLAIIIIGIIMKRKNSG

SEQ ID NO: 2398141 - protein, 25 aa, Entamoeba dispar
INEGVLFYENIKLFGGKNKIIHLSI

SEQ ID NO: 2398142 - protein, 24 aa, Entamoeba dispar
INELALWTLKCCGLYYQRLEGGDE

SEQ ID NO: 2398143 - protein, 28 aa, Entamoeba dispar
INEYLYHNIIELLTILPPSNNIIEKFQN

SEQ ID NO: 2398144 - protein, 17 aa, Entamoeba dispar
INFFQSLKMKIFFQIHQ

SEQ ID NO: 2398145 - protein, 26 aa, Entamoeba dispar
INFMESVWWVFKQLYEKNLVYRGLKI

SEQ ID NO: 2398146 - protein, 23 aa, Entamoeba dispar
INGHGYILLVAVLNAQIIGFASF

SEQ ID NO: 2398147 - protein, 23 aa, Entamoeba dispar
INGTLFYYFLIDNSLNINYPNIY

SEQ ID NO: 2398148 - protein, 22 aa, Entamoeba dispar
INICPYIRYETVPSSSLPGSTE

SEQ ID NO: 2398149 - protein, 26 aa, Entamoeba dispar
INICVIIICIIIFDIIYRLMYFINSR

SEQ ID NO: 2398150 - protein, 25 aa, Entamoeba dispar
INIDMNFILSCLIIFIANAETVSFV

SEQ ID NO: 2398151 - protein, 18 aa, Entamoeba dispar
INIFIPRPLDIQKVIIAI

SEQ ID NO: 2398152 - protein, 25 aa, Entamoeba dispar
INISYIMLILLFLAKTICFSVYGIM

SEQ ID NO: 2398153 - protein, 22 aa, Entamoeba dispar
INKFVSEGLRLVNKYLIECDVN

SEQ ID NO: 2398154 - protein, 17 aa, Entamoeba dispar
INKIIAIITLIIIIIFI

SEQ ID NO: 2398155 - protein, 40 aa, Entamoeba dispar
INKITITLIVILLVLIIFIVLIIIIVIIVIVIPKKKKSTK

SEQ ID NO: 2398156 - protein, 37 aa, Entamoeba dispar
INKRRKYILSGCYYLITKGWSFLFSKEKRTAKKLDHF

SEQ ID NO: 2398157 - protein, 19 aa, Entamoeba dispar
INLKFSSNNGIWYLISSYE

SEQ ID NO: 2398158 - protein, 17 aa, Entamoeba dispar
INLYVYPAYGFVTLMLG

SEQ ID NO: 2398159 - protein, 26 aa, Entamoeba dispar
INMATYFCWLIIPLLMKENGASSFLI

SEQ ID NO: 2398160 - protein, 23 aa, Entamoeba dispar
INNFWKIQHFFDKRLPALRDSAR

SEQ ID NO: 2398161 - protein, 17 aa, Entamoeba dispar
INNLKELTKLRSPLLIN

SEQ ID NO: 2398162 - protein, 18 aa, Entamoeba dispar
INNLTIRGFYQLYSKGKI

SEQ ID NO: 2398163 - protein, 20 aa, Entamoeba dispar
INNMYRIQVYYKAGGSWGPL

SEQ ID NO: 2398164 - protein, 27 aa, Entamoeba dispar
INNNVIYLHQLYLKNALTIRESWIKEN

SEQ ID NO: 2398165 - protein, 18 aa, Entamoeba dispar
INPIRWTLYQGISLKYNH

SEQ ID NO: 2398166 - protein, 24 aa, Entamoeba dispar
INPMRYWRIGVLFGGTIYVIILLI

SEQ ID NO: 2398167 - protein, 25 aa, Entamoeba dispar
INRSVLFFLFITYFFKILSRNKYNH

SEQ ID NO: 2398168 - protein, 24 aa, Entamoeba dispar
INRYTVCNWLILLFGWMSFVAFDS

SEQ ID NO: 2398169 - protein, 33 aa, Entamoeba dispar
INSIYHMQIVRNKKKFKMMFEWGRIGDKLKRTY

SEQ ID NO: 2398170 - protein, 25 aa, Entamoeba dispar
INSVFYPFKLCSCILNITIYIYIYH

SEQ ID NO: 2398171 - protein, 18 aa, Entamoeba dispar
INTHYFIDLTLFDIRKYY

SEQ ID NO: 2398172 - protein, 23 aa, Entamoeba dispar
INTLIGFWILFKRCCRLSKHKSV

SEQ ID NO: 2398173 - protein, 28 aa, Entamoeba dispar
INTLLIFFTLMIYIVLYLVCIMFNFNLI

SEQ ID NO: 2398174 - protein, 18 aa, Entamoeba dispar
INVIVINSFYYDVSNKTS

SEQ ID NO: 2398175 - protein, 22 aa, Entamoeba dispar
INVMMVIFYIMGILIHINCLYQ

SEQ ID NO: 2398176 - protein, 18 aa, Entamoeba dispar
INVQGSCTYCLNAKSKSY

SEQ ID NO: 2398177 - protein, 17 aa, Entamoeba dispar
INWRQYQVLFNHFSDDN

SEQ ID NO: 2398178 - protein, 20 aa, Entamoeba dispar
INYIAIYPIIWIYVFGRCRG

SEQ ID NO: 2398179 - protein, 19 aa, Entamoeba dispar
IPANYYTIYLKPVEVTIFI

SEQ ID NO: 2398180 - protein, 25 aa, Entamoeba dispar
IPCFFFFLFLFHYLSSSLLLSFFFH

SEQ ID NO: 2398181 - protein, 31 aa, Entamoeba dispar
IPESKSLEVFYPILPGRPFDKSFTTAAPYSK

SEQ ID NO: 2398182 - protein, 22 aa, Entamoeba dispar
IPETLLKRLALAKNLPTKIAVW

SEQ ID NO: 2398183 - protein, 38 aa, Entamoeba dispar
IPFIGCPLLLFKAWMLRWWKIMYLRLLDLQKWKVIHGL

SEQ ID NO: 2398184 - protein, 36 aa, Entamoeba dispar
IPGGIIGGLWYCLYVFLLIALMFRFFQAFWDCNKKT

SEQ ID NO: 2398185 - protein, 20 aa, Entamoeba dispar
IPISIFIDQQFLSLMKLYYP

SEQ ID NO: 2398186 - protein, 20 aa, Entamoeba dispar
IPITIPIKKMFWKIYIMLVG

SEQ ID NO: 2398187 - protein, 19 aa, Entamoeba dispar
IPKLSLNPLKVKLFVLFYF

SEQ ID NO: 2398188 - protein, 18 aa, Entamoeba dispar
IPLFISEALCFLFLIIFQ

SEQ ID NO: 2398189 - protein, 24 aa, Entamoeba dispar
IPLRSFFVVFTLILSIILSSFIIL

SEQ ID NO: 2398190 - protein, 27 aa, Entamoeba dispar
IPLTIYMLLNWLWLLGTLIYLNYVDPG

SEQ ID NO: 2398191 - protein, 27 aa, Entamoeba dispar
IPLVILWIILIVIEIGIFAVSMASYFI

SEQ ID NO: 2398192 - protein, 23 aa, Entamoeba dispar
IPMEKLTLLCVLKVLLSNTPTNA

SEQ ID NO: 2398193 - protein, 24 aa, Entamoeba dispar
IPNEKIEYLLPYLQFKINQINCKI

SEQ ID NO: 2398194 - protein, 26 aa, Entamoeba dispar
IPNTTLIMMKLPFLKQVKDLVDHFPE

SEQ ID NO: 2398195 - protein, 23 aa, Entamoeba dispar
IPPKNFLVRQIQKDLKKFEKRSD

SEQ ID NO: 2398196 - protein, 22 aa, Entamoeba dispar
IPQLIEIVTIYFIQIRKLIPSD

SEQ ID NO: 2398197 - protein, 24 aa, Entamoeba dispar
IPQMIQIPFLLQLDTSILLSNELL

SEQ ID NO: 2398198 - protein, 28 aa, Entamoeba dispar
IPRHLVLPDFFFKVLPYFKQSWVCDIYI

SEQ ID NO: 2398199 - protein, 22 aa, Entamoeba dispar
IPSYSFIKPLKSMKNRVVSKEI

SEQ ID NO: 2398200 - protein, 19 aa, Entamoeba dispar
IPTIIFPVLLFYLGMNNGL

SEQ ID NO: 2398201 - protein, 25 aa, Entamoeba dispar
IPTLFYPIIYIFWLDNEKLTSFKPL

SEQ ID NO: 2398202 - protein, 27 aa, Entamoeba dispar
IPTSPKEIFMFLKDPNKPILSRKVLVQ

SEQ ID NO: 2398203 - protein, 19 aa, Entamoeba dispar
IPTTCVYICNFRNVIGTMN

SEQ ID NO: 2398204 - protein, 18 aa, Entamoeba dispar
IPVHFDITFPYSSCPITS

SEQ ID NO: 2398205 - protein, 26 aa, Entamoeba dispar
IPVKPFRLFIPMSFINEIPFLIVLHF

SEQ ID NO: 2398206 - protein, 27 aa, Entamoeba dispar
IPVNRYTIPLIFYLTTSNNDFLQYNEI

SEQ ID NO: 2398207 - protein, 22 aa, Entamoeba dispar
IPVVLFLWLLLWVISGCFVCDR

SEQ ID NO: 2398208 - protein, 20 aa, Entamoeba dispar
IPWKTIVVVLIISSIYSLLQ

SEQ ID NO: 2398209 - protein, 20 aa, Entamoeba dispar
IPYTIWLSKCKKSLQMIAEL

SEQ ID NO: 2398210 - protein, 19 aa, Entamoeba dispar
IPYTIYFSKKKEILKEIIN

SEQ ID NO: 2398211 - protein, 18 aa, Entamoeba dispar
IQELLKIRKPTIVNITKF

SEQ ID NO: 2398212 - protein, 22 aa, Entamoeba dispar
IQEYVGFIITFNCSSKFTTGCL

SEQ ID NO: 2398213 - protein, 17 aa, Entamoeba dispar
IQFIKLLTNIVRISDHR

SEQ ID NO: 2398214 - protein, 19 aa, Entamoeba dispar
IQFISYLLTFIGSIVLDSS

SEQ ID NO: 2398215 - protein, 19 aa, Entamoeba dispar
IQFTRTKIYPGTRGVVLIL

SEQ ID NO: 2398216 - protein, 19 aa, Entamoeba dispar
IQHPIPHCKIYISQLSNYQ

SEQ ID NO: 2398217 - protein, 18 aa, Entamoeba dispar
IQIIWARYPCFDGIYDFS

SEQ ID NO: 2398218 - protein, 25 aa, Entamoeba dispar
IQIVTSVAIFLARGRVIKSLINHFK

SEQ ID NO: 2398219 - protein, 21 aa, Entamoeba dispar
IQLQIKWLRKFFIQEIIKLIE

SEQ ID NO: 2398220 - protein, 28 aa, Entamoeba dispar
IQNILFSGIGLYLPPSPLTTSLLKAQNS

SEQ ID NO: 2398221 - protein, 26 aa, Entamoeba dispar
IQNKTLDLFLLFIKEYISLFSSMNWT

SEQ ID NO: 2398222 - protein, 34 aa, Entamoeba dispar
IQNKYNDLFHLPHLFYICILELIWYLTENKCDNI

SEQ ID NO: 2398223 - protein, 18 aa, Entamoeba dispar
IQQGLFDLFIQTLQIFKN

SEQ ID NO: 2398224 - protein, 17 aa, Entamoeba dispar
IQQPLTQELIMSYPGCG

SEQ ID NO: 2398225 - protein, 24 aa, Entamoeba dispar
IQQYPIFHTYILNSFSFIPLKISH

SEQ ID NO: 2398226 - protein, 29 aa, Entamoeba dispar
IQSIQFFVIFKFIEFFLLDEALYTQFGFD

SEQ ID NO: 2398227 - protein, 23 aa, Entamoeba dispar
IQSKGAFLLYKGRDAVVTTCNSM

SEQ ID NO: 2398228 - protein, 26 aa, Entamoeba dispar
IQTMIFNAFVFCQIFNEINSRKVNGE

SEQ ID NO: 2398229 - protein, 25 aa, Entamoeba dispar
IQTVVLQIIPLIQLLLHSFKSSKDI

SEQ ID NO: 2398230 - protein, 32 aa, Entamoeba dispar
IQTWIFIPTSILLSIYLLCWTLFTVYSWTAHE

SEQ ID NO: 2398231 - protein, 22 aa, Entamoeba dispar
IRALFHLLIVPYLLAIFGHPTK

SEQ ID NO: 2398232 - protein, 26 aa, Entamoeba dispar
IRALIMKHFIHIISYSKLQKIFLVIS

SEQ ID NO: 2398233 - protein, 20 aa, Entamoeba dispar
IRARVISAVKYWIENIWGVI

SEQ ID NO: 2398234 - protein, 18 aa, Entamoeba dispar
IRCPYIVNFIGSVATADT

SEQ ID NO: 2398235 - protein, 25 aa, Entamoeba dispar
IRDANLFFAEFIRDLAIMWRHDEMA

SEQ ID NO: 2398236 - protein, 26 aa, Entamoeba dispar
IRDLLQLVLIFWILLNEFFSFTEVMN

SEQ ID NO: 2398237 - protein, 29 aa, Entamoeba dispar
IRDLTTRYYYMIPHIFDRGNIILIDNAEK

SEQ ID NO: 2398238 - protein, 19 aa, Entamoeba dispar
IRFIFIETFKRKLIINFNN

SEQ ID NO: 2398239 - protein, 49 aa, Entamoeba dispar
IRFSALGCFTFSGIIFFILSIVLALFPLNPIIQKWYLPIPQAINSIITD

SEQ ID NO: 2398240 - protein, 23 aa, Entamoeba dispar
IRGWKNFLFFAIGTLILIGGIVC

SEQ ID NO: 2398241 - protein, 27 aa, Entamoeba dispar
IRHDLGFRRILFILSLINGGVSYVQGM

SEQ ID NO: 2398242 - protein, 28 aa, Entamoeba dispar
IRIASLLHSLLFYSKIYPTINTLLSDDM

SEQ ID NO: 2398243 - protein, 27 aa, Entamoeba dispar
IRIETPQLLTYLYFTSLKDFDNTVWNI

SEQ ID NO: 2398244 - protein, 17 aa, Entamoeba dispar
IRKIWKFISYFIFMVFT

SEQ ID NO: 2398245 - protein, 32 aa, Entamoeba dispar
IRNPRLTAIINPKIPYYIFVHSRYASMTIPSF

SEQ ID NO: 2398246 - protein, 18 aa, Entamoeba dispar
IRNTLDLLFIHFHTFQKE

SEQ ID NO: 2398247 - protein, 33 aa, Entamoeba dispar
IRPEVTYFSLLLLLILISLCGSYFIRMNKPSFG

SEQ ID NO: 2398248 - protein, 22 aa, Entamoeba dispar
IRPYPTKFFWNLLSLYNVCLIL

SEQ ID NO: 2398249 - protein, 27 aa, Entamoeba dispar
IRPYSKYIICWFGLDTLQLLNFSIKIR

SEQ ID NO: 2398250 - protein, 24 aa, Entamoeba dispar
IRRFKHLTKLILFYGRNGKYQIST

SEQ ID NO: 2398251 - protein, 17 aa, Entamoeba dispar
IRRLHVFGEIFAENGFL

SEQ ID NO: 2398252 - protein, 24 aa, Entamoeba dispar
IRRQRRWYTKPKTIKYGDIKHKIT

SEQ ID NO: 2398253 - protein, 22 aa, Entamoeba dispar
IRSEPQLAFIKPGNAVEFNLFV

SEQ ID NO: 2398254 - protein, 17 aa, Entamoeba dispar
IRSIKRNVIFYGTLIIL

SEQ ID NO: 2398255 - protein, 19 aa, Entamoeba dispar
IRSKPLIIGGNFRHFLNGG

SEQ ID NO: 2398256 - protein, 20 aa, Entamoeba dispar
IRSNVWKLLLGYYTPRKREW

SEQ ID NO: 2398257 - protein, 28 aa, Entamoeba dispar
IRTKILDIIIKYILPLISNIPDIQKAFI

SEQ ID NO: 2398258 - protein, 18 aa, Entamoeba dispar
IRTRFVLPSLLTRQVVES

SEQ ID NO: 2398259 - protein, 27 aa, Entamoeba dispar
IRTYGDYLFKENLDFSYKLLRGIMNYC

SEQ ID NO: 2398260 - protein, 19 aa, Entamoeba dispar
ISCFYLILQPIFDYAPLLS

SEQ ID NO: 2398261 - protein, 23 aa, Entamoeba dispar
ISCGLCNDGYYLVDGKCIKCPSS

SEQ ID NO: 2398262 - protein, 23 aa, Entamoeba dispar
ISCYCFLLVFIRMLVELPGFCLT

SEQ ID NO: 2398263 - protein, 26 aa, Entamoeba dispar
ISDEMILFVQLIRYISNLPKMYIIYT

SEQ ID NO: 2398264 - protein, 25 aa, Entamoeba dispar
ISDSNSYICPLPYTCIDSNNCQHQT

SEQ ID NO: 2398265 - protein, 24 aa, Entamoeba dispar
ISDVFQFEDIWKHVCIVWTRCYDC

SEQ ID NO: 2398266 - protein, 23 aa, Entamoeba dispar
ISELCNIFRYFEIPKENGSKMIK

SEQ ID NO: 2398267 - protein, 25 aa, Entamoeba dispar
ISELLRIIEIAFISTPIFYSMSVTC

SEQ ID NO: 2398268 - protein, 23 aa, Entamoeba dispar
ISFCISEIIPWWLLCCHDSVKEV

SEQ ID NO: 2398269 - protein, 26 aa, Entamoeba dispar
ISFIIVIPALIYIIFASNLLPNKKDS

SEQ ID NO: 2398270 - protein, 26 aa, Entamoeba dispar
ISFIPMKAFIYHRRSNFLEVINIHYS

SEQ ID NO: 2398271 - protein, 18 aa, Entamoeba dispar
ISFKIRSITNSNEKVKMI

SEQ ID NO: 2398272 - protein, 20 aa, Entamoeba dispar
ISFLIFSCLFSSIITIIIPI

SEQ ID NO: 2398273 - protein, 20 aa, Entamoeba dispar
ISFLWIFNCAKGQDETGCFC

SEQ ID NO: 2398274 - protein, 21 aa, Entamoeba dispar
ISFNIFNVIWKRFLNKNYGIN

SEQ ID NO: 2398275 - protein, 24 aa, Entamoeba dispar
ISFSFDFLGLAGWALAILGQSPRR

SEQ ID NO: 2398276 - protein, 30 aa, Entamoeba dispar
ISFTSDIILLFFTLLFSVFIIISHWKKSCF

SEQ ID NO: 2398277 - protein, 26 aa, Entamoeba dispar
ISGFHDLYISLILLSLKKSDKMKKEK

SEQ ID NO: 2398278 - protein, 17 aa, Entamoeba dispar
ISGFLYSNGQKQSKYDT

SEQ ID NO: 2398279 - protein, 28 aa, Entamoeba dispar
ISGQTLLLLVLFFLAIEELINQNLSQFQ

SEQ ID NO: 2398280 - protein, 28 aa, Entamoeba dispar
ISHAFGIFLILCYIIVFIATLMTWVGAA

SEQ ID NO: 2398281 - protein, 24 aa, Entamoeba dispar
ISHIDHCIGIGKWLGTLTLHQNKP

SEQ ID NO: 2398282 - protein, 19 aa, Entamoeba dispar
ISHYIIKSTWLPDNRKYIH

SEQ ID NO: 2398283 - protein, 26 aa, Entamoeba dispar
ISIFALLLTFYLWIRAVKSGSPIKAA

SEQ ID NO: 2398284 - protein, 24 aa, Entamoeba dispar
ISIFILLLIAFFIPNSPLKSVIIS

SEQ ID NO: 2398285 - protein, 32 aa, Entamoeba dispar
ISIGTVIVLILFVLLFIFLSSFIKSKKVNIEV

SEQ ID NO: 2398286 - protein, 18 aa, Entamoeba dispar
ISILLGVICGLFAVLFVM

SEQ ID NO: 2398287 - protein, 33 aa, Entamoeba dispar
ISIMQAVFSMVFYFTPITLFTGILLVGYSTFYT

SEQ ID NO: 2398288 - protein, 25 aa, Entamoeba dispar
ISISLPIIVIFLFAKKRNSTYYFIT

SEQ ID NO: 2398289 - protein, 18 aa, Entamoeba dispar
ISITPYFDIYDSGTFTLT

SEQ ID NO: 2398290 - protein, 17 aa, Entamoeba dispar
ISIVERMLILLEKKDSG

SEQ ID NO: 2398291 - protein, 17 aa, Entamoeba dispar
ISKFHVYLNLQVESALS

SEQ ID NO: 2398292 - protein, 38 aa, Entamoeba dispar
ISKIPLPPRAAVVLYYSYLGRSLEIISPLLAMLNQENL

SEQ ID NO: 2398293 - protein, 37 aa, Entamoeba dispar
ISKLGKLYVFHRYICFWPQVLKFNADVWKFEDISGIK

SEQ ID NO: 2398294 - protein, 27 aa, Entamoeba dispar
ISKLKNWLLLLFDASYYKIIVWILFTI

SEQ ID NO: 2398295 - protein, 35 aa, Entamoeba dispar
ISKMKIKYYNNTSPLFIPLLQHDVVIWMGDLNYRI

SEQ ID NO: 2398296 - protein, 22 aa, Entamoeba dispar
ISKPLLTIKKMESLLTLLVLVF

SEQ ID NO: 2398297 - protein, 23 aa, Entamoeba dispar
ISKYWDFFTLYIFVAVVAILVII

SEQ ID NO: 2398298 - protein, 19 aa, Entamoeba dispar
ISLCHFIHSLIIPTSPLEL

SEQ ID NO: 2398299 - protein, 28 aa, Entamoeba dispar
ISLDMDFTFLLIFYSLKSRKPTNYIKMN

SEQ ID NO: 2398300 - protein, 24 aa, Entamoeba dispar
ISLFSSMNWTIHDSIIISILNFIE

SEQ ID NO: 2398301 - protein, 24 aa, Entamoeba dispar
ISLGFFQLLLWKYYPEEPTARIWG

SEQ ID NO: 2398302 - protein, 23 aa, Entamoeba dispar
ISLIFVPFIIPLFYKKTPLQEDQ

SEQ ID NO: 2398303 - protein, 20 aa, Entamoeba dispar
ISLITILFWYDTPVGIVSII

SEQ ID NO: 2398304 - protein, 17 aa, Entamoeba dispar
ISLKHVLNNFQEFLYSG

SEQ ID NO: 2398305 - protein, 29 aa, Entamoeba dispar
ISLLFIVIGFFFPLVWIINYVLFSSSKDK

SEQ ID NO: 2398306 - protein, 25 aa, Entamoeba dispar
ISLLTILLLIYFNCSHIFYRNLFIS

SEQ ID NO: 2398307 - protein, 18 aa, Entamoeba dispar
ISLLYLLGYIIDLILSIL

SEQ ID NO: 2398308 - protein, 25 aa, Entamoeba dispar
ISLNDYVLMLRFIQILGKEAFEVLI

SEQ ID NO: 2398309 - protein, 25 aa, Entamoeba dispar
ISLTLFFNYFIFSVRWYCGRYLLDP

SEQ ID NO: 2398310 - protein, 22 aa, Entamoeba dispar
ISMLHSFHFIYRQLNPSSILVA

SEQ ID NO: 2398311 - protein, 23 aa, Entamoeba dispar
ISNKYFITSKWTKLVKRNYHEKV

SEQ ID NO: 2398312 - protein, 44 aa, Entamoeba dispar
ISNNLKIMIQILSNVFPFKDFWGHVCIVWNKCYYFFSQDQLEMQ

SEQ ID NO: 2398313 - protein, 25 aa, Entamoeba dispar
ISNNLKIMIQILSNVFPVSEFWGHV

SEQ ID NO: 2398314 - protein, 22 aa, Entamoeba dispar
ISNSFIYVFLDTLYIQYFVKQI

SEQ ID NO: 2398315 - protein, 25 aa, Entamoeba dispar
ISPDFSYIFNIIKKEVMKKWPENAL

SEQ ID NO: 2398316 - protein, 27 aa, Entamoeba dispar
ISQIAMLMFPLMLQFIVAWVKEDEPKK

SEQ ID NO: 2398317 - protein, 25 aa, Entamoeba dispar
ISQVVIHFIVIQLALKWGKEAAGPD

SEQ ID NO: 2398318 - protein, 17 aa, Entamoeba dispar
ISQYFYEHSLLPSINFV

SEQ ID NO: 2398319 - protein, 35 aa, Entamoeba dispar
ISRDVYSLIIPFLIPNCVELLPILLSMERLEILKI

SEQ ID NO: 2398320 - protein, 24 aa, Entamoeba dispar
ISRKPLLTYMLLKLDCPIKEEQLA

SEQ ID NO: 2398321 - protein, 23 aa, Entamoeba dispar
ISRKPLLTYMLLRLDTPLKEEQI

SEQ ID NO: 2398322 - protein, 28 aa, Entamoeba dispar
ISRLCIPPMIQFFHLLNNTPELISCITS

SEQ ID NO: 2398323 - protein, 17 aa, Entamoeba dispar
ISRYKYIDLCVLRNKFP

SEQ ID NO: 2398324 - protein, 26 aa, Entamoeba dispar
ISSEAPPLFLFFKCSDNIALDEARKQ

SEQ ID NO: 2398325 - protein, 20 aa, Entamoeba dispar
ISSFSFATTFFFLVFSHLLS

SEQ ID NO: 2398326 - protein, 17 aa, Entamoeba dispar
ISSIIIIKLMKKKSTNQ

SEQ ID NO: 2398327 - protein, 26 aa, Entamoeba dispar
ISSIPALIYFFQNILCQLSLANIQPG

SEQ ID NO: 2398328 - protein, 21 aa, Entamoeba dispar
ISSIVICEYGYYYNGSICTQC

SEQ ID NO: 2398329 - protein, 23 aa, Entamoeba dispar
ISSLNYGLIIGIPLICILMIIII

SEQ ID NO: 2398330 - protein, 18 aa, Entamoeba dispar
ISSLSPLIYLTTLKFLNA

SEQ ID NO: 2398331 - protein, 32 aa, Entamoeba dispar
ISSMSLTMRFFIMLRIYLSKYIKELPIFDTEG

SEQ ID NO: 2398332 - protein, 17 aa, Entamoeba dispar
ISSPYGCLRCMTGYYLK

SEQ ID NO: 2398333 - protein, 28 aa, Entamoeba dispar
ISSQMHLTLLDLLLFSTSGFIDFSISLF

SEQ ID NO: 2398334 - protein, 25 aa, Entamoeba dispar
ISSTLSIPSFYFSYTYDLTRSYQTQ

SEQ ID NO: 2398335 - protein, 23 aa, Entamoeba dispar
ISTISFNLLISFITYILSNQKNI

SEQ ID NO: 2398336 - protein, 37 aa, Entamoeba dispar
ISVAIVIGLFIIGIWIWYLRRPYPVYLVSFATSIPED

SEQ ID NO: 2398337 - protein, 37 aa, Entamoeba dispar
ISVATLFLFAYIPLSIYYIFSWGFTSLYLLLSLGLVI

SEQ ID NO: 2398338 - protein, 37 aa, Entamoeba dispar
ISVHYRFYWQIITVDLLFIIPYWRSYLTGLSSVHIKQ

SEQ ID NO: 2398339 - protein, 27 aa, Entamoeba dispar
ISVLFLVFTFFLIFVSYQSLKTKPQKA

SEQ ID NO: 2398340 - protein, 24 aa, Entamoeba dispar
ISVSLMFWILYFKSPSTVFRATDE

SEQ ID NO: 2398341 - protein, 25 aa, Entamoeba dispar
ISVSLNFALINLGLVSVAVTFLMGS

SEQ ID NO: 2398342 - protein, 33 aa, Entamoeba dispar
ISWVFNYYLNKLPSWRWYYKFHYAPFALDFALY

SEQ ID NO: 2398343 - protein, 22 aa, Entamoeba dispar
ISYFCDIIFLVLLVLRLDRVFM

SEQ ID NO: 2398344 - protein, 34 aa, Entamoeba dispar
ISYGIIILIVLTTLIIILITIGMFIVIYRIYNKR

SEQ ID NO: 2398345 - protein, 31 aa, Entamoeba dispar
ISYITNLRVAPKTYFSIRKLNLHITKMYGTE

SEQ ID NO: 2398346 - protein, 28 aa, Entamoeba dispar
ISYKEMIKFIIFFIKQKLGKIDSKEVFM

SEQ ID NO: 2398347 - protein, 29 aa, Entamoeba dispar
ISYPALMFPTCAGILRYIPKKWKIVQLWN

SEQ ID NO: 2398348 - protein, 18 aa, Entamoeba dispar
ISYYLYHNSLSFTTGNGL

SEQ ID NO: 2398349 - protein, 25 aa, Entamoeba dispar
ITAKTSFPLYIYTQSYELFELTRTN

SEQ ID NO: 2398350 - protein, 22 aa, Entamoeba dispar
ITASFIIKIIWFRGIVRESSGL

SEQ ID NO: 2398351 - protein, 19 aa, Entamoeba dispar
ITFLTALLKVCCKIESLSD

SEQ ID NO: 2398352 - protein, 30 aa, Entamoeba dispar
ITFNVPSFTPLLIPIFHVTPLTSPIPSCDD

SEQ ID NO: 2398353 - protein, 19 aa, Entamoeba dispar
ITFSIIFLGLPIYYIAKTY

SEQ ID NO: 2398354 - protein, 19 aa, Entamoeba dispar
ITGFGIILFLHLCFDVLTL

SEQ ID NO: 2398355 - protein, 26 aa, Entamoeba dispar
ITIEEVLSHPLFWNCKKRLEFIQKVS

SEQ ID NO: 2398356 - protein, 28 aa, Entamoeba dispar
ITIELIIIYILLMLSWIGYYPASFNMTI

SEQ ID NO: 2398357 - protein, 19 aa, Entamoeba dispar
ITIKCNNLPILISSIRSEG

SEQ ID NO: 2398358 - protein, 24 aa, Entamoeba dispar
ITIKPNVILTYNGKTSLLINKLSI

SEQ ID NO: 2398359 - protein, 18 aa, Entamoeba dispar
ITILGILQCNILTISGNS

SEQ ID NO: 2398360 - protein, 19 aa, Entamoeba dispar
ITIQRILTLLYSYADLFSS

SEQ ID NO: 2398361 - protein, 27 aa, Entamoeba dispar
ITKASIYLVIFALVIAAVFIAFYIFTV

SEQ ID NO: 2398362 - protein, 27 aa, Entamoeba dispar
ITKASIYLVILVLVIAAVFVAFYIFTS

SEQ ID NO: 2398363 - protein, 23 aa, Entamoeba dispar
ITKELILVICPLLSSITKNHIEL

SEQ ID NO: 2398364 - protein, 23 aa, Entamoeba dispar
ITKFLQHKLFQIEDYAIFPITEH

SEQ ID NO: 2398365 - protein, 21 aa, Entamoeba dispar
ITKLNIFFQRFLKDMKSFEIL

SEQ ID NO: 2398366 - protein, 29 aa, Entamoeba dispar
ITKNRLVHLIIFCPCTCVPPIPIMVGTDY

SEQ ID NO: 2398367 - protein, 17 aa, Entamoeba dispar
ITKQRIRWKKQFELPVQ

SEQ ID NO: 2398368 - protein, 25 aa, Entamoeba dispar
ITKRGFSLPLFFMGHSMGGLLTSIL

SEQ ID NO: 2398369 - protein, 23 aa, Entamoeba dispar
ITLALTITTLIILSTKLGEINYT

SEQ ID NO: 2398370 - protein, 27 aa, Entamoeba dispar
ITLCVGITFFLFSLHVTVFHVQYNSLP

SEQ ID NO: 2398371 - protein, 22 aa, Entamoeba dispar
ITLFLKGFIMSYWFGYSDNPIN

SEQ ID NO: 2398372 - protein, 19 aa, Entamoeba dispar
ITLIVFILGMLRKIKDSST

SEQ ID NO: 2398373 - protein, 25 aa, Entamoeba dispar
ITLKYLYFISYFFNFFYQKVINITT

SEQ ID NO: 2398374 - protein, 29 aa, Entamoeba dispar
ITLRFGWTINIILLYVAWFDENKIVRECI

SEQ ID NO: 2398375 - protein, 17 aa, Entamoeba dispar
ITLSFGRKCYYYELYQS

SEQ ID NO: 2398376 - protein, 21 aa, Entamoeba dispar
ITLTSLYVWVYVMIGWCLFVM

SEQ ID NO: 2398377 - protein, 27 aa, Entamoeba dispar
ITMNAWDIFLFLSSKSFIILRRNNEMI

SEQ ID NO: 2398378 - protein, 22 aa, Entamoeba dispar
ITNFITVLFQLLRAFGLNTIAG

SEQ ID NO: 2398379 - protein, 30 aa, Entamoeba dispar
ITNIFKTLLILIFWIFVIQPELTMIGKLKT

SEQ ID NO: 2398380 - protein, 22 aa, Entamoeba dispar
ITNLRVLLKQLVNNRHITDTNL

SEQ ID NO: 2398381 - protein, 30 aa, Entamoeba dispar
ITNSIDLLIEYFFIILKKNNKSYDWMILIL

SEQ ID NO: 2398382 - protein, 23 aa, Entamoeba dispar
ITPSARLPWHIRMLKKASESGED

SEQ ID NO: 2398383 - protein, 26 aa, Entamoeba dispar
ITQKHLIITYFIRELLNIYTREGPVG

SEQ ID NO: 2398384 - protein, 23 aa, Entamoeba dispar
ITQRSIVVLPKKKLMKNPRKPTD

SEQ ID NO: 2398385 - protein, 18 aa, Entamoeba dispar
ITRKGIFFSVKTVPYHTL

SEQ ID NO: 2398386 - protein, 24 aa, Entamoeba dispar
ITRQLVMCIIILYIRFYGNVIERW

SEQ ID NO: 2398387 - protein, 25 aa, Entamoeba dispar
ITRTMRILYNIFLLGIILTIVSSSI

SEQ ID NO: 2398388 - protein, 18 aa, Entamoeba dispar
ITRYPLFIQTLISGISQE

SEQ ID NO: 2398389 - protein, 18 aa, Entamoeba dispar
ITSAFGYYLSLIEMIFTL

SEQ ID NO: 2398390 - protein, 23 aa, Entamoeba dispar
ITSFIVLLFIIIPLVINGNISDQ

SEQ ID NO: 2398391 - protein, 28 aa, Entamoeba dispar
ITSGGLELIYLILTMKYDDKHKGNMNVV

SEQ ID NO: 2398392 - protein, 30 aa, Entamoeba dispar
ITSILLVLLCLIIVTIICVLCLIKKKSKYA

SEQ ID NO: 2398393 - protein, 19 aa, Entamoeba dispar
ITSLLVCKMLSLLQPTSDQ

SEQ ID NO: 2398394 - protein, 33 aa, Entamoeba dispar
ITSSVFGLLALLYPFIWQGVLIPFVPVQLQEFL

SEQ ID NO: 2398395 - protein, 25 aa, Entamoeba dispar
ITTGLNCIIFLLFQFKKLQIECRLI

SEQ ID NO: 2398396 - protein, 31 aa, Entamoeba dispar
ITTIQYIPHLCALSLLFYAPTTVHGELEACA

SEQ ID NO: 2398397 - protein, 20 aa, Entamoeba dispar
ITTLFRIILLIPILNNYLSN

SEQ ID NO: 2398398 - protein, 24 aa, Entamoeba dispar
ITVENPFFSFLSPNIEFGKEVPLD

SEQ ID NO: 2398399 - protein, 19 aa, Entamoeba dispar
ITVFSLYVLSIIILPICVW

SEQ ID NO: 2398400 - protein, 56 aa, Entamoeba dispar
ITVHSKTPMWLILLIAFLSFDNIVYVLKSPTLLALTLIIIAIIYSLNKFGYAYLID

SEQ ID NO: 2398401 - protein, 22 aa, Entamoeba dispar
ITVYFTITLLCTCKEYEAIQLI

SEQ ID NO: 2398402 - protein, 26 aa, Entamoeba dispar
ITYEDYPYFIIAESRPFTIRTSLENT

SEQ ID NO: 2398403 - protein, 21 aa, Entamoeba dispar
ITYILIMTLIIFLLPKVYGDE

SEQ ID NO: 2398404 - protein, 18 aa, Entamoeba dispar
ITYRFIHRYGFDLDSGMI

SEQ ID NO: 2398405 - protein, 22 aa, Entamoeba dispar
ITYYIIPMSLLQMKLDILFICF

SEQ ID NO: 2398406 - protein, 21 aa, Entamoeba dispar
IVAEMFLGIPLFPANSEYDLL

SEQ ID NO: 2398407 - protein, 31 aa, Entamoeba dispar
IVAIKGTFPFIWIFLVFASICYWSSNQFAPN

SEQ ID NO: 2398408 - protein, 24 aa, Entamoeba dispar
IVCRMLMIIVVVISYPALMFPTCA

SEQ ID NO: 2398409 - protein, 23 aa, Entamoeba dispar
IVDGQLILYLQSFARYMVNVLQE

SEQ ID NO: 2398410 - protein, 24 aa, Entamoeba dispar
IVDWTIPIFQFPLSGIITFIIGGI

SEQ ID NO: 2398411 - protein, 18 aa, Entamoeba dispar
IVDYRKNVFYLSAANGWF

SEQ ID NO: 2398412 - protein, 27 aa, Entamoeba dispar
IVEPPDYPMRFYGKVYFNNTLKITKSD

SEQ ID NO: 2398413 - protein, 20 aa, Entamoeba dispar
IVFLAPFSVSVPEALEIGCS

SEQ ID NO: 2398414 - protein, 18 aa, Entamoeba dispar
IVFNTYIQLRISVGFAGP

SEQ ID NO: 2398415 - protein, 18 aa, Entamoeba dispar
IVFWIGHVSFKHSITFET

SEQ ID NO: 2398416 - protein, 23 aa, Entamoeba dispar
IVGFSLFVLIIVSLSIIGLASVQ

SEQ ID NO: 2398417 - protein, 29 aa, Entamoeba dispar
IVHNFHFETLPSIFWSLLNAGNNKRLLCR

SEQ ID NO: 2398418 - protein, 18 aa, Entamoeba dispar
IVIMNILNAFYNKFEKMD

SEQ ID NO: 2398419 - protein, 26 aa, Entamoeba dispar
IVIPLCAIPFWYIQIPLIIIGFLVMS

SEQ ID NO: 2398420 - protein, 19 aa, Entamoeba dispar
IVIQLLSLHFSFSKDILPQ

SEQ ID NO: 2398421 - protein, 17 aa, Entamoeba dispar
IVITLLACCQGAVIVDF

SEQ ID NO: 2398422 - protein, 38 aa, Entamoeba dispar
IVKASGFKISYEGGPLPWYLNKGLYFTNITLRNRIADV

SEQ ID NO: 2398423 - protein, 27 aa, Entamoeba dispar
IVKFITHPFLWSFVFMVICGYWNGIFQ

SEQ ID NO: 2398424 - protein, 35 aa, Entamoeba dispar
IVKQTFIQCLSSIPLKLLYKLILLIKPNNSLSYPT

SEQ ID NO: 2398425 - protein, 25 aa, Entamoeba dispar
IVLFWVFVLIWRKKKLITFIVYCCL

SEQ ID NO: 2398426 - protein, 37 aa, Entamoeba dispar
IVLGRWSYWQYKQRFNLLALCIMLVVALGLLFSPNGW

SEQ ID NO: 2398427 - protein, 26 aa, Entamoeba dispar
IVLIISPRLLFKFLSVSLAFIMFIYL

SEQ ID NO: 2398428 - protein, 24 aa, Entamoeba dispar
IVLIRLHLFLDFYSFNIPSFGYFY

SEQ ID NO: 2398429 - protein, 22 aa, Entamoeba dispar
IVLLEKAQIFAVPLISSMKYNI

SEQ ID NO: 2398430 - protein, 21 aa, Entamoeba dispar
IVLLLFFISSINGKIHCNNGV

SEQ ID NO: 2398431 - protein, 19 aa, Entamoeba dispar
IVLLLFYFILYIIFVVYSQ

SEQ ID NO: 2398432 - protein, 42 aa, Entamoeba dispar
IVLQLIENTPYYLFVHKPFGIPFTTDVPILFTPIVHPCSYVY

SEQ ID NO: 2398433 - protein, 18 aa, Entamoeba dispar
IVLSPETLTKIIKIDFDC

SEQ ID NO: 2398434 - protein, 20 aa, Entamoeba dispar
IVLTMDFNNPRFSHSLKHLV

SEQ ID NO: 2398435 - protein, 35 aa, Entamoeba dispar
IVLYRTYFLGYLIPLFLYLWLSYYPPHLSYQNTMN

SEQ ID NO: 2398436 - protein, 25 aa, Entamoeba dispar
IVMRAQDLILRLFNKLSSEEKKYFK

SEQ ID NO: 2398437 - protein, 18 aa, Entamoeba dispar
IVNHDLFYLNDSGSIRII

SEQ ID NO: 2398438 - protein, 30 aa, Entamoeba dispar
IVNPNQMFVLFILLIKYSIYSFLSGISCVQ

SEQ ID NO: 2398439 - protein, 22 aa, Entamoeba dispar
IVQRNYNGKLLWNIWMEKDDNG

SEQ ID NO: 2398440 - protein, 58 aa, Entamoeba dispar
IVRYPLHILPPLKSIPLRTIIWILFYAPFKFFYLAVQLLYLLLFKLPNYSHILIQNPP

SEQ ID NO: 2398441 - protein, 18 aa, Entamoeba dispar
IVSFFFALFSSKQIVPHQ

SEQ ID NO: 2398442 - protein, 23 aa, Entamoeba dispar
IVSGNYEFMFAYTGLGDLGNPVA

SEQ ID NO: 2398443 - protein, 25 aa, Entamoeba dispar
IVSIIALILFIIYSLTVFSSELLLP

SEQ ID NO: 2398444 - protein, 20 aa, Entamoeba dispar
IVSIIKILRRCCEIDLFQFH

SEQ ID NO: 2398445 - protein, 17 aa, Entamoeba dispar
IVSLCFILALRGLSTQI

SEQ ID NO: 2398446 - protein, 28 aa, Entamoeba dispar
IVSLSVLIFCIITIIISFNLSLHNMFYK

SEQ ID NO: 2398447 - protein, 28 aa, Entamoeba dispar
IVSQLPLKYFIIPFILSIGIILIVHLTE

SEQ ID NO: 2398448 - protein, 18 aa, Entamoeba dispar
IVSSLLKEALREISLFPI

SEQ ID NO: 2398449 - protein, 17 aa, Entamoeba dispar
IVSVIIFVLLLVVAFFL

SEQ ID NO: 2398450 - protein, 20 aa, Entamoeba dispar
IVSVIIIIVIIVTLRNKKDE

SEQ ID NO: 2398451 - protein, 20 aa, Entamoeba dispar
IVSWLLFIGALLTSTGLLLN

SEQ ID NO: 2398452 - protein, 20 aa, Entamoeba dispar
IVSYEVFLRKIPYGNGCFVH

SEQ ID NO: 2398453 - protein, 28 aa, Entamoeba dispar
IVTLILLLLQWKMLMIICLIINKNYKQK

SEQ ID NO: 2398454 - protein, 21 aa, Entamoeba dispar
IVTVFRQFHPSTLWTSFSYLS

SEQ ID NO: 2398455 - protein, 18 aa, Entamoeba dispar
IVTWMNAGATQYIFVHKK

SEQ ID NO: 2398456 - protein, 23 aa, Entamoeba dispar
IVVDPALFMMLSGFYKETATDVL

SEQ ID NO: 2398457 - protein, 22 aa, Entamoeba dispar
IVVLLVIWRKTSMKSWYFEHSY

SEQ ID NO: 2398458 - protein, 32 aa, Entamoeba dispar
IVVNKLSAWDYLLFLNGIVLASILVYITLKMI

SEQ ID NO: 2398459 - protein, 29 aa, Entamoeba dispar
IVVTIIFILMIIFYLLRRVYFPEEQQKFA

SEQ ID NO: 2398460 - protein, 21 aa, Entamoeba dispar
IVVVLGIIWFAIGIVYVALSL

SEQ ID NO: 2398461 - protein, 19 aa, Entamoeba dispar
IVVVMIIIAIGIKQTVDIV

SEQ ID NO: 2398462 - protein, 19 aa, Entamoeba dispar
IVVYGLIGSLFIAVFCGVT

SEQ ID NO: 2398463 - protein, 19 aa, Entamoeba dispar
IWFDFTIACSSRFPIVLVP

SEQ ID NO: 2398464 - protein, 31 aa, Entamoeba dispar
IWLSIFHITNSLLILILSILLQALCFTLYCL

SEQ ID NO: 2398465 - protein, 19 aa, Entamoeba dispar
IWLVLPFSHQHYVLIIYSF

SEQ ID NO: 2398466 - protein, 19 aa, Entamoeba dispar
IYAQTFFNGLQNHFTRMIL

SEQ ID NO: 2398467 - protein, 27 aa, Entamoeba dispar
IYDETMAKLLLRLLAYFHEHVSETDQI

SEQ ID NO: 2398468 - protein, 18 aa, Entamoeba dispar
IYEMFRVFRIIDLTKENK

SEQ ID NO: 2398469 - protein, 22 aa, Entamoeba dispar
IYFIVFVIVLKLSAIYLYGSGF

SEQ ID NO: 2398470 - protein, 19 aa, Entamoeba dispar
IYFLFPLFCLTTYISLDTG

SEQ ID NO: 2398471 - protein, 29 aa, Entamoeba dispar
IYFVETPCFNILPYLIQQTKGYYYVLYSE

SEQ ID NO: 2398472 - protein, 19 aa, Entamoeba dispar
IYGKWFKLNMNFNGYIAIE

SEQ ID NO: 2398473 - protein, 30 aa, Entamoeba dispar
IYGSPLLFVFVYRFILFSFQYISVSIKFYS

SEQ ID NO: 2398474 - protein, 17 aa, Entamoeba dispar
IYHDALVGIFDYIQSDG

SEQ ID NO: 2398475 - protein, 28 aa, Entamoeba dispar
IYHYSAFAILLFFTAWLPQAAIAMHGSQ

SEQ ID NO: 2398476 - protein, 23 aa, Entamoeba dispar
IYICLFYLLYKYLVFYEIFTFIT

SEQ ID NO: 2398477 - protein, 35 aa, Entamoeba dispar
IYINMGKWVYVPLIVFIVFLLLNIGFGFLNGKFFS

SEQ ID NO: 2398478 - protein, 21 aa, Entamoeba dispar
IYKFISPYYFPKEIKTLFDSF

SEQ ID NO: 2398479 - protein, 18 aa, Entamoeba dispar
IYKLVIFEGYQPYYLEEF

SEQ ID NO: 2398480 - protein, 17 aa, Entamoeba dispar
IYKYSLEFVLKLLHCSL

SEQ ID NO: 2398481 - protein, 31 aa, Entamoeba dispar
IYLLPLCCSLLIPFILQFTISWGMKAVLPIT

SEQ ID NO: 2398482 - protein, 19 aa, Entamoeba dispar
IYLRDILDDTLRLLEKLQS

SEQ ID NO: 2398483 - protein, 17 aa, Entamoeba dispar
IYLTWKRRLKMLHDAAS

SEQ ID NO: 2398484 - protein, 21 aa, Entamoeba dispar
IYNVLFTFLPIIVFGIFDRDI

SEQ ID NO: 2398485 - protein, 19 aa, Entamoeba dispar
IYPLGVCFYRILTNKLPFG

SEQ ID NO: 2398486 - protein, 27 aa, Entamoeba dispar
IYSLGMLYIIIHMKFIPSKKQYISWVM

SEQ ID NO: 2398487 - protein, 23 aa, Entamoeba dispar
IYSTLICFLIFLGLSCGEIQKPL

SEQ ID NO: 2398488 - protein, 23 aa, Entamoeba dispar
IYTKSFIPHLFSLSANGFSYYVY

SEQ ID NO: 2398489 - protein, 28 aa, Entamoeba dispar
IYYIIPIIIFIFYFWIINGSDSCNKIRF

SEQ ID NO: 2398490 - protein, 24 aa, Entamoeba dispar
KAATKCVPALLRVFFQAVSVRYNS

SEQ ID NO: 2398491 - protein, 23 aa, Entamoeba dispar
KAAVDLCRLVFPLSSDENPRVRN

SEQ ID NO: 2398492 - protein, 25 aa, Entamoeba dispar
KACMIIFLILGICFPPFLICSLVYM

SEQ ID NO: 2398493 - protein, 30 aa, Entamoeba dispar
KAEDVFKIIFRLAPNHCFAHYLRGVLFQQI

SEQ ID NO: 2398494 - protein, 24 aa, Entamoeba dispar
KAERIEFLELITDNFFSLNALTCT

SEQ ID NO: 2398495 - protein, 30 aa, Entamoeba dispar
KAFPTKDFWRHVCIVWAKCFYYTSEKTLEK

SEQ ID NO: 2398496 - protein, 25 aa, Entamoeba dispar
KAIVCGIIIFFVKFWIIKEIENKMN

SEQ ID NO: 2398497 - protein, 25 aa, Entamoeba dispar
KAKTKFFITISRFGNLQFTNALSLA

SEQ ID NO: 2398498 - protein, 21 aa, Entamoeba dispar
KAKYYRVEIPKGKKIRVNTCN

SEQ ID NO: 2398499 - protein, 20 aa, Entamoeba dispar
KALARGLLDLGLKKGDVIGF

SEQ ID NO: 2398500 - protein, 17 aa, Entamoeba dispar
KAMEKLFNYYKVELIKA

SEQ ID NO: 2398501 - protein, 26 aa, Entamoeba dispar
KAMLIAIIPRLIFDITMFIPIVAQTI

SEQ ID NO: 2398502 - protein, 27 aa, Entamoeba dispar
KANILFILGIFIPLLQCMNWMCIFRKP

SEQ ID NO: 2398503 - protein, 31 aa, Entamoeba dispar
KANYFTPNYVLYLPYYLLGSQVTLRIITISI

SEQ ID NO: 2398504 - protein, 25 aa, Entamoeba dispar
KAPKHIYDFLITELNWEEFIAKLPK

SEQ ID NO: 2398505 - protein, 32 aa, Entamoeba dispar
KAQTLICAYLTRIKLPKYLKYTLYSMIPDLRK

SEQ ID NO: 2398506 - protein, 19 aa, Entamoeba dispar
KARVTNNMFLSDKINFIRT

SEQ ID NO: 2398507 - protein, 24 aa, Entamoeba dispar
KASRLTYHFTKPSYIFITGATQLD

SEQ ID NO: 2398508 - protein, 21 aa, Entamoeba dispar
KATQMSWALKIDRLREAFSNG

SEQ ID NO: 2398509 - protein, 29 aa, Entamoeba dispar
KATRVKIIVLILLMLILGAIIVLVLKVAL

SEQ ID NO: 2398510 - protein, 17 aa, Entamoeba dispar
KAYSTFDFAILEEIPLT

SEQ ID NO: 2398511 - protein, 28 aa, Entamoeba dispar
KCDVSYQMLYIPFYSLTKKAQSIVNRKL

SEQ ID NO: 2398512 - protein, 18 aa, Entamoeba dispar
KCFALYVLGTSKTTGFIS

SEQ ID NO: 2398513 - protein, 23 aa, Entamoeba dispar
KCFKCLTGFIPYNEQCVTLKSIN

SEQ ID NO: 2398514 - protein, 17 aa, Entamoeba dispar
KCFSCDSSLNLYLLNSH

SEQ ID NO: 2398515 - protein, 34 aa, Entamoeba dispar
KCILGLVALLIIFQAFVLIFIFTSGYVTLDNYQL

SEQ ID NO: 2398516 - protein, 17 aa, Entamoeba dispar
KCISFRLLNRCIKSKNN

SEQ ID NO: 2398517 - protein, 22 aa, Entamoeba dispar
KCKLCFDGFVLNGLNCLSYKTI

SEQ ID NO: 2398518 - protein, 21 aa, Entamoeba dispar
KCKTGYFAFEGKCYLCDPRCA

SEQ ID NO: 2398519 - protein, 17 aa, Entamoeba dispar
KCLKLINTGLIGLNKFK

SEQ ID NO: 2398520 - protein, 19 aa, Entamoeba dispar
KCMLSKTNIIIIVSISCIV

SEQ ID NO: 2398521 - protein, 44 aa, Entamoeba dispar
KCNKEIIWWMIMIIIIIILIIIIIIIIIIIIMINYIIKRKEKKE

SEQ ID NO: 2398522 - protein, 45 aa, Entamoeba dispar
KCNKEIVWWMIMIIIIIILIIIIIIIIIIIIIMINYIIKRKEKKE

SEQ ID NO: 2398523 - protein, 45 aa, Entamoeba dispar
KCNKEIVWWMIMIIIIIILIIIIIIIIIIITMINYIIKLKEKKEQ

SEQ ID NO: 2398524 - protein, 44 aa, Entamoeba dispar
KCNKEIVWWMIMIIIIIILIIIITIIIIIIIMINYIIKRKEKKE

SEQ ID NO: 2398525 - protein, 44 aa, Entamoeba dispar
KCNKEIVWWMIMIIIIIILIIIITIIIIIITMINYIIKRKEKKE

SEQ ID NO: 2398526 - protein, 44 aa, Entamoeba dispar
KCNKEMVWWMIMIIIIIILIIIIIIIIIIIIMINYIIKRKEKKE

SEQ ID NO: 2398527 - protein, 45 aa, Entamoeba dispar
KCNKEMVWWMIMIIIIIILIIIIIIIIIIITMINYIIKLKEKKEQ

SEQ ID NO: 2398528 - protein, 24 aa, Entamoeba dispar
KCNYQLWRLITPIFLHGGIIHLIC

SEQ ID NO: 2398529 - protein, 17 aa, Entamoeba dispar
KCPECMVALLIAPVLSA

SEQ ID NO: 2398530 - protein, 17 aa, Entamoeba dispar
KCQYNNFLYQSYCYECS

SEQ ID NO: 2398531 - protein, 18 aa, Entamoeba dispar
KCSFNKLKKKMPTILNEL

SEQ ID NO: 2398532 - protein, 20 aa, Entamoeba dispar
KCVLAYCDLGYKFDYINNNC

SEQ ID NO: 2398533 - protein, 34 aa, Entamoeba dispar
KCYSLFCQLNLNYLPLIPLILNKIQQLYDYTKTQ

SEQ ID NO: 2398534 - protein, 24 aa, Entamoeba dispar
KDENFYYIFINVKEYKVVTVSLTI

SEQ ID NO: 2398535 - protein, 26 aa, Entamoeba dispar
KDIEKWIEKTLYWYKNKEKKGAEEWK

SEQ ID NO: 2398536 - protein, 23 aa, Entamoeba dispar
KDIIEFLCYKGFRDILPILITCF

SEQ ID NO: 2398537 - protein, 21 aa, Entamoeba dispar
KDIIYSMFLAIQILSEEYESN

SEQ ID NO: 2398538 - protein, 21 aa, Entamoeba dispar
KDIPVIIFFGIYASSDTDYFI

SEQ ID NO: 2398539 - protein, 17 aa, Entamoeba dispar
KDKINIVYFVVLTIFAL

SEQ ID NO: 2398540 - protein, 28 aa, Entamoeba dispar
KDKIYIRAILFFLLSVTFLIISILLVFI

SEQ ID NO: 2398541 - protein, 29 aa, Entamoeba dispar
KDKKKIEDIKLIELIKQPTPYINENKKET

SEQ ID NO: 2398542 - protein, 17 aa, Entamoeba dispar
KDKWRLIYTFFDEKKHE

SEQ ID NO: 2398543 - protein, 21 aa, Entamoeba dispar
KDLFNFITSSLFWNIIKKGLS

SEQ ID NO: 2398544 - protein, 18 aa, Entamoeba dispar
KDLVFKEKRKTCLYLEFV

SEQ ID NO: 2398545 - protein, 34 aa, Entamoeba dispar
KDMKSFEILLPTFIQILLLMFPNTAPEITNKLKV

SEQ ID NO: 2398546 - protein, 22 aa, Entamoeba dispar
KDNYVLFFVHTHLEFCIYKYQL

SEQ ID NO: 2398547 - protein, 21 aa, Entamoeba dispar
KDPMHFTFHSGDYTKYEIMCR

SEQ ID NO: 2398548 - protein, 30 aa, Entamoeba dispar
KDPNDVAIIYILLGRIPALAALYRLNKEMK

SEQ ID NO: 2398549 - protein, 45 aa, Entamoeba dispar
KDTIIYLSSIIIFYIFFWIALLIIHYFIYIKLNKIIMKELNEQEM

SEQ ID NO: 2398550 - protein, 25 aa, Entamoeba dispar
KDTPLLLVVGQWLTALFSINFDKSV

SEQ ID NO: 2398551 - protein, 28 aa, Entamoeba dispar
KDVGWEDYFFPLPDYVTSYSFLIEPTQE

SEQ ID NO: 2398552 - protein, 22 aa, Entamoeba dispar
KDVKIIFHHQSTLGYTKIHPST

SEQ ID NO: 2398553 - protein, 25 aa, Entamoeba dispar
KDVKTYKLFFSKKKLCFPDNGKWWN

SEQ ID NO: 2398554 - protein, 17 aa, Entamoeba dispar
KDWLIIVCRMLMIILVL

SEQ ID NO: 2398555 - protein, 28 aa, Entamoeba dispar
KDYSFSITIPPAPTRTFYRSCLYDSLAP

SEQ ID NO: 2398556 - protein, 18 aa, Entamoeba dispar
KEAKITFLPTFKIKIGNG

SEQ ID NO: 2398557 - protein, 17 aa, Entamoeba dispar
KECIQCEKGYYLNSNKE

SEQ ID NO: 2398558 - protein, 45 aa, Entamoeba dispar
KECKSSPVWWVIVLAIIGGIMFFILFIVFVIFIVRKTIKRLHIKQ

SEQ ID NO: 2398559 - protein, 24 aa, Entamoeba dispar
KEDLIHSINIFEEILTALKISILS

SEQ ID NO: 2398560 - protein, 24 aa, Entamoeba dispar
KEDNRPCHYIYSSLLNYDEFVTDI

SEQ ID NO: 2398561 - protein, 21 aa, Entamoeba dispar
KEDSPKTLILFVIRDRDQKKP

SEQ ID NO: 2398562 - protein, 23 aa, Entamoeba dispar
KEDVINIYCILDWFIENDQQKKK

SEQ ID NO: 2398563 - protein, 26 aa, Entamoeba dispar
KEDWFDWFRQIAMVFLKESPSQSLCY

SEQ ID NO: 2398564 - protein, 22 aa, Entamoeba dispar
KEEGISFPMFFVDSQPDEGEDN

SEQ ID NO: 2398565 - protein, 27 aa, Entamoeba dispar
KEEKQIVVNYLYWKKFIQTHYPEVSDF

SEQ ID NO: 2398566 - protein, 25 aa, Entamoeba dispar
KEERKDCYSLFYNGTSLTFLSLCLL

SEQ ID NO: 2398567 - protein, 25 aa, Entamoeba dispar
KEGHKLIINSFFDTVLYNEGTVIFK

SEQ ID NO: 2398568 - protein, 24 aa, Entamoeba dispar
KEGKLLVVPVTYFINPTPSIDQRG

SEQ ID NO: 2398569 - protein, 19 aa, Entamoeba dispar
KEHYKLPSDIYSFAITMYE

SEQ ID NO: 2398570 - protein, 23 aa, Entamoeba dispar
KEHYQVIQLFIYALKNPYQLEQN

SEQ ID NO: 2398571 - protein, 20 aa, Entamoeba dispar
KEIIINCPFINDYKYQVKTY

SEQ ID NO: 2398572 - protein, 19 aa, Entamoeba dispar
KEIPEEFLTLLYQGSEVHP

SEQ ID NO: 2398573 - protein, 31 aa, Entamoeba dispar
KEIVYGLFNTKLIFFIVKVLLRCDSLDKELK

SEQ ID NO: 2398574 - protein, 20 aa, Entamoeba dispar
KEIYRLFGELPKDITGLCAL

SEQ ID NO: 2398575 - protein, 21 aa, Entamoeba dispar
KEKEFPITLLMKLSSFSFGSF

SEQ ID NO: 2398576 - protein, 23 aa, Entamoeba dispar
KEKKSPLFLLLKSMPKYLQMIVG

SEQ ID NO: 2398577 - protein, 24 aa, Entamoeba dispar
KEKRKNILKAIGLGGLAVGATVAT

SEQ ID NO: 2398578 - protein, 36 aa, Entamoeba dispar
KEKYPILQWGLRSILFILYLFALLIYFFSNLVHQYS

SEQ ID NO: 2398579 - protein, 17 aa, Entamoeba dispar
KELFQFLQNEKNKRINE

SEQ ID NO: 2398580 - protein, 24 aa, Entamoeba dispar
KELFVQFLIDNDFICFLCIAIENK

SEQ ID NO: 2398581 - protein, 31 aa, Entamoeba dispar
KELIKNTKYLKLFEIKKINLFPRIINYQQQK

SEQ ID NO: 2398582 - protein, 27 aa, Entamoeba dispar
KELLTTFITLIYPQLSVTSPTLLAALH

SEQ ID NO: 2398583 - protein, 22 aa, Entamoeba dispar
KELWEMFRFHRIVWEWKTYHFI

SEQ ID NO: 2398584 - protein, 17 aa, Entamoeba dispar
KEMTLFKHLNRTHTKIG

SEQ ID NO: 2398585 - protein, 18 aa, Entamoeba dispar
KEMVLAKYFIKYVGNCLR

SEQ ID NO: 2398586 - protein, 26 aa, Entamoeba dispar
KENELAELFLIIERIMALSKEGLMIH

SEQ ID NO: 2398587 - protein, 41 aa, Entamoeba dispar
KENIFLSFIHRYFNKSYLGLIIIITFLILMTVWGSLQTSIE

SEQ ID NO: 2398588 - protein, 17 aa, Entamoeba dispar
KENVIEHKLLYPNQFVF

SEQ ID NO: 2398589 - protein, 26 aa, Entamoeba dispar
KEPPNDFLRIYPKPLFISIHHPNTAV

SEQ ID NO: 2398590 - protein, 27 aa, Entamoeba dispar
KEQNDKFLLRIQPPLVALDGGYACEFE

SEQ ID NO: 2398591 - protein, 28 aa, Entamoeba dispar
KERIAEYFIPFLFDFIDNFERITEIWTK

SEQ ID NO: 2398592 - protein, 23 aa, Entamoeba dispar
KESIKLLDKLIPPIMMVERKVSR

SEQ ID NO: 2398593 - protein, 28 aa, Entamoeba dispar
KESKNHLILLIKKILTDLGYFGDPELIL

SEQ ID NO: 2398594 - protein, 24 aa, Entamoeba dispar
KESNEYIFPTYDATFPITMADING

SEQ ID NO: 2398595 - protein, 28 aa, Entamoeba dispar
KESTLKEIIVFLIKEFQHLFPENVSDIT

SEQ ID NO: 2398596 - protein, 26 aa, Entamoeba dispar
KETIPFWLCALISYVPPFLLILLFSF

SEQ ID NO: 2398597 - protein, 25 aa, Entamoeba dispar
KETIPLRTFRLTQVDRFLTGAYPFY

SEQ ID NO: 2398598 - protein, 24 aa, Entamoeba dispar
KETKLIMCYPNELRKWLINEAKKN

SEQ ID NO: 2398599 - protein, 32 aa, Entamoeba dispar
KETNPLIIILKQYELLLPLYFDYHFTVTKTMK

SEQ ID NO: 2398600 - protein, 20 aa, Entamoeba dispar
KETYFLPQYNKEIPADGLSC

SEQ ID NO: 2398601 - protein, 21 aa, Entamoeba dispar
KEVIPLLLQQLSYYSELLLTT

SEQ ID NO: 2398602 - protein, 20 aa, Entamoeba dispar
KEVKFIIHPVAGRLPGHMNV

SEQ ID NO: 2398603 - protein, 23 aa, Entamoeba dispar
KEVLLLSFSLFKQTFKTKPFDIT

SEQ ID NO: 2398604 - protein, 20 aa, Entamoeba dispar
KEWEHFLSLLKGKDDIIKLA

SEQ ID NO: 2398605 - protein, 20 aa, Entamoeba dispar
KEWMRICHELLDAFKAHKKS

SEQ ID NO: 2398606 - protein, 28 aa, Entamoeba dispar
KEYPQKPFTLFLIKRPAIVNLQNIVKRQ

SEQ ID NO: 2398607 - protein, 20 aa, Entamoeba dispar
KEYYLALSTLLQNVAYQGLS

SEQ ID NO: 2398608 - protein, 20 aa, Entamoeba dispar
KFDDFFVNIVFTFTPDCADY

SEQ ID NO: 2398609 - protein, 23 aa, Entamoeba dispar
KFDFFELFFDHIFNLQFSQDLFI

SEQ ID NO: 2398610 - protein, 17 aa, Entamoeba dispar
KFDFRLNGRMKITTLII

SEQ ID NO: 2398611 - protein, 18 aa, Entamoeba dispar
KFEYTGEHQTFNYPILIA

SEQ ID NO: 2398612 - protein, 33 aa, Entamoeba dispar
KFGKILLWLSIGVYLFYILAIYLTNKLSKEIII

SEQ ID NO: 2398613 - protein, 17 aa, Entamoeba dispar
KFGPKRALQLMLILLFF

SEQ ID NO: 2398614 - protein, 19 aa, Entamoeba dispar
KFGRRRIFLVVGAIIDVLG

SEQ ID NO: 2398615 - protein, 40 aa, Entamoeba dispar
KFGYAYLIDSVISFILSISWSSVLYLIQDLGLFKNLLPKP

SEQ ID NO: 2398616 - protein, 28 aa, Entamoeba dispar
KFIDKQYITLFIEYGGVLKLFDSIAQSE

SEQ ID NO: 2398617 - protein, 27 aa, Entamoeba dispar
KFIISDSYVLVPLRLLMKSFGLKRVYE

SEQ ID NO: 2398618 - protein, 53 aa, Entamoeba dispar
KFINKYFINYTVFELIFLWFIISTSNFRKVLFGILFLLHYLCLKKIVTIHFTF

SEQ ID NO: 2398619 - protein, 23 aa, Entamoeba dispar
KFISYFIFMVFTLIFCTILVVII

SEQ ID NO: 2398620 - protein, 26 aa, Entamoeba dispar
KFITTFNPLIIEPLEFANYVLTVIIS

SEQ ID NO: 2398621 - protein, 18 aa, Entamoeba dispar
KFKMIQQLMFYYLLQELV

SEQ ID NO: 2398622 - protein, 17 aa, Entamoeba dispar
KFLFIKYVKKNRIPPSQ

SEQ ID NO: 2398623 - protein, 24 aa, Entamoeba dispar
KFLPPILVYFFSSAVVHFLIASLC

SEQ ID NO: 2398624 - protein, 19 aa, Entamoeba dispar
KFLTNVIIARGCDTLHIVI

SEQ ID NO: 2398625 - protein, 25 aa, Entamoeba dispar
KFNIKFIIWAWIKYSFYILQTFLIG

SEQ ID NO: 2398626 - protein, 20 aa, Entamoeba dispar
KFPINIYQIIDGEDKRMKIK

SEQ ID NO: 2398627 - protein, 19 aa, Entamoeba dispar
KFQLFTREYEIGETVIAAV

SEQ ID NO: 2398628 - protein, 19 aa, Entamoeba dispar
KFRCDYIINFFGACCLKDH

SEQ ID NO: 2398629 - protein, 24 aa, Entamoeba dispar
KFRSEYIIHFYGAVFIPNKICMIT

SEQ ID NO: 2398630 - protein, 24 aa, Entamoeba dispar
KFRSEYIIHFYGAVFIPNKICMVT

SEQ ID NO: 2398631 - protein, 25 aa, Entamoeba dispar
KFRSEYIIHFYGAVMVPNKYCMVTE

SEQ ID NO: 2398632 - protein, 24 aa, Entamoeba dispar
KFRSEYIVHFYGAVFIPTKICMVT

SEQ ID NO: 2398633 - protein, 26 aa, Entamoeba dispar
KFTINGLVFLLLLYTNGRIKFKLINE

SEQ ID NO: 2398634 - protein, 25 aa, Entamoeba dispar
KFVFIFYSCIIVGIYLFIFRTFIFK

SEQ ID NO: 2398635 - protein, 17 aa, Entamoeba dispar
KFYNHLLSNLDLFSELL

SEQ ID NO: 2398636 - protein, 21 aa, Entamoeba dispar
KGCILLCEVALGRQWETQEDK

SEQ ID NO: 2398637 - protein, 19 aa, Entamoeba dispar
KGCTLCESSYYLENLTCHL

SEQ ID NO: 2398638 - protein, 41 aa, Entamoeba dispar
KGDKIFNFLFKYIHKLRFVIVIFWILAVIGFAYPALKFLGA

SEQ ID NO: 2398639 - protein, 28 aa, Entamoeba dispar
KGDNQTLTDFYLFFSIVAEQQPIDLSKV

SEQ ID NO: 2398640 - protein, 33 aa, Entamoeba dispar
KGDVIGFFSKRRLEWHYLFLACGYTGIVLVTLY

SEQ ID NO: 2398641 - protein, 25 aa, Entamoeba dispar
KGFACEFHIFIKPLCTCRIKDQLNL

SEQ ID NO: 2398642 - protein, 20 aa, Entamoeba dispar
KGFALWLTTKPIVSGNNFGG

SEQ ID NO: 2398643 - protein, 19 aa, Entamoeba dispar
KGGFILKNSWNDTIYGNYP

SEQ ID NO: 2398644 - protein, 25 aa, Entamoeba dispar
KGGIFNIWFNTWFIHDNKLEFSKME

SEQ ID NO: 2398645 - protein, 32 aa, Entamoeba dispar
KGHGRRKYILKMLYIYILGYDVDFGIPIITEL

SEQ ID NO: 2398646 - protein, 25 aa, Entamoeba dispar
KGITLFVWVLTFIQSFLLFMTYPFY

SEQ ID NO: 2398647 - protein, 26 aa, Entamoeba dispar
KGIVGLTRALLILDYMLRYHNDFSAD

SEQ ID NO: 2398648 - protein, 42 aa, Entamoeba dispar
KGIYLHVGIGLLCGLIVIILIVTIIGIILYRRIKRIDIRIFK

SEQ ID NO: 2398649 - protein, 28 aa, Entamoeba dispar
KGKAVEFEIFIKPLCTCSLNESILLVAL

SEQ ID NO: 2398650 - protein, 34 aa, Entamoeba dispar
KGLKHRIYGLRSFVLGLLFYLVPCFEMYIYVNSS

SEQ ID NO: 2398651 - protein, 24 aa, Entamoeba dispar
KGNKYNIDWSFIGSAPLCGINSVE

SEQ ID NO: 2398652 - protein, 23 aa, Entamoeba dispar
KGNYEIQLLIIKATEFIIYVEKK

SEQ ID NO: 2398653 - protein, 21 aa, Entamoeba dispar
KGQWFFVEGANLNIKFDTCSS

SEQ ID NO: 2398654 - protein, 30 aa, Entamoeba dispar
KGSIFTIHNPWIFPLIEILKEIYKLNLSGL

SEQ ID NO: 2398655 - protein, 20 aa, Entamoeba dispar
KGSLRCGVLYLSNTTKIIGF

SEQ ID NO: 2398656 - protein, 26 aa, Entamoeba dispar
KGSPFMQTIVKLLRLLHTMNNNGCMM

SEQ ID NO: 2398657 - protein, 28 aa, Entamoeba dispar
KGTLIHVVAFYLFLLGILSAIIGVSMDI

SEQ ID NO: 2398658 - protein, 23 aa, Entamoeba dispar
KGVPMNYRRDLWKKLLEIDNIEE

SEQ ID NO: 2398659 - protein, 22 aa, Entamoeba dispar
KGWKKIMALIVMILGILIGIVG

SEQ ID NO: 2398660 - protein, 23 aa, Entamoeba dispar
KGWQTICQYGYADPYGGCEKCNG

SEQ ID NO: 2398661 - protein, 21 aa, Entamoeba dispar
KGYLWVLVIGIIEGIVFLGYS

SEQ ID NO: 2398662 - protein, 30 aa, Entamoeba dispar
KHCIFPIKDGKFFFLSPLQMTPKPYNQDPS

SEQ ID NO: 2398663 - protein, 21 aa, Entamoeba dispar
KHCYINHQIQIFVNGVIHEFN

SEQ ID NO: 2398664 - protein, 25 aa, Entamoeba dispar
KHFRIVAVLLKYWLKTRNLNCPFKG

SEQ ID NO: 2398665 - protein, 23 aa, Entamoeba dispar
KHGFLLDFPKLRNEPRLLTSIQS

SEQ ID NO: 2398666 - protein, 25 aa, Entamoeba dispar
KHGPFALIEKGLPVILIILDDEHAN

SEQ ID NO: 2398667 - protein, 17 aa, Entamoeba dispar
KHKYLIIYDSEKKSFLN

SEQ ID NO: 2398668 - protein, 25 aa, Entamoeba dispar
KHLQSLKILVLYFKKINQESIDLIV

SEQ ID NO: 2398669 - protein, 31 aa, Entamoeba dispar
KHMDIFIFPIAIIIFLYVIRNIVLVVIPICN

SEQ ID NO: 2398670 - protein, 18 aa, Entamoeba dispar
KHQPFVLMDIFFDILPYV

SEQ ID NO: 2398671 - protein, 22 aa, Entamoeba dispar
KHSDIVIPIKLHLFTQLDCSLD

SEQ ID NO: 2398672 - protein, 25 aa, Entamoeba dispar
KHSNRFVLFRVIWNNYRHEYIFCTL

SEQ ID NO: 2398673 - protein, 20 aa, Entamoeba dispar
KHVLNNFQEFLYSGIGLTDE

SEQ ID NO: 2398674 - protein, 27 aa, Entamoeba dispar
KHVWPSLLFMVLITFLLSVVIDNIPVV

SEQ ID NO: 2398675 - protein, 23 aa, Entamoeba dispar
KHWMIKILFVVVLDIIIYGLILQ

SEQ ID NO: 2398676 - protein, 31 aa, Entamoeba dispar
KIAIYFVQPFLKSYLFWTSQTLLYCGLTYTI

SEQ ID NO: 2398677 - protein, 23 aa, Entamoeba dispar
KICGKIMTPIDFIWAYHSEAKES

SEQ ID NO: 2398678 - protein, 20 aa, Entamoeba dispar
KICYYLLFIFVSIGRILFHV

SEQ ID NO: 2398679 - protein, 19 aa, Entamoeba dispar
KIDFYLDEFKVKLPLNLND

SEQ ID NO: 2398680 - protein, 23 aa, Entamoeba dispar
KIDKMYFVYFLKFGIAIGIHLSI

SEQ ID NO: 2398681 - protein, 23 aa, Entamoeba dispar
KIDQYLYTVRFIPVLFRDTKQNV

SEQ ID NO: 2398682 - protein, 23 aa, Entamoeba dispar
KIDVIDIFTSLPTRITFDNPVSI

SEQ ID NO: 2398683 - protein, 17 aa, Entamoeba dispar
KIFWLNIVGAILAAISV

SEQ ID NO: 2398684 - protein, 17 aa, Entamoeba dispar
KIHMDNESILTISGFLF

SEQ ID NO: 2398685 - protein, 22 aa, Entamoeba dispar
KIHYLFICVYIIVSLVVVYGLQ

SEQ ID NO: 2398686 - protein, 28 aa, Entamoeba dispar
KIIAIITLIIIIIFINTIVHSQIITTII

SEQ ID NO: 2398687 - protein, 25 aa, Entamoeba dispar
KIIEIIHLLQWPYWSSIKCLEMKNK

SEQ ID NO: 2398688 - protein, 21 aa, Entamoeba dispar
KIIGPWYVRRKKIQDALQAEN

SEQ ID NO: 2398689 - protein, 25 aa, Entamoeba dispar
KIIIDLINYFFFKGSLDAMVLTTKM

SEQ ID NO: 2398690 - protein, 33 aa, Entamoeba dispar
KIINKIFIHKKFYYLIILYEFINEKNILQIINE

SEQ ID NO: 2398691 - protein, 20 aa, Entamoeba dispar
KIIQLFISLKNIIQSNIIIT

SEQ ID NO: 2398692 - protein, 29 aa, Entamoeba dispar
KIIRVILPIYAIIFLCVLIVRYVIQMDVI

SEQ ID NO: 2398693 - protein, 32 aa, Entamoeba dispar
KIISQFIIGLFVLLLLLIFDKTLIEQPSFTLT

SEQ ID NO: 2398694 - protein, 26 aa, Entamoeba dispar
KIIVQLRYSSPIYKLSFRNIETNIEL

SEQ ID NO: 2398695 - protein, 17 aa, Entamoeba dispar
KIKCWEYFIEFISDVFP

SEQ ID NO: 2398696 - protein, 21 aa, Entamoeba dispar
KIKGVLLIYKYAEIDPNGSKE

SEQ ID NO: 2398697 - protein, 18 aa, Entamoeba dispar
KILDDLAIALQFLHQNQI

SEQ ID NO: 2398698 - protein, 30 aa, Entamoeba dispar
KILHETLILLNILFKNPIIFSSISIPLLPL

SEQ ID NO: 2398699 - protein, 20 aa, Entamoeba dispar
KILTELLRFLPVSDLTIREE

SEQ ID NO: 2398700 - protein, 26 aa, Entamoeba dispar
KILTMKEWFWELINLGWNQNPKERIT

SEQ ID NO: 2398701 - protein, 21 aa, Entamoeba dispar
KIMFNLTFPFVILKALINTHS

SEQ ID NO: 2398702 - protein, 20 aa, Entamoeba dispar
KIMGMKIPYTIYFSKKKEIL

SEQ ID NO: 2398703 - protein, 22 aa, Entamoeba dispar
KIMIDNDIIISSLILDGKNSRI

SEQ ID NO: 2398704 - protein, 20 aa, Entamoeba dispar
KINIVYFVVLTIFALRELMV

SEQ ID NO: 2398705 - protein, 24 aa, Entamoeba dispar
KINPKALFYFSINTKIIVLTIDDA

SEQ ID NO: 2398706 - protein, 18 aa, Entamoeba dispar
KINQIIRCLYGIKSIQFQ

SEQ ID NO: 2398707 - protein, 17 aa, Entamoeba dispar
KINTFFIVSFDPKDAYV

SEQ ID NO: 2398708 - protein, 24 aa, Entamoeba dispar
KINYDFMLDIIKLLQQLLENKADK

SEQ ID NO: 2398709 - protein, 17 aa, Entamoeba dispar
KIPLLNENYLTEITTDF

SEQ ID NO: 2398710 - protein, 21 aa, Entamoeba dispar
KIPYLKELGISIVWLNPIYST

SEQ ID NO: 2398711 - protein, 24 aa, Entamoeba dispar
KIQKYFMFFLIYTNDFLLILSVLS

SEQ ID NO: 2398712 - protein, 17 aa, Entamoeba dispar
KIRIKFMLDGAKGISYL

SEQ ID NO: 2398713 - protein, 21 aa, Entamoeba dispar
KIRPSLVYIPTRLPTTVIGDI

SEQ ID NO: 2398714 - protein, 19 aa, Entamoeba dispar
KIRYSYALIFLIGCIFFVA

SEQ ID NO: 2398715 - protein, 23 aa, Entamoeba dispar
KITEFPYFTPVLNVSLFTRKQDF

SEQ ID NO: 2398716 - protein, 35 aa, Entamoeba dispar
KITFTGHYANLFLRFIRRLLTSRGNYIFKENISFG

SEQ ID NO: 2398717 - protein, 20 aa, Entamoeba dispar
KITGNMNIIINKEAIIEKEH

SEQ ID NO: 2398718 - protein, 18 aa, Entamoeba dispar
KITIFKRFPALLPQLCVA

SEQ ID NO: 2398719 - protein, 17 aa, Entamoeba dispar
KIVIIGLFLFSFSLFFL

SEQ ID NO: 2398720 - protein, 20 aa, Entamoeba dispar
KIYYFSFRVTSASRFVGIPI

SEQ ID NO: 2398721 - protein, 22 aa, Entamoeba dispar
KKAFLVGFPDNVAIRQPDNTYL

SEQ ID NO: 2398722 - protein, 24 aa, Entamoeba dispar
KKALVTMQFLPIESLIFSNEDSIS

SEQ ID NO: 2398723 - protein, 18 aa, Entamoeba dispar
KKCFIIYSFIISYNLIKL

SEQ ID NO: 2398724 - protein, 20 aa, Entamoeba dispar
KKCLSCVDLYYMKASGCYSG

SEQ ID NO: 2398725 - protein, 31 aa, Entamoeba dispar
KKDSRYFIAFRWFMVQLLINVKSYLAYSWIF

SEQ ID NO: 2398726 - protein, 21 aa, Entamoeba dispar
KKDYYIFVSYQTSSFAMINFS

SEQ ID NO: 2398727 - protein, 32 aa, Entamoeba dispar
KKEAYSFLLILIPSKIISSIILCIFNQSINIC

SEQ ID NO: 2398728 - protein, 34 aa, Entamoeba dispar
KKEFFKEEMIILLTILLKIIPINNIIEIFIFHEK

SEQ ID NO: 2398729 - protein, 31 aa, Entamoeba dispar
KKEKNINIRLFMKIKILIDAAKGIQYLHSNG

SEQ ID NO: 2398730 - protein, 42 aa, Entamoeba dispar
KKEQPDIIPMIIIYTLIPIIILLGCGIIFFLSCWVDKKENKK

SEQ ID NO: 2398731 - protein, 24 aa, Entamoeba dispar
KKEYESIFYLQSYTLIQCLDEFTL

SEQ ID NO: 2398732 - protein, 19 aa, Entamoeba dispar
KKEYIANLCQVFVVLEVYK

SEQ ID NO: 2398733 - protein, 26 aa, Entamoeba dispar
KKFDFNMLFLIIYSVSVFYFSCVMSR

SEQ ID NO: 2398734 - protein, 25 aa, Entamoeba dispar
KKFFGYFNLISYTIPISVGVTIEVC

SEQ ID NO: 2398735 - protein, 38 aa, Entamoeba dispar
KKFKISFSIIFTTLILFLIFVCIIIGILFIIQPDYTCS

SEQ ID NO: 2398736 - protein, 28 aa, Entamoeba dispar
KKGEACEFEIFIIPLCTCTIEDDITIVG

SEQ ID NO: 2398737 - protein, 21 aa, Entamoeba dispar
KKHILFLLNYQALQPILNTIS

SEQ ID NO: 2398738 - protein, 29 aa, Entamoeba dispar
KKHPSIFNLIFFRRSFPQIIKGRKGSLNV

SEQ ID NO: 2398739 - protein, 17 aa, Entamoeba dispar
KKIFKTKLGFFDVTPLG

SEQ ID NO: 2398740 - protein, 28 aa, Entamoeba dispar
KKIINITELFIPIIFNSLSLQDNYIQTM

SEQ ID NO: 2398741 - protein, 25 aa, Entamoeba dispar
KKIISKVYVLGKRLILEGSNIKLSE

SEQ ID NO: 2398742 - protein, 30 aa, Entamoeba dispar
KKIKEDLILSFLLSGIILAPPYVVIYQNFV

SEQ ID NO: 2398743 - protein, 26 aa, Entamoeba dispar
KKILKKYILSIFKYHYIATTIFLFIM

SEQ ID NO: 2398744 - protein, 22 aa, Entamoeba dispar
KKILMIIMPYPFLGNWERKYII

SEQ ID NO: 2398745 - protein, 26 aa, Entamoeba dispar
KKKESIPKLSIRLRFLLDAAKGIQYL

SEQ ID NO: 2398746 - protein, 24 aa, Entamoeba dispar
KKKIQILQFCYFLVFVRLVICTLY

SEQ ID NO: 2398747 - protein, 21 aa, Entamoeba dispar
KKLEPFACELLALTAHHVEQL

SEQ ID NO: 2398748 - protein, 32 aa, Entamoeba dispar
KKLFGTTGMSHLLVLVIGGIGILVVIYVLAFK

SEQ ID NO: 2398749 - protein, 20 aa, Entamoeba dispar
KKLLPQVNPVYPLFGQIHRE

SEQ ID NO: 2398750 - protein, 24 aa, Entamoeba dispar
KKMCIAIEFAPNGSLGHILKKIKL

SEQ ID NO: 2398751 - protein, 24 aa, Entamoeba dispar
KKMNIPMSYLKYYSDHVLSNGCPN

SEQ ID NO: 2398752 - protein, 19 aa, Entamoeba dispar
KKMYKIFFMYINEEEIEKE

SEQ ID NO: 2398753 - protein, 34 aa, Entamoeba dispar
KKNPSLIRAVIKREWWPFLLSLIAISISQIAMLM

SEQ ID NO: 2398754 - protein, 21 aa, Entamoeba dispar
KKPLGLIEGEWKWKPKRNYNW

SEQ ID NO: 2398755 - protein, 40 aa, Entamoeba dispar
KKQFKVKFYLKVVIGVSLFVSIFFLIMRTITIKKSYVCSK

SEQ ID NO: 2398756 - protein, 27 aa, Entamoeba dispar
KKQIQSIFIIIKPILIEALTDVGHDES

SEQ ID NO: 2398757 - protein, 18 aa, Entamoeba dispar
KKQSILAEMFLLNISRIR

SEQ ID NO: 2398758 - protein, 24 aa, Entamoeba dispar
KKRKLFFYVSLFLSISIYGSLAIM

SEQ ID NO: 2398759 - protein, 27 aa, Entamoeba dispar
KKSLCKRIIQFPSWFFKQFFRTDPNGA

SEQ ID NO: 2398760 - protein, 19 aa, Entamoeba dispar
KKSQIMIIRMNGVRFSNVV

SEQ ID NO: 2398761 - protein, 42 aa, Entamoeba dispar
KKSYLPLIISIFSGLFFIISLILIIVIWGYPIILPDPKQSNE

SEQ ID NO: 2398762 - protein, 27 aa, Entamoeba dispar
KKTGRLYVECFGKWIMYKLSSDSYINC

SEQ ID NO: 2398763 - protein, 32 aa, Entamoeba dispar
KKVCVRMYDNLLRLFIFAFQSLQQLQDFRDEL

SEQ ID NO: 2398764 - protein, 25 aa, Entamoeba dispar
KKVFSFYIIFISLFQFQLLNDYDQE

SEQ ID NO: 2398765 - protein, 22 aa, Entamoeba dispar
KKVLNFVIYTPAEGDKNIYFAM

SEQ ID NO: 2398766 - protein, 23 aa, Entamoeba dispar
KKVMKIFIHFIIKYMEENIKNKE

SEQ ID NO: 2398767 - protein, 20 aa, Entamoeba dispar
KKWLGFVYCGIILITQMIDS

SEQ ID NO: 2398768 - protein, 25 aa, Entamoeba dispar
KKYCLILNILLYNKYFNLNEYYLLF

SEQ ID NO: 2398769 - protein, 25 aa, Entamoeba dispar
KLAGYLMIFSIILAILLLVILSFIQ

SEQ ID NO: 2398770 - protein, 20 aa, Entamoeba dispar
KLAYLYIMNYAKTQQDNATR

SEQ ID NO: 2398771 - protein, 22 aa, Entamoeba dispar
KLDRKMIELMKKKELEQLVNDK

SEQ ID NO: 2398772 - protein, 21 aa, Entamoeba dispar
KLEHDVILTYILKVLAALLKE

SEQ ID NO: 2398773 - protein, 37 aa, Entamoeba dispar
KLEIIDCPMPFFIFEWHYLWYVHAFNFEISLRVFDFI

SEQ ID NO: 2398774 - protein, 40 aa, Entamoeba dispar
KLFFTVLEWAVLIATIVSIILIITSVISFVLIPPMGKTDM

SEQ ID NO: 2398775 - protein, 27 aa, Entamoeba dispar
KLFVGMLICLIFSEALALYGFIVALIM

SEQ ID NO: 2398776 - protein, 26 aa, Entamoeba dispar
KLGDVSLFYYLPNLFYLSNGTTIVLL

SEQ ID NO: 2398777 - protein, 32 aa, Entamoeba dispar
KLGMGCAIIVFTILCIYWVMDAINYKPILICD

SEQ ID NO: 2398778 - protein, 33 aa, Entamoeba dispar
KLHTISILKNSWFFYELIVKSLTLEMDLSGLLN

SEQ ID NO: 2398779 - protein, 24 aa, Entamoeba dispar
KLIDFVFFLLFIYLYFYYYLIILQ

SEQ ID NO: 2398780 - protein, 29 aa, Entamoeba dispar
KLIHQHLYLFVFFLIFGLHISLYFKISQQ

SEQ ID NO: 2398781 - protein, 18 aa, Entamoeba dispar
KLILLNPNKKVFSFYIIF

SEQ ID NO: 2398782 - protein, 33 aa, Entamoeba dispar
KLILLSFFTFIGLLFIATLFFDTTQPPPDIRMK

SEQ ID NO: 2398783 - protein, 21 aa, Entamoeba dispar
KLINSSFLTYKMISLSSNKLI

SEQ ID NO: 2398784 - protein, 18 aa, Entamoeba dispar
KLIPLRRLTIDSSQINTP

SEQ ID NO: 2398785 - protein, 19 aa, Entamoeba dispar
KLKIKFIIDGAKGIEYLHS

SEQ ID NO: 2398786 - protein, 32 aa, Entamoeba dispar
KLKKIIVKIIKFILIGSLIIMLIFNLNEHGIE

SEQ ID NO: 2398787 - protein, 24 aa, Entamoeba dispar
KLKRNFYTVLIHNFRLECPIKEKF

SEQ ID NO: 2398788 - protein, 21 aa, Entamoeba dispar
KLKRSTPIYSLYFRNIETNIE

SEQ ID NO: 2398789 - protein, 28 aa, Entamoeba dispar
KLLDKIRWRTLMELSTKWRQISEPNDPV

SEQ ID NO: 2398790 - protein, 17 aa, Entamoeba dispar
KLLFIRLLLYQLLFIFV

SEQ ID NO: 2398791 - protein, 17 aa, Entamoeba dispar
KLLIYDEQKIDKLNRYC

SEQ ID NO: 2398792 - protein, 18 aa, Entamoeba dispar
KLLKIQFSTKDQLDKYEI

SEQ ID NO: 2398793 - protein, 17 aa, Entamoeba dispar
KLLLDLHDLHMYFGFES

SEQ ID NO: 2398794 - protein, 19 aa, Entamoeba dispar
KLLSFRLNTLNDLIQRKVG

SEQ ID NO: 2398795 - protein, 18 aa, Entamoeba dispar
KLLWLCLCNVLSSSSSSS

SEQ ID NO: 2398796 - protein, 19 aa, Entamoeba dispar
KLMICIFCFIINGMYAFEL

SEQ ID NO: 2398797 - protein, 24 aa, Entamoeba dispar
KLMNFVLLIQPLILSILLTIQEFF

SEQ ID NO: 2398798 - protein, 36 aa, Entamoeba dispar
KLNFLHYCCSKSFIYLLPLILKKFPLLMNFQDGCGR

SEQ ID NO: 2398799 - protein, 24 aa, Entamoeba dispar
KLNMSSMDVVWLKGYESDHECPNI

SEQ ID NO: 2398800 - protein, 28 aa, Entamoeba dispar
KLNPEKRYFFFFTFHDDNLFINFNIKIV

SEQ ID NO: 2398801 - protein, 23 aa, Entamoeba dispar
KLNSFDYYKGITLTFMALTYYFA

SEQ ID NO: 2398802 - protein, 19 aa, Entamoeba dispar
KLNTLYSSSLIIPLEYTKN

SEQ ID NO: 2398803 - protein, 28 aa, Entamoeba dispar
KLPDAHIPWYRYLLFTIAMACCVVLCIL

SEQ ID NO: 2398804 - protein, 24 aa, Entamoeba dispar
KLPETLVFHLKRFGYNEQFQIVKY

SEQ ID NO: 2398805 - protein, 24 aa, Entamoeba dispar
KLQESVIPPILPETEEIPKMNALE

SEQ ID NO: 2398806 - protein, 28 aa, Entamoeba dispar
KLQNKEKFYIIFRSLLKCLVKNVLCQLN

SEQ ID NO: 2398807 - protein, 22 aa, Entamoeba dispar
KLRNPFIVNYIGSVTYIPEICM

SEQ ID NO: 2398808 - protein, 26 aa, Entamoeba dispar
KLSRDRSLVILKIRNFGTLNIGHPKF

SEQ ID NO: 2398809 - protein, 42 aa, Entamoeba dispar
KLSSIYQLWDWVLQSPKFAKFMFFLLAYILSCEPMILEYNDP

SEQ ID NO: 2398810 - protein, 29 aa, Entamoeba dispar
KLTNWFNKIFLILSIPFRFIMEFTTPHIS

SEQ ID NO: 2398811 - protein, 40 aa, Entamoeba dispar
KLTSKEWFIKGYIEDKFIEIIMPPMINGRFNGDGSVICDD

SEQ ID NO: 2398812 - protein, 20 aa, Entamoeba dispar
KLVIYFFLVNSVQFSIEFSY

SEQ ID NO: 2398813 - protein, 18 aa, Entamoeba dispar
KLWCLRKGNWEENYQRHI

SEQ ID NO: 2398814 - protein, 17 aa, Entamoeba dispar
KLWNMVPYIQQLVFLML

SEQ ID NO: 2398815 - protein, 30 aa, Entamoeba dispar
KLYCSKMPKWSIYPLTFIPGVVLYCFVWVV

SEQ ID NO: 2398816 - protein, 23 aa, Entamoeba dispar
KLYESYFIFVYLFGLSLFNNFIE

SEQ ID NO: 2398817 - protein, 20 aa, Entamoeba dispar
KLYEYSLKLFPYKSQFEDTS

SEQ ID NO: 2398818 - protein, 20 aa, Entamoeba dispar
KLYNMKFLISLLTPIIFICF

SEQ ID NO: 2398819 - protein, 27 aa, Entamoeba dispar
KMDTMPIYQWLIIKYEFIQYCTDIIIR

SEQ ID NO: 2398820 - protein, 18 aa, Entamoeba dispar
KMFMPSNSPIKIINAIKS

SEQ ID NO: 2398821 - protein, 22 aa, Entamoeba dispar
KMGVIGFVAWCLATIVYFVITW

SEQ ID NO: 2398822 - protein, 38 aa, Entamoeba dispar
KMKLVILQNRYVPWISLARIFYLSLMTLHPSKIYFSVK

SEQ ID NO: 2398823 - protein, 18 aa, Entamoeba dispar
KMKSFIFNSILITGKLKT

SEQ ID NO: 2398824 - protein, 20 aa, Entamoeba dispar
KMLDPLVLVLPGLIAFHLYQ

SEQ ID NO: 2398825 - protein, 24 aa, Entamoeba dispar
KMMAIQNILLLLIFLVLFGIFLKK

SEQ ID NO: 2398826 - protein, 18 aa, Entamoeba dispar
KMMALRKSAQSQSPDISV

SEQ ID NO: 2398827 - protein, 35 aa, Entamoeba dispar
KMMIRNLFGTLLSFFDITPLGRLLNYFSRDLRFVD

SEQ ID NO: 2398828 - protein, 19 aa, Entamoeba dispar
KMNCSIFYQIPIKSIQQSS

SEQ ID NO: 2398829 - protein, 21 aa, Entamoeba dispar
KMQTVILSPPFQQLVESPCHE

SEQ ID NO: 2398830 - protein, 25 aa, Entamoeba dispar
KMRSNQLILMHLFNEMFKRKNLVDP

SEQ ID NO: 2398831 - protein, 20 aa, Entamoeba dispar
KMYAIIFVVLAAISIVLIPI

SEQ ID NO: 2398832 - protein, 25 aa, Entamoeba dispar
KNALDLVYIMVKYNFIFSQNISRSM

SEQ ID NO: 2398833 - protein, 29 aa, Entamoeba dispar
KNATNMAFLYFVRYPLLEKIYENIIKNEE

SEQ ID NO: 2398834 - protein, 26 aa, Entamoeba dispar
KNCALIHLLRVILWAVRESPKSNFFC

SEQ ID NO: 2398835 - protein, 26 aa, Entamoeba dispar
KNCKYFLFFLLSMSISLLIVTYYCVV

SEQ ID NO: 2398836 - protein, 29 aa, Entamoeba dispar
KNDFELLFSFINFILPFAPHQISLSFFVW

SEQ ID NO: 2398837 - protein, 21 aa, Entamoeba dispar
KNDPYLLSYPLYTFNFNICGP

SEQ ID NO: 2398838 - protein, 30 aa, Entamoeba dispar
KNENRLRSIMIYILYLLVGISVITMVVAVI

SEQ ID NO: 2398839 - protein, 25 aa, Entamoeba dispar
KNFANNLIFIFAKTNFIVTGNTVAT

SEQ ID NO: 2398840 - protein, 21 aa, Entamoeba dispar
KNFFHSQLFWGIISMIICGYW

SEQ ID NO: 2398841 - protein, 20 aa, Entamoeba dispar
KNFILLKRSMLIFNKRRKEY

SEQ ID NO: 2398842 - protein, 25 aa, Entamoeba dispar
KNFSNNLIFIFAKTNFIVTGNTVAT

SEQ ID NO: 2398843 - protein, 17 aa, Entamoeba dispar
KNGFVLTQWHKMKILLT

SEQ ID NO: 2398844 - protein, 19 aa, Entamoeba dispar
KNGIKVYYLPLLRMFNECC

SEQ ID NO: 2398845 - protein, 18 aa, Entamoeba dispar
KNGKYKLAMKTLDRLAGI

SEQ ID NO: 2398846 - protein, 20 aa, Entamoeba dispar
KNGMLFFKDNITTGLKFVNE

SEQ ID NO: 2398847 - protein, 26 aa, Entamoeba dispar
KNHFKILSIFNPFSIISSLLITKNEV

SEQ ID NO: 2398848 - protein, 18 aa, Entamoeba dispar
KNIFKEVMLLSSSVICCR

SEQ ID NO: 2398849 - protein, 20 aa, Entamoeba dispar
KNIKFWIGRIMFFCAFMLVI

SEQ ID NO: 2398850 - protein, 18 aa, Entamoeba dispar
KNIKIPYTIWLSKCKKSL

SEQ ID NO: 2398851 - protein, 26 aa, Entamoeba dispar
KNIKTFISNFLIDTALELGFTFDSKM

SEQ ID NO: 2398852 - protein, 23 aa, Entamoeba dispar
KNINKFYTFLTFEISSGLSTKLD

SEQ ID NO: 2398853 - protein, 24 aa, Entamoeba dispar
KNIYFAMKGKVIPTLFYTTNLTET

SEQ ID NO: 2398854 - protein, 27 aa, Entamoeba dispar
KNKIDKMLFFNFSFGPAIVTLFASIFL

SEQ ID NO: 2398855 - protein, 35 aa, Entamoeba dispar
KNKKNKFYMMKLDKVPPALAFLTTWQQGGPKLHID

SEQ ID NO: 2398856 - protein, 32 aa, Entamoeba dispar
KNKKVFMQNLLIDILLEFGFFFDSKMARHSQK

SEQ ID NO: 2398857 - protein, 38 aa, Entamoeba dispar
KNKSKVVVSSLIIAAGIFAIFVGIFISFTNTDDTGNTG

SEQ ID NO: 2398858 - protein, 24 aa, Entamoeba dispar
KNKTALFYLYIQKNPSFLKGNIER

SEQ ID NO: 2398859 - protein, 17 aa, Entamoeba dispar
KNLILLNKYHFTKYAWL

SEQ ID NO: 2398860 - protein, 17 aa, Entamoeba dispar
KNLPKTIIPKKVELIKK

SEQ ID NO: 2398861 - protein, 36 aa, Entamoeba dispar
KNLQLIGWIMICVIIGILLIVIAGIYLFYRYRHEKK

SEQ ID NO: 2398862 - protein, 17 aa, Entamoeba dispar
KNLSNVYLLLFSEKHKY

SEQ ID NO: 2398863 - protein, 26 aa, Entamoeba dispar
KNNMKFFVQFIFYASLALLLASVING

SEQ ID NO: 2398864 - protein, 36 aa, Entamoeba dispar
KNNNQMKVIWNILNMNSELLFQLHPELLNNEKTHGE

SEQ ID NO: 2398865 - protein, 22 aa, Entamoeba dispar
KNPKNALPLFKLKLLQTNNPEV

SEQ ID NO: 2398866 - protein, 22 aa, Entamoeba dispar
KNPPEVYFFTPNGRFAINTKIC

SEQ ID NO: 2398867 - protein, 34 aa, Entamoeba dispar
KNQFAFSCFVFIVIIIMFIFVMSYALLSVNVPSN

SEQ ID NO: 2398868 - protein, 36 aa, Entamoeba dispar
KNQKNEPVFFLLPDQSICYLLLQKIGVVEQLLNAQL

SEQ ID NO: 2398869 - protein, 46 aa, Entamoeba dispar
KNQSKNWYGFIIPLVLVLFLGVIFYKWIYPLLYKLISSLLKSRFSI

SEQ ID NO: 2398870 - protein, 24 aa, Entamoeba dispar
KNRDSFLIIFQALMKIDLKTTFLR

SEQ ID NO: 2398871 - protein, 44 aa, Entamoeba dispar
KNRTPDPIIIPFWKIWFEALQDKTLIILIIAAIISLILAFVVPN

SEQ ID NO: 2398872 - protein, 44 aa, Entamoeba dispar
KNRTPDPVLIPFWKIWFEALQDKTLIILILAAVVSLILAFVVPN

SEQ ID NO: 2398873 - protein, 31 aa, Entamoeba dispar
KNSFYKVIIWIIYTIILVTIAFLWTKFISPT

SEQ ID NO: 2398874 - protein, 24 aa, Entamoeba dispar
KNSMNLFFVIHFFFGYLIINLNLV

SEQ ID NO: 2398875 - protein, 18 aa, Entamoeba dispar
KNSPLLMKVLFNLALPCV

SEQ ID NO: 2398876 - protein, 49 aa, Entamoeba dispar
KNTEFPKWTIGVIVIFVIALIVIVVVIIVYAVYVYLQRQRNLKVFSEGE

SEQ ID NO: 2398877 - protein, 26 aa, Entamoeba dispar
KNTQKTTFFTFASKMLAYPTLNDHEK

SEQ ID NO: 2398878 - protein, 28 aa, Entamoeba dispar
KNTVQTFFRYFGLLSYLIPISCAVSLEV

SEQ ID NO: 2398879 - protein, 20 aa, Entamoeba dispar
KNVIFPPPEVFFICDNCTDS

SEQ ID NO: 2398880 - protein, 25 aa, Entamoeba dispar
KNVQLKFLLEYVLENSIISISRSIE

SEQ ID NO: 2398881 - protein, 22 aa, Entamoeba dispar
KNWIKFLFRPIPPIYPLFKNIF

SEQ ID NO: 2398882 - protein, 28 aa, Entamoeba dispar
KNYLNLPKWLKWIYTISYYRITHNICFS

SEQ ID NO: 2398883 - protein, 25 aa, Entamoeba dispar
KNYNKEPYVVLPNKDFRFSTEFEYG

SEQ ID NO: 2398884 - protein, 26 aa, Entamoeba dispar
KNYPPIIMMWIFLLVLMVVIAFLPHQ

SEQ ID NO: 2398885 - protein, 27 aa, Entamoeba dispar
KNYPPIIMMWIFLLVLMVVIAFLPHQP

SEQ ID NO: 2398886 - protein, 18 aa, Entamoeba dispar
KNYSLKKLIQLGISQKDA

SEQ ID NO: 2398887 - protein, 48 aa, Entamoeba dispar
KNYTTSIIIISIIGGIFLIIIFIIIIIIIIILLRKRKIKQLKEIEEDE

SEQ ID NO: 2398888 - protein, 25 aa, Entamoeba dispar
KPACIYLRCKEVCEFKITINPGCTC

SEQ ID NO: 2398889 - protein, 19 aa, Entamoeba dispar
KPEWATIVDDTLYLGSQGL

SEQ ID NO: 2398890 - protein, 24 aa, Entamoeba dispar
KPKEPFLLMRNYILEYNLTGNDAH

SEQ ID NO: 2398891 - protein, 27 aa, Entamoeba dispar
KPKMCCLINVLIMPYCSFNIQQEFKCI

SEQ ID NO: 2398892 - protein, 33 aa, Entamoeba dispar
KPLFFNSLMFFAMALCTFPYLLLKYVFSDKMSK

SEQ ID NO: 2398893 - protein, 26 aa, Entamoeba dispar
KPNDSYLISLYEFIRTMIITYKEFIF

SEQ ID NO: 2398894 - protein, 29 aa, Entamoeba dispar
KPNSELTNFFYFLPFEINIDNDKKMYLIP

SEQ ID NO: 2398895 - protein, 29 aa, Entamoeba dispar
KPSNWEVYFKWGLIVVNVIILVVGVLLLL

SEQ ID NO: 2398896 - protein, 29 aa, Entamoeba dispar
KPTFSGIFKYLVFNTYLSIGGKFTLTILS

SEQ ID NO: 2398897 - protein, 26 aa, Entamoeba dispar
KPTWNTILKVIFYSLKKMFPMKEYFS

SEQ ID NO: 2398898 - protein, 23 aa, Entamoeba dispar
KPYGSNYFGGMFKLALTNTDGNN

SEQ ID NO: 2398899 - protein, 20 aa, Entamoeba dispar
KPYTYGVWFKLTSTINTFVS

SEQ ID NO: 2398900 - protein, 20 aa, Entamoeba dispar
KQCISCVSNLYYLNKDKMCE

SEQ ID NO: 2398901 - protein, 17 aa, Entamoeba dispar
KQDWPLFHSECGDGIVL

SEQ ID NO: 2398902 - protein, 19 aa, Entamoeba dispar
KQIISLHRLILTGTPIQNN

SEQ ID NO: 2398903 - protein, 21 aa, Entamoeba dispar
KQIMLMPYEKEVRQLVKSVIE

SEQ ID NO: 2398904 - protein, 24 aa, Entamoeba dispar
KQITLFTSELFRKIKLVEFFKSTS

SEQ ID NO: 2398905 - protein, 22 aa, Entamoeba dispar
KQKNFFIFYKELTNNKSMSIKE

SEQ ID NO: 2398906 - protein, 21 aa, Entamoeba dispar
KQKSYIWMTFNEYQLISNADT

SEQ ID NO: 2398907 - protein, 17 aa, Entamoeba dispar
KQKYRFGKWFKINLNQV

SEQ ID NO: 2398908 - protein, 22 aa, Entamoeba dispar
KQLILICRPVRFSTLAFCIIGI

SEQ ID NO: 2398909 - protein, 23 aa, Entamoeba dispar
KQLIPWQCDIIVLPLKSKKKLNI

SEQ ID NO: 2398910 - protein, 25 aa, Entamoeba dispar
KQLKKIHFELYRTLGTILFNCRLSI

SEQ ID NO: 2398911 - protein, 39 aa, Entamoeba dispar
KQMLIKIAIQVIYQLGILLIILFFGSTFKFISAPCGYIS

SEQ ID NO: 2398912 - protein, 23 aa, Entamoeba dispar
KQMTYYVFLISDTKIQINEQILY

SEQ ID NO: 2398913 - protein, 28 aa, Entamoeba dispar
KQNNWWSILQFIIWSIIITLIISSIIIT

SEQ ID NO: 2398914 - protein, 20 aa, Entamoeba dispar
KQPLHFTFHSGDYTKYEIMC

SEQ ID NO: 2398915 - protein, 26 aa, Entamoeba dispar
KQQCHPYLISMYFITLEKQSYEEKLN

SEQ ID NO: 2398916 - protein, 26 aa, Entamoeba dispar
KQQFKLFLIHLLQSDSPPALLRAYSS

SEQ ID NO: 2398917 - protein, 18 aa, Entamoeba dispar
KQRLSVIHYLYSLIPMAT

SEQ ID NO: 2398918 - protein, 29 aa, Entamoeba dispar
KQSTRIMIQVLLYCWLCYNSKNEKEWKIL

SEQ ID NO: 2398919 - protein, 17 aa, Entamoeba dispar
KQVCYNTFIVRLASLIN

SEQ ID NO: 2398920 - protein, 17 aa, Entamoeba dispar
KQYISWVMALFELSSHC

SEQ ID NO: 2398921 - protein, 34 aa, Entamoeba dispar
KQYPCTQIYINGLLLLKVMLLKCSFTRLKKRMPT

SEQ ID NO: 2398922 - protein, 21 aa, Entamoeba dispar
KQYQMYIGITGFIVITTILLL

SEQ ID NO: 2398923 - protein, 23 aa, Entamoeba dispar
KRAALFVVVIFIGALIMLNNLDV

SEQ ID NO: 2398924 - protein, 24 aa, Entamoeba dispar
KRDTRYLCSLFKYDIQQNVSEAIK

SEQ ID NO: 2398925 - protein, 23 aa, Entamoeba dispar
KREPKLMDFPPLEFAKQITLFTS

SEQ ID NO: 2398926 - protein, 30 aa, Entamoeba dispar
KRFIAVLIMIVLIFLFYTLNKQRKKCCTEV

SEQ ID NO: 2398927 - protein, 21 aa, Entamoeba dispar
KRFMTIYHQPVLLTFDDFVDR

SEQ ID NO: 2398928 - protein, 19 aa, Entamoeba dispar
KRFNLFRKSLNSEKQFFQI

SEQ ID NO: 2398929 - protein, 18 aa, Entamoeba dispar
KRFSMRKTLLLEKVHFDI

SEQ ID NO: 2398930 - protein, 25 aa, Entamoeba dispar
KRHNKFIVEYLLEAVLSIACILFGP

SEQ ID NO: 2398931 - protein, 23 aa, Entamoeba dispar
KRIENNMIIKLLSDAAHGIQYLH

SEQ ID NO: 2398932 - protein, 41 aa, Entamoeba dispar
KRLKEKRTLWYVWALWWFIYAVVCVATFTVLKLFIKKDDLL

SEQ ID NO: 2398933 - protein, 36 aa, Entamoeba dispar
KRLTITIVCVILLFSYIFTYVLLKTTPDTKEIKKIL

SEQ ID NO: 2398934 - protein, 19 aa, Entamoeba dispar
KRLVIPLKVDFKGIVSNEE

SEQ ID NO: 2398935 - protein, 17 aa, Entamoeba dispar
KRMFVSDEKLKVITQAT

SEQ ID NO: 2398936 - protein, 24 aa, Entamoeba dispar
KRNDKWLHSIGINPQMMKASEQVS

SEQ ID NO: 2398937 - protein, 24 aa, Entamoeba dispar
KRNEQLYYKHYPAFEVDSIVDVHG

SEQ ID NO: 2398938 - protein, 29 aa, Entamoeba dispar
KRNHISYFNWFLYTTTLLFKQLNLNQEDI

SEQ ID NO: 2398939 - protein, 23 aa, Entamoeba dispar
KRNWITDSFFLFITLVAGTGIYA

SEQ ID NO: 2398940 - protein, 24 aa, Entamoeba dispar
KRNYSFIVIFVYLALVISSIIISS

SEQ ID NO: 2398941 - protein, 18 aa, Entamoeba dispar
KRQRRWYTKPKTIKYGDI

SEQ ID NO: 2398942 - protein, 27 aa, Entamoeba dispar
KRSSKRMLAYFPIKKILDENGKTIFDD

SEQ ID NO: 2398943 - protein, 24 aa, Entamoeba dispar
KRSVQLCFLMGILNKFCSLTFQRP

SEQ ID NO: 2398944 - protein, 20 aa, Entamoeba dispar
KRTILKLKHSFPSVLEREEV

SEQ ID NO: 2398945 - protein, 25 aa, Entamoeba dispar
KRVILYYIIIIVFFIFTAIMVSISL

SEQ ID NO: 2398946 - protein, 22 aa, Entamoeba dispar
KRVKAPTWYPIYHTSLNFKNFE

SEQ ID NO: 2398947 - protein, 25 aa, Entamoeba dispar
KRVWESLVLVIFIRPFDIGDRIQVT

SEQ ID NO: 2398948 - protein, 42 aa, Entamoeba dispar
KRYEVITETYNLTYIYLYCLFIEVIKFLKRRNEIFKTTFILT

SEQ ID NO: 2398949 - protein, 54 aa, Entamoeba dispar
KRYTILNFIALFFSIILFITLLFIQQLFPSFDNWFWFNVFIQMLQTPVFYALVL

SEQ ID NO: 2398950 - protein, 32 aa, Entamoeba dispar
KSAEYILTPRLIIHLQPSIPIYVFIHSPYGKT

SEQ ID NO: 2398951 - protein, 25 aa, Entamoeba dispar
KSAPYFIQWIVNILQTYGTLKRLAL

SEQ ID NO: 2398952 - protein, 27 aa, Entamoeba dispar
KSCSAILFWCYMFAILNIIFGVVLSMK

SEQ ID NO: 2398953 - protein, 23 aa, Entamoeba dispar
KSDNILLFDLTLEAPVRAKLTDF

SEQ ID NO: 2398954 - protein, 23 aa, Entamoeba dispar
KSDTPCVLVIKPSYDTNTNKIHI

SEQ ID NO: 2398955 - protein, 26 aa, Entamoeba dispar
KSEHVFLILQLCGSIIFYHSSGETCV

SEQ ID NO: 2398956 - protein, 29 aa, Entamoeba dispar
KSEKIIIKTWWRLVIFIINGIMVGIMNIK

SEQ ID NO: 2398957 - protein, 24 aa, Entamoeba dispar
KSENKFYPFIQQYLTIINQTKIFN

SEQ ID NO: 2398958 - protein, 25 aa, Entamoeba dispar
KSENLFLSLIKLLEGYLANSLVEVS

SEQ ID NO: 2398959 - protein, 33 aa, Entamoeba dispar
KSFEEWDLESFYPFFKEGFCKHLIPAALHRYEE

SEQ ID NO: 2398960 - protein, 21 aa, Entamoeba dispar
KSFFREGFISEIMVWIHNFLT

SEQ ID NO: 2398961 - protein, 20 aa, Entamoeba dispar
KSFFRVFDDKNTQKTTFFTF

SEQ ID NO: 2398962 - protein, 28 aa, Entamoeba dispar
KSFIEQFMLFINPLINNNIQLNGLLTLC

SEQ ID NO: 2398963 - protein, 19 aa, Entamoeba dispar
KSFRMFIELGKKILIPLQL

SEQ ID NO: 2398964 - protein, 33 aa, Entamoeba dispar
KSFVAFLSYPISGYALKMPLFGSTFKSVQIEST

SEQ ID NO: 2398965 - protein, 17 aa, Entamoeba dispar
KSFWKLVLSCVLIITNV

SEQ ID NO: 2398966 - protein, 26 aa, Entamoeba dispar
KSGNKYMLIIFHTPNNPKFVFNFEKQ

SEQ ID NO: 2398967 - protein, 31 aa, Entamoeba dispar
KSHWSLSQFFLWITVFVLIHISFTISLILGY

SEQ ID NO: 2398968 - protein, 20 aa, Entamoeba dispar
KSIAFCMFEIVWKQITQIKN

SEQ ID NO: 2398969 - protein, 23 aa, Entamoeba dispar
KSIQHHEFLIKPTYQIRKEEDLK

SEQ ID NO: 2398970 - protein, 49 aa, Entamoeba dispar
KSKALTNFLFWGIGSIVYVLYYIFALTLFLLLYIRLTKKIKQEIDDEKL

SEQ ID NO: 2398971 - protein, 24 aa, Entamoeba dispar
KSKEWIMAISIGSTILILFVLIII

SEQ ID NO: 2398972 - protein, 23 aa, Entamoeba dispar
KSKSIIWMVSWKGVKFVLKDQKI

SEQ ID NO: 2398973 - protein, 21 aa, Entamoeba dispar
KSKYIGKLTSKEWFIKGYIED

SEQ ID NO: 2398974 - protein, 28 aa, Entamoeba dispar
KSLELFELFRLRWKGNFIILHSISSLIN

SEQ ID NO: 2398975 - protein, 19 aa, Entamoeba dispar
KSLPIIFDILFISIQYSTS

SEQ ID NO: 2398976 - protein, 17 aa, Entamoeba dispar
KSLQRIIVKNVELLMGA

SEQ ID NO: 2398977 - protein, 17 aa, Entamoeba dispar
KSLRHPCVLQFFGSGMD

SEQ ID NO: 2398978 - protein, 23 aa, Entamoeba dispar
KSLSYFEYFFELCFTRGVGCENL

SEQ ID NO: 2398979 - protein, 28 aa, Entamoeba dispar
KSNIFVIGMFILELIFALISTIMGSIWR

SEQ ID NO: 2398980 - protein, 24 aa, Entamoeba dispar
KSNLRAFWQFLVSMGLIGFIGSYH

SEQ ID NO: 2398981 - protein, 34 aa, Entamoeba dispar
KSNSYLLMIIIADKLLFILWVATLTTFILIDKLR

SEQ ID NO: 2398982 - protein, 44 aa, Entamoeba dispar
KSNTIYYIVGGIICGILLLLLVIIVIAIIVFFVMRKKKGSEYHD

SEQ ID NO: 2398983 - protein, 31 aa, Entamoeba dispar
KSNVFGMMGVIFYWIITQKNYIIKEEYIDNL

SEQ ID NO: 2398984 - protein, 24 aa, Entamoeba dispar
KSPALYLQTFPLLKSAFEIFEQTP

SEQ ID NO: 2398985 - protein, 32 aa, Entamoeba dispar
KSQQKIETVPNIILLFFNSLEEWNIHKDIPNN

SEQ ID NO: 2398986 - protein, 32 aa, Entamoeba dispar
KSRWILYDKELEACWKKLALLILTRKGEKSEE

SEQ ID NO: 2398987 - protein, 37 aa, Entamoeba dispar
KSSIIMKLFIIAMAVLLFLFVMSVIAAIWFSPKHNRN

SEQ ID NO: 2398988 - protein, 22 aa, Entamoeba dispar
KSSLGNFILKKNTFKVSADPNS

SEQ ID NO: 2398989 - protein, 18 aa, Entamoeba dispar
KSTLNPFYGYEPAPNGTD

SEQ ID NO: 2398990 - protein, 24 aa, Entamoeba dispar
KSVKLMIFESIKPFNKIGFQQFAE

SEQ ID NO: 2398991 - protein, 18 aa, Entamoeba dispar
KSWDLALVVLATVLLSCF

SEQ ID NO: 2398992 - protein, 19 aa, Entamoeba dispar
KSWLCVFPGCKESVKTHYN

SEQ ID NO: 2398993 - protein, 22 aa, Entamoeba dispar
KSYDHFFPINKMWDKNGVLVFS

SEQ ID NO: 2398994 - protein, 23 aa, Entamoeba dispar
KSYFKKGFSKLFLPLGFSGVLSI

SEQ ID NO: 2398995 - protein, 37 aa, Entamoeba dispar
KSYIPWISLVRIIYLSLMSLYPYKTFFSVKSDIPDFI

SEQ ID NO: 2398996 - protein, 23 aa, Entamoeba dispar
KSYSLFGFLHYFKSLKLQPNSSN

SEQ ID NO: 2398997 - protein, 29 aa, Entamoeba dispar
KTAISIFDIIPFEFPLGKWYTKPNIIKYG

SEQ ID NO: 2398998 - protein, 18 aa, Entamoeba dispar
KTAMAQILLKVICDLLKR

SEQ ID NO: 2398999 - protein, 24 aa, Entamoeba dispar
KTCTKCLDGYYLDDDSCFQIKHCD

SEQ ID NO: 2399000 - protein, 23 aa, Entamoeba dispar
KTEIPKFLVKVLVDFASTTFTIK

SEQ ID NO: 2399001 - protein, 18 aa, Entamoeba dispar
KTELINLFEQLAIFIRKS

SEQ ID NO: 2399002 - protein, 26 aa, Entamoeba dispar
KTESILPIYFLLLQQSAALAFFWSPC

SEQ ID NO: 2399003 - protein, 18 aa, Entamoeba dispar
KTFFSVKSDIPDFIKSHW

SEQ ID NO: 2399004 - protein, 34 aa, Entamoeba dispar
KTFPITGLILCIILFVLIGLYIIVTVILNIFVFH

SEQ ID NO: 2399005 - protein, 21 aa, Entamoeba dispar
KTFSYSSWLYSFINAIYPPSN

SEQ ID NO: 2399006 - protein, 20 aa, Entamoeba dispar
KTFTQALFAAAVEYLLPFRR

SEQ ID NO: 2399007 - protein, 36 aa, Entamoeba dispar
KTGEHEPFWINIYHIMLLHGLLYWRHRPNIEFKDMI

SEQ ID NO: 2399008 - protein, 22 aa, Entamoeba dispar
KTGVLKAFAFLFEYIGEKSKDY

SEQ ID NO: 2399009 - protein, 24 aa, Entamoeba dispar
KTHKQYIHPLKHKSLPVTSLTPPS

SEQ ID NO: 2399010 - protein, 22 aa, Entamoeba dispar
KTICLLYHEYYSICTDKEDECN

SEQ ID NO: 2399011 - protein, 29 aa, Entamoeba dispar
KTIETQDLYLCLIWVLKNLNREVLKRYIS

SEQ ID NO: 2399012 - protein, 18 aa, Entamoeba dispar
KTIIIGILIIFNVIGMII

SEQ ID NO: 2399013 - protein, 18 aa, Entamoeba dispar
KTIKLSSTKGWDVLRWKD

SEQ ID NO: 2399014 - protein, 21 aa, Entamoeba dispar
KTIKTTICGTLAWIAPEVLAR

SEQ ID NO: 2399015 - protein, 19 aa, Entamoeba dispar
KTILHWYFGTDKTLKWRFI

SEQ ID NO: 2399016 - protein, 17 aa, Entamoeba dispar
KTIWIFHGARTDGLFVG

SEQ ID NO: 2399017 - protein, 24 aa, Entamoeba dispar
KTIYPFIIIIIIALFIMMKKTNSS

SEQ ID NO: 2399018 - protein, 18 aa, Entamoeba dispar
KTIYTIYLKEFIKIIIEI

SEQ ID NO: 2399019 - protein, 23 aa, Entamoeba dispar
KTLIEYINAQQFRYGFDSIITVQ

SEQ ID NO: 2399020 - protein, 20 aa, Entamoeba dispar
KTLLHGLFSLYPPTLEGLYK

SEQ ID NO: 2399021 - protein, 34 aa, Entamoeba dispar
KTLPIFIISQLLLRFFLVLWTLFVIFPSNSFFEP

SEQ ID NO: 2399022 - protein, 18 aa, Entamoeba dispar
KTMFDVFAKLSQLFPSLI

SEQ ID NO: 2399023 - protein, 20 aa, Entamoeba dispar
KTMLKFLIRSSHKNTFKMIK

SEQ ID NO: 2399024 - protein, 28 aa, Entamoeba dispar
KTNIIYLVIGYLGFLIPAACIGIFIASR

SEQ ID NO: 2399025 - protein, 24 aa, Entamoeba dispar
KTNKDFIPMYFVDSQPEAGDNTRS

SEQ ID NO: 2399026 - protein, 22 aa, Entamoeba dispar
KTNPFIIMRLGILAFIIALFFP

SEQ ID NO: 2399027 - protein, 17 aa, Entamoeba dispar
KTPFFKTLIKFYQPSKK

SEQ ID NO: 2399028 - protein, 31 aa, Entamoeba dispar
KTPHRVSVFNWFWNRQSYIPSEPYSTQLRRY

SEQ ID NO: 2399029 - protein, 39 aa, Entamoeba dispar
KTQFITILLFFFTSGCWILLSLLLMFLDCQYHLKIMGIS

SEQ ID NO: 2399030 - protein, 23 aa, Entamoeba dispar
KTRIKFMCLRLPSERVWLGCEDE

SEQ ID NO: 2399031 - protein, 24 aa, Entamoeba dispar
KTSAFMPFFQLNSMSSGYGIDGII

SEQ ID NO: 2399032 - protein, 43 aa, Entamoeba dispar
KTSCPDYIFVKPTTSLWWVSATIFIFFIICVFIFGICFSIYHY

SEQ ID NO: 2399033 - protein, 41 aa, Entamoeba dispar
KTSESLLFDSFYILRQLWYISLFLTPLGIKVCIKLLQVSTL

SEQ ID NO: 2399034 - protein, 46 aa, Entamoeba dispar
KTTKYCWWSFIPVFLFNQFKYFINLFFLIIAILSCIPQLSAASPVA

SEQ ID NO: 2399035 - protein, 26 aa, Entamoeba dispar
KVARDWFLFLMSHDATLFISIVMGVL

SEQ ID NO: 2399036 - protein, 21 aa, Entamoeba dispar
KVCVKKFFKSKAGIILGCVIG

SEQ ID NO: 2399037 - protein, 17 aa, Entamoeba dispar
KVEFGKCYYFGSDSGAM

SEQ ID NO: 2399038 - protein, 26 aa, Entamoeba dispar
KVELAPIALPLLINILSSFHCCQNQQ

SEQ ID NO: 2399039 - protein, 19 aa, Entamoeba dispar
KVERLDLFGYLSCKELHLK

SEQ ID NO: 2399040 - protein, 25 aa, Entamoeba dispar
KVFFFCDEFMFKRWTKYINDSVEGK

SEQ ID NO: 2399041 - protein, 21 aa, Entamoeba dispar
KVFLCLVLMWTNSLPIYLFSI

SEQ ID NO: 2399042 - protein, 17 aa, Entamoeba dispar
KVFQCCFPLDFVKVLMF

SEQ ID NO: 2399043 - protein, 27 aa, Entamoeba dispar
KVICLCIILLVINLLLFLEKKSDEINV

SEQ ID NO: 2399044 - protein, 20 aa, Entamoeba dispar
KVIFNFVLSHKLFNTLFCHW

SEQ ID NO: 2399045 - protein, 24 aa, Entamoeba dispar
KVIHGIIEYLFYKPNPLLIIFMGV

SEQ ID NO: 2399046 - protein, 23 aa, Entamoeba dispar
KVKDGYYRYSFSNSGAVCTLTCL

SEQ ID NO: 2399047 - protein, 23 aa, Entamoeba dispar
KVKKLVYLIMSNLIYYNEQDVNK

SEQ ID NO: 2399048 - protein, 18 aa, Entamoeba dispar
KVMLCPEGFYSDGTQCLH

SEQ ID NO: 2399049 - protein, 40 aa, Entamoeba dispar
KVMWNGGPLILYFKHNNFISIYLFLLLAAIGITVSMIMGT

SEQ ID NO: 2399050 - protein, 18 aa, Entamoeba dispar
KVNVFKMLWNQITDFIVM

SEQ ID NO: 2399051 - protein, 17 aa, Entamoeba dispar
KVRSITVLVLYSLAIFI

SEQ ID NO: 2399052 - protein, 40 aa, Entamoeba dispar
KVSSVILTVLQILVVLPEKDLYVLPNTQIPYKVFTTKRNE

SEQ ID NO: 2399053 - protein, 17 aa, Entamoeba dispar
KVSVLFTLFVLSPFVIF

SEQ ID NO: 2399054 - protein, 23 aa, Entamoeba dispar
KVTKIIIHPDKFSDSHLPVINVI

SEQ ID NO: 2399055 - protein, 20 aa, Entamoeba dispar
KVVLLYYQKKEFRIPISIFI

SEQ ID NO: 2399056 - protein, 22 aa, Entamoeba dispar
KVYQIKLFNFIGTSIFINIKFI

SEQ ID NO: 2399057 - protein, 26 aa, Entamoeba dispar
KVYTMQYFIWWFVLLPFVVPKIIEGA

SEQ ID NO: 2399058 - protein, 19 aa, Entamoeba dispar
KWFETNKLKWYKYNQLAYI

SEQ ID NO: 2399059 - protein, 27 aa, Entamoeba dispar
KWIIEGTPFLWYLLNTLLIISTPLCVL

SEQ ID NO: 2399060 - protein, 17 aa, Entamoeba dispar
KWIMYKLSSDSYINCNP

SEQ ID NO: 2399061 - protein, 23 aa, Entamoeba dispar
KWIYLLFFFLLFGILMIMKYFII

SEQ ID NO: 2399062 - protein, 19 aa, Entamoeba dispar
KWLNRINPLYPFLQTELQE

SEQ ID NO: 2399063 - protein, 31 aa, Entamoeba dispar
KWMKLPDAPVPIWRYFVFGTAMFCCLVLCIL

SEQ ID NO: 2399064 - protein, 22 aa, Entamoeba dispar
KWRPLFFYCRFLVTKIIVPIFL

SEQ ID NO: 2399065 - protein, 21 aa, Entamoeba dispar
KWTFILNIVLILFNNPFFFYE

SEQ ID NO: 2399066 - protein, 27 aa, Entamoeba dispar
KYCIVITIIRFLFTPLRSIILRRYCFI

SEQ ID NO: 2399067 - protein, 33 aa, Entamoeba dispar
KYDSHSFIYFFIFFLDIFCIIQPQFLVRIKDND

SEQ ID NO: 2399068 - protein, 29 aa, Entamoeba dispar
KYEKLYTTVKTQLYFFFSSSGNDLLNGLI

SEQ ID NO: 2399069 - protein, 18 aa, Entamoeba dispar
KYEKQLFIILDHFNVHPK

SEQ ID NO: 2399070 - protein, 25 aa, Entamoeba dispar
KYELTQVCRIYVALVPKGYTITECP

SEQ ID NO: 2399071 - protein, 17 aa, Entamoeba dispar
KYFHYTIPKSTTTQNYL

SEQ ID NO: 2399072 - protein, 21 aa, Entamoeba dispar
KYGIIGIWIIAALCCGYFALN

SEQ ID NO: 2399073 - protein, 18 aa, Entamoeba dispar
KYGKYFHYTIPKSTTTQN

SEQ ID NO: 2399074 - protein, 29 aa, Entamoeba dispar
KYGSYETYYYDIELWYSLLAHSKVPFLTF

SEQ ID NO: 2399075 - protein, 20 aa, Entamoeba dispar
KYHPEIYTKIMRLGGYDSLY

SEQ ID NO: 2399076 - protein, 27 aa, Entamoeba dispar
KYIAEILLHFEKLAKKELWYINEEQIK

SEQ ID NO: 2399077 - protein, 20 aa, Entamoeba dispar
KYLLRILKRNNATATFFMLG

SEQ ID NO: 2399078 - protein, 22 aa, Entamoeba dispar
KYNFCPFFMMTFKASWEMFKQT

SEQ ID NO: 2399079 - protein, 27 aa, Entamoeba dispar
KYNFLRKKTLYYKWIYPIAIAVDITLR

SEQ ID NO: 2399080 - protein, 21 aa, Entamoeba dispar
KYNKMFVVSLIRNVFTNNFLE

SEQ ID NO: 2399081 - protein, 19 aa, Entamoeba dispar
KYNMLVLDTIFRTYFRVLK

SEQ ID NO: 2399082 - protein, 21 aa, Entamoeba dispar
KYPDCHYLSYLFDLSLNIDNT

SEQ ID NO: 2399083 - protein, 20 aa, Entamoeba dispar
KYPDCHYLSYLYDFSLNTEN

SEQ ID NO: 2399084 - protein, 22 aa, Entamoeba dispar
KYPKLYIILNPFSGTKKGEIIM

SEQ ID NO: 2399085 - protein, 22 aa, Entamoeba dispar
KYPNILINFIKTMFLRIIESTS

SEQ ID NO: 2399086 - protein, 19 aa, Entamoeba dispar
KYRFGKWFKINLNQVTNAV

SEQ ID NO: 2399087 - protein, 17 aa, Entamoeba dispar
KYSFKYFSLQQRINFII

SEQ ID NO: 2399088 - protein, 32 aa, Entamoeba dispar
KYSLPIFNTSIYPLFSIFNVSGMTTLFLLLMT

SEQ ID NO: 2399089 - protein, 35 aa, Entamoeba dispar
KYTVYNFIPYFLYEQFRKLANVYFLFISCLQLIPG

SEQ ID NO: 2399090 - protein, 25 aa, Entamoeba dispar
KYVIKRYHHFFIIKTDAASSTHLDM

SEQ ID NO: 2399091 - protein, 20 aa, Entamoeba dispar
KYVWWNVFTIRKNSTGILLR

SEQ ID NO: 2399092 - protein, 28 aa, Entamoeba dispar
KYWKRKSIVIILLIVLVLGIIGVIIGVC

SEQ ID NO: 2399093 - protein, 19 aa, Entamoeba dispar
KYYGILQFEFSYLSSIDFE

SEQ ID NO: 2399094 - protein, 19 aa, Entamoeba dispar
KYYISNFFSYFGPLYILFV

SEQ ID NO: 2399095 - protein, 28 aa, Entamoeba dispar
LAAIHPKLFPTPLILPTAPNSMLRLNRL

SEQ ID NO: 2399096 - protein, 17 aa, Entamoeba dispar
LACVVVGFVYFRRNKQE

SEQ ID NO: 2399097 - protein, 32 aa, Entamoeba dispar
LADLYDIESLYVIFFFILKNLKETTIQQWLVS

SEQ ID NO: 2399098 - protein, 33 aa, Entamoeba dispar
LADTTLLIVLIVFGTLALLPMIKRKLGKGEDDY

SEQ ID NO: 2399099 - protein, 18 aa, Entamoeba dispar
LAFFIELPLCYILRYLPS

SEQ ID NO: 2399100 - protein, 18 aa, Entamoeba dispar
LAFFWSICEYLLSNEIYQ

SEQ ID NO: 2399101 - protein, 32 aa, Entamoeba dispar
LAFSNCIVLCLFFWFLRLYSVFNWALEQHLTG

SEQ ID NO: 2399102 - protein, 33 aa, Entamoeba dispar
LAFSTRLLQILPLSLIIFFFSLVTDVPKQFIPI

SEQ ID NO: 2399103 - protein, 27 aa, Entamoeba dispar
LAGFFFLLEGLFIYNGYLRIAAPFFDY

SEQ ID NO: 2399104 - protein, 23 aa, Entamoeba dispar
LAGHNALVLMPTGGGKSLCYQLP

SEQ ID NO: 2399105 - protein, 17 aa, Entamoeba dispar
LAHLPFFHFIRENKELF

SEQ ID NO: 2399106 - protein, 19 aa, Entamoeba dispar
LAITGVYPLTIKTLNRDKS

SEQ ID NO: 2399107 - protein, 23 aa, Entamoeba dispar
LAIVIVEAFDRKCPYSMLGSSWE

SEQ ID NO: 2399108 - protein, 26 aa, Entamoeba dispar
LAKPLKQMFRLFSRISQMSKEMAIVF

SEQ ID NO: 2399109 - protein, 18 aa, Entamoeba dispar
LALSISYTWTGASSNLFE

SEQ ID NO: 2399110 - protein, 21 aa, Entamoeba dispar
LALYVLIYLISLFTGYPNLLQ

SEQ ID NO: 2399111 - protein, 17 aa, Entamoeba dispar
LAPIPFGLISKFIKNRT

SEQ ID NO: 2399112 - protein, 18 aa, Entamoeba dispar
LARLLYFVIITYSLSKGK

SEQ ID NO: 2399113 - protein, 26 aa, Entamoeba dispar
LATIVYFVITWNYFNRAIYITGAATM

SEQ ID NO: 2399114 - protein, 18 aa, Entamoeba dispar
LATNKLLDDILSVSFQKI

SEQ ID NO: 2399115 - protein, 45 aa, Entamoeba dispar
LATYSHTFVWPFYISMILSILLFFGWYIFYGFVGGFKFISMGESV

SEQ ID NO: 2399116 - protein, 24 aa, Entamoeba dispar
LAVYQSVMLYLLSSSIIITNDVFD

SEQ ID NO: 2399117 - protein, 26 aa, Entamoeba dispar
LAYSILGLFFEWKIPLKYIKVVLQVA

SEQ ID NO: 2399118 - protein, 25 aa, Entamoeba dispar
LAYVGFFQMFPTIIKGIYSALDNGS

SEQ ID NO: 2399119 - protein, 17 aa, Entamoeba dispar
LCDIFLQKTVHPNLCLC

SEQ ID NO: 2399120 - protein, 25 aa, Entamoeba dispar
LCEQIHFFLPFHFINIEDNFVDTKF

SEQ ID NO: 2399121 - protein, 17 aa, Entamoeba dispar
LCFIAFSLVVYFTDWKM

SEQ ID NO: 2399122 - protein, 21 aa, Entamoeba dispar
LCFLGIRINYLGLAIICFVMQ

SEQ ID NO: 2399123 - protein, 18 aa, Entamoeba dispar
LCFLLVIVLGDNTNTTVD

SEQ ID NO: 2399124 - protein, 18 aa, Entamoeba dispar
LCFNIIAVILCFPLSFHQ

SEQ ID NO: 2399125 - protein, 23 aa, Entamoeba dispar
LCIAYIIVILFFNFAGTAVIQYS

SEQ ID NO: 2399126 - protein, 17 aa, Entamoeba dispar
LCIGLDAAAIEEFISYL

SEQ ID NO: 2399127 - protein, 18 aa, Entamoeba dispar
LCILGCFAQNLTINIFHV

SEQ ID NO: 2399128 - protein, 21 aa, Entamoeba dispar
LCKGLIVIFTIVLCLPSLQTC

SEQ ID NO: 2399129 - protein, 34 aa, Entamoeba dispar
LCKSAPIIIIWTTLFLVEILLAIIVVLIAQTGCQ

SEQ ID NO: 2399130 - protein, 27 aa, Entamoeba dispar
LCLCVSIMFWILYFKSPSAVFRVSEDW

SEQ ID NO: 2399131 - protein, 18 aa, Entamoeba dispar
LCLIPCYLTHECIVKSPL

SEQ ID NO: 2399132 - protein, 18 aa, Entamoeba dispar
LCNNFFLNSLWTFPQQVD

SEQ ID NO: 2399133 - protein, 23 aa, Entamoeba dispar
LCNRFSLQITFLESLLDLDYSNQ

SEQ ID NO: 2399134 - protein, 21 aa, Entamoeba dispar
LCPNNNLPLVLTTNSDNKINV

SEQ ID NO: 2399135 - protein, 20 aa, Entamoeba dispar
LCVIVYFLPVKVINGYIPPI

SEQ ID NO: 2399136 - protein, 18 aa, Entamoeba dispar
LCVIYAIIFFFMIKPENN

SEQ ID NO: 2399137 - protein, 28 aa, Entamoeba dispar
LCVPTVYDTLPLYRTLFHPKDNEFVVNV

SEQ ID NO: 2399138 - protein, 20 aa, Entamoeba dispar
LCVRNSFNVWLTIANLDALF

SEQ ID NO: 2399139 - protein, 25 aa, Entamoeba dispar
LCYNHNILGHWFRFIGNKSVSYQIQ

SEQ ID NO: 2399140 - protein, 19 aa, Entamoeba dispar
LCYQLPSLFKDGYTLVISP

SEQ ID NO: 2399141 - protein, 24 aa, Entamoeba dispar
LDAFESVMKITLGTTLIGAIIIIA

SEQ ID NO: 2399142 - protein, 19 aa, Entamoeba dispar
LDDILHRPIGGIALEPRVG

SEQ ID NO: 2399143 - protein, 24 aa, Entamoeba dispar
LDEMKLIALLLVYGIIHNKKIILE

SEQ ID NO: 2399144 - protein, 23 aa, Entamoeba dispar
LDETFFLEDPPIYSVVDALKELY

SEQ ID NO: 2399145 - protein, 17 aa, Entamoeba dispar
LDFLSRLIHRTGLGDHT

SEQ ID NO: 2399146 - protein, 22 aa, Entamoeba dispar
LDFSYKLLRGIMNYCNYPDPDI

SEQ ID NO: 2399147 - protein, 21 aa, Entamoeba dispar
LDHEHLYFLYLEINEEYAATI

SEQ ID NO: 2399148 - protein, 18 aa, Entamoeba dispar
LDIPFQENLLLLALSFYD

SEQ ID NO: 2399149 - protein, 29 aa, Entamoeba dispar
LDKFRCDYVVYFYGAVFVPNKICIVTEFA

SEQ ID NO: 2399150 - protein, 29 aa, Entamoeba dispar
LDKFRNDYIVHFYGAVFIPNKICMVMELA

SEQ ID NO: 2399151 - protein, 29 aa, Entamoeba dispar
LDKFRNEYIIHFFGAVFIPNKISIVTEYA

SEQ ID NO: 2399152 - protein, 29 aa, Entamoeba dispar
LDKFRNEYIVHFYGAVFIPKKICMVTEFA

SEQ ID NO: 2399153 - protein, 27 aa, Entamoeba dispar
LDKFRNEYLVHFYGAVFIPNKICMVNE

SEQ ID NO: 2399154 - protein, 29 aa, Entamoeba dispar
LDKFRSDYIVYFYGAVFIPSKICIVTEFA

SEQ ID NO: 2399155 - protein, 27 aa, Entamoeba dispar
LDKFRSEYIIHFYGAVFIPNKICMITE

SEQ ID NO: 2399156 - protein, 27 aa, Entamoeba dispar
LDKFRSEYIIHFYGAVMIPGKVCMVTE

SEQ ID NO: 2399157 - protein, 29 aa, Entamoeba dispar
LDKFRSEYIIQFYGAVFIPNKICIVTEYA

SEQ ID NO: 2399158 - protein, 26 aa, Entamoeba dispar
LDKFRSEYIIQFYGAVFIPNKICMIT

SEQ ID NO: 2399159 - protein, 29 aa, Entamoeba dispar
LDKFRSNYIIHFYGAVLIPGKISIVTEFA

SEQ ID NO: 2399160 - protein, 40 aa, Entamoeba dispar
LDLGIKRIYIPTFLIYPIQRLPRYLLLLETLSKNVPENYE

SEQ ID NO: 2399161 - protein, 28 aa, Entamoeba dispar
LDRNEILYLLIGYLSCLIPAACIGIFIA

SEQ ID NO: 2399162 - protein, 22 aa, Entamoeba dispar
LDRRTVIHLFGLTILHTKKDDY

SEQ ID NO: 2399163 - protein, 18 aa, Entamoeba dispar
LDSELKYVIKRYHHFFII

SEQ ID NO: 2399164 - protein, 40 aa, Entamoeba dispar
LDSLRMRIFGFHWKTSFPLIFFFTLVFMSFTIFGTKSVNS

SEQ ID NO: 2399165 - protein, 24 aa, Entamoeba dispar
LDSMIRFFLILFTPQPDDFIDQTT

SEQ ID NO: 2399166 - protein, 26 aa, Entamoeba dispar
LDSPMNIIDIIPYPINIKINEQEIPF

SEQ ID NO: 2399167 - protein, 20 aa, Entamoeba dispar
LDTFLLFVSSCSQSKFIASL

SEQ ID NO: 2399168 - protein, 22 aa, Entamoeba dispar
LDYIKGIMRKPTCNEIVMIGVG

SEQ ID NO: 2399169 - protein, 18 aa, Entamoeba dispar
LDYKQYQMYIGITGFIVI

SEQ ID NO: 2399170 - protein, 19 aa, Entamoeba dispar
LEAYVFKDILKNPPQPSFS

SEQ ID NO: 2399171 - protein, 27 aa, Entamoeba dispar
LECCPLPSFDIIFTDSFHSFWTYTNKN

SEQ ID NO: 2399172 - protein, 19 aa, Entamoeba dispar
LECHKGCILEFISVTSLHI

SEQ ID NO: 2399173 - protein, 27 aa, Entamoeba dispar
LECPIKEKFHCVFAIYTKNKLIEKVTS

SEQ ID NO: 2399174 - protein, 24 aa, Entamoeba dispar
LECQRWCFATLKLILLNPNKKVFS

SEQ ID NO: 2399175 - protein, 17 aa, Entamoeba dispar
LECYYDQTNTELCYSLK

SEQ ID NO: 2399176 - protein, 25 aa, Entamoeba dispar
LEEEKMVVLFELLIDIATDFGFIFI

SEQ ID NO: 2399177 - protein, 27 aa, Entamoeba dispar
LEESKFQIIFLHLFDYSTFSSDIYSII

SEQ ID NO: 2399178 - protein, 17 aa, Entamoeba dispar
LEEVKLLEQLRSPCIIS

SEQ ID NO: 2399179 - protein, 21 aa, Entamoeba dispar
LEGPIYLLRTSYQNFISRFGV

SEQ ID NO: 2399180 - protein, 26 aa, Entamoeba dispar
LEGSTIIKVYPLAILTLETQVIENTK

SEQ ID NO: 2399181 - protein, 25 aa, Entamoeba dispar
LEHVPYLFVIIYGLSFFFQNMGPNT

SEQ ID NO: 2399182 - protein, 19 aa, Entamoeba dispar
LEIILLLREILQSQLTIYS

SEQ ID NO: 2399183 - protein, 24 aa, Entamoeba dispar
LEKFRCNYIIHFYGAVIIQDNRCV

SEQ ID NO: 2399184 - protein, 18 aa, Entamoeba dispar
LEKIGTPVYNFLCSYLLK

SEQ ID NO: 2399185 - protein, 27 aa, Entamoeba dispar
LEKMGTILQIVAVVSVALMSIVINMML

SEQ ID NO: 2399186 - protein, 25 aa, Entamoeba dispar
LEKSNYLIVITKKKLITKFLQHKLF

SEQ ID NO: 2399187 - protein, 25 aa, Entamoeba dispar
LELSPFMAFILYLVYIQIDYHLEVG

SEQ ID NO: 2399188 - protein, 20 aa, Entamoeba dispar
LELWSLFDFLMPGFLGTEKE

SEQ ID NO: 2399189 - protein, 22 aa, Entamoeba dispar
LELYVPFLFVFVHLITSPNGDD

SEQ ID NO: 2399190 - protein, 33 aa, Entamoeba dispar
LENHVIWKYLLKSKYWITIFIDMAVSLVSSKEY

SEQ ID NO: 2399191 - protein, 36 aa, Entamoeba dispar
LEPYKGTLSFFIIFTILLHYLYFLDWYTHYETQLHN

SEQ ID NO: 2399192 - protein, 26 aa, Entamoeba dispar
LEQTPKLLFFTGIALYASFVASLFKN

SEQ ID NO: 2399193 - protein, 30 aa, Entamoeba dispar
LERADGFGMEILPLLKFIGSSQTYAEFLTT

SEQ ID NO: 2399194 - protein, 38 aa, Entamoeba dispar
LERTTEISFYLWNKTEYIPMGYYPITTIPTKVMNIIQK

SEQ ID NO: 2399195 - protein, 26 aa, Entamoeba dispar
LESKLWKYLCLFVSFSIKQKNITRTT

SEQ ID NO: 2399196 - protein, 29 aa, Entamoeba dispar
LESLLKLLGLIYDILPYFIKTSRDILLLD

SEQ ID NO: 2399197 - protein, 24 aa, Entamoeba dispar
LESTSKLFLGWFNSNELKFDGTIE

SEQ ID NO: 2399198 - protein, 28 aa, Entamoeba dispar
LETFSFNGFFCFPFVDYSFLSDTTKVSS

SEQ ID NO: 2399199 - protein, 29 aa, Entamoeba dispar
LETSKLYPLLLPDVINLITLLILTTNEAL

SEQ ID NO: 2399200 - protein, 25 aa, Entamoeba dispar
LETTKEFFLFTYNNNTQQIIRRKKN

SEQ ID NO: 2399201 - protein, 18 aa, Entamoeba dispar
LEVEYPLKFATENKFTHF

SEQ ID NO: 2399202 - protein, 17 aa, Entamoeba dispar
LEVNPVRQTLKAGFGIE

SEQ ID NO: 2399203 - protein, 17 aa, Entamoeba dispar
LEYILGKELPHNYDELF

SEQ ID NO: 2399204 - protein, 17 aa, Entamoeba dispar
LEYVFYTLLELNNFFLT

SEQ ID NO: 2399205 - protein, 20 aa, Entamoeba dispar
LFAIFLTFFVPIISIIFPLY

SEQ ID NO: 2399206 - protein, 26 aa, Entamoeba dispar
LFALSSLIIFIFYYHLIKLPQINIQM

SEQ ID NO: 2399207 - protein, 24 aa, Entamoeba dispar
LFAMPLVYLPWISLLLHASFMTEL

SEQ ID NO: 2399208 - protein, 17 aa, Entamoeba dispar
LFCIVFSQYNCSLGCGS

SEQ ID NO: 2399209 - protein, 18 aa, Entamoeba dispar
LFCTMCKPGYYLQKQDCK

SEQ ID NO: 2399210 - protein, 25 aa, Entamoeba dispar
LFDELTFDLILPPRAFITSQELLMN

SEQ ID NO: 2399211 - protein, 17 aa, Entamoeba dispar
LFDGDIYIVKYLTSSVE

SEQ ID NO: 2399212 - protein, 31 aa, Entamoeba dispar
LFEAYTWDTPYPIEKFKYPWDVAQFIGSGKR

SEQ ID NO: 2399213 - protein, 21 aa, Entamoeba dispar
LFFISMFGFIFYLNMTSNPIV

SEQ ID NO: 2399214 - protein, 20 aa, Entamoeba dispar
LFFNHGIWHLIVWFANFQHS

SEQ ID NO: 2399215 - protein, 24 aa, Entamoeba dispar
LFGFLVIGFICIGIIYAIQPSYQP

SEQ ID NO: 2399216 - protein, 24 aa, Entamoeba dispar
LFGIFYAIFIFKMFRRYAQKHNLN

SEQ ID NO: 2399217 - protein, 20 aa, Entamoeba dispar
LFGRYLKAIIIGGSALPSEL

SEQ ID NO: 2399218 - protein, 17 aa, Entamoeba dispar
LFGYFLKDENCVACSDR

SEQ ID NO: 2399219 - protein, 18 aa, Entamoeba dispar
LFHEFINVIFISLTKRRA

SEQ ID NO: 2399220 - protein, 25 aa, Entamoeba dispar
LFHIGLLYLFIYCSSADEGIVCYWK

SEQ ID NO: 2399221 - protein, 22 aa, Entamoeba dispar
LFHQFYFVFMIYHLLSFFFFHS

SEQ ID NO: 2399222 - protein, 18 aa, Entamoeba dispar
LFIGYLTEKVPNLEQWAI

SEQ ID NO: 2399223 - protein, 20 aa, Entamoeba dispar
LFIHHLLPEELVSINVDVLN

SEQ ID NO: 2399224 - protein, 26 aa, Entamoeba dispar
LFIICFFFLLYFFLNDMYFILFEILL

SEQ ID NO: 2399225 - protein, 20 aa, Entamoeba dispar
LFIIDILYAFYAFNLKLQLR

SEQ ID NO: 2399226 - protein, 20 aa, Entamoeba dispar
LFIIVFLTILSNKSCLGEKC

SEQ ID NO: 2399227 - protein, 18 aa, Entamoeba dispar
LFIMSLLNGNISLSVEQL

SEQ ID NO: 2399228 - protein, 19 aa, Entamoeba dispar
LFINLVSSQFLSIKSPIDE

SEQ ID NO: 2399229 - protein, 30 aa, Entamoeba dispar
LFIPFMTLPILIAFIPYIFIKTLCKWNVSL

SEQ ID NO: 2399230 - protein, 19 aa, Entamoeba dispar
LFIRVIQFIHLAMFLKKVF

SEQ ID NO: 2399231 - protein, 19 aa, Entamoeba dispar
LFISFCNGEFCKKVEENDI

SEQ ID NO: 2399232 - protein, 28 aa, Entamoeba dispar
LFITSLQILIICILKFRVNLKTEIALLL

SEQ ID NO: 2399233 - protein, 18 aa, Entamoeba dispar
LFIYSLTNAQITVNFDEI

SEQ ID NO: 2399234 - protein, 18 aa, Entamoeba dispar
LFKELLSYICADYCKIYC

SEQ ID NO: 2399235 - protein, 35 aa, Entamoeba dispar
LFKIAHVYSFAIALYNFIIPYFISNKNYSELALAH

SEQ ID NO: 2399236 - protein, 20 aa, Entamoeba dispar
LFLIGQIIIMLLFIVVAASS

SEQ ID NO: 2399237 - protein, 26 aa, Entamoeba dispar
LFLINKVFHFLDFILTVLKPFNSQSY

SEQ ID NO: 2399238 - protein, 22 aa, Entamoeba dispar
LFLKGFLFLLLFSSLKIPLSLP

SEQ ID NO: 2399239 - protein, 22 aa, Entamoeba dispar
LFLLFTVFSYAFCLQEAMIGVI

SEQ ID NO: 2399240 - protein, 20 aa, Entamoeba dispar
LFLLIMLIIGFIVFILLHYI

SEQ ID NO: 2399241 - protein, 23 aa, Entamoeba dispar
LFLSFTFILLPMKFAKLFTVGNV

SEQ ID NO: 2399242 - protein, 22 aa, Entamoeba dispar
LFLVYIAFFVLLESIHRLIHPS

SEQ ID NO: 2399243 - protein, 20 aa, Entamoeba dispar
LFMICYILGLLLISLSTFFL

SEQ ID NO: 2399244 - protein, 25 aa, Entamoeba dispar
LFNEKSIFYSIFQIFPKISIQETLK

SEQ ID NO: 2399245 - protein, 24 aa, Entamoeba dispar
LFNFASYFYWLVVPLKCVDMGGST

SEQ ID NO: 2399246 - protein, 18 aa, Entamoeba dispar
LFNFLKVYIIKKMTYLNK

SEQ ID NO: 2399247 - protein, 17 aa, Entamoeba dispar
LFNVCKLCKLLINDTEK

SEQ ID NO: 2399248 - protein, 25 aa, Entamoeba dispar
LFPLFLLFLICFYLFLYPLINMYFY

SEQ ID NO: 2399249 - protein, 19 aa, Entamoeba dispar
LFPMTTIYYRGISFTLPDS

SEQ ID NO: 2399250 - protein, 31 aa, Entamoeba dispar
LFPSDFRCAMDRWLRLRILGSKIPTQIIIQH

SEQ ID NO: 2399251 - protein, 26 aa, Entamoeba dispar
LFPSDFRYYLVPPCELRILGSKLPAQ

SEQ ID NO: 2399252 - protein, 19 aa, Entamoeba dispar
LFPVIPSVWNGYIKSLKLS

SEQ ID NO: 2399253 - protein, 32 aa, Entamoeba dispar
LFQEYNIFIKFIPFINAYLFPLTTDIETLNHF

SEQ ID NO: 2399254 - protein, 19 aa, Entamoeba dispar
LFSIIHILVTILSLPFNLF

SEQ ID NO: 2399255 - protein, 24 aa, Entamoeba dispar
LFSKKGLSFIYLLKYTPFSPNNTI

SEQ ID NO: 2399256 - protein, 18 aa, Entamoeba dispar
LFSMVLILLAARITALFY

SEQ ID NO: 2399257 - protein, 27 aa, Entamoeba dispar
LFSNLIEYLIFHKFTPLKKQIIPDIKI

SEQ ID NO: 2399258 - protein, 25 aa, Entamoeba dispar
LFSPNGWIVMIFSVPMGIVAGYELQ

SEQ ID NO: 2399259 - protein, 17 aa, Entamoeba dispar
LFSSICFGYYCLKEQKN

SEQ ID NO: 2399260 - protein, 20 aa, Entamoeba dispar
LFTLFVLSPFVIFCCVGVFD

SEQ ID NO: 2399261 - protein, 25 aa, Entamoeba dispar
LFTLHLPMMVLSLTIFLFLIHLPNL

SEQ ID NO: 2399262 - protein, 18 aa, Entamoeba dispar
LFTLIIATPISCDSYQSQ

SEQ ID NO: 2399263 - protein, 20 aa, Entamoeba dispar
LFTLIIATPISCDSYQSQSG

SEQ ID NO: 2399264 - protein, 19 aa, Entamoeba dispar
LFTSLFLSPSLFGLVVEII

SEQ ID NO: 2399265 - protein, 27 aa, Entamoeba dispar
LFVALYIVLFCLVLFKKFGTSLIPTLL

SEQ ID NO: 2399266 - protein, 22 aa, Entamoeba dispar
LFVHIVDRPLVPGRFKILNKHI

SEQ ID NO: 2399267 - protein, 20 aa, Entamoeba dispar
LFVINIAQLVAFFILGLFKA

SEQ ID NO: 2399268 - protein, 21 aa, Entamoeba dispar
LFYIPFLFLYCFFYCFFFSSI

SEQ ID NO: 2399269 - protein, 21 aa, Entamoeba dispar
LFYKSMALPKILGLSIHNNWG

SEQ ID NO: 2399270 - protein, 19 aa, Entamoeba dispar
LFYLCCSLNILFIVSNVCF

SEQ ID NO: 2399271 - protein, 18 aa, Entamoeba dispar
LFYNILNCFGYDVIGAGC

SEQ ID NO: 2399272 - protein, 26 aa, Entamoeba dispar
LFYSIIIICFFFYSLLSLLSFSSFII

SEQ ID NO: 2399273 - protein, 17 aa, Entamoeba dispar
LGAFIPFYEFKLFGIPV

SEQ ID NO: 2399274 - protein, 25 aa, Entamoeba dispar
LGALAWWYPKPWPESYWHIVSIIVI

SEQ ID NO: 2399275 - protein, 18 aa, Entamoeba dispar
LGCCLASVWTPFQKKSSC

SEQ ID NO: 2399276 - protein, 37 aa, Entamoeba dispar
LGCCLFIRVIPVEDLIILLSALVLQRKLLIKSKNRCI

SEQ ID NO: 2399277 - protein, 20 aa, Entamoeba dispar
LGCQLGCELCVSNKGCIECL

SEQ ID NO: 2399278 - protein, 19 aa, Entamoeba dispar
LGFIIAKICSLNFETTLRN

SEQ ID NO: 2399279 - protein, 23 aa, Entamoeba dispar
LGFIVVVMLVYINYIQKGINSSS

SEQ ID NO: 2399280 - protein, 26 aa, Entamoeba dispar
LGHYYCKELLFYQAQYYLKQKVYQKA

SEQ ID NO: 2399281 - protein, 24 aa, Entamoeba dispar
LGIDTLWCFFIGTSVFYSFTISIS

SEQ ID NO: 2399282 - protein, 27 aa, Entamoeba dispar
LGIGCGIIVFIILSIYYIISQITHKDV

SEQ ID NO: 2399283 - protein, 27 aa, Entamoeba dispar
LGIILPDTIYLLTLISLIICYKQRLSV

SEQ ID NO: 2399284 - protein, 17 aa, Entamoeba dispar
LGIIQYSYSNECTCTVS

SEQ ID NO: 2399285 - protein, 26 aa, Entamoeba dispar
LGIPRLYYHFFPLKAHIIQAPFTSVG

SEQ ID NO: 2399286 - protein, 26 aa, Entamoeba dispar
LGKNQFYYDYLSLLSIESFCLIILKR

SEQ ID NO: 2399287 - protein, 28 aa, Entamoeba dispar
LGKPCYLMYMQLIGYLLLIGMELHDKIY

SEQ ID NO: 2399288 - protein, 18 aa, Entamoeba dispar
LGLDMKKGKQYEARIGIS

SEQ ID NO: 2399289 - protein, 31 aa, Entamoeba dispar
LGLQKMLCIISYFFVMILYPEKNEKVHFIRK

SEQ ID NO: 2399290 - protein, 43 aa, Entamoeba dispar
LGLQTVLLHYNFLNQFKFYQQKLVFQCFLYQIFNDWIYQIYQL

SEQ ID NO: 2399291 - protein, 26 aa, Entamoeba dispar
LGLSRLYYFLNPNNVEYFFAPYLSMK

SEQ ID NO: 2399292 - protein, 27 aa, Entamoeba dispar
LGPDDAIFPIYRLPKDQIKKEYPSEKE

SEQ ID NO: 2399293 - protein, 23 aa, Entamoeba dispar
LGRLFFPLLFTKGSDFVITLLLI

SEQ ID NO: 2399294 - protein, 25 aa, Entamoeba dispar
LGRRIPIINIFLSPFVFASLVVMCD

SEQ ID NO: 2399295 - protein, 30 aa, Entamoeba dispar
LGSIPWIELLPLFFPLSFVYSILQKLFQKC

SEQ ID NO: 2399296 - protein, 18 aa, Entamoeba dispar
LGSLFFKRGNVLRKILSN

SEQ ID NO: 2399297 - protein, 35 aa, Entamoeba dispar
LGSSAGLLFIIGLFILLFFILLRYERTNIEIFKQQ

SEQ ID NO: 2399298 - protein, 23 aa, Entamoeba dispar
LGSSSGPFILSYGGKDKSFTVTS

SEQ ID NO: 2399299 - protein, 25 aa, Entamoeba dispar
LGSSWYFIMYLFCGTMPLFGSYLFA

SEQ ID NO: 2399300 - protein, 27 aa, Entamoeba dispar
LGTIIDILIFTLFISIGLPGGFAQTLS

SEQ ID NO: 2399301 - protein, 40 aa, Entamoeba dispar
LGTILFALLVFLLPTSIIYYLYFTFVLMLVQLFKKILSVL

SEQ ID NO: 2399302 - protein, 35 aa, Entamoeba dispar
LGTILFNCRLSIYLPLFLKQFIPIIEQIQLYIKQP

SEQ ID NO: 2399303 - protein, 37 aa, Entamoeba dispar
LGVTTAIIVVFLMIVTFLTWLFISRCWKNKYTESEIP

SEQ ID NO: 2399304 - protein, 21 aa, Entamoeba dispar
LGWGIFTLIAAGLWIGVVFVG

SEQ ID NO: 2399305 - protein, 24 aa, Entamoeba dispar
LHARNYLHYNIKPSNILLISTNIN

SEQ ID NO: 2399306 - protein, 18 aa, Entamoeba dispar
LHCFISNSFILLALIIAF

SEQ ID NO: 2399307 - protein, 18 aa, Entamoeba dispar
LHCTTKIFGLKIHVSCYF

SEQ ID NO: 2399308 - protein, 32 aa, Entamoeba dispar
LHCTTKIMGMKIPYTVWFSKHSKTLLKIASLL

SEQ ID NO: 2399309 - protein, 21 aa, Entamoeba dispar
LHDGFLDISLLHISQFPLTSQ

SEQ ID NO: 2399310 - protein, 33 aa, Entamoeba dispar
LHEKKWLNIFFNWIPEMMFMICSFGYLCFLIIL

SEQ ID NO: 2399311 - protein, 18 aa, Entamoeba dispar
LHFAARLPFSYYYFVSFL

SEQ ID NO: 2399312 - protein, 29 aa, Entamoeba dispar
LHFGTVLVLFFFSFLYCLTKKVSWQPIPS

SEQ ID NO: 2399313 - protein, 24 aa, Entamoeba dispar
LHHYGLKKWSMIGLILHVIVIIII

SEQ ID NO: 2399314 - protein, 19 aa, Entamoeba dispar
LHKAFFMMSGEFLTYRVRK

SEQ ID NO: 2399315 - protein, 29 aa, Entamoeba dispar
LHKIFHHETLRLLQYPVINAILAGHNALV

SEQ ID NO: 2399316 - protein, 19 aa, Entamoeba dispar
LHLLLFCGCFILKIAIYFV

SEQ ID NO: 2399317 - protein, 28 aa, Entamoeba dispar
LHLPISQLHPIQFIPKVYSIKIKMPDYP

SEQ ID NO: 2399318 - protein, 29 aa, Entamoeba dispar
LHLTNPTKTIPYFISVTPNKLPLVGDSFY

SEQ ID NO: 2399319 - protein, 27 aa, Entamoeba dispar
LHNDGTLLWYKFLPVNWELNQLDLTTF

SEQ ID NO: 2399320 - protein, 19 aa, Entamoeba dispar
LHQFVYFYEINVPTISPMT

SEQ ID NO: 2399321 - protein, 26 aa, Entamoeba dispar
LHQNKPILMIQLNLKPFIISKCKVHS

SEQ ID NO: 2399322 - protein, 29 aa, Entamoeba dispar
LHRDIKPDNLLIFSLDKNVPVFAKITDFG

SEQ ID NO: 2399323 - protein, 25 aa, Entamoeba dispar
LHRSHTFILPSPPQQTIWDVETPLN

SEQ ID NO: 2399324 - protein, 20 aa, Entamoeba dispar
LHWRPSLHKLGKITSLLFSV

SEQ ID NO: 2399325 - protein, 20 aa, Entamoeba dispar
LIACIYLVFSNKFLLPSHVK

SEQ ID NO: 2399326 - protein, 27 aa, Entamoeba dispar
LIAGVFYYHFWLLCILFCIARTSFELV

SEQ ID NO: 2399327 - protein, 18 aa, Entamoeba dispar
LIASFQKFKLITTSGKPT

SEQ ID NO: 2399328 - protein, 30 aa, Entamoeba dispar
LIDKDLIGIRFFYYIHLISSGFSKQQELLW

SEQ ID NO: 2399329 - protein, 24 aa, Entamoeba dispar
LIDKMKVLYKNYVDVAYALNPAYK

SEQ ID NO: 2399330 - protein, 25 aa, Entamoeba dispar
LIEEKKYFDIFHFKPIGFIGQIEIF

SEQ ID NO: 2399331 - protein, 26 aa, Entamoeba dispar
LIEIILIFITCILWIFVIINNSEVKE

SEQ ID NO: 2399332 - protein, 17 aa, Entamoeba dispar
LIEPNDNLPTEPLFGVF

SEQ ID NO: 2399333 - protein, 22 aa, Entamoeba dispar
LIFCFAGWYYLVHHQRVSDLEL

SEQ ID NO: 2399334 - protein, 29 aa, Entamoeba dispar
LIFDIAHAAIMFYSFYSFQINCDNYDFAK

SEQ ID NO: 2399335 - protein, 32 aa, Entamoeba dispar
LIFDSDIYIRTLILFLPLLIVFNKERIDKNVR

SEQ ID NO: 2399336 - protein, 19 aa, Entamoeba dispar
LIFISNALIPLSTCFEGTS

SEQ ID NO: 2399337 - protein, 26 aa, Entamoeba dispar
LIFPEKFFVLYISVAIWPFCTAFYWP

SEQ ID NO: 2399338 - protein, 25 aa, Entamoeba dispar
LIFSFIITLFLLQVLIYTPKVSLDV

SEQ ID NO: 2399339 - protein, 23 aa, Entamoeba dispar
LIGLLRGILRRRKDLKVVVMSAT

SEQ ID NO: 2399340 - protein, 19 aa, Entamoeba dispar
LIGMYAYLDILQSPLKEDQ

SEQ ID NO: 2399341 - protein, 21 aa, Entamoeba dispar
LIGSLFIAVFCGVTSLLTGNT

SEQ ID NO: 2399342 - protein, 52 aa, Entamoeba dispar
LIGSLLQVFLCVYSAIMVILWGARKWLDVSFSSFFIVSFILCCIACFGVFIF

SEQ ID NO: 2399343 - protein, 29 aa, Entamoeba dispar
LIGTNHIWPLTFVSVPPLEALKPIIVMFV

SEQ ID NO: 2399344 - protein, 26 aa, Entamoeba dispar
LIHFFLGVFLCFFALKTNSLLVLSFL

SEQ ID NO: 2399345 - protein, 17 aa, Entamoeba dispar
LIHNFRLECPIKEKFHC

SEQ ID NO: 2399346 - protein, 18 aa, Entamoeba dispar
LIHYVIAEKYDCIPLGSS

SEQ ID NO: 2399347 - protein, 21 aa, Entamoeba dispar
LIIFFYFSLSYSFTQNFKFMS

SEQ ID NO: 2399348 - protein, 27 aa, Entamoeba dispar
LIIGGNFRHFLNAVLVILGCLLCIPYI

SEQ ID NO: 2399349 - protein, 26 aa, Entamoeba dispar
LIIGGNFRHFLNGGLVILGCLLCIPY

SEQ ID NO: 2399350 - protein, 27 aa, Entamoeba dispar
LIIIFTIVVIIILGYSIFICFKVKHPT

SEQ ID NO: 2399351 - protein, 24 aa, Entamoeba dispar
LIIIIIIIIIIIIMINYIIKRKEK

SEQ ID NO: 2399352 - protein, 19 aa, Entamoeba dispar
LIIIILSFNIEISSLFATL

SEQ ID NO: 2399353 - protein, 23 aa, Entamoeba dispar
LIIMGSLIYGMILGAITGFYQMA

SEQ ID NO: 2399354 - protein, 23 aa, Entamoeba dispar
LIIMIPFCVFIYRFEWTLDNNQV

SEQ ID NO: 2399355 - protein, 30 aa, Entamoeba dispar
LIINVIILPIYILYRPLYQWIFQRVTEVYM

SEQ ID NO: 2399356 - protein, 24 aa, Entamoeba dispar
LIIPSFLYILWQIIYLIITEGFKK

SEQ ID NO: 2399357 - protein, 17 aa, Entamoeba dispar
LIISDLVPQLFMENFFK

SEQ ID NO: 2399358 - protein, 18 aa, Entamoeba dispar
LIISINDLIYYFILICCI

SEQ ID NO: 2399359 - protein, 29 aa, Entamoeba dispar
LIISLIFICIGIYLFFKIKTLQPTQPLQH

SEQ ID NO: 2399360 - protein, 28 aa, Entamoeba dispar
LIIVSCIAENFIRFPYPGLPSTDIDGKK

SEQ ID NO: 2399361 - protein, 19 aa, Entamoeba dispar
LIIWKSDYIHLYKDKEFIN

SEQ ID NO: 2399362 - protein, 17 aa, Entamoeba dispar
LIIYDSEKKSFLNQEIW

SEQ ID NO: 2399363 - protein, 26 aa, Entamoeba dispar
LIKDFLVIFFLIIVTRTSFFWGRVYK

SEQ ID NO: 2399364 - protein, 20 aa, Entamoeba dispar
LIKELMQLYSLLPLTQSSQL

SEQ ID NO: 2399365 - protein, 18 aa, Entamoeba dispar
LIKGFWFRIKGAEQTIVI

SEQ ID NO: 2399366 - protein, 27 aa, Entamoeba dispar
LIKIKVPYHYIFLNFGDWVMTNYIFIA

SEQ ID NO: 2399367 - protein, 25 aa, Entamoeba dispar
LIKQDDLFHYYFYDPSVITILKQEV

SEQ ID NO: 2399368 - protein, 23 aa, Entamoeba dispar
LILCFVGWYFLIKNQSISSLELL

SEQ ID NO: 2399369 - protein, 18 aa, Entamoeba dispar
LILFANSKSLLGIETKDV

SEQ ID NO: 2399370 - protein, 20 aa, Entamoeba dispar
LILFLQYYIHQHHDPFFLDF

SEQ ID NO: 2399371 - protein, 18 aa, Entamoeba dispar
LILFPPEILPYIPSNVII

SEQ ID NO: 2399372 - protein, 18 aa, Entamoeba dispar
LILISFYSLLFSSLFIHN

SEQ ID NO: 2399373 - protein, 19 aa, Entamoeba dispar
LILLIRITAEEVSKKEYDN

SEQ ID NO: 2399374 - protein, 34 aa, Entamoeba dispar
LILRIFNMLFLYKIPIKIRLLFSTIFNLIGLFGI

SEQ ID NO: 2399375 - protein, 20 aa, Entamoeba dispar
LILTFYLWIEAVYNNSPILS

SEQ ID NO: 2399376 - protein, 23 aa, Entamoeba dispar
LILTLFVLWNFKVGQPALLYLVP

SEQ ID NO: 2399377 - protein, 17 aa, Entamoeba dispar
LIMEPRIFTRLMTQNNK

SEQ ID NO: 2399378 - protein, 17 aa, Entamoeba dispar
LIMKKLDMPIQKNTMRY

SEQ ID NO: 2399379 - protein, 25 aa, Entamoeba dispar
LINKQKPLEYLRTLSNKLISLKNAN

SEQ ID NO: 2399380 - protein, 19 aa, Entamoeba dispar
LINLFEQLAIFIRKSVQSK

SEQ ID NO: 2399381 - protein, 18 aa, Entamoeba dispar
LINLHLPLISKDISFNRT

SEQ ID NO: 2399382 - protein, 18 aa, Entamoeba dispar
LINPICIILYAWASWSFF

SEQ ID NO: 2399383 - protein, 21 aa, Entamoeba dispar
LINTFLFLRVIYCKCSFVMTR

SEQ ID NO: 2399384 - protein, 17 aa, Entamoeba dispar
LINYINADGYDCIPKGY

SEQ ID NO: 2399385 - protein, 18 aa, Entamoeba dispar
LIPFDNLPRHLLVAFLYD

SEQ ID NO: 2399386 - protein, 19 aa, Entamoeba dispar
LIPIILDVCGFYKIIQFSF

SEQ ID NO: 2399387 - protein, 20 aa, Entamoeba dispar
LIPILYLMLLIPLVTARFLV

SEQ ID NO: 2399388 - protein, 23 aa, Entamoeba dispar
LIPTLLMFFAISKLLGFTLSIEY

SEQ ID NO: 2399389 - protein, 17 aa, Entamoeba dispar
LIQFFQKNRNIILKINK

SEQ ID NO: 2399390 - protein, 20 aa, Entamoeba dispar
LIRYTALFISIIIPFVLGSI

SEQ ID NO: 2399391 - protein, 21 aa, Entamoeba dispar
LISCLELFLEWVRGTKYISNF

SEQ ID NO: 2399392 - protein, 20 aa, Entamoeba dispar
LISFFYFTMFIVHTFIEGGP

SEQ ID NO: 2399393 - protein, 20 aa, Entamoeba dispar
LISFLLILISFYSLLFSSLF

SEQ ID NO: 2399394 - protein, 18 aa, Entamoeba dispar
LISFVMSESIIITTLKSS

SEQ ID NO: 2399395 - protein, 31 aa, Entamoeba dispar
LISIHQIMRFLLMISYVYPSLVFTDGPFFPW

SEQ ID NO: 2399396 - protein, 19 aa, Entamoeba dispar
LISKVIGLVFVLGGGMWAG

SEQ ID NO: 2399397 - protein, 20 aa, Entamoeba dispar
LISLIISIGMPWLVFEVLYP

SEQ ID NO: 2399398 - protein, 22 aa, Entamoeba dispar
LISNDFFILWKLVDVSHSSNFE

SEQ ID NO: 2399399 - protein, 25 aa, Entamoeba dispar
LISNTFCIGLLHKELKGYLWVLVIG

SEQ ID NO: 2399400 - protein, 22 aa, Entamoeba dispar
LISSPFFEGIFFEAINSIQFNC

SEQ ID NO: 2399401 - protein, 19 aa, Entamoeba dispar
LISVIIGSIILLFAIVIIS

SEQ ID NO: 2399402 - protein, 19 aa, Entamoeba dispar
LISWVRIFSQLQTENYQWS

SEQ ID NO: 2399403 - protein, 17 aa, Entamoeba dispar
LISYLWNGMISLIIIYF

SEQ ID NO: 2399404 - protein, 22 aa, Entamoeba dispar
LITKLRKIPIKIEVWKLILERR

SEQ ID NO: 2399405 - protein, 30 aa, Entamoeba dispar
LITLHLIAFLVFLCLYISFPLTITETPRNL

SEQ ID NO: 2399406 - protein, 25 aa, Entamoeba dispar
LITRGVFCFIRKSGNIYALLNNEEI

SEQ ID NO: 2399407 - protein, 26 aa, Entamoeba dispar
LIVAQQLIFFDYSMFKVIQPIQFYHY

SEQ ID NO: 2399408 - protein, 27 aa, Entamoeba dispar
LIVGFSFFLLLVVGIVFIYLIGGSLNS

SEQ ID NO: 2399409 - protein, 25 aa, Entamoeba dispar
LIVMLILLLPILLLCHADSDAQKYT

SEQ ID NO: 2399410 - protein, 19 aa, Entamoeba dispar
LIVPKSFTSGILKLYDFVG

SEQ ID NO: 2399411 - protein, 25 aa, Entamoeba dispar
LIVSPTLNIIPWELLEPFKNCVRYF

SEQ ID NO: 2399412 - protein, 35 aa, Entamoeba dispar
LIVTSWSCAIGEYFFYFSCYGCPNGYFCPGDDYDY

SEQ ID NO: 2399413 - protein, 19 aa, Entamoeba dispar
LIWRGLYFINTYSYFRIFI

SEQ ID NO: 2399414 - protein, 21 aa, Entamoeba dispar
LIWYCVAIPSIKLIEKFPYEE

SEQ ID NO: 2399415 - protein, 22 aa, Entamoeba dispar
LIYASFFTLLFLIPFLICGPRL

SEQ ID NO: 2399416 - protein, 17 aa, Entamoeba dispar
LIYFVIAGYKSSINNQQ

SEQ ID NO: 2399417 - protein, 21 aa, Entamoeba dispar
LIYLCYSFKCSPGCIGGCEAD

SEQ ID NO: 2399418 - protein, 18 aa, Entamoeba dispar
LKAFGISLFFLSALGIRM

SEQ ID NO: 2399419 - protein, 24 aa, Entamoeba dispar
LKALQMLWVNMIMDTLAALALGTE

SEQ ID NO: 2399420 - protein, 26 aa, Entamoeba dispar
LKEFIIILFIIILSRTSYFWGEKYKK

SEQ ID NO: 2399421 - protein, 22 aa, Entamoeba dispar
LKEGVLYYIRATCIISDCAVTL

SEQ ID NO: 2399422 - protein, 36 aa, Entamoeba dispar
LKELSILYPLIFFPTHLKMVFKYIFSLEITSELELP

SEQ ID NO: 2399423 - protein, 21 aa, Entamoeba dispar
LKEYENSPLMPKFKELNEKLG

SEQ ID NO: 2399424 - protein, 26 aa, Entamoeba dispar
LKFIIYSILFYIQYTNAFVESINTPC

SEQ ID NO: 2399425 - protein, 21 aa, Entamoeba dispar
LKGIYLPKSLILMKTQWDNKI

SEQ ID NO: 2399426 - protein, 25 aa, Entamoeba dispar
LKHGLPYFCFTLMSFINILLVPNTF

SEQ ID NO: 2399427 - protein, 19 aa, Entamoeba dispar
LKHHIEYTLNKQLDGKGNV

SEQ ID NO: 2399428 - protein, 31 aa, Entamoeba dispar
LKHQNMFFIRFLFMLLLTFHCSFTVFLGSRR

SEQ ID NO: 2399429 - protein, 17 aa, Entamoeba dispar
LKHYLEAYVFKDILKNP

SEQ ID NO: 2399430 - protein, 22 aa, Entamoeba dispar
LKKIKAYFHITNFGKRLLKNQG

SEQ ID NO: 2399431 - protein, 18 aa, Entamoeba dispar
LKKIKLTYEQKLKFMIDC

SEQ ID NO: 2399432 - protein, 19 aa, Entamoeba dispar
LKKKYVFQLFVGNKSLNIC

SEQ ID NO: 2399433 - protein, 17 aa, Entamoeba dispar
LKKPKLYFRGCILAIIG

SEQ ID NO: 2399434 - protein, 22 aa, Entamoeba dispar
LKKQFIFCTEPFRIPFAGIVDI

SEQ ID NO: 2399435 - protein, 30 aa, Entamoeba dispar
LKKSKNMYFLYSILLFIATFCFCFMLSFWF

SEQ ID NO: 2399436 - protein, 23 aa, Entamoeba dispar
LKLHAQLLVFTPTCGISLESILE

SEQ ID NO: 2399437 - protein, 26 aa, Entamoeba dispar
LKLLNNPDLCLVSCAVMILLVIVEKD

SEQ ID NO: 2399438 - protein, 20 aa, Entamoeba dispar
LKNIIFFFPNLIVDWTIPIF

SEQ ID NO: 2399439 - protein, 26 aa, Entamoeba dispar
LKNKTYIYLGYIMQLGLFGASCVITN

SEQ ID NO: 2399440 - protein, 28 aa, Entamoeba dispar
LKNNNIPLLRKTLQLIPPYLVQRPQIEG

SEQ ID NO: 2399441 - protein, 36 aa, Entamoeba dispar
LKPIIVMFVGFYHKKYIKRMLRFLHKSSIYNIQFNG

SEQ ID NO: 2399442 - protein, 22 aa, Entamoeba dispar
LKSHKLQFVGPLLNLLVKHYSG

SEQ ID NO: 2399443 - protein, 24 aa, Entamoeba dispar
LKSKSAIILQPLLSIILMTPEDFV

SEQ ID NO: 2399444 - protein, 21 aa, Entamoeba dispar
LKTRDIFGEESLYTVLSLVGE

SEQ ID NO: 2399445 - protein, 33 aa, Entamoeba dispar
LKTRWYVVLSSFIGWYLAFLSPLLMPLDIVSTF

SEQ ID NO: 2399446 - protein, 22 aa, Entamoeba dispar
LKTSTLRTYLEKEVPIRCSMLM

SEQ ID NO: 2399447 - protein, 29 aa, Entamoeba dispar
LKYINIAIIIIGIFLLFHGITNALFSKHP

SEQ ID NO: 2399448 - protein, 19 aa, Entamoeba dispar
LKYIRVLVACLPQFNQNDL

SEQ ID NO: 2399449 - protein, 38 aa, Entamoeba dispar
LLAIGILINIILILPLVLFIWRFVIRRIIHPNPIQKYH

SEQ ID NO: 2399450 - protein, 25 aa, Entamoeba dispar
LLALHIYWFYLIIQMLIHLISGKGA

SEQ ID NO: 2399451 - protein, 17 aa, Entamoeba dispar
LLALNKMNIIKSPEFLL

SEQ ID NO: 2399452 - protein, 18 aa, Entamoeba dispar
LLALQIDNLFYKLDNENN

SEQ ID NO: 2399453 - protein, 55 aa, Entamoeba dispar
LLAMKHHRPFYLFTSYIVFVLYCWYYSYSLIIILLPLFIYLISFIIETDDYPHTY

SEQ ID NO: 2399454 - protein, 17 aa, Entamoeba dispar
LLAMVYLPQIFFYLLFY

SEQ ID NO: 2399455 - protein, 18 aa, Entamoeba dispar
LLAMVYLPQIFFYLLFYP

SEQ ID NO: 2399456 - protein, 17 aa, Entamoeba dispar
LLAPIFRELQCLVNVIL

SEQ ID NO: 2399457 - protein, 25 aa, Entamoeba dispar
LLASKQLIYPFFGSPLFLSNVCSLH

SEQ ID NO: 2399458 - protein, 20 aa, Entamoeba dispar
LLAVFATKFTVLGEEYLASA

SEQ ID NO: 2399459 - protein, 18 aa, Entamoeba dispar
LLCKMKLVILQNRYVPWI

SEQ ID NO: 2399460 - protein, 18 aa, Entamoeba dispar
LLDDILSVSFQKIIKDNQ

SEQ ID NO: 2399461 - protein, 19 aa, Entamoeba dispar
LLDIFFNFNHNCTIFRQVA

SEQ ID NO: 2399462 - protein, 20 aa, Entamoeba dispar
LLDIIKNFFGFQFKEEVKKK

SEQ ID NO: 2399463 - protein, 25 aa, Entamoeba dispar
LLDIMCNMFQKHIFYKGFSLTTFLK

SEQ ID NO: 2399464 - protein, 18 aa, Entamoeba dispar
LLFEDFSTEAIFKGDGYL

SEQ ID NO: 2399465 - protein, 24 aa, Entamoeba dispar
LLFFYFFIYLLFRIIYFSLLSLLL

SEQ ID NO: 2399466 - protein, 21 aa, Entamoeba dispar
LLFGTLAIIIALNGNFPFIWG

SEQ ID NO: 2399467 - protein, 18 aa, Entamoeba dispar
LLFIICLVWFMFRMTHYH

SEQ ID NO: 2399468 - protein, 37 aa, Entamoeba dispar
LLFKRRGIAVIPNYVFWLSLPMLIKDGCKFIFCCKKP

SEQ ID NO: 2399469 - protein, 19 aa, Entamoeba dispar
LLFLFHVLLLFLFSLISFY

SEQ ID NO: 2399470 - protein, 27 aa, Entamoeba dispar
LLFLIFLFFIYFLLFLSLYSFFTLITL

SEQ ID NO: 2399471 - protein, 24 aa, Entamoeba dispar
LLFNFSAYFLWTVIPLKANDLGAS

SEQ ID NO: 2399472 - protein, 19 aa, Entamoeba dispar
LLFYTLYVPTIDSIVIIFI

SEQ ID NO: 2399473 - protein, 19 aa, Entamoeba dispar
LLGIFTRMALFTTAVSLIF

SEQ ID NO: 2399474 - protein, 20 aa, Entamoeba dispar
LLGIILCVYSLIPKPTMGIV

SEQ ID NO: 2399475 - protein, 28 aa, Entamoeba dispar
LLGLVMCLCFMMIGISYIKNIFKRAFFH

SEQ ID NO: 2399476 - protein, 19 aa, Entamoeba dispar
LLGNWFVITAPENKTLLVF

SEQ ID NO: 2399477 - protein, 29 aa, Entamoeba dispar
LLGSILIYGYPLVLNIILITLQLCDHPPL

SEQ ID NO: 2399478 - protein, 25 aa, Entamoeba dispar
LLHSKNYLHYNIKPANVLLISDDLN

SEQ ID NO: 2399479 - protein, 20 aa, Entamoeba dispar
LLICVTLVFIIFHRNQIKAK

SEQ ID NO: 2399480 - protein, 18 aa, Entamoeba dispar
LLIFTHFTYNLFPMTFFG

SEQ ID NO: 2399481 - protein, 17 aa, Entamoeba dispar
LLIGILIFSICLLLHCF

SEQ ID NO: 2399482 - protein, 26 aa, Entamoeba dispar
LLIGTVIFLVFFFNGLLQIELIPLAP

SEQ ID NO: 2399483 - protein, 40 aa, Entamoeba dispar
LLIICIPGIIVYEIVLVIILIIFLIQYHLLNDKIIFEQKE

SEQ ID NO: 2399484 - protein, 22 aa, Entamoeba dispar
LLIIFMLFMPEMFVTAFMSFVL

SEQ ID NO: 2399485 - protein, 19 aa, Entamoeba dispar
LLIIGIIGSIGVGCLNPLI

SEQ ID NO: 2399486 - protein, 17 aa, Entamoeba dispar
LLILACDGVWDVLTNEE

SEQ ID NO: 2399487 - protein, 18 aa, Entamoeba dispar
LLILIPESNCLQIDSPCI

SEQ ID NO: 2399488 - protein, 17 aa, Entamoeba dispar
LLIVFNKERIDKNVRRL

SEQ ID NO: 2399489 - protein, 19 aa, Entamoeba dispar
LLKQAWEPLLSIVLNIEII

SEQ ID NO: 2399490 - protein, 24 aa, Entamoeba dispar
LLKQKSIIMNIKKLKIKMIVHATS

SEQ ID NO: 2399491 - protein, 22 aa, Entamoeba dispar
LLKTFSTFHYNSIVCLTICEEN

SEQ ID NO: 2399492 - protein, 17 aa, Entamoeba dispar
LLLCCLADKLNEFSADI

SEQ ID NO: 2399493 - protein, 18 aa, Entamoeba dispar
LLLEKVHFDIKITTLKKL

SEQ ID NO: 2399494 - protein, 19 aa, Entamoeba dispar
LLLFDIILLYRKLILGWYS

SEQ ID NO: 2399495 - protein, 20 aa, Entamoeba dispar
LLLIFITLIFSSNSYECSVG

SEQ ID NO: 2399496 - protein, 18 aa, Entamoeba dispar
LLLINYALAATCTASEEN

SEQ ID NO: 2399497 - protein, 29 aa, Entamoeba dispar
LLLLFILFSMGQYIGLFPSNHECSMNESC

SEQ ID NO: 2399498 - protein, 21 aa, Entamoeba dispar
LLLLMDGLQWFACGLVSFLTC

SEQ ID NO: 2399499 - protein, 19 aa, Entamoeba dispar
LLLMIFERIKFDELFFECI

SEQ ID NO: 2399500 - protein, 27 aa, Entamoeba dispar
LLLSCLLHPFYFITFALDNPITLHIDH

SEQ ID NO: 2399501 - protein, 35 aa, Entamoeba dispar
LLLSSLKCFLNWRLVLLFPLALLFGFSRSFYYTSM

SEQ ID NO: 2399502 - protein, 20 aa, Entamoeba dispar
LLLVCRMFFYILPPTTSSEK

SEQ ID NO: 2399503 - protein, 21 aa, Entamoeba dispar
LLLVLHIGVVILPFIGIIYGE

SEQ ID NO: 2399504 - protein, 19 aa, Entamoeba dispar
LLNEKIPITLRYGQLGNIL

SEQ ID NO: 2399505 - protein, 24 aa, Entamoeba dispar
LLNHFIPIPLIFNSILKFFGVRDH

SEQ ID NO: 2399506 - protein, 19 aa, Entamoeba dispar
LLNNYAMIVGGALIGSSGA

SEQ ID NO: 2399507 - protein, 21 aa, Entamoeba dispar
LLNRPYSLPIDVYAFAIVSYE

SEQ ID NO: 2399508 - protein, 18 aa, Entamoeba dispar
LLPITIHLPTDKKMLLLG

SEQ ID NO: 2399509 - protein, 32 aa, Entamoeba dispar
LLPVTVYLEAPLQRFFKYPKIFGNLLSSVDPK

SEQ ID NO: 2399510 - protein, 19 aa, Entamoeba dispar
LLQICSCPIFVYIKKPDLF

SEQ ID NO: 2399511 - protein, 18 aa, Entamoeba dispar
LLQIGMTRLILNTKSKLP

SEQ ID NO: 2399512 - protein, 19 aa, Entamoeba dispar
LLQPNLFIEFINYTKDKNP

SEQ ID NO: 2399513 - protein, 23 aa, Entamoeba dispar
LLQVVLVFWILMSEFFSFTQVMN

SEQ ID NO: 2399514 - protein, 18 aa, Entamoeba dispar
LLRLLKISITSVSIACQC

SEQ ID NO: 2399515 - protein, 20 aa, Entamoeba dispar
LLRLLKISITSVSIACQCHI

SEQ ID NO: 2399516 - protein, 24 aa, Entamoeba dispar
LLRTFAICLIPFYEVYHGCSCWCN

SEQ ID NO: 2399517 - protein, 17 aa, Entamoeba dispar
LLSFLTYHTFSHRFSTI

SEQ ID NO: 2399518 - protein, 17 aa, Entamoeba dispar
LLSIESFCLIILKRSII

SEQ ID NO: 2399519 - protein, 17 aa, Entamoeba dispar
LLSKQMLIKIAIQVIYQ

SEQ ID NO: 2399520 - protein, 27 aa, Entamoeba dispar
LLSLPTLLLLFLFPFDFNISAIELILL

SEQ ID NO: 2399521 - protein, 23 aa, Entamoeba dispar
LLSLYFFFLFLLLLVCHFHYMIV

SEQ ID NO: 2399522 - protein, 26 aa, Entamoeba dispar
LLSLYLLIPFLFVTIVLFYYNKFPSK

SEQ ID NO: 2399523 - protein, 18 aa, Entamoeba dispar
LLSMSLSSTMEYLRTIPF

SEQ ID NO: 2399524 - protein, 23 aa, Entamoeba dispar
LLSQLYTFIIKNPIEKYHLLAPL

SEQ ID NO: 2399525 - protein, 19 aa, Entamoeba dispar
LLSVFNWPIDWISFAFLLF

SEQ ID NO: 2399526 - protein, 19 aa, Entamoeba dispar
LLSYVSPKQFFLTSFVMFN

SEQ ID NO: 2399527 - protein, 21 aa, Entamoeba dispar
LLTTLIISGGILITITGGAYL

SEQ ID NO: 2399528 - protein, 22 aa, Entamoeba dispar
LLTVLLKPFQRYRYYEPKLIIL

SEQ ID NO: 2399529 - protein, 18 aa, Entamoeba dispar
LLVGMLCSLLILHIYWFK

SEQ ID NO: 2399530 - protein, 18 aa, Entamoeba dispar
LLVGVVIGFLIFNKAKKK

SEQ ID NO: 2399531 - protein, 20 aa, Entamoeba dispar
LLVLIVIFTVKFFDGMIYIK

SEQ ID NO: 2399532 - protein, 32 aa, Entamoeba dispar
LLVNDVKIFYCKYNDPLYIKIEKLEIIVALAN

SEQ ID NO: 2399533 - protein, 25 aa, Entamoeba dispar
LLVPSFVHLFGELNWWPIKYKIDTT

SEQ ID NO: 2399534 - protein, 26 aa, Entamoeba dispar
LLVRTICYTYFLYSLIIDELGDIIHN

SEQ ID NO: 2399535 - protein, 17 aa, Entamoeba dispar
LLVVDQMEKEMDTFTIW

SEQ ID NO: 2399536 - protein, 20 aa, Entamoeba dispar
LLYKYIPSVDLLKKTLATIL

SEQ ID NO: 2399537 - protein, 26 aa, Entamoeba dispar
LLYNYAAFLFWLVVPLVATKQDASNW

SEQ ID NO: 2399538 - protein, 19 aa, Entamoeba dispar
LLYQLFLQVPFKFQSLLNS

SEQ ID NO: 2399539 - protein, 23 aa, Entamoeba dispar
LLYTFHGKENPKYKLIFSPTTGA

SEQ ID NO: 2399540 - protein, 28 aa, Entamoeba dispar
LLYTHMPFTRILPLFQLRVAQPPTTVRD

SEQ ID NO: 2399541 - protein, 18 aa, Entamoeba dispar
LMAGLLSQPIMQLNKLPG

SEQ ID NO: 2399542 - protein, 18 aa, Entamoeba dispar
LMAIILWTNSFVFHDLTK

SEQ ID NO: 2399543 - protein, 40 aa, Entamoeba dispar
LMARVIYLRDFIIKTAKKFYQMMYWIIGIPAVAVEYNPIT

SEQ ID NO: 2399544 - protein, 19 aa, Entamoeba dispar
LMDCIWRFLETPFKFRMEK

SEQ ID NO: 2399545 - protein, 18 aa, Entamoeba dispar
LMELKKTYFSIEDYPIFL

SEQ ID NO: 2399546 - protein, 24 aa, Entamoeba dispar
LMESWRRSIIFSEKLKQITKRQTN

SEQ ID NO: 2399547 - protein, 27 aa, Entamoeba dispar
LMFINDNLWILWIMGIMYAFSYVLFWI

SEQ ID NO: 2399548 - protein, 20 aa, Entamoeba dispar
LMFITTLTILIIFSILQAFS

SEQ ID NO: 2399549 - protein, 19 aa, Entamoeba dispar
LMIFRRKFNQLLKYDKNIF

SEQ ID NO: 2399550 - protein, 28 aa, Entamoeba dispar
LMITLMSLLILPLTFFKNLSALKFTSII

SEQ ID NO: 2399551 - protein, 29 aa, Entamoeba dispar
LMIYNSILLFSWLYNYFVFALDDIGRVII

SEQ ID NO: 2399552 - protein, 28 aa, Entamoeba dispar
LMKEEPTLFYLLEYFKSDGLLKQMYGVN

SEQ ID NO: 2399553 - protein, 31 aa, Entamoeba dispar
LMKKIKQWWVLLIILIIFSSFTPLGAIIGKF

SEQ ID NO: 2399554 - protein, 18 aa, Entamoeba dispar
LMKVLFNLALPCVIFRNL

SEQ ID NO: 2399555 - protein, 25 aa, Entamoeba dispar
LMLFDARWLLLGMGLMAIYCGIVFN

SEQ ID NO: 2399556 - protein, 20 aa, Entamoeba dispar
LMLFSSITLFFGMTPMIEQQ

SEQ ID NO: 2399557 - protein, 17 aa, Entamoeba dispar
LMLHKVIVYFTVNDTFH

SEQ ID NO: 2399558 - protein, 27 aa, Entamoeba dispar
LMLKYITIEQFIYTLLIMFNVIESTNE

SEQ ID NO: 2399559 - protein, 23 aa, Entamoeba dispar
LMLNQFAFILMFSVLLDTFIIRS

SEQ ID NO: 2399560 - protein, 17 aa, Entamoeba dispar
LMMSLSCIFIIPVAFSS

SEQ ID NO: 2399561 - protein, 24 aa, Entamoeba dispar
LMNRSFIVYIVLSIIALLPFITTC

SEQ ID NO: 2399562 - protein, 21 aa, Entamoeba dispar
LMNVILYLPTINELINFLQVS

SEQ ID NO: 2399563 - protein, 25 aa, Entamoeba dispar
LMSLTTIWTYKRSLFLIGQIIIMLL

SEQ ID NO: 2399564 - protein, 24 aa, Entamoeba dispar
LMSSFNSIFYYQLNNPPTCSSINL

SEQ ID NO: 2399565 - protein, 18 aa, Entamoeba dispar
LMTTFWQYRTPPVNSIHE

SEQ ID NO: 2399566 - protein, 18 aa, Entamoeba dispar
LMWLSQQLDPFIKTNSEE

SEQ ID NO: 2399567 - protein, 20 aa, Entamoeba dispar
LNDIVFTSLRYSHQKKYLFL

SEQ ID NO: 2399568 - protein, 17 aa, Entamoeba dispar
LNDKNFILLKRSMLIFN

SEQ ID NO: 2399569 - protein, 20 aa, Entamoeba dispar
LNDLLLLKTYLLQNPNHYSS

SEQ ID NO: 2399570 - protein, 32 aa, Entamoeba dispar
LNEKTINFLVKSNDFMLVMGPSTQINSNTLEV

SEQ ID NO: 2399571 - protein, 18 aa, Entamoeba dispar
LNEKVPITLRYGQLGNIL

SEQ ID NO: 2399572 - protein, 30 aa, Entamoeba dispar
LNENNEITLFYYFLPFTINIDNDKKMYLTP

SEQ ID NO: 2399573 - protein, 22 aa, Entamoeba dispar
LNESFIIQPIKMTKSIAFCMFE

SEQ ID NO: 2399574 - protein, 30 aa, Entamoeba dispar
LNFDYISMTTLTCLFLDFIILAQSNQITTF

SEQ ID NO: 2399575 - protein, 17 aa, Entamoeba dispar
LNFFFKNIPEMTVESIR

SEQ ID NO: 2399576 - protein, 25 aa, Entamoeba dispar
LNFKFTTILYFPKTLTSLMIDNCGA

SEQ ID NO: 2399577 - protein, 26 aa, Entamoeba dispar
LNFVELLYFYLCQYFSFILNIIILAY

SEQ ID NO: 2399578 - protein, 25 aa, Entamoeba dispar
LNFYFSLRLLFVFALVFEISFIYTI

SEQ ID NO: 2399579 - protein, 33 aa, Entamoeba dispar
LNFYNAPLIPFWRSIFYMIFRVPFKVMFHCAYL

SEQ ID NO: 2399580 - protein, 18 aa, Entamoeba dispar
LNIIPLLMMGSISVGGFG

SEQ ID NO: 2399581 - protein, 21 aa, Entamoeba dispar
LNIIVQIFIGAICLALIYLRN

SEQ ID NO: 2399582 - protein, 19 aa, Entamoeba dispar
LNILFPAIGRGTFGNVYKA

SEQ ID NO: 2399583 - protein, 35 aa, Entamoeba dispar
LNIQQENLYLLLTLLQQFGICYILTKQFATIVNEE

SEQ ID NO: 2399584 - protein, 31 aa, Entamoeba dispar
LNKPKSELTNFFYFLPFTINIDNDKKMYLIP

SEQ ID NO: 2399585 - protein, 18 aa, Entamoeba dispar
LNLDNVLIYPSYSFKTCE

SEQ ID NO: 2399586 - protein, 19 aa, Entamoeba dispar
LNLKMIYTDYLLSSLKSND

SEQ ID NO: 2399587 - protein, 34 aa, Entamoeba dispar
LNMLLSVIHFNIYRIFYIYNSLSTTLFPILNSIS

SEQ ID NO: 2399588 - protein, 27 aa, Entamoeba dispar
LNNFFLTFIGFAVFALITLGILIGMES

SEQ ID NO: 2399589 - protein, 19 aa, Entamoeba dispar
LNQCLSCKTKLLLNGICTL

SEQ ID NO: 2399590 - protein, 30 aa, Entamoeba dispar
LNQIQTKFNFLILLKFLIVKEIIEECKEEM

SEQ ID NO: 2399591 - protein, 19 aa, Entamoeba dispar
LNQKPIFISSPLILTDLSS

SEQ ID NO: 2399592 - protein, 18 aa, Entamoeba dispar
LNQRELFYQLHFLDSLEK

SEQ ID NO: 2399593 - protein, 26 aa, Entamoeba dispar
LNQRITEFPYFTPILNVNEFTQTKDK

SEQ ID NO: 2399594 - protein, 20 aa, Entamoeba dispar
LNQTWYEKLGRWQQALNIYE

SEQ ID NO: 2399595 - protein, 25 aa, Entamoeba dispar
LNQYLPFYILMIVGVINSMLMLLTP

SEQ ID NO: 2399596 - protein, 26 aa, Entamoeba dispar
LNSMQMLWVNLIMDTLAALALGTEKP

SEQ ID NO: 2399597 - protein, 28 aa, Entamoeba dispar
LNSQHKYILSIAFFLIGGAITEAIQISF

SEQ ID NO: 2399598 - protein, 22 aa, Entamoeba dispar
LNTFYCCIAFLSKQSIYYSNKK

SEQ ID NO: 2399599 - protein, 26 aa, Entamoeba dispar
LNTTYNTLYYIFISGIHKSTGSYFLQ

SEQ ID NO: 2399600 - protein, 44 aa, Entamoeba dispar
LNVFYSCLLLYKHFYIIQSPQLFHPRFIMIACFCFGKKLEEFRF

SEQ ID NO: 2399601 - protein, 28 aa, Entamoeba dispar
LNVGYWFPLLFCLPFVLYFTFIPTFNFC

SEQ ID NO: 2399602 - protein, 31 aa, Entamoeba dispar
LNVRKSFRFILPRALLLLTLFILVFTELMYN

SEQ ID NO: 2399603 - protein, 22 aa, Entamoeba dispar
LNYNILIKELTTLKFMIINKPL

SEQ ID NO: 2399604 - protein, 19 aa, Entamoeba dispar
LNYYLFTLSFFILFLCFIV

SEQ ID NO: 2399605 - protein, 28 aa, Entamoeba dispar
LPADKLVSLMFISLPIASSIICLKKAPE

SEQ ID NO: 2399606 - protein, 18 aa, Entamoeba dispar
LPCHCCCYRCLSCFRIML

SEQ ID NO: 2399607 - protein, 18 aa, Entamoeba dispar
LPDMLPSYKFIKTTWDLF

SEQ ID NO: 2399608 - protein, 24 aa, Entamoeba dispar
LPEKMELYGMYIYIQGNKTHLNKS

SEQ ID NO: 2399609 - protein, 17 aa, Entamoeba dispar
LPEQLKIKEDWAEKVKA

SEQ ID NO: 2399610 - protein, 23 aa, Entamoeba dispar
LPETLIMNPYLYKSIKSLFNYKT

SEQ ID NO: 2399611 - protein, 20 aa, Entamoeba dispar
LPEYGAFLFYASYGIETRGS

SEQ ID NO: 2399612 - protein, 18 aa, Entamoeba dispar
LPFLHILHYIFSSSCSLC

SEQ ID NO: 2399613 - protein, 20 aa, Entamoeba dispar
LPFLKAVCGSKKSWYARHTG

SEQ ID NO: 2399614 - protein, 21 aa, Entamoeba dispar
LPFLLICFVFGGITEEVYNQI

SEQ ID NO: 2399615 - protein, 39 aa, Entamoeba dispar
LPFTYHYQYIIWGYFIFTTLCAYFSLIFKRKELWEMFRF

SEQ ID NO: 2399616 - protein, 24 aa, Entamoeba dispar
LPHQLRFLMVYGCKDIVALDNLKN

SEQ ID NO: 2399617 - protein, 17 aa, Entamoeba dispar
LPIIVSAVSSFLAAGIS

SEQ ID NO: 2399618 - protein, 17 aa, Entamoeba dispar
LPILLSMERLEILKIDA

SEQ ID NO: 2399619 - protein, 26 aa, Entamoeba dispar
LPKKYLNIMHLLPQTFRINYLSNHVT

SEQ ID NO: 2399620 - protein, 18 aa, Entamoeba dispar
LPLIITRGNNVFGPHQFP

SEQ ID NO: 2399621 - protein, 45 aa, Entamoeba dispar
LPLVITGSCAPILFLVVCIILLCIITYWAFIPIGVCLLFVCVNML

SEQ ID NO: 2399622 - protein, 20 aa, Entamoeba dispar
LPLYLVCLNGIRNLLQLTSV

SEQ ID NO: 2399623 - protein, 33 aa, Entamoeba dispar
LPMTVSIIISLLFYLSICHWYWISEIFEGMCIY

SEQ ID NO: 2399624 - protein, 19 aa, Entamoeba dispar
LPNIDYHVFFGLSSKFEAG

SEQ ID NO: 2399625 - protein, 20 aa, Entamoeba dispar
LPNLVRYYMSYSDRNFIYIA

SEQ ID NO: 2399626 - protein, 32 aa, Entamoeba dispar
LPPHDLGYYVARLRTIIYPNFLNYYLMHFLFF

SEQ ID NO: 2399627 - protein, 32 aa, Entamoeba dispar
LPPQNNIIRIPWRRILFTPNPKKPTIWDDIKI

SEQ ID NO: 2399628 - protein, 25 aa, Entamoeba dispar
LPSLMQCIMLTLFAIPLDKIFQESK

SEQ ID NO: 2399629 - protein, 32 aa, Entamoeba dispar
LPSPTLVGIFYMYFYTLNIPLLPINDLESINN

SEQ ID NO: 2399630 - protein, 31 aa, Entamoeba dispar
LPSQSFLIIKMIWFIILKRLQDWTVNSSSQF

SEQ ID NO: 2399631 - protein, 43 aa, Entamoeba dispar
LPSSSPFILKFLFFIIFAVVIGGVIFFIFGKKKNKFRNDRIEL

SEQ ID NO: 2399632 - protein, 20 aa, Entamoeba dispar
LPSWRWYYKFHYAPFALDFA

SEQ ID NO: 2399633 - protein, 18 aa, Entamoeba dispar
LPTGCYCTYSLISKQECI

SEQ ID NO: 2399634 - protein, 21 aa, Entamoeba dispar
LPVEQIWYSFTNIDDTTLSIP

SEQ ID NO: 2399635 - protein, 26 aa, Entamoeba dispar
LQAKVQYYFRTLFNDIGRLLSAHILL

SEQ ID NO: 2399636 - protein, 22 aa, Entamoeba dispar
LQATFNLYIRRIHHPCSYVNQE

SEQ ID NO: 2399637 - protein, 35 aa, Entamoeba dispar
LQEMKITHILTIGPLQPIFPELFVYKQINIDDSVK

SEQ ID NO: 2399638 - protein, 28 aa, Entamoeba dispar
LQEVELLEKIRCPFIINFIGSVTSSDTL

SEQ ID NO: 2399639 - protein, 38 aa, Entamoeba dispar
LQGQYGLSWQAWLLSLLLSFITLIIGQISFFIPVPTSK

SEQ ID NO: 2399640 - protein, 21 aa, Entamoeba dispar
LQHGALLLMVSLLRNCKEYMK

SEQ ID NO: 2399641 - protein, 17 aa, Entamoeba dispar
LQIITWEDPFPKTEFKF

SEQ ID NO: 2399642 - protein, 20 aa, Entamoeba dispar
LQKHFLSILITCFFSLFLFN

SEQ ID NO: 2399643 - protein, 18 aa, Entamoeba dispar
LQKVLYVNLIMEYNREIC

SEQ ID NO: 2399644 - protein, 17 aa, Entamoeba dispar
LQLFLHCKVIDKRVAIT

SEQ ID NO: 2399645 - protein, 31 aa, Entamoeba dispar
LQMKLDILFICFLLILLSFLAGLCLLSQIIQ

SEQ ID NO: 2399646 - protein, 22 aa, Entamoeba dispar
LQNKKCILYKEPCNYFKGDICY

SEQ ID NO: 2399647 - protein, 25 aa, Entamoeba dispar
LQNNKYNWFRPASFFPLGYMYEILD

SEQ ID NO: 2399648 - protein, 34 aa, Entamoeba dispar
LQNPAFILFVLGFFLPCIWIYNIIKYKNSGDLIE

SEQ ID NO: 2399649 - protein, 27 aa, Entamoeba dispar
LQNTTLQIFFIIPLGYCIFLSIKRIES

SEQ ID NO: 2399650 - protein, 25 aa, Entamoeba dispar
LQNTVWRFSFPYSFLETFRHNYNYD

SEQ ID NO: 2399651 - protein, 23 aa, Entamoeba dispar
LQQNMEEMKLMKPVFIAAENGSD

SEQ ID NO: 2399652 - protein, 18 aa, Entamoeba dispar
LQRRILALIITLDEKSIE

SEQ ID NO: 2399653 - protein, 26 aa, Entamoeba dispar
LQTHNALFMIYPNWISEMGITVESEK

SEQ ID NO: 2399654 - protein, 23 aa, Entamoeba dispar
LQTICFFVLSEYQGIKIRSLYFK

SEQ ID NO: 2399655 - protein, 25 aa, Entamoeba dispar
LQTIIFNTFVFCQIFNEVNSRRVNG

SEQ ID NO: 2399656 - protein, 17 aa, Entamoeba dispar
LQVLYKQATRKNILGFD

SEQ ID NO: 2399657 - protein, 22 aa, Entamoeba dispar
LQWKHVIIIPFIGSLFLIFVFF

SEQ ID NO: 2399658 - protein, 26 aa, Entamoeba dispar
LQYGLLVLFAFWFFHGIVDSLIGSSL

SEQ ID NO: 2399659 - protein, 22 aa, Entamoeba dispar
LRESNFPSEWFFLIDSLKNVEI

SEQ ID NO: 2399660 - protein, 17 aa, Entamoeba dispar
LRFLLDAAKGIQYLHNN

SEQ ID NO: 2399661 - protein, 17 aa, Entamoeba dispar
LRFMLIIMNSRGSIFVH

SEQ ID NO: 2399662 - protein, 35 aa, Entamoeba dispar
LRFNQVTSTPIIFRLCEWYSIIPEPDKHYSFSVPT

SEQ ID NO: 2399663 - protein, 25 aa, Entamoeba dispar
LRHPSYFGWFWWSITTQIVMLNPLS

SEQ ID NO: 2399664 - protein, 18 aa, Entamoeba dispar
LRIRNGLIGLIYDKALKL

SEQ ID NO: 2399665 - protein, 22 aa, Entamoeba dispar
LRMTRFWTYFGMWSCGGYFFIN

SEQ ID NO: 2399666 - protein, 17 aa, Entamoeba dispar
LRNPFVVNYVGSVTYIP

SEQ ID NO: 2399667 - protein, 18 aa, Entamoeba dispar
LRNQSFGTFLFVALLLIF

SEQ ID NO: 2399668 - protein, 39 aa, Entamoeba dispar
LRNVTLIKMCFYKNASFFLILFWYSFFNGQSGMSMYDDY

SEQ ID NO: 2399669 - protein, 23 aa, Entamoeba dispar
LRQAATSVLYLFAKTNYQVTGDT

SEQ ID NO: 2399670 - protein, 30 aa, Entamoeba dispar
LRRTNFIICLFFILYSLYQIGILLAWIFRV

SEQ ID NO: 2399671 - protein, 27 aa, Entamoeba dispar
LRSEIWIQIYYLIITFGVVITPFVGFI

SEQ ID NO: 2399672 - protein, 23 aa, Entamoeba dispar
LRTYFIIERIKKVMKIFIHFIIK

SEQ ID NO: 2399673 - protein, 26 aa, Entamoeba dispar
LRVDDQKYIILLAAKDFNGLEQYNIP

SEQ ID NO: 2399674 - protein, 34 aa, Entamoeba dispar
LRVWSLLIMLYSFVHFIILITFYFVDIEEHWGLM

SEQ ID NO: 2399675 - protein, 36 aa, Entamoeba dispar
LRYIPKKWKIVQLWNSRIIILMIRTCILILTTFCAT

SEQ ID NO: 2399676 - protein, 21 aa, Entamoeba dispar
LSALYFFFPLFTYSAFSTSCR

SEQ ID NO: 2399677 - protein, 25 aa, Entamoeba dispar
LSAQGSLLTMILFLSPQTLNNNISF

SEQ ID NO: 2399678 - protein, 25 aa, Entamoeba dispar
LSASLMKYFTIGKYYLHVFGHYGIV

SEQ ID NO: 2399679 - protein, 50 aa, Entamoeba dispar
LSCKKLNLGLIISLIIVGLLFIVIIISIIIFLIWRKRRKIIKEREKEIKP

SEQ ID NO: 2399680 - protein, 30 aa, Entamoeba dispar
LSDCKLFFGVEFLYNCLVSFLLTILERRKV

SEQ ID NO: 2399681 - protein, 17 aa, Entamoeba dispar
LSDERYGIVALDALCNE

SEQ ID NO: 2399682 - protein, 20 aa, Entamoeba dispar
LSELLKLFGYIYLNVDNEKT

SEQ ID NO: 2399683 - protein, 24 aa, Entamoeba dispar
LSFIIAFSLLFITTLLMSSVTFIA

SEQ ID NO: 2399684 - protein, 22 aa, Entamoeba dispar
LSFILLICFILKWSVLYISSLL

SEQ ID NO: 2399685 - protein, 18 aa, Entamoeba dispar
LSFLFQINNQLWFLLSWT

SEQ ID NO: 2399686 - protein, 19 aa, Entamoeba dispar
LSFPAAYFTFKGTGTGVSI

SEQ ID NO: 2399687 - protein, 25 aa, Entamoeba dispar
LSFSAYCFWLIIPILMRDIGASPFQ

SEQ ID NO: 2399688 - protein, 32 aa, Entamoeba dispar
LSFSSFSLFPLYFMDFFISPKLHYLMFSNHSI

SEQ ID NO: 2399689 - protein, 19 aa, Entamoeba dispar
LSFTIMNFLKYCRFNGFFN

SEQ ID NO: 2399690 - protein, 17 aa, Entamoeba dispar
LSFVNARLFQLNEFGSM

SEQ ID NO: 2399691 - protein, 25 aa, Entamoeba dispar
LSGFLLPILSIFRLIKGKLVIVIPF

SEQ ID NO: 2399692 - protein, 39 aa, Entamoeba dispar
LSGGEIFGIIVAVLFLVVILLVVGLFVGYIGYKKYQNKH

SEQ ID NO: 2399693 - protein, 21 aa, Entamoeba dispar
LSHFHLILYIIGTNAGPMLSS

SEQ ID NO: 2399694 - protein, 28 aa, Entamoeba dispar
LSHHVYFGAILFSLKTLFLIINTFAFNN

SEQ ID NO: 2399695 - protein, 21 aa, Entamoeba dispar
LSHRIFLSVLFAYCNTFFSGI

SEQ ID NO: 2399696 - protein, 21 aa, Entamoeba dispar
LSIAEFTFYLQREVVPQLLVD

SEQ ID NO: 2399697 - protein, 24 aa, Entamoeba dispar
LSIEPLALLPFIIESLKELNVQLK

SEQ ID NO: 2399698 - protein, 24 aa, Entamoeba dispar
LSIIPTLIIYFFKPNPEILVTLLL

SEQ ID NO: 2399699 - protein, 18 aa, Entamoeba dispar
LSIKFLKQNPLPKTIYTI

SEQ ID NO: 2399700 - protein, 17 aa, Entamoeba dispar
LSILIPILAVIKGSLTL

SEQ ID NO: 2399701 - protein, 18 aa, Entamoeba dispar
LSILITCFFSLFLFNYCS

SEQ ID NO: 2399702 - protein, 17 aa, Entamoeba dispar
LSILLVQSLLTINIESQ

SEQ ID NO: 2399703 - protein, 42 aa, Entamoeba dispar
LSILMIIPDLIQHPNWFILVSLTRFMILFSSIIPISMRVNLD

SEQ ID NO: 2399704 - protein, 37 aa, Entamoeba dispar
LSILVSEHPFVSMVLLTVTMILIGLIVMWWSSEYDDE

SEQ ID NO: 2399705 - protein, 32 aa, Entamoeba dispar
LSISFMDLTFLPFLVFPIVIMGYTHYAKWIGP

SEQ ID NO: 2399706 - protein, 23 aa, Entamoeba dispar
LSITIHKGCTFFLKLPSKLEELN

SEQ ID NO: 2399707 - protein, 46 aa, Entamoeba dispar
LSKALTNFLFWGIGSIVYILYFFFVITLFLILHIKLTRKIKQDIDD

SEQ ID NO: 2399708 - protein, 45 aa, Entamoeba dispar
LSKHPSLFLAIFKKEWYHFLFAYILVTIYELFSLAFPLESQYIVK

SEQ ID NO: 2399709 - protein, 23 aa, Entamoeba dispar
LSKILLILYTILIVGSIALTIII

SEQ ID NO: 2399710 - protein, 30 aa, Entamoeba dispar
LSKRPTHYFLYYINDIIFHLIIYGTVGIIQ

SEQ ID NO: 2399711 - protein, 28 aa, Entamoeba dispar
LSLDSHFFDIFFDFLFTHMSITKSQHII

SEQ ID NO: 2399712 - protein, 18 aa, Entamoeba dispar
LSLHFSFSKDILPQGFAP

SEQ ID NO: 2399713 - protein, 18 aa, Entamoeba dispar
LSLIYWRNYPPSIIGMMI

SEQ ID NO: 2399714 - protein, 19 aa, Entamoeba dispar
LSLMFYFYKHNTLLSVAML

SEQ ID NO: 2399715 - protein, 58 aa, Entamoeba dispar
LSLQEYIYFFKRRLWFTLEFISFIGIFYSFVTLHFILLILFCICFILTLVVPTLTVSN

SEQ ID NO: 2399716 - protein, 23 aa, Entamoeba dispar
LSLVLLIMTSSSVFKLFQVVKFN

SEQ ID NO: 2399717 - protein, 24 aa, Entamoeba dispar
LSLYNVCLILVRLFFQLPGFCLTS

SEQ ID NO: 2399718 - protein, 22 aa, Entamoeba dispar
LSLYPKLKMLVISSNKAYPIKY

SEQ ID NO: 2399719 - protein, 24 aa, Entamoeba dispar
LSLYSILYFLLNKVLFLCFLYSTH

SEQ ID NO: 2399720 - protein, 37 aa, Entamoeba dispar
LSNAPNLFFQIKPLYTLLLQVLIPKLPVIINSTLQYH

SEQ ID NO: 2399721 - protein, 25 aa, Entamoeba dispar
LSNEIKWRIIKLTLFIPKEIKAEDK

SEQ ID NO: 2399722 - protein, 22 aa, Entamoeba dispar
LSNLFLCHAQKQDWPLFHSECG

SEQ ID NO: 2399723 - protein, 23 aa, Entamoeba dispar
LSNLSLLVLFLISLQEKSIQLLP

SEQ ID NO: 2399724 - protein, 26 aa, Entamoeba dispar
LSNNYITILPSLTSLPLKLLDISFNN

SEQ ID NO: 2399725 - protein, 24 aa, Entamoeba dispar
LSNQKTIWKYFSKEWCFYHNTNIK

SEQ ID NO: 2399726 - protein, 20 aa, Entamoeba dispar
LSNVYLLLFSEKHKYCKRIL

SEQ ID NO: 2399727 - protein, 25 aa, Entamoeba dispar
LSPLIYLTTLKFLNASTNPILLIPP

SEQ ID NO: 2399728 - protein, 26 aa, Entamoeba dispar
LSPRVSVILRKDVPYYLFIHSKYASK

SEQ ID NO: 2399729 - protein, 19 aa, Entamoeba dispar
LSPSFLLILAFNQVFAVIN

SEQ ID NO: 2399730 - protein, 30 aa, Entamoeba dispar
LSPTMATLLIPVFPLLITPFLGVMNSNHES

SEQ ID NO: 2399731 - protein, 24 aa, Entamoeba dispar
LSQSLVALFRLFAPLISSPLIAWS

SEQ ID NO: 2399732 - protein, 25 aa, Entamoeba dispar
LSQSLVALFRLFAPLISSPLIAWSF

SEQ ID NO: 2399733 - protein, 26 aa, Entamoeba dispar
LSREGRFRFGGFWGKKWAKLTVNKNE

SEQ ID NO: 2399734 - protein, 24 aa, Entamoeba dispar
LSSFIKCYIPILSTHQYYLNDIEC

SEQ ID NO: 2399735 - protein, 17 aa, Entamoeba dispar
LSSFVLYFDGLIKLFSS

SEQ ID NO: 2399736 - protein, 24 aa, Entamoeba dispar
LSSGFPAFLLLYVNTLPLLLFRSH

SEQ ID NO: 2399737 - protein, 25 aa, Entamoeba dispar
LSSGFPAFLLLYVNTLPLLLFRSHF

SEQ ID NO: 2399738 - protein, 24 aa, Entamoeba dispar
LSSIGCLFPMYEAKLRDVPELGYL

SEQ ID NO: 2399739 - protein, 17 aa, Entamoeba dispar
LSSLFLFDLNQYPMKII

SEQ ID NO: 2399740 - protein, 32 aa, Entamoeba dispar
LSSLQYGPLPLKYIPKLVYPFEQIDILTILKC

SEQ ID NO: 2399741 - protein, 29 aa, Entamoeba dispar
LSTAKVFRYRPFSLILTMSSTWRENKGLT

SEQ ID NO: 2399742 - protein, 27 aa, Entamoeba dispar
LSTDHFPLARDLFNYAFLSMWQDSTDN

SEQ ID NO: 2399743 - protein, 20 aa, Entamoeba dispar
LSTIFPLFSNIFTENPHITK

SEQ ID NO: 2399744 - protein, 20 aa, Entamoeba dispar
LSTVFFQLLLCSVMAGFASW

SEQ ID NO: 2399745 - protein, 22 aa, Entamoeba dispar
LSVDVLGIIPFLVESLKQLNSE

SEQ ID NO: 2399746 - protein, 25 aa, Entamoeba dispar
LSVFPTLIFLIIEVVVHYLPAPSFE

SEQ ID NO: 2399747 - protein, 22 aa, Entamoeba dispar
LSVIAYILLLISSIAHFIHFKL

SEQ ID NO: 2399748 - protein, 19 aa, Entamoeba dispar
LSVIYLCYAYVSWSSERSL

SEQ ID NO: 2399749 - protein, 17 aa, Entamoeba dispar
LSVLFAYCNTFFSGIIF

SEQ ID NO: 2399750 - protein, 26 aa, Entamoeba dispar
LSVMLSWVFIIVFAAIIHGQWFSIFN

SEQ ID NO: 2399751 - protein, 27 aa, Entamoeba dispar
LSWINLIPPMHLFIPFVLCAGCILSYC

SEQ ID NO: 2399752 - protein, 18 aa, Entamoeba dispar
LSWVSYLISYFGSNAFTK

SEQ ID NO: 2399753 - protein, 34 aa, Entamoeba dispar
LSYDIFQIMYKLIFGHPLLFKTKKIWGFCILTIS

SEQ ID NO: 2399754 - protein, 26 aa, Entamoeba dispar
LSYKSNIPIDYLLFTGDSKVTDIVNG

SEQ ID NO: 2399755 - protein, 25 aa, Entamoeba dispar
LSYLVKTYCFLQLPKESEKILQEFF

SEQ ID NO: 2399756 - protein, 30 aa, Entamoeba dispar
LTADYWNPLFIPYVLLLCFVSRAFNVFPIS

SEQ ID NO: 2399757 - protein, 18 aa, Entamoeba dispar
LTCPILSLFYHQSLPNNA

SEQ ID NO: 2399758 - protein, 29 aa, Entamoeba dispar
LTCYKYAAKPPLTAAYFLEKIYDVTNKYA

SEQ ID NO: 2399759 - protein, 17 aa, Entamoeba dispar
LTDLLKIKNTRITIKKK

SEQ ID NO: 2399760 - protein, 26 aa, Entamoeba dispar
LTDNFNNFLFWFIVEHPKMPVVDFTD

SEQ ID NO: 2399761 - protein, 23 aa, Entamoeba dispar
LTEGIFSFIKKLFVKRTYNKIYV

SEQ ID NO: 2399762 - protein, 21 aa, Entamoeba dispar
LTFIFFFTNAERRKITTIQTP

SEQ ID NO: 2399763 - protein, 22 aa, Entamoeba dispar
LTGCKQCYIGYVFDTEKKLCVS

SEQ ID NO: 2399764 - protein, 25 aa, Entamoeba dispar
LTGFVYPLIFYISWQVIYVIITEVI

SEQ ID NO: 2399765 - protein, 42 aa, Entamoeba dispar
LTGYLVGFIKCWDLTLVILCMFPFIMISMMGLGMSAGIFTIK

SEQ ID NO: 2399766 - protein, 26 aa, Entamoeba dispar
LTHIRKALLLFSRYPNTFIPNASKTY

SEQ ID NO: 2399767 - protein, 33 aa, Entamoeba dispar
LTHIRKALLLFSRYPYDFIPNSTAIYSKELIQL

SEQ ID NO: 2399768 - protein, 26 aa, Entamoeba dispar
LTHLESPILRILLLEDNPIYNIQSYL

SEQ ID NO: 2399769 - protein, 22 aa, Entamoeba dispar
LTHYIEFYSPKLSYNEWYFVFY

SEQ ID NO: 2399770 - protein, 26 aa, Entamoeba dispar
LTIDILQTLFYLQVSYRTNKMPLLNG

SEQ ID NO: 2399771 - protein, 18 aa, Entamoeba dispar
LTIEPKLVILSKGKCVTF

SEQ ID NO: 2399772 - protein, 24 aa, Entamoeba dispar
LTIFYLFKVVYWTISGLQIRAGYN

SEQ ID NO: 2399773 - protein, 26 aa, Entamoeba dispar
LTIIYNSWILCEAILIELGYSSVTYT

SEQ ID NO: 2399774 - protein, 18 aa, Entamoeba dispar
LTIKLIFSYFIDNPSYIP

SEQ ID NO: 2399775 - protein, 37 aa, Entamoeba dispar
LTILTTMALSIKSWNFFLALGFFVSFLLSLICILLVS

SEQ ID NO: 2399776 - protein, 26 aa, Entamoeba dispar
LTITPSLLLIFPRFFRIKGLIPCNKW

SEQ ID NO: 2399777 - protein, 17 aa, Entamoeba dispar
LTIWWTVSTLRLKYYGT

SEQ ID NO: 2399778 - protein, 32 aa, Entamoeba dispar
LTKIFSKYLFSKQFQPIAYKLLLNYFISNYKK

SEQ ID NO: 2399779 - protein, 23 aa, Entamoeba dispar
LTKLRSPLLINIIGIVTTPKHEC

SEQ ID NO: 2399780 - protein, 33 aa, Entamoeba dispar
LTKQWYEFYVIVTTPYLLIFESEEKMNKMEYYA

SEQ ID NO: 2399781 - protein, 22 aa, Entamoeba dispar
LTKTKTIPPIFKIQNIKFEKEE

SEQ ID NO: 2399782 - protein, 26 aa, Entamoeba dispar
LTKYMTELHLFKFSPEIIYQLSIDSI

SEQ ID NO: 2399783 - protein, 36 aa, Entamoeba dispar
LTLFSKPQHYIYFYKMLWLLLEKFDHKIAFMDEWFF

SEQ ID NO: 2399784 - protein, 36 aa, Entamoeba dispar
LTLLFRNKCALFCQLLPLIVIILCGIIVLIMRADRE

SEQ ID NO: 2399785 - protein, 18 aa, Entamoeba dispar
LTLSIASTIFFLLKDKIM

SEQ ID NO: 2399786 - protein, 27 aa, Entamoeba dispar
LTLSKQIPFIIFQLCDFMTSIIQIGGY

SEQ ID NO: 2399787 - protein, 28 aa, Entamoeba dispar
LTLTNHWKYPMHFTFHSGDYTKYEIMCK

SEQ ID NO: 2399788 - protein, 17 aa, Entamoeba dispar
LTLVYIPLLSFAVCNAC

SEQ ID NO: 2399789 - protein, 18 aa, Entamoeba dispar
LTMFVSEFTRLGGIGLVL

SEQ ID NO: 2399790 - protein, 32 aa, Entamoeba dispar
LTNKWNQIDFIYFYQLMIKFFTQINVNELSLC

SEQ ID NO: 2399791 - protein, 20 aa, Entamoeba dispar
LTPKLTNVLLPIIDPLFLSN

SEQ ID NO: 2399792 - protein, 26 aa, Entamoeba dispar
LTPSLLGIFPKFFSKRGFIPCIKRCR

SEQ ID NO: 2399793 - protein, 24 aa, Entamoeba dispar
LTSIPFIQIELLQNALKRLHVAGE

SEQ ID NO: 2399794 - protein, 37 aa, Entamoeba dispar
LTTILNNYLIILLCNYYIFNLIYLVPKIKNEGKRHIS

SEQ ID NO: 2399795 - protein, 22 aa, Entamoeba dispar
LTVAIISILYSFFRFITSMSHG

SEQ ID NO: 2399796 - protein, 22 aa, Entamoeba dispar
LTVDYLGIIPLLVEALKEIHNN

SEQ ID NO: 2399797 - protein, 18 aa, Entamoeba dispar
LTVETISSGILFISNILS

SEQ ID NO: 2399798 - protein, 23 aa, Entamoeba dispar
LTVLAVFWYYWKNKQEFVHVKEV

SEQ ID NO: 2399799 - protein, 18 aa, Entamoeba dispar
LTYIRKLDFISGTSKILN

SEQ ID NO: 2399800 - protein, 17 aa, Entamoeba dispar
LTYKFKMRILKDVAKGM

SEQ ID NO: 2399801 - protein, 39 aa, Entamoeba dispar
LTYMAPEIFLKEPYKFPADIFAFGVVIFETIKWGDAFEQ

SEQ ID NO: 2399802 - protein, 23 aa, Entamoeba dispar
LTYNELVIMNILNEYYNKYKDIG

SEQ ID NO: 2399803 - protein, 20 aa, Entamoeba dispar
LTYYLWVILSSSILPPYDLQ

SEQ ID NO: 2399804 - protein, 32 aa, Entamoeba dispar
LVAPGWFYFCPISLLLWLLTGGVTYYLGTIFF

SEQ ID NO: 2399805 - protein, 23 aa, Entamoeba dispar
LVAYRFELLPSIEFLPICISFIV

SEQ ID NO: 2399806 - protein, 25 aa, Entamoeba dispar
LVDETLIRTYLWIVENLFVTVCELD

SEQ ID NO: 2399807 - protein, 18 aa, Entamoeba dispar
LVEILLDKLIDTIKQYPC

SEQ ID NO: 2399808 - protein, 18 aa, Entamoeba dispar
LVFFDKLLQFIPENTSII

SEQ ID NO: 2399809 - protein, 18 aa, Entamoeba dispar
LVFLIKTFSDVQSSFVSV

SEQ ID NO: 2399810 - protein, 18 aa, Entamoeba dispar
LVFLLIDCFLFKQGNTRV

SEQ ID NO: 2399811 - protein, 18 aa, Entamoeba dispar
LVFSLTLSFSLSASCSKG

SEQ ID NO: 2399812 - protein, 20 aa, Entamoeba dispar
LVFYSLFNDKHKYQWFFDAS

SEQ ID NO: 2399813 - protein, 26 aa, Entamoeba dispar
LVGCFAQHTVYYFKQSDLGAQHKRLR

SEQ ID NO: 2399814 - protein, 27 aa, Entamoeba dispar
LVGKTYVPLFPYFKDLKGCFRVVADDY

SEQ ID NO: 2399815 - protein, 25 aa, Entamoeba dispar
LVGLILVIILFIFTPQIYDFLKCQE

SEQ ID NO: 2399816 - protein, 17 aa, Entamoeba dispar
LVIIPFGFGLPSHTFDK

SEQ ID NO: 2399817 - protein, 43 aa, Entamoeba dispar
LVITGSCAPILFLVVCIILLCIITYWAFIPIGVCLLFVCVNML

SEQ ID NO: 2399818 - protein, 25 aa, Entamoeba dispar
LVIVTIISFFIGWHMVMAIGGADMP

SEQ ID NO: 2399819 - protein, 17 aa, Entamoeba dispar
LVKCTCILRCKIPVTLR

SEQ ID NO: 2399820 - protein, 25 aa, Entamoeba dispar
LVKKHYLLVLLIIVYKMKSVMIRRE

SEQ ID NO: 2399821 - protein, 25 aa, Entamoeba dispar
LVKSPFILCMCLIYSIVILAYNLFG

SEQ ID NO: 2399822 - protein, 22 aa, Entamoeba dispar
LVLFEDFIISDLKFIREYVWCL

SEQ ID NO: 2399823 - protein, 18 aa, Entamoeba dispar
LVLIFKYSQDEAIQQTAI

SEQ ID NO: 2399824 - protein, 36 aa, Entamoeba dispar
LVLKTKIVYWFYYLLMILLFFFPKIFIPCPSNHKIF

SEQ ID NO: 2399825 - protein, 24 aa, Entamoeba dispar
LVLRHFYSLFIQFYDPMDTVLSLY

SEQ ID NO: 2399826 - protein, 20 aa, Entamoeba dispar
LVLYCALFFLLTIPFFNKWI

SEQ ID NO: 2399827 - protein, 23 aa, Entamoeba dispar
LVPAFFFIFFDFIITIKQFFEPN

SEQ ID NO: 2399828 - protein, 20 aa, Entamoeba dispar
LVRIAILWHEAWHEALEEAS

SEQ ID NO: 2399829 - protein, 42 aa, Entamoeba dispar
LVRKMAIYPFLYIVCWIVPFFNRLLPLFKITPPFWMEYVHCF

SEQ ID NO: 2399830 - protein, 31 aa, Entamoeba dispar
LVTEEWYYFILFIISFIPLLINGYCCSTKED

SEQ ID NO: 2399831 - protein, 30 aa, Entamoeba dispar
LVTKIIVPIFLFISFVLLVIGMFLISFSFD

SEQ ID NO: 2399832 - protein, 30 aa, Entamoeba dispar
LVTRNPTSFLFWFITLGVQGFTVFVLYFII

SEQ ID NO: 2399833 - protein, 27 aa, Entamoeba dispar
LVVASPQIFQLFYLAVQKFTLPDDLNS

SEQ ID NO: 2399834 - protein, 18 aa, Entamoeba dispar
LVVGFVCGIFLILFLIWN

SEQ ID NO: 2399835 - protein, 18 aa, Entamoeba dispar
LVVISFLVLTFVSLDFEN

SEQ ID NO: 2399836 - protein, 28 aa, Entamoeba dispar
LVVKVFDCLFIFLINRISFHFREGHIHE

SEQ ID NO: 2399837 - protein, 28 aa, Entamoeba dispar
LVVVIVSLIILYYLRPNGYDQKLNGCFV

SEQ ID NO: 2399838 - protein, 19 aa, Entamoeba dispar
LVYISLFLIVLHLDIVVES

SEQ ID NO: 2399839 - protein, 20 aa, Entamoeba dispar
LWILIKRNALIQWRSPGKII

SEQ ID NO: 2399840 - protein, 17 aa, Entamoeba dispar
LWTVCHSNRLNFHRAKL

SEQ ID NO: 2399841 - protein, 18 aa, Entamoeba dispar
LWVCTLSSLILIIPNFHT

SEQ ID NO: 2399842 - protein, 26 aa, Entamoeba dispar
LYDTSCFFYWIVVPLLFNEQGATPVQ

SEQ ID NO: 2399843 - protein, 19 aa, Entamoeba dispar
LYHGSRLANFVSILSTGLK

SEQ ID NO: 2399844 - protein, 17 aa, Entamoeba dispar
LYHKVSDGDLPLYLVCL

SEQ ID NO: 2399845 - protein, 22 aa, Entamoeba dispar
LYHKYFILLYFYTFILLYLYTF

SEQ ID NO: 2399846 - protein, 47 aa, Entamoeba dispar
LYKAIISINPPYWINVWYVYIFYYFALLFAFFFPSFTVHYINESLFN

SEQ ID NO: 2399847 - protein, 27 aa, Entamoeba dispar
LYKPFMKLMYYLFIPISATLILCVIVA

SEQ ID NO: 2399848 - protein, 21 aa, Entamoeba dispar
LYLFISFGLTKHFMSFSAGVI

SEQ ID NO: 2399849 - protein, 18 aa, Entamoeba dispar
LYLSYKGVSSVIGMETRI

SEQ ID NO: 2399850 - protein, 18 aa, Entamoeba dispar
LYLVKFNRDYAKASELLV

SEQ ID NO: 2399851 - protein, 30 aa, Entamoeba dispar
LYNSVISSFPLYRCFELIQIIKEPVLYFNN

SEQ ID NO: 2399852 - protein, 34 aa, Entamoeba dispar
LYQYLGACIYTSIKSFHWQFLITKSKRSSKRMLA

SEQ ID NO: 2399853 - protein, 19 aa, Entamoeba dispar
LYSFYKNIIMYLTQFSFLF

SEQ ID NO: 2399854 - protein, 29 aa, Entamoeba dispar
LYSLGIVLYYLIYLQFPFKINSLNELKER

SEQ ID NO: 2399855 - protein, 26 aa, Entamoeba dispar
LYSNFDIKFYSCISWSIHCCIMAFEK

SEQ ID NO: 2399856 - protein, 18 aa, Entamoeba dispar
LYSVLTQVKILSAAILSV

SEQ ID NO: 2399857 - protein, 31 aa, Entamoeba dispar
LYSYLVDEILFLFLNIFYFKAKSTTNNISSY

SEQ ID NO: 2399858 - protein, 20 aa, Entamoeba dispar
LYTDIFGQKKIKIFNGFYST

SEQ ID NO: 2399859 - protein, 20 aa, Entamoeba dispar
LYTRSSILVMLFFGYQLLSI

SEQ ID NO: 2399860 - protein, 21 aa, Entamoeba dispar
LYYIIMFFFYSLIPLFFLFSR

SEQ ID NO: 2399861 - protein, 19 aa, Entamoeba dispar
LYYWSFQQCVLVDKLWNCS

SEQ ID NO: 2399862 - protein, 35 aa, Entamoeba dispar
MADKAIWRIIFIISPITLILLILGIVGLVVTTYLL

SEQ ID NO: 2399863 - protein, 22 aa, Entamoeba dispar
MAKKIRDVLPEWVFGGLTEEQA

SEQ ID NO: 2399864 - protein, 17 aa, Entamoeba dispar
MAKKSLPFLTVVSLQRG

SEQ ID NO: 2399865 - protein, 17 aa, Entamoeba dispar
MALTCRPNLQRIAHRLI

SEQ ID NO: 2399866 - protein, 18 aa, Entamoeba dispar
MALYNFIFTSIPPVFISF

SEQ ID NO: 2399867 - protein, 20 aa, Entamoeba dispar
MASLNLVYPLTFRLNKHRNN

SEQ ID NO: 2399868 - protein, 18 aa, Entamoeba dispar
MAYFLFCFCFYSLMCISY

SEQ ID NO: 2399869 - protein, 27 aa, Entamoeba dispar
MCCILYAIIFLIFGMGWIKGVIADFLI

SEQ ID NO: 2399870 - protein, 33 aa, Entamoeba dispar
MCFGFGFALYYNWKLALCVIATSPIHALILFGD

SEQ ID NO: 2399871 - protein, 17 aa, Entamoeba dispar
MCVGYLGIIYYPSFFSL

SEQ ID NO: 2399872 - protein, 38 aa, Entamoeba dispar
MDFGRIINFQYIPPIYFAYFIFIALIEGLSITKVFMNQ

SEQ ID NO: 2399873 - protein, 34 aa, Entamoeba dispar
MDNSQMHWFYGINFLIHRLFFQFFDSNRISSKIK

SEQ ID NO: 2399874 - protein, 24 aa, Entamoeba dispar
MDNSVTISFIKVTQVSGKCNSNSA

SEQ ID NO: 2399875 - protein, 25 aa, Entamoeba dispar
MDPSPINRYFTWTPTLTYSNETKKV

SEQ ID NO: 2399876 - protein, 17 aa, Entamoeba dispar
MDRSEISGFLYSNGQKQ

SEQ ID NO: 2399877 - protein, 39 aa, Entamoeba dispar
MDTVLSLYDRLLYSSPIIPMFILCSIFITHRSELLKTTS

SEQ ID NO: 2399878 - protein, 27 aa, Entamoeba dispar
MDVSELLEILFWKYLKEEPGASAELDK

SEQ ID NO: 2399879 - protein, 22 aa, Entamoeba dispar
MDYENLLFVYPTEICLGKEKKR

SEQ ID NO: 2399880 - protein, 25 aa, Entamoeba dispar
MEETVLLGALVIGSIFIGSNVEKKK

SEQ ID NO: 2399881 - protein, 20 aa, Entamoeba dispar
MEGSYSRWLFFKTHFVVYFG

SEQ ID NO: 2399882 - protein, 20 aa, Entamoeba dispar
MEGVGSLLFIPQINEMWSID

SEQ ID NO: 2399883 - protein, 17 aa, Entamoeba dispar
MEITPICSTTISQQIRF

SEQ ID NO: 2399884 - protein, 19 aa, Entamoeba dispar
MEKLFNYYKVELIKAPAKY

SEQ ID NO: 2399885 - protein, 24 aa, Entamoeba dispar
MELIVFPIALIILLYVVQSPVLLI

SEQ ID NO: 2399886 - protein, 32 aa, Entamoeba dispar
MELNNNLIKLVKAYFLMCEIIEYNETKENEEG

SEQ ID NO: 2399887 - protein, 29 aa, Entamoeba dispar
MEMGDEAYLVKWKLFRSLALEDLKKTYER

SEQ ID NO: 2399888 - protein, 18 aa, Entamoeba dispar
METAKTRSLIPSELKIQE

SEQ ID NO: 2399889 - protein, 46 aa, Entamoeba dispar
MEYNYFNEIIFISLLYSIALILLLIVTLILIGFYFYSNRKFKRNQD

SEQ ID NO: 2399890 - protein, 29 aa, Entamoeba dispar
MFDGFLVLKMPFPLSYRFKLITQQGLGGM

SEQ ID NO: 2399891 - protein, 18 aa, Entamoeba dispar
MFDILCHLKYLNISNRPL

SEQ ID NO: 2399892 - protein, 18 aa, Entamoeba dispar
MFETIKWDNPYSKEVYKF

SEQ ID NO: 2399893 - protein, 28 aa, Entamoeba dispar
MFETMKWGPAYPKEQFKYPWQIAQFVCD

SEQ ID NO: 2399894 - protein, 24 aa, Entamoeba dispar
MFFGMFLALLIYYFTELIKFCINC

SEQ ID NO: 2399895 - protein, 31 aa, Entamoeba dispar
MFGNKYLLVGLVVSVLFLVAGIYIPYFNDII

SEQ ID NO: 2399896 - protein, 18 aa, Entamoeba dispar
MFKFFNKKNFWSIYCSIL

SEQ ID NO: 2399897 - protein, 19 aa, Entamoeba dispar
MFKIIYRDSYETTQKKLWG

SEQ ID NO: 2399898 - protein, 27 aa, Entamoeba dispar
MFLLSVVIYLFWLLFEVIRSFSERRKM

SEQ ID NO: 2399899 - protein, 23 aa, Entamoeba dispar
MFNFASYFYWLVVPLKCVDMGGS

SEQ ID NO: 2399900 - protein, 24 aa, Entamoeba dispar
MFNSFTIILLVINFLIQNDYLPEL

SEQ ID NO: 2399901 - protein, 28 aa, Entamoeba dispar
MFPVDNRKWYEKIPALKWYKQFHKPRSI

SEQ ID NO: 2399902 - protein, 19 aa, Entamoeba dispar
MFREFLLRVHPQLYTHLLK

SEQ ID NO: 2399903 - protein, 21 aa, Entamoeba dispar
MFRFLFAFILEVPISIICRYI

SEQ ID NO: 2399904 - protein, 19 aa, Entamoeba dispar
MFSILFEIIELAPFVEFPE

SEQ ID NO: 2399905 - protein, 25 aa, Entamoeba dispar
MFSMIYELLPILNKKYRVMLITFIM

SEQ ID NO: 2399906 - protein, 31 aa, Entamoeba dispar
MGLVGYTIWIILTIFYFCLTWSYFNRAIYLT

SEQ ID NO: 2399907 - protein, 34 aa, Entamoeba dispar
MGMFCAAVVFIVLTLWWFYKALTFTGYVQPDDHC

SEQ ID NO: 2399908 - protein, 23 aa, Entamoeba dispar
MGVLILNILFISLVIASFIALFI

SEQ ID NO: 2399909 - protein, 18 aa, Entamoeba dispar
MHCNLKPQNILIYSYNSL

SEQ ID NO: 2399910 - protein, 36 aa, Entamoeba dispar
MHYSNPILIYLFTLLYIFIYCYTLISNILITGTDES

SEQ ID NO: 2399911 - protein, 25 aa, Entamoeba dispar
MICANSCFFLPFGYQTNLMVMKDGG

SEQ ID NO: 2399912 - protein, 17 aa, Entamoeba dispar
MIFLITGILFFISMFGF

SEQ ID NO: 2399913 - protein, 38 aa, Entamoeba dispar
MIIDVILFIIVWVTFFGIIVYLFYPALPPEIYPTPTIV

SEQ ID NO: 2399914 - protein, 19 aa, Entamoeba dispar
MIIELGVIIVFFIKCGKKL

SEQ ID NO: 2399915 - protein, 17 aa, Entamoeba dispar
MIILIHGFCTYAGVMKR

SEQ ID NO: 2399916 - protein, 17 aa, Entamoeba dispar
MIILLNFYNNPFNILRF

SEQ ID NO: 2399917 - protein, 17 aa, Entamoeba dispar
MIIYVLDIPFQENLLLL

SEQ ID NO: 2399918 - protein, 17 aa, Entamoeba dispar
MILVLLSFFLPMVATRD

SEQ ID NO: 2399919 - protein, 17 aa, Entamoeba dispar
MIMTSMPPVFIGAFEID

SEQ ID NO: 2399920 - protein, 27 aa, Entamoeba dispar
MIQNGLFEYKVFFTPKLIGEHLIIVSV

SEQ ID NO: 2399921 - protein, 26 aa, Entamoeba dispar
MIRNLFGTLLSFFDITPLGRLLNYFS

SEQ ID NO: 2399922 - protein, 34 aa, Entamoeba dispar
MISCIIMIVYLVFKSLFSLFLDYPAKPTVGLTRA

SEQ ID NO: 2399923 - protein, 23 aa, Entamoeba dispar
MISLHFYLDACFIFSLLNNTSNT

SEQ ID NO: 2399924 - protein, 22 aa, Entamoeba dispar
MISLILFIIHYFRRSIIFPLRI

SEQ ID NO: 2399925 - protein, 34 aa, Entamoeba dispar
MISLKNLKVLSLIGNPLIFYPRSLEPFCDVSLQQ

SEQ ID NO: 2399926 - protein, 22 aa, Entamoeba dispar
MISMMIFFMMLALSFFFGNQQT

SEQ ID NO: 2399927 - protein, 17 aa, Entamoeba dispar
MISNFKKFAYKIGGICY

SEQ ID NO: 2399928 - protein, 29 aa, Entamoeba dispar
MITKIIYDMFLFLKLFKTFNIKRGNETKQ

SEQ ID NO: 2399929 - protein, 26 aa, Entamoeba dispar
MITLMSLLILPLTFFKNLSALKFTSI

SEQ ID NO: 2399930 - protein, 22 aa, Entamoeba dispar
MIYGALFPIFSYYLCESIVMLV

SEQ ID NO: 2399931 - protein, 27 aa, Entamoeba dispar
MKDADLALMAKKPLRFTSDIIVNRLTL

SEQ ID NO: 2399932 - protein, 28 aa, Entamoeba dispar
MKDFGAIAILFLPMAFIASLFGMNVTVP

SEQ ID NO: 2399933 - protein, 29 aa, Entamoeba dispar
MKDKQKLLQPYLITFIDSLFPKGKLTEIK

SEQ ID NO: 2399934 - protein, 23 aa, Entamoeba dispar
MKEFIHPLNYLIESIEYHPNITS

SEQ ID NO: 2399935 - protein, 34 aa, Entamoeba dispar
MKEKKPVKQKWLWSLYIILTVMSIITLALTITTL

SEQ ID NO: 2399936 - protein, 23 aa, Entamoeba dispar
MKEVALYTHHLLDHNFTEWNIDS

SEQ ID NO: 2399937 - protein, 27 aa, Entamoeba dispar
MKEYIQLFLPIILLMGKTALPQIRVKC

SEQ ID NO: 2399938 - protein, 25 aa, Entamoeba dispar
MKFFNKYLRYLSYLNPYNYCHKNEE

SEQ ID NO: 2399939 - protein, 17 aa, Entamoeba dispar
MKGLPLDLFSLTNLSIL

SEQ ID NO: 2399940 - protein, 19 aa, Entamoeba dispar
MKGVAYFDLLVYYHKKIQK

SEQ ID NO: 2399941 - protein, 23 aa, Entamoeba dispar
MKHLQLFGIIVWTVNGTLELRCK

SEQ ID NO: 2399942 - protein, 25 aa, Entamoeba dispar
MKIKPSYEWFLGGLVFILIVCTPCL

SEQ ID NO: 2399943 - protein, 33 aa, Entamoeba dispar
MKKAMCWRKWKLWIIIGVIAAIIIIVIIVAIVI

SEQ ID NO: 2399944 - protein, 18 aa, Entamoeba dispar
MKKIMIYPESLNSTHLEI

SEQ ID NO: 2399945 - protein, 25 aa, Entamoeba dispar
MKKVYPTIILGIPRIYEKIIEKMKQ

SEQ ID NO: 2399946 - protein, 35 aa, Entamoeba dispar
MKKWPENALIAIGGFLFLRFINPAIVSPQRFGSRM

SEQ ID NO: 2399947 - protein, 24 aa, Entamoeba dispar
MKLKQDFLTPFLKSLSIALSNNLS

SEQ ID NO: 2399948 - protein, 27 aa, Entamoeba dispar
MKLTEIFKVFILRFNFKSKENILINSF

SEQ ID NO: 2399949 - protein, 30 aa, Entamoeba dispar
MKPLLYVEFIVNCYLLLSWIYECIVNLHTQ

SEQ ID NO: 2399950 - protein, 23 aa, Entamoeba dispar
MKSIRSSIYFEKGQWDYEANSLD

SEQ ID NO: 2399951 - protein, 27 aa, Entamoeba dispar
MLCSLLILHIYWFKLIIEMIFKVASHE

SEQ ID NO: 2399952 - protein, 43 aa, Entamoeba dispar
MLGMKMTPYWVLHIVYFFCIFLIQFILYCLLGVLFGVTFILDV

SEQ ID NO: 2399953 - protein, 29 aa, Entamoeba dispar
MLIFIMTVAFIIKIIWYRGVIRENSGLLM

SEQ ID NO: 2399954 - protein, 20 aa, Entamoeba dispar
MLIINRILNLFFQIELNLQS

SEQ ID NO: 2399955 - protein, 17 aa, Entamoeba dispar
MLILNNFNLEIKAGHSV

SEQ ID NO: 2399956 - protein, 17 aa, Entamoeba dispar
MLPSYKFIKTTWDLFVK

SEQ ID NO: 2399957 - protein, 19 aa, Entamoeba dispar
MLQIITWEDPFPKTEFKFP

SEQ ID NO: 2399958 - protein, 24 aa, Entamoeba dispar
MLQIITWEDPFPKTLYPHPWDTAN

SEQ ID NO: 2399959 - protein, 39 aa, Entamoeba dispar
MLQTPVFYALVLLIPLILFSKDFLWRHLKRKFIPSSNHI

SEQ ID NO: 2399960 - protein, 18 aa, Entamoeba dispar
MLSSYKYCYSCKSGYYLF

SEQ ID NO: 2399961 - protein, 25 aa, Entamoeba dispar
MLTNIAPDFLLYEPSKISNGMVSAF

SEQ ID NO: 2399962 - protein, 17 aa, Entamoeba dispar
MLTPLTCRCGKTKIMPP

SEQ ID NO: 2399963 - protein, 22 aa, Entamoeba dispar
MLTQLRHKCVVEFIGAVYTEGE

SEQ ID NO: 2399964 - protein, 41 aa, Entamoeba dispar
MLVEYILNFFPIQLTILIITILILITCAFQSIIMAFRVIFT

SEQ ID NO: 2399965 - protein, 26 aa, Entamoeba dispar
MLVIDPLAFRSWDDYVLNNLKHSEQL

SEQ ID NO: 2399966 - protein, 30 aa, Entamoeba dispar
MMDDMPMFAFMMLIMLFVFEGMTTLTRLKN

SEQ ID NO: 2399967 - protein, 23 aa, Entamoeba dispar
MMERIRCPYIVNFIGSVVTYDTL

SEQ ID NO: 2399968 - protein, 18 aa, Entamoeba dispar
MMFIGMFGCLFVFEGKHL

SEQ ID NO: 2399969 - protein, 18 aa, Entamoeba dispar
MMILLTSILLVFLQIITP

SEQ ID NO: 2399970 - protein, 24 aa, Entamoeba dispar
MMIPKPILIYILKKKDQKRNENGQ

SEQ ID NO: 2399971 - protein, 18 aa, Entamoeba dispar
MMIYVLFYLIFKIFLIVI

SEQ ID NO: 2399972 - protein, 18 aa, Entamoeba dispar
MMKQAILPIIDDFLEDFL

SEQ ID NO: 2399973 - protein, 33 aa, Entamoeba dispar
MMMQPMNYLINLVFTYLCGYYQINIVPMVVKKS

SEQ ID NO: 2399974 - protein, 27 aa, Entamoeba dispar
MMSCIVTIPWIIFYFIIEKQYEYTINF

SEQ ID NO: 2399975 - protein, 23 aa, Entamoeba dispar
MMYSIVLILISESSYRLLNETLQ

SEQ ID NO: 2399976 - protein, 26 aa, Entamoeba dispar
MNEVMKKLYDQGLFSYLVIDEAHCIS

SEQ ID NO: 2399977 - protein, 25 aa, Entamoeba dispar
MNGSSKWWYSVVIYEHTLGIKSVEV

SEQ ID NO: 2399978 - protein, 26 aa, Entamoeba dispar
MNLHNDIIVLLLKLLRSSFLINVDKT

SEQ ID NO: 2399979 - protein, 25 aa, Entamoeba dispar
MNMSTYFFWLVVPLLMQDRDASSFQ

SEQ ID NO: 2399980 - protein, 17 aa, Entamoeba dispar
MNSLLELIKSGSLGRMP

SEQ ID NO: 2399981 - protein, 19 aa, Entamoeba dispar
MNTSNIKWIPLSGRSQILV

SEQ ID NO: 2399982 - protein, 19 aa, Entamoeba dispar
MNWLGDWGSQFGLLAIGFE

SEQ ID NO: 2399983 - protein, 24 aa, Entamoeba dispar
MNWYHFVLLFFVYYLSFSTFLIAI

SEQ ID NO: 2399984 - protein, 20 aa, Entamoeba dispar
MNYVAYLMFPLICLCIKITF

SEQ ID NO: 2399985 - protein, 17 aa, Entamoeba dispar
MPFFLCLLSLISLLFSF

SEQ ID NO: 2399986 - protein, 17 aa, Entamoeba dispar
MPPIGEGAFGMVFRGTY

SEQ ID NO: 2399987 - protein, 17 aa, Entamoeba dispar
MPQLFLEEFQNILLPIL

SEQ ID NO: 2399988 - protein, 25 aa, Entamoeba dispar
MPTDPNWFKIVRLPNATYDKCTAPT

SEQ ID NO: 2399989 - protein, 23 aa, Entamoeba dispar
MQIFWYIVYYGMIAFAAIILPFG

SEQ ID NO: 2399990 - protein, 33 aa, Entamoeba dispar
MQILTSFCFQLSIKWIFVLSLRLRNGLISMIYE

SEQ ID NO: 2399991 - protein, 17 aa, Entamoeba dispar
MQVILKEIAAELKYFIQ

SEQ ID NO: 2399992 - protein, 19 aa, Entamoeba dispar
MRCPYIINFIGAVDTPGYY

SEQ ID NO: 2399993 - protein, 19 aa, Entamoeba dispar
MRESFVFLEAIKKAFISQF

SEQ ID NO: 2399994 - protein, 19 aa, Entamoeba dispar
MRFLAIYIPHISVICAIII

SEQ ID NO: 2399995 - protein, 24 aa, Entamoeba dispar
MRFLSIYLPHISIICAIIFAAYPT

SEQ ID NO: 2399996 - protein, 17 aa, Entamoeba dispar
MRGRLLASYIKASGQVI

SEQ ID NO: 2399997 - protein, 26 aa, Entamoeba dispar
MRQGQTLISFFYPAKNLKLLDLAVKK

SEQ ID NO: 2399998 - protein, 33 aa, Entamoeba dispar
MSCIIVSFFVILLFNIVFFVIKNCFLNEPSIVE

SEQ ID NO: 2399999 - protein, 48 aa, Entamoeba dispar
MSCSKTNWALIIPLIIVAVIIIIIILIVIIGIIWWRRRKSVKAESTAI

SEQ ID NO: 2400000 - protein, 48 aa, Entamoeba dispar
MSCSKTNWALIIPLIIVGIIIIIVIISIIIAIVWWRRKKTAKAESKAI

SEQ ID NO: 2400001 - protein, 48 aa, Entamoeba dispar
MSCSKTNWALIIPLVIVAVIIIIILLLVLIGIIWWRRSRSVKAETAAI

SEQ ID NO: 2400002 - protein, 17 aa, Entamoeba dispar
MSLLFLLIGLITSLKYM

SEQ ID NO: 2400003 - protein, 25 aa, Entamoeba dispar
MSMCFVFILAIILFVYCISIILSHS

SEQ ID NO: 2400004 - protein, 23 aa, Entamoeba dispar
MSNSDPLFIAFSGKKAYSYQGKF

SEQ ID NO: 2400005 - protein, 17 aa, Entamoeba dispar
MSPFIVLSMTLLAVFAT

SEQ ID NO: 2400006 - protein, 24 aa, Entamoeba dispar
MSPFIVLSMTLLAVFATKFTVLGE

SEQ ID NO: 2400007 - protein, 24 aa, Entamoeba dispar
MSRNPLILLIKAKGKIFGAYMNDS

SEQ ID NO: 2400008 - protein, 38 aa, Entamoeba dispar
MSSFTPRILIYRKLPLFNIPRFPYPLSYIPLMKEVTIN

SEQ ID NO: 2400009 - protein, 26 aa, Entamoeba dispar
MSTYPIFLNWYNFFIAFGLVLMATFI

SEQ ID NO: 2400010 - protein, 24 aa, Entamoeba dispar
MSYSSCNYVILPSLLVIRSNSTTL

SEQ ID NO: 2400011 - protein, 26 aa, Entamoeba dispar
MTDCSLFFFYVLMRMAFKPIMAKLFG

SEQ ID NO: 2400012 - protein, 22 aa, Entamoeba dispar
MTDVWWNIITQCWDHIPSKRPT

SEQ ID NO: 2400013 - protein, 23 aa, Entamoeba dispar
MTFFDDVYLPDTSLSIDGTCIFK

SEQ ID NO: 2400014 - protein, 18 aa, Entamoeba dispar
MTFTKGIGSPKYMAPEIL

SEQ ID NO: 2400015 - protein, 43 aa, Entamoeba dispar
MTGIIIGCVLAGIIILLIIITTISLILFIRIERSIKKRSAEAI

SEQ ID NO: 2400016 - protein, 21 aa, Entamoeba dispar
MTKFDYLAIRNLIITLRQIKP

SEQ ID NO: 2400017 - protein, 17 aa, Entamoeba dispar
MTNMTFTKGIGTPVYMA

SEQ ID NO: 2400018 - protein, 34 aa, Entamoeba dispar
MTNTLRNIFNAIISYLIDLFPNDTSFAYYVNSQN

SEQ ID NO: 2400019 - protein, 25 aa, Entamoeba dispar
MVAIGLLFHLHFLSLQRWLDEDQRE

SEQ ID NO: 2400020 - protein, 17 aa, Entamoeba dispar
MVCSIICALLAILPAFS

SEQ ID NO: 2400021 - protein, 30 aa, Entamoeba dispar
MVDPNNRYIGYFYLVSFFGTFANAGKKYVY

SEQ ID NO: 2400022 - protein, 24 aa, Entamoeba dispar
MVELSFEYFVANNLLNRLAVCIGK

SEQ ID NO: 2400023 - protein, 22 aa, Entamoeba dispar
MVFFVIFTICLCLLYFCDWKVH

SEQ ID NO: 2400024 - protein, 17 aa, Entamoeba dispar
MVFNGMMFISLLLCGEL

SEQ ID NO: 2400025 - protein, 26 aa, Entamoeba dispar
MVINYRRPFLSYLEYKETIPLRTFRL

SEQ ID NO: 2400026 - protein, 19 aa, Entamoeba dispar
MVIQYFQLGSLGDYIRHEK

SEQ ID NO: 2400027 - protein, 22 aa, Entamoeba dispar
MVITEIDADLYRLVEPTQVIIS

SEQ ID NO: 2400028 - protein, 17 aa, Entamoeba dispar
MVMFIYISLSLGNSFYH

SEQ ID NO: 2400029 - protein, 19 aa, Entamoeba dispar
MVPALFLRRIYDIGMSKFD

SEQ ID NO: 2400030 - protein, 17 aa, Entamoeba dispar
MVPYTILDWNLNAEPSN

SEQ ID NO: 2400031 - protein, 17 aa, Entamoeba dispar
MVSNMFIGLLAYVNLYC

SEQ ID NO: 2400032 - protein, 24 aa, Entamoeba dispar
MVVDQFILLYKEKVFQCCFPLDFV

SEQ ID NO: 2400033 - protein, 26 aa, Entamoeba dispar
MVVIVLMVVAIFIYEFIQKKRYNRFS

SEQ ID NO: 2400034 - protein, 18 aa, Entamoeba dispar
MVVYVSLFVLIGGLLIIM

SEQ ID NO: 2400035 - protein, 18 aa, Entamoeba dispar
MWDVYYAPLFTYDERILL

SEQ ID NO: 2400036 - protein, 19 aa, Entamoeba dispar
MWTGITLLVFLVCSQIPLI

SEQ ID NO: 2400037 - protein, 17 aa, Entamoeba dispar
MWYGFRNVKLNDFFFSN

SEQ ID NO: 2400038 - protein, 19 aa, Entamoeba dispar
MYAFSYVLFWIPIQTSISR

SEQ ID NO: 2400039 - protein, 20 aa, Entamoeba dispar
MYHSLPITKPILSSSNKYIF

SEQ ID NO: 2400040 - protein, 23 aa, Entamoeba dispar
MYIGILFFCYFIAQTLVMSVMSF

SEQ ID NO: 2400041 - protein, 28 aa, Entamoeba dispar
MYIIVLIMWMIWIPLHFISSIRFDIFPI

SEQ ID NO: 2400042 - protein, 19 aa, Entamoeba dispar
MYLILIVVFFGWISWTPMK

SEQ ID NO: 2400043 - protein, 38 aa, Entamoeba dispar
MYNVPPCIHYLYPYGTLLLWIVFGFYSASLQTVMQFAL

SEQ ID NO: 2400044 - protein, 25 aa, Entamoeba dispar
MYSKKPLWVLKMIINIQISMNNKNI

SEQ ID NO: 2400045 - protein, 27 aa, Entamoeba dispar
MYVYKSDNLIRIFPIQFTRTKIYPGTR

SEQ ID NO: 2400046 - protein, 23 aa, Entamoeba dispar
NAFCFYFLIEYLYLNSNQFYSID

SEQ ID NO: 2400047 - protein, 36 aa, Entamoeba dispar
NAHFTFFVMAVVPLINFLLLLLIPKSINYPKEEVQY

SEQ ID NO: 2400048 - protein, 19 aa, Entamoeba dispar
NAIAFRPLAVSLFGRYLKA

SEQ ID NO: 2400049 - protein, 24 aa, Entamoeba dispar
NAIQVTFKIKVLCTCSLSDQLGIS

SEQ ID NO: 2400050 - protein, 17 aa, Entamoeba dispar
NAIRRPFMNFGYFVSCV

SEQ ID NO: 2400051 - protein, 21 aa, Entamoeba dispar
NALALQLKWANLTYLRDGKPQ

SEQ ID NO: 2400052 - protein, 17 aa, Entamoeba dispar
NALLVLMSDEIGFNAVV

SEQ ID NO: 2400053 - protein, 23 aa, Entamoeba dispar
NALQMLWVNMIMDTLAALALGTE

SEQ ID NO: 2400054 - protein, 29 aa, Entamoeba dispar
NAPSCVPIQFLLIPLVLVQAVGIALLVLS

SEQ ID NO: 2400055 - protein, 21 aa, Entamoeba dispar
NARDWAISRNRFWGTPIPIWT

SEQ ID NO: 2400056 - protein, 26 aa, Entamoeba dispar
NARKTYYINVIPTLFKYPSYTLRTYQ

SEQ ID NO: 2400057 - protein, 23 aa, Entamoeba dispar
NASLYLKKIAPPLGTLMSASKAY

SEQ ID NO: 2400058 - protein, 39 aa, Entamoeba dispar
NASMRYFILVLIVLVIVILIMVLIFFKSALVPLRVVFTT

SEQ ID NO: 2400059 - protein, 24 aa, Entamoeba dispar
NASSFILIPTILKSIQKLEKLPNI

SEQ ID NO: 2400060 - protein, 25 aa, Entamoeba dispar
NASSFILTVFSAFWILSDGTCSIHQ

SEQ ID NO: 2400061 - protein, 31 aa, Entamoeba dispar
NASSVLHYILDLPIIALLLTIIPPGTVDHEK

SEQ ID NO: 2400062 - protein, 25 aa, Entamoeba dispar
NATNDPFIIDYFKRMVLVKENLFEK

SEQ ID NO: 2400063 - protein, 17 aa, Entamoeba dispar
NCCFIPSKIIFNNAINY

SEQ ID NO: 2400064 - protein, 18 aa, Entamoeba dispar
NCENAVSINLPFTRTQNV

SEQ ID NO: 2400065 - protein, 31 aa, Entamoeba dispar
NCISSWNIVFKSWNNILPMGIEVLKKASEIQ

SEQ ID NO: 2400066 - protein, 34 aa, Entamoeba dispar
NCKESFEICYGCFLCGLIPIFISPRVSIVEINKV

SEQ ID NO: 2400067 - protein, 19 aa, Entamoeba dispar
NCKIKLKIFLDASKGIQYL

SEQ ID NO: 2400068 - protein, 21 aa, Entamoeba dispar
NCSHIFYRNLFISIVFSSFHI

SEQ ID NO: 2400069 - protein, 24 aa, Entamoeba dispar
NCSNDIWTLLFPNGMTISLTPRKP

SEQ ID NO: 2400070 - protein, 33 aa, Entamoeba dispar
NCVAVKFNWWRITDLVDYFIIAVTIVVVAVPEG

SEQ ID NO: 2400071 - protein, 19 aa, Entamoeba dispar
NCVECFLPYFGYNGDCQIN

SEQ ID NO: 2400072 - protein, 31 aa, Entamoeba dispar
NCVSVLEMLFISFPLDFIGEYLLMFNSFPDK

SEQ ID NO: 2400073 - protein, 36 aa, Entamoeba dispar
NDCHSSGLFYLKPQYKVGYYAGLYYLDDKCTKETGL

SEQ ID NO: 2400074 - protein, 47 aa, Entamoeba dispar
NDDNFGKIYNFYLPCQAYVTATYHYSSLFNLTKYKLHLPQSEEFMKE

SEQ ID NO: 2400075 - protein, 29 aa, Entamoeba dispar
NDDNLVLMALPRYPLLTGWKTEFMIGYSL

SEQ ID NO: 2400076 - protein, 26 aa, Entamoeba dispar
NDDTMYYYFFSLPEELDLIFSFSFTE

SEQ ID NO: 2400077 - protein, 20 aa, Entamoeba dispar
NDFIKFKLISFSKPEIILIS

SEQ ID NO: 2400078 - protein, 19 aa, Entamoeba dispar
NDFIMQIMIQDGGVFFVEI

SEQ ID NO: 2400079 - protein, 17 aa, Entamoeba dispar
NDFSKQKFTFGHDSLII

SEQ ID NO: 2400080 - protein, 23 aa, Entamoeba dispar
NDGDDIDLALQKIYLVLGKVQQQ

SEQ ID NO: 2400081 - protein, 27 aa, Entamoeba dispar
NDGLKNPLNFYFYPEFEISDSKPFIFA

SEQ ID NO: 2400082 - protein, 21 aa, Entamoeba dispar
NDIKLLLPLSSFIPLIPSYAQ

SEQ ID NO: 2400083 - protein, 30 aa, Entamoeba dispar
NDIKTLSILIYKITFIFRNFQRVINNYFTV

SEQ ID NO: 2400084 - protein, 23 aa, Entamoeba dispar
NDIRILCRNQIPSSLRSSIYKLF

SEQ ID NO: 2400085 - protein, 35 aa, Entamoeba dispar
NDKHKYQWFFDASHLAYYLAYFTLIMLLGASDNFE

SEQ ID NO: 2400086 - protein, 32 aa, Entamoeba dispar
NDKLSYLWIFFTFIILYNNLVPISLYVCLEII

SEQ ID NO: 2400087 - protein, 29 aa, Entamoeba dispar
NDLLPNPLILLWAFIPFVLIYALRVLCIE

SEQ ID NO: 2400088 - protein, 19 aa, Entamoeba dispar
NDLPLWLIDGQCKSQTQIF

SEQ ID NO: 2400089 - protein, 17 aa, Entamoeba dispar
NDLYSLFLDNSSCFRTT

SEQ ID NO: 2400090 - protein, 23 aa, Entamoeba dispar
NDMYFDSLFIYLNEINLGKDKKH

SEQ ID NO: 2400091 - protein, 27 aa, Entamoeba dispar
NDMYLGLFFFIFYFAQTIAMVLMSLTT

SEQ ID NO: 2400092 - protein, 20 aa, Entamoeba dispar
NDNFVLTCRFLMKFRTTQLT

SEQ ID NO: 2400093 - protein, 36 aa, Entamoeba dispar
NDNNNYYYYHLPIQRTYFNSIPINLKFSSNNGIWYL

SEQ ID NO: 2400094 - protein, 23 aa, Entamoeba dispar
NDSYFHFDHIIITFGLKNKNIKL

SEQ ID NO: 2400095 - protein, 27 aa, Entamoeba dispar
NDTIKQIIYIIISILYQPLGNIVKKSI

SEQ ID NO: 2400096 - protein, 17 aa, Entamoeba dispar
NDTTKWKWGEYKQFHMI

SEQ ID NO: 2400097 - protein, 23 aa, Entamoeba dispar
NDVHYFIKPLFLNWAMFLGMTLC

SEQ ID NO: 2400098 - protein, 18 aa, Entamoeba dispar
NDVPLSYHLQIYSQSYSS

SEQ ID NO: 2400099 - protein, 29 aa, Entamoeba dispar
NDYGNEGFLLMIFYYLGCTLTLRKIKKEG

SEQ ID NO: 2400100 - protein, 21 aa, Entamoeba dispar
NDYILSASFLSYFQVRKYYLH

SEQ ID NO: 2400101 - protein, 25 aa, Entamoeba dispar
NDYSYYFNKAFKYSGLAFKCNRTYL

SEQ ID NO: 2400102 - protein, 25 aa, Entamoeba dispar
NDYSYYFNKDFTYSGLAFNCNRTYL

SEQ ID NO: 2400103 - protein, 26 aa, Entamoeba dispar
NEAWQYPIKLFVHLINIQTDRITSIP

SEQ ID NO: 2400104 - protein, 24 aa, Entamoeba dispar
NECILCYNGYQLQNKKCILYKEPC

SEQ ID NO: 2400105 - protein, 21 aa, Entamoeba dispar
NECMRLFMKIKRLLDSTQNIQ

SEQ ID NO: 2400106 - protein, 23 aa, Entamoeba dispar
NEDDLLKYMLFWKNSSVLVYDIE

SEQ ID NO: 2400107 - protein, 24 aa, Entamoeba dispar
NEDFKLYFNLINKFNSSQIPLLNN

SEQ ID NO: 2400108 - protein, 39 aa, Entamoeba dispar
NEEGVLLNCFLMILPVLKPHRRLAIALAIEYLKKMNSCI

SEQ ID NO: 2400109 - protein, 35 aa, Entamoeba dispar
NEFITFIIMTIIGILLIIFLFKFFDYSIQMSKNYS

SEQ ID NO: 2400110 - protein, 25 aa, Entamoeba dispar
NEFKELMNIIGINPVFICYMETMKN

SEQ ID NO: 2400111 - protein, 18 aa, Entamoeba dispar
NEFLYIVGVLAEIYISIG

SEQ ID NO: 2400112 - protein, 18 aa, Entamoeba dispar
NEFPFNKKVFLFTIIFPC

SEQ ID NO: 2400113 - protein, 27 aa, Entamoeba dispar
NEIEKYLKLILNLIHLLLIVEYVSPQS

SEQ ID NO: 2400114 - protein, 26 aa, Entamoeba dispar
NEIGDIPHLLLFKNINILIKDYLISP

SEQ ID NO: 2400115 - protein, 18 aa, Entamoeba dispar
NEIINYILKILFKHPRPP

SEQ ID NO: 2400116 - protein, 19 aa, Entamoeba dispar
NEILCISLTHFLLKKVVDC

SEQ ID NO: 2400117 - protein, 31 aa, Entamoeba dispar
NELDTLYSKELYLFWLFNVGNRKTKEDIICN

SEQ ID NO: 2400118 - protein, 23 aa, Entamoeba dispar
NENGILFKFLKNGKSFLTSQRIQ

SEQ ID NO: 2400119 - protein, 18 aa, Entamoeba dispar
NENLKPEPMYKLYISIEE

SEQ ID NO: 2400120 - protein, 28 aa, Entamoeba dispar
NENWKWKYLIHLSSYLTPTVLGKVFCML

SEQ ID NO: 2400121 - protein, 18 aa, Entamoeba dispar
NEPGLFGYYIADEPSTNC

SEQ ID NO: 2400122 - protein, 32 aa, Entamoeba dispar
NEPITIKYFGPPDELFIIPAVMTVLDPTSFEN

SEQ ID NO: 2400123 - protein, 26 aa, Entamoeba dispar
NEPKKQFIIHLFQLVLTGAVLVLDIK

SEQ ID NO: 2400124 - protein, 23 aa, Entamoeba dispar
NEPSCYQVFHDEIYMAMGTCVYY

SEQ ID NO: 2400125 - protein, 25 aa, Entamoeba dispar
NEQCSSLLFWAYLTSLFTLSIGMIG

SEQ ID NO: 2400126 - protein, 24 aa, Entamoeba dispar
NEQQFYRIAEISTLMLMDISLIST

SEQ ID NO: 2400127 - protein, 23 aa, Entamoeba dispar
NERPKFDANLFAIPSVLRNQLQK

SEQ ID NO: 2400128 - protein, 22 aa, Entamoeba dispar
NERRKLIRKLKESKIKLLNYQE

SEQ ID NO: 2400129 - protein, 27 aa, Entamoeba dispar
NERSRLLPYTLFRLGGAAILLTNKWNL

SEQ ID NO: 2400130 - protein, 30 aa, Entamoeba dispar
NERVFITTVVSTYLWDGLYVSLAKVTMRES

SEQ ID NO: 2400131 - protein, 23 aa, Entamoeba dispar
NESILLVALDMKKGKQFNCKINL

SEQ ID NO: 2400132 - protein, 27 aa, Entamoeba dispar
NETDCALLLFLKKIGISPSLIRSTNVI

SEQ ID NO: 2400133 - protein, 26 aa, Entamoeba dispar
NETRKKMIFINKKIQQIILYDKTFRG

SEQ ID NO: 2400134 - protein, 24 aa, Entamoeba dispar
NEVINYFKFISYNGKYRFNGVCNL

SEQ ID NO: 2400135 - protein, 25 aa, Entamoeba dispar
NEVPRRLKLKLLIDAAHGIKYLHQN

SEQ ID NO: 2400136 - protein, 33 aa, Entamoeba dispar
NEYKDFYVIQQGILLSFLNSYCLIKIKKQKKQA

SEQ ID NO: 2400137 - protein, 46 aa, Entamoeba dispar
NEYKKWYIQPIVLIKLLYNLIVLCLKYFGILLSPSLLLKKQWTPYS

SEQ ID NO: 2400138 - protein, 27 aa, Entamoeba dispar
NFAGIFGFFLLFIIPGVLQIYSKFIIR

SEQ ID NO: 2400139 - protein, 34 aa, Entamoeba dispar
NFDKNYYYMMIMDMILLLIRLLQEKEFEDECYRI

SEQ ID NO: 2400140 - protein, 25 aa, Entamoeba dispar
NFDYSYPIDVYAYGIVLYETYIEKG

SEQ ID NO: 2400141 - protein, 17 aa, Entamoeba dispar
NFFVNMSHYMFRASVDE

SEQ ID NO: 2400142 - protein, 33 aa, Entamoeba dispar
NFIGTSIFINIKFIPNIIFISSTPFPITYNEST

SEQ ID NO: 2400143 - protein, 24 aa, Entamoeba dispar
NFIIPKDVYFDFNTLAKKPKPVDA

SEQ ID NO: 2400144 - protein, 25 aa, Entamoeba dispar
NFIKIPKKIFISLIGKGFNGLVKEI

SEQ ID NO: 2400145 - protein, 17 aa, Entamoeba dispar
NFILKKNVFMACESPNS

SEQ ID NO: 2400146 - protein, 18 aa, Entamoeba dispar
NFILLKRSMIIFNKRRKE

SEQ ID NO: 2400147 - protein, 19 aa, Entamoeba dispar
NFIYIALTYCECTLEQHIN

SEQ ID NO: 2400148 - protein, 23 aa, Entamoeba dispar
NFKILIQLYQAFCKFALIYIRAN

SEQ ID NO: 2400149 - protein, 20 aa, Entamoeba dispar
NFKILYIDNVPYYGILTNVH

SEQ ID NO: 2400150 - protein, 34 aa, Entamoeba dispar
NFKVVWVCYIYQIALILFGILYQYTPKILKPIED

SEQ ID NO: 2400151 - protein, 19 aa, Entamoeba dispar
NFLGEILRSIKFIKYNAWE

SEQ ID NO: 2400152 - protein, 26 aa, Entamoeba dispar
NFLNYYLMHFLFFTALCFVGAIIMIL

SEQ ID NO: 2400153 - protein, 23 aa, Entamoeba dispar
NFNQQPIIILSNTSKLTGLKSIQ

SEQ ID NO: 2400154 - protein, 24 aa, Entamoeba dispar
NFPSTTIHFFLFNSSKIQLQNNTS

SEQ ID NO: 2400155 - protein, 22 aa, Entamoeba dispar
NFQLYVPQIITKGKIGYSLSSD

SEQ ID NO: 2400156 - protein, 17 aa, Entamoeba dispar
NFRAIVFIKRGLSGIEV

SEQ ID NO: 2400157 - protein, 21 aa, Entamoeba dispar
NFTTSWKDGKAFCALVHHFKP

SEQ ID NO: 2400158 - protein, 26 aa, Entamoeba dispar
NFVSFNFFIMYFAQTIMFGIMSITDK

SEQ ID NO: 2400159 - protein, 25 aa, Entamoeba dispar
NFYNGFLFPLLFYSTWQSFYLIYTE

SEQ ID NO: 2400160 - protein, 18 aa, Entamoeba dispar
NGAFSFLSTFFVGILLLS

SEQ ID NO: 2400161 - protein, 24 aa, Entamoeba dispar
NGEDPFNIIRKFGKKYIGLRSPHA

SEQ ID NO: 2400162 - protein, 28 aa, Entamoeba dispar
NGEDPFNIIRKFGKKYIGLRSPHAQFEK

SEQ ID NO: 2400163 - protein, 21 aa, Entamoeba dispar
NGEFIIILNSLNNWLEKINKE

SEQ ID NO: 2400164 - protein, 34 aa, Entamoeba dispar
NGEICPIPHSFLIFIRIISLFIMTVPSAFEFSQQ

SEQ ID NO: 2400165 - protein, 17 aa, Entamoeba dispar
NGEKIIGPWYVRRKKIQ

SEQ ID NO: 2400166 - protein, 42 aa, Entamoeba dispar
NGFERIKANLFLANFIRDLMRFWKLTYVVGLIDMVMDWYAFG

SEQ ID NO: 2400167 - protein, 23 aa, Entamoeba dispar
NGFFSWALIHLFTLSFIVTAFGA

SEQ ID NO: 2400168 - protein, 30 aa, Entamoeba dispar
NGGILIIVIIISFFIGWHMVMAIGGADMPV

SEQ ID NO: 2400169 - protein, 26 aa, Entamoeba dispar
NGIEDYKGFSWIRIVLKSGSKTPTLN

SEQ ID NO: 2400170 - protein, 24 aa, Entamoeba dispar
NGIEVIHLFTGKPLLHVSLSSSTM

SEQ ID NO: 2400171 - protein, 30 aa, Entamoeba dispar
NGINDGLIILIMWMNLFSYDINPIPKEIED

SEQ ID NO: 2400172 - protein, 26 aa, Entamoeba dispar
NGIQQLVKPVWYILNSTKDTTFTVST

SEQ ID NO: 2400173 - protein, 22 aa, Entamoeba dispar
NGKYLDLYRTQLALRKEKHEEA

SEQ ID NO: 2400174 - protein, 22 aa, Entamoeba dispar
NGLIIIRSIFMLLMLDCSKEED

SEQ ID NO: 2400175 - protein, 30 aa, Entamoeba dispar
NGLKNYLIIIRYYCLLLKYNYIDENCSIIN

SEQ ID NO: 2400176 - protein, 20 aa, Entamoeba dispar
NGLKYYLEAYVFKDILKNPP

SEQ ID NO: 2400177 - protein, 41 aa, Entamoeba dispar
NGLSTGMKVFIGIFIVVAVITIIAGIIAIIFAVVKTKKSGY

SEQ ID NO: 2400178 - protein, 29 aa, Entamoeba dispar
NGLVLGWVHAFIFWKYSVLMYVAGQELKK

SEQ ID NO: 2400179 - protein, 17 aa, Entamoeba dispar
NGNEFMIRCQCALRRIS

SEQ ID NO: 2400180 - protein, 21 aa, Entamoeba dispar
NGNIDFYLDDIKLILKEGSCN

SEQ ID NO: 2400181 - protein, 35 aa, Entamoeba dispar
NGQKCDLVPVWWNFIVVIIIISIIIKSCVIIGTAL

SEQ ID NO: 2400182 - protein, 24 aa, Entamoeba dispar
NGRVIIFIIRCSILFVTTLCACFV

SEQ ID NO: 2400183 - protein, 25 aa, Entamoeba dispar
NGTTPLMLSLYKNFPDIIKILLNAN

SEQ ID NO: 2400184 - protein, 17 aa, Entamoeba dispar
NGTVCIANFFATERQVD

SEQ ID NO: 2400185 - protein, 33 aa, Entamoeba dispar
NGVPISSYLLPSCTFFLGFSFIFGNYMKRVWES

SEQ ID NO: 2400186 - protein, 18 aa, Entamoeba dispar
NGVQPLIIGILSFILLLI

SEQ ID NO: 2400187 - protein, 17 aa, Entamoeba dispar
NGYAIFHMLRWTQGNEA

SEQ ID NO: 2400188 - protein, 22 aa, Entamoeba dispar
NGYTKDCTGCQPGYMWFGEGNC

SEQ ID NO: 2400189 - protein, 17 aa, Entamoeba dispar
NHEHRLYFFVYVTSDQS

SEQ ID NO: 2400190 - protein, 25 aa, Entamoeba dispar
NHFSHNLFIYPLKVTSSSFSLKKKF

SEQ ID NO: 2400191 - protein, 18 aa, Entamoeba dispar
NHPFFPWIDTAMSWETLV

SEQ ID NO: 2400192 - protein, 29 aa, Entamoeba dispar
NHQEKIFSLWGFIISYIVSKGGIVTVKLP

SEQ ID NO: 2400193 - protein, 18 aa, Entamoeba dispar
NHQELKKIFLLENDKKNL

SEQ ID NO: 2400194 - protein, 30 aa, Entamoeba dispar
NHQQLLDYINLLHAKLHIIKIGLSNKFIGE

SEQ ID NO: 2400195 - protein, 26 aa, Entamoeba dispar
NHSKKKWLMVIFHTPNSPKYVFYFDP

SEQ ID NO: 2400196 - protein, 24 aa, Entamoeba dispar
NIAVTLSIFYNWNDSGQLPTSFFS

SEQ ID NO: 2400197 - protein, 17 aa, Entamoeba dispar
NIAWRRTIGKNGKKITA

SEQ ID NO: 2400198 - protein, 18 aa, Entamoeba dispar
NICFIITFGYLLYRHIYL

SEQ ID NO: 2400199 - protein, 47 aa, Entamoeba dispar
NICKRKSMWWISLIVIPIFILIVIMIYFILTLISKKIIRLKQDNTLN

SEQ ID NO: 2400200 - protein, 20 aa, Entamoeba dispar
NIDHDIILYNFISVKQINVN

SEQ ID NO: 2400201 - protein, 27 aa, Entamoeba dispar
NIDNDKKMYLIPRKSLGGIPIDVPEEI

SEQ ID NO: 2400202 - protein, 20 aa, Entamoeba dispar
NIDNGLLDIIKNFFGFQFKE

SEQ ID NO: 2400203 - protein, 28 aa, Entamoeba dispar
NIFIISQLLFKRFPTNFLINLFGSWSVV

SEQ ID NO: 2400204 - protein, 29 aa, Entamoeba dispar
NIFIISQLLFKRFPTNFLINLFGSWSVVS

SEQ ID NO: 2400205 - protein, 19 aa, Entamoeba dispar
NIFNWKKALIVLFQGMTMA

SEQ ID NO: 2400206 - protein, 26 aa, Entamoeba dispar
NIFSNYMFVGIVSMTIIVQTLIVVFA

SEQ ID NO: 2400207 - protein, 25 aa, Entamoeba dispar
NIGIQSLYFAILSTMGYTLLLEKPK

SEQ ID NO: 2400208 - protein, 20 aa, Entamoeba dispar
NIHSLKLNTLYSSSLIIPLE

SEQ ID NO: 2400209 - protein, 32 aa, Entamoeba dispar
NIIKKSFGYYIFIVELFLVSLPIKGHILKQQF

SEQ ID NO: 2400210 - protein, 19 aa, Entamoeba dispar
NIILDIDQEVKDTKIYSVF

SEQ ID NO: 2400211 - protein, 20 aa, Entamoeba dispar
NIIMYLTQFSFLFFNGYSGT

SEQ ID NO: 2400212 - protein, 21 aa, Entamoeba dispar
NIINEVLIYNLFKQYNITNIF

SEQ ID NO: 2400213 - protein, 24 aa, Entamoeba dispar
NIIQPYLIESILTNIQPIRKVIAE

SEQ ID NO: 2400214 - protein, 21 aa, Entamoeba dispar
NIIRIKSIIPVLNIIPSKQRP

SEQ ID NO: 2400215 - protein, 20 aa, Entamoeba dispar
NIKLIWNFIVKIWDVITEFV

SEQ ID NO: 2400216 - protein, 26 aa, Entamoeba dispar
NIKNDWSCLFVLWLSITIQFKINNNH

SEQ ID NO: 2400217 - protein, 25 aa, Entamoeba dispar
NIKSYPIWTNWWGENFHWRERVDEV

SEQ ID NO: 2400218 - protein, 24 aa, Entamoeba dispar
NIKTKLCYPFVYVWNKFPSIVRSS

SEQ ID NO: 2400219 - protein, 28 aa, Entamoeba dispar
NILAPLVVLILLYTPLKLDYVWRTALAL

SEQ ID NO: 2400220 - protein, 26 aa, Entamoeba dispar
NILFIFMEQYLFLIKYEFHIFIQMEY

SEQ ID NO: 2400221 - protein, 24 aa, Entamoeba dispar
NILGCLCIFFFIMQLIYKYLRGVI

SEQ ID NO: 2400222 - protein, 18 aa, Entamoeba dispar
NILGHIFYKPKNAILLMI

SEQ ID NO: 2400223 - protein, 20 aa, Entamoeba dispar
NILKQYGYNLGLTVIETYRF

SEQ ID NO: 2400224 - protein, 24 aa, Entamoeba dispar
NILKTYLLYIVIQKNIVLTVHSEP

SEQ ID NO: 2400225 - protein, 17 aa, Entamoeba dispar
NILLPKLEESINKSHST

SEQ ID NO: 2400226 - protein, 20 aa, Entamoeba dispar
NILLYYFITLFLYSFITLFL

SEQ ID NO: 2400227 - protein, 21 aa, Entamoeba dispar
NILQQILYICETILTEIIDCF

SEQ ID NO: 2400228 - protein, 30 aa, Entamoeba dispar
NIMSFGRQINLYLLSLLSNKKQLILKKEDK

SEQ ID NO: 2400229 - protein, 18 aa, Entamoeba dispar
NIMYLIMIGLETVLGIFI

SEQ ID NO: 2400230 - protein, 28 aa, Entamoeba dispar
NINELVFQFLIQLSIYRSMIAFKLDATE

SEQ ID NO: 2400231 - protein, 18 aa, Entamoeba dispar
NINGFGFRIKRPERRSQK

SEQ ID NO: 2400232 - protein, 17 aa, Entamoeba dispar
NINKIIYYIGITGIDCY

SEQ ID NO: 2400233 - protein, 21 aa, Entamoeba dispar
NINNLFCPIVVYLNTNGVDKL

SEQ ID NO: 2400234 - protein, 22 aa, Entamoeba dispar
NIPDIQLISKIMWVVSCFLISY

SEQ ID NO: 2400235 - protein, 27 aa, Entamoeba dispar
NIPVIQLMHFFPVIMSNLFGMFNNHRI

SEQ ID NO: 2400236 - protein, 20 aa, Entamoeba dispar
NIRPQIFVGISMFNVLPAFS

SEQ ID NO: 2400237 - protein, 21 aa, Entamoeba dispar
NIRYFDYIFRIIETMSFYIVT

SEQ ID NO: 2400238 - protein, 24 aa, Entamoeba dispar
NISSLPIHYGYYKLLSELVLRYKK

SEQ ID NO: 2400239 - protein, 17 aa, Entamoeba dispar
NISVLFAGIVIGAISTI

SEQ ID NO: 2400240 - protein, 37 aa, Entamoeba dispar
NISWNGFTYVFQSFTFYLITIFTIIISVAPLILKRFI

SEQ ID NO: 2400241 - protein, 27 aa, Entamoeba dispar
NITVITIYSISFWYPGIISYDGLFSMA

SEQ ID NO: 2400242 - protein, 17 aa, Entamoeba dispar
NITVQSKPEWLTLCKKS

SEQ ID NO: 2400243 - protein, 26 aa, Entamoeba dispar
NIVMISSIVFYWFYPHEFKLHENLIV

SEQ ID NO: 2400244 - protein, 36 aa, Entamoeba dispar
NIVTQAIYQLFVLLFLLYCGRYISFLNAPCAYINHG

SEQ ID NO: 2400245 - protein, 18 aa, Entamoeba dispar
NIYISTLCSLFKLGRIPA

SEQ ID NO: 2400246 - protein, 29 aa, Entamoeba dispar
NIYTTLTFFGIFAEFITALTLAARVEESR

SEQ ID NO: 2400247 - protein, 29 aa, Entamoeba dispar
NKAICIGVLVLWLALLITFSLTSKIEDME

SEQ ID NO: 2400248 - protein, 25 aa, Entamoeba dispar
NKCIEPLIVLLTFSSSLDLTLLQLI

SEQ ID NO: 2400249 - protein, 18 aa, Entamoeba dispar
NKCIPGKLLVSCLNGKIY

SEQ ID NO: 2400250 - protein, 24 aa, Entamoeba dispar
NKCTKCLPDYFLKDGYCYSCYKCK

SEQ ID NO: 2400251 - protein, 17 aa, Entamoeba dispar
NKCVLIVGFVIILGLIA

SEQ ID NO: 2400252 - protein, 19 aa, Entamoeba dispar
NKCVLIVGFVIILGLIAGG

SEQ ID NO: 2400253 - protein, 17 aa, Entamoeba dispar
NKCYYFFSQDQLEMQKK

SEQ ID NO: 2400254 - protein, 24 aa, Entamoeba dispar
NKDVIQLLLKWIKSEVNEIVLPAV

SEQ ID NO: 2400255 - protein, 20 aa, Entamoeba dispar
NKDYYLLVHGYYGSPLDTFT

SEQ ID NO: 2400256 - protein, 41 aa, Entamoeba dispar
NKEGCIYHVIWWIVLLEIIIALFILIIIISIVCVITKIFIY

SEQ ID NO: 2400257 - protein, 37 aa, Entamoeba dispar
NKEIVWWMIMIIIIIILIIIIIIITIIIIMINYIIKR

SEQ ID NO: 2400258 - protein, 37 aa, Entamoeba dispar
NKEIVWWMIMIIIIIILIIIITIIIIIIIMINYIIKR

SEQ ID NO: 2400259 - protein, 46 aa, Entamoeba dispar
NKEKNWRLGLYIICPLLGVLLIGNIFVIVLYIIRKFRNNSYTSLSV

SEQ ID NO: 2400260 - protein, 41 aa, Entamoeba dispar
NKELSKIITLIQNYALMLINIKIILIHQFKKSNNILLQSNG

SEQ ID NO: 2400261 - protein, 24 aa, Entamoeba dispar
NKEQKWIWPTAIRFVPLFACASVF

SEQ ID NO: 2400262 - protein, 30 aa, Entamoeba dispar
NKEVIFNIITRWYIIISIGLIAFSMTFLMG

SEQ ID NO: 2400263 - protein, 26 aa, Entamoeba dispar
NKEWNKYLLFIYDNQNKKPNILLKYL

SEQ ID NO: 2400264 - protein, 25 aa, Entamoeba dispar
NKEYIQTLLTYFLNVPFKVIIKVEY

SEQ ID NO: 2400265 - protein, 29 aa, Entamoeba dispar
NKFEQPILSIPYLPLFGQPLKNVMLCHRP

SEQ ID NO: 2400266 - protein, 26 aa, Entamoeba dispar
NKGSKPIFSALMQSLLKLFTEISEYD

SEQ ID NO: 2400267 - protein, 25 aa, Entamoeba dispar
NKGSLLLLNLVDNKFYHIQYSCPKT

SEQ ID NO: 2400268 - protein, 17 aa, Entamoeba dispar
NKIKLCSLLTCFRRSSA

SEQ ID NO: 2400269 - protein, 21 aa, Entamoeba dispar
NKKEYALLVDLLKKLIVFERK

SEQ ID NO: 2400270 - protein, 22 aa, Entamoeba dispar
NKKIGEQLLDWAKKSLSIDSCD

SEQ ID NO: 2400271 - protein, 24 aa, Entamoeba dispar
NKKNKFLPELLKLTKEPTGTEGSV

SEQ ID NO: 2400272 - protein, 24 aa, Entamoeba dispar
NKKPNDCLSLKLKIKFIIDGAKGI

SEQ ID NO: 2400273 - protein, 25 aa, Entamoeba dispar
NKKPNILLKYLISNPRFITNFCNNV

SEQ ID NO: 2400274 - protein, 20 aa, Entamoeba dispar
NKKTCLWMTPFLIILAYIHL

SEQ ID NO: 2400275 - protein, 20 aa, Entamoeba dispar
NKLLPNDFFKKLYQNAERLS

SEQ ID NO: 2400276 - protein, 19 aa, Entamoeba dispar
NKLPLVGDSFYLISCDNQP

SEQ ID NO: 2400277 - protein, 27 aa, Entamoeba dispar
NKPLRPHFNPIFSKKIPPLLYLSCAQA

SEQ ID NO: 2400278 - protein, 31 aa, Entamoeba dispar
NKPNSELTNFFYFLPFTINIDNDKKMYLTPR

SEQ ID NO: 2400279 - protein, 43 aa, Entamoeba dispar
NKPNSELVYFVYFLPFTIYIDNNKKMYLIPRNELLDTPFGVPE

SEQ ID NO: 2400280 - protein, 34 aa, Entamoeba dispar
NKPNSELVYFYYFLPFKIYIDNNKKMYLIPRNEV

SEQ ID NO: 2400281 - protein, 25 aa, Entamoeba dispar
NKQRSIYFTYLPLENGNLLINSCDK

SEQ ID NO: 2400282 - protein, 26 aa, Entamoeba dispar
NKRDKYMLVIIHLPKSPKYVFHTEPE

SEQ ID NO: 2400283 - protein, 24 aa, Entamoeba dispar
NKRDLLIYGGYFPDKQKWLKQREV

SEQ ID NO: 2400284 - protein, 23 aa, Entamoeba dispar
NKRFSYFFFHWSDLIRTAFFHII

SEQ ID NO: 2400285 - protein, 36 aa, Entamoeba dispar
NKRIMVNTILILYPTGLQMYLIPLDNTIVESIWISV

SEQ ID NO: 2400286 - protein, 25 aa, Entamoeba dispar
NKRYKRAVWYKVFVPRRGTISVNTC

SEQ ID NO: 2400287 - protein, 17 aa, Entamoeba dispar
NKSIIMEYAPYGSLRNL

SEQ ID NO: 2400288 - protein, 38 aa, Entamoeba dispar
NKSNKWMMIIFHTPKTPKYIFYFEPQILIIKSKHKKIE

SEQ ID NO: 2400289 - protein, 25 aa, Entamoeba dispar
NKSYDWMILILINKIINIFITNNSI

SEQ ID NO: 2400290 - protein, 33 aa, Entamoeba dispar
NKTSLKFMYIGIGLFFTSLIRTIIFDVTGGNQI

SEQ ID NO: 2400291 - protein, 25 aa, Entamoeba dispar
NKTVKPLFTPQRWIDKAIPGGTNLQ

SEQ ID NO: 2400292 - protein, 23 aa, Entamoeba dispar
NKVMLFAMYVSCGISFVLLIIMI

SEQ ID NO: 2400293 - protein, 31 aa, Entamoeba dispar
NKVQYEFLAPFLPVISWQLAHVDLSWSLTQP

SEQ ID NO: 2400294 - protein, 17 aa, Entamoeba dispar
NKWHYFLLDFCYFTNCV

SEQ ID NO: 2400295 - protein, 21 aa, Entamoeba dispar
NKWHYFLLDFCYYTNFLLLVT

SEQ ID NO: 2400296 - protein, 22 aa, Entamoeba dispar
NKYFRREYIFVRDFITGLSTKT

SEQ ID NO: 2400297 - protein, 21 aa, Entamoeba dispar
NKYGFKFGPLPSTTILLYLNQ

SEQ ID NO: 2400298 - protein, 41 aa, Entamoeba dispar
NKYKNEIIGLLLLGFIYTIHCFFTIYCFFISIISTKSFEIS

SEQ ID NO: 2400299 - protein, 19 aa, Entamoeba dispar
NKYRFNFILKIEASASTDI

SEQ ID NO: 2400300 - protein, 23 aa, Entamoeba dispar
NKYTLVVVYAFNLGILLNRFFKL

SEQ ID NO: 2400301 - protein, 17 aa, Entamoeba dispar
NLARLVLFNNPITKISE

SEQ ID NO: 2400302 - protein, 24 aa, Entamoeba dispar
NLARVLSRICFLCGLFGGIKSNQL

SEQ ID NO: 2400303 - protein, 18 aa, Entamoeba dispar
NLCYLVITKYSPFVISLE

SEQ ID NO: 2400304 - protein, 21 aa, Entamoeba dispar
NLDAASSPFIILFAFIMAIVF

SEQ ID NO: 2400305 - protein, 26 aa, Entamoeba dispar
NLDCSFNRIFSFPPILSLTSLNIISN

SEQ ID NO: 2400306 - protein, 25 aa, Entamoeba dispar
NLEDAQYISDYWLKAISISNYAVTL

SEQ ID NO: 2400307 - protein, 23 aa, Entamoeba dispar
NLEDNYLVFKTLFDTNTNGFDKN

SEQ ID NO: 2400308 - protein, 22 aa, Entamoeba dispar
NLEQWAILLIKFGVTSIATILN

SEQ ID NO: 2400309 - protein, 24 aa, Entamoeba dispar
NLFFYFVFIFLFISVLFIIVINVT

SEQ ID NO: 2400310 - protein, 18 aa, Entamoeba dispar
NLFKMIDFSLLEQTLQTL

SEQ ID NO: 2400311 - protein, 22 aa, Entamoeba dispar
NLFQEFPTYNFSMGPAVITLVA

SEQ ID NO: 2400312 - protein, 27 aa, Entamoeba dispar
NLFSVQSLVLLFLKWMNVGKNCNFPLN

SEQ ID NO: 2400313 - protein, 25 aa, Entamoeba dispar
NLGILLNRFFKLWCLRKGNWEENYQ

SEQ ID NO: 2400314 - protein, 18 aa, Entamoeba dispar
NLGKLFINIILRTNIVIE

SEQ ID NO: 2400315 - protein, 18 aa, Entamoeba dispar
NLGLVSVAVTFLMGSALQ

SEQ ID NO: 2400316 - protein, 23 aa, Entamoeba dispar
NLGVIFFYIIVYTVNFILIHFVP

SEQ ID NO: 2400317 - protein, 23 aa, Entamoeba dispar
NLHKNLIHKLLKAKLGFFDVTPM

SEQ ID NO: 2400318 - protein, 28 aa, Entamoeba dispar
NLIGLIIFLPITFLTLTGGFVFGYSKGL

SEQ ID NO: 2400319 - protein, 26 aa, Entamoeba dispar
NLINSPYILKLYGISFDPLALVMDIC

SEQ ID NO: 2400320 - protein, 44 aa, Entamoeba dispar
NLKEVPWMILGFIGSMIYGALFPIFAYFLAEAICMLVTVYLTGM

SEQ ID NO: 2400321 - protein, 22 aa, Entamoeba dispar
NLKGFLWGYVAIILGVIATLLT

SEQ ID NO: 2400322 - protein, 26 aa, Entamoeba dispar
NLKMKRIIIIVFVTTFVVAVCIVCVL

SEQ ID NO: 2400323 - protein, 20 aa, Entamoeba dispar
NLKVTCSLPFSLKKYVQEKE

SEQ ID NO: 2400324 - protein, 20 aa, Entamoeba dispar
NLLGYWILNIIALIGQLAPI

SEQ ID NO: 2400325 - protein, 17 aa, Entamoeba dispar
NLLIIESLGALPKSTPI

SEQ ID NO: 2400326 - protein, 21 aa, Entamoeba dispar
NLLILSTKLHRFEITFEVMLF

SEQ ID NO: 2400327 - protein, 26 aa, Entamoeba dispar
NLLLTYPIIFHQFLTELSYDQLWTRN

SEQ ID NO: 2400328 - protein, 21 aa, Entamoeba dispar
NLLQDYWCIPGVLNGIAKVYG

SEQ ID NO: 2400329 - protein, 25 aa, Entamoeba dispar
NLNKKKLIYKLPIKVQTELSPKLDI

SEQ ID NO: 2400330 - protein, 21 aa, Entamoeba dispar
NLPEYGAFLFYASYGIETRGS

SEQ ID NO: 2400331 - protein, 31 aa, Entamoeba dispar
NLPLIKFYGKLLFALLFPLVMFLVITQLMEL

SEQ ID NO: 2400332 - protein, 24 aa, Entamoeba dispar
NLPNFETILLEDLKYWNSINFETK

SEQ ID NO: 2400333 - protein, 25 aa, Entamoeba dispar
NLQELSYFCFFLLISHMVSVTFDLS

SEQ ID NO: 2400334 - protein, 26 aa, Entamoeba dispar
NLRVVFLLVFIIFFTLNVRSEFQLFG

SEQ ID NO: 2400335 - protein, 29 aa, Entamoeba dispar
NLSGRLRWMIELFAYWNQLQFSPSPCYAT

SEQ ID NO: 2400336 - protein, 30 aa, Entamoeba dispar
NLSKSFVSFPPLFWVVRDYALDERTESWFF

SEQ ID NO: 2400337 - protein, 29 aa, Entamoeba dispar
NLSLVIFVWIFYFFLIRNWLSLRILIPIV

SEQ ID NO: 2400338 - protein, 28 aa, Entamoeba dispar
NLSTIFQFIIIGILTFIFIRNIIKINSS

SEQ ID NO: 2400339 - protein, 24 aa, Entamoeba dispar
NLVCYPFFLIPDEVHWYSIYICSA

SEQ ID NO: 2400340 - protein, 25 aa, Entamoeba dispar
NLVILFVILDFLRIQFAPNGTLSQL

SEQ ID NO: 2400341 - protein, 21 aa, Entamoeba dispar
NLVLLPLSKEYLRIPLTIKWE

SEQ ID NO: 2400342 - protein, 20 aa, Entamoeba dispar
NLVPWLFMSLVVVCWCTFFL

SEQ ID NO: 2400343 - protein, 18 aa, Entamoeba dispar
NLYAIIPISLRTDKERYS

SEQ ID NO: 2400344 - protein, 19 aa, Entamoeba dispar
NLYMFRWLTLLCCMEFTLF

SEQ ID NO: 2400345 - protein, 30 aa, Entamoeba dispar
NMEVKTKILLFQYLIDLIPNTLLNNIIEQC

SEQ ID NO: 2400346 - protein, 17 aa, Entamoeba dispar
NMGFVLYYFINTMVPFS

SEQ ID NO: 2400347 - protein, 25 aa, Entamoeba dispar
NMGNNQLFFVCKEYGKSMVMVTVGN

SEQ ID NO: 2400348 - protein, 26 aa, Entamoeba dispar
NMKEFYIMIMIIIFIIMGIISSELNK

SEQ ID NO: 2400349 - protein, 27 aa, Entamoeba dispar
NMMNDETLIFVLLRALDKVICDSTNIK

SEQ ID NO: 2400350 - protein, 20 aa, Entamoeba dispar
NMPDNYWNLITKCWDQEADK

SEQ ID NO: 2400351 - protein, 26 aa, Entamoeba dispar
NMTRKGHMFSPLKNFRKWQRKTPKQM

SEQ ID NO: 2400352 - protein, 23 aa, Entamoeba dispar
NNAILAHFILLNIGLACVAVTFL

SEQ ID NO: 2400353 - protein, 25 aa, Entamoeba dispar
NNCVEKLFNFLYKILSKDRLDKIIT

SEQ ID NO: 2400354 - protein, 24 aa, Entamoeba dispar
NNDLFNFIFTANSHFALFLTDLLR

SEQ ID NO: 2400355 - protein, 31 aa, Entamoeba dispar
NNDNKDLLYFYYFLPFNITIDRNKKMYLIPK

SEQ ID NO: 2400356 - protein, 30 aa, Entamoeba dispar
NNDPPKYIYNLKALYFLGGALLVVVALLSL

SEQ ID NO: 2400357 - protein, 18 aa, Entamoeba dispar
NNDTYLIYTVPQGIFIDK

SEQ ID NO: 2400358 - protein, 24 aa, Entamoeba dispar
NNEENSFIIIKLISCLLSSLDIEY

SEQ ID NO: 2400359 - protein, 27 aa, Entamoeba dispar
NNEHRNTLSRYLFLMNVIAVNQRLNRM

SEQ ID NO: 2400360 - protein, 31 aa, Entamoeba dispar
NNEISKYALIILLKRIILCDLDIRFENKKER

SEQ ID NO: 2400361 - protein, 22 aa, Entamoeba dispar
NNEYTILVLDRIVRVCPKDNLD

SEQ ID NO: 2400362 - protein, 21 aa, Entamoeba dispar
NNFFIVVCIVTLFETSALHRL

SEQ ID NO: 2400363 - protein, 24 aa, Entamoeba dispar
NNFSLPTFGFTVYGGLKVNGILTI

SEQ ID NO: 2400364 - protein, 37 aa, Entamoeba dispar
NNFTMRLIFTILCATVCLLFIIAITSIFLILKREREE

SEQ ID NO: 2400365 - protein, 33 aa, Entamoeba dispar
NNGLDGLLRKLGWLTFLDVLPLPITPSWGRILE

SEQ ID NO: 2400366 - protein, 43 aa, Entamoeba dispar
NNGVKVGWIIFGVVFFLIFVSIFAFIIGFIIYRKKRSNNGYHD

SEQ ID NO: 2400367 - protein, 31 aa, Entamoeba dispar
NNIDLYLFISSLKIYYSIPSLSLLIHSYTNA

SEQ ID NO: 2400368 - protein, 17 aa, Entamoeba dispar
NNIEALIKKLYKAFPTK

SEQ ID NO: 2400369 - protein, 22 aa, Entamoeba dispar
NNIFKQYGYKVGISFMESYRYK

SEQ ID NO: 2400370 - protein, 29 aa, Entamoeba dispar
NNIFLQNDFVWLLQSLYQAKFKRVHILCH

SEQ ID NO: 2400371 - protein, 20 aa, Entamoeba dispar
NNIMIVIKDWNGNVFGSFHE

SEQ ID NO: 2400372 - protein, 38 aa, Entamoeba dispar
NNINFKWRLSQYVTWYIIFSLLISMLMLSIIIGYHVII

SEQ ID NO: 2400373 - protein, 27 aa, Entamoeba dispar
NNKWNYLNIVYWIKFEFALRRYQFNIM

SEQ ID NO: 2400374 - protein, 31 aa, Entamoeba dispar
NNLESLVVILFLLVFALIAAGYVFVDGINKG

SEQ ID NO: 2400375 - protein, 20 aa, Entamoeba dispar
NNLWNVFISHSIEWQLDGEV

SEQ ID NO: 2400376 - protein, 25 aa, Entamoeba dispar
NNNNKIRIIDNLPILPIQSFSEACN

SEQ ID NO: 2400377 - protein, 20 aa, Entamoeba dispar
NNPEILYPLFKELLSYICAD

SEQ ID NO: 2400378 - protein, 22 aa, Entamoeba dispar
NNPFFFYEYVVDSVTFLLFNTG

SEQ ID NO: 2400379 - protein, 23 aa, Entamoeba dispar
NNPKILGEWYTKPNIIKYGGVEH

SEQ ID NO: 2400380 - protein, 24 aa, Entamoeba dispar
NNPVERYIWVCTEYSLYKIHAVKP

SEQ ID NO: 2400381 - protein, 17 aa, Entamoeba dispar
NNQKYVWWNVFTIRKNS

SEQ ID NO: 2400382 - protein, 29 aa, Entamoeba dispar
NNRDQQWIKTIFPIIFMSKKMNKWKNELV

SEQ ID NO: 2400383 - protein, 42 aa, Entamoeba dispar
NNRIGFIPPISDCYIIILLFDRWRSVLFHWKYYLQRVLPNDE

SEQ ID NO: 2400384 - protein, 17 aa, Entamoeba dispar
NNRLLHHAVANAGLLIT

SEQ ID NO: 2400385 - protein, 22 aa, Entamoeba dispar
NNTFDIIISTLFTWMKLYSKDE

SEQ ID NO: 2400386 - protein, 26 aa, Entamoeba dispar
NNTSKIYIIIIKLIDKINKINNYLEW

SEQ ID NO: 2400387 - protein, 18 aa, Entamoeba dispar
NNWFFYTIFVIYAIIFFL

SEQ ID NO: 2400388 - protein, 23 aa, Entamoeba dispar
NNYNWIHIIGIIIPLFGVIVGLV

SEQ ID NO: 2400389 - protein, 25 aa, Entamoeba dispar
NNYSYYFNKNFTYSGLAFNCNRTYL

SEQ ID NO: 2400390 - protein, 18 aa, Entamoeba dispar
NNYWFGVGLFYLTLVYIP

SEQ ID NO: 2400391 - protein, 27 aa, Entamoeba dispar
NPEDTLWIFTYFMKDLNLYGLFCDGLP

SEQ ID NO: 2400392 - protein, 25 aa, Entamoeba dispar
NPENFWLCIIPLCQPMYVLSSLVFK

SEQ ID NO: 2400393 - protein, 27 aa, Entamoeba dispar
NPFVFSPFLLLYATLSALLFIYLSHKL

SEQ ID NO: 2400394 - protein, 19 aa, Entamoeba dispar
NPLSFHSIFLLNGELKITE

SEQ ID NO: 2400395 - protein, 28 aa, Entamoeba dispar
NPQLIRLFLSFFLINSTRFAYLAKVDNF

SEQ ID NO: 2400396 - protein, 24 aa, Entamoeba dispar
NPRFKPIQFKWSKFIKKLDPDNEA

SEQ ID NO: 2400397 - protein, 22 aa, Entamoeba dispar
NPRSDHIFVFVIGGISLGEISM

SEQ ID NO: 2400398 - protein, 29 aa, Entamoeba dispar
NPSKFDKLIPFVPILLRKGDSISPLDQIT

SEQ ID NO: 2400399 - protein, 19 aa, Entamoeba dispar
NQCIECQIGYVLFNKKCYI

SEQ ID NO: 2400400 - protein, 18 aa, Entamoeba dispar
NQEFIPYEREWSTLITTG

SEQ ID NO: 2400401 - protein, 25 aa, Entamoeba dispar
NQETFYRMVLYPYKADVLFEMSKLI

SEQ ID NO: 2400402 - protein, 25 aa, Entamoeba dispar
NQFVFGIFCFKIVIVIVATIAGSLF

SEQ ID NO: 2400403 - protein, 21 aa, Entamoeba dispar
NQGFLKYWRIKEIPNFLLCAP

SEQ ID NO: 2400404 - protein, 31 aa, Entamoeba dispar
NQIHTFIVLYFVDVLICLFVDSLDLYHIHIL

SEQ ID NO: 2400405 - protein, 26 aa, Entamoeba dispar
NQILTNNYYHIIAGKLTTKECIVVVN

SEQ ID NO: 2400406 - protein, 22 aa, Entamoeba dispar
NQISLYQLIDWFKKDIHCKEDI

SEQ ID NO: 2400407 - protein, 24 aa, Entamoeba dispar
NQKGILFHIMRVLKILISGLCLII

SEQ ID NO: 2400408 - protein, 23 aa, Entamoeba dispar
NQKYRGFFDVIHFDITWDDRSYV

SEQ ID NO: 2400409 - protein, 27 aa, Entamoeba dispar
NQLFLSFLWIILLFTILFIYQLFLFFG

SEQ ID NO: 2400410 - protein, 21 aa, Entamoeba dispar
NQLLLPILLATVVTISLSRFF

SEQ ID NO: 2400411 - protein, 25 aa, Entamoeba dispar
NQMIYRKGHWFFVDFNKIDSMTKVI

SEQ ID NO: 2400412 - protein, 43 aa, Entamoeba dispar
NQNNSNTIWLIIIPSVICIILIIIIIVLLSIYLHKLLIKRRRF

SEQ ID NO: 2400413 - protein, 22 aa, Entamoeba dispar
NQQTIPIILDNPSIINLYNSVI

SEQ ID NO: 2400414 - protein, 32 aa, Entamoeba dispar
NQSLVVYFDLFMKYLQFIQPLLINKSTANKQI

SEQ ID NO: 2400415 - protein, 24 aa, Entamoeba dispar
NQTGLWYFIEKSGFKIKKYVGRNI

SEQ ID NO: 2400416 - protein, 23 aa, Entamoeba dispar
NQTIPERICLFLLETKSKYNSKD

SEQ ID NO: 2400417 - protein, 20 aa, Entamoeba dispar
NQVLFLSSIKQPIPFHSNCF

SEQ ID NO: 2400418 - protein, 26 aa, Entamoeba dispar
NRIILYQQYMALFLWVIHYLKRIFET

SEQ ID NO: 2400419 - protein, 19 aa, Entamoeba dispar
NRLYRTPYPFPATTTYGEI

SEQ ID NO: 2400420 - protein, 18 aa, Entamoeba dispar
NRMVSGLIYFFVTPFIDI

SEQ ID NO: 2400421 - protein, 18 aa, Entamoeba dispar
NRNIYFLNSCGIDYYNKN

SEQ ID NO: 2400422 - protein, 28 aa, Entamoeba dispar
NRQFRRRFFILRPFFRRRRFTLSPIIWK

SEQ ID NO: 2400423 - protein, 33 aa, Entamoeba dispar
NRQQLEAYLLSIIYIIFVCCVSILIAFVIIIIL

SEQ ID NO: 2400424 - protein, 23 aa, Entamoeba dispar
NRSDFEIHWITFSQLNDLTIEFF

SEQ ID NO: 2400425 - protein, 34 aa, Entamoeba dispar
NRSSGLLIWTIWTIMTILAVTILTVSIISLIFFN

SEQ ID NO: 2400426 - protein, 17 aa, Entamoeba dispar
NRTHAVFYNLTYDISVQ

SEQ ID NO: 2400427 - protein, 29 aa, Entamoeba dispar
NRTPVGLYTFIFSIILPCATIIGCLKLKS

SEQ ID NO: 2400428 - protein, 31 aa, Entamoeba dispar
NRWCNCTINCPFSFIYSKFWLESGAYEMTSI

SEQ ID NO: 2400429 - protein, 17 aa, Entamoeba dispar
NSCICVEWYEITPEPWK

SEQ ID NO: 2400430 - protein, 18 aa, Entamoeba dispar
NSCISCEDNFFLYNGRQC

SEQ ID NO: 2400431 - protein, 18 aa, Entamoeba dispar
NSCSCGETLNIVFNKRGI

SEQ ID NO: 2400432 - protein, 35 aa, Entamoeba dispar
NSEIIKICFYKNASFFLILLWYSFISNFTCQVVYD

SEQ ID NO: 2400433 - protein, 25 aa, Entamoeba dispar
NSEKQFFQILPPLLIPSDGKAHDGR

SEQ ID NO: 2400434 - protein, 35 aa, Entamoeba dispar
NSEYDLLYRFVQTLGMLPFSLLSTGNKSKCYFKKS

SEQ ID NO: 2400435 - protein, 27 aa, Entamoeba dispar
NSFGIITLFLLFSPLFSWIYCLCIKTH

SEQ ID NO: 2400436 - protein, 17 aa, Entamoeba dispar
NSFILLALIIAFFFIIP

SEQ ID NO: 2400437 - protein, 33 aa, Entamoeba dispar
NSFLFNSHLSILSPFLPFLNLTRRFDSQLIQLQ

SEQ ID NO: 2400438 - protein, 25 aa, Entamoeba dispar
NSFPSTYKWACLNSILILSTQTFND

SEQ ID NO: 2400439 - protein, 26 aa, Entamoeba dispar
NSFQLSPFLYFQPDVFVLAFDISNIK

SEQ ID NO: 2400440 - protein, 26 aa, Entamoeba dispar
NSFTQGKLLLLPLSKEYLNTPITITW

SEQ ID NO: 2400441 - protein, 29 aa, Entamoeba dispar
NSIHCGYYFQPYSTIRFLVSDYKAWGYES

SEQ ID NO: 2400442 - protein, 24 aa, Entamoeba dispar
NSIIQFIQNCLLRIILFVCGIYSI

SEQ ID NO: 2400443 - protein, 25 aa, Entamoeba dispar
NSIVLSFILKQLPSLFKKRLPGIEV

SEQ ID NO: 2400444 - protein, 22 aa, Entamoeba dispar
NSKEFIIMEIYLDQLRKDCKAD

SEQ ID NO: 2400445 - protein, 28 aa, Entamoeba dispar
NSLAIRLCSLMFYHYFSCSQECSLEYPV

SEQ ID NO: 2400446 - protein, 23 aa, Entamoeba dispar
NSLCLIIEYFPLGSIRKFYTEHE

SEQ ID NO: 2400447 - protein, 27 aa, Entamoeba dispar
NSMESPYFHLKWYNTIYMKQKELENYM

SEQ ID NO: 2400448 - protein, 18 aa, Entamoeba dispar
NSMFYHIIHSPFIFFDTT

SEQ ID NO: 2400449 - protein, 25 aa, Entamoeba dispar
NSMTLWMMILVICAVVGSTLYQIRS

SEQ ID NO: 2400450 - protein, 22 aa, Entamoeba dispar
NSQRTIITTIKKLKLATKNNDE

SEQ ID NO: 2400451 - protein, 41 aa, Entamoeba dispar
NSQRYAHLKYFYLSLPSLLLTYIDFIIAAKERLLRNSTNLD

SEQ ID NO: 2400452 - protein, 26 aa, Entamoeba dispar
NSRAMWNIVQIFDWTVYNDSYNLDWS

SEQ ID NO: 2400453 - protein, 22 aa, Entamoeba dispar
NSRFIIVLMTLLYVFAQEYFMS

SEQ ID NO: 2400454 - protein, 27 aa, Entamoeba dispar
NSSETLLRLFSSRLIYLTLKSEFVLSN

SEQ ID NO: 2400455 - protein, 25 aa, Entamoeba dispar
NSSKYMLLIFHTPNNPKYVFHFMPQ

SEQ ID NO: 2400456 - protein, 20 aa, Entamoeba dispar
NSSPSYLFFIEFLMIIILLF

SEQ ID NO: 2400457 - protein, 25 aa, Entamoeba dispar
NSVIKQYCMLLLPKDFDNYEIEKLE

SEQ ID NO: 2400458 - protein, 22 aa, Entamoeba dispar
NSVLSTIILSPGGKFLDIIFSL

SEQ ID NO: 2400459 - protein, 23 aa, Entamoeba dispar
NSWVFSWLMFISYIFVCLNCGGI

SEQ ID NO: 2400460 - protein, 19 aa, Entamoeba dispar
NSYLNSYYIDQIKKLTVIN

SEQ ID NO: 2400461 - protein, 22 aa, Entamoeba dispar
NTAWLNIITFPFLFGIMFSDAG

SEQ ID NO: 2400462 - protein, 22 aa, Entamoeba dispar
NTCMMVNVLYFMFFHITTPSKG

SEQ ID NO: 2400463 - protein, 26 aa, Entamoeba dispar
NTDFSLPSFPFKVYGGLNIIGELTFE

SEQ ID NO: 2400464 - protein, 20 aa, Entamoeba dispar
NTFKRMFKFFNKKNFWSIYC

SEQ ID NO: 2400465 - protein, 17 aa, Entamoeba dispar
NTFKYPIVLDNYQSYEK

SEQ ID NO: 2400466 - protein, 23 aa, Entamoeba dispar
NTGISIVFFLRRGQTFWQTLVSI

SEQ ID NO: 2400467 - protein, 30 aa, Entamoeba dispar
NTGLFMTSILGFIGFFICSVIALIQGKKAT

SEQ ID NO: 2400468 - protein, 26 aa, Entamoeba dispar
NTGSEFVYFFAYKNEAWGFTKITAKT

SEQ ID NO: 2400469 - protein, 21 aa, Entamoeba dispar
NTHFILPICPSKCSISGKGME

SEQ ID NO: 2400470 - protein, 36 aa, Entamoeba dispar
NTIELCIEIIYILITLYPFDNFKILKPIIIVKKEIQ

SEQ ID NO: 2400471 - protein, 26 aa, Entamoeba dispar
NTIHHLAWLLLFDIQRMYSIDKDKEV

SEQ ID NO: 2400472 - protein, 28 aa, Entamoeba dispar
NTLMTFERFVFIASVTGILIFERGRMKK

SEQ ID NO: 2400473 - protein, 42 aa, Entamoeba dispar
NTNKKEWIIIIVFIIAVIVIGIIIIGIIFVGVYLSKRKEKGY

SEQ ID NO: 2400474 - protein, 23 aa, Entamoeba dispar
NTNPIIVILPMNGGGYADLEANF

SEQ ID NO: 2400475 - protein, 19 aa, Entamoeba dispar
NTNVIVESLLFKQSYYYAD

SEQ ID NO: 2400476 - protein, 23 aa, Entamoeba dispar
NTQCFFKYFTPFWNNSNKRFESL

SEQ ID NO: 2400477 - protein, 19 aa, Entamoeba dispar
NTQELLLFGPSPGLGSAEA

SEQ ID NO: 2400478 - protein, 25 aa, Entamoeba dispar
NTQLKTIQFVLYYESTNTSEVPIII

SEQ ID NO: 2400479 - protein, 24 aa, Entamoeba dispar
NTQYPTTIYLYKKVTTSNGCMGDA

SEQ ID NO: 2400480 - protein, 28 aa, Entamoeba dispar
NTSLIKLIFFKNAAFFLHLLWFACICMF

SEQ ID NO: 2400481 - protein, 35 aa, Entamoeba dispar
NTSRGFSYITFIFLFLCFIAYILIATLVLHRTENC

SEQ ID NO: 2400482 - protein, 34 aa, Entamoeba dispar
NTTESLQWFYGINYLVHRIFFTFYDNNSFLSLIK

SEQ ID NO: 2400483 - protein, 22 aa, Entamoeba dispar
NTTFMTIYPLLMIASVGSGGFG

SEQ ID NO: 2400484 - protein, 24 aa, Entamoeba dispar
NTTNSFIKFSFYNITLTSAELITF

SEQ ID NO: 2400485 - protein, 29 aa, Entamoeba dispar
NTVIPLSVVLFIFLLITFSVISNRKRRDD

SEQ ID NO: 2400486 - protein, 23 aa, Entamoeba dispar
NVALNKIFELIALSKPALKAVHY

SEQ ID NO: 2400487 - protein, 22 aa, Entamoeba dispar
NVDGRFFCVMELTVINEEVFQS

SEQ ID NO: 2400488 - protein, 29 aa, Entamoeba dispar
NVELTIDTLIPCDYLSFGPGISVKTTNVG

SEQ ID NO: 2400489 - protein, 20 aa, Entamoeba dispar
NVEYFFAPYLSMKGFDILTD

SEQ ID NO: 2400490 - protein, 19 aa, Entamoeba dispar
NVFDYINVDNILTLPGCLI

SEQ ID NO: 2400491 - protein, 23 aa, Entamoeba dispar
NVFRKLFHLPLYPVEEEIVFGHL

SEQ ID NO: 2400492 - protein, 29 aa, Entamoeba dispar
NVFSNLFTNFIFLSIIAITIIVQFIIVQF

SEQ ID NO: 2400493 - protein, 21 aa, Entamoeba dispar
NVGIFIFMILSLCLLSYTNHC

SEQ ID NO: 2400494 - protein, 28 aa, Entamoeba dispar
NVLITILFFIFLIWYFNKHSFNLGVLLV

SEQ ID NO: 2400495 - protein, 30 aa, Entamoeba dispar
NVLMELYMFILFVWIFFHVDHLKLLAIEEP

SEQ ID NO: 2400496 - protein, 18 aa, Entamoeba dispar
NVLQLIKPLISTGGQLTI

SEQ ID NO: 2400497 - protein, 21 aa, Entamoeba dispar
NVMMVIFYIMGILIHINCLYQ

SEQ ID NO: 2400498 - protein, 26 aa, Entamoeba dispar
NVNIIIFLIIIFIIVILIFAYTYPFN

SEQ ID NO: 2400499 - protein, 27 aa, Entamoeba dispar
NVPISSIIGIKYYQYLGAVLEACVNST

SEQ ID NO: 2400500 - protein, 17 aa, Entamoeba dispar
NVPYGLFIKDQSKWNTE

SEQ ID NO: 2400501 - protein, 24 aa, Entamoeba dispar
NVQKLDRILPPIISILLTQQDERN

SEQ ID NO: 2400502 - protein, 24 aa, Entamoeba dispar
NVQTFIIYHFWVDVIVRAGIASIP

SEQ ID NO: 2400503 - protein, 18 aa, Entamoeba dispar
NVVECPYWLAPEVILNNH

SEQ ID NO: 2400504 - protein, 25 aa, Entamoeba dispar
NVVLPSAPLFISGTVYFVGGITVQR

SEQ ID NO: 2400505 - protein, 23 aa, Entamoeba dispar
NVVVCFLEMLIMKGEVLKPQKGE

SEQ ID NO: 2400506 - protein, 18 aa, Entamoeba dispar
NVYFACHDTIYVYISDSN

SEQ ID NO: 2400507 - protein, 25 aa, Entamoeba dispar
NWFFTLWYFILSCLTFFITGVLGLV

SEQ ID NO: 2400508 - protein, 31 aa, Entamoeba dispar
NWKDLYEILFEFFKIFLTTKPFICEYQNVLI

SEQ ID NO: 2400509 - protein, 26 aa, Entamoeba dispar
NWKINIIVIILLLNFFHILSLSVIDI

SEQ ID NO: 2400510 - protein, 23 aa, Entamoeba dispar
NWKKVPLIIIIKTALWVKEKIQQ

SEQ ID NO: 2400511 - protein, 18 aa, Entamoeba dispar
NWNDVRFELVSDIPWNCF

SEQ ID NO: 2400512 - protein, 18 aa, Entamoeba dispar
NWNTKMIFVWVKASFIDE

SEQ ID NO: 2400513 - protein, 18 aa, Entamoeba dispar
NWPGNKFITIVKGTTLKT

SEQ ID NO: 2400514 - protein, 17 aa, Entamoeba dispar
NWRYCPKYKEEEGFDAD

SEQ ID NO: 2400515 - protein, 17 aa, Entamoeba dispar
NWSLLISVLFWNINGVD

SEQ ID NO: 2400516 - protein, 25 aa, Entamoeba dispar
NYCQKLWPIVIIYTLLIVLMEMIVQ

SEQ ID NO: 2400517 - protein, 30 aa, Entamoeba dispar
NYDEFTFIIFISIFIVVTLKVFFITKRYTI

SEQ ID NO: 2400518 - protein, 23 aa, Entamoeba dispar
NYDITRSLPLYLSIFIFGESSNE

SEQ ID NO: 2400519 - protein, 23 aa, Entamoeba dispar
NYDWKRLRCFHFSLKEMRINDFN

SEQ ID NO: 2400520 - protein, 22 aa, Entamoeba dispar
NYENLPHTFYFDDITLIRDENA

SEQ ID NO: 2400521 - protein, 18 aa, Entamoeba dispar
NYFIGYISSCLIFPIALT

SEQ ID NO: 2400522 - protein, 23 aa, Entamoeba dispar
NYGMFISLYIIAIAAMIGGILYF

SEQ ID NO: 2400523 - protein, 20 aa, Entamoeba dispar
NYGYILYSPNGWNETIIESV

SEQ ID NO: 2400524 - protein, 24 aa, Entamoeba dispar
NYHEKVYWNLWLEKDGNGDIGIID

SEQ ID NO: 2400525 - protein, 29 aa, Entamoeba dispar
NYHLNSMTFFIIFICITPFFVHGDCWYVS

SEQ ID NO: 2400526 - protein, 38 aa, Entamoeba dispar
NYIDVIIEGYFYLFPAFCLPWFVKQKKNIPMLNEALKK

SEQ ID NO: 2400527 - protein, 17 aa, Entamoeba dispar
NYIVCSPNWAYVGDESK

SEQ ID NO: 2400528 - protein, 25 aa, Entamoeba dispar
NYIVIVWFCLFISFISCIIHPLLNS

SEQ ID NO: 2400529 - protein, 24 aa, Entamoeba dispar
NYKEIIMPNFLFLIKICLQNKDIC

SEQ ID NO: 2400530 - protein, 25 aa, Entamoeba dispar
NYKKIIHLLEQRIWRYYYIHYKQIQ

SEQ ID NO: 2400531 - protein, 24 aa, Entamoeba dispar
NYNLLTLLFNRYSFFKYYPSKYLI

SEQ ID NO: 2400532 - protein, 24 aa, Entamoeba dispar
NYNYNYHLPIQRTYFNSNPINLKF

SEQ ID NO: 2400533 - protein, 19 aa, Entamoeba dispar
NYPFQLIFEFMLEKNAKCL

SEQ ID NO: 2400534 - protein, 20 aa, Entamoeba dispar
NYQCWDCMLGYIKNGSYCAR

SEQ ID NO: 2400535 - protein, 27 aa, Entamoeba dispar
NYQNKKIFFFFFENQPNYCYPPNKIID

SEQ ID NO: 2400536 - protein, 25 aa, Entamoeba dispar
NYRHEYIFCTLGLIGGIGAGAAFPF

SEQ ID NO: 2400537 - protein, 36 aa, Entamoeba dispar
NYRSIYWPVFVSLYGWPLILLIIGLYCDMVLPRKYG

SEQ ID NO: 2400538 - protein, 26 aa, Entamoeba dispar
NYSRNKWMMIIFHTPNNPKYVFYFEP

SEQ ID NO: 2400539 - protein, 32 aa, Entamoeba dispar
NYSTTIFFTFLLFLLSIFIYTIFLCCKNLKEW

SEQ ID NO: 2400540 - protein, 31 aa, Entamoeba dispar
NYSVLIQLIFIFLISIISFSGTLYWSHGLTT

SEQ ID NO: 2400541 - protein, 37 aa, Entamoeba dispar
NYSYSYFKELYPIYYYFNINLIISQLWGLVYKGFNDT

SEQ ID NO: 2400542 - protein, 24 aa, Entamoeba dispar
NYVQRVLEVIPEQVFLLINSIAKL

SEQ ID NO: 2400543 - protein, 17 aa, Entamoeba dispar
NYYIFKQIQVAVSILCG

SEQ ID NO: 2400544 - protein, 18 aa, Entamoeba dispar
PADIYSFAITMFETIKWD

SEQ ID NO: 2400545 - protein, 44 aa, Entamoeba dispar
PADIYSFAITMYEIMKWGPAYDKTTFKYPWSIADFVTKGNRLPI

SEQ ID NO: 2400546 - protein, 36 aa, Entamoeba dispar
PAFLAVFFGMLFLFVKPLYNFFFTGPLRVVGNTMKV

SEQ ID NO: 2400547 - protein, 28 aa, Entamoeba dispar
PAHYVFTMYEILGRVVRLMILFGKNTIN

SEQ ID NO: 2400548 - protein, 17 aa, Entamoeba dispar
PAILFMVLTLVAAFAVI

SEQ ID NO: 2400549 - protein, 18 aa, Entamoeba dispar
PAQFKTIKLSSTKGWDVL

SEQ ID NO: 2400550 - protein, 17 aa, Entamoeba dispar
PATLPLLLPLLPSLSPT

SEQ ID NO: 2400551 - protein, 23 aa, Entamoeba dispar
PATTLYPIGWKQTTTYNLGLCYL

SEQ ID NO: 2400552 - protein, 17 aa, Entamoeba dispar
PCILSVLVAALDGLLKS

SEQ ID NO: 2400553 - protein, 24 aa, Entamoeba dispar
PCSRQLQPGTWFFLKGADETIMIS

SEQ ID NO: 2400554 - protein, 19 aa, Entamoeba dispar
PCYIGFFFLVISYARFRLY

SEQ ID NO: 2400555 - protein, 41 aa, Entamoeba dispar
PDFNSLAFLIFPLLVTFLAIIILILFPFLKTYFIPSNSHST

SEQ ID NO: 2400556 - protein, 25 aa, Entamoeba dispar
PDFSMPYNVLALTLAIFALGIGNSI

SEQ ID NO: 2400557 - protein, 58 aa, Entamoeba dispar
PDGPFLSFIMNLFLYGFFSSFCSFSSFFFFGNSHINPFLLAILYTKLQYGFFRANFSS

SEQ ID NO: 2400558 - protein, 22 aa, Entamoeba dispar
PDNECYILWTQVQPVYDNGDFI

SEQ ID NO: 2400559 - protein, 23 aa, Entamoeba dispar
PDNKQFIQLLLSLLEIFITNGNY

SEQ ID NO: 2400560 - protein, 26 aa, Entamoeba dispar
PDNYYKTFNFNKINSFIPIICVINNC

SEQ ID NO: 2400561 - protein, 25 aa, Entamoeba dispar
PDQYLILYFSLCIFTSIINQTLFLS

SEQ ID NO: 2400562 - protein, 24 aa, Entamoeba dispar
PEAKAAMIWIIGEYSDRITNVADL

SEQ ID NO: 2400563 - protein, 25 aa, Entamoeba dispar
PEELSLFHFFLGEVMFDPNVTIHTF

SEQ ID NO: 2400564 - protein, 38 aa, Entamoeba dispar
PEGFFNKIVWVGKKIYCMIKLNRWYIKPKTIKYGNVKH

SEQ ID NO: 2400565 - protein, 44 aa, Entamoeba dispar
PEGKYCAKKNLWYVWVIIVVGIIFIISLIILGIVYKRIHHKIKK

SEQ ID NO: 2400566 - protein, 29 aa, Entamoeba dispar
PEIAKARLFLFYCARIVLGNGLRLLGLEP

SEQ ID NO: 2400567 - protein, 22 aa, Entamoeba dispar
PEIRDWVLIPLLIVTVCSNYLR

SEQ ID NO: 2400568 - protein, 26 aa, Entamoeba dispar
PEIYNQLYLLLKLYQNFIKPKNQSFI

SEQ ID NO: 2400569 - protein, 28 aa, Entamoeba dispar
PEKEFMPQRWILAHIKLEKDWTMKEIIE

SEQ ID NO: 2400570 - protein, 35 aa, Entamoeba dispar
PEKLILQPNKCCYINLLFMPYCSFNIQIPFQIIIV

SEQ ID NO: 2400571 - protein, 20 aa, Entamoeba dispar
PEKLLKRPVFQRTAFSSLNL

SEQ ID NO: 2400572 - protein, 32 aa, Entamoeba dispar
PELNHLQLIVWNSDFIFLSKGALLETQTFRIK

SEQ ID NO: 2400573 - protein, 26 aa, Entamoeba dispar
PENFRIYFIRLCQLLSFHGPKVAPTM

SEQ ID NO: 2400574 - protein, 25 aa, Entamoeba dispar
PENMPDWYYILICKCWQNNPQERLT

SEQ ID NO: 2400575 - protein, 26 aa, Entamoeba dispar
PEPNNLLLFIIATLMIYLKANKKIVN

SEQ ID NO: 2400576 - protein, 31 aa, Entamoeba dispar
PEQALRSLLFCDTPSLLYCYCDSLLKQTVSL

SEQ ID NO: 2400577 - protein, 25 aa, Entamoeba dispar
PESYKYWHHWALINFEIVSYIELDE

SEQ ID NO: 2400578 - protein, 20 aa, Entamoeba dispar
PETFGFVNFLFVFNEKTHEY

SEQ ID NO: 2400579 - protein, 23 aa, Entamoeba dispar
PEVKILIQNLIKTILLSLQQSSF

SEQ ID NO: 2400580 - protein, 21 aa, Entamoeba dispar
PEYVPVIYTPRVGPKRLKEKR

SEQ ID NO: 2400581 - protein, 25 aa, Entamoeba dispar
PFCWRSDTPLIYRAIPSWFVNVESF

SEQ ID NO: 2400582 - protein, 29 aa, Entamoeba dispar
PFFGIFLAIIRWVFILNFFISIIYAFVYN

SEQ ID NO: 2400583 - protein, 25 aa, Entamoeba dispar
PFICGLLCSAFGKTWLHFLNIFMCC

SEQ ID NO: 2400584 - protein, 20 aa, Entamoeba dispar
PFIYDYSKPIPLKQNIFIIL

SEQ ID NO: 2400585 - protein, 20 aa, Entamoeba dispar
PFIYIVFISICYITFCIEQK

SEQ ID NO: 2400586 - protein, 17 aa, Entamoeba dispar
PFLIVLHFTIPYMNNIH

SEQ ID NO: 2400587 - protein, 18 aa, Entamoeba dispar
PFLLLGNLIVIISIGIQV

SEQ ID NO: 2400588 - protein, 17 aa, Entamoeba dispar
PFLNAPCGFVKTVGHSG

SEQ ID NO: 2400589 - protein, 23 aa, Entamoeba dispar
PFLPINFNGIIRCSLPSCGNHQI

SEQ ID NO: 2400590 - protein, 24 aa, Entamoeba dispar
PFLYSLITVIFWFVIAQILVYLIT

SEQ ID NO: 2400591 - protein, 26 aa, Entamoeba dispar
PFPPTQKVFAILPYKNLNVLSGSDTF

SEQ ID NO: 2400592 - protein, 37 aa, Entamoeba dispar
PFTAIINGLVLGWVHAFIFWKYSVLMYFAGQELKKDP

SEQ ID NO: 2400593 - protein, 38 aa, Entamoeba dispar
PFTAIINGLVLGWVHAFIFWKYYVLMYVAGQELKDDPN

SEQ ID NO: 2400594 - protein, 26 aa, Entamoeba dispar
PFVFSPFLLLYATLSALLFIYLSHKL

SEQ ID NO: 2400595 - protein, 17 aa, Entamoeba dispar
PFWVYPERSVEGLIKFI

SEQ ID NO: 2400596 - protein, 20 aa, Entamoeba dispar
PFYFFFFSIFFFFLLFLCSL

SEQ ID NO: 2400597 - protein, 31 aa, Entamoeba dispar
PGERATRWRFLGFWICAVLNLFVPNYISGFD

SEQ ID NO: 2400598 - protein, 17 aa, Entamoeba dispar
PGFIYFIQNMLLYIILQ

SEQ ID NO: 2400599 - protein, 29 aa, Entamoeba dispar
PGISLTQWGVCILLGLVSLPLGLLNGIFK

SEQ ID NO: 2400600 - protein, 21 aa, Entamoeba dispar
PGKRNELFAIGLRKKRFISRD

SEQ ID NO: 2400601 - protein, 24 aa, Entamoeba dispar
PGLSERILSFLILNSTSVISQQPK

SEQ ID NO: 2400602 - protein, 22 aa, Entamoeba dispar
PGNVFIIIFSLISAMIMFSMSC

SEQ ID NO: 2400603 - protein, 29 aa, Entamoeba dispar
PGNVPLLILLGIVCLFFAGITTLFIIKFF

SEQ ID NO: 2400604 - protein, 19 aa, Entamoeba dispar
PGVFFKYELSPYIVINEMN

SEQ ID NO: 2400605 - protein, 18 aa, Entamoeba dispar
PHISNGLPFYIISANKSF

SEQ ID NO: 2400606 - protein, 26 aa, Entamoeba dispar
PHQISLSFFVWYIYSIHSFFTTTHPS

SEQ ID NO: 2400607 - protein, 36 aa, Entamoeba dispar
PIAGCLAIIIVIILIIIFLIFIIQTRRKKKEREEKI

SEQ ID NO: 2400608 - protein, 17 aa, Entamoeba dispar
PIAIRELPFLHSSKPSG

SEQ ID NO: 2400609 - protein, 17 aa, Entamoeba dispar
PICVWVFCHFAKETTFM

SEQ ID NO: 2400610 - protein, 26 aa, Entamoeba dispar
PIDTLKFFYYYILRQIKTLYNYVIHS

SEQ ID NO: 2400611 - protein, 29 aa, Entamoeba dispar
PIEYTFPTLLLVIVIISAILFALISTLLP

SEQ ID NO: 2400612 - protein, 20 aa, Entamoeba dispar
PIFCCIAILLYLITSIAAYF

SEQ ID NO: 2400613 - protein, 18 aa, Entamoeba dispar
PIFIHFDQTLLGLSTIRT

SEQ ID NO: 2400614 - protein, 27 aa, Entamoeba dispar
PIFISSPLILTDLSSISFTLPLQSCIE

SEQ ID NO: 2400615 - protein, 26 aa, Entamoeba dispar
PIFQSIVMFFAMSLCFFIEKLIELYK

SEQ ID NO: 2400616 - protein, 18 aa, Entamoeba dispar
PIFYTFACTFLSFFFILF

SEQ ID NO: 2400617 - protein, 20 aa, Entamoeba dispar
PIGILYPFHLLIESDVQTMD

SEQ ID NO: 2400618 - protein, 17 aa, Entamoeba dispar
PIGVFRDGEDINIIVST

SEQ ID NO: 2400619 - protein, 18 aa, Entamoeba dispar
PIHLAILSLLIKNSSFDH

SEQ ID NO: 2400620 - protein, 17 aa, Entamoeba dispar
PIIFICFCSFTTSVIIG

SEQ ID NO: 2400621 - protein, 20 aa, Entamoeba dispar
PIIIESIPFTKMVALPFEIE

SEQ ID NO: 2400622 - protein, 17 aa, Entamoeba dispar
PIIIHFPKIPRVVYLNN

SEQ ID NO: 2400623 - protein, 18 aa, Entamoeba dispar
PIIISPLLSWGLSNEFSY

SEQ ID NO: 2400624 - protein, 23 aa, Entamoeba dispar
PIIRRMIYIFGKLLEIMNKSTLF

SEQ ID NO: 2400625 - protein, 20 aa, Entamoeba dispar
PIIVFGIFDRDILPETLIMN

SEQ ID NO: 2400626 - protein, 20 aa, Entamoeba dispar
PIIWIYVFGRCRGFVHFLSC

SEQ ID NO: 2400627 - protein, 18 aa, Entamoeba dispar
PIKILIEQLNIIAKNAHF

SEQ ID NO: 2400628 - protein, 30 aa, Entamoeba dispar
PILFLVVCIILLCIITYWAFIPIGVCLLFV

SEQ ID NO: 2400629 - protein, 17 aa, Entamoeba dispar
PILIRNAALIAVTTILI

SEQ ID NO: 2400630 - protein, 25 aa, Entamoeba dispar
PINGDDWFFVLRLAKQITVSRDFKY

SEQ ID NO: 2400631 - protein, 25 aa, Entamoeba dispar
PINRKRLFFLTPFTLLVAIACVIQL

SEQ ID NO: 2400632 - protein, 17 aa, Entamoeba dispar
PIQLIFPKNGGGDYDYS

SEQ ID NO: 2400633 - protein, 18 aa, Entamoeba dispar
PIRFKKLWEYSGNISSQF

SEQ ID NO: 2400634 - protein, 19 aa, Entamoeba dispar
PIRKSIFKSFMNILVKLNA

SEQ ID NO: 2400635 - protein, 38 aa, Entamoeba dispar
PISHVIFWSIFEGIVFLLWIISLLLLVITKKVRKGVTS

SEQ ID NO: 2400636 - protein, 26 aa, Entamoeba dispar
PISLQLHFLVWPLEQRTDICQYLINT

SEQ ID NO: 2400637 - protein, 20 aa, Entamoeba dispar
PISLSEILKLDLNGGWGDQW

SEQ ID NO: 2400638 - protein, 27 aa, Entamoeba dispar
PISLSILIITFIPLVYYVITEESIFHN

SEQ ID NO: 2400639 - protein, 20 aa, Entamoeba dispar
PITEYPYPWSISKFVCVGRR

SEQ ID NO: 2400640 - protein, 18 aa, Entamoeba dispar
PITKPILSSSNKYIFELI

SEQ ID NO: 2400641 - protein, 25 aa, Entamoeba dispar
PITQVRIQLVHLLLSLTLSNYSYIY

SEQ ID NO: 2400642 - protein, 33 aa, Entamoeba dispar
PIVINDFIFLIQYYINCISLISFYYFTSQRNIS

SEQ ID NO: 2400643 - protein, 19 aa, Entamoeba dispar
PIVKEFISFALRLINSHSF

SEQ ID NO: 2400644 - protein, 18 aa, Entamoeba dispar
PIVLFTFQKNACGSFYEE

SEQ ID NO: 2400645 - protein, 20 aa, Entamoeba dispar
PIVPYIGLILSDLTFTNFGN

SEQ ID NO: 2400646 - protein, 19 aa, Entamoeba dispar
PIYLYHTFNYLYTPFAQMY

SEQ ID NO: 2400647 - protein, 27 aa, Entamoeba dispar
PIYTPYYFMMYYFNNLVIHFTVYGTIA

SEQ ID NO: 2400648 - protein, 30 aa, Entamoeba dispar
PKAKFIRLKPLVFDFFKIPNYRVVMEKELR

SEQ ID NO: 2400649 - protein, 33 aa, Entamoeba dispar
PKCLFNQFKYFYNLYFLITALSQFVPILQVGYR

SEQ ID NO: 2400650 - protein, 27 aa, Entamoeba dispar
PKDIPENIFWCKYFRFLYIKCGKEKQY

SEQ ID NO: 2400651 - protein, 25 aa, Entamoeba dispar
PKEVLTFIVISIPVTILLAIYSIIA

SEQ ID NO: 2400652 - protein, 17 aa, Entamoeba dispar
PKEYVTQYIYRDPPKEK

SEQ ID NO: 2400653 - protein, 24 aa, Entamoeba dispar
PKKSNWIVVGVIVLGVVVGAVVGG

SEQ ID NO: 2400654 - protein, 21 aa, Entamoeba dispar
PKKYLLILPGETSTSFCVCIV

SEQ ID NO: 2400655 - protein, 23 aa, Entamoeba dispar
PKLSDTQRIFYIAKIKLNEDNNT

SEQ ID NO: 2400656 - protein, 34 aa, Entamoeba dispar
PKLSYNEWYFVFYKIFFRILEPIGYYHLKSENVF

SEQ ID NO: 2400657 - protein, 21 aa, Entamoeba dispar
PKNYLFIISGVWFGLIHFINI

SEQ ID NO: 2400658 - protein, 22 aa, Entamoeba dispar
PKQFFLTSFVMFNLLGIDVSNI

SEQ ID NO: 2400659 - protein, 23 aa, Entamoeba dispar
PKQKTRLFNFESCKNSTAAQCFL

SEQ ID NO: 2400660 - protein, 18 aa, Entamoeba dispar
PKQRPVFSEIDRITSKLF

SEQ ID NO: 2400661 - protein, 26 aa, Entamoeba dispar
PKSPSLLRTLFRMEWGHFLICFIAIL

SEQ ID NO: 2400662 - protein, 38 aa, Entamoeba dispar
PKSPSLLRTLFRMEWGHFLICFIAILISQLSTLVIPAI

SEQ ID NO: 2400663 - protein, 41 aa, Entamoeba dispar
PKTISIIFTCLLVISFVVALLLIITYFTFVVISDKVGKKYI

SEQ ID NO: 2400664 - protein, 24 aa, Entamoeba dispar
PKTKINIDLTKPIKSYIPQHLKKE

SEQ ID NO: 2400665 - protein, 20 aa, Entamoeba dispar
PKTPVYFEYGKVIFEGTIYF

SEQ ID NO: 2400666 - protein, 24 aa, Entamoeba dispar
PKTTKFIRPYLDQLKQFHSQLING

SEQ ID NO: 2400667 - protein, 27 aa, Entamoeba dispar
PKVEFLQEFVWSLPSIDFLPTSVVLKI

SEQ ID NO: 2400668 - protein, 25 aa, Entamoeba dispar
PKYFVKDSFLGWKYIDFNNSKFNPD

SEQ ID NO: 2400669 - protein, 20 aa, Entamoeba dispar
PKYVFHFNPQVKILGPRRSK

SEQ ID NO: 2400670 - protein, 18 aa, Entamoeba dispar
PKYVFISMAFADIFTKDP

SEQ ID NO: 2400671 - protein, 18 aa, Entamoeba dispar
PLAGMPIIDVYKAKICVV

SEQ ID NO: 2400672 - protein, 28 aa, Entamoeba dispar
PLAVFPIMLFFTMLSWLTLVVNITGFTI

SEQ ID NO: 2400673 - protein, 32 aa, Entamoeba dispar
PLCSLQTFFPPMLPFLFRSLTQPKQPLPKKYL

SEQ ID NO: 2400674 - protein, 27 aa, Entamoeba dispar
PLCYKQAYPTLWYKIKGDGRYLVVNTC

SEQ ID NO: 2400675 - protein, 24 aa, Entamoeba dispar
PLEESPFNLLKLDVQIQLKVCSFL

SEQ ID NO: 2400676 - protein, 19 aa, Entamoeba dispar
PLENLQVPYFVFTASRYLE

SEQ ID NO: 2400677 - protein, 27 aa, Entamoeba dispar
PLEYAVQLQLPLLVRLILDIDSADVKL

SEQ ID NO: 2400678 - protein, 31 aa, Entamoeba dispar
PLFGKHYLFALFLLFIVRFTITAMSISMPVP

SEQ ID NO: 2400679 - protein, 21 aa, Entamoeba dispar
PLGIYFIKYFVQILRNYKEEI

SEQ ID NO: 2400680 - protein, 19 aa, Entamoeba dispar
PLGWYYPVIYHYGQKELYG

SEQ ID NO: 2400681 - protein, 17 aa, Entamoeba dispar
PLHLACALGFLESVQKL

SEQ ID NO: 2400682 - protein, 23 aa, Entamoeba dispar
PLLIQCISYFIQKDLSLSLFCAK

SEQ ID NO: 2400683 - protein, 21 aa, Entamoeba dispar
PLLLLKCLILGFSLSSIGYFM

SEQ ID NO: 2400684 - protein, 28 aa, Entamoeba dispar
PLNLNDQYHFFFLIQDVTFPEEQKKETT

SEQ ID NO: 2400685 - protein, 34 aa, Entamoeba dispar
PLSQRTFKFFYFPRFLIVLLIGSFLVNLYLYNSE

SEQ ID NO: 2400686 - protein, 24 aa, Entamoeba dispar
PLSTYFDYFFLLVQDIIIILLILY

SEQ ID NO: 2400687 - protein, 20 aa, Entamoeba dispar
PLTQFNGLYGTFYKIKQNGV

SEQ ID NO: 2400688 - protein, 21 aa, Entamoeba dispar
PLYLYILILLYFYTFIPITIY

SEQ ID NO: 2400689 - protein, 22 aa, Entamoeba dispar
PLYMAPEILLNRPYSLPIDVYA

SEQ ID NO: 2400690 - protein, 26 aa, Entamoeba dispar
PLYTTIETIHLILLKGKYGIVSLCYG

SEQ ID NO: 2400691 - protein, 19 aa, Entamoeba dispar
PMIILSGLQLFDMLQIIPE

SEQ ID NO: 2400692 - protein, 34 aa, Entamoeba dispar
PMIYTPSWKSIVIPLLIGFIIPLISNIIPIKKAL

SEQ ID NO: 2400693 - protein, 24 aa, Entamoeba dispar
PMQIFWYIVYYGMIAFAAIILPFG

SEQ ID NO: 2400694 - protein, 25 aa, Entamoeba dispar
PMVQPAQQPMYAQPAPMGQPIQQPM

SEQ ID NO: 2400695 - protein, 25 aa, Entamoeba dispar
PNDPVYWIDLLTHEQFEEGFGSHTP

SEQ ID NO: 2400696 - protein, 26 aa, Entamoeba dispar
PNEISLFMLSKIYRDIFNLYIIKIKE

SEQ ID NO: 2400697 - protein, 18 aa, Entamoeba dispar
PNIAFFIGMILFVLLEKS

SEQ ID NO: 2400698 - protein, 28 aa, Entamoeba dispar
PNILRLFCLRFLVPGYYMVLQEIYSDKK

SEQ ID NO: 2400699 - protein, 30 aa, Entamoeba dispar
PNKKITILFLKIFLINPTRFCTMYSSPYFS

SEQ ID NO: 2400700 - protein, 26 aa, Entamoeba dispar
PNNYRIVIFCLIILCSILFDIYSLWQ

SEQ ID NO: 2400701 - protein, 25 aa, Entamoeba dispar
PNQIKIRRFLPLKERLTLGRVLNDI

SEQ ID NO: 2400702 - protein, 28 aa, Entamoeba dispar
PNSFQLSPFLYFQPDVFVLAFDISNIKN

SEQ ID NO: 2400703 - protein, 25 aa, Entamoeba dispar
PNSIIKFFRTLFFRQTMHQLLKGRK

SEQ ID NO: 2400704 - protein, 33 aa, Entamoeba dispar
PNSSKFTFYSYPQTKILLPKTKQKIILFFTAHC

SEQ ID NO: 2400705 - protein, 36 aa, Entamoeba dispar
PNSSSHHIIFLLLLIIIVIILIVLIVLMLMNNTNQS

SEQ ID NO: 2400706 - protein, 18 aa, Entamoeba dispar
PNVLLKFNQQHQLIAVLS

SEQ ID NO: 2400707 - protein, 21 aa, Entamoeba dispar
PPHGELLFRGLPVTKGYFNRP

SEQ ID NO: 2400708 - protein, 25 aa, Entamoeba dispar
PPPNGYIRFYGFTKYSNYDNYLSDL

SEQ ID NO: 2400709 - protein, 21 aa, Entamoeba dispar
PPSNFFVFFNLSYSLSSQHTT

SEQ ID NO: 2400710 - protein, 33 aa, Entamoeba dispar
PPYGFEFLNNIPYWIFPLINVLILTIVFIIKQI

SEQ ID NO: 2400711 - protein, 29 aa, Entamoeba dispar
PQFMPYYYVILIFPLLGARYFIYKKNGWQ

SEQ ID NO: 2400712 - protein, 19 aa, Entamoeba dispar
PQGELLFRGLPVSKGYFNR

SEQ ID NO: 2400713 - protein, 29 aa, Entamoeba dispar
PQGTLKIGLLFILLTIIFQLISCFTQEFG

SEQ ID NO: 2400714 - protein, 24 aa, Entamoeba dispar
PQKLPKLSLQFKKIPTNPFDEPTT

SEQ ID NO: 2400715 - protein, 23 aa, Entamoeba dispar
PQLHFTWMCELSHKLKIAELNIE

SEQ ID NO: 2400716 - protein, 27 aa, Entamoeba dispar
PQPPKYILYYFINALILHFHVYGTIAI

SEQ ID NO: 2400717 - protein, 21 aa, Entamoeba dispar
PQSFMSFFTMAPFISANFQVH

SEQ ID NO: 2400718 - protein, 23 aa, Entamoeba dispar
PQSKQLLYIVAEPAGYYPYYYNP

SEQ ID NO: 2400719 - protein, 23 aa, Entamoeba dispar
PRHAYRLLSVFLLKAVSIMNEQP

SEQ ID NO: 2400720 - protein, 17 aa, Entamoeba dispar
PRHFILKLKIKGIYDSD

SEQ ID NO: 2400721 - protein, 19 aa, Entamoeba dispar
PRRVLRCPALLVFQNFLIQ

SEQ ID NO: 2400722 - protein, 27 aa, Entamoeba dispar
PSAQWVMYALLMDIIKGYKLIMKHIEE

SEQ ID NO: 2400723 - protein, 23 aa, Entamoeba dispar
PSDQWLDNISRWSNDRMPIDSIG

SEQ ID NO: 2400724 - protein, 22 aa, Entamoeba dispar
PSFDRLSFPTLGMLISKKLKKQ

SEQ ID NO: 2400725 - protein, 22 aa, Entamoeba dispar
PSFLIICFYVYLSFVIDKHIVN

SEQ ID NO: 2400726 - protein, 19 aa, Entamoeba dispar
PSGKYVTLTLIPKHIQDTD

SEQ ID NO: 2400727 - protein, 28 aa, Entamoeba dispar
PSIDFEPFRWLFTLPLSGLTTTLSPFFN

SEQ ID NO: 2400728 - protein, 21 aa, Entamoeba dispar
PSIEFLPICISFIVLMMSYNI

SEQ ID NO: 2400729 - protein, 18 aa, Entamoeba dispar
PSIKYFNTMFSTSSRRIC

SEQ ID NO: 2400730 - protein, 17 aa, Entamoeba dispar
PSIMKFEIKKLMKNPRK

SEQ ID NO: 2400731 - protein, 20 aa, Entamoeba dispar
PSLEAFIHLIFRIPQKQSNP

SEQ ID NO: 2400732 - protein, 21 aa, Entamoeba dispar
PSLLEFIGYFYFFPSIFSGPC

SEQ ID NO: 2400733 - protein, 21 aa, Entamoeba dispar
PSLNPAKLIPLRRLTIDSSQI

SEQ ID NO: 2400734 - protein, 37 aa, Entamoeba dispar
PSLNQPQLIIWKSDYIDLYNPTWLRAGSFVISNPVNN

SEQ ID NO: 2400735 - protein, 20 aa, Entamoeba dispar
PSLRLVILNIIRNLAVDEGL

SEQ ID NO: 2400736 - protein, 19 aa, Entamoeba dispar
PSLVTLKKGFACEFHIFIK

SEQ ID NO: 2400737 - protein, 32 aa, Entamoeba dispar
PSLYEFIRSMITTYRDFIFKRPNNLALNLLKN

SEQ ID NO: 2400738 - protein, 17 aa, Entamoeba dispar
PSMTVNLVMIIIGIITL

SEQ ID NO: 2400739 - protein, 25 aa, Entamoeba dispar
PSNILELVFCVIMLYMKGNKKLINT

SEQ ID NO: 2400740 - protein, 20 aa, Entamoeba dispar
PSRFLFYVSALLHSISDYLP

SEQ ID NO: 2400741 - protein, 22 aa, Entamoeba dispar
PSSNYLTKYIGKVLLKNTHLII

SEQ ID NO: 2400742 - protein, 25 aa, Entamoeba dispar
PSSYNFLFEKVLFNTNLKFIEDQPE

SEQ ID NO: 2400743 - protein, 18 aa, Entamoeba dispar
PSWVYSAIAFCEASYRKN

SEQ ID NO: 2400744 - protein, 17 aa, Entamoeba dispar
PSYKFIKTTWDLFVKDI

SEQ ID NO: 2400745 - protein, 25 aa, Entamoeba dispar
PTDPQVFLRICQLIYVCLTTQPIDN

SEQ ID NO: 2400746 - protein, 31 aa, Entamoeba dispar
PTLNQPQIIIWKSDWIHLYKPAGSQISKFEV

SEQ ID NO: 2400747 - protein, 29 aa, Entamoeba dispar
PTMETFLQTSRVFCKYAFPDNLARVLSRI

SEQ ID NO: 2400748 - protein, 24 aa, Entamoeba dispar
PTSDPRFVYPWKIAEFVISGKRLE

SEQ ID NO: 2400749 - protein, 27 aa, Entamoeba dispar
PTSMPFHYFMLFVRMLISLTNSIILIV

SEQ ID NO: 2400750 - protein, 17 aa, Entamoeba dispar
PTSNFFRYCLTGFLYNY

SEQ ID NO: 2400751 - protein, 36 aa, Entamoeba dispar
PTTIYLVIFYFILSTILYIPYLFLFGWNIVSIEDHY

SEQ ID NO: 2400752 - protein, 21 aa, Entamoeba dispar
PTVFILLYLLTLFTLCLCVNR

SEQ ID NO: 2400753 - protein, 25 aa, Entamoeba dispar
PVFMAPEILLLQKYKKPADIYAFAI

SEQ ID NO: 2400754 - protein, 17 aa, Entamoeba dispar
PVGLLVLMLIITILVSC

SEQ ID NO: 2400755 - protein, 19 aa, Entamoeba dispar
PVHIIFKTVLSTKLDYNDL

SEQ ID NO: 2400756 - protein, 26 aa, Entamoeba dispar
PVIPDYLICPSLPTFQWTMIITYSLD

SEQ ID NO: 2400757 - protein, 29 aa, Entamoeba dispar
PVIVDLFGLLLVSIILTSSIFLVIKTMKL

SEQ ID NO: 2400758 - protein, 17 aa, Entamoeba dispar
PVKLLEDGIRKALGRRL

SEQ ID NO: 2400759 - protein, 20 aa, Entamoeba dispar
PVNYIKVEFGKCYYFGSDSG

SEQ ID NO: 2400760 - protein, 25 aa, Entamoeba dispar
PVQRTMRYPLLLETIKKHTPPLHPD

SEQ ID NO: 2400761 - protein, 28 aa, Entamoeba dispar
PVSDLFKLRVFYQAYIIYKKVGDKSKCN

SEQ ID NO: 2400762 - protein, 33 aa, Entamoeba dispar
PVSEFWGHVCIVWNKCYYFFSQNQLKMQKENKR

SEQ ID NO: 2400763 - protein, 24 aa, Entamoeba dispar
PVSPLSPLLNFYCEVLLNLNKNNK

SEQ ID NO: 2400764 - protein, 25 aa, Entamoeba dispar
PVVEFILLTLVIINSIWTIPLEPLD

SEQ ID NO: 2400765 - protein, 17 aa, Entamoeba dispar
PYCPSSFEAPLAFMSMS

SEQ ID NO: 2400766 - protein, 17 aa, Entamoeba dispar
PYFTIDPPSIDFQEERV

SEQ ID NO: 2400767 - protein, 26 aa, Entamoeba dispar
PYHNNILQLLMYFYDISIDLDVIEHQ

SEQ ID NO: 2400768 - protein, 21 aa, Entamoeba dispar
PYIFIKTLCKWNVSLPEKIFG

SEQ ID NO: 2400769 - protein, 19 aa, Entamoeba dispar
PYILIRIAMCFFVVAVAII

SEQ ID NO: 2400770 - protein, 28 aa, Entamoeba dispar
PYKQQYKILIIILFFLETVTQNNPMFDC

SEQ ID NO: 2400771 - protein, 20 aa, Entamoeba dispar
PYLGLIIYLMNLLYILCTSI

SEQ ID NO: 2400772 - protein, 19 aa, Entamoeba dispar
PYMLVEVFSLPLFYFISQN

SEQ ID NO: 2400773 - protein, 23 aa, Entamoeba dispar
PYPLNEFPYPWSISKFVCVGRRL

SEQ ID NO: 2400774 - protein, 18 aa, Entamoeba dispar
PYPLQHPYYCGISCFLKS

SEQ ID NO: 2400775 - protein, 31 aa, Entamoeba dispar
PYSTIPILLFPLFFFFALLGECTIAFIGFNI

SEQ ID NO: 2400776 - protein, 19 aa, Entamoeba dispar
PYTYGVWIELIHDKEAKVA

SEQ ID NO: 2400777 - protein, 17 aa, Entamoeba dispar
PYVIILDGLYSLYSLEI

SEQ ID NO: 2400778 - protein, 17 aa, Entamoeba dispar
PYYYNPITVEAGVSGIF

SEQ ID NO: 2400779 - protein, 24 aa, Entamoeba dispar
QAEGVPNYFIFNATRQKELWTTVD

SEQ ID NO: 2400780 - protein, 18 aa, Entamoeba dispar
QAFCKFALIYIRANSKNE

SEQ ID NO: 2400781 - protein, 22 aa, Entamoeba dispar
QAINILTLFRNITANVAIENDY

SEQ ID NO: 2400782 - protein, 20 aa, Entamoeba dispar
QAITEFIKYIYLNGYYSLEE

SEQ ID NO: 2400783 - protein, 28 aa, Entamoeba dispar
QALESLFIFVLFLYYLITLICMSSKNSL

SEQ ID NO: 2400784 - protein, 22 aa, Entamoeba dispar
QAMRRLFYRFQMVGESQIVGRV

SEQ ID NO: 2400785 - protein, 26 aa, Entamoeba dispar
QAPLPKRYGLLLRNYIRHFGDHGNVV

SEQ ID NO: 2400786 - protein, 26 aa, Entamoeba dispar
QARMFAILSMVFFLVSTIIIVISIGF

SEQ ID NO: 2400787 - protein, 18 aa, Entamoeba dispar
QARTCDFLSFFIDSASTA

SEQ ID NO: 2400788 - protein, 40 aa, Entamoeba dispar
QASRYLPIQTLRFIFFYFDVVYLRLPRQPLTSKWNILLHE

SEQ ID NO: 2400789 - protein, 23 aa, Entamoeba dispar
QAVLLGILNINGFGFRIKRPERR

SEQ ID NO: 2400790 - protein, 21 aa, Entamoeba dispar
QCAEDYFRYGLELSTLCLPQT

SEQ ID NO: 2400791 - protein, 25 aa, Entamoeba dispar
QCETNPYCILFDGSCNKCIKCKSSY

SEQ ID NO: 2400792 - protein, 25 aa, Entamoeba dispar
QCIIFDNYHRLLPTLPLHLMLERVL

SEQ ID NO: 2400793 - protein, 18 aa, Entamoeba dispar
QCLFEWRGKCWKCKDGYY

SEQ ID NO: 2400794 - protein, 17 aa, Entamoeba dispar
QCMFASAVQYYVPLRMK

SEQ ID NO: 2400795 - protein, 27 aa, Entamoeba dispar
QDAEYVFYISLSFTTAIFLRWVNRIDG

SEQ ID NO: 2400796 - protein, 32 aa, Entamoeba dispar
QDIIDKKLELPPLLRSRIILDAAKGIALLHSK

SEQ ID NO: 2400797 - protein, 23 aa, Entamoeba dispar
QDIIIILLILYYANKFTPIFYTF

SEQ ID NO: 2400798 - protein, 18 aa, Entamoeba dispar
QDLLWGSIVNHDLFYLND

SEQ ID NO: 2400799 - protein, 26 aa, Entamoeba dispar
QDSKIMKEIFKLSISYINKFIEKEII

SEQ ID NO: 2400800 - protein, 27 aa, Entamoeba dispar
QEDCSSEYIDLSKMILVFSSDPGIKSD

SEQ ID NO: 2400801 - protein, 32 aa, Entamoeba dispar
QEELMKRFAIITTLFTPLTFLSTSFGMNVLVP

SEQ ID NO: 2400802 - protein, 29 aa, Entamoeba dispar
QEESLVSRLLWQFLMKIKDDMEKVENVMK

SEQ ID NO: 2400803 - protein, 26 aa, Entamoeba dispar
QEFRIDIILNHILFTGTLGVLSSSLS

SEQ ID NO: 2400804 - protein, 31 aa, Entamoeba dispar
QEHYVVLPLFALDLLFMYLKEVVGHCLSVKD

SEQ ID NO: 2400805 - protein, 24 aa, Entamoeba dispar
QELESPILYLFLSLNEMADVSLEI

SEQ ID NO: 2400806 - protein, 22 aa, Entamoeba dispar
QELLLYIALTHIYFHSEIKELF

SEQ ID NO: 2400807 - protein, 25 aa, Entamoeba dispar
QELLSKYFYYIQFISVYSINDTYLF

SEQ ID NO: 2400808 - protein, 20 aa, Entamoeba dispar
QEMILNGMYWFECLFNAKKY

SEQ ID NO: 2400809 - protein, 18 aa, Entamoeba dispar
QEMKKKILLLMKKKQELY

SEQ ID NO: 2400810 - protein, 40 aa, Entamoeba dispar
QEMKSCVPLYRPLTVILFFLITGIIFIPIGIAVFVVTNNC

SEQ ID NO: 2400811 - protein, 23 aa, Entamoeba dispar
QENIELFTQFGFEVIFREDKEVT

SEQ ID NO: 2400812 - protein, 25 aa, Entamoeba dispar
QENKYWKLIKRICLFQVFGYKGTLI

SEQ ID NO: 2400813 - protein, 29 aa, Entamoeba dispar
QENTYYFIRYFLVICIFFILACIGIICAV

SEQ ID NO: 2400814 - protein, 24 aa, Entamoeba dispar
QEPTSYLSCKIPKQPNGKYDMGLL

SEQ ID NO: 2400815 - protein, 19 aa, Entamoeba dispar
QEPVNKSNIILFFEDIESL

SEQ ID NO: 2400816 - protein, 19 aa, Entamoeba dispar
QESKFRVVVFTTLQGMFSV

SEQ ID NO: 2400817 - protein, 17 aa, Entamoeba dispar
QEVLIMLLNNLKVLDRQ

SEQ ID NO: 2400818 - protein, 19 aa, Entamoeba dispar
QEYFISVIMFIVCGILSIS

SEQ ID NO: 2400819 - protein, 25 aa, Entamoeba dispar
QFAPFSVFVYLFFKKAYGLYTIKSN

SEQ ID NO: 2400820 - protein, 21 aa, Entamoeba dispar
QFDSRLTYFWITHIGSGRFNN

SEQ ID NO: 2400821 - protein, 17 aa, Entamoeba dispar
QFEICKTLRFTLAANKT

SEQ ID NO: 2400822 - protein, 19 aa, Entamoeba dispar
QFENAFVLAYTKYNSPSSH

SEQ ID NO: 2400823 - protein, 18 aa, Entamoeba dispar
QFHPSTLWTSFSYLSLYV

SEQ ID NO: 2400824 - protein, 17 aa, Entamoeba dispar
QFIFRFACRALKEKKVL

SEQ ID NO: 2400825 - protein, 20 aa, Entamoeba dispar
QFIIIYILRVILVENIFLKL

SEQ ID NO: 2400826 - protein, 20 aa, Entamoeba dispar
QFKCIQCKKGYYLNSKQECQ

SEQ ID NO: 2400827 - protein, 21 aa, Entamoeba dispar
QFKCIQCKKGYYLNSKQECQY

SEQ ID NO: 2400828 - protein, 27 aa, Entamoeba dispar
QFKDKRLFEKLPIGNLLLHYVNWMTNL

SEQ ID NO: 2400829 - protein, 18 aa, Entamoeba dispar
QFKLLNIMYKRIIYIQAL

SEQ ID NO: 2400830 - protein, 19 aa, Entamoeba dispar
QFKVYIFNVGQADSQLIVY

SEQ ID NO: 2400831 - protein, 21 aa, Entamoeba dispar
QFLGTLIFYYLAIKTPPGYIK

SEQ ID NO: 2400832 - protein, 25 aa, Entamoeba dispar
QFLMMLYCVIVFALMLITCFVQLGF

SEQ ID NO: 2400833 - protein, 25 aa, Entamoeba dispar
QFLTSLLFIIIFDFISTVISIPFKL

SEQ ID NO: 2400834 - protein, 28 aa, Entamoeba dispar
QFNFSWIYLFYIVLWFLSFVCYYKCVTT

SEQ ID NO: 2400835 - protein, 34 aa, Entamoeba dispar
QFNPMVIVKYSWFFFDLIIRSLVYYLNDEINKGN

SEQ ID NO: 2400836 - protein, 26 aa, Entamoeba dispar
QFPSSLLIRRKLVLIAFQCLQSKVIK

SEQ ID NO: 2400837 - protein, 35 aa, Entamoeba dispar
QFRIWCIWCIILFFSPFIIIKIYFTFKKLFSSNII

SEQ ID NO: 2400838 - protein, 19 aa, Entamoeba dispar
QFSIIIRFLCVILMFGCNS

SEQ ID NO: 2400839 - protein, 20 aa, Entamoeba dispar
QFSIIIRFLCVILMFVCNSA

SEQ ID NO: 2400840 - protein, 32 aa, Entamoeba dispar
QFTLAKDYLVKGYLGFTPLSKEYLNTPISITW

SEQ ID NO: 2400841 - protein, 23 aa, Entamoeba dispar
QFTLPQQIYLISLAVLPICISII

SEQ ID NO: 2400842 - protein, 18 aa, Entamoeba dispar
QFVLSTVFFQLLLCSVMA

SEQ ID NO: 2400843 - protein, 21 aa, Entamoeba dispar
QGELLIGTWIDGVPVGPFEST

SEQ ID NO: 2400844 - protein, 25 aa, Entamoeba dispar
QGEPYGVFMFFAAYIDMEQGTSIEN

SEQ ID NO: 2400845 - protein, 21 aa, Entamoeba dispar
QGFQFRMYFVPPVLQNHYGFG

SEQ ID NO: 2400846 - protein, 32 aa, Entamoeba dispar
QGLEIVRLVLGRKITLIIFGTNNGKIHCLDGS

SEQ ID NO: 2400847 - protein, 24 aa, Entamoeba dispar
QGMFSVLYRFIFSSDINTFQKLLM

SEQ ID NO: 2400848 - protein, 27 aa, Entamoeba dispar
QGNPKLLNAYIYGLGIVLLLGVEVINP

SEQ ID NO: 2400849 - protein, 23 aa, Entamoeba dispar
QGSNTIFNIKYSNSLWIKADNSN

SEQ ID NO: 2400850 - protein, 24 aa, Entamoeba dispar
QGVIWFFVLFIAAFPFYLTCIAFG

SEQ ID NO: 2400851 - protein, 29 aa, Entamoeba dispar
QHIDSFIDYYFEILPLFKEIPKPIQGLIN

SEQ ID NO: 2400852 - protein, 24 aa, Entamoeba dispar
QHIILIILLFVYINNGAICGVGCI

SEQ ID NO: 2400853 - protein, 26 aa, Entamoeba dispar
QHKSIACIWFLTMGSLIITIIIFCTI

SEQ ID NO: 2400854 - protein, 20 aa, Entamoeba dispar
QHLSTIYAYLTKQANNDKPK

SEQ ID NO: 2400855 - protein, 18 aa, Entamoeba dispar
QIAFHKFKPMILNLVFMI

SEQ ID NO: 2400856 - protein, 24 aa, Entamoeba dispar
QIAVGFFVFLFANTFIWTKNGTYL

SEQ ID NO: 2400857 - protein, 23 aa, Entamoeba dispar
QIAYIYPTFYSACDYVFHFLVRV

SEQ ID NO: 2400858 - protein, 26 aa, Entamoeba dispar
QIDNDLFVLLIKTLFDEFKRIKDFPK

SEQ ID NO: 2400859 - protein, 26 aa, Entamoeba dispar
QIFLGVYICVMLFVWGGSQTIKASFV

SEQ ID NO: 2400860 - protein, 22 aa, Entamoeba dispar
QIGDIIVYNLPSKGIPIIHRVI

SEQ ID NO: 2400861 - protein, 22 aa, Entamoeba dispar
QIGLLTWKITYKNNLFTFQLIK

SEQ ID NO: 2400862 - protein, 27 aa, Entamoeba dispar
QIGLSQILLRFLKNDKLLPSLTTMCVS

SEQ ID NO: 2400863 - protein, 18 aa, Entamoeba dispar
QIICLARALLKKSKILIM

SEQ ID NO: 2400864 - protein, 32 aa, Entamoeba dispar
QIIEIYGAIVCFIYFPFSQIASFLIIDNTKRI

SEQ ID NO: 2400865 - protein, 21 aa, Entamoeba dispar
QIIISTIKIISFLYSRNISNN

SEQ ID NO: 2400866 - protein, 19 aa, Entamoeba dispar
QIILLKPSENFVAAAIGIQ

SEQ ID NO: 2400867 - protein, 20 aa, Entamoeba dispar
QIINFFNYYPTNITFIVRAM

SEQ ID NO: 2400868 - protein, 25 aa, Entamoeba dispar
QIISPIFIVILMIFTGFFIQKDNII

SEQ ID NO: 2400869 - protein, 20 aa, Entamoeba dispar
QIIYSLLLVYTFRTLERRWS

SEQ ID NO: 2400870 - protein, 28 aa, Entamoeba dispar
QIKYWIPRIIFFLFFFAAVELVFVYNKS

SEQ ID NO: 2400871 - protein, 19 aa, Entamoeba dispar
QILFFVNSYASECIINEGT

SEQ ID NO: 2400872 - protein, 23 aa, Entamoeba dispar
QILHKEFIIIGLFITVFVLTLIS

SEQ ID NO: 2400873 - protein, 18 aa, Entamoeba dispar
QILPLLMSITLEQQERHI

SEQ ID NO: 2400874 - protein, 17 aa, Entamoeba dispar
QILRMKLGYYTKDLYRM

SEQ ID NO: 2400875 - protein, 27 aa, Entamoeba dispar
QILTFTLMYILLLFNNPLALIEYQAHH

SEQ ID NO: 2400876 - protein, 36 aa, Entamoeba dispar
QISTLIKFCFYKNAAFFLMDIWFATISNFTCQIIYD

SEQ ID NO: 2400877 - protein, 23 aa, Entamoeba dispar
QITDFIVMVLIVGTIVSLCIEEW

SEQ ID NO: 2400878 - protein, 23 aa, Entamoeba dispar
QIYKILVCFFARDLNIHLTSIIY

SEQ ID NO: 2400879 - protein, 18 aa, Entamoeba dispar
QIYRLFTSLFLSPSLFGL

SEQ ID NO: 2400880 - protein, 20 aa, Entamoeba dispar
QIYRLKLMWCEIEPFTCFFE

SEQ ID NO: 2400881 - protein, 28 aa, Entamoeba dispar
QKALQTEKLFKETLFFFTADENASNIYT

SEQ ID NO: 2400882 - protein, 30 aa, Entamoeba dispar
QKCSYFEVIIPFLLFAECRLVVTSNAILLN

SEQ ID NO: 2400883 - protein, 21 aa, Entamoeba dispar
QKEEIILLLKEMGNIVLMCGD

SEQ ID NO: 2400884 - protein, 23 aa, Entamoeba dispar
QKFITYIIITPFQSAIQSIVLKN

SEQ ID NO: 2400885 - protein, 18 aa, Entamoeba dispar
QKGLPAAYKQLSASILIH

SEQ ID NO: 2400886 - protein, 26 aa, Entamoeba dispar
QKHYTKLYIALISLLFETGTKGQTDI

SEQ ID NO: 2400887 - protein, 34 aa, Entamoeba dispar
QKIIIVINALTSCNLFFLLFADICNKNIPNFIHS

SEQ ID NO: 2400888 - protein, 42 aa, Entamoeba dispar
QKIVEPLLLILIIISLLLMFIPKPIFLYIKLRKQQKAHPESR

SEQ ID NO: 2400889 - protein, 29 aa, Entamoeba dispar
QKKETTLQYFAYRPLFEQGKLIINGEYKL

SEQ ID NO: 2400890 - protein, 19 aa, Entamoeba dispar
QKKLFLRKKPEQPRTIIIP

SEQ ID NO: 2400891 - protein, 35 aa, Entamoeba dispar
QKKNLVVIYFVLGSLLHFLYAISSLIYSKPSRQEE

SEQ ID NO: 2400892 - protein, 36 aa, Entamoeba dispar
QKKRQVFTTLFFLRYLFLPLISYPSLLKILQKATSE

SEQ ID NO: 2400893 - protein, 29 aa, Entamoeba dispar
QKLTSLLLHYIYLLPIYKNNNLTSILNEK

SEQ ID NO: 2400894 - protein, 21 aa, Entamoeba dispar
QKMSKIKVLFAGAEHLLHDEI

SEQ ID NO: 2400895 - protein, 24 aa, Entamoeba dispar
QKNIKIIKLLVLSLFNQFNSIEEL

SEQ ID NO: 2400896 - protein, 23 aa, Entamoeba dispar
QKNYLIIINLLNAGSLTLLVLIQ

SEQ ID NO: 2400897 - protein, 38 aa, Entamoeba dispar
QKRTINVVSPYKVRLVWKEIRGVWQWIEGRTYEVKPEL

SEQ ID NO: 2400898 - protein, 24 aa, Entamoeba dispar
QKRYRFAIKILKRNLKKIGLHKTR

SEQ ID NO: 2400899 - protein, 25 aa, Entamoeba dispar
QKSLYLSYFIIFNINLCAIAISFIF

SEQ ID NO: 2400900 - protein, 22 aa, Entamoeba dispar
QKSVPHRILLTTYITLLRSFNN

SEQ ID NO: 2400901 - protein, 33 aa, Entamoeba dispar
QKTIQLKHGLVTEELLIPIPSGIKDKEQVKVGD

SEQ ID NO: 2400902 - protein, 23 aa, Entamoeba dispar
QKTIQLLIRFKNSFNALCQSHLR

SEQ ID NO: 2400903 - protein, 26 aa, Entamoeba dispar
QKYGMFIMIGVLILTFFFKGNSGPEP

SEQ ID NO: 2400904 - protein, 17 aa, Entamoeba dispar
QLALPTSYELLCQVFHC

SEQ ID NO: 2400905 - protein, 26 aa, Entamoeba dispar
QLDIASYLHYVLLALPSECITKKCFD

SEQ ID NO: 2400906 - protein, 20 aa, Entamoeba dispar
QLEFKLRNQLPYLSPKEIDD

SEQ ID NO: 2400907 - protein, 19 aa, Entamoeba dispar
QLFFHILQLRKSCNNKIVC

SEQ ID NO: 2400908 - protein, 30 aa, Entamoeba dispar
QLGPSKNIYLIPYLKLFLNFEPTQPPIVKQ

SEQ ID NO: 2400909 - protein, 23 aa, Entamoeba dispar
QLIGLFLALLINKRIILTSRCTT

SEQ ID NO: 2400910 - protein, 17 aa, Entamoeba dispar
QLIIWKSDYIHLYKDEK

SEQ ID NO: 2400911 - protein, 18 aa, Entamoeba dispar
QLKSHIPCLPKIVQIFLS

SEQ ID NO: 2400912 - protein, 17 aa, Entamoeba dispar
QLLFILRNNIHSSPIVQ

SEQ ID NO: 2400913 - protein, 20 aa, Entamoeba dispar
QLLLGIYFADTLKQYENSFK

SEQ ID NO: 2400914 - protein, 17 aa, Entamoeba dispar
QLLYHKVSDGDLPLYLV

SEQ ID NO: 2400915 - protein, 41 aa, Entamoeba dispar
QLLYSSIFNFVPLPLYIGWYMIFFTTIFNQLPIIMFITDFD

SEQ ID NO: 2400916 - protein, 25 aa, Entamoeba dispar
QLNDKIVDLYIKLGKYLPECETLPE

SEQ ID NO: 2400917 - protein, 18 aa, Entamoeba dispar
QLPIIMFITDFDLYRYST

SEQ ID NO: 2400918 - protein, 21 aa, Entamoeba dispar
QLPLIMPIHHICNTTLMLLLR

SEQ ID NO: 2400919 - protein, 19 aa, Entamoeba dispar
QLPPELLVNVKLFEISYIQ

SEQ ID NO: 2400920 - protein, 17 aa, Entamoeba dispar
QLPYMLVEVFSLPLFYF

SEQ ID NO: 2400921 - protein, 39 aa, Entamoeba dispar
QLPYRFVYLLEYIGPLVLYFIPFFILKALNRIILYQQYM

SEQ ID NO: 2400922 - protein, 26 aa, Entamoeba dispar
QLQIPKEFVSLMVILIFVVSGRIKNY

SEQ ID NO: 2400923 - protein, 22 aa, Entamoeba dispar
QLQPILQTFTVIPSYPILLKGE

SEQ ID NO: 2400924 - protein, 30 aa, Entamoeba dispar
QLQQRHTLMFIILRQYFQLILSPDKTVSTM

SEQ ID NO: 2400925 - protein, 29 aa, Entamoeba dispar
QLQQRHTLMFIILRQYFQLILTHDKTISK

SEQ ID NO: 2400926 - protein, 19 aa, Entamoeba dispar
QLQYSTYFYILLDTNHYIN

SEQ ID NO: 2400927 - protein, 23 aa, Entamoeba dispar
QLRLLKIVLNWLIPEVFNECLYF

SEQ ID NO: 2400928 - protein, 18 aa, Entamoeba dispar
QLRQNCVVELIGAVYTEG

SEQ ID NO: 2400929 - protein, 21 aa, Entamoeba dispar
QLSIGFIIEVPTNGFRCISDE

SEQ ID NO: 2400930 - protein, 34 aa, Entamoeba dispar
QLSSTVFIGFIHKFLYPINPIFLTKRVTEPPTKL

SEQ ID NO: 2400931 - protein, 20 aa, Entamoeba dispar
QLTIFYYYKYYFKLLFPVIN

SEQ ID NO: 2400932 - protein, 23 aa, Entamoeba dispar
QLTRLPIFKFLRNSNELFMQMLS

SEQ ID NO: 2400933 - protein, 22 aa, Entamoeba dispar
QLVLQFVDLLPNSLPILLHCSS

SEQ ID NO: 2400934 - protein, 23 aa, Entamoeba dispar
QLVLTVYRFVSFLIMFITCVVQL

SEQ ID NO: 2400935 - protein, 20 aa, Entamoeba dispar
QLWFLLSWTIMVICGATAVY

SEQ ID NO: 2400936 - protein, 18 aa, Entamoeba dispar
QLYTIVIDLAKRGDLEPS

SEQ ID NO: 2400937 - protein, 18 aa, Entamoeba dispar
QMAHTILKILYYHPRDTL

SEQ ID NO: 2400938 - protein, 21 aa, Entamoeba dispar
QMALTFYRFFAFSVMLITCIV

SEQ ID NO: 2400939 - protein, 31 aa, Entamoeba dispar
QMASGLSIFGWLLASVFIIAAAITYPMDIAV

SEQ ID NO: 2400940 - protein, 32 aa, Entamoeba dispar
QMEKEMDTFTIWISLEESFLGTQKTIQLKHGL

SEQ ID NO: 2400941 - protein, 19 aa, Entamoeba dispar
QMFFNLFPKHYALNHLNYL

SEQ ID NO: 2400942 - protein, 18 aa, Entamoeba dispar
QMIDLRYDLSFMSKVLVT

SEQ ID NO: 2400943 - protein, 20 aa, Entamoeba dispar
QMIVTAVGLNSLWGKTKESL

SEQ ID NO: 2400944 - protein, 18 aa, Entamoeba dispar
QNFIPFGMFLFSSNPIRK

SEQ ID NO: 2400945 - protein, 27 aa, Entamoeba dispar
QNGFSIVILICDIRFPPKLAFVTMKNI

SEQ ID NO: 2400946 - protein, 17 aa, Entamoeba dispar
QNGILHRDIKPDNFLVV

SEQ ID NO: 2400947 - protein, 32 aa, Entamoeba dispar
QNHFLSIVIVIFIGCAFLLGVAYFLTRDRHQA

SEQ ID NO: 2400948 - protein, 28 aa, Entamoeba dispar
QNIEHMLNELLGLYNHITFLVSTQEEMV

SEQ ID NO: 2400949 - protein, 22 aa, Entamoeba dispar
QNIFIILYHFFTFKEVKNIIEV

SEQ ID NO: 2400950 - protein, 19 aa, Entamoeba dispar
QNILTVIFFFFFGSSYLMF

SEQ ID NO: 2400951 - protein, 30 aa, Entamoeba dispar
QNIPDVFVHLLLYILYDYLISAKSLQREYM

SEQ ID NO: 2400952 - protein, 28 aa, Entamoeba dispar
QNKLHGGWKYLFIVLSRFEQMNLIEHQT

SEQ ID NO: 2400953 - protein, 26 aa, Entamoeba dispar
QNLETLFRVVSLLIGWLILHVLGDFT

SEQ ID NO: 2400954 - protein, 22 aa, Entamoeba dispar
QNLLIIFLICWCLFRILDSMIR

SEQ ID NO: 2400955 - protein, 22 aa, Entamoeba dispar
QNMQFHVLKKEQLGFIARSDIL

SEQ ID NO: 2400956 - protein, 27 aa, Entamoeba dispar
QNNHRYFIQFLYYLPINGLTGMVIQIW

SEQ ID NO: 2400957 - protein, 17 aa, Entamoeba dispar
QNQLLVEILLDKLIDTI

SEQ ID NO: 2400958 - protein, 28 aa, Entamoeba dispar
QNRMIMLFISLILILLEHILQLPLIIIS

SEQ ID NO: 2400959 - protein, 21 aa, Entamoeba dispar
QNRYRIGHWLELNLLEFSDSI

SEQ ID NO: 2400960 - protein, 27 aa, Entamoeba dispar
QNSETTFILILSLITVILGFIVVVMLV

SEQ ID NO: 2400961 - protein, 23 aa, Entamoeba dispar
QNVKPYIFGLKLISTYVGHLPMN

SEQ ID NO: 2400962 - protein, 29 aa, Entamoeba dispar
QPDNLLTKLVYWLAGMTFTPMVVLEVIPF

SEQ ID NO: 2400963 - protein, 18 aa, Entamoeba dispar
QPEHCLRNTINGRHSVMC

SEQ ID NO: 2400964 - protein, 28 aa, Entamoeba dispar
QPFMADIIHIVITFIIRGISQSSSVAVL

SEQ ID NO: 2400965 - protein, 25 aa, Entamoeba dispar
QPHNFDFYLTYITSLTIQKFLSIKD

SEQ ID NO: 2400966 - protein, 30 aa, Entamoeba dispar
QPITIFKRFWKVLIIPYYMVKSFFVRGDFT

SEQ ID NO: 2400967 - protein, 33 aa, Entamoeba dispar
QPNAKFLICCEPIFFDYIQLLITYYLENDANCS

SEQ ID NO: 2400968 - protein, 23 aa, Entamoeba dispar
QPTLLTSALLFDYLCEHPKERID

SEQ ID NO: 2400969 - protein, 17 aa, Entamoeba dispar
QPWMIPQFVIEGNRLSK

SEQ ID NO: 2400970 - protein, 30 aa, Entamoeba dispar
QPYKNQLIHSFPLLMKLMLQLFNNEISNTE

SEQ ID NO: 2400971 - protein, 25 aa, Entamoeba dispar
QPYTYGIWIKLISFTERYVSVALND

SEQ ID NO: 2400972 - protein, 21 aa, Entamoeba dispar
QPYVNWFLAFMGGLAGGFAYQ

SEQ ID NO: 2400973 - protein, 20 aa, Entamoeba dispar
QQFHLFLPEINMIQKLLIDI

SEQ ID NO: 2400974 - protein, 21 aa, Entamoeba dispar
QQFILLIEHYFNRKISLPCCD

SEQ ID NO: 2400975 - protein, 18 aa, Entamoeba dispar
QQHGGLAMFIFIKKIMKN

SEQ ID NO: 2400976 - protein, 35 aa, Entamoeba dispar
QQLESDVFPIIQIPELRTLLRKSLLTEYLTNFQDT

SEQ ID NO: 2400977 - protein, 27 aa, Entamoeba dispar
QQLPNSILNFLILFLTNIYEINFDYTS

SEQ ID NO: 2400978 - protein, 28 aa, Entamoeba dispar
QQLVFLMLITLLPFPYMTEPGLLSIPYL

SEQ ID NO: 2400979 - protein, 24 aa, Entamoeba dispar
QQNCIECPQLYWSNPNSISCKVCD

SEQ ID NO: 2400980 - protein, 23 aa, Entamoeba dispar
QQQKDLLVPIAQKLIEFHIEHNA

SEQ ID NO: 2400981 - protein, 21 aa, Entamoeba dispar
QQRVSLLRCFLASLPEPLIPE

SEQ ID NO: 2400982 - protein, 25 aa, Entamoeba dispar
QQSQLKWYFSIFTKILEKLKENIIN

SEQ ID NO: 2400983 - protein, 24 aa, Entamoeba dispar
QQSYLLFSFFHYTLSLVLLNFVHL

SEQ ID NO: 2400984 - protein, 25 aa, Entamoeba dispar
QQSYSLYHPRCLLQLLFAGSFKQVE

SEQ ID NO: 2400985 - protein, 26 aa, Entamoeba dispar
QQTQPFVVIFLVYLFISFGSHIFKDI

SEQ ID NO: 2400986 - protein, 21 aa, Entamoeba dispar
QRGILLKQMSMVLMGLSKPTN

SEQ ID NO: 2400987 - protein, 18 aa, Entamoeba dispar
QRIAIARALIRKPSILLL

SEQ ID NO: 2400988 - protein, 26 aa, Entamoeba dispar
QRIRRPVVLPLLVSLFIELLSSFMLP

SEQ ID NO: 2400989 - protein, 28 aa, Entamoeba dispar
QRIVYVFNWPLLVILAYTIPDVKIKTCA

SEQ ID NO: 2400990 - protein, 23 aa, Entamoeba dispar
QRKKSWLCIFPGCKEPVKTHYNC

SEQ ID NO: 2400991 - protein, 20 aa, Entamoeba dispar
QRLEIFNNPYFSFSDSIISF

SEQ ID NO: 2400992 - protein, 23 aa, Entamoeba dispar
QRLIMVYKVPLWMTFDECTIRPL

SEQ ID NO: 2400993 - protein, 27 aa, Entamoeba dispar
QRLTRVWVFFIFPVLISAYRCNPTICY

SEQ ID NO: 2400994 - protein, 29 aa, Entamoeba dispar
QRLYVICGCYYLIMKGWTILFSSEKRSAK

SEQ ID NO: 2400995 - protein, 17 aa, Entamoeba dispar
QRMGMVMIFIYSIVFRY

SEQ ID NO: 2400996 - protein, 25 aa, Entamoeba dispar
QRSERYFERFIGWIQLIGVLQNINY

SEQ ID NO: 2400997 - protein, 19 aa, Entamoeba dispar
QRSLPLCCLKKGLTSPIDI

SEQ ID NO: 2400998 - protein, 19 aa, Entamoeba dispar
QRTWREKIWRIILQGNEDF

SEQ ID NO: 2400999 - protein, 31 aa, Entamoeba dispar
QRVEPLLGFINGFFLVLFSAFTLMQCVERMI

SEQ ID NO: 2401000 - protein, 18 aa, Entamoeba dispar
QRYLKLYNMHVKCSHPDV

SEQ ID NO: 2401001 - protein, 37 aa, Entamoeba dispar
QSATFILGEYYFNSLWMIMCLLPPPQSFIDQFKDKRL

SEQ ID NO: 2401002 - protein, 26 aa, Entamoeba dispar
QSFEQYGFFLVYIIGLLYSGYGFYIV

SEQ ID NO: 2401003 - protein, 17 aa, Entamoeba dispar
QSGYYLKNGDCVKCDSK

SEQ ID NO: 2401004 - protein, 33 aa, Entamoeba dispar
QSIFMLLISSSFPWLVFIYLIKPVLSISSTFSP

SEQ ID NO: 2401005 - protein, 17 aa, Entamoeba dispar
QSIIMAFRVIFTTALTL

SEQ ID NO: 2401006 - protein, 26 aa, Entamoeba dispar
QSIKKYQYYLYKTSTKQIWVILGDHI

SEQ ID NO: 2401007 - protein, 17 aa, Entamoeba dispar
QSIVLLQPNLFIEFINY

SEQ ID NO: 2401008 - protein, 20 aa, Entamoeba dispar
QSLGFFFATLIDHLKPMYSN

SEQ ID NO: 2401009 - protein, 21 aa, Entamoeba dispar
QSLLNHMYFAGYFNSLNVTMA

SEQ ID NO: 2401010 - protein, 21 aa, Entamoeba dispar
QSLLTKCPLLVNSITAIPEAT

SEQ ID NO: 2401011 - protein, 24 aa, Entamoeba dispar
QSNHIFWMSSCCCWILFNVKVFEE

SEQ ID NO: 2401012 - protein, 26 aa, Entamoeba dispar
QSNTLKCIMTQYPSFWYSIQLSESLD

SEQ ID NO: 2401013 - protein, 29 aa, Entamoeba dispar
QSRVQELLILCLYLLLSNIVICINCKSGC

SEQ ID NO: 2401014 - protein, 17 aa, Entamoeba dispar
QSRWLMYFLEVRNPAAL

SEQ ID NO: 2401015 - protein, 28 aa, Entamoeba dispar
QSVIGMMLFFGYILFSWGTLFDTLIIGY

SEQ ID NO: 2401016 - protein, 29 aa, Entamoeba dispar
QTDDRKWALWFGLILQCVGIVLCIITQAI

SEQ ID NO: 2401017 - protein, 27 aa, Entamoeba dispar
QTFLIYVAFIFICIIVNLPKKAPLRII

SEQ ID NO: 2401018 - protein, 33 aa, Entamoeba dispar
QTFSLKQYTPALKAITIIILIIDSIMRNDTQIK

SEQ ID NO: 2401019 - protein, 18 aa, Entamoeba dispar
QTIFSKKKLCFPDNGRWL

SEQ ID NO: 2401020 - protein, 24 aa, Entamoeba dispar
QTIGMKVHKLLSIFFQNSNKVTTI

SEQ ID NO: 2401021 - protein, 24 aa, Entamoeba dispar
QTILYFMNKYFKDELKILIEQMKI

SEQ ID NO: 2401022 - protein, 38 aa, Entamoeba dispar
QTKKKYILFNIAGVIICIILSVLFSISFLVITNKRIEK

SEQ ID NO: 2401023 - protein, 23 aa, Entamoeba dispar
QTLIFNIFVFCQVFNEFNSRKVN

SEQ ID NO: 2401024 - protein, 25 aa, Entamoeba dispar
QTLYISIIYQLLNSLSWKYITQLLN

SEQ ID NO: 2401025 - protein, 21 aa, Entamoeba dispar
QTLYTMFFDGPRDIGPNIPAH

SEQ ID NO: 2401026 - protein, 26 aa, Entamoeba dispar
QTRGWFYSLIVISTALFGKAPFKNCV

SEQ ID NO: 2401027 - protein, 30 aa, Entamoeba dispar
QTSHTVFIIYYYLEVLPLIKLKIFMLETSD

SEQ ID NO: 2401028 - protein, 28 aa, Entamoeba dispar
QTTGSERIIFPMFFVDSKPLAGYDNSRS

SEQ ID NO: 2401029 - protein, 26 aa, Entamoeba dispar
QTTLNYPLSGLTLSLKLIYSSIDSIL

SEQ ID NO: 2401030 - protein, 22 aa, Entamoeba dispar
QTTTLPQFYVPNSNIHIPSINE

SEQ ID NO: 2401031 - protein, 31 aa, Entamoeba dispar
QTVITFICNLFIFVFIIFTVKMYYLMMYGFQ

SEQ ID NO: 2401032 - protein, 21 aa, Entamoeba dispar
QTVYLLLLLTYVIIKLFFVVM

SEQ ID NO: 2401033 - protein, 22 aa, Entamoeba dispar
QTWDCLHFLLFITTMVCLLSKK

SEQ ID NO: 2401034 - protein, 23 aa, Entamoeba dispar
QTYGTLKRLALTQFKLLNIMYKR

SEQ ID NO: 2401035 - protein, 17 aa, Entamoeba dispar
QVCGKLIGWELPYHLFP

SEQ ID NO: 2401036 - protein, 18 aa, Entamoeba dispar
QVFMCYWMSNVVNGIFTV

SEQ ID NO: 2401037 - protein, 25 aa, Entamoeba dispar
QVFPINYPLFKETILLYLGYIKGLP

SEQ ID NO: 2401038 - protein, 21 aa, Entamoeba dispar
QVIIGSFVPLEPKKYVIFQHQ

SEQ ID NO: 2401039 - protein, 29 aa, Entamoeba dispar
QVKSNLPTILLIIRSLYYTFKNKKKESHQ

SEQ ID NO: 2401040 - protein, 28 aa, Entamoeba dispar
QVQNDWMNGIFLVVCATVAFGMGIDKPD

SEQ ID NO: 2401041 - protein, 24 aa, Entamoeba dispar
QVRFVDRGLLLKSKVPASKPLCYK

SEQ ID NO: 2401042 - protein, 33 aa, Entamoeba dispar
QVSLFIVHALSIYPYFINLLVKYDITVFEDLKS

SEQ ID NO: 2401043 - protein, 26 aa, Entamoeba dispar
QVTTRQCPLLLYNTLKFLVQFTNSTY

SEQ ID NO: 2401044 - protein, 22 aa, Entamoeba dispar
QWFAHQMCCFLLPYYDCSSNIV

SEQ ID NO: 2401045 - protein, 31 aa, Entamoeba dispar
QWIIDTLKILIGLAIILLCCGLIWKSHTEMI

SEQ ID NO: 2401046 - protein, 20 aa, Entamoeba dispar
QWMLVGFIILIFVSYSMDIT

SEQ ID NO: 2401047 - protein, 19 aa, Entamoeba dispar
QYALDKPFLPLPCTLKAMD

SEQ ID NO: 2401048 - protein, 19 aa, Entamoeba dispar
QYCINIIPSPVLPLYGDQE

SEQ ID NO: 2401049 - protein, 21 aa, Entamoeba dispar
QYGAFHFYAQYPASLQQYSSF

SEQ ID NO: 2401050 - protein, 26 aa, Entamoeba dispar
QYKGLLLLIFFVCLFLIMGTGSTIIS

SEQ ID NO: 2401051 - protein, 26 aa, Entamoeba dispar
QYKVKVLIKLVLIISIITSIMFGIIR

SEQ ID NO: 2401052 - protein, 24 aa, Entamoeba dispar
QYKYDNFLCFINVLYGAVPRINLT

SEQ ID NO: 2401053 - protein, 29 aa, Entamoeba dispar
QYQPFIIAFFVITSFLFLFKKFFIPNDVI

SEQ ID NO: 2401054 - protein, 20 aa, Entamoeba dispar
QYTSQFIISLPPSSLRLDAE

SEQ ID NO: 2401055 - protein, 28 aa, Entamoeba dispar
QYVLTFVMTPLFPPVMRLFNYLDQNTMH

SEQ ID NO: 2401056 - protein, 26 aa, Entamoeba dispar
QYVVAGVCVDSKIFVKAQFGVGQHKC

SEQ ID NO: 2401057 - protein, 20 aa, Entamoeba dispar
QYVYDTLILLPETLYNTIAL

SEQ ID NO: 2401058 - protein, 18 aa, Entamoeba dispar
RAGGFIGLILCLMPFVVR

SEQ ID NO: 2401059 - protein, 18 aa, Entamoeba dispar
RAICNHSRYLRDCFVSTA

SEQ ID NO: 2401060 - protein, 20 aa, Entamoeba dispar
RAIFTCVPLYALVLGYLCGL

SEQ ID NO: 2401061 - protein, 26 aa, Entamoeba dispar
RALQMPYFYLYSLLAIILAITPNILK

SEQ ID NO: 2401062 - protein, 17 aa, Entamoeba dispar
RAPRHNGFYSLFSDDST

SEQ ID NO: 2401063 - protein, 24 aa, Entamoeba dispar
RAQIQEFYQLKKSALIIGSIKNYL

SEQ ID NO: 2401064 - protein, 32 aa, Entamoeba dispar
RASLLQFLVSPKKSFLRFILKSKSNMVSKNLK

SEQ ID NO: 2401065 - protein, 22 aa, Entamoeba dispar
RASMEMTFIGNQLLNSATFPSI

SEQ ID NO: 2401066 - protein, 23 aa, Entamoeba dispar
RAVIPLCYGLMNSTIYKQTDIKY

SEQ ID NO: 2401067 - protein, 19 aa, Entamoeba dispar
RCILFFTGNPSLLAFYIDF

SEQ ID NO: 2401068 - protein, 20 aa, Entamoeba dispar
RCKDGYYLENSKCLYYANKL

SEQ ID NO: 2401069 - protein, 26 aa, Entamoeba dispar
RCQNLISLCRLTLKHWTQFKDLPTSN

SEQ ID NO: 2401070 - protein, 20 aa, Entamoeba dispar
RCTTFVMQWWSNALINNEKA

SEQ ID NO: 2401071 - protein, 32 aa, Entamoeba dispar
RCVLKIQIWVHIFFLVAIVVTIIFILMIIFYL

SEQ ID NO: 2401072 - protein, 17 aa, Entamoeba dispar
RCVLRGLEYLKEIWSEN

SEQ ID NO: 2401073 - protein, 25 aa, Entamoeba dispar
RDANLFFGEFIRDLSLLWRHDEMAK

SEQ ID NO: 2401074 - protein, 20 aa, Entamoeba dispar
RDDMLYLINISSLSLYFSNL

SEQ ID NO: 2401075 - protein, 18 aa, Entamoeba dispar
RDDTVRVYVTDSCYKCLG

SEQ ID NO: 2401076 - protein, 19 aa, Entamoeba dispar
RDIFRRYPNRYEKVIGTLC

SEQ ID NO: 2401077 - protein, 25 aa, Entamoeba dispar
RDIKPDNILVFSLDTNIKINAKLTD

SEQ ID NO: 2401078 - protein, 19 aa, Entamoeba dispar
RDIPKLYNMKFLISLLTPI

SEQ ID NO: 2401079 - protein, 21 aa, Entamoeba dispar
RDLLVYSFGFFTKGIYMRQRT

SEQ ID NO: 2401080 - protein, 19 aa, Entamoeba dispar
RDLRRFLYSLRNTKIKKIH

SEQ ID NO: 2401081 - protein, 23 aa, Entamoeba dispar
RDQYIKYGDGFVLIYSITSKESF

SEQ ID NO: 2401082 - protein, 33 aa, Entamoeba dispar
RDSLIFKIIIYIIPIFFGVLMMTFYFMQKKTLK

SEQ ID NO: 2401083 - protein, 17 aa, Entamoeba dispar
RDTVKWCFYHNTNIKSN

SEQ ID NO: 2401084 - protein, 25 aa, Entamoeba dispar
RDVKGENLLIFSINPHSPVCAKLTD

SEQ ID NO: 2401085 - protein, 18 aa, Entamoeba dispar
RECIECEKGYYLNSNKEC

SEQ ID NO: 2401086 - protein, 18 aa, Entamoeba dispar
RECIECEKGYYLNSTKEC

SEQ ID NO: 2401087 - protein, 31 aa, Entamoeba dispar
REDRVYIGNILFGLLIYLLDEFDKIKDVHYN

SEQ ID NO: 2401088 - protein, 24 aa, Entamoeba dispar
REELKHELLITQKLWSAFPSVDEY

SEQ ID NO: 2401089 - protein, 29 aa, Entamoeba dispar
REEMKMFRLYTIITPLVDLLVTLSNWYIR

SEQ ID NO: 2401090 - protein, 18 aa, Entamoeba dispar
REFFNITVLLRLSKALDI

SEQ ID NO: 2401091 - protein, 29 aa, Entamoeba dispar
REGIRLRKLYFKSLLRQDATWYDFQESGE

SEQ ID NO: 2401092 - protein, 24 aa, Entamoeba dispar
REIISLKGIWYLLDLSRPANVTIQ

SEQ ID NO: 2401093 - protein, 21 aa, Entamoeba dispar
RELLEKMFKIIYRDSYETTQK

SEQ ID NO: 2401094 - protein, 33 aa, Entamoeba dispar
RETLKKYWNKLKLLLISIQLFDYMSPSIGIILS

SEQ ID NO: 2401095 - protein, 33 aa, Entamoeba dispar
RETSKYIQVFNFISLIFFPITFVVNTFGCNIRV

SEQ ID NO: 2401096 - protein, 18 aa, Entamoeba dispar
REVLGAEQLPPLYSYLLF

SEQ ID NO: 2401097 - protein, 22 aa, Entamoeba dispar
REYQLDWSLIPSDTSKLPVVSI

SEQ ID NO: 2401098 - protein, 21 aa, Entamoeba dispar
REYVLLLSGLLSTQLTIQKTD

SEQ ID NO: 2401099 - protein, 20 aa, Entamoeba dispar
RFDYSTNTGYPQFLWRYSSL

SEQ ID NO: 2401100 - protein, 38 aa, Entamoeba dispar
RFEDEKIVILFDLLIDILFEYGFIIFTSKMRNKVNKSK

SEQ ID NO: 2401101 - protein, 17 aa, Entamoeba dispar
RFEPILKIIPSDYQLIL

SEQ ID NO: 2401102 - protein, 22 aa, Entamoeba dispar
RFILLIMYINIVNGINNLLYTN

SEQ ID NO: 2401103 - protein, 23 aa, Entamoeba dispar
RFILLIMYINIVNGINNLLYTNK

SEQ ID NO: 2401104 - protein, 27 aa, Entamoeba dispar
RFKDSSPLILLPHQMNYIRYIPSIIGD

SEQ ID NO: 2401105 - protein, 18 aa, Entamoeba dispar
RFMGWKRFAFREYPVALA

SEQ ID NO: 2401106 - protein, 34 aa, Entamoeba dispar
RFNPISIQSLTLFPFIQTLYLYSSFDPFIKGIDQ

SEQ ID NO: 2401107 - protein, 33 aa, Entamoeba dispar
RFNQVTSTPIIFNLCEWYSIIPEPDKHYSFSVP

SEQ ID NO: 2401108 - protein, 29 aa, Entamoeba dispar
RFPFNFLAHFSFILYLILFVLSPIVLNYI

SEQ ID NO: 2401109 - protein, 26 aa, Entamoeba dispar
RFRNKYYPFWLTIYPEGTRVKPQKLI

SEQ ID NO: 2401110 - protein, 21 aa, Entamoeba dispar
RFSRLQELKLLPRLQLLSVNC

SEQ ID NO: 2401111 - protein, 19 aa, Entamoeba dispar
RFVTILRLNGSGPYTYFGY

SEQ ID NO: 2401112 - protein, 19 aa, Entamoeba dispar
RFWPYFSNVTLFSIFVPIL

SEQ ID NO: 2401113 - protein, 25 aa, Entamoeba dispar
RFYFYLEILYLLMNITIQPPNFHIS

SEQ ID NO: 2401114 - protein, 20 aa, Entamoeba dispar
RFYTFFISYFFQLTTKTDIH

SEQ ID NO: 2401115 - protein, 20 aa, Entamoeba dispar
RGEFIPLTFPVHTYTTDNTV

SEQ ID NO: 2401116 - protein, 17 aa, Entamoeba dispar
RGILSLEYPMQKEPIDY

SEQ ID NO: 2401117 - protein, 34 aa, Entamoeba dispar
RGIYTFDIWINNKRIRALLFNTHFILPICPSKCS

SEQ ID NO: 2401118 - protein, 19 aa, Entamoeba dispar
RGKYFLILLLVGVIISTFL

SEQ ID NO: 2401119 - protein, 24 aa, Entamoeba dispar
RGLYVLICIIIAVLIRLYSVLRYE

SEQ ID NO: 2401120 - protein, 18 aa, Entamoeba dispar
RGNELSELVWYNKKLYGF

SEQ ID NO: 2401121 - protein, 25 aa, Entamoeba dispar
RGNYIFKENISFGFNILKSTISLCD

SEQ ID NO: 2401122 - protein, 25 aa, Entamoeba dispar
RGRFITEFIGAIFQLNKLAIVTEYA

SEQ ID NO: 2401123 - protein, 22 aa, Entamoeba dispar
RGSFIFYHELLPQIFINDKNTS

SEQ ID NO: 2401124 - protein, 27 aa, Entamoeba dispar
RGTLIFSFIFGTIGYLLFALQVSFRFS

SEQ ID NO: 2401125 - protein, 17 aa, Entamoeba dispar
RGWKNFLLFGCGTVTLI

SEQ ID NO: 2401126 - protein, 30 aa, Entamoeba dispar
RHEEYIFGQWGFLILYIISKGGKVEILYPK

SEQ ID NO: 2401127 - protein, 18 aa, Entamoeba dispar
RHHLHPFYFLFPSSSHTD

SEQ ID NO: 2401128 - protein, 19 aa, Entamoeba dispar
RHHLHPFYFLFPSSSHTDL

SEQ ID NO: 2401129 - protein, 18 aa, Entamoeba dispar
RHIVEMDSLYPFTKFVTS

SEQ ID NO: 2401130 - protein, 18 aa, Entamoeba dispar
RHNLSVYWYYLSLSFDFP

SEQ ID NO: 2401131 - protein, 24 aa, Entamoeba dispar
RHSSYFIIPSTFTPYDIERIRLIL

SEQ ID NO: 2401132 - protein, 20 aa, Entamoeba dispar
RIASMVGIKVFVTGGLGGVH

SEQ ID NO: 2401133 - protein, 17 aa, Entamoeba dispar
RICLFQVFGYKGTLIHV

SEQ ID NO: 2401134 - protein, 40 aa, Entamoeba dispar
RIDKLHFDLFVRDWQKYFPMKTLLFLSKPLSDLSSVNSLV

SEQ ID NO: 2401135 - protein, 25 aa, Entamoeba dispar
RIDSKHLYFLFLEINEEYSASINLT

SEQ ID NO: 2401136 - protein, 22 aa, Entamoeba dispar
RIEGTFTFKKPVKLINIHSPKK

SEQ ID NO: 2401137 - protein, 34 aa, Entamoeba dispar
RIFEQKGMLQLLMFSAALIKFKPKYDPFKLVKPV

SEQ ID NO: 2401138 - protein, 25 aa, Entamoeba dispar
RIFVKTVVSAYLWDGLYISLDKVTM

SEQ ID NO: 2401139 - protein, 17 aa, Entamoeba dispar
RIGGISKLLILLNQKYN

SEQ ID NO: 2401140 - protein, 25 aa, Entamoeba dispar
RIGNFAYEFTPIDNFPLSLSCSTLT

SEQ ID NO: 2401141 - protein, 29 aa, Entamoeba dispar
RIIILFILSIILQPILMISLFSLKLASGN

SEQ ID NO: 2401142 - protein, 38 aa, Entamoeba dispar
RIKERRTLWMLWAFWWFVYALVCVMTFGALKYFGANDD

SEQ ID NO: 2401143 - protein, 17 aa, Entamoeba dispar
RIKSPMIAGNWFNTGIG

SEQ ID NO: 2401144 - protein, 28 aa, Entamoeba dispar
RIKSYIVISVVMLLGLLVSSMKKKLLSF

SEQ ID NO: 2401145 - protein, 19 aa, Entamoeba dispar
RILIMMLNCDSSIALDFCA

SEQ ID NO: 2401146 - protein, 27 aa, Entamoeba dispar
RILYSQILDLFNYFGLRTSLMYIHCFI

SEQ ID NO: 2401147 - protein, 26 aa, Entamoeba dispar
RINATSVFYLFVRTNYEILGSTQCMR

SEQ ID NO: 2401148 - protein, 27 aa, Entamoeba dispar
RINDDITYLPFFSFLQFEESIILSLLK

SEQ ID NO: 2401149 - protein, 20 aa, Entamoeba dispar
RININFSKGKVYYILLSMKD

SEQ ID NO: 2401150 - protein, 18 aa, Entamoeba dispar
RINNKYYWYLETQDKIIP

SEQ ID NO: 2401151 - protein, 26 aa, Entamoeba dispar
RINTLADWWYLPISAILINGLAFPSI

SEQ ID NO: 2401152 - protein, 19 aa, Entamoeba dispar
RIRCPYIVNFIGSVATADT

SEQ ID NO: 2401153 - protein, 20 aa, Entamoeba dispar
RIRCPYIVNFIGSVATADTL

SEQ ID NO: 2401154 - protein, 17 aa, Entamoeba dispar
RIRFLLRPSGVVGCNTV

SEQ ID NO: 2401155 - protein, 23 aa, Entamoeba dispar
RISDFTEYLMKAGMGTILYDPET

SEQ ID NO: 2401156 - protein, 18 aa, Entamoeba dispar
RISNACIIGLLVVLGNSV

SEQ ID NO: 2401157 - protein, 29 aa, Entamoeba dispar
RITIVIRVVIPLIIFLNIALFVTSNTGTG

SEQ ID NO: 2401158 - protein, 23 aa, Entamoeba dispar
RITKIEGIFLYEIKQYKYDNFLC

SEQ ID NO: 2401159 - protein, 41 aa, Entamoeba dispar
RITPHLISLVHANIYFAEFMRSMLYLWRLGKVAEVIEKYLN

SEQ ID NO: 2401160 - protein, 21 aa, Entamoeba dispar
RIVELLYGFSLVGRPTPMSVI

SEQ ID NO: 2401161 - protein, 17 aa, Entamoeba dispar
RIWGSMCCILYAIIFLI

SEQ ID NO: 2401162 - protein, 32 aa, Entamoeba dispar
RIWGSMCCILYLFVFLIFGMGWIKGPVADFLV

SEQ ID NO: 2401163 - protein, 31 aa, Entamoeba dispar
RIYCTVYILAFFFIFPMRLGQIITALNQRSQ

SEQ ID NO: 2401164 - protein, 25 aa, Entamoeba dispar
RIYVPDKFPYIQMLLFVVIGTVTII

SEQ ID NO: 2401165 - protein, 24 aa, Entamoeba dispar
RKDLSLLWYFLPYTPSIKYNITVD

SEQ ID NO: 2401166 - protein, 28 aa, Entamoeba dispar
RKDNENFIRFPFKLKIKILLDTARGMQF

SEQ ID NO: 2401167 - protein, 26 aa, Entamoeba dispar
RKDNESYIKLPYKLKVKMLFDTARGM

SEQ ID NO: 2401168 - protein, 24 aa, Entamoeba dispar
RKELRSFIIVRCDNVYFVWCGSFI

SEQ ID NO: 2401169 - protein, 18 aa, Entamoeba dispar
RKFASWLGANLLDKENIG

SEQ ID NO: 2401170 - protein, 19 aa, Entamoeba dispar
RKFLQFQLTVNVSAVVLCI

SEQ ID NO: 2401171 - protein, 24 aa, Entamoeba dispar
RKFLSNVLAFLSSCIWSISISSRS

SEQ ID NO: 2401172 - protein, 21 aa, Entamoeba dispar
RKGLEIIYLMNIVPYLENIST

SEQ ID NO: 2401173 - protein, 20 aa, Entamoeba dispar
RKKQQAYLLINMLRVDPQAF

SEQ ID NO: 2401174 - protein, 26 aa, Entamoeba dispar
RKKRNLLLSPCYLISFIATEINSLIQ

SEQ ID NO: 2401175 - protein, 20 aa, Entamoeba dispar
RKLCAKKRYVSAFKIFKESF

SEQ ID NO: 2401176 - protein, 17 aa, Entamoeba dispar
RKLIQFFQKNRNIILKI

SEQ ID NO: 2401177 - protein, 25 aa, Entamoeba dispar
RKLKKLIFITLLSATIIYITLGIIG

SEQ ID NO: 2401178 - protein, 22 aa, Entamoeba dispar
RKLLSAQQLLDCNTVAWGGCGG

SEQ ID NO: 2401179 - protein, 20 aa, Entamoeba dispar
RKMIVLKSINFFVNTPFLIF

SEQ ID NO: 2401180 - protein, 30 aa, Entamoeba dispar
RKNITEYKPLMYCLLIVFGLTIILSFEIIP

SEQ ID NO: 2401181 - protein, 27 aa, Entamoeba dispar
RKNKSNYLRLPYKLKIRMLFDTARGME

SEQ ID NO: 2401182 - protein, 24 aa, Entamoeba dispar
RKSKYLFEYYNPRLSEIDLLYSSN

SEQ ID NO: 2401183 - protein, 27 aa, Entamoeba dispar
RKSSKDFLILPYNLKLRMLYDTARGMS

SEQ ID NO: 2401184 - protein, 21 aa, Entamoeba dispar
RKTELPYLLERKFNNIFRFDN

SEQ ID NO: 2401185 - protein, 22 aa, Entamoeba dispar
RKTMKEVIRLAEDLRAYHDNDV

SEQ ID NO: 2401186 - protein, 19 aa, Entamoeba dispar
RKTWKEDIAKAMKKILGGE

SEQ ID NO: 2401187 - protein, 23 aa, Entamoeba dispar
RKWALWFGLILQCVGIVLCIITQ

SEQ ID NO: 2401188 - protein, 17 aa, Entamoeba dispar
RLAVAVVLLFLYLGIFA

SEQ ID NO: 2401189 - protein, 18 aa, Entamoeba dispar
RLAYFCTFLLITYTYYHW

SEQ ID NO: 2401190 - protein, 17 aa, Entamoeba dispar
RLCFIISLIVVVGYIAL

SEQ ID NO: 2401191 - protein, 49 aa, Entamoeba dispar
RLECTKVNLALILPLCIGACLILIAIILIIIFFLWRRRRAAEKQRETEI

SEQ ID NO: 2401192 - protein, 26 aa, Entamoeba dispar
RLELYDSIHFLTLWSQSISFIPMKAF

SEQ ID NO: 2401193 - protein, 18 aa, Entamoeba dispar
RLFDKVLQTCLSPLQYNV

SEQ ID NO: 2401194 - protein, 19 aa, Entamoeba dispar
RLFILYFYLLILNINILFF

SEQ ID NO: 2401195 - protein, 17 aa, Entamoeba dispar
RLHVFGEIFAENGFLQR

SEQ ID NO: 2401196 - protein, 39 aa, Entamoeba dispar
RLIEALSCYLYPLHPFTKPPQYIYPWKIIGELSAILSYE

SEQ ID NO: 2401197 - protein, 18 aa, Entamoeba dispar
RLIVIIVFYLISVKYSIF

SEQ ID NO: 2401198 - protein, 20 aa, Entamoeba dispar
RLLHHAVANAGLLITIITHA

SEQ ID NO: 2401199 - protein, 21 aa, Entamoeba dispar
RLLKNLVWINNLLEFLMLLNS

SEQ ID NO: 2401200 - protein, 35 aa, Entamoeba dispar
RLLLTTISRIGFFLLFIVFAVLVVIALFVSLNAPK

SEQ ID NO: 2401201 - protein, 19 aa, Entamoeba dispar
RLLPAIISMITFSAALKNM

SEQ ID NO: 2401202 - protein, 19 aa, Entamoeba dispar
RLLPFFETSIIPFDPSDAK

SEQ ID NO: 2401203 - protein, 31 aa, Entamoeba dispar
RLMTKANLFCLFIVMWTFTFSLTCFAYFLAT

SEQ ID NO: 2401204 - protein, 34 aa, Entamoeba dispar
RLNRLQVASLFALSFLGLFRLPIKFQDAKQFPRC

SEQ ID NO: 2401205 - protein, 19 aa, Entamoeba dispar
RLRNPYIIGYIGSVTYNPE

SEQ ID NO: 2401206 - protein, 18 aa, Entamoeba dispar
RLSKWMYIGLAIGCFVVT

SEQ ID NO: 2401207 - protein, 18 aa, Entamoeba dispar
RLYFFVYVTSDQSTSITI

SEQ ID NO: 2401208 - protein, 51 aa, Entamoeba dispar
RLYGINSFCSCLFFLLTIFSFKLFLCFHSIELILLASWCPIIPSCGVYDYH

SEQ ID NO: 2401209 - protein, 25 aa, Entamoeba dispar
RMEWGHFLICFIAILISQLSTLVIP

SEQ ID NO: 2401210 - protein, 19 aa, Entamoeba dispar
RMKISNIPTTCVYICNFRN

SEQ ID NO: 2401211 - protein, 25 aa, Entamoeba dispar
RMLMSYSCWIYFIETYRFNYEYNER

SEQ ID NO: 2401212 - protein, 20 aa, Entamoeba dispar
RMNALPVGTQFPFVKLRDVD

SEQ ID NO: 2401213 - protein, 18 aa, Entamoeba dispar
RMNKFNVLYAPITGLNRL

SEQ ID NO: 2401214 - protein, 19 aa, Entamoeba dispar
RMRIDLISELLRIIEIAFI

SEQ ID NO: 2401215 - protein, 22 aa, Entamoeba dispar
RMWINFQEYYPLIIKKFNDESI

SEQ ID NO: 2401216 - protein, 24 aa, Entamoeba dispar
RNDQLTHILSLWKSLINVKSEISH

SEQ ID NO: 2401217 - protein, 31 aa, Entamoeba dispar
RNDYGNEGFLLMILYYLGCYITLSKLQKDGK

SEQ ID NO: 2401218 - protein, 23 aa, Entamoeba dispar
RNGIIRFNILSLLIEINKEAESD

SEQ ID NO: 2401219 - protein, 19 aa, Entamoeba dispar
RNGWVLCVLAIPIGIISGY

SEQ ID NO: 2401220 - protein, 20 aa, Entamoeba dispar
RNGWVLCVLAIPIGIISGYD

SEQ ID NO: 2401221 - protein, 24 aa, Entamoeba dispar
RNKLEYFYSVVLRLTLLSPNACLN

SEQ ID NO: 2401222 - protein, 23 aa, Entamoeba dispar
RNLKGFLWGYVAIILGVIATLLT

SEQ ID NO: 2401223 - protein, 17 aa, Entamoeba dispar
RNNINICFLINNKQMKF

SEQ ID NO: 2401224 - protein, 28 aa, Entamoeba dispar
RNNYRGYLCILFIAFSNFVYVLDILKLK

SEQ ID NO: 2401225 - protein, 36 aa, Entamoeba dispar
RNPILQLLRCYVLFPEHWPTFLALADMHELLAIYSE

SEQ ID NO: 2401226 - protein, 32 aa, Entamoeba dispar
RNSTYYFITVFIVFLFSFSINFFLTNAIKLFA

SEQ ID NO: 2401227 - protein, 21 aa, Entamoeba dispar
RNTERLLLFIVYCGFDTKLAK

SEQ ID NO: 2401228 - protein, 20 aa, Entamoeba dispar
RNTFIQYNVLITKGIRTNSN

SEQ ID NO: 2401229 - protein, 32 aa, Entamoeba dispar
RNVKKTLFYIIIATIVFIPICISFHIATRPHS

SEQ ID NO: 2401230 - protein, 21 aa, Entamoeba dispar
RNYLFFLCLTICIASFIGMVI

SEQ ID NO: 2401231 - protein, 24 aa, Entamoeba dispar
RPDNIPEPLYKLITLCWAQEPKER

SEQ ID NO: 2401232 - protein, 34 aa, Entamoeba dispar
RPFIVVLMFELYWFTILFFLLEAYNSFSLTILSI

SEQ ID NO: 2401233 - protein, 25 aa, Entamoeba dispar
RPFMLIGLGVWLLGAIIIVCSSIYP

SEQ ID NO: 2401234 - protein, 17 aa, Entamoeba dispar
RPHFVELISFEDQNISA

SEQ ID NO: 2401235 - protein, 28 aa, Entamoeba dispar
RPKSTTLYLPPRYPLLGGWKTSFEVNYN

SEQ ID NO: 2401236 - protein, 19 aa, Entamoeba dispar
RPLAVSLFGRYLKAIIIGG

SEQ ID NO: 2401237 - protein, 28 aa, Entamoeba dispar
RPYQLDGISWLLFLHKYCINGILCDDMG

SEQ ID NO: 2401238 - protein, 27 aa, Entamoeba dispar
RQFFGYYFFGVFLFLLLAFYVMVPFSY

SEQ ID NO: 2401239 - protein, 18 aa, Entamoeba dispar
RQFVKLCYSFLFIQNLTS

SEQ ID NO: 2401240 - protein, 25 aa, Entamoeba dispar
RQHMDSLWMIIIAQSPRVSLNNDNK

SEQ ID NO: 2401241 - protein, 20 aa, Entamoeba dispar
RQNEMNIYYPPTDEGICMSY

SEQ ID NO: 2401242 - protein, 35 aa, Entamoeba dispar
RQYLRKYKLGRIPYLYLFIVALFTSIVTAPWYGEI

SEQ ID NO: 2401243 - protein, 20 aa, Entamoeba dispar
RRDMRIMENLKIVTKIGGYD

SEQ ID NO: 2401244 - protein, 19 aa, Entamoeba dispar
RREEKLLGIKPDRNEKKEI

SEQ ID NO: 2401245 - protein, 18 aa, Entamoeba dispar
RRKVDLTKEVKFIPNIFD

SEQ ID NO: 2401246 - protein, 37 aa, Entamoeba dispar
RRKVITYLAIFVFITSYITLYLLVQISKRSSLIGKQL

SEQ ID NO: 2401247 - protein, 26 aa, Entamoeba dispar
RRNAKFIFGNAFYYKSYSSQYTLFDG

SEQ ID NO: 2401248 - protein, 25 aa, Entamoeba dispar
RRPLPILFCLLLLPLPKNNISFISI

SEQ ID NO: 2401249 - protein, 29 aa, Entamoeba dispar
RRRGKFISSVPLLNLFPLGECFSKKENNE

SEQ ID NO: 2401250 - protein, 19 aa, Entamoeba dispar
RSCMNFIVWAIPPSVSFVT

SEQ ID NO: 2401251 - protein, 21 aa, Entamoeba dispar
RSEGLLFFRTKNEYKDFYVIQ

SEQ ID NO: 2401252 - protein, 21 aa, Entamoeba dispar
RSELIPQYYTTPAFLTNLNNY

SEQ ID NO: 2401253 - protein, 19 aa, Entamoeba dispar
RSEPQLAFIKPGNAVEFNL

SEQ ID NO: 2401254 - protein, 23 aa, Entamoeba dispar
RSEVWKLLLLKDLDYKTLQDEFD

SEQ ID NO: 2401255 - protein, 22 aa, Entamoeba dispar
RSFDIDYQLLSFKSPDPFNSSC

SEQ ID NO: 2401256 - protein, 20 aa, Entamoeba dispar
RSFKELMNIILVTGNYLNAD

SEQ ID NO: 2401257 - protein, 19 aa, Entamoeba dispar
RSFYLSLVNEKQALRKTKR

SEQ ID NO: 2401258 - protein, 17 aa, Entamoeba dispar
RSGAIVVCAPIAPYREI

SEQ ID NO: 2401259 - protein, 22 aa, Entamoeba dispar
RSGYLFLIGIFLMIPYLHRKFH

SEQ ID NO: 2401260 - protein, 23 aa, Entamoeba dispar
RSHTPLTVFRYISGSISFSYNFQ

SEQ ID NO: 2401261 - protein, 42 aa, Entamoeba dispar
RSITLRGYWQIFGYVMVAIFVILILYLSFFKSKKSTVTKRPH

SEQ ID NO: 2401262 - protein, 20 aa, Entamoeba dispar
RSKIAWIEFPYECGLIQCEQ

SEQ ID NO: 2401263 - protein, 29 aa, Entamoeba dispar
RSLKVECPLLIPQFSLIPKFLKSGNEQVV

SEQ ID NO: 2401264 - protein, 28 aa, Entamoeba dispar
RSNQIEHLILFTPLPLKPQLNEYFSPNS

SEQ ID NO: 2401265 - protein, 17 aa, Entamoeba dispar
RSPIFIHFDQTLLGLAT

SEQ ID NO: 2401266 - protein, 29 aa, Entamoeba dispar
RSPKFYLHVFICLLPPLAPRLISYFFNLL

SEQ ID NO: 2401267 - protein, 20 aa, Entamoeba dispar
RSQFIINFIGSVITPDKLCL

SEQ ID NO: 2401268 - protein, 24 aa, Entamoeba dispar
RSQYSSYLFTITFLEVNPNNTDEQ

SEQ ID NO: 2401269 - protein, 26 aa, Entamoeba dispar
RSSRNTHLFFLKPLVPIQLTEIFIEQ

SEQ ID NO: 2401270 - protein, 26 aa, Entamoeba dispar
RSSSIKWILFIFASILFSFSRRLIIQ

SEQ ID NO: 2401271 - protein, 25 aa, Entamoeba dispar
RSTNAIAYWIATTCSILIHIKCYVT

SEQ ID NO: 2401272 - protein, 71 aa, Entamoeba dispar
RSTRLMAINIILLCTYFFQLGVIGFLDYSFLNYISIYIHLMIYILEFLLLFILLFVCAKSNRIFKMEFKSK

SEQ ID NO: 2401273 - protein, 27 aa, Entamoeba dispar
RSYHDLSHYPIFPWIIQDYTSISLDLS

SEQ ID NO: 2401274 - protein, 22 aa, Entamoeba dispar
RSYLTVVVVVIFGVLLVGVVIG

SEQ ID NO: 2401275 - protein, 32 aa, Entamoeba dispar
RTAGEYLPSAIRKLWPYLPNGIKEWYCTKKLK

SEQ ID NO: 2401276 - protein, 26 aa, Entamoeba dispar
RTAKKLDHFFPIQKIWNQSGVIMFDE

SEQ ID NO: 2401277 - protein, 26 aa, Entamoeba dispar
RTEKEGFVKLPYKLKIKMLFDTARGM

SEQ ID NO: 2401278 - protein, 18 aa, Entamoeba dispar
RTFINSDISLYRIYLHIL

SEQ ID NO: 2401279 - protein, 33 aa, Entamoeba dispar
RTIDTSWIMLLKFHISFLFSIQFEKLENLIYSV

SEQ ID NO: 2401280 - protein, 18 aa, Entamoeba dispar
RTIYVAVKQFRWENLSNE

SEQ ID NO: 2401281 - protein, 23 aa, Entamoeba dispar
RTMNVIINFYIPICIIAMISIYK

SEQ ID NO: 2401282 - protein, 17 aa, Entamoeba dispar
RTPYPFPATTTYGEILT

SEQ ID NO: 2401283 - protein, 30 aa, Entamoeba dispar
RTRHCFGGFLTIICVVIIIILSIAEFTFYL

SEQ ID NO: 2401284 - protein, 17 aa, Entamoeba dispar
RTSLFQVLYSIAYEFKD

SEQ ID NO: 2401285 - protein, 27 aa, Entamoeba dispar
RTSLPNALPFKINATPFIPKRKRIENT

SEQ ID NO: 2401286 - protein, 29 aa, Entamoeba dispar
RTSLPNALPFKINATPFIPKRKRIENTIN

SEQ ID NO: 2401287 - protein, 23 aa, Entamoeba dispar
RTYFKKMRLLDQKPLGTAFQFPI

SEQ ID NO: 2401288 - protein, 20 aa, Entamoeba dispar
RTYQFDCLFPILSNAPNLFF

SEQ ID NO: 2401289 - protein, 41 aa, Entamoeba dispar
RTYSTKLLVLAIFLPGLGIYIFFVLVLSIINAIKYTLLIEK

SEQ ID NO: 2401290 - protein, 17 aa, Entamoeba dispar
RVFGCGKIITVVVLLAM

SEQ ID NO: 2401291 - protein, 25 aa, Entamoeba dispar
RVFVADLRDVFFFADGFATFSDRQL

SEQ ID NO: 2401292 - protein, 24 aa, Entamoeba dispar
RVGGVKIFFDKYLTSTGSGRFALV

SEQ ID NO: 2401293 - protein, 23 aa, Entamoeba dispar
RVGVRVFELILSGAFSLSKFLSN

SEQ ID NO: 2401294 - protein, 18 aa, Entamoeba dispar
RVHIVYCESKYYNPLTIT

SEQ ID NO: 2401295 - protein, 23 aa, Entamoeba dispar
RVIDPYWFHYFEDWSYDCLPDDI

SEQ ID NO: 2401296 - protein, 17 aa, Entamoeba dispar
RVLCDIFLQKTVHPNLC

SEQ ID NO: 2401297 - protein, 22 aa, Entamoeba dispar
RVLEMLKLLPYSLKVHFVSGLE

SEQ ID NO: 2401298 - protein, 35 aa, Entamoeba dispar
RVPSHFIHDAFYLTLFSLIVILHIMIWRQGGALLI

SEQ ID NO: 2401299 - protein, 49 aa, Entamoeba dispar
RVRRSIVSLIIFIGGIIIWIFIWLLLLIGFISKYIFLNKLIISEQQKDE

SEQ ID NO: 2401300 - protein, 24 aa, Entamoeba dispar
RVSDLELIFKYKYSGNPTSELNAV

SEQ ID NO: 2401301 - protein, 18 aa, Entamoeba dispar
RVTGICILLLFIVVLIMT

SEQ ID NO: 2401302 - protein, 17 aa, Entamoeba dispar
RVVVGSLLLIVTSVVFT

SEQ ID NO: 2401303 - protein, 21 aa, Entamoeba dispar
RVWPSLLLMVITVATLSIFID

SEQ ID NO: 2401304 - protein, 27 aa, Entamoeba dispar
RVYAFNVICWLLPIKFGLSDIFDQNLY

SEQ ID NO: 2401305 - protein, 19 aa, Entamoeba dispar
RVYEGLYLVKFNRDYAKAS

SEQ ID NO: 2401306 - protein, 17 aa, Entamoeba dispar
RVYYSIQYFLKSGFSLI

SEQ ID NO: 2401307 - protein, 25 aa, Entamoeba dispar
RWAYWSMIALFCVTIFYAILVLIVI

SEQ ID NO: 2401308 - protein, 53 aa, Entamoeba dispar
RWLQSSIIMFIVYLFILITLWLYFNTHRISIIFPLILIFQLSLIQSSWNKNLC

SEQ ID NO: 2401309 - protein, 30 aa, Entamoeba dispar
RYCYRQIGITLFYLLYKNIILIMCEFIYNM

SEQ ID NO: 2401310 - protein, 20 aa, Entamoeba dispar
RYEWMAMLLACCRQGIIIVT

SEQ ID NO: 2401311 - protein, 24 aa, Entamoeba dispar
RYFAKEKGLYLSQEDIKKILSEIL

SEQ ID NO: 2401312 - protein, 17 aa, Entamoeba dispar
RYFSIKNIKFHSATSKC

SEQ ID NO: 2401313 - protein, 24 aa, Entamoeba dispar
RYIPKKWKICQLWNGRVIIFIIRC

SEQ ID NO: 2401314 - protein, 27 aa, Entamoeba dispar
RYIPKQWKFMTIWNGRLSILVIRISLL

SEQ ID NO: 2401315 - protein, 28 aa, Entamoeba dispar
RYKILHDAALGILFLHNRNLMHCNLKPQ

SEQ ID NO: 2401316 - protein, 19 aa, Entamoeba dispar
RYLCFIISKTPEENLICVG

SEQ ID NO: 2401317 - protein, 27 aa, Entamoeba dispar
RYNKDTDIYLPYKLKIKMLFDTARGMQ

SEQ ID NO: 2401318 - protein, 23 aa, Entamoeba dispar
RYPINIILHLFLFTIGGISIGTV

SEQ ID NO: 2401319 - protein, 23 aa, Entamoeba dispar
RYPSWVFFGMNYVAYLMFPLICL

SEQ ID NO: 2401320 - protein, 17 aa, Entamoeba dispar
RYRRGLPLVLNGINALI

SEQ ID NO: 2401321 - protein, 37 aa, Entamoeba dispar
RYSFYSFKLFGLPVPYPLLWCRYSFFIVLYPMGVSGE

SEQ ID NO: 2401322 - protein, 20 aa, Entamoeba dispar
RYSIGLKCPPALNPEWGDIS

SEQ ID NO: 2401323 - protein, 21 aa, Entamoeba dispar
RYTKYSIIDFYHTLFNNNNEV

SEQ ID NO: 2401324 - protein, 19 aa, Entamoeba dispar
RYVPIVEKTPFFKTLIKFY

SEQ ID NO: 2401325 - protein, 18 aa, Entamoeba dispar
RYYCQYQRAFEIVKKLLP

SEQ ID NO: 2401326 - protein, 27 aa, Entamoeba dispar
SAALCFMILHYFSSFEPPLFPSDFRCA

SEQ ID NO: 2401327 - protein, 18 aa, Entamoeba dispar
SAAVFCALFLLGGSFEKG

SEQ ID NO: 2401328 - protein, 22 aa, Entamoeba dispar
SACIFLVFSIILILTCLKLWGE

SEQ ID NO: 2401329 - protein, 25 aa, Entamoeba dispar
SACSRMLYLRLPTILLQTPSTKAVN

SEQ ID NO: 2401330 - protein, 40 aa, Entamoeba dispar
SADIFSFSILMYETFKWDRPYPENLFKYPWNIAEYVMQGN

SEQ ID NO: 2401331 - protein, 27 aa, Entamoeba dispar
SAFIFKFLAYFNLIIDVRLICVCMGPI

SEQ ID NO: 2401332 - protein, 31 aa, Entamoeba dispar
SAHFLRFAPCALVMLFFQLPSFQELFLDHIS

SEQ ID NO: 2401333 - protein, 27 aa, Entamoeba dispar
SAHIASFFEIIKRCLIILTKDTIASRN

SEQ ID NO: 2401334 - protein, 31 aa, Entamoeba dispar
SAIDCSFLSKYLSFKIKPNQEFIPYEREWST

SEQ ID NO: 2401335 - protein, 27 aa, Entamoeba dispar
SAIENIVGIIFYLLKRYGNLSSMLNEH

SEQ ID NO: 2401336 - protein, 27 aa, Entamoeba dispar
SAIINLFNVSWRIITSHRLGIHNMIHA

SEQ ID NO: 2401337 - protein, 23 aa, Entamoeba dispar
SAIKDICWIVMKIEKLAQLERIN

SEQ ID NO: 2401338 - protein, 18 aa, Entamoeba dispar
SAIPLMRESVDKEKKYYQ

SEQ ID NO: 2401339 - protein, 17 aa, Entamoeba dispar
SAKQIMLMPYEKEVRQL

SEQ ID NO: 2401340 - protein, 33 aa, Entamoeba dispar
SAKTAIFLFVFVIMMFILLLEIWHAGIVLMTGV

SEQ ID NO: 2401341 - protein, 24 aa, Entamoeba dispar
SALESPICKFALFFGNRISEEVEL

SEQ ID NO: 2401342 - protein, 23 aa, Entamoeba dispar
SALSFCLFSIRIIGGLLTQKLIL

SEQ ID NO: 2401343 - protein, 23 aa, Entamoeba dispar
SALTRRVNFYLFGLNAKDQDIEK

SEQ ID NO: 2401344 - protein, 37 aa, Entamoeba dispar
SANALGPIVIAIISIIFASLVFFLCQRRTDNNPAQYN

SEQ ID NO: 2401345 - protein, 23 aa, Entamoeba dispar
SASPYLPVIETFKRISLSKYPYQ

SEQ ID NO: 2401346 - protein, 22 aa, Entamoeba dispar
SATKLRCYMAYFSTIGIAIINK

SEQ ID NO: 2401347 - protein, 18 aa, Entamoeba dispar
SAVLKKEYIANLCQVFVV

SEQ ID NO: 2401348 - protein, 27 aa, Entamoeba dispar
SAVTLIFLALIFLPRYLKRGIATIPDF

SEQ ID NO: 2401349 - protein, 30 aa, Entamoeba dispar
SAVVLAAVKLILVLLPHLSEQNASLYLKKI

SEQ ID NO: 2401350 - protein, 21 aa, Entamoeba dispar
SCDVKYYIDPITHTCLPCGSS

SEQ ID NO: 2401351 - protein, 44 aa, Entamoeba dispar
SCEEKSKWWISLIILGVLLILFIITILSISFTITFLINRKKKKE

SEQ ID NO: 2401352 - protein, 19 aa, Entamoeba dispar
SCEIYISSFYITLKKINLE

SEQ ID NO: 2401353 - protein, 53 aa, Entamoeba dispar
SCEKHPVWWVVLVIVILLIFIIVTVLILVIFGLYKILLYINKKNLQNKARKTY

SEQ ID NO: 2401354 - protein, 18 aa, Entamoeba dispar
SCFILPTSLQTITFTNCS

SEQ ID NO: 2401355 - protein, 25 aa, Entamoeba dispar
SCGKPMKFIFLIDVSKDSLTRVFDS

SEQ ID NO: 2401356 - protein, 29 aa, Entamoeba dispar
SCIPIAILVLLWVLKSLSLMIIPLCTIVT

SEQ ID NO: 2401357 - protein, 17 aa, Entamoeba dispar
SCIVCEDGYVYDSYTKQ

SEQ ID NO: 2401358 - protein, 47 aa, Entamoeba dispar
SCKESGIFWWHILLIIIGSVWIAFILMIGIFLIINTFRKRKSFDPKA

SEQ ID NO: 2401359 - protein, 17 aa, Entamoeba dispar
SCKRFYRLNKFSCVRTC

SEQ ID NO: 2401360 - protein, 50 aa, Entamoeba dispar
SCREKIFPSWGIALIIILSILVMIILIIILGIFIYFIMKHKTIDINIYKT

SEQ ID NO: 2401361 - protein, 17 aa, Entamoeba dispar
SCRIGVCRILFVGAHFS

SEQ ID NO: 2401362 - protein, 17 aa, Entamoeba dispar
SCSMKHEIVLLASDLNN

SEQ ID NO: 2401363 - protein, 26 aa, Entamoeba dispar
SCSPKEINLIPLAQEDIKCRGGPPLR

SEQ ID NO: 2401364 - protein, 24 aa, Entamoeba dispar
SCYILIFFFYSFSILILVFSYSLE

SEQ ID NO: 2401365 - protein, 21 aa, Entamoeba dispar
SDALMVFRCSTPLVIINEAEY

SEQ ID NO: 2401366 - protein, 20 aa, Entamoeba dispar
SDDGFLIGVAYILSILNQRE

SEQ ID NO: 2401367 - protein, 19 aa, Entamoeba dispar
SDDSLFIMSLLNGNISLSV

SEQ ID NO: 2401368 - protein, 18 aa, Entamoeba dispar
SDDTFTIQLFSHSINIYL

SEQ ID NO: 2401369 - protein, 22 aa, Entamoeba dispar
SDFIILILIIRISTVTGISEDS

SEQ ID NO: 2401370 - protein, 20 aa, Entamoeba dispar
SDFKRNILLPFNILYVTKNS

SEQ ID NO: 2401371 - protein, 20 aa, Entamoeba dispar
SDFLTFQLLTALTNNPRYAI

SEQ ID NO: 2401372 - protein, 23 aa, Entamoeba dispar
SDFSFIFGLILIVISLVCDGIAS

SEQ ID NO: 2401373 - protein, 26 aa, Entamoeba dispar
SDGLFGLFIQPILVSNYTLLASTKDQ

SEQ ID NO: 2401374 - protein, 24 aa, Entamoeba dispar
SDIILLLPIILISIYFLITLKNKF

SEQ ID NO: 2401375 - protein, 40 aa, Entamoeba dispar
SDIYSFAITMYEVSIWRNPFPKEQFKYPWEIADFISEGKR

SEQ ID NO: 2401376 - protein, 29 aa, Entamoeba dispar
SDIYSLAVSMYQTWSWKNPYDKDESSQFK

SEQ ID NO: 2401377 - protein, 19 aa, Entamoeba dispar
SDLLYNGAVLRFIVIQKYL

SEQ ID NO: 2401378 - protein, 26 aa, Entamoeba dispar
SDLNQFEFNLYLQLYDIVKECTNCCA

SEQ ID NO: 2401379 - protein, 25 aa, Entamoeba dispar
SDLPEMMRLPIIQGFIGRSECAVEP

SEQ ID NO: 2401380 - protein, 27 aa, Entamoeba dispar
SDLVPQLFMENFFKSLQRIIVKNVELL

SEQ ID NO: 2401381 - protein, 18 aa, Entamoeba dispar
SDLYDLLCEIPIGDINSL

SEQ ID NO: 2401382 - protein, 20 aa, Entamoeba dispar
SDMKLYLLVGGKVKDKVVLR

SEQ ID NO: 2401383 - protein, 32 aa, Entamoeba dispar
SDNFDLAVDLLFQKRNFSLLPNDVVFASWPKV

SEQ ID NO: 2401384 - protein, 27 aa, Entamoeba dispar
SDNGDHFMLLSLYLAFKKVGVNRRKRW

SEQ ID NO: 2401385 - protein, 17 aa, Entamoeba dispar
SDPGLWYLLKHNSSIVN

SEQ ID NO: 2401386 - protein, 22 aa, Entamoeba dispar
SDPIIIVGLNRIIDKYPIDTID

SEQ ID NO: 2401387 - protein, 19 aa, Entamoeba dispar
SDPISTCFLYSTPLRLNQD

SEQ ID NO: 2401388 - protein, 25 aa, Entamoeba dispar
SDRSKLMFFTLFRSGGAAILLTNKK

SEQ ID NO: 2401389 - protein, 25 aa, Entamoeba dispar
SDSYALICLTISMIYQVIPILPCEL

SEQ ID NO: 2401390 - protein, 31 aa, Entamoeba dispar
SDTLQQLFQILLPQIIRFKLTPKLTNVLLPI

SEQ ID NO: 2401391 - protein, 27 aa, Entamoeba dispar
SDVIGSLFFGLLLGISILLTGKFRFGY

SEQ ID NO: 2401392 - protein, 35 aa, Entamoeba dispar
SDVLLNILLIGVSILGVLFLIFQGLKYIIGDSMEK

SEQ ID NO: 2401393 - protein, 22 aa, Entamoeba dispar
SDVMYSWMKDSIIPFNIESVPK

SEQ ID NO: 2401394 - protein, 18 aa, Entamoeba dispar
SDYIHLYKDKEFINKFII

SEQ ID NO: 2401395 - protein, 25 aa, Entamoeba dispar
SDYRMIGINYEFVKNILIRNGDNLK

SEQ ID NO: 2401396 - protein, 25 aa, Entamoeba dispar
SDYSKCIVEIKPTPNYLAFGVFTGE

SEQ ID NO: 2401397 - protein, 18 aa, Entamoeba dispar
SDYTIFNINFICPQAIGE

SEQ ID NO: 2401398 - protein, 36 aa, Entamoeba dispar
SEAEKYMKILLSLIHLLLMIEFVFINPTKTQEGRSY

SEQ ID NO: 2401399 - protein, 24 aa, Entamoeba dispar
SEALCFLFLIIFQGTFTNIQGSFI

SEQ ID NO: 2401400 - protein, 17 aa, Entamoeba dispar
SEDISLKLKVRMLPYEF

SEQ ID NO: 2401401 - protein, 37 aa, Entamoeba dispar
SEEEKILRAMFSFTFFWYNFMPLTRGTAAGGFVFMMS

SEQ ID NO: 2401402 - protein, 25 aa, Entamoeba dispar
SEEEVKTLLTWIRNLASLNVVEKVV

SEQ ID NO: 2401403 - protein, 25 aa, Entamoeba dispar
SEEGKSIIWDLLKQLRPGMDLGRIS

SEQ ID NO: 2401404 - protein, 28 aa, Entamoeba dispar
SEEILINFYHFLKRYLKVISPLIVSSYV

SEQ ID NO: 2401405 - protein, 17 aa, Entamoeba dispar
SEELCFRGVFQFCSEHL

SEQ ID NO: 2401406 - protein, 25 aa, Entamoeba dispar
SEELGIWIQKLLTPNYDANLLSSAR

SEQ ID NO: 2401407 - protein, 33 aa, Entamoeba dispar
SEEYNLPPELLQIYKYSIMIKPISDEEKVFFFC

SEQ ID NO: 2401408 - protein, 24 aa, Entamoeba dispar
SEGLGIWIQKLLAPNYDADLISSA

SEQ ID NO: 2401409 - protein, 26 aa, Entamoeba dispar
SEGLLFLFMKVIPDNFVLTFGCFGVD

SEQ ID NO: 2401410 - protein, 21 aa, Entamoeba dispar
SEGQYLMKYICSLYNVGTQRG

SEQ ID NO: 2401411 - protein, 22 aa, Entamoeba dispar
SEGTFRYYIIPFSSERKRMSVV

SEQ ID NO: 2401412 - protein, 22 aa, Entamoeba dispar
SEHIIHFYGAVFIPNKICMITE

SEQ ID NO: 2401413 - protein, 22 aa, Entamoeba dispar
SEIDWVILICRALMTIVVCIAY

SEQ ID NO: 2401414 - protein, 52 aa, Entamoeba dispar
SEIKYQIPLYLIVLVIFFGFDEFIAILTNPLLFILTLIIGGGIYIGYKLNLG

SEQ ID NO: 2401415 - protein, 32 aa, Entamoeba dispar
SEILHSCGFLLLRVMLLKCSFNKLKKKMPTIL

SEQ ID NO: 2401416 - protein, 23 aa, Entamoeba dispar
SEINTLIVLSFQPDKKLRKSYED

SEQ ID NO: 2401417 - protein, 23 aa, Entamoeba dispar
SEINYCTILYFNELRSFSCLKCG

SEQ ID NO: 2401418 - protein, 27 aa, Entamoeba dispar
SEIRNILLSFIFLLNCFVINGEQFSFG

SEQ ID NO: 2401419 - protein, 26 aa, Entamoeba dispar
SEISILLPKFLTFYALPIESVNKCLY

SEQ ID NO: 2401420 - protein, 25 aa, Entamoeba dispar
SELTLQQRIILLRKFNYEDPEICEL

SEQ ID NO: 2401421 - protein, 25 aa, Entamoeba dispar
SENGWLFEIFGYKTLKQLAKKVIKE

SEQ ID NO: 2401422 - protein, 35 aa, Entamoeba dispar
SENIKIMIRIIANAFPIAGFWKHVCIVWTFCDCYK

SEQ ID NO: 2401423 - protein, 18 aa, Entamoeba dispar
SENRYLCFIISKTPEENL

SEQ ID NO: 2401424 - protein, 20 aa, Entamoeba dispar
SESCVTCHPGFYLNDKNQCE

SEQ ID NO: 2401425 - protein, 27 aa, Entamoeba dispar
SESITTFFLFIGIHFFFLSGHAFQFSD

SEQ ID NO: 2401426 - protein, 22 aa, Entamoeba dispar
SETKYWPNMGYYISLFGFEYRT

SEQ ID NO: 2401427 - protein, 20 aa, Entamoeba dispar
SEVDLLCSTASFIRSHTPLT

SEQ ID NO: 2401428 - protein, 25 aa, Entamoeba dispar
SEVLLLIIVFGIQTILLFPFVQERL

SEQ ID NO: 2401429 - protein, 21 aa, Entamoeba dispar
SEVLLYYYNYVLFSNTTSLPK

SEQ ID NO: 2401430 - protein, 19 aa, Entamoeba dispar
SEWKGDPQYLLFSPKKLFN

SEQ ID NO: 2401431 - protein, 19 aa, Entamoeba dispar
SEYIDLELMPLPSTNYSGP

SEQ ID NO: 2401432 - protein, 22 aa, Entamoeba dispar
SEYILSPRIVTWMNAGATQYIF

SEQ ID NO: 2401433 - protein, 21 aa, Entamoeba dispar
SEYLFLMDDIVQRMKKIKIED

SEQ ID NO: 2401434 - protein, 19 aa, Entamoeba dispar
SEYSLIRFKTYNFSTITTC

SEQ ID NO: 2401435 - protein, 18 aa, Entamoeba dispar
SFAICMLEIWLGKEPYDS

SEQ ID NO: 2401436 - protein, 18 aa, Entamoeba dispar
SFAICMLEIWLGTSPYNS

SEQ ID NO: 2401437 - protein, 17 aa, Entamoeba dispar
SFAITMYELEKWGQPFT

SEQ ID NO: 2401438 - protein, 28 aa, Entamoeba dispar
SFAVTMYEVWNWNIVYKDKSRFHYPWDI

SEQ ID NO: 2401439 - protein, 21 aa, Entamoeba dispar
SFCCLACWVVFMFQPTFSCSV

SEQ ID NO: 2401440 - protein, 27 aa, Entamoeba dispar
SFCFIFLYYLICFFFKSFDIIIRIFIN

SEQ ID NO: 2401441 - protein, 27 aa, Entamoeba dispar
SFCFQLSIKWIFVLSLRLRNGLISMIY

SEQ ID NO: 2401442 - protein, 18 aa, Entamoeba dispar
SFCYSACSLVTKGLKEWG

SEQ ID NO: 2401443 - protein, 18 aa, Entamoeba dispar
SFDHYLPKGFKNGLVMSE

SEQ ID NO: 2401444 - protein, 17 aa, Entamoeba dispar
SFDLIKNPNVFVVHQKN

SEQ ID NO: 2401445 - protein, 24 aa, Entamoeba dispar
SFDPLFKEGFCKHLIPAALHRYEE

SEQ ID NO: 2401446 - protein, 24 aa, Entamoeba dispar
SFDTWIVVIIIILTLIIDILFLLH

SEQ ID NO: 2401447 - protein, 24 aa, Entamoeba dispar
SFEKVQFIFFNGNSPTRIIGDVDE

SEQ ID NO: 2401448 - protein, 23 aa, Entamoeba dispar
SFEKVQFIFYNGNSPTRIIGDVD

SEQ ID NO: 2401449 - protein, 24 aa, Entamoeba dispar
SFEKVQFIFYNGNSPTRIIGDVDE

SEQ ID NO: 2401450 - protein, 21 aa, Entamoeba dispar
SFEKVQFYFYNGNSPTRIIGD

SEQ ID NO: 2401451 - protein, 18 aa, Entamoeba dispar
SFELYLNKLYELMKKYSN

SEQ ID NO: 2401452 - protein, 17 aa, Entamoeba dispar
SFETYIIDQLKDKIQKL

SEQ ID NO: 2401453 - protein, 19 aa, Entamoeba dispar
SFFEIWQDALGDQTLLILI

SEQ ID NO: 2401454 - protein, 17 aa, Entamoeba dispar
SFFIGLLLTGLIVAQIM

SEQ ID NO: 2401455 - protein, 19 aa, Entamoeba dispar
SFFLNQPYHFSYFSTLIGV

SEQ ID NO: 2401456 - protein, 22 aa, Entamoeba dispar
SFFLQIPFIYRSVVNFILYTGC

SEQ ID NO: 2401457 - protein, 19 aa, Entamoeba dispar
SFFSSILRSFYSILSQKLL

SEQ ID NO: 2401458 - protein, 18 aa, Entamoeba dispar
SFFYLFCYGEQCVCTLKK

SEQ ID NO: 2401459 - protein, 45 aa, Entamoeba dispar
SFGFNFRFSIILWVIIAGLTIVLIIFIIWVLYIPSKSNTKNKTTT

SEQ ID NO: 2401460 - protein, 24 aa, Entamoeba dispar
SFGIIMWEFLTRDVPYKNLPLTSI

SEQ ID NO: 2401461 - protein, 25 aa, Entamoeba dispar
SFGISIYEILTWQEAYPTSDPRFVY

SEQ ID NO: 2401462 - protein, 17 aa, Entamoeba dispar
SFGIVYIGEFRGNQVAI

SEQ ID NO: 2401463 - protein, 23 aa, Entamoeba dispar
SFGIVYIGKFRGSKVAIKKMKEI

SEQ ID NO: 2401464 - protein, 19 aa, Entamoeba dispar
SFGIVYKGIYRGNKVAIKK

SEQ ID NO: 2401465 - protein, 18 aa, Entamoeba dispar
SFGLFIFGGITAILFIAI

SEQ ID NO: 2401466 - protein, 20 aa, Entamoeba dispar
SFGMILFNDPFVALGFYANY

SEQ ID NO: 2401467 - protein, 22 aa, Entamoeba dispar
SFHRKYPFFTGKFVLPNGTSLP

SEQ ID NO: 2401468 - protein, 23 aa, Entamoeba dispar
SFILCCIACFGVFIFQPTFSCDV

SEQ ID NO: 2401469 - protein, 19 aa, Entamoeba dispar
SFIRFLVMFTYYIAQFLLG

SEQ ID NO: 2401470 - protein, 18 aa, Entamoeba dispar
SFIRYWNNIKFTGNGYRT

SEQ ID NO: 2401471 - protein, 21 aa, Entamoeba dispar
SFKFIFSLFELLSIHPEQLNS

SEQ ID NO: 2401472 - protein, 24 aa, Entamoeba dispar
SFKKGIITLIIATSTLALGVNLPA

SEQ ID NO: 2401473 - protein, 24 aa, Entamoeba dispar
SFKKQNLLLLLLSNHYLNTLLTII

SEQ ID NO: 2401474 - protein, 24 aa, Entamoeba dispar
SFKNVQFIFYNGNSPTRIIGGVDE

SEQ ID NO: 2401475 - protein, 23 aa, Entamoeba dispar
SFKQPLCDVIIKVFPHIQSLLNG

SEQ ID NO: 2401476 - protein, 24 aa, Entamoeba dispar
SFKTYAWVEMSMFLKNLKIDERSE

SEQ ID NO: 2401477 - protein, 22 aa, Entamoeba dispar
SFKVYWEYIKAGLVFLGAACIV

SEQ ID NO: 2401478 - protein, 20 aa, Entamoeba dispar
SFLDIVIYRYLLNATFVYPT

SEQ ID NO: 2401479 - protein, 18 aa, Entamoeba dispar
SFLNGYFQLLNKIPTNYE

SEQ ID NO: 2401480 - protein, 20 aa, Entamoeba dispar
SFLYFMIFSVYDVKYIFTIW

SEQ ID NO: 2401481 - protein, 32 aa, Entamoeba dispar
SFNDSHKIFDLFWFFLGLVEKSIVAYLQTKRA

SEQ ID NO: 2401482 - protein, 25 aa, Entamoeba dispar
SFNLKVRLAYFKFLTKLLEGYDEFI

SEQ ID NO: 2401483 - protein, 24 aa, Entamoeba dispar
SFNTPYNTIFFYPISQGTVNNPIE

SEQ ID NO: 2401484 - protein, 31 aa, Entamoeba dispar
SFNYALIVFILPLVILFISLLFFCNVNGLFS

SEQ ID NO: 2401485 - protein, 17 aa, Entamoeba dispar
SFRCSTCNNRFTRFTDG

SEQ ID NO: 2401486 - protein, 24 aa, Entamoeba dispar
SFSLGKLFYIEALSLSTETVQFTE

SEQ ID NO: 2401487 - protein, 28 aa, Entamoeba dispar
SFSSQVICLCLIAVWFSQHRKCISGREQ

SEQ ID NO: 2401488 - protein, 24 aa, Entamoeba dispar
SFSTFNFYLLFHTASWIGLNCNNN

SEQ ID NO: 2401489 - protein, 23 aa, Entamoeba dispar
SFTHLIIGLLFYMYVLFDTLDGK

SEQ ID NO: 2401490 - protein, 21 aa, Entamoeba dispar
SFTLFNLFKSLLPTVFIGILV

SEQ ID NO: 2401491 - protein, 18 aa, Entamoeba dispar
SFVFYNFNKLLFAITLSI

SEQ ID NO: 2401492 - protein, 17 aa, Entamoeba dispar
SFVKLLVLPLYDASNTL

SEQ ID NO: 2401493 - protein, 23 aa, Entamoeba dispar
SFVLLIIMIIVCIVPVHLPSSHS

SEQ ID NO: 2401494 - protein, 23 aa, Entamoeba dispar
SFVLYFDGLIKLFSSINTSCISI

SEQ ID NO: 2401495 - protein, 25 aa, Entamoeba dispar
SFVMTRLLLGPILVEAIRIIKNYKE

SEQ ID NO: 2401496 - protein, 19 aa, Entamoeba dispar
SFVNIETNFRLELVKNSYS

SEQ ID NO: 2401497 - protein, 25 aa, Entamoeba dispar
SFVQIFLRVFLPCFIWGVGTAFGEI

SEQ ID NO: 2401498 - protein, 18 aa, Entamoeba dispar
SFVTPYQLPRYCQYNRGT

SEQ ID NO: 2401499 - protein, 38 aa, Entamoeba dispar
SFYAFVHLPIIWIMPIPLILFILMSISYYKAVRTKPGK

SEQ ID NO: 2401500 - protein, 17 aa, Entamoeba dispar
SFYPTFLFQVFMCYWMS

SEQ ID NO: 2401501 - protein, 24 aa, Entamoeba dispar
SGAWFFWSMAALIFTWFCMLHSGL

SEQ ID NO: 2401502 - protein, 28 aa, Entamoeba dispar
SGCFVQLFFFITMILVGILVIFFISVEH

SEQ ID NO: 2401503 - protein, 19 aa, Entamoeba dispar
SGCYVMMIGFMYLSSYPIT

SEQ ID NO: 2401504 - protein, 18 aa, Entamoeba dispar
SGDYYHPHWTCFSPDTES

SEQ ID NO: 2401505 - protein, 18 aa, Entamoeba dispar
SGEYLFGTPPSQPTLLTS

SEQ ID NO: 2401506 - protein, 21 aa, Entamoeba dispar
SGFFIYLIGSILIVGGIIGST

SEQ ID NO: 2401507 - protein, 26 aa, Entamoeba dispar
SGFIPLLIKILFLQIPLKKLVIQILG

SEQ ID NO: 2401508 - protein, 17 aa, Entamoeba dispar
SGFLLNNYAMIVGGALI

SEQ ID NO: 2401509 - protein, 32 aa, Entamoeba dispar
SGFREDIIPILRYILAPTPYSGLLTTTQVFLD

SEQ ID NO: 2401510 - protein, 24 aa, Entamoeba dispar
SGGEINWFYSFPGLYNQILPDSVC

SEQ ID NO: 2401511 - protein, 35 aa, Entamoeba dispar
SGIIGYLVVIFKLLKLLPHYKLRIPLRSFFVVFTL

SEQ ID NO: 2401512 - protein, 20 aa, Entamoeba dispar
SGILKLYDFVGDALALPFKL

SEQ ID NO: 2401513 - protein, 24 aa, Entamoeba dispar
SGITILSYLFLFIATQGCGALFQT

SEQ ID NO: 2401514 - protein, 23 aa, Entamoeba dispar
SGIVLFALIVIPLSLMGVAEQAI

SEQ ID NO: 2401515 - protein, 33 aa, Entamoeba dispar
SGLGFPLFIFLIKIIPLEQWYRLLQSTILVILV

SEQ ID NO: 2401516 - protein, 31 aa, Entamoeba dispar
SGLLSFLIPFKNFITTGIILFFIVLVTQYSN

SEQ ID NO: 2401517 - protein, 24 aa, Entamoeba dispar
SGLTRRVHFYLLGLNTKDQDVEKG

SEQ ID NO: 2401518 - protein, 26 aa, Entamoeba dispar
SGLYRMIRFMVINDIPFIEIIDTTGL

SEQ ID NO: 2401519 - protein, 24 aa, Entamoeba dispar
SGNAVFFNNLLFYGGTKISGGISN

SEQ ID NO: 2401520 - protein, 26 aa, Entamoeba dispar
SGQFNYYFFFITNILFFIVCLGQGLY

SEQ ID NO: 2401521 - protein, 28 aa, Entamoeba dispar
SGSPTRLCYWLSTILRLYAMIHLARFDP

SEQ ID NO: 2401522 - protein, 26 aa, Entamoeba dispar
SGTASDIFFIIYNLRKGLPVANHITP

SEQ ID NO: 2401523 - protein, 17 aa, Entamoeba dispar
SGTPLFLRNSGTDFVLA

SEQ ID NO: 2401524 - protein, 33 aa, Entamoeba dispar
SGTYCQKQPVVWFIVLICILGSIIVILIIAGVV

SEQ ID NO: 2401525 - protein, 43 aa, Entamoeba dispar
SGTYCQKQPVVWFIVLICILGSIIVILIIAGVVALSCIKPACI

SEQ ID NO: 2401526 - protein, 25 aa, Entamoeba dispar
SGYNQFDKYFIWNIGNSAEVILTDP

SEQ ID NO: 2401527 - protein, 23 aa, Entamoeba dispar
SGYYFGLLNIIFVSVSFGIAVLS

SEQ ID NO: 2401528 - protein, 20 aa, Entamoeba dispar
SGYYTLFMKADDLGRLLLNV

SEQ ID NO: 2401529 - protein, 25 aa, Entamoeba dispar
SHCFGPTYFIIFMSILFSISSIIVP

SEQ ID NO: 2401530 - protein, 27 aa, Entamoeba dispar
SHGAAIWLLVILLGLAGILYAVIGGLR

SEQ ID NO: 2401531 - protein, 24 aa, Entamoeba dispar
SHHLRLKILLDASKGIQYLHENEM

SEQ ID NO: 2401532 - protein, 24 aa, Entamoeba dispar
SHLFYDLIIPYDKTYCYPITLRNE

SEQ ID NO: 2401533 - protein, 25 aa, Entamoeba dispar
SHLLLERKFIFISESLQLLSSSVHT

SEQ ID NO: 2401534 - protein, 31 aa, Entamoeba dispar
SHLRKMMKTLLYPIYITIPMIRSQKFSSFPT

SEQ ID NO: 2401535 - protein, 29 aa, Entamoeba dispar
SHLVDSLYFSFLTYPITWAAVPGFVEITN

SEQ ID NO: 2401536 - protein, 24 aa, Entamoeba dispar
SHMMLERKFLFVSDYLMTLSNTIS

SEQ ID NO: 2401537 - protein, 30 aa, Entamoeba dispar
SHPKTFYYSSIIVHLFLYGVIAIISNQYVD

SEQ ID NO: 2401538 - protein, 27 aa, Entamoeba dispar
SHTLYRSILLFITQFYFAFFSGFSGTS

SEQ ID NO: 2401539 - protein, 20 aa, Entamoeba dispar
SHTPFLRKAIKERFYLFVEI

SEQ ID NO: 2401540 - protein, 25 aa, Entamoeba dispar
SHVVAVMFFFFISLTIIGGISMIIL

SEQ ID NO: 2401541 - protein, 26 aa, Entamoeba dispar
SIACQCHILFFSAIILVGITIIFTFS

SEQ ID NO: 2401542 - protein, 26 aa, Entamoeba dispar
SIAFFEKFHRYVLTHYPSIQNALNTI

SEQ ID NO: 2401543 - protein, 24 aa, Entamoeba dispar
SIAHPNCLFAMKNGSPLLIGIGDN

SEQ ID NO: 2401544 - protein, 33 aa, Entamoeba dispar
SIAIIVIVGVLLFILIKLYIKTRSRLNITGSGG

SEQ ID NO: 2401545 - protein, 32 aa, Entamoeba dispar
SIALSRIIDIFGILLILIVICLINGVPISSYL

SEQ ID NO: 2401546 - protein, 20 aa, Entamoeba dispar
SICLLLHCFISNSFILLALI

SEQ ID NO: 2401547 - protein, 38 aa, Entamoeba dispar
SICRYQKCYLFYTIIGLFVLFAYTGNILIPCDFINSKR

SEQ ID NO: 2401548 - protein, 26 aa, Entamoeba dispar
SIDIILFGMIILISLYLLISILSSKV

SEQ ID NO: 2401549 - protein, 18 aa, Entamoeba dispar
SIDLIISFMAKCTTLLNE

SEQ ID NO: 2401550 - protein, 49 aa, Entamoeba dispar
SIDLTVRLLARITLIYPLISMTTYLLKLLPLFIFTLFIQIVSTTPPHQA

SEQ ID NO: 2401551 - protein, 32 aa, Entamoeba dispar
SIDNLYCRMSFYDKDYIKLTSNFYFVITAEKL

SEQ ID NO: 2401552 - protein, 24 aa, Entamoeba dispar
SIDPLALLPFIVESLKQLAFQLNN

SEQ ID NO: 2401553 - protein, 20 aa, Entamoeba dispar
SIDPLSLLPFIVESLKELQI

SEQ ID NO: 2401554 - protein, 18 aa, Entamoeba dispar
SIDSFSFKIINKGTMLIS

SEQ ID NO: 2401555 - protein, 25 aa, Entamoeba dispar
SIEGAGFFLVNLLKGIKGSIFTIHN

SEQ ID NO: 2401556 - protein, 26 aa, Entamoeba dispar
SIEIKEKPYYIGYISFVEDDDQCSNH

SEQ ID NO: 2401557 - protein, 18 aa, Entamoeba dispar
SIEILWIITIIIVIIIYL

SEQ ID NO: 2401558 - protein, 25 aa, Entamoeba dispar
SIEKQRFAILPLYDNKKPIGNKTVS

SEQ ID NO: 2401559 - protein, 18 aa, Entamoeba dispar
SIFGFIEILLSIRLQKIF

SEQ ID NO: 2401560 - protein, 28 aa, Entamoeba dispar
SIFSAKIYLIYFWSLCKGLIVIFTIVLC

SEQ ID NO: 2401561 - protein, 35 aa, Entamoeba dispar
SIFSAKIYLIYFWSLCKGLIVIFTIVLCLPSLQTC

SEQ ID NO: 2401562 - protein, 22 aa, Entamoeba dispar
SIFSVPIIFLPSIKGILFAIFL

SEQ ID NO: 2401563 - protein, 23 aa, Entamoeba dispar
SIGFFIVGLIFQLLAETSMFVDA

SEQ ID NO: 2401564 - protein, 19 aa, Entamoeba dispar
SIGFSFVMIFISVAAAAAT

SEQ ID NO: 2401565 - protein, 18 aa, Entamoeba dispar
SIGIVVLLVIWRKTSMKS

SEQ ID NO: 2401566 - protein, 19 aa, Entamoeba dispar
SIGLTIIYSMGGMLGNLFV

SEQ ID NO: 2401567 - protein, 24 aa, Entamoeba dispar
SIGSLFFLIIIHLLLSFNNTNVAI

SEQ ID NO: 2401568 - protein, 20 aa, Entamoeba dispar
SIGYFMLKLLQLLFSHLPSL

SEQ ID NO: 2401569 - protein, 27 aa, Entamoeba dispar
SIIHSIIFILIYILYVCFIGYITKNKP

SEQ ID NO: 2401570 - protein, 18 aa, Entamoeba dispar
SIIIILPLLTLSSILKYG

SEQ ID NO: 2401571 - protein, 18 aa, Entamoeba dispar
SIIISYYIKQSIGGILFI

SEQ ID NO: 2401572 - protein, 40 aa, Entamoeba dispar
SIIKTRFINTIRVLVFYFNKLISIILDWARYTKYSIIDFY

SEQ ID NO: 2401573 - protein, 21 aa, Entamoeba dispar
SIILLILIPLSYKRIRIIPSI

SEQ ID NO: 2401574 - protein, 25 aa, Entamoeba dispar
SIIQLILFIVFVNRINGLSICYIPN

SEQ ID NO: 2401575 - protein, 28 aa, Entamoeba dispar
SIISIIIFFLISFITKSIFSVPIIFLPS

SEQ ID NO: 2401576 - protein, 18 aa, Entamoeba dispar
SIISLMEFFGLKSKGLET

SEQ ID NO: 2401577 - protein, 24 aa, Entamoeba dispar
SIIYLFFYLIFIFPIFILLFYFIL

SEQ ID NO: 2401578 - protein, 20 aa, Entamoeba dispar
SIKQLFVRPPKFAAATTFKL

SEQ ID NO: 2401579 - protein, 24 aa, Entamoeba dispar
SIKSHVLAGYRLPFPDFISPKMKN

SEQ ID NO: 2401580 - protein, 19 aa, Entamoeba dispar
SILCFFLSLILSSLIIIFV

SEQ ID NO: 2401581 - protein, 21 aa, Entamoeba dispar
SILFILVPVFMVLCVLIIVVI

SEQ ID NO: 2401582 - protein, 20 aa, Entamoeba dispar
SILIFFFYILVLCYVSNIIG

SEQ ID NO: 2401583 - protein, 17 aa, Entamoeba dispar
SILKVLASHDPGCYYHT

SEQ ID NO: 2401584 - protein, 25 aa, Entamoeba dispar
SILLTGKFRFGYVFGFTIIGSLAEY

SEQ ID NO: 2401585 - protein, 20 aa, Entamoeba dispar
SILQFFGYTFFFPAFFSGPS

SEQ ID NO: 2401586 - protein, 32 aa, Entamoeba dispar
SILSIINEVFLQLKLLWPLFNITNTTNDLFNC

SEQ ID NO: 2401587 - protein, 41 aa, Entamoeba dispar
SILSLISGYIIYSLPKLPGIWVYCWTLLLLCGQVRNSLSHI

SEQ ID NO: 2401588 - protein, 32 aa, Entamoeba dispar
SILVYVGVSFIILISMLIVSILLGIFILFMHR

SEQ ID NO: 2401589 - protein, 17 aa, Entamoeba dispar
SILWMMDDMPMFAFMML

SEQ ID NO: 2401590 - protein, 25 aa, Entamoeba dispar
SIMYCMEQFVINIPVPRVFALIHKT

SEQ ID NO: 2401591 - protein, 19 aa, Entamoeba dispar
SINKVCQLIPLIKKFKVVD

SEQ ID NO: 2401592 - protein, 26 aa, Entamoeba dispar
SINSYITNAWFYFGLVNTFKANKVIV

SEQ ID NO: 2401593 - protein, 22 aa, Entamoeba dispar
SIPVISWFFPFIGHTAICDMEG

SEQ ID NO: 2401594 - protein, 19 aa, Entamoeba dispar
SIPYLLEFLIVSFSGIFTE

SEQ ID NO: 2401595 - protein, 18 aa, Entamoeba dispar
SIQFEKLENLIYSVIFFI

SEQ ID NO: 2401596 - protein, 20 aa, Entamoeba dispar
SIQFQFIDSLIKILLEAFEF

SEQ ID NO: 2401597 - protein, 33 aa, Entamoeba dispar
SIQILINYAYFSLLLLHPVWDKSLFKIDTKIQC

SEQ ID NO: 2401598 - protein, 43 aa, Entamoeba dispar
SIQKYYYLYVIIIEILCFIVLTITFFLAFFLYRRSFKVTEVSE

SEQ ID NO: 2401599 - protein, 29 aa, Entamoeba dispar
SIQNALNTIFLQLLLFHCPSFAIKLESKR

SEQ ID NO: 2401600 - protein, 26 aa, Entamoeba dispar
SIQRDVLPLLYLFIGNGNASSVLHYI

SEQ ID NO: 2401601 - protein, 17 aa, Entamoeba dispar
SIQRKMIVLKSINFFVN

SEQ ID NO: 2401602 - protein, 30 aa, Entamoeba dispar
SIQSVLASLPLILPSFRQWKLKDMMEMIDA

SEQ ID NO: 2401603 - protein, 25 aa, Entamoeba dispar
SIQTILFGIFVFPIKVIMVIDTLLF

SEQ ID NO: 2401604 - protein, 27 aa, Entamoeba dispar
SIREETFKIILKWIKLKGSINQEEVEI

SEQ ID NO: 2401605 - protein, 33 aa, Entamoeba dispar
SIRLQKLFEKMKAFTLFLPHINKENLKELKIQC

SEQ ID NO: 2401606 - protein, 36 aa, Entamoeba dispar
SISIINIISSVLWRWLLGCMASDFPLYTTIETIHLI

SEQ ID NO: 2401607 - protein, 17 aa, Entamoeba dispar
SISNIIFPFVIQYNHYI

SEQ ID NO: 2401608 - protein, 26 aa, Entamoeba dispar
SITQAIYIVLYILFYSRSSVYTWEHI

SEQ ID NO: 2401609 - protein, 26 aa, Entamoeba dispar
SITVFSKKCFLLIQSIVKFITSALQA

SEQ ID NO: 2401610 - protein, 27 aa, Entamoeba dispar
SIVFSSFHIITFIALILFISLQPFYYF

SEQ ID NO: 2401611 - protein, 23 aa, Entamoeba dispar
SIVGGIFTTFQLFDAIVFESIHS

SEQ ID NO: 2401612 - protein, 20 aa, Entamoeba dispar
SIVIVVLIRKQIRQKRLRVI

SEQ ID NO: 2401613 - protein, 24 aa, Entamoeba dispar
SIVLPTLKALYKFLQYVNAEEFIS

SEQ ID NO: 2401614 - protein, 24 aa, Entamoeba dispar
SIYENLFTNLLIPLLDSIDKFIAL

SEQ ID NO: 2401615 - protein, 17 aa, Entamoeba dispar
SIYVFEVLVSLFKTMKQ

SEQ ID NO: 2401616 - protein, 28 aa, Entamoeba dispar
SKAHRNINILRIGFVASLLARSGAIVVC

SEQ ID NO: 2401617 - protein, 30 aa, Entamoeba dispar
SKAMSWYSKFLWKFKWIILAVVVLCCIILC

SEQ ID NO: 2401618 - protein, 19 aa, Entamoeba dispar
SKCIDLFDSNDYPIQVIFA

SEQ ID NO: 2401619 - protein, 19 aa, Entamoeba dispar
SKCIDLFDSNKYPIQVIFP

SEQ ID NO: 2401620 - protein, 25 aa, Entamoeba dispar
SKCVKCFDGYYLKNQQCIPEDKNCD

SEQ ID NO: 2401621 - protein, 29 aa, Entamoeba dispar
SKDKLLEYRRLLPILLNYGTGATPSIIKC

SEQ ID NO: 2401622 - protein, 26 aa, Entamoeba dispar
SKDQLLDILSLLQLIQLSFSQQWETI

SEQ ID NO: 2401623 - protein, 27 aa, Entamoeba dispar
SKEEYCIFINKLLQFLQINKIITNEIE

SEQ ID NO: 2401624 - protein, 24 aa, Entamoeba dispar
SKEIFNKMILYYIPQCWMEYRIIP

SEQ ID NO: 2401625 - protein, 22 aa, Entamoeba dispar
SKEIIAPMKIKFDTELTTRLDP

SEQ ID NO: 2401626 - protein, 32 aa, Entamoeba dispar
SKENRKRLDAITLMYLFTKCNYITTYDAALSE

SEQ ID NO: 2401627 - protein, 23 aa, Entamoeba dispar
SKEVENVFIHYLHAISNTDEYEK

SEQ ID NO: 2401628 - protein, 20 aa, Entamoeba dispar
SKFFKDPYLLKSNNLHVCLE

SEQ ID NO: 2401629 - protein, 24 aa, Entamoeba dispar
SKHYFIPHFGLLPSLNLLSIESLK

SEQ ID NO: 2401630 - protein, 36 aa, Entamoeba dispar
SKILKKIWFEALQDKTLIILIIAAIISLILAFVVPN

SEQ ID NO: 2401631 - protein, 23 aa, Entamoeba dispar
SKIWGKHELSFELKVKILDDLAI

SEQ ID NO: 2401632 - protein, 18 aa, Entamoeba dispar
SKIWGKQIINYQLKVKIL

SEQ ID NO: 2401633 - protein, 28 aa, Entamoeba dispar
SKIWGKQKISYQLKIKFLDDMAVALSYL

SEQ ID NO: 2401634 - protein, 24 aa, Entamoeba dispar
SKIYFMRRIYIVIGLIDLLDSFNF

SEQ ID NO: 2401635 - protein, 30 aa, Entamoeba dispar
SKKSFLIYIFALILLIIENLLRFIVHLYFP

SEQ ID NO: 2401636 - protein, 19 aa, Entamoeba dispar
SKLAIVVFSVLCGTLGLSQ

SEQ ID NO: 2401637 - protein, 18 aa, Entamoeba dispar
SKLGFEWLLKAAQQGNVK

SEQ ID NO: 2401638 - protein, 17 aa, Entamoeba dispar
SKLPVTFCNHKEIMWSC

SEQ ID NO: 2401639 - protein, 27 aa, Entamoeba dispar
SKLTKLKTLLLFIAIMVFASTLIIFLS

SEQ ID NO: 2401640 - protein, 21 aa, Entamoeba dispar
SKMPGFCFKIEAVKKILCYKH

SEQ ID NO: 2401641 - protein, 18 aa, Entamoeba dispar
SKMQPELIRFIFASMKMG

SEQ ID NO: 2401642 - protein, 30 aa, Entamoeba dispar
SKMTLTKPFLFGVKHYKDFYAIQQGVLIAL

SEQ ID NO: 2401643 - protein, 42 aa, Entamoeba dispar
SKNNLNIIIPVVVIIIIIIIVILIIIIVIVSWKSIHKKNTTK

SEQ ID NO: 2401644 - protein, 20 aa, Entamoeba dispar
SKQIPICRNLYRITVWDSFN

SEQ ID NO: 2401645 - protein, 21 aa, Entamoeba dispar
SKQLYGLYDLSFPIFSQQNAK

SEQ ID NO: 2401646 - protein, 24 aa, Entamoeba dispar
SKRKDMMIIFHTPNNPKYVFHFNP

SEQ ID NO: 2401647 - protein, 24 aa, Entamoeba dispar
SKSSSVIILLLYSILCIICNTNEP

SEQ ID NO: 2401648 - protein, 23 aa, Entamoeba dispar
SKTFFRGFNYAIGASLFICGILL

SEQ ID NO: 2401649 - protein, 25 aa, Entamoeba dispar
SKTLHKTICLIALINALKQSDIAQN

SEQ ID NO: 2401650 - protein, 18 aa, Entamoeba dispar
SKTSLFCLQCAENFYFVS

SEQ ID NO: 2401651 - protein, 23 aa, Entamoeba dispar
SKTTIFTVILLTAHSIFAHLSIV

SEQ ID NO: 2401652 - protein, 24 aa, Entamoeba dispar
SKTVFMLIMISLAVLFMVAGGMMI

SEQ ID NO: 2401653 - protein, 21 aa, Entamoeba dispar
SKVLFKVIGTVPYLGLIIYLM

SEQ ID NO: 2401654 - protein, 27 aa, Entamoeba dispar
SKYELTQVCRIYVALVPKGYTITECPK

SEQ ID NO: 2401655 - protein, 29 aa, Entamoeba dispar
SKYNISLYSKYFYLIQLQTKENIASIILK

SEQ ID NO: 2401656 - protein, 25 aa, Entamoeba dispar
SLAFRFSILLSFLYFMIFSVYDVKY

SEQ ID NO: 2401657 - protein, 20 aa, Entamoeba dispar
SLASFLDWLGQGIWQSLLLT

SEQ ID NO: 2401658 - protein, 33 aa, Entamoeba dispar
SLASIDSFFIKLPQWISFLLQDDSYKNVIENEK

SEQ ID NO: 2401659 - protein, 28 aa, Entamoeba dispar
SLAVQLVFLCYIIFSALPKFLFGSILQK

SEQ ID NO: 2401660 - protein, 26 aa, Entamoeba dispar
SLAVVQLVLFVLEKFIYCCKPQNIPD

SEQ ID NO: 2401661 - protein, 22 aa, Entamoeba dispar
SLCIIFGFSLLAIKRFNRKNYG

SEQ ID NO: 2401662 - protein, 18 aa, Entamoeba dispar
SLCLFLTNAFKLFSGKPR

SEQ ID NO: 2401663 - protein, 19 aa, Entamoeba dispar
SLEALLLLKDVPGLLQNGL

SEQ ID NO: 2401664 - protein, 28 aa, Entamoeba dispar
SLEKQFRNIWSYFFGYWKDPNTENFSTR

SEQ ID NO: 2401665 - protein, 24 aa, Entamoeba dispar
SLEVIISIVWLFCVVQWSAFAGLV

SEQ ID NO: 2401666 - protein, 19 aa, Entamoeba dispar
SLFCLQCAENFYFVSSNIC

SEQ ID NO: 2401667 - protein, 26 aa, Entamoeba dispar
SLFDILLFIFFLFISTSFYFYSFHLP

SEQ ID NO: 2401668 - protein, 22 aa, Entamoeba dispar
SLFFSHIIWFYTATLIVMGFYC

SEQ ID NO: 2401669 - protein, 30 aa, Entamoeba dispar
SLFFVSVMLLGIWFIFTSSSLYLFTSSFYS

SEQ ID NO: 2401670 - protein, 18 aa, Entamoeba dispar
SLFLFSYALYDTCQTAHE

SEQ ID NO: 2401671 - protein, 19 aa, Entamoeba dispar
SLFMIVILLPRDGVFTHIH

SEQ ID NO: 2401672 - protein, 23 aa, Entamoeba dispar
SLFYFFILCSFISYCFAFFSISF

SEQ ID NO: 2401673 - protein, 25 aa, Entamoeba dispar
SLGITNLWYYFIPNENRFFHVPFIS

SEQ ID NO: 2401674 - protein, 24 aa, Entamoeba dispar
SLGTRFFLQSFSMLKELFAPTEEF

SEQ ID NO: 2401675 - protein, 17 aa, Entamoeba dispar
SLHDYFIFVSATEKTQL

SEQ ID NO: 2401676 - protein, 18 aa, Entamoeba dispar
SLICLNINKLNVILKDLL

SEQ ID NO: 2401677 - protein, 24 aa, Entamoeba dispar
SLIENFTILRPFGTEMWDIEMINF

SEQ ID NO: 2401678 - protein, 18 aa, Entamoeba dispar
SLIFKRKELWEMFRFHRI

SEQ ID NO: 2401679 - protein, 20 aa, Entamoeba dispar
SLIGKEILWDVFLKKKNQKI

SEQ ID NO: 2401680 - protein, 25 aa, Entamoeba dispar
SLIIMIPALITYYFMKWKKSLHMAL

SEQ ID NO: 2401681 - protein, 22 aa, Entamoeba dispar
SLILPMYGIITLKGTFVNKKRI

SEQ ID NO: 2401682 - protein, 22 aa, Entamoeba dispar
SLILSIALINFLQTFPIIDNHT

SEQ ID NO: 2401683 - protein, 26 aa, Entamoeba dispar
SLILTIILMFIVFIAFIVYCSITIYT

SEQ ID NO: 2401684 - protein, 25 aa, Entamoeba dispar
SLISFKMLRSILFQAGYQLVITLAI

SEQ ID NO: 2401685 - protein, 19 aa, Entamoeba dispar
SLISFVLFPRMPRNRSGIT

SEQ ID NO: 2401686 - protein, 26 aa, Entamoeba dispar
SLITTLFFYLMSIVTAIWVLENMARS

SEQ ID NO: 2401687 - protein, 24 aa, Entamoeba dispar
SLIVLRQLLLGLSFNINIVGYLYH

SEQ ID NO: 2401688 - protein, 23 aa, Entamoeba dispar
SLKELYLIWKKGGYIGLIFDKIM

SEQ ID NO: 2401689 - protein, 22 aa, Entamoeba dispar
SLKHLVKVISDVFQFEDIWKHV

SEQ ID NO: 2401690 - protein, 18 aa, Entamoeba dispar
SLLEFFGYTFFFPGIFSG

SEQ ID NO: 2401691 - protein, 17 aa, Entamoeba dispar
SLLFFFFNLLYYSFHFS

SEQ ID NO: 2401692 - protein, 22 aa, Entamoeba dispar
SLLHILVYKYPNFTLPIYDSIE

SEQ ID NO: 2401693 - protein, 17 aa, Entamoeba dispar
SLLHLFGELNWWPRKRP

SEQ ID NO: 2401694 - protein, 18 aa, Entamoeba dispar
SLLLIFHSLCYIIKDPKG

SEQ ID NO: 2401695 - protein, 20 aa, Entamoeba dispar
SLLLPVFLMVFIPSNFLIFQ

SEQ ID NO: 2401696 - protein, 17 aa, Entamoeba dispar
SLLLQLIILICHLIRDI

SEQ ID NO: 2401697 - protein, 19 aa, Entamoeba dispar
SLLTIIRIFRYSSFYISSI

SEQ ID NO: 2401698 - protein, 18 aa, Entamoeba dispar
SLLTLKIIKFLLVSFICS

SEQ ID NO: 2401699 - protein, 18 aa, Entamoeba dispar
SLLVVSTLIFVIISKNKQ

SEQ ID NO: 2401700 - protein, 24 aa, Entamoeba dispar
SLNEPLYLFRVTSSDYIANNNITV

SEQ ID NO: 2401701 - protein, 29 aa, Entamoeba dispar
SLNIEHRNTLGRYLFLMNVIAINQRLNRM

SEQ ID NO: 2401702 - protein, 18 aa, Entamoeba dispar
SLNINKWIDLIFGYKSCG

SEQ ID NO: 2401703 - protein, 25 aa, Entamoeba dispar
SLNKKPLFIMFFDQQNYQTIFTRLT

SEQ ID NO: 2401704 - protein, 32 aa, Entamoeba dispar
SLNLKKPYRNIFKWAPLLALVNSLSNLSNFVV

SEQ ID NO: 2401705 - protein, 34 aa, Entamoeba dispar
SLNLKKPYRNIFKWAPLLALVNSLSYLLYFVVDA

SEQ ID NO: 2401706 - protein, 24 aa, Entamoeba dispar
SLNQPQIIIWKSDYIHLYKPAGSQ

SEQ ID NO: 2401707 - protein, 19 aa, Entamoeba dispar
SLPEDWFEFGLTLSKTPMF

SEQ ID NO: 2401708 - protein, 23 aa, Entamoeba dispar
SLPFFYYFIFLLLFKISVIDYLK

SEQ ID NO: 2401709 - protein, 17 aa, Entamoeba dispar
SLPIDVYAFAIVSYEVF

SEQ ID NO: 2401710 - protein, 18 aa, Entamoeba dispar
SLQEFFVKVLKTFESFSP

SEQ ID NO: 2401711 - protein, 27 aa, Entamoeba dispar
SLQIPYLTYIALLFFGTSYAFFLYKML

SEQ ID NO: 2401712 - protein, 38 aa, Entamoeba dispar
SLQKCILGLVALLIIFQAFVLIFIFTSGYVTLDNYQLS

SEQ ID NO: 2401713 - protein, 44 aa, Entamoeba dispar
SLRGKVINFILWFFYGIYQSLIFFFVFFWFISPSDIIGKDGLNG

SEQ ID NO: 2401714 - protein, 21 aa, Entamoeba dispar
SLRIQFGEFVYFTGGDLDGSQ

SEQ ID NO: 2401715 - protein, 28 aa, Entamoeba dispar
SLRMLYNMYLFTYIVILNSPRNDQILHF

SEQ ID NO: 2401716 - protein, 17 aa, Entamoeba dispar
SLSEILKLDLNGGWGDQ

SEQ ID NO: 2401717 - protein, 21 aa, Entamoeba dispar
SLSHLFFSTTSCILIVVDLSE

SEQ ID NO: 2401718 - protein, 23 aa, Entamoeba dispar
SLSLCCMPFIYKRSILSRYGCCY

SEQ ID NO: 2401719 - protein, 25 aa, Entamoeba dispar
SLSLFFLHFWRSCLIFIVLPSFYIF

SEQ ID NO: 2401720 - protein, 17 aa, Entamoeba dispar
SLSNYIYQISLSTNNYI

SEQ ID NO: 2401721 - protein, 20 aa, Entamoeba dispar
SLSNYYYQLSLSTNNYIIRN

SEQ ID NO: 2401722 - protein, 27 aa, Entamoeba dispar
SLSQYLDHPLYSSLFKLVKNYKSSFTE

SEQ ID NO: 2401723 - protein, 34 aa, Entamoeba dispar
SLSSGLIFVIYYFRMYFMMLIFGASHGLFFLPIL

SEQ ID NO: 2401724 - protein, 22 aa, Entamoeba dispar
SLTIIILSYFFISFNNIQFYKY

SEQ ID NO: 2401725 - protein, 26 aa, Entamoeba dispar
SLTNEFIELFIPLQIQRRVGEIGIVF

SEQ ID NO: 2401726 - protein, 26 aa, Entamoeba dispar
SLVFLPAWYVFGFYIIVTQLTVFITE

SEQ ID NO: 2401727 - protein, 27 aa, Entamoeba dispar
SLVFSLKQVFLILRHPPQDTLKKYANY

SEQ ID NO: 2401728 - protein, 22 aa, Entamoeba dispar
SLVIIRLFIHFVLSSDEYFQCF

SEQ ID NO: 2401729 - protein, 27 aa, Entamoeba dispar
SLVITLLTPLFYLFSYSKLLTLVSVYS

SEQ ID NO: 2401730 - protein, 34 aa, Entamoeba dispar
SLVTLMLELSPFMAFILYLVYIQIDYHLEVGKVF

SEQ ID NO: 2401731 - protein, 35 aa, Entamoeba dispar
SLVTLMLELSPFMAFILYLVYIQIDYHLEVGKVFT

SEQ ID NO: 2401732 - protein, 32 aa, Entamoeba dispar
SLVVSLVMMITGLPLLYSCIRIVMQVVPKRFD

SEQ ID NO: 2401733 - protein, 30 aa, Entamoeba dispar
SLYVAAILPLFVFIIFPRQPKYKNDETNPK

SEQ ID NO: 2401734 - protein, 20 aa, Entamoeba dispar
SLYVPPCRPLINLTYFIALM

SEQ ID NO: 2401735 - protein, 33 aa, Entamoeba dispar
SMIRLMFQDLPTNIIWFAFVTEPIVNLDIEIPT

SEQ ID NO: 2401736 - protein, 25 aa, Entamoeba dispar
SMKAIEIFFRFCELDLFKESKEILK

SEQ ID NO: 2401737 - protein, 19 aa, Entamoeba dispar
SMKCDIEPYIRPVIFVNET

SEQ ID NO: 2401738 - protein, 17 aa, Entamoeba dispar
SMKESPKQLIWRCLLNA

SEQ ID NO: 2401739 - protein, 29 aa, Entamoeba dispar
SMKLYPSQFIWFRHIYLAFSTYTKLNQLV

SEQ ID NO: 2401740 - protein, 35 aa, Entamoeba dispar
SMKSWYFEHSYLLVLLFFTILYDATYPFIYLYSGV

SEQ ID NO: 2401741 - protein, 28 aa, Entamoeba dispar
SMLSSVLYLLHLYLSYNPSKFDKLIPFV

SEQ ID NO: 2401742 - protein, 18 aa, Entamoeba dispar
SMNLIFLTLLQIYKYINY

SEQ ID NO: 2401743 - protein, 18 aa, Entamoeba dispar
SMRRSIVTQYKIIEKLGQ

SEQ ID NO: 2401744 - protein, 24 aa, Entamoeba dispar
SMSYVFYLMRQTIPKAHLVLFLAE

SEQ ID NO: 2401745 - protein, 19 aa, Entamoeba dispar
SMVLSFMRTFSLFVVSQRE

SEQ ID NO: 2401746 - protein, 17 aa, Entamoeba dispar
SMYKVLDQILLFQDDFI

SEQ ID NO: 2401747 - protein, 18 aa, Entamoeba dispar
SMYMKLFEMLCVVFPCYP

SEQ ID NO: 2401748 - protein, 24 aa, Entamoeba dispar
SNCNWLLCILSYIAGLSSGFANQT

SEQ ID NO: 2401749 - protein, 23 aa, Entamoeba dispar
SNDKKWFEYPQCPCLEENCTILI

SEQ ID NO: 2401750 - protein, 30 aa, Entamoeba dispar
SNEEFKYYFDSFYAVLPFSIDIINEGKDVI

SEQ ID NO: 2401751 - protein, 32 aa, Entamoeba dispar
SNEKQVSLLRRKKLFVWIEYKNKDVIGHRANV

SEQ ID NO: 2401752 - protein, 33 aa, Entamoeba dispar
SNEVKAYLVIFYALLIYFPQLPSTTIELYLNKT

SEQ ID NO: 2401753 - protein, 24 aa, Entamoeba dispar
SNEYLPLSLIILKQFYLCLKDKRY

SEQ ID NO: 2401754 - protein, 23 aa, Entamoeba dispar
SNFCVVKWLYSLAGQLFSQPNFI

SEQ ID NO: 2401755 - protein, 38 aa, Entamoeba dispar
SNGKVYFFSKCESKKKFLIVGGFFQQFEYSDDECKNVK

SEQ ID NO: 2401756 - protein, 25 aa, Entamoeba dispar
SNGNGIWYLISSYERTINQLTPKLS

SEQ ID NO: 2401757 - protein, 17 aa, Entamoeba dispar
SNGYRFGKGIYFANCAS

SEQ ID NO: 2401758 - protein, 23 aa, Entamoeba dispar
SNIFQFLTLYSCLSNILITGISP

SEQ ID NO: 2401759 - protein, 26 aa, Entamoeba dispar
SNIIDIRKYNLLFDSRFDLLDNRTFN

SEQ ID NO: 2401760 - protein, 22 aa, Entamoeba dispar
SNIVLLVYCEILWQYQGCFVLE

SEQ ID NO: 2401761 - protein, 23 aa, Entamoeba dispar
SNKEKIIFIGICNGNLIGLKETE

SEQ ID NO: 2401762 - protein, 30 aa, Entamoeba dispar
SNKKFILDKIDLVDPFFAYITLKAFKEPTE

SEQ ID NO: 2401763 - protein, 29 aa, Entamoeba dispar
SNKSLIDTYLSYYITLLNLSIERVFSSKK

SEQ ID NO: 2401764 - protein, 20 aa, Entamoeba dispar
SNKVFWLNCYIIILINAYLT

SEQ ID NO: 2401765 - protein, 27 aa, Entamoeba dispar
SNLCNFITTFFISFLPITPETSNFNIS

SEQ ID NO: 2401766 - protein, 60 aa, Entamoeba dispar
SNLTSPFIYNLFISLFNDLDALWKLWDYLLLSEDPCFFVFILVALFLLKEKMLGDSTEDI

SEQ ID NO: 2401767 - protein, 25 aa, Entamoeba dispar
SNPAWSLWSLLVIAVLWALPQSMTM

SEQ ID NO: 2401768 - protein, 21 aa, Entamoeba dispar
SNPILHWYYTRSVLFILCLCN

SEQ ID NO: 2401769 - protein, 18 aa, Entamoeba dispar
SNPRININFSKGKVYYIL

SEQ ID NO: 2401770 - protein, 26 aa, Entamoeba dispar
SNPSKLFSIPMLYQEYIRCLESIMFY

SEQ ID NO: 2401771 - protein, 17 aa, Entamoeba dispar
SNPYFTIDPPSIDFQEE

SEQ ID NO: 2401772 - protein, 23 aa, Entamoeba dispar
SNQAIFKIYRKKEPYQRIEFSLT

SEQ ID NO: 2401773 - protein, 30 aa, Entamoeba dispar
SNQITTFVFLGDRFILLESIPFVDGWIITN

SEQ ID NO: 2401774 - protein, 44 aa, Entamoeba dispar
SNRISIYILFGIVLIVSLFSISYYFYTLLKNKLLILFGNTMENK

SEQ ID NO: 2401775 - protein, 31 aa, Entamoeba dispar
SNSKRALIVIFIVLVLLACVVVGFVYFRRNK

SEQ ID NO: 2401776 - protein, 24 aa, Entamoeba dispar
SNSLALSTLILTKAILNNATLSEA

SEQ ID NO: 2401777 - protein, 25 aa, Entamoeba dispar
SNSYKGCLIGYFEEHKFSCITCSDG

SEQ ID NO: 2401778 - protein, 23 aa, Entamoeba dispar
SNTFILFIGLINGVNYTISFNAK

SEQ ID NO: 2401779 - protein, 26 aa, Entamoeba dispar
SNTIVFLLSLLYFSASVFHLLEGYNP

SEQ ID NO: 2401780 - protein, 23 aa, Entamoeba dispar
SNTLMTMYWLFKNQPQMCDTQTW

SEQ ID NO: 2401781 - protein, 26 aa, Entamoeba dispar
SNTSWDRWFCTFRLKNCFIDLMYAVL

SEQ ID NO: 2401782 - protein, 21 aa, Entamoeba dispar
SNVGLLWIPASIWQMLRGSMT

SEQ ID NO: 2401783 - protein, 20 aa, Entamoeba dispar
SNYFIWLIPYFIGTVLRCIA

SEQ ID NO: 2401784 - protein, 26 aa, Entamoeba dispar
SNYITLGFDYWDYSKARVSGKIKLFI

SEQ ID NO: 2401785 - protein, 17 aa, Entamoeba dispar
SNYLIFPLLLQQFGNDQ

SEQ ID NO: 2401786 - protein, 22 aa, Entamoeba dispar
SNYNIIFNFLKSELPKAKNRDS

SEQ ID NO: 2401787 - protein, 33 aa, Entamoeba dispar
SNYSYIYSLIIKYKLMNILLDIFFNFNHNCTIF

SEQ ID NO: 2401788 - protein, 17 aa, Entamoeba dispar
SNYSYPVDIYAYGIVLY

SEQ ID NO: 2401789 - protein, 40 aa, Entamoeba dispar
SPDFEQRWWRLTLIFFLLGFCCFPFWIPSFVLSRKSSQRT

SEQ ID NO: 2401790 - protein, 40 aa, Entamoeba dispar
SPDFEQRWWRLTLIFFLLGFCFFPFWIPSFILSQKSSQRT

SEQ ID NO: 2401791 - protein, 33 aa, Entamoeba dispar
SPDLFLPIHQPIRTILLKLLPSFISYIGIEPIH

SEQ ID NO: 2401792 - protein, 34 aa, Entamoeba dispar
SPEISGNYLQILYLLFFWVFKNLSHQTLSDLIRK

SEQ ID NO: 2401793 - protein, 21 aa, Entamoeba dispar
SPELLYYLYELFGNELVKGIS

SEQ ID NO: 2401794 - protein, 26 aa, Entamoeba dispar
SPIAGGLLVMYLISLNEPMIPVEHTK

SEQ ID NO: 2401795 - protein, 19 aa, Entamoeba dispar
SPINRFFDFQFTSLPHYEH

SEQ ID NO: 2401796 - protein, 17 aa, Entamoeba dispar
SPISTPKIKINCGLLAI

SEQ ID NO: 2401797 - protein, 23 aa, Entamoeba dispar
SPKLQLHLLSLVKLLMKGSDITH

SEQ ID NO: 2401798 - protein, 25 aa, Entamoeba dispar
SPKLQLHLLSLVKLLVRLSDITQPE

SEQ ID NO: 2401799 - protein, 21 aa, Entamoeba dispar
SPKPHTFLFPGVTLFDTAVDV

SEQ ID NO: 2401800 - protein, 23 aa, Entamoeba dispar
SPLFMQWDYWILPETKIEFVGER

SEQ ID NO: 2401801 - protein, 20 aa, Entamoeba dispar
SPLMPKFKELNEKLGSPEEV

SEQ ID NO: 2401802 - protein, 21 aa, Entamoeba dispar
SPLSKIIVGILSGIFVIAFCI

SEQ ID NO: 2401803 - protein, 20 aa, Entamoeba dispar
SPLTEILMYDLKLPSEIIKN

SEQ ID NO: 2401804 - protein, 35 aa, Entamoeba dispar
SPMYSDRFIMDPIALAGILIFIFIGGEGMERISGL

SEQ ID NO: 2401805 - protein, 22 aa, Entamoeba dispar
SPNNSHWFGLKKVSFAETKEKE

SEQ ID NO: 2401806 - protein, 29 aa, Entamoeba dispar
SPNSIVKFFRILFFRTSMPQLLKGRKGNL

SEQ ID NO: 2401807 - protein, 19 aa, Entamoeba dispar
SPPRFECWWLVRVIPHIFL

SEQ ID NO: 2401808 - protein, 25 aa, Entamoeba dispar
SPQLREFLFSCFKRDPNQRASSRDL

SEQ ID NO: 2401809 - protein, 50 aa, Entamoeba dispar
SPQSLLVRQLKYWGTLVIVYWIFFFILLFILILLYIKLTKKIKQEIDDEK

SEQ ID NO: 2401810 - protein, 21 aa, Entamoeba dispar
SPRNSLYLYNGRSPNLQTSQT

SEQ ID NO: 2401811 - protein, 18 aa, Entamoeba dispar
SPVALINAPYIYGKWFKL

SEQ ID NO: 2401812 - protein, 24 aa, Entamoeba dispar
SPVFPFPIINYILPPVVDFTQYAI

SEQ ID NO: 2401813 - protein, 41 aa, Entamoeba dispar
SPYQENLLPFTFPVKYFFVFYKQRKLFVPTILRSIQHFGTK

SEQ ID NO: 2401814 - protein, 30 aa, Entamoeba dispar
SQCSSPYQILKYPLSEEFTFDPNSKNPGIC

SEQ ID NO: 2401815 - protein, 27 aa, Entamoeba dispar
SQDLGMCLPFIENLAHQLKCNVVGYDY

SEQ ID NO: 2401816 - protein, 23 aa, Entamoeba dispar
SQDYVPYQAFLFDAMLVASHGIQ

SEQ ID NO: 2401817 - protein, 26 aa, Entamoeba dispar
SQFCKTNLIAFYKFGTKFVMKRLFLN

SEQ ID NO: 2401818 - protein, 25 aa, Entamoeba dispar
SQGGIIPILFFLASIVLIISPRLLF

SEQ ID NO: 2401819 - protein, 27 aa, Entamoeba dispar
SQGQRLDFPKTFPPGICELIKKCWAHD

SEQ ID NO: 2401820 - protein, 24 aa, Entamoeba dispar
SQIAALMFPLISYAIEEKSYFENS

SEQ ID NO: 2401821 - protein, 32 aa, Entamoeba dispar
SQIKPHFVTLSFYKIFGFPMGIGALLMRKDVV

SEQ ID NO: 2401822 - protein, 21 aa, Entamoeba dispar
SQLFYQSLFDIFQPMPISLIE

SEQ ID NO: 2401823 - protein, 27 aa, Entamoeba dispar
SQNNSWTILLWIVVGCIICAGLVMVIV

SEQ ID NO: 2401824 - protein, 31 aa, Entamoeba dispar
SQNPFPTALSRQLFLLLGGVETLIVAIGIRN

SEQ ID NO: 2401825 - protein, 28 aa, Entamoeba dispar
SQPSTLNLPPLMKFIINDLYSSYNPRKP

SEQ ID NO: 2401826 - protein, 38 aa, Entamoeba dispar
SQRSAMLLYLRLYATLFILFILSVFSLHYFLIVCFSLW

SEQ ID NO: 2401827 - protein, 24 aa, Entamoeba dispar
SQSKFKHLIGQQPQLLFKTHPKRK

SEQ ID NO: 2401828 - protein, 24 aa, Entamoeba dispar
SQTGEFKIIISTKGKIKGTETKNL

SEQ ID NO: 2401829 - protein, 28 aa, Entamoeba dispar
SQTKLISFLMYVLYSLGYSFVVRKPTKV

SEQ ID NO: 2401830 - protein, 27 aa, Entamoeba dispar
SRCYSILLTIAYFKILLAYINDIASTR

SEQ ID NO: 2401831 - protein, 18 aa, Entamoeba dispar
SRDIVFISIGSLLGLVMC

SEQ ID NO: 2401832 - protein, 24 aa, Entamoeba dispar
SREQNVFFKWIFNQVNMDYSIKRL

SEQ ID NO: 2401833 - protein, 31 aa, Entamoeba dispar
SRGYSAVTLIPLLLDIRLWRGVEYLFEYYIK

SEQ ID NO: 2401834 - protein, 23 aa, Entamoeba dispar
SRKLSSLSFLPLGHVFAIVMEFI

SEQ ID NO: 2401835 - protein, 20 aa, Entamoeba dispar
SRLFFFVGFGSLFTLSCFFV

SEQ ID NO: 2401836 - protein, 22 aa, Entamoeba dispar
SRNKYMMIIVHTPDNPKYVFHF

SEQ ID NO: 2401837 - protein, 17 aa, Entamoeba dispar
SRPIDISKYSLIYASAQ

SEQ ID NO: 2401838 - protein, 29 aa, Entamoeba dispar
SRPKSTTLYLPPRYPLLGGWKTSFEVNYN

SEQ ID NO: 2401839 - protein, 50 aa, Entamoeba dispar
SRSQGMINFIYWGIGSIVYALYYIFSLIFFLLLYVRLTKKIKQEIDEENM

SEQ ID NO: 2401840 - protein, 25 aa, Entamoeba dispar
SRTRQYFFLDYLLDKQFSSLAYFWE

SEQ ID NO: 2401841 - protein, 23 aa, Entamoeba dispar
SRTTKFLITSVNKGSLLLLNLVD

SEQ ID NO: 2401842 - protein, 21 aa, Entamoeba dispar
SRVPSVHLSWYKTLSEKQGER

SEQ ID NO: 2401843 - protein, 20 aa, Entamoeba dispar
SRYFQYPRTITIDRFEIPEM

SEQ ID NO: 2401844 - protein, 25 aa, Entamoeba dispar
SSADLPKFPAIFKGVEFSTNEVVKI

SEQ ID NO: 2401845 - protein, 27 aa, Entamoeba dispar
SSAITYKIDKLWKSVSFDKAFEGDIIN

SEQ ID NO: 2401846 - protein, 26 aa, Entamoeba dispar
SSARSLYAAALWYLDDWNEFDSIVSE

SEQ ID NO: 2401847 - protein, 47 aa, Entamoeba dispar
SSATRLKRAMWWKNIKLYLIAGAILLIFLLVLLWAGCGITFSRCIPD

SEQ ID NO: 2401848 - protein, 26 aa, Entamoeba dispar
SSDDLYFYIFVDLNGWIDHFIDKFKP

SEQ ID NO: 2401849 - protein, 24 aa, Entamoeba dispar
SSDEYFQCFIPFISILIGNIFPSL

SEQ ID NO: 2401850 - protein, 22 aa, Entamoeba dispar
SSDSFFGKKFIFVARTQNGEWK

SEQ ID NO: 2401851 - protein, 22 aa, Entamoeba dispar
SSEARYLFPEKIHYVPTIIQRL

SEQ ID NO: 2401852 - protein, 26 aa, Entamoeba dispar
SSELLLPFNLPILSPLYYIIQSIESS

SEQ ID NO: 2401853 - protein, 17 aa, Entamoeba dispar
SSFALFQRWSDQYLLFE

SEQ ID NO: 2401854 - protein, 20 aa, Entamoeba dispar
SSFMLPCAVVMLFIQIFADC

SEQ ID NO: 2401855 - protein, 20 aa, Entamoeba dispar
SSFYLIIFNTRSSYVFEKGL

SEQ ID NO: 2401856 - protein, 29 aa, Entamoeba dispar
SSGKSTLLNYLFNTKFRILNEVMGRSRTT

SEQ ID NO: 2401857 - protein, 24 aa, Entamoeba dispar
SSHAQFWCCFLVLFCYYTNQQSKL

SEQ ID NO: 2401858 - protein, 24 aa, Entamoeba dispar
SSHFYYVFIVFLVLFFGNMTFALT

SEQ ID NO: 2401859 - protein, 30 aa, Entamoeba dispar
SSIALDFCAILTWIFKRYRDTFIGLIEQEN

SEQ ID NO: 2401860 - protein, 18 aa, Entamoeba dispar
SSIFILFQNKLINEWFIK

SEQ ID NO: 2401861 - protein, 38 aa, Entamoeba dispar
SSIGILQIFFIIVSLVALLLCFFVMLLSFTSNVHENSW

SEQ ID NO: 2401862 - protein, 24 aa, Entamoeba dispar
SSIINIPTLLFSLGQLIIGGVSRG

SEQ ID NO: 2401863 - protein, 30 aa, Entamoeba dispar
SSIITIIIPIIFPSMYFLMGLTVILCIILW

SEQ ID NO: 2401864 - protein, 49 aa, Entamoeba dispar
SSISRGITNFLFWGIGSIIYIIFYILLLLLVLFIYYNLTKQIKQEIDDE

SEQ ID NO: 2401865 - protein, 24 aa, Entamoeba dispar
SSITNPMVLFYTRLRRVNVDKQCD

SEQ ID NO: 2401866 - protein, 25 aa, Entamoeba dispar
SSKIIAIKDIAFTLPPLFSNDHAKT

SEQ ID NO: 2401867 - protein, 32 aa, Entamoeba dispar
SSKKKNFYFDSFKAILPFKFIIDQSTVKTQII

SEQ ID NO: 2401868 - protein, 21 aa, Entamoeba dispar
SSKPIITFSGTVTLSSLIVDT

SEQ ID NO: 2401869 - protein, 25 aa, Entamoeba dispar
SSKSYVLLGLLFAITMSTSSILILV

SEQ ID NO: 2401870 - protein, 17 aa, Entamoeba dispar
SSKVVLLYYQKKEFRIP

SEQ ID NO: 2401871 - protein, 51 aa, Entamoeba dispar
SSKWSIELYFLDLNLMFWIAISMTIALIILGIIMLVLFIRDKKKEAESHFL

SEQ ID NO: 2401872 - protein, 27 aa, Entamoeba dispar
SSKYERLLQYLQLKSIIDLLGKVYFSF

SEQ ID NO: 2401873 - protein, 24 aa, Entamoeba dispar
SSLDQLLIFFIIGTLIFTSTNYTY

SEQ ID NO: 2401874 - protein, 20 aa, Entamoeba dispar
SSLGCLYYLHNSYGCAICKN

SEQ ID NO: 2401875 - protein, 20 aa, Entamoeba dispar
SSLHISLYFPSAKSAMMSLM

SEQ ID NO: 2401876 - protein, 25 aa, Entamoeba dispar
SSLKNIRLERLFYLKSIQGLKQCDL

SEQ ID NO: 2401877 - protein, 24 aa, Entamoeba dispar
SSLLIRLIPFVRIFELFIIDILYA

SEQ ID NO: 2401878 - protein, 20 aa, Entamoeba dispar
SSLMTEFQIFFTKVKHPCSN

SEQ ID NO: 2401879 - protein, 20 aa, Entamoeba dispar
SSLRLLTIDDCPLKKLKLSL

SEQ ID NO: 2401880 - protein, 26 aa, Entamoeba dispar
SSLTVLIDYFILAVTIIVAAVPEGLP

SEQ ID NO: 2401881 - protein, 36 aa, Entamoeba dispar
SSLVTLMLELSPFMAFILYLVYIQIDYHLEVGKVFT

SEQ ID NO: 2401882 - protein, 19 aa, Entamoeba dispar
SSLYRYEGGIYKSESCTGQ

SEQ ID NO: 2401883 - protein, 25 aa, Entamoeba dispar
SSMNVPSVLLPYPTKQHPIDYTIEA

SEQ ID NO: 2401884 - protein, 23 aa, Entamoeba dispar
SSNNGIWYLISSYEGSINKITST

SEQ ID NO: 2401885 - protein, 29 aa, Entamoeba dispar
SSNQNFWFVVIIIFLLTVILFLIASILLH

SEQ ID NO: 2401886 - protein, 26 aa, Entamoeba dispar
SSNRGLIIKSLLIILFFALVFLVFFL

SEQ ID NO: 2401887 - protein, 31 aa, Entamoeba dispar
SSNSLILRSLALVWLLFQECNYVIVIDKQKR

SEQ ID NO: 2401888 - protein, 42 aa, Entamoeba dispar
SSPNAILLFRAIVSTIKIIIPLLPLLPEKLFDNSIPRVFTIF

SEQ ID NO: 2401889 - protein, 22 aa, Entamoeba dispar
SSQEIIYILEHLQPPLNKTLVE

SEQ ID NO: 2401890 - protein, 28 aa, Entamoeba dispar
SSQTIQVSILYIVLIMKVVDKKDKKEDI

SEQ ID NO: 2401891 - protein, 24 aa, Entamoeba dispar
SSRDLLKHKWFITNGIKIEESKKP

SEQ ID NO: 2401892 - protein, 17 aa, Entamoeba dispar
SSRFWPYFSNVTLFSIF

SEQ ID NO: 2401893 - protein, 23 aa, Entamoeba dispar
SSRLKLIIQSHYPVIIKYDKYNQ

SEQ ID NO: 2401894 - protein, 22 aa, Entamoeba dispar
SSSRYYLMILSVFELRISSIML

SEQ ID NO: 2401895 - protein, 22 aa, Entamoeba dispar
SSSVFYLFLDRLYIPYYSVLPK

SEQ ID NO: 2401896 - protein, 22 aa, Entamoeba dispar
SSTFLIMFALCAVVVLISTIPT

SEQ ID NO: 2401897 - protein, 28 aa, Entamoeba dispar
SSTMEYLRTIPFFTPLIDKIWPKDDNKD

SEQ ID NO: 2401898 - protein, 25 aa, Entamoeba dispar
SSTNTMLKLPFSDGIRYLISSYEGT

SEQ ID NO: 2401899 - protein, 37 aa, Entamoeba dispar
SSVHGIHYFMIGIVSIIVFIINYTILRVLVSLDNKYY

SEQ ID NO: 2401900 - protein, 21 aa, Entamoeba dispar
SSVHGLWYTFVGDGRAIVADT

SEQ ID NO: 2401901 - protein, 45 aa, Entamoeba dispar
SSVHTFSRLIYPFIWQHVLIPILPPDMLSLAFAPMPFIIGCTYST

SEQ ID NO: 2401902 - protein, 20 aa, Entamoeba dispar
SSVLIWILRATGFIAYFVFF

SEQ ID NO: 2401903 - protein, 28 aa, Entamoeba dispar
SSVPKLIKYLQLIPPISFPLNQKDYPNL

SEQ ID NO: 2401904 - protein, 21 aa, Entamoeba dispar
SSVTMILWKYPLSKFGECSIV

SEQ ID NO: 2401905 - protein, 39 aa, Entamoeba dispar
SSVYTWEHILIIIPPIFVLFILIPLSLSSMTLIRYVDKD

SEQ ID NO: 2401906 - protein, 18 aa, Entamoeba dispar
SSWLLSLPEDWFEFGLTL

SEQ ID NO: 2401907 - protein, 23 aa, Entamoeba dispar
SSYHAWRYIALTGNASLIPAIDT

SEQ ID NO: 2401908 - protein, 26 aa, Entamoeba dispar
SSYSLHFILHLMHSLHVILLVDEEFF

SEQ ID NO: 2401909 - protein, 18 aa, Entamoeba dispar
STALKWLCYATNSNIKNA

SEQ ID NO: 2401910 - protein, 23 aa, Entamoeba dispar
STASFWLVQVISPFVLPLFEKCY

SEQ ID NO: 2401911 - protein, 18 aa, Entamoeba dispar
STCFLYSTPLRLNQDFKE

SEQ ID NO: 2401912 - protein, 19 aa, Entamoeba dispar
STCLTCFGGYYLTNNGNEC

SEQ ID NO: 2401913 - protein, 27 aa, Entamoeba dispar
STDAHISWLTLNYPDCLYNGSLYTLTV

SEQ ID NO: 2401914 - protein, 32 aa, Entamoeba dispar
STDLKRTMWWKNMKLWFIIGGVVAIIVIVIII

SEQ ID NO: 2401915 - protein, 25 aa, Entamoeba dispar
STDQNTIVLLYYDTPHLFGEMYSEF

SEQ ID NO: 2401916 - protein, 52 aa, Entamoeba dispar
STETKEFPMYMIAVIVIFFLVLVVVAILFIVYIVHVYLVRKRNLKVFEEGEE

SEQ ID NO: 2401917 - protein, 23 aa, Entamoeba dispar
STFILCYLLFLTLYIASLFIVSK

SEQ ID NO: 2401918 - protein, 27 aa, Entamoeba dispar
STFPLFYNWFNFLIAIIMTYLASSLKS

SEQ ID NO: 2401919 - protein, 25 aa, Entamoeba dispar
STHPSPIFALHWTNPITLTLPQNTI

SEQ ID NO: 2401920 - protein, 19 aa, Entamoeba dispar
STHTSCYFPLPSFSQIFQG

SEQ ID NO: 2401921 - protein, 19 aa, Entamoeba dispar
STIILFFSMSMYIEGKKNK

SEQ ID NO: 2401922 - protein, 21 aa, Entamoeba dispar
STILFWSYMLAIISLTVDIII

SEQ ID NO: 2401923 - protein, 19 aa, Entamoeba dispar
STIQLIPIFNSSAIKEEIK

SEQ ID NO: 2401924 - protein, 20 aa, Entamoeba dispar
STIVLFYLQPFISLNIREME

SEQ ID NO: 2401925 - protein, 22 aa, Entamoeba dispar
STKDRFKLIYSLVSNSSYDYMG

SEQ ID NO: 2401926 - protein, 24 aa, Entamoeba dispar
STLCSFAVYLLIGLFGYFSLTPNI

SEQ ID NO: 2401927 - protein, 24 aa, Entamoeba dispar
STLMILIASAFVSLFLALVMPKSQ

SEQ ID NO: 2401928 - protein, 25 aa, Entamoeba dispar
STLQSIWLYFIKLSRIDCNTLTSEN

SEQ ID NO: 2401929 - protein, 20 aa, Entamoeba dispar
STMKSWLEKEIPTRIEIFLI

SEQ ID NO: 2401930 - protein, 17 aa, Entamoeba dispar
STNPVISRYKYIDLCVL

SEQ ID NO: 2401931 - protein, 27 aa, Entamoeba dispar
STNSGSLRILFINYGILSITKGIGTII

SEQ ID NO: 2401932 - protein, 18 aa, Entamoeba dispar
STPSFPLELSKNTLLFGG

SEQ ID NO: 2401933 - protein, 18 aa, Entamoeba dispar
STPSILYAISFKGKIISK

SEQ ID NO: 2401934 - protein, 41 aa, Entamoeba dispar
STQIIQHLPKVFLLFCVYSWTTFVFSYFTSFNPLFTSDNIY

SEQ ID NO: 2401935 - protein, 23 aa, Entamoeba dispar
STQYQMVYIPPQTLNKHIARKIS

SEQ ID NO: 2401936 - protein, 24 aa, Entamoeba dispar
STRLAIICFLIVLTWYCCYGVALY

SEQ ID NO: 2401937 - protein, 23 aa, Entamoeba dispar
STRLTPLLYQIAIESSFNIIRNT

SEQ ID NO: 2401938 - protein, 26 aa, Entamoeba dispar
STSLMNTLLMIIPDKGFKYTQERAIE

SEQ ID NO: 2401939 - protein, 22 aa, Entamoeba dispar
STSRLAWCVLIISIILFAFSVV

SEQ ID NO: 2401940 - protein, 26 aa, Entamoeba dispar
STSSILILVIFFTNNSIIIPLTEKVP

SEQ ID NO: 2401941 - protein, 23 aa, Entamoeba dispar
STSYSVRFFLSTYLSPLHIDWLE

SEQ ID NO: 2401942 - protein, 21 aa, Entamoeba dispar
STTKWFYPCGKFGILLGIFLP

SEQ ID NO: 2401943 - protein, 25 aa, Entamoeba dispar
STVAFLIIRNYLCSFDEIISETSFG

SEQ ID NO: 2401944 - protein, 31 aa, Entamoeba dispar
STWQEGKWLLLYLIIFLFSILSNGVTIIKEL

SEQ ID NO: 2401945 - protein, 19 aa, Entamoeba dispar
SVAFGKLIDFVLPEKEGKT

SEQ ID NO: 2401946 - protein, 25 aa, Entamoeba dispar
SVCFLFVSLFSPLLFFVDKKAERLV

SEQ ID NO: 2401947 - protein, 35 aa, Entamoeba dispar
SVDQRLRIIQSCPFFPLILKLILQESFALVLEEPQ

SEQ ID NO: 2401948 - protein, 24 aa, Entamoeba dispar
SVERGYFRFVIFSVIMEAANMMML

SEQ ID NO: 2401949 - protein, 24 aa, Entamoeba dispar
SVFGEFYFLFRLDSQTTLHFLSKS

SEQ ID NO: 2401950 - protein, 28 aa, Entamoeba dispar
SVFITTALIYGILLLLNAIVKPKNGWDY

SEQ ID NO: 2401951 - protein, 28 aa, Entamoeba dispar
SVFLFTLLCHIIVRLVPWLHIFSESIVS

SEQ ID NO: 2401952 - protein, 17 aa, Entamoeba dispar
SVFLLKAVSIMNEQPSA

SEQ ID NO: 2401953 - protein, 29 aa, Entamoeba dispar
SVFQILQHTLSFLPFLVLGIIEAKVAIER

SEQ ID NO: 2401954 - protein, 19 aa, Entamoeba dispar
SVIFCGILAFLLFLKQSHS

SEQ ID NO: 2401955 - protein, 21 aa, Entamoeba dispar
SVIIFLILSLLLQNDLIISHY

SEQ ID NO: 2401956 - protein, 28 aa, Entamoeba dispar
SVILSVLNLLFYLMNICCMSARTIILKL

SEQ ID NO: 2401957 - protein, 25 aa, Entamoeba dispar
SVIPPLRNLLINDIKLLLPLSSFIP

SEQ ID NO: 2401958 - protein, 19 aa, Entamoeba dispar
SVIQLFHSFISKSITGPTI

SEQ ID NO: 2401959 - protein, 26 aa, Entamoeba dispar
SVIQRSFVYEIFLSSLPLLSLKNQAL

SEQ ID NO: 2401960 - protein, 17 aa, Entamoeba dispar
SVKHCIFPIKDGKFFFL

SEQ ID NO: 2401961 - protein, 27 aa, Entamoeba dispar
SVKIGRMKFRPSRPHFVELISFEDQNI

SEQ ID NO: 2401962 - protein, 23 aa, Entamoeba dispar
SVKIPRQYIIKVDLLFQSCCNKE

SEQ ID NO: 2401963 - protein, 20 aa, Entamoeba dispar
SVKKCIINFPKPVHHLHLTN

SEQ ID NO: 2401964 - protein, 24 aa, Entamoeba dispar
SVKTLKLRIYKELGPFNKNGVILF

SEQ ID NO: 2401965 - protein, 26 aa, Entamoeba dispar
SVLAVIIIIIAIIVLVVGIIKYRTYK

SEQ ID NO: 2401966 - protein, 25 aa, Entamoeba dispar
SVLCHLLYIWTLLAPALFPNRNFSK

SEQ ID NO: 2401967 - protein, 17 aa, Entamoeba dispar
SVLFTLFVLSPFVIFCC

SEQ ID NO: 2401968 - protein, 21 aa, Entamoeba dispar
SVLMYLISIIVLRPTFEPSFV

SEQ ID NO: 2401969 - protein, 23 aa, Entamoeba dispar
SVLTLIAAFITTASIIGKLIYAA

SEQ ID NO: 2401970 - protein, 37 aa, Entamoeba dispar
SVLYSISIAIIFLIYLMLQIFLFKRHNKFIVEYLLEA

SEQ ID NO: 2401971 - protein, 19 aa, Entamoeba dispar
SVMKITLGTTLIGAIIIIA

SEQ ID NO: 2401972 - protein, 19 aa, Entamoeba dispar
SVMVSLFFWAVVTVLCFYD

SEQ ID NO: 2401973 - protein, 31 aa, Entamoeba dispar
SVNKKYSVFYYLTMQPWRNLEWTSIDSNFPN

SEQ ID NO: 2401974 - protein, 23 aa, Entamoeba dispar
SVNPFLFRIGFTSVSPNARTFVL

SEQ ID NO: 2401975 - protein, 26 aa, Entamoeba dispar
SVSAYYLSLLYTEYLHLSARLGRNNY

SEQ ID NO: 2401976 - protein, 45 aa, Entamoeba dispar
SVSCEYKYLNNIIFISCFIGIYTLLYIILLVVTLIKFNKISKVMK

SEQ ID NO: 2401977 - protein, 27 aa, Entamoeba dispar
SVSLAFIMFIYLIILSLWNIFSFVSNE

SEQ ID NO: 2401978 - protein, 23 aa, Entamoeba dispar
SVSLLLLLCYLFQKLPLSQFILQ

SEQ ID NO: 2401979 - protein, 23 aa, Entamoeba dispar
SVSSSRYIILKNSKINVQSITGS

SEQ ID NO: 2401980 - protein, 33 aa, Entamoeba dispar
SVTLKIWDMFLLEGFVWLVKVSSALLLIHSDIF

SEQ ID NO: 2401981 - protein, 17 aa, Entamoeba dispar
SVTLKNSITLRTNEIRN

SEQ ID NO: 2401982 - protein, 17 aa, Entamoeba dispar
SVTPNKLPLVGDSFYLI

SEQ ID NO: 2401983 - protein, 19 aa, Entamoeba dispar
SVYDLYYFVIYTLYNKTES

SEQ ID NO: 2401984 - protein, 27 aa, Entamoeba dispar
SVYQLMPNYQWWNDTILIFNGTSYPAS

SEQ ID NO: 2401985 - protein, 19 aa, Entamoeba dispar
SVYQRFKIIKELNTFSFGL

SEQ ID NO: 2401986 - protein, 28 aa, Entamoeba dispar
SVYSCYILPFLFFLGFVYSLGSLYINGI

SEQ ID NO: 2401987 - protein, 20 aa, Entamoeba dispar
SVYWSLPIILIFVSLKYGSN

SEQ ID NO: 2401988 - protein, 22 aa, Entamoeba dispar
SVYYFLKRIISYNCLPSFLTTL

SEQ ID NO: 2401989 - protein, 23 aa, Entamoeba dispar
SWFSLLPIDSYPDDILSFLFTIF

SEQ ID NO: 2401990 - protein, 23 aa, Entamoeba dispar
SWIFPTLFVVIFGPLLTAIPMWN

SEQ ID NO: 2401991 - protein, 19 aa, Entamoeba dispar
SWKIYQTCLYLSYNKEPQF

SEQ ID NO: 2401992 - protein, 19 aa, Entamoeba dispar
SWPIMLRFAYQIASGMASL

SEQ ID NO: 2401993 - protein, 21 aa, Entamoeba dispar
SWVSTIFVPLIVFNTYIQLRI

SEQ ID NO: 2401994 - protein, 19 aa, Entamoeba dispar
SYALIFLIGCIFFVAIFLS

SEQ ID NO: 2401995 - protein, 17 aa, Entamoeba dispar
SYCGPNQYSLKGAISCL

SEQ ID NO: 2401996 - protein, 18 aa, Entamoeba dispar
SYCISCDSGYFLTTVGTC

SEQ ID NO: 2401997 - protein, 24 aa, Entamoeba dispar
SYCLMIWIRLGGNGPFEVINYSWK

SEQ ID NO: 2401998 - protein, 36 aa, Entamoeba dispar
SYDIEYLVKWGLTVCVIILVVLIRHYNCYENKIKYD

SEQ ID NO: 2401999 - protein, 22 aa, Entamoeba dispar
SYDKLVQFDLIPSGSASIIQSS

SEQ ID NO: 2402000 - protein, 25 aa, Entamoeba dispar
SYDVKVLINIILRYQGIKLSGSKKT

SEQ ID NO: 2402001 - protein, 21 aa, Entamoeba dispar
SYFGPLYILFVLVVCICLHAN

SEQ ID NO: 2402002 - protein, 27 aa, Entamoeba dispar
SYFNGDISSLAWYFNQLTPNGVPTLLL

SEQ ID NO: 2402003 - protein, 19 aa, Entamoeba dispar
SYGFLISAYIDELIDHIDI

SEQ ID NO: 2402004 - protein, 25 aa, Entamoeba dispar
SYGNYLPQLLHLAASLLFVSNDESM

SEQ ID NO: 2402005 - protein, 19 aa, Entamoeba dispar
SYHNLTIGETYFMFICSWK

SEQ ID NO: 2402006 - protein, 17 aa, Entamoeba dispar
SYIFCKEIEIPIIQNIM

SEQ ID NO: 2402007 - protein, 24 aa, Entamoeba dispar
SYIIWALILYYIPGLYMLYTYMLS

SEQ ID NO: 2402008 - protein, 33 aa, Entamoeba dispar
SYKIEYITFFLVIVYFVYFFIGKSSNSSVVTEY

SEQ ID NO: 2402009 - protein, 27 aa, Entamoeba dispar
SYKNGHGFWYQFTAKKDKIYINTCNKF

SEQ ID NO: 2402010 - protein, 27 aa, Entamoeba dispar
SYKYCYSCKSGYYLFDGQCIRIPYCQE

SEQ ID NO: 2402011 - protein, 22 aa, Entamoeba dispar
SYLFQTQMTLAINYIKTMLTTS

SEQ ID NO: 2402012 - protein, 20 aa, Entamoeba dispar
SYLLLLSMFVINIYLNYFHH

SEQ ID NO: 2402013 - protein, 19 aa, Entamoeba dispar
SYLYCIDFLFKTRYFLIGV

SEQ ID NO: 2402014 - protein, 23 aa, Entamoeba dispar
SYPCYVHVFCTKGFYSVFKKMIK

SEQ ID NO: 2402015 - protein, 19 aa, Entamoeba dispar
SYPLTLLKSCSFGYSADVV

SEQ ID NO: 2402016 - protein, 24 aa, Entamoeba dispar
SYSITMLEIITWQDPFPKTSYPHP

SEQ ID NO: 2402017 - protein, 32 aa, Entamoeba dispar
SYSITMLEIITWQNPFPKEIYNFPWDIADAIT

SEQ ID NO: 2402018 - protein, 29 aa, Entamoeba dispar
SYSITMLEIITWQNPFPKEIYNFPWDIAE

SEQ ID NO: 2402019 - protein, 35 aa, Entamoeba dispar
SYSITMLQIITWEDPFPKTLYPHPWDIADTITTGK

SEQ ID NO: 2402020 - protein, 35 aa, Entamoeba dispar
SYSITMLQIITWEDPFPKTLYPHPWDIANTISTGK

SEQ ID NO: 2402021 - protein, 26 aa, Entamoeba dispar
SYSITMLQIITWKEPFPKTEFKFPWK

SEQ ID NO: 2402022 - protein, 33 aa, Entamoeba dispar
SYSITMLQIITWQDPFPKTLYPHPWDIANTIST

SEQ ID NO: 2402023 - protein, 30 aa, Entamoeba dispar
SYSLVIKKYPFLTLFFQAIGSMICCFDALL

SEQ ID NO: 2402024 - protein, 22 aa, Entamoeba dispar
SYTKRPFLYTLIVDIICFVLYL

SEQ ID NO: 2402025 - protein, 29 aa, Entamoeba dispar
SYTSPILQTFILNGKLTLYKTTYAHIISN

SEQ ID NO: 2402026 - protein, 22 aa, Entamoeba dispar
SYVMVLMIVAFYFDIPLPIRHP

SEQ ID NO: 2402027 - protein, 20 aa, Entamoeba dispar
SYVPLSFFELIIQATKLNPK

SEQ ID NO: 2402028 - protein, 28 aa, Entamoeba dispar
SYVPPFLLILLFSFFKKSSKFLCYSLFC

SEQ ID NO: 2402029 - protein, 27 aa, Entamoeba dispar
SYVSSMSWYILIFAGGRYIIRLFDLND

SEQ ID NO: 2402030 - protein, 17 aa, Entamoeba dispar
SYYGLWYENNYEGEYSI

SEQ ID NO: 2402031 - protein, 33 aa, Entamoeba dispar
SYYILKRHLYSQKGVWYRVSLSTPQTLIIDTCF

SEQ ID NO: 2402032 - protein, 20 aa, Entamoeba dispar
SYYLNHSYTFLGPDIVCKKL

SEQ ID NO: 2402033 - protein, 47 aa, Entamoeba dispar
TACNSHIEVWLIIFCVIILLIIIIVIIVLLIYIIKRVLGYRKEEELR

SEQ ID NO: 2402034 - protein, 46 aa, Entamoeba dispar
TACNSHIEVWLIIICVIVLLIIIIVIIVLLIYIIKRVLGYRKEEEL

SEQ ID NO: 2402035 - protein, 24 aa, Entamoeba dispar
TAFCLFSIIIYYAGKMYAHRSSTE

SEQ ID NO: 2402036 - protein, 21 aa, Entamoeba dispar
TAHYYSHSTLFFKPSTEELLT

SEQ ID NO: 2402037 - protein, 23 aa, Entamoeba dispar
TAHYYSHSTLFFKPSTEELLTPL

SEQ ID NO: 2402038 - protein, 19 aa, Entamoeba dispar
TAIILFFVGMILEGFPGYH

SEQ ID NO: 2402039 - protein, 17 aa, Entamoeba dispar
TAISFSWLLQYAEQNGV

SEQ ID NO: 2402040 - protein, 21 aa, Entamoeba dispar
TAKLALYWTTALLIALCSFIT

SEQ ID NO: 2402041 - protein, 20 aa, Entamoeba dispar
TALMLTVVISFILFAGAVFS

SEQ ID NO: 2402042 - protein, 29 aa, Entamoeba dispar
TALQVLGFLLLTFGLFIYTGVIKLNFFGI

SEQ ID NO: 2402043 - protein, 18 aa, Entamoeba dispar
TALTLTWVFGISTVIFTS

SEQ ID NO: 2402044 - protein, 36 aa, Entamoeba dispar
TAPQTISWLFIFRIVPMLVIFMICLARAVIPLCYGL

SEQ ID NO: 2402045 - protein, 18 aa, Entamoeba dispar
TAQWTSEDISLKLKVRML

SEQ ID NO: 2402046 - protein, 24 aa, Entamoeba dispar
TASGDYYYPYWTCFSPDTESTCGF

SEQ ID NO: 2402047 - protein, 29 aa, Entamoeba dispar
TASQYIKFFEWFFFDYYENVLFAGVDANG

SEQ ID NO: 2402048 - protein, 37 aa, Entamoeba dispar
TATLSILFVVFILLILLWFMMHFMLAVQSIGPAVFAK

SEQ ID NO: 2402049 - protein, 25 aa, Entamoeba dispar
TCAFIPILIVLILIHGFAIIAPCLS

SEQ ID NO: 2402050 - protein, 24 aa, Entamoeba dispar
TCEGITDILFTKVQKISLMFGSIK

SEQ ID NO: 2402051 - protein, 20 aa, Entamoeba dispar
TCGFPIVLNTTFMNYKSING

SEQ ID NO: 2402052 - protein, 23 aa, Entamoeba dispar
TCGGMVRYFSYKNIAIHDITTEC

SEQ ID NO: 2402053 - protein, 28 aa, Entamoeba dispar
TCGTIKSLKFLLYDITLSKQSSQTNCEL

SEQ ID NO: 2402054 - protein, 32 aa, Entamoeba dispar
TCIFNMKYSNIQFFLCKTIKGIELNKQCIAYD

SEQ ID NO: 2402055 - protein, 33 aa, Entamoeba dispar
TCMTNTYYPLFLSYIRFIIREKTEFLFQSNSRL

SEQ ID NO: 2402056 - protein, 20 aa, Entamoeba dispar
TCNEGYYIKDHSCIRCSIQS

SEQ ID NO: 2402057 - protein, 17 aa, Entamoeba dispar
TCPPPPPPPCRGKDCDH

SEQ ID NO: 2402058 - protein, 23 aa, Entamoeba dispar
TCSFIVMERFDLLKNIIIKTVNE

SEQ ID NO: 2402059 - protein, 22 aa, Entamoeba dispar
TCSKKIILLCNSPSELYQCPTQ

SEQ ID NO: 2402060 - protein, 27 aa, Entamoeba dispar
TCSPNLIFKILLFTMKFNGNYSIRIDS

SEQ ID NO: 2402061 - protein, 18 aa, Entamoeba dispar
TCSSCISGFMLQENTCIS

SEQ ID NO: 2402062 - protein, 27 aa, Entamoeba dispar
TCTRSLPIKLIPFTRTIDIPDAWPTQT

SEQ ID NO: 2402063 - protein, 29 aa, Entamoeba dispar
TCVNYVYQYLLKQFTLLSEFLFDDQIKGI

SEQ ID NO: 2402064 - protein, 25 aa, Entamoeba dispar
TCWAFSSIFQLEYAYNKNLSNKYIS

SEQ ID NO: 2402065 - protein, 31 aa, Entamoeba dispar
TCYPETIIAPRIYYKIYINTCNKFTTVTTSI

SEQ ID NO: 2402066 - protein, 18 aa, Entamoeba dispar
TDEWILPSDLTVSKSIDC

SEQ ID NO: 2402067 - protein, 18 aa, Entamoeba dispar
TDFDKFLFIKYVKKNRIP

SEQ ID NO: 2402068 - protein, 18 aa, Entamoeba dispar
TDGLLFFRAFSGYKGILV

SEQ ID NO: 2402069 - protein, 25 aa, Entamoeba dispar
TDKNWHGVLFYYFNDSDCFEIYNIC

SEQ ID NO: 2402070 - protein, 25 aa, Entamoeba dispar
TDNNSFKFYSLCGGLVISDLPEDQV

SEQ ID NO: 2402071 - protein, 25 aa, Entamoeba dispar
TDPVYRYFMKSLLPSQKQPNGRYFD

SEQ ID NO: 2402072 - protein, 25 aa, Entamoeba dispar
TDTHLCLLVILYQTIQMYCFKISEP

SEQ ID NO: 2402073 - protein, 17 aa, Entamoeba dispar
TDYFAHIQYFKPISEEP

SEQ ID NO: 2402074 - protein, 26 aa, Entamoeba dispar
TDYINLAPMQVKLLWLCLCNVLSSSS

SEQ ID NO: 2402075 - protein, 28 aa, Entamoeba dispar
TDYPSVFSIPSFFNNKQLDILYNSMTAL

SEQ ID NO: 2402076 - protein, 24 aa, Entamoeba dispar
TEAKFWIHSFASDSIRIIFKQPNQ

SEQ ID NO: 2402077 - protein, 19 aa, Entamoeba dispar
TECFICSDGFYLTNNGGEC

SEQ ID NO: 2402078 - protein, 33 aa, Entamoeba dispar
TEDFKEVFVWKVFYTSLIWVLKNIDKETLLLYF

SEQ ID NO: 2402079 - protein, 24 aa, Entamoeba dispar
TEEHPEFILITKFLKNVNGIKEVI

SEQ ID NO: 2402080 - protein, 25 aa, Entamoeba dispar
TEEYQPFPLSYLEGPYPLQHPYYCG

SEQ ID NO: 2402081 - protein, 17 aa, Entamoeba dispar
TEFCNIMKLLHAEITPF

SEQ ID NO: 2402082 - protein, 19 aa, Entamoeba dispar
TEHCFIFFFDLADNKYKQI

SEQ ID NO: 2402083 - protein, 35 aa, Entamoeba dispar
TEIALLLNSVIFFYILSPLPLYSYKQVVISELVKL

SEQ ID NO: 2402084 - protein, 43 aa, Entamoeba dispar
TEIIANYDLIILPLYSALPLYKQKRVFFKTPEYARKIVISTNI

SEQ ID NO: 2402085 - protein, 23 aa, Entamoeba dispar
TEIYIVISILLFIISFNQIKKVS

SEQ ID NO: 2402086 - protein, 31 aa, Entamoeba dispar
TELILSPNGVFLDTLFSLLLTSFIGIGYEEA

SEQ ID NO: 2402087 - protein, 20 aa, Entamoeba dispar
TELKPIMPPIGEGAFGMVFR

SEQ ID NO: 2402088 - protein, 20 aa, Entamoeba dispar
TELKPVMPPIGEGAFGLVFR

SEQ ID NO: 2402089 - protein, 23 aa, Entamoeba dispar
TENIEFPMYFVDSRGLHGFDNTS

SEQ ID NO: 2402090 - protein, 25 aa, Entamoeba dispar
TENQTLFSFFQSIFFTFQTTFDPSL

SEQ ID NO: 2402091 - protein, 44 aa, Entamoeba dispar
TEPEYLIITPKRKGMITIYLTLFCTIKLLGMKIPSTVYFSQRKN

SEQ ID NO: 2402092 - protein, 19 aa, Entamoeba dispar
TEPPFIPIVVLIKQELIKI

SEQ ID NO: 2402093 - protein, 25 aa, Entamoeba dispar
TERIRKFHLYLPLQAESTLSTKLDY

SEQ ID NO: 2402094 - protein, 24 aa, Entamoeba dispar
TESQELCFRLLKILELKKESERSA

SEQ ID NO: 2402095 - protein, 22 aa, Entamoeba dispar
TETLMTLLSKEGIILGSTSSEK

SEQ ID NO: 2402096 - protein, 21 aa, Entamoeba dispar
TEVIILPPLLIPNQEIAHDGR

SEQ ID NO: 2402097 - protein, 24 aa, Entamoeba dispar
TEVYMMYFPLIFYYIIGNRIIETG

SEQ ID NO: 2402098 - protein, 17 aa, Entamoeba dispar
TEYFTLKKDIYGFVADH

SEQ ID NO: 2402099 - protein, 17 aa, Entamoeba dispar
TFAFANESLVFTALTDD

SEQ ID NO: 2402100 - protein, 19 aa, Entamoeba dispar
TFAILAFFIATLITKEFYA

SEQ ID NO: 2402101 - protein, 23 aa, Entamoeba dispar
TFAILMTFIFMKLIPFPQAHYIN

SEQ ID NO: 2402102 - protein, 17 aa, Entamoeba dispar
TFCGIIMAVAFSGLFLA

SEQ ID NO: 2402103 - protein, 19 aa, Entamoeba dispar
TFDFAILEEIPLTKEYLNT

SEQ ID NO: 2402104 - protein, 21 aa, Entamoeba dispar
TFDGKWWPQSFMSFFTMAPFI

SEQ ID NO: 2402105 - protein, 27 aa, Entamoeba dispar
TFDTLSTTLLPFISPFTMTPIELTVTR

SEQ ID NO: 2402106 - protein, 17 aa, Entamoeba dispar
TFECVLGSVLFIFAFGH

SEQ ID NO: 2402107 - protein, 46 aa, Entamoeba dispar
TFEPSFVFSLGFWWRVAIITLINSFPFILKFIYELLNPPKHMTVGH

SEQ ID NO: 2402108 - protein, 17 aa, Entamoeba dispar
TFEVHFNFSIFSSKPIM

SEQ ID NO: 2402109 - protein, 24 aa, Entamoeba dispar
TFFCVFKFRYILFILLSILLQLGA

SEQ ID NO: 2402110 - protein, 17 aa, Entamoeba dispar
TFFFIFIFYFDVFYYLN

SEQ ID NO: 2402111 - protein, 17 aa, Entamoeba dispar
TFFIVSFDPKDAYVKSY

SEQ ID NO: 2402112 - protein, 18 aa, Entamoeba dispar
TFFVMAVVPLINFLLLLL

SEQ ID NO: 2402113 - protein, 20 aa, Entamoeba dispar
TFFYFHYLFNLWGNWKELFK

SEQ ID NO: 2402114 - protein, 19 aa, Entamoeba dispar
TFGIKWLRLLFSREFPLDL

SEQ ID NO: 2402115 - protein, 18 aa, Entamoeba dispar
TFGYNILGFQTYIKYIFD

SEQ ID NO: 2402116 - protein, 18 aa, Entamoeba dispar
TFILVFINILISTIYLFD

SEQ ID NO: 2402117 - protein, 35 aa, Entamoeba dispar
TFIPGVVLYCFVWVVVFIIFLRKHKRLTKMIEIEQ

SEQ ID NO: 2402118 - protein, 28 aa, Entamoeba dispar
TFITIFVGFAIWAMITLAILIGMESLSS

SEQ ID NO: 2402119 - protein, 24 aa, Entamoeba dispar
TFIVFGCYVLIFFLGFFLFIKYSA

SEQ ID NO: 2402120 - protein, 17 aa, Entamoeba dispar
TFIVFVLSKLFSLLPPF

SEQ ID NO: 2402121 - protein, 25 aa, Entamoeba dispar
TFIYYHYQYLELLWILFCVTWAISN

SEQ ID NO: 2402122 - protein, 22 aa, Entamoeba dispar
TFKIIVLLYVACGWCLFTIVRI

SEQ ID NO: 2402123 - protein, 31 aa, Entamoeba dispar
TFLNNCTRELWRSACSLLDYIKGIMRKPTCN

SEQ ID NO: 2402124 - protein, 28 aa, Entamoeba dispar
TFLSCLLPTIFPFVSFVAVLQNSFIGFS

SEQ ID NO: 2402125 - protein, 18 aa, Entamoeba dispar
TFLSFPSHPLLLTSDRSV

SEQ ID NO: 2402126 - protein, 26 aa, Entamoeba dispar
TFPSAFLEVTGYPWVFVSSYDQKHPL

SEQ ID NO: 2402127 - protein, 18 aa, Entamoeba dispar
TFQWTMIITYSLDFSLQD

SEQ ID NO: 2402128 - protein, 20 aa, Entamoeba dispar
TFSCFAIPCKFGLTPSSTEL

SEQ ID NO: 2402129 - protein, 25 aa, Entamoeba dispar
TFSNLLFQLLFFVFYLIEVIDELNQ

SEQ ID NO: 2402130 - protein, 23 aa, Entamoeba dispar
TFTCFLLYGWTLIYMLFTYSEIR

SEQ ID NO: 2402131 - protein, 20 aa, Entamoeba dispar
TFTIQLFSHSINIYLISFDS

SEQ ID NO: 2402132 - protein, 25 aa, Entamoeba dispar
TFTLSSNLFVPHYITGSAGSSITIK

SEQ ID NO: 2402133 - protein, 23 aa, Entamoeba dispar
TFTLYLVAFIAFGVFILIPRYNK

SEQ ID NO: 2402134 - protein, 27 aa, Entamoeba dispar
TFTSLFTFHLILLSIFSTTLFPEKINT

SEQ ID NO: 2402135 - protein, 17 aa, Entamoeba dispar
TFTSTNAYRFIVPNRAQ

SEQ ID NO: 2402136 - protein, 39 aa, Entamoeba dispar
TFVKVICYLNRKTLPYIPQILSLYLKLFKTCTINVRPAL

SEQ ID NO: 2402137 - protein, 25 aa, Entamoeba dispar
TFVQIFILGQMFIHLLFIGTVTSSD

SEQ ID NO: 2402138 - protein, 26 aa, Entamoeba dispar
TFVYALFRLYVFPIYIIRAGLIAINY

SEQ ID NO: 2402139 - protein, 20 aa, Entamoeba dispar
TFWGMYQTLNLSKYQLRCCF

SEQ ID NO: 2402140 - protein, 20 aa, Entamoeba dispar
TFYFLFLLCIYIYYICTYVL

SEQ ID NO: 2402141 - protein, 22 aa, Entamoeba dispar
TGAFFLGGWYEDNGADYSRLIY

SEQ ID NO: 2402142 - protein, 24 aa, Entamoeba dispar
TGAKLDLLNSLRDLALAKTKEGST

SEQ ID NO: 2402143 - protein, 26 aa, Entamoeba dispar
TGCEIAFIVIICLADTTLLIVLIVFG

SEQ ID NO: 2402144 - protein, 17 aa, Entamoeba dispar
TGFDRSSIRRSEASRFL

SEQ ID NO: 2402145 - protein, 18 aa, Entamoeba dispar
TGFILLNRNLPFVVIVEQ

SEQ ID NO: 2402146 - protein, 24 aa, Entamoeba dispar
TGGILTYYKWFSIGDNKTQLYDYD

SEQ ID NO: 2402147 - protein, 26 aa, Entamoeba dispar
TGGQLTIRVWQISALLTLATGYEKRF

SEQ ID NO: 2402148 - protein, 29 aa, Entamoeba dispar
TGGVFVIIAILLFILTRVSPRFVLYFVFY

SEQ ID NO: 2402149 - protein, 30 aa, Entamoeba dispar
TGILVHFSLYILTIFILIGFIIGEVYNNFV

SEQ ID NO: 2402150 - protein, 18 aa, Entamoeba dispar
TGLKYYLEAYVFKDILKN

SEQ ID NO: 2402151 - protein, 28 aa, Entamoeba dispar
TGLLSLIYLFWLIFAIIRSFSEARKLGE

SEQ ID NO: 2402152 - protein, 24 aa, Entamoeba dispar
TGLMSACFLVYMLDSLNAHEAIDF

SEQ ID NO: 2402153 - protein, 23 aa, Entamoeba dispar
TGLQGIILTLNFNVDRFSANTQQ

SEQ ID NO: 2402154 - protein, 24 aa, Entamoeba dispar
TGNINILFVMYQLASVLSSTFMVK

SEQ ID NO: 2402155 - protein, 24 aa, Entamoeba dispar
TGNTLSILTNLPATVTFKSSLDYF

SEQ ID NO: 2402156 - protein, 24 aa, Entamoeba dispar
TGPEQWAILMVTKPIVLTTRFLNI

SEQ ID NO: 2402157 - protein, 17 aa, Entamoeba dispar
TGPFLNFAINKSALTKM

SEQ ID NO: 2402158 - protein, 23 aa, Entamoeba dispar
TGSKTLLVIMRLPKENEIKVEEY

SEQ ID NO: 2402159 - protein, 24 aa, Entamoeba dispar
TGVYWLCQNGFINDLLKLFIISEN

SEQ ID NO: 2402160 - protein, 18 aa, Entamoeba dispar
TGYLITFCGIIMAVAFSG

SEQ ID NO: 2402161 - protein, 17 aa, Entamoeba dispar
TGYLYFLFVGVNEQYSA

SEQ ID NO: 2402162 - protein, 23 aa, Entamoeba dispar
TGYSMLYKPLISLNKKQQEKIKA

SEQ ID NO: 2402163 - protein, 30 aa, Entamoeba dispar
THGYALHFIVIIILWTFLWTVCHSNRLNFH

SEQ ID NO: 2402164 - protein, 21 aa, Entamoeba dispar
THQFYYFFCVMLLIAVCNPYL

SEQ ID NO: 2402165 - protein, 32 aa, Entamoeba dispar
THYNPAFVMPLFRKTIIRLLTELQFINDLKTD

SEQ ID NO: 2402166 - protein, 29 aa, Entamoeba dispar
THYYTYCLLHFFLYIGMIFCNYNYFNECF

SEQ ID NO: 2402167 - protein, 25 aa, Entamoeba dispar
TIACSSRFPIVLVPAFMSSSLHIKS

SEQ ID NO: 2402168 - protein, 17 aa, Entamoeba dispar
TIAFAIDGSSYSQCSSP

SEQ ID NO: 2402169 - protein, 23 aa, Entamoeba dispar
TICDILLLRNNQIIEWNKEVVVE

SEQ ID NO: 2402170 - protein, 17 aa, Entamoeba dispar
TICIYILNIIGDLTTIG

SEQ ID NO: 2402171 - protein, 25 aa, Entamoeba dispar
TICYFTYSYIYRKGEKWYLPDTDNV

SEQ ID NO: 2402172 - protein, 23 aa, Entamoeba dispar
TIDFFIPLICIILLCLKNHYISG

SEQ ID NO: 2402173 - protein, 23 aa, Entamoeba dispar
TIDTKEDIFLTSIKSNTGSIIFT

SEQ ID NO: 2402174 - protein, 25 aa, Entamoeba dispar
TIEDELSMFFYYGTLHQMSVSYQEL

SEQ ID NO: 2402175 - protein, 17 aa, Entamoeba dispar
TIEFFGDSYYYLYDDDR

SEQ ID NO: 2402176 - protein, 22 aa, Entamoeba dispar
TIEGLPLYCDYDLFLERIRKTQ

SEQ ID NO: 2402177 - protein, 18 aa, Entamoeba dispar
TIENIILIKPGTTSILIK

SEQ ID NO: 2402178 - protein, 35 aa, Entamoeba dispar
TIETYCTLWMILSMITFVLFGIVLTCCMFLSTRLE

SEQ ID NO: 2402179 - protein, 17 aa, Entamoeba dispar
TIFLPKLSPTNSPQGHD

SEQ ID NO: 2402180 - protein, 19 aa, Entamoeba dispar
TIFNNFLTGNFIPYGVLIY

SEQ ID NO: 2402181 - protein, 17 aa, Entamoeba dispar
TIFQRWIFDLFNEKRIL

SEQ ID NO: 2402182 - protein, 17 aa, Entamoeba dispar
TIFYIFPESATILCYQK

SEQ ID NO: 2402183 - protein, 23 aa, Entamoeba dispar
TIGFNCQVISSVPFYLKEKTVGS

SEQ ID NO: 2402184 - protein, 23 aa, Entamoeba dispar
TIGGLQLFFSERFTSILYQSTES

SEQ ID NO: 2402185 - protein, 25 aa, Entamoeba dispar
TIIGVILMLLKWVRDPLFIRTDWSI

SEQ ID NO: 2402186 - protein, 18 aa, Entamoeba dispar
TIIIIISIFILLLIAFFI

SEQ ID NO: 2402187 - protein, 17 aa, Entamoeba dispar
TIIIPFYNSINNSVLYN

SEQ ID NO: 2402188 - protein, 32 aa, Entamoeba dispar
TIILIVIGIGIVIYYGYIHFAQKKETINIKHQ

SEQ ID NO: 2402189 - protein, 25 aa, Entamoeba dispar
TIILLMLWIILFTVMGFVKDPRNVY

SEQ ID NO: 2402190 - protein, 17 aa, Entamoeba dispar
TIIPIFCLLIPCILEST

SEQ ID NO: 2402191 - protein, 19 aa, Entamoeba dispar
TIIQMLFSCKSTKLKKVLI

SEQ ID NO: 2402192 - protein, 25 aa, Entamoeba dispar
TIIQTFLMMVLKMIIKFNKQETRKA

SEQ ID NO: 2402193 - protein, 33 aa, Entamoeba dispar
TIIVSLIGTILYWLIYEMQFSVLDFVLPGKQSL

SEQ ID NO: 2402194 - protein, 23 aa, Entamoeba dispar
TIKKHVFIPPSLYYDIDTPLEMM

SEQ ID NO: 2402195 - protein, 28 aa, Entamoeba dispar
TIKKKSSLFLLFSLLSLGLSASMCLGVT

SEQ ID NO: 2402196 - protein, 17 aa, Entamoeba dispar
TIKNYLNLPKWLKWIYT

SEQ ID NO: 2402197 - protein, 22 aa, Entamoeba dispar
TIKRGTMIVLMDKALGSEFDAE

SEQ ID NO: 2402198 - protein, 23 aa, Entamoeba dispar
TIKTITPLLLEKESKKKRIKSTT

SEQ ID NO: 2402199 - protein, 17 aa, Entamoeba dispar
TILFYLCCSLNILFIVS

SEQ ID NO: 2402200 - protein, 17 aa, Entamoeba dispar
TILLLAFELIEKCDNEL

SEQ ID NO: 2402201 - protein, 17 aa, Entamoeba dispar
TILLNTRNLVLEPVISI

SEQ ID NO: 2402202 - protein, 27 aa, Entamoeba dispar
TILQIHPLFRLTSIQTFAILLKKITHT

SEQ ID NO: 2402203 - protein, 26 aa, Entamoeba dispar
TILSILILVIIVLITLLFSTFFSTIL

SEQ ID NO: 2402204 - protein, 37 aa, Entamoeba dispar
TILSLMIRNYMMLIIRGGMLQRLGVFGLSLLVMRFDC

SEQ ID NO: 2402205 - protein, 39 aa, Entamoeba dispar
TILSVILSILYPSLPFIWGYFALLSVGLWYSSRSSNVSV

SEQ ID NO: 2402206 - protein, 26 aa, Entamoeba dispar
TILTVSIISLIFFNIKMKSTYQTFQQ

SEQ ID NO: 2402207 - protein, 17 aa, Entamoeba dispar
TIMKLLDERFDSFLAQS

SEQ ID NO: 2402208 - protein, 29 aa, Entamoeba dispar
TIPIHCFELLWKVFIVLKYGLLNKLILTN

SEQ ID NO: 2402209 - protein, 23 aa, Entamoeba dispar
TIPQTIMISSFFPNTFNLEIACK

SEQ ID NO: 2402210 - protein, 18 aa, Entamoeba dispar
TIQELYTYTLALSSTNPS

SEQ ID NO: 2402211 - protein, 19 aa, Entamoeba dispar
TIQFIRWLRKSYVTGIVII

SEQ ID NO: 2402212 - protein, 24 aa, Entamoeba dispar
TIQNIMIFYFVFVTIITLITTFFS

SEQ ID NO: 2402213 - protein, 29 aa, Entamoeba dispar
TIQSFIIANIIPLLFKWYSSSNNLIKKEI

SEQ ID NO: 2402214 - protein, 23 aa, Entamoeba dispar
TISFGIFLCLWFDGLEAQPQDMI

SEQ ID NO: 2402215 - protein, 27 aa, Entamoeba dispar
TISFIYFFLGIINFFEFIWSVIVQFLA

SEQ ID NO: 2402216 - protein, 30 aa, Entamoeba dispar
TISLCLMIIILSLNWYLPPLKATKPNPVHL

SEQ ID NO: 2402217 - protein, 21 aa, Entamoeba dispar
TISLTICYILFTPSILNSVTG

SEQ ID NO: 2402218 - protein, 35 aa, Entamoeba dispar
TISSFITLMSPFVWQHVLIPLLPKSLVTYCAAPMP

SEQ ID NO: 2402219 - protein, 25 aa, Entamoeba dispar
TISTFTVLILVILKCWFSVDTGMAS

SEQ ID NO: 2402220 - protein, 27 aa, Entamoeba dispar
TITLLNRIICWILMISHNFTTPDDIPL

SEQ ID NO: 2402221 - protein, 38 aa, Entamoeba dispar
TITTIIALFIGIIVYISLFKITFLKIKCIYLMVVSKKF

SEQ ID NO: 2402222 - protein, 26 aa, Entamoeba dispar
TITTKMYIPEIIYLLNLIGSVFTTIH

SEQ ID NO: 2402223 - protein, 21 aa, Entamoeba dispar
TITYNCPPIRCSYKQENKLPT

SEQ ID NO: 2402224 - protein, 18 aa, Entamoeba dispar
TIVLIVMVVYVSLFVLIG

SEQ ID NO: 2402225 - protein, 24 aa, Entamoeba dispar
TIVLLVFLSFVTPKYPYFSFSCIS

SEQ ID NO: 2402226 - protein, 17 aa, Entamoeba dispar
TIYLIESSVYECHFSFK

SEQ ID NO: 2402227 - protein, 30 aa, Entamoeba dispar
TKATVIPFCLFFFNLFIKVIEVLIIIVRTQ

SEQ ID NO: 2402228 - protein, 20 aa, Entamoeba dispar
TKCSIWYKPSITGIECEINI

SEQ ID NO: 2402229 - protein, 23 aa, Entamoeba dispar
TKDTFSFILQPQKTNYIALVVNG

SEQ ID NO: 2402230 - protein, 22 aa, Entamoeba dispar
TKDTIILLIKEFDVLNKLKSCN

SEQ ID NO: 2402231 - protein, 20 aa, Entamoeba dispar
TKECIICQPGFVLLNGQCYK

SEQ ID NO: 2402232 - protein, 20 aa, Entamoeba dispar
TKECIQCEYGYYLNSNTECQ

SEQ ID NO: 2402233 - protein, 23 aa, Entamoeba dispar
TKERVIIQNACKRLQFGETGKSE

SEQ ID NO: 2402234 - protein, 22 aa, Entamoeba dispar
TKFGLYGFRKPTSGKFRVTIDS

SEQ ID NO: 2402235 - protein, 18 aa, Entamoeba dispar
TKFTPYGSFVLNKIFPEK

SEQ ID NO: 2402236 - protein, 18 aa, Entamoeba dispar
TKFVYVIICYCGIHTKLS

SEQ ID NO: 2402237 - protein, 20 aa, Entamoeba dispar
TKIIIYTYSFCYSTCSFITK

SEQ ID NO: 2402238 - protein, 25 aa, Entamoeba dispar
TKIIPIIKLILVILLTINSIWTIPL

SEQ ID NO: 2402239 - protein, 25 aa, Entamoeba dispar
TKILCLHFLLIILSSCIKLFSFHVI

SEQ ID NO: 2402240 - protein, 29 aa, Entamoeba dispar
TKIQLSTIIILILKVFLYGIENTYFMHYI

SEQ ID NO: 2402241 - protein, 35 aa, Entamoeba dispar
TKISTIKGFKLASFELTKTGFKFVACEIGQLSYKS

SEQ ID NO: 2402242 - protein, 23 aa, Entamoeba dispar
TKKFYSFIIPQELLSKYFYYIQF

SEQ ID NO: 2402243 - protein, 22 aa, Entamoeba dispar
TKKTWYKIFSNSFSFGFSLTNS

SEQ ID NO: 2402244 - protein, 23 aa, Entamoeba dispar
TKKVFNIFGTNQLIFDNNLNNAL

SEQ ID NO: 2402245 - protein, 21 aa, Entamoeba dispar
TKMFFELFHNKKIPRCGQCLE

SEQ ID NO: 2402246 - protein, 23 aa, Entamoeba dispar
TKNCSFVSLWKKFAPSLTHDKFT

SEQ ID NO: 2402247 - protein, 24 aa, Entamoeba dispar
TKNIIFDTILTDSIYITSSAMLTL

SEQ ID NO: 2402248 - protein, 27 aa, Entamoeba dispar
TKNLKMPYIILFRLKQKLTSLLLHYIY

SEQ ID NO: 2402249 - protein, 28 aa, Entamoeba dispar
TKNLLVKDIYLLIINYTQQTDFLSYLKS

SEQ ID NO: 2402250 - protein, 31 aa, Entamoeba dispar
TKPSNWEVYFKWGLIIVNVIILVVGVLLHLT

SEQ ID NO: 2402251 - protein, 29 aa, Entamoeba dispar
TKQAITMNFILLNVFLVCVSASFLMGTAL

SEQ ID NO: 2402252 - protein, 21 aa, Entamoeba dispar
TKQHTLFRLLPSGNKVFRENN

SEQ ID NO: 2402253 - protein, 27 aa, Entamoeba dispar
TKQNKYYYYLLKRLINVLHFCLLKNAS

SEQ ID NO: 2402254 - protein, 39 aa, Entamoeba dispar
TKRCGHIIMLSFLGSILLYIILYTIIMFVPGMSVRNISY

SEQ ID NO: 2402255 - protein, 34 aa, Entamoeba dispar
TKRNEIFDMLFGARWMILLMGLFSIYCGALYNEF

SEQ ID NO: 2402256 - protein, 34 aa, Entamoeba dispar
TKSCIVALLRGIWIMPIEWLFSKGDYFENEELYV

SEQ ID NO: 2402257 - protein, 24 aa, Entamoeba dispar
TKTALLTAFVIGVLNWVGCTLVIH

SEQ ID NO: 2402258 - protein, 33 aa, Entamoeba dispar
TKTMTVWSILILINIIVFLLSLHSSVFFETPLK

SEQ ID NO: 2402259 - protein, 35 aa, Entamoeba dispar
TKTSILLLVVIWLYNIIVQVIGFLLLLIAFAKDKD

SEQ ID NO: 2402260 - protein, 25 aa, Entamoeba dispar
TKVDDNIFITFRYGKLHAVLMDMNQ

SEQ ID NO: 2402261 - protein, 22 aa, Entamoeba dispar
TKVFKVIIPMDNYWYNAFLYEI

SEQ ID NO: 2402262 - protein, 26 aa, Entamoeba dispar
TKWYVTFFVFLGWGMSFAIPILLPID

SEQ ID NO: 2402263 - protein, 29 aa, Entamoeba dispar
TKYSIISFLPLFLYNQFKHVTNIYFLLVA

SEQ ID NO: 2402264 - protein, 17 aa, Entamoeba dispar
TLATKISTIKGFKLASF

SEQ ID NO: 2402265 - protein, 33 aa, Entamoeba dispar
TLATLFLLLFIVVLFFQLFTFPAFPPAKKDKNT

SEQ ID NO: 2402266 - protein, 20 aa, Entamoeba dispar
TLATWAIIVICIGGILLVII

SEQ ID NO: 2402267 - protein, 18 aa, Entamoeba dispar
TLCSQFFKDLFKGYLKCT

SEQ ID NO: 2402268 - protein, 28 aa, Entamoeba dispar
TLDQIKWIIILNFFETPIKFILPSDIQI

SEQ ID NO: 2402269 - protein, 34 aa, Entamoeba dispar
TLEDKHLLFTLQSFVLCFMFVMKNLKTSTLRTYL

SEQ ID NO: 2402270 - protein, 17 aa, Entamoeba dispar
TLEDVHLFEFELINKKQ

SEQ ID NO: 2402271 - protein, 17 aa, Entamoeba dispar
TLEIGTLTYSKLCWFDS

SEQ ID NO: 2402272 - protein, 17 aa, Entamoeba dispar
TLESCLLHLLHSPIVTD

SEQ ID NO: 2402273 - protein, 25 aa, Entamoeba dispar
TLEYINLNYTWGFSPGVFIEGHIAV

SEQ ID NO: 2402274 - protein, 32 aa, Entamoeba dispar
TLFDIVFYPFVDFQPSIWRFLKYWFTSLLSSQ

SEQ ID NO: 2402275 - protein, 19 aa, Entamoeba dispar
TLFEFWAHLLYICNYGYMN

SEQ ID NO: 2402276 - protein, 19 aa, Entamoeba dispar
TLFGTTYFNSTKPIYIIST

SEQ ID NO: 2402277 - protein, 18 aa, Entamoeba dispar
TLFISPIEVIIPKDKRPK

SEQ ID NO: 2402278 - protein, 23 aa, Entamoeba dispar
TLFKTMYYFIITPLGIYLFRHED

SEQ ID NO: 2402279 - protein, 18 aa, Entamoeba dispar
TLFLIINTFAFNNTIDQS

SEQ ID NO: 2402280 - protein, 19 aa, Entamoeba dispar
TLFLLFYQDKHSRIFKRVI

SEQ ID NO: 2402281 - protein, 25 aa, Entamoeba dispar
TLFPNIYFPSFVLLPPLNQSLNYNI

SEQ ID NO: 2402282 - protein, 23 aa, Entamoeba dispar
TLFTIGFYIFIALVIIVCIIFYT

SEQ ID NO: 2402283 - protein, 17 aa, Entamoeba dispar
TLGFLPEKVGVQTQLLI

SEQ ID NO: 2402284 - protein, 25 aa, Entamoeba dispar
TLGGYNGCLYYFTKDFTYSSTDDME

SEQ ID NO: 2402285 - protein, 30 aa, Entamoeba dispar
TLGGYPMISLDQLTWYYYVQGDDTPYLVNG

SEQ ID NO: 2402286 - protein, 17 aa, Entamoeba dispar
TLHLYLKDTIESKYLNI

SEQ ID NO: 2402287 - protein, 25 aa, Entamoeba dispar
TLIVDIICFVLYLSLSLMNTEFSKK

SEQ ID NO: 2402288 - protein, 34 aa, Entamoeba dispar
TLIVKLSFYKNVAFILMQFWFGIQNAFSGQSLYE

SEQ ID NO: 2402289 - protein, 21 aa, Entamoeba dispar
TLIVLSFGRIDYWCDSVDNYV

SEQ ID NO: 2402290 - protein, 17 aa, Entamoeba dispar
TLIVVFAGPIFSVSPFP

SEQ ID NO: 2402291 - protein, 25 aa, Entamoeba dispar
TLKDQFIPHLFKPSSLDFPSTTSAF

SEQ ID NO: 2402292 - protein, 31 aa, Entamoeba dispar
TLKELISTIFLPWFNTLRYLKQSFKPEMKIM

SEQ ID NO: 2402293 - protein, 19 aa, Entamoeba dispar
TLKHWTQFKDLPTSNIILF

SEQ ID NO: 2402294 - protein, 19 aa, Entamoeba dispar
TLKKILHHYGPISTAIYSN

SEQ ID NO: 2402295 - protein, 25 aa, Entamoeba dispar
TLKLFLNLILLLKRLCNKIKEIIIA

SEQ ID NO: 2402296 - protein, 40 aa, Entamoeba dispar
TLKRMLYRAITNKIFLIIMAIVFLIIIGVVIYVGFFVFRK

SEQ ID NO: 2402297 - protein, 21 aa, Entamoeba dispar
TLLILHIILHLSSLSWWSIVP

SEQ ID NO: 2402298 - protein, 24 aa, Entamoeba dispar
TLLSHISFYYHLISNYAGAAAGDN

SEQ ID NO: 2402299 - protein, 23 aa, Entamoeba dispar
TLLSLFLIFIINIYISFIFSTQS

SEQ ID NO: 2402300 - protein, 21 aa, Entamoeba dispar
TLLTLIVGQISFFIPVPTSKP

SEQ ID NO: 2402301 - protein, 21 aa, Entamoeba dispar
TLLVFVWLMTWMYCWANSKVN

SEQ ID NO: 2402302 - protein, 18 aa, Entamoeba dispar
TLNIFFNKFSIIIENDDI

SEQ ID NO: 2402303 - protein, 24 aa, Entamoeba dispar
TLNLSKYQLRCCFLRGFPGVQKFK

SEQ ID NO: 2402304 - protein, 24 aa, Entamoeba dispar
TLNSTFSLLIKQKIKHFNDLTTDP

SEQ ID NO: 2402305 - protein, 26 aa, Entamoeba dispar
TLNTSFLNFFIVSFSFCCLACWVVFM

SEQ ID NO: 2402306 - protein, 25 aa, Entamoeba dispar
TLPCKLFFCFNLPVYLGLDHSKLTN

SEQ ID NO: 2402307 - protein, 27 aa, Entamoeba dispar
TLPDDYSDYYFKAGKISTINGGLSPLF

SEQ ID NO: 2402308 - protein, 26 aa, Entamoeba dispar
TLQDTLRLLTILFKYGKYQEVEEAII

SEQ ID NO: 2402309 - protein, 20 aa, Entamoeba dispar
TLQLMLIEALTKENTLIQFE

SEQ ID NO: 2402310 - protein, 32 aa, Entamoeba dispar
TLRYLWESHFMLFIPLIIILIGTRFTSVCWFG

SEQ ID NO: 2402311 - protein, 26 aa, Entamoeba dispar
  misc_feature (23)..(24): Xaa can be any naturally occurring amino acid
TLSFFILFLCFIVFSFLLFLYLXXIT

SEQ ID NO: 2402312 - protein, 22 aa, Entamoeba dispar
TLSFLLILILISFYSILFYSLF

SEQ ID NO: 2402313 - protein, 18 aa, Entamoeba dispar
TLSPAPFAHWCIKEITEQ

SEQ ID NO: 2402314 - protein, 26 aa, Entamoeba dispar
TLSRCLFFRVIPLNNLLTLISAVLLE

SEQ ID NO: 2402315 - protein, 25 aa, Entamoeba dispar
TLSVLLMLYLIFFLSHWEEYHTGVL

SEQ ID NO: 2402316 - protein, 28 aa, Entamoeba dispar
TLSYGNLFIWLLSIFYIPRPTRPIWDKA

SEQ ID NO: 2402317 - protein, 28 aa, Entamoeba dispar
TLTEPKFLYFTPLYQQYTLRSLDKSIFE

SEQ ID NO: 2402318 - protein, 20 aa, Entamoeba dispar
TLTLPLMNLFIKINLNKQNV

SEQ ID NO: 2402319 - protein, 30 aa, Entamoeba dispar
TLTLQFFHIFINFLFIGFIFSIIKYFNRDG

SEQ ID NO: 2402320 - protein, 21 aa, Entamoeba dispar
TLVILWNLLYWGTTILCWTAI

SEQ ID NO: 2402321 - protein, 20 aa, Entamoeba dispar
TLYFIIYIITFRNKPFIFKQ

SEQ ID NO: 2402322 - protein, 17 aa, Entamoeba dispar
TLYFNLFAEQIIRLLYQ

SEQ ID NO: 2402323 - protein, 38 aa, Entamoeba dispar
TLYLSGFAMTLFTLLLFGPLFYRLIKVIFMPKTTAPQT

SEQ ID NO: 2402324 - protein, 19 aa, Entamoeba dispar
TMCVSLFEFFLQSLSVVSV

SEQ ID NO: 2402325 - protein, 18 aa, Entamoeba dispar
TMDGFLMNYFAYNIDRTR

SEQ ID NO: 2402326 - protein, 26 aa, Entamoeba dispar
TMFTIFSILIICLLVGSILLIINIIP

SEQ ID NO: 2402327 - protein, 33 aa, Entamoeba dispar
TMFVALCVYFINGHWKYYLDPVSSLVVSLVMMI

SEQ ID NO: 2402328 - protein, 18 aa, Entamoeba dispar
TMILGRRVILSPSILEKE

SEQ ID NO: 2402329 - protein, 20 aa, Entamoeba dispar
TMKIIDVLDIFYKDLDRFDM

SEQ ID NO: 2402330 - protein, 28 aa, Entamoeba dispar
TMKILYYKVFAYFYYLVGNLASLVFVNG

SEQ ID NO: 2402331 - protein, 35 aa, Entamoeba dispar
TMKVIRHLIHLLKTKWYCVVFVIMFITFSMIVYFS

SEQ ID NO: 2402332 - protein, 18 aa, Entamoeba dispar
TMLDILKNQFGFVFDQTV

SEQ ID NO: 2402333 - protein, 26 aa, Entamoeba dispar
TMLQIITWEDPFPKTLYPHPWDIADS

SEQ ID NO: 2402334 - protein, 21 aa, Entamoeba dispar
TMLQIITWQDPFPKEIYNFPW

SEQ ID NO: 2402335 - protein, 33 aa, Entamoeba dispar
TMLSSLFNITVIFPFVLCFYPDCIRIYNFFTGQ

SEQ ID NO: 2402336 - protein, 25 aa, Entamoeba dispar
TMNQFLLFLLTFVSIPLAIFLILLS

SEQ ID NO: 2402337 - protein, 24 aa, Entamoeba dispar
TMNRWHFIILIIITILISLAVAGV

SEQ ID NO: 2402338 - protein, 18 aa, Entamoeba dispar
TMPLAFVVILAMAKDAYD

SEQ ID NO: 2402339 - protein, 24 aa, Entamoeba dispar
TMQKFIHILKYRMNALPVGTQFPF

SEQ ID NO: 2402340 - protein, 19 aa, Entamoeba dispar
TMRLFLSSIFTSFLPQPIQ

SEQ ID NO: 2402341 - protein, 18 aa, Entamoeba dispar
TMSFFSRWLDTIGKKKFP

SEQ ID NO: 2402342 - protein, 23 aa, Entamoeba dispar
TMTLSMILLIYKSIDIHESLFNQ

SEQ ID NO: 2402343 - protein, 18 aa, Entamoeba dispar
TMTMLFYSPEINIYQQCY

SEQ ID NO: 2402344 - protein, 27 aa, Entamoeba dispar
TMVINYRRPFLSYLEYKETIPLRTFRL

SEQ ID NO: 2402345 - protein, 34 aa, Entamoeba dispar
TMYEILDWKTPYNTPLFPFAWSIADFVTHGKRLM

SEQ ID NO: 2402346 - protein, 37 aa, Entamoeba dispar
TMYYTLNYIFCRSMLSILFNIIKAFLSKAFYGIGNPI

SEQ ID NO: 2402347 - protein, 26 aa, Entamoeba dispar
TNAIVEIILLFKSFPTLFSQLSINDD

SEQ ID NO: 2402348 - protein, 54 aa, Entamoeba dispar
TNDDVPTWVIVILVIVGVIIVIIIILFIVFIVVARMFLLRRKNNKVFDDDDNIF

SEQ ID NO: 2402349 - protein, 17 aa, Entamoeba dispar
TNDLAIFETNKDTLKHH

SEQ ID NO: 2402350 - protein, 41 aa, Entamoeba dispar
TNDNTMLYIIIGCSVGGALILVLLVVVVVISIIIYKKRHSG

SEQ ID NO: 2402351 - protein, 21 aa, Entamoeba dispar
TNEIIILIQKSLKKCFIIYSF

SEQ ID NO: 2402352 - protein, 27 aa, Entamoeba dispar
TNEIRYRLLNIYLSTLYLKGTNNINNE

SEQ ID NO: 2402353 - protein, 24 aa, Entamoeba dispar
TNELRFLHIFPLNIIFACYNGYLT

SEQ ID NO: 2402354 - protein, 20 aa, Entamoeba dispar
TNFLKLRFCQDIARGMLYLH

SEQ ID NO: 2402355 - protein, 23 aa, Entamoeba dispar
TNGKIRIINPFSGSICCWCDDTA

SEQ ID NO: 2402356 - protein, 38 aa, Entamoeba dispar
TNHMILTLCCIAIGILIFIIILIILLDGYNKALQETGI

SEQ ID NO: 2402357 - protein, 21 aa, Entamoeba dispar
TNIDFPVFYLSTSFRNSIVLW

SEQ ID NO: 2402358 - protein, 19 aa, Entamoeba dispar
TNIILLFIEIRLVVCCIIA

SEQ ID NO: 2402359 - protein, 31 aa, Entamoeba dispar
TNIKSRLRISLLYTWCVILILNNVRIQDQRE

SEQ ID NO: 2402360 - protein, 21 aa, Entamoeba dispar
TNIYRCDDKFFIDKDDGTCAK

SEQ ID NO: 2402361 - protein, 17 aa, Entamoeba dispar
TNKLNIWYKIRCINIDI

SEQ ID NO: 2402362 - protein, 23 aa, Entamoeba dispar
TNKTIQLCELYLKNIVVPGKQSK

SEQ ID NO: 2402363 - protein, 25 aa, Entamoeba dispar
TNNDRIFLFVNKRPIEHKKLQQIII

SEQ ID NO: 2402364 - protein, 26 aa, Entamoeba dispar
TNNPHIFCNTLKILYLLVGETTEILS

SEQ ID NO: 2402365 - protein, 21 aa, Entamoeba dispar
TNPLKNWAAMVKLNPYAKIAS

SEQ ID NO: 2402366 - protein, 22 aa, Entamoeba dispar
TNPQLITLKKGKAVEFEIFIKP

SEQ ID NO: 2402367 - protein, 29 aa, Entamoeba dispar
TNQLSTEIIPFYSLWATIFGGFSSMILIL

SEQ ID NO: 2402368 - protein, 17 aa, Entamoeba dispar
TNRIIRFNFKGSPHARA

SEQ ID NO: 2402369 - protein, 19 aa, Entamoeba dispar
TNRLVMVMFTLAIILSSIS

SEQ ID NO: 2402370 - protein, 30 aa, Entamoeba dispar
TNRNSSLYRFILLFCLFTCYKRIKRMLMSY

SEQ ID NO: 2402371 - protein, 18 aa, Entamoeba dispar
TNRTLFLPRVICLVFNEQ

SEQ ID NO: 2402372 - protein, 27 aa, Entamoeba dispar
TNTAQMDVFLNDEFRYIFVYGTGGQET

SEQ ID NO: 2402373 - protein, 24 aa, Entamoeba dispar
TNTGYPQFLWRYSSLSNKVLPESI

SEQ ID NO: 2402374 - protein, 23 aa, Entamoeba dispar
TNTLSILLPIVTPLSLINEELLN

SEQ ID NO: 2402375 - protein, 41 aa, Entamoeba dispar
TNTTTIYIVAIIILLLIVTIGIVAFFWYTRKPRSVHSQNRG

SEQ ID NO: 2402376 - protein, 27 aa, Entamoeba dispar
TNWQKFSAHFLVFGRVFRLNLKEVPWM

SEQ ID NO: 2402377 - protein, 18 aa, Entamoeba dispar
TNYYLFIASLEHGYDGMI

SEQ ID NO: 2402378 - protein, 22 aa, Entamoeba dispar
TPAPHLPPSFPLSIDIPDNYSN

SEQ ID NO: 2402379 - protein, 24 aa, Entamoeba dispar
TPASLIKGFFNYFKNYDWNEPITI

SEQ ID NO: 2402380 - protein, 18 aa, Entamoeba dispar
TPCFFFLFFIVSFCFCFA

SEQ ID NO: 2402381 - protein, 19 aa, Entamoeba dispar
TPFIKYIFGILSQIHCKVN

SEQ ID NO: 2402382 - protein, 21 aa, Entamoeba dispar
TPLEQMILKKVLLTPTVEEYE

SEQ ID NO: 2402383 - protein, 24 aa, Entamoeba dispar
TPNNPKYVFYFEPQVLFIRPHTTP

SEQ ID NO: 2402384 - protein, 25 aa, Entamoeba dispar
TPNNPKYVFYFEPQVLLIRPHSTPK

SEQ ID NO: 2402385 - protein, 25 aa, Entamoeba dispar
TPNSPKYVFYFDPQVKFVSSNSTKK

SEQ ID NO: 2402386 - protein, 26 aa, Entamoeba dispar
TPPFSAMMILWANLVVDIPPSICLGL

SEQ ID NO: 2402387 - protein, 23 aa, Entamoeba dispar
TPQIVVLKLIPWINLSSINLTTK

SEQ ID NO: 2402388 - protein, 25 aa, Entamoeba dispar
TPQKYIWPSAIRLFPFVMAVSLFLN

SEQ ID NO: 2402389 - protein, 24 aa, Entamoeba dispar
TPSQKLYRFSIFKERVKLIRQRNA

SEQ ID NO: 2402390 - protein, 25 aa, Entamoeba dispar
TPSTLFMFFGLILIGLILGRLFFPL

SEQ ID NO: 2402391 - protein, 26 aa, Entamoeba dispar
TPTTKSYFFYIKPSDTLPISITIDKP

SEQ ID NO: 2402392 - protein, 31 aa, Entamoeba dispar
TPVDIFSFSIVLYEIWKWDKAYPTEEFKFPW

SEQ ID NO: 2402393 - protein, 31 aa, Entamoeba dispar
TPYDIERIRLILPEVQFITKHKLHAGMILDA

SEQ ID NO: 2402394 - protein, 37 aa, Entamoeba dispar
TPYGSFVLNKIFPEKQQISPILKTIALGLKSITSLTN

SEQ ID NO: 2402395 - protein, 32 aa, Entamoeba dispar
TQDPNYLLIQIVFYFSLFYSTSYAVLKEYISH

SEQ ID NO: 2402396 - protein, 25 aa, Entamoeba dispar
TQFTMVTNIYFLAILIICCIPSIST

SEQ ID NO: 2402397 - protein, 17 aa, Entamoeba dispar
TQFYFAFFSGFSGTSIY

SEQ ID NO: 2402398 - protein, 18 aa, Entamoeba dispar
TQGNLVLLPLSKEYLRIP

SEQ ID NO: 2402399 - protein, 25 aa, Entamoeba dispar
TQIVYFMTIIVLPILHMVSLFVLWF

SEQ ID NO: 2402400 - protein, 28 aa, Entamoeba dispar
TQKCVDFWVGDWWGIWSTSAYLEQGLRV

SEQ ID NO: 2402401 - protein, 26 aa, Entamoeba dispar
TQKEKIWLYKIIYKFGINLSSFPSYF

SEQ ID NO: 2402402 - protein, 23 aa, Entamoeba dispar
TQKIQFVMAFRPSGLRRFILPIN

SEQ ID NO: 2402403 - protein, 29 aa, Entamoeba dispar
TQLFIAFITYFVLFLCIVMVCIVGSIFTS

SEQ ID NO: 2402404 - protein, 21 aa, Entamoeba dispar
TQLFIYKPIVNLLKPLWTNRL

SEQ ID NO: 2402405 - protein, 28 aa, Entamoeba dispar
TQMNSMFQYYLTIIPIKNNFINGTSTFY

SEQ ID NO: 2402406 - protein, 29 aa, Entamoeba dispar
TQQTLHFKQLFKILELLGYSWAKECYHIS

SEQ ID NO: 2402407 - protein, 19 aa, Entamoeba dispar
TQRPFVCMIAGTFKTKPNH

SEQ ID NO: 2402408 - protein, 21 aa, Entamoeba dispar
TQRVFLTKVYHRGKNFFGINE

SEQ ID NO: 2402409 - protein, 31 aa, Entamoeba dispar
TQTKLLFLVQLFLILLQTIFFSLFYNKNDLS

SEQ ID NO: 2402410 - protein, 18 aa, Entamoeba dispar
TQTNLARLVLFNNPITKI

SEQ ID NO: 2402411 - protein, 25 aa, Entamoeba dispar
TQYNPKYILLLISTIQKSLSSLNFF

SEQ ID NO: 2402412 - protein, 30 aa, Entamoeba dispar
TRCISKTLKWYYHLVILIAVMVGVMLIIIC

SEQ ID NO: 2402413 - protein, 27 aa, Entamoeba dispar
TRCKIERLPIILPLIQEDVLSMQIDDA

SEQ ID NO: 2402414 - protein, 27 aa, Entamoeba dispar
TRDDLPVVSILFYVLGKSLFNTCMTNT

SEQ ID NO: 2402415 - protein, 19 aa, Entamoeba dispar
TRECIECEYGYYLNSNKEC

SEQ ID NO: 2402416 - protein, 19 aa, Entamoeba dispar
TRECIQCEKGYYLNSKQEC

SEQ ID NO: 2402417 - protein, 24 aa, Entamoeba dispar
TRFNLTFQLFINSLFYSIPSLITG

SEQ ID NO: 2402418 - protein, 25 aa, Entamoeba dispar
TRGMEILLKNYWKLYVKGKRLSKGT

SEQ ID NO: 2402419 - protein, 17 aa, Entamoeba dispar
TRILRRIIIFTTSLLLL

SEQ ID NO: 2402420 - protein, 23 aa, Entamoeba dispar
TRLIGSFRYFDTMNLFYKKEFIN

SEQ ID NO: 2402421 - protein, 21 aa, Entamoeba dispar
TRLYKIPQLNIIYSYSINNKS

SEQ ID NO: 2402422 - protein, 24 aa, Entamoeba dispar
TRMYTKDCTGCQPGYMWYGEGNCS

SEQ ID NO: 2402423 - protein, 25 aa, Entamoeba dispar
TRNTKLFDFISFNPLIQTKEIKEIK

SEQ ID NO: 2402424 - protein, 36 aa, Entamoeba dispar
TRTKMLLEMLPKQFAAFMFFDCHNRFYQEILALARS

SEQ ID NO: 2402425 - protein, 37 aa, Entamoeba dispar
TRTTWYSFLPMSLFNQFKYFYNLYFLCNACSQLIPIF

SEQ ID NO: 2402426 - protein, 17 aa, Entamoeba dispar
TRYTKDCTGCQPGYMWF

SEQ ID NO: 2402427 - protein, 24 aa, Entamoeba dispar
TSAKGFIEPLYGYFAVYDYSEHEK

SEQ ID NO: 2402428 - protein, 25 aa, Entamoeba dispar
TSANSPICYCSYDPYVDQSCILDCS

SEQ ID NO: 2402429 - protein, 30 aa, Entamoeba dispar
TSCSVLYHCLKIMSILMAPFTPFFSEFCYQ

SEQ ID NO: 2402430 - protein, 17 aa, Entamoeba dispar
TSCTIGTLIFSTAIAHE

SEQ ID NO: 2402431 - protein, 20 aa, Entamoeba dispar
TSCVLCSPGYWFDGNTCVKC

SEQ ID NO: 2402432 - protein, 24 aa, Entamoeba dispar
TSDYLPIFYVLGLLLQFVMILIDR

SEQ ID NO: 2402433 - protein, 25 aa, Entamoeba dispar
TSENWPITYPITINGQLIVNGTIDL

SEQ ID NO: 2402434 - protein, 23 aa, Entamoeba dispar
TSEYCPFGKLIGKFKTLRQFCQL

SEQ ID NO: 2402435 - protein, 24 aa, Entamoeba dispar
TSEYCPFGKLIGKFKTLRQFCQLW

SEQ ID NO: 2402436 - protein, 21 aa, Entamoeba dispar
TSFINEVIFFFGNSSFNIDGF

SEQ ID NO: 2402437 - protein, 17 aa, Entamoeba dispar
TSFKIIHTQYPKAPIMT

SEQ ID NO: 2402438 - protein, 22 aa, Entamoeba dispar
TSFKILIILTTLCGIMSLVAFS

SEQ ID NO: 2402439 - protein, 20 aa, Entamoeba dispar
TSFRLLFKMIKIVEYIHSKQ

SEQ ID NO: 2402440 - protein, 21 aa, Entamoeba dispar
TSFVPFPMFQVYAASKAFIKQ

SEQ ID NO: 2402441 - protein, 33 aa, Entamoeba dispar
TSGFIMVIVLLAILWFPLLFMSSAAPNFAQPKP

SEQ ID NO: 2402442 - protein, 28 aa, Entamoeba dispar
TSGLLWSFLYLIISLFINALFQAITDDY

SEQ ID NO: 2402443 - protein, 27 aa, Entamoeba dispar
TSHDSWKMLIVLLPFIIAGTVAISRTR

SEQ ID NO: 2402444 - protein, 26 aa, Entamoeba dispar
TSIDNLISLLYPFPPTQKVFAILPYK

SEQ ID NO: 2402445 - protein, 26 aa, Entamoeba dispar
TSILLSLFLLRIISFIISLTLFFNYF

SEQ ID NO: 2402446 - protein, 18 aa, Entamoeba dispar
TSKITSLLVCKMLSLLQP

SEQ ID NO: 2402447 - protein, 23 aa, Entamoeba dispar
TSKSIIHFIGSFKFGSFTLGSSD

SEQ ID NO: 2402448 - protein, 28 aa, Entamoeba dispar
TSKYNIFTFLPLVLLEQFRKLANVYFLI

SEQ ID NO: 2402449 - protein, 25 aa, Entamoeba dispar
TSLISFIVLLYKPSFFKFGRVICLI

SEQ ID NO: 2402450 - protein, 24 aa, Entamoeba dispar
TSLLKMWLHFIHFCGNVANITNPD

SEQ ID NO: 2402451 - protein, 18 aa, Entamoeba dispar
TSLLLIKQNQKLFNSILR

SEQ ID NO: 2402452 - protein, 26 aa, Entamoeba dispar
TSLLPILVIIPLWYISLPTNNDMQLF

SEQ ID NO: 2402453 - protein, 25 aa, Entamoeba dispar
TSLPGFVLLLLLFSIDISILVYVPT

SEQ ID NO: 2402454 - protein, 23 aa, Entamoeba dispar
TSMLLFILGFFTCLTWVINIFMF

SEQ ID NO: 2402455 - protein, 25 aa, Entamoeba dispar
TSNKSYYFEILTNPSHRYSLEVNPV

SEQ ID NO: 2402456 - protein, 22 aa, Entamoeba dispar
TSPQTFGYFLPVTKNDQTNILE

SEQ ID NO: 2402457 - protein, 24 aa, Entamoeba dispar
TSQPEYVLLKYNKIITPFVKLTGK

SEQ ID NO: 2402458 - protein, 17 aa, Entamoeba dispar
TSQWINYIAIYPIIWIY

SEQ ID NO: 2402459 - protein, 30 aa, Entamoeba dispar
TSRKAVERMVILMYFGVAIPDILVYLGVTR

SEQ ID NO: 2402460 - protein, 24 aa, Entamoeba dispar
TSRKISFLFILSLGGYLFGLIIKY

SEQ ID NO: 2402461 - protein, 26 aa, Entamoeba dispar
TSSENGIISMLTWVRSLTPINVEEVK

SEQ ID NO: 2402462 - protein, 23 aa, Entamoeba dispar
TSSRYLLLIEFIEALIMNERNIN

SEQ ID NO: 2402463 - protein, 20 aa, Entamoeba dispar
TSSTLDSFIFDSIQRMIIKG

SEQ ID NO: 2402464 - protein, 24 aa, Entamoeba dispar
TSSVVMELFFVLASLRQINVPNAM

SEQ ID NO: 2402465 - protein, 29 aa, Entamoeba dispar
TSTIPIPLIFICSIFIINICLFSIIHILV

SEQ ID NO: 2402466 - protein, 21 aa, Entamoeba dispar
TSTLCFISFFFCDAIFTSYNS

SEQ ID NO: 2402467 - protein, 23 aa, Entamoeba dispar
TSTLSIIFRISGGILAILFSLSY

SEQ ID NO: 2402468 - protein, 20 aa, Entamoeba dispar
TSTSLPLGWYYPVIYHYGQK

SEQ ID NO: 2402469 - protein, 28 aa, Entamoeba dispar
TSTTLSFILFLDFLHLYISMVKLHLFSG

SEQ ID NO: 2402470 - protein, 23 aa, Entamoeba dispar
TSYAFFLYKMLFGSLASIQTEEN

SEQ ID NO: 2402471 - protein, 20 aa, Entamoeba dispar
TSYIFGLINICFWMCAQFPQ

SEQ ID NO: 2402472 - protein, 22 aa, Entamoeba dispar
TSYKKILIRYNTRPYVLELTDG

SEQ ID NO: 2402473 - protein, 25 aa, Entamoeba dispar
TSYLALYYNIFLSKSIRSPKNSMSI

SEQ ID NO: 2402474 - protein, 33 aa, Entamoeba dispar
TTDNLYCRMSLYDKNYIKLTSDFYFTLTSDALK

SEQ ID NO: 2402475 - protein, 18 aa, Entamoeba dispar
TTEGWAFGAFIAGHIPVP

SEQ ID NO: 2402476 - protein, 18 aa, Entamoeba dispar
TTFLLFQVLAGISYSMLC

SEQ ID NO: 2402477 - protein, 18 aa, Entamoeba dispar
TTIFIIAVFLCFSLIKIQ

SEQ ID NO: 2402478 - protein, 26 aa, Entamoeba dispar
TTIIALFIGIIVYIISKKFKSNNKKS

SEQ ID NO: 2402479 - protein, 25 aa, Entamoeba dispar
TTIKKQPFILLSPAILVAVTDSCAT

SEQ ID NO: 2402480 - protein, 33 aa, Entamoeba dispar
TTIQQWLVSDFLPSLLNSLLTHIRKALLLFSRY

SEQ ID NO: 2402481 - protein, 20 aa, Entamoeba dispar
TTIYPFLKVIQKPTLRKSVL

SEQ ID NO: 2402482 - protein, 28 aa, Entamoeba dispar
TTKHLLYLFFPALLAFSATYLQNIGLVY

SEQ ID NO: 2402483 - protein, 21 aa, Entamoeba dispar
TTLMKWLCDVDDIPEWYTNED

SEQ ID NO: 2402484 - protein, 35 aa, Entamoeba dispar
TTLQSCCLFFILFFYYLNKYLLTSLVQNYEICCIC

SEQ ID NO: 2402485 - protein, 38 aa, Entamoeba dispar
TTLSDYMLTYNPVPLLYYFILQLIAVIFTLLKSIIETR

SEQ ID NO: 2402486 - protein, 22 aa, Entamoeba dispar
TTMLIYVFSYWRGIVSTLKLFL

SEQ ID NO: 2402487 - protein, 25 aa, Entamoeba dispar
TTNFIIKYILWWFGLGVLSSVGLGT

SEQ ID NO: 2402488 - protein, 30 aa, Entamoeba dispar
TTNNTACLWCLLFLTLLSVSVSLVMGIVGV

SEQ ID NO: 2402489 - protein, 26 aa, Entamoeba dispar
TTQRVIPILLHFGSLFKQNSLVVICE

SEQ ID NO: 2402490 - protein, 23 aa, Entamoeba dispar
TTRHYFNYVIDYYILQGKEIGED

SEQ ID NO: 2402491 - protein, 18 aa, Entamoeba dispar
TTSFLVSLPFLPWKYIFY

SEQ ID NO: 2402492 - protein, 24 aa, Entamoeba dispar
TTSVMYKLISNEKYEGLKISEDQI

SEQ ID NO: 2402493 - protein, 23 aa, Entamoeba dispar
TTSVYIPLDSISFLIVILLFLLM

SEQ ID NO: 2402494 - protein, 23 aa, Entamoeba dispar
TTSWSDFLIPQRMESLTLDITAN

SEQ ID NO: 2402495 - protein, 30 aa, Entamoeba dispar
TTTAYNFAFLFFAFIFVIALLLATNCFCYY

SEQ ID NO: 2402496 - protein, 45 aa, Entamoeba dispar
TTTGLVYKIIGGIGMFALVVVALIELLLVLLQRILCGLSRKNATY

SEQ ID NO: 2402497 - protein, 23 aa, Entamoeba dispar
TTTIPFVFSIIIDKTILNIKDLA

SEQ ID NO: 2402498 - protein, 17 aa, Entamoeba dispar
TTVIYPMKKGETVYIFV

SEQ ID NO: 2402499 - protein, 20 aa, Entamoeba dispar
TTVKGVTLYYLKGDSYATAN

SEQ ID NO: 2402500 - protein, 25 aa, Entamoeba dispar
TTWGTLSILWLLFTEAKYVNGKAIL

SEQ ID NO: 2402501 - protein, 22 aa, Entamoeba dispar
TTWSDFLIPQRMDSLVFNLTAE

SEQ ID NO: 2402502 - protein, 17 aa, Entamoeba dispar
TTYIILMLYILSGTICI

SEQ ID NO: 2402503 - protein, 18 aa, Entamoeba dispar
TVALLFLAPIPFGLISKF

SEQ ID NO: 2402504 - protein, 26 aa, Entamoeba dispar
TVAQFKFMYFNRGLMYFFMIVSIINH

SEQ ID NO: 2402505 - protein, 35 aa, Entamoeba dispar
TVCDSFPIKDFWKHVCIVWTKCYCHFSKKKLEKAK

SEQ ID NO: 2402506 - protein, 31 aa, Entamoeba dispar
TVFAVSCILVLLIIIIMTQLIGLSCIEISRR

SEQ ID NO: 2402507 - protein, 24 aa, Entamoeba dispar
TVGFKIFIGVFVGIAIVIVAIIVI

SEQ ID NO: 2402508 - protein, 19 aa, Entamoeba dispar
TVIMYMCIFLLTAKEMLSV

SEQ ID NO: 2402509 - protein, 24 aa, Entamoeba dispar
TVIVLPLVILSWVGGAFEVINIEN

SEQ ID NO: 2402510 - protein, 27 aa, Entamoeba dispar
TVKDFVQFYYVRLFGTVFGDYLNAKSF

SEQ ID NO: 2402511 - protein, 39 aa, Entamoeba dispar
TVLGTLPFKLFEKLSYRSLMLWILYDDIPEFEKETIPRA

SEQ ID NO: 2402512 - protein, 26 aa, Entamoeba dispar
TVLVFKNPLLLLSTNNFKILIQLYQA

SEQ ID NO: 2402513 - protein, 19 aa, Entamoeba dispar
TVPSLPQKLPKLSLQFKKI

SEQ ID NO: 2402514 - protein, 20 aa, Entamoeba dispar
TVRSLYVHKLYSYGIDYGFD

SEQ ID NO: 2402515 - protein, 19 aa, Entamoeba dispar
TVRVYVTDSCYKCLGDYCK

SEQ ID NO: 2402516 - protein, 25 aa, Entamoeba dispar
TVSDYPFFHMVTVPPLIIPSSDICH

SEQ ID NO: 2402517 - protein, 25 aa, Entamoeba dispar
TVSINYSILYIPLETLSKEKQKRIN

SEQ ID NO: 2402518 - protein, 19 aa, Entamoeba dispar
TVSYPWNSINIVTTSTLTL

SEQ ID NO: 2402519 - protein, 27 aa, Entamoeba dispar
TVVTNKLLVILRYLFAVVVIGVIIGVV

SEQ ID NO: 2402520 - protein, 26 aa, Entamoeba dispar
TVVVDCLFVVWIYWNKSNLKEWKELQ

SEQ ID NO: 2402521 - protein, 20 aa, Entamoeba dispar
TVWKDRRKVDLTKEVKFIPN

SEQ ID NO: 2402522 - protein, 25 aa, Entamoeba dispar
TVYSLFYVFLLFYVLITFEFYRYGK

SEQ ID NO: 2402523 - protein, 20 aa, Entamoeba dispar
TWEVQMPSRISPELAYVGFF

SEQ ID NO: 2402524 - protein, 37 aa, Entamoeba dispar
TYCSLFLGIVYFSQSFCFWVLGQFSYWQYKQILNIIV

SEQ ID NO: 2402525 - protein, 19 aa, Entamoeba dispar
TYEKNGIIDVLPESIDKIK

SEQ ID NO: 2402526 - protein, 20 aa, Entamoeba dispar
TYFMMYAIIFRNQPFIYNQT

SEQ ID NO: 2402527 - protein, 20 aa, Entamoeba dispar
TYHYGVWLKYSHDPSFKYTA

SEQ ID NO: 2402528 - protein, 25 aa, Entamoeba dispar
TYIPEICMVTIYMPLGSLSNYIRKN

SEQ ID NO: 2402529 - protein, 22 aa, Entamoeba dispar
TYIPQICMVTVFFELGSLNNYI

SEQ ID NO: 2402530 - protein, 27 aa, Entamoeba dispar
TYKRTLFLIAMAVFTLFLILLTVVFNP

SEQ ID NO: 2402531 - protein, 23 aa, Entamoeba dispar
TYKTIICLILIGIMITLILSNLY

SEQ ID NO: 2402532 - protein, 18 aa, Entamoeba dispar
TYLFLCKVSAQDDPCINR

SEQ ID NO: 2402533 - protein, 31 aa, Entamoeba dispar
TYLIIQSFLIKILYKGIYPFNSFQFDYLILS

SEQ ID NO: 2402534 - protein, 25 aa, Entamoeba dispar
TYLTDPIHMTIFDTLFVAITDLNSI

SEQ ID NO: 2402535 - protein, 22 aa, Entamoeba dispar
TYLYIFFIYLFVKMISHGIIII

SEQ ID NO: 2402536 - protein, 20 aa, Entamoeba dispar
TYMTLIAIFICEIIALILYL

SEQ ID NO: 2402537 - protein, 18 aa, Entamoeba dispar
TYPNQWLKYESSNQIIFK

SEQ ID NO: 2402538 - protein, 33 aa, Entamoeba dispar
TYSFFIWLGLIIASFLFIIWQFVPRKIAYSIGL

SEQ ID NO: 2402539 - protein, 27 aa, Entamoeba dispar
TYSLNKLLKVLFIFIRFNDSSLFNTSQ

SEQ ID NO: 2402540 - protein, 19 aa, Entamoeba dispar
TYTLQLIYEYNFDQTAHLG

SEQ ID NO: 2402541 - protein, 22 aa, Entamoeba dispar
TYTRSILTIICLFVSITSLILA

SEQ ID NO: 2402542 - protein, 25 aa, Entamoeba dispar
TYYLGTIFFLWDKLYFNHTIWHIIV

SEQ ID NO: 2402543 - protein, 20 aa, Entamoeba dispar
VAAKRIAWAKSINAGQICVC

SEQ ID NO: 2402544 - protein, 17 aa, Entamoeba dispar
VAFVKGLTICQIIETYY

SEQ ID NO: 2402545 - protein, 19 aa, Entamoeba dispar
VAIGCSGILLIIYPYCLPP

SEQ ID NO: 2402546 - protein, 29 aa, Entamoeba dispar
VAKEMFKLLILKFPTLPPIEIPSVTFIEM

SEQ ID NO: 2402547 - protein, 32 aa, Entamoeba dispar
VALFCLCFYWAGLFFVICFWIMFVITIAVIVV

SEQ ID NO: 2402548 - protein, 27 aa, Entamoeba dispar
VALTFAPLVLLFYSFYKYLFYEETPKQ

SEQ ID NO: 2402549 - protein, 24 aa, Entamoeba dispar
VALVLGIIFNFFEDSKTSESLLFD

SEQ ID NO: 2402550 - protein, 31 aa, Entamoeba dispar
VANGIFLIMYLKPVWWVCILISIYVIIVALS

SEQ ID NO: 2402551 - protein, 33 aa, Entamoeba dispar
VAQSFVPEFLRLPVWMLFLGIDVNLAYKRYNER

SEQ ID NO: 2402552 - protein, 31 aa, Entamoeba dispar
VAREVFIDIIFIVPLVGVLLFFIGAVCKCCC

SEQ ID NO: 2402553 - protein, 24 aa, Entamoeba dispar
VASMQHVFIVHLILCQLHSIALKN

SEQ ID NO: 2402554 - protein, 31 aa, Entamoeba dispar
VAVAIILIWPNTFFVLYISVAIWPFCTAFFW

SEQ ID NO: 2402555 - protein, 24 aa, Entamoeba dispar
VAWFIFAIGIIPLLFIVPSLLAMI

SEQ ID NO: 2402556 - protein, 31 aa, Entamoeba dispar
VCCLLYSIVPFILLLPFYQAQTLHGKAIRSI

SEQ ID NO: 2402557 - protein, 31 aa, Entamoeba dispar
VCESLSFVVRLLLLLDILIPGIVRERILIFV

SEQ ID NO: 2402558 - protein, 20 aa, Entamoeba dispar
VCFCYLIPFLSKNKNNKYKF

SEQ ID NO: 2402559 - protein, 21 aa, Entamoeba dispar
VCFEFIKFWHHALPLNEISQI

SEQ ID NO: 2402560 - protein, 21 aa, Entamoeba dispar
VCFFKMLYFFITAPLGVGFFR

SEQ ID NO: 2402561 - protein, 26 aa, Entamoeba dispar
VCGCALGFIGYGYGGPVYAGLGGAIG

SEQ ID NO: 2402562 - protein, 35 aa, Entamoeba dispar
VCGCCVILLIIILIIIGFIIYKFSHSIQLLLNDDT

SEQ ID NO: 2402563 - protein, 19 aa, Entamoeba dispar
VCGSKKSWYARHTGLKCIQ

SEQ ID NO: 2402564 - protein, 19 aa, Entamoeba dispar
VCIISPWNFPANLSLIPCA

SEQ ID NO: 2402565 - protein, 29 aa, Entamoeba dispar
VCKKDKAFMEFIYSELDLLDNEKLYPLDE

SEQ ID NO: 2402566 - protein, 21 aa, Entamoeba dispar
VCLNFPFIIPKSVKFLNRISV

SEQ ID NO: 2402567 - protein, 24 aa, Entamoeba dispar
VCQIQIPPLFPTVLNITAFGKCEL

SEQ ID NO: 2402568 - protein, 24 aa, Entamoeba dispar
VCQRWLGMRIELIGCIGLGAVVIF

SEQ ID NO: 2402569 - protein, 17 aa, Entamoeba dispar
VCSIFSLAPLSLGEKFF

SEQ ID NO: 2402570 - protein, 36 aa, Entamoeba dispar
VCTVNIIAVILISLIIFISVSAILLGIIIYTGIAIN

SEQ ID NO: 2402571 - protein, 23 aa, Entamoeba dispar
VCVKCFGPYKPINGTCTETIAQI

SEQ ID NO: 2402572 - protein, 17 aa, Entamoeba dispar
VCYETIPCWWSNKITDI

SEQ ID NO: 2402573 - protein, 18 aa, Entamoeba dispar
VDAIPFWDAIRNCLDSDA

SEQ ID NO: 2402574 - protein, 20 aa, Entamoeba dispar
VDFLNVLRDSSILFRANSVE

SEQ ID NO: 2402575 - protein, 25 aa, Entamoeba dispar
VDGDPVFFMSLEFGKCYYLDDSESE

SEQ ID NO: 2402576 - protein, 19 aa, Entamoeba dispar
VDGLDGIIFPFTCGKANNL

SEQ ID NO: 2402577 - protein, 23 aa, Entamoeba dispar
VDIMFPVVWNLYYGINDSSPHGA

SEQ ID NO: 2402578 - protein, 25 aa, Entamoeba dispar
VDKALYIIYSIYLMIAFRPKKVISL

SEQ ID NO: 2402579 - protein, 18 aa, Entamoeba dispar
VDLYYMKASGCYSGGDNC

SEQ ID NO: 2402580 - protein, 18 aa, Entamoeba dispar
VDMLLSILIDLQGLLTVA

SEQ ID NO: 2402581 - protein, 27 aa, Entamoeba dispar
VDMMKPYTYGYWFNITFEKASKIMIEV

SEQ ID NO: 2402582 - protein, 24 aa, Entamoeba dispar
VDMRETIWLLHDRELYLYSLVSET

SEQ ID NO: 2402583 - protein, 17 aa, Entamoeba dispar
VDNFQFAAVPFPPTSSS

SEQ ID NO: 2402584 - protein, 25 aa, Entamoeba dispar
VDPEYGFVTLLLGTLISLLLSHVMV

SEQ ID NO: 2402585 - protein, 21 aa, Entamoeba dispar
VDSLVLLGLDMKKGKQYEARI

SEQ ID NO: 2402586 - protein, 17 aa, Entamoeba dispar
VDYLGIIPYIIEALKSI

SEQ ID NO: 2402587 - protein, 17 aa, Entamoeba dispar
VDYLPADKQFLITRNIR

SEQ ID NO: 2402588 - protein, 27 aa, Entamoeba dispar
VECFLRLILMLLLSILLKTRDYVFKPL

SEQ ID NO: 2402589 - protein, 21 aa, Entamoeba dispar
VEDLWCFTPGLFPLIRSGATD

SEQ ID NO: 2402590 - protein, 23 aa, Entamoeba dispar
VEHDITLFNLAFAEQINVNDDVK

SEQ ID NO: 2402591 - protein, 24 aa, Entamoeba dispar
VEKGKLIVPTSGYYTLFMKADDLG

SEQ ID NO: 2402592 - protein, 24 aa, Entamoeba dispar
VEKQPKFKKVLFGAGYWIKRKCYV

SEQ ID NO: 2402593 - protein, 28 aa, Entamoeba dispar
VENKLTFLLLFVLILFNNPFFSYEYVFA

SEQ ID NO: 2402594 - protein, 30 aa, Entamoeba dispar
VENVMKYSWILFTILFKGIVMMINSGKKLD

SEQ ID NO: 2402595 - protein, 23 aa, Entamoeba dispar
VEQLLNAQLFLRVTIPPPSVDSK

SEQ ID NO: 2402596 - protein, 24 aa, Entamoeba dispar
VEQTLIPLIITKTGEWVYPLPIEE

SEQ ID NO: 2402597 - protein, 19 aa, Entamoeba dispar
VERYFWKLLNVTCQMIQES

SEQ ID NO: 2402598 - protein, 28 aa, Entamoeba dispar
VESIQQYFKLVIGTLYLNNNIDVGKYCE

SEQ ID NO: 2402599 - protein, 28 aa, Entamoeba dispar
VESQTFGCMFLLIDLMRNWFLSSNDNLP

SEQ ID NO: 2402600 - protein, 19 aa, Entamoeba dispar
VEYIKRGALHISYYDLNVY

SEQ ID NO: 2402601 - protein, 18 aa, Entamoeba dispar
VEYLGCEVIYNPESKLCE

SEQ ID NO: 2402602 - protein, 17 aa, Entamoeba dispar
VFAGKYIPFLNAPCGFV

SEQ ID NO: 2402603 - protein, 19 aa, Entamoeba dispar
VFCSPHILTDKPVIEFYGD

SEQ ID NO: 2402604 - protein, 17 aa, Entamoeba dispar
VFDEQLTNPPPPPPLMQ

SEQ ID NO: 2402605 - protein, 18 aa, Entamoeba dispar
VFDRGYLTTSKIIRDVKP

SEQ ID NO: 2402606 - protein, 31 aa, Entamoeba dispar
VFDTVIPFNGTLPPYIAFTTKDYKSCPNTFN

SEQ ID NO: 2402607 - protein, 26 aa, Entamoeba dispar
VFEQKGYLQLLMFSAKLINFQASYSN

SEQ ID NO: 2402608 - protein, 27 aa, Entamoeba dispar
VFERIFSNWYFLGICAGICVCQIIIVQ

SEQ ID NO: 2402609 - protein, 21 aa, Entamoeba dispar
VFEYPFHAPYVFFKLDSTLCN

SEQ ID NO: 2402610 - protein, 19 aa, Entamoeba dispar
VFFITKRYTILNFIALFFS

SEQ ID NO: 2402611 - protein, 18 aa, Entamoeba dispar
VFFTIWMASQTLVTITTP

SEQ ID NO: 2402612 - protein, 19 aa, Entamoeba dispar
VFGLTIILSFEIIPELNEL

SEQ ID NO: 2402613 - protein, 31 aa, Entamoeba dispar
VFGPFYSMLLMFCIGIFWIIVGTLILISSES

SEQ ID NO: 2402614 - protein, 20 aa, Entamoeba dispar
VFGPHQFPEKLIPKFITLLD

SEQ ID NO: 2402615 - protein, 32 aa, Entamoeba dispar
VFGPHQFPEKLIPKFITLLDRGQNCPIHGSGE

SEQ ID NO: 2402616 - protein, 18 aa, Entamoeba dispar
VFHALFRMRLIDMRHRVL

SEQ ID NO: 2402617 - protein, 39 aa, Entamoeba dispar
VFHTTLCSKTFLIWVTKDRPYLYLYQEKNDKEKKEIWIN

SEQ ID NO: 2402618 - protein, 24 aa, Entamoeba dispar
VFIAYFWFFLTLLEAVGLFLLIAP

SEQ ID NO: 2402619 - protein, 28 aa, Entamoeba dispar
VFIEQRWLRFITIIIYILLGLTALGMMG

SEQ ID NO: 2402620 - protein, 34 aa, Entamoeba dispar
VFIIKQIRHSWVIKVIFRIISAPWKKVYFKDFWM

SEQ ID NO: 2402621 - protein, 17 aa, Entamoeba dispar
VFIISLLLFITAVVFII

SEQ ID NO: 2402622 - protein, 18 aa, Entamoeba dispar
VFKNIYFFITAPLGICLF

SEQ ID NO: 2402623 - protein, 29 aa, Entamoeba dispar
VFLAARIVALYFYNKFLTTWGRSIRPKLG

SEQ ID NO: 2402624 - protein, 28 aa, Entamoeba dispar
VFLENVFYLLMKMNTFITIFVGFAIWAM

SEQ ID NO: 2402625 - protein, 19 aa, Entamoeba dispar
VFLQLDFYIYIIAIALVSG

SEQ ID NO: 2402626 - protein, 18 aa, Entamoeba dispar
VFMFPSIVPFLFFSVSII

SEQ ID NO: 2402627 - protein, 31 aa, Entamoeba dispar
VFMITLFFLIFYWAGLFFVVCFWIMFVVAIL

SEQ ID NO: 2402628 - protein, 25 aa, Entamoeba dispar
VFNIIIVFIFIIVLSILLFDGYDAS

SEQ ID NO: 2402629 - protein, 23 aa, Entamoeba dispar
VFNSVPFDRLLITKMAQFCTKRF

SEQ ID NO: 2402630 - protein, 24 aa, Entamoeba dispar
VFPLMKYWFINKQKKSYLLPSEML

SEQ ID NO: 2402631 - protein, 20 aa, Entamoeba dispar
VFRDILMRFVVYFSTRAETK

SEQ ID NO: 2402632 - protein, 23 aa, Entamoeba dispar
VFSHPVLYLHQTTMYILSGKFVT

SEQ ID NO: 2402633 - protein, 23 aa, Entamoeba dispar
VFSIVCLLISKPLLTIKKMESLL

SEQ ID NO: 2402634 - protein, 25 aa, Entamoeba dispar
VFSPLKWQHLLVPFLPIKYTELTET

SEQ ID NO: 2402635 - protein, 24 aa, Entamoeba dispar
VFSYAICLLEIWLGRSPYSPIKFP

SEQ ID NO: 2402636 - protein, 19 aa, Entamoeba dispar
VFTCIAYFNAIRRPFMNFG

SEQ ID NO: 2402637 - protein, 20 aa, Entamoeba dispar
VFTLFLILLTVVFNPYVIFV

SEQ ID NO: 2402638 - protein, 22 aa, Entamoeba dispar
VFTPNNPWIQPLLQFVCETSLS

SEQ ID NO: 2402639 - protein, 34 aa, Entamoeba dispar
VFVHGDFLPITLFGYFYIFFATIRALYLSIIVAW

SEQ ID NO: 2402640 - protein, 36 aa, Entamoeba dispar
VFVHGDFLPITLFGYFYIFFATLRALYLSIIVAWKT

SEQ ID NO: 2402641 - protein, 17 aa, Entamoeba dispar
VFVNVFYARSNEWTENN

SEQ ID NO: 2402642 - protein, 20 aa, Entamoeba dispar
VFVQFTYIETQYPKYSLRIV

SEQ ID NO: 2402643 - protein, 37 aa, Entamoeba dispar
VFVTRAYLRKFYLGRIPYLYFIIFATLTGVVTAPWKN

SEQ ID NO: 2402644 - protein, 17 aa, Entamoeba dispar
VFYFMFVVMVHSLWYKW

SEQ ID NO: 2402645 - protein, 26 aa, Entamoeba dispar
VGALFLNFVYLFLRMPFHSFMFHLHL

SEQ ID NO: 2402646 - protein, 17 aa, Entamoeba dispar
VGFVIILGLIAGGVYYW

SEQ ID NO: 2402647 - protein, 25 aa, Entamoeba dispar
VGGFLVIGIILAIIVIIGIIVHKKH

SEQ ID NO: 2402648 - protein, 34 aa, Entamoeba dispar
VGGIILSFYIMLNWFMTLLEYLSIMSGKAAPQEF

SEQ ID NO: 2402649 - protein, 17 aa, Entamoeba dispar
VGISFMESYRYKYSYDE

SEQ ID NO: 2402650 - protein, 42 aa, Entamoeba dispar
VGIYLFIFRTFIFKTWIFEVKWTFILLIILVIQNNPIYSYQY

SEQ ID NO: 2402651 - protein, 28 aa, Entamoeba dispar
VGKILMPAISFFPWLIKDKWDNLNEIKQ

SEQ ID NO: 2402652 - protein, 53 aa, Entamoeba dispar
VGLKKKYLPVYVVVSPPLLLVFQSQDDYKKIKPFAILNLLNITVKLSDHHENT

SEQ ID NO: 2402653 - protein, 23 aa, Entamoeba dispar
VGQEPILFAGTIRENIILGTREG

SEQ ID NO: 2402654 - protein, 26 aa, Entamoeba dispar
VGQNKFMNFVIFFHSVLQPNNEIKEH

SEQ ID NO: 2402655 - protein, 26 aa, Entamoeba dispar
VGRRTWILLIFAFIALAINIVGMILW

SEQ ID NO: 2402656 - protein, 28 aa, Entamoeba dispar
VGVLIIPLIIIVYFFFCYKTIPHFHSLF

SEQ ID NO: 2402657 - protein, 22 aa, Entamoeba dispar
VGYIALIIFISYFGFIQSLFLK

SEQ ID NO: 2402658 - protein, 26 aa, Entamoeba dispar
VGYICVLIAILFFGSNWIVVKKFPAG

SEQ ID NO: 2402659 - protein, 22 aa, Entamoeba dispar
VGYLGIIYYPSFFSLLSQFKFF

SEQ ID NO: 2402660 - protein, 18 aa, Entamoeba dispar
VHFYGAVMIPNKLCLVTE

SEQ ID NO: 2402661 - protein, 37 aa, Entamoeba dispar
VHIQGFIFMMVMYSLISTLLYLRVLPSIKDLFESSYD

SEQ ID NO: 2402662 - protein, 20 aa, Entamoeba dispar
VHLLLFVLMSLSSAIIGITQ

SEQ ID NO: 2402663 - protein, 19 aa, Entamoeba dispar
VHNDIQFCFYGMHPQTKRA

SEQ ID NO: 2402664 - protein, 18 aa, Entamoeba dispar
VHPCSYVYSIVNWPEVAT

SEQ ID NO: 2402665 - protein, 19 aa, Entamoeba dispar
VHSMPTFILFKNGQEYDRF

SEQ ID NO: 2402666 - protein, 19 aa, Entamoeba dispar
VHYLIKQMKMFNTNPLIAF

SEQ ID NO: 2402667 - protein, 34 aa, Entamoeba dispar
VIAKSVILLGELLYLAGLLLPQRHLSLQKLFATA

SEQ ID NO: 2402668 - protein, 18 aa, Entamoeba dispar
VIAPILYTSSFIGVLFFF

SEQ ID NO: 2402669 - protein, 25 aa, Entamoeba dispar
VIATSPILVLILFGDYKFNSMQSSP

SEQ ID NO: 2402670 - protein, 26 aa, Entamoeba dispar
VICFIVSCILFIYPALHFIDVFFNHY

SEQ ID NO: 2402671 - protein, 29 aa, Entamoeba dispar
VICIGIHFTLWWYNIIPSDPMYFFVVCIE

SEQ ID NO: 2402672 - protein, 20 aa, Entamoeba dispar
VICMAPIRRYHKIWSCPRCF

SEQ ID NO: 2402673 - protein, 27 aa, Entamoeba dispar
VIDSIEIQFALPSFFIITGKSKNELKV

SEQ ID NO: 2402674 - protein, 22 aa, Entamoeba dispar
VIEDYPELNYNAKVAQYFSFTS

SEQ ID NO: 2402675 - protein, 39 aa, Entamoeba dispar
VIFGTCLMFIGLILLIFLLCWPETLVYWERNKCFAMQSS

SEQ ID NO: 2402676 - protein, 17 aa, Entamoeba dispar
VIFLFRGFSVFATLLPN

SEQ ID NO: 2402677 - protein, 28 aa, Entamoeba dispar
VIFLSILCFIIYIPTYFVYGQSEPKFQL

SEQ ID NO: 2402678 - protein, 29 aa, Entamoeba dispar
VIFTLFVLFKRYLLYTKRNYIEYIQIILM

SEQ ID NO: 2402679 - protein, 25 aa, Entamoeba dispar
VIGGFIPFFIKFLPNRKLAGEILDV

SEQ ID NO: 2402680 - protein, 26 aa, Entamoeba dispar
VIGSFVIFISWIYHKIWKYYERFGYQ

SEQ ID NO: 2402681 - protein, 24 aa, Entamoeba dispar
VIGVLVVVLVIVSVIIIIVIIVTL

SEQ ID NO: 2402682 - protein, 25 aa, Entamoeba dispar
VIGYIIRYAILIFPIVNILNEYPLV

SEQ ID NO: 2402683 - protein, 24 aa, Entamoeba dispar
VIHALPYLGYFLSDVTFINDGNVS

SEQ ID NO: 2402684 - protein, 21 aa, Entamoeba dispar
VIIEDIDIPPFYMGISATNGG

SEQ ID NO: 2402685 - protein, 24 aa, Entamoeba dispar
VIIEQLCHIIWHTLLKQSEYRWCS

SEQ ID NO: 2402686 - protein, 22 aa, Entamoeba dispar
VIIFIYIAIVRIMAFCLGYFHI

SEQ ID NO: 2402687 - protein, 17 aa, Entamoeba dispar
VIIKHIIIDPKCISRYF

SEQ ID NO: 2402688 - protein, 18 aa, Entamoeba dispar
VIILGTKSERVYPCDSGY

SEQ ID NO: 2402689 - protein, 25 aa, Entamoeba dispar
VIISLIICYFINKTSYRFGFPYQYS

SEQ ID NO: 2402690 - protein, 18 aa, Entamoeba dispar
VIKKTFILSPFGNTFING

SEQ ID NO: 2402691 - protein, 18 aa, Entamoeba dispar
VILFVILDFLRIQFAPNG

SEQ ID NO: 2402692 - protein, 17 aa, Entamoeba dispar
VILITGGAGFIASHIVI

SEQ ID NO: 2402693 - protein, 20 aa, Entamoeba dispar
VILLNGKLRFGNIYGFSIIA

SEQ ID NO: 2402694 - protein, 26 aa, Entamoeba dispar
VILNILLIIIFLLQSLSYFVTIYEDI

SEQ ID NO: 2402695 - protein, 20 aa, Entamoeba dispar
VILNTFFFPSIAVLAIAGII

SEQ ID NO: 2402696 - protein, 20 aa, Entamoeba dispar
VILNTFFFPSISIIFGLLII

SEQ ID NO: 2402697 - protein, 20 aa, Entamoeba dispar
VINLYQNATFLSGSVLFDGC

SEQ ID NO: 2402698 - protein, 23 aa, Entamoeba dispar
VINSMLMLLTPPSIDFVKNHNES

SEQ ID NO: 2402699 - protein, 20 aa, Entamoeba dispar
VIPFAYYWYKFFGYQPGLIL

SEQ ID NO: 2402700 - protein, 31 aa, Entamoeba dispar
VIPFWILWSGLIVLNLFILIVTITSACLLGN

SEQ ID NO: 2402701 - protein, 24 aa, Entamoeba dispar
VIPHIFLIFVSLFLCLLRGGEVIK

SEQ ID NO: 2402702 - protein, 17 aa, Entamoeba dispar
VIRGIKIYFGKKVPKQI

SEQ ID NO: 2402703 - protein, 20 aa, Entamoeba dispar
VISAIITLLLLLVKKAPKIN

SEQ ID NO: 2402704 - protein, 30 aa, Entamoeba dispar
VISIIIIILLFIGILLLYRVLPTIITYLNL

SEQ ID NO: 2402705 - protein, 26 aa, Entamoeba dispar
VISQEYMIMMLLIYNSFKEENKKKFI

SEQ ID NO: 2402706 - protein, 29 aa, Entamoeba dispar
VISYRDMFRFIIFFIKQKLGKIDAKETFM

SEQ ID NO: 2402707 - protein, 27 aa, Entamoeba dispar
VITEFFGFILLVVILCDLYLLHKREIH

SEQ ID NO: 2402708 - protein, 25 aa, Entamoeba dispar
VITENTYIDLPLLPVSWNCFNSKFR

SEQ ID NO: 2402709 - protein, 20 aa, Entamoeba dispar
VITFLRFFFTPYRTIVLKRF

SEQ ID NO: 2402710 - protein, 24 aa, Entamoeba dispar
VITFNKMFLYPINDLNFTECPIGT

SEQ ID NO: 2402711 - protein, 17 aa, Entamoeba dispar
VITIQPRYPLLGGWSTS

SEQ ID NO: 2402712 - protein, 23 aa, Entamoeba dispar
VITKIFIYNVLLKQKSIIMNIKK

SEQ ID NO: 2402713 - protein, 24 aa, Entamoeba dispar
VITKPMFCLLLLIFVITSIDLNTH

SEQ ID NO: 2402714 - protein, 18 aa, Entamoeba dispar
VITLAIVFAGKYIPFLNA

SEQ ID NO: 2402715 - protein, 25 aa, Entamoeba dispar
VITRNRFIHIYTTDGNLVVLDDTYS

SEQ ID NO: 2402716 - protein, 17 aa, Entamoeba dispar
VIVLNYSINTISNNLKI

SEQ ID NO: 2402717 - protein, 27 aa, Entamoeba dispar
VIVMEKLHRQVLPFILRRLKESVLQDL

SEQ ID NO: 2402718 - protein, 25 aa, Entamoeba dispar
VIVSILLCLYPIKKIRYSYALIFLI

SEQ ID NO: 2402719 - protein, 22 aa, Entamoeba dispar
VIYKLYDIYLIDDVLSAVDPHV

SEQ ID NO: 2402720 - protein, 32 aa, Entamoeba dispar
VIYLLVIFLGVSFGLITLLYTYQRTLIQTSFL

SEQ ID NO: 2402721 - protein, 18 aa, Entamoeba dispar
VIYPMKKGETVYIFVGGM

SEQ ID NO: 2402722 - protein, 17 aa, Entamoeba dispar
VKAIPYNYFVTMNTLRS

SEQ ID NO: 2402723 - protein, 33 aa, Entamoeba dispar
VKDSFDYWSLIKNPMIIMALVSLGLIGFSKLSM

SEQ ID NO: 2402724 - protein, 20 aa, Entamoeba dispar
VKDTSVFIDIPRLAPKVQIF

SEQ ID NO: 2402725 - protein, 17 aa, Entamoeba dispar
VKFIPNIFDGNSLVFSP

SEQ ID NO: 2402726 - protein, 19 aa, Entamoeba dispar
VKFKFLCTCFVNEIVDVLA

SEQ ID NO: 2402727 - protein, 23 aa, Entamoeba dispar
VKFLYIFIPFFFLELSIVFFNLA

SEQ ID NO: 2402728 - protein, 25 aa, Entamoeba dispar
VKGENLLVFSLNPRSPVCAKLTDFG

SEQ ID NO: 2402729 - protein, 20 aa, Entamoeba dispar
VKGLTICQIIETYYNILFNA

SEQ ID NO: 2402730 - protein, 19 aa, Entamoeba dispar
VKGMLISNTLFRMGGAAIL

SEQ ID NO: 2402731 - protein, 21 aa, Entamoeba dispar
VKHYFAMLMFVNLLGCFSVVL

SEQ ID NO: 2402732 - protein, 35 aa, Entamoeba dispar
VKIELPKPILATWQFYAVLFTIIGVMTIAFYAFFK

SEQ ID NO: 2402733 - protein, 18 aa, Entamoeba dispar
VKISVWIICPIICLAVIL

SEQ ID NO: 2402734 - protein, 38 aa, Entamoeba dispar
VKKKFFRICLVVVIIILLSFLVGLIWCLCKEGKHKKAS

SEQ ID NO: 2402735 - protein, 18 aa, Entamoeba dispar
VKKLVLHDLPFDTARDFI

SEQ ID NO: 2402736 - protein, 27 aa, Entamoeba dispar
VKKQKELFIPAYYQFFNEMLGLNILQT

SEQ ID NO: 2402737 - protein, 20 aa, Entamoeba dispar
VKRLIKFIHLISFVNKVIDK

SEQ ID NO: 2402738 - protein, 23 aa, Entamoeba dispar
VKRYVPFALALTSIGKPKVGLLE

SEQ ID NO: 2402739 - protein, 18 aa, Entamoeba dispar
VKSLNKLYVYLDLNLESA

SEQ ID NO: 2402740 - protein, 20 aa, Entamoeba dispar
VKSYLAYSWIFDCPKGFFDK

SEQ ID NO: 2402741 - protein, 38 aa, Entamoeba dispar
VKTWNLWTLASFIISLVLFFIFMLLIVYCPGISIRDLS

SEQ ID NO: 2402742 - protein, 17 aa, Entamoeba dispar
VKVDIKFDLSKPAPPLP

SEQ ID NO: 2402743 - protein, 27 aa, Entamoeba dispar
VKVEGKILFLIDGLTIKPIPLTKTMKL

SEQ ID NO: 2402744 - protein, 48 aa, Entamoeba dispar
VKVGDYTFTIRIFPHKYCWREGDDLYINIKGCDFFTHPSGKKFSVINE

SEQ ID NO: 2402745 - protein, 34 aa, Entamoeba dispar
VKVVNRIIFKLDNLVRPFTAKLLVVITPLLDDAD

SEQ ID NO: 2402746 - protein, 21 aa, Entamoeba dispar
VLAHFLGIFLSSTFYFICYII

SEQ ID NO: 2402747 - protein, 24 aa, Entamoeba dispar
VLDSSYYILIKLFRMGTKKQTKSL

SEQ ID NO: 2402748 - protein, 32 aa, Entamoeba dispar
VLEEPQLLFVIRWFFSFLLDPMNSVILSKLTG

SEQ ID NO: 2402749 - protein, 17 aa, Entamoeba dispar
VLELFVMLFERIGDDRI

SEQ ID NO: 2402750 - protein, 42 aa, Entamoeba dispar
VLERFGAKGIMISLLVVAVCGLLLIFGMIIVKFAKRNNNEYN

SEQ ID NO: 2402751 - protein, 20 aa, Entamoeba dispar
VLFSDFLVYCSDNKIVDGLT

SEQ ID NO: 2402752 - protein, 18 aa, Entamoeba dispar
VLGEEILNWARKTSFLEC

SEQ ID NO: 2402753 - protein, 24 aa, Entamoeba dispar
VLGIFFEWHIPLKYLWPSIRVVLY

SEQ ID NO: 2402754 - protein, 18 aa, Entamoeba dispar
VLHKQLMFNLKSKFIDKQ

SEQ ID NO: 2402755 - protein, 19 aa, Entamoeba dispar
VLHPIFLKIVFALDDLLNY

SEQ ID NO: 2402756 - protein, 17 aa, Entamoeba dispar
VLHYLQFKWNHHKQGIL

SEQ ID NO: 2402757 - protein, 18 aa, Entamoeba dispar
VLIHIFDLVDVPVSLIIC

SEQ ID NO: 2402758 - protein, 18 aa, Entamoeba dispar
VLIIIGWLSKLFDSNREL

SEQ ID NO: 2402759 - protein, 23 aa, Entamoeba dispar
VLIMLLNNLKVLDRQLRVCTTIA

SEQ ID NO: 2402760 - protein, 34 aa, Entamoeba dispar
VLITIIFVLPLWFHRVFYWISIIGAILFILYSLI

SEQ ID NO: 2402761 - protein, 18 aa, Entamoeba dispar
VLIYPQYYEILIKNVEYQ

SEQ ID NO: 2402762 - protein, 21 aa, Entamoeba dispar
VLKRMFWGLIPFFGNFFKQTE

SEQ ID NO: 2402763 - protein, 17 aa, Entamoeba dispar
VLLFAIYTLAQQTVRPS

SEQ ID NO: 2402764 - protein, 19 aa, Entamoeba dispar
VLLPLCVIVYFLPVKVING

SEQ ID NO: 2402765 - protein, 23 aa, Entamoeba dispar
VLLSVMFFYDIFWVFGSVNVSLF

SEQ ID NO: 2402766 - protein, 17 aa, Entamoeba dispar
VLLSYLHYSIEKEWFSL

SEQ ID NO: 2402767 - protein, 26 aa, Entamoeba dispar
VLLYIIFIPIILWAVCRFAFKIKNPL

SEQ ID NO: 2402768 - protein, 29 aa, Entamoeba dispar
VLMEFYIFIVFIWIFFQVDHLRFLAIKEK

SEQ ID NO: 2402769 - protein, 26 aa, Entamoeba dispar
VLNSYQRLPFTIPKEIYRLVDKLLSL

SEQ ID NO: 2402770 - protein, 17 aa, Entamoeba dispar
VLPLRKEAEKYIQAIMG

SEQ ID NO: 2402771 - protein, 29 aa, Entamoeba dispar
VLQKISTYYLKDYLIWGKSMIISAIKQIQ

SEQ ID NO: 2402772 - protein, 26 aa, Entamoeba dispar
VLRAIGIGKFLLLRIYLAESFVVIFS

SEQ ID NO: 2402773 - protein, 17 aa, Entamoeba dispar
VLRKSYIPWISLVRIIY

SEQ ID NO: 2402774 - protein, 20 aa, Entamoeba dispar
VLSHFLGIFISSTLYFICYA

SEQ ID NO: 2402775 - protein, 29 aa, Entamoeba dispar
VLSMDNMYSAWNPQLLISIKTPQSVNAVN

SEQ ID NO: 2402776 - protein, 27 aa, Entamoeba dispar
VLSSLLSLPLMKLIKVTSLSLTLTDHQ

SEQ ID NO: 2402777 - protein, 17 aa, Entamoeba dispar
VLSWFSLLPIDSYPDDI

SEQ ID NO: 2402778 - protein, 21 aa, Entamoeba dispar
VLTIIFVGGLYYANCILDPRS

SEQ ID NO: 2402779 - protein, 24 aa, Entamoeba dispar
VLTNFFGILFPFIKVHFPIISRVT

SEQ ID NO: 2402780 - protein, 19 aa, Entamoeba dispar
VLTTYIFVIIWNIFITFFA

SEQ ID NO: 2402781 - protein, 46 aa, Entamoeba dispar
VLTVVFVLLLNLLSSILFMPLLIILSYIYISIIIFYIDSSQNLQRL

SEQ ID NO: 2402782 - protein, 17 aa, Entamoeba dispar
VLVLPGLIAFHLYQDLP

SEQ ID NO: 2402783 - protein, 24 aa, Entamoeba dispar
VLVVIPICNLIIILSISFGTLYPV

SEQ ID NO: 2402784 - protein, 42 aa, Entamoeba dispar
VLVYSIVCIINISLALFFLWKVILVVIFFILQVSYGCVKGSF

SEQ ID NO: 2402785 - protein, 26 aa, Entamoeba dispar
VLWVLHAYWFYLIIQIIVVAIKNKGR

SEQ ID NO: 2402786 - protein, 34 aa, Entamoeba dispar
VLYRTYFLGYLIPLFLYLWLSYYPPHLSYQNTMN

SEQ ID NO: 2402787 - protein, 17 aa, Entamoeba dispar
VLYVFGGSLDKTCECKP

SEQ ID NO: 2402788 - protein, 18 aa, Entamoeba dispar
VLYYLRWKSSFPIPDHLT

SEQ ID NO: 2402789 - protein, 19 aa, Entamoeba dispar
VMCMNYIYCILRDSQQAEN

SEQ ID NO: 2402790 - protein, 27 aa, Entamoeba dispar
VMDDHSLFFGILSMELTTINQIFYNGT

SEQ ID NO: 2402791 - protein, 23 aa, Entamoeba dispar
VMEAIFIMVFQEATYRTLIVWDL

SEQ ID NO: 2402792 - protein, 23 aa, Entamoeba dispar
VMENEFYIYLISTSKIVTIEKKN

SEQ ID NO: 2402793 - protein, 17 aa, Entamoeba dispar
VMKTFTQALFAAAVEYL

SEQ ID NO: 2402794 - protein, 18 aa, Entamoeba dispar
VMMIIQIVLMTWIGSMFD

SEQ ID NO: 2402795 - protein, 23 aa, Entamoeba dispar
VMPPIGEGAFGLVFRGTYRGQDV

SEQ ID NO: 2402796 - protein, 42 aa, Entamoeba dispar
VMSVMSFSTFWVYLRSLFLLFQFFYLMFLITLGLSAQPYVNW

SEQ ID NO: 2402797 - protein, 20 aa, Entamoeba dispar
VMSWKDIFLYLIDMIQHKLN

SEQ ID NO: 2402798 - protein, 21 aa, Entamoeba dispar
VMTCFFLIMEPRIFTRLMTQN

SEQ ID NO: 2402799 - protein, 30 aa, Entamoeba dispar
VMTIISIFCFLISLIAFVYQFVFFGETDRD

SEQ ID NO: 2402800 - protein, 25 aa, Entamoeba dispar
VMTNYLLHLFSLFCYPGTCPLLKFI

SEQ ID NO: 2402801 - protein, 26 aa, Entamoeba dispar
VNAYGYYLGIYFMKKIINYKQDVPNF

SEQ ID NO: 2402802 - protein, 24 aa, Entamoeba dispar
VNCECDVGYFYSTYMRQCYPQIGQ

SEQ ID NO: 2402803 - protein, 21 aa, Entamoeba dispar
VNELVLNGLTLHTFSPSDGIT

SEQ ID NO: 2402804 - protein, 25 aa, Entamoeba dispar
VNFMAKFFCNVPSTLCSYIVDTFTT

SEQ ID NO: 2402805 - protein, 29 aa, Entamoeba dispar
VNGEENTYFLAWTTTPWTLPSNLALCVNP

SEQ ID NO: 2402806 - protein, 23 aa, Entamoeba dispar
VNIVIRVIMPFLILLNIALFITS

SEQ ID NO: 2402807 - protein, 23 aa, Entamoeba dispar
VNKCLYLFTQLKLLNVPVRLTPS

SEQ ID NO: 2402808 - protein, 23 aa, Entamoeba dispar
VNKVISKLPLITTGSFSAYSVDK

SEQ ID NO: 2402809 - protein, 24 aa, Entamoeba dispar
VNLEAYIAARLFGSLFSKDQTLTR

SEQ ID NO: 2402810 - protein, 17 aa, Entamoeba dispar
VNQCDGQWLVAVPKGTN

SEQ ID NO: 2402811 - protein, 24 aa, Entamoeba dispar
VNQTIIPIPLPSLPWNCYNPTFIY

SEQ ID NO: 2402812 - protein, 23 aa, Entamoeba dispar
VNRLIIWLLYLIAISFCCLHALT

SEQ ID NO: 2402813 - protein, 27 aa, Entamoeba dispar
VNSLSYLLYFVVDAYGYYLGVSFLTRD

SEQ ID NO: 2402814 - protein, 25 aa, Entamoeba dispar
VNSPLYLYIILRLYNQDIQLAYIQN

SEQ ID NO: 2402815 - protein, 28 aa, Entamoeba dispar
VNYEIVNEIAFWYYQQLFEEKCYEYIEG

SEQ ID NO: 2402816 - protein, 17 aa, Entamoeba dispar
VNYYLKALTIFLTKNIL

SEQ ID NO: 2402817 - protein, 37 aa, Entamoeba dispar
VPCLITKFIFKLIFQVLFLFLAICLFVFISGIIPYAI

SEQ ID NO: 2402818 - protein, 23 aa, Entamoeba dispar
VPETIEFLIRGGIKVWMITGDKV

SEQ ID NO: 2402819 - protein, 18 aa, Entamoeba dispar
VPFDYVEFLFMPTREYMD

SEQ ID NO: 2402820 - protein, 22 aa, Entamoeba dispar
VPGIKYVIDQGLAKVLRSSSGA

SEQ ID NO: 2402821 - protein, 18 aa, Entamoeba dispar
VPKNFLPILVRETVLNIC

SEQ ID NO: 2402822 - protein, 18 aa, Entamoeba dispar
VPKNTYTLQLIYEYNFDQ

SEQ ID NO: 2402823 - protein, 23 aa, Entamoeba dispar
VPKSIPFLYSLTNKWNQIDFIYF

SEQ ID NO: 2402824 - protein, 46 aa, Entamoeba dispar
VPKVMIFYCMLFTGILIVTILTIIPVKFFSFCLLIGLLTIPQVLRS

SEQ ID NO: 2402825 - protein, 18 aa, Entamoeba dispar
VPLFIYYYDVYTNPFLMF

SEQ ID NO: 2402826 - protein, 20 aa, Entamoeba dispar
VPLSTLLVKCSGIIPLCVCQ

SEQ ID NO: 2402827 - protein, 25 aa, Entamoeba dispar
VPPVPLQYLTYDTALLWASENMSKN

SEQ ID NO: 2402828 - protein, 19 aa, Entamoeba dispar
VPSIKYFNTMFSTSSRRIC

SEQ ID NO: 2402829 - protein, 18 aa, Entamoeba dispar
VPVAIKIFRWENLTEEEM

SEQ ID NO: 2402830 - protein, 19 aa, Entamoeba dispar
VPVRLTPSCIHLLLLTLKD

SEQ ID NO: 2402831 - protein, 18 aa, Entamoeba dispar
VPYKPLIFGIFIGIFLGL

SEQ ID NO: 2402832 - protein, 25 aa, Entamoeba dispar
VQILDRIIYYLLPTTRQEYVFPSAL

SEQ ID NO: 2402833 - protein, 25 aa, Entamoeba dispar
VQIQLKVCSFLQPKHLFSLMQTNTH

SEQ ID NO: 2402834 - protein, 30 aa, Entamoeba dispar
VQKKSLIFILAYIAFSFVLLIVGIADTVMG

SEQ ID NO: 2402835 - protein, 38 aa, Entamoeba dispar
VQKRKLMLYWKKENTLFTYVLLFIGLLTVGMSIVMGNS

SEQ ID NO: 2402836 - protein, 25 aa, Entamoeba dispar
VQKRRKSMGPTQILEAALKNAKESK

SEQ ID NO: 2402837 - protein, 20 aa, Entamoeba dispar
VQLFALSFVSVIPYTALSLR

SEQ ID NO: 2402838 - protein, 30 aa, Entamoeba dispar
VQLNNFDIIYYLLLTWKRLIEITSIRSYPL

SEQ ID NO: 2402839 - protein, 19 aa, Entamoeba dispar
VQMMLLFSDFFCRTCSYGC

SEQ ID NO: 2402840 - protein, 22 aa, Entamoeba dispar
VQMVLACTLYRYLDNLFRYSYL

SEQ ID NO: 2402841 - protein, 22 aa, Entamoeba dispar
VQPYYDYPELLGLLIEVASNER

SEQ ID NO: 2402842 - protein, 25 aa, Entamoeba dispar
VQRIVAQYWSLLTNKYDTLVSNICI

SEQ ID NO: 2402843 - protein, 28 aa, Entamoeba dispar
VQVIPLLLQQTLQFFYPPFIDKIHEQDD

SEQ ID NO: 2402844 - protein, 22 aa, Entamoeba dispar
VQWYIVTRLLHLPSPPLYINFY

SEQ ID NO: 2402845 - protein, 17 aa, Entamoeba dispar
VRAFFLYQDISWIFPTL

SEQ ID NO: 2402846 - protein, 26 aa, Entamoeba dispar
VRAMMTTIVLFLSQNYYKFSNWREYI

SEQ ID NO: 2402847 - protein, 25 aa, Entamoeba dispar
VRAQVLKFFQRLFLNYQKCFKEVKP

SEQ ID NO: 2402848 - protein, 17 aa, Entamoeba dispar
VRCTIIMCSLGKVLEPS

SEQ ID NO: 2402849 - protein, 17 aa, Entamoeba dispar
VRFLFNTAFQFKKKFYV

SEQ ID NO: 2402850 - protein, 24 aa, Entamoeba dispar
VRGWKNFIFFGIGTFILIIGIVCI

SEQ ID NO: 2402851 - protein, 46 aa, Entamoeba dispar
VRIKVSIIRFIKTKKDIIVIILMLNQVFLFISCCLVGHCLAQTKYI

SEQ ID NO: 2402852 - protein, 18 aa, Entamoeba dispar
VRLMILFGKNTINANFVI

SEQ ID NO: 2402853 - protein, 37 aa, Entamoeba dispar
VRNISYWGWLFTLKQPLFYLMIIISIVITVLPQTVSI

SEQ ID NO: 2402854 - protein, 26 aa, Entamoeba dispar
VRQCIYKMMRWWFDKGIDGFRMDVIN

SEQ ID NO: 2402855 - protein, 43 aa, Entamoeba dispar
VRRSIVSLIIFIGGIIIWIFIWLLLLIGFISKYIFLNKLIISE

SEQ ID NO: 2402856 - protein, 23 aa, Entamoeba dispar
VRTTSAVLSIKHSPSDLYSCEDY

SEQ ID NO: 2402857 - protein, 17 aa, Entamoeba dispar
VSAPYKLSIEKLGSDSS

SEQ ID NO: 2402858 - protein, 19 aa, Entamoeba dispar
VSARGHHIAGVPQIPLVVN

SEQ ID NO: 2402859 - protein, 24 aa, Entamoeba dispar
VSCLIGFIPFFVMTRFPLVNNIKT

SEQ ID NO: 2402860 - protein, 52 aa, Entamoeba dispar
VSCRKVSVWLYWVLYLVTIIILYWIFLIITGFFIGLLYHRLNKIIKSDLENL

SEQ ID NO: 2402861 - protein, 23 aa, Entamoeba dispar
VSENLLLFYQNQSQLFASYSKKY

SEQ ID NO: 2402862 - protein, 27 aa, Entamoeba dispar
VSEQLPLYLIGFSIGGLIVSRIASDKK

SEQ ID NO: 2402863 - protein, 24 aa, Entamoeba dispar
VSEYWLGFYVRNYVIGLKGVKISF

SEQ ID NO: 2402864 - protein, 23 aa, Entamoeba dispar
VSFDNRIRFIQEVDYDDINKCKQ

SEQ ID NO: 2402865 - protein, 27 aa, Entamoeba dispar
VSFIFCIKMFNTPFLTYRLTPNWYQHQ

SEQ ID NO: 2402866 - protein, 17 aa, Entamoeba dispar
VSGKLIVLSPETLTKII

SEQ ID NO: 2402867 - protein, 24 aa, Entamoeba dispar
VSGLIYFFVTPFIDIQIHDSTYVN

SEQ ID NO: 2402868 - protein, 27 aa, Entamoeba dispar
VSGMTTLFLLLMTNLKIVIFSSHLSLL

SEQ ID NO: 2402869 - protein, 31 aa, Entamoeba dispar
VSGNDNYYYYYYYLPIQRTYFNSSPTNLIFS

SEQ ID NO: 2402870 - protein, 24 aa, Entamoeba dispar
VSGSSVFFFFNNEVSIILGTTKEK

SEQ ID NO: 2402871 - protein, 31 aa, Entamoeba dispar
VSIKELFRYAGVFEITLLIIGIIGSIGVGCL

SEQ ID NO: 2402872 - protein, 18 aa, Entamoeba dispar
VSIKIFSLIFCCISSIIT

SEQ ID NO: 2402873 - protein, 19 aa, Entamoeba dispar
VSINLPFTRTQNVPSAWPL

SEQ ID NO: 2402874 - protein, 18 aa, Entamoeba dispar
VSISFTALILIQLINVGF

SEQ ID NO: 2402875 - protein, 23 aa, Entamoeba dispar
VSISFTVLILIELLNIGFTIRRW

SEQ ID NO: 2402876 - protein, 28 aa, Entamoeba dispar
VSKYDNAIYFYVFPEELHILKYSKDFTH

SEQ ID NO: 2402877 - protein, 26 aa, Entamoeba dispar
VSLGVLVLMQYVLQGLFHPARHVREP

SEQ ID NO: 2402878 - protein, 37 aa, Entamoeba dispar
VSLNHLLVVIVISILIIGIIVLTLIFVILCIVKAKKK

SEQ ID NO: 2402879 - protein, 21 aa, Entamoeba dispar
VSMKLRIKFMLDSIKGIEYLH

SEQ ID NO: 2402880 - protein, 23 aa, Entamoeba dispar
VSPLLECPLLQTLVLSHNNIENI

SEQ ID NO: 2402881 - protein, 28 aa, Entamoeba dispar
VSPRFVLYFVFYLINLYLSFSKFADKRF

SEQ ID NO: 2402882 - protein, 27 aa, Entamoeba dispar
VSPSLIALLILYMFQFNNILNQLIQSS

SEQ ID NO: 2402883 - protein, 17 aa, Entamoeba dispar
VSQKAFVIYSQKHIYII

SEQ ID NO: 2402884 - protein, 29 aa, Entamoeba dispar
VSRITYMRKLFKMLQNIPPKLTAKGIVGL

SEQ ID NO: 2402885 - protein, 17 aa, Entamoeba dispar
VSSIKLFNGIQGYKYGI

SEQ ID NO: 2402886 - protein, 47 aa, Entamoeba dispar
VSSSHRYCEIAPVWWLIVIIILLSITLLIIIITLTGCIARMVLKKVV

SEQ ID NO: 2402887 - protein, 24 aa, Entamoeba dispar
VSSSIIYINLFIVSINSSLHISLY

SEQ ID NO: 2402888 - protein, 25 aa, Entamoeba dispar
VSTKTFLFMFTFDVMLTLLLAEVMH

SEQ ID NO: 2402889 - protein, 33 aa, Entamoeba dispar
VSVFMMFKYATWIEIIFNIIGVVISLCDGVLYP

SEQ ID NO: 2402890 - protein, 19 aa, Entamoeba dispar
VSWIWRIIVIIAFEFLEMS

SEQ ID NO: 2402891 - protein, 20 aa, Entamoeba dispar
VTDEAYLVYGPKGSILNVPQ

SEQ ID NO: 2402892 - protein, 22 aa, Entamoeba dispar
VTEYWIEYFFFPNLKTCPYIYI

SEQ ID NO: 2402893 - protein, 17 aa, Entamoeba dispar
VTFLLFNTGIETFFICF

SEQ ID NO: 2402894 - protein, 18 aa, Entamoeba dispar
VTFTIYLIYAYRKTVHHL

SEQ ID NO: 2402895 - protein, 28 aa, Entamoeba dispar
VTGQIDISSLFIGPLKADSLNAGSISGN

SEQ ID NO: 2402896 - protein, 30 aa, Entamoeba dispar
VTGTSLIVFTIFIIISFPLINLNKLNHKEY

SEQ ID NO: 2402897 - protein, 21 aa, Entamoeba dispar
VTILISLLYIGVFAFIGIFCG

SEQ ID NO: 2402898 - protein, 20 aa, Entamoeba dispar
VTIPYKLLYKEVKGALKNSI

SEQ ID NO: 2402899 - protein, 18 aa, Entamoeba dispar
VTKVLKECGCAILVGFDG

SEQ ID NO: 2402900 - protein, 21 aa, Entamoeba dispar
VTKYIIEWIGYIRYNDPEIYN

SEQ ID NO: 2402901 - protein, 18 aa, Entamoeba dispar
VTLYYLKGDSYATANIDL

SEQ ID NO: 2402902 - protein, 23 aa, Entamoeba dispar
VTQQNFVMIFSFNTKLEEKTMSF

SEQ ID NO: 2402903 - protein, 22 aa, Entamoeba dispar
VTRSPIFIHFDQTLLGLATVRT

SEQ ID NO: 2402904 - protein, 28 aa, Entamoeba dispar
VTSILYSIPIIILYISYKTWYSFLDVSN

SEQ ID NO: 2402905 - protein, 29 aa, Entamoeba dispar
VTSILYSIPIIILYISYKTWYSFLDVSNG

SEQ ID NO: 2402906 - protein, 29 aa, Entamoeba dispar
VTVCCFLLFFIIIAIIGVLLAYYMKSKEQ

SEQ ID NO: 2402907 - protein, 24 aa, Entamoeba dispar
VTVSLPNYYYQLSLSANNYIIRNN

SEQ ID NO: 2402908 - protein, 37 aa, Entamoeba dispar
VTYFITIVAIPFLHHIMLLILWTVPITRKIQNIIFQF

SEQ ID NO: 2402909 - protein, 18 aa, Entamoeba dispar
VVALGLLFSPNGWIVMIF

SEQ ID NO: 2402910 - protein, 17 aa, Entamoeba dispar
VVALLLGILKCSPEGRK

SEQ ID NO: 2402911 - protein, 24 aa, Entamoeba dispar
VVDAYGYYLGTYFLAKKLNYKQTS

SEQ ID NO: 2402912 - protein, 31 aa, Entamoeba dispar
VVDVAVEYCWFFFDVIIKSLTLYLEELGIFD

SEQ ID NO: 2402913 - protein, 38 aa, Entamoeba dispar
VVEKYGYIFVFILFFILLLPFLVIPVVIWMNKMGCRKK

SEQ ID NO: 2402914 - protein, 25 aa, Entamoeba dispar
VVFNPYVIFVMSFIAGLAAGFSYQT

SEQ ID NO: 2402915 - protein, 29 aa, Entamoeba dispar
VVFSNINRKWYFAPRKISNIAYNETYDNL

SEQ ID NO: 2402916 - protein, 19 aa, Entamoeba dispar
VVGGLLFPNGFLYAIGYAG

SEQ ID NO: 2402917 - protein, 31 aa, Entamoeba dispar
VVGMKRVLKYLVYWLLNGTVCIANFFATERQ

SEQ ID NO: 2402918 - protein, 18 aa, Entamoeba dispar
VVGWTFILITYFLKALET

SEQ ID NO: 2402919 - protein, 28 aa, Entamoeba dispar
VVICFFLGFILFIPFLVAYIIGKKSKSK

SEQ ID NO: 2402920 - protein, 22 aa, Entamoeba dispar
VVIVVVVIITLVVIRIHKKKKA

SEQ ID NO: 2402921 - protein, 25 aa, Entamoeba dispar
VVKRKKFEFILSKPKVQEMKHIEAK

SEQ ID NO: 2402922 - protein, 28 aa, Entamoeba dispar
VVLEFIIFTLYLIFFKAKKDKIYIRAIL

SEQ ID NO: 2402923 - protein, 19 aa, Entamoeba dispar
VVLKLKYLNISLDETFFLE

SEQ ID NO: 2402924 - protein, 19 aa, Entamoeba dispar
VVLVPKKWNRNQSYLMMLM

SEQ ID NO: 2402925 - protein, 17 aa, Entamoeba dispar
VVMSCIIVSFFVILLFN

SEQ ID NO: 2402926 - protein, 38 aa, Entamoeba dispar
VVMSLTMIWTYKRIFFLIFQLFYIIMLIVFGVSRNAYV

SEQ ID NO: 2402927 - protein, 24 aa, Entamoeba dispar
VVNAFDVILRKGVVGQIYNIGTTR

SEQ ID NO: 2402928 - protein, 27 aa, Entamoeba dispar
VVNDYKYAFPLFIQANVLLASSTKHTA

SEQ ID NO: 2402929 - protein, 24 aa, Entamoeba dispar
VVNSKRTILTIKKLGFNSVKLAGK

SEQ ID NO: 2402930 - protein, 25 aa, Entamoeba dispar
VVPLQILAYELSIAKGINPDKPRNL

SEQ ID NO: 2402931 - protein, 22 aa, Entamoeba dispar
VVPSVEFLPICIASLIVLMSYN

SEQ ID NO: 2402932 - protein, 24 aa, Entamoeba dispar
VVQEDIFLVLSLLSLSSSSYVKQL

SEQ ID NO: 2402933 - protein, 36 aa, Entamoeba dispar
VVQSRFLDFLLSWKIFGLLYVFSMAVGLNLLMDCIW

SEQ ID NO: 2402934 - protein, 26 aa, Entamoeba dispar
VVRDYLQFYYVRLFGKVFGPELNRCS

SEQ ID NO: 2402935 - protein, 25 aa, Entamoeba dispar
VVRFTITFLCTCSCNDDDIIAFAIA

SEQ ID NO: 2402936 - protein, 19 aa, Entamoeba dispar
VVRYDHHCAWLSCIGLHNI

SEQ ID NO: 2402937 - protein, 30 aa, Entamoeba dispar
VVRYHRLYHAYFRFLARYAAENPNLVGTIV

SEQ ID NO: 2402938 - protein, 23 aa, Entamoeba dispar
VVSLLLSVFIFRFTHKFYSLQTS

SEQ ID NO: 2402939 - protein, 32 aa, Entamoeba dispar
VVSLTSFVAAFLFIDYIATPAPHLPPSFPLSI

SEQ ID NO: 2402940 - protein, 41 aa, Entamoeba dispar
VVSSFIFFSFIIPLAFGYAVWRPMTLLWTLTVKQSNHIFWM

SEQ ID NO: 2402941 - protein, 39 aa, Entamoeba dispar
VVSVFNYLMYLLKEIFNFIVIVFAFMGGLLIYSLLIADV

SEQ ID NO: 2402942 - protein, 19 aa, Entamoeba dispar
VVSWMYCNICRIKLVLDPY

SEQ ID NO: 2402943 - protein, 24 aa, Entamoeba dispar
VVTDQFFFEWSLKLVIDRNNKEIS

SEQ ID NO: 2402944 - protein, 28 aa, Entamoeba dispar
VVVALIVVSIGLFKTYQLVSSAMKNAIT

SEQ ID NO: 2402945 - protein, 34 aa, Entamoeba dispar
VVVGLIIIIALILLVAFILYAKLVLLKNRKNNKV

SEQ ID NO: 2402946 - protein, 23 aa, Entamoeba dispar
VVVLFIALCIMLPIIICMKDFKW

SEQ ID NO: 2402947 - protein, 20 aa, Entamoeba dispar
VVYLISMLCAFLPSLSPVKN

SEQ ID NO: 2402948 - protein, 21 aa, Entamoeba dispar
VVYLIVIAFMQILTSFCFQLS

SEQ ID NO: 2402949 - protein, 18 aa, Entamoeba dispar
VWIEPWFVGGVLGVSLSL

SEQ ID NO: 2402950 - protein, 32 aa, Entamoeba dispar
VWKQTVLHFFSFLNMFSFLVPVSCLVSLEFSK

SEQ ID NO: 2402951 - protein, 17 aa, Entamoeba dispar
VWYHITAPEDKTLQALT

SEQ ID NO: 2402952 - protein, 21 aa, Entamoeba dispar
VYAFALTMFAIITLNEPYPIT

SEQ ID NO: 2402953 - protein, 38 aa, Entamoeba dispar
VYEFSLMPREMYVKLLAYLSIYYKMIVVWKRGIICSER

SEQ ID NO: 2402954 - protein, 24 aa, Entamoeba dispar
VYIGFVFSLFLFKLYHNYILFCST

SEQ ID NO: 2402955 - protein, 17 aa, Entamoeba dispar
VYIPTRLPTTVIGDIHG

SEQ ID NO: 2402956 - protein, 27 aa, Entamoeba dispar
VYKDKSRFHYPWDIATFVTKGLRLEQT

SEQ ID NO: 2402957 - protein, 18 aa, Entamoeba dispar
VYLGKYRGNKVAIKKMKQ

SEQ ID NO: 2402958 - protein, 25 aa, Entamoeba dispar
VYMMYFPLVFYYINGNRIYVSGDKM

SEQ ID NO: 2402959 - protein, 25 aa, Entamoeba dispar
VYMYTQGYEFFYFTKNEPEAFVLFK

SEQ ID NO: 2402960 - protein, 26 aa, Entamoeba dispar
VYNTTIFLIIPIVLLICSRKITINKN

SEQ ID NO: 2402961 - protein, 31 aa, Entamoeba dispar
VYPFTLNFFSYDGFLLGCVFSFNFFGFSSFF

SEQ ID NO: 2402962 - protein, 22 aa, Entamoeba dispar
VYSFAICMLEIWLGRDPYDPAK

SEQ ID NO: 2402963 - protein, 42 aa, Entamoeba dispar
VYSFGMIMFETVHWESPFPKKNFPYEWTIARFVTEGKRPSFK

SEQ ID NO: 2402964 - protein, 22 aa, Entamoeba dispar
VYSFIFALIFLVVAAVFCVIFY

SEQ ID NO: 2402965 - protein, 26 aa, Entamoeba dispar
VYSGLKYIMWMIGIGGGIVSVVIIIE

SEQ ID NO: 2402966 - protein, 34 aa, Entamoeba dispar
VYSINDTYLFILKQPHLLILFDSISSIQAIIPID

SEQ ID NO: 2402967 - protein, 23 aa, Entamoeba dispar
VYSSTLYKLALQKKYDFINEYQC

SEQ ID NO: 2402968 - protein, 19 aa, Entamoeba dispar
VYYLHVLFQWLIQKVFMLS

SEQ ID NO: 2402969 - protein, 26 aa, Entamoeba dispar
WAEQKGFFYIFLNVFSPKLTIGMSVY

SEQ ID NO: 2402970 - protein, 19 aa, Entamoeba dispar
WAIAVIVVVGLIIIIALIL

SEQ ID NO: 2402971 - protein, 25 aa, Entamoeba dispar
WAIIIKIIIMLLPIITTLSVYPPLV

SEQ ID NO: 2402972 - protein, 18 aa, Entamoeba dispar
WCHSPLYTGFETLINNLR

SEQ ID NO: 2402973 - protein, 17 aa, Entamoeba dispar
WCLKCSSEYYLNKITHL

SEQ ID NO: 2402974 - protein, 19 aa, Entamoeba dispar
WDDYLLPIIVSAVSSFLAA

SEQ ID NO: 2402975 - protein, 31 aa, Entamoeba dispar
WDVLISVLLCFFIAFLIMKFTRMNFCKSLTL

SEQ ID NO: 2402976 - protein, 18 aa, Entamoeba dispar
WDVLRWKDIQRIRQSCID

SEQ ID NO: 2402977 - protein, 29 aa, Entamoeba dispar
WDYSFIVWIFLCFLSYIHPIHSPLCIGSF

SEQ ID NO: 2402978 - protein, 17 aa, Entamoeba dispar
WEESIGHLALLLNLPQS

SEQ ID NO: 2402979 - protein, 19 aa, Entamoeba dispar
WEIIPIEEMLLVSCVVYNP

SEQ ID NO: 2402980 - protein, 23 aa, Entamoeba dispar
WENTFYLLLDFLHKKKDKENLKR

SEQ ID NO: 2402981 - protein, 22 aa, Entamoeba dispar
WEVLFGQWKSILPKTTEIIQRI

SEQ ID NO: 2402982 - protein, 35 aa, Entamoeba dispar
WEWKTYHFITLSLFAFLFILSLSFTVIMGSASFQT

SEQ ID NO: 2402983 - protein, 18 aa, Entamoeba dispar
WEYFIEFISDVFPVHSMI

SEQ ID NO: 2402984 - protein, 20 aa, Entamoeba dispar
WFCHFSFLDFFFFLSFQTHP

SEQ ID NO: 2402985 - protein, 22 aa, Entamoeba dispar
WFGVGLFYLTLVYIPLLSFAVC

SEQ ID NO: 2402986 - protein, 22 aa, Entamoeba dispar
WFKIFMIYLYVEFIKLRYYFVW

SEQ ID NO: 2402987 - protein, 18 aa, Entamoeba dispar
WFSLFTTDVFMKTTLVMK

SEQ ID NO: 2402988 - protein, 19 aa, Entamoeba dispar
WFTFIEVFGFIFLTGGFLL

SEQ ID NO: 2402989 - protein, 20 aa, Entamoeba dispar
WGFWCSFFSSLILLLAGFIN

SEQ ID NO: 2402990 - protein, 19 aa, Entamoeba dispar
WGHFLICFIAILISQLSTL

SEQ ID NO: 2402991 - protein, 20 aa, Entamoeba dispar
WGKQIINYQLKVKILDDMAV

SEQ ID NO: 2402992 - protein, 28 aa, Entamoeba dispar
WGQSFIEPILFIFTILSVIAMMIPKPIL

SEQ ID NO: 2402993 - protein, 29 aa, Entamoeba dispar
WGVIIIIGCVLCLLWAYYKSKKEAYRQKV

SEQ ID NO: 2402994 - protein, 19 aa, Entamoeba dispar
WHNVMFKSLQMILFYEQRC

SEQ ID NO: 2402995 - protein, 18 aa, Entamoeba dispar
WHYFLLDFCYFTNCVLII

SEQ ID NO: 2402996 - protein, 22 aa, Entamoeba dispar
WIGGITWFIFYIVAIHLFNKPR

SEQ ID NO: 2402997 - protein, 21 aa, Entamoeba dispar
WIICPIICLAVILLTLLLLYL

SEQ ID NO: 2402998 - protein, 17 aa, Entamoeba dispar
WIIPYILFDVIIPMIIG

SEQ ID NO: 2402999 - protein, 18 aa, Entamoeba dispar
WIITIIIVIIIYLVYHNN

SEQ ID NO: 2403000 - protein, 36 aa, Entamoeba dispar
WIKEKLYVNFDLRSPYLFMPIVKLVNAIAFRPLAVS

SEQ ID NO: 2403001 - protein, 18 aa, Entamoeba dispar
WIKWFVLGNLMVTLGLFL

SEQ ID NO: 2403002 - protein, 19 aa, Entamoeba dispar
WILSMFIFSLIGLSSSFFW

SEQ ID NO: 2403003 - protein, 18 aa, Entamoeba dispar
WINNLLEFLMLLNSVKII

SEQ ID NO: 2403004 - protein, 18 aa, Entamoeba dispar
WISLYYKNVLMLVGPELI

SEQ ID NO: 2403005 - protein, 25 aa, Entamoeba dispar
WKFGFIIIICSPWFFNDKKTNKTRL

SEQ ID NO: 2403006 - protein, 17 aa, Entamoeba dispar
WKHICIVWTKCYNYTPE

SEQ ID NO: 2403007 - protein, 27 aa, Entamoeba dispar
WKIHQYVVWFILFSLFIDCAISNMVIG

SEQ ID NO: 2403008 - protein, 26 aa, Entamoeba dispar
WKKEQGPIILLSFLVKYSKQRQFTEE

SEQ ID NO: 2403009 - protein, 24 aa, Entamoeba dispar
WKKYSYPIMFTQTSVVYFTQNNGY

SEQ ID NO: 2403010 - protein, 32 aa, Entamoeba dispar
WKLLFKTESIRLKKFPDYYPLYQDALLEQTAS

SEQ ID NO: 2403011 - protein, 17 aa, Entamoeba dispar
WKLYDEELTECWKNIVR

SEQ ID NO: 2403012 - protein, 22 aa, Entamoeba dispar
WKQQYIYPISKGNEIIFEDNSQ

SEQ ID NO: 2403013 - protein, 26 aa, Entamoeba dispar
WKRFIYVIILIIYFQLFDLNSFFLKA

SEQ ID NO: 2403014 - protein, 26 aa, Entamoeba dispar
WKVRMYAVIALLRSLTLRMLIFIGNE

SEQ ID NO: 2403015 - protein, 26 aa, Entamoeba dispar
WLCSVFLPIFISLLLYLYQIICSTHR

SEQ ID NO: 2403016 - protein, 28 aa, Entamoeba dispar
WLGQGIWQSLLLTFVFHFMLDDVDVYSS

SEQ ID NO: 2403017 - protein, 21 aa, Entamoeba dispar
WLHRTWMIFVLLWASYNGANF

SEQ ID NO: 2403018 - protein, 20 aa, Entamoeba dispar
WLIALSVIALIWLVLPFSHQ

SEQ ID NO: 2403019 - protein, 28 aa, Entamoeba dispar
WLIIVCRMLMIILVLMSYPALTFSTCAG

SEQ ID NO: 2403020 - protein, 17 aa, Entamoeba dispar
WLINQIYLLPLCCSLLI

SEQ ID NO: 2403021 - protein, 17 aa, Entamoeba dispar
WMYLSYFPVYKKPRQET

SEQ ID NO: 2403022 - protein, 17 aa, Entamoeba dispar
WNGMISLIIIYFVISCI

SEQ ID NO: 2403023 - protein, 19 aa, Entamoeba dispar
WNICRLEDYHVVSSIIRTC

SEQ ID NO: 2403024 - protein, 27 aa, Entamoeba dispar
WNLITELLVIFPNDLLTISLIGELCLT

SEQ ID NO: 2403025 - protein, 24 aa, Entamoeba dispar
WNMINYRFMLYKEYLKEHEGEIDR

SEQ ID NO: 2403026 - protein, 26 aa, Entamoeba dispar
WPYTKLVILLFTWFMPSTLVVPKVRG

SEQ ID NO: 2403027 - protein, 27 aa, Entamoeba dispar
WPYTKLVMLLIAWMIPSSIIKPSARGV

SEQ ID NO: 2403028 - protein, 27 aa, Entamoeba dispar
WQDPFPKTEFKFPWKIAEFISTGKRPT

SEQ ID NO: 2403029 - protein, 30 aa, Entamoeba dispar
WSFLDSYVMILMIMAFYFDVPLPIRHPNSV

SEQ ID NO: 2403030 - protein, 29 aa, Entamoeba dispar
WSLATIVYFIYTWYYYNRAIYLTGAGTMG

SEQ ID NO: 2403031 - protein, 32 aa, Entamoeba dispar
WSMMLYFMTLIVSLITWFVLEGVFGMITFGLT

SEQ ID NO: 2403032 - protein, 18 aa, Entamoeba dispar
WSTIPILSWLVPCLGHTA

SEQ ID NO: 2403033 - protein, 17 aa, Entamoeba dispar
WTSFSYLSLYVKGVMIN

SEQ ID NO: 2403034 - protein, 32 aa, Entamoeba dispar
WTYHRSLCLLAQAIFLVFSLLLVVVFNPYVIF

SEQ ID NO: 2403035 - protein, 18 aa, Entamoeba dispar
WVGKITLRLLWDLICLST

SEQ ID NO: 2403036 - protein, 17 aa, Entamoeba dispar
WVGVLVSIFIRKLSPDN

SEQ ID NO: 2403037 - protein, 18 aa, Entamoeba dispar
WVIPVINGIVYKDISQKL

SEQ ID NO: 2403038 - protein, 17 aa, Entamoeba dispar
WVKLSKILLILYTILIV

SEQ ID NO: 2403039 - protein, 32 aa, Entamoeba dispar
WVPVVIIILIFGFLFFVYGLFIMIIKQCEYNT

SEQ ID NO: 2403040 - protein, 19 aa, Entamoeba dispar
WWLSLCKIGYMLSVSFFSF

SEQ ID NO: 2403041 - protein, 25 aa, Entamoeba dispar
WWSIVPLICIPFQYVLRKRQTTPLN

SEQ ID NO: 2403042 - protein, 21 aa, Entamoeba dispar
WYCILFVLCFIAFSLVVYFTD

SEQ ID NO: 2403043 - protein, 26 aa, Entamoeba dispar
WYGVVVQWVILLFPAINLTSEYPLVC

SEQ ID NO: 2403044 - protein, 38 aa, Entamoeba dispar
WYHSYTNQYDVFYYLAMQPWRHFVWTTCSGNGNTDCYK

SEQ ID NO: 2403045 - protein, 20 aa, Entamoeba dispar
WYVIVIALFVRMVVVPVICI

SEQ ID NO: 2403046 - protein, 24 aa, Entamoeba dispar
  misc_feature (1)..(2): Xaa can be any naturally occurring amino acid
XXMKILIFQMYFVDSQPDEDYDNI

SEQ ID NO: 2403047 - protein, 26 aa, Entamoeba dispar
  misc_feature (1)..(2): Xaa can be any naturally occurring amino acid
XXYSFHYTFIPLFSKKLYESYFIFVY

SEQ ID NO: 2403048 - protein, 28 aa, Entamoeba dispar
YAAEFILMYITITAMIWFGASASKYLHM

SEQ ID NO: 2403049 - protein, 27 aa, Entamoeba dispar
YAALPPEQQLLIFSPPPPDTRKIVLST

SEQ ID NO: 2403050 - protein, 26 aa, Entamoeba dispar
YAAVDNPLFFYSNTRMFLSDCKKGFE

SEQ ID NO: 2403051 - protein, 21 aa, Entamoeba dispar
YACEFEIFIIIKCTTKIKEQI

SEQ ID NO: 2403052 - protein, 25 aa, Entamoeba dispar
YAENNYLYLKITSSADLPKFPAIFK

SEQ ID NO: 2403053 - protein, 18 aa, Entamoeba dispar
YAFTLISTILMTIQKIPT

SEQ ID NO: 2403054 - protein, 17 aa, Entamoeba dispar
YAIFHMLRWTQGNEANV

SEQ ID NO: 2403055 - protein, 18 aa, Entamoeba dispar
YALNALLVLMSDEIGFNA

SEQ ID NO: 2403056 - protein, 28 aa, Entamoeba dispar
YALQSIFLFAVFFIVSLPFLILCLAVGH

SEQ ID NO: 2403057 - protein, 22 aa, Entamoeba dispar
YAMTVIGLLLNILRDNNLVSGH

SEQ ID NO: 2403058 - protein, 20 aa, Entamoeba dispar
YAPYLLMTLPFCLASFGYHG

SEQ ID NO: 2403059 - protein, 23 aa, Entamoeba dispar
YAREFFKTTLFPPPFNKQNIKII

SEQ ID NO: 2403060 - protein, 35 aa, Entamoeba dispar
YASRSTLLLCLLVSIIFYFIPIIIGYNSFEISGTK

SEQ ID NO: 2403061 - protein, 20 aa, Entamoeba dispar
YAVFIAFTLFCLISVVIGEV

SEQ ID NO: 2403062 - protein, 19 aa, Entamoeba dispar
YAVLMMVVVIVIIALFVSL

SEQ ID NO: 2403063 - protein, 22 aa, Entamoeba dispar
YAVYPFMRFELIPSLIVLYRTY

SEQ ID NO: 2403064 - protein, 23 aa, Entamoeba dispar
YAVYPFMRFELIPSLIVLYRTYF

SEQ ID NO: 2403065 - protein, 27 aa, Entamoeba dispar
YCAQCRLMKFLLFRMNFKGDYSILLDS

SEQ ID NO: 2403066 - protein, 43 aa, Entamoeba dispar
YCDKKSIVTIILPIILLIFIGIIIICTIIIAGIILYKEKQGEK

SEQ ID NO: 2403067 - protein, 47 aa, Entamoeba dispar
YCDYKLNYVLVVGLPVILLSIILLIIVLNIIIISAIIYKCSKSKKKV

SEQ ID NO: 2403068 - protein, 42 aa, Entamoeba dispar
YCEFHLNVLIVILPIIGFIIILIIVLCMAIILINSITRYTAN

SEQ ID NO: 2403069 - protein, 48 aa, Entamoeba dispar
YCEFHLNVLIVILPIIGFIIILIIVLCMAIILIYSITRYTANKQREKE

SEQ ID NO: 2403070 - protein, 18 aa, Entamoeba dispar
YCERIKLSPVFFNVSYPE

SEQ ID NO: 2403071 - protein, 19 aa, Entamoeba dispar
YCEVDEKHILLSPLYTFLP

SEQ ID NO: 2403072 - protein, 38 aa, Entamoeba dispar
YCFSKYRFIWDSISLKNLFIHFLHFYISFDYSQLIAIN

SEQ ID NO: 2403073 - protein, 17 aa, Entamoeba dispar
YCFVPTYNNNLISDREG

SEQ ID NO: 2403074 - protein, 18 aa, Entamoeba dispar
YCIYFKEDIFRFENKQIC

SEQ ID NO: 2403075 - protein, 17 aa, Entamoeba dispar
YCKDLIFDYSYIPKSES

SEQ ID NO: 2403076 - protein, 29 aa, Entamoeba dispar
YCKFDEEKGYLWLGVYPNNKCDKSERKDN

SEQ ID NO: 2403077 - protein, 18 aa, Entamoeba dispar
YCLYFRNIETNIELELIK

SEQ ID NO: 2403078 - protein, 19 aa, Entamoeba dispar
YCMYKIENGHMYGIIYANS

SEQ ID NO: 2403079 - protein, 28 aa, Entamoeba dispar
YCPNTRLERWWFIITDVRNQVVLNATHG

SEQ ID NO: 2403080 - protein, 24 aa, Entamoeba dispar
YCRATKFIIKGKKTIKILQHEVDF

SEQ ID NO: 2403081 - protein, 23 aa, Entamoeba dispar
YCTKCYDGYYLKDNSCTRCPEHC

SEQ ID NO: 2403082 - protein, 17 aa, Entamoeba dispar
YCYSACSLVTKGLKEWG

SEQ ID NO: 2403083 - protein, 18 aa, Entamoeba dispar
YDCCYGMPLTYHYSELYL

SEQ ID NO: 2403084 - protein, 26 aa, Entamoeba dispar
YDESGWYQLCGIVLFVFVHKHIKSQI

SEQ ID NO: 2403085 - protein, 18 aa, Entamoeba dispar
YDFLGLPLGFFCCGCSFL

SEQ ID NO: 2403086 - protein, 19 aa, Entamoeba dispar
YDMGLLLNLPSHCKNINPS

SEQ ID NO: 2403087 - protein, 31 aa, Entamoeba dispar
YDNGLITNIINYPPNFIFGGDQLTITQLIVS

SEQ ID NO: 2403088 - protein, 27 aa, Entamoeba dispar
YDNIRKFLQFQLTVNVVALALCIIGAI

SEQ ID NO: 2403089 - protein, 25 aa, Entamoeba dispar
YDPSFYWQLYRVTPSQRLKPIQIQN

SEQ ID NO: 2403090 - protein, 28 aa, Entamoeba dispar
YDRIIKPLGIFFFLSSGVYLLITITASI

SEQ ID NO: 2403091 - protein, 20 aa, Entamoeba dispar
YDSAFQLLALRFVSQKHLET

SEQ ID NO: 2403092 - protein, 47 aa, Entamoeba dispar
YDSLYPHLLEYYALWFSRLFTGDLGIWILDIIIVEGWQLTLSIASTI

SEQ ID NO: 2403093 - protein, 25 aa, Entamoeba dispar
YDSNLYYLLAAQSLKIQLLLDVPKI

SEQ ID NO: 2403094 - protein, 27 aa, Entamoeba dispar
YDVDYVLNLYSLLQRTLFTCKRGLTIH

SEQ ID NO: 2403095 - protein, 27 aa, Entamoeba dispar
YDVMYDSILFFVYTPIVFSLSMPQWLY

SEQ ID NO: 2403096 - protein, 24 aa, Entamoeba dispar
YDYKPLEFSLSYSILETFKHNYKY

SEQ ID NO: 2403097 - protein, 33 aa, Entamoeba dispar
YEAGGMACLVCCIFTLLGCCYCGLIACCMKNLK

SEQ ID NO: 2403098 - protein, 31 aa, Entamoeba dispar
YEAGSLVFILCCVLCFLGLLCFSCIPCCLDG

SEQ ID NO: 2403099 - protein, 17 aa, Entamoeba dispar
YECIKCDPPFISDKHHS

SEQ ID NO: 2403100 - protein, 19 aa, Entamoeba dispar
YEDTILKCIDLFDSNKYPI

SEQ ID NO: 2403101 - protein, 31 aa, Entamoeba dispar
YEEHIVPYGLILLCILIIGPPTGLNLRNLLW

SEQ ID NO: 2403102 - protein, 26 aa, Entamoeba dispar
YEETPKQLFLFYLLEGIIEGGSQGIA

SEQ ID NO: 2403103 - protein, 25 aa, Entamoeba dispar
YEIYDGIKGLYIPLLDASKQSVDYA

SEQ ID NO: 2403104 - protein, 19 aa, Entamoeba dispar
YELKRRIVELLYGFSLVGR

SEQ ID NO: 2403105 - protein, 31 aa, Entamoeba dispar
YEMRTTISLPFYFYSVRFLGKIFRSRDNDTN

SEQ ID NO: 2403106 - protein, 23 aa, Entamoeba dispar
YENNIDWFIKYQKKFKPLAIKAE

SEQ ID NO: 2403107 - protein, 36 aa, Entamoeba dispar
YEQVLLFDIIMSICGLFFVVILAFKQMNRKYQQLIT

SEQ ID NO: 2403108 - protein, 26 aa, Entamoeba dispar
YERWSLVMFNILFSILLPMVVATFDK

SEQ ID NO: 2403109 - protein, 18 aa, Entamoeba dispar
YESIWNYFKLFNYEDKLY

SEQ ID NO: 2403110 - protein, 26 aa, Entamoeba dispar
YESSNQAIFKIYRKKEPFNQKIEFSL

SEQ ID NO: 2403111 - protein, 26 aa, Entamoeba dispar
YESSNQIIFKIYRKKEPYQKIEFSLT

SEQ ID NO: 2403112 - protein, 24 aa, Entamoeba dispar
YETENICYILLTSVPFFEIHYHLL

SEQ ID NO: 2403113 - protein, 22 aa, Entamoeba dispar
YEVPIIIYRKAIKMLKYALNPE

SEQ ID NO: 2403114 - protein, 19 aa, Entamoeba dispar
YEYFYEVNIPLMVKPNLFE

SEQ ID NO: 2403115 - protein, 22 aa, Entamoeba dispar
YEYGCRTCVDGYYLFDYHCIKC

SEQ ID NO: 2403116 - protein, 28 aa, Entamoeba dispar
YEYKSLNAIILLIRIFQQIGDFPFNSFF

SEQ ID NO: 2403117 - protein, 24 aa, Entamoeba dispar
YEYLIIGILLFLYQLFDSLDGMQA

SEQ ID NO: 2403118 - protein, 19 aa, Entamoeba dispar
YEYLSFWNIMVSSLNPYFD

SEQ ID NO: 2403119 - protein, 20 aa, Entamoeba dispar
YFALLYGFILGVTSLISFIV

SEQ ID NO: 2403120 - protein, 24 aa, Entamoeba dispar
YFEMIYITFYIWGYLSFGVCCLEI

SEQ ID NO: 2403121 - protein, 24 aa, Entamoeba dispar
YFFDLHCLILIAPAGLYYCFKKFD

SEQ ID NO: 2403122 - protein, 18 aa, Entamoeba dispar
YFFFVFYCIFSIGQGIML

SEQ ID NO: 2403123 - protein, 17 aa, Entamoeba dispar
YFFYHFTLFLMSFFIQN

SEQ ID NO: 2403124 - protein, 19 aa, Entamoeba dispar
YFGLRTSLMYIHCFIRRDF

SEQ ID NO: 2403125 - protein, 18 aa, Entamoeba dispar
YFGLSSPIPEFTLEAPYT

SEQ ID NO: 2403126 - protein, 17 aa, Entamoeba dispar
YFIEHPFYYQQASNLQH

SEQ ID NO: 2403127 - protein, 17 aa, Entamoeba dispar
YFILFEILLFVVYDLFS

SEQ ID NO: 2403128 - protein, 17 aa, Entamoeba dispar
YFILLVGLYYVSIRIFF

SEQ ID NO: 2403129 - protein, 18 aa, Entamoeba dispar
YFIVYEGEGMYRISIDFY

SEQ ID NO: 2403130 - protein, 17 aa, Entamoeba dispar
YFLFLGINEEYSAEVLL

SEQ ID NO: 2403131 - protein, 20 aa, Entamoeba dispar
YFLSLIFTLYFSYSTLDSYS

SEQ ID NO: 2403132 - protein, 19 aa, Entamoeba dispar
YFMFVVMVHSLWYKWATTI

SEQ ID NO: 2403133 - protein, 18 aa, Entamoeba dispar
YFNDFVPFYTEAINQKLD

SEQ ID NO: 2403134 - protein, 31 aa, Entamoeba dispar
YFNNLHRYFRLFPRMYLLVNSFYSIFDDIVS

SEQ ID NO: 2403135 - protein, 17 aa, Entamoeba dispar
YFNQLWLWSNKGGFRPA

SEQ ID NO: 2403136 - protein, 23 aa, Entamoeba dispar
YFPSPFQLVLPLNVQLPQPMVIY

SEQ ID NO: 2403137 - protein, 18 aa, Entamoeba dispar
YFQVIYSKGYHPFNFCIF

SEQ ID NO: 2403138 - protein, 29 aa, Entamoeba dispar
YFSLHTRQKLLVIPPLLTGNINILFVMYQ

SEQ ID NO: 2403139 - protein, 22 aa, Entamoeba dispar
YFSLLLYHILIVIVYPSFVETK

SEQ ID NO: 2403140 - protein, 26 aa, Entamoeba dispar
YFSPNNFEIEWLSKKIGYKGVGCDGG

SEQ ID NO: 2403141 - protein, 34 aa, Entamoeba dispar
YFSTISMIPALFGLAFYILIQKISLSFFVSMDFV

SEQ ID NO: 2403142 - protein, 24 aa, Entamoeba dispar
YFTGYFFVCYILFLNKTYSKPPNN

SEQ ID NO: 2403143 - protein, 18 aa, Entamoeba dispar
YGCLECEPGYFFNEDLEC

SEQ ID NO: 2403144 - protein, 19 aa, Entamoeba dispar
YGCLQCIHGYFFNSDLECQ

SEQ ID NO: 2403145 - protein, 24 aa, Entamoeba dispar
YGDMNSNIPLLRKEERKLLRRMGI

SEQ ID NO: 2403146 - protein, 31 aa, Entamoeba dispar
YGEGQGLFIAGLVLIGLGIILNFCICICCCK

SEQ ID NO: 2403147 - protein, 19 aa, Entamoeba dispar
YGFIFFYPGLFSGPTLEYN

SEQ ID NO: 2403148 - protein, 23 aa, Entamoeba dispar
YGGFTICVIILYLCLLIAANFMG

SEQ ID NO: 2403149 - protein, 17 aa, Entamoeba dispar
YGIQLPDIIILTPSCGP

SEQ ID NO: 2403150 - protein, 35 aa, Entamoeba dispar
YGITKILKYIFPIKRVIFILRKQLKLLINSFAKDE

SEQ ID NO: 2403151 - protein, 27 aa, Entamoeba dispar
YGKFTFITFMRYVILAAPMIPISLRIN

SEQ ID NO: 2403152 - protein, 24 aa, Entamoeba dispar
YGLKKFFGYFTLISYIIPISCQVS

SEQ ID NO: 2403153 - protein, 22 aa, Entamoeba dispar
YGLSWQGWIVSIASTLLTLIVG

SEQ ID NO: 2403154 - protein, 23 aa, Entamoeba dispar
YGPAFIVLLLFIGLSLAAGLYVF

SEQ ID NO: 2403155 - protein, 26 aa, Entamoeba dispar
YGPLVFYFCPLSLVFYLFTGGISYAI

SEQ ID NO: 2403156 - protein, 26 aa, Entamoeba dispar
YGSILFYALLVVPLSFLKLSSQTFVQ

SEQ ID NO: 2403157 - protein, 29 aa, Entamoeba dispar
YGSLVEPIYFFHTLSPYYKTILNCIELFD

SEQ ID NO: 2403158 - protein, 21 aa, Entamoeba dispar
YGYFPMLLNGTIKCSLKTCGN

SEQ ID NO: 2403159 - protein, 24 aa, Entamoeba dispar
YHFIGVPIIFQSLSLVAIALSVPA

SEQ ID NO: 2403160 - protein, 23 aa, Entamoeba dispar
YHFSMFWYEILFVSNIWTPFSFK

SEQ ID NO: 2403161 - protein, 22 aa, Entamoeba dispar
YHFVDWRNITVQSKPEWLTLCK

SEQ ID NO: 2403162 - protein, 18 aa, Entamoeba dispar
YHINDSFVFYNFNKLLFA

SEQ ID NO: 2403163 - protein, 18 aa, Entamoeba dispar
YHLPIQRTYFNSNPTTLI

SEQ ID NO: 2403164 - protein, 20 aa, Entamoeba dispar
YHLYDYLNYTQINSVFYPFK

SEQ ID NO: 2403165 - protein, 27 aa, Entamoeba dispar
YHNYRYFFLFQFYLWIGLLLADFHLYK

SEQ ID NO: 2403166 - protein, 19 aa, Entamoeba dispar
YHQFLFFDFQDFTWTYFIL

SEQ ID NO: 2403167 - protein, 22 aa, Entamoeba dispar
YHRGLWITMDGYNLMIYIDACP

SEQ ID NO: 2403168 - protein, 25 aa, Entamoeba dispar
YHSRESFTMYLTKPINFPTNTCFEL

SEQ ID NO: 2403169 - protein, 20 aa, Entamoeba dispar
YICVIVFMILTVPLAYVNLA

SEQ ID NO: 2403170 - protein, 18 aa, Entamoeba dispar
YIDKSFYLKYLSEPNKKI

SEQ ID NO: 2403171 - protein, 17 aa, Entamoeba dispar
YIDPPIDGFYERLVVSS

SEQ ID NO: 2403172 - protein, 22 aa, Entamoeba dispar
YIEELRIFCKNKFKLNYLSYRN

SEQ ID NO: 2403173 - protein, 19 aa, Entamoeba dispar
YIELYDRLIVQIALSCPDV

SEQ ID NO: 2403174 - protein, 19 aa, Entamoeba dispar
YIELYIKYHRPLLIHMKDS

SEQ ID NO: 2403175 - protein, 19 aa, Entamoeba dispar
YIETQYPKYSLRIVPQTIC

SEQ ID NO: 2403176 - protein, 23 aa, Entamoeba dispar
YIFNKYLYQPILTYLIPRNLAPN

SEQ ID NO: 2403177 - protein, 26 aa, Entamoeba dispar
YIGGITLLVLAWILSAFAMYLLTYVS

SEQ ID NO: 2403178 - protein, 18 aa, Entamoeba dispar
YIGLAIGCFVVTDIVLYL

SEQ ID NO: 2403179 - protein, 26 aa, Entamoeba dispar
YIGTKSHWFFIDFYSFIDPIQIELIQ

SEQ ID NO: 2403180 - protein, 25 aa, Entamoeba dispar
YIHAHYLQIFTVAKLFFKKMHLEIL

SEQ ID NO: 2403181 - protein, 23 aa, Entamoeba dispar
YIHIICLLLVFLLSIAILCNIQF

SEQ ID NO: 2403182 - protein, 18 aa, Entamoeba dispar
YIHIVLFIDIVLLKSYIS

SEQ ID NO: 2403183 - protein, 18 aa, Entamoeba dispar
YIIGMMTFSLIVIMSIVY

SEQ ID NO: 2403184 - protein, 17 aa, Entamoeba dispar
YIIPVVLFLWLLLWVIS

SEQ ID NO: 2403185 - protein, 20 aa, Entamoeba dispar
YIKFTLAVILFLAMSFVTML

SEQ ID NO: 2403186 - protein, 28 aa, Entamoeba dispar
YIKSNANAEFWFWAFGKTDASAKTITTT

SEQ ID NO: 2403187 - protein, 21 aa, Entamoeba dispar
YILVCYFVCVIGGFIPFFIKF

SEQ ID NO: 2403188 - protein, 18 aa, Entamoeba dispar
YIMLLHWEYIDKILFLMY

SEQ ID NO: 2403189 - protein, 31 aa, Entamoeba dispar
YINQKVLIIIWWIIYILQFGLCYLIFPIIQT

SEQ ID NO: 2403190 - protein, 17 aa, Entamoeba dispar
YINYPYCTALCGNFVID

SEQ ID NO: 2403191 - protein, 24 aa, Entamoeba dispar
YIPQFFIFELLFTIPLLSLDIYHF

SEQ ID NO: 2403192 - protein, 18 aa, Entamoeba dispar
YIPQWHLYHLTNLTFLDI

SEQ ID NO: 2403193 - protein, 23 aa, Entamoeba dispar
YIPVFLFYNYRWLHRTWMIFVLL

SEQ ID NO: 2403194 - protein, 39 aa, Entamoeba dispar
YIPYFNDIIEQYPLKWLDWLLILVAVLVHFVICETVKLV

SEQ ID NO: 2403195 - protein, 22 aa, Entamoeba dispar
YISLVYPYPVKISKHYSYLYSD

SEQ ID NO: 2403196 - protein, 29 aa, Entamoeba dispar
YISTHLFMFSLLFWILGYIYINLNKTNDE

SEQ ID NO: 2403197 - protein, 17 aa, Entamoeba dispar
YISWVMALFELSSHCKE

SEQ ID NO: 2403198 - protein, 23 aa, Entamoeba dispar
YITMLYIELVSFVPFICYSMPKL

SEQ ID NO: 2403199 - protein, 28 aa, Entamoeba dispar
YITTFITFVILYNNLVPISLYISLEIVR

SEQ ID NO: 2403200 - protein, 29 aa, Entamoeba dispar
YIVFYGIAFLYFLIVILSFYLSFSSSSSS

SEQ ID NO: 2403201 - protein, 33 aa, Entamoeba dispar
YIVIRIAFVFFIIAVAVILIWPSSIAALYVSVC

SEQ ID NO: 2403202 - protein, 23 aa, Entamoeba dispar
YIVKLFILLFIISIPLLTVPKIF

SEQ ID NO: 2403203 - protein, 20 aa, Entamoeba dispar
YIVLLIYTWRQRLMGIWIGF

SEQ ID NO: 2403204 - protein, 28 aa, Entamoeba dispar
YIVSKILLYISLVFIASPWKQLILICRP

SEQ ID NO: 2403205 - protein, 19 aa, Entamoeba dispar
YKAGYMIFGAGLAVGFCNL

SEQ ID NO: 2403206 - protein, 26 aa, Entamoeba dispar
YKCEKNVLFYIMISVSLVISMVVIVV

SEQ ID NO: 2403207 - protein, 20 aa, Entamoeba dispar
YKDFYAIQQGVLIALANQCF

SEQ ID NO: 2403208 - protein, 44 aa, Entamoeba dispar
YKDKAFTFHEFLRKLPFPSFVCLFIIILMKISKCSYLYSFNNNK

SEQ ID NO: 2403209 - protein, 26 aa, Entamoeba dispar
YKDLDRFDMVLYNKLFDILKESTNCC

SEQ ID NO: 2403210 - protein, 19 aa, Entamoeba dispar
YKEALYFTFHCGEYPKYDI

SEQ ID NO: 2403211 - protein, 29 aa, Entamoeba dispar
YKEQIMQPFFIFQVVCSILWMMDDMPMFA

SEQ ID NO: 2403212 - protein, 17 aa, Entamoeba dispar
YKFLTCFTLLDNQIDYL

SEQ ID NO: 2403213 - protein, 24 aa, Entamoeba dispar
YKHYIICHTLRLRFYLNSININTI

SEQ ID NO: 2403214 - protein, 26 aa, Entamoeba dispar
YKIKDFIIFGIPLMILSFVSAVGLSY

SEQ ID NO: 2403215 - protein, 40 aa, Entamoeba dispar
YKIKSFVEWYLYGGLQSILFFVIFYFIIAPSDVTSFDGKV

SEQ ID NO: 2403216 - protein, 31 aa, Entamoeba dispar
YKLLHILCPILLLIFIYLPLRKHYTMGYTVL

SEQ ID NO: 2403217 - protein, 17 aa, Entamoeba dispar
YKLLILLPETSFSTQQI

SEQ ID NO: 2403218 - protein, 25 aa, Entamoeba dispar
YKMGIVGFVLWSLATIVYFIYTWYY

SEQ ID NO: 2403219 - protein, 20 aa, Entamoeba dispar
YKNPLILNAINHFVPTKTSG

SEQ ID NO: 2403220 - protein, 24 aa, Entamoeba dispar
YKNRIFWFSIFTSVVLIVTLLHLI

SEQ ID NO: 2403221 - protein, 28 aa, Entamoeba dispar
YKQHFEIIKTIILLPQQLSEIALITICQ

SEQ ID NO: 2403222 - protein, 18 aa, Entamoeba dispar
YKQLSASILIHVVDPFSS

SEQ ID NO: 2403223 - protein, 17 aa, Entamoeba dispar
YKSLKIALLEKARDVSN

SEQ ID NO: 2403224 - protein, 26 aa, Entamoeba dispar
YKSRLYMIFWGIWFYCSEQTEVFIQI

SEQ ID NO: 2403225 - protein, 26 aa, Entamoeba dispar
YKYKSRIYMLFWGLCFYFGQQTEVLV

SEQ ID NO: 2403226 - protein, 31 aa, Entamoeba dispar
YLACVLISYVYLYIVVYLWQKHTIKIYANPK

SEQ ID NO: 2403227 - protein, 17 aa, Entamoeba dispar
YLCQCIEGYYSVHSLSC

SEQ ID NO: 2403228 - protein, 20 aa, Entamoeba dispar
YLDLFRMLITFIGNSIGFVR

SEQ ID NO: 2403229 - protein, 17 aa, Entamoeba dispar
YLDTLYITKLDNGILSL

SEQ ID NO: 2403230 - protein, 24 aa, Entamoeba dispar
YLETHFLTFLRTKGIWKGKCTPNI

SEQ ID NO: 2403231 - protein, 19 aa, Entamoeba dispar
YLFEDLYIHAHYLQIFTVA

SEQ ID NO: 2403232 - protein, 26 aa, Entamoeba dispar
YLFGTAGCWFFFDIAFYGNSMFNSTV

SEQ ID NO: 2403233 - protein, 18 aa, Entamoeba dispar
YLFIISGVWFGLIHFINI

SEQ ID NO: 2403234 - protein, 17 aa, Entamoeba dispar
YLFILMSSKIPDSLLSI

SEQ ID NO: 2403235 - protein, 17 aa, Entamoeba dispar
YLFIWTPGMIFVYALPG

SEQ ID NO: 2403236 - protein, 23 aa, Entamoeba dispar
YLFLYYFLIFLLFLFIPPLISFI

SEQ ID NO: 2403237 - protein, 17 aa, Entamoeba dispar
YLGLVLILAIIQAFAFV

SEQ ID NO: 2403238 - protein, 24 aa, Entamoeba dispar
YLGSYRGIFVAIKRFKMSIRDEEE

SEQ ID NO: 2403239 - protein, 21 aa, Entamoeba dispar
YLGVHIFHILEAVLSFLMFHE

SEQ ID NO: 2403240 - protein, 42 aa, Entamoeba dispar
YLHFLSNSFFFERIMTFYIALIFRFHIFIGTPELMRKNANGL

SEQ ID NO: 2403241 - protein, 18 aa, Entamoeba dispar
YLIGIYPVHRYIASRFIW

SEQ ID NO: 2403242 - protein, 18 aa, Entamoeba dispar
YLIIVCVGVLIIPLIIIV

SEQ ID NO: 2403243 - protein, 21 aa, Entamoeba dispar
YLIVQLLITLIFISINGKLNK

SEQ ID NO: 2403244 - protein, 25 aa, Entamoeba dispar
YLKFGLAFILFILMSLTVLLEGEEG

SEQ ID NO: 2403245 - protein, 20 aa, Entamoeba dispar
YLKRKKILVLVALGPSLLVP

SEQ ID NO: 2403246 - protein, 17 aa, Entamoeba dispar
YLLFALQVSFRFSGITI

SEQ ID NO: 2403247 - protein, 18 aa, Entamoeba dispar
YLMFPLICLCIKITFNEK

SEQ ID NO: 2403248 - protein, 28 aa, Entamoeba dispar
YLMQIKFSLMIKYLLIGISLKLYSDYEY

SEQ ID NO: 2403249 - protein, 19 aa, Entamoeba dispar
YLNAPFIHNFFLVVSDSYQ

SEQ ID NO: 2403250 - protein, 17 aa, Entamoeba dispar
YLNAWVFRGFIKTLNNS

SEQ ID NO: 2403251 - protein, 19 aa, Entamoeba dispar
YLNDIFLDLFNKQFPKPNQ

SEQ ID NO: 2403252 - protein, 26 aa, Entamoeba dispar
YLNSDFGLFINDLIRIYSHTIGFETM

SEQ ID NO: 2403253 - protein, 28 aa, Entamoeba dispar
YLNYVNYIIGQFLKDLLRFYSRTTTMEA

SEQ ID NO: 2403254 - protein, 18 aa, Entamoeba dispar
YLPFLKEFCETQMFESFI

SEQ ID NO: 2403255 - protein, 17 aa, Entamoeba dispar
YLPPLKATKPNPVHLPK

SEQ ID NO: 2403256 - protein, 25 aa, Entamoeba dispar
YLPVKICFALYGLLTKYQTKQRNGF

SEQ ID NO: 2403257 - protein, 26 aa, Entamoeba dispar
YLQRNKFFHFIAIPFVFDKIKNKIPS

SEQ ID NO: 2403258 - protein, 20 aa, Entamoeba dispar
YLQYLLTLYFMFIGAVGISE

SEQ ID NO: 2403259 - protein, 27 aa, Entamoeba dispar
YLRHPSYFGWFYWSIFTQFVLINPICI

SEQ ID NO: 2403260 - protein, 19 aa, Entamoeba dispar
YLSFMALDPSTKKKMPLTQ

SEQ ID NO: 2403261 - protein, 17 aa, Entamoeba dispar
YLSLIKKLIELDNDSLN

SEQ ID NO: 2403262 - protein, 23 aa, Entamoeba dispar
YLSSLLFTIILFKINKLKKEEEE

SEQ ID NO: 2403263 - protein, 20 aa, Entamoeba dispar
YLSYLLIPLQVIVTSILITL

SEQ ID NO: 2403264 - protein, 18 aa, Entamoeba dispar
YLTGGLSYTPILKEKVKD

SEQ ID NO: 2403265 - protein, 20 aa, Entamoeba dispar
YLTKCIHLLSLIKPSNITNV

SEQ ID NO: 2403266 - protein, 18 aa, Entamoeba dispar
YLTYLAKICIAYSDSYSF

SEQ ID NO: 2403267 - protein, 24 aa, Entamoeba dispar
YLVAFVVLLIVTLIIVSLSVLFQS

SEQ ID NO: 2403268 - protein, 18 aa, Entamoeba dispar
YLYSDYFINKPLVKEPEF

SEQ ID NO: 2403269 - protein, 23 aa, Entamoeba dispar
YLYTILFLLYLYTYIELYLYTFI

SEQ ID NO: 2403270 - protein, 24 aa, Entamoeba dispar
YMAAVFICLAIVFQLIVCFSQEFG

SEQ ID NO: 2403271 - protein, 17 aa, Entamoeba dispar
YMDINVYHLIKDLIIKI

SEQ ID NO: 2403272 - protein, 24 aa, Entamoeba dispar
YMFGYLPIAPSWFFILLLIPSCCG

SEQ ID NO: 2403273 - protein, 17 aa, Entamoeba dispar
YMFINQLNFFAGYSYND

SEQ ID NO: 2403274 - protein, 24 aa, Entamoeba dispar
YMISNYSSFWYSQNSTYLKVINPI

SEQ ID NO: 2403275 - protein, 24 aa, Entamoeba dispar
YMIYGTFLSLLYVIGSALLSYAIF

SEQ ID NO: 2403276 - protein, 28 aa, Entamoeba dispar
YMTINLLIGFFLAEYWKFGFIIIICSPW

SEQ ID NO: 2403277 - protein, 19 aa, Entamoeba dispar
YMWLAVCMIPTIAFYLIDT

SEQ ID NO: 2403278 - protein, 21 aa, Entamoeba dispar
YNALHLIVNDKFLWINVEEEK

SEQ ID NO: 2403279 - protein, 20 aa, Entamoeba dispar
YNEFIFHLDNISAVAIIVDV

SEQ ID NO: 2403280 - protein, 29 aa, Entamoeba dispar
YNELKPSIISILIKILLRNIEIIEISKNH

SEQ ID NO: 2403281 - protein, 27 aa, Entamoeba dispar
YNFNKPQLFITTIIVLTVTVVLSFITK

SEQ ID NO: 2403282 - protein, 27 aa, Entamoeba dispar
YNGITEPFIWYYYCVGFYGEKAFEKDH

SEQ ID NO: 2403283 - protein, 18 aa, Entamoeba dispar
YNHLLSNLDLFSELLKCE

SEQ ID NO: 2403284 - protein, 35 aa, Entamoeba dispar
YNIIYYAFQWLGIAVFFLYLTSLILYVPPITSVSH

SEQ ID NO: 2403285 - protein, 18 aa, Entamoeba dispar
YNIPIINLFFINNYSSLT

SEQ ID NO: 2403286 - protein, 29 aa, Entamoeba dispar
YNKLLSILNLYWLVRLHCFEISSLQCPVC

SEQ ID NO: 2403287 - protein, 23 aa, Entamoeba dispar
YNNDSIVHLLNPNLPFGGNCQSG

SEQ ID NO: 2403288 - protein, 26 aa, Entamoeba dispar
YNNPTYRLQTQKLLLDVICGILLGKA

SEQ ID NO: 2403289 - protein, 17 aa, Entamoeba dispar
YNQLLYHKVSDGDLPLY

SEQ ID NO: 2403290 - protein, 17 aa, Entamoeba dispar
YNRWLQLIYQILISIDE

SEQ ID NO: 2403291 - protein, 27 aa, Entamoeba dispar
YNSYQKRRGFWYKFVATKESVYINACN

SEQ ID NO: 2403292 - protein, 17 aa, Entamoeba dispar
YNYNYHLPIQRTYINSN

SEQ ID NO: 2403293 - protein, 28 aa, Entamoeba dispar
YPCGKFGILLGIFLPTLILAQPLANTMI

SEQ ID NO: 2403294 - protein, 26 aa, Entamoeba dispar
YPDDILSFLFTIFAHSQLIPLTKETI

SEQ ID NO: 2403295 - protein, 18 aa, Entamoeba dispar
YPFGVDPIWKSSNNELYF

SEQ ID NO: 2403296 - protein, 29 aa, Entamoeba dispar
YPIQVPNELIIFLTRVWINRITNKKEGDK

SEQ ID NO: 2403297 - protein, 33 aa, Entamoeba dispar
YPLIKQVLLIFRYILLFVVFLSFIFNSFIKYIK

SEQ ID NO: 2403298 - protein, 29 aa, Entamoeba dispar
YPRKATIWLIIVFFMITFSEFIIQMSLDF

SEQ ID NO: 2403299 - protein, 20 aa, Entamoeba dispar
YPSFWYSIQLSESLDVIAST

SEQ ID NO: 2403300 - protein, 19 aa, Entamoeba dispar
YPVDIYAYGIVLYETFNEK

SEQ ID NO: 2403301 - protein, 32 aa, Entamoeba dispar
YQEFDFIFTLGPLKITFPLVIITLLSTLSSVI

SEQ ID NO: 2403302 - protein, 19 aa, Entamoeba dispar
YQEKEACKFAFEIGIKYTK

SEQ ID NO: 2403303 - protein, 25 aa, Entamoeba dispar
YQGNTLFIKWWRGSKSKSGALKRSL

SEQ ID NO: 2403304 - protein, 18 aa, Entamoeba dispar
YQIGILLAWIFRVNKIEK

SEQ ID NO: 2403305 - protein, 27 aa, Entamoeba dispar
YQISPKKALLRYLIKTPTQKISKMVKI

SEQ ID NO: 2403306 - protein, 29 aa, Entamoeba dispar
YQIVCHLFATMFTFIFSIVSFVFGSVLVQ

SEQ ID NO: 2403307 - protein, 33 aa, Entamoeba dispar
YQLLSWNDPYPNDKFKYPWNIASFIMNGDRLPK

SEQ ID NO: 2403308 - protein, 22 aa, Entamoeba dispar
YQLSFEMFPFISFIVYSCYSLK

SEQ ID NO: 2403309 - protein, 34 aa, Entamoeba dispar
YQLVFIPLYIFLFIAFLFPLFTFIFFCSLCLCNK

SEQ ID NO: 2403310 - protein, 27 aa, Entamoeba dispar
YQMRKSLYEWAHLRTYFIIERIKKVMK

SEQ ID NO: 2403311 - protein, 27 aa, Entamoeba dispar
YQPRTFSDIILITLGVGLTLMTIIAFF

SEQ ID NO: 2403312 - protein, 27 aa, Entamoeba dispar
YQRNTLLNILWDCYPQFNTNSTLLSMI

SEQ ID NO: 2403313 - protein, 24 aa, Entamoeba dispar
YQVICEFFKSLPYAHVIGTSVFVV

SEQ ID NO: 2403314 - protein, 17 aa, Entamoeba dispar
YRDIFNLYIIKIKEFSQ

SEQ ID NO: 2403315 - protein, 24 aa, Entamoeba dispar
YRDYLNCLFIRYFPRAICPGCVMN

SEQ ID NO: 2403316 - protein, 18 aa, Entamoeba dispar
YREPNLIIYFKCASEIID

SEQ ID NO: 2403317 - protein, 17 aa, Entamoeba dispar
YRLCITGLLFNFSAYFL

SEQ ID NO: 2403318 - protein, 24 aa, Entamoeba dispar
YRPSTTFYLYPKLINKIEFAKEII

SEQ ID NO: 2403319 - protein, 29 aa, Entamoeba dispar
YRRIRKLFIILLFLETVIVLPLVILSWVG

SEQ ID NO: 2403320 - protein, 18 aa, Entamoeba dispar
YRRYSQFVELKRQLEIRF

SEQ ID NO: 2403321 - protein, 20 aa, Entamoeba dispar
YRVRKLSFYAICRQDIGWFD

SEQ ID NO: 2403322 - protein, 20 aa, Entamoeba dispar
YRVYPMLIVPFLLLFIIVCI

SEQ ID NO: 2403323 - protein, 22 aa, Entamoeba dispar
YRYAKLLQLQLPRELSTGSNDD

SEQ ID NO: 2403324 - protein, 19 aa, Entamoeba dispar
YRYYEPKLIILLNELYLLQ

SEQ ID NO: 2403325 - protein, 21 aa, Entamoeba dispar
YSCYSIYYIFATILSMQVPFI

SEQ ID NO: 2403326 - protein, 28 aa, Entamoeba dispar
YSDETYFWARYFKLLFLKSNKLGEYSTF

SEQ ID NO: 2403327 - protein, 25 aa, Entamoeba dispar
YSDYEYHMIYWYISILFSMSYEHLN

SEQ ID NO: 2403328 - protein, 20 aa, Entamoeba dispar
YSFAICMLEIWLGRDPYDPM

SEQ ID NO: 2403329 - protein, 19 aa, Entamoeba dispar
YSFAICMLEIWLGRDPYNP

SEQ ID NO: 2403330 - protein, 21 aa, Entamoeba dispar
YSFAITMFETIKWDNPYSKEV

SEQ ID NO: 2403331 - protein, 35 aa, Entamoeba dispar
YSFAVTMLHILMWDAPYQGSLFKYPWSIANFVADG

SEQ ID NO: 2403332 - protein, 26 aa, Entamoeba dispar
YSFEKVYFIFYNGNSPTRIIGGVGGL

SEQ ID NO: 2403333 - protein, 20 aa, Entamoeba dispar
YSFFYFFIFLFSISLLIQLY

SEQ ID NO: 2403334 - protein, 21 aa, Entamoeba dispar
YSFIFALIFLVVAAVFCVIFY

SEQ ID NO: 2403335 - protein, 23 aa, Entamoeba dispar
YSFQFTLRNTYKKVLLYTFHGKE

SEQ ID NO: 2403336 - protein, 29 aa, Entamoeba dispar
YSFTISISIFFFSPLTYLQLLLLCVINYI

SEQ ID NO: 2403337 - protein, 25 aa, Entamoeba dispar
YSGDVPKQFYLACYGRALIYNIDTK

SEQ ID NO: 2403338 - protein, 27 aa, Entamoeba dispar
YSGNYHGLLRGMWFKFTATQSTHVIDT

SEQ ID NO: 2403339 - protein, 17 aa, Entamoeba dispar
YSITMLQIITFQDHFLK

SEQ ID NO: 2403340 - protein, 29 aa, Entamoeba dispar
YSITMLQIITWQEPFPKEIYKYPWDIADA

SEQ ID NO: 2403341 - protein, 25 aa, Entamoeba dispar
YSKNKYMMIIFHTPNNPKFVFHFEP

SEQ ID NO: 2403342 - protein, 36 aa, Entamoeba dispar
YSKVVIQFILPIYSFIFFIVLLVRYVSQFRPDSVYS

SEQ ID NO: 2403343 - protein, 27 aa, Entamoeba dispar
YSLCFFRVLYLDCLLSEALVYFWVGEN

SEQ ID NO: 2403344 - protein, 22 aa, Entamoeba dispar
YSLCLPIVWITQSAKLCLVKYY

SEQ ID NO: 2403345 - protein, 29 aa, Entamoeba dispar
YSLLSTESFIPCIFILEKQLKKLNKKPLV

SEQ ID NO: 2403346 - protein, 21 aa, Entamoeba dispar
YSLTLLAIIGTPSITFVLLFL

SEQ ID NO: 2403347 - protein, 27 aa, Entamoeba dispar
YSNMYHEWYIFPRKVSKIEWIDELDEI

SEQ ID NO: 2403348 - protein, 25 aa, Entamoeba dispar
YSQMFDIWHIIPAYVTMAEIQFLRD

SEQ ID NO: 2403349 - protein, 18 aa, Entamoeba dispar
YSQRLDWLGVGLAIITVM

SEQ ID NO: 2403350 - protein, 26 aa, Entamoeba dispar
YSRNKWMMIIFHTPNNPKYVFYFEPQ

SEQ ID NO: 2403351 - protein, 24 aa, Entamoeba dispar
YSSNCILQLLPSISFFDIDHFFEG

SEQ ID NO: 2403352 - protein, 28 aa, Entamoeba dispar
YSSSYWAWPILLIAIICFSFALVQFVAD

SEQ ID NO: 2403353 - protein, 41 aa, Entamoeba dispar
YSTSHKALFVILYGHALYLLLHLNAFPFKLIQRISSNNNSV

SEQ ID NO: 2403354 - protein, 22 aa, Entamoeba dispar
YSTVFSLRYILPRQKNPLTGKK

SEQ ID NO: 2403355 - protein, 19 aa, Entamoeba dispar
YSVFEMFWRMAFILFSSFC

SEQ ID NO: 2403356 - protein, 25 aa, Entamoeba dispar
YSVFNIVFICYLFFMLDSFMKQNGT

SEQ ID NO: 2403357 - protein, 24 aa, Entamoeba dispar
YSVHHVLLKPKETIMFFITTTEEE

SEQ ID NO: 2403358 - protein, 24 aa, Entamoeba dispar
YSVLNWSEPFPKQSFKFAWDVAEF

SEQ ID NO: 2403359 - protein, 24 aa, Entamoeba dispar
YSVNFNLFQSISPLFMQWDYWILP

SEQ ID NO: 2403360 - protein, 18 aa, Entamoeba dispar
YSVYCPSAISIKIGMESK

SEQ ID NO: 2403361 - protein, 25 aa, Entamoeba dispar
YSVYTLFIHLFISHINMLVLFNNIH

SEQ ID NO: 2403362 - protein, 24 aa, Entamoeba dispar
YSWNELNLLSKQKIWIGNDTALIL

SEQ ID NO: 2403363 - protein, 33 aa, Entamoeba dispar
YSYAITMLQIITWKDPFPKTEFKFPWSIANATA

SEQ ID NO: 2403364 - protein, 25 aa, Entamoeba dispar
YSYPTIFEFTPYLLSFLTYHTFSHR

SEQ ID NO: 2403365 - protein, 17 aa, Entamoeba dispar
YSYPVDIYAYGIVLYET

SEQ ID NO: 2403366 - protein, 32 aa, Entamoeba dispar
YSYSITMLEIITWQDPFPKDMKPWTVADKISA

SEQ ID NO: 2403367 - protein, 39 aa, Entamoeba dispar
YSYSITMLQIITWKEPFPKTEFKFPWKIAEFISTGKRPT

SEQ ID NO: 2403368 - protein, 40 aa, Entamoeba dispar
YSYSITMLQIITWKEPFPKTEFKFPWKIAEFISTGKRPTI

SEQ ID NO: 2403369 - protein, 33 aa, Entamoeba dispar
YSYSITMLQIITWQDPFPKEIYKYPWDIANTIT

SEQ ID NO: 2403370 - protein, 27 aa, Entamoeba dispar
YSYSITMLQIITWQDPFPKTEFKFPWK

SEQ ID NO: 2403371 - protein, 32 aa, Entamoeba dispar
YSYSITMLQIITWQDPFPKTLTGKRPPIIQEV

SEQ ID NO: 2403372 - protein, 36 aa, Entamoeba dispar
YSYSITMLQIITWQDPFPKTLYPHPWDIANTISTGK

SEQ ID NO: 2403373 - protein, 34 aa, Entamoeba dispar
YSYSITMLQIITWQEPFPKEIYKYPWDIADAITT

SEQ ID NO: 2403374 - protein, 18 aa, Entamoeba dispar
YTCDSCNPGYYLNSDNFC

SEQ ID NO: 2403375 - protein, 27 aa, Entamoeba dispar
YTCKMAKYWYLQRMDWIGAAISIITVI

SEQ ID NO: 2403376 - protein, 28 aa, Entamoeba dispar
YTFACTFLSFFFILFFGLFPLSLLEILQ

SEQ ID NO: 2403377 - protein, 24 aa, Entamoeba dispar
YTFFSFICYIIFFNVLLLVLQYSL

SEQ ID NO: 2403378 - protein, 28 aa, Entamoeba dispar
YTGEHQTFNYPILIAELSSEEKLIVPES

SEQ ID NO: 2403379 - protein, 30 aa, Entamoeba dispar
YTIYIPAQYGYFLFWALKSKENIGKYPSNP

SEQ ID NO: 2403380 - protein, 21 aa, Entamoeba dispar
YTKDCTGCQPGYMWFGEGNCL

SEQ ID NO: 2403381 - protein, 18 aa, Entamoeba dispar
YTKYEIMCKPFTGTIRPG

SEQ ID NO: 2403382 - protein, 18 aa, Entamoeba dispar
YTLLNSVCTLCSVAIPNC

SEQ ID NO: 2403383 - protein, 24 aa, Entamoeba dispar
YTLQMAKIWYSQRLEWMGFTISTF

SEQ ID NO: 2403384 - protein, 28 aa, Entamoeba dispar
YTMVGSNLIISDYLLKGLISIEIKSSSK

SEQ ID NO: 2403385 - protein, 26 aa, Entamoeba dispar
YTNKTRYICYLPLAHIFELTIEFCNL

SEQ ID NO: 2403386 - protein, 25 aa, Entamoeba dispar
YTNPFLMFFIMLIFSTTHGYFASHA

SEQ ID NO: 2403387 - protein, 26 aa, Entamoeba dispar
YTPETFLQKHLFIYELKTSQYIINPD

SEQ ID NO: 2403388 - protein, 24 aa, Entamoeba dispar
YTSFPTTIYLFKYDQKLIRLEYIG

SEQ ID NO: 2403389 - protein, 37 aa, Entamoeba dispar
YTSGWSVALIIIGITLFIGLVILLLTIIIINYNKYEE

SEQ ID NO: 2403390 - protein, 21 aa, Entamoeba dispar
YTSVFFFRLLEFLHLSVDIKE

SEQ ID NO: 2403391 - protein, 25 aa, Entamoeba dispar
YTTFNYSLLILIVSFIGFGIVQSKT

SEQ ID NO: 2403392 - protein, 23 aa, Entamoeba dispar
YTTWQFMERLFTPKDLSNFLNTE

SEQ ID NO: 2403393 - protein, 24 aa, Entamoeba dispar
YVAEWLSIVMFFFALSQRKQGSTK

SEQ ID NO: 2403394 - protein, 38 aa, Entamoeba dispar
YVATFLSYYPVKIIGLFFFIAFFIFSLNYVPKTMLGLP

SEQ ID NO: 2403395 - protein, 20 aa, Entamoeba dispar
YVDPIRPYTYGVWIELIHDK

SEQ ID NO: 2403396 - protein, 17 aa, Entamoeba dispar
YVFKKRPTKPAKLTVKM

SEQ ID NO: 2403397 - protein, 26 aa, Entamoeba dispar
YVFPSALRFLPFVMILSLFLNNTPVV

SEQ ID NO: 2403398 - protein, 17 aa, Entamoeba dispar
YVFVKKGKSISLIELDQ

SEQ ID NO: 2403399 - protein, 18 aa, Entamoeba dispar
YVHKLYSYGIDYGFDSTT

SEQ ID NO: 2403400 - protein, 37 aa, Entamoeba dispar
YVINNNLVYYLYYLFVIILFFFPSLMIPTNPADEIFT

SEQ ID NO: 2403401 - protein, 19 aa, Entamoeba dispar
YVISYLTGKLLKTFSTFHY

SEQ ID NO: 2403402 - protein, 53 aa, Entamoeba dispar
YVKNTEFPKWTIGVIVIFVIALIVIVVVIIVYAVYVYLQRQRNLKVFSERVKK

SEQ ID NO: 2403403 - protein, 23 aa, Entamoeba dispar
YVLDINSIFPILLLSVNGYKTTD

SEQ ID NO: 2403404 - protein, 27 aa, Entamoeba dispar
YVLFYLIFKIFLIVIALLRARSEVFFA

SEQ ID NO: 2403405 - protein, 17 aa, Entamoeba dispar
YVLLPNRPDIQSKGAFL

SEQ ID NO: 2403406 - protein, 24 aa, Entamoeba dispar
YVNNGVWYLISSYEGIINQTTPYP

SEQ ID NO: 2403407 - protein, 18 aa, Entamoeba dispar
YVNWFLAFMGGLAGGFAY

SEQ ID NO: 2403408 - protein, 19 aa, Entamoeba dispar
YVNWFLAFVGGLAGGFAYQ

SEQ ID NO: 2403409 - protein, 30 aa, Entamoeba dispar
YVQDVVNAFDLILRKGIIGQIYNIGTTREI

SEQ ID NO: 2403410 - protein, 25 aa, Entamoeba dispar
YVVISALCPPFFFYIQRIYSKSEDP

SEQ ID NO: 2403411 - protein, 28 aa, Entamoeba dispar
YVVKVHRIHAIELLPLYSSNGLSVGETM

SEQ ID NO: 2403412 - protein, 30 aa, Entamoeba dispar
YVVKVISDIFQFKDVWKHICIVWTKCYNYT

SEQ ID NO: 2403413 - protein, 21 aa, Entamoeba dispar
YVVLTFYFLLLSSCGEAPCLT

SEQ ID NO: 2403414 - protein, 17 aa, Entamoeba dispar
YVYGIYFDIPVQNSLDT

SEQ ID NO: 2403415 - protein, 17 aa, Entamoeba dispar
YVYPFGVDPIWKSSNNE

SEQ ID NO: 2403416 - protein, 34 aa, Entamoeba dispar
YWIAHFIQNMIISFFLCWFVIGIGAICGFRLMTK

SEQ ID NO: 2403417 - protein, 18 aa, Entamoeba dispar
YWIKRKCYVDYDLRTPFL

SEQ ID NO: 2403418 - protein, 17 aa, Entamoeba dispar
YWLRKYSFEVSLCEKCP

SEQ ID NO: 2403419 - protein, 39 aa, Entamoeba dispar
YYCAYILHSIPFLIFYPTLYLAIAYPMLNLRPGFVNFLC

SEQ ID NO: 2403420 - protein, 26 aa, Entamoeba dispar
YYDIEQWYHFLPKSSIPLLAINSIDD

SEQ ID NO: 2403421 - protein, 18 aa, Entamoeba dispar
YYDWRVSLCVMAVSPVLI

SEQ ID NO: 2403422 - protein, 19 aa, Entamoeba dispar
YYDWRVSLCVMAVSPVLIV

SEQ ID NO: 2403423 - protein, 24 aa, Entamoeba dispar
YYEKSNIVLPYKLKLKIMRDVECG

SEQ ID NO: 2403424 - protein, 19 aa, Entamoeba dispar
YYEWKVALCVIATSPILVL

SEQ ID NO: 2403425 - protein, 18 aa, Entamoeba dispar
YYFEGLTWNKDLFNFITS

SEQ ID NO: 2403426 - protein, 17 aa, Entamoeba dispar
YYFYCYKTITVTFTGQS

SEQ ID NO: 2403427 - protein, 20 aa, Entamoeba dispar
YYHLCYYFIHNQSLPSYTSL

SEQ ID NO: 2403428 - protein, 27 aa, Entamoeba dispar
YYHNCPDAMFITLPFTAIHSFDNSASQ

SEQ ID NO: 2403429 - protein, 20 aa, Entamoeba dispar
YYIFLFLSIEVVGEYCDWNK

SEQ ID NO: 2403430 - protein, 19 aa, Entamoeba dispar
YYKFSNWREYIKPKYHCII

SEQ ID NO: 2403431 - protein, 24 aa, Entamoeba dispar
YYKKMEINFFKARVALVLGIIFNF

SEQ ID NO: 2403432 - protein, 17 aa, Entamoeba dispar
YYLPLLRMFNECCFPTG

SEQ ID NO: 2403433 - protein, 18 aa, Entamoeba dispar
YYMSYSDRNFIYIALTYC

SEQ ID NO: 2403434 - protein, 20 aa, Entamoeba dispar
YYPSFFSLLSQFKFFIKQKL

SEQ ID NO: 2403435 - protein, 20 aa, Entamoeba dispar
YYQFIQLVGLLYYAGDVIGR

SEQ ID NO: 2403436 - protein, 26 aa, Entamoeba dispar
YYQSHAHMMLPVWCALHGQTVELFHE

SEQ ID NO: 2403437 - protein, 19 aa, Entamoeba dispar
YYRQKYRLGKWFKLDMSSI

SEQ ID NO: 2403438 - protein, 22 aa, Entamoeba dispar
YYSNKKAWKYALISILSIVDMD

SEQ ID NO: 2403439 - protein, 30 aa, Entamoeba dispar
YYSNKMLFFYKQIIIFYYFVNYQTNDKNQI

SEQ ID NO: 2403440 - protein, 25 aa, Entamoeba dispar
YYYDLVFFKIILTINWPWLCICMVL

SEQ ID NO: 2403441 - protein, 20 aa, Entamoeba dispar
YYYFSLVPPVSFKLATTLSS

SEQ ID NO: 2403442 - protein, 26 aa, Entamoeba dispar
NKEIVWWMIMIIIIIILIIIIIIIII

SEQ ID NO: 2403443 - protein, 25 aa, Entamoeba dispar
KEIVWWMIMIIIIIILIIIIIIIII

SEQ ID NO: 2403444 - protein, 18 aa, Entamoeba dispar
IIIIIIIIIIIMINYIIK

SEQ ID NO: 2403445 - protein, 17 aa, Entamoeba dispar
IIIIIIIIIIMINYIIK

SEQ ID NO: 2403446 - protein, 24 aa, Entamoeba dispar
KEIVWWMIMIIIIIILIIIIIIII

SEQ ID NO: 2403447 - protein, 23 aa, Entamoeba dispar
DNFRHEWFLSILGFIGGIGGGAI

SEQ ID NO: 2403448 - protein, 19 aa, Entamoeba dispar
IIIIIIIIIIIMINYIIKR

SEQ ID NO: 2403449 - protein, 17 aa, Entamoeba dispar
KYSDWIDLILLIIGIIS

SEQ ID NO: 2403450 - protein, 19 aa, Entamoeba dispar
AFQTILLYRITLARFSKLD

SEQ ID NO: 2403451 - protein, 20 aa, Entamoeba dispar
AKIYLIYFWSLCKGLIVIFT

SEQ ID NO: 2403452 - protein, 23 aa, Entamoeba dispar
EQMKMNFIFFTLATLGGIVGGAI

SEQ ID NO: 2403453 - protein, 20 aa, Entamoeba dispar
FISYFMYIGLFLSAGFKMIG

SEQ ID NO: 2403454 - protein, 23 aa, Entamoeba dispar
FSTHSMFIAFSLLYIGAASETKT

SEQ ID NO: 2403455 - protein, 22 aa, Entamoeba dispar
IINKPYFFIITGEEQYPLFFGK

SEQ ID NO: 2403456 - protein, 26 aa, Entamoeba dispar
IRNYIAYFYYFLPFNIMIDKEKHMYL

SEQ ID NO: 2403457 - protein, 24 aa, Entamoeba dispar
LCSKTFLIWVTKDRPYLYLYQEKN

SEQ ID NO: 2403458 - protein, 18 aa, Entamoeba dispar
LKKPYRNIFKWAPLLALV

SEQ ID NO: 2403459 - protein, 22 aa, Entamoeba dispar
MSTYFCWLIIPLLMKENGATPF

SEQ ID NO: 2403460 - protein, 20 aa, Entamoeba dispar
PFMAFILYLVYIQIDYHLEV

SEQ ID NO: 2403461 - protein, 21 aa, Entamoeba dispar
PLINFLLLLLIPKSINYPKEE

SEQ ID NO: 2403462 - protein, 23 aa, Entamoeba dispar
QLYRYANWLDLILLAVGIFGSIG

SEQ ID NO: 2403463 - protein, 23 aa, Entamoeba dispar
STTLYLPPRYPLLGGWKTSFEVN

SEQ ID NO: 2403464 - protein, 25 aa, Entamoeba dispar
TAYKPNLILKVLSYFLPFSIYINDD

SEQ ID NO: 2403465 - protein, 25 aa, Entamoeba dispar
TERDKFFNMIFPFVLFILDDSEKIN

SEQ ID NO: 2403466 - protein, 24 aa, Entamoeba dispar
VSEHPFVSMVLLTVTMILIGLIVM

SEQ ID NO: 2403467 - protein, 22 aa, Entamoeba dispar
VSILIVGVLLVALVIVIILAIV

SEQ ID NO: 2403468 - protein, 23 aa, Entamoeba dispar
VSSLFVSFLIVCAVILIVAVVVR

SEQ ID NO: 2403469 - protein, 23 aa, Entamoeba dispar
AAILPLFVFIIFPRQPKYKNDET

SEQ ID NO: 2403470 - protein, 18 aa, Entamoeba dispar
ACTFLSFFFILFFGLFPL

SEQ ID NO: 2403471 - protein, 20 aa, Entamoeba dispar
AFFLMDIWFATISNFTCQII

SEQ ID NO: 2403472 - protein, 20 aa, Entamoeba dispar
AFIQIVIFALLAWWQYRNLK

SEQ ID NO: 2403473 - protein, 18 aa, Entamoeba dispar
AFPLFIQANVLLASSTKH

SEQ ID NO: 2403474 - protein, 17 aa, Entamoeba dispar
AFTTATNIILDIDQEVK

SEQ ID NO: 2403475 - protein, 17 aa, Entamoeba dispar
AFVVIFIVFVITKLVVQ

SEQ ID NO: 2403476 - protein, 25 aa, Entamoeba dispar
AGCDAMFAFPWYITWFLHSVEDIEV

SEQ ID NO: 2403477 - protein, 22 aa, Entamoeba dispar
AGEIFCFLFFGFSLLPCFDKIL

SEQ ID NO: 2403478 - protein, 25 aa, Entamoeba dispar
AGIIILLIIITTISLILFIRIERSI

SEQ ID NO: 2403479 - protein, 19 aa, Entamoeba dispar
AGVVVLSWYFIKKTNQNKR

SEQ ID NO: 2403480 - protein, 18 aa, Entamoeba dispar
AIALYNFIIPYFISNKNY

SEQ ID NO: 2403481 - protein, 21 aa, Entamoeba dispar
AIGGFLFLRFINPAIVSPQRF

SEQ ID NO: 2403482 - protein, 27 aa, Entamoeba dispar
AIGILINIILILPLVLFIWRFVIRRII

SEQ ID NO: 2403483 - protein, 24 aa, Entamoeba dispar
AILGIFMPPLFILSFLFSRKSNKK

SEQ ID NO: 2403484 - protein, 20 aa, Entamoeba dispar
AIVCFIYFPFSQIASFLIID

SEQ ID NO: 2403485 - protein, 26 aa, Entamoeba dispar
AKKNLWYVWVIIVVGIIFIISLIILG

SEQ ID NO: 2403486 - protein, 25 aa, Entamoeba dispar
AKSVILLGELLYLAGLLLPQRHLSL

SEQ ID NO: 2403487 - protein, 23 aa, Entamoeba dispar
AKYGSLYHLIFKQGMKKLPKEAV

SEQ ID NO: 2403488 - protein, 17 aa, Entamoeba dispar
ALFIGIIVYISLFKITF

SEQ ID NO: 2403489 - protein, 18 aa, Entamoeba dispar
ALFLLFIVRFTITAMSIS

SEQ ID NO: 2403490 - protein, 20 aa, Entamoeba dispar
ALIVIFIVLVLLACVVVGFV

SEQ ID NO: 2403491 - protein, 20 aa, Entamoeba dispar
ALLAWWQYRNLKSFFRHIKV

SEQ ID NO: 2403492 - protein, 24 aa, Entamoeba dispar
ALLIIFQAFVLIFIFTSGYVTLDN

SEQ ID NO: 2403493 - protein, 27 aa, Entamoeba dispar
ALLIVLIIIIIIIGVLVYFFIFKPKKQ

SEQ ID NO: 2403494 - protein, 19 aa, Entamoeba dispar
ALLLFLKKIGISPSLIRST

SEQ ID NO: 2403495 - protein, 25 aa, Entamoeba dispar
ALLLNSVIFFYILSPLPLYSYKQVV

SEQ ID NO: 2403496 - protein, 21 aa, Entamoeba dispar
ALSFILAFVFNFLVINLFKYT

SEQ ID NO: 2403497 - protein, 38 aa, Entamoeba dispar
ALTNFLFWGIGSIVYILYFFFVITLFLILHIKLTRKIK

SEQ ID NO: 2403498 - protein, 23 aa, Entamoeba dispar
AQCRLMKFLLFRMNFKGDYSILL

SEQ ID NO: 2403499 - protein, 17 aa, Entamoeba dispar
ASFFEIIKRCLIILTKD

SEQ ID NO: 2403500 - protein, 19 aa, Entamoeba dispar
ASIYLVILVLVIAAVFVAF

SEQ ID NO: 2403501 - protein, 36 aa, Entamoeba dispar
ASKTLIIILSILSILIFLGIIVALILIFLVYKKNKK

SEQ ID NO: 2403502 - protein, 26 aa, Entamoeba dispar
ASTHTFFWICFFLMQFCTVVLVLNLL

SEQ ID NO: 2403503 - protein, 27 aa, Entamoeba dispar
ASTHTLFWICFFLMQFCTVVLVLNLLK

SEQ ID NO: 2403504 - protein, 24 aa, Entamoeba dispar
ATVIPFCLFFFNLFIKVIEVLIII

SEQ ID NO: 2403505 - protein, 20 aa, Entamoeba dispar
AVERMVILMYFGVAIPDILV

SEQ ID NO: 2403506 - protein, 19 aa, Entamoeba dispar
AVFIISYLVSLKREKLSKK

SEQ ID NO: 2403507 - protein, 23 aa, Entamoeba dispar
AVQLVFLCYIIFSALPKFLFGSI

SEQ ID NO: 2403508 - protein, 24 aa, Entamoeba dispar
AVTMLHILMWDAPYQGSLFKYPWS

SEQ ID NO: 2403509 - protein, 20 aa, Entamoeba dispar
AWDYLLFLNGIVLASILVYI

SEQ ID NO: 2403510 - protein, 22 aa, Entamoeba dispar
AYFSLLLLHPVWDKSLFKIDTK

SEQ ID NO: 2403511 - protein, 19 aa, Entamoeba dispar
AYLLSIIYIIFVCCVSILI

SEQ ID NO: 2403512 - protein, 26 aa, Entamoeba dispar
CAAVVFIVLTLWWFYKALTFTGYVQP

SEQ ID NO: 2403513 - protein, 24 aa, Entamoeba dispar
CCILYLFVFLIFGMGWIKGPVADF

SEQ ID NO: 2403514 - protein, 17 aa, Entamoeba dispar
CCPLPSFDIIFTDSFHS

SEQ ID NO: 2403515 - protein, 18 aa, Entamoeba dispar
CCSGILLYFLLRTTKFDI

SEQ ID NO: 2403516 - protein, 26 aa, Entamoeba dispar
CCVFVGIIILFFIKSKRKSTEVELED

SEQ ID NO: 2403517 - protein, 26 aa, Entamoeba dispar
CDLVPVWWNFIVVIIIISIIIKSCVI

SEQ ID NO: 2403518 - protein, 26 aa, Entamoeba dispar
CESKKKFLIVGGFFQQFEYSDDECKN

SEQ ID NO: 2403519 - protein, 17 aa, Entamoeba dispar
CFIIYIPTYFVYGQSEP

SEQ ID NO: 2403520 - protein, 19 aa, Entamoeba dispar
CFLLFFIIIAIIGVLLAYY

SEQ ID NO: 2403521 - protein, 19 aa, Entamoeba dispar
CFQLSIKWIFVLSLRLRNG

SEQ ID NO: 2403522 - protein, 17 aa, Entamoeba dispar
CGFIIFRFIFKSEVPWI

SEQ ID NO: 2403523 - protein, 25 aa, Entamoeba dispar
CIIVSFFVILLFNIVFFVIKNCFLN

SEQ ID NO: 2403524 - protein, 18 aa, Entamoeba dispar
CILLFFKSKGFHCSPGCT

SEQ ID NO: 2403525 - protein, 17 aa, Entamoeba dispar
CILLLLHIYWFTLILKM

SEQ ID NO: 2403526 - protein, 28 aa, Entamoeba dispar
CIVALLRGIWIMPIEWLFSKGDYFENEE

SEQ ID NO: 2403527 - protein, 23 aa, Entamoeba dispar
CKMAKLWYLQRMDWIGAFIIVVT

SEQ ID NO: 2403528 - protein, 22 aa, Entamoeba dispar
CKMAKYWYLQRMDWIGAAISII

SEQ ID NO: 2403529 - protein, 24 aa, Entamoeba dispar
CKSSPVWWVIVLAIIGGIMFFILF

SEQ ID NO: 2403530 - protein, 23 aa, Entamoeba dispar
CKSSPVWWVIVLVIIGGIVLTVI

SEQ ID NO: 2403531 - protein, 30 aa, Entamoeba dispar
CLAIIIVIILIIIFLIFIIQTRRKKKEREE

SEQ ID NO: 2403532 - protein, 19 aa, Entamoeba dispar
CLCFVFFFCFLNTTYLLDG

SEQ ID NO: 2403533 - protein, 22 aa, Entamoeba dispar
CLFSTFFIIVIPIIFRSFYFLI

SEQ ID NO: 2403534 - protein, 21 aa, Entamoeba dispar
CLPFYFIYRPIYQWIFQRVTE

SEQ ID NO: 2403535 - protein, 17 aa, Entamoeba dispar
CLVCCIFTLLGCCYCGL

SEQ ID NO: 2403536 - protein, 19 aa, Entamoeba dispar
CLWCLLFLTLLSVSVSLVM

SEQ ID NO: 2403537 - protein, 24 aa, Entamoeba dispar
CMSIIGYYYFWWLDAVGGIILSFY

SEQ ID NO: 2403538 - protein, 24 aa, Entamoeba dispar
CMSVVGYYYFWWLDAVGGIVLSFY

SEQ ID NO: 2403539 - protein, 23 aa, Entamoeba dispar
CMTQYFIFLILTLSLILLLHINS

SEQ ID NO: 2403540 - protein, 26 aa, Entamoeba dispar
CNIEWIIVVIILIITIIILLSIVIIG

SEQ ID NO: 2403541 - protein, 26 aa, Entamoeba dispar
CPIPHSFLIFIRIISLFIMTVPSAFE

SEQ ID NO: 2403542 - protein, 29 aa, Entamoeba dispar
CPLLLFKAWMLRWWKIMYLRLLDLQKWKV

SEQ ID NO: 2403543 - protein, 19 aa, Entamoeba dispar
CQLLPLIVIILCGIIVLIM

SEQ ID NO: 2403544 - protein, 41 aa, Entamoeba dispar
CRKVSVWLYWVLYLVTIIILYWIFLIITGFFIGLLYHRLNK

SEQ ID NO: 2403545 - protein, 28 aa, Entamoeba dispar
CRSKPIGWWVWLLIALGIVFIFICSIVM

SEQ ID NO: 2403546 - protein, 31 aa, Entamoeba dispar
CRYQKCYLYYLKIGLLILLSYAGNTFLPCDF

SEQ ID NO: 2403547 - protein, 22 aa, Entamoeba dispar
CSAILFWCYMFAILNIIFGVVL

SEQ ID NO: 2403548 - protein, 22 aa, Entamoeba dispar
CVLVLYWFAFPYNFMNYRVDGI

SEQ ID NO: 2403549 - protein, 19 aa, Entamoeba dispar
CVVMYFINGFNKNLARKLA

SEQ ID NO: 2403550 - protein, 18 aa, Entamoeba dispar
CWILLSLLLMFLDCQYHL

SEQ ID NO: 2403551 - protein, 17 aa, Entamoeba dispar
CYLYPLHPFTKPPQYIY

SEQ ID NO: 2403552 - protein, 25 aa, Entamoeba dispar
CYPKLLFKFPWAIADFINRGQRRER

SEQ ID NO: 2403553 - protein, 23 aa, Entamoeba dispar
DADLALMAKKPLRFTSDIIVNRL

SEQ ID NO: 2403554 - protein, 25 aa, Entamoeba dispar
DDVPTWVIVILVIVGVIIVIIIILF

SEQ ID NO: 2403555 - protein, 23 aa, Entamoeba dispar
DDYKKIKPFAILNLLNITVKLSD

SEQ ID NO: 2403556 - protein, 25 aa, Entamoeba dispar
DEIYYALNILYFVSLVLDPYIPEFG

SEQ ID NO: 2403557 - protein, 27 aa, Entamoeba dispar
DFIGRILIPYWIFLILIGCVSGIVHWK

SEQ ID NO: 2403558 - protein, 18 aa, Entamoeba dispar
DFWVGDWWGIWSTSAYLE

SEQ ID NO: 2403559 - protein, 20 aa, Entamoeba dispar
DGFYEYFHFKFPSLFTVLYS

SEQ ID NO: 2403560 - protein, 24 aa, Entamoeba dispar
DGRPKFDIILLNNLGLMTSVSNNG

SEQ ID NO: 2403561 - protein, 17 aa, Entamoeba dispar
DGTLLWYKFLPVNWELN

SEQ ID NO: 2403562 - protein, 20 aa, Entamoeba dispar
DHFPLARDLFNYAFLSMWQD

SEQ ID NO: 2403563 - protein, 20 aa, Entamoeba dispar
DIILLFFTLLFSVFIIISHW

SEQ ID NO: 2403564 - protein, 24 aa, Entamoeba dispar
DIKVMYLCMFFVLKNISYSTMKSW

SEQ ID NO: 2403565 - protein, 24 aa, Entamoeba dispar
DIVLYLLVLFFSWISERKLDKVIS

SEQ ID NO: 2403566 - protein, 17 aa, Entamoeba dispar
DKAFMEFIYSELDLLDN

SEQ ID NO: 2403567 - protein, 24 aa, Entamoeba dispar
DKDLIGIRFFYYIHLISSGFSKQQ

SEQ ID NO: 2403568 - protein, 21 aa, Entamoeba dispar
DKEKHMYLIPKYYYKNLKIDV

SEQ ID NO: 2403569 - protein, 20 aa, Entamoeba dispar
DKFLLRIQPPLVALDGGYAC

SEQ ID NO: 2403570 - protein, 26 aa, Entamoeba dispar
DKIIWLLYSFLFITFFLIYSSKPKEL

SEQ ID NO: 2403571 - protein, 25 aa, Entamoeba dispar
DLISWIYIIRIILFSLTKLYPQTEY

SEQ ID NO: 2403572 - protein, 25 aa, Entamoeba dispar
DLRDRGLFYWRLLAHDPELAKEMVC

SEQ ID NO: 2403573 - protein, 23 aa, Entamoeba dispar
DLRTPFLFMPLVKLVDAMIFKPL

SEQ ID NO: 2403574 - protein, 20 aa, Entamoeba dispar
DMFGLIYQLLLTPSFYLLIL

SEQ ID NO: 2403575 - protein, 23 aa, Entamoeba dispar
DNENFIRFPFKLKIKILLDTARG

SEQ ID NO: 2403576 - protein, 23 aa, Entamoeba dispar
DNIIGFWLWAYYLSYLRYAFELV

SEQ ID NO: 2403577 - protein, 24 aa, Entamoeba dispar
DNPSLVWFFVILSLCLVWMIVGVI

SEQ ID NO: 2403578 - protein, 21 aa, Entamoeba dispar
DQPFYPFYKKINKLLLDLHDL

SEQ ID NO: 2403579 - protein, 26 aa, Entamoeba dispar
DSCRYFKIILITMQIVLLSPLIYNEL

SEQ ID NO: 2403580 - protein, 24 aa, Entamoeba dispar
DSDGVIQLLWLLIQYHDPQLSNHF

SEQ ID NO: 2403581 - protein, 18 aa, Entamoeba dispar
DSGASLTMMLLLVTVMLL

SEQ ID NO: 2403582 - protein, 23 aa, Entamoeba dispar
DSRYFFLVMVICLIVLVLQQIVF

SEQ ID NO: 2403583 - protein, 33 aa, Entamoeba dispar
DSTPVGWIIFGVLFYILFVIVLAIIIIGIIMKR

SEQ ID NO: 2403584 - protein, 22 aa, Entamoeba dispar
DSVIPTILLLKSALWKEEWNSK

SEQ ID NO: 2403585 - protein, 18 aa, Entamoeba dispar
DTLPLYRTLFHPKDNEFV

SEQ ID NO: 2403586 - protein, 24 aa, Entamoeba dispar
DTLQQLFQILLPQIIRFKLTPKLT

SEQ ID NO: 2403587 - protein, 20 aa, Entamoeba dispar
DTLWIFTYFMKDLNLYGLFC

SEQ ID NO: 2403588 - protein, 23 aa, Entamoeba dispar
DTMPIYQWLIIKYEFIQYCTDII

SEQ ID NO: 2403589 - protein, 21 aa, Entamoeba dispar
DTMYYYFFSLPEELDLIFSFS

SEQ ID NO: 2403590 - protein, 25 aa, Entamoeba dispar
DTTLLIVLIVFGTLALLPMIKRKLG

SEQ ID NO: 2403591 - protein, 21 aa, Entamoeba dispar
DVFVHLLLYILYDYLISAKSL

SEQ ID NO: 2403592 - protein, 27 aa, Entamoeba dispar
DVIIEGYFYLFPAFCLPWFVKQKKNIP

SEQ ID NO: 2403593 - protein, 24 aa, Entamoeba dispar
DVSELLEILFWKYLKEEPGASAEL

SEQ ID NO: 2403594 - protein, 24 aa, Entamoeba dispar
DVSYQMLYIPFYSLTKKAQSIVNR

SEQ ID NO: 2403595 - protein, 23 aa, Entamoeba dispar
DYKLNYVLVVGLPVILLSIILLI

SEQ ID NO: 2403596 - protein, 17 aa, Entamoeba dispar
DYKYAFPLFIQANVLLA

SEQ ID NO: 2403597 - protein, 20 aa, Entamoeba dispar
EALKLIPIFVLGAMKTSAFM

SEQ ID NO: 2403598 - protein, 31 aa, Entamoeba dispar
EALLRAMFDFTFYWYNFMPLSRGTAATGFVF

SEQ ID NO: 2403599 - protein, 21 aa, Entamoeba dispar
EAYLVKWKLFRSLALEDLKKT

SEQ ID NO: 2403600 - protein, 26 aa, Entamoeba dispar
EDEKIVILFDLLIDILFEYGFIIFTS

SEQ ID NO: 2403601 - protein, 19 aa, Entamoeba dispar
EDYFFPLPDYVTSYSFLIE

SEQ ID NO: 2403602 - protein, 32 aa, Entamoeba dispar
EEKILRAMFSFTFFWYNFMPLTRGTAAGGFVF

SEQ ID NO: 2403603 - protein, 36 aa, Entamoeba dispar
EEKSKWWISLIILGVLLILFIITILSISFTITFLIN

SEQ ID NO: 2403604 - protein, 20 aa, Entamoeba dispar
EEWDLESFYPFFKEGFCKHL

SEQ ID NO: 2403605 - protein, 23 aa, Entamoeba dispar
EEYLPYLYLIINQVILILDTRCT

SEQ ID NO: 2403606 - protein, 18 aa, Entamoeba dispar
EFFKEEMIILLTILLKII

SEQ ID NO: 2403607 - protein, 26 aa, Entamoeba dispar
EFGYVRFYMITLPYFTTPATVLHFIC

SEQ ID NO: 2403608 - protein, 30 aa, Entamoeba dispar
EFIAILTNPLLFILTLIIGGGIYIGYKLNL

SEQ ID NO: 2403609 - protein, 20 aa, Entamoeba dispar
EFLAPFLPVISWQLAHVDLS

SEQ ID NO: 2403610 - protein, 19 aa, Entamoeba dispar
EFWWKLVVIILLTSIPFIA

SEQ ID NO: 2403611 - protein, 29 aa, Entamoeba dispar
EGVLLNCFLMILPVLKPHRRLAIALAIEY

SEQ ID NO: 2403612 - protein, 17 aa, Entamoeba dispar
EHQTFNYPILIAELSSE

SEQ ID NO: 2403613 - protein, 30 aa, Entamoeba dispar
EIFGIIVAVLFLVVILLVVGLFVGYIGYKK

SEQ ID NO: 2403614 - protein, 23 aa, Entamoeba dispar
EIVWWMIMIIIIIILIIIIIIII

SEQ ID NO: 2403615 - protein, 20 aa, Entamoeba dispar
EKFYIIFRSLLKCLVKNVLC

SEQ ID NO: 2403616 - protein, 19 aa, Entamoeba dispar
EKHMYLIPKYYYKNVKIDI

SEQ ID NO: 2403617 - protein, 34 aa, Entamoeba dispar
EKHPVWWVVLVIVILLIFIIVTVLILVIFGLYKI

SEQ ID NO: 2403618 - protein, 23 aa, Entamoeba dispar
EKKWLNIFFNWIPEMMFMICSFG

SEQ ID NO: 2403619 - protein, 24 aa, Entamoeba dispar
EKNINIRLFMKIKILIDAAKGIQY

SEQ ID NO: 2403620 - protein, 21 aa, Entamoeba dispar
EKRFNGLRRAWLLSYSFAIVI

SEQ ID NO: 2403621 - protein, 21 aa, Entamoeba dispar
EKYHFVMLYFIMNFPNDVKNL

SEQ ID NO: 2403622 - protein, 18 aa, Entamoeba dispar
EKYHLLITVLFISYDDFS

SEQ ID NO: 2403623 - protein, 23 aa, Entamoeba dispar
ELSLPFISVLIVSVTFICAFVVI

SEQ ID NO: 2403624 - protein, 17 aa, Entamoeba dispar
ELSPFMAFILYLVYIQI

SEQ ID NO: 2403625 - protein, 18 aa, Entamoeba dispar
ELSPFMAFILYLVYIQID

SEQ ID NO: 2403626 - protein, 29 aa, Entamoeba dispar
ELSRIIFLISLICILIIGALFVIVYGGFM

SEQ ID NO: 2403627 - protein, 22 aa, Entamoeba dispar
ELYMFILFVWIFFHVDHLKLLA

SEQ ID NO: 2403628 - protein, 24 aa, Entamoeba dispar
ENLLPFTFPVKYFFVFYKQRKLFV

SEQ ID NO: 2403629 - protein, 19 aa, Entamoeba dispar
ENTLFTYVLLFIGLLTVGM

SEQ ID NO: 2403630 - protein, 23 aa, Entamoeba dispar
ENVYFILLSFIISLIPITTIQYI

SEQ ID NO: 2403631 - protein, 26 aa, Entamoeba dispar
EPFWINIYHIMLLHGLLYWRHRPNIE

SEQ ID NO: 2403632 - protein, 35 aa, Entamoeba dispar
EQPDIIPMIIIYTLIPIIILLGCGIIFFLSCWVDK

SEQ ID NO: 2403633 - protein, 24 aa, Entamoeba dispar
EQRWWRLTLIFFLLGFCCFPFWIP

SEQ ID NO: 2403634 - protein, 23 aa, Entamoeba dispar
EQRWWRLTLIFFLLGFCFFPFWI

SEQ ID NO: 2403635 - protein, 24 aa, Entamoeba dispar
ERQLFTIPRWFSVGIVFIVFTFIV

SEQ ID NO: 2403636 - protein, 20 aa, Entamoeba dispar
ESFYPFFKEGFCKHLIPAAL

SEQ ID NO: 2403637 - protein, 21 aa, Entamoeba dispar
ESHFMLFIPLIIILIGTRFTS

SEQ ID NO: 2403638 - protein, 20 aa, Entamoeba dispar
ESKFQIIFLHLFDYSTFSSD

SEQ ID NO: 2403639 - protein, 21 aa, Entamoeba dispar
ESLQWFYGINYLVHRIFFTFY

SEQ ID NO: 2403640 - protein, 23 aa, Entamoeba dispar
ETFMYWDFFFIDLHKFLLLKVVC

SEQ ID NO: 2403641 - protein, 45 aa, Entamoeba dispar
ETKEFPMYMIAVIVIFFLVLVVVAILFIVYIVHVYLVRKRNLKVF

SEQ ID NO: 2403642 - protein, 24 aa, Entamoeba dispar
EVKAYLVIFYALLIYFPQLPSTTI

SEQ ID NO: 2403643 - protein, 32 aa, Entamoeba dispar
EVVLFGLWGIFLFLIIPSIIVFSVFYPSLKYP

SEQ ID NO: 2403644 - protein, 23 aa, Entamoeba dispar
EWKFTPYIFFYAIIFFLQLVLFI

SEQ ID NO: 2403645 - protein, 18 aa, Entamoeba dispar
EYFIPFLFDFIDNFERIT

SEQ ID NO: 2403646 - protein, 23 aa, Entamoeba dispar
EYKPLMYCLLIVFGLTIILSFEI

SEQ ID NO: 2403647 - protein, 17 aa, Entamoeba dispar
FAFLFFAFIFVIALLLA

SEQ ID NO: 2403648 - protein, 17 aa, Entamoeba dispar
FAIFVGIFISFTNTDDT

SEQ ID NO: 2403649 - protein, 25 aa, Entamoeba dispar
FALSIYWFFYVFNWYMTYAKQLLRL

SEQ ID NO: 2403650 - protein, 28 aa, Entamoeba dispar
FAMTLFTLLLFGPLFYRLIKVIFMPKTT

SEQ ID NO: 2403651 - protein, 24 aa, Entamoeba dispar
FCFQLSIKWIFVLSLRLRNGLISM

SEQ ID NO: 2403652 - protein, 17 aa, Entamoeba dispar
FDGYYLKNQQCIPEDKN

SEQ ID NO: 2403653 - protein, 18 aa, Entamoeba dispar
FEKVYFIFYNGNSPTRII

SEQ ID NO: 2403654 - protein, 19 aa, Entamoeba dispar
FELIFLWFIISTSNFRKVL

SEQ ID NO: 2403655 - protein, 24 aa, Entamoeba dispar
FELIKYFIFIIKNITGYCVVGFKG

SEQ ID NO: 2403656 - protein, 23 aa, Entamoeba dispar
FENKVFYVWFDAPIGYLSITANY

SEQ ID NO: 2403657 - protein, 23 aa, Entamoeba dispar
FEQQLIITIFIISIIFLLCCVCC

SEQ ID NO: 2403658 - protein, 18 aa, Entamoeba dispar
FFEIIKRCLIILTKDTIA

SEQ ID NO: 2403659 - protein, 17 aa, Entamoeba dispar
FFIIFSFAHETKPILLV

SEQ ID NO: 2403660 - protein, 24 aa, Entamoeba dispar
FFIISLILIIVIWGYPIILPDPKQ

SEQ ID NO: 2403661 - protein, 17 aa, Entamoeba dispar
FFILFLCFIVFSFLLFL

SEQ ID NO: 2403662 - protein, 18 aa, Entamoeba dispar
FFLLFIVFAVLVVIALFV

SEQ ID NO: 2403663 - protein, 18 aa, Entamoeba dispar
FFLLGFCFFPFWIPSFIL

SEQ ID NO: 2403664 - protein, 19 aa, Entamoeba dispar
FFLTLFYTFILCTFLFVLT

SEQ ID NO: 2403665 - protein, 18 aa, Entamoeba dispar
FFSFIIPLAFGYAVWRPM

SEQ ID NO: 2403666 - protein, 19 aa, Entamoeba dispar
FFSKYWVWILIGVVALYFF

SEQ ID NO: 2403667 - protein, 17 aa, Entamoeba dispar
FFTLLFSVFIIISHWKK

SEQ ID NO: 2403668 - protein, 17 aa, Entamoeba dispar
FFVFYKQRKLFVPTILR

SEQ ID NO: 2403669 - protein, 17 aa, Entamoeba dispar
FFVVKLMMILLLGISSG

SEQ ID NO: 2403670 - protein, 17 aa, Entamoeba dispar
FFWSMAALIFTWFCMLH

SEQ ID NO: 2403671 - protein, 18 aa, Entamoeba dispar
FGFSMFFIFCSYALGSWY

SEQ ID NO: 2403672 - protein, 18 aa, Entamoeba dispar
FGIFLILCYIIVFIATLM

SEQ ID NO: 2403673 - protein, 25 aa, Entamoeba dispar
FGLLALLYPFIWQGVLIPFVPVQLQ

SEQ ID NO: 2403674 - protein, 30 aa, Entamoeba dispar
FGTCLMFIGLILLIFLLCWPETLVYWERNK

SEQ ID NO: 2403675 - protein, 23 aa, Entamoeba dispar
FGYYIFIVELFLVSLPIKGHILK

SEQ ID NO: 2403676 - protein, 33 aa, Entamoeba dispar
FHEFLRKLPFPSFVCLFIIILMKISKCSYLYSF

SEQ ID NO: 2403677 - protein, 23 aa, Entamoeba dispar
FHLNVLIVILPIIGFIIILIIVL

SEQ ID NO: 2403678 - protein, 24 aa, Entamoeba dispar
FHLNVLIVILPIIGFIIILIIVLC

SEQ ID NO: 2403679 - protein, 20 aa, Entamoeba dispar
FIAGLVLIGLGIILNFCICI

SEQ ID NO: 2403680 - protein, 26 aa, Entamoeba dispar
FIAIILLIIFMLFMPEMFVTAFMSFV

SEQ ID NO: 2403681 - protein, 25 aa, Entamoeba dispar
FIALTILEYLLLYGYPFALKILLIL

SEQ ID NO: 2403682 - protein, 23 aa, Entamoeba dispar
FIFEWHYLWYVHAFNFEISLRVF

SEQ ID NO: 2403683 - protein, 24 aa, Entamoeba dispar
FIHKKFYYLIILYEFINEKNILQI

SEQ ID NO: 2403684 - protein, 17 aa, Entamoeba dispar
FIIFLRKHKRLTKMIEI

SEQ ID NO: 2403685 - protein, 17 aa, Entamoeba dispar
FIIGKLGYDLYIIDQHA

SEQ ID NO: 2403686 - protein, 18 aa, Entamoeba dispar
FIIILIIVLCMAIILIYS

SEQ ID NO: 2403687 - protein, 18 aa, Entamoeba dispar
FIILLFLETVIVLPLVIL

SEQ ID NO: 2403688 - protein, 20 aa, Entamoeba dispar
FIIVICTILFFLRKKPLPKE

SEQ ID NO: 2403689 - protein, 31 aa, Entamoeba dispar
FILCCCGGLLLLIFIAYITLIVIGLVKGWLK

SEQ ID NO: 2403690 - protein, 18 aa, Entamoeba dispar
FILFVLGFFLPCIWIYNI

SEQ ID NO: 2403691 - protein, 22 aa, Entamoeba dispar
FILGEYYFNSLWMIMCLLPPPQ

SEQ ID NO: 2403692 - protein, 17 aa, Entamoeba dispar
FIPPYYSKKMWPLVIVF

SEQ ID NO: 2403693 - protein, 17 aa, Entamoeba dispar
FIQFLYYLPINGLTGMV

SEQ ID NO: 2403694 - protein, 17 aa, Entamoeba dispar
FIRYFLVICIFFILACI

SEQ ID NO: 2403695 - protein, 20 aa, Entamoeba dispar
FITLSLFAFLFILSLSFTVI

SEQ ID NO: 2403696 - protein, 23 aa, Entamoeba dispar
FKELYPIYYYFNINLIISQLWGL

SEQ ID NO: 2403697 - protein, 19 aa, Entamoeba dispar
FKNAILVTPYLPFTTDYNI

SEQ ID NO: 2403698 - protein, 26 aa, Entamoeba dispar
FKNHKYFIQFLWYAPFILILGFIWHC

SEQ ID NO: 2403699 - protein, 17 aa, Entamoeba dispar
FKQLFKILELLGYSWAK

SEQ ID NO: 2403700 - protein, 20 aa, Entamoeba dispar
FLCVYSAIMVILWGARKWLD

SEQ ID NO: 2403701 - protein, 20 aa, Entamoeba dispar
FLDFLLSWKIFGLLYVFSMA

SEQ ID NO: 2403702 - protein, 19 aa, Entamoeba dispar
FLFFAFIFVIALLLATNCF

SEQ ID NO: 2403703 - protein, 17 aa, Entamoeba dispar
FLFVSSYAQFKVYIFNV

SEQ ID NO: 2403704 - protein, 17 aa, Entamoeba dispar
FLFYCYSEKIDLKKNKL

SEQ ID NO: 2403705 - protein, 24 aa, Entamoeba dispar
FLGSILLYIILYTIIMFVPGMSVR

SEQ ID NO: 2403706 - protein, 22 aa, Entamoeba dispar
FLGVIFYKWIYPLLYKLISSLL

SEQ ID NO: 2403707 - protein, 18 aa, Entamoeba dispar
FLHHIMLLILWTVPITRK

SEQ ID NO: 2403708 - protein, 18 aa, Entamoeba dispar
FLIILAIVFLIIIGVVIY

SEQ ID NO: 2403709 - protein, 17 aa, Entamoeba dispar
FLILCYIIVFIATLMTW

SEQ ID NO: 2403710 - protein, 17 aa, Entamoeba dispar
FLLAILYTKLQYGFFRA

SEQ ID NO: 2403711 - protein, 32 aa, Entamoeba dispar
FLLEFFYLDALFLCLFWFLIEVTFDIDANGIL

SEQ ID NO: 2403712 - protein, 25 aa, Entamoeba dispar
FLPITLFGYFYIFFATIRALYLSII

SEQ ID NO: 2403713 - protein, 25 aa, Entamoeba dispar
FLPITLFGYFYIFFATLRALYLSII

SEQ ID NO: 2403714 - protein, 20 aa, Entamoeba dispar
FLQLVLFILFIICLGFMTKD

SEQ ID NO: 2403715 - protein, 20 aa, Entamoeba dispar
FLRFIRRLLTSRGNYIFKEN

SEQ ID NO: 2403716 - protein, 17 aa, Entamoeba dispar
FLRQFLIPHPFQLVDIR

SEQ ID NO: 2403717 - protein, 18 aa, Entamoeba dispar
FLSILCFIIYIPTYFVYG

SEQ ID NO: 2403718 - protein, 20 aa, Entamoeba dispar
FLSLFIYFYFKKSNIHLKSL

SEQ ID NO: 2403719 - protein, 18 aa, Entamoeba dispar
FLTLFFQAIGSMICCFDA

SEQ ID NO: 2403720 - protein, 20 aa, Entamoeba dispar
FMMVMYSLISTLLYLRVLPS

SEQ ID NO: 2403721 - protein, 27 aa, Entamoeba dispar
FNNLHRYFRLFPRMYLLVNSFYSIFDD

SEQ ID NO: 2403722 - protein, 34 aa, Entamoeba dispar
FNSLAFLIFPLLVTFLAIIILILFPFLKTYFIPS

SEQ ID NO: 2403723 - protein, 17 aa, Entamoeba dispar
FPLFIQTNVLLASSTKH

SEQ ID NO: 2403724 - protein, 24 aa, Entamoeba dispar
FQIKPLYTLLLQVLIPKLPVIINS

SEQ ID NO: 2403725 - protein, 18 aa, Entamoeba dispar
FRCDYVVYFYGAVFVPNK

SEQ ID NO: 2403726 - protein, 25 aa, Entamoeba dispar
FSFLFKFLYYQYKLLTNVYFLINMI

SEQ ID NO: 2403727 - protein, 17 aa, Entamoeba dispar
FSFLTYPITWAAVPGFV

SEQ ID NO: 2403728 - protein, 20 aa, Entamoeba dispar
FSILFIVMIYFIAKKEPSVY

SEQ ID NO: 2403729 - protein, 21 aa, Entamoeba dispar
FSLLLLLILISLCGSYFIRMN

SEQ ID NO: 2403730 - protein, 17 aa, Entamoeba dispar
FSSFFFFGNSHINPFLL

SEQ ID NO: 2403731 - protein, 17 aa, Entamoeba dispar
FTFIRKYRKMPLSYLLF

SEQ ID NO: 2403732 - protein, 22 aa, Entamoeba dispar
FTIHNPWIFPLIEILKEIYKLN

SEQ ID NO: 2403733 - protein, 19 aa, Entamoeba dispar
FVLVFLAISFLSIVKWLFC

SEQ ID NO: 2403734 - protein, 19 aa, Entamoeba dispar
FVQFYYVRLFGTVFGDYLN

SEQ ID NO: 2403735 - protein, 19 aa, Entamoeba dispar
FVSIFAFIIGFIIYRKKRS

SEQ ID NO: 2403736 - protein, 25 aa, Entamoeba dispar
FYFDSFKAILPFKFIIDQSTVKTQI

SEQ ID NO: 2403737 - protein, 19 aa, Entamoeba dispar
FYFLLIGLPLLYCFVPTYN

SEQ ID NO: 2403738 - protein, 20 aa, Entamoeba dispar
FYIMLNWFMTLLEYLSIMSG

SEQ ID NO: 2403739 - protein, 30 aa, Entamoeba dispar
FYISMILSILLFFGWYIFYGFVGGFKFISM

SEQ ID NO: 2403740 - protein, 18 aa, Entamoeba dispar
FYLIFKIFLIVIALLRAR

SEQ ID NO: 2403741 - protein, 17 aa, Entamoeba dispar
FYLIYYFYKDVSILFCV

SEQ ID NO: 2403742 - protein, 34 aa, Entamoeba dispar
FYQYIPEMIIIPFFILCLSIIYLLNDYWKIKEEK

SEQ ID NO: 2403743 - protein, 17 aa, Entamoeba dispar
FYTLLSIFFPFLTEFLL

SEQ ID NO: 2403744 - protein, 19 aa, Entamoeba dispar
FYYSSIIVHLFLYGVIAII

SEQ ID NO: 2403745 - protein, 24 aa, Entamoeba dispar
GAAIWLLVILLGLAGILYAVIGGL

SEQ ID NO: 2403746 - protein, 19 aa, Entamoeba dispar
GAIAILFLPMAFIASLFGM

SEQ ID NO: 2403747 - protein, 17 aa, Entamoeba dispar
GCFLFAWLSFISIILFI

SEQ ID NO: 2403748 - protein, 23 aa, Entamoeba dispar
GCIYHVIWWIVLLEIIIALFILI

SEQ ID NO: 2403749 - protein, 18 aa, Entamoeba dispar
GCMFLLIDLMRNWFLSSN

SEQ ID NO: 2403750 - protein, 19 aa, Entamoeba dispar
GCYYLITKGWSFLFSKEKR

SEQ ID NO: 2403751 - protein, 23 aa, Entamoeba dispar
GDMRLYWVIFVLSIISGLIPSTR

SEQ ID NO: 2403752 - protein, 20 aa, Entamoeba dispar
GEYCFFYLDNLKYKELYLDE

SEQ ID NO: 2403753 - protein, 17 aa, Entamoeba dispar
GFLLLRVMLLKCSFNKL

SEQ ID NO: 2403754 - protein, 29 aa, Entamoeba dispar
GGIIIWIFIWLLLLIGFISKYIFLNKLII

SEQ ID NO: 2403755 - protein, 23 aa, Entamoeba dispar
GIIIIIIMIISIFYFVFKTKKRV

SEQ ID NO: 2403756 - protein, 30 aa, Entamoeba dispar
GIIIIIVIISIIIAIVWWRRKKTAKAESKA

SEQ ID NO: 2403757 - protein, 24 aa, Entamoeba dispar
GIKRIYIPTFLIYPIQRLPRYLLL

SEQ ID NO: 2403758 - protein, 19 aa, Entamoeba dispar
GIMISLLVVAVCGLLLIFG

SEQ ID NO: 2403759 - protein, 23 aa, Entamoeba dispar
GIPDMRFFRWRLYTKINGLINKL

SEQ ID NO: 2403760 - protein, 23 aa, Entamoeba dispar
GITLFIGLVILLLTIIIINYNKY

SEQ ID NO: 2403761 - protein, 29 aa, Entamoeba dispar
GIVIGAISTILFRLLRTWLSKTNNNSKNT

SEQ ID NO: 2403762 - protein, 29 aa, Entamoeba dispar
GKTPRVDLYLMIFLKFLATVIPTMEYDYG

SEQ ID NO: 2403763 - protein, 21 aa, Entamoeba dispar
GLEVIPNYLFWIGLPSLLVDG

SEQ ID NO: 2403764 - protein, 25 aa, Entamoeba dispar
GLFNTKLIFFIVKVLLRCDSLDKEL

SEQ ID NO: 2403765 - protein, 21 aa, Entamoeba dispar
GLPIFLWVFICGALLPYLFFE

SEQ ID NO: 2403766 - protein, 22 aa, Entamoeba dispar
GLVIFILPKLPGIWFYCWGITC

SEQ ID NO: 2403767 - protein, 21 aa, Entamoeba dispar
GMMGVIFYWIITQKNYIIKEE

SEQ ID NO: 2403768 - protein, 18 aa, Entamoeba dispar
GMTFTYFAPLVFVVCLAI

SEQ ID NO: 2403769 - protein, 17 aa, Entamoeba dispar
GMYLYFMVNWTTTINRK

SEQ ID NO: 2403770 - protein, 26 aa, Entamoeba dispar
GNDNYYYYYYYLPIQRTYFNSSPTNL

SEQ ID NO: 2403771 - protein, 24 aa, Entamoeba dispar
GNFPFIWGFFMLCSLSYWISFQMV

SEQ ID NO: 2403772 - protein, 27 aa, Entamoeba dispar
GNNFLVDSFYFILPFDIVILNDKSVKF

SEQ ID NO: 2403773 - protein, 26 aa, Entamoeba dispar
GPFLSFIMNLFLYGFFSSFCSFSSFF

SEQ ID NO: 2403774 - protein, 24 aa, Entamoeba dispar
GPFYSMLLMFCIGIFWIIVGTLIL

SEQ ID NO: 2403775 - protein, 24 aa, Entamoeba dispar
GQYGLSWQAWLLSLLLSFITLIIG

SEQ ID NO: 2403776 - protein, 22 aa, Entamoeba dispar
GSERIIFPMFFVDSKPLAGYDN

SEQ ID NO: 2403777 - protein, 22 aa, Entamoeba dispar
GSERIIFPMFFVNSKPLAGYDN

SEQ ID NO: 2403778 - protein, 34 aa, Entamoeba dispar
GSIVYVLYYIFALTLFLLLYIRLTKKIKQEIDDE

SEQ ID NO: 2403779 - protein, 25 aa, Entamoeba dispar
GSLVFILCCVLCFLGLLCFSCIPCC

SEQ ID NO: 2403780 - protein, 22 aa, Entamoeba dispar
GTLLLPIFFILILQSFALAFFW

SEQ ID NO: 2403781 - protein, 23 aa, Entamoeba dispar
GTLSIIVFLLFNLIRLTPFDIKQ

SEQ ID NO: 2403782 - protein, 17 aa, Entamoeba dispar
GTLYFIFPKLIKHWLFW

SEQ ID NO: 2403783 - protein, 22 aa, Entamoeba dispar
GTSLIVFTIFIIISFPLINLNK

SEQ ID NO: 2403784 - protein, 19 aa, Entamoeba dispar
GVIGYILYFSLQPTKSHTF

SEQ ID NO: 2403785 - protein, 22 aa, Entamoeba dispar
GVLLFILIKLYIKTRSRLNITG

SEQ ID NO: 2403786 - protein, 20 aa, Entamoeba dispar
GVSFIILISMLIVSILLGIF

SEQ ID NO: 2403787 - protein, 29 aa, Entamoeba dispar
GVVLYILVWLCLLIIIMFKYKKLTLEIKE

SEQ ID NO: 2403788 - protein, 17 aa, Entamoeba dispar
HCIGIGKWLGTLTLHQN

SEQ ID NO: 2403789 - protein, 23 aa, Entamoeba dispar
HEDWQLWMWFGIVTVVIMVVIVL

SEQ ID NO: 2403790 - protein, 23 aa, Entamoeba dispar
HETLILLNILFKNPIIFSSISIP

SEQ ID NO: 2403791 - protein, 17 aa, Entamoeba dispar
HFIVIIILWTFLWTVCH

SEQ ID NO: 2403792 - protein, 23 aa, Entamoeba dispar
HFLSIVIVIFIGCAFLLGVAYFL

SEQ ID NO: 2403793 - protein, 18 aa, Entamoeba dispar
HFSLYILTIFILIGFIIG

SEQ ID NO: 2403794 - protein, 21 aa, Entamoeba dispar
HGLVTEELLIPIPSGIKDKEQ

SEQ ID NO: 2403795 - protein, 27 aa, Entamoeba dispar
HHIIFLLLLIIIVIILIVLIVLMLMNN

SEQ ID NO: 2403796 - protein, 17 aa, Entamoeba dispar
HIPWYRYLLFTIAMACC

SEQ ID NO: 2403797 - protein, 17 aa, Entamoeba dispar
HMDSLWMIIIAQSPRVS

SEQ ID NO: 2403798 - protein, 26 aa, Entamoeba dispar
HNWIKQNWLVLILITGVLLLTVLAVF

SEQ ID NO: 2403799 - protein, 24 aa, Entamoeba dispar
HQHLYLFVFFLIFGLHISLYFKIS

SEQ ID NO: 2403800 - protein, 21 aa, Entamoeba dispar
HYYYDFMYAVLPFIPDIVDNE

SEQ ID NO: 2403801 - protein, 20 aa, Entamoeba dispar
IAFFYLIFLVQSTNYETIIE

SEQ ID NO: 2403802 - protein, 19 aa, Entamoeba dispar
IAFILMIGIFLIINTFRKR

SEQ ID NO: 2403803 - protein, 20 aa, Entamoeba dispar
IAFRWFMVQLLINVKSYLAY

SEQ ID NO: 2403804 - protein, 20 aa, Entamoeba dispar
IAIGYILYVFIRPSNNTQHS

SEQ ID NO: 2403805 - protein, 25 aa, Entamoeba dispar
ICAIIGFIWFIIWIFNWLMALLKAN

SEQ ID NO: 2403806 - protein, 20 aa, Entamoeba dispar
ICCEPIFFDYIQLLITYYLE

SEQ ID NO: 2403807 - protein, 25 aa, Entamoeba dispar
ICFVTVTFFLLFKYSPKVPPPIPVT

SEQ ID NO: 2403808 - protein, 18 aa, Entamoeba dispar
ICIIILISIIILIGIGIY

SEQ ID NO: 2403809 - protein, 18 aa, Entamoeba dispar
ICILFLRIFLYYCHIDTS

SEQ ID NO: 2403810 - protein, 19 aa, Entamoeba dispar
ICNLFIFVFIIFTVKMYYL

SEQ ID NO: 2403811 - protein, 18 aa, Entamoeba dispar
ICVSVIVGILLILAIVLL

SEQ ID NO: 2403812 - protein, 17 aa, Entamoeba dispar
IDILFEYGFIIFTSKMR

SEQ ID NO: 2403813 - protein, 18 aa, Entamoeba dispar
IEEVLSHPLFWNCKKRLE

SEQ ID NO: 2403814 - protein, 19 aa, Entamoeba dispar
IEHKIACLLPLFGPVLLLL

SEQ ID NO: 2403815 - protein, 26 aa, Entamoeba dispar
IEIFLIHLRRALLFFIHFPCSINNPI

SEQ ID NO: 2403816 - protein, 18 aa, Entamoeba dispar
IEKWIEKTLYWYKNKEKK

SEQ ID NO: 2403817 - protein, 24 aa, Entamoeba dispar
IELYFLDLNLMFWIAISMTIALII

SEQ ID NO: 2403818 - protein, 23 aa, Entamoeba dispar
IETPQLLTYLYFTSLKDFDNTVW

SEQ ID NO: 2403819 - protein, 19 aa, Entamoeba dispar
IETVPNIILLFFNSLEEWN

SEQ ID NO: 2403820 - protein, 24 aa, Entamoeba dispar
IETWDLLHFLLFASILIALLMKKG

SEQ ID NO: 2403821 - protein, 25 aa, Entamoeba dispar
IEYITFFLVIVYFVYFFIGKSSNSS

SEQ ID NO: 2403822 - protein, 23 aa, Entamoeba dispar
IFAHKLIWFFIISILTMLFLYII

SEQ ID NO: 2403823 - protein, 17 aa, Entamoeba dispar
IFDLLLEQYFRYFFMHW

SEQ ID NO: 2403824 - protein, 20 aa, Entamoeba dispar
IFFLILFIGFIVCLIITTVY

SEQ ID NO: 2403825 - protein, 19 aa, Entamoeba dispar
IFFTFIILYNNLVPISLYV

SEQ ID NO: 2403826 - protein, 34 aa, Entamoeba dispar
IFGILIAVIILLVILIITIGLIIFLIIKKKKTST

SEQ ID NO: 2403827 - protein, 19 aa, Entamoeba dispar
IFGILLILIVICLINGVPI

SEQ ID NO: 2403828 - protein, 22 aa, Entamoeba dispar
IFGLLSLFYPFSWPGIFIPYIP

SEQ ID NO: 2403829 - protein, 17 aa, Entamoeba dispar
IFGLYKILLYINKKNLQ

SEQ ID NO: 2403830 - protein, 18 aa, Entamoeba dispar
IFGNAFYYKSYSSQYTLF

SEQ ID NO: 2403831 - protein, 21 aa, Entamoeba dispar
IFICSIVMIFLLIRFTKGHKI

SEQ ID NO: 2403832 - protein, 17 aa, Entamoeba dispar
IFIFLISIISFSGTLYW

SEQ ID NO: 2403833 - protein, 21 aa, Entamoeba dispar
IFIKFIPFINAYLFPLTTDIE

SEQ ID NO: 2403834 - protein, 19 aa, Entamoeba dispar
IFILFYLFFFLFSFDIILL

SEQ ID NO: 2403835 - protein, 24 aa, Entamoeba dispar
IFLAFIIIVIIVAVIVIIIIKKKG

SEQ ID NO: 2403836 - protein, 25 aa, Entamoeba dispar
IFLAFIIIVIIVAVIVIIIIKKKGK

SEQ ID NO: 2403837 - protein, 17 aa, Entamoeba dispar
IFLALIFLPRYLKRGIA

SEQ ID NO: 2403838 - protein, 17 aa, Entamoeba dispar
IFLFLSSKSFIILRRNN

SEQ ID NO: 2403839 - protein, 29 aa, Entamoeba dispar
IFLIIIFIIIIIIIIILLRKRKIKQLKEI

SEQ ID NO: 2403840 - protein, 19 aa, Entamoeba dispar
IFLILFFLFTIILGIFGPS

SEQ ID NO: 2403841 - protein, 17 aa, Entamoeba dispar
IFLLIRFTKGHKIDLNV

SEQ ID NO: 2403842 - protein, 23 aa, Entamoeba dispar
IFRSFYFLIAFFGSLTIILWFVV

SEQ ID NO: 2403843 - protein, 18 aa, Entamoeba dispar
IFSLVWVLSIWFLSIIIS

SEQ ID NO: 2403844 - protein, 17 aa, Entamoeba dispar
IFVINLLYDLCLEKGYF

SEQ ID NO: 2403845 - protein, 19 aa, Entamoeba dispar
IFWYFILILLFIGLKLDNI

SEQ ID NO: 2403846 - protein, 35 aa, Entamoeba dispar
IFYSKKQWIVYLLSFLIFAIVLIIFVLMLAFHILN

SEQ ID NO: 2403847 - protein, 31 aa, Entamoeba dispar
IGCPLLLFKAWMLRWWKIMYLRLLDLQKWKV

SEQ ID NO: 2403848 - protein, 26 aa, Entamoeba dispar
IGGIMFFILFIVFVIFIVRKTIKRLH

SEQ ID NO: 2403849 - protein, 17 aa, Entamoeba dispar
IGIIIIGIIFVGVYLSK

SEQ ID NO: 2403850 - protein, 32 aa, Entamoeba dispar
IGIPLFGIFVIIVLTIIIISYLLFALHKKKKL

SEQ ID NO: 2403851 - protein, 25 aa, Entamoeba dispar
IGIVSIIVFIINYTILRVLVSLDNK

SEQ ID NO: 2403852 - protein, 25 aa, Entamoeba dispar
IGIYTLLYIILLVVTLIKFNKISKV

SEQ ID NO: 2403853 - protein, 20 aa, Entamoeba dispar
IGVITLVSFFCYVGLFMAAG

SEQ ID NO: 2403854 - protein, 23 aa, Entamoeba dispar
IHQYVVWFILFSLFIDCAISNMV

SEQ ID NO: 2403855 - protein, 17 aa, Entamoeba dispar
IIALAILTGILFGILYW

SEQ ID NO: 2403856 - protein, 18 aa, Entamoeba dispar
IIAMGCFQVWYIKRQFKR

SEQ ID NO: 2403857 - protein, 26 aa, Entamoeba dispar
IIANYDLIILPLYSALPLYKQKRVFF

SEQ ID NO: 2403858 - protein, 17 aa, Entamoeba dispar
IIDILIFTLFISIGLPG

SEQ ID NO: 2403859 - protein, 28 aa, Entamoeba dispar
IIEQYPLKWLDWLLILVAVLVHFVICET

SEQ ID NO: 2403860 - protein, 34 aa, Entamoeba dispar
IIFIGGIIIWIFIWLLLLIGFISKYIFLNKLIIS

SEQ ID NO: 2403861 - protein, 17 aa, Entamoeba dispar
IIFRLAPNHCFAHYLRG

SEQ ID NO: 2403862 - protein, 26 aa, Entamoeba dispar
IIGHILFFLLLVYYKFEPNQLVISEQ

SEQ ID NO: 2403863 - protein, 24 aa, Entamoeba dispar
IIGLFFFIAFFIFSLNYVPKTMLG

SEQ ID NO: 2403864 - protein, 18 aa, Entamoeba dispar
IIGLFVLLLLLIFDKTLI

SEQ ID NO: 2403865 - protein, 17 aa, Entamoeba dispar
IIHSPFIFFDTTPMGRI

SEQ ID NO: 2403866 - protein, 24 aa, Entamoeba dispar
IIIAVICIFILILIIALISVLYKK

SEQ ID NO: 2403867 - protein, 21 aa, Entamoeba dispar
IIIIIIIIIIIIMINYIIKRK

SEQ ID NO: 2403868 - protein, 19 aa, Entamoeba dispar
IIIIIIIIIITMINYIIKL

SEQ ID NO: 2403869 - protein, 18 aa, Entamoeba dispar
IIIIIIIIITMINYIIKL

SEQ ID NO: 2403870 - protein, 17 aa, Entamoeba dispar
IIIIIVLLSIYLHKLLI

SEQ ID NO: 2403871 - protein, 19 aa, Entamoeba dispar
IIIILSIIFSFSYGFEQNY

SEQ ID NO: 2403872 - protein, 17 aa, Entamoeba dispar
IIIIVFVTTFVVAVCIV

SEQ ID NO: 2403873 - protein, 21 aa, Entamoeba dispar
IIIIVILIIIIVIVSWKSIHK

SEQ ID NO: 2403874 - protein, 19 aa, Entamoeba dispar
IIILIVIIGIIWWRRRKSV

SEQ ID NO: 2403875 - protein, 22 aa, Entamoeba dispar
IIISLTLLRFRILKKSKLNYTL

SEQ ID NO: 2403876 - protein, 19 aa, Entamoeba dispar
IIIVDLYPGIKDREVFAWD

SEQ ID NO: 2403877 - protein, 18 aa, Entamoeba dispar
IIIYILLMLSWIGYYPAS

SEQ ID NO: 2403878 - protein, 18 aa, Entamoeba dispar
IIKTWWRLVIFIINGIMV

SEQ ID NO: 2403879 - protein, 18 aa, Entamoeba dispar
IILFIIKYSFYNISLIET

SEQ ID NO: 2403880 - protein, 19 aa, Entamoeba dispar
IILIFVVVGAYYYFKKSMK

SEQ ID NO: 2403881 - protein, 19 aa, Entamoeba dispar
IILIIIGFIIYKFSHSIQL

SEQ ID NO: 2403882 - protein, 17 aa, Entamoeba dispar
IILIMWMNLFSYDINPI

SEQ ID NO: 2403883 - protein, 18 aa, Entamoeba dispar
IILLSFLVGLIWCLCKEG

SEQ ID NO: 2403884 - protein, 24 aa, Entamoeba dispar
IILNVLMYVLYKRIIFSASLFISM

SEQ ID NO: 2403885 - protein, 18 aa, Entamoeba dispar
IIMFIVYLFILITLWLYF

SEQ ID NO: 2403886 - protein, 19 aa, Entamoeba dispar
IIPLLPLLPEKLFDNSIPR

SEQ ID NO: 2403887 - protein, 23 aa, Entamoeba dispar
IIPPIFVLFILIPLSLSSMTLIR

SEQ ID NO: 2403888 - protein, 18 aa, Entamoeba dispar
IIRWVFILNFFISIIYAF

SEQ ID NO: 2403889 - protein, 18 aa, Entamoeba dispar
IISDSYVLVPLRLLMKSF

SEQ ID NO: 2403890 - protein, 18 aa, Entamoeba dispar
IISFIVTIPLVVGLISWA

SEQ ID NO: 2403891 - protein, 19 aa, Entamoeba dispar
IITIIILLSIVIIGVLFIK

SEQ ID NO: 2403892 - protein, 22 aa, Entamoeba dispar
IITLIIIIIFINTIVHSQIITT

SEQ ID NO: 2403893 - protein, 18 aa, Entamoeba dispar
IIVKIIKFILIGSLIIML

SEQ ID NO: 2403894 - protein, 17 aa, Entamoeba dispar
IIYIIISILYQPLGNIV

SEQ ID NO: 2403895 - protein, 21 aa, Entamoeba dispar
IKDIILLILQTYIDLIKEINE

SEQ ID NO: 2403896 - protein, 33 aa, Entamoeba dispar
IKERRTLWMLWAFWWFVYALVCVMTFGALKYFG

SEQ ID NO: 2403897 - protein, 19 aa, Entamoeba dispar
IKFGNLDKVSFVKKASREE

SEQ ID NO: 2403898 - protein, 25 aa, Entamoeba dispar
IKGTFPFIWIFLVFASICYWSSNQF

SEQ ID NO: 2403899 - protein, 21 aa, Entamoeba dispar
IKIARTFFLFGLNNISKIAHT

SEQ ID NO: 2403900 - protein, 24 aa, Entamoeba dispar
IKYQIPLYLIVLVIFFGFDEFIAI

SEQ ID NO: 2403901 - protein, 18 aa, Entamoeba dispar
ILFLFLNIFYFKAKSTTN

SEQ ID NO: 2403902 - protein, 23 aa, Entamoeba dispar
ILFYLIIVIILYFIPKLYLPLQY

SEQ ID NO: 2403903 - protein, 26 aa, Entamoeba dispar
ILIAIILIIIFFLWRRRRAAEKQRET

SEQ ID NO: 2403904 - protein, 18 aa, Entamoeba dispar
ILILFIPLYILATISYNR

SEQ ID NO: 2403905 - protein, 18 aa, Entamoeba dispar
ILITCTILLIIKIRNKKK

SEQ ID NO: 2403906 - protein, 24 aa, Entamoeba dispar
ILKNSWFFYELIVKSLTLEMDLSG

SEQ ID NO: 2403907 - protein, 17 aa, Entamoeba dispar
ILLFITQFYFAFFSGFS

SEQ ID NO: 2403908 - protein, 18 aa, Entamoeba dispar
ILLIIVCIICCLLYLLIK

SEQ ID NO: 2403909 - protein, 17 aa, Entamoeba dispar
ILLLLLIIVSLLLFIIY

SEQ ID NO: 2403910 - protein, 20 aa, Entamoeba dispar
ILLLPEALKLIPIFVLGAMK

SEQ ID NO: 2403911 - protein, 22 aa, Entamoeba dispar
ILMPAISFFPWLIKDKWDNLNE

SEQ ID NO: 2403912 - protein, 28 aa, Entamoeba dispar
ILPNLGIVFWILCILVALGGVYLYQISN

SEQ ID NO: 2403913 - protein, 18 aa, Entamoeba dispar
ILQIFFIIVSLVALLLCF

SEQ ID NO: 2403914 - protein, 21 aa, Entamoeba dispar
ILQLLRCYVLFPEHWPTFLAL

SEQ ID NO: 2403915 - protein, 22 aa, Entamoeba dispar
ILRSLALVWLLFQECNYVIVID

SEQ ID NO: 2403916 - protein, 17 aa, Entamoeba dispar
ILSFLLSGIILAPPYVV

SEQ ID NO: 2403917 - protein, 20 aa, Entamoeba dispar
ILTGILFGILYWFNNRHKID

SEQ ID NO: 2403918 - protein, 17 aa, Entamoeba dispar
ILTIFILIGFIIGEVYN

SEQ ID NO: 2403919 - protein, 18 aa, Entamoeba dispar
ILYLIRTLIFLTSSLKKA

SEQ ID NO: 2403920 - protein, 22 aa, Entamoeba dispar
IMKYFYIFLGISGAMFISTYLH

SEQ ID NO: 2403921 - protein, 21 aa, Entamoeba dispar
INEVFLQLKLLWPLFNITNTT

SEQ ID NO: 2403922 - protein, 18 aa, Entamoeba dispar
INIKFIPNIIFISSTPFP

SEQ ID NO: 2403923 - protein, 21 aa, Entamoeba dispar
INILFIILYWIEVVASLILSF

SEQ ID NO: 2403924 - protein, 24 aa, Entamoeba dispar
INKLKWIIIVFWIIVALGMVYCVF

SEQ ID NO: 2403925 - protein, 23 aa, Entamoeba dispar
INLIIFFVLLIRIALFKQLPEVF

SEQ ID NO: 2403926 - protein, 38 aa, Entamoeba dispar
INPPYWINVWYVYIFYYFALLFAFFFPSFTVHYINESL

SEQ ID NO: 2403927 - protein, 21 aa, Entamoeba dispar
IPDWLYLIITDCWNPISAKRL

SEQ ID NO: 2403928 - protein, 17 aa, Entamoeba dispar
IPLLYQHIERYLSLRLL

SEQ ID NO: 2403929 - protein, 23 aa, Entamoeba dispar
IPLSVVLFIFLLITFSVISNRKR

SEQ ID NO: 2403930 - protein, 25 aa, Entamoeba dispar
IPLVILWIILIVIEIGIFAVSMASY

SEQ ID NO: 2403931 - protein, 17 aa, Entamoeba dispar
IPMKMKIKFMIDAAKGI

SEQ ID NO: 2403932 - protein, 18 aa, Entamoeba dispar
IQHLPKVFLLFCVYSWTT

SEQ ID NO: 2403933 - protein, 21 aa, Entamoeba dispar
IQNLLWFSIIMIICLVWFVVG

SEQ ID NO: 2403934 - protein, 20 aa, Entamoeba dispar
IQVFNFISLIFFPITFVVNT

SEQ ID NO: 2403935 - protein, 31 aa, Entamoeba dispar
IRMLPLLKEYFYPFITKFLPFLLQRCKIQIP

SEQ ID NO: 2403936 - protein, 17 aa, Entamoeba dispar
IRTAFFHIILYRSLFIK

SEQ ID NO: 2403937 - protein, 29 aa, Entamoeba dispar
IRWLGAFRFILWTLWYCVTLMTTKAKIKT

SEQ ID NO: 2403938 - protein, 18 aa, Entamoeba dispar
ISFFLFYILIIFDSLRKP

SEQ ID NO: 2403939 - protein, 17 aa, Entamoeba dispar
ISFLWIFNCAKGQDETG

SEQ ID NO: 2403940 - protein, 17 aa, Entamoeba dispar
ISFLWYLARPCLGGVRG

SEQ ID NO: 2403941 - protein, 30 aa, Entamoeba dispar
ISGNYLQILYLLFFWVFKNLSHQTLSDLIR

SEQ ID NO: 2403942 - protein, 24 aa, Entamoeba dispar
ISGPYLFVIYLINFIIFLNLIVGE

SEQ ID NO: 2403943 - protein, 34 aa, Entamoeba dispar
ISGWGIWGILLYAVYFVIIIVALIIIIIIYKKKN

SEQ ID NO: 2403944 - protein, 17 aa, Entamoeba dispar
ISGYALKMPLFGSTFKS

SEQ ID NO: 2403945 - protein, 18 aa, Entamoeba dispar
ISGYIIYSLPKLPGIWVY

SEQ ID NO: 2403946 - protein, 24 aa, Entamoeba dispar
ISIAIIFLIYLMLQIFLFKRHNKF

SEQ ID NO: 2403947 - protein, 23 aa, Entamoeba dispar
ISIIFPLILIFQLSLIQSSWNKN

SEQ ID NO: 2403948 - protein, 25 aa, Entamoeba dispar
ISIQSLTLFPFIQTLYLYSSFDPFI

SEQ ID NO: 2403949 - protein, 22 aa, Entamoeba dispar
ISISIFFFSPLTYLQLLLLCVI

SEQ ID NO: 2403950 - protein, 34 aa, Entamoeba dispar
ISIWTIFALPKLPGIWVLLFITSACLWVSFWRTR

SEQ ID NO: 2403951 - protein, 22 aa, Entamoeba dispar
ISIYILFGIVLIVSLFSISYYF

SEQ ID NO: 2403952 - protein, 27 aa, Entamoeba dispar
ISLALFFLWKVILVVIFFILQVSYGCV

SEQ ID NO: 2403953 - protein, 21 aa, Entamoeba dispar
ISLSFFVWYIYSIHSFFTTTH

SEQ ID NO: 2403954 - protein, 24 aa, Entamoeba dispar
ISPISFCWWLFNAILSSFTIFFIS

SEQ ID NO: 2403955 - protein, 22 aa, Entamoeba dispar
ISTYYLKDYLIWGKSMIISAIK

SEQ ID NO: 2403956 - protein, 35 aa, Entamoeba dispar
ITIGTFIIVLIIVITIIIIISLFYIQHKKEKKKMD

SEQ ID NO: 2403957 - protein, 17 aa, Entamoeba dispar
ITLHKLILPSGATISGK

SEQ ID NO: 2403958 - protein, 19 aa, Entamoeba dispar
ITSAFYWGALLLPLGLAFF

SEQ ID NO: 2403959 - protein, 21 aa, Entamoeba dispar
ITSMILLVIIYRGWALASPAI

SEQ ID NO: 2403960 - protein, 22 aa, Entamoeba dispar
ITTMIFIQYKLIDGLLEFICQT

SEQ ID NO: 2403961 - protein, 20 aa, Entamoeba dispar
ITVIFPFVLCFYPDCIRIYN

SEQ ID NO: 2403962 - protein, 26 aa, Entamoeba dispar
IVEPLLLILIIISLLLMFIPKPIFLY

SEQ ID NO: 2403963 - protein, 17 aa, Entamoeba dispar
IVFICYLFFMLDSFMKQ

SEQ ID NO: 2403964 - protein, 17 aa, Entamoeba dispar
IVFILPLVILFISLLFF

SEQ ID NO: 2403965 - protein, 32 aa, Entamoeba dispar
IVGGIICGILLLLLVIIVIAIIVFFVMRKKKG

SEQ ID NO: 2403966 - protein, 26 aa, Entamoeba dispar
IVIGLFIIGIWIWYLRRPYPVYLVSF

SEQ ID NO: 2403967 - protein, 20 aa, Entamoeba dispar
IVLIIFIIWVLYIPSKSNTK

SEQ ID NO: 2403968 - protein, 19 aa, Entamoeba dispar
IVLLLFFISSINGKIHCNN

SEQ ID NO: 2403969 - protein, 17 aa, Entamoeba dispar
IVLLYYDTPHLFGEMYS

SEQ ID NO: 2403970 - protein, 17 aa, Entamoeba dispar
IVMIYFIAKKEPSVYLV

SEQ ID NO: 2403971 - protein, 19 aa, Entamoeba dispar
IVTLILLLLQWKMLMIICL

SEQ ID NO: 2403972 - protein, 26 aa, Entamoeba dispar
IVTSWSCAIGEYFFYFSCYGCPNGYF

SEQ ID NO: 2403973 - protein, 21 aa, Entamoeba dispar
IVVGLLVLWLFIKNGSMTWDD

SEQ ID NO: 2403974 - protein, 27 aa, Entamoeba dispar
IVVLMFELYWFTILFFLLEAYNSFSLT

SEQ ID NO: 2403975 - protein, 17 aa, Entamoeba dispar
IVYAVYVYLQRQRNLKV

SEQ ID NO: 2403976 - protein, 23 aa, Entamoeba dispar
IYFHSFFNFSYFFISVSFLNSFS

SEQ ID NO: 2403977 - protein, 45 aa, Entamoeba dispar
IYHLNLFIIIGIPIIIIFLFIIIFMFSCFLIILIIRKQQQKKIKE

SEQ ID NO: 2403978 - protein, 31 aa, Entamoeba dispar
IYIVAIIILLLIVTIGIVAFFWYTRKPRSVH

SEQ ID NO: 2403979 - protein, 21 aa, Entamoeba dispar
IYNILRFWGMYSLYPSFIPSS

SEQ ID NO: 2403980 - protein, 18 aa, Entamoeba dispar
IYPIQRLPRYLLLLETLS

SEQ ID NO: 2403981 - protein, 26 aa, Entamoeba dispar
IYQLGILLIILFFGSTFKFISAPCGY

SEQ ID NO: 2403982 - protein, 24 aa, Entamoeba dispar
KALTNFLFWGIGSIVYVLYYIFAL

SEQ ID NO: 2403983 - protein, 21 aa, Entamoeba dispar
KANLFCLFIVMWTFTFSLTCF

SEQ ID NO: 2403984 - protein, 18 aa, Entamoeba dispar
KARLLWFRNYFIGVLISI

SEQ ID NO: 2403985 - protein, 30 aa, Entamoeba dispar
KAYSTFDWLLWLIVSIVIFAAFLIPFLAVG

SEQ ID NO: 2403986 - protein, 19 aa, Entamoeba dispar
KCIEPLIVLLTFSSSLDLT

SEQ ID NO: 2403987 - protein, 24 aa, Entamoeba dispar
KDIPENIFWCKYFRFLYIKCGKEK

SEQ ID NO: 2403988 - protein, 33 aa, Entamoeba dispar
KEKRTLWYVWALWWFIYAVVCVATFTVLKLFIK

SEQ ID NO: 2403989 - protein, 20 aa, Entamoeba dispar
KELFIPAYYQFFNEMLGLNI

SEQ ID NO: 2403990 - protein, 25 aa, Entamoeba dispar
KELISTIFLPWFNTLRYLKQSFKPE

SEQ ID NO: 2403991 - protein, 25 aa, Entamoeba dispar
KEMDTFTIWISLEESFLGTQKTIQL

SEQ ID NO: 2403992 - protein, 23 aa, Entamoeba dispar
KEMIKFIIFFIKQKLGKIDSKEV

SEQ ID NO: 2403993 - protein, 25 aa, Entamoeba dispar
KEMVWWMIMIIIIIILIIIIIIIII

SEQ ID NO: 2403994 - protein, 24 aa, Entamoeba dispar
KERLKYCWVIYSLLIKSIIGYLKD

SEQ ID NO: 2403995 - protein, 25 aa, Entamoeba dispar
KERLKYVWIIFALIIKSMVGYYEDK

SEQ ID NO: 2403996 - protein, 18 aa, Entamoeba dispar
KETLIPMKMKIKFMIDAA

SEQ ID NO: 2403997 - protein, 17 aa, Entamoeba dispar
KFHCVFAIYTKNKLIEK

SEQ ID NO: 2403998 - protein, 17 aa, Entamoeba dispar
KGIIYYLSLLLSTKYKK

SEQ ID NO: 2403999 - protein, 19 aa, Entamoeba dispar
KHIYIINPRRLLGTKAPFE

SEQ ID NO: 2404000 - protein, 24 aa, Entamoeba dispar
KHLNFFLKIIIKSLLFWMQKEDLF

SEQ ID NO: 2404001 - protein, 17 aa, Entamoeba dispar
KHPSLFLVIFKLEWKMF

SEQ ID NO: 2404002 - protein, 24 aa, Entamoeba dispar
KHYHSWNIFFLSGSVIFVLGLLGV

SEQ ID NO: 2404003 - protein, 22 aa, Entamoeba dispar
KIDKMLFFNFSFGPAIVTLFAS

SEQ ID NO: 2404004 - protein, 17 aa, Entamoeba dispar
KIDKRIYLPLILKRIRE

SEQ ID NO: 2404005 - protein, 19 aa, Entamoeba dispar
KIFSLWGFIISYIVSKGGI

SEQ ID NO: 2404006 - protein, 20 aa, Entamoeba dispar
KIGLLFILLTIIFQLISCFT

SEQ ID NO: 2404007 - protein, 26 aa, Entamoeba dispar
KIGSNPWLCFFVPGLVVIVVVYFFTH

SEQ ID NO: 2404008 - protein, 19 aa, Entamoeba dispar
KILIPLQLRTKLLGQMRLL

SEQ ID NO: 2404009 - protein, 18 aa, Entamoeba dispar
KILLFQYLIDLIPNTLLN

SEQ ID NO: 2404010 - protein, 20 aa, Entamoeba dispar
KITWRLQIMLWYAGLRGAIA

SEQ ID NO: 2404011 - protein, 30 aa, Entamoeba dispar
KKASKKLWIILCIAGGIVIVLGAIVTLVCI

SEQ ID NO: 2404012 - protein, 23 aa, Entamoeba dispar
KKEWIIIIVFIIAVIVIGIIIIG

SEQ ID NO: 2404013 - protein, 18 aa, Entamoeba dispar
KKIIWWIAMIFTILSIIE

SEQ ID NO: 2404014 - protein, 20 aa, Entamoeba dispar
KKILLFFIFLQVLSNILYLI

SEQ ID NO: 2404015 - protein, 25 aa, Entamoeba dispar
KKKSYWYIYMIIGICILFIILIFVV

SEQ ID NO: 2404016 - protein, 26 aa, Entamoeba dispar
KKKYLPVYVVVSPPLLLVFQSQDDYK

SEQ ID NO: 2404017 - protein, 21 aa, Entamoeba dispar
KKLDHFFPIQKIWNQSGVIMF

SEQ ID NO: 2404018 - protein, 33 aa, Entamoeba dispar
KKLVIKIVIFIIFIVIILILILCIIGIPVGIYL

SEQ ID NO: 2404019 - protein, 24 aa, Entamoeba dispar
KKRLWELLFVFLVGFFRCSFFTLT

SEQ ID NO: 2404020 - protein, 17 aa, Entamoeba dispar
KKSLIFILAYIAFSFVL

SEQ ID NO: 2404021 - protein, 30 aa, Entamoeba dispar
KKSMKWIYSIIIIPVIIAIGYILYVFIRPS

SEQ ID NO: 2404022 - protein, 17 aa, Entamoeba dispar
KKVFLFTIIFPCIGYYG

SEQ ID NO: 2404023 - protein, 24 aa, Entamoeba dispar
KKVNIIFYTVLIIGFLVLGIYAAC

SEQ ID NO: 2404024 - protein, 24 aa, Entamoeba dispar
KKYIPIVLLFLYFIFFIKTSQECL

SEQ ID NO: 2404025 - protein, 20 aa, Entamoeba dispar
KKYQYYLYKTSTKQIWVILG

SEQ ID NO: 2404026 - protein, 25 aa, Entamoeba dispar
KLDILFICFLLILLSFLAGLCLLSQ

SEQ ID NO: 2404027 - protein, 18 aa, Entamoeba dispar
KLFPLLLMLLIEGISQNI

SEQ ID NO: 2404028 - protein, 29 aa, Entamoeba dispar
KLHPMVRFILFIITFLIGLTILLLTLPLT

SEQ ID NO: 2404029 - protein, 25 aa, Entamoeba dispar
KLILLSFFTFIGLLFIATLFFDTTQ

SEQ ID NO: 2404030 - protein, 22 aa, Entamoeba dispar
KLKNWLLLLFDASYYKIIVWIL

SEQ ID NO: 2404031 - protein, 26 aa, Entamoeba dispar
KLSYNEWYFVFYKIFFRILEPIGYYH

SEQ ID NO: 2404032 - protein, 18 aa, Entamoeba dispar
KLWKYLCLFVSFSIKQKN

SEQ ID NO: 2404033 - protein, 27 aa, Entamoeba dispar
KLYVFHRYICFWPQVLKFNADVWKFED

SEQ ID NO: 2404034 - protein, 20 aa, Entamoeba dispar
KMFLLCYITIVTYELIALAF

SEQ ID NO: 2404035 - protein, 18 aa, Entamoeba dispar
KMFRLYTIITPLVDLLVT

SEQ ID NO: 2404036 - protein, 18 aa, Entamoeba dispar
KMMYLSYVPLLYSPSMIA

SEQ ID NO: 2404037 - protein, 32 aa, Entamoeba dispar
KMTPYWVLHIVYFFCIFLIQFILYCLLGVLFG

SEQ ID NO: 2404038 - protein, 24 aa, Entamoeba dispar
KNASFFLILLWYSFISNFTCQVVY

SEQ ID NO: 2404039 - protein, 22 aa, Entamoeba dispar
KNHLILLIKKILTDLGYFGDPE

SEQ ID NO: 2404040 - protein, 20 aa, Entamoeba dispar
KNKFYMMKLDKVPPALAFLT

SEQ ID NO: 2404041 - protein, 24 aa, Entamoeba dispar
KNMIKGIIVIMIIISVQGICFTYS

SEQ ID NO: 2404042 - protein, 22 aa, Entamoeba dispar
KNWYGFIIPLVLVLFLGVIFYK

SEQ ID NO: 2404043 - protein, 24 aa, Entamoeba dispar
KNYTNILPMFRWKMYYIADNDNVT

SEQ ID NO: 2404044 - protein, 18 aa, Entamoeba dispar
KPHRRLAIALAIEYLKKM

SEQ ID NO: 2404045 - protein, 25 aa, Entamoeba dispar
KQLKKFIVILLSVNIILIALVLKLL

SEQ ID NO: 2404046 - protein, 30 aa, Entamoeba dispar
KQNYFIVIGIPIIICIIITLIIIICIGSIV

SEQ ID NO: 2404047 - protein, 24 aa, Entamoeba dispar
KQPVVWFIVLICILGSIIVILIIA

SEQ ID NO: 2404048 - protein, 17 aa, Entamoeba dispar
KQYCMLLLPKDFDNYEI

SEQ ID NO: 2404049 - protein, 42 aa, Entamoeba dispar
KRKSMWWISLIVIPIFILIVIMIYFILTLISKKIIRLKQDNT

SEQ ID NO: 2404050 - protein, 23 aa, Entamoeba dispar
KRLVILLVLIIVVIFLIFIIWYK

SEQ ID NO: 2404051 - protein, 19 aa, Entamoeba dispar
KRTMWWKNMKLWFIIGGVV

SEQ ID NO: 2404052 - protein, 24 aa, Entamoeba dispar
KRVLKYLVYWLLNGTVCIANFFAT

SEQ ID NO: 2404053 - protein, 23 aa, Entamoeba dispar
KSILWLSLCMLFIPLTAAFARQR

SEQ ID NO: 2404054 - protein, 18 aa, Entamoeba dispar
KSLLYIIVEREYCFSDTA

SEQ ID NO: 2404055 - protein, 24 aa, Entamoeba dispar
KSSKDFLILPYNLKLRMLYDTARG

SEQ ID NO: 2404056 - protein, 27 aa, Entamoeba dispar
KSSKKLKIILLVSLIIVLILALIIGIV

SEQ ID NO: 2404057 - protein, 29 aa, Entamoeba dispar
KTKKDIIVIILMLNQVFLFISCCLVGHCL

SEQ ID NO: 2404058 - protein, 21 aa, Entamoeba dispar
KTLLILIFWIFVIQPELTMIG

SEQ ID NO: 2404059 - protein, 42 aa, Entamoeba dispar
KTNWALIIPLVIVAVIIIIILLLVLIGIIWWRRSRSVKAETA

SEQ ID NO: 2404060 - protein, 21 aa, Entamoeba dispar
KTYVPLFPYFKDLKGCFRVVA

SEQ ID NO: 2404061 - protein, 17 aa, Entamoeba dispar
KVGMTFTYFAPLVFVVC

SEQ ID NO: 2404062 - protein, 20 aa, Entamoeba dispar
KVIIWIIYTIILVTIAFLWT

SEQ ID NO: 2404063 - protein, 27 aa, Entamoeba dispar
KVINFILWFFYGIYQSLIFFFVFFWFI

SEQ ID NO: 2404064 - protein, 21 aa, Entamoeba dispar
KVNLALILPLCIGACLILIAI

SEQ ID NO: 2404065 - protein, 26 aa, Entamoeba dispar
KVVVSSLIIAAGIFAIFVGIFISFTN

SEQ ID NO: 2404066 - protein, 19 aa, Entamoeba dispar
KWALWFGLILQCVGIVLCI

SEQ ID NO: 2404067 - protein, 17 aa, Entamoeba dispar
KWKLWIIIGVIAAIIIA

SEQ ID NO: 2404068 - protein, 17 aa, Entamoeba dispar
KWLLSGFYLMPTGIKKP

SEQ ID NO: 2404069 - protein, 18 aa, Entamoeba dispar
KWTIGVIVIFVIALIVIV

SEQ ID NO: 2404070 - protein, 19 aa, Entamoeba dispar
KWYEKIPALKWYKQFHKPR

SEQ ID NO: 2404071 - protein, 24 aa, Entamoeba dispar
KYLLKSKYWITIFIDMAVSLVSSK

SEQ ID NO: 2404072 - protein, 18 aa, Entamoeba dispar
KYPFLTLFFQAIGSMICC

SEQ ID NO: 2404073 - protein, 26 aa, Entamoeba dispar
LANFIRDLMRFWKLTYVVGLIDMVMD

SEQ ID NO: 2404074 - protein, 27 aa, Entamoeba dispar
LATDKIIMVLIIVCVLVIIGCSVLYIF

SEQ ID NO: 2404075 - protein, 24 aa, Entamoeba dispar
LAYIYIIILGLFPPLFFGTSMSGF

SEQ ID NO: 2404076 - protein, 26 aa, Entamoeba dispar
LCIEIIYILITLYPFDNFKILKPIII

SEQ ID NO: 2404077 - protein, 20 aa, Entamoeba dispar
LCIISYFFVMILYPEKNEKV

SEQ ID NO: 2404078 - protein, 18 aa, Entamoeba dispar
LCILAVFPIISFFMFING

SEQ ID NO: 2404079 - protein, 19 aa, Entamoeba dispar
LCLMIIILSLNWYLPPLKA

SEQ ID NO: 2404080 - protein, 18 aa, Entamoeba dispar
LCPLLIPYSSNPIFDTPS

SEQ ID NO: 2404081 - protein, 17 aa, Entamoeba dispar
LCRSLIYNPEPYYSKYN

SEQ ID NO: 2404082 - protein, 24 aa, Entamoeba dispar
LDMDFTFLLIFYSLKSRKPTNYIK

SEQ ID NO: 2404083 - protein, 30 aa, Entamoeba dispar
LDNKGFVNLPYLLRFDFLNILRDFDFLYEK

SEQ ID NO: 2404084 - protein, 19 aa, Entamoeba dispar
LEAPLQRFFKYPKIFGNLL

SEQ ID NO: 2404085 - protein, 23 aa, Entamoeba dispar
LEGLFFVFAYFMDVAHAEECVSI

SEQ ID NO: 2404086 - protein, 17 aa, Entamoeba dispar
LEIITWQDPFPKDMKPW

SEQ ID NO: 2404087 - protein, 23 aa, Entamoeba dispar
LEYYALWFSRLFTGDLGIWILDI

SEQ ID NO: 2404088 - protein, 17 aa, Entamoeba dispar
LFGARWMILLMGLFSIY

SEQ ID NO: 2404089 - protein, 21 aa, Entamoeba dispar
LFHIGLLYLFIYCSSADEGIV

SEQ ID NO: 2404090 - protein, 20 aa, Entamoeba dispar
LFHPRFIMIACFCFGKKLEE

SEQ ID NO: 2404091 - protein, 18 aa, Entamoeba dispar
LFINLVSSQFLSIKSPID

SEQ ID NO: 2404092 - protein, 21 aa, Entamoeba dispar
LFLLFTVFSYAFCLQEAMIGV

SEQ ID NO: 2404093 - protein, 19 aa, Entamoeba dispar
LFLNIFYFKAKSTTNNISS

SEQ ID NO: 2404094 - protein, 20 aa, Entamoeba dispar
LFPMTFFGLILFLLNSFKAT

SEQ ID NO: 2404095 - protein, 20 aa, Entamoeba dispar
LFSIPMLYQEYIRCLESIMF

SEQ ID NO: 2404096 - protein, 26 aa, Entamoeba dispar
LFSISYYFYTLLKNKLLILFGNTMEN

SEQ ID NO: 2404097 - protein, 23 aa, Entamoeba dispar
LFTYLPFLLILFTFIIFTTFLII

SEQ ID NO: 2404098 - protein, 17 aa, Entamoeba dispar
LFVSIFFLIMRTITIKK

SEQ ID NO: 2404099 - protein, 35 aa, Entamoeba dispar
LFWGIGACVYLFIYIIGYIICLIMYLRLTKKIKQE

SEQ ID NO: 2404100 - protein, 24 aa, Entamoeba dispar
LGFYVWYVSLLILILFIPLYILAT

SEQ ID NO: 2404101 - protein, 20 aa, Entamoeba dispar
LGIYIFFVLVLSIINAIKYT

SEQ ID NO: 2404102 - protein, 17 aa, Entamoeba dispar
LGRIPYLYFIIFATLTG

SEQ ID NO: 2404103 - protein, 23 aa, Entamoeba dispar
LGWVHAFIFWKYSVLMYVAGQEL

SEQ ID NO: 2404104 - protein, 17 aa, Entamoeba dispar
LHKTICLIALINALKQS

SEQ ID NO: 2404105 - protein, 21 aa, Entamoeba dispar
LIAFLVFLCLYISFPLTITET

SEQ ID NO: 2404106 - protein, 23 aa, Entamoeba dispar
LIAYFFCFILYFFMNILHHSSSI

SEQ ID NO: 2404107 - protein, 17 aa, Entamoeba dispar
LIFCFAGWYYLVHHQRV

SEQ ID NO: 2404108 - protein, 18 aa, Entamoeba dispar
LIFIIILIILLDGYNKAL

SEQ ID NO: 2404109 - protein, 17 aa, Entamoeba dispar
LIFISNALIPLSTCFEG

SEQ ID NO: 2404110 - protein, 19 aa, Entamoeba dispar
LIFLVLMIQFGVMLYFRFA

SEQ ID NO: 2404111 - protein, 29 aa, Entamoeba dispar
LIGITILCLFVFVFYIILFNISLTPNPYQ

SEQ ID NO: 2404112 - protein, 18 aa, Entamoeba dispar
LIGVSILGVLFLIFQGLK

SEQ ID NO: 2404113 - protein, 19 aa, Entamoeba dispar
LIHLLLMIEFVFINPTKTQ

SEQ ID NO: 2404114 - protein, 19 aa, Entamoeba dispar
LIIFFYFSLSYSFTQNFKF

SEQ ID NO: 2404115 - protein, 19 aa, Entamoeba dispar
LIIFQAFVLIFIFTSGYVT

SEQ ID NO: 2404116 - protein, 18 aa, Entamoeba dispar
LIIIRYYCLLLKYNYIDE

SEQ ID NO: 2404117 - protein, 19 aa, Entamoeba dispar
LIIIVYFFFCYKTIPHFHS

SEQ ID NO: 2404118 - protein, 17 aa, Entamoeba dispar
LIILLKRIILCDLDIRF

SEQ ID NO: 2404119 - protein, 22 aa, Entamoeba dispar
LIISIVLFIFFIMKYRVDKKNE

SEQ ID NO: 2404120 - protein, 17 aa, Entamoeba dispar
LIISLIFICIGIYLFFK

SEQ ID NO: 2404121 - protein, 38 aa, Entamoeba dispar
LIISLIIVGLLFIVIIISIIIFLIWRKRRKIIKEREKE

SEQ ID NO: 2404122 - protein, 18 aa, Entamoeba dispar
LIIVLCMAIILIYSITRY

SEQ ID NO: 2404123 - protein, 21 aa, Entamoeba dispar
LIKHWLFWYVFSMIIFVFSVG

SEQ ID NO: 2404124 - protein, 19 aa, Entamoeba dispar
LILVIFFTNNSIIIPLTEK

SEQ ID NO: 2404125 - protein, 17 aa, Entamoeba dispar
LIPLFLYLWLSYYPPHL

SEQ ID NO: 2404126 - protein, 17 aa, Entamoeba dispar
LIPLLRLLSDIASSKNF

SEQ ID NO: 2404127 - protein, 19 aa, Entamoeba dispar
LIRAVIKREWWPFLLSLIA

SEQ ID NO: 2404128 - protein, 22 aa, Entamoeba dispar
LIRLFLSFFLINSTRFAYLAKV

SEQ ID NO: 2404129 - protein, 19 aa, Entamoeba dispar
LIRYMMIILLFSFSSRFSF

SEQ ID NO: 2404130 - protein, 18 aa, Entamoeba dispar
LISLYFVGIMVCGILSPL

SEQ ID NO: 2404131 - protein, 17 aa, Entamoeba dispar
LISTLLYLRVLPSIKDL

SEQ ID NO: 2404132 - protein, 25 aa, Entamoeba dispar
LITILFFIFLIWYFNKHSFNLGVLL

SEQ ID NO: 2404133 - protein, 27 aa, Entamoeba dispar
LIVILLVLIIFIVLIIIIVIIVIVIPK

SEQ ID NO: 2404134 - protein, 23 aa, Entamoeba dispar
LIVMLILLLPILLLCHADSDAQK

SEQ ID NO: 2404135 - protein, 19 aa, Entamoeba dispar
LIWYCVAIPSIKLIEKFPY

SEQ ID NO: 2404136 - protein, 19 aa, Entamoeba dispar
LKFIIYSILFYIQYTNAFV

SEQ ID NO: 2404137 - protein, 17 aa, Entamoeba dispar
LKHGLVTEELLIPIPSG

SEQ ID NO: 2404138 - protein, 23 aa, Entamoeba dispar
LKSIWVYKFFVQLIQKLNTKNKN

SEQ ID NO: 2404139 - protein, 18 aa, Entamoeba dispar
LKVKLFVLFYFYYSSVDY

SEQ ID NO: 2404140 - protein, 17 aa, Entamoeba dispar
LKYIFPIKRVIFILRKQ

SEQ ID NO: 2404141 - protein, 19 aa, Entamoeba dispar
LLEYRRLLPILLNYGTGAT

SEQ ID NO: 2404142 - protein, 18 aa, Entamoeba dispar
LLFFIHFPCSINNPIEEI

SEQ ID NO: 2404143 - protein, 20 aa, Entamoeba dispar
LLFTLQSFVLCFMFVMKNLK

SEQ ID NO: 2404144 - protein, 20 aa, Entamoeba dispar
LLIIFMLFMPEMFVTAFMSF

SEQ ID NO: 2404145 - protein, 17 aa, Entamoeba dispar
LLILFCICFILTLVVPT

SEQ ID NO: 2404146 - protein, 19 aa, Entamoeba dispar
LLILLGIVCLFFAGITTLF

SEQ ID NO: 2404147 - protein, 22 aa, Entamoeba dispar
LLLFQFFYLMFLITLGLSAQPY

SEQ ID NO: 2404148 - protein, 17 aa, Entamoeba dispar
LLLIFFVCLFLIMGTGS

SEQ ID NO: 2404149 - protein, 23 aa, Entamoeba dispar
LLLLFILFSMGQYIGLFPSNHEC

SEQ ID NO: 2404150 - protein, 21 aa, Entamoeba dispar
LLPIIILTLLILRFKYQKKRT

SEQ ID NO: 2404151 - protein, 18 aa, Entamoeba dispar
LLPIILYLSILTLTIFVI

SEQ ID NO: 2404152 - protein, 20 aa, Entamoeba dispar
LLRLFSSRLIYLTLKSEFVL

SEQ ID NO: 2404153 - protein, 23 aa, Entamoeba dispar
LLSLIYLFWLIFAIIRSFSEARK

SEQ ID NO: 2404154 - protein, 19 aa, Entamoeba dispar
LLTTLIISGGILITITGGA

SEQ ID NO: 2404155 - protein, 17 aa, Entamoeba dispar
LLVILYQTIQMYCFKIS

SEQ ID NO: 2404156 - protein, 17 aa, Entamoeba dispar
LLYFYLCQYFSFILNII

SEQ ID NO: 2404157 - protein, 24 aa, Entamoeba dispar
LMAINIILLCTYFFQLGVIGFLDY

SEQ ID NO: 2404158 - protein, 17 aa, Entamoeba dispar
LMNTLLMIIPDKGFKYT

SEQ ID NO: 2404159 - protein, 25 aa, Entamoeba dispar
LMSPFVWQHVLIPLLPKSLVTYCAA

SEQ ID NO: 2404160 - protein, 18 aa, Entamoeba dispar
LMYITITAMIWFGASASK

SEQ ID NO: 2404161 - protein, 23 aa, Entamoeba dispar
LNDQYHFFFLIQDVTFPEEQKKE

SEQ ID NO: 2404162 - protein, 32 aa, Entamoeba dispar
LNDYFIFTLQLILFIGVLFYTLLLYSNNRNRV

SEQ ID NO: 2404163 - protein, 18 aa, Entamoeba dispar
LNLLFYLMNICCMSARTI

SEQ ID NO: 2404164 - protein, 18 aa, Entamoeba dispar
LNLPPLMKFIINDLYSSY

SEQ ID NO: 2404165 - protein, 24 aa, Entamoeba dispar
LNSMTFFIIFICITPFFVHGDCWY

SEQ ID NO: 2404166 - protein, 23 aa, Entamoeba dispar
LNTSFLNFFIVSFSFCCLACWVV

SEQ ID NO: 2404167 - protein, 22 aa, Entamoeba dispar
LNYLPLIPLILNKIQQLYDYTK

SEQ ID NO: 2404168 - protein, 19 aa, Entamoeba dispar
LPCLFIFMSLYRFNGFTLF

SEQ ID NO: 2404169 - protein, 18 aa, Entamoeba dispar
LPFLLICFVFGGITEEVY

SEQ ID NO: 2404170 - protein, 19 aa, Entamoeba dispar
LPGIWFYCWGITCTLWFST

SEQ ID NO: 2404171 - protein, 21 aa, Entamoeba dispar
LPGIWVYCWTLLLLCGQVRNS

SEQ ID NO: 2404172 - protein, 28 aa, Entamoeba dispar
LPIQTLRFIFFYFDVVYLRLPRQPLTSK

SEQ ID NO: 2404173 - protein, 21 aa, Entamoeba dispar
LPVVSILFYVLGKSLFNTCMT

SEQ ID NO: 2404174 - protein, 23 aa, Entamoeba dispar
LQEYIYFFKRRLWFTLEFISFIG

SEQ ID NO: 2404175 - protein, 17 aa, Entamoeba dispar
LQIITWKDPFPKTEFKF

SEQ ID NO: 2404176 - protein, 25 aa, Entamoeba dispar
LQQKLKTPLLLLPKEKRPTANMFMS

SEQ ID NO: 2404177 - protein, 26 aa, Entamoeba dispar
LQQRHTLMFIILRQYFQLILSPDKTV

SEQ ID NO: 2404178 - protein, 25 aa, Entamoeba dispar
LQQRHTLMFIILRQYFQLILTHDKT

SEQ ID NO: 2404179 - protein, 22 aa, Entamoeba dispar
LQRRLLVVILMNLVLISMLIYL

SEQ ID NO: 2404180 - protein, 27 aa, Entamoeba dispar
LQSCCLFFILFFYYLNKYLLTSLVQNY

SEQ ID NO: 2404181 - protein, 21 aa, Entamoeba dispar
LRCLALFLEYAWMKGIDGFNN

SEQ ID NO: 2404182 - protein, 20 aa, Entamoeba dispar
LRLILMLLLSILLKTRDYVF

SEQ ID NO: 2404183 - protein, 26 aa, Entamoeba dispar
LRPSLRWYFSILFWRRIKTLKSTFKQ

SEQ ID NO: 2404184 - protein, 22 aa, Entamoeba dispar
LRSILFILYLFALLIYFFSNLV

SEQ ID NO: 2404185 - protein, 21 aa, Entamoeba dispar
LSFLNSFYLLFASSPAKLLVV

SEQ ID NO: 2404186 - protein, 23 aa, Entamoeba dispar
LSIIFLLFVLFIESLLFCLQWIT

SEQ ID NO: 2404187 - protein, 32 aa, Entamoeba dispar
LSILFVVFILLILLWFMMHFMLAVQSIGPAVF

SEQ ID NO: 2404188 - protein, 22 aa, Entamoeba dispar
LSILYPLIFFPTHLKMVFKYIF

SEQ ID NO: 2404189 - protein, 26 aa, Entamoeba dispar
LSILYPSLPFIWGYFALLSVGLWYSS

SEQ ID NO: 2404190 - protein, 18 aa, Entamoeba dispar
LSIYYIFSWGFTSLYLLL

SEQ ID NO: 2404191 - protein, 23 aa, Entamoeba dispar
LSQFFLWITVFVLIHISFTISLI

SEQ ID NO: 2404192 - protein, 24 aa, Entamoeba dispar
LSRPIQLIFLLRPNSFDTLMLALT

SEQ ID NO: 2404193 - protein, 26 aa, Entamoeba dispar
LSSILFMPLLIILSYIYISIIIFYID

SEQ ID NO: 2404194 - protein, 22 aa, Entamoeba dispar
LSSLKCFLNWRLVLLFPLALLF

SEQ ID NO: 2404195 - protein, 17 aa, Entamoeba dispar
LTHLLICGCMGFLYFHH

SEQ ID NO: 2404196 - protein, 19 aa, Entamoeba dispar
LTIILWFVVALNWKDIKIF

SEQ ID NO: 2404197 - protein, 20 aa, Entamoeba dispar
LTKLVYWLAGMTFTPMVVLE

SEQ ID NO: 2404198 - protein, 23 aa, Entamoeba dispar
LTMKEWFWELINLGWNQNPKERI

SEQ ID NO: 2404199 - protein, 20 aa, Entamoeba dispar
LTMTLVMLVLIFIGFLIIKK

SEQ ID NO: 2404200 - protein, 35 aa, Entamoeba dispar
LTNQKQLWYLLLIPILFILVLFMITTLMCVYKIYQ

SEQ ID NO: 2404201 - protein, 29 aa, Entamoeba dispar
LTTTKTIFLVFFLVVFVVFLIVWGHCGIS

SEQ ID NO: 2404202 - protein, 18 aa, Entamoeba dispar
LVALFRLFAPLISSPLIA

SEQ ID NO: 2404203 - protein, 17 aa, Entamoeba dispar
LVDYYRYSPLLWYRLAC

SEQ ID NO: 2404204 - protein, 17 aa, Entamoeba dispar
LVGLVVSVLFLVAGIYI

SEQ ID NO: 2404205 - protein, 19 aa, Entamoeba dispar
LVHLIIFCPCTCVPPIPIM

SEQ ID NO: 2404206 - protein, 22 aa, Entamoeba dispar
LVIFVWIFYFFLIRNWLSLRIL

SEQ ID NO: 2404207 - protein, 25 aa, Entamoeba dispar
LVLGWVHAFIFWKYYVLMYVAGQEL

SEQ ID NO: 2404208 - protein, 23 aa, Entamoeba dispar
LVLMALPRYPLLTGWKTEFMIGY

SEQ ID NO: 2404209 - protein, 21 aa, Entamoeba dispar
LVLYFIPFFILKALNRIILYQ

SEQ ID NO: 2404210 - protein, 22 aa, Entamoeba dispar
LVMIILIIILGIFIYFIMKHKT

SEQ ID NO: 2404211 - protein, 20 aa, Entamoeba dispar
LVSRLLWQFLMKIKDDMEKV

SEQ ID NO: 2404212 - protein, 18 aa, Entamoeba dispar
LVVAVCGLLLIFGMIIVK

SEQ ID NO: 2404213 - protein, 25 aa, Entamoeba dispar
LVVCIILLCIITYWAFIPIGVCLLF

SEQ ID NO: 2404214 - protein, 25 aa, Entamoeba dispar
LVVILFLLVFALIAAGYVFVDGINK

SEQ ID NO: 2404215 - protein, 17 aa, Entamoeba dispar
LWILIKRNALIQWRSPG

SEQ ID NO: 2404216 - protein, 22 aa, Entamoeba dispar
LWWVSATIFIFFIICVFIFGIC

SEQ ID NO: 2404217 - protein, 40 aa, Entamoeba dispar
LYGINSFCSCLFFLLTIFSFKLFLCFHSIELILLASWCPI

SEQ ID NO: 2404218 - protein, 17 aa, Entamoeba dispar
LYLFISFGLTKHFMSFS

SEQ ID NO: 2404219 - protein, 24 aa, Entamoeba dispar
LYRPLTVILFFLITGIIFIPIGIA

SEQ ID NO: 2404220 - protein, 20 aa, Entamoeba dispar
LYSIPIIILYISYKTWYSFL

SEQ ID NO: 2404221 - protein, 18 aa, Entamoeba dispar
LYYKVFAYFYYLVGNLAS

SEQ ID NO: 2404222 - protein, 17 aa, Entamoeba dispar
MAFILYLVYIQIDYHLE

SEQ ID NO: 2404223 - protein, 23 aa, Entamoeba dispar
MATYFCWLIIPLLMKENGASSFL

SEQ ID NO: 2404224 - protein, 21 aa, Entamoeba dispar
MDFVPIMWIFYIVGSYFAVPL

SEQ ID NO: 2404225 - protein, 22 aa, Entamoeba dispar
MDLTFLPFLVFPIVIMGYTHYA

SEQ ID NO: 2404226 - protein, 17 aa, Entamoeba dispar
MDPIALAGILIFIFIGG

SEQ ID NO: 2404227 - protein, 17 aa, Entamoeba dispar
MFKLLILKFPTLPPIEI

SEQ ID NO: 2404228 - protein, 17 aa, Entamoeba dispar
MFQYYLTIIPIKNNFIN

SEQ ID NO: 2404229 - protein, 17 aa, Entamoeba dispar
MIILLTILLKIIPINNI

SEQ ID NO: 2404230 - protein, 18 aa, Entamoeba dispar
MIQVLLYCWLCYNSKNEK

SEQ ID NO: 2404231 - protein, 23 aa, Entamoeba dispar
MITLFFLIFYWAGLFFVVCFWIM

SEQ ID NO: 2404232 - protein, 24 aa, Entamoeba dispar
MIYGALFPIFAYFLAEAICMLVTV

SEQ ID NO: 2404233 - protein, 19 aa, Entamoeba dispar
MKRFAIITTLFTPLTFLST

SEQ ID NO: 2404234 - protein, 21 aa, Entamoeba dispar
MLFFYKQIIIFYYFVNYQTND

SEQ ID NO: 2404235 - protein, 17 aa, Entamoeba dispar
MLFISFPLDFIGEYLLM

SEQ ID NO: 2404236 - protein, 23 aa, Entamoeba dispar
MLISTLIFVFFYLSYKELPKNIK

SEQ ID NO: 2404237 - protein, 17 aa, Entamoeba dispar
MMIIFHTPNNPKYVFYF

SEQ ID NO: 2404238 - protein, 17 aa, Entamoeba dispar
MMKLPFLKQVKDLVDHF

SEQ ID NO: 2404239 - protein, 22 aa, Entamoeba dispar
MMKPYTYGYWFNITFEKASKIM

SEQ ID NO: 2404240 - protein, 20 aa, Entamoeba dispar
MNAWDIFLFLSSKSFIILRR

SEQ ID NO: 2404241 - protein, 17 aa, Entamoeba dispar
MNFILLNVFLVCVSASF

SEQ ID NO: 2404242 - protein, 18 aa, Entamoeba dispar
MNGIFLVVCATVAFGMGI

SEQ ID NO: 2404243 - protein, 18 aa, Entamoeba dispar
MNKYGWLLLPSWNSPDAK

SEQ ID NO: 2404244 - protein, 23 aa, Entamoeba dispar
MVILPFILFIFTAIPFMNWRNLS

SEQ ID NO: 2404245 - protein, 28 aa, Entamoeba dispar
MVIVKYSWFFFDLIIRSLVYYLNDEINK

SEQ ID NO: 2404246 - protein, 17 aa, Entamoeba dispar
MWIFYIVGSYFAVPLCN

SEQ ID NO: 2404247 - protein, 23 aa, Entamoeba dispar
MYIGIIFFFYFLAQTLVMVVMSL

SEQ ID NO: 2404248 - protein, 28 aa, Entamoeba dispar
NDNKDLLYFYYFLPFNITIDRNKKMYLI

SEQ ID NO: 2404249 - protein, 26 aa, Entamoeba dispar
NDSHKIFDLFWFFLGLVEKSIVAYLQ

SEQ ID NO: 2404250 - protein, 18 aa, Entamoeba dispar
NEFIKWRILSWKSNEWRN

SEQ ID NO: 2404251 - protein, 23 aa, Entamoeba dispar
NEILYLLIGYLSCLIPAACIGIF

SEQ ID NO: 2404252 - protein, 24 aa, Entamoeba dispar
NEITLFYYFLPFTINIDNDKKMYL

SEQ ID NO: 2404253 - protein, 19 aa, Entamoeba dispar
NEMILNLLLLIFSFIDGFS

SEQ ID NO: 2404254 - protein, 19 aa, Entamoeba dispar
NFDLRSPYLFMPIVKLVNA

SEQ ID NO: 2404255 - protein, 21 aa, Entamoeba dispar
NFGKIYNFYLPCQAYVTATYH

SEQ ID NO: 2404256 - protein, 19 aa, Entamoeba dispar
NFISIYLFLLLAAIGITVS

SEQ ID NO: 2404257 - protein, 23 aa, Entamoeba dispar
NGDHFMLLSLYLAFKKVGVNRRK

SEQ ID NO: 2404258 - protein, 23 aa, Entamoeba dispar
NHISYFNWFLYTTTLLFKQLNLN

SEQ ID NO: 2404259 - protein, 19 aa, Entamoeba dispar
NIILLFFNSLEEWNIHKDI

SEQ ID NO: 2404260 - protein, 20 aa, Entamoeba dispar
NILCLLLGGFFFILVSIFEL

SEQ ID NO: 2404261 - protein, 17 aa, Entamoeba dispar
NILRIGFVASLLARSGA

SEQ ID NO: 2404262 - protein, 23 aa, Entamoeba dispar
NINRKWYFAPRKISNIAYNETYD

SEQ ID NO: 2404263 - protein, 18 aa, Entamoeba dispar
NIPLLRKTLQLIPPYLVQ

SEQ ID NO: 2404264 - protein, 26 aa, Entamoeba dispar
NKEIIWWMIMIIIIIILIIIIIIIII

SEQ ID NO: 2404265 - protein, 27 aa, Entamoeba dispar
NKEIVWWMIMIIIIIILIIIIIIIIII

SEQ ID NO: 2404266 - protein, 32 aa, Entamoeba dispar
NKEIVWWMIMIIIIIILIIIITIIIIIIIMIN

SEQ ID NO: 2404267 - protein, 32 aa, Entamoeba dispar
NKEIVWWMIMIIIIIILIIIITIIIIIITMIN

SEQ ID NO: 2404268 - protein, 26 aa, Entamoeba dispar
NKEMVWWMIMIIIIIILIIIIIIIII

SEQ ID NO: 2404269 - protein, 23 aa, Entamoeba dispar
NKRIFIHNFLFDLALEFGFFFDS

SEQ ID NO: 2404270 - protein, 25 aa, Entamoeba dispar
NKWNQIDFIYFYQLMIKFFTQINVN

SEQ ID NO: 2404271 - protein, 22 aa, Entamoeba dispar
NKYYYYLLKRLINVLHFCLLKN

SEQ ID NO: 2404272 - protein, 24 aa, Entamoeba dispar
NLCSLPRFWIVLLYIVCIPLVKPT

SEQ ID NO: 2404273 - protein, 20 aa, Entamoeba dispar
NLFLSLIKLLEGYLANSLVE

SEQ ID NO: 2404274 - protein, 17 aa, Entamoeba dispar
NLKMPYIILFRLKQKLT

SEQ ID NO: 2404275 - protein, 22 aa, Entamoeba dispar
NLPPELLQIYKYSIMIKPISDE

SEQ ID NO: 2404276 - protein, 17 aa, Entamoeba dispar
NLYLLLTLLQQFGICYI

SEQ ID NO: 2404277 - protein, 17 aa, Entamoeba dispar
NMESPLLVFVYSGSETI

SEQ ID NO: 2404278 - protein, 17 aa, Entamoeba dispar
NMLFLIIYSVSVFYFSC

SEQ ID NO: 2404279 - protein, 20 aa, Entamoeba dispar
NMNYPTYYPFFNVYAMSYNG

SEQ ID NO: 2404280 - protein, 19 aa, Entamoeba dispar
NNFKIFCDCLYDKKMKEFM

SEQ ID NO: 2404281 - protein, 17 aa, Entamoeba dispar
NNIPYWIFPLINVLILT

SEQ ID NO: 2404282 - protein, 23 aa, Entamoeba dispar
NNKYQWWNFIPLAYLRQFKYTYN

SEQ ID NO: 2404283 - protein, 30 aa, Entamoeba dispar
NNLVYYLYYLFVIILFFFPSLMIPTNPADE

SEQ ID NO: 2404284 - protein, 23 aa, Entamoeba dispar
NNMKFFVQFIFYASLALLLASVI

SEQ ID NO: 2404285 - protein, 23 aa, Entamoeba dispar
NNSWTILLWIVVGCIICAGLVMV

SEQ ID NO: 2404286 - protein, 26 aa, Entamoeba dispar
NNYLIILLCNYYIFNLIYLVPKIKNE

SEQ ID NO: 2404287 - protein, 22 aa, Entamoeba dispar
NNYYYYHLPIQRTYFNSIPINL

SEQ ID NO: 2404288 - protein, 19 aa, Entamoeba dispar
NNYYYYLPIQRTYINSNPI

SEQ ID NO: 2404289 - protein, 26 aa, Entamoeba dispar
NPNQMFVLFILLIKYSIYSFLSGISC

SEQ ID NO: 2404290 - protein, 25 aa, Entamoeba dispar
NQSYLMMLMFSFIGTSGLLVVLFII

SEQ ID NO: 2404291 - protein, 25 aa, Entamoeba dispar
NSELTNFFYFLPFEINIDNDKKMYL

SEQ ID NO: 2404292 - protein, 22 aa, Entamoeba dispar
NSGSLRILFINYGILSITKGIG

SEQ ID NO: 2404293 - protein, 41 aa, Entamoeba dispar
NSHIEVWLIIICVIVLLIIIIVIIVLLIYIIKRVLGYRKEE

SEQ ID NO: 2404294 - protein, 35 aa, Entamoeba dispar
NTEFPKWTIGVIVIFVIALIVIVVVIIVYAVYVYL

SEQ ID NO: 2404295 - protein, 20 aa, Entamoeba dispar
NTHLFFLKPLVPIQLTEIFI

SEQ ID NO: 2404296 - protein, 21 aa, Entamoeba dispar
NTHLIKFFYYHCYSKRFIEFL

SEQ ID NO: 2404297 - protein, 23 aa, Entamoeba dispar
NTTLQIFFIIPLGYCIFLSIKRI

SEQ ID NO: 2404298 - protein, 19 aa, Entamoeba dispar
NTYFLAWTTTPWTLPSNLA

SEQ ID NO: 2404299 - protein, 19 aa, Entamoeba dispar
NVKILFPKYLPLFSKIVYL

SEQ ID NO: 2404300 - protein, 17 aa, Entamoeba dispar
NWWSILQFIIWSIIITL

SEQ ID NO: 2404301 - protein, 20 aa, Entamoeba dispar
PAFVMPLFRKTIIRLLTELQ

SEQ ID NO: 2404302 - protein, 23 aa, Entamoeba dispar
PCYLMYMQLIGYLLLIGMELHDK

SEQ ID NO: 2404303 - protein, 19 aa, Entamoeba dispar
PDLQLFDYLFQPLLNNSDS

SEQ ID NO: 2404304 - protein, 23 aa, Entamoeba dispar
PDPIIIPFWKIWFEALQDKTLII

SEQ ID NO: 2404305 - protein, 24 aa, Entamoeba dispar
PDPVLIPFWKIWFEALQDKTLIIL

SEQ ID NO: 2404306 - protein, 23 aa, Entamoeba dispar
PEKRYFFFFTFHDDNLFINFNIK

SEQ ID NO: 2404307 - protein, 19 aa, Entamoeba dispar
PFFPLILKLILQESFALVL

SEQ ID NO: 2404308 - protein, 19 aa, Entamoeba dispar
PFIAKFFYQLIFPPKYMTV

SEQ ID NO: 2404309 - protein, 26 aa, Entamoeba dispar
PGGKFLDIIFSLLLMSFLGIGYLEQE

SEQ ID NO: 2404310 - protein, 21 aa, Entamoeba dispar
PIIERLLLYLLYFWDKVGLSL

SEQ ID NO: 2404311 - protein, 25 aa, Entamoeba dispar
PILIYLFTLLYIFIYCYTLISNILI

SEQ ID NO: 2404312 - protein, 19 aa, Entamoeba dispar
PIQVLPLYAALPPEQQLLI

SEQ ID NO: 2404313 - protein, 22 aa, Entamoeba dispar
PISMYYPLLTLLVYAISLTESP

SEQ ID NO: 2404314 - protein, 27 aa, Entamoeba dispar
PIVDFLYMIIILHFSLIIKSEELSQCI

SEQ ID NO: 2404315 - protein, 29 aa, Entamoeba dispar
PIVIAIISIIFASLVFFLCQRRTDNNPAQ

SEQ ID NO: 2404316 - protein, 18 aa, Entamoeba dispar
PIWTNWWGENFHWRERVD

SEQ ID NO: 2404317 - protein, 17 aa, Entamoeba dispar
PKHIYDFLITELNWEEF

SEQ ID NO: 2404318 - protein, 27 aa, Entamoeba dispar
PKSELTNFFYFLPFTINIDNDKKMYLI

SEQ ID NO: 2404319 - protein, 20 aa, Entamoeba dispar
PKYLTFENINLTLPANFVFS

SEQ ID NO: 2404320 - protein, 18 aa, Entamoeba dispar
PLFIPYVLLLCFVSRAFN

SEQ ID NO: 2404321 - protein, 18 aa, Entamoeba dispar
PLFLYLWLSYYPPHLSYQ

SEQ ID NO: 2404322 - protein, 17 aa, Entamoeba dispar
PLLKWTVIGLLLISVLL

SEQ ID NO: 2404323 - protein, 17 aa, Entamoeba dispar
PLVFNWPSSQNAACYYC

SEQ ID NO: 2404324 - protein, 17 aa, Entamoeba dispar
PLVLLFYSFYKYLFYEE

SEQ ID NO: 2404325 - protein, 21 aa, Entamoeba dispar
PNGVFLDTLFSLLLTSFIGIG

SEQ ID NO: 2404326 - protein, 27 aa, Entamoeba dispar
PNSELTNFFYFLPFTINIDNDKKMYLT

SEQ ID NO: 2404327 - protein, 26 aa, Entamoeba dispar
PNSELVYFVYFLPFTIYIDNNKKMYL

SEQ ID NO: 2404328 - protein, 27 aa, Entamoeba dispar
PNSELVYFYYFLPFKIYIDNNKKMYLI

SEQ ID NO: 2404329 - protein, 22 aa, Entamoeba dispar
PNYVLYLPYYLLGSQVTLRIIT

SEQ ID NO: 2404330 - protein, 22 aa, Entamoeba dispar
PPFLLILLFSFFKKSSKFLCYS

SEQ ID NO: 2404331 - protein, 29 aa, Entamoeba dispar
PPQNNIIRIPWRRILFTPNPKKPTIWDDI

SEQ ID NO: 2404332 - protein, 23 aa, Entamoeba dispar
PPSYNIWLLICTAIFGALIIITA

SEQ ID NO: 2404333 - protein, 20 aa, Entamoeba dispar
PQGFAPLLFYGLTPGLSERI

SEQ ID NO: 2404334 - protein, 20 aa, Entamoeba dispar
PQHILPLVFNWPSSQNAACY

SEQ ID NO: 2404335 - protein, 21 aa, Entamoeba dispar
PQHYIYFYKMLWLLLEKFDHK

SEQ ID NO: 2404336 - protein, 25 aa, Entamoeba dispar
PQTISWLFIFRIVPMLVIFMICLAR

SEQ ID NO: 2404337 - protein, 19 aa, Entamoeba dispar
PRFVLYFVFYLINLYLSFS

SEQ ID NO: 2404338 - protein, 21 aa, Entamoeba dispar
PRLYYHFFPLKAHIIQAPFTS

SEQ ID NO: 2404339 - protein, 24 aa, Entamoeba dispar
PSAFLIILFIIVVIIIIIFSCTRC

SEQ ID NO: 2404340 - protein, 18 aa, Entamoeba dispar
PSLKWYFMIFFGPNVETM

SEQ ID NO: 2404341 - protein, 24 aa, Entamoeba dispar
PTQVIFFILIFVLVFLAISFLSIV

SEQ ID NO: 2404342 - protein, 29 aa, Entamoeba dispar
PVFLFNQFKYFINLFFLIIAILSCIPQLS

SEQ ID NO: 2404343 - protein, 26 aa, Entamoeba dispar
PVILLSIILLIIVLNIIIISAIIYKC

SEQ ID NO: 2404344 - protein, 26 aa, Entamoeba dispar
PVKQKWLWSLYIILTVMSIITLALTI

SEQ ID NO: 2404345 - protein, 19 aa, Entamoeba dispar
PYCFFSFIIILVETIILWS

SEQ ID NO: 2404346 - protein, 18 aa, Entamoeba dispar
PYLYLFIVALFTSIVTAP

SEQ ID NO: 2404347 - protein, 24 aa, Entamoeba dispar
PYSKYIICWFGLDTLQLLNFSIKI

SEQ ID NO: 2404348 - protein, 23 aa, Entamoeba dispar
QARIFFFKLILLKMTLAPSFRIN

SEQ ID NO: 2404349 - protein, 19 aa, Entamoeba dispar
QDLYLCLIWVLKNLNREVL

SEQ ID NO: 2404350 - protein, 26 aa, Entamoeba dispar
QDPNYLLIQIVFYFSLFYSTSYAVLK

SEQ ID NO: 2404351 - protein, 24 aa, Entamoeba dispar
QFKYFYNLYFLITALSQFVPILQV

SEQ ID NO: 2404352 - protein, 20 aa, Entamoeba dispar
QFNKGFIIGKLGYDLYIIDQ

SEQ ID NO: 2404353 - protein, 21 aa, Entamoeba dispar
QGMINFIYWGIGSIVYALYYI

SEQ ID NO: 2404354 - protein, 19 aa, Entamoeba dispar
QHHTLIVSIIWIIGIAFVG

SEQ ID NO: 2404355 - protein, 19 aa, Entamoeba dispar
QHHTLIVSIIWIIGIAIVG

SEQ ID NO: 2404356 - protein, 20 aa, Entamoeba dispar
QIEWALKVISIPIPTYLTPI

SEQ ID NO: 2404357 - protein, 21 aa, Entamoeba dispar
QIKFLSLILYYCIVSSMGSIT

SEQ ID NO: 2404358 - protein, 21 aa, Entamoeba dispar
QIKWIIILNFFETPIKFILPS

SEQ ID NO: 2404359 - protein, 18 aa, Entamoeba dispar
QILPLSLIIFFFSLVTDV

SEQ ID NO: 2404360 - protein, 26 aa, Entamoeba dispar
QIQTKFNFLILLKFLIVKEIIEECKE

SEQ ID NO: 2404361 - protein, 20 aa, Entamoeba dispar
QKCYLFYTIIGLFVLFAYTG

SEQ ID NO: 2404362 - protein, 20 aa, Entamoeba dispar
QKKWVVTYSIYWLPYVNLAQ

SEQ ID NO: 2404363 - protein, 26 aa, Entamoeba dispar
QKQPVVWFIVLICILGSIIVILIIAG

SEQ ID NO: 2404364 - protein, 17 aa, Entamoeba dispar
QLEAYLLSIIYIIFVCC

SEQ ID NO: 2404365 - protein, 19 aa, Entamoeba dispar
QLIGWIMICVIIGILLIVI

SEQ ID NO: 2404366 - protein, 20 aa, Entamoeba dispar
QLLFVIRWFFSFLLDPMNSV

SEQ ID NO: 2404367 - protein, 25 aa, Entamoeba dispar
QLLLTPSFYLLILIPPLLLGAKEMV

SEQ ID NO: 2404368 - protein, 23 aa, Entamoeba dispar
QLPPLYSYLLFKSKYPNVYSDSM

SEQ ID NO: 2404369 - protein, 32 aa, Entamoeba dispar
QLWDWVLQSPKFAKFMFFLLAYILSCEPMILE

SEQ ID NO: 2404370 - protein, 31 aa, Entamoeba dispar
QNAFVLLKLFFLFLPTPIIPFCFLDFIKQQE

SEQ ID NO: 2404371 - protein, 25 aa, Entamoeba dispar
QNMFFIRFLFMLLLTFHCSFTVFLG

SEQ ID NO: 2404372 - protein, 25 aa, Entamoeba dispar
QNMIISFFLCWFVIGIGAICGFRLM

SEQ ID NO: 2404373 - protein, 34 aa, Entamoeba dispar
QNNSNTIWLIIIPSVICIILIIIIIVLLSIYLHK

SEQ ID NO: 2404374 - protein, 25 aa, Entamoeba dispar
QPSTYLFILLYVILAITPLLLRNFC

SEQ ID NO: 2404375 - protein, 28 aa, Entamoeba dispar
QQSDWKIFWIVLLVPLILATYFAFKLSM

SEQ ID NO: 2404376 - protein, 25 aa, Entamoeba dispar
QRSPVWWVIILVIMVILLVIIITLI

SEQ ID NO: 2404377 - protein, 26 aa, Entamoeba dispar
QRTFKFFYFPRFLIVLLIGSFLVNLY

SEQ ID NO: 2404378 - protein, 21 aa, Entamoeba dispar
QRTPILLIPLLRLLSDIASSK

SEQ ID NO: 2404379 - protein, 24 aa, Entamoeba dispar
QSMKFIPIILLRPIFRIPLKQNDL

SEQ ID NO: 2404380 - protein, 27 aa, Entamoeba dispar
QSYNKLLIYLIYLVKPYVNWSRVYLEI

SEQ ID NO: 2404381 - protein, 25 aa, Entamoeba dispar
QTFFPPMLPFLFRSLTQPKQPLPKK

SEQ ID NO: 2404382 - protein, 17 aa, Entamoeba dispar
QTFFRYFGLLSYLIPIS

SEQ ID NO: 2404383 - protein, 23 aa, Entamoeba dispar
QTHNALFMIYPNWISEMGITVES

SEQ ID NO: 2404384 - protein, 22 aa, Entamoeba dispar
QTLLLLVLFFLAIEELINQNLS

SEQ ID NO: 2404385 - protein, 30 aa, Entamoeba dispar
QVFTTLFFLRYLFLPLISYPSLLKILQKAT

SEQ ID NO: 2404386 - protein, 21 aa, Entamoeba dispar
QVNYPLHKYLGFSLLKLHLPA

SEQ ID NO: 2404387 - protein, 26 aa, Entamoeba dispar
QVTSTPIIFRLCEWYSIIPEPDKHYS

SEQ ID NO: 2404388 - protein, 17 aa, Entamoeba dispar
QWLGIAVFFLYLTSLIL

SEQ ID NO: 2404389 - protein, 25 aa, Entamoeba dispar
QYDVFYYLAMQPWRHFVWTTCSGNG

SEQ ID NO: 2404390 - protein, 24 aa, Entamoeba dispar
RADGFGMEILPLLKFIGSSQTYAE

SEQ ID NO: 2404391 - protein, 17 aa, Entamoeba dispar
RAYMALTFYKNTKYYLF

SEQ ID NO: 2404392 - protein, 26 aa, Entamoeba dispar
REDIIPILRYILAPTPYSGLLTTTQV

SEQ ID NO: 2404393 - protein, 17 aa, Entamoeba dispar
RFFFLFISSLSLSLLLG

SEQ ID NO: 2404394 - protein, 18 aa, Entamoeba dispar
RFILLIMYINIVNGINNL

SEQ ID NO: 2404395 - protein, 29 aa, Entamoeba dispar
RFKKWSILICICLIVVIFLIVVGSILLPI

SEQ ID NO: 2404396 - protein, 18 aa, Entamoeba dispar
RFTITFLCTCSCNDDDII

SEQ ID NO: 2404397 - protein, 18 aa, Entamoeba dispar
RFYFRADLFIKVPSILTL

SEQ ID NO: 2404398 - protein, 22 aa, Entamoeba dispar
RFYFYLEILYLLMNITIQPPNF

SEQ ID NO: 2404399 - protein, 43 aa, Entamoeba dispar
RGITNFLFWGIGSIIYIIFYILLLLLVLFIYYNLTKQIKQEID

SEQ ID NO: 2404400 - protein, 28 aa, Entamoeba dispar
RGPDKMLMTIMMICLLLGVVSIIAMIFL

SEQ ID NO: 2404401 - protein, 29 aa, Entamoeba dispar
RGPDQLCCTITILFVIFGIISIGAMILMK

SEQ ID NO: 2404402 - protein, 21 aa, Entamoeba dispar
RICPLELKSACGAILYASPYF

SEQ ID NO: 2404403 - protein, 18 aa, Entamoeba dispar
RIDIILNHILFTGTLGVL

SEQ ID NO: 2404404 - protein, 18 aa, Entamoeba dispar
RIFPHKYCWREGDDLYIN

SEQ ID NO: 2404405 - protein, 20 aa, Entamoeba dispar
RIFSNWYFLGICAGICVCQI

SEQ ID NO: 2404406 - protein, 24 aa, Entamoeba dispar
RIIKPLGIFFFLSSGVYLLITITA

SEQ ID NO: 2404407 - protein, 19 aa, Entamoeba dispar
RKLANLGKWLVLLAGILCL

SEQ ID NO: 2404408 - protein, 20 aa, Entamoeba dispar
RKMPLSYLLFFIGILLYIHC

SEQ ID NO: 2404409 - protein, 21 aa, Entamoeba dispar
RKPIFLPLFTLNLSKQMTYYV

SEQ ID NO: 2404410 - protein, 18 aa, Entamoeba dispar
RKWKLWIIIGVIAAIIII

SEQ ID NO: 2404411 - protein, 18 aa, Entamoeba dispar
RLLVYALQYVIVPLIRVH

SEQ ID NO: 2404412 - protein, 23 aa, Entamoeba dispar
RLPFSYYYFVSFLEDLLLIFEYT

SEQ ID NO: 2404413 - protein, 17 aa, Entamoeba dispar
RLPHFFQILSLTPIGRG

SEQ ID NO: 2404414 - protein, 20 aa, Entamoeba dispar
RLRISLLYTWCVILILNNVR

SEQ ID NO: 2404415 - protein, 23 aa, Entamoeba dispar
RLRSIMIYILYLLVGISVITMVV

SEQ ID NO: 2404416 - protein, 20 aa, Entamoeba dispar
RLYMIFWGIWFYCSEQTEVF

SEQ ID NO: 2404417 - protein, 18 aa, Entamoeba dispar
RMLGLVKWLLSGFYLMPT

SEQ ID NO: 2404418 - protein, 18 aa, Entamoeba dispar
RNILLSFIFLLNCFVING

SEQ ID NO: 2404419 - protein, 22 aa, Entamoeba dispar
RNKFFHFIAIPFVFDKIKNKIP

SEQ ID NO: 2404420 - protein, 17 aa, Entamoeba dispar
RNKWMMIIFHTPNNPKY

SEQ ID NO: 2404421 - protein, 24 aa, Entamoeba dispar
RQGQTLISFFYPAKNLKLLDLAVK

SEQ ID NO: 2404422 - protein, 18 aa, Entamoeba dispar
RQINLYLLSLLSNKKQLI

SEQ ID NO: 2404423 - protein, 20 aa, Entamoeba dispar
RQIVSFFDLILFLFGQHQHF

SEQ ID NO: 2404424 - protein, 23 aa, Entamoeba dispar
RRKYILKMLYIYILGYDVDFGIP

SEQ ID NO: 2404425 - protein, 17 aa, Entamoeba dispar
RRLEWHYLFLACGYTGI

SEQ ID NO: 2404426 - protein, 25 aa, Entamoeba dispar
RSLFLLFQFFYLMFLITLGLSAQPY

SEQ ID NO: 2404427 - protein, 25 aa, Entamoeba dispar
RSSGLLIWTIWTIMTILAVTILTVS

SEQ ID NO: 2404428 - protein, 17 aa, Entamoeba dispar
RSTLLLCLLVSIIFYFI

SEQ ID NO: 2404429 - protein, 20 aa, Entamoeba dispar
RTFSDIILITLGVGLTLMTI

SEQ ID NO: 2404430 - protein, 18 aa, Entamoeba dispar
RVAPKTYFSIRKLNLHIT

SEQ ID NO: 2404431 - protein, 22 aa, Entamoeba dispar
RVDYPLWFLCLYDAAGRASKAL

SEQ ID NO: 2404432 - protein, 30 aa, Entamoeba dispar
SAGLLFIIGLFILLFFILLRYERTNIEIFK

SEQ ID NO: 2404433 - protein, 17 aa, Entamoeba dispar
SAHFLVFGRVFRLNLKE

SEQ ID NO: 2404434 - protein, 29 aa, Entamoeba dispar
SAPIIIIWTTLFLVEILLAIIVVLIAQTG

SEQ ID NO: 2404435 - protein, 27 aa, Entamoeba dispar
SDASPVYLTFYYLVNILINGKIYKKTS

SEQ ID NO: 2404436 - protein, 25 aa, Entamoeba dispar
SDIYIRTLILFLPLLIVFNKERIDK

SEQ ID NO: 2404437 - protein, 24 aa, Entamoeba dispar
SDNWIIYHILWKVLQLEPLKWNLK

SEQ ID NO: 2404438 - protein, 26 aa, Entamoeba dispar
SEDPCFFVFILVALFLLKEKMLGDST

SEQ ID NO: 2404439 - protein, 18 aa, Entamoeba dispar
SERIIFPMFFVNSKPLAG

SEQ ID NO: 2404440 - protein, 19 aa, Entamoeba dispar
SERIIFPMFFVNSKPLAGY

SEQ ID NO: 2404441 - protein, 24 aa, Entamoeba dispar
SFAIALCYFIIPYFSANHDFRKLA

SEQ ID NO: 2404442 - protein, 18 aa, Entamoeba dispar
SFFFILFFGLFPLSLLEI

SEQ ID NO: 2404443 - protein, 20 aa, Entamoeba dispar
SFFIFLMITILFIRLLISIP

SEQ ID NO: 2404444 - protein, 22 aa, Entamoeba dispar
SFISYFMYIGLFLSAGFKMIGR

SEQ ID NO: 2404445 - protein, 20 aa, Entamoeba dispar
SFLLILIPSKIISSIILCIF

SEQ ID NO: 2404446 - protein, 20 aa, Entamoeba dispar
SFLSLVFLYTFITLSLLLNA

SEQ ID NO: 2404447 - protein, 25 aa, Entamoeba dispar
SFVAAFLFIDYIATPAPHLPPSFPL

SEQ ID NO: 2404448 - protein, 22 aa, Entamoeba dispar
SFYIMINWFFTLLEYLSIMSGK

SEQ ID NO: 2404449 - protein, 18 aa, Entamoeba dispar
SGAWFFWSMAALIFTWFC

SEQ ID NO: 2404450 - protein, 22 aa, Entamoeba dispar
SGIFWWHILLIIIGSVWIAFIL

SEQ ID NO: 2404451 - protein, 20 aa, Entamoeba dispar
SGIIFFILSIVLALFPLNPI

SEQ ID NO: 2404452 - protein, 23 aa, Entamoeba dispar
SGKSTLLNYLFNTKFRILNEVMG

SEQ ID NO: 2404453 - protein, 20 aa, Entamoeba dispar
SGLKYIMWMIGIGGGIVSVV

SEQ ID NO: 2404454 - protein, 19 aa, Entamoeba dispar
SGNEFIFKSFKVTLTDNKN

SEQ ID NO: 2404455 - protein, 17 aa, Entamoeba dispar
SHFFDIFFDFLFTHMSI

SEQ ID NO: 2404456 - protein, 40 aa, Entamoeba dispar
SHIEVWLIIFCVIILLIIIIVIIVLLIYIIKRVLGYRKEE

SEQ ID NO: 2404457 - protein, 23 aa, Entamoeba dispar
SIDSFFIKLPQWISFLLQDDSYK

SEQ ID NO: 2404458 - protein, 17 aa, Entamoeba dispar
SIEFKKCYYFGEDGSMY

SEQ ID NO: 2404459 - protein, 17 aa, Entamoeba dispar
SIFFPFLTEFLLFILNK

SEQ ID NO: 2404460 - protein, 30 aa, Entamoeba dispar
SIIFTTLILFLIFVCIIIGILFIIQPDYTC

SEQ ID NO: 2404461 - protein, 20 aa, Entamoeba dispar
SIIPFTRFLRVFLPYTLVNR

SEQ ID NO: 2404462 - protein, 35 aa, Entamoeba dispar
SIIPIILIYPNPFMFIVWFIPQWIKSLKRIGIIKE

SEQ ID NO: 2404463 - protein, 22 aa, Entamoeba dispar
SIIQLILFIVFVNRINGLSICY

SEQ ID NO: 2404464 - protein, 18 aa, Entamoeba dispar
SILFFVIFYFIIAPSDVT

SEQ ID NO: 2404465 - protein, 22 aa, Entamoeba dispar
SILIIGIIVLTLIFVILCIVKA

SEQ ID NO: 2404466 - protein, 24 aa, Entamoeba dispar
SIPLLPLLLPLFKILPIQSFAILL

SEQ ID NO: 2404467 - protein, 23 aa, Entamoeba dispar
SISLFFMTLYIKPLAEFGGYDMP

SEQ ID NO: 2404468 - protein, 23 aa, Entamoeba dispar
SIVKFFRILFFRTSMPQLLKGRK

SEQ ID NO: 2404469 - protein, 18 aa, Entamoeba dispar
SIVLYEIWKWDKAYPTEE

SEQ ID NO: 2404470 - protein, 32 aa, Entamoeba dispar
SIVYALYYIFSLIFFLLLYVRLTKKIKQEIDE

SEQ ID NO: 2404471 - protein, 19 aa, Entamoeba dispar
SIYCINLPGLSKSVGLNHV

SEQ ID NO: 2404472 - protein, 27 aa, Entamoeba dispar
SIYICSALCLFLLTVLIFASYKRVKRI

SEQ ID NO: 2404473 - protein, 24 aa, Entamoeba dispar
SKDYYYWIDLIGIVLPFTVSIKQT

SEQ ID NO: 2404474 - protein, 20 aa, Entamoeba dispar
SKILLYISLVFIASPWKQLI

SEQ ID NO: 2404475 - protein, 21 aa, Entamoeba dispar
SKNIYLIPYLKLFLNFEPTQP

SEQ ID NO: 2404476 - protein, 24 aa, Entamoeba dispar
SKSFVSFPPLFWVVRDYALDERTE

SEQ ID NO: 2404477 - protein, 27 aa, Entamoeba dispar
SKTNWALIIPLIIVAVIIIIIILIVII

SEQ ID NO: 2404478 - protein, 26 aa, Entamoeba dispar
SKTNWALIIPLIIVGIIIIIVIISII

SEQ ID NO: 2404479 - protein, 24 aa, Entamoeba dispar
SLEYFIYILLFYTISFKLIGFIVI

SEQ ID NO: 2404480 - protein, 20 aa, Entamoeba dispar
SLFLLFSLLSLGLSASMCLG

SEQ ID NO: 2404481 - protein, 23 aa, Entamoeba dispar
SLFPLYFMDFFISPKLHYLMFSN

SEQ ID NO: 2404482 - protein, 22 aa, Entamoeba dispar
SLIFICIGIYLFFKIKTLQPTQ

SEQ ID NO: 2404483 - protein, 18 aa, Entamoeba dispar
SLIIVLILALIIGIVLYI

SEQ ID NO: 2404484 - protein, 23 aa, Entamoeba dispar
SLIKNPMIIMALVSLGLIGFSKL

SEQ ID NO: 2404485 - protein, 27 aa, Entamoeba dispar
SLKTSIFLFLFVELKFIVIFIFDYCFN

SEQ ID NO: 2404486 - protein, 31 aa, Entamoeba dispar
SLLFDSFYILRQLWYISLFLTPLGIKVCIKL

SEQ ID NO: 2404487 - protein, 20 aa, Entamoeba dispar
SLLLMFIPKPIFLYIKLRKQ

SEQ ID NO: 2404488 - protein, 17 aa, Entamoeba dispar
SLLYIRILIVIMLLCHI

SEQ ID NO: 2404489 - protein, 25 aa, Entamoeba dispar
SLTMRFFIMLRIYLSKYIKELPIFD

SEQ ID NO: 2404490 - protein, 24 aa, Entamoeba dispar
SLVEPIYFFHTLSPYYKTILNCIE

SEQ ID NO: 2404491 - protein, 19 aa, Entamoeba dispar
SLYITNECRLIFSVLPSIS

SEQ ID NO: 2404492 - protein, 25 aa, Entamoeba dispar
SPFILKFLFFIIFAVVIGGVIFFIF

SEQ ID NO: 2404493 - protein, 22 aa, Entamoeba dispar
SPNLIFKILLFTMKFNGNYSIR

SEQ ID NO: 2404494 - protein, 18 aa, Entamoeba dispar
SPQIFQLFYLAVQKFTLP

SEQ ID NO: 2404495 - protein, 18 aa, Entamoeba dispar
SQLKWYFSIFTKILEKLK

SEQ ID NO: 2404496 - protein, 24 aa, Entamoeba dispar
SQNSFLRMYFPTVLNWMIGGVVGQ

SEQ ID NO: 2404497 - protein, 28 aa, Entamoeba dispar
SQSFLIIKMIWFIILKRLQDWTVNSSSQ

SEQ ID NO: 2404498 - protein, 23 aa, Entamoeba dispar
SRNKWMMIIFHTPNNPKYVFYFE

SEQ ID NO: 2404499 - protein, 18 aa, Entamoeba dispar
SSILILVIFFTNNSIIIP

SEQ ID NO: 2404500 - protein, 21 aa, Entamoeba dispar
SSKLMCIILIVVAIIMIIVVA

SEQ ID NO: 2404501 - protein, 24 aa, Entamoeba dispar
SSLPFSLFLFFLSLPSLLYGLLHL

SEQ ID NO: 2404502 - protein, 21 aa, Entamoeba dispar
SSLYRFILLFCLFTCYKRIKR

SEQ ID NO: 2404503 - protein, 24 aa, Entamoeba dispar
SSSLWMRVPLYLLQDYPRQSRKLS

SEQ ID NO: 2404504 - protein, 18 aa, Entamoeba dispar
STEIIPFYSLWATIFGGF

SEQ ID NO: 2404505 - protein, 24 aa, Entamoeba dispar
STFGQWDCLLYSPYLSLVINSDSI

SEQ ID NO: 2404506 - protein, 26 aa, Entamoeba dispar
STGLLFFFVFCAFWIGYIYGAKKIQK

SEQ ID NO: 2404507 - protein, 23 aa, Entamoeba dispar
STHLFMFSLLFWILGYIYINLNK

SEQ ID NO: 2404508 - protein, 25 aa, Entamoeba dispar
STHTLFWICFFLMQFCTVVLVLNLL

SEQ ID NO: 2404509 - protein, 24 aa, Entamoeba dispar
STILILFVLIIIITAWILSRKRKT

SEQ ID NO: 2404510 - protein, 24 aa, Entamoeba dispar
STPTFIYAIAFLLQILTGYFIYII

SEQ ID NO: 2404511 - protein, 19 aa, Entamoeba dispar
SVFYYLTMQPWRNLEWTSI

SEQ ID NO: 2404512 - protein, 24 aa, Entamoeba dispar
SVLSLFILYCSQFFIFDSRYQTLM

SEQ ID NO: 2404513 - protein, 23 aa, Entamoeba dispar
SYEGGPLPWYLNKGLYFTNITLR

SEQ ID NO: 2404514 - protein, 20 aa, Entamoeba dispar
SYETYYYDIELWYSLLAHSK

SEQ ID NO: 2404515 - protein, 26 aa, Entamoeba dispar
SYITFIFLFLCFIAYILIATLVLHRT

SEQ ID NO: 2404516 - protein, 17 aa, Entamoeba dispar
SYLLFFIGILLYIHCGY

SEQ ID NO: 2404517 - protein, 17 aa, Entamoeba dispar
SYPIWTNWWGENFHWRE

SEQ ID NO: 2404518 - protein, 27 aa, Entamoeba dispar
SYRNYIAYFYYFLPFNIMIDKEKHMYL

SEQ ID NO: 2404519 - protein, 22 aa, Entamoeba dispar
SYVMILMIMAFYFDVPLPIRHP

SEQ ID NO: 2404520 - protein, 21 aa, Entamoeba dispar
SYYLIIVVVLVLIAFFLFHKY

SEQ ID NO: 2404521 - protein, 23 aa, Entamoeba dispar
TAKKFYQMMYWIIGIPAVAVEYN

SEQ ID NO: 2404522 - protein, 19 aa, Entamoeba dispar
TALSRQLFLLLGGVETLIV

SEQ ID NO: 2404523 - protein, 22 aa, Entamoeba dispar
TASFLFILFYIVVLLLALPATP

SEQ ID NO: 2404524 - protein, 23 aa, Entamoeba dispar
TEHPFLISLFIKPTIEILFYYAT

SEQ ID NO: 2404525 - protein, 18 aa, Entamoeba dispar
TEKLFKETLFFFTADENA

SEQ ID NO: 2404526 - protein, 22 aa, Entamoeba dispar
TESFIPCIFILEKQLKKLNKKP

SEQ ID NO: 2404527 - protein, 29 aa, Entamoeba dispar
TETYNLTYIYLYCLFIEVIKFLKRRNEIF

SEQ ID NO: 2404528 - protein, 17 aa, Entamoeba dispar
TEYPFILYNLNTGGQGF

SEQ ID NO: 2404529 - protein, 17 aa, Entamoeba dispar
TFSNYIQYWVLGSTPRM

SEQ ID NO: 2404530 - protein, 19 aa, Entamoeba dispar
TIDTLIPCDYLSFGPGISV

SEQ ID NO: 2404531 - protein, 23 aa, Entamoeba dispar
TIFSIILPFILPYCFFSFIIILV

SEQ ID NO: 2404532 - protein, 17 aa, Entamoeba dispar
TIKIIIPLLPLLPEKLF

SEQ ID NO: 2404533 - protein, 28 aa, Entamoeba dispar
TINIIFYLSIFLIILMVLNLLKIKIIMY

SEQ ID NO: 2404534 - protein, 21 aa, Entamoeba dispar
TISLPFYFYSVRFLGKIFRSR

SEQ ID NO: 2404535 - protein, 22 aa, Entamoeba dispar
TIVFLLSLLYFSASVFHLLEGY

SEQ ID NO: 2404536 - protein, 22 aa, Entamoeba dispar
TIVLIIFIIWVLYIPSKSNTKN

SEQ ID NO: 2404537 - protein, 23 aa, Entamoeba dispar
TKIIYDMFLFLKLFKTFNIKRGN

SEQ ID NO: 2404538 - protein, 29 aa, Entamoeba dispar
TKIVYWFYYLLMILLFFFPKIFIPCPSNH

SEQ ID NO: 2404539 - protein, 24 aa, Entamoeba dispar
TKLISFLMYVLYSLGYSFVVRKPT

SEQ ID NO: 2404540 - protein, 22 aa, Entamoeba dispar
TLIAILIFLHKIMNLSFCVVST

SEQ ID NO: 2404541 - protein, 25 aa, Entamoeba dispar
TLIGYPFFIVYIIAAGLGIWIEGTF

SEQ ID NO: 2404542 - protein, 17 aa, Entamoeba dispar
TLIVLSFGRIDYWCDSV

SEQ ID NO: 2404543 - protein, 22 aa, Entamoeba dispar
TLKEIIVFLIKEFQHLFPENVS

SEQ ID NO: 2404544 - protein, 21 aa, Entamoeba dispar
TLLALTLIIIAIIYSLNKFGY

SEQ ID NO: 2404545 - protein, 21 aa, Entamoeba dispar
TLLLALLFSILSGLVIFILPK

SEQ ID NO: 2404546 - protein, 21 aa, Entamoeba dispar
TLLLCLLVSIIFYFIPIIIGY

SEQ ID NO: 2404547 - protein, 20 aa, Entamoeba dispar
TLLWYKFLPVNWELNQLDLT

SEQ ID NO: 2404548 - protein, 21 aa, Entamoeba dispar
TLSFFIIFTILLHYLYFLDWY

SEQ ID NO: 2404549 - protein, 21 aa, Entamoeba dispar
TLTKPFLFGVKHYKDFYAIQQ

SEQ ID NO: 2404550 - protein, 25 aa, Entamoeba dispar
TLVGIFYMYFYTLNIPLLPINDLES

SEQ ID NO: 2404551 - protein, 22 aa, Entamoeba dispar
TLVILCMFPFIMISMMGLGMSA

SEQ ID NO: 2404552 - protein, 26 aa, Entamoeba dispar
TLWFAIIIIVVVILLTLWQVRSLKAF

SEQ ID NO: 2404553 - protein, 23 aa, Entamoeba dispar
TMATLLIPVFPLLITPFLGVMNS

SEQ ID NO: 2404554 - protein, 25 aa, Entamoeba dispar
TNTYYPLFLSYIRFIIREKTEFLFQ

SEQ ID NO: 2404555 - protein, 35 aa, Entamoeba dispar
TNYIFIAVIPVWILFFILLFGYYILKVIVIRQAEE

SEQ ID NO: 2404556 - protein, 20 aa, Entamoeba dispar
TPKYIFYFEPQILIIKSKHK

SEQ ID NO: 2404557 - protein, 37 aa, Entamoeba dispar
TPLFIPSAFFLSKLFWVILGYFIIALAILTGILFGIL

SEQ ID NO: 2404558 - protein, 26 aa, Entamoeba dispar
TPRILIYRKLPLFNIPRFPYPLSYIP

SEQ ID NO: 2404559 - protein, 30 aa, Entamoeba dispar
TPSITFVLLFLFALVIIVILILYAHRREPK

SEQ ID NO: 2404560 - protein, 24 aa, Entamoeba dispar
TPVYNFLCSYLLKTYKHQSKGLFI

SEQ ID NO: 2404561 - protein, 27 aa, Entamoeba dispar
TQAIYQLFVLLFLLYCGRYISFLNAPC

SEQ ID NO: 2404562 - protein, 19 aa, Entamoeba dispar
TRELWRSACSLLDYIKGIM

SEQ ID NO: 2404563 - protein, 18 aa, Entamoeba dispar
TRHKWLLISLYFVGIMVC

SEQ ID NO: 2404564 - protein, 29 aa, Entamoeba dispar
TRLKRAMWWKNIKLYLIAGAILLIFLLVL

SEQ ID NO: 2404565 - protein, 25 aa, Entamoeba dispar
TRNPTSFLFWFITLGVQGFTVFVLY

SEQ ID NO: 2404566 - protein, 22 aa, Entamoeba dispar
TRQYFFLDYLLDKQFSSLAYFW

SEQ ID NO: 2404567 - protein, 20 aa, Entamoeba dispar
TRVWVFFIFPVLISAYRCNP

SEQ ID NO: 2404568 - protein, 20 aa, Entamoeba dispar
TRYYYMIPHIFDRGNIILID

SEQ ID NO: 2404569 - protein, 24 aa, Entamoeba dispar
TSGLLVVLFIIYSLIKASHIGNLK

SEQ ID NO: 2404570 - protein, 33 aa, Entamoeba dispar
TSHKALFVILYGHALYLLLHLNAFPFKLIQRIS

SEQ ID NO: 2404571 - protein, 23 aa, Entamoeba dispar
TSPKEIFMFLKDPNKPILSRKVL

SEQ ID NO: 2404572 - protein, 23 aa, Entamoeba dispar
TSTPIIFNLCEWYSIIPEPDKHY

SEQ ID NO: 2404573 - protein, 17 aa, Entamoeba dispar
TSYFGLIEFYENYLETH

SEQ ID NO: 2404574 - protein, 25 aa, Entamoeba dispar
TTEAYLFTIIFFICSWYYQPGYYVP

SEQ ID NO: 2404575 - protein, 23 aa, Entamoeba dispar
TTIFFTFLLFLLSIFIYTIFLCC

SEQ ID NO: 2404576 - protein, 17 aa, Entamoeba dispar
TTLFFYLMSIVTAIWVL

SEQ ID NO: 2404577 - protein, 17 aa, Entamoeba dispar
TTLIMMKLPFLKQVKDL

SEQ ID NO: 2404578 - protein, 20 aa, Entamoeba dispar
TTLQYFAYRPLFEQGKLIIN

SEQ ID NO: 2404579 - protein, 23 aa, Entamoeba dispar
TVDLLFIIPYWRSYLTGLSSVHI

SEQ ID NO: 2404580 - protein, 29 aa, Entamoeba dispar
TVGLILILIFFIVLLIFVLRYKKVDINIY

SEQ ID NO: 2404581 - protein, 26 aa, Entamoeba dispar
TVIVLILFVLLFIFLSSFIKSKKVNI

SEQ ID NO: 2404582 - protein, 18 aa, Entamoeba dispar
TVKPIQVLPLYAALPPEQ

SEQ ID NO: 2404583 - protein, 21 aa, Entamoeba dispar
TVLQILVVLPEKDLYVLPNTQ

SEQ ID NO: 2404584 - protein, 29 aa, Entamoeba dispar
TWKSGVMMLIIFIVLFTALSIWNDVLNEM

SEQ ID NO: 2404585 - protein, 17 aa, Entamoeba dispar
TYCQKQPVVWFIVLICI

SEQ ID NO: 2404586 - protein, 29 aa, Entamoeba dispar
TYCTLWMILSMITFVLFGIVLTCCMFLST

SEQ ID NO: 2404587 - protein, 18 aa, Entamoeba dispar
TYVLLFIGLLTVGMSIVM

SEQ ID NO: 2404588 - protein, 19 aa, Entamoeba dispar
TYWHYFRAGGFIGLILCLM

SEQ ID NO: 2404589 - protein, 26 aa, Entamoeba dispar
VAVEYCWFFFDVIIKSLTLYLEELGI

SEQ ID NO: 2404590 - protein, 19 aa, Entamoeba dispar
VAYLPYLIKVIPNISALYI

SEQ ID NO: 2404591 - protein, 25 aa, Entamoeba dispar
VCCFLLFFIIIAIIGVLLAYYMKSK

SEQ ID NO: 2404592 - protein, 21 aa, Entamoeba dispar
VCICCWFLNLFQNKKTRIIYL

SEQ ID NO: 2404593 - protein, 18 aa, Entamoeba dispar
VCIILLCIITYWAFIPIG

SEQ ID NO: 2404594 - protein, 19 aa, Entamoeba dispar
VDCLFVVWIYWNKSNLKEW

SEQ ID NO: 2404595 - protein, 23 aa, Entamoeba dispar
VDIYSWIFFLPYSPDELIKSKFK

SEQ ID NO: 2404596 - protein, 17 aa, Entamoeba dispar
VELLYFYLCQYFSFILN

SEQ ID NO: 2404597 - protein, 25 aa, Entamoeba dispar
VFIGFIHKFLYPINPIFLTKRVTEP

SEQ ID NO: 2404598 - protein, 19 aa, Entamoeba dispar
VFIIYYYLEVLPLIKLKIF

SEQ ID NO: 2404599 - protein, 25 aa, Entamoeba dispar
VFIPLYIFLFIAFLFPLFTFIFFCS

SEQ ID NO: 2404600 - protein, 21 aa, Entamoeba dispar
VFLMIVTFLTWLFISRCWKNK

SEQ ID NO: 2404601 - protein, 19 aa, Entamoeba dispar
VFNYLMYLLKEIFNFIVIV

SEQ ID NO: 2404602 - protein, 19 aa, Entamoeba dispar
VFSLGFWWRVAIITLINSF

SEQ ID NO: 2404603 - protein, 20 aa, Entamoeba dispar
VFVWKVFYTSLIWVLKNIDK

SEQ ID NO: 2404604 - protein, 25 aa, Entamoeba dispar
VGILLILAIVLLAFIIYRKCTSKND

SEQ ID NO: 2404605 - protein, 28 aa, Entamoeba dispar
VGLIIIIALILLVAFILYAKLVLLKNRK

SEQ ID NO: 2404606 - protein, 32 aa, Entamoeba dispar
VGVIIVIIIILFIVFIVVARMFLLRRKNNKVF

SEQ ID NO: 2404607 - protein, 23 aa, Entamoeba dispar
VGYTIWIILTIFYFCLTWSYFNR

SEQ ID NO: 2404608 - protein, 26 aa, Entamoeba dispar
VHSKTPMWLILLIAFLSFDNIVYVLK

SEQ ID NO: 2404609 - protein, 27 aa, Entamoeba dispar
VHTFSRLIYPFIWQHVLIPILPPDMLS

SEQ ID NO: 2404610 - protein, 23 aa, Entamoeba dispar
VIALFFLIFYWAGLFFVICFWIM

SEQ ID NO: 2404611 - protein, 24 aa, Entamoeba dispar
VIFSLPEFPFMWGYCWFTTILSYL

SEQ ID NO: 2404612 - protein, 17 aa, Entamoeba dispar
VIKQYCMLLLPKDFDNY

SEQ ID NO: 2404613 - protein, 19 aa, Entamoeba dispar
VILAILAIIFIVLVDYLMV

SEQ ID NO: 2404614 - protein, 20 aa, Entamoeba dispar
VILCIILWIFVFINKTEAMN

SEQ ID NO: 2404615 - protein, 18 aa, Entamoeba dispar
VILIIAGVVVLSWYFIKK

SEQ ID NO: 2404616 - protein, 19 aa, Entamoeba dispar
VILLVIIITLISIGWCSRK

SEQ ID NO: 2404617 - protein, 25 aa, Entamoeba dispar
VIPFWILWSGLIVLNLFILIVTITS

SEQ ID NO: 2404618 - protein, 20 aa, Entamoeba dispar
VIQLMHFFPVIMSNLFGMFN

SEQ ID NO: 2404619 - protein, 25 aa, Entamoeba dispar
VITVMILTTIIIIGLMYLINVESNY

SEQ ID NO: 2404620 - protein, 17 aa, Entamoeba dispar
VIVIFWILAVIGFAYPA

SEQ ID NO: 2404621 - protein, 21 aa, Entamoeba dispar
VIVTLIVLVIGLIFCVKKKHH

SEQ ID NO: 2404622 - protein, 21 aa, Entamoeba dispar
VIYLLVIFLGVSFGLITLLYT

SEQ ID NO: 2404623 - protein, 23 aa, Entamoeba dispar
VKKTLFYIIIATIVFIPICISFH

SEQ ID NO: 2404624 - protein, 23 aa, Entamoeba dispar
VKVGWIIFGVVFFLIFVSIFAFI

SEQ ID NO: 2404625 - protein, 23 aa, Entamoeba dispar
VLCLFFWFLRLYSVFNWALEQHL

SEQ ID NO: 2404626 - protein, 25 aa, Entamoeba dispar
VLGWVHAFIFWKYSVLMYFAGQELK

SEQ ID NO: 2404627 - protein, 23 aa, Entamoeba dispar
VLHYILDLPIIALLLTIIPPGTV

SEQ ID NO: 2404628 - protein, 20 aa, Entamoeba dispar
VLIIIWWIIYILQFGLCYLI

SEQ ID NO: 2404629 - protein, 19 aa, Entamoeba dispar
VLLCFFIAFLIMKFTRMNF

SEQ ID NO: 2404630 - protein, 17 aa, Entamoeba dispar
VLNEFNLLILKSGSKQT

SEQ ID NO: 2404631 - protein, 19 aa, Entamoeba dispar
VLTIIFVGGLYYANCILDP

SEQ ID NO: 2404632 - protein, 26 aa, Entamoeba dispar
VLTVITIIILLVFIRIIIGKATKYSQ

SEQ ID NO: 2404633 - protein, 22 aa, Entamoeba dispar
VLYSIIQLYLRSGFYGRVLDYH

SEQ ID NO: 2404634 - protein, 25 aa, Entamoeba dispar
VMIKFLLIYFVVLLIILGGIKLILE

SEQ ID NO: 2404635 - protein, 26 aa, Entamoeba dispar
VMKYSWILFTILFKGIVMMINSGKKL

SEQ ID NO: 2404636 - protein, 18 aa, Entamoeba dispar
VMTPLFPPVMRLFNYLDQ

SEQ ID NO: 2404637 - protein, 26 aa, Entamoeba dispar
VNLQFILFLQLPYTFSFPWLNAVIVY

SEQ ID NO: 2404638 - protein, 25 aa, Entamoeba dispar
VSCILVLLIIIIMTQLIGLSCIEIS

SEQ ID NO: 2404639 - protein, 18 aa, Entamoeba dispar
VSFFCYVGLFMAAGEKMI

SEQ ID NO: 2404640 - protein, 17 aa, Entamoeba dispar
VSFNFFIMYFAQTIMFG

SEQ ID NO: 2404641 - protein, 26 aa, Entamoeba dispar
VTEEWYYFILFIISFIPLLINGYCCS

SEQ ID NO: 2404642 - protein, 20 aa, Entamoeba dispar
VTFFGIIVYLFYPALPPEIY

SEQ ID NO: 2404643 - protein, 25 aa, Entamoeba dispar
VTIIFILMIIFYLLRRVYFPEEQQK

SEQ ID NO: 2404644 - protein, 31 aa, Entamoeba dispar
VTIILPIILLIFIGIIIICTIIIAGIILYKE

SEQ ID NO: 2404645 - protein, 17 aa, Entamoeba dispar
VTLVDYYRYSPLLWYRL

SEQ ID NO: 2404646 - protein, 17 aa, Entamoeba dispar
VVFFLIFVSIFAFIIGF

SEQ ID NO: 2404647 - protein, 32 aa, Entamoeba dispar
VVGLIIIIALILLVAFILYAKLVLLKNRKNNK

SEQ ID NO: 2404648 - protein, 27 aa, Entamoeba dispar
  misc_feature (25)..(26): Xaa can be any naturally occurring amino acid
VVIKSFLFYLIFLFHLIVSVSFLFXXS

SEQ ID NO: 2404649 - protein, 30 aa, Entamoeba dispar
VVLLLIIITIIVIFCIWFFKKPVEDKPQTY

SEQ ID NO: 2404650 - protein, 26 aa, Entamoeba dispar
VVLYCFVWVVVFIIFLRKHKRLTKMI

SEQ ID NO: 2404651 - protein, 20 aa, Entamoeba dispar
VVNAFDLILRKGIIGQIYNI

SEQ ID NO: 2404652 - protein, 23 aa, Entamoeba dispar
VVRLFGSYFLLLLNKIKPKELIE

SEQ ID NO: 2404653 - protein, 25 aa, Entamoeba dispar
VWSILILINIIVFLLSLHSSVFFET

SEQ ID NO: 2404654 - protein, 25 aa, Entamoeba dispar
VYIGNILFGLLIYLLDEFDKIKDVH

SEQ ID NO: 2404655 - protein, 18 aa, Entamoeba dispar
VYISLFKITFLKIKCIYL

SEQ ID NO: 2404656 - protein, 17 aa, Entamoeba dispar
WALIIKYMILLFPIVNL

SEQ ID NO: 2404657 - protein, 23 aa, Entamoeba dispar
WEVYFKWGLIIVNVIILVVGVLL

SEQ ID NO: 2404658 - protein, 23 aa, Entamoeba dispar
WEVYFKWGLIVVNVIILVVGVLL

SEQ ID NO: 2404659 - protein, 20 aa, Entamoeba dispar
WFIPIAIVGVILIISIVLFI

SEQ ID NO: 2404660 - protein, 36 aa, Entamoeba dispar
WGTLVIVYWIFFFILLFILILLYIKLTKKIKQEIDD

SEQ ID NO: 2404661 - protein, 17 aa, Entamoeba dispar
WIIIGVIAAIIIIVIIV

SEQ ID NO: 2404662 - protein, 18 aa, Entamoeba dispar
WILDIIIVEGWQLTLSIA

SEQ ID NO: 2404663 - protein, 20 aa, Entamoeba dispar
WIMICVIIGILLIVIAGIYL

SEQ ID NO: 2404664 - protein, 18 aa, Entamoeba dispar
WINYLVDQFFFRVLDRIY

SEQ ID NO: 2404665 - protein, 24 aa, Entamoeba dispar
WKTSFPLIFFFTLVFMSFTIFGTK

SEQ ID NO: 2404666 - protein, 27 aa, Entamoeba dispar
WLFTLKQPLFYLMIIISIVITVLPQTV

SEQ ID NO: 2404667 - protein, 17 aa, Entamoeba dispar
WLLLYLIIFLFSILSNG

SEQ ID NO: 2404668 - protein, 18 aa, Entamoeba dispar
WLLSYSFAIVIVTMLVTF

SEQ ID NO: 2404669 - protein, 24 aa, Entamoeba dispar
WQDEDIIFIFRIFTKLLSSKENYS

SEQ ID NO: 2404670 - protein, 27 aa, Entamoeba dispar
WSIFEGIVFLLWIISLLLLVITKKVRK

SEQ ID NO: 2404671 - protein, 29 aa, Entamoeba dispar
WSLILLWCSLILFEFLLIVLSIISFFSLV

SEQ ID NO: 2404672 - protein, 20 aa, Entamoeba dispar
WVYFTFVMVFFFISSFLLIG

SEQ ID NO: 2404673 - protein, 24 aa, Entamoeba dispar
WVYVPLIVFIVFLLLNIGFGFLNG

SEQ ID NO: 2404674 - protein, 19 aa, Entamoeba dispar
WWRITDLVDYFIIAVTIVV

SEQ ID NO: 2404675 - protein, 22 aa, Entamoeba dispar
WYFIPFFFFIQVILLSLHSLCF

SEQ ID NO: 2404676 - protein, 17 aa, Entamoeba dispar
WYVFSMIIFVFSVGGLV

SEQ ID NO: 2404677 - protein, 26 aa, Entamoeba dispar
WYYSYSLIIILLPLFIYLISFIIETD

SEQ ID NO: 2404678 - protein, 24 aa, Entamoeba dispar
YAHLKYFYLSLPSLLLTYIDFIIA

SEQ ID NO: 2404679 - protein, 17 aa, Entamoeba dispar
YAITMLQIITWKDPFPK

SEQ ID NO: 2404680 - protein, 18 aa, Entamoeba dispar
YASMFGCSIMRKLKSFNT

SEQ ID NO: 2404681 - protein, 28 aa, Entamoeba dispar
YCCSKSFIYLLPLILKKFPLLMNFQDGC

SEQ ID NO: 2404682 - protein, 29 aa, Entamoeba dispar
YCEIAPVWWLIVIIILLSITLLIIIITLT

SEQ ID NO: 2404683 - protein, 19 aa, Entamoeba dispar
YCLFYLQILFIIFTYFRAI

SEQ ID NO: 2404684 - protein, 17 aa, Entamoeba dispar
YCLYVFLLIALMFRFFQ

SEQ ID NO: 2404685 - protein, 17 aa, Entamoeba dispar
YCMLLLPKDFDNYEIEK

SEQ ID NO: 2404686 - protein, 25 aa, Entamoeba dispar
YCSNFSLPLWILTLIIIGAICCLGV

SEQ ID NO: 2404687 - protein, 17 aa, Entamoeba dispar
YDFLITELNWEEFIAKL

SEQ ID NO: 2404688 - protein, 19 aa, Entamoeba dispar
YDFLIVHIFPLITPLISLL

SEQ ID NO: 2404689 - protein, 26 aa, Entamoeba dispar
YDIESLYVIFFFILKNLKETTIQQWL

SEQ ID NO: 2404690 - protein, 25 aa, Entamoeba dispar
YDIETLYIIFFFILKNLKEETVQQW

SEQ ID NO: 2404691 - protein, 23 aa, Entamoeba dispar
YDNAIYFYVFPEELHILKYSKDF

SEQ ID NO: 2404692 - protein, 27 aa, Entamoeba dispar
YDSHSFIYFFIFFLDIFCIIQPQFLVR

SEQ ID NO: 2404693 - protein, 24 aa, Entamoeba dispar
YEIVLVIILIIFLIQYHLLNDKII

SEQ ID NO: 2404694 - protein, 20 aa, Entamoeba dispar
YEPYFKIYFFLISGILCCLN

SEQ ID NO: 2404695 - protein, 25 aa, Entamoeba dispar
YFEHSYLLVLLFFTILYDATYPFIY

SEQ ID NO: 2404696 - protein, 19 aa, Entamoeba dispar
YFIFPKLIKHWLFWYVFSM

SEQ ID NO: 2404697 - protein, 22 aa, Entamoeba dispar
YFIIFYLLLFIWIQPLQITIST

SEQ ID NO: 2404698 - protein, 17 aa, Entamoeba dispar
YFNKLISIILDWARYTK

SEQ ID NO: 2404699 - protein, 17 aa, Entamoeba dispar
YFRFVIFSVIMEAANMM

SEQ ID NO: 2404700 - protein, 17 aa, Entamoeba dispar
YFSIFTKILEKLKENII

SEQ ID NO: 2404701 - protein, 25 aa, Entamoeba dispar
YGNEGFLLMIFYYLGCTLTLRKIKK

SEQ ID NO: 2404702 - protein, 26 aa, Entamoeba dispar
YGNEGFLLMILYYLGCYITLSKLQKD

SEQ ID NO: 2404703 - protein, 31 aa, Entamoeba dispar
YGYIFVFILFFILLLPFLVIPVVIWMNKMGC

SEQ ID NO: 2404704 - protein, 23 aa, Entamoeba dispar
YHDLSHYPIFPWIIQDYTSISLD

SEQ ID NO: 2404705 - protein, 19 aa, Entamoeba dispar
YHGLLRGMWFKFTATQSTH

SEQ ID NO: 2404706 - protein, 20 aa, Entamoeba dispar
YIAYFGSLIFYFGWGFVYGL

SEQ ID NO: 2404707 - protein, 22 aa, Entamoeba dispar
YIFGQWGFLILYIISKGGKVEI

SEQ ID NO: 2404708 - protein, 17 aa, Entamoeba dispar
YIFWLIYILIRSFSDGI

SEQ ID NO: 2404709 - protein, 25 aa, Entamoeba dispar
YIIVGMIVFLIIFIGIWSYCGIRFQ

SEQ ID NO: 2404710 - protein, 23 aa, Entamoeba dispar
YILAFFFIFPMRLGQIITALNQR

SEQ ID NO: 2404711 - protein, 24 aa, Entamoeba dispar
YILHSIPFLIFYPTLYLAIAYPML

SEQ ID NO: 2404712 - protein, 18 aa, Entamoeba dispar
YINGLLLLKVMLLKCSFT

SEQ ID NO: 2404713 - protein, 20 aa, Entamoeba dispar
YIPHLCALSLLFYAPTTVHG

SEQ ID NO: 2404714 - protein, 19 aa, Entamoeba dispar
YIQLFLPIILLMGKTALPQ

SEQ ID NO: 2404715 - protein, 36 aa, Entamoeba dispar
YISIYIHLMIYILEFLLLFILLFVCAKSNRIFKMEF

SEQ ID NO: 2404716 - protein, 17 aa, Entamoeba dispar
YIVFFFIFVICAFSNQY

SEQ ID NO: 2404717 - protein, 22 aa, Entamoeba dispar
YIVFVLYCWYYSYSLIIILLPL

SEQ ID NO: 2404718 - protein, 18 aa, Entamoeba dispar
YIVHFYGAVFIPKKICMV

SEQ ID NO: 2404719 - protein, 18 aa, Entamoeba dispar
YKILIIILFFLETVTQNN

SEQ ID NO: 2404720 - protein, 25 aa, Entamoeba dispar
YKNASFFLILFWYSFFNGQSGMSMY

SEQ ID NO: 2404721 - protein, 24 aa, Entamoeba dispar
YKNQLIHSFPLLMKLMLQLFNNEI

SEQ ID NO: 2404722 - protein, 24 aa, Entamoeba dispar
YKWKEMFLNFDLIQKLWKITGIIM

SEQ ID NO: 2404723 - protein, 17 aa, Entamoeba dispar
YKYWHHWALINFEIVSY

SEQ ID NO: 2404724 - protein, 20 aa, Entamoeba dispar
YLFILITLWLYFNTHRISII

SEQ ID NO: 2404725 - protein, 19 aa, Entamoeba dispar
YLFILKQPHLLILFDSISS

SEQ ID NO: 2404726 - protein, 17 aa, Entamoeba dispar
YLIGFSIGGLIVSRIAS

SEQ ID NO: 2404727 - protein, 24 aa, Entamoeba dispar
YLKQYWPEILWRWYVKKGMYEESI

SEQ ID NO: 2404728 - protein, 26 aa, Entamoeba dispar
YLLILLWISFFIYIMYIIALTMMSFF

SEQ ID NO: 2404729 - protein, 34 aa, Entamoeba dispar
YLNIKLFIIVPTHNDFLFISLLQNGTTALDNTLI

SEQ ID NO: 2404730 - protein, 19 aa, Entamoeba dispar
YLNIMHLLPQTFRINYLSN

SEQ ID NO: 2404731 - protein, 35 aa, Entamoeba dispar
YLSSIIIFYIFFWIALLIIHYFIYIKLNKIIMKEL

SEQ ID NO: 2404732 - protein, 25 aa, Entamoeba dispar
YLVDQFFFRVLDRIYFIIGIIICAL

SEQ ID NO: 2404733 - protein, 21 aa, Entamoeba dispar
YLYYYLFILFTVITTGLNCII

SEQ ID NO: 2404734 - protein, 26 aa, Entamoeba dispar
YMAENLFFYFKFPNLNSLPLNFSSET

SEQ ID NO: 2404735 - protein, 19 aa, Entamoeba dispar
YMALTFYKNTKYYLFIQSE

SEQ ID NO: 2404736 - protein, 17 aa, Entamoeba dispar
YNPAFVMPLFRKTIIRL

SEQ ID NO: 2404737 - protein, 25 aa, Entamoeba dispar
YNPVPLLYYFILQLIAVIFTLLKSI

SEQ ID NO: 2404738 - protein, 26 aa, Entamoeba dispar
YQLRPRYLFIPFIKLFDSLVFKKIKE

SEQ ID NO: 2404739 - protein, 17 aa, Entamoeba dispar
YQQFQILTQLFISPLRN

SEQ ID NO: 2404740 - protein, 26 aa, Entamoeba dispar
YQSLIFFFVFFWFISPSDIIGKDGLN

SEQ ID NO: 2404741 - protein, 26 aa, Entamoeba dispar
YQYIIWGYFIFTTLCAYFSLIFKRKE

SEQ ID NO: 2404742 - protein, 24 aa, Entamoeba dispar
YRDMFRFIIFFIKQKLGKIDAKET

SEQ ID NO: 2404743 - protein, 17 aa, Entamoeba dispar
YRGYLCILFIAFSNFVY

SEQ ID NO: 2404744 - protein, 20 aa, Entamoeba dispar
YRYFFLFLFYLWISMLIVDC

SEQ ID NO: 2404745 - protein, 23 aa, Entamoeba dispar
YSCYILPFLFFLGFVYSLGSLYI

SEQ ID NO: 2404746 - protein, 24 aa, Entamoeba dispar
YSGPFMFFLHYFLLLISCFLNFIW

SEQ ID NO: 2404747 - protein, 25 aa, Entamoeba dispar
YSIVPFILLLPFYQAQTLHGKAIRS

SEQ ID NO: 2404748 - protein, 20 aa, Entamoeba dispar
YSKELYLFWLFNVGNRKTKE

SEQ ID NO: 2404749 - protein, 18 aa, Entamoeba dispar
YSKFLWKFKWIILAVVVL

SEQ ID NO: 2404750 - protein, 26 aa, Entamoeba dispar
YSTKLLVLAIFLPGLGIYIFFVLVLS

SEQ ID NO: 2404751 - protein, 17 aa, Entamoeba dispar
YTFILCTFLFVLTILIL

SEQ ID NO: 2404752 - protein, 25 aa, Entamoeba dispar
YTIIGLFVLFAYTGNILIPCDFINS

SEQ ID NO: 2404753 - protein, 17 aa, Entamoeba dispar
YTIITPLVDLLVTLSNW

SEQ ID NO: 2404754 - protein, 24 aa, Entamoeba dispar
YTTLTFFGIFAEFITALTLAARVE

SEQ ID NO: 2404755 - protein, 23 aa, Entamoeba dispar
YTYCLLHFFLYIGMIFCNYNYFN

SEQ ID NO: 2404756 - protein, 17 aa, Entamoeba dispar
YVEPLLNILLPKLEESI

SEQ ID NO: 2404757 - protein, 19 aa, Entamoeba dispar
YVKLYFRYLDRYLFNYILH

SEQ ID NO: 2404758 - protein, 23 aa, Entamoeba dispar
YVLPFFLGLFLTATAFFGAYTFA

SEQ ID NO: 2404759 - protein, 26 aa, Entamoeba dispar
YVMVAIFVILILYLSFFKSKKSTVTK

SEQ ID NO: 2404760 - protein, 24 aa, Entamoeba dispar
YVQHNYFILYFTVIWIGIHVKSIV

SEQ ID NO: 2404761 - protein, 20 aa, Entamoeba dispar
YVYQYLLKQFTLLSEFLFDD

SEQ ID NO: 2404762 - protein, 18 aa, Entamoeba dispar
YWHHWALINFEIVSYIEL

SEQ ID NO: 2404763 - protein, 17 aa, Entamoeba dispar
YWHYFRAGGFIGLILCL

SEQ ID NO: 2404764 - protein, 23 aa, Entamoeba dispar
YWIPRIIFFLFFFAAVELVFVYN

SEQ ID NO: 2404765 - protein, 18 aa, Entamoeba dispar
YYDIELWYSLLAHSKVPF

SEQ ID NO: 2404766 - protein, 17 aa, Entamoeba dispar
YYDYLSLLSIESFCLII

SEQ ID NO: 2404767 - protein, 24 aa, Entamoeba dispar
YYFITVFIVFLFSFSINFFLTNAI

SEQ ID NO: 2404768 - protein, 17 aa, Entamoeba dispar
YYIFLFLSIEVVGEYCD

SEQ ID NO: 2404769 - protein, 18 aa, Entamoeba dispar
YYQLFQFLVLIASIIQTF

SEQ ID NO: 2404770 - protein, 26 aa, Entamoeba dispar
YYYMMIMDMILLLIRLLQEKEFEDEC

SEQ ID NO: 2404771 - protein, 7 aa, Entamoeba dispar
KNIEKKD

SEQ ID NO: 2404772 - protein, 4 aa, Entamoeba dispar
DEIF

SEQ ID NO: 2404773 - protein, 4 aa, Entamoeba dispar
INIP

SEQ ID NO: 2404774 - protein, 6 aa, Entamoeba dispar
NIPSSI

SEQ ID NO: 2404775 - protein, 5 aa, Entamoeba dispar
IPSSI

SEQ ID NO: 2404776 - protein, 10 aa, Entamoeba dispar
ADKSKGGVGK

SEQ ID NO: 2404777 - protein, 19 aa, Entamoeba dispar
NGTSQGNERRIENSTKLGR

SEQ ID NO: 2404778 - protein, 11 aa, Entamoeba dispar
AQIGKEAPEFK

SEQ ID NO: 2404779 - protein, 4 aa, Entamoeba dispar
SITS

SEQ ID NO: 2404780 - protein, 6 aa, Entamoeba dispar
SSITSF

SEQ ID NO: 2404781 - protein, 11 aa, Entamoeba dispar
KEVEKKGENER

SEQ ID NO: 2404782 - protein, 5 aa, Entamoeba dispar
TGVSR

SEQ ID NO: 2404783 - protein, 6 aa, Entamoeba dispar
VIKEDT

SEQ ID NO: 2404784 - protein, 6 aa, Entamoeba dispar
GDVPSN

SEQ ID NO: 2404785 - protein, 17 aa, Entamoeba dispar
KYGNDLTAQAESGKMDP

SEQ ID NO: 2404786 - protein, 9 aa, Entamoeba dispar
LQEKEQGNI

SEQ ID NO: 2404787 - protein, 4 aa, Entamoeba dispar
NSGI

SEQ ID NO: 2404788 - protein, 11 aa, Entamoeba dispar
NTNKDIEIETD

SEQ ID NO: 2404789 - protein, 7 aa, Entamoeba dispar
EKDPAFE

SEQ ID NO: 2404790 - protein, 8 aa, Entamoeba dispar
EPGVGKTA

SEQ ID NO: 2404791 - protein, 5 aa, Entamoeba dispar
EPTAA

SEQ ID NO: 2404792 - protein, 4 aa, Entamoeba dispar
IPTS

SEQ ID NO: 2404793 - protein, 20 aa, Entamoeba dispar
ITEMRKGQSVETKEAESQYE

SEQ ID NO: 2404794 - protein, 6 aa, Entamoeba dispar
KEEEKK

SEQ ID NO: 2404795 - protein, 4 aa, Entamoeba dispar
KYEN

SEQ ID NO: 2404796 - protein, 4 aa, Entamoeba dispar
PSSI

SEQ ID NO: 2404797 - protein, 9 aa, Entamoeba dispar
PTKTGKTEF

SEQ ID NO: 2404798 - protein, 4 aa, Entamoeba dispar
PTTQ

SEQ ID NO: 2404799 - protein, 9 aa, Entamoeba dispar
QTGSGKTTL

SEQ ID NO: 2404800 - protein, 4 aa, Entamoeba dispar
RDEE

SEQ ID NO: 2404801 - protein, 4 aa, Entamoeba dispar
RRKP

SEQ ID NO: 2404802 - protein, 6 aa, Entamoeba dispar
RTKNNP

SEQ ID NO: 2404803 - protein, 8 aa, Entamoeba dispar
RTKRTPPI

SEQ ID NO: 2404804 - protein, 11 aa, Entamoeba dispar
DIKESDEDHNK

SEQ ID NO: 2404805 - protein, 11 aa, Entamoeba dispar
EKELSENKEKL

SEQ ID NO: 2404806 - protein, 12 aa, Entamoeba dispar
GRLTDGRGRTVD

SEQ ID NO: 2404807 - protein, 10 aa, Entamoeba dispar
HKAESTKDLE

SEQ ID NO: 2404808 - protein, 4 aa, Entamoeba dispar
KAHP

SEQ ID NO: 2404809 - protein, 8 aa, Entamoeba dispar
KNTEITGK

SEQ ID NO: 2404810 - protein, 8 aa, Entamoeba dispar
LERRETQL

SEQ ID NO: 2404811 - protein, 9 aa, Entamoeba dispar
LKEKEQGNI

SEQ ID NO: 2404812 - protein, 11 aa, Entamoeba dispar
NDQGNRTTPSY

SEQ ID NO: 2404813 - protein, 10 aa, Entamoeba dispar
QKNSQPEEID

SEQ ID NO: 2404814 - protein, 5 aa, Entamoeba dispar
SEKEL

SEQ ID NO: 2404815 - protein, 5 aa, Entamoeba dispar
VKESK

SEQ ID NO: 2404816 - protein, 10 aa, Entamoeba dispar
AGATGEGAMD

SEQ ID NO: 2404817 - protein, 11 aa, Entamoeba dispar
DGIGRSTEETI

SEQ ID NO: 2404818 - protein, 8 aa, Entamoeba dispar
ESNNEQNI

SEQ ID NO: 2404819 - protein, 18 aa, Entamoeba dispar
GAPPGYVGYEEGGQLTEA

SEQ ID NO: 2404820 - protein, 9 aa, Entamoeba dispar
GDAAKNQIG

SEQ ID NO: 2404821 - protein, 7 aa, Entamoeba dispar
KECQEKE

SEQ ID NO: 2404822 - protein, 6 aa, Entamoeba dispar
KQPQEK

SEQ ID NO: 2404823 - protein, 7 aa, Entamoeba dispar
QYRGQFE

SEQ ID NO: 2404824 - protein, 4 aa, Entamoeba dispar
SKEN

SEQ ID NO: 2404825 - protein, 13 aa, Entamoeba dispar
YEKEKGGSEEMKE

SEQ ID NO: 2404826 - protein, 4 aa, Entamoeba dispar
DKTW

SEQ ID NO: 2404827 - protein, 8 aa, Entamoeba dispar
GQNEAVTA

SEQ ID NO: 2404828 - protein, 9 aa, Entamoeba dispar
KRTNTEIPN

SEQ ID NO: 2404829 - protein, 4 aa, Entamoeba dispar
NEET

SEQ ID NO: 2404830 - protein, 4 aa, Entamoeba dispar
PTQI

SEQ ID NO: 2404831 - protein, 8 aa, Entamoeba dispar
SGVGKTEL

SEQ ID NO: 2404832 - protein, 14 aa, Entamoeba dispar
SRGGLGNEKRPTGS

SEQ ID NO: 2404833 - protein, 4 aa, Entamoeba dispar
SSIN

SEQ ID NO: 2404834 - protein, 6 aa, Entamoeba dispar
STISKI

SEQ ID NO: 2404835 - protein, 8 aa, Entamoeba dispar
VQNPPPVD

SEQ ID NO: 2404836 - protein, 6 aa, Entamoeba dispar
AGQERF

SEQ ID NO: 2404837 - protein, 7 aa, Entamoeba dispar
DDGHDKP

SEQ ID NO: 2404838 - protein, 7 aa, Entamoeba dispar
KKDTTEI

SEQ ID NO: 2404839 - protein, 11 aa, Entamoeba dispar
KVNQGNREKEI

SEQ ID NO: 2404840 - protein, 13 aa, Entamoeba dispar
NDKKNVKIRKENI

SEQ ID NO: 2404841 - protein, 5 aa, Entamoeba dispar
NEYER

SEQ ID NO: 2404842 - protein, 9 aa, Entamoeba dispar
NSNSSDEYV

SEQ ID NO: 2404843 - protein, 10 aa, Entamoeba dispar
NTPIEEIQNN

SEQ ID NO: 2404844 - protein, 18 aa, Entamoeba dispar
PEAEKRMKELKEQNKETT

SEQ ID NO: 2404845 - protein, 6 aa, Entamoeba dispar
RFTPEE

SEQ ID NO: 2404846 - protein, 6 aa, Entamoeba dispar
SEPSIQ

SEQ ID NO: 2404847 - protein, 17 aa, Entamoeba dispar
SESTDKKRKSVSNEIKE

SEQ ID NO: 2404848 - protein, 5 aa, Entamoeba dispar
SSISE

SEQ ID NO: 2404849 - protein, 7 aa, Entamoeba dispar
TKSNEYE

SEQ ID NO: 2404850 - protein, 5 aa, Entamoeba dispar
TPPPL

SEQ ID NO: 2404851 - protein, 5 aa, Entamoeba dispar
TYNLK

SEQ ID NO: 2404852 - protein, 6 aa, Entamoeba dispar
AKTKEV

SEQ ID NO: 2404853 - protein, 5 aa, Entamoeba dispar
ATQLT

SEQ ID NO: 2404854 - protein, 14 aa, Entamoeba dispar
DSQRQATKDAGTIA

SEQ ID NO: 2404855 - protein, 12 aa, Entamoeba dispar
EKMNRNESKYQS

SEQ ID NO: 2404856 - protein, 6 aa, Entamoeba dispar
ENEEEQ

SEQ ID NO: 2404857 - protein, 9 aa, Entamoeba dispar
ESTPDEQKE

SEQ ID NO: 2404858 - protein, 4 aa, Entamoeba dispar
GAVG

SEQ ID NO: 2404859 - protein, 4 aa, Entamoeba dispar
GNEE

SEQ ID NO: 2404860 - protein, 8 aa, Entamoeba dispar
GPPGTGKT

SEQ ID NO: 2404861 - protein, 7 aa, Entamoeba dispar
GVSSSEK

SEQ ID NO: 2404862 - protein, 6 aa, Entamoeba dispar
IPSSIS

SEQ ID NO: 2404863 - protein, 5 aa, Entamoeba dispar
IPTEE

SEQ ID NO: 2404864 - protein, 5 aa, Entamoeba dispar
IPTSV

SEQ ID NO: 2404865 - protein, 6 aa, Entamoeba dispar
IQNIPE

SEQ ID NO: 2404866 - protein, 11 aa, Entamoeba dispar
KGTMKRKGKEI

SEQ ID NO: 2404867 - protein, 6 aa, Entamoeba dispar
KMPGAP

SEQ ID NO: 2404868 - protein, 8 aa, Entamoeba dispar
KQKRMGDS

SEQ ID NO: 2404869 - protein, 5 aa, Entamoeba dispar
KRIAG

SEQ ID NO: 2404870 - protein, 8 aa, Entamoeba dispar
MAKEGKDC

SEQ ID NO: 2404871 - protein, 5 aa, Entamoeba dispar
NIPSS

SEQ ID NO: 2404872 - protein, 8 aa, Entamoeba dispar
NIPSSVSK

SEQ ID NO: 2404873 - protein, 11 aa, Entamoeba dispar
NNIPKGITENN

SEQ ID NO: 2404874 - protein, 10 aa, Entamoeba dispar
QEREETIDET

SEQ ID NO: 2404875 - protein, 6 aa, Entamoeba dispar
SISSTP

SEQ ID NO: 2404876 - protein, 4 aa, Entamoeba dispar
SSIS

SEQ ID NO: 2404877 - protein, 4 aa, Entamoeba dispar
SSIT

SEQ ID NO: 2404878 - protein, 9 aa, Entamoeba dispar
SYTSRTGDI

SEQ ID NO: 2404879 - protein, 4 aa, Entamoeba dispar
TLEE

SEQ ID NO: 2404880 - protein, 5 aa, Entamoeba dispar
TRNEE

SEQ ID NO: 2404881 - protein, 7 aa, Entamoeba dispar
TSNSINQ

SEQ ID NO: 2404882 - protein, 4 aa, Entamoeba dispar
VSET

SEQ ID NO: 2404883 - protein, 8 aa, Entamoeba dispar
WKDEEKSI

SEQ ID NO: 2404884 - protein, 5 aa, Entamoeba dispar
DEDSF

SEQ ID NO: 2404885 - protein, 4 aa, Entamoeba dispar
DGEV

SEQ ID NO: 2404886 - protein, 20 aa, Entamoeba dispar
DKQNQNQNEEERKEKEEEIT

SEQ ID NO: 2404887 - protein, 8 aa, Entamoeba dispar
ECNIPETK

SEQ ID NO: 2404888 - protein, 7 aa, Entamoeba dispar
ERETGRL

SEQ ID NO: 2404889 - protein, 11 aa, Entamoeba dispar
ETEGQVSRKVK

SEQ ID NO: 2404890 - protein, 9 aa, Entamoeba dispar
ETKQQTAQE

SEQ ID NO: 2404891 - protein, 4 aa, Entamoeba dispar
FDEG

SEQ ID NO: 2404892 - protein, 7 aa, Entamoeba dispar
FTTTAER

SEQ ID NO: 2404893 - protein, 10 aa, Entamoeba dispar
GIPPAPRGVP

SEQ ID NO: 2404894 - protein, 19 aa, Entamoeba dispar
GPYQVSSYSSAVSRAYYPG

SEQ ID NO: 2404895 - protein, 6 aa, Entamoeba dispar
GSYNKI

SEQ ID NO: 2404896 - protein, 19 aa, Entamoeba dispar
IKEMGDKISSEDKKKAEEI

SEQ ID NO: 2404897 - protein, 5 aa, Entamoeba dispar
ITPTS

SEQ ID NO: 2404898 - protein, 22 aa, Entamoeba dispar
KDYEELERKETDSHRSSGFETI

SEQ ID NO: 2404899 - protein, 6 aa, Entamoeba dispar
KETAET

SEQ ID NO: 2404900 - protein, 6 aa, Entamoeba dispar
KLGGNM

SEQ ID NO: 2404901 - protein, 7 aa, Entamoeba dispar
KQSQSKL

SEQ ID NO: 2404902 - protein, 7 aa, Entamoeba dispar
KSIESEK

SEQ ID NO: 2404903 - protein, 8 aa, Entamoeba dispar
MQQRDSTN

SEQ ID NO: 2404904 - protein, 22 aa, Entamoeba dispar
NEEMQKAASSSELEKSYELPDG

SEQ ID NO: 2404905 - protein, 9 aa, Entamoeba dispar
NIKKEKDKI

SEQ ID NO: 2404906 - protein, 6 aa, Entamoeba dispar
NKIQID

SEQ ID NO: 2404907 - protein, 6 aa, Entamoeba dispar
NQTATC

SEQ ID NO: 2404908 - protein, 13 aa, Entamoeba dispar
NYEENRRRRQRRR

SEQ ID NO: 2404909 - protein, 24 aa, Entamoeba dispar
PNANSLGYAGTNAGTVASGTNNTM

SEQ ID NO: 2404910 - protein, 11 aa, Entamoeba dispar
QPADDTLSDAE

SEQ ID NO: 2404911 - protein, 8 aa, Entamoeba dispar
QSTNKRRK

SEQ ID NO: 2404912 - protein, 10 aa, Entamoeba dispar
RCNAEGDDKE

SEQ ID NO: 2404913 - protein, 5 aa, Entamoeba dispar
RLSGY

SEQ ID NO: 2404914 - protein, 4 aa, Entamoeba dispar
SLQE

SEQ ID NO: 2404915 - protein, 6 aa, Entamoeba dispar
SSITSI

SEQ ID NO: 2404916 - protein, 12 aa, Entamoeba dispar
YNPQNESELKLE

SEQ ID NO: 2404917 - protein, 9 aa, Entamoeba dispar
YRQRREEAI

SEQ ID NO: 2404918 - protein, 8 aa, Entamoeba dispar
AEPTSEAL

SEQ ID NO: 2404919 - protein, 19 aa, Entamoeba dispar
AGKDTIEPTPEGIKKYLTT

SEQ ID NO: 2404920 - protein, 6 aa, Entamoeba dispar
AKPVPD

SEQ ID NO: 2404921 - protein, 7 aa, Entamoeba dispar
ANSGVHD

SEQ ID NO: 2404922 - protein, 4 aa, Entamoeba dispar
APEE

SEQ ID NO: 2404923 - protein, 12 aa, Entamoeba dispar
APMNPKANREKM

SEQ ID NO: 2404924 - protein, 6 aa, Entamoeba dispar
APPERK

SEQ ID NO: 2404925 - protein, 4 aa, Entamoeba dispar
APSY

SEQ ID NO: 2404926 - protein, 7 aa, Entamoeba dispar
ASGRTTG

SEQ ID NO: 2404927 - protein, 6 aa, Entamoeba dispar
DFGSSR

SEQ ID NO: 2404928 - protein, 9 aa, Entamoeba dispar
DKKSSGEKK

SEQ ID NO: 2404929 - protein, 5 aa, Entamoeba dispar
DKSSI

SEQ ID NO: 2404930 - protein, 7 aa, Entamoeba dispar
DTASITL

SEQ ID NO: 2404931 - protein, 7 aa, Entamoeba dispar
DVKDPDN

SEQ ID NO: 2404932 - protein, 5 aa, Entamoeba dispar
EASMT

SEQ ID NO: 2404933 - protein, 5 aa, Entamoeba dispar
EETGD

SEQ ID NO: 2404934 - protein, 15 aa, Entamoeba dispar
EEYDESGPAIVHRKC

SEQ ID NO: 2404935 - protein, 8 aa, Entamoeba dispar
EGESKGKI

SEQ ID NO: 2404936 - protein, 4 aa, Entamoeba dispar
ENEE

SEQ ID NO: 2404937 - protein, 8 aa, Entamoeba dispar
ENKRLRKE

SEQ ID NO: 2404938 - protein, 6 aa, Entamoeba dispar
ENYPKT

SEQ ID NO: 2404939 - protein, 6 aa, Entamoeba dispar
ENYPTK

SEQ ID NO: 2404940 - protein, 17 aa, Entamoeba dispar
ERNKQTQIKLSTNKSNN

SEQ ID NO: 2404941 - protein, 6 aa, Entamoeba dispar
ESDEIN

SEQ ID NO: 2404942 - protein, 4 aa, Entamoeba dispar
ESMY

SEQ ID NO: 2404943 - protein, 9 aa, Entamoeba dispar
FAGDDAPRA

SEQ ID NO: 2404944 - protein, 6 aa, Entamoeba dispar
FQPKQK

SEQ ID NO: 2404945 - protein, 8 aa, Entamoeba dispar
FQQRDSTQ

SEQ ID NO: 2404946 - protein, 8 aa, Entamoeba dispar
FRKRKSKE

SEQ ID NO: 2404947 - protein, 6 aa, Entamoeba dispar
FYGPTR

SEQ ID NO: 2404948 - protein, 8 aa, Entamoeba dispar
GGTSMYPG

SEQ ID NO: 2404949 - protein, 14 aa, Entamoeba dispar
GKEPNKSINPDEAV

SEQ ID NO: 2404950 - protein, 16 aa, Entamoeba dispar
GQKDAYVGDEAQSKRG

SEQ ID NO: 2404951 - protein, 4 aa, Entamoeba dispar
GTTN

SEQ ID NO: 2404952 - protein, 5 aa, Entamoeba dispar
HETTY

SEQ ID NO: 2404953 - protein, 10 aa, Entamoeba dispar
IDSSDPPCPV

SEQ ID NO: 2404954 - protein, 6 aa, Entamoeba dispar
IEPTEN

SEQ ID NO: 2404955 - protein, 17 aa, Entamoeba dispar
IGKAGNGKYIPPLKDNT

SEQ ID NO: 2404956 - protein, 4 aa, Entamoeba dispar
IQEE

SEQ ID NO: 2404957 - protein, 9 aa, Entamoeba dispar
IQREEDRNQ

SEQ ID NO: 2404958 - protein, 8 aa, Entamoeba dispar
KEPSEEDT

SEQ ID NO: 2404959 - protein, 4 aa, Entamoeba dispar
KETL

SEQ ID NO: 2404960 - protein, 5 aa, Entamoeba dispar
KGEIK

SEQ ID NO: 2404961 - protein, 7 aa, Entamoeba dispar
KGRNGEG

SEQ ID NO: 2404962 - protein, 4 aa, Entamoeba dispar
KGTE

SEQ ID NO: 2404963 - protein, 12 aa, Entamoeba dispar
KKDAEAKLGKRV

SEQ ID NO: 2404964 - protein, 10 aa, Entamoeba dispar
KKYQESKEEY

SEQ ID NO: 2404965 - protein, 8 aa, Entamoeba dispar
KQGTGKTT

SEQ ID NO: 2404966 - protein, 9 aa, Entamoeba dispar
KSSHTTNVK

SEQ ID NO: 2404967 - protein, 7 aa, Entamoeba dispar
KTNEEIR

SEQ ID NO: 2404968 - protein, 8 aa, Entamoeba dispar
KTYSPTEI

SEQ ID NO: 2404969 - protein, 7 aa, Entamoeba dispar
MNQTEKT

SEQ ID NO: 2404970 - protein, 11 aa, Entamoeba dispar
NAEGKRTTPSC

SEQ ID NO: 2404971 - protein, 5 aa, Entamoeba dispar
NEHPY

SEQ ID NO: 2404972 - protein, 4 aa, Entamoeba dispar
NESL

SEQ ID NO: 2404973 - protein, 5 aa, Entamoeba dispar
NGSGM

SEQ ID NO: 2404974 - protein, 7 aa, Entamoeba dispar
NIPSSIS

SEQ ID NO: 2404975 - protein, 10 aa, Entamoeba dispar
NIPSSVSKIG

SEQ ID NO: 2404976 - protein, 6 aa, Entamoeba dispar
NNSLLT

SEQ ID NO: 2404977 - protein, 8 aa, Entamoeba dispar
NYDSPEND

SEQ ID NO: 2404978 - protein, 11 aa, Entamoeba dispar
PANTNGATTVR

SEQ ID NO: 2404979 - protein, 9 aa, Entamoeba dispar
PLTKESNDR

SEQ ID NO: 2404980 - protein, 14 aa, Entamoeba dispar
PNESSSKKRISSPI

SEQ ID NO: 2404981 - protein, 5 aa, Entamoeba dispar
PNSYC

SEQ ID NO: 2404982 - protein, 5 aa, Entamoeba dispar
PSFKT

SEQ ID NO: 2404983 - protein, 6 aa, Entamoeba dispar
PTTTIS

SEQ ID NO: 2404984 - protein, 22 aa, Entamoeba dispar
PVYTTQVQNTGGVTSVSNNSWT

SEQ ID NO: 2404985 - protein, 10 aa, Entamoeba dispar
QNAGEDETFK

SEQ ID NO: 2404986 - protein, 9 aa, Entamoeba dispar
RENNTDEEI

SEQ ID NO: 2404987 - protein, 7 aa, Entamoeba dispar
SGDGVSH

SEQ ID NO: 2404988 - protein, 6 aa, Entamoeba dispar
SGVGKT

SEQ ID NO: 2404989 - protein, 15 aa, Entamoeba dispar
SNNEIDEIKEKMKET

SEQ ID NO: 2404990 - protein, 5 aa, Entamoeba dispar
SPSKE

SEQ ID NO: 2404991 - protein, 5 aa, Entamoeba dispar
SSISK

SEQ ID NO: 2404992 - protein, 7 aa, Entamoeba dispar
STRGEQI

SEQ ID NO: 2404993 - protein, 6 aa, Entamoeba dispar
STSIPI

SEQ ID NO: 2404994 - protein, 4 aa, Entamoeba dispar
TDES

SEQ ID NO: 2404995 - protein, 6 aa, Entamoeba dispar
TEQQNE

SEQ ID NO: 2404996 - protein, 10 aa, Entamoeba dispar
TGTGGKATED

SEQ ID NO: 2404997 - protein, 5 aa, Entamoeba dispar
TIQEQ

SEQ ID NO: 2404998 - protein, 8 aa, Entamoeba dispar
TKDNAHVT

SEQ ID NO: 2404999 - protein, 5 aa, Entamoeba dispar
TTPRI

SEQ ID NO: 2405000 - protein, 11 aa, Entamoeba dispar
VRQRREASENR

SEQ ID NO: 2405001 - protein, 7 aa, Entamoeba dispar
YIQQEGK

SEQ ID NO: 2405002 - protein, 29 aa, Entamoeba dispar
YQGRGSNEFTGGRNTEKENNNKGPTIEEV

SEQ ID NO: 2405003 - protein, 4 aa, Entamoeba dispar
YRGN

SEQ ID NO: 2405004 - protein, 6 aa, Entamoeba dispar
AEGTGI

SEQ ID NO: 2405005 - protein, 12 aa, Entamoeba dispar
AEIKNKEEKSLF

SEQ ID NO: 2405006 - protein, 8 aa, Entamoeba dispar
DAIPGYNT

SEQ ID NO: 2405007 - protein, 5 aa, Entamoeba dispar
DGQDS

SEQ ID NO: 2405008 - protein, 8 aa, Entamoeba dispar
DKEKTIRE

SEQ ID NO: 2405009 - protein, 15 aa, Entamoeba dispar
DNKPYPDKPFSSIEK

SEQ ID NO: 2405010 - protein, 5 aa, Entamoeba dispar
DNPND

SEQ ID NO: 2405011 - protein, 8 aa, Entamoeba dispar
DTSNSINQ

SEQ ID NO: 2405012 - protein, 7 aa, Entamoeba dispar
ECNIPET

SEQ ID NO: 2405013 - protein, 6 aa, Entamoeba dispar
EDIGRN

SEQ ID NO: 2405014 - protein, 6 aa, Entamoeba dispar
EDNSFK

SEQ ID NO: 2405015 - protein, 9 aa, Entamoeba dispar
EEGKTRKGC

SEQ ID NO: 2405016 - protein, 8 aa, Entamoeba dispar
EELDYKPG

SEQ ID NO: 2405017 - protein, 6 aa, Entamoeba dispar
EIDTNS

SEQ ID NO: 2405018 - protein, 5 aa, Entamoeba dispar
EQGNI

SEQ ID NO: 2405019 - protein, 5 aa, Entamoeba dispar
EQQNE

SEQ ID NO: 2405020 - protein, 12 aa, Entamoeba dispar
ERKTKNDEEGLQ

SEQ ID NO: 2405021 - protein, 4 aa, Entamoeba dispar
EYNI

SEQ ID NO: 2405022 - protein, 6 aa, Entamoeba dispar
GGTPYL

SEQ ID NO: 2405023 - protein, 5 aa, Entamoeba dispar
GKKTI

SEQ ID NO: 2405024 - protein, 8 aa, Entamoeba dispar
GKPARSLK

SEQ ID NO: 2405025 - protein, 4 aa, Entamoeba dispar
GSCK

SEQ ID NO: 2405026 - protein, 9 aa, Entamoeba dispar
INNEENRKK

SEQ ID NO: 2405027 - protein, 7 aa, Entamoeba dispar
IPSSVSE

SEQ ID NO: 2405028 - protein, 15 aa, Entamoeba dispar
KATNGDTHLGGEDFD

SEQ ID NO: 2405029 - protein, 8 aa, Entamoeba dispar
KEKEAGNI

SEQ ID NO: 2405030 - protein, 4 aa, Entamoeba dispar
KEYE

SEQ ID NO: 2405031 - protein, 7 aa, Entamoeba dispar
KKEEIKE

SEQ ID NO: 2405032 - protein, 6 aa, Entamoeba dispar
KKPYTY

SEQ ID NO: 2405033 - protein, 9 aa, Entamoeba dispar
KLKKEIKET

SEQ ID NO: 2405034 - protein, 7 aa, Entamoeba dispar
KLRKKDI

SEQ ID NO: 2405035 - protein, 4 aa, Entamoeba dispar
KNGN

SEQ ID NO: 2405036 - protein, 7 aa, Entamoeba dispar
KNIENKD

SEQ ID NO: 2405037 - protein, 8 aa, Entamoeba dispar
KQGAGKTT

SEQ ID NO: 2405038 - protein, 5 aa, Entamoeba dispar
KRGVK

SEQ ID NO: 2405039 - protein, 5 aa, Entamoeba dispar
KRKKL

SEQ ID NO: 2405040 - protein, 9 aa, Entamoeba dispar
KRYSSKDRF

SEQ ID NO: 2405041 - protein, 9 aa, Entamoeba dispar
KSPDNTVEK

SEQ ID NO: 2405042 - protein, 8 aa, Entamoeba dispar
KSSDGMTT

SEQ ID NO: 2405043 - protein, 39 aa, Entamoeba dispar
LERKRRNTRTIGEYGTTSIIGGTADNRVVSGASAGTTSL

SEQ ID NO: 2405044 - protein, 5 aa, Entamoeba dispar
LKNDR

SEQ ID NO: 2405045 - protein, 7 aa, Entamoeba dispar
LNKTQEE

SEQ ID NO: 2405046 - protein, 6 aa, Entamoeba dispar
MSVGED

SEQ ID NO: 2405047 - protein, 13 aa, Entamoeba dispar
NEIIEEDNVEERM

SEQ ID NO: 2405048 - protein, 4 aa, Entamoeba dispar
NEIN

SEQ ID NO: 2405049 - protein, 7 aa, Entamoeba dispar
NIPSSIT

SEQ ID NO: 2405050 - protein, 4 aa, Entamoeba dispar
NIPT

SEQ ID NO: 2405051 - protein, 12 aa, Entamoeba dispar
NIQNTQRTNPVQ

SEQ ID NO: 2405052 - protein, 7 aa, Entamoeba dispar
NNEEVND

SEQ ID NO: 2405053 - protein, 7 aa, Entamoeba dispar
NNGTIQL

SEQ ID NO: 2405054 - protein, 4 aa, Entamoeba dispar
NNNI

SEQ ID NO: 2405055 - protein, 4 aa, Entamoeba dispar
NPFS

SEQ ID NO: 2405056 - protein, 11 aa, Entamoeba dispar
NSTIPAKKSEI

SEQ ID NO: 2405057 - protein, 11 aa, Entamoeba dispar
PERKSIKRKRK

SEQ ID NO: 2405058 - protein, 4 aa, Entamoeba dispar
PNTP

SEQ ID NO: 2405059 - protein, 10 aa, Entamoeba dispar
PWKEDNPVVK

SEQ ID NO: 2405060 - protein, 4 aa, Entamoeba dispar
QMEY

SEQ ID NO: 2405061 - protein, 14 aa, Entamoeba dispar
QSKQVNITGNERCN

SEQ ID NO: 2405062 - protein, 9 aa, Entamoeba dispar
RGDGESWSD

SEQ ID NO: 2405063 - protein, 4 aa, Entamoeba dispar
RSSP

SEQ ID NO: 2405064 - protein, 6 aa, Entamoeba dispar
SDNEAY

SEQ ID NO: 2405065 - protein, 4 aa, Entamoeba dispar
SEEH

SEQ ID NO: 2405066 - protein, 14 aa, Entamoeba dispar
SESNYDKENPNQIE

SEQ ID NO: 2405067 - protein, 6 aa, Entamoeba dispar
SGATKG

SEQ ID NO: 2405068 - protein, 5 aa, Entamoeba dispar
STRIP

SEQ ID NO: 2405069 - protein, 4 aa, Entamoeba dispar
SYGS

SEQ ID NO: 2405070 - protein, 9 aa, Entamoeba dispar
TAGSATNSV

SEQ ID NO: 2405071 - protein, 9 aa, Entamoeba dispar
TDEKDRAER

SEQ ID NO: 2405072 - protein, 4 aa, Entamoeba dispar
TEEN

SEQ ID NO: 2405073 - protein, 11 aa, Entamoeba dispar
TENETTTPEAQ

SEQ ID NO: 2405074 - protein, 19 aa, Entamoeba dispar
TGKDTIEPTPEGIKKYLTT

SEQ ID NO: 2405075 - protein, 7 aa, Entamoeba dispar
TKMGKTE

SEQ ID NO: 2405076 - protein, 7 aa, Entamoeba dispar
TLSNTTY

SEQ ID NO: 2405077 - protein, 11 aa, Entamoeba dispar
TNDDINNREDI

SEQ ID NO: 2405078 - protein, 4 aa, Entamoeba dispar
TNMN

SEQ ID NO: 2405079 - protein, 14 aa, Entamoeba dispar
TPNVQTDDCPLNSD

SEQ ID NO: 2405080 - protein, 4 aa, Entamoeba dispar
VEPQ

SEQ ID NO: 2405081 - protein, 4 aa, Entamoeba dispar
VHPG

SEQ ID NO: 2405082 - protein, 6 aa, Entamoeba dispar
YDDEQN

SEQ ID NO: 2405083 - protein, 11 aa, Entamoeba dispar
YKKDISGNARA

SEQ ID NO: 2405084 - protein, 7 aa, Entamoeba dispar
YKTTSTV

SEQ ID NO: 2405085 - protein, 9 aa, Entamoeba dispar
YLSAGRDAL

SEQ ID NO: 2405086 - protein, 5 aa, Entamoeba dispar
AAINE

SEQ ID NO: 2405087 - protein, 9 aa, Entamoeba dispar
AANNAYSNG

SEQ ID NO: 2405088 - protein, 20 aa, Entamoeba dispar
AEKYKAEDDENKARIETKNQ

SEQ ID NO: 2405089 - protein, 6 aa, Entamoeba dispar
AERNGI

SEQ ID NO: 2405090 - protein, 8 aa, Entamoeba dispar
AKGNTFTT

SEQ ID NO: 2405091 - protein, 5 aa, Entamoeba dispar
ALRES

SEQ ID NO: 2405092 - protein, 18 aa, Entamoeba dispar
APGISNPEFDNKCESIKN

SEQ ID NO: 2405093 - protein, 9 aa, Entamoeba dispar
AQTGSGKTA

SEQ ID NO: 2405094 - protein, 14 aa, Entamoeba dispar
CERAKRTLSSASVA

SEQ ID NO: 2405095 - protein, 15 aa, Entamoeba dispar
DAQRQATKDAGTLAG

SEQ ID NO: 2405096 - protein, 5 aa, Entamoeba dispar
DLTES

SEQ ID NO: 2405097 - protein, 8 aa, Entamoeba dispar
DPVPEDAK

SEQ ID NO: 2405098 - protein, 36 aa, Entamoeba dispar
DRTQGNLERQAKESRKLQRKTRKQEKIKKMKDPINK

SEQ ID NO: 2405099 - protein, 7 aa, Entamoeba dispar
DSIGDRV

SEQ ID NO: 2405100 - protein, 6 aa, Entamoeba dispar
EAPEFK

SEQ ID NO: 2405101 - protein, 4 aa, Entamoeba dispar
ECYE

SEQ ID NO: 2405102 - protein, 28 aa, Entamoeba dispar
EDPQLDPSFVPPQNAPSDPSQETPYAPP

SEQ ID NO: 2405103 - protein, 8 aa, Entamoeba dispar
EDSEAEIP

SEQ ID NO: 2405104 - protein, 11 aa, Entamoeba dispar
EEEYSEYSSER

SEQ ID NO: 2405105 - protein, 8 aa, Entamoeba dispar
EEFKGKEV

SEQ ID NO: 2405106 - protein, 4 aa, Entamoeba dispar
EEIQ

SEQ ID NO: 2405107 - protein, 11 aa, Entamoeba dispar
EEIYEKGEKVN

SEQ ID NO: 2405108 - protein, 5 aa, Entamoeba dispar
EEMNK

SEQ ID NO: 2405109 - protein, 6 aa, Entamoeba dispar
EGIPIK

SEQ ID NO: 2405110 - protein, 4 aa, Entamoeba dispar
EGKK

SEQ ID NO: 2405111 - protein, 7 aa, Entamoeba dispar
EHPLPSE

SEQ ID NO: 2405112 - protein, 4 aa, Entamoeba dispar
EIIN

SEQ ID NO: 2405113 - protein, 13 aa, Entamoeba dispar
EINEKGKKIEINK

SEQ ID NO: 2405114 - protein, 22 aa, Entamoeba dispar
EINKNEEYKSIRRNEKKEEEKY

SEQ ID NO: 2405115 - protein, 11 aa, Entamoeba dispar
ELEERRKKMDK

SEQ ID NO: 2405116 - protein, 14 aa, Entamoeba dispar
ELKAPSPAKAGVIA

SEQ ID NO: 2405117 - protein, 11 aa, Entamoeba dispar
EREGQVSRKVK

SEQ ID NO: 2405118 - protein, 13 aa, Entamoeba dispar
ERRVTSKNKKLGE

SEQ ID NO: 2405119 - protein, 10 aa, Entamoeba dispar
ETGDGKSSLG

SEQ ID NO: 2405120 - protein, 4 aa, Entamoeba dispar
EVGE

SEQ ID NO: 2405121 - protein, 4 aa, Entamoeba dispar
EVKH

SEQ ID NO: 2405122 - protein, 19 aa, Entamoeba dispar
EYTKEDRKSYGNTIPSEVK

SEQ ID NO: 2405123 - protein, 28 aa, Entamoeba dispar
FQGSDAADVEAAYKQELANHTSVDSDGS

SEQ ID NO: 2405124 - protein, 7 aa, Entamoeba dispar
GADRPFH

SEQ ID NO: 2405125 - protein, 7 aa, Entamoeba dispar
GDTNSYV

SEQ ID NO: 2405126 - protein, 6 aa, Entamoeba dispar
GEKVGV

SEQ ID NO: 2405127 - protein, 4 aa, Entamoeba dispar
GELE

SEQ ID NO: 2405128 - protein, 5 aa, Entamoeba dispar
GERGM

SEQ ID NO: 2405129 - protein, 9 aa, Entamoeba dispar
GKIRTDTRY

SEQ ID NO: 2405130 - protein, 8 aa, Entamoeba dispar
GKNIEKKD

SEQ ID NO: 2405131 - protein, 13 aa, Entamoeba dispar
GLKSVGKKIAGIG

SEQ ID NO: 2405132 - protein, 13 aa, Entamoeba dispar
GRPYNPPIPDESL

SEQ ID NO: 2405133 - protein, 6 aa, Entamoeba dispar
GRTIRY

SEQ ID NO: 2405134 - protein, 10 aa, Entamoeba dispar
HNSEKKKINY

SEQ ID NO: 2405135 - protein, 18 aa, Entamoeba dispar
IEQAAPKKTRNQKDKMNQ

SEQ ID NO: 2405136 - protein, 5 aa, Entamoeba dispar
IKEKE

SEQ ID NO: 2405137 - protein, 12 aa, Entamoeba dispar
IKQEKENKINTK

SEQ ID NO: 2405138 - protein, 16 aa, Entamoeba dispar
INEKNEEQGITTTNKR

SEQ ID NO: 2405139 - protein, 16 aa, Entamoeba dispar
INEQISTAGYEASGTS

SEQ ID NO: 2405140 - protein, 7 aa, Entamoeba dispar
INIPSSI

SEQ ID NO: 2405141 - protein, 10 aa, Entamoeba dispar
INIPSSITSF

SEQ ID NO: 2405142 - protein, 4 aa, Entamoeba dispar
IPNE

SEQ ID NO: 2405143 - protein, 10 aa, Entamoeba dispar
IPPAKKGIPK

SEQ ID NO: 2405144 - protein, 6 aa, Entamoeba dispar
IPSSVS

SEQ ID NO: 2405145 - protein, 4 aa, Entamoeba dispar
IPTT

SEQ ID NO: 2405146 - protein, 6 aa, Entamoeba dispar
IRKEGK

SEQ ID NO: 2405147 - protein, 27 aa, Entamoeba dispar
ISEGNKTEEQESPKETEEERVNREFGE

SEQ ID NO: 2405148 - protein, 16 aa, Entamoeba dispar
ISSSSYSGSDEIKDNI

SEQ ID NO: 2405149 - protein, 14 aa, Entamoeba dispar
ISWTGNAGIPQEEE

SEQ ID NO: 2405150 - protein, 6 aa, Entamoeba dispar
KDINEL

SEQ ID NO: 2405151 - protein, 20 aa, Entamoeba dispar
KDRLNRDNVPTRKNTTQDNI

SEQ ID NO: 2405152 - protein, 12 aa, Entamoeba dispar
KDYNKEDEEMCN

SEQ ID NO: 2405153 - protein, 8 aa, Entamoeba dispar
KEKEQGNI

SEQ ID NO: 2405154 - protein, 7 aa, Entamoeba dispar
KEQPLQE

SEQ ID NO: 2405155 - protein, 5 aa, Entamoeba dispar
KGIIT

SEQ ID NO: 2405156 - protein, 5 aa, Entamoeba dispar
KGTET

SEQ ID NO: 2405157 - protein, 9 aa, Entamoeba dispar
KIKEGNKIQ

SEQ ID NO: 2405158 - protein, 7 aa, Entamoeba dispar
KKKQLTS

SEQ ID NO: 2405159 - protein, 9 aa, Entamoeba dispar
KKTKLSDVR

SEQ ID NO: 2405160 - protein, 27 aa, Entamoeba dispar
KKYPKKQAAPKKSKGNKKVVPGKKIGK

SEQ ID NO: 2405161 - protein, 11 aa, Entamoeba dispar
KLEDKDQTNKF

SEQ ID NO: 2405162 - protein, 10 aa, Entamoeba dispar
KLKKEIKETM

SEQ ID NO: 2405163 - protein, 10 aa, Entamoeba dispar
KNDKQERRPY

SEQ ID NO: 2405164 - protein, 5 aa, Entamoeba dispar
KPSSQ

SEQ ID NO: 2405165 - protein, 29 aa, Entamoeba dispar
KQTKTKSIQQNLNTRPSLTTTFTPKSINN

SEQ ID NO: 2405166 - protein, 7 aa, Entamoeba dispar
KRYGSYG

SEQ ID NO: 2405167 - protein, 24 aa, Entamoeba dispar
LDKGTGKKTGNQVKSNGGLNEDEI

SEQ ID NO: 2405168 - protein, 11 aa, Entamoeba dispar
LGSSENEDEWG

SEQ ID NO: 2405169 - protein, 8 aa, Entamoeba dispar
LPSIDKEE

SEQ ID NO: 2405170 - protein, 7 aa, Entamoeba dispar
LSGRTKR

SEQ ID NO: 2405171 - protein, 8 aa, Entamoeba dispar
LTGSNDDY

SEQ ID NO: 2405172 - protein, 9 aa, Entamoeba dispar
LTSSTTLNN

SEQ ID NO: 2405173 - protein, 4 aa, Entamoeba dispar
LTSV

SEQ ID NO: 2405174 - protein, 16 aa, Entamoeba dispar
MEEEKNQETTTPPEMT

SEQ ID NO: 2405175 - protein, 4 aa, Entamoeba dispar
MKNK

SEQ ID NO: 2405176 - protein, 7 aa, Entamoeba dispar
NEENRKK

SEQ ID NO: 2405177 - protein, 8 aa, Entamoeba dispar
NENETARD

SEQ ID NO: 2405178 - protein, 6 aa, Entamoeba dispar
NEPTAA

SEQ ID NO: 2405179 - protein, 6 aa, Entamoeba dispar
NEYERV

SEQ ID NO: 2405180 - protein, 4 aa, Entamoeba dispar
NGEY

SEQ ID NO: 2405181 - protein, 5 aa, Entamoeba dispar
NGVTG

SEQ ID NO: 2405182 - protein, 4 aa, Entamoeba dispar
NGYY

SEQ ID NO: 2405183 - protein, 10 aa, Entamoeba dispar
NIPSSVSEIG

SEQ ID NO: 2405184 - protein, 9 aa, Entamoeba dispar
NIPSSVSKI

SEQ ID NO: 2405185 - protein, 10 aa, Entamoeba dispar
NKRINGKRRI

SEQ ID NO: 2405186 - protein, 9 aa, Entamoeba dispar
NKYKQNAER

SEQ ID NO: 2405187 - protein, 6 aa, Entamoeba dispar
NLPTEA

SEQ ID NO: 2405188 - protein, 4 aa, Entamoeba dispar
NNGG

SEQ ID NO: 2405189 - protein, 9 aa, Entamoeba dispar
NNITRKPTN

SEQ ID NO: 2405190 - protein, 7 aa, Entamoeba dispar
NNLEEQE

SEQ ID NO: 2405191 - protein, 6 aa, Entamoeba dispar
NNPKRH

SEQ ID NO: 2405192 - protein, 19 aa, Entamoeba dispar
NREEENKNTISKAKTTLDK

SEQ ID NO: 2405193 - protein, 5 aa, Entamoeba dispar
NSSHI

SEQ ID NO: 2405194 - protein, 8 aa, Entamoeba dispar
NVPNAQPP

SEQ ID NO: 2405195 - protein, 35 aa, Entamoeba dispar
NYKKRGDDSSSDSEDNREDGKGKVKYQAKRPFEEK

SEQ ID NO: 2405196 - protein, 13 aa, Entamoeba dispar
PAGDTGLDPTQTN

SEQ ID NO: 2405197 - protein, 10 aa, Entamoeba dispar
PCKNINPDEA

SEQ ID NO: 2405198 - protein, 8 aa, Entamoeba dispar
PELQANDT

SEQ ID NO: 2405199 - protein, 5 aa, Entamoeba dispar
PELQN

SEQ ID NO: 2405200 - protein, 24 aa, Entamoeba dispar
PRKRITGDGISSDSNSGLENRGHG

SEQ ID NO: 2405201 - protein, 5 aa, Entamoeba dispar
PRTKE

SEQ ID NO: 2405202 - protein, 8 aa, Entamoeba dispar
PSNCKSGS

SEQ ID NO: 2405203 - protein, 17 aa, Entamoeba dispar
PSSSNLQQKTITYTSNG

SEQ ID NO: 2405204 - protein, 10 aa, Entamoeba dispar
PTNTEESSWS

SEQ ID NO: 2405205 - protein, 4 aa, Entamoeba dispar
PTTI

SEQ ID NO: 2405206 - protein, 9 aa, Entamoeba dispar
QEGVQAATA

SEQ ID NO: 2405207 - protein, 6 aa, Entamoeba dispar
QGNKYR

SEQ ID NO: 2405208 - protein, 5 aa, Entamoeba dispar
QLPES

SEQ ID NO: 2405209 - protein, 4 aa, Entamoeba dispar
QNSI

SEQ ID NO: 2405210 - protein, 6 aa, Entamoeba dispar
QPIGQH

SEQ ID NO: 2405211 - protein, 7 aa, Entamoeba dispar
QRNTPTM

SEQ ID NO: 2405212 - protein, 10 aa, Entamoeba dispar
QSAGEDETFK

SEQ ID NO: 2405213 - protein, 10 aa, Entamoeba dispar
QTQEKSGNYI

SEQ ID NO: 2405214 - protein, 7 aa, Entamoeba dispar
RNDNKIK

SEQ ID NO: 2405215 - protein, 5 aa, Entamoeba dispar
RNNNG

SEQ ID NO: 2405216 - protein, 5 aa, Entamoeba dispar
RTIPN

SEQ ID NO: 2405217 - protein, 8 aa, Entamoeba dispar
RYEEREKI

SEQ ID NO: 2405218 - protein, 9 aa, Entamoeba dispar
SDKPASRYN

SEQ ID NO: 2405219 - protein, 15 aa, Entamoeba dispar
SERSKNDEDKIINDD

SEQ ID NO: 2405220 - protein, 6 aa, Entamoeba dispar
SGTYQA

SEQ ID NO: 2405221 - protein, 5 aa, Entamoeba dispar
SINEI

SEQ ID NO: 2405222 - protein, 10 aa, Entamoeba dispar
SKITKGQIEI

SEQ ID NO: 2405223 - protein, 5 aa, Entamoeba dispar
SLGGG

SEQ ID NO: 2405224 - protein, 9 aa, Entamoeba dispar
SNGSTISPI

SEQ ID NO: 2405225 - protein, 8 aa, Entamoeba dispar
SNINSDVT

SEQ ID NO: 2405226 - protein, 7 aa, Entamoeba dispar
SPTDPDT

SEQ ID NO: 2405227 - protein, 4 aa, Entamoeba dispar
SRDF

SEQ ID NO: 2405228 - protein, 7 aa, Entamoeba dispar
SRGGSIN

SEQ ID NO: 2405229 - protein, 7 aa, Entamoeba dispar
SSNARLT

SEQ ID NO: 2405230 - protein, 14 aa, Entamoeba dispar
TAAAGEGGKDLYKG

SEQ ID NO: 2405231 - protein, 4 aa, Entamoeba dispar
TAGG

SEQ ID NO: 2405232 - protein, 8 aa, Entamoeba dispar
TDVRPPLQ

SEQ ID NO: 2405233 - protein, 9 aa, Entamoeba dispar
TEEKEEKGI

SEQ ID NO: 2405234 - protein, 6 aa, Entamoeba dispar
TESIPR

SEQ ID NO: 2405235 - protein, 5 aa, Entamoeba dispar
THSIQ

SEQ ID NO: 2405236 - protein, 4 aa, Entamoeba dispar
TIEE

SEQ ID NO: 2405237 - protein, 4 aa, Entamoeba dispar
TIGP

SEQ ID NO: 2405238 - protein, 8 aa, Entamoeba dispar
TKDNKNIT

SEQ ID NO: 2405239 - protein, 6 aa, Entamoeba dispar
TKPHQT

SEQ ID NO: 2405240 - protein, 8 aa, Entamoeba dispar
TNEVTCSR

SEQ ID NO: 2405241 - protein, 7 aa, Entamoeba dispar
TNIPEET

SEQ ID NO: 2405242 - protein, 8 aa, Entamoeba dispar
TNTPQSKG

SEQ ID NO: 2405243 - protein, 7 aa, Entamoeba dispar
TPQSVNA

SEQ ID NO: 2405244 - protein, 6 aa, Entamoeba dispar
TSTINK

SEQ ID NO: 2405245 - protein, 21 aa, Entamoeba dispar
TTIPTSVSKDFTTSMDNQQEV

SEQ ID NO: 2405246 - protein, 4 aa, Entamoeba dispar
VAGD

SEQ ID NO: 2405247 - protein, 6 aa, Entamoeba dispar
VDNNAG

SEQ ID NO: 2405248 - protein, 4 aa, Entamoeba dispar
VGGS

SEQ ID NO: 2405249 - protein, 10 aa, Entamoeba dispar
VGSTTTNSPA

SEQ ID NO: 2405250 - protein, 10 aa, Entamoeba dispar
VKERSGKEID

SEQ ID NO: 2405251 - protein, 8 aa, Entamoeba dispar
WNPYTNEN

SEQ ID NO: 2405252 - protein, 5 aa, Entamoeba dispar
YCSDG

SEQ ID NO: 2405253 - protein, 9 aa, Entamoeba dispar
YGSVDKGRS

SEQ ID NO: 2405254 - protein, 4 aa, Entamoeba dispar
YQEA

SEQ ID NO: 2405255 - protein, 5 aa, Entamoeba dispar
YQKYP

SEQ ID NO: 2405256 - protein, 5 aa, Entamoeba dispar
YVSNK

SEQ ID NO: 2405257 - protein, 11 aa, Entamoeba dispar
YYDNPENEREV

SEQ ID NO: 2405258 - protein, 6 aa, Entamoeba dispar
ACSSVE

SEQ ID NO: 2405259 - protein, 25 aa, Entamoeba dispar
AEDKTTGKKNKITITNDKGRLSKEE

SEQ ID NO: 2405260 - protein, 12 aa, Entamoeba dispar
AGDAKVPAYYPT

SEQ ID NO: 2405261 - protein, 6 aa, Entamoeba dispar
AGHPDG

SEQ ID NO: 2405262 - protein, 4 aa, Entamoeba dispar
AGKI

SEQ ID NO: 2405263 - protein, 6 aa, Entamoeba dispar
AGQERY

SEQ ID NO: 2405264 - protein, 27 aa, Entamoeba dispar
AKELAEKTQKGEKATASKKTEKPATLS

SEQ ID NO: 2405265 - protein, 4 aa, Entamoeba dispar
AKEN

SEQ ID NO: 2405266 - protein, 7 aa, Entamoeba dispar
AKGVSTK

SEQ ID NO: 2405267 - protein, 8 aa, Entamoeba dispar
AKIAEKNK

SEQ ID NO: 2405268 - protein, 17 aa, Entamoeba dispar
ALKSSIQKIGAGKTEEL

SEQ ID NO: 2405269 - protein, 10 aa, Entamoeba dispar
ALQQTAKEYE

SEQ ID NO: 2405270 - protein, 13 aa, Entamoeba dispar
AQLPGMTGDENNR

SEQ ID NO: 2405271 - protein, 6 aa, Entamoeba dispar
AQQDNL

SEQ ID NO: 2405272 - protein, 7 aa, Entamoeba dispar
ARDPKRL

SEQ ID NO: 2405273 - protein, 4 aa, Entamoeba dispar
ASIP

SEQ ID NO: 2405274 - protein, 5 aa, Entamoeba dispar
DDDNH

SEQ ID NO: 2405275 - protein, 13 aa, Entamoeba dispar
DDEESELNIPPGK

SEQ ID NO: 2405276 - protein, 8 aa, Entamoeba dispar
DDFESRRE

SEQ ID NO: 2405277 - protein, 10 aa, Entamoeba dispar
DDNNNKVEGT

SEQ ID NO: 2405278 - protein, 7 aa, Entamoeba dispar
DEENRES

SEQ ID NO: 2405279 - protein, 4 aa, Entamoeba dispar
DESV

SEQ ID NO: 2405280 - protein, 6 aa, Entamoeba dispar
DFEKKS

SEQ ID NO: 2405281 - protein, 6 aa, Entamoeba dispar
DGGDRL

SEQ ID NO: 2405282 - protein, 9 aa, Entamoeba dispar
DIPNQKKSR

SEQ ID NO: 2405283 - protein, 9 aa, Entamoeba dispar
DISERFPKD

SEQ ID NO: 2405284 - protein, 4 aa, Entamoeba dispar
DISS

SEQ ID NO: 2405285 - protein, 9 aa, Entamoeba dispar
DKAHNPNEI

SEQ ID NO: 2405286 - protein, 4 aa, Entamoeba dispar
DNSF

SEQ ID NO: 2405287 - protein, 15 aa, Entamoeba dispar
DQERNKIQRENEKSL

SEQ ID NO: 2405288 - protein, 8 aa, Entamoeba dispar
DQGSNENI

SEQ ID NO: 2405289 - protein, 6 aa, Entamoeba dispar
DQNGNH

SEQ ID NO: 2405290 - protein, 7 aa, Entamoeba dispar
DSISNQV

SEQ ID NO: 2405291 - protein, 4 aa, Entamoeba dispar
DTVT

SEQ ID NO: 2405292 - protein, 6 aa, Entamoeba dispar
DTYRRN

SEQ ID NO: 2405293 - protein, 7 aa, Entamoeba dispar
DVKTTDG

SEQ ID NO: 2405294 - protein, 4 aa, Entamoeba dispar
DVNE

SEQ ID NO: 2405295 - protein, 6 aa, Entamoeba dispar
DYNPTI

SEQ ID NO: 2405296 - protein, 4 aa, Entamoeba dispar
EAET

SEQ ID NO: 2405297 - protein, 4 aa, Entamoeba dispar
EDTS

SEQ ID NO: 2405298 - protein, 5 aa, Entamoeba dispar
EDVNG

SEQ ID NO: 2405299 - protein, 13 aa, Entamoeba dispar
EEEDKEEYGEKIE

SEQ ID NO: 2405300 - protein, 4 aa, Entamoeba dispar
EEEI

SEQ ID NO: 2405301 - protein, 8 aa, Entamoeba dispar
EEEMKQEK

SEQ ID NO: 2405302 - protein, 5 aa, Entamoeba dispar
EEENK

SEQ ID NO: 2405303 - protein, 5 aa, Entamoeba dispar
EEHGE

SEQ ID NO: 2405304 - protein, 5 aa, Entamoeba dispar
EENKE

SEQ ID NO: 2405305 - protein, 8 aa, Entamoeba dispar
EEQEPANF

SEQ ID NO: 2405306 - protein, 5 aa, Entamoeba dispar
EICQT

SEQ ID NO: 2405307 - protein, 7 aa, Entamoeba dispar
EINEKKA

SEQ ID NO: 2405308 - protein, 7 aa, Entamoeba dispar
EKEAGNI

SEQ ID NO: 2405309 - protein, 9 aa, Entamoeba dispar
EKEIEESNK

SEQ ID NO: 2405310 - protein, 17 aa, Entamoeba dispar
EKEIKIKENDREYPFNE

SEQ ID NO: 2405311 - protein, 7 aa, Entamoeba dispar
EKEQGNI

SEQ ID NO: 2405312 - protein, 14 aa, Entamoeba dispar
EKEYQEETKKCGWS

SEQ ID NO: 2405313 - protein, 8 aa, Entamoeba dispar
EKKEEQVE

SEQ ID NO: 2405314 - protein, 4 aa, Entamoeba dispar
EKNR

SEQ ID NO: 2405315 - protein, 9 aa, Entamoeba dispar
EKQGSRLQN

SEQ ID NO: 2405316 - protein, 6 aa, Entamoeba dispar
EKRTEE

SEQ ID NO: 2405317 - protein, 20 aa, Entamoeba dispar
ELKQGEKSTLGKFIQKMRSM

SEQ ID NO: 2405318 - protein, 4 aa, Entamoeba dispar
ENIE

SEQ ID NO: 2405319 - protein, 7 aa, Entamoeba dispar
ENIERRD

SEQ ID NO: 2405320 - protein, 12 aa, Entamoeba dispar
ENKQNENHIYNL

SEQ ID NO: 2405321 - protein, 8 aa, Entamoeba dispar
EQATTIGR

SEQ ID NO: 2405322 - protein, 11 aa, Entamoeba dispar
ERKTKNDEGLQ

SEQ ID NO: 2405323 - protein, 12 aa, Entamoeba dispar
ERYYSNEEKYNE

SEQ ID NO: 2405324 - protein, 7 aa, Entamoeba dispar
ESGVGKS

SEQ ID NO: 2405325 - protein, 5 aa, Entamoeba dispar
ETEGK

SEQ ID NO: 2405326 - protein, 9 aa, Entamoeba dispar
ETGSGKTTL

SEQ ID NO: 2405327 - protein, 10 aa, Entamoeba dispar
ETNNESNVKH

SEQ ID NO: 2405328 - protein, 6 aa, Entamoeba dispar
EYEEYG

SEQ ID NO: 2405329 - protein, 6 aa, Entamoeba dispar
EYSEQG

SEQ ID NO: 2405330 - protein, 19 aa, Entamoeba dispar
EYTKKDRKKYGNTIPSEVK

SEQ ID NO: 2405331 - protein, 10 aa, Entamoeba dispar
FEELNESEKR

SEQ ID NO: 2405332 - protein, 4 aa, Entamoeba dispar
FEGS

SEQ ID NO: 2405333 - protein, 8 aa, Entamoeba dispar
FNPTRKRT

SEQ ID NO: 2405334 - protein, 10 aa, Entamoeba dispar
FPPVNGKESW

SEQ ID NO: 2405335 - protein, 5 aa, Entamoeba dispar
FSEPR

SEQ ID NO: 2405336 - protein, 17 aa, Entamoeba dispar
FTNNGNYTLKPDENHYG

SEQ ID NO: 2405337 - protein, 8 aa, Entamoeba dispar
GATYPNPR

SEQ ID NO: 2405338 - protein, 4 aa, Entamoeba dispar
GDIP

SEQ ID NO: 2405339 - protein, 5 aa, Entamoeba dispar
GEDLP

SEQ ID NO: 2405340 - protein, 22 aa, Entamoeba dispar
GEKGFETLAPEDKPWETEGANL

SEQ ID NO: 2405341 - protein, 4 aa, Entamoeba dispar
GELT

SEQ ID NO: 2405342 - protein, 10 aa, Entamoeba dispar
GGNLKIDKDE

SEQ ID NO: 2405343 - protein, 6 aa, Entamoeba dispar
GGTNNE

SEQ ID NO: 2405344 - protein, 8 aa, Entamoeba dispar
GGVSTISP

SEQ ID NO: 2405345 - protein, 8 aa, Entamoeba dispar
GIKGEEDS

SEQ ID NO: 2405346 - protein, 12 aa, Entamoeba dispar
GKKCGYTRRYGK

SEQ ID NO: 2405347 - protein, 7 aa, Entamoeba dispar
GKKQMGS

SEQ ID NO: 2405348 - protein, 6 aa, Entamoeba dispar
GKTPQV

SEQ ID NO: 2405349 - protein, 16 aa, Entamoeba dispar
GNVKKGSKRKIAEPFS

SEQ ID NO: 2405350 - protein, 8 aa, Entamoeba dispar
GQIRKGYT

SEQ ID NO: 2405351 - protein, 6 aa, Entamoeba dispar
GRRGHA

SEQ ID NO: 2405352 - protein, 13 aa, Entamoeba dispar
GTFAPKPSHGPHG

SEQ ID NO: 2405353 - protein, 9 aa, Entamoeba dispar
GVKKPNDNE

SEQ ID NO: 2405354 - protein, 13 aa, Entamoeba dispar
GVNSNDGQALLEN

SEQ ID NO: 2405355 - protein, 7 aa, Entamoeba dispar
GVQSGSL

SEQ ID NO: 2405356 - protein, 9 aa, Entamoeba dispar
GVSSSEKMM

SEQ ID NO: 2405357 - protein, 10 aa, Entamoeba dispar
GYQPNSESGA

SEQ ID NO: 2405358 - protein, 5 aa, Entamoeba dispar
HEEPS

SEQ ID NO: 2405359 - protein, 5 aa, Entamoeba dispar
HPGAS

SEQ ID NO: 2405360 - protein, 5 aa, Entamoeba dispar
HSKPS

SEQ ID NO: 2405361 - protein, 23 aa, Entamoeba dispar
IDRRTGKSMEGGEPEYIKNGDSA

SEQ ID NO: 2405362 - protein, 11 aa, Entamoeba dispar
IEEGKKKKECR

SEQ ID NO: 2405363 - protein, 5 aa, Entamoeba dispar
IEPKY

SEQ ID NO: 2405364 - protein, 11 aa, Entamoeba dispar
IETKQPNSGIR

SEQ ID NO: 2405365 - protein, 4 aa, Entamoeba dispar
IGPV

SEQ ID NO: 2405366 - protein, 4 aa, Entamoeba dispar
IGTG

SEQ ID NO: 2405367 - protein, 4 aa, Entamoeba dispar
IKDG

SEQ ID NO: 2405368 - protein, 10 aa, Entamoeba dispar
IKNNPAAKLD

SEQ ID NO: 2405369 - protein, 17 aa, Entamoeba dispar
IKRGNVASDAKNQPAVG

SEQ ID NO: 2405370 - protein, 9 aa, Entamoeba dispar
INIPSSVSK

SEQ ID NO: 2405371 - protein, 10 aa, Entamoeba dispar
INIPSSVSKI

SEQ ID NO: 2405372 - protein, 6 aa, Entamoeba dispar
IPSSIN

SEQ ID NO: 2405373 - protein, 7 aa, Entamoeba dispar
IPSSISK

SEQ ID NO: 2405374 - protein, 9 aa, Entamoeba dispar
IPSSISKIG

SEQ ID NO: 2405375 - protein, 8 aa, Entamoeba dispar
IPSSVSEL

SEQ ID NO: 2405376 - protein, 4 aa, Entamoeba dispar
IPST

SEQ ID NO: 2405377 - protein, 6 aa, Entamoeba dispar
IPSTIS

SEQ ID NO: 2405378 - protein, 4 aa, Entamoeba dispar
ISDD

SEQ ID NO: 2405379 - protein, 7 aa, Entamoeba dispar
ISNQTQF

SEQ ID NO: 2405380 - protein, 7 aa, Entamoeba dispar
ISPENLN

SEQ ID NO: 2405381 - protein, 23 aa, Entamoeba dispar
KAQIADSDLDEYAERTEKRFNDY

SEQ ID NO: 2405382 - protein, 8 aa, Entamoeba dispar
KAQKLEAK

SEQ ID NO: 2405383 - protein, 4 aa, Entamoeba dispar
KARL

SEQ ID NO: 2405384 - protein, 11 aa, Entamoeba dispar
KATKEGEKPKL

SEQ ID NO: 2405385 - protein, 5 aa, Entamoeba dispar
KCTRI

SEQ ID NO: 2405386 - protein, 9 aa, Entamoeba dispar
KDDNSNIDE

SEQ ID NO: 2405387 - protein, 9 aa, Entamoeba dispar
KDLDEQNSI

SEQ ID NO: 2405388 - protein, 4 aa, Entamoeba dispar
KDNT

SEQ ID NO: 2405389 - protein, 8 aa, Entamoeba dispar
KEAASREL

SEQ ID NO: 2405390 - protein, 11 aa, Entamoeba dispar
KEEEQKYQTVD

SEQ ID NO: 2405391 - protein, 4 aa, Entamoeba dispar
KEEY

SEQ ID NO: 2405392 - protein, 14 aa, Entamoeba dispar
KEGEEHATEDKRKE

SEQ ID NO: 2405393 - protein, 5 aa, Entamoeba dispar
KEYEG

SEQ ID NO: 2405394 - protein, 11 aa, Entamoeba dispar
KGEGEIEGVTN

SEQ ID NO: 2405395 - protein, 5 aa, Entamoeba dispar
KGKLN

SEQ ID NO: 2405396 - protein, 11 aa, Entamoeba dispar
KGNNVKNDDLD

SEQ ID NO: 2405397 - protein, 27 aa, Entamoeba dispar
KHNEKQKKIQNKLNKDLADKAKQQAAL

SEQ ID NO: 2405398 - protein, 4 aa, Entamoeba dispar
KIFN

SEQ ID NO: 2405399 - protein, 11 aa, Entamoeba dispar
KIGNKKEEDEF

SEQ ID NO: 2405400 - protein, 12 aa, Entamoeba dispar
KIKGSSKMDKRE

SEQ ID NO: 2405401 - protein, 5 aa, Entamoeba dispar
KITQP

SEQ ID NO: 2405402 - protein, 9 aa, Entamoeba dispar
KKDGERYYA

SEQ ID NO: 2405403 - protein, 10 aa, Entamoeba dispar
KKDTSAKSKR

SEQ ID NO: 2405404 - protein, 5 aa, Entamoeba dispar
KKERE

SEQ ID NO: 2405405 - protein, 18 aa, Entamoeba dispar
KKHPKEGKSTKRSKAPKI

SEQ ID NO: 2405406 - protein, 9 aa, Entamoeba dispar
KKRAERAKK

SEQ ID NO: 2405407 - protein, 21 aa, Entamoeba dispar
KKYSPTKATVDISKRNQRQEL

SEQ ID NO: 2405408 - protein, 10 aa, Entamoeba dispar
KLSDDYQNMG

SEQ ID NO: 2405409 - protein, 7 aa, Entamoeba dispar
KLSTKTM

SEQ ID NO: 2405410 - protein, 5 aa, Entamoeba dispar
KNFGI

SEQ ID NO: 2405411 - protein, 7 aa, Entamoeba dispar
KNHEEGK

SEQ ID NO: 2405412 - protein, 10 aa, Entamoeba dispar
KNIEKKDTNE

SEQ ID NO: 2405413 - protein, 10 aa, Entamoeba dispar
KNNEVRGTQY

SEQ ID NO: 2405414 - protein, 7 aa, Entamoeba dispar
KNNYRGK

SEQ ID NO: 2405415 - protein, 10 aa, Entamoeba dispar
KNQAETQPEL

SEQ ID NO: 2405416 - protein, 8 aa, Entamoeba dispar
KPEERAAK

SEQ ID NO: 2405417 - protein, 14 aa, Entamoeba dispar
KPLRNGERRRKTVR

SEQ ID NO: 2405418 - protein, 24 aa, Entamoeba dispar
KQNKAGSKKAASKGKKVNSKKTGK

SEQ ID NO: 2405419 - protein, 6 aa, Entamoeba dispar
KQTNPL

SEQ ID NO: 2405420 - protein, 7 aa, Entamoeba dispar
KRTIPSG

SEQ ID NO: 2405421 - protein, 22 aa, Entamoeba dispar
KSEDENRDIDYETNDKYTTQFI

SEQ ID NO: 2405422 - protein, 5 aa, Entamoeba dispar
KSFTT

SEQ ID NO: 2405423 - protein, 13 aa, Entamoeba dispar
KTAGTRIASEQLK

SEQ ID NO: 2405424 - protein, 8 aa, Entamoeba dispar
KTGYNPDK

SEQ ID NO: 2405425 - protein, 6 aa, Entamoeba dispar
KTPPAV

SEQ ID NO: 2405426 - protein, 7 aa, Entamoeba dispar
KTWSGYA

SEQ ID NO: 2405427 - protein, 4 aa, Entamoeba dispar
KVKK

SEQ ID NO: 2405428 - protein, 13 aa, Entamoeba dispar
KVSNETSTSETNK

SEQ ID NO: 2405429 - protein, 5 aa, Entamoeba dispar
KYAGK

SEQ ID NO: 2405430 - protein, 4 aa, Entamoeba dispar
KYIN

SEQ ID NO: 2405431 - protein, 4 aa, Entamoeba dispar
LAAQ

SEQ ID NO: 2405432 - protein, 13 aa, Entamoeba dispar
LEGSGREQNPNQQ

SEQ ID NO: 2405433 - protein, 11 aa, Entamoeba dispar
LERESIEKTVK

SEQ ID NO: 2405434 - protein, 14 aa, Entamoeba dispar
LGEYLREEDTMMVQ

SEQ ID NO: 2405435 - protein, 13 aa, Entamoeba dispar
LIEEPKKKEGEST

SEQ ID NO: 2405436 - protein, 7 aa, Entamoeba dispar
LKDEDID

SEQ ID NO: 2405437 - protein, 12 aa, Entamoeba dispar
LPMRAGPKRASH

SEQ ID NO: 2405438 - protein, 8 aa, Entamoeba dispar
LSSNDRKI

SEQ ID NO: 2405439 - protein, 9 aa, Entamoeba dispar
MGNISDEDI

SEQ ID NO: 2405440 - protein, 6 aa, Entamoeba dispar
MIEPST

SEQ ID NO: 2405441 - protein, 20 aa, Entamoeba dispar
MIQEQKKKLRTRKGAKITAL

SEQ ID NO: 2405442 - protein, 7 aa, Entamoeba dispar
MNQGGTL

SEQ ID NO: 2405443 - protein, 6 aa, Entamoeba dispar
NAFPNE

SEQ ID NO: 2405444 - protein, 26 aa, Entamoeba dispar
NAKSKTGSKTFNIENEYKQATQIGGK

SEQ ID NO: 2405445 - protein, 36 aa, Entamoeba dispar
NDYREEEDDDDDIGEEEIDKEIKERLSNIKGENQIK

SEQ ID NO: 2405446 - protein, 5 aa, Entamoeba dispar
NEDGD

SEQ ID NO: 2405447 - protein, 10 aa, Entamoeba dispar
NEEGSGIRDK

SEQ ID NO: 2405448 - protein, 4 aa, Entamoeba dispar
NEIL

SEQ ID NO: 2405449 - protein, 13 aa, Entamoeba dispar
NEIPNDITKTASK

SEQ ID NO: 2405450 - protein, 13 aa, Entamoeba dispar
NEIPNDITKTASN

SEQ ID NO: 2405451 - protein, 25 aa, Entamoeba dispar
NEKKEKKKIQISSKEENEKYSIRTN

SEQ ID NO: 2405452 - protein, 8 aa, Entamoeba dispar
NEPSEEDT

SEQ ID NO: 2405453 - protein, 6 aa, Entamoeba dispar
NEYYEE

SEQ ID NO: 2405454 - protein, 4 aa, Entamoeba dispar
NGCY

SEQ ID NO: 2405455 - protein, 7 aa, Entamoeba dispar
NGIERSI

SEQ ID NO: 2405456 - protein, 8 aa, Entamoeba dispar
NGKEGASA

SEQ ID NO: 2405457 - protein, 5 aa, Entamoeba dispar
NGKKI

SEQ ID NO: 2405458 - protein, 5 aa, Entamoeba dispar
NGKQQ

SEQ ID NO: 2405459 - protein, 8 aa, Entamoeba dispar
NGQSDNVN

SEQ ID NO: 2405460 - protein, 7 aa, Entamoeba dispar
NGVSPKI

SEQ ID NO: 2405461 - protein, 6 aa, Entamoeba dispar
NIIPPE

SEQ ID NO: 2405462 - protein, 4 aa, Entamoeba dispar
NIPS

SEQ ID NO: 2405463 - protein, 8 aa, Entamoeba dispar
NIPSSISK

SEQ ID NO: 2405464 - protein, 9 aa, Entamoeba dispar
NIPSSVSTL

SEQ ID NO: 2405465 - protein, 5 aa, Entamoeba dispar
NIPTS

SEQ ID NO: 2405466 - protein, 6 aa, Entamoeba dispar
NIPTSV

SEQ ID NO: 2405467 - protein, 19 aa, Entamoeba dispar
NITWSGGKLKPDIDDEKGL

SEQ ID NO: 2405468 - protein, 8 aa, Entamoeba dispar
NKDSTISE

SEQ ID NO: 2405469 - protein, 6 aa, Entamoeba dispar
NKKEIQ

SEQ ID NO: 2405470 - protein, 6 aa, Entamoeba dispar
NKLPKE

SEQ ID NO: 2405471 - protein, 4 aa, Entamoeba dispar
NKRL

SEQ ID NO: 2405472 - protein, 7 aa, Entamoeba dispar
NKRLRKE

SEQ ID NO: 2405473 - protein, 8 aa, Entamoeba dispar
NLPPQQPI

SEQ ID NO: 2405474 - protein, 11 aa, Entamoeba dispar
NNDDDNGINKR

SEQ ID NO: 2405475 - protein, 11 aa, Entamoeba dispar
NNDISKGLSDQ

SEQ ID NO: 2405476 - protein, 4 aa, Entamoeba dispar
NNQI

SEQ ID NO: 2405477 - protein, 20 aa, Entamoeba dispar
NNQNGSKEEYEKKKEEMEKE

SEQ ID NO: 2405478 - protein, 9 aa, Entamoeba dispar
NPNNPEQVY

SEQ ID NO: 2405479 - protein, 5 aa, Entamoeba dispar
NPTVV

SEQ ID NO: 2405480 - protein, 11 aa, Entamoeba dispar
NQPTSRFSSQT

SEQ ID NO: 2405481 - protein, 22 aa, Entamoeba dispar
NSINDNYDPDAGDEDYTEEDDV

SEQ ID NO: 2405482 - protein, 4 aa, Entamoeba dispar
NSKI

SEQ ID NO: 2405483 - protein, 4 aa, Entamoeba dispar
NSQI

SEQ ID NO: 2405484 - protein, 8 aa, Entamoeba dispar
NVGSSQFQ

SEQ ID NO: 2405485 - protein, 6 aa, Entamoeba dispar
NYGNEI

SEQ ID NO: 2405486 - protein, 7 aa, Entamoeba dispar
PAPYDKM

SEQ ID NO: 2405487 - protein, 4 aa, Entamoeba dispar
PEAT

SEQ ID NO: 2405488 - protein, 7 aa, Entamoeba dispar
PENQNGR

SEQ ID NO: 2405489 - protein, 31 aa, Entamoeba dispar
PEQKKKKKSPKKIQNNDDVNGNKPDDDSKGI

SEQ ID NO: 2405490 - protein, 4 aa, Entamoeba dispar
PEST

SEQ ID NO: 2405491 - protein, 4 aa, Entamoeba dispar
PGHR

SEQ ID NO: 2405492 - protein, 9 aa, Entamoeba dispar
PKNYKRRTV

SEQ ID NO: 2405493 - protein, 8 aa, Entamoeba dispar
PLGSGTYG

SEQ ID NO: 2405494 - protein, 11 aa, Entamoeba dispar
PLGTASHAKGL

SEQ ID NO: 2405495 - protein, 5 aa, Entamoeba dispar
PPNSM

SEQ ID NO: 2405496 - protein, 5 aa, Entamoeba dispar
PRDGS

SEQ ID NO: 2405497 - protein, 5 aa, Entamoeba dispar
PRDQN

SEQ ID NO: 2405498 - protein, 6 aa, Entamoeba dispar
PSDESY

SEQ ID NO: 2405499 - protein, 4 aa, Entamoeba dispar
PSGK

SEQ ID NO: 2405500 - protein, 10 aa, Entamoeba dispar
PSGVSSECKS

SEQ ID NO: 2405501 - protein, 5 aa, Entamoeba dispar
PSQRT

SEQ ID NO: 2405502 - protein, 5 aa, Entamoeba dispar
PSSIS

SEQ ID NO: 2405503 - protein, 5 aa, Entamoeba dispar
PSSIT

SEQ ID NO: 2405504 - protein, 6 aa, Entamoeba dispar
PSSVSK

SEQ ID NO: 2405505 - protein, 24 aa, Entamoeba dispar
PTIDSVEERQRPTGKYVIEWGGII

SEQ ID NO: 2405506 - protein, 6 aa, Entamoeba dispar
PTNITS

SEQ ID NO: 2405507 - protein, 7 aa, Entamoeba dispar
PTTNTRD

SEQ ID NO: 2405508 - protein, 8 aa, Entamoeba dispar
PYSEKTTL

SEQ ID NO: 2405509 - protein, 8 aa, Entamoeba dispar
QAIPGDNV

SEQ ID NO: 2405510 - protein, 8 aa, Entamoeba dispar
QDSSTSYV

SEQ ID NO: 2405511 - protein, 7 aa, Entamoeba dispar
QERYEEI

SEQ ID NO: 2405512 - protein, 7 aa, Entamoeba dispar
QFEQNKY

SEQ ID NO: 2405513 - protein, 9 aa, Entamoeba dispar
QKKAKKEAY

SEQ ID NO: 2405514 - protein, 8 aa, Entamoeba dispar
QLENNKNK

SEQ ID NO: 2405515 - protein, 13 aa, Entamoeba dispar
QLNQTIQQHNKEL

SEQ ID NO: 2405516 - protein, 15 aa, Entamoeba dispar
QNDMNSYKKGGQIIN

SEQ ID NO: 2405517 - protein, 5 aa, Entamoeba dispar
QNETY

SEQ ID NO: 2405518 - protein, 15 aa, Entamoeba dispar
QNQIEKDKIEKKEFK

SEQ ID NO: 2405519 - protein, 8 aa, Entamoeba dispar
QQQEDQIV

SEQ ID NO: 2405520 - protein, 14 aa, Entamoeba dispar
QRSMKEEDHPFAQA

SEQ ID NO: 2405521 - protein, 9 aa, Entamoeba dispar
QSFFPEPNH

SEQ ID NO: 2405522 - protein, 29 aa, Entamoeba dispar
QSLQEKTITYTTRGTQTLLPDTNYDGISK

SEQ ID NO: 2405523 - protein, 13 aa, Entamoeba dispar
RARRNLKSTMAGN

SEQ ID NO: 2405524 - protein, 7 aa, Entamoeba dispar
REQIKTQ

SEQ ID NO: 2405525 - protein, 11 aa, Entamoeba dispar
REYKRALNATK

SEQ ID NO: 2405526 - protein, 4 aa, Entamoeba dispar
RGGF

SEQ ID NO: 2405527 - protein, 12 aa, Entamoeba dispar
RIASGENVIGTT

SEQ ID NO: 2405528 - protein, 22 aa, Entamoeba dispar
RNGIDKATANVVTNPEGGQNIT

SEQ ID NO: 2405529 - protein, 9 aa, Entamoeba dispar
RQNNKITKQ

SEQ ID NO: 2405530 - protein, 6 aa, Entamoeba dispar
RSGSTF

SEQ ID NO: 2405531 - protein, 5 aa, Entamoeba dispar
RSPAD

SEQ ID NO: 2405532 - protein, 6 aa, Entamoeba dispar
RTGNEI

SEQ ID NO: 2405533 - protein, 13 aa, Entamoeba dispar
RTKEISKTPTKRL

SEQ ID NO: 2405534 - protein, 9 aa, Entamoeba dispar
RTKKAPPIK

SEQ ID NO: 2405535 - protein, 12 aa, Entamoeba dispar
RTNNTTEENKEI

SEQ ID NO: 2405536 - protein, 7 aa, Entamoeba dispar
RTTKNEI

SEQ ID NO: 2405537 - protein, 10 aa, Entamoeba dispar
RVNTNPTRGA

SEQ ID NO: 2405538 - protein, 13 aa, Entamoeba dispar
RYENGRNGKFSVS

SEQ ID NO: 2405539 - protein, 13 aa, Entamoeba dispar
RYNEGKKGMASAE

SEQ ID NO: 2405540 - protein, 8 aa, Entamoeba dispar
SEEKEEKG

SEQ ID NO: 2405541 - protein, 9 aa, Entamoeba dispar
SENGNTQTW

SEQ ID NO: 2405542 - protein, 5 aa, Entamoeba dispar
SEPFQ

SEQ ID NO: 2405543 - protein, 5 aa, Entamoeba dispar
SEPKE

SEQ ID NO: 2405544 - protein, 10 aa, Entamoeba dispar
SESNYDNENF

SEQ ID NO: 2405545 - protein, 5 aa, Entamoeba dispar
SESVS

SEQ ID NO: 2405546 - protein, 7 aa, Entamoeba dispar
SGGYDGE

SEQ ID NO: 2405547 - protein, 13 aa, Entamoeba dispar
SGKTKETCKGRDC

SEQ ID NO: 2405548 - protein, 5 aa, Entamoeba dispar
SISEI

SEQ ID NO: 2405549 - protein, 5 aa, Entamoeba dispar
SKGVS

SEQ ID NO: 2405550 - protein, 7 aa, Entamoeba dispar
SKQTRIN

SEQ ID NO: 2405551 - protein, 6 aa, Entamoeba dispar
SNIEKN

SEQ ID NO: 2405552 - protein, 6 aa, Entamoeba dispar
SNPFST

SEQ ID NO: 2405553 - protein, 15 aa, Entamoeba dispar
SNTYYSEPSYDEFSS

SEQ ID NO: 2405554 - protein, 6 aa, Entamoeba dispar
SQKDDV

SEQ ID NO: 2405555 - protein, 14 aa, Entamoeba dispar
SQKVDVSKVDTTGV

SEQ ID NO: 2405556 - protein, 8 aa, Entamoeba dispar
SQYRTRQD

SEQ ID NO: 2405557 - protein, 18 aa, Entamoeba dispar
SRKSNQIKKTSYAKSAQI

SEQ ID NO: 2405558 - protein, 14 aa, Entamoeba dispar
SRNKKTACEQTEAL

SEQ ID NO: 2405559 - protein, 7 aa, Entamoeba dispar
SSIDDNN

SEQ ID NO: 2405560 - protein, 6 aa, Entamoeba dispar
SSISEL

SEQ ID NO: 2405561 - protein, 6 aa, Entamoeba dispar
SSISKI

SEQ ID NO: 2405562 - protein, 6 aa, Entamoeba dispar
SSISKL

SEQ ID NO: 2405563 - protein, 5 aa, Entamoeba dispar
SSITS

SEQ ID NO: 2405564 - protein, 9 aa, Entamoeba dispar
SSNARLTAN

SEQ ID NO: 2405565 - protein, 14 aa, Entamoeba dispar
SSVSSYSSANEKTL

SEQ ID NO: 2405566 - protein, 7 aa, Entamoeba dispar
SSYDNEI

SEQ ID NO: 2405567 - protein, 13 aa, Entamoeba dispar
STEEDSKPAKVNA

SEQ ID NO: 2405568 - protein, 4 aa, Entamoeba dispar
STIS

SEQ ID NO: 2405569 - protein, 12 aa, Entamoeba dispar
STKVEKLQRASL

SEQ ID NO: 2405570 - protein, 6 aa, Entamoeba dispar
SVSTTK

SEQ ID NO: 2405571 - protein, 11 aa, Entamoeba dispar
SVTPPERPVDK

SEQ ID NO: 2405572 - protein, 8 aa, Entamoeba dispar
SWNSNRMA

SEQ ID NO: 2405573 - protein, 4 aa, Entamoeba dispar
SYAD

SEQ ID NO: 2405574 - protein, 9 aa, Entamoeba dispar
TAGQEDYDR

SEQ ID NO: 2405575 - protein, 19 aa, Entamoeba dispar
TAVEEKAAPVAEEKKADKT

SEQ ID NO: 2405576 - protein, 7 aa, Entamoeba dispar
TDGIYPK

SEQ ID NO: 2405577 - protein, 8 aa, Entamoeba dispar
TDINKEYR

SEQ ID NO: 2405578 - protein, 4 aa, Entamoeba dispar
TDKL

SEQ ID NO: 2405579 - protein, 14 aa, Entamoeba dispar
TEAKSSESDYALTQ

SEQ ID NO: 2405580 - protein, 8 aa, Entamoeba dispar
TEEKEEKG

SEQ ID NO: 2405581 - protein, 11 aa, Entamoeba dispar
TETKKEDKAAF

SEQ ID NO: 2405582 - protein, 8 aa, Entamoeba dispar
TKGVEESI

SEQ ID NO: 2405583 - protein, 7 aa, Entamoeba dispar
TKGVSAN

SEQ ID NO: 2405584 - protein, 5 aa, Entamoeba dispar
TKTGK

SEQ ID NO: 2405585 - protein, 19 aa, Entamoeba dispar
TPGFGDTRGIEHDKEITKQ

SEQ ID NO: 2405586 - protein, 4 aa, Entamoeba dispar
TPGR

SEQ ID NO: 2405587 - protein, 14 aa, Entamoeba dispar
TPTEDEDNEPNPDI

SEQ ID NO: 2405588 - protein, 19 aa, Entamoeba dispar
TQQINTNSRQSEIESSIET

SEQ ID NO: 2405589 - protein, 8 aa, Entamoeba dispar
TQYDRNKY

SEQ ID NO: 2405590 - protein, 15 aa, Entamoeba dispar
TRRGTEDFCTGTSEG

SEQ ID NO: 2405591 - protein, 4 aa, Entamoeba dispar
TSIT

SEQ ID NO: 2405592 - protein, 5 aa, Entamoeba dispar
TTKPK

SEQ ID NO: 2405593 - protein, 7 aa, Entamoeba dispar
TVGGDGS

SEQ ID NO: 2405594 - protein, 8 aa, Entamoeba dispar
TYTDNQPG

SEQ ID NO: 2405595 - protein, 7 aa, Entamoeba dispar
VASRGLD

SEQ ID NO: 2405596 - protein, 5 aa, Entamoeba dispar
VETIK

SEQ ID NO: 2405597 - protein, 12 aa, Entamoeba dispar
VFGKGNVAHPRD

SEQ ID NO: 2405598 - protein, 8 aa, Entamoeba dispar
VGANEGTM

SEQ ID NO: 2405599 - protein, 7 aa, Entamoeba dispar
VGSDVKG

SEQ ID NO: 2405600 - protein, 7 aa, Entamoeba dispar
VNIPTTI

SEQ ID NO: 2405601 - protein, 11 aa, Entamoeba dispar
VPDDGYDGISQ

SEQ ID NO: 2405602 - protein, 6 aa, Entamoeba dispar
VSDRGN

SEQ ID NO: 2405603 - protein, 4 aa, Entamoeba dispar
VSKI

SEQ ID NO: 2405604 - protein, 8 aa, Entamoeba dispar
VSTNASLT

SEQ ID NO: 2405605 - protein, 19 aa, Entamoeba dispar
VTHGRPGVGATHSSKFVPL

SEQ ID NO: 2405606 - protein, 14 aa, Entamoeba dispar
VTPRASNAAAAGKK

SEQ ID NO: 2405607 - protein, 14 aa, Entamoeba dispar
VTPVASDYRQKTND

SEQ ID NO: 2405608 - protein, 9 aa, Entamoeba dispar
YEEQESSAV

SEQ ID NO: 2405609 - protein, 17 aa, Entamoeba dispar
YETNGKTLTEISEGKKI

SEQ ID NO: 2405610 - protein, 16 aa, Entamoeba dispar
YKKTRGSSKTVKRKRI

SEQ ID NO: 2405611 - protein, 11 aa, Entamoeba dispar
YKTPKVPYERE

SEQ ID NO: 2405612 - protein, 8 aa, Entamoeba dispar
YNDSTKRL

SEQ ID NO: 2405613 - protein, 10 aa, Entamoeba dispar
YPDDPNRSGF

SEQ ID NO: 2405614 - protein, 4 aa, Entamoeba dispar
YQRI

SEQ ID NO: 2405615 - protein, 4 aa, Entamoeba dispar
YRDV

SEQ ID NO: 2405616 - protein, 5 aa, Entamoeba dispar
YVNEN

SEQ ID NO: 2405617 - protein, 7 aa, Entamoeba dispar
AAAPGYF

SEQ ID NO: 2405618 - protein, 37 aa, Entamoeba dispar
AAATAVATETKTEEKKEEAPAAKEEEEEEDFGGFGDL

SEQ ID NO: 2405619 - protein, 33 aa, Entamoeba dispar
AAGKKGALTKPKKSSGGKAPKKSWSKTKVKEKL

SEQ ID NO: 2405620 - protein, 9 aa, Entamoeba dispar
AAQSLEPET

SEQ ID NO: 2405621 - protein, 4 aa, Entamoeba dispar
AARE

SEQ ID NO: 2405622 - protein, 6 aa, Entamoeba dispar
AASTDF

SEQ ID NO: 2405623 - protein, 7 aa, Entamoeba dispar
ADGTKQT

SEQ ID NO: 2405624 - protein, 9 aa, Entamoeba dispar
ADRLQTGMR

SEQ ID NO: 2405625 - protein, 7 aa, Entamoeba dispar
ADSIDSQ

SEQ ID NO: 2405626 - protein, 11 aa, Entamoeba dispar
ADTVNNDPEVG

SEQ ID NO: 2405627 - protein, 5 aa, Entamoeba dispar
AEADP

SEQ ID NO: 2405628 - protein, 5 aa, Entamoeba dispar
AEAEG

SEQ ID NO: 2405629 - protein, 9 aa, Entamoeba dispar
AEDRVKEGR

SEQ ID NO: 2405630 - protein, 8 aa, Entamoeba dispar
AERDPAQI

SEQ ID NO: 2405631 - protein, 5 aa, Entamoeba dispar
AETLQ

SEQ ID NO: 2405632 - protein, 18 aa, Entamoeba dispar
AFGKTVEEDFAKKQYEAK

SEQ ID NO: 2405633 - protein, 7 aa, Entamoeba dispar
AGATSNV

SEQ ID NO: 2405634 - protein, 6 aa, Entamoeba dispar
AGEDQE

SEQ ID NO: 2405635 - protein, 10 aa, Entamoeba dispar
AGENTREYNS

SEQ ID NO: 2405636 - protein, 8 aa, Entamoeba dispar
AGGQAKDF

SEQ ID NO: 2405637 - protein, 8 aa, Entamoeba dispar
AGKDEAKY

SEQ ID NO: 2405638 - protein, 5 aa, Entamoeba dispar
AGKDG

SEQ ID NO: 2405639 - protein, 8 aa, Entamoeba dispar
AGQEEYDR

SEQ ID NO: 2405640 - protein, 7 aa, Entamoeba dispar
AGQERFR

SEQ ID NO: 2405641 - protein, 7 aa, Entamoeba dispar
AGRFGTK

SEQ ID NO: 2405642 - protein, 7 aa, Entamoeba dispar
AGRGRTG

SEQ ID NO: 2405643 - protein, 7 aa, Entamoeba dispar
AGVNPEG

SEQ ID NO: 2405644 - protein, 19 aa, Entamoeba dispar
AIKPMDDDEEDEKNRKRYR

SEQ ID NO: 2405645 - protein, 11 aa, Entamoeba dispar
AITSGKRPPII

SEQ ID NO: 2405646 - protein, 6 aa, Entamoeba dispar
AIYDDD

SEQ ID NO: 2405647 - protein, 6 aa, Entamoeba dispar
AKAAEI

SEQ ID NO: 2405648 - protein, 10 aa, Entamoeba dispar
AKAAQARGDN

SEQ ID NO: 2405649 - protein, 16 aa, Entamoeba dispar
AKAKKWKKNGKGDHGE

SEQ ID NO: 2405650 - protein, 14 aa, Entamoeba dispar
AKAQAAHKAQYAAK

SEQ ID NO: 2405651 - protein, 8 aa, Entamoeba dispar
AKEKQDIS

SEQ ID NO: 2405652 - protein, 7 aa, Entamoeba dispar
AKEPGKH

SEQ ID NO: 2405653 - protein, 8 aa, Entamoeba dispar
AKIDKSSI

SEQ ID NO: 2405654 - protein, 8 aa, Entamoeba dispar
AKNDIGKE

SEQ ID NO: 2405655 - protein, 8 aa, Entamoeba dispar
AKSLPKID

SEQ ID NO: 2405656 - protein, 6 aa, Entamoeba dispar
AKTLEE

SEQ ID NO: 2405657 - protein, 6 aa, Entamoeba dispar
AKTNEV

SEQ ID NO: 2405658 - protein, 10 aa, Entamoeba dispar
AKVGSDQGFP

SEQ ID NO: 2405659 - protein, 4 aa, Entamoeba dispar
AKYE

SEQ ID NO: 2405660 - protein, 13 aa, Entamoeba dispar
ALTPDNDKETSDL

SEQ ID NO: 2405661 - protein, 10 aa, Entamoeba dispar
ANDGKPTVQT

SEQ ID NO: 2405662 - protein, 4 aa, Entamoeba dispar
ANEP

SEQ ID NO: 2405663 - protein, 5 aa, Entamoeba dispar
ANHLG

SEQ ID NO: 2405664 - protein, 6 aa, Entamoeba dispar
ANPIPI

SEQ ID NO: 2405665 - protein, 10 aa, Entamoeba dispar
ANYGGTSMDA

SEQ ID NO: 2405666 - protein, 17 aa, Entamoeba dispar
APTSARHISQSSSPTTE

SEQ ID NO: 2405667 - protein, 5 aa, Entamoeba dispar
AQEIG

SEQ ID NO: 2405668 - protein, 5 aa, Entamoeba dispar
AQKAI

SEQ ID NO: 2405669 - protein, 10 aa, Entamoeba dispar
AQQSKSDLRF

SEQ ID NO: 2405670 - protein, 4 aa, Entamoeba dispar
AREN

SEQ ID NO: 2405671 - protein, 5 aa, Entamoeba dispar
ARENK

SEQ ID NO: 2405672 - protein, 19 aa, Entamoeba dispar
ARPTNPERARRLGYKPKDG

SEQ ID NO: 2405673 - protein, 6 aa, Entamoeba dispar
ASAPIN

SEQ ID NO: 2405674 - protein, 5 aa, Entamoeba dispar
ASCTT

SEQ ID NO: 2405675 - protein, 7 aa, Entamoeba dispar
ASDDNTV

SEQ ID NO: 2405676 - protein, 7 aa, Entamoeba dispar
ASDNDFV

SEQ ID NO: 2405677 - protein, 9 aa, Entamoeba dispar
ASERGNLKH

SEQ ID NO: 2405678 - protein, 5 aa, Entamoeba dispar
ASFKT

SEQ ID NO: 2405679 - protein, 22 aa, Entamoeba dispar
ASPREDSTRVGTGGNAKRQAVD

SEQ ID NO: 2405680 - protein, 7 aa, Entamoeba dispar
ASQAFTG

SEQ ID NO: 2405681 - protein, 8 aa, Entamoeba dispar
ATAGADSY

SEQ ID NO: 2405682 - protein, 8 aa, Entamoeba dispar
ATDGKGVD

SEQ ID NO: 2405683 - protein, 6 aa, Entamoeba dispar
ATGSEM

SEQ ID NO: 2405684 - protein, 13 aa, Entamoeba dispar
ATNGDTMLGGEDF

SEQ ID NO: 2405685 - protein, 4 aa, Entamoeba dispar
ATNN

SEQ ID NO: 2405686 - protein, 8 aa, Entamoeba dispar
ATPNERQQ

SEQ ID NO: 2405687 - protein, 8 aa, Entamoeba dispar
ATSGNTGI

SEQ ID NO: 2405688 - protein, 20 aa, Entamoeba dispar
ATTATQKTVDGPSGKDWRAG

SEQ ID NO: 2405689 - protein, 12 aa, Entamoeba dispar
AVDNAKAKGLNT

SEQ ID NO: 2405690 - protein, 10 aa, Entamoeba dispar
AYTGNEQNNK

SEQ ID NO: 2405691 - protein, 8 aa, Entamoeba dispar
CATNGDGL

SEQ ID NO: 2405692 - protein, 7 aa, Entamoeba dispar
CDNDKYT

SEQ ID NO: 2405693 - protein, 6 aa, Entamoeba dispar
CEPPSK

SEQ ID NO: 2405694 - protein, 6 aa, Entamoeba dispar
CFEGST

SEQ ID NO: 2405695 - protein, 7 aa, Entamoeba dispar
CNIPETT

SEQ ID NO: 2405696 - protein, 4 aa, Entamoeba dispar
CNKE

SEQ ID NO: 2405697 - protein, 11 aa, Entamoeba dispar
CSKTRETNVEG

SEQ ID NO: 2405698 - protein, 19 aa, Entamoeba dispar
CTAEGEGLENAETKTPAPF

SEQ ID NO: 2405699 - protein, 5 aa, Entamoeba dispar
DATTV

SEQ ID NO: 2405700 - protein, 11 aa, Entamoeba dispar
DDDITQQKNSM

SEQ ID NO: 2405701 - protein, 31 aa, Entamoeba dispar
DDISNNNGFSKSLNDGRRKQKSSKYEKTQRK

SEQ ID NO: 2405702 - protein, 4 aa, Entamoeba dispar
DDLQ

SEQ ID NO: 2405703 - protein, 5 aa, Entamoeba dispar
DDNDN

SEQ ID NO: 2405704 - protein, 10 aa, Entamoeba dispar
DDSQKDRTKK

SEQ ID NO: 2405705 - protein, 14 aa, Entamoeba dispar
DDVSQLSTLNTTNM

SEQ ID NO: 2405706 - protein, 4 aa, Entamoeba dispar
DEDG

SEQ ID NO: 2405707 - protein, 8 aa, Entamoeba dispar
DEDKKKEV

SEQ ID NO: 2405708 - protein, 7 aa, Entamoeba dispar
DEEFDDG

SEQ ID NO: 2405709 - protein, 9 aa, Entamoeba dispar
DEEPIKASN

SEQ ID NO: 2405710 - protein, 8 aa, Entamoeba dispar
DELYNDGK

SEQ ID NO: 2405711 - protein, 7 aa, Entamoeba dispar
DEMGVRS

SEQ ID NO: 2405712 - protein, 8 aa, Entamoeba dispar
DEPVENTP

SEQ ID NO: 2405713 - protein, 6 aa, Entamoeba dispar
DGKSIQ

SEQ ID NO: 2405714 - protein, 7 aa, Entamoeba dispar
DGTEIPH

SEQ ID NO: 2405715 - protein, 10 aa, Entamoeba dispar
DGTVEGACPP

SEQ ID NO: 2405716 - protein, 6 aa, Entamoeba dispar
DHKDGV

SEQ ID NO: 2405717 - protein, 49 aa, Entamoeba dispar
DHPHGGGNHQHVGHPTTLKRSSPPGQKAGKVAARRTGLIRGGNKEGAAD

SEQ ID NO: 2405718 - protein, 8 aa, Entamoeba dispar
DIASTEYY

SEQ ID NO: 2405719 - protein, 10 aa, Entamoeba dispar
DIKKQEKAIN

SEQ ID NO: 2405720 - protein, 4 aa, Entamoeba dispar
DIPT

SEQ ID NO: 2405721 - protein, 5 aa, Entamoeba dispar
DIPTS

SEQ ID NO: 2405722 - protein, 8 aa, Entamoeba dispar
DKCTKEVP

SEQ ID NO: 2405723 - protein, 13 aa, Entamoeba dispar
DKEDIPADANGNG

SEQ ID NO: 2405724 - protein, 7 aa, Entamoeba dispar
DKGVTYN

SEQ ID NO: 2405725 - protein, 6 aa, Entamoeba dispar
DKINKR

SEQ ID NO: 2405726 - protein, 16 aa, Entamoeba dispar
DKKTKAPRKARKEHKK

SEQ ID NO: 2405727 - protein, 9 aa, Entamoeba dispar
DKRLGDDGG

SEQ ID NO: 2405728 - protein, 6 aa, Entamoeba dispar
DKTKGL

SEQ ID NO: 2405729 - protein, 8 aa, Entamoeba dispar
DKVNNNQD

SEQ ID NO: 2405730 - protein, 15 aa, Entamoeba dispar
DLERQRAEKVEEGKK

SEQ ID NO: 2405731 - protein, 8 aa, Entamoeba dispar
DMLDPENT

SEQ ID NO: 2405732 - protein, 15 aa, Entamoeba dispar
DNGSAPSINPETVYD

SEQ ID NO: 2405733 - protein, 5 aa, Entamoeba dispar
DNNTE

SEQ ID NO: 2405734 - protein, 8 aa, Entamoeba dispar
DNPNDENM

SEQ ID NO: 2405735 - protein, 5 aa, Entamoeba dispar
DNSFN

SEQ ID NO: 2405736 - protein, 18 aa, Entamoeba dispar
DNTEARAKHTGGRILGFF

SEQ ID NO: 2405737 - protein, 5 aa, Entamoeba dispar
DPIDE

SEQ ID NO: 2405738 - protein, 8 aa, Entamoeba dispar
DPQGNEVP

SEQ ID NO: 2405739 - protein, 4 aa, Entamoeba dispar
DPTL

SEQ ID NO: 2405740 - protein, 15 aa, Entamoeba dispar
DQKGSKIEKDKEQTL

SEQ ID NO: 2405741 - protein, 13 aa, Entamoeba dispar
DQKQAPKSTGTMS

SEQ ID NO: 2405742 - protein, 6 aa, Entamoeba dispar
DQSNER

SEQ ID NO: 2405743 - protein, 5 aa, Entamoeba dispar
DRHSD

SEQ ID NO: 2405744 - protein, 9 aa, Entamoeba dispar
DRKTKKSLG

SEQ ID NO: 2405745 - protein, 6 aa, Entamoeba dispar
DRPNEY

SEQ ID NO: 2405746 - protein, 7 aa, Entamoeba dispar
DRTTYES

SEQ ID NO: 2405747 - protein, 13 aa, Entamoeba dispar
DSATEHDNVSKQQ

SEQ ID NO: 2405748 - protein, 10 aa, Entamoeba dispar
DSGKSTTTGH

SEQ ID NO: 2405749 - protein, 6 aa, Entamoeba dispar
DSIDDF

SEQ ID NO: 2405750 - protein, 4 aa, Entamoeba dispar
DSST

SEQ ID NO: 2405751 - protein, 8 aa, Entamoeba dispar
DSYRDYKE

SEQ ID NO: 2405752 - protein, 27 aa, Entamoeba dispar
DTCNEESTQSVDEVQANISEVQNDINK

SEQ ID NO: 2405753 - protein, 7 aa, Entamoeba dispar
DTETDGV

SEQ ID NO: 2405754 - protein, 6 aa, Entamoeba dispar
DTHRSG

SEQ ID NO: 2405755 - protein, 11 aa, Entamoeba dispar
DTRKENEGKNI

SEQ ID NO: 2405756 - protein, 7 aa, Entamoeba dispar
DTYDDEQ

SEQ ID NO: 2405757 - protein, 6 aa, Entamoeba dispar
DVSEGS

SEQ ID NO: 2405758 - protein, 10 aa, Entamoeba dispar
DVTDATSKVG

SEQ ID NO: 2405759 - protein, 13 aa, Entamoeba dispar
DYNDGYDDPYDSF

SEQ ID NO: 2405760 - protein, 6 aa, Entamoeba dispar
DYSSDG

SEQ ID NO: 2405761 - protein, 12 aa, Entamoeba dispar
EAERRKEEEKHQ

SEQ ID NO: 2405762 - protein, 5 aa, Entamoeba dispar
EAETS

SEQ ID NO: 2405763 - protein, 8 aa, Entamoeba dispar
EAHIKGGA

SEQ ID NO: 2405764 - protein, 6 aa, Entamoeba dispar
EDGDQD

SEQ ID NO: 2405765 - protein, 6 aa, Entamoeba dispar
EDPQLD

SEQ ID NO: 2405766 - protein, 11 aa, Entamoeba dispar
EEDEEFDDGRI

SEQ ID NO: 2405767 - protein, 14 aa, Entamoeba dispar
EEEKENKMEEEKKY

SEQ ID NO: 2405768 - protein, 30 aa, Entamoeba dispar
EEEMKEKGEMDEKTKKRVIKNTKRRRDINK

SEQ ID NO: 2405769 - protein, 4 aa, Entamoeba dispar
EEIE

SEQ ID NO: 2405770 - protein, 4 aa, Entamoeba dispar
EEKY

SEQ ID NO: 2405771 - protein, 7 aa, Entamoeba dispar
EEPEEAY

SEQ ID NO: 2405772 - protein, 8 aa, Entamoeba dispar
EEQLKTQC

SEQ ID NO: 2405773 - protein, 21 aa, Entamoeba dispar
EERFYSDDPDMRQSKKAFENT

SEQ ID NO: 2405774 - protein, 4 aa, Entamoeba dispar
EESI

SEQ ID NO: 2405775 - protein, 9 aa, Entamoeba dispar
EESSALNET

SEQ ID NO: 2405776 - protein, 5 aa, Entamoeba dispar
EEVGE

SEQ ID NO: 2405777 - protein, 11 aa, Entamoeba dispar
EGEFDEKKAEN

SEQ ID NO: 2405778 - protein, 4 aa, Entamoeba dispar
EGEI

SEQ ID NO: 2405779 - protein, 21 aa, Entamoeba dispar
EGIQKKTKKNKEEKKPHKRKN

SEQ ID NO: 2405780 - protein, 4 aa, Entamoeba dispar
EGKE

SEQ ID NO: 2405781 - protein, 4 aa, Entamoeba dispar
EGNE

SEQ ID NO: 2405782 - protein, 8 aa, Entamoeba dispar
EGTTKSLD

SEQ ID NO: 2405783 - protein, 5 aa, Entamoeba dispar
EGYAI

SEQ ID NO: 2405784 - protein, 6 aa, Entamoeba dispar
EHDEDK

SEQ ID NO: 2405785 - protein, 10 aa, Entamoeba dispar
EHDPGRGAPL

SEQ ID NO: 2405786 - protein, 4 aa, Entamoeba dispar
EHPK

SEQ ID NO: 2405787 - protein, 8 aa, Entamoeba dispar
EHQKSEFE

SEQ ID NO: 2405788 - protein, 12 aa, Entamoeba dispar
EIEIGEGEEIEV

SEQ ID NO: 2405789 - protein, 10 aa, Entamoeba dispar
EIRETPNKKH

SEQ ID NO: 2405790 - protein, 10 aa, Entamoeba dispar
EKDESKLQEA

SEQ ID NO: 2405791 - protein, 5 aa, Entamoeba dispar
EKEKF

SEQ ID NO: 2405792 - protein, 8 aa, Entamoeba dispar
EKGISRGT

SEQ ID NO: 2405793 - protein, 7 aa, Entamoeba dispar
EKGKDLE

SEQ ID NO: 2405794 - protein, 18 aa, Entamoeba dispar
EKKGKVEQRDKDKSYQNI

SEQ ID NO: 2405795 - protein, 9 aa, Entamoeba dispar
EKPFQEKKE

SEQ ID NO: 2405796 - protein, 15 aa, Entamoeba dispar
EKYNDVKAKSKRERQ

SEQ ID NO: 2405797 - protein, 5 aa, Entamoeba dispar
ELPPN

SEQ ID NO: 2405798 - protein, 16 aa, Entamoeba dispar
ELSRYEKRVNASKRNN

SEQ ID NO: 2405799 - protein, 8 aa, Entamoeba dispar
EMKEEAKK

SEQ ID NO: 2405800 - protein, 5 aa, Entamoeba dispar
ENDEL

SEQ ID NO: 2405801 - protein, 5 aa, Entamoeba dispar
ENELN

SEQ ID NO: 2405802 - protein, 5 aa, Entamoeba dispar
ENGGY

SEQ ID NO: 2405803 - protein, 6 aa, Entamoeba dispar
ENGIEY

SEQ ID NO: 2405804 - protein, 4 aa, Entamoeba dispar
ENIT

SEQ ID NO: 2405805 - protein, 13 aa, Entamoeba dispar
ENKYNKEPSECVV

SEQ ID NO: 2405806 - protein, 4 aa, Entamoeba dispar
ENLN

SEQ ID NO: 2405807 - protein, 18 aa, Entamoeba dispar
ENNEEVEQRDKDKSYQNI

SEQ ID NO: 2405808 - protein, 7 aa, Entamoeba dispar
ENNEVEE

SEQ ID NO: 2405809 - protein, 4 aa, Entamoeba dispar
ENQT

SEQ ID NO: 2405810 - protein, 4 aa, Entamoeba dispar
ENSG

SEQ ID NO: 2405811 - protein, 7 aa, Entamoeba dispar
EPSAAAY

SEQ ID NO: 2405812 - protein, 5 aa, Entamoeba dispar
EPTNG

SEQ ID NO: 2405813 - protein, 6 aa, Entamoeba dispar
EQGTHQ

SEQ ID NO: 2405814 - protein, 4 aa, Entamoeba dispar
EQIE

SEQ ID NO: 2405815 - protein, 5 aa, Entamoeba dispar
EQQQV

SEQ ID NO: 2405816 - protein, 8 aa, Entamoeba dispar
EQRREEAQ

SEQ ID NO: 2405817 - protein, 7 aa, Entamoeba dispar
EQTNPNQ

SEQ ID NO: 2405818 - protein, 11 aa, Entamoeba dispar
ERIGRSTEETI

SEQ ID NO: 2405819 - protein, 4 aa, Entamoeba dispar
ERIQ

SEQ ID NO: 2405820 - protein, 7 aa, Entamoeba dispar
ERNNGPT

SEQ ID NO: 2405821 - protein, 4 aa, Entamoeba dispar
ERSL

SEQ ID NO: 2405822 - protein, 13 aa, Entamoeba dispar
ESASRKSKVLPET

SEQ ID NO: 2405823 - protein, 8 aa, Entamoeba dispar
ESATFKTE

SEQ ID NO: 2405824 - protein, 6 aa, Entamoeba dispar
ESEADV

SEQ ID NO: 2405825 - protein, 5 aa, Entamoeba dispar
ESGKE

SEQ ID NO: 2405826 - protein, 7 aa, Entamoeba dispar
ESHEKGK

SEQ ID NO: 2405827 - protein, 4 aa, Entamoeba dispar
ESIN

SEQ ID NO: 2405828 - protein, 9 aa, Entamoeba dispar
ESKPGDRGI

SEQ ID NO: 2405829 - protein, 6 aa, Entamoeba dispar
ESLPPP

SEQ ID NO: 2405830 - protein, 14 aa, Entamoeba dispar
ESSGGNQNLGGNDF

SEQ ID NO: 2405831 - protein, 4 aa, Entamoeba dispar
ESVG

SEQ ID NO: 2405832 - protein, 4 aa, Entamoeba dispar
ESYK

SEQ ID NO: 2405833 - protein, 16 aa, Entamoeba dispar
ETDTERFRKDMEEESV

SEQ ID NO: 2405834 - protein, 9 aa, Entamoeba dispar
ETGSGKTTI

SEQ ID NO: 2405835 - protein, 4 aa, Entamoeba dispar
ETRM

SEQ ID NO: 2405836 - protein, 6 aa, Entamoeba dispar
ETTTTL

SEQ ID NO: 2405837 - protein, 4 aa, Entamoeba dispar
EVDG

SEQ ID NO: 2405838 - protein, 8 aa, Entamoeba dispar
EVSETSYS

SEQ ID NO: 2405839 - protein, 5 aa, Entamoeba dispar
EVYGN

SEQ ID NO: 2405840 - protein, 7 aa, Entamoeba dispar
EWNNGTK

SEQ ID NO: 2405841 - protein, 4 aa, Entamoeba dispar
EYEN

SEQ ID NO: 2405842 - protein, 4 aa, Entamoeba dispar
EYKE

SEQ ID NO: 2405843 - protein, 13 aa, Entamoeba dispar
EYKKEEPELSKEF

SEQ ID NO: 2405844 - protein, 4 aa, Entamoeba dispar
EYTK

SEQ ID NO: 2405845 - protein, 9 aa, Entamoeba dispar
FEEEKNYRP

SEQ ID NO: 2405846 - protein, 5 aa, Entamoeba dispar
FETKV

SEQ ID NO: 2405847 - protein, 4 aa, Entamoeba dispar
FGQT

SEQ ID NO: 2405848 - protein, 8 aa, Entamoeba dispar
FKSEKRKL

SEQ ID NO: 2405849 - protein, 5 aa, Entamoeba dispar
FKSTV

SEQ ID NO: 2405850 - protein, 8 aa, Entamoeba dispar
FNDRQREA

SEQ ID NO: 2405851 - protein, 14 aa, Entamoeba dispar
FNEETKGNNTNTLF

SEQ ID NO: 2405852 - protein, 8 aa, Entamoeba dispar
FNHNGKEE

SEQ ID NO: 2405853 - protein, 10 aa, Entamoeba dispar
FPSTTRTAQE

SEQ ID NO: 2405854 - protein, 6 aa, Entamoeba dispar
FRNSKT

SEQ ID NO: 2405855 - protein, 4 aa, Entamoeba dispar
FTEK

SEQ ID NO: 2405856 - protein, 5 aa, Entamoeba dispar
GAIEE

SEQ ID NO: 2405857 - protein, 6 aa, Entamoeba dispar
GATNNV

SEQ ID NO: 2405858 - protein, 7 aa, Entamoeba dispar
GAVGKSA

SEQ ID NO: 2405859 - protein, 8 aa, Entamoeba dispar
GCGKSTSI

SEQ ID NO: 2405860 - protein, 32 aa, Entamoeba dispar
GDAAAGASLGPKVGPLGLNPKKTGDDLAKSTL

SEQ ID NO: 2405861 - protein, 14 aa, Entamoeba dispar
GDKLVGSKNPRYLQ

SEQ ID NO: 2405862 - protein, 11 aa, Entamoeba dispar
GDLTEADQSNN

SEQ ID NO: 2405863 - protein, 14 aa, Entamoeba dispar
GDRGSQLSGGQKQR

SEQ ID NO: 2405864 - protein, 4 aa, Entamoeba dispar
GDYE

SEQ ID NO: 2405865 - protein, 6 aa, Entamoeba dispar
GEDPQI

SEQ ID NO: 2405866 - protein, 9 aa, Entamoeba dispar
GEETQVPTQ

SEQ ID NO: 2405867 - protein, 6 aa, Entamoeba dispar
GEGHYE

SEQ ID NO: 2405868 - protein, 5 aa, Entamoeba dispar
GEGIV

SEQ ID NO: 2405869 - protein, 6 aa, Entamoeba dispar
GEHEHY

SEQ ID NO: 2405870 - protein, 6 aa, Entamoeba dispar
GEKKEV

SEQ ID NO: 2405871 - protein, 4 aa, Entamoeba dispar
GELN

SEQ ID NO: 2405872 - protein, 7 aa, Entamoeba dispar
GFQGNEK

SEQ ID NO: 2405873 - protein, 8 aa, Entamoeba dispar
GGCDKDGF

SEQ ID NO: 2405874 - protein, 9 aa, Entamoeba dispar
GGGRTEKPI

SEQ ID NO: 2405875 - protein, 4 aa, Entamoeba dispar
GGGT

SEQ ID NO: 2405876 - protein, 6 aa, Entamoeba dispar
GGGTTD

SEQ ID NO: 2405877 - protein, 10 aa, Entamoeba dispar
GGHFGRNDPD

SEQ ID NO: 2405878 - protein, 8 aa, Entamoeba dispar
GGIKEKSI

SEQ ID NO: 2405879 - protein, 6 aa, Entamoeba dispar
GGSIAE

SEQ ID NO: 2405880 - protein, 10 aa, Entamoeba dispar
GGSIKKNGVY

SEQ ID NO: 2405881 - protein, 6 aa, Entamoeba dispar
GGSWKS

SEQ ID NO: 2405882 - protein, 4 aa, Entamoeba dispar
GIPD

SEQ ID NO: 2405883 - protein, 5 aa, Entamoeba dispar
GIQNE

SEQ ID NO: 2405884 - protein, 12 aa, Entamoeba dispar
GITPPTPRLNQQ

SEQ ID NO: 2405885 - protein, 6 aa, Entamoeba dispar
GKCGEN

SEQ ID NO: 2405886 - protein, 18 aa, Entamoeba dispar
GKHRKQRGGRGNAGGQHH

SEQ ID NO: 2405887 - protein, 7 aa, Entamoeba dispar
GKNSGKK

SEQ ID NO: 2405888 - protein, 10 aa, Entamoeba dispar
GKPSESFSDT

SEQ ID NO: 2405889 - protein, 6 aa, Entamoeba dispar
GKPSWS

SEQ ID NO: 2405890 - protein, 14 aa, Entamoeba dispar
GKQQKRIDDDNKNL

SEQ ID NO: 2405891 - protein, 5 aa, Entamoeba dispar
GKSKQ

SEQ ID NO: 2405892 - protein, 8 aa, Entamoeba dispar
GLTPGGRV

SEQ ID NO: 2405893 - protein, 17 aa, Entamoeba dispar
GNAGNPRLSKNDAALDP

SEQ ID NO: 2405894 - protein, 6 aa, Entamoeba dispar
GNDINK

SEQ ID NO: 2405895 - protein, 17 aa, Entamoeba dispar
GNGEITEKGEIKEDIQG

SEQ ID NO: 2405896 - protein, 9 aa, Entamoeba dispar
GNKESDIEI

SEQ ID NO: 2405897 - protein, 5 aa, Entamoeba dispar
GNKKI

SEQ ID NO: 2405898 - protein, 5 aa, Entamoeba dispar
GNPAH

SEQ ID NO: 2405899 - protein, 5 aa, Entamoeba dispar
GNQNQ

SEQ ID NO: 2405900 - protein, 7 aa, Entamoeba dispar
GPPGCGK

SEQ ID NO: 2405901 - protein, 10 aa, Entamoeba dispar
GPPGTGKTTV

SEQ ID NO: 2405902 - protein, 5 aa, Entamoeba dispar
GQAGE

SEQ ID NO: 2405903 - protein, 13 aa, Entamoeba dispar
GQEVDASSLGDEF

SEQ ID NO: 2405904 - protein, 7 aa, Entamoeba dispar
GQGSSLE

SEQ ID NO: 2405905 - protein, 21 aa, Entamoeba dispar
GQHTKTTGRRGRTVGVSRTKG

SEQ ID NO: 2405906 - protein, 8 aa, Entamoeba dispar
GQKTKEEY

SEQ ID NO: 2405907 - protein, 9 aa, Entamoeba dispar
GRERKEEKY

SEQ ID NO: 2405908 - protein, 8 aa, Entamoeba dispar
GRKADYEK

SEQ ID NO: 2405909 - protein, 5 aa, Entamoeba dispar
GSGCG

SEQ ID NO: 2405910 - protein, 4 aa, Entamoeba dispar
GSII

SEQ ID NO: 2405911 - protein, 10 aa, Entamoeba dispar
GSIKKNGVYE

SEQ ID NO: 2405912 - protein, 6 aa, Entamoeba dispar
GSLDEI

SEQ ID NO: 2405913 - protein, 6 aa, Entamoeba dispar
GSMYGE

SEQ ID NO: 2405914 - protein, 4 aa, Entamoeba dispar
GSSV

SEQ ID NO: 2405915 - protein, 8 aa, Entamoeba dispar
GTADVGGS

SEQ ID NO: 2405916 - protein, 17 aa, Entamoeba dispar
GTGEFEAGISKNGQTRE

SEQ ID NO: 2405917 - protein, 5 aa, Entamoeba dispar
GTPDV

SEQ ID NO: 2405918 - protein, 8 aa, Entamoeba dispar
GTPDYTAP

SEQ ID NO: 2405919 - protein, 8 aa, Entamoeba dispar
GTVEAGEN

SEQ ID NO: 2405920 - protein, 11 aa, Entamoeba dispar
GVGEDGPTHQP

SEQ ID NO: 2405921 - protein, 14 aa, Entamoeba dispar
GVINRGTKRHPTVG

SEQ ID NO: 2405922 - protein, 15 aa, Entamoeba dispar
GVTEKTAIRRYQNNK

SEQ ID NO: 2405923 - protein, 7 aa, Entamoeba dispar
GWDRTSQ

SEQ ID NO: 2405924 - protein, 23 aa, Entamoeba dispar
GWGAHGGGAFSGKDSSKVDRSGA

SEQ ID NO: 2405925 - protein, 10 aa, Entamoeba dispar
GYGSAKATRN

SEQ ID NO: 2405926 - protein, 21 aa, Entamoeba dispar
GYYNSNGNDAYKTLSNTFKNN

SEQ ID NO: 2405927 - protein, 10 aa, Entamoeba dispar
HDANDKSAVI

SEQ ID NO: 2405928 - protein, 9 aa, Entamoeba dispar
HEDPKGRNI

SEQ ID NO: 2405929 - protein, 8 aa, Entamoeba dispar
HGDTNKRW

SEQ ID NO: 2405930 - protein, 7 aa, Entamoeba dispar
HGISNTS

SEQ ID NO: 2405931 - protein, 8 aa, Entamoeba dispar
HGKSTLTD

SEQ ID NO: 2405932 - protein, 5 aa, Entamoeba dispar
HGKTG

SEQ ID NO: 2405933 - protein, 5 aa, Entamoeba dispar
HNNGV

SEQ ID NO: 2405934 - protein, 9 aa, Entamoeba dispar
HNTNVHPRN

SEQ ID NO: 2405935 - protein, 8 aa, Entamoeba dispar
HPYPKSKY

SEQ ID NO: 2405936 - protein, 9 aa, Entamoeba dispar
HQAGSDSLI

SEQ ID NO: 2405937 - protein, 8 aa, Entamoeba dispar
HQYTQTDH

SEQ ID NO: 2405938 - protein, 10 aa, Entamoeba dispar
HSDKLNPPKY

SEQ ID NO: 2405939 - protein, 8 aa, Entamoeba dispar
HSGSSENI

SEQ ID NO: 2405940 - protein, 6 aa, Entamoeba dispar
HSKDEK

SEQ ID NO: 2405941 - protein, 9 aa, Entamoeba dispar
IDGTNTLQD

SEQ ID NO: 2405942 - protein, 18 aa, Entamoeba dispar
IDGTNTLQDNIKQLIEEL

SEQ ID NO: 2405943 - protein, 4 aa, Entamoeba dispar
IDIP

SEQ ID NO: 2405944 - protein, 5 aa, Entamoeba dispar
IDQRT

SEQ ID NO: 2405945 - protein, 6 aa, Entamoeba dispar
IDSNQT

SEQ ID NO: 2405946 - protein, 12 aa, Entamoeba dispar
IDTQRKKNQECL

SEQ ID NO: 2405947 - protein, 4 aa, Entamoeba dispar
IDVN

SEQ ID NO: 2405948 - protein, 7 aa, Entamoeba dispar
IEGEEGK

SEQ ID NO: 2405949 - protein, 8 aa, Entamoeba dispar
IEKDEEET

SEQ ID NO: 2405950 - protein, 10 aa, Entamoeba dispar
IENYNGDFSI

SEQ ID NO: 2405951 - protein, 8 aa, Entamoeba dispar
IEPNPSHE

SEQ ID NO: 2405952 - protein, 7 aa, Entamoeba dispar
IFASGGN

SEQ ID NO: 2405953 - protein, 6 aa, Entamoeba dispar
IGNNAK

SEQ ID NO: 2405954 - protein, 10 aa, Entamoeba dispar
IGRTNSDEYY

SEQ ID NO: 2405955 - protein, 4 aa, Entamoeba dispar
IGSE

SEQ ID NO: 2405956 - protein, 10 aa, Entamoeba dispar
IGTANEKFNG

SEQ ID NO: 2405957 - protein, 5 aa, Entamoeba dispar
IHRGG

SEQ ID NO: 2405958 - protein, 4 aa, Entamoeba dispar
IKAE

SEQ ID NO: 2405959 - protein, 15 aa, Entamoeba dispar
IKAGESTTISTSSGE

SEQ ID NO: 2405960 - protein, 20 aa, Entamoeba dispar
IKEDEKGEATRISSGKAFNE

SEQ ID NO: 2405961 - protein, 4 aa, Entamoeba dispar
IKEK

SEQ ID NO: 2405962 - protein, 4 aa, Entamoeba dispar
IKET

SEQ ID NO: 2405963 - protein, 9 aa, Entamoeba dispar
IKIPENEKE

SEQ ID NO: 2405964 - protein, 10 aa, Entamoeba dispar
IKKASEGEMK

SEQ ID NO: 2405965 - protein, 7 aa, Entamoeba dispar
IKKERDK

SEQ ID NO: 2405966 - protein, 4 aa, Entamoeba dispar
IKPD

SEQ ID NO: 2405967 - protein, 13 aa, Entamoeba dispar
IKPKKNKPGYKPS

SEQ ID NO: 2405968 - protein, 5 aa, Entamoeba dispar
IKPPE

SEQ ID NO: 2405969 - protein, 11 aa, Entamoeba dispar
IKQENKINTKR

SEQ ID NO: 2405970 - protein, 4 aa, Entamoeba dispar
IKQG

SEQ ID NO: 2405971 - protein, 4 aa, Entamoeba dispar
IKTK

SEQ ID NO: 2405972 - protein, 7 aa, Entamoeba dispar
INDNIND

SEQ ID NO: 2405973 - protein, 6 aa, Entamoeba dispar
INGNDQ

SEQ ID NO: 2405974 - protein, 6 aa, Entamoeba dispar
INIPSS

SEQ ID NO: 2405975 - protein, 10 aa, Entamoeba dispar
INIPSSINEL

SEQ ID NO: 2405976 - protein, 10 aa, Entamoeba dispar
INIPSSVNEF

SEQ ID NO: 2405977 - protein, 9 aa, Entamoeba dispar
INKENGKEW

SEQ ID NO: 2405978 - protein, 7 aa, Entamoeba dispar
INKSDLE

SEQ ID NO: 2405979 - protein, 11 aa, Entamoeba dispar
INNNNKVYQQQ

SEQ ID NO: 2405980 - protein, 6 aa, Entamoeba dispar
INREDP

SEQ ID NO: 2405981 - protein, 8 aa, Entamoeba dispar
INSFSSSP

SEQ ID NO: 2405982 - protein, 7 aa, Entamoeba dispar
INSTTNK

SEQ ID NO: 2405983 - protein, 6 aa, Entamoeba dispar
INTGNQ

SEQ ID NO: 2405984 - protein, 4 aa, Entamoeba dispar
IPEG

SEQ ID NO: 2405985 - protein, 4 aa, Entamoeba dispar
IPEN

SEQ ID NO: 2405986 - protein, 5 aa, Entamoeba dispar
IPGNG

SEQ ID NO: 2405987 - protein, 13 aa, Entamoeba dispar
IPKEEENKEKSIA

SEQ ID NO: 2405988 - protein, 19 aa, Entamoeba dispar
IPNEVENEEPILEDDEQEL

SEQ ID NO: 2405989 - protein, 4 aa, Entamoeba dispar
IPNL

SEQ ID NO: 2405990 - protein, 4 aa, Entamoeba dispar
IPSS

SEQ ID NO: 2405991 - protein, 9 aa, Entamoeba dispar
IPSSISKLG

SEQ ID NO: 2405992 - protein, 6 aa, Entamoeba dispar
IPSSIT

SEQ ID NO: 2405993 - protein, 8 aa, Entamoeba dispar
IPSSITKL

SEQ ID NO: 2405994 - protein, 7 aa, Entamoeba dispar
IPSSVSK

SEQ ID NO: 2405995 - protein, 8 aa, Entamoeba dispar
IPTNDKGR

SEQ ID NO: 2405996 - protein, 4 aa, Entamoeba dispar
IPTR

SEQ ID NO: 2405997 - protein, 5 aa, Entamoeba dispar
IPTSI

SEQ ID NO: 2405998 - protein, 6 aa, Entamoeba dispar
IPTSVS

SEQ ID NO: 2405999 - protein, 5 aa, Entamoeba dispar
IPTTV

SEQ ID NO: 2406000 - protein, 6 aa, Entamoeba dispar
IPTTVT

SEQ ID NO: 2406001 - protein, 4 aa, Entamoeba dispar
IRND

SEQ ID NO: 2406002 - protein, 5 aa, Entamoeba dispar
IRNDP

SEQ ID NO: 2406003 - protein, 7 aa, Entamoeba dispar
IRPSGCQ

SEQ ID NO: 2406004 - protein, 11 aa, Entamoeba dispar
ISEEQRPGTPL

SEQ ID NO: 2406005 - protein, 11 aa, Entamoeba dispar
ISELEKSPFDY

SEQ ID NO: 2406006 - protein, 11 aa, Entamoeba dispar
ISKRETDARKS

SEQ ID NO: 2406007 - protein, 5 aa, Entamoeba dispar
ISNIE

SEQ ID NO: 2406008 - protein, 6 aa, Entamoeba dispar
ISPEIN

SEQ ID NO: 2406009 - protein, 7 aa, Entamoeba dispar
ISPTENN

SEQ ID NO: 2406010 - protein, 9 aa, Entamoeba dispar
ITEEGDDRY

SEQ ID NO: 2406011 - protein, 9 aa, Entamoeba dispar
ITEEGNNKY

SEQ ID NO: 2406012 - protein, 11 aa, Entamoeba dispar
ITGEAEKTPVR

SEQ ID NO: 2406013 - protein, 6 aa, Entamoeba dispar
ITGGNR

SEQ ID NO: 2406014 - protein, 18 aa, Entamoeba dispar
ITGKDNNGKDLGHGGDDV

SEQ ID NO: 2406015 - protein, 4 aa, Entamoeba dispar
ITIP

SEQ ID NO: 2406016 - protein, 6 aa, Entamoeba dispar
ITNEED

SEQ ID NO: 2406017 - protein, 4 aa, Entamoeba dispar
ITWT

SEQ ID NO: 2406018 - protein, 4 aa, Entamoeba dispar
IYDS

SEQ ID NO: 2406019 - protein, 7 aa, Entamoeba dispar
KAEQGKT

SEQ ID NO: 2406020 - protein, 8 aa, Entamoeba dispar
KAERERGI

SEQ ID NO: 2406021 - protein, 6 aa, Entamoeba dispar
KATSQQ

SEQ ID NO: 2406022 - protein, 7 aa, Entamoeba dispar
KATSQQV

SEQ ID NO: 2406023 - protein, 6 aa, Entamoeba dispar
KAVKEC

SEQ ID NO: 2406024 - protein, 7 aa, Entamoeba dispar
KDGGLQI

SEQ ID NO: 2406025 - protein, 8 aa, Entamoeba dispar
KDNTNHYN

SEQ ID NO: 2406026 - protein, 5 aa, Entamoeba dispar
KEDEN

SEQ ID NO: 2406027 - protein, 4 aa, Entamoeba dispar
KEEL

SEQ ID NO: 2406028 - protein, 9 aa, Entamoeba dispar
KEELERKKE

SEQ ID NO: 2406029 - protein, 4 aa, Entamoeba dispar
KEIE

SEQ ID NO: 2406030 - protein, 6 aa, Entamoeba dispar
KEKGID

SEQ ID NO: 2406031 - protein, 8 aa, Entamoeba dispar
KEKNEYKH

SEQ ID NO: 2406032 - protein, 7 aa, Entamoeba dispar
KEKNRKK

SEQ ID NO: 2406033 - protein, 7 aa, Entamoeba dispar
KEKYPEL

SEQ ID NO: 2406034 - protein, 6 aa, Entamoeba dispar
KELPND

SEQ ID NO: 2406035 - protein, 9 aa, Entamoeba dispar
KENAKDDKF

SEQ ID NO: 2406036 - protein, 8 aa, Entamoeba dispar
KENGNEIT

SEQ ID NO: 2406037 - protein, 22 aa, Entamoeba dispar
KEPPKDRKKNKGVPTVHSGSIS

SEQ ID NO: 2406038 - protein, 8 aa, Entamoeba dispar
KEPSEENT

SEQ ID NO: 2406039 - protein, 8 aa, Entamoeba dispar
KEQEKTTT

SEQ ID NO: 2406040 - protein, 6 aa, Entamoeba dispar
KEQGIR

SEQ ID NO: 2406041 - protein, 4 aa, Entamoeba dispar
KERN

SEQ ID NO: 2406042 - protein, 8 aa, Entamoeba dispar
KERRKEEI

SEQ ID NO: 2406043 - protein, 4 aa, Entamoeba dispar
KESF

SEQ ID NO: 2406044 - protein, 15 aa, Entamoeba dispar
KEVEKAKIELSSTSY

SEQ ID NO: 2406045 - protein, 5 aa, Entamoeba dispar
KEYES

SEQ ID NO: 2406046 - protein, 9 aa, Entamoeba dispar
KFDQTDNRL

SEQ ID NO: 2406047 - protein, 13 aa, Entamoeba dispar
KFEKESAEMGKGS

SEQ ID NO: 2406048 - protein, 9 aa, Entamoeba dispar
KFKEGKYEE

SEQ ID NO: 2406049 - protein, 12 aa, Entamoeba dispar
KGAEPTEQAPND

SEQ ID NO: 2406050 - protein, 7 aa, Entamoeba dispar
KGEEYKG

SEQ ID NO: 2406051 - protein, 8 aa, Entamoeba dispar
KGFEHEKA

SEQ ID NO: 2406052 - protein, 5 aa, Entamoeba dispar
KGIEE

SEQ ID NO: 2406053 - protein, 8 aa, Entamoeba dispar
KGIGTPKY

SEQ ID NO: 2406054 - protein, 7 aa, Entamoeba dispar
KGITPMG

SEQ ID NO: 2406055 - protein, 4 aa, Entamoeba dispar
KGKG

SEQ ID NO: 2406056 - protein, 6 aa, Entamoeba dispar
KGPVRG

SEQ ID NO: 2406057 - protein, 4 aa, Entamoeba dispar
KGYG

SEQ ID NO: 2406058 - protein, 11 aa, Entamoeba dispar
KIEPSRPGGIR

SEQ ID NO: 2406059 - protein, 13 aa, Entamoeba dispar
KIKNKQKQLEQQQ

SEQ ID NO: 2406060 - protein, 9 aa, Entamoeba dispar
KINTESFKE

SEQ ID NO: 2406061 - protein, 8 aa, Entamoeba dispar
KKEALNQS

SEQ ID NO: 2406062 - protein, 12 aa, Entamoeba dispar
KKEDMERVAKSN

SEQ ID NO: 2406063 - protein, 4 aa, Entamoeba dispar
KKEG

SEQ ID NO: 2406064 - protein, 8 aa, Entamoeba dispar
KKEGPKEN

SEQ ID NO: 2406065 - protein, 24 aa, Entamoeba dispar
KKEQAKETSDSKKKKKEGIKDNRN

SEQ ID NO: 2406066 - protein, 8 aa, Entamoeba dispar
KKEQRAPF

SEQ ID NO: 2406067 - protein, 7 aa, Entamoeba dispar
KKESERI

SEQ ID NO: 2406068 - protein, 9 aa, Entamoeba dispar
KKGKISPEQ

SEQ ID NO: 2406069 - protein, 10 aa, Entamoeba dispar
KKGKPEYRKK

SEQ ID NO: 2406070 - protein, 8 aa, Entamoeba dispar
KKGKTTSQ

SEQ ID NO: 2406071 - protein, 9 aa, Entamoeba dispar
KKGRGHTQN

SEQ ID NO: 2406072 - protein, 8 aa, Entamoeba dispar
KKGRYGEH

SEQ ID NO: 2406073 - protein, 7 aa, Entamoeba dispar
KKHCQSS

SEQ ID NO: 2406074 - protein, 6 aa, Entamoeba dispar
KKHSEK

SEQ ID NO: 2406075 - protein, 9 aa, Entamoeba dispar
KKKPNPKNW

SEQ ID NO: 2406076 - protein, 4 aa, Entamoeba dispar
KKKT

SEQ ID NO: 2406077 - protein, 9 aa, Entamoeba dispar
KKLKNDKRI

SEQ ID NO: 2406078 - protein, 10 aa, Entamoeba dispar
KKMAQGKSGF

SEQ ID NO: 2406079 - protein, 7 aa, Entamoeba dispar
KKNSLHG

SEQ ID NO: 2406080 - protein, 10 aa, Entamoeba dispar
KKPTKIQENS

SEQ ID NO: 2406081 - protein, 6 aa, Entamoeba dispar
KKQNKK

SEQ ID NO: 2406082 - protein, 7 aa, Entamoeba dispar
KKQPTNV

SEQ ID NO: 2406083 - protein, 6 aa, Entamoeba dispar
KKQRVK

SEQ ID NO: 2406084 - protein, 7 aa, Entamoeba dispar
KKRIDSK

SEQ ID NO: 2406085 - protein, 7 aa, Entamoeba dispar
KKRYQKE

SEQ ID NO: 2406086 - protein, 15 aa, Entamoeba dispar
KKTNGMTDGTEKRKG

SEQ ID NO: 2406087 - protein, 16 aa, Entamoeba dispar
KKTPIETDKTKKKLTY

SEQ ID NO: 2406088 - protein, 9 aa, Entamoeba dispar
KKTTTGLKP

SEQ ID NO: 2406089 - protein, 5 aa, Entamoeba dispar
KKYPE

SEQ ID NO: 2406090 - protein, 5 aa, Entamoeba dispar
KLTQP

SEQ ID NO: 2406091 - protein, 9 aa, Entamoeba dispar
KMTEEEKER

SEQ ID NO: 2406092 - protein, 16 aa, Entamoeba dispar
KNEEKPLGIQSHTDRV

SEQ ID NO: 2406093 - protein, 6 aa, Entamoeba dispar
KNEKEN

SEQ ID NO: 2406094 - protein, 5 aa, Entamoeba dispar
KNHAF

SEQ ID NO: 2406095 - protein, 7 aa, Entamoeba dispar
KNIEKKN

SEQ ID NO: 2406096 - protein, 5 aa, Entamoeba dispar
KNIKI

SEQ ID NO: 2406097 - protein, 11 aa, Entamoeba dispar
KNKIKGSGTIK

SEQ ID NO: 2406098 - protein, 4 aa, Entamoeba dispar
KNNA

SEQ ID NO: 2406099 - protein, 8 aa, Entamoeba dispar
KNNTNHYN

SEQ ID NO: 2406100 - protein, 9 aa, Entamoeba dispar
KNSTAEATI

SEQ ID NO: 2406101 - protein, 5 aa, Entamoeba dispar
KNYAP

SEQ ID NO: 2406102 - protein, 5 aa, Entamoeba dispar
KPADL

SEQ ID NO: 2406103 - protein, 8 aa, Entamoeba dispar
KPGSDIGN

SEQ ID NO: 2406104 - protein, 6 aa, Entamoeba dispar
KPHGGK

SEQ ID NO: 2406105 - protein, 4 aa, Entamoeba dispar
KPSN

SEQ ID NO: 2406106 - protein, 7 aa, Entamoeba dispar
KPTRRSC

SEQ ID NO: 2406107 - protein, 6 aa, Entamoeba dispar
KPTSTG

SEQ ID NO: 2406108 - protein, 7 aa, Entamoeba dispar
KPTVVGE

SEQ ID NO: 2406109 - protein, 15 aa, Entamoeba dispar
KPVPNTGNVFSSKKK

SEQ ID NO: 2406110 - protein, 7 aa, Entamoeba dispar
KQGRIEI

SEQ ID NO: 2406111 - protein, 7 aa, Entamoeba dispar
KQIAQTL

SEQ ID NO: 2406112 - protein, 5 aa, Entamoeba dispar
KQYKE

SEQ ID NO: 2406113 - protein, 4 aa, Entamoeba dispar
KRES

SEQ ID NO: 2406114 - protein, 15 aa, Entamoeba dispar
KRKDDEITGKPKKLR

SEQ ID NO: 2406115 - protein, 18 aa, Entamoeba dispar
KRKGLPEGVPGLDKFYDK

SEQ ID NO: 2406116 - protein, 14 aa, Entamoeba dispar
KRNLQGNKKGISRI

SEQ ID NO: 2406117 - protein, 10 aa, Entamoeba dispar
KRSIKSAKKT

SEQ ID NO: 2406118 - protein, 11 aa, Entamoeba dispar
KRSSQQELTAT

SEQ ID NO: 2406119 - protein, 12 aa, Entamoeba dispar
KRTNTKLPKDGV

SEQ ID NO: 2406120 - protein, 7 aa, Entamoeba dispar
KRTTWPR

SEQ ID NO: 2406121 - protein, 5 aa, Entamoeba dispar
KSAAF

SEQ ID NO: 2406122 - protein, 9 aa, Entamoeba dispar
KSDINSDVT

SEQ ID NO: 2406123 - protein, 20 aa, Entamoeba dispar
KSELTEEREVGTEEGMKYSE

SEQ ID NO: 2406124 - protein, 6 aa, Entamoeba dispar
KSGKRG

SEQ ID NO: 2406125 - protein, 6 aa, Entamoeba dispar
KSRIQE

SEQ ID NO: 2406126 - protein, 10 aa, Entamoeba dispar
KSTDSDEEKL

SEQ ID NO: 2406127 - protein, 9 aa, Entamoeba dispar
KSTKVNKNN

SEQ ID NO: 2406128 - protein, 6 aa, Entamoeba dispar
KSYGST

SEQ ID NO: 2406129 - protein, 13 aa, Entamoeba dispar
KTAKTGTRKDGVP

SEQ ID NO: 2406130 - protein, 6 aa, Entamoeba dispar
KTCEEF

SEQ ID NO: 2406131 - protein, 4 aa, Entamoeba dispar
KTIG

SEQ ID NO: 2406132 - protein, 9 aa, Entamoeba dispar
KTNKEYEEM

SEQ ID NO: 2406133 - protein, 4 aa, Entamoeba dispar
KTPI

SEQ ID NO: 2406134 - protein, 17 aa, Entamoeba dispar
KTSIETDKTKKKKKLTY

SEQ ID NO: 2406135 - protein, 4 aa, Entamoeba dispar
KTTY

SEQ ID NO: 2406136 - protein, 21 aa, Entamoeba dispar
KTVRAGQGKMRGRKIKERKGP

SEQ ID NO: 2406137 - protein, 22 aa, Entamoeba dispar
KVATKLSKEYQNNKGYLQERTY

SEQ ID NO: 2406138 - protein, 8 aa, Entamoeba dispar
KVKDNEGK

SEQ ID NO: 2406139 - protein, 7 aa, Entamoeba dispar
KVKENEI

SEQ ID NO: 2406140 - protein, 20 aa, Entamoeba dispar
KVKENSKKIGSTTHADPRCQ

SEQ ID NO: 2406141 - protein, 8 aa, Entamoeba dispar
KVNPAKAK

SEQ ID NO: 2406142 - protein, 9 aa, Entamoeba dispar
KYGGGKTSG

SEQ ID NO: 2406143 - protein, 4 aa, Entamoeba dispar
KYGS

SEQ ID NO: 2406144 - protein, 5 aa, Entamoeba dispar
KYNGI

SEQ ID NO: 2406145 - protein, 27 aa, Entamoeba dispar
KYRTSNLYTGPMDDEAAKAMANCDEKG

SEQ ID NO: 2406146 - protein, 5 aa, Entamoeba dispar
KYSSN

SEQ ID NO: 2406147 - protein, 18 aa, Entamoeba dispar
LADEKYKAKVAILKKFGY

SEQ ID NO: 2406148 - protein, 10 aa, Entamoeba dispar
LDKASKGRTT

SEQ ID NO: 2406149 - protein, 8 aa, Entamoeba dispar
LDKTNATQ

SEQ ID NO: 2406150 - protein, 4 aa, Entamoeba dispar
LDYK

SEQ ID NO: 2406151 - protein, 5 aa, Entamoeba dispar
LEERE

SEQ ID NO: 2406152 - protein, 38 aa, Entamoeba dispar
LERKRRNTRTIGEYGTTSIIGGTADNRVVSGASVGTTS

SEQ ID NO: 2406153 - protein, 9 aa, Entamoeba dispar
LESNNEEQM

SEQ ID NO: 2406154 - protein, 4 aa, Entamoeba dispar
LFQP

SEQ ID NO: 2406155 - protein, 12 aa, Entamoeba dispar
LGEGDNIDIPRS

SEQ ID NO: 2406156 - protein, 4 aa, Entamoeba dispar
LGGG

SEQ ID NO: 2406157 - protein, 6 aa, Entamoeba dispar
LHKEGL

SEQ ID NO: 2406158 - protein, 26 aa, Entamoeba dispar
LKEEAQKKKEKLQKGQKKLNEEEDND

SEQ ID NO: 2406159 - protein, 11 aa, Entamoeba dispar
LKEENKGKYSR

SEQ ID NO: 2406160 - protein, 9 aa, Entamoeba dispar
LKEKEAGNI

SEQ ID NO: 2406161 - protein, 19 aa, Entamoeba dispar
LKEQRSYQLNEENKGYGWA

SEQ ID NO: 2406162 - protein, 4 aa, Entamoeba dispar
LKKN

SEQ ID NO: 2406163 - protein, 10 aa, Entamoeba dispar
LKNAKTEFDI

SEQ ID NO: 2406164 - protein, 4 aa, Entamoeba dispar
LKRN

SEQ ID NO: 2406165 - protein, 10 aa, Entamoeba dispar
LNDNEQNQGT

SEQ ID NO: 2406166 - protein, 4 aa, Entamoeba dispar
LNEE

SEQ ID NO: 2406167 - protein, 5 aa, Entamoeba dispar
LPGAS

SEQ ID NO: 2406168 - protein, 12 aa, Entamoeba dispar
LPNQSGATAESV

SEQ ID NO: 2406169 - protein, 5 aa, Entamoeba dispar
LPSND

SEQ ID NO: 2406170 - protein, 5 aa, Entamoeba dispar
LPSSI

SEQ ID NO: 2406171 - protein, 12 aa, Entamoeba dispar
LPTTNTKQVLSQ

SEQ ID NO: 2406172 - protein, 9 aa, Entamoeba dispar
LQEKEAGNI

SEQ ID NO: 2406173 - protein, 5 aa, Entamoeba dispar
LQGNE

SEQ ID NO: 2406174 - protein, 4 aa, Entamoeba dispar
LSEE

SEQ ID NO: 2406175 - protein, 13 aa, Entamoeba dispar
LSEWGKGKEEFEN

SEQ ID NO: 2406176 - protein, 12 aa, Entamoeba dispar
LSSRGTATVKSA

SEQ ID NO: 2406177 - protein, 5 aa, Entamoeba dispar
LSYPQ

SEQ ID NO: 2406178 - protein, 6 aa, Entamoeba dispar
LSYPST

SEQ ID NO: 2406179 - protein, 7 aa, Entamoeba dispar
LTEDQYG

SEQ ID NO: 2406180 - protein, 9 aa, Entamoeba dispar
LTESYEKKI

SEQ ID NO: 2406181 - protein, 4 aa, Entamoeba dispar
LTGN

SEQ ID NO: 2406182 - protein, 5 aa, Entamoeba dispar
LTKRG

SEQ ID NO: 2406183 - protein, 12 aa, Entamoeba dispar
LTQESEEFEPEE

SEQ ID NO: 2406184 - protein, 13 aa, Entamoeba dispar
MEEFEKKKRSIEE

SEQ ID NO: 2406185 - protein, 5 aa, Entamoeba dispar
MNDDP

SEQ ID NO: 2406186 - protein, 5 aa, Entamoeba dispar
MNERE

SEQ ID NO: 2406187 - protein, 7 aa, Entamoeba dispar
MNERNKE

SEQ ID NO: 2406188 - protein, 6 aa, Entamoeba dispar
MNQTEK

SEQ ID NO: 2406189 - protein, 4 aa, Entamoeba dispar
MPSV

SEQ ID NO: 2406190 - protein, 5 aa, Entamoeba dispar
MRPRS

SEQ ID NO: 2406191 - protein, 5 aa, Entamoeba dispar
MSQQK

SEQ ID NO: 2406192 - protein, 24 aa, Entamoeba dispar
MTGASPSMFGAGSEGALTKGPFNS

SEQ ID NO: 2406193 - protein, 9 aa, Entamoeba dispar
NADNETTRI

SEQ ID NO: 2406194 - protein, 8 aa, Entamoeba dispar
NAKGNKFV

SEQ ID NO: 2406195 - protein, 10 aa, Entamoeba dispar
NASKSNTASF

SEQ ID NO: 2406196 - protein, 15 aa, Entamoeba dispar
NASTVNCADNTGAKT

SEQ ID NO: 2406197 - protein, 21 aa, Entamoeba dispar
NAYSNAHLPPSLFSNRWKALN

SEQ ID NO: 2406198 - protein, 6 aa, Entamoeba dispar
NDGLPE

SEQ ID NO: 2406199 - protein, 5 aa, Entamoeba dispar
NDGLT

SEQ ID NO: 2406200 - protein, 4 aa, Entamoeba dispar
NDGQ

SEQ ID NO: 2406201 - protein, 9 aa, Entamoeba dispar
NDKGKRITI

SEQ ID NO: 2406202 - protein, 8 aa, Entamoeba dispar
NDKTFDDG

SEQ ID NO: 2406203 - protein, 7 aa, Entamoeba dispar
NDMKGKE

SEQ ID NO: 2406204 - protein, 7 aa, Entamoeba dispar
NDNTEDD

SEQ ID NO: 2406205 - protein, 7 aa, Entamoeba dispar
NEDNSYS

SEQ ID NO: 2406206 - protein, 4 aa, Entamoeba dispar
NEEI

SEQ ID NO: 2406207 - protein, 4 aa, Entamoeba dispar
NEEN

SEQ ID NO: 2406208 - protein, 10 aa, Entamoeba dispar
NEENRKKRKD

SEQ ID NO: 2406209 - protein, 6 aa, Entamoeba dispar
NEGIPI

SEQ ID NO: 2406210 - protein, 11 aa, Entamoeba dispar
NEIGNKQKRSV

SEQ ID NO: 2406211 - protein, 4 aa, Entamoeba dispar
NELK

SEQ ID NO: 2406212 - protein, 4 aa, Entamoeba dispar
NEQI

SEQ ID NO: 2406213 - protein, 7 aa, Entamoeba dispar
NESEDEE

SEQ ID NO: 2406214 - protein, 10 aa, Entamoeba dispar
NESQEDNTSM

SEQ ID NO: 2406215 - protein, 7 aa, Entamoeba dispar
NESVGTP

SEQ ID NO: 2406216 - protein, 5 aa, Entamoeba dispar
NGDKS

SEQ ID NO: 2406217 - protein, 11 aa, Entamoeba dispar
NGGVGRKAQCK

SEQ ID NO: 2406218 - protein, 16 aa, Entamoeba dispar
NGKQIGKYKGHSSTIT

SEQ ID NO: 2406219 - protein, 6 aa, Entamoeba dispar
NGNDAQ

SEQ ID NO: 2406220 - protein, 8 aa, Entamoeba dispar
NGRPIRER

SEQ ID NO: 2406221 - protein, 9 aa, Entamoeba dispar
NGVTNGTIR

SEQ ID NO: 2406222 - protein, 7 aa, Entamoeba dispar
NIKKEKD

SEQ ID NO: 2406223 - protein, 9 aa, Entamoeba dispar
NIPSSITKL

SEQ ID NO: 2406224 - protein, 9 aa, Entamoeba dispar
NIPSSITSF

SEQ ID NO: 2406225 - protein, 6 aa, Entamoeba dispar
NIPSSV

SEQ ID NO: 2406226 - protein, 7 aa, Entamoeba dispar
NIPSSVK

SEQ ID NO: 2406227 - protein, 8 aa, Entamoeba dispar
NIPSSVSE

SEQ ID NO: 2406228 - protein, 5 aa, Entamoeba dispar
NIPST

SEQ ID NO: 2406229 - protein, 5 aa, Entamoeba dispar
NIPTT

SEQ ID NO: 2406230 - protein, 5 aa, Entamoeba dispar
NKDGE

SEQ ID NO: 2406231 - protein, 4 aa, Entamoeba dispar
NKDR

SEQ ID NO: 2406232 - protein, 7 aa, Entamoeba dispar
NKEKEGD

SEQ ID NO: 2406233 - protein, 9 aa, Entamoeba dispar
NKENEYEKK

SEQ ID NO: 2406234 - protein, 6 aa, Entamoeba dispar
NKEQLE

SEQ ID NO: 2406235 - protein, 18 aa, Entamoeba dispar
NKGNKSRYKQDNRRAKEW

SEQ ID NO: 2406236 - protein, 9 aa, Entamoeba dispar
NKKKDEQRL

SEQ ID NO: 2406237 - protein, 10 aa, Entamoeba dispar
NKNEQTNENQ

SEQ ID NO: 2406238 - protein, 10 aa, Entamoeba dispar
NKPTQSSNVS

SEQ ID NO: 2406239 - protein, 6 aa, Entamoeba dispar
NKYSSF

SEQ ID NO: 2406240 - protein, 9 aa, Entamoeba dispar
NLDKSTAKK

SEQ ID NO: 2406241 - protein, 16 aa, Entamoeba dispar
NLEQNRDQSKSQTSEV

SEQ ID NO: 2406242 - protein, 9 aa, Entamoeba dispar
NNEEEMSPT

SEQ ID NO: 2406243 - protein, 7 aa, Entamoeba dispar
NNERFNE

SEQ ID NO: 2406244 - protein, 10 aa, Entamoeba dispar
NNNTSISSTY

SEQ ID NO: 2406245 - protein, 4 aa, Entamoeba dispar
NNQQ

SEQ ID NO: 2406246 - protein, 6 aa, Entamoeba dispar
NNSTGV

SEQ ID NO: 2406247 - protein, 5 aa, Entamoeba dispar
NPEQY

SEQ ID NO: 2406248 - protein, 4 aa, Entamoeba dispar
NPPL

SEQ ID NO: 2406249 - protein, 14 aa, Entamoeba dispar
NPPRNNNLPPQQPI

SEQ ID NO: 2406250 - protein, 4 aa, Entamoeba dispar
NQIT

SEQ ID NO: 2406251 - protein, 10 aa, Entamoeba dispar
NQLETTNSNT

SEQ ID NO: 2406252 - protein, 6 aa, Entamoeba dispar
NQSISS

SEQ ID NO: 2406253 - protein, 19 aa, Entamoeba dispar
NREEEIKNTISKAKTTLDK

SEQ ID NO: 2406254 - protein, 7 aa, Entamoeba dispar
NRNRAER

SEQ ID NO: 2406255 - protein, 7 aa, Entamoeba dispar
NRRDSAV

SEQ ID NO: 2406256 - protein, 10 aa, Entamoeba dispar
NRSKESYSRK

SEQ ID NO: 2406257 - protein, 5 aa, Entamoeba dispar
NSGKI

SEQ ID NO: 2406258 - protein, 6 aa, Entamoeba dispar
NSNRGT

SEQ ID NO: 2406259 - protein, 4 aa, Entamoeba dispar
NSQY

SEQ ID NO: 2406260 - protein, 10 aa, Entamoeba dispar
NSRDGKSSLG

SEQ ID NO: 2406261 - protein, 9 aa, Entamoeba dispar
NTEFSEKRD

SEQ ID NO: 2406262 - protein, 10 aa, Entamoeba dispar
NTGDGKSSLG

SEQ ID NO: 2406263 - protein, 5 aa, Entamoeba dispar
NTPIK

SEQ ID NO: 2406264 - protein, 24 aa, Entamoeba dispar
NTPLTNPEINGRRKRKNNHAGKED

SEQ ID NO: 2406265 - protein, 8 aa, Entamoeba dispar
NTPTPINE

SEQ ID NO: 2406266 - protein, 11 aa, Entamoeba dispar
NVITGGADGKV

SEQ ID NO: 2406267 - protein, 18 aa, Entamoeba dispar
NVQPTEETISQTYTESGY

SEQ ID NO: 2406268 - protein, 4 aa, Entamoeba dispar
NYAK

SEQ ID NO: 2406269 - protein, 4 aa, Entamoeba dispar
NYTK

SEQ ID NO: 2406270 - protein, 4 aa, Entamoeba dispar
NYTR

SEQ ID NO: 2406271 - protein, 9 aa, Entamoeba dispar
NYVPGKKDD

SEQ ID NO: 2406272 - protein, 10 aa, Entamoeba dispar
PASTGAAKAV

SEQ ID NO: 2406273 - protein, 5 aa, Entamoeba dispar
PCSAA

SEQ ID NO: 2406274 - protein, 11 aa, Entamoeba dispar
PEEKGRSGKFN

SEQ ID NO: 2406275 - protein, 4 aa, Entamoeba dispar
PEGY

SEQ ID NO: 2406276 - protein, 29 aa, Entamoeba dispar
PEQKKKSPKKIQNNDDVNGNKPDDDSKGI

SEQ ID NO: 2406277 - protein, 4 aa, Entamoeba dispar
PESA

SEQ ID NO: 2406278 - protein, 4 aa, Entamoeba dispar
PGHV

SEQ ID NO: 2406279 - protein, 10 aa, Entamoeba dispar
PGVQESEEMN

SEQ ID NO: 2406280 - protein, 5 aa, Entamoeba dispar
PHGNH

SEQ ID NO: 2406281 - protein, 8 aa, Entamoeba dispar
PHTSQNQS

SEQ ID NO: 2406282 - protein, 4 aa, Entamoeba dispar
PIEE

SEQ ID NO: 2406283 - protein, 8 aa, Entamoeba dispar
PIGSSEAT

SEQ ID NO: 2406284 - protein, 6 aa, Entamoeba dispar
PITTTY

SEQ ID NO: 2406285 - protein, 4 aa, Entamoeba dispar
PIVS

SEQ ID NO: 2406286 - protein, 8 aa, Entamoeba dispar
PKDKAIKR

SEQ ID NO: 2406287 - protein, 23 aa, Entamoeba dispar
PKKMRGSTSLVDGDGLKTGEVNI

SEQ ID NO: 2406288 - protein, 7 aa, Entamoeba dispar
PKQATVR

SEQ ID NO: 2406289 - protein, 6 aa, Entamoeba dispar
PKSEED

SEQ ID NO: 2406290 - protein, 7 aa, Entamoeba dispar
PLEDPQF

SEQ ID NO: 2406291 - protein, 4 aa, Entamoeba dispar
PLGR

SEQ ID NO: 2406292 - protein, 4 aa, Entamoeba dispar
PLSN

SEQ ID NO: 2406293 - protein, 9 aa, Entamoeba dispar
PMGDAGLTG

SEQ ID NO: 2406294 - protein, 5 aa, Entamoeba dispar
PMTPE

SEQ ID NO: 2406295 - protein, 12 aa, Entamoeba dispar
PMTREEAKDFTK

SEQ ID NO: 2406296 - protein, 5 aa, Entamoeba dispar
PNGEI

SEQ ID NO: 2406297 - protein, 6 aa, Entamoeba dispar
PNNETN

SEQ ID NO: 2406298 - protein, 16 aa, Entamoeba dispar
PPEDISQTNASKIKEG

SEQ ID NO: 2406299 - protein, 6 aa, Entamoeba dispar
PPKAMG

SEQ ID NO: 2406300 - protein, 22 aa, Entamoeba dispar
PPNQQTTRNSTNSLQNKIPQLP

SEQ ID NO: 2406301 - protein, 5 aa, Entamoeba dispar
PRAGC

SEQ ID NO: 2406302 - protein, 10 aa, Entamoeba dispar
PRKQQTRRSM

SEQ ID NO: 2406303 - protein, 5 aa, Entamoeba dispar
PRQYG

SEQ ID NO: 2406304 - protein, 22 aa, Entamoeba dispar
PRRCEAKKFGGPGARAKYQKSY

SEQ ID NO: 2406305 - protein, 4 aa, Entamoeba dispar
PRTS

SEQ ID NO: 2406306 - protein, 8 aa, Entamoeba dispar
PSDANETR

SEQ ID NO: 2406307 - protein, 6 aa, Entamoeba dispar
PSLNGK

SEQ ID NO: 2406308 - protein, 4 aa, Entamoeba dispar
PSNH

SEQ ID NO: 2406309 - protein, 4 aa, Entamoeba dispar
PSQI

SEQ ID NO: 2406310 - protein, 7 aa, Entamoeba dispar
PSSITSI

SEQ ID NO: 2406311 - protein, 4 aa, Entamoeba dispar
PSTI

SEQ ID NO: 2406312 - protein, 8 aa, Entamoeba dispar
PTKERDSY

SEQ ID NO: 2406313 - protein, 5 aa, Entamoeba dispar
PTKSS

SEQ ID NO: 2406314 - protein, 10 aa, Entamoeba dispar
PTKTMQKKYA

SEQ ID NO: 2406315 - protein, 4 aa, Entamoeba dispar
PTTV

SEQ ID NO: 2406316 - protein, 4 aa, Entamoeba dispar
PVEY

SEQ ID NO: 2406317 - protein, 4 aa, Entamoeba dispar
QAQQ

SEQ ID NO: 2406318 - protein, 9 aa, Entamoeba dispar
QATERQKKE

SEQ ID NO: 2406319 - protein, 5 aa, Entamoeba dispar
QCEET

SEQ ID NO: 2406320 - protein, 5 aa, Entamoeba dispar
QCPEG

SEQ ID NO: 2406321 - protein, 9 aa, Entamoeba dispar
QEARSSRRR

SEQ ID NO: 2406322 - protein, 19 aa, Entamoeba dispar
QEEERERRDNYVPEKSEVN

SEQ ID NO: 2406323 - protein, 7 aa, Entamoeba dispar
QESLPPP

SEQ ID NO: 2406324 - protein, 7 aa, Entamoeba dispar
QFNPTQN

SEQ ID NO: 2406325 - protein, 8 aa, Entamoeba dispar
QGKSLEEI

SEQ ID NO: 2406326 - protein, 6 aa, Entamoeba dispar
QGPTIA

SEQ ID NO: 2406327 - protein, 6 aa, Entamoeba dispar
QGREDI

SEQ ID NO: 2406328 - protein, 23 aa, Entamoeba dispar
QHQDNSAPVEAAPVAEEKGEVVE

SEQ ID NO: 2406329 - protein, 7 aa, Entamoeba dispar
QIENNKD

SEQ ID NO: 2406330 - protein, 12 aa, Entamoeba dispar
QKDNKDGKDSQL

SEQ ID NO: 2406331 - protein, 4 aa, Entamoeba dispar
QKGL

SEQ ID NO: 2406332 - protein, 17 aa, Entamoeba dispar
QKIEDQERERTEYEKNH

SEQ ID NO: 2406333 - protein, 4 aa, Entamoeba dispar
QKIG

SEQ ID NO: 2406334 - protein, 8 aa, Entamoeba dispar
QKISNGVR

SEQ ID NO: 2406335 - protein, 5 aa, Entamoeba dispar
QKKAE

SEQ ID NO: 2406336 - protein, 4 aa, Entamoeba dispar
QKQT

SEQ ID NO: 2406337 - protein, 7 aa, Entamoeba dispar
QKQVDES

SEQ ID NO: 2406338 - protein, 6 aa, Entamoeba dispar
QKVDGK

SEQ ID NO: 2406339 - protein, 21 aa, Entamoeba dispar
QLNQTIQQHNKELKKGNITTK

SEQ ID NO: 2406340 - protein, 12 aa, Entamoeba dispar
QNKTIPENCFQP

SEQ ID NO: 2406341 - protein, 10 aa, Entamoeba dispar
QPCAKDSRAH

SEQ ID NO: 2406342 - protein, 4 aa, Entamoeba dispar
QPNC

SEQ ID NO: 2406343 - protein, 31 aa, Entamoeba dispar
QPPSTKRKEPIEEKEQKEEKPEIEKEENDYP

SEQ ID NO: 2406344 - protein, 8 aa, Entamoeba dispar
QRKTPKQM

SEQ ID NO: 2406345 - protein, 7 aa, Entamoeba dispar
QRNQYPN

SEQ ID NO: 2406346 - protein, 5 aa, Entamoeba dispar
QSENS

SEQ ID NO: 2406347 - protein, 4 aa, Entamoeba dispar
QSKI

SEQ ID NO: 2406348 - protein, 22 aa, Entamoeba dispar
QSKNTRQPEGVSTEAGKQHSAI

SEQ ID NO: 2406349 - protein, 4 aa, Entamoeba dispar
QSNG

SEQ ID NO: 2406350 - protein, 4 aa, Entamoeba dispar
QSQL

SEQ ID NO: 2406351 - protein, 5 aa, Entamoeba dispar
QSREV

SEQ ID NO: 2406352 - protein, 22 aa, Entamoeba dispar
QTAYGEGNRGYNAAQNFKEGKQ

SEQ ID NO: 2406353 - protein, 7 aa, Entamoeba dispar
QTGHSGS

SEQ ID NO: 2406354 - protein, 9 aa, Entamoeba dispar
QTNSTENLG

SEQ ID NO: 2406355 - protein, 12 aa, Entamoeba dispar
QTSTEKSLEVSP

SEQ ID NO: 2406356 - protein, 10 aa, Entamoeba dispar
QVDKKSPKQV

SEQ ID NO: 2406357 - protein, 10 aa, Entamoeba dispar
QVSPGEGTVA

SEQ ID NO: 2406358 - protein, 12 aa, Entamoeba dispar
QVSTDNGSTWTD

SEQ ID NO: 2406359 - protein, 12 aa, Entamoeba dispar
QVTQKKGYKRGN

SEQ ID NO: 2406360 - protein, 4 aa, Entamoeba dispar
QYGL

SEQ ID NO: 2406361 - protein, 5 aa, Entamoeba dispar
QYGND

SEQ ID NO: 2406362 - protein, 13 aa, Entamoeba dispar
RARRNLKSSMAGN

SEQ ID NO: 2406363 - protein, 14 aa, Entamoeba dispar
RARRSYRRSPKLKH

SEQ ID NO: 2406364 - protein, 7 aa, Entamoeba dispar
RASGNYA

SEQ ID NO: 2406365 - protein, 27 aa, Entamoeba dispar
RATGGKKNSMQKKKKNTMGRQPANTRL

SEQ ID NO: 2406366 - protein, 4 aa, Entamoeba dispar
RDET

SEQ ID NO: 2406367 - protein, 11 aa, Entamoeba dispar
RDISDNSALNK

SEQ ID NO: 2406368 - protein, 11 aa, Entamoeba dispar
RENQAIETGKL

SEQ ID NO: 2406369 - protein, 18 aa, Entamoeba dispar
RETKSGYEKIKKENEEIS

SEQ ID NO: 2406370 - protein, 5 aa, Entamoeba dispar
RGGSD

SEQ ID NO: 2406371 - protein, 10 aa, Entamoeba dispar
RGIPKGVEVN

SEQ ID NO: 2406372 - protein, 11 aa, Entamoeba dispar
RGNRKVSARKG

SEQ ID NO: 2406373 - protein, 4 aa, Entamoeba dispar
RGSI

SEQ ID NO: 2406374 - protein, 7 aa, Entamoeba dispar
RGYPNDR

SEQ ID NO: 2406375 - protein, 11 aa, Entamoeba dispar
RIASGENVIGA

SEQ ID NO: 2406376 - protein, 6 aa, Entamoeba dispar
RIGKTS

SEQ ID NO: 2406377 - protein, 19 aa, Entamoeba dispar
RISGSGSGRNGQGAFGNMT

SEQ ID NO: 2406378 - protein, 17 aa, Entamoeba dispar
RKGSLDSDIKEVKPNKI

SEQ ID NO: 2406379 - protein, 6 aa, Entamoeba dispar
RKKQSD

SEQ ID NO: 2406380 - protein, 11 aa, Entamoeba dispar
RKSIEETPEFE

SEQ ID NO: 2406381 - protein, 7 aa, Entamoeba dispar
RKTHRGL

SEQ ID NO: 2406382 - protein, 14 aa, Entamoeba dispar
RLEELEREEEEKKN

SEQ ID NO: 2406383 - protein, 13 aa, Entamoeba dispar
RLPSGAKKTLKSN

SEQ ID NO: 2406384 - protein, 5 aa, Entamoeba dispar
RLTND

SEQ ID NO: 2406385 - protein, 15 aa, Entamoeba dispar
RNRAGEQLKKGGQKF

SEQ ID NO: 2406386 - protein, 4 aa, Entamoeba dispar
RNTT

SEQ ID NO: 2406387 - protein, 4 aa, Entamoeba dispar
RPQQ

SEQ ID NO: 2406388 - protein, 6 aa, Entamoeba dispar
RPRSFK

SEQ ID NO: 2406389 - protein, 4 aa, Entamoeba dispar
RQQT

SEQ ID NO: 2406390 - protein, 5 aa, Entamoeba dispar
RQSFE

SEQ ID NO: 2406391 - protein, 14 aa, Entamoeba dispar
RRANKWADKEWKKG

SEQ ID NO: 2406392 - protein, 9 aa, Entamoeba dispar
RSHTSGQAF

SEQ ID NO: 2406393 - protein, 14 aa, Entamoeba dispar
RSRTDRRNRLPPKR

SEQ ID NO: 2406394 - protein, 11 aa, Entamoeba dispar
RTARAGKSGYA

SEQ ID NO: 2406395 - protein, 6 aa, Entamoeba dispar
RTQVNK

SEQ ID NO: 2406396 - protein, 6 aa, Entamoeba dispar
RTTRNE

SEQ ID NO: 2406397 - protein, 8 aa, Entamoeba dispar
SAATGSSL

SEQ ID NO: 2406398 - protein, 12 aa, Entamoeba dispar
SADDKEKEGKEL

SEQ ID NO: 2406399 - protein, 8 aa, Entamoeba dispar
SAKRNENI

SEQ ID NO: 2406400 - protein, 8 aa, Entamoeba dispar
SALIGSNS

SEQ ID NO: 2406401 - protein, 8 aa, Entamoeba dispar
SAPSADAP

SEQ ID NO: 2406402 - protein, 12 aa, Entamoeba dispar
SATKNGTSGNEV

SEQ ID NO: 2406403 - protein, 8 aa, Entamoeba dispar
SDEEPLYT

SEQ ID NO: 2406404 - protein, 8 aa, Entamoeba dispar
SDFKNGQP

SEQ ID NO: 2406405 - protein, 9 aa, Entamoeba dispar
SDKLTGTAK

SEQ ID NO: 2406406 - protein, 8 aa, Entamoeba dispar
SDPAERTK

SEQ ID NO: 2406407 - protein, 4 aa, Entamoeba dispar
SEIK

SEQ ID NO: 2406408 - protein, 18 aa, Entamoeba dispar
SEKAQQKIKAVGGACELT

SEQ ID NO: 2406409 - protein, 5 aa, Entamoeba dispar
SEQYN

SEQ ID NO: 2406410 - protein, 4 aa, Entamoeba dispar
SESG

SEQ ID NO: 2406411 - protein, 5 aa, Entamoeba dispar
SFDGD

SEQ ID NO: 2406412 - protein, 9 aa, Entamoeba dispar
SFKKRAPKA

SEQ ID NO: 2406413 - protein, 7 aa, Entamoeba dispar
SGFNNKN

SEQ ID NO: 2406414 - protein, 14 aa, Entamoeba dispar
SGRRNNPPQVAKNG

SEQ ID NO: 2406415 - protein, 7 aa, Entamoeba dispar
SGVGKTS

SEQ ID NO: 2406416 - protein, 4 aa, Entamoeba dispar
SIGK

SEQ ID NO: 2406417 - protein, 4 aa, Entamoeba dispar
SINE

SEQ ID NO: 2406418 - protein, 5 aa, Entamoeba dispar
SINIP

SEQ ID NO: 2406419 - protein, 4 aa, Entamoeba dispar
SINN

SEQ ID NO: 2406420 - protein, 7 aa, Entamoeba dispar
SIPINDP

SEQ ID NO: 2406421 - protein, 12 aa, Entamoeba dispar
SITNAEKQGKRQ

SEQ ID NO: 2406422 - protein, 5 aa, Entamoeba dispar
SITSF

SEQ ID NO: 2406423 - protein, 5 aa, Entamoeba dispar
SKDKV

SEQ ID NO: 2406424 - protein, 6 aa, Entamoeba dispar
SKDPIA

SEQ ID NO: 2406425 - protein, 7 aa, Entamoeba dispar
SKEKYQI

SEQ ID NO: 2406426 - protein, 42 aa, Entamoeba dispar
SKEMSSDKKRTRSSSNNEVEENGEKEETDQEGKDKEKKVSRE

SEQ ID NO: 2406427 - protein, 9 aa, Entamoeba dispar
SKEPKNKYN

SEQ ID NO: 2406428 - protein, 4 aa, Entamoeba dispar
SKES

SEQ ID NO: 2406429 - protein, 7 aa, Entamoeba dispar
SKITDNM

SEQ ID NO: 2406430 - protein, 4 aa, Entamoeba dispar
SKLG

SEQ ID NO: 2406431 - protein, 4 aa, Entamoeba dispar
SKPI

SEQ ID NO: 2406432 - protein, 8 aa, Entamoeba dispar
SKRFGDNE

SEQ ID NO: 2406433 - protein, 9 aa, Entamoeba dispar
SKRTVTRAY

SEQ ID NO: 2406434 - protein, 4 aa, Entamoeba dispar
SKSF

SEQ ID NO: 2406435 - protein, 6 aa, Entamoeba dispar
SKYTTR

SEQ ID NO: 2406436 - protein, 17 aa, Entamoeba dispar
SLAEKEITTVDTTVKTK

SEQ ID NO: 2406437 - protein, 7 aa, Entamoeba dispar
SLTQLSQ

SEQ ID NO: 2406438 - protein, 6 aa, Entamoeba dispar
SNEELN

SEQ ID NO: 2406439 - protein, 20 aa, Entamoeba dispar
SNEKAGVARYTDTRPDEQER

SEQ ID NO: 2406440 - protein, 9 aa, Entamoeba dispar
SNNNEGKLT

SEQ ID NO: 2406441 - protein, 44 aa, Entamoeba dispar
SNTMEEETTKDTSSITTIPQSPSQNQTNGTSSQLTQNDKTDTLS

SEQ ID NO: 2406442 - protein, 7 aa, Entamoeba dispar
SNYGNQI

SEQ ID NO: 2406443 - protein, 8 aa, Entamoeba dispar
SPANPTCK

SEQ ID NO: 2406444 - protein, 5 aa, Entamoeba dispar
SPFSP

SEQ ID NO: 2406445 - protein, 5 aa, Entamoeba dispar
SPIEG

SEQ ID NO: 2406446 - protein, 8 aa, Entamoeba dispar
SPNKETVS

SEQ ID NO: 2406447 - protein, 8 aa, Entamoeba dispar
SQKPMTNG

SEQ ID NO: 2406448 - protein, 4 aa, Entamoeba dispar
SQLE

SEQ ID NO: 2406449 - protein, 5 aa, Entamoeba dispar
SQPLK

SEQ ID NO: 2406450 - protein, 8 aa, Entamoeba dispar
SQSITKGT

SEQ ID NO: 2406451 - protein, 8 aa, Entamoeba dispar
SREARNNF

SEQ ID NO: 2406452 - protein, 10 aa, Entamoeba dispar
SRPGQTGSVE

SEQ ID NO: 2406453 - protein, 6 aa, Entamoeba dispar
SRQYDD

SEQ ID NO: 2406454 - protein, 7 aa, Entamoeba dispar
SRRTVPP

SEQ ID NO: 2406455 - protein, 9 aa, Entamoeba dispar
SSENLRKGG

SEQ ID NO: 2406456 - protein, 8 aa, Entamoeba dispar
SSGVEGIG

SEQ ID NO: 2406457 - protein, 6 aa, Entamoeba dispar
SSINEI

SEQ ID NO: 2406458 - protein, 6 aa, Entamoeba dispar
SSINEL

SEQ ID NO: 2406459 - protein, 6 aa, Entamoeba dispar
SSIPKS

SEQ ID NO: 2406460 - protein, 4 aa, Entamoeba dispar
SSIQ

SEQ ID NO: 2406461 - protein, 6 aa, Entamoeba dispar
SSISEI

SEQ ID NO: 2406462 - protein, 5 aa, Entamoeba dispar
SSNNA

SEQ ID NO: 2406463 - protein, 9 aa, Entamoeba dispar
SSNPRLTAS

SEQ ID NO: 2406464 - protein, 6 aa, Entamoeba dispar
SSQIPR

SEQ ID NO: 2406465 - protein, 4 aa, Entamoeba dispar
SSQL

SEQ ID NO: 2406466 - protein, 5 aa, Entamoeba dispar
SSREF

SEQ ID NO: 2406467 - protein, 5 aa, Entamoeba dispar
SSSEF

SEQ ID NO: 2406468 - protein, 8 aa, Entamoeba dispar
SSSEIKTN

SEQ ID NO: 2406469 - protein, 9 aa, Entamoeba dispar
SSSSGKTKF

SEQ ID NO: 2406470 - protein, 10 aa, Entamoeba dispar
STEAREAGFQ

SEQ ID NO: 2406471 - protein, 9 aa, Entamoeba dispar
STGKLDTSK

SEQ ID NO: 2406472 - protein, 5 aa, Entamoeba dispar
STINK

SEQ ID NO: 2406473 - protein, 6 aa, Entamoeba dispar
STNGKC

SEQ ID NO: 2406474 - protein, 15 aa, Entamoeba dispar
STPPLENEEKRTDEV

SEQ ID NO: 2406475 - protein, 14 aa, Entamoeba dispar
STQDLSKDLNTYAE

SEQ ID NO: 2406476 - protein, 10 aa, Entamoeba dispar
STTEYSLGSD

SEQ ID NO: 2406477 - protein, 4 aa, Entamoeba dispar
STTI

SEQ ID NO: 2406478 - protein, 9 aa, Entamoeba dispar
SVKTDSHSE

SEQ ID NO: 2406479 - protein, 4 aa, Entamoeba dispar
SVSE

SEQ ID NO: 2406480 - protein, 12 aa, Entamoeba dispar
SVSGKTIPLLTG

SEQ ID NO: 2406481 - protein, 5 aa, Entamoeba dispar
SVSKI

SEQ ID NO: 2406482 - protein, 5 aa, Entamoeba dispar
SVTEM

SEQ ID NO: 2406483 - protein, 13 aa, Entamoeba dispar
SWKDTQTGQTVSH

SEQ ID NO: 2406484 - protein, 9 aa, Entamoeba dispar
SYNTKSNGI

SEQ ID NO: 2406485 - protein, 10 aa, Entamoeba dispar
SYSSANEKTL

SEQ ID NO: 2406486 - protein, 11 aa, Entamoeba dispar
SYSTTTTPPLE

SEQ ID NO: 2406487 - protein, 5 aa, Entamoeba dispar
SYYRG

SEQ ID NO: 2406488 - protein, 9 aa, Entamoeba dispar
TAASEAKAH

SEQ ID NO: 2406489 - protein, 5 aa, Entamoeba dispar
TADPV

SEQ ID NO: 2406490 - protein, 8 aa, Entamoeba dispar
TAGQERYR

SEQ ID NO: 2406491 - protein, 7 aa, Entamoeba dispar
TAGTEQF

SEQ ID NO: 2406492 - protein, 7 aa, Entamoeba dispar
TAKTNIY

SEQ ID NO: 2406493 - protein, 4 aa, Entamoeba dispar
TDNY

SEQ ID NO: 2406494 - protein, 4 aa, Entamoeba dispar
TDSI

SEQ ID NO: 2406495 - protein, 7 aa, Entamoeba dispar
TEAYKPE

SEQ ID NO: 2406496 - protein, 4 aa, Entamoeba dispar
TEEE

SEQ ID NO: 2406497 - protein, 11 aa, Entamoeba dispar
TEIGNGSFKGC

SEQ ID NO: 2406498 - protein, 4 aa, Entamoeba dispar
TEIP

SEQ ID NO: 2406499 - protein, 7 aa, Entamoeba dispar
TEPDHSG

SEQ ID NO: 2406500 - protein, 4 aa, Entamoeba dispar
TGAN

SEQ ID NO: 2406501 - protein, 4 aa, Entamoeba dispar
TGEE

SEQ ID NO: 2406502 - protein, 5 aa, Entamoeba dispar
TGIGK

SEQ ID NO: 2406503 - protein, 19 aa, Entamoeba dispar
TGINPDNNETQTQINEQPT

SEQ ID NO: 2406504 - protein, 5 aa, Entamoeba dispar
TGISR

SEQ ID NO: 2406505 - protein, 5 aa, Entamoeba dispar
TGTGK

SEQ ID NO: 2406506 - protein, 6 aa, Entamoeba dispar
TGTSQA

SEQ ID NO: 2406507 - protein, 9 aa, Entamoeba dispar
TGVGKSSLG

SEQ ID NO: 2406508 - protein, 6 aa, Entamoeba dispar
THTKIG

SEQ ID NO: 2406509 - protein, 21 aa, Entamoeba dispar
TIDPKGSYSPFSEQELSSPKC

SEQ ID NO: 2406510 - protein, 14 aa, Entamoeba dispar
TIENTEDLTPITPE

SEQ ID NO: 2406511 - protein, 14 aa, Entamoeba dispar
TIESKRNRRQKATL

SEQ ID NO: 2406512 - protein, 6 aa, Entamoeba dispar
TIPSSI

SEQ ID NO: 2406513 - protein, 5 aa, Entamoeba dispar
TIQNA

SEQ ID NO: 2406514 - protein, 11 aa, Entamoeba dispar
TIRTGGKARIC

SEQ ID NO: 2406515 - protein, 5 aa, Entamoeba dispar
TISKI

SEQ ID NO: 2406516 - protein, 14 aa, Entamoeba dispar
TKEEYQQLKKDGKI

SEQ ID NO: 2406517 - protein, 10 aa, Entamoeba dispar
TKEGCENAYQ

SEQ ID NO: 2406518 - protein, 4 aa, Entamoeba dispar
TKEN

SEQ ID NO: 2406519 - protein, 4 aa, Entamoeba dispar
TKEY

SEQ ID NO: 2406520 - protein, 7 aa, Entamoeba dispar
TKGHGYN

SEQ ID NO: 2406521 - protein, 4 aa, Entamoeba dispar
TKGY

SEQ ID NO: 2406522 - protein, 10 aa, Entamoeba dispar
TKIKETEKGY

SEQ ID NO: 2406523 - protein, 12 aa, Entamoeba dispar
TKITDGKSGINR

SEQ ID NO: 2406524 - protein, 13 aa, Entamoeba dispar
TKKSKKTLTSQQY

SEQ ID NO: 2406525 - protein, 4 aa, Entamoeba dispar
TKQA

SEQ ID NO: 2406526 - protein, 6 aa, Entamoeba dispar
TKTDDI

SEQ ID NO: 2406527 - protein, 5 aa, Entamoeba dispar
TKTRQ

SEQ ID NO: 2406528 - protein, 4 aa, Entamoeba dispar
TKYK

SEQ ID NO: 2406529 - protein, 4 aa, Entamoeba dispar
TNDS

SEQ ID NO: 2406530 - protein, 4 aa, Entamoeba dispar
TNEV

SEQ ID NO: 2406531 - protein, 9 aa, Entamoeba dispar
TNLYNAPKY

SEQ ID NO: 2406532 - protein, 19 aa, Entamoeba dispar
TNTPQPFPKLKKKTQCCII

SEQ ID NO: 2406533 - protein, 4 aa, Entamoeba dispar
TNTQ

SEQ ID NO: 2406534 - protein, 4 aa, Entamoeba dispar
TNTS

SEQ ID NO: 2406535 - protein, 4 aa, Entamoeba dispar
TPDK

SEQ ID NO: 2406536 - protein, 13 aa, Entamoeba dispar
TPGFGDTRGIEYD

SEQ ID NO: 2406537 - protein, 11 aa, Entamoeba dispar
TPGFGDTRGME

SEQ ID NO: 2406538 - protein, 6 aa, Entamoeba dispar
TPNEAK

SEQ ID NO: 2406539 - protein, 13 aa, Entamoeba dispar
TPTEDEDIEPNPD

SEQ ID NO: 2406540 - protein, 5 aa, Entamoeba dispar
TQTIE

SEQ ID NO: 2406541 - protein, 12 aa, Entamoeba dispar
TRENTSPNITTG

SEQ ID NO: 2406542 - protein, 6 aa, Entamoeba dispar
TRPDGR

SEQ ID NO: 2406543 - protein, 7 aa, Entamoeba dispar
TRRDDEI

SEQ ID NO: 2406544 - protein, 10 aa, Entamoeba dispar
TSAKSNNNVD

SEQ ID NO: 2406545 - protein, 4 aa, Entamoeba dispar
TSDQ

SEQ ID NO: 2406546 - protein, 5 aa, Entamoeba dispar
TSISE

SEQ ID NO: 2406547 - protein, 5 aa, Entamoeba dispar
TSLRE

SEQ ID NO: 2406548 - protein, 4 aa, Entamoeba dispar
TSQG

SEQ ID NO: 2406549 - protein, 7 aa, Entamoeba dispar
TSSINKK

SEQ ID NO: 2406550 - protein, 23 aa, Entamoeba dispar
TSSKYGHSRFQTTTEKKARMGPM

SEQ ID NO: 2406551 - protein, 4 aa, Entamoeba dispar
TSVS

SEQ ID NO: 2406552 - protein, 6 aa, Entamoeba dispar
TSVTSI

SEQ ID NO: 2406553 - protein, 11 aa, Entamoeba dispar
TVKRTAKQAAY

SEQ ID NO: 2406554 - protein, 5 aa, Entamoeba dispar
TVNPV

SEQ ID NO: 2406555 - protein, 8 aa, Entamoeba dispar
TYETADAI

SEQ ID NO: 2406556 - protein, 5 aa, Entamoeba dispar
TYGTG

SEQ ID NO: 2406557 - protein, 7 aa, Entamoeba dispar
TYSNDPY

SEQ ID NO: 2406558 - protein, 10 aa, Entamoeba dispar
VDSLSGKTVP

SEQ ID NO: 2406559 - protein, 7 aa, Entamoeba dispar
VEASSTM

SEQ ID NO: 2406560 - protein, 4 aa, Entamoeba dispar
VEED

SEQ ID NO: 2406561 - protein, 10 aa, Entamoeba dispar
VEEITTTHKN

SEQ ID NO: 2406562 - protein, 7 aa, Entamoeba dispar
VEGEKRL

SEQ ID NO: 2406563 - protein, 8 aa, Entamoeba dispar
VETEKETL

SEQ ID NO: 2406564 - protein, 7 aa, Entamoeba dispar
VGKTSTI

SEQ ID NO: 2406565 - protein, 8 aa, Entamoeba dispar
VGSNNVNN

SEQ ID NO: 2406566 - protein, 10 aa, Entamoeba dispar
VKDNEDGTYD

SEQ ID NO: 2406567 - protein, 11 aa, Entamoeba dispar
VKDNGDGTYDV

SEQ ID NO: 2406568 - protein, 10 aa, Entamoeba dispar
VKKGSNKPAI

SEQ ID NO: 2406569 - protein, 17 aa, Entamoeba dispar
VKKTNKQQAVKPSTEAV

SEQ ID NO: 2406570 - protein, 7 aa, Entamoeba dispar
VKNGGEV

SEQ ID NO: 2406571 - protein, 13 aa, Entamoeba dispar
VKTKPSPVTLGPG

SEQ ID NO: 2406572 - protein, 7 aa, Entamoeba dispar
VKTQISY

SEQ ID NO: 2406573 - protein, 8 aa, Entamoeba dispar
VNIPSSVS

SEQ ID NO: 2406574 - protein, 9 aa, Entamoeba dispar
VNNKQKTIK

SEQ ID NO: 2406575 - protein, 9 aa, Entamoeba dispar
VNTKEDTPF

SEQ ID NO: 2406576 - protein, 7 aa, Entamoeba dispar
VNVGETD

SEQ ID NO: 2406577 - protein, 11 aa, Entamoeba dispar
VPDDGYEGISQ

SEQ ID NO: 2406578 - protein, 9 aa, Entamoeba dispar
VPKRTNPLK

SEQ ID NO: 2406579 - protein, 5 aa, Entamoeba dispar
VPTPN

SEQ ID NO: 2406580 - protein, 14 aa, Entamoeba dispar
VQAQYKNAKVGEEV

SEQ ID NO: 2406581 - protein, 4 aa, Entamoeba dispar
VRDI

SEQ ID NO: 2406582 - protein, 9 aa, Entamoeba dispar
VSAKKRQEI

SEQ ID NO: 2406583 - protein, 10 aa, Entamoeba dispar
VSANSASTTY

SEQ ID NO: 2406584 - protein, 6 aa, Entamoeba dispar
VSDSWE

SEQ ID NO: 2406585 - protein, 14 aa, Entamoeba dispar
VSSQEAEDLAKREG

SEQ ID NO: 2406586 - protein, 12 aa, Entamoeba dispar
VSTDNGVNYTSY

SEQ ID NO: 2406587 - protein, 8 aa, Entamoeba dispar
VTGGGQVA

SEQ ID NO: 2406588 - protein, 5 aa, Entamoeba dispar
VTPGD

SEQ ID NO: 2406589 - protein, 8 aa, Entamoeba dispar
WEKKEATK

SEQ ID NO: 2406590 - protein, 8 aa, Entamoeba dispar
WGKSYGSC

SEQ ID NO: 2406591 - protein, 5 aa, Entamoeba dispar
WGTGR

SEQ ID NO: 2406592 - protein, 10 aa, Entamoeba dispar
WNETAKQTKM

SEQ ID NO: 2406593 - protein, 10 aa, Entamoeba dispar
WNPQNDLQAQ

SEQ ID NO: 2406594 - protein, 5 aa, Entamoeba dispar
WRRKD

SEQ ID NO: 2406595 - protein, 6 aa, Entamoeba dispar
WSPDSL

SEQ ID NO: 2406596 - protein, 4 aa, Entamoeba dispar
YAAE

SEQ ID NO: 2406597 - protein, 12 aa, Entamoeba dispar
YEGGDADTNGAV

SEQ ID NO: 2406598 - protein, 5 aa, Entamoeba dispar
YENEE

SEQ ID NO: 2406599 - protein, 8 aa, Entamoeba dispar
YGAEREEC

SEQ ID NO: 2406600 - protein, 20 aa, Entamoeba dispar
YGDESKQEHVRDIAKSFVSR

SEQ ID NO: 2406601 - protein, 4 aa, Entamoeba dispar
YGER

SEQ ID NO: 2406602 - protein, 12 aa, Entamoeba dispar
YGGRNMTGENKK

SEQ ID NO: 2406603 - protein, 13 aa, Entamoeba dispar
YGNPGKKVQKTYT

SEQ ID NO: 2406604 - protein, 7 aa, Entamoeba dispar
YIQQEGR

SEQ ID NO: 2406605 - protein, 22 aa, Entamoeba dispar
YKENNNQIESSNEEIKQKGCFI

SEQ ID NO: 2406606 - protein, 13 aa, Entamoeba dispar
YKKKEMKKASRKK

SEQ ID NO: 2406607 - protein, 7 aa, Entamoeba dispar
YKNTKNQ

SEQ ID NO: 2406608 - protein, 10 aa, Entamoeba dispar
YKVNKEQIEN

SEQ ID NO: 2406609 - protein, 10 aa, Entamoeba dispar
YNPVGAHKDI

SEQ ID NO: 2406610 - protein, 14 aa, Entamoeba dispar
YPGSHIGPEPTTDG

SEQ ID NO: 2406611 - protein, 10 aa, Entamoeba dispar
YPKDLTTGKP

SEQ ID NO: 2406612 - protein, 13 aa, Entamoeba dispar
YQLNEQGKRSIES

SEQ ID NO: 2406613 - protein, 8 aa, Entamoeba dispar
YSGNEEVE

SEQ ID NO: 2406614 - protein, 7 aa, Entamoeba dispar
YSTGKTT

SEQ ID NO: 2406615 - protein, 7 aa, Entamoeba dispar
YTDGGEE

SEQ ID NO: 2406616 - protein, 6 aa, Entamoeba dispar
YTPSGT

SEQ ID NO: 2406617 - protein, 4 aa, Entamoeba dispar
YYAP

SEQ ID NO: 2406618 - protein, 18 aa, Entamoeba dispar
YYNEISNNNINDQNNIKL

SEQ ID NO: 2406619 - protein, 12 aa, Entamoeba dispar
YYRNGKGCSKCE

SEQ ID NO: 2406620 - protein, 14 aa, Entamoeba dispar
YYSDKNYPKRRTME

SEQ ID NO: 2406621 - protein, 9 aa, Entamoeba dispar
AAAQTSSNI

SEQ ID NO: 2406622 - protein, 14 aa, Entamoeba dispar
AAASQKLASAPQPP

SEQ ID NO: 2406623 - protein, 6 aa, Entamoeba dispar
AAATEA

SEQ ID NO: 2406624 - protein, 7 aa, Entamoeba dispar
AAGAPEN

SEQ ID NO: 2406625 - protein, 6 aa, Entamoeba dispar
AAGKTS

SEQ ID NO: 2406626 - protein, 6 aa, Entamoeba dispar
AAGKTT

SEQ ID NO: 2406627 - protein, 5 aa, Entamoeba dispar
AAGQI

SEQ ID NO: 2406628 - protein, 5 aa, Entamoeba dispar
AAMHS

SEQ ID NO: 2406629 - protein, 4 aa, Entamoeba dispar
AANN

SEQ ID NO: 2406630 - protein, 15 aa, Entamoeba dispar
AANTSLNSKVVNQSS

SEQ ID NO: 2406631 - protein, 36 aa, Entamoeba dispar
AAPAATTAQTETKAEEKKEEKKEEEEEEDFGGFGDL

SEQ ID NO: 2406632 - protein, 6 aa, Entamoeba dispar
AAPTPK

SEQ ID NO: 2406633 - protein, 7 aa, Entamoeba dispar
AAQERNY

SEQ ID NO: 2406634 - protein, 15 aa, Entamoeba dispar
AAQGIKEDKKWEGKV

SEQ ID NO: 2406635 - protein, 6 aa, Entamoeba dispar
AARVGD

SEQ ID NO: 2406636 - protein, 11 aa, Entamoeba dispar
AATNLRRPEEG

SEQ ID NO: 2406637 - protein, 5 aa, Entamoeba dispar
AATQA

SEQ ID NO: 2406638 - protein, 7 aa, Entamoeba dispar
AAWKPNT

SEQ ID NO: 2406639 - protein, 6 aa, Entamoeba dispar
ADDVAN

SEQ ID NO: 2406640 - protein, 19 aa, Entamoeba dispar
ADENQKPITTEEGEKLAKD

SEQ ID NO: 2406641 - protein, 12 aa, Entamoeba dispar
ADGDGKLTKEEV

SEQ ID NO: 2406642 - protein, 11 aa, Entamoeba dispar
ADGKSAKEVIT

SEQ ID NO: 2406643 - protein, 10 aa, Entamoeba dispar
ADKYTKKTKL

SEQ ID NO: 2406644 - protein, 11 aa, Entamoeba dispar
ADNEEKTPQER

SEQ ID NO: 2406645 - protein, 6 aa, Entamoeba dispar
ADNQEG

SEQ ID NO: 2406646 - protein, 14 aa, Entamoeba dispar
ADNTKIISGGRDKT

SEQ ID NO: 2406647 - protein, 5 aa, Entamoeba dispar
AEAEV

SEQ ID NO: 2406648 - protein, 25 aa, Entamoeba dispar
AEDKTTRKKNKITITNDKGRLSKEE

SEQ ID NO: 2406649 - protein, 14 aa, Entamoeba dispar
AEDSGQIELGDSQF

SEQ ID NO: 2406650 - protein, 10 aa, Entamoeba dispar
AEEREQAERI

SEQ ID NO: 2406651 - protein, 17 aa, Entamoeba dispar
AEEYRKGKESWLFTKLR

SEQ ID NO: 2406652 - protein, 8 aa, Entamoeba dispar
AEGADPQV

SEQ ID NO: 2406653 - protein, 15 aa, Entamoeba dispar
AEKEKRLGEAERLAR

SEQ ID NO: 2406654 - protein, 9 aa, Entamoeba dispar
AEKKQPAKH

SEQ ID NO: 2406655 - protein, 12 aa, Entamoeba dispar
AEKNQRSEIARG

SEQ ID NO: 2406656 - protein, 6 aa, Entamoeba dispar
AEKTNP

SEQ ID NO: 2406657 - protein, 6 aa, Entamoeba dispar
AEKYGN

SEQ ID NO: 2406658 - protein, 8 aa, Entamoeba dispar
AELSEQPN

SEQ ID NO: 2406659 - protein, 14 aa, Entamoeba dispar
AENETELSLKEGDK

SEQ ID NO: 2406660 - protein, 6 aa, Entamoeba dispar
AENQVL

SEQ ID NO: 2406661 - protein, 7 aa, Entamoeba dispar
AEQAGIQ

SEQ ID NO: 2406662 - protein, 9 aa, Entamoeba dispar
AEREQKNPT

SEQ ID NO: 2406663 - protein, 10 aa, Entamoeba dispar
AERLKDPHYK

SEQ ID NO: 2406664 - protein, 5 aa, Entamoeba dispar
AERSL

SEQ ID NO: 2406665 - protein, 4 aa, Entamoeba dispar
AESG

SEQ ID NO: 2406666 - protein, 5 aa, Entamoeba dispar
AETEK

SEQ ID NO: 2406667 - protein, 5 aa, Entamoeba dispar
AETSI

SEQ ID NO: 2406668 - protein, 6 aa, Entamoeba dispar
AETVST

SEQ ID NO: 2406669 - protein, 21 aa, Entamoeba dispar
AEVSNAETLNVKTESPQAHDY

SEQ ID NO: 2406670 - protein, 16 aa, Entamoeba dispar
AEYDEFGASYINSKDK

SEQ ID NO: 2406671 - protein, 8 aa, Entamoeba dispar
AFDGNHDG

SEQ ID NO: 2406672 - protein, 4 aa, Entamoeba dispar
AFDS

SEQ ID NO: 2406673 - protein, 6 aa, Entamoeba dispar
AFHQKE

SEQ ID NO: 2406674 - protein, 5 aa, Entamoeba dispar
AFQED

SEQ ID NO: 2406675 - protein, 8 aa, Entamoeba dispar
AGAEIDEA

SEQ ID NO: 2406676 - protein, 7 aa, Entamoeba dispar
AGATNNV

SEQ ID NO: 2406677 - protein, 6 aa, Entamoeba dispar
AGDDKT

SEQ ID NO: 2406678 - protein, 13 aa, Entamoeba dispar
AGDLTEADKSNDL

SEQ ID NO: 2406679 - protein, 9 aa, Entamoeba dispar
AGDPAAPGL

SEQ ID NO: 2406680 - protein, 9 aa, Entamoeba dispar
AGEEQPRKV

SEQ ID NO: 2406681 - protein, 6 aa, Entamoeba dispar
AGESKN

SEQ ID NO: 2406682 - protein, 11 aa, Entamoeba dispar
AGFPAHASEKQ

SEQ ID NO: 2406683 - protein, 9 aa, Entamoeba dispar
AGGKDGREK

SEQ ID NO: 2406684 - protein, 6 aa, Entamoeba dispar
AGGNMT

SEQ ID NO: 2406685 - protein, 9 aa, Entamoeba dispar
AGGQGSRLG

SEQ ID NO: 2406686 - protein, 6 aa, Entamoeba dispar
AGKGEK

SEQ ID NO: 2406687 - protein, 5 aa, Entamoeba dispar
AGKKA

SEQ ID NO: 2406688 - protein, 6 aa, Entamoeba dispar
AGNPAR

SEQ ID NO: 2406689 - protein, 7 aa, Entamoeba dispar
AGPTIEP

SEQ ID NO: 2406690 - protein, 7 aa, Entamoeba dispar
AGQEKYR

SEQ ID NO: 2406691 - protein, 37 aa, Entamoeba dispar
AGSQETPYKGSDINKPLPEVQSQQSIQEEPKEEIKEP

SEQ ID NO: 2406692 - protein, 12 aa, Entamoeba dispar
AGSRKVNELHGT

SEQ ID NO: 2406693 - protein, 8 aa, Entamoeba dispar
AGSSKRPI

SEQ ID NO: 2406694 - protein, 32 aa, Entamoeba dispar
AGTLPKQYTEKEKIAPGTDLSNGNPPAKKPTL

SEQ ID NO: 2406695 - protein, 5 aa, Entamoeba dispar
AGVGD

SEQ ID NO: 2406696 - protein, 5 aa, Entamoeba dispar
AHEQG

SEQ ID NO: 2406697 - protein, 6 aa, Entamoeba dispar
AHGDEF

SEQ ID NO: 2406698 - protein, 7 aa, Entamoeba dispar
AHPQYSS

SEQ ID NO: 2406699 - protein, 6 aa, Entamoeba dispar
AIDETT

SEQ ID NO: 2406700 - protein, 41 aa, Entamoeba dispar
AIEEENSDDYDDYDEYGDEEMNNPMEQQPLGGNGNDPDIIY

SEQ ID NO: 2406701 - protein, 10 aa, Entamoeba dispar
AIGANYQAAE

SEQ ID NO: 2406702 - protein, 17 aa, Entamoeba dispar
AIKEDNSIKQCSEEKIK

SEQ ID NO: 2406703 - protein, 7 aa, Entamoeba dispar
AIPPNKR

SEQ ID NO: 2406704 - protein, 11 aa, Entamoeba dispar
AIYDDNTEDGF

SEQ ID NO: 2406705 - protein, 9 aa, Entamoeba dispar
AKDAVSLGR

SEQ ID NO: 2406706 - protein, 5 aa, Entamoeba dispar
AKENN

SEQ ID NO: 2406707 - protein, 4 aa, Entamoeba dispar
AKEV

SEQ ID NO: 2406708 - protein, 7 aa, Entamoeba dispar
AKEVESK

SEQ ID NO: 2406709 - protein, 8 aa, Entamoeba dispar
AKEVREQL

SEQ ID NO: 2406710 - protein, 7 aa, Entamoeba dispar
AKFPGGI

SEQ ID NO: 2406711 - protein, 4 aa, Entamoeba dispar
AKGA

SEQ ID NO: 2406712 - protein, 24 aa, Entamoeba dispar
AKHATAAPTEAEKKPAKGSKKQVK

SEQ ID NO: 2406713 - protein, 8 aa, Entamoeba dispar
AKIDKSNI

SEQ ID NO: 2406714 - protein, 18 aa, Entamoeba dispar
AKKGNGINHPESEELQNK

SEQ ID NO: 2406715 - protein, 6 aa, Entamoeba dispar
AKKNAI

SEQ ID NO: 2406716 - protein, 57 aa, Entamoeba dispar
AKKRNAAIKEIKEKKAENAAKKEAARKEAKANGKKATNTYKKSNAKLPKAGHANFNS

SEQ ID NO: 2406717 - protein, 7 aa, Entamoeba dispar
AKKSITE

SEQ ID NO: 2406718 - protein, 15 aa, Entamoeba dispar
AKKYNKKTVDQSTIP

SEQ ID NO: 2406719 - protein, 17 aa, Entamoeba dispar
AKNAIAAYKAALAKKIA

SEQ ID NO: 2406720 - protein, 14 aa, Entamoeba dispar
AKNCKGDQITQGGV

SEQ ID NO: 2406721 - protein, 13 aa, Entamoeba dispar
AKNEAERKERAAK

SEQ ID NO: 2406722 - protein, 25 aa, Entamoeba dispar
AKNVAKAVSGIAKGQKKANNAPSKK

SEQ ID NO: 2406723 - protein, 10 aa, Entamoeba dispar
AKNVKGKAKL

SEQ ID NO: 2406724 - protein, 6 aa, Entamoeba dispar
AKQEIP

SEQ ID NO: 2406725 - protein, 9 aa, Entamoeba dispar
AKQQQAEIG

SEQ ID NO: 2406726 - protein, 13 aa, Entamoeba dispar
AKRKSKNRDAAQQ

SEQ ID NO: 2406727 - protein, 7 aa, Entamoeba dispar
AKSAEIL

SEQ ID NO: 2406728 - protein, 9 aa, Entamoeba dispar
AKTGEGVKE

SEQ ID NO: 2406729 - protein, 10 aa, Entamoeba dispar
AKTGEGVSNA

SEQ ID NO: 2406730 - protein, 8 aa, Entamoeba dispar
AKTGNGKL

SEQ ID NO: 2406731 - protein, 8 aa, Entamoeba dispar
AKTKGTNE

SEQ ID NO: 2406732 - protein, 31 aa, Entamoeba dispar
AKTNLEKKQSVKEDKKKATKTVKKADKKTQK

SEQ ID NO: 2406733 - protein, 6 aa, Entamoeba dispar
AKTSMQ

SEQ ID NO: 2406734 - protein, 7 aa, Entamoeba dispar
AKTVQRG

SEQ ID NO: 2406735 - protein, 12 aa, Entamoeba dispar
AKVTGGAPAKIS

SEQ ID NO: 2406736 - protein, 6 aa, Entamoeba dispar
AKYGEI

SEQ ID NO: 2406737 - protein, 8 aa, Entamoeba dispar
AKYSPSGY

SEQ ID NO: 2406738 - protein, 22 aa, Entamoeba dispar
AKYVPKEIRPKTTRKERRQLTK

SEQ ID NO: 2406739 - protein, 30 aa, Entamoeba dispar
ALDEMKSRRAMTRSLPKKSDEKKPKKPEVD

SEQ ID NO: 2406740 - protein, 5 aa, Entamoeba dispar
ALESP

SEQ ID NO: 2406741 - protein, 4 aa, Entamoeba dispar
ALPE

SEQ ID NO: 2406742 - protein, 7 aa, Entamoeba dispar
ALPEPDE

SEQ ID NO: 2406743 - protein, 13 aa, Entamoeba dispar
ALPPPAKGEEKEM

SEQ ID NO: 2406744 - protein, 6 aa, Entamoeba dispar
ALPYEE

SEQ ID NO: 2406745 - protein, 7 aa, Entamoeba dispar
ALRDNSM

SEQ ID NO: 2406746 - protein, 4 aa, Entamoeba dispar
AMNT

SEQ ID NO: 2406747 - protein, 4 aa, Entamoeba dispar
AMTN

SEQ ID NO: 2406748 - protein, 8 aa, Entamoeba dispar
ANASKSSV

SEQ ID NO: 2406749 - protein, 11 aa, Entamoeba dispar
ANDQSAGIKSE

SEQ ID NO: 2406750 - protein, 7 aa, Entamoeba dispar
ANDTEKH

SEQ ID NO: 2406751 - protein, 6 aa, Entamoeba dispar
ANEKFK

SEQ ID NO: 2406752 - protein, 7 aa, Entamoeba dispar
ANEKFKG

SEQ ID NO: 2406753 - protein, 5 aa, Entamoeba dispar
ANERV

SEQ ID NO: 2406754 - protein, 4 aa, Entamoeba dispar
ANET

SEQ ID NO: 2406755 - protein, 7 aa, Entamoeba dispar
ANEVTRT

SEQ ID NO: 2406756 - protein, 7 aa, Entamoeba dispar
ANGDIDE

SEQ ID NO: 2406757 - protein, 9 aa, Entamoeba dispar
ANGEPLTSD

SEQ ID NO: 2406758 - protein, 6 aa, Entamoeba dispar
ANIEES

SEQ ID NO: 2406759 - protein, 4 aa, Entamoeba dispar
ANKG

SEQ ID NO: 2406760 - protein, 8 aa, Entamoeba dispar
ANKGVKSD

SEQ ID NO: 2406761 - protein, 8 aa, Entamoeba dispar
ANKNKAKD

SEQ ID NO: 2406762 - protein, 8 aa, Entamoeba dispar
ANKTAEEV

SEQ ID NO: 2406763 - protein, 7 aa, Entamoeba dispar
ANLGDAE

SEQ ID NO: 2406764 - protein, 6 aa, Entamoeba dispar
ANMTDA

SEQ ID NO: 2406765 - protein, 4 aa, Entamoeba dispar
ANNA

SEQ ID NO: 2406766 - protein, 18 aa, Entamoeba dispar
ANNDNFESYQQRGLEEGT

SEQ ID NO: 2406767 - protein, 5 aa, Entamoeba dispar
ANNPI

SEQ ID NO: 2406768 - protein, 7 aa, Entamoeba dispar
ANPINEI

SEQ ID NO: 2406769 - protein, 6 aa, Entamoeba dispar
ANSRKA

SEQ ID NO: 2406770 - protein, 8 aa, Entamoeba dispar
ANTDNAES

SEQ ID NO: 2406771 - protein, 6 aa, Entamoeba dispar
ANTNKM

SEQ ID NO: 2406772 - protein, 17 aa, Entamoeba dispar
ANYQQKYTQQGGSRPFG

SEQ ID NO: 2406773 - protein, 6 aa, Entamoeba dispar
APAFPE

SEQ ID NO: 2406774 - protein, 4 aa, Entamoeba dispar
APAQ

SEQ ID NO: 2406775 - protein, 6 aa, Entamoeba dispar
APDEEI

SEQ ID NO: 2406776 - protein, 7 aa, Entamoeba dispar
APEFPGD

SEQ ID NO: 2406777 - protein, 11 aa, Entamoeba dispar
APEKKVAGEGF

SEQ ID NO: 2406778 - protein, 8 aa, Entamoeba dispar
APGSGKTT

SEQ ID NO: 2406779 - protein, 9 aa, Entamoeba dispar
APIPTGKEV

SEQ ID NO: 2406780 - protein, 4 aa, Entamoeba dispar
APNV

SEQ ID NO: 2406781 - protein, 6 aa, Entamoeba dispar
APPHGF

SEQ ID NO: 2406782 - protein, 4 aa, Entamoeba dispar
APQA

SEQ ID NO: 2406783 - protein, 6 aa, Entamoeba dispar
APQAVA

SEQ ID NO: 2406784 - protein, 10 aa, Entamoeba dispar
APQPRVTVPQ

SEQ ID NO: 2406785 - protein, 4 aa, Entamoeba dispar
APSR

SEQ ID NO: 2406786 - protein, 6 aa, Entamoeba dispar
APSTSI

SEQ ID NO: 2406787 - protein, 4 aa, Entamoeba dispar
APTI

SEQ ID NO: 2406788 - protein, 4 aa, Entamoeba dispar
APYT

SEQ ID NO: 2406789 - protein, 5 aa, Entamoeba dispar
AQESI

SEQ ID NO: 2406790 - protein, 6 aa, Entamoeba dispar
AQETKN

SEQ ID NO: 2406791 - protein, 26 aa, Entamoeba dispar
AQIEKKSNNEEEITIEKEKIDKFFAQ

SEQ ID NO: 2406792 - protein, 6 aa, Entamoeba dispar
AQKSLS

SEQ ID NO: 2406793 - protein, 4 aa, Entamoeba dispar
AQPK

SEQ ID NO: 2406794 - protein, 8 aa, Entamoeba dispar
AQPPPDFS

SEQ ID NO: 2406795 - protein, 7 aa, Entamoeba dispar
AQQNGFV

SEQ ID NO: 2406796 - protein, 5 aa, Entamoeba dispar
AQTIS

SEQ ID NO: 2406797 - protein, 7 aa, Entamoeba dispar
AQTKVED

SEQ ID NO: 2406798 - protein, 8 aa, Entamoeba dispar
AQTTPEEF

SEQ ID NO: 2406799 - protein, 10 aa, Entamoeba dispar
AQVQTTVSEL

SEQ ID NO: 2406800 - protein, 51 aa, Entamoeba dispar
ARANRGGSAPHPTRGAPAPRGMPSRGSPVPRGRGGMMPPAQVPEHEEQETP

SEQ ID NO: 2406801 - protein, 7 aa, Entamoeba dispar
ARDATNV

SEQ ID NO: 2406802 - protein, 5 aa, Entamoeba dispar
AREEK

SEQ ID NO: 2406803 - protein, 4 aa, Entamoeba dispar
ARGV

SEQ ID NO: 2406804 - protein, 4 aa, Entamoeba dispar
ARHT

SEQ ID NO: 2406805 - protein, 8 aa, Entamoeba dispar
ARTSTCTQ

SEQ ID NO: 2406806 - protein, 14 aa, Entamoeba dispar
ASAAQRAGRAGRNF

SEQ ID NO: 2406807 - protein, 7 aa, Entamoeba dispar
ASAEQCK

SEQ ID NO: 2406808 - protein, 4 aa, Entamoeba dispar
ASCG

SEQ ID NO: 2406809 - protein, 6 aa, Entamoeba dispar
ASDSDL

SEQ ID NO: 2406810 - protein, 13 aa, Entamoeba dispar
ASEEYDRAAEAYD

SEQ ID NO: 2406811 - protein, 9 aa, Entamoeba dispar
ASERDDPKT

SEQ ID NO: 2406812 - protein, 13 aa, Entamoeba dispar
ASESTKIKDKREI

SEQ ID NO: 2406813 - protein, 6 aa, Entamoeba dispar
ASGDKL

SEQ ID NO: 2406814 - protein, 37 aa, Entamoeba dispar
ASIDRPPIDSKTPLDKVSDRTQQDLQNRTQLDRNQRL

SEQ ID NO: 2406815 - protein, 18 aa, Entamoeba dispar
ASIPGVKNNTESDKSDTR

SEQ ID NO: 2406816 - protein, 7 aa, Entamoeba dispar
ASKDSTV

SEQ ID NO: 2406817 - protein, 4 aa, Entamoeba dispar
ASKG

SEQ ID NO: 2406818 - protein, 9 aa, Entamoeba dispar
ASNKAREVV

SEQ ID NO: 2406819 - protein, 8 aa, Entamoeba dispar
ASNKTEVA

SEQ ID NO: 2406820 - protein, 5 aa, Entamoeba dispar
ASNPQ

SEQ ID NO: 2406821 - protein, 6 aa, Entamoeba dispar
ASSEGT

SEQ ID NO: 2406822 - protein, 10 aa, Entamoeba dispar
ASSRLSSQQA

SEQ ID NO: 2406823 - protein, 10 aa, Entamoeba dispar
ASSSRDMSSK

SEQ ID NO: 2406824 - protein, 7 aa, Entamoeba dispar
ASSTNPL

SEQ ID NO: 2406825 - protein, 8 aa, Entamoeba dispar
ASTDTTAK

SEQ ID NO: 2406826 - protein, 9 aa, Entamoeba dispar
ASTRGVTEG

SEQ ID NO: 2406827 - protein, 8 aa, Entamoeba dispar
ASTSAGCK

SEQ ID NO: 2406828 - protein, 5 aa, Entamoeba dispar
ASTSI

SEQ ID NO: 2406829 - protein, 4 aa, Entamoeba dispar
ATAY

SEQ ID NO: 2406830 - protein, 5 aa, Entamoeba dispar
ATEDP

SEQ ID NO: 2406831 - protein, 4 aa, Entamoeba dispar
ATEE

SEQ ID NO: 2406832 - protein, 17 aa, Entamoeba dispar
ATEGETHLGGKDIDRKV

SEQ ID NO: 2406833 - protein, 9 aa, Entamoeba dispar
ATEPEAVKK

SEQ ID NO: 2406834 - protein, 10 aa, Entamoeba dispar
ATGAGTEAAQ

SEQ ID NO: 2406835 - protein, 19 aa, Entamoeba dispar
ATKDATKPKKAGDEEKKTM

SEQ ID NO: 2406836 - protein, 6 aa, Entamoeba dispar
ATKTMV

SEQ ID NO: 2406837 - protein, 6 aa, Entamoeba dispar
ATLPSK

SEQ ID NO: 2406838 - protein, 11 aa, Entamoeba dispar
ATLPTGEGDIT

SEQ ID NO: 2406839 - protein, 6 aa, Entamoeba dispar
ATNERI

SEQ ID NO: 2406840 - protein, 8 aa, Entamoeba dispar
ATNGDTME

SEQ ID NO: 2406841 - protein, 4 aa, Entamoeba dispar
ATNT

SEQ ID NO: 2406842 - protein, 4 aa, Entamoeba dispar
ATPI

SEQ ID NO: 2406843 - protein, 10 aa, Entamoeba dispar
ATRNRTNPTQ

SEQ ID NO: 2406844 - protein, 13 aa, Entamoeba dispar
ATSTIGGEDKVRT

SEQ ID NO: 2406845 - protein, 7 aa, Entamoeba dispar
ATVKRER

SEQ ID NO: 2406846 - protein, 5 aa, Entamoeba dispar
ATYPE

SEQ ID NO: 2406847 - protein, 9 aa, Entamoeba dispar
AVEETGRGI

SEQ ID NO: 2406848 - protein, 7 aa, Entamoeba dispar
AVETPNA

SEQ ID NO: 2406849 - protein, 6 aa, Entamoeba dispar
AVGYTG

SEQ ID NO: 2406850 - protein, 16 aa, Entamoeba dispar
AVKKGSLDQQEANRRI

SEQ ID NO: 2406851 - protein, 22 aa, Entamoeba dispar
AYGDQYNKHYNPSHRTLGSGKV

SEQ ID NO: 2406852 - protein, 7 aa, Entamoeba dispar
AYGYTQK

SEQ ID NO: 2406853 - protein, 6 aa, Entamoeba dispar
AYKSKW

SEQ ID NO: 2406854 - protein, 19 aa, Entamoeba dispar
AYSSGKPALGVGAGNVPTY

SEQ ID NO: 2406855 - protein, 11 aa, Entamoeba dispar
CAEGDGNTIIE

SEQ ID NO: 2406856 - protein, 5 aa, Entamoeba dispar
CASGN

SEQ ID NO: 2406857 - protein, 17 aa, Entamoeba dispar
CATTPTITLGDNIQYSI

SEQ ID NO: 2406858 - protein, 5 aa, Entamoeba dispar
CDSNN

SEQ ID NO: 2406859 - protein, 8 aa, Entamoeba dispar
CDTKRSEL

SEQ ID NO: 2406860 - protein, 13 aa, Entamoeba dispar
CEADGKESCPNRH

SEQ ID NO: 2406861 - protein, 12 aa, Entamoeba dispar
CEATGKEIPTGT

SEQ ID NO: 2406862 - protein, 8 aa, Entamoeba dispar
CEATGKVG

SEQ ID NO: 2406863 - protein, 12 aa, Entamoeba dispar
CEFTTSAKSLTQ

SEQ ID NO: 2406864 - protein, 4 aa, Entamoeba dispar
CEPL

SEQ ID NO: 2406865 - protein, 5 aa, Entamoeba dispar
CEPYP

SEQ ID NO: 2406866 - protein, 6 aa, Entamoeba dispar
CETCYG

SEQ ID NO: 2406867 - protein, 6 aa, Entamoeba dispar
CFEGSN

SEQ ID NO: 2406868 - protein, 8 aa, Entamoeba dispar
CGATTTTF

SEQ ID NO: 2406869 - protein, 5 aa, Entamoeba dispar
CGEHP

SEQ ID NO: 2406870 - protein, 4 aa, Entamoeba dispar
CGNN

SEQ ID NO: 2406871 - protein, 6 aa, Entamoeba dispar
CGNQVG

SEQ ID NO: 2406872 - protein, 4 aa, Entamoeba dispar
CGPA

SEQ ID NO: 2406873 - protein, 6 aa, Entamoeba dispar
CGPPEN

SEQ ID NO: 2406874 - protein, 8 aa, Entamoeba dispar
CGPRPQME

SEQ ID NO: 2406875 - protein, 4 aa, Entamoeba dispar
CGQP

SEQ ID NO: 2406876 - protein, 10 aa, Entamoeba dispar
CKAAPNGSVM

SEQ ID NO: 2406877 - protein, 7 aa, Entamoeba dispar
CKEEEEM

SEQ ID NO: 2406878 - protein, 7 aa, Entamoeba dispar
CKEPTKS

SEQ ID NO: 2406879 - protein, 6 aa, Entamoeba dispar
CKIGNE

SEQ ID NO: 2406880 - protein, 7 aa, Entamoeba dispar
CLPSANQ

SEQ ID NO: 2406881 - protein, 14 aa, Entamoeba dispar
CLTPSKCKKSQTKY

SEQ ID NO: 2406882 - protein, 10 aa, Entamoeba dispar
CNDGKSKELL

SEQ ID NO: 2406883 - protein, 6 aa, Entamoeba dispar
CNESTI

SEQ ID NO: 2406884 - protein, 7 aa, Entamoeba dispar
CNGEETS

SEQ ID NO: 2406885 - protein, 12 aa, Entamoeba dispar
CNKNNTKSIPSK

SEQ ID NO: 2406886 - protein, 10 aa, Entamoeba dispar
CNNTKSEEEI

SEQ ID NO: 2406887 - protein, 9 aa, Entamoeba dispar
CNQKRKAKI

SEQ ID NO: 2406888 - protein, 10 aa, Entamoeba dispar
CNSGEYNGKI

SEQ ID NO: 2406889 - protein, 7 aa, Entamoeba dispar
CNTAKLP

SEQ ID NO: 2406890 - protein, 5 aa, Entamoeba dispar
CPEEQ

SEQ ID NO: 2406891 - protein, 6 aa, Entamoeba dispar
CPEMPE

SEQ ID NO: 2406892 - protein, 5 aa, Entamoeba dispar
CPINR

SEQ ID NO: 2406893 - protein, 9 aa, Entamoeba dispar
CPKESQIGV

SEQ ID NO: 2406894 - protein, 6 aa, Entamoeba dispar
CPKGDK

SEQ ID NO: 2406895 - protein, 5 aa, Entamoeba dispar
CPPLE

SEQ ID NO: 2406896 - protein, 7 aa, Entamoeba dispar
CPTSPSP

SEQ ID NO: 2406897 - protein, 19 aa, Entamoeba dispar
CQNLKPKDLDLGSDKSGNI

SEQ ID NO: 2406898 - protein, 7 aa, Entamoeba dispar
CRGVPDP

SEQ ID NO: 2406899 - protein, 9 aa, Entamoeba dispar
CSEDKQKPI

SEQ ID NO: 2406900 - protein, 6 aa, Entamoeba dispar
CSEDRN

SEQ ID NO: 2406901 - protein, 8 aa, Entamoeba dispar
CSEGLKKN

SEQ ID NO: 2406902 - protein, 11 aa, Entamoeba dispar
CSRKDEKGIGE

SEQ ID NO: 2406903 - protein, 8 aa, Entamoeba dispar
CTDYQSRE

SEQ ID NO: 2406904 - protein, 5 aa, Entamoeba dispar
CTLDD

SEQ ID NO: 2406905 - protein, 4 aa, Entamoeba dispar
CTNQ

SEQ ID NO: 2406906 - protein, 6 aa, Entamoeba dispar
CTTPDE

SEQ ID NO: 2406907 - protein, 18 aa, Entamoeba dispar
DAAIAEEKNSNTSGGQEF

SEQ ID NO: 2406908 - protein, 17 aa, Entamoeba dispar
DAEDDATRQISTYDSEY

SEQ ID NO: 2406909 - protein, 6 aa, Entamoeba dispar
DAENQE

SEQ ID NO: 2406910 - protein, 18 aa, Entamoeba dispar
DAFGSCGDKERNIEPNKE

SEQ ID NO: 2406911 - protein, 7 aa, Entamoeba dispar
DAKSVDN

SEQ ID NO: 2406912 - protein, 5 aa, Entamoeba dispar
DALGT

SEQ ID NO: 2406913 - protein, 9 aa, Entamoeba dispar
DALKPRKNV

SEQ ID NO: 2406914 - protein, 4 aa, Entamoeba dispar
DANA

SEQ ID NO: 2406915 - protein, 7 aa, Entamoeba dispar
DANGDTQ

SEQ ID NO: 2406916 - protein, 15 aa, Entamoeba dispar
DANKRLPSIRKTGEA

SEQ ID NO: 2406917 - protein, 6 aa, Entamoeba dispar
DAPTVE

SEQ ID NO: 2406918 - protein, 5 aa, Entamoeba dispar
DATNF

SEQ ID NO: 2406919 - protein, 7 aa, Entamoeba dispar
DATNSYL

SEQ ID NO: 2406920 - protein, 9 aa, Entamoeba dispar
DAVEQAKGK

SEQ ID NO: 2406921 - protein, 4 aa, Entamoeba dispar
DDAS

SEQ ID NO: 2406922 - protein, 12 aa, Entamoeba dispar
DDDSSKKNDSMK

SEQ ID NO: 2406923 - protein, 5 aa, Entamoeba dispar
DDEAA

SEQ ID NO: 2406924 - protein, 5 aa, Entamoeba dispar
DDEDN

SEQ ID NO: 2406925 - protein, 28 aa, Entamoeba dispar
DDEIGAEKSVEKYKTIDPSISSERDYKT

SEQ ID NO: 2406926 - protein, 13 aa, Entamoeba dispar
DDENKARIETKNQ

SEQ ID NO: 2406927 - protein, 6 aa, Entamoeba dispar
DDEQSL

SEQ ID NO: 2406928 - protein, 9 aa, Entamoeba dispar
DDEQVQEDI

SEQ ID NO: 2406929 - protein, 4 aa, Entamoeba dispar
DDGY

SEQ ID NO: 2406930 - protein, 19 aa, Entamoeba dispar
DDIDDNLNDLNDNDENNLN

SEQ ID NO: 2406931 - protein, 31 aa, Entamoeba dispar; identical to SEQ ID NO: 2360805

SEQ ID NO: 2406932 - protein, 5 aa, Entamoeba dispar
DDKDN

SEQ ID NO: 2406933 - protein, 28 aa, Entamoeba dispar
DDKEEEPATEPVPAVEETPIEDSKMEEV

SEQ ID NO: 2406934 - protein, 5 aa, Entamoeba dispar
DDKSL

SEQ ID NO: 2406935 - protein, 4 aa, Entamoeba dispar
DDKT

SEQ ID NO: 2406936 - protein, 7 aa, Entamoeba dispar
DDKTSFE

SEQ ID NO: 2406937 - protein, 5 aa, Entamoeba dispar
DDLRQ

SEQ ID NO: 2406938 - protein, 28 aa, Entamoeba dispar
DDNSKERRREGRGLLDGETTLKKKKVEN

SEQ ID NO: 2406939 - protein, 7 aa, Entamoeba dispar
DDPKKYY

SEQ ID NO: 2406940 - protein, 4 aa, Entamoeba dispar
DDPN

SEQ ID NO: 2406941 - protein, 4 aa, Entamoeba dispar
DDRK

SEQ ID NO: 2406942 - protein, 7 aa, Entamoeba dispar
DDSMPLP

SEQ ID NO: 2406943 - protein, 9 aa, Entamoeba dispar
DDTEREDID

SEQ ID NO: 2406944 - protein, 7 aa, Entamoeba dispar
DDTHYEN

SEQ ID NO: 2406945 - protein, 4 aa, Entamoeba dispar
DDTR

SEQ ID NO: 2406946 - protein, 5 aa, Entamoeba dispar
DDVFN

SEQ ID NO: 2406947 - protein, 7 aa, Entamoeba dispar
DDVKGKE

SEQ ID NO: 2406948 - protein, 10 aa, Entamoeba dispar
DEAEEEDNLS

SEQ ID NO: 2406949 - protein, 31 aa, Entamoeba dispar
DEDDEEGDDDYDANKFEDYDQEDMSEERHSE

SEQ ID NO: 2406950 - protein, 14 aa, Entamoeba dispar
DEDIKEKEEINTKL

SEQ ID NO: 2406951 - protein, 8 aa, Entamoeba dispar
DEDPNNPI

SEQ ID NO: 2406952 - protein, 10 aa, Entamoeba dispar
DEDQQDFNDV

SEQ ID NO: 2406953 - protein, 7 aa, Entamoeba dispar
DEDTDEV

SEQ ID NO: 2406954 - protein, 17 aa, Entamoeba dispar
DEEEKIPMSSERESEEI

SEQ ID NO: 2406955 - protein, 6 aa, Entamoeba dispar
DEEEKK

SEQ ID NO: 2406956 - protein, 4 aa, Entamoeba dispar
DEEI

SEQ ID NO: 2406957 - protein, 7 aa, Entamoeba dispar
DEELEKE

SEQ ID NO: 2406958 - protein, 5 aa, Entamoeba dispar
DEENE

SEQ ID NO: 2406959 - protein, 14 aa, Entamoeba dispar
DEENENNDNNSDDF

SEQ ID NO: 2406960 - protein, 12 aa, Entamoeba dispar
DEEPDKRPNAEE

SEQ ID NO: 2406961 - protein, 15 aa, Entamoeba dispar
DEERNKIQRENEKSL

SEQ ID NO: 2406962 - protein, 7 aa, Entamoeba dispar
DEESVTV

SEQ ID NO: 2406963 - protein, 6 aa, Entamoeba dispar
DEFEKQ

SEQ ID NO: 2406964 - protein, 6 aa, Entamoeba dispar
DEGITG

SEQ ID NO: 2406965 - protein, 14 aa, Entamoeba dispar
DEGKEIKEEEELKE

SEQ ID NO: 2406966 - protein, 11 aa, Entamoeba dispar
DEHGEGKHPTI

SEQ ID NO: 2406967 - protein, 4 aa, Entamoeba dispar
DEHT

SEQ ID NO: 2406968 - protein, 6 aa, Entamoeba dispar
DEIEKE

SEQ ID NO: 2406969 - protein, 5 aa, Entamoeba dispar
DEIFN

SEQ ID NO: 2406970 - protein, 6 aa, Entamoeba dispar
DEIGEI

SEQ ID NO: 2406971 - protein, 6 aa, Entamoeba dispar
DEIPKV

SEQ ID NO: 2406972 - protein, 13 aa, Entamoeba dispar
DEITERNDGSVVS

SEQ ID NO: 2406973 - protein, 8 aa, Entamoeba dispar
DEKKPNLS

SEQ ID NO: 2406974 - protein, 4 aa, Entamoeba dispar
DEKN

SEQ ID NO: 2406975 - protein, 6 aa, Entamoeba dispar
DEKPFQ

SEQ ID NO: 2406976 - protein, 8 aa, Entamoeba dispar
DEKSLKKV

SEQ ID NO: 2406977 - protein, 5 aa, Entamoeba dispar
DEKTQ

SEQ ID NO: 2406978 - protein, 11 aa, Entamoeba dispar
DELAKSESRIV

SEQ ID NO: 2406979 - protein, 22 aa, Entamoeba dispar
DEMNGIGETKKKKPVVKKPAVK

SEQ ID NO: 2406980 - protein, 5 aa, Entamoeba dispar
DENEI

SEQ ID NO: 2406981 - protein, 12 aa, Entamoeba dispar
DENGTETPCDTE

SEQ ID NO: 2406982 - protein, 9 aa, Entamoeba dispar
DENKTYASD

SEQ ID NO: 2406983 - protein, 4 aa, Entamoeba dispar
DENN

SEQ ID NO: 2406984 - protein, 10 aa, Entamoeba dispar
DENPQNNETE

SEQ ID NO: 2406985 - protein, 7 aa, Entamoeba dispar
DENQKKV

SEQ ID NO: 2406986 - protein, 7 aa, Entamoeba dispar
DENTEIG

SEQ ID NO: 2406987 - protein, 6 aa, Entamoeba dispar
DENTIK

SEQ ID NO: 2406988 - protein, 9 aa, Entamoeba dispar
DEPKKENQN

SEQ ID NO: 2406989 - protein, 6 aa, Entamoeba dispar
DEQIIG

SEQ ID NO: 2406990 - protein, 12 aa, Entamoeba dispar
DERESSSISQQR

SEQ ID NO: 2406991 - protein, 4 aa, Entamoeba dispar
DERK

SEQ ID NO: 2406992 - protein, 8 aa, Entamoeba dispar
DESAVTGY

SEQ ID NO: 2406993 - protein, 7 aa, Entamoeba dispar
DESKMRR

SEQ ID NO: 2406994 - protein, 15 aa, Entamoeba dispar
DESLTDEERKDIRKE

SEQ ID NO: 2406995 - protein, 9 aa, Entamoeba dispar
DESTPTLYS

SEQ ID NO: 2406996 - protein, 7 aa, Entamoeba dispar
DETGPRL

SEQ ID NO: 2406997 - protein, 11 aa, Entamoeba dispar
DEYEEEEDEIG

SEQ ID NO: 2406998 - protein, 17 aa, Entamoeba dispar
DFEKETMSSYEKQRNNY

SEQ ID NO: 2406999 - protein, 6 aa, Entamoeba dispar
DFGASR

SEQ ID NO: 2407000 - protein, 4 aa, Entamoeba dispar
DFGV

SEQ ID NO: 2407001 - protein, 14 aa, Entamoeba dispar
DFTDSSNQLNQQDQ

SEQ ID NO: 2407002 - protein, 6 aa, Entamoeba dispar
DGAKKE

SEQ ID NO: 2407003 - protein, 6 aa, Entamoeba dispar
DGASKE

SEQ ID NO: 2407004 - protein, 7 aa, Entamoeba dispar
DGAVGKT

SEQ ID NO: 2407005 - protein, 5 aa, Entamoeba dispar
DGDEI

SEQ ID NO: 2407006 - protein, 4 aa, Entamoeba dispar
DGDK

SEQ ID NO: 2407007 - protein, 10 aa, Entamoeba dispar
DGDSYRSPFS

SEQ ID NO: 2407008 - protein, 7 aa, Entamoeba dispar
DGEETMK

SEQ ID NO: 2407009 - protein, 5 aa, Entamoeba dispar
DGESR

SEQ ID NO: 2407010 - protein, 18 aa, Entamoeba dispar
DGFEPKDATVNPNEAIPT

SEQ ID NO: 2407011 - protein, 5 aa, Entamoeba dispar
DGGAF

SEQ ID NO: 2407012 - protein, 16 aa, Entamoeba dispar
DGIGRSTEETIRIVKQ

SEQ ID NO: 2407013 - protein, 16 aa, Entamoeba dispar
DGKDFNTKDSSSDEVS

SEQ ID NO: 2407014 - protein, 8 aa, Entamoeba dispar
DGKEPQHI

SEQ ID NO: 2407015 - protein, 6 aa, Entamoeba dispar
DGKKTF

SEQ ID NO: 2407016 - protein, 5 aa, Entamoeba dispar
DGKRY

SEQ ID NO: 2407017 - protein, 8 aa, Entamoeba dispar
DGKTGEMK

SEQ ID NO: 2407018 - protein, 6 aa, Entamoeba dispar
DGKVKS

SEQ ID NO: 2407019 - protein, 4 aa, Entamoeba dispar
DGNA

SEQ ID NO: 2407020 - protein, 5 aa, Entamoeba dispar
DGNDG

SEQ ID NO: 2407021 - protein, 13 aa, Entamoeba dispar
DGNPDMAGDKINV

SEQ ID NO: 2407022 - protein, 11 aa, Entamoeba dispar
DGPPDTPYEGG

SEQ ID NO: 2407023 - protein, 11 aa, Entamoeba dispar
DGSGSDGGSCI

SEQ ID NO: 2407024 - protein, 18 aa, Entamoeba dispar
DGSSVATASYDHTIKIWR

SEQ ID NO: 2407025 - protein, 6 aa, Entamoeba dispar
DGSTGC

SEQ ID NO: 2407026 - protein, 5 aa, Entamoeba dispar
DGTVG

SEQ ID NO: 2407027 - protein, 10 aa, Entamoeba dispar
DGVDRGNGFE

SEQ ID NO: 2407028 - protein, 25 aa, Entamoeba dispar
DGVSKNLRKNLEDIEKEKNGYNDSI

SEQ ID NO: 2407029 - protein, 6 aa, Entamoeba dispar
DHIEEE

SEQ ID NO: 2407030 - protein, 8 aa, Entamoeba dispar
DHPPQDNS

SEQ ID NO: 2407031 - protein, 12 aa, Entamoeba dispar
DHSSLKDLNGFN

SEQ ID NO: 2407032 - protein, 6 aa, Entamoeba dispar
DHTAGN

SEQ ID NO: 2407033 - protein, 11 aa, Entamoeba dispar
DIDANDKDEYI

SEQ ID NO: 2407034 - protein, 9 aa, Entamoeba dispar
DIDGKGNTI

SEQ ID NO: 2407035 - protein, 8 aa, Entamoeba dispar
DIEEIDNE

SEQ ID NO: 2407036 - protein, 16 aa, Entamoeba dispar
DIEEYQSDNPLGLTRQ

SEQ ID NO: 2407037 - protein, 11 aa, Entamoeba dispar
DIEPANKDNYV

SEQ ID NO: 2407038 - protein, 7 aa, Entamoeba dispar
DIIEETK

SEQ ID NO: 2407039 - protein, 7 aa, Entamoeba dispar
DILSNGS

SEQ ID NO: 2407040 - protein, 14 aa, Entamoeba dispar
DIPPLEEQIKKPTS

SEQ ID NO: 2407041 - protein, 9 aa, Entamoeba dispar
DIPSSVSKI

SEQ ID NO: 2407042 - protein, 8 aa, Entamoeba dispar
DIPSTVSK

SEQ ID NO: 2407043 - protein, 16 aa, Entamoeba dispar
DIQSNEEIDKTNDDYD

SEQ ID NO: 2407044 - protein, 7 aa, Entamoeba dispar
DIREEKM

SEQ ID NO: 2407045 - protein, 5 aa, Entamoeba dispar
DIRSE

SEQ ID NO: 2407046 - protein, 4 aa, Entamoeba dispar
DISG

SEQ ID NO: 2407047 - protein, 9 aa, Entamoeba dispar
DISRGQSNG

SEQ ID NO: 2407048 - protein, 4 aa, Entamoeba dispar
DIST

SEQ ID NO: 2407049 - protein, 6 aa, Entamoeba dispar
DITKQE

SEQ ID NO: 2407050 - protein, 8 aa, Entamoeba dispar
DITKQSEM

SEQ ID NO: 2407051 - protein, 6 aa, Entamoeba dispar
DITNQE

SEQ ID NO: 2407052 - protein, 4 aa, Entamoeba dispar
DITS

SEQ ID NO: 2407053 - protein, 13 aa, Entamoeba dispar
DIYDDDGSTEMSP

SEQ ID NO: 2407054 - protein, 5 aa, Entamoeba dispar
DKACQ

SEQ ID NO: 2407055 - protein, 6 aa, Entamoeba dispar
DKCKER

SEQ ID NO: 2407056 - protein, 7 aa, Entamoeba dispar
DKDKDEL

SEQ ID NO: 2407057 - protein, 15 aa, Entamoeba dispar
DKDREKYGTTIPPEV

SEQ ID NO: 2407058 - protein, 7 aa, Entamoeba dispar
DKDSVNY

SEQ ID NO: 2407059 - protein, 14 aa, Entamoeba dispar
DKEEDKTKRNEIEF

SEQ ID NO: 2407060 - protein, 8 aa, Entamoeba dispar
DKEEKNTA

SEQ ID NO: 2407061 - protein, 9 aa, Entamoeba dispar
DKEENGQIH

SEQ ID NO: 2407062 - protein, 5 aa, Entamoeba dispar
DKEMK

SEQ ID NO: 2407063 - protein, 5 aa, Entamoeba dispar
DKERK

SEQ ID NO: 2407064 - protein, 6 aa, Entamoeba dispar
DKGEEV

SEQ ID NO: 2407065 - protein, 20 aa, Entamoeba dispar
DKGKSAPSVETMKDEIEKLL

SEQ ID NO: 2407066 - protein, 6 aa, Entamoeba dispar
DKGNPF

SEQ ID NO: 2407067 - protein, 8 aa, Entamoeba dispar
DKGTSARL

SEQ ID NO: 2407068 - protein, 9 aa, Entamoeba dispar
DKIISSSKD

SEQ ID NO: 2407069 - protein, 8 aa, Entamoeba dispar
DKINSSNE

SEQ ID NO: 2407070 - protein, 6 aa, Entamoeba dispar
DKIQGE

SEQ ID NO: 2407071 - protein, 5 aa, Entamoeba dispar
DKIRE

SEQ ID NO: 2407072 - protein, 9 aa, Entamoeba dispar
DKITSSNEY

SEQ ID NO: 2407073 - protein, 9 aa, Entamoeba dispar
DKKEKTKNF

SEQ ID NO: 2407074 - protein, 26 aa, Entamoeba dispar
DKKETDQKGSVDMNRASSLRKTEDKK

SEQ ID NO: 2407075 - protein, 9 aa, Entamoeba dispar
DKKETKKLI

SEQ ID NO: 2407076 - protein, 7 aa, Entamoeba dispar
DKKISRD

SEQ ID NO: 2407077 - protein, 16 aa, Entamoeba dispar
DKKKDDKKKDKKKNKT

SEQ ID NO: 2407078 - protein, 6 aa, Entamoeba dispar
DKKNAT

SEQ ID NO: 2407079 - protein, 8 aa, Entamoeba dispar
DKKQLKED

SEQ ID NO: 2407080 - protein, 33 aa, Entamoeba dispar
DKKQQLKQDQRGGTYNESSDEEQEEKKENLEDF

SEQ ID NO: 2407081 - protein, 13 aa, Entamoeba dispar
DKKTEESKPEKND

SEQ ID NO: 2407082 - protein, 10 aa, Entamoeba dispar
DKKTKLSDVR

SEQ ID NO: 2407083 - protein, 12 aa, Entamoeba dispar
DKKTKSNDIRKS

SEQ ID NO: 2407084 - protein, 4 aa, Entamoeba dispar
DKLN

SEQ ID NO: 2407085 - protein, 10 aa, Entamoeba dispar
DKLPKNEVGK

SEQ ID NO: 2407086 - protein, 7 aa, Entamoeba dispar
DKLSEVQ

SEQ ID NO: 2407087 - protein, 9 aa, Entamoeba dispar
DKNASDDEF

SEQ ID NO: 2407088 - protein, 6 aa, Entamoeba dispar
DKNGNS

SEQ ID NO: 2407089 - protein, 7 aa, Entamoeba dispar
DKNQTIK

SEQ ID NO: 2407090 - protein, 7 aa, Entamoeba dispar
DKPFTSL

SEQ ID NO: 2407091 - protein, 5 aa, Entamoeba dispar
DKRAV

SEQ ID NO: 2407092 - protein, 8 aa, Entamoeba dispar
DKSISNIE

SEQ ID NO: 2407093 - protein, 6 aa, Entamoeba dispar
DKSISV

SEQ ID NO: 2407094 - protein, 6 aa, Entamoeba dispar
DKSVTA

SEQ ID NO: 2407095 - protein, 5 aa, Entamoeba dispar
DKSWG

SEQ ID NO: 2407096 - protein, 9 aa, Entamoeba dispar
DKTDTSNFN

SEQ ID NO: 2407097 - protein, 5 aa, Entamoeba dispar
DKVKT

SEQ ID NO: 2407098 - protein, 8 aa, Entamoeba dispar
DKVNKNKD

SEQ ID NO: 2407099 - protein, 18 aa, Entamoeba dispar
DKYLRNDKTCQSNEELNG

SEQ ID NO: 2407100 - protein, 8 aa, Entamoeba dispar
DKYTEGNE

SEQ ID NO: 2407101 - protein, 14 aa, Entamoeba dispar
DLAGTQKKQLAPAG

SEQ ID NO: 2407102 - protein, 5 aa, Entamoeba dispar
DLDGQ

SEQ ID NO: 2407103 - protein, 11 aa, Entamoeba dispar
DLEKEKQKEKT

SEQ ID NO: 2407104 - protein, 16 aa, Entamoeba dispar
DLENEREVTKEEGMNY

SEQ ID NO: 2407105 - protein, 5 aa, Entamoeba dispar
DLESQ

SEQ ID NO: 2407106 - protein, 5 aa, Entamoeba dispar
DLFGN

SEQ ID NO: 2407107 - protein, 6 aa, Entamoeba dispar
DLNPRS

SEQ ID NO: 2407108 - protein, 18 aa, Entamoeba dispar
DLPDRQVTKEEGEAFAKE

SEQ ID NO: 2407109 - protein, 5 aa, Entamoeba dispar
DLPPD

SEQ ID NO: 2407110 - protein, 4 aa, Entamoeba dispar
DLPQ

SEQ ID NO: 2407111 - protein, 5 aa, Entamoeba dispar
DLPRL

SEQ ID NO: 2407112 - protein, 13 aa, Entamoeba dispar
DLPSAAKKALEFG

SEQ ID NO: 2407113 - protein, 4 aa, Entamoeba dispar
DLTQ

SEQ ID NO: 2407114 - protein, 11 aa, Entamoeba dispar
DLTSSSEVFDD

SEQ ID NO: 2407115 - protein, 11 aa, Entamoeba dispar
DLVKSSDDEQF

SEQ ID NO: 2407116 - protein, 11 aa, Entamoeba dispar
DMEEDDDNDDF

SEQ ID NO: 2407117 - protein, 10 aa, Entamoeba dispar
DMGDDTVDDL

SEQ ID NO: 2407118 - protein, 12 aa, Entamoeba dispar
DMREDKEQLKRL

SEQ ID NO: 2407119 - protein, 11 aa, Entamoeba dispar
DMTNESEEYSS

SEQ ID NO: 2407120 - protein, 8 aa, Entamoeba dispar
DNAGFDPT

SEQ ID NO: 2407121 - protein, 4 aa, Entamoeba dispar
DNCG

SEQ ID NO: 2407122 - protein, 11 aa, Entamoeba dispar
DNDGEISNKKD

SEQ ID NO: 2407123 - protein, 6 aa, Entamoeba dispar
DNDPKA

SEQ ID NO: 2407124 - protein, 5 aa, Entamoeba dispar
DNDYY

SEQ ID NO: 2407125 - protein, 8 aa, Entamoeba dispar
DNENSQID

SEQ ID NO: 2407126 - protein, 8 aa, Entamoeba dispar
DNNDGTYS

SEQ ID NO: 2407127 - protein, 8 aa, Entamoeba dispar
DNNEGKTI

SEQ ID NO: 2407128 - protein, 9 aa, Entamoeba dispar
DNNEYQEEL

SEQ ID NO: 2407129 - protein, 10 aa, Entamoeba dispar
DNNGARDEID

SEQ ID NO: 2407130 - protein, 8 aa, Entamoeba dispar
DNNGLKQK

SEQ ID NO: 2407131 - protein, 10 aa, Entamoeba dispar
DNNGNNKNCL

SEQ ID NO: 2407132 - protein, 15 aa, Entamoeba dispar
DNPFESSSNANTLFQ

SEQ ID NO: 2407133 - protein, 8 aa, Entamoeba dispar
DNQFNPQY

SEQ ID NO: 2407134 - protein, 6 aa, Entamoeba dispar
DNQIRN

SEQ ID NO: 2407135 - protein, 9 aa, Entamoeba dispar
DNQKKENIE

SEQ ID NO: 2407136 - protein, 8 aa, Entamoeba dispar
DNQQKQEN

SEQ ID NO: 2407137 - protein, 27 aa, Entamoeba dispar
DNRQPSDYPYYQTTNTTNYQTKEPFNG

SEQ ID NO: 2407138 - protein, 17 aa, Entamoeba dispar
DNSDKLKLKDKQTQQTI

SEQ ID NO: 2407139 - protein, 4 aa, Entamoeba dispar
DNSP

SEQ ID NO: 2407140 - protein, 15 aa, Entamoeba dispar
DNSSAPSINPETVYD

SEQ ID NO: 2407141 - protein, 6 aa, Entamoeba dispar
DNSVQA

SEQ ID NO: 2407142 - protein, 4 aa, Entamoeba dispar
DNTQ

SEQ ID NO: 2407143 - protein, 8 aa, Entamoeba dispar
DNYPDSDL

SEQ ID NO: 2407144 - protein, 13 aa, Entamoeba dispar
DPAMRAGAKRRFD

SEQ ID NO: 2407145 - protein, 5 aa, Entamoeba dispar
DPASI

SEQ ID NO: 2407146 - protein, 17 aa, Entamoeba dispar
DPEENEKGMRVSSRGAG

SEQ ID NO: 2407147 - protein, 8 aa, Entamoeba dispar
DPERVPKA

SEQ ID NO: 2407148 - protein, 8 aa, Entamoeba dispar
DPGTAKSQ

SEQ ID NO: 2407149 - protein, 8 aa, Entamoeba dispar
DPIGQSEK

SEQ ID NO: 2407150 - protein, 8 aa, Entamoeba dispar
DPKQKKVT

SEQ ID NO: 2407151 - protein, 4 aa, Entamoeba dispar
DPLG

SEQ ID NO: 2407152 - protein, 8 aa, Entamoeba dispar
DPNVGKSS

SEQ ID NO: 2407153 - protein, 7 aa, Entamoeba dispar
DPQQISQ

SEQ ID NO: 2407154 - protein, 6 aa, Entamoeba dispar
DPRTGK

SEQ ID NO: 2407155 - protein, 4 aa, Entamoeba dispar
DPSL

SEQ ID NO: 2407156 - protein, 8 aa, Entamoeba dispar
DPSTAKSQ

SEQ ID NO: 2407157 - protein, 7 aa, Entamoeba dispar
DPSVGKT

SEQ ID NO: 2407158 - protein, 6 aa, Entamoeba dispar
DPTPEM

SEQ ID NO: 2407159 - protein, 8 aa, Entamoeba dispar
DPTSRGKV

SEQ ID NO: 2407160 - protein, 7 aa, Entamoeba dispar
DPVKGEP

SEQ ID NO: 2407161 - protein, 7 aa, Entamoeba dispar
DPVPEDA

SEQ ID NO: 2407162 - protein, 16 aa, Entamoeba dispar
DPYDDPKGFVKPKAPE

SEQ ID NO: 2407163 - protein, 19 aa, Entamoeba dispar
DQDIKNNNRIIENDNSEEL

SEQ ID NO: 2407164 - protein, 14 aa, Entamoeba dispar
DQEVLKRSEAEHWT

SEQ ID NO: 2407165 - protein, 15 aa, Entamoeba dispar
DQPKQPSTNSQTFDF

SEQ ID NO: 2407166 - protein, 10 aa, Entamoeba dispar
DQPVNIPEGT

SEQ ID NO: 2407167 - protein, 6 aa, Entamoeba dispar
DQTLSQ

SEQ ID NO: 2407168 - protein, 4 aa, Entamoeba dispar
DQWK

SEQ ID NO: 2407169 - protein, 9 aa, Entamoeba dispar
DRDKNADLH

SEQ ID NO: 2407170 - protein, 4 aa, Entamoeba dispar
DRDN

SEQ ID NO: 2407171 - protein, 4 aa, Entamoeba dispar
DRDV

SEQ ID NO: 2407172 - protein, 18 aa, Entamoeba dispar
DREAYLAKKAESRKSYKE

SEQ ID NO: 2407173 - protein, 9 aa, Entamoeba dispar
DRENADEPV

SEQ ID NO: 2407174 - protein, 9 aa, Entamoeba dispar
DRFPKGSKE

SEQ ID NO: 2407175 - protein, 9 aa, Entamoeba dispar
DRGANNQYV

SEQ ID NO: 2407176 - protein, 6 aa, Entamoeba dispar
DRGQMS

SEQ ID NO: 2407177 - protein, 12 aa, Entamoeba dispar
DRGRLGDKDIGK

SEQ ID NO: 2407178 - protein, 5 aa, Entamoeba dispar
DRGSY

SEQ ID NO: 2407179 - protein, 4 aa, Entamoeba dispar
DRGV

SEQ ID NO: 2407180 - protein, 17 aa, Entamoeba dispar
DRIEEGTKIPESGRFDE

SEQ ID NO: 2407181 - protein, 9 aa, Entamoeba dispar
DRSKGADKM

SEQ ID NO: 2407182 - protein, 4 aa, Entamoeba dispar
DRTE

SEQ ID NO: 2407183 - protein, 5 aa, Entamoeba dispar
DRTET

SEQ ID NO: 2407184 - protein, 12 aa, Entamoeba dispar
DSASKGEGEERI

SEQ ID NO: 2407185 - protein, 8 aa, Entamoeba dispar
DSDGDNEL

SEQ ID NO: 2407186 - protein, 8 aa, Entamoeba dispar
DSEAEIPV

SEQ ID NO: 2407187 - protein, 9 aa, Entamoeba dispar
DSEDEDIVK

SEQ ID NO: 2407188 - protein, 16 aa, Entamoeba dispar
DSEDRLGSKYGASEIK

SEQ ID NO: 2407189 - protein, 7 aa, Entamoeba dispar
DSEGNVL

SEQ ID NO: 2407190 - protein, 7 aa, Entamoeba dispar
DSEGSDI

SEQ ID NO: 2407191 - protein, 12 aa, Entamoeba dispar
DSEKVDEKAMRQ

SEQ ID NO: 2407192 - protein, 15 aa, Entamoeba dispar
DSENEEFKERGRGEV

SEQ ID NO: 2407193 - protein, 4 aa, Entamoeba dispar
DSEY

SEQ ID NO: 2407194 - protein, 9 aa, Entamoeba dispar
DSGKEGALN

SEQ ID NO: 2407195 - protein, 17 aa, Entamoeba dispar
DSGRKKTRYYDTKSGIS

SEQ ID NO: 2407196 - protein, 6 aa, Entamoeba dispar
DSGVGK

SEQ ID NO: 2407197 - protein, 7 aa, Entamoeba dispar
DSGVGKT

SEQ ID NO: 2407198 - protein, 8 aa, Entamoeba dispar
DSHIPYRN

SEQ ID NO: 2407199 - protein, 5 aa, Entamoeba dispar
DSIEN

SEQ ID NO: 2407200 - protein, 8 aa, Entamoeba dispar
DSKTLEFQ

SEQ ID NO: 2407201 - protein, 7 aa, Entamoeba dispar
DSLNGDR

SEQ ID NO: 2407202 - protein, 4 aa, Entamoeba dispar
DSMK

SEQ ID NO: 2407203 - protein, 4 aa, Entamoeba dispar
DSNA

SEQ ID NO: 2407204 - protein, 5 aa, Entamoeba dispar
DSNIK

SEQ ID NO: 2407205 - protein, 8 aa, Entamoeba dispar
DSPPGEFN

SEQ ID NO: 2407206 - protein, 6 aa, Entamoeba dispar
DSRYPV

SEQ ID NO: 2407207 - protein, 21 aa, Entamoeba dispar
DSSSDDYDDDEDYEDEEMNNP

SEQ ID NO: 2407208 - protein, 5 aa, Entamoeba dispar
DSTGS

SEQ ID NO: 2407209 - protein, 29 aa, Entamoeba dispar
DSTISNSSEDYQHHNKNKEKKPKQNQGLK

SEQ ID NO: 2407210 - protein, 8 aa, Entamoeba dispar
DSTRKSVE

SEQ ID NO: 2407211 - protein, 14 aa, Entamoeba dispar
DSTVPELARERESC

SEQ ID NO: 2407212 - protein, 10 aa, Entamoeba dispar
DTAGQEKFRE

SEQ ID NO: 2407213 - protein, 8 aa, Entamoeba dispar
DTAGQEVY

SEQ ID NO: 2407214 - protein, 12 aa, Entamoeba dispar
DTAKSDPQKLQG

SEQ ID NO: 2407215 - protein, 4 aa, Entamoeba dispar
DTGK

SEQ ID NO: 2407216 - protein, 4 aa, Entamoeba dispar
DTHP

SEQ ID NO: 2407217 - protein, 6 aa, Entamoeba dispar
DTIRDG

SEQ ID NO: 2407218 - protein, 4 aa, Entamoeba dispar
DTNG

SEQ ID NO: 2407219 - protein, 14 aa, Entamoeba dispar
DTPFIGEKTTSRIG

SEQ ID NO: 2407220 - protein, 4 aa, Entamoeba dispar
DTPI

SEQ ID NO: 2407221 - protein, 6 aa, Entamoeba dispar
DTPILE

SEQ ID NO: 2407222 - protein, 5 aa, Entamoeba dispar
DTPRL

SEQ ID NO: 2407223 - protein, 18 aa, Entamoeba dispar
DTPTADNLKSNAYITPGG

SEQ ID NO: 2407224 - protein, 6 aa, Entamoeba dispar
DTRETV

SEQ ID NO: 2407225 - protein, 5 aa, Entamoeba dispar
DTRYD

SEQ ID NO: 2407226 - protein, 7 aa, Entamoeba dispar
DTSGEEE

SEQ ID NO: 2407227 - protein, 16 aa, Entamoeba dispar
DTTENREKDLKELSGT

SEQ ID NO: 2407228 - protein, 8 aa, Entamoeba dispar
DTTHTRKK

SEQ ID NO: 2407229 - protein, 5 aa, Entamoeba dispar
DTTNI

SEQ ID NO: 2407230 - protein, 14 aa, Entamoeba dispar
DTTTKAIKPSKNKD

SEQ ID NO: 2407231 - protein, 5 aa, Entamoeba dispar
DTVTD

SEQ ID NO: 2407232 - protein, 8 aa, Entamoeba dispar
DTYDDEQQ

SEQ ID NO: 2407233 - protein, 5 aa, Entamoeba dispar
DVEEF

SEQ ID NO: 2407234 - protein, 4 aa, Entamoeba dispar
DVMP

SEQ ID NO: 2407235 - protein, 7 aa, Entamoeba dispar
DVPQPYI

SEQ ID NO: 2407236 - protein, 5 aa, Entamoeba dispar
DVQGN

SEQ ID NO: 2407237 - protein, 7 aa, Entamoeba dispar
DVSEGTE

SEQ ID NO: 2407238 - protein, 7 aa, Entamoeba dispar
DVSSREV

SEQ ID NO: 2407239 - protein, 20 aa, Entamoeba dispar
DVTSTLTQLKSQKDNLDKDL

SEQ ID NO: 2407240 - protein, 7 aa, Entamoeba dispar
DWRDQTR

SEQ ID NO: 2407241 - protein, 9 aa, Entamoeba dispar
DYDDEYNTE

SEQ ID NO: 2407242 - protein, 13 aa, Entamoeba dispar
DYDEFKDKSRTEI

SEQ ID NO: 2407243 - protein, 12 aa, Entamoeba dispar
DYNETTGSCLLR

SEQ ID NO: 2407244 - protein, 13 aa, Entamoeba dispar
DYNGDPIKEGGAK

SEQ ID NO: 2407245 - protein, 6 aa, Entamoeba dispar
DYSRLK

SEQ ID NO: 2407246 - protein, 7 aa, Entamoeba dispar
DYTGTTQ

SEQ ID NO: 2407247 - protein, 11 aa, Entamoeba dispar
DYYGGASASLN

SEQ ID NO: 2407248 - protein, 8 aa, Entamoeba dispar
EAAKQSGL

SEQ ID NO: 2407249 - protein, 4 aa, Entamoeba dispar
EADP

SEQ ID NO: 2407250 - protein, 4 aa, Entamoeba dispar
EAEF

SEQ ID NO: 2407251 - protein, 8 aa, Entamoeba dispar
EAENYSGT

SEQ ID NO: 2407252 - protein, 12 aa, Entamoeba dispar
EAFHSKRDYPHK

SEQ ID NO: 2407253 - protein, 7 aa, Entamoeba dispar
EAGRGPV

SEQ ID NO: 2407254 - protein, 7 aa, Entamoeba dispar
EAINGTY

SEQ ID NO: 2407255 - protein, 10 aa, Entamoeba dispar
EAKEEYKIAP

SEQ ID NO: 2407256 - protein, 23 aa, Entamoeba dispar
EAKESQEKQEVKGEIEISTRETL

SEQ ID NO: 2407257 - protein, 9 aa, Entamoeba dispar
EAKPPTPGM

SEQ ID NO: 2407258 - protein, 9 aa, Entamoeba dispar
EAKSAKNGI

SEQ ID NO: 2407259 - protein, 13 aa, Entamoeba dispar
EALGQVAGSTHPT

SEQ ID NO: 2407260 - protein, 10 aa, Entamoeba dispar
EAMPQNNPDV

SEQ ID NO: 2407261 - protein, 6 aa, Entamoeba dispar
EAQNGL

SEQ ID NO: 2407262 - protein, 9 aa, Entamoeba dispar
EAQSEPNVN

SEQ ID NO: 2407263 - protein, 4 aa, Entamoeba dispar
EARN

SEQ ID NO: 2407264 - protein, 8 aa, Entamoeba dispar
EASEVSSN

SEQ ID NO: 2407265 - protein, 4 aa, Entamoeba dispar
EAST

SEQ ID NO: 2407266 - protein, 6 aa, Entamoeba dispar
EATQEL

SEQ ID NO: 2407267 - protein, 5 aa, Entamoeba dispar
EAWNE

SEQ ID NO: 2407268 - protein, 4 aa, Entamoeba dispar
ECPS

SEQ ID NO: 2407269 - protein, 4 aa, Entamoeba dispar
EDAD

SEQ ID NO: 2407270 - protein, 17 aa, Entamoeba dispar
EDAISALSSPTKNVLGK

SEQ ID NO: 2407271 - protein, 6 aa, Entamoeba dispar
EDAKRA

SEQ ID NO: 2407272 - protein, 4 aa, Entamoeba dispar
EDEE

SEQ ID NO: 2407273 - protein, 48 aa, Entamoeba dispar
EDEEENENEEVDLEKDESEDERIDEKADSGIVDEETIEKAKKEAQQRE

SEQ ID NO: 2407274 - protein, 8 aa, Entamoeba dispar
EDEEFDDG

SEQ ID NO: 2407275 - protein, 10 aa, Entamoeba dispar
EDEKEKSGKF

SEQ ID NO: 2407276 - protein, 10 aa, Entamoeba dispar
EDEMNSYQKE

SEQ ID NO: 2407277 - protein, 7 aa, Entamoeba dispar
EDEPNFK

SEQ ID NO: 2407278 - protein, 12 aa, Entamoeba dispar
EDESTEIEEENV

SEQ ID NO: 2407279 - protein, 20 aa, Entamoeba dispar
EDFEEEENFDTKISPQDTKN

SEQ ID NO: 2407280 - protein, 7 aa, Entamoeba dispar
EDFPEDV

SEQ ID NO: 2407281 - protein, 10 aa, Entamoeba dispar
EDGNKTDGKV

SEQ ID NO: 2407282 - protein, 5 aa, Entamoeba dispar
EDGRA

SEQ ID NO: 2407283 - protein, 4 aa, Entamoeba dispar
EDGS

SEQ ID NO: 2407284 - protein, 6 aa, Entamoeba dispar
EDGSSI

SEQ ID NO: 2407285 - protein, 17 aa, Entamoeba dispar
EDGTITVGGELSNGRKC

SEQ ID NO: 2407286 - protein, 16 aa, Entamoeba dispar
EDIEAGEIKPDTDFKE

SEQ ID NO: 2407287 - protein, 34 aa, Entamoeba dispar
EDIKKEEKKEKQKEQNNQIEGKEKTIKEKVYPQK

SEQ ID NO: 2407288 - protein, 16 aa, Entamoeba dispar
EDITPTKRIAEDDHEI

SEQ ID NO: 2407289 - protein, 6 aa, Entamoeba dispar
EDKAQD

SEQ ID NO: 2407290 - protein, 7 aa, Entamoeba dispar
EDKATKN

SEQ ID NO: 2407291 - protein, 8 aa, Entamoeba dispar
EDKKNWEE

SEQ ID NO: 2407292 - protein, 4 aa, Entamoeba dispar
EDKT

SEQ ID NO: 2407293 - protein, 6 aa, Entamoeba dispar
EDKYTE

SEQ ID NO: 2407294 - protein, 5 aa, Entamoeba dispar
EDNME

SEQ ID NO: 2407295 - protein, 9 aa, Entamoeba dispar
EDNPTAQPK

SEQ ID NO: 2407296 - protein, 5 aa, Entamoeba dispar
EDNPV

SEQ ID NO: 2407297 - protein, 5 aa, Entamoeba dispar
EDPQV

SEQ ID NO: 2407298 - protein, 11 aa, Entamoeba dispar
EDREKYGYEIP

SEQ ID NO: 2407299 - protein, 6 aa, Entamoeba dispar
EDRYCD

SEQ ID NO: 2407300 - protein, 13 aa, Entamoeba dispar
EDSDNEQDDQNDL

SEQ ID NO: 2407301 - protein, 6 aa, Entamoeba dispar
EDSFER

SEQ ID NO: 2407302 - protein, 5 aa, Entamoeba dispar
EDSIT

SEQ ID NO: 2407303 - protein, 8 aa, Entamoeba dispar
EDSNEKTG

SEQ ID NO: 2407304 - protein, 7 aa, Entamoeba dispar
EDTTAKK

SEQ ID NO: 2407305 - protein, 4 aa, Entamoeba dispar
EDVQ

SEQ ID NO: 2407306 - protein, 8 aa, Entamoeba dispar
EDYPSETS

SEQ ID NO: 2407307 - protein, 13 aa, Entamoeba dispar
EEAKKVDREQRQK

SEQ ID NO: 2407308 - protein, 4 aa, Entamoeba dispar
EEAL

SEQ ID NO: 2407309 - protein, 14 aa, Entamoeba dispar
EEAPKRNKNDPHKR

SEQ ID NO: 2407310 - protein, 6 aa, Entamoeba dispar
EECIEE

SEQ ID NO: 2407311 - protein, 4 aa, Entamoeba dispar
EEDL

SEQ ID NO: 2407312 - protein, 5 aa, Entamoeba dispar
EEDSF

SEQ ID NO: 2407313 - protein, 5 aa, Entamoeba dispar
EEEDI

SEQ ID NO: 2407314 - protein, 4 aa, Entamoeba dispar
EEEE

SEQ ID NO: 2407315 - protein, 8 aa, Entamoeba dispar
EEEEEKMA

SEQ ID NO: 2407316 - protein, 8 aa, Entamoeba dispar
EEEGEDIN

SEQ ID NO: 2407317 - protein, 18 aa, Entamoeba dispar
EEEHAGGAITRPSYDLGE

SEQ ID NO: 2407318 - protein, 5 aa, Entamoeba dispar
EEEKE

SEQ ID NO: 2407319 - protein, 10 aa, Entamoeba dispar
EEEKREKINK

SEQ ID NO: 2407320 - protein, 10 aa, Entamoeba dispar
EEELKNDKRI

SEQ ID NO: 2407321 - protein, 15 aa, Entamoeba dispar
EEERLKRRKSAYSNA

SEQ ID NO: 2407322 - protein, 4 aa, Entamoeba dispar
EEEY

SEQ ID NO: 2407323 - protein, 8 aa, Entamoeba dispar
EEFDDGRI

SEQ ID NO: 2407324 - protein, 19 aa, Entamoeba dispar
EEFDKRSTEENLKNQVSND

SEQ ID NO: 2407325 - protein, 5 aa, Entamoeba dispar
EEGKT

SEQ ID NO: 2407326 - protein, 9 aa, Entamoeba dispar
EEGRNKLGY

SEQ ID NO: 2407327 - protein, 19 aa, Entamoeba dispar
EEHKTTNEDESKRIKESGG

SEQ ID NO: 2407328 - protein, 6 aa, Entamoeba dispar
EEHQKE

SEQ ID NO: 2407329 - protein, 4 aa, Entamoeba dispar
EEHY

SEQ ID NO: 2407330 - protein, 10 aa, Entamoeba dispar
EEIEGKTGDQ

SEQ ID NO: 2407331 - protein, 7 aa, Entamoeba dispar
EEIEKAK

SEQ ID NO: 2407332 - protein, 21 aa, Entamoeba dispar
EEIEQEKEGNEISKKEQIEEL

SEQ ID NO: 2407333 - protein, 5 aa, Entamoeba dispar
EEIGE

SEQ ID NO: 2407334 - protein, 5 aa, Entamoeba dispar
EEIKR

SEQ ID NO: 2407335 - protein, 13 aa, Entamoeba dispar
EEINERDNDIKNL

SEQ ID NO: 2407336 - protein, 21 aa, Entamoeba dispar
EEIRTRKAEEEIKRKEARKQA

SEQ ID NO: 2407337 - protein, 5 aa, Entamoeba dispar
EEKAT

SEQ ID NO: 2407338 - protein, 10 aa, Entamoeba dispar
EEKEERETIE

SEQ ID NO: 2407339 - protein, 16 aa, Entamoeba dispar
EEKEIEEEKKDNGIIE

SEQ ID NO: 2407340 - protein, 26 aa, Entamoeba dispar
EEKEMNKRKIKENMKKEWNERKESGD

SEQ ID NO: 2407341 - protein, 4 aa, Entamoeba dispar
EEKQ

SEQ ID NO: 2407342 - protein, 5 aa, Entamoeba dispar
EELEA

SEQ ID NO: 2407343 - protein, 8 aa, Entamoeba dispar
EELEQDEA

SEQ ID NO: 2407344 - protein, 4 aa, Entamoeba dispar
EELK

SEQ ID NO: 2407345 - protein, 11 aa, Entamoeba dispar
EELKKNERIPR

SEQ ID NO: 2407346 - protein, 17 aa, Entamoeba dispar
EELKKNKRIPRNCFDRG

SEQ ID NO: 2407347 - protein, 4 aa, Entamoeba dispar
EELP

SEQ ID NO: 2407348 - protein, 4 aa, Entamoeba dispar
EEMA

SEQ ID NO: 2407349 - protein, 4 aa, Entamoeba dispar
EEMK

SEQ ID NO: 2407350 - protein, 7 aa, Entamoeba dispar
EENGSME

SEQ ID NO: 2407351 - protein, 10 aa, Entamoeba dispar
EENPKGVDPQ

SEQ ID NO: 2407352 - protein, 7 aa, Entamoeba dispar
EENQPKD

SEQ ID NO: 2407353 - protein, 5 aa, Entamoeba dispar
EENQQ

SEQ ID NO: 2407354 - protein, 9 aa, Entamoeba dispar
EEQIKQGRE

SEQ ID NO: 2407355 - protein, 8 aa, Entamoeba dispar
EEQQIGKE

SEQ ID NO: 2407356 - protein, 4 aa, Entamoeba dispar
EEQS

SEQ ID NO: 2407357 - protein, 5 aa, Entamoeba dispar
EERAY

SEQ ID NO: 2407358 - protein, 6 aa, Entamoeba dispar
EESEKF

SEQ ID NO: 2407359 - protein, 11 aa, Entamoeba dispar
EESINQIPKER

SEQ ID NO: 2407360 - protein, 5 aa, Entamoeba dispar
EESNK

SEQ ID NO: 2407361 - protein, 4 aa, Entamoeba dispar
EESQ

SEQ ID NO: 2407362 - protein, 7 aa, Entamoeba dispar
EETESRM

SEQ ID NO: 2407363 - protein, 6 aa, Entamoeba dispar
EETNLH

SEQ ID NO: 2407364 - protein, 6 aa, Entamoeba dispar
EETPEK

SEQ ID NO: 2407365 - protein, 9 aa, Entamoeba dispar
EETTPEEKL

SEQ ID NO: 2407366 - protein, 10 aa, Entamoeba dispar
EEVGRGNELA

SEQ ID NO: 2407367 - protein, 8 aa, Entamoeba dispar
EEVPKIPD

SEQ ID NO: 2407368 - protein, 8 aa, Entamoeba dispar
EEVREAGP

SEQ ID NO: 2407369 - protein, 4 aa, Entamoeba dispar
EEYK

SEQ ID NO: 2407370 - protein, 4 aa, Entamoeba dispar
EFDG

SEQ ID NO: 2407371 - protein, 10 aa, Entamoeba dispar
EFEDCNQKEF

SEQ ID NO: 2407372 - protein, 4 aa, Entamoeba dispar
EFGQ

SEQ ID NO: 2407373 - protein, 9 aa, Entamoeba dispar
EFKAGNYEK

SEQ ID NO: 2407374 - protein, 16 aa, Entamoeba dispar
EFKGASKKTYEERGCA

SEQ ID NO: 2407375 - protein, 5 aa, Entamoeba dispar
EFKGN

SEQ ID NO: 2407376 - protein, 14 aa, Entamoeba dispar
EFKSQEDDYDLGGI

SEQ ID NO: 2407377 - protein, 14 aa, Entamoeba dispar
EFNEESEAKSRTRK

SEQ ID NO: 2407378 - protein, 5 aa, Entamoeba dispar
EFPKD

SEQ ID NO: 2407379 - protein, 10 aa, Entamoeba dispar
EFPNPKEEAR

SEQ ID NO: 2407380 - protein, 5 aa, Entamoeba dispar
EFTEN

SEQ ID NO: 2407381 - protein, 5 aa, Entamoeba dispar
EFYPK

SEQ ID NO: 2407382 - protein, 13 aa, Entamoeba dispar
EGAAGSAAFGSGM

SEQ ID NO: 2407383 - protein, 4 aa, Entamoeba dispar
EGCD

SEQ ID NO: 2407384 - protein, 16 aa, Entamoeba dispar
EGCSAQPVGTQEGNCT

SEQ ID NO: 2407385 - protein, 12 aa, Entamoeba dispar
EGDTIETLPEEA

SEQ ID NO: 2407386 - protein, 5 aa, Entamoeba dispar
EGEHM

SEQ ID NO: 2407387 - protein, 8 aa, Entamoeba dispar
EGFDNSDT

SEQ ID NO: 2407388 - protein, 14 aa, Entamoeba dispar
EGFEIPTDEEQSYK

SEQ ID NO: 2407389 - protein, 25 aa, Entamoeba dispar
EGFEQDDDNEEIQKEPKNEFEKQQE

SEQ ID NO: 2407390 - protein, 9 aa, Entamoeba dispar
EGGDEDSLE

SEQ ID NO: 2407391 - protein, 8 aa, Entamoeba dispar
EGGDESNP

SEQ ID NO: 2407392 - protein, 6 aa, Entamoeba dispar
EGGRSK

SEQ ID NO: 2407393 - protein, 5 aa, Entamoeba dispar
EGGSN

SEQ ID NO: 2407394 - protein, 4 aa, Entamoeba dispar
EGIP

SEQ ID NO: 2407395 - protein, 8 aa, Entamoeba dispar
EGKDDRSD

SEQ ID NO: 2407396 - protein, 6 aa, Entamoeba dispar
EGKEKL

SEQ ID NO: 2407397 - protein, 15 aa, Entamoeba dispar
EGKEKSKKSYENSPH

SEQ ID NO: 2407398 - protein, 6 aa, Entamoeba dispar
EGKETG

SEQ ID NO: 2407399 - protein, 10 aa, Entamoeba dispar
EGKKLAVNTP

SEQ ID NO: 2407400 - protein, 8 aa, Entamoeba dispar
EGKPAEEC

SEQ ID NO: 2407401 - protein, 9 aa, Entamoeba dispar
EGKTLPDHF

SEQ ID NO: 2407402 - protein, 17 aa, Entamoeba dispar
EGNKQTQFKLSTNKSND

SEQ ID NO: 2407403 - protein, 11 aa, Entamoeba dispar
EGNPDKLGDGT

SEQ ID NO: 2407404 - protein, 9 aa, Entamoeba dispar
EGNPPNRHV

SEQ ID NO: 2407405 - protein, 7 aa, Entamoeba dispar
EGNQSRI

SEQ ID NO: 2407406 - protein, 4 aa, Entamoeba dispar
EGNV

SEQ ID NO: 2407407 - protein, 12 aa, Entamoeba dispar
EGQANAKGDSLP

SEQ ID NO: 2407408 - protein, 6 aa, Entamoeba dispar
EGQYGI

SEQ ID NO: 2407409 - protein, 8 aa, Entamoeba dispar
EGSKVKNW

SEQ ID NO: 2407410 - protein, 7 aa, Entamoeba dispar
EGSVGKS

SEQ ID NO: 2407411 - protein, 12 aa, Entamoeba dispar
EGTDTSQGKGQI

SEQ ID NO: 2407412 - protein, 5 aa, Entamoeba dispar
EGTLK

SEQ ID NO: 2407413 - protein, 5 aa, Entamoeba dispar
EGVKD

SEQ ID NO: 2407414 - protein, 5 aa, Entamoeba dispar
EGVNS

SEQ ID NO: 2407415 - protein, 13 aa, Entamoeba dispar
EGVNTTTNNPSVE

SEQ ID NO: 2407416 - protein, 16 aa, Entamoeba dispar
EGVRNGNIKGYTGKEF

SEQ ID NO: 2407417 - protein, 8 aa, Entamoeba dispar
EHGGEPSS

SEQ ID NO: 2407418 - protein, 8 aa, Entamoeba dispar
EHIDSNGK

SEQ ID NO: 2407419 - protein, 4 aa, Entamoeba dispar
EHKA

SEQ ID NO: 2407420 - protein, 6 aa, Entamoeba dispar
EHKGDE

SEQ ID NO: 2407421 - protein, 9 aa, Entamoeba dispar
EHPSEVQSQ

SEQ ID NO: 2407422 - protein, 9 aa, Entamoeba dispar
EHPTIKKGT

SEQ ID NO: 2407423 - protein, 9 aa, Entamoeba dispar
EHSRDTTNR

SEQ ID NO: 2407424 - protein, 7 aa, Entamoeba dispar
EHSYENM

SEQ ID NO: 2407425 - protein, 11 aa, Entamoeba dispar
EIAPNNKVNGF

SEQ ID NO: 2407426 - protein, 21 aa, Entamoeba dispar
EIDEENKKQKEEEDQKSIPGW

SEQ ID NO: 2407427 - protein, 6 aa, Entamoeba dispar
EIEEQK

SEQ ID NO: 2407428 - protein, 5 aa, Entamoeba dispar
EIEET

SEQ ID NO: 2407429 - protein, 13 aa, Entamoeba dispar
EIEIGEGEKIEVN

SEQ ID NO: 2407430 - protein, 4 aa, Entamoeba dispar
EIEK

SEQ ID NO: 2407431 - protein, 6 aa, Entamoeba dispar
EIEKKD

SEQ ID NO: 2407432 - protein, 6 aa, Entamoeba dispar
EIENSC

SEQ ID NO: 2407433 - protein, 9 aa, Entamoeba dispar
EIESSQNDW

SEQ ID NO: 2407434 - protein, 4 aa, Entamoeba dispar
EIGN

SEQ ID NO: 2407435 - protein, 12 aa, Entamoeba dispar
EIGSDDSSSDYY

SEQ ID NO: 2407436 - protein, 5 aa, Entamoeba dispar
EIIES

SEQ ID NO: 2407437 - protein, 13 aa, Entamoeba dispar
EIKEEQEKRRETY

SEQ ID NO: 2407438 - protein, 35 aa, Entamoeba dispar
EIKEEVKERKRRKEELEQEREKKEKEIKELKAQKN

SEQ ID NO: 2407439 - protein, 11 aa, Entamoeba dispar
EIKEGQKIESE

SEQ ID NO: 2407440 - protein, 6 aa, Entamoeba dispar
EIKENY

SEQ ID NO: 2407441 - protein, 7 aa, Entamoeba dispar
EIKEREK

SEQ ID NO: 2407442 - protein, 6 aa, Entamoeba dispar
EIKITR

SEQ ID NO: 2407443 - protein, 4 aa, Entamoeba dispar
EIKP

SEQ ID NO: 2407444 - protein, 5 aa, Entamoeba dispar
EIKRT

SEQ ID NO: 2407445 - protein, 6 aa, Entamoeba dispar
EINEGV

SEQ ID NO: 2407446 - protein, 7 aa, Entamoeba dispar
EIPSSVS

SEQ ID NO: 2407447 - protein, 17 aa, Entamoeba dispar
EIQQDPPCNCSAGPVGD

SEQ ID NO: 2407448 - protein, 9 aa, Entamoeba dispar
EIRETPSRK

SEQ ID NO: 2407449 - protein, 11 aa, Entamoeba dispar
EIRGSKGCSVS

SEQ ID NO: 2407450 - protein, 8 aa, Entamoeba dispar
EISEEGKW

SEQ ID NO: 2407451 - protein, 5 aa, Entamoeba dispar
EISEN

SEQ ID NO: 2407452 - protein, 6 aa, Entamoeba dispar
EISNEE

SEQ ID NO: 2407453 - protein, 4 aa, Entamoeba dispar
EITK

SEQ ID NO: 2407454 - protein, 5 aa, Entamoeba dispar
EITRD

SEQ ID NO: 2407455 - protein, 4 aa, Entamoeba dispar
EIVT

SEQ ID NO: 2407456 - protein, 8 aa, Entamoeba dispar
EKAQTPGV

SEQ ID NO: 2407457 - protein, 5 aa, Entamoeba dispar
EKDEE

SEQ ID NO: 2407458 - protein, 13 aa, Entamoeba dispar
EKDESKLQEAPTI

SEQ ID NO: 2407459 - protein, 4 aa, Entamoeba dispar
EKDK

SEQ ID NO: 2407460 - protein, 9 aa, Entamoeba dispar
EKDKEAVEI

SEQ ID NO: 2407461 - protein, 9 aa, Entamoeba dispar
EKDKVYPIE

SEQ ID NO: 2407462 - protein, 9 aa, Entamoeba dispar
EKDSHPKPL

SEQ ID NO: 2407463 - protein, 7 aa, Entamoeba dispar
EKEEDYC

SEQ ID NO: 2407464 - protein, 14 aa, Entamoeba dispar
EKEELKRKQRSLER

SEQ ID NO: 2407465 - protein, 13 aa, Entamoeba dispar
EKEIKGDDRTTTR

SEQ ID NO: 2407466 - protein, 16 aa, Entamoeba dispar
EKEIKQTNNNYNESRI

SEQ ID NO: 2407467 - protein, 12 aa, Entamoeba dispar
EKEKESYRKKYT

SEQ ID NO: 2407468 - protein, 24 aa, Entamoeba dispar
EKEKKKIKINRKDNPIPGTPNNKI

SEQ ID NO: 2407469 - protein, 5 aa, Entamoeba dispar
EKEKW

SEQ ID NO: 2407470 - protein, 10 aa, Entamoeba dispar
EKENSNNPSR

SEQ ID NO: 2407471 - protein, 5 aa, Entamoeba dispar
EKGDR

SEQ ID NO: 2407472 - protein, 4 aa, Entamoeba dispar
EKGF

SEQ ID NO: 2407473 - protein, 4 aa, Entamoeba dispar
EKGI

SEQ ID NO: 2407474 - protein, 6 aa, Entamoeba dispar
EKGLTP

SEQ ID NO: 2407475 - protein, 6 aa, Entamoeba dispar
EKGMDT

SEQ ID NO: 2407476 - protein, 6 aa, Entamoeba dispar
EKGNET

SEQ ID NO: 2407477 - protein, 5 aa, Entamoeba dispar
EKGNI

SEQ ID NO: 2407478 - protein, 8 aa, Entamoeba dispar
EKHSEENI

SEQ ID NO: 2407479 - protein, 7 aa, Entamoeba dispar
EKIGNKI

SEQ ID NO: 2407480 - protein, 10 aa, Entamoeba dispar
EKIKKKNERF

SEQ ID NO: 2407481 - protein, 4 aa, Entamoeba dispar
EKIP

SEQ ID NO: 2407482 - protein, 13 aa, Entamoeba dispar
EKISEAKKDKKMK

SEQ ID NO: 2407483 - protein, 12 aa, Entamoeba dispar
EKISEGIKSSGV

SEQ ID NO: 2407484 - protein, 8 aa, Entamoeba dispar
EKKEEEEK

SEQ ID NO: 2407485 - protein, 9 aa, Entamoeba dispar
EKKEEEEKI

SEQ ID NO: 2407486 - protein, 11 aa, Entamoeba dispar
EKKEEKKIERK

SEQ ID NO: 2407487 - protein, 8 aa, Entamoeba dispar
EKKGEEGV

SEQ ID NO: 2407488 - protein, 19 aa, Entamoeba dispar
EKKITPITTEQGEAKCKDI

SEQ ID NO: 2407489 - protein, 12 aa, Entamoeba dispar
EKNDENPSPEQL

SEQ ID NO: 2407490 - protein, 6 aa, Entamoeba dispar
EKNDQL

SEQ ID NO: 2407491 - protein, 13 aa, Entamoeba dispar
EKNQEQTTGEINT

SEQ ID NO: 2407492 - protein, 9 aa, Entamoeba dispar
EKQAYRAHP

SEQ ID NO: 2407493 - protein, 9 aa, Entamoeba dispar
EKQNSQSPV

SEQ ID NO: 2407494 - protein, 13 aa, Entamoeba dispar
EKRASQIPEKPIP

SEQ ID NO: 2407495 - protein, 7 aa, Entamoeba dispar
EKRDKGL

SEQ ID NO: 2407496 - protein, 13 aa, Entamoeba dispar
EKRREEEQEAETY

SEQ ID NO: 2407497 - protein, 4 aa, Entamoeba dispar
EKRT

SEQ ID NO: 2407498 - protein, 5 aa, Entamoeba dispar
EKRTQ

SEQ ID NO: 2407499 - protein, 6 aa, Entamoeba dispar
EKRTRH

SEQ ID NO: 2407500 - protein, 12 aa, Entamoeba dispar
EKSKTNKKLEEI

SEQ ID NO: 2407501 - protein, 12 aa, Entamoeba dispar
EKTKQEKTLEEH

SEQ ID NO: 2407502 - protein, 7 aa, Entamoeba dispar
EKTNNIV

SEQ ID NO: 2407503 - protein, 8 aa, Entamoeba dispar
EKTTDSGW

SEQ ID NO: 2407504 - protein, 7 aa, Entamoeba dispar
EKTYYTP

SEQ ID NO: 2407505 - protein, 8 aa, Entamoeba dispar
EKVKQNNV

SEQ ID NO: 2407506 - protein, 16 aa, Entamoeba dispar
EKVPNRNQSTKNVELE

SEQ ID NO: 2407507 - protein, 7 aa, Entamoeba dispar
EKYEIDE

SEQ ID NO: 2407508 - protein, 9 aa, Entamoeba dispar
EKYPDKEAM

SEQ ID NO: 2407509 - protein, 11 aa, Entamoeba dispar
EKYSTDSDGDL

SEQ ID NO: 2407510 - protein, 6 aa, Entamoeba dispar
ELADGF

SEQ ID NO: 2407511 - protein, 10 aa, Entamoeba dispar
ELEERRRKMD

SEQ ID NO: 2407512 - protein, 6 aa, Entamoeba dispar
ELIPKG

SEQ ID NO: 2407513 - protein, 5 aa, Entamoeba dispar
ELKET

SEQ ID NO: 2407514 - protein, 5 aa, Entamoeba dispar
ELKGS

SEQ ID NO: 2407515 - protein, 20 aa, Entamoeba dispar
ELKGTGGNKKGNSKSGKCIL

SEQ ID NO: 2407516 - protein, 13 aa, Entamoeba dispar
ELKKNERIPIDCF

SEQ ID NO: 2407517 - protein, 13 aa, Entamoeba dispar
ELKKNKRIPRKCF

SEQ ID NO: 2407518 - protein, 13 aa, Entamoeba dispar
ELLTEENKELLGN

SEQ ID NO: 2407519 - protein, 7 aa, Entamoeba dispar
ELNEKQG

SEQ ID NO: 2407520 - protein, 10 aa, Entamoeba dispar
ELNGKEIGKL

SEQ ID NO: 2407521 - protein, 17 aa, Entamoeba dispar
ELNTKDINDFSSSISPQ

SEQ ID NO: 2407522 - protein, 6 aa, Entamoeba dispar
ELPRDV

SEQ ID NO: 2407523 - protein, 18 aa, Entamoeba dispar
ELPSTIPESQQHTVTEGN

SEQ ID NO: 2407524 - protein, 7 aa, Entamoeba dispar
ELSEDQN

SEQ ID NO: 2407525 - protein, 15 aa, Entamoeba dispar
ELSGTKDEDFEKTVK

SEQ ID NO: 2407526 - protein, 8 aa, Entamoeba dispar
ELSSSEES

SEQ ID NO: 2407527 - protein, 6 aa, Entamoeba dispar
ELTQPG

SEQ ID NO: 2407528 - protein, 8 aa, Entamoeba dispar
ELTSSEES

SEQ ID NO: 2407529 - protein, 6 aa, Entamoeba dispar
ELTTKN

SEQ ID NO: 2407530 - protein, 26 aa, Entamoeba dispar
EMEALQGDVEKNQAQLELESKSKDDL

SEQ ID NO: 2407531 - protein, 36 aa, Entamoeba dispar
EMEEAQKTHKSVRVKSKKVEKQDEAVLNEQESKKIV

SEQ ID NO: 2407532 - protein, 37 aa, Entamoeba dispar
EMEKQKAMKKENNSTSPREQSKSEEKKEEQTTTPSEQ

SEQ ID NO: 2407533 - protein, 29 aa, Entamoeba dispar
EMGEEKKGKGKAPSVSKEAKKEEQEKKRK

SEQ ID NO: 2407534 - protein, 10 aa, Entamoeba dispar
EMKGEEKELS

SEQ ID NO: 2407535 - protein, 23 aa, Entamoeba dispar
EMNKRKIKENMKKEWNERKESGD

SEQ ID NO: 2407536 - protein, 21 aa, Entamoeba dispar
EMNNEQNENIKKLTKREVDDK

SEQ ID NO: 2407537 - protein, 6 aa, Entamoeba dispar
EMSEES

SEQ ID NO: 2407538 - protein, 7 aa, Entamoeba dispar
EMTSSEK

SEQ ID NO: 2407539 - protein, 17 aa, Entamoeba dispar
EMYYEEKRKEGKEIKNK

SEQ ID NO: 2407540 - protein, 4 aa, Entamoeba dispar
ENAD

SEQ ID NO: 2407541 - protein, 23 aa, Entamoeba dispar
ENDIRKRDGKRHNEEPKEKRRFD

SEQ ID NO: 2407542 - protein, 11 aa, Entamoeba dispar
ENDKLPTENTI

SEQ ID NO: 2407543 - protein, 11 aa, Entamoeba dispar
ENEGGDEGSEQ

SEQ ID NO: 2407544 - protein, 4 aa, Entamoeba dispar
ENEK

SEQ ID NO: 2407545 - protein, 9 aa, Entamoeba dispar
ENEKRMSAA

SEQ ID NO: 2407546 - protein, 10 aa, Entamoeba dispar
ENELNQKDIK

SEQ ID NO: 2407547 - protein, 4 aa, Entamoeba dispar
ENEN

SEQ ID NO: 2407548 - protein, 6 aa, Entamoeba dispar
ENENEI

SEQ ID NO: 2407549 - protein, 6 aa, Entamoeba dispar
ENESKK

SEQ ID NO: 2407550 - protein, 6 aa, Entamoeba dispar
ENGCNT

SEQ ID NO: 2407551 - protein, 4 aa, Entamoeba dispar
ENGE

SEQ ID NO: 2407552 - protein, 4 aa, Entamoeba dispar
ENGL

SEQ ID NO: 2407553 - protein, 7 aa, Entamoeba dispar
ENGQELK

SEQ ID NO: 2407554 - protein, 4 aa, Entamoeba dispar
ENGR

SEQ ID NO: 2407555 - protein, 4 aa, Entamoeba dispar
ENGS

SEQ ID NO: 2407556 - protein, 8 aa, Entamoeba dispar
ENGSGKSA

SEQ ID NO: 2407557 - protein, 8 aa, Entamoeba dispar
ENGTNGKQ

SEQ ID NO: 2407558 - protein, 4 aa, Entamoeba dispar
ENIS

SEQ ID NO: 2407559 - protein, 12 aa, Entamoeba dispar
ENKEEVIGDEKA

SEQ ID NO: 2407560 - protein, 9 aa, Entamoeba dispar
ENKEKNDRL

SEQ ID NO: 2407561 - protein, 14 aa, Entamoeba dispar
ENKELKEQVSKLSE

SEQ ID NO: 2407562 - protein, 10 aa, Entamoeba dispar
ENKGGEKWEE

SEQ ID NO: 2407563 - protein, 8 aa, Entamoeba dispar
ENKKKQMK

SEQ ID NO: 2407564 - protein, 13 aa, Entamoeba dispar
ENKYNKEPSDCVV

SEQ ID NO: 2407565 - protein, 4 aa, Entamoeba dispar
ENLE

SEQ ID NO: 2407566 - protein, 5 aa, Entamoeba dispar
ENLNE

SEQ ID NO: 2407567 - protein, 4 aa, Entamoeba dispar
ENLS

SEQ ID NO: 2407568 - protein, 18 aa, Entamoeba dispar
ENNEEVEQRDKDKSYENI

SEQ ID NO: 2407569 - protein, 20 aa, Entamoeba dispar
ENNTSSKNYFSTETKTPSLS

SEQ ID NO: 2407570 - protein, 7 aa, Entamoeba dispar
ENNVRVP

SEQ ID NO: 2407571 - protein, 4 aa, Entamoeba dispar
ENNY

SEQ ID NO: 2407572 - protein, 10 aa, Entamoeba dispar
ENPFQEKKEL

SEQ ID NO: 2407573 - protein, 4 aa, Entamoeba dispar
ENPI

SEQ ID NO: 2407574 - protein, 6 aa, Entamoeba dispar
ENPTLL

SEQ ID NO: 2407575 - protein, 4 aa, Entamoeba dispar
ENPY

SEQ ID NO: 2407576 - protein, 8 aa, Entamoeba dispar
ENQGEIER

SEQ ID NO: 2407577 - protein, 5 aa, Entamoeba dispar
ENQLI

SEQ ID NO: 2407578 - protein, 8 aa, Entamoeba dispar
ENQPTQQI

SEQ ID NO: 2407579 - protein, 17 aa, Entamoeba dispar
ENQSEWNTASSVKQTNT

SEQ ID NO: 2407580 - protein, 5 aa, Entamoeba dispar
ENQYS

SEQ ID NO: 2407581 - protein, 6 aa, Entamoeba dispar
ENRREE

SEQ ID NO: 2407582 - protein, 6 aa, Entamoeba dispar
ENSKVI

SEQ ID NO: 2407583 - protein, 53 aa, Entamoeba dispar
ENSLEETKGIQETTPKTNVLTNEQPNETNQAQKEDNKKQEKESSVEVKKPLNY

SEQ ID NO: 2407584 - protein, 4 aa, Entamoeba dispar
ENSN

SEQ ID NO: 2407585 - protein, 5 aa, Entamoeba dispar
ENSVV

SEQ ID NO: 2407586 - protein, 4 aa, Entamoeba dispar
ENTE

SEQ ID NO: 2407587 - protein, 12 aa, Entamoeba dispar
ENTKTLNSGKIK

SEQ ID NO: 2407588 - protein, 6 aa, Entamoeba dispar
ENTMPG

SEQ ID NO: 2407589 - protein, 8 aa, Entamoeba dispar
ENTSGEAT

SEQ ID NO: 2407590 - protein, 10 aa, Entamoeba dispar
ENTSPNITTG

SEQ ID NO: 2407591 - protein, 8 aa, Entamoeba dispar
ENTVENAA

SEQ ID NO: 2407592 - protein, 13 aa, Entamoeba dispar
ENVSQSKPNTSSD

SEQ ID NO: 2407593 - protein, 8 aa, Entamoeba dispar
EPAAKERL

SEQ ID NO: 2407594 - protein, 5 aa, Entamoeba dispar
EPARE

SEQ ID NO: 2407595 - protein, 20 aa, Entamoeba dispar
EPDTGDIINSADEPDTSHDN

SEQ ID NO: 2407596 - protein, 6 aa, Entamoeba dispar
EPEQNI

SEQ ID NO: 2407597 - protein, 13 aa, Entamoeba dispar
EPFKRNKERENRI

SEQ ID NO: 2407598 - protein, 11 aa, Entamoeba dispar
EPFNPKDENDA

SEQ ID NO: 2407599 - protein, 11 aa, Entamoeba dispar
EPFNPKDESDA

SEQ ID NO: 2407600 - protein, 11 aa, Entamoeba dispar
EPFNQKDESEA

SEQ ID NO: 2407601 - protein, 8 aa, Entamoeba dispar
EPGVRGEL

SEQ ID NO: 2407602 - protein, 4 aa, Entamoeba dispar
EPLD

SEQ ID NO: 2407603 - protein, 6 aa, Entamoeba dispar
EPLEDP

SEQ ID NO: 2407604 - protein, 5 aa, Entamoeba dispar
EPLGS

SEQ ID NO: 2407605 - protein, 5 aa, Entamoeba dispar
EPNRC

SEQ ID NO: 2407606 - protein, 12 aa, Entamoeba dispar
EPPKEINRKREE

SEQ ID NO: 2407607 - protein, 4 aa, Entamoeba dispar
EPPY

SEQ ID NO: 2407608 - protein, 6 aa, Entamoeba dispar
EPSCSV

SEQ ID NO: 2407609 - protein, 8 aa, Entamoeba dispar
EPSGTTYG

SEQ ID NO: 2407610 - protein, 7 aa, Entamoeba dispar
EPTEDEV

SEQ ID NO: 2407611 - protein, 6 aa, Entamoeba dispar
EQDKHP

SEQ ID NO: 2407612 - protein, 13 aa, Entamoeba dispar
EQEEEYSEYSSER

SEQ ID NO: 2407613 - protein, 15 aa, Entamoeba dispar
EQEETNKKKKEEKGL

SEQ ID NO: 2407614 - protein, 5 aa, Entamoeba dispar
EQEKM

SEQ ID NO: 2407615 - protein, 7 aa, Entamoeba dispar
EQESMPA

SEQ ID NO: 2407616 - protein, 10 aa, Entamoeba dispar
EQFKTNDVNS

SEQ ID NO: 2407617 - protein, 8 aa, Entamoeba dispar
EQISTLGD

SEQ ID NO: 2407618 - protein, 12 aa, Entamoeba dispar
EQKEQAKGNDKH

SEQ ID NO: 2407619 - protein, 5 aa, Entamoeba dispar
EQKGL

SEQ ID NO: 2407620 - protein, 10 aa, Entamoeba dispar
EQKTWNNSEE

SEQ ID NO: 2407621 - protein, 4 aa, Entamoeba dispar
EQLS

SEQ ID NO: 2407622 - protein, 4 aa, Entamoeba dispar
EQPF

SEQ ID NO: 2407623 - protein, 11 aa, Entamoeba dispar
EQPLTGPKRER

SEQ ID NO: 2407624 - protein, 6 aa, Entamoeba dispar
EQQKYK

SEQ ID NO: 2407625 - protein, 12 aa, Entamoeba dispar
EQQQQPSSITTN

SEQ ID NO: 2407626 - protein, 11 aa, Entamoeba dispar
EQRAQALKDNI

SEQ ID NO: 2407627 - protein, 12 aa, Entamoeba dispar
EQRRQQEEQRQQ

SEQ ID NO: 2407628 - protein, 4 aa, Entamoeba dispar
EQRS

SEQ ID NO: 2407629 - protein, 32 aa, Entamoeba dispar
EQTPINQKSQETSTKELPPLNKESSSANGIDD

SEQ ID NO: 2407630 - protein, 16 aa, Entamoeba dispar
EQVNETKNYRKGDKRA

SEQ ID NO: 2407631 - protein, 21 aa, Entamoeba dispar
EQYNKTEESLFDDPDYEEYNK

SEQ ID NO: 2407632 - protein, 15 aa, Entamoeba dispar
ERDKQAEAEEKKPIL

SEQ ID NO: 2407633 - protein, 5 aa, Entamoeba dispar
EREKE

SEQ ID NO: 2407634 - protein, 7 aa, Entamoeba dispar
EREKRRE

SEQ ID NO: 2407635 - protein, 6 aa, Entamoeba dispar
ERGNNN

SEQ ID NO: 2407636 - protein, 12 aa, Entamoeba dispar
ERHTGSGIDPTQ

SEQ ID NO: 2407637 - protein, 10 aa, Entamoeba dispar
ERIDEMNEKV

SEQ ID NO: 2407638 - protein, 9 aa, Entamoeba dispar
ERIEEAKES

SEQ ID NO: 2407639 - protein, 20 aa, Entamoeba dispar
ERIKEEIETQYSTTPNYQEN

SEQ ID NO: 2407640 - protein, 8 aa, Entamoeba dispar
ERIRPPRY

SEQ ID NO: 2407641 - protein, 5 aa, Entamoeba dispar
ERKDF

SEQ ID NO: 2407642 - protein, 10 aa, Entamoeba dispar
ERLDGASGAE

SEQ ID NO: 2407643 - protein, 9 aa, Entamoeba dispar
ERLNEPGEI

SEQ ID NO: 2407644 - protein, 8 aa, Entamoeba dispar
ERMSQSSY

SEQ ID NO: 2407645 - protein, 4 aa, Entamoeba dispar
ERMV

SEQ ID NO: 2407646 - protein, 7 aa, Entamoeba dispar
ERNAQKR

SEQ ID NO: 2407647 - protein, 8 aa, Entamoeba dispar
ERNGESLD

SEQ ID NO: 2407648 - protein, 5 aa, Entamoeba dispar
ERNPH

SEQ ID NO: 2407649 - protein, 18 aa, Entamoeba dispar
ERPEEFKKTAREWTKLYA

SEQ ID NO: 2407650 - protein, 21 aa, Entamoeba dispar
ERRQTKKVNKLKERLAKSKEQ

SEQ ID NO: 2407651 - protein, 4 aa, Entamoeba dispar
ERSE

SEQ ID NO: 2407652 - protein, 4 aa, Entamoeba dispar
ERSK

SEQ ID NO: 2407653 - protein, 10 aa, Entamoeba dispar
ERSNKQIESK

SEQ ID NO: 2407654 - protein, 13 aa, Entamoeba dispar
ERTEKEERKERIK

SEQ ID NO: 2407655 - protein, 8 aa, Entamoeba dispar
ERYVETSD

SEQ ID NO: 2407656 - protein, 11 aa, Entamoeba dispar
ERYYPNEEKYN

SEQ ID NO: 2407657 - protein, 13 aa, Entamoeba dispar
ESAEGPTKEVDDS

SEQ ID NO: 2407658 - protein, 21 aa, Entamoeba dispar
ESAKRKAKELDLDQPDSKKKI

SEQ ID NO: 2407659 - protein, 13 aa, Entamoeba dispar
ESASRKSKVLPES

SEQ ID NO: 2407660 - protein, 13 aa, Entamoeba dispar
ESASRNSKVLPES

SEQ ID NO: 2407661 - protein, 8 aa, Entamoeba dispar
ESCTKESC

SEQ ID NO: 2407662 - protein, 8 aa, Entamoeba dispar
ESDNEQNI

SEQ ID NO: 2407663 - protein, 4 aa, Entamoeba dispar
ESGI

SEQ ID NO: 2407664 - protein, 6 aa, Entamoeba dispar
ESGNAY

SEQ ID NO: 2407665 - protein, 8 aa, Entamoeba dispar
ESGTGSGC

SEQ ID NO: 2407666 - protein, 4 aa, Entamoeba dispar
ESIG

SEQ ID NO: 2407667 - protein, 8 aa, Entamoeba dispar
ESILGNGS

SEQ ID NO: 2407668 - protein, 7 aa, Entamoeba dispar
ESITDKD

SEQ ID NO: 2407669 - protein, 4 aa, Entamoeba dispar
ESKE

SEQ ID NO: 2407670 - protein, 7 aa, Entamoeba dispar
ESKEDDM

SEQ ID NO: 2407671 - protein, 4 aa, Entamoeba dispar
ESKF

SEQ ID NO: 2407672 - protein, 12 aa, Entamoeba dispar
ESKFTIKKGERI

SEQ ID NO: 2407673 - protein, 9 aa, Entamoeba dispar
ESKNDANEY

SEQ ID NO: 2407674 - protein, 14 aa, Entamoeba dispar
ESLTIEEREDIKND

SEQ ID NO: 2407675 - protein, 10 aa, Entamoeba dispar
ESNNKPATNN

SEQ ID NO: 2407676 - protein, 9 aa, Entamoeba dispar
ESPESSNKC

SEQ ID NO: 2407677 - protein, 7 aa, Entamoeba dispar
ESPNGVN

SEQ ID NO: 2407678 - protein, 16 aa, Entamoeba dispar
ESQFPKEKTNKKVKDK

SEQ ID NO: 2407679 - protein, 19 aa, Entamoeba dispar
ESQFPKEKTNKRVRDEYQT

SEQ ID NO: 2407680 - protein, 4 aa, Entamoeba dispar
ESQS

SEQ ID NO: 2407681 - protein, 5 aa, Entamoeba dispar
ESSKY

SEQ ID NO: 2407682 - protein, 4 aa, Entamoeba dispar
ESSL

SEQ ID NO: 2407683 - protein, 5 aa, Entamoeba dispar
ESSNQ

SEQ ID NO: 2407684 - protein, 4 aa, Entamoeba dispar
ESSQ

SEQ ID NO: 2407685 - protein, 10 aa, Entamoeba dispar
ESSRNENRYR

SEQ ID NO: 2407686 - protein, 5 aa, Entamoeba dispar
ESTKY

SEQ ID NO: 2407687 - protein, 7 aa, Entamoeba dispar
ESTLDGL

SEQ ID NO: 2407688 - protein, 7 aa, Entamoeba dispar
ESTQKEY

SEQ ID NO: 2407689 - protein, 6 aa, Entamoeba dispar
ESVCEN

SEQ ID NO: 2407690 - protein, 15 aa, Entamoeba dispar
ESVTQTTFKSATENI

SEQ ID NO: 2407691 - protein, 23 aa, Entamoeba dispar
ETAKIDEGEVVDSKDYFNDFTYC

SEQ ID NO: 2407692 - protein, 4 aa, Entamoeba dispar
ETCT

SEQ ID NO: 2407693 - protein, 10 aa, Entamoeba dispar
ETDGETPIST

SEQ ID NO: 2407694 - protein, 4 aa, Entamoeba dispar
ETDI

SEQ ID NO: 2407695 - protein, 5 aa, Entamoeba dispar
ETDLN

SEQ ID NO: 2407696 - protein, 15 aa, Entamoeba dispar
ETDPQPCKRTPGGGF

SEQ ID NO: 2407697 - protein, 8 aa, Entamoeba dispar
ETEGNVGR

SEQ ID NO: 2407698 - protein, 9 aa, Entamoeba dispar
ETEGNVGRP

SEQ ID NO: 2407699 - protein, 13 aa, Entamoeba dispar
ETEGQVSKKVKET

SEQ ID NO: 2407700 - protein, 4 aa, Entamoeba dispar
ETEI

SEQ ID NO: 2407701 - protein, 17 aa, Entamoeba dispar
ETENEGKKSGYKERING

SEQ ID NO: 2407702 - protein, 4 aa, Entamoeba dispar
ETFE

SEQ ID NO: 2407703 - protein, 10 aa, Entamoeba dispar
ETGASTTIEA

SEQ ID NO: 2407704 - protein, 4 aa, Entamoeba dispar
ETGE

SEQ ID NO: 2407705 - protein, 14 aa, Entamoeba dispar
ETGKKWGSLHPYNF

SEQ ID NO: 2407706 - protein, 10 aa, Entamoeba dispar
ETGSGKTTQI

SEQ ID NO: 2407707 - protein, 15 aa, Entamoeba dispar
ETHEGDANACSFDPN

SEQ ID NO: 2407708 - protein, 13 aa, Entamoeba dispar
ETHNKDVYTPMGK

SEQ ID NO: 2407709 - protein, 33 aa, Entamoeba dispar
ETIKKNKMQKAGIQKASKKSKTTTEKKVTPKAI

SEQ ID NO: 2407710 - protein, 33 aa, Entamoeba dispar
ETIKKNKMQKAGIQKASKKSKTTTEKKVTPKAV

SEQ ID NO: 2407711 - protein, 5 aa, Entamoeba dispar
ETITG

SEQ ID NO: 2407712 - protein, 29 aa, Entamoeba dispar
ETKEQTAEEVRKRYNEGKEGMASAETTLK

SEQ ID NO: 2407713 - protein, 8 aa, Entamoeba dispar
ETKGSEYK

SEQ ID NO: 2407714 - protein, 10 aa, Entamoeba dispar
ETKNPSDLPK

SEQ ID NO: 2407715 - protein, 5 aa, Entamoeba dispar
ETKNV

SEQ ID NO: 2407716 - protein, 7 aa, Entamoeba dispar
ETKPEDI

SEQ ID NO: 2407717 - protein, 16 aa, Entamoeba dispar
ETKQKAKEVKQIRQKG

SEQ ID NO: 2407718 - protein, 16 aa, Entamoeba dispar
ETNGKALTEISEGKKI

SEQ ID NO: 2407719 - protein, 4 aa, Entamoeba dispar
ETNK

SEQ ID NO: 2407720 - protein, 7 aa, Entamoeba dispar
ETNSTNK

SEQ ID NO: 2407721 - protein, 11 aa, Entamoeba dispar
ETPDDKQKLRK

SEQ ID NO: 2407722 - protein, 10 aa, Entamoeba dispar
ETPKKMSTNE

SEQ ID NO: 2407723 - protein, 34 aa, Entamoeba dispar
ETPNNEKRSEEKYIKERKERKQGRNWTKEEDKKL

SEQ ID NO: 2407724 - protein, 4 aa, Entamoeba dispar
ETRE

SEQ ID NO: 2407725 - protein, 4 aa, Entamoeba dispar
ETSI

SEQ ID NO: 2407726 - protein, 6 aa, Entamoeba dispar
ETSKEL

SEQ ID NO: 2407727 - protein, 4 aa, Entamoeba dispar
ETTE

SEQ ID NO: 2407728 - protein, 10 aa, Entamoeba dispar
ETTERGFDEN

SEQ ID NO: 2407729 - protein, 6 aa, Entamoeba dispar
ETTKKE

SEQ ID NO: 2407730 - protein, 11 aa, Entamoeba dispar
ETVPNEVTAGL

SEQ ID NO: 2407731 - protein, 5 aa, Entamoeba dispar
EVAEA

SEQ ID NO: 2407732 - protein, 13 aa, Entamoeba dispar
EVEGTGYEKPTDD

SEQ ID NO: 2407733 - protein, 7 aa, Entamoeba dispar
EVESSID

SEQ ID NO: 2407734 - protein, 7 aa, Entamoeba dispar
EVGDDKI

SEQ ID NO: 2407735 - protein, 9 aa, Entamoeba dispar
EVGKEINDV

SEQ ID NO: 2407736 - protein, 6 aa, Entamoeba dispar
EVKESY

SEQ ID NO: 2407737 - protein, 9 aa, Entamoeba dispar
EVKKGDPVY

SEQ ID NO: 2407738 - protein, 7 aa, Entamoeba dispar
EVKSTEL

SEQ ID NO: 2407739 - protein, 6 aa, Entamoeba dispar
EVPKDE

SEQ ID NO: 2407740 - protein, 14 aa, Entamoeba dispar
EVRQQLSRATDETA

SEQ ID NO: 2407741 - protein, 14 aa, Entamoeba dispar
EVSEEKKNKIKNKI

SEQ ID NO: 2407742 - protein, 17 aa, Entamoeba dispar
EVSTKGTGKYARETEEY

SEQ ID NO: 2407743 - protein, 11 aa, Entamoeba dispar
EVTNINSEAFD

SEQ ID NO: 2407744 - protein, 5 aa, Entamoeba dispar
EVVHP

SEQ ID NO: 2407745 - protein, 4 aa, Entamoeba dispar
EYEH

SEQ ID NO: 2407746 - protein, 10 aa, Entamoeba dispar
EYEIEDSLGD

SEQ ID NO: 2407747 - protein, 6 aa, Entamoeba dispar
EYKTTC

SEQ ID NO: 2407748 - protein, 12 aa, Entamoeba dispar
EYLNEDKEIEEY

SEQ ID NO: 2407749 - protein, 11 aa, Entamoeba dispar
EYNGMTRESKE

SEQ ID NO: 2407750 - protein, 5 aa, Entamoeba dispar
EYNST

SEQ ID NO: 2407751 - protein, 4 aa, Entamoeba dispar
EYPT

SEQ ID NO: 2407752 - protein, 5 aa, Entamoeba dispar
EYQEG

SEQ ID NO: 2407753 - protein, 10 aa, Entamoeba dispar
EYQGKPIDVH

SEQ ID NO: 2407754 - protein, 20 aa, Entamoeba dispar
EYTDKDKDKYGTTIPSEVNS

SEQ ID NO: 2407755 - protein, 20 aa, Entamoeba dispar
EYTEEDRKKYGNTIPSEVKS

SEQ ID NO: 2407756 - protein, 20 aa, Entamoeba dispar
EYTKEDRKSYGNTIPREVTT

SEQ ID NO: 2407757 - protein, 19 aa, Entamoeba dispar
EYTKEDRNTYGNTIPSEVK

SEQ ID NO: 2407758 - protein, 7 aa, Entamoeba dispar
FAQEDPR

SEQ ID NO: 2407759 - protein, 4 aa, Entamoeba dispar
FDDA

SEQ ID NO: 2407760 - protein, 5 aa, Entamoeba dispar
FDKEV

SEQ ID NO: 2407761 - protein, 11 aa, Entamoeba dispar
FDNKKEEEYVD

SEQ ID NO: 2407762 - protein, 19 aa, Entamoeba dispar
FDPDGTPRLYQTDPAGTWT

SEQ ID NO: 2407763 - protein, 7 aa, Entamoeba dispar
FDPKTKQ

SEQ ID NO: 2407764 - protein, 6 aa, Entamoeba dispar
FDPMRR

SEQ ID NO: 2407765 - protein, 6 aa, Entamoeba dispar
FDPRYD

SEQ ID NO: 2407766 - protein, 4 aa, Entamoeba dispar
FDSA

SEQ ID NO: 2407767 - protein, 10 aa, Entamoeba dispar
FDSDSTQQDI

SEQ ID NO: 2407768 - protein, 9 aa, Entamoeba dispar
FEDCNQKEF

SEQ ID NO: 2407769 - protein, 4 aa, Entamoeba dispar
FEDS

SEQ ID NO: 2407770 - protein, 4 aa, Entamoeba dispar
FEEE

SEQ ID NO: 2407771 - protein, 13 aa, Entamoeba dispar
FEKAAGPSFAPPE

SEQ ID NO: 2407772 - protein, 9 aa, Entamoeba dispar
FEKDDDNNH

SEQ ID NO: 2407773 - protein, 5 aa, Entamoeba dispar
FENGK

SEQ ID NO: 2407774 - protein, 12 aa, Entamoeba dispar
FEPINDPKQDGV

SEQ ID NO: 2407775 - protein, 9 aa, Entamoeba dispar
FEQGSSDCS

SEQ ID NO: 2407776 - protein, 4 aa, Entamoeba dispar
FERK

SEQ ID NO: 2407777 - protein, 6 aa, Entamoeba dispar
FESGEV

SEQ ID NO: 2407778 - protein, 6 aa, Entamoeba dispar
FESTGI

SEQ ID NO: 2407779 - protein, 8 aa, Entamoeba dispar
FETEEGKK

SEQ ID NO: 2407780 - protein, 6 aa, Entamoeba dispar
FEYGDK

SEQ ID NO: 2407781 - protein, 7 aa, Entamoeba dispar
FGEGDRS

SEQ ID NO: 2407782 - protein, 13 aa, Entamoeba dispar
FGEGSRKKKVMSR

SEQ ID NO: 2407783 - protein, 6 aa, Entamoeba dispar
FGNATQ

SEQ ID NO: 2407784 - protein, 4 aa, Entamoeba dispar
FGSS

SEQ ID NO: 2407785 - protein, 4 aa, Entamoeba dispar
FHPD

SEQ ID NO: 2407786 - protein, 10 aa, Entamoeba dispar
FKDNGNPKEL

SEQ ID NO: 2407787 - protein, 22 aa, Entamoeba dispar
FKEPPPKPQVEQNKNKYDGLDP

SEQ ID NO: 2407788 - protein, 6 aa, Entamoeba dispar
FKGTDD

SEQ ID NO: 2407789 - protein, 13 aa, Entamoeba dispar
FKKNGTKVADDVP

SEQ ID NO: 2407790 - protein, 9 aa, Entamoeba dispar
FKSTPLSTM

SEQ ID NO: 2407791 - protein, 5 aa, Entamoeba dispar
FKTEE

SEQ ID NO: 2407792 - protein, 6 aa, Entamoeba dispar
FKTTPF

SEQ ID NO: 2407793 - protein, 5 aa, Entamoeba dispar
FNDGS

SEQ ID NO: 2407794 - protein, 12 aa, Entamoeba dispar
FNEDSYVDDSDT

SEQ ID NO: 2407795 - protein, 13 aa, Entamoeba dispar
FNEESEAKSRTRK

SEQ ID NO: 2407796 - protein, 6 aa, Entamoeba dispar
FNEKSG

SEQ ID NO: 2407797 - protein, 4 aa, Entamoeba dispar
FNEN

SEQ ID NO: 2407798 - protein, 4 aa, Entamoeba dispar
FNGG

SEQ ID NO: 2407799 - protein, 10 aa, Entamoeba dispar
FNKNSSLSDI

SEQ ID NO: 2407800 - protein, 4 aa, Entamoeba dispar
FNNN

SEQ ID NO: 2407801 - protein, 5 aa, Entamoeba dispar
FNNNY

SEQ ID NO: 2407802 - protein, 4 aa, Entamoeba dispar
FNPL

SEQ ID NO: 2407803 - protein, 4 aa, Entamoeba dispar
FNSL

SEQ ID NO: 2407804 - protein, 8 aa, Entamoeba dispar
FNTIDESD

SEQ ID NO: 2407805 - protein, 5 aa, Entamoeba dispar
FPETE

SEQ ID NO: 2407806 - protein, 21 aa, Entamoeba dispar
FPGFSSRTSCNMQDSVDPDEH

SEQ ID NO: 2407807 - protein, 4 aa, Entamoeba dispar
FPNN

SEQ ID NO: 2407808 - protein, 5 aa, Entamoeba dispar
FPNNQ

SEQ ID NO: 2407809 - protein, 4 aa, Entamoeba dispar
FPPR

SEQ ID NO: 2407810 - protein, 8 aa, Entamoeba dispar
FPPTDTSI

SEQ ID NO: 2407811 - protein, 9 aa, Entamoeba dispar
FPSKNYSPF

SEQ ID NO: 2407812 - protein, 4 aa, Entamoeba dispar
FPTD

SEQ ID NO: 2407813 - protein, 6 aa, Entamoeba dispar
FPYSGR

SEQ ID NO: 2407814 - protein, 5 aa, Entamoeba dispar
FQGAE

SEQ ID NO: 2407815 - protein, 6 aa, Entamoeba dispar
FQGNTE

SEQ ID NO: 2407816 - protein, 8 aa, Entamoeba dispar
FQPDHNKL

SEQ ID NO: 2407817 - protein, 5 aa, Entamoeba dispar
FRDCG

SEQ ID NO: 2407818 - protein, 5 aa, Entamoeba dispar
FRGND

SEQ ID NO: 2407819 - protein, 10 aa, Entamoeba dispar
FRQTRRRRGH

SEQ ID NO: 2407820 - protein, 6 aa, Entamoeba dispar
FSADDQ

SEQ ID NO: 2407821 - protein, 12 aa, Entamoeba dispar
FSDLKKDPNYYY

SEQ ID NO: 2407822 - protein, 4 aa, Entamoeba dispar
FSEK

SEQ ID NO: 2407823 - protein, 7 aa, Entamoeba dispar
FSESFKD

SEQ ID NO: 2407824 - protein, 9 aa, Entamoeba dispar
FSGKKEKIK

SEQ ID NO: 2407825 - protein, 31 aa, Entamoeba dispar
FSGSENAKEEKEVDNPFGNFEESKSETLPEI

SEQ ID NO: 2407826 - protein, 6 aa, Entamoeba dispar
FSGSTV

SEQ ID NO: 2407827 - protein, 4 aa, Entamoeba dispar
FSKE

SEQ ID NO: 2407828 - protein, 9 aa, Entamoeba dispar
FSNDWNTGD

SEQ ID NO: 2407829 - protein, 6 aa, Entamoeba dispar
FSPDGS

SEQ ID NO: 2407830 - protein, 10 aa, Entamoeba dispar
FSPEEDEIVS

SEQ ID NO: 2407831 - protein, 7 aa, Entamoeba dispar
FSSDSNK

SEQ ID NO: 2407832 - protein, 14 aa, Entamoeba dispar
FSTGYEATIGTDFS

SEQ ID NO: 2407833 - protein, 8 aa, Entamoeba dispar
FSTTQNGI

SEQ ID NO: 2407834 - protein, 4 aa, Entamoeba dispar
FSWP

SEQ ID NO: 2407835 - protein, 5 aa, Entamoeba dispar
FTEKE

SEQ ID NO: 2407836 - protein, 4 aa, Entamoeba dispar
FTNN

SEQ ID NO: 2407837 - protein, 11 aa, Entamoeba dispar
FTPKQKKETIQ

SEQ ID NO: 2407838 - protein, 5 aa, Entamoeba dispar
FTQQS

SEQ ID NO: 2407839 - protein, 20 aa, Entamoeba dispar
FVPPQNAPSDPSQETPYAPP

SEQ ID NO: 2407840 - protein, 31 aa, Entamoeba dispar
FVTNENEPSVDNPFESNNTQPNKVPNLPEVD

SEQ ID NO: 2407841 - protein, 5 aa, Entamoeba dispar
FYNNK

SEQ ID NO: 2407842 - protein, 4 aa, Entamoeba dispar
GAAM

SEQ ID NO: 2407843 - protein, 4 aa, Entamoeba dispar
GADA

SEQ ID NO: 2407844 - protein, 6 aa, Entamoeba dispar
GAISSS

SEQ ID NO: 2407845 - protein, 8 aa, Entamoeba dispar
GAKGCEVS

SEQ ID NO: 2407846 - protein, 9 aa, Entamoeba dispar
GALGSTGRG

SEQ ID NO: 2407847 - protein, 9 aa, Entamoeba dispar
GANPSFGPS

SEQ ID NO: 2407848 - protein, 7 aa, Entamoeba dispar
GANSVTK

SEQ ID NO: 2407849 - protein, 32 aa, Entamoeba dispar
GAPELPPCPDITETPKEETKAKKNKTNNKEKM

SEQ ID NO: 2407850 - protein, 9 aa, Entamoeba dispar
GAPVKGESM

SEQ ID NO: 2407851 - protein, 8 aa, Entamoeba dispar
GAQPTGLG

SEQ ID NO: 2407852 - protein, 8 aa, Entamoeba dispar
GASSEIEK

SEQ ID NO: 2407853 - protein, 6 aa, Entamoeba dispar
GAVARA

SEQ ID NO: 2407854 - protein, 15 aa, Entamoeba dispar
GAVEYSKEIDPEHKG

SEQ ID NO: 2407855 - protein, 8 aa, Entamoeba dispar
GAVGKSSI

SEQ ID NO: 2407856 - protein, 6 aa, Entamoeba dispar
GAVGKT

SEQ ID NO: 2407857 - protein, 5 aa, Entamoeba dispar
GAYHS

SEQ ID NO: 2407858 - protein, 6 aa, Entamoeba dispar
GCNTNG

SEQ ID NO: 2407859 - protein, 9 aa, Entamoeba dispar
GDAINHPPK

SEQ ID NO: 2407860 - protein, 14 aa, Entamoeba dispar
GDAPENQNPEQELE

SEQ ID NO: 2407861 - protein, 5 aa, Entamoeba dispar
GDDLR

SEQ ID NO: 2407862 - protein, 12 aa, Entamoeba dispar
GDEISSKDNKGH

SEQ ID NO: 2407863 - protein, 15 aa, Entamoeba dispar
GDEYGGRQDVKGDSF

SEQ ID NO: 2407864 - protein, 8 aa, Entamoeba dispar
GDGFPKGC

SEQ ID NO: 2407865 - protein, 8 aa, Entamoeba dispar
GDGKSSLG

SEQ ID NO: 2407866 - protein, 8 aa, Entamoeba dispar
GDGSVRKG

SEQ ID NO: 2407867 - protein, 4 aa, Entamoeba dispar
GDGT

SEQ ID NO: 2407868 - protein, 4 aa, Entamoeba dispar
GDIK

SEQ ID NO: 2407869 - protein, 13 aa, Entamoeba dispar
GDKIESSRVTYGK

SEQ ID NO: 2407870 - protein, 7 aa, Entamoeba dispar
GDKRSEK

SEQ ID NO: 2407871 - protein, 4 aa, Entamoeba dispar
GDNK

SEQ ID NO: 2407872 - protein, 11 aa, Entamoeba dispar
GDPSSGKTSSI

SEQ ID NO: 2407873 - protein, 8 aa, Entamoeba dispar
GDRGSGKT

SEQ ID NO: 2407874 - protein, 5 aa, Entamoeba dispar
GDRHN

SEQ ID NO: 2407875 - protein, 18 aa, Entamoeba dispar
GDRMENNRNQVQKRAEMD

SEQ ID NO: 2407876 - protein, 10 aa, Entamoeba dispar
GDSAQKKSIQ

SEQ ID NO: 2407877 - protein, 7 aa, Entamoeba dispar
GDTDSPV

SEQ ID NO: 2407878 - protein, 6 aa, Entamoeba dispar
GDTPFD

SEQ ID NO: 2407879 - protein, 11 aa, Entamoeba dispar
GDVGDGKLAPV

SEQ ID NO: 2407880 - protein, 4 aa, Entamoeba dispar
GEED

SEQ ID NO: 2407881 - protein, 6 aa, Entamoeba dispar
GEEDIE

SEQ ID NO: 2407882 - protein, 4 aa, Entamoeba dispar
GEEI

SEQ ID NO: 2407883 - protein, 5 aa, Entamoeba dispar
GEEPM

SEQ ID NO: 2407884 - protein, 7 aa, Entamoeba dispar
GEESKKL

SEQ ID NO: 2407885 - protein, 4 aa, Entamoeba dispar
GEGE

SEQ ID NO: 2407886 - protein, 4 aa, Entamoeba dispar
GEGM

SEQ ID NO: 2407887 - protein, 9 aa, Entamoeba dispar
GEGNKEEEL

SEQ ID NO: 2407888 - protein, 4 aa, Entamoeba dispar
GEGQ

SEQ ID NO: 2407889 - protein, 5 aa, Entamoeba dispar
GEGSR

SEQ ID NO: 2407890 - protein, 6 aa, Entamoeba dispar
GEIPTA

SEQ ID NO: 2407891 - protein, 8 aa, Entamoeba dispar
GEKLGNGA

SEQ ID NO: 2407892 - protein, 8 aa, Entamoeba dispar
GEKRDDES

SEQ ID NO: 2407893 - protein, 18 aa, Entamoeba dispar
GEMKGSAITGPVSKESAD

SEQ ID NO: 2407894 - protein, 19 aa, Entamoeba dispar
GENETEIPKKRENKKDIDE

SEQ ID NO: 2407895 - protein, 4 aa, Entamoeba dispar
GEPI

SEQ ID NO: 2407896 - protein, 7 aa, Entamoeba dispar
GEQCTTN

SEQ ID NO: 2407897 - protein, 4 aa, Entamoeba dispar
GEQI

SEQ ID NO: 2407898 - protein, 15 aa, Entamoeba dispar
GESFDDHQISDDSSL

SEQ ID NO: 2407899 - protein, 11 aa, Entamoeba dispar
GESKKTEENNY

SEQ ID NO: 2407900 - protein, 7 aa, Entamoeba dispar
GESMKGT

SEQ ID NO: 2407901 - protein, 7 aa, Entamoeba dispar
GESTEFN

SEQ ID NO: 2407902 - protein, 4 aa, Entamoeba dispar
GETI

SEQ ID NO: 2407903 - protein, 7 aa, Entamoeba dispar
GETLPTN

SEQ ID NO: 2407904 - protein, 4 aa, Entamoeba dispar
GETQ

SEQ ID NO: 2407905 - protein, 5 aa, Entamoeba dispar
GEYKS

SEQ ID NO: 2407906 - protein, 6 aa, Entamoeba dispar
GFDNEG

SEQ ID NO: 2407907 - protein, 6 aa, Entamoeba dispar
GFEPTK

SEQ ID NO: 2407908 - protein, 16 aa, Entamoeba dispar
GFKPEANNESEGRAKL

SEQ ID NO: 2407909 - protein, 7 aa, Entamoeba dispar
GFKRETA

SEQ ID NO: 2407910 - protein, 9 aa, Entamoeba dispar
GFNGDENSQ

SEQ ID NO: 2407911 - protein, 5 aa, Entamoeba dispar
GFTED

SEQ ID NO: 2407912 - protein, 14 aa, Entamoeba dispar
GGGERLVSASDDGT

SEQ ID NO: 2407913 - protein, 4 aa, Entamoeba dispar
GGGL

SEQ ID NO: 2407914 - protein, 9 aa, Entamoeba dispar
GGGPQPVFP

SEQ ID NO: 2407915 - protein, 8 aa, Entamoeba dispar
GGHTPARK

SEQ ID NO: 2407916 - protein, 7 aa, Entamoeba dispar
GGHTQGV

SEQ ID NO: 2407917 - protein, 5 aa, Entamoeba dispar
GGIKE

SEQ ID NO: 2407918 - protein, 4 aa, Entamoeba dispar
GGKD

SEQ ID NO: 2407919 - protein, 9 aa, Entamoeba dispar
GGLTNEQKK

SEQ ID NO: 2407920 - protein, 6 aa, Entamoeba dispar
GGMKEQ

SEQ ID NO: 2407921 - protein, 11 aa, Entamoeba dispar
GGPGGGKTTSL

SEQ ID NO: 2407922 - protein, 6 aa, Entamoeba dispar
GGSDLG

SEQ ID NO: 2407923 - protein, 4 aa, Entamoeba dispar
GGSL

SEQ ID NO: 2407924 - protein, 10 aa, Entamoeba dispar
GGTASGKTTF

SEQ ID NO: 2407925 - protein, 12 aa, Entamoeba dispar
GGTTGTKGNTQS

SEQ ID NO: 2407926 - protein, 12 aa, Entamoeba dispar
GGVSSAKTEEDI

SEQ ID NO: 2407927 - protein, 18 aa, Entamoeba dispar
GGYDPLEKDKGIDGAKKR

SEQ ID NO: 2407928 - protein, 7 aa, Entamoeba dispar
GGYTVSN

SEQ ID NO: 2407929 - protein, 11 aa, Entamoeba dispar
GHGGKEAAKVA

SEQ ID NO: 2407930 - protein, 7 aa, Entamoeba dispar
GHNEREI

SEQ ID NO: 2407931 - protein, 4 aa, Entamoeba dispar
GIDE

SEQ ID NO: 2407932 - protein, 4 aa, Entamoeba dispar
GIDK

SEQ ID NO: 2407933 - protein, 8 aa, Entamoeba dispar
GIEASAKT

SEQ ID NO: 2407934 - protein, 5 aa, Entamoeba dispar
GIEEG

SEQ ID NO: 2407935 - protein, 26 aa, Entamoeba dispar
GIEQRPLEKRGSESQIDRNNQITSHQ

SEQ ID NO: 2407936 - protein, 10 aa, Entamoeba dispar
GIGKGKQICK

SEQ ID NO: 2407937 - protein, 13 aa, Entamoeba dispar
GIKKRRSKKTECP

SEQ ID NO: 2407938 - protein, 8 aa, Entamoeba dispar
GIPKPTSI

SEQ ID NO: 2407939 - protein, 12 aa, Entamoeba dispar
GIPNGKAGEQTI

SEQ ID NO: 2407940 - protein, 5 aa, Entamoeba dispar
GIPRN

SEQ ID NO: 2407941 - protein, 9 aa, Entamoeba dispar
GIQPSQPKI

SEQ ID NO: 2407942 - protein, 7 aa, Entamoeba dispar
GIQQSWS

SEQ ID NO: 2407943 - protein, 10 aa, Entamoeba dispar
GITGDSSLQR

SEQ ID NO: 2407944 - protein, 4 aa, Entamoeba dispar
GITP

SEQ ID NO: 2407945 - protein, 4 aa, Entamoeba dispar
GITS

SEQ ID NO: 2407946 - protein, 6 aa, Entamoeba dispar
GITSDT

SEQ ID NO: 2407947 - protein, 10 aa, Entamoeba dispar
GKAPTQQQEE

SEQ ID NO: 2407948 - protein, 15 aa, Entamoeba dispar
GKAQNDILDKAGNNF

SEQ ID NO: 2407949 - protein, 5 aa, Entamoeba dispar
GKDRR

SEQ ID NO: 2407950 - protein, 4 aa, Entamoeba dispar
GKED

SEQ ID NO: 2407951 - protein, 5 aa, Entamoeba dispar
GKEEY

SEQ ID NO: 2407952 - protein, 5 aa, Entamoeba dispar
GKEGK

SEQ ID NO: 2407953 - protein, 4 aa, Entamoeba dispar
GKEI

SEQ ID NO: 2407954 - protein, 7 aa, Entamoeba dispar
GKEITAE

SEQ ID NO: 2407955 - protein, 6 aa, Entamoeba dispar
GKEPNV

SEQ ID NO: 2407956 - protein, 4 aa, Entamoeba dispar
GKER

SEQ ID NO: 2407957 - protein, 8 aa, Entamoeba dispar
GKETSGIH

SEQ ID NO: 2407958 - protein, 9 aa, Entamoeba dispar
GKFEVSEEL

SEQ ID NO: 2407959 - protein, 5 aa, Entamoeba dispar
GKGGF

SEQ ID NO: 2407960 - protein, 14 aa, Entamoeba dispar
GKGSTDNITTIVLK

SEQ ID NO: 2407961 - protein, 5 aa, Entamoeba dispar
GKGTY

SEQ ID NO: 2407962 - protein, 16 aa, Entamoeba dispar
GKIDQSSNALKPKLED

SEQ ID NO: 2407963 - protein, 8 aa, Entamoeba dispar
GKINSSNE

SEQ ID NO: 2407964 - protein, 8 aa, Entamoeba dispar
GKITSSNE

SEQ ID NO: 2407965 - protein, 4 aa, Entamoeba dispar
GKKL

SEQ ID NO: 2407966 - protein, 13 aa, Entamoeba dispar
GKKLEMKGPNETA

SEQ ID NO: 2407967 - protein, 10 aa, Entamoeba dispar
GKKQGGSVKT

SEQ ID NO: 2407968 - protein, 5 aa, Entamoeba dispar
GKKRE

SEQ ID NO: 2407969 - protein, 9 aa, Entamoeba dispar
GKLRGQRAQ

SEQ ID NO: 2407970 - protein, 4 aa, Entamoeba dispar
GKNG

SEQ ID NO: 2407971 - protein, 8 aa, Entamoeba dispar
GKNIEKRD

SEQ ID NO: 2407972 - protein, 7 aa, Entamoeba dispar
GKNSEGF

SEQ ID NO: 2407973 - protein, 7 aa, Entamoeba dispar
GKNTIGS

SEQ ID NO: 2407974 - protein, 11 aa, Entamoeba dispar
GKPCVSGAEGI

SEQ ID NO: 2407975 - protein, 5 aa, Entamoeba dispar
GKPIS

SEQ ID NO: 2407976 - protein, 7 aa, Entamoeba dispar
GKRPTLE

SEQ ID NO: 2407977 - protein, 8 aa, Entamoeba dispar
GKRRDNNI

SEQ ID NO: 2407978 - protein, 7 aa, Entamoeba dispar
GKRRKST

SEQ ID NO: 2407979 - protein, 8 aa, Entamoeba dispar
GKSNVGDV

SEQ ID NO: 2407980 - protein, 8 aa, Entamoeba dispar
GKTGRPNV

SEQ ID NO: 2407981 - protein, 4 aa, Entamoeba dispar
GKTS

SEQ ID NO: 2407982 - protein, 4 aa, Entamoeba dispar
GKTT

SEQ ID NO: 2407983 - protein, 8 aa, Entamoeba dispar
GKYEESEP

SEQ ID NO: 2407984 - protein, 19 aa, Entamoeba dispar
GKYHPDPLKDDITKYLIIN

SEQ ID NO: 2407985 - protein, 6 aa, Entamoeba dispar
GLFEGK

SEQ ID NO: 2407986 - protein, 6 aa, Entamoeba dispar
GLNEDS

SEQ ID NO: 2407987 - protein, 5 aa, Entamoeba dispar
GLNPK

SEQ ID NO: 2407988 - protein, 13 aa, Entamoeba dispar
GLQGFDNTHSEDE

SEQ ID NO: 2407989 - protein, 12 aa, Entamoeba dispar
GLQSKVSDKNYK

SEQ ID NO: 2407990 - protein, 9 aa, Entamoeba dispar
GLSGPNLRN

SEQ ID NO: 2407991 - protein, 12 aa, Entamoeba dispar
GMEENEFTDARQ

SEQ ID NO: 2407992 - protein, 7 aa, Entamoeba dispar
GMGTGSA

SEQ ID NO: 2407993 - protein, 8 aa, Entamoeba dispar
GMGTGSTE

SEQ ID NO: 2407994 - protein, 18 aa, Entamoeba dispar
GMSENAKKFAEKRSPGSY

SEQ ID NO: 2407995 - protein, 8 aa, Entamoeba dispar
GMSQQEIE

SEQ ID NO: 2407996 - protein, 7 aa, Entamoeba dispar
GNAEFTS

SEQ ID NO: 2407997 - protein, 6 aa, Entamoeba dispar
GNCHQR

SEQ ID NO: 2407998 - protein, 5 aa, Entamoeba dispar
GNDEN

SEQ ID NO: 2407999 - protein, 8 aa, Entamoeba dispar
GNDIEDSE

SEQ ID NO: 2408000 - protein, 10 aa, Entamoeba dispar
GNDSRTAKNL

SEQ ID NO: 2408001 - protein, 7 aa, Entamoeba dispar
GNEESEF

SEQ ID NO: 2408002 - protein, 4 aa, Entamoeba dispar
GNEG

SEQ ID NO: 2408003 - protein, 7 aa, Entamoeba dispar
GNEHGKG

SEQ ID NO: 2408004 - protein, 4 aa, Entamoeba dispar
GNET

SEQ ID NO: 2408005 - protein, 20 aa, Entamoeba dispar
GNETNTISIGGDKNLGGNDF

SEQ ID NO: 2408006 - protein, 13 aa, Entamoeba dispar
GNETPASKSRLPL

SEQ ID NO: 2408007 - protein, 4 aa, Entamoeba dispar
GNEV

SEQ ID NO: 2408008 - protein, 6 aa, Entamoeba dispar
GNGNNM

SEQ ID NO: 2408009 - protein, 17 aa, Entamoeba dispar
GNKFTTEAKLNEHDARV

SEQ ID NO: 2408010 - protein, 7 aa, Entamoeba dispar
GNKMPEG

SEQ ID NO: 2408011 - protein, 10 aa, Entamoeba dispar
GNKSKGPVSI

SEQ ID NO: 2408012 - protein, 8 aa, Entamoeba dispar
GNKVTTGD

SEQ ID NO: 2408013 - protein, 8 aa, Entamoeba dispar
GNNENDLQ

SEQ ID NO: 2408014 - protein, 6 aa, Entamoeba dispar
GNPAHL

SEQ ID NO: 2408015 - protein, 24 aa, Entamoeba dispar
GNPIQSQTGQQQQPNTQTQPQKDI

SEQ ID NO: 2408016 - protein, 6 aa, Entamoeba dispar
GNPRQF

SEQ ID NO: 2408017 - protein, 6 aa, Entamoeba dispar
GNPTVE

SEQ ID NO: 2408018 - protein, 4 aa, Entamoeba dispar
GNQK

SEQ ID NO: 2408019 - protein, 8 aa, Entamoeba dispar
GNQYKNKK

SEQ ID NO: 2408020 - protein, 6 aa, Entamoeba dispar
GNRSEM

SEQ ID NO: 2408021 - protein, 4 aa, Entamoeba dispar
GNSE

SEQ ID NO: 2408022 - protein, 5 aa, Entamoeba dispar
GNSNL

SEQ ID NO: 2408023 - protein, 6 aa, Entamoeba dispar
GNSQPI

SEQ ID NO: 2408024 - protein, 17 aa, Entamoeba dispar
GNSTGNVSLVKLTDMPG

SEQ ID NO: 2408025 - protein, 5 aa, Entamoeba dispar
GNTEK

SEQ ID NO: 2408026 - protein, 5 aa, Entamoeba dispar
GNTIN

SEQ ID NO: 2408027 - protein, 9 aa, Entamoeba dispar
GNTIPSEVK

SEQ ID NO: 2408028 - protein, 20 aa, Entamoeba dispar
GNWQTQREDNQDDSENEGEC

SEQ ID NO: 2408029 - protein, 23 aa, Entamoeba dispar
GPAKQPKGYPSGSFGPTTSARMD

SEQ ID NO: 2408030 - protein, 10 aa, Entamoeba dispar
GPDNSNEKSE

SEQ ID NO: 2408031 - protein, 9 aa, Entamoeba dispar
GPEEKSPNV

SEQ ID NO: 2408032 - protein, 4 aa, Entamoeba dispar
GPFA

SEQ ID NO: 2408033 - protein, 12 aa, Entamoeba dispar
GPGLNKAGKFPT

SEQ ID NO: 2408034 - protein, 9 aa, Entamoeba dispar
GPKRKRQHI

SEQ ID NO: 2408035 - protein, 4 aa, Entamoeba dispar
GPMN

SEQ ID NO: 2408036 - protein, 6 aa, Entamoeba dispar
GPMNGQ

SEQ ID NO: 2408037 - protein, 9 aa, Entamoeba dispar
GPNMGGKST

SEQ ID NO: 2408038 - protein, 9 aa, Entamoeba dispar
GPQAITGVP

SEQ ID NO: 2408039 - protein, 7 aa, Entamoeba dispar
GPQSENG

SEQ ID NO: 2408040 - protein, 6 aa, Entamoeba dispar
GPQYKG

SEQ ID NO: 2408041 - protein, 5 aa, Entamoeba dispar
GPTNN

SEQ ID NO: 2408042 - protein, 8 aa, Entamoeba dispar
GPTTESDI

SEQ ID NO: 2408043 - protein, 11 aa, Entamoeba dispar
GPTTIQKPSGV

SEQ ID NO: 2408044 - protein, 5 aa, Entamoeba dispar
GQDKI

SEQ ID NO: 2408045 - protein, 7 aa, Entamoeba dispar
GQGPSKL

SEQ ID NO: 2408046 - protein, 5 aa, Entamoeba dispar
GQGTF

SEQ ID NO: 2408047 - protein, 10 aa, Entamoeba dispar
GQKAEKEEKI

SEQ ID NO: 2408048 - protein, 13 aa, Entamoeba dispar
GQPLPYNKSTSKL

SEQ ID NO: 2408049 - protein, 36 aa, Entamoeba dispar
GQQRVEVSPSHSIKSPRATPTDRDDQPKRSRRTPIR

SEQ ID NO: 2408050 - protein, 7 aa, Entamoeba dispar
GQQSSLE

SEQ ID NO: 2408051 - protein, 6 aa, Entamoeba dispar
GQRSSL

SEQ ID NO: 2408052 - protein, 20 aa, Entamoeba dispar
GQTGSGKTYTMEGTNDKPGM

SEQ ID NO: 2408053 - protein, 7 aa, Entamoeba dispar
GRDFPDL

SEQ ID NO: 2408054 - protein, 16 aa, Entamoeba dispar
GREQYGSSGTSYNNEG

SEQ ID NO: 2408055 - protein, 8 aa, Entamoeba dispar
GRGPSSDA

SEQ ID NO: 2408056 - protein, 9 aa, Entamoeba dispar
GRGTSTYDG

SEQ ID NO: 2408057 - protein, 7 aa, Entamoeba dispar
GRIPPSP

SEQ ID NO: 2408058 - protein, 8 aa, Entamoeba dispar
GRNSKTVD

SEQ ID NO: 2408059 - protein, 7 aa, Entamoeba dispar
GRNTTDV

SEQ ID NO: 2408060 - protein, 17 aa, Entamoeba dispar
GRPWKEAYKKKSIKDNV

SEQ ID NO: 2408061 - protein, 6 aa, Entamoeba dispar
GRSFND

SEQ ID NO: 2408062 - protein, 13 aa, Entamoeba dispar
GRTGRAGKKGTAI

SEQ ID NO: 2408063 - protein, 7 aa, Entamoeba dispar
GSDEGNI

SEQ ID NO: 2408064 - protein, 4 aa, Entamoeba dispar
GSDG

SEQ ID NO: 2408065 - protein, 5 aa, Entamoeba dispar
GSDGG

SEQ ID NO: 2408066 - protein, 8 aa, Entamoeba dispar
GSDKLDEA

SEQ ID NO: 2408067 - protein, 5 aa, Entamoeba dispar
GSDSK

SEQ ID NO: 2408068 - protein, 5 aa, Entamoeba dispar
GSEDC

SEQ ID NO: 2408069 - protein, 6 aa, Entamoeba dispar
GSEEIK

SEQ ID NO: 2408070 - protein, 27 aa, Entamoeba dispar
GSERLDESGAKGERLEETKNINKSLSA

SEQ ID NO: 2408071 - protein, 4 aa, Entamoeba dispar
GSFG

SEQ ID NO: 2408072 - protein, 11 aa, Entamoeba dispar
GSGGIKLTKDG

SEQ ID NO: 2408073 - protein, 7 aa, Entamoeba dispar
GSGGRDS

SEQ ID NO: 2408074 - protein, 5 aa, Entamoeba dispar
GSGKG

SEQ ID NO: 2408075 - protein, 12 aa, Entamoeba dispar
GSGKPVDKGPNV

SEQ ID NO: 2408076 - protein, 5 aa, Entamoeba dispar
GSGKS

SEQ ID NO: 2408077 - protein, 7 aa, Entamoeba dispar
GSGRQEL

SEQ ID NO: 2408078 - protein, 8 aa, Entamoeba dispar
GSGTGKTV

SEQ ID NO: 2408079 - protein, 10 aa, Entamoeba dispar
GSHDSGTSTI

SEQ ID NO: 2408080 - protein, 4 aa, Entamoeba dispar
GSIP

SEQ ID NO: 2408081 - protein, 9 aa, Entamoeba dispar
GSKDLTEQQ

SEQ ID NO: 2408082 - protein, 4 aa, Entamoeba dispar
GSLL

SEQ ID NO: 2408083 - protein, 18 aa, Entamoeba dispar
GSLTRQNEKVLSTTQKDS

SEQ ID NO: 2408084 - protein, 6 aa, Entamoeba dispar
GSNTEG

SEQ ID NO: 2408085 - protein, 4 aa, Entamoeba dispar
GSNV

SEQ ID NO: 2408086 - protein, 6 aa, Entamoeba dispar
GSPRNT

SEQ ID NO: 2408087 - protein, 9 aa, Entamoeba dispar
GSQKEIVSS

SEQ ID NO: 2408088 - protein, 9 aa, Entamoeba dispar
GSRTRKQCR

SEQ ID NO: 2408089 - protein, 7 aa, Entamoeba dispar
GSSANGR

SEQ ID NO: 2408090 - protein, 8 aa, Entamoeba dispar
GSSTIPST

SEQ ID NO: 2408091 - protein, 4 aa, Entamoeba dispar
GSTF

SEQ ID NO: 2408092 - protein, 7 aa, Entamoeba dispar
GSTTEMK

SEQ ID NO: 2408093 - protein, 4 aa, Entamoeba dispar
GSVE

SEQ ID NO: 2408094 - protein, 6 aa, Entamoeba dispar
GSVIDG

SEQ ID NO: 2408095 - protein, 4 aa, Entamoeba dispar
GSYD

SEQ ID NO: 2408096 - protein, 5 aa, Entamoeba dispar
GSYNK

SEQ ID NO: 2408097 - protein, 9 aa, Entamoeba dispar
GSYPPKNEF

SEQ ID NO: 2408098 - protein, 15 aa, Entamoeba dispar
GTDSSKTFKNTSTDH

SEQ ID NO: 2408099 - protein, 11 aa, Entamoeba dispar
GTENGKPLREE

SEQ ID NO: 2408100 - protein, 9 aa, Entamoeba dispar
GTITDSDTA

SEQ ID NO: 2408101 - protein, 4 aa, Entamoeba dispar
GTKY

SEQ ID NO: 2408102 - protein, 6 aa, Entamoeba dispar
GTLSPL

SEQ ID NO: 2408103 - protein, 5 aa, Entamoeba dispar
GTNGC

SEQ ID NO: 2408104 - protein, 6 aa, Entamoeba dispar
GTNGEN

SEQ ID NO: 2408105 - protein, 12 aa, Entamoeba dispar
GTNKKLLGGKGA

SEQ ID NO: 2408106 - protein, 8 aa, Entamoeba dispar
GTRHPGMP

SEQ ID NO: 2408107 - protein, 15 aa, Entamoeba dispar
GTRSIEESKIASKKY

SEQ ID NO: 2408108 - protein, 8 aa, Entamoeba dispar
GTSGIDAR

SEQ ID NO: 2408109 - protein, 15 aa, Entamoeba dispar
GTSPANARTKKQTKI

SEQ ID NO: 2408110 - protein, 11 aa, Entamoeba dispar
GTTKSSIARYD

SEQ ID NO: 2408111 - protein, 4 aa, Entamoeba dispar
GTTY

SEQ ID NO: 2408112 - protein, 5 aa, Entamoeba dispar
GTVDD

SEQ ID NO: 2408113 - protein, 9 aa, Entamoeba dispar
GVDNQKSGV

SEQ ID NO: 2408114 - protein, 4 aa, Entamoeba dispar
GVEA

SEQ ID NO: 2408115 - protein, 7 aa, Entamoeba dispar
GVEEKKD

SEQ ID NO: 2408116 - protein, 10 aa, Entamoeba dispar
GVGKRNDDCM

SEQ ID NO: 2408117 - protein, 26 aa, Entamoeba dispar
GVISNSGKFAVNGGGLNIGRSTSDDY

SEQ ID NO: 2408118 - protein, 6 aa, Entamoeba dispar
GVTGMG

SEQ ID NO: 2408119 - protein, 5 aa, Entamoeba dispar
GVVKS

SEQ ID NO: 2408120 - protein, 8 aa, Entamoeba dispar
GWDRTSQL

SEQ ID NO: 2408121 - protein, 22 aa, Entamoeba dispar
GYAGISAEEIAKRKQTQSSEVL

SEQ ID NO: 2408122 - protein, 13 aa, Entamoeba dispar
GYPQYNQEERNHP

SEQ ID NO: 2408123 - protein, 5 aa, Entamoeba dispar
GYPTK

SEQ ID NO: 2408124 - protein, 4 aa, Entamoeba dispar
GYQN

SEQ ID NO: 2408125 - protein, 10 aa, Entamoeba dispar
GYREKDEEGK

SEQ ID NO: 2408126 - protein, 7 aa, Entamoeba dispar
GYSTESV

SEQ ID NO: 2408127 - protein, 6 aa, Entamoeba dispar
GYTPNE

SEQ ID NO: 2408128 - protein, 8 aa, Entamoeba dispar
HADSSFSY

SEQ ID NO: 2408129 - protein, 6 aa, Entamoeba dispar
HAEEAK

SEQ ID NO: 2408130 - protein, 7 aa, Entamoeba dispar
HAEEAKV

SEQ ID NO: 2408131 - protein, 12 aa, Entamoeba dispar
HAEEKKAQGNEM

SEQ ID NO: 2408132 - protein, 6 aa, Entamoeba dispar
HAEHKK

SEQ ID NO: 2408133 - protein, 5 aa, Entamoeba dispar
HAGEG

SEQ ID NO: 2408134 - protein, 7 aa, Entamoeba dispar
HANDSSQ

SEQ ID NO: 2408135 - protein, 5 aa, Entamoeba dispar
HCGCG

SEQ ID NO: 2408136 - protein, 15 aa, Entamoeba dispar
HDDRELARKELNKPK

SEQ ID NO: 2408137 - protein, 8 aa, Entamoeba dispar
HDDTQMDS

SEQ ID NO: 2408138 - protein, 6 aa, Entamoeba dispar
HDEQKQ

SEQ ID NO: 2408139 - protein, 4 aa, Entamoeba dispar
HDGP

SEQ ID NO: 2408140 - protein, 8 aa, Entamoeba dispar
HDNRVTER

SEQ ID NO: 2408141 - protein, 4 aa, Entamoeba dispar
HDNS

SEQ ID NO: 2408142 - protein, 8 aa, Entamoeba dispar
HDPNGDDL

SEQ ID NO: 2408143 - protein, 6 aa, Entamoeba dispar
HDSNIK

SEQ ID NO: 2408144 - protein, 9 aa, Entamoeba dispar
HDSNNGFNP

SEQ ID NO: 2408145 - protein, 27 aa, Entamoeba dispar
HEEKEQLKEKEVEEEIETSPIQEDTDE

SEQ ID NO: 2408146 - protein, 5 aa, Entamoeba dispar
HEKEG

SEQ ID NO: 2408147 - protein, 6 aa, Entamoeba dispar
HERNLN

SEQ ID NO: 2408148 - protein, 6 aa, Entamoeba dispar
HESPEA

SEQ ID NO: 2408149 - protein, 8 aa, Entamoeba dispar
HKDGTQQK

SEQ ID NO: 2408150 - protein, 8 aa, Entamoeba dispar
HKDKNEPI

SEQ ID NO: 2408151 - protein, 33 aa, Entamoeba dispar
HKEGINKRKGYYYSEQQSKGIEKDKKEIKEKEV

SEQ ID NO: 2408152 - protein, 5 aa, Entamoeba dispar
HKEQG

SEQ ID NO: 2408153 - protein, 14 aa, Entamoeba dispar
HKKDETPKATEKKP

SEQ ID NO: 2408154 - protein, 20 aa, Entamoeba dispar
HKMPKKKKEQLIKHSKRNQT

SEQ ID NO: 2408155 - protein, 28 aa, Entamoeba dispar
HKNQESTSTESIDLNDDTKEEDMDNDEL

SEQ ID NO: 2408156 - protein, 8 aa, Entamoeba dispar
HKQETIRS

SEQ ID NO: 2408157 - protein, 17 aa, Entamoeba dispar
HKSKYKFSNDDKSITKN

SEQ ID NO: 2408158 - protein, 6 aa, Entamoeba dispar
HKTEFS

SEQ ID NO: 2408159 - protein, 11 aa, Entamoeba dispar
HKVEDDEDNIK

SEQ ID NO: 2408160 - protein, 16 aa, Entamoeba dispar
HLGTHKRGLAKRDEIQ

SEQ ID NO: 2408161 - protein, 5 aa, Entamoeba dispar
HLPTE

SEQ ID NO: 2408162 - protein, 7 aa, Entamoeba dispar
HMSREEA

SEQ ID NO: 2408163 - protein, 4 aa, Entamoeba dispar
HNGH

SEQ ID NO: 2408164 - protein, 8 aa, Entamoeba dispar
HNKPEVEL

SEQ ID NO: 2408165 - protein, 11 aa, Entamoeba dispar
HNPAKDKRTTV

SEQ ID NO: 2408166 - protein, 4 aa, Entamoeba dispar
HNPE

SEQ ID NO: 2408167 - protein, 9 aa, Entamoeba dispar
HNSEKKKIN

SEQ ID NO: 2408168 - protein, 7 aa, Entamoeba dispar
HNSNYSR

SEQ ID NO: 2408169 - protein, 5 aa, Entamoeba dispar
HNTNV

SEQ ID NO: 2408170 - protein, 19 aa, Entamoeba dispar
HPATVKEEEESEEEKERAF

SEQ ID NO: 2408171 - protein, 6 aa, Entamoeba dispar
HPEERG

SEQ ID NO: 2408172 - protein, 6 aa, Entamoeba dispar
HPEETA

SEQ ID NO: 2408173 - protein, 7 aa, Entamoeba dispar
HPNDNTA

SEQ ID NO: 2408174 - protein, 4 aa, Entamoeba dispar
HPNE

SEQ ID NO: 2408175 - protein, 5 aa, Entamoeba dispar
HPNYP

SEQ ID NO: 2408176 - protein, 5 aa, Entamoeba dispar
HQLPS

SEQ ID NO: 2408177 - protein, 18 aa, Entamoeba dispar
HQRGGTILGTSRGAQDPK

SEQ ID NO: 2408178 - protein, 4 aa, Entamoeba dispar
HQYE

SEQ ID NO: 2408179 - protein, 16 aa, Entamoeba dispar
HREVTQKEALAKGQNY

SEQ ID NO: 2408180 - protein, 8 aa, Entamoeba dispar
HRGRTAAQ

SEQ ID NO: 2408181 - protein, 7 aa, Entamoeba dispar
HRLKGKT

SEQ ID NO: 2408182 - protein, 4 aa, Entamoeba dispar
HRSR

SEQ ID NO: 2408183 - protein, 23 aa, Entamoeba dispar
HSAESFDNDLTSISKSLSELTSR

SEQ ID NO: 2408184 - protein, 8 aa, Entamoeba dispar
HSDGTKQS

SEQ ID NO: 2408185 - protein, 8 aa, Entamoeba dispar
HSDGTQQT

SEQ ID NO: 2408186 - protein, 8 aa, Entamoeba dispar
HSDGTRQT

SEQ ID NO: 2408187 - protein, 9 aa, Entamoeba dispar
HSEKERRKL

SEQ ID NO: 2408188 - protein, 8 aa, Entamoeba dispar
HSKKGDSL

SEQ ID NO: 2408189 - protein, 4 aa, Entamoeba dispar
HSKM

SEQ ID NO: 2408190 - protein, 4 aa, Entamoeba dispar
HSKR

SEQ ID NO: 2408191 - protein, 7 aa, Entamoeba dispar
HSRKPDW

SEQ ID NO: 2408192 - protein, 6 aa, Entamoeba dispar
HSSSQD

SEQ ID NO: 2408193 - protein, 7 aa, Entamoeba dispar
HSTGKMG

SEQ ID NO: 2408194 - protein, 4 aa, Entamoeba dispar
HTST

SEQ ID NO: 2408195 - protein, 6 aa, Entamoeba dispar
HVSEDA

SEQ ID NO: 2408196 - protein, 12 aa, Entamoeba dispar
HYEKEEKEFKQF

SEQ ID NO: 2408197 - protein, 6 aa, Entamoeba dispar
HYNEQK

SEQ ID NO: 2408198 - protein, 4 aa, Entamoeba dispar
HYRS

SEQ ID NO: 2408199 - protein, 37 aa, Entamoeba dispar
IADDRKRKISLTESMKEPKTKKTAEEMLQEKLKGNSL

SEQ ID NO: 2408200 - protein, 5 aa, Entamoeba dispar
IAGIG

SEQ ID NO: 2408201 - protein, 8 aa, Entamoeba dispar
IAGPTNNL

SEQ ID NO: 2408202 - protein, 11 aa, Entamoeba dispar
IAPTHSTYETI

SEQ ID NO: 2408203 - protein, 7 aa, Entamoeba dispar
IAQPTPL

SEQ ID NO: 2408204 - protein, 24 aa, Entamoeba dispar
IASEKEKHESQIKLNESAKPYYER

SEQ ID NO: 2408205 - protein, 5 aa, Entamoeba dispar
IASGA

SEQ ID NO: 2408206 - protein, 7 aa, Entamoeba dispar
IATGKTT

SEQ ID NO: 2408207 - protein, 7 aa, Entamoeba dispar
IATLGSD

SEQ ID NO: 2408208 - protein, 13 aa, Entamoeba dispar
IATSNEQQTNDNL

SEQ ID NO: 2408209 - protein, 10 aa, Entamoeba dispar
IAVTPDNGIP

SEQ ID NO: 2408210 - protein, 4 aa, Entamoeba dispar
IDDN

SEQ ID NO: 2408211 - protein, 12 aa, Entamoeba dispar
IDDTGTDPVPHY

SEQ ID NO: 2408212 - protein, 5 aa, Entamoeba dispar
IDEDS

SEQ ID NO: 2408213 - protein, 6 aa, Entamoeba dispar
IDEETK

SEQ ID NO: 2408214 - protein, 17 aa, Entamoeba dispar
IDEMDKADEENRKKSLA

SEQ ID NO: 2408215 - protein, 10 aa, Entamoeba dispar
IDEPEKSDLK

SEQ ID NO: 2408216 - protein, 9 aa, Entamoeba dispar
IDGKKNNVQ

SEQ ID NO: 2408217 - protein, 6 aa, Entamoeba dispar
IDGTSN

SEQ ID NO: 2408218 - protein, 13 aa, Entamoeba dispar
IDKFKNKKAAIDG

SEQ ID NO: 2408219 - protein, 27 aa, Entamoeba dispar
IDNNEMEEEDVNIQQKAAKIAREYETW

SEQ ID NO: 2408220 - protein, 7 aa, Entamoeba dispar
IDNPTSY

SEQ ID NO: 2408221 - protein, 14 aa, Entamoeba dispar
IDPDYVPPKDDPRR

SEQ ID NO: 2408222 - protein, 5 aa, Entamoeba dispar
IDPKY

SEQ ID NO: 2408223 - protein, 22 aa, Entamoeba dispar
IDPNETVESSAKRELKEETGYV

SEQ ID NO: 2408224 - protein, 15 aa, Entamoeba dispar
IDPNNKEVKAEMNGI

SEQ ID NO: 2408225 - protein, 9 aa, Entamoeba dispar
IDSCVSSKQ

SEQ ID NO: 2408226 - protein, 19 aa, Entamoeba dispar
IDSDTEKKIKENEAKSRAE

SEQ ID NO: 2408227 - protein, 5 aa, Entamoeba dispar
IDTIG

SEQ ID NO: 2408228 - protein, 11 aa, Entamoeba dispar
IEATSTRLTYT

SEQ ID NO: 2408229 - protein, 11 aa, Entamoeba dispar
IEDKETAKKEL

SEQ ID NO: 2408230 - protein, 19 aa, Entamoeba dispar
IEEDNEKEKSEDSEKEDLS

SEQ ID NO: 2408231 - protein, 6 aa, Entamoeba dispar
IEEEEK

SEQ ID NO: 2408232 - protein, 4 aa, Entamoeba dispar
IEEG

SEQ ID NO: 2408233 - protein, 5 aa, Entamoeba dispar
IEEKE

SEQ ID NO: 2408234 - protein, 8 aa, Entamoeba dispar
IEEKGRQG

SEQ ID NO: 2408235 - protein, 10 aa, Entamoeba dispar
IEELSKDEVG

SEQ ID NO: 2408236 - protein, 6 aa, Entamoeba dispar
IEENPG

SEQ ID NO: 2408237 - protein, 10 aa, Entamoeba dispar
IEESIPGYYE

SEQ ID NO: 2408238 - protein, 15 aa, Entamoeba dispar
IEETPSKRVVTDDHE

SEQ ID NO: 2408239 - protein, 5 aa, Entamoeba dispar
IEGIG

SEQ ID NO: 2408240 - protein, 5 aa, Entamoeba dispar
IEGRT

SEQ ID NO: 2408241 - protein, 10 aa, Entamoeba dispar
IEHSGTISYG

SEQ ID NO: 2408242 - protein, 6 aa, Entamoeba dispar
IEKDEE

SEQ ID NO: 2408243 - protein, 8 aa, Entamoeba dispar
IEKEDEEQ

SEQ ID NO: 2408244 - protein, 7 aa, Entamoeba dispar
IEKEETV

SEQ ID NO: 2408245 - protein, 13 aa, Entamoeba dispar
IEKEGLKQVNEEV

SEQ ID NO: 2408246 - protein, 5 aa, Entamoeba dispar
IEKEY

SEQ ID NO: 2408247 - protein, 8 aa, Entamoeba dispar
IEKNEQEN

SEQ ID NO: 2408248 - protein, 6 aa, Entamoeba dispar
IEKNST

SEQ ID NO: 2408249 - protein, 11 aa, Entamoeba dispar
IEKSTKSVDEI

SEQ ID NO: 2408250 - protein, 11 aa, Entamoeba dispar
IENDKTKVKTL

SEQ ID NO: 2408251 - protein, 14 aa, Entamoeba dispar
IENGTQLPAHAKEG

SEQ ID NO: 2408252 - protein, 24 aa, Entamoeba dispar
IENKQKTPKIESIQEPKPLPHTET

SEQ ID NO: 2408253 - protein, 12 aa, Entamoeba dispar
IENNDDPNNPHI

SEQ ID NO: 2408254 - protein, 9 aa, Entamoeba dispar
IEPEKKDDD

SEQ ID NO: 2408255 - protein, 8 aa, Entamoeba dispar
IEPNPAHE

SEQ ID NO: 2408256 - protein, 5 aa, Entamoeba dispar
IEQKD

SEQ ID NO: 2408257 - protein, 8 aa, Entamoeba dispar
IEQTDKGV

SEQ ID NO: 2408258 - protein, 5 aa, Entamoeba dispar
IERKN

SEQ ID NO: 2408259 - protein, 19 aa, Entamoeba dispar
IESDINSDVTIENSENIAL

SEQ ID NO: 2408260 - protein, 4 aa, Entamoeba dispar
IETA

SEQ ID NO: 2408261 - protein, 10 aa, Entamoeba dispar
IEVKEEQKQL

SEQ ID NO: 2408262 - protein, 7 aa, Entamoeba dispar
IGDHSKV

SEQ ID NO: 2408263 - protein, 8 aa, Entamoeba dispar
IGDKRNDH

SEQ ID NO: 2408264 - protein, 8 aa, Entamoeba dispar
IGGSGEYS

SEQ ID NO: 2408265 - protein, 5 aa, Entamoeba dispar
IGKEQ

SEQ ID NO: 2408266 - protein, 6 aa, Entamoeba dispar
IGKEQI

SEQ ID NO: 2408267 - protein, 4 aa, Entamoeba dispar
IGKG

SEQ ID NO: 2408268 - protein, 5 aa, Entamoeba dispar
IGKGA

SEQ ID NO: 2408269 - protein, 8 aa, Entamoeba dispar
IGKPVGQY

SEQ ID NO: 2408270 - protein, 14 aa, Entamoeba dispar
IGNKKAENESNGGC

SEQ ID NO: 2408271 - protein, 10 aa, Entamoeba dispar
IGNTTEKKSI

SEQ ID NO: 2408272 - protein, 6 aa, Entamoeba dispar
IGQKKE

SEQ ID NO: 2408273 - protein, 13 aa, Entamoeba dispar
IGRDESDVSYDDR

SEQ ID NO: 2408274 - protein, 6 aa, Entamoeba dispar
IGTNPE

SEQ ID NO: 2408275 - protein, 8 aa, Entamoeba dispar
IGTQQPSI

SEQ ID NO: 2408276 - protein, 16 aa, Entamoeba dispar
IGTTGKRGDLYLIIKF

SEQ ID NO: 2408277 - protein, 12 aa, Entamoeba dispar
IIGEEARRSSQG

SEQ ID NO: 2408278 - protein, 7 aa, Entamoeba dispar
IINPNSQ

SEQ ID NO: 2408279 - protein, 6 aa, Entamoeba dispar
IISDAD

SEQ ID NO: 2408280 - protein, 7 aa, Entamoeba dispar
IKAFTKT

SEQ ID NO: 2408281 - protein, 15 aa, Entamoeba dispar
IKAGESTIISTSSGE

SEQ ID NO: 2408282 - protein, 9 aa, Entamoeba dispar
IKAKKSVSL

SEQ ID NO: 2408283 - protein, 22 aa, Entamoeba dispar
IKARENQQSRAFAQYKNDEHKL

SEQ ID NO: 2408284 - protein, 12 aa, Entamoeba dispar
IKASTPRVRHQR

SEQ ID NO: 2408285 - protein, 15 aa, Entamoeba dispar
IKDPDEGTPNSISPF

SEQ ID NO: 2408286 - protein, 17 aa, Entamoeba dispar
IKDTMKTVKKEKDAEKM

SEQ ID NO: 2408287 - protein, 4 aa, Entamoeba dispar
IKED

SEQ ID NO: 2408288 - protein, 4 aa, Entamoeba dispar
IKEE

SEQ ID NO: 2408289 - protein, 14 aa, Entamoeba dispar
IKEEEQQKHGNEIP

SEQ ID NO: 2408290 - protein, 15 aa, Entamoeba dispar
IKEENEKTSKELKGH

SEQ ID NO: 2408291 - protein, 7 aa, Entamoeba dispar
IKEGKNA

SEQ ID NO: 2408292 - protein, 4 aa, Entamoeba dispar
IKEI

SEQ ID NO: 2408293 - protein, 10 aa, Entamoeba dispar
IKEIGSQREV

SEQ ID NO: 2408294 - protein, 7 aa, Entamoeba dispar
IKEQKPI

SEQ ID NO: 2408295 - protein, 9 aa, Entamoeba dispar
IKESEKIKE

SEQ ID NO: 2408296 - protein, 26 aa, Entamoeba dispar
IKGETQISTRLDPDEIKEEHKIGEGS

SEQ ID NO: 2408297 - protein, 26 aa, Entamoeba dispar
IKGETQISTRLDPDEIKEENKIGEGS

SEQ ID NO: 2408298 - protein, 8 aa, Entamoeba dispar
IKGNVSGL

SEQ ID NO: 2408299 - protein, 4 aa, Entamoeba dispar
IKIN

SEQ ID NO: 2408300 - protein, 11 aa, Entamoeba dispar
IKIQTKEDQIA

SEQ ID NO: 2408301 - protein, 7 aa, Entamoeba dispar
IKKEELK

SEQ ID NO: 2408302 - protein, 12 aa, Entamoeba dispar
IKKGKKCINQDT

SEQ ID NO: 2408303 - protein, 5 aa, Entamoeba dispar
IKKSQ

SEQ ID NO: 2408304 - protein, 10 aa, Entamoeba dispar
IKKSTTSMGE

SEQ ID NO: 2408305 - protein, 6 aa, Entamoeba dispar
IKPELN

SEQ ID NO: 2408306 - protein, 28 aa, Entamoeba dispar
IKPPNDENSGNTILEDGGDTRDTSFEDT

SEQ ID NO: 2408307 - protein, 7 aa, Entamoeba dispar
IKPPQIA

SEQ ID NO: 2408308 - protein, 4 aa, Entamoeba dispar
IKPQ

SEQ ID NO: 2408309 - protein, 8 aa, Entamoeba dispar
IKPTPQEL

SEQ ID NO: 2408310 - protein, 7 aa, Entamoeba dispar
IKQAAND

SEQ ID NO: 2408311 - protein, 8 aa, Entamoeba dispar
IKQEKEIK

SEQ ID NO: 2408312 - protein, 14 aa, Entamoeba dispar
IKQESGNSDTVDDL

SEQ ID NO: 2408313 - protein, 9 aa, Entamoeba dispar
IKQNKKQKI

SEQ ID NO: 2408314 - protein, 9 aa, Entamoeba dispar
IKQTETKSI

SEQ ID NO: 2408315 - protein, 4 aa, Entamoeba dispar
IKRI

SEQ ID NO: 2408316 - protein, 6 aa, Entamoeba dispar
IKRQNT

SEQ ID NO: 2408317 - protein, 6 aa, Entamoeba dispar
IKSAIG

SEQ ID NO: 2408318 - protein, 4 aa, Entamoeba dispar
IKSD

SEQ ID NO: 2408319 - protein, 5 aa, Entamoeba dispar
IKSEK

SEQ ID NO: 2408320 - protein, 20 aa, Entamoeba dispar
IKSESTTNIKKTKKKGINRK

SEQ ID NO: 2408321 - protein, 6 aa, Entamoeba dispar
IKSGAF

SEQ ID NO: 2408322 - protein, 14 aa, Entamoeba dispar
IKSKKISEEDKNYL

SEQ ID NO: 2408323 - protein, 9 aa, Entamoeba dispar
IKSNKMKLE

SEQ ID NO: 2408324 - protein, 25 aa, Entamoeba dispar
IKSRMNASYSNPSEVEFAFEERINN

SEQ ID NO: 2408325 - protein, 8 aa, Entamoeba dispar
IKSTNDNH

SEQ ID NO: 2408326 - protein, 7 aa, Entamoeba dispar
IKTQDES

SEQ ID NO: 2408327 - protein, 13 aa, Entamoeba dispar
IKTTGKKLAGIGG

SEQ ID NO: 2408328 - protein, 18 aa, Entamoeba dispar
IKTTNEEEQKKRQEEIDN

SEQ ID NO: 2408329 - protein, 6 aa, Entamoeba dispar
IKTTQD

SEQ ID NO: 2408330 - protein, 11 aa, Entamoeba dispar
IKTTSDFNINP

SEQ ID NO: 2408331 - protein, 12 aa, Entamoeba dispar
IKTTTEKEDELT

SEQ ID NO: 2408332 - protein, 12 aa, Entamoeba dispar
IKTTTEKEDEVT

SEQ ID NO: 2408333 - protein, 24 aa, Entamoeba dispar
IKVEETEEEKKEQEAKEKDNEELS

SEQ ID NO: 2408334 - protein, 32 aa, Entamoeba dispar
ILTTDNKNQSIVTNGSKEVMTKENQNSTQQLE

SEQ ID NO: 2408335 - protein, 10 aa, Entamoeba dispar
INAEDMTTKE

SEQ ID NO: 2408336 - protein, 58 aa, Entamoeba dispar
INDKQEKDEKEGNVCNEKESIHENIKQEENNKEKINTKTPTQTPSKSCSFGQKGQTSL

SEQ ID NO: 2408337 - protein, 10 aa, Entamoeba dispar
INDKRTSVFS

SEQ ID NO: 2408338 - protein, 4 aa, Entamoeba dispar
INDP

SEQ ID NO: 2408339 - protein, 4 aa, Entamoeba dispar
INDQ

SEQ ID NO: 2408340 - protein, 4 aa, Entamoeba dispar
INEE

SEQ ID NO: 2408341 - protein, 38 aa, Entamoeba dispar
INEEPKQEAKTEMGGVSHQEETPENKQNKNIKRQSSEL

SEQ ID NO: 2408342 - protein, 9 aa, Entamoeba dispar
INENEKELE

SEQ ID NO: 2408343 - protein, 16 aa, Entamoeba dispar
INERKTGNFEKRSREI

SEQ ID NO: 2408344 - protein, 9 aa, Entamoeba dispar
INGKEIRER

SEQ ID NO: 2408345 - protein, 12 aa, Entamoeba dispar
INGNQGNELKYR

SEQ ID NO: 2408346 - protein, 7 aa, Entamoeba dispar
INGNRMP

SEQ ID NO: 2408347 - protein, 9 aa, Entamoeba dispar
INIPSSISE

SEQ ID NO: 2408348 - protein, 10 aa, Entamoeba dispar
INIPSSISEI

SEQ ID NO: 2408349 - protein, 9 aa, Entamoeba dispar
INIPSSISK

SEQ ID NO: 2408350 - protein, 9 aa, Entamoeba dispar
INIPSSITS

SEQ ID NO: 2408351 - protein, 7 aa, Entamoeba dispar
INIPSSV

SEQ ID NO: 2408352 - protein, 9 aa, Entamoeba dispar
INIPSSVSE

SEQ ID NO: 2408353 - protein, 11 aa, Entamoeba dispar
INIPSSVSKIG

SEQ ID NO: 2408354 - protein, 8 aa, Entamoeba dispar
INKNEQNK

SEQ ID NO: 2408355 - protein, 10 aa, Entamoeba dispar
INKNSSNQHK

SEQ ID NO: 2408356 - protein, 5 aa, Entamoeba dispar
INKQS

SEQ ID NO: 2408357 - protein, 9 aa, Entamoeba dispar
INKTDYEKG

SEQ ID NO: 2408358 - protein, 19 aa, Entamoeba dispar
INKTKTRNDTLPKPPTNLD

SEQ ID NO: 2408359 - protein, 10 aa, Entamoeba dispar
INKTQSRKHS

SEQ ID NO: 2408360 - protein, 9 aa, Entamoeba dispar
INKYDEAEQ

SEQ ID NO: 2408361 - protein, 12 aa, Entamoeba dispar
INLPNPERQKRK

SEQ ID NO: 2408362 - protein, 7 aa, Entamoeba dispar
INNTEKR

SEQ ID NO: 2408363 - protein, 4 aa, Entamoeba dispar
INPE

SEQ ID NO: 2408364 - protein, 4 aa, Entamoeba dispar
INPI

SEQ ID NO: 2408365 - protein, 10 aa, Entamoeba dispar
INPKKDTQKV

SEQ ID NO: 2408366 - protein, 6 aa, Entamoeba dispar
INPPKF

SEQ ID NO: 2408367 - protein, 6 aa, Entamoeba dispar
INPSEI

SEQ ID NO: 2408368 - protein, 13 aa, Entamoeba dispar
INQQQKGSIPSLD

SEQ ID NO: 2408369 - protein, 13 aa, Entamoeba dispar
INRITTEEKEEKG

SEQ ID NO: 2408370 - protein, 6 aa, Entamoeba dispar
INRKET

SEQ ID NO: 2408371 - protein, 6 aa, Entamoeba dispar
INSQNA

SEQ ID NO: 2408372 - protein, 20 aa, Entamoeba dispar
INSQPATAVPGSSYASTARS

SEQ ID NO: 2408373 - protein, 6 aa, Entamoeba dispar
INTSEP

SEQ ID NO: 2408374 - protein, 7 aa, Entamoeba dispar
INYNTNE

SEQ ID NO: 2408375 - protein, 7 aa, Entamoeba dispar
IPASVSE

SEQ ID NO: 2408376 - protein, 14 aa, Entamoeba dispar
IPATPKYNEEKDNL

SEQ ID NO: 2408377 - protein, 8 aa, Entamoeba dispar
IPDFRSRN

SEQ ID NO: 2408378 - protein, 4 aa, Entamoeba dispar
IPED

SEQ ID NO: 2408379 - protein, 31 aa, Entamoeba dispar
IPKEKEKKEWEQREEKITKEFKKSNEEKRKE

SEQ ID NO: 2408380 - protein, 5 aa, Entamoeba dispar
IPKGE

SEQ ID NO: 2408381 - protein, 8 aa, Entamoeba dispar
IPKNSNKK

SEQ ID NO: 2408382 - protein, 9 aa, Entamoeba dispar
IPKQTSEKV

SEQ ID NO: 2408383 - protein, 6 aa, Entamoeba dispar
IPKTNN

SEQ ID NO: 2408384 - protein, 19 aa, Entamoeba dispar
IPNEVENEEPILEDDGQEL

SEQ ID NO: 2408385 - protein, 6 aa, Entamoeba dispar
IPPDGD

SEQ ID NO: 2408386 - protein, 6 aa, Entamoeba dispar
IPPPSI

SEQ ID NO: 2408387 - protein, 5 aa, Entamoeba dispar
IPPSI

SEQ ID NO: 2408388 - protein, 5 aa, Entamoeba dispar
IPPYL

SEQ ID NO: 2408389 - protein, 8 aa, Entamoeba dispar
IPQQNSGY

SEQ ID NO: 2408390 - protein, 9 aa, Entamoeba dispar
IPRDPAIKS

SEQ ID NO: 2408391 - protein, 5 aa, Entamoeba dispar
IPSAN

SEQ ID NO: 2408392 - protein, 15 aa, Entamoeba dispar
IPSDGHSGLYTTKSD

SEQ ID NO: 2408393 - protein, 6 aa, Entamoeba dispar
IPSKHS

SEQ ID NO: 2408394 - protein, 4 aa, Entamoeba dispar
IPSN

SEQ ID NO: 2408395 - protein, 8 aa, Entamoeba dispar
IPSSISEI

SEQ ID NO: 2408396 - protein, 8 aa, Entamoeba dispar
IPSSISKI

SEQ ID NO: 2408397 - protein, 5 aa, Entamoeba dispar
IPSSL

SEQ ID NO: 2408398 - protein, 6 aa, Entamoeba dispar
IPSSVN

SEQ ID NO: 2408399 - protein, 7 aa, Entamoeba dispar
IPSSVNE

SEQ ID NO: 2408400 - protein, 8 aa, Entamoeba dispar
IPSSVSKI

SEQ ID NO: 2408401 - protein, 11 aa, Entamoeba dispar
IPSSVSKIDDG

SEQ ID NO: 2408402 - protein, 9 aa, Entamoeba dispar
IPSSVSKIG

SEQ ID NO: 2408403 - protein, 8 aa, Entamoeba dispar
IPSTISKI

SEQ ID NO: 2408404 - protein, 10 aa, Entamoeba dispar
IPSTTSKIGE

SEQ ID NO: 2408405 - protein, 4 aa, Entamoeba dispar
IPSY

SEQ ID NO: 2408406 - protein, 6 aa, Entamoeba dispar
IPTPIT

SEQ ID NO: 2408407 - protein, 5 aa, Entamoeba dispar
IPTTI

SEQ ID NO: 2408408 - protein, 7 aa, Entamoeba dispar
IQDPTTN

SEQ ID NO: 2408409 - protein, 10 aa, Entamoeba dispar
IQEEKGYKSF

SEQ ID NO: 2408410 - protein, 12 aa, Entamoeba dispar
IQENEGKNNAVY

SEQ ID NO: 2408411 - protein, 4 aa, Entamoeba dispar
IQES

SEQ ID NO: 2408412 - protein, 11 aa, Entamoeba dispar
IQKKIEKKLDT

SEQ ID NO: 2408413 - protein, 13 aa, Entamoeba dispar
IQKRKEDFNDVVD

SEQ ID NO: 2408414 - protein, 8 aa, Entamoeba dispar
IQPESGEI

SEQ ID NO: 2408415 - protein, 14 aa, Entamoeba dispar
IQQEGGTTQTLPTA

SEQ ID NO: 2408416 - protein, 44 aa, Entamoeba dispar
IQRGSTKRKRVDDDEYEDENKYEKERDYEDESYEDEKEYEDEDI

SEQ ID NO: 2408417 - protein, 42 aa, Entamoeba dispar
IQRGTKLKKTTTVDKSAPAIGKSSSSSSSGMGGGMPSGGNPL

SEQ ID NO: 2408418 - protein, 6 aa, Entamoeba dispar
IQSIPE

SEQ ID NO: 2408419 - protein, 18 aa, Entamoeba dispar
IQSPSRQNNFPSFEQEEK

SEQ ID NO: 2408420 - protein, 9 aa, Entamoeba dispar
IQTAREKNE

SEQ ID NO: 2408421 - protein, 17 aa, Entamoeba dispar
IQTPSKAIQPSNEDTIG

SEQ ID NO: 2408422 - protein, 6 aa, Entamoeba dispar
IQVGSG

SEQ ID NO: 2408423 - protein, 4 aa, Entamoeba dispar
IRAE

SEQ ID NO: 2408424 - protein, 14 aa, Entamoeba dispar
IRDEETDKEKKPVR

SEQ ID NO: 2408425 - protein, 8 aa, Entamoeba dispar
IRGNEKCN

SEQ ID NO: 2408426 - protein, 5 aa, Entamoeba dispar
IRGRT

SEQ ID NO: 2408427 - protein, 9 aa, Entamoeba dispar
IRNEEDPGK

SEQ ID NO: 2408428 - protein, 10 aa, Entamoeba dispar
IRPRNDIDDI

SEQ ID NO: 2408429 - protein, 9 aa, Entamoeba dispar
IRRYETNKV

SEQ ID NO: 2408430 - protein, 13 aa, Entamoeba dispar
ISAQENTKFAGIQ

SEQ ID NO: 2408431 - protein, 9 aa, Entamoeba dispar
ISDATGKIK

SEQ ID NO: 2408432 - protein, 7 aa, Entamoeba dispar
ISDDNTS

SEQ ID NO: 2408433 - protein, 4 aa, Entamoeba dispar
ISDG

SEQ ID NO: 2408434 - protein, 6 aa, Entamoeba dispar
ISDKNS

SEQ ID NO: 2408435 - protein, 5 aa, Entamoeba dispar
ISEET

SEQ ID NO: 2408436 - protein, 4 aa, Entamoeba dispar
ISEI

SEQ ID NO: 2408437 - protein, 6 aa, Entamoeba dispar
ISEKKN

SEQ ID NO: 2408438 - protein, 7 aa, Entamoeba dispar
ISETNKG

SEQ ID NO: 2408439 - protein, 4 aa, Entamoeba dispar
ISGT

SEQ ID NO: 2408440 - protein, 11 aa, Entamoeba dispar
ISISQGSNPLI

SEQ ID NO: 2408441 - protein, 8 aa, Entamoeba dispar
ISKEPTRI

SEQ ID NO: 2408442 - protein, 9 aa, Entamoeba dispar
ISKNPSETI

SEQ ID NO: 2408443 - protein, 15 aa, Entamoeba dispar
ISNDEKNVKIRKENI

SEQ ID NO: 2408444 - protein, 15 aa, Entamoeba dispar
ISNDKKNVKIRKENI

SEQ ID NO: 2408445 - protein, 9 aa, Entamoeba dispar
ISNETPSDV

SEQ ID NO: 2408446 - protein, 4 aa, Entamoeba dispar
ISNN

SEQ ID NO: 2408447 - protein, 5 aa, Entamoeba dispar
ISPDM

SEQ ID NO: 2408448 - protein, 6 aa, Entamoeba dispar
ISPESQ

SEQ ID NO: 2408449 - protein, 20 aa, Entamoeba dispar
ISPSNTKVFDAPPKLRYNTS

SEQ ID NO: 2408450 - protein, 22 aa, Entamoeba dispar
ISQENDNKKSCKQEEEREIDKK

SEQ ID NO: 2408451 - protein, 46 aa, Entamoeba dispar
ISQQGKNKYITTQSGKKIKIASRDNSEEEESEDDPEELASRWTGGN

SEQ ID NO: 2408452 - protein, 6 aa, Entamoeba dispar
ISQTYH

SEQ ID NO: 2408453 - protein, 12 aa, Entamoeba dispar
ISSEEGEKLTNK

SEQ ID NO: 2408454 - protein, 8 aa, Entamoeba dispar
ISSKEEDT

SEQ ID NO: 2408455 - protein, 7 aa, Entamoeba dispar
ISSSPYK

SEQ ID NO: 2408456 - protein, 5 aa, Entamoeba dispar
ISTDF

SEQ ID NO: 2408457 - protein, 25 aa, Entamoeba dispar
ISTSTSEHKINDTKEHDKKYKKPVA

SEQ ID NO: 2408458 - protein, 4 aa, Entamoeba dispar
ITAS

SEQ ID NO: 2408459 - protein, 4 aa, Entamoeba dispar
ITEI

SEQ ID NO: 2408460 - protein, 10 aa, Entamoeba dispar
ITEKPRLAET

SEQ ID NO: 2408461 - protein, 4 aa, Entamoeba dispar
ITES

SEQ ID NO: 2408462 - protein, 11 aa, Entamoeba dispar
ITGPDDSPYQG

SEQ ID NO: 2408463 - protein, 5 aa, Entamoeba dispar
ITKDN

SEQ ID NO: 2408464 - protein, 17 aa, Entamoeba dispar
ITKKRRGEEKKIERIGS

SEQ ID NO: 2408465 - protein, 4 aa, Entamoeba dispar
ITLP

SEQ ID NO: 2408466 - protein, 8 aa, Entamoeba dispar
ITQKKPGM

SEQ ID NO: 2408467 - protein, 17 aa, Entamoeba dispar
ITRTQSTTIVKSPQSVD

SEQ ID NO: 2408468 - protein, 28 aa, Entamoeba dispar
ITSPKQKHIPSEPVHRTSKSYTNSLSSQ

SEQ ID NO: 2408469 - protein, 5 aa, Entamoeba dispar
ITSQE

SEQ ID NO: 2408470 - protein, 12 aa, Entamoeba dispar
ITSTNTSTSSYS

SEQ ID NO: 2408471 - protein, 18 aa, Entamoeba dispar
ITTEMSDTSSNNNTTSVG

SEQ ID NO: 2408472 - protein, 44 aa, Entamoeba dispar
ITTEMSDTSSNNNTTSVGSPCNTTTHNTSSNNTTTVPRKNVPIE

SEQ ID NO: 2408473 - protein, 24 aa, Entamoeba dispar
ITWTGGKKHPDPNYDNMSKYLRIS

SEQ ID NO: 2408474 - protein, 4 aa, Entamoeba dispar
ITYG

SEQ ID NO: 2408475 - protein, 5 aa, Entamoeba dispar
IVNPE

SEQ ID NO: 2408476 - protein, 15 aa, Entamoeba dispar
IVSQDDGKALADKYG

SEQ ID NO: 2408477 - protein, 5 aa, Entamoeba dispar
IYKGS

SEQ ID NO: 2408478 - protein, 7 aa, Entamoeba dispar
KAALGRA

SEQ ID NO: 2408479 - protein, 9 aa, Entamoeba dispar
KAASGKYTP

SEQ ID NO: 2408480 - protein, 8 aa, Entamoeba dispar
KAATSYEN

SEQ ID NO: 2408481 - protein, 4 aa, Entamoeba dispar
KADE

SEQ ID NO: 2408482 - protein, 9 aa, Entamoeba dispar
KAEAKNTWQ

SEQ ID NO: 2408483 - protein, 6 aa, Entamoeba dispar
KAEING

SEQ ID NO: 2408484 - protein, 10 aa, Entamoeba dispar
KAGRTTADGI

SEQ ID NO: 2408485 - protein, 13 aa, Entamoeba dispar
KAKAEELKKAIPK

SEQ ID NO: 2408486 - protein, 33 aa, Entamoeba dispar
KAKEEEKLKQKMEEMNKPKAAEPVYKEQTNEGE

SEQ ID NO: 2408487 - protein, 9 aa, Entamoeba dispar
KAKEELQNH

SEQ ID NO: 2408488 - protein, 6 aa, Entamoeba dispar
KAKSVE

SEQ ID NO: 2408489 - protein, 5 aa, Entamoeba dispar
KALKY

SEQ ID NO: 2408490 - protein, 6 aa, Entamoeba dispar
KANQPF

SEQ ID NO: 2408491 - protein, 7 aa, Entamoeba dispar
KAPTGRK

SEQ ID NO: 2408492 - protein, 57 aa, Entamoeba dispar
KAQEYRKPFGSKRGRKGGFNRRGAGRFGGRDRRYERRREEDWDNTRSISTPIKPHLF

SEQ ID NO: 2408493 - protein, 7 aa, Entamoeba dispar
KAQKEQI

SEQ ID NO: 2408494 - protein, 11 aa, Entamoeba dispar
KARNAEYNPKR

SEQ ID NO: 2408495 - protein, 6 aa, Entamoeba dispar
KARNEI

SEQ ID NO: 2408496 - protein, 9 aa, Entamoeba dispar
KASAPKSKI

SEQ ID NO: 2408497 - protein, 10 aa, Entamoeba dispar
KASSAASAAK

SEQ ID NO: 2408498 - protein, 5 aa, Entamoeba dispar
KASSS

SEQ ID NO: 2408499 - protein, 15 aa, Entamoeba dispar
KASTQKSKEEIKAEI

SEQ ID NO: 2408500 - protein, 7 aa, Entamoeba dispar
KATGGDV

SEQ ID NO: 2408501 - protein, 16 aa, Entamoeba dispar
KATGKAVGIRGKGHCT

SEQ ID NO: 2408502 - protein, 5 aa, Entamoeba dispar
KAVEG

SEQ ID NO: 2408503 - protein, 15 aa, Entamoeba dispar
KAYAQTKDAAKAKEL

SEQ ID NO: 2408504 - protein, 8 aa, Entamoeba dispar
KAYSRQQI

SEQ ID NO: 2408505 - protein, 8 aa, Entamoeba dispar
KCYDSEES

SEQ ID NO: 2408506 - protein, 7 aa, Entamoeba dispar
KDAGSLM

SEQ ID NO: 2408507 - protein, 13 aa, Entamoeba dispar
KDAQQQIERSASH

SEQ ID NO: 2408508 - protein, 4 aa, Entamoeba dispar
KDDI

SEQ ID NO: 2408509 - protein, 24 aa, Entamoeba dispar
KDDNKLESEETKKTEKKERRKSLS

SEQ ID NO: 2408510 - protein, 8 aa, Entamoeba dispar
KDDVKGKE

SEQ ID NO: 2408511 - protein, 8 aa, Entamoeba dispar
KDEEFDDR

SEQ ID NO: 2408512 - protein, 27 aa, Entamoeba dispar
KDEEKEVNQINQPKENNKKGHRTKEYE

SEQ ID NO: 2408513 - protein, 9 aa, Entamoeba dispar
KDEERKATI

SEQ ID NO: 2408514 - protein, 6 aa, Entamoeba dispar
KDEHTQ

SEQ ID NO: 2408515 - protein, 7 aa, Entamoeba dispar
KDETEEI

SEQ ID NO: 2408516 - protein, 5 aa, Entamoeba dispar
KDEVY

SEQ ID NO: 2408517 - protein, 4 aa, Entamoeba dispar
KDFD

SEQ ID NO: 2408518 - protein, 8 aa, Entamoeba dispar
KDFKPQQV

SEQ ID NO: 2408519 - protein, 7 aa, Entamoeba dispar
KDGENIA

SEQ ID NO: 2408520 - protein, 10 aa, Entamoeba dispar
KDGQKKMHGS

SEQ ID NO: 2408521 - protein, 7 aa, Entamoeba dispar
KDGTKNL

SEQ ID NO: 2408522 - protein, 8 aa, Entamoeba dispar
KDIDEEEK

SEQ ID NO: 2408523 - protein, 10 aa, Entamoeba dispar
KDINDISGTI

SEQ ID NO: 2408524 - protein, 13 aa, Entamoeba dispar
KDIQKSKLKQEEI

SEQ ID NO: 2408525 - protein, 10 aa, Entamoeba dispar
KDKIDDAKKT

SEQ ID NO: 2408526 - protein, 10 aa, Entamoeba dispar
KDKKRKKELE

SEQ ID NO: 2408527 - protein, 6 aa, Entamoeba dispar
KDKPYE

SEQ ID NO: 2408528 - protein, 4 aa, Entamoeba dispar
KDLS

SEQ ID NO: 2408529 - protein, 15 aa, Entamoeba dispar
KDMPEEQDSIDDNPI

SEQ ID NO: 2408530 - protein, 66 aa, Entamoeba dispar
KDNEEEEESDEEPKSKETKEKEVKEENKKGKEIGSTEEEKKENKKVLSKREIEKKKMKEMEERRRE

SEQ ID NO: 2408531 - protein, 16 aa, Entamoeba dispar
KDNETTEKKEETPNPS

SEQ ID NO: 2408532 - protein, 7 aa, Entamoeba dispar
KDNNHEL

SEQ ID NO: 2408533 - protein, 6 aa, Entamoeba dispar
KDNNTY

SEQ ID NO: 2408534 - protein, 5 aa, Entamoeba dispar
KDNTV

SEQ ID NO: 2408535 - protein, 4 aa, Entamoeba dispar
KDPD

SEQ ID NO: 2408536 - protein, 6 aa, Entamoeba dispar
KDPHSI

SEQ ID NO: 2408537 - protein, 9 aa, Entamoeba dispar
KDPKNPKYN

SEQ ID NO: 2408538 - protein, 7 aa, Entamoeba dispar
KDPTRLQ

SEQ ID NO: 2408539 - protein, 11 aa, Entamoeba dispar
KDQDGGEGQIG

SEQ ID NO: 2408540 - protein, 10 aa, Entamoeba dispar
KDQNGKCNNN

SEQ ID NO: 2408541 - protein, 6 aa, Entamoeba dispar
KDQTEL

SEQ ID NO: 2408542 - protein, 9 aa, Entamoeba dispar
KDSQLDPNV

SEQ ID NO: 2408543 - protein, 6 aa, Entamoeba dispar
KDSTWT

SEQ ID NO: 2408544 - protein, 6 aa, Entamoeba dispar
KDSVYS

SEQ ID NO: 2408545 - protein, 10 aa, Entamoeba dispar
KDTGKDYEGL

SEQ ID NO: 2408546 - protein, 14 aa, Entamoeba dispar
KDTSEIIKKSTKNS

SEQ ID NO: 2408547 - protein, 7 aa, Entamoeba dispar
KDVERKE

SEQ ID NO: 2408548 - protein, 5 aa, Entamoeba dispar
KDVND

SEQ ID NO: 2408549 - protein, 6 aa, Entamoeba dispar
KDVNEE

SEQ ID NO: 2408550 - protein, 7 aa, Entamoeba dispar
KDYDDID

SEQ ID NO: 2408551 - protein, 6 aa, Entamoeba dispar
KDYEDI

SEQ ID NO: 2408552 - protein, 17 aa, Entamoeba dispar
KEAEELKKQIEQTNNEL

SEQ ID NO: 2408553 - protein, 5 aa, Entamoeba dispar
KEAIS

SEQ ID NO: 2408554 - protein, 6 aa, Entamoeba dispar
KEAKYR

SEQ ID NO: 2408555 - protein, 4 aa, Entamoeba dispar
KECG

SEQ ID NO: 2408556 - protein, 17 aa, Entamoeba dispar
KEDASSNFAKGKTGYEP

SEQ ID NO: 2408557 - protein, 4 aa, Entamoeba dispar
KEDN

SEQ ID NO: 2408558 - protein, 11 aa, Entamoeba dispar
KEDNTKKAYEW

SEQ ID NO: 2408559 - protein, 13 aa, Entamoeba dispar
KEDRSILKPQFLK

SEQ ID NO: 2408560 - protein, 6 aa, Entamoeba dispar
KEECET

SEQ ID NO: 2408561 - protein, 5 aa, Entamoeba dispar
KEECI

SEQ ID NO: 2408562 - protein, 4 aa, Entamoeba dispar
KEEE

SEQ ID NO: 2408563 - protein, 6 aa, Entamoeba dispar
KEEEEK

SEQ ID NO: 2408564 - protein, 10 aa, Entamoeba dispar
KEEEKKINEE

SEQ ID NO: 2408565 - protein, 11 aa, Entamoeba dispar
KEEEKKINEEI

SEQ ID NO: 2408566 - protein, 6 aa, Entamoeba dispar
KEEENG

SEQ ID NO: 2408567 - protein, 6 aa, Entamoeba dispar
KEEENK

SEQ ID NO: 2408568 - protein, 5 aa, Entamoeba dispar
KEEGN

SEQ ID NO: 2408569 - protein, 4 aa, Entamoeba dispar
KEEI

SEQ ID NO: 2408570 - protein, 6 aa, Entamoeba dispar
KEEKYT

SEQ ID NO: 2408571 - protein, 17 aa, Entamoeba dispar
KEELKKNKRIPRNCFEW

SEQ ID NO: 2408572 - protein, 5 aa, Entamoeba dispar
KEERI

SEQ ID NO: 2408573 - protein, 21 aa, Entamoeba dispar
KEESAKEAKEELNGTTYGGTT

SEQ ID NO: 2408574 - protein, 21 aa, Entamoeba dispar
KEESTLASLSSELDKKYELPD

SEQ ID NO: 2408575 - protein, 5 aa, Entamoeba dispar
KEFDR

SEQ ID NO: 2408576 - protein, 6 aa, Entamoeba dispar
KEFEKK

SEQ ID NO: 2408577 - protein, 6 aa, Entamoeba dispar
KEGEKI

SEQ ID NO: 2408578 - protein, 4 aa, Entamoeba dispar
KEGI

SEQ ID NO: 2408579 - protein, 5 aa, Entamoeba dispar
KEGNC

SEQ ID NO: 2408580 - protein, 5 aa, Entamoeba dispar
KEGQP

SEQ ID NO: 2408581 - protein, 5 aa, Entamoeba dispar
KEGSH

SEQ ID NO: 2408582 - protein, 8 aa, Entamoeba dispar
KEGTKNSY

SEQ ID NO: 2408583 - protein, 15 aa, Entamoeba dispar
KEIAKTRTFGSTNKS

SEQ ID NO: 2408584 - protein, 23 aa, Entamoeba dispar
KEIEDRTDSLFDKGSSSKEKDSW

SEQ ID NO: 2408585 - protein, 13 aa, Entamoeba dispar
KEIERTETEYKTV

SEQ ID NO: 2408586 - protein, 9 aa, Entamoeba dispar
KEIGKDDNE

SEQ ID NO: 2408587 - protein, 4 aa, Entamoeba dispar
KEIK

SEQ ID NO: 2408588 - protein, 20 aa, Entamoeba dispar
KEIKPMDDDEEDEKNRKRYR

SEQ ID NO: 2408589 - protein, 4 aa, Entamoeba dispar
KEIS

SEQ ID NO: 2408590 - protein, 6 aa, Entamoeba dispar
KEITKQ

SEQ ID NO: 2408591 - protein, 9 aa, Entamoeba dispar
KEITTSEDI

SEQ ID NO: 2408592 - protein, 7 aa, Entamoeba dispar
KEKAVTL

SEQ ID NO: 2408593 - protein, 30 aa, Entamoeba dispar
KEKEAGNSCKNIEYTKEDRNKYGNTIPPEV

SEQ ID NO: 2408594 - protein, 10 aa, Entamoeba dispar
KEKEDKKELK

SEQ ID NO: 2408595 - protein, 10 aa, Entamoeba dispar
KEKEDKKEVK

SEQ ID NO: 2408596 - protein, 22 aa, Entamoeba dispar
KEKEDKKGTRIKQKDKKVTTVQ

SEQ ID NO: 2408597 - protein, 8 aa, Entamoeba dispar
KEKEEAIK

SEQ ID NO: 2408598 - protein, 9 aa, Entamoeba dispar
KEKEEGNEC

SEQ ID NO: 2408599 - protein, 8 aa, Entamoeba dispar
KEKEIEDE

SEQ ID NO: 2408600 - protein, 9 aa, Entamoeba dispar
KEKEQGNEC

SEQ ID NO: 2408601 - protein, 4 aa, Entamoeba dispar
KEKG

SEQ ID NO: 2408602 - protein, 5 aa, Entamoeba dispar
KEKGI

SEQ ID NO: 2408603 - protein, 7 aa, Entamoeba dispar
KEKGYTR

SEQ ID NO: 2408604 - protein, 10 aa, Entamoeba dispar
KEKKEQRPGY

SEQ ID NO: 2408605 - protein, 5 aa, Entamoeba dispar
KEKKH

SEQ ID NO: 2408606 - protein, 5 aa, Entamoeba dispar
KEKQC

SEQ ID NO: 2408607 - protein, 10 aa, Entamoeba dispar
KEKQENEKHL

SEQ ID NO: 2408608 - protein, 7 aa, Entamoeba dispar
KEKSSYD

SEQ ID NO: 2408609 - protein, 4 aa, Entamoeba dispar
KEKT

SEQ ID NO: 2408610 - protein, 8 aa, Entamoeba dispar
KEKTGDKA

SEQ ID NO: 2408611 - protein, 4 aa, Entamoeba dispar
KEKY

SEQ ID NO: 2408612 - protein, 11 aa, Entamoeba dispar
KELEKNNNLSK

SEQ ID NO: 2408613 - protein, 9 aa, Entamoeba dispar
KELNNQSTQ

SEQ ID NO: 2408614 - protein, 9 aa, Entamoeba dispar
KELQTKDLS

SEQ ID NO: 2408615 - protein, 13 aa, Entamoeba dispar
KELRKESEEGFKK

SEQ ID NO: 2408616 - protein, 5 aa, Entamoeba dispar
KELSE

SEQ ID NO: 2408617 - protein, 4 aa, Entamoeba dispar
KELT

SEQ ID NO: 2408618 - protein, 12 aa, Entamoeba dispar
KEMENGVTKEYY

SEQ ID NO: 2408619 - protein, 4 aa, Entamoeba dispar
KEMK

SEQ ID NO: 2408620 - protein, 5 aa, Entamoeba dispar
KEMKE

SEQ ID NO: 2408621 - protein, 5 aa, Entamoeba dispar
KENDI

SEQ ID NO: 2408622 - protein, 12 aa, Entamoeba dispar
KENEEKIEGGKI

SEQ ID NO: 2408623 - protein, 4 aa, Entamoeba dispar
KENI

SEQ ID NO: 2408624 - protein, 7 aa, Entamoeba dispar
KENIAKN

SEQ ID NO: 2408625 - protein, 6 aa, Entamoeba dispar
KENIGS

SEQ ID NO: 2408626 - protein, 8 aa, Entamoeba dispar
KENKSSVE

SEQ ID NO: 2408627 - protein, 10 aa, Entamoeba dispar
KENTKEKSVE

SEQ ID NO: 2408628 - protein, 5 aa, Entamoeba dispar
KEPTE

SEQ ID NO: 2408629 - protein, 5 aa, Entamoeba dispar
KEPYD

SEQ ID NO: 2408630 - protein, 22 aa, Entamoeba dispar
KEQEERKEEKKEEKEEKYEPSR

SEQ ID NO: 2408631 - protein, 6 aa, Entamoeba dispar
KEQGNI

SEQ ID NO: 2408632 - protein, 6 aa, Entamoeba dispar
KEQSWD

SEQ ID NO: 2408633 - protein, 4 aa, Entamoeba dispar
KERD

SEQ ID NO: 2408634 - protein, 6 aa, Entamoeba dispar
KEREGK

SEQ ID NO: 2408635 - protein, 7 aa, Entamoeba dispar
KEREVSA

SEQ ID NO: 2408636 - protein, 6 aa, Entamoeba dispar
KERITE

SEQ ID NO: 2408637 - protein, 21 aa, Entamoeba dispar
KERKREAKKLKELKPEQRHPK

SEQ ID NO: 2408638 - protein, 13 aa, Entamoeba dispar
KERKYKKKRWDPQ

SEQ ID NO: 2408639 - protein, 10 aa, Entamoeba dispar
KERQEVEETL

SEQ ID NO: 2408640 - protein, 7 aa, Entamoeba dispar
KESEGEI

SEQ ID NO: 2408641 - protein, 9 aa, Entamoeba dispar
KESELEKSS

SEQ ID NO: 2408642 - protein, 6 aa, Entamoeba dispar
KESERI

SEQ ID NO: 2408643 - protein, 11 aa, Entamoeba dispar
KESGKENVSTL

SEQ ID NO: 2408644 - protein, 12 aa, Entamoeba dispar
KESKNEKKIRLE

SEQ ID NO: 2408645 - protein, 5 aa, Entamoeba dispar
KESNN

SEQ ID NO: 2408646 - protein, 7 aa, Entamoeba dispar
KESSKTH

SEQ ID NO: 2408647 - protein, 15 aa, Entamoeba dispar
KETEIVSKDQDVQEL

SEQ ID NO: 2408648 - protein, 9 aa, Entamoeba dispar
KETGDVPQY

SEQ ID NO: 2408649 - protein, 4 aa, Entamoeba dispar
KETI

SEQ ID NO: 2408650 - protein, 7 aa, Entamoeba dispar
KETNKIN

SEQ ID NO: 2408651 - protein, 9 aa, Entamoeba dispar
KETTGTTEN

SEQ ID NO: 2408652 - protein, 11 aa, Entamoeba dispar
KEVEKKEENER

SEQ ID NO: 2408653 - protein, 7 aa, Entamoeba dispar
KEVKGEY

SEQ ID NO: 2408654 - protein, 4 aa, Entamoeba dispar
KEVL

SEQ ID NO: 2408655 - protein, 21 aa, Entamoeba dispar
KEVQEKEEDKEQISTTEEVEE

SEQ ID NO: 2408656 - protein, 4 aa, Entamoeba dispar
KEVT

SEQ ID NO: 2408657 - protein, 5 aa, Entamoeba dispar
KEYGS

SEQ ID NO: 2408658 - protein, 14 aa, Entamoeba dispar
KEYNEGKEVNLEGE

SEQ ID NO: 2408659 - protein, 9 aa, Entamoeba dispar
KEYNGHKLQ

SEQ ID NO: 2408660 - protein, 9 aa, Entamoeba dispar
KEYPHKPPT

SEQ ID NO: 2408661 - protein, 25 aa, Entamoeba dispar
KEYQERKQKEAEDIRRTKEQQRISS

SEQ ID NO: 2408662 - protein, 5 aa, Entamoeba dispar
KEYQN

SEQ ID NO: 2408663 - protein, 36 aa, Entamoeba dispar
KFEDDDDDVVEEAATKAEEEEEDDDDDLLEKADEQI

SEQ ID NO: 2408664 - protein, 8 aa, Entamoeba dispar
KFGRGKHS

SEQ ID NO: 2408665 - protein, 11 aa, Entamoeba dispar
KFGVKRERTPF

SEQ ID NO: 2408666 - protein, 6 aa, Entamoeba dispar
KFKETG

SEQ ID NO: 2408667 - protein, 6 aa, Entamoeba dispar
KFNKEA

SEQ ID NO: 2408668 - protein, 5 aa, Entamoeba dispar
KFPQN

SEQ ID NO: 2408669 - protein, 11 aa, Entamoeba dispar
KFSSDRSIEEY

SEQ ID NO: 2408670 - protein, 11 aa, Entamoeba dispar
KFSSDRSMKEY

SEQ ID NO: 2408671 - protein, 5 aa, Entamoeba dispar
KFSSN

SEQ ID NO: 2408672 - protein, 11 aa, Entamoeba dispar
KGAAEKAKSLK

SEQ ID NO: 2408673 - protein, 11 aa, Entamoeba dispar
KGAEPTEQVPN

SEQ ID NO: 2408674 - protein, 17 aa, Entamoeba dispar
KGAGMSKGDPSTKEDLK

SEQ ID NO: 2408675 - protein, 9 aa, Entamoeba dispar
KGAHPEDAI

SEQ ID NO: 2408676 - protein, 8 aa, Entamoeba dispar
KGAREYAN

SEQ ID NO: 2408677 - protein, 4 aa, Entamoeba dispar
KGAY

SEQ ID NO: 2408678 - protein, 6 aa, Entamoeba dispar
KGDGKI

SEQ ID NO: 2408679 - protein, 8 aa, Entamoeba dispar
KGEERPVD

SEQ ID NO: 2408680 - protein, 6 aa, Entamoeba dispar
KGEMGQ

SEQ ID NO: 2408681 - protein, 17 aa, Entamoeba dispar
KGEMKEGKEGEKNIRQT

SEQ ID NO: 2408682 - protein, 7 aa, Entamoeba dispar
KGERGKA

SEQ ID NO: 2408683 - protein, 9 aa, Entamoeba dispar
KGERISEEK

SEQ ID NO: 2408684 - protein, 4 aa, Entamoeba dispar
KGES

SEQ ID NO: 2408685 - protein, 6 aa, Entamoeba dispar
KGFNGI

SEQ ID NO: 2408686 - protein, 7 aa, Entamoeba dispar
KGGEITK

SEQ ID NO: 2408687 - protein, 10 aa, Entamoeba dispar
KGGKVTEVKP

SEQ ID NO: 2408688 - protein, 5 aa, Entamoeba dispar
KGGVN

SEQ ID NO: 2408689 - protein, 10 aa, Entamoeba dispar
KGIDQPSLDK

SEQ ID NO: 2408690 - protein, 10 aa, Entamoeba dispar
KGIEEYQDPV

SEQ ID NO: 2408691 - protein, 11 aa, Entamoeba dispar
KGINTTNSIEK

SEQ ID NO: 2408692 - protein, 5 aa, Entamoeba dispar
KGKQY

SEQ ID NO: 2408693 - protein, 4 aa, Entamoeba dispar
KGLA

SEQ ID NO: 2408694 - protein, 6 aa, Entamoeba dispar
KGLPTT

SEQ ID NO: 2408695 - protein, 5 aa, Entamoeba dispar
KGNDF

SEQ ID NO: 2408696 - protein, 5 aa, Entamoeba dispar
KGNEM

SEQ ID NO: 2408697 - protein, 9 aa, Entamoeba dispar
KGNENKNQV

SEQ ID NO: 2408698 - protein, 11 aa, Entamoeba dispar
KGNEQYSTKVT

SEQ ID NO: 2408699 - protein, 4 aa, Entamoeba dispar
KGNI

SEQ ID NO: 2408700 - protein, 9 aa, Entamoeba dispar
KGNIKGKKE

SEQ ID NO: 2408701 - protein, 13 aa, Entamoeba dispar
KGPDNERRRASED

SEQ ID NO: 2408702 - protein, 15 aa, Entamoeba dispar
KGPKAGKMSKSIPDS

SEQ ID NO: 2408703 - protein, 6 aa, Entamoeba dispar
KGPKYS

SEQ ID NO: 2408704 - protein, 5 aa, Entamoeba dispar
KGQGV

SEQ ID NO: 2408705 - protein, 14 aa, Entamoeba dispar
KGQQGYFPYNYVCP

SEQ ID NO: 2408706 - protein, 4 aa, Entamoeba dispar
KGQW

SEQ ID NO: 2408707 - protein, 8 aa, Entamoeba dispar
KGRPNDNP

SEQ ID NO: 2408708 - protein, 8 aa, Entamoeba dispar
KGRQTRPE

SEQ ID NO: 2408709 - protein, 6 aa, Entamoeba dispar
KGRTVI

SEQ ID NO: 2408710 - protein, 5 aa, Entamoeba dispar
KGSAN

SEQ ID NO: 2408711 - protein, 5 aa, Entamoeba dispar
KGSCK

SEQ ID NO: 2408712 - protein, 6 aa, Entamoeba dispar
KGSDSH

SEQ ID NO: 2408713 - protein, 15 aa, Entamoeba dispar
KGSGNNKTMKDGTKK

SEQ ID NO: 2408714 - protein, 6 aa, Entamoeba dispar
KGTKAE

SEQ ID NO: 2408715 - protein, 13 aa, Entamoeba dispar
KGTYNSDGENNCK

SEQ ID NO: 2408716 - protein, 4 aa, Entamoeba dispar
KGVL

SEQ ID NO: 2408717 - protein, 4 aa, Entamoeba dispar
KGWK

SEQ ID NO: 2408718 - protein, 6 aa, Entamoeba dispar
KGYECK

SEQ ID NO: 2408719 - protein, 5 aa, Entamoeba dispar
KGYET

SEQ ID NO: 2408720 - protein, 6 aa, Entamoeba dispar
KHAEGG

SEQ ID NO: 2408721 - protein, 24 aa, Entamoeba dispar
KHAVSEGQSAVKRASGKGSTSGSQ

SEQ ID NO: 2408722 - protein, 7 aa, Entamoeba dispar
KHDDYTR

SEQ ID NO: 2408723 - protein, 4 aa, Entamoeba dispar
KHPD

SEQ ID NO: 2408724 - protein, 8 aa, Entamoeba dispar
KHPEFDDE

SEQ ID NO: 2408725 - protein, 4 aa, Entamoeba dispar
KHPQ

SEQ ID NO: 2408726 - protein, 4 aa, Entamoeba dispar
KHQI

SEQ ID NO: 2408727 - protein, 5 aa, Entamoeba dispar
KIDEE

SEQ ID NO: 2408728 - protein, 4 aa, Entamoeba dispar
KIEN

SEQ ID NO: 2408729 - protein, 9 aa, Entamoeba dispar
KIETSKPNI

SEQ ID NO: 2408730 - protein, 6 aa, Entamoeba dispar
KIETTQ

SEQ ID NO: 2408731 - protein, 7 aa, Entamoeba dispar
KIFEDGK

SEQ ID NO: 2408732 - protein, 5 aa, Entamoeba dispar
KIFND

SEQ ID NO: 2408733 - protein, 25 aa, Entamoeba dispar
KIGEEREKKREKIEEGERELQENNS

SEQ ID NO: 2408734 - protein, 10 aa, Entamoeba dispar
KIGGTIDDTE

SEQ ID NO: 2408735 - protein, 4 aa, Entamoeba dispar
KIHQ

SEQ ID NO: 2408736 - protein, 7 aa, Entamoeba dispar
KIHQNRG

SEQ ID NO: 2408737 - protein, 7 aa, Entamoeba dispar
KIKAEED

SEQ ID NO: 2408738 - protein, 5 aa, Entamoeba dispar
KIKEG

SEQ ID NO: 2408739 - protein, 6 aa, Entamoeba dispar
KIKEGA

SEQ ID NO: 2408740 - protein, 4 aa, Entamoeba dispar
KIKT

SEQ ID NO: 2408741 - protein, 8 aa, Entamoeba dispar
KINGRPVQ

SEQ ID NO: 2408742 - protein, 7 aa, Entamoeba dispar
KINNNND

SEQ ID NO: 2408743 - protein, 6 aa, Entamoeba dispar
KINTES

SEQ ID NO: 2408744 - protein, 5 aa, Entamoeba dispar
KIPER

SEQ ID NO: 2408745 - protein, 6 aa, Entamoeba dispar
KIPSSI

SEQ ID NO: 2408746 - protein, 5 aa, Entamoeba dispar
KIQID

SEQ ID NO: 2408747 - protein, 5 aa, Entamoeba dispar
KIQTT

SEQ ID NO: 2408748 - protein, 9 aa, Entamoeba dispar
KIRENHKKV

SEQ ID NO: 2408749 - protein, 4 aa, Entamoeba dispar
KIRP

SEQ ID NO: 2408750 - protein, 4 aa, Entamoeba dispar
KISK

SEQ ID NO: 2408751 - protein, 29 aa, Entamoeba dispar
KITNNSQQGGNDNHPTNNTNKQNNSSKIS

SEQ ID NO: 2408752 - protein, 8 aa, Entamoeba dispar
KITPEKIK

SEQ ID NO: 2408753 - protein, 12 aa, Entamoeba dispar
KITPQNSTREVR

SEQ ID NO: 2408754 - protein, 10 aa, Entamoeba dispar
KITTSDENDF

SEQ ID NO: 2408755 - protein, 33 aa, Entamoeba dispar
KKAATAKGHSEWGNGSPSNAGNYNSKPPSSTGF

SEQ ID NO: 2408756 - protein, 7 aa, Entamoeba dispar
KKAEELG

SEQ ID NO: 2408757 - protein, 8 aa, Entamoeba dispar
KKAKKAGF

SEQ ID NO: 2408758 - protein, 40 aa, Entamoeba dispar
KKATEKKSVEKKPKKVTEKKVKSHDDEGRKNTLSKKSGLQ

SEQ ID NO: 2408759 - protein, 6 aa, Entamoeba dispar
KKCGEA

SEQ ID NO: 2408760 - protein, 7 aa, Entamoeba dispar
KKDCEKI

SEQ ID NO: 2408761 - protein, 12 aa, Entamoeba dispar
KKDGTKIPEGTK

SEQ ID NO: 2408762 - protein, 8 aa, Entamoeba dispar
KKDKRIEE

SEQ ID NO: 2408763 - protein, 11 aa, Entamoeba dispar
KKDQIKSEEWK

SEQ ID NO: 2408764 - protein, 4 aa, Entamoeba dispar
KKDS

SEQ ID NO: 2408765 - protein, 4 aa, Entamoeba dispar
KKDV

SEQ ID NO: 2408766 - protein, 7 aa, Entamoeba dispar
KKEAERV

SEQ ID NO: 2408767 - protein, 8 aa, Entamoeba dispar
KKECQEKE

SEQ ID NO: 2408768 - protein, 7 aa, Entamoeba dispar
KKEDRRV

SEQ ID NO: 2408769 - protein, 14 aa, Entamoeba dispar
KKEDSDEEKEDSDD

SEQ ID NO: 2408770 - protein, 4 aa, Entamoeba dispar
KKEE

SEQ ID NO: 2408771 - protein, 10 aa, Entamoeba dispar
KKEGKGPAIT

SEQ ID NO: 2408772 - protein, 4 aa, Entamoeba dispar
KKEH

SEQ ID NO: 2408773 - protein, 18 aa, Entamoeba dispar
KKEKDNAEVRIDDPTQYQ

SEQ ID NO: 2408774 - protein, 18 aa, Entamoeba dispar
KKEPEIKEEKKEIKKPIR

SEQ ID NO: 2408775 - protein, 16 aa, Entamoeba dispar
KKEQRTTLGSDKYSNL

SEQ ID NO: 2408776 - protein, 5 aa, Entamoeba dispar
KKESP

SEQ ID NO: 2408777 - protein, 12 aa, Entamoeba dispar
KKEVQENEKKND

SEQ ID NO: 2408778 - protein, 6 aa, Entamoeba dispar
KKEYNE

SEQ ID NO: 2408779 - protein, 4 aa, Entamoeba dispar
KKGE

SEQ ID NO: 2408780 - protein, 6 aa, Entamoeba dispar
KKGEEF

SEQ ID NO: 2408781 - protein, 18 aa, Entamoeba dispar
KKGEGLHEGNANTKDELK

SEQ ID NO: 2408782 - protein, 7 aa, Entamoeba dispar
KKGESIV

SEQ ID NO: 2408783 - protein, 9 aa, Entamoeba dispar
KKGIAPSQI

SEQ ID NO: 2408784 - protein, 9 aa, Entamoeba dispar
KKGKTWDDF

SEQ ID NO: 2408785 - protein, 14 aa, Entamoeba dispar
KKGLEKKFSTNGKG

SEQ ID NO: 2408786 - protein, 15 aa, Entamoeba dispar
KKGRKINDVTTDFKN

SEQ ID NO: 2408787 - protein, 6 aa, Entamoeba dispar
KKGTEV

SEQ ID NO: 2408788 - protein, 14 aa, Entamoeba dispar
KKGYKEENKINTKR

SEQ ID NO: 2408789 - protein, 12 aa, Entamoeba dispar
KKIENKETEEKV

SEQ ID NO: 2408790 - protein, 23 aa, Entamoeba dispar
KKINGPSAKSKIRNAMKEKGKRK

SEQ ID NO: 2408791 - protein, 7 aa, Entamoeba dispar
KKIQSDI

SEQ ID NO: 2408792 - protein, 12 aa, Entamoeba dispar
KKISKKREEYQK

SEQ ID NO: 2408793 - protein, 5 aa, Entamoeba dispar
KKISS

SEQ ID NO: 2408794 - protein, 6 aa, Entamoeba dispar
KKITQE

SEQ ID NO: 2408795 - protein, 8 aa, Entamoeba dispar
KKKELNRM

SEQ ID NO: 2408796 - protein, 11 aa, Entamoeba dispar
KKKGKSMKEED

SEQ ID NO: 2408797 - protein, 7 aa, Entamoeba dispar
KKKINEA

SEQ ID NO: 2408798 - protein, 7 aa, Entamoeba dispar
KKKSIKP

SEQ ID NO: 2408799 - protein, 6 aa, Entamoeba dispar
KKLPGG

SEQ ID NO: 2408800 - protein, 13 aa, Entamoeba dispar
KKLSKKQKELYKD

SEQ ID NO: 2408801 - protein, 14 aa, Entamoeba dispar
KKLVSQDDHKNTYD

SEQ ID NO: 2408802 - protein, 4 aa, Entamoeba dispar
KKNA

SEQ ID NO: 2408803 - protein, 6 aa, Entamoeba dispar
KKNDFR

SEQ ID NO: 2408804 - protein, 9 aa, Entamoeba dispar
KKNEEIDEL

SEQ ID NO: 2408805 - protein, 13 aa, Entamoeba dispar
KKNPAKQYKGKQT

SEQ ID NO: 2408806 - protein, 12 aa, Entamoeba dispar
KKNSEKDSTYKR

SEQ ID NO: 2408807 - protein, 10 aa, Entamoeba dispar
KKNSTNSQKI

SEQ ID NO: 2408808 - protein, 9 aa, Entamoeba dispar
KKPEEPLPS

SEQ ID NO: 2408809 - protein, 5 aa, Entamoeba dispar
KKPEL

SEQ ID NO: 2408810 - protein, 6 aa, Entamoeba dispar
KKPKMR

SEQ ID NO: 2408811 - protein, 7 aa, Entamoeba dispar
KKPLTKN

SEQ ID NO: 2408812 - protein, 8 aa, Entamoeba dispar
KKPQTQKQ

SEQ ID NO: 2408813 - protein, 8 aa, Entamoeba dispar
KKQEEKVS

SEQ ID NO: 2408814 - protein, 4 aa, Entamoeba dispar
KKQF

SEQ ID NO: 2408815 - protein, 11 aa, Entamoeba dispar
KKQGMTQKEKI

SEQ ID NO: 2408816 - protein, 7 aa, Entamoeba dispar
KKQMPNV

SEQ ID NO: 2408817 - protein, 9 aa, Entamoeba dispar
KKQMTGYGS

SEQ ID NO: 2408818 - protein, 8 aa, Entamoeba dispar
KKQSALTG

SEQ ID NO: 2408819 - protein, 6 aa, Entamoeba dispar
KKQTRN

SEQ ID NO: 2408820 - protein, 4 aa, Entamoeba dispar
KKRK

SEQ ID NO: 2408821 - protein, 9 aa, Entamoeba dispar
KKRKRMETL

SEQ ID NO: 2408822 - protein, 5 aa, Entamoeba dispar
KKRVA

SEQ ID NO: 2408823 - protein, 6 aa, Entamoeba dispar
KKSDLL

SEQ ID NO: 2408824 - protein, 12 aa, Entamoeba dispar
KKSGKVFGGDEN

SEQ ID NO: 2408825 - protein, 12 aa, Entamoeba dispar
KKSKKTLTSQQY

SEQ ID NO: 2408826 - protein, 4 aa, Entamoeba dispar
KKSN

SEQ ID NO: 2408827 - protein, 8 aa, Entamoeba dispar
KKSSDVQQ

SEQ ID NO: 2408828 - protein, 8 aa, Entamoeba dispar
KKSSIPEA

SEQ ID NO: 2408829 - protein, 7 aa, Entamoeba dispar
KKSSIPV

SEQ ID NO: 2408830 - protein, 8 aa, Entamoeba dispar
KKSTNEEV

SEQ ID NO: 2408831 - protein, 13 aa, Entamoeba dispar
KKTLTSEDENEIK

SEQ ID NO: 2408832 - protein, 9 aa, Entamoeba dispar
KKTNEGLQS

SEQ ID NO: 2408833 - protein, 8 aa, Entamoeba dispar
KKVEHDPS

SEQ ID NO: 2408834 - protein, 8 aa, Entamoeba dispar
KKVETDSI

SEQ ID NO: 2408835 - protein, 8 aa, Entamoeba dispar
KKVGQGTF

SEQ ID NO: 2408836 - protein, 9 aa, Entamoeba dispar
KKVINSTEI

SEQ ID NO: 2408837 - protein, 6 aa, Entamoeba dispar
KKVNDK

SEQ ID NO: 2408838 - protein, 8 aa, Entamoeba dispar
KKWEKNRK

SEQ ID NO: 2408839 - protein, 10 aa, Entamoeba dispar
KKYDSYSGKN

SEQ ID NO: 2408840 - protein, 7 aa, Entamoeba dispar
KKYEEGK

SEQ ID NO: 2408841 - protein, 7 aa, Entamoeba dispar
KKYKDMP

SEQ ID NO: 2408842 - protein, 6 aa, Entamoeba dispar
KKYPTQ

SEQ ID NO: 2408843 - protein, 11 aa, Entamoeba dispar
KKYSSGLSKEQ

SEQ ID NO: 2408844 - protein, 4 aa, Entamoeba dispar
KLAK

SEQ ID NO: 2408845 - protein, 4 aa, Entamoeba dispar
KLDK

SEQ ID NO: 2408846 - protein, 5 aa, Entamoeba dispar
KLDNY

SEQ ID NO: 2408847 - protein, 8 aa, Entamoeba dispar
KLDQQGVN

SEQ ID NO: 2408848 - protein, 8 aa, Entamoeba dispar
KLEEENMK

SEQ ID NO: 2408849 - protein, 9 aa, Entamoeba dispar
KLENKSEEW

SEQ ID NO: 2408850 - protein, 6 aa, Entamoeba dispar
KLEYNE

SEQ ID NO: 2408851 - protein, 13 aa, Entamoeba dispar
KLGDNSSANKAAL

SEQ ID NO: 2408852 - protein, 6 aa, Entamoeba dispar
KLGLGT

SEQ ID NO: 2408853 - protein, 7 aa, Entamoeba dispar
KLGNQPI

SEQ ID NO: 2408854 - protein, 10 aa, Entamoeba dispar
KLKEEESIEQ

SEQ ID NO: 2408855 - protein, 8 aa, Entamoeba dispar
KLKESYTQ

SEQ ID NO: 2408856 - protein, 10 aa, Entamoeba dispar
KLKGNSITKK

SEQ ID NO: 2408857 - protein, 7 aa, Entamoeba dispar
KLKNTQI

SEQ ID NO: 2408858 - protein, 5 aa, Entamoeba dispar
KLNPY

SEQ ID NO: 2408859 - protein, 6 aa, Entamoeba dispar
KLNQGN

SEQ ID NO: 2408860 - protein, 8 aa, Entamoeba dispar
KLPDEEYD

SEQ ID NO: 2408861 - protein, 6 aa, Entamoeba dispar
KLPPHL

SEQ ID NO: 2408862 - protein, 7 aa, Entamoeba dispar
KLPSNVD

SEQ ID NO: 2408863 - protein, 10 aa, Entamoeba dispar
KLQGKELEGR

SEQ ID NO: 2408864 - protein, 13 aa, Entamoeba dispar
KLQGTTQDKGLSC

SEQ ID NO: 2408865 - protein, 6 aa, Entamoeba dispar
KLRHMS

SEQ ID NO: 2408866 - protein, 12 aa, Entamoeba dispar
KLSKAGDETSRI

SEQ ID NO: 2408867 - protein, 12 aa, Entamoeba dispar
KLTEAKKDKKMK

SEQ ID NO: 2408868 - protein, 7 aa, Entamoeba dispar
KLTKEAQ

SEQ ID NO: 2408869 - protein, 12 aa, Entamoeba dispar
KLTPTPEDPEAL

SEQ ID NO: 2408870 - protein, 7 aa, Entamoeba dispar
KLTSKNV

SEQ ID NO: 2408871 - protein, 9 aa, Entamoeba dispar
KLTSSADEV

SEQ ID NO: 2408872 - protein, 13 aa, Entamoeba dispar
KLVETGEDKVEAG

SEQ ID NO: 2408873 - protein, 7 aa, Entamoeba dispar
KLYGGGS

SEQ ID NO: 2408874 - protein, 8 aa, Entamoeba dispar
KLYQNNPK

SEQ ID NO: 2408875 - protein, 5 aa, Entamoeba dispar
KMEEA

SEQ ID NO: 2408876 - protein, 4 aa, Entamoeba dispar
KNDI

SEQ ID NO: 2408877 - protein, 5 aa, Entamoeba dispar
KNDLP

SEQ ID NO: 2408878 - protein, 6 aa, Entamoeba dispar
KNDMKR

SEQ ID NO: 2408879 - protein, 10 aa, Entamoeba dispar
KNEASKFKPK

SEQ ID NO: 2408880 - protein, 4 aa, Entamoeba dispar
KNED

SEQ ID NO: 2408881 - protein, 5 aa, Entamoeba dispar
KNEDL

SEQ ID NO: 2408882 - protein, 4 aa, Entamoeba dispar
KNEF

SEQ ID NO: 2408883 - protein, 6 aa, Entamoeba dispar
KNEIKE

SEQ ID NO: 2408884 - protein, 6 aa, Entamoeba dispar
KNEQRI

SEQ ID NO: 2408885 - protein, 5 aa, Entamoeba dispar
KNEVE

SEQ ID NO: 2408886 - protein, 6 aa, Entamoeba dispar
KNGAEK

SEQ ID NO: 2408887 - protein, 4 aa, Entamoeba dispar
KNHP

SEQ ID NO: 2408888 - protein, 8 aa, Entamoeba dispar
KNIEKKDI

SEQ ID NO: 2408889 - protein, 6 aa, Entamoeba dispar
KNIENK

SEQ ID NO: 2408890 - protein, 8 aa, Entamoeba dispar
KNIGSSNI

SEQ ID NO: 2408891 - protein, 7 aa, Entamoeba dispar
KNIKKKD

SEQ ID NO: 2408892 - protein, 13 aa, Entamoeba dispar
KNIYPKKNEEPFG

SEQ ID NO: 2408893 - protein, 9 aa, Entamoeba dispar
KNKEGKERI

SEQ ID NO: 2408894 - protein, 13 aa, Entamoeba dispar
KNKKFKEKTMNKG

SEQ ID NO: 2408895 - protein, 12 aa, Entamoeba dispar
KNKRIPRKCFKW

SEQ ID NO: 2408896 - protein, 6 aa, Entamoeba dispar
KNLTEE

SEQ ID NO: 2408897 - protein, 27 aa, Entamoeba dispar
KNPAIRYQQNSELSKRIAEGLTQGLER

SEQ ID NO: 2408898 - protein, 9 aa, Entamoeba dispar
KNPENTAEI

SEQ ID NO: 2408899 - protein, 7 aa, Entamoeba dispar
KNPIPSI

SEQ ID NO: 2408900 - protein, 10 aa, Entamoeba dispar
KNPRKEGGPH

SEQ ID NO: 2408901 - protein, 9 aa, Entamoeba dispar
KNPSRRLTD

SEQ ID NO: 2408902 - protein, 9 aa, Entamoeba dispar
KNPTFSQKG

SEQ ID NO: 2408903 - protein, 9 aa, Entamoeba dispar
KNQHKGQDE

SEQ ID NO: 2408904 - protein, 5 aa, Entamoeba dispar
KNQKL

SEQ ID NO: 2408905 - protein, 6 aa, Entamoeba dispar
KNQTTT

SEQ ID NO: 2408906 - protein, 7 aa, Entamoeba dispar
KNRKEYD

SEQ ID NO: 2408907 - protein, 6 aa, Entamoeba dispar
KNRKLV

SEQ ID NO: 2408908 - protein, 5 aa, Entamoeba dispar
KNRRR

SEQ ID NO: 2408909 - protein, 15 aa, Entamoeba dispar
KNSSFNEASTQSQQL

SEQ ID NO: 2408910 - protein, 8 aa, Entamoeba dispar
KNTGKTKG

SEQ ID NO: 2408911 - protein, 5 aa, Entamoeba dispar
KNTKM

SEQ ID NO: 2408912 - protein, 7 aa, Entamoeba dispar
KNTLQED

SEQ ID NO: 2408913 - protein, 8 aa, Entamoeba dispar
KNTNERID

SEQ ID NO: 2408914 - protein, 7 aa, Entamoeba dispar
KNTQFDQ

SEQ ID NO: 2408915 - protein, 21 aa, Entamoeba dispar
KNVAPYNPIGRAEEEIEEGFS

SEQ ID NO: 2408916 - protein, 20 aa, Entamoeba dispar
KNVGDINRTLRNSAKLPTHD

SEQ ID NO: 2408917 - protein, 11 aa, Entamoeba dispar
KNYKEQGESYL

SEQ ID NO: 2408918 - protein, 8 aa, Entamoeba dispar
KPADPRLP

SEQ ID NO: 2408919 - protein, 23 aa, Entamoeba dispar
KPAGGPKIPQQRMQGPMDQNDAG

SEQ ID NO: 2408920 - protein, 6 aa, Entamoeba dispar
KPAVPY

SEQ ID NO: 2408921 - protein, 4 aa, Entamoeba dispar
KPDV

SEQ ID NO: 2408922 - protein, 8 aa, Entamoeba dispar
KPEHGAGY

SEQ ID NO: 2408923 - protein, 10 aa, Entamoeba dispar
KPEKSNIEPT

SEQ ID NO: 2408924 - protein, 8 aa, Entamoeba dispar
KPEQQSKT

SEQ ID NO: 2408925 - protein, 7 aa, Entamoeba dispar
KPFDKEE

SEQ ID NO: 2408926 - protein, 11 aa, Entamoeba dispar
KPFNPKDENDA

SEQ ID NO: 2408927 - protein, 5 aa, Entamoeba dispar
KPGEY

SEQ ID NO: 2408928 - protein, 6 aa, Entamoeba dispar
KPGFDA

SEQ ID NO: 2408929 - protein, 18 aa, Entamoeba dispar
KPHHHENHTRQRPPVQQQ

SEQ ID NO: 2408930 - protein, 7 aa, Entamoeba dispar
KPIDKEE

SEQ ID NO: 2408931 - protein, 4 aa, Entamoeba dispar
KPIE

SEQ ID NO: 2408932 - protein, 5 aa, Entamoeba dispar
KPIPK

SEQ ID NO: 2408933 - protein, 5 aa, Entamoeba dispar
KPITT

SEQ ID NO: 2408934 - protein, 4 aa, Entamoeba dispar
KPLE

SEQ ID NO: 2408935 - protein, 12 aa, Entamoeba dispar
KPLHGTNVPHDS

SEQ ID NO: 2408936 - protein, 6 aa, Entamoeba dispar
KPLLTP

SEQ ID NO: 2408937 - protein, 4 aa, Entamoeba dispar
KPMS

SEQ ID NO: 2408938 - protein, 13 aa, Entamoeba dispar
KPNLGQYKNPPSW

SEQ ID NO: 2408939 - protein, 4 aa, Entamoeba dispar
KPNQ

SEQ ID NO: 2408940 - protein, 9 aa, Entamoeba dispar
KPQAAVGTN

SEQ ID NO: 2408941 - protein, 6 aa, Entamoeba dispar
KPSAED

SEQ ID NO: 2408942 - protein, 6 aa, Entamoeba dispar
KPSFGN

SEQ ID NO: 2408943 - protein, 4 aa, Entamoeba dispar
KPSK

SEQ ID NO: 2408944 - protein, 6 aa, Entamoeba dispar
KPSSFP

SEQ ID NO: 2408945 - protein, 7 aa, Entamoeba dispar
KPTLRAY

SEQ ID NO: 2408946 - protein, 5 aa, Entamoeba dispar
KPTPL

SEQ ID NO: 2408947 - protein, 5 aa, Entamoeba dispar
KPTSL

SEQ ID NO: 2408948 - protein, 4 aa, Entamoeba dispar
KQAF

SEQ ID NO: 2408949 - protein, 7 aa, Entamoeba dispar
KQDKELE

SEQ ID NO: 2408950 - protein, 4 aa, Entamoeba dispar
KQED

SEQ ID NO: 2408951 - protein, 7 aa, Entamoeba dispar
KQEKIRE

SEQ ID NO: 2408952 - protein, 8 aa, Entamoeba dispar
KQEPNMIE

SEQ ID NO: 2408953 - protein, 9 aa, Entamoeba dispar
KQEQINQQN

SEQ ID NO: 2408954 - protein, 7 aa, Entamoeba dispar
KQEQSFN

SEQ ID NO: 2408955 - protein, 8 aa, Entamoeba dispar
KQETDQVT

SEQ ID NO: 2408956 - protein, 5 aa, Entamoeba dispar
KQEVK

SEQ ID NO: 2408957 - protein, 6 aa, Entamoeba dispar
KQGIST

SEQ ID NO: 2408958 - protein, 6 aa, Entamoeba dispar
KQGKIG

SEQ ID NO: 2408959 - protein, 5 aa, Entamoeba dispar
KQIKP

SEQ ID NO: 2408960 - protein, 17 aa, Entamoeba dispar
KQKAESNEEVKENITET

SEQ ID NO: 2408961 - protein, 39 aa, Entamoeba dispar
KQKRREARGLTSAAKKSRGFTGKGRRYNKIGAGARGNLK

SEQ ID NO: 2408962 - protein, 21 aa, Entamoeba dispar
KQLKEEKDAMEEEKVNEHQQI

SEQ ID NO: 2408963 - protein, 8 aa, Entamoeba dispar
KQLKETNK

SEQ ID NO: 2408964 - protein, 5 aa, Entamoeba dispar
KQLQE

SEQ ID NO: 2408965 - protein, 19 aa, Entamoeba dispar
KQLSKESFDQKEQKSKIKL

SEQ ID NO: 2408966 - protein, 9 aa, Entamoeba dispar
KQMEEDIEK

SEQ ID NO: 2408967 - protein, 6 aa, Entamoeba dispar
KQNSQS

SEQ ID NO: 2408968 - protein, 25 aa, Entamoeba dispar
KQNVITSKRGMSYKDSEIPTTIRST

SEQ ID NO: 2408969 - protein, 7 aa, Entamoeba dispar
KQPAVIS

SEQ ID NO: 2408970 - protein, 9 aa, Entamoeba dispar
KQPPSQDDS

SEQ ID NO: 2408971 - protein, 9 aa, Entamoeba dispar
KQPYTSKTD

SEQ ID NO: 2408972 - protein, 4 aa, Entamoeba dispar
KQQN

SEQ ID NO: 2408973 - protein, 22 aa, Entamoeba dispar
KQQPKKQLEQTKTQTKRIAGRK

SEQ ID NO: 2408974 - protein, 8 aa, Entamoeba dispar
KQQQIEQQ

SEQ ID NO: 2408975 - protein, 4 aa, Entamoeba dispar
KQSI

SEQ ID NO: 2408976 - protein, 8 aa, Entamoeba dispar
KQTDDETL

SEQ ID NO: 2408977 - protein, 16 aa, Entamoeba dispar
KQTDENTLKELRQEGN

SEQ ID NO: 2408978 - protein, 6 aa, Entamoeba dispar
KQTEEI

SEQ ID NO: 2408979 - protein, 6 aa, Entamoeba dispar
KQTEYD

SEQ ID NO: 2408980 - protein, 10 aa, Entamoeba dispar
KQTKKTKCTE

SEQ ID NO: 2408981 - protein, 29 aa, Entamoeba dispar
KQTKTKSIQQNLNTHPSLTTTFTPKSINN

SEQ ID NO: 2408982 - protein, 8 aa, Entamoeba dispar
KQTNTSCF

SEQ ID NO: 2408983 - protein, 4 aa, Entamoeba dispar
KQTT

SEQ ID NO: 2408984 - protein, 7 aa, Entamoeba dispar
KQVNDPA

SEQ ID NO: 2408985 - protein, 7 aa, Entamoeba dispar
KQVSPQS

SEQ ID NO: 2408986 - protein, 6 aa, Entamoeba dispar
KQYGEH

SEQ ID NO: 2408987 - protein, 7 aa, Entamoeba dispar
KQYPEQS

SEQ ID NO: 2408988 - protein, 9 aa, Entamoeba dispar
KRDSDGKLK

SEQ ID NO: 2408989 - protein, 14 aa, Entamoeba dispar
KREKEEQEKERTER

SEQ ID NO: 2408990 - protein, 9 aa, Entamoeba dispar
KRELTDESL

SEQ ID NO: 2408991 - protein, 12 aa, Entamoeba dispar
KRERGSKKEVND

SEQ ID NO: 2408992 - protein, 15 aa, Entamoeba dispar
KRERSGSGSRITRRR

SEQ ID NO: 2408993 - protein, 12 aa, Entamoeba dispar
KREYSSGNINSD

SEQ ID NO: 2408994 - protein, 10 aa, Entamoeba dispar
KRFDNKSDRV

SEQ ID NO: 2408995 - protein, 5 aa, Entamoeba dispar
KRGAD

SEQ ID NO: 2408996 - protein, 5 aa, Entamoeba dispar
KRHIG

SEQ ID NO: 2408997 - protein, 7 aa, Entamoeba dispar
KRHYGVT

SEQ ID NO: 2408998 - protein, 9 aa, Entamoeba dispar
KRKKEELNI

SEQ ID NO: 2408999 - protein, 12 aa, Entamoeba dispar
KRLPKQPRPAEL

SEQ ID NO: 2409000 - protein, 7 aa, Entamoeba dispar
KRMQRQT

SEQ ID NO: 2409001 - protein, 9 aa, Entamoeba dispar
KRMSRNEET

SEQ ID NO: 2409002 - protein, 6 aa, Entamoeba dispar
KRNEEV

SEQ ID NO: 2409003 - protein, 13 aa, Entamoeba dispar
KRNELIRDNRSSF

SEQ ID NO: 2409004 - protein, 4 aa, Entamoeba dispar
KRNG

SEQ ID NO: 2409005 - protein, 6 aa, Entamoeba dispar
KRNYHQ

SEQ ID NO: 2409006 - protein, 8 aa, Entamoeba dispar
KRQGMSHC

SEQ ID NO: 2409007 - protein, 9 aa, Entamoeba dispar
KRQSKSFEA

SEQ ID NO: 2409008 - protein, 5 aa, Entamoeba dispar
KRRNM

SEQ ID NO: 2409009 - protein, 9 aa, Entamoeba dispar
KRSEAGETV

SEQ ID NO: 2409010 - protein, 8 aa, Entamoeba dispar
KRSREAQL

SEQ ID NO: 2409011 - protein, 6 aa, Entamoeba dispar
KRTGNI

SEQ ID NO: 2409012 - protein, 4 aa, Entamoeba dispar
KRVE

SEQ ID NO: 2409013 - protein, 7 aa, Entamoeba dispar
KRVKNIG

SEQ ID NO: 2409014 - protein, 4 aa, Entamoeba dispar
KRWD

SEQ ID NO: 2409015 - protein, 9 aa, Entamoeba dispar
KRYANGEVK

SEQ ID NO: 2409016 - protein, 10 aa, Entamoeba dispar
KRYPASQNAE

SEQ ID NO: 2409017 - protein, 24 aa, Entamoeba dispar
KRYYNSAGRYVSRQYDKQPIDNEQ

SEQ ID NO: 2409018 - protein, 11 aa, Entamoeba dispar
KSAKENVESVE

SEQ ID NO: 2409019 - protein, 7 aa, Entamoeba dispar
KSANNQN

SEQ ID NO: 2409020 - protein, 8 aa, Entamoeba dispar
KSAQEGKY

SEQ ID NO: 2409021 - protein, 10 aa, Entamoeba dispar
KSDKQERRPY

SEQ ID NO: 2409022 - protein, 5 aa, Entamoeba dispar
KSDLG

SEQ ID NO: 2409023 - protein, 10 aa, Entamoeba dispar
KSDLPSTISE

SEQ ID NO: 2409024 - protein, 7 aa, Entamoeba dispar
KSDSRMK

SEQ ID NO: 2409025 - protein, 5 aa, Entamoeba dispar
KSDTY

SEQ ID NO: 2409026 - protein, 5 aa, Entamoeba dispar
KSEDL

SEQ ID NO: 2409027 - protein, 8 aa, Entamoeba dispar
KSEIEENK

SEQ ID NO: 2409028 - protein, 8 aa, Entamoeba dispar
KSEQPKFE

SEQ ID NO: 2409029 - protein, 4 aa, Entamoeba dispar
KSES

SEQ ID NO: 2409030 - protein, 14 aa, Entamoeba dispar
KSFHPAKLSNQKKV

SEQ ID NO: 2409031 - protein, 6 aa, Entamoeba dispar
KSGASV

SEQ ID NO: 2409032 - protein, 7 aa, Entamoeba dispar
KSGMGKT

SEQ ID NO: 2409033 - protein, 9 aa, Entamoeba dispar
KSGNATRQF

SEQ ID NO: 2409034 - protein, 7 aa, Entamoeba dispar
KSHEKGK

SEQ ID NO: 2409035 - protein, 12 aa, Entamoeba dispar
KSIEEESNEENE

SEQ ID NO: 2409036 - protein, 16 aa, Entamoeba dispar
KSIKEELKEMNNKEIE

SEQ ID NO: 2409037 - protein, 4 aa, Entamoeba dispar
KSKF

SEQ ID NO: 2409038 - protein, 8 aa, Entamoeba dispar
KSKGGIES

SEQ ID NO: 2409039 - protein, 6 aa, Entamoeba dispar
KSKIIN

SEQ ID NO: 2409040 - protein, 8 aa, Entamoeba dispar
KSKKGFGY

SEQ ID NO: 2409041 - protein, 6 aa, Entamoeba dispar
KSKKVT

SEQ ID NO: 2409042 - protein, 14 aa, Entamoeba dispar
KSKRGGPVKPGNAK

SEQ ID NO: 2409043 - protein, 15 aa, Entamoeba dispar
KSLPNNQNYTSVQEN

SEQ ID NO: 2409044 - protein, 4 aa, Entamoeba dispar
KSMT

SEQ ID NO: 2409045 - protein, 17 aa, Entamoeba dispar
KSNEQLEKEKQEQTKRA

SEQ ID NO: 2409046 - protein, 10 aa, Entamoeba dispar
KSNLQLSGDS

SEQ ID NO: 2409047 - protein, 7 aa, Entamoeba dispar
KSPASFN

SEQ ID NO: 2409048 - protein, 4 aa, Entamoeba dispar
KSPN

SEQ ID NO: 2409049 - protein, 9 aa, Entamoeba dispar
KSPNNTIEK

SEQ ID NO: 2409050 - protein, 9 aa, Entamoeba dispar
KSPTSPIIS

SEQ ID NO: 2409051 - protein, 7 aa, Entamoeba dispar
KSQDPNI

SEQ ID NO: 2409052 - protein, 4 aa, Entamoeba dispar
KSQK

SEQ ID NO: 2409053 - protein, 8 aa, Entamoeba dispar
KSQTEEVK

SEQ ID NO: 2409054 - protein, 8 aa, Entamoeba dispar
KSRDDGSA

SEQ ID NO: 2409055 - protein, 7 aa, Entamoeba dispar
KSRSNEV

SEQ ID NO: 2409056 - protein, 9 aa, Entamoeba dispar
KSRVGSLAR

SEQ ID NO: 2409057 - protein, 7 aa, Entamoeba dispar
KSSKENV

SEQ ID NO: 2409058 - protein, 7 aa, Entamoeba dispar
KSSSIKN

SEQ ID NO: 2409059 - protein, 23 aa, Entamoeba dispar
KSSSKKSREEVKAELERGMSELK

SEQ ID NO: 2409060 - protein, 7 aa, Entamoeba dispar
KSTIGGK

SEQ ID NO: 2409061 - protein, 4 aa, Entamoeba dispar
KSTN

SEQ ID NO: 2409062 - protein, 6 aa, Entamoeba dispar
KSTNSS

SEQ ID NO: 2409063 - protein, 5 aa, Entamoeba dispar
KSTQH

SEQ ID NO: 2409064 - protein, 10 aa, Entamoeba dispar
KSTSNNDEAI

SEQ ID NO: 2409065 - protein, 8 aa, Entamoeba dispar
KSTSSDQL

SEQ ID NO: 2409066 - protein, 10 aa, Entamoeba dispar
KSVESSSMVP

SEQ ID NO: 2409067 - protein, 17 aa, Entamoeba dispar
KSVPRSTLDDAYPDVEK

SEQ ID NO: 2409068 - protein, 5 aa, Entamoeba dispar
KSVQR

SEQ ID NO: 2409069 - protein, 7 aa, Entamoeba dispar
KSYEGHK

SEQ ID NO: 2409070 - protein, 7 aa, Entamoeba dispar
KSYTSDE

SEQ ID NO: 2409071 - protein, 13 aa, Entamoeba dispar
KTAEAAITKAGGK

SEQ ID NO: 2409072 - protein, 7 aa, Entamoeba dispar
KTAEEAK

SEQ ID NO: 2409073 - protein, 8 aa, Entamoeba dispar
KTDCRNDE

SEQ ID NO: 2409074 - protein, 5 aa, Entamoeba dispar
KTDSS

SEQ ID NO: 2409075 - protein, 4 aa, Entamoeba dispar
KTEE

SEQ ID NO: 2409076 - protein, 5 aa, Entamoeba dispar
KTENY

SEQ ID NO: 2409077 - protein, 13 aa, Entamoeba dispar
KTEYKDDITLEEA

SEQ ID NO: 2409078 - protein, 4 aa, Entamoeba dispar
KTFT

SEQ ID NO: 2409079 - protein, 8 aa, Entamoeba dispar
KTGDGCKE

SEQ ID NO: 2409080 - protein, 7 aa, Entamoeba dispar
KTGEYSG

SEQ ID NO: 2409081 - protein, 11 aa, Entamoeba dispar
KTGGIKQSPMD

SEQ ID NO: 2409082 - protein, 6 aa, Entamoeba dispar
KTGYQS

SEQ ID NO: 2409083 - protein, 10 aa, Entamoeba dispar
KTIDNNKEVE

SEQ ID NO: 2409084 - protein, 5 aa, Entamoeba dispar
KTIQE

SEQ ID NO: 2409085 - protein, 4 aa, Entamoeba dispar
KTIT

SEQ ID NO: 2409086 - protein, 10 aa, Entamoeba dispar
KTKCNPNNKR

SEQ ID NO: 2409087 - protein, 19 aa, Entamoeba dispar
KTKEERKPKKNGGKKQGTL

SEQ ID NO: 2409088 - protein, 14 aa, Entamoeba dispar
KTKGRTGASSKSAL

SEQ ID NO: 2409089 - protein, 4 aa, Entamoeba dispar
KTKN

SEQ ID NO: 2409090 - protein, 8 aa, Entamoeba dispar
KTKPGSLA

SEQ ID NO: 2409091 - protein, 7 aa, Entamoeba dispar
KTKQGFS

SEQ ID NO: 2409092 - protein, 9 aa, Entamoeba dispar
KTLDDLKTE

SEQ ID NO: 2409093 - protein, 30 aa, Entamoeba dispar
KTLEGFKENSDIKEEKSRIEEKEFSEDEYE

SEQ ID NO: 2409094 - protein, 14 aa, Entamoeba dispar
KTLKEKYDLRPKNR

SEQ ID NO: 2409095 - protein, 16 aa, Entamoeba dispar
KTLKKQNTTPPNKSLN

SEQ ID NO: 2409096 - protein, 5 aa, Entamoeba dispar
KTMAD

SEQ ID NO: 2409097 - protein, 4 aa, Entamoeba dispar
KTNA

SEQ ID NO: 2409098 - protein, 6 aa, Entamoeba dispar
KTNENE

SEQ ID NO: 2409099 - protein, 9 aa, Entamoeba dispar
KTNGENTKF

SEQ ID NO: 2409100 - protein, 8 aa, Entamoeba dispar
KTNKTNNY

SEQ ID NO: 2409101 - protein, 4 aa, Entamoeba dispar
KTNN

SEQ ID NO: 2409102 - protein, 19 aa, Entamoeba dispar
KTPKDESTTVKTEVIPANK

SEQ ID NO: 2409103 - protein, 5 aa, Entamoeba dispar
KTPKY

SEQ ID NO: 2409104 - protein, 4 aa, Entamoeba dispar
KTQE

SEQ ID NO: 2409105 - protein, 4 aa, Entamoeba dispar
KTQL

SEQ ID NO: 2409106 - protein, 6 aa, Entamoeba dispar
KTQQLG

SEQ ID NO: 2409107 - protein, 7 aa, Entamoeba dispar
KTQRESI

SEQ ID NO: 2409108 - protein, 6 aa, Entamoeba dispar
KTQSSV

SEQ ID NO: 2409109 - protein, 4 aa, Entamoeba dispar
KTQT

SEQ ID NO: 2409110 - protein, 5 aa, Entamoeba dispar
KTRIT

SEQ ID NO: 2409111 - protein, 12 aa, Entamoeba dispar
KTSAKNGEGVTE

SEQ ID NO: 2409112 - protein, 5 aa, Entamoeba dispar
KTSEN

SEQ ID NO: 2409113 - protein, 4 aa, Entamoeba dispar
KTSF

SEQ ID NO: 2409114 - protein, 12 aa, Entamoeba dispar
KTSKSRDITQYT

SEQ ID NO: 2409115 - protein, 9 aa, Entamoeba dispar
KTSTEYSTT

SEQ ID NO: 2409116 - protein, 6 aa, Entamoeba dispar
KTSTTI

SEQ ID NO: 2409117 - protein, 5 aa, Entamoeba dispar
KTTDV

SEQ ID NO: 2409118 - protein, 7 aa, Entamoeba dispar
KTTKKEV

SEQ ID NO: 2409119 - protein, 17 aa, Entamoeba dispar
KTTLNSSTETFSPSTSF

SEQ ID NO: 2409120 - protein, 5 aa, Entamoeba dispar
KTTRH

SEQ ID NO: 2409121 - protein, 8 aa, Entamoeba dispar
KTVQERGA

SEQ ID NO: 2409122 - protein, 4 aa, Entamoeba dispar
KTVT

SEQ ID NO: 2409123 - protein, 5 aa, Entamoeba dispar
KTYPE

SEQ ID NO: 2409124 - protein, 6 aa, Entamoeba dispar
KVDNND

SEQ ID NO: 2409125 - protein, 17 aa, Entamoeba dispar
KVGEDQTSNDADDGGSE

SEQ ID NO: 2409126 - protein, 18 aa, Entamoeba dispar
KVKKEQAKIKKTTFTPTP

SEQ ID NO: 2409127 - protein, 7 aa, Entamoeba dispar
KVNATKE

SEQ ID NO: 2409128 - protein, 7 aa, Entamoeba dispar
KVNNNQN

SEQ ID NO: 2409129 - protein, 4 aa, Entamoeba dispar
KVPH

SEQ ID NO: 2409130 - protein, 5 aa, Entamoeba dispar
KVPKT

SEQ ID NO: 2409131 - protein, 6 aa, Entamoeba dispar
KVSPRH

SEQ ID NO: 2409132 - protein, 13 aa, Entamoeba dispar
KVSQHIPTQQPTM

SEQ ID NO: 2409133 - protein, 10 aa, Entamoeba dispar
KVTGPRGTLT

SEQ ID NO: 2409134 - protein, 4 aa, Entamoeba dispar
KVTL

SEQ ID NO: 2409135 - protein, 15 aa, Entamoeba dispar
KVTNKNQKEKQQNLE

SEQ ID NO: 2409136 - protein, 8 aa, Entamoeba dispar
KWSPNETK

SEQ ID NO: 2409137 - protein, 12 aa, Entamoeba dispar
KYDIKANPIQKK

SEQ ID NO: 2409138 - protein, 17 aa, Entamoeba dispar
KYDKASEAYKTAAGHYE

SEQ ID NO: 2409139 - protein, 5 aa, Entamoeba dispar
KYDSA

SEQ ID NO: 2409140 - protein, 13 aa, Entamoeba dispar
KYDSTDMDTSGSF

SEQ ID NO: 2409141 - protein, 6 aa, Entamoeba dispar
KYEGNM

SEQ ID NO: 2409142 - protein, 9 aa, Entamoeba dispar
KYEKEGNQI

SEQ ID NO: 2409143 - protein, 13 aa, Entamoeba dispar
KYEKSLKTEPRVK

SEQ ID NO: 2409144 - protein, 5 aa, Entamoeba dispar
KYGED

SEQ ID NO: 2409145 - protein, 4 aa, Entamoeba dispar
KYGK

SEQ ID NO: 2409146 - protein, 6 aa, Entamoeba dispar
KYGNDN

SEQ ID NO: 2409147 - protein, 6 aa, Entamoeba dispar
KYGNPA

SEQ ID NO: 2409148 - protein, 12 aa, Entamoeba dispar
KYHPDRNPEGRE

SEQ ID NO: 2409149 - protein, 20 aa, Entamoeba dispar
KYNETERTINTNTQQIERKR

SEQ ID NO: 2409150 - protein, 9 aa, Entamoeba dispar
KYPEKTVQE

SEQ ID NO: 2409151 - protein, 8 aa, Entamoeba dispar
KYQREEEE

SEQ ID NO: 2409152 - protein, 6 aa, Entamoeba dispar
KYRESA

SEQ ID NO: 2409153 - protein, 13 aa, Entamoeba dispar
KYRSCSGSPTEEI

SEQ ID NO: 2409154 - protein, 7 aa, Entamoeba dispar
KYSNPNT

SEQ ID NO: 2409155 - protein, 12 aa, Entamoeba dispar
KYTEGKKPTKAH

SEQ ID NO: 2409156 - protein, 14 aa, Entamoeba dispar
KYTKSDRKSYGNTI

SEQ ID NO: 2409157 - protein, 23 aa, Entamoeba dispar
KYTLNNGKCSNKEKNQNGKNEEI

SEQ ID NO: 2409158 - protein, 9 aa, Entamoeba dispar
KYTVKSSGI

SEQ ID NO: 2409159 - protein, 9 aa, Entamoeba dispar
LAKPQNDNH

SEQ ID NO: 2409160 - protein, 10 aa, Entamoeba dispar
LANGSTNTQM

SEQ ID NO: 2409161 - protein, 5 aa, Entamoeba dispar
LAPDQ

SEQ ID NO: 2409162 - protein, 6 aa, Entamoeba dispar
LAPKIP

SEQ ID NO: 2409163 - protein, 6 aa, Entamoeba dispar
LARDEK

SEQ ID NO: 2409164 - protein, 15 aa, Entamoeba dispar
LARTNEGEHKEEYNN

SEQ ID NO: 2409165 - protein, 14 aa, Entamoeba dispar
LATEKPKPQKRVER

SEQ ID NO: 2409166 - protein, 5 aa, Entamoeba dispar
LDALS

SEQ ID NO: 2409167 - protein, 10 aa, Entamoeba dispar
LDDSCPSTHN

SEQ ID NO: 2409168 - protein, 14 aa, Entamoeba dispar
LDDSSTYDLTPQGM

SEQ ID NO: 2409169 - protein, 28 aa, Entamoeba dispar
LDEKEQLINESSETEEVFSGTDGSNSVM

SEQ ID NO: 2409170 - protein, 5 aa, Entamoeba dispar
LDENT

SEQ ID NO: 2409171 - protein, 8 aa, Entamoeba dispar
LDESNEEI

SEQ ID NO: 2409172 - protein, 6 aa, Entamoeba dispar
LDGTNI

SEQ ID NO: 2409173 - protein, 6 aa, Entamoeba dispar
LDQPHE

SEQ ID NO: 2409174 - protein, 7 aa, Entamoeba dispar
LDREEYG

SEQ ID NO: 2409175 - protein, 10 aa, Entamoeba dispar
LDSYQDYNEL

SEQ ID NO: 2409176 - protein, 11 aa, Entamoeba dispar
LDTELDANDMK

SEQ ID NO: 2409177 - protein, 5 aa, Entamoeba dispar
LEAQN

SEQ ID NO: 2409178 - protein, 13 aa, Entamoeba dispar
LEEEGVDKRINNF

SEQ ID NO: 2409179 - protein, 8 aa, Entamoeba dispar
LEEEMREA

SEQ ID NO: 2409180 - protein, 40 aa, Entamoeba dispar
LEEENRDESGDENNDENNEEENEEENEEENGDISNSENTE

SEQ ID NO: 2409181 - protein, 8 aa, Entamoeba dispar
LEEEPHLN

SEQ ID NO: 2409182 - protein, 100 aa, Entamoeba dispar
LEEEQMKEGDESDNESSEKTKTKESNEINKRNESERSHSSSKKKNNSKGKKKGSKKKSGTKKQNVSPSINESKKSELLEPSSKPPSRPIPNNKRRTSIDP

SEQ ID NO: 2409183 - protein, 5 aa, Entamoeba dispar
LEERQ

SEQ ID NO: 2409184 - protein, 9 aa, Entamoeba dispar
LEETNKEDH

SEQ ID NO: 2409185 - protein, 9 aa, Entamoeba dispar
LEEVPSKRV

SEQ ID NO: 2409186 - protein, 6 aa, Entamoeba dispar
LEEYNS

SEQ ID NO: 2409187 - protein, 13 aa, Entamoeba dispar
LEEYQTDNPLGMT

SEQ ID NO: 2409188 - protein, 25 aa, Entamoeba dispar
LEGGKNKKSKKKDTSKPKHKKHVNK

SEQ ID NO: 2409189 - protein, 11 aa, Entamoeba dispar
LEKEGSSPHID

SEQ ID NO: 2409190 - protein, 13 aa, Entamoeba dispar
LEKGQIEKAESDF

SEQ ID NO: 2409191 - protein, 5 aa, Entamoeba dispar
LEKKR

SEQ ID NO: 2409192 - protein, 11 aa, Entamoeba dispar
LEKNKKDKDAK

SEQ ID NO: 2409193 - protein, 14 aa, Entamoeba dispar
LEKVESELKLNNEK

SEQ ID NO: 2409194 - protein, 14 aa, Entamoeba dispar
LEKYQSDNPLGMTT

SEQ ID NO: 2409195 - protein, 12 aa, Entamoeba dispar
LENGVSNEDRFD

SEQ ID NO: 2409196 - protein, 4 aa, Entamoeba dispar
LENK

SEQ ID NO: 2409197 - protein, 8 aa, Entamoeba dispar
LENKSEEW

SEQ ID NO: 2409198 - protein, 4 aa, Entamoeba dispar
LENN

SEQ ID NO: 2409199 - protein, 6 aa, Entamoeba dispar
LENPTS

SEQ ID NO: 2409200 - protein, 6 aa, Entamoeba dispar
LENTEQ

SEQ ID NO: 2409201 - protein, 4 aa, Entamoeba dispar
LEPN

SEQ ID NO: 2409202 - protein, 15 aa, Entamoeba dispar
LEQSGDQSKSQTSEV

SEQ ID NO: 2409203 - protein, 9 aa, Entamoeba dispar
LERESIEKT

SEQ ID NO: 2409204 - protein, 12 aa, Entamoeba dispar
LERQKKEEEELR

SEQ ID NO: 2409205 - protein, 5 aa, Entamoeba dispar
LESPY

SEQ ID NO: 2409206 - protein, 8 aa, Entamoeba dispar
LESTGNKT

SEQ ID NO: 2409207 - protein, 11 aa, Entamoeba dispar
LETDDIENHDT

SEQ ID NO: 2409208 - protein, 8 aa, Entamoeba dispar
LETTTTST

SEQ ID NO: 2409209 - protein, 12 aa, Entamoeba dispar
LGASENKEATFV

SEQ ID NO: 2409210 - protein, 9 aa, Entamoeba dispar
LGDGDLDEV

SEQ ID NO: 2409211 - protein, 4 aa, Entamoeba dispar
LGDK

SEQ ID NO: 2409212 - protein, 5 aa, Entamoeba dispar
LGDKD

SEQ ID NO: 2409213 - protein, 9 aa, Entamoeba dispar
LGDNDKKKT

SEQ ID NO: 2409214 - protein, 6 aa, Entamoeba dispar
LGEGSF

SEQ ID NO: 2409215 - protein, 4 aa, Entamoeba dispar
LGET

SEQ ID NO: 2409216 - protein, 6 aa, Entamoeba dispar
LGGNEK

SEQ ID NO: 2409217 - protein, 8 aa, Entamoeba dispar
LGGRDYSD

SEQ ID NO: 2409218 - protein, 11 aa, Entamoeba dispar
LGKQVASDEEM

SEQ ID NO: 2409219 - protein, 20 aa, Entamoeba dispar
LGKTRRDKKTNSSIVKSPNA

SEQ ID NO: 2409220 - protein, 8 aa, Entamoeba dispar
LGNGTTGY

SEQ ID NO: 2409221 - protein, 6 aa, Entamoeba dispar
LGNHPI

SEQ ID NO: 2409222 - protein, 5 aa, Entamoeba dispar
LGNYP

SEQ ID NO: 2409223 - protein, 7 aa, Entamoeba dispar
LGSTSEI

SEQ ID NO: 2409224 - protein, 5 aa, Entamoeba dispar
LGTTM

SEQ ID NO: 2409225 - protein, 7 aa, Entamoeba dispar
LGTTNPE

SEQ ID NO: 2409226 - protein, 6 aa, Entamoeba dispar
LGYAEN

SEQ ID NO: 2409227 - protein, 6 aa, Entamoeba dispar
LHSESG

SEQ ID NO: 2409228 - protein, 5 aa, Entamoeba dispar
LISKP

SEQ ID NO: 2409229 - protein, 8 aa, Entamoeba dispar
LKATEKEV

SEQ ID NO: 2409230 - protein, 25 aa, Entamoeba dispar
LKDRMKDSTKQISEKSIHKSSDNYN

SEQ ID NO: 2409231 - protein, 9 aa, Entamoeba dispar
LKEDKENNS

SEQ ID NO: 2409232 - protein, 15 aa, Entamoeba dispar
LKEEAETKKKTQTIQ

SEQ ID NO: 2409233 - protein, 6 aa, Entamoeba dispar
LKEEEI

SEQ ID NO: 2409234 - protein, 7 aa, Entamoeba dispar
LKEEEKK

SEQ ID NO: 2409235 - protein, 29 aa, Entamoeba dispar
LKEEKKVDKEEEKKLRKEHKKQYKIERRE

SEQ ID NO: 2409236 - protein, 9 aa, Entamoeba dispar
LKEKEKGNI

SEQ ID NO: 2409237 - protein, 15 aa, Entamoeba dispar
LKEKISDSQQFLSKD

SEQ ID NO: 2409238 - protein, 10 aa, Entamoeba dispar
LKEKKKGNIC

SEQ ID NO: 2409239 - protein, 9 aa, Entamoeba dispar
LKENESKRS

SEQ ID NO: 2409240 - protein, 12 aa, Entamoeba dispar
LKENKQIPRRCF

SEQ ID NO: 2409241 - protein, 4 aa, Entamoeba dispar
LKEQ

SEQ ID NO: 2409242 - protein, 10 aa, Entamoeba dispar
LKKDEIERTE

SEQ ID NO: 2409243 - protein, 32 aa, Entamoeba dispar
LKKERCKNCGSSEHTTKDCLERPKKYGCKSSV

SEQ ID NO: 2409244 - protein, 9 aa, Entamoeba dispar
LKKESAGVK

SEQ ID NO: 2409245 - protein, 11 aa, Entamoeba dispar
LKNHSQRPYPP

SEQ ID NO: 2409246 - protein, 7 aa, Entamoeba dispar
LKNKEGK

SEQ ID NO: 2409247 - protein, 8 aa, Entamoeba dispar
LKNNTTIN

SEQ ID NO: 2409248 - protein, 6 aa, Entamoeba dispar
LKNPKF

SEQ ID NO: 2409249 - protein, 8 aa, Entamoeba dispar
LKNPPTGI

SEQ ID NO: 2409250 - protein, 4 aa, Entamoeba dispar
LKNQ

SEQ ID NO: 2409251 - protein, 9 aa, Entamoeba dispar
LKPGDIPAE

SEQ ID NO: 2409252 - protein, 12 aa, Entamoeba dispar
LKPQRYQNNIQQ

SEQ ID NO: 2409253 - protein, 4 aa, Entamoeba dispar
LKQP

SEQ ID NO: 2409254 - protein, 9 aa, Entamoeba dispar
LKQSEMSKL

SEQ ID NO: 2409255 - protein, 6 aa, Entamoeba dispar
LKRGEY

SEQ ID NO: 2409256 - protein, 9 aa, Entamoeba dispar
LKTIRDGKS

SEQ ID NO: 2409257 - protein, 6 aa, Entamoeba dispar
LKVPSQ

SEQ ID NO: 2409258 - protein, 6 aa, Entamoeba dispar
LKYPEE

SEQ ID NO: 2409259 - protein, 12 aa, Entamoeba dispar
LLNTDSLKQTAS

SEQ ID NO: 2409260 - protein, 7 aa, Entamoeba dispar
LNEEEPR

SEQ ID NO: 2409261 - protein, 10 aa, Entamoeba dispar
LNEGEDVDEY

SEQ ID NO: 2409262 - protein, 4 aa, Entamoeba dispar
LNEI

SEQ ID NO: 2409263 - protein, 22 aa, Entamoeba dispar
LNGDENEMNNEEDNEDYDIEDY

SEQ ID NO: 2409264 - protein, 7 aa, Entamoeba dispar
LNGSELN

SEQ ID NO: 2409265 - protein, 11 aa, Entamoeba dispar
LNIGRSTSDDY

SEQ ID NO: 2409266 - protein, 10 aa, Entamoeba dispar
LNKNSSLSDI

SEQ ID NO: 2409267 - protein, 7 aa, Entamoeba dispar
LNKNSYL

SEQ ID NO: 2409268 - protein, 8 aa, Entamoeba dispar
LNKQLPNG

SEQ ID NO: 2409269 - protein, 11 aa, Entamoeba dispar
LNNAAAKKYDL

SEQ ID NO: 2409270 - protein, 7 aa, Entamoeba dispar
LNNPKYG

SEQ ID NO: 2409271 - protein, 5 aa, Entamoeba dispar
LNPGI

SEQ ID NO: 2409272 - protein, 4 aa, Entamoeba dispar
LNPY

SEQ ID NO: 2409273 - protein, 12 aa, Entamoeba dispar
LNQESEEFEPEE

SEQ ID NO: 2409274 - protein, 26 aa, Entamoeba dispar
LNQKDNKKELTSSKSKQNKKQETYQE

SEQ ID NO: 2409275 - protein, 7 aa, Entamoeba dispar
LNQPDEQ

SEQ ID NO: 2409276 - protein, 7 aa, Entamoeba dispar
LNQYGDY

SEQ ID NO: 2409277 - protein, 4 aa, Entamoeba dispar
LNSK

SEQ ID NO: 2409278 - protein, 11 aa, Entamoeba dispar
LNSSSNDGGLQ

SEQ ID NO: 2409279 - protein, 5 aa, Entamoeba dispar
LNTET

SEQ ID NO: 2409280 - protein, 8 aa, Entamoeba dispar
LNTPTQQV

SEQ ID NO: 2409281 - protein, 5 aa, Entamoeba dispar
LNVPE

SEQ ID NO: 2409282 - protein, 7 aa, Entamoeba dispar
LNYPPQI

SEQ ID NO: 2409283 - protein, 10 aa, Entamoeba dispar
LPASPGAATG

SEQ ID NO: 2409284 - protein, 12 aa, Entamoeba dispar
LPDGIQRRRTEI

SEQ ID NO: 2409285 - protein, 8 aa, Entamoeba dispar
LPDGTYGS

SEQ ID NO: 2409286 - protein, 11 aa, Entamoeba dispar
LPDSEKASIGM

SEQ ID NO: 2409287 - protein, 8 aa, Entamoeba dispar
LPDTIGKY

SEQ ID NO: 2409288 - protein, 11 aa, Entamoeba dispar
LPEDAVPSTLK

SEQ ID NO: 2409289 - protein, 4 aa, Entamoeba dispar
LPES

SEQ ID NO: 2409290 - protein, 5 aa, Entamoeba dispar
LPGDG

SEQ ID NO: 2409291 - protein, 9 aa, Entamoeba dispar
LPGRTANQI

SEQ ID NO: 2409292 - protein, 4 aa, Entamoeba dispar
LPHN

SEQ ID NO: 2409293 - protein, 9 aa, Entamoeba dispar
LPKNELGKQ

SEQ ID NO: 2409294 - protein, 9 aa, Entamoeba dispar
LPKNKKGGI

SEQ ID NO: 2409295 - protein, 7 aa, Entamoeba dispar
LPKPKDT

SEQ ID NO: 2409296 - protein, 9 aa, Entamoeba dispar
LPKPQDDNY

SEQ ID NO: 2409297 - protein, 9 aa, Entamoeba dispar
LPKTPTDMK

SEQ ID NO: 2409298 - protein, 4 aa, Entamoeba dispar
LPLS

SEQ ID NO: 2409299 - protein, 5 aa, Entamoeba dispar
LPPEL

SEQ ID NO: 2409300 - protein, 4 aa, Entamoeba dispar
LPPT

SEQ ID NO: 2409301 - protein, 5 aa, Entamoeba dispar
LPQEP

SEQ ID NO: 2409302 - protein, 7 aa, Entamoeba dispar
LPQPNHV

SEQ ID NO: 2409303 - protein, 4 aa, Entamoeba dispar
LPRS

SEQ ID NO: 2409304 - protein, 4 aa, Entamoeba dispar
LPSG

SEQ ID NO: 2409305 - protein, 4 aa, Entamoeba dispar
LPSS

SEQ ID NO: 2409306 - protein, 5 aa, Entamoeba dispar
LPSSE

SEQ ID NO: 2409307 - protein, 7 aa, Entamoeba dispar
LPSSITS

SEQ ID NO: 2409308 - protein, 5 aa, Entamoeba dispar
LPSSL

SEQ ID NO: 2409309 - protein, 6 aa, Entamoeba dispar
LPSSNY

SEQ ID NO: 2409310 - protein, 4 aa, Entamoeba dispar
LPST

SEQ ID NO: 2409311 - protein, 5 aa, Entamoeba dispar
LPTEK

SEQ ID NO: 2409312 - protein, 5 aa, Entamoeba dispar
LPTSL

SEQ ID NO: 2409313 - protein, 4 aa, Entamoeba dispar
LPTT

SEQ ID NO: 2409314 - protein, 6 aa, Entamoeba dispar
LPYSQR

SEQ ID NO: 2409315 - protein, 9 aa, Entamoeba dispar
LQEKEKRNI

SEQ ID NO: 2409316 - protein, 9 aa, Entamoeba dispar
LQEKESGNI

SEQ ID NO: 2409317 - protein, 8 aa, Entamoeba dispar
LQENKPPI

SEQ ID NO: 2409318 - protein, 10 aa, Entamoeba dispar
LQEPDSVEEI

SEQ ID NO: 2409319 - protein, 6 aa, Entamoeba dispar
LQEYNA

SEQ ID NO: 2409320 - protein, 9 aa, Entamoeba dispar
LQGTKDRKY

SEQ ID NO: 2409321 - protein, 7 aa, Entamoeba dispar
LQKNKEG

SEQ ID NO: 2409322 - protein, 9 aa, Entamoeba dispar
LQKTGSFKV

SEQ ID NO: 2409323 - protein, 9 aa, Entamoeba dispar
LQPNPQPYL

SEQ ID NO: 2409324 - protein, 6 aa, Entamoeba dispar
LQPSTQ

SEQ ID NO: 2409325 - protein, 17 aa, Entamoeba dispar
LQPVDETEARKGHHQKR

SEQ ID NO: 2409326 - protein, 30 aa, Entamoeba dispar
LQPVNLGNDSKINTNGYSIETHQPNTSKSF

SEQ ID NO: 2409327 - protein, 5 aa, Entamoeba dispar
LQSTQ

SEQ ID NO: 2409328 - protein, 4 aa, Entamoeba dispar
LRDE

SEQ ID NO: 2409329 - protein, 5 aa, Entamoeba dispar
LRDKR

SEQ ID NO: 2409330 - protein, 7 aa, Entamoeba dispar
LREDGDK

SEQ ID NO: 2409331 - protein, 23 aa, Entamoeba dispar
LREDNNKDHISKKEGEKMAKELK

SEQ ID NO: 2409332 - protein, 5 aa, Entamoeba dispar
LRESG

SEQ ID NO: 2409333 - protein, 17 aa, Entamoeba dispar
LRKDGSDDVTKQEGDDL

SEQ ID NO: 2409334 - protein, 9 aa, Entamoeba dispar
LRNNKENQE

SEQ ID NO: 2409335 - protein, 17 aa, Entamoeba dispar
LSADGYSGVEVRKNGSK

SEQ ID NO: 2409336 - protein, 4 aa, Entamoeba dispar
LSDE

SEQ ID NO: 2409337 - protein, 4 aa, Entamoeba dispar
LSDS

SEQ ID NO: 2409338 - protein, 5 aa, Entamoeba dispar
LSGMP

SEQ ID NO: 2409339 - protein, 8 aa, Entamoeba dispar
LSGNEEDS

SEQ ID NO: 2409340 - protein, 14 aa, Entamoeba dispar
LSGPSSLSDEEKYV

SEQ ID NO: 2409341 - protein, 4 aa, Entamoeba dispar
LSGR

SEQ ID NO: 2409342 - protein, 5 aa, Entamoeba dispar
LSGSD

SEQ ID NO: 2409343 - protein, 6 aa, Entamoeba dispar
LSKPEL

SEQ ID NO: 2409344 - protein, 10 aa, Entamoeba dispar
LSNENTLTKK

SEQ ID NO: 2409345 - protein, 11 aa, Entamoeba dispar
LSNGNDGISKL

SEQ ID NO: 2409346 - protein, 11 aa, Entamoeba dispar
LSNKDSTDPFS

SEQ ID NO: 2409347 - protein, 15 aa, Entamoeba dispar
LSNSKSPQPKQEKKL

SEQ ID NO: 2409348 - protein, 4 aa, Entamoeba dispar
LSPL

SEQ ID NO: 2409349 - protein, 5 aa, Entamoeba dispar
LSPNA

SEQ ID NO: 2409350 - protein, 4 aa, Entamoeba dispar
LSPP

SEQ ID NO: 2409351 - protein, 5 aa, Entamoeba dispar
LSPPF

SEQ ID NO: 2409352 - protein, 4 aa, Entamoeba dispar
LSPS

SEQ ID NO: 2409353 - protein, 5 aa, Entamoeba dispar
LSPSS

SEQ ID NO: 2409354 - protein, 5 aa, Entamoeba dispar
LSPST

SEQ ID NO: 2409355 - protein, 10 aa, Entamoeba dispar
LSQTEGPCCG

SEQ ID NO: 2409356 - protein, 14 aa, Entamoeba dispar
LSREPNQQEVPLTT

SEQ ID NO: 2409357 - protein, 8 aa, Entamoeba dispar
LSSDSNSN

SEQ ID NO: 2409358 - protein, 7 aa, Entamoeba dispar
LSSPRNL

SEQ ID NO: 2409359 - protein, 11 aa, Entamoeba dispar
LSSSSDKFNQQ

SEQ ID NO: 2409360 - protein, 10 aa, Entamoeba dispar
LSTGGDYSEE

SEQ ID NO: 2409361 - protein, 9 aa, Entamoeba dispar
LSTHTNPFE

SEQ ID NO: 2409362 - protein, 5 aa, Entamoeba dispar
LSYPN

SEQ ID NO: 2409363 - protein, 5 aa, Entamoeba dispar
LTASD

SEQ ID NO: 2409364 - protein, 6 aa, Entamoeba dispar
LTDGDN

SEQ ID NO: 2409365 - protein, 9 aa, Entamoeba dispar
LTDPSLDNN

SEQ ID NO: 2409366 - protein, 4 aa, Entamoeba dispar
LTDT

SEQ ID NO: 2409367 - protein, 4 aa, Entamoeba dispar
LTED

SEQ ID NO: 2409368 - protein, 45 aa, Entamoeba dispar
LTEEELKKEEEKKEKRRIQARQYREEKKRKEDAISNASQTIGGSI

SEQ ID NO: 2409369 - protein, 5 aa, Entamoeba dispar
LTEEL

SEQ ID NO: 2409370 - protein, 6 aa, Entamoeba dispar
LTEELK

SEQ ID NO: 2409371 - protein, 12 aa, Entamoeba dispar
LTEFPQEEVKKE

SEQ ID NO: 2409372 - protein, 5 aa, Entamoeba dispar
LTEIE

SEQ ID NO: 2409373 - protein, 5 aa, Entamoeba dispar
LTETQ

SEQ ID NO: 2409374 - protein, 7 aa, Entamoeba dispar
LTGENGF

SEQ ID NO: 2409375 - protein, 8 aa, Entamoeba dispar
LTGGQYAA

SEQ ID NO: 2409376 - protein, 8 aa, Entamoeba dispar
LTKGTKPH

SEQ ID NO: 2409377 - protein, 16 aa, Entamoeba dispar
LTNSDCDQILKALTSS

SEQ ID NO: 2409378 - protein, 4 aa, Entamoeba dispar
LTPQ

SEQ ID NO: 2409379 - protein, 11 aa, Entamoeba dispar
LTPTVNNATKI

SEQ ID NO: 2409380 - protein, 8 aa, Entamoeba dispar
LTQESTIG

SEQ ID NO: 2409381 - protein, 24 aa, Entamoeba dispar
LTQKSKSEKTEIKSEELKEEINNH

SEQ ID NO: 2409382 - protein, 4 aa, Entamoeba dispar
LTSI

SEQ ID NO: 2409383 - protein, 4 aa, Entamoeba dispar
LTSK

SEQ ID NO: 2409384 - protein, 6 aa, Entamoeba dispar
LTSRKI

SEQ ID NO: 2409385 - protein, 5 aa, Entamoeba dispar
LTTPF

SEQ ID NO: 2409386 - protein, 18 aa, Entamoeba dispar
LTTTTTNDSSQDQNSTSY

SEQ ID NO: 2409387 - protein, 6 aa, Entamoeba dispar
LVPEKS

SEQ ID NO: 2409388 - protein, 7 aa, Entamoeba dispar
LVTEENT

SEQ ID NO: 2409389 - protein, 10 aa, Entamoeba dispar
LYEEEREKYN

SEQ ID NO: 2409390 - protein, 10 aa, Entamoeba dispar
MAKQRQVQEA

SEQ ID NO: 2409391 - protein, 10 aa, Entamoeba dispar
MATAGKDGNI

SEQ ID NO: 2409392 - protein, 4 aa, Entamoeba dispar
MDAE

SEQ ID NO: 2409393 - protein, 9 aa, Entamoeba dispar
MDESNNETR

SEQ ID NO: 2409394 - protein, 6 aa, Entamoeba dispar
MDETIQ

SEQ ID NO: 2409395 - protein, 9 aa, Entamoeba dispar
MDNRPASAL

SEQ ID NO: 2409396 - protein, 4 aa, Entamoeba dispar
MEER

SEQ ID NO: 2409397 - protein, 11 aa, Entamoeba dispar
MEKYDKARLDK

SEQ ID NO: 2409398 - protein, 12 aa, Entamoeba dispar
MENEKTKREQLE

SEQ ID NO: 2409399 - protein, 7 aa, Entamoeba dispar
MEPVPTP

SEQ ID NO: 2409400 - protein, 4 aa, Entamoeba dispar
METG

SEQ ID NO: 2409401 - protein, 4 aa, Entamoeba dispar
MEYN

SEQ ID NO: 2409402 - protein, 5 aa, Entamoeba dispar
MGAEI

SEQ ID NO: 2409403 - protein, 10 aa, Entamoeba dispar
MGATPPRQSE

SEQ ID NO: 2409404 - protein, 12 aa, Entamoeba dispar
MGEETKNKEIID

SEQ ID NO: 2409405 - protein, 9 aa, Entamoeba dispar
MGKGGNSFE

SEQ ID NO: 2409406 - protein, 4 aa, Entamoeba dispar
MGNT

SEQ ID NO: 2409407 - protein, 20 aa, Entamoeba dispar
MHTDTKKKVTCNGGSEDQIA

SEQ ID NO: 2409408 - protein, 10 aa, Entamoeba dispar
MKDTQLGPNG

SEQ ID NO: 2409409 - protein, 22 aa, Entamoeba dispar
MKEEDERKKEQIELEKKQRADE

SEQ ID NO: 2409410 - protein, 8 aa, Entamoeba dispar
MKEEGADV

SEQ ID NO: 2409411 - protein, 7 aa, Entamoeba dispar
MKEEKGK

SEQ ID NO: 2409412 - protein, 15 aa, Entamoeba dispar
MKKDNNASVSLQQLW

SEQ ID NO: 2409413 - protein, 9 aa, Entamoeba dispar
MKNGQQPKK

SEQ ID NO: 2409414 - protein, 7 aa, Entamoeba dispar
MKQENRC

SEQ ID NO: 2409415 - protein, 7 aa, Entamoeba dispar
MKTTEKG

SEQ ID NO: 2409416 - protein, 20 aa, Entamoeba dispar
MLNGSRPQSVPNNYNQTELT

SEQ ID NO: 2409417 - protein, 7 aa, Entamoeba dispar
MNDEEVY

SEQ ID NO: 2409418 - protein, 7 aa, Entamoeba dispar
MNEEEEI

SEQ ID NO: 2409419 - protein, 9 aa, Entamoeba dispar
MNKPRKPTE

SEQ ID NO: 2409420 - protein, 6 aa, Entamoeba dispar
MNRTPL

SEQ ID NO: 2409421 - protein, 21 aa, Entamoeba dispar
MNSPDNTEPIRNSNNNEININ

SEQ ID NO: 2409422 - protein, 10 aa, Entamoeba dispar
MNTDNTSPIY

SEQ ID NO: 2409423 - protein, 14 aa, Entamoeba dispar
MNTGAGKIENGKKA

SEQ ID NO: 2409424 - protein, 15 aa, Entamoeba dispar
MPGTESLKKQQYYGH

SEQ ID NO: 2409425 - protein, 6 aa, Entamoeba dispar
MPNDSD

SEQ ID NO: 2409426 - protein, 8 aa, Entamoeba dispar
MPRPDERS

SEQ ID NO: 2409427 - protein, 5 aa, Entamoeba dispar
MPRPG

SEQ ID NO: 2409428 - protein, 5 aa, Entamoeba dispar
MPSSN

SEQ ID NO: 2409429 - protein, 13 aa, Entamoeba dispar
MPTFGKDKKKAEL

SEQ ID NO: 2409430 - protein, 8 aa, Entamoeba dispar
MRTPDPSK

SEQ ID NO: 2409431 - protein, 12 aa, Entamoeba dispar
MSPKSHDEDDYK

SEQ ID NO: 2409432 - protein, 16 aa, Entamoeba dispar
MSSNHDSDSNSNSNTN

SEQ ID NO: 2409433 - protein, 25 aa, Entamoeba dispar
MSSSVEYNPTRKTFKYKPKTNATNI

SEQ ID NO: 2409434 - protein, 11 aa, Entamoeba dispar
MSTTPGIGPKV

SEQ ID NO: 2409435 - protein, 11 aa, Entamoeba dispar
MTPEERAQQVP

SEQ ID NO: 2409436 - protein, 7 aa, Entamoeba dispar
MTPEESR

SEQ ID NO: 2409437 - protein, 7 aa, Entamoeba dispar
MVTGGGA

SEQ ID NO: 2409438 - protein, 6 aa, Entamoeba dispar
MYGGNV

SEQ ID NO: 2409439 - protein, 7 aa, Entamoeba dispar
NAAGTVG

SEQ ID NO: 2409440 - protein, 9 aa, Entamoeba dispar
NAGISAEDF

SEQ ID NO: 2409441 - protein, 6 aa, Entamoeba dispar
NAGKTT

SEQ ID NO: 2409442 - protein, 7 aa, Entamoeba dispar
NAGLDAT

SEQ ID NO: 2409443 - protein, 10 aa, Entamoeba dispar
NAIKEERDEL

SEQ ID NO: 2409444 - protein, 7 aa, Entamoeba dispar
NAKEELS

SEQ ID NO: 2409445 - protein, 10 aa, Entamoeba dispar
NAKNRDEQTP

SEQ ID NO: 2409446 - protein, 4 aa, Entamoeba dispar
NALD

SEQ ID NO: 2409447 - protein, 9 aa, Entamoeba dispar
NALDGGSNQ

SEQ ID NO: 2409448 - protein, 6 aa, Entamoeba dispar
NAMEDG

SEQ ID NO: 2409449 - protein, 4 aa, Entamoeba dispar
NANS

SEQ ID NO: 2409450 - protein, 7 aa, Entamoeba dispar
NANTSTV

SEQ ID NO: 2409451 - protein, 8 aa, Entamoeba dispar
NASKPRLI

SEQ ID NO: 2409452 - protein, 11 aa, Entamoeba dispar
NASNSNKNTNL

SEQ ID NO: 2409453 - protein, 8 aa, Entamoeba dispar
NATGAEIQ

SEQ ID NO: 2409454 - protein, 11 aa, Entamoeba dispar
NAYISKHNEGD

SEQ ID NO: 2409455 - protein, 5 aa, Entamoeba dispar
NCGNE

SEQ ID NO: 2409456 - protein, 11 aa, Entamoeba dispar
NDAALGSGGLG

SEQ ID NO: 2409457 - protein, 4 aa, Entamoeba dispar
NDDI

SEQ ID NO: 2409458 - protein, 4 aa, Entamoeba dispar
NDDP

SEQ ID NO: 2409459 - protein, 16 aa, Entamoeba dispar
NDDSASDSEKEEIQRK

SEQ ID NO: 2409460 - protein, 5 aa, Entamoeba dispar
NDEFS

SEQ ID NO: 2409461 - protein, 4 aa, Entamoeba dispar
NDEL

SEQ ID NO: 2409462 - protein, 24 aa, Entamoeba dispar
NDESNNKKEEHMKEEEENKERTKM

SEQ ID NO: 2409463 - protein, 23 aa, Entamoeba dispar
NDEVPEKRKRKSTKQEGTPQPKV

SEQ ID NO: 2409464 - protein, 5 aa, Entamoeba dispar
NDFKL

SEQ ID NO: 2409465 - protein, 6 aa, Entamoeba dispar
NDFTTE

SEQ ID NO: 2409466 - protein, 4 aa, Entamoeba dispar
NDGI

SEQ ID NO: 2409467 - protein, 4 aa, Entamoeba dispar
NDIF

SEQ ID NO: 2409468 - protein, 20 aa, Entamoeba dispar
NDKEANTTRHRGTESIKPPE

SEQ ID NO: 2409469 - protein, 4 aa, Entamoeba dispar
NDKI

SEQ ID NO: 2409470 - protein, 14 aa, Entamoeba dispar
NDKQYNRSKEAQIN

SEQ ID NO: 2409471 - protein, 4 aa, Entamoeba dispar
NDKT

SEQ ID NO: 2409472 - protein, 9 aa, Entamoeba dispar
NDKTNVKIR

SEQ ID NO: 2409473 - protein, 7 aa, Entamoeba dispar
NDLEGSK

SEQ ID NO: 2409474 - protein, 9 aa, Entamoeba dispar
NDNIEKSNL

SEQ ID NO: 2409475 - protein, 4 aa, Entamoeba dispar
NDPE

SEQ ID NO: 2409476 - protein, 17 aa, Entamoeba dispar
NDPKTCNKRGKLYDQKE

SEQ ID NO: 2409477 - protein, 8 aa, Entamoeba dispar
NDPRLDPR

SEQ ID NO: 2409478 - protein, 11 aa, Entamoeba dispar
NDRDRIGEARE

SEQ ID NO: 2409479 - protein, 7 aa, Entamoeba dispar
NDRQRNA

SEQ ID NO: 2409480 - protein, 4 aa, Entamoeba dispar
NDRT

SEQ ID NO: 2409481 - protein, 5 aa, Entamoeba dispar
NDTNS

SEQ ID NO: 2409482 - protein, 4 aa, Entamoeba dispar
NDTT

SEQ ID NO: 2409483 - protein, 13 aa, Entamoeba dispar
NDVEKVSQSAANI

SEQ ID NO: 2409484 - protein, 6 aa, Entamoeba dispar
NEARTI

SEQ ID NO: 2409485 - protein, 12 aa, Entamoeba dispar
NEASSGVTAEQM

SEQ ID NO: 2409486 - protein, 4 aa, Entamoeba dispar
NEDS

SEQ ID NO: 2409487 - protein, 14 aa, Entamoeba dispar
NEDTLKNASNRISE

SEQ ID NO: 2409488 - protein, 8 aa, Entamoeba dispar
NEDTTTSI

SEQ ID NO: 2409489 - protein, 4 aa, Entamoeba dispar
NEED

SEQ ID NO: 2409490 - protein, 10 aa, Entamoeba dispar
NEEEEELNGG

SEQ ID NO: 2409491 - protein, 41 aa, Entamoeba dispar
NEEEEGYVTERRKQLDAIKNNTKYDYEEEQKKEEESKKIQV

SEQ ID NO: 2409492 - protein, 6 aa, Entamoeba dispar
NEEEKE

SEQ ID NO: 2409493 - protein, 16 aa, Entamoeba dispar
NEEKIKNKALQEELTS

SEQ ID NO: 2409494 - protein, 16 aa, Entamoeba dispar
NEEKPIKQDKSEKEMM

SEQ ID NO: 2409495 - protein, 6 aa, Entamoeba dispar
NEEKVT

SEQ ID NO: 2409496 - protein, 10 aa, Entamoeba dispar
NEENSSSNIV

SEQ ID NO: 2409497 - protein, 7 aa, Entamoeba dispar
NEETYQE

SEQ ID NO: 2409498 - protein, 8 aa, Entamoeba dispar
NEEVPHEG

SEQ ID NO: 2409499 - protein, 6 aa, Entamoeba dispar
NEGKDV

SEQ ID NO: 2409500 - protein, 7 aa, Entamoeba dispar
NEGPNHG

SEQ ID NO: 2409501 - protein, 6 aa, Entamoeba dispar
NEGSHE

SEQ ID NO: 2409502 - protein, 5 aa, Entamoeba dispar
NEGVE

SEQ ID NO: 2409503 - protein, 7 aa, Entamoeba dispar
NEHDTDV

SEQ ID NO: 2409504 - protein, 6 aa, Entamoeba dispar
NEIEKN

SEQ ID NO: 2409505 - protein, 6 aa, Entamoeba dispar
NEIKKT

SEQ ID NO: 2409506 - protein, 19 aa, Entamoeba dispar
NEINKKEVELGEGFMEIEE

SEQ ID NO: 2409507 - protein, 10 aa, Entamoeba dispar
NEIPNDITNT

SEQ ID NO: 2409508 - protein, 5 aa, Entamoeba dispar
NEIQE

SEQ ID NO: 2409509 - protein, 4 aa, Entamoeba dispar
NEKE

SEQ ID NO: 2409510 - protein, 14 aa, Entamoeba dispar
NEKEEVSQECNELK

SEQ ID NO: 2409511 - protein, 4 aa, Entamoeba dispar
NEKG

SEQ ID NO: 2409512 - protein, 6 aa, Entamoeba dispar
NEKGEW

SEQ ID NO: 2409513 - protein, 8 aa, Entamoeba dispar
NEKKQAQI

SEQ ID NO: 2409514 - protein, 4 aa, Entamoeba dispar
NEKT

SEQ ID NO: 2409515 - protein, 9 aa, Entamoeba dispar
NELPPKEQA

SEQ ID NO: 2409516 - protein, 8 aa, Entamoeba dispar
NEMPPVGK

SEQ ID NO: 2409517 - protein, 6 aa, Entamoeba dispar
NEMRNK

SEQ ID NO: 2409518 - protein, 8 aa, Entamoeba dispar
NENKEYLD

SEQ ID NO: 2409519 - protein, 11 aa, Entamoeba dispar
NENNDKSKFQM

SEQ ID NO: 2409520 - protein, 5 aa, Entamoeba dispar
NENNI

SEQ ID NO: 2409521 - protein, 5 aa, Entamoeba dispar
NEPTL

SEQ ID NO: 2409522 - protein, 4 aa, Entamoeba dispar
NEQR

SEQ ID NO: 2409523 - protein, 6 aa, Entamoeba dispar
NERERN

SEQ ID NO: 2409524 - protein, 9 aa, Entamoeba dispar
NERKYADDQ

SEQ ID NO: 2409525 - protein, 8 aa, Entamoeba dispar
NERLEEDR

SEQ ID NO: 2409526 - protein, 11 aa, Entamoeba dispar
NESLQANHASI

SEQ ID NO: 2409527 - protein, 8 aa, Entamoeba dispar
NESTKELK

SEQ ID NO: 2409528 - protein, 8 aa, Entamoeba dispar
NESTSIKS

SEQ ID NO: 2409529 - protein, 10 aa, Entamoeba dispar
NESVNGIGPN

SEQ ID NO: 2409530 - protein, 11 aa, Entamoeba dispar
NETADKVKEYL

SEQ ID NO: 2409531 - protein, 5 aa, Entamoeba dispar
NETGL

SEQ ID NO: 2409532 - protein, 6 aa, Entamoeba dispar
NETHPI

SEQ ID NO: 2409533 - protein, 6 aa, Entamoeba dispar
NETSPE

SEQ ID NO: 2409534 - protein, 12 aa, Entamoeba dispar
NEVNKDDEQKPI

SEQ ID NO: 2409535 - protein, 21 aa, Entamoeba dispar
NEYKVNEKEAIAYSQKANDAM

SEQ ID NO: 2409536 - protein, 8 aa, Entamoeba dispar
NFDSPSSF

SEQ ID NO: 2409537 - protein, 4 aa, Entamoeba dispar
NFQE

SEQ ID NO: 2409538 - protein, 6 aa, Entamoeba dispar
NGANNE

SEQ ID NO: 2409539 - protein, 10 aa, Entamoeba dispar
NGDKVGKAPY

SEQ ID NO: 2409540 - protein, 11 aa, Entamoeba dispar
NGDPNGKDEEF

SEQ ID NO: 2409541 - protein, 4 aa, Entamoeba dispar
NGGD

SEQ ID NO: 2409542 - protein, 7 aa, Entamoeba dispar
NGGYSSQ

SEQ ID NO: 2409543 - protein, 9 aa, Entamoeba dispar
NGIPNNNKL

SEQ ID NO: 2409544 - protein, 4 aa, Entamoeba dispar
NGIS

SEQ ID NO: 2409545 - protein, 15 aa, Entamoeba dispar
NGKAAPESLGRPRDY

SEQ ID NO: 2409546 - protein, 4 aa, Entamoeba dispar
NGKI

SEQ ID NO: 2409547 - protein, 9 aa, Entamoeba dispar
NGKNIEKKD

SEQ ID NO: 2409548 - protein, 7 aa, Entamoeba dispar
NGKNNGL

SEQ ID NO: 2409549 - protein, 6 aa, Entamoeba dispar
NGKPAE

SEQ ID NO: 2409550 - protein, 19 aa, Entamoeba dispar
NGKPSGERQLNKNSSLSDI

SEQ ID NO: 2409551 - protein, 4 aa, Entamoeba dispar
NGKT

SEQ ID NO: 2409552 - protein, 8 aa, Entamoeba dispar
NGKTQQTI

SEQ ID NO: 2409553 - protein, 10 aa, Entamoeba dispar
NGKVSEEDAK

SEQ ID NO: 2409554 - protein, 8 aa, Entamoeba dispar
NGLREKTA

SEQ ID NO: 2409555 - protein, 4 aa, Entamoeba dispar
NGNI

SEQ ID NO: 2409556 - protein, 6 aa, Entamoeba dispar
NGNQYS

SEQ ID NO: 2409557 - protein, 6 aa, Entamoeba dispar
NGNSNA

SEQ ID NO: 2409558 - protein, 12 aa, Entamoeba dispar
NGPENSPYEGGK

SEQ ID NO: 2409559 - protein, 6 aa, Entamoeba dispar
NGQHDQ

SEQ ID NO: 2409560 - protein, 11 aa, Entamoeba dispar
NGQPINPANRV

SEQ ID NO: 2409561 - protein, 6 aa, Entamoeba dispar
NGQSIE

SEQ ID NO: 2409562 - protein, 16 aa, Entamoeba dispar
NGRAGTDGTTESPEYT

SEQ ID NO: 2409563 - protein, 5 aa, Entamoeba dispar
NGRHV

SEQ ID NO: 2409564 - protein, 6 aa, Entamoeba dispar
NGRLKP

SEQ ID NO: 2409565 - protein, 7 aa, Entamoeba dispar
NGRRDTS

SEQ ID NO: 2409566 - protein, 7 aa, Entamoeba dispar
NGRYSGQ

SEQ ID NO: 2409567 - protein, 4 aa, Entamoeba dispar
NGSC

SEQ ID NO: 2409568 - protein, 14 aa, Entamoeba dispar
NGSFSQAAKTEQEI

SEQ ID NO: 2409569 - protein, 8 aa, Entamoeba dispar
NGSTSLTS

SEQ ID NO: 2409570 - protein, 4 aa, Entamoeba dispar
NGSY

SEQ ID NO: 2409571 - protein, 9 aa, Entamoeba dispar
NGTEIPQEN

SEQ ID NO: 2409572 - protein, 11 aa, Entamoeba dispar
NGTEIQNKTFP

SEQ ID NO: 2409573 - protein, 4 aa, Entamoeba dispar
NGTG

SEQ ID NO: 2409574 - protein, 8 aa, Entamoeba dispar
NGTNECSL

SEQ ID NO: 2409575 - protein, 10 aa, Entamoeba dispar
NGVEPSDEYH

SEQ ID NO: 2409576 - protein, 6 aa, Entamoeba dispar
NGVTPR

SEQ ID NO: 2409577 - protein, 20 aa, Entamoeba dispar
NGYKIQNNQCNGDKEDQCYY

SEQ ID NO: 2409578 - protein, 78 aa, Entamoeba dispar
NGYSPRRGVRREEPYLSPRRDIRREEPYLSPRRDIRREEPYLSPRREMRRDEPYLSPRRDIRREDESGMFSPRSRSEM

SEQ ID NO: 2409579 - protein, 7 aa, Entamoeba dispar
NHAPKNR

SEQ ID NO: 2409580 - protein, 4 aa, Entamoeba dispar
NHED

SEQ ID NO: 2409581 - protein, 4 aa, Entamoeba dispar
NHEN

SEQ ID NO: 2409582 - protein, 7 aa, Entamoeba dispar
NHESRQI

SEQ ID NO: 2409583 - protein, 6 aa, Entamoeba dispar
NHFNTE

SEQ ID NO: 2409584 - protein, 13 aa, Entamoeba dispar
NHSNEDTDKQRLS

SEQ ID NO: 2409585 - protein, 13 aa, Entamoeba dispar
NIDTSKWKKEEDE

SEQ ID NO: 2409586 - protein, 13 aa, Entamoeba dispar
NIEEEKRKVEEEL

SEQ ID NO: 2409587 - protein, 6 aa, Entamoeba dispar
NIEKKD

SEQ ID NO: 2409588 - protein, 6 aa, Entamoeba dispar
NIETRT

SEQ ID NO: 2409589 - protein, 10 aa, Entamoeba dispar
NIGSNEQRFG

SEQ ID NO: 2409590 - protein, 13 aa, Entamoeba dispar
NIKLKKESGITKD

SEQ ID NO: 2409591 - protein, 4 aa, Entamoeba dispar
NIKT

SEQ ID NO: 2409592 - protein, 7 aa, Entamoeba dispar
NILEQGS

SEQ ID NO: 2409593 - protein, 13 aa, Entamoeba dispar
NINQPKSKVASEA

SEQ ID NO: 2409594 - protein, 6 aa, Entamoeba dispar
NINRAT

SEQ ID NO: 2409595 - protein, 6 aa, Entamoeba dispar
NIPIEG

SEQ ID NO: 2409596 - protein, 4 aa, Entamoeba dispar
NIPQ

SEQ ID NO: 2409597 - protein, 9 aa, Entamoeba dispar
NIPSPISEI

SEQ ID NO: 2409598 - protein, 12 aa, Entamoeba dispar
NIPSSASKLDNK

SEQ ID NO: 2409599 - protein, 7 aa, Entamoeba dispar
NIPSSIN

SEQ ID NO: 2409600 - protein, 8 aa, Entamoeba dispar
NIPSSISE

SEQ ID NO: 2409601 - protein, 10 aa, Entamoeba dispar
NIPSSISELG

SEQ ID NO: 2409602 - protein, 10 aa, Entamoeba dispar
NIPSSISKIG

SEQ ID NO: 2409603 - protein, 9 aa, Entamoeba dispar
NIPSSISKL

SEQ ID NO: 2409604 - protein, 7 aa, Entamoeba dispar
NIPSSVS

SEQ ID NO: 2409605 - protein, 9 aa, Entamoeba dispar
NIPSSVSKF

SEQ ID NO: 2409606 - protein, 11 aa, Entamoeba dispar
NIPSSVSKIGD

SEQ ID NO: 2409607 - protein, 12 aa, Entamoeba dispar
NIPSSVSKIGNG

SEQ ID NO: 2409608 - protein, 9 aa, Entamoeba dispar
NIPSTISKI

SEQ ID NO: 2409609 - protein, 7 aa, Entamoeba dispar
NIPTNNS

SEQ ID NO: 2409610 - protein, 7 aa, Entamoeba dispar
NIPTSVS

SEQ ID NO: 2409611 - protein, 9 aa, Entamoeba dispar
NIPTSVSKI

SEQ ID NO: 2409612 - protein, 10 aa, Entamoeba dispar
NIPTSVSKLG

SEQ ID NO: 2409613 - protein, 7 aa, Entamoeba dispar
NIPTTVK

SEQ ID NO: 2409614 - protein, 4 aa, Entamoeba dispar
NIQQ

SEQ ID NO: 2409615 - protein, 7 aa, Entamoeba dispar
NISNDGK

SEQ ID NO: 2409616 - protein, 4 aa, Entamoeba dispar
NISR

SEQ ID NO: 2409617 - protein, 4 aa, Entamoeba dispar
NISS

SEQ ID NO: 2409618 - protein, 14 aa, Entamoeba dispar
NITGEKVKFAFPVV

SEQ ID NO: 2409619 - protein, 10 aa, Entamoeba dispar
NITGNEKCNT

SEQ ID NO: 2409620 - protein, 11 aa, Entamoeba dispar
NITSSRGKTVT

SEQ ID NO: 2409621 - protein, 13 aa, Entamoeba dispar
NIVSQASSLDKPE

SEQ ID NO: 2409622 - protein, 9 aa, Entamoeba dispar
NKAIPEGRR

SEQ ID NO: 2409623 - protein, 7 aa, Entamoeba dispar
NKDPERF

SEQ ID NO: 2409624 - protein, 8 aa, Entamoeba dispar
NKDRLGTC

SEQ ID NO: 2409625 - protein, 4 aa, Entamoeba dispar
NKDS

SEQ ID NO: 2409626 - protein, 4 aa, Entamoeba dispar
NKEE

SEQ ID NO: 2409627 - protein, 7 aa, Entamoeba dispar
NKEEDFK

SEQ ID NO: 2409628 - protein, 6 aa, Entamoeba dispar
NKEETF

SEQ ID NO: 2409629 - protein, 4 aa, Entamoeba dispar
NKEL

SEQ ID NO: 2409630 - protein, 4 aa, Entamoeba dispar
NKEQ

SEQ ID NO: 2409631 - protein, 4 aa, Entamoeba dispar
NKET

SEQ ID NO: 2409632 - protein, 7 aa, Entamoeba dispar
NKEWSSI

SEQ ID NO: 2409633 - protein, 10 aa, Entamoeba dispar
NKFGAEDMRE

SEQ ID NO: 2409634 - protein, 5 aa, Entamoeba dispar
NKGEE

SEQ ID NO: 2409635 - protein, 10 aa, Entamoeba dispar
NKGKQYVTSD

SEQ ID NO: 2409636 - protein, 8 aa, Entamoeba dispar
NKIDKITP

SEQ ID NO: 2409637 - protein, 8 aa, Entamoeba dispar
NKIDSSND

SEQ ID NO: 2409638 - protein, 8 aa, Entamoeba dispar
NKIGDNND

SEQ ID NO: 2409639 - protein, 6 aa, Entamoeba dispar
NKINEN

SEQ ID NO: 2409640 - protein, 8 aa, Entamoeba dispar
NKIPSEVK

SEQ ID NO: 2409641 - protein, 11 aa, Entamoeba dispar
NKITTIPNGMS

SEQ ID NO: 2409642 - protein, 9 aa, Entamoeba dispar
NKKEHNSEA

SEQ ID NO: 2409643 - protein, 26 aa, Entamoeba dispar
NKKEKVKERVEKKKQENEEEKTKEEI

SEQ ID NO: 2409644 - protein, 17 aa, Entamoeba dispar
NKKGQQNELVEKKKTRR

SEQ ID NO: 2409645 - protein, 10 aa, Entamoeba dispar
NKKGQYPDGV

SEQ ID NO: 2409646 - protein, 20 aa, Entamoeba dispar
NKKKVDKKTFEKFKTKEENP

SEQ ID NO: 2409647 - protein, 15 aa, Entamoeba dispar
NKKPGILTHSGGNPV

SEQ ID NO: 2409648 - protein, 7 aa, Entamoeba dispar
NKKSEEG

SEQ ID NO: 2409649 - protein, 8 aa, Entamoeba dispar
NKKTETDK

SEQ ID NO: 2409650 - protein, 13 aa, Entamoeba dispar
NKLDTENISLKNE

SEQ ID NO: 2409651 - protein, 8 aa, Entamoeba dispar
NKMDASKN

SEQ ID NO: 2409652 - protein, 7 aa, Entamoeba dispar
NKNEEEI

SEQ ID NO: 2409653 - protein, 9 aa, Entamoeba dispar
NKNERTGKE

SEQ ID NO: 2409654 - protein, 4 aa, Entamoeba dispar
NKNI

SEQ ID NO: 2409655 - protein, 6 aa, Entamoeba dispar
NKNKKT

SEQ ID NO: 2409656 - protein, 4 aa, Entamoeba dispar
NKPA

SEQ ID NO: 2409657 - protein, 9 aa, Entamoeba dispar
NKPPSFKNP

SEQ ID NO: 2409658 - protein, 4 aa, Entamoeba dispar
NKPS

SEQ ID NO: 2409659 - protein, 6 aa, Entamoeba dispar
NKQNNF

SEQ ID NO: 2409660 - protein, 16 aa, Entamoeba dispar
NKRETDAELDKLSNEN

SEQ ID NO: 2409661 - protein, 6 aa, Entamoeba dispar
NKRGEA

SEQ ID NO: 2409662 - protein, 7 aa, Entamoeba dispar
NKRNQRV

SEQ ID NO: 2409663 - protein, 8 aa, Entamoeba dispar
NKRTQREI

SEQ ID NO: 2409664 - protein, 9 aa, Entamoeba dispar
NKRYGKKTE

SEQ ID NO: 2409665 - protein, 27 aa, Entamoeba dispar
NKSEEMKMEEENQENNINEQKEINESL

SEQ ID NO: 2409666 - protein, 4 aa, Entamoeba dispar
NKSI

SEQ ID NO: 2409667 - protein, 4 aa, Entamoeba dispar
NKSK

SEQ ID NO: 2409668 - protein, 7 aa, Entamoeba dispar
NKSQNEI

SEQ ID NO: 2409669 - protein, 8 aa, Entamoeba dispar
NKSSTKLY

SEQ ID NO: 2409670 - protein, 10 aa, Entamoeba dispar
NKTATGKAIE

SEQ ID NO: 2409671 - protein, 4 aa, Entamoeba dispar
NKTC

SEQ ID NO: 2409672 - protein, 14 aa, Entamoeba dispar
NKTDDNDNGDKKLN

SEQ ID NO: 2409673 - protein, 7 aa, Entamoeba dispar
NKTDLAA

SEQ ID NO: 2409674 - protein, 5 aa, Entamoeba dispar
NKTIN

SEQ ID NO: 2409675 - protein, 7 aa, Entamoeba dispar
NKTTDEF

SEQ ID NO: 2409676 - protein, 4 aa, Entamoeba dispar
NKVD

SEQ ID NO: 2409677 - protein, 6 aa, Entamoeba dispar
NKVKSP

SEQ ID NO: 2409678 - protein, 9 aa, Entamoeba dispar
NKVNKKNAW

SEQ ID NO: 2409679 - protein, 8 aa, Entamoeba dispar
NKYGKDDI

SEQ ID NO: 2409680 - protein, 5 aa, Entamoeba dispar
NKYTD

SEQ ID NO: 2409681 - protein, 8 aa, Entamoeba dispar
NLDGRRKV

SEQ ID NO: 2409682 - protein, 16 aa, Entamoeba dispar
NLEQSKDQSKSQTSEV

SEQ ID NO: 2409683 - protein, 7 aa, Entamoeba dispar
NLGPKGT

SEQ ID NO: 2409684 - protein, 13 aa, Entamoeba dispar
NLGSYSREQINKI

SEQ ID NO: 2409685 - protein, 4 aa, Entamoeba dispar
NLID

SEQ ID NO: 2409686 - protein, 10 aa, Entamoeba dispar
NLKNEKGMDT

SEQ ID NO: 2409687 - protein, 16 aa, Entamoeba dispar
NLKQNRDQSKSQTSEV

SEQ ID NO: 2409688 - protein, 8 aa, Entamoeba dispar
NLKTTKTL

SEQ ID NO: 2409689 - protein, 7 aa, Entamoeba dispar
NLPPTIS

SEQ ID NO: 2409690 - protein, 14 aa, Entamoeba dispar
NLQTINGKNIEKKD

SEQ ID NO: 2409691 - protein, 16 aa, Entamoeba dispar
NLTDSSDKKTLAESKR

SEQ ID NO: 2409692 - protein, 7 aa, Entamoeba dispar
NLTEDGR

SEQ ID NO: 2409693 - protein, 13 aa, Entamoeba dispar
NLTTKEVKEINKI

SEQ ID NO: 2409694 - protein, 4 aa, Entamoeba dispar
NMKG

SEQ ID NO: 2409695 - protein, 13 aa, Entamoeba dispar
NNAVYSEPSYEEF

SEQ ID NO: 2409696 - protein, 6 aa, Entamoeba dispar
NNDGTI

SEQ ID NO: 2409697 - protein, 7 aa, Entamoeba dispar
NNDKTID

SEQ ID NO: 2409698 - protein, 5 aa, Entamoeba dispar
NNDPH

SEQ ID NO: 2409699 - protein, 5 aa, Entamoeba dispar
NNEFN

SEQ ID NO: 2409700 - protein, 5 aa, Entamoeba dispar
NNESL

SEQ ID NO: 2409701 - protein, 5 aa, Entamoeba dispar
NNETG

SEQ ID NO: 2409702 - protein, 8 aa, Entamoeba dispar
NNFSATGN

SEQ ID NO: 2409703 - protein, 5 aa, Entamoeba dispar
NNGEI

SEQ ID NO: 2409704 - protein, 5 aa, Entamoeba dispar
NNGTK

SEQ ID NO: 2409705 - protein, 8 aa, Entamoeba dispar
NNHIKGQE

SEQ ID NO: 2409706 - protein, 5 aa, Entamoeba dispar
NNIRS

SEQ ID NO: 2409707 - protein, 16 aa, Entamoeba dispar
NNKETLFNNQDNRSKI

SEQ ID NO: 2409708 - protein, 4 aa, Entamoeba dispar
NNKI

SEQ ID NO: 2409709 - protein, 12 aa, Entamoeba dispar
NNKKEKKGPVSI

SEQ ID NO: 2409710 - protein, 4 aa, Entamoeba dispar
NNKL

SEQ ID NO: 2409711 - protein, 7 aa, Entamoeba dispar
NNKNEPI

SEQ ID NO: 2409712 - protein, 6 aa, Entamoeba dispar
NNKTKE

SEQ ID NO: 2409713 - protein, 10 aa, Entamoeba dispar
NNLKEKEIKA

SEQ ID NO: 2409714 - protein, 16 aa, Entamoeba dispar
NNLPNSKLYNSYDTSR

SEQ ID NO: 2409715 - protein, 17 aa, Entamoeba dispar
NNMNKNKTRREQTERKR

SEQ ID NO: 2409716 - protein, 8 aa, Entamoeba dispar
NNNDEKEY

SEQ ID NO: 2409717 - protein, 8 aa, Entamoeba dispar
NNNKQNQT

SEQ ID NO: 2409718 - protein, 24 aa, Entamoeba dispar
NNNSEEVQHPEQQQSSEQTDENPI

SEQ ID NO: 2409719 - protein, 17 aa, Entamoeba dispar
NNNTPLGRTIKTINITQ

SEQ ID NO: 2409720 - protein, 6 aa, Entamoeba dispar
NNNTYN

SEQ ID NO: 2409721 - protein, 4 aa, Entamoeba dispar
NNPI

SEQ ID NO: 2409722 - protein, 13 aa, Entamoeba dispar
NNPIKGRNNQEEI

SEQ ID NO: 2409723 - protein, 5 aa, Entamoeba dispar
NNPPL

SEQ ID NO: 2409724 - protein, 6 aa, Entamoeba dispar
NNPQDL

SEQ ID NO: 2409725 - protein, 7 aa, Entamoeba dispar
NNPSLDE

SEQ ID NO: 2409726 - protein, 4 aa, Entamoeba dispar
NNPT

SEQ ID NO: 2409727 - protein, 14 aa, Entamoeba dispar
NNQNELTNQINERT

SEQ ID NO: 2409728 - protein, 20 aa, Entamoeba dispar
NNQNGSKEEYEKKKEEIEKE

SEQ ID NO: 2409729 - protein, 21 aa, Entamoeba dispar
NNQNGSKEEYEKKKEEIEKEI

SEQ ID NO: 2409730 - protein, 7 aa, Entamoeba dispar
NNQVCPK

SEQ ID NO: 2409731 - protein, 10 aa, Entamoeba dispar
NNQVPQTKQD

SEQ ID NO: 2409732 - protein, 11 aa, Entamoeba dispar
NNSLSNEQRQK

SEQ ID NO: 2409733 - protein, 6 aa, Entamoeba dispar
NNSPLT

SEQ ID NO: 2409734 - protein, 4 aa, Entamoeba dispar
NNTA

SEQ ID NO: 2409735 - protein, 5 aa, Entamoeba dispar
NNTID

SEQ ID NO: 2409736 - protein, 6 aa, Entamoeba dispar
NNTPIQ

SEQ ID NO: 2409737 - protein, 6 aa, Entamoeba dispar
NNTPQF

SEQ ID NO: 2409738 - protein, 28 aa, Entamoeba dispar
NNTTTVPITSRKTSTSVVSQPPVAGGGD

SEQ ID NO: 2409739 - protein, 5 aa, Entamoeba dispar
NNVGK

SEQ ID NO: 2409740 - protein, 5 aa, Entamoeba dispar
NPADW

SEQ ID NO: 2409741 - protein, 7 aa, Entamoeba dispar
NPANTNA

SEQ ID NO: 2409742 - protein, 4 aa, Entamoeba dispar
NPEE

SEQ ID NO: 2409743 - protein, 5 aa, Entamoeba dispar
NPEGP

SEQ ID NO: 2409744 - protein, 19 aa, Entamoeba dispar
NPEQAKSNARNYTQKYAHA

SEQ ID NO: 2409745 - protein, 5 aa, Entamoeba dispar
NPFGE

SEQ ID NO: 2409746 - protein, 8 aa, Entamoeba dispar
NPGCSAED

SEQ ID NO: 2409747 - protein, 4 aa, Entamoeba dispar
NPIE

SEQ ID NO: 2409748 - protein, 4 aa, Entamoeba dispar
NPIS

SEQ ID NO: 2409749 - protein, 6 aa, Entamoeba dispar
NPKIKT

SEQ ID NO: 2409750 - protein, 7 aa, Entamoeba dispar
NPKIQEN

SEQ ID NO: 2409751 - protein, 9 aa, Entamoeba dispar
NPKNEDARE

SEQ ID NO: 2409752 - protein, 14 aa, Entamoeba dispar
NPKTQESEEFEPEE

SEQ ID NO: 2409753 - protein, 6 aa, Entamoeba dispar
NPLGMN

SEQ ID NO: 2409754 - protein, 12 aa, Entamoeba dispar
NPNKKKNSHSGV

SEQ ID NO: 2409755 - protein, 4 aa, Entamoeba dispar
NPNY

SEQ ID NO: 2409756 - protein, 6 aa, Entamoeba dispar
NPPRID

SEQ ID NO: 2409757 - protein, 5 aa, Entamoeba dispar
NPQEW

SEQ ID NO: 2409758 - protein, 6 aa, Entamoeba dispar
NPQGGD

SEQ ID NO: 2409759 - protein, 5 aa, Entamoeba dispar
NPQTQ

SEQ ID NO: 2409760 - protein, 8 aa, Entamoeba dispar
NPSKPELV

SEQ ID NO: 2409761 - protein, 7 aa, Entamoeba dispar
NPSNESI

SEQ ID NO: 2409762 - protein, 7 aa, Entamoeba dispar
NPSQWTP

SEQ ID NO: 2409763 - protein, 5 aa, Entamoeba dispar
NPSRI

SEQ ID NO: 2409764 - protein, 9 aa, Entamoeba dispar
NPSTECENE

SEQ ID NO: 2409765 - protein, 5 aa, Entamoeba dispar
NPTLS

SEQ ID NO: 2409766 - protein, 4 aa, Entamoeba dispar
NPTV

SEQ ID NO: 2409767 - protein, 9 aa, Entamoeba dispar
NPVQNELKR

SEQ ID NO: 2409768 - protein, 9 aa, Entamoeba dispar
NQCEKQKEE

SEQ ID NO: 2409769 - protein, 7 aa, Entamoeba dispar
NQEIPHE

SEQ ID NO: 2409770 - protein, 22 aa, Entamoeba dispar
NQFADAAEAEHFTNESDSEKYN

SEQ ID NO: 2409771 - protein, 4 aa, Entamoeba dispar
NQIM

SEQ ID NO: 2409772 - protein, 19 aa, Entamoeba dispar
NQLDKEVNDQTQQTEYKDK

SEQ ID NO: 2409773 - protein, 4 aa, Entamoeba dispar
NQLP

SEQ ID NO: 2409774 - protein, 7 aa, Entamoeba dispar
NQNKPSF

SEQ ID NO: 2409775 - protein, 6 aa, Entamoeba dispar
NQNNTD

SEQ ID NO: 2409776 - protein, 6 aa, Entamoeba dispar
NQPDLY

SEQ ID NO: 2409777 - protein, 8 aa, Entamoeba dispar
NQPSDRRD

SEQ ID NO: 2409778 - protein, 4 aa, Entamoeba dispar
NQQN

SEQ ID NO: 2409779 - protein, 5 aa, Entamoeba dispar
NQSEL

SEQ ID NO: 2409780 - protein, 17 aa, Entamoeba dispar
NQSSSQPVVSQSTNKHE

SEQ ID NO: 2409781 - protein, 26 aa, Entamoeba dispar
NQSYQHTKEEKKKAKKRKQENTERDK

SEQ ID NO: 2409782 - protein, 4 aa, Entamoeba dispar
NQYG

SEQ ID NO: 2409783 - protein, 5 aa, Entamoeba dispar
NRDGH

SEQ ID NO: 2409784 - protein, 7 aa, Entamoeba dispar
NRGEPDG

SEQ ID NO: 2409785 - protein, 6 aa, Entamoeba dispar
NRHEKQ

SEQ ID NO: 2409786 - protein, 14 aa, Entamoeba dispar
NRMNAKGGGDEPES

SEQ ID NO: 2409787 - protein, 5 aa, Entamoeba dispar
NRPDI

SEQ ID NO: 2409788 - protein, 8 aa, Entamoeba dispar
NRPDTLDP

SEQ ID NO: 2409789 - protein, 5 aa, Entamoeba dispar
NRPFD

SEQ ID NO: 2409790 - protein, 6 aa, Entamoeba dispar
NRRRRI

SEQ ID NO: 2409791 - protein, 7 aa, Entamoeba dispar
NRSAPCD

SEQ ID NO: 2409792 - protein, 4 aa, Entamoeba dispar
NRSR

SEQ ID NO: 2409793 - protein, 18 aa, Entamoeba dispar
NRTTESIENEELKNEYGS

SEQ ID NO: 2409794 - protein, 18 aa, Entamoeba dispar
NRTTEYIENEELKNEYGS

SEQ ID NO: 2409795 - protein, 4 aa, Entamoeba dispar
NSAL

SEQ ID NO: 2409796 - protein, 5 aa, Entamoeba dispar
NSCKG

SEQ ID NO: 2409797 - protein, 14 aa, Entamoeba dispar
NSDKVKSDEDRQDL

SEQ ID NO: 2409798 - protein, 5 aa, Entamoeba dispar
NSDSF

SEQ ID NO: 2409799 - protein, 5 aa, Entamoeba dispar
NSDTS

SEQ ID NO: 2409800 - protein, 7 aa, Entamoeba dispar
NSEDLSV

SEQ ID NO: 2409801 - protein, 4 aa, Entamoeba dispar
NSEI

SEQ ID NO: 2409802 - protein, 6 aa, Entamoeba dispar
NSEMYT

SEQ ID NO: 2409803 - protein, 8 aa, Entamoeba dispar
NSEPNSVD

SEQ ID NO: 2409804 - protein, 4 aa, Entamoeba dispar
NSER

SEQ ID NO: 2409805 - protein, 8 aa, Entamoeba dispar
NSGDQLQT

SEQ ID NO: 2409806 - protein, 8 aa, Entamoeba dispar
NSGKKGYP

SEQ ID NO: 2409807 - protein, 17 aa, Entamoeba dispar
NSGSSVETDKKEKEGIS

SEQ ID NO: 2409808 - protein, 8 aa, Entamoeba dispar
NSHEEETG

SEQ ID NO: 2409809 - protein, 7 aa, Entamoeba dispar
NSHGNTF

SEQ ID NO: 2409810 - protein, 4 aa, Entamoeba dispar
NSHQ

SEQ ID NO: 2409811 - protein, 12 aa, Entamoeba dispar
NSHSHPSKKCCL

SEQ ID NO: 2409812 - protein, 18 aa, Entamoeba dispar
NSIKTQSIQNNITRKPTN

SEQ ID NO: 2409813 - protein, 4 aa, Entamoeba dispar
NSIS

SEQ ID NO: 2409814 - protein, 13 aa, Entamoeba dispar
NSKDEELNQQKKE

SEQ ID NO: 2409815 - protein, 10 aa, Entamoeba dispar
NSKETTEQYQ

SEQ ID NO: 2409816 - protein, 8 aa, Entamoeba dispar
NSKQNISQ

SEQ ID NO: 2409817 - protein, 5 aa, Entamoeba dispar
NSLES

SEQ ID NO: 2409818 - protein, 7 aa, Entamoeba dispar
NSLKELQ

SEQ ID NO: 2409819 - protein, 12 aa, Entamoeba dispar
NSLNESFDNVNT

SEQ ID NO: 2409820 - protein, 4 aa, Entamoeba dispar
NSNE

SEQ ID NO: 2409821 - protein, 4 aa, Entamoeba dispar
NSNI

SEQ ID NO: 2409822 - protein, 7 aa, Entamoeba dispar
NSNKTPL

SEQ ID NO: 2409823 - protein, 15 aa, Entamoeba dispar
NSNYNEAMPQNNPDV

SEQ ID NO: 2409824 - protein, 7 aa, Entamoeba dispar
NSPIDRE

SEQ ID NO: 2409825 - protein, 9 aa, Entamoeba dispar
NSPIQGTAA

SEQ ID NO: 2409826 - protein, 10 aa, Entamoeba dispar
NSPSVGSLPN

SEQ ID NO: 2409827 - protein, 5 aa, Entamoeba dispar
NSPTT

SEQ ID NO: 2409828 - protein, 4 aa, Entamoeba dispar
NSRI

SEQ ID NO: 2409829 - protein, 7 aa, Entamoeba dispar
NSRPCPS

SEQ ID NO: 2409830 - protein, 6 aa, Entamoeba dispar
NSRRID

SEQ ID NO: 2409831 - protein, 15 aa, Entamoeba dispar
NSSDKVKTDEERQDL

SEQ ID NO: 2409832 - protein, 5 aa, Entamoeba dispar
NSSDY

SEQ ID NO: 2409833 - protein, 4 aa, Entamoeba dispar
NSSL

SEQ ID NO: 2409834 - protein, 5 aa, Entamoeba dispar
NSSLV

SEQ ID NO: 2409835 - protein, 13 aa, Entamoeba dispar
NSSNLNDRAKSVL

SEQ ID NO: 2409836 - protein, 4 aa, Entamoeba dispar
NSSS

SEQ ID NO: 2409837 - protein, 4 aa, Entamoeba dispar
NSTN

SEQ ID NO: 2409838 - protein, 4 aa, Entamoeba dispar
NSTQ

SEQ ID NO: 2409839 - protein, 19 aa, Entamoeba dispar
NSTSSLSIPPPTDAPGTDQ

SEQ ID NO: 2409840 - protein, 4 aa, Entamoeba dispar
NSYS

SEQ ID NO: 2409841 - protein, 7 aa, Entamoeba dispar
NSYYNGA

SEQ ID NO: 2409842 - protein, 7 aa, Entamoeba dispar
NTEITGK

SEQ ID NO: 2409843 - protein, 4 aa, Entamoeba dispar
NTEQ

SEQ ID NO: 2409844 - protein, 7 aa, Entamoeba dispar
NTGQGLQ

SEQ ID NO: 2409845 - protein, 4 aa, Entamoeba dispar
NTIK

SEQ ID NO: 2409846 - protein, 4 aa, Entamoeba dispar
NTIT

SEQ ID NO: 2409847 - protein, 6 aa, Entamoeba dispar
NTKNKG

SEQ ID NO: 2409848 - protein, 8 aa, Entamoeba dispar
NTKTPERY

SEQ ID NO: 2409849 - protein, 10 aa, Entamoeba dispar
NTKYKEETKH

SEQ ID NO: 2409850 - protein, 5 aa, Entamoeba dispar
NTLKG

SEQ ID NO: 2409851 - protein, 4 aa, Entamoeba dispar
NTLQ

SEQ ID NO: 2409852 - protein, 27 aa, Entamoeba dispar
NTNGEKKRRILPPTPIRQKDINQRKRV

SEQ ID NO: 2409853 - protein, 15 aa, Entamoeba dispar
NTNRPPPPMTKEQTL

SEQ ID NO: 2409854 - protein, 9 aa, Entamoeba dispar
NTNTIKSDL

SEQ ID NO: 2409855 - protein, 9 aa, Entamoeba dispar
NTNVRPRNK

SEQ ID NO: 2409856 - protein, 8 aa, Entamoeba dispar
NTPAEGVE

SEQ ID NO: 2409857 - protein, 4 aa, Entamoeba dispar
NTQI

SEQ ID NO: 2409858 - protein, 6 aa, Entamoeba dispar
NTQLNS

SEQ ID NO: 2409859 - protein, 7 aa, Entamoeba dispar
NTSKQVN

SEQ ID NO: 2409860 - protein, 7 aa, Entamoeba dispar
NTSPQAI

SEQ ID NO: 2409861 - protein, 12 aa, Entamoeba dispar
NTSSGADAAVDV

SEQ ID NO: 2409862 - protein, 11 aa, Entamoeba dispar
NTSSKEIKRRQ

SEQ ID NO: 2409863 - protein, 4 aa, Entamoeba dispar
NTTT

SEQ ID NO: 2409864 - protein, 4 aa, Entamoeba dispar
NTTV

SEQ ID NO: 2409865 - protein, 10 aa, Entamoeba dispar
NTVQSEEDEE

SEQ ID NO: 2409866 - protein, 4 aa, Entamoeba dispar
NTYE

SEQ ID NO: 2409867 - protein, 5 aa, Entamoeba dispar
NVDEQ

SEQ ID NO: 2409868 - protein, 8 aa, Entamoeba dispar
NVGEDETF

SEQ ID NO: 2409869 - protein, 5 aa, Entamoeba dispar
NVGKS

SEQ ID NO: 2409870 - protein, 4 aa, Entamoeba dispar
NVKN

SEQ ID NO: 2409871 - protein, 28 aa, Entamoeba dispar
NVKPSSQTKTINITENGTTTVTPDNNIP

SEQ ID NO: 2409872 - protein, 13 aa, Entamoeba dispar
NVQPHSTVSETVP

SEQ ID NO: 2409873 - protein, 6 aa, Entamoeba dispar
NVQPIQ

SEQ ID NO: 2409874 - protein, 10 aa, Entamoeba dispar
NVSSPQQQMM

SEQ ID NO: 2409875 - protein, 6 aa, Entamoeba dispar
NWDPND

SEQ ID NO: 2409876 - protein, 6 aa, Entamoeba dispar
NWQNTQ

SEQ ID NO: 2409877 - protein, 35 aa, Entamoeba dispar
NYKKRGDDSSSDSEDNREDGKGKIKYQAKRPFEEK

SEQ ID NO: 2409878 - protein, 12 aa, Entamoeba dispar
NYKQPSYSFGGQ

SEQ ID NO: 2409879 - protein, 4 aa, Entamoeba dispar
NYNE

SEQ ID NO: 2409880 - protein, 7 aa, Entamoeba dispar
NYPYSPP

SEQ ID NO: 2409881 - protein, 6 aa, Entamoeba dispar
NYQGTN

SEQ ID NO: 2409882 - protein, 6 aa, Entamoeba dispar
NYQPTI

SEQ ID NO: 2409883 - protein, 6 aa, Entamoeba dispar
NYQSEY

SEQ ID NO: 2409884 - protein, 11 aa, Entamoeba dispar
NYSENGGKTFK

SEQ ID NO: 2409885 - protein, 5 aa, Entamoeba dispar
PAIPY

SEQ ID NO: 2409886 - protein, 10 aa, Entamoeba dispar
PANEPNDYPI

SEQ ID NO: 2409887 - protein, 8 aa, Entamoeba dispar
PANYSEAP

SEQ ID NO: 2409888 - protein, 7 aa, Entamoeba dispar
PAPKQDV

SEQ ID NO: 2409889 - protein, 7 aa, Entamoeba dispar
PAPRGTG

SEQ ID NO: 2409890 - protein, 12 aa, Entamoeba dispar
PASNLKKTNGMD

SEQ ID NO: 2409891 - protein, 7 aa, Entamoeba dispar
PATGKTA

SEQ ID NO: 2409892 - protein, 6 aa, Entamoeba dispar
PAYNEK

SEQ ID NO: 2409893 - protein, 11 aa, Entamoeba dispar
PCGETRYPSYP

SEQ ID NO: 2409894 - protein, 7 aa, Entamoeba dispar
PCNPNHP

SEQ ID NO: 2409895 - protein, 7 aa, Entamoeba dispar
PCTSDTH

SEQ ID NO: 2409896 - protein, 8 aa, Entamoeba dispar
PDAHSGYG

SEQ ID NO: 2409897 - protein, 14 aa, Entamoeba dispar
PDEEGKPTKRNSSD

SEQ ID NO: 2409898 - protein, 16 aa, Entamoeba dispar
PDENGSVSITSGTTTE

SEQ ID NO: 2409899 - protein, 4 aa, Entamoeba dispar
PDGE

SEQ ID NO: 2409900 - protein, 8 aa, Entamoeba dispar
PDKEEEEL

SEQ ID NO: 2409901 - protein, 6 aa, Entamoeba dispar
PDKQQM

SEQ ID NO: 2409902 - protein, 11 aa, Entamoeba dispar
PDLPISTKADF

SEQ ID NO: 2409903 - protein, 6 aa, Entamoeba dispar
PDSPQF

SEQ ID NO: 2409904 - protein, 14 aa, Entamoeba dispar
PDWGEEESQRGYPM

SEQ ID NO: 2409905 - protein, 7 aa, Entamoeba dispar
PDYRKTW

SEQ ID NO: 2409906 - protein, 5 aa, Entamoeba dispar
PECGP

SEQ ID NO: 2409907 - protein, 5 aa, Entamoeba dispar
PEDVR

SEQ ID NO: 2409908 - protein, 26 aa, Entamoeba dispar
PEEIEAEKKRKEAKEAAKKAEPVGQS

SEQ ID NO: 2409909 - protein, 5 aa, Entamoeba dispar
PEELQ

SEQ ID NO: 2409910 - protein, 15 aa, Entamoeba dispar
PEEPQVNPDEPPNFN

SEQ ID NO: 2409911 - protein, 9 aa, Entamoeba dispar
PEFRGEKIG

SEQ ID NO: 2409912 - protein, 5 aa, Entamoeba dispar
PEFTQ

SEQ ID NO: 2409913 - protein, 10 aa, Entamoeba dispar
PEGGLPSDEL

SEQ ID NO: 2409914 - protein, 17 aa, Entamoeba dispar
PEGKTKHYYTTQINKFN

SEQ ID NO: 2409915 - protein, 4 aa, Entamoeba dispar
PEIQ

SEQ ID NO: 2409916 - protein, 9 aa, Entamoeba dispar
PEITTPVSS

SEQ ID NO: 2409917 - protein, 7 aa, Entamoeba dispar
PEKARQV

SEQ ID NO: 2409918 - protein, 5 aa, Entamoeba dispar
PELPA

SEQ ID NO: 2409919 - protein, 20 aa, Entamoeba dispar
PELPPKSSNPYFPKSKIRKD

SEQ ID NO: 2409920 - protein, 16 aa, Entamoeba dispar
PENAIKGITKSISDRR

SEQ ID NO: 2409921 - protein, 12 aa, Entamoeba dispar
PENEGRSGKFNL

SEQ ID NO: 2409922 - protein, 8 aa, Entamoeba dispar
PENTITDE

SEQ ID NO: 2409923 - protein, 13 aa, Entamoeba dispar
PERFGESKKELDS

SEQ ID NO: 2409924 - protein, 4 aa, Entamoeba dispar
PETD

SEQ ID NO: 2409925 - protein, 4 aa, Entamoeba dispar
PETL

SEQ ID NO: 2409926 - protein, 7 aa, Entamoeba dispar
PEVGYSK

SEQ ID NO: 2409927 - protein, 12 aa, Entamoeba dispar
PFGEVSDDELKE

SEQ ID NO: 2409928 - protein, 9 aa, Entamoeba dispar
PFNQVEESD

SEQ ID NO: 2409929 - protein, 7 aa, Entamoeba dispar
PFPYQNK

SEQ ID NO: 2409930 - protein, 7 aa, Entamoeba dispar
PFQPPKN

SEQ ID NO: 2409931 - protein, 6 aa, Entamoeba dispar
PFTSED

SEQ ID NO: 2409932 - protein, 8 aa, Entamoeba dispar
PGDPLDKE

SEQ ID NO: 2409933 - protein, 5 aa, Entamoeba dispar
PGDYD

SEQ ID NO: 2409934 - protein, 4 aa, Entamoeba dispar
PGEY

SEQ ID NO: 2409935 - protein, 4 aa, Entamoeba dispar
PGHT

SEQ ID NO: 2409936 - protein, 8 aa, Entamoeba dispar
PGKTTITV

SEQ ID NO: 2409937 - protein, 7 aa, Entamoeba dispar
PGLNDTC

SEQ ID NO: 2409938 - protein, 13 aa, Entamoeba dispar
PGLQDSEGRERQY

SEQ ID NO: 2409939 - protein, 10 aa, Entamoeba dispar
PGNDPAYMEG

SEQ ID NO: 2409940 - protein, 4 aa, Entamoeba dispar
PGRI

SEQ ID NO: 2409941 - protein, 4 aa, Entamoeba dispar
PGRL

SEQ ID NO: 2409942 - protein, 4 aa, Entamoeba dispar
PGVG

SEQ ID NO: 2409943 - protein, 6 aa, Entamoeba dispar
PGVGPK

SEQ ID NO: 2409944 - protein, 14 aa, Entamoeba dispar
PGVLSGEKQRIGRS

SEQ ID NO: 2409945 - protein, 4 aa, Entamoeba dispar
PHAV

SEQ ID NO: 2409946 - protein, 17 aa, Entamoeba dispar
PHTSTSNTLVSDSSLNN

SEQ ID NO: 2409947 - protein, 9 aa, Entamoeba dispar
PIITPGESS

SEQ ID NO: 2409948 - protein, 12 aa, Entamoeba dispar
PIKARTQGELVP

SEQ ID NO: 2409949 - protein, 4 aa, Entamoeba dispar
PIKG

SEQ ID NO: 2409950 - protein, 28 aa, Entamoeba dispar
PIKQETDKEINKPKKQSQVKPKENKRSN

SEQ ID NO: 2409951 - protein, 4 aa, Entamoeba dispar
PINN

SEQ ID NO: 2409952 - protein, 5 aa, Entamoeba dispar
PINNM

SEQ ID NO: 2409953 - protein, 4 aa, Entamoeba dispar
PIPD

SEQ ID NO: 2409954 - protein, 24 aa, Entamoeba dispar
PIQPQNGQQQPTGQPQKNVWGNPV

SEQ ID NO: 2409955 - protein, 22 aa, Entamoeba dispar
PIQSKTGQQQQPNTQTQPQKDV

SEQ ID NO: 2409956 - protein, 4 aa, Entamoeba dispar
PISS

SEQ ID NO: 2409957 - protein, 4 aa, Entamoeba dispar
PIST

SEQ ID NO: 2409958 - protein, 11 aa, Entamoeba dispar
PITNSNPFNQI

SEQ ID NO: 2409959 - protein, 15 aa, Entamoeba dispar
PKALRESKKEKKMSK

SEQ ID NO: 2409960 - protein, 5 aa, Entamoeba dispar
PKDDA

SEQ ID NO: 2409961 - protein, 6 aa, Entamoeba dispar
PKDEIP

SEQ ID NO: 2409962 - protein, 11 aa, Entamoeba dispar
PKGSSKAEYRL

SEQ ID NO: 2409963 - protein, 10 aa, Entamoeba dispar
PKKGRSEEWN

SEQ ID NO: 2409964 - protein, 10 aa, Entamoeba dispar
PKLEDQNTIE

SEQ ID NO: 2409965 - protein, 11 aa, Entamoeba dispar
PKNDWNEAPTG

SEQ ID NO: 2409966 - protein, 11 aa, Entamoeba dispar
PKQEPEQTDEK

SEQ ID NO: 2409967 - protein, 4 aa, Entamoeba dispar
PKQF

SEQ ID NO: 2409968 - protein, 4 aa, Entamoeba dispar
PKQR

SEQ ID NO: 2409969 - protein, 6 aa, Entamoeba dispar
PKQTEW

SEQ ID NO: 2409970 - protein, 7 aa, Entamoeba dispar
PKRLTKK

SEQ ID NO: 2409971 - protein, 4 aa, Entamoeba dispar
PKSA

SEQ ID NO: 2409972 - protein, 7 aa, Entamoeba dispar
PKSFKAR

SEQ ID NO: 2409973 - protein, 4 aa, Entamoeba dispar
PKSI

SEQ ID NO: 2409974 - protein, 11 aa, Entamoeba dispar
PKTKRKNDKKG

SEQ ID NO: 2409975 - protein, 5 aa, Entamoeba dispar
PKTNN

SEQ ID NO: 2409976 - protein, 8 aa, Entamoeba dispar
PKTPDELY

SEQ ID NO: 2409977 - protein, 32 aa, Entamoeba dispar
PKVSPQHNSINNDSSKEITQNPLSKPQTPETF

SEQ ID NO: 2409978 - protein, 8 aa, Entamoeba dispar
PLASDKLE

SEQ ID NO: 2409979 - protein, 5 aa, Entamoeba dispar
PLEDP

SEQ ID NO: 2409980 - protein, 7 aa, Entamoeba dispar
PLEGTPF

SEQ ID NO: 2409981 - protein, 13 aa, Entamoeba dispar
PLGGSDEVSGSHK

SEQ ID NO: 2409982 - protein, 5 aa, Entamoeba dispar
PLKGM

SEQ ID NO: 2409983 - protein, 7 aa, Entamoeba dispar
PLKNEGI

SEQ ID NO: 2409984 - protein, 5 aa, Entamoeba dispar
PLKTL

SEQ ID NO: 2409985 - protein, 21 aa, Entamoeba dispar
PLNGNNTNIDEYSDNDSIDDY

SEQ ID NO: 2409986 - protein, 4 aa, Entamoeba dispar
PLPG

SEQ ID NO: 2409987 - protein, 5 aa, Entamoeba dispar
PLPTN

SEQ ID NO: 2409988 - protein, 23 aa, Entamoeba dispar
PLSASQPRPPEDDISPGISSEEF

SEQ ID NO: 2409989 - protein, 4 aa, Entamoeba dispar
PLSE

SEQ ID NO: 2409990 - protein, 7 aa, Entamoeba dispar
PLSNSEV

SEQ ID NO: 2409991 - protein, 4 aa, Entamoeba dispar
PLTG

SEQ ID NO: 2409992 - protein, 6 aa, Entamoeba dispar
PLTSRR

SEQ ID NO: 2409993 - protein, 4 aa, Entamoeba dispar
PLTT

SEQ ID NO: 2409994 - protein, 4 aa, Entamoeba dispar
PNAT

SEQ ID NO: 2409995 - protein, 7 aa, Entamoeba dispar
PNCSEQI

SEQ ID NO: 2409996 - protein, 4 aa, Entamoeba dispar
PNEF

SEQ ID NO: 2409997 - protein, 9 aa, Entamoeba dispar
PNEINKEND

SEQ ID NO: 2409998 - protein, 4 aa, Entamoeba dispar
PNEQ

SEQ ID NO: 2409999 - protein, 5 aa, Entamoeba dispar
PNETM

SEQ ID NO: 2410000 - protein, 9 aa, Entamoeba dispar
PNETPEISL

SEQ ID NO: 2410001 - protein, 15 aa, Entamoeba dispar
PNGSFEDWKVSELIV

SEQ ID NO: 2410002 - protein, 4 aa, Entamoeba dispar
PNIN

SEQ ID NO: 2410003 - protein, 8 aa, Entamoeba dispar
PNKNETQR

SEQ ID NO: 2410004 - protein, 5 aa, Entamoeba dispar
PNLYR

SEQ ID NO: 2410005 - protein, 4 aa, Entamoeba dispar
PNPQ

SEQ ID NO: 2410006 - protein, 8 aa, Entamoeba dispar
PNPSTKRT

SEQ ID NO: 2410007 - protein, 4 aa, Entamoeba dispar
PNQN

SEQ ID NO: 2410008 - protein, 13 aa, Entamoeba dispar
PNTMSKEYKGSGL

SEQ ID NO: 2410009 - protein, 5 aa, Entamoeba dispar
PNTQL

SEQ ID NO: 2410010 - protein, 4 aa, Entamoeba dispar
PPDG

SEQ ID NO: 2410011 - protein, 4 aa, Entamoeba dispar
PPEQ

SEQ ID NO: 2410012 - protein, 6 aa, Entamoeba dispar
PPGCGK

SEQ ID NO: 2410013 - protein, 7 aa, Entamoeba dispar
PPGCGKT

SEQ ID NO: 2410014 - protein, 6 aa, Entamoeba dispar
PPGEDL

SEQ ID NO: 2410015 - protein, 5 aa, Entamoeba dispar
PPIPT

SEQ ID NO: 2410016 - protein, 8 aa, Entamoeba dispar
PPKQFNTN

SEQ ID NO: 2410017 - protein, 8 aa, Entamoeba dispar
PPKTNMDG

SEQ ID NO: 2410018 - protein, 23 aa, Entamoeba dispar
PPLPIQETKTRSTETLSSETNNL

SEQ ID NO: 2410019 - protein, 4 aa, Entamoeba dispar
PPLY

SEQ ID NO: 2410020 - protein, 4 aa, Entamoeba dispar
PPPI

SEQ ID NO: 2410021 - protein, 4 aa, Entamoeba dispar
PPPQ

SEQ ID NO: 2410022 - protein, 7 aa, Entamoeba dispar
PPQKVED

SEQ ID NO: 2410023 - protein, 7 aa, Entamoeba dispar
PPQRERI

SEQ ID NO: 2410024 - protein, 7 aa, Entamoeba dispar
PPSFDNV

SEQ ID NO: 2410025 - protein, 4 aa, Entamoeba dispar
PQID

SEQ ID NO: 2410026 - protein, 13 aa, Entamoeba dispar
PQIEYNKQENDIE

SEQ ID NO: 2410027 - protein, 5 aa, Entamoeba dispar
PQITE

SEQ ID NO: 2410028 - protein, 4 aa, Entamoeba dispar
PQKE

SEQ ID NO: 2410029 - protein, 6 aa, Entamoeba dispar
PQQETL

SEQ ID NO: 2410030 - protein, 7 aa, Entamoeba dispar
PQQRERI

SEQ ID NO: 2410031 - protein, 4 aa, Entamoeba dispar
PQRK

SEQ ID NO: 2410032 - protein, 10 aa, Entamoeba dispar
PQTMSTDSPV

SEQ ID NO: 2410033 - protein, 8 aa, Entamoeba dispar
PREGNGDS

SEQ ID NO: 2410034 - protein, 11 aa, Entamoeba dispar
PRKSLDNSREV

SEQ ID NO: 2410035 - protein, 14 aa, Entamoeba dispar
PRLNESKNIFNIRN

SEQ ID NO: 2410036 - protein, 7 aa, Entamoeba dispar
PRRNNNE

SEQ ID NO: 2410037 - protein, 6 aa, Entamoeba dispar
PRSGST

SEQ ID NO: 2410038 - protein, 30 aa, Entamoeba dispar
PRYDRYDPRYDPRYDRYDPRYDNTTDPRID

SEQ ID NO: 2410039 - protein, 8 aa, Entamoeba dispar
PSDIDYED

SEQ ID NO: 2410040 - protein, 13 aa, Entamoeba dispar
PSEPNAEENGVDK

SEQ ID NO: 2410041 - protein, 4 aa, Entamoeba dispar
PSGD

SEQ ID NO: 2410042 - protein, 8 aa, Entamoeba dispar
PSGNYGGW

SEQ ID NO: 2410043 - protein, 5 aa, Entamoeba dispar
PSIDD

SEQ ID NO: 2410044 - protein, 4 aa, Entamoeba dispar
PSIK

SEQ ID NO: 2410045 - protein, 4 aa, Entamoeba dispar
PSKE

SEQ ID NO: 2410046 - protein, 10 aa, Entamoeba dispar
PSKSTTEKQT

SEQ ID NO: 2410047 - protein, 9 aa, Entamoeba dispar
PSNSPTEQP

SEQ ID NO: 2410048 - protein, 12 aa, Entamoeba dispar
PSNYNTSQNEIE

SEQ ID NO: 2410049 - protein, 10 aa, Entamoeba dispar
PSPRVRPSLS

SEQ ID NO: 2410050 - protein, 17 aa, Entamoeba dispar
PSPTHLNERKLLKFFTL

SEQ ID NO: 2410051 - protein, 7 aa, Entamoeba dispar
PSPVSKI

SEQ ID NO: 2410052 - protein, 5 aa, Entamoeba dispar
PSQQD

SEQ ID NO: 2410053 - protein, 6 aa, Entamoeba dispar
PSQYGL

SEQ ID NO: 2410054 - protein, 10 aa, Entamoeba dispar
PSSGKSAKIY

SEQ ID NO: 2410055 - protein, 5 aa, Entamoeba dispar
PSSIN

SEQ ID NO: 2410056 - protein, 6 aa, Entamoeba dispar
PSSISE

SEQ ID NO: 2410057 - protein, 7 aa, Entamoeba dispar
PSSISKL

SEQ ID NO: 2410058 - protein, 6 aa, Entamoeba dispar
PSSITS

SEQ ID NO: 2410059 - protein, 4 aa, Entamoeba dispar
PSSL

SEQ ID NO: 2410060 - protein, 12 aa, Entamoeba dispar
PSSLKDIPTSYY

SEQ ID NO: 2410061 - protein, 17 aa, Entamoeba dispar
PSSPNLQQKTITYTSNG

SEQ ID NO: 2410062 - protein, 8 aa, Entamoeba dispar
PSSVSEIG

SEQ ID NO: 2410063 - protein, 5 aa, Entamoeba dispar
PSTIT

SEQ ID NO: 2410064 - protein, 7 aa, Entamoeba dispar
PSTITSI

SEQ ID NO: 2410065 - protein, 4 aa, Entamoeba dispar
PSTS

SEQ ID NO: 2410066 - protein, 7 aa, Entamoeba dispar
PSVDHQA

SEQ ID NO: 2410067 - protein, 7 aa, Entamoeba dispar
PSVQEGS

SEQ ID NO: 2410068 - protein, 6 aa, Entamoeba dispar
PSVTRG

SEQ ID NO: 2410069 - protein, 7 aa, Entamoeba dispar
PSWSPEE

SEQ ID NO: 2410070 - protein, 19 aa, Entamoeba dispar
PSYITNNTKTLTNQLTSTN

SEQ ID NO: 2410071 - protein, 6 aa, Entamoeba dispar
PTDEDD

SEQ ID NO: 2410072 - protein, 7 aa, Entamoeba dispar
PTESLKR

SEQ ID NO: 2410073 - protein, 10 aa, Entamoeba dispar
PTIEDSYRKQ

SEQ ID NO: 2410074 - protein, 4 aa, Entamoeba dispar
PTIT

SEQ ID NO: 2410075 - protein, 7 aa, Entamoeba dispar
PTKESVD

SEQ ID NO: 2410076 - protein, 4 aa, Entamoeba dispar
PTKG

SEQ ID NO: 2410077 - protein, 12 aa, Entamoeba dispar
PTLEEAEQESIH

SEQ ID NO: 2410078 - protein, 13 aa, Entamoeba dispar
PTLQDTSKENESW

SEQ ID NO: 2410079 - protein, 5 aa, Entamoeba dispar
PTNKC

SEQ ID NO: 2410080 - protein, 5 aa, Entamoeba dispar
PTNRT

SEQ ID NO: 2410081 - protein, 7 aa, Entamoeba dispar
PTPSYEG

SEQ ID NO: 2410082 - protein, 4 aa, Entamoeba dispar
PTSI

SEQ ID NO: 2410083 - protein, 6 aa, Entamoeba dispar
PTSIDQ

SEQ ID NO: 2410084 - protein, 45 aa, Entamoeba dispar
PTTSKQPRKYYAPKSASKKAAVSSKKAVAGVSQKKPVARHSHPGI

SEQ ID NO: 2410085 - protein, 13 aa, Entamoeba dispar
PVEGTVQRNRKAR

SEQ ID NO: 2410086 - protein, 6 aa, Entamoeba dispar
PVGDEM

SEQ ID NO: 2410087 - protein, 18 aa, Entamoeba dispar
PVKSKDEEKKPKKADSSD

SEQ ID NO: 2410088 - protein, 9 aa, Entamoeba dispar
PVQNPPPVD

SEQ ID NO: 2410089 - protein, 11 aa, Entamoeba dispar
PVQQKEAKQVL

SEQ ID NO: 2410090 - protein, 9 aa, Entamoeba dispar
PVTNPTSTA

SEQ ID NO: 2410091 - protein, 4 aa, Entamoeba dispar
PVYE

SEQ ID NO: 2410092 - protein, 4 aa, Entamoeba dispar
PYEN

SEQ ID NO: 2410093 - protein, 6 aa, Entamoeba dispar
PYGTTY

SEQ ID NO: 2410094 - protein, 4 aa, Entamoeba dispar
PYIS

SEQ ID NO: 2410095 - protein, 10 aa, Entamoeba dispar
PYNADPKKRL

SEQ ID NO: 2410096 - protein, 7 aa, Entamoeba dispar
PYPNSEA

SEQ ID NO: 2410097 - protein, 9 aa, Entamoeba dispar
PYSSTEKDV

SEQ ID NO: 2410098 - protein, 4 aa, Entamoeba dispar
QAHG

SEQ ID NO: 2410099 - protein, 4 aa, Entamoeba dispar
QAIE

SEQ ID NO: 2410100 - protein, 9 aa, Entamoeba dispar
QAKEKYGDA

SEQ ID NO: 2410101 - protein, 4 aa, Entamoeba dispar
QANE

SEQ ID NO: 2410102 - protein, 5 aa, Entamoeba dispar
QAPEH

SEQ ID NO: 2410103 - protein, 10 aa, Entamoeba dispar
QAQEEGELSF

SEQ ID NO: 2410104 - protein, 15 aa, Entamoeba dispar
QAQNDVTNSIEETAQ

SEQ ID NO: 2410105 - protein, 8 aa, Entamoeba dispar
QATFDTSE

SEQ ID NO: 2410106 - protein, 9 aa, Entamoeba dispar
QCSPANPRV

SEQ ID NO: 2410107 - protein, 9 aa, Entamoeba dispar
QDEPTKNDP

SEQ ID NO: 2410108 - protein, 11 aa, Entamoeba dispar
QDGSVEDSIIN

SEQ ID NO: 2410109 - protein, 5 aa, Entamoeba dispar
QDHYA

SEQ ID NO: 2410110 - protein, 8 aa, Entamoeba dispar
QDLPKTPF

SEQ ID NO: 2410111 - protein, 6 aa, Entamoeba dispar
QDNQEI

SEQ ID NO: 2410112 - protein, 15 aa, Entamoeba dispar
QDNVKSYNEHQTEAQ

SEQ ID NO: 2410113 - protein, 6 aa, Entamoeba dispar
QDPSLA

SEQ ID NO: 2410114 - protein, 5 aa, Entamoeba dispar
QDQRI

SEQ ID NO: 2410115 - protein, 11 aa, Entamoeba dispar
QDSEVGDGTTT

SEQ ID NO: 2410116 - protein, 6 aa, Entamoeba dispar
QDTIQK

SEQ ID NO: 2410117 - protein, 14 aa, Entamoeba dispar
QEANKDAFIPYPFV

SEQ ID NO: 2410118 - protein, 16 aa, Entamoeba dispar
QEAQRLAAKKQQMEKS

SEQ ID NO: 2410119 - protein, 8 aa, Entamoeba dispar
QEEKKEMY

SEQ ID NO: 2410120 - protein, 10 aa, Entamoeba dispar
QEEQQKDFEG

SEQ ID NO: 2410121 - protein, 4 aa, Entamoeba dispar
QEFT

SEQ ID NO: 2410122 - protein, 5 aa, Entamoeba dispar
QEGAY

SEQ ID NO: 2410123 - protein, 11 aa, Entamoeba dispar
QEGVQGPYEGY

SEQ ID NO: 2410124 - protein, 17 aa, Entamoeba dispar
QEIREKEYQRFRDGESR

SEQ ID NO: 2410125 - protein, 8 aa, Entamoeba dispar
QEKEAWNE

SEQ ID NO: 2410126 - protein, 10 aa, Entamoeba dispar
QEKEQGNECK

SEQ ID NO: 2410127 - protein, 4 aa, Entamoeba dispar
QEKG

SEQ ID NO: 2410128 - protein, 6 aa, Entamoeba dispar
QEKGSC

SEQ ID NO: 2410129 - protein, 27 aa, Entamoeba dispar
QEKIEEEKKKIEEEKKKIEEEEERQKK

SEQ ID NO: 2410130 - protein, 6 aa, Entamoeba dispar
QEKYEN

SEQ ID NO: 2410131 - protein, 4 aa, Entamoeba dispar
QELK

SEQ ID NO: 2410132 - protein, 7 aa, Entamoeba dispar
QELPQEL

SEQ ID NO: 2410133 - protein, 13 aa, Entamoeba dispar
QEMEKEKKDNELL

SEQ ID NO: 2410134 - protein, 7 aa, Entamoeba dispar
QENDKKL

SEQ ID NO: 2410135 - protein, 7 aa, Entamoeba dispar
QENPIKQ

SEQ ID NO: 2410136 - protein, 8 aa, Entamoeba dispar
QENTNETK

SEQ ID NO: 2410137 - protein, 4 aa, Entamoeba dispar
QEPT

SEQ ID NO: 2410138 - protein, 14 aa, Entamoeba dispar
QEQETKQKEQPTTT

SEQ ID NO: 2410139 - protein, 4 aa, Entamoeba dispar
QESE

SEQ ID NO: 2410140 - protein, 7 aa, Entamoeba dispar
QESEISI

SEQ ID NO: 2410141 - protein, 8 aa, Entamoeba dispar
QESQGQYQ

SEQ ID NO: 2410142 - protein, 4 aa, Entamoeba dispar
QETL

SEQ ID NO: 2410143 - protein, 5 aa, Entamoeba dispar
QETLQ

SEQ ID NO: 2410144 - protein, 5 aa, Entamoeba dispar
QEYTN

SEQ ID NO: 2410145 - protein, 6 aa, Entamoeba dispar
QFENCS

SEQ ID NO: 2410146 - protein, 10 aa, Entamoeba dispar
QFGCNGKEPY

SEQ ID NO: 2410147 - protein, 10 aa, Entamoeba dispar
QFPHVSGEQL

SEQ ID NO: 2410148 - protein, 14 aa, Entamoeba dispar
QFPQQQENKQSDFE

SEQ ID NO: 2410149 - protein, 4 aa, Entamoeba dispar
QGAA

SEQ ID NO: 2410150 - protein, 9 aa, Entamoeba dispar
QGEQRENTV

SEQ ID NO: 2410151 - protein, 4 aa, Entamoeba dispar
QGGY

SEQ ID NO: 2410152 - protein, 6 aa, Entamoeba dispar
QGKYDM

SEQ ID NO: 2410153 - protein, 5 aa, Entamoeba dispar
QGNES

SEQ ID NO: 2410154 - protein, 5 aa, Entamoeba dispar
QGTSC

SEQ ID NO: 2410155 - protein, 20 aa, Entamoeba dispar
QHADNVTNEEIAKGLEEEVT

SEQ ID NO: 2410156 - protein, 6 aa, Entamoeba dispar
QHPDND

SEQ ID NO: 2410157 - protein, 4 aa, Entamoeba dispar
QHQF

SEQ ID NO: 2410158 - protein, 10 aa, Entamoeba dispar
QHREETNERM

SEQ ID NO: 2410159 - protein, 24 aa, Entamoeba dispar
QIKEEKKEVNKTVKIKGNNQRYVR

SEQ ID NO: 2410160 - protein, 4 aa, Entamoeba dispar
QIPW

SEQ ID NO: 2410161 - protein, 5 aa, Entamoeba dispar
QIQPF

SEQ ID NO: 2410162 - protein, 12 aa, Entamoeba dispar
QISTKGSIPKRV

SEQ ID NO: 2410163 - protein, 22 aa, Entamoeba dispar
QITSSQPLSSGLPGNDSLRQAL

SEQ ID NO: 2410164 - protein, 5 aa, Entamoeba dispar
QIVPP

SEQ ID NO: 2410165 - protein, 9 aa, Entamoeba dispar
QKAGMSAEQ

SEQ ID NO: 2410166 - protein, 5 aa, Entamoeba dispar
QKEAQ

SEQ ID NO: 2410167 - protein, 10 aa, Entamoeba dispar
QKEKTTPQIV

SEQ ID NO: 2410168 - protein, 9 aa, Entamoeba dispar
QKESPDYNP

SEQ ID NO: 2410169 - protein, 6 aa, Entamoeba dispar
QKEVEE

SEQ ID NO: 2410170 - protein, 12 aa, Entamoeba dispar
QKFSATPKYLAY

SEQ ID NO: 2410171 - protein, 9 aa, Entamoeba dispar
QKGINKNES

SEQ ID NO: 2410172 - protein, 15 aa, Entamoeba dispar
QKGRAKTRTTSAEKR

SEQ ID NO: 2410173 - protein, 4 aa, Entamoeba dispar
QKGW

SEQ ID NO: 2410174 - protein, 6 aa, Entamoeba dispar
QKHGND

SEQ ID NO: 2410175 - protein, 10 aa, Entamoeba dispar
QKIKKDENEL

SEQ ID NO: 2410176 - protein, 6 aa, Entamoeba dispar
QKKEVV

SEQ ID NO: 2410177 - protein, 8 aa, Entamoeba dispar
QKKHTEAL

SEQ ID NO: 2410178 - protein, 6 aa, Entamoeba dispar
QKKPNY

SEQ ID NO: 2410179 - protein, 9 aa, Entamoeba dispar
QKKVEEQND

SEQ ID NO: 2410180 - protein, 22 aa, Entamoeba dispar
QKKVNGDECCEGKENGFKPSEL

SEQ ID NO: 2410181 - protein, 6 aa, Entamoeba dispar
QKLQET

SEQ ID NO: 2410182 - protein, 10 aa, Entamoeba dispar
QKMTEEEKER

SEQ ID NO: 2410183 - protein, 18 aa, Entamoeba dispar
QKQEDGKEEEGVFKEDQK

SEQ ID NO: 2410184 - protein, 11 aa, Entamoeba dispar
QKQTSAGQRTR

SEQ ID NO: 2410185 - protein, 8 aa, Entamoeba dispar
QKRGMTQK

SEQ ID NO: 2410186 - protein, 12 aa, Entamoeba dispar
QKSSQELRKDGR

SEQ ID NO: 2410187 - protein, 8 aa, Entamoeba dispar
QKTPLTQQ

SEQ ID NO: 2410188 - protein, 4 aa, Entamoeba dispar
QKTV

SEQ ID NO: 2410189 - protein, 6 aa, Entamoeba dispar
QKTYET

SEQ ID NO: 2410190 - protein, 11 aa, Entamoeba dispar
QKVAGKVTAVR

SEQ ID NO: 2410191 - protein, 5 aa, Entamoeba dispar
QKYGP

SEQ ID NO: 2410192 - protein, 14 aa, Entamoeba dispar
QLERPNERTPLERA

SEQ ID NO: 2410193 - protein, 14 aa, Entamoeba dispar
QLGEESSSYSAKLY

SEQ ID NO: 2410194 - protein, 4 aa, Entamoeba dispar
QLGG

SEQ ID NO: 2410195 - protein, 9 aa, Entamoeba dispar
QLKKEGKEL

SEQ ID NO: 2410196 - protein, 13 aa, Entamoeba dispar
QLKQKAVAEAKEK

SEQ ID NO: 2410197 - protein, 4 aa, Entamoeba dispar
QLQN

SEQ ID NO: 2410198 - protein, 5 aa, Entamoeba dispar
QLTNK

SEQ ID NO: 2410199 - protein, 4 aa, Entamoeba dispar
QMEK

SEQ ID NO: 2410200 - protein, 7 aa, Entamoeba dispar
QMERNKK

SEQ ID NO: 2410201 - protein, 15 aa, Entamoeba dispar
QMNEEQEITTTNNRK

SEQ ID NO: 2410202 - protein, 10 aa, Entamoeba dispar
QMTGKINEGG

SEQ ID NO: 2410203 - protein, 4 aa, Entamoeba dispar
QNEI

SEQ ID NO: 2410204 - protein, 4 aa, Entamoeba dispar
QNEV

SEQ ID NO: 2410205 - protein, 5 aa, Entamoeba dispar
QNGSL

SEQ ID NO: 2410206 - protein, 4 aa, Entamoeba dispar
QNKE

SEQ ID NO: 2410207 - protein, 6 aa, Entamoeba dispar
QNKGIA

SEQ ID NO: 2410208 - protein, 5 aa, Entamoeba dispar
QNKIP

SEQ ID NO: 2410209 - protein, 10 aa, Entamoeba dispar
QNKKHPEEGA

SEQ ID NO: 2410210 - protein, 4 aa, Entamoeba dispar
QNKN

SEQ ID NO: 2410211 - protein, 11 aa, Entamoeba dispar
QNNTPAKPFQD

SEQ ID NO: 2410212 - protein, 8 aa, Entamoeba dispar
QNPNADIS

SEQ ID NO: 2410213 - protein, 8 aa, Entamoeba dispar
QNPNSDIS

SEQ ID NO: 2410214 - protein, 5 aa, Entamoeba dispar
QNPTT

SEQ ID NO: 2410215 - protein, 4 aa, Entamoeba dispar
QNQK

SEQ ID NO: 2410216 - protein, 4 aa, Entamoeba dispar
QNQM

SEQ ID NO: 2410217 - protein, 6 aa, Entamoeba dispar
QNQNSL

SEQ ID NO: 2410218 - protein, 5 aa, Entamoeba dispar
QNSIP

SEQ ID NO: 2410219 - protein, 12 aa, Entamoeba dispar
QNSQNTANSRLT

SEQ ID NO: 2410220 - protein, 4 aa, Entamoeba dispar
QNSS

SEQ ID NO: 2410221 - protein, 14 aa, Entamoeba dispar
QNSSTQIKESKHRS

SEQ ID NO: 2410222 - protein, 5 aa, Entamoeba dispar
QNTIE

SEQ ID NO: 2410223 - protein, 5 aa, Entamoeba dispar
QNVPN

SEQ ID NO: 2410224 - protein, 7 aa, Entamoeba dispar
QNVQPTL

SEQ ID NO: 2410225 - protein, 28 aa, Entamoeba dispar
QPALQSKNISIQENTTTTYTPDSNYSGF

SEQ ID NO: 2410226 - protein, 28 aa, Entamoeba dispar
QPALQSKNISIQQNTTTTYTPDSNYSGF

SEQ ID NO: 2410227 - protein, 4 aa, Entamoeba dispar
QPES

SEQ ID NO: 2410228 - protein, 21 aa, Entamoeba dispar
QPKEFGEEEIDKAKIENDEEL

SEQ ID NO: 2410229 - protein, 16 aa, Entamoeba dispar
QPNINTVKRDSDIPPQ

SEQ ID NO: 2410230 - protein, 38 aa, Entamoeba dispar
QPQEQKSSNQEMKQERRERGGEIGNQGNKRSGEKMNEK

SEQ ID NO: 2410231 - protein, 18 aa, Entamoeba dispar
QPQIGYKQKQKQIDYEYE

SEQ ID NO: 2410232 - protein, 15 aa, Entamoeba dispar
QPQPIKTSPNAPISV

SEQ ID NO: 2410233 - protein, 5 aa, Entamoeba dispar
QPRRI

SEQ ID NO: 2410234 - protein, 6 aa, Entamoeba dispar
QPSYDN

SEQ ID NO: 2410235 - protein, 4 aa, Entamoeba dispar
QPTN

SEQ ID NO: 2410236 - protein, 9 aa, Entamoeba dispar
QPTSQHEYT

SEQ ID NO: 2410237 - protein, 4 aa, Entamoeba dispar
QPVE

SEQ ID NO: 2410238 - protein, 5 aa, Entamoeba dispar
QPVNE

SEQ ID NO: 2410239 - protein, 8 aa, Entamoeba dispar
QQFEPSET

SEQ ID NO: 2410240 - protein, 6 aa, Entamoeba dispar
QQFNPN

SEQ ID NO: 2410241 - protein, 4 aa, Entamoeba dispar
QQIR

SEQ ID NO: 2410242 - protein, 13 aa, Entamoeba dispar
QQLEKIKNDYENA

SEQ ID NO: 2410243 - protein, 25 aa, Entamoeba dispar
QQLQPNKTTSSLQLNQSTKTMRRPL

SEQ ID NO: 2410244 - protein, 5 aa, Entamoeba dispar
QQLRG

SEQ ID NO: 2410245 - protein, 5 aa, Entamoeba dispar
QQNEH

SEQ ID NO: 2410246 - protein, 14 aa, Entamoeba dispar
QQNGLTQNVAQGAT

SEQ ID NO: 2410247 - protein, 12 aa, Entamoeba dispar
QQPTQHPLPSPQ

SEQ ID NO: 2410248 - protein, 12 aa, Entamoeba dispar
QQQRAYDAQQIQ

SEQ ID NO: 2410249 - protein, 11 aa, Entamoeba dispar
QQQYQQNNSQF

SEQ ID NO: 2410250 - protein, 10 aa, Entamoeba dispar
QQRQNRSAEY

SEQ ID NO: 2410251 - protein, 6 aa, Entamoeba dispar
QQSTCR

SEQ ID NO: 2410252 - protein, 6 aa, Entamoeba dispar
QQTHEE

SEQ ID NO: 2410253 - protein, 7 aa, Entamoeba dispar
QQTKMNE

SEQ ID NO: 2410254 - protein, 8 aa, Entamoeba dispar
QQVGQATE

SEQ ID NO: 2410255 - protein, 7 aa, Entamoeba dispar
QQYETTQ

SEQ ID NO: 2410256 - protein, 6 aa, Entamoeba dispar
QRDNEI

SEQ ID NO: 2410257 - protein, 4 aa, Entamoeba dispar
QREL

SEQ ID NO: 2410258 - protein, 9 aa, Entamoeba dispar
QRGELNSTT

SEQ ID NO: 2410259 - protein, 10 aa, Entamoeba dispar
QRGKNAEEAC

SEQ ID NO: 2410260 - protein, 6 aa, Entamoeba dispar
QRIGSG

SEQ ID NO: 2410261 - protein, 6 aa, Entamoeba dispar
QRIPGS

SEQ ID NO: 2410262 - protein, 8 aa, Entamoeba dispar
QRKDEEFE

SEQ ID NO: 2410263 - protein, 11 aa, Entamoeba dispar
QRNNSLPGDEV

SEQ ID NO: 2410264 - protein, 5 aa, Entamoeba dispar
QRPDA

SEQ ID NO: 2410265 - protein, 4 aa, Entamoeba dispar
QRRS

SEQ ID NO: 2410266 - protein, 7 aa, Entamoeba dispar
QRYEKRH

SEQ ID NO: 2410267 - protein, 8 aa, Entamoeba dispar
QSASPKQL

SEQ ID NO: 2410268 - protein, 19 aa, Entamoeba dispar
QSATHKTINCGTNKPERSV

SEQ ID NO: 2410269 - protein, 9 aa, Entamoeba dispar
QSDEAIKQK

SEQ ID NO: 2410270 - protein, 4 aa, Entamoeba dispar
QSEI

SEQ ID NO: 2410271 - protein, 8 aa, Entamoeba dispar
QSGEESAI

SEQ ID NO: 2410272 - protein, 12 aa, Entamoeba dispar
QSGGYPDNLPPV

SEQ ID NO: 2410273 - protein, 6 aa, Entamoeba dispar
QSHQNE

SEQ ID NO: 2410274 - protein, 7 aa, Entamoeba dispar
QSINNND

SEQ ID NO: 2410275 - protein, 20 aa, Entamoeba dispar
QSKKCSEDVTEIQEKNEVER

SEQ ID NO: 2410276 - protein, 11 aa, Entamoeba dispar
QSKKETEEANI

SEQ ID NO: 2410277 - protein, 4 aa, Entamoeba dispar
QSKN

SEQ ID NO: 2410278 - protein, 8 aa, Entamoeba dispar
QSKNTKPQ

SEQ ID NO: 2410279 - protein, 15 aa, Entamoeba dispar
QSKSSTQNVSATPQK

SEQ ID NO: 2410280 - protein, 7 aa, Entamoeba dispar
QSLKQNN

SEQ ID NO: 2410281 - protein, 4 aa, Entamoeba dispar
QSNR

SEQ ID NO: 2410282 - protein, 17 aa, Entamoeba dispar
QSPPSPQPLLDLIKQVA

SEQ ID NO: 2410283 - protein, 5 aa, Entamoeba dispar
QSRTE

SEQ ID NO: 2410284 - protein, 9 aa, Entamoeba dispar
QSTEQKKPL

SEQ ID NO: 2410285 - protein, 5 aa, Entamoeba dispar
QSYGF

SEQ ID NO: 2410286 - protein, 12 aa, Entamoeba dispar
QSYQTDKSISEA

SEQ ID NO: 2410287 - protein, 16 aa, Entamoeba dispar
QSYSTGSVRDPEEKSI

SEQ ID NO: 2410288 - protein, 7 aa, Entamoeba dispar
QTASESK

SEQ ID NO: 2410289 - protein, 5 aa, Entamoeba dispar
QTDKG

SEQ ID NO: 2410290 - protein, 11 aa, Entamoeba dispar
QTDKKDKTKSY

SEQ ID NO: 2410291 - protein, 5 aa, Entamoeba dispar
QTDPS

SEQ ID NO: 2410292 - protein, 16 aa, Entamoeba dispar
QTEEITKEIQNTQNRI

SEQ ID NO: 2410293 - protein, 6 aa, Entamoeba dispar
QTEKED

SEQ ID NO: 2410294 - protein, 15 aa, Entamoeba dispar
QTENDEKKSGYQERI

SEQ ID NO: 2410295 - protein, 4 aa, Entamoeba dispar
QTIS

SEQ ID NO: 2410296 - protein, 9 aa, Entamoeba dispar
QTKNPKMKT

SEQ ID NO: 2410297 - protein, 9 aa, Entamoeba dispar
QTPNGPKRV

SEQ ID NO: 2410298 - protein, 7 aa, Entamoeba dispar
QTPSMSN

SEQ ID NO: 2410299 - protein, 7 aa, Entamoeba dispar
QTPSTLQ

SEQ ID NO: 2410300 - protein, 7 aa, Entamoeba dispar
QTQFQQQ

SEQ ID NO: 2410301 - protein, 15 aa, Entamoeba dispar
QTQRERRSDESIEIG

SEQ ID NO: 2410302 - protein, 5 aa, Entamoeba dispar
QTSPN

SEQ ID NO: 2410303 - protein, 5 aa, Entamoeba dispar
QTTEQ

SEQ ID NO: 2410304 - protein, 11 aa, Entamoeba dispar
QTTQSQRWDKP

SEQ ID NO: 2410305 - protein, 7 aa, Entamoeba dispar
QVGRKSD

SEQ ID NO: 2410306 - protein, 9 aa, Entamoeba dispar
QVKKTKKTI

SEQ ID NO: 2410307 - protein, 8 aa, Entamoeba dispar
QVTKNTKI

SEQ ID NO: 2410308 - protein, 12 aa, Entamoeba dispar
QVTQKKGYKKGN

SEQ ID NO: 2410309 - protein, 4 aa, Entamoeba dispar
QYAE

SEQ ID NO: 2410310 - protein, 9 aa, Entamoeba dispar
QYEQIEEEN

SEQ ID NO: 2410311 - protein, 5 aa, Entamoeba dispar
QYGPV

SEQ ID NO: 2410312 - protein, 8 aa, Entamoeba dispar
QYQPSSPL

SEQ ID NO: 2410313 - protein, 5 aa, Entamoeba dispar
QYSLS

SEQ ID NO: 2410314 - protein, 10 aa, Entamoeba dispar
QYTARNGSNF

SEQ ID NO: 2410315 - protein, 4 aa, Entamoeba dispar
QYTK

SEQ ID NO: 2410316 - protein, 17 aa, Entamoeba dispar
RAATSQDDIVGDGTTST

SEQ ID NO: 2410317 - protein, 4 aa, Entamoeba dispar
RADK

SEQ ID NO: 2410318 - protein, 12 aa, Entamoeba dispar
RADKVQVSQPEI

SEQ ID NO: 2410319 - protein, 25 aa, Entamoeba dispar
RADYEKEIEEMKKKTEEDKKREEEL

SEQ ID NO: 2410320 - protein, 8 aa, Entamoeba dispar
RAGSTVES

SEQ ID NO: 2410321 - protein, 7 aa, Entamoeba dispar
RAKEIEE

SEQ ID NO: 2410322 - protein, 12 aa, Entamoeba dispar
RAQEAIESGCND

SEQ ID NO: 2410323 - protein, 7 aa, Entamoeba dispar
RAQGQDE

SEQ ID NO: 2410324 - protein, 6 aa, Entamoeba dispar
RAQKRD

SEQ ID NO: 2410325 - protein, 4 aa, Entamoeba dispar
RASI

SEQ ID NO: 2410326 - protein, 15 aa, Entamoeba dispar
RASTQTNEGGISDDL

SEQ ID NO: 2410327 - protein, 5 aa, Entamoeba dispar
RATNE

SEQ ID NO: 2410328 - protein, 9 aa, Entamoeba dispar
RCENSGVAK

SEQ ID NO: 2410329 - protein, 7 aa, Entamoeba dispar
RCKPGKC

SEQ ID NO: 2410330 - protein, 12 aa, Entamoeba dispar
RCTAGSAKYHPE

SEQ ID NO: 2410331 - protein, 11 aa, Entamoeba dispar
RCVTGSSDKSI

SEQ ID NO: 2410332 - protein, 13 aa, Entamoeba dispar
RDGELKPGQKGIS

SEQ ID NO: 2410333 - protein, 16 aa, Entamoeba dispar
RDITEEEKEKREQKNK

SEQ ID NO: 2410334 - protein, 10 aa, Entamoeba dispar
RDNVDSKLIT

SEQ ID NO: 2410335 - protein, 32 aa, Entamoeba dispar
RDPDNYRPRINKENSQKDQEQKREGKYFHTEL

SEQ ID NO: 2410336 - protein, 4 aa, Entamoeba dispar
RDPE

SEQ ID NO: 2410337 - protein, 18 aa, Entamoeba dispar
RDPEEEIKGKKEEIKEPV

SEQ ID NO: 2410338 - protein, 10 aa, Entamoeba dispar
RDPTKRPQIS

SEQ ID NO: 2410339 - protein, 10 aa, Entamoeba dispar
RDSKADKAIL

SEQ ID NO: 2410340 - protein, 4 aa, Entamoeba dispar
RDSS

SEQ ID NO: 2410341 - protein, 8 aa, Entamoeba dispar
RDYSKGLT

SEQ ID NO: 2410342 - protein, 13 aa, Entamoeba dispar
REEREKKKGETLI

SEQ ID NO: 2410343 - protein, 6 aa, Entamoeba dispar
REESPH

SEQ ID NO: 2410344 - protein, 8 aa, Entamoeba dispar
REESTPLT

SEQ ID NO: 2410345 - protein, 15 aa, Entamoeba dispar
REGEEKDKKQGNTTD

SEQ ID NO: 2410346 - protein, 4 aa, Entamoeba dispar
REGQ

SEQ ID NO: 2410347 - protein, 23 aa, Entamoeba dispar
REIEDRTDSLFDKGSSSKEKDSW

SEQ ID NO: 2410348 - protein, 13 aa, Entamoeba dispar
REIKEAKAGTPLF

SEQ ID NO: 2410349 - protein, 25 aa, Entamoeba dispar
REKELKEELGNVTSEIDAVKEEKRE

SEQ ID NO: 2410350 - protein, 10 aa, Entamoeba dispar
REKEPNNEGL

SEQ ID NO: 2410351 - protein, 6 aa, Entamoeba dispar
REMEED

SEQ ID NO: 2410352 - protein, 9 aa, Entamoeba dispar
RENISSEAM

SEQ ID NO: 2410353 - protein, 13 aa, Entamoeba dispar
REPFESKSEVKIP

SEQ ID NO: 2410354 - protein, 9 aa, Entamoeba dispar
RERAEKSDA

SEQ ID NO: 2410355 - protein, 4 aa, Entamoeba dispar
RESF

SEQ ID NO: 2410356 - protein, 9 aa, Entamoeba dispar
RESKTYEAI

SEQ ID NO: 2410357 - protein, 5 aa, Entamoeba dispar
RFNEE

SEQ ID NO: 2410358 - protein, 9 aa, Entamoeba dispar
RFSDKNGIS

SEQ ID NO: 2410359 - protein, 10 aa, Entamoeba dispar
RFTPGSFTNQ

SEQ ID NO: 2410360 - protein, 4 aa, Entamoeba dispar
RGDF

SEQ ID NO: 2410361 - protein, 4 aa, Entamoeba dispar
RGGK

SEQ ID NO: 2410362 - protein, 8 aa, Entamoeba dispar
RGGKTSHA

SEQ ID NO: 2410363 - protein, 4 aa, Entamoeba dispar
RGKE

SEQ ID NO: 2410364 - protein, 6 aa, Entamoeba dispar
RGKTTL

SEQ ID NO: 2410365 - protein, 5 aa, Entamoeba dispar
RGNFS

SEQ ID NO: 2410366 - protein, 5 aa, Entamoeba dispar
RGQND

SEQ ID NO: 2410367 - protein, 4 aa, Entamoeba dispar
RGRT

SEQ ID NO: 2410368 - protein, 8 aa, Entamoeba dispar
RGSMDSAA

SEQ ID NO: 2410369 - protein, 11 aa, Entamoeba dispar
RHETKTSKTFS

SEQ ID NO: 2410370 - protein, 4 aa, Entamoeba dispar
RHIG

SEQ ID NO: 2410371 - protein, 4 aa, Entamoeba dispar
RHPL

SEQ ID NO: 2410372 - protein, 7 aa, Entamoeba dispar
RHPPPSL

SEQ ID NO: 2410373 - protein, 19 aa, Entamoeba dispar
RHTGHGKRKGTKNARTPQK

SEQ ID NO: 2410374 - protein, 14 aa, Entamoeba dispar
RIENSKSRNEPKPI

SEQ ID NO: 2410375 - protein, 6 aa, Entamoeba dispar
RIGSGR

SEQ ID NO: 2410376 - protein, 11 aa, Entamoeba dispar
RINGKEIRERD

SEQ ID NO: 2410377 - protein, 11 aa, Entamoeba dispar
RINGKEISERD

SEQ ID NO: 2410378 - protein, 14 aa, Entamoeba dispar
RINTSKKEIPSQIP

SEQ ID NO: 2410379 - protein, 4 aa, Entamoeba dispar
RIPT

SEQ ID NO: 2410380 - protein, 7 aa, Entamoeba dispar
RITYTGE

SEQ ID NO: 2410381 - protein, 9 aa, Entamoeba dispar
RKATENCTG

SEQ ID NO: 2410382 - protein, 10 aa, Entamoeba dispar
RKDNNTRQLS

SEQ ID NO: 2410383 - protein, 8 aa, Entamoeba dispar
RKDNPQRV

SEQ ID NO: 2410384 - protein, 10 aa, Entamoeba dispar
RKEEIEKRRK

SEQ ID NO: 2410385 - protein, 6 aa, Entamoeba dispar
RKEHGV

SEQ ID NO: 2410386 - protein, 16 aa, Entamoeba dispar
RKEIEEGAKRKEHKDI

SEQ ID NO: 2410387 - protein, 6 aa, Entamoeba dispar
RKEIGN

SEQ ID NO: 2410388 - protein, 7 aa, Entamoeba dispar
RKEIKET

SEQ ID NO: 2410389 - protein, 4 aa, Entamoeba dispar
RKEN

SEQ ID NO: 2410390 - protein, 5 aa, Entamoeba dispar
RKESF

SEQ ID NO: 2410391 - protein, 15 aa, Entamoeba dispar
RKETTGFPPNQTVDT

SEQ ID NO: 2410392 - protein, 6 aa, Entamoeba dispar
RKFEEK

SEQ ID NO: 2410393 - protein, 8 aa, Entamoeba dispar
RKFNQEKK

SEQ ID NO: 2410394 - protein, 8 aa, Entamoeba dispar
RKHTEEVD

SEQ ID NO: 2410395 - protein, 14 aa, Entamoeba dispar
RKIEENEVNNSHNG

SEQ ID NO: 2410396 - protein, 15 aa, Entamoeba dispar
RKKKEEKTEEENKTY

SEQ ID NO: 2410397 - protein, 6 aa, Entamoeba dispar
RKKRNR

SEQ ID NO: 2410398 - protein, 10 aa, Entamoeba dispar
RKKSTSTSIA

SEQ ID NO: 2410399 - protein, 4 aa, Entamoeba dispar
RKKY

SEQ ID NO: 2410400 - protein, 9 aa, Entamoeba dispar
RKLGQEDLE

SEQ ID NO: 2410401 - protein, 19 aa, Entamoeba dispar
RKLKNKESARKSRQKSKEA

SEQ ID NO: 2410402 - protein, 9 aa, Entamoeba dispar
RKPEMKRKV

SEQ ID NO: 2410403 - protein, 14 aa, Entamoeba dispar
RKRMEEEKNDKKRY

SEQ ID NO: 2410404 - protein, 8 aa, Entamoeba dispar
RKRMQDKI

SEQ ID NO: 2410405 - protein, 8 aa, Entamoeba dispar
RKSDAKKH

SEQ ID NO: 2410406 - protein, 8 aa, Entamoeba dispar
RKSEMADD

SEQ ID NO: 2410407 - protein, 13 aa, Entamoeba dispar
RKSKRISKKEYRY

SEQ ID NO: 2410408 - protein, 15 aa, Entamoeba dispar
RKSLEKSREVLKSRE

SEQ ID NO: 2410409 - protein, 14 aa, Entamoeba dispar
RKSYYTKKYPNSTI

SEQ ID NO: 2410410 - protein, 15 aa, Entamoeba dispar
RKTNNGIQQSNKSIP

SEQ ID NO: 2410411 - protein, 9 aa, Entamoeba dispar
RKYNEGRMR

SEQ ID NO: 2410412 - protein, 7 aa, Entamoeba dispar
RLAKTNA

SEQ ID NO: 2410413 - protein, 8 aa, Entamoeba dispar
RLKDEKVH

SEQ ID NO: 2410414 - protein, 24 aa, Entamoeba dispar
RMDSKTISKMTKKQAKRTQEAQLN

SEQ ID NO: 2410415 - protein, 7 aa, Entamoeba dispar
RNAQPNS

SEQ ID NO: 2410416 - protein, 10 aa, Entamoeba dispar
RNDATKGHAV

SEQ ID NO: 2410417 - protein, 6 aa, Entamoeba dispar
RNFNTR

SEQ ID NO: 2410418 - protein, 7 aa, Entamoeba dispar
RNGCGKT

SEQ ID NO: 2410419 - protein, 22 aa, Entamoeba dispar
RNGIDKATANVVTNPEGGQNLT

SEQ ID NO: 2410420 - protein, 14 aa, Entamoeba dispar
RNIEEEAKKYITKG

SEQ ID NO: 2410421 - protein, 5 aa, Entamoeba dispar
RNKTE

SEQ ID NO: 2410422 - protein, 7 aa, Entamoeba dispar
RNNDIAK

SEQ ID NO: 2410423 - protein, 7 aa, Entamoeba dispar
RNNDKQR

SEQ ID NO: 2410424 - protein, 19 aa, Entamoeba dispar
RNNTNQTSHCEEQTDSIIS

SEQ ID NO: 2410425 - protein, 17 aa, Entamoeba dispar
RNPLADSPSTNPITPQS

SEQ ID NO: 2410426 - protein, 8 aa, Entamoeba dispar
RNQLNDQV

SEQ ID NO: 2410427 - protein, 18 aa, Entamoeba dispar
RNRAVAATKCNAQSSRSH

SEQ ID NO: 2410428 - protein, 9 aa, Entamoeba dispar
RNRPLEYGP

SEQ ID NO: 2410429 - protein, 9 aa, Entamoeba dispar
RNRSNNPVV

SEQ ID NO: 2410430 - protein, 5 aa, Entamoeba dispar
RNVRE

SEQ ID NO: 2410431 - protein, 7 aa, Entamoeba dispar
RPERMAK

SEQ ID NO: 2410432 - protein, 14 aa, Entamoeba dispar
RPFGGKDNDMDIIY

SEQ ID NO: 2410433 - protein, 5 aa, Entamoeba dispar
RPGRL

SEQ ID NO: 2410434 - protein, 4 aa, Entamoeba dispar
RPHE

SEQ ID NO: 2410435 - protein, 7 aa, Entamoeba dispar
RPKNGRT

SEQ ID NO: 2410436 - protein, 4 aa, Entamoeba dispar
RPKR

SEQ ID NO: 2410437 - protein, 8 aa, Entamoeba dispar
RPPENEEN

SEQ ID NO: 2410438 - protein, 4 aa, Entamoeba dispar
RPRH

SEQ ID NO: 2410439 - protein, 7 aa, Entamoeba dispar
RPRSFKA

SEQ ID NO: 2410440 - protein, 9 aa, Entamoeba dispar
RPSKKSTMT

SEQ ID NO: 2410441 - protein, 13 aa, Entamoeba dispar
RPSLNDPRDLRDP

SEQ ID NO: 2410442 - protein, 11 aa, Entamoeba dispar
RPVAHGNGGLG

SEQ ID NO: 2410443 - protein, 15 aa, Entamoeba dispar
RQEKQNIKFEKQGTC

SEQ ID NO: 2410444 - protein, 11 aa, Entamoeba dispar
RQETTSKNSEE

SEQ ID NO: 2410445 - protein, 8 aa, Entamoeba dispar
RQKFTPRA

SEQ ID NO: 2410446 - protein, 6 aa, Entamoeba dispar
RQKVTD

SEQ ID NO: 2410447 - protein, 7 aa, Entamoeba dispar
RQNQMPL

SEQ ID NO: 2410448 - protein, 6 aa, Entamoeba dispar
RQPIDN

SEQ ID NO: 2410449 - protein, 9 aa, Entamoeba dispar
RQPPKKSNV

SEQ ID NO: 2410450 - protein, 8 aa, Entamoeba dispar
RQQKIGES

SEQ ID NO: 2410451 - protein, 6 aa, Entamoeba dispar
RRDDIA

SEQ ID NO: 2410452 - protein, 8 aa, Entamoeba dispar
RREETLQN

SEQ ID NO: 2410453 - protein, 22 aa, Entamoeba dispar
RREKEKRRSSEISIKKEKKNIE

SEQ ID NO: 2410454 - protein, 7 aa, Entamoeba dispar
RRGGVKR

SEQ ID NO: 2410455 - protein, 9 aa, Entamoeba dispar
RRGRRGTLR

SEQ ID NO: 2410456 - protein, 12 aa, Entamoeba dispar
RRGYKKRATLKR

SEQ ID NO: 2410457 - protein, 24 aa, Entamoeba dispar
RRKEIEKGIKEKIEEETKKIEEEI

SEQ ID NO: 2410458 - protein, 4 aa, Entamoeba dispar
RRKG

SEQ ID NO: 2410459 - protein, 11 aa, Entamoeba dispar
RRNEKNGEVEI

SEQ ID NO: 2410460 - protein, 6 aa, Entamoeba dispar
RRPSYH

SEQ ID NO: 2410461 - protein, 10 aa, Entamoeba dispar
RRRERSRRRM

SEQ ID NO: 2410462 - protein, 7 aa, Entamoeba dispar
RSDNTLD

SEQ ID NO: 2410463 - protein, 9 aa, Entamoeba dispar
RSDTGQDPF

SEQ ID NO: 2410464 - protein, 27 aa, Entamoeba dispar
RSEEKKEKELTQKVKEETKPKRRKTEL

SEQ ID NO: 2410465 - protein, 11 aa, Entamoeba dispar
RSGLNEDKSAM

SEQ ID NO: 2410466 - protein, 7 aa, Entamoeba dispar
RSGRLNQ

SEQ ID NO: 2410467 - protein, 8 aa, Entamoeba dispar
RSHKEINN

SEQ ID NO: 2410468 - protein, 7 aa, Entamoeba dispar
RSHVTQE

SEQ ID NO: 2410469 - protein, 5 aa, Entamoeba dispar
RSIKG

SEQ ID NO: 2410470 - protein, 6 aa, Entamoeba dispar
RSNNNA

SEQ ID NO: 2410471 - protein, 6 aa, Entamoeba dispar
RSPADS

SEQ ID NO: 2410472 - protein, 7 aa, Entamoeba dispar
RSPSDSL

SEQ ID NO: 2410473 - protein, 4 aa, Entamoeba dispar
RSQI

SEQ ID NO: 2410474 - protein, 7 aa, Entamoeba dispar
RSRTNTF

SEQ ID NO: 2410475 - protein, 6 aa, Entamoeba dispar
RSSEEF

SEQ ID NO: 2410476 - protein, 5 aa, Entamoeba dispar
RSSFR

SEQ ID NO: 2410477 - protein, 4 aa, Entamoeba dispar
RSSM

SEQ ID NO: 2410478 - protein, 7 aa, Entamoeba dispar
RSSNREI

SEQ ID NO: 2410479 - protein, 8 aa, Entamoeba dispar
RSVDEGQT

SEQ ID NO: 2410480 - protein, 7 aa, Entamoeba dispar
RTARSIR

SEQ ID NO: 2410481 - protein, 5 aa, Entamoeba dispar
RTAYS

SEQ ID NO: 2410482 - protein, 5 aa, Entamoeba dispar
RTEIE

SEQ ID NO: 2410483 - protein, 4 aa, Entamoeba dispar
RTGG

SEQ ID NO: 2410484 - protein, 5 aa, Entamoeba dispar
RTKPE

SEQ ID NO: 2410485 - protein, 8 aa, Entamoeba dispar
RTKQQEIE

SEQ ID NO: 2410486 - protein, 8 aa, Entamoeba dispar
RTKRAPPI

SEQ ID NO: 2410487 - protein, 6 aa, Entamoeba dispar
RTKTKT

SEQ ID NO: 2410488 - protein, 8 aa, Entamoeba dispar
RTNPSKRK

SEQ ID NO: 2410489 - protein, 5 aa, Entamoeba dispar
RTNTQ

SEQ ID NO: 2410490 - protein, 20 aa, Entamoeba dispar
RTQNPQDATKILDSITLLID

SEQ ID NO: 2410491 - protein, 6 aa, Entamoeba dispar
RTQSKF

SEQ ID NO: 2410492 - protein, 11 aa, Entamoeba dispar
RTQVDGEKDID

SEQ ID NO: 2410493 - protein, 6 aa, Entamoeba dispar
RTSFDN

SEQ ID NO: 2410494 - protein, 4 aa, Entamoeba dispar
RTSK

SEQ ID NO: 2410495 - protein, 6 aa, Entamoeba dispar
RTSVET

SEQ ID NO: 2410496 - protein, 16 aa, Entamoeba dispar
RTTEEELKEKMGEYGD

SEQ ID NO: 2410497 - protein, 6 aa, Entamoeba dispar
RTTGKI

SEQ ID NO: 2410498 - protein, 13 aa, Entamoeba dispar
RTTNIIGDKGRRI

SEQ ID NO: 2410499 - protein, 14 aa, Entamoeba dispar
RTTTSTSKDQLRER

SEQ ID NO: 2410500 - protein, 9 aa, Entamoeba dispar
RVDESNEAV

SEQ ID NO: 2410501 - protein, 8 aa, Entamoeba dispar
RVEDNSPL

SEQ ID NO: 2410502 - protein, 12 aa, Entamoeba dispar
RVGEEMGEEGGV

SEQ ID NO: 2410503 - protein, 6 aa, Entamoeba dispar
RVQEEI

SEQ ID NO: 2410504 - protein, 7 aa, Entamoeba dispar
RVQRGED

SEQ ID NO: 2410505 - protein, 10 aa, Entamoeba dispar
RVSEDEADEL

SEQ ID NO: 2410506 - protein, 11 aa, Entamoeba dispar
RVSTDSGTSFT

SEQ ID NO: 2410507 - protein, 12 aa, Entamoeba dispar
RVSTDSGTSFTN

SEQ ID NO: 2410508 - protein, 7 aa, Entamoeba dispar
RVVEEKK

SEQ ID NO: 2410509 - protein, 5 aa, Entamoeba dispar
RWTPS

SEQ ID NO: 2410510 - protein, 8 aa, Entamoeba dispar
RYGDNPVT

SEQ ID NO: 2410511 - protein, 10 aa, Entamoeba dispar
RYPPNTPSSI

SEQ ID NO: 2410512 - protein, 18 aa, Entamoeba dispar
RYQQPYQPNYQYNGNNYP

SEQ ID NO: 2410513 - protein, 17 aa, Entamoeba dispar
SAAYEEWKSKNKPEDRP

SEQ ID NO: 2410514 - protein, 8 aa, Entamoeba dispar
SADETIER

SEQ ID NO: 2410515 - protein, 15 aa, Entamoeba dispar
SADHKKEFQNRFSNR

SEQ ID NO: 2410516 - protein, 9 aa, Entamoeba dispar
SAEGLSAKQ

SEQ ID NO: 2410517 - protein, 14 aa, Entamoeba dispar
SAFPKDNAAEKPHL

SEQ ID NO: 2410518 - protein, 5 aa, Entamoeba dispar
SAINK

SEQ ID NO: 2410519 - protein, 8 aa, Entamoeba dispar
SAKGTILS

SEQ ID NO: 2410520 - protein, 14 aa, Entamoeba dispar
SAKNRPAGADAGQF

SEQ ID NO: 2410521 - protein, 14 aa, Entamoeba dispar
SAKQSIDKRTPRRL

SEQ ID NO: 2410522 - protein, 7 aa, Entamoeba dispar
SANEECT

SEQ ID NO: 2410523 - protein, 8 aa, Entamoeba dispar
SAQQTKIT

SEQ ID NO: 2410524 - protein, 10 aa, Entamoeba dispar
SAQVESGREV

SEQ ID NO: 2410525 - protein, 7 aa, Entamoeba dispar
SARFGRK

SEQ ID NO: 2410526 - protein, 7 aa, Entamoeba dispar
SASTDRK

SEQ ID NO: 2410527 - protein, 7 aa, Entamoeba dispar
SATAPYN

SEQ ID NO: 2410528 - protein, 7 aa, Entamoeba dispar
SATDQPL

SEQ ID NO: 2410529 - protein, 5 aa, Entamoeba dispar
SATTL

SEQ ID NO: 2410530 - protein, 6 aa, Entamoeba dispar
SAVGKT

SEQ ID NO: 2410531 - protein, 7 aa, Entamoeba dispar
SAYLDSE

SEQ ID NO: 2410532 - protein, 7 aa, Entamoeba dispar
SCEEGNP

SEQ ID NO: 2410533 - protein, 6 aa, Entamoeba dispar
SCQRQN

SEQ ID NO: 2410534 - protein, 7 aa, Entamoeba dispar
SCYSNYR

SEQ ID NO: 2410535 - protein, 6 aa, Entamoeba dispar
SDASIQ

SEQ ID NO: 2410536 - protein, 4 aa, Entamoeba dispar
SDDS

SEQ ID NO: 2410537 - protein, 5 aa, Entamoeba dispar
SDEHG

SEQ ID NO: 2410538 - protein, 4 aa, Entamoeba dispar
SDEL

SEQ ID NO: 2410539 - protein, 8 aa, Entamoeba dispar
SDEQEIEQ

SEQ ID NO: 2410540 - protein, 4 aa, Entamoeba dispar
SDEY

SEQ ID NO: 2410541 - protein, 5 aa, Entamoeba dispar
SDGEK

SEQ ID NO: 2410542 - protein, 9 aa, Entamoeba dispar
SDGSNGSLE

SEQ ID NO: 2410543 - protein, 9 aa, Entamoeba dispar
SDGTSNAID

SEQ ID NO: 2410544 - protein, 25 aa, Entamoeba dispar
SDGTTNYSEQIPLTGKGHYTTQNGS

SEQ ID NO: 2410545 - protein, 6 aa, Entamoeba dispar
SDIQTA

SEQ ID NO: 2410546 - protein, 8 aa, Entamoeba dispar
SDITTINA

SEQ ID NO: 2410547 - protein, 8 aa, Entamoeba dispar
SDKTDTEL

SEQ ID NO: 2410548 - protein, 8 aa, Entamoeba dispar
SDKTQIEQ

SEQ ID NO: 2410549 - protein, 28 aa, Entamoeba dispar
SDKYLTQKSKSEKTEIKSEELKEEINNH

SEQ ID NO: 2410550 - protein, 4 aa, Entamoeba dispar
SDLQ

SEQ ID NO: 2410551 - protein, 8 aa, Entamoeba dispar
SDNDNKIT

SEQ ID NO: 2410552 - protein, 7 aa, Entamoeba dispar
SDNDTRL

SEQ ID NO: 2410553 - protein, 18 aa, Entamoeba dispar
SDNGTYEYTPNPSTDGIS

SEQ ID NO: 2410554 - protein, 18 aa, Entamoeba dispar
SDNGTYNYTPNPSTDGIS

SEQ ID NO: 2410555 - protein, 4 aa, Entamoeba dispar
SDNI

SEQ ID NO: 2410556 - protein, 6 aa, Entamoeba dispar
SDNKSV

SEQ ID NO: 2410557 - protein, 6 aa, Entamoeba dispar
SDNKTL

SEQ ID NO: 2410558 - protein, 7 aa, Entamoeba dispar
SDNSLKN

SEQ ID NO: 2410559 - protein, 7 aa, Entamoeba dispar
SDPYQNN

SEQ ID NO: 2410560 - protein, 9 aa, Entamoeba dispar
SDQQDTLET

SEQ ID NO: 2410561 - protein, 9 aa, Entamoeba dispar
SDQTRDTLP

SEQ ID NO: 2410562 - protein, 17 aa, Entamoeba dispar
SDSEQSGGNKLGKSQEI

SEQ ID NO: 2410563 - protein, 11 aa, Entamoeba dispar
SDSQLSSSKSF

SEQ ID NO: 2410564 - protein, 6 aa, Entamoeba dispar
SDSSCF

SEQ ID NO: 2410565 - protein, 7 aa, Entamoeba dispar
SDSSDFD

SEQ ID NO: 2410566 - protein, 9 aa, Entamoeba dispar
SDSSEFGGY

SEQ ID NO: 2410567 - protein, 5 aa, Entamoeba dispar
SDTNS

SEQ ID NO: 2410568 - protein, 10 aa, Entamoeba dispar
SDTQEGDISA

SEQ ID NO: 2410569 - protein, 9 aa, Entamoeba dispar
SDTRVETDE

SEQ ID NO: 2410570 - protein, 7 aa, Entamoeba dispar
SDYSGDF

SEQ ID NO: 2410571 - protein, 14 aa, Entamoeba dispar
SECPPNETSEYQNG

SEQ ID NO: 2410572 - protein, 7 aa, Entamoeba dispar
SEDEREM

SEQ ID NO: 2410573 - protein, 4 aa, Entamoeba dispar
SEDG

SEQ ID NO: 2410574 - protein, 14 aa, Entamoeba dispar
SEDGTAKTWEPRTC

SEQ ID NO: 2410575 - protein, 4 aa, Entamoeba dispar
SEDL

SEQ ID NO: 2410576 - protein, 5 aa, Entamoeba dispar
SEEEY

SEQ ID NO: 2410577 - protein, 4 aa, Entamoeba dispar
SEEM

SEQ ID NO: 2410578 - protein, 9 aa, Entamoeba dispar
SEESKGSTH

SEQ ID NO: 2410579 - protein, 5 aa, Entamoeba dispar
SEEYG

SEQ ID NO: 2410580 - protein, 7 aa, Entamoeba dispar
SEFETNE

SEQ ID NO: 2410581 - protein, 8 aa, Entamoeba dispar
SEFKGQQI

SEQ ID NO: 2410582 - protein, 9 aa, Entamoeba dispar
SEGSGATPV

SEQ ID NO: 2410583 - protein, 9 aa, Entamoeba dispar
SEGVPTQPR

SEQ ID NO: 2410584 - protein, 5 aa, Entamoeba dispar
SEHGD

SEQ ID NO: 2410585 - protein, 4 aa, Entamoeba dispar
SEHK

SEQ ID NO: 2410586 - protein, 15 aa, Entamoeba dispar
SEHPGWTREQRDVPL

SEQ ID NO: 2410587 - protein, 5 aa, Entamoeba dispar
SEIEQ

SEQ ID NO: 2410588 - protein, 5 aa, Entamoeba dispar
SEKGN

SEQ ID NO: 2410589 - protein, 7 aa, Entamoeba dispar
SEKQCPD

SEQ ID NO: 2410590 - protein, 4 aa, Entamoeba dispar
SELK

SEQ ID NO: 2410591 - protein, 6 aa, Entamoeba dispar
SELTRS

SEQ ID NO: 2410592 - protein, 10 aa, Entamoeba dispar
SENDDGLNDL

SEQ ID NO: 2410593 - protein, 25 aa, Entamoeba dispar
SENEEKKSGYKKRIEGYKQLKQSNE

SEQ ID NO: 2410594 - protein, 4 aa, Entamoeba dispar
SENG

SEQ ID NO: 2410595 - protein, 8 aa, Entamoeba dispar
SEPNNETN

SEQ ID NO: 2410596 - protein, 9 aa, Entamoeba dispar
SESDAIDPI

SEQ ID NO: 2410597 - protein, 4 aa, Entamoeba dispar
SESF

SEQ ID NO: 2410598 - protein, 5 aa, Entamoeba dispar
SESRE

SEQ ID NO: 2410599 - protein, 5 aa, Entamoeba dispar
SESSA

SEQ ID NO: 2410600 - protein, 9 aa, Entamoeba dispar
SEVQNDIDK

SEQ ID NO: 2410601 - protein, 7 aa, Entamoeba dispar
SEYKEDV

SEQ ID NO: 2410602 - protein, 7 aa, Entamoeba dispar
SEYPDGI

SEQ ID NO: 2410603 - protein, 6 aa, Entamoeba dispar
SEYSHQ

SEQ ID NO: 2410604 - protein, 4 aa, Entamoeba dispar
SFEQ

SEQ ID NO: 2410605 - protein, 4 aa, Entamoeba dispar
SFND

SEQ ID NO: 2410606 - protein, 4 aa, Entamoeba dispar
SFNN

SEQ ID NO: 2410607 - protein, 8 aa, Entamoeba dispar
SFQNGQNG

SEQ ID NO: 2410608 - protein, 6 aa, Entamoeba dispar
SFSPSG

SEQ ID NO: 2410609 - protein, 8 aa, Entamoeba dispar
SGADKKDL

SEQ ID NO: 2410610 - protein, 5 aa, Entamoeba dispar
SGAKG

SEQ ID NO: 2410611 - protein, 4 aa, Entamoeba dispar
SGDI

SEQ ID NO: 2410612 - protein, 6 aa, Entamoeba dispar
SGDKYR

SEQ ID NO: 2410613 - protein, 4 aa, Entamoeba dispar
SGDV

SEQ ID NO: 2410614 - protein, 5 aa, Entamoeba dispar
SGEEE

SEQ ID NO: 2410615 - protein, 7 aa, Entamoeba dispar
SGEGLET

SEQ ID NO: 2410616 - protein, 7 aa, Entamoeba dispar
SGEPIQT

SEQ ID NO: 2410617 - protein, 10 aa, Entamoeba dispar
SGGGDGPIDG

SEQ ID NO: 2410618 - protein, 4 aa, Entamoeba dispar
SGHD

SEQ ID NO: 2410619 - protein, 12 aa, Entamoeba dispar
SGIEESSINQEE

SEQ ID NO: 2410620 - protein, 9 aa, Entamoeba dispar
SGKTEGLAE

SEQ ID NO: 2410621 - protein, 7 aa, Entamoeba dispar
SGKTKET

SEQ ID NO: 2410622 - protein, 10 aa, Entamoeba dispar
SGLTKGPDSI

SEQ ID NO: 2410623 - protein, 4 aa, Entamoeba dispar
SGNI

SEQ ID NO: 2410624 - protein, 5 aa, Entamoeba dispar
SGNKF

SEQ ID NO: 2410625 - protein, 6 aa, Entamoeba dispar
SGNKYR

SEQ ID NO: 2410626 - protein, 6 aa, Entamoeba dispar
SGNPIN

SEQ ID NO: 2410627 - protein, 9 aa, Entamoeba dispar
SGNSEIKES

SEQ ID NO: 2410628 - protein, 8 aa, Entamoeba dispar
SGPGLKTG

SEQ ID NO: 2410629 - protein, 5 aa, Entamoeba dispar
SGPLC

SEQ ID NO: 2410630 - protein, 35 aa, Entamoeba dispar
SGQFQSESAVPKDTRYMNEGTTETTDTMGSVSSFS

SEQ ID NO: 2410631 - protein, 5 aa, Entamoeba dispar
SGSIR

SEQ ID NO: 2410632 - protein, 4 aa, Entamoeba dispar
SGSL

SEQ ID NO: 2410633 - protein, 7 aa, Entamoeba dispar
SGSSDRK

SEQ ID NO: 2410634 - protein, 4 aa, Entamoeba dispar
SGST

SEQ ID NO: 2410635 - protein, 4 aa, Entamoeba dispar
SGTA

SEQ ID NO: 2410636 - protein, 14 aa, Entamoeba dispar
SGTDGSCGSSPANL

SEQ ID NO: 2410637 - protein, 10 aa, Entamoeba dispar
SGTSGNPKGV

SEQ ID NO: 2410638 - protein, 4 aa, Entamoeba dispar
SGTV

SEQ ID NO: 2410639 - protein, 4 aa, Entamoeba dispar
SGVG

SEQ ID NO: 2410640 - protein, 9 aa, Entamoeba dispar
SGVPGEGEH

SEQ ID NO: 2410641 - protein, 25 aa, Entamoeba dispar
SGYDKGNKENEFNKESDSEKVSCAN

SEQ ID NO: 2410642 - protein, 7 aa, Entamoeba dispar
SHAAEMT

SEQ ID NO: 2410643 - protein, 5 aa, Entamoeba dispar
SHDET

SEQ ID NO: 2410644 - protein, 7 aa, Entamoeba dispar
SHPEHSK

SEQ ID NO: 2410645 - protein, 9 aa, Entamoeba dispar
SHSGSPEDI

SEQ ID NO: 2410646 - protein, 6 aa, Entamoeba dispar
SHSSSA

SEQ ID NO: 2410647 - protein, 16 aa, Entamoeba dispar
SHTTEIASQEDSTKEQ

SEQ ID NO: 2410648 - protein, 11 aa, Entamoeba dispar
SHVSGGPTHVE

SEQ ID NO: 2410649 - protein, 11 aa, Entamoeba dispar
SIAKLQDPRTV

SEQ ID NO: 2410650 - protein, 6 aa, Entamoeba dispar
SIDDNN

SEQ ID NO: 2410651 - protein, 4 aa, Entamoeba dispar
SIDG

SEQ ID NO: 2410652 - protein, 23 aa, Entamoeba dispar
SIDNSGAGTSSVSGSTTNSSNGL

SEQ ID NO: 2410653 - protein, 13 aa, Entamoeba dispar
SIDQSKKQTSVSD

SEQ ID NO: 2410654 - protein, 6 aa, Entamoeba dispar
SIGHGS

SEQ ID NO: 2410655 - protein, 18 aa, Entamoeba dispar
SIGSSRIEGKSGGDSEVQ

SEQ ID NO: 2410656 - protein, 13 aa, Entamoeba dispar
SIGTDPYPYKCMK

SEQ ID NO: 2410657 - protein, 8 aa, Entamoeba dispar
SIKENKIE

SEQ ID NO: 2410658 - protein, 5 aa, Entamoeba dispar
SIKSV

SEQ ID NO: 2410659 - protein, 8 aa, Entamoeba dispar
SINQPKGK

SEQ ID NO: 2410660 - protein, 11 aa, Entamoeba dispar
SIPKPQPASVI

SEQ ID NO: 2410661 - protein, 4 aa, Entamoeba dispar
SIRK

SEQ ID NO: 2410662 - protein, 4 aa, Entamoeba dispar
SIRS

SEQ ID NO: 2410663 - protein, 4 aa, Entamoeba dispar
SISE

SEQ ID NO: 2410664 - protein, 6 aa, Entamoeba dispar
SISNIE

SEQ ID NO: 2410665 - protein, 20 aa, Entamoeba dispar
SISRGTSTCNMNQKGESFQT

SEQ ID NO: 2410666 - protein, 4 aa, Entamoeba dispar
SITE

SEQ ID NO: 2410667 - protein, 13 aa, Entamoeba dispar
SITKKSREEIKAE

SEQ ID NO: 2410668 - protein, 14 aa, Entamoeba dispar
SITQKSKEEIKAEI

SEQ ID NO: 2410669 - protein, 5 aa, Entamoeba dispar
SITSI

SEQ ID NO: 2410670 - protein, 6 aa, Entamoeba dispar
SKDESI

SEQ ID NO: 2410671 - protein, 9 aa, Entamoeba dispar
SKEDLNDLN

SEQ ID NO: 2410672 - protein, 7 aa, Entamoeba dispar
SKEITNN

SEQ ID NO: 2410673 - protein, 21 aa, Entamoeba dispar
SKENYTNINNKRNEYGDKYDN

SEQ ID NO: 2410674 - protein, 17 aa, Entamoeba dispar
SKESDEITKLIKHFQTF

SEQ ID NO: 2410675 - protein, 7 aa, Entamoeba dispar
SKESFEE

SEQ ID NO: 2410676 - protein, 17 aa, Entamoeba dispar
SKESKEEEKEKEIEKIG

SEQ ID NO: 2410677 - protein, 5 aa, Entamoeba dispar
SKESS

SEQ ID NO: 2410678 - protein, 11 aa, Entamoeba dispar
SKEYDTPQKLG

SEQ ID NO: 2410679 - protein, 10 aa, Entamoeba dispar
SKFERDRKAY

SEQ ID NO: 2410680 - protein, 6 aa, Entamoeba dispar
SKFPQD

SEQ ID NO: 2410681 - protein, 6 aa, Entamoeba dispar
SKFTTL

SEQ ID NO: 2410682 - protein, 4 aa, Entamoeba dispar
SKGK

SEQ ID NO: 2410683 - protein, 8 aa, Entamoeba dispar
SKGSPISE

SEQ ID NO: 2410684 - protein, 5 aa, Entamoeba dispar
SKIGD

SEQ ID NO: 2410685 - protein, 4 aa, Entamoeba dispar
SKIT

SEQ ID NO: 2410686 - protein, 12 aa, Entamoeba dispar
SKKEQKQEIKQN

SEQ ID NO: 2410687 - protein, 6 aa, Entamoeba dispar
SKKIPT

SEQ ID NO: 2410688 - protein, 17 aa, Entamoeba dispar
SKKNPRVTAETIQMELQ

SEQ ID NO: 2410689 - protein, 9 aa, Entamoeba dispar
SKKNTTGKY

SEQ ID NO: 2410690 - protein, 8 aa, Entamoeba dispar
SKKPCKDY

SEQ ID NO: 2410691 - protein, 20 aa, Entamoeba dispar
SKKPPGKQSGLAEAQNKYNV

SEQ ID NO: 2410692 - protein, 7 aa, Entamoeba dispar
SKLRSEA

SEQ ID NO: 2410693 - protein, 7 aa, Entamoeba dispar
SKLSKTP

SEQ ID NO: 2410694 - protein, 8 aa, Entamoeba dispar
SKLTQSSE

SEQ ID NO: 2410695 - protein, 13 aa, Entamoeba dispar
SKMNEKEKQTTLD

SEQ ID NO: 2410696 - protein, 4 aa, Entamoeba dispar
SKNN

SEQ ID NO: 2410697 - protein, 5 aa, Entamoeba dispar
SKNNI

SEQ ID NO: 2410698 - protein, 5 aa, Entamoeba dispar
SKPIQ

SEQ ID NO: 2410699 - protein, 7 aa, Entamoeba dispar
SKPPLPI

SEQ ID NO: 2410700 - protein, 4 aa, Entamoeba dispar
SKQG

SEQ ID NO: 2410701 - protein, 8 aa, Entamoeba dispar
SKQTIAKQ

SEQ ID NO: 2410702 - protein, 5 aa, Entamoeba dispar
SKQTM

SEQ ID NO: 2410703 - protein, 5 aa, Entamoeba dispar
SKRES

SEQ ID NO: 2410704 - protein, 5 aa, Entamoeba dispar
SKRTS

SEQ ID NO: 2410705 - protein, 4 aa, Entamoeba dispar
SKSD

SEQ ID NO: 2410706 - protein, 15 aa, Entamoeba dispar
SKSQDIEAGDGTTTV

SEQ ID NO: 2410707 - protein, 9 aa, Entamoeba dispar
SKSRNGKSA

SEQ ID NO: 2410708 - protein, 4 aa, Entamoeba dispar
SKSS

SEQ ID NO: 2410709 - protein, 4 aa, Entamoeba dispar
SKSV

SEQ ID NO: 2410710 - protein, 9 aa, Entamoeba dispar
SKTARGNNA

SEQ ID NO: 2410711 - protein, 13 aa, Entamoeba dispar
SKTGMKGEGDMTS

SEQ ID NO: 2410712 - protein, 14 aa, Entamoeba dispar
SKTIEETLKEHPED

SEQ ID NO: 2410713 - protein, 6 aa, Entamoeba dispar
SKTQSL

SEQ ID NO: 2410714 - protein, 4 aa, Entamoeba dispar
SKTV

SEQ ID NO: 2410715 - protein, 4 aa, Entamoeba dispar
SKVS

SEQ ID NO: 2410716 - protein, 6 aa, Entamoeba dispar
SKWQPE

SEQ ID NO: 2410717 - protein, 5 aa, Entamoeba dispar
SKYTP

SEQ ID NO: 2410718 - protein, 7 aa, Entamoeba dispar
SLDEPAA

SEQ ID NO: 2410719 - protein, 14 aa, Entamoeba dispar
SLDSQTYTNYEYKI

SEQ ID NO: 2410720 - protein, 9 aa, Entamoeba dispar
SLEPKEQEK

SEQ ID NO: 2410721 - protein, 5 aa, Entamoeba dispar
SLESI

SEQ ID NO: 2410722 - protein, 11 aa, Entamoeba dispar
SLGGGTGSGLG

SEQ ID NO: 2410723 - protein, 4 aa, Entamoeba dispar
SLGS

SEQ ID NO: 2410724 - protein, 8 aa, Entamoeba dispar
SLKPNQRV

SEQ ID NO: 2410725 - protein, 8 aa, Entamoeba dispar
SLMGGESI

SEQ ID NO: 2410726 - protein, 11 aa, Entamoeba dispar
SLNDGGKNSFE

SEQ ID NO: 2410727 - protein, 6 aa, Entamoeba dispar
SLPDID

SEQ ID NO: 2410728 - protein, 5 aa, Entamoeba dispar
SLQPL

SEQ ID NO: 2410729 - protein, 14 aa, Entamoeba dispar
SLQTINGKEVQKKD

SEQ ID NO: 2410730 - protein, 5 aa, Entamoeba dispar
SLSEN

SEQ ID NO: 2410731 - protein, 4 aa, Entamoeba dispar
SLSG

SEQ ID NO: 2410732 - protein, 5 aa, Entamoeba dispar
SLSLQ

SEQ ID NO: 2410733 - protein, 9 aa, Entamoeba dispar
SLTQPTTEL

SEQ ID NO: 2410734 - protein, 4 aa, Entamoeba dispar
SLTS

SEQ ID NO: 2410735 - protein, 10 aa, Entamoeba dispar
SMGSVPPRYE

SEQ ID NO: 2410736 - protein, 5 aa, Entamoeba dispar
SMNGQ

SEQ ID NO: 2410737 - protein, 14 aa, Entamoeba dispar
SNDEKNVKIRKENI

SEQ ID NO: 2410738 - protein, 4 aa, Entamoeba dispar
SNDG

SEQ ID NO: 2410739 - protein, 14 aa, Entamoeba dispar
SNDQVEKAGKRAGN

SEQ ID NO: 2410740 - protein, 4 aa, Entamoeba dispar
SNDT

SEQ ID NO: 2410741 - protein, 4 aa, Entamoeba dispar
SNEE

SEQ ID NO: 2410742 - protein, 4 aa, Entamoeba dispar
SNEI

SEQ ID NO: 2410743 - protein, 8 aa, Entamoeba dispar
SNEQYQQG

SEQ ID NO: 2410744 - protein, 5 aa, Entamoeba dispar
SNESL

SEQ ID NO: 2410745 - protein, 7 aa, Entamoeba dispar
SNGETPL

SEQ ID NO: 2410746 - protein, 7 aa, Entamoeba dispar
SNGNEVK

SEQ ID NO: 2410747 - protein, 21 aa, Entamoeba dispar
SNHESDQASPRVTSVSPNIGS

SEQ ID NO: 2410748 - protein, 7 aa, Entamoeba dispar
SNKKAAE

SEQ ID NO: 2410749 - protein, 8 aa, Entamoeba dispar
SNKTDTEL

SEQ ID NO: 2410750 - protein, 5 aa, Entamoeba dispar
SNLKE

SEQ ID NO: 2410751 - protein, 4 aa, Entamoeba dispar
SNLL

SEQ ID NO: 2410752 - protein, 18 aa, Entamoeba dispar
SNLPQKDDGYDYAAWVKT

SEQ ID NO: 2410753 - protein, 7 aa, Entamoeba dispar
SNNDLEK

SEQ ID NO: 2410754 - protein, 6 aa, Entamoeba dispar
SNNEIE

SEQ ID NO: 2410755 - protein, 7 aa, Entamoeba dispar
SNNGNLR

SEQ ID NO: 2410756 - protein, 5 aa, Entamoeba dispar
SNPDL

SEQ ID NO: 2410757 - protein, 7 aa, Entamoeba dispar
SNPFSTN

SEQ ID NO: 2410758 - protein, 17 aa, Entamoeba dispar
SNPPKREPKYAQDSLTS

SEQ ID NO: 2410759 - protein, 5 aa, Entamoeba dispar
SNQFQ

SEQ ID NO: 2410760 - protein, 6 aa, Entamoeba dispar
SNRDKL

SEQ ID NO: 2410761 - protein, 7 aa, Entamoeba dispar
SNSITGR

SEQ ID NO: 2410762 - protein, 5 aa, Entamoeba dispar
SNSIY

SEQ ID NO: 2410763 - protein, 12 aa, Entamoeba dispar
SNSIYVNTRKLI

SEQ ID NO: 2410764 - protein, 11 aa, Entamoeba dispar
SNSMKNEQKTI

SEQ ID NO: 2410765 - protein, 4 aa, Entamoeba dispar
SNSN

SEQ ID NO: 2410766 - protein, 4 aa, Entamoeba dispar
SNSQ

SEQ ID NO: 2410767 - protein, 5 aa, Entamoeba dispar
SNSVG

SEQ ID NO: 2410768 - protein, 7 aa, Entamoeba dispar
SNTISKK

SEQ ID NO: 2410769 - protein, 8 aa, Entamoeba dispar
SNYGNEIN

SEQ ID NO: 2410770 - protein, 17 aa, Entamoeba dispar
SPAGGAKKDKKKGGCML

SEQ ID NO: 2410771 - protein, 8 aa, Entamoeba dispar
SPATTESQ

SEQ ID NO: 2410772 - protein, 8 aa, Entamoeba dispar
SPDDDTDV

SEQ ID NO: 2410773 - protein, 5 aa, Entamoeba dispar
SPDDY

SEQ ID NO: 2410774 - protein, 4 aa, Entamoeba dispar
SPDG

SEQ ID NO: 2410775 - protein, 11 aa, Entamoeba dispar
SPDQYKREQDQ

SEQ ID NO: 2410776 - protein, 4 aa, Entamoeba dispar
SPDS

SEQ ID NO: 2410777 - protein, 5 aa, Entamoeba dispar
SPDSR

SEQ ID NO: 2410778 - protein, 8 aa, Entamoeba dispar
SPEPIDKI

SEQ ID NO: 2410779 - protein, 14 aa, Entamoeba dispar
SPFTSQNNPIKSTV

SEQ ID NO: 2410780 - protein, 4 aa, Entamoeba dispar
SPGN

SEQ ID NO: 2410781 - protein, 5 aa, Entamoeba dispar
SPHAK

SEQ ID NO: 2410782 - protein, 4 aa, Entamoeba dispar
SPIP

SEQ ID NO: 2410783 - protein, 12 aa, Entamoeba dispar
SPITEVKESAAR

SEQ ID NO: 2410784 - protein, 4 aa, Entamoeba dispar
SPIY

SEQ ID NO: 2410785 - protein, 6 aa, Entamoeba dispar
SPKEKQ

SEQ ID NO: 2410786 - protein, 5 aa, Entamoeba dispar
SPKRI

SEQ ID NO: 2410787 - protein, 7 aa, Entamoeba dispar
SPLNKQE

SEQ ID NO: 2410788 - protein, 4 aa, Entamoeba dispar
SPNE

SEQ ID NO: 2410789 - protein, 11 aa, Entamoeba dispar
SPNGETIITND

SEQ ID NO: 2410790 - protein, 7 aa, Entamoeba dispar
SPNLEDP

SEQ ID NO: 2410791 - protein, 7 aa, Entamoeba dispar
SPQTRDQ

SEQ ID NO: 2410792 - protein, 7 aa, Entamoeba dispar
SPRPDMP

SEQ ID NO: 2410793 - protein, 8 aa, Entamoeba dispar
SPSIQNSI

SEQ ID NO: 2410794 - protein, 13 aa, Entamoeba dispar
SPTEIDEVNPKPH

SEQ ID NO: 2410795 - protein, 5 aa, Entamoeba dispar
SPTLR

SEQ ID NO: 2410796 - protein, 6 aa, Entamoeba dispar
SQAESI

SEQ ID NO: 2410797 - protein, 4 aa, Entamoeba dispar
SQCT

SEQ ID NO: 2410798 - protein, 14 aa, Entamoeba dispar
SQDGDVSNKESKFS

SEQ ID NO: 2410799 - protein, 19 aa, Entamoeba dispar
SQDNLKTVREKLSEKMSGS

SEQ ID NO: 2410800 - protein, 14 aa, Entamoeba dispar
SQDSSKLGSCSGDH

SEQ ID NO: 2410801 - protein, 7 aa, Entamoeba dispar
SQEKRIQ

SEQ ID NO: 2410802 - protein, 10 aa, Entamoeba dispar
SQETNLEEAA

SEQ ID NO: 2410803 - protein, 12 aa, Entamoeba dispar
SQHSQQPQHQQY

SEQ ID NO: 2410804 - protein, 6 aa, Entamoeba dispar
SQHSST

SEQ ID NO: 2410805 - protein, 9 aa, Entamoeba dispar
SQKTNGNET

SEQ ID NO: 2410806 - protein, 4 aa, Entamoeba dispar
SQPL

SEQ ID NO: 2410807 - protein, 6 aa, Entamoeba dispar
SQPMTK

SEQ ID NO: 2410808 - protein, 5 aa, Entamoeba dispar
SQQGL

SEQ ID NO: 2410809 - protein, 15 aa, Entamoeba dispar
SQQYKENENKKAEDF

SEQ ID NO: 2410810 - protein, 8 aa, Entamoeba dispar
SQREPDVN

SEQ ID NO: 2410811 - protein, 6 aa, Entamoeba dispar
SQTDNV

SEQ ID NO: 2410812 - protein, 4 aa, Entamoeba dispar
SQTK

SEQ ID NO: 2410813 - protein, 8 aa, Entamoeba dispar
SQVKENTK

SEQ ID NO: 2410814 - protein, 11 aa, Entamoeba dispar
SRINQESNKGK

SEQ ID NO: 2410815 - protein, 18 aa, Entamoeba dispar
SRLSRSNSCSSKLTPRTR

SEQ ID NO: 2410816 - protein, 7 aa, Entamoeba dispar
SRMSGPW

SEQ ID NO: 2410817 - protein, 14 aa, Entamoeba dispar
SRNKKTSCEQTEAL

SEQ ID NO: 2410818 - protein, 7 aa, Entamoeba dispar
SRNTKGS

SEQ ID NO: 2410819 - protein, 4 aa, Entamoeba dispar
SRRK

SEQ ID NO: 2410820 - protein, 7 aa, Entamoeba dispar
SRSSDVA

SEQ ID NO: 2410821 - protein, 7 aa, Entamoeba dispar
SRTTPIP

SEQ ID NO: 2410822 - protein, 9 aa, Entamoeba dispar
SSASYRIGN

SEQ ID NO: 2410823 - protein, 7 aa, Entamoeba dispar
SSDCYEG

SEQ ID NO: 2410824 - protein, 4 aa, Entamoeba dispar
SSDE

SEQ ID NO: 2410825 - protein, 4 aa, Entamoeba dispar
SSDI

SEQ ID NO: 2410826 - protein, 4 aa, Entamoeba dispar
SSEI

SEQ ID NO: 2410827 - protein, 4 aa, Entamoeba dispar
SSFG

SEQ ID NO: 2410828 - protein, 9 aa, Entamoeba dispar
SSFKSSETL

SEQ ID NO: 2410829 - protein, 8 aa, Entamoeba dispar
SSFLESPK

SEQ ID NO: 2410830 - protein, 10 aa, Entamoeba dispar
SSFTQNETND

SEQ ID NO: 2410831 - protein, 4 aa, Entamoeba dispar
SSGK

SEQ ID NO: 2410832 - protein, 8 aa, Entamoeba dispar
SSGRPPIN

SEQ ID NO: 2410833 - protein, 5 aa, Entamoeba dispar
SSGSV

SEQ ID NO: 2410834 - protein, 9 aa, Entamoeba dispar
SSHNPKPWN

SEQ ID NO: 2410835 - protein, 6 aa, Entamoeba dispar
SSIDIP

SEQ ID NO: 2410836 - protein, 5 aa, Entamoeba dispar
SSIKS

SEQ ID NO: 2410837 - protein, 6 aa, Entamoeba dispar
SSIKSF

SEQ ID NO: 2410838 - protein, 7 aa, Entamoeba dispar
SSISKIG

SEQ ID NO: 2410839 - protein, 5 aa, Entamoeba dispar
SSISQ

SEQ ID NO: 2410840 - protein, 5 aa, Entamoeba dispar
SSITK

SEQ ID NO: 2410841 - protein, 7 aa, Entamoeba dispar
SSITQES

SEQ ID NO: 2410842 - protein, 5 aa, Entamoeba dispar
SSIYE

SEQ ID NO: 2410843 - protein, 12 aa, Entamoeba dispar
SSKEFEKKRDEV

SEQ ID NO: 2410844 - protein, 8 aa, Entamoeba dispar
SSKGDKQI

SEQ ID NO: 2410845 - protein, 6 aa, Entamoeba dispar
SSKNDR

SEQ ID NO: 2410846 - protein, 9 aa, Entamoeba dispar
SSKQKPKCT

SEQ ID NO: 2410847 - protein, 5 aa, Entamoeba dispar
SSLDG

SEQ ID NO: 2410848 - protein, 4 aa, Entamoeba dispar
SSLR

SEQ ID NO: 2410849 - protein, 10 aa, Entamoeba dispar
SSLTGSACNS

SEQ ID NO: 2410850 - protein, 7 aa, Entamoeba dispar
SSNETKL

SEQ ID NO: 2410851 - protein, 4 aa, Entamoeba dispar
SSNN

SEQ ID NO: 2410852 - protein, 9 aa, Entamoeba dispar
SSNPNASSL

SEQ ID NO: 2410853 - protein, 4 aa, Entamoeba dispar
SSNS

SEQ ID NO: 2410854 - protein, 23 aa, Entamoeba dispar
SSNSNKSTEPRTERDESTKPNII

SEQ ID NO: 2410855 - protein, 10 aa, Entamoeba dispar
SSNTRLTENQ

SEQ ID NO: 2410856 - protein, 4 aa, Entamoeba dispar
SSPH

SEQ ID NO: 2410857 - protein, 4 aa, Entamoeba dispar
SSPI

SEQ ID NO: 2410858 - protein, 6 aa, Entamoeba dispar
SSPKST

SEQ ID NO: 2410859 - protein, 9 aa, Entamoeba dispar
SSQIKEGDL

SEQ ID NO: 2410860 - protein, 9 aa, Entamoeba dispar
SSQLQTTKE

SEQ ID NO: 2410861 - protein, 8 aa, Entamoeba dispar
SSRSAAKY

SEQ ID NO: 2410862 - protein, 8 aa, Entamoeba dispar
SSSADSTI

SEQ ID NO: 2410863 - protein, 6 aa, Entamoeba dispar
SSSETF

SEQ ID NO: 2410864 - protein, 4 aa, Entamoeba dispar
SSSF

SEQ ID NO: 2410865 - protein, 4 aa, Entamoeba dispar
SSTN

SEQ ID NO: 2410866 - protein, 7 aa, Entamoeba dispar
SSTPDKL

SEQ ID NO: 2410867 - protein, 5 aa, Entamoeba dispar
SSTRE

SEQ ID NO: 2410868 - protein, 4 aa, Entamoeba dispar
SSTT

SEQ ID NO: 2410869 - protein, 5 aa, Entamoeba dispar
SSVGK

SEQ ID NO: 2410870 - protein, 7 aa, Entamoeba dispar
SSVGKTS

SEQ ID NO: 2410871 - protein, 4 aa, Entamoeba dispar
SSVI

SEQ ID NO: 2410872 - protein, 6 aa, Entamoeba dispar
SSVSEI

SEQ ID NO: 2410873 - protein, 7 aa, Entamoeba dispar
SSVSKIG

SEQ ID NO: 2410874 - protein, 7 aa, Entamoeba dispar
SSVSTIG

SEQ ID NO: 2410875 - protein, 12 aa, Entamoeba dispar
SSWKLEKDKNGL

SEQ ID NO: 2410876 - protein, 14 aa, Entamoeba dispar
SSYGKTIQKPIKEE

SEQ ID NO: 2410877 - protein, 14 aa, Entamoeba dispar
SSYTNTTLKTKHSE

SEQ ID NO: 2410878 - protein, 9 aa, Entamoeba dispar
STADKQYEI

SEQ ID NO: 2410879 - protein, 6 aa, Entamoeba dispar
STDEEF

SEQ ID NO: 2410880 - protein, 7 aa, Entamoeba dispar
STDFPNK

SEQ ID NO: 2410881 - protein, 9 aa, Entamoeba dispar
STDHVTNTE

SEQ ID NO: 2410882 - protein, 4 aa, Entamoeba dispar
STDI

SEQ ID NO: 2410883 - protein, 5 aa, Entamoeba dispar
STDPN

SEQ ID NO: 2410884 - protein, 4 aa, Entamoeba dispar
STDT

SEQ ID NO: 2410885 - protein, 9 aa, Entamoeba dispar
STEDKETSF

SEQ ID NO: 2410886 - protein, 9 aa, Entamoeba dispar
STEEINKRP

SEQ ID NO: 2410887 - protein, 6 aa, Entamoeba dispar
STEESY

SEQ ID NO: 2410888 - protein, 7 aa, Entamoeba dispar
STENVRQ

SEQ ID NO: 2410889 - protein, 7 aa, Entamoeba dispar
STESPAN

SEQ ID NO: 2410890 - protein, 4 aa, Entamoeba dispar
STFP

SEQ ID NO: 2410891 - protein, 6 aa, Entamoeba dispar
STGCDK

SEQ ID NO: 2410892 - protein, 6 aa, Entamoeba dispar
STHDVE

SEQ ID NO: 2410893 - protein, 4 aa, Entamoeba dispar
STIG

SEQ ID NO: 2410894 - protein, 4 aa, Entamoeba dispar
STIT

SEQ ID NO: 2410895 - protein, 5 aa, Entamoeba dispar
STKEV

SEQ ID NO: 2410896 - protein, 8 aa, Entamoeba dispar
STKGTSIE

SEQ ID NO: 2410897 - protein, 7 aa, Entamoeba dispar
STKINKN

SEQ ID NO: 2410898 - protein, 6 aa, Entamoeba dispar
STKNDR

SEQ ID NO: 2410899 - protein, 8 aa, Entamoeba dispar
STKNKEAK

SEQ ID NO: 2410900 - protein, 7 aa, Entamoeba dispar
STKQYHG

SEQ ID NO: 2410901 - protein, 7 aa, Entamoeba dispar
STLEPPV

SEQ ID NO: 2410902 - protein, 6 aa, Entamoeba dispar
STNHPD

SEQ ID NO: 2410903 - protein, 4 aa, Entamoeba dispar
STNL

SEQ ID NO: 2410904 - protein, 7 aa, Entamoeba dispar
STNNSPD

SEQ ID NO: 2410905 - protein, 13 aa, Entamoeba dispar
STNPQMKNCNSRN

SEQ ID NO: 2410906 - protein, 6 aa, Entamoeba dispar
STNTID

SEQ ID NO: 2410907 - protein, 4 aa, Entamoeba dispar
STPI

SEQ ID NO: 2410908 - protein, 7 aa, Entamoeba dispar
STPIQQK

SEQ ID NO: 2410909 - protein, 6 aa, Entamoeba dispar
STPPPI

SEQ ID NO: 2410910 - protein, 10 aa, Entamoeba dispar
STPQSDALEV

SEQ ID NO: 2410911 - protein, 15 aa, Entamoeba dispar
STQPSFEVSGGSQVF

SEQ ID NO: 2410912 - protein, 6 aa, Entamoeba dispar
STQQGA

SEQ ID NO: 2410913 - protein, 6 aa, Entamoeba dispar
STRGEQ

SEQ ID NO: 2410914 - protein, 8 aa, Entamoeba dispar
STRINRGN

SEQ ID NO: 2410915 - protein, 4 aa, Entamoeba dispar
STSI

SEQ ID NO: 2410916 - protein, 14 aa, Entamoeba dispar
STSQYNELSEQEIQ

SEQ ID NO: 2410917 - protein, 5 aa, Entamoeba dispar
STSTE

SEQ ID NO: 2410918 - protein, 20 aa, Entamoeba dispar
STSTESQERSLNNPNDTHPE

SEQ ID NO: 2410919 - protein, 7 aa, Entamoeba dispar
STTETPE

SEQ ID NO: 2410920 - protein, 11 aa, Entamoeba dispar
STTGKHEDQEI

SEQ ID NO: 2410921 - protein, 6 aa, Entamoeba dispar
STTQTP

SEQ ID NO: 2410922 - protein, 4 aa, Entamoeba dispar
STTS

SEQ ID NO: 2410923 - protein, 12 aa, Entamoeba dispar
STVGEISGQTKT

SEQ ID NO: 2410924 - protein, 6 aa, Entamoeba dispar
STYNDL

SEQ ID NO: 2410925 - protein, 8 aa, Entamoeba dispar
STYTKGKK

SEQ ID NO: 2410926 - protein, 4 aa, Entamoeba dispar
SVAA

SEQ ID NO: 2410927 - protein, 9 aa, Entamoeba dispar
SVDGLTSYG

SEQ ID NO: 2410928 - protein, 6 aa, Entamoeba dispar
SVDSPA

SEQ ID NO: 2410929 - protein, 9 aa, Entamoeba dispar
SVEASERKR

SEQ ID NO: 2410930 - protein, 11 aa, Entamoeba dispar
SVEDKDETSPV

SEQ ID NO: 2410931 - protein, 5 aa, Entamoeba dispar
SVEEH

SEQ ID NO: 2410932 - protein, 4 aa, Entamoeba dispar
SVEP

SEQ ID NO: 2410933 - protein, 6 aa, Entamoeba dispar
SVGPLR

SEQ ID NO: 2410934 - protein, 5 aa, Entamoeba dispar
SVKEI

SEQ ID NO: 2410935 - protein, 28 aa, Entamoeba dispar
SVKPLNSQDNLKTAREKLKEKMSGSQQF

SEQ ID NO: 2410936 - protein, 13 aa, Entamoeba dispar
SVQVTKKSTFITE

SEQ ID NO: 2410937 - protein, 5 aa, Entamoeba dispar
SVSEI

SEQ ID NO: 2410938 - protein, 7 aa, Entamoeba dispar
SVSSLGN

SEQ ID NO: 2410939 - protein, 28 aa, Entamoeba dispar
SVTDNAKPDDIIKTPQKIEGVPKPIDKV

SEQ ID NO: 2410940 - protein, 6 aa, Entamoeba dispar
SVTDYK

SEQ ID NO: 2410941 - protein, 5 aa, Entamoeba dispar
SVTEI

SEQ ID NO: 2410942 - protein, 5 aa, Entamoeba dispar
SVTGS

SEQ ID NO: 2410943 - protein, 10 aa, Entamoeba dispar
SVTIPSSVSK

SEQ ID NO: 2410944 - protein, 6 aa, Entamoeba dispar
SVTTAL

SEQ ID NO: 2410945 - protein, 13 aa, Entamoeba dispar
SWKDTRTGQTVSH

SEQ ID NO: 2410946 - protein, 5 aa, Entamoeba dispar
SYCGP

SEQ ID NO: 2410947 - protein, 10 aa, Entamoeba dispar
SYDATSHFET

SEQ ID NO: 2410948 - protein, 13 aa, Entamoeba dispar
SYDDSKPKQKKIT

SEQ ID NO: 2410949 - protein, 10 aa, Entamoeba dispar
SYDRSSTSNF

SEQ ID NO: 2410950 - protein, 20 aa, Entamoeba dispar
SYEEDLKTKLEDCKTKSQKI

SEQ ID NO: 2410951 - protein, 6 aa, Entamoeba dispar
SYFPDK

SEQ ID NO: 2410952 - protein, 4 aa, Entamoeba dispar
SYGD

SEQ ID NO: 2410953 - protein, 14 aa, Entamoeba dispar
SYKPQKISPKFEGT

SEQ ID NO: 2410954 - protein, 23 aa, Entamoeba dispar
SYNKTESKELNEQLEYYQSQLNN

SEQ ID NO: 2410955 - protein, 6 aa, Entamoeba dispar
SYPTPI

SEQ ID NO: 2410956 - protein, 12 aa, Entamoeba dispar
SYQQKAKEIIHV

SEQ ID NO: 2410957 - protein, 12 aa, Entamoeba dispar
SYQTATSSVNEE

SEQ ID NO: 2410958 - protein, 10 aa, Entamoeba dispar
SYRDSKNKGI

SEQ ID NO: 2410959 - protein, 5 aa, Entamoeba dispar
SYSSL

SEQ ID NO: 2410960 - protein, 9 aa, Entamoeba dispar
SYTARTGDI

SEQ ID NO: 2410961 - protein, 32 aa, Entamoeba dispar
SYTPDQYQEETPEATTTTEETNEAPPVPAPRR

SEQ ID NO: 2410962 - protein, 9 aa, Entamoeba dispar
SYTQYGGLR

SEQ ID NO: 2410963 - protein, 4 aa, Entamoeba dispar
SYTS

SEQ ID NO: 2410964 - protein, 10 aa, Entamoeba dispar
SYYKEQDKKT

SEQ ID NO: 2410965 - protein, 6 aa, Entamoeba dispar
SYYRGT

SEQ ID NO: 2410966 - protein, 7 aa, Entamoeba dispar
TAAKSST

SEQ ID NO: 2410967 - protein, 7 aa, Entamoeba dispar
TAANTSG

SEQ ID NO: 2410968 - protein, 9 aa, Entamoeba dispar
TAANTSGTV

SEQ ID NO: 2410969 - protein, 7 aa, Entamoeba dispar
TADKCEY

SEQ ID NO: 2410970 - protein, 14 aa, Entamoeba dispar
TADQSKKGNPMKGT

SEQ ID NO: 2410971 - protein, 19 aa, Entamoeba dispar
TAGEDIGMKEENKKEKKKT

SEQ ID NO: 2410972 - protein, 18 aa, Entamoeba dispar
TAGEKEYETEQLRKSFGD

SEQ ID NO: 2410973 - protein, 14 aa, Entamoeba dispar
TAGFTEKLSKSIDE

SEQ ID NO: 2410974 - protein, 11 aa, Entamoeba dispar
TAGQDEYSSYR

SEQ ID NO: 2410975 - protein, 9 aa, Entamoeba dispar
TAGQEDYEQ

SEQ ID NO: 2410976 - protein, 7 aa, Entamoeba dispar
TAGQEEY

SEQ ID NO: 2410977 - protein, 9 aa, Entamoeba dispar
TAGQEEYDR

SEQ ID NO: 2410978 - protein, 9 aa, Entamoeba dispar
TAGQEEYSA

SEQ ID NO: 2410979 - protein, 7 aa, Entamoeba dispar
TAGQEKF

SEQ ID NO: 2410980 - protein, 8 aa, Entamoeba dispar
TAGQEKYR

SEQ ID NO: 2410981 - protein, 8 aa, Entamoeba dispar
TAGQERFR

SEQ ID NO: 2410982 - protein, 9 aa, Entamoeba dispar
TAGSEKFRS

SEQ ID NO: 2410983 - protein, 7 aa, Entamoeba dispar
TAGSERF

SEQ ID NO: 2410984 - protein, 25 aa, Entamoeba dispar
TAIDQTKKPAPMKPIPRYPAPYPFG

SEQ ID NO: 2410985 - protein, 19 aa, Entamoeba dispar
TAKCKEEKGEIEKSKKMYR

SEQ ID NO: 2410986 - protein, 11 aa, Entamoeba dispar
TAKVTATRGYG

SEQ ID NO: 2410987 - protein, 4 aa, Entamoeba dispar
TAPF

SEQ ID NO: 2410988 - protein, 5 aa, Entamoeba dispar
TAPSW

SEQ ID NO: 2410989 - protein, 4 aa, Entamoeba dispar
TASA

SEQ ID NO: 2410990 - protein, 7 aa, Entamoeba dispar
TASADRT

SEQ ID NO: 2410991 - protein, 8 aa, Entamoeba dispar
TASRGRIP

SEQ ID NO: 2410992 - protein, 9 aa, Entamoeba dispar
TATGADAAV

SEQ ID NO: 2410993 - protein, 25 aa, Entamoeba dispar
TAYSDSDESKEEQPKKEPEFEVDND

SEQ ID NO: 2410994 - protein, 8 aa, Entamoeba dispar
TCPHTKKD

SEQ ID NO: 2410995 - protein, 7 aa, Entamoeba dispar
TCPNPKG

SEQ ID NO: 2410996 - protein, 8 aa, Entamoeba dispar
TCSYEPQN

SEQ ID NO: 2410997 - protein, 4 aa, Entamoeba dispar
TDDS

SEQ ID NO: 2410998 - protein, 8 aa, Entamoeba dispar
TDEEIQGY

SEQ ID NO: 2410999 - protein, 10 aa, Entamoeba dispar
TDEETKPKSV

SEQ ID NO: 2411000 - protein, 7 aa, Entamoeba dispar
TDEYQFT

SEQ ID NO: 2411001 - protein, 5 aa, Entamoeba dispar
TDGYG

SEQ ID NO: 2411002 - protein, 12 aa, Entamoeba dispar
TDKDDNKQYATK

SEQ ID NO: 2411003 - protein, 10 aa, Entamoeba dispar
TDKDESSVDS

SEQ ID NO: 2411004 - protein, 4 aa, Entamoeba dispar
TDKI

SEQ ID NO: 2411005 - protein, 14 aa, Entamoeba dispar
TDNKPGNWAPTSSV

SEQ ID NO: 2411006 - protein, 4 aa, Entamoeba dispar
TDNN

SEQ ID NO: 2411007 - protein, 5 aa, Entamoeba dispar
TDPIE

SEQ ID NO: 2411008 - protein, 6 aa, Entamoeba dispar
TDPKDV

SEQ ID NO: 2411009 - protein, 12 aa, Entamoeba dispar
TDPNPSDPLDPE

SEQ ID NO: 2411010 - protein, 13 aa, Entamoeba dispar
TDPSGKNGPAARI

SEQ ID NO: 2411011 - protein, 4 aa, Entamoeba dispar
TDQS

SEQ ID NO: 2411012 - protein, 16 aa, Entamoeba dispar
TDSLSQQYTDQYEQFP

SEQ ID NO: 2411013 - protein, 10 aa, Entamoeba dispar
TDSYSTKKTK

SEQ ID NO: 2411014 - protein, 12 aa, Entamoeba dispar
TDTENDSEMPPL

SEQ ID NO: 2411015 - protein, 12 aa, Entamoeba dispar
TDTGKDDPHRTS

SEQ ID NO: 2411016 - protein, 36 aa, Entamoeba dispar
TDTKTSRKIVPASKIGKLSSIPRKPNGDEGELSPEE

SEQ ID NO: 2411017 - protein, 14 aa, Entamoeba dispar
TDTTITPKQALEQA

SEQ ID NO: 2411018 - protein, 6 aa, Entamoeba dispar
TEAKSP

SEQ ID NO: 2411019 - protein, 15 aa, Entamoeba dispar
TEASSLARNYNKTTI

SEQ ID NO: 2411020 - protein, 6 aa, Entamoeba dispar
TEDKKQ

SEQ ID NO: 2411021 - protein, 7 aa, Entamoeba dispar
TEEDDKV

SEQ ID NO: 2411022 - protein, 13 aa, Entamoeba dispar
TEEDMEKAKKTPI

SEQ ID NO: 2411023 - protein, 5 aa, Entamoeba dispar
TEEEE

SEQ ID NO: 2411024 - protein, 8 aa, Entamoeba dispar
TEENNEDI

SEQ ID NO: 2411025 - protein, 4 aa, Entamoeba dispar
TEES

SEQ ID NO: 2411026 - protein, 5 aa, Entamoeba dispar
TEGIP

SEQ ID NO: 2411027 - protein, 8 aa, Entamoeba dispar
TEGNIGRP

SEQ ID NO: 2411028 - protein, 14 aa, Entamoeba dispar
TEKSKISPEVTPDE

SEQ ID NO: 2411029 - protein, 8 aa, Entamoeba dispar
TEKTMSET

SEQ ID NO: 2411030 - protein, 4 aa, Entamoeba dispar
TELP

SEQ ID NO: 2411031 - protein, 5 aa, Entamoeba dispar
TELSE

SEQ ID NO: 2411032 - protein, 6 aa, Entamoeba dispar
TENDEI

SEQ ID NO: 2411033 - protein, 7 aa, Entamoeba dispar
TENDEQP

SEQ ID NO: 2411034 - protein, 7 aa, Entamoeba dispar
TENEEMD

SEQ ID NO: 2411035 - protein, 4 aa, Entamoeba dispar
TEPK

SEQ ID NO: 2411036 - protein, 7 aa, Entamoeba dispar
TEQEDET

SEQ ID NO: 2411037 - protein, 9 aa, Entamoeba dispar
TEQPSSSKF

SEQ ID NO: 2411038 - protein, 7 aa, Entamoeba dispar
TEQRDPI

SEQ ID NO: 2411039 - protein, 9 aa, Entamoeba dispar
TETQRPKGC

SEQ ID NO: 2411040 - protein, 6 aa, Entamoeba dispar
TETTMN

SEQ ID NO: 2411041 - protein, 5 aa, Entamoeba dispar
TETTQ

SEQ ID NO: 2411042 - protein, 4 aa, Entamoeba dispar
TEWN

SEQ ID NO: 2411043 - protein, 5 aa, Entamoeba dispar
TFAGT

SEQ ID NO: 2411044 - protein, 4 aa, Entamoeba dispar
TFSY

SEQ ID NO: 2411045 - protein, 7 aa, Entamoeba dispar
TFYPEDK

SEQ ID NO: 2411046 - protein, 10 aa, Entamoeba dispar
TGAKDEESLN

SEQ ID NO: 2411047 - protein, 6 aa, Entamoeba dispar
TGCGKT

SEQ ID NO: 2411048 - protein, 15 aa, Entamoeba dispar
TGCPNIDESNLKSQS

SEQ ID NO: 2411049 - protein, 5 aa, Entamoeba dispar
TGEDN

SEQ ID NO: 2411050 - protein, 27 aa, Entamoeba dispar
TGFEEQPKEEIIRKEDKQEKQNGKEDC

SEQ ID NO: 2411051 - protein, 9 aa, Entamoeba dispar
TGGEDAQYD

SEQ ID NO: 2411052 - protein, 5 aa, Entamoeba dispar
TGGNA

SEQ ID NO: 2411053 - protein, 9 aa, Entamoeba dispar
TGIGPTDIV

SEQ ID NO: 2411054 - protein, 4 aa, Entamoeba dispar
TGKT

SEQ ID NO: 2411055 - protein, 4 aa, Entamoeba dispar
TGNG

SEQ ID NO: 2411056 - protein, 8 aa, Entamoeba dispar
TGNGMSGI

SEQ ID NO: 2411057 - protein, 13 aa, Entamoeba dispar
TGPYRGTIPPEVK

SEQ ID NO: 2411058 - protein, 7 aa, Entamoeba dispar
TGSLSKG

SEQ ID NO: 2411059 - protein, 6 aa, Entamoeba dispar
TGSMGS

SEQ ID NO: 2411060 - protein, 10 aa, Entamoeba dispar
TGTGKTLTAN

SEQ ID NO: 2411061 - protein, 7 aa, Entamoeba dispar
TGVPSKR

SEQ ID NO: 2411062 - protein, 8 aa, Entamoeba dispar
TGYTPNGV

SEQ ID NO: 2411063 - protein, 6 aa, Entamoeba dispar
THDPSK

SEQ ID NO: 2411064 - protein, 5 aa, Entamoeba dispar
THEQI

SEQ ID NO: 2411065 - protein, 7 aa, Entamoeba dispar
THITQKD

SEQ ID NO: 2411066 - protein, 4 aa, Entamoeba dispar
THPS

SEQ ID NO: 2411067 - protein, 7 aa, Entamoeba dispar
THPTDPL

SEQ ID NO: 2411068 - protein, 4 aa, Entamoeba dispar
THQP

SEQ ID NO: 2411069 - protein, 8 aa, Entamoeba dispar
THRYGPNS

SEQ ID NO: 2411070 - protein, 12 aa, Entamoeba dispar
THSSFNNQTHCG

SEQ ID NO: 2411071 - protein, 9 aa, Entamoeba dispar
THVEDQIET

SEQ ID NO: 2411072 - protein, 7 aa, Entamoeba dispar
TIDEVAN

SEQ ID NO: 2411073 - protein, 11 aa, Entamoeba dispar
TIEDSYRTSIS

SEQ ID NO: 2411074 - protein, 11 aa, Entamoeba dispar
TIEKKEMELER

SEQ ID NO: 2411075 - protein, 8 aa, Entamoeba dispar
TIENHQDY

SEQ ID NO: 2411076 - protein, 17 aa, Entamoeba dispar
TIKKSFETNQNTKESPQ

SEQ ID NO: 2411077 - protein, 5 aa, Entamoeba dispar
TIKYG

SEQ ID NO: 2411078 - protein, 4 aa, Entamoeba dispar
TINE

SEQ ID NO: 2411079 - protein, 8 aa, Entamoeba dispar
TIPGGPND

SEQ ID NO: 2411080 - protein, 7 aa, Entamoeba dispar
TIPIQGQ

SEQ ID NO: 2411081 - protein, 4 aa, Entamoeba dispar
TIPP

SEQ ID NO: 2411082 - protein, 8 aa, Entamoeba dispar
TIPSNVKS

SEQ ID NO: 2411083 - protein, 4 aa, Entamoeba dispar
TIPT

SEQ ID NO: 2411084 - protein, 5 aa, Entamoeba dispar
TIPTS

SEQ ID NO: 2411085 - protein, 12 aa, Entamoeba dispar
TIPTSVSKLGPG

SEQ ID NO: 2411086 - protein, 5 aa, Entamoeba dispar
TIPTT

SEQ ID NO: 2411087 - protein, 16 aa, Entamoeba dispar
TIQKKTNDVEKEDVSN

SEQ ID NO: 2411088 - protein, 9 aa, Entamoeba dispar
TIREGETAL

SEQ ID NO: 2411089 - protein, 4 aa, Entamoeba dispar
TISE

SEQ ID NO: 2411090 - protein, 16 aa, Entamoeba dispar
TISESNLSSPNKTTAS

SEQ ID NO: 2411091 - protein, 20 aa, Entamoeba dispar
TISKTSEIDVSNPSQQKVSL

SEQ ID NO: 2411092 - protein, 4 aa, Entamoeba dispar
TITS

SEQ ID NO: 2411093 - protein, 4 aa, Entamoeba dispar
TITT

SEQ ID NO: 2411094 - protein, 5 aa, Entamoeba dispar
TKAKR

SEQ ID NO: 2411095 - protein, 6 aa, Entamoeba dispar
TKANAD

SEQ ID NO: 2411096 - protein, 15 aa, Entamoeba dispar
TKEDRKKYGNNVPKN

SEQ ID NO: 2411097 - protein, 8 aa, Entamoeba dispar
TKEEHDNV

SEQ ID NO: 2411098 - protein, 4 aa, Entamoeba dispar
TKEL

SEQ ID NO: 2411099 - protein, 6 aa, Entamoeba dispar
TKGGFS

SEQ ID NO: 2411100 - protein, 4 aa, Entamoeba dispar
TKIN

SEQ ID NO: 2411101 - protein, 15 aa, Entamoeba dispar
TKKAGIASKQYRSLE

SEQ ID NO: 2411102 - protein, 14 aa, Entamoeba dispar
TKKQIQKKKKRVNT

SEQ ID NO: 2411103 - protein, 8 aa, Entamoeba dispar
TKLSPSKI

SEQ ID NO: 2411104 - protein, 4 aa, Entamoeba dispar
TKPI

SEQ ID NO: 2411105 - protein, 33 aa, Entamoeba dispar
TKPKEKGCKPVPLSTKHNPTDDGEKKRIEEAGG

SEQ ID NO: 2411106 - protein, 9 aa, Entamoeba dispar
TKPKKFELK

SEQ ID NO: 2411107 - protein, 11 aa, Entamoeba dispar
TKQINSPVKGN

SEQ ID NO: 2411108 - protein, 6 aa, Entamoeba dispar
TKREQI

SEQ ID NO: 2411109 - protein, 22 aa, Entamoeba dispar
TKRNNGKSIKDKYENDTTIEDQ

SEQ ID NO: 2411110 - protein, 9 aa, Entamoeba dispar
TKRNRTPEI

SEQ ID NO: 2411111 - protein, 10 aa, Entamoeba dispar
TKRPSQRVTT

SEQ ID NO: 2411112 - protein, 4 aa, Entamoeba dispar
TKSF

SEQ ID NO: 2411113 - protein, 4 aa, Entamoeba dispar
TKSG

SEQ ID NO: 2411114 - protein, 16 aa, Entamoeba dispar
TKSYNQKSVETQEETL

SEQ ID NO: 2411115 - protein, 10 aa, Entamoeba dispar
TKTKANGQTV

SEQ ID NO: 2411116 - protein, 7 aa, Entamoeba dispar
TKTLTKG

SEQ ID NO: 2411117 - protein, 7 aa, Entamoeba dispar
TKTREDI

SEQ ID NO: 2411118 - protein, 9 aa, Entamoeba dispar
TKTTFGPQG

SEQ ID NO: 2411119 - protein, 10 aa, Entamoeba dispar
TKVSEKKAAI

SEQ ID NO: 2411120 - protein, 5 aa, Entamoeba dispar
TKWEP

SEQ ID NO: 2411121 - protein, 6 aa, Entamoeba dispar
TLASMS

SEQ ID NO: 2411122 - protein, 7 aa, Entamoeba dispar
TLEERKK

SEQ ID NO: 2411123 - protein, 9 aa, Entamoeba dispar
TLEGHNGAV

SEQ ID NO: 2411124 - protein, 7 aa, Entamoeba dispar
TLEINPD

SEQ ID NO: 2411125 - protein, 6 aa, Entamoeba dispar
TLGPRG

SEQ ID NO: 2411126 - protein, 6 aa, Entamoeba dispar
TLGSYG

SEQ ID NO: 2411127 - protein, 8 aa, Entamoeba dispar
TLKDGTPS

SEQ ID NO: 2411128 - protein, 78 aa, Entamoeba dispar
TLPKKEDSKTIGKGDSEISKESKDNKDSKEYKDDRTRKRKGNDEGYSRRDERNYRGDYRRNNSKSSRSNSRKRDRGGR

SEQ ID NO: 2411129 - protein, 8 aa, Entamoeba dispar
TLQEEKEK

SEQ ID NO: 2411130 - protein, 6 aa, Entamoeba dispar
TLQTQE

SEQ ID NO: 2411131 - protein, 7 aa, Entamoeba dispar
TLSGGEL

SEQ ID NO: 2411132 - protein, 9 aa, Entamoeba dispar
TLSGGQKSR

SEQ ID NO: 2411133 - protein, 22 aa, Entamoeba dispar
TLTEEEKKRGVVAASAGNHAQG

SEQ ID NO: 2411134 - protein, 14 aa, Entamoeba dispar
TLTEKEKEEINEEI

SEQ ID NO: 2411135 - protein, 9 aa, Entamoeba dispar
TLTGQTPVL

SEQ ID NO: 2411136 - protein, 5 aa, Entamoeba dispar
TMPQD

SEQ ID NO: 2411137 - protein, 7 aa, Entamoeba dispar
TNASTTG

SEQ ID NO: 2411138 - protein, 9 aa, Entamoeba dispar
TNASYSNND

SEQ ID NO: 2411139 - protein, 7 aa, Entamoeba dispar
TNDGATV

SEQ ID NO: 2411140 - protein, 8 aa, Entamoeba dispar
TNDTTIVS

SEQ ID NO: 2411141 - protein, 7 aa, Entamoeba dispar
TNEISVS

SEQ ID NO: 2411142 - protein, 13 aa, Entamoeba dispar
TNENTQTKTKEIS

SEQ ID NO: 2411143 - protein, 17 aa, Entamoeba dispar
TNGIDSQSISQSSSFIL

SEQ ID NO: 2411144 - protein, 9 aa, Entamoeba dispar
TNGIGKSTA

SEQ ID NO: 2411145 - protein, 12 aa, Entamoeba dispar
TNINPNKKAEQK

SEQ ID NO: 2411146 - protein, 6 aa, Entamoeba dispar
TNKSAA

SEQ ID NO: 2411147 - protein, 6 aa, Entamoeba dispar
TNKSTA

SEQ ID NO: 2411148 - protein, 5 aa, Entamoeba dispar
TNMSN

SEQ ID NO: 2411149 - protein, 6 aa, Entamoeba dispar
TNNERF

SEQ ID NO: 2411150 - protein, 17 aa, Entamoeba dispar
TNNHPKVTPTNTSPFTF

SEQ ID NO: 2411151 - protein, 10 aa, Entamoeba dispar
TNNRIEENKE

SEQ ID NO: 2411152 - protein, 8 aa, Entamoeba dispar
TNNSTDKE

SEQ ID NO: 2411153 - protein, 11 aa, Entamoeba dispar
TNNTTEENKEI

SEQ ID NO: 2411154 - protein, 5 aa, Entamoeba dispar
TNPRK

SEQ ID NO: 2411155 - protein, 4 aa, Entamoeba dispar
TNQI

SEQ ID NO: 2411156 - protein, 11 aa, Entamoeba dispar
TNSEAQAETIL

SEQ ID NO: 2411157 - protein, 7 aa, Entamoeba dispar
TNSETEQ

SEQ ID NO: 2411158 - protein, 5 aa, Entamoeba dispar
TNSKN

SEQ ID NO: 2411159 - protein, 5 aa, Entamoeba dispar
TNSPF

SEQ ID NO: 2411160 - protein, 34 aa, Entamoeba dispar
TNSQSYEESNIKKPALPTSVETSHRNSQLKSKVI

SEQ ID NO: 2411161 - protein, 11 aa, Entamoeba dispar
TNSTGNESERF

SEQ ID NO: 2411162 - protein, 5 aa, Entamoeba dispar
TNTEV

SEQ ID NO: 2411163 - protein, 14 aa, Entamoeba dispar
TNTGIGSQDITDGN

SEQ ID NO: 2411164 - protein, 7 aa, Entamoeba dispar
TNTLGNT

SEQ ID NO: 2411165 - protein, 6 aa, Entamoeba dispar
TNTQFK

SEQ ID NO: 2411166 - protein, 4 aa, Entamoeba dispar
TNTT

SEQ ID NO: 2411167 - protein, 4 aa, Entamoeba dispar
TNVG

SEQ ID NO: 2411168 - protein, 5 aa, Entamoeba dispar
TPDAI

SEQ ID NO: 2411169 - protein, 7 aa, Entamoeba dispar
TPEDVKK

SEQ ID NO: 2411170 - protein, 5 aa, Entamoeba dispar
TPELA

SEQ ID NO: 2411171 - protein, 13 aa, Entamoeba dispar
TPGFGDTRGDEYD

SEQ ID NO: 2411172 - protein, 23 aa, Entamoeba dispar
TPHPKREVSCTKYSTGVFEQDKN

SEQ ID NO: 2411173 - protein, 4 aa, Entamoeba dispar
TPIA

SEQ ID NO: 2411174 - protein, 19 aa, Entamoeba dispar
TPIAAPSANLSTKPSPTIG

SEQ ID NO: 2411175 - protein, 16 aa, Entamoeba dispar
TPINRDAQQTHSNPYM

SEQ ID NO: 2411176 - protein, 11 aa, Entamoeba dispar
TPKNLQTINGK

SEQ ID NO: 2411177 - protein, 4 aa, Entamoeba dispar
TPLF

SEQ ID NO: 2411178 - protein, 5 aa, Entamoeba dispar
TPLQN

SEQ ID NO: 2411179 - protein, 6 aa, Entamoeba dispar
TPLSEK

SEQ ID NO: 2411180 - protein, 6 aa, Entamoeba dispar
TPPQEN

SEQ ID NO: 2411181 - protein, 6 aa, Entamoeba dispar
TPQTVK

SEQ ID NO: 2411182 - protein, 4 aa, Entamoeba dispar
TPQY

SEQ ID NO: 2411183 - protein, 11 aa, Entamoeba dispar
TPRGAKVRSGK

SEQ ID NO: 2411184 - protein, 6 aa, Entamoeba dispar
TPSPTG

SEQ ID NO: 2411185 - protein, 4 aa, Entamoeba dispar
TPSY

SEQ ID NO: 2411186 - protein, 20 aa, Entamoeba dispar
TPVTPSEGEKINPDNKEMKS

SEQ ID NO: 2411187 - protein, 5 aa, Entamoeba dispar
TQEED

SEQ ID NO: 2411188 - protein, 4 aa, Entamoeba dispar
TQES

SEQ ID NO: 2411189 - protein, 6 aa, Entamoeba dispar
TQHTKG

SEQ ID NO: 2411190 - protein, 12 aa, Entamoeba dispar
TQITTELENRAQ

SEQ ID NO: 2411191 - protein, 19 aa, Entamoeba dispar
TQKGKNPIDLDQSTVRGNT

SEQ ID NO: 2411192 - protein, 4 aa, Entamoeba dispar
TQKI

SEQ ID NO: 2411193 - protein, 4 aa, Entamoeba dispar
TQLE

SEQ ID NO: 2411194 - protein, 4 aa, Entamoeba dispar
TQNF

SEQ ID NO: 2411195 - protein, 12 aa, Entamoeba dispar
TQNKRIPIECFD

SEQ ID NO: 2411196 - protein, 4 aa, Entamoeba dispar
TQNL

SEQ ID NO: 2411197 - protein, 6 aa, Entamoeba dispar
TQNTMC

SEQ ID NO: 2411198 - protein, 13 aa, Entamoeba dispar
TQQTESYQRQENN

SEQ ID NO: 2411199 - protein, 10 aa, Entamoeba dispar
TQTTGHTKTL

SEQ ID NO: 2411200 - protein, 5 aa, Entamoeba dispar
TQYDR

SEQ ID NO: 2411201 - protein, 9 aa, Entamoeba dispar
TRDVPDNTI

SEQ ID NO: 2411202 - protein, 6 aa, Entamoeba dispar
TREDDE

SEQ ID NO: 2411203 - protein, 5 aa, Entamoeba dispar
TRGMT

SEQ ID NO: 2411204 - protein, 6 aa, Entamoeba dispar
TRGPNK

SEQ ID NO: 2411205 - protein, 5 aa, Entamoeba dispar
TRIDS

SEQ ID NO: 2411206 - protein, 4 aa, Entamoeba dispar
TRKE

SEQ ID NO: 2411207 - protein, 6 aa, Entamoeba dispar
TRMGKT

SEQ ID NO: 2411208 - protein, 6 aa, Entamoeba dispar
TRNPRQ

SEQ ID NO: 2411209 - protein, 4 aa, Entamoeba dispar
TRQY

SEQ ID NO: 2411210 - protein, 8 aa, Entamoeba dispar
TRRPATSA

SEQ ID NO: 2411211 - protein, 5 aa, Entamoeba dispar
TRSGL

SEQ ID NO: 2411212 - protein, 4 aa, Entamoeba dispar
TRTD

SEQ ID NO: 2411213 - protein, 10 aa, Entamoeba dispar
TRTPTQVRSH

SEQ ID NO: 2411214 - protein, 11 aa, Entamoeba dispar
TRTVKSKPKKA

SEQ ID NO: 2411215 - protein, 7 aa, Entamoeba dispar
TSAGKVE

SEQ ID NO: 2411216 - protein, 8 aa, Entamoeba dispar
TSAKTNIN

SEQ ID NO: 2411217 - protein, 11 aa, Entamoeba dispar
TSALDTQSEKI

SEQ ID NO: 2411218 - protein, 9 aa, Entamoeba dispar
TSDPSLKDA

SEQ ID NO: 2411219 - protein, 5 aa, Entamoeba dispar
TSDQI

SEQ ID NO: 2411220 - protein, 6 aa, Entamoeba dispar
TSDVEK

SEQ ID NO: 2411221 - protein, 4 aa, Entamoeba dispar
TSED

SEQ ID NO: 2411222 - protein, 5 aa, Entamoeba dispar
TSEDE

SEQ ID NO: 2411223 - protein, 4 aa, Entamoeba dispar
TSEQ

SEQ ID NO: 2411224 - protein, 6 aa, Entamoeba dispar
TSETPI

SEQ ID NO: 2411225 - protein, 6 aa, Entamoeba dispar
TSFPYS

SEQ ID NO: 2411226 - protein, 13 aa, Entamoeba dispar
TSGAVQEETELGT

SEQ ID NO: 2411227 - protein, 7 aa, Entamoeba dispar
TSGDGRD

SEQ ID NO: 2411228 - protein, 12 aa, Entamoeba dispar
TSGMDGNIAIWK

SEQ ID NO: 2411229 - protein, 9 aa, Entamoeba dispar
TSGSDDLDE

SEQ ID NO: 2411230 - protein, 8 aa, Entamoeba dispar
TSGVTATP

SEQ ID NO: 2411231 - protein, 4 aa, Entamoeba dispar
TSIS

SEQ ID NO: 2411232 - protein, 6 aa, Entamoeba dispar
TSISEL

SEQ ID NO: 2411233 - protein, 6 aa, Entamoeba dispar
TSISTL

SEQ ID NO: 2411234 - protein, 10 aa, Entamoeba dispar
TSKDPSSKLK

SEQ ID NO: 2411235 - protein, 9 aa, Entamoeba dispar
TSKDYETTH

SEQ ID NO: 2411236 - protein, 9 aa, Entamoeba dispar
TSKGLSETT

SEQ ID NO: 2411237 - protein, 7 aa, Entamoeba dispar
TSKTIDL

SEQ ID NO: 2411238 - protein, 12 aa, Entamoeba dispar
TSLSAGENGSKI

SEQ ID NO: 2411239 - protein, 4 aa, Entamoeba dispar
TSNE

SEQ ID NO: 2411240 - protein, 4 aa, Entamoeba dispar
TSPL

SEQ ID NO: 2411241 - protein, 8 aa, Entamoeba dispar
TSQKTTGI

SEQ ID NO: 2411242 - protein, 12 aa, Entamoeba dispar
TSQTINGQKSGN

SEQ ID NO: 2411243 - protein, 7 aa, Entamoeba dispar
TSQVEDI

SEQ ID NO: 2411244 - protein, 8 aa, Entamoeba dispar
TSRGDQAK

SEQ ID NO: 2411245 - protein, 13 aa, Entamoeba dispar
TSRGTGDKKQFAI

SEQ ID NO: 2411246 - protein, 6 aa, Entamoeba dispar
TSRIDG

SEQ ID NO: 2411247 - protein, 6 aa, Entamoeba dispar
TSSEGF

SEQ ID NO: 2411248 - protein, 9 aa, Entamoeba dispar
TSSEPEKVK

SEQ ID NO: 2411249 - protein, 8 aa, Entamoeba dispar
TSSISSNK

SEQ ID NO: 2411250 - protein, 9 aa, Entamoeba dispar
TSSKKDINI

SEQ ID NO: 2411251 - protein, 28 aa, Entamoeba dispar
TSSKPSSHKTTKSKSKEPEQTYQPAYPR

SEQ ID NO: 2411252 - protein, 15 aa, Entamoeba dispar
TSSNVESGKRTYGGK

SEQ ID NO: 2411253 - protein, 5 aa, Entamoeba dispar
TSSRD

SEQ ID NO: 2411254 - protein, 21 aa, Entamoeba dispar
TSSTSSTQPISQSPSIQPQPI

SEQ ID NO: 2411255 - protein, 6 aa, Entamoeba dispar
TSSTVV

SEQ ID NO: 2411256 - protein, 10 aa, Entamoeba dispar
TSTDTDIPIT

SEQ ID NO: 2411257 - protein, 6 aa, Entamoeba dispar
TSTIDK

SEQ ID NO: 2411258 - protein, 12 aa, Entamoeba dispar
TSTIGGEDKVRT

SEQ ID NO: 2411259 - protein, 11 aa, Entamoeba dispar
TSTSIESHEVG

SEQ ID NO: 2411260 - protein, 7 aa, Entamoeba dispar
TSTSKGY

SEQ ID NO: 2411261 - protein, 8 aa, Entamoeba dispar
TSTSKTGL

SEQ ID NO: 2411262 - protein, 4 aa, Entamoeba dispar
TSVN

SEQ ID NO: 2411263 - protein, 5 aa, Entamoeba dispar
TSVSK

SEQ ID NO: 2411264 - protein, 4 aa, Entamoeba dispar
TTAN

SEQ ID NO: 2411265 - protein, 24 aa, Entamoeba dispar
TTDEEENEEKESRIEQIKGERKLE

SEQ ID NO: 2411266 - protein, 6 aa, Entamoeba dispar
TTDNIS

SEQ ID NO: 2411267 - protein, 6 aa, Entamoeba dispar
TTDSGE

SEQ ID NO: 2411268 - protein, 40 aa, Entamoeba dispar
TTENIQNTHQQTTPTSPHFQPPSPKQSKSPLSPPKSTIKT

SEQ ID NO: 2411269 - protein, 6 aa, Entamoeba dispar
TTEPYF

SEQ ID NO: 2411270 - protein, 4 aa, Entamoeba dispar
TTER

SEQ ID NO: 2411271 - protein, 14 aa, Entamoeba dispar
TTETFGASSNNTVV

SEQ ID NO: 2411272 - protein, 10 aa, Entamoeba dispar
TTFNEEDGAR

SEQ ID NO: 2411273 - protein, 8 aa, Entamoeba dispar
TTGNEESI

SEQ ID NO: 2411274 - protein, 6 aa, Entamoeba dispar
TTIENG

SEQ ID NO: 2411275 - protein, 4 aa, Entamoeba dispar
TTIK

SEQ ID NO: 2411276 - protein, 4 aa, Entamoeba dispar
TTIT

SEQ ID NO: 2411277 - protein, 4 aa, Entamoeba dispar
TTKI

SEQ ID NO: 2411278 - protein, 5 aa, Entamoeba dispar
TTLER

SEQ ID NO: 2411279 - protein, 4 aa, Entamoeba dispar
TTNE

SEQ ID NO: 2411280 - protein, 11 aa, Entamoeba dispar
TTNKTKIGEEN

SEQ ID NO: 2411281 - protein, 12 aa, Entamoeba dispar
TTNKTNEGEEDQ

SEQ ID NO: 2411282 - protein, 5 aa, Entamoeba dispar
TTPLG

SEQ ID NO: 2411283 - protein, 7 aa, Entamoeba dispar
TTPSTDH

SEQ ID NO: 2411284 - protein, 5 aa, Entamoeba dispar
TTQDK

SEQ ID NO: 2411285 - protein, 5 aa, Entamoeba dispar
TTQIN

SEQ ID NO: 2411286 - protein, 7 aa, Entamoeba dispar
TTQKEHP

SEQ ID NO: 2411287 - protein, 6 aa, Entamoeba dispar
TTSASM

SEQ ID NO: 2411288 - protein, 8 aa, Entamoeba dispar
TTSKINDT

SEQ ID NO: 2411289 - protein, 6 aa, Entamoeba dispar
TTSNSP

SEQ ID NO: 2411290 - protein, 26 aa, Entamoeba dispar
TTVTKPQNNTKHTSLKLSGSKPIPTF

SEQ ID NO: 2411291 - protein, 12 aa, Entamoeba dispar
TVETSNPEKEVE

SEQ ID NO: 2411292 - protein, 9 aa, Entamoeba dispar
TVETTNGNW

SEQ ID NO: 2411293 - protein, 10 aa, Entamoeba dispar
TVNNPQTEIP

SEQ ID NO: 2411294 - protein, 8 aa, Entamoeba dispar
TVNRKNIE

SEQ ID NO: 2411295 - protein, 9 aa, Entamoeba dispar
TVSENETAG

SEQ ID NO: 2411296 - protein, 14 aa, Entamoeba dispar
TVSGGGKSEISKNI

SEQ ID NO: 2411297 - protein, 7 aa, Entamoeba dispar
TVSREGY

SEQ ID NO: 2411298 - protein, 5 aa, Entamoeba dispar
TVTSS

SEQ ID NO: 2411299 - protein, 8 aa, Entamoeba dispar
TWKKPQEW

SEQ ID NO: 2411300 - protein, 5 aa, Entamoeba dispar
TWTDD

SEQ ID NO: 2411301 - protein, 4 aa, Entamoeba dispar
TYPQ

SEQ ID NO: 2411302 - protein, 13 aa, Entamoeba dispar
TYQPSGDETYQKT

SEQ ID NO: 2411303 - protein, 6 aa, Entamoeba dispar
TYSNDT

SEQ ID NO: 2411304 - protein, 12 aa, Entamoeba dispar
TYTEHAKRRTVT

SEQ ID NO: 2411305 - protein, 13 aa, Entamoeba dispar
TYTQTDRKSYGNI

SEQ ID NO: 2411306 - protein, 4 aa, Entamoeba dispar
TYTY

SEQ ID NO: 2411307 - protein, 11 aa, Entamoeba dispar
VAAAPAESDTY

SEQ ID NO: 2411308 - protein, 14 aa, Entamoeba dispar
VAAKRAEEDNKKEE

SEQ ID NO: 2411309 - protein, 4 aa, Entamoeba dispar
VAAY

SEQ ID NO: 2411310 - protein, 14 aa, Entamoeba dispar
VADAVRTSLGPRGM

SEQ ID NO: 2411311 - protein, 6 aa, Entamoeba dispar
VAEENG

SEQ ID NO: 2411312 - protein, 4 aa, Entamoeba dispar
VAGV

SEQ ID NO: 2411313 - protein, 12 aa, Entamoeba dispar
VAKEQKKTKQFN

SEQ ID NO: 2411314 - protein, 12 aa, Entamoeba dispar
VAKKPRMPKQED

SEQ ID NO: 2411315 - protein, 12 aa, Entamoeba dispar
VAPKKKKNVSKD

SEQ ID NO: 2411316 - protein, 15 aa, Entamoeba dispar
VAQQPPYPKMPSSLP

SEQ ID NO: 2411317 - protein, 5 aa, Entamoeba dispar
VASGD

SEQ ID NO: 2411318 - protein, 35 aa, Entamoeba dispar
VDEEKKKRKEQLEREQNKEKEEEKRIKVEKRRERE

SEQ ID NO: 2411319 - protein, 6 aa, Entamoeba dispar
VDEETI

SEQ ID NO: 2411320 - protein, 9 aa, Entamoeba dispar
VDEGSNEVS

SEQ ID NO: 2411321 - protein, 8 aa, Entamoeba dispar
VDENYRPY

SEQ ID NO: 2411322 - protein, 30 aa, Entamoeba dispar
VDEQSECEKRTKEEVMKNKKKNNTADQSSI

SEQ ID NO: 2411323 - protein, 9 aa, Entamoeba dispar
VDETTKNEL

SEQ ID NO: 2411324 - protein, 4 aa, Entamoeba dispar
VDIE

SEQ ID NO: 2411325 - protein, 10 aa, Entamoeba dispar
VDIPTSVSEI

SEQ ID NO: 2411326 - protein, 12 aa, Entamoeba dispar
VDKDEKKGRDEK

SEQ ID NO: 2411327 - protein, 26 aa, Entamoeba dispar
VDKEEDSNEENEMSEENNDSIEEHQP

SEQ ID NO: 2411328 - protein, 8 aa, Entamoeba dispar
VDSNTQLL

SEQ ID NO: 2411329 - protein, 5 aa, Entamoeba dispar
VDTEC

SEQ ID NO: 2411330 - protein, 11 aa, Entamoeba dispar
VDTESVQEEIE

SEQ ID NO: 2411331 - protein, 7 aa, Entamoeba dispar
VDTSKYF

SEQ ID NO: 2411332 - protein, 7 aa, Entamoeba dispar
VDVTDNN

SEQ ID NO: 2411333 - protein, 6 aa, Entamoeba dispar
VEDDVA

SEQ ID NO: 2411334 - protein, 4 aa, Entamoeba dispar
VEDL

SEQ ID NO: 2411335 - protein, 6 aa, Entamoeba dispar
VEEDDM

SEQ ID NO: 2411336 - protein, 7 aa, Entamoeba dispar
VEEDGKT

SEQ ID NO: 2411337 - protein, 10 aa, Entamoeba dispar
VEEDVRKRNE

SEQ ID NO: 2411338 - protein, 10 aa, Entamoeba dispar
VEEKEEKREM

SEQ ID NO: 2411339 - protein, 9 aa, Entamoeba dispar
VEESTPKRL

SEQ ID NO: 2411340 - protein, 20 aa, Entamoeba dispar
VEGKQAEFDKLQKEEKSYKC

SEQ ID NO: 2411341 - protein, 5 aa, Entamoeba dispar
VEKGN

SEQ ID NO: 2411342 - protein, 4 aa, Entamoeba dispar
VEKK

SEQ ID NO: 2411343 - protein, 11 aa, Entamoeba dispar
VENKKEEAKKL

SEQ ID NO: 2411344 - protein, 4 aa, Entamoeba dispar
VENS

SEQ ID NO: 2411345 - protein, 4 aa, Entamoeba dispar
VEPF

SEQ ID NO: 2411346 - protein, 6 aa, Entamoeba dispar
VEPKPN

SEQ ID NO: 2411347 - protein, 11 aa, Entamoeba dispar
VERDEINPNPH

SEQ ID NO: 2411348 - protein, 4 aa, Entamoeba dispar
VERK

SEQ ID NO: 2411349 - protein, 14 aa, Entamoeba dispar
VESASRKSKVLPES

SEQ ID NO: 2411350 - protein, 14 aa, Entamoeba dispar
VESASRKSKVLPET

SEQ ID NO: 2411351 - protein, 4 aa, Entamoeba dispar
VESN

SEQ ID NO: 2411352 - protein, 24 aa, Entamoeba dispar
VGAGQKTMDSDVQYAKNKLSESYK

SEQ ID NO: 2411353 - protein, 7 aa, Entamoeba dispar
VGANKKQ

SEQ ID NO: 2411354 - protein, 8 aa, Entamoeba dispar
VGDKAIKN

SEQ ID NO: 2411355 - protein, 9 aa, Entamoeba dispar
VGDKAVKNP

SEQ ID NO: 2411356 - protein, 7 aa, Entamoeba dispar
VGEATEN

SEQ ID NO: 2411357 - protein, 10 aa, Entamoeba dispar
VGEDDRANLE

SEQ ID NO: 2411358 - protein, 6 aa, Entamoeba dispar
VGENKN

SEQ ID NO: 2411359 - protein, 10 aa, Entamoeba dispar
VGESGDRLTR

SEQ ID NO: 2411360 - protein, 10 aa, Entamoeba dispar
VGGGTGSGFT

SEQ ID NO: 2411361 - protein, 7 aa, Entamoeba dispar
VGKSSVA

SEQ ID NO: 2411362 - protein, 4 aa, Entamoeba dispar
VGKT

SEQ ID NO: 2411363 - protein, 7 aa, Entamoeba dispar
VGPSGKY

SEQ ID NO: 2411364 - protein, 5 aa, Entamoeba dispar
VGSIT

SEQ ID NO: 2411365 - protein, 6 aa, Entamoeba dispar
VGSQQK

SEQ ID NO: 2411366 - protein, 4 aa, Entamoeba dispar
VGSS

SEQ ID NO: 2411367 - protein, 21 aa, Entamoeba dispar
VGSYGEYTPNIGKSMKAAKHS

SEQ ID NO: 2411368 - protein, 5 aa, Entamoeba dispar
VGVGK

SEQ ID NO: 2411369 - protein, 16 aa, Entamoeba dispar
VHQDEEDDEIPTQPIT

SEQ ID NO: 2411370 - protein, 11 aa, Entamoeba dispar
VHTDNSDKTVK

SEQ ID NO: 2411371 - protein, 33 aa, Entamoeba dispar
VIEQPQQSIQEESKEEKKEEEPKEEKKEEPKAI

SEQ ID NO: 2411372 - protein, 15 aa, Entamoeba dispar
VIPTNQTAGNINMED

SEQ ID NO: 2411373 - protein, 18 aa, Entamoeba dispar
VKAAKKAQHFPARKFFVL

SEQ ID NO: 2411374 - protein, 10 aa, Entamoeba dispar
VKAKDNQQHF

SEQ ID NO: 2411375 - protein, 10 aa, Entamoeba dispar
VKAPGDKTAP

SEQ ID NO: 2411376 - protein, 7 aa, Entamoeba dispar
VKEPGTY

SEQ ID NO: 2411377 - protein, 6 aa, Entamoeba dispar
VKGTAP

SEQ ID NO: 2411378 - protein, 10 aa, Entamoeba dispar
VKLNSEVNKE

SEQ ID NO: 2411379 - protein, 7 aa, Entamoeba dispar
VKNSGEV

SEQ ID NO: 2411380 - protein, 7 aa, Entamoeba dispar
VKPPSAT

SEQ ID NO: 2411381 - protein, 13 aa, Entamoeba dispar
VKPSGENGPIATQ

SEQ ID NO: 2411382 - protein, 8 aa, Entamoeba dispar
VKQQDEID

SEQ ID NO: 2411383 - protein, 54 aa, Entamoeba dispar
VKQTTAQQQKDNWKEQPQQGTRQSNTQQQGTQQQPSTQQQNVQQQNTQTQPQRD

SEQ ID NO: 2411384 - protein, 10 aa, Entamoeba dispar
VKRDEKCDKE

SEQ ID NO: 2411385 - protein, 5 aa, Entamoeba dispar
VKRGK

SEQ ID NO: 2411386 - protein, 5 aa, Entamoeba dispar
VKTAH

SEQ ID NO: 2411387 - protein, 14 aa, Entamoeba dispar
VKTALKKKTELKPK

SEQ ID NO: 2411388 - protein, 7 aa, Entamoeba dispar
VLKEGET

SEQ ID NO: 2411389 - protein, 7 aa, Entamoeba dispar
VNAQNKI

SEQ ID NO: 2411390 - protein, 14 aa, Entamoeba dispar
VNDITDGERRKAKT

SEQ ID NO: 2411391 - protein, 6 aa, Entamoeba dispar
VNEEQI

SEQ ID NO: 2411392 - protein, 4 aa, Entamoeba dispar
VNEK

SEQ ID NO: 2411393 - protein, 30 aa, Entamoeba dispar
VNGEIESELKEKEQAKIEQSDATTNGYSSS

SEQ ID NO: 2411394 - protein, 9 aa, Entamoeba dispar
VNGSEGYGY

SEQ ID NO: 2411395 - protein, 4 aa, Entamoeba dispar
VNPP

SEQ ID NO: 2411396 - protein, 5 aa, Entamoeba dispar
VNPSV

SEQ ID NO: 2411397 - protein, 8 aa, Entamoeba dispar
VNTFSSEG

SEQ ID NO: 2411398 - protein, 6 aa, Entamoeba dispar
VPDSTY

SEQ ID NO: 2411399 - protein, 6 aa, Entamoeba dispar
VPEDTK

SEQ ID NO: 2411400 - protein, 5 aa, Entamoeba dispar
VPEST

SEQ ID NO: 2411401 - protein, 4 aa, Entamoeba dispar
VPGA

SEQ ID NO: 2411402 - protein, 6 aa, Entamoeba dispar
VPIATD

SEQ ID NO: 2411403 - protein, 4 aa, Entamoeba dispar
VPKN

SEQ ID NO: 2411404 - protein, 9 aa, Entamoeba dispar
VPKSDSKRV

SEQ ID NO: 2411405 - protein, 12 aa, Entamoeba dispar
VPLEEPQVGSGY

SEQ ID NO: 2411406 - protein, 4 aa, Entamoeba dispar
VPPE

SEQ ID NO: 2411407 - protein, 9 aa, Entamoeba dispar
VPQENRTKV

SEQ ID NO: 2411408 - protein, 4 aa, Entamoeba dispar
VPTQ

SEQ ID NO: 2411409 - protein, 12 aa, Entamoeba dispar
VPTRTKKQCRER

SEQ ID NO: 2411410 - protein, 7 aa, Entamoeba dispar
VPTSVTN

SEQ ID NO: 2411411 - protein, 8 aa, Entamoeba dispar
VPTTETKM

SEQ ID NO: 2411412 - protein, 7 aa, Entamoeba dispar
VPVPADK

SEQ ID NO: 2411413 - protein, 10 aa, Entamoeba dispar
VQDDSSTEIP

SEQ ID NO: 2411414 - protein, 20 aa, Entamoeba dispar
VQKKEKKEIELDGEKSKLGL

SEQ ID NO: 2411415 - protein, 18 aa, Entamoeba dispar
VQPQTNLQQQQQQISQPL

SEQ ID NO: 2411416 - protein, 16 aa, Entamoeba dispar
VQQPSTSTSFGSPKTQ

SEQ ID NO: 2411417 - protein, 5 aa, Entamoeba dispar
VQQQI

SEQ ID NO: 2411418 - protein, 6 aa, Entamoeba dispar
VQQRGM

SEQ ID NO: 2411419 - protein, 16 aa, Entamoeba dispar
VQSQNTNESIEEEKKL

SEQ ID NO: 2411420 - protein, 29 aa, Entamoeba dispar
VREEAKQIQGERKLKRDFNAGKKPEMKKA

SEQ ID NO: 2411421 - protein, 7 aa, Entamoeba dispar
VRGPQVQ

SEQ ID NO: 2411422 - protein, 4 aa, Entamoeba dispar
VRGR

SEQ ID NO: 2411423 - protein, 8 aa, Entamoeba dispar
VRGSGNPI

SEQ ID NO: 2411424 - protein, 4 aa, Entamoeba dispar
VRPI

SEQ ID NO: 2411425 - protein, 7 aa, Entamoeba dispar
VRSKEKG

SEQ ID NO: 2411426 - protein, 5 aa, Entamoeba dispar
VSDDR

SEQ ID NO: 2411427 - protein, 12 aa, Entamoeba dispar
VSDSDEKPSGGF

SEQ ID NO: 2411428 - protein, 22 aa, Entamoeba dispar
VSDSDESSTKYAGGYFGEGDRS

SEQ ID NO: 2411429 - protein, 22 aa, Entamoeba dispar
VSDSDESSTKYTGGYFGEGDRN

SEQ ID NO: 2411430 - protein, 14 aa, Entamoeba dispar
VSEEEAKKLKRGQK

SEQ ID NO: 2411431 - protein, 5 aa, Entamoeba dispar
VSEGI

SEQ ID NO: 2411432 - protein, 4 aa, Entamoeba dispar
VSEH

SEQ ID NO: 2411433 - protein, 4 aa, Entamoeba dispar
VSEI

SEQ ID NO: 2411434 - protein, 4 aa, Entamoeba dispar
VSEP

SEQ ID NO: 2411435 - protein, 59 aa, Entamoeba dispar
VSEQGKRKQDERDSEGEHKMRDDEENIEEQGVEERLPTIDSETSNIQTPQSETYKNELR

SEQ ID NO: 2411436 - protein, 9 aa, Entamoeba dispar
VSEQNKRTL

SEQ ID NO: 2411437 - protein, 10 aa, Entamoeba dispar
VSERSQAEQL

SEQ ID NO: 2411438 - protein, 7 aa, Entamoeba dispar
VSIEDED

SEQ ID NO: 2411439 - protein, 5 aa, Entamoeba dispar
VSKIG

SEQ ID NO: 2411440 - protein, 5 aa, Entamoeba dispar
VSKSI

SEQ ID NO: 2411441 - protein, 7 aa, Entamoeba dispar
VSKVSGW

SEQ ID NO: 2411442 - protein, 14 aa, Entamoeba dispar
VSLKEGSLTGAVNR

SEQ ID NO: 2411443 - protein, 4 aa, Entamoeba dispar
VSNS

SEQ ID NO: 2411444 - protein, 4 aa, Entamoeba dispar
VSPN

SEQ ID NO: 2411445 - protein, 7 aa, Entamoeba dispar
VSQDDTV

SEQ ID NO: 2411446 - protein, 5 aa, Entamoeba dispar
VSQPE

SEQ ID NO: 2411447 - protein, 15 aa, Entamoeba dispar
VSQSSSDVVSGSQDL

SEQ ID NO: 2411448 - protein, 6 aa, Entamoeba dispar
VSRGSE

SEQ ID NO: 2411449 - protein, 8 aa, Entamoeba dispar
VSRTNKNI

SEQ ID NO: 2411450 - protein, 8 aa, Entamoeba dispar
VSSSDKKV

SEQ ID NO: 2411451 - protein, 13 aa, Entamoeba dispar
VSSVTGDKQRTEI

SEQ ID NO: 2411452 - protein, 10 aa, Entamoeba dispar
VSTEKTENQI

SEQ ID NO: 2411453 - protein, 12 aa, Entamoeba dispar
VSTEQGQKFAKE

SEQ ID NO: 2411454 - protein, 23 aa, Entamoeba dispar
VSTNKCCKSTQVQNGNYCNSSKH

SEQ ID NO: 2411455 - protein, 5 aa, Entamoeba dispar
VTCEG

SEQ ID NO: 2411456 - protein, 9 aa, Entamoeba dispar
VTDVTQAET

SEQ ID NO: 2411457 - protein, 7 aa, Entamoeba dispar
VTENALP

SEQ ID NO: 2411458 - protein, 10 aa, Entamoeba dispar
VTENKHYDGS

SEQ ID NO: 2411459 - protein, 4 aa, Entamoeba dispar
VTGN

SEQ ID NO: 2411460 - protein, 9 aa, Entamoeba dispar
VTGSSDKKV

SEQ ID NO: 2411461 - protein, 5 aa, Entamoeba dispar
VTKDH

SEQ ID NO: 2411462 - protein, 9 aa, Entamoeba dispar
VTKGENGVS

SEQ ID NO: 2411463 - protein, 9 aa, Entamoeba dispar
VTPEKAIRQ

SEQ ID NO: 2411464 - protein, 7 aa, Entamoeba dispar
VTPGNKQ

SEQ ID NO: 2411465 - protein, 7 aa, Entamoeba dispar
VTQRTEM

SEQ ID NO: 2411466 - protein, 9 aa, Entamoeba dispar
VTRRSRRMS

SEQ ID NO: 2411467 - protein, 6 aa, Entamoeba dispar
VTSLPK

SEQ ID NO: 2411468 - protein, 12 aa, Entamoeba dispar
VTTGESPKYELS

SEQ ID NO: 2411469 - protein, 10 aa, Entamoeba dispar
VTTLSEGEFP

SEQ ID NO: 2411470 - protein, 8 aa, Entamoeba dispar
VTTSSDGN

SEQ ID NO: 2411471 - protein, 11 aa, Entamoeba dispar
VTVPSSISKIG

SEQ ID NO: 2411472 - protein, 6 aa, Entamoeba dispar
VVETNE

SEQ ID NO: 2411473 - protein, 16 aa, Entamoeba dispar
WAPNKATQLCSASDDH

SEQ ID NO: 2411474 - protein, 10 aa, Entamoeba dispar
WDDQDGGIGS

SEQ ID NO: 2411475 - protein, 8 aa, Entamoeba dispar
WENSSSVN

SEQ ID NO: 2411476 - protein, 34 aa, Entamoeba dispar
WGSSGQFQQQNGIQNPFGQQSTPFNQFPQQQNQF

SEQ ID NO: 2411477 - protein, 8 aa, Entamoeba dispar
WKEENSLV

SEQ ID NO: 2411478 - protein, 11 aa, Entamoeba dispar
WKGSERKDVAY

SEQ ID NO: 2411479 - protein, 9 aa, Entamoeba dispar
WKQEAKERI

SEQ ID NO: 2411480 - protein, 9 aa, Entamoeba dispar
WKQEPKERI

SEQ ID NO: 2411481 - protein, 16 aa, Entamoeba dispar
WNKTENAVNGISIVKL

SEQ ID NO: 2411482 - protein, 8 aa, Entamoeba dispar
WNNNGNSA

SEQ ID NO: 2411483 - protein, 7 aa, Entamoeba dispar
WPPIQNK

SEQ ID NO: 2411484 - protein, 7 aa, Entamoeba dispar
WRTPGIK

SEQ ID NO: 2411485 - protein, 8 aa, Entamoeba dispar
WSGEGVKN

SEQ ID NO: 2411486 - protein, 4 aa, Entamoeba dispar
WSPA

SEQ ID NO: 2411487 - protein, 6 aa, Entamoeba dispar
WSQEED

SEQ ID NO: 2411488 - protein, 12 aa, Entamoeba dispar
YAGNSERNEVIG

SEQ ID NO: 2411489 - protein, 8 aa, Entamoeba dispar
YAPTVNRK

SEQ ID NO: 2411490 - protein, 7 aa, Entamoeba dispar
YDARRGE

SEQ ID NO: 2411491 - protein, 15 aa, Entamoeba dispar
YDENKPETHKGRNLK

SEQ ID NO: 2411492 - protein, 5 aa, Entamoeba dispar
YDETR

SEQ ID NO: 2411493 - protein, 10 aa, Entamoeba dispar
YDKDKDGQIT

SEQ ID NO: 2411494 - protein, 43 aa, Entamoeba dispar
YDKDNRDQRYSRTYDDPYYDDPRFDPRYSSSRFDPRFDPRYDP

SEQ ID NO: 2411495 - protein, 5 aa, Entamoeba dispar
YDKNT

SEQ ID NO: 2411496 - protein, 10 aa, Entamoeba dispar
YDKPKPTKLI

SEQ ID NO: 2411497 - protein, 9 aa, Entamoeba dispar
YDKQTEKNK

SEQ ID NO: 2411498 - protein, 15 aa, Entamoeba dispar
YDKTLENKKIEKGVK

SEQ ID NO: 2411499 - protein, 4 aa, Entamoeba dispar
YDPS

SEQ ID NO: 2411500 - protein, 17 aa, Entamoeba dispar
YDREKFGDKIPSEVSSL

SEQ ID NO: 2411501 - protein, 12 aa, Entamoeba dispar
YDRFSDENLRKE

SEQ ID NO: 2411502 - protein, 12 aa, Entamoeba dispar
YDSEIEKEGKKL

SEQ ID NO: 2411503 - protein, 11 aa, Entamoeba dispar
YDSKKIKTKHI

SEQ ID NO: 2411504 - protein, 7 aa, Entamoeba dispar
YDSRIKQ

SEQ ID NO: 2411505 - protein, 14 aa, Entamoeba dispar
YDYGVNSEDITNQE

SEQ ID NO: 2411506 - protein, 10 aa, Entamoeba dispar
YEDDRDYGSI

SEQ ID NO: 2411507 - protein, 9 aa, Entamoeba dispar
YEEDRDYGA

SEQ ID NO: 2411508 - protein, 9 aa, Entamoeba dispar
YEEHGKNKD

SEQ ID NO: 2411509 - protein, 9 aa, Entamoeba dispar
YEELEERQK

SEQ ID NO: 2411510 - protein, 4 aa, Entamoeba dispar
YEES

SEQ ID NO: 2411511 - protein, 6 aa, Entamoeba dispar
YEGGQL

SEQ ID NO: 2411512 - protein, 12 aa, Entamoeba dispar
YEGLNEENKKVK

SEQ ID NO: 2411513 - protein, 9 aa, Entamoeba dispar
YEKSEVNSS

SEQ ID NO: 2411514 - protein, 6 aa, Entamoeba dispar
YESPNG

SEQ ID NO: 2411515 - protein, 4 aa, Entamoeba dispar
YETN

SEQ ID NO: 2411516 - protein, 5 aa, Entamoeba dispar
YFGKT

SEQ ID NO: 2411517 - protein, 5 aa, Entamoeba dispar
YFPTE

SEQ ID NO: 2411518 - protein, 4 aa, Entamoeba dispar
YGAP

SEQ ID NO: 2411519 - protein, 20 aa, Entamoeba dispar
YGDESKQEHVRDIVKSFVSR

SEQ ID NO: 2411520 - protein, 9 aa, Entamoeba dispar
YGEGTPTAA

SEQ ID NO: 2411521 - protein, 12 aa, Entamoeba dispar
YGEPSQYSELPN

SEQ ID NO: 2411522 - protein, 6 aa, Entamoeba dispar
YGGPRE

SEQ ID NO: 2411523 - protein, 13 aa, Entamoeba dispar
YGITGKGQPMMNN

SEQ ID NO: 2411524 - protein, 30 aa, Entamoeba dispar
YGKAETGTTFTQTNQNKTDYQTETNAQENE

SEQ ID NO: 2411525 - protein, 6 aa, Entamoeba dispar
YGKKKT

SEQ ID NO: 2411526 - protein, 13 aa, Entamoeba dispar
YGKSGLISKNANI

SEQ ID NO: 2411527 - protein, 7 aa, Entamoeba dispar
YGNEQEK

SEQ ID NO: 2411528 - protein, 4 aa, Entamoeba dispar
YGPF

SEQ ID NO: 2411529 - protein, 12 aa, Entamoeba dispar
YGQYLTEDEKRR

SEQ ID NO: 2411530 - protein, 4 aa, Entamoeba dispar
YGTS

SEQ ID NO: 2411531 - protein, 8 aa, Entamoeba dispar
YIQQEGKI

SEQ ID NO: 2411532 - protein, 9 aa, Entamoeba dispar
YIQQEGKIK

SEQ ID NO: 2411533 - protein, 12 aa, Entamoeba dispar
YITESGSLNVTN

SEQ ID NO: 2411534 - protein, 23 aa, Entamoeba dispar
YKDPEESEKDSEDMEKQEENYDA

SEQ ID NO: 2411535 - protein, 9 aa, Entamoeba dispar
YKEEGYKND

SEQ ID NO: 2411536 - protein, 9 aa, Entamoeba dispar
YKQNNDCEP

SEQ ID NO: 2411537 - protein, 5 aa, Entamoeba dispar
YLTPE

SEQ ID NO: 2411538 - protein, 6 aa, Entamoeba dispar
YMRSGD

SEQ ID NO: 2411539 - protein, 5 aa, Entamoeba dispar
YMSED

SEQ ID NO: 2411540 - protein, 12 aa, Entamoeba dispar
YNEGKEGMANAE

SEQ ID NO: 2411541 - protein, 9 aa, Entamoeba dispar
YNEKERKIA

SEQ ID NO: 2411542 - protein, 7 aa, Entamoeba dispar
YNGDNRR

SEQ ID NO: 2411543 - protein, 4 aa, Entamoeba dispar
YNGI

SEQ ID NO: 2411544 - protein, 10 aa, Entamoeba dispar
YNGKTYSGKR

SEQ ID NO: 2411545 - protein, 5 aa, Entamoeba dispar
YNHED

SEQ ID NO: 2411546 - protein, 14 aa, Entamoeba dispar
YNNEGQYLNTERPT

SEQ ID NO: 2411547 - protein, 8 aa, Entamoeba dispar
YNPIETTS

SEQ ID NO: 2411548 - protein, 9 aa, Entamoeba dispar
YNQNNAYNE

SEQ ID NO: 2411549 - protein, 9 aa, Entamoeba dispar
YNTNEENNQ

SEQ ID NO: 2411550 - protein, 13 aa, Entamoeba dispar
YNTRIPRECFEKE

SEQ ID NO: 2411551 - protein, 7 aa, Entamoeba dispar
YPDYTEQ

SEQ ID NO: 2411552 - protein, 6 aa, Entamoeba dispar
YPEPIN

SEQ ID NO: 2411553 - protein, 5 aa, Entamoeba dispar
YPFGS

SEQ ID NO: 2411554 - protein, 6 aa, Entamoeba dispar
YPIKPP

SEQ ID NO: 2411555 - protein, 13 aa, Entamoeba dispar
YPISQKKAISSQF

SEQ ID NO: 2411556 - protein, 10 aa, Entamoeba dispar
YPKDLTTGSP

SEQ ID NO: 2411557 - protein, 6 aa, Entamoeba dispar
YPKGKA

SEQ ID NO: 2411558 - protein, 4 aa, Entamoeba dispar
YPNS

SEQ ID NO: 2411559 - protein, 20 aa, Entamoeba dispar
YPPERSPYYPYSQNYNQPVP

SEQ ID NO: 2411560 - protein, 9 aa, Entamoeba dispar
YPPNNGGKI

SEQ ID NO: 2411561 - protein, 5 aa, Entamoeba dispar
YPSKE

SEQ ID NO: 2411562 - protein, 8 aa, Entamoeba dispar
YQKETDKI

SEQ ID NO: 2411563 - protein, 4 aa, Entamoeba dispar
YQSK

SEQ ID NO: 2411564 - protein, 6 aa, Entamoeba dispar
YRGDIP

SEQ ID NO: 2411565 - protein, 14 aa, Entamoeba dispar
YRIPEDQKEAAKKI

SEQ ID NO: 2411566 - protein, 7 aa, Entamoeba dispar
YRPTGKV

SEQ ID NO: 2411567 - protein, 5 aa, Entamoeba dispar
YSDAA

SEQ ID NO: 2411568 - protein, 14 aa, Entamoeba dispar
YSDAIEEINKGNEC

SEQ ID NO: 2411569 - protein, 11 aa, Entamoeba dispar
YSMSEDSNNED

SEQ ID NO: 2411570 - protein, 14 aa, Entamoeba dispar
YSNKFKTQTIPPPI

SEQ ID NO: 2411571 - protein, 8 aa, Entamoeba dispar
YSPNLKGE

SEQ ID NO: 2411572 - protein, 6 aa, Entamoeba dispar
YSPNTL

SEQ ID NO: 2411573 - protein, 13 aa, Entamoeba dispar
YSPTGREFTTGSY

SEQ ID NO: 2411574 - protein, 4 aa, Entamoeba dispar
YSSE

SEQ ID NO: 2411575 - protein, 5 aa, Entamoeba dispar
YSSIE

SEQ ID NO: 2411576 - protein, 5 aa, Entamoeba dispar
YSSNV

SEQ ID NO: 2411577 - protein, 7 aa, Entamoeba dispar
YSTNEDI

SEQ ID NO: 2411578 - protein, 17 aa, Entamoeba dispar
YSYGKAINKPSNEQGSI

SEQ ID NO: 2411579 - protein, 8 aa, Entamoeba dispar
YTEQSAQE

SEQ ID NO: 2411580 - protein, 9 aa, Entamoeba dispar
YTKYEGKKE

SEQ ID NO: 2411581 - protein, 22 aa, Entamoeba dispar
YTLNNGKCSNKEKNQNGKNEEI

SEQ ID NO: 2411582 - protein, 5 aa, Entamoeba dispar
YTQGM

SEQ ID NO: 2411583 - protein, 6 aa, Entamoeba dispar
YTQSSR

SEQ ID NO: 2411584 - protein, 11 aa, Entamoeba dispar
YTSNSPSSLAA

SEQ ID NO: 2411585 - protein, 19 aa, Entamoeba dispar
YTSPNDTTDVPEKNVPIKG

SEQ ID NO: 2411586 - protein, 8 aa, Entamoeba dispar
YTSRTGDF

SEQ ID NO: 2411587 - protein, 13 aa, Entamoeba dispar
YTTDGPKEKEEDA

SEQ ID NO: 2411588 - protein, 4 aa, Entamoeba dispar
YTYY

SEQ ID NO: 2411589 - protein, 4 aa, Entamoeba dispar
YVND

SEQ ID NO: 2411590 - protein, 5 aa, Entamoeba dispar
YVPPS

SEQ ID NO: 2411591 - protein, 8 aa, Entamoeba dispar
YVPTPEEE

SEQ ID NO: 2411592 - protein, 16 aa, Entamoeba dispar
YYGEPSYSASISKDGS

SEQ ID NO: 2411593 - protein, 4 aa, Entamoeba dispar
YYKS

SEQ ID NO: 2411594 - protein, 6 aa, Entamoeba dispar
YYNNNQ

SEQ ID NO: 2411595 - protein, 10 aa, Entamoeba dispar
YYPPYQGYAD

SEQ ID NO: 2411596 - protein, 4 aa, Entamoeba dispar
YYRN

SEQ ID NO: 2411597 - protein, 35 aa, Entamoeba dispar
YYSRRYSPDDSMSDSPISYSPKPRDRDRTNERMNE

SEQ ID NO: 2411598 - protein, 8 aa, Entamoeba dispar
AAAAANQL

SEQ ID NO: 2411599 - protein, 42 aa, Entamoeba dispar
AAAAGGAARAAGRGPGGQRGVDGCADGAAQAGARPDPVAGLR

SEQ ID NO: 2411600 - protein, 12 aa, Entamoeba dispar
AAAEAADINEKQ

SEQ ID NO: 2411601 - protein, 21 aa, Entamoeba dispar
AAAKAPGATRIYTPGEKEHET

SEQ ID NO: 2411602 - protein, 38 aa, Entamoeba dispar
AAAPAAGAAAQTETKAEEKKEEKKEEEEEEDFGGFGDL

SEQ ID NO: 2411603 - protein, 8 aa, Entamoeba dispar
AAAPSYYR

SEQ ID NO: 2411604 - protein, 10 aa, Entamoeba dispar
AAAPTGNARD

SEQ ID NO: 2411605 - protein, 6 aa, Entamoeba dispar
AAAREK

SEQ ID NO: 2411606 - protein, 17 aa, Entamoeba dispar
AAASCRPIAPARQRGAV

SEQ ID NO: 2411607 - protein, 6 aa, Entamoeba dispar
AACENT

SEQ ID NO: 2411608 - protein, 6 aa, Entamoeba dispar
AACSQQ

SEQ ID NO: 2411609 - protein, 19 aa, Entamoeba dispar
AADALSKISRQRSNTSCKK

SEQ ID NO: 2411610 - protein, 8 aa, Entamoeba dispar
AADGPDKL

SEQ ID NO: 2411611 - protein, 9 aa, Entamoeba dispar
AADNKEKKL

SEQ ID NO: 2411612 - protein, 6 aa, Entamoeba dispar
AADPEG

SEQ ID NO: 2411613 - protein, 4 aa, Entamoeba dispar
AADT

SEQ ID NO: 2411614 - protein, 13 aa, Entamoeba dispar
AADTRLKQKTQQL

SEQ ID NO: 2411615 - protein, 17 aa, Entamoeba dispar
AADVPKGSVKSKHTLTG

SEQ ID NO: 2411616 - protein, 11 aa, Entamoeba dispar
AADVTGTSDGY

SEQ ID NO: 2411617 - protein, 27 aa, Entamoeba dispar
AAEDAAKAKKEKREKDLKERKKNARVI

SEQ ID NO: 2411618 - protein, 8 aa, Entamoeba dispar
AAEDENIR

SEQ ID NO: 2411619 - protein, 6 aa, Entamoeba dispar
AAEDIK

SEQ ID NO: 2411620 - protein, 36 aa, Entamoeba dispar
AAEEREARKRRDKEKGGYQPKYRRTERSESRERNKK

SEQ ID NO: 2411621 - protein, 7 aa, Entamoeba dispar
AAEGSGI

SEQ ID NO: 2411622 - protein, 42 aa, Entamoeba dispar
AAEIEANEKKMKKRKSFKEPLKNKEKESVKLPKQKEKEKKMI

SEQ ID NO: 2411623 - protein, 5 aa, Entamoeba dispar
AAEIR

SEQ ID NO: 2411624 - protein, 15 aa, Entamoeba dispar
AAEKDPKATFTKPSR

SEQ ID NO: 2411625 - protein, 6 aa, Entamoeba dispar
AAEKGI

SEQ ID NO: 2411626 - protein, 15 aa, Entamoeba dispar
AAEKIKKKALPSGPI

SEQ ID NO: 2411627 - protein, 6 aa, Entamoeba dispar
AAEKLG

SEQ ID NO: 2411628 - protein, 4 aa, Entamoeba dispar
AAEN

SEQ ID NO: 2411629 - protein, 38 aa, Entamoeba dispar
AAENEAREAARKKEEEEKKPEEKPEEKTEVEPKKEVKK

SEQ ID NO: 2411630 - protein, 10 aa, Entamoeba dispar
AAENGDKNGM

SEQ ID NO: 2411631 - protein, 7 aa, Entamoeba dispar
AAENRKN

SEQ ID NO: 2411632 - protein, 7 aa, Entamoeba dispar
AAEQEKM

SEQ ID NO: 2411633 - protein, 7 aa, Entamoeba dispar
AAEQRKE

SEQ ID NO: 2411634 - protein, 11 aa, Entamoeba dispar
AAFDKGASTIS

SEQ ID NO: 2411635 - protein, 6 aa, Entamoeba dispar
AAGATD

SEQ ID NO: 2411636 - protein, 12 aa, Entamoeba dispar
AAGEKEQEAFNN

SEQ ID NO: 2411637 - protein, 7 aa, Entamoeba dispar
AAGGIRT

SEQ ID NO: 2411638 - protein, 8 aa, Entamoeba dispar
AAGGVSSL

SEQ ID NO: 2411639 - protein, 25 aa, Entamoeba dispar
AAGKSLKKQKAKEIKQDGQLGTTKS

SEQ ID NO: 2411640 - protein, 14 aa, Entamoeba dispar
AAGLDTKAGCTGTY

SEQ ID NO: 2411641 - protein, 6 aa, Entamoeba dispar
AAGLEG

SEQ ID NO: 2411642 - protein, 12 aa, Entamoeba dispar
AAGLGGIGKKGK

SEQ ID NO: 2411643 - protein, 7 aa, Entamoeba dispar
AAGRRDH

SEQ ID NO: 2411644 - protein, 13 aa, Entamoeba dispar
AAGRTSKKQKYSV

SEQ ID NO: 2411645 - protein, 7 aa, Entamoeba dispar
AAGTGIT

SEQ ID NO: 2411646 - protein, 8 aa, Entamoeba dispar
AAGTGKSY

SEQ ID NO: 2411647 - protein, 7 aa, Entamoeba dispar
AAHSNDY

SEQ ID NO: 2411648 - protein, 7 aa, Entamoeba dispar
AAHSNTK

SEQ ID NO: 2411649 - protein, 4 aa, Entamoeba dispar
AAHT

SEQ ID NO: 2411650 - protein, 19 aa, Entamoeba dispar
AAKEPTGKKEKGGKKGCSL

SEQ ID NO: 2411651 - protein, 8 aa, Entamoeba dispar
AAKETQNK

SEQ ID NO: 2411652 - protein, 17 aa, Entamoeba dispar
AAKLGEDYTPEEVEERR

SEQ ID NO: 2411653 - protein, 35 aa, Entamoeba dispar
AAKNQSATASDRLKKRKDRIPEYENDKKKADNEMK

SEQ ID NO: 2411654 - protein, 6 aa, Entamoeba dispar
AAKPNS

SEQ ID NO: 2411655 - protein, 7 aa, Entamoeba dispar
AAKQNPT

SEQ ID NO: 2411656 - protein, 6 aa, Entamoeba dispar
AAKRIN

SEQ ID NO: 2411657 - protein, 6 aa, Entamoeba dispar
AALKDD

SEQ ID NO: 2411658 - protein, 17 aa, Entamoeba dispar
AALKKTKGDLVSAFFEF

SEQ ID NO: 2411659 - protein, 6 aa, Entamoeba dispar
AALKNT

SEQ ID NO: 2411660 - protein, 9 aa, Entamoeba dispar
AALTRKPKL

SEQ ID NO: 2411661 - protein, 7 aa, Entamoeba dispar
AALTTNE

SEQ ID NO: 2411662 - protein, 6 aa, Entamoeba dispar
AAMKPG

SEQ ID NO: 2411663 - protein, 7 aa, Entamoeba dispar
AAMPPQK

SEQ ID NO: 2411664 - protein, 8 aa, Entamoeba dispar
AANASSNV

SEQ ID NO: 2411665 - protein, 6 aa, Entamoeba dispar
AANEED

SEQ ID NO: 2411666 - protein, 8 aa, Entamoeba dispar
AANFNDST

SEQ ID NO: 2411667 - protein, 10 aa, Entamoeba dispar
AANGATKEKI

SEQ ID NO: 2411668 - protein, 6 aa, Entamoeba dispar
AANHPE

SEQ ID NO: 2411669 - protein, 5 aa, Entamoeba dispar
AANIN

SEQ ID NO: 2411670 - protein, 10 aa, Entamoeba dispar
AANKATKKVK

SEQ ID NO: 2411671 - protein, 8 aa, Entamoeba dispar
AANNGSTI

SEQ ID NO: 2411672 - protein, 10 aa, Entamoeba dispar
AANPKTASYL

SEQ ID NO: 2411673 - protein, 18 aa, Entamoeba dispar
AANPKTGKYNPNKNLNQN

SEQ ID NO: 2411674 - protein, 8 aa, Entamoeba dispar
AANPSFGR

SEQ ID NO: 2411675 - protein, 17 aa, Entamoeba dispar
AANPSNGNYNVKKSPME

SEQ ID NO: 2411676 - protein, 13 aa, Entamoeba dispar
AANTIKHDERQGR

SEQ ID NO: 2411677 - protein, 36 aa, Entamoeba dispar
AAPAATTTQTETKAEEKKEEKKEEEEEEDFGGFGDL

SEQ ID NO: 2411678 - protein, 32 aa, Entamoeba dispar
AAPATTEEKKEEEVKEEKKEEAETPAVTEEKK

SEQ ID NO: 2411679 - protein, 7 aa, Entamoeba dispar
AAPDNLK

SEQ ID NO: 2411680 - protein, 8 aa, Entamoeba dispar
AAPEASGI

SEQ ID NO: 2411681 - protein, 8 aa, Entamoeba dispar
AAPEGSNL

SEQ ID NO: 2411682 - protein, 4 aa, Entamoeba dispar
AAPG

SEQ ID NO: 2411683 - protein, 9 aa, Entamoeba dispar
AAPGNKTTH

SEQ ID NO: 2411684 - protein, 15 aa, Entamoeba dispar
AAPKKTRNQKDKMNQ

SEQ ID NO: 2411685 - protein, 25 aa, Entamoeba dispar
AAPPPLKKKRVTKPKSKTKSTKSKN

SEQ ID NO: 2411686 - protein, 23 aa, Entamoeba dispar
AAPPPLSNSTAISQSTSSNTSTL

SEQ ID NO: 2411687 - protein, 19 aa, Entamoeba dispar
AAPQDPKGFVSKRNLPEYF

SEQ ID NO: 2411688 - protein, 9 aa, Entamoeba dispar
AAPTDEQKE

SEQ ID NO: 2411689 - protein, 4 aa, Entamoeba dispar
AAQA

SEQ ID NO: 2411690 - protein, 8 aa, Entamoeba dispar
AAQDVAKR

SEQ ID NO: 2411691 - protein, 24 aa, Entamoeba dispar
AAQEEAEQMRNAPVRSAPTPSDLP

SEQ ID NO: 2411692 - protein, 6 aa, Entamoeba dispar
AAQGNF

SEQ ID NO: 2411693 - protein, 6 aa, Entamoeba dispar
AAQSVE

SEQ ID NO: 2411694 - protein, 7 aa, Entamoeba dispar
AAQTKST

SEQ ID NO: 2411695 - protein, 14 aa, Entamoeba dispar
AAQTLQGHKRKVGT

SEQ ID NO: 2411696 - protein, 19 aa, Entamoeba dispar
AARADSCRNDTGSIDGTCG

SEQ ID NO: 2411697 - protein, 8 aa, Entamoeba dispar
AARAHARK

SEQ ID NO: 2411698 - protein, 4 aa, Entamoeba dispar
AARD

SEQ ID NO: 2411699 - protein, 6 aa, Entamoeba dispar
AARDEY

SEQ ID NO: 2411700 - protein, 12 aa, Entamoeba dispar
AAREGEKERNNV

SEQ ID NO: 2411701 - protein, 6 aa, Entamoeba dispar
AARGLD

SEQ ID NO: 2411702 - protein, 10 aa, Entamoeba dispar
AARKKEPNTN

SEQ ID NO: 2411703 - protein, 9 aa, Entamoeba dispar
AARRKAGKK

SEQ ID NO: 2411704 - protein, 8 aa, Entamoeba dispar
AARSGGSV

SEQ ID NO: 2411705 - protein, 9 aa, Entamoeba dispar
AARTGSGKT

SEQ ID NO: 2411706 - protein, 8 aa, Entamoeba dispar
AASATGKV

SEQ ID NO: 2411707 - protein, 22 aa, Entamoeba dispar
AASEEKGKKVVKPKVNKQQPVK

SEQ ID NO: 2411708 - protein, 6 aa, Entamoeba dispar
AASGSF

SEQ ID NO: 2411709 - protein, 11 aa, Entamoeba dispar
AASGTGKYPSI

SEQ ID NO: 2411710 - protein, 8 aa, Entamoeba dispar
AASQAKAD

SEQ ID NO: 2411711 - protein, 13 aa, Entamoeba dispar
AASQENKKGSKKK

SEQ ID NO: 2411712 - protein, 5 aa, Entamoeba dispar
AASQG

SEQ ID NO: 2411713 - protein, 7 aa, Entamoeba dispar
AASQKQV

SEQ ID NO: 2411714 - protein, 8 aa, Entamoeba dispar
AASSDVTV

SEQ ID NO: 2411715 - protein, 33 aa, Entamoeba dispar
AASSSVKIKGKKEKDTKKKFTQEDVDKACEKAV

SEQ ID NO: 2411716 - protein, 8 aa, Entamoeba dispar
AASVNEDK

SEQ ID NO: 2411717 - protein, 14 aa, Entamoeba dispar
AATAKEAIASGRPV

SEQ ID NO: 2411718 - protein, 5 aa, Entamoeba dispar
AATEA

SEQ ID NO: 2411719 - protein, 13 aa, Entamoeba dispar
AATESYKKQIDDL

SEQ ID NO: 2411720 - protein, 5 aa, Entamoeba dispar
AATIT

SEQ ID NO: 2411721 - protein, 9 aa, Entamoeba dispar
AATKELEAP

SEQ ID NO: 2411722 - protein, 6 aa, Entamoeba dispar
AATKPD

SEQ ID NO: 2411723 - protein, 4 aa, Entamoeba dispar
AATL

SEQ ID NO: 2411724 - protein, 5 aa, Entamoeba dispar
AATLS

SEQ ID NO: 2411725 - protein, 10 aa, Entamoeba dispar
AATNTDSGKY

SEQ ID NO: 2411726 - protein, 41 aa, Entamoeba dispar
AATQGSVETVHNPDCSYTEAELNQSRDRAATVSLSRPTKPL

SEQ ID NO: 2411727 - protein, 10 aa, Entamoeba dispar
AATSKKEDFK

SEQ ID NO: 2411728 - protein, 7 aa, Entamoeba dispar
AATSTRN

SEQ ID NO: 2411729 - protein, 20 aa, Entamoeba dispar
AATTPNVVKEEQKPTGSTKF

SEQ ID NO: 2411730 - protein, 14 aa, Entamoeba dispar
AATVGKGDTEGDNQ

SEQ ID NO: 2411731 - protein, 12 aa, Entamoeba dispar
AATVSEENLEYG

SEQ ID NO: 2411732 - protein, 7 aa, Entamoeba dispar
AAVKSKK

SEQ ID NO: 2411733 - protein, 5 aa, Entamoeba dispar
AAVPV

SEQ ID NO: 2411734 - protein, 4 aa, Entamoeba dispar
AAVR

SEQ ID NO: 2411735 - protein, 5 aa, Entamoeba dispar
AAVTD

SEQ ID NO: 2411736 - protein, 6 aa, Entamoeba dispar
AAYGPI

SEQ ID NO: 2411737 - protein, 5 aa, Entamoeba dispar
AAYQQ

SEQ ID NO: 2411738 - protein, 13 aa, Entamoeba dispar
ACEKAKKLAPKDN

SEQ ID NO: 2411739 - protein, 4 aa, Entamoeba dispar
ACET

SEQ ID NO: 2411740 - protein, 10 aa, Entamoeba dispar
ACETSGSSQV

SEQ ID NO: 2411741 - protein, 8 aa, Entamoeba dispar
ACIEKTED

SEQ ID NO: 2411742 - protein, 11 aa, Entamoeba dispar
ACNDPPYSPDI

SEQ ID NO: 2411743 - protein, 4 aa, Entamoeba dispar
ACNE

SEQ ID NO: 2411744 - protein, 6 aa, Entamoeba dispar
ACNNRE

SEQ ID NO: 2411745 - protein, 10 aa, Entamoeba dispar
ACNSSEQANK

SEQ ID NO: 2411746 - protein, 6 aa, Entamoeba dispar
ACPSNS

SEQ ID NO: 2411747 - protein, 13 aa, Entamoeba dispar
ACQTKITSRETSI

SEQ ID NO: 2411748 - protein, 4 aa, Entamoeba dispar
ADAK

SEQ ID NO: 2411749 - protein, 15 aa, Entamoeba dispar
ADAKNVKKKKEKRMK

SEQ ID NO: 2411750 - protein, 18 aa, Entamoeba dispar
ADANGDGYITLEEFLAFS

SEQ ID NO: 2411751 - protein, 18 aa, Entamoeba dispar
ADANGDGYITLEEFLEFT

SEQ ID NO: 2411752 - protein, 21 aa, Entamoeba dispar
ADARNEKSPEKEEEAKKIKED

SEQ ID NO: 2411753 - protein, 6 aa, Entamoeba dispar
ADATIG

SEQ ID NO: 2411754 - protein, 6 aa, Entamoeba dispar
ADCRTT

SEQ ID NO: 2411755 - protein, 9 aa, Entamoeba dispar
ADDAGERSL

SEQ ID NO: 2411756 - protein, 7 aa, Entamoeba dispar
ADDGENV

SEQ ID NO: 2411757 - protein, 6 aa, Entamoeba dispar
ADDGGV

SEQ ID NO: 2411758 - protein, 7 aa, Entamoeba dispar
ADDGNCS

SEQ ID NO: 2411759 - protein, 8 aa, Entamoeba dispar
ADDGVDLR

SEQ ID NO: 2411760 - protein, 9 aa, Entamoeba dispar
ADDGYTDVG

SEQ ID NO: 2411761 - protein, 4 aa, Entamoeba dispar
ADDP

SEQ ID NO: 2411762 - protein, 7 aa, Entamoeba dispar
ADDVKPQ

SEQ ID NO: 2411763 - protein, 20 aa, Entamoeba dispar
ADEDAEEGAAGEAGEANAEK

SEQ ID NO: 2411764 - protein, 7 aa, Entamoeba dispar
ADEDEEQ

SEQ ID NO: 2411765 - protein, 17 aa, Entamoeba dispar
ADEEADLKAQAKQRVWD

SEQ ID NO: 2411766 - protein, 6 aa, Entamoeba dispar
ADEEEM

SEQ ID NO: 2411767 - protein, 9 aa, Entamoeba dispar
ADEGGQGTL

SEQ ID NO: 2411768 - protein, 16 aa, Entamoeba dispar
ADEGSAMGKKGAEGIS

SEQ ID NO: 2411769 - protein, 7 aa, Entamoeba dispar
ADENHVD

SEQ ID NO: 2411770 - protein, 8 aa, Entamoeba dispar
ADENQPNG

SEQ ID NO: 2411771 - protein, 9 aa, Entamoeba dispar
ADEQNRERL

SEQ ID NO: 2411772 - protein, 8 aa, Entamoeba dispar
ADESEELQ

SEQ ID NO: 2411773 - protein, 8 aa, Entamoeba dispar
ADETGNGN

SEQ ID NO: 2411774 - protein, 4 aa, Entamoeba dispar
ADEY

SEQ ID NO: 2411775 - protein, 17 aa, Entamoeba dispar
ADEYTPEELEELKKKFA

SEQ ID NO: 2411776 - protein, 6 aa, Entamoeba dispar
ADFEKK

SEQ ID NO: 2411777 - protein, 13 aa, Entamoeba dispar
ADFENRKNTEFTR

SEQ ID NO: 2411778 - protein, 4 aa, Entamoeba dispar
ADFH

SEQ ID NO: 2411779 - protein, 23 aa, Entamoeba dispar
ADFKGNVNYGEDEDGPYLHIIFQ

SEQ ID NO: 2411780 - protein, 5 aa, Entamoeba dispar
ADGFE

SEQ ID NO: 2411781 - protein, 9 aa, Entamoeba dispar
ADGIGTGWS

SEQ ID NO: 2411782 - protein, 12 aa, Entamoeba dispar
ADGKASPNSIQV

SEQ ID NO: 2411783 - protein, 8 aa, Entamoeba dispar
ADGRKENE

SEQ ID NO: 2411784 - protein, 7 aa, Entamoeba dispar
ADGRNLN

SEQ ID NO: 2411785 - protein, 8 aa, Entamoeba dispar
ADGRTSMG

SEQ ID NO: 2411786 - protein, 14 aa, Entamoeba dispar
ADGSIIKQRGMKVG

SEQ ID NO: 2411787 - protein, 9 aa, Entamoeba dispar
ADGSSPEKV

SEQ ID NO: 2411788 - protein, 9 aa, Entamoeba dispar
ADGSTPEKV

SEQ ID NO: 2411789 - protein, 5 aa, Entamoeba dispar
ADGTC

SEQ ID NO: 2411790 - protein, 7 aa, Entamoeba dispar
ADGTPPY

SEQ ID NO: 2411791 - protein, 17 aa, Entamoeba dispar
ADGTVQSNETENDNQME

SEQ ID NO: 2411792 - protein, 4 aa, Entamoeba dispar
ADIE

SEQ ID NO: 2411793 - protein, 8 aa, Entamoeba dispar
ADIGEEEM

SEQ ID NO: 2411794 - protein, 7 aa, Entamoeba dispar
ADIPETK

SEQ ID NO: 2411795 - protein, 8 aa, Entamoeba dispar
ADIQKGDL

SEQ ID NO: 2411796 - protein, 5 aa, Entamoeba dispar
ADIQN

SEQ ID NO: 2411797 - protein, 4 aa, Entamoeba dispar
ADIS

SEQ ID NO: 2411798 - protein, 7 aa, Entamoeba dispar
ADITETG

SEQ ID NO: 2411799 - protein, 35 aa, Entamoeba dispar
ADKDHKRKTRDDERRRTERDREWERERRKSGIKSI

SEQ ID NO: 2411800 - protein, 7 aa, Entamoeba dispar
ADKDNKQ

SEQ ID NO: 2411801 - protein, 19 aa, Entamoeba dispar
ADKEEEAKAPQKVEEIPEQ

SEQ ID NO: 2411802 - protein, 5 aa, Entamoeba dispar
ADKFN

SEQ ID NO: 2411803 - protein, 7 aa, Entamoeba dispar
ADKIATE

SEQ ID NO: 2411804 - protein, 10 aa, Entamoeba dispar
ADKKEKPKGH

SEQ ID NO: 2411805 - protein, 7 aa, Entamoeba dispar
ADKKELK

SEQ ID NO: 2411806 - protein, 8 aa, Entamoeba dispar
ADKKGNTA

SEQ ID NO: 2411807 - protein, 9 aa, Entamoeba dispar
ADKKQKDAA

SEQ ID NO: 2411808 - protein, 22 aa, Entamoeba dispar
ADKNHKQALGDALKAKGYEFVF

SEQ ID NO: 2411809 - protein, 7 aa, Entamoeba dispar
ADKNNRG

SEQ ID NO: 2411810 - protein, 8 aa, Entamoeba dispar
ADKQKYES

SEQ ID NO: 2411811 - protein, 5 aa, Entamoeba dispar
ADKRV

SEQ ID NO: 2411812 - protein, 10 aa, Entamoeba dispar
ADKSDELKQA

SEQ ID NO: 2411813 - protein, 10 aa, Entamoeba dispar
ADKSGNLDAN

SEQ ID NO: 2411814 - protein, 11 aa, Entamoeba dispar
ADKSKGGGVGK

SEQ ID NO: 2411815 - protein, 9 aa, Entamoeba dispar
ADKSQVTEV

SEQ ID NO: 2411816 - protein, 11 aa, Entamoeba dispar
ADKTIKNKEVR

SEQ ID NO: 2411817 - protein, 7 aa, Entamoeba dispar
ADKTKQI

SEQ ID NO: 2411818 - protein, 17 aa, Entamoeba dispar
ADLAQTREIEEATAKEF

SEQ ID NO: 2411819 - protein, 19 aa, Entamoeba dispar
ADLKQEREVNTSDGTEFAQ

SEQ ID NO: 2411820 - protein, 10 aa, Entamoeba dispar
ADLNGASKDL

SEQ ID NO: 2411821 - protein, 9 aa, Entamoeba dispar
ADLRNSAEH

SEQ ID NO: 2411822 - protein, 4 aa, Entamoeba dispar
ADLS

SEQ ID NO: 2411823 - protein, 4 aa, Entamoeba dispar
ADMD

SEQ ID NO: 2411824 - protein, 6 aa, Entamoeba dispar
ADMDPC

SEQ ID NO: 2411825 - protein, 44 aa, Entamoeba dispar
ADMKTKNMKPEDKVPLEPKKVTTNTSKPATAKATVQKPPKIEKN

SEQ ID NO: 2411826 - protein, 13 aa, Entamoeba dispar
ADMNSARQAMGQR

SEQ ID NO: 2411827 - protein, 10 aa, Entamoeba dispar
ADNADYSEAI

SEQ ID NO: 2411828 - protein, 7 aa, Entamoeba dispar
ADNCPSV

SEQ ID NO: 2411829 - protein, 4 aa, Entamoeba dispar
ADND

SEQ ID NO: 2411830 - protein, 17 aa, Entamoeba dispar
ADNDKIRKERDEYRNKI

SEQ ID NO: 2411831 - protein, 6 aa, Entamoeba dispar
ADNGKF

SEQ ID NO: 2411832 - protein, 14 aa, Entamoeba dispar
ADNTKILSSGRDKT

SEQ ID NO: 2411833 - protein, 58 aa, Entamoeba dispar
ADNTKSDSEESEEVFEPDEELEKELDAEDDLSTDLSSEEESSSSSEEEDDDGESWSDL

SEQ ID NO: 2411834 - protein, 7 aa, Entamoeba dispar
ADPAPGT

SEQ ID NO: 2411835 - protein, 8 aa, Entamoeba dispar
ADPDDVFA

SEQ ID NO: 2411836 - protein, 9 aa, Entamoeba dispar
ADPEDKRDG

SEQ ID NO: 2411837 - protein, 7 aa, Entamoeba dispar
ADPKAET

SEQ ID NO: 2411838 - protein, 6 aa, Entamoeba dispar
ADPLGE

SEQ ID NO: 2411839 - protein, 6 aa, Entamoeba dispar
ADPLTS

SEQ ID NO: 2411840 - protein, 7 aa, Entamoeba dispar
ADPRGQK

SEQ ID NO: 2411841 - protein, 24 aa, Entamoeba dispar
ADPSKVEEKCNGSEITTAITSNGK

SEQ ID NO: 2411842 - protein, 5 aa, Entamoeba dispar
ADPTD

SEQ ID NO: 2411843 - protein, 6 aa, Entamoeba dispar
ADPTIP

SEQ ID NO: 2411844 - protein, 6 aa, Entamoeba dispar
ADQERF

SEQ ID NO: 2411845 - protein, 8 aa, Entamoeba dispar
ADQKVKEQ

SEQ ID NO: 2411846 - protein, 8 aa, Entamoeba dispar
ADQQEREI

SEQ ID NO: 2411847 - protein, 7 aa, Entamoeba dispar
ADQQGTW

SEQ ID NO: 2411848 - protein, 11 aa, Entamoeba dispar
ADRALKNERMN

SEQ ID NO: 2411849 - protein, 16 aa, Entamoeba dispar
ADRDAVSQKQNDTNNI

SEQ ID NO: 2411850 - protein, 7 aa, Entamoeba dispar
ADRESSI

SEQ ID NO: 2411851 - protein, 7 aa, Entamoeba dispar
ADREVAE

SEQ ID NO: 2411852 - protein, 7 aa, Entamoeba dispar
ADRGDFD

SEQ ID NO: 2411853 - protein, 5 aa, Entamoeba dispar
ADRRN

SEQ ID NO: 2411854 - protein, 10 aa, Entamoeba dispar
ADRRRRPRRR

SEQ ID NO: 2411855 - protein, 8 aa, Entamoeba dispar
ADRVDTTK

SEQ ID NO: 2411856 - protein, 8 aa, Entamoeba dispar
ADSEDDRE

SEQ ID NO: 2411857 - protein, 9 aa, Entamoeba dispar
ADSFPKDKH

SEQ ID NO: 2411858 - protein, 10 aa, Entamoeba dispar
ADSGKNGSLN

SEQ ID NO: 2411859 - protein, 8 aa, Entamoeba dispar
ADSINGLA

SEQ ID NO: 2411860 - protein, 8 aa, Entamoeba dispar
ADSLKPGT

SEQ ID NO: 2411861 - protein, 7 aa, Entamoeba dispar
ADSMTTA

SEQ ID NO: 2411862 - protein, 9 aa, Entamoeba dispar
ADSNQISSL

SEQ ID NO: 2411863 - protein, 8 aa, Entamoeba dispar
ADSQRKSH

SEQ ID NO: 2411864 - protein, 10 aa, Entamoeba dispar
ADSSGGQHPQ

SEQ ID NO: 2411865 - protein, 5 aa, Entamoeba dispar
ADTCR

SEQ ID NO: 2411866 - protein, 11 aa, Entamoeba dispar
ADTELGNKPWK

SEQ ID NO: 2411867 - protein, 7 aa, Entamoeba dispar
ADTERAV

SEQ ID NO: 2411868 - protein, 4 aa, Entamoeba dispar
ADTI

SEQ ID NO: 2411869 - protein, 6 aa, Entamoeba dispar
ADTNKL

SEQ ID NO: 2411870 - protein, 8 aa, Entamoeba dispar
ADTNQDTN

SEQ ID NO: 2411871 - protein, 19 aa, Entamoeba dispar
ADTNSTQSSQLKKKKDFNF

SEQ ID NO: 2411872 - protein, 7 aa, Entamoeba dispar
ADTPDMG

SEQ ID NO: 2411873 - protein, 7 aa, Entamoeba dispar
ADTRGDP

SEQ ID NO: 2411874 - protein, 8 aa, Entamoeba dispar
ADTSKEGF

SEQ ID NO: 2411875 - protein, 9 aa, Entamoeba dispar
ADTSNRATP

SEQ ID NO: 2411876 - protein, 9 aa, Entamoeba dispar
ADTSTEAMN

SEQ ID NO: 2411877 - protein, 14 aa, Entamoeba dispar
ADVEEGKDESSGVN

SEQ ID NO: 2411878 - protein, 8 aa, Entamoeba dispar
ADVETDSQ

SEQ ID NO: 2411879 - protein, 4 aa, Entamoeba dispar
ADVN

SEQ ID NO: 2411880 - protein, 5 aa, Entamoeba dispar
ADVNV

SEQ ID NO: 2411881 - protein, 10 aa, Entamoeba dispar
ADVRAKAEAL

SEQ ID NO: 2411882 - protein, 23 aa, Entamoeba dispar
ADVSKLSGTMGSSIARSTFSGMS

SEQ ID NO: 2411883 - protein, 5 aa, Entamoeba dispar
ADVSV

SEQ ID NO: 2411884 - protein, 10 aa, Entamoeba dispar
ADWDAEKKKS

SEQ ID NO: 2411885 - protein, 6 aa, Entamoeba dispar
ADYDKK

SEQ ID NO: 2411886 - protein, 7 aa, Entamoeba dispar
ADYTNAY

SEQ ID NO: 2411887 - protein, 14 aa, Entamoeba dispar
AEAAMKGSKNLDRP

SEQ ID NO: 2411888 - protein, 6 aa, Entamoeba dispar
AEAASL

SEQ ID NO: 2411889 - protein, 13 aa, Entamoeba dispar
AEADRQKRESEHL

SEQ ID NO: 2411890 - protein, 8 aa, Entamoeba dispar
AEAEKNAP

SEQ ID NO: 2411891 - protein, 13 aa, Entamoeba dispar
AEAEQSQRGDDSQ

SEQ ID NO: 2411892 - protein, 9 aa, Entamoeba dispar
AEAGEEGKK

SEQ ID NO: 2411893 - protein, 5 aa, Entamoeba dispar
AEAHP

SEQ ID NO: 2411894 - protein, 9 aa, Entamoeba dispar
AEAKESNEI

SEQ ID NO: 2411895 - protein, 9 aa, Entamoeba dispar
AEAKNKGRI

SEQ ID NO: 2411896 - protein, 4 aa, Entamoeba dispar
AEAL

SEQ ID NO: 2411897 - protein, 7 aa, Entamoeba dispar
AEALTQA

SEQ ID NO: 2411898 - protein, 4 aa, Entamoeba dispar
AEAN

SEQ ID NO: 2411899 - protein, 6 aa, Entamoeba dispar
AEANGA

SEQ ID NO: 2411900 - protein, 10 aa, Entamoeba dispar
AEANKKLPFA

SEQ ID NO: 2411901 - protein, 13 aa, Entamoeba dispar
AECAEKVSRSFTD

SEQ ID NO: 2411902 - protein, 10 aa, Entamoeba dispar
AECDGSNSVI

SEQ ID NO: 2411903 - protein, 5 aa, Entamoeba dispar
AECNA

SEQ ID NO: 2411904 - protein, 4 aa, Entamoeba dispar
AECT

SEQ ID NO: 2411905 - protein, 14 aa, Entamoeba dispar
AEDESNQTSELSTL

SEQ ID NO: 2411906 - protein, 5 aa, Entamoeba dispar
AEDGQ

SEQ ID NO: 2411907 - protein, 11 aa, Entamoeba dispar
AEDKLKDKEKW

SEQ ID NO: 2411908 - protein, 6 aa, Entamoeba dispar
AEDKPV

SEQ ID NO: 2411909 - protein, 25 aa, Entamoeba dispar
AEDKTTGKKNKITITNDKGRLSKEQ

SEQ ID NO: 2411910 - protein, 9 aa, Entamoeba dispar
AEDKTTNDI

SEQ ID NO: 2411911 - protein, 34 aa, Entamoeba dispar
AEDKTTRKKNKITITNDKGRLNDENKARIETKNQ

SEQ ID NO: 2411912 - protein, 16 aa, Entamoeba dispar
AEDNGCPRGKEQNYIE

SEQ ID NO: 2411913 - protein, 9 aa, Entamoeba dispar
AEDTKWTGK

SEQ ID NO: 2411914 - protein, 5 aa, Entamoeba dispar
AEDTR

SEQ ID NO: 2411915 - protein, 6 aa, Entamoeba dispar
AEEALQ

SEQ ID NO: 2411916 - protein, 7 aa, Entamoeba dispar
AEEALQD

SEQ ID NO: 2411917 - protein, 5 aa, Entamoeba dispar
AEEDM

SEQ ID NO: 2411918 - protein, 4 aa, Entamoeba dispar
AEEE

SEQ ID NO: 2411919 - protein, 13 aa, Entamoeba dispar
AEEENAEKTKPVD

SEQ ID NO: 2411920 - protein, 7 aa, Entamoeba dispar
AEEEQVR

SEQ ID NO: 2411921 - protein, 20 aa, Entamoeba dispar
AEEERKSKSSVSTSGSSLNS

SEQ ID NO: 2411922 - protein, 6 aa, Entamoeba dispar
AEEFKN

SEQ ID NO: 2411923 - protein, 7 aa, Entamoeba dispar
AEEGLPE

SEQ ID NO: 2411924 - protein, 5 aa, Entamoeba dispar
AEEGN

SEQ ID NO: 2411925 - protein, 6 aa, Entamoeba dispar
AEEGPT

SEQ ID NO: 2411926 - protein, 7 aa, Entamoeba dispar
AEEHKDD

SEQ ID NO: 2411927 - protein, 7 aa, Entamoeba dispar
AEEHKRA

SEQ ID NO: 2411928 - protein, 5 aa, Entamoeba dispar
AEEHP

SEQ ID NO: 2411929 - protein, 8 aa, Entamoeba dispar
AEEKKEEN

SEQ ID NO: 2411930 - protein, 7 aa, Entamoeba dispar
AEEKTPD

SEQ ID NO: 2411931 - protein, 16 aa, Entamoeba dispar
AEELKKNKTIPRNCFN

SEQ ID NO: 2411932 - protein, 7 aa, Entamoeba dispar
AEEMEKE

SEQ ID NO: 2411933 - protein, 9 aa, Entamoeba dispar
AEEPTGEIQ

SEQ ID NO: 2411934 - protein, 6 aa, Entamoeba dispar
AEEQSV

SEQ ID NO: 2411935 - protein, 14 aa, Entamoeba dispar
AEERDCDKVNEIYE

SEQ ID NO: 2411936 - protein, 7 aa, Entamoeba dispar
AEERMKE

SEQ ID NO: 2411937 - protein, 10 aa, Entamoeba dispar
AEERNRNTAE

SEQ ID NO: 2411938 - protein, 8 aa, Entamoeba dispar
AEESQEDI

SEQ ID NO: 2411939 - protein, 8 aa, Entamoeba dispar
AEETTGDK

SEQ ID NO: 2411940 - protein, 5 aa, Entamoeba dispar
AEFDV

SEQ ID NO: 2411941 - protein, 5 aa, Entamoeba dispar
AEFEQ

SEQ ID NO: 2411942 - protein, 4 aa, Entamoeba dispar
AEGC

SEQ ID NO: 2411943 - protein, 8 aa, Entamoeba dispar
AEGDTAYD

SEQ ID NO: 2411944 - protein, 8 aa, Entamoeba dispar
AEGEFDEP

SEQ ID NO: 2411945 - protein, 6 aa, Entamoeba dispar
AEGGYI

SEQ ID NO: 2411946 - protein, 5 aa, Entamoeba dispar
AEGHI

SEQ ID NO: 2411947 - protein, 6 aa, Entamoeba dispar
AEGIES

SEQ ID NO: 2411948 - protein, 10 aa, Entamoeba dispar
AEGIHSDREI

SEQ ID NO: 2411949 - protein, 9 aa, Entamoeba dispar
AEGKAQYEN

SEQ ID NO: 2411950 - protein, 21 aa, Entamoeba dispar
AEGKKLNKYAYGGKAFNQKST

SEQ ID NO: 2411951 - protein, 10 aa, Entamoeba dispar
AEGLSAAGSS

SEQ ID NO: 2411952 - protein, 4 aa, Entamoeba dispar
AEGN

SEQ ID NO: 2411953 - protein, 6 aa, Entamoeba dispar
AEGPLK

SEQ ID NO: 2411954 - protein, 6 aa, Entamoeba dispar
AEGTGN

SEQ ID NO: 2411955 - protein, 16 aa, Entamoeba dispar
AEGTSLTKEQFVKYLT

SEQ ID NO: 2411956 - protein, 11 aa, Entamoeba dispar
AEGVKPDSYSV

SEQ ID NO: 2411957 - protein, 6 aa, Entamoeba dispar
AEGVKS

SEQ ID NO: 2411958 - protein, 11 aa, Entamoeba dispar
AEIDPRTIQQE

SEQ ID NO: 2411959 - protein, 10 aa, Entamoeba dispar
AEIEEAERTR

SEQ ID NO: 2411960 - protein, 20 aa, Entamoeba dispar
AEIEEKEKELAEAKQGEDPM

SEQ ID NO: 2411961 - protein, 6 aa, Entamoeba dispar
AEIGSE

SEQ ID NO: 2411962 - protein, 12 aa, Entamoeba dispar
AEIKEQQQKELT

SEQ ID NO: 2411963 - protein, 29 aa, Entamoeba dispar
AEINQEIKGDNKNEMKSEEEKEEKKEDEI

SEQ ID NO: 2411964 - protein, 25 aa, Entamoeba dispar
AEIRETKKIEKKKVDEEQPSLPQQQ

SEQ ID NO: 2411965 - protein, 12 aa, Entamoeba dispar
AEISKTNVKNVP

SEQ ID NO: 2411966 - protein, 17 aa, Entamoeba dispar
AEKDKFINSKPTFKENP

SEQ ID NO: 2411967 - protein, 8 aa, Entamoeba dispar
AEKEGVTA

SEQ ID NO: 2411968 - protein, 12 aa, Entamoeba dispar
AEKEKEKGNEYY

SEQ ID NO: 2411969 - protein, 7 aa, Entamoeba dispar
AEKENTC

SEQ ID NO: 2411970 - protein, 9 aa, Entamoeba dispar
AEKERYSKL

SEQ ID NO: 2411971 - protein, 10 aa, Entamoeba dispar
AEKESSGQLI

SEQ ID NO: 2411972 - protein, 23 aa, Entamoeba dispar
AEKGEIQFSSDERKQQVEDKKKR

SEQ ID NO: 2411973 - protein, 5 aa, Entamoeba dispar
AEKGI

SEQ ID NO: 2411974 - protein, 5 aa, Entamoeba dispar
AEKGW

SEQ ID NO: 2411975 - protein, 8 aa, Entamoeba dispar
AEKKEDGV

SEQ ID NO: 2411976 - protein, 11 aa, Entamoeba dispar
AEKKQNQIDDI

SEQ ID NO: 2411977 - protein, 19 aa, Entamoeba dispar
AEKKQNQIDDTQKELKNRI

SEQ ID NO: 2411978 - protein, 16 aa, Entamoeba dispar
AEKKRGVITASSGNHG

SEQ ID NO: 2411979 - protein, 10 aa, Entamoeba dispar
AEKKVEEQAK

SEQ ID NO: 2411980 - protein, 6 aa, Entamoeba dispar
AEKNEY

SEQ ID NO: 2411981 - protein, 17 aa, Entamoeba dispar
AEKPEQKENETKRKEQE

SEQ ID NO: 2411982 - protein, 10 aa, Entamoeba dispar
AEKQANDLLN

SEQ ID NO: 2411983 - protein, 8 aa, Entamoeba dispar
AEKRKEDM

SEQ ID NO: 2411984 - protein, 12 aa, Entamoeba dispar
AEKSAEQYKKAV

SEQ ID NO: 2411985 - protein, 6 aa, Entamoeba dispar
AEKSDF

SEQ ID NO: 2411986 - protein, 6 aa, Entamoeba dispar
AEKSGS

SEQ ID NO: 2411987 - protein, 24 aa, Entamoeba dispar
AEKSSYQVDEDRLEDLRKQRDKIA

SEQ ID NO: 2411988 - protein, 7 aa, Entamoeba dispar
AEKTGGK

SEQ ID NO: 2411989 - protein, 11 aa, Entamoeba dispar
AEKVEKVTTPL

SEQ ID NO: 2411990 - protein, 23 aa, Entamoeba dispar
AELEKKKKKQIKKMKKEIKLQTG

SEQ ID NO: 2411991 - protein, 14 aa, Entamoeba dispar
AELGSEEAKEILSK

SEQ ID NO: 2411992 - protein, 5 aa, Entamoeba dispar
AELGT

SEQ ID NO: 2411993 - protein, 4 aa, Entamoeba dispar
AELI

SEQ ID NO: 2411994 - protein, 5 aa, Entamoeba dispar
AELKE

SEQ ID NO: 2411995 - protein, 10 aa, Entamoeba dispar
AEMKKKAKDV

SEQ ID NO: 2411996 - protein, 10 aa, Entamoeba dispar
AEMKRKPREI

SEQ ID NO: 2411997 - protein, 7 aa, Entamoeba dispar
AENACNN

SEQ ID NO: 2411998 - protein, 9 aa, Entamoeba dispar
AENANVDAD

SEQ ID NO: 2411999 - protein, 6 aa, Entamoeba dispar
AENEEI

SEQ ID NO: 2412000 - protein, 9 aa, Entamoeba dispar
AENEKEDMV

SEQ ID NO: 2412001 - protein, 15 aa, Entamoeba dispar
AENEKLRKAGAGARL

SEQ ID NO: 2412002 - protein, 6 aa, Entamoeba dispar
AENEKM

SEQ ID NO: 2412003 - protein, 8 aa, Entamoeba dispar
AENENTRI

SEQ ID NO: 2412004 - protein, 10 aa, Entamoeba dispar
AENEQNCGFD

SEQ ID NO: 2412005 - protein, 11 aa, Entamoeba dispar
AENERKGKNPR

SEQ ID NO: 2412006 - protein, 5 aa, Entamoeba dispar
AENNK

SEQ ID NO: 2412007 - protein, 6 aa, Entamoeba dispar
AENNKD

SEQ ID NO: 2412008 - protein, 5 aa, Entamoeba dispar
AENNL

SEQ ID NO: 2412009 - protein, 9 aa, Entamoeba dispar
AENPEREKQ

SEQ ID NO: 2412010 - protein, 30 aa, Entamoeba dispar
AENPPEERKRSKKDSGEEAIASSKKRKLEE

SEQ ID NO: 2412011 - protein, 7 aa, Entamoeba dispar
AENSGLN

SEQ ID NO: 2412012 - protein, 9 aa, Entamoeba dispar
AENSNTRRH

SEQ ID NO: 2412013 - protein, 11 aa, Entamoeba dispar
AENTQDGIDKA

SEQ ID NO: 2412014 - protein, 6 aa, Entamoeba dispar
AENWDN

SEQ ID NO: 2412015 - protein, 16 aa, Entamoeba dispar
AENYNKKELSKLTSQQ

SEQ ID NO: 2412016 - protein, 6 aa, Entamoeba dispar
AEPDHL

SEQ ID NO: 2412017 - protein, 11 aa, Entamoeba dispar
AEPIDGQHKLN

SEQ ID NO: 2412018 - protein, 10 aa, Entamoeba dispar
AEPKAVPGVP

SEQ ID NO: 2412019 - protein, 23 aa, Entamoeba dispar
AEPSHSTHEISPTTVKEEKESHI

SEQ ID NO: 2412020 - protein, 17 aa, Entamoeba dispar
AEPSPRRKNLQKRLNRS

SEQ ID NO: 2412021 - protein, 5 aa, Entamoeba dispar
AEPTI

SEQ ID NO: 2412022 - protein, 7 aa, Entamoeba dispar
AEPTPSK

SEQ ID NO: 2412023 - protein, 7 aa, Entamoeba dispar
AEPYKGD

SEQ ID NO: 2412024 - protein, 18 aa, Entamoeba dispar
AEQEAAKTGQKKRPTTAG

SEQ ID NO: 2412025 - protein, 24 aa, Entamoeba dispar
AEQEAKEKEEKEKKRLKEINEQKE

SEQ ID NO: 2412026 - protein, 20 aa, Entamoeba dispar
AEQERKQERIEREKQSVNEM

SEQ ID NO: 2412027 - protein, 8 aa, Entamoeba dispar
AEQERTKR

SEQ ID NO: 2412028 - protein, 5 aa, Entamoeba dispar
AEQET

SEQ ID NO: 2412029 - protein, 18 aa, Entamoeba dispar
AEQFKNQNKSTTEGEEGV

SEQ ID NO: 2412030 - protein, 4 aa, Entamoeba dispar
AEQG

SEQ ID NO: 2412031 - protein, 5 aa, Entamoeba dispar
AEQGN

SEQ ID NO: 2412032 - protein, 17 aa, Entamoeba dispar
AEQISEEEFSDDTVDSL

SEQ ID NO: 2412033 - protein, 15 aa, Entamoeba dispar
AEQKKEQKKKIEERI

SEQ ID NO: 2412034 - protein, 19 aa, Entamoeba dispar
AEQKYSDGILTSAKSGLAV

SEQ ID NO: 2412035 - protein, 13 aa, Entamoeba dispar
AEQNTNKNVAQTT

SEQ ID NO: 2412036 - protein, 8 aa, Entamoeba dispar
AEQPRQIN

SEQ ID NO: 2412037 - protein, 11 aa, Entamoeba dispar
AEQRHTLPSGQ

SEQ ID NO: 2412038 - protein, 8 aa, Entamoeba dispar
AEQSERYD

SEQ ID NO: 2412039 - protein, 8 aa, Entamoeba dispar
AEQSERYE

SEQ ID NO: 2412040 - protein, 4 aa, Entamoeba dispar
AERE

SEQ ID NO: 2412041 - protein, 4 aa, Entamoeba dispar
AERG

SEQ ID NO: 2412042 - protein, 13 aa, Entamoeba dispar
AERGISEEQKKLE

SEQ ID NO: 2412043 - protein, 8 aa, Entamoeba dispar
AERGSVKR

SEQ ID NO: 2412044 - protein, 7 aa, Entamoeba dispar
AERISDK

SEQ ID NO: 2412045 - protein, 11 aa, Entamoeba dispar
AERKGIETELR

SEQ ID NO: 2412046 - protein, 5 aa, Entamoeba dispar
AERNG

SEQ ID NO: 2412047 - protein, 6 aa, Entamoeba dispar
AERPEE

SEQ ID NO: 2412048 - protein, 20 aa, Entamoeba dispar
AERRQKKAAMGMEERQNWEQ

SEQ ID NO: 2412049 - protein, 9 aa, Entamoeba dispar
AERRRPQKI

SEQ ID NO: 2412050 - protein, 10 aa, Entamoeba dispar
AERSAQNSLT

SEQ ID NO: 2412051 - protein, 27 aa, Entamoeba dispar
AERSQHNKEKLTEEKKNNEVEEKQKEM

SEQ ID NO: 2412052 - protein, 18 aa, Entamoeba dispar
AERTALKSKTFAANSKRV

SEQ ID NO: 2412053 - protein, 6 aa, Entamoeba dispar
AERYPS

SEQ ID NO: 2412054 - protein, 9 aa, Entamoeba dispar
AESDGSYED

SEQ ID NO: 2412055 - protein, 10 aa, Entamoeba dispar
AESDKGGDNK

SEQ ID NO: 2412056 - protein, 11 aa, Entamoeba dispar
AESEIKNGEHS

SEQ ID NO: 2412057 - protein, 8 aa, Entamoeba dispar
AESERAQR

SEQ ID NO: 2412058 - protein, 8 aa, Entamoeba dispar
AESIDSSE

SEQ ID NO: 2412059 - protein, 5 aa, Entamoeba dispar
AESIQ

SEQ ID NO: 2412060 - protein, 9 aa, Entamoeba dispar
AESKHKTIS

SEQ ID NO: 2412061 - protein, 20 aa, Entamoeba dispar
AESLEKAKEIAEKVMNILLS

SEQ ID NO: 2412062 - protein, 9 aa, Entamoeba dispar
AESLEQAEK

SEQ ID NO: 2412063 - protein, 7 aa, Entamoeba dispar
AESQEQM

SEQ ID NO: 2412064 - protein, 6 aa, Entamoeba dispar
AESQYE

SEQ ID NO: 2412065 - protein, 34 aa, Entamoeba dispar
AESSAGSGHAAGPDADPSRGQHGRRRSRHAAGAL

SEQ ID NO: 2412066 - protein, 5 aa, Entamoeba dispar
AESTS

SEQ ID NO: 2412067 - protein, 26 aa, Entamoeba dispar
AESVGDDDDSGSLSDDESSEEQENDS

SEQ ID NO: 2412068 - protein, 6 aa, Entamoeba dispar
AESYYE

SEQ ID NO: 2412069 - protein, 6 aa, Entamoeba dispar
AETAAD

SEQ ID NO: 2412070 - protein, 4 aa, Entamoeba dispar
AETF

SEQ ID NO: 2412071 - protein, 6 aa, Entamoeba dispar
AETFNE

SEQ ID NO: 2412072 - protein, 11 aa, Entamoeba dispar
AETGKKAIDSK

SEQ ID NO: 2412073 - protein, 8 aa, Entamoeba dispar
AETGKSNF

SEQ ID NO: 2412074 - protein, 8 aa, Entamoeba dispar
AETGTGKT

SEQ ID NO: 2412075 - protein, 14 aa, Entamoeba dispar
AETLKNEAEAVEEN

SEQ ID NO: 2412076 - protein, 7 aa, Entamoeba dispar
AETMDQS

SEQ ID NO: 2412077 - protein, 9 aa, Entamoeba dispar
AETNQSERV

SEQ ID NO: 2412078 - protein, 9 aa, Entamoeba dispar
AETPEGESC

SEQ ID NO: 2412079 - protein, 5 aa, Entamoeba dispar
AETPF

SEQ ID NO: 2412080 - protein, 11 aa, Entamoeba dispar
AETPMPSKETV

SEQ ID NO: 2412081 - protein, 7 aa, Entamoeba dispar
AETQGIS

SEQ ID NO: 2412082 - protein, 5 aa, Entamoeba dispar
AETSL

SEQ ID NO: 2412083 - protein, 6 aa, Entamoeba dispar
AETSLT

SEQ ID NO: 2412084 - protein, 5 aa, Entamoeba dispar
AETSV

SEQ ID NO: 2412085 - protein, 7 aa, Entamoeba dispar
AETTASF

SEQ ID NO: 2412086 - protein, 9 aa, Entamoeba dispar
AETVSSPKM

SEQ ID NO: 2412087 - protein, 13 aa, Entamoeba dispar
AETYVDKTNGFQS

SEQ ID NO: 2412088 - protein, 25 aa, Entamoeba dispar
AEVGTNNLRSKSSRTLKENEEADKM

SEQ ID NO: 2412089 - protein, 13 aa, Entamoeba dispar
AEVSDNTKEQYED

SEQ ID NO: 2412090 - protein, 20 aa, Entamoeba dispar
AEVSNAETLNVKTESPQAHD

SEQ ID NO: 2412091 - protein, 6 aa, Entamoeba dispar
AEVSQV

SEQ ID NO: 2412092 - protein, 6 aa, Entamoeba dispar
AEVSRP

SEQ ID NO: 2412093 - protein, 9 aa, Entamoeba dispar
AEVSSESYD

SEQ ID NO: 2412094 - protein, 16 aa, Entamoeba dispar
AEYDEKGVGAMLKKPG

SEQ ID NO: 2412095 - protein, 5 aa, Entamoeba dispar
AEYEK

SEQ ID NO: 2412096 - protein, 5 aa, Entamoeba dispar
AEYLG

SEQ ID NO: 2412097 - protein, 9 aa, Entamoeba dispar
AEYNNHPVR

SEQ ID NO: 2412098 - protein, 20 aa, Entamoeba dispar
AEYVKTSTGFGTHGATPEDV

SEQ ID NO: 2412099 - protein, 5 aa, Entamoeba dispar
AFDDS

SEQ ID NO: 2412100 - protein, 4 aa, Entamoeba dispar
AFDG

SEQ ID NO: 2412101 - protein, 5 aa, Entamoeba dispar
AFDGN

SEQ ID NO: 2412102 - protein, 7 aa, Entamoeba dispar
AFDKGEY

SEQ ID NO: 2412103 - protein, 6 aa, Entamoeba dispar
AFDTGD

SEQ ID NO: 2412104 - protein, 11 aa, Entamoeba dispar
AFEDGNSDIKS

SEQ ID NO: 2412105 - protein, 10 aa, Entamoeba dispar
AFEEEKKEGS

SEQ ID NO: 2412106 - protein, 24 aa, Entamoeba dispar
AFEKENKEIERKEKEKKINKKREQ

SEQ ID NO: 2412107 - protein, 6 aa, Entamoeba dispar
AFENNN

SEQ ID NO: 2412108 - protein, 14 aa, Entamoeba dispar
AFEQSDEDGEKGNV

SEQ ID NO: 2412109 - protein, 6 aa, Entamoeba dispar
AFETKE

SEQ ID NO: 2412110 - protein, 7 aa, Entamoeba dispar
AFGGEGK

SEQ ID NO: 2412111 - protein, 32 aa, Entamoeba dispar
AFGKTVEEDFAKKQYEAKKASIVEKQKQVDES

SEQ ID NO: 2412112 - protein, 13 aa, Entamoeba dispar
AFGTCDSSTCRPQ

SEQ ID NO: 2412113 - protein, 4 aa, Entamoeba dispar
AFKD

SEQ ID NO: 2412114 - protein, 7 aa, Entamoeba dispar
AFKEESK

SEQ ID NO: 2412115 - protein, 6 aa, Entamoeba dispar
AFKKQN

SEQ ID NO: 2412116 - protein, 12 aa, Entamoeba dispar
AFKKTQNKTPMK

SEQ ID NO: 2412117 - protein, 17 aa, Entamoeba dispar
AFKNREIAQSSLRQKKR

SEQ ID NO: 2412118 - protein, 4 aa, Entamoeba dispar
AFKR

SEQ ID NO: 2412119 - protein, 8 aa, Entamoeba dispar
AFKSKESV

SEQ ID NO: 2412120 - protein, 6 aa, Entamoeba dispar
AFNEDE

SEQ ID NO: 2412121 - protein, 6 aa, Entamoeba dispar
AFNGSD

SEQ ID NO: 2412122 - protein, 6 aa, Entamoeba dispar
AFNKNT

SEQ ID NO: 2412123 - protein, 9 aa, Entamoeba dispar
AFNPGNGEF

SEQ ID NO: 2412124 - protein, 33 aa, Entamoeba dispar
AFNSAQEKAATAKKAADESKVKASQAKKVADEC

SEQ ID NO: 2412125 - protein, 12 aa, Entamoeba dispar
AFPDDGVETPTF

SEQ ID NO: 2412126 - protein, 4 aa, Entamoeba dispar
AFPG

SEQ ID NO: 2412127 - protein, 15 aa, Entamoeba dispar
AFPNSNTCTKERATK

SEQ ID NO: 2412128 - protein, 7 aa, Entamoeba dispar
AFPNSPQ

SEQ ID NO: 2412129 - protein, 8 aa, Entamoeba dispar
AFPNTTEA

SEQ ID NO: 2412130 - protein, 10 aa, Entamoeba dispar
AFPPSKKKSF

SEQ ID NO: 2412131 - protein, 6 aa, Entamoeba dispar
AFPTNY

SEQ ID NO: 2412132 - protein, 27 aa, Entamoeba dispar
AFQVSNSPTPETKESHEVYGEGDRNDI

SEQ ID NO: 2412133 - protein, 5 aa, Entamoeba dispar
AFSES

SEQ ID NO: 2412134 - protein, 28 aa, Entamoeba dispar
AFSKPSDNLLDPAQNNVQQPVRQENTHQ

SEQ ID NO: 2412135 - protein, 5 aa, Entamoeba dispar
AFSNE

SEQ ID NO: 2412136 - protein, 10 aa, Entamoeba dispar
AFSNGTVKEH

SEQ ID NO: 2412137 - protein, 6 aa, Entamoeba dispar
AFSNYS

SEQ ID NO: 2412138 - protein, 11 aa, Entamoeba dispar
AFSSNQKKRLK

SEQ ID NO: 2412139 - protein, 8 aa, Entamoeba dispar
AFTADSDE

SEQ ID NO: 2412140 - protein, 7 aa, Entamoeba dispar
AFTGERK

SEQ ID NO: 2412141 - protein, 35 aa, Entamoeba dispar
AFTKKSKSLTKPKKVEKNPTISSRPTSESSSVVSD

SEQ ID NO: 2412142 - protein, 5 aa, Entamoeba dispar
AFTQH

SEQ ID NO: 2412143 - protein, 9 aa, Entamoeba dispar
AGADKGNLR

SEQ ID NO: 2412144 - protein, 10 aa, Entamoeba dispar
AGADKTTMDD

SEQ ID NO: 2412145 - protein, 6 aa, Entamoeba dispar
AGADPK

SEQ ID NO: 2412146 - protein, 6 aa, Entamoeba dispar
AGAFDE

SEQ ID NO: 2412147 - protein, 7 aa, Entamoeba dispar
AGAINSK

SEQ ID NO: 2412148 - protein, 15 aa, Entamoeba dispar
AGATGEGATGEGAMD

SEQ ID NO: 2412149 - protein, 27 aa, Entamoeba dispar
AGAVSGGALSSTIPHRRRRSTAPSKAI

SEQ ID NO: 2412150 - protein, 14 aa, Entamoeba dispar
AGAYGIQDNAGPTF

SEQ ID NO: 2412151 - protein, 6 aa, Entamoeba dispar
AGDASV

SEQ ID NO: 2412152 - protein, 17 aa, Entamoeba dispar
AGDFDGSDASARPDEAV

SEQ ID NO: 2412153 - protein, 9 aa, Entamoeba dispar
AGDIAEDRF

SEQ ID NO: 2412154 - protein, 12 aa, Entamoeba dispar
AGDNGIDPSPTE

SEQ ID NO: 2412155 - protein, 8 aa, Entamoeba dispar
AGDPAAPG

SEQ ID NO: 2412156 - protein, 8 aa, Entamoeba dispar
AGDQPNNA

SEQ ID NO: 2412157 - protein, 9 aa, Entamoeba dispar
AGDRAETRD

SEQ ID NO: 2412158 - protein, 9 aa, Entamoeba dispar
AGDSAKTRD

SEQ ID NO: 2412159 - protein, 5 aa, Entamoeba dispar
AGDYG

SEQ ID NO: 2412160 - protein, 6 aa, Entamoeba dispar
AGDYGG

SEQ ID NO: 2412161 - protein, 7 aa, Entamoeba dispar
AGEANGA

SEQ ID NO: 2412162 - protein, 5 aa, Entamoeba dispar
AGEEE

SEQ ID NO: 2412163 - protein, 5 aa, Entamoeba dispar
AGEGF

SEQ ID NO: 2412164 - protein, 9 aa, Entamoeba dispar
AGEKETQIQ

SEQ ID NO: 2412165 - protein, 13 aa, Entamoeba dispar
AGEMKKEDQMEEE

SEQ ID NO: 2412166 - protein, 13 aa, Entamoeba dispar
AGERRNPLNDEDI

SEQ ID NO: 2412167 - protein, 9 aa, Entamoeba dispar
AGESEGNLR

SEQ ID NO: 2412168 - protein, 9 aa, Entamoeba dispar
AGESESNLR

SEQ ID NO: 2412169 - protein, 8 aa, Entamoeba dispar
AGESQARN

SEQ ID NO: 2412170 - protein, 6 aa, Entamoeba dispar
AGEWTP

SEQ ID NO: 2412171 - protein, 14 aa, Entamoeba dispar
AGEYKQEVTEASKE

SEQ ID NO: 2412172 - protein, 17 aa, Entamoeba dispar
AGFKGYYKESEEYNNEH

SEQ ID NO: 2412173 - protein, 8 aa, Entamoeba dispar
AGFSRSNP

SEQ ID NO: 2412174 - protein, 10 aa, Entamoeba dispar
AGFSSHADPL

SEQ ID NO: 2412175 - protein, 5 aa, Entamoeba dispar
AGGAA

SEQ ID NO: 2412176 - protein, 6 aa, Entamoeba dispar
AGGDFS

SEQ ID NO: 2412177 - protein, 6 aa, Entamoeba dispar
AGGDGC

SEQ ID NO: 2412178 - protein, 12 aa, Entamoeba dispar
AGGDIDDNRGDT

SEQ ID NO: 2412179 - protein, 12 aa, Entamoeba dispar
AGGHGGSHQLVP

SEQ ID NO: 2412180 - protein, 6 aa, Entamoeba dispar
AGGKMT

SEQ ID NO: 2412181 - protein, 9 aa, Entamoeba dispar
AGGKVTDIY

SEQ ID NO: 2412182 - protein, 4 aa, Entamoeba dispar
AGGL

SEQ ID NO: 2412183 - protein, 9 aa, Entamoeba dispar
AGGLDTKNR

SEQ ID NO: 2412184 - protein, 7 aa, Entamoeba dispar
AGGLGSP

SEQ ID NO: 2412185 - protein, 4 aa, Entamoeba dispar
AGGP

SEQ ID NO: 2412186 - protein, 8 aa, Entamoeba dispar
AGGPGVIS

SEQ ID NO: 2412187 - protein, 6 aa, Entamoeba dispar
AGGRNC

SEQ ID NO: 2412188 - protein, 9 aa, Entamoeba dispar
AGGSCDNSY

SEQ ID NO: 2412189 - protein, 7 aa, Entamoeba dispar
AGGTPRK

SEQ ID NO: 2412190 - protein, 5 aa, Entamoeba dispar
AGGVD

SEQ ID NO: 2412191 - protein, 7 aa, Entamoeba dispar
AGHEKYQ

SEQ ID NO: 2412192 - protein, 5 aa, Entamoeba dispar
AGHER

SEQ ID NO: 2412193 - protein, 8 aa, Entamoeba dispar
AGHPNRKI

SEQ ID NO: 2412194 - protein, 6 aa, Entamoeba dispar
AGHTGD

SEQ ID NO: 2412195 - protein, 4 aa, Entamoeba dispar
AGID

SEQ ID NO: 2412196 - protein, 15 aa, Entamoeba dispar
AGIETNFKTPTVDDI

SEQ ID NO: 2412197 - protein, 6 aa, Entamoeba dispar
AGINSK

SEQ ID NO: 2412198 - protein, 5 aa, Entamoeba dispar
AGIPE

SEQ ID NO: 2412199 - protein, 4 aa, Entamoeba dispar
AGIQ

SEQ ID NO: 2412200 - protein, 8 aa, Entamoeba dispar
AGITEEDF

SEQ ID NO: 2412201 - protein, 7 aa, Entamoeba dispar
AGITTSL

SEQ ID NO: 2412202 - protein, 71 aa, Entamoeba dispar
AGKAKEMAAQRKSKKKAKALTKKTKALTKKTKALTKKTKSGKLNKIAKSAPKRKTTKRITKATQKRTVKAI

SEQ ID NO: 2412203 - protein, 8 aa, Entamoeba dispar
AGKATSQC

SEQ ID NO: 2412204 - protein, 6 aa, Entamoeba dispar
AGKDRE

SEQ ID NO: 2412205 - protein, 9 aa, Entamoeba dispar
AGKEEAKKY

SEQ ID NO: 2412206 - protein, 6 aa, Entamoeba dispar
AGKERE

SEQ ID NO: 2412207 - protein, 9 aa, Entamoeba dispar
AGKGNKKYD

SEQ ID NO: 2412208 - protein, 7 aa, Entamoeba dispar
AGKGRTG

SEQ ID NO: 2412209 - protein, 8 aa, Entamoeba dispar
AGKGRTGL

SEQ ID NO: 2412210 - protein, 7 aa, Entamoeba dispar
AGKNADI

SEQ ID NO: 2412211 - protein, 15 aa, Entamoeba dispar
AGKNGKLVHKECAEH

SEQ ID NO: 2412212 - protein, 7 aa, Entamoeba dispar
AGKPDPF

SEQ ID NO: 2412213 - protein, 11 aa, Entamoeba dispar
AGKPGTNIGIT

SEQ ID NO: 2412214 - protein, 15 aa, Entamoeba dispar
  misc_feature (15)..(15): Xaa can be any naturally occurring amino acid
AGKQSSPYNNPNPSX

SEQ ID NO: 2412215 - protein, 8 aa, Entamoeba dispar
AGKQTKEG

SEQ ID NO: 2412216 - protein, 4 aa, Entamoeba dispar
AGKS

SEQ ID NO: 2412217 - protein, 20 aa, Entamoeba dispar
AGKSLGNELDNKAKSKKTFY

SEQ ID NO: 2412218 - protein, 14 aa, Entamoeba dispar
AGKSNPGDKGSYEE

SEQ ID NO: 2412219 - protein, 9 aa, Entamoeba dispar
AGKSTTSGN

SEQ ID NO: 2412220 - protein, 4 aa, Entamoeba dispar
AGKT

SEQ ID NO: 2412221 - protein, 10 aa, Entamoeba dispar
AGKTEISPGT

SEQ ID NO: 2412222 - protein, 5 aa, Entamoeba dispar
AGKTL

SEQ ID NO: 2412223 - protein, 8 aa, Entamoeba dispar
AGLDGSTR

SEQ ID NO: 2412224 - protein, 5 aa, Entamoeba dispar
AGLKR

SEQ ID NO: 2412225 - protein, 5 aa, Entamoeba dispar
AGLQQ

SEQ ID NO: 2412226 - protein, 5 aa, Entamoeba dispar
AGLSV

SEQ ID NO: 2412227 - protein, 10 aa, Entamoeba dispar
AGNGGGKGSI

SEQ ID NO: 2412228 - protein, 6 aa, Entamoeba dispar
AGNGRN

SEQ ID NO: 2412229 - protein, 9 aa, Entamoeba dispar
AGNKNLYGT

SEQ ID NO: 2412230 - protein, 7 aa, Entamoeba dispar
AGNPQWD

SEQ ID NO: 2412231 - protein, 17 aa, Entamoeba dispar
AGNQTISRSAQPLPGAL

SEQ ID NO: 2412232 - protein, 6 aa, Entamoeba dispar
AGNTKS

SEQ ID NO: 2412233 - protein, 7 aa, Entamoeba dispar
AGPAGLA

SEQ ID NO: 2412234 - protein, 16 aa, Entamoeba dispar
AGPENGFMPSKHKKAC

SEQ ID NO: 2412235 - protein, 10 aa, Entamoeba dispar
AGPENSPFEG

SEQ ID NO: 2412236 - protein, 10 aa, Entamoeba dispar
AGPGQSSENE

SEQ ID NO: 2412237 - protein, 8 aa, Entamoeba dispar
AGPHPNSE

SEQ ID NO: 2412238 - protein, 6 aa, Entamoeba dispar
AGPIDD

SEQ ID NO: 2412239 - protein, 13 aa, Entamoeba dispar
AGPSASGKTTFSK

SEQ ID NO: 2412240 - protein, 10 aa, Entamoeba dispar
AGPTASSGAV

SEQ ID NO: 2412241 - protein, 7 aa, Entamoeba dispar
AGPTNNL

SEQ ID NO: 2412242 - protein, 9 aa, Entamoeba dispar
AGPTSSGAV

SEQ ID NO: 2412243 - protein, 23 aa, Entamoeba dispar
AGPVPQPRHRCGNPARTAHAGRG

SEQ ID NO: 2412244 - protein, 6 aa, Entamoeba dispar
AGQDRF

SEQ ID NO: 2412245 - protein, 4 aa, Entamoeba dispar
AGQE

SEQ ID NO: 2412246 - protein, 6 aa, Entamoeba dispar
AGQEEF

SEQ ID NO: 2412247 - protein, 7 aa, Entamoeba dispar
AGQEEFD

SEQ ID NO: 2412248 - protein, 7 aa, Entamoeba dispar
AGQEKFA

SEQ ID NO: 2412249 - protein, 9 aa, Entamoeba dispar
AGQEKFGGL

SEQ ID NO: 2412250 - protein, 7 aa, Entamoeba dispar
AGQEKYQ

SEQ ID NO: 2412251 - protein, 7 aa, Entamoeba dispar
AGQERFA

SEQ ID NO: 2412252 - protein, 7 aa, Entamoeba dispar
AGQERYR

SEQ ID NO: 2412253 - protein, 4 aa, Entamoeba dispar
AGQI

SEQ ID NO: 2412254 - protein, 7 aa, Entamoeba dispar
AGQKAKE

SEQ ID NO: 2412255 - protein, 7 aa, Entamoeba dispar
AGQLPSD

SEQ ID NO: 2412256 - protein, 7 aa, Entamoeba dispar
AGQPEGV

SEQ ID NO: 2412257 - protein, 13 aa, Entamoeba dispar
AGQSKKAGQLGEL

SEQ ID NO: 2412258 - protein, 11 aa, Entamoeba dispar
AGQSMGEPSTQ

SEQ ID NO: 2412259 - protein, 13 aa, Entamoeba dispar
AGRAGRDGKPAES

SEQ ID NO: 2412260 - protein, 5 aa, Entamoeba dispar
AGRCT

SEQ ID NO: 2412261 - protein, 15 aa, Entamoeba dispar
AGRDVKRPEEGVEQV

SEQ ID NO: 2412262 - protein, 5 aa, Entamoeba dispar
AGRFD

SEQ ID NO: 2412263 - protein, 12 aa, Entamoeba dispar
AGRFDEKRAARY

SEQ ID NO: 2412264 - protein, 6 aa, Entamoeba dispar
AGRGPL

SEQ ID NO: 2412265 - protein, 10 aa, Entamoeba dispar
AGRKGSFPVP

SEQ ID NO: 2412266 - protein, 8 aa, Entamoeba dispar
AGRMQGND

SEQ ID NO: 2412267 - protein, 4 aa, Entamoeba dispar
AGRN

SEQ ID NO: 2412268 - protein, 11 aa, Entamoeba dispar
AGRPQFDKEGT

SEQ ID NO: 2412269 - protein, 10 aa, Entamoeba dispar
AGRPQYDNEG

SEQ ID NO: 2412270 - protein, 11 aa, Entamoeba dispar
AGRPQYDSEGA

SEQ ID NO: 2412271 - protein, 9 aa, Entamoeba dispar
AGRPTPAHL

SEQ ID NO: 2412272 - protein, 14 aa, Entamoeba dispar
AGRTARAGKEGTTI

SEQ ID NO: 2412273 - protein, 11 aa, Entamoeba dispar
AGRTGRAGNEG

SEQ ID NO: 2412274 - protein, 6 aa, Entamoeba dispar
AGRTQL

SEQ ID NO: 2412275 - protein, 9 aa, Entamoeba dispar
AGRTSVSNK

SEQ ID NO: 2412276 - protein, 6 aa, Entamoeba dispar
AGSAHS

SEQ ID NO: 2412277 - protein, 4 aa, Entamoeba dispar
AGSD

SEQ ID NO: 2412278 - protein, 12 aa, Entamoeba dispar
AGSENSKRAGII

SEQ ID NO: 2412279 - protein, 7 aa, Entamoeba dispar
AGSESKR

SEQ ID NO: 2412280 - protein, 10 aa, Entamoeba dispar
AGSGEGGVDE

SEQ ID NO: 2412281 - protein, 8 aa, Entamoeba dispar
AGSGKSTY

SEQ ID NO: 2412282 - protein, 29 aa, Entamoeba dispar
AGSLPKQYTEKEKITPGTDMSNGNVRTQQ

SEQ ID NO: 2412283 - protein, 9 aa, Entamoeba dispar
AGSNKDSTT

SEQ ID NO: 2412284 - protein, 8 aa, Entamoeba dispar
AGSNRKTC

SEQ ID NO: 2412285 - protein, 8 aa, Entamoeba dispar
AGSQLGSL

SEQ ID NO: 2412286 - protein, 7 aa, Entamoeba dispar
AGSRPTF

SEQ ID NO: 2412287 - protein, 5 aa, Entamoeba dispar
AGSSK

SEQ ID NO: 2412288 - protein, 7 aa, Entamoeba dispar
AGSSNGE

SEQ ID NO: 2412289 - protein, 4 aa, Entamoeba dispar
AGTD

SEQ ID NO: 2412290 - protein, 6 aa, Entamoeba dispar
AGTEQF

SEQ ID NO: 2412291 - protein, 8 aa, Entamoeba dispar
AGTIAQKE

SEQ ID NO: 2412292 - protein, 6 aa, Entamoeba dispar
AGTIMK

SEQ ID NO: 2412293 - protein, 7 aa, Entamoeba dispar
AGTKEKA

SEQ ID NO: 2412294 - protein, 45 aa, Entamoeba dispar
AGTLPKQYTEKEKVVAGSDMSNGSPQPVKELPSSQPAQQKKPSLA

SEQ ID NO: 2412295 - protein, 17 aa, Entamoeba dispar
AGTLPNEFQKQKGTVEE

SEQ ID NO: 2412296 - protein, 8 aa, Entamoeba dispar
AGTNTASV

SEQ ID NO: 2412297 - protein, 8 aa, Entamoeba dispar
AGTPEPID

SEQ ID NO: 2412298 - protein, 8 aa, Entamoeba dispar
AGTPVGAL

SEQ ID NO: 2412299 - protein, 8 aa, Entamoeba dispar
AGTSDFTL

SEQ ID NO: 2412300 - protein, 7 aa, Entamoeba dispar
AGTSDPY

SEQ ID NO: 2412301 - protein, 10 aa, Entamoeba dispar
AGTSNQPNDY

SEQ ID NO: 2412302 - protein, 5 aa, Entamoeba dispar
AGTSV

SEQ ID NO: 2412303 - protein, 8 aa, Entamoeba dispar
AGTSVDED

SEQ ID NO: 2412304 - protein, 5 aa, Entamoeba dispar
AGTTA

SEQ ID NO: 2412305 - protein, 11 aa, Entamoeba dispar
AGTTNNDHTRL

SEQ ID NO: 2412306 - protein, 6 aa, Entamoeba dispar
AGTVDG

SEQ ID NO: 2412307 - protein, 6 aa, Entamoeba dispar
AGTVEE

SEQ ID NO: 2412308 - protein, 5 aa, Entamoeba dispar
AGVAE

SEQ ID NO: 2412309 - protein, 14 aa, Entamoeba dispar
AGVDKAHDEVEEAK

SEQ ID NO: 2412310 - protein, 4 aa, Entamoeba dispar
AGVG

SEQ ID NO: 2412311 - protein, 51 aa, Entamoeba dispar
AGVGADTYEAGYRRGADAAGPMASKGTWAATTDSGITAPCSGTEPIPDSYE

SEQ ID NO: 2412312 - protein, 11 aa, Entamoeba dispar
AGVKPKHLADP

SEQ ID NO: 2412313 - protein, 5 aa, Entamoeba dispar
AGVKR

SEQ ID NO: 2412314 - protein, 13 aa, Entamoeba dispar
AGVKRRDLADPDT

SEQ ID NO: 2412315 - protein, 4 aa, Entamoeba dispar
AGVN

SEQ ID NO: 2412316 - protein, 31 aa, Entamoeba dispar
AGVSAQKKKEKKLAKMTEGEKKKAQRNNPKA

SEQ ID NO: 2412317 - protein, 12 aa, Entamoeba dispar
AGVTITSDGNSV

SEQ ID NO: 2412318 - protein, 10 aa, Entamoeba dispar
AGYDGKERTL

SEQ ID NO: 2412319 - protein, 6 aa, Entamoeba dispar
AGYDNS

SEQ ID NO: 2412320 - protein, 9 aa, Entamoeba dispar
AGYDSTETL

SEQ ID NO: 2412321 - protein, 6 aa, Entamoeba dispar
AGYITS

SEQ ID NO: 2412322 - protein, 6 aa, Entamoeba dispar
AGYNDD

SEQ ID NO: 2412323 - protein, 6 aa, Entamoeba dispar
AGYQDG

SEQ ID NO: 2412324 - protein, 6 aa, Entamoeba dispar
AGYQPT

SEQ ID NO: 2412325 - protein, 10 aa, Entamoeba dispar
AGYSSQMKTQ

SEQ ID NO: 2412326 - protein, 12 aa, Entamoeba dispar
AGYTDAKESALE

SEQ ID NO: 2412327 - protein, 9 aa, Entamoeba dispar
AHASSPSLG

SEQ ID NO: 2412328 - protein, 7 aa, Entamoeba dispar
AHATGKV

SEQ ID NO: 2412329 - protein, 18 aa, Entamoeba dispar
AHDKQNENNERADKLYEE

SEQ ID NO: 2412330 - protein, 35 aa, Entamoeba dispar
AHDKYESIAKKAPEKQNGLAEAETRYNEAKDNYDY

SEQ ID NO: 2412331 - protein, 6 aa, Entamoeba dispar
AHEDGD

SEQ ID NO: 2412332 - protein, 14 aa, Entamoeba dispar
AHEELNKKEIDGRP

SEQ ID NO: 2412333 - protein, 58 aa, Entamoeba dispar
AHGYNDEEKSSKRKEVTKPKEKHEQQELTKKQQKKLQKKQKMKEQKSVSTQSKESNME

SEQ ID NO: 2412334 - protein, 7 aa, Entamoeba dispar
AHKEAGK

SEQ ID NO: 2412335 - protein, 6 aa, Entamoeba dispar
AHKEGK

SEQ ID NO: 2412336 - protein, 10 aa, Entamoeba dispar
AHKGNCSQSV

SEQ ID NO: 2412337 - protein, 21 aa, Entamoeba dispar
AHKRGLNPTHPSQRGTSQGPD

SEQ ID NO: 2412338 - protein, 8 aa, Entamoeba dispar
AHKSGGVT

SEQ ID NO: 2412339 - protein, 23 aa, Entamoeba dispar
AHNLSGAIRDSTIQNLNDDEDVV

SEQ ID NO: 2412340 - protein, 6 aa, Entamoeba dispar
AHNTEH

SEQ ID NO: 2412341 - protein, 11 aa, Entamoeba dispar
AHNYKNKKRNL

SEQ ID NO: 2412342 - protein, 4 aa, Entamoeba dispar
AHPL

SEQ ID NO: 2412343 - protein, 4 aa, Entamoeba dispar
AHPQ

SEQ ID NO: 2412344 - protein, 13 aa, Entamoeba dispar
AHQEVPSELLNMR

SEQ ID NO: 2412345 - protein, 6 aa, Entamoeba dispar
AHRSTQ

SEQ ID NO: 2412346 - protein, 11 aa, Entamoeba dispar
AHRTGDKAVKK

SEQ ID NO: 2412347 - protein, 7 aa, Entamoeba dispar
AHSAAVT

SEQ ID NO: 2412348 - protein, 5 aa, Entamoeba dispar
AHSGE

SEQ ID NO: 2412349 - protein, 13 aa, Entamoeba dispar
AHSKKNDKRITLE

SEQ ID NO: 2412350 - protein, 8 aa, Entamoeba dispar
AHSLPTHN

SEQ ID NO: 2412351 - protein, 8 aa, Entamoeba dispar
AHSNGGQN

SEQ ID NO: 2412352 - protein, 8 aa, Entamoeba dispar
AHSPQQVN

SEQ ID NO: 2412353 - protein, 7 aa, Entamoeba dispar
AHTKNKP

SEQ ID NO: 2412354 - protein, 11 aa, Entamoeba dispar
AHTQSGGERSV

SEQ ID NO: 2412355 - protein, 5 aa, Entamoeba dispar
AHTRK

SEQ ID NO: 2412356 - protein, 16 aa, Entamoeba dispar
AHTTKTLDKNHQYAQG

SEQ ID NO: 2412357 - protein, 11 aa, Entamoeba dispar
AHVEDASDEFK

SEQ ID NO: 2412358 - protein, 12 aa, Entamoeba dispar
AIADASNEISEA

SEQ ID NO: 2412359 - protein, 6 aa, Entamoeba dispar
AIAKAT

SEQ ID NO: 2412360 - protein, 6 aa, Entamoeba dispar
AIASEN

SEQ ID NO: 2412361 - protein, 22 aa, Entamoeba dispar
AIDADADINTFATTKATNGHMP

SEQ ID NO: 2412362 - protein, 5 aa, Entamoeba dispar
AIDES

SEQ ID NO: 2412363 - protein, 5 aa, Entamoeba dispar
AIDET

SEQ ID NO: 2412364 - protein, 7 aa, Entamoeba dispar
AIDGTPV

SEQ ID NO: 2412365 - protein, 8 aa, Entamoeba dispar
AIDKCKSN

SEQ ID NO: 2412366 - protein, 4 aa, Entamoeba dispar
AIDN

SEQ ID NO: 2412367 - protein, 6 aa, Entamoeba dispar
AIDPNT

SEQ ID NO: 2412368 - protein, 7 aa, Entamoeba dispar
AIDPTGN

SEQ ID NO: 2412369 - protein, 5 aa, Entamoeba dispar
AIDSD

SEQ ID NO: 2412370 - protein, 8 aa, Entamoeba dispar
AIDSLNDK

SEQ ID NO: 2412371 - protein, 4 aa, Entamoeba dispar
AIDY

SEQ ID NO: 2412372 - protein, 13 aa, Entamoeba dispar
AIEDEDQRKKYTD

SEQ ID NO: 2412373 - protein, 16 aa, Entamoeba dispar
AIEKGKERYGKRTRSI

SEQ ID NO: 2412374 - protein, 9 aa, Entamoeba dispar
AIERNGKGG

SEQ ID NO: 2412375 - protein, 10 aa, Entamoeba dispar
AIETKRQQIP

SEQ ID NO: 2412376 - protein, 10 aa, Entamoeba dispar
AIETKSGDLQ

SEQ ID NO: 2412377 - protein, 10 aa, Entamoeba dispar
AIGDQTIERP

SEQ ID NO: 2412378 - protein, 4 aa, Entamoeba dispar
AIGE

SEQ ID NO: 2412379 - protein, 4 aa, Entamoeba dispar
AIGK

SEQ ID NO: 2412380 - protein, 10 aa, Entamoeba dispar
AIGKEEEGIN

SEQ ID NO: 2412381 - protein, 6 aa, Entamoeba dispar
AIGSEC

SEQ ID NO: 2412382 - protein, 30 aa, Entamoeba dispar
AIGSQSDNNITEHSKDTAKIKQPSSFDPSA

SEQ ID NO: 2412383 - protein, 8 aa, Entamoeba dispar
AIHNKSST

SEQ ID NO: 2412384 - protein, 27 aa, Entamoeba dispar
AIIPKTDPNVKEAKKKGSHRKSTSMPE

SEQ ID NO: 2412385 - protein, 7 aa, Entamoeba dispar
AIKDTGI

SEQ ID NO: 2412386 - protein, 10 aa, Entamoeba dispar
AIKDTSPYVR

SEQ ID NO: 2412387 - protein, 6 aa, Entamoeba dispar
AIKENE

SEQ ID NO: 2412388 - protein, 21 aa, Entamoeba dispar
AIKETTEPNTIEQTKKPKLPL

SEQ ID NO: 2412389 - protein, 6 aa, Entamoeba dispar
AIKKNS

SEQ ID NO: 2412390 - protein, 7 aa, Entamoeba dispar
AIKKPKL

SEQ ID NO: 2412391 - protein, 10 aa, Entamoeba dispar
AIKNENTERR

SEQ ID NO: 2412392 - protein, 114 aa, Entamoeba dispar
AIKNNTTDSQNTNSSNNLNSTNNNPNQLSNSTNNTNLNNTTQLNNGTQLNNTTQLNNTTQLNNTTQLNNGTQLNNGTQLNNGTQLNNGTQLNNTTQLNNGTQLNNTTTQLNNTT

SEQ ID NO: 2412393 - protein, 9 aa, Entamoeba dispar
AIKNSRNKI

SEQ ID NO: 2412394 - protein, 10 aa, Entamoeba dispar
AIKPKEQVKI

SEQ ID NO: 2412395 - protein, 16 aa, Entamoeba dispar
AIKREDEERPDDIGYD

SEQ ID NO: 2412396 - protein, 4 aa, Entamoeba dispar
AIKT

SEQ ID NO: 2412397 - protein, 7 aa, Entamoeba dispar
AINERSK

SEQ ID NO: 2412398 - protein, 8 aa, Entamoeba dispar
AINQTTKD

SEQ ID NO: 2412399 - protein, 17 aa, Entamoeba dispar
AINTAKQNKMKRTSITN

SEQ ID NO: 2412400 - protein, 11 aa, Entamoeba dispar
AINTNTQDNEF

SEQ ID NO: 2412401 - protein, 13 aa, Entamoeba dispar
AIPDTPMNTRRTF

SEQ ID NO: 2412402 - protein, 15 aa, Entamoeba dispar
AIPKPRSYGVFSSLF

SEQ ID NO: 2412403 - protein, 4 aa, Entamoeba dispar
AIPP

SEQ ID NO: 2412404 - protein, 5 aa, Entamoeba dispar
AIPPS

SEQ ID NO: 2412405 - protein, 8 aa, Entamoeba dispar
AIPQPYQS

SEQ ID NO: 2412406 - protein, 5 aa, Entamoeba dispar
AIQEE

SEQ ID NO: 2412407 - protein, 4 aa, Entamoeba dispar
AIQK

SEQ ID NO: 2412408 - protein, 35 aa, Entamoeba dispar
AIQKKYPKLAKPNQPLGSPSQLTRSGITNSPYGTH

SEQ ID NO: 2412409 - protein, 16 aa, Entamoeba dispar
AIQLSEDHKPNGTCER

SEQ ID NO: 2412410 - protein, 22 aa, Entamoeba dispar
AIQSKAEQELKERVEKAESVEL

SEQ ID NO: 2412411 - protein, 6 aa, Entamoeba dispar
AIREES

SEQ ID NO: 2412412 - protein, 5 aa, Entamoeba dispar
AIRES

SEQ ID NO: 2412413 - protein, 6 aa, Entamoeba dispar
AIRSRA

SEQ ID NO: 2412414 - protein, 4 aa, Entamoeba dispar
AIRT

SEQ ID NO: 2412415 - protein, 6 aa, Entamoeba dispar
AISATD

SEQ ID NO: 2412416 - protein, 60 aa, Entamoeba dispar
AISDSDDDDDAKPTTRKATDKKAVSSSDSDEDIKPTAKKTSTKKEESSDDLNDDDDGVGA

SEQ ID NO: 2412417 - protein, 85 aa, Entamoeba dispar
AISDSDDDDDIKPAVKKTTTKKFSISDSDDDDDIKPTTKKTTTKKFSISDSDDDEDIKPTAKKTSTKKASSDDLSDDDEDIEATL

SEQ ID NO: 2412418 - protein, 61 aa, Entamoeba dispar
AISDSDDDDDIKPTTKKTTTKKFSISDSDSDDEDIKPTAKKTSTKKASSDDLSDDDEDIAA

SEQ ID NO: 2412419 - protein, 83 aa, Entamoeba dispar
AISDSDDDDDVKPVTKKTTTKKFSISDSDDDDIKPTTKKTTTKKFSISDSDSDDDEIKPPTKKTSTKKASSDDLSDDDEDIAA

SEQ ID NO: 2412420 - protein, 111 aa, Entamoeba dispar
AISDSDDDDEDIKPTTKKTTTKKEESSDDLSDSDEDIKPTAKKTSTKKELSDDLSDDEDTKPVTKKTTTKKFSISDSDSDDEDIKPTAKKTSTKKASSDDLSDDDEDIEAA

SEQ ID NO: 2412421 - protein, 8 aa, Entamoeba dispar
AISGNSYK

SEQ ID NO: 2412422 - protein, 11 aa, Entamoeba dispar
AISNGEKINKI

SEQ ID NO: 2412423 - protein, 10 aa, Entamoeba dispar
AISNNKQTVY

SEQ ID NO: 2412424 - protein, 6 aa, Entamoeba dispar
AISPNN

SEQ ID NO: 2412425 - protein, 13 aa, Entamoeba dispar
AISSPIFLKIHYE

SEQ ID NO: 2412426 - protein, 6 aa, Entamoeba dispar
AISSTG

SEQ ID NO: 2412427 - protein, 17 aa, Entamoeba dispar
AISSTGRYLASGDEKGS

SEQ ID NO: 2412428 - protein, 13 aa, Entamoeba dispar
AISTPIATTEIDN

SEQ ID NO: 2412429 - protein, 9 aa, Entamoeba dispar
AITGSGLDA

SEQ ID NO: 2412430 - protein, 4 aa, Entamoeba dispar
AITQ

SEQ ID NO: 2412431 - protein, 9 aa, Entamoeba dispar
AITRPTEDK

SEQ ID NO: 2412432 - protein, 6 aa, Entamoeba dispar
AITSNT

SEQ ID NO: 2412433 - protein, 6 aa, Entamoeba dispar
AITTES

SEQ ID NO: 2412434 - protein, 16 aa, Entamoeba dispar
AITTVTEMSNEELEEI

SEQ ID NO: 2412435 - protein, 10 aa, Entamoeba dispar
AIVDDSKSSI

SEQ ID NO: 2412436 - protein, 12 aa, Entamoeba dispar
AIVENSDTSQIN

SEQ ID NO: 2412437 - protein, 19 aa, Entamoeba dispar
AIVPPDQMKRKSHRGGRRV

SEQ ID NO: 2412438 - protein, 11 aa, Entamoeba dispar
AIYDDNTEDEF

SEQ ID NO: 2412439 - protein, 9 aa, Entamoeba dispar
AIYDDNTGD

SEQ ID NO: 2412440 - protein, 11 aa, Entamoeba dispar
AIYDDNTGDEF

SEQ ID NO: 2412441 - protein, 9 aa, Entamoeba dispar
AIYSDNTED

SEQ ID NO: 2412442 - protein, 11 aa, Entamoeba dispar
AIYSENTEDKF

SEQ ID NO: 2412443 - protein, 13 aa, Entamoeba dispar
AKAAEEKMEYGEQ

SEQ ID NO: 2412444 - protein, 6 aa, Entamoeba dispar
AKADED

SEQ ID NO: 2412445 - protein, 25 aa, Entamoeba dispar
AKADPENTYADGEGVEKCDAGKGPV

SEQ ID NO: 2412446 - protein, 6 aa, Entamoeba dispar
AKADPI

SEQ ID NO: 2412447 - protein, 8 aa, Entamoeba dispar
AKAEAVKN

SEQ ID NO: 2412448 - protein, 8 aa, Entamoeba dispar
AKAGEDEL

SEQ ID NO: 2412449 - protein, 6 aa, Entamoeba dispar
AKAKIN

SEQ ID NO: 2412450 - protein, 7 aa, Entamoeba dispar
AKAKINI

SEQ ID NO: 2412451 - protein, 4 aa, Entamoeba dispar
AKAN

SEQ ID NO: 2412452 - protein, 7 aa, Entamoeba dispar
AKAPKAF

SEQ ID NO: 2412453 - protein, 7 aa, Entamoeba dispar
AKAQDAL

SEQ ID NO: 2412454 - protein, 21 aa, Entamoeba dispar
AKASAKTTKDNKEEKQKGCTK

SEQ ID NO: 2412455 - protein, 11 aa, Entamoeba dispar
AKASTEDEAVA

SEQ ID NO: 2412456 - protein, 8 aa, Entamoeba dispar
AKASYETT

SEQ ID NO: 2412457 - protein, 15 aa, Entamoeba dispar
AKATITYSQFIDIMH

SEQ ID NO: 2412458 - protein, 11 aa, Entamoeba dispar
AKAVEKDLEAE

SEQ ID NO: 2412459 - protein, 5 aa, Entamoeba dispar
AKAWE

SEQ ID NO: 2412460 - protein, 5 aa, Entamoeba dispar
AKDAE

SEQ ID NO: 2412461 - protein, 35 aa, Entamoeba dispar
AKDCPKRKEELKKKQEEKIKERMEEEEGIDDEEMS

SEQ ID NO: 2412462 - protein, 4 aa, Entamoeba dispar
AKDE

SEQ ID NO: 2412463 - protein, 9 aa, Entamoeba dispar
AKDECPTEF

SEQ ID NO: 2412464 - protein, 8 aa, Entamoeba dispar
AKDEGKCP

SEQ ID NO: 2412465 - protein, 9 aa, Entamoeba dispar
AKDEKKAIP

SEQ ID NO: 2412466 - protein, 8 aa, Entamoeba dispar
AKDGTNSA

SEQ ID NO: 2412467 - protein, 9 aa, Entamoeba dispar
AKDHQSLSA

SEQ ID NO: 2412468 - protein, 9 aa, Entamoeba dispar
AKDITTKSR

SEQ ID NO: 2412469 - protein, 6 aa, Entamoeba dispar
AKDKHG

SEQ ID NO: 2412470 - protein, 12 aa, Entamoeba dispar
AKDNFDRAKGPV

SEQ ID NO: 2412471 - protein, 6 aa, Entamoeba dispar
AKDNIG

SEQ ID NO: 2412472 - protein, 17 aa, Entamoeba dispar
AKDPKKRYSIQGEGNQI

SEQ ID NO: 2412473 - protein, 6 aa, Entamoeba dispar
AKDRMK

SEQ ID NO: 2412474 - protein, 10 aa, Entamoeba dispar
AKDRNNGDEG

SEQ ID NO: 2412475 - protein, 7 aa, Entamoeba dispar
AKDSAPS

SEQ ID NO: 2412476 - protein, 8 aa, Entamoeba dispar
AKDSETIN

SEQ ID NO: 2412477 - protein, 7 aa, Entamoeba dispar
AKDSFNI

SEQ ID NO: 2412478 - protein, 15 aa, Entamoeba dispar
AKDSIVNDPTKNSVS

SEQ ID NO: 2412479 - protein, 4 aa, Entamoeba dispar
AKDT

SEQ ID NO: 2412480 - protein, 15 aa, Entamoeba dispar
AKDTIRKNGTEEITT

SEQ ID NO: 2412481 - protein, 4 aa, Entamoeba dispar
AKDV

SEQ ID NO: 2412482 - protein, 15 aa, Entamoeba dispar
AKDVAANTNRKTLST

SEQ ID NO: 2412483 - protein, 8 aa, Entamoeba dispar
AKEANEGI

SEQ ID NO: 2412484 - protein, 52 aa, Entamoeba dispar
AKEASKQIDSLNTELEEVEKDLDDEIKRHTATKADLEKTKNDLESSNNQINK

SEQ ID NO: 2412485 - protein, 6 aa, Entamoeba dispar
AKEDFN

SEQ ID NO: 2412486 - protein, 10 aa, Entamoeba dispar
AKEDPFDRTP

SEQ ID NO: 2412487 - protein, 8 aa, Entamoeba dispar
AKEEGHAQ

SEQ ID NO: 2412488 - protein, 19 aa, Entamoeba dispar
AKEESKKKMSKASDKTGVP

SEQ ID NO: 2412489 - protein, 7 aa, Entamoeba dispar
AKEFAVQ

SEQ ID NO: 2412490 - protein, 7 aa, Entamoeba dispar
AKEGNSI

SEQ ID NO: 2412491 - protein, 5 aa, Entamoeba dispar
AKEGR

SEQ ID NO: 2412492 - protein, 10 aa, Entamoeba dispar
AKEHDKESHH

SEQ ID NO: 2412493 - protein, 7 aa, Entamoeba dispar
AKEINDE

SEQ ID NO: 2412494 - protein, 12 aa, Entamoeba dispar
AKEKKDPNTQKL

SEQ ID NO: 2412495 - protein, 7 aa, Entamoeba dispar
AKEKKGI

SEQ ID NO: 2412496 - protein, 9 aa, Entamoeba dispar
AKEKYSEAM

SEQ ID NO: 2412497 - protein, 8 aa, Entamoeba dispar
AKELANEY

SEQ ID NO: 2412498 - protein, 5 aa, Entamoeba dispar
AKELK

SEQ ID NO: 2412499 - protein, 14 aa, Entamoeba dispar
AKELKKNKQIPRNC

SEQ ID NO: 2412500 - protein, 12 aa, Entamoeba dispar
AKELNESVNKMN

SEQ ID NO: 2412501 - protein, 6 aa, Entamoeba dispar
AKELPY

SEQ ID NO: 2412502 - protein, 6 aa, Entamoeba dispar
AKEMVS

SEQ ID NO: 2412503 - protein, 7 aa, Entamoeba dispar
AKENEEQ

SEQ ID NO: 2412504 - protein, 12 aa, Entamoeba dispar
AKENGSSVIQGD

SEQ ID NO: 2412505 - protein, 30 aa, Entamoeba dispar
AKENKEKERIEQLKKEQKEMESKGIKPSPF

SEQ ID NO: 2412506 - protein, 7 aa, Entamoeba dispar
AKEQKYE

SEQ ID NO: 2412507 - protein, 10 aa, Entamoeba dispar
AKERGATLGA

SEQ ID NO: 2412508 - protein, 9 aa, Entamoeba dispar
AKERGDAKW

SEQ ID NO: 2412509 - protein, 5 aa, Entamoeba dispar
AKEVG

SEQ ID NO: 2412510 - protein, 6 aa, Entamoeba dispar
AKGAGY

SEQ ID NO: 2412511 - protein, 13 aa, Entamoeba dispar
AKGEVSAAQDQLK

SEQ ID NO: 2412512 - protein, 14 aa, Entamoeba dispar
AKGGFSTNEKATIG

SEQ ID NO: 2412513 - protein, 7 aa, Entamoeba dispar
AKGGKPY

SEQ ID NO: 2412514 - protein, 46 aa, Entamoeba dispar
AKGGKRNRNKGQQQSQQQNSQQQTPQKLEKPTTKVEQSPKPSPSFN

SEQ ID NO: 2412515 - protein, 5 aa, Entamoeba dispar
AKGIQ

SEQ ID NO: 2412516 - protein, 10 aa, Entamoeba dispar
AKGKGSLEEV

SEQ ID NO: 2412517 - protein, 15 aa, Entamoeba dispar
AKGKKIFKGNACKES

SEQ ID NO: 2412518 - protein, 10 aa, Entamoeba dispar
AKGKNYISDG

SEQ ID NO: 2412519 - protein, 5 aa, Entamoeba dispar
AKGNI

SEQ ID NO: 2412520 - protein, 8 aa, Entamoeba dispar
AKGPQSNI

SEQ ID NO: 2412521 - protein, 13 aa, Entamoeba dispar
AKGQTTKNSCYNE

SEQ ID NO: 2412522 - protein, 12 aa, Entamoeba dispar
AKGSSYTSSKMN

SEQ ID NO: 2412523 - protein, 5 aa, Entamoeba dispar
AKGSY

SEQ ID NO: 2412524 - protein, 5 aa, Entamoeba dispar
AKGTP

SEQ ID NO: 2412525 - protein, 8 aa, Entamoeba dispar
AKGTRTLD

SEQ ID NO: 2412526 - protein, 12 aa, Entamoeba dispar
AKGVLSPRSRKE

SEQ ID NO: 2412527 - protein, 7 aa, Entamoeba dispar
AKGYKEN

SEQ ID NO: 2412528 - protein, 24 aa, Entamoeba dispar
AKHATAAPTEAEKKPAKGSKKQAK

SEQ ID NO: 2412529 - protein, 23 aa, Entamoeba dispar
AKHKRELKQLNEEKESGNNDKIK

SEQ ID NO: 2412530 - protein, 10 aa, Entamoeba dispar
AKHKSKKYQY

SEQ ID NO: 2412531 - protein, 9 aa, Entamoeba dispar
AKIASGGGR

SEQ ID NO: 2412532 - protein, 7 aa, Entamoeba dispar
AKIDKNL

SEQ ID NO: 2412533 - protein, 7 aa, Entamoeba dispar
AKIEGSC

SEQ ID NO: 2412534 - protein, 7 aa, Entamoeba dispar
AKIEKEL

SEQ ID NO: 2412535 - protein, 14 aa, Entamoeba dispar
AKIGNKNLNSVSRK

SEQ ID NO: 2412536 - protein, 9 aa, Entamoeba dispar
AKIKKSHDV

SEQ ID NO: 2412537 - protein, 12 aa, Entamoeba dispar
AKIPLNSKGEID

SEQ ID NO: 2412538 - protein, 4 aa, Entamoeba dispar
AKIQ

SEQ ID NO: 2412539 - protein, 13 aa, Entamoeba dispar
AKIQEKEGIPPDQ

SEQ ID NO: 2412540 - protein, 8 aa, Entamoeba dispar
AKIRKEND

SEQ ID NO: 2412541 - protein, 7 aa, Entamoeba dispar
AKKAEDE

SEQ ID NO: 2412542 - protein, 7 aa, Entamoeba dispar
AKKAGKK

SEQ ID NO: 2412543 - protein, 11 aa, Entamoeba dispar
AKKASDGRSVW

SEQ ID NO: 2412544 - protein, 8 aa, Entamoeba dispar
AKKASKTL

SEQ ID NO: 2412545 - protein, 14 aa, Entamoeba dispar
AKKDGETKPQPVRP

SEQ ID NO: 2412546 - protein, 87 aa, Entamoeba dispar
AKKEAEEKAKKEAEEKAKKEAEEKAKKEAEERARKEAEERARKEAEERARKEAEEKARKEAEEKARKEAEEKAKKEKSEKEKQERLK

SEQ ID NO: 2412547 - protein, 25 aa, Entamoeba dispar
AKKEGEKKTAQRMTGREDAEFDPSV

SEQ ID NO: 2412548 - protein, 8 aa, Entamoeba dispar
AKKEIGHG

SEQ ID NO: 2412549 - protein, 17 aa, Entamoeba dispar
AKKEINELGNKEKNKER

SEQ ID NO: 2412550 - protein, 16 aa, Entamoeba dispar
AKKEISEIHSKKKGVI

SEQ ID NO: 2412551 - protein, 11 aa, Entamoeba dispar
AKKEKIKIPNK

SEQ ID NO: 2412552 - protein, 9 aa, Entamoeba dispar
AKKEPENTA

SEQ ID NO: 2412553 - protein, 10 aa, Entamoeba dispar
AKKERNEEEM

SEQ ID NO: 2412554 - protein, 7 aa, Entamoeba dispar
AKKESGD

SEQ ID NO: 2412555 - protein, 6 aa, Entamoeba dispar
AKKHGM

SEQ ID NO: 2412556 - protein, 10 aa, Entamoeba dispar
AKKHNKKATQ

SEQ ID NO: 2412557 - protein, 15 aa, Entamoeba dispar
AKKKGLKSVDQSTIP

SEQ ID NO: 2412558 - protein, 20 aa, Entamoeba dispar
AKKKIEEKEHELSTTSPKEV

SEQ ID NO: 2412559 - protein, 8 aa, Entamoeba dispar
AKKKVSRN

SEQ ID NO: 2412560 - protein, 9 aa, Entamoeba dispar
AKKNGIKVD

SEQ ID NO: 2412561 - protein, 17 aa, Entamoeba dispar
AKKNIDGYQKWSDEHKD

SEQ ID NO: 2412562 - protein, 7 aa, Entamoeba dispar
AKKNQAL

SEQ ID NO: 2412563 - protein, 9 aa, Entamoeba dispar
AKKNSDLGG

SEQ ID NO: 2412564 - protein, 10 aa, Entamoeba dispar
AKKNSPTNVR

SEQ ID NO: 2412565 - protein, 8 aa, Entamoeba dispar
AKKPIKKE

SEQ ID NO: 2412566 - protein, 9 aa, Entamoeba dispar
AKKPLDSAG

SEQ ID NO: 2412567 - protein, 10 aa, Entamoeba dispar
AKKRAERAKK

SEQ ID NO: 2412568 - protein, 14 aa, Entamoeba dispar
AKKRGKLLRGGEPD

SEQ ID NO: 2412569 - protein, 18 aa, Entamoeba dispar
AKKRKDKKEKKEEEKIEG

SEQ ID NO: 2412570 - protein, 9 aa, Entamoeba dispar
AKKRTEQIE

SEQ ID NO: 2412571 - protein, 7 aa, Entamoeba dispar
AKKSGGI

SEQ ID NO: 2412572 - protein, 11 aa, Entamoeba dispar
AKKSKDEEKVT

SEQ ID NO: 2412573 - protein, 13 aa, Entamoeba dispar
AKKSKRCHVPCVL

SEQ ID NO: 2412574 - protein, 8 aa, Entamoeba dispar
AKKSPNVF

SEQ ID NO: 2412575 - protein, 8 aa, Entamoeba dispar
AKKSQASG

SEQ ID NO: 2412576 - protein, 9 aa, Entamoeba dispar
AKKSSPINS

SEQ ID NO: 2412577 - protein, 7 aa, Entamoeba dispar
AKKSTAI

SEQ ID NO: 2412578 - protein, 6 aa, Entamoeba dispar
AKKTNE

SEQ ID NO: 2412579 - protein, 14 aa, Entamoeba dispar
AKKTNNQQTSSDEI

SEQ ID NO: 2412580 - protein, 8 aa, Entamoeba dispar
AKKTRKEE

SEQ ID NO: 2412581 - protein, 10 aa, Entamoeba dispar
AKKTTCKGSF

SEQ ID NO: 2412582 - protein, 8 aa, Entamoeba dispar
AKLDKGSI

SEQ ID NO: 2412583 - protein, 24 aa, Entamoeba dispar
AKLGGGSPSISSSEIDSIKRPPSQ

SEQ ID NO: 2412584 - protein, 16 aa, Entamoeba dispar
AKLKNEKISVSEGKES

SEQ ID NO: 2412585 - protein, 8 aa, Entamoeba dispar
AKLKNSVK

SEQ ID NO: 2412586 - protein, 12 aa, Entamoeba dispar
AKLPDEKKRITS

SEQ ID NO: 2412587 - protein, 5 aa, Entamoeba dispar
AKLPQ

SEQ ID NO: 2412588 - protein, 18 aa, Entamoeba dispar
AKLPQQSTSPKRKRAITP

SEQ ID NO: 2412589 - protein, 8 aa, Entamoeba dispar
AKLQNKKG

SEQ ID NO: 2412590 - protein, 16 aa, Entamoeba dispar
AKLSDEINKGLNEATA

SEQ ID NO: 2412591 - protein, 7 aa, Entamoeba dispar
AKLSGGK

SEQ ID NO: 2412592 - protein, 6 aa, Entamoeba dispar
AKLSPT

SEQ ID NO: 2412593 - protein, 9 aa, Entamoeba dispar
AKMPPNPKV

SEQ ID NO: 2412594 - protein, 9 aa, Entamoeba dispar
AKNANSTEL

SEQ ID NO: 2412595 - protein, 10 aa, Entamoeba dispar
AKNDKAHKHG

SEQ ID NO: 2412596 - protein, 10 aa, Entamoeba dispar
AKNEKGETPL

SEQ ID NO: 2412597 - protein, 6 aa, Entamoeba dispar
AKNEKI

SEQ ID NO: 2412598 - protein, 14 aa, Entamoeba dispar
AKNETERKEKASKW

SEQ ID NO: 2412599 - protein, 23 aa, Entamoeba dispar
AKNETERKEKASKWYAAKQLKQK

SEQ ID NO: 2412600 - protein, 6 aa, Entamoeba dispar
AKNGEA

SEQ ID NO: 2412601 - protein, 7 aa, Entamoeba dispar
AKNHSKY

SEQ ID NO: 2412602 - protein, 6 aa, Entamoeba dispar
AKNIET

SEQ ID NO: 2412603 - protein, 10 aa, Entamoeba dispar
AKNNKKINVT

SEQ ID NO: 2412604 - protein, 9 aa, Entamoeba dispar
AKNPPESPI

SEQ ID NO: 2412605 - protein, 6 aa, Entamoeba dispar
AKNRNK

SEQ ID NO: 2412606 - protein, 24 aa, Entamoeba dispar
AKNSENDAEIDSLKEEKKALEDEI

SEQ ID NO: 2412607 - protein, 11 aa, Entamoeba dispar
AKNSLSDRANI

SEQ ID NO: 2412608 - protein, 9 aa, Entamoeba dispar
AKNVSGDLS

SEQ ID NO: 2412609 - protein, 30 aa, Entamoeba dispar
AKNYEEHDKLESDINNNEKTIKQLQNTNKV

SEQ ID NO: 2412610 - protein, 8 aa, Entamoeba dispar
AKNYSNVD

SEQ ID NO: 2412611 - protein, 13 aa, Entamoeba dispar
AKPANNPETSTEK

SEQ ID NO: 2412612 - protein, 10 aa, Entamoeba dispar
AKPDQTNRQF

SEQ ID NO: 2412613 - protein, 8 aa, Entamoeba dispar
AKPEPKKL

SEQ ID NO: 2412614 - protein, 18 aa, Entamoeba dispar
AKPEREVEKKTASGRTFK

SEQ ID NO: 2412615 - protein, 10 aa, Entamoeba dispar
AKPKDGRPYL

SEQ ID NO: 2412616 - protein, 4 aa, Entamoeba dispar
AKPL

SEQ ID NO: 2412617 - protein, 9 aa, Entamoeba dispar
AKPLPQNRV

SEQ ID NO: 2412618 - protein, 11 aa, Entamoeba dispar
AKPNEVEPSSG

SEQ ID NO: 2412619 - protein, 8 aa, Entamoeba dispar
AKPPPPEE

SEQ ID NO: 2412620 - protein, 10 aa, Entamoeba dispar
AKPQRKTTVT

SEQ ID NO: 2412621 - protein, 6 aa, Entamoeba dispar
AKPRGV

SEQ ID NO: 2412622 - protein, 9 aa, Entamoeba dispar
AKPRNGSRK

SEQ ID NO: 2412623 - protein, 10 aa, Entamoeba dispar
AKPRNGSRKT

SEQ ID NO: 2412624 - protein, 5 aa, Entamoeba dispar
AKPSL

SEQ ID NO: 2412625 - protein, 28 aa, Entamoeba dispar
AKPSSVSPQEENESEEHKEVQEPPRAFS

SEQ ID NO: 2412626 - protein, 8 aa, Entamoeba dispar
AKPTPTIA

SEQ ID NO: 2412627 - protein, 21 aa, Entamoeba dispar
AKPTSPIRTQVKGNPPKPAQT

SEQ ID NO: 2412628 - protein, 9 aa, Entamoeba dispar
AKPYEGSFG

SEQ ID NO: 2412629 - protein, 7 aa, Entamoeba dispar
AKQATLV

SEQ ID NO: 2412630 - protein, 4 aa, Entamoeba dispar
AKQE

SEQ ID NO: 2412631 - protein, 10 aa, Entamoeba dispar
AKQEGYRARS

SEQ ID NO: 2412632 - protein, 7 aa, Entamoeba dispar
AKQENPI

SEQ ID NO: 2412633 - protein, 7 aa, Entamoeba dispar
AKQETEH

SEQ ID NO: 2412634 - protein, 14 aa, Entamoeba dispar
AKQFDGTKAEVGEL

SEQ ID NO: 2412635 - protein, 7 aa, Entamoeba dispar
AKQGEAC

SEQ ID NO: 2412636 - protein, 23 aa, Entamoeba dispar
AKQIPEIKKDETETIPAKGLYDD

SEQ ID NO: 2412637 - protein, 14 aa, Entamoeba dispar
AKQNEDTKQEFENR

SEQ ID NO: 2412638 - protein, 7 aa, Entamoeba dispar
AKQPNTS

SEQ ID NO: 2412639 - protein, 7 aa, Entamoeba dispar
AKQPVEP

SEQ ID NO: 2412640 - protein, 11 aa, Entamoeba dispar
AKQRYDNTLPS

SEQ ID NO: 2412641 - protein, 10 aa, Entamoeba dispar
AKQSSAEPVI

SEQ ID NO: 2412642 - protein, 11 aa, Entamoeba dispar
AKQTGSVDITR

SEQ ID NO: 2412643 - protein, 6 aa, Entamoeba dispar
AKQTSL

SEQ ID NO: 2412644 - protein, 12 aa, Entamoeba dispar
AKRAAKVGRASF

SEQ ID NO: 2412645 - protein, 5 aa, Entamoeba dispar
AKRAG

SEQ ID NO: 2412646 - protein, 8 aa, Entamoeba dispar
AKREDAYK

SEQ ID NO: 2412647 - protein, 6 aa, Entamoeba dispar
AKRELN

SEQ ID NO: 2412648 - protein, 13 aa, Entamoeba dispar
AKRESKNRDAAQQ

SEQ ID NO: 2412649 - protein, 8 aa, Entamoeba dispar
AKRESQNR

SEQ ID NO: 2412650 - protein, 10 aa, Entamoeba dispar
AKRKAQNPLN

SEQ ID NO: 2412651 - protein, 6 aa, Entamoeba dispar
AKRMDD

SEQ ID NO: 2412652 - protein, 12 aa, Entamoeba dispar
AKRMKNPQIQSG

SEQ ID NO: 2412653 - protein, 15 aa, Entamoeba dispar
AKRNQQNIKTEEDYI

SEQ ID NO: 2412654 - protein, 6 aa, Entamoeba dispar
AKRNRK

SEQ ID NO: 2412655 - protein, 23 aa, Entamoeba dispar
AKRRTEYQSQVQEESKMEEGDED

SEQ ID NO: 2412656 - protein, 6 aa, Entamoeba dispar
AKRRYQ

SEQ ID NO: 2412657 - protein, 47 aa, Entamoeba dispar
AKRTTTGDQKSGENKVDEKGDENKKEQESTEEKNQNLQIKEDGNSFV

SEQ ID NO: 2412658 - protein, 9 aa, Entamoeba dispar
AKSAPLADN

SEQ ID NO: 2412659 - protein, 6 aa, Entamoeba dispar
AKSDYE

SEQ ID NO: 2412660 - protein, 8 aa, Entamoeba dispar
AKSGMGKT

SEQ ID NO: 2412661 - protein, 4 aa, Entamoeba dispar
AKSI

SEQ ID NO: 2412662 - protein, 8 aa, Entamoeba dispar
AKSIASKL

SEQ ID NO: 2412663 - protein, 9 aa, Entamoeba dispar
AKSKEVSPI

SEQ ID NO: 2412664 - protein, 7 aa, Entamoeba dispar
AKSNKIK

SEQ ID NO: 2412665 - protein, 31 aa, Entamoeba dispar
AKSNLENKQNVKEDKKKATKTIKKADKKNQK

SEQ ID NO: 2412666 - protein, 7 aa, Entamoeba dispar
AKSNYNF

SEQ ID NO: 2412667 - protein, 9 aa, Entamoeba dispar
AKSQERKQF

SEQ ID NO: 2412668 - protein, 7 aa, Entamoeba dispar
AKSQIGD

SEQ ID NO: 2412669 - protein, 10 aa, Entamoeba dispar
AKSQKPTQEE

SEQ ID NO: 2412670 - protein, 16 aa, Entamoeba dispar
AKSQTLNDMIHDFVHY

SEQ ID NO: 2412671 - protein, 7 aa, Entamoeba dispar
AKSRNFN

SEQ ID NO: 2412672 - protein, 9 aa, Entamoeba dispar
AKSSNRSYL

SEQ ID NO: 2412673 - protein, 10 aa, Entamoeba dispar
AKSSPKEIPN

SEQ ID NO: 2412674 - protein, 7 aa, Entamoeba dispar
AKSSYDE

SEQ ID NO: 2412675 - protein, 13 aa, Entamoeba dispar
AKSTGYSAKLTKN

SEQ ID NO: 2412676 - protein, 12 aa, Entamoeba dispar
AKSTKKSTTNTF

SEQ ID NO: 2412677 - protein, 7 aa, Entamoeba dispar
AKSTNKK

SEQ ID NO: 2412678 - protein, 7 aa, Entamoeba dispar
AKSTQAI

SEQ ID NO: 2412679 - protein, 61 aa, Entamoeba dispar
AKSVVEAKNKDNENEKAALSEEIDQANEKLKNVQAELRKANADLQEANEKKAEVEAQRDKL

SEQ ID NO: 2412680 - protein, 21 aa, Entamoeba dispar
AKSWSKTTEMRIPGSTSDDNV

SEQ ID NO: 2412681 - protein, 27 aa, Entamoeba dispar
AKTAFSEPENDAKKEAAIKSYKEDRAR

SEQ ID NO: 2412682 - protein, 8 aa, Entamoeba dispar
AKTEDGQC

SEQ ID NO: 2412683 - protein, 7 aa, Entamoeba dispar
AKTEKCK

SEQ ID NO: 2412684 - protein, 11 aa, Entamoeba dispar
AKTESDAIENG

SEQ ID NO: 2412685 - protein, 7 aa, Entamoeba dispar
AKTGAGI

SEQ ID NO: 2412686 - protein, 8 aa, Entamoeba dispar
AKTGDNVD

SEQ ID NO: 2412687 - protein, 8 aa, Entamoeba dispar
AKTGEGIK

SEQ ID NO: 2412688 - protein, 8 aa, Entamoeba dispar
AKTGEGVE

SEQ ID NO: 2412689 - protein, 8 aa, Entamoeba dispar
AKTGEGVN

SEQ ID NO: 2412690 - protein, 8 aa, Entamoeba dispar
AKTGEGVQ

SEQ ID NO: 2412691 - protein, 8 aa, Entamoeba dispar
AKTGENIE

SEQ ID NO: 2412692 - protein, 7 aa, Entamoeba dispar
AKTGQNV

SEQ ID NO: 2412693 - protein, 10 aa, Entamoeba dispar
AKTGSNVKET

SEQ ID NO: 2412694 - protein, 7 aa, Entamoeba dispar
AKTGTNV

SEQ ID NO: 2412695 - protein, 7 aa, Entamoeba dispar
AKTKENI

SEQ ID NO: 2412696 - protein, 45 aa, Entamoeba dispar
AKTKEQEIRTNAEQECEREKATYIEKERNKLEADYQRRVKEAEVK

SEQ ID NO: 2412697 - protein, 12 aa, Entamoeba dispar
AKTKTKQGENDV

SEQ ID NO: 2412698 - protein, 9 aa, Entamoeba dispar
AKTKTPPKP

SEQ ID NO: 2412699 - protein, 7 aa, Entamoeba dispar
AKTLPTT

SEQ ID NO: 2412700 - protein, 12 aa, Entamoeba dispar
AKTLRNNNSSRF

SEQ ID NO: 2412701 - protein, 14 aa, Entamoeba dispar
AKTLTTSGDLTVTG

SEQ ID NO: 2412702 - protein, 7 aa, Entamoeba dispar
AKTNENI

SEQ ID NO: 2412703 - protein, 6 aa, Entamoeba dispar
AKTNGN

SEQ ID NO: 2412704 - protein, 6 aa, Entamoeba dispar
AKTNIG

SEQ ID NO: 2412705 - protein, 10 aa, Entamoeba dispar
AKTNPNELDR

SEQ ID NO: 2412706 - protein, 8 aa, Entamoeba dispar
AKTNQNIT

SEQ ID NO: 2412707 - protein, 8 aa, Entamoeba dispar
AKTNTNIA

SEQ ID NO: 2412708 - protein, 6 aa, Entamoeba dispar
AKTPER

SEQ ID NO: 2412709 - protein, 7 aa, Entamoeba dispar
AKTQKGL

SEQ ID NO: 2412710 - protein, 6 aa, Entamoeba dispar
AKTRLS

SEQ ID NO: 2412711 - protein, 7 aa, Entamoeba dispar
AKTRPKI

SEQ ID NO: 2412712 - protein, 7 aa, Entamoeba dispar
AKTSKEL

SEQ ID NO: 2412713 - protein, 62 aa, Entamoeba dispar
AKTTLEAAQRKAAKAVKIATEAKEKADNDATVAQESQKKADEAAKEAEQAVESTQKKMEEAE

SEQ ID NO: 2412714 - protein, 7 aa, Entamoeba dispar
AKTTTDI

SEQ ID NO: 2412715 - protein, 4 aa, Entamoeba dispar
AKTV

SEQ ID NO: 2412716 - protein, 5 aa, Entamoeba dispar
AKTVK

SEQ ID NO: 2412717 - protein, 5 aa, Entamoeba dispar
AKTYE

SEQ ID NO: 2412718 - protein, 7 aa, Entamoeba dispar
AKVEDGT

SEQ ID NO: 2412719 - protein, 10 aa, Entamoeba dispar
AKVEQEEPNF

SEQ ID NO: 2412720 - protein, 6 aa, Entamoeba dispar
AKVRNG

SEQ ID NO: 2412721 - protein, 7 aa, Entamoeba dispar
AKVSDVR

SEQ ID NO: 2412722 - protein, 5 aa, Entamoeba dispar
AKWSI

SEQ ID NO: 2412723 - protein, 7 aa, Entamoeba dispar
AKYEAEI

SEQ ID NO: 2412724 - protein, 7 aa, Entamoeba dispar
AKYGTRK

SEQ ID NO: 2412725 - protein, 13 aa, Entamoeba dispar
AKYNATSVQTIPN

SEQ ID NO: 2412726 - protein, 6 aa, Entamoeba dispar
AKYNSS

SEQ ID NO: 2412727 - protein, 23 aa, Entamoeba dispar
AKYPHDPPLSTEGIQQAKDLAKR

SEQ ID NO: 2412728 - protein, 7 aa, Entamoeba dispar
AKYPQIP

SEQ ID NO: 2412729 - protein, 4 aa, Entamoeba dispar
AKYQ

SEQ ID NO: 2412730 - protein, 10 aa, Entamoeba dispar
ALAGPNHSST

SEQ ID NO: 2412731 - protein, 7 aa, Entamoeba dispar
ALDDGRK

SEQ ID NO: 2412732 - protein, 7 aa, Entamoeba dispar
ALDDNNI

SEQ ID NO: 2412733 - protein, 13 aa, Entamoeba dispar
ALDEEAAKRGTTV

SEQ ID NO: 2412734 - protein, 7 aa, Entamoeba dispar
ALDGDEV

SEQ ID NO: 2412735 - protein, 8 aa, Entamoeba dispar
ALDGKNVE

SEQ ID NO: 2412736 - protein, 8 aa, Entamoeba dispar
ALDGSNVE

SEQ ID NO: 2412737 - protein, 10 aa, Entamoeba dispar
ALDGTNVETA

SEQ ID NO: 2412738 - protein, 24 aa, Entamoeba dispar
ALDKYSRKSVRELKEEVCGKEEPP

SEQ ID NO: 2412739 - protein, 6 aa, Entamoeba dispar
ALDQSK

SEQ ID NO: 2412740 - protein, 6 aa, Entamoeba dispar
ALDRPA

SEQ ID NO: 2412741 - protein, 16 aa, Entamoeba dispar
ALDTNDEAMKKKKEKF

SEQ ID NO: 2412742 - protein, 21 aa, Entamoeba dispar
ALEDANKTIQYKPDWSRGYSR

SEQ ID NO: 2412743 - protein, 27 aa, Entamoeba dispar
ALEDGNMKEKASKAKKNSGETSKIAQS

SEQ ID NO: 2412744 - protein, 9 aa, Entamoeba dispar
ALEEAGYTK

SEQ ID NO: 2412745 - protein, 27 aa, Entamoeba dispar
ALEEENEEKLKSALEELEKKKKMKDDV

SEQ ID NO: 2412746 - protein, 5 aa, Entamoeba dispar
ALEGS

SEQ ID NO: 2412747 - protein, 10 aa, Entamoeba dispar
ALEGTNVEKA

SEQ ID NO: 2412748 - protein, 8 aa, Entamoeba dispar
ALEKNSDA

SEQ ID NO: 2412749 - protein, 6 aa, Entamoeba dispar
ALEQPK

SEQ ID NO: 2412750 - protein, 17 aa, Entamoeba dispar
ALERKGRDLEKETDEIQ

SEQ ID NO: 2412751 - protein, 8 aa, Entamoeba dispar
ALERTSLD

SEQ ID NO: 2412752 - protein, 14 aa, Entamoeba dispar
ALFSREGSSVGKGK

SEQ ID NO: 2412753 - protein, 12 aa, Entamoeba dispar
ALGDEKKNEELD

SEQ ID NO: 2412754 - protein, 7 aa, Entamoeba dispar
ALGEDTP

SEQ ID NO: 2412755 - protein, 46 aa, Entamoeba dispar
ALGEEEKKEYQAKADAAKEQYKKDMEKYTGKKQVSEEEEEEGEGDS

SEQ ID NO: 2412756 - protein, 45 aa, Entamoeba dispar
ALGEEEKKEYQAKADAAREQYKKDMEKYTGKKQASEEEEEEEGDS

SEQ ID NO: 2412757 - protein, 13 aa, Entamoeba dispar
ALGKTRRVKKSNS

SEQ ID NO: 2412758 - protein, 5 aa, Entamoeba dispar
ALGNS

SEQ ID NO: 2412759 - protein, 9 aa, Entamoeba dispar
ALGTYSSKD

SEQ ID NO: 2412760 - protein, 7 aa, Entamoeba dispar
ALKEEKK

SEQ ID NO: 2412761 - protein, 12 aa, Entamoeba dispar
ALKKRSKRVNIT

SEQ ID NO: 2412762 - protein, 6 aa, Entamoeba dispar
ALKPKN

SEQ ID NO: 2412763 - protein, 8 aa, Entamoeba dispar
ALKPSEKE

SEQ ID NO: 2412764 - protein, 10 aa, Entamoeba dispar
ALKQSQSIRK

SEQ ID NO: 2412765 - protein, 7 aa, Entamoeba dispar
ALNDPHN

SEQ ID NO: 2412766 - protein, 7 aa, Entamoeba dispar
ALNETKK

SEQ ID NO: 2412767 - protein, 10 aa, Entamoeba dispar
ALNPKQIREK

SEQ ID NO: 2412768 - protein, 6 aa, Entamoeba dispar
ALNRTS

SEQ ID NO: 2412769 - protein, 9 aa, Entamoeba dispar
ALPAPRQSI

SEQ ID NO: 2412770 - protein, 6 aa, Entamoeba dispar
ALPDAA

SEQ ID NO: 2412771 - protein, 6 aa, Entamoeba dispar
ALPDRD

SEQ ID NO: 2412772 - protein, 17 aa, Entamoeba dispar
ALPEEDAKELSKTRIPA

SEQ ID NO: 2412773 - protein, 8 aa, Entamoeba dispar
ALPKEPRK

SEQ ID NO: 2412774 - protein, 6 aa, Entamoeba dispar
ALPNEG

SEQ ID NO: 2412775 - protein, 6 aa, Entamoeba dispar
ALPPEI

SEQ ID NO: 2412776 - protein, 7 aa, Entamoeba dispar
ALPPKLP

SEQ ID NO: 2412777 - protein, 8 aa, Entamoeba dispar
ALPPSEQS

SEQ ID NO: 2412778 - protein, 12 aa, Entamoeba dispar
ALPRKAKMNSAT

SEQ ID NO: 2412779 - protein, 4 aa, Entamoeba dispar
ALPS

SEQ ID NO: 2412780 - protein, 10 aa, Entamoeba dispar
ALQDSTHSDQ

SEQ ID NO: 2412781 - protein, 6 aa, Entamoeba dispar
ALQEAA

SEQ ID NO: 2412782 - protein, 55 aa, Entamoeba dispar
ALQEEKENVESSKNSTEKDKKKIEDNLKDTQKKLEDMTAENEKLKTKAKDLEAQL

SEQ ID NO: 2412783 - protein, 10 aa, Entamoeba dispar
ALQKTAKEYE

SEQ ID NO: 2412784 - protein, 12 aa, Entamoeba dispar
ALQNANEQTEES

SEQ ID NO: 2412785 - protein, 19 aa, Entamoeba dispar
ALQNQKPKDLNLGTDKSGN

SEQ ID NO: 2412786 - protein, 5 aa, Entamoeba dispar
ALQPE

SEQ ID NO: 2412787 - protein, 8 aa, Entamoeba dispar
ALQTRAKE

SEQ ID NO: 2412788 - protein, 11 aa, Entamoeba dispar
ALRKSQNNTAI

SEQ ID NO: 2412789 - protein, 10 aa, Entamoeba dispar
ALSAEERQTK

SEQ ID NO: 2412790 - protein, 6 aa, Entamoeba dispar
ALSASS

SEQ ID NO: 2412791 - protein, 7 aa, Entamoeba dispar
ALSDREK

SEQ ID NO: 2412792 - protein, 32 aa, Entamoeba dispar
ALSEDERSHYSELAKENKKRDLGDEEEKKELI

SEQ ID NO: 2412793 - protein, 6 aa, Entamoeba dispar
ALSGEV

SEQ ID NO: 2412794 - protein, 14 aa, Entamoeba dispar
ALSGSLQQHTGKSA

SEQ ID NO: 2412795 - protein, 10 aa, Entamoeba dispar
ALSKSNNNLK

SEQ ID NO: 2412796 - protein, 12 aa, Entamoeba dispar
ALSNQKYRDLQE

SEQ ID NO: 2412797 - protein, 8 aa, Entamoeba dispar
ALSSEDGV

SEQ ID NO: 2412798 - protein, 21 aa, Entamoeba dispar
ALSSSTSPDEIQKQHDTGLKP

SEQ ID NO: 2412799 - protein, 8 aa, Entamoeba dispar
ALSSTQYI

SEQ ID NO: 2412800 - protein, 5 aa, Entamoeba dispar
ALSTS

SEQ ID NO: 2412801 - protein, 9 aa, Entamoeba dispar
ALTETKEQA

SEQ ID NO: 2412802 - protein, 5 aa, Entamoeba dispar
ALTEY

SEQ ID NO: 2412803 - protein, 5 aa, Entamoeba dispar
ALTKE

SEQ ID NO: 2412804 - protein, 13 aa, Entamoeba dispar
ALTKGKKKEETKR

SEQ ID NO: 2412805 - protein, 22 aa, Entamoeba dispar
ALTKQGDGFDPDMEEDDSEVEE

SEQ ID NO: 2412806 - protein, 6 aa, Entamoeba dispar
ALTPEE

SEQ ID NO: 2412807 - protein, 5 aa, Entamoeba dispar
ALTPS

SEQ ID NO: 2412808 - protein, 6 aa, Entamoeba dispar
ALTREE

SEQ ID NO: 2412809 - protein, 6 aa, Entamoeba dispar
ALTSIP

SEQ ID NO: 2412810 - protein, 15 aa, Entamoeba dispar
ALTSPSTPAHNDYHD

SEQ ID NO: 2412811 - protein, 7 aa, Entamoeba dispar
ALTTKNG

SEQ ID NO: 2412812 - protein, 4 aa, Entamoeba dispar
ALYG

SEQ ID NO: 2412813 - protein, 16 aa, Entamoeba dispar
ALYGKTSGISSFDDQS

SEQ ID NO: 2412814 - protein, 11 aa, Entamoeba dispar
AMAESLSPDPL

SEQ ID NO: 2412815 - protein, 16 aa, Entamoeba dispar
AMDGGNASNEDDLTTQ

SEQ ID NO: 2412816 - protein, 4 aa, Entamoeba dispar
AMDN

SEQ ID NO: 2412817 - protein, 5 aa, Entamoeba dispar
AMDND

SEQ ID NO: 2412818 - protein, 12 aa, Entamoeba dispar
AMDQNEDEDKII

SEQ ID NO: 2412819 - protein, 8 aa, Entamoeba dispar
AMEPSEVE

SEQ ID NO: 2412820 - protein, 15 aa, Entamoeba dispar
AMGKRTKYQEKETAQ

SEQ ID NO: 2412821 - protein, 33 aa, Entamoeba dispar
AMKGDDEKLKEKIAKRKQEVAAARAQKEEEERL

SEQ ID NO: 2412822 - protein, 11 aa, Entamoeba dispar
AMNNESPYTRV

SEQ ID NO: 2412823 - protein, 9 aa, Entamoeba dispar
AMPPSTSIH

SEQ ID NO: 2412824 - protein, 5 aa, Entamoeba dispar
AMPTD

SEQ ID NO: 2412825 - protein, 11 aa, Entamoeba dispar
AMRGGASGVST

SEQ ID NO: 2412826 - protein, 6 aa, Entamoeba dispar
AMRKSL

SEQ ID NO: 2412827 - protein, 6 aa, Entamoeba dispar
AMSDRE

SEQ ID NO: 2412828 - protein, 10 aa, Entamoeba dispar
AMSTRKPSEL

SEQ ID NO: 2412829 - protein, 6 aa, Entamoeba dispar
AMTDPV

SEQ ID NO: 2412830 - protein, 11 aa, Entamoeba dispar
AMTEDDSGEIN

SEQ ID NO: 2412831 - protein, 5 aa, Entamoeba dispar
AMTGE

SEQ ID NO: 2412832 - protein, 7 aa, Entamoeba dispar
AMTNNGR

SEQ ID NO: 2412833 - protein, 5 aa, Entamoeba dispar
AMTPP

SEQ ID NO: 2412834 - protein, 4 aa, Entamoeba dispar
ANAD

SEQ ID NO: 2412835 - protein, 17 aa, Entamoeba dispar
ANADADLEKQAASEELD

SEQ ID NO: 2412836 - protein, 7 aa, Entamoeba dispar
ANADQNV

SEQ ID NO: 2412837 - protein, 4 aa, Entamoeba dispar
ANAG

SEQ ID NO: 2412838 - protein, 5 aa, Entamoeba dispar
ANAKG

SEQ ID NO: 2412839 - protein, 4 aa, Entamoeba dispar
ANAN

SEQ ID NO: 2412840 - protein, 17 aa, Entamoeba dispar
ANAPPPKSSHSKQIAQV

SEQ ID NO: 2412841 - protein, 15 aa, Entamoeba dispar
ANAPQGDNTAELDKA

SEQ ID NO: 2412842 - protein, 5 aa, Entamoeba dispar
ANAQL

SEQ ID NO: 2412843 - protein, 13 aa, Entamoeba dispar
ANASMSEEQIRTT

SEQ ID NO: 2412844 - protein, 9 aa, Entamoeba dispar
ANATKGQLK

SEQ ID NO: 2412845 - protein, 6 aa, Entamoeba dispar
ANATSK

SEQ ID NO: 2412846 - protein, 32 aa, Entamoeba dispar
ANAVSQTQDPGELPKGSVLENTNQPNKDNTLS

SEQ ID NO: 2412847 - protein, 8 aa, Entamoeba dispar
ANCNSNDF

SEQ ID NO: 2412848 - protein, 13 aa, Entamoeba dispar
ANCTPSAQESVTI

SEQ ID NO: 2412849 - protein, 12 aa, Entamoeba dispar
ANDESSDNNGLT

SEQ ID NO: 2412850 - protein, 4 aa, Entamoeba dispar
ANDF

SEQ ID NO: 2412851 - protein, 7 aa, Entamoeba dispar
ANDKAMK

SEQ ID NO: 2412852 - protein, 6 aa, Entamoeba dispar
ANDNNA

SEQ ID NO: 2412853 - protein, 17 aa, Entamoeba dispar
ANDRNRQATFTKRKNGL

SEQ ID NO: 2412854 - protein, 23 aa, Entamoeba dispar
ANDYQSKIGRMTTNSIPISKEEV

SEQ ID NO: 2412855 - protein, 6 aa, Entamoeba dispar
ANDYSN

SEQ ID NO: 2412856 - protein, 11 aa, Entamoeba dispar
ANDYSNGINKK

SEQ ID NO: 2412857 - protein, 10 aa, Entamoeba dispar
ANEALGAKNQ

SEQ ID NO: 2412858 - protein, 7 aa, Entamoeba dispar
ANEALTP

SEQ ID NO: 2412859 - protein, 4 aa, Entamoeba dispar
ANEC

SEQ ID NO: 2412860 - protein, 6 aa, Entamoeba dispar
ANECTK

SEQ ID NO: 2412861 - protein, 10 aa, Entamoeba dispar
ANEDDPYKRT

SEQ ID NO: 2412862 - protein, 6 aa, Entamoeba dispar
ANEDNK

SEQ ID NO: 2412863 - protein, 8 aa, Entamoeba dispar
ANEEEEKI

SEQ ID NO: 2412864 - protein, 23 aa, Entamoeba dispar
ANEEEEKTTRSCIGTGDQEEIKG

SEQ ID NO: 2412865 - protein, 6 aa, Entamoeba dispar
ANEEER

SEQ ID NO: 2412866 - protein, 14 aa, Entamoeba dispar
ANEEKQDKSISSKI

SEQ ID NO: 2412867 - protein, 6 aa, Entamoeba dispar
ANEGEY

SEQ ID NO: 2412868 - protein, 8 aa, Entamoeba dispar
ANEGPHGL

SEQ ID NO: 2412869 - protein, 5 aa, Entamoeba dispar
ANEIS

SEQ ID NO: 2412870 - protein, 7 aa, Entamoeba dispar
ANEKTDF

SEQ ID NO: 2412871 - protein, 9 aa, Entamoeba dispar
ANENTLEND

SEQ ID NO: 2412872 - protein, 9 aa, Entamoeba dispar
ANEPSEDDI

SEQ ID NO: 2412873 - protein, 8 aa, Entamoeba dispar
ANEQDGEL

SEQ ID NO: 2412874 - protein, 5 aa, Entamoeba dispar
ANEQI

SEQ ID NO: 2412875 - protein, 25 aa, Entamoeba dispar
ANEQKQKESIKKTFTQERKDRITKK

SEQ ID NO: 2412876 - protein, 10 aa, Entamoeba dispar
ANERATNKEV

SEQ ID NO: 2412877 - protein, 13 aa, Entamoeba dispar
ANERLEEDRRKRL

SEQ ID NO: 2412878 - protein, 8 aa, Entamoeba dispar
ANERNDKG

SEQ ID NO: 2412879 - protein, 4 aa, Entamoeba dispar
ANES

SEQ ID NO: 2412880 - protein, 9 aa, Entamoeba dispar
ANESHKSSQ

SEQ ID NO: 2412881 - protein, 7 aa, Entamoeba dispar
ANESSIE

SEQ ID NO: 2412882 - protein, 5 aa, Entamoeba dispar
ANESV

SEQ ID NO: 2412883 - protein, 9 aa, Entamoeba dispar
ANETEDKQR

SEQ ID NO: 2412884 - protein, 5 aa, Entamoeba dispar
ANETF

SEQ ID NO: 2412885 - protein, 6 aa, Entamoeba dispar
ANETLA

SEQ ID NO: 2412886 - protein, 6 aa, Entamoeba dispar
ANETNV

SEQ ID NO: 2412887 - protein, 5 aa, Entamoeba dispar
ANETV

SEQ ID NO: 2412888 - protein, 6 aa, Entamoeba dispar
ANFNND

SEQ ID NO: 2412889 - protein, 13 aa, Entamoeba dispar
ANFQQNDRMKEER

SEQ ID NO: 2412890 - protein, 9 aa, Entamoeba dispar
ANGCGKSNV

SEQ ID NO: 2412891 - protein, 18 aa, Entamoeba dispar
ANGEDNEIEAGIDGKVTG

SEQ ID NO: 2412892 - protein, 15 aa, Entamoeba dispar
ANGELSTALDILERG

SEQ ID NO: 2412893 - protein, 6 aa, Entamoeba dispar
ANGIDE

SEQ ID NO: 2412894 - protein, 6 aa, Entamoeba dispar
ANGIGN

SEQ ID NO: 2412895 - protein, 5 aa, Entamoeba dispar
ANGKE

SEQ ID NO: 2412896 - protein, 8 aa, Entamoeba dispar
ANGLNPDP

SEQ ID NO: 2412897 - protein, 9 aa, Entamoeba dispar
ANGNDGLTK

SEQ ID NO: 2412898 - protein, 9 aa, Entamoeba dispar
ANGNKDQTL

SEQ ID NO: 2412899 - protein, 6 aa, Entamoeba dispar
ANGNVI

SEQ ID NO: 2412900 - protein, 9 aa, Entamoeba dispar
ANGPSLMTP

SEQ ID NO: 2412901 - protein, 10 aa, Entamoeba dispar
ANGSDGMNKL

SEQ ID NO: 2412902 - protein, 10 aa, Entamoeba dispar
ANGVATGINT

SEQ ID NO: 2412903 - protein, 7 aa, Entamoeba dispar
ANGYTTE

SEQ ID NO: 2412904 - protein, 11 aa, Entamoeba dispar
ANHGDEKSLKK

SEQ ID NO: 2412905 - protein, 12 aa, Entamoeba dispar
ANHGDEKSLKKV

SEQ ID NO: 2412906 - protein, 7 aa, Entamoeba dispar
ANHRPAT

SEQ ID NO: 2412907 - protein, 5 aa, Entamoeba dispar
ANIDL

SEQ ID NO: 2412908 - protein, 12 aa, Entamoeba dispar
ANIDTVDSDKSN

SEQ ID NO: 2412909 - protein, 4 aa, Entamoeba dispar
ANIE

SEQ ID NO: 2412910 - protein, 5 aa, Entamoeba dispar
ANIEQ

SEQ ID NO: 2412911 - protein, 5 aa, Entamoeba dispar
ANIGE

SEQ ID NO: 2412912 - protein, 13 aa, Entamoeba dispar
ANIGTTGIKQPIK

SEQ ID NO: 2412913 - protein, 10 aa, Entamoeba dispar
ANINPTNELE

SEQ ID NO: 2412914 - protein, 6 aa, Entamoeba dispar
ANINVA

SEQ ID NO: 2412915 - protein, 13 aa, Entamoeba dispar
ANINVANKAKNTA

SEQ ID NO: 2412916 - protein, 7 aa, Entamoeba dispar
ANIPDQS

SEQ ID NO: 2412917 - protein, 5 aa, Entamoeba dispar
ANKDN

SEQ ID NO: 2412918 - protein, 6 aa, Entamoeba dispar
ANKDQQ

SEQ ID NO: 2412919 - protein, 9 aa, Entamoeba dispar
ANKEMDDNM

SEQ ID NO: 2412920 - protein, 10 aa, Entamoeba dispar
ANKENEEALN

SEQ ID NO: 2412921 - protein, 12 aa, Entamoeba dispar
ANKENKQKITNL

SEQ ID NO: 2412922 - protein, 5 aa, Entamoeba dispar
ANKER

SEQ ID NO: 2412923 - protein, 7 aa, Entamoeba dispar
ANKGTLT

SEQ ID NO: 2412924 - protein, 12 aa, Entamoeba dispar
ANKGVKKGMETN

SEQ ID NO: 2412925 - protein, 7 aa, Entamoeba dispar
ANKISAE

SEQ ID NO: 2412926 - protein, 8 aa, Entamoeba dispar
ANKNDIDP

SEQ ID NO: 2412927 - protein, 6 aa, Entamoeba dispar
ANKRPE

SEQ ID NO: 2412928 - protein, 5 aa, Entamoeba dispar
ANKSQ

SEQ ID NO: 2412929 - protein, 5 aa, Entamoeba dispar
ANKTM

SEQ ID NO: 2412930 - protein, 6 aa, Entamoeba dispar
ANKTSL

SEQ ID NO: 2412931 - protein, 9 aa, Entamoeba dispar
ANLENEYGK

SEQ ID NO: 2412932 - protein, 12 aa, Entamoeba dispar
ANLKSAPEKFQD

SEQ ID NO: 2412933 - protein, 11 aa, Entamoeba dispar
ANLRSDSHTRY

SEQ ID NO: 2412934 - protein, 4 aa, Entamoeba dispar
ANMG

SEQ ID NO: 2412935 - protein, 16 aa, Entamoeba dispar
ANMNDRSLRGDRDTEI

SEQ ID NO: 2412936 - protein, 4 aa, Entamoeba dispar
ANNE

SEQ ID NO: 2412937 - protein, 7 aa, Entamoeba dispar
ANNEALR

SEQ ID NO: 2412938 - protein, 8 aa, Entamoeba dispar
ANNEPSQA

SEQ ID NO: 2412939 - protein, 9 aa, Entamoeba dispar
ANNKTNYGE

SEQ ID NO: 2412940 - protein, 5 aa, Entamoeba dispar
ANNLG

SEQ ID NO: 2412941 - protein, 8 aa, Entamoeba dispar
ANNPKMKD

SEQ ID NO: 2412942 - protein, 5 aa, Entamoeba dispar
ANNRA

SEQ ID NO: 2412943 - protein, 6 aa, Entamoeba dispar
ANNSGV

SEQ ID NO: 2412944 - protein, 5 aa, Entamoeba dispar
ANNSK

SEQ ID NO: 2412945 - protein, 5 aa, Entamoeba dispar
ANNSL

SEQ ID NO: 2412946 - protein, 7 aa, Entamoeba dispar
ANNSTYS

SEQ ID NO: 2412947 - protein, 9 aa, Entamoeba dispar
ANNYPHKRP

SEQ ID NO: 2412948 - protein, 14 aa, Entamoeba dispar
ANPAILDSQKNNAL

SEQ ID NO: 2412949 - protein, 8 aa, Entamoeba dispar
ANPATGRI

SEQ ID NO: 2412950 - protein, 8 aa, Entamoeba dispar
ANPGGKIK

SEQ ID NO: 2412951 - protein, 14 aa, Entamoeba dispar
ANPIDNASTGPIIT

SEQ ID NO: 2412952 - protein, 7 aa, Entamoeba dispar
ANPIKAR

SEQ ID NO: 2412953 - protein, 19 aa, Entamoeba dispar
ANPLKGRYDSNRSLKSNLN

SEQ ID NO: 2412954 - protein, 7 aa, Entamoeba dispar
ANPNKDE

SEQ ID NO: 2412955 - protein, 6 aa, Entamoeba dispar
ANPSNY

SEQ ID NO: 2412956 - protein, 14 aa, Entamoeba dispar
ANPTISKEIKDQVN

SEQ ID NO: 2412957 - protein, 9 aa, Entamoeba dispar
ANPTRSTYQ

SEQ ID NO: 2412958 - protein, 6 aa, Entamoeba dispar
ANPVEG

SEQ ID NO: 2412959 - protein, 14 aa, Entamoeba dispar
ANPVINDETFFNSH

SEQ ID NO: 2412960 - protein, 7 aa, Entamoeba dispar
ANPYEKM

SEQ ID NO: 2412961 - protein, 7 aa, Entamoeba dispar
ANQAKEI

SEQ ID NO: 2412962 - protein, 21 aa, Entamoeba dispar
ANQDDRADNVIPGTKQNHLDT

SEQ ID NO: 2412963 - protein, 5 aa, Entamoeba dispar
ANQEM

SEQ ID NO: 2412964 - protein, 6 aa, Entamoeba dispar
ANQGHS

SEQ ID NO: 2412965 - protein, 16 aa, Entamoeba dispar
ANQITTISPIQESSSC

SEQ ID NO: 2412966 - protein, 7 aa, Entamoeba dispar
ANQKPQD

SEQ ID NO: 2412967 - protein, 9 aa, Entamoeba dispar
ANQNASRVT

SEQ ID NO: 2412968 - protein, 5 aa, Entamoeba dispar
ANQNT

SEQ ID NO: 2412969 - protein, 24 aa, Entamoeba dispar
ANQPEQNPLENQQNSTENQQTVGS

SEQ ID NO: 2412970 - protein, 6 aa, Entamoeba dispar
ANQRKE

SEQ ID NO: 2412971 - protein, 9 aa, Entamoeba dispar
ANQSATRNY

SEQ ID NO: 2412972 - protein, 10 aa, Entamoeba dispar
ANQVANSPNL

SEQ ID NO: 2412973 - protein, 5 aa, Entamoeba dispar
ANQYS

SEQ ID NO: 2412974 - protein, 11 aa, Entamoeba dispar
ANRDNPDDLQN

SEQ ID NO: 2412975 - protein, 5 aa, Entamoeba dispar
ANRPR

SEQ ID NO: 2412976 - protein, 4 aa, Entamoeba dispar
ANRR

SEQ ID NO: 2412977 - protein, 23 aa, Entamoeba dispar
ANRRKDIEADTSEEEDDDDDEWS

SEQ ID NO: 2412978 - protein, 7 aa, Entamoeba dispar
ANRTEST

SEQ ID NO: 2412979 - protein, 9 aa, Entamoeba dispar
ANSGAVGAR

SEQ ID NO: 2412980 - protein, 7 aa, Entamoeba dispar
ANSGGVN

SEQ ID NO: 2412981 - protein, 7 aa, Entamoeba dispar
ANSGRQI

SEQ ID NO: 2412982 - protein, 9 aa, Entamoeba dispar
ANSITGNPL

SEQ ID NO: 2412983 - protein, 8 aa, Entamoeba dispar
ANSKNPRN

SEQ ID NO: 2412984 - protein, 8 aa, Entamoeba dispar
ANSPEERA

SEQ ID NO: 2412985 - protein, 8 aa, Entamoeba dispar
ANSPGELI

SEQ ID NO: 2412986 - protein, 7 aa, Entamoeba dispar
ANSQPKQ

SEQ ID NO: 2412987 - protein, 5 aa, Entamoeba dispar
ANSQY

SEQ ID NO: 2412988 - protein, 14 aa, Entamoeba dispar
ANSRTNARWEDRSN

SEQ ID NO: 2412989 - protein, 4 aa, Entamoeba dispar
ANSS

SEQ ID NO: 2412990 - protein, 6 aa, Entamoeba dispar
ANSSMG

SEQ ID NO: 2412991 - protein, 9 aa, Entamoeba dispar
ANSSTKKMH

SEQ ID NO: 2412992 - protein, 9 aa, Entamoeba dispar
ANSTEGNNT

SEQ ID NO: 2412993 - protein, 7 aa, Entamoeba dispar
ANTERTR

SEQ ID NO: 2412994 - protein, 11 aa, Entamoeba dispar
ANTIGTGKKDV

SEQ ID NO: 2412995 - protein, 6 aa, Entamoeba dispar
ANTKNF

SEQ ID NO: 2412996 - protein, 7 aa, Entamoeba dispar
ANTPLTK

SEQ ID NO: 2412997 - protein, 7 aa, Entamoeba dispar
ANTPNQS

SEQ ID NO: 2412998 - protein, 6 aa, Entamoeba dispar
ANTQQI

SEQ ID NO: 2412999 - protein, 6 aa, Entamoeba dispar
ANTQRY

SEQ ID NO: 2413000 - protein, 8 aa, Entamoeba dispar
ANTRKARH

SEQ ID NO: 2413001 - protein, 6 aa, Entamoeba dispar
ANTSFS

SEQ ID NO: 2413002 - protein, 9 aa, Entamoeba dispar
ANTSSCHSS

SEQ ID NO: 2413003 - protein, 9 aa, Entamoeba dispar
ANTTTSPQY

SEQ ID NO: 2413004 - protein, 9 aa, Entamoeba dispar
ANTTVDGKQ

SEQ ID NO: 2413005 - protein, 4 aa, Entamoeba dispar
ANTY

SEQ ID NO: 2413006 - protein, 12 aa, Entamoeba dispar
ANTYNSNSKVRG

SEQ ID NO: 2413007 - protein, 5 aa, Entamoeba dispar
ANVAK

SEQ ID NO: 2413008 - protein, 6 aa, Entamoeba dispar
ANVGDS

SEQ ID NO: 2413009 - protein, 10 aa, Entamoeba dispar
ANVKVSDMKE

SEQ ID NO: 2413010 - protein, 13 aa, Entamoeba dispar
ANVNACDENRYSP

SEQ ID NO: 2413011 - protein, 8 aa, Entamoeba dispar
ANVTNPND

SEQ ID NO: 2413012 - protein, 7 aa, Entamoeba dispar
ANYNSKS

SEQ ID NO: 2413013 - protein, 13 aa, Entamoeba dispar
ANYTTSDGRKNLE

SEQ ID NO: 2413014 - protein, 6 aa, Entamoeba dispar
APAQNI

SEQ ID NO: 2413015 - protein, 11 aa, Entamoeba dispar
APATSSQDTTK

SEQ ID NO: 2413016 - protein, 4 aa, Entamoeba dispar
APCA

SEQ ID NO: 2413017 - protein, 5 aa, Entamoeba dispar
APCNV

SEQ ID NO: 2413018 - protein, 17 aa, Entamoeba dispar
APCSGNEPVPDSYSGAA

SEQ ID NO: 2413019 - protein, 10 aa, Entamoeba dispar
APDEQTNDEW

SEQ ID NO: 2413020 - protein, 8 aa, Entamoeba dispar
APDIKQAN

SEQ ID NO: 2413021 - protein, 6 aa, Entamoeba dispar
APDVTG

SEQ ID NO: 2413022 - protein, 4 aa, Entamoeba dispar
APEA

SEQ ID NO: 2413023 - protein, 6 aa, Entamoeba dispar
APEAAA

SEQ ID NO: 2413024 - protein, 4 aa, Entamoeba dispar
APEC

SEQ ID NO: 2413025 - protein, 20 aa, Entamoeba dispar
APEDDIKTEKKVAQNKRRVT

SEQ ID NO: 2413026 - protein, 10 aa, Entamoeba dispar
APEFKKAGKS

SEQ ID NO: 2413027 - protein, 8 aa, Entamoeba dispar
APEGATKI

SEQ ID NO: 2413028 - protein, 7 aa, Entamoeba dispar
APEGITK

SEQ ID NO: 2413029 - protein, 7 aa, Entamoeba dispar
APEKKLH

SEQ ID NO: 2413030 - protein, 15 aa, Entamoeba dispar
APELTDSMKKQLKEE

SEQ ID NO: 2413031 - protein, 5 aa, Entamoeba dispar
APENY

SEQ ID NO: 2413032 - protein, 7 aa, Entamoeba dispar
APENYKD

SEQ ID NO: 2413033 - protein, 6 aa, Entamoeba dispar
APEQTF

SEQ ID NO: 2413034 - protein, 8 aa, Entamoeba dispar
APESIQPS

SEQ ID NO: 2413035 - protein, 11 aa, Entamoeba dispar
APEVNSGNTYD

SEQ ID NO: 2413036 - protein, 6 aa, Entamoeba dispar
APEYTP

SEQ ID NO: 2413037 - protein, 4 aa, Entamoeba dispar
APFF

SEQ ID NO: 2413038 - protein, 5 aa, Entamoeba dispar
APFIP

SEQ ID NO: 2413039 - protein, 7 aa, Entamoeba dispar
APGEEPK

SEQ ID NO: 2413040 - protein, 7 aa, Entamoeba dispar
APGEVGK

SEQ ID NO: 2413041 - protein, 9 aa, Entamoeba dispar
APGFGETRK

SEQ ID NO: 2413042 - protein, 8 aa, Entamoeba dispar
APGGKTTH

SEQ ID NO: 2413043 - protein, 4 aa, Entamoeba dispar
APGI

SEQ ID NO: 2413044 - protein, 14 aa, Entamoeba dispar
APGLHDDNHTSVGS

SEQ ID NO: 2413045 - protein, 13 aa, Entamoeba dispar
APGLHDDNLTSIG

SEQ ID NO: 2413046 - protein, 4 aa, Entamoeba dispar
APGN

SEQ ID NO: 2413047 - protein, 7 aa, Entamoeba dispar
APGQTKE

SEQ ID NO: 2413048 - protein, 4 aa, Entamoeba dispar
APGS

SEQ ID NO: 2413049 - protein, 8 aa, Entamoeba dispar
APGSKTSQ

SEQ ID NO: 2413050 - protein, 10 aa, Entamoeba dispar
APGSKTSQLV

SEQ ID NO: 2413051 - protein, 8 aa, Entamoeba dispar
APGSKTTQ

SEQ ID NO: 2413052 - protein, 15 aa, Entamoeba dispar
APGSLNELREEGRRL

SEQ ID NO: 2413053 - protein, 8 aa, Entamoeba dispar
APGSSGIG

SEQ ID NO: 2413054 - protein, 6 aa, Entamoeba dispar
APGSWS

SEQ ID NO: 2413055 - protein, 10 aa, Entamoeba dispar
APGTKVKPDD

SEQ ID NO: 2413056 - protein, 5 aa, Entamoeba dispar
APHCS

SEQ ID NO: 2413057 - protein, 13 aa, Entamoeba dispar
APHPSPLAKGGFD

SEQ ID NO: 2413058 - protein, 6 aa, Entamoeba dispar
APIDPD

SEQ ID NO: 2413059 - protein, 6 aa, Entamoeba dispar
APIEPK

SEQ ID NO: 2413060 - protein, 12 aa, Entamoeba dispar
APIKKEKEVEID

SEQ ID NO: 2413061 - protein, 6 aa, Entamoeba dispar
APINNK

SEQ ID NO: 2413062 - protein, 26 aa, Entamoeba dispar
APIPDSNPVGKSDDVDDLLARMNALK

SEQ ID NO: 2413063 - protein, 5 aa, Entamoeba dispar
APIQG

SEQ ID NO: 2413064 - protein, 9 aa, Entamoeba dispar
APISEEIKE

SEQ ID NO: 2413065 - protein, 7 aa, Entamoeba dispar
APISVEG

SEQ ID NO: 2413066 - protein, 4 aa, Entamoeba dispar
APKE

SEQ ID NO: 2413067 - protein, 7 aa, Entamoeba dispar
APKEDIE

SEQ ID NO: 2413068 - protein, 9 aa, Entamoeba dispar
APKGEPLPI

SEQ ID NO: 2413069 - protein, 16 aa, Entamoeba dispar
APKKHTTTKPTKRDVA

SEQ ID NO: 2413070 - protein, 6 aa, Entamoeba dispar
APKKMD

SEQ ID NO: 2413071 - protein, 5 aa, Entamoeba dispar
APKLG

SEQ ID NO: 2413072 - protein, 4 aa, Entamoeba dispar
APKS

SEQ ID NO: 2413073 - protein, 9 aa, Entamoeba dispar
APKSEQTRV

SEQ ID NO: 2413074 - protein, 14 aa, Entamoeba dispar
APKSSNRFEKKRQL

SEQ ID NO: 2413075 - protein, 17 aa, Entamoeba dispar
APKSSSSEPLNNTTAEL

SEQ ID NO: 2413076 - protein, 4 aa, Entamoeba dispar
APKT

SEQ ID NO: 2413077 - protein, 4 aa, Entamoeba dispar
APKV

SEQ ID NO: 2413078 - protein, 9 aa, Entamoeba dispar
APLESTATS

SEQ ID NO: 2413079 - protein, 4 aa, Entamoeba dispar
APLN

SEQ ID NO: 2413080 - protein, 6 aa, Entamoeba dispar
APLPEQ

SEQ ID NO: 2413081 - protein, 8 aa, Entamoeba dispar
APLPSSTP

SEQ ID NO: 2413082 - protein, 8 aa, Entamoeba dispar
APLPTQTS

SEQ ID NO: 2413083 - protein, 4 aa, Entamoeba dispar
APLT

SEQ ID NO: 2413084 - protein, 5 aa, Entamoeba dispar
APLTE

SEQ ID NO: 2413085 - protein, 8 aa, Entamoeba dispar
APLTPSSR

SEQ ID NO: 2413086 - protein, 6 aa, Entamoeba dispar
APLTSY

SEQ ID NO: 2413087 - protein, 6 aa, Entamoeba dispar
APNAEI

SEQ ID NO: 2413088 - protein, 11 aa, Entamoeba dispar
APNDESPANVD

SEQ ID NO: 2413089 - protein, 9 aa, Entamoeba dispar
APNESAPVH

SEQ ID NO: 2413090 - protein, 8 aa, Entamoeba dispar
APNGNGGL

SEQ ID NO: 2413091 - protein, 5 aa, Entamoeba dispar
APNKM

SEQ ID NO: 2413092 - protein, 12 aa, Entamoeba dispar
APNKNYVRGYKK

SEQ ID NO: 2413093 - protein, 10 aa, Entamoeba dispar
APNKQSKGVN

SEQ ID NO: 2413094 - protein, 7 aa, Entamoeba dispar
APNPNTV

SEQ ID NO: 2413095 - protein, 4 aa, Entamoeba dispar
APPA

SEQ ID NO: 2413096 - protein, 4 aa, Entamoeba dispar
APPE

SEQ ID NO: 2413097 - protein, 6 aa, Entamoeba dispar
APPEEE

SEQ ID NO: 2413098 - protein, 5 aa, Entamoeba dispar
APPEI

SEQ ID NO: 2413099 - protein, 5 aa, Entamoeba dispar
APPFS

SEQ ID NO: 2413100 - protein, 6 aa, Entamoeba dispar
APPFTC

SEQ ID NO: 2413101 - protein, 7 aa, Entamoeba dispar
APPGKVY

SEQ ID NO: 2413102 - protein, 17 aa, Entamoeba dispar
APPGYVGYEEGGQLTEA

SEQ ID NO: 2413103 - protein, 4 aa, Entamoeba dispar
APPI

SEQ ID NO: 2413104 - protein, 12 aa, Entamoeba dispar
APPKENSLNKTI

SEQ ID NO: 2413105 - protein, 9 aa, Entamoeba dispar
APPKTNEED

SEQ ID NO: 2413106 - protein, 7 aa, Entamoeba dispar
APPLPEQ

SEQ ID NO: 2413107 - protein, 6 aa, Entamoeba dispar
APPLQQ

SEQ ID NO: 2413108 - protein, 8 aa, Entamoeba dispar
APPNSLKT

SEQ ID NO: 2413109 - protein, 10 aa, Entamoeba dispar
APPPPPPSKI

SEQ ID NO: 2413110 - protein, 11 aa, Entamoeba dispar
APPPPSFTKPT

SEQ ID NO: 2413111 - protein, 6 aa, Entamoeba dispar
APPPSI

SEQ ID NO: 2413112 - protein, 73 aa, Entamoeba dispar
APPRGMPPRGGPRGAPSRGSPAPRGMPSRGASTGGMMPPPPPSNCPPPPPSNNLPPPGPANVPPPSSGGRGDL

SEQ ID NO: 2413113 - protein, 53 aa, Entamoeba dispar
APPRGMPSRGASTGGMMPPPPPSNCPPPPPSNNLPPPGPANVPPPSSGGRGDL

SEQ ID NO: 2413114 - protein, 36 aa, Entamoeba dispar
APPRGMPSRGGPRGAPPRGMPPRGGPRGAPRGRGAA

SEQ ID NO: 2413115 - protein, 51 aa, Entamoeba dispar
APPRGMPSRGGPRGAPPRGMPPRGGPRGAPRGRGGMMPPAQAPEHEEQETP

SEQ ID NO: 2413116 - protein, 73 aa, Entamoeba dispar
APPRGMPSRGGPRGAPSRGSPAPRGMPSRGASTGGMMPPPPPSNCPPPPPSNNLPPPGPANVPPPSSGGRGDL

SEQ ID NO: 2413117 - protein, 9 aa, Entamoeba dispar
APPVPAPRR

SEQ ID NO: 2413118 - protein, 12 aa, Entamoeba dispar
APPVPAPRRGLT

SEQ ID NO: 2413119 - protein, 5 aa, Entamoeba dispar
APQAK

SEQ ID NO: 2413120 - protein, 5 aa, Entamoeba dispar
APQKE

SEQ ID NO: 2413121 - protein, 10 aa, Entamoeba dispar
APQKEIEEKL

SEQ ID NO: 2413122 - protein, 52 aa, Entamoeba dispar
APQKEISNEEYQDEEEIRKEKEEKEQKVQAEREAEEKRKKEEEEKKTKVEKM

SEQ ID NO: 2413123 - protein, 6 aa, Entamoeba dispar
APQKSL

SEQ ID NO: 2413124 - protein, 7 aa, Entamoeba dispar
APQLPPK

SEQ ID NO: 2413125 - protein, 5 aa, Entamoeba dispar
APQMP

SEQ ID NO: 2413126 - protein, 5 aa, Entamoeba dispar
APQMT

SEQ ID NO: 2413127 - protein, 5 aa, Entamoeba dispar
APQNQ

SEQ ID NO: 2413128 - protein, 7 aa, Entamoeba dispar
APQPNEK

SEQ ID NO: 2413129 - protein, 16 aa, Entamoeba dispar
APQPRRPNKAAPIPKK

SEQ ID NO: 2413130 - protein, 7 aa, Entamoeba dispar
APQQCER

SEQ ID NO: 2413131 - protein, 5 aa, Entamoeba dispar
APQRV

SEQ ID NO: 2413132 - protein, 4 aa, Entamoeba dispar
APQW

SEQ ID NO: 2413133 - protein, 19 aa, Entamoeba dispar
APRGRGARKDGASDGWTPV

SEQ ID NO: 2413134 - protein, 8 aa, Entamoeba dispar
APRGVTSE

SEQ ID NO: 2413135 - protein, 6 aa, Entamoeba dispar
APRQCS

SEQ ID NO: 2413136 - protein, 7 aa, Entamoeba dispar
APRQRNT

SEQ ID NO: 2413137 - protein, 6 aa, Entamoeba dispar
APRSSL

SEQ ID NO: 2413138 - protein, 7 aa, Entamoeba dispar
APSAEAV

SEQ ID NO: 2413139 - protein, 4 aa, Entamoeba dispar
APSD

SEQ ID NO: 2413140 - protein, 9 aa, Entamoeba dispar
APSDKDKLA

SEQ ID NO: 2413141 - protein, 4 aa, Entamoeba dispar
APSE

SEQ ID NO: 2413142 - protein, 18 aa, Entamoeba dispar
APSITEREERLNSIRSKQ

SEQ ID NO: 2413143 - protein, 9 aa, Entamoeba dispar
APSKYDPNL

SEQ ID NO: 2413144 - protein, 7 aa, Entamoeba dispar
APSLPKI

SEQ ID NO: 2413145 - protein, 8 aa, Entamoeba dispar
APSNEDSG

SEQ ID NO: 2413146 - protein, 5 aa, Entamoeba dispar
APSNP

SEQ ID NO: 2413147 - protein, 7 aa, Entamoeba dispar
APSPENV

SEQ ID NO: 2413148 - protein, 5 aa, Entamoeba dispar
APSPQ

SEQ ID NO: 2413149 - protein, 7 aa, Entamoeba dispar
APSQKNL

SEQ ID NO: 2413150 - protein, 10 aa, Entamoeba dispar
APSRAAPRPV

SEQ ID NO: 2413151 - protein, 12 aa, Entamoeba dispar
APSSLSNTDSFE

SEQ ID NO: 2413152 - protein, 57 aa, Entamoeba dispar
APSSVSSTPTISPISTPSKSKEETPRRYPTNSITSESMSETPKPSLKQSKTEKHKSF

SEQ ID NO: 2413153 - protein, 7 aa, Entamoeba dispar
APSTPNK

SEQ ID NO: 2413154 - protein, 8 aa, Entamoeba dispar
APSVENRN

SEQ ID NO: 2413155 - protein, 5 aa, Entamoeba dispar
APSYP

SEQ ID NO: 2413156 - protein, 10 aa, Entamoeba dispar
APTAVNKQET

SEQ ID NO: 2413157 - protein, 28 aa, Entamoeba dispar
APTDKSNDKKSHKKEGKKEKGEKKKCVF

SEQ ID NO: 2413158 - protein, 12 aa, Entamoeba dispar
APTDSLSRRTLD

SEQ ID NO: 2413159 - protein, 20 aa, Entamoeba dispar
APTEQQSLNENNQITANHHP

SEQ ID NO: 2413160 - protein, 5 aa, Entamoeba dispar
APTFA

SEQ ID NO: 2413161 - protein, 5 aa, Entamoeba dispar
APTFS

SEQ ID NO: 2413162 - protein, 5 aa, Entamoeba dispar
APTGH

SEQ ID NO: 2413163 - protein, 6 aa, Entamoeba dispar
APTIDV

SEQ ID NO: 2413164 - protein, 13 aa, Entamoeba dispar
APTKKSPSPSSQS

SEQ ID NO: 2413165 - protein, 33 aa, Entamoeba dispar
APTLRKSNTSRISTLPPSRTRSSLTAKNDFEKG

SEQ ID NO: 2413166 - protein, 8 aa, Entamoeba dispar
APTRRMKD

SEQ ID NO: 2413167 - protein, 5 aa, Entamoeba dispar
APTSL

SEQ ID NO: 2413168 - protein, 10 aa, Entamoeba dispar
APTTPKSHSN

SEQ ID NO: 2413169 - protein, 15 aa, Entamoeba dispar
APVAAAAKTIEGGAK

SEQ ID NO: 2413170 - protein, 10 aa, Entamoeba dispar
APVNKEQYKT

SEQ ID NO: 2413171 - protein, 6 aa, Entamoeba dispar
APVSEK

SEQ ID NO: 2413172 - protein, 5 aa, Entamoeba dispar
APVSS

SEQ ID NO: 2413173 - protein, 6 aa, Entamoeba dispar
APVSSL

SEQ ID NO: 2413174 - protein, 9 aa, Entamoeba dispar
APVSVPTSS

SEQ ID NO: 2413175 - protein, 6 aa, Entamoeba dispar
APYDDD

SEQ ID NO: 2413176 - protein, 18 aa, Entamoeba dispar
APYDERKITQAEKERIQR

SEQ ID NO: 2413177 - protein, 7 aa, Entamoeba dispar
APYGSTY

SEQ ID NO: 2413178 - protein, 16 aa, Entamoeba dispar
AQAAAIAAARDPKNII

SEQ ID NO: 2413179 - protein, 7 aa, Entamoeba dispar
AQADNKK

SEQ ID NO: 2413180 - protein, 29 aa, Entamoeba dispar
AQAKKESASRGLKAARAAAKAKKEAEVKT

SEQ ID NO: 2413181 - protein, 10 aa, Entamoeba dispar
AQAKLGNHPI

SEQ ID NO: 2413182 - protein, 7 aa, Entamoeba dispar
AQAPSIP

SEQ ID NO: 2413183 - protein, 9 aa, Entamoeba dispar
AQASAKDQH

SEQ ID NO: 2413184 - protein, 8 aa, Entamoeba dispar
AQASGNKE

SEQ ID NO: 2413185 - protein, 6 aa, Entamoeba dispar
AQASSL

SEQ ID NO: 2413186 - protein, 9 aa, Entamoeba dispar
AQAVNSPER

SEQ ID NO: 2413187 - protein, 9 aa, Entamoeba dispar
AQDAEPNFS

SEQ ID NO: 2413188 - protein, 5 aa, Entamoeba dispar
AQDDV

SEQ ID NO: 2413189 - protein, 8 aa, Entamoeba dispar
AQDPSRAK

SEQ ID NO: 2413190 - protein, 27 aa, Entamoeba dispar
AQDVKQKQDDVQRQKEQLDKELKEKEA

SEQ ID NO: 2413191 - protein, 9 aa, Entamoeba dispar
AQEDIRKST

SEQ ID NO: 2413192 - protein, 8 aa, Entamoeba dispar
AQEDLDPR

SEQ ID NO: 2413193 - protein, 20 aa, Entamoeba dispar
AQEEDSSLDDSSVFSDDESL

SEQ ID NO: 2413194 - protein, 12 aa, Entamoeba dispar
AQEENKKKSIND

SEQ ID NO: 2413195 - protein, 7 aa, Entamoeba dispar
AQEHGAS

SEQ ID NO: 2413196 - protein, 26 aa, Entamoeba dispar
AQEIGSKGDSPILQNQPSEEVSGNCC

SEQ ID NO: 2413197 - protein, 12 aa, Entamoeba dispar
AQEIHPNGPVRG

SEQ ID NO: 2413198 - protein, 6 aa, Entamoeba dispar
AQEKIN

SEQ ID NO: 2413199 - protein, 6 aa, Entamoeba dispar
AQEKLE

SEQ ID NO: 2413200 - protein, 5 aa, Entamoeba dispar
AQERN

SEQ ID NO: 2413201 - protein, 8 aa, Entamoeba dispar
AQESPSID

SEQ ID NO: 2413202 - protein, 12 aa, Entamoeba dispar
AQETGIGAQYGG

SEQ ID NO: 2413203 - protein, 8 aa, Entamoeba dispar
AQEWNQTT

SEQ ID NO: 2413204 - protein, 13 aa, Entamoeba dispar
AQFEATKTEEIKT

SEQ ID NO: 2413205 - protein, 4 aa, Entamoeba dispar
AQFQ

SEQ ID NO: 2413206 - protein, 12 aa, Entamoeba dispar
AQFTDSKSKITF

SEQ ID NO: 2413207 - protein, 7 aa, Entamoeba dispar
AQFTTEK

SEQ ID NO: 2413208 - protein, 5 aa, Entamoeba dispar
AQGEG

SEQ ID NO: 2413209 - protein, 4 aa, Entamoeba dispar
AQGK

SEQ ID NO: 2413210 - protein, 8 aa, Entamoeba dispar
AQGKPGLQ

SEQ ID NO: 2413211 - protein, 9 aa, Entamoeba dispar
AQGKSVSLQ

SEQ ID NO: 2413212 - protein, 10 aa, Entamoeba dispar
AQGLPENKPR

SEQ ID NO: 2413213 - protein, 10 aa, Entamoeba dispar
AQGLSKETEI

SEQ ID NO: 2413214 - protein, 23 aa, Entamoeba dispar
AQGNAPNKSKSKKLSKESTNEYG

SEQ ID NO: 2413215 - protein, 16 aa, Entamoeba dispar
AQGNNNGNHFNNENKT

SEQ ID NO: 2413216 - protein, 10 aa, Entamoeba dispar
AQGRKVSKEI

SEQ ID NO: 2413217 - protein, 4 aa, Entamoeba dispar
AQHG

SEQ ID NO: 2413218 - protein, 8 aa, Entamoeba dispar
AQHGSQKE

SEQ ID NO: 2413219 - protein, 6 aa, Entamoeba dispar
AQHRGK

SEQ ID NO: 2413220 - protein, 7 aa, Entamoeba dispar
AQHSGTL

SEQ ID NO: 2413221 - protein, 26 aa, Entamoeba dispar
AQIEEDENNEMEFEDSSDTEYEDPSS

SEQ ID NO: 2413222 - protein, 23 aa, Entamoeba dispar
AQIENEKQKRLKADSLKEEQIKE

SEQ ID NO: 2413223 - protein, 12 aa, Entamoeba dispar
AQIGKEAPEFKA

SEQ ID NO: 2413224 - protein, 4 aa, Entamoeba dispar
AQIT

SEQ ID NO: 2413225 - protein, 11 aa, Entamoeba dispar
AQIYNNNPRNI

SEQ ID NO: 2413226 - protein, 34 aa, Entamoeba dispar
AQKAKEYEQKRKEEKEKKKQQQKPQQLQKEKSIK

SEQ ID NO: 2413227 - protein, 8 aa, Entamoeba dispar
AQKASQVG

SEQ ID NO: 2413228 - protein, 4 aa, Entamoeba dispar
AQKD

SEQ ID NO: 2413229 - protein, 5 aa, Entamoeba dispar
AQKDK

SEQ ID NO: 2413230 - protein, 9 aa, Entamoeba dispar
AQKGTFEDK

SEQ ID NO: 2413231 - protein, 24 aa, Entamoeba dispar
AQKINEKPQTIADYESGRAIPSQQ

SEQ ID NO: 2413232 - protein, 5 aa, Entamoeba dispar
AQKIS

SEQ ID NO: 2413233 - protein, 6 aa, Entamoeba dispar
AQKPLE

SEQ ID NO: 2413234 - protein, 13 aa, Entamoeba dispar
AQKQGLKGFQPGN

SEQ ID NO: 2413235 - protein, 6 aa, Entamoeba dispar
AQKQLS

SEQ ID NO: 2413236 - protein, 6 aa, Entamoeba dispar
AQKRKL

SEQ ID NO: 2413237 - protein, 74 aa, Entamoeba dispar
AQKRRMSESSDQEVGGKRKGDTMSPSYDPHTTTTFGSTTTNNSNKQDKNISQSISGITNTPLQGQVSDDTPDKQ

SEQ ID NO: 2413238 - protein, 8 aa, Entamoeba dispar
AQKTGNWR

SEQ ID NO: 2413239 - protein, 6 aa, Entamoeba dispar
AQKVKE

SEQ ID NO: 2413240 - protein, 19 aa, Entamoeba dispar
AQKVNDAQEKLIKSMKTQQ

SEQ ID NO: 2413241 - protein, 7 aa, Entamoeba dispar
AQKVTTK

SEQ ID NO: 2413242 - protein, 4 aa, Entamoeba dispar
AQLA

SEQ ID NO: 2413243 - protein, 17 aa, Entamoeba dispar
AQLEKTDTPAIKQTAIN

SEQ ID NO: 2413244 - protein, 13 aa, Entamoeba dispar
AQLGNSNAQPNEA

SEQ ID NO: 2413245 - protein, 13 aa, Entamoeba dispar
AQLPGMNGDENNR

SEQ ID NO: 2413246 - protein, 6 aa, Entamoeba dispar
AQLPGS

SEQ ID NO: 2413247 - protein, 9 aa, Entamoeba dispar
AQMKESVKN

SEQ ID NO: 2413248 - protein, 4 aa, Entamoeba dispar
AQMQ

SEQ ID NO: 2413249 - protein, 7 aa, Entamoeba dispar
AQMSTYK

SEQ ID NO: 2413250 - protein, 11 aa, Entamoeba dispar
AQMTPEPSSVG

SEQ ID NO: 2413251 - protein, 8 aa, Entamoeba dispar
AQNALTKG

SEQ ID NO: 2413252 - protein, 32 aa, Entamoeba dispar
AQNEIKEYDNKSVELGQSKIEEIKENSDTKNF

SEQ ID NO: 2413253 - protein, 12 aa, Entamoeba dispar
AQNEQINSMGSK

SEQ ID NO: 2413254 - protein, 10 aa, Entamoeba dispar
AQNGDCSNEL

SEQ ID NO: 2413255 - protein, 11 aa, Entamoeba dispar
AQNHQRDEEFS

SEQ ID NO: 2413256 - protein, 10 aa, Entamoeba dispar
AQNKPSPEME

SEQ ID NO: 2413257 - protein, 8 aa, Entamoeba dispar
AQNPERAK

SEQ ID NO: 2413258 - protein, 7 aa, Entamoeba dispar
AQNPNSF

SEQ ID NO: 2413259 - protein, 6 aa, Entamoeba dispar
AQNPSN

SEQ ID NO: 2413260 - protein, 10 aa, Entamoeba dispar
AQNPSRENEF

SEQ ID NO: 2413261 - protein, 8 aa, Entamoeba dispar
AQNQKEKY

SEQ ID NO: 2413262 - protein, 9 aa, Entamoeba dispar
AQNRKNYRA

SEQ ID NO: 2413263 - protein, 8 aa, Entamoeba dispar
AQNSGYDR

SEQ ID NO: 2413264 - protein, 9 aa, Entamoeba dispar
AQNSKKNQK

SEQ ID NO: 2413265 - protein, 15 aa, Entamoeba dispar
AQNSQTLNKTIQNQV

SEQ ID NO: 2413266 - protein, 7 aa, Entamoeba dispar
AQNSVDD

SEQ ID NO: 2413267 - protein, 6 aa, Entamoeba dispar
AQNYGN

SEQ ID NO: 2413268 - protein, 23 aa, Entamoeba dispar
AQPASAYQNNVQQEFNTSSNNIT

SEQ ID NO: 2413269 - protein, 6 aa, Entamoeba dispar
AQPIDK

SEQ ID NO: 2413270 - protein, 5 aa, Entamoeba dispar
AQPKN

SEQ ID NO: 2413271 - protein, 5 aa, Entamoeba dispar
AQPLN

SEQ ID NO: 2413272 - protein, 6 aa, Entamoeba dispar
AQPLPG

SEQ ID NO: 2413273 - protein, 26 aa, Entamoeba dispar
AQPPPSKIKVGSTQQTYAAPIPPTIS

SEQ ID NO: 2413274 - protein, 7 aa, Entamoeba dispar
AQPQQST

SEQ ID NO: 2413275 - protein, 7 aa, Entamoeba dispar
AQPSVTE

SEQ ID NO: 2413276 - protein, 8 aa, Entamoeba dispar
AQQDGSNI

SEQ ID NO: 2413277 - protein, 19 aa, Entamoeba dispar
AQQETKEEEIQDAATKELV

SEQ ID NO: 2413278 - protein, 5 aa, Entamoeba dispar
AQQHQ

SEQ ID NO: 2413279 - protein, 10 aa, Entamoeba dispar
AQQKVNPASI

SEQ ID NO: 2413280 - protein, 5 aa, Entamoeba dispar
AQQNA

SEQ ID NO: 2413281 - protein, 10 aa, Entamoeba dispar
AQQNDKTKEL

SEQ ID NO: 2413282 - protein, 43 aa, Entamoeba dispar
AQQPKKSTENIKKEPTEEKRVDIQSTDTQQSSELIQKDSQYDQ

SEQ ID NO: 2413283 - protein, 7 aa, Entamoeba dispar
AQQSTFE

SEQ ID NO: 2413284 - protein, 20 aa, Entamoeba dispar
AQQVRKVEKGCDEPKQTNTL

SEQ ID NO: 2413285 - protein, 5 aa, Entamoeba dispar
AQRDN

SEQ ID NO: 2413286 - protein, 19 aa, Entamoeba dispar
AQRLKNKSSKLNKTLTEIP

SEQ ID NO: 2413287 - protein, 5 aa, Entamoeba dispar
AQRLT

SEQ ID NO: 2413288 - protein, 5 aa, Entamoeba dispar
AQRRR

SEQ ID NO: 2413289 - protein, 5 aa, Entamoeba dispar
AQRTF

SEQ ID NO: 2413290 - protein, 12 aa, Entamoeba dispar
AQRVPSKETIKS

SEQ ID NO: 2413291 - protein, 7 aa, Entamoeba dispar
AQSETYK

SEQ ID NO: 2413292 - protein, 12 aa, Entamoeba dispar
AQSFSEKREIGP

SEQ ID NO: 2413293 - protein, 7 aa, Entamoeba dispar
AQSGNKE

SEQ ID NO: 2413294 - protein, 5 aa, Entamoeba dispar
AQSIG

SEQ ID NO: 2413295 - protein, 10 aa, Entamoeba dispar
AQSIGAPATQ

SEQ ID NO: 2413296 - protein, 10 aa, Entamoeba dispar
AQSKSSQSLY

SEQ ID NO: 2413297 - protein, 22 aa, Entamoeba dispar
AQSMNGSSWKGGDGSYSSSFGR

SEQ ID NO: 2413298 - protein, 6 aa, Entamoeba dispar
AQSPDV

SEQ ID NO: 2413299 - protein, 9 aa, Entamoeba dispar
AQSQAKENH

SEQ ID NO: 2413300 - protein, 13 aa, Entamoeba dispar
AQSQKVRSFSPTS

SEQ ID NO: 2413301 - protein, 7 aa, Entamoeba dispar
AQSTNKK

SEQ ID NO: 2413302 - protein, 7 aa, Entamoeba dispar
AQTANEA

SEQ ID NO: 2413303 - protein, 11 aa, Entamoeba dispar
AQTDEPSNHRD

SEQ ID NO: 2413304 - protein, 9 aa, Entamoeba dispar
AQTEGADRK

SEQ ID NO: 2413305 - protein, 14 aa, Entamoeba dispar
AQTGGDIRLSPEEY

SEQ ID NO: 2413306 - protein, 8 aa, Entamoeba dispar
AQTGSGKT

SEQ ID NO: 2413307 - protein, 5 aa, Entamoeba dispar
AQTIN

SEQ ID NO: 2413308 - protein, 11 aa, Entamoeba dispar
AQTNQIPPMPT

SEQ ID NO: 2413309 - protein, 5 aa, Entamoeba dispar
AQTNT

SEQ ID NO: 2413310 - protein, 15 aa, Entamoeba dispar
AQTPLCQPYSDATNN

SEQ ID NO: 2413311 - protein, 8 aa, Entamoeba dispar
AQTQEQKV

SEQ ID NO: 2413312 - protein, 5 aa, Entamoeba dispar
AQTQR

SEQ ID NO: 2413313 - protein, 8 aa, Entamoeba dispar
AQTREEPT

SEQ ID NO: 2413314 - protein, 20 aa, Entamoeba dispar
AQTSINSSTKVEDSDNSQPV

SEQ ID NO: 2413315 - protein, 6 aa, Entamoeba dispar
AQTSNN

SEQ ID NO: 2413316 - protein, 6 aa, Entamoeba dispar
AQTTAR

SEQ ID NO: 2413317 - protein, 6 aa, Entamoeba dispar
AQTTRT

SEQ ID NO: 2413318 - protein, 7 aa, Entamoeba dispar
AQVDPQV

SEQ ID NO: 2413319 - protein, 34 aa, Entamoeba dispar
AQVGNNSIDENKKNQIKKIRETAPRKTVQSQHIR

SEQ ID NO: 2413320 - protein, 4 aa, Entamoeba dispar
AQVP

SEQ ID NO: 2413321 - protein, 11 aa, Entamoeba dispar
AQYKSGCTTDV

SEQ ID NO: 2413322 - protein, 23 aa, Entamoeba dispar
AQYPHDPPLHNDGIKQAEEVGRR

SEQ ID NO: 2413323 - protein, 6 aa, Entamoeba dispar
AQYREG

SEQ ID NO: 2413324 - protein, 6 aa, Entamoeba dispar
ARAGRM

SEQ ID NO: 2413325 - protein, 8 aa, Entamoeba dispar
ARAHNNSA

SEQ ID NO: 2413326 - protein, 7 aa, Entamoeba dispar
ARANGEH

SEQ ID NO: 2413327 - protein, 62 aa, Entamoeba dispar
ARANRGGSAPHPTRGAPAPRGMPSRGAPTPRGMPSRGSPVPRGRGGMMPPAQVSEHEEQETP

SEQ ID NO: 2413328 - protein, 20 aa, Entamoeba dispar
ARANRGGSSMKNTRGTPQRK

SEQ ID NO: 2413329 - protein, 7 aa, Entamoeba dispar
ARAQVST

SEQ ID NO: 2413330 - protein, 24 aa, Entamoeba dispar
ARARGPKSSLTRQPTEGRSRDGGL

SEQ ID NO: 2413331 - protein, 4 aa, Entamoeba dispar
ARCE

SEQ ID NO: 2413332 - protein, 6 aa, Entamoeba dispar
ARDAEK

SEQ ID NO: 2413333 - protein, 33 aa, Entamoeba dispar
ARDDYYGRSDRYSLRDNCNDREIDYDRYNSRRI

SEQ ID NO: 2413334 - protein, 9 aa, Entamoeba dispar
ARDGSGDVV

SEQ ID NO: 2413335 - protein, 9 aa, Entamoeba dispar
ARDPAKLAS

SEQ ID NO: 2413336 - protein, 8 aa, Entamoeba dispar
ARDPRLEQ

SEQ ID NO: 2413337 - protein, 11 aa, Entamoeba dispar
ARDRNKVNEIK

SEQ ID NO: 2413338 - protein, 6 aa, Entamoeba dispar
ARDVLE

SEQ ID NO: 2413339 - protein, 7 aa, Entamoeba dispar
AREFTPE

SEQ ID NO: 2413340 - protein, 7 aa, Entamoeba dispar
AREGKID

SEQ ID NO: 2413341 - protein, 10 aa, Entamoeba dispar
AREGKKCQPG

SEQ ID NO: 2413342 - protein, 8 aa, Entamoeba dispar
AREHSKGI

SEQ ID NO: 2413343 - protein, 7 aa, Entamoeba dispar
ARENSPS

SEQ ID NO: 2413344 - protein, 7 aa, Entamoeba dispar
ARENYTK

SEQ ID NO: 2413345 - protein, 8 aa, Entamoeba dispar
ARERQERL

SEQ ID NO: 2413346 - protein, 10 aa, Entamoeba dispar
ARESSGQKNK

SEQ ID NO: 2413347 - protein, 5 aa, Entamoeba dispar
ARGAA

SEQ ID NO: 2413348 - protein, 18 aa, Entamoeba dispar
ARGEKVGEFRRGKSAAEI

SEQ ID NO: 2413349 - protein, 16 aa, Entamoeba dispar
ARGEKVGEFRRGKSVA

SEQ ID NO: 2413350 - protein, 8 aa, Entamoeba dispar
ARGGAIST

SEQ ID NO: 2413351 - protein, 4 aa, Entamoeba dispar
ARGI

SEQ ID NO: 2413352 - protein, 6 aa, Entamoeba dispar
ARGITT

SEQ ID NO: 2413353 - protein, 10 aa, Entamoeba dispar
ARGKTHVGKA

SEQ ID NO: 2413354 - protein, 11 aa, Entamoeba dispar
ARGNGKGNSDL

SEQ ID NO: 2413355 - protein, 9 aa, Entamoeba dispar
ARGSGRDIR

SEQ ID NO: 2413356 - protein, 11 aa, Entamoeba dispar
ARGSKHQGGIN

SEQ ID NO: 2413357 - protein, 17 aa, Entamoeba dispar
ARGSRDNVTAVIIFLNW

SEQ ID NO: 2413358 - protein, 65 aa, Entamoeba dispar
ARGSRGGSAPHSMGGMPSRGAPRGMPSRGAPTPRGMPSRGSPVPRGRGGMMPPAQVSEHEEQETP

SEQ ID NO: 2413359 - protein, 14 aa, Entamoeba dispar
ARGSTDNVSCVVCK

SEQ ID NO: 2413360 - protein, 16 aa, Entamoeba dispar
ARGTQAFKDQKYEEAI

SEQ ID NO: 2413361 - protein, 17 aa, Entamoeba dispar
ARIDSPKGILDSQGPDA

SEQ ID NO: 2413362 - protein, 6 aa, Entamoeba dispar
ARIPQE

SEQ ID NO: 2413363 - protein, 7 aa, Entamoeba dispar
ARIQEGQ

SEQ ID NO: 2413364 - protein, 11 aa, Entamoeba dispar
ARIRGSNTIDE

SEQ ID NO: 2413365 - protein, 9 aa, Entamoeba dispar
ARKEAMEEY

SEQ ID NO: 2413366 - protein, 11 aa, Entamoeba dispar
ARKEFKTKEQL

SEQ ID NO: 2413367 - protein, 15 aa, Entamoeba dispar
ARKQAKKDMAAATDP

SEQ ID NO: 2413368 - protein, 9 aa, Entamoeba dispar
ARKQDDVGI

SEQ ID NO: 2413369 - protein, 14 aa, Entamoeba dispar
ARKQGEAKEDLNAK

SEQ ID NO: 2413370 - protein, 6 aa, Entamoeba dispar
ARKRED

SEQ ID NO: 2413371 - protein, 8 aa, Entamoeba dispar
ARKRLPAM

SEQ ID NO: 2413372 - protein, 14 aa, Entamoeba dispar
ARLDDSKFPKLGSN

SEQ ID NO: 2413373 - protein, 5 aa, Entamoeba dispar
ARLEK

SEQ ID NO: 2413374 - protein, 7 aa, Entamoeba dispar
ARLNHNG

SEQ ID NO: 2413375 - protein, 20 aa, Entamoeba dispar
ARLSKKKKQVIQQRAPSFDP

SEQ ID NO: 2413376 - protein, 11 aa, Entamoeba dispar
ARMTKEQSDEV

SEQ ID NO: 2413377 - protein, 10 aa, Entamoeba dispar
ARNGKSKNKI

SEQ ID NO: 2413378 - protein, 14 aa, Entamoeba dispar
ARNNQLKSLPPSIG

SEQ ID NO: 2413379 - protein, 18 aa, Entamoeba dispar
ARNQTDLKYDSEQPQNMR

SEQ ID NO: 2413380 - protein, 10 aa, Entamoeba dispar
ARNSKGELTG

SEQ ID NO: 2413381 - protein, 5 aa, Entamoeba dispar
ARNST

SEQ ID NO: 2413382 - protein, 4 aa, Entamoeba dispar
ARPE

SEQ ID NO: 2413383 - protein, 10 aa, Entamoeba dispar
ARPESQDGQL

SEQ ID NO: 2413384 - protein, 9 aa, Entamoeba dispar
ARPKLNANV

SEQ ID NO: 2413385 - protein, 5 aa, Entamoeba dispar
ARPPK

SEQ ID NO: 2413386 - protein, 32 aa, Entamoeba dispar
ARPPKERKAVTEGEKKTTTGPRGYRPRRFGPR

SEQ ID NO: 2413387 - protein, 11 aa, Entamoeba dispar
ARPPMDRPLPT

SEQ ID NO: 2413388 - protein, 9 aa, Entamoeba dispar
ARPQGTNEA

SEQ ID NO: 2413389 - protein, 8 aa, Entamoeba dispar
ARPSHQDL

SEQ ID NO: 2413390 - protein, 5 aa, Entamoeba dispar
ARQDN

SEQ ID NO: 2413391 - protein, 5 aa, Entamoeba dispar
ARQPV

SEQ ID NO: 2413392 - protein, 7 aa, Entamoeba dispar
ARQRETV

SEQ ID NO: 2413393 - protein, 22 aa, Entamoeba dispar
ARQRYQGKINNESFYKRKNDSV

SEQ ID NO: 2413394 - protein, 36 aa, Entamoeba dispar
ARQSHAKSPNTTSQHYNSPQHQMQSPSVTPTKTSQA

SEQ ID NO: 2413395 - protein, 8 aa, Entamoeba dispar
ARQSKEEV

SEQ ID NO: 2413396 - protein, 4 aa, Entamoeba dispar
ARQT

SEQ ID NO: 2413397 - protein, 12 aa, Entamoeba dispar
ARRQNKIKSKKY

SEQ ID NO: 2413398 - protein, 6 aa, Entamoeba dispar
ARRQTQ

SEQ ID NO: 2413399 - protein, 24 aa, Entamoeba dispar
ARRRPQLSKELDDSVKNEVNECTS

SEQ ID NO: 2413400 - protein, 6 aa, Entamoeba dispar
ARRVQS

SEQ ID NO: 2413401 - protein, 8 aa, Entamoeba dispar
ARSFKEKT

SEQ ID NO: 2413402 - protein, 13 aa, Entamoeba dispar
ARSGCNESEFDKE

SEQ ID NO: 2413403 - protein, 26 aa, Entamoeba dispar
ARSKADFDSPTLGKVESASKSVKEAT

SEQ ID NO: 2413404 - protein, 9 aa, Entamoeba dispar
ARSKNGEDG

SEQ ID NO: 2413405 - protein, 8 aa, Entamoeba dispar
ARSMPTSA

SEQ ID NO: 2413406 - protein, 6 aa, Entamoeba dispar
ARSRGY

SEQ ID NO: 2413407 - protein, 13 aa, Entamoeba dispar
ARSSEKGSPGSKF

SEQ ID NO: 2413408 - protein, 17 aa, Entamoeba dispar
ARSTSIEAQKAKKERMD

SEQ ID NO: 2413409 - protein, 11 aa, Entamoeba dispar
ARTDKGVSAAN

SEQ ID NO: 2413410 - protein, 8 aa, Entamoeba dispar
ARTGSGKT

SEQ ID NO: 2413411 - protein, 7 aa, Entamoeba dispar
ARTKTDK

SEQ ID NO: 2413412 - protein, 13 aa, Entamoeba dispar
ARTLTEEQEKEFK

SEQ ID NO: 2413413 - protein, 9 aa, Entamoeba dispar
ARTNPTTLS

SEQ ID NO: 2413414 - protein, 6 aa, Entamoeba dispar
ARTSQN

SEQ ID NO: 2413415 - protein, 8 aa, Entamoeba dispar
ARTTFRPE

SEQ ID NO: 2413416 - protein, 8 aa, Entamoeba dispar
ARTTTGSK

SEQ ID NO: 2413417 - protein, 4 aa, Entamoeba dispar
ARTY

SEQ ID NO: 2413418 - protein, 8 aa, Entamoeba dispar
ARVDYDAE

SEQ ID NO: 2413419 - protein, 4 aa, Entamoeba dispar
ARVG

SEQ ID NO: 2413420 - protein, 4 aa, Entamoeba dispar
ARVP

SEQ ID NO: 2413421 - protein, 6 aa, Entamoeba dispar
ARVTGR

SEQ ID NO: 2413422 - protein, 68 aa, Entamoeba dispar
ARYGNAKKPIPSGVSSARSVPKVPAAKTNKVGGYGASKSTATSKPNTTTKPTTTTKPSPTTTPARSGF

SEQ ID NO: 2413423 - protein, 5 aa, Entamoeba dispar
ASAGE

SEQ ID NO: 2413424 - protein, 7 aa, Entamoeba dispar
ASAGRQR

SEQ ID NO: 2413425 - protein, 4 aa, Entamoeba dispar
ASAI

SEQ ID NO: 2413426 - protein, 14 aa, Entamoeba dispar
ASAKEVDTENKTKT

SEQ ID NO: 2413427 - protein, 10 aa, Entamoeba dispar
ASAKTGENVK

SEQ ID NO: 2413428 - protein, 13 aa, Entamoeba dispar
ASANPKESRYNPK

SEQ ID NO: 2413429 - protein, 8 aa, Entamoeba dispar
ASANTYDP

SEQ ID NO: 2413430 - protein, 6 aa, Entamoeba dispar
ASASNV

SEQ ID NO: 2413431 - protein, 7 aa, Entamoeba dispar
ASATTDI

SEQ ID NO: 2413432 - protein, 10 aa, Entamoeba dispar
ASATTPKKVE

SEQ ID NO: 2413433 - protein, 8 aa, Entamoeba dispar
ASAVGSGY

SEQ ID NO: 2413434 - protein, 8 aa, Entamoeba dispar
ASAYLQDS

SEQ ID NO: 2413435 - protein, 7 aa, Entamoeba dispar
ASCANKE

SEQ ID NO: 2413436 - protein, 7 aa, Entamoeba dispar
ASCPEQR

SEQ ID NO: 2413437 - protein, 9 aa, Entamoeba dispar
ASCTPADGE

SEQ ID NO: 2413438 - protein, 11 aa, Entamoeba dispar
ASDATRRTEGF

SEQ ID NO: 2413439 - protein, 6 aa, Entamoeba dispar
ASDDDT

SEQ ID NO: 2413440 - protein, 6 aa, Entamoeba dispar
ASDDEI

SEQ ID NO: 2413441 - protein, 16 aa, Entamoeba dispar
ASDDIESSYYNEYSET

SEQ ID NO: 2413442 - protein, 5 aa, Entamoeba dispar
ASDEI

SEQ ID NO: 2413443 - protein, 7 aa, Entamoeba dispar
ASDERGI

SEQ ID NO: 2413444 - protein, 10 aa, Entamoeba dispar
ASDERGIETI

SEQ ID NO: 2413445 - protein, 5 aa, Entamoeba dispar
ASDFT

SEQ ID NO: 2413446 - protein, 7 aa, Entamoeba dispar
ASDGDTL

SEQ ID NO: 2413447 - protein, 9 aa, Entamoeba dispar
ASDKRQSID

SEQ ID NO: 2413448 - protein, 5 aa, Entamoeba dispar
ASDKS

SEQ ID NO: 2413449 - protein, 5 aa, Entamoeba dispar
ASDNA

SEQ ID NO: 2413450 - protein, 9 aa, Entamoeba dispar
ASDNNGSHP

SEQ ID NO: 2413451 - protein, 7 aa, Entamoeba dispar
ASDPRYL

SEQ ID NO: 2413452 - protein, 7 aa, Entamoeba dispar
ASDPSKI

SEQ ID NO: 2413453 - protein, 8 aa, Entamoeba dispar
ASDPSLRK

SEQ ID NO: 2413454 - protein, 4 aa, Entamoeba dispar
ASDS

SEQ ID NO: 2413455 - protein, 6 aa, Entamoeba dispar
ASDSDQ

SEQ ID NO: 2413456 - protein, 10 aa, Entamoeba dispar
ASDTRNKSSI

SEQ ID NO: 2413457 - protein, 4 aa, Entamoeba dispar
ASEA

SEQ ID NO: 2413458 - protein, 8 aa, Entamoeba dispar
ASEDKRVQ

SEQ ID NO: 2413459 - protein, 6 aa, Entamoeba dispar
ASEDTQ

SEQ ID NO: 2413460 - protein, 16 aa, Entamoeba dispar
ASEEEKKRKKIEDEIP

SEQ ID NO: 2413461 - protein, 8 aa, Entamoeba dispar
ASEEEVKQ

SEQ ID NO: 2413462 - protein, 8 aa, Entamoeba dispar
ASEGDLEM

SEQ ID NO: 2413463 - protein, 5 aa, Entamoeba dispar
ASEHS

SEQ ID NO: 2413464 - protein, 14 aa, Entamoeba dispar
ASEKLKDEVDGWQN

SEQ ID NO: 2413465 - protein, 7 aa, Entamoeba dispar
ASELKEQ

SEQ ID NO: 2413466 - protein, 9 aa, Entamoeba dispar
ASELTRAEP

SEQ ID NO: 2413467 - protein, 4 aa, Entamoeba dispar
ASEP

SEQ ID NO: 2413468 - protein, 4 aa, Entamoeba dispar
ASEQ

SEQ ID NO: 2413469 - protein, 9 aa, Entamoeba dispar
ASEQPYVAS

SEQ ID NO: 2413470 - protein, 11 aa, Entamoeba dispar
ASERGKVGYGD

SEQ ID NO: 2413471 - protein, 8 aa, Entamoeba dispar
ASESEVNR

SEQ ID NO: 2413472 - protein, 6 aa, Entamoeba dispar
ASESQN

SEQ ID NO: 2413473 - protein, 8 aa, Entamoeba dispar
ASETPEFS

SEQ ID NO: 2413474 - protein, 37 aa, Entamoeba dispar
ASETTGEIEEEIEEEDYGYEEEEDNEENEEEDDDMTA

SEQ ID NO: 2413475 - protein, 14 aa, Entamoeba dispar
ASFGGKNNDMDIIY

SEQ ID NO: 2413476 - protein, 13 aa, Entamoeba dispar
ASGCSSKISEHAT

SEQ ID NO: 2413477 - protein, 8 aa, Entamoeba dispar
ASGDAVGG

SEQ ID NO: 2413478 - protein, 8 aa, Entamoeba dispar
ASGDKTPA

SEQ ID NO: 2413479 - protein, 7 aa, Entamoeba dispar
ASGDKYR

SEQ ID NO: 2413480 - protein, 10 aa, Entamoeba dispar
ASGENVVGAT

SEQ ID NO: 2413481 - protein, 14 aa, Entamoeba dispar
ASGGEQDLGHPPMD

SEQ ID NO: 2413482 - protein, 39 aa, Entamoeba dispar
ASGISNDNGTRTTFTNGKEEDDDITQYTTAADPDENYEN

SEQ ID NO: 2413483 - protein, 17 aa, Entamoeba dispar
ASGITTYGKKAVTNPFG

SEQ ID NO: 2413484 - protein, 6 aa, Entamoeba dispar
ASGLRS

SEQ ID NO: 2413485 - protein, 8 aa, Entamoeba dispar
ASGMDTTI

SEQ ID NO: 2413486 - protein, 8 aa, Entamoeba dispar
ASGRYKGD

SEQ ID NO: 2413487 - protein, 11 aa, Entamoeba dispar
ASGSASDQSHQ

SEQ ID NO: 2413488 - protein, 8 aa, Entamoeba dispar
ASGTEEMK

SEQ ID NO: 2413489 - protein, 9 aa, Entamoeba dispar
ASHGPGKTE

SEQ ID NO: 2413490 - protein, 6 aa, Entamoeba dispar
ASHKRF

SEQ ID NO: 2413491 - protein, 13 aa, Entamoeba dispar
ASHPEETHGPARK

SEQ ID NO: 2413492 - protein, 6 aa, Entamoeba dispar
ASHPKT

SEQ ID NO: 2413493 - protein, 8 aa, Entamoeba dispar
ASIDQSRG

SEQ ID NO: 2413494 - protein, 10 aa, Entamoeba dispar
ASIESIGDEA

SEQ ID NO: 2413495 - protein, 9 aa, Entamoeba dispar
ASIKEEHPD

SEQ ID NO: 2413496 - protein, 7 aa, Entamoeba dispar
ASINEAT

SEQ ID NO: 2413497 - protein, 18 aa, Entamoeba dispar
ASIPGVKNNSDNDKSDTR

SEQ ID NO: 2413498 - protein, 18 aa, Entamoeba dispar
ASIPGVKNNTESDKTDTR

SEQ ID NO: 2413499 - protein, 6 aa, Entamoeba dispar
ASIPNS

SEQ ID NO: 2413500 - protein, 5 aa, Entamoeba dispar
ASIRP

SEQ ID NO: 2413501 - protein, 12 aa, Entamoeba dispar
ASISSSCDSDAY

SEQ ID NO: 2413502 - protein, 4 aa, Entamoeba dispar
ASKD

SEQ ID NO: 2413503 - protein, 8 aa, Entamoeba dispar
ASKDKVSE

SEQ ID NO: 2413504 - protein, 12 aa, Entamoeba dispar
ASKEKTKEKYAE

SEQ ID NO: 2413505 - protein, 14 aa, Entamoeba dispar
ASKEVRNNKLDGSY

SEQ ID NO: 2413506 - protein, 6 aa, Entamoeba dispar
ASKFRN

SEQ ID NO: 2413507 - protein, 12 aa, Entamoeba dispar
ASKISGSLASGV

SEQ ID NO: 2413508 - protein, 17 aa, Entamoeba dispar
ASKKDEKKEVSVQEESF

SEQ ID NO: 2413509 - protein, 15 aa, Entamoeba dispar
ASKKDGKLKASPLEI

SEQ ID NO: 2413510 - protein, 6 aa, Entamoeba dispar
ASKKDN

SEQ ID NO: 2413511 - protein, 8 aa, Entamoeba dispar
ASKKDNLH

SEQ ID NO: 2413512 - protein, 19 aa, Entamoeba dispar
ASKKEDANRLLNMKKFFEQ

SEQ ID NO: 2413513 - protein, 10 aa, Entamoeba dispar
ASKKPLENEY

SEQ ID NO: 2413514 - protein, 16 aa, Entamoeba dispar
ASKKQSQRKASGEEDV

SEQ ID NO: 2413515 - protein, 12 aa, Entamoeba dispar
ASKKTSLIYDEN

SEQ ID NO: 2413516 - protein, 8 aa, Entamoeba dispar
ASKNIDGY

SEQ ID NO: 2413517 - protein, 7 aa, Entamoeba dispar
ASKNQPQ

SEQ ID NO: 2413518 - protein, 5 aa, Entamoeba dispar
ASKNT

SEQ ID NO: 2413519 - protein, 17 aa, Entamoeba dispar
ASKPNGSFYINTRDPLL

SEQ ID NO: 2413520 - protein, 7 aa, Entamoeba dispar
ASKRIKG

SEQ ID NO: 2413521 - protein, 9 aa, Entamoeba dispar
ASKRPLENE

SEQ ID NO: 2413522 - protein, 11 aa, Entamoeba dispar
ASKSPNKDRKD

SEQ ID NO: 2413523 - protein, 13 aa, Entamoeba dispar
ASKTKQNKNGMTP

SEQ ID NO: 2413524 - protein, 9 aa, Entamoeba dispar
ASKYTEENY

SEQ ID NO: 2413525 - protein, 6 aa, Entamoeba dispar
ASLDAA

SEQ ID NO: 2413526 - protein, 7 aa, Entamoeba dispar
ASLEEKK

SEQ ID NO: 2413527 - protein, 15 aa, Entamoeba dispar
ASLEIKNEKGETPLS

SEQ ID NO: 2413528 - protein, 22 aa, Entamoeba dispar
ASLESKKISDASQLKRHSYKNR

SEQ ID NO: 2413529 - protein, 9 aa, Entamoeba dispar
ASLEYDPSS

SEQ ID NO: 2413530 - protein, 6 aa, Entamoeba dispar
ASLPGE

SEQ ID NO: 2413531 - protein, 6 aa, Entamoeba dispar
ASLPNS

SEQ ID NO: 2413532 - protein, 12 aa, Entamoeba dispar
ASLPSKRDIPSY

SEQ ID NO: 2413533 - protein, 7 aa, Entamoeba dispar
ASLPTFN

SEQ ID NO: 2413534 - protein, 12 aa, Entamoeba dispar
ASLSSSCDSDAY

SEQ ID NO: 2413535 - protein, 6 aa, Entamoeba dispar
ASLTHT

SEQ ID NO: 2413536 - protein, 6 aa, Entamoeba dispar
ASMGNV

SEQ ID NO: 2413537 - protein, 10 aa, Entamoeba dispar
ASMSNELDES

SEQ ID NO: 2413538 - protein, 4 aa, Entamoeba dispar
ASNA

SEQ ID NO: 2413539 - protein, 16 aa, Entamoeba dispar
ASNAGTAINLPAGSST

SEQ ID NO: 2413540 - protein, 8 aa, Entamoeba dispar
ASNAPKTI

SEQ ID NO: 2413541 - protein, 7 aa, Entamoeba dispar
ASNDNKT

SEQ ID NO: 2413542 - protein, 10 aa, Entamoeba dispar
ASNDSLSPCT

SEQ ID NO: 2413543 - protein, 5 aa, Entamoeba dispar
ASNEI

SEQ ID NO: 2413544 - protein, 8 aa, Entamoeba dispar
ASNELTES

SEQ ID NO: 2413545 - protein, 18 aa, Entamoeba dispar
ASNHKTPFKVEDKNTNED

SEQ ID NO: 2413546 - protein, 10 aa, Entamoeba dispar
ASNKDPTTPI

SEQ ID NO: 2413547 - protein, 9 aa, Entamoeba dispar
ASNNKEFTS

SEQ ID NO: 2413548 - protein, 15 aa, Entamoeba dispar
ASNNPSNRAGSKAYM

SEQ ID NO: 2413549 - protein, 10 aa, Entamoeba dispar
ASNPTRNDIP

SEQ ID NO: 2413550 - protein, 7 aa, Entamoeba dispar
ASNQRGI

SEQ ID NO: 2413551 - protein, 8 aa, Entamoeba dispar
ASNSETSK

SEQ ID NO: 2413552 - protein, 8 aa, Entamoeba dispar
ASNSKAIY

SEQ ID NO: 2413553 - protein, 8 aa, Entamoeba dispar
ASNSKSVE

SEQ ID NO: 2413554 - protein, 5 aa, Entamoeba dispar
ASNTI

SEQ ID NO: 2413555 - protein, 9 aa, Entamoeba dispar
ASNTISRTC

SEQ ID NO: 2413556 - protein, 6 aa, Entamoeba dispar
ASNTKT

SEQ ID NO: 2413557 - protein, 8 aa, Entamoeba dispar
ASNTSRSE

SEQ ID NO: 2413558 - protein, 11 aa, Entamoeba dispar
ASNTSSGMRTY

SEQ ID NO: 2413559 - protein, 26 aa, Entamoeba dispar
ASNTTSNSKSGNEPSKKEKKGKKCVM

SEQ ID NO: 2413560 - protein, 4 aa, Entamoeba dispar
ASPA

SEQ ID NO: 2413561 - protein, 7 aa, Entamoeba dispar
ASPATVG

SEQ ID NO: 2413562 - protein, 13 aa, Entamoeba dispar
ASPDRDFKRSQSP

SEQ ID NO: 2413563 - protein, 77 aa, Entamoeba dispar
ASPEEEEAYTPEEVSEEEDSADDKKTTKKQSIHKKEQNENKVKQNKNKKEQNLTKEKKPYPTISHKKETKKKNKKKA

SEQ ID NO: 2413564 - protein, 5 aa, Entamoeba dispar
ASPEP

SEQ ID NO: 2413565 - protein, 8 aa, Entamoeba dispar
ASPEQRGK

SEQ ID NO: 2413566 - protein, 9 aa, Entamoeba dispar
ASPGSNTVK

SEQ ID NO: 2413567 - protein, 19 aa, Entamoeba dispar
ASPIKSSSEITSIPNITPS

SEQ ID NO: 2413568 - protein, 5 aa, Entamoeba dispar
ASPIN

SEQ ID NO: 2413569 - protein, 6 aa, Entamoeba dispar
ASPISG

SEQ ID NO: 2413570 - protein, 4 aa, Entamoeba dispar
ASPL

SEQ ID NO: 2413571 - protein, 8 aa, Entamoeba dispar
ASPLDTSE

SEQ ID NO: 2413572 - protein, 5 aa, Entamoeba dispar
ASPLT

SEQ ID NO: 2413573 - protein, 4 aa, Entamoeba dispar
ASPN

SEQ ID NO: 2413574 - protein, 7 aa, Entamoeba dispar
ASPNQHL

SEQ ID NO: 2413575 - protein, 10 aa, Entamoeba dispar
ASPNSTPKGV

SEQ ID NO: 2413576 - protein, 9 aa, Entamoeba dispar
ASPQTKDSI

SEQ ID NO: 2413577 - protein, 30 aa, Entamoeba dispar
ASPRHEEFQTPSSPRLNGRKSSSSSSPQNT

SEQ ID NO: 2413578 - protein, 5 aa, Entamoeba dispar
ASPSN

SEQ ID NO: 2413579 - protein, 13 aa, Entamoeba dispar
ASPTKPLSPRKFE

SEQ ID NO: 2413580 - protein, 28 aa, Entamoeba dispar
ASPTKPLSPRKFETKPESDIKKDGITQL

SEQ ID NO: 2413581 - protein, 21 aa, Entamoeba dispar
ASPVNQSLSTMNKKGNKEIEE

SEQ ID NO: 2413582 - protein, 17 aa, Entamoeba dispar
ASQAQPIDIEEEKEETI

SEQ ID NO: 2413583 - protein, 8 aa, Entamoeba dispar
ASQARKGD

SEQ ID NO: 2413584 - protein, 4 aa, Entamoeba dispar
ASQC

SEQ ID NO: 2413585 - protein, 4 aa, Entamoeba dispar
ASQD

SEQ ID NO: 2413586 - protein, 9 aa, Entamoeba dispar
ASQEAQSVS

SEQ ID NO: 2413587 - protein, 15 aa, Entamoeba dispar
ASQIANSLSTSSPIL

SEQ ID NO: 2413588 - protein, 6 aa, Entamoeba dispar
ASQLKN

SEQ ID NO: 2413589 - protein, 11 aa, Entamoeba dispar
ASQLNSQLKQQ

SEQ ID NO: 2413590 - protein, 5 aa, Entamoeba dispar
ASQPI

SEQ ID NO: 2413591 - protein, 9 aa, Entamoeba dispar
ASQPKRTLK

SEQ ID NO: 2413592 - protein, 5 aa, Entamoeba dispar
ASQQA

SEQ ID NO: 2413593 - protein, 15 aa, Entamoeba dispar
ASQQTTINAYSENTD

SEQ ID NO: 2413594 - protein, 13 aa, Entamoeba dispar
ASQRDPFCGSKSP

SEQ ID NO: 2413595 - protein, 7 aa, Entamoeba dispar
ASQRMEP

SEQ ID NO: 2413596 - protein, 9 aa, Entamoeba dispar
ASQSGGVSQ

SEQ ID NO: 2413597 - protein, 5 aa, Entamoeba dispar
ASQVD

SEQ ID NO: 2413598 - protein, 10 aa, Entamoeba dispar
ASRARPGDNV

SEQ ID NO: 2413599 - protein, 6 aa, Entamoeba dispar
ASRATT

SEQ ID NO: 2413600 - protein, 8 aa, Entamoeba dispar
ASRGDKYS

SEQ ID NO: 2413601 - protein, 5 aa, Entamoeba dispar
ASRGL

SEQ ID NO: 2413602 - protein, 6 aa, Entamoeba dispar
ASRGLD

SEQ ID NO: 2413603 - protein, 9 aa, Entamoeba dispar
ASRKDEIRM

SEQ ID NO: 2413604 - protein, 8 aa, Entamoeba dispar
ASRKRRNH

SEQ ID NO: 2413605 - protein, 7 aa, Entamoeba dispar
ASRNDGY

SEQ ID NO: 2413606 - protein, 10 aa, Entamoeba dispar
ASRPWKGTRL

SEQ ID NO: 2413607 - protein, 4 aa, Entamoeba dispar
ASRR

SEQ ID NO: 2413608 - protein, 6 aa, Entamoeba dispar
ASRSMN

SEQ ID NO: 2413609 - protein, 11 aa, Entamoeba dispar
ASRSSKLPGRP

SEQ ID NO: 2413610 - protein, 7 aa, Entamoeba dispar
ASRTEKK

SEQ ID NO: 2413611 - protein, 6 aa, Entamoeba dispar
ASRTKE

SEQ ID NO: 2413612 - protein, 11 aa, Entamoeba dispar
ASRTNREKKSF

SEQ ID NO: 2413613 - protein, 7 aa, Entamoeba dispar
ASRTSSI

SEQ ID NO: 2413614 - protein, 6 aa, Entamoeba dispar
ASRYPD

SEQ ID NO: 2413615 - protein, 9 aa, Entamoeba dispar
ASSDDTPDL

SEQ ID NO: 2413616 - protein, 7 aa, Entamoeba dispar
ASSDLQP

SEQ ID NO: 2413617 - protein, 19 aa, Entamoeba dispar
ASSDPNRAAVPNIPLPEAY

SEQ ID NO: 2413618 - protein, 4 aa, Entamoeba dispar
ASSE

SEQ ID NO: 2413619 - protein, 8 aa, Entamoeba dispar
ASSEPGEE

SEQ ID NO: 2413620 - protein, 8 aa, Entamoeba dispar
ASSESSIQ

SEQ ID NO: 2413621 - protein, 6 aa, Entamoeba dispar
ASSEVD

SEQ ID NO: 2413622 - protein, 8 aa, Entamoeba dispar
ASSGLKNL

SEQ ID NO: 2413623 - protein, 5 aa, Entamoeba dispar
ASSIA

SEQ ID NO: 2413624 - protein, 6 aa, Entamoeba dispar
ASSINK

SEQ ID NO: 2413625 - protein, 11 aa, Entamoeba dispar
ASSIQSEPENI

SEQ ID NO: 2413626 - protein, 8 aa, Entamoeba dispar
ASSKDKPV

SEQ ID NO: 2413627 - protein, 7 aa, Entamoeba dispar
ASSKPTI

SEQ ID NO: 2413628 - protein, 15 aa, Entamoeba dispar
ASSKSTYHSTTNPSI

SEQ ID NO: 2413629 - protein, 13 aa, Entamoeba dispar
ASSKTWKRSKPVE

SEQ ID NO: 2413630 - protein, 6 aa, Entamoeba dispar
ASSKYT

SEQ ID NO: 2413631 - protein, 8 aa, Entamoeba dispar
ASSNAIQK

SEQ ID NO: 2413632 - protein, 7 aa, Entamoeba dispar
ASSNETM

SEQ ID NO: 2413633 - protein, 6 aa, Entamoeba dispar
ASSNGQ

SEQ ID NO: 2413634 - protein, 11 aa, Entamoeba dispar
ASSNKQRSENH

SEQ ID NO: 2413635 - protein, 5 aa, Entamoeba dispar
ASSNL

SEQ ID NO: 2413636 - protein, 5 aa, Entamoeba dispar
ASSPE

SEQ ID NO: 2413637 - protein, 19 aa, Entamoeba dispar
ASSPLPEEKGDHDRSPITP

SEQ ID NO: 2413638 - protein, 5 aa, Entamoeba dispar
ASSPM

SEQ ID NO: 2413639 - protein, 10 aa, Entamoeba dispar
ASSPTSNNND

SEQ ID NO: 2413640 - protein, 7 aa, Entamoeba dispar
ASSRMSA

SEQ ID NO: 2413641 - protein, 6 aa, Entamoeba dispar
ASSRRY

SEQ ID NO: 2413642 - protein, 13 aa, Entamoeba dispar
ASSSAFGKKEKLP

SEQ ID NO: 2413643 - protein, 34 aa, Entamoeba dispar
ASSSAQRETPSSSSFSRKNSSFQLAPPPSRGQPI

SEQ ID NO: 2413644 - protein, 7 aa, Entamoeba dispar
ASSSFYE

SEQ ID NO: 2413645 - protein, 5 aa, Entamoeba dispar
ASSSL

SEQ ID NO: 2413646 - protein, 11 aa, Entamoeba dispar
ASSSNETQQGF

SEQ ID NO: 2413647 - protein, 17 aa, Entamoeba dispar
ASSSPVKSINQNTKNAI

SEQ ID NO: 2413648 - protein, 10 aa, Entamoeba dispar
ASSSTPNSPH

SEQ ID NO: 2413649 - protein, 16 aa, Entamoeba dispar
ASSSVSHSSNEQPISP

SEQ ID NO: 2413650 - protein, 4 aa, Entamoeba dispar
ASST

SEQ ID NO: 2413651 - protein, 9 aa, Entamoeba dispar
ASTDERAKA

SEQ ID NO: 2413652 - protein, 22 aa, Entamoeba dispar
ASTDSPNTLKDLQKRGKDTTIY

SEQ ID NO: 2413653 - protein, 7 aa, Entamoeba dispar
ASTFSEN

SEQ ID NO: 2413654 - protein, 4 aa, Entamoeba dispar
ASTG

SEQ ID NO: 2413655 - protein, 7 aa, Entamoeba dispar
ASTGKSD

SEQ ID NO: 2413656 - protein, 6 aa, Entamoeba dispar
ASTGYY

SEQ ID NO: 2413657 - protein, 8 aa, Entamoeba dispar
ASTIQNDC

SEQ ID NO: 2413658 - protein, 8 aa, Entamoeba dispar
ASTKRQEI

SEQ ID NO: 2413659 - protein, 10 aa, Entamoeba dispar
ASTKYQGDLY

SEQ ID NO: 2413660 - protein, 14 aa, Entamoeba dispar
ASTLDHCPQGYKSL

SEQ ID NO: 2413661 - protein, 19 aa, Entamoeba dispar
ASTNSNKCQITENEMNEIS

SEQ ID NO: 2413662 - protein, 8 aa, Entamoeba dispar
ASTPASEY

SEQ ID NO: 2413663 - protein, 7 aa, Entamoeba dispar
ASTPSKV

SEQ ID NO: 2413664 - protein, 6 aa, Entamoeba dispar
ASTQTT

SEQ ID NO: 2413665 - protein, 8 aa, Entamoeba dispar
ASTSDNLK

SEQ ID NO: 2413666 - protein, 5 aa, Entamoeba dispar
ASTSV

SEQ ID NO: 2413667 - protein, 8 aa, Entamoeba dispar
ASTTNGNI

SEQ ID NO: 2413668 - protein, 12 aa, Entamoeba dispar
ASTTSEESRGQN

SEQ ID NO: 2413669 - protein, 20 aa, Entamoeba dispar
ASTVKSQEIPEMNEEDMSAL

SEQ ID NO: 2413670 - protein, 15 aa, Entamoeba dispar
ASTVSKEKQTSTIYY

SEQ ID NO: 2413671 - protein, 12 aa, Entamoeba dispar
ASVGGLKKTGFT

SEQ ID NO: 2413672 - protein, 5 aa, Entamoeba dispar
ASVGK

SEQ ID NO: 2413673 - protein, 7 aa, Entamoeba dispar
ASVGKTS

SEQ ID NO: 2413674 - protein, 4 aa, Entamoeba dispar
ASVK

SEQ ID NO: 2413675 - protein, 8 aa, Entamoeba dispar
ASVNPTGT

SEQ ID NO: 2413676 - protein, 9 aa, Entamoeba dispar
ASVPTQTIN

SEQ ID NO: 2413677 - protein, 6 aa, Entamoeba dispar
ASVQPK

SEQ ID NO: 2413678 - protein, 25 aa, Entamoeba dispar
ASVQPSVARRPGRGRGGRKPPTKKL

SEQ ID NO: 2413679 - protein, 23 aa, Entamoeba dispar
ASVSAGQNSDATYKCAKYLMDAG

SEQ ID NO: 2413680 - protein, 5 aa, Entamoeba dispar
ASVTI

SEQ ID NO: 2413681 - protein, 12 aa, Entamoeba dispar
ASVTTSTGDSIK

SEQ ID NO: 2413682 - protein, 7 aa, Entamoeba dispar
ASVYENP

SEQ ID NO: 2413683 - protein, 8 aa, Entamoeba dispar
ASVYTATG

SEQ ID NO: 2413684 - protein, 9 aa, Entamoeba dispar
ASWNSNRMA

SEQ ID NO: 2413685 - protein, 7 aa, Entamoeba dispar
ASYENVE

SEQ ID NO: 2413686 - protein, 16 aa, Entamoeba dispar
ASYENVEGKWKPEIDQ

SEQ ID NO: 2413687 - protein, 9 aa, Entamoeba dispar
ASYEQNANG

SEQ ID NO: 2413688 - protein, 5 aa, Entamoeba dispar
ASYGP

SEQ ID NO: 2413689 - protein, 16 aa, Entamoeba dispar
ASYPSFKNNSCTDEDA

SEQ ID NO: 2413690 - protein, 11 aa, Entamoeba dispar
ASYSGSEMKPK

SEQ ID NO: 2413691 - protein, 10 aa, Entamoeba dispar
ATAARAGKKA

SEQ ID NO: 2413692 - protein, 13 aa, Entamoeba dispar
ATAENNKKQLSEV

SEQ ID NO: 2413693 - protein, 8 aa, Entamoeba dispar
ATAGKDGK

SEQ ID NO: 2413694 - protein, 5 aa, Entamoeba dispar
ATAKN

SEQ ID NO: 2413695 - protein, 6 aa, Entamoeba dispar
ATANTI

SEQ ID NO: 2413696 - protein, 8 aa, Entamoeba dispar
ATAQQKSE

SEQ ID NO: 2413697 - protein, 18 aa, Entamoeba dispar
ATASCPPEQPRQPLPNVG

SEQ ID NO: 2413698 - protein, 10 aa, Entamoeba dispar
ATASDFSGAK

SEQ ID NO: 2413699 - protein, 8 aa, Entamoeba dispar
ATASKEIS

SEQ ID NO: 2413700 - protein, 9 aa, Entamoeba dispar
ATASSDGTI

SEQ ID NO: 2413701 - protein, 10 aa, Entamoeba dispar
ATASSQNVDD

SEQ ID NO: 2413702 - protein, 9 aa, Entamoeba dispar
ATATPKVKE

SEQ ID NO: 2413703 - protein, 4 aa, Entamoeba dispar
ATAV

SEQ ID NO: 2413704 - protein, 9 aa, Entamoeba dispar
ATAVQREAC

SEQ ID NO: 2413705 - protein, 9 aa, Entamoeba dispar
ATCGDTYEG

SEQ ID NO: 2413706 - protein, 6 aa, Entamoeba dispar
ATCREE

SEQ ID NO: 2413707 - protein, 14 aa, Entamoeba dispar
ATDGDTHLGGNDFD

SEQ ID NO: 2413708 - protein, 7 aa, Entamoeba dispar
ATDGSRG

SEQ ID NO: 2413709 - protein, 8 aa, Entamoeba dispar
ATDKDIDS

SEQ ID NO: 2413710 - protein, 5 aa, Entamoeba dispar
ATDME

SEQ ID NO: 2413711 - protein, 32 aa, Entamoeba dispar
ATDNGLSKEEDNDEEEEDEELLEEEDEPINTF

SEQ ID NO: 2413712 - protein, 9 aa, Entamoeba dispar
ATDQKQRKE

SEQ ID NO: 2413713 - protein, 5 aa, Entamoeba dispar
ATDQS

SEQ ID NO: 2413714 - protein, 5 aa, Entamoeba dispar
ATDVR

SEQ ID NO: 2413715 - protein, 5 aa, Entamoeba dispar
ATEDI

SEQ ID NO: 2413716 - protein, 10 aa, Entamoeba dispar
ATEENGWQTS

SEQ ID NO: 2413717 - protein, 4 aa, Entamoeba dispar
ATEF

SEQ ID NO: 2413718 - protein, 13 aa, Entamoeba dispar
ATEFKSARQPIDN

SEQ ID NO: 2413719 - protein, 19 aa, Entamoeba dispar
ATEGQKKDFPNGIEECGTD

SEQ ID NO: 2413720 - protein, 11 aa, Entamoeba dispar
ATEGTVDDQTF

SEQ ID NO: 2413721 - protein, 14 aa, Entamoeba dispar
ATEKASLGHKTNMT

SEQ ID NO: 2413722 - protein, 8 aa, Entamoeba dispar
ATEKDAYS

SEQ ID NO: 2413723 - protein, 8 aa, Entamoeba dispar
ATEKDVKQ

SEQ ID NO: 2413724 - protein, 17 aa, Entamoeba dispar
ATEKTEVKIDDGKGDTQ

SEQ ID NO: 2413725 - protein, 6 aa, Entamoeba dispar
ATENRK

SEQ ID NO: 2413726 - protein, 8 aa, Entamoeba dispar
ATEQGWDT

SEQ ID NO: 2413727 - protein, 5 aa, Entamoeba dispar
ATEQQ

SEQ ID NO: 2413728 - protein, 6 aa, Entamoeba dispar
ATERVK

SEQ ID NO: 2413729 - protein, 4 aa, Entamoeba dispar
ATEV

SEQ ID NO: 2413730 - protein, 15 aa, Entamoeba dispar
ATEYSEDKANQGGSL

SEQ ID NO: 2413731 - protein, 7 aa, Entamoeba dispar
ATEYTKQ

SEQ ID NO: 2413732 - protein, 13 aa, Entamoeba dispar
ATFATRKRREQMH

SEQ ID NO: 2413733 - protein, 4 aa, Entamoeba dispar
ATFE

SEQ ID NO: 2413734 - protein, 13 aa, Entamoeba dispar
ATFTNRGKRVSDI

SEQ ID NO: 2413735 - protein, 5 aa, Entamoeba dispar
ATGCS

SEQ ID NO: 2413736 - protein, 6 aa, Entamoeba dispar
ATGEQI

SEQ ID NO: 2413737 - protein, 5 aa, Entamoeba dispar
ATGEV

SEQ ID NO: 2413738 - protein, 7 aa, Entamoeba dispar
ATGGEDK

SEQ ID NO: 2413739 - protein, 10 aa, Entamoeba dispar
ATGGGSSDRT

SEQ ID NO: 2413740 - protein, 10 aa, Entamoeba dispar
ATGHNGDDVA

SEQ ID NO: 2413741 - protein, 10 aa, Entamoeba dispar
ATGKKLDNGL

SEQ ID NO: 2413742 - protein, 25 aa, Entamoeba dispar
ATGKKTGIAAKSKQSKFEGSRRSYR

SEQ ID NO: 2413743 - protein, 8 aa, Entamoeba dispar
ATGMSDER

SEQ ID NO: 2413744 - protein, 6 aa, Entamoeba dispar
ATGNAY

SEQ ID NO: 2413745 - protein, 5 aa, Entamoeba dispar
ATGNE

SEQ ID NO: 2413746 - protein, 5 aa, Entamoeba dispar
ATGNR

SEQ ID NO: 2413747 - protein, 4 aa, Entamoeba dispar
ATGQ

SEQ ID NO: 2413748 - protein, 12 aa, Entamoeba dispar
ATGSDVDGKEIK

SEQ ID NO: 2413749 - protein, 8 aa, Entamoeba dispar
ATGSEMNP

SEQ ID NO: 2413750 - protein, 8 aa, Entamoeba dispar
ATGSRDNT

SEQ ID NO: 2413751 - protein, 8 aa, Entamoeba dispar
ATGSTPTA

SEQ ID NO: 2413752 - protein, 17 aa, Entamoeba dispar
ATGTETNNLFVVTIMER

SEQ ID NO: 2413753 - protein, 5 aa, Entamoeba dispar
ATHDI

SEQ ID NO: 2413754 - protein, 5 aa, Entamoeba dispar
ATHNT

SEQ ID NO: 2413755 - protein, 5 aa, Entamoeba dispar
ATHPG

SEQ ID NO: 2413756 - protein, 5 aa, Entamoeba dispar
ATIEG

SEQ ID NO: 2413757 - protein, 9 aa, Entamoeba dispar
ATIEKNRGC

SEQ ID NO: 2413758 - protein, 6 aa, Entamoeba dispar
ATIGSD

SEQ ID NO: 2413759 - protein, 7 aa, Entamoeba dispar
ATIGSSE

SEQ ID NO: 2413760 - protein, 6 aa, Entamoeba dispar
ATIPSA

SEQ ID NO: 2413761 - protein, 62 aa, Entamoeba dispar
ATISQSSNNQSSTKTPTTPITELNKEKRNTISSISQAPIAQKTTEKTKRKEGEKEKKRKKSF

SEQ ID NO: 2413762 - protein, 8 aa, Entamoeba dispar
ATITPGNI

SEQ ID NO: 2413763 - protein, 7 aa, Entamoeba dispar
ATKCESL

SEQ ID NO: 2413764 - protein, 9 aa, Entamoeba dispar
ATKEKKKVT

SEQ ID NO: 2413765 - protein, 6 aa, Entamoeba dispar
ATKETF

SEQ ID NO: 2413766 - protein, 4 aa, Entamoeba dispar
ATKG

SEQ ID NO: 2413767 - protein, 10 aa, Entamoeba dispar
ATKGKEQNKY

SEQ ID NO: 2413768 - protein, 11 aa, Entamoeba dispar
ATKGSKNTHEM

SEQ ID NO: 2413769 - protein, 5 aa, Entamoeba dispar
ATKGY

SEQ ID NO: 2413770 - protein, 9 aa, Entamoeba dispar
ATKIAYSPC

SEQ ID NO: 2413771 - protein, 8 aa, Entamoeba dispar
ATKKKEIK

SEQ ID NO: 2413772 - protein, 11 aa, Entamoeba dispar
ATKNDKDADVL

SEQ ID NO: 2413773 - protein, 7 aa, Entamoeba dispar
ATKNNSV

SEQ ID NO: 2413774 - protein, 5 aa, Entamoeba dispar
ATKPD

SEQ ID NO: 2413775 - protein, 7 aa, Entamoeba dispar
ATKPHSI

SEQ ID NO: 2413776 - protein, 12 aa, Entamoeba dispar
ATKPPASRNTSA

SEQ ID NO: 2413777 - protein, 10 aa, Entamoeba dispar
ATKQGGSWKS

SEQ ID NO: 2413778 - protein, 7 aa, Entamoeba dispar
ATKQSGI

SEQ ID NO: 2413779 - protein, 4 aa, Entamoeba dispar
ATKR

SEQ ID NO: 2413780 - protein, 5 aa, Entamoeba dispar
ATKSM

SEQ ID NO: 2413781 - protein, 7 aa, Entamoeba dispar
ATKSNAM

SEQ ID NO: 2413782 - protein, 5 aa, Entamoeba dispar
ATKTM

SEQ ID NO: 2413783 - protein, 10 aa, Entamoeba dispar
ATKYSGDAKV

SEQ ID NO: 2413784 - protein, 9 aa, Entamoeba dispar
ATLENSDDI

SEQ ID NO: 2413785 - protein, 45 aa, Entamoeba dispar
ATLKAEVEKKDQELKSKGEELEKEKEEQAKKIEEIEKEKEEQVKK

SEQ ID NO: 2413786 - protein, 10 aa, Entamoeba dispar
ATLNKYNEIE

SEQ ID NO: 2413787 - protein, 7 aa, Entamoeba dispar
ATLPSKC

SEQ ID NO: 2413788 - protein, 11 aa, Entamoeba dispar
ATLPTGAGDIT

SEQ ID NO: 2413789 - protein, 11 aa, Entamoeba dispar
ATLPTGDGDIT

SEQ ID NO: 2413790 - protein, 13 aa, Entamoeba dispar
ATLRQANETKATL

SEQ ID NO: 2413791 - protein, 6 aa, Entamoeba dispar
ATMKAQ

SEQ ID NO: 2413792 - protein, 6 aa, Entamoeba dispar
ATNDSY

SEQ ID NO: 2413793 - protein, 9 aa, Entamoeba dispar
ATNESEKGI

SEQ ID NO: 2413794 - protein, 17 aa, Entamoeba dispar
ATNGDVTGCPIAPDQDI

SEQ ID NO: 2413795 - protein, 8 aa, Entamoeba dispar
ATNGSKKF

SEQ ID NO: 2413796 - protein, 29 aa, Entamoeba dispar
ATNISQMKNKNLSTKNIETKTNPTEEENE

SEQ ID NO: 2413797 - protein, 16 aa, Entamoeba dispar
ATNPKGRYDPAKSMSL

SEQ ID NO: 2413798 - protein, 6 aa, Entamoeba dispar
ATNPSM

SEQ ID NO: 2413799 - protein, 30 aa, Entamoeba dispar
ATNQQTHKKKELRKTVEPTTIPSKYPPSQM

SEQ ID NO: 2413800 - protein, 4 aa, Entamoeba dispar
ATNR

SEQ ID NO: 2413801 - protein, 4 aa, Entamoeba dispar
ATNY

SEQ ID NO: 2413802 - protein, 4 aa, Entamoeba dispar
ATPA

SEQ ID NO: 2413803 - protein, 8 aa, Entamoeba dispar
ATPDLNGE

SEQ ID NO: 2413804 - protein, 6 aa, Entamoeba dispar
ATPDTN

SEQ ID NO: 2413805 - protein, 9 aa, Entamoeba dispar
ATPGQQPMR

SEQ ID NO: 2413806 - protein, 6 aa, Entamoeba dispar
ATPINQ

SEQ ID NO: 2413807 - protein, 7 aa, Entamoeba dispar
ATPIRED

SEQ ID NO: 2413808 - protein, 4 aa, Entamoeba dispar
ATPL

SEQ ID NO: 2413809 - protein, 14 aa, Entamoeba dispar
ATPLRATNDGYYDP

SEQ ID NO: 2413810 - protein, 5 aa, Entamoeba dispar
ATPMT

SEQ ID NO: 2413811 - protein, 4 aa, Entamoeba dispar
ATPN

SEQ ID NO: 2413812 - protein, 9 aa, Entamoeba dispar
ATPNGTSTI

SEQ ID NO: 2413813 - protein, 14 aa, Entamoeba dispar
ATPNKLKVPSTEPI

SEQ ID NO: 2413814 - protein, 5 aa, Entamoeba dispar
ATPNN

SEQ ID NO: 2413815 - protein, 14 aa, Entamoeba dispar
ATPNQQYKPKELTD

SEQ ID NO: 2413816 - protein, 7 aa, Entamoeba dispar
ATPPIEE

SEQ ID NO: 2413817 - protein, 14 aa, Entamoeba dispar
ATPRRSSTNKSNVE

SEQ ID NO: 2413818 - protein, 12 aa, Entamoeba dispar
ATPSAAEQEPFQ

SEQ ID NO: 2413819 - protein, 9 aa, Entamoeba dispar
ATPSEEPLP

SEQ ID NO: 2413820 - protein, 6 aa, Entamoeba dispar
ATPSEI

SEQ ID NO: 2413821 - protein, 10 aa, Entamoeba dispar
ATPSPETEEA

SEQ ID NO: 2413822 - protein, 6 aa, Entamoeba dispar
ATPTFT

SEQ ID NO: 2413823 - protein, 6 aa, Entamoeba dispar
ATPTSK

SEQ ID NO: 2413824 - protein, 13 aa, Entamoeba dispar
ATPTTNNLTSNNY

SEQ ID NO: 2413825 - protein, 10 aa, Entamoeba dispar
ATPVSSDLEG

SEQ ID NO: 2413826 - protein, 6 aa, Entamoeba dispar
ATQAMG

SEQ ID NO: 2413827 - protein, 4 aa, Entamoeba dispar
ATQD

SEQ ID NO: 2413828 - protein, 6 aa, Entamoeba dispar
ATQDFD

SEQ ID NO: 2413829 - protein, 8 aa, Entamoeba dispar
ATQDKNGD

SEQ ID NO: 2413830 - protein, 5 aa, Entamoeba dispar
ATQDN

SEQ ID NO: 2413831 - protein, 5 aa, Entamoeba dispar
ATQEG

SEQ ID NO: 2413832 - protein, 12 aa, Entamoeba dispar
ATQGKGDSSQAT

SEQ ID NO: 2413833 - protein, 4 aa, Entamoeba dispar
ATQP

SEQ ID NO: 2413834 - protein, 13 aa, Entamoeba dispar
ATQPTKSINSIGS

SEQ ID NO: 2413835 - protein, 17 aa, Entamoeba dispar
ATQSQDDKQKEDGISSD

SEQ ID NO: 2413836 - protein, 5 aa, Entamoeba dispar
ATQTS

SEQ ID NO: 2413837 - protein, 7 aa, Entamoeba dispar
ATRAEDK

SEQ ID NO: 2413838 - protein, 9 aa, Entamoeba dispar
ATRKEDGAA

SEQ ID NO: 2413839 - protein, 9 aa, Entamoeba dispar
ATRKNDGYE

SEQ ID NO: 2413840 - protein, 13 aa, Entamoeba dispar
ATRNEEIPPKEKH

SEQ ID NO: 2413841 - protein, 14 aa, Entamoeba dispar
ATRPKNLDYDGAEK

SEQ ID NO: 2413842 - protein, 13 aa, Entamoeba dispar
ATSALDSESEKIV

SEQ ID NO: 2413843 - protein, 6 aa, Entamoeba dispar
ATSEIK

SEQ ID NO: 2413844 - protein, 17 aa, Entamoeba dispar
ATSFKGYTDGTVETLEE

SEQ ID NO: 2413845 - protein, 4 aa, Entamoeba dispar
ATSG

SEQ ID NO: 2413846 - protein, 5 aa, Entamoeba dispar
ATSIA

SEQ ID NO: 2413847 - protein, 6 aa, Entamoeba dispar
ATSKES

SEQ ID NO: 2413848 - protein, 7 aa, Entamoeba dispar
ATSMSKE

SEQ ID NO: 2413849 - protein, 4 aa, Entamoeba dispar
ATSN

SEQ ID NO: 2413850 - protein, 9 aa, Entamoeba dispar
ATSNDQEKI

SEQ ID NO: 2413851 - protein, 6 aa, Entamoeba dispar
ATSNES

SEQ ID NO: 2413852 - protein, 10 aa, Entamoeba dispar
ATSNKIPPLG

SEQ ID NO: 2413853 - protein, 13 aa, Entamoeba dispar
ATSPSWNSSFQPS

SEQ ID NO: 2413854 - protein, 10 aa, Entamoeba dispar
ATSQASRENY

SEQ ID NO: 2413855 - protein, 7 aa, Entamoeba dispar
ATSQSSN

SEQ ID NO: 2413856 - protein, 7 aa, Entamoeba dispar
ATSQTQL

SEQ ID NO: 2413857 - protein, 8 aa, Entamoeba dispar
ATSSAKTI

SEQ ID NO: 2413858 - protein, 13 aa, Entamoeba dispar
ATSTIGGEEKVRT

SEQ ID NO: 2413859 - protein, 4 aa, Entamoeba dispar
ATSV

SEQ ID NO: 2413860 - protein, 11 aa, Entamoeba dispar
ATSYDKDRGVA

SEQ ID NO: 2413861 - protein, 5 aa, Entamoeba dispar
ATSYE

SEQ ID NO: 2413862 - protein, 7 aa, Entamoeba dispar
ATTDQTT

SEQ ID NO: 2413863 - protein, 6 aa, Entamoeba dispar
ATTDSL

SEQ ID NO: 2413864 - protein, 8 aa, Entamoeba dispar
ATTEKKKE

SEQ ID NO: 2413865 - protein, 19 aa, Entamoeba dispar
ATTEKTNQRKKQKIVKFPF

SEQ ID NO: 2413866 - protein, 8 aa, Entamoeba dispar
ATTEKTYS

SEQ ID NO: 2413867 - protein, 8 aa, Entamoeba dispar
ATTGQDKT

SEQ ID NO: 2413868 - protein, 16 aa, Entamoeba dispar
ATTGRGRVDDSGPASH

SEQ ID NO: 2413869 - protein, 15 aa, Entamoeba dispar
ATTINEKGHEYEADE

SEQ ID NO: 2413870 - protein, 16 aa, Entamoeba dispar
ATTKADTLVSGSRDKT

SEQ ID NO: 2413871 - protein, 7 aa, Entamoeba dispar
ATTKYNA

SEQ ID NO: 2413872 - protein, 7 aa, Entamoeba dispar
ATTNPKA

SEQ ID NO: 2413873 - protein, 4 aa, Entamoeba dispar
ATTP

SEQ ID NO: 2413874 - protein, 7 aa, Entamoeba dispar
ATTSIDN

SEQ ID NO: 2413875 - protein, 11 aa, Entamoeba dispar
ATTSSKPVLPD

SEQ ID NO: 2413876 - protein, 5 aa, Entamoeba dispar
ATTTF

SEQ ID NO: 2413877 - protein, 7 aa, Entamoeba dispar
ATTVSTP

SEQ ID NO: 2413878 - protein, 26 aa, Entamoeba dispar
ATVAGRGAAPRHPGAGPDGAVPDRRR

SEQ ID NO: 2413879 - protein, 13 aa, Entamoeba dispar
ATVEKKDKTIAEM

SEQ ID NO: 2413880 - protein, 18 aa, Entamoeba dispar
ATVGAPGLRNPSKAPPEF

SEQ ID NO: 2413881 - protein, 6 aa, Entamoeba dispar
ATVGSE

SEQ ID NO: 2413882 - protein, 8 aa, Entamoeba dispar
ATVNDNGS

SEQ ID NO: 2413883 - protein, 5 aa, Entamoeba dispar
ATVSR

SEQ ID NO: 2413884 - protein, 12 aa, Entamoeba dispar
ATVSSASPYAKQ

SEQ ID NO: 2413885 - protein, 9 aa, Entamoeba dispar
ATVSTYATS

SEQ ID NO: 2413886 - protein, 7 aa, Entamoeba dispar
ATVYGEP

SEQ ID NO: 2413887 - protein, 12 aa, Entamoeba dispar
ATYAYSQKDYMT

SEQ ID NO: 2413888 - protein, 4 aa, Entamoeba dispar
ATYH

SEQ ID NO: 2413889 - protein, 7 aa, Entamoeba dispar
ATYKNGN

SEQ ID NO: 2413890 - protein, 5 aa, Entamoeba dispar
ATYSL

SEQ ID NO: 2413891 - protein, 37 aa, Entamoeba dispar
AVAERKRQLQERMEEEEKQREEEFKRQEAEEREHAER

SEQ ID NO: 2413892 - protein, 38 aa, Entamoeba dispar
AVAPAAAAATESETKEEKKEDKKEEEEAEEDFGGFGDL

SEQ ID NO: 2413893 - protein, 9 aa, Entamoeba dispar
AVAPGQNKN

SEQ ID NO: 2413894 - protein, 13 aa, Entamoeba dispar
AVARSDDKKKFGI

SEQ ID NO: 2413895 - protein, 9 aa, Entamoeba dispar
AVASSEKLT

SEQ ID NO: 2413896 - protein, 39 aa, Entamoeba dispar
  misc_feature (36)..(37): Xaa can be any naturally occurring amino acid
AVATETKAEEKKEEAPAAKKGEEEEDFGGFGDCSKXXIC

SEQ ID NO: 2413897 - protein, 33 aa, Entamoeba dispar
AVATETKTEEKKEEAPAAKEEEEEEDFGGFGDL

SEQ ID NO: 2413898 - protein, 6 aa, Entamoeba dispar
AVDDEK

SEQ ID NO: 2413899 - protein, 23 aa, Entamoeba dispar
AVDDNDTVPLENKKEPKKSKCYL

SEQ ID NO: 2413900 - protein, 6 aa, Entamoeba dispar
AVDGEE

SEQ ID NO: 2413901 - protein, 39 aa, Entamoeba dispar
AVDNKNTGALAKNAKEALTATKATIPKMKETAQKEKEPL

SEQ ID NO: 2413902 - protein, 9 aa, Entamoeba dispar
AVDPGELSF

SEQ ID NO: 2413903 - protein, 6 aa, Entamoeba dispar
AVDTDN

SEQ ID NO: 2413904 - protein, 19 aa, Entamoeba dispar
AVDTPPSEEQEQNKDNTFE

SEQ ID NO: 2413905 - protein, 12 aa, Entamoeba dispar
AVEDENNAEGID

SEQ ID NO: 2413906 - protein, 13 aa, Entamoeba dispar
AVEEKKKALEETL

SEQ ID NO: 2413907 - protein, 15 aa, Entamoeba dispar
AVEKATHNEGQSYLE

SEQ ID NO: 2413908 - protein, 5 aa, Entamoeba dispar
AVEQD

SEQ ID NO: 2413909 - protein, 8 aa, Entamoeba dispar
AVEQSSSV

SEQ ID NO: 2413910 - protein, 24 aa, Entamoeba dispar
AVERKVSDLEKKVEGYKTDYETAQ

SEQ ID NO: 2413911 - protein, 20 aa, Entamoeba dispar
AVETTMKSDPKEKKHPKFSG

SEQ ID NO: 2413912 - protein, 10 aa, Entamoeba dispar
AVGANQLDDN

SEQ ID NO: 2413913 - protein, 22 aa, Entamoeba dispar
AVGDGASSETKETIGSCGDLDR

SEQ ID NO: 2413914 - protein, 13 aa, Entamoeba dispar
AVGEDDKEEINDL

SEQ ID NO: 2413915 - protein, 5 aa, Entamoeba dispar
AVGEN

SEQ ID NO: 2413916 - protein, 14 aa, Entamoeba dispar
AVGGVETLDQPDVD

SEQ ID NO: 2413917 - protein, 4 aa, Entamoeba dispar
AVGK

SEQ ID NO: 2413918 - protein, 5 aa, Entamoeba dispar
AVGKT

SEQ ID NO: 2413919 - protein, 9 aa, Entamoeba dispar
AVGKTSLSN

SEQ ID NO: 2413920 - protein, 14 aa, Entamoeba dispar
AVGLREQKQQLQQK

SEQ ID NO: 2413921 - protein, 9 aa, Entamoeba dispar
AVGNEETPL

SEQ ID NO: 2413922 - protein, 8 aa, Entamoeba dispar
AVHDNTTT

SEQ ID NO: 2413923 - protein, 6 aa, Entamoeba dispar
AVIESR

SEQ ID NO: 2413924 - protein, 5 aa, Entamoeba dispar
AVKDK

SEQ ID NO: 2413925 - protein, 10 aa, Entamoeba dispar
AVKEGKCDQS

SEQ ID NO: 2413926 - protein, 7 aa, Entamoeba dispar
AVKEGKT

SEQ ID NO: 2413927 - protein, 51 aa, Entamoeba dispar
AVKNKDVKKKKIAENLSEDLAPSINDSKASLVDKENKAKKEKAKQSLEKLK

SEQ ID NO: 2413928 - protein, 9 aa, Entamoeba dispar
AVKNSNDDT

SEQ ID NO: 2413929 - protein, 9 aa, Entamoeba dispar
AVKTAETGY

SEQ ID NO: 2413930 - protein, 4 aa, Entamoeba dispar
AVLE

SEQ ID NO: 2413931 - protein, 4 aa, Entamoeba dispar
AVME

SEQ ID NO: 2413932 - protein, 9 aa, Entamoeba dispar
AVNEEKMGK

SEQ ID NO: 2413933 - protein, 6 aa, Entamoeba dispar
AVNRGD

SEQ ID NO: 2413934 - protein, 23 aa, Entamoeba dispar
AVNRRKDCHDVSSVNESFTQILT

SEQ ID NO: 2413935 - protein, 9 aa, Entamoeba dispar
AVNSNETPS

SEQ ID NO: 2413936 - protein, 6 aa, Entamoeba dispar
AVNVNE

SEQ ID NO: 2413937 - protein, 17 aa, Entamoeba dispar
AVPGKSKPKFFGKKGKK

SEQ ID NO: 2413938 - protein, 13 aa, Entamoeba dispar
AVPKKTYKPVPIT

SEQ ID NO: 2413939 - protein, 20 aa, Entamoeba dispar
AVPPPPAPVTVTTTSNSTGV

SEQ ID NO: 2413940 - protein, 5 aa, Entamoeba dispar
AVPQV

SEQ ID NO: 2413941 - protein, 11 aa, Entamoeba dispar
AVPSRSRKQCR

SEQ ID NO: 2413942 - protein, 12 aa, Entamoeba dispar
AVPSSWNATEDI

SEQ ID NO: 2413943 - protein, 9 aa, Entamoeba dispar
AVQQGTVPK

SEQ ID NO: 2413944 - protein, 9 aa, Entamoeba dispar
AVQTKSKDL

SEQ ID NO: 2413945 - protein, 6 aa, Entamoeba dispar
AVRGKG

SEQ ID NO: 2413946 - protein, 6 aa, Entamoeba dispar
AVRSPS

SEQ ID NO: 2413947 - protein, 9 aa, Entamoeba dispar
AVSEEATPA

SEQ ID NO: 2413948 - protein, 6 aa, Entamoeba dispar
AVSGGQ

SEQ ID NO: 2413949 - protein, 7 aa, Entamoeba dispar
AVSKERC

SEQ ID NO: 2413950 - protein, 5 aa, Entamoeba dispar
AVSSN

SEQ ID NO: 2413951 - protein, 5 aa, Entamoeba dispar
AVSSP

SEQ ID NO: 2413952 - protein, 14 aa, Entamoeba dispar
AVSSTDSSITLFGF

SEQ ID NO: 2413953 - protein, 6 aa, Entamoeba dispar
AVSTRE

SEQ ID NO: 2413954 - protein, 5 aa, Entamoeba dispar
AVTNT

SEQ ID NO: 2413955 - protein, 9 aa, Entamoeba dispar
AVTPGQNQK

SEQ ID NO: 2413956 - protein, 6 aa, Entamoeba dispar
AVVGAG

SEQ ID NO: 2413957 - protein, 4 aa, Entamoeba dispar
AVYS

SEQ ID NO: 2413958 - protein, 6 aa, Entamoeba dispar
AWTERS

SEQ ID NO: 2413959 - protein, 11 aa, Entamoeba dispar
AYAGKNHPPEI

SEQ ID NO: 2413960 - protein, 5 aa, Entamoeba dispar
AYAPA

SEQ ID NO: 2413961 - protein, 16 aa, Entamoeba dispar
AYAPSTASSKKITVNG

SEQ ID NO: 2413962 - protein, 51 aa, Entamoeba dispar
AYAPTSGASKKITVNGKTVTVTANTQVGKSAPRMKGKVEHKGAAAETKKLE

SEQ ID NO: 2413963 - protein, 7 aa, Entamoeba dispar
AYAQDPT

SEQ ID NO: 2413964 - protein, 12 aa, Entamoeba dispar
AYASTAKKGDFR

SEQ ID NO: 2413965 - protein, 11 aa, Entamoeba dispar
AYDKDGSSNTV

SEQ ID NO: 2413966 - protein, 4 aa, Entamoeba dispar
AYDR

SEQ ID NO: 2413967 - protein, 8 aa, Entamoeba dispar
AYDSNGKK

SEQ ID NO: 2413968 - protein, 5 aa, Entamoeba dispar
AYENQ

SEQ ID NO: 2413969 - protein, 12 aa, Entamoeba dispar
AYGGGMDGPESV

SEQ ID NO: 2413970 - protein, 7 aa, Entamoeba dispar
AYGNDGV

SEQ ID NO: 2413971 - protein, 17 aa, Entamoeba dispar
AYGPGCPGLNTPATSAK

SEQ ID NO: 2413972 - protein, 5 aa, Entamoeba dispar
AYGST

SEQ ID NO: 2413973 - protein, 12 aa, Entamoeba dispar
AYKDEPDGIEYS

SEQ ID NO: 2413974 - protein, 7 aa, Entamoeba dispar
AYKPEQL

SEQ ID NO: 2413975 - protein, 11 aa, Entamoeba dispar
AYKPSVDNSMS

SEQ ID NO: 2413976 - protein, 9 aa, Entamoeba dispar
AYNPYTEPS

SEQ ID NO: 2413977 - protein, 12 aa, Entamoeba dispar
AYNQQTETELKP

SEQ ID NO: 2413978 - protein, 14 aa, Entamoeba dispar
AYNRAQQSRHNKSP

SEQ ID NO: 2413979 - protein, 16 aa, Entamoeba dispar
AYNTSLEKLGNDPSNY

SEQ ID NO: 2413980 - protein, 11 aa, Entamoeba dispar
AYNYNSESQEV

SEQ ID NO: 2413981 - protein, 5 aa, Entamoeba dispar
AYPEN

SEQ ID NO: 2413982 - protein, 4 aa, Entamoeba dispar
AYPL

SEQ ID NO: 2413983 - protein, 4 aa, Entamoeba dispar
AYPS

SEQ ID NO: 2413984 - protein, 6 aa, Entamoeba dispar
AYQNKA

SEQ ID NO: 2413985 - protein, 119 aa, Entamoeba dispar
AYQPSQQPNETYNLPPQLPVRNQPPQLPPRSQQNTQVPPQLPPRNQPPQLPPRNQPPQLPPRSQQQPNYGVGPQMQQPQYIPPNGYPPNQLGYNPYQQVPRGQYNNPINQPPQQYGYTP

SEQ ID NO: 2413986 - protein, 4 aa, Entamoeba dispar
AYQR

SEQ ID NO: 2413987 - protein, 11 aa, Entamoeba dispar
AYSADEELRST

SEQ ID NO: 2413988 - protein, 13 aa, Entamoeba dispar
AYSDPIKDAEGKS

SEQ ID NO: 2413989 - protein, 5 aa, Entamoeba dispar
AYSDT

SEQ ID NO: 2413990 - protein, 14 aa, Entamoeba dispar
AYSEDKSLTGTARY

SEQ ID NO: 2413991 - protein, 11 aa, Entamoeba dispar
AYSESEKVKLT

SEQ ID NO: 2413992 - protein, 9 aa, Entamoeba dispar
AYSKAQTTL

SEQ ID NO: 2413993 - protein, 20 aa, Entamoeba dispar
AYSSDYKTSMTETHETRKKV

SEQ ID NO: 2413994 - protein, 8 aa, Entamoeba dispar
AYSSPEND

SEQ ID NO: 2413995 - protein, 10 aa, Entamoeba dispar
AYSTSGMKTR

SEQ ID NO: 2413996 - protein, 18 aa, Entamoeba dispar
AYTETDENIKEKREQERA

SEQ ID NO: 2413997 - protein, 10 aa, Entamoeba dispar
AYTKEDQRKW

SEQ ID NO: 2413998 - protein, 5 aa, Entamoeba dispar
AYTKS

SEQ ID NO: 2413999 - protein, 4 aa, Entamoeba dispar
AYTQ

SEQ ID NO: 2414000 - protein, 15 aa, Entamoeba dispar
AYYTKNTGKPLKDIT

SEQ ID NO: 2414001 - protein, 20 aa, Entamoeba dispar
CAAPRLKDAGLNDDEKNEAY

SEQ ID NO: 2414002 - protein, 9 aa, Entamoeba dispar
CADETRIRE

SEQ ID NO: 2414003 - protein, 9 aa, Entamoeba dispar
CADKNYSEK

SEQ ID NO: 2414004 - protein, 16 aa, Entamoeba dispar
CADQRAGRAGRTGPGK

SEQ ID NO: 2414005 - protein, 28 aa, Entamoeba dispar
CAERKEHDINSGVSISAAKQRVGKNKIT

SEQ ID NO: 2414006 - protein, 4 aa, Entamoeba dispar
CAPS

SEQ ID NO: 2414007 - protein, 10 aa, Entamoeba dispar
CAPTEDEVNS

SEQ ID NO: 2414008 - protein, 10 aa, Entamoeba dispar
CARPESKVTF

SEQ ID NO: 2414009 - protein, 9 aa, Entamoeba dispar
CARPESPVT

SEQ ID NO: 2414010 - protein, 7 aa, Entamoeba dispar
CASNNST

SEQ ID NO: 2414011 - protein, 5 aa, Entamoeba dispar
CASYG

SEQ ID NO: 2414012 - protein, 11 aa, Entamoeba dispar
CATESNTSMEK

SEQ ID NO: 2414013 - protein, 9 aa, Entamoeba dispar
CATTEDPNI

SEQ ID NO: 2414014 - protein, 5 aa, Entamoeba dispar
CCNEA

SEQ ID NO: 2414015 - protein, 11 aa, Entamoeba dispar
CDDAKATLTDK

SEQ ID NO: 2414016 - protein, 5 aa, Entamoeba dispar
CDDES

SEQ ID NO: 2414017 - protein, 14 aa, Entamoeba dispar
CDDHSRSPHPIEGG

SEQ ID NO: 2414018 - protein, 11 aa, Entamoeba dispar
CDDNSEIRNPK

SEQ ID NO: 2414019 - protein, 7 aa, Entamoeba dispar
CDDSSRI

SEQ ID NO: 2414020 - protein, 22 aa, Entamoeba dispar
CDECPSKSSCASNTSSQGGCSH

SEQ ID NO: 2414021 - protein, 5 aa, Entamoeba dispar
CDEEM

SEQ ID NO: 2414022 - protein, 7 aa, Entamoeba dispar
CDEKRRE

SEQ ID NO: 2414023 - protein, 5 aa, Entamoeba dispar
CDERE

SEQ ID NO: 2414024 - protein, 15 aa, Entamoeba dispar
CDESNTECSIKSDNM

SEQ ID NO: 2414025 - protein, 8 aa, Entamoeba dispar
CDESSPNV

SEQ ID NO: 2414026 - protein, 4 aa, Entamoeba dispar
CDET

SEQ ID NO: 2414027 - protein, 13 aa, Entamoeba dispar
CDETEENRKKERI

SEQ ID NO: 2414028 - protein, 10 aa, Entamoeba dispar
CDETSPQKRY

SEQ ID NO: 2414029 - protein, 6 aa, Entamoeba dispar
CDGLKQ

SEQ ID NO: 2414030 - protein, 9 aa, Entamoeba dispar
CDGRKNINK

SEQ ID NO: 2414031 - protein, 7 aa, Entamoeba dispar
CDKTPDI

SEQ ID NO: 2414032 - protein, 4 aa, Entamoeba dispar
CDLD

SEQ ID NO: 2414033 - protein, 19 aa, Entamoeba dispar
CDLDNRTVTTEQAQEFADK

SEQ ID NO: 2414034 - protein, 6 aa, Entamoeba dispar
CDLEEQ

SEQ ID NO: 2414035 - protein, 19 aa, Entamoeba dispar
CDLEEQRQIPNEEAKKLAE

SEQ ID NO: 2414036 - protein, 17 aa, Entamoeba dispar
CDMESDRQVNTSEVKQI

SEQ ID NO: 2414037 - protein, 24 aa, Entamoeba dispar
CDNEPLGIDQSTEIKKEEITKEEY

SEQ ID NO: 2414038 - protein, 9 aa, Entamoeba dispar
CDNKPTGLK

SEQ ID NO: 2414039 - protein, 6 aa, Entamoeba dispar
CDNTSQ

SEQ ID NO: 2414040 - protein, 4 aa, Entamoeba dispar
CDPE

SEQ ID NO: 2414041 - protein, 6 aa, Entamoeba dispar
CDPKSK

SEQ ID NO: 2414042 - protein, 7 aa, Entamoeba dispar
CDPSVRK

SEQ ID NO: 2414043 - protein, 6 aa, Entamoeba dispar
CDPTHS

SEQ ID NO: 2414044 - protein, 5 aa, Entamoeba dispar
CDQLR

SEQ ID NO: 2414045 - protein, 12 aa, Entamoeba dispar
CDQPTKTLLLEQ

SEQ ID NO: 2414046 - protein, 19 aa, Entamoeba dispar
CDQQKTNQSIISEEQGIEQ

SEQ ID NO: 2414047 - protein, 14 aa, Entamoeba dispar
CDQRKGVKEEELKK

SEQ ID NO: 2414048 - protein, 12 aa, Entamoeba dispar
CDQTPQQEDFEP

SEQ ID NO: 2414049 - protein, 6 aa, Entamoeba dispar
CDRNGP

SEQ ID NO: 2414050 - protein, 20 aa, Entamoeba dispar
CDSCPSKGKCGGGNNGPDIE

SEQ ID NO: 2414051 - protein, 8 aa, Entamoeba dispar
CDSETITK

SEQ ID NO: 2414052 - protein, 7 aa, Entamoeba dispar
CDSKTKV

SEQ ID NO: 2414053 - protein, 5 aa, Entamoeba dispar
CDSND

SEQ ID NO: 2414054 - protein, 21 aa, Entamoeba dispar
CDSSQRTVTTDEGKDKAKKLN

SEQ ID NO: 2414055 - protein, 5 aa, Entamoeba dispar
CDSTI

SEQ ID NO: 2414056 - protein, 6 aa, Entamoeba dispar
CDTCTD

SEQ ID NO: 2414057 - protein, 10 aa, Entamoeba dispar
CDTGNDNKPL

SEQ ID NO: 2414058 - protein, 22 aa, Entamoeba dispar
CDTGYFSRETKEFSPALGEDSI

SEQ ID NO: 2414059 - protein, 13 aa, Entamoeba dispar
CDTRSAESCQETI

SEQ ID NO: 2414060 - protein, 6 aa, Entamoeba dispar
CEAEGT

SEQ ID NO: 2414061 - protein, 12 aa, Entamoeba dispar
CEDGSDENEGLC

SEQ ID NO: 2414062 - protein, 15 aa, Entamoeba dispar
CEDKPISKNYANISK

SEQ ID NO: 2414063 - protein, 12 aa, Entamoeba dispar
CEDNEKKPKGVT

SEQ ID NO: 2414064 - protein, 9 aa, Entamoeba dispar
CEDPGKVAK

SEQ ID NO: 2414065 - protein, 10 aa, Entamoeba dispar
CEDQEGNSTF

SEQ ID NO: 2414066 - protein, 6 aa, Entamoeba dispar
CEDSGE

SEQ ID NO: 2414067 - protein, 8 aa, Entamoeba dispar
CEDTTSGS

SEQ ID NO: 2414068 - protein, 8 aa, Entamoeba dispar
CEEATKNA

SEQ ID NO: 2414069 - protein, 7 aa, Entamoeba dispar
CEEEGCD

SEQ ID NO: 2414070 - protein, 5 aa, Entamoeba dispar
CEEEL

SEQ ID NO: 2414071 - protein, 13 aa, Entamoeba dispar
CEEELKKNERIPR

SEQ ID NO: 2414072 - protein, 5 aa, Entamoeba dispar
CEEGE

SEQ ID NO: 2414073 - protein, 4 aa, Entamoeba dispar
CEEH

SEQ ID NO: 2414074 - protein, 15 aa, Entamoeba dispar
CEEIEEKYKASQSAV

SEQ ID NO: 2414075 - protein, 8 aa, Entamoeba dispar
CEEQLEGG

SEQ ID NO: 2414076 - protein, 9 aa, Entamoeba dispar
CEESPQNTV

SEQ ID NO: 2414077 - protein, 9 aa, Entamoeba dispar
CEETGTRYK

SEQ ID NO: 2414078 - protein, 9 aa, Entamoeba dispar
CEETPKTRY

SEQ ID NO: 2414079 - protein, 17 aa, Entamoeba dispar
CEGATAESIVKPGRSFV

SEQ ID NO: 2414080 - protein, 8 aa, Entamoeba dispar
CEGPPTIK

SEQ ID NO: 2414081 - protein, 5 aa, Entamoeba dispar
CEGRN

SEQ ID NO: 2414082 - protein, 8 aa, Entamoeba dispar
CEIDQPSQ

SEQ ID NO: 2414083 - protein, 7 aa, Entamoeba dispar
CEIPNGV

SEQ ID NO: 2414084 - protein, 5 aa, Entamoeba dispar
CEKDE

SEQ ID NO: 2414085 - protein, 22 aa, Entamoeba dispar
CEKERIREGKEKNIQTYSNNEV

SEQ ID NO: 2414086 - protein, 5 aa, Entamoeba dispar
CEKES

SEQ ID NO: 2414087 - protein, 10 aa, Entamoeba dispar
CEKKAKVNGL

SEQ ID NO: 2414088 - protein, 5 aa, Entamoeba dispar
CEKNK

SEQ ID NO: 2414089 - protein, 8 aa, Entamoeba dispar
CEKSSKEL

SEQ ID NO: 2414090 - protein, 9 aa, Entamoeba dispar
CELEEKEKE

SEQ ID NO: 2414091 - protein, 11 aa, Entamoeba dispar
CELNEEEQKKI

SEQ ID NO: 2414092 - protein, 9 aa, Entamoeba dispar
CELSSSEES

SEQ ID NO: 2414093 - protein, 6 aa, Entamoeba dispar
CENDIS

SEQ ID NO: 2414094 - protein, 5 aa, Entamoeba dispar
CENED

SEQ ID NO: 2414095 - protein, 18 aa, Entamoeba dispar
CENELKNNERIPKKCFDT

SEQ ID NO: 2414096 - protein, 8 aa, Entamoeba dispar
CENGKKAS

SEQ ID NO: 2414097 - protein, 8 aa, Entamoeba dispar
CENGQHGN

SEQ ID NO: 2414098 - protein, 114 aa, Entamoeba dispar
CENGTTYKCGNKTTNQENSSDDRSDGKSNDYSEGSNNKESSSNNNGQSEDTSNNNSEESKNKEDDSKSQSDEKSMNHSEDGSKGHSEDSSSAHSDGNSKTHSEDDSKDSIDSAP

SEQ ID NO: 2414099 - protein, 12 aa, Entamoeba dispar
CENGVGKEYYKD

SEQ ID NO: 2414100 - protein, 5 aa, Entamoeba dispar
CENPE

SEQ ID NO: 2414101 - protein, 6 aa, Entamoeba dispar
CENPET

SEQ ID NO: 2414102 - protein, 8 aa, Entamoeba dispar
CENSSRSI

SEQ ID NO: 2414103 - protein, 17 aa, Entamoeba dispar
CEPNQTKSSSLKNQSGL

SEQ ID NO: 2414104 - protein, 6 aa, Entamoeba dispar
CEPTPT

SEQ ID NO: 2414105 - protein, 4 aa, Entamoeba dispar
CEQP

SEQ ID NO: 2414106 - protein, 8 aa, Entamoeba dispar
CERAEKEN

SEQ ID NO: 2414107 - protein, 14 aa, Entamoeba dispar
CERDPKTYGPTGKE

SEQ ID NO: 2414108 - protein, 5 aa, Entamoeba dispar
CEREK

SEQ ID NO: 2414109 - protein, 5 aa, Entamoeba dispar
CERKV

SEQ ID NO: 2414110 - protein, 10 aa, Entamoeba dispar
CESDGDLDGI

SEQ ID NO: 2414111 - protein, 5 aa, Entamoeba dispar
CESDS

SEQ ID NO: 2414112 - protein, 11 aa, Entamoeba dispar
CESDSKKAQEV

SEQ ID NO: 2414113 - protein, 8 aa, Entamoeba dispar
CESGIPEV

SEQ ID NO: 2414114 - protein, 8 aa, Entamoeba dispar
CESHPEDD

SEQ ID NO: 2414115 - protein, 30 aa, Entamoeba dispar
CESNTNGNIKEENCLEKDNEIESEVPPKKE

SEQ ID NO: 2414116 - protein, 6 aa, Entamoeba dispar
CETKNA

SEQ ID NO: 2414117 - protein, 8 aa, Entamoeba dispar
CETKSDEQ

SEQ ID NO: 2414118 - protein, 5 aa, Entamoeba dispar
CETNE

SEQ ID NO: 2414119 - protein, 7 aa, Entamoeba dispar
CETQVND

SEQ ID NO: 2414120 - protein, 5 aa, Entamoeba dispar
CETSQ

SEQ ID NO: 2414121 - protein, 10 aa, Entamoeba dispar
CEVPQNGGKG

SEQ ID NO: 2414122 - protein, 5 aa, Entamoeba dispar
CFNAR

SEQ ID NO: 2414123 - protein, 6 aa, Entamoeba dispar
CFPEGE

SEQ ID NO: 2414124 - protein, 7 aa, Entamoeba dispar
CFQERRK

SEQ ID NO: 2414125 - protein, 5 aa, Entamoeba dispar
CFTSR

SEQ ID NO: 2414126 - protein, 4 aa, Entamoeba dispar
CGAD

SEQ ID NO: 2414127 - protein, 6 aa, Entamoeba dispar
CGADGK

SEQ ID NO: 2414128 - protein, 7 aa, Entamoeba dispar
CGAGGPI

SEQ ID NO: 2414129 - protein, 15 aa, Entamoeba dispar
CGAPLPAKGIAKTKI

SEQ ID NO: 2414130 - protein, 33 aa, Entamoeba dispar
CGAPTGEGATTQEPATQHRPTTPPPSALDEDTI

SEQ ID NO: 2414131 - protein, 5 aa, Entamoeba dispar
CGCKS

SEQ ID NO: 2414132 - protein, 36 aa, Entamoeba dispar
CGDEDEKKKEKKKVDKKEDSPLKKEEKEESSANVST

SEQ ID NO: 2414133 - protein, 5 aa, Entamoeba dispar
CGDSE

SEQ ID NO: 2414134 - protein, 16 aa, Entamoeba dispar
CGDSEETTTSPHEINS

SEQ ID NO: 2414135 - protein, 5 aa, Entamoeba dispar
CGDSV

SEQ ID NO: 2414136 - protein, 4 aa, Entamoeba dispar
CGEE

SEQ ID NO: 2414137 - protein, 11 aa, Entamoeba dispar
CGEEKKEFSCD

SEQ ID NO: 2414138 - protein, 6 aa, Entamoeba dispar
CGENQA

SEQ ID NO: 2414139 - protein, 4 aa, Entamoeba dispar
CGES

SEQ ID NO: 2414140 - protein, 7 aa, Entamoeba dispar
CGETGHY

SEQ ID NO: 2414141 - protein, 6 aa, Entamoeba dispar
CGFQGS

SEQ ID NO: 2414142 - protein, 9 aa, Entamoeba dispar
CGGKPTDKT

SEQ ID NO: 2414143 - protein, 8 aa, Entamoeba dispar
CGGKSNNI

SEQ ID NO: 2414144 - protein, 12 aa, Entamoeba dispar
CGGNQNLGGNDF

SEQ ID NO: 2414145 - protein, 11 aa, Entamoeba dispar
CGGNQNLGGNE

SEQ ID NO: 2414146 - protein, 6 aa, Entamoeba dispar
CGGQSG

SEQ ID NO: 2414147 - protein, 6 aa, Entamoeba dispar
CGGTTT

SEQ ID NO: 2414148 - protein, 8 aa, Entamoeba dispar
CGGYTERG

SEQ ID NO: 2414149 - protein, 6 aa, Entamoeba dispar
CGHSKD

SEQ ID NO: 2414150 - protein, 23 aa, Entamoeba dispar
CGIRRGDDKPVSRYSVPSNEESV

SEQ ID NO: 2414151 - protein, 10 aa, Entamoeba dispar
CGKEMTQNLR

SEQ ID NO: 2414152 - protein, 5 aa, Entamoeba dispar
CGKES

SEQ ID NO: 2414153 - protein, 6 aa, Entamoeba dispar
CGKGIK

SEQ ID NO: 2414154 - protein, 5 aa, Entamoeba dispar
CGKPL

SEQ ID NO: 2414155 - protein, 10 aa, Entamoeba dispar
CGKPPPEKNG

SEQ ID NO: 2414156 - protein, 7 aa, Entamoeba dispar
CGKPVEG

SEQ ID NO: 2414157 - protein, 7 aa, Entamoeba dispar
CGKQLGG

SEQ ID NO: 2414158 - protein, 9 aa, Entamoeba dispar
CGKTDTVIS

SEQ ID NO: 2414159 - protein, 13 aa, Entamoeba dispar
CGMGSRPAKSARV

SEQ ID NO: 2414160 - protein, 13 aa, Entamoeba dispar
CGMNDEKELSKTR

SEQ ID NO: 2414161 - protein, 10 aa, Entamoeba dispar
CGNEIEKGRN

SEQ ID NO: 2414162 - protein, 5 aa, Entamoeba dispar
CGNEN

SEQ ID NO: 2414163 - protein, 11 aa, Entamoeba dispar
CGNENGPQLST

SEQ ID NO: 2414164 - protein, 8 aa, Entamoeba dispar
CGNGETID

SEQ ID NO: 2414165 - protein, 6 aa, Entamoeba dispar
CGNGKY

SEQ ID NO: 2414166 - protein, 16 aa, Entamoeba dispar
CGNNEQPVWSENTRKK

SEQ ID NO: 2414167 - protein, 7 aa, Entamoeba dispar
CGNPECD

SEQ ID NO: 2414168 - protein, 5 aa, Entamoeba dispar
CGNPR

SEQ ID NO: 2414169 - protein, 6 aa, Entamoeba dispar
CGNQLG

SEQ ID NO: 2414170 - protein, 20 aa, Entamoeba dispar
CGNSTTQPTPINQQPKTNNN

SEQ ID NO: 2414171 - protein, 4 aa, Entamoeba dispar
CGNT

SEQ ID NO: 2414172 - protein, 8 aa, Entamoeba dispar
CGPGEEPK

SEQ ID NO: 2414173 - protein, 8 aa, Entamoeba dispar
CGPKKKIT

SEQ ID NO: 2414174 - protein, 7 aa, Entamoeba dispar
CGPKTSI

SEQ ID NO: 2414175 - protein, 5 aa, Entamoeba dispar
CGPNR

SEQ ID NO: 2414176 - protein, 25 aa, Entamoeba dispar
CGPSQYARPPVYSQGTYSSSSLGRV

SEQ ID NO: 2414177 - protein, 5 aa, Entamoeba dispar
CGPTS

SEQ ID NO: 2414178 - protein, 9 aa, Entamoeba dispar
CGQAGDRMH

SEQ ID NO: 2414179 - protein, 8 aa, Entamoeba dispar
CGQPSSPG

SEQ ID NO: 2414180 - protein, 10 aa, Entamoeba dispar
CGRANTATFL

SEQ ID NO: 2414181 - protein, 7 aa, Entamoeba dispar
CGRSTEL

SEQ ID NO: 2414182 - protein, 6 aa, Entamoeba dispar
CGSAES

SEQ ID NO: 2414183 - protein, 8 aa, Entamoeba dispar
CGSEEAYS

SEQ ID NO: 2414184 - protein, 23 aa, Entamoeba dispar
CGSESLKKEEYVKENSQSSLSSN

SEQ ID NO: 2414185 - protein, 18 aa, Entamoeba dispar
CGSGGEANETAELSGEID

SEQ ID NO: 2414186 - protein, 4 aa, Entamoeba dispar
CGSL

SEQ ID NO: 2414187 - protein, 10 aa, Entamoeba dispar
CGSQTNTSLI

SEQ ID NO: 2414188 - protein, 8 aa, Entamoeba dispar
CGSSDGQI

SEQ ID NO: 2414189 - protein, 8 aa, Entamoeba dispar
CGSSGYDR

SEQ ID NO: 2414190 - protein, 4 aa, Entamoeba dispar
CGST

SEQ ID NO: 2414191 - protein, 6 aa, Entamoeba dispar
CGSTSL

SEQ ID NO: 2414192 - protein, 6 aa, Entamoeba dispar
CGTAIN

SEQ ID NO: 2414193 - protein, 11 aa, Entamoeba dispar
CGTEADSEQQY

SEQ ID NO: 2414194 - protein, 15 aa, Entamoeba dispar
CGTETGYNEDLSGHT

SEQ ID NO: 2414195 - protein, 9 aa, Entamoeba dispar
CGTGPQNDH

SEQ ID NO: 2414196 - protein, 12 aa, Entamoeba dispar
CGTNGKSSPKKF

SEQ ID NO: 2414197 - protein, 84 aa, Entamoeba dispar
CGTPVKSTPSNNLKTASLTPTITKSSTSSSLKPVTSTNTTRSTKPTSSNSTSSSSSISSKKSYFESKDKEVQKEKKVKQPKEKS

SEQ ID NO: 2414198 - protein, 5 aa, Entamoeba dispar
CGTQR

SEQ ID NO: 2414199 - protein, 5 aa, Entamoeba dispar
CGTTI

SEQ ID NO: 2414200 - protein, 6 aa, Entamoeba dispar
CGVENR

SEQ ID NO: 2414201 - protein, 18 aa, Entamoeba dispar
CGVQDSLNTTLTKRSQEA

SEQ ID NO: 2414202 - protein, 10 aa, Entamoeba dispar
CGWGDKPSFA

SEQ ID NO: 2414203 - protein, 14 aa, Entamoeba dispar
CGWGEKSAKAAISA

SEQ ID NO: 2414204 - protein, 7 aa, Entamoeba dispar
CGYPSDI

SEQ ID NO: 2414205 - protein, 10 aa, Entamoeba dispar
CGYQGDELTG

SEQ ID NO: 2414206 - protein, 10 aa, Entamoeba dispar
CHDNSGSARV

SEQ ID NO: 2414207 - protein, 9 aa, Entamoeba dispar
CHENENRYD

SEQ ID NO: 2414208 - protein, 6 aa, Entamoeba dispar
CHKGSR

SEQ ID NO: 2414209 - protein, 6 aa, Entamoeba dispar
CHKNQL

SEQ ID NO: 2414210 - protein, 5 aa, Entamoeba dispar
CHPPC

SEQ ID NO: 2414211 - protein, 4 aa, Entamoeba dispar
CHRP

SEQ ID NO: 2414212 - protein, 4 aa, Entamoeba dispar
CITE

SEQ ID NO: 2414213 - protein, 4 aa, Entamoeba dispar
CITP

SEQ ID NO: 2414214 - protein, 6 aa, Entamoeba dispar
CITPGT

SEQ ID NO: 2414215 - protein, 5 aa, Entamoeba dispar
CKEAL

SEQ ID NO: 2414216 - protein, 13 aa, Entamoeba dispar
CKEARYKSTETTV

SEQ ID NO: 2414217 - protein, 6 aa, Entamoeba dispar
CKEDTP

SEQ ID NO: 2414218 - protein, 13 aa, Entamoeba dispar
CKEKKNVKHGDNL

SEQ ID NO: 2414219 - protein, 12 aa, Entamoeba dispar
CKENPSTRTKIN

SEQ ID NO: 2414220 - protein, 4 aa, Entamoeba dispar
CKES

SEQ ID NO: 2414221 - protein, 8 aa, Entamoeba dispar
CKESHDLE

SEQ ID NO: 2414222 - protein, 9 aa, Entamoeba dispar
CKESTDDYL

SEQ ID NO: 2414223 - protein, 24 aa, Entamoeba dispar
CKETDQSKEKIEEMKDQSLQTDCK

SEQ ID NO: 2414224 - protein, 11 aa, Entamoeba dispar
CKGDESEFEGK

SEQ ID NO: 2414225 - protein, 6 aa, Entamoeba dispar
CKGDNK

SEQ ID NO: 2414226 - protein, 8 aa, Entamoeba dispar
CKGDQSSI

SEQ ID NO: 2414227 - protein, 21 aa, Entamoeba dispar
CKGKGTKSGNEPKRCSKCGGN

SEQ ID NO: 2414228 - protein, 9 aa, Entamoeba dispar
CKGNDKSLQ

SEQ ID NO: 2414229 - protein, 9 aa, Entamoeba dispar
CKGNPRDDI

SEQ ID NO: 2414230 - protein, 5 aa, Entamoeba dispar
CKIGN

SEQ ID NO: 2414231 - protein, 6 aa, Entamoeba dispar
CKKAEV

SEQ ID NO: 2414232 - protein, 8 aa, Entamoeba dispar
CKKGANQI

SEQ ID NO: 2414233 - protein, 8 aa, Entamoeba dispar
CKKGGSCT

SEQ ID NO: 2414234 - protein, 12 aa, Entamoeba dispar
CKKGKIGVTQPR

SEQ ID NO: 2414235 - protein, 11 aa, Entamoeba dispar
CKKGNENYYKR

SEQ ID NO: 2414236 - protein, 8 aa, Entamoeba dispar
CKKKEAPF

SEQ ID NO: 2414237 - protein, 8 aa, Entamoeba dispar
CKKRSTKI

SEQ ID NO: 2414238 - protein, 11 aa, Entamoeba dispar
CKKSELESEYN

SEQ ID NO: 2414239 - protein, 6 aa, Entamoeba dispar
CKKTGT

SEQ ID NO: 2414240 - protein, 25 aa, Entamoeba dispar
CKKTRKITKNITHSNGTTTQESNNV

SEQ ID NO: 2414241 - protein, 4 aa, Entamoeba dispar
CKLT

SEQ ID NO: 2414242 - protein, 9 aa, Entamoeba dispar
CKNKGKDKP

SEQ ID NO: 2414243 - protein, 8 aa, Entamoeba dispar
CKNTDIKG

SEQ ID NO: 2414244 - protein, 6 aa, Entamoeba dispar
CKNTEI

SEQ ID NO: 2414245 - protein, 11 aa, Entamoeba dispar
CKNTEIKGELD

SEQ ID NO: 2414246 - protein, 7 aa, Entamoeba dispar
CKPPNVE

SEQ ID NO: 2414247 - protein, 23 aa, Entamoeba dispar
CKPQKEDIPKSRLQSGRSQRTYS

SEQ ID NO: 2414248 - protein, 9 aa, Entamoeba dispar
CKPYKGETG

SEQ ID NO: 2414249 - protein, 5 aa, Entamoeba dispar
CKQAV

SEQ ID NO: 2414250 - protein, 9 aa, Entamoeba dispar
CKQSNGNIK

SEQ ID NO: 2414251 - protein, 21 aa, Entamoeba dispar
CKRGSSIENDDLSSPNPNGVE

SEQ ID NO: 2414252 - protein, 10 aa, Entamoeba dispar
CKRKDQQPDE

SEQ ID NO: 2414253 - protein, 6 aa, Entamoeba dispar
CKSAVE

SEQ ID NO: 2414254 - protein, 20 aa, Entamoeba dispar
CKSLESSSEREEKSAPRISI

SEQ ID NO: 2414255 - protein, 8 aa, Entamoeba dispar
CKSNETSL

SEQ ID NO: 2414256 - protein, 25 aa, Entamoeba dispar
CKSSNKSNPSKKVEVTNQLTQPSFQ

SEQ ID NO: 2414257 - protein, 4 aa, Entamoeba dispar
CKST

SEQ ID NO: 2414258 - protein, 10 aa, Entamoeba dispar
CKSTPNPKPF

SEQ ID NO: 2414259 - protein, 18 aa, Entamoeba dispar
CKSTTTIKGCKGEIDKEY

SEQ ID NO: 2414260 - protein, 27 aa, Entamoeba dispar
CKSTTTIKGCKGEIDKEYGCRECLQDI

SEQ ID NO: 2414261 - protein, 21 aa, Entamoeba dispar
CKSTTTIKGCKGEIDKEYGLN

SEQ ID NO: 2414262 - protein, 7 aa, Entamoeba dispar
CKSVGDN

SEQ ID NO: 2414263 - protein, 7 aa, Entamoeba dispar
CKTETVT

SEQ ID NO: 2414264 - protein, 5 aa, Entamoeba dispar
CKTPI

SEQ ID NO: 2414265 - protein, 18 aa, Entamoeba dispar
CKTQKTSKKHQNPINCKF

SEQ ID NO: 2414266 - protein, 8 aa, Entamoeba dispar
CKTTKTND

SEQ ID NO: 2414267 - protein, 14 aa, Entamoeba dispar
CKYDSEEDYDKAID

SEQ ID NO: 2414268 - protein, 4 aa, Entamoeba dispar
CKYK

SEQ ID NO: 2414269 - protein, 10 aa, Entamoeba dispar
CLKEEKQDIP

SEQ ID NO: 2414270 - protein, 9 aa, Entamoeba dispar
CLNDSPAVK

SEQ ID NO: 2414271 - protein, 5 aa, Entamoeba dispar
CLPEN

SEQ ID NO: 2414272 - protein, 7 aa, Entamoeba dispar
CLPESEA

SEQ ID NO: 2414273 - protein, 6 aa, Entamoeba dispar
CLPKTS

SEQ ID NO: 2414274 - protein, 12 aa, Entamoeba dispar
CLPNKTRKQCRE

SEQ ID NO: 2414275 - protein, 8 aa, Entamoeba dispar
CNANDTNV

SEQ ID NO: 2414276 - protein, 10 aa, Entamoeba dispar
CNASKSPAIQ

SEQ ID NO: 2414277 - protein, 94 aa, Entamoeba dispar
CNDDKSDKSSDSSSEEKKPKMKIDKKDKKDKKDKKDKKDKKDKKDKKDKKDKKDKKNKKDKKNKKDKKEKKEKKNKKDKEEKKPRKINKKINKE

SEQ ID NO: 2414278 - protein, 5 aa, Entamoeba dispar
CNDEN

SEQ ID NO: 2414279 - protein, 7 aa, Entamoeba dispar
CNDHKSY

SEQ ID NO: 2414280 - protein, 5 aa, Entamoeba dispar
CNDSY

SEQ ID NO: 2414281 - protein, 6 aa, Entamoeba dispar
CNEDQA

SEQ ID NO: 2414282 - protein, 9 aa, Entamoeba dispar
CNEEGDSTW

SEQ ID NO: 2414283 - protein, 4 aa, Entamoeba dispar
CNEK

SEQ ID NO: 2414284 - protein, 6 aa, Entamoeba dispar
CNEKAK

SEQ ID NO: 2414285 - protein, 10 aa, Entamoeba dispar
CNEKTSMEIE

SEQ ID NO: 2414286 - protein, 6 aa, Entamoeba dispar
CNENQI

SEQ ID NO: 2414287 - protein, 7 aa, Entamoeba dispar
CNEPNDI

SEQ ID NO: 2414288 - protein, 9 aa, Entamoeba dispar
CNERKEHEI

SEQ ID NO: 2414289 - protein, 8 aa, Entamoeba dispar
CNETHNPF

SEQ ID NO: 2414290 - protein, 5 aa, Entamoeba dispar
CNGGD

SEQ ID NO: 2414291 - protein, 5 aa, Entamoeba dispar
CNGKQ

SEQ ID NO: 2414292 - protein, 4 aa, Entamoeba dispar
CNGN

SEQ ID NO: 2414293 - protein, 8 aa, Entamoeba dispar
CNGNPQTG

SEQ ID NO: 2414294 - protein, 6 aa, Entamoeba dispar
CNGRVE

SEQ ID NO: 2414295 - protein, 6 aa, Entamoeba dispar
CNGSPY

SEQ ID NO: 2414296 - protein, 14 aa, Entamoeba dispar
CNIPETKNNIKEDT

SEQ ID NO: 2414297 - protein, 8 aa, Entamoeba dispar
CNIPTGEF

SEQ ID NO: 2414298 - protein, 5 aa, Entamoeba dispar
CNKDE

SEQ ID NO: 2414299 - protein, 6 aa, Entamoeba dispar
CNKEIS

SEQ ID NO: 2414300 - protein, 10 aa, Entamoeba dispar
CNKGQETNTF

SEQ ID NO: 2414301 - protein, 6 aa, Entamoeba dispar
CNKQEF

SEQ ID NO: 2414302 - protein, 15 aa, Entamoeba dispar
CNLSQQKDDHITSSS

SEQ ID NO: 2414303 - protein, 8 aa, Entamoeba dispar
CNNDKNVN

SEQ ID NO: 2414304 - protein, 12 aa, Entamoeba dispar
CNNEKQKKDELL

SEQ ID NO: 2414305 - protein, 8 aa, Entamoeba dispar
CNNGSKQY

SEQ ID NO: 2414306 - protein, 12 aa, Entamoeba dispar
CNNNNINDTEKL

SEQ ID NO: 2414307 - protein, 10 aa, Entamoeba dispar
CNNQQRLEKA

SEQ ID NO: 2414308 - protein, 41 aa, Entamoeba dispar
CNNYSVHDSDNKITQNDSSETSKKPKKTLTQSNSENSSELL

SEQ ID NO: 2414309 - protein, 19 aa, Entamoeba dispar
CNPHKKKQLKQEIKQTIQN

SEQ ID NO: 2414310 - protein, 24 aa, Entamoeba dispar
CNPTPKNSSPVPRLGGATPAPIAS

SEQ ID NO: 2414311 - protein, 5 aa, Entamoeba dispar
CNQAS

SEQ ID NO: 2414312 - protein, 4 aa, Entamoeba dispar
CNQF

SEQ ID NO: 2414313 - protein, 15 aa, Entamoeba dispar
CNQGKESSVRIKERD

SEQ ID NO: 2414314 - protein, 66 aa, Entamoeba dispar
CNQQEKEDDNKQEKGEEFTTDGVGMAEGKGINDVSKEIKDQEQLTGLKGEKQQEQNKDEKQEMDKG

SEQ ID NO: 2414315 - protein, 5 aa, Entamoeba dispar
CNREG

SEQ ID NO: 2414316 - protein, 6 aa, Entamoeba dispar
CNRGHT

SEQ ID NO: 2414317 - protein, 9 aa, Entamoeba dispar
CNRKRNGKL

SEQ ID NO: 2414318 - protein, 6 aa, Entamoeba dispar
CNSCNE

SEQ ID NO: 2414319 - protein, 11 aa, Entamoeba dispar
CNSEEKAKEII

SEQ ID NO: 2414320 - protein, 9 aa, Entamoeba dispar
CNSGNPQLL

SEQ ID NO: 2414321 - protein, 13 aa, Entamoeba dispar
CNSNDTSKMTSDE

SEQ ID NO: 2414322 - protein, 7 aa, Entamoeba dispar
CNSNGLT

SEQ ID NO: 2414323 - protein, 5 aa, Entamoeba dispar
CNSPL

SEQ ID NO: 2414324 - protein, 10 aa, Entamoeba dispar
CNSPSLPSLT

SEQ ID NO: 2414325 - protein, 13 aa, Entamoeba dispar
CNSQNASQRDLSQ

SEQ ID NO: 2414326 - protein, 12 aa, Entamoeba dispar
CNSSEKRNQTVE

SEQ ID NO: 2414327 - protein, 5 aa, Entamoeba dispar
CNSSL

SEQ ID NO: 2414328 - protein, 9 aa, Entamoeba dispar
CNSSYLSEN

SEQ ID NO: 2414329 - protein, 10 aa, Entamoeba dispar
CNSTNAEQIA

SEQ ID NO: 2414330 - protein, 10 aa, Entamoeba dispar
CNSTTGKGIS

SEQ ID NO: 2414331 - protein, 13 aa, Entamoeba dispar
CNSVPSLNGILHY

SEQ ID NO: 2414332 - protein, 4 aa, Entamoeba dispar
CNTI

SEQ ID NO: 2414333 - protein, 10 aa, Entamoeba dispar
CNTKDTLEHK

SEQ ID NO: 2414334 - protein, 9 aa, Entamoeba dispar
CNTKSNASK

SEQ ID NO: 2414335 - protein, 9 aa, Entamoeba dispar
CNTNESREE

SEQ ID NO: 2414336 - protein, 6 aa, Entamoeba dispar
CNTNGA

SEQ ID NO: 2414337 - protein, 15 aa, Entamoeba dispar
CNTSTGGVFKAAKRK

SEQ ID NO: 2414338 - protein, 9 aa, Entamoeba dispar
CNYPTQSEW

SEQ ID NO: 2414339 - protein, 5 aa, Entamoeba dispar
CNYPY

SEQ ID NO: 2414340 - protein, 4 aa, Entamoeba dispar
CPAP

SEQ ID NO: 2414341 - protein, 15 aa, Entamoeba dispar
CPDEDDDNTRSEEEI

SEQ ID NO: 2414342 - protein, 16 aa, Entamoeba dispar
CPDSEKIDYSSLSKKT

SEQ ID NO: 2414343 - protein, 8 aa, Entamoeba dispar
CPEDLKKN

SEQ ID NO: 2414344 - protein, 6 aa, Entamoeba dispar
CPEDTA

SEQ ID NO: 2414345 - protein, 4 aa, Entamoeba dispar
CPEI

SEQ ID NO: 2414346 - protein, 16 aa, Entamoeba dispar
CPENKGVKGSYGDLDR

SEQ ID NO: 2414347 - protein, 16 aa, Entamoeba dispar
CPENKGVKGSYGGLDR

SEQ ID NO: 2414348 - protein, 17 aa, Entamoeba dispar
CPENNNPAFDKKEAAGL

SEQ ID NO: 2414349 - protein, 8 aa, Entamoeba dispar
CPEPRTGK

SEQ ID NO: 2414350 - protein, 4 aa, Entamoeba dispar
CPER

SEQ ID NO: 2414351 - protein, 7 aa, Entamoeba dispar
CPKCGGD

SEQ ID NO: 2414352 - protein, 5 aa, Entamoeba dispar
CPKSY

SEQ ID NO: 2414353 - protein, 5 aa, Entamoeba dispar
CPMDP

SEQ ID NO: 2414354 - protein, 4 aa, Entamoeba dispar
CPNE

SEQ ID NO: 2414355 - protein, 4 aa, Entamoeba dispar
CPNG

SEQ ID NO: 2414356 - protein, 13 aa, Entamoeba dispar
CPNNPTRKATYGK

SEQ ID NO: 2414357 - protein, 12 aa, Entamoeba dispar
CPNSYQNDGEDI

SEQ ID NO: 2414358 - protein, 4 aa, Entamoeba dispar
CPNT

SEQ ID NO: 2414359 - protein, 8 aa, Entamoeba dispar
CPNTSIPN

SEQ ID NO: 2414360 - protein, 9 aa, Entamoeba dispar
CPPERTGDI

SEQ ID NO: 2414361 - protein, 7 aa, Entamoeba dispar
CPPGQNI

SEQ ID NO: 2414362 - protein, 11 aa, Entamoeba dispar
CPPPDSNPIPF

SEQ ID NO: 2414363 - protein, 4 aa, Entamoeba dispar
CPPY

SEQ ID NO: 2414364 - protein, 9 aa, Entamoeba dispar
CPQPSNEEM

SEQ ID NO: 2414365 - protein, 8 aa, Entamoeba dispar
CPSELKKN

SEQ ID NO: 2414366 - protein, 8 aa, Entamoeba dispar
CPSERNKI

SEQ ID NO: 2414367 - protein, 17 aa, Entamoeba dispar
CPSHSSSQDSDVEGSSV

SEQ ID NO: 2414368 - protein, 11 aa, Entamoeba dispar
CPSISNKTIES

SEQ ID NO: 2414369 - protein, 14 aa, Entamoeba dispar
CPSKASLIKEAIKS

SEQ ID NO: 2414370 - protein, 4 aa, Entamoeba dispar
CPSS

SEQ ID NO: 2414371 - protein, 5 aa, Entamoeba dispar
CPTDK

SEQ ID NO: 2414372 - protein, 4 aa, Entamoeba dispar
CPTL

SEQ ID NO: 2414373 - protein, 8 aa, Entamoeba dispar
CPTSPGKG

SEQ ID NO: 2414374 - protein, 10 aa, Entamoeba dispar
CPVEGRPIKT

SEQ ID NO: 2414375 - protein, 4 aa, Entamoeba dispar
CQDN

SEQ ID NO: 2414376 - protein, 10 aa, Entamoeba dispar
CQDTSMPFTP

SEQ ID NO: 2414377 - protein, 4 aa, Entamoeba dispar
CQEA

SEQ ID NO: 2414378 - protein, 6 aa, Entamoeba dispar
CQEDGN

SEQ ID NO: 2414379 - protein, 4 aa, Entamoeba dispar
CQEE

SEQ ID NO: 2414380 - protein, 7 aa, Entamoeba dispar
CQERAQQ

SEQ ID NO: 2414381 - protein, 4 aa, Entamoeba dispar
CQET

SEQ ID NO: 2414382 - protein, 9 aa, Entamoeba dispar
CQGGYQGKT

SEQ ID NO: 2414383 - protein, 8 aa, Entamoeba dispar
CQGSVDDK

SEQ ID NO: 2414384 - protein, 5 aa, Entamoeba dispar
CQINS

SEQ ID NO: 2414385 - protein, 16 aa, Entamoeba dispar
CQKEEVDKNDYVTGQD

SEQ ID NO: 2414386 - protein, 14 aa, Entamoeba dispar
CQKGVEKEPDNSTE

SEQ ID NO: 2414387 - protein, 9 aa, Entamoeba dispar
CQNDEYNKD

SEQ ID NO: 2414388 - protein, 11 aa, Entamoeba dispar
CQNDQHKYKKR

SEQ ID NO: 2414389 - protein, 7 aa, Entamoeba dispar
CQNKQDR

SEQ ID NO: 2414390 - protein, 9 aa, Entamoeba dispar
CQNNEEMKE

SEQ ID NO: 2414391 - protein, 5 aa, Entamoeba dispar
CQNSC

SEQ ID NO: 2414392 - protein, 11 aa, Entamoeba dispar
CQPNSYQNRKS

SEQ ID NO: 2414393 - protein, 4 aa, Entamoeba dispar
CQPP

SEQ ID NO: 2414394 - protein, 21 aa, Entamoeba dispar
CQPSSQEKYGDLNEPNTNGVE

SEQ ID NO: 2414395 - protein, 6 aa, Entamoeba dispar
CQPYNT

SEQ ID NO: 2414396 - protein, 7 aa, Entamoeba dispar
CQQQKDP

SEQ ID NO: 2414397 - protein, 5 aa, Entamoeba dispar
CQSAG

SEQ ID NO: 2414398 - protein, 6 aa, Entamoeba dispar
CQSDDP

SEQ ID NO: 2414399 - protein, 7 aa, Entamoeba dispar
CQSEGGL

SEQ ID NO: 2414400 - protein, 7 aa, Entamoeba dispar
CQSENGA

SEQ ID NO: 2414401 - protein, 6 aa, Entamoeba dispar
CQSGPA

SEQ ID NO: 2414402 - protein, 25 aa, Entamoeba dispar
CQTLSDPSLSSTSSSCPNKTNDHSE

SEQ ID NO: 2414403 - protein, 8 aa, Entamoeba dispar
CQTNNWDN

SEQ ID NO: 2414404 - protein, 6 aa, Entamoeba dispar
CQTPET

SEQ ID NO: 2414405 - protein, 11 aa, Entamoeba dispar
CQYDGSSDEDL

SEQ ID NO: 2414406 - protein, 6 aa, Entamoeba dispar
CRDANG

SEQ ID NO: 2414407 - protein, 9 aa, Entamoeba dispar
CRDDETGQI

SEQ ID NO: 2414408 - protein, 20 aa, Entamoeba dispar
CRDDETGQITRKYPTNEKKW

SEQ ID NO: 2414409 - protein, 10 aa, Entamoeba dispar
CRDNSTTAIV

SEQ ID NO: 2414410 - protein, 7 aa, Entamoeba dispar
CRDSNPI

SEQ ID NO: 2414411 - protein, 16 aa, Entamoeba dispar
CRENREKKLTEITKPK

SEQ ID NO: 2414412 - protein, 18 aa, Entamoeba dispar
CRENRESKKREQTKPKKN

SEQ ID NO: 2414413 - protein, 4 aa, Entamoeba dispar
CRGD

SEQ ID NO: 2414414 - protein, 16 aa, Entamoeba dispar
CRGTKPKRFQRTTNTS

SEQ ID NO: 2414415 - protein, 12 aa, Entamoeba dispar
CRGVPDRSAPCD

SEQ ID NO: 2414416 - protein, 8 aa, Entamoeba dispar
CRKAPKPR

SEQ ID NO: 2414417 - protein, 7 aa, Entamoeba dispar
CRKPLDG

SEQ ID NO: 2414418 - protein, 27 aa, Entamoeba dispar
CRKRKSNDIEQGIPEKTAQRRFENNKF

SEQ ID NO: 2414419 - protein, 7 aa, Entamoeba dispar
CRKTPKP

SEQ ID NO: 2414420 - protein, 5 aa, Entamoeba dispar
CRNDT

SEQ ID NO: 2414421 - protein, 5 aa, Entamoeba dispar
CRRKR

SEQ ID NO: 2414422 - protein, 9 aa, Entamoeba dispar
CRSDKTKLT

SEQ ID NO: 2414423 - protein, 10 aa, Entamoeba dispar
CRSNKKDEII

SEQ ID NO: 2414424 - protein, 12 aa, Entamoeba dispar
CRTDDRRGERRD

SEQ ID NO: 2414425 - protein, 5 aa, Entamoeba dispar
CRTGD

SEQ ID NO: 2414426 - protein, 8 aa, Entamoeba dispar
CRTKGIDE

SEQ ID NO: 2414427 - protein, 14 aa, Entamoeba dispar
CSADRNIKGKITKD

SEQ ID NO: 2414428 - protein, 5 aa, Entamoeba dispar
CSAEG

SEQ ID NO: 2414429 - protein, 10 aa, Entamoeba dispar
CSANTKKMSL

SEQ ID NO: 2414430 - protein, 19 aa, Entamoeba dispar
CSASITGYAGPSPSLEESK

SEQ ID NO: 2414431 - protein, 8 aa, Entamoeba dispar
CSATTTTF

SEQ ID NO: 2414432 - protein, 7 aa, Entamoeba dispar
CSDASDH

SEQ ID NO: 2414433 - protein, 4 aa, Entamoeba dispar
CSDD

SEQ ID NO: 2414434 - protein, 6 aa, Entamoeba dispar
CSDDKT

SEQ ID NO: 2414435 - protein, 12 aa, Entamoeba dispar
CSDGKDKYRSLT

SEQ ID NO: 2414436 - protein, 7 aa, Entamoeba dispar
CSDKGDQ

SEQ ID NO: 2414437 - protein, 57 aa, Entamoeba dispar
CSDKKSDKKSSQSDDDEENEKKNKHTDNQNNQSNQQELQQTPTNQPNYGYENSQQNY

SEQ ID NO: 2414438 - protein, 7 aa, Entamoeba dispar
CSDKSYG

SEQ ID NO: 2414439 - protein, 12 aa, Entamoeba dispar
CSDQLKKNKSLK

SEQ ID NO: 2414440 - protein, 8 aa, Entamoeba dispar
CSDRQSSY

SEQ ID NO: 2414441 - protein, 7 aa, Entamoeba dispar
CSDTSRV

SEQ ID NO: 2414442 - protein, 7 aa, Entamoeba dispar
CSEEEKK

SEQ ID NO: 2414443 - protein, 10 aa, Entamoeba dispar
CSEETTKKLS

SEQ ID NO: 2414444 - protein, 8 aa, Entamoeba dispar
CSEETTTG

SEQ ID NO: 2414445 - protein, 9 aa, Entamoeba dispar
CSEKDEKIK

SEQ ID NO: 2414446 - protein, 6 aa, Entamoeba dispar
CSEKND

SEQ ID NO: 2414447 - protein, 16 aa, Entamoeba dispar
CSEKTANRRFQTNKKT

SEQ ID NO: 2414448 - protein, 7 aa, Entamoeba dispar
CSENDAH

SEQ ID NO: 2414449 - protein, 22 aa, Entamoeba dispar
CSEQEKEGIELDGKKKQKKGGC

SEQ ID NO: 2414450 - protein, 7 aa, Entamoeba dispar
CSESADI

SEQ ID NO: 2414451 - protein, 5 aa, Entamoeba dispar
CSFEQ

SEQ ID NO: 2414452 - protein, 11 aa, Entamoeba dispar
CSGAKTDQAIS

SEQ ID NO: 2414453 - protein, 5 aa, Entamoeba dispar
CSGDG

SEQ ID NO: 2414454 - protein, 14 aa, Entamoeba dispar
CSGDGTLRKNPDAW

SEQ ID NO: 2414455 - protein, 10 aa, Entamoeba dispar
CSGESNKDDV

SEQ ID NO: 2414456 - protein, 6 aa, Entamoeba dispar
CSGINK

SEQ ID NO: 2414457 - protein, 22 aa, Entamoeba dispar
CSGNGTKSGAKAQTCNTCKGNG

SEQ ID NO: 2414458 - protein, 17 aa, Entamoeba dispar
CSGSPNILNETPTSPLT

SEQ ID NO: 2414459 - protein, 8 aa, Entamoeba dispar
CSHLSEKG

SEQ ID NO: 2414460 - protein, 4 aa, Entamoeba dispar
CSKD

SEQ ID NO: 2414461 - protein, 12 aa, Entamoeba dispar
CSKGMEAKDQKE

SEQ ID NO: 2414462 - protein, 7 aa, Entamoeba dispar
CSKNESA

SEQ ID NO: 2414463 - protein, 7 aa, Entamoeba dispar
CSKNNSL

SEQ ID NO: 2414464 - protein, 8 aa, Entamoeba dispar
CSKTHSDV

SEQ ID NO: 2414465 - protein, 10 aa, Entamoeba dispar
CSNEEEEGRE

SEQ ID NO: 2414466 - protein, 10 aa, Entamoeba dispar
CSNGGDPKVN

SEQ ID NO: 2414467 - protein, 8 aa, Entamoeba dispar
CSNGKDVF

SEQ ID NO: 2414468 - protein, 6 aa, Entamoeba dispar
CSNKDR

SEQ ID NO: 2414469 - protein, 5 aa, Entamoeba dispar
CSNSN

SEQ ID NO: 2414470 - protein, 8 aa, Entamoeba dispar
CSNSPESI

SEQ ID NO: 2414471 - protein, 23 aa, Entamoeba dispar
CSPDNSSEQDTFSSELASPRKVS

SEQ ID NO: 2414472 - protein, 5 aa, Entamoeba dispar
CSPHH

SEQ ID NO: 2414473 - protein, 5 aa, Entamoeba dispar
CSPIQ

SEQ ID NO: 2414474 - protein, 7 aa, Entamoeba dispar
CSPRALE

SEQ ID NO: 2414475 - protein, 8 aa, Entamoeba dispar
CSPRNKSY

SEQ ID NO: 2414476 - protein, 11 aa, Entamoeba dispar
CSPSKVNVPID

SEQ ID NO: 2414477 - protein, 8 aa, Entamoeba dispar
CSPSNKNI

SEQ ID NO: 2414478 - protein, 5 aa, Entamoeba dispar
CSPTN

SEQ ID NO: 2414479 - protein, 4 aa, Entamoeba dispar
CSQC

SEQ ID NO: 2414480 - protein, 10 aa, Entamoeba dispar
CSQEKREKIA

SEQ ID NO: 2414481 - protein, 9 aa, Entamoeba dispar
CSQNDKCSE

SEQ ID NO: 2414482 - protein, 7 aa, Entamoeba dispar
CSQNKAT

SEQ ID NO: 2414483 - protein, 4 aa, Entamoeba dispar
CSRD

SEQ ID NO: 2414484 - protein, 6 aa, Entamoeba dispar
CSSDPH

SEQ ID NO: 2414485 - protein, 9 aa, Entamoeba dispar
CSSEGGSNI

SEQ ID NO: 2414486 - protein, 12 aa, Entamoeba dispar
CSSELKKNKTLK

SEQ ID NO: 2414487 - protein, 14 aa, Entamoeba dispar
CSSKRSKQTKPEKN

SEQ ID NO: 2414488 - protein, 22 aa, Entamoeba dispar
CSSNSSSSSSESSEDDSEIENK

SEQ ID NO: 2414489 - protein, 6 aa, Entamoeba dispar
CSSPTL

SEQ ID NO: 2414490 - protein, 9 aa, Entamoeba dispar
CSSSRNHQH

SEQ ID NO: 2414491 - protein, 6 aa, Entamoeba dispar
CSSSSV

SEQ ID NO: 2414492 - protein, 10 aa, Entamoeba dispar
CSSTSTAYSE

SEQ ID NO: 2414493 - protein, 36 aa, Entamoeba dispar
CSSYNENKSNTVGANRNSSEIDSEPYEPKKKTQTIE

SEQ ID NO: 2414494 - protein, 4 aa, Entamoeba dispar
CSTD

SEQ ID NO: 2414495 - protein, 5 aa, Entamoeba dispar
CSTEF

SEQ ID NO: 2414496 - protein, 11 aa, Entamoeba dispar
CSTENTPPPKF

SEQ ID NO: 2414497 - protein, 8 aa, Entamoeba dispar
CSTESKRM

SEQ ID NO: 2414498 - protein, 18 aa, Entamoeba dispar
CSTESQSNEEEKKKERKK

SEQ ID NO: 2414499 - protein, 4 aa, Entamoeba dispar
CSTF

SEQ ID NO: 2414500 - protein, 8 aa, Entamoeba dispar
CSTNNGEC

SEQ ID NO: 2414501 - protein, 5 aa, Entamoeba dispar
CSTSP

SEQ ID NO: 2414502 - protein, 6 aa, Entamoeba dispar
CSTSPI

SEQ ID NO: 2414503 - protein, 6 aa, Entamoeba dispar
CSTSSV

SEQ ID NO: 2414504 - protein, 8 aa, Entamoeba dispar
CSTTEKQT

SEQ ID NO: 2414505 - protein, 28 aa, Entamoeba dispar
CSTTNQQPQNIQPYQQPQNIQPYQQQPV

SEQ ID NO: 2414506 - protein, 9 aa, Entamoeba dispar
CSVGKIQTK

SEQ ID NO: 2414507 - protein, 6 aa, Entamoeba dispar
CTADKG

SEQ ID NO: 2414508 - protein, 12 aa, Entamoeba dispar
CTAGPGKVIGTS

SEQ ID NO: 2414509 - protein, 11 aa, Entamoeba dispar
CTASSQQINAQ

SEQ ID NO: 2414510 - protein, 10 aa, Entamoeba dispar
CTDENDSNTI

SEQ ID NO: 2414511 - protein, 8 aa, Entamoeba dispar
CTDENYRS

SEQ ID NO: 2414512 - protein, 5 aa, Entamoeba dispar
CTDQS

SEQ ID NO: 2414513 - protein, 13 aa, Entamoeba dispar
CTEEEYNSFSPQT

SEQ ID NO: 2414514 - protein, 5 aa, Entamoeba dispar
CTEEL

SEQ ID NO: 2414515 - protein, 19 aa, Entamoeba dispar
CTEELKKNKTIPRNAFSYI

SEQ ID NO: 2414516 - protein, 14 aa, Entamoeba dispar
CTEGKNDVNELTNT

SEQ ID NO: 2414517 - protein, 5 aa, Entamoeba dispar
CTEKE

SEQ ID NO: 2414518 - protein, 10 aa, Entamoeba dispar
CTEKEEREGV

SEQ ID NO: 2414519 - protein, 11 aa, Entamoeba dispar
CTEKITQETRW

SEQ ID NO: 2414520 - protein, 11 aa, Entamoeba dispar
CTEKTSKRRMQ

SEQ ID NO: 2414521 - protein, 6 aa, Entamoeba dispar
CTENAE

SEQ ID NO: 2414522 - protein, 8 aa, Entamoeba dispar
CTGAPTNV

SEQ ID NO: 2414523 - protein, 11 aa, Entamoeba dispar
CTGESKPNEDD

SEQ ID NO: 2414524 - protein, 11 aa, Entamoeba dispar
CTGTSGAYTNS

SEQ ID NO: 2414525 - protein, 13 aa, Entamoeba dispar
CTGTSPPNSNGGR

SEQ ID NO: 2414526 - protein, 14 aa, Entamoeba dispar
CTISKKNELENTEL

SEQ ID NO: 2414527 - protein, 18 aa, Entamoeba dispar
CTKDHGPSSLKEIGETEF

SEQ ID NO: 2414528 - protein, 11 aa, Entamoeba dispar
CTKEDEERENI

SEQ ID NO: 2414529 - protein, 9 aa, Entamoeba dispar
CTKGKEVNS

SEQ ID NO: 2414530 - protein, 5 aa, Entamoeba dispar
CTKGN

SEQ ID NO: 2414531 - protein, 4 aa, Entamoeba dispar
CTKN

SEQ ID NO: 2414532 - protein, 53 aa, Entamoeba dispar
CTKQQSSIENNHQFSSSVTKEQTTDNHLSQEGHKTCSQDVSSHITTHEQQETI

SEQ ID NO: 2414533 - protein, 9 aa, Entamoeba dispar
CTKSSGPMI

SEQ ID NO: 2414534 - protein, 24 aa, Entamoeba dispar
CTKTRNITKNITTSNGITNKKTNT

SEQ ID NO: 2414535 - protein, 6 aa, Entamoeba dispar
CTKYPE

SEQ ID NO: 2414536 - protein, 7 aa, Entamoeba dispar
CTNKDNH

SEQ ID NO: 2414537 - protein, 7 aa, Entamoeba dispar
CTPDTQL

SEQ ID NO: 2414538 - protein, 9 aa, Entamoeba dispar
CTPEESQTF

SEQ ID NO: 2414539 - protein, 9 aa, Entamoeba dispar
CTPQPPLSF

SEQ ID NO: 2414540 - protein, 6 aa, Entamoeba dispar
CTPSAL

SEQ ID NO: 2414541 - protein, 5 aa, Entamoeba dispar
CTPTS

SEQ ID NO: 2414542 - protein, 18 aa, Entamoeba dispar
CTQNCTQVDAPTQKLRKP

SEQ ID NO: 2414543 - protein, 8 aa, Entamoeba dispar
CTQPQREI

SEQ ID NO: 2414544 - protein, 9 aa, Entamoeba dispar
CTQQTGERN

SEQ ID NO: 2414545 - protein, 17 aa, Entamoeba dispar
CTQQTQTIRNTRNPSWN

SEQ ID NO: 2414546 - protein, 11 aa, Entamoeba dispar
CTQRSKKEEWS

SEQ ID NO: 2414547 - protein, 6 aa, Entamoeba dispar
CTQTEG

SEQ ID NO: 2414548 - protein, 6 aa, Entamoeba dispar
CTRAGP

SEQ ID NO: 2414549 - protein, 12 aa, Entamoeba dispar
CTRRKTEDTRVE

SEQ ID NO: 2414550 - protein, 4 aa, Entamoeba dispar
CTRS

SEQ ID NO: 2414551 - protein, 7 aa, Entamoeba dispar
CTSASLA

SEQ ID NO: 2414552 - protein, 14 aa, Entamoeba dispar
CTSLSSLQTSTGPK

SEQ ID NO: 2414553 - protein, 6 aa, Entamoeba dispar
CTSSAE

SEQ ID NO: 2414554 - protein, 13 aa, Entamoeba dispar
CTSSSIEKKQLNN

SEQ ID NO: 2414555 - protein, 8 aa, Entamoeba dispar
CTTFSPDG

SEQ ID NO: 2414556 - protein, 7 aa, Entamoeba dispar
CTTGTSY

SEQ ID NO: 2414557 - protein, 8 aa, Entamoeba dispar
CTTNKNGK

SEQ ID NO: 2414558 - protein, 8 aa, Entamoeba dispar
CTVEEDDY

SEQ ID NO: 2414559 - protein, 8 aa, Entamoeba dispar
CTYNKTQG

SEQ ID NO: 2414560 - protein, 6 aa, Entamoeba dispar
CVDNNG

SEQ ID NO: 2414561 - protein, 12 aa, Entamoeba dispar
CVEQSKSRYRSK

SEQ ID NO: 2414562 - protein, 10 aa, Entamoeba dispar
CVNENTKNQP

SEQ ID NO: 2414563 - protein, 11 aa, Entamoeba dispar
CVNKKTNTSTE

SEQ ID NO: 2414564 - protein, 6 aa, Entamoeba dispar
CVNPEG

SEQ ID NO: 2414565 - protein, 7 aa, Entamoeba dispar
CVQTTGN

SEQ ID NO: 2414566 - protein, 9 aa, Entamoeba dispar
CYATATEDM

SEQ ID NO: 2414567 - protein, 24 aa, Entamoeba dispar
CYKPSKKNTPTSDNRSDSLSPDPQ

SEQ ID NO: 2414568 - protein, 12 aa, Entamoeba dispar
CYNAEDKSFELE

SEQ ID NO: 2414569 - protein, 8 aa, Entamoeba dispar
CYNPSPTE

SEQ ID NO: 2414570 - protein, 7 aa, Entamoeba dispar
CYNTPVG

SEQ ID NO: 2414571 - protein, 8 aa, Entamoeba dispar
CYQSKPSE

SEQ ID NO: 2414572 - protein, 7 aa, Entamoeba dispar
DAAEKLG

SEQ ID NO: 2414573 - protein, 8 aa, Entamoeba dispar
DAAPQSLS

SEQ ID NO: 2414574 - protein, 6 aa, Entamoeba dispar
DAAPRV

SEQ ID NO: 2414575 - protein, 14 aa, Entamoeba dispar
DAARENANKRGAGN

SEQ ID NO: 2414576 - protein, 8 aa, Entamoeba dispar
DAATGDDW

SEQ ID NO: 2414577 - protein, 9 aa, Entamoeba dispar
DAATSQEKH

SEQ ID NO: 2414578 - protein, 6 aa, Entamoeba dispar
DAAYKN

SEQ ID NO: 2414579 - protein, 7 aa, Entamoeba dispar
DADDEDI

SEQ ID NO: 2414580 - protein, 8 aa, Entamoeba dispar
DADDINED

SEQ ID NO: 2414581 - protein, 11 aa, Entamoeba dispar
DADGNGEIDAN

SEQ ID NO: 2414582 - protein, 4 aa, Entamoeba dispar
DADI

SEQ ID NO: 2414583 - protein, 8 aa, Entamoeba dispar
DADIGNKE

SEQ ID NO: 2414584 - protein, 7 aa, Entamoeba dispar
DADKKYQ

SEQ ID NO: 2414585 - protein, 6 aa, Entamoeba dispar
DADKTI

SEQ ID NO: 2414586 - protein, 8 aa, Entamoeba dispar
DADSYPSV

SEQ ID NO: 2414587 - protein, 11 aa, Entamoeba dispar
DADVREKAEAL

SEQ ID NO: 2414588 - protein, 6 aa, Entamoeba dispar
DADVSS

SEQ ID NO: 2414589 - protein, 20 aa, Entamoeba dispar
DAEAEEDNEDESEEYQMTEK

SEQ ID NO: 2414590 - protein, 10 aa, Entamoeba dispar
DAEEEEDDDR

SEQ ID NO: 2414591 - protein, 11 aa, Entamoeba dispar
DAEEWKTKTIN

SEQ ID NO: 2414592 - protein, 13 aa, Entamoeba dispar
DAEINTNEDSAKL

SEQ ID NO: 2414593 - protein, 7 aa, Entamoeba dispar
DAEKEGG

SEQ ID NO: 2414594 - protein, 5 aa, Entamoeba dispar
DAEKS

SEQ ID NO: 2414595 - protein, 4 aa, Entamoeba dispar
DAEL

SEQ ID NO: 2414596 - protein, 14 aa, Entamoeba dispar
DAELSTDPTQKGDE

SEQ ID NO: 2414597 - protein, 16 aa, Entamoeba dispar
DAEPQEPKDEEEMNDL

SEQ ID NO: 2414598 - protein, 9 aa, Entamoeba dispar
DAEPYQPRR

SEQ ID NO: 2414599 - protein, 5 aa, Entamoeba dispar
DAEQE

SEQ ID NO: 2414600 - protein, 10 aa, Entamoeba dispar
DAEQKVAEAE

SEQ ID NO: 2414601 - protein, 4 aa, Entamoeba dispar
DAEV

SEQ ID NO: 2414602 - protein, 34 aa, Entamoeba dispar
DAEVEPEEEGEEEIVQSEEKETKMDDGIEETDLG

SEQ ID NO: 2414603 - protein, 8 aa, Entamoeba dispar
DAFEKQND

SEQ ID NO: 2414604 - protein, 9 aa, Entamoeba dispar
DAFERGDKA

SEQ ID NO: 2414605 - protein, 8 aa, Entamoeba dispar
DAFRTPPK

SEQ ID NO: 2414606 - protein, 10 aa, Entamoeba dispar
DAGASDETFE

SEQ ID NO: 2414607 - protein, 19 aa, Entamoeba dispar
DAGDGVEDANFAKETADNG

SEQ ID NO: 2414608 - protein, 10 aa, Entamoeba dispar
DAGENAKQYT

SEQ ID NO: 2414609 - protein, 8 aa, Entamoeba dispar
DAGKSDGW

SEQ ID NO: 2414610 - protein, 11 aa, Entamoeba dispar
DAGKTVRIGSQ

SEQ ID NO: 2414611 - protein, 10 aa, Entamoeba dispar
DAGLTRPSGM

SEQ ID NO: 2414612 - protein, 9 aa, Entamoeba dispar
DAGTEGSLR

SEQ ID NO: 2414613 - protein, 7 aa, Entamoeba dispar
DAGVGKT

SEQ ID NO: 2414614 - protein, 19 aa, Entamoeba dispar
DAHPNACKKTLKRRKDLNR

SEQ ID NO: 2414615 - protein, 13 aa, Entamoeba dispar
DAHPRGSGNTLNM

SEQ ID NO: 2414616 - protein, 14 aa, Entamoeba dispar
DAHSEESPKSVDEI

SEQ ID NO: 2414617 - protein, 10 aa, Entamoeba dispar
DAIAKGEPFK

SEQ ID NO: 2414618 - protein, 5 aa, Entamoeba dispar
DAIEE

SEQ ID NO: 2414619 - protein, 7 aa, Entamoeba dispar
DAIEEED

SEQ ID NO: 2414620 - protein, 26 aa, Entamoeba dispar
DAIETETLKKEKEQNKVNRKPRETTV

SEQ ID NO: 2414621 - protein, 7 aa, Entamoeba dispar
DAIGRTK

SEQ ID NO: 2414622 - protein, 5 aa, Entamoeba dispar
DAIKP

SEQ ID NO: 2414623 - protein, 8 aa, Entamoeba dispar
DAISGTSN

SEQ ID NO: 2414624 - protein, 7 aa, Entamoeba dispar
DAKDHQG

SEQ ID NO: 2414625 - protein, 12 aa, Entamoeba dispar
DAKEKNKGEEII

SEQ ID NO: 2414626 - protein, 15 aa, Entamoeba dispar
DAKETEKTRLKEIIE

SEQ ID NO: 2414627 - protein, 7 aa, Entamoeba dispar
DAKGGFT

SEQ ID NO: 2414628 - protein, 8 aa, Entamoeba dispar
DAKHRKRL

SEQ ID NO: 2414629 - protein, 15 aa, Entamoeba dispar
DAKKDAPVIAGEEKV

SEQ ID NO: 2414630 - protein, 39 aa, Entamoeba dispar
DAKKDAPVIAGEEKVAKVEDKKAANDATVASTEWDDQKK

SEQ ID NO: 2414631 - protein, 9 aa, Entamoeba dispar
DAKKNPFTL

SEQ ID NO: 2414632 - protein, 9 aa, Entamoeba dispar
DAKKQDDII

SEQ ID NO: 2414633 - protein, 6 aa, Entamoeba dispar
DAKKRL

SEQ ID NO: 2414634 - protein, 54 aa, Entamoeba dispar
DAKKSGRRDDVKKIKDVKEEYEKASDEVKKSKKDPKDKEQRQKASEKLRKYQET

SEQ ID NO: 2414635 - protein, 10 aa, Entamoeba dispar
DAKNDMETNL

SEQ ID NO: 2414636 - protein, 6 aa, Entamoeba dispar
DAKNDP

SEQ ID NO: 2414637 - protein, 9 aa, Entamoeba dispar
DAKNKIDNF

SEQ ID NO: 2414638 - protein, 6 aa, Entamoeba dispar
DALKEN

SEQ ID NO: 2414639 - protein, 13 aa, Entamoeba dispar
DALKSEKNEDSVM

SEQ ID NO: 2414640 - protein, 5 aa, Entamoeba dispar
DALQN

SEQ ID NO: 2414641 - protein, 4 aa, Entamoeba dispar
DALS

SEQ ID NO: 2414642 - protein, 6 aa, Entamoeba dispar
DALTET

SEQ ID NO: 2414643 - protein, 10 aa, Entamoeba dispar
DALTPDAQTA

SEQ ID NO: 2414644 - protein, 9 aa, Entamoeba dispar
DAMKPRKNV

SEQ ID NO: 2414645 - protein, 4 aa, Entamoeba dispar
DAND

SEQ ID NO: 2414646 - protein, 9 aa, Entamoeba dispar
DANDSDVKR

SEQ ID NO: 2414647 - protein, 4 aa, Entamoeba dispar
DANG

SEQ ID NO: 2414648 - protein, 8 aa, Entamoeba dispar
DANGKSPL

SEQ ID NO: 2414649 - protein, 8 aa, Entamoeba dispar
DANKPNAI

SEQ ID NO: 2414650 - protein, 12 aa, Entamoeba dispar
DANKSNYRGRSG

SEQ ID NO: 2414651 - protein, 8 aa, Entamoeba dispar
DANSTIEI

SEQ ID NO: 2414652 - protein, 13 aa, Entamoeba dispar
DANVSEAASEALN

SEQ ID NO: 2414653 - protein, 6 aa, Entamoeba dispar
DAPCNG

SEQ ID NO: 2414654 - protein, 17 aa, Entamoeba dispar
DAPDDDPTAKTLKDGRR

SEQ ID NO: 2414655 - protein, 14 aa, Entamoeba dispar
DAPKTGAEVDGGEI

SEQ ID NO: 2414656 - protein, 6 aa, Entamoeba dispar
DAPNHL

SEQ ID NO: 2414657 - protein, 12 aa, Entamoeba dispar
DAPPIDGKANTE

SEQ ID NO: 2414658 - protein, 12 aa, Entamoeba dispar
DAPQKAGGQHRS

SEQ ID NO: 2414659 - protein, 13 aa, Entamoeba dispar
DAPQSVTQEEQST

SEQ ID NO: 2414660 - protein, 8 aa, Entamoeba dispar
DAPTSVGK

SEQ ID NO: 2414661 - protein, 7 aa, Entamoeba dispar
DAPTTTS

SEQ ID NO: 2414662 - protein, 7 aa, Entamoeba dispar
DAPYHND

SEQ ID NO: 2414663 - protein, 5 aa, Entamoeba dispar
DAQEA

SEQ ID NO: 2414664 - protein, 10 aa, Entamoeba dispar
DAQGRKMSKS

SEQ ID NO: 2414665 - protein, 39 aa, Entamoeba dispar
DAQKAAELKKKESNKTAQNPNSSRKLSSSPSQVGEGEKV

SEQ ID NO: 2414666 - protein, 21 aa, Entamoeba dispar
DAQLTKRKLNRKKIKKGKEIK

SEQ ID NO: 2414667 - protein, 14 aa, Entamoeba dispar
DAQRQATKDAGTLA

SEQ ID NO: 2414668 - protein, 15 aa, Entamoeba dispar
DAQRQATKDAGTLSG

SEQ ID NO: 2414669 - protein, 4 aa, Entamoeba dispar
DAQV

SEQ ID NO: 2414670 - protein, 7 aa, Entamoeba dispar
DARETNV

SEQ ID NO: 2414671 - protein, 6 aa, Entamoeba dispar
DARPIK

SEQ ID NO: 2414672 - protein, 8 aa, Entamoeba dispar
DARRSVSD

SEQ ID NO: 2414673 - protein, 11 aa, Entamoeba dispar
DARRTHFGSDS

SEQ ID NO: 2414674 - protein, 8 aa, Entamoeba dispar
DASCTSNE

SEQ ID NO: 2414675 - protein, 11 aa, Entamoeba dispar
DASDKKNEKLN

SEQ ID NO: 2414676 - protein, 9 aa, Entamoeba dispar
DASDQFNQI

SEQ ID NO: 2414677 - protein, 5 aa, Entamoeba dispar
DASEE

SEQ ID NO: 2414678 - protein, 7 aa, Entamoeba dispar
DASELPL

SEQ ID NO: 2414679 - protein, 13 aa, Entamoeba dispar
DASIHRPDAPPEI

SEQ ID NO: 2414680 - protein, 11 aa, Entamoeba dispar
DASKAKRNKTN

SEQ ID NO: 2414681 - protein, 13 aa, Entamoeba dispar
DASLQPTQKKQSC

SEQ ID NO: 2414682 - protein, 9 aa, Entamoeba dispar
DASNETEDY

SEQ ID NO: 2414683 - protein, 10 aa, Entamoeba dispar
DASNGSTQLS

SEQ ID NO: 2414684 - protein, 10 aa, Entamoeba dispar
DASNIEATET

SEQ ID NO: 2414685 - protein, 9 aa, Entamoeba dispar
DASNPFEHR

SEQ ID NO: 2414686 - protein, 5 aa, Entamoeba dispar
DASQH

SEQ ID NO: 2414687 - protein, 7 aa, Entamoeba dispar
DASSYTV

SEQ ID NO: 2414688 - protein, 4 aa, Entamoeba dispar
DAST

SEQ ID NO: 2414689 - protein, 8 aa, Entamoeba dispar
DASYNSNN

SEQ ID NO: 2414690 - protein, 6 aa, Entamoeba dispar
DASYSE

SEQ ID NO: 2414691 - protein, 9 aa, Entamoeba dispar
DATASTYQK

SEQ ID NO: 2414692 - protein, 6 aa, Entamoeba dispar
DATEEQ

SEQ ID NO: 2414693 - protein, 11 aa, Entamoeba dispar
DATEKSRITAT

SEQ ID NO: 2414694 - protein, 25 aa, Entamoeba dispar
DATENKESNHEQINPITSQKTQPLE

SEQ ID NO: 2414695 - protein, 7 aa, Entamoeba dispar
DATEPSY

SEQ ID NO: 2414696 - protein, 8 aa, Entamoeba dispar
DATHGQQD

SEQ ID NO: 2414697 - protein, 5 aa, Entamoeba dispar
DATIQ

SEQ ID NO: 2414698 - protein, 6 aa, Entamoeba dispar
DATKDK

SEQ ID NO: 2414699 - protein, 7 aa, Entamoeba dispar
DATKNKV

SEQ ID NO: 2414700 - protein, 15 aa, Entamoeba dispar
DATNNDQWGPTTKQY

SEQ ID NO: 2414701 - protein, 7 aa, Entamoeba dispar
DATPNDR

SEQ ID NO: 2414702 - protein, 13 aa, Entamoeba dispar
DATPQLNTPQSGL

SEQ ID NO: 2414703 - protein, 4 aa, Entamoeba dispar
DATR

SEQ ID NO: 2414704 - protein, 5 aa, Entamoeba dispar
DATSF

SEQ ID NO: 2414705 - protein, 7 aa, Entamoeba dispar
DATTNKN

SEQ ID NO: 2414706 - protein, 4 aa, Entamoeba dispar
DATV

SEQ ID NO: 2414707 - protein, 21 aa, Entamoeba dispar
DAVEEDKEVPLHKKNESLGKK

SEQ ID NO: 2414708 - protein, 8 aa, Entamoeba dispar
DAVNKATE

SEQ ID NO: 2414709 - protein, 9 aa, Entamoeba dispar
DAYDSLTTA

SEQ ID NO: 2414710 - protein, 11 aa, Entamoeba dispar
DAYNPNTISSQ

SEQ ID NO: 2414711 - protein, 7 aa, Entamoeba dispar
DAYSYGN

SEQ ID NO: 2414712 - protein, 12 aa, Entamoeba dispar
DCDENVKNEIKE

SEQ ID NO: 2414713 - protein, 9 aa, Entamoeba dispar
DCDNNGNTA

SEQ ID NO: 2414714 - protein, 5 aa, Entamoeba dispar
DCDNV

SEQ ID NO: 2414715 - protein, 15 aa, Entamoeba dispar
DCGGHDHSKEDGRWK

SEQ ID NO: 2414716 - protein, 8 aa, Entamoeba dispar
DCGPKTSA

SEQ ID NO: 2414717 - protein, 4 aa, Entamoeba dispar
DCGS

SEQ ID NO: 2414718 - protein, 6 aa, Entamoeba dispar
DCLGEK

SEQ ID NO: 2414719 - protein, 14 aa, Entamoeba dispar
DCLSEEELNKAQED

SEQ ID NO: 2414720 - protein, 11 aa, Entamoeba dispar
DCNFPKGDPIE

SEQ ID NO: 2414721 - protein, 9 aa, Entamoeba dispar
DCNGKKERE

SEQ ID NO: 2414722 - protein, 8 aa, Entamoeba dispar
DCNNQSNN

SEQ ID NO: 2414723 - protein, 8 aa, Entamoeba dispar
DCPDGTKQ

SEQ ID NO: 2414724 - protein, 28 aa, Entamoeba dispar
DCPHKNEKKEKKGGIKRKNKEQKQDPKH

SEQ ID NO: 2414725 - protein, 5 aa, Entamoeba dispar
DCQIS

SEQ ID NO: 2414726 - protein, 4 aa, Entamoeba dispar
DCQP

SEQ ID NO: 2414727 - protein, 4 aa, Entamoeba dispar
DCSK

SEQ ID NO: 2414728 - protein, 9 aa, Entamoeba dispar
DCSLEKDST

SEQ ID NO: 2414729 - protein, 9 aa, Entamoeba dispar
DCSNSEDYS

SEQ ID NO: 2414730 - protein, 5 aa, Entamoeba dispar
DCSRN

SEQ ID NO: 2414731 - protein, 6 aa, Entamoeba dispar
DCSRTG

SEQ ID NO: 2414732 - protein, 9 aa, Entamoeba dispar
DCSSSTQGG

SEQ ID NO: 2414733 - protein, 4 aa, Entamoeba dispar
DCST

SEQ ID NO: 2414734 - protein, 6 aa, Entamoeba dispar
DCSTKP

SEQ ID NO: 2414735 - protein, 6 aa, Entamoeba dispar
DCTGDM

SEQ ID NO: 2414736 - protein, 8 aa, Entamoeba dispar
DCTGEKMN

SEQ ID NO: 2414737 - protein, 18 aa, Entamoeba dispar
DCTPEEKYAGNQRSKELT

SEQ ID NO: 2414738 - protein, 12 aa, Entamoeba dispar
DCTSKNKELKSM

SEQ ID NO: 2414739 - protein, 8 aa, Entamoeba dispar
DCTSQPSM

SEQ ID NO: 2414740 - protein, 4 aa, Entamoeba dispar
DCTT

SEQ ID NO: 2414741 - protein, 7 aa, Entamoeba dispar
DCVTGPK

SEQ ID NO: 2414742 - protein, 7 aa, Entamoeba dispar
DDADESS

SEQ ID NO: 2414743 - protein, 7 aa, Entamoeba dispar
DDAETAK

SEQ ID NO: 2414744 - protein, 15 aa, Entamoeba dispar
DDAKNEAVKKRKDAE

SEQ ID NO: 2414745 - protein, 5 aa, Entamoeba dispar
DDAKT

SEQ ID NO: 2414746 - protein, 20 aa, Entamoeba dispar
DDANNKYKNNFEIPKKSMEE

SEQ ID NO: 2414747 - protein, 6 aa, Entamoeba dispar
DDAYTQ

SEQ ID NO: 2414748 - protein, 8 aa, Entamoeba dispar
DDCNPKGI

SEQ ID NO: 2414749 - protein, 19 aa, Entamoeba dispar
DDDDDDKLEKESDEPGDNK

SEQ ID NO: 2414750 - protein, 7 aa, Entamoeba dispar
DDDDDSF

SEQ ID NO: 2414751 - protein, 13 aa, Entamoeba dispar
DDDDFDEDDFQEQ

SEQ ID NO: 2414752 - protein, 16 aa, Entamoeba dispar
DDDDNSSLTDATEDDI

SEQ ID NO: 2414753 - protein, 20 aa, Entamoeba dispar
DDDDNVGKTQSCNTSGLAND

SEQ ID NO: 2414754 - protein, 7 aa, Entamoeba dispar
DDDDTRV

SEQ ID NO: 2414755 - protein, 5 aa, Entamoeba dispar
DDDEA

SEQ ID NO: 2414756 - protein, 14 aa, Entamoeba dispar
DDDEFSDEIDETND

SEQ ID NO: 2414757 - protein, 16 aa, Entamoeba dispar
DDDEGWKVKQDKNGTK

SEQ ID NO: 2414758 - protein, 7 aa, Entamoeba dispar
DDDELKS

SEQ ID NO: 2414759 - protein, 8 aa, Entamoeba dispar
DDDENLEI

SEQ ID NO: 2414760 - protein, 30 aa, Entamoeba dispar
DDDENTCYDDKENNEEENDDDQLFEPNTSD

SEQ ID NO: 2414761 - protein, 24 aa, Entamoeba dispar
DDDENTRYDDKENNEEEENDDDQF

SEQ ID NO: 2414762 - protein, 8 aa, Entamoeba dispar
DDDENVKP

SEQ ID NO: 2414763 - protein, 18 aa, Entamoeba dispar
DDDFEGIDDDVDDEIVGP

SEQ ID NO: 2414764 - protein, 14 aa, Entamoeba dispar
DDDHNQNNGNGEED

SEQ ID NO: 2414765 - protein, 12 aa, Entamoeba dispar
DDDITQQKNSMT

SEQ ID NO: 2414766 - protein, 9 aa, Entamoeba dispar
DDDLREQRY

SEQ ID NO: 2414767 - protein, 6 aa, Entamoeba dispar
DDDLRQ

SEQ ID NO: 2414768 - protein, 8 aa, Entamoeba dispar
DDDQRSKF

SEQ ID NO: 2414769 - protein, 8 aa, Entamoeba dispar
DDDRTESF

SEQ ID NO: 2414770 - protein, 9 aa, Entamoeba dispar
DDDSDKTNI

SEQ ID NO: 2414771 - protein, 9 aa, Entamoeba dispar
DDDTPCVSP

SEQ ID NO: 2414772 - protein, 8 aa, Entamoeba dispar
DDDVDDEI

SEQ ID NO: 2414773 - protein, 5 aa, Entamoeba dispar
DDDYE

SEQ ID NO: 2414774 - protein, 20 aa, Entamoeba dispar
DDEALEAKRNMSEKEKQNIF

SEQ ID NO: 2414775 - protein, 22 aa, Entamoeba dispar
DDEDDGVPIRPHTTEGVTNGPS

SEQ ID NO: 2414776 - protein, 26 aa, Entamoeba dispar
DDEDDNESVKEIKSDSTDDEMSEDEE

SEQ ID NO: 2414777 - protein, 10 aa, Entamoeba dispar
DDEDEEYHTN

SEQ ID NO: 2414778 - protein, 6 aa, Entamoeba dispar
DDEDEI

SEQ ID NO: 2414779 - protein, 15 aa, Entamoeba dispar
DDEDGIDFKQKEKEI

SEQ ID NO: 2414780 - protein, 22 aa, Entamoeba dispar
DDEDREVQRRIEEEKKRREEEL

SEQ ID NO: 2414781 - protein, 5 aa, Entamoeba dispar
DDEEA

SEQ ID NO: 2414782 - protein, 10 aa, Entamoeba dispar
DDEEDDKKVE

SEQ ID NO: 2414783 - protein, 22 aa, Entamoeba dispar
DDEEEEKKKEESVIEKNQGFTS

SEQ ID NO: 2414784 - protein, 21 aa, Entamoeba dispar
DDEEEKKDEVSQVMESGEEDL

SEQ ID NO: 2414785 - protein, 9 aa, Entamoeba dispar
DDEEKGDLS

SEQ ID NO: 2414786 - protein, 9 aa, Entamoeba dispar
DDEEPPLDY

SEQ ID NO: 2414787 - protein, 7 aa, Entamoeba dispar
DDEESEL

SEQ ID NO: 2414788 - protein, 8 aa, Entamoeba dispar
DDEESEQS

SEQ ID NO: 2414789 - protein, 25 aa, Entamoeba dispar
DDEETNDLKEEKKDTPIKQNKKKVI

SEQ ID NO: 2414790 - protein, 5 aa, Entamoeba dispar
DDEGK

SEQ ID NO: 2414791 - protein, 10 aa, Entamoeba dispar
DDEGSEDGTT

SEQ ID NO: 2414792 - protein, 7 aa, Entamoeba dispar
DDEIGEK

SEQ ID NO: 2414793 - protein, 14 aa, Entamoeba dispar
DDEKDQTHIHILLD

SEQ ID NO: 2414794 - protein, 6 aa, Entamoeba dispar
DDEKEQ

SEQ ID NO: 2414795 - protein, 11 aa, Entamoeba dispar
DDEKGENNKKI

SEQ ID NO: 2414796 - protein, 9 aa, Entamoeba dispar
DDEKIDGKT

SEQ ID NO: 2414797 - protein, 8 aa, Entamoeba dispar
DDEKNDQL

SEQ ID NO: 2414798 - protein, 31 aa, Entamoeba dispar
DDEKSSTQSNSKPTSQPSSQPVTPQKTVKLE

SEQ ID NO: 2414799 - protein, 6 aa, Entamoeba dispar
DDEKTL

SEQ ID NO: 2414800 - protein, 6 aa, Entamoeba dispar
DDEKVY

SEQ ID NO: 2414801 - protein, 9 aa, Entamoeba dispar
DDELGNSKF

SEQ ID NO: 2414802 - protein, 9 aa, Entamoeba dispar
DDELGQSKF

SEQ ID NO: 2414803 - protein, 4 aa, Entamoeba dispar
DDEM

SEQ ID NO: 2414804 - protein, 13 aa, Entamoeba dispar
DDEMKNKIKEMEE

SEQ ID NO: 2414805 - protein, 15 aa, Entamoeba dispar
DDEMSMSSGVDGVDP

SEQ ID NO: 2414806 - protein, 4 aa, Entamoeba dispar
DDEN

SEQ ID NO: 2414807 - protein, 7 aa, Entamoeba dispar
DDENDEK

SEQ ID NO: 2414808 - protein, 7 aa, Entamoeba dispar
DDENNTY

SEQ ID NO: 2414809 - protein, 6 aa, Entamoeba dispar
DDENQS

SEQ ID NO: 2414810 - protein, 7 aa, Entamoeba dispar
DDENQTL

SEQ ID NO: 2414811 - protein, 7 aa, Entamoeba dispar
DDEPNEK

SEQ ID NO: 2414812 - protein, 12 aa, Entamoeba dispar
DDEQQTKAAFTD

SEQ ID NO: 2414813 - protein, 8 aa, Entamoeba dispar
DDEQVQED

SEQ ID NO: 2414814 - protein, 7 aa, Entamoeba dispar
DDERNAG

SEQ ID NO: 2414815 - protein, 9 aa, Entamoeba dispar
DDESAVTGY

SEQ ID NO: 2414816 - protein, 7 aa, Entamoeba dispar
DDESIDQ

SEQ ID NO: 2414817 - protein, 18 aa, Entamoeba dispar
DDESITHQVGERGEHKNI

SEQ ID NO: 2414818 - protein, 13 aa, Entamoeba dispar
DDESQLSKEDYKA

SEQ ID NO: 2414819 - protein, 11 aa, Entamoeba dispar
DDETAKNNQLK

SEQ ID NO: 2414820 - protein, 7 aa, Entamoeba dispar
DDETATK

SEQ ID NO: 2414821 - protein, 16 aa, Entamoeba dispar
DDETEETQKQPLPEND

SEQ ID NO: 2414822 - protein, 11 aa, Entamoeba dispar
DDETKETLTNE

SEQ ID NO: 2414823 - protein, 6 aa, Entamoeba dispar
DDETKN

SEQ ID NO: 2414824 - protein, 13 aa, Entamoeba dispar
DDETLEEDNEDVR

SEQ ID NO: 2414825 - protein, 6 aa, Entamoeba dispar
DDEVFK

SEQ ID NO: 2414826 - protein, 12 aa, Entamoeba dispar
DDEYPSGEIEIR

SEQ ID NO: 2414827 - protein, 7 aa, Entamoeba dispar
DDFASEE

SEQ ID NO: 2414828 - protein, 41 aa, Entamoeba dispar
DDFDGEEYDEELNEDGNNKDQEEDDDRDQTMGDVDKDKREI

SEQ ID NO: 2414829 - protein, 10 aa, Entamoeba dispar
DDFDSDEVQL

SEQ ID NO: 2414830 - protein, 7 aa, Entamoeba dispar
DDFGDTI

SEQ ID NO: 2414831 - protein, 7 aa, Entamoeba dispar
DDFPSTF

SEQ ID NO: 2414832 - protein, 13 aa, Entamoeba dispar
DDFSEETDKTEKL

SEQ ID NO: 2414833 - protein, 27 aa, Entamoeba dispar
DDFSKDDSDSEDDTLDQTDSEDESNTT

SEQ ID NO: 2414834 - protein, 9 aa, Entamoeba dispar
DDFSTPQEV

SEQ ID NO: 2414835 - protein, 9 aa, Entamoeba dispar
DDGDHSGAW

SEQ ID NO: 2414836 - protein, 16 aa, Entamoeba dispar
DDGDKTHCSWGKDGNF

SEQ ID NO: 2414837 - protein, 10 aa, Entamoeba dispar
DDGEHAAGKQ

SEQ ID NO: 2414838 - protein, 5 aa, Entamoeba dispar
DDGEL

SEQ ID NO: 2414839 - protein, 11 aa, Entamoeba dispar
DDGFKPDSYGK

SEQ ID NO: 2414840 - protein, 17 aa, Entamoeba dispar
DDGHDKPIIEVEYKGEI

SEQ ID NO: 2414841 - protein, 12 aa, Entamoeba dispar
DDGIGRQQKKLL

SEQ ID NO: 2414842 - protein, 23 aa, Entamoeba dispar
DDGIISSSRTTISRKIRRGSEFS

SEQ ID NO: 2414843 - protein, 6 aa, Entamoeba dispar
DDGIQN

SEQ ID NO: 2414844 - protein, 4 aa, Entamoeba dispar
DDGK

SEQ ID NO: 2414845 - protein, 12 aa, Entamoeba dispar
DDGKDLNVAIEI

SEQ ID NO: 2414846 - protein, 23 aa, Entamoeba dispar
DDGKGFEREKLGDSDKKDLPSPF

SEQ ID NO: 2414847 - protein, 9 aa, Entamoeba dispar
DDGLPRPGE

SEQ ID NO: 2414848 - protein, 10 aa, Entamoeba dispar
DDGNKQGDKT

SEQ ID NO: 2414849 - protein, 9 aa, Entamoeba dispar
DDGNSIKET

SEQ ID NO: 2414850 - protein, 5 aa, Entamoeba dispar
DDGNV

SEQ ID NO: 2414851 - protein, 10 aa, Entamoeba dispar
DDGQFQPNPM

SEQ ID NO: 2414852 - protein, 13 aa, Entamoeba dispar
DDGQGLERKRHVG

SEQ ID NO: 2414853 - protein, 7 aa, Entamoeba dispar
DDGRRLA

SEQ ID NO: 2414854 - protein, 7 aa, Entamoeba dispar
DDGSVTA

SEQ ID NO: 2414855 - protein, 6 aa, Entamoeba dispar
DDGTFT

SEQ ID NO: 2414856 - protein, 8 aa, Entamoeba dispar
DDGTMNQE

SEQ ID NO: 2414857 - protein, 25 aa, Entamoeba dispar
DDHDEQITPFSNTQNSEYLDNSYSK

SEQ ID NO: 2414858 - protein, 12 aa, Entamoeba dispar
DDIATSVGSTSF

SEQ ID NO: 2414859 - protein, 9 aa, Entamoeba dispar
DDIDDNLND

SEQ ID NO: 2414860 - protein, 5 aa, Entamoeba dispar
DDIDH

SEQ ID NO: 2414861 - protein, 7 aa, Entamoeba dispar
DDIDSTV

SEQ ID NO: 2414862 - protein, 5 aa, Entamoeba dispar
DDIEE

SEQ ID NO: 2414863 - protein, 18 aa, Entamoeba dispar
DDIEQDKSNITPPLTPPI

SEQ ID NO: 2414864 - protein, 10 aa, Entamoeba dispar
DDIGGEELNE

SEQ ID NO: 2414865 - protein, 6 aa, Entamoeba dispar
DDIGSL

SEQ ID NO: 2414866 - protein, 7 aa, Entamoeba dispar
DDIGTSE

SEQ ID NO: 2414867 - protein, 9 aa, Entamoeba dispar
DDIHQKERA

SEQ ID NO: 2414868 - protein, 4 aa, Entamoeba dispar
DDIN

SEQ ID NO: 2414869 - protein, 8 aa, Entamoeba dispar
DDINPRPH

SEQ ID NO: 2414870 - protein, 13 aa, Entamoeba dispar
DDINTSDEESIDT

SEQ ID NO: 2414871 - protein, 19 aa, Entamoeba dispar
DDIQRREDEIREREGEVRR

SEQ ID NO: 2414872 - protein, 5 aa, Entamoeba dispar
DDIRS

SEQ ID NO: 2414873 - protein, 6 aa, Entamoeba dispar
DDISKC

SEQ ID NO: 2414874 - protein, 13 aa, Entamoeba dispar
DDISRNDSTDFES

SEQ ID NO: 2414875 - protein, 7 aa, Entamoeba dispar
DDITDES

SEQ ID NO: 2414876 - protein, 8 aa, Entamoeba dispar
DDITKKGI

SEQ ID NO: 2414877 - protein, 5 aa, Entamoeba dispar
DDIYD

SEQ ID NO: 2414878 - protein, 5 aa, Entamoeba dispar
DDKAG

SEQ ID NO: 2414879 - protein, 11 aa, Entamoeba dispar
DDKDGSNNFPG

SEQ ID NO: 2414880 - protein, 12 aa, Entamoeba dispar
DDKEKDSTAIEP

SEQ ID NO: 2414881 - protein, 8 aa, Entamoeba dispar
DDKELPSQ

SEQ ID NO: 2414882 - protein, 6 aa, Entamoeba dispar
DDKGLE

SEQ ID NO: 2414883 - protein, 5 aa, Entamoeba dispar
DDKGN

SEQ ID NO: 2414884 - protein, 8 aa, Entamoeba dispar
DDKKDYAD

SEQ ID NO: 2414885 - protein, 9 aa, Entamoeba dispar
DDKKESYRE

SEQ ID NO: 2414886 - protein, 10 aa, Entamoeba dispar
DDKKPNQTQK

SEQ ID NO: 2414887 - protein, 8 aa, Entamoeba dispar
DDKLSSTS

SEQ ID NO: 2414888 - protein, 31 aa, Entamoeba dispar
DDKNENQFGEDDSKLKALQKRKEKRQRRRQR

SEQ ID NO: 2414889 - protein, 32 aa, Entamoeba dispar
DDKNIGDEPESDLLAEKSKKLFAKSSKLQERR

SEQ ID NO: 2414890 - protein, 13 aa, Entamoeba dispar
DDKNNTRQAKSDC

SEQ ID NO: 2414891 - protein, 6 aa, Entamoeba dispar
DDKNQE

SEQ ID NO: 2414892 - protein, 8 aa, Entamoeba dispar
DDKPIQPY

SEQ ID NO: 2414893 - protein, 7 aa, Entamoeba dispar
DDKPITK

SEQ ID NO: 2414894 - protein, 4 aa, Entamoeba dispar
DDKQ

SEQ ID NO: 2414895 - protein, 27 aa, Entamoeba dispar
DDKQDKNNLKRKEKITINETNEEEQKM

SEQ ID NO: 2414896 - protein, 7 aa, Entamoeba dispar
DDKSFNG

SEQ ID NO: 2414897 - protein, 5 aa, Entamoeba dispar
DDKSK

SEQ ID NO: 2414898 - protein, 9 aa, Entamoeba dispar
DDKSSKPVE

SEQ ID NO: 2414899 - protein, 9 aa, Entamoeba dispar
DDKTAPSPL

SEQ ID NO: 2414900 - protein, 10 aa, Entamoeba dispar
DDKTNLTEIG

SEQ ID NO: 2414901 - protein, 9 aa, Entamoeba dispar
DDKTNNQED

SEQ ID NO: 2414902 - protein, 4 aa, Entamoeba dispar
DDLE

SEQ ID NO: 2414903 - protein, 6 aa, Entamoeba dispar
DDLKGK

SEQ ID NO: 2414904 - protein, 16 aa, Entamoeba dispar
DDLKKIDDKYKTHCQG

SEQ ID NO: 2414905 - protein, 7 aa, Entamoeba dispar
DDLKQQI

SEQ ID NO: 2414906 - protein, 4 aa, Entamoeba dispar
DDLL

SEQ ID NO: 2414907 - protein, 6 aa, Entamoeba dispar
DDLNGT

SEQ ID NO: 2414908 - protein, 8 aa, Entamoeba dispar
DDLQPSDV

SEQ ID NO: 2414909 - protein, 10 aa, Entamoeba dispar
DDLRSTKKNK

SEQ ID NO: 2414910 - protein, 7 aa, Entamoeba dispar
DDLSGAD

SEQ ID NO: 2414911 - protein, 13 aa, Entamoeba dispar
DDLSTNKSIRNSI

SEQ ID NO: 2414912 - protein, 5 aa, Entamoeba dispar
DDLTP

SEQ ID NO: 2414913 - protein, 5 aa, Entamoeba dispar
DDLTS

SEQ ID NO: 2414914 - protein, 10 aa, Entamoeba dispar
DDMDQEPVKS

SEQ ID NO: 2414915 - protein, 11 aa, Entamoeba dispar
DDMGDDTIDDL

SEQ ID NO: 2414916 - protein, 11 aa, Entamoeba dispar
DDMGDDTVDDL

SEQ ID NO: 2414917 - protein, 7 aa, Entamoeba dispar
DDMNSST

SEQ ID NO: 2414918 - protein, 5 aa, Entamoeba dispar
DDNAI

SEQ ID NO: 2414919 - protein, 7 aa, Entamoeba dispar
DDNEDLD

SEQ ID NO: 2414920 - protein, 17 aa, Entamoeba dispar
DDNGNQIIKNEGEKSHH

SEQ ID NO: 2414921 - protein, 21 aa, Entamoeba dispar
DDNIKSDNQEKEKLTAEETKK

SEQ ID NO: 2414922 - protein, 8 aa, Entamoeba dispar
DDNKDEEL

SEQ ID NO: 2414923 - protein, 5 aa, Entamoeba dispar
DDNLT

SEQ ID NO: 2414924 - protein, 11 aa, Entamoeba dispar
DDNPKQSNGYD

SEQ ID NO: 2414925 - protein, 8 aa, Entamoeba dispar
DDNPNISS

SEQ ID NO: 2414926 - protein, 5 aa, Entamoeba dispar
DDNPY

SEQ ID NO: 2414927 - protein, 11 aa, Entamoeba dispar
DDNRNTDTQPL

SEQ ID NO: 2414928 - protein, 6 aa, Entamoeba dispar
DDNSIQ

SEQ ID NO: 2414929 - protein, 19 aa, Entamoeba dispar
DDNSNPQEEKKKNKTKTIQ

SEQ ID NO: 2414930 - protein, 8 aa, Entamoeba dispar
DDNTPINY

SEQ ID NO: 2414931 - protein, 28 aa, Entamoeba dispar
DDNTQEKKTENQTNQDKKGPNKQKKEID

SEQ ID NO: 2414932 - protein, 9 aa, Entamoeba dispar
DDNVKKAKF

SEQ ID NO: 2414933 - protein, 7 aa, Entamoeba dispar
DDPDHPF

SEQ ID NO: 2414934 - protein, 5 aa, Entamoeba dispar
DDPDI

SEQ ID NO: 2414935 - protein, 44 aa, Entamoeba dispar
DDPEDGGSECADEPNERTETQESIACKEEGQVCEQQSNNDDSII

SEQ ID NO: 2414936 - protein, 6 aa, Entamoeba dispar
DDPEDV

SEQ ID NO: 2414937 - protein, 9 aa, Entamoeba dispar
DDPENTAIG

SEQ ID NO: 2414938 - protein, 7 aa, Entamoeba dispar
DDPETVP

SEQ ID NO: 2414939 - protein, 13 aa, Entamoeba dispar
DDPHVKEAKPHPQ

SEQ ID NO: 2414940 - protein, 8 aa, Entamoeba dispar
DDPNPIAK

SEQ ID NO: 2414941 - protein, 8 aa, Entamoeba dispar
DDPNYSNS

SEQ ID NO: 2414942 - protein, 6 aa, Entamoeba dispar
DDPNYY

SEQ ID NO: 2414943 - protein, 4 aa, Entamoeba dispar
DDPR

SEQ ID NO: 2414944 - protein, 8 aa, Entamoeba dispar
DDPSGNSF

SEQ ID NO: 2414945 - protein, 25 aa, Entamoeba dispar
DDPSVPEEAKNMEKQNELKKQEIER

SEQ ID NO: 2414946 - protein, 6 aa, Entamoeba dispar
DDPTEI

SEQ ID NO: 2414947 - protein, 15 aa, Entamoeba dispar
DDPTLPDDDKDSASL

SEQ ID NO: 2414948 - protein, 7 aa, Entamoeba dispar
DDPTVRK

SEQ ID NO: 2414949 - protein, 8 aa, Entamoeba dispar
DDQDPFKN

SEQ ID NO: 2414950 - protein, 4 aa, Entamoeba dispar
DDQG

SEQ ID NO: 2414951 - protein, 4 aa, Entamoeba dispar
DDQI

SEQ ID NO: 2414952 - protein, 23 aa, Entamoeba dispar
DDQIDEEDMSVEEGNVIDEEDDV

SEQ ID NO: 2414953 - protein, 22 aa, Entamoeba dispar
DDQKGASPTIKDYSSSESIDEE

SEQ ID NO: 2414954 - protein, 8 aa, Entamoeba dispar
DDQNPSKY

SEQ ID NO: 2414955 - protein, 8 aa, Entamoeba dispar
DDQPNIDL

SEQ ID NO: 2414956 - protein, 7 aa, Entamoeba dispar
DDQPSKI

SEQ ID NO: 2414957 - protein, 8 aa, Entamoeba dispar
DDQQVKKN

SEQ ID NO: 2414958 - protein, 8 aa, Entamoeba dispar
DDQREQVD

SEQ ID NO: 2414959 - protein, 7 aa, Entamoeba dispar
DDQRSIR

SEQ ID NO: 2414960 - protein, 6 aa, Entamoeba dispar
DDQYEN

SEQ ID NO: 2414961 - protein, 8 aa, Entamoeba dispar
DDRATGIK

SEQ ID NO: 2414962 - protein, 4 aa, Entamoeba dispar
DDRI

SEQ ID NO: 2414963 - protein, 24 aa, Entamoeba dispar
DDRKKVLQNTRSQYSTGKPNCHNE

SEQ ID NO: 2414964 - protein, 24 aa, Entamoeba dispar
DDRKNRTLTMSQRSDALNAAKNIR

SEQ ID NO: 2414965 - protein, 16 aa, Entamoeba dispar
DDRMSAEKALAHPFFN

SEQ ID NO: 2414966 - protein, 7 aa, Entamoeba dispar
DDRNEDV

SEQ ID NO: 2414967 - protein, 5 aa, Entamoeba dispar
DDRPN

SEQ ID NO: 2414968 - protein, 11 aa, Entamoeba dispar
DDRSLQRSSFG

SEQ ID NO: 2414969 - protein, 9 aa, Entamoeba dispar
DDRSNAIPF

SEQ ID NO: 2414970 - protein, 13 aa, Entamoeba dispar
DDRSYGKLLSSFI

SEQ ID NO: 2414971 - protein, 4 aa, Entamoeba dispar
DDRT

SEQ ID NO: 2414972 - protein, 9 aa, Entamoeba dispar
DDSDCKGNI

SEQ ID NO: 2414973 - protein, 16 aa, Entamoeba dispar
DDSDEPFIDSPSDTRI

SEQ ID NO: 2414974 - protein, 7 aa, Entamoeba dispar
DDSDRSF

SEQ ID NO: 2414975 - protein, 42 aa, Entamoeba dispar
DDSDSDIEEISPKRPSEKLERTQRSQKIATQSKKGDLTPEET

SEQ ID NO: 2414976 - protein, 8 aa, Entamoeba dispar
DDSDTSEE

SEQ ID NO: 2414977 - protein, 7 aa, Entamoeba dispar
DDSEDNN

SEQ ID NO: 2414978 - protein, 7 aa, Entamoeba dispar
DDSENGL

SEQ ID NO: 2414979 - protein, 5 aa, Entamoeba dispar
DDSFK

SEQ ID NO: 2414980 - protein, 6 aa, Entamoeba dispar
DDSGEF

SEQ ID NO: 2414981 - protein, 10 aa, Entamoeba dispar
DDSGPKTDIL

SEQ ID NO: 2414982 - protein, 7 aa, Entamoeba dispar
DDSGSNV

SEQ ID NO: 2414983 - protein, 10 aa, Entamoeba dispar
DDSIKTPKTY

SEQ ID NO: 2414984 - protein, 8 aa, Entamoeba dispar
DDSIPESK

SEQ ID NO: 2414985 - protein, 10 aa, Entamoeba dispar
DDSKDGDALS

SEQ ID NO: 2414986 - protein, 10 aa, Entamoeba dispar
DDSKIQGKYT

SEQ ID NO: 2414987 - protein, 6 aa, Entamoeba dispar
DDSKNG

SEQ ID NO: 2414988 - protein, 6 aa, Entamoeba dispar
DDSKTK

SEQ ID NO: 2414989 - protein, 5 aa, Entamoeba dispar
DDSLT

SEQ ID NO: 2414990 - protein, 15 aa, Entamoeba dispar
DDSLTDEERKDIKNE

SEQ ID NO: 2414991 - protein, 6 aa, Entamoeba dispar
DDSMEN

SEQ ID NO: 2414992 - protein, 14 aa, Entamoeba dispar
DDSMNKKPTKIEKD

SEQ ID NO: 2414993 - protein, 7 aa, Entamoeba dispar
DDSNLKE

SEQ ID NO: 2414994 - protein, 6 aa, Entamoeba dispar
DDSNQV

SEQ ID NO: 2414995 - protein, 8 aa, Entamoeba dispar
DDSNSEPK

SEQ ID NO: 2414996 - protein, 19 aa, Entamoeba dispar
DDSSEDSETTSPNEETDIA

SEQ ID NO: 2414997 - protein, 5 aa, Entamoeba dispar
DDSSV

SEQ ID NO: 2414998 - protein, 13 aa, Entamoeba dispar
DDSSVHHSKPAPD

SEQ ID NO: 2414999 - protein, 6 aa, Entamoeba dispar
DDSTRL

SEQ ID NO: 2415000 - protein, 14 aa, Entamoeba dispar
DDSVKRPDAKNKQE

SEQ ID NO: 2415001 - protein, 5 aa, Entamoeba dispar
DDSVQ

SEQ ID NO: 2415002 - protein, 10 aa, Entamoeba dispar
DDSVSETTLS

SEQ ID NO: 2415003 - protein, 8 aa, Entamoeba dispar
DDTCANPD

SEQ ID NO: 2415004 - protein, 9 aa, Entamoeba dispar
DDTEKINQS

SEQ ID NO: 2415005 - protein, 5 aa, Entamoeba dispar
DDTID

SEQ ID NO: 2415006 - protein, 5 aa, Entamoeba dispar
DDTIN

SEQ ID NO: 2415007 - protein, 6 aa, Entamoeba dispar
DDTISD

SEQ ID NO: 2415008 - protein, 6 aa, Entamoeba dispar
DDTITK

SEQ ID NO: 2415009 - protein, 8 aa, Entamoeba dispar
DDTKEEYI

SEQ ID NO: 2415010 - protein, 16 aa, Entamoeba dispar
DDTKRKQARQKQITFG

SEQ ID NO: 2415011 - protein, 16 aa, Entamoeba dispar
DDTMGANPDDVKEQTN

SEQ ID NO: 2415012 - protein, 8 aa, Entamoeba dispar
DDTNGTKT

SEQ ID NO: 2415013 - protein, 6 aa, Entamoeba dispar
DDTNNY

SEQ ID NO: 2415014 - protein, 14 aa, Entamoeba dispar
DDTNTNIKKIEEKP

SEQ ID NO: 2415015 - protein, 12 aa, Entamoeba dispar
DDTNTNKSSIPI

SEQ ID NO: 2415016 - protein, 5 aa, Entamoeba dispar
DDTPL

SEQ ID NO: 2415017 - protein, 10 aa, Entamoeba dispar
DDTPTMQTSK

SEQ ID NO: 2415018 - protein, 13 aa, Entamoeba dispar
DDTQKTDTTLENQ

SEQ ID NO: 2415019 - protein, 6 aa, Entamoeba dispar
DDTRDQ

SEQ ID NO: 2415020 - protein, 8 aa, Entamoeba dispar
DDTRDQAA

SEQ ID NO: 2415021 - protein, 15 aa, Entamoeba dispar
DDTRKKESKVSVSIK

SEQ ID NO: 2415022 - protein, 17 aa, Entamoeba dispar
DDTSMRNALSKEKISVK

SEQ ID NO: 2415023 - protein, 22 aa, Entamoeba dispar
DDTSSSSSDLDDDIKQYIYHSD

SEQ ID NO: 2415024 - protein, 4 aa, Entamoeba dispar
DDTT

SEQ ID NO: 2415025 - protein, 20 aa, Entamoeba dispar
DDTTKKVNNENVQEKKNIQK

SEQ ID NO: 2415026 - protein, 9 aa, Entamoeba dispar
DDTTKTNIY

SEQ ID NO: 2415027 - protein, 5 aa, Entamoeba dispar
DDTTR

SEQ ID NO: 2415028 - protein, 11 aa, Entamoeba dispar
DDTVDGNPDIG

SEQ ID NO: 2415029 - protein, 7 aa, Entamoeba dispar
DDTYGRG

SEQ ID NO: 2415030 - protein, 6 aa, Entamoeba dispar
DDVDDI

SEQ ID NO: 2415031 - protein, 18 aa, Entamoeba dispar
DDVDVDEEISEQKSKRAL

SEQ ID NO: 2415032 - protein, 5 aa, Entamoeba dispar
DDVHP

SEQ ID NO: 2415033 - protein, 9 aa, Entamoeba dispar
DDVKGNNEC

SEQ ID NO: 2415034 - protein, 25 aa, Entamoeba dispar
DDVKNKNKENEKKKKRNQEIQEEIN

SEQ ID NO: 2415035 - protein, 6 aa, Entamoeba dispar
DDVKQL

SEQ ID NO: 2415036 - protein, 14 aa, Entamoeba dispar
DDVNTKELQKLQGN

SEQ ID NO: 2415037 - protein, 17 aa, Entamoeba dispar
DDVSDGAVSIFDIYSLI

SEQ ID NO: 2415038 - protein, 7 aa, Entamoeba dispar
DDWNQNT

SEQ ID NO: 2415039 - protein, 6 aa, Entamoeba dispar
DDYDDE

SEQ ID NO: 2415040 - protein, 7 aa, Entamoeba dispar
DDYGDEY

SEQ ID NO: 2415041 - protein, 10 aa, Entamoeba dispar
DDYKPSGNLY

SEQ ID NO: 2415042 - protein, 24 aa, Entamoeba dispar
DDYMDEEDDDYEDEEDYSGGPLEH

SEQ ID NO: 2415043 - protein, 38 aa, Entamoeba dispar
DDYMDEEDDDYEEEEDYSEGPLEHTPFGGKNDDIDIIY

SEQ ID NO: 2415044 - protein, 18 aa, Entamoeba dispar
DDYNRTHATKKNLTEVEE

SEQ ID NO: 2415045 - protein, 16 aa, Entamoeba dispar
DDYPPNKKGEGKNRRT

SEQ ID NO: 2415046 - protein, 16 aa, Entamoeba dispar
DDYSANPQRQESFPSI

SEQ ID NO: 2415047 - protein, 9 aa, Entamoeba dispar
DDYSNLADN

SEQ ID NO: 2415048 - protein, 58 aa, Entamoeba dispar
DDYSSSEKTELTTDNQTNNSSNDTTTEEANDIDDTTNDDELSDDSIKSTSTNTKISKH

SEQ ID NO: 2415049 - protein, 9 aa, Entamoeba dispar
DEAEGKITN

SEQ ID NO: 2415050 - protein, 9 aa, Entamoeba dispar
DEAEKSDLN

SEQ ID NO: 2415051 - protein, 6 aa, Entamoeba dispar
DEARTE

SEQ ID NO: 2415052 - protein, 7 aa, Entamoeba dispar
DEASTRI

SEQ ID NO: 2415053 - protein, 4 aa, Entamoeba dispar
DEAT

SEQ ID NO: 2415054 - protein, 5 aa, Entamoeba dispar
DEAVL

SEQ ID NO: 2415055 - protein, 12 aa, Entamoeba dispar
DECDECDEDEMI

SEQ ID NO: 2415056 - protein, 7 aa, Entamoeba dispar
DECIGKE

SEQ ID NO: 2415057 - protein, 9 aa, Entamoeba dispar
DECKNDKSC

SEQ ID NO: 2415058 - protein, 4 aa, Entamoeba dispar
DECN

SEQ ID NO: 2415059 - protein, 4 aa, Entamoeba dispar
DECR

SEQ ID NO: 2415060 - protein, 16 aa, Entamoeba dispar
DECVSPRRRPVYGGSP

SEQ ID NO: 2415061 - protein, 18 aa, Entamoeba dispar
DEDAENKFGYANAASQRL

SEQ ID NO: 2415062 - protein, 5 aa, Entamoeba dispar
DEDAK

SEQ ID NO: 2415063 - protein, 12 aa, Entamoeba dispar
DEDCEDSRDSDD

SEQ ID NO: 2415064 - protein, 8 aa, Entamoeba dispar
DEDDDKPI

SEQ ID NO: 2415065 - protein, 7 aa, Entamoeba dispar
DEDDHVR

SEQ ID NO: 2415066 - protein, 5 aa, Entamoeba dispar
DEDDI

SEQ ID NO: 2415067 - protein, 6 aa, Entamoeba dispar
DEDDLE

SEQ ID NO: 2415068 - protein, 15 aa, Entamoeba dispar
DEDDVQPYEKKPFTP

SEQ ID NO: 2415069 - protein, 7 aa, Entamoeba dispar
DEDELAS

SEQ ID NO: 2415070 - protein, 9 aa, Entamoeba dispar
DEDETGNGF

SEQ ID NO: 2415071 - protein, 7 aa, Entamoeba dispar
DEDEVNE

SEQ ID NO: 2415072 - protein, 8 aa, Entamoeba dispar
DEDGGNQE

SEQ ID NO: 2415073 - protein, 9 aa, Entamoeba dispar
DEDGNKFGG

SEQ ID NO: 2415074 - protein, 12 aa, Entamoeba dispar
DEDHKEQLPTTE

SEQ ID NO: 2415075 - protein, 6 aa, Entamoeba dispar
DEDIKQ

SEQ ID NO: 2415076 - protein, 7 aa, Entamoeba dispar
DEDKDGY

SEQ ID NO: 2415077 - protein, 6 aa, Entamoeba dispar
DEDKIT

SEQ ID NO: 2415078 - protein, 6 aa, Entamoeba dispar
DEDMKA

SEQ ID NO: 2415079 - protein, 8 aa, Entamoeba dispar
DEDNDDVD

SEQ ID NO: 2415080 - protein, 8 aa, Entamoeba dispar
DEDNNISK

SEQ ID NO: 2415081 - protein, 13 aa, Entamoeba dispar
DEDNNTQENEEEV

SEQ ID NO: 2415082 - protein, 7 aa, Entamoeba dispar
DEDNSSF

SEQ ID NO: 2415083 - protein, 17 aa, Entamoeba dispar
DEDNTIPLSTDSMSHGD

SEQ ID NO: 2415084 - protein, 11 aa, Entamoeba dispar
DEDPGKDDKLG

SEQ ID NO: 2415085 - protein, 6 aa, Entamoeba dispar
DEDSFT

SEQ ID NO: 2415086 - protein, 10 aa, Entamoeba dispar
DEDSGDFETV

SEQ ID NO: 2415087 - protein, 8 aa, Entamoeba dispar
DEDSPKQV

SEQ ID NO: 2415088 - protein, 6 aa, Entamoeba dispar
DEDSTI

SEQ ID NO: 2415089 - protein, 6 aa, Entamoeba dispar
DEDSVT

SEQ ID NO: 2415090 - protein, 5 aa, Entamoeba dispar
DEDTE

SEQ ID NO: 2415091 - protein, 6 aa, Entamoeba dispar
DEDTKI

SEQ ID NO: 2415092 - protein, 13 aa, Entamoeba dispar
DEDTTEESSDVES

SEQ ID NO: 2415093 - protein, 7 aa, Entamoeba dispar
DEDTTKT

SEQ ID NO: 2415094 - protein, 6 aa, Entamoeba dispar
DEDTTV

SEQ ID NO: 2415095 - protein, 13 aa, Entamoeba dispar
DEDYEGGERKEFG

SEQ ID NO: 2415096 - protein, 6 aa, Entamoeba dispar
DEDYRG

SEQ ID NO: 2415097 - protein, 4 aa, Entamoeba dispar
DEEA

SEQ ID NO: 2415098 - protein, 6 aa, Entamoeba dispar
DEEANE

SEQ ID NO: 2415099 - protein, 6 aa, Entamoeba dispar
DEEAYN

SEQ ID NO: 2415100 - protein, 10 aa, Entamoeba dispar
DEECDESLKD

SEQ ID NO: 2415101 - protein, 6 aa, Entamoeba dispar
DEEDDF

SEQ ID NO: 2415102 - protein, 8 aa, Entamoeba dispar
DEEDEEWN

SEQ ID NO: 2415103 - protein, 10 aa, Entamoeba dispar
DEEDENQIQR

SEQ ID NO: 2415104 - protein, 18 aa, Entamoeba dispar
DEEDGEPMEEEEEEEDIF

SEQ ID NO: 2415105 - protein, 6 aa, Entamoeba dispar
DEEDKK

SEQ ID NO: 2415106 - protein, 9 aa, Entamoeba dispar
DEEDTSGEE

SEQ ID NO: 2415107 - protein, 4 aa, Entamoeba dispar
DEEE

SEQ ID NO: 2415108 - protein, 9 aa, Entamoeba dispar
DEEEAKSAM

SEQ ID NO: 2415109 - protein, 21 aa, Entamoeba dispar
DEEEAPKKQRSFSVDIKQKQT

SEQ ID NO: 2415110 - protein, 13 aa, Entamoeba dispar
DEEEEKKDEVSQV

SEQ ID NO: 2415111 - protein, 32 aa, Entamoeba dispar
DEEEEKNVLNNEDNSASQEEEQQQPNQEKKVI

SEQ ID NO: 2415112 - protein, 12 aa, Entamoeba dispar
DEEEKKEWTSYN

SEQ ID NO: 2415113 - protein, 5 aa, Entamoeba dispar
DEEEL

SEQ ID NO: 2415114 - protein, 7 aa, Entamoeba dispar
DEEEPAE

SEQ ID NO: 2415115 - protein, 6 aa, Entamoeba dispar
DEEEQF

SEQ ID NO: 2415116 - protein, 36 aa, Entamoeba dispar
DEEEQRDEQTIVPHESDRFKDVDEEEIKKEVKEEDV

SEQ ID NO: 2415117 - protein, 12 aa, Entamoeba dispar
DEEESELNIPSG

SEQ ID NO: 2415118 - protein, 16 aa, Entamoeba dispar
DEEEVKENKPNKEIEE

SEQ ID NO: 2415119 - protein, 11 aa, Entamoeba dispar
DEEEYANTITT

SEQ ID NO: 2415120 - protein, 7 aa, Entamoeba dispar
DEEFKDG

SEQ ID NO: 2415121 - protein, 7 aa, Entamoeba dispar
DEEFNDG

SEQ ID NO: 2415122 - protein, 8 aa, Entamoeba dispar
DEEFQKDQ

SEQ ID NO: 2415123 - protein, 18 aa, Entamoeba dispar
DEEGYSKKGKIGCTQPRR

SEQ ID NO: 2415124 - protein, 7 aa, Entamoeba dispar
DEEHTGH

SEQ ID NO: 2415125 - protein, 9 aa, Entamoeba dispar
DEEIENESK

SEQ ID NO: 2415126 - protein, 10 aa, Entamoeba dispar
DEEIENESKR

SEQ ID NO: 2415127 - protein, 7 aa, Entamoeba dispar
DEEIGES

SEQ ID NO: 2415128 - protein, 7 aa, Entamoeba dispar
DEEIGRS

SEQ ID NO: 2415129 - protein, 5 aa, Entamoeba dispar
DEEIK

SEQ ID NO: 2415130 - protein, 6 aa, Entamoeba dispar
DEEIKE

SEQ ID NO: 2415131 - protein, 7 aa, Entamoeba dispar
DEEIPED

SEQ ID NO: 2415132 - protein, 8 aa, Entamoeba dispar
DEEKARQL

SEQ ID NO: 2415133 - protein, 13 aa, Entamoeba dispar
DEEKCTKDYYQDN

SEQ ID NO: 2415134 - protein, 20 aa, Entamoeba dispar
DEEKKIKEQQHKENKRRKHD

SEQ ID NO: 2415135 - protein, 89 aa, Entamoeba dispar
DEEKLDVEPKKDIKEEENKEETKLEEEHKEEHKEEHKEEEHKEEEHKEEHKEEEHKEEEHKEEEHKEEVKKEEEIKEEEKKNGSNEQQK

SEQ ID NO: 2415136 - protein, 73 aa, Entamoeba dispar
DEEKLNKKMEEEKLTQEQQSKTKQKEDDQKKKEDKTKQKEDKKKQEEGKTKQEEDKAITKTDQPELVEEGSKT

SEQ ID NO: 2415137 - protein, 13 aa, Entamoeba dispar
DEEKNFKRQGDDL

SEQ ID NO: 2415138 - protein, 8 aa, Entamoeba dispar
DEEKTKYE

SEQ ID NO: 2415139 - protein, 6 aa, Entamoeba dispar
DEEKYP

SEQ ID NO: 2415140 - protein, 9 aa, Entamoeba dispar
DEELDEVNE

SEQ ID NO: 2415141 - protein, 5 aa, Entamoeba dispar
DEEMN

SEQ ID NO: 2415142 - protein, 16 aa, Entamoeba dispar
DEENKKWKLNEKEIKK

SEQ ID NO: 2415143 - protein, 7 aa, Entamoeba dispar
DEENLES

SEQ ID NO: 2415144 - protein, 12 aa, Entamoeba dispar
DEENPEGNESNW

SEQ ID NO: 2415145 - protein, 7 aa, Entamoeba dispar
DEENTAV

SEQ ID NO: 2415146 - protein, 11 aa, Entamoeba dispar
DEENTNDPKRW

SEQ ID NO: 2415147 - protein, 11 aa, Entamoeba dispar
DEENYTNETDA

SEQ ID NO: 2415148 - protein, 17 aa, Entamoeba dispar
DEEPAEPPKNELESQIN

SEQ ID NO: 2415149 - protein, 6 aa, Entamoeba dispar
DEEPGL

SEQ ID NO: 2415150 - protein, 39 aa, Entamoeba dispar
DEEPKDLITSPKGSSPSNIDSSQSIVSNTRPSPTQQTGK

SEQ ID NO: 2415151 - protein, 8 aa, Entamoeba dispar
DEEPTKRI

SEQ ID NO: 2415152 - protein, 9 aa, Entamoeba dispar
DEEQQELNK

SEQ ID NO: 2415153 - protein, 5 aa, Entamoeba dispar
DEEQR

SEQ ID NO: 2415154 - protein, 7 aa, Entamoeba dispar
DEERTKL

SEQ ID NO: 2415155 - protein, 6 aa, Entamoeba dispar
DEERVR

SEQ ID NO: 2415156 - protein, 10 aa, Entamoeba dispar
DEESEKGIYS

SEQ ID NO: 2415157 - protein, 5 aa, Entamoeba dispar
DEESF

SEQ ID NO: 2415158 - protein, 6 aa, Entamoeba dispar
DEESFK

SEQ ID NO: 2415159 - protein, 5 aa, Entamoeba dispar
DEESI

SEQ ID NO: 2415160 - protein, 11 aa, Entamoeba dispar
DEESKKVTGYF

SEQ ID NO: 2415161 - protein, 20 aa, Entamoeba dispar
DEESNDKSNDDKINSNPSND

SEQ ID NO: 2415162 - protein, 9 aa, Entamoeba dispar
DEESRENTY

SEQ ID NO: 2415163 - protein, 4 aa, Entamoeba dispar
DEET

SEQ ID NO: 2415164 - protein, 19 aa, Entamoeba dispar
DEETAEKAVNEMNGKEIDG

SEQ ID NO: 2415165 - protein, 7 aa, Entamoeba dispar
DEETPEE

SEQ ID NO: 2415166 - protein, 9 aa, Entamoeba dispar
DEETPQTDP

SEQ ID NO: 2415167 - protein, 8 aa, Entamoeba dispar
DEETQKLA

SEQ ID NO: 2415168 - protein, 4 aa, Entamoeba dispar
DEEV

SEQ ID NO: 2415169 - protein, 5 aa, Entamoeba dispar
DEEVE

SEQ ID NO: 2415170 - protein, 6 aa, Entamoeba dispar
DEEVEE

SEQ ID NO: 2415171 - protein, 9 aa, Entamoeba dispar
DEEVPNQDR

SEQ ID NO: 2415172 - protein, 7 aa, Entamoeba dispar
DEEVQEV

SEQ ID NO: 2415173 - protein, 7 aa, Entamoeba dispar
DEEVRKQ

SEQ ID NO: 2415174 - protein, 37 aa, Entamoeba dispar
DEEYEKKDEEIKRMNEKKNEDRGKEIENQNDKKKRFV

SEQ ID NO: 2415175 - protein, 4 aa, Entamoeba dispar
DEFD

SEQ ID NO: 2415176 - protein, 6 aa, Entamoeba dispar
DEFDDT

SEQ ID NO: 2415177 - protein, 6 aa, Entamoeba dispar
DEFDEM

SEQ ID NO: 2415178 - protein, 22 aa, Entamoeba dispar
DEFDSRPQKETGCTQPTYEGYD

SEQ ID NO: 2415179 - protein, 38 aa, Entamoeba dispar
DEFGESDESEISTEKTKRVRERKKKGRDKRERKTRQIK

SEQ ID NO: 2415180 - protein, 4 aa, Entamoeba dispar
DEFK

SEQ ID NO: 2415181 - protein, 6 aa, Entamoeba dispar
DEFPTD

SEQ ID NO: 2415182 - protein, 4 aa, Entamoeba dispar
DEFR

SEQ ID NO: 2415183 - protein, 5 aa, Entamoeba dispar
DEFTD

SEQ ID NO: 2415184 - protein, 4 aa, Entamoeba dispar
DEGC

SEQ ID NO: 2415185 - protein, 8 aa, Entamoeba dispar
DEGCPSSR

SEQ ID NO: 2415186 - protein, 8 aa, Entamoeba dispar
DEGEELEE

SEQ ID NO: 2415187 - protein, 8 aa, Entamoeba dispar
DEGEGVES

SEQ ID NO: 2415188 - protein, 10 aa, Entamoeba dispar
DEGEKKDTLN

SEQ ID NO: 2415189 - protein, 23 aa, Entamoeba dispar
DEGFERRKSNLAGSIPKKASKIT

SEQ ID NO: 2415190 - protein, 7 aa, Entamoeba dispar
DEGINSL

SEQ ID NO: 2415191 - protein, 5 aa, Entamoeba dispar
DEGKS

SEQ ID NO: 2415192 - protein, 7 aa, Entamoeba dispar
DEGKYKS

SEQ ID NO: 2415193 - protein, 4 aa, Entamoeba dispar
DEGL

SEQ ID NO: 2415194 - protein, 8 aa, Entamoeba dispar
DEGNGNLK

SEQ ID NO: 2415195 - protein, 14 aa, Entamoeba dispar
DEGNPDKTESGDVN

SEQ ID NO: 2415196 - protein, 6 aa, Entamoeba dispar
DEGQEW

SEQ ID NO: 2415197 - protein, 6 aa, Entamoeba dispar
DEGRVD

SEQ ID NO: 2415198 - protein, 8 aa, Entamoeba dispar
DEGSIEEL

SEQ ID NO: 2415199 - protein, 6 aa, Entamoeba dispar
DEGVGK

SEQ ID NO: 2415200 - protein, 11 aa, Entamoeba dispar
DEGVNTYETRI

SEQ ID NO: 2415201 - protein, 11 aa, Entamoeba dispar
DEGVNTYETRV

SEQ ID NO: 2415202 - protein, 6 aa, Entamoeba dispar
DEGYQN

SEQ ID NO: 2415203 - protein, 9 aa, Entamoeba dispar
DEHRTTRDL

SEQ ID NO: 2415204 - protein, 5 aa, Entamoeba dispar
DEHSK

SEQ ID NO: 2415205 - protein, 4 aa, Entamoeba dispar
DEID

SEQ ID NO: 2415206 - protein, 7 aa, Entamoeba dispar
DEIDPEI

SEQ ID NO: 2415207 - protein, 12 aa, Entamoeba dispar
DEIENDENYLGE

SEQ ID NO: 2415208 - protein, 7 aa, Entamoeba dispar
DEIFNDG

SEQ ID NO: 2415209 - protein, 5 aa, Entamoeba dispar
DEIKE

SEQ ID NO: 2415210 - protein, 24 aa, Entamoeba dispar
DEIKEEENDIEQSVHEDQKSIEEI

SEQ ID NO: 2415211 - protein, 5 aa, Entamoeba dispar
DEIKP

SEQ ID NO: 2415212 - protein, 19 aa, Entamoeba dispar
DEINDDDTIDDKEEGDSIK

SEQ ID NO: 2415213 - protein, 6 aa, Entamoeba dispar
DEINEN

SEQ ID NO: 2415214 - protein, 25 aa, Entamoeba dispar
DEINKESEQTKKTKWYKSNEIQQRQ

SEQ ID NO: 2415215 - protein, 29 aa, Entamoeba dispar
DEINKKKSQENQEKKKPIQPISDQKEDIH

SEQ ID NO: 2415216 - protein, 7 aa, Entamoeba dispar
DEIPEPS

SEQ ID NO: 2415217 - protein, 9 aa, Entamoeba dispar
DEIPRNDSV

SEQ ID NO: 2415218 - protein, 9 aa, Entamoeba dispar
DEIQSGSVS

SEQ ID NO: 2415219 - protein, 12 aa, Entamoeba dispar
DEIRGTSSLNKK

SEQ ID NO: 2415220 - protein, 4 aa, Entamoeba dispar
DEIS

SEQ ID NO: 2415221 - protein, 20 aa, Entamoeba dispar
DEISGDGGEASASIKEVGKG

SEQ ID NO: 2415222 - protein, 7 aa, Entamoeba dispar
DEISSPA

SEQ ID NO: 2415223 - protein, 4 aa, Entamoeba dispar
DEIT

SEQ ID NO: 2415224 - protein, 6 aa, Entamoeba dispar
DEITDL

SEQ ID NO: 2415225 - protein, 5 aa, Entamoeba dispar
DEITE

SEQ ID NO: 2415226 - protein, 6 aa, Entamoeba dispar
DEITKN

SEQ ID NO: 2415227 - protein, 5 aa, Entamoeba dispar
DEITN

SEQ ID NO: 2415228 - protein, 7 aa, Entamoeba dispar
DEITNEN

SEQ ID NO: 2415229 - protein, 7 aa, Entamoeba dispar
DEITSKT

SEQ ID NO: 2415230 - protein, 4 aa, Entamoeba dispar
DEKA

SEQ ID NO: 2415231 - protein, 15 aa, Entamoeba dispar
DEKADKLKQYEPTDV

SEQ ID NO: 2415232 - protein, 7 aa, Entamoeba dispar
DEKAKDA

SEQ ID NO: 2415233 - protein, 5 aa, Entamoeba dispar
DEKAS

SEQ ID NO: 2415234 - protein, 8 aa, Entamoeba dispar
DEKATIKN

SEQ ID NO: 2415235 - protein, 10 aa, Entamoeba dispar
DEKDASEVAA

SEQ ID NO: 2415236 - protein, 6 aa, Entamoeba dispar
DEKDMN

SEQ ID NO: 2415237 - protein, 13 aa, Entamoeba dispar
DEKEDLSSLHDQT

SEQ ID NO: 2415238 - protein, 46 aa, Entamoeba dispar
DEKEEKNENNLEGEKEKESSKKGNNLEEEENKSIKSKTSKSEVIND

SEQ ID NO: 2415239 - protein, 7 aa, Entamoeba dispar
DEKEISK

SEQ ID NO: 2415240 - protein, 6 aa, Entamoeba dispar
DEKEMG

SEQ ID NO: 2415241 - protein, 7 aa, Entamoeba dispar
DEKERSL

SEQ ID NO: 2415242 - protein, 15 aa, Entamoeba dispar
DEKETSEESKKRGAT

SEQ ID NO: 2415243 - protein, 5 aa, Entamoeba dispar
DEKEW

SEQ ID NO: 2415244 - protein, 4 aa, Entamoeba dispar
DEKG

SEQ ID NO: 2415245 - protein, 4 aa, Entamoeba dispar
DEKI

SEQ ID NO: 2415246 - protein, 6 aa, Entamoeba dispar
DEKIKK

SEQ ID NO: 2415247 - protein, 5 aa, Entamoeba dispar
DEKIY

SEQ ID NO: 2415248 - protein, 16 aa, Entamoeba dispar
DEKKELEEKLKKKDDI

SEQ ID NO: 2415249 - protein, 12 aa, Entamoeba dispar
DEKKENHGKDLE

SEQ ID NO: 2415250 - protein, 5 aa, Entamoeba dispar
DEKKK

SEQ ID NO: 2415251 - protein, 12 aa, Entamoeba dispar
DEKKKKQNQAVS

SEQ ID NO: 2415252 - protein, 16 aa, Entamoeba dispar
DEKKKYMPTRKGGVAK

SEQ ID NO: 2415253 - protein, 7 aa, Entamoeba dispar
DEKKMEE

SEQ ID NO: 2415254 - protein, 12 aa, Entamoeba dispar
DEKKSKKSKCTE

SEQ ID NO: 2415255 - protein, 8 aa, Entamoeba dispar
DEKLNKRR

SEQ ID NO: 2415256 - protein, 15 aa, Entamoeba dispar
DEKLSSIKKRERELV

SEQ ID NO: 2415257 - protein, 8 aa, Entamoeba dispar
DEKMKDAI

SEQ ID NO: 2415258 - protein, 8 aa, Entamoeba dispar
DEKNASEA

SEQ ID NO: 2415259 - protein, 9 aa, Entamoeba dispar
DEKNKKLSV

SEQ ID NO: 2415260 - protein, 30 aa, Entamoeba dispar
DEKNKMEKEYKELKGKYDKEVSAAASAQAK

SEQ ID NO: 2415261 - protein, 6 aa, Entamoeba dispar
DEKNNS

SEQ ID NO: 2415262 - protein, 7 aa, Entamoeba dispar
DEKNQLE

SEQ ID NO: 2415263 - protein, 43 aa, Entamoeba dispar
DEKPEKAEGMTADGKKKKIAVSAAPTKKQKDLEQLKKDEAEEA

SEQ ID NO: 2415264 - protein, 10 aa, Entamoeba dispar
DEKQRKQGDG

SEQ ID NO: 2415265 - protein, 12 aa, Entamoeba dispar
DEKRDNNLQEPT

SEQ ID NO: 2415266 - protein, 30 aa, Entamoeba dispar
DEKRKEVADKSLAAYTEATEISNAELAPTH

SEQ ID NO: 2415267 - protein, 9 aa, Entamoeba dispar
DEKRKNIQQ

SEQ ID NO: 2415268 - protein, 31 aa, Entamoeba dispar
DEKRQEVADKSLAAYTEATEISNADLAPTHP

SEQ ID NO: 2415269 - protein, 11 aa, Entamoeba dispar
DEKRTSKDMEN

SEQ ID NO: 2415270 - protein, 7 aa, Entamoeba dispar
DEKRVSQ

SEQ ID NO: 2415271 - protein, 6 aa, Entamoeba dispar
DEKRWK

SEQ ID NO: 2415272 - protein, 17 aa, Entamoeba dispar
DEKSAGLALKNENGKFW

SEQ ID NO: 2415273 - protein, 9 aa, Entamoeba dispar
DEKSIKEVS

SEQ ID NO: 2415274 - protein, 8 aa, Entamoeba dispar
DEKSTKVV

SEQ ID NO: 2415275 - protein, 7 aa, Entamoeba dispar
DEKTPEN

SEQ ID NO: 2415276 - protein, 8 aa, Entamoeba dispar
DEKTRNNA

SEQ ID NO: 2415277 - protein, 11 aa, Entamoeba dispar
DEKTVNWEQSR

SEQ ID NO: 2415278 - protein, 6 aa, Entamoeba dispar
DEKVDE

SEQ ID NO: 2415279 - protein, 5 aa, Entamoeba dispar
DELAE

SEQ ID NO: 2415280 - protein, 8 aa, Entamoeba dispar
DELDDSIQ

SEQ ID NO: 2415281 - protein, 16 aa, Entamoeba dispar
DELDGDSLIPDTSTAE

SEQ ID NO: 2415282 - protein, 22 aa, Entamoeba dispar
DELEEYESNELELEDNNEEEML

SEQ ID NO: 2415283 - protein, 7 aa, Entamoeba dispar
DELENEI

SEQ ID NO: 2415284 - protein, 6 aa, Entamoeba dispar
DELENQ

SEQ ID NO: 2415285 - protein, 7 aa, Entamoeba dispar
DELERKV

SEQ ID NO: 2415286 - protein, 4 aa, Entamoeba dispar
DELF

SEQ ID NO: 2415287 - protein, 8 aa, Entamoeba dispar
DELGQNSN

SEQ ID NO: 2415288 - protein, 4 aa, Entamoeba dispar
DELI

SEQ ID NO: 2415289 - protein, 4 aa, Entamoeba dispar
DELK

SEQ ID NO: 2415290 - protein, 6 aa, Entamoeba dispar
DELKET

SEQ ID NO: 2415291 - protein, 16 aa, Entamoeba dispar
DELKKNETIPRDCFDE

SEQ ID NO: 2415292 - protein, 16 aa, Entamoeba dispar
DELKKNKRIPSFCFNK

SEQ ID NO: 2415293 - protein, 20 aa, Entamoeba dispar
DELKMDDSNEEHLRKNARKA

SEQ ID NO: 2415294 - protein, 17 aa, Entamoeba dispar
DELKNNETIPRDCFDKH

SEQ ID NO: 2415295 - protein, 7 aa, Entamoeba dispar
DELKQGC

SEQ ID NO: 2415296 - protein, 10 aa, Entamoeba dispar
DELNDHSNHD

SEQ ID NO: 2415297 - protein, 12 aa, Entamoeba dispar
DELNEEDSQEEI

SEQ ID NO: 2415298 - protein, 11 aa, Entamoeba dispar
DELNEENEQLR

SEQ ID NO: 2415299 - protein, 16 aa, Entamoeba dispar
DELNETESSDDEGEDL

SEQ ID NO: 2415300 - protein, 6 aa, Entamoeba dispar
DELNQI

SEQ ID NO: 2415301 - protein, 9 aa, Entamoeba dispar
DELNQTVNN

SEQ ID NO: 2415302 - protein, 6 aa, Entamoeba dispar
DELNTI

SEQ ID NO: 2415303 - protein, 5 aa, Entamoeba dispar
DELQN

SEQ ID NO: 2415304 - protein, 8 aa, Entamoeba dispar
DELQTIEE

SEQ ID NO: 2415305 - protein, 4 aa, Entamoeba dispar
DELR

SEQ ID NO: 2415306 - protein, 5 aa, Entamoeba dispar
DELRG

SEQ ID NO: 2415307 - protein, 14 aa, Entamoeba dispar
DELSPTKRNRIEGT

SEQ ID NO: 2415308 - protein, 7 aa, Entamoeba dispar
DELSQRQ

SEQ ID NO: 2415309 - protein, 5 aa, Entamoeba dispar
DELYP

SEQ ID NO: 2415310 - protein, 11 aa, Entamoeba dispar
DEMDDESVNID

SEQ ID NO: 2415311 - protein, 58 aa, Entamoeba dispar
DEMDESSENEQTMESDENEVNEEEQNESKEESMEEDQELEAESLEDDDLGDEEEQQIR

SEQ ID NO: 2415312 - protein, 10 aa, Entamoeba dispar
DEMDPEPVSQ

SEQ ID NO: 2415313 - protein, 5 aa, Entamoeba dispar
DEMFG

SEQ ID NO: 2415314 - protein, 5 aa, Entamoeba dispar
DEMLK

SEQ ID NO: 2415315 - protein, 12 aa, Entamoeba dispar
DEMSSNQLSSLE

SEQ ID NO: 2415316 - protein, 5 aa, Entamoeba dispar
DEMTE

SEQ ID NO: 2415317 - protein, 8 aa, Entamoeba dispar
DENDDPIP

SEQ ID NO: 2415318 - protein, 7 aa, Entamoeba dispar
DENDENE

SEQ ID NO: 2415319 - protein, 7 aa, Entamoeba dispar
DENDGEW

SEQ ID NO: 2415320 - protein, 6 aa, Entamoeba dispar
DENDPV

SEQ ID NO: 2415321 - protein, 8 aa, Entamoeba dispar
DENDSDIQ

SEQ ID NO: 2415322 - protein, 7 aa, Entamoeba dispar
DENDSIP

SEQ ID NO: 2415323 - protein, 8 aa, Entamoeba dispar
DENEEHQG

SEQ ID NO: 2415324 - protein, 20 aa, Entamoeba dispar
DENEKRESKSILKGSKRQSI

SEQ ID NO: 2415325 - protein, 16 aa, Entamoeba dispar
DENEWKRGEEKGVKAK

SEQ ID NO: 2415326 - protein, 15 aa, Entamoeba dispar
DENEWKRGKENETID

SEQ ID NO: 2415327 - protein, 14 aa, Entamoeba dispar
DENGCSEVNDGETY

SEQ ID NO: 2415328 - protein, 9 aa, Entamoeba dispar
DENGDGKMD

SEQ ID NO: 2415329 - protein, 6 aa, Entamoeba dispar
DENGEE

SEQ ID NO: 2415330 - protein, 5 aa, Entamoeba dispar
DENGI

SEQ ID NO: 2415331 - protein, 15 aa, Entamoeba dispar
DENGIADDDLPPLEY

SEQ ID NO: 2415332 - protein, 8 aa, Entamoeba dispar
DENGNTPF

SEQ ID NO: 2415333 - protein, 6 aa, Entamoeba dispar
DENGRI

SEQ ID NO: 2415334 - protein, 9 aa, Entamoeba dispar
DENGVPDDD

SEQ ID NO: 2415335 - protein, 8 aa, Entamoeba dispar
DENGYLKG

SEQ ID NO: 2415336 - protein, 5 aa, Entamoeba dispar
DENHK

SEQ ID NO: 2415337 - protein, 4 aa, Entamoeba dispar
DENK

SEQ ID NO: 2415338 - protein, 6 aa, Entamoeba dispar
DENKAL

SEQ ID NO: 2415339 - protein, 9 aa, Entamoeba dispar
DENKENTKI

SEQ ID NO: 2415340 - protein, 7 aa, Entamoeba dispar
DENKIKV

SEQ ID NO: 2415341 - protein, 7 aa, Entamoeba dispar
DENKKTV

SEQ ID NO: 2415342 - protein, 5 aa, Entamoeba dispar
DENKM

SEQ ID NO: 2415343 - protein, 7 aa, Entamoeba dispar
DENKMKE

SEQ ID NO: 2415344 - protein, 9 aa, Entamoeba dispar
DENKSVKPL

SEQ ID NO: 2415345 - protein, 5 aa, Entamoeba dispar
DENLT

SEQ ID NO: 2415346 - protein, 8 aa, Entamoeba dispar
DENNAVKK

SEQ ID NO: 2415347 - protein, 8 aa, Entamoeba dispar
DENNEIQK

SEQ ID NO: 2415348 - protein, 11 aa, Entamoeba dispar
DENNKDQSLRN

SEQ ID NO: 2415349 - protein, 4 aa, Entamoeba dispar
DENQ

SEQ ID NO: 2415350 - protein, 5 aa, Entamoeba dispar
DENQG

SEQ ID NO: 2415351 - protein, 10 aa, Entamoeba dispar
DENQSLKQTI

SEQ ID NO: 2415352 - protein, 7 aa, Entamoeba dispar
DENQSNP

SEQ ID NO: 2415353 - protein, 20 aa, Entamoeba dispar
DENRYGQQQKRNPPSTGITW

SEQ ID NO: 2415354 - protein, 8 aa, Entamoeba dispar
DENSDVDP

SEQ ID NO: 2415355 - protein, 16 aa, Entamoeba dispar
DENSSCIQSRSSPNLL

SEQ ID NO: 2415356 - protein, 7 aa, Entamoeba dispar
DENTEEI

SEQ ID NO: 2415357 - protein, 21 aa, Entamoeba dispar
DENTIKGIEKGELKEEKGRNE

SEQ ID NO: 2415358 - protein, 9 aa, Entamoeba dispar
DENTPKELT

SEQ ID NO: 2415359 - protein, 7 aa, Entamoeba dispar
DENTYDN

SEQ ID NO: 2415360 - protein, 4 aa, Entamoeba dispar
DENW

SEQ ID NO: 2415361 - protein, 6 aa, Entamoeba dispar
DENYAS

SEQ ID NO: 2415362 - protein, 6 aa, Entamoeba dispar
DEPDVT

SEQ ID NO: 2415363 - protein, 8 aa, Entamoeba dispar
DEPEETET

SEQ ID NO: 2415364 - protein, 6 aa, Entamoeba dispar
DEPFPK

SEQ ID NO: 2415365 - protein, 5 aa, Entamoeba dispar
DEPFQ

SEQ ID NO: 2415366 - protein, 4 aa, Entamoeba dispar
DEPH

SEQ ID NO: 2415367 - protein, 12 aa, Entamoeba dispar
DEPHYPSYQYPL

SEQ ID NO: 2415368 - protein, 4 aa, Entamoeba dispar
DEPI

SEQ ID NO: 2415369 - protein, 22 aa, Entamoeba dispar
DEPKDVSDVEEDVTSDDEGNSY

SEQ ID NO: 2415370 - protein, 4 aa, Entamoeba dispar
DEPL

SEQ ID NO: 2415371 - protein, 5 aa, Entamoeba dispar
DEPLK

SEQ ID NO: 2415372 - protein, 13 aa, Entamoeba dispar
DEPSHSKRSTLQE

SEQ ID NO: 2415373 - protein, 9 aa, Entamoeba dispar
DEPSSQKGI

SEQ ID NO: 2415374 - protein, 4 aa, Entamoeba dispar
DEPY

SEQ ID NO: 2415375 - protein, 12 aa, Entamoeba dispar
DEQALERKRHVG

SEQ ID NO: 2415376 - protein, 4 aa, Entamoeba dispar
DEQE

SEQ ID NO: 2415377 - protein, 21 aa, Entamoeba dispar
DEQEESMDREPTYQNHAQVKG

SEQ ID NO: 2415378 - protein, 15 aa, Entamoeba dispar
DEQGKRAIDYTSEGT

SEQ ID NO: 2415379 - protein, 5 aa, Entamoeba dispar
DEQIR

SEQ ID NO: 2415380 - protein, 5 aa, Entamoeba dispar
DEQKK

SEQ ID NO: 2415381 - protein, 12 aa, Entamoeba dispar
DEQKTEKKRHIG

SEQ ID NO: 2415382 - protein, 8 aa, Entamoeba dispar
DEQLKRTV

SEQ ID NO: 2415383 - protein, 6 aa, Entamoeba dispar
DEQNKL

SEQ ID NO: 2415384 - protein, 6 aa, Entamoeba dispar
DEQNPN

SEQ ID NO: 2415385 - protein, 7 aa, Entamoeba dispar
DEQNPPL

SEQ ID NO: 2415386 - protein, 5 aa, Entamoeba dispar
DEQSI

SEQ ID NO: 2415387 - protein, 8 aa, Entamoeba dispar
DEQSIGNQ

SEQ ID NO: 2415388 - protein, 22 aa, Entamoeba dispar
DEQTKTKAITGNEENNSQLYKE

SEQ ID NO: 2415389 - protein, 7 aa, Entamoeba dispar
DEQTSLD

SEQ ID NO: 2415390 - protein, 7 aa, Entamoeba dispar
DEQVDEI

SEQ ID NO: 2415391 - protein, 7 aa, Entamoeba dispar
DEQVGDR

SEQ ID NO: 2415392 - protein, 14 aa, Entamoeba dispar
DEQVTNTTFDQQNP

SEQ ID NO: 2415393 - protein, 8 aa, Entamoeba dispar
DEQYRDDS

SEQ ID NO: 2415394 - protein, 7 aa, Entamoeba dispar
DERATIT

SEQ ID NO: 2415395 - protein, 8 aa, Entamoeba dispar
DERDKEQV

SEQ ID NO: 2415396 - protein, 11 aa, Entamoeba dispar
DEREKIEEGLN

SEQ ID NO: 2415397 - protein, 6 aa, Entamoeba dispar
DERITK

SEQ ID NO: 2415398 - protein, 7 aa, Entamoeba dispar
DERKELA

SEQ ID NO: 2415399 - protein, 7 aa, Entamoeba dispar
DERKGNV

SEQ ID NO: 2415400 - protein, 8 aa, Entamoeba dispar
DERKGVKN

SEQ ID NO: 2415401 - protein, 9 aa, Entamoeba dispar
DERKKNISS

SEQ ID NO: 2415402 - protein, 10 aa, Entamoeba dispar
DERKRETSTS

SEQ ID NO: 2415403 - protein, 7 aa, Entamoeba dispar
DERNDSI

SEQ ID NO: 2415404 - protein, 6 aa, Entamoeba dispar
DERNHI

SEQ ID NO: 2415405 - protein, 14 aa, Entamoeba dispar
DERNKKYNLSGTEF

SEQ ID NO: 2415406 - protein, 6 aa, Entamoeba dispar
DERNKV

SEQ ID NO: 2415407 - protein, 11 aa, Entamoeba dispar
DERNVVKQSQL

SEQ ID NO: 2415408 - protein, 4 aa, Entamoeba dispar
DERP

SEQ ID NO: 2415409 - protein, 7 aa, Entamoeba dispar
DERPKDL

SEQ ID NO: 2415410 - protein, 38 aa, Entamoeba dispar
DERPMPKTPRTMTSISKGKIDMSGRKPLPKGKMGRSTV

SEQ ID NO: 2415411 - protein, 7 aa, Entamoeba dispar
DERSEEN

SEQ ID NO: 2415412 - protein, 7 aa, Entamoeba dispar
DERTKTS

SEQ ID NO: 2415413 - protein, 7 aa, Entamoeba dispar
DERVKDG

SEQ ID NO: 2415414 - protein, 6 aa, Entamoeba dispar
DERVND

SEQ ID NO: 2415415 - protein, 6 aa, Entamoeba dispar
DERYQP

SEQ ID NO: 2415416 - protein, 6 aa, Entamoeba dispar
DERYTK

SEQ ID NO: 2415417 - protein, 6 aa, Entamoeba dispar
DESEEG

SEQ ID NO: 2415418 - protein, 7 aa, Entamoeba dispar
DESERQQ

SEQ ID NO: 2415419 - protein, 15 aa, Entamoeba dispar
DESESRPELRMPEET

SEQ ID NO: 2415420 - protein, 11 aa, Entamoeba dispar
DESGERLKRGT

SEQ ID NO: 2415421 - protein, 8 aa, Entamoeba dispar
DESGKEQV

SEQ ID NO: 2415422 - protein, 10 aa, Entamoeba dispar
DESIATRSKL

SEQ ID NO: 2415423 - protein, 7 aa, Entamoeba dispar
DESIDKI

SEQ ID NO: 2415424 - protein, 7 aa, Entamoeba dispar
DESIGTP

SEQ ID NO: 2415425 - protein, 8 aa, Entamoeba dispar
DESIPYEQ

SEQ ID NO: 2415426 - protein, 10 aa, Entamoeba dispar
DESKCDDEGI

SEQ ID NO: 2415427 - protein, 12 aa, Entamoeba dispar
DESKDKRSLVAD

SEQ ID NO: 2415428 - protein, 9 aa, Entamoeba dispar
DESKEKQLE

SEQ ID NO: 2415429 - protein, 6 aa, Entamoeba dispar
DESKKN

SEQ ID NO: 2415430 - protein, 8 aa, Entamoeba dispar
DESKKYKK

SEQ ID NO: 2415431 - protein, 21 aa, Entamoeba dispar
DESKMVDDNNMSEENLEKVDL

SEQ ID NO: 2415432 - protein, 6 aa, Entamoeba dispar
DESKNN

SEQ ID NO: 2415433 - protein, 10 aa, Entamoeba dispar
DESKVKEYGN

SEQ ID NO: 2415434 - protein, 4 aa, Entamoeba dispar
DESL

SEQ ID NO: 2415435 - protein, 13 aa, Entamoeba dispar
DESLEKVTRYTNG

SEQ ID NO: 2415436 - protein, 8 aa, Entamoeba dispar
DESLQAPT

SEQ ID NO: 2415437 - protein, 17 aa, Entamoeba dispar
DESLTNTDYYDISSHPY

SEQ ID NO: 2415438 - protein, 16 aa, Entamoeba dispar
DESMKDPSKTSFERNQ

SEQ ID NO: 2415439 - protein, 21 aa, Entamoeba dispar
DESNEKSRAESLPSDARKEKS

SEQ ID NO: 2415440 - protein, 6 aa, Entamoeba dispar
DESNYY

SEQ ID NO: 2415441 - protein, 13 aa, Entamoeba dispar
DESPRLSPRGYEE

SEQ ID NO: 2415442 - protein, 10 aa, Entamoeba dispar
DESQENNDSM

SEQ ID NO: 2415443 - protein, 10 aa, Entamoeba dispar
DESRFKPKDH

SEQ ID NO: 2415444 - protein, 17 aa, Entamoeba dispar
DESSDDDETIKPPDWMN

SEQ ID NO: 2415445 - protein, 9 aa, Entamoeba dispar
DESSNGTIV

SEQ ID NO: 2415446 - protein, 9 aa, Entamoeba dispar
DESSRTFVG

SEQ ID NO: 2415447 - protein, 4 aa, Entamoeba dispar
DEST

SEQ ID NO: 2415448 - protein, 16 aa, Entamoeba dispar
DESTDTKEQLPQPEKM

SEQ ID NO: 2415449 - protein, 6 aa, Entamoeba dispar
DESTEE

SEQ ID NO: 2415450 - protein, 20 aa, Entamoeba dispar
DESVDPFGSNNSTTDPFGAS

SEQ ID NO: 2415451 - protein, 7 aa, Entamoeba dispar
DESVGIN

SEQ ID NO: 2415452 - protein, 11 aa, Entamoeba dispar
DESVPPPKANI

SEQ ID NO: 2415453 - protein, 8 aa, Entamoeba dispar
DESVSNSC

SEQ ID NO: 2415454 - protein, 7 aa, Entamoeba dispar
DETDESY

SEQ ID NO: 2415455 - protein, 6 aa, Entamoeba dispar
DETDNE

SEQ ID NO: 2415456 - protein, 27 aa, Entamoeba dispar
DETEEKKPRKKNSESKNNKKKNSKKDK

SEQ ID NO: 2415457 - protein, 10 aa, Entamoeba dispar
DETEETKECK

SEQ ID NO: 2415458 - protein, 9 aa, Entamoeba dispar
DETEEVRET

SEQ ID NO: 2415459 - protein, 7 aa, Entamoeba dispar
DETERRR

SEQ ID NO: 2415460 - protein, 8 aa, Entamoeba dispar
DETGDRKT

SEQ ID NO: 2415461 - protein, 15 aa, Entamoeba dispar
DETGELDDKDYYGNK

SEQ ID NO: 2415462 - protein, 6 aa, Entamoeba dispar
DETGHL

SEQ ID NO: 2415463 - protein, 10 aa, Entamoeba dispar
DETGKEQTAS

SEQ ID NO: 2415464 - protein, 8 aa, Entamoeba dispar
DETGKEQV

SEQ ID NO: 2415465 - protein, 8 aa, Entamoeba dispar
DETGYNEK

SEQ ID NO: 2415466 - protein, 5 aa, Entamoeba dispar
DETHL

SEQ ID NO: 2415467 - protein, 17 aa, Entamoeba dispar
DETISVSSHSTQKTNPW

SEQ ID NO: 2415468 - protein, 4 aa, Entamoeba dispar
DETK

SEQ ID NO: 2415469 - protein, 6 aa, Entamoeba dispar
DETKEI

SEQ ID NO: 2415470 - protein, 8 aa, Entamoeba dispar
DETKHDYN

SEQ ID NO: 2415471 - protein, 9 aa, Entamoeba dispar
DETKNNQFD

SEQ ID NO: 2415472 - protein, 8 aa, Entamoeba dispar
DETKQRSD

SEQ ID NO: 2415473 - protein, 7 aa, Entamoeba dispar
DETMSGK

SEQ ID NO: 2415474 - protein, 8 aa, Entamoeba dispar
DETNDSSF

SEQ ID NO: 2415475 - protein, 7 aa, Entamoeba dispar
DETNDVK

SEQ ID NO: 2415476 - protein, 6 aa, Entamoeba dispar
DETNKY

SEQ ID NO: 2415477 - protein, 5 aa, Entamoeba dispar
DETNN

SEQ ID NO: 2415478 - protein, 7 aa, Entamoeba dispar
DETNNDI

SEQ ID NO: 2415479 - protein, 17 aa, Entamoeba dispar
DETNSNEQSKESRMNED

SEQ ID NO: 2415480 - protein, 11 aa, Entamoeba dispar
DETNTRKERGF

SEQ ID NO: 2415481 - protein, 10 aa, Entamoeba dispar
DETPETTDSM

SEQ ID NO: 2415482 - protein, 28 aa, Entamoeba dispar
DETPQQNEKKPSKPLVKKPSKSSQSIEK

SEQ ID NO: 2415483 - protein, 5 aa, Entamoeba dispar
DETRL

SEQ ID NO: 2415484 - protein, 57 aa, Entamoeba dispar
DETSEKEEIDSDSQKSSVTNLEQTDSPDNDRKSKKKKSGEKKEKKANISDKKRKRSI

SEQ ID NO: 2415485 - protein, 6 aa, Entamoeba dispar
DETSFK

SEQ ID NO: 2415486 - protein, 9 aa, Entamoeba dispar
DETSSEHAI

SEQ ID NO: 2415487 - protein, 5 aa, Entamoeba dispar
DETSY

SEQ ID NO: 2415488 - protein, 5 aa, Entamoeba dispar
DETTI

SEQ ID NO: 2415489 - protein, 6 aa, Entamoeba dispar
DETTPS

SEQ ID NO: 2415490 - protein, 6 aa, Entamoeba dispar
DETTQQ

SEQ ID NO: 2415491 - protein, 6 aa, Entamoeba dispar
DETVKE

SEQ ID NO: 2415492 - protein, 8 aa, Entamoeba dispar
DETVSKDD

SEQ ID NO: 2415493 - protein, 16 aa, Entamoeba dispar
DETYKVKGRYDDCDRR

SEQ ID NO: 2415494 - protein, 24 aa, Entamoeba dispar
DEVASTEKKTKKKDKKEEEKKKEE

SEQ ID NO: 2415495 - protein, 29 aa, Entamoeba dispar
DEVDDGDDSSNDDSQEKNDMSEENEEEIP

SEQ ID NO: 2415496 - protein, 7 aa, Entamoeba dispar
DEVDKSI

SEQ ID NO: 2415497 - protein, 6 aa, Entamoeba dispar
DEVDSN

SEQ ID NO: 2415498 - protein, 22 aa, Entamoeba dispar
DEVKKEHEVIEKNDEKVQQIKE

SEQ ID NO: 2415499 - protein, 5 aa, Entamoeba dispar
DEVNE

SEQ ID NO: 2415500 - protein, 7 aa, Entamoeba dispar
DEVPENM

SEQ ID NO: 2415501 - protein, 11 aa, Entamoeba dispar
DEVPESSYKDS

SEQ ID NO: 2415502 - protein, 13 aa, Entamoeba dispar
DEVPTRTKKQCKE

SEQ ID NO: 2415503 - protein, 6 aa, Entamoeba dispar
DEVSAI

SEQ ID NO: 2415504 - protein, 12 aa, Entamoeba dispar
DEVSEQKSKRAL

SEQ ID NO: 2415505 - protein, 8 aa, Entamoeba dispar
DEVTLNSD

SEQ ID NO: 2415506 - protein, 6 aa, Entamoeba dispar
DEWTTT

SEQ ID NO: 2415507 - protein, 6 aa, Entamoeba dispar
DEYDER

SEQ ID NO: 2415508 - protein, 12 aa, Entamoeba dispar
DEYEENKLQETI

SEQ ID NO: 2415509 - protein, 6 aa, Entamoeba dispar
DEYGNA

SEQ ID NO: 2415510 - protein, 10 aa, Entamoeba dispar
DEYKDKKNIV

SEQ ID NO: 2415511 - protein, 4 aa, Entamoeba dispar
DEYN

SEQ ID NO: 2415512 - protein, 11 aa, Entamoeba dispar
DEYNGETRTRY

SEQ ID NO: 2415513 - protein, 10 aa, Entamoeba dispar
DEYQDDNSSM

SEQ ID NO: 2415514 - protein, 7 aa, Entamoeba dispar
DEYSLDK

SEQ ID NO: 2415515 - protein, 10 aa, Entamoeba dispar
DEYTKEMNER

SEQ ID NO: 2415516 - protein, 8 aa, Entamoeba dispar
DFAENAEY

SEQ ID NO: 2415517 - protein, 7 aa, Entamoeba dispar
DFAQETP

SEQ ID NO: 2415518 - protein, 16 aa, Entamoeba dispar
DFDDEHSKNSSCNDQH

SEQ ID NO: 2415519 - protein, 8 aa, Entamoeba dispar
DFDETTSI

SEQ ID NO: 2415520 - protein, 6 aa, Entamoeba dispar
DFDGDE

SEQ ID NO: 2415521 - protein, 6 aa, Entamoeba dispar
DFDGSH

SEQ ID NO: 2415522 - protein, 8 aa, Entamoeba dispar
DFDRRTKC

SEQ ID NO: 2415523 - protein, 11 aa, Entamoeba dispar
DFDSDLSSEEW

SEQ ID NO: 2415524 - protein, 8 aa, Entamoeba dispar
DFDSSSNH

SEQ ID NO: 2415525 - protein, 4 aa, Entamoeba dispar
DFEA

SEQ ID NO: 2415526 - protein, 7 aa, Entamoeba dispar
DFEDGES

SEQ ID NO: 2415527 - protein, 7 aa, Entamoeba dispar
DFEEEIT

SEQ ID NO: 2415528 - protein, 5 aa, Entamoeba dispar
DFEEG

SEQ ID NO: 2415529 - protein, 7 aa, Entamoeba dispar
DFEGQTE

SEQ ID NO: 2415530 - protein, 15 aa, Entamoeba dispar
DFEKCKKSKKPGIVT

SEQ ID NO: 2415531 - protein, 20 aa, Entamoeba dispar
DFEKQEIEQEVGKKQLTQEM

SEQ ID NO: 2415532 - protein, 17 aa, Entamoeba dispar
DFEKSIQESNVEKNNIE

SEQ ID NO: 2415533 - protein, 4 aa, Entamoeba dispar
DFER

SEQ ID NO: 2415534 - protein, 8 aa, Entamoeba dispar
DFETINES

SEQ ID NO: 2415535 - protein, 4 aa, Entamoeba dispar
DFGA

SEQ ID NO: 2415536 - protein, 4 aa, Entamoeba dispar
DFGD

SEQ ID NO: 2415537 - protein, 7 aa, Entamoeba dispar
DFGEEEK

SEQ ID NO: 2415538 - protein, 5 aa, Entamoeba dispar
DFGQQ

SEQ ID NO: 2415539 - protein, 5 aa, Entamoeba dispar
DFGRS

SEQ ID NO: 2415540 - protein, 9 aa, Entamoeba dispar
DFGSNNNIK

SEQ ID NO: 2415541 - protein, 27 aa, Entamoeba dispar
DFGSSRHDDNKDSQKNNSIETKSYTKK

SEQ ID NO: 2415542 - protein, 7 aa, Entamoeba dispar
DFGSSRN

SEQ ID NO: 2415543 - protein, 8 aa, Entamoeba dispar
DFGSSRNI

SEQ ID NO: 2415544 - protein, 14 aa, Entamoeba dispar
DFGTSRAVQEYEGN

SEQ ID NO: 2415545 - protein, 26 aa, Entamoeba dispar
DFHTRKRASTISDISTKSKIKQNEPF

SEQ ID NO: 2415546 - protein, 5 aa, Entamoeba dispar
DFIEE

SEQ ID NO: 2415547 - protein, 8 aa, Entamoeba dispar
DFKPQEKF

SEQ ID NO: 2415548 - protein, 8 aa, Entamoeba dispar
DFKTEGKL

SEQ ID NO: 2415549 - protein, 9 aa, Entamoeba dispar
DFKTGQTKI

SEQ ID NO: 2415550 - protein, 7 aa, Entamoeba dispar
DFNGTDF

SEQ ID NO: 2415551 - protein, 4 aa, Entamoeba dispar
DFNI

SEQ ID NO: 2415552 - protein, 6 aa, Entamoeba dispar
DFNNSI

SEQ ID NO: 2415553 - protein, 22 aa, Entamoeba dispar
DFNNSLNKNKGFKFDQNQQNNI

SEQ ID NO: 2415554 - protein, 8 aa, Entamoeba dispar
DFNPPSES

SEQ ID NO: 2415555 - protein, 6 aa, Entamoeba dispar
DFNQFE

SEQ ID NO: 2415556 - protein, 8 aa, Entamoeba dispar
DFPGGDLT

SEQ ID NO: 2415557 - protein, 5 aa, Entamoeba dispar
DFPNS

SEQ ID NO: 2415558 - protein, 4 aa, Entamoeba dispar
DFPP

SEQ ID NO: 2415559 - protein, 8 aa, Entamoeba dispar
DFPPGAEF

SEQ ID NO: 2415560 - protein, 5 aa, Entamoeba dispar
DFPQG

SEQ ID NO: 2415561 - protein, 7 aa, Entamoeba dispar
DFPSGNS

SEQ ID NO: 2415562 - protein, 6 aa, Entamoeba dispar
DFPSNG

SEQ ID NO: 2415563 - protein, 6 aa, Entamoeba dispar
DFPSSE

SEQ ID NO: 2415564 - protein, 5 aa, Entamoeba dispar
DFPTL

SEQ ID NO: 2415565 - protein, 5 aa, Entamoeba dispar
DFQDP

SEQ ID NO: 2415566 - protein, 11 aa, Entamoeba dispar
DFQESNKNRLP

SEQ ID NO: 2415567 - protein, 5 aa, Entamoeba dispar
DFQKY

SEQ ID NO: 2415568 - protein, 11 aa, Entamoeba dispar
DFQPNETGQLT

SEQ ID NO: 2415569 - protein, 4 aa, Entamoeba dispar
DFSF

SEQ ID NO: 2415570 - protein, 9 aa, Entamoeba dispar
DFSGETDRH

SEQ ID NO: 2415571 - protein, 13 aa, Entamoeba dispar
DFSNSDKLPPLSA

SEQ ID NO: 2415572 - protein, 13 aa, Entamoeba dispar
DFSQNKPVQEDLE

SEQ ID NO: 2415573 - protein, 32 aa, Entamoeba dispar
DFSQPSQFSNFDPQVNQQPTQQNTPSKGPTKF

SEQ ID NO: 2415574 - protein, 39 aa, Entamoeba dispar
DFSSTTESELTSSASNKETHPVPPFENPIGNTKLPTLPS

SEQ ID NO: 2415575 - protein, 4 aa, Entamoeba dispar
DFST

SEQ ID NO: 2415576 - protein, 4 aa, Entamoeba dispar
DFTD

SEQ ID NO: 2415577 - protein, 7 aa, Entamoeba dispar
DFTGVGD

SEQ ID NO: 2415578 - protein, 5 aa, Entamoeba dispar
DFTKE

SEQ ID NO: 2415579 - protein, 20 aa, Entamoeba dispar
DFTKEEEAEIKQKNKWLEEF

SEQ ID NO: 2415580 - protein, 10 aa, Entamoeba dispar
DFTPDSAAIA

SEQ ID NO: 2415581 - protein, 5 aa, Entamoeba dispar
DFTQK

SEQ ID NO: 2415582 - protein, 4 aa, Entamoeba dispar
DFTT

SEQ ID NO: 2415583 - protein, 10 aa, Entamoeba dispar
DFTTASKEID

SEQ ID NO: 2415584 - protein, 9 aa, Entamoeba dispar
DGAAPRLGI

SEQ ID NO: 2415585 - protein, 4 aa, Entamoeba dispar
DGAE

SEQ ID NO: 2415586 - protein, 7 aa, Entamoeba dispar
DGAGQRP

SEQ ID NO: 2415587 - protein, 10 aa, Entamoeba dispar
DGAKAGRNYY

SEQ ID NO: 2415588 - protein, 6 aa, Entamoeba dispar
DGASQA

SEQ ID NO: 2415589 - protein, 7 aa, Entamoeba dispar
DGASTGI

SEQ ID NO: 2415590 - protein, 25 aa, Entamoeba dispar
DGCDDKYDIDPTITRKEFEEECEKR

SEQ ID NO: 2415591 - protein, 7 aa, Entamoeba dispar
DGCGKSN

SEQ ID NO: 2415592 - protein, 5 aa, Entamoeba dispar
DGCNS

SEQ ID NO: 2415593 - protein, 6 aa, Entamoeba dispar
DGCPTV

SEQ ID NO: 2415594 - protein, 9 aa, Entamoeba dispar
DGDAKSLKS

SEQ ID NO: 2415595 - protein, 45 aa, Entamoeba dispar
DGDEEIQEKKSNSSSSSNSGDQYGQLETSDPSEQEAEDDYGTFEP

SEQ ID NO: 2415596 - protein, 15 aa, Entamoeba dispar
DGDEINTNAPAMTVN

SEQ ID NO: 2415597 - protein, 14 aa, Entamoeba dispar
DGDELGTYNDEGFN

SEQ ID NO: 2415598 - protein, 7 aa, Entamoeba dispar
DGDGDRN

SEQ ID NO: 2415599 - protein, 7 aa, Entamoeba dispar
DGDGRWI

SEQ ID NO: 2415600 - protein, 5 aa, Entamoeba dispar
DGDGY

SEQ ID NO: 2415601 - protein, 4 aa, Entamoeba dispar
DGDI

SEQ ID NO: 2415602 - protein, 9 aa, Entamoeba dispar
DGDNEQYAN

SEQ ID NO: 2415603 - protein, 8 aa, Entamoeba dispar
DGDQDVDM

SEQ ID NO: 2415604 - protein, 7 aa, Entamoeba dispar
DGDSMSN

SEQ ID NO: 2415605 - protein, 12 aa, Entamoeba dispar
DGDTLTEEEAND

SEQ ID NO: 2415606 - protein, 6 aa, Entamoeba dispar
DGDVKL

SEQ ID NO: 2415607 - protein, 8 aa, Entamoeba dispar
DGDYNGTK

SEQ ID NO: 2415608 - protein, 6 aa, Entamoeba dispar
DGEAIK

SEQ ID NO: 2415609 - protein, 5 aa, Entamoeba dispar
DGEDP

SEQ ID NO: 2415610 - protein, 4 aa, Entamoeba dispar
DGEG

SEQ ID NO: 2415611 - protein, 105 aa, Entamoeba dispar
DGEGKKKIKKGESSTKEEDNKNEETKTKDNNEKKDEAEGVIKNNEEQQKAEDKKDETTPISENNENNISIEEPNNNTQCESKKTEDTTEEIENKREEPKDELKKE

SEQ ID NO: 2415612 - protein, 11 aa, Entamoeba dispar
DGEGSIGPNIA

SEQ ID NO: 2415613 - protein, 10 aa, Entamoeba dispar
DGEKKNGNSC

SEQ ID NO: 2415614 - protein, 5 aa, Entamoeba dispar
DGELE

SEQ ID NO: 2415615 - protein, 11 aa, Entamoeba dispar
DGELKEEDPLE

SEQ ID NO: 2415616 - protein, 8 aa, Entamoeba dispar
DGENETKS

SEQ ID NO: 2415617 - protein, 13 aa, Entamoeba dispar
DGENINNDPVSQF

SEQ ID NO: 2415618 - protein, 5 aa, Entamoeba dispar
DGEPI

SEQ ID NO: 2415619 - protein, 7 aa, Entamoeba dispar
DGEQIDS

SEQ ID NO: 2415620 - protein, 6 aa, Entamoeba dispar
DGEQVN

SEQ ID NO: 2415621 - protein, 6 aa, Entamoeba dispar
DGERQP

SEQ ID NO: 2415622 - protein, 10 aa, Entamoeba dispar
DGERRTEEEI

SEQ ID NO: 2415623 - protein, 5 aa, Entamoeba dispar
DGESF

SEQ ID NO: 2415624 - protein, 61 aa, Entamoeba dispar
DGESGDNEEEKVNEEEKEKEEKKEEEEPKKEEEKEKEEGVEEPKEEIEGKKVAQKQQGSIP

SEQ ID NO: 2415625 - protein, 21 aa, Entamoeba dispar
DGESGKKGGMASETFSSEVEK

SEQ ID NO: 2415626 - protein, 13 aa, Entamoeba dispar
DGESKENINTINS

SEQ ID NO: 2415627 - protein, 5 aa, Entamoeba dispar
DGEST

SEQ ID NO: 2415628 - protein, 6 aa, Entamoeba dispar
DGETAA

SEQ ID NO: 2415629 - protein, 16 aa, Entamoeba dispar
DGFENGKDKQCESLSN

SEQ ID NO: 2415630 - protein, 6 aa, Entamoeba dispar
DGFETR

SEQ ID NO: 2415631 - protein, 8 aa, Entamoeba dispar
DGFGNKEY

SEQ ID NO: 2415632 - protein, 5 aa, Entamoeba dispar
DGFIS

SEQ ID NO: 2415633 - protein, 4 aa, Entamoeba dispar
DGFK

SEQ ID NO: 2415634 - protein, 5 aa, Entamoeba dispar
DGFKK

SEQ ID NO: 2415635 - protein, 16 aa, Entamoeba dispar
DGFKNNNFNENVGGKE

SEQ ID NO: 2415636 - protein, 19 aa, Entamoeba dispar
DGFLTKPKEKKKEPKEGMR

SEQ ID NO: 2415637 - protein, 6 aa, Entamoeba dispar
DGFQTS

SEQ ID NO: 2415638 - protein, 5 aa, Entamoeba dispar
DGFSD

SEQ ID NO: 2415639 - protein, 7 aa, Entamoeba dispar
DGFSGAD

SEQ ID NO: 2415640 - protein, 5 aa, Entamoeba dispar
DGFTG

SEQ ID NO: 2415641 - protein, 6 aa, Entamoeba dispar
DGGAGW

SEQ ID NO: 2415642 - protein, 5 aa, Entamoeba dispar
DGGDA

SEQ ID NO: 2415643 - protein, 6 aa, Entamoeba dispar
DGGETD

SEQ ID NO: 2415644 - protein, 4 aa, Entamoeba dispar
DGGG

SEQ ID NO: 2415645 - protein, 6 aa, Entamoeba dispar
DGGGDE

SEQ ID NO: 2415646 - protein, 7 aa, Entamoeba dispar
DGGGDID

SEQ ID NO: 2415647 - protein, 6 aa, Entamoeba dispar
DGGGSK

SEQ ID NO: 2415648 - protein, 13 aa, Entamoeba dispar
DGGIVSSGNELKS

SEQ ID NO: 2415649 - protein, 5 aa, Entamoeba dispar
DGGKS

SEQ ID NO: 2415650 - protein, 5 aa, Entamoeba dispar
DGGLA

SEQ ID NO: 2415651 - protein, 18 aa, Entamoeba dispar
DGGLQIEEGADGKTYGFY

SEQ ID NO: 2415652 - protein, 4 aa, Entamoeba dispar
DGGN

SEQ ID NO: 2415653 - protein, 7 aa, Entamoeba dispar
DGGNEPA

SEQ ID NO: 2415654 - protein, 5 aa, Entamoeba dispar
DGGNI

SEQ ID NO: 2415655 - protein, 7 aa, Entamoeba dispar
DGGNISL

SEQ ID NO: 2415656 - protein, 16 aa, Entamoeba dispar
DGGNYRIGENPGDDAK

SEQ ID NO: 2415657 - protein, 5 aa, Entamoeba dispar
DGGQD

SEQ ID NO: 2415658 - protein, 5 aa, Entamoeba dispar
DGGSA

SEQ ID NO: 2415659 - protein, 7 aa, Entamoeba dispar
DGGVGKS

SEQ ID NO: 2415660 - protein, 8 aa, Entamoeba dispar
DGGVGKSA

SEQ ID NO: 2415661 - protein, 6 aa, Entamoeba dispar
DGHDKP

SEQ ID NO: 2415662 - protein, 5 aa, Entamoeba dispar
DGHEG

SEQ ID NO: 2415663 - protein, 26 aa, Entamoeba dispar
DGHIQSKAQKDLNPVYGKESKIKKIG

SEQ ID NO: 2415664 - protein, 10 aa, Entamoeba dispar
DGHSEKIAND

SEQ ID NO: 2415665 - protein, 6 aa, Entamoeba dispar
DGHSGK

SEQ ID NO: 2415666 - protein, 18 aa, Entamoeba dispar
DGHSNGGGALSAVAATKS

SEQ ID NO: 2415667 - protein, 4 aa, Entamoeba dispar
DGHW

SEQ ID NO: 2415668 - protein, 6 aa, Entamoeba dispar
DGIGKK

SEQ ID NO: 2415669 - protein, 7 aa, Entamoeba dispar
DGIGKKE

SEQ ID NO: 2415670 - protein, 6 aa, Entamoeba dispar
DGIGRE

SEQ ID NO: 2415671 - protein, 16 aa, Entamoeba dispar
DGIGRSTEETIRIVKA

SEQ ID NO: 2415672 - protein, 4 aa, Entamoeba dispar
DGIH

SEQ ID NO: 2415673 - protein, 8 aa, Entamoeba dispar
DGIKEQSI

SEQ ID NO: 2415674 - protein, 6 aa, Entamoeba dispar
DGIKER

SEQ ID NO: 2415675 - protein, 8 aa, Entamoeba dispar
DGIKERYP

SEQ ID NO: 2415676 - protein, 5 aa, Entamoeba dispar
DGIKN

SEQ ID NO: 2415677 - protein, 7 aa, Entamoeba dispar
DGINDEG

SEQ ID NO: 2415678 - protein, 7 aa, Entamoeba dispar
DGINEAK

SEQ ID NO: 2415679 - protein, 8 aa, Entamoeba dispar
DGINEEMK

SEQ ID NO: 2415680 - protein, 10 aa, Entamoeba dispar
DGINKEEYYN

SEQ ID NO: 2415681 - protein, 14 aa, Entamoeba dispar
DGINTSVESLEKKK

SEQ ID NO: 2415682 - protein, 6 aa, Entamoeba dispar
DGIQEE

SEQ ID NO: 2415683 - protein, 4 aa, Entamoeba dispar
DGIT

SEQ ID NO: 2415684 - protein, 10 aa, Entamoeba dispar
DGITKRPVKT

SEQ ID NO: 2415685 - protein, 15 aa, Entamoeba dispar
DGKAGSQSVTEASDL

SEQ ID NO: 2415686 - protein, 11 aa, Entamoeba dispar
DGKDENQYYGT

SEQ ID NO: 2415687 - protein, 8 aa, Entamoeba dispar
DGKEERIG

SEQ ID NO: 2415688 - protein, 9 aa, Entamoeba dispar
DGKEFSEEF

SEQ ID NO: 2415689 - protein, 5 aa, Entamoeba dispar
DGKEI

SEQ ID NO: 2415690 - protein, 7 aa, Entamoeba dispar
DGKENPQ

SEQ ID NO: 2415691 - protein, 7 aa, Entamoeba dispar
DGKEYKD

SEQ ID NO: 2415692 - protein, 5 aa, Entamoeba dispar
DGKFI

SEQ ID NO: 2415693 - protein, 12 aa, Entamoeba dispar
DGKFSSIGTNYP

SEQ ID NO: 2415694 - protein, 5 aa, Entamoeba dispar
DGKGN

SEQ ID NO: 2415695 - protein, 9 aa, Entamoeba dispar
DGKGQQAGY

SEQ ID NO: 2415696 - protein, 7 aa, Entamoeba dispar
DGKHQTT

SEQ ID NO: 2415697 - protein, 4 aa, Entamoeba dispar
DGKI

SEQ ID NO: 2415698 - protein, 5 aa, Entamoeba dispar
DGKKC

SEQ ID NO: 2415699 - protein, 38 aa, Entamoeba dispar
DGKKGGDKDNDGGKFGAFGSSNKRGKQHTFKGKQGGDN

SEQ ID NO: 2415700 - protein, 9 aa, Entamoeba dispar
DGKKGIKEL

SEQ ID NO: 2415701 - protein, 8 aa, Entamoeba dispar
DGKKNNVQ

SEQ ID NO: 2415702 - protein, 8 aa, Entamoeba dispar
DGKKSSYF

SEQ ID NO: 2415703 - protein, 5 aa, Entamoeba dispar
DGKKT

SEQ ID NO: 2415704 - protein, 9 aa, Entamoeba dispar
DGKKYDWET

SEQ ID NO: 2415705 - protein, 12 aa, Entamoeba dispar
DGKLKTGSKKGD

SEQ ID NO: 2415706 - protein, 5 aa, Entamoeba dispar
DGKLL

SEQ ID NO: 2415707 - protein, 6 aa, Entamoeba dispar
DGKMYG

SEQ ID NO: 2415708 - protein, 11 aa, Entamoeba dispar
DGKNPKMIDSS

SEQ ID NO: 2415709 - protein, 7 aa, Entamoeba dispar
DGKNRAP

SEQ ID NO: 2415710 - protein, 4 aa, Entamoeba dispar
DGKP

SEQ ID NO: 2415711 - protein, 8 aa, Entamoeba dispar
DGKPAENS

SEQ ID NO: 2415712 - protein, 14 aa, Entamoeba dispar
DGKPIGKKQGQKLE

SEQ ID NO: 2415713 - protein, 5 aa, Entamoeba dispar
DGKPL

SEQ ID NO: 2415714 - protein, 20 aa, Entamoeba dispar
DGKPTQDDSNTQPAPQECTQ

SEQ ID NO: 2415715 - protein, 5 aa, Entamoeba dispar
DGKPV

SEQ ID NO: 2415716 - protein, 7 aa, Entamoeba dispar
DGKSREL

SEQ ID NO: 2415717 - protein, 8 aa, Entamoeba dispar
DGKTMDES

SEQ ID NO: 2415718 - protein, 10 aa, Entamoeba dispar
DGKTSQKQRD

SEQ ID NO: 2415719 - protein, 5 aa, Entamoeba dispar
DGKTY

SEQ ID NO: 2415720 - protein, 8 aa, Entamoeba dispar
DGKVTMTK

SEQ ID NO: 2415721 - protein, 5 aa, Entamoeba dispar
DGKYP

SEQ ID NO: 2415722 - protein, 9 aa, Entamoeba dispar
DGKYSQTRE

SEQ ID NO: 2415723 - protein, 8 aa, Entamoeba dispar
DGKYTEPK

SEQ ID NO: 2415724 - protein, 8 aa, Entamoeba dispar
DGLDSTKE

SEQ ID NO: 2415725 - protein, 4 aa, Entamoeba dispar
DGLE

SEQ ID NO: 2415726 - protein, 13 aa, Entamoeba dispar
DGLLPNGNINTTN

SEQ ID NO: 2415727 - protein, 7 aa, Entamoeba dispar
DGLNKRG

SEQ ID NO: 2415728 - protein, 17 aa, Entamoeba dispar
DGLNNESLQSESSPQPI

SEQ ID NO: 2415729 - protein, 13 aa, Entamoeba dispar
DGLPQNVSKDLST

SEQ ID NO: 2415730 - protein, 13 aa, Entamoeba dispar
DGLPQNVSQDLST

SEQ ID NO: 2415731 - protein, 7 aa, Entamoeba dispar
DGLTARD

SEQ ID NO: 2415732 - protein, 19 aa, Entamoeba dispar
DGMESEAVSRTHSTPSQIE

SEQ ID NO: 2415733 - protein, 5 aa, Entamoeba dispar
DGMPA

SEQ ID NO: 2415734 - protein, 6 aa, Entamoeba dispar
DGMSSA

SEQ ID NO: 2415735 - protein, 12 aa, Entamoeba dispar
DGMSSGDRGGIT

SEQ ID NO: 2415736 - protein, 4 aa, Entamoeba dispar
DGMT

SEQ ID NO: 2415737 - protein, 7 aa, Entamoeba dispar
DGNATEL

SEQ ID NO: 2415738 - protein, 7 aa, Entamoeba dispar
DGNEPAI

SEQ ID NO: 2415739 - protein, 6 aa, Entamoeba dispar
DGNESE

SEQ ID NO: 2415740 - protein, 6 aa, Entamoeba dispar
DGNFDT

SEQ ID NO: 2415741 - protein, 6 aa, Entamoeba dispar
DGNFGS

SEQ ID NO: 2415742 - protein, 6 aa, Entamoeba dispar
DGNFTE

SEQ ID NO: 2415743 - protein, 9 aa, Entamoeba dispar
DGNKPNRCS

SEQ ID NO: 2415744 - protein, 13 aa, Entamoeba dispar
DGNKTYYIKSLWE

SEQ ID NO: 2415745 - protein, 5 aa, Entamoeba dispar
DGNLG

SEQ ID NO: 2415746 - protein, 5 aa, Entamoeba dispar
DGNLR

SEQ ID NO: 2415747 - protein, 8 aa, Entamoeba dispar
DGNNEKAM

SEQ ID NO: 2415748 - protein, 5 aa, Entamoeba dispar
DGNNI

SEQ ID NO: 2415749 - protein, 61 aa, Entamoeba dispar
DGNNQMSEEGSTPINSEDEMSEEDHLSTTDSKPPKAPQSDQQKSNLPKKENLTSEDQKNIT

SEQ ID NO: 2415750 - protein, 8 aa, Entamoeba dispar
DGNPLGSY

SEQ ID NO: 2415751 - protein, 8 aa, Entamoeba dispar
DGNPPYMD

SEQ ID NO: 2415752 - protein, 5 aa, Entamoeba dispar
DGNPQ

SEQ ID NO: 2415753 - protein, 6 aa, Entamoeba dispar
DGNQNN

SEQ ID NO: 2415754 - protein, 6 aa, Entamoeba dispar
DGNQRV

SEQ ID NO: 2415755 - protein, 4 aa, Entamoeba dispar
DGNS

SEQ ID NO: 2415756 - protein, 8 aa, Entamoeba dispar
DGNSGRGV

SEQ ID NO: 2415757 - protein, 7 aa, Entamoeba dispar
DGNSNIP

SEQ ID NO: 2415758 - protein, 5 aa, Entamoeba dispar
DGNSP

SEQ ID NO: 2415759 - protein, 10 aa, Entamoeba dispar
DGNTSEEHRR

SEQ ID NO: 2415760 - protein, 6 aa, Entamoeba dispar
DGNVGK

SEQ ID NO: 2415761 - protein, 15 aa, Entamoeba dispar
DGNVGKFSTNNVHHR

SEQ ID NO: 2415762 - protein, 5 aa, Entamoeba dispar
DGNVT

SEQ ID NO: 2415763 - protein, 4 aa, Entamoeba dispar
DGPF

SEQ ID NO: 2415764 - protein, 6 aa, Entamoeba dispar
DGPFDK

SEQ ID NO: 2415765 - protein, 6 aa, Entamoeba dispar
DGPFET

SEQ ID NO: 2415766 - protein, 6 aa, Entamoeba dispar
DGPFGE

SEQ ID NO: 2415767 - protein, 5 aa, Entamoeba dispar
DGPGN

SEQ ID NO: 2415768 - protein, 7 aa, Entamoeba dispar
DGPIKNG

SEQ ID NO: 2415769 - protein, 5 aa, Entamoeba dispar
DGPLG

SEQ ID NO: 2415770 - protein, 4 aa, Entamoeba dispar
DGPN

SEQ ID NO: 2415771 - protein, 7 aa, Entamoeba dispar
DGPSGLR

SEQ ID NO: 2415772 - protein, 9 aa, Entamoeba dispar
DGPSSPSFA

SEQ ID NO: 2415773 - protein, 42 aa, Entamoeba dispar
DGQDTGDYKNEKKSESELKQISTEKSYKSNEGKSLEKKTEFP

SEQ ID NO: 2415774 - protein, 10 aa, Entamoeba dispar
DGQEDYTKFE

SEQ ID NO: 2415775 - protein, 17 aa, Entamoeba dispar
DGQEEPTSTNQQNSNYS

SEQ ID NO: 2415776 - protein, 10 aa, Entamoeba dispar
DGQGTSVEQA

SEQ ID NO: 2415777 - protein, 9 aa, Entamoeba dispar
DGQKEENEF

SEQ ID NO: 2415778 - protein, 4 aa, Entamoeba dispar
DGQL

SEQ ID NO: 2415779 - protein, 10 aa, Entamoeba dispar
DGQPFTQDEI

SEQ ID NO: 2415780 - protein, 12 aa, Entamoeba dispar
DGQPIKVKFKNQ

SEQ ID NO: 2415781 - protein, 6 aa, Entamoeba dispar
DGQQKK

SEQ ID NO: 2415782 - protein, 16 aa, Entamoeba dispar
DGQQSSVELQSTSNLK

SEQ ID NO: 2415783 - protein, 4 aa, Entamoeba dispar
DGQR

SEQ ID NO: 2415784 - protein, 11 aa, Entamoeba dispar
DGQTQQEDRVE

SEQ ID NO: 2415785 - protein, 6 aa, Entamoeba dispar
DGRARQ

SEQ ID NO: 2415786 - protein, 6 aa, Entamoeba dispar
DGRDDK

SEQ ID NO: 2415787 - protein, 7 aa, Entamoeba dispar
DGRDDLK

SEQ ID NO: 2415788 - protein, 5 aa, Entamoeba dispar
DGRDE

SEQ ID NO: 2415789 - protein, 4 aa, Entamoeba dispar
DGRF

SEQ ID NO: 2415790 - protein, 8 aa, Entamoeba dispar
DGRGRTVD

SEQ ID NO: 2415791 - protein, 11 aa, Entamoeba dispar
DGRISEENMDS

SEQ ID NO: 2415792 - protein, 7 aa, Entamoeba dispar
DGRLKPG

SEQ ID NO: 2415793 - protein, 6 aa, Entamoeba dispar
DGRQPK

SEQ ID NO: 2415794 - protein, 13 aa, Entamoeba dispar
DGRRIVTGNEKGE

SEQ ID NO: 2415795 - protein, 8 aa, Entamoeba dispar
DGRRTTEM

SEQ ID NO: 2415796 - protein, 10 aa, Entamoeba dispar
DGRTQETNTN

SEQ ID NO: 2415797 - protein, 9 aa, Entamoeba dispar
DGRTTFTEY

SEQ ID NO: 2415798 - protein, 12 aa, Entamoeba dispar
DGRYPNAPDGNT

SEQ ID NO: 2415799 - protein, 17 aa, Entamoeba dispar
DGSDLPDGVEFPDVLLN

SEQ ID NO: 2415800 - protein, 10 aa, Entamoeba dispar
DGSFNDNTLK

SEQ ID NO: 2415801 - protein, 7 aa, Entamoeba dispar
DGSGKTS

SEQ ID NO: 2415802 - protein, 8 aa, Entamoeba dispar
DGSGNEKL

SEQ ID NO: 2415803 - protein, 5 aa, Entamoeba dispar
DGSGY

SEQ ID NO: 2415804 - protein, 5 aa, Entamoeba dispar
DGSIK

SEQ ID NO: 2415805 - protein, 22 aa, Entamoeba dispar
DGSIYGTYNNSNLNENKTDLFN

SEQ ID NO: 2415806 - protein, 5 aa, Entamoeba dispar
DGSKE

SEQ ID NO: 2415807 - protein, 11 aa, Entamoeba dispar
DGSKNKRVKTE

SEQ ID NO: 2415808 - protein, 4 aa, Entamoeba dispar
DGSL

SEQ ID NO: 2415809 - protein, 8 aa, Entamoeba dispar
DGSLTTSI

SEQ ID NO: 2415810 - protein, 8 aa, Entamoeba dispar
DGSNELPN

SEQ ID NO: 2415811 - protein, 4 aa, Entamoeba dispar
DGSP

SEQ ID NO: 2415812 - protein, 6 aa, Entamoeba dispar
DGSPED

SEQ ID NO: 2415813 - protein, 8 aa, Entamoeba dispar
DGSPNMGK

SEQ ID NO: 2415814 - protein, 9 aa, Entamoeba dispar
DGSPNTAKQ

SEQ ID NO: 2415815 - protein, 4 aa, Entamoeba dispar
DGSQ

SEQ ID NO: 2415816 - protein, 8 aa, Entamoeba dispar
DGSQSYLP

SEQ ID NO: 2415817 - protein, 4 aa, Entamoeba dispar
DGSS

SEQ ID NO: 2415818 - protein, 8 aa, Entamoeba dispar
DGSSFNDH

SEQ ID NO: 2415819 - protein, 7 aa, Entamoeba dispar
DGSSQLL

SEQ ID NO: 2415820 - protein, 10 aa, Entamoeba dispar
DGSTDFCPSE

SEQ ID NO: 2415821 - protein, 6 aa, Entamoeba dispar
DGSVES

SEQ ID NO: 2415822 - protein, 5 aa, Entamoeba dispar
DGSVK

SEQ ID NO: 2415823 - protein, 13 aa, Entamoeba dispar
DGSVRSNDRQNAI

SEQ ID NO: 2415824 - protein, 7 aa, Entamoeba dispar
DGSYEKN

SEQ ID NO: 2415825 - protein, 7 aa, Entamoeba dispar
DGSYPDI

SEQ ID NO: 2415826 - protein, 9 aa, Entamoeba dispar
DGTATEGPW

SEQ ID NO: 2415827 - protein, 5 aa, Entamoeba dispar
DGTDC

SEQ ID NO: 2415828 - protein, 23 aa, Entamoeba dispar
DGTHNYSEQIPLTGNGHYTTQNG

SEQ ID NO: 2415829 - protein, 4 aa, Entamoeba dispar
DGTI

SEQ ID NO: 2415830 - protein, 8 aa, Entamoeba dispar
DGTIDRKK

SEQ ID NO: 2415831 - protein, 8 aa, Entamoeba dispar
DGTIDTEF

SEQ ID NO: 2415832 - protein, 5 aa, Entamoeba dispar
DGTIN

SEQ ID NO: 2415833 - protein, 5 aa, Entamoeba dispar
DGTIP

SEQ ID NO: 2415834 - protein, 9 aa, Entamoeba dispar
DGTKGMPGA

SEQ ID NO: 2415835 - protein, 10 aa, Entamoeba dispar
DGTKQITYDG

SEQ ID NO: 2415836 - protein, 6 aa, Entamoeba dispar
DGTLTY

SEQ ID NO: 2415837 - protein, 12 aa, Entamoeba dispar
DGTNNKGKLGAN

SEQ ID NO: 2415838 - protein, 7 aa, Entamoeba dispar
DGTPQTL

SEQ ID NO: 2415839 - protein, 17 aa, Entamoeba dispar
DGTQGPIASLGAPAAAL

SEQ ID NO: 2415840 - protein, 9 aa, Entamoeba dispar
DGTRTEKDI

SEQ ID NO: 2415841 - protein, 7 aa, Entamoeba dispar
DGTSGSI

SEQ ID NO: 2415842 - protein, 6 aa, Entamoeba dispar
DGTSLV

SEQ ID NO: 2415843 - protein, 8 aa, Entamoeba dispar
DGTSNCGL

SEQ ID NO: 2415844 - protein, 5 aa, Entamoeba dispar
DGTTN

SEQ ID NO: 2415845 - protein, 8 aa, Entamoeba dispar
DGTTTEGP

SEQ ID NO: 2415846 - protein, 6 aa, Entamoeba dispar
DGTVGK

SEQ ID NO: 2415847 - protein, 6 aa, Entamoeba dispar
DGTVGP

SEQ ID NO: 2415848 - protein, 56 aa, Entamoeba dispar
DGTYKEEYKESEEQINEEGEEDTEIKGNSSLNEMSEEEDNKEQKMEESEEEEEGIN

SEQ ID NO: 2415849 - protein, 7 aa, Entamoeba dispar
DGVEETE

SEQ ID NO: 2415850 - protein, 6 aa, Entamoeba dispar
DGVFEQ

SEQ ID NO: 2415851 - protein, 9 aa, Entamoeba dispar
DGVGEDGYV

SEQ ID NO: 2415852 - protein, 5 aa, Entamoeba dispar
DGVNG

SEQ ID NO: 2415853 - protein, 7 aa, Entamoeba dispar
DGVNKGD

SEQ ID NO: 2415854 - protein, 5 aa, Entamoeba dispar
DGVNS

SEQ ID NO: 2415855 - protein, 8 aa, Entamoeba dispar
DGVRKERV

SEQ ID NO: 2415856 - protein, 9 aa, Entamoeba dispar
DGVSQSTIY

SEQ ID NO: 2415857 - protein, 6 aa, Entamoeba dispar
DGVTDV

SEQ ID NO: 2415858 - protein, 7 aa, Entamoeba dispar
DGVTQAE

SEQ ID NO: 2415859 - protein, 15 aa, Entamoeba dispar
DGVTSARLNPNITDG

SEQ ID NO: 2415860 - protein, 4 aa, Entamoeba dispar
DGWD

SEQ ID NO: 2415861 - protein, 5 aa, Entamoeba dispar
DGYEG

SEQ ID NO: 2415862 - protein, 8 aa, Entamoeba dispar
DGYGDPMK

SEQ ID NO: 2415863 - protein, 8 aa, Entamoeba dispar
DGYGGHTT

SEQ ID NO: 2415864 - protein, 11 aa, Entamoeba dispar
DGYGTSETGSL

SEQ ID NO: 2415865 - protein, 5 aa, Entamoeba dispar
DGYKH

SEQ ID NO: 2415866 - protein, 25 aa, Entamoeba dispar
DGYNPNVTDQHEVEKDSEAKNTMKN

SEQ ID NO: 2415867 - protein, 9 aa, Entamoeba dispar
DGYNPQTRE

SEQ ID NO: 2415868 - protein, 7 aa, Entamoeba dispar
DGYPDGC

SEQ ID NO: 2415869 - protein, 10 aa, Entamoeba dispar
DHAKELQEKI

SEQ ID NO: 2415870 - protein, 7 aa, Entamoeba dispar
DHANEAN

SEQ ID NO: 2415871 - protein, 6 aa, Entamoeba dispar
DHDGLI

SEQ ID NO: 2415872 - protein, 6 aa, Entamoeba dispar
DHDPRC

SEQ ID NO: 2415873 - protein, 6 aa, Entamoeba dispar
DHEESR

SEQ ID NO: 2415874 - protein, 5 aa, Entamoeba dispar
DHEET

SEQ ID NO: 2415875 - protein, 9 aa, Entamoeba dispar
DHEGRNKTL

SEQ ID NO: 2415876 - protein, 7 aa, Entamoeba dispar
DHEKQKV

SEQ ID NO: 2415877 - protein, 8 aa, Entamoeba dispar
DHEKQKVT

SEQ ID NO: 2415878 - protein, 9 aa, Entamoeba dispar
DHEKREMYD

SEQ ID NO: 2415879 - protein, 9 aa, Entamoeba dispar
DHEQPEDPY

SEQ ID NO: 2415880 - protein, 10 aa, Entamoeba dispar
DHERKNGRLS

SEQ ID NO: 2415881 - protein, 11 aa, Entamoeba dispar
DHETGKKYPLA

SEQ ID NO: 2415882 - protein, 5 aa, Entamoeba dispar
DHFRE

SEQ ID NO: 2415883 - protein, 5 aa, Entamoeba dispar
DHGQY

SEQ ID NO: 2415884 - protein, 5 aa, Entamoeba dispar
DHHRS

SEQ ID NO: 2415885 - protein, 8 aa, Entamoeba dispar
DHIGTEYK

SEQ ID NO: 2415886 - protein, 6 aa, Entamoeba dispar
DHITRR

SEQ ID NO: 2415887 - protein, 4 aa, Entamoeba dispar
DHKE

SEQ ID NO: 2415888 - protein, 8 aa, Entamoeba dispar
DHKESDSV

SEQ ID NO: 2415889 - protein, 11 aa, Entamoeba dispar
DHKHDENTEVE

SEQ ID NO: 2415890 - protein, 9 aa, Entamoeba dispar
DHKKEGDIL

SEQ ID NO: 2415891 - protein, 28 aa, Entamoeba dispar
DHKPSYQEDRQRIRETGNYISDQEKVNG

SEQ ID NO: 2415892 - protein, 10 aa, Entamoeba dispar
DHKPTNPNEF

SEQ ID NO: 2415893 - protein, 19 aa, Entamoeba dispar
DHNHDGNQKLSDVKSQLKP

SEQ ID NO: 2415894 - protein, 10 aa, Entamoeba dispar
DHNQSPRNTY

SEQ ID NO: 2415895 - protein, 7 aa, Entamoeba dispar
DHNSSFK

SEQ ID NO: 2415896 - protein, 11 aa, Entamoeba dispar
DHPDEAKLGTC

SEQ ID NO: 2415897 - protein, 6 aa, Entamoeba dispar
DHPKTN

SEQ ID NO: 2415898 - protein, 6 aa, Entamoeba dispar
DHPQGQ

SEQ ID NO: 2415899 - protein, 7 aa, Entamoeba dispar
DHPREAA

SEQ ID NO: 2415900 - protein, 13 aa, Entamoeba dispar
DHQTRANKEGKRV

SEQ ID NO: 2415901 - protein, 13 aa, Entamoeba dispar
DHRETDKEKLEIN

SEQ ID NO: 2415902 - protein, 7 aa, Entamoeba dispar
DHRKEDI

SEQ ID NO: 2415903 - protein, 5 aa, Entamoeba dispar
DHRTQ

SEQ ID NO: 2415904 - protein, 13 aa, Entamoeba dispar
DHSESQEQKNIDQ

SEQ ID NO: 2415905 - protein, 5 aa, Entamoeba dispar
DHSGY

SEQ ID NO: 2415906 - protein, 7 aa, Entamoeba dispar
DHSHDRI

SEQ ID NO: 2415907 - protein, 24 aa, Entamoeba dispar
DHSINPQKSINSRGSSPKQEHPSD

SEQ ID NO: 2415908 - protein, 17 aa, Entamoeba dispar
DHSKPKEVKKLLPFEDD

SEQ ID NO: 2415909 - protein, 6 aa, Entamoeba dispar
DHSNDF

SEQ ID NO: 2415910 - protein, 4 aa, Entamoeba dispar
DHSS

SEQ ID NO: 2415911 - protein, 17 aa, Entamoeba dispar
DHSSKKTPTIKVSPPTI

SEQ ID NO: 2415912 - protein, 12 aa, Entamoeba dispar
DHSSLKDLNDFN

SEQ ID NO: 2415913 - protein, 11 aa, Entamoeba dispar
DHTDNPNFNTD

SEQ ID NO: 2415914 - protein, 13 aa, Entamoeba dispar
DHTPYNERGYKGS

SEQ ID NO: 2415915 - protein, 4 aa, Entamoeba dispar
DHTS

SEQ ID NO: 2415916 - protein, 11 aa, Entamoeba dispar
DIANNSNSTVA

SEQ ID NO: 2415917 - protein, 5 aa, Entamoeba dispar
DIAPL

SEQ ID NO: 2415918 - protein, 18 aa, Entamoeba dispar
DIARSETEKKIIEEEQKE

SEQ ID NO: 2415919 - protein, 7 aa, Entamoeba dispar
DIDAGQR

SEQ ID NO: 2415920 - protein, 10 aa, Entamoeba dispar
DIDDEPKENI

SEQ ID NO: 2415921 - protein, 25 aa, Entamoeba dispar
DIDDNTNDTYHNNIESKQNSNGTLF

SEQ ID NO: 2415922 - protein, 11 aa, Entamoeba dispar
DIDDVEGNVTK

SEQ ID NO: 2415923 - protein, 19 aa, Entamoeba dispar
DIDKLTKDIKSSNNEEDIN

SEQ ID NO: 2415924 - protein, 6 aa, Entamoeba dispar
DIDKTH

SEQ ID NO: 2415925 - protein, 8 aa, Entamoeba dispar
DIDPEEMH

SEQ ID NO: 2415926 - protein, 8 aa, Entamoeba dispar
DIDPKKER

SEQ ID NO: 2415927 - protein, 5 aa, Entamoeba dispar
DIDPT

SEQ ID NO: 2415928 - protein, 5 aa, Entamoeba dispar
DIDSQ

SEQ ID NO: 2415929 - protein, 15 aa, Entamoeba dispar
DIDTEDFMANTEYRG

SEQ ID NO: 2415930 - protein, 4 aa, Entamoeba dispar
DIED

SEQ ID NO: 2415931 - protein, 10 aa, Entamoeba dispar
DIEDADKNTT

SEQ ID NO: 2415932 - protein, 4 aa, Entamoeba dispar
DIEE

SEQ ID NO: 2415933 - protein, 12 aa, Entamoeba dispar
DIEEDEKEQEYP

SEQ ID NO: 2415934 - protein, 6 aa, Entamoeba dispar
DIEEDL

SEQ ID NO: 2415935 - protein, 7 aa, Entamoeba dispar
DIEELGT

SEQ ID NO: 2415936 - protein, 12 aa, Entamoeba dispar
DIEEPKTYTVEG

SEQ ID NO: 2415937 - protein, 14 aa, Entamoeba dispar
DIEEQKKELDATTK

SEQ ID NO: 2415938 - protein, 5 aa, Entamoeba dispar
DIEET

SEQ ID NO: 2415939 - protein, 6 aa, Entamoeba dispar
DIEETL

SEQ ID NO: 2415940 - protein, 4 aa, Entamoeba dispar
DIEG

SEQ ID NO: 2415941 - protein, 9 aa, Entamoeba dispar
DIEKEDKKF

SEQ ID NO: 2415942 - protein, 5 aa, Entamoeba dispar
DIEKT

SEQ ID NO: 2415943 - protein, 7 aa, Entamoeba dispar
DIEKTNK

SEQ ID NO: 2415944 - protein, 4 aa, Entamoeba dispar
DIEN

SEQ ID NO: 2415945 - protein, 8 aa, Entamoeba dispar
DIENDPQN

SEQ ID NO: 2415946 - protein, 5 aa, Entamoeba dispar
DIENG

SEQ ID NO: 2415947 - protein, 8 aa, Entamoeba dispar
DIENRETH

SEQ ID NO: 2415948 - protein, 7 aa, Entamoeba dispar
DIEREGI

SEQ ID NO: 2415949 - protein, 6 aa, Entamoeba dispar
DIESGQ

SEQ ID NO: 2415950 - protein, 12 aa, Entamoeba dispar
DIESPIEDDGLL

SEQ ID NO: 2415951 - protein, 8 aa, Entamoeba dispar
DIESSFDA

SEQ ID NO: 2415952 - protein, 6 aa, Entamoeba dispar
DIETAQ

SEQ ID NO: 2415953 - protein, 6 aa, Entamoeba dispar
DIETGL

SEQ ID NO: 2415954 - protein, 5 aa, Entamoeba dispar
DIETI

SEQ ID NO: 2415955 - protein, 16 aa, Entamoeba dispar
DIEYYTDKNDINESIN

SEQ ID NO: 2415956 - protein, 21 aa, Entamoeba dispar
DIEYYTDKNDINESINPINIT

SEQ ID NO: 2415957 - protein, 4 aa, Entamoeba dispar
DIFR

SEQ ID NO: 2415958 - protein, 11 aa, Entamoeba dispar
DIGDRIDNDDL

SEQ ID NO: 2415959 - protein, 6 aa, Entamoeba dispar
DIGEGG

SEQ ID NO: 2415960 - protein, 8 aa, Entamoeba dispar
DIGEPSYC

SEQ ID NO: 2415961 - protein, 4 aa, Entamoeba dispar
DIGG

SEQ ID NO: 2415962 - protein, 5 aa, Entamoeba dispar
DIGGG

SEQ ID NO: 2415963 - protein, 9 aa, Entamoeba dispar
DIGGTSDGY

SEQ ID NO: 2415964 - protein, 18 aa, Entamoeba dispar
DIHNDSQKDKADQISHPL

SEQ ID NO: 2415965 - protein, 6 aa, Entamoeba dispar
DIHTGD

SEQ ID NO: 2415966 - protein, 19 aa, Entamoeba dispar
DIIKEKDGVIEKKEKECYE

SEQ ID NO: 2415967 - protein, 4 aa, Entamoeba dispar
DIIP

SEQ ID NO: 2415968 - protein, 6 aa, Entamoeba dispar
DIISSS

SEQ ID NO: 2415969 - protein, 6 aa, Entamoeba dispar
DIITGK

SEQ ID NO: 2415970 - protein, 11 aa, Entamoeba dispar
DIKEKNNKEIN

SEQ ID NO: 2415971 - protein, 7 aa, Entamoeba dispar
DIKGDAY

SEQ ID NO: 2415972 - protein, 17 aa, Entamoeba dispar
DIKGDETNARSDGEKGL

SEQ ID NO: 2415973 - protein, 8 aa, Entamoeba dispar
DIKKMEKK

SEQ ID NO: 2415974 - protein, 8 aa, Entamoeba dispar
DIKKQNSG

SEQ ID NO: 2415975 - protein, 5 aa, Entamoeba dispar
DIKNE

SEQ ID NO: 2415976 - protein, 7 aa, Entamoeba dispar
DIKNTTC

SEQ ID NO: 2415977 - protein, 4 aa, Entamoeba dispar
DIKP

SEQ ID NO: 2415978 - protein, 14 aa, Entamoeba dispar
DIKQETEDDTITHN

SEQ ID NO: 2415979 - protein, 6 aa, Entamoeba dispar
DIKREQ

SEQ ID NO: 2415980 - protein, 9 aa, Entamoeba dispar
DIKSDKEHI

SEQ ID NO: 2415981 - protein, 10 aa, Entamoeba dispar
DIKTGAQQGS

SEQ ID NO: 2415982 - protein, 6 aa, Entamoeba dispar
DIKTKD

SEQ ID NO: 2415983 - protein, 5 aa, Entamoeba dispar
DIKVY

SEQ ID NO: 2415984 - protein, 11 aa, Entamoeba dispar
DILSGKKNIYD

SEQ ID NO: 2415985 - protein, 5 aa, Entamoeba dispar
DINCK

SEQ ID NO: 2415986 - protein, 19 aa, Entamoeba dispar
DINDDFEEVRKEAKSATDA

SEQ ID NO: 2415987 - protein, 8 aa, Entamoeba dispar
DINDDGLI

SEQ ID NO: 2415988 - protein, 10 aa, Entamoeba dispar
DINDNDPPSL

SEQ ID NO: 2415989 - protein, 6 aa, Entamoeba dispar
DINEDD

SEQ ID NO: 2415990 - protein, 5 aa, Entamoeba dispar
DINEE

SEQ ID NO: 2415991 - protein, 13 aa, Entamoeba dispar
DINEEPESTNNNN

SEQ ID NO: 2415992 - protein, 6 aa, Entamoeba dispar
DINENN

SEQ ID NO: 2415993 - protein, 13 aa, Entamoeba dispar
DINERNKRSIKEY

SEQ ID NO: 2415994 - protein, 15 aa, Entamoeba dispar
DINETIKGLNTSEDL

SEQ ID NO: 2415995 - protein, 6 aa, Entamoeba dispar
DINETL

SEQ ID NO: 2415996 - protein, 14 aa, Entamoeba dispar
DINGNGKISKEEFK

SEQ ID NO: 2415997 - protein, 15 aa, Entamoeba dispar
DINNTKNKHKKTKID

SEQ ID NO: 2415998 - protein, 4 aa, Entamoeba dispar
DINP

SEQ ID NO: 2415999 - protein, 8 aa, Entamoeba dispar
DINQEEGT

SEQ ID NO: 2416000 - protein, 10 aa, Entamoeba dispar
DINQQDDGGL

SEQ ID NO: 2416001 - protein, 7 aa, Entamoeba dispar
DINSLQI

SEQ ID NO: 2416002 - protein, 6 aa, Entamoeba dispar
DINSNE

SEQ ID NO: 2416003 - protein, 14 aa, Entamoeba dispar
DINSSDKNTSQYDT

SEQ ID NO: 2416004 - protein, 19 aa, Entamoeba dispar
DINTQSPNPIDKEKHKTKR

SEQ ID NO: 2416005 - protein, 4 aa, Entamoeba dispar
DIPA

SEQ ID NO: 2416006 - protein, 12 aa, Entamoeba dispar
DIPAETQAKLQS

SEQ ID NO: 2416007 - protein, 6 aa, Entamoeba dispar
DIPASV

SEQ ID NO: 2416008 - protein, 6 aa, Entamoeba dispar
DIPDPL

SEQ ID NO: 2416009 - protein, 5 aa, Entamoeba dispar
DIPEE

SEQ ID NO: 2416010 - protein, 12 aa, Entamoeba dispar
DIPEKRTSKENL

SEQ ID NO: 2416011 - protein, 10 aa, Entamoeba dispar
DIPEQPQVEE

SEQ ID NO: 2416012 - protein, 6 aa, Entamoeba dispar
DIPGEL

SEQ ID NO: 2416013 - protein, 6 aa, Entamoeba dispar
DIPGYY

SEQ ID NO: 2416014 - protein, 28 aa, Entamoeba dispar
DIPKEEGKNEEDFSKQNQQEEQSENQSI

SEQ ID NO: 2416015 - protein, 15 aa, Entamoeba dispar
DIPKGSTFENTQKYG

SEQ ID NO: 2416016 - protein, 6 aa, Entamoeba dispar
DIPKVP

SEQ ID NO: 2416017 - protein, 5 aa, Entamoeba dispar
DIPLP

SEQ ID NO: 2416018 - protein, 4 aa, Entamoeba dispar
DIPN

SEQ ID NO: 2416019 - protein, 11 aa, Entamoeba dispar
DIPNETSVNSP

SEQ ID NO: 2416020 - protein, 5 aa, Entamoeba dispar
DIPNL

SEQ ID NO: 2416021 - protein, 125 aa, Entamoeba dispar
DIPNSNKHTTVSTTNPPQNLKKPEPELETQIPSAPVISSKNETPQPNTQTRRPPPPLPNRKVPPTLPSRSDNNIPPSSVNPPPPPNLNVPPPPNLNVPPPPPTLNTPSPSTKTTPDVSLPTGGRS

SEQ ID NO: 2416022 - protein, 12 aa, Entamoeba dispar
DIPNSVENPLKD

SEQ ID NO: 2416023 - protein, 7 aa, Entamoeba dispar
DIPNTEC

SEQ ID NO: 2416024 - protein, 12 aa, Entamoeba dispar
DIPPNQSNIEVP

SEQ ID NO: 2416025 - protein, 10 aa, Entamoeba dispar
DIPPSDNENY

SEQ ID NO: 2416026 - protein, 12 aa, Entamoeba dispar
DIPQHPPSCPRC

SEQ ID NO: 2416027 - protein, 6 aa, Entamoeba dispar
DIPQHS

SEQ ID NO: 2416028 - protein, 8 aa, Entamoeba dispar
DIPQSVQE

SEQ ID NO: 2416029 - protein, 5 aa, Entamoeba dispar
DIPRS

SEQ ID NO: 2416030 - protein, 4 aa, Entamoeba dispar
DIPS

SEQ ID NO: 2416031 - protein, 8 aa, Entamoeba dispar
DIPSIQGS

SEQ ID NO: 2416032 - protein, 5 aa, Entamoeba dispar
DIPSK

SEQ ID NO: 2416033 - protein, 8 aa, Entamoeba dispar
DIPSSVSE

SEQ ID NO: 2416034 - protein, 8 aa, Entamoeba dispar
DIPSSVSK

SEQ ID NO: 2416035 - protein, 8 aa, Entamoeba dispar
DIPSSVTE

SEQ ID NO: 2416036 - protein, 5 aa, Entamoeba dispar
DIPTG

SEQ ID NO: 2416037 - protein, 54 aa, Entamoeba dispar
DIPTQSDESLKQKPSVLQPKTSGESSTPSSISHSTNSVNNNTPNISPSLNKSTD

SEQ ID NO: 2416038 - protein, 8 aa, Entamoeba dispar
DIPTSISK

SEQ ID NO: 2416039 - protein, 8 aa, Entamoeba dispar
DIPTSVSK

SEQ ID NO: 2416040 - protein, 12 aa, Entamoeba dispar
DIPTSVSKIGNG

SEQ ID NO: 2416041 - protein, 6 aa, Entamoeba dispar
DIPTVT

SEQ ID NO: 2416042 - protein, 5 aa, Entamoeba dispar
DIPYP

SEQ ID NO: 2416043 - protein, 21 aa, Entamoeba dispar
DIQDKKQKRLNNEIETSCGSS

SEQ ID NO: 2416044 - protein, 9 aa, Entamoeba dispar
DIQEQDNLT

SEQ ID NO: 2416045 - protein, 4 aa, Entamoeba dispar
DIQK

SEQ ID NO: 2416046 - protein, 7 aa, Entamoeba dispar
DIQKSSG

SEQ ID NO: 2416047 - protein, 7 aa, Entamoeba dispar
DIQPGVR

SEQ ID NO: 2416048 - protein, 14 aa, Entamoeba dispar
DIQQKQREQTLNGF

SEQ ID NO: 2416049 - protein, 20 aa, Entamoeba dispar
DIQQSTPSNNKNKPHIITPS

SEQ ID NO: 2416050 - protein, 7 aa, Entamoeba dispar
DIQSRQQ

SEQ ID NO: 2416051 - protein, 6 aa, Entamoeba dispar
DIQTGE

SEQ ID NO: 2416052 - protein, 11 aa, Entamoeba dispar
DIQTIGQQTGN

SEQ ID NO: 2416053 - protein, 6 aa, Entamoeba dispar
DIQTKR

SEQ ID NO: 2416054 - protein, 6 aa, Entamoeba dispar
DIRDEK

SEQ ID NO: 2416055 - protein, 5 aa, Entamoeba dispar
DIRDN

SEQ ID NO: 2416056 - protein, 7 aa, Entamoeba dispar
DIRNNSA

SEQ ID NO: 2416057 - protein, 9 aa, Entamoeba dispar
DISADQSIK

SEQ ID NO: 2416058 - protein, 4 aa, Entamoeba dispar
DISD

SEQ ID NO: 2416059 - protein, 16 aa, Entamoeba dispar
DISDKEKINEFEKRSK

SEQ ID NO: 2416060 - protein, 23 aa, Entamoeba dispar
DISEETKHTQKRTRTRGNSFYGR

SEQ ID NO: 2416061 - protein, 4 aa, Entamoeba dispar
DISK

SEQ ID NO: 2416062 - protein, 28 aa, Entamoeba dispar
DISKSAVESIERNAKYNNTTKIQPSESD

SEQ ID NO: 2416063 - protein, 9 aa, Entamoeba dispar
DISKTSAPI

SEQ ID NO: 2416064 - protein, 4 aa, Entamoeba dispar
DISN

SEQ ID NO: 2416065 - protein, 9 aa, Entamoeba dispar
DISNNEVEN

SEQ ID NO: 2416066 - protein, 5 aa, Entamoeba dispar
DISPK

SEQ ID NO: 2416067 - protein, 6 aa, Entamoeba dispar
DISQPN

SEQ ID NO: 2416068 - protein, 7 aa, Entamoeba dispar
DISSLNN

SEQ ID NO: 2416069 - protein, 23 aa, Entamoeba dispar
DISSSEERKEISVQDVSNSTEIE

SEQ ID NO: 2416070 - protein, 24 aa, Entamoeba dispar
DITANEKYQKLKEEISQGIKEDEF

SEQ ID NO: 2416071 - protein, 10 aa, Entamoeba dispar
DITDKDVEEY

SEQ ID NO: 2416072 - protein, 20 aa, Entamoeba dispar
DITDKEKITTIKEQNSENKR

SEQ ID NO: 2416073 - protein, 7 aa, Entamoeba dispar
DITDKNR

SEQ ID NO: 2416074 - protein, 10 aa, Entamoeba dispar
DITDNEKRKK

SEQ ID NO: 2416075 - protein, 10 aa, Entamoeba dispar
DITGGSTKLE

SEQ ID NO: 2416076 - protein, 6 aa, Entamoeba dispar
DITHPI

SEQ ID NO: 2416077 - protein, 6 aa, Entamoeba dispar
DITKEN

SEQ ID NO: 2416078 - protein, 6 aa, Entamoeba dispar
DITKKQ

SEQ ID NO: 2416079 - protein, 16 aa, Entamoeba dispar
DITKPNKDFNLTPSSA

SEQ ID NO: 2416080 - protein, 8 aa, Entamoeba dispar
DITNNKEL

SEQ ID NO: 2416081 - protein, 8 aa, Entamoeba dispar
DITPEEKE

SEQ ID NO: 2416082 - protein, 17 aa, Entamoeba dispar
DITPQPQVNNITNQQEL

SEQ ID NO: 2416083 - protein, 5 aa, Entamoeba dispar
DITQE

SEQ ID NO: 2416084 - protein, 5 aa, Entamoeba dispar
DITQP

SEQ ID NO: 2416085 - protein, 5 aa, Entamoeba dispar
DITQR

SEQ ID NO: 2416086 - protein, 5 aa, Entamoeba dispar
DITSE

SEQ ID NO: 2416087 - protein, 12 aa, Entamoeba dispar
DITSSINKMKEG

SEQ ID NO: 2416088 - protein, 8 aa, Entamoeba dispar
DITTNNAS

SEQ ID NO: 2416089 - protein, 7 aa, Entamoeba dispar
DIVEEKQ

SEQ ID NO: 2416090 - protein, 7 aa, Entamoeba dispar
DIVSDDA

SEQ ID NO: 2416091 - protein, 6 aa, Entamoeba dispar
DIYENG

SEQ ID NO: 2416092 - protein, 6 aa, Entamoeba dispar
DIYNDG

SEQ ID NO: 2416093 - protein, 9 aa, Entamoeba dispar
DKAASVRES

SEQ ID NO: 2416094 - protein, 9 aa, Entamoeba dispar
DKACPKGFQ

SEQ ID NO: 2416095 - protein, 31 aa, Entamoeba dispar
DKAEAQSKELEEIKSQIEKAKKELKSKKLKN

SEQ ID NO: 2416096 - protein, 19 aa, Entamoeba dispar
DKAEDAKRAVEQLNGTEVD

SEQ ID NO: 2416097 - protein, 10 aa, Entamoeba dispar
DKAGITEEEI

SEQ ID NO: 2416098 - protein, 9 aa, Entamoeba dispar
DKAIPEGHR

SEQ ID NO: 2416099 - protein, 12 aa, Entamoeba dispar
DKAKEPSLDNQT

SEQ ID NO: 2416100 - protein, 8 aa, Entamoeba dispar
DKAKTIGA

SEQ ID NO: 2416101 - protein, 4 aa, Entamoeba dispar
DKAL

SEQ ID NO: 2416102 - protein, 7 aa, Entamoeba dispar
DKAPNDI

SEQ ID NO: 2416103 - protein, 17 aa, Entamoeba dispar
DKAQAERDRALSDFKSG

SEQ ID NO: 2416104 - protein, 30 aa, Entamoeba dispar
DKASAKEDIEKKEEKTKRKKNPNTKLKNEW

SEQ ID NO: 2416105 - protein, 6 aa, Entamoeba dispar
DKASGL

SEQ ID NO: 2416106 - protein, 6 aa, Entamoeba dispar
DKASGS

SEQ ID NO: 2416107 - protein, 28 aa, Entamoeba dispar
DKASKPNSSNQVSTLNQSEDSGKTKEMV

SEQ ID NO: 2416108 - protein, 6 aa, Entamoeba dispar
DKASRV

SEQ ID NO: 2416109 - protein, 4 aa, Entamoeba dispar
DKCG

SEQ ID NO: 2416110 - protein, 10 aa, Entamoeba dispar
DKCNSRPKDF

SEQ ID NO: 2416111 - protein, 5 aa, Entamoeba dispar
DKCQK

SEQ ID NO: 2416112 - protein, 11 aa, Entamoeba dispar
DKDALGSRTLP

SEQ ID NO: 2416113 - protein, 8 aa, Entamoeba dispar
DKDARQSS

SEQ ID NO: 2416114 - protein, 9 aa, Entamoeba dispar
DKDDEQQPI

SEQ ID NO: 2416115 - protein, 9 aa, Entamoeba dispar
DKDDIKPED

SEQ ID NO: 2416116 - protein, 8 aa, Entamoeba dispar
DKDEGEVE

SEQ ID NO: 2416117 - protein, 16 aa, Entamoeba dispar
DKDEGNKALNELDKQY

SEQ ID NO: 2416118 - protein, 6 aa, Entamoeba dispar
DKDFTP

SEQ ID NO: 2416119 - protein, 9 aa, Entamoeba dispar
DKDGIQSET

SEQ ID NO: 2416120 - protein, 6 aa, Entamoeba dispar
DKDGKM

SEQ ID NO: 2416121 - protein, 8 aa, Entamoeba dispar
DKDHSGTL

SEQ ID NO: 2416122 - protein, 9 aa, Entamoeba dispar
DKDHTKLNR

SEQ ID NO: 2416123 - protein, 16 aa, Entamoeba dispar
DKDHWSYPEDPDKSGF

SEQ ID NO: 2416124 - protein, 6 aa, Entamoeba dispar
DKDKIQ

SEQ ID NO: 2416125 - protein, 7 aa, Entamoeba dispar
DKDKSGI

SEQ ID NO: 2416126 - protein, 11 aa, Entamoeba dispar
DKDKSGNLDEQ

SEQ ID NO: 2416127 - protein, 7 aa, Entamoeba dispar
DKDLKGR

SEQ ID NO: 2416128 - protein, 5 aa, Entamoeba dispar
DKDNA

SEQ ID NO: 2416129 - protein, 21 aa, Entamoeba dispar
DKDNNQIESGISTKSIDPIWD

SEQ ID NO: 2416130 - protein, 18 aa, Entamoeba dispar
DKDNNSEETQEGQSTVQE

SEQ ID NO: 2416131 - protein, 14 aa, Entamoeba dispar
DKDQPIGGDSGETF

SEQ ID NO: 2416132 - protein, 19 aa, Entamoeba dispar
DKDQRLDSGKTLDEIKENG

SEQ ID NO: 2416133 - protein, 16 aa, Entamoeba dispar
DKDRADNVDEKTIRRR

SEQ ID NO: 2416134 - protein, 6 aa, Entamoeba dispar
DKDSQN

SEQ ID NO: 2416135 - protein, 7 aa, Entamoeba dispar
DKDTKCE

SEQ ID NO: 2416136 - protein, 9 aa, Entamoeba dispar
DKDTPEERE

SEQ ID NO: 2416137 - protein, 9 aa, Entamoeba dispar
DKDTTTTDW

SEQ ID NO: 2416138 - protein, 6 aa, Entamoeba dispar
DKDYHK

SEQ ID NO: 2416139 - protein, 9 aa, Entamoeba dispar
DKEAEKRKQ

SEQ ID NO: 2416140 - protein, 37 aa, Entamoeba dispar
DKEAKQYKKYSFKEKKKLKTIAGGASDIGVRQANEDT

SEQ ID NO: 2416141 - protein, 10 aa, Entamoeba dispar
DKEARDYAAE

SEQ ID NO: 2416142 - protein, 9 aa, Entamoeba dispar
DKECANDPY

SEQ ID NO: 2416143 - protein, 4 aa, Entamoeba dispar
DKED

SEQ ID NO: 2416144 - protein, 6 aa, Entamoeba dispar
DKEDDL

SEQ ID NO: 2416145 - protein, 12 aa, Entamoeba dispar
DKEDECNSKKLP

SEQ ID NO: 2416146 - protein, 7 aa, Entamoeba dispar
DKEDIYE

SEQ ID NO: 2416147 - protein, 128 aa, Entamoeba dispar
DKEDNEKSMEEENAIGKGMKGEAEGMGSEEEGDIKEEKEKKKEEHQEQTMEEANDEKEEKGEEQQEEGQEVEETEKLQTLPGKEQIEEDNQEENNDDDEFKMDEEGEENMSIEEENNNENEEEQGGQF

SEQ ID NO: 2416148 - protein, 6 aa, Entamoeba dispar
DKEDNL

SEQ ID NO: 2416149 - protein, 7 aa, Entamoeba dispar
DKEDPQL

SEQ ID NO: 2416150 - protein, 11 aa, Entamoeba dispar
DKEEDEIVTND

SEQ ID NO: 2416151 - protein, 10 aa, Entamoeba dispar
DKEEDKKQEI

SEQ ID NO: 2416152 - protein, 6 aa, Entamoeba dispar
DKEEDL

SEQ ID NO: 2416153 - protein, 23 aa, Entamoeba dispar
DKEEEQKEEKNPRIKDKEEKEEI

SEQ ID NO: 2416154 - protein, 13 aa, Entamoeba dispar
DKEEFSEETGTSI

SEQ ID NO: 2416155 - protein, 11 aa, Entamoeba dispar
DKEEGTGDSDG

SEQ ID NO: 2416156 - protein, 37 aa, Entamoeba dispar
DKEESTEEDEEEKEQLEDQSNEIENIEKGSNNNTTNT

SEQ ID NO: 2416157 - protein, 9 aa, Entamoeba dispar
DKEEVDTNN

SEQ ID NO: 2416158 - protein, 7 aa, Entamoeba dispar
DKEFKGN

SEQ ID NO: 2416159 - protein, 5 aa, Entamoeba dispar
DKEGL

SEQ ID NO: 2416160 - protein, 9 aa, Entamoeba dispar
DKEIGEKEI

SEQ ID NO: 2416161 - protein, 5 aa, Entamoeba dispar
DKEIN

SEQ ID NO: 2416162 - protein, 7 aa, Entamoeba dispar
DKEIPEF

SEQ ID NO: 2416163 - protein, 23 aa, Entamoeba dispar
DKEIRVDTQSSQNTNKSQCNERS

SEQ ID NO: 2416164 - protein, 14 aa, Entamoeba dispar
DKEISSMEKSLNRQ

SEQ ID NO: 2416165 - protein, 8 aa, Entamoeba dispar
DKEKAINK

SEQ ID NO: 2416166 - protein, 7 aa, Entamoeba dispar
DKEKDIT

SEQ ID NO: 2416167 - protein, 9 aa, Entamoeba dispar
DKEKERKIT

SEQ ID NO: 2416168 - protein, 12 aa, Entamoeba dispar
DKEKIKKENELS

SEQ ID NO: 2416169 - protein, 12 aa, Entamoeba dispar
DKEKRKERIKQE

SEQ ID NO: 2416170 - protein, 10 aa, Entamoeba dispar
DKEKYQEERI

SEQ ID NO: 2416171 - protein, 7 aa, Entamoeba dispar
DKELTSR

SEQ ID NO: 2416172 - protein, 4 aa, Entamoeba dispar
DKEM

SEQ ID NO: 2416173 - protein, 9 aa, Entamoeba dispar
DKEMDQKYK

SEQ ID NO: 2416174 - protein, 5 aa, Entamoeba dispar
DKEME

SEQ ID NO: 2416175 - protein, 5 aa, Entamoeba dispar
DKEND

SEQ ID NO: 2416176 - protein, 12 aa, Entamoeba dispar
DKENSPYSLESK

SEQ ID NO: 2416177 - protein, 5 aa, Entamoeba dispar
DKENV

SEQ ID NO: 2416178 - protein, 11 aa, Entamoeba dispar
DKEPANTNTKE

SEQ ID NO: 2416179 - protein, 4 aa, Entamoeba dispar
DKEQ

SEQ ID NO: 2416180 - protein, 6 aa, Entamoeba dispar
DKEQKI

SEQ ID NO: 2416181 - protein, 9 aa, Entamoeba dispar
DKERAIGEA

SEQ ID NO: 2416182 - protein, 9 aa, Entamoeba dispar
DKERKYTKQ

SEQ ID NO: 2416183 - protein, 5 aa, Entamoeba dispar
DKERM

SEQ ID NO: 2416184 - protein, 7 aa, Entamoeba dispar
DKERNDV

SEQ ID NO: 2416185 - protein, 6 aa, Entamoeba dispar
DKERYQ

SEQ ID NO: 2416186 - protein, 6 aa, Entamoeba dispar
DKESFK

SEQ ID NO: 2416187 - protein, 23 aa, Entamoeba dispar
DKESGEPSRMTAGVDDEAERQRI

SEQ ID NO: 2416188 - protein, 12 aa, Entamoeba dispar
DKESHQPTKELE

SEQ ID NO: 2416189 - protein, 5 aa, Entamoeba dispar
DKESI

SEQ ID NO: 2416190 - protein, 10 aa, Entamoeba dispar
DKESKKKKKS

SEQ ID NO: 2416191 - protein, 9 aa, Entamoeba dispar
DKESKNIVE

SEQ ID NO: 2416192 - protein, 12 aa, Entamoeba dispar
DKESKQISQEQQ

SEQ ID NO: 2416193 - protein, 7 aa, Entamoeba dispar
DKESVEC

SEQ ID NO: 2416194 - protein, 6 aa, Entamoeba dispar
DKETDQ

SEQ ID NO: 2416195 - protein, 5 aa, Entamoeba dispar
DKETI

SEQ ID NO: 2416196 - protein, 65 aa, Entamoeba dispar
DKEVEKESKKKAKKEETEESEEEIKHKDKKENKTKGKKEQESSEEIEEEKESKKKVKKEKEIKVP

SEQ ID NO: 2416197 - protein, 65 aa, Entamoeba dispar
DKEVEKESKKKAKKEETEESEEEIKRKDKKENKTKGKKEQESSEEIEEEKESKKKVKKEKEIKVP

SEQ ID NO: 2416198 - protein, 7 aa, Entamoeba dispar
DKEWKKG

SEQ ID NO: 2416199 - protein, 7 aa, Entamoeba dispar
DKEWTET

SEQ ID NO: 2416200 - protein, 13 aa, Entamoeba dispar
DKFDDQEPSTSTN

SEQ ID NO: 2416201 - protein, 14 aa, Entamoeba dispar
DKFDEQEPSTSTTF

SEQ ID NO: 2416202 - protein, 8 aa, Entamoeba dispar
DKFDSRPC

SEQ ID NO: 2416203 - protein, 6 aa, Entamoeba dispar
DKFDYQ

SEQ ID NO: 2416204 - protein, 11 aa, Entamoeba dispar
DKFGTKQADKL

SEQ ID NO: 2416205 - protein, 9 aa, Entamoeba dispar
DKFKQMKET

SEQ ID NO: 2416206 - protein, 7 aa, Entamoeba dispar
DKFKTPK

SEQ ID NO: 2416207 - protein, 13 aa, Entamoeba dispar
DKFTEGKESEEEI

SEQ ID NO: 2416208 - protein, 5 aa, Entamoeba dispar
DKFTP

SEQ ID NO: 2416209 - protein, 4 aa, Entamoeba dispar
DKGA

SEQ ID NO: 2416210 - protein, 7 aa, Entamoeba dispar
DKGCRDE

SEQ ID NO: 2416211 - protein, 6 aa, Entamoeba dispar
DKGEIF

SEQ ID NO: 2416212 - protein, 38 aa, Entamoeba dispar
DKGESKEGLKDNKATQVGEEKKRTSSLDLDTHSDSSSI

SEQ ID NO: 2416213 - protein, 8 aa, Entamoeba dispar
DKGFDDRR

SEQ ID NO: 2416214 - protein, 6 aa, Entamoeba dispar
DKGGYI

SEQ ID NO: 2416215 - protein, 20 aa, Entamoeba dispar
DKGIQDEKKPKKRITRKEKK

SEQ ID NO: 2416216 - protein, 7 aa, Entamoeba dispar
DKGIRKA

SEQ ID NO: 2416217 - protein, 8 aa, Entamoeba dispar
DKGKGGES

SEQ ID NO: 2416218 - protein, 6 aa, Entamoeba dispar
DKGKGV

SEQ ID NO: 2416219 - protein, 6 aa, Entamoeba dispar
DKGKLD

SEQ ID NO: 2416220 - protein, 7 aa, Entamoeba dispar
DKGKLES

SEQ ID NO: 2416221 - protein, 8 aa, Entamoeba dispar
DKGKPGDR

SEQ ID NO: 2416222 - protein, 6 aa, Entamoeba dispar
DKGQEI

SEQ ID NO: 2416223 - protein, 6 aa, Entamoeba dispar
DKGSEG

SEQ ID NO: 2416224 - protein, 8 aa, Entamoeba dispar
DKGSKTTK

SEQ ID NO: 2416225 - protein, 9 aa, Entamoeba dispar
DKGSNKKQC

SEQ ID NO: 2416226 - protein, 9 aa, Entamoeba dispar
DKGSPEDKM

SEQ ID NO: 2416227 - protein, 6 aa, Entamoeba dispar
DKGTDA

SEQ ID NO: 2416228 - protein, 7 aa, Entamoeba dispar
DKGTGIV

SEQ ID NO: 2416229 - protein, 8 aa, Entamoeba dispar
DKHEEGQK

SEQ ID NO: 2416230 - protein, 17 aa, Entamoeba dispar
DKHEHPVSCGTKGGYCK

SEQ ID NO: 2416231 - protein, 8 aa, Entamoeba dispar
DKHFQEKE

SEQ ID NO: 2416232 - protein, 11 aa, Entamoeba dispar
DKHGKDDHMGN

SEQ ID NO: 2416233 - protein, 12 aa, Entamoeba dispar
DKHGKDDPMGNA

SEQ ID NO: 2416234 - protein, 7 aa, Entamoeba dispar
DKHKNRI

SEQ ID NO: 2416235 - protein, 8 aa, Entamoeba dispar
DKHPNTPQ

SEQ ID NO: 2416236 - protein, 10 aa, Entamoeba dispar
DKHTSTETVN

SEQ ID NO: 2416237 - protein, 5 aa, Entamoeba dispar
DKIAK

SEQ ID NO: 2416238 - protein, 18 aa, Entamoeba dispar
DKIEKSKSKVDPKTANDI

SEQ ID NO: 2416239 - protein, 5 aa, Entamoeba dispar
DKIFN

SEQ ID NO: 2416240 - protein, 7 aa, Entamoeba dispar
DKIIPSD

SEQ ID NO: 2416241 - protein, 12 aa, Entamoeba dispar
DKIKQKKAERIA

SEQ ID NO: 2416242 - protein, 7 aa, Entamoeba dispar
DKIKSVG

SEQ ID NO: 2416243 - protein, 6 aa, Entamoeba dispar
DKINDT

SEQ ID NO: 2416244 - protein, 10 aa, Entamoeba dispar
DKINENKNYT

SEQ ID NO: 2416245 - protein, 9 aa, Entamoeba dispar
DKINKNEKK

SEQ ID NO: 2416246 - protein, 6 aa, Entamoeba dispar
DKIPSD

SEQ ID NO: 2416247 - protein, 4 aa, Entamoeba dispar
DKIQ

SEQ ID NO: 2416248 - protein, 19 aa, Entamoeba dispar
DKISELESKLSAAELDKQE

SEQ ID NO: 2416249 - protein, 8 aa, Entamoeba dispar
DKISENDI

SEQ ID NO: 2416250 - protein, 7 aa, Entamoeba dispar
DKISGAT

SEQ ID NO: 2416251 - protein, 8 aa, Entamoeba dispar
DKISSTEH

SEQ ID NO: 2416252 - protein, 4 aa, Entamoeba dispar
DKIT

SEQ ID NO: 2416253 - protein, 9 aa, Entamoeba dispar
DKITCDADP

SEQ ID NO: 2416254 - protein, 6 aa, Entamoeba dispar
DKITEE

SEQ ID NO: 2416255 - protein, 7 aa, Entamoeba dispar
DKITEEN

SEQ ID NO: 2416256 - protein, 6 aa, Entamoeba dispar
DKITGK

SEQ ID NO: 2416257 - protein, 8 aa, Entamoeba dispar
DKITSSNE

SEQ ID NO: 2416258 - protein, 7 aa, Entamoeba dispar
DKIYKDG

SEQ ID NO: 2416259 - protein, 6 aa, Entamoeba dispar
DKIYNN

SEQ ID NO: 2416260 - protein, 18 aa, Entamoeba dispar
DKKAEEAKNEKEKAEKMR

SEQ ID NO: 2416261 - protein, 9 aa, Entamoeba dispar
DKKAEKETQ

SEQ ID NO: 2416262 - protein, 9 aa, Entamoeba dispar
DKKAEVGKV

SEQ ID NO: 2416263 - protein, 6 aa, Entamoeba dispar
DKKDDI

SEQ ID NO: 2416264 - protein, 258 aa, Entamoeba dispar
DKKDDKEKEEKKKEEKKKDKSHHEKEESQKIKEKEEAKKKAEEEAKKKAEEEAKKKAEEEAKKKAEEEAKKKEEEEAKMKAEEAKKKEEEEAKKKEEEEAKKKEEEEAKKKEEEEAKKREEEEAKKKEEEAKMKAEEAKKKEEEEAKKREEEEAKMKAEEEAKKKEEEEAKKREEEEAKKREEEEAKKKEEEEAKKKEEEAKKKEEEAKKKEEEAKMKAEEEAKMKAEEEAKTEEKKDQPQGLGLGGGLGQPQGLGLG

SEQ ID NO: 2416265 - protein, 6 aa, Entamoeba dispar
DKKDGF

SEQ ID NO: 2416266 - protein, 5 aa, Entamoeba dispar
DKKDL

SEQ ID NO: 2416267 - protein, 7 aa, Entamoeba dispar
DKKDSRY

SEQ ID NO: 2416268 - protein, 7 aa, Entamoeba dispar
DKKEAFG

SEQ ID NO: 2416269 - protein, 96 aa, Entamoeba dispar
DKKEDKKKKEEKKEEKKGLFSSSSHKDKKDESSSSIKQKKEQKEEVPPPVPSKKYNSKPSATSPSLPAKSLHSSSGAKTIEKPKENMSDSSHNNTL

SEQ ID NO: 2416270 - protein, 23 aa, Entamoeba dispar
DKKEIPKKSSIQQKDIPKPTTAH

SEQ ID NO: 2416271 - protein, 14 aa, Entamoeba dispar
DKKEKLDKLKQQTF

SEQ ID NO: 2416272 - protein, 7 aa, Entamoeba dispar
DKKELEN

SEQ ID NO: 2416273 - protein, 23 aa, Entamoeba dispar
DKKEMSIKSESIETVNDNSLNQE

SEQ ID NO: 2416274 - protein, 7 aa, Entamoeba dispar
DKKENKI

SEQ ID NO: 2416275 - protein, 6 aa, Entamoeba dispar
DKKEPA

SEQ ID NO: 2416276 - protein, 6 aa, Entamoeba dispar
DKKEPY

SEQ ID NO: 2416277 - protein, 9 aa, Entamoeba dispar
DKKEQKLKE

SEQ ID NO: 2416278 - protein, 5 aa, Entamoeba dispar
DKKEY

SEQ ID NO: 2416279 - protein, 8 aa, Entamoeba dispar
DKKEYQKE

SEQ ID NO: 2416280 - protein, 15 aa, Entamoeba dispar
DKKGAERACSRDGSI

SEQ ID NO: 2416281 - protein, 5 aa, Entamoeba dispar
DKKGF

SEQ ID NO: 2416282 - protein, 9 aa, Entamoeba dispar
DKKGGEANV

SEQ ID NO: 2416283 - protein, 5 aa, Entamoeba dispar
DKKGL

SEQ ID NO: 2416284 - protein, 8 aa, Entamoeba dispar
DKKIDEKF

SEQ ID NO: 2416285 - protein, 30 aa, Entamoeba dispar
DKKIEEEKQEEKEINLTKQNEKKKEGCSQN

SEQ ID NO: 2416286 - protein, 7 aa, Entamoeba dispar
DKKIEGC

SEQ ID NO: 2416287 - protein, 11 aa, Entamoeba dispar
DKKIKTSLKQN

SEQ ID NO: 2416288 - protein, 6 aa, Entamoeba dispar
DKKISK

SEQ ID NO: 2416289 - protein, 7 aa, Entamoeba dispar
DKKITNG

SEQ ID NO: 2416290 - protein, 22 aa, Entamoeba dispar
DKKKDGSSIGGTDKQRKNQLKT

SEQ ID NO: 2416291 - protein, 19 aa, Entamoeba dispar
DKKKKLSEIRKSNQNIPKS

SEQ ID NO: 2416292 - protein, 21 aa, Entamoeba dispar
DKKKREKNISSTNLTENNEPE

SEQ ID NO: 2416293 - protein, 10 aa, Entamoeba dispar
DKKKYDGLDP

SEQ ID NO: 2416294 - protein, 8 aa, Entamoeba dispar
DKKKYDVQ

SEQ ID NO: 2416295 - protein, 8 aa, Entamoeba dispar
DKKLKTSL

SEQ ID NO: 2416296 - protein, 15 aa, Entamoeba dispar
DKKMGDSILSWAKSW

SEQ ID NO: 2416297 - protein, 84 aa, Entamoeba dispar
DKKNHEIKKEEKVVKEENEAEDSKKDNVDEEKEEEELVEKQRKQKEIQEQEEAARQKQLEEQQKESAALSDKSKEKSDKAKEKN

SEQ ID NO: 2416298 - protein, 16 aa, Entamoeba dispar
DKKPEREPEQTDEKPI

SEQ ID NO: 2416299 - protein, 16 aa, Entamoeba dispar
DKKPEREPEQTDENPI

SEQ ID NO: 2416300 - protein, 23 aa, Entamoeba dispar
DKKPRQKKEKTEKRQEKEKKKSK

SEQ ID NO: 2416301 - protein, 121 aa, Entamoeba dispar
DKKPSPRSLSSTSVPPSQPLQPKRSPSPVVGSTLQKTPLQHSASMQSVPSSHHPEPKRKPPLPPNKPIPTPQPKQQLSHSGVASSSNLSVTQPPKKMPPQVPNKLRTSESTLTQSAPLHQK

SEQ ID NO: 2416302 - protein, 10 aa, Entamoeba dispar
DKKQNKEETF

SEQ ID NO: 2416303 - protein, 9 aa, Entamoeba dispar
DKKQQTIED

SEQ ID NO: 2416304 - protein, 10 aa, Entamoeba dispar
DKKRDKDSKI

SEQ ID NO: 2416305 - protein, 10 aa, Entamoeba dispar
DKKRKRTKEM

SEQ ID NO: 2416306 - protein, 8 aa, Entamoeba dispar
DKKRRNKL

SEQ ID NO: 2416307 - protein, 25 aa, Entamoeba dispar
DKKRSEKNTPKYKKVEPQEKEQTEI

SEQ ID NO: 2416308 - protein, 6 aa, Entamoeba dispar
DKKRSY

SEQ ID NO: 2416309 - protein, 7 aa, Entamoeba dispar
DKKRYEC

SEQ ID NO: 2416310 - protein, 8 aa, Entamoeba dispar
DKKSDNPL

SEQ ID NO: 2416311 - protein, 8 aa, Entamoeba dispar
DKKSDREK

SEQ ID NO: 2416312 - protein, 8 aa, Entamoeba dispar
DKKSIADI

SEQ ID NO: 2416313 - protein, 10 aa, Entamoeba dispar
DKKSIPKEEI

SEQ ID NO: 2416314 - protein, 16 aa, Entamoeba dispar
DKKSNPARRERPEEAA

SEQ ID NO: 2416315 - protein, 16 aa, Entamoeba dispar
DKKSQEEEIEEKQQNI

SEQ ID NO: 2416316 - protein, 9 aa, Entamoeba dispar
DKKTFESTK

SEQ ID NO: 2416317 - protein, 9 aa, Entamoeba dispar
DKKTHNPVT

SEQ ID NO: 2416318 - protein, 9 aa, Entamoeba dispar
DKKTKISDI

SEQ ID NO: 2416319 - protein, 18 aa, Entamoeba dispar
DKKTKSNDNRKSIQNIPE

SEQ ID NO: 2416320 - protein, 6 aa, Entamoeba dispar
DKKTLI

SEQ ID NO: 2416321 - protein, 8 aa, Entamoeba dispar
DKKTTGIE

SEQ ID NO: 2416322 - protein, 4 aa, Entamoeba dispar
DKKV

SEQ ID NO: 2416323 - protein, 9 aa, Entamoeba dispar
DKKVVEETV

SEQ ID NO: 2416324 - protein, 6 aa, Entamoeba dispar
DKKYTK

SEQ ID NO: 2416325 - protein, 9 aa, Entamoeba dispar
DKLEEENPE

SEQ ID NO: 2416326 - protein, 17 aa, Entamoeba dispar
DKLETDQTGETKEDQQK

SEQ ID NO: 2416327 - protein, 10 aa, Entamoeba dispar
DKLKRNEIDE

SEQ ID NO: 2416328 - protein, 21 aa, Entamoeba dispar
DKLKSENEKLKTDAEVNSQTN

SEQ ID NO: 2416329 - protein, 5 aa, Entamoeba dispar
DKLKT

SEQ ID NO: 2416330 - protein, 15 aa, Entamoeba dispar
DKLLNSGKASHQPTK

SEQ ID NO: 2416331 - protein, 14 aa, Entamoeba dispar
DKLNGEDKKVPLSD

SEQ ID NO: 2416332 - protein, 14 aa, Entamoeba dispar
DKLNKKDKKVPLSD

SEQ ID NO: 2416333 - protein, 7 aa, Entamoeba dispar
DKLNNYG

SEQ ID NO: 2416334 - protein, 5 aa, Entamoeba dispar
DKLPD

SEQ ID NO: 2416335 - protein, 9 aa, Entamoeba dispar
DKLPERPQG

SEQ ID NO: 2416336 - protein, 7 aa, Entamoeba dispar
DKLPHSS

SEQ ID NO: 2416337 - protein, 15 aa, Entamoeba dispar
DKLPKNEEGKVSGKD

SEQ ID NO: 2416338 - protein, 5 aa, Entamoeba dispar
DKLPN

SEQ ID NO: 2416339 - protein, 14 aa, Entamoeba dispar
DKLPNDSSVNDEIK

SEQ ID NO: 2416340 - protein, 5 aa, Entamoeba dispar
DKLRE

SEQ ID NO: 2416341 - protein, 9 aa, Entamoeba dispar
DKLRKVSDG

SEQ ID NO: 2416342 - protein, 6 aa, Entamoeba dispar
DKLSHY

SEQ ID NO: 2416343 - protein, 16 aa, Entamoeba dispar
DKLSNSSVQKQIQTTT

SEQ ID NO: 2416344 - protein, 12 aa, Entamoeba dispar
DKLSQENNDKTR

SEQ ID NO: 2416345 - protein, 15 aa, Entamoeba dispar
DKLTNEETKEISEQI

SEQ ID NO: 2416346 - protein, 9 aa, Entamoeba dispar
DKMEEMKQG

SEQ ID NO: 2416347 - protein, 4 aa, Entamoeba dispar
DKMN

SEQ ID NO: 2416348 - protein, 6 aa, Entamoeba dispar
DKMSKA

SEQ ID NO: 2416349 - protein, 7 aa, Entamoeba dispar
DKNACKS

SEQ ID NO: 2416350 - protein, 6 aa, Entamoeba dispar
DKNCRP

SEQ ID NO: 2416351 - protein, 7 aa, Entamoeba dispar
DKNDNIP

SEQ ID NO: 2416352 - protein, 8 aa, Entamoeba dispar
DKNDRNQI

SEQ ID NO: 2416353 - protein, 5 aa, Entamoeba dispar
DKNDS

SEQ ID NO: 2416354 - protein, 4 aa, Entamoeba dispar
DKNE

SEQ ID NO: 2416355 - protein, 23 aa, Entamoeba dispar
DKNEEEQGTTNDNEDVIDDILQW

SEQ ID NO: 2416356 - protein, 13 aa, Entamoeba dispar
DKNEKGKELNEEN

SEQ ID NO: 2416357 - protein, 7 aa, Entamoeba dispar
DKNENIV

SEQ ID NO: 2416358 - protein, 8 aa, Entamoeba dispar
DKNEPENI

SEQ ID NO: 2416359 - protein, 14 aa, Entamoeba dispar
DKNEPENQNGNIYT

SEQ ID NO: 2416360 - protein, 9 aa, Entamoeba dispar
DKNEPQTAA

SEQ ID NO: 2416361 - protein, 8 aa, Entamoeba dispar
DKNESSLI

SEQ ID NO: 2416362 - protein, 5 aa, Entamoeba dispar
DKNEV

SEQ ID NO: 2416363 - protein, 6 aa, Entamoeba dispar
DKNEVC

SEQ ID NO: 2416364 - protein, 7 aa, Entamoeba dispar
DKNEYRE

SEQ ID NO: 2416365 - protein, 6 aa, Entamoeba dispar
DKNGDL

SEQ ID NO: 2416366 - protein, 5 aa, Entamoeba dispar
DKNGR

SEQ ID NO: 2416367 - protein, 8 aa, Entamoeba dispar
DKNGVSAI

SEQ ID NO: 2416368 - protein, 5 aa, Entamoeba dispar
DKNKG

SEQ ID NO: 2416369 - protein, 11 aa, Entamoeba dispar
DKNKGSSKTNF

SEQ ID NO: 2416370 - protein, 9 aa, Entamoeba dispar
DKNKKENFI

SEQ ID NO: 2416371 - protein, 33 aa, Entamoeba dispar
DKNKRKKKIKKDEWSSVQQKLKEGYNEYIGDEQ

SEQ ID NO: 2416372 - protein, 7 aa, Entamoeba dispar
DKNKTTH

SEQ ID NO: 2416373 - protein, 8 aa, Entamoeba dispar
DKNLNNGL

SEQ ID NO: 2416374 - protein, 6 aa, Entamoeba dispar
DKNLPR

SEQ ID NO: 2416375 - protein, 7 aa, Entamoeba dispar
DKNLSGT

SEQ ID NO: 2416376 - protein, 27 aa, Entamoeba dispar
DKNLSKEGSTSLTKSRRKKSDKVADAQ

SEQ ID NO: 2416377 - protein, 8 aa, Entamoeba dispar
DKNNERIE

SEQ ID NO: 2416378 - protein, 10 aa, Entamoeba dispar
DKNNGDDSKI

SEQ ID NO: 2416379 - protein, 9 aa, Entamoeba dispar
DKNNKSSLG

SEQ ID NO: 2416380 - protein, 10 aa, Entamoeba dispar
DKNNLGECET

SEQ ID NO: 2416381 - protein, 4 aa, Entamoeba dispar
DKNP

SEQ ID NO: 2416382 - protein, 10 aa, Entamoeba dispar
DKNQIGATNQ

SEQ ID NO: 2416383 - protein, 15 aa, Entamoeba dispar
DKNQKSIGEQGYDPS

SEQ ID NO: 2416384 - protein, 8 aa, Entamoeba dispar
DKNSGVDL

SEQ ID NO: 2416385 - protein, 8 aa, Entamoeba dispar
DKNSKATD

SEQ ID NO: 2416386 - protein, 6 aa, Entamoeba dispar
DKNTNS

SEQ ID NO: 2416387 - protein, 6 aa, Entamoeba dispar
DKNTSG

SEQ ID NO: 2416388 - protein, 5 aa, Entamoeba dispar
DKNVK

SEQ ID NO: 2416389 - protein, 8 aa, Entamoeba dispar
DKPASRYN

SEQ ID NO: 2416390 - protein, 13 aa, Entamoeba dispar
DKPDGTKNNNQNE

SEQ ID NO: 2416391 - protein, 5 aa, Entamoeba dispar
DKPEL

SEQ ID NO: 2416392 - protein, 20 aa, Entamoeba dispar
DKPFEYGEDISEKPERQMTD

SEQ ID NO: 2416393 - protein, 5 aa, Entamoeba dispar
DKPFN

SEQ ID NO: 2416394 - protein, 5 aa, Entamoeba dispar
DKPFT

SEQ ID NO: 2416395 - protein, 12 aa, Entamoeba dispar
DKPKERKLRKNM

SEQ ID NO: 2416396 - protein, 8 aa, Entamoeba dispar
DKPKPNNI

SEQ ID NO: 2416397 - protein, 5 aa, Entamoeba dispar
DKPLK

SEQ ID NO: 2416398 - protein, 8 aa, Entamoeba dispar
DKPLKERR

SEQ ID NO: 2416399 - protein, 4 aa, Entamoeba dispar
DKPN

SEQ ID NO: 2416400 - protein, 7 aa, Entamoeba dispar
DKPNEER

SEQ ID NO: 2416401 - protein, 6 aa, Entamoeba dispar
DKPNLT

SEQ ID NO: 2416402 - protein, 10 aa, Entamoeba dispar
DKPQPKKTPV

SEQ ID NO: 2416403 - protein, 6 aa, Entamoeba dispar
DKPSIN

SEQ ID NO: 2416404 - protein, 6 aa, Entamoeba dispar
DKPSLE

SEQ ID NO: 2416405 - protein, 6 aa, Entamoeba dispar
DKPTAK

SEQ ID NO: 2416406 - protein, 17 aa, Entamoeba dispar
DKPTIKEKKTPKIETGK

SEQ ID NO: 2416407 - protein, 7 aa, Entamoeba dispar
DKPTPVI

SEQ ID NO: 2416408 - protein, 7 aa, Entamoeba dispar
DKPTVLS

SEQ ID NO: 2416409 - protein, 5 aa, Entamoeba dispar
DKPVE

SEQ ID NO: 2416410 - protein, 9 aa, Entamoeba dispar
DKQDEYKLT

SEQ ID NO: 2416411 - protein, 6 aa, Entamoeba dispar
DKQDVD

SEQ ID NO: 2416412 - protein, 10 aa, Entamoeba dispar
DKQEKKTQTH

SEQ ID NO: 2416413 - protein, 6 aa, Entamoeba dispar
DKQENK

SEQ ID NO: 2416414 - protein, 11 aa, Entamoeba dispar
DKQESQEDQEL

SEQ ID NO: 2416415 - protein, 8 aa, Entamoeba dispar
DKQEYSSQ

SEQ ID NO: 2416416 - protein, 5 aa, Entamoeba dispar
DKQFH

SEQ ID NO: 2416417 - protein, 4 aa, Entamoeba dispar
DKQG

SEQ ID NO: 2416418 - protein, 9 aa, Entamoeba dispar
DKQGMDTHG

SEQ ID NO: 2416419 - protein, 6 aa, Entamoeba dispar
DKQHEQ

SEQ ID NO: 2416420 - protein, 4 aa, Entamoeba dispar
DKQI

SEQ ID NO: 2416421 - protein, 9 aa, Entamoeba dispar
DKQISDSHN

SEQ ID NO: 2416422 - protein, 11 aa, Entamoeba dispar
DKQKKTTSPII

SEQ ID NO: 2416423 - protein, 5 aa, Entamoeba dispar
DKQKR

SEQ ID NO: 2416424 - protein, 6 aa, Entamoeba dispar
DKQNSF

SEQ ID NO: 2416425 - protein, 5 aa, Entamoeba dispar
DKQNT

SEQ ID NO: 2416426 - protein, 8 aa, Entamoeba dispar
DKQQTSYE

SEQ ID NO: 2416427 - protein, 7 aa, Entamoeba dispar
DKQREAT

SEQ ID NO: 2416428 - protein, 7 aa, Entamoeba dispar
DKQRKVP

SEQ ID NO: 2416429 - protein, 11 aa, Entamoeba dispar
DKQSKRGHSKV

SEQ ID NO: 2416430 - protein, 23 aa, Entamoeba dispar
DKQSNTTEEPKSSSFDIKPSPSF

SEQ ID NO: 2416431 - protein, 7 aa, Entamoeba dispar
DKQSTSL

SEQ ID NO: 2416432 - protein, 7 aa, Entamoeba dispar
DKQTDEQ

SEQ ID NO: 2416433 - protein, 7 aa, Entamoeba dispar
DKQTEYD

SEQ ID NO: 2416434 - protein, 6 aa, Entamoeba dispar
DKQTFN

SEQ ID NO: 2416435 - protein, 14 aa, Entamoeba dispar
DKQTGQISKTNGAV

SEQ ID NO: 2416436 - protein, 5 aa, Entamoeba dispar
DKQTI

SEQ ID NO: 2416437 - protein, 8 aa, Entamoeba dispar
DKQTQQTI

SEQ ID NO: 2416438 - protein, 4 aa, Entamoeba dispar
DKQV

SEQ ID NO: 2416439 - protein, 7 aa, Entamoeba dispar
DKREIGK

SEQ ID NO: 2416440 - protein, 7 aa, Entamoeba dispar
DKRETEI

SEQ ID NO: 2416441 - protein, 8 aa, Entamoeba dispar
DKRFPPVS

SEQ ID NO: 2416442 - protein, 4 aa, Entamoeba dispar
DKRG

SEQ ID NO: 2416443 - protein, 6 aa, Entamoeba dispar
DKRGVT

SEQ ID NO: 2416444 - protein, 9 aa, Entamoeba dispar
DKRIKRSKS

SEQ ID NO: 2416445 - protein, 7 aa, Entamoeba dispar
DKRIQGT

SEQ ID NO: 2416446 - protein, 40 aa, Entamoeba dispar
DKRKKPIKTSKMAKTLKPINSSEHTQTSEIPYEESRLAKR

SEQ ID NO: 2416447 - protein, 9 aa, Entamoeba dispar
DKRKQSQVS

SEQ ID NO: 2416448 - protein, 15 aa, Entamoeba dispar
DKRKSSGDDELFDRK

SEQ ID NO: 2416449 - protein, 11 aa, Entamoeba dispar
DKRKVPEKRNQ

SEQ ID NO: 2416450 - protein, 10 aa, Entamoeba dispar
DKRLGDDDNL

SEQ ID NO: 2416451 - protein, 7 aa, Entamoeba dispar
DKRNALD

SEQ ID NO: 2416452 - protein, 7 aa, Entamoeba dispar
DKRNGYI

SEQ ID NO: 2416453 - protein, 18 aa, Entamoeba dispar
DKRNPNKKFQHSSAPELE

SEQ ID NO: 2416454 - protein, 7 aa, Entamoeba dispar
DKRNQKY

SEQ ID NO: 2416455 - protein, 4 aa, Entamoeba dispar
DKRR

SEQ ID NO: 2416456 - protein, 8 aa, Entamoeba dispar
DKRRFQED

SEQ ID NO: 2416457 - protein, 15 aa, Entamoeba dispar
DKRSDEVVRNTPTFE

SEQ ID NO: 2416458 - protein, 5 aa, Entamoeba dispar
DKRSG

SEQ ID NO: 2416459 - protein, 9 aa, Entamoeba dispar
DKRSKKEEV

SEQ ID NO: 2416460 - protein, 8 aa, Entamoeba dispar
DKRTQGKA

SEQ ID NO: 2416461 - protein, 9 aa, Entamoeba dispar
DKRTSELKK

SEQ ID NO: 2416462 - protein, 8 aa, Entamoeba dispar
DKSCRVDQ

SEQ ID NO: 2416463 - protein, 6 aa, Entamoeba dispar
DKSDIE

SEQ ID NO: 2416464 - protein, 11 aa, Entamoeba dispar
DKSEKCKKDMK

SEQ ID NO: 2416465 - protein, 26 aa, Entamoeba dispar
DKSELEKSKSSNSELKISPETETTVI

SEQ ID NO: 2416466 - protein, 5 aa, Entamoeba dispar
DKSFE

SEQ ID NO: 2416467 - protein, 7 aa, Entamoeba dispar
DKSGDEV

SEQ ID NO: 2416468 - protein, 8 aa, Entamoeba dispar
DKSGTHAG

SEQ ID NO: 2416469 - protein, 5 aa, Entamoeba dispar
DKSGY

SEQ ID NO: 2416470 - protein, 4 aa, Entamoeba dispar
DKSI

SEQ ID NO: 2416471 - protein, 14 aa, Entamoeba dispar
DKSIDNLKKSTVKS

SEQ ID NO: 2416472 - protein, 7 aa, Entamoeba dispar
DKSIEKI

SEQ ID NO: 2416473 - protein, 4 aa, Entamoeba dispar
DKSK

SEQ ID NO: 2416474 - protein, 20 aa, Entamoeba dispar
DKSKKGSKPARNGIGKSKVI

SEQ ID NO: 2416475 - protein, 11 aa, Entamoeba dispar
DKSKKKNYKKC

SEQ ID NO: 2416476 - protein, 10 aa, Entamoeba dispar
DKSKKQRKSV

SEQ ID NO: 2416477 - protein, 10 aa, Entamoeba dispar
DKSKYEGLDP

SEQ ID NO: 2416478 - protein, 4 aa, Entamoeba dispar
DKSL

SEQ ID NO: 2416479 - protein, 14 aa, Entamoeba dispar
DKSNPDDTSKSKFM

SEQ ID NO: 2416480 - protein, 30 aa, Entamoeba dispar
DKSNQGSNGSSKPNELTNLTDKPKDNGKGC

SEQ ID NO: 2416481 - protein, 7 aa, Entamoeba dispar
DKSNTDT

SEQ ID NO: 2416482 - protein, 10 aa, Entamoeba dispar
DKSPCSSQQQ

SEQ ID NO: 2416483 - protein, 8 aa, Entamoeba dispar
DKSPDEVK

SEQ ID NO: 2416484 - protein, 5 aa, Entamoeba dispar
DKSPI

SEQ ID NO: 2416485 - protein, 19 aa, Entamoeba dispar
DKSPIDDSNNVELPPPGTS

SEQ ID NO: 2416486 - protein, 9 aa, Entamoeba dispar
DKSPRLQKA

SEQ ID NO: 2416487 - protein, 17 aa, Entamoeba dispar
DKSPSELAKKYKAKLED

SEQ ID NO: 2416488 - protein, 9 aa, Entamoeba dispar
DKSQEGAQF

SEQ ID NO: 2416489 - protein, 13 aa, Entamoeba dispar
DKSQIEEQAQKTI

SEQ ID NO: 2416490 - protein, 8 aa, Entamoeba dispar
DKSQNWSE

SEQ ID NO: 2416491 - protein, 6 aa, Entamoeba dispar
DKSSIK

SEQ ID NO: 2416492 - protein, 7 aa, Entamoeba dispar
DKSSNKR

SEQ ID NO: 2416493 - protein, 14 aa, Entamoeba dispar
DKSVSQVSSDSICT

SEQ ID NO: 2416494 - protein, 5 aa, Entamoeba dispar
DKTAP

SEQ ID NO: 2416495 - protein, 5 aa, Entamoeba dispar
DKTDK

SEQ ID NO: 2416496 - protein, 5 aa, Entamoeba dispar
DKTDN

SEQ ID NO: 2416497 - protein, 11 aa, Entamoeba dispar
DKTDQDDNEYT

SEQ ID NO: 2416498 - protein, 11 aa, Entamoeba dispar
DKTEDELDDEE

SEQ ID NO: 2416499 - protein, 11 aa, Entamoeba dispar
DKTENKPLKRP

SEQ ID NO: 2416500 - protein, 20 aa, Entamoeba dispar
DKTETDVYKRQSSFGVNGED

SEQ ID NO: 2416501 - protein, 7 aa, Entamoeba dispar
DKTFEDS

SEQ ID NO: 2416502 - protein, 7 aa, Entamoeba dispar
DKTFKDG

SEQ ID NO: 2416503 - protein, 6 aa, Entamoeba dispar
DKTFKS

SEQ ID NO: 2416504 - protein, 7 aa, Entamoeba dispar
DKTFNDG

SEQ ID NO: 2416505 - protein, 11 aa, Entamoeba dispar
DKTGDKVAVGE

SEQ ID NO: 2416506 - protein, 9 aa, Entamoeba dispar
DKTGKEQIP

SEQ ID NO: 2416507 - protein, 5 aa, Entamoeba dispar
DKTGP

SEQ ID NO: 2416508 - protein, 8 aa, Entamoeba dispar
DKTIEEYD

SEQ ID NO: 2416509 - protein, 7 aa, Entamoeba dispar
DKTIRDT

SEQ ID NO: 2416510 - protein, 20 aa, Entamoeba dispar
DKTITTQKAKPVMNEEERTA

SEQ ID NO: 2416511 - protein, 8 aa, Entamoeba dispar
DKTKKSAI

SEQ ID NO: 2416512 - protein, 9 aa, Entamoeba dispar
DKTLPDYTI

SEQ ID NO: 2416513 - protein, 4 aa, Entamoeba dispar
DKTN

SEQ ID NO: 2416514 - protein, 6 aa, Entamoeba dispar
DKTNEF

SEQ ID NO: 2416515 - protein, 9 aa, Entamoeba dispar
DKTNLSGNY

SEQ ID NO: 2416516 - protein, 9 aa, Entamoeba dispar
DKTNTGKDF

SEQ ID NO: 2416517 - protein, 8 aa, Entamoeba dispar
DKTPARRV

SEQ ID NO: 2416518 - protein, 14 aa, Entamoeba dispar
DKTPATIQLSSPTE

SEQ ID NO: 2416519 - protein, 9 aa, Entamoeba dispar
DKTPERSPI

SEQ ID NO: 2416520 - protein, 5 aa, Entamoeba dispar
DKTPL

SEQ ID NO: 2416521 - protein, 10 aa, Entamoeba dispar
DKTPQSTYEA

SEQ ID NO: 2416522 - protein, 7 aa, Entamoeba dispar
DKTREPL

SEQ ID NO: 2416523 - protein, 7 aa, Entamoeba dispar
DKTRPET

SEQ ID NO: 2416524 - protein, 9 aa, Entamoeba dispar
DKTRTMYNN

SEQ ID NO: 2416525 - protein, 4 aa, Entamoeba dispar
DKTS

SEQ ID NO: 2416526 - protein, 9 aa, Entamoeba dispar
DKTSKKTKI

SEQ ID NO: 2416527 - protein, 8 aa, Entamoeba dispar
DKTSQDLQ

SEQ ID NO: 2416528 - protein, 4 aa, Entamoeba dispar
DKTT

SEQ ID NO: 2416529 - protein, 8 aa, Entamoeba dispar
DKTTEKTR

SEQ ID NO: 2416530 - protein, 8 aa, Entamoeba dispar
DKTTGRMK

SEQ ID NO: 2416531 - protein, 7 aa, Entamoeba dispar
DKTTHET

SEQ ID NO: 2416532 - protein, 7 aa, Entamoeba dispar
DKTTNKY

SEQ ID NO: 2416533 - protein, 13 aa, Entamoeba dispar
DKTVTNKGTNSEP

SEQ ID NO: 2416534 - protein, 21 aa, Entamoeba dispar
DKTYAEMSEAEKNKCSHRGVG

SEQ ID NO: 2416535 - protein, 86 aa, Entamoeba dispar
DKVANIEEELEEEEDKKKPIKKQIKKEEKEKKLAKKDDKKPLKKETTKKEIKKSSSKTEKEPKKPKGTKIEKKITTPKKEAKTKGK

SEQ ID NO: 2416536 - protein, 7 aa, Entamoeba dispar
DKVEPLN

SEQ ID NO: 2416537 - protein, 7 aa, Entamoeba dispar
DKVFKDG

SEQ ID NO: 2416538 - protein, 7 aa, Entamoeba dispar
DKVFNDG

SEQ ID NO: 2416539 - protein, 7 aa, Entamoeba dispar
DKVGKKV

SEQ ID NO: 2416540 - protein, 4 aa, Entamoeba dispar
DKVI

SEQ ID NO: 2416541 - protein, 18 aa, Entamoeba dispar
DKVKETSISQPKKIKKSK

SEQ ID NO: 2416542 - protein, 4 aa, Entamoeba dispar
DKVL

SEQ ID NO: 2416543 - protein, 6 aa, Entamoeba dispar
DKVNDL

SEQ ID NO: 2416544 - protein, 8 aa, Entamoeba dispar
DKVNNNQN

SEQ ID NO: 2416545 - protein, 9 aa, Entamoeba dispar
DKVNNNQNF

SEQ ID NO: 2416546 - protein, 4 aa, Entamoeba dispar
DKVQ

SEQ ID NO: 2416547 - protein, 6 aa, Entamoeba dispar
DKVTQD

SEQ ID NO: 2416548 - protein, 8 aa, Entamoeba dispar
DKVTSSNE

SEQ ID NO: 2416549 - protein, 9 aa, Entamoeba dispar
DKVTSSNEY

SEQ ID NO: 2416550 - protein, 12 aa, Entamoeba dispar
DKVTTTKSKTDF

SEQ ID NO: 2416551 - protein, 6 aa, Entamoeba dispar
DKYEDN

SEQ ID NO: 2416552 - protein, 7 aa, Entamoeba dispar
DKYEQGL

SEQ ID NO: 2416553 - protein, 4 aa, Entamoeba dispar
DKYG

SEQ ID NO: 2416554 - protein, 6 aa, Entamoeba dispar
DKYGDL

SEQ ID NO: 2416555 - protein, 5 aa, Entamoeba dispar
DKYGF

SEQ ID NO: 2416556 - protein, 10 aa, Entamoeba dispar
DKYGNTIPSE

SEQ ID NO: 2416557 - protein, 18 aa, Entamoeba dispar
DKYLRNDKTCQSNKELNG

SEQ ID NO: 2416558 - protein, 7 aa, Entamoeba dispar
DKYPDTY

SEQ ID NO: 2416559 - protein, 6 aa, Entamoeba dispar
DKYPEF

SEQ ID NO: 2416560 - protein, 8 aa, Entamoeba dispar
DKYPKPQK

SEQ ID NO: 2416561 - protein, 6 aa, Entamoeba dispar
DKYPNG

SEQ ID NO: 2416562 - protein, 16 aa, Entamoeba dispar
DKYQLKTKTVDERTEW

SEQ ID NO: 2416563 - protein, 14 aa, Entamoeba dispar
DKYQTKDDSPYEPC

SEQ ID NO: 2416564 - protein, 13 aa, Entamoeba dispar
DKYTIGRSGDNDV

SEQ ID NO: 2416565 - protein, 11 aa, Entamoeba dispar
DKYTKDRESYR

SEQ ID NO: 2416566 - protein, 19 aa, Entamoeba dispar
DLAEERKLAQDKPEDEPVK

SEQ ID NO: 2416567 - protein, 19 aa, Entamoeba dispar
DLAQDFDTTPVKAAADSYK

SEQ ID NO: 2416568 - protein, 22 aa, Entamoeba dispar
DLASKREVSIEDAENYAKSKNM

SEQ ID NO: 2416569 - protein, 13 aa, Entamoeba dispar
DLDAKKSSKKDKK

SEQ ID NO: 2416570 - protein, 13 aa, Entamoeba dispar
DLDDDDDDDDIEL

SEQ ID NO: 2416571 - protein, 9 aa, Entamoeba dispar
DLDDGLRKE

SEQ ID NO: 2416572 - protein, 17 aa, Entamoeba dispar
DLDEQNSILKRRVSNMK

SEQ ID NO: 2416573 - protein, 15 aa, Entamoeba dispar
DLDESFHQQKAPNVD

SEQ ID NO: 2416574 - protein, 7 aa, Entamoeba dispar
DLDGKTE

SEQ ID NO: 2416575 - protein, 18 aa, Entamoeba dispar
DLDKKTSVTYTLDLKEYE

SEQ ID NO: 2416576 - protein, 4 aa, Entamoeba dispar
DLDP

SEQ ID NO: 2416577 - protein, 10 aa, Entamoeba dispar
DLDTFGKNIP

SEQ ID NO: 2416578 - protein, 10 aa, Entamoeba dispar
DLDYQKGSFE

SEQ ID NO: 2416579 - protein, 12 aa, Entamoeba dispar
DLEAPQTNPKYP

SEQ ID NO: 2416580 - protein, 8 aa, Entamoeba dispar
DLEAQRKI

SEQ ID NO: 2416581 - protein, 18 aa, Entamoeba dispar
DLEDERAVTVEQGQELAN

SEQ ID NO: 2416582 - protein, 10 aa, Entamoeba dispar
DLEDYNEKTS

SEQ ID NO: 2416583 - protein, 4 aa, Entamoeba dispar
DLEE

SEQ ID NO: 2416584 - protein, 8 aa, Entamoeba dispar
DLEEKYEE

SEQ ID NO: 2416585 - protein, 20 aa, Entamoeba dispar
DLEESIKQTEKEEKEMYKNK

SEQ ID NO: 2416586 - protein, 6 aa, Entamoeba dispar
DLEETM

SEQ ID NO: 2416587 - protein, 5 aa, Entamoeba dispar
DLEEW

SEQ ID NO: 2416588 - protein, 6 aa, Entamoeba dispar
DLEFKS

SEQ ID NO: 2416589 - protein, 12 aa, Entamoeba dispar
DLEGEYATNCKK

SEQ ID NO: 2416590 - protein, 12 aa, Entamoeba dispar
DLEKNDSSSIKD

SEQ ID NO: 2416591 - protein, 7 aa, Entamoeba dispar
DLENAKK

SEQ ID NO: 2416592 - protein, 22 aa, Entamoeba dispar
DLENDARAVTTAEGQQFASEGG

SEQ ID NO: 2416593 - protein, 18 aa, Entamoeba dispar
DLENERQVETAEAKKLAD

SEQ ID NO: 2416594 - protein, 5 aa, Entamoeba dispar
DLENN

SEQ ID NO: 2416595 - protein, 13 aa, Entamoeba dispar
DLENQHKTGSDEQ

SEQ ID NO: 2416596 - protein, 8 aa, Entamoeba dispar
DLENSEYK

SEQ ID NO: 2416597 - protein, 6 aa, Entamoeba dispar
DLENTR

SEQ ID NO: 2416598 - protein, 5 aa, Entamoeba dispar
DLEPK

SEQ ID NO: 2416599 - protein, 8 aa, Entamoeba dispar
DLESDNQN

SEQ ID NO: 2416600 - protein, 18 aa, Entamoeba dispar
DLESERQVQANEAKNLAE

SEQ ID NO: 2416601 - protein, 21 aa, Entamoeba dispar
DLESQRAVSQDDGKALADKYG

SEQ ID NO: 2416602 - protein, 5 aa, Entamoeba dispar
DLETK

SEQ ID NO: 2416603 - protein, 7 aa, Entamoeba dispar
DLGAPQG

SEQ ID NO: 2416604 - protein, 20 aa, Entamoeba dispar
DLGEEKRKIAEESVKDKEDL

SEQ ID NO: 2416605 - protein, 6 aa, Entamoeba dispar
DLGENS

SEQ ID NO: 2416606 - protein, 6 aa, Entamoeba dispar
DLGESG

SEQ ID NO: 2416607 - protein, 8 aa, Entamoeba dispar
DLGGQSKI

SEQ ID NO: 2416608 - protein, 9 aa, Entamoeba dispar
DLGGTSDGY

SEQ ID NO: 2416609 - protein, 7 aa, Entamoeba dispar
DLGKEAE

SEQ ID NO: 2416610 - protein, 11 aa, Entamoeba dispar
DLGLPTSDEID

SEQ ID NO: 2416611 - protein, 7 aa, Entamoeba dispar
DLGPYQS

SEQ ID NO: 2416612 - protein, 7 aa, Entamoeba dispar
DLGRGTQ

SEQ ID NO: 2416613 - protein, 7 aa, Entamoeba dispar
DLGRTIK

SEQ ID NO: 2416614 - protein, 4 aa, Entamoeba dispar
DLGV

SEQ ID NO: 2416615 - protein, 20 aa, Entamoeba dispar
DLHGKEKDIEKTIKKQKNEI

SEQ ID NO: 2416616 - protein, 7 aa, Entamoeba dispar
DLIEETE

SEQ ID NO: 2416617 - protein, 25 aa, Entamoeba dispar
DLIKPKEDLIKPKEDLIKPKEELTE

SEQ ID NO: 2416618 - protein, 12 aa, Entamoeba dispar
DLKDDKVTMNKI

SEQ ID NO: 2416619 - protein, 6 aa, Entamoeba dispar
DLKDER

SEQ ID NO: 2416620 - protein, 22 aa, Entamoeba dispar
DLKEAEEKLKTDACLIKKVEFD

SEQ ID NO: 2416621 - protein, 8 aa, Entamoeba dispar
DLKEDTKY

SEQ ID NO: 2416622 - protein, 7 aa, Entamoeba dispar
DLKEGEV

SEQ ID NO: 2416623 - protein, 5 aa, Entamoeba dispar
DLKEK

SEQ ID NO: 2416624 - protein, 5 aa, Entamoeba dispar
DLKEN

SEQ ID NO: 2416625 - protein, 6 aa, Entamoeba dispar
DLKENK

SEQ ID NO: 2416626 - protein, 7 aa, Entamoeba dispar
DLKETDV

SEQ ID NO: 2416627 - protein, 6 aa, Entamoeba dispar
DLKEYE

SEQ ID NO: 2416628 - protein, 10 aa, Entamoeba dispar
DLKKSKSENL

SEQ ID NO: 2416629 - protein, 7 aa, Entamoeba dispar
DLKNKRI

SEQ ID NO: 2416630 - protein, 5 aa, Entamoeba dispar
DLKNP

SEQ ID NO: 2416631 - protein, 19 aa, Entamoeba dispar
DLKQEDKPNEIKREEKKPI

SEQ ID NO: 2416632 - protein, 23 aa, Entamoeba dispar
DLKQQKNYQVNGQRSCNSNDPNV

SEQ ID NO: 2416633 - protein, 4 aa, Entamoeba dispar
DLKR

SEQ ID NO: 2416634 - protein, 9 aa, Entamoeba dispar
DLKRNQQQF

SEQ ID NO: 2416635 - protein, 6 aa, Entamoeba dispar
DLKRSD

SEQ ID NO: 2416636 - protein, 14 aa, Entamoeba dispar
DLKRTKSVNALNED

SEQ ID NO: 2416637 - protein, 6 aa, Entamoeba dispar
DLKSDF

SEQ ID NO: 2416638 - protein, 7 aa, Entamoeba dispar
DLKSSVD

SEQ ID NO: 2416639 - protein, 18 aa, Entamoeba dispar
DLKTKDKEVEKKHMRSRE

SEQ ID NO: 2416640 - protein, 7 aa, Entamoeba dispar
DLKTSQV

SEQ ID NO: 2416641 - protein, 25 aa, Entamoeba dispar
DLLKSDEEKDAAAAKLKEIANSNGF

SEQ ID NO: 2416642 - protein, 4 aa, Entamoeba dispar
DLLT

SEQ ID NO: 2416643 - protein, 17 aa, Entamoeba dispar
DLNDKPLGSKFKTPAKR

SEQ ID NO: 2416644 - protein, 10 aa, Entamoeba dispar
DLNDSQSELK

SEQ ID NO: 2416645 - protein, 4 aa, Entamoeba dispar
DLNE

SEQ ID NO: 2416646 - protein, 11 aa, Entamoeba dispar
DLNEGARDTLT

SEQ ID NO: 2416647 - protein, 8 aa, Entamoeba dispar
DLNGQTEV

SEQ ID NO: 2416648 - protein, 4 aa, Entamoeba dispar
DLNI

SEQ ID NO: 2416649 - protein, 6 aa, Entamoeba dispar
DLNKEE

SEQ ID NO: 2416650 - protein, 7 aa, Entamoeba dispar
DLNKPWG

SEQ ID NO: 2416651 - protein, 15 aa, Entamoeba dispar
DLNNTDEKIEGLKNE

SEQ ID NO: 2416652 - protein, 6 aa, Entamoeba dispar
DLNPTA

SEQ ID NO: 2416653 - protein, 6 aa, Entamoeba dispar
DLNPTN

SEQ ID NO: 2416654 - protein, 8 aa, Entamoeba dispar
DLNPTPAI

SEQ ID NO: 2416655 - protein, 9 aa, Entamoeba dispar
DLNQKTISQ

SEQ ID NO: 2416656 - protein, 13 aa, Entamoeba dispar
DLNTSFVSQNNSH

SEQ ID NO: 2416657 - protein, 10 aa, Entamoeba dispar
DLNVSEQVNK

SEQ ID NO: 2416658 - protein, 8 aa, Entamoeba dispar
DLPASGNQ

SEQ ID NO: 2416659 - protein, 6 aa, Entamoeba dispar
DLPDER

SEQ ID NO: 2416660 - protein, 10 aa, Entamoeba dispar
DLPEKEQSQI

SEQ ID NO: 2416661 - protein, 6 aa, Entamoeba dispar
DLPKTV

SEQ ID NO: 2416662 - protein, 5 aa, Entamoeba dispar
DLPND

SEQ ID NO: 2416663 - protein, 6 aa, Entamoeba dispar
DLPPET

SEQ ID NO: 2416664 - protein, 18 aa, Entamoeba dispar
DLPPQDDDESGIDSGIDD

SEQ ID NO: 2416665 - protein, 7 aa, Entamoeba dispar
DLPQGQW

SEQ ID NO: 2416666 - protein, 20 aa, Entamoeba dispar
DLPQPPQKKIEISRDDFEKS

SEQ ID NO: 2416667 - protein, 11 aa, Entamoeba dispar
DLPRAKSVSEI

SEQ ID NO: 2416668 - protein, 5 aa, Entamoeba dispar
DLPRF

SEQ ID NO: 2416669 - protein, 6 aa, Entamoeba dispar
DLPSED

SEQ ID NO: 2416670 - protein, 21 aa, Entamoeba dispar
DLPSKVTNEQAEAAAKEKGYQ

SEQ ID NO: 2416671 - protein, 8 aa, Entamoeba dispar
DLPSNSPK

SEQ ID NO: 2416672 - protein, 6 aa, Entamoeba dispar
DLPTED

SEQ ID NO: 2416673 - protein, 9 aa, Entamoeba dispar
DLPTSISEI

SEQ ID NO: 2416674 - protein, 8 aa, Entamoeba dispar
DLQDENNP

SEQ ID NO: 2416675 - protein, 5 aa, Entamoeba dispar
DLQFG

SEQ ID NO: 2416676 - protein, 8 aa, Entamoeba dispar
DLQGPDLK

SEQ ID NO: 2416677 - protein, 19 aa, Entamoeba dispar
DLQNAANKGLTKKSRSETF

SEQ ID NO: 2416678 - protein, 19 aa, Entamoeba dispar
DLQNDEEIDELKDSNIEYT

SEQ ID NO: 2416679 - protein, 5 aa, Entamoeba dispar
DLQSD

SEQ ID NO: 2416680 - protein, 7 aa, Entamoeba dispar
DLRDNDS

SEQ ID NO: 2416681 - protein, 8 aa, Entamoeba dispar
DLRDSVEE

SEQ ID NO: 2416682 - protein, 12 aa, Entamoeba dispar
DLRGTSITQPPA

SEQ ID NO: 2416683 - protein, 8 aa, Entamoeba dispar
DLRKERNA

SEQ ID NO: 2416684 - protein, 6 aa, Entamoeba dispar
DLRQKE

SEQ ID NO: 2416685 - protein, 9 aa, Entamoeba dispar
DLRQQTQEM

SEQ ID NO: 2416686 - protein, 4 aa, Entamoeba dispar
DLRR

SEQ ID NO: 2416687 - protein, 5 aa, Entamoeba dispar
DLSAS

SEQ ID NO: 2416688 - protein, 8 aa, Entamoeba dispar
DLSDDQKE

SEQ ID NO: 2416689 - protein, 5 aa, Entamoeba dispar
DLSDG

SEQ ID NO: 2416690 - protein, 14 aa, Entamoeba dispar
DLSDNGLDDSNTSI

SEQ ID NO: 2416691 - protein, 11 aa, Entamoeba dispar
DLSDPHGTHRK

SEQ ID NO: 2416692 - protein, 10 aa, Entamoeba dispar
DLSDSTDDVV

SEQ ID NO: 2416693 - protein, 9 aa, Entamoeba dispar
DLSETEPRP

SEQ ID NO: 2416694 - protein, 26 aa, Entamoeba dispar
DLSGESESSSETLDKPEVSPRYQQTH

SEQ ID NO: 2416695 - protein, 9 aa, Entamoeba dispar
DLSKVDAEM

SEQ ID NO: 2416696 - protein, 8 aa, Entamoeba dispar
DLSLGGNN

SEQ ID NO: 2416697 - protein, 31 aa, Entamoeba dispar
DLSLTNKVNKKKNEKVNKPVRQPVDENGQII

SEQ ID NO: 2416698 - protein, 16 aa, Entamoeba dispar
DLSPPQYSQLARSFAG

SEQ ID NO: 2416699 - protein, 8 aa, Entamoeba dispar
DLSPSSSN

SEQ ID NO: 2416700 - protein, 6 aa, Entamoeba dispar
DLSPST

SEQ ID NO: 2416701 - protein, 6 aa, Entamoeba dispar
DLSQAQ

SEQ ID NO: 2416702 - protein, 7 aa, Entamoeba dispar
DLSQQKK

SEQ ID NO: 2416703 - protein, 9 aa, Entamoeba dispar
DLSSQESVP

SEQ ID NO: 2416704 - protein, 11 aa, Entamoeba dispar
DLSSQMNRTQL

SEQ ID NO: 2416705 - protein, 9 aa, Entamoeba dispar
DLSSSDDVT

SEQ ID NO: 2416706 - protein, 7 aa, Entamoeba dispar
DLSTSDV

SEQ ID NO: 2416707 - protein, 6 aa, Entamoeba dispar
DLTETD

SEQ ID NO: 2416708 - protein, 7 aa, Entamoeba dispar
DLTGEEV

SEQ ID NO: 2416709 - protein, 7 aa, Entamoeba dispar
DLTNNNT

SEQ ID NO: 2416710 - protein, 6 aa, Entamoeba dispar
DLTNTN

SEQ ID NO: 2416711 - protein, 5 aa, Entamoeba dispar
DLTPT

SEQ ID NO: 2416712 - protein, 5 aa, Entamoeba dispar
DLTSK

SEQ ID NO: 2416713 - protein, 8 aa, Entamoeba dispar
DLTTDTED

SEQ ID NO: 2416714 - protein, 5 aa, Entamoeba dispar
DLTTS

SEQ ID NO: 2416715 - protein, 6 aa, Entamoeba dispar
DLVPSN

SEQ ID NO: 2416716 - protein, 20 aa, Entamoeba dispar
DLYDPSGILTGGSKPKSSGF

SEQ ID NO: 2416717 - protein, 8 aa, Entamoeba dispar
DLYGTDEE

SEQ ID NO: 2416718 - protein, 4 aa, Entamoeba dispar
DMDE

SEQ ID NO: 2416719 - protein, 9 aa, Entamoeba dispar
DMDETDGTK

SEQ ID NO: 2416720 - protein, 7 aa, Entamoeba dispar
DMDKEEL

SEQ ID NO: 2416721 - protein, 6 aa, Entamoeba dispar
DMDPQD

SEQ ID NO: 2416722 - protein, 14 aa, Entamoeba dispar
DMEDGGIADRPGDC

SEQ ID NO: 2416723 - protein, 89 aa, Entamoeba dispar
DMEDSDDEEEEEEPPKKEALKKEEKKPQPPKQEKKSQPKKEVKQQPKKEIKQQPKKEIKQQPKKESKPQPPKKQFQENENKKKNKKHGK

SEQ ID NO: 2416724 - protein, 12 aa, Entamoeba dispar
DMEEDELENEMG

SEQ ID NO: 2416725 - protein, 10 aa, Entamoeba dispar
DMEKDEQSAY

SEQ ID NO: 2416726 - protein, 5 aa, Entamoeba dispar
DMEKP

SEQ ID NO: 2416727 - protein, 8 aa, Entamoeba dispar
DMESQQKV

SEQ ID NO: 2416728 - protein, 11 aa, Entamoeba dispar
DMGATPPRQTD

SEQ ID NO: 2416729 - protein, 10 aa, Entamoeba dispar
DMGDDTIDGL

SEQ ID NO: 2416730 - protein, 20 aa, Entamoeba dispar
DMGNSSKLQKHVSQVHSREI

SEQ ID NO: 2416731 - protein, 15 aa, Entamoeba dispar
DMGTYSTERCDYPDF

SEQ ID NO: 2416732 - protein, 14 aa, Entamoeba dispar
DMKDAIRKYRSKKN

SEQ ID NO: 2416733 - protein, 6 aa, Entamoeba dispar
DMKGKE

SEQ ID NO: 2416734 - protein, 6 aa, Entamoeba dispar
DMKRKE

SEQ ID NO: 2416735 - protein, 30 aa, Entamoeba dispar
DMNNDKTKLSNNKVDAAKSAQKISEEKEAL

SEQ ID NO: 2416736 - protein, 15 aa, Entamoeba dispar
DMPESQTSEETNPIE

SEQ ID NO: 2416737 - protein, 10 aa, Entamoeba dispar
DMPFTESGMT

SEQ ID NO: 2416738 - protein, 14 aa, Entamoeba dispar
DMPKQVSTEEGQSF

SEQ ID NO: 2416739 - protein, 6 aa, Entamoeba dispar
DMPQSS

SEQ ID NO: 2416740 - protein, 5 aa, Entamoeba dispar
DMRNS

SEQ ID NO: 2416741 - protein, 13 aa, Entamoeba dispar
DMTESNLKSSRQL

SEQ ID NO: 2416742 - protein, 6 aa, Entamoeba dispar
DMTNEI

SEQ ID NO: 2416743 - protein, 5 aa, Entamoeba dispar
DMTPG

SEQ ID NO: 2416744 - protein, 5 aa, Entamoeba dispar
DMTPS

SEQ ID NO: 2416745 - protein, 8 aa, Entamoeba dispar
DMTSSDRD

SEQ ID NO: 2416746 - protein, 10 aa, Entamoeba dispar
DNAADENEVH

SEQ ID NO: 2416747 - protein, 19 aa, Entamoeba dispar
DNADDNENDDLKDSDSEGD

SEQ ID NO: 2416748 - protein, 7 aa, Entamoeba dispar
DNAGKTT

SEQ ID NO: 2416749 - protein, 8 aa, Entamoeba dispar
DNAGSGDI

SEQ ID NO: 2416750 - protein, 6 aa, Entamoeba dispar
DNAIPT

SEQ ID NO: 2416751 - protein, 7 aa, Entamoeba dispar
DNAKTNV

SEQ ID NO: 2416752 - protein, 4 aa, Entamoeba dispar
DNAL

SEQ ID NO: 2416753 - protein, 7 aa, Entamoeba dispar
DNAPTDK

SEQ ID NO: 2416754 - protein, 8 aa, Entamoeba dispar
DNAQTLGG

SEQ ID NO: 2416755 - protein, 9 aa, Entamoeba dispar
DNASGSAMT

SEQ ID NO: 2416756 - protein, 8 aa, Entamoeba dispar
DNASPQYK

SEQ ID NO: 2416757 - protein, 8 aa, Entamoeba dispar
DNASQKPT

SEQ ID NO: 2416758 - protein, 4 aa, Entamoeba dispar
DNAY

SEQ ID NO: 2416759 - protein, 5 aa, Entamoeba dispar
DNCDM

SEQ ID NO: 2416760 - protein, 4 aa, Entamoeba dispar
DNCK

SEQ ID NO: 2416761 - protein, 9 aa, Entamoeba dispar
DNCPPEQLP

SEQ ID NO: 2416762 - protein, 8 aa, Entamoeba dispar
DNDCNGDV

SEQ ID NO: 2416763 - protein, 5 aa, Entamoeba dispar
DNDEE

SEQ ID NO: 2416764 - protein, 8 aa, Entamoeba dispar
DNDELDDE

SEQ ID NO: 2416765 - protein, 8 aa, Entamoeba dispar
DNDELTDS

SEQ ID NO: 2416766 - protein, 7 aa, Entamoeba dispar
DNDELTL

SEQ ID NO: 2416767 - protein, 8 aa, Entamoeba dispar
DNDESELD

SEQ ID NO: 2416768 - protein, 7 aa, Entamoeba dispar
DNDFTTN

SEQ ID NO: 2416769 - protein, 11 aa, Entamoeba dispar
DNDGSVNADEY

SEQ ID NO: 2416770 - protein, 4 aa, Entamoeba dispar
DNDH

SEQ ID NO: 2416771 - protein, 8 aa, Entamoeba dispar
DNDKENFR

SEQ ID NO: 2416772 - protein, 5 aa, Entamoeba dispar
DNDKH

SEQ ID NO: 2416773 - protein, 12 aa, Entamoeba dispar
DNDNQKNITKKY

SEQ ID NO: 2416774 - protein, 10 aa, Entamoeba dispar
DNDNSLNEKE

SEQ ID NO: 2416775 - protein, 6 aa, Entamoeba dispar
DNDPNT

SEQ ID NO: 2416776 - protein, 7 aa, Entamoeba dispar
DNDPSIS

SEQ ID NO: 2416777 - protein, 7 aa, Entamoeba dispar
DNDSRDC

SEQ ID NO: 2416778 - protein, 6 aa, Entamoeba dispar
DNDTQF

SEQ ID NO: 2416779 - protein, 6 aa, Entamoeba dispar
DNDVDT

SEQ ID NO: 2416780 - protein, 5 aa, Entamoeba dispar
DNDYN

SEQ ID NO: 2416781 - protein, 10 aa, Entamoeba dispar
DNEAQSEIEQ

SEQ ID NO: 2416782 - protein, 8 aa, Entamoeba dispar
DNEDAQTF

SEQ ID NO: 2416783 - protein, 5 aa, Entamoeba dispar
DNEDD

SEQ ID NO: 2416784 - protein, 7 aa, Entamoeba dispar
DNEDDSY

SEQ ID NO: 2416785 - protein, 13 aa, Entamoeba dispar
DNEDLKKKQKEIL

SEQ ID NO: 2416786 - protein, 14 aa, Entamoeba dispar
DNEEEEEDEEDDWS

SEQ ID NO: 2416787 - protein, 7 aa, Entamoeba dispar
DNEEVNP

SEQ ID NO: 2416788 - protein, 4 aa, Entamoeba dispar
DNEG

SEQ ID NO: 2416789 - protein, 7 aa, Entamoeba dispar
DNEGSEF

SEQ ID NO: 2416790 - protein, 4 aa, Entamoeba dispar
DNEI

SEQ ID NO: 2416791 - protein, 30 aa, Entamoeba dispar
DNEIEKKEEEVKNKEVEIKKRDDEIKNKEN

SEQ ID NO: 2416792 - protein, 42 aa, Entamoeba dispar
DNEIEKRGCEIKKKEEEVENKKKTIQEKDNTIQVKDDEIEEL

SEQ ID NO: 2416793 - protein, 30 aa, Entamoeba dispar
DNEIKGKPLLPSKSLKSKTMKEQQQPALTK

SEQ ID NO: 2416794 - protein, 27 aa, Entamoeba dispar
DNEIKNKEVEIKKRDYEIKKRDDEIKH

SEQ ID NO: 2416795 - protein, 36 aa, Entamoeba dispar
DNEIKQSVSNPKLNEDSSSTNNKEHKNSSENEDKNL

SEQ ID NO: 2416796 - protein, 7 aa, Entamoeba dispar
DNEIKQT

SEQ ID NO: 2416797 - protein, 12 aa, Entamoeba dispar
DNEINGGNEDDV

SEQ ID NO: 2416798 - protein, 20 aa, Entamoeba dispar
DNEIQKEKEIGKKQQKEIEM

SEQ ID NO: 2416799 - protein, 10 aa, Entamoeba dispar
DNEKNRKRIN

SEQ ID NO: 2416800 - protein, 5 aa, Entamoeba dispar
DNELI

SEQ ID NO: 2416801 - protein, 8 aa, Entamoeba dispar
DNELNGDT

SEQ ID NO: 2416802 - protein, 8 aa, Entamoeba dispar
DNENDDFE

SEQ ID NO: 2416803 - protein, 8 aa, Entamoeba dispar
DNENEESL

SEQ ID NO: 2416804 - protein, 8 aa, Entamoeba dispar
DNENKNEL

SEQ ID NO: 2416805 - protein, 8 aa, Entamoeba dispar
DNENNVNN

SEQ ID NO: 2416806 - protein, 8 aa, Entamoeba dispar
DNENTTQN

SEQ ID NO: 2416807 - protein, 7 aa, Entamoeba dispar
DNEPCQT

SEQ ID NO: 2416808 - protein, 4 aa, Entamoeba dispar
DNEQ

SEQ ID NO: 2416809 - protein, 50 aa, Entamoeba dispar
DNEQIDIKSPKQSIESQSKDYNFEPENNFKSQSQNEIINSPNESHSLSYQ

SEQ ID NO: 2416810 - protein, 7 aa, Entamoeba dispar
DNERLRQ

SEQ ID NO: 2416811 - protein, 5 aa, Entamoeba dispar
DNERN

SEQ ID NO: 2416812 - protein, 4 aa, Entamoeba dispar
DNES

SEQ ID NO: 2416813 - protein, 5 aa, Entamoeba dispar
DNESK

SEQ ID NO: 2416814 - protein, 10 aa, Entamoeba dispar
DNESPTQRRK

SEQ ID NO: 2416815 - protein, 6 aa, Entamoeba dispar
DNESTV

SEQ ID NO: 2416816 - protein, 8 aa, Entamoeba dispar
DNETDTGY

SEQ ID NO: 2416817 - protein, 12 aa, Entamoeba dispar
DNETDVKPKAPW

SEQ ID NO: 2416818 - protein, 27 aa, Entamoeba dispar
DNETKSAQHTPREEDEGSRRKTMQPNR

SEQ ID NO: 2416819 - protein, 8 aa, Entamoeba dispar
DNETNSTL

SEQ ID NO: 2416820 - protein, 8 aa, Entamoeba dispar
DNETQLKN

SEQ ID NO: 2416821 - protein, 6 aa, Entamoeba dispar
DNETST

SEQ ID NO: 2416822 - protein, 5 aa, Entamoeba dispar
DNEVI

SEQ ID NO: 2416823 - protein, 6 aa, Entamoeba dispar
DNEYSV

SEQ ID NO: 2416824 - protein, 4 aa, Entamoeba dispar
DNFE

SEQ ID NO: 2416825 - protein, 7 aa, Entamoeba dispar
DNFEGSR

SEQ ID NO: 2416826 - protein, 6 aa, Entamoeba dispar
DNFGNE

SEQ ID NO: 2416827 - protein, 7 aa, Entamoeba dispar
DNFNEKK

SEQ ID NO: 2416828 - protein, 14 aa, Entamoeba dispar
DNFNGNKGKNRNKI

SEQ ID NO: 2416829 - protein, 5 aa, Entamoeba dispar
DNFQE

SEQ ID NO: 2416830 - protein, 10 aa, Entamoeba dispar
DNFQRDPKMT

SEQ ID NO: 2416831 - protein, 9 aa, Entamoeba dispar
DNFSGDRNG

SEQ ID NO: 2416832 - protein, 6 aa, Entamoeba dispar
DNFTNT

SEQ ID NO: 2416833 - protein, 6 aa, Entamoeba dispar
DNGATD

SEQ ID NO: 2416834 - protein, 27 aa, Entamoeba dispar
DNGDEEDPSGLPAAHVPPTRPVPVYRA

SEQ ID NO: 2416835 - protein, 4 aa, Entamoeba dispar
DNGE

SEQ ID NO: 2416836 - protein, 5 aa, Entamoeba dispar
DNGER

SEQ ID NO: 2416837 - protein, 9 aa, Entamoeba dispar
DNGKGDEEF

SEQ ID NO: 2416838 - protein, 18 aa, Entamoeba dispar
DNGKKRISNQMAQRKAEK

SEQ ID NO: 2416839 - protein, 15 aa, Entamoeba dispar
DNGKMYTKSEVQDSM

SEQ ID NO: 2416840 - protein, 6 aa, Entamoeba dispar
DNGNIL

SEQ ID NO: 2416841 - protein, 4 aa, Entamoeba dispar
DNGQ

SEQ ID NO: 2416842 - protein, 9 aa, Entamoeba dispar
DNGSILSSN

SEQ ID NO: 2416843 - protein, 8 aa, Entamoeba dispar
DNGSNDSI

SEQ ID NO: 2416844 - protein, 9 aa, Entamoeba dispar
DNGTEEAKK

SEQ ID NO: 2416845 - protein, 10 aa, Entamoeba dispar
DNGTEEAPGI

SEQ ID NO: 2416846 - protein, 10 aa, Entamoeba dispar
DNGTTRSNDP

SEQ ID NO: 2416847 - protein, 8 aa, Entamoeba dispar
DNHEISEK

SEQ ID NO: 2416848 - protein, 7 aa, Entamoeba dispar
DNHGECQ

SEQ ID NO: 2416849 - protein, 9 aa, Entamoeba dispar
DNHPSNKER

SEQ ID NO: 2416850 - protein, 6 aa, Entamoeba dispar
DNHQAR

SEQ ID NO: 2416851 - protein, 5 aa, Entamoeba dispar
DNIAE

SEQ ID NO: 2416852 - protein, 10 aa, Entamoeba dispar
DNIASKTSEI

SEQ ID NO: 2416853 - protein, 13 aa, Entamoeba dispar
DNIDKNPISSPRS

SEQ ID NO: 2416854 - protein, 11 aa, Entamoeba dispar
DNIEKEKEQYS

SEQ ID NO: 2416855 - protein, 8 aa, Entamoeba dispar
DNIETGIN

SEQ ID NO: 2416856 - protein, 5 aa, Entamoeba dispar
DNIGK

SEQ ID NO: 2416857 - protein, 7 aa, Entamoeba dispar
DNIKEGE

SEQ ID NO: 2416858 - protein, 11 aa, Entamoeba dispar
DNIKRRTEIEE

SEQ ID NO: 2416859 - protein, 5 aa, Entamoeba dispar
DNINN

SEQ ID NO: 2416860 - protein, 5 aa, Entamoeba dispar
DNINR

SEQ ID NO: 2416861 - protein, 9 aa, Entamoeba dispar
DNIPKEKAT

SEQ ID NO: 2416862 - protein, 11 aa, Entamoeba dispar
DNIPNKGSEQV

SEQ ID NO: 2416863 - protein, 24 aa, Entamoeba dispar
DNIRNEKEFQRELTESDRKKQEMI

SEQ ID NO: 2416864 - protein, 5 aa, Entamoeba dispar
DNISP

SEQ ID NO: 2416865 - protein, 8 aa, Entamoeba dispar
DNKDSNEI

SEQ ID NO: 2416866 - protein, 5 aa, Entamoeba dispar
DNKED

SEQ ID NO: 2416867 - protein, 16 aa, Entamoeba dispar
DNKEHSKKSTGISETK

SEQ ID NO: 2416868 - protein, 8 aa, Entamoeba dispar
DNKIPTNN

SEQ ID NO: 2416869 - protein, 12 aa, Entamoeba dispar
DNKIQENNKERI

SEQ ID NO: 2416870 - protein, 8 aa, Entamoeba dispar
DNKKKKTI

SEQ ID NO: 2416871 - protein, 5 aa, Entamoeba dispar
DNKLI

SEQ ID NO: 2416872 - protein, 7 aa, Entamoeba dispar
DNKMRSS

SEQ ID NO: 2416873 - protein, 52 aa, Entamoeba dispar
DNKMSQTKLSSPYNISPNETYQKLKPSHSQTSINEMEKQQNSYYKEDEYKKC

SEQ ID NO: 2416874 - protein, 4 aa, Entamoeba dispar
DNKN

SEQ ID NO: 2416875 - protein, 9 aa, Entamoeba dispar
DNKNEEKLL

SEQ ID NO: 2416876 - protein, 16 aa, Entamoeba dispar
DNKNNSLSSNSGNNGC

SEQ ID NO: 2416877 - protein, 12 aa, Entamoeba dispar
DNKNRSKTRGQH

SEQ ID NO: 2416878 - protein, 6 aa, Entamoeba dispar
DNKNSI

SEQ ID NO: 2416879 - protein, 6 aa, Entamoeba dispar
DNKPFG

SEQ ID NO: 2416880 - protein, 8 aa, Entamoeba dispar
DNKQERPV

SEQ ID NO: 2416881 - protein, 7 aa, Entamoeba dispar
DNKQKEL

SEQ ID NO: 2416882 - protein, 5 aa, Entamoeba dispar
DNKQY

SEQ ID NO: 2416883 - protein, 8 aa, Entamoeba dispar
DNKRNEKS

SEQ ID NO: 2416884 - protein, 9 aa, Entamoeba dispar
DNKSDVDDI

SEQ ID NO: 2416885 - protein, 8 aa, Entamoeba dispar
DNKSEQLS

SEQ ID NO: 2416886 - protein, 8 aa, Entamoeba dispar
DNKSFNNP

SEQ ID NO: 2416887 - protein, 10 aa, Entamoeba dispar
DNKSKETREA

SEQ ID NO: 2416888 - protein, 7 aa, Entamoeba dispar
DNKSNLY

SEQ ID NO: 2416889 - protein, 9 aa, Entamoeba dispar
DNKSNSQLN

SEQ ID NO: 2416890 - protein, 13 aa, Entamoeba dispar
DNKTIMSDDTQLG

SEQ ID NO: 2416891 - protein, 11 aa, Entamoeba dispar
DNKTSQNGFSR

SEQ ID NO: 2416892 - protein, 7 aa, Entamoeba dispar
DNKTTKH

SEQ ID NO: 2416893 - protein, 8 aa, Entamoeba dispar
DNKYPEPF

SEQ ID NO: 2416894 - protein, 10 aa, Entamoeba dispar
DNKYSVNTPE

SEQ ID NO: 2416895 - protein, 8 aa, Entamoeba dispar
DNLAKQRN

SEQ ID NO: 2416896 - protein, 12 aa, Entamoeba dispar
DNLDEPSKDRGK

SEQ ID NO: 2416897 - protein, 7 aa, Entamoeba dispar
DNLEEKE

SEQ ID NO: 2416898 - protein, 6 aa, Entamoeba dispar
DNLENE

SEQ ID NO: 2416899 - protein, 19 aa, Entamoeba dispar
DNLEPQTRGFSPNEVQPEL

SEQ ID NO: 2416900 - protein, 6 aa, Entamoeba dispar
DNLGAI

SEQ ID NO: 2416901 - protein, 28 aa, Entamoeba dispar
DNLKRSSLSIPQSPREHEKKISRTSSKK

SEQ ID NO: 2416902 - protein, 13 aa, Entamoeba dispar
DNLNEQEKWAGRG

SEQ ID NO: 2416903 - protein, 9 aa, Entamoeba dispar
DNLNKDDLQ

SEQ ID NO: 2416904 - protein, 16 aa, Entamoeba dispar
DNLNRQNEKTKTLNGS

SEQ ID NO: 2416905 - protein, 13 aa, Entamoeba dispar
DNLPLSAADSLRT

SEQ ID NO: 2416906 - protein, 6 aa, Entamoeba dispar
DNLQTD

SEQ ID NO: 2416907 - protein, 8 aa, Entamoeba dispar
DNLSTDTL

SEQ ID NO: 2416908 - protein, 7 aa, Entamoeba dispar
DNLTRRS

SEQ ID NO: 2416909 - protein, 6 aa, Entamoeba dispar
DNLTSK

SEQ ID NO: 2416910 - protein, 6 aa, Entamoeba dispar
DNMRKE

SEQ ID NO: 2416911 - protein, 7 aa, Entamoeba dispar
DNMYETP

SEQ ID NO: 2416912 - protein, 5 aa, Entamoeba dispar
DNNDL

SEQ ID NO: 2416913 - protein, 4 aa, Entamoeba dispar
DNNE

SEQ ID NO: 2416914 - protein, 11 aa, Entamoeba dispar
DNNEIQAKNRP

SEQ ID NO: 2416915 - protein, 10 aa, Entamoeba dispar
DNNEKIINQN

SEQ ID NO: 2416916 - protein, 6 aa, Entamoeba dispar
DNNEYL

SEQ ID NO: 2416917 - protein, 5 aa, Entamoeba dispar
DNNFT

SEQ ID NO: 2416918 - protein, 16 aa, Entamoeba dispar
DNNGGDAFVAFLNSAF

SEQ ID NO: 2416919 - protein, 18 aa, Entamoeba dispar
DNNGKITISSPLEAHKSN

SEQ ID NO: 2416920 - protein, 7 aa, Entamoeba dispar
DNNGLKQ

SEQ ID NO: 2416921 - protein, 11 aa, Entamoeba dispar
DNNINKKEKIE

SEQ ID NO: 2416922 - protein, 16 aa, Entamoeba dispar
DNNKKTITSSINNEVN

SEQ ID NO: 2416923 - protein, 6 aa, Entamoeba dispar
DNNKRL

SEQ ID NO: 2416924 - protein, 12 aa, Entamoeba dispar
DNNKRNNAKSQI

SEQ ID NO: 2416925 - protein, 14 aa, Entamoeba dispar
DNNKSTNCNTKSYY

SEQ ID NO: 2416926 - protein, 10 aa, Entamoeba dispar
DNNKTIEKQS

SEQ ID NO: 2416927 - protein, 12 aa, Entamoeba dispar
DNNKTQEVDPSV

SEQ ID NO: 2416928 - protein, 5 aa, Entamoeba dispar
DNNKY

SEQ ID NO: 2416929 - protein, 8 aa, Entamoeba dispar
DNNNKDTL

SEQ ID NO: 2416930 - protein, 23 aa, Entamoeba dispar
DNNNLEKEKKYKSTEEQDKEEAE

SEQ ID NO: 2416931 - protein, 7 aa, Entamoeba dispar
DNNNNIV

SEQ ID NO: 2416932 - protein, 5 aa, Entamoeba dispar
DNNNQ

SEQ ID NO: 2416933 - protein, 16 aa, Entamoeba dispar
DNNNTEQKIKQKENKI

SEQ ID NO: 2416934 - protein, 7 aa, Entamoeba dispar
DNNPKAE

SEQ ID NO: 2416935 - protein, 10 aa, Entamoeba dispar
DNNPRLDEER

SEQ ID NO: 2416936 - protein, 5 aa, Entamoeba dispar
DNNQI

SEQ ID NO: 2416937 - protein, 7 aa, Entamoeba dispar
DNNQNYD

SEQ ID NO: 2416938 - protein, 8 aa, Entamoeba dispar
DNNSCKVG

SEQ ID NO: 2416939 - protein, 8 aa, Entamoeba dispar
DNNSDEQY

SEQ ID NO: 2416940 - protein, 5 aa, Entamoeba dispar
DNNST

SEQ ID NO: 2416941 - protein, 19 aa, Entamoeba dispar
DNNTNTLPQNSQTNEFNSQ

SEQ ID NO: 2416942 - protein, 5 aa, Entamoeba dispar
DNNTY

SEQ ID NO: 2416943 - protein, 4 aa, Entamoeba dispar
DNNV

SEQ ID NO: 2416944 - protein, 5 aa, Entamoeba dispar
DNNVF

SEQ ID NO: 2416945 - protein, 6 aa, Entamoeba dispar
DNPDEI

SEQ ID NO: 2416946 - protein, 7 aa, Entamoeba dispar
DNPDGTT

SEQ ID NO: 2416947 - protein, 8 aa, Entamoeba dispar
DNPGISPI

SEQ ID NO: 2416948 - protein, 6 aa, Entamoeba dispar
DNPGME

SEQ ID NO: 2416949 - protein, 13 aa, Entamoeba dispar
DNPISDIRGANNM

SEQ ID NO: 2416950 - protein, 15 aa, Entamoeba dispar
DNPLEDKGSISETRQ

SEQ ID NO: 2416951 - protein, 6 aa, Entamoeba dispar
DNPNEI

SEQ ID NO: 2416952 - protein, 14 aa, Entamoeba dispar
DNPNKESPAQQRAN

SEQ ID NO: 2416953 - protein, 8 aa, Entamoeba dispar
DNPNLGPP

SEQ ID NO: 2416954 - protein, 7 aa, Entamoeba dispar
DNPPAKL

SEQ ID NO: 2416955 - protein, 12 aa, Entamoeba dispar
DNPPKKGLFPEY

SEQ ID NO: 2416956 - protein, 8 aa, Entamoeba dispar
DNPPVIDG

SEQ ID NO: 2416957 - protein, 10 aa, Entamoeba dispar
DNPQSSVSPL

SEQ ID NO: 2416958 - protein, 7 aa, Entamoeba dispar
DNPSAWK

SEQ ID NO: 2416959 - protein, 7 aa, Entamoeba dispar
DNPSESI

SEQ ID NO: 2416960 - protein, 17 aa, Entamoeba dispar
DNPSYVPKYPKEGDNIS

SEQ ID NO: 2416961 - protein, 5 aa, Entamoeba dispar
DNPTK

SEQ ID NO: 2416962 - protein, 8 aa, Entamoeba dispar
DNPTKKID

SEQ ID NO: 2416963 - protein, 4 aa, Entamoeba dispar
DNQE

SEQ ID NO: 2416964 - protein, 5 aa, Entamoeba dispar
DNQED

SEQ ID NO: 2416965 - protein, 5 aa, Entamoeba dispar
DNQEL

SEQ ID NO: 2416966 - protein, 9 aa, Entamoeba dispar
DNQEYGVEP

SEQ ID NO: 2416967 - protein, 4 aa, Entamoeba dispar
DNQF

SEQ ID NO: 2416968 - protein, 14 aa, Entamoeba dispar
DNQGIDVPSDKIPS

SEQ ID NO: 2416969 - protein, 10 aa, Entamoeba dispar
DNQIKAKGLQ

SEQ ID NO: 2416970 - protein, 5 aa, Entamoeba dispar
DNQIR

SEQ ID NO: 2416971 - protein, 7 aa, Entamoeba dispar
DNQNDYI

SEQ ID NO: 2416972 - protein, 7 aa, Entamoeba dispar
DNQNNLS

SEQ ID NO: 2416973 - protein, 5 aa, Entamoeba dispar
DNQNV

SEQ ID NO: 2416974 - protein, 32 aa, Entamoeba dispar
DNQPHQEEKESQQNPTLTAPSIPSQDFAEEEN

SEQ ID NO: 2416975 - protein, 7 aa, Entamoeba dispar
DNQPTPL

SEQ ID NO: 2416976 - protein, 6 aa, Entamoeba dispar
DNQQHF

SEQ ID NO: 2416977 - protein, 5 aa, Entamoeba dispar
DNQRY

SEQ ID NO: 2416978 - protein, 4 aa, Entamoeba dispar
DNQT

SEQ ID NO: 2416979 - protein, 6 aa, Entamoeba dispar
DNQTDP

SEQ ID NO: 2416980 - protein, 5 aa, Entamoeba dispar
DNQTN

SEQ ID NO: 2416981 - protein, 6 aa, Entamoeba dispar
DNQYNE

SEQ ID NO: 2416982 - protein, 6 aa, Entamoeba dispar
DNQYYT

SEQ ID NO: 2416983 - protein, 5 aa, Entamoeba dispar
DNRDD

SEQ ID NO: 2416984 - protein, 10 aa, Entamoeba dispar
DNRDERDDEY

SEQ ID NO: 2416985 - protein, 6 aa, Entamoeba dispar
DNREGV

SEQ ID NO: 2416986 - protein, 44 aa, Entamoeba dispar
DNRKIDSLEKEKPTLKKEQQDDTSFNENKQISDSDNGVDKQTGI

SEQ ID NO: 2416987 - protein, 11 aa, Entamoeba dispar
DNRLRTDDGRY

SEQ ID NO: 2416988 - protein, 17 aa, Entamoeba dispar
DNRPIKNTTSILSVRLL

SEQ ID NO: 2416989 - protein, 4 aa, Entamoeba dispar
DNRQ

SEQ ID NO: 2416990 - protein, 16 aa, Entamoeba dispar
DNRRNDYDDGCEPRRR

SEQ ID NO: 2416991 - protein, 4 aa, Entamoeba dispar
DNRY

SEQ ID NO: 2416992 - protein, 7 aa, Entamoeba dispar
DNSDVSI

SEQ ID NO: 2416993 - protein, 4 aa, Entamoeba dispar
DNSE

SEQ ID NO: 2416994 - protein, 17 aa, Entamoeba dispar
DNSEQNRDQSKSQTSKV

SEQ ID NO: 2416995 - protein, 7 aa, Entamoeba dispar
DNSFISP

SEQ ID NO: 2416996 - protein, 6 aa, Entamoeba dispar
DNSGCT

SEQ ID NO: 2416997 - protein, 7 aa, Entamoeba dispar
DNSGCTS

SEQ ID NO: 2416998 - protein, 11 aa, Entamoeba dispar
DNSGDEKEIDR

SEQ ID NO: 2416999 - protein, 17 aa, Entamoeba dispar
DNSGNVEIKNEEKELKE

SEQ ID NO: 2417000 - protein, 6 aa, Entamoeba dispar
DNSGSI

SEQ ID NO: 2417001 - protein, 6 aa, Entamoeba dispar
DNSIDE

SEQ ID NO: 2417002 - protein, 8 aa, Entamoeba dispar
DNSITQPQ

SEQ ID NO: 2417003 - protein, 5 aa, Entamoeba dispar
DNSIV

SEQ ID NO: 2417004 - protein, 7 aa, Entamoeba dispar
DNSKDSL

SEQ ID NO: 2417005 - protein, 62 aa, Entamoeba dispar
DNSKHKGGSAPPPPPPAGAPPPPSGGMPPPPPPPGAPPPPAGMPPPPSNHSMPKPSSAGRGD

SEQ ID NO: 2417006 - protein, 5 aa, Entamoeba dispar
DNSKK

SEQ ID NO: 2417007 - protein, 9 aa, Entamoeba dispar
DNSKKMQTY

SEQ ID NO: 2417008 - protein, 15 aa, Entamoeba dispar
DNSKVFESQQENNQL

SEQ ID NO: 2417009 - protein, 13 aa, Entamoeba dispar
DNSKVGDEKAKKN

SEQ ID NO: 2417010 - protein, 4 aa, Entamoeba dispar
DNSL

SEQ ID NO: 2417011 - protein, 5 aa, Entamoeba dispar
DNSLK

SEQ ID NO: 2417012 - protein, 5 aa, Entamoeba dispar
DNSMN

SEQ ID NO: 2417013 - protein, 4 aa, Entamoeba dispar
DNSN

SEQ ID NO: 2417014 - protein, 9 aa, Entamoeba dispar
DNSNFVDSQ

SEQ ID NO: 2417015 - protein, 8 aa, Entamoeba dispar
DNSPYKRK

SEQ ID NO: 2417016 - protein, 5 aa, Entamoeba dispar
DNSQI

SEQ ID NO: 2417017 - protein, 6 aa, Entamoeba dispar
DNSQIE

SEQ ID NO: 2417018 - protein, 10 aa, Entamoeba dispar
DNSRSKEEIE

SEQ ID NO: 2417019 - protein, 31 aa, Entamoeba dispar
DNSSIKTDDVTDHNKLKKKKRRFTEEETQNL

SEQ ID NO: 2417020 - protein, 10 aa, Entamoeba dispar
DNSTNQQINS

SEQ ID NO: 2417021 - protein, 7 aa, Entamoeba dispar
DNSVEQL

SEQ ID NO: 2417022 - protein, 9 aa, Entamoeba dispar
DNSVPGYNP

SEQ ID NO: 2417023 - protein, 23 aa, Entamoeba dispar
DNTDFNKSENWGNNSSNCPCEGN

SEQ ID NO: 2417024 - protein, 20 aa, Entamoeba dispar
DNTDKLKLKDKQTQKQIGYE

SEQ ID NO: 2417025 - protein, 5 aa, Entamoeba dispar
DNTEE

SEQ ID NO: 2417026 - protein, 8 aa, Entamoeba dispar
DNTENPLT

SEQ ID NO: 2417027 - protein, 9 aa, Entamoeba dispar
DNTHHPEEK

SEQ ID NO: 2417028 - protein, 16 aa, Entamoeba dispar
DNTKENNIKRAESITQ

SEQ ID NO: 2417029 - protein, 8 aa, Entamoeba dispar
DNTKETPI

SEQ ID NO: 2417030 - protein, 7 aa, Entamoeba dispar
DNTKIGK

SEQ ID NO: 2417031 - protein, 13 aa, Entamoeba dispar
DNTKTETVSSSKL

SEQ ID NO: 2417032 - protein, 7 aa, Entamoeba dispar
DNTLGED

SEQ ID NO: 2417033 - protein, 6 aa, Entamoeba dispar
DNTMPG

SEQ ID NO: 2417034 - protein, 4 aa, Entamoeba dispar
DNTN

SEQ ID NO: 2417035 - protein, 23 aa, Entamoeba dispar
DNTNETSKKNPSFGSFFTKYCTI

SEQ ID NO: 2417036 - protein, 15 aa, Entamoeba dispar
DNTNNSKERLSSEDS

SEQ ID NO: 2417037 - protein, 18 aa, Entamoeba dispar
DNTNPFDDNAPKRDTSKT

SEQ ID NO: 2417038 - protein, 27 aa, Entamoeba dispar
DNTPTQNQNDEEIINTNKDEISDEELA

SEQ ID NO: 2417039 - protein, 8 aa, Entamoeba dispar
DNTQRNKR

SEQ ID NO: 2417040 - protein, 7 aa, Entamoeba dispar
DNTQVKT

SEQ ID NO: 2417041 - protein, 8 aa, Entamoeba dispar
DNTRKRKG

SEQ ID NO: 2417042 - protein, 7 aa, Entamoeba dispar
DNTSFPS

SEQ ID NO: 2417043 - protein, 15 aa, Entamoeba dispar
DNTSQGESVNLTTGN

SEQ ID NO: 2417044 - protein, 7 aa, Entamoeba dispar
DNTTRRI

SEQ ID NO: 2417045 - protein, 6 aa, Entamoeba dispar
DNTVNK

SEQ ID NO: 2417046 - protein, 12 aa, Entamoeba dispar
DNVEDDVEEKED

SEQ ID NO: 2417047 - protein, 7 aa, Entamoeba dispar
DNVEDVP

SEQ ID NO: 2417048 - protein, 6 aa, Entamoeba dispar
DNVKEK

SEQ ID NO: 2417049 - protein, 8 aa, Entamoeba dispar
DNVKTYTY

SEQ ID NO: 2417050 - protein, 8 aa, Entamoeba dispar
DNVNESYY

SEQ ID NO: 2417051 - protein, 27 aa, Entamoeba dispar
DNVNNFNEKELSKTINVSKQNTKQYSQ

SEQ ID NO: 2417052 - protein, 7 aa, Entamoeba dispar
DNVPMSP

SEQ ID NO: 2417053 - protein, 9 aa, Entamoeba dispar
DNVPSQYRK

SEQ ID NO: 2417054 - protein, 10 aa, Entamoeba dispar
DNVSDDENEF

SEQ ID NO: 2417055 - protein, 10 aa, Entamoeba dispar
DNWDKDKSVF

SEQ ID NO: 2417056 - protein, 7 aa, Entamoeba dispar
DNWGTVS

SEQ ID NO: 2417057 - protein, 19 aa, Entamoeba dispar
DNYAQAKRISTSYEGEQES

SEQ ID NO: 2417058 - protein, 4 aa, Entamoeba dispar
DNYD

SEQ ID NO: 2417059 - protein, 6 aa, Entamoeba dispar
DNYDNV

SEQ ID NO: 2417060 - protein, 5 aa, Entamoeba dispar
DNYEV

SEQ ID NO: 2417061 - protein, 23 aa, Entamoeba dispar
DNYFPGTGDVDEIGIDEGKNYSI

SEQ ID NO: 2417062 - protein, 4 aa, Entamoeba dispar
DNYQ

SEQ ID NO: 2417063 - protein, 7 aa, Entamoeba dispar
DNYQAAQ

SEQ ID NO: 2417064 - protein, 7 aa, Entamoeba dispar
DNYRRKG

SEQ ID NO: 2417065 - protein, 7 aa, Entamoeba dispar
DNYRSEE

SEQ ID NO: 2417066 - protein, 5 aa, Entamoeba dispar
DNYSD

SEQ ID NO: 2417067 - protein, 5 aa, Entamoeba dispar
DPAAA

SEQ ID NO: 2417068 - protein, 17 aa, Entamoeba dispar
DPAARAAGINKQIHLML

SEQ ID NO: 2417069 - protein, 24 aa, Entamoeba dispar
DPAARAAGIQQTNPLDAFKNAGLF

SEQ ID NO: 2417070 - protein, 5 aa, Entamoeba dispar
DPACP

SEQ ID NO: 2417071 - protein, 9 aa, Entamoeba dispar
DPAHNTSDA

SEQ ID NO: 2417072 - protein, 4 aa, Entamoeba dispar
DPAI

SEQ ID NO: 2417073 - protein, 12 aa, Entamoeba dispar
DPAIDKQSSRYK

SEQ ID NO: 2417074 - protein, 5 aa, Entamoeba dispar
DPAIQ

SEQ ID NO: 2417075 - protein, 7 aa, Entamoeba dispar
DPAKYDK

SEQ ID NO: 2417076 - protein, 5 aa, Entamoeba dispar
DPAPV

SEQ ID NO: 2417077 - protein, 7 aa, Entamoeba dispar
DPASGKY

SEQ ID NO: 2417078 - protein, 9 aa, Entamoeba dispar
DPATDKPHP

SEQ ID NO: 2417079 - protein, 15 aa, Entamoeba dispar
DPAYRTEWDTSMKSE

SEQ ID NO: 2417080 - protein, 7 aa, Entamoeba dispar
DPDAPVP

SEQ ID NO: 2417081 - protein, 15 aa, Entamoeba dispar
DPDDSVDGMKSSMRG

SEQ ID NO: 2417082 - protein, 17 aa, Entamoeba dispar
DPDDSVEGMTPSTRGAG

SEQ ID NO: 2417083 - protein, 8 aa, Entamoeba dispar
DPDENQLE

SEQ ID NO: 2417084 - protein, 6 aa, Entamoeba dispar
DPDERI

SEQ ID NO: 2417085 - protein, 17 aa, Entamoeba dispar
DPDESGIEWEESPRGAG

SEQ ID NO: 2417086 - protein, 5 aa, Entamoeba dispar
DPDGC

SEQ ID NO: 2417087 - protein, 5 aa, Entamoeba dispar
DPDIE

SEQ ID NO: 2417088 - protein, 5 aa, Entamoeba dispar
DPDIN

SEQ ID NO: 2417089 - protein, 11 aa, Entamoeba dispar
DPDKDECSADS

SEQ ID NO: 2417090 - protein, 5 aa, Entamoeba dispar
DPDKF

SEQ ID NO: 2417091 - protein, 10 aa, Entamoeba dispar
DPDKKRKTSI

SEQ ID NO: 2417092 - protein, 9 aa, Entamoeba dispar
DPDNAPPEN

SEQ ID NO: 2417093 - protein, 6 aa, Entamoeba dispar
DPDNLE

SEQ ID NO: 2417094 - protein, 10 aa, Entamoeba dispar
DPDNLKENFE

SEQ ID NO: 2417095 - protein, 18 aa, Entamoeba dispar
DPDPATNDWKSSPRGAGH

SEQ ID NO: 2417096 - protein, 5 aa, Entamoeba dispar
DPDSF

SEQ ID NO: 2417097 - protein, 11 aa, Entamoeba dispar
DPDSPLGESQN

SEQ ID NO: 2417098 - protein, 9 aa, Entamoeba dispar
DPDSRWTAK

SEQ ID NO: 2417099 - protein, 4 aa, Entamoeba dispar
DPDV

SEQ ID NO: 2417100 - protein, 6 aa, Entamoeba dispar
DPDVTP

SEQ ID NO: 2417101 - protein, 10 aa, Entamoeba dispar
DPEDEKNKQI

SEQ ID NO: 2417102 - protein, 15 aa, Entamoeba dispar
DPEEKAGWEQSPRGA

SEQ ID NO: 2417103 - protein, 14 aa, Entamoeba dispar
DPEEKGVIDSKELT

SEQ ID NO: 2417104 - protein, 8 aa, Entamoeba dispar
DPEGNEIP

SEQ ID NO: 2417105 - protein, 20 aa, Entamoeba dispar
DPEGNEIPIEQKDNGDGTYD

SEQ ID NO: 2417106 - protein, 4 aa, Entamoeba dispar
DPEI

SEQ ID NO: 2417107 - protein, 6 aa, Entamoeba dispar
DPEIRR

SEQ ID NO: 2417108 - protein, 7 aa, Entamoeba dispar
DPEKAVE

SEQ ID NO: 2417109 - protein, 14 aa, Entamoeba dispar
DPEKRLTNPNNIKS

SEQ ID NO: 2417110 - protein, 17 aa, Entamoeba dispar
DPENVNVTEKRLKNYSE

SEQ ID NO: 2417111 - protein, 17 aa, Entamoeba dispar
DPEPEVDTWRPSNRGAG

SEQ ID NO: 2417112 - protein, 34 aa, Entamoeba dispar
  misc_feature (28)..(29): Xaa can be any naturally occurring amino acid
DPEPLSQQSKRNENQSVNAHQNNVTKEXXEMISL

SEQ ID NO: 2417113 - protein, 35 aa, Entamoeba dispar
DPEQSRKVAEETKGLDNARKKEQEEIKKWDSSKAQ

SEQ ID NO: 2417114 - protein, 4 aa, Entamoeba dispar
DPER

SEQ ID NO: 2417115 - protein, 8 aa, Entamoeba dispar
DPEREATY

SEQ ID NO: 2417116 - protein, 4 aa, Entamoeba dispar
DPES

SEQ ID NO: 2417117 - protein, 13 aa, Entamoeba dispar
DPESSSGSPEDDL

SEQ ID NO: 2417118 - protein, 13 aa, Entamoeba dispar
DPESSSGSPEDEL

SEQ ID NO: 2417119 - protein, 8 aa, Entamoeba dispar
DPETGNKE

SEQ ID NO: 2417120 - protein, 10 aa, Entamoeba dispar
DPETKPKNRN

SEQ ID NO: 2417121 - protein, 14 aa, Entamoeba dispar
DPEVIPGDTIEPET

SEQ ID NO: 2417122 - protein, 5 aa, Entamoeba dispar
DPEVT

SEQ ID NO: 2417123 - protein, 7 aa, Entamoeba dispar
DPFAEDD

SEQ ID NO: 2417124 - protein, 14 aa, Entamoeba dispar
DPFAKEETKGKRTW

SEQ ID NO: 2417125 - protein, 5 aa, Entamoeba dispar
DPFDE

SEQ ID NO: 2417126 - protein, 4 aa, Entamoeba dispar
DPFK

SEQ ID NO: 2417127 - protein, 21 aa, Entamoeba dispar
DPFKKNNKHSRKIMNSICSAI

SEQ ID NO: 2417128 - protein, 4 aa, Entamoeba dispar
DPFL

SEQ ID NO: 2417129 - protein, 4 aa, Entamoeba dispar
DPFS

SEQ ID NO: 2417130 - protein, 6 aa, Entamoeba dispar
DPFSMN

SEQ ID NO: 2417131 - protein, 18 aa, Entamoeba dispar
DPFTEPTNRSYKQEDESN

SEQ ID NO: 2417132 - protein, 5 aa, Entamoeba dispar
DPFYS

SEQ ID NO: 2417133 - protein, 21 aa, Entamoeba dispar
DPGEEEVKITQQTEDTDGGCV

SEQ ID NO: 2417134 - protein, 6 aa, Entamoeba dispar
DPGKGA

SEQ ID NO: 2417135 - protein, 13 aa, Entamoeba dispar
DPGKNERFSGPRE

SEQ ID NO: 2417136 - protein, 4 aa, Entamoeba dispar
DPGL

SEQ ID NO: 2417137 - protein, 7 aa, Entamoeba dispar
DPGLGKS

SEQ ID NO: 2417138 - protein, 4 aa, Entamoeba dispar
DPGR

SEQ ID NO: 2417139 - protein, 9 aa, Entamoeba dispar
DPGSLDTRT

SEQ ID NO: 2417140 - protein, 8 aa, Entamoeba dispar
DPGTGKSQ

SEQ ID NO: 2417141 - protein, 8 aa, Entamoeba dispar
DPGTSKSQ

SEQ ID NO: 2417142 - protein, 6 aa, Entamoeba dispar
DPGTVN

SEQ ID NO: 2417143 - protein, 6 aa, Entamoeba dispar
DPHASN

SEQ ID NO: 2417144 - protein, 12 aa, Entamoeba dispar
DPHKSLEQNEVY

SEQ ID NO: 2417145 - protein, 4 aa, Entamoeba dispar
DPHS

SEQ ID NO: 2417146 - protein, 12 aa, Entamoeba dispar
DPHVKEAKPNPQ

SEQ ID NO: 2417147 - protein, 4 aa, Entamoeba dispar
DPIE

SEQ ID NO: 2417148 - protein, 5 aa, Entamoeba dispar
DPIGV

SEQ ID NO: 2417149 - protein, 6 aa, Entamoeba dispar
DPIKRD

SEQ ID NO: 2417150 - protein, 4 aa, Entamoeba dispar
DPIL

SEQ ID NO: 2417151 - protein, 8 aa, Entamoeba dispar
DPISTNQD

SEQ ID NO: 2417152 - protein, 4 aa, Entamoeba dispar
DPIT

SEQ ID NO: 2417153 - protein, 12 aa, Entamoeba dispar
DPITQKTEEPST

SEQ ID NO: 2417154 - protein, 13 aa, Entamoeba dispar
DPIYTSEVSENGE

SEQ ID NO: 2417155 - protein, 33 aa, Entamoeba dispar
DPKEVRRNQQKQRQMASRQKQLERNRKEKMGIG

SEQ ID NO: 2417156 - protein, 5 aa, Entamoeba dispar
DPKFK

SEQ ID NO: 2417157 - protein, 4 aa, Entamoeba dispar
DPKG

SEQ ID NO: 2417158 - protein, 5 aa, Entamoeba dispar
DPKIQ

SEQ ID NO: 2417159 - protein, 12 aa, Entamoeba dispar
DPKKGDKLTQIQ

SEQ ID NO: 2417160 - protein, 10 aa, Entamoeba dispar
DPKKRPDANQ

SEQ ID NO: 2417161 - protein, 8 aa, Entamoeba dispar
DPKLEGPT

SEQ ID NO: 2417162 - protein, 11 aa, Entamoeba dispar
DPKNPNARTLK

SEQ ID NO: 2417163 - protein, 7 aa, Entamoeba dispar
DPKPNTI

SEQ ID NO: 2417164 - protein, 8 aa, Entamoeba dispar
DPKRSAEI

SEQ ID NO: 2417165 - protein, 10 aa, Entamoeba dispar
DPKSKSKTHY

SEQ ID NO: 2417166 - protein, 8 aa, Entamoeba dispar
DPKTNKTE

SEQ ID NO: 2417167 - protein, 8 aa, Entamoeba dispar
DPKTPNPQ

SEQ ID NO: 2417168 - protein, 6 aa, Entamoeba dispar
DPKVGP

SEQ ID NO: 2417169 - protein, 5 aa, Entamoeba dispar
DPKVT

SEQ ID NO: 2417170 - protein, 17 aa, Entamoeba dispar
DPLAQTIKSANDIEKTV

SEQ ID NO: 2417171 - protein, 5 aa, Entamoeba dispar
DPLDP

SEQ ID NO: 2417172 - protein, 8 aa, Entamoeba dispar
DPLDSSKI

SEQ ID NO: 2417173 - protein, 13 aa, Entamoeba dispar
DPLLDNQSSIEEV

SEQ ID NO: 2417174 - protein, 5 aa, Entamoeba dispar
DPLLR

SEQ ID NO: 2417175 - protein, 11 aa, Entamoeba dispar
DPLNPSQTESF

SEQ ID NO: 2417176 - protein, 4 aa, Entamoeba dispar
DPLQ

SEQ ID NO: 2417177 - protein, 5 aa, Entamoeba dispar
DPLRQ

SEQ ID NO: 2417178 - protein, 4 aa, Entamoeba dispar
DPLS

SEQ ID NO: 2417179 - protein, 5 aa, Entamoeba dispar
DPLST

SEQ ID NO: 2417180 - protein, 6 aa, Entamoeba dispar
DPMKYQ

SEQ ID NO: 2417181 - protein, 20 aa, Entamoeba dispar
DPMRDKLASTIKKITDSQSA

SEQ ID NO: 2417182 - protein, 4 aa, Entamoeba dispar
DPMT

SEQ ID NO: 2417183 - protein, 5 aa, Entamoeba dispar
DPNAE

SEQ ID NO: 2417184 - protein, 7 aa, Entamoeba dispar
DPNASIK

SEQ ID NO: 2417185 - protein, 7 aa, Entamoeba dispar
DPNCPQV

SEQ ID NO: 2417186 - protein, 9 aa, Entamoeba dispar
DPNDDIDEN

SEQ ID NO: 2417187 - protein, 16 aa, Entamoeba dispar
DPNDEPEIVEIKKESS

SEQ ID NO: 2417188 - protein, 7 aa, Entamoeba dispar
DPNDFVK

SEQ ID NO: 2417189 - protein, 5 aa, Entamoeba dispar
DPNDG

SEQ ID NO: 2417190 - protein, 7 aa, Entamoeba dispar
DPNDNFQ

SEQ ID NO: 2417191 - protein, 21 aa, Entamoeba dispar
DPNDYSYTMSQQEQPSYVDQE

SEQ ID NO: 2417192 - protein, 4 aa, Entamoeba dispar
DPNE

SEQ ID NO: 2417193 - protein, 10 aa, Entamoeba dispar
DPNEAKEPRF

SEQ ID NO: 2417194 - protein, 10 aa, Entamoeba dispar
DPNEDTTVEG

SEQ ID NO: 2417195 - protein, 6 aa, Entamoeba dispar
DPNEQM

SEQ ID NO: 2417196 - protein, 4 aa, Entamoeba dispar
DPNF

SEQ ID NO: 2417197 - protein, 4 aa, Entamoeba dispar
DPNG

SEQ ID NO: 2417198 - protein, 11 aa, Entamoeba dispar
DPNGTKTTLQQ

SEQ ID NO: 2417199 - protein, 5 aa, Entamoeba dispar
DPNHR

SEQ ID NO: 2417200 - protein, 5 aa, Entamoeba dispar
DPNIK

SEQ ID NO: 2417201 - protein, 8 aa, Entamoeba dispar
DPNKIDGL

SEQ ID NO: 2417202 - protein, 7 aa, Entamoeba dispar
DPNKKLG

SEQ ID NO: 2417203 - protein, 9 aa, Entamoeba dispar
DPNNEGPTI

SEQ ID NO: 2417204 - protein, 7 aa, Entamoeba dispar
DPNNPRI

SEQ ID NO: 2417205 - protein, 6 aa, Entamoeba dispar
DPNNRH

SEQ ID NO: 2417206 - protein, 24 aa, Entamoeba dispar
DPNNTRNAQQQNDLKKPVKSSHFA

SEQ ID NO: 2417207 - protein, 7 aa, Entamoeba dispar
DPNPFNE

SEQ ID NO: 2417208 - protein, 6 aa, Entamoeba dispar
DPNPRV

SEQ ID NO: 2417209 - protein, 7 aa, Entamoeba dispar
DPNQQID

SEQ ID NO: 2417210 - protein, 39 aa, Entamoeba dispar
  misc_feature (21)..(22): Xaa can be any naturally occurring amino acid
DPNQRPTSEQILESPFVATNXXFNDYLLLWKMFFLMKKI

SEQ ID NO: 2417211 - protein, 9 aa, Entamoeba dispar
DPNRTHQGK

SEQ ID NO: 2417212 - protein, 27 aa, Entamoeba dispar
DPNSKPAFTKTQTFTSDGKITSTLRTQ

SEQ ID NO: 2417213 - protein, 10 aa, Entamoeba dispar
DPNSSGPEPI

SEQ ID NO: 2417214 - protein, 6 aa, Entamoeba dispar
DPNSSI

SEQ ID NO: 2417215 - protein, 6 aa, Entamoeba dispar
DPNSTL

SEQ ID NO: 2417216 - protein, 8 aa, Entamoeba dispar
DPNTENFS

SEQ ID NO: 2417217 - protein, 7 aa, Entamoeba dispar
DPNVESK

SEQ ID NO: 2417218 - protein, 5 aa, Entamoeba dispar
DPNVK

SEQ ID NO: 2417219 - protein, 8 aa, Entamoeba dispar
DPPASQSL

SEQ ID NO: 2417220 - protein, 7 aa, Entamoeba dispar
DPPESEL

SEQ ID NO: 2417221 - protein, 8 aa, Entamoeba dispar
DPPGETSE

SEQ ID NO: 2417222 - protein, 4 aa, Entamoeba dispar
DPPL

SEQ ID NO: 2417223 - protein, 8 aa, Entamoeba dispar
DPPQDPKT

SEQ ID NO: 2417224 - protein, 5 aa, Entamoeba dispar
DPPRR

SEQ ID NO: 2417225 - protein, 21 aa, Entamoeba dispar
DPPYGIREGAKKVGKRKPDMV

SEQ ID NO: 2417226 - protein, 5 aa, Entamoeba dispar
DPQDI

SEQ ID NO: 2417227 - protein, 10 aa, Entamoeba dispar
DPQEEVDQDD

SEQ ID NO: 2417228 - protein, 6 aa, Entamoeba dispar
DPQENE

SEQ ID NO: 2417229 - protein, 8 aa, Entamoeba dispar
DPQHSQLT

SEQ ID NO: 2417230 - protein, 4 aa, Entamoeba dispar
DPQI

SEQ ID NO: 2417231 - protein, 9 aa, Entamoeba dispar
DPQKDEGSI

SEQ ID NO: 2417232 - protein, 6 aa, Entamoeba dispar
DPQLPP

SEQ ID NO: 2417233 - protein, 7 aa, Entamoeba dispar
DPQQQIE

SEQ ID NO: 2417234 - protein, 9 aa, Entamoeba dispar
DPQSGTKVG

SEQ ID NO: 2417235 - protein, 5 aa, Entamoeba dispar
DPQTG

SEQ ID NO: 2417236 - protein, 8 aa, Entamoeba dispar
DPQTHKGF

SEQ ID NO: 2417237 - protein, 14 aa, Entamoeba dispar
DPQTSNGSSPSIRG

SEQ ID NO: 2417238 - protein, 7 aa, Entamoeba dispar
DPQVSRK

SEQ ID NO: 2417239 - protein, 6 aa, Entamoeba dispar
DPQWDK

SEQ ID NO: 2417240 - protein, 4 aa, Entamoeba dispar
DPQY

SEQ ID NO: 2417241 - protein, 4 aa, Entamoeba dispar
DPRA

SEQ ID NO: 2417242 - protein, 6 aa, Entamoeba dispar
DPRASG

SEQ ID NO: 2417243 - protein, 5 aa, Entamoeba dispar
DPRDD

SEQ ID NO: 2417244 - protein, 5 aa, Entamoeba dispar
DPRDF

SEQ ID NO: 2417245 - protein, 6 aa, Entamoeba dispar
DPRDKN

SEQ ID NO: 2417246 - protein, 8 aa, Entamoeba dispar
DPRDRPSC

SEQ ID NO: 2417247 - protein, 7 aa, Entamoeba dispar
DPRESQI

SEQ ID NO: 2417248 - protein, 9 aa, Entamoeba dispar
DPRFGTKND

SEQ ID NO: 2417249 - protein, 6 aa, Entamoeba dispar
DPRGSI

SEQ ID NO: 2417250 - protein, 24 aa, Entamoeba dispar
DPRMGPFEKGEECQTCRGTRTECP

SEQ ID NO: 2417251 - protein, 8 aa, Entamoeba dispar
DPRNSGKQ

SEQ ID NO: 2417252 - protein, 5 aa, Entamoeba dispar
DPRPL

SEQ ID NO: 2417253 - protein, 8 aa, Entamoeba dispar
DPRPPQQR

SEQ ID NO: 2417254 - protein, 4 aa, Entamoeba dispar
DPRQ

SEQ ID NO: 2417255 - protein, 15 aa, Entamoeba dispar
DPRRKESSKECLNRN

SEQ ID NO: 2417256 - protein, 4 aa, Entamoeba dispar
DPRS

SEQ ID NO: 2417257 - protein, 10 aa, Entamoeba dispar
DPRSEETKKY

SEQ ID NO: 2417258 - protein, 4 aa, Entamoeba dispar
DPRY

SEQ ID NO: 2417259 - protein, 6 aa, Entamoeba dispar
DPRYAY

SEQ ID NO: 2417260 - protein, 8 aa, Entamoeba dispar
DPSAEPVK

SEQ ID NO: 2417261 - protein, 14 aa, Entamoeba dispar
DPSCDDPSDDFLND

SEQ ID NO: 2417262 - protein, 9 aa, Entamoeba dispar
DPSFNGEKK

SEQ ID NO: 2417263 - protein, 5 aa, Entamoeba dispar
DPSGS

SEQ ID NO: 2417264 - protein, 7 aa, Entamoeba dispar
DPSGTER

SEQ ID NO: 2417265 - protein, 4 aa, Entamoeba dispar
DPSI

SEQ ID NO: 2417266 - protein, 5 aa, Entamoeba dispar
DPSIK

SEQ ID NO: 2417267 - protein, 9 aa, Entamoeba dispar
DPSKFPSNY

SEQ ID NO: 2417268 - protein, 7 aa, Entamoeba dispar
DPSKQIQ

SEQ ID NO: 2417269 - protein, 8 aa, Entamoeba dispar
DPSKRNCD

SEQ ID NO: 2417270 - protein, 8 aa, Entamoeba dispar
DPSKRPSA

SEQ ID NO: 2417271 - protein, 13 aa, Entamoeba dispar
DPSLIKKESEGKG

SEQ ID NO: 2417272 - protein, 18 aa, Entamoeba dispar
DPSLPQTLRSTTSQQEFS

SEQ ID NO: 2417273 - protein, 5 aa, Entamoeba dispar
DPSNA

SEQ ID NO: 2417274 - protein, 7 aa, Entamoeba dispar
DPSNPIE

SEQ ID NO: 2417275 - protein, 5 aa, Entamoeba dispar
DPSPY

SEQ ID NO: 2417276 - protein, 19 aa, Entamoeba dispar
DPSREASKQKLRKQTRKIR

SEQ ID NO: 2417277 - protein, 6 aa, Entamoeba dispar
DPSSCE

SEQ ID NO: 2417278 - protein, 7 aa, Entamoeba dispar
DPSSGSL

SEQ ID NO: 2417279 - protein, 5 aa, Entamoeba dispar
DPSSK

SEQ ID NO: 2417280 - protein, 11 aa, Entamoeba dispar
DPSSLHDKTNE

SEQ ID NO: 2417281 - protein, 5 aa, Entamoeba dispar
DPSSN

SEQ ID NO: 2417282 - protein, 9 aa, Entamoeba dispar
DPSSQPTTF

SEQ ID NO: 2417283 - protein, 4 aa, Entamoeba dispar
DPST

SEQ ID NO: 2417284 - protein, 6 aa, Entamoeba dispar
DPSTAC

SEQ ID NO: 2417285 - protein, 8 aa, Entamoeba dispar
DPSTDTFG

SEQ ID NO: 2417286 - protein, 7 aa, Entamoeba dispar
DPSTIED

SEQ ID NO: 2417287 - protein, 4 aa, Entamoeba dispar
DPSV

SEQ ID NO: 2417288 - protein, 6 aa, Entamoeba dispar
DPSVIG

SEQ ID NO: 2417289 - protein, 5 aa, Entamoeba dispar
DPSVT

SEQ ID NO: 2417290 - protein, 4 aa, Entamoeba dispar
DPSW

SEQ ID NO: 2417291 - protein, 5 aa, Entamoeba dispar
DPTAD

SEQ ID NO: 2417292 - protein, 18 aa, Entamoeba dispar
DPTDSYDQPRGKQVSNAN

SEQ ID NO: 2417293 - protein, 4 aa, Entamoeba dispar
DPTE

SEQ ID NO: 2417294 - protein, 4 aa, Entamoeba dispar
DPTK

SEQ ID NO: 2417295 - protein, 6 aa, Entamoeba dispar
DPTKRI

SEQ ID NO: 2417296 - protein, 14 aa, Entamoeba dispar
DPTKRPDCEELDKD

SEQ ID NO: 2417297 - protein, 9 aa, Entamoeba dispar
DPTKRTNQP

SEQ ID NO: 2417298 - protein, 6 aa, Entamoeba dispar
DPTLSE

SEQ ID NO: 2417299 - protein, 7 aa, Entamoeba dispar
DPTNDSF

SEQ ID NO: 2417300 - protein, 10 aa, Entamoeba dispar
DPTNPTQTES

SEQ ID NO: 2417301 - protein, 8 aa, Entamoeba dispar
DPTNTNDI

SEQ ID NO: 2417302 - protein, 5 aa, Entamoeba dispar
DPTPG

SEQ ID NO: 2417303 - protein, 6 aa, Entamoeba dispar
DPTPNF

SEQ ID NO: 2417304 - protein, 5 aa, Entamoeba dispar
DPTRR

SEQ ID NO: 2417305 - protein, 14 aa, Entamoeba dispar
DPTSFEGCINLHKI

SEQ ID NO: 2417306 - protein, 6 aa, Entamoeba dispar
DPTSKK

SEQ ID NO: 2417307 - protein, 7 aa, Entamoeba dispar
DPTTPPI

SEQ ID NO: 2417308 - protein, 4 aa, Entamoeba dispar
DPTV

SEQ ID NO: 2417309 - protein, 7 aa, Entamoeba dispar
DPVEKDK

SEQ ID NO: 2417310 - protein, 5 aa, Entamoeba dispar
DPVFD

SEQ ID NO: 2417311 - protein, 4 aa, Entamoeba dispar
DPVI

SEQ ID NO: 2417312 - protein, 4 aa, Entamoeba dispar
DPVP

SEQ ID NO: 2417313 - protein, 8 aa, Entamoeba dispar
DPVQPQEE

SEQ ID NO: 2417314 - protein, 11 aa, Entamoeba dispar
DPWNPPTPSNI

SEQ ID NO: 2417315 - protein, 13 aa, Entamoeba dispar
DPYCSQTTPVTEK

SEQ ID NO: 2417316 - protein, 6 aa, Entamoeba dispar
DPYDES

SEQ ID NO: 2417317 - protein, 11 aa, Entamoeba dispar
DPYDVPSTFRE

SEQ ID NO: 2417318 - protein, 4 aa, Entamoeba dispar
DPYK

SEQ ID NO: 2417319 - protein, 5 aa, Entamoeba dispar
DPYNV

SEQ ID NO: 2417320 - protein, 4 aa, Entamoeba dispar
DPYP

SEQ ID NO: 2417321 - protein, 5 aa, Entamoeba dispar
DPYSH

SEQ ID NO: 2417322 - protein, 7 aa, Entamoeba dispar
DPYSSSW

SEQ ID NO: 2417323 - protein, 4 aa, Entamoeba dispar
DPYY

SEQ ID NO: 2417324 - protein, 9 aa, Entamoeba dispar
DPYYPEKDP

SEQ ID NO: 2417325 - protein, 4 aa, Entamoeba dispar
DQAE

SEQ ID NO: 2417326 - protein, 10 aa, Entamoeba dispar
DQAKEKVYTQ

SEQ ID NO: 2417327 - protein, 9 aa, Entamoeba dispar
DQAKNTEKM

SEQ ID NO: 2417328 - protein, 7 aa, Entamoeba dispar
DQCTEED

SEQ ID NO: 2417329 - protein, 4 aa, Entamoeba dispar
DQDF

SEQ ID NO: 2417330 - protein, 5 aa, Entamoeba dispar
DQDID

SEQ ID NO: 2417331 - protein, 8 aa, Entamoeba dispar
DQDIDKSL

SEQ ID NO: 2417332 - protein, 10 aa, Entamoeba dispar
DQDIKKNNQI

SEQ ID NO: 2417333 - protein, 10 aa, Entamoeba dispar
DQDIKNNNQI

SEQ ID NO: 2417334 - protein, 9 aa, Entamoeba dispar
DQDKKEVSI

SEQ ID NO: 2417335 - protein, 6 aa, Entamoeba dispar
DQDPSV

SEQ ID NO: 2417336 - protein, 10 aa, Entamoeba dispar
DQDQSKRPRF

SEQ ID NO: 2417337 - protein, 4 aa, Entamoeba dispar
DQDV

SEQ ID NO: 2417338 - protein, 15 aa, Entamoeba dispar
DQEEEEEEEEEEEDD

SEQ ID NO: 2417339 - protein, 15 aa, Entamoeba dispar
DQEEHQNIPNDSQIG

SEQ ID NO: 2417340 - protein, 8 aa, Entamoeba dispar
DQEERERQ

SEQ ID NO: 2417341 - protein, 5 aa, Entamoeba dispar
DQEFE

SEQ ID NO: 2417342 - protein, 8 aa, Entamoeba dispar
DQEGNTPF

SEQ ID NO: 2417343 - protein, 5 aa, Entamoeba dispar
DQEIK

SEQ ID NO: 2417344 - protein, 9 aa, Entamoeba dispar
DQEKKSNEE

SEQ ID NO: 2417345 - protein, 6 aa, Entamoeba dispar
DQEKNF

SEQ ID NO: 2417346 - protein, 6 aa, Entamoeba dispar
DQELTD

SEQ ID NO: 2417347 - protein, 7 aa, Entamoeba dispar
DQETGDE

SEQ ID NO: 2417348 - protein, 8 aa, Entamoeba dispar
DQETSTDI

SEQ ID NO: 2417349 - protein, 6 aa, Entamoeba dispar
DQFDPL

SEQ ID NO: 2417350 - protein, 12 aa, Entamoeba dispar
DQFKQKLSTKTM

SEQ ID NO: 2417351 - protein, 13 aa, Entamoeba dispar
DQFPTQRITQTPG

SEQ ID NO: 2417352 - protein, 4 aa, Entamoeba dispar
DQFS

SEQ ID NO: 2417353 - protein, 7 aa, Entamoeba dispar
DQGAKYG

SEQ ID NO: 2417354 - protein, 8 aa, Entamoeba dispar
DQGEGEKL

SEQ ID NO: 2417355 - protein, 5 aa, Entamoeba dispar
DQGHS

SEQ ID NO: 2417356 - protein, 9 aa, Entamoeba dispar
DQGKDAEKF

SEQ ID NO: 2417357 - protein, 10 aa, Entamoeba dispar
DQGKIGAPEL

SEQ ID NO: 2417358 - protein, 8 aa, Entamoeba dispar
DQGQNNKI

SEQ ID NO: 2417359 - protein, 28 aa, Entamoeba dispar
DQHEEETKKENHINEVKEEEEKKEEGIL

SEQ ID NO: 2417360 - protein, 10 aa, Entamoeba dispar
DQHKEFANDD

SEQ ID NO: 2417361 - protein, 5 aa, Entamoeba dispar
DQIED

SEQ ID NO: 2417362 - protein, 5 aa, Entamoeba dispar
DQIEK

SEQ ID NO: 2417363 - protein, 28 aa, Entamoeba dispar
DQIESENTEIKNVPNISNGEEGTSDEEF

SEQ ID NO: 2417364 - protein, 10 aa, Entamoeba dispar
DQIKDVSNAC

SEQ ID NO: 2417365 - protein, 5 aa, Entamoeba dispar
DQIKE

SEQ ID NO: 2417366 - protein, 11 aa, Entamoeba dispar
DQIKQTAQPLM

SEQ ID NO: 2417367 - protein, 5 aa, Entamoeba dispar
DQINE

SEQ ID NO: 2417368 - protein, 13 aa, Entamoeba dispar
DQISQDDDTKTKD

SEQ ID NO: 2417369 - protein, 11 aa, Entamoeba dispar
DQKAEITTTSI

SEQ ID NO: 2417370 - protein, 4 aa, Entamoeba dispar
DQKC

SEQ ID NO: 2417371 - protein, 8 aa, Entamoeba dispar
DQKDSPNR

SEQ ID NO: 2417372 - protein, 5 aa, Entamoeba dispar
DQKDV

SEQ ID NO: 2417373 - protein, 10 aa, Entamoeba dispar
DQKEGRERNI

SEQ ID NO: 2417374 - protein, 10 aa, Entamoeba dispar
DQKEIDKSSV

SEQ ID NO: 2417375 - protein, 6 aa, Entamoeba dispar
DQKESL

SEQ ID NO: 2417376 - protein, 5 aa, Entamoeba dispar
DQKGF

SEQ ID NO: 2417377 - protein, 5 aa, Entamoeba dispar
DQKID

SEQ ID NO: 2417378 - protein, 5 aa, Entamoeba dispar
DQKIQ

SEQ ID NO: 2417379 - protein, 8 aa, Entamoeba dispar
DQKMAEES

SEQ ID NO: 2417380 - protein, 33 aa, Entamoeba dispar
DQKNEENKIKQPNKKRDNEKIEKKKLSVDPKRI

SEQ ID NO: 2417381 - protein, 7 aa, Entamoeba dispar
DQKNEQE

SEQ ID NO: 2417382 - protein, 14 aa, Entamoeba dispar
DQKPDNFEGSINEY

SEQ ID NO: 2417383 - protein, 30 aa, Entamoeba dispar
DQKPNQKPIRKPSSQKHREEEDDDNDTEEI

SEQ ID NO: 2417384 - protein, 7 aa, Entamoeba dispar
DQKPSGL

SEQ ID NO: 2417385 - protein, 10 aa, Entamoeba dispar
DQKQKCDEIE

SEQ ID NO: 2417386 - protein, 8 aa, Entamoeba dispar
DQKRNFKA

SEQ ID NO: 2417387 - protein, 8 aa, Entamoeba dispar
DQKSNSDD

SEQ ID NO: 2417388 - protein, 9 aa, Entamoeba dispar
DQKTGNITV

SEQ ID NO: 2417389 - protein, 8 aa, Entamoeba dispar
DQKTSLTP

SEQ ID NO: 2417390 - protein, 9 aa, Entamoeba dispar
DQKTSQKDV

SEQ ID NO: 2417391 - protein, 19 aa, Entamoeba dispar
DQLDRSGKLAKKNPPFLRS

SEQ ID NO: 2417392 - protein, 21 aa, Entamoeba dispar
DQLEADSAARQEEMKRQMEEE

SEQ ID NO: 2417393 - protein, 6 aa, Entamoeba dispar
DQLHPT

SEQ ID NO: 2417394 - protein, 16 aa, Entamoeba dispar
DQLNSDDISPAAVAWR

SEQ ID NO: 2417395 - protein, 6 aa, Entamoeba dispar
DQLNSI

SEQ ID NO: 2417396 - protein, 9 aa, Entamoeba dispar
DQLNTSKAK

SEQ ID NO: 2417397 - protein, 4 aa, Entamoeba dispar
DQLS

SEQ ID NO: 2417398 - protein, 11 aa, Entamoeba dispar
DQMAPPGKKGG

SEQ ID NO: 2417399 - protein, 5 aa, Entamoeba dispar
DQMEN

SEQ ID NO: 2417400 - protein, 4 aa, Entamoeba dispar
DQMF

SEQ ID NO: 2417401 - protein, 7 aa, Entamoeba dispar
DQNDLKR

SEQ ID NO: 2417402 - protein, 12 aa, Entamoeba dispar
DQNDNSDNNNTH

SEQ ID NO: 2417403 - protein, 6 aa, Entamoeba dispar
DQNETL

SEQ ID NO: 2417404 - protein, 14 aa, Entamoeba dispar
DQNEVEEDQEISRY

SEQ ID NO: 2417405 - protein, 5 aa, Entamoeba dispar
DQNEW

SEQ ID NO: 2417406 - protein, 7 aa, Entamoeba dispar
DQNGIKP

SEQ ID NO: 2417407 - protein, 5 aa, Entamoeba dispar
DQNGQ

SEQ ID NO: 2417408 - protein, 9 aa, Entamoeba dispar
DQNIPKQTI

SEQ ID NO: 2417409 - protein, 4 aa, Entamoeba dispar
DQNK

SEQ ID NO: 2417410 - protein, 9 aa, Entamoeba dispar
DQNKRPNIE

SEQ ID NO: 2417411 - protein, 8 aa, Entamoeba dispar
DQNNGKIE

SEQ ID NO: 2417412 - protein, 7 aa, Entamoeba dispar
DQNNYKK

SEQ ID NO: 2417413 - protein, 7 aa, Entamoeba dispar
DQNRATA

SEQ ID NO: 2417414 - protein, 6 aa, Entamoeba dispar
DQNSFE

SEQ ID NO: 2417415 - protein, 7 aa, Entamoeba dispar
DQNWNRS

SEQ ID NO: 2417416 - protein, 7 aa, Entamoeba dispar
DQPESNE

SEQ ID NO: 2417417 - protein, 6 aa, Entamoeba dispar
DQPEVS

SEQ ID NO: 2417418 - protein, 11 aa, Entamoeba dispar
DQPKTSIQPSR

SEQ ID NO: 2417419 - protein, 9 aa, Entamoeba dispar
DQPNVQGET

SEQ ID NO: 2417420 - protein, 4 aa, Entamoeba dispar
DQPQ

SEQ ID NO: 2417421 - protein, 7 aa, Entamoeba dispar
DQPQQEY

SEQ ID NO: 2417422 - protein, 13 aa, Entamoeba dispar
DQPTDNTTPPGKY

SEQ ID NO: 2417423 - protein, 4 aa, Entamoeba dispar
DQPV

SEQ ID NO: 2417424 - protein, 5 aa, Entamoeba dispar
DQQEF

SEQ ID NO: 2417425 - protein, 5 aa, Entamoeba dispar
DQQEN

SEQ ID NO: 2417426 - protein, 8 aa, Entamoeba dispar
DQQGTASV

SEQ ID NO: 2417427 - protein, 7 aa, Entamoeba dispar
DQQINGN

SEQ ID NO: 2417428 - protein, 12 aa, Entamoeba dispar
DQQIRDETEDTV

SEQ ID NO: 2417429 - protein, 5 aa, Entamoeba dispar
DQQKN

SEQ ID NO: 2417430 - protein, 7 aa, Entamoeba dispar
DQQKQDL

SEQ ID NO: 2417431 - protein, 7 aa, Entamoeba dispar
DQQNARI

SEQ ID NO: 2417432 - protein, 5 aa, Entamoeba dispar
DQQNS

SEQ ID NO: 2417433 - protein, 5 aa, Entamoeba dispar
DQQPF

SEQ ID NO: 2417434 - protein, 9 aa, Entamoeba dispar
DQQPPFPYP

SEQ ID NO: 2417435 - protein, 8 aa, Entamoeba dispar
DQQSRNKF

SEQ ID NO: 2417436 - protein, 6 aa, Entamoeba dispar
DQQTKA

SEQ ID NO: 2417437 - protein, 8 aa, Entamoeba dispar
DQRKTKCK

SEQ ID NO: 2417438 - protein, 7 aa, Entamoeba dispar
DQRRNQL

SEQ ID NO: 2417439 - protein, 6 aa, Entamoeba dispar
DQRSPG

SEQ ID NO: 2417440 - protein, 53 aa, Entamoeba dispar
DQRSQLKKTNPQKQTPSVTKSAAKPITPTHFTPGNQSSSPKITTKTYTPYSSS

SEQ ID NO: 2417441 - protein, 4 aa, Entamoeba dispar
DQRT

SEQ ID NO: 2417442 - protein, 6 aa, Entamoeba dispar
DQRYVP

SEQ ID NO: 2417443 - protein, 10 aa, Entamoeba dispar
DQSDRNRTSP

SEQ ID NO: 2417444 - protein, 10 aa, Entamoeba dispar
DQSDSTVIKS

SEQ ID NO: 2417445 - protein, 7 aa, Entamoeba dispar
DQSEVED

SEQ ID NO: 2417446 - protein, 5 aa, Entamoeba dispar
DQSFG

SEQ ID NO: 2417447 - protein, 7 aa, Entamoeba dispar
DQSGKSI

SEQ ID NO: 2417448 - protein, 11 aa, Entamoeba dispar
DQSGKSSAAQR

SEQ ID NO: 2417449 - protein, 8 aa, Entamoeba dispar
DQSGSLDI

SEQ ID NO: 2417450 - protein, 6 aa, Entamoeba dispar
DQSGTI

SEQ ID NO: 2417451 - protein, 11 aa, Entamoeba dispar
DQSGYQPTYDS

SEQ ID NO: 2417452 - protein, 6 aa, Entamoeba dispar
DQSIKG

SEQ ID NO: 2417453 - protein, 7 aa, Entamoeba dispar
DQSKGIE

SEQ ID NO: 2417454 - protein, 5 aa, Entamoeba dispar
DQSKI

SEQ ID NO: 2417455 - protein, 14 aa, Entamoeba dispar
DQSLENIGYSKAVI

SEQ ID NO: 2417456 - protein, 13 aa, Entamoeba dispar
DQSLNQSDSDDFR

SEQ ID NO: 2417457 - protein, 11 aa, Entamoeba dispar
DQSNDLSTTSK

SEQ ID NO: 2417458 - protein, 14 aa, Entamoeba dispar
DQSPADPNEFTEEK

SEQ ID NO: 2417459 - protein, 7 aa, Entamoeba dispar
DQSSDVY

SEQ ID NO: 2417460 - protein, 8 aa, Entamoeba dispar
DQSSSDTL

SEQ ID NO: 2417461 - protein, 6 aa, Entamoeba dispar
DQSTYN

SEQ ID NO: 2417462 - protein, 5 aa, Entamoeba dispar
DQSVC

SEQ ID NO: 2417463 - protein, 11 aa, Entamoeba dispar
DQSYKTNVIND

SEQ ID NO: 2417464 - protein, 27 aa, Entamoeba dispar
DQTASEEIEMDNEESESDSTTPTSNDS

SEQ ID NO: 2417465 - protein, 4 aa, Entamoeba dispar
DQTI

SEQ ID NO: 2417466 - protein, 11 aa, Entamoeba dispar
DQTIDKPVRER

SEQ ID NO: 2417467 - protein, 8 aa, Entamoeba dispar
DQTKFGEG

SEQ ID NO: 2417468 - protein, 25 aa, Entamoeba dispar
DQTKNTSQEHDKVSNKEEKMEEESI

SEQ ID NO: 2417469 - protein, 6 aa, Entamoeba dispar
DQTKTY

SEQ ID NO: 2417470 - protein, 7 aa, Entamoeba dispar
DQTLNNA

SEQ ID NO: 2417471 - protein, 7 aa, Entamoeba dispar
DQTLRPT

SEQ ID NO: 2417472 - protein, 7 aa, Entamoeba dispar
DQTLSVN

SEQ ID NO: 2417473 - protein, 5 aa, Entamoeba dispar
DQTNQ

SEQ ID NO: 2417474 - protein, 7 aa, Entamoeba dispar
DQTPNTI

SEQ ID NO: 2417475 - protein, 8 aa, Entamoeba dispar
DQTREINK

SEQ ID NO: 2417476 - protein, 4 aa, Entamoeba dispar
DQTT

SEQ ID NO: 2417477 - protein, 24 aa, Entamoeba dispar
DQTVKPSNYLSTSVEEEKKIGKRN

SEQ ID NO: 2417478 - protein, 6 aa, Entamoeba dispar
DQTYDH

SEQ ID NO: 2417479 - protein, 12 aa, Entamoeba dispar
DQVAASSSFSKA

SEQ ID NO: 2417480 - protein, 9 aa, Entamoeba dispar
DQVEGKEQV

SEQ ID NO: 2417481 - protein, 12 aa, Entamoeba dispar
DQVEKKRKAISK

SEQ ID NO: 2417482 - protein, 13 aa, Entamoeba dispar
DQVGEELTENPTI

SEQ ID NO: 2417483 - protein, 8 aa, Entamoeba dispar
DQVTPNEE

SEQ ID NO: 2417484 - protein, 24 aa, Entamoeba dispar
DQWKKESNTINDDYEKNEKEMNNT

SEQ ID NO: 2417485 - protein, 4 aa, Entamoeba dispar
DQYG

SEQ ID NO: 2417486 - protein, 10 aa, Entamoeba dispar
DQYGEEIPRD

SEQ ID NO: 2417487 - protein, 5 aa, Entamoeba dispar
DQYGN

SEQ ID NO: 2417488 - protein, 7 aa, Entamoeba dispar
DQYNNQG

SEQ ID NO: 2417489 - protein, 12 aa, Entamoeba dispar
DQYTSDIKDALE

SEQ ID NO: 2417490 - protein, 4 aa, Entamoeba dispar
DRAI

SEQ ID NO: 2417491 - protein, 6 aa, Entamoeba dispar
DRASCT

SEQ ID NO: 2417492 - protein, 6 aa, Entamoeba dispar
DRASFD

SEQ ID NO: 2417493 - protein, 9 aa, Entamoeba dispar
DRAVNQEPI

SEQ ID NO: 2417494 - protein, 5 aa, Entamoeba dispar
DRDDA

SEQ ID NO: 2417495 - protein, 6 aa, Entamoeba dispar
DRDEMQ

SEQ ID NO: 2417496 - protein, 6 aa, Entamoeba dispar
DRDGIH

SEQ ID NO: 2417497 - protein, 16 aa, Entamoeba dispar
DRDVSEKEGKDKAAEL

SEQ ID NO: 2417498 - protein, 15 aa, Entamoeba dispar
DRECVEEKENESYDK

SEQ ID NO: 2417499 - protein, 8 aa, Entamoeba dispar
DREERNYI

SEQ ID NO: 2417500 - protein, 5 aa, Entamoeba dispar
DREES

SEQ ID NO: 2417501 - protein, 13 aa, Entamoeba dispar
DREEYGNVIPPEV

SEQ ID NO: 2417502 - protein, 8 aa, Entamoeba dispar
DREHVNEA

SEQ ID NO: 2417503 - protein, 5 aa, Entamoeba dispar
DREIL

SEQ ID NO: 2417504 - protein, 8 aa, Entamoeba dispar
DREKELKN

SEQ ID NO: 2417505 - protein, 36 aa, Entamoeba dispar
DREKEVKEKERKSIEKVKGEIENETKQIKMERSRIK

SEQ ID NO: 2417506 - protein, 9 aa, Entamoeba dispar
DREKNKDQY

SEQ ID NO: 2417507 - protein, 17 aa, Entamoeba dispar
DRELDGSAKTMLNDESR

SEQ ID NO: 2417508 - protein, 5 aa, Entamoeba dispar
DREPI

SEQ ID NO: 2417509 - protein, 8 aa, Entamoeba dispar
DREQHELE

SEQ ID NO: 2417510 - protein, 7 aa, Entamoeba dispar
DRERQRL

SEQ ID NO: 2417511 - protein, 7 aa, Entamoeba dispar
DRETAQS

SEQ ID NO: 2417512 - protein, 6 aa, Entamoeba dispar
DRETEE

SEQ ID NO: 2417513 - protein, 8 aa, Entamoeba dispar
DRFPQTNK

SEQ ID NO: 2417514 - protein, 5 aa, Entamoeba dispar
DRGDY

SEQ ID NO: 2417515 - protein, 6 aa, Entamoeba dispar
DRGDYS

SEQ ID NO: 2417516 - protein, 5 aa, Entamoeba dispar
DRGEY

SEQ ID NO: 2417517 - protein, 7 aa, Entamoeba dispar
DRGKNGV

SEQ ID NO: 2417518 - protein, 7 aa, Entamoeba dispar
DRGKNSI

SEQ ID NO: 2417519 - protein, 7 aa, Entamoeba dispar
DRGKNSV

SEQ ID NO: 2417520 - protein, 6 aa, Entamoeba dispar
DRGKYG

SEQ ID NO: 2417521 - protein, 9 aa, Entamoeba dispar
DRGMGNSNI

SEQ ID NO: 2417522 - protein, 5 aa, Entamoeba dispar
DRGNG

SEQ ID NO: 2417523 - protein, 6 aa, Entamoeba dispar
DRGQMG

SEQ ID NO: 2417524 - protein, 13 aa, Entamoeba dispar
DRGRLGDKDIGKA

SEQ ID NO: 2417525 - protein, 4 aa, Entamoeba dispar
DRGS

SEQ ID NO: 2417526 - protein, 5 aa, Entamoeba dispar
DRGTH

SEQ ID NO: 2417527 - protein, 5 aa, Entamoeba dispar
DRGTM

SEQ ID NO: 2417528 - protein, 9 aa, Entamoeba dispar
DRGYTLDDQ

SEQ ID NO: 2417529 - protein, 5 aa, Entamoeba dispar
DRHND

SEQ ID NO: 2417530 - protein, 5 aa, Entamoeba dispar
DRHNG

SEQ ID NO: 2417531 - protein, 10 aa, Entamoeba dispar
DRHNGKYDVK

SEQ ID NO: 2417532 - protein, 5 aa, Entamoeba dispar
DRHPQ

SEQ ID NO: 2417533 - protein, 10 aa, Entamoeba dispar
DRIDQAGDDI

SEQ ID NO: 2417534 - protein, 11 aa, Entamoeba dispar
DRIGKDDKLGK

SEQ ID NO: 2417535 - protein, 37 aa, Entamoeba dispar
DRIGYRSNRRKTRREYSRSEDREDRHRRVAEEEHYNR

SEQ ID NO: 2417536 - protein, 11 aa, Entamoeba dispar
DRIPSERERDH

SEQ ID NO: 2417537 - protein, 4 aa, Entamoeba dispar
DRIS

SEQ ID NO: 2417538 - protein, 11 aa, Entamoeba dispar
DRITDDETSVT

SEQ ID NO: 2417539 - protein, 20 aa, Entamoeba dispar
DRKDNIPESTISRRVQERRR

SEQ ID NO: 2417540 - protein, 6 aa, Entamoeba dispar
DRKEEL

SEQ ID NO: 2417541 - protein, 7 aa, Entamoeba dispar
DRKEMNA

SEQ ID NO: 2417542 - protein, 5 aa, Entamoeba dispar
DRKEY

SEQ ID NO: 2417543 - protein, 9 aa, Entamoeba dispar
DRKGNNAES

SEQ ID NO: 2417544 - protein, 10 aa, Entamoeba dispar
DRKIEKTNRS

SEQ ID NO: 2417545 - protein, 8 aa, Entamoeba dispar
DRKKERKR

SEQ ID NO: 2417546 - protein, 12 aa, Entamoeba dispar
DRKKYGNTIPPE

SEQ ID NO: 2417547 - protein, 7 aa, Entamoeba dispar
DRKPTLS

SEQ ID NO: 2417548 - protein, 4 aa, Entamoeba dispar
DRKQ

SEQ ID NO: 2417549 - protein, 6 aa, Entamoeba dispar
DRKSLR

SEQ ID NO: 2417550 - protein, 16 aa, Entamoeba dispar
DRKSNPARRERPQEAA

SEQ ID NO: 2417551 - protein, 20 aa, Entamoeba dispar
DRKTGELKTKIQQKIENKGI

SEQ ID NO: 2417552 - protein, 9 aa, Entamoeba dispar
DRLEEDLSN

SEQ ID NO: 2417553 - protein, 9 aa, Entamoeba dispar
DRLKDGGYG

SEQ ID NO: 2417554 - protein, 4 aa, Entamoeba dispar
DRLP

SEQ ID NO: 2417555 - protein, 5 aa, Entamoeba dispar
DRLSA

SEQ ID NO: 2417556 - protein, 6 aa, Entamoeba dispar
DRLSNE

SEQ ID NO: 2417557 - protein, 11 aa, Entamoeba dispar
DRLSNVNEATR

SEQ ID NO: 2417558 - protein, 8 aa, Entamoeba dispar
DRLSQSTS

SEQ ID NO: 2417559 - protein, 6 aa, Entamoeba dispar
DRMRDD

SEQ ID NO: 2417560 - protein, 7 aa, Entamoeba dispar
DRNDEDL

SEQ ID NO: 2417561 - protein, 7 aa, Entamoeba dispar
DRNDFSS

SEQ ID NO: 2417562 - protein, 10 aa, Entamoeba dispar
DRNDKFPDKR

SEQ ID NO: 2417563 - protein, 5 aa, Entamoeba dispar
DRNEL

SEQ ID NO: 2417564 - protein, 15 aa, Entamoeba dispar
DRNINNQQEASEKFK

SEQ ID NO: 2417565 - protein, 13 aa, Entamoeba dispar
DRNKYGTTIPSEV

SEQ ID NO: 2417566 - protein, 14 aa, Entamoeba dispar
DRNKYGTTIPSEVK

SEQ ID NO: 2417567 - protein, 5 aa, Entamoeba dispar
DRNNH

SEQ ID NO: 2417568 - protein, 7 aa, Entamoeba dispar
DRNQRKI

SEQ ID NO: 2417569 - protein, 8 aa, Entamoeba dispar
DRNSERQV

SEQ ID NO: 2417570 - protein, 7 aa, Entamoeba dispar
DRNSFES

SEQ ID NO: 2417571 - protein, 6 aa, Entamoeba dispar
DRNTFE

SEQ ID NO: 2417572 - protein, 4 aa, Entamoeba dispar
DRPA

SEQ ID NO: 2417573 - protein, 7 aa, Entamoeba dispar
DRPAGKG

SEQ ID NO: 2417574 - protein, 5 aa, Entamoeba dispar
DRPDE

SEQ ID NO: 2417575 - protein, 9 aa, Entamoeba dispar
DRPEDAAKA

SEQ ID NO: 2417576 - protein, 5 aa, Entamoeba dispar
DRPES

SEQ ID NO: 2417577 - protein, 7 aa, Entamoeba dispar
DRPFPPY

SEQ ID NO: 2417578 - protein, 39 aa, Entamoeba dispar
DRPSVKRKPTSAAGDLLSPNSGNSPCKSTASTPRSENGL

SEQ ID NO: 2417579 - protein, 6 aa, Entamoeba dispar
DRPTEI

SEQ ID NO: 2417580 - protein, 7 aa, Entamoeba dispar
DRPTFQE

SEQ ID NO: 2417581 - protein, 9 aa, Entamoeba dispar
DRQDSITKT

SEQ ID NO: 2417582 - protein, 9 aa, Entamoeba dispar
DRQDYDDAH

SEQ ID NO: 2417583 - protein, 8 aa, Entamoeba dispar
DRQKTANK

SEQ ID NO: 2417584 - protein, 5 aa, Entamoeba dispar
DRQLQ

SEQ ID NO: 2417585 - protein, 11 aa, Entamoeba dispar
DRQNDLNELQQ

SEQ ID NO: 2417586 - protein, 10 aa, Entamoeba dispar
DRQNEEREKI

SEQ ID NO: 2417587 - protein, 4 aa, Entamoeba dispar
DRQR

SEQ ID NO: 2417588 - protein, 4 aa, Entamoeba dispar
DRQS

SEQ ID NO: 2417589 - protein, 5 aa, Entamoeba dispar
DRREV

SEQ ID NO: 2417590 - protein, 5 aa, Entamoeba dispar
DRRIE

SEQ ID NO: 2417591 - protein, 10 aa, Entamoeba dispar
DRRKYGNTIP

SEQ ID NO: 2417592 - protein, 42 aa, Entamoeba dispar
DRRPPPTPIARSTPSTGAPTTSNVATTSVQAAPANIPPPPIA

SEQ ID NO: 2417593 - protein, 6 aa, Entamoeba dispar
DRRQQY

SEQ ID NO: 2417594 - protein, 4 aa, Entamoeba dispar
DRRT

SEQ ID NO: 2417595 - protein, 7 aa, Entamoeba dispar
DRRYKNR

SEQ ID NO: 2417596 - protein, 17 aa, Entamoeba dispar
DRSCGNDSSNITNIDGL

SEQ ID NO: 2417597 - protein, 8 aa, Entamoeba dispar
DRSDEVKR

SEQ ID NO: 2417598 - protein, 18 aa, Entamoeba dispar
DRSEFDKKYTKENEIGQG

SEQ ID NO: 2417599 - protein, 6 aa, Entamoeba dispar
DRSERF

SEQ ID NO: 2417600 - protein, 5 aa, Entamoeba dispar
DRSGT

SEQ ID NO: 2417601 - protein, 5 aa, Entamoeba dispar
DRSKR

SEQ ID NO: 2417602 - protein, 12 aa, Entamoeba dispar
DRSKSYAKKESC

SEQ ID NO: 2417603 - protein, 21 aa, Entamoeba dispar
DRSNKTKTATPSVSPDNTLRE

SEQ ID NO: 2417604 - protein, 118 aa, Entamoeba dispar
DRSPSDKKNEFDKRYNRDYDKRYEETKPRRPDSNRPQRPTNKRPTQDRRPSQKDKPGNRPENKRPVQDRKPTNPNRQPVDQKKPRQPIRPEQGKPTSPNNNPAQKPSKIDDKYDPDLG

SEQ ID NO: 2417605 - protein, 118 aa, Entamoeba dispar
DRSPSDKKNEFDKRYNRDYDKRYKETKPRRPDSNRPQRPTNKRPTQDRRPSQKDKPTNRPENKRPVQDRKPTNANRQPVDQKKPRQPNRPEQGKPTNPNNNPTQKPSKIDDKYDPDLG

SEQ ID NO: 2417606 - protein, 117 aa, Entamoeba dispar
DRSPSDKRNEFDKRYNRDYDKRHEETKPRRPDSNRPQRPTNKRPTQDRRPSQKDKPSNRPENKRPVQDRKPTNSNRQPVDQKKPRQPTRPEQRKPTNPNNNPAQKPSKIDDRYDPDL

SEQ ID NO: 2417607 - protein, 111 aa, Entamoeba dispar
DRSPSDKRNEFDKRYNRDYDKRHEETKPRRPDSNRPQRPTNKRPTQDRRPSQKDKPSNRPENKRPVQDRKPVDQKKPRQPTRPEQRKPTNPNNNPTQKPSKVDDKYDPDLG

SEQ ID NO: 2417608 - protein, 106 aa, Entamoeba dispar
DRSPSNKRNEFDKRYNRDYDKRHEETKPRRPDSNRPQRPTNKRPTQDRRPSQKDKPINRPENKRPVQDRRPDSIKKPRHPSQPEQRKPIRPTQKPSKINDKYDPDL

SEQ ID NO: 2417609 - protein, 118 aa, Entamoeba dispar
DRSPSNKRNEFDKRYNRDYDKRYEETKPRRPDSNRPQRPTNKRPTQDRRPSQKDKPGNRPENKRPVQDRKPTNPNRQPVDQKKPRQPTRPEQGKPTNPNNNPTQKPSKIDDKYDPDLG

SEQ ID NO: 2417610 - protein, 8 aa, Entamoeba dispar
DRSRVEAQ

SEQ ID NO: 2417611 - protein, 26 aa, Entamoeba dispar
DRSTSIDEEDDSIDNSKPKTRKLPDA

SEQ ID NO: 2417612 - protein, 7 aa, Entamoeba dispar
DRTDSNS

SEQ ID NO: 2417613 - protein, 6 aa, Entamoeba dispar
DRTEEE

SEQ ID NO: 2417614 - protein, 11 aa, Entamoeba dispar
DRTEPLGEQEA

SEQ ID NO: 2417615 - protein, 7 aa, Entamoeba dispar
DRTGAGT

SEQ ID NO: 2417616 - protein, 8 aa, Entamoeba dispar
DRTGESKA

SEQ ID NO: 2417617 - protein, 7 aa, Entamoeba dispar
DRTGKYY

SEQ ID NO: 2417618 - protein, 10 aa, Entamoeba dispar
DRTIRKGGLR

SEQ ID NO: 2417619 - protein, 7 aa, Entamoeba dispar
DRTKSCE

SEQ ID NO: 2417620 - protein, 5 aa, Entamoeba dispar
DRTLQ

SEQ ID NO: 2417621 - protein, 4 aa, Entamoeba dispar
DRTN

SEQ ID NO: 2417622 - protein, 7 aa, Entamoeba dispar
DRTNDGF

SEQ ID NO: 2417623 - protein, 44 aa, Entamoeba dispar
DRTNEYEAKETKRNPKSKSSKKRRESKPRKSSNKKGFVKRMTSK

SEQ ID NO: 2417624 - protein, 9 aa, Entamoeba dispar
DRTNNSPIR

SEQ ID NO: 2417625 - protein, 10 aa, Entamoeba dispar
DRTNTNKALS

SEQ ID NO: 2417626 - protein, 8 aa, Entamoeba dispar
DRTPKQSK

SEQ ID NO: 2417627 - protein, 6 aa, Entamoeba dispar
DRTQGK

SEQ ID NO: 2417628 - protein, 36 aa, Entamoeba dispar
DRTQGNLARQAKESRKLQRKTRKQEKIKKMKDPINK

SEQ ID NO: 2417629 - protein, 37 aa, Entamoeba dispar
DRTQGNLERQAKESRKLQRKTRKQEKIKKMKDPINKI

SEQ ID NO: 2417630 - protein, 6 aa, Entamoeba dispar
DRTQRI

SEQ ID NO: 2417631 - protein, 6 aa, Entamoeba dispar
DRTYPF

SEQ ID NO: 2417632 - protein, 10 aa, Entamoeba dispar
DRVGAKNCSS

SEQ ID NO: 2417633 - protein, 6 aa, Entamoeba dispar
DRVNGQ

SEQ ID NO: 2417634 - protein, 11 aa, Entamoeba dispar
DRVPSDLSSMT

SEQ ID NO: 2417635 - protein, 7 aa, Entamoeba dispar
DRVPVGG

SEQ ID NO: 2417636 - protein, 4 aa, Entamoeba dispar
DRYH

SEQ ID NO: 2417637 - protein, 17 aa, Entamoeba dispar
DRYKNDLKRADSNIALS

SEQ ID NO: 2417638 - protein, 5 aa, Entamoeba dispar
DRYPS

SEQ ID NO: 2417639 - protein, 5 aa, Entamoeba dispar
DSADS

SEQ ID NO: 2417640 - protein, 11 aa, Entamoeba dispar
DSAEKDQEDKV

SEQ ID NO: 2417641 - protein, 13 aa, Entamoeba dispar
DSAENKTNSVDSI

SEQ ID NO: 2417642 - protein, 9 aa, Entamoeba dispar
DSAGSPTVI

SEQ ID NO: 2417643 - protein, 18 aa, Entamoeba dispar
DSAIKKAKAEGKPNPYPF

SEQ ID NO: 2417644 - protein, 10 aa, Entamoeba dispar
DSAKADVEKL

SEQ ID NO: 2417645 - protein, 10 aa, Entamoeba dispar
DSAKPGDRIE

SEQ ID NO: 2417646 - protein, 31 aa, Entamoeba dispar
DSALEQSDAKMEKKKKKREEMEEKKRKQLYE

SEQ ID NO: 2417647 - protein, 11 aa, Entamoeba dispar
DSALPRTPRNH

SEQ ID NO: 2417648 - protein, 15 aa, Entamoeba dispar
DSAMPKLPQELLSEL

SEQ ID NO: 2417649 - protein, 8 aa, Entamoeba dispar
DSANDQTI

SEQ ID NO: 2417650 - protein, 16 aa, Entamoeba dispar
DSANEPTDQQKEENKK

SEQ ID NO: 2417651 - protein, 25 aa, Entamoeba dispar
DSAPSTPRVEHEARRTKNGIRETSL

SEQ ID NO: 2417652 - protein, 13 aa, Entamoeba dispar
DSASEHDNVSKQQ

SEQ ID NO: 2417653 - protein, 9 aa, Entamoeba dispar
DSCGGDDYV

SEQ ID NO: 2417654 - protein, 9 aa, Entamoeba dispar
DSCKARKKI

SEQ ID NO: 2417655 - protein, 14 aa, Entamoeba dispar
DSCKSYRFNNSNNQ

SEQ ID NO: 2417656 - protein, 4 aa, Entamoeba dispar
DSCP

SEQ ID NO: 2417657 - protein, 6 aa, Entamoeba dispar
DSCSVG

SEQ ID NO: 2417658 - protein, 7 aa, Entamoeba dispar
DSDALDR

SEQ ID NO: 2417659 - protein, 9 aa, Entamoeba dispar
DSDDGRATR

SEQ ID NO: 2417660 - protein, 10 aa, Entamoeba dispar
DSDDKTSATA

SEQ ID NO: 2417661 - protein, 10 aa, Entamoeba dispar
DSDECGDGRY

SEQ ID NO: 2417662 - protein, 8 aa, Entamoeba dispar
DSDELPIE

SEQ ID NO: 2417663 - protein, 6 aa, Entamoeba dispar
DSDELY

SEQ ID NO: 2417664 - protein, 9 aa, Entamoeba dispar
DSDESKDDL

SEQ ID NO: 2417665 - protein, 19 aa, Entamoeba dispar
DSDFEYSTQSYTGYEPTSM

SEQ ID NO: 2417666 - protein, 14 aa, Entamoeba dispar
DSDGNASLSAEEIT

SEQ ID NO: 2417667 - protein, 10 aa, Entamoeba dispar
DSDGQESPIE

SEQ ID NO: 2417668 - protein, 9 aa, Entamoeba dispar
DSDHPSEAL

SEQ ID NO: 2417669 - protein, 5 aa, Entamoeba dispar
DSDID

SEQ ID NO: 2417670 - protein, 18 aa, Entamoeba dispar
DSDIERDSNEIEKQEDLY

SEQ ID NO: 2417671 - protein, 7 aa, Entamoeba dispar
DSDNDIQ

SEQ ID NO: 2417672 - protein, 23 aa, Entamoeba dispar
DSDNDTGYFEDERGMKQSHMKKD

SEQ ID NO: 2417673 - protein, 8 aa, Entamoeba dispar
DSDPVRQA

SEQ ID NO: 2417674 - protein, 4 aa, Entamoeba dispar
DSDR

SEQ ID NO: 2417675 - protein, 32 aa, Entamoeba dispar
DSDRPIEEQENSQPNEVPKQEGDDKLPSFGDD

SEQ ID NO: 2417676 - protein, 8 aa, Entamoeba dispar
DSDSDTIT

SEQ ID NO: 2417677 - protein, 8 aa, Entamoeba dispar
DSDSFNSV

SEQ ID NO: 2417678 - protein, 6 aa, Entamoeba dispar
DSDSLS

SEQ ID NO: 2417679 - protein, 14 aa, Entamoeba dispar
DSDSPAEKAGLQEG

SEQ ID NO: 2417680 - protein, 9 aa, Entamoeba dispar
DSDSSYVQR

SEQ ID NO: 2417681 - protein, 7 aa, Entamoeba dispar
DSDSVSN

SEQ ID NO: 2417682 - protein, 8 aa, Entamoeba dispar
DSDVPLPL

SEQ ID NO: 2417683 - protein, 4 aa, Entamoeba dispar
DSDW

SEQ ID NO: 2417684 - protein, 10 aa, Entamoeba dispar
DSEDGKRWSK

SEQ ID NO: 2417685 - protein, 6 aa, Entamoeba dispar
DSEDLP

SEQ ID NO: 2417686 - protein, 7 aa, Entamoeba dispar
DSEDLTK

SEQ ID NO: 2417687 - protein, 9 aa, Entamoeba dispar
DSEEEEVQQ

SEQ ID NO: 2417688 - protein, 25 aa, Entamoeba dispar
DSEEEGLGYSDDEIQEEQEQDEETN

SEQ ID NO: 2417689 - protein, 9 aa, Entamoeba dispar
DSEEETELD

SEQ ID NO: 2417690 - protein, 20 aa, Entamoeba dispar
DSEEKIEKIKRNKETSQGIY

SEQ ID NO: 2417691 - protein, 11 aa, Entamoeba dispar
DSEEQEPNRSC

SEQ ID NO: 2417692 - protein, 13 aa, Entamoeba dispar
DSEETYCIGTISY

SEQ ID NO: 2417693 - protein, 15 aa, Entamoeba dispar
DSEEYGYDSNTLNQQ

SEQ ID NO: 2417694 - protein, 4 aa, Entamoeba dispar
DSEH

SEQ ID NO: 2417695 - protein, 14 aa, Entamoeba dispar
DSEKELDKKGKSLS

SEQ ID NO: 2417696 - protein, 6 aa, Entamoeba dispar
DSEKIP

SEQ ID NO: 2417697 - protein, 10 aa, Entamoeba dispar
DSEKKKYSEI

SEQ ID NO: 2417698 - protein, 42 aa, Entamoeba dispar
DSEKRKLKSTETRGQLSTQNDIPENEKTESDNTETISEDFGS

SEQ ID NO: 2417699 - protein, 4 aa, Entamoeba dispar
DSEL

SEQ ID NO: 2417700 - protein, 8 aa, Entamoeba dispar
DSENDITG

SEQ ID NO: 2417701 - protein, 7 aa, Entamoeba dispar
DSENTNT

SEQ ID NO: 2417702 - protein, 6 aa, Entamoeba dispar
DSEPLR

SEQ ID NO: 2417703 - protein, 10 aa, Entamoeba dispar
DSEPSSQDKI

SEQ ID NO: 2417704 - protein, 10 aa, Entamoeba dispar
DSEQQETKKH

SEQ ID NO: 2417705 - protein, 5 aa, Entamoeba dispar
DSERL

SEQ ID NO: 2417706 - protein, 7 aa, Entamoeba dispar
DSERNSI

SEQ ID NO: 2417707 - protein, 6 aa, Entamoeba dispar
DSESLN

SEQ ID NO: 2417708 - protein, 6 aa, Entamoeba dispar
DSETAI

SEQ ID NO: 2417709 - protein, 6 aa, Entamoeba dispar
DSETET

SEQ ID NO: 2417710 - protein, 6 aa, Entamoeba dispar
DSETQF

SEQ ID NO: 2417711 - protein, 6 aa, Entamoeba dispar
DSETTC

SEQ ID NO: 2417712 - protein, 6 aa, Entamoeba dispar
DSETYG

SEQ ID NO: 2417713 - protein, 7 aa, Entamoeba dispar
DSETYGK

SEQ ID NO: 2417714 - protein, 27 aa, Entamoeba dispar
DSEVIPKETKMEEEQIKDVNNQHTYTK

SEQ ID NO: 2417715 - protein, 5 aa, Entamoeba dispar
DSFDE

SEQ ID NO: 2417716 - protein, 8 aa, Entamoeba dispar
DSFDNNGK

SEQ ID NO: 2417717 - protein, 7 aa, Entamoeba dispar
DSFDSTP

SEQ ID NO: 2417718 - protein, 16 aa, Entamoeba dispar
DSFDVEPKAKCKRTER

SEQ ID NO: 2417719 - protein, 8 aa, Entamoeba dispar
DSFEPYSP

SEQ ID NO: 2417720 - protein, 6 aa, Entamoeba dispar
DSFKKE

SEQ ID NO: 2417721 - protein, 6 aa, Entamoeba dispar
DSFNRK

SEQ ID NO: 2417722 - protein, 6 aa, Entamoeba dispar
DSFPKD

SEQ ID NO: 2417723 - protein, 7 aa, Entamoeba dispar
DSFPSKE

SEQ ID NO: 2417724 - protein, 5 aa, Entamoeba dispar
DSFRE

SEQ ID NO: 2417725 - protein, 8 aa, Entamoeba dispar
DSFRPSQE

SEQ ID NO: 2417726 - protein, 4 aa, Entamoeba dispar
DSFS

SEQ ID NO: 2417727 - protein, 6 aa, Entamoeba dispar
DSFTAG

SEQ ID NO: 2417728 - protein, 14 aa, Entamoeba dispar
DSFTQNTKKPQIKE

SEQ ID NO: 2417729 - protein, 7 aa, Entamoeba dispar
DSFVGSQ

SEQ ID NO: 2417730 - protein, 14 aa, Entamoeba dispar
DSGADKKARNVQHR

SEQ ID NO: 2417731 - protein, 6 aa, Entamoeba dispar
DSGDGV

SEQ ID NO: 2417732 - protein, 7 aa, Entamoeba dispar
DSGDIDT

SEQ ID NO: 2417733 - protein, 8 aa, Entamoeba dispar
DSGEKELE

SEQ ID NO: 2417734 - protein, 10 aa, Entamoeba dispar
DSGENDPNRC

SEQ ID NO: 2417735 - protein, 10 aa, Entamoeba dispar
DSGENNPNRC

SEQ ID NO: 2417736 - protein, 29 aa, Entamoeba dispar
DSGERREEAVPTEQPQEEVHEEEVHEEEV

SEQ ID NO: 2417737 - protein, 6 aa, Entamoeba dispar
DSGESI

SEQ ID NO: 2417738 - protein, 6 aa, Entamoeba dispar
DSGETL

SEQ ID NO: 2417739 - protein, 6 aa, Entamoeba dispar
DSGEVA

SEQ ID NO: 2417740 - protein, 6 aa, Entamoeba dispar
DSGEYG

SEQ ID NO: 2417741 - protein, 4 aa, Entamoeba dispar
DSGI

SEQ ID NO: 2417742 - protein, 9 aa, Entamoeba dispar
DSGKSTTVG

SEQ ID NO: 2417743 - protein, 10 aa, Entamoeba dispar
DSGKTDDAKW

SEQ ID NO: 2417744 - protein, 5 aa, Entamoeba dispar
DSGNN

SEQ ID NO: 2417745 - protein, 5 aa, Entamoeba dispar
DSGNS

SEQ ID NO: 2417746 - protein, 9 aa, Entamoeba dispar
DSGNVYEGD

SEQ ID NO: 2417747 - protein, 6 aa, Entamoeba dispar
DSGQFG

SEQ ID NO: 2417748 - protein, 13 aa, Entamoeba dispar
DSGSDPKSSFKKH

SEQ ID NO: 2417749 - protein, 7 aa, Entamoeba dispar
DSGVGKS

SEQ ID NO: 2417750 - protein, 8 aa, Entamoeba dispar
DSGVGKSS

SEQ ID NO: 2417751 - protein, 8 aa, Entamoeba dispar
DSGVGKTS

SEQ ID NO: 2417752 - protein, 6 aa, Entamoeba dispar
DSGYKA

SEQ ID NO: 2417753 - protein, 17 aa, Entamoeba dispar
DSHEENQTKSVNKIQKP

SEQ ID NO: 2417754 - protein, 18 aa, Entamoeba dispar
DSHQNTITKEEEKKEKFD

SEQ ID NO: 2417755 - protein, 8 aa, Entamoeba dispar
DSHSDNAC

SEQ ID NO: 2417756 - protein, 18 aa, Entamoeba dispar
DSHSISNQVQSNNQPQIS

SEQ ID NO: 2417757 - protein, 12 aa, Entamoeba dispar
DSHSPSPQEKET

SEQ ID NO: 2417758 - protein, 5 aa, Entamoeba dispar
DSHTI

SEQ ID NO: 2417759 - protein, 11 aa, Entamoeba dispar
DSHTTEETKSS

SEQ ID NO: 2417760 - protein, 7 aa, Entamoeba dispar
DSIDPQN

SEQ ID NO: 2417761 - protein, 13 aa, Entamoeba dispar
DSIEEEKQKNRFE

SEQ ID NO: 2417762 - protein, 5 aa, Entamoeba dispar
DSIEG

SEQ ID NO: 2417763 - protein, 13 aa, Entamoeba dispar
DSIEGMNNAEYEE

SEQ ID NO: 2417764 - protein, 6 aa, Entamoeba dispar
DSIEKY

SEQ ID NO: 2417765 - protein, 8 aa, Entamoeba dispar
DSIKATKS

SEQ ID NO: 2417766 - protein, 10 aa, Entamoeba dispar
DSIKESLSQS

SEQ ID NO: 2417767 - protein, 5 aa, Entamoeba dispar
DSIKN

SEQ ID NO: 2417768 - protein, 9 aa, Entamoeba dispar
DSIKREESL

SEQ ID NO: 2417769 - protein, 5 aa, Entamoeba dispar
DSINN

SEQ ID NO: 2417770 - protein, 6 aa, Entamoeba dispar
DSIQKS

SEQ ID NO: 2417771 - protein, 6 aa, Entamoeba dispar
DSIQQA

SEQ ID NO: 2417772 - protein, 11 aa, Entamoeba dispar
DSISDDVSSHF

SEQ ID NO: 2417773 - protein, 5 aa, Entamoeba dispar
DSISS

SEQ ID NO: 2417774 - protein, 8 aa, Entamoeba dispar
DSISTKNS

SEQ ID NO: 2417775 - protein, 8 aa, Entamoeba dispar
DSITKTKQ

SEQ ID NO: 2417776 - protein, 17 aa, Entamoeba dispar
DSITNDEDKKENKFIEP

SEQ ID NO: 2417777 - protein, 6 aa, Entamoeba dispar
DSITTL

SEQ ID NO: 2417778 - protein, 8 aa, Entamoeba dispar
DSKADGCN

SEQ ID NO: 2417779 - protein, 9 aa, Entamoeba dispar
DSKAKPNKL

SEQ ID NO: 2417780 - protein, 5 aa, Entamoeba dispar
DSKAL

SEQ ID NO: 2417781 - protein, 6 aa, Entamoeba dispar
DSKDKK

SEQ ID NO: 2417782 - protein, 9 aa, Entamoeba dispar
DSKDQKEHH

SEQ ID NO: 2417783 - protein, 10 aa, Entamoeba dispar
DSKDSDVSMK

SEQ ID NO: 2417784 - protein, 22 aa, Entamoeba dispar
DSKDSTEEINQSYTDETSITEE

SEQ ID NO: 2417785 - protein, 4 aa, Entamoeba dispar
DSKE

SEQ ID NO: 2417786 - protein, 9 aa, Entamoeba dispar
DSKESYSNR

SEQ ID NO: 2417787 - protein, 6 aa, Entamoeba dispar
DSKEVE

SEQ ID NO: 2417788 - protein, 10 aa, Entamoeba dispar
DSKGKGTTLS

SEQ ID NO: 2417789 - protein, 9 aa, Entamoeba dispar
DSKGKNEVS

SEQ ID NO: 2417790 - protein, 8 aa, Entamoeba dispar
DSKHQQNA

SEQ ID NO: 2417791 - protein, 15 aa, Entamoeba dispar
DSKINDKKGKNKEEM

SEQ ID NO: 2417792 - protein, 7 aa, Entamoeba dispar
DSKIPNL

SEQ ID NO: 2417793 - protein, 8 aa, Entamoeba dispar
DSKKGELA

SEQ ID NO: 2417794 - protein, 6 aa, Entamoeba dispar
DSKKLG

SEQ ID NO: 2417795 - protein, 9 aa, Entamoeba dispar
DSKKNFTTM

SEQ ID NO: 2417796 - protein, 9 aa, Entamoeba dispar
DSKKNQKPE

SEQ ID NO: 2417797 - protein, 39 aa, Entamoeba dispar
DSKKVLSPSPRIKKISNNSKQQNSPSPFRTPSTHLESPL

SEQ ID NO: 2417798 - protein, 9 aa, Entamoeba dispar
DSKLNREIE

SEQ ID NO: 2417799 - protein, 26 aa, Entamoeba dispar
DSKLQSKYSQPPPSRAALAANKENVT

SEQ ID NO: 2417800 - protein, 36 aa, Entamoeba dispar
DSKLSKSEKIDKKTNTKEDKKQQEKNETAMSGCCYI

SEQ ID NO: 2417801 - protein, 7 aa, Entamoeba dispar
DSKMTLK

SEQ ID NO: 2417802 - protein, 10 aa, Entamoeba dispar
DSKNKNYISE

SEQ ID NO: 2417803 - protein, 6 aa, Entamoeba dispar
DSKNRI

SEQ ID NO: 2417804 - protein, 10 aa, Entamoeba dispar
DSKNVQEEKV

SEQ ID NO: 2417805 - protein, 6 aa, Entamoeba dispar
DSKNYR

SEQ ID NO: 2417806 - protein, 4 aa, Entamoeba dispar
DSKP

SEQ ID NO: 2417807 - protein, 13 aa, Entamoeba dispar
DSKPYSYLDGDAT

SEQ ID NO: 2417808 - protein, 16 aa, Entamoeba dispar
DSKQMSASISKRSIKN

SEQ ID NO: 2417809 - protein, 19 aa, Entamoeba dispar
DSKREDIEGNNEDEEKEEK

SEQ ID NO: 2417810 - protein, 4 aa, Entamoeba dispar
DSKT

SEQ ID NO: 2417811 - protein, 8 aa, Entamoeba dispar
DSKTGICN

SEQ ID NO: 2417812 - protein, 7 aa, Entamoeba dispar
DSKTKNI

SEQ ID NO: 2417813 - protein, 12 aa, Entamoeba dispar
DSKTLSIEKDEE

SEQ ID NO: 2417814 - protein, 11 aa, Entamoeba dispar
DSKTPGHPEYG

SEQ ID NO: 2417815 - protein, 8 aa, Entamoeba dispar
DSKTQDDT

SEQ ID NO: 2417816 - protein, 25 aa, Entamoeba dispar
DSKVSQSNEEMSTEDVKSNSGNENI

SEQ ID NO: 2417817 - protein, 8 aa, Entamoeba dispar
DSKYPNSF

SEQ ID NO: 2417818 - protein, 8 aa, Entamoeba dispar
DSLAETDK

SEQ ID NO: 2417819 - protein, 5 aa, Entamoeba dispar
DSLEG

SEQ ID NO: 2417820 - protein, 7 aa, Entamoeba dispar
DSLEQKG

SEQ ID NO: 2417821 - protein, 7 aa, Entamoeba dispar
DSLESEI

SEQ ID NO: 2417822 - protein, 7 aa, Entamoeba dispar
DSLGKNV

SEQ ID NO: 2417823 - protein, 6 aa, Entamoeba dispar
DSLGQS

SEQ ID NO: 2417824 - protein, 6 aa, Entamoeba dispar
DSLIGV

SEQ ID NO: 2417825 - protein, 6 aa, Entamoeba dispar
DSLKRE

SEQ ID NO: 2417826 - protein, 10 aa, Entamoeba dispar
DSLNKNKAAL

SEQ ID NO: 2417827 - protein, 6 aa, Entamoeba dispar
DSLPEG

SEQ ID NO: 2417828 - protein, 10 aa, Entamoeba dispar
DSLPLKSNTT

SEQ ID NO: 2417829 - protein, 6 aa, Entamoeba dispar
DSLPNG

SEQ ID NO: 2417830 - protein, 16 aa, Entamoeba dispar
DSLPTTGNKGGRAYRD

SEQ ID NO: 2417831 - protein, 4 aa, Entamoeba dispar
DSLQ

SEQ ID NO: 2417832 - protein, 5 aa, Entamoeba dispar
DSLQR

SEQ ID NO: 2417833 - protein, 13 aa, Entamoeba dispar
DSLRNNKENIDET

SEQ ID NO: 2417834 - protein, 4 aa, Entamoeba dispar
DSLS

SEQ ID NO: 2417835 - protein, 26 aa, Entamoeba dispar
DSLSDDESSFGDLDDTLTDDNEEEET

SEQ ID NO: 2417836 - protein, 6 aa, Entamoeba dispar
DSLSDQ

SEQ ID NO: 2417837 - protein, 13 aa, Entamoeba dispar
DSLSGKTVPLLYV

SEQ ID NO: 2417838 - protein, 7 aa, Entamoeba dispar
DSLSPCT

SEQ ID NO: 2417839 - protein, 9 aa, Entamoeba dispar
DSLTKGEQI

SEQ ID NO: 2417840 - protein, 9 aa, Entamoeba dispar
DSLTPGNER

SEQ ID NO: 2417841 - protein, 8 aa, Entamoeba dispar
DSLVGSQT

SEQ ID NO: 2417842 - protein, 13 aa, Entamoeba dispar
DSMNDTQKVQSLQ

SEQ ID NO: 2417843 - protein, 7 aa, Entamoeba dispar
DSNARDC

SEQ ID NO: 2417844 - protein, 4 aa, Entamoeba dispar
DSNE

SEQ ID NO: 2417845 - protein, 5 aa, Entamoeba dispar
DSNEI

SEQ ID NO: 2417846 - protein, 13 aa, Entamoeba dispar
DSNEISFDGPSAI

SEQ ID NO: 2417847 - protein, 7 aa, Entamoeba dispar
DSNEQTI

SEQ ID NO: 2417848 - protein, 6 aa, Entamoeba dispar
DSNETI

SEQ ID NO: 2417849 - protein, 8 aa, Entamoeba dispar
DSNGNITS

SEQ ID NO: 2417850 - protein, 5 aa, Entamoeba dispar
DSNGQ

SEQ ID NO: 2417851 - protein, 8 aa, Entamoeba dispar
DSNKEVTD

SEQ ID NO: 2417852 - protein, 10 aa, Entamoeba dispar
DSNKPADSQY

SEQ ID NO: 2417853 - protein, 9 aa, Entamoeba dispar
DSNLEDKIR

SEQ ID NO: 2417854 - protein, 5 aa, Entamoeba dispar
DSNLP

SEQ ID NO: 2417855 - protein, 8 aa, Entamoeba dispar
DSNNNNVE

SEQ ID NO: 2417856 - protein, 11 aa, Entamoeba dispar
DSNNSGKVNKK

SEQ ID NO: 2417857 - protein, 15 aa, Entamoeba dispar
DSNPSEQSNEKPVQS

SEQ ID NO: 2417858 - protein, 15 aa, Entamoeba dispar
DSNPYNKTKRQGEAE

SEQ ID NO: 2417859 - protein, 8 aa, Entamoeba dispar
DSNRREVT

SEQ ID NO: 2417860 - protein, 6 aa, Entamoeba dispar
DSNSEI

SEQ ID NO: 2417861 - protein, 8 aa, Entamoeba dispar
DSNSKEPE

SEQ ID NO: 2417862 - protein, 9 aa, Entamoeba dispar
DSNSREKIT

SEQ ID NO: 2417863 - protein, 4 aa, Entamoeba dispar
DSNT

SEQ ID NO: 2417864 - protein, 9 aa, Entamoeba dispar
DSNTEEEDL

SEQ ID NO: 2417865 - protein, 7 aa, Entamoeba dispar
DSNTHED

SEQ ID NO: 2417866 - protein, 9 aa, Entamoeba dispar
DSNTKNSSL

SEQ ID NO: 2417867 - protein, 7 aa, Entamoeba dispar
DSNTSIL

SEQ ID NO: 2417868 - protein, 16 aa, Entamoeba dispar
DSNTTNKVTKQEKVDG

SEQ ID NO: 2417869 - protein, 7 aa, Entamoeba dispar
DSNVRSY

SEQ ID NO: 2417870 - protein, 4 aa, Entamoeba dispar
DSNY

SEQ ID NO: 2417871 - protein, 7 aa, Entamoeba dispar
DSNYQKR

SEQ ID NO: 2417872 - protein, 6 aa, Entamoeba dispar
DSPAEE

SEQ ID NO: 2417873 - protein, 5 aa, Entamoeba dispar
DSPAP

SEQ ID NO: 2417874 - protein, 9 aa, Entamoeba dispar
DSPASPRSF

SEQ ID NO: 2417875 - protein, 5 aa, Entamoeba dispar
DSPAY

SEQ ID NO: 2417876 - protein, 9 aa, Entamoeba dispar
DSPDEKDEI

SEQ ID NO: 2417877 - protein, 7 aa, Entamoeba dispar
DSPDNAY

SEQ ID NO: 2417878 - protein, 24 aa, Entamoeba dispar
DSPDQPPEKLDITDDERQHPRPQM

SEQ ID NO: 2417879 - protein, 8 aa, Entamoeba dispar
DSPEGVKT

SEQ ID NO: 2417880 - protein, 9 aa, Entamoeba dispar
DSPESVKTA

SEQ ID NO: 2417881 - protein, 7 aa, Entamoeba dispar
DSPGNIK

SEQ ID NO: 2417882 - protein, 9 aa, Entamoeba dispar
DSPGNQEYR

SEQ ID NO: 2417883 - protein, 10 aa, Entamoeba dispar
DSPKAKVCST

SEQ ID NO: 2417884 - protein, 28 aa, Entamoeba dispar
DSPKDCGLPGEEWSDDNSTQTEKRKQEL

SEQ ID NO: 2417885 - protein, 6 aa, Entamoeba dispar
DSPKEN

SEQ ID NO: 2417886 - protein, 5 aa, Entamoeba dispar
DSPKN

SEQ ID NO: 2417887 - protein, 13 aa, Entamoeba dispar
DSPNRSENPGLNN

SEQ ID NO: 2417888 - protein, 5 aa, Entamoeba dispar
DSPNV

SEQ ID NO: 2417889 - protein, 6 aa, Entamoeba dispar
DSPPTI

SEQ ID NO: 2417890 - protein, 8 aa, Entamoeba dispar
DSPQKCTE

SEQ ID NO: 2417891 - protein, 5 aa, Entamoeba dispar
DSPSC

SEQ ID NO: 2417892 - protein, 14 aa, Entamoeba dispar
DSPSKRRVMTPIFS

SEQ ID NO: 2417893 - protein, 9 aa, Entamoeba dispar
DSPSLSKRS

SEQ ID NO: 2417894 - protein, 8 aa, Entamoeba dispar
DSPSSELI

SEQ ID NO: 2417895 - protein, 5 aa, Entamoeba dispar
DSPTT

SEQ ID NO: 2417896 - protein, 7 aa, Entamoeba dispar
DSPTYST

SEQ ID NO: 2417897 - protein, 6 aa, Entamoeba dispar
DSPVGY

SEQ ID NO: 2417898 - protein, 4 aa, Entamoeba dispar
DSPY

SEQ ID NO: 2417899 - protein, 16 aa, Entamoeba dispar
DSPYLDDTDNEKESKL

SEQ ID NO: 2417900 - protein, 9 aa, Entamoeba dispar
DSQESTSYN

SEQ ID NO: 2417901 - protein, 8 aa, Entamoeba dispar
DSQETSDN

SEQ ID NO: 2417902 - protein, 8 aa, Entamoeba dispar
DSQFATVG

SEQ ID NO: 2417903 - protein, 6 aa, Entamoeba dispar
DSQFEE

SEQ ID NO: 2417904 - protein, 5 aa, Entamoeba dispar
DSQIT

SEQ ID NO: 2417905 - protein, 7 aa, Entamoeba dispar
DSQKQKA

SEQ ID NO: 2417906 - protein, 7 aa, Entamoeba dispar
DSQLRKS

SEQ ID NO: 2417907 - protein, 4 aa, Entamoeba dispar
DSQP

SEQ ID NO: 2417908 - protein, 18 aa, Entamoeba dispar
DSQPDEDCDDNSRSEKAI

SEQ ID NO: 2417909 - protein, 8 aa, Entamoeba dispar
DSQRKSEM

SEQ ID NO: 2417910 - protein, 8 aa, Entamoeba dispar
DSQRLATE

SEQ ID NO: 2417911 - protein, 14 aa, Entamoeba dispar
DSQRQATKDAGTLQ

SEQ ID NO: 2417912 - protein, 12 aa, Entamoeba dispar
DSQSSKDSHEEI

SEQ ID NO: 2417913 - protein, 9 aa, Entamoeba dispar
DSQSTSPVF

SEQ ID NO: 2417914 - protein, 7 aa, Entamoeba dispar
DSRAPPE

SEQ ID NO: 2417915 - protein, 34 aa, Entamoeba dispar
DSRATELEEKEQQLKEAKEYSKQFESKKEKIKVK

SEQ ID NO: 2417916 - protein, 6 aa, Entamoeba dispar
DSRDKK

SEQ ID NO: 2417917 - protein, 8 aa, Entamoeba dispar
DSRGNPTI

SEQ ID NO: 2417918 - protein, 5 aa, Entamoeba dispar
DSRHT

SEQ ID NO: 2417919 - protein, 6 aa, Entamoeba dispar
DSRKIA

SEQ ID NO: 2417920 - protein, 6 aa, Entamoeba dispar
DSRPDF

SEQ ID NO: 2417921 - protein, 9 aa, Entamoeba dispar
DSRRSGNKM

SEQ ID NO: 2417922 - protein, 4 aa, Entamoeba dispar
DSRS

SEQ ID NO: 2417923 - protein, 6 aa, Entamoeba dispar
DSRSIR

SEQ ID NO: 2417924 - protein, 7 aa, Entamoeba dispar
DSRSLRG

SEQ ID NO: 2417925 - protein, 5 aa, Entamoeba dispar
DSRYT

SEQ ID NO: 2417926 - protein, 4 aa, Entamoeba dispar
DSSC

SEQ ID NO: 2417927 - protein, 6 aa, Entamoeba dispar
DSSDDL

SEQ ID NO: 2417928 - protein, 9 aa, Entamoeba dispar
DSSDGDGRM

SEQ ID NO: 2417929 - protein, 6 aa, Entamoeba dispar
DSSDIS

SEQ ID NO: 2417930 - protein, 7 aa, Entamoeba dispar
DSSDSPC

SEQ ID NO: 2417931 - protein, 25 aa, Entamoeba dispar
DSSEDVISRSSNIKENGQSQSESPV

SEQ ID NO: 2417932 - protein, 8 aa, Entamoeba dispar
DSSEEVCS

SEQ ID NO: 2417933 - protein, 4 aa, Entamoeba dispar
DSSF

SEQ ID NO: 2417934 - protein, 13 aa, Entamoeba dispar
DSSFSAYSTNHTP

SEQ ID NO: 2417935 - protein, 6 aa, Entamoeba dispar
DSSFTD

SEQ ID NO: 2417936 - protein, 10 aa, Entamoeba dispar
DSSGGNENLG

SEQ ID NO: 2417937 - protein, 7 aa, Entamoeba dispar
DSSGIPD

SEQ ID NO: 2417938 - protein, 6 aa, Entamoeba dispar
DSSGNI

SEQ ID NO: 2417939 - protein, 8 aa, Entamoeba dispar
DSSHATCD

SEQ ID NO: 2417940 - protein, 26 aa, Entamoeba dispar
DSSHKKKKKSSKKKKVNKSKPPRLPP

SEQ ID NO: 2417941 - protein, 6 aa, Entamoeba dispar
DSSINT

SEQ ID NO: 2417942 - protein, 4 aa, Entamoeba dispar
DSSK

SEQ ID NO: 2417943 - protein, 5 aa, Entamoeba dispar
DSSKA

SEQ ID NO: 2417944 - protein, 6 aa, Entamoeba dispar
DSSKEI

SEQ ID NO: 2417945 - protein, 6 aa, Entamoeba dispar
DSSLNE

SEQ ID NO: 2417946 - protein, 5 aa, Entamoeba dispar
DSSND

SEQ ID NO: 2417947 - protein, 7 aa, Entamoeba dispar
DSSNELV

SEQ ID NO: 2417948 - protein, 5 aa, Entamoeba dispar
DSSNI

SEQ ID NO: 2417949 - protein, 22 aa, Entamoeba dispar
DSSPEKIQSKKNYDINTTSTQY

SEQ ID NO: 2417950 - protein, 6 aa, Entamoeba dispar
DSSPIP

SEQ ID NO: 2417951 - protein, 5 aa, Entamoeba dispar
DSSPR

SEQ ID NO: 2417952 - protein, 8 aa, Entamoeba dispar
DSSPSTIL

SEQ ID NO: 2417953 - protein, 9 aa, Entamoeba dispar
DSSQADYLS

SEQ ID NO: 2417954 - protein, 10 aa, Entamoeba dispar
DSSQKEFSNN

SEQ ID NO: 2417955 - protein, 6 aa, Entamoeba dispar
DSSQQC

SEQ ID NO: 2417956 - protein, 12 aa, Entamoeba dispar
DSSQQTSQLPWK

SEQ ID NO: 2417957 - protein, 8 aa, Entamoeba dispar
DSSRLKRT

SEQ ID NO: 2417958 - protein, 9 aa, Entamoeba dispar
DSSRSNTNL

SEQ ID NO: 2417959 - protein, 7 aa, Entamoeba dispar
DSSRTDF

SEQ ID NO: 2417960 - protein, 38 aa, Entamoeba dispar
DSSSDDYDDDEDYEDEEMNNPMEQQPLGGNGNDPDIIY

SEQ ID NO: 2417961 - protein, 15 aa, Entamoeba dispar
DSSSDEKSLNQQINK

SEQ ID NO: 2417962 - protein, 12 aa, Entamoeba dispar
DSSSSYTNGQIS

SEQ ID NO: 2417963 - protein, 7 aa, Entamoeba dispar
DSSVGKS

SEQ ID NO: 2417964 - protein, 7 aa, Entamoeba dispar
DSSVGKT

SEQ ID NO: 2417965 - protein, 4 aa, Entamoeba dispar
DSSY

SEQ ID NO: 2417966 - protein, 7 aa, Entamoeba dispar
DSSYENP

SEQ ID NO: 2417967 - protein, 7 aa, Entamoeba dispar
DSSYPGI

SEQ ID NO: 2417968 - protein, 8 aa, Entamoeba dispar
DSTALDKS

SEQ ID NO: 2417969 - protein, 12 aa, Entamoeba dispar
DSTATDEEIKKA

SEQ ID NO: 2417970 - protein, 4 aa, Entamoeba dispar
DSTC

SEQ ID NO: 2417971 - protein, 15 aa, Entamoeba dispar
DSTDETIKNKSIETI

SEQ ID NO: 2417972 - protein, 5 aa, Entamoeba dispar
DSTDP

SEQ ID NO: 2417973 - protein, 9 aa, Entamoeba dispar
DSTDPTPSL

SEQ ID NO: 2417974 - protein, 5 aa, Entamoeba dispar
DSTDS

SEQ ID NO: 2417975 - protein, 8 aa, Entamoeba dispar
DSTEYSEE

SEQ ID NO: 2417976 - protein, 5 aa, Entamoeba dispar
DSTGI

SEQ ID NO: 2417977 - protein, 8 aa, Entamoeba dispar
DSTGLEKD

SEQ ID NO: 2417978 - protein, 12 aa, Entamoeba dispar
DSTIETDCKEGY

SEQ ID NO: 2417979 - protein, 6 aa, Entamoeba dispar
DSTIHK

SEQ ID NO: 2417980 - protein, 5 aa, Entamoeba dispar
DSTIK

SEQ ID NO: 2417981 - protein, 6 aa, Entamoeba dispar
DSTISE

SEQ ID NO: 2417982 - protein, 5 aa, Entamoeba dispar
DSTKI

SEQ ID NO: 2417983 - protein, 7 aa, Entamoeba dispar
DSTKKYP

SEQ ID NO: 2417984 - protein, 5 aa, Entamoeba dispar
DSTKN

SEQ ID NO: 2417985 - protein, 15 aa, Entamoeba dispar
DSTLNDESKKGRVIF

SEQ ID NO: 2417986 - protein, 5 aa, Entamoeba dispar
DSTLT

SEQ ID NO: 2417987 - protein, 6 aa, Entamoeba dispar
DSTNKT

SEQ ID NO: 2417988 - protein, 7 aa, Entamoeba dispar
DSTNQTI

SEQ ID NO: 2417989 - protein, 8 aa, Entamoeba dispar
DSTPEEIG

SEQ ID NO: 2417990 - protein, 9 aa, Entamoeba dispar
DSTPIKNLT

SEQ ID NO: 2417991 - protein, 6 aa, Entamoeba dispar
DSTPIP

SEQ ID NO: 2417992 - protein, 14 aa, Entamoeba dispar
DSTPIPPEIPEEEE

SEQ ID NO: 2417993 - protein, 17 aa, Entamoeba dispar
DSTPSQSSQQKPLQTNT

SEQ ID NO: 2417994 - protein, 10 aa, Entamoeba dispar
DSTRKDGFSR

SEQ ID NO: 2417995 - protein, 17 aa, Entamoeba dispar
DSTRVLGDGDVTPPGGL

SEQ ID NO: 2417996 - protein, 6 aa, Entamoeba dispar
DSTSFT

SEQ ID NO: 2417997 - protein, 5 aa, Entamoeba dispar
DSTSN

SEQ ID NO: 2417998 - protein, 7 aa, Entamoeba dispar
DSTSRWA

SEQ ID NO: 2417999 - protein, 18 aa, Entamoeba dispar
DSTSSSLMEESYGSIRSS

SEQ ID NO: 2418000 - protein, 9 aa, Entamoeba dispar
DSTSSTTSL

SEQ ID NO: 2418001 - protein, 6 aa, Entamoeba dispar
DSTSTR

SEQ ID NO: 2418002 - protein, 6 aa, Entamoeba dispar
DSTSTS

SEQ ID NO: 2418003 - protein, 9 aa, Entamoeba dispar
DSTSTTTSL

SEQ ID NO: 2418004 - protein, 5 aa, Entamoeba dispar
DSTTL

SEQ ID NO: 2418005 - protein, 7 aa, Entamoeba dispar
DSTTNRL

SEQ ID NO: 2418006 - protein, 6 aa, Entamoeba dispar
DSTTQI

SEQ ID NO: 2418007 - protein, 8 aa, Entamoeba dispar
DSTTRESL

SEQ ID NO: 2418008 - protein, 5 aa, Entamoeba dispar
DSTVD

SEQ ID NO: 2418009 - protein, 7 aa, Entamoeba dispar
DSTWTRD

SEQ ID NO: 2418010 - protein, 4 aa, Entamoeba dispar
DSTY

SEQ ID NO: 2418011 - protein, 7 aa, Entamoeba dispar
DSTYKTT

SEQ ID NO: 2418012 - protein, 5 aa, Entamoeba dispar
DSVAI

SEQ ID NO: 2418013 - protein, 6 aa, Entamoeba dispar
DSVDSA

SEQ ID NO: 2418014 - protein, 19 aa, Entamoeba dispar
DSVDSLNESLRESSAKNSL

SEQ ID NO: 2418015 - protein, 5 aa, Entamoeba dispar
DSVFP

SEQ ID NO: 2418016 - protein, 9 aa, Entamoeba dispar
DSVKEKSNF

SEQ ID NO: 2418017 - protein, 10 aa, Entamoeba dispar
DSVNNESLDQ

SEQ ID NO: 2418018 - protein, 7 aa, Entamoeba dispar
DSVNPFP

SEQ ID NO: 2418019 - protein, 13 aa, Entamoeba dispar
DSVNSSSQELTIE

SEQ ID NO: 2418020 - protein, 5 aa, Entamoeba dispar
DSVNV

SEQ ID NO: 2418021 - protein, 8 aa, Entamoeba dispar
DSVPNKEV

SEQ ID NO: 2418022 - protein, 9 aa, Entamoeba dispar
DSVQMKTEQ

SEQ ID NO: 2418023 - protein, 4 aa, Entamoeba dispar
DSVR

SEQ ID NO: 2418024 - protein, 4 aa, Entamoeba dispar
DSVS

SEQ ID NO: 2418025 - protein, 6 aa, Entamoeba dispar
DSVTKD

SEQ ID NO: 2418026 - protein, 16 aa, Entamoeba dispar
DSVTPGTQKVFLETYL

SEQ ID NO: 2418027 - protein, 12 aa, Entamoeba dispar
DSVVNDGISGSA

SEQ ID NO: 2418028 - protein, 18 aa, Entamoeba dispar
DSVVSEFKSSTEVQKEFN

SEQ ID NO: 2418029 - protein, 8 aa, Entamoeba dispar
DSWTSRSA

SEQ ID NO: 2418030 - protein, 8 aa, Entamoeba dispar
DSYDDDQN

SEQ ID NO: 2418031 - protein, 7 aa, Entamoeba dispar
DSYDEEE

SEQ ID NO: 2418032 - protein, 7 aa, Entamoeba dispar
DSYESSI

SEQ ID NO: 2418033 - protein, 12 aa, Entamoeba dispar
DSYGCSCLKIGF

SEQ ID NO: 2418034 - protein, 5 aa, Entamoeba dispar
DSYIG

SEQ ID NO: 2418035 - protein, 7 aa, Entamoeba dispar
DSYKEPP

SEQ ID NO: 2418036 - protein, 6 aa, Entamoeba dispar
DSYQDF

SEQ ID NO: 2418037 - protein, 9 aa, Entamoeba dispar
DSYQDYNEL

SEQ ID NO: 2418038 - protein, 9 aa, Entamoeba dispar
DSYSTKQKR

SEQ ID NO: 2418039 - protein, 8 aa, Entamoeba dispar
DSYYGDDG

SEQ ID NO: 2418040 - protein, 11 aa, Entamoeba dispar
DSYYNSKDEEF

SEQ ID NO: 2418041 - protein, 9 aa, Entamoeba dispar
DTAEKGAIE

SEQ ID NO: 2418042 - protein, 7 aa, Entamoeba dispar
DTAGNER

SEQ ID NO: 2418043 - protein, 7 aa, Entamoeba dispar
DTAGQER

SEQ ID NO: 2418044 - protein, 11 aa, Entamoeba dispar
DTAGSPSSFSA

SEQ ID NO: 2418045 - protein, 9 aa, Entamoeba dispar
DTAGSPSYF

SEQ ID NO: 2418046 - protein, 7 aa, Entamoeba dispar
DTAKTAQ

SEQ ID NO: 2418047 - protein, 8 aa, Entamoeba dispar
DTAKTNIY

SEQ ID NO: 2418048 - protein, 11 aa, Entamoeba dispar
DTANQQISAPT

SEQ ID NO: 2418049 - protein, 6 aa, Entamoeba dispar
DTAPPD

SEQ ID NO: 2418050 - protein, 7 aa, Entamoeba dispar
DTAQLSQ

SEQ ID NO: 2418051 - protein, 11 aa, Entamoeba dispar
DTAQPDKNPLL

SEQ ID NO: 2418052 - protein, 4 aa, Entamoeba dispar
DTAS

SEQ ID NO: 2418053 - protein, 28 aa, Entamoeba dispar
DTASDTKKSTTQPIGTTLPEEKKPEVNF

SEQ ID NO: 2418054 - protein, 14 aa, Entamoeba dispar
DTCNEESPKSVDEI

SEQ ID NO: 2418055 - protein, 13 aa, Entamoeba dispar
DTDDDNSNVAGTI

SEQ ID NO: 2418056 - protein, 6 aa, Entamoeba dispar
DTDFED

SEQ ID NO: 2418057 - protein, 4 aa, Entamoeba dispar
DTDG

SEQ ID NO: 2418058 - protein, 5 aa, Entamoeba dispar
DTDGS

SEQ ID NO: 2418059 - protein, 8 aa, Entamoeba dispar
DTDGSGKG

SEQ ID NO: 2418060 - protein, 9 aa, Entamoeba dispar
DTDKNGSLD

SEQ ID NO: 2418061 - protein, 4 aa, Entamoeba dispar
DTDL

SEQ ID NO: 2418062 - protein, 10 aa, Entamoeba dispar
DTDNREKAMN

SEQ ID NO: 2418063 - protein, 5 aa, Entamoeba dispar
DTDPV

SEQ ID NO: 2418064 - protein, 7 aa, Entamoeba dispar
DTDRSQF

SEQ ID NO: 2418065 - protein, 7 aa, Entamoeba dispar
DTDSIKK

SEQ ID NO: 2418066 - protein, 7 aa, Entamoeba dispar
DTDSSVQ

SEQ ID NO: 2418067 - protein, 8 aa, Entamoeba dispar
DTDTAEQI

SEQ ID NO: 2418068 - protein, 5 aa, Entamoeba dispar
DTDTY

SEQ ID NO: 2418069 - protein, 4 aa, Entamoeba dispar
DTDV

SEQ ID NO: 2418070 - protein, 4 aa, Entamoeba dispar
DTED

SEQ ID NO: 2418071 - protein, 25 aa, Entamoeba dispar
DTEEDAAEKGKQLRSYEKVQRKMGQ

SEQ ID NO: 2418072 - protein, 6 aa, Entamoeba dispar
DTEEEL

SEQ ID NO: 2418073 - protein, 17 aa, Entamoeba dispar
DTEEHAAAAKKALTGRY

SEQ ID NO: 2418074 - protein, 17 aa, Entamoeba dispar
DTEESAQKALREGNNEM

SEQ ID NO: 2418075 - protein, 7 aa, Entamoeba dispar
DTEESYV

SEQ ID NO: 2418076 - protein, 4 aa, Entamoeba dispar
DTEF

SEQ ID NO: 2418077 - protein, 6 aa, Entamoeba dispar
DTEFPY

SEQ ID NO: 2418078 - protein, 6 aa, Entamoeba dispar
DTEGRD

SEQ ID NO: 2418079 - protein, 5 aa, Entamoeba dispar
DTEIK

SEQ ID NO: 2418080 - protein, 4 aa, Entamoeba dispar
DTEK

SEQ ID NO: 2418081 - protein, 14 aa, Entamoeba dispar
DTELPNKEVKTDNS

SEQ ID NO: 2418082 - protein, 4 aa, Entamoeba dispar
DTEN

SEQ ID NO: 2418083 - protein, 5 aa, Entamoeba dispar
DTENI

SEQ ID NO: 2418084 - protein, 7 aa, Entamoeba dispar
DTEPSIP

SEQ ID NO: 2418085 - protein, 4 aa, Entamoeba dispar
DTER

SEQ ID NO: 2418086 - protein, 6 aa, Entamoeba dispar
DTERGT

SEQ ID NO: 2418087 - protein, 6 aa, Entamoeba dispar
DTETDG

SEQ ID NO: 2418088 - protein, 6 aa, Entamoeba dispar
DTETRD

SEQ ID NO: 2418089 - protein, 6 aa, Entamoeba dispar
DTETRN

SEQ ID NO: 2418090 - protein, 11 aa, Entamoeba dispar
DTEYDDMPPNM

SEQ ID NO: 2418091 - protein, 11 aa, Entamoeba dispar
DTEYTSKSVDE

SEQ ID NO: 2418092 - protein, 11 aa, Entamoeba dispar
DTFDQTEEQRK

SEQ ID NO: 2418093 - protein, 11 aa, Entamoeba dispar
DTFDSVKNREE

SEQ ID NO: 2418094 - protein, 7 aa, Entamoeba dispar
DTFESSD

SEQ ID NO: 2418095 - protein, 5 aa, Entamoeba dispar
DTFNK

SEQ ID NO: 2418096 - protein, 13 aa, Entamoeba dispar
DTFNPTNWNKSVN

SEQ ID NO: 2418097 - protein, 8 aa, Entamoeba dispar
DTFSSNSN

SEQ ID NO: 2418098 - protein, 8 aa, Entamoeba dispar
DTFTQEEA

SEQ ID NO: 2418099 - protein, 7 aa, Entamoeba dispar
DTGASVQ

SEQ ID NO: 2418100 - protein, 11 aa, Entamoeba dispar
DTGDFKPSPGF

SEQ ID NO: 2418101 - protein, 5 aa, Entamoeba dispar
DTGIE

SEQ ID NO: 2418102 - protein, 11 aa, Entamoeba dispar
DTGKDETERKK

SEQ ID NO: 2418103 - protein, 6 aa, Entamoeba dispar
DTGKTK

SEQ ID NO: 2418104 - protein, 7 aa, Entamoeba dispar
DTGLEPG

SEQ ID NO: 2418105 - protein, 6 aa, Entamoeba dispar
DTGNDR

SEQ ID NO: 2418106 - protein, 6 aa, Entamoeba dispar
DTGNSI

SEQ ID NO: 2418107 - protein, 6 aa, Entamoeba dispar
DTGSDC

SEQ ID NO: 2418108 - protein, 4 aa, Entamoeba dispar
DTGV

SEQ ID NO: 2418109 - protein, 6 aa, Entamoeba dispar
DTHDQL

SEQ ID NO: 2418110 - protein, 8 aa, Entamoeba dispar
DTHHKTKE

SEQ ID NO: 2418111 - protein, 10 aa, Entamoeba dispar
DTHKHSTPYH

SEQ ID NO: 2418112 - protein, 8 aa, Entamoeba dispar
DTHLDEPK

SEQ ID NO: 2418113 - protein, 6 aa, Entamoeba dispar
DTHPTV

SEQ ID NO: 2418114 - protein, 10 aa, Entamoeba dispar
DTIAKTLSPA

SEQ ID NO: 2418115 - protein, 5 aa, Entamoeba dispar
DTIDD

SEQ ID NO: 2418116 - protein, 4 aa, Entamoeba dispar
DTIE

SEQ ID NO: 2418117 - protein, 5 aa, Entamoeba dispar
DTIKE

SEQ ID NO: 2418118 - protein, 36 aa, Entamoeba dispar
DTIKKEKTPEIHQKDDTKKIDDFKKQESDDKTKGYE

SEQ ID NO: 2418119 - protein, 32 aa, Entamoeba dispar
DTIKSEEKSIKSDNNDTIKSDDIADKEQIPEN

SEQ ID NO: 2418120 - protein, 6 aa, Entamoeba dispar
DTIPNE

SEQ ID NO: 2418121 - protein, 8 aa, Entamoeba dispar
DTIPNPQS

SEQ ID NO: 2418122 - protein, 6 aa, Entamoeba dispar
DTIPTT

SEQ ID NO: 2418123 - protein, 4 aa, Entamoeba dispar
DTIR

SEQ ID NO: 2418124 - protein, 4 aa, Entamoeba dispar
DTIS

SEQ ID NO: 2418125 - protein, 6 aa, Entamoeba dispar
DTISDT

SEQ ID NO: 2418126 - protein, 12 aa, Entamoeba dispar
DTISSNTFNEPS

SEQ ID NO: 2418127 - protein, 6 aa, Entamoeba dispar
DTITLN

SEQ ID NO: 2418128 - protein, 9 aa, Entamoeba dispar
DTITQSNIN

SEQ ID NO: 2418129 - protein, 4 aa, Entamoeba dispar
DTKD

SEQ ID NO: 2418130 - protein, 10 aa, Entamoeba dispar
DTKDGLSEES

SEQ ID NO: 2418131 - protein, 6 aa, Entamoeba dispar
DTKEAD

SEQ ID NO: 2418132 - protein, 7 aa, Entamoeba dispar
DTKEREM

SEQ ID NO: 2418133 - protein, 7 aa, Entamoeba dispar
DTKFHRE

SEQ ID NO: 2418134 - protein, 9 aa, Entamoeba dispar
DTKGIETVR

SEQ ID NO: 2418135 - protein, 8 aa, Entamoeba dispar
DTKGMNDN

SEQ ID NO: 2418136 - protein, 8 aa, Entamoeba dispar
DTKKKQQL

SEQ ID NO: 2418137 - protein, 9 aa, Entamoeba dispar
DTKKKSSIT

SEQ ID NO: 2418138 - protein, 10 aa, Entamoeba dispar
DTKKNGNASP

SEQ ID NO: 2418139 - protein, 14 aa, Entamoeba dispar
DTKKPKPQKSTYSH

SEQ ID NO: 2418140 - protein, 7 aa, Entamoeba dispar
DTKKRTV

SEQ ID NO: 2418141 - protein, 12 aa, Entamoeba dispar
DTKMYQPSPSPH

SEQ ID NO: 2418142 - protein, 25 aa, Entamoeba dispar
DTKPKQGFHRATSSSSNLFSFDENA

SEQ ID NO: 2418143 - protein, 7 aa, Entamoeba dispar
DTKQSYY

SEQ ID NO: 2418144 - protein, 7 aa, Entamoeba dispar
DTKRNQE

SEQ ID NO: 2418145 - protein, 41 aa, Entamoeba dispar
DTKTKEDEEQKKLKEHEPTTKKSSKKQRNGKKSYKKIGCSV

SEQ ID NO: 2418146 - protein, 15 aa, Entamoeba dispar
DTKVEDTEQVSTNEI

SEQ ID NO: 2418147 - protein, 21 aa, Entamoeba dispar
DTLARERERRESAEADALRAN

SEQ ID NO: 2418148 - protein, 4 aa, Entamoeba dispar
DTLD

SEQ ID NO: 2418149 - protein, 25 aa, Entamoeba dispar
DTLDSEINAKTQTQKNTKEFEELQQ

SEQ ID NO: 2418150 - protein, 7 aa, Entamoeba dispar
DTLKDRV

SEQ ID NO: 2418151 - protein, 5 aa, Entamoeba dispar
DTLNE

SEQ ID NO: 2418152 - protein, 9 aa, Entamoeba dispar
DTLPKNPLH

SEQ ID NO: 2418153 - protein, 7 aa, Entamoeba dispar
DTLTEEQ

SEQ ID NO: 2418154 - protein, 12 aa, Entamoeba dispar
DTLTSDDHLGDA

SEQ ID NO: 2418155 - protein, 8 aa, Entamoeba dispar
DTNDASLE

SEQ ID NO: 2418156 - protein, 11 aa, Entamoeba dispar
DTNDDDDWSEF

SEQ ID NO: 2418157 - protein, 8 aa, Entamoeba dispar
DTNDVPKS

SEQ ID NO: 2418158 - protein, 8 aa, Entamoeba dispar
DTNEINSK

SEQ ID NO: 2418159 - protein, 8 aa, Entamoeba dispar
DTNEMHKP

SEQ ID NO: 2418160 - protein, 11 aa, Entamoeba dispar
DTNEQKRNSAL

SEQ ID NO: 2418161 - protein, 5 aa, Entamoeba dispar
DTNEV

SEQ ID NO: 2418162 - protein, 13 aa, Entamoeba dispar
DTNHKTNDTNPLT

SEQ ID NO: 2418163 - protein, 10 aa, Entamoeba dispar
DTNHSFSSEK

SEQ ID NO: 2418164 - protein, 62 aa, Entamoeba dispar
DTNKQDEGDDKTKKDQEQDAINEEIKKDGEEEKIESGNMIEQQDENNDDNLKKENKEEELPQ

SEQ ID NO: 2418165 - protein, 7 aa, Entamoeba dispar
DTNKSNL

SEQ ID NO: 2418166 - protein, 9 aa, Entamoeba dispar
DTNPEKETH

SEQ ID NO: 2418167 - protein, 10 aa, Entamoeba dispar
DTNPLKESAE

SEQ ID NO: 2418168 - protein, 7 aa, Entamoeba dispar
DTNQEVV

SEQ ID NO: 2418169 - protein, 37 aa, Entamoeba dispar
DTNQPTPQQLNSDEQTTTESKQKDTFEDDFSDFFVSS

SEQ ID NO: 2418170 - protein, 13 aa, Entamoeba dispar
DTNQSGQAKGSPL

SEQ ID NO: 2418171 - protein, 8 aa, Entamoeba dispar
DTNRTGKI

SEQ ID NO: 2418172 - protein, 14 aa, Entamoeba dispar
DTNSQTDLEENNRI

SEQ ID NO: 2418173 - protein, 9 aa, Entamoeba dispar
DTNYDGISK

SEQ ID NO: 2418174 - protein, 6 aa, Entamoeba dispar
DTNYGS

SEQ ID NO: 2418175 - protein, 6 aa, Entamoeba dispar
DTPCNG

SEQ ID NO: 2418176 - protein, 8 aa, Entamoeba dispar
DTPCNHAS

SEQ ID NO: 2418177 - protein, 6 aa, Entamoeba dispar
DTPDGR

SEQ ID NO: 2418178 - protein, 5 aa, Entamoeba dispar
DTPDK

SEQ ID NO: 2418179 - protein, 8 aa, Entamoeba dispar
DTPELENS

SEQ ID NO: 2418180 - protein, 12 aa, Entamoeba dispar
DTPENRTPNKYP

SEQ ID NO: 2418181 - protein, 6 aa, Entamoeba dispar
DTPEQL

SEQ ID NO: 2418182 - protein, 11 aa, Entamoeba dispar
DTPESEERTLK

SEQ ID NO: 2418183 - protein, 4 aa, Entamoeba dispar
DTPF

SEQ ID NO: 2418184 - protein, 7 aa, Entamoeba dispar
DTPFETS

SEQ ID NO: 2418185 - protein, 6 aa, Entamoeba dispar
DTPFIG

SEQ ID NO: 2418186 - protein, 14 aa, Entamoeba dispar
DTPFIGEETTTRIG

SEQ ID NO: 2418187 - protein, 7 aa, Entamoeba dispar
DTPGYAI

SEQ ID NO: 2418188 - protein, 9 aa, Entamoeba dispar
DTPHSEPKL

SEQ ID NO: 2418189 - protein, 6 aa, Entamoeba dispar
DTPITT

SEQ ID NO: 2418190 - protein, 7 aa, Entamoeba dispar
DTPKQEA

SEQ ID NO: 2418191 - protein, 14 aa, Entamoeba dispar
DTPLEQISMIIDQL

SEQ ID NO: 2418192 - protein, 14 aa, Entamoeba dispar
DTPLNNGLRQPQLR

SEQ ID NO: 2418193 - protein, 11 aa, Entamoeba dispar
DTPLPPTPKDF

SEQ ID NO: 2418194 - protein, 5 aa, Entamoeba dispar
DTPLY

SEQ ID NO: 2418195 - protein, 10 aa, Entamoeba dispar
DTPPGTSDEH

SEQ ID NO: 2418196 - protein, 15 aa, Entamoeba dispar
DTPQPSSYDHHEPRK

SEQ ID NO: 2418197 - protein, 16 aa, Entamoeba dispar
DTPRTPRHRLGSNSTL

SEQ ID NO: 2418198 - protein, 7 aa, Entamoeba dispar
DTPSYSI

SEQ ID NO: 2418199 - protein, 4 aa, Entamoeba dispar
DTPT

SEQ ID NO: 2418200 - protein, 8 aa, Entamoeba dispar
DTPTPKIE

SEQ ID NO: 2418201 - protein, 8 aa, Entamoeba dispar
DTPTSNQI

SEQ ID NO: 2418202 - protein, 6 aa, Entamoeba dispar
DTPTSY

SEQ ID NO: 2418203 - protein, 13 aa, Entamoeba dispar
DTPVDSHKEEIQF

SEQ ID NO: 2418204 - protein, 5 aa, Entamoeba dispar
DTQEA

SEQ ID NO: 2418205 - protein, 10 aa, Entamoeba dispar
DTQEIPPIDP

SEQ ID NO: 2418206 - protein, 12 aa, Entamoeba dispar
DTQGMKKMKGNV

SEQ ID NO: 2418207 - protein, 6 aa, Entamoeba dispar
DTQKQP

SEQ ID NO: 2418208 - protein, 5 aa, Entamoeba dispar
DTQLQ

SEQ ID NO: 2418209 - protein, 6 aa, Entamoeba dispar
DTQLRG

SEQ ID NO: 2418210 - protein, 4 aa, Entamoeba dispar
DTQP

SEQ ID NO: 2418211 - protein, 5 aa, Entamoeba dispar
DTQPI

SEQ ID NO: 2418212 - protein, 7 aa, Entamoeba dispar
DTQRDEM

SEQ ID NO: 2418213 - protein, 6 aa, Entamoeba dispar
DTQSHK

SEQ ID NO: 2418214 - protein, 10 aa, Entamoeba dispar
DTRENNGNTE

SEQ ID NO: 2418215 - protein, 13 aa, Entamoeba dispar
DTRKENEGKNNAV

SEQ ID NO: 2418216 - protein, 6 aa, Entamoeba dispar
DTRKYY

SEQ ID NO: 2418217 - protein, 5 aa, Entamoeba dispar
DTRMS

SEQ ID NO: 2418218 - protein, 4 aa, Entamoeba dispar
DTRN

SEQ ID NO: 2418219 - protein, 9 aa, Entamoeba dispar
DTRNDEQEL

SEQ ID NO: 2418220 - protein, 12 aa, Entamoeba dispar
DTRPKDVEAPFR

SEQ ID NO: 2418221 - protein, 4 aa, Entamoeba dispar
DTSA

SEQ ID NO: 2418222 - protein, 8 aa, Entamoeba dispar
DTSAKGIK

SEQ ID NO: 2418223 - protein, 10 aa, Entamoeba dispar
DTSDVRIETQ

SEQ ID NO: 2418224 - protein, 11 aa, Entamoeba dispar
DTSEMDKTLEE

SEQ ID NO: 2418225 - protein, 9 aa, Entamoeba dispar
DTSGSDPNE

SEQ ID NO: 2418226 - protein, 19 aa, Entamoeba dispar
DTSGSPDYSKLASGAIGNS

SEQ ID NO: 2418227 - protein, 6 aa, Entamoeba dispar
DTSITS

SEQ ID NO: 2418228 - protein, 6 aa, Entamoeba dispar
DTSKGK

SEQ ID NO: 2418229 - protein, 9 aa, Entamoeba dispar
DTSKKSKCA

SEQ ID NO: 2418230 - protein, 34 aa, Entamoeba dispar
DTSKKVEEITSTPQGSQTPSHITNSQSPTQPATA

SEQ ID NO: 2418231 - protein, 8 aa, Entamoeba dispar
DTSKPNDI

SEQ ID NO: 2418232 - protein, 7 aa, Entamoeba dispar
DTSKRKG

SEQ ID NO: 2418233 - protein, 11 aa, Entamoeba dispar
DTSKRTLRPTK

SEQ ID NO: 2418234 - protein, 15 aa, Entamoeba dispar
DTSLEEGGQQTHPDL

SEQ ID NO: 2418235 - protein, 6 aa, Entamoeba dispar
DTSLND

SEQ ID NO: 2418236 - protein, 12 aa, Entamoeba dispar
DTSLSKESTPIS

SEQ ID NO: 2418237 - protein, 4 aa, Entamoeba dispar
DTSN

SEQ ID NO: 2418238 - protein, 11 aa, Entamoeba dispar
DTSNEAPGKNV

SEQ ID NO: 2418239 - protein, 8 aa, Entamoeba dispar
DTSNSIKT

SEQ ID NO: 2418240 - protein, 9 aa, Entamoeba dispar
DTSNVGGGR

SEQ ID NO: 2418241 - protein, 18 aa, Entamoeba dispar
DTSPDGKKFVTGGGDGKV

SEQ ID NO: 2418242 - protein, 10 aa, Entamoeba dispar
DTSPSNDSLL

SEQ ID NO: 2418243 - protein, 6 aa, Entamoeba dispar
DTSQIN

SEQ ID NO: 2418244 - protein, 23 aa, Entamoeba dispar
DTSSNGTFINDGNKRLEKRSETV

SEQ ID NO: 2418245 - protein, 26 aa, Entamoeba dispar
DTSSNNTTSVGSPCNTTDLSEPNVPI

SEQ ID NO: 2418246 - protein, 8 aa, Entamoeba dispar
DTSSPIPK

SEQ ID NO: 2418247 - protein, 8 aa, Entamoeba dispar
DTSSYQNL

SEQ ID NO: 2418248 - protein, 6 aa, Entamoeba dispar
DTSTFD

SEQ ID NO: 2418249 - protein, 5 aa, Entamoeba dispar
DTSTQ

SEQ ID NO: 2418250 - protein, 6 aa, Entamoeba dispar
DTSVGK

SEQ ID NO: 2418251 - protein, 8 aa, Entamoeba dispar
DTSVPKKQ

SEQ ID NO: 2418252 - protein, 5 aa, Entamoeba dispar
DTTAF

SEQ ID NO: 2418253 - protein, 16 aa, Entamoeba dispar
DTTDESIPERSNDELR

SEQ ID NO: 2418254 - protein, 12 aa, Entamoeba dispar
DTTEANARNNGF

SEQ ID NO: 2418255 - protein, 7 aa, Entamoeba dispar
DTTGAGD

SEQ ID NO: 2418256 - protein, 10 aa, Entamoeba dispar
DTTGAGDTTI

SEQ ID NO: 2418257 - protein, 6 aa, Entamoeba dispar
DTTGFG

SEQ ID NO: 2418258 - protein, 8 aa, Entamoeba dispar
DTTGKGAD

SEQ ID NO: 2418259 - protein, 5 aa, Entamoeba dispar
DTTKD

SEQ ID NO: 2418260 - protein, 5 aa, Entamoeba dispar
DTTKN

SEQ ID NO: 2418261 - protein, 4 aa, Entamoeba dispar
DTTL

SEQ ID NO: 2418262 - protein, 5 aa, Entamoeba dispar
DTTLP

SEQ ID NO: 2418263 - protein, 8 aa, Entamoeba dispar
DTTLTEKE

SEQ ID NO: 2418264 - protein, 16 aa, Entamoeba dispar
DTTMTTEIDQKEKKNV

SEQ ID NO: 2418265 - protein, 6 aa, Entamoeba dispar
DTTNGF

SEQ ID NO: 2418266 - protein, 7 aa, Entamoeba dispar
DTTPELN

SEQ ID NO: 2418267 - protein, 5 aa, Entamoeba dispar
DTTPS

SEQ ID NO: 2418268 - protein, 7 aa, Entamoeba dispar
DTTQQEL

SEQ ID NO: 2418269 - protein, 8 aa, Entamoeba dispar
DTTSGEKV

SEQ ID NO: 2418270 - protein, 11 aa, Entamoeba dispar
DTTSIHEDNTI

SEQ ID NO: 2418271 - protein, 10 aa, Entamoeba dispar
DTTSKYPTGH

SEQ ID NO: 2418272 - protein, 8 aa, Entamoeba dispar
DTTSPINK

SEQ ID NO: 2418273 - protein, 8 aa, Entamoeba dispar
DTTSSGRL

SEQ ID NO: 2418274 - protein, 10 aa, Entamoeba dispar
DTTTKRSRGF

SEQ ID NO: 2418275 - protein, 19 aa, Entamoeba dispar
DTTTNEDLEKQTDLEEQKY

SEQ ID NO: 2418276 - protein, 11 aa, Entamoeba dispar
DTTVDSTPSIH

SEQ ID NO: 2418277 - protein, 9 aa, Entamoeba dispar
DTTVNSTPK

SEQ ID NO: 2418278 - protein, 7 aa, Entamoeba dispar
DTTYKGE

SEQ ID NO: 2418279 - protein, 5 aa, Entamoeba dispar
DTVDG

SEQ ID NO: 2418280 - protein, 11 aa, Entamoeba dispar
DTVEDTDTTFE

SEQ ID NO: 2418281 - protein, 8 aa, Entamoeba dispar
DTVGKDGK

SEQ ID NO: 2418282 - protein, 5 aa, Entamoeba dispar
DTVKK

SEQ ID NO: 2418283 - protein, 5 aa, Entamoeba dispar
DTVYP

SEQ ID NO: 2418284 - protein, 19 aa, Entamoeba dispar
DTWPEQYKETRRHKFREGN

SEQ ID NO: 2418285 - protein, 35 aa, Entamoeba dispar
DTYPKSTTPSIISEESKEIEQQKTVEIKETTQPLI

SEQ ID NO: 2418286 - protein, 15 aa, Entamoeba dispar
DTYSSYDELEPSIQE

SEQ ID NO: 2418287 - protein, 6 aa, Entamoeba dispar
DTYTDT

SEQ ID NO: 2418288 - protein, 17 aa, Entamoeba dispar
DVADNKHTVNKYSEKEY

SEQ ID NO: 2418289 - protein, 7 aa, Entamoeba dispar
DVASGGN

SEQ ID NO: 2418290 - protein, 12 aa, Entamoeba dispar
DVDEKEKREPKI

SEQ ID NO: 2418291 - protein, 8 aa, Entamoeba dispar
DVDGTGHT

SEQ ID NO: 2418292 - protein, 14 aa, Entamoeba dispar
DVDKKGKRCTEGEN

SEQ ID NO: 2418293 - protein, 7 aa, Entamoeba dispar
DVDLTEK

SEQ ID NO: 2418294 - protein, 8 aa, Entamoeba dispar
DVDNNGVA

SEQ ID NO: 2418295 - protein, 6 aa, Entamoeba dispar
DVDTTK

SEQ ID NO: 2418296 - protein, 9 aa, Entamoeba dispar
DVEEEQGII

SEQ ID NO: 2418297 - protein, 5 aa, Entamoeba dispar
DVEEN

SEQ ID NO: 2418298 - protein, 27 aa, Entamoeba dispar
DVEKPSWVSESSNDSVHNLGSKPITEK

SEQ ID NO: 2418299 - protein, 9 aa, Entamoeba dispar
DVEPKYGSQ

SEQ ID NO: 2418300 - protein, 9 aa, Entamoeba dispar
DVEPPEQKM

SEQ ID NO: 2418301 - protein, 7 aa, Entamoeba dispar
DVEQNKW

SEQ ID NO: 2418302 - protein, 17 aa, Entamoeba dispar
DVEQQRDITADVGASLA

SEQ ID NO: 2418303 - protein, 12 aa, Entamoeba dispar
DVEQYNSNETVT

SEQ ID NO: 2418304 - protein, 4 aa, Entamoeba dispar
DVER

SEQ ID NO: 2418305 - protein, 6 aa, Entamoeba dispar
DVESSR

SEQ ID NO: 2418306 - protein, 8 aa, Entamoeba dispar
DVETGKGW

SEQ ID NO: 2418307 - protein, 6 aa, Entamoeba dispar
DVGDND

SEQ ID NO: 2418308 - protein, 4 aa, Entamoeba dispar
DVGG

SEQ ID NO: 2418309 - protein, 5 aa, Entamoeba dispar
DVGGS

SEQ ID NO: 2418310 - protein, 8 aa, Entamoeba dispar
DVGKDKNL

SEQ ID NO: 2418311 - protein, 15 aa, Entamoeba dispar
DVGKGCAESLRGQGA

SEQ ID NO: 2418312 - protein, 10 aa, Entamoeba dispar
DVGKKDNENG

SEQ ID NO: 2418313 - protein, 10 aa, Entamoeba dispar
DVGRPKSEVA

SEQ ID NO: 2418314 - protein, 10 aa, Entamoeba dispar
DVGSDESEVG

SEQ ID NO: 2418315 - protein, 20 aa, Entamoeba dispar
DVGSERNRGPLKECPAPEQL

SEQ ID NO: 2418316 - protein, 13 aa, Entamoeba dispar
DVHEPKETTQKDL

SEQ ID NO: 2418317 - protein, 16 aa, Entamoeba dispar
DVHSSFSSSVLSNEES

SEQ ID NO: 2418318 - protein, 16 aa, Entamoeba dispar
DVIAQSQSGTGKTATF

SEQ ID NO: 2418319 - protein, 12 aa, Entamoeba dispar
DVIEKDDEETFS

SEQ ID NO: 2418320 - protein, 5 aa, Entamoeba dispar
DVIGH

SEQ ID NO: 2418321 - protein, 8 aa, Entamoeba dispar
DVKAKKNR

SEQ ID NO: 2418322 - protein, 10 aa, Entamoeba dispar
DVKDRKVKQR

SEQ ID NO: 2418323 - protein, 9 aa, Entamoeba dispar
DVKDYSKGK

SEQ ID NO: 2418324 - protein, 13 aa, Entamoeba dispar
DVKEPSEKDEEKY

SEQ ID NO: 2418325 - protein, 13 aa, Entamoeba dispar
DVKGKNLKLYDVI

SEQ ID NO: 2418326 - protein, 12 aa, Entamoeba dispar
DVKKGDEDDEDR

SEQ ID NO: 2418327 - protein, 10 aa, Entamoeba dispar
DVKKGSKITE

SEQ ID NO: 2418328 - protein, 17 aa, Entamoeba dispar
DVKNGRPTDLIFEVIPK

SEQ ID NO: 2418329 - protein, 13 aa, Entamoeba dispar
DVKPNEQQQYQTN

SEQ ID NO: 2418330 - protein, 11 aa, Entamoeba dispar
DVKPYSEKAQQ

SEQ ID NO: 2418331 - protein, 8 aa, Entamoeba dispar
DVKSQLKP

SEQ ID NO: 2418332 - protein, 7 aa, Entamoeba dispar
DVKSTAI

SEQ ID NO: 2418333 - protein, 21 aa, Entamoeba dispar
DVKTTGGRLGPVEGEQPELDN

SEQ ID NO: 2418334 - protein, 62 aa, Entamoeba dispar
DVMGKEETKKEEVKNEEETKNEEIKIGETKKEETKKEETKKEETKKEETSECGKEKDQGDDC

SEQ ID NO: 2418335 - protein, 10 aa, Entamoeba dispar
DVNAQTINGK

SEQ ID NO: 2418336 - protein, 10 aa, Entamoeba dispar
DVNDPYASAY

SEQ ID NO: 2418337 - protein, 6 aa, Entamoeba dispar
DVNEFQ

SEQ ID NO: 2418338 - protein, 10 aa, Entamoeba dispar
DVNEKCTKSY

SEQ ID NO: 2418339 - protein, 6 aa, Entamoeba dispar
DVNGRD

SEQ ID NO: 2418340 - protein, 14 aa, Entamoeba dispar
DVNNELDQLQENRP

SEQ ID NO: 2418341 - protein, 27 aa, Entamoeba dispar
DVNPRNSELSIDEGEKRLLEMKNGMDD

SEQ ID NO: 2418342 - protein, 5 aa, Entamoeba dispar
DVNSA

SEQ ID NO: 2418343 - protein, 5 aa, Entamoeba dispar
DVPAG

SEQ ID NO: 2418344 - protein, 5 aa, Entamoeba dispar
DVPNA

SEQ ID NO: 2418345 - protein, 6 aa, Entamoeba dispar
DVPPCS

SEQ ID NO: 2418346 - protein, 6 aa, Entamoeba dispar
DVPPIP

SEQ ID NO: 2418347 - protein, 15 aa, Entamoeba dispar
DVPPPLPEKRPSQDE

SEQ ID NO: 2418348 - protein, 6 aa, Entamoeba dispar
DVPSND

SEQ ID NO: 2418349 - protein, 5 aa, Entamoeba dispar
DVPSS

SEQ ID NO: 2418350 - protein, 4 aa, Entamoeba dispar
DVQE

SEQ ID NO: 2418351 - protein, 31 aa, Entamoeba dispar
DVQEETTDAISQKLPQPESIPPKVNQTTTPS

SEQ ID NO: 2418352 - protein, 15 aa, Entamoeba dispar
DVQEQYKNAKTGEEV

SEQ ID NO: 2418353 - protein, 9 aa, Entamoeba dispar
DVQKELPPK

SEQ ID NO: 2418354 - protein, 10 aa, Entamoeba dispar
DVQNKQSSNN

SEQ ID NO: 2418355 - protein, 18 aa, Entamoeba dispar
DVRKRKDAVASRASQIDA

SEQ ID NO: 2418356 - protein, 11 aa, Entamoeba dispar
DVSAYSSKSVE

SEQ ID NO: 2418357 - protein, 4 aa, Entamoeba dispar
DVSD

SEQ ID NO: 2418358 - protein, 7 aa, Entamoeba dispar
DVSDDCK

SEQ ID NO: 2418359 - protein, 13 aa, Entamoeba dispar
DVSDVAVSILIFI

SEQ ID NO: 2418360 - protein, 9 aa, Entamoeba dispar
DVSERFPKD

SEQ ID NO: 2418361 - protein, 7 aa, Entamoeba dispar
DVSESSA

SEQ ID NO: 2418362 - protein, 17 aa, Entamoeba dispar
DVSGSERSQFKFIRRNF

SEQ ID NO: 2418363 - protein, 5 aa, Entamoeba dispar
DVSGY

SEQ ID NO: 2418364 - protein, 7 aa, Entamoeba dispar
DVSIPGE

SEQ ID NO: 2418365 - protein, 9 aa, Entamoeba dispar
DVSNTQNFG

SEQ ID NO: 2418366 - protein, 4 aa, Entamoeba dispar
DVSP

SEQ ID NO: 2418367 - protein, 8 aa, Entamoeba dispar
DVSSKSDG

SEQ ID NO: 2418368 - protein, 47 aa, Entamoeba dispar
DVSSSEEEESEEEEESEKEDQDENEEKEEENIEEQQKENNVTNEDDF

SEQ ID NO: 2418369 - protein, 5 aa, Entamoeba dispar
DVSTE

SEQ ID NO: 2418370 - protein, 8 aa, Entamoeba dispar
DVSTEKDE

SEQ ID NO: 2418371 - protein, 4 aa, Entamoeba dispar
DVSY

SEQ ID NO: 2418372 - protein, 7 aa, Entamoeba dispar
DVSYEDR

SEQ ID NO: 2418373 - protein, 8 aa, Entamoeba dispar
DVSYKGTP

SEQ ID NO: 2418374 - protein, 8 aa, Entamoeba dispar
DVTGGMAG

SEQ ID NO: 2418375 - protein, 9 aa, Entamoeba dispar
DVTKANEMN

SEQ ID NO: 2418376 - protein, 8 aa, Entamoeba dispar
DVTNQREK

SEQ ID NO: 2418377 - protein, 5 aa, Entamoeba dispar
DVTPC

SEQ ID NO: 2418378 - protein, 10 aa, Entamoeba dispar
DVTPSADLTQ

SEQ ID NO: 2418379 - protein, 6 aa, Entamoeba dispar
DVTPVK

SEQ ID NO: 2418380 - protein, 11 aa, Entamoeba dispar
DVTQKDNLEDV

SEQ ID NO: 2418381 - protein, 8 aa, Entamoeba dispar
DVTQTATS

SEQ ID NO: 2418382 - protein, 5 aa, Entamoeba dispar
DVTTR

SEQ ID NO: 2418383 - protein, 7 aa, Entamoeba dispar
DVTTTDK

SEQ ID NO: 2418384 - protein, 7 aa, Entamoeba dispar
DVTTTNK

SEQ ID NO: 2418385 - protein, 7 aa, Entamoeba dispar
DVTVENS

SEQ ID NO: 2418386 - protein, 8 aa, Entamoeba dispar
DVYDPNEV

SEQ ID NO: 2418387 - protein, 10 aa, Entamoeba dispar
DWEAEKRDEM

SEQ ID NO: 2418388 - protein, 5 aa, Entamoeba dispar
DWEDG

SEQ ID NO: 2418389 - protein, 13 aa, Entamoeba dispar
DWEKEKAANEKEL

SEQ ID NO: 2418390 - protein, 5 aa, Entamoeba dispar
DWGAD

SEQ ID NO: 2418391 - protein, 17 aa, Entamoeba dispar
DWGTGNDVDITPSQGTV

SEQ ID NO: 2418392 - protein, 10 aa, Entamoeba dispar
DWNPQSDIQA

SEQ ID NO: 2418393 - protein, 8 aa, Entamoeba dispar
DWQESTRK

SEQ ID NO: 2418394 - protein, 12 aa, Entamoeba dispar
DWRDEDKKGYWG

SEQ ID NO: 2418395 - protein, 6 aa, Entamoeba dispar
DWSGYS

SEQ ID NO: 2418396 - protein, 6 aa, Entamoeba dispar
DWSPVS

SEQ ID NO: 2418397 - protein, 7 aa, Entamoeba dispar
DWTDDTD

SEQ ID NO: 2418398 - protein, 5 aa, Entamoeba dispar
DWYES

SEQ ID NO: 2418399 - protein, 7 aa, Entamoeba dispar
DYAIEAG

SEQ ID NO: 2418400 - protein, 6 aa, Entamoeba dispar
DYASQQ

SEQ ID NO: 2418401 - protein, 13 aa, Entamoeba dispar
DYASRPDKISGAE

SEQ ID NO: 2418402 - protein, 7 aa, Entamoeba dispar
DYCEDDG

SEQ ID NO: 2418403 - protein, 16 aa, Entamoeba dispar
DYDDKYDIDPTITRKE

SEQ ID NO: 2418404 - protein, 5 aa, Entamoeba dispar
DYDES

SEQ ID NO: 2418405 - protein, 6 aa, Entamoeba dispar
DYDGKI

SEQ ID NO: 2418406 - protein, 13 aa, Entamoeba dispar
DYDKDNSGKFDQE

SEQ ID NO: 2418407 - protein, 4 aa, Entamoeba dispar
DYDN

SEQ ID NO: 2418408 - protein, 7 aa, Entamoeba dispar
DYDNDNT

SEQ ID NO: 2418409 - protein, 4 aa, Entamoeba dispar
DYDP

SEQ ID NO: 2418410 - protein, 7 aa, Entamoeba dispar
DYDPKQR

SEQ ID NO: 2418411 - protein, 6 aa, Entamoeba dispar
DYDTNE

SEQ ID NO: 2418412 - protein, 8 aa, Entamoeba dispar
DYEDNSEG

SEQ ID NO: 2418413 - protein, 11 aa, Entamoeba dispar
DYEEDEEQTED

SEQ ID NO: 2418414 - protein, 5 aa, Entamoeba dispar
DYEGA

SEQ ID NO: 2418415 - protein, 37 aa, Entamoeba dispar
DYEHNEKDNEIKDSSESSIESKEDSKEEKNEKSPLLK

SEQ ID NO: 2418416 - protein, 52 aa, Entamoeba dispar
DYEIKKKPQSTNLTKEAEKVEIENQKRKSKKELSSSKQLKEKKKSIKTSSLK

SEQ ID NO: 2418417 - protein, 8 aa, Entamoeba dispar
DYEKNGNK

SEQ ID NO: 2418418 - protein, 24 aa, Entamoeba dispar
DYEKPLETKGTKEITEIKPSKSQS

SEQ ID NO: 2418419 - protein, 9 aa, Entamoeba dispar
DYEKQLQRE

SEQ ID NO: 2418420 - protein, 22 aa, Entamoeba dispar
DYENLQTTNVHESKKEEQKEIT

SEQ ID NO: 2418421 - protein, 11 aa, Entamoeba dispar
DYENSVTKASE

SEQ ID NO: 2418422 - protein, 16 aa, Entamoeba dispar
DYEQLTEDDKAYNEHE

SEQ ID NO: 2418423 - protein, 6 aa, Entamoeba dispar
DYETTE

SEQ ID NO: 2418424 - protein, 4 aa, Entamoeba dispar
DYFS

SEQ ID NO: 2418425 - protein, 9 aa, Entamoeba dispar
DYGDENEPI

SEQ ID NO: 2418426 - protein, 10 aa, Entamoeba dispar
DYGDGKHPKW

SEQ ID NO: 2418427 - protein, 6 aa, Entamoeba dispar
DYGEYY

SEQ ID NO: 2418428 - protein, 6 aa, Entamoeba dispar
DYGKEY

SEQ ID NO: 2418429 - protein, 6 aa, Entamoeba dispar
DYGTTS

SEQ ID NO: 2418430 - protein, 6 aa, Entamoeba dispar
DYHDKD

SEQ ID NO: 2418431 - protein, 7 aa, Entamoeba dispar
DYHTSKK

SEQ ID NO: 2418432 - protein, 5 aa, Entamoeba dispar
DYIND

SEQ ID NO: 2418433 - protein, 5 aa, Entamoeba dispar
DYITK

SEQ ID NO: 2418434 - protein, 9 aa, Entamoeba dispar
DYITSATKG

SEQ ID NO: 2418435 - protein, 142 aa, Entamoeba dispar
DYKANNGNKPVPQQGGMLGGQQNGFGQQQGVFGSQQNGFGQQQGVLGNQQNGFGQQGGLFGGQQNGFGQQQGVFGGQQGGMLGNQQNGFGQQGGLFGGQQGGFGQQTQGGFGTNGFGQTNGFGQQTQGGFGTTGFGQTNGFG

SEQ ID NO: 2418436 - protein, 5 aa, Entamoeba dispar
DYKDI

SEQ ID NO: 2418437 - protein, 8 aa, Entamoeba dispar
DYKGETKY

SEQ ID NO: 2418438 - protein, 8 aa, Entamoeba dispar
DYKGTVPV

SEQ ID NO: 2418439 - protein, 5 aa, Entamoeba dispar
DYKIR

SEQ ID NO: 2418440 - protein, 10 aa, Entamoeba dispar
DYKKSPSIEL

SEQ ID NO: 2418441 - protein, 13 aa, Entamoeba dispar
DYKQSNGKGYRSA

SEQ ID NO: 2418442 - protein, 4 aa, Entamoeba dispar
DYKT

SEQ ID NO: 2418443 - protein, 21 aa, Entamoeba dispar
DYKTEEDKTKEEKENQKGNVD

SEQ ID NO: 2418444 - protein, 10 aa, Entamoeba dispar
DYKTKRKSMK

SEQ ID NO: 2418445 - protein, 17 aa, Entamoeba dispar
DYLKKQKQQSRTQEAAL

SEQ ID NO: 2418446 - protein, 39 aa, Entamoeba dispar
DYMDEEDDDYEEDDDFNDENALPEHRPFGGKDGDMDIIY

SEQ ID NO: 2418447 - protein, 13 aa, Entamoeba dispar
DYMRNGDYTPSRM

SEQ ID NO: 2418448 - protein, 4 aa, Entamoeba dispar
DYND

SEQ ID NO: 2418449 - protein, 7 aa, Entamoeba dispar
DYNEEIE

SEQ ID NO: 2418450 - protein, 10 aa, Entamoeba dispar
DYNGALQTRT

SEQ ID NO: 2418451 - protein, 12 aa, Entamoeba dispar
DYNGTTKKWKDE

SEQ ID NO: 2418452 - protein, 19 aa, Entamoeba dispar
DYNGVDENGIKKPTNKKDI

SEQ ID NO: 2418453 - protein, 8 aa, Entamoeba dispar
DYNKNVES

SEQ ID NO: 2418454 - protein, 7 aa, Entamoeba dispar
DYNMPKE

SEQ ID NO: 2418455 - protein, 4 aa, Entamoeba dispar
DYNN

SEQ ID NO: 2418456 - protein, 8 aa, Entamoeba dispar
DYNRLEED

SEQ ID NO: 2418457 - protein, 5 aa, Entamoeba dispar
DYNSG

SEQ ID NO: 2418458 - protein, 16 aa, Entamoeba dispar
DYNTRDGTCIRDYIHV

SEQ ID NO: 2418459 - protein, 5 aa, Entamoeba dispar
DYNYD

SEQ ID NO: 2418460 - protein, 28 aa, Entamoeba dispar
DYPDRNYNESRNRSNSRHRKESRYYQKS

SEQ ID NO: 2418461 - protein, 4 aa, Entamoeba dispar
DYPI

SEQ ID NO: 2418462 - protein, 13 aa, Entamoeba dispar
DYPLPESGNERRI

SEQ ID NO: 2418463 - protein, 9 aa, Entamoeba dispar
DYPNNPPKV

SEQ ID NO: 2418464 - protein, 4 aa, Entamoeba dispar
DYPP

SEQ ID NO: 2418465 - protein, 8 aa, Entamoeba dispar
DYPPFPST

SEQ ID NO: 2418466 - protein, 7 aa, Entamoeba dispar
DYPTESF

SEQ ID NO: 2418467 - protein, 10 aa, Entamoeba dispar
DYQATSPNEE

SEQ ID NO: 2418468 - protein, 6 aa, Entamoeba dispar
DYQEIR

SEQ ID NO: 2418469 - protein, 5 aa, Entamoeba dispar
DYQPN

SEQ ID NO: 2418470 - protein, 10 aa, Entamoeba dispar
DYQPPKQPRM

SEQ ID NO: 2418471 - protein, 15 aa, Entamoeba dispar
DYQQQSSIQEKRLSP

SEQ ID NO: 2418472 - protein, 4 aa, Entamoeba dispar
DYQT

SEQ ID NO: 2418473 - protein, 34 aa, Entamoeba dispar
DYREEEDDDDIGEEEIDKEIKERLSNIKGENQIK

SEQ ID NO: 2418474 - protein, 34 aa, Entamoeba dispar
DYREEEEDDDIGEEEIDKEIKERLSNIKGENQIK

SEQ ID NO: 2418475 - protein, 32 aa, Entamoeba dispar
DYRKRTNDMLPKKSLKSSSYTQTHPIGPQGPI

SEQ ID NO: 2418476 - protein, 5 aa, Entamoeba dispar
DYRKT

SEQ ID NO: 2418477 - protein, 5 aa, Entamoeba dispar
DYRQT

SEQ ID NO: 2418478 - protein, 8 aa, Entamoeba dispar
DYSAAYGY

SEQ ID NO: 2418479 - protein, 5 aa, Entamoeba dispar
DYSEP

SEQ ID NO: 2418480 - protein, 12 aa, Entamoeba dispar
DYSESSSLCHSI

SEQ ID NO: 2418481 - protein, 10 aa, Entamoeba dispar
DYSKNKNETI

SEQ ID NO: 2418482 - protein, 7 aa, Entamoeba dispar
DYSKSIE

SEQ ID NO: 2418483 - protein, 4 aa, Entamoeba dispar
DYSP

SEQ ID NO: 2418484 - protein, 13 aa, Entamoeba dispar
DYSPETKEKHSRL

SEQ ID NO: 2418485 - protein, 6 aa, Entamoeba dispar
DYSPSL

SEQ ID NO: 2418486 - protein, 7 aa, Entamoeba dispar
DYSRALD

SEQ ID NO: 2418487 - protein, 4 aa, Entamoeba dispar
DYSY

SEQ ID NO: 2418488 - protein, 10 aa, Entamoeba dispar
DYTEDKIEEI

SEQ ID NO: 2418489 - protein, 8 aa, Entamoeba dispar
DYTKRPNI

SEQ ID NO: 2418490 - protein, 5 aa, Entamoeba dispar
DYTQI

SEQ ID NO: 2418491 - protein, 10 aa, Entamoeba dispar
DYTQKLSSEL

SEQ ID NO: 2418492 - protein, 7 aa, Entamoeba dispar
DYTSGYE

SEQ ID NO: 2418493 - protein, 7 aa, Entamoeba dispar
DYTSTAG

SEQ ID NO: 2418494 - protein, 25 aa, Entamoeba dispar
DYVDKKDNELEISSEEEDDEEEERL

SEQ ID NO: 2418495 - protein, 12 aa, Entamoeba dispar
DYVREKKEPLSV

SEQ ID NO: 2418496 - protein, 4 aa, Entamoeba dispar
DYYS

SEQ ID NO: 2418497 - protein, 6 aa, Entamoeba dispar
DYYSKS

SEQ ID NO: 2418498 - protein, 7 aa, Entamoeba dispar
EAAEITN

SEQ ID NO: 2418499 - protein, 5 aa, Entamoeba dispar
EAAEK

SEQ ID NO: 2418500 - protein, 9 aa, Entamoeba dispar
EAAEKIGAK

SEQ ID NO: 2418501 - protein, 14 aa, Entamoeba dispar
EAAGQEITTTFGKT

SEQ ID NO: 2418502 - protein, 12 aa, Entamoeba dispar
EAAKKTEGKKAL

SEQ ID NO: 2418503 - protein, 6 aa, Entamoeba dispar
EAAQKY

SEQ ID NO: 2418504 - protein, 4 aa, Entamoeba dispar
EACG

SEQ ID NO: 2418505 - protein, 4 aa, Entamoeba dispar
EADA

SEQ ID NO: 2418506 - protein, 6 aa, Entamoeba dispar
EADDPE

SEQ ID NO: 2418507 - protein, 8 aa, Entamoeba dispar
EADDSKLK

SEQ ID NO: 2418508 - protein, 8 aa, Entamoeba dispar
EADEDTKQ

SEQ ID NO: 2418509 - protein, 5 aa, Entamoeba dispar
EADEE

SEQ ID NO: 2418510 - protein, 16 aa, Entamoeba dispar
EADEEAETKCYITTIS

SEQ ID NO: 2418511 - protein, 6 aa, Entamoeba dispar
EADFNE

SEQ ID NO: 2418512 - protein, 7 aa, Entamoeba dispar
EADGQMK

SEQ ID NO: 2418513 - protein, 15 aa, Entamoeba dispar
EADGVEDIEESPVPI

SEQ ID NO: 2418514 - protein, 11 aa, Entamoeba dispar
EADKDRDGKIS

SEQ ID NO: 2418515 - protein, 8 aa, Entamoeba dispar
EADKTYKD

SEQ ID NO: 2418516 - protein, 19 aa, Entamoeba dispar
EADNKLNPSHLKSEEETNR

SEQ ID NO: 2418517 - protein, 12 aa, Entamoeba dispar
EADNSDVKKNKI

SEQ ID NO: 2418518 - protein, 6 aa, Entamoeba dispar
EADNVS

SEQ ID NO: 2418519 - protein, 5 aa, Entamoeba dispar
EADPQ

SEQ ID NO: 2418520 - protein, 5 aa, Entamoeba dispar
EADRC

SEQ ID NO: 2418521 - protein, 8 aa, Entamoeba dispar
EADSNSEY

SEQ ID NO: 2418522 - protein, 13 aa, Entamoeba dispar
EAEAYAKEMSTEK

SEQ ID NO: 2418523 - protein, 6 aa, Entamoeba dispar
EAEERN

SEQ ID NO: 2418524 - protein, 4 aa, Entamoeba dispar
EAEG

SEQ ID NO: 2418525 - protein, 11 aa, Entamoeba dispar
EAEGNEDASSS

SEQ ID NO: 2418526 - protein, 15 aa, Entamoeba dispar
EAEGPEEMSVKRGDT

SEQ ID NO: 2418527 - protein, 6 aa, Entamoeba dispar
EAEHYT

SEQ ID NO: 2418528 - protein, 18 aa, Entamoeba dispar
EAEKAKQNLEQIETSKEF

SEQ ID NO: 2418529 - protein, 11 aa, Entamoeba dispar
EAEKMGSIPSS

SEQ ID NO: 2418530 - protein, 5 aa, Entamoeba dispar
EAELS

SEQ ID NO: 2418531 - protein, 12 aa, Entamoeba dispar
EAENAPKSYTKT

SEQ ID NO: 2418532 - protein, 16 aa, Entamoeba dispar
EAENASTKANENKKKF

SEQ ID NO: 2418533 - protein, 7 aa, Entamoeba dispar
EAENEFE

SEQ ID NO: 2418534 - protein, 6 aa, Entamoeba dispar
EAERAT

SEQ ID NO: 2418535 - protein, 35 aa, Entamoeba dispar
EAERKKELEKEKQPIEIEPQKKKEGEEKLTEERKV

SEQ ID NO: 2418536 - protein, 8 aa, Entamoeba dispar
EAERVASK

SEQ ID NO: 2418537 - protein, 44 aa, Entamoeba dispar
EAESATAAVEKAAQDPSTKPNKTQQLTSKKETAIQKAKEADSNY

SEQ ID NO: 2418538 - protein, 6 aa, Entamoeba dispar
EAESQG

SEQ ID NO: 2418539 - protein, 8 aa, Entamoeba dispar
EAETVGGN

SEQ ID NO: 2418540 - protein, 4 aa, Entamoeba dispar
EAFE

SEQ ID NO: 2418541 - protein, 7 aa, Entamoeba dispar
EAFETKV

SEQ ID NO: 2418542 - protein, 7 aa, Entamoeba dispar
EAFNNGD

SEQ ID NO: 2418543 - protein, 6 aa, Entamoeba dispar
EAFPPI

SEQ ID NO: 2418544 - protein, 22 aa, Entamoeba dispar
EAGANDVQAKHDEFQKQKEEFE

SEQ ID NO: 2418545 - protein, 7 aa, Entamoeba dispar
EAGCGKS

SEQ ID NO: 2418546 - protein, 5 aa, Entamoeba dispar
EAGDQ

SEQ ID NO: 2418547 - protein, 9 aa, Entamoeba dispar
EAGEPIKNI

SEQ ID NO: 2418548 - protein, 4 aa, Entamoeba dispar
EAGG

SEQ ID NO: 2418549 - protein, 7 aa, Entamoeba dispar
EAGGDYI

SEQ ID NO: 2418550 - protein, 7 aa, Entamoeba dispar
EAGGRSG

SEQ ID NO: 2418551 - protein, 8 aa, Entamoeba dispar
EAGKDAEN

SEQ ID NO: 2418552 - protein, 12 aa, Entamoeba dispar
EAGKKEEQSDNI

SEQ ID NO: 2418553 - protein, 6 aa, Entamoeba dispar
EAGKKI

SEQ ID NO: 2418554 - protein, 12 aa, Entamoeba dispar
EAGLGGGNKSSG

SEQ ID NO: 2418555 - protein, 8 aa, Entamoeba dispar
EAGNIPPE

SEQ ID NO: 2418556 - protein, 5 aa, Entamoeba dispar
EAGNP

SEQ ID NO: 2418557 - protein, 11 aa, Entamoeba dispar
EAGNVPEDIGQ

SEQ ID NO: 2418558 - protein, 7 aa, Entamoeba dispar
EAGPELE

SEQ ID NO: 2418559 - protein, 6 aa, Entamoeba dispar
EAGRNG

SEQ ID NO: 2418560 - protein, 7 aa, Entamoeba dispar
EAGRSTI

SEQ ID NO: 2418561 - protein, 6 aa, Entamoeba dispar
EAGTKR

SEQ ID NO: 2418562 - protein, 7 aa, Entamoeba dispar
EAHENRN

SEQ ID NO: 2418563 - protein, 14 aa, Entamoeba dispar
EAHKKNMKASNNGQ

SEQ ID NO: 2418564 - protein, 6 aa, Entamoeba dispar
EAHKNG

SEQ ID NO: 2418565 - protein, 6 aa, Entamoeba dispar
EAHPEG

SEQ ID NO: 2418566 - protein, 10 aa, Entamoeba dispar
EAHRSHGAVA

SEQ ID NO: 2418567 - protein, 44 aa, Entamoeba dispar
EAIAKEKDAKKKKELEEAKKKVQESIEEAKKTTKKALDTNNDED

SEQ ID NO: 2418568 - protein, 17 aa, Entamoeba dispar
EAIKATKINPNYSNDSL

SEQ ID NO: 2418569 - protein, 18 aa, Entamoeba dispar
EAIKEDNSIKQCSEEKIK

SEQ ID NO: 2418570 - protein, 6 aa, Entamoeba dispar
EAINSS

SEQ ID NO: 2418571 - protein, 4 aa, Entamoeba dispar
EAIS

SEQ ID NO: 2418572 - protein, 7 aa, Entamoeba dispar
EAISNKP

SEQ ID NO: 2418573 - protein, 24 aa, Entamoeba dispar
EAITGRKKNKKERTKKAKGGDCVL

SEQ ID NO: 2418574 - protein, 9 aa, Entamoeba dispar
EAKAGTIDT

SEQ ID NO: 2418575 - protein, 18 aa, Entamoeba dispar
EAKAKKHSQKRRNVKLGI

SEQ ID NO: 2418576 - protein, 15 aa, Entamoeba dispar
EAKAKSAKKCEGKNL

SEQ ID NO: 2418577 - protein, 8 aa, Entamoeba dispar
EAKDSIKW

SEQ ID NO: 2418578 - protein, 4 aa, Entamoeba dispar
EAKE

SEQ ID NO: 2418579 - protein, 7 aa, Entamoeba dispar
EAKEAGA

SEQ ID NO: 2418580 - protein, 5 aa, Entamoeba dispar
EAKEE

SEQ ID NO: 2418581 - protein, 5 aa, Entamoeba dispar
EAKEQ

SEQ ID NO: 2418582 - protein, 12 aa, Entamoeba dispar
EAKEWKERGRGD

SEQ ID NO: 2418583 - protein, 6 aa, Entamoeba dispar
EAKGQD

SEQ ID NO: 2418584 - protein, 8 aa, Entamoeba dispar
EAKGSDNQ

SEQ ID NO: 2418585 - protein, 10 aa, Entamoeba dispar
EAKKENENLK

SEQ ID NO: 2418586 - protein, 9 aa, Entamoeba dispar
EAKKEVNKM

SEQ ID NO: 2418587 - protein, 9 aa, Entamoeba dispar
EAKKLSKNF

SEQ ID NO: 2418588 - protein, 10 aa, Entamoeba dispar
EAKKMNSSNV

SEQ ID NO: 2418589 - protein, 5 aa, Entamoeba dispar
EAKKP

SEQ ID NO: 2418590 - protein, 6 aa, Entamoeba dispar
EAKNIK

SEQ ID NO: 2418591 - protein, 12 aa, Entamoeba dispar
EAKQERGQSTMQ

SEQ ID NO: 2418592 - protein, 10 aa, Entamoeba dispar
EAKQGSVTEV

SEQ ID NO: 2418593 - protein, 13 aa, Entamoeba dispar
EAKQWTNDQVYHM

SEQ ID NO: 2418594 - protein, 56 aa, Entamoeba dispar
EAKRIEQEKIKKAKEEEQQKIKEEEERKRIEENERIQKEEEEKKKKEEEKIKKEHE

SEQ ID NO: 2418595 - protein, 9 aa, Entamoeba dispar
EAKTKRNWL

SEQ ID NO: 2418596 - protein, 15 aa, Entamoeba dispar
EAKTNKFTLKNVIET

SEQ ID NO: 2418597 - protein, 12 aa, Entamoeba dispar
EAKVTPMILMPM

SEQ ID NO: 2418598 - protein, 12 aa, Entamoeba dispar
EALAGGPIGKLR

SEQ ID NO: 2418599 - protein, 8 aa, Entamoeba dispar
EALDNSNY

SEQ ID NO: 2418600 - protein, 12 aa, Entamoeba dispar
EALESEKEEIEE

SEQ ID NO: 2418601 - protein, 10 aa, Entamoeba dispar
EALKKEYENG

SEQ ID NO: 2418602 - protein, 4 aa, Entamoeba dispar
EALN

SEQ ID NO: 2418603 - protein, 6 aa, Entamoeba dispar
EALNPS

SEQ ID NO: 2418604 - protein, 13 aa, Entamoeba dispar
EALQGSKAKLEGF

SEQ ID NO: 2418605 - protein, 20 aa, Entamoeba dispar
EALTKEKEDFQKGAGNRQIE

SEQ ID NO: 2418606 - protein, 28 aa, Entamoeba dispar
EAMDSTTKKKKKTPEEMRAEGLKRKAEI

SEQ ID NO: 2418607 - protein, 7 aa, Entamoeba dispar
EAMKKDP

SEQ ID NO: 2418608 - protein, 5 aa, Entamoeba dispar
EANDA

SEQ ID NO: 2418609 - protein, 6 aa, Entamoeba dispar
EANDES

SEQ ID NO: 2418610 - protein, 6 aa, Entamoeba dispar
EANDRN

SEQ ID NO: 2418611 - protein, 8 aa, Entamoeba dispar
EANDSAIT

SEQ ID NO: 2418612 - protein, 15 aa, Entamoeba dispar
EANDSQESMKEQIDQ

SEQ ID NO: 2418613 - protein, 5 aa, Entamoeba dispar
EANEI

SEQ ID NO: 2418614 - protein, 7 aa, Entamoeba dispar
EANEIRA

SEQ ID NO: 2418615 - protein, 8 aa, Entamoeba dispar
EANEIRAT

SEQ ID NO: 2418616 - protein, 6 aa, Entamoeba dispar
EANERR

SEQ ID NO: 2418617 - protein, 5 aa, Entamoeba dispar
EANGM

SEQ ID NO: 2418618 - protein, 7 aa, Entamoeba dispar
EANIGRS

SEQ ID NO: 2418619 - protein, 31 aa, Entamoeba dispar
EANKARKEAKKAKAANKKPAKEIKQKEMAPI

SEQ ID NO: 2418620 - protein, 7 aa, Entamoeba dispar
EANKISR

SEQ ID NO: 2418621 - protein, 11 aa, Entamoeba dispar
EANKSLKTVQA

SEQ ID NO: 2418622 - protein, 31 aa, Entamoeba dispar
EANKTRKEAKKAKAANKKPTKEIKQKEMAPI

SEQ ID NO: 2418623 - protein, 10 aa, Entamoeba dispar
EANNRNNNNL

SEQ ID NO: 2418624 - protein, 12 aa, Entamoeba dispar
EANNTLGHPEPT

SEQ ID NO: 2418625 - protein, 8 aa, Entamoeba dispar
EANPDAFN

SEQ ID NO: 2418626 - protein, 9 aa, Entamoeba dispar
EANPKTHIP

SEQ ID NO: 2418627 - protein, 9 aa, Entamoeba dispar
EANPTHETC

SEQ ID NO: 2418628 - protein, 5 aa, Entamoeba dispar
EANQD

SEQ ID NO: 2418629 - protein, 6 aa, Entamoeba dispar
EANQEL

SEQ ID NO: 2418630 - protein, 7 aa, Entamoeba dispar
EANQMVG

SEQ ID NO: 2418631 - protein, 8 aa, Entamoeba dispar
EANQPNTA

SEQ ID NO: 2418632 - protein, 8 aa, Entamoeba dispar
EANRGKQA

SEQ ID NO: 2418633 - protein, 6 aa, Entamoeba dispar
EANYPD

SEQ ID NO: 2418634 - protein, 9 aa, Entamoeba dispar
EAPADRQYS

SEQ ID NO: 2418635 - protein, 13 aa, Entamoeba dispar
EAPEPNEEAKNEL

SEQ ID NO: 2418636 - protein, 4 aa, Entamoeba dispar
EAPI

SEQ ID NO: 2418637 - protein, 7 aa, Entamoeba dispar
EAPLGLS

SEQ ID NO: 2418638 - protein, 20 aa, Entamoeba dispar
EAPLQSKTSPVQTKKEIPSL

SEQ ID NO: 2418639 - protein, 12 aa, Entamoeba dispar
EAPNDPNSPPIG

SEQ ID NO: 2418640 - protein, 9 aa, Entamoeba dispar
EAPPQEPNL

SEQ ID NO: 2418641 - protein, 7 aa, Entamoeba dispar
EAPSTTY

SEQ ID NO: 2418642 - protein, 5 aa, Entamoeba dispar
EAPSV

SEQ ID NO: 2418643 - protein, 6 aa, Entamoeba dispar
EAQAKY

SEQ ID NO: 2418644 - protein, 13 aa, Entamoeba dispar
EAQANERKEDIRK

SEQ ID NO: 2418645 - protein, 5 aa, Entamoeba dispar
EAQDE

SEQ ID NO: 2418646 - protein, 4 aa, Entamoeba dispar
EAQK

SEQ ID NO: 2418647 - protein, 9 aa, Entamoeba dispar
EAQKHGSNG

SEQ ID NO: 2418648 - protein, 8 aa, Entamoeba dispar
EAQKSTDD

SEQ ID NO: 2418649 - protein, 9 aa, Entamoeba dispar
EAQNKNLET

SEQ ID NO: 2418650 - protein, 5 aa, Entamoeba dispar
EAQSR

SEQ ID NO: 2418651 - protein, 15 aa, Entamoeba dispar
EAQTSKRNRRQKATM

SEQ ID NO: 2418652 - protein, 4 aa, Entamoeba dispar
EARA

SEQ ID NO: 2418653 - protein, 17 aa, Entamoeba dispar
EARAKAECREIATKDDA

SEQ ID NO: 2418654 - protein, 13 aa, Entamoeba dispar
EARDNQTPTYKRP

SEQ ID NO: 2418655 - protein, 25 aa, Entamoeba dispar
EARQKTAQEELQRYNEGKKGMASAE

SEQ ID NO: 2418656 - protein, 17 aa, Entamoeba dispar
EARSSTGIANELSKEQI

SEQ ID NO: 2418657 - protein, 4 aa, Entamoeba dispar
EART

SEQ ID NO: 2418658 - protein, 5 aa, Entamoeba dispar
EARTI

SEQ ID NO: 2418659 - protein, 8 aa, Entamoeba dispar
EASDYAAD

SEQ ID NO: 2418660 - protein, 17 aa, Entamoeba dispar
EASEKISKSKKPKDIEQ

SEQ ID NO: 2418661 - protein, 6 aa, Entamoeba dispar
EASELE

SEQ ID NO: 2418662 - protein, 8 aa, Entamoeba dispar
EASKAKVA

SEQ ID NO: 2418663 - protein, 7 aa, Entamoeba dispar
EASKHCK

SEQ ID NO: 2418664 - protein, 13 aa, Entamoeba dispar
EASKTKSKTPNNQ

SEQ ID NO: 2418665 - protein, 13 aa, Entamoeba dispar
EASLAKGVSTPPD

SEQ ID NO: 2418666 - protein, 4 aa, Entamoeba dispar
EASM

SEQ ID NO: 2418667 - protein, 9 aa, Entamoeba dispar
EASNPGNVD

SEQ ID NO: 2418668 - protein, 6 aa, Entamoeba dispar
EASNRL

SEQ ID NO: 2418669 - protein, 12 aa, Entamoeba dispar
EASRANKEDKLS

SEQ ID NO: 2418670 - protein, 7 aa, Entamoeba dispar
EASRRDQ

SEQ ID NO: 2418671 - protein, 7 aa, Entamoeba dispar
EASSGNG

SEQ ID NO: 2418672 - protein, 8 aa, Entamoeba dispar
EASSPEEY

SEQ ID NO: 2418673 - protein, 19 aa, Entamoeba dispar
EASVRKAQKSGGDGESPAG

SEQ ID NO: 2418674 - protein, 6 aa, Entamoeba dispar
EATAAG

SEQ ID NO: 2418675 - protein, 6 aa, Entamoeba dispar
EATCPT

SEQ ID NO: 2418676 - protein, 10 aa, Entamoeba dispar
EATDDDIKKA

SEQ ID NO: 2418677 - protein, 6 aa, Entamoeba dispar
EATDNI

SEQ ID NO: 2418678 - protein, 10 aa, Entamoeba dispar
EATEKGESIE

SEQ ID NO: 2418679 - protein, 11 aa, Entamoeba dispar
EATGQPSAEDL

SEQ ID NO: 2418680 - protein, 9 aa, Entamoeba dispar
EATGRRNYK

SEQ ID NO: 2418681 - protein, 4 aa, Entamoeba dispar
EATI

SEQ ID NO: 2418682 - protein, 12 aa, Entamoeba dispar
EATINEASKMSN

SEQ ID NO: 2418683 - protein, 7 aa, Entamoeba dispar
EATKEEG

SEQ ID NO: 2418684 - protein, 10 aa, Entamoeba dispar
EATKKIDKRG

SEQ ID NO: 2418685 - protein, 17 aa, Entamoeba dispar
EATMSNDVENIQEKQKQ

SEQ ID NO: 2418686 - protein, 7 aa, Entamoeba dispar
EATNGQF

SEQ ID NO: 2418687 - protein, 18 aa, Entamoeba dispar
EATSNENLSQSYQGWCPY

SEQ ID NO: 2418688 - protein, 5 aa, Entamoeba dispar
EATTG

SEQ ID NO: 2418689 - protein, 6 aa, Entamoeba dispar
EATVNK

SEQ ID NO: 2418690 - protein, 9 aa, Entamoeba dispar
EATVVPKNE

SEQ ID NO: 2418691 - protein, 12 aa, Entamoeba dispar
EATYAYSQKDYM

SEQ ID NO: 2418692 - protein, 29 aa, Entamoeba dispar
EAVEQRKKNLEMQKEENKMKKQKRREDAI

SEQ ID NO: 2418693 - protein, 5 aa, Entamoeba dispar
EAVER

SEQ ID NO: 2418694 - protein, 8 aa, Entamoeba dispar
EAVETEES

SEQ ID NO: 2418695 - protein, 10 aa, Entamoeba dispar
EAVGNETVPV

SEQ ID NO: 2418696 - protein, 16 aa, Entamoeba dispar
EAVKKGSLDQQEANRR

SEQ ID NO: 2418697 - protein, 17 aa, Entamoeba dispar
EAVKKGSLDQQEANRRI

SEQ ID NO: 2418698 - protein, 10 aa, Entamoeba dispar
EAVKNADVEY

SEQ ID NO: 2418699 - protein, 5 aa, Entamoeba dispar
EAVKQ

SEQ ID NO: 2418700 - protein, 9 aa, Entamoeba dispar
EAVKQGSAV

SEQ ID NO: 2418701 - protein, 6 aa, Entamoeba dispar
EAVNSN

SEQ ID NO: 2418702 - protein, 5 aa, Entamoeba dispar
EAVRK

SEQ ID NO: 2418703 - protein, 6 aa, Entamoeba dispar
EAVRQR

SEQ ID NO: 2418704 - protein, 7 aa, Entamoeba dispar
EAVRRDS

SEQ ID NO: 2418705 - protein, 11 aa, Entamoeba dispar
EAVSEPTNNFG

SEQ ID NO: 2418706 - protein, 4 aa, Entamoeba dispar
EAVT

SEQ ID NO: 2418707 - protein, 7 aa, Entamoeba dispar
EAWDKNQ

SEQ ID NO: 2418708 - protein, 23 aa, Entamoeba dispar
EAWNECKNKEYTEYDRNTYGNTI

SEQ ID NO: 2418709 - protein, 10 aa, Entamoeba dispar
EAYKTLKTEV

SEQ ID NO: 2418710 - protein, 9 aa, Entamoeba dispar
EAYQNEQIA

SEQ ID NO: 2418711 - protein, 30 aa, Entamoeba dispar
ECCNKQESQEKIEAKEEEMEIDKSNTENEK

SEQ ID NO: 2418712 - protein, 18 aa, Entamoeba dispar
ECDASDAGSEVAADRTKG

SEQ ID NO: 2418713 - protein, 22 aa, Entamoeba dispar
ECDDKKEQQTDVDYSKDNDTSL

SEQ ID NO: 2418714 - protein, 10 aa, Entamoeba dispar
ECDEGKIDIK

SEQ ID NO: 2418715 - protein, 7 aa, Entamoeba dispar
ECDGGME

SEQ ID NO: 2418716 - protein, 8 aa, Entamoeba dispar
ECDPERKE

SEQ ID NO: 2418717 - protein, 11 aa, Entamoeba dispar
ECDREKYGCPI

SEQ ID NO: 2418718 - protein, 7 aa, Entamoeba dispar
ECDSGNF

SEQ ID NO: 2418719 - protein, 6 aa, Entamoeba dispar
ECDTGM

SEQ ID NO: 2418720 - protein, 7 aa, Entamoeba dispar
ECDYQSD

SEQ ID NO: 2418721 - protein, 4 aa, Entamoeba dispar
ECEE

SEQ ID NO: 2418722 - protein, 5 aa, Entamoeba dispar
ECEKE

SEQ ID NO: 2418723 - protein, 7 aa, Entamoeba dispar
ECEKESE

SEQ ID NO: 2418724 - protein, 5 aa, Entamoeba dispar
ECEKY

SEQ ID NO: 2418725 - protein, 8 aa, Entamoeba dispar
ECEPKPLQ

SEQ ID NO: 2418726 - protein, 4 aa, Entamoeba dispar
ECGK

SEQ ID NO: 2418727 - protein, 9 aa, Entamoeba dispar
ECGTNKDYR

SEQ ID NO: 2418728 - protein, 19 aa, Entamoeba dispar
ECHGNDGNEGGCEGGFKSH

SEQ ID NO: 2418729 - protein, 9 aa, Entamoeba dispar
ECKATPDEM

SEQ ID NO: 2418730 - protein, 8 aa, Entamoeba dispar
ECKEIASA

SEQ ID NO: 2418731 - protein, 7 aa, Entamoeba dispar
ECKNDEQ

SEQ ID NO: 2418732 - protein, 17 aa, Entamoeba dispar
ECKPKRSISSEPFTRQR

SEQ ID NO: 2418733 - protein, 10 aa, Entamoeba dispar
ECKTKDVLNQ

SEQ ID NO: 2418734 - protein, 6 aa, Entamoeba dispar
ECLSGK

SEQ ID NO: 2418735 - protein, 5 aa, Entamoeba dispar
ECNGS

SEQ ID NO: 2418736 - protein, 6 aa, Entamoeba dispar
ECNPDN

SEQ ID NO: 2418737 - protein, 15 aa, Entamoeba dispar
ECNSDEEILSKTRNT

SEQ ID NO: 2418738 - protein, 7 aa, Entamoeba dispar
ECPAGNI

SEQ ID NO: 2418739 - protein, 8 aa, Entamoeba dispar
ECPEESRE

SEQ ID NO: 2418740 - protein, 29 aa, Entamoeba dispar
ECPETNKPFFNEEDDSREENVQRLIITQW

SEQ ID NO: 2418741 - protein, 7 aa, Entamoeba dispar
ECPETVN

SEQ ID NO: 2418742 - protein, 10 aa, Entamoeba dispar
ECPSNTEQEL

SEQ ID NO: 2418743 - protein, 4 aa, Entamoeba dispar
ECQD

SEQ ID NO: 2418744 - protein, 6 aa, Entamoeba dispar
ECQGYG

SEQ ID NO: 2418745 - protein, 12 aa, Entamoeba dispar
ECQKTKKNEQDL

SEQ ID NO: 2418746 - protein, 4 aa, Entamoeba dispar
ECRA

SEQ ID NO: 2418747 - protein, 6 aa, Entamoeba dispar
ECRKAS

SEQ ID NO: 2418748 - protein, 10 aa, Entamoeba dispar
ECSAANQNGL

SEQ ID NO: 2418749 - protein, 14 aa, Entamoeba dispar
ECSEKAGDLVKPYD

SEQ ID NO: 2418750 - protein, 17 aa, Entamoeba dispar
ECSSSKSINIPSSITSF

SEQ ID NO: 2418751 - protein, 6 aa, Entamoeba dispar
ECTEKT

SEQ ID NO: 2418752 - protein, 5 aa, Entamoeba dispar
ECTGK

SEQ ID NO: 2418753 - protein, 7 aa, Entamoeba dispar
ECTGNDW

SEQ ID NO: 2418754 - protein, 11 aa, Entamoeba dispar
ECTKCNKGYEL

SEQ ID NO: 2418755 - protein, 4 aa, Entamoeba dispar
ECTV

SEQ ID NO: 2418756 - protein, 10 aa, Entamoeba dispar
EDAALGSERL

SEQ ID NO: 2418757 - protein, 11 aa, Entamoeba dispar
EDAALGSGGLG

SEQ ID NO: 2418758 - protein, 7 aa, Entamoeba dispar
EDADLPG

SEQ ID NO: 2418759 - protein, 16 aa, Entamoeba dispar
EDAEQRRKTMKTDRYE

SEQ ID NO: 2418760 - protein, 6 aa, Entamoeba dispar
EDAETA

SEQ ID NO: 2418761 - protein, 6 aa, Entamoeba dispar
EDAGNH

SEQ ID NO: 2418762 - protein, 10 aa, Entamoeba dispar
EDAKASTEAL

SEQ ID NO: 2418763 - protein, 9 aa, Entamoeba dispar
EDAKDEIAK

SEQ ID NO: 2418764 - protein, 10 aa, Entamoeba dispar
EDAKEEIGQV

SEQ ID NO: 2418765 - protein, 19 aa, Entamoeba dispar
EDAKKDPSLLHPKTKRKSH

SEQ ID NO: 2418766 - protein, 11 aa, Entamoeba dispar
EDARVKKGFPE

SEQ ID NO: 2418767 - protein, 8 aa, Entamoeba dispar
EDASDSLV

SEQ ID NO: 2418768 - protein, 9 aa, Entamoeba dispar
EDASEKNMN

SEQ ID NO: 2418769 - protein, 14 aa, Entamoeba dispar
EDASIHRPDAPPEL

SEQ ID NO: 2418770 - protein, 10 aa, Entamoeba dispar
EDATEEETIN

SEQ ID NO: 2418771 - protein, 14 aa, Entamoeba dispar
EDATIPTRGSNYAA

SEQ ID NO: 2418772 - protein, 6 aa, Entamoeba dispar
EDCAKQ

SEQ ID NO: 2418773 - protein, 9 aa, Entamoeba dispar
EDCEKENPQ

SEQ ID NO: 2418774 - protein, 8 aa, Entamoeba dispar
EDCPNEGV

SEQ ID NO: 2418775 - protein, 5 aa, Entamoeba dispar
EDCTE

SEQ ID NO: 2418776 - protein, 7 aa, Entamoeba dispar
EDCTNQK

SEQ ID NO: 2418777 - protein, 7 aa, Entamoeba dispar
EDCTQLQ

SEQ ID NO: 2418778 - protein, 5 aa, Entamoeba dispar
EDDDF

SEQ ID NO: 2418779 - protein, 12 aa, Entamoeba dispar
EDDDGKPGKQID

SEQ ID NO: 2418780 - protein, 9 aa, Entamoeba dispar
EDDDPHPVV

SEQ ID NO: 2418781 - protein, 11 aa, Entamoeba dispar
EDDDSDEELQR

SEQ ID NO: 2418782 - protein, 7 aa, Entamoeba dispar
EDDEEHE

SEQ ID NO: 2418783 - protein, 10 aa, Entamoeba dispar
EDDESDDNKM

SEQ ID NO: 2418784 - protein, 8 aa, Entamoeba dispar
EDDFGTPQ

SEQ ID NO: 2418785 - protein, 4 aa, Entamoeba dispar
EDDG

SEQ ID NO: 2418786 - protein, 7 aa, Entamoeba dispar
EDDGDDW

SEQ ID NO: 2418787 - protein, 54 aa, Entamoeba dispar
EDDIDDLKKDIKDLKRENNPKTNLRNSIATTQPTTKETQIKEEGTSQKGNVTEA

SEQ ID NO: 2418788 - protein, 15 aa, Entamoeba dispar
EDDIEEKPVNINNPK

SEQ ID NO: 2418789 - protein, 11 aa, Entamoeba dispar
EDDINEQNIEK

SEQ ID NO: 2418790 - protein, 5 aa, Entamoeba dispar
EDDIR

SEQ ID NO: 2418791 - protein, 4 aa, Entamoeba dispar
EDDL

SEQ ID NO: 2418792 - protein, 7 aa, Entamoeba dispar
EDDLNSL

SEQ ID NO: 2418793 - protein, 7 aa, Entamoeba dispar
EDDLRQD

SEQ ID NO: 2418794 - protein, 6 aa, Entamoeba dispar
EDDMEK

SEQ ID NO: 2418795 - protein, 7 aa, Entamoeba dispar
EDDNIGN

SEQ ID NO: 2418796 - protein, 8 aa, Entamoeba dispar
EDDNSSST

SEQ ID NO: 2418797 - protein, 9 aa, Entamoeba dispar
EDDNTAQEY

SEQ ID NO: 2418798 - protein, 21 aa, Entamoeba dispar
EDDNTNKEQQNQTRQEASTLI

SEQ ID NO: 2418799 - protein, 4 aa, Entamoeba dispar
EDDQ

SEQ ID NO: 2418800 - protein, 14 aa, Entamoeba dispar
EDDREKYGNTIPSE

SEQ ID NO: 2418801 - protein, 5 aa, Entamoeba dispar
EDDRK

SEQ ID NO: 2418802 - protein, 10 aa, Entamoeba dispar
EDDSETTLDN

SEQ ID NO: 2418803 - protein, 9 aa, Entamoeba dispar
EDDSFNNCP

SEQ ID NO: 2418804 - protein, 10 aa, Entamoeba dispar
EDDSVEEKKE

SEQ ID NO: 2418805 - protein, 5 aa, Entamoeba dispar
EDDSY

SEQ ID NO: 2418806 - protein, 24 aa, Entamoeba dispar
EDDTTQNESNNFEYSDKSSDTTTL

SEQ ID NO: 2418807 - protein, 4 aa, Entamoeba dispar
EDEA

SEQ ID NO: 2418808 - protein, 5 aa, Entamoeba dispar
EDEAK

SEQ ID NO: 2418809 - protein, 9 aa, Entamoeba dispar
EDEDDQEIN

SEQ ID NO: 2418810 - protein, 10 aa, Entamoeba dispar
EDEDEEYHTN

SEQ ID NO: 2418811 - protein, 6 aa, Entamoeba dispar
EDEDEG

SEQ ID NO: 2418812 - protein, 8 aa, Entamoeba dispar
EDEDEGEF

SEQ ID NO: 2418813 - protein, 11 aa, Entamoeba dispar
EDEDEPKSPIS

SEQ ID NO: 2418814 - protein, 9 aa, Entamoeba dispar
EDEDKERMA

SEQ ID NO: 2418815 - protein, 6 aa, Entamoeba dispar
EDEDKT

SEQ ID NO: 2418816 - protein, 8 aa, Entamoeba dispar
EDEDNKKQ

SEQ ID NO: 2418817 - protein, 8 aa, Entamoeba dispar
EDEDSLER

SEQ ID NO: 2418818 - protein, 8 aa, Entamoeba dispar
EDEECENS

SEQ ID NO: 2418819 - protein, 22 aa, Entamoeba dispar
EDEEENSNSKTSDDSQEELTDE

SEQ ID NO: 2418820 - protein, 7 aa, Entamoeba dispar
EDEEFDD

SEQ ID NO: 2418821 - protein, 8 aa, Entamoeba dispar
EDEEFEDG

SEQ ID NO: 2418822 - protein, 18 aa, Entamoeba dispar
EDEEIEEDNEEHESEETL

SEQ ID NO: 2418823 - protein, 20 aa, Entamoeba dispar
EDEEKKKQIEEETDKDEKKI

SEQ ID NO: 2418824 - protein, 9 aa, Entamoeba dispar
EDEENSNGW

SEQ ID NO: 2418825 - protein, 9 aa, Entamoeba dispar
EDEETENEW

SEQ ID NO: 2418826 - protein, 13 aa, Entamoeba dispar
EDEETEPQKIFKN

SEQ ID NO: 2418827 - protein, 7 aa, Entamoeba dispar
EDEETWK

SEQ ID NO: 2418828 - protein, 69 aa, Entamoeba dispar
EDEEYEEDDESDDNKKEVSDDESGEYDPNAGEYDDEDSEEEEGDTDGSEEENNEEVSGEENESSVKEEE

SEQ ID NO: 2418829 - protein, 5 aa, Entamoeba dispar
EDEFY

SEQ ID NO: 2418830 - protein, 13 aa, Entamoeba dispar
EDEGELEEEKKID

SEQ ID NO: 2418831 - protein, 59 aa, Entamoeba dispar
EDEGENLQEIKKEEEEEKEIKKEEEEKEIKKEEINQENIKEEEKEEKHEEINQENTDVN

SEQ ID NO: 2418832 - protein, 20 aa, Entamoeba dispar
EDEGKPIKETEKTQNKVDED

SEQ ID NO: 2418833 - protein, 6 aa, Entamoeba dispar
EDEGMD

SEQ ID NO: 2418834 - protein, 8 aa, Entamoeba dispar
EDEGRTIA

SEQ ID NO: 2418835 - protein, 7 aa, Entamoeba dispar
EDEGRVD

SEQ ID NO: 2418836 - protein, 4 aa, Entamoeba dispar
EDEI

SEQ ID NO: 2418837 - protein, 13 aa, Entamoeba dispar
EDEIQDAKDESDV

SEQ ID NO: 2418838 - protein, 17 aa, Entamoeba dispar
EDEIQQQVNSSRQYTLT

SEQ ID NO: 2418839 - protein, 4 aa, Entamoeba dispar
EDEK

SEQ ID NO: 2418840 - protein, 14 aa, Entamoeba dispar
EDEKENKGQQFTQH

SEQ ID NO: 2418841 - protein, 5 aa, Entamoeba dispar
EDEKK

SEQ ID NO: 2418842 - protein, 7 aa, Entamoeba dispar
EDEKKKN

SEQ ID NO: 2418843 - protein, 5 aa, Entamoeba dispar
EDEKM

SEQ ID NO: 2418844 - protein, 8 aa, Entamoeba dispar
EDEKRRNI

SEQ ID NO: 2418845 - protein, 16 aa, Entamoeba dispar
EDEKYKRHIKQGNEDA

SEQ ID NO: 2418846 - protein, 17 aa, Entamoeba dispar
EDELKKNERIPSYCFNE

SEQ ID NO: 2418847 - protein, 21 aa, Entamoeba dispar
EDELKKNETIPRNCFKEWWLM

SEQ ID NO: 2418848 - protein, 16 aa, Entamoeba dispar
EDELKKNKKIPRNCFK

SEQ ID NO: 2418849 - protein, 15 aa, Entamoeba dispar
EDELKKNKRIPKYCF

SEQ ID NO: 2418850 - protein, 19 aa, Entamoeba dispar
EDELNEEQPTIIESNELYD

SEQ ID NO: 2418851 - protein, 10 aa, Entamoeba dispar
EDELRRNAPT

SEQ ID NO: 2418852 - protein, 12 aa, Entamoeba dispar
EDELSTDQVGSD

SEQ ID NO: 2418853 - protein, 4 aa, Entamoeba dispar
EDEM

SEQ ID NO: 2418854 - protein, 15 aa, Entamoeba dispar
EDEMKSKTTKEYSGG

SEQ ID NO: 2418855 - protein, 9 aa, Entamoeba dispar
EDEMSECNT

SEQ ID NO: 2418856 - protein, 19 aa, Entamoeba dispar
EDENKEIKQQLDNERNNHK

SEQ ID NO: 2418857 - protein, 8 aa, Entamoeba dispar
EDENVGKY

SEQ ID NO: 2418858 - protein, 5 aa, Entamoeba dispar
EDEPP

SEQ ID NO: 2418859 - protein, 5 aa, Entamoeba dispar
EDEQD

SEQ ID NO: 2418860 - protein, 14 aa, Entamoeba dispar
EDEQLKDDGNEEIV

SEQ ID NO: 2418861 - protein, 22 aa, Entamoeba dispar
EDEQQSQQKEEVRHNEADADKE

SEQ ID NO: 2418862 - protein, 9 aa, Entamoeba dispar
EDEQTKKKY

SEQ ID NO: 2418863 - protein, 19 aa, Entamoeba dispar
EDERREELNQAKQRKEELQ

SEQ ID NO: 2418864 - protein, 7 aa, Entamoeba dispar
EDESKKF

SEQ ID NO: 2418865 - protein, 13 aa, Entamoeba dispar
EDESRDISSYNED

SEQ ID NO: 2418866 - protein, 25 aa, Entamoeba dispar
EDESSSDSVISEEEEDDKNEINKSE

SEQ ID NO: 2418867 - protein, 11 aa, Entamoeba dispar
EDETDIPKEES

SEQ ID NO: 2418868 - protein, 7 aa, Entamoeba dispar
EDETMET

SEQ ID NO: 2418869 - protein, 13 aa, Entamoeba dispar
EDETQHKTSPITS

SEQ ID NO: 2418870 - protein, 9 aa, Entamoeba dispar
EDEYEEKKK

SEQ ID NO: 2418871 - protein, 4 aa, Entamoeba dispar
EDFE

SEQ ID NO: 2418872 - protein, 5 aa, Entamoeba dispar
EDFEG

SEQ ID NO: 2418873 - protein, 22 aa, Entamoeba dispar
EDFEPENKATKDQYKAAISSKV

SEQ ID NO: 2418874 - protein, 4 aa, Entamoeba dispar
EDFK

SEQ ID NO: 2418875 - protein, 17 aa, Entamoeba dispar
EDFKDNRNEFPMLPFAL

SEQ ID NO: 2418876 - protein, 7 aa, Entamoeba dispar
EDFKGDT

SEQ ID NO: 2418877 - protein, 6 aa, Entamoeba dispar
EDFNEI

SEQ ID NO: 2418878 - protein, 5 aa, Entamoeba dispar
EDFNS

SEQ ID NO: 2418879 - protein, 18 aa, Entamoeba dispar
EDFQPKYISGKNDSTGTM

SEQ ID NO: 2418880 - protein, 9 aa, Entamoeba dispar
EDFREEEYS

SEQ ID NO: 2418881 - protein, 6 aa, Entamoeba dispar
EDGDME

SEQ ID NO: 2418882 - protein, 6 aa, Entamoeba dispar
EDGEPI

SEQ ID NO: 2418883 - protein, 5 aa, Entamoeba dispar
EDGEQ

SEQ ID NO: 2418884 - protein, 9 aa, Entamoeba dispar
EDGGESPLH

SEQ ID NO: 2418885 - protein, 21 aa, Entamoeba dispar
EDGINYNKESANKKLENYNST

SEQ ID NO: 2418886 - protein, 9 aa, Entamoeba dispar
EDGIPGYYE

SEQ ID NO: 2418887 - protein, 8 aa, Entamoeba dispar
EDGIVDPK

SEQ ID NO: 2418888 - protein, 6 aa, Entamoeba dispar
EDGKAI

SEQ ID NO: 2418889 - protein, 9 aa, Entamoeba dispar
EDGKGIKQI

SEQ ID NO: 2418890 - protein, 7 aa, Entamoeba dispar
EDGNQKI

SEQ ID NO: 2418891 - protein, 10 aa, Entamoeba dispar
EDGNTSRLTE

SEQ ID NO: 2418892 - protein, 7 aa, Entamoeba dispar
EDGSGWT

SEQ ID NO: 2418893 - protein, 8 aa, Entamoeba dispar
EDGSLRND

SEQ ID NO: 2418894 - protein, 5 aa, Entamoeba dispar
EDGSV

SEQ ID NO: 2418895 - protein, 20 aa, Entamoeba dispar
EDGSYGKRKKGDITKRKEEY

SEQ ID NO: 2418896 - protein, 4 aa, Entamoeba dispar
EDGT

SEQ ID NO: 2418897 - protein, 5 aa, Entamoeba dispar
EDGTT

SEQ ID NO: 2418898 - protein, 8 aa, Entamoeba dispar
EDGVEEGT

SEQ ID NO: 2418899 - protein, 5 aa, Entamoeba dispar
EDGWA

SEQ ID NO: 2418900 - protein, 11 aa, Entamoeba dispar
EDGYGTVSNSL

SEQ ID NO: 2418901 - protein, 8 aa, Entamoeba dispar
EDHSSQTF

SEQ ID NO: 2418902 - protein, 9 aa, Entamoeba dispar
EDHSSSPTL

SEQ ID NO: 2418903 - protein, 9 aa, Entamoeba dispar
EDHTDQTKT

SEQ ID NO: 2418904 - protein, 20 aa, Entamoeba dispar
EDIDGDGLGAFGDNLSPEEI

SEQ ID NO: 2418905 - protein, 6 aa, Entamoeba dispar
EDIDGI

SEQ ID NO: 2418906 - protein, 24 aa, Entamoeba dispar
EDIDPAKLSDKTIQIESEEKEREK

SEQ ID NO: 2418907 - protein, 9 aa, Entamoeba dispar
EDIEKKENI

SEQ ID NO: 2418908 - protein, 8 aa, Entamoeba dispar
EDIEKQNK

SEQ ID NO: 2418909 - protein, 10 aa, Entamoeba dispar
EDIESSTEKD

SEQ ID NO: 2418910 - protein, 5 aa, Entamoeba dispar
EDIGI

SEQ ID NO: 2418911 - protein, 12 aa, Entamoeba dispar
EDIGSGTPNNQL

SEQ ID NO: 2418912 - protein, 15 aa, Entamoeba dispar
EDIHEARKKRIKEEM

SEQ ID NO: 2418913 - protein, 4 aa, Entamoeba dispar
EDIK

SEQ ID NO: 2418914 - protein, 8 aa, Entamoeba dispar
EDIKNGLS

SEQ ID NO: 2418915 - protein, 6 aa, Entamoeba dispar
EDINEE

SEQ ID NO: 2418916 - protein, 22 aa, Entamoeba dispar
EDINEKEDSISSEYLEEILSGM

SEQ ID NO: 2418917 - protein, 29 aa, Entamoeba dispar
EDINEKKKEEEQTKEIKKIEDGNDEIEET

SEQ ID NO: 2418918 - protein, 9 aa, Entamoeba dispar
EDINKDTAI

SEQ ID NO: 2418919 - protein, 7 aa, Entamoeba dispar
EDINKKE

SEQ ID NO: 2418920 - protein, 21 aa, Entamoeba dispar
EDINNKQNTTPPFKTNTIPPQ

SEQ ID NO: 2418921 - protein, 4 aa, Entamoeba dispar
EDIP

SEQ ID NO: 2418922 - protein, 10 aa, Entamoeba dispar
EDIQKEGRKL

SEQ ID NO: 2418923 - protein, 13 aa, Entamoeba dispar
EDISKIDNTTDQT

SEQ ID NO: 2418924 - protein, 27 aa, Entamoeba dispar
EDISKYEKQSVRSSLKHKQKDFHKNSI

SEQ ID NO: 2418925 - protein, 10 aa, Entamoeba dispar
EDITKESPLH

SEQ ID NO: 2418926 - protein, 5 aa, Entamoeba dispar
EDITT

SEQ ID NO: 2418927 - protein, 4 aa, Entamoeba dispar
EDKA

SEQ ID NO: 2418928 - protein, 4 aa, Entamoeba dispar
EDKE

SEQ ID NO: 2418929 - protein, 11 aa, Entamoeba dispar
EDKEGKKEEEL

SEQ ID NO: 2418930 - protein, 23 aa, Entamoeba dispar
EDKENHEEITQQETKEVQQKESV

SEQ ID NO: 2418931 - protein, 17 aa, Entamoeba dispar
EDKINESIKKEKKQGIK

SEQ ID NO: 2418932 - protein, 7 aa, Entamoeba dispar
EDKKEIT

SEQ ID NO: 2418933 - protein, 6 aa, Entamoeba dispar
EDKKIP

SEQ ID NO: 2418934 - protein, 13 aa, Entamoeba dispar
EDKKKKKGNGFNT

SEQ ID NO: 2418935 - protein, 13 aa, Entamoeba dispar
EDKKLTKKEMEKR

SEQ ID NO: 2418936 - protein, 7 aa, Entamoeba dispar
EDKNELN

SEQ ID NO: 2418937 - protein, 16 aa, Entamoeba dispar
EDKNKKINKNNSNINR

SEQ ID NO: 2418938 - protein, 4 aa, Entamoeba dispar
EDKP

SEQ ID NO: 2418939 - protein, 8 aa, Entamoeba dispar
EDKPKKKI

SEQ ID NO: 2418940 - protein, 7 aa, Entamoeba dispar
EDKPLVR

SEQ ID NO: 2418941 - protein, 7 aa, Entamoeba dispar
EDKPNTE

SEQ ID NO: 2418942 - protein, 9 aa, Entamoeba dispar
EDKQPSVRQ

SEQ ID NO: 2418943 - protein, 10 aa, Entamoeba dispar
EDKSGRKSPS

SEQ ID NO: 2418944 - protein, 5 aa, Entamoeba dispar
EDKST

SEQ ID NO: 2418945 - protein, 9 aa, Entamoeba dispar
EDKSTDTCG

SEQ ID NO: 2418946 - protein, 16 aa, Entamoeba dispar
EDKSYIGSASGEQLNR

SEQ ID NO: 2418947 - protein, 9 aa, Entamoeba dispar
EDKTDAEFY

SEQ ID NO: 2418948 - protein, 6 aa, Entamoeba dispar
EDKTIN

SEQ ID NO: 2418949 - protein, 8 aa, Entamoeba dispar
EDKTKMYD

SEQ ID NO: 2418950 - protein, 6 aa, Entamoeba dispar
EDKTNG

SEQ ID NO: 2418951 - protein, 7 aa, Entamoeba dispar
EDKTPYE

SEQ ID NO: 2418952 - protein, 12 aa, Entamoeba dispar
EDKTSMKKGDLA

SEQ ID NO: 2418953 - protein, 11 aa, Entamoeba dispar
EDKTSNYSETE

SEQ ID NO: 2418954 - protein, 15 aa, Entamoeba dispar
EDKYDEVPSSFISIP

SEQ ID NO: 2418955 - protein, 10 aa, Entamoeba dispar
EDLDDSIGDR

SEQ ID NO: 2418956 - protein, 53 aa, Entamoeba dispar
EDLEGQLEKAKGSAAAAGASDLKSKIKDLQDEIEDVNQKLSSEKEKSSRLQRK

SEQ ID NO: 2418957 - protein, 10 aa, Entamoeba dispar
EDLEKENDEV

SEQ ID NO: 2418958 - protein, 7 aa, Entamoeba dispar
EDLGKEE

SEQ ID NO: 2418959 - protein, 20 aa, Entamoeba dispar
EDLKKGLSEKYNKSREATKV

SEQ ID NO: 2418960 - protein, 6 aa, Entamoeba dispar
EDLNKR

SEQ ID NO: 2418961 - protein, 6 aa, Entamoeba dispar
EDLQDA

SEQ ID NO: 2418962 - protein, 6 aa, Entamoeba dispar
EDLQKV

SEQ ID NO: 2418963 - protein, 7 aa, Entamoeba dispar
EDLRQDE

SEQ ID NO: 2418964 - protein, 4 aa, Entamoeba dispar
EDLS

SEQ ID NO: 2418965 - protein, 5 aa, Entamoeba dispar
EDLSP

SEQ ID NO: 2418966 - protein, 8 aa, Entamoeba dispar
EDLSSSLD

SEQ ID NO: 2418967 - protein, 20 aa, Entamoeba dispar
EDLSTEGEFQKQEKQPIKEQ

SEQ ID NO: 2418968 - protein, 17 aa, Entamoeba dispar
EDLTEPQDIAEDPDVDR

SEQ ID NO: 2418969 - protein, 43 aa, Entamoeba dispar
EDLTNQSSDSYDPEDSNDEKNPNNSYPTTPSSEYSEDEDDEFY

SEQ ID NO: 2418970 - protein, 5 aa, Entamoeba dispar
EDMKT

SEQ ID NO: 2418971 - protein, 35 aa, Entamoeba dispar
EDMSKKETSTLLSSNAKTYFTKEKKGLSRIRQFCK

SEQ ID NO: 2418972 - protein, 5 aa, Entamoeba dispar
EDNAE

SEQ ID NO: 2418973 - protein, 6 aa, Entamoeba dispar
EDNDFS

SEQ ID NO: 2418974 - protein, 10 aa, Entamoeba dispar
EDNDKSDNTL

SEQ ID NO: 2418975 - protein, 8 aa, Entamoeba dispar
EDNEAKSV

SEQ ID NO: 2418976 - protein, 9 aa, Entamoeba dispar
EDNEKFNYP

SEQ ID NO: 2418977 - protein, 5 aa, Entamoeba dispar
EDNEW

SEQ ID NO: 2418978 - protein, 25 aa, Entamoeba dispar
EDNGEEKAKEDEGKEKKKKTRKEKK

SEQ ID NO: 2418979 - protein, 10 aa, Entamoeba dispar
EDNGYVPAEE

SEQ ID NO: 2418980 - protein, 4 aa, Entamoeba dispar
EDNI

SEQ ID NO: 2418981 - protein, 5 aa, Entamoeba dispar
EDNIE

SEQ ID NO: 2418982 - protein, 31 aa, Entamoeba dispar
EDNINKRRSSQQGGSKRNSRRRSSISLKPEH

SEQ ID NO: 2418983 - protein, 10 aa, Entamoeba dispar
EDNKDINKRI

SEQ ID NO: 2418984 - protein, 6 aa, Entamoeba dispar
EDNKSF

SEQ ID NO: 2418985 - protein, 7 aa, Entamoeba dispar
EDNLTNQ

SEQ ID NO: 2418986 - protein, 8 aa, Entamoeba dispar
EDNNSLEW

SEQ ID NO: 2418987 - protein, 6 aa, Entamoeba dispar
EDNNSR

SEQ ID NO: 2418988 - protein, 5 aa, Entamoeba dispar
EDNPQ

SEQ ID NO: 2418989 - protein, 7 aa, Entamoeba dispar
EDNPTNT

SEQ ID NO: 2418990 - protein, 5 aa, Entamoeba dispar
EDNQP

SEQ ID NO: 2418991 - protein, 10 aa, Entamoeba dispar
EDNSGSIEGE

SEQ ID NO: 2418992 - protein, 5 aa, Entamoeba dispar
EDNSL

SEQ ID NO: 2418993 - protein, 8 aa, Entamoeba dispar
EDNSSRSA

SEQ ID NO: 2418994 - protein, 97 aa, Entamoeba dispar
EDNTNYDDEENDEGYEYSDEEGEEEVEYYDEDGNLIEPGDDDEWEYEEDEIEEEKPEETEENKKNNDSKEDNENNETEDGEKEQEIDNEKKDEEEKK

SEQ ID NO: 2418995 - protein, 4 aa, Entamoeba dispar
EDNY

SEQ ID NO: 2418996 - protein, 8 aa, Entamoeba dispar
EDNYKTIQ

SEQ ID NO: 2418997 - protein, 7 aa, Entamoeba dispar
EDNYSDH

SEQ ID NO: 2418998 - protein, 8 aa, Entamoeba dispar
EDPCREQT

SEQ ID NO: 2418999 - protein, 11 aa, Entamoeba dispar
EDPCSQRGNEL

SEQ ID NO: 2419000 - protein, 5 aa, Entamoeba dispar
EDPEN

SEQ ID NO: 2419001 - protein, 8 aa, Entamoeba dispar
EDPHEAAE

SEQ ID NO: 2419002 - protein, 6 aa, Entamoeba dispar
EDPHEI

SEQ ID NO: 2419003 - protein, 7 aa, Entamoeba dispar
EDPHYQR

SEQ ID NO: 2419004 - protein, 5 aa, Entamoeba dispar
EDPIE

SEQ ID NO: 2419005 - protein, 4 aa, Entamoeba dispar
EDPK

SEQ ID NO: 2419006 - protein, 9 aa, Entamoeba dispar
EDPKEAIAD

SEQ ID NO: 2419007 - protein, 6 aa, Entamoeba dispar
EDPLIE

SEQ ID NO: 2419008 - protein, 4 aa, Entamoeba dispar
EDPN

SEQ ID NO: 2419009 - protein, 4 aa, Entamoeba dispar
EDPQ

SEQ ID NO: 2419010 - protein, 28 aa, Entamoeba dispar
EDPQLDPSFVPPQNPPSDPSQETPYAPP

SEQ ID NO: 2419011 - protein, 7 aa, Entamoeba dispar
EDPRLKN

SEQ ID NO: 2419012 - protein, 190 aa, Entamoeba dispar
EDPSEKELKETEERLKREAEEAERKRKEEEEERLRKEEEERLRKEEEEERLRKEEEEERLRKEEEERQKKEEEERLRKEEEERLRKEEEERLRKEEEERLKREAEEAERKRKEEEERLRKEEEERLRKEEEERLRKEEEERLRKEEEERKKKEEEERLAAEEAERKRKELEAAKTPSPTPEEEKKKEKEL

SEQ ID NO: 2419013 - protein, 19 aa, Entamoeba dispar
EDPSFSKDGMRIGGNPSYI

SEQ ID NO: 2419014 - protein, 28 aa, Entamoeba dispar
EDPSIEKRKNNKKGTRRSTQDGEDADIE

SEQ ID NO: 2419015 - protein, 7 aa, Entamoeba dispar
EDPSTPE

SEQ ID NO: 2419016 - protein, 6 aa, Entamoeba dispar
EDPTDV

SEQ ID NO: 2419017 - protein, 9 aa, Entamoeba dispar
EDPTKRPDY

SEQ ID NO: 2419018 - protein, 5 aa, Entamoeba dispar
EDPVN

SEQ ID NO: 2419019 - protein, 4 aa, Entamoeba dispar
EDPY

SEQ ID NO: 2419020 - protein, 7 aa, Entamoeba dispar
EDQANQK

SEQ ID NO: 2419021 - protein, 12 aa, Entamoeba dispar
EDQFKQKLNTKT

SEQ ID NO: 2419022 - protein, 4 aa, Entamoeba dispar
EDQH

SEQ ID NO: 2419023 - protein, 9 aa, Entamoeba dispar
EDQHPTKTL

SEQ ID NO: 2419024 - protein, 4 aa, Entamoeba dispar
EDQK

SEQ ID NO: 2419025 - protein, 13 aa, Entamoeba dispar
EDQKKETRDAATE

SEQ ID NO: 2419026 - protein, 14 aa, Entamoeba dispar
EDQKNQLSFGIDLS

SEQ ID NO: 2419027 - protein, 8 aa, Entamoeba dispar
EDQKSQEY

SEQ ID NO: 2419028 - protein, 4 aa, Entamoeba dispar
EDQL

SEQ ID NO: 2419029 - protein, 4 aa, Entamoeba dispar
EDQM

SEQ ID NO: 2419030 - protein, 7 aa, Entamoeba dispar
EDQNGNH

SEQ ID NO: 2419031 - protein, 4 aa, Entamoeba dispar
EDQP

SEQ ID NO: 2419032 - protein, 14 aa, Entamoeba dispar
EDQPQTVSKQNSLH

SEQ ID NO: 2419033 - protein, 7 aa, Entamoeba dispar
EDQPTEG

SEQ ID NO: 2419034 - protein, 6 aa, Entamoeba dispar
EDQRAY

SEQ ID NO: 2419035 - protein, 7 aa, Entamoeba dispar
EDQTKPF

SEQ ID NO: 2419036 - protein, 5 aa, Entamoeba dispar
EDQTN

SEQ ID NO: 2419037 - protein, 5 aa, Entamoeba dispar
EDQTR

SEQ ID NO: 2419038 - protein, 8 aa, Entamoeba dispar
EDQTSVPF

SEQ ID NO: 2419039 - protein, 6 aa, Entamoeba dispar
EDRDEA

SEQ ID NO: 2419040 - protein, 5 aa, Entamoeba dispar
EDRDP

SEQ ID NO: 2419041 - protein, 5 aa, Entamoeba dispar
EDREE

SEQ ID NO: 2419042 - protein, 9 aa, Entamoeba dispar
EDREKDIGN

SEQ ID NO: 2419043 - protein, 4 aa, Entamoeba dispar
EDRF

SEQ ID NO: 2419044 - protein, 20 aa, Entamoeba dispar
EDRFTTQNLQNAQENYSQEY

SEQ ID NO: 2419045 - protein, 5 aa, Entamoeba dispar
EDRGA

SEQ ID NO: 2419046 - protein, 6 aa, Entamoeba dispar
EDRKHD

SEQ ID NO: 2419047 - protein, 6 aa, Entamoeba dispar
EDRKKD

SEQ ID NO: 2419048 - protein, 7 aa, Entamoeba dispar
EDRKKGY

SEQ ID NO: 2419049 - protein, 7 aa, Entamoeba dispar
EDRKLEQ

SEQ ID NO: 2419050 - protein, 38 aa, Entamoeba dispar
EDRSTLKSEESKKTITPINQTENNKSTQTINDKKGNFD

SEQ ID NO: 2419051 - protein, 4 aa, Entamoeba dispar
EDRT

SEQ ID NO: 2419052 - protein, 6 aa, Entamoeba dispar
EDRTSS

SEQ ID NO: 2419053 - protein, 8 aa, Entamoeba dispar
EDSALYEG

SEQ ID NO: 2419054 - protein, 16 aa, Entamoeba dispar
EDSDALTAKNQQLEKR

SEQ ID NO: 2419055 - protein, 6 aa, Entamoeba dispar
EDSDKV

SEQ ID NO: 2419056 - protein, 7 aa, Entamoeba dispar
EDSEEIQ

SEQ ID NO: 2419057 - protein, 28 aa, Entamoeba dispar
EDSELENEHESESEEDEEEEDDEDADLD

SEQ ID NO: 2419058 - protein, 25 aa, Entamoeba dispar
EDSFKKSEIDQKKKKMPITNPNQMG

SEQ ID NO: 2419059 - protein, 9 aa, Entamoeba dispar
EDSGKTGYI

SEQ ID NO: 2419060 - protein, 12 aa, Entamoeba dispar
EDSHELKENEHA

SEQ ID NO: 2419061 - protein, 12 aa, Entamoeba dispar
EDSIEDNDYSKI

SEQ ID NO: 2419062 - protein, 7 aa, Entamoeba dispar
EDSIKKR

SEQ ID NO: 2419063 - protein, 21 aa, Entamoeba dispar
EDSKEIESDTTNRANDHQSYD

SEQ ID NO: 2419064 - protein, 8 aa, Entamoeba dispar
EDSKEPIG

SEQ ID NO: 2419065 - protein, 10 aa, Entamoeba dispar
EDSKNKYEKL

SEQ ID NO: 2419066 - protein, 14 aa, Entamoeba dispar
EDSKPKKAKITPRE

SEQ ID NO: 2419067 - protein, 5 aa, Entamoeba dispar
EDSKS

SEQ ID NO: 2419068 - protein, 8 aa, Entamoeba dispar
EDSKSEIL

SEQ ID NO: 2419069 - protein, 8 aa, Entamoeba dispar
EDSKVEKD

SEQ ID NO: 2419070 - protein, 6 aa, Entamoeba dispar
EDSMTN

SEQ ID NO: 2419071 - protein, 12 aa, Entamoeba dispar
EDSNKPFPEKSL

SEQ ID NO: 2419072 - protein, 7 aa, Entamoeba dispar
EDSNNID

SEQ ID NO: 2419073 - protein, 7 aa, Entamoeba dispar
EDSNVNK

SEQ ID NO: 2419074 - protein, 4 aa, Entamoeba dispar
EDSP

SEQ ID NO: 2419075 - protein, 5 aa, Entamoeba dispar
EDSPF

SEQ ID NO: 2419076 - protein, 8 aa, Entamoeba dispar
EDSPMDAG

SEQ ID NO: 2419077 - protein, 9 aa, Entamoeba dispar
EDSPRVLSD

SEQ ID NO: 2419078 - protein, 31 aa, Entamoeba dispar
EDSPYSNDSEEYLSQNEEDNDNDNDNEEEYE

SEQ ID NO: 2419079 - protein, 7 aa, Entamoeba dispar
EDSREET

SEQ ID NO: 2419080 - protein, 8 aa, Entamoeba dispar
EDSRKPLK

SEQ ID NO: 2419081 - protein, 4 aa, Entamoeba dispar
EDSS

SEQ ID NO: 2419082 - protein, 11 aa, Entamoeba dispar
EDSSKKIREPF

SEQ ID NO: 2419083 - protein, 10 aa, Entamoeba dispar
EDSSKNARNV

SEQ ID NO: 2419084 - protein, 6 aa, Entamoeba dispar
EDSSSL

SEQ ID NO: 2419085 - protein, 5 aa, Entamoeba dispar
EDSTR

SEQ ID NO: 2419086 - protein, 9 aa, Entamoeba dispar
EDSWDKGIP

SEQ ID NO: 2419087 - protein, 10 aa, Entamoeba dispar
EDSYGKTNVG

SEQ ID NO: 2419088 - protein, 5 aa, Entamoeba dispar
EDTAS

SEQ ID NO: 2419089 - protein, 4 aa, Entamoeba dispar
EDTC

SEQ ID NO: 2419090 - protein, 4 aa, Entamoeba dispar
EDTD

SEQ ID NO: 2419091 - protein, 30 aa, Entamoeba dispar
EDTEKVTKSPKTPKSIRELKREKKAQITKQ

SEQ ID NO: 2419092 - protein, 9 aa, Entamoeba dispar
EDTFKTNQQ

SEQ ID NO: 2419093 - protein, 12 aa, Entamoeba dispar
EDTIKNNENYST

SEQ ID NO: 2419094 - protein, 6 aa, Entamoeba dispar
EDTNGE

SEQ ID NO: 2419095 - protein, 7 aa, Entamoeba dispar
EDTNGEV

SEQ ID NO: 2419096 - protein, 7 aa, Entamoeba dispar
EDTNSKV

SEQ ID NO: 2419097 - protein, 7 aa, Entamoeba dispar
EDTPQKT

SEQ ID NO: 2419098 - protein, 5 aa, Entamoeba dispar
EDTQT

SEQ ID NO: 2419099 - protein, 11 aa, Entamoeba dispar
EDTSERNKIGN

SEQ ID NO: 2419100 - protein, 6 aa, Entamoeba dispar
EDTSFH

SEQ ID NO: 2419101 - protein, 12 aa, Entamoeba dispar
EDTSTNSQNQET

SEQ ID NO: 2419102 - protein, 10 aa, Entamoeba dispar
EDTSTTEGGC

SEQ ID NO: 2419103 - protein, 15 aa, Entamoeba dispar
EDTTGDKRDSQTKRV

SEQ ID NO: 2419104 - protein, 6 aa, Entamoeba dispar
EDTTKK

SEQ ID NO: 2419105 - protein, 13 aa, Entamoeba dispar
EDTVDKTSSKDIL

SEQ ID NO: 2419106 - protein, 17 aa, Entamoeba dispar
EDTYKINNNYQPQRTVT

SEQ ID NO: 2419107 - protein, 6 aa, Entamoeba dispar
EDVDDD

SEQ ID NO: 2419108 - protein, 17 aa, Entamoeba dispar
EDVDEVNEKKEPRPSNV

SEQ ID NO: 2419109 - protein, 9 aa, Entamoeba dispar
EDVDGSDSF

SEQ ID NO: 2419110 - protein, 7 aa, Entamoeba dispar
EDVDPNQ

SEQ ID NO: 2419111 - protein, 15 aa, Entamoeba dispar
EDVEEEVKAKCGSVE

SEQ ID NO: 2419112 - protein, 13 aa, Entamoeba dispar
EDVEGKWSTSSSV

SEQ ID NO: 2419113 - protein, 8 aa, Entamoeba dispar
EDVEQKRS

SEQ ID NO: 2419114 - protein, 7 aa, Entamoeba dispar
EDVGLGE

SEQ ID NO: 2419115 - protein, 17 aa, Entamoeba dispar
EDVIPSVNAGTRLEKPD

SEQ ID NO: 2419116 - protein, 4 aa, Entamoeba dispar
EDVK

SEQ ID NO: 2419117 - protein, 4 aa, Entamoeba dispar
EDVN

SEQ ID NO: 2419118 - protein, 16 aa, Entamoeba dispar
EDVNSKTLDLKSGGDV

SEQ ID NO: 2419119 - protein, 25 aa, Entamoeba dispar
EDVPTGVDNTKKKKAVPKVSQTAQV

SEQ ID NO: 2419120 - protein, 5 aa, Entamoeba dispar
EDYDG

SEQ ID NO: 2419121 - protein, 4 aa, Entamoeba dispar
EDYE

SEQ ID NO: 2419122 - protein, 16 aa, Entamoeba dispar
EDYERSEESEYDDPNL

SEQ ID NO: 2419123 - protein, 6 aa, Entamoeba dispar
EDYNKE

SEQ ID NO: 2419124 - protein, 35 aa, Entamoeba dispar
EDYNKLKRDQNEIQKSQFDVDEKKTIKSQKLQEKE

SEQ ID NO: 2419125 - protein, 6 aa, Entamoeba dispar
EDYNTQ

SEQ ID NO: 2419126 - protein, 4 aa, Entamoeba dispar
EDYP

SEQ ID NO: 2419127 - protein, 8 aa, Entamoeba dispar
EDYPETHP

SEQ ID NO: 2419128 - protein, 17 aa, Entamoeba dispar
EDYTDVPSTIKKQRDAL

SEQ ID NO: 2419129 - protein, 8 aa, Entamoeba dispar
EDYTEEEL

SEQ ID NO: 2419130 - protein, 10 aa, Entamoeba dispar
EDYTSHELSD

SEQ ID NO: 2419131 - protein, 13 aa, Entamoeba dispar
EDYYNQEDDGIEA

SEQ ID NO: 2419132 - protein, 4 aa, Entamoeba dispar
EEAC

SEQ ID NO: 2419133 - protein, 9 aa, Entamoeba dispar
EEADAVRSG

SEQ ID NO: 2419134 - protein, 6 aa, Entamoeba dispar
EEADEK

SEQ ID NO: 2419135 - protein, 9 aa, Entamoeba dispar
EEAEKNSPA

SEQ ID NO: 2419136 - protein, 7 aa, Entamoeba dispar
EEAENSI

SEQ ID NO: 2419137 - protein, 6 aa, Entamoeba dispar
EEAGVE

SEQ ID NO: 2419138 - protein, 6 aa, Entamoeba dispar
EEAKDF

SEQ ID NO: 2419139 - protein, 19 aa, Entamoeba dispar
EEAKKSGKIEAVNQTNNGD

SEQ ID NO: 2419140 - protein, 15 aa, Entamoeba dispar
EEAKKYKPQKKGGVA

SEQ ID NO: 2419141 - protein, 5 aa, Entamoeba dispar
EEAQY

SEQ ID NO: 2419142 - protein, 5 aa, Entamoeba dispar
EEARR

SEQ ID NO: 2419143 - protein, 7 aa, Entamoeba dispar
EEASNRL

SEQ ID NO: 2419144 - protein, 6 aa, Entamoeba dispar
EEASNY

SEQ ID NO: 2419145 - protein, 18 aa, Entamoeba dispar
EEASSKINESDKNHEENK

SEQ ID NO: 2419146 - protein, 4 aa, Entamoeba dispar
EEAT

SEQ ID NO: 2419147 - protein, 9 aa, Entamoeba dispar
EEATGEKAT

SEQ ID NO: 2419148 - protein, 6 aa, Entamoeba dispar
EEAYEA

SEQ ID NO: 2419149 - protein, 4 aa, Entamoeba dispar
EECA

SEQ ID NO: 2419150 - protein, 10 aa, Entamoeba dispar
EECEKETFKE

SEQ ID NO: 2419151 - protein, 32 aa, Entamoeba dispar
EECEKSIKTRSATESIERAKSQSDKEQAILTG

SEQ ID NO: 2419152 - protein, 4 aa, Entamoeba dispar
EECP

SEQ ID NO: 2419153 - protein, 5 aa, Entamoeba dispar
EECSD

SEQ ID NO: 2419154 - protein, 11 aa, Entamoeba dispar
EEDADADESGV

SEQ ID NO: 2419155 - protein, 13 aa, Entamoeba dispar
EEDADGKYESNGY

SEQ ID NO: 2419156 - protein, 6 aa, Entamoeba dispar
EEDADK

SEQ ID NO: 2419157 - protein, 6 aa, Entamoeba dispar
EEDAKE

SEQ ID NO: 2419158 - protein, 7 aa, Entamoeba dispar
EEDCTGG

SEQ ID NO: 2419159 - protein, 13 aa, Entamoeba dispar
EEDDDDNYGYDEE

SEQ ID NO: 2419160 - protein, 26 aa, Entamoeba dispar
EEDDEKDNKKEEAKEENKKEDLEEKE

SEQ ID NO: 2419161 - protein, 12 aa, Entamoeba dispar
EEDDNDEIHAQG

SEQ ID NO: 2419162 - protein, 25 aa, Entamoeba dispar
EEDDTTTQTTSGTTTNTNDHQRRRY

SEQ ID NO: 2419163 - protein, 4 aa, Entamoeba dispar
EEDE

SEQ ID NO: 2419164 - protein, 21 aa, Entamoeba dispar
EEDEEEPNELNDQDFEEILKL

SEQ ID NO: 2419165 - protein, 10 aa, Entamoeba dispar
EEDEKGYQYL

SEQ ID NO: 2419166 - protein, 8 aa, Entamoeba dispar
EEDETSFS

SEQ ID NO: 2419167 - protein, 10 aa, Entamoeba dispar
EEDEVTTLKE

SEQ ID NO: 2419168 - protein, 4 aa, Entamoeba dispar
EEDF

SEQ ID NO: 2419169 - protein, 11 aa, Entamoeba dispar
EEDFNENENAG

SEQ ID NO: 2419170 - protein, 4 aa, Entamoeba dispar
EEDG

SEQ ID NO: 2419171 - protein, 18 aa, Entamoeba dispar
EEDGKITVGGELSDGKKC

SEQ ID NO: 2419172 - protein, 9 aa, Entamoeba dispar
EEDGNQEYK

SEQ ID NO: 2419173 - protein, 4 aa, Entamoeba dispar
EEDI

SEQ ID NO: 2419174 - protein, 40 aa, Entamoeba dispar
EEDIRQETNLNGEIEVNNNSNKQEEEQTAQPIPSTPRRAA

SEQ ID NO: 2419175 - protein, 4 aa, Entamoeba dispar
EEDK

SEQ ID NO: 2419176 - protein, 9 aa, Entamoeba dispar
EEDKERNEY

SEQ ID NO: 2419177 - protein, 11 aa, Entamoeba dispar
EEDKESDIDGA

SEQ ID NO: 2419178 - protein, 11 aa, Entamoeba dispar
EEDKKEVESRF

SEQ ID NO: 2419179 - protein, 8 aa, Entamoeba dispar
EEDKKTRI

SEQ ID NO: 2419180 - protein, 5 aa, Entamoeba dispar
EEDKN

SEQ ID NO: 2419181 - protein, 9 aa, Entamoeba dispar
EEDKQTAEK

SEQ ID NO: 2419182 - protein, 17 aa, Entamoeba dispar
EEDKTINKKTSKRRKCE

SEQ ID NO: 2419183 - protein, 8 aa, Entamoeba dispar
EEDNKDKE

SEQ ID NO: 2419184 - protein, 28 aa, Entamoeba dispar
EEDNTTSMENDNEQQEEKEDIQKSERVI

SEQ ID NO: 2419185 - protein, 8 aa, Entamoeba dispar
EEDPTDPQ

SEQ ID NO: 2419186 - protein, 8 aa, Entamoeba dispar
EEDQIRQK

SEQ ID NO: 2419187 - protein, 7 aa, Entamoeba dispar
EEDQYDD

SEQ ID NO: 2419188 - protein, 16 aa, Entamoeba dispar
EEDRDKYGNTIPSEVK

SEQ ID NO: 2419189 - protein, 17 aa, Entamoeba dispar
EEDRENDRFQEKEKEVV

SEQ ID NO: 2419190 - protein, 15 aa, Entamoeba dispar
EEDRKSYGNTIPSEV

SEQ ID NO: 2419191 - protein, 11 aa, Entamoeba dispar
EEDSDKADSVY

SEQ ID NO: 2419192 - protein, 12 aa, Entamoeba dispar
EEDSTTHKSQPF

SEQ ID NO: 2419193 - protein, 6 aa, Entamoeba dispar
EEDTKL

SEQ ID NO: 2419194 - protein, 13 aa, Entamoeba dispar
EEDTKNVQPFQKE

SEQ ID NO: 2419195 - protein, 8 aa, Entamoeba dispar
EEDTVKSV

SEQ ID NO: 2419196 - protein, 6 aa, Entamoeba dispar
EEDYIP

SEQ ID NO: 2419197 - protein, 13 aa, Entamoeba dispar
EEEAEQLETNKTP

SEQ ID NO: 2419198 - protein, 11 aa, Entamoeba dispar
EEEAGKYARNT

SEQ ID NO: 2419199 - protein, 8 aa, Entamoeba dispar
EEECDKRG

SEQ ID NO: 2419200 - protein, 10 aa, Entamoeba dispar
EEECKKETLK

SEQ ID NO: 2419201 - protein, 7 aa, Entamoeba dispar
EEECNEV

SEQ ID NO: 2419202 - protein, 6 aa, Entamoeba dispar
EEECNV

SEQ ID NO: 2419203 - protein, 4 aa, Entamoeba dispar
EEED

SEQ ID NO: 2419204 - protein, 8 aa, Entamoeba dispar
EEEDFEED

SEQ ID NO: 2419205 - protein, 13 aa, Entamoeba dispar
EEEDFKDQKQMEL

SEQ ID NO: 2419206 - protein, 11 aa, Entamoeba dispar
EEEDGDFEDPE

SEQ ID NO: 2419207 - protein, 10 aa, Entamoeba dispar
EEEDSNELET

SEQ ID NO: 2419208 - protein, 71 aa, Entamoeba dispar
EEEDTQKKLEEYNDESSETNKDNNTNIETNDMETEETNSEEITEDFENEEESNEMEFEESNDVEYEDPSSI

SEQ ID NO: 2419209 - protein, 14 aa, Entamoeba dispar
EEEDVEKAKITEME

SEQ ID NO: 2419210 - protein, 19 aa, Entamoeba dispar
EEEEEEEEKTDMTKKGRYA

SEQ ID NO: 2419211 - protein, 42 aa, Entamoeba dispar
EEEEEEFDEEIEEEEIDEGEEVEEEEEEEEEEEEEEEDSVEE

SEQ ID NO: 2419212 - protein, 6 aa, Entamoeba dispar
EEEEEI

SEQ ID NO: 2419213 - protein, 7 aa, Entamoeba dispar
EEEEHNK

SEQ ID NO: 2419214 - protein, 9 aa, Entamoeba dispar
EEEEITPTA

SEQ ID NO: 2419215 - protein, 20 aa, Entamoeba dispar
EEEEKEKEENINKEPKNISE

SEQ ID NO: 2419216 - protein, 23 aa, Entamoeba dispar
EEEEKEREKEIKELEGGDEQKEV

SEQ ID NO: 2419217 - protein, 12 aa, Entamoeba dispar
EEEEKRVEEQED

SEQ ID NO: 2419218 - protein, 20 aa, Entamoeba dispar
EEEENISQIPTDIQDNCNSS

SEQ ID NO: 2419219 - protein, 11 aa, Entamoeba dispar
EEEENKKEEEI

SEQ ID NO: 2419220 - protein, 15 aa, Entamoeba dispar
EEEENQQSDEEANIQ

SEQ ID NO: 2419221 - protein, 18 aa, Entamoeba dispar
EEEEPQQVEKKEEKETEE

SEQ ID NO: 2419222 - protein, 7 aa, Entamoeba dispar
EEEEQVS

SEQ ID NO: 2419223 - protein, 49 aa, Entamoeba dispar
EEEEREAKRVEEKRKKEQKKQQKEEAKAAKKKEKEIEAQLKKAKKAEKK

SEQ ID NO: 2419224 - protein, 6 aa, Entamoeba dispar
EEEERK

SEQ ID NO: 2419225 - protein, 16 aa, Entamoeba dispar
EEEERPKKETVVEEQG

SEQ ID NO: 2419226 - protein, 116 aa, Entamoeba dispar
EEEERRRKEEEERRKREEEERKRKEEERRLEEERKRKEEEENLKRKEEERQRQIEEARRRAEEERKRLEEEKKRLEEERKRIEEEQHRIEEEKRKKEEEERIKKEQERKKKEEELI

SEQ ID NO: 2419227 - protein, 7 aa, Entamoeba dispar
EEEESQY

SEQ ID NO: 2419228 - protein, 45 aa, Entamoeba dispar
EEEEVPKKVGKRTKRKYTKRVKKDTEYEKTLTHTEENMEEDRGDV

SEQ ID NO: 2419229 - protein, 5 aa, Entamoeba dispar
EEEFS

SEQ ID NO: 2419230 - protein, 16 aa, Entamoeba dispar
EEEGANDSTEETETFE

SEQ ID NO: 2419231 - protein, 7 aa, Entamoeba dispar
EEEGFKE

SEQ ID NO: 2419232 - protein, 8 aa, Entamoeba dispar
EEEGGGKK

SEQ ID NO: 2419233 - protein, 10 aa, Entamoeba dispar
EEEGKKENDL

SEQ ID NO: 2419234 - protein, 14 aa, Entamoeba dispar
EEEGNNFTYTEEEI

SEQ ID NO: 2419235 - protein, 5 aa, Entamoeba dispar
EEEGT

SEQ ID NO: 2419236 - protein, 29 aa, Entamoeba dispar
EEEHAGGAIARPSYDLGESCDASKYAEGY

SEQ ID NO: 2419237 - protein, 5 aa, Entamoeba dispar
EEEIA

SEQ ID NO: 2419238 - protein, 15 aa, Entamoeba dispar
EEEIDDTKENILQED

SEQ ID NO: 2419239 - protein, 23 aa, Entamoeba dispar
EEEIDGSIDTESQPKKKKDQPGV

SEQ ID NO: 2419240 - protein, 20 aa, Entamoeba dispar
EEEIENEESKLKYRQNIEEN

SEQ ID NO: 2419241 - protein, 49 aa, Entamoeba dispar
EEEIKNKEEEIKKKESIIQEKDNEIKKRDNEIKKRDDEIKKRDDEIKHK

SEQ ID NO: 2419242 - protein, 6 aa, Entamoeba dispar
EEEIKT

SEQ ID NO: 2419243 - protein, 8 aa, Entamoeba dispar
EEEINENS

SEQ ID NO: 2419244 - protein, 44 aa, Entamoeba dispar
EEEINTFNKTKEEEPQKKQKEETKKKTEPDNEIKKRSQSSVEKR

SEQ ID NO: 2419245 - protein, 16 aa, Entamoeba dispar
EEEIPDHLQNPPDCNA

SEQ ID NO: 2419246 - protein, 8 aa, Entamoeba dispar
EEEISEDN

SEQ ID NO: 2419247 - protein, 13 aa, Entamoeba dispar
EEEISKEEKYQKI

SEQ ID NO: 2419248 - protein, 16 aa, Entamoeba dispar
EEEITDNENESPEDRI

SEQ ID NO: 2419249 - protein, 4 aa, Entamoeba dispar
EEEK

SEQ ID NO: 2419250 - protein, 6 aa, Entamoeba dispar
EEEKAK

SEQ ID NO: 2419251 - protein, 24 aa, Entamoeba dispar
EEEKDDLEQDRADVSATKDDIAKK

SEQ ID NO: 2419252 - protein, 20 aa, Entamoeba dispar
EEEKEENPQNNTTNQPTTTI

SEQ ID NO: 2419253 - protein, 7 aa, Entamoeba dispar
EEEKESA

SEQ ID NO: 2419254 - protein, 23 aa, Entamoeba dispar
EEEKESSDVDELKRGLNNSVSSL

SEQ ID NO: 2419255 - protein, 8 aa, Entamoeba dispar
EEEKETKL

SEQ ID NO: 2419256 - protein, 12 aa, Entamoeba dispar
EEEKGEDEMKEG

SEQ ID NO: 2419257 - protein, 15 aa, Entamoeba dispar
EEEKIDGNGLQELGR

SEQ ID NO: 2419258 - protein, 31 aa, Entamoeba dispar
EEEKIGEGEKKNMIEKKERKEEEMKENQQVD

SEQ ID NO: 2419259 - protein, 6 aa, Entamoeba dispar
EEEKIS

SEQ ID NO: 2419260 - protein, 8 aa, Entamoeba dispar
EEEKKDEI

SEQ ID NO: 2419261 - protein, 6 aa, Entamoeba dispar
EEEKKI

SEQ ID NO: 2419262 - protein, 56 aa, Entamoeba dispar
EEEKNEMSEEEEVEKEEKNSSSSEEEEEKEEKNLSEEKEEKKGKSKIIEKEEKVKK

SEQ ID NO: 2419263 - protein, 82 aa, Entamoeba dispar
EEEKQEENKQDKQGTEQQEVKQKDKEEVTQENKQQEEGNNEGVKQEEGNQDEEGQKDIRQEEKDDKEDKHEESQSKEHKDCA

SEQ ID NO: 2419264 - protein, 7 aa, Entamoeba dispar
EEEKQTI

SEQ ID NO: 2419265 - protein, 7 aa, Entamoeba dispar
EEEKSEW

SEQ ID NO: 2419266 - protein, 7 aa, Entamoeba dispar
EEEKSNY

SEQ ID NO: 2419267 - protein, 8 aa, Entamoeba dispar
EEEKYSED

SEQ ID NO: 2419268 - protein, 9 aa, Entamoeba dispar
EEEKYSKLT

SEQ ID NO: 2419269 - protein, 5 aa, Entamoeba dispar
EEELE

SEQ ID NO: 2419270 - protein, 14 aa, Entamoeba dispar
EEELKKDKIIRKIY

SEQ ID NO: 2419271 - protein, 10 aa, Entamoeba dispar
EEELKKDKRI

SEQ ID NO: 2419272 - protein, 11 aa, Entamoeba dispar
EEELKKDKRIR

SEQ ID NO: 2419273 - protein, 16 aa, Entamoeba dispar
EEELKKNKAIPRICFN

SEQ ID NO: 2419274 - protein, 17 aa, Entamoeba dispar
EEELKKNKRIPKYCFDK

SEQ ID NO: 2419275 - protein, 16 aa, Entamoeba dispar
EEELKKNKRIPRKCFE

SEQ ID NO: 2419276 - protein, 19 aa, Entamoeba dispar
EEELKKNKRIPRNCFKDND

SEQ ID NO: 2419277 - protein, 16 aa, Entamoeba dispar
EEELKKNKRIPRNCFN

SEQ ID NO: 2419278 - protein, 18 aa, Entamoeba dispar
EEELKKNKTIPRKCFDKR

SEQ ID NO: 2419279 - protein, 15 aa, Entamoeba dispar
EEELKKNKTIPRNCF

SEQ ID NO: 2419280 - protein, 15 aa, Entamoeba dispar
EEELKQNKRIPRDCF

SEQ ID NO: 2419281 - protein, 16 aa, Entamoeba dispar
EEELKQNKRIPRDCFE

SEQ ID NO: 2419282 - protein, 18 aa, Entamoeba dispar
EEELNNNIEKKKKEIEKL

SEQ ID NO: 2419283 - protein, 11 aa, Entamoeba dispar
EEELSSKEETI

SEQ ID NO: 2419284 - protein, 11 aa, Entamoeba dispar
EEEMDFSEQGN

SEQ ID NO: 2419285 - protein, 31 aa, Entamoeba dispar
EEEMKEIKQRQELQKVNQPNIDETDKANWID

SEQ ID NO: 2419286 - protein, 7 aa, Entamoeba dispar
EEEMKKG

SEQ ID NO: 2419287 - protein, 5 aa, Entamoeba dispar
EEEMN

SEQ ID NO: 2419288 - protein, 22 aa, Entamoeba dispar
EEENDEAQRKRINKPDNYPLKR

SEQ ID NO: 2419289 - protein, 6 aa, Entamoeba dispar
EEENEE

SEQ ID NO: 2419290 - protein, 33 aa, Entamoeba dispar
EEENEEESSSSSSEDSQEETKEVEEIENKKGNF

SEQ ID NO: 2419291 - protein, 7 aa, Entamoeba dispar
EEENEEY

SEQ ID NO: 2419292 - protein, 7 aa, Entamoeba dispar
EEENESA

SEQ ID NO: 2419293 - protein, 9 aa, Entamoeba dispar
EEENKQLTQ

SEQ ID NO: 2419294 - protein, 25 aa, Entamoeba dispar
EEENKTLKETMEKQIKERSDEIEKM

SEQ ID NO: 2419295 - protein, 9 aa, Entamoeba dispar
EEENNIESQ

SEQ ID NO: 2419296 - protein, 18 aa, Entamoeba dispar
EEENNKKLKESVEEINER

SEQ ID NO: 2419297 - protein, 5 aa, Entamoeba dispar
EEENS

SEQ ID NO: 2419298 - protein, 12 aa, Entamoeba dispar
EEEPETDETHTY

SEQ ID NO: 2419299 - protein, 5 aa, Entamoeba dispar
EEEPF

SEQ ID NO: 2419300 - protein, 10 aa, Entamoeba dispar
EEEPQQPNLD

SEQ ID NO: 2419301 - protein, 13 aa, Entamoeba dispar
EEEPSTPLEEDEI

SEQ ID NO: 2419302 - protein, 8 aa, Entamoeba dispar
EEEQEGMY

SEQ ID NO: 2419303 - protein, 23 aa, Entamoeba dispar
EEEQQQQKKKEPEQNQEKKKINF

SEQ ID NO: 2419304 - protein, 4 aa, Entamoeba dispar
EEER

SEQ ID NO: 2419305 - protein, 6 aa, Entamoeba dispar
EEERAS

SEQ ID NO: 2419306 - protein, 32 aa, Entamoeba dispar
EEERDEIDYENSTECTSSSSTTPDSINESTFI

SEQ ID NO: 2419307 - protein, 43 aa, Entamoeba dispar
EEERFRKESEEEERKMREEEERLNKEAEKLQKELEEERESKEE

SEQ ID NO: 2419308 - protein, 19 aa, Entamoeba dispar
EEERKEKESISNEFEETKE

SEQ ID NO: 2419309 - protein, 26 aa, Entamoeba dispar
EEERKEKESISNEFEETKEQVLLFLK

SEQ ID NO: 2419310 - protein, 17 aa, Entamoeba dispar
EEERSKEKKRNKEKKTW

SEQ ID NO: 2419311 - protein, 11 aa, Entamoeba dispar
EEESAQQVNEA

SEQ ID NO: 2419312 - protein, 13 aa, Entamoeba dispar
EEESGASKEKKQL

SEQ ID NO: 2419313 - protein, 7 aa, Entamoeba dispar
EEESKEL

SEQ ID NO: 2419314 - protein, 18 aa, Entamoeba dispar
EEESKKRQEEQKKEETMK

SEQ ID NO: 2419315 - protein, 9 aa, Entamoeba dispar
EEESKVPEN

SEQ ID NO: 2419316 - protein, 14 aa, Entamoeba dispar
EEESQTKDELNEED

SEQ ID NO: 2419317 - protein, 4 aa, Entamoeba dispar
EEET

SEQ ID NO: 2419318 - protein, 6 aa, Entamoeba dispar
EEETDK

SEQ ID NO: 2419319 - protein, 8 aa, Entamoeba dispar
EEETIKNK

SEQ ID NO: 2419320 - protein, 20 aa, Entamoeba dispar
EEETKKQEIKIQGSKVSSKI

SEQ ID NO: 2419321 - protein, 45 aa, Entamoeba dispar
EEETNDKRGRSNSRKRSRSNSLIRKGEEHSMPRQEMRDKAERLRR

SEQ ID NO: 2419322 - protein, 6 aa, Entamoeba dispar
EEETNE

SEQ ID NO: 2419323 - protein, 7 aa, Entamoeba dispar
EEETQVP

SEQ ID NO: 2419324 - protein, 7 aa, Entamoeba dispar
EEETREL

SEQ ID NO: 2419325 - protein, 15 aa, Entamoeba dispar
EEETRKEDVETIPQT

SEQ ID NO: 2419326 - protein, 7 aa, Entamoeba dispar
EEETSPI

SEQ ID NO: 2419327 - protein, 14 aa, Entamoeba dispar
EEETSQVDKTTQNL

SEQ ID NO: 2419328 - protein, 5 aa, Entamoeba dispar
EEETV

SEQ ID NO: 2419329 - protein, 4 aa, Entamoeba dispar
EEEV

SEQ ID NO: 2419330 - protein, 7 aa, Entamoeba dispar
EEEVEEK

SEQ ID NO: 2419331 - protein, 18 aa, Entamoeba dispar
EEEVNEEEDVDADDVEAP

SEQ ID NO: 2419332 - protein, 7 aa, Entamoeba dispar
EEEVPNE

SEQ ID NO: 2419333 - protein, 15 aa, Entamoeba dispar
EEEVPVTESVEKKEE

SEQ ID NO: 2419334 - protein, 17 aa, Entamoeba dispar
EEEVSKYGDGRETQIKE

SEQ ID NO: 2419335 - protein, 5 aa, Entamoeba dispar
EEEVT

SEQ ID NO: 2419336 - protein, 17 aa, Entamoeba dispar
EEEVVPNTSTQNKVEES

SEQ ID NO: 2419337 - protein, 10 aa, Entamoeba dispar
EEEWKNETLK

SEQ ID NO: 2419338 - protein, 8 aa, Entamoeba dispar
EEEYETIN

SEQ ID NO: 2419339 - protein, 6 aa, Entamoeba dispar
EEEYGY

SEQ ID NO: 2419340 - protein, 7 aa, Entamoeba dispar
EEEYKQK

SEQ ID NO: 2419341 - protein, 15 aa, Entamoeba dispar
EEEYPFDEPQPVSIP

SEQ ID NO: 2419342 - protein, 8 aa, Entamoeba dispar
EEEYSEYS

SEQ ID NO: 2419343 - protein, 11 aa, Entamoeba dispar
EEEYSEYSTER

SEQ ID NO: 2419344 - protein, 12 aa, Entamoeba dispar
EEEYSTNQGLDP

SEQ ID NO: 2419345 - protein, 5 aa, Entamoeba dispar
EEEYT

SEQ ID NO: 2419346 - protein, 4 aa, Entamoeba dispar
EEFE

SEQ ID NO: 2419347 - protein, 13 aa, Entamoeba dispar
EEFEGTENGLNQL

SEQ ID NO: 2419348 - protein, 17 aa, Entamoeba dispar
EEFGKRPNTKGRIGGNE

SEQ ID NO: 2419349 - protein, 4 aa, Entamoeba dispar
EEFK

SEQ ID NO: 2419350 - protein, 9 aa, Entamoeba dispar
EEFKEEKEF

SEQ ID NO: 2419351 - protein, 14 aa, Entamoeba dispar
EEFQQEKQKLEAEI

SEQ ID NO: 2419352 - protein, 10 aa, Entamoeba dispar
EEFSSSNKIN

SEQ ID NO: 2419353 - protein, 12 aa, Entamoeba dispar
EEFTKKTKTLTE

SEQ ID NO: 2419354 - protein, 5 aa, Entamoeba dispar
EEGAE

SEQ ID NO: 2419355 - protein, 9 aa, Entamoeba dispar
EEGASGEDK

SEQ ID NO: 2419356 - protein, 8 aa, Entamoeba dispar
EEGDGGEL

SEQ ID NO: 2419357 - protein, 10 aa, Entamoeba dispar
EEGDYKSSLP

SEQ ID NO: 2419358 - protein, 6 aa, Entamoeba dispar
EEGEEE

SEQ ID NO: 2419359 - protein, 9 aa, Entamoeba dispar
EEGEGGEEG

SEQ ID NO: 2419360 - protein, 6 aa, Entamoeba dispar
EEGEIK

SEQ ID NO: 2419361 - protein, 16 aa, Entamoeba dispar
EEGEIKYNTRSKDSAI

SEQ ID NO: 2419362 - protein, 5 aa, Entamoeba dispar
EEGGG

SEQ ID NO: 2419363 - protein, 7 aa, Entamoeba dispar
EEGGGPK

SEQ ID NO: 2419364 - protein, 14 aa, Entamoeba dispar
EEGGTKTESFSEND

SEQ ID NO: 2419365 - protein, 7 aa, Entamoeba dispar
EEGIENE

SEQ ID NO: 2419366 - protein, 26 aa, Entamoeba dispar
EEGINDESIQKTNKMEEEKKPTMTSL

SEQ ID NO: 2419367 - protein, 4 aa, Entamoeba dispar
EEGK

SEQ ID NO: 2419368 - protein, 10 aa, Entamoeba dispar
EEGKDKMKSM

SEQ ID NO: 2419369 - protein, 12 aa, Entamoeba dispar
EEGKEIEIEGDT

SEQ ID NO: 2419370 - protein, 7 aa, Entamoeba dispar
EEGKEVL

SEQ ID NO: 2419371 - protein, 9 aa, Entamoeba dispar
EEGKGIEKE

SEQ ID NO: 2419372 - protein, 8 aa, Entamoeba dispar
EEGKNLSI

SEQ ID NO: 2419373 - protein, 8 aa, Entamoeba dispar
EEGKPIGK

SEQ ID NO: 2419374 - protein, 10 aa, Entamoeba dispar
EEGKPKAQQI

SEQ ID NO: 2419375 - protein, 6 aa, Entamoeba dispar
EEGKQC

SEQ ID NO: 2419376 - protein, 5 aa, Entamoeba dispar
EEGKV

SEQ ID NO: 2419377 - protein, 7 aa, Entamoeba dispar
EEGLAER

SEQ ID NO: 2419378 - protein, 7 aa, Entamoeba dispar
EEGLKEK

SEQ ID NO: 2419379 - protein, 4 aa, Entamoeba dispar
EEGM

SEQ ID NO: 2419380 - protein, 4 aa, Entamoeba dispar
EEGN

SEQ ID NO: 2419381 - protein, 14 aa, Entamoeba dispar
EEGNGLNNTSPSYM

SEQ ID NO: 2419382 - protein, 10 aa, Entamoeba dispar
EEGPHSKKPM

SEQ ID NO: 2419383 - protein, 14 aa, Entamoeba dispar
EEGPKLKKYEPKKA

SEQ ID NO: 2419384 - protein, 5 aa, Entamoeba dispar
EEGPL

SEQ ID NO: 2419385 - protein, 8 aa, Entamoeba dispar
EEGQEYGQ

SEQ ID NO: 2419386 - protein, 5 aa, Entamoeba dispar
EEGQF

SEQ ID NO: 2419387 - protein, 4 aa, Entamoeba dispar
EEGT

SEQ ID NO: 2419388 - protein, 6 aa, Entamoeba dispar
EEGVDT

SEQ ID NO: 2419389 - protein, 6 aa, Entamoeba dispar
EEGVGN

SEQ ID NO: 2419390 - protein, 14 aa, Entamoeba dispar
EEGWERIKKDGKKW

SEQ ID NO: 2419391 - protein, 4 aa, Entamoeba dispar
EEGY

SEQ ID NO: 2419392 - protein, 19 aa, Entamoeba dispar
EEGYSIKKKKNDGMKRKEE

SEQ ID NO: 2419393 - protein, 5 aa, Entamoeba dispar
EEHDY

SEQ ID NO: 2419394 - protein, 5 aa, Entamoeba dispar
EEHER

SEQ ID NO: 2419395 - protein, 8 aa, Entamoeba dispar
EEHEVDNK

SEQ ID NO: 2419396 - protein, 9 aa, Entamoeba dispar
EEHGEYSKA

SEQ ID NO: 2419397 - protein, 8 aa, Entamoeba dispar
EEHGKNIE

SEQ ID NO: 2419398 - protein, 23 aa, Entamoeba dispar
EEHKEKESVAESQEINKENKSFN

SEQ ID NO: 2419399 - protein, 5 aa, Entamoeba dispar
EEHKG

SEQ ID NO: 2419400 - protein, 14 aa, Entamoeba dispar
EEHKGRQKKKNEVI

SEQ ID NO: 2419401 - protein, 28 aa, Entamoeba dispar
EEHKNDFPETQPTINSKPSSNISSPHKN

SEQ ID NO: 2419402 - protein, 18 aa, Entamoeba dispar
EEHKSEPEKRWNNSTIST

SEQ ID NO: 2419403 - protein, 18 aa, Entamoeba dispar
EEHKTTNEDESKRIKESG

SEQ ID NO: 2419404 - protein, 7 aa, Entamoeba dispar
EEHKTYS

SEQ ID NO: 2419405 - protein, 16 aa, Entamoeba dispar
EEHPDIHSKGGGKEGI

SEQ ID NO: 2419406 - protein, 6 aa, Entamoeba dispar
EEIANP

SEQ ID NO: 2419407 - protein, 47 aa, Entamoeba dispar
EEIDEEEKKKEKVIRQQTENNDSIPSSLEQGDDLSQQKVQEINENND

SEQ ID NO: 2419408 - protein, 5 aa, Entamoeba dispar
EEIDL

SEQ ID NO: 2419409 - protein, 13 aa, Entamoeba dispar
EEIDPWDSIAYMQ

SEQ ID NO: 2419410 - protein, 26 aa, Entamoeba dispar
EEIDTKKIKAETVGDVNELDSDTKEL

SEQ ID NO: 2419411 - protein, 29 aa, Entamoeba dispar
EEIEDGKEDVDLDEDQKAVDAEDDFEAEQ

SEQ ID NO: 2419412 - protein, 12 aa, Entamoeba dispar
EEIEELKKKNEL

SEQ ID NO: 2419413 - protein, 6 aa, Entamoeba dispar
EEIEEN

SEQ ID NO: 2419414 - protein, 21 aa, Entamoeba dispar
EEIEKEGKKKIAWKEEEDTRL

SEQ ID NO: 2419415 - protein, 7 aa, Entamoeba dispar
EEIEKTP

SEQ ID NO: 2419416 - protein, 9 aa, Entamoeba dispar
EEIESRTSP

SEQ ID NO: 2419417 - protein, 6 aa, Entamoeba dispar
EEIGGL

SEQ ID NO: 2419418 - protein, 12 aa, Entamoeba dispar
EEIGSTNRRGAN

SEQ ID NO: 2419419 - protein, 5 aa, Entamoeba dispar
EEIHT

SEQ ID NO: 2419420 - protein, 4 aa, Entamoeba dispar
EEIK

SEQ ID NO: 2419421 - protein, 17 aa, Entamoeba dispar
EEIKEINNKEKKEKENF

SEQ ID NO: 2419422 - protein, 7 aa, Entamoeba dispar
EEIKETA

SEQ ID NO: 2419423 - protein, 28 aa, Entamoeba dispar
EEIKKNEEKYIKEKEEMEKKIGGKDVRE

SEQ ID NO: 2419424 - protein, 14 aa, Entamoeba dispar
EEIKKNQNEGCEKK

SEQ ID NO: 2419425 - protein, 5 aa, Entamoeba dispar
EEIKL

SEQ ID NO: 2419426 - protein, 5 aa, Entamoeba dispar
EEIKP

SEQ ID NO: 2419427 - protein, 26 aa, Entamoeba dispar
EEIKPIKNDNEIAKKKFQQAKEKYEA

SEQ ID NO: 2419428 - protein, 14 aa, Entamoeba dispar
EEIKQGEFKGDEKL

SEQ ID NO: 2419429 - protein, 14 aa, Entamoeba dispar
EEIKRNERIPIDCF

SEQ ID NO: 2419430 - protein, 13 aa, Entamoeba dispar
EEIKTDKEQNAAF

SEQ ID NO: 2419431 - protein, 6 aa, Entamoeba dispar
EEILTK

SEQ ID NO: 2419432 - protein, 20 aa, Entamoeba dispar
EEINEQEIEIEKKKAQERIK

SEQ ID NO: 2419433 - protein, 8 aa, Entamoeba dispar
EEINKSPA

SEQ ID NO: 2419434 - protein, 5 aa, Entamoeba dispar
EEINN

SEQ ID NO: 2419435 - protein, 8 aa, Entamoeba dispar
EEINNENG

SEQ ID NO: 2419436 - protein, 13 aa, Entamoeba dispar
EEINNSNSNGIRQ

SEQ ID NO: 2419437 - protein, 7 aa, Entamoeba dispar
EEINRYP

SEQ ID NO: 2419438 - protein, 13 aa, Entamoeba dispar
EEINSNKSFKKTH

SEQ ID NO: 2419439 - protein, 6 aa, Entamoeba dispar
EEINTL

SEQ ID NO: 2419440 - protein, 6 aa, Entamoeba dispar
EEIPDT

SEQ ID NO: 2419441 - protein, 10 aa, Entamoeba dispar
EEIPDTDQRV

SEQ ID NO: 2419442 - protein, 13 aa, Entamoeba dispar
EEIPRTQKQRKKN

SEQ ID NO: 2419443 - protein, 7 aa, Entamoeba dispar
EEIPSNT

SEQ ID NO: 2419444 - protein, 39 aa, Entamoeba dispar
EEIQEDNNIQKESKDELEVKKEKKEIQKEENINKRKGID

SEQ ID NO: 2419445 - protein, 15 aa, Entamoeba dispar
EEIQKGKDVETQKIK

SEQ ID NO: 2419446 - protein, 12 aa, Entamoeba dispar
EEIQRRESVKNQ

SEQ ID NO: 2419447 - protein, 12 aa, Entamoeba dispar
EEIQSNSNTINL

SEQ ID NO: 2419448 - protein, 5 aa, Entamoeba dispar
EEIRQ

SEQ ID NO: 2419449 - protein, 9 aa, Entamoeba dispar
EEIRQQEEA

SEQ ID NO: 2419450 - protein, 6 aa, Entamoeba dispar
EEIRTT

SEQ ID NO: 2419451 - protein, 13 aa, Entamoeba dispar
EEISEFKEEEKNQ

SEQ ID NO: 2419452 - protein, 8 aa, Entamoeba dispar
EEISPDGI

SEQ ID NO: 2419453 - protein, 6 aa, Entamoeba dispar
EEISPE

SEQ ID NO: 2419454 - protein, 5 aa, Entamoeba dispar
EEITE

SEQ ID NO: 2419455 - protein, 6 aa, Entamoeba dispar
EEITLE

SEQ ID NO: 2419456 - protein, 49 aa, Entamoeba dispar
EEITNEKSKLTNEEDKQEHITEKTEEGEETEEVLEEDEEVKELNEEGKR

SEQ ID NO: 2419457 - protein, 8 aa, Entamoeba dispar
EEITTMPE

SEQ ID NO: 2419458 - protein, 8 aa, Entamoeba dispar
EEIVTEDD

SEQ ID NO: 2419459 - protein, 4 aa, Entamoeba dispar
EEIY

SEQ ID NO: 2419460 - protein, 10 aa, Entamoeba dispar
EEIYEKGEKV

SEQ ID NO: 2419461 - protein, 10 aa, Entamoeba dispar
EEKAEKQAYD

SEQ ID NO: 2419462 - protein, 15 aa, Entamoeba dispar
EEKAKQEQPIQESSI

SEQ ID NO: 2419463 - protein, 10 aa, Entamoeba dispar
EEKCQYTKEI

SEQ ID NO: 2419464 - protein, 10 aa, Entamoeba dispar
EEKDEIEQKV

SEQ ID NO: 2419465 - protein, 14 aa, Entamoeba dispar
EEKDKPYMAPNGHG

SEQ ID NO: 2419466 - protein, 17 aa, Entamoeba dispar
EEKDKQEKVIKQEKNIK

SEQ ID NO: 2419467 - protein, 10 aa, Entamoeba dispar
EEKDKQERVI

SEQ ID NO: 2419468 - protein, 8 aa, Entamoeba dispar
EEKDKTDN

SEQ ID NO: 2419469 - protein, 10 aa, Entamoeba dispar
EEKDRKRAAR

SEQ ID NO: 2419470 - protein, 37 aa, Entamoeba dispar
EEKEDDEEKGTQMEEIPNEQPQTITTEIKENNNQNKI

SEQ ID NO: 2419471 - protein, 5 aa, Entamoeba dispar
EEKEE

SEQ ID NO: 2419472 - protein, 6 aa, Entamoeba dispar
EEKEEG

SEQ ID NO: 2419473 - protein, 9 aa, Entamoeba dispar
EEKEEGKVI

SEQ ID NO: 2419474 - protein, 8 aa, Entamoeba dispar
EEKEEKIA

SEQ ID NO: 2419475 - protein, 47 aa, Entamoeba dispar
EEKEENKNINERKEEDKNINERKEEGPKENDKKIEKKEEETVNEQED

SEQ ID NO: 2419476 - protein, 10 aa, Entamoeba dispar
EEKEEPKNEE

SEQ ID NO: 2419477 - protein, 13 aa, Entamoeba dispar
EEKEGNEDISEEY

SEQ ID NO: 2419478 - protein, 8 aa, Entamoeba dispar
EEKEGSLR

SEQ ID NO: 2419479 - protein, 25 aa, Entamoeba dispar
EEKEINSKKIKEEIDNSSGLPSTSI

SEQ ID NO: 2419480 - protein, 8 aa, Entamoeba dispar
EEKEKGNR

SEQ ID NO: 2419481 - protein, 12 aa, Entamoeba dispar
EEKEKKTKRKWL

SEQ ID NO: 2419482 - protein, 23 aa, Entamoeba dispar
EEKEKQNENSNTIISKSSRKVAN

SEQ ID NO: 2419483 - protein, 20 aa, Entamoeba dispar
EEKEKRKSAELELENKKDDI

SEQ ID NO: 2419484 - protein, 13 aa, Entamoeba dispar
EEKEKTKGMEEEI

SEQ ID NO: 2419485 - protein, 10 aa, Entamoeba dispar
EEKEMKNKEI

SEQ ID NO: 2419486 - protein, 19 aa, Entamoeba dispar
EEKEQPEEEVEESNSVNEV

SEQ ID NO: 2419487 - protein, 6 aa, Entamoeba dispar
EEKEQT

SEQ ID NO: 2419488 - protein, 27 aa, Entamoeba dispar
EEKERQKIAEEQQLKQLEEKHAEEERK

SEQ ID NO: 2419489 - protein, 5 aa, Entamoeba dispar
EEKEV

SEQ ID NO: 2419490 - protein, 6 aa, Entamoeba dispar
EEKEVL

SEQ ID NO: 2419491 - protein, 8 aa, Entamoeba dispar
EEKEYKKA

SEQ ID NO: 2419492 - protein, 4 aa, Entamoeba dispar
EEKF

SEQ ID NO: 2419493 - protein, 4 aa, Entamoeba dispar
EEKG

SEQ ID NO: 2419494 - protein, 5 aa, Entamoeba dispar
EEKGD

SEQ ID NO: 2419495 - protein, 10 aa, Entamoeba dispar
EEKGINKPKI

SEQ ID NO: 2419496 - protein, 6 aa, Entamoeba dispar
EEKGKG

SEQ ID NO: 2419497 - protein, 6 aa, Entamoeba dispar
EEKGTQ

SEQ ID NO: 2419498 - protein, 5 aa, Entamoeba dispar
EEKGV

SEQ ID NO: 2419499 - protein, 7 aa, Entamoeba dispar
EEKHKSK

SEQ ID NO: 2419500 - protein, 4 aa, Entamoeba dispar
EEKI

SEQ ID NO: 2419501 - protein, 16 aa, Entamoeba dispar
EEKIEDKEDKIEKRRE

SEQ ID NO: 2419502 - protein, 15 aa, Entamoeba dispar
EEKIKKKKEKTRNNK

SEQ ID NO: 2419503 - protein, 7 aa, Entamoeba dispar
EEKINTQ

SEQ ID NO: 2419504 - protein, 15 aa, Entamoeba dispar
EEKIPENERKTKSTA

SEQ ID NO: 2419505 - protein, 6 aa, Entamoeba dispar
EEKISK

SEQ ID NO: 2419506 - protein, 4 aa, Entamoeba dispar
EEKK

SEQ ID NO: 2419507 - protein, 11 aa, Entamoeba dispar
EEKKEEEIIES

SEQ ID NO: 2419508 - protein, 11 aa, Entamoeba dispar
EEKKEKIKEIE

SEQ ID NO: 2419509 - protein, 11 aa, Entamoeba dispar
EEKKEQPSYPI

SEQ ID NO: 2419510 - protein, 36 aa, Entamoeba dispar
EEKKERQNERRQLKRKEKKERIKTIKKEASEHPEEN

SEQ ID NO: 2419511 - protein, 21 aa, Entamoeba dispar
EEKKIKTQEELDNENRKKIYE

SEQ ID NO: 2419512 - protein, 8 aa, Entamoeba dispar
EEKKKEVN

SEQ ID NO: 2419513 - protein, 15 aa, Entamoeba dispar
EEKKKFMPMKKGGIA

SEQ ID NO: 2419514 - protein, 10 aa, Entamoeba dispar
EEKKKGVDDR

SEQ ID NO: 2419515 - protein, 22 aa, Entamoeba dispar
EEKKKLKEEEKARRKAIKEKQK

SEQ ID NO: 2419516 - protein, 12 aa, Entamoeba dispar
EEKKKRGRKRKA

SEQ ID NO: 2419517 - protein, 10 aa, Entamoeba dispar
EEKKKSKIGI

SEQ ID NO: 2419518 - protein, 11 aa, Entamoeba dispar
EEKKPQIPSSV

SEQ ID NO: 2419519 - protein, 16 aa, Entamoeba dispar
EEKKRLGAKGSEEVKN

SEQ ID NO: 2419520 - protein, 22 aa, Entamoeba dispar
EEKKRQEEKRTQQMKEEEECKK

SEQ ID NO: 2419521 - protein, 13 aa, Entamoeba dispar
EEKKRSKVGKYQE

SEQ ID NO: 2419522 - protein, 4 aa, Entamoeba dispar
EEKL

SEQ ID NO: 2419523 - protein, 7 aa, Entamoeba dispar
EEKLENR

SEQ ID NO: 2419524 - protein, 4 aa, Entamoeba dispar
EEKM

SEQ ID NO: 2419525 - protein, 7 aa, Entamoeba dispar
EEKNEGK

SEQ ID NO: 2419526 - protein, 9 aa, Entamoeba dispar
EEKNEPRII

SEQ ID NO: 2419527 - protein, 8 aa, Entamoeba dispar
EEKNKFQF

SEQ ID NO: 2419528 - protein, 5 aa, Entamoeba dispar
EEKNL

SEQ ID NO: 2419529 - protein, 12 aa, Entamoeba dispar
EEKNNDSQTEDF

SEQ ID NO: 2419530 - protein, 6 aa, Entamoeba dispar
EEKNQY

SEQ ID NO: 2419531 - protein, 8 aa, Entamoeba dispar
EEKNRIKA

SEQ ID NO: 2419532 - protein, 10 aa, Entamoeba dispar
EEKPDVTYKD

SEQ ID NO: 2419533 - protein, 7 aa, Entamoeba dispar
EEKPSFQ

SEQ ID NO: 2419534 - protein, 56 aa, Entamoeba dispar
EEKPSINNKKEEESLGEELPNDPIETEKPFNKSETDYQTRTFEEQSEEEISNENKV

SEQ ID NO: 2419535 - protein, 6 aa, Entamoeba dispar
EEKPYC

SEQ ID NO: 2419536 - protein, 8 aa, Entamoeba dispar
EEKQALEG

SEQ ID NO: 2419537 - protein, 26 aa, Entamoeba dispar
EEKQKEEANELSKQIKNCKDPQEREK

SEQ ID NO: 2419538 - protein, 8 aa, Entamoeba dispar
EEKQKEEL

SEQ ID NO: 2419539 - protein, 10 aa, Entamoeba dispar
EEKQPKKALE

SEQ ID NO: 2419540 - protein, 7 aa, Entamoeba dispar
EEKQPKP

SEQ ID NO: 2419541 - protein, 4 aa, Entamoeba dispar
EEKR

SEQ ID NO: 2419542 - protein, 13 aa, Entamoeba dispar
EEKRGEMNSELEK

SEQ ID NO: 2419543 - protein, 11 aa, Entamoeba dispar
EEKRINDASID

SEQ ID NO: 2419544 - protein, 8 aa, Entamoeba dispar
EEKRKELT

SEQ ID NO: 2419545 - protein, 8 aa, Entamoeba dispar
EEKRKGLG

SEQ ID NO: 2419546 - protein, 20 aa, Entamoeba dispar
EEKRNKNEESMSQKNFKDNK

SEQ ID NO: 2419547 - protein, 26 aa, Entamoeba dispar
EEKRQNKLNNTKKKIEEVKSNKQTIN

SEQ ID NO: 2419548 - protein, 14 aa, Entamoeba dispar
EEKRSELERKYRPS

SEQ ID NO: 2419549 - protein, 10 aa, Entamoeba dispar
EEKSEDNRVN

SEQ ID NO: 2419550 - protein, 51 aa, Entamoeba dispar
EEKSETKKIKQKQERKGKKQRNTERKEEKQEKRFDRKGLSREEKEELHKED

SEQ ID NO: 2419551 - protein, 9 aa, Entamoeba dispar
EEKSGLSVA

SEQ ID NO: 2419552 - protein, 7 aa, Entamoeba dispar
EEKSGLV

SEQ ID NO: 2419553 - protein, 12 aa, Entamoeba dispar
EEKSRPTASERL

SEQ ID NO: 2419554 - protein, 10 aa, Entamoeba dispar
EEKSTVKKQF

SEQ ID NO: 2419555 - protein, 15 aa, Entamoeba dispar
EEKTDGLKAPPVSVE

SEQ ID NO: 2419556 - protein, 6 aa, Entamoeba dispar
EEKTKE

SEQ ID NO: 2419557 - protein, 8 aa, Entamoeba dispar
EEKTKKPM

SEQ ID NO: 2419558 - protein, 9 aa, Entamoeba dispar
EEKTRMNAS

SEQ ID NO: 2419559 - protein, 8 aa, Entamoeba dispar
EEKTRSLR

SEQ ID NO: 2419560 - protein, 13 aa, Entamoeba dispar
EEKTTETSEDVKA

SEQ ID NO: 2419561 - protein, 4 aa, Entamoeba dispar
EEKV

SEQ ID NO: 2419562 - protein, 6 aa, Entamoeba dispar
EEKVKQ

SEQ ID NO: 2419563 - protein, 5 aa, Entamoeba dispar
EEKYP

SEQ ID NO: 2419564 - protein, 8 aa, Entamoeba dispar
EEKYPKDE

SEQ ID NO: 2419565 - protein, 7 aa, Entamoeba dispar
EELDQNE

SEQ ID NO: 2419566 - protein, 10 aa, Entamoeba dispar
EELEDEPTAV

SEQ ID NO: 2419567 - protein, 5 aa, Entamoeba dispar
EELEE

SEQ ID NO: 2419568 - protein, 6 aa, Entamoeba dispar
EELEEE

SEQ ID NO: 2419569 - protein, 10 aa, Entamoeba dispar
EELEEGQCQS

SEQ ID NO: 2419570 - protein, 31 aa, Entamoeba dispar
EELEGERNNEKQKAEQLEKKVNDSEKENNEL

SEQ ID NO: 2419571 - protein, 52 aa, Entamoeba dispar
EELEKEKRKQAEKIESEKNLPETETTIPGQPPVNKDGKTKKSKSTKMSPELK

SEQ ID NO: 2419572 - protein, 20 aa, Entamoeba dispar
EELENEEEERSEILSKSKED

SEQ ID NO: 2419573 - protein, 21 aa, Entamoeba dispar
EELENEKKNNQNNKTNEEQIK

SEQ ID NO: 2419574 - protein, 9 aa, Entamoeba dispar
EELENESKR

SEQ ID NO: 2419575 - protein, 28 aa, Entamoeba dispar
EELENQSDDETEEAQYQQPLDQYGSNDL

SEQ ID NO: 2419576 - protein, 20 aa, Entamoeba dispar
EELERQQEKMKTLDSRATKE

SEQ ID NO: 2419577 - protein, 29 aa, Entamoeba dispar
EELETQHTPQTKYSSSILTNTNQPTTPQI

SEQ ID NO: 2419578 - protein, 9 aa, Entamoeba dispar
EELGPTKPD

SEQ ID NO: 2419579 - protein, 13 aa, Entamoeba dispar
EELHKDDAALPLQ

SEQ ID NO: 2419580 - protein, 12 aa, Entamoeba dispar
EELKDSADKINK

SEQ ID NO: 2419581 - protein, 16 aa, Entamoeba dispar
EELKEENNKKERELAE

SEQ ID NO: 2419582 - protein, 9 aa, Entamoeba dispar
EELKEENQI

SEQ ID NO: 2419583 - protein, 15 aa, Entamoeba dispar
EELKEEQGTFPPKME

SEQ ID NO: 2419584 - protein, 6 aa, Entamoeba dispar
EELKEN

SEQ ID NO: 2419585 - protein, 13 aa, Entamoeba dispar
EELKKKGISSNQF

SEQ ID NO: 2419586 - protein, 26 aa, Entamoeba dispar
EELKKKVDELTKQISSIKKEATEGID

SEQ ID NO: 2419587 - protein, 14 aa, Entamoeba dispar
EELKKNERIPRICF

SEQ ID NO: 2419588 - protein, 14 aa, Entamoeba dispar
EELKKNERIPRNCF

SEQ ID NO: 2419589 - protein, 15 aa, Entamoeba dispar
EELKKNERIPRNCFN

SEQ ID NO: 2419590 - protein, 14 aa, Entamoeba dispar
EELKKNERIPTDCF

SEQ ID NO: 2419591 - protein, 17 aa, Entamoeba dispar
EELKKNETIPRICFDRG

SEQ ID NO: 2419592 - protein, 15 aa, Entamoeba dispar
EELKKNKRIPRKCFE

SEQ ID NO: 2419593 - protein, 14 aa, Entamoeba dispar
EELKKNKRIPRNCF

SEQ ID NO: 2419594 - protein, 18 aa, Entamoeba dispar
EELKKNKTIPEDCFKLYI

SEQ ID NO: 2419595 - protein, 15 aa, Entamoeba dispar
EELKKNKTIPRDCFN

SEQ ID NO: 2419596 - protein, 14 aa, Entamoeba dispar
EELKKNKTIPRNCF

SEQ ID NO: 2419597 - protein, 20 aa, Entamoeba dispar
EELKKNKTIPRNCFDAWQQM

SEQ ID NO: 2419598 - protein, 14 aa, Entamoeba dispar
EELKQNKRIPSYCF

SEQ ID NO: 2419599 - protein, 24 aa, Entamoeba dispar
EELKQNNKKSEQENLEKQKQIDQL

SEQ ID NO: 2419600 - protein, 15 aa, Entamoeba dispar
EELKRNETIPRNCFD

SEQ ID NO: 2419601 - protein, 9 aa, Entamoeba dispar
EELKSKETN

SEQ ID NO: 2419602 - protein, 4 aa, Entamoeba dispar
EELL

SEQ ID NO: 2419603 - protein, 35 aa, Entamoeba dispar
EELLESEENLKEKEKANEEEHEEEEEEEEEENAAV

SEQ ID NO: 2419604 - protein, 4 aa, Entamoeba dispar
EELN

SEQ ID NO: 2419605 - protein, 17 aa, Entamoeba dispar
EELNKEETQTINKKKST

SEQ ID NO: 2419606 - protein, 16 aa, Entamoeba dispar
EELNKTKEDVNTAKSD

SEQ ID NO: 2419607 - protein, 31 aa, Entamoeba dispar
EELNNEKEKAMNETKKQEDLLNSKTKENELE

SEQ ID NO: 2419608 - protein, 7 aa, Entamoeba dispar
EELPKEY

SEQ ID NO: 2419609 - protein, 10 aa, Entamoeba dispar
EELPSNVKDD

SEQ ID NO: 2419610 - protein, 7 aa, Entamoeba dispar
EELQEDY

SEQ ID NO: 2419611 - protein, 14 aa, Entamoeba dispar
EELQKEKIKYSGLT

SEQ ID NO: 2419612 - protein, 4 aa, Entamoeba dispar
EELR

SEQ ID NO: 2419613 - protein, 14 aa, Entamoeba dispar
EELSKRQQEHQDTI

SEQ ID NO: 2419614 - protein, 16 aa, Entamoeba dispar
EELSQTKKELDESNKT

SEQ ID NO: 2419615 - protein, 14 aa, Entamoeba dispar
EELSRAKKEIEDNS

SEQ ID NO: 2419616 - protein, 8 aa, Entamoeba dispar
EELSSEEE

SEQ ID NO: 2419617 - protein, 9 aa, Entamoeba dispar
EELSSRQIN

SEQ ID NO: 2419618 - protein, 6 aa, Entamoeba dispar
EELTEF

SEQ ID NO: 2419619 - protein, 8 aa, Entamoeba dispar
EELTESKI

SEQ ID NO: 2419620 - protein, 44 aa, Entamoeba dispar
EELTESPNHSQSPIEYSNNEINTNKSVENDSHEKISKSHSEEGH

SEQ ID NO: 2419621 - protein, 14 aa, Entamoeba dispar
EELTNGLQDKPSTL

SEQ ID NO: 2419622 - protein, 11 aa, Entamoeba dispar
EELTPYQKSRR

SEQ ID NO: 2419623 - protein, 8 aa, Entamoeba dispar
EELTQENE

SEQ ID NO: 2419624 - protein, 72 aa, Entamoeba dispar
EELTQHSEEEVKQEEPKQEEPKQEEPKQEEPKQEEIKQEEIKQDEEQPKEESQQSNTELTQETPKQQEETPL

SEQ ID NO: 2419625 - protein, 18 aa, Entamoeba dispar
EELVENKQQEIKKEEEEE

SEQ ID NO: 2419626 - protein, 11 aa, Entamoeba dispar
EELYRNDKRGF

SEQ ID NO: 2419627 - protein, 13 aa, Entamoeba dispar
EEMDKNLEKKKRD

SEQ ID NO: 2419628 - protein, 20 aa, Entamoeba dispar
EEMEEENKQLKEENKELKEQ

SEQ ID NO: 2419629 - protein, 5 aa, Entamoeba dispar
EEMER

SEQ ID NO: 2419630 - protein, 6 aa, Entamoeba dispar
EEMESA

SEQ ID NO: 2419631 - protein, 17 aa, Entamoeba dispar
EEMKKQSSLIAENEEKV

SEQ ID NO: 2419632 - protein, 34 aa, Entamoeba dispar
EEMKQNESNSIQSTSPQVSINTTTNTKDIQKQES

SEQ ID NO: 2419633 - protein, 14 aa, Entamoeba dispar
EEMKSQNKNTLTPV

SEQ ID NO: 2419634 - protein, 5 aa, Entamoeba dispar
EEMKT

SEQ ID NO: 2419635 - protein, 14 aa, Entamoeba dispar
EEMNEKNKKLRNNI

SEQ ID NO: 2419636 - protein, 7 aa, Entamoeba dispar
EEMPKEI

SEQ ID NO: 2419637 - protein, 10 aa, Entamoeba dispar
EEMSENDDHL

SEQ ID NO: 2419638 - protein, 5 aa, Entamoeba dispar
EEMTP

SEQ ID NO: 2419639 - protein, 8 aa, Entamoeba dispar
EENADGTI

SEQ ID NO: 2419640 - protein, 9 aa, Entamoeba dispar
EENAGTDKL

SEQ ID NO: 2419641 - protein, 13 aa, Entamoeba dispar
EENAIKQVEQDIS

SEQ ID NO: 2419642 - protein, 41 aa, Entamoeba dispar
EENAKQVVEKAKAEKVQKIAQAREEAKAKVAEMKKEKDEEF

SEQ ID NO: 2419643 - protein, 4 aa, Entamoeba dispar
EEND

SEQ ID NO: 2419644 - protein, 14 aa, Entamoeba dispar
EENDEKAKKYEEKL

SEQ ID NO: 2419645 - protein, 18 aa, Entamoeba dispar
EENDYTPEEIEELKKKYA

SEQ ID NO: 2419646 - protein, 4 aa, Entamoeba dispar
EENE

SEQ ID NO: 2419647 - protein, 6 aa, Entamoeba dispar
EENEDC

SEQ ID NO: 2419648 - protein, 9 aa, Entamoeba dispar
EENEEETKK

SEQ ID NO: 2419649 - protein, 8 aa, Entamoeba dispar
EENEGVQT

SEQ ID NO: 2419650 - protein, 58 aa, Entamoeba dispar
EENEIEKEKVEVENKKTDEENKIDNEENKKMEEENKIENERNEDDIKNQSDEEQKPDN

SEQ ID NO: 2419651 - protein, 7 aa, Entamoeba dispar
EENEINE

SEQ ID NO: 2419652 - protein, 6 aa, Entamoeba dispar
EENEKI

SEQ ID NO: 2419653 - protein, 17 aa, Entamoeba dispar
EENEKLKEESEKCHKPK

SEQ ID NO: 2419654 - protein, 5 aa, Entamoeba dispar
EENEN

SEQ ID NO: 2419655 - protein, 6 aa, Entamoeba dispar
EENENV

SEQ ID NO: 2419656 - protein, 14 aa, Entamoeba dispar
EENEQKNQQKSEHS

SEQ ID NO: 2419657 - protein, 17 aa, Entamoeba dispar
EENERVPSEDKEKKEHL

SEQ ID NO: 2419658 - protein, 15 aa, Entamoeba dispar
EENETLKKTVENFTQ

SEQ ID NO: 2419659 - protein, 14 aa, Entamoeba dispar
EENFQEDPEDGILP

SEQ ID NO: 2419660 - protein, 4 aa, Entamoeba dispar
EENG

SEQ ID NO: 2419661 - protein, 13 aa, Entamoeba dispar
EENGELKSTKEGT

SEQ ID NO: 2419662 - protein, 11 aa, Entamoeba dispar
EENGKKDDNII

SEQ ID NO: 2419663 - protein, 8 aa, Entamoeba dispar
EENGPNGI

SEQ ID NO: 2419664 - protein, 15 aa, Entamoeba dispar
EENGQRGGDGRYRDY

SEQ ID NO: 2419665 - protein, 9 aa, Entamoeba dispar
EENGRLRKE

SEQ ID NO: 2419666 - protein, 6 aa, Entamoeba dispar
EENGTF

SEQ ID NO: 2419667 - protein, 6 aa, Entamoeba dispar
EENGTY

SEQ ID NO: 2419668 - protein, 9 aa, Entamoeba dispar
EENGVDGGG

SEQ ID NO: 2419669 - protein, 4 aa, Entamoeba dispar
EENI

SEQ ID NO: 2419670 - protein, 22 aa, Entamoeba dispar
EENIRKEEEEEEKVEETLKEQG

SEQ ID NO: 2419671 - protein, 4 aa, Entamoeba dispar
EENK

SEQ ID NO: 2419672 - protein, 10 aa, Entamoeba dispar
EENKGKYVPQ

SEQ ID NO: 2419673 - protein, 9 aa, Entamoeba dispar
EENKHKTPI

SEQ ID NO: 2419674 - protein, 10 aa, Entamoeba dispar
EENKNNKSFT

SEQ ID NO: 2419675 - protein, 11 aa, Entamoeba dispar
EENKNNPVKGR

SEQ ID NO: 2419676 - protein, 25 aa, Entamoeba dispar
EENKPNQKEETTEEQPQQTKEQNQD

SEQ ID NO: 2419677 - protein, 14 aa, Entamoeba dispar
EENKRRANRYKGEL

SEQ ID NO: 2419678 - protein, 6 aa, Entamoeba dispar
EENKSF

SEQ ID NO: 2419679 - protein, 6 aa, Entamoeba dispar
EENKSM

SEQ ID NO: 2419680 - protein, 8 aa, Entamoeba dispar
EENLSAED

SEQ ID NO: 2419681 - protein, 5 aa, Entamoeba dispar
EENNE

SEQ ID NO: 2419682 - protein, 29 aa, Entamoeba dispar
EENNEEEGIENISDEVKQKKKLLEQKKID

SEQ ID NO: 2419683 - protein, 8 aa, Entamoeba dispar
EENNGNYD

SEQ ID NO: 2419684 - protein, 12 aa, Entamoeba dispar
EENNKRKENKER

SEQ ID NO: 2419685 - protein, 9 aa, Entamoeba dispar
EENNQMKSN

SEQ ID NO: 2419686 - protein, 20 aa, Entamoeba dispar
EENNQSEESNQPEENSQQEV

SEQ ID NO: 2419687 - protein, 5 aa, Entamoeba dispar
EENNS

SEQ ID NO: 2419688 - protein, 15 aa, Entamoeba dispar
EENPSTLQPEKQKKH

SEQ ID NO: 2419689 - protein, 4 aa, Entamoeba dispar
EENQ

SEQ ID NO: 2419690 - protein, 8 aa, Entamoeba dispar
EENQASNI

SEQ ID NO: 2419691 - protein, 16 aa, Entamoeba dispar
EENQEIQSRRIERGGS

SEQ ID NO: 2419692 - protein, 20 aa, Entamoeba dispar
EENQEKETVCPSSPKSYCGD

SEQ ID NO: 2419693 - protein, 17 aa, Entamoeba dispar
EENQHQRVTNNQSGELR

SEQ ID NO: 2419694 - protein, 7 aa, Entamoeba dispar
EENQIND

SEQ ID NO: 2419695 - protein, 6 aa, Entamoeba dispar
EENQNS

SEQ ID NO: 2419696 - protein, 14 aa, Entamoeba dispar
EENQPLTKITQPKI

SEQ ID NO: 2419697 - protein, 6 aa, Entamoeba dispar
EENQRN

SEQ ID NO: 2419698 - protein, 6 aa, Entamoeba dispar
EENQVN

SEQ ID NO: 2419699 - protein, 5 aa, Entamoeba dispar
EENRI

SEQ ID NO: 2419700 - protein, 13 aa, Entamoeba dispar
EENRKKKEKRIQQ

SEQ ID NO: 2419701 - protein, 18 aa, Entamoeba dispar
EENRKSYAKEFARFEMED

SEQ ID NO: 2419702 - protein, 5 aa, Entamoeba dispar
EENRM

SEQ ID NO: 2419703 - protein, 6 aa, Entamoeba dispar
EENSHY

SEQ ID NO: 2419704 - protein, 15 aa, Entamoeba dispar
EENSMTEEEKKKIKK

SEQ ID NO: 2419705 - protein, 5 aa, Entamoeba dispar
EENSS

SEQ ID NO: 2419706 - protein, 10 aa, Entamoeba dispar
EENTAGPALD

SEQ ID NO: 2419707 - protein, 7 aa, Entamoeba dispar
EENTFSD

SEQ ID NO: 2419708 - protein, 7 aa, Entamoeba dispar
EENTIAK

SEQ ID NO: 2419709 - protein, 7 aa, Entamoeba dispar
EENTNEI

SEQ ID NO: 2419710 - protein, 8 aa, Entamoeba dispar
EENTNPKI

SEQ ID NO: 2419711 - protein, 21 aa, Entamoeba dispar
EENTTLNIKETTKKKIKEIDN

SEQ ID NO: 2419712 - protein, 15 aa, Entamoeba dispar
EENVDDDIDAPEEIG

SEQ ID NO: 2419713 - protein, 11 aa, Entamoeba dispar
EENVPEKYEDV

SEQ ID NO: 2419714 - protein, 15 aa, Entamoeba dispar
EENVQEIEEDEIEEV

SEQ ID NO: 2419715 - protein, 9 aa, Entamoeba dispar
EEPAPSEAI

SEQ ID NO: 2419716 - protein, 5 aa, Entamoeba dispar
EEPDD

SEQ ID NO: 2419717 - protein, 7 aa, Entamoeba dispar
EEPDEPI

SEQ ID NO: 2419718 - protein, 5 aa, Entamoeba dispar
EEPEQ

SEQ ID NO: 2419719 - protein, 8 aa, Entamoeba dispar
EEPGGKRR

SEQ ID NO: 2419720 - protein, 5 aa, Entamoeba dispar
EEPIE

SEQ ID NO: 2419721 - protein, 17 aa, Entamoeba dispar
EEPIKEEEIKENVEEDE

SEQ ID NO: 2419722 - protein, 6 aa, Entamoeba dispar
EEPIKR

SEQ ID NO: 2419723 - protein, 9 aa, Entamoeba dispar
EEPIPASER

SEQ ID NO: 2419724 - protein, 9 aa, Entamoeba dispar
EEPISSNST

SEQ ID NO: 2419725 - protein, 10 aa, Entamoeba dispar
EEPISSNSTV

SEQ ID NO: 2419726 - protein, 19 aa, Entamoeba dispar
EEPKDKKGLEELSKYSYIP

SEQ ID NO: 2419727 - protein, 11 aa, Entamoeba dispar
EEPKQQIDEEI

SEQ ID NO: 2419728 - protein, 5 aa, Entamoeba dispar
EEPKY

SEQ ID NO: 2419729 - protein, 12 aa, Entamoeba dispar
EEPKYPTTKPIT

SEQ ID NO: 2419730 - protein, 6 aa, Entamoeba dispar
EEPLKE

SEQ ID NO: 2419731 - protein, 9 aa, Entamoeba dispar
EEPLKGSSG

SEQ ID NO: 2419732 - protein, 7 aa, Entamoeba dispar
EEPMTTS

SEQ ID NO: 2419733 - protein, 41 aa, Entamoeba dispar
EEPNKEKKSDEEKKEETAENQEEEKQEEKKEEKKEETQQEE

SEQ ID NO: 2419734 - protein, 52 aa, Entamoeba dispar
EEPNKEKKSDEEKKEETAENQEEENKKEQETRIEKEETKEVSKELEKKEKLK

SEQ ID NO: 2419735 - protein, 9 aa, Entamoeba dispar
EEPNNPKSL

SEQ ID NO: 2419736 - protein, 9 aa, Entamoeba dispar
EEPNQIETD

SEQ ID NO: 2419737 - protein, 7 aa, Entamoeba dispar
EEPSIPI

SEQ ID NO: 2419738 - protein, 4 aa, Entamoeba dispar
EEPT

SEQ ID NO: 2419739 - protein, 5 aa, Entamoeba dispar
EEPTA

SEQ ID NO: 2419740 - protein, 4 aa, Entamoeba dispar
EEPV

SEQ ID NO: 2419741 - protein, 4 aa, Entamoeba dispar
EEPY

SEQ ID NO: 2419742 - protein, 14 aa, Entamoeba dispar
EEPYIEKKQNIDQG

SEQ ID NO: 2419743 - protein, 7 aa, Entamoeba dispar
EEQDEPL

SEQ ID NO: 2419744 - protein, 7 aa, Entamoeba dispar
EEQDFDK

SEQ ID NO: 2419745 - protein, 4 aa, Entamoeba dispar
EEQE

SEQ ID NO: 2419746 - protein, 5 aa, Entamoeba dispar
EEQEN

SEQ ID NO: 2419747 - protein, 4 aa, Entamoeba dispar
EEQF

SEQ ID NO: 2419748 - protein, 5 aa, Entamoeba dispar
EEQGE

SEQ ID NO: 2419749 - protein, 4 aa, Entamoeba dispar
EEQI

SEQ ID NO: 2419750 - protein, 5 aa, Entamoeba dispar
EEQIN

SEQ ID NO: 2419751 - protein, 6 aa, Entamoeba dispar
EEQIQQ

SEQ ID NO: 2419752 - protein, 6 aa, Entamoeba dispar
EEQKDI

SEQ ID NO: 2419753 - protein, 6 aa, Entamoeba dispar
EEQKKN

SEQ ID NO: 2419754 - protein, 6 aa, Entamoeba dispar
EEQKLE

SEQ ID NO: 2419755 - protein, 14 aa, Entamoeba dispar
EEQKPNKRNNEENT

SEQ ID NO: 2419756 - protein, 19 aa, Entamoeba dispar
EEQKQKKKLYKEENEQLRQ

SEQ ID NO: 2419757 - protein, 17 aa, Entamoeba dispar
EEQKQKYDSDLNSFKEE

SEQ ID NO: 2419758 - protein, 8 aa, Entamoeba dispar
EEQKRYDT

SEQ ID NO: 2419759 - protein, 15 aa, Entamoeba dispar
EEQLEKGDNNYVQKQ

SEQ ID NO: 2419760 - protein, 7 aa, Entamoeba dispar
EEQMQKG

SEQ ID NO: 2419761 - protein, 7 aa, Entamoeba dispar
EEQNDAI

SEQ ID NO: 2419762 - protein, 10 aa, Entamoeba dispar
EEQNETQTKV

SEQ ID NO: 2419763 - protein, 8 aa, Entamoeba dispar
EEQNGYGC

SEQ ID NO: 2419764 - protein, 9 aa, Entamoeba dispar
EEQNGYGCK

SEQ ID NO: 2419765 - protein, 8 aa, Entamoeba dispar
EEQNTYGC

SEQ ID NO: 2419766 - protein, 17 aa, Entamoeba dispar
EEQPSQYNLEDVNYSEL

SEQ ID NO: 2419767 - protein, 16 aa, Entamoeba dispar
EEQPTLSDELKKSAQE

SEQ ID NO: 2419768 - protein, 7 aa, Entamoeba dispar
EEQQDDR

SEQ ID NO: 2419769 - protein, 5 aa, Entamoeba dispar
EEQQK

SEQ ID NO: 2419770 - protein, 9 aa, Entamoeba dispar
EEQQQEKPL

SEQ ID NO: 2419771 - protein, 43 aa, Entamoeba dispar
EEQREAQRKKEREERRKRLEEERKALEGSSVTERTERAAQKLK

SEQ ID NO: 2419772 - protein, 9 aa, Entamoeba dispar
EEQRREARN

SEQ ID NO: 2419773 - protein, 155 aa, Entamoeba dispar
EEQRRLEEEKKRKEEEAFKRNQERIEKQQSSSEVYRPSFSQRQKEDEEGWIPSKKDQKHSNSGVASFTGSHSRSPQQRVGGSSDNYPRTGGSGYNNSVHQQRPSGNSSVPSFTQKRGNGYSNSGASFSNRGPRTNGGSSSVASFTSGGSRGGYRK

SEQ ID NO: 2419774 - protein, 9 aa, Entamoeba dispar
EEQSEEITG

SEQ ID NO: 2419775 - protein, 6 aa, Entamoeba dispar
EEQTRF

SEQ ID NO: 2419776 - protein, 10 aa, Entamoeba dispar
EEQYDATPFD

SEQ ID NO: 2419777 - protein, 15 aa, Entamoeba dispar
EEQYQGEDKELKSSQ

SEQ ID NO: 2419778 - protein, 9 aa, Entamoeba dispar
EEQYSQYKN

SEQ ID NO: 2419779 - protein, 7 aa, Entamoeba dispar
EERDGAI

SEQ ID NO: 2419780 - protein, 8 aa, Entamoeba dispar
EERDKNEV

SEQ ID NO: 2419781 - protein, 15 aa, Entamoeba dispar
EERDPKKEESSDSSS

SEQ ID NO: 2419782 - protein, 4 aa, Entamoeba dispar
EERE

SEQ ID NO: 2419783 - protein, 8 aa, Entamoeba dispar
EEREDKTI

SEQ ID NO: 2419784 - protein, 8 aa, Entamoeba dispar
EEREEEYE

SEQ ID NO: 2419785 - protein, 9 aa, Entamoeba dispar
EEREMNSDK

SEQ ID NO: 2419786 - protein, 11 aa, Entamoeba dispar
EERENEEEFEE

SEQ ID NO: 2419787 - protein, 16 aa, Entamoeba dispar
EERENESDDSEETKSQ

SEQ ID NO: 2419788 - protein, 4 aa, Entamoeba dispar
EERF

SEQ ID NO: 2419789 - protein, 6 aa, Entamoeba dispar
EERGDV

SEQ ID NO: 2419790 - protein, 8 aa, Entamoeba dispar
EERGEKGL

SEQ ID NO: 2419791 - protein, 5 aa, Entamoeba dispar
EERGL

SEQ ID NO: 2419792 - protein, 6 aa, Entamoeba dispar
EERGPV

SEQ ID NO: 2419793 - protein, 5 aa, Entamoeba dispar
EERHH

SEQ ID NO: 2419794 - protein, 4 aa, Entamoeba dispar
EERI

SEQ ID NO: 2419795 - protein, 19 aa, Entamoeba dispar
EERKKQLAEMKEKEGESMA

SEQ ID NO: 2419796 - protein, 6 aa, Entamoeba dispar
EERKKY

SEQ ID NO: 2419797 - protein, 14 aa, Entamoeba dispar
EERLAEEGRREDEA

SEQ ID NO: 2419798 - protein, 6 aa, Entamoeba dispar
EERLKN

SEQ ID NO: 2419799 - protein, 7 aa, Entamoeba dispar
EERLSPD

SEQ ID NO: 2419800 - protein, 15 aa, Entamoeba dispar
EERMEKERLEKEGVK

SEQ ID NO: 2419801 - protein, 7 aa, Entamoeba dispar
EERNTWA

SEQ ID NO: 2419802 - protein, 5 aa, Entamoeba dispar
EERPM

SEQ ID NO: 2419803 - protein, 5 aa, Entamoeba dispar
EERRI

SEQ ID NO: 2419804 - protein, 8 aa, Entamoeba dispar
EERRNRKE

SEQ ID NO: 2419805 - protein, 5 aa, Entamoeba dispar
EERSE

SEQ ID NO: 2419806 - protein, 14 aa, Entamoeba dispar
EERSRSKSSLAATR

SEQ ID NO: 2419807 - protein, 23 aa, Entamoeba dispar
EERTKKENKEITEIKKDETKEEN

SEQ ID NO: 2419808 - protein, 6 aa, Entamoeba dispar
EERTPA

SEQ ID NO: 2419809 - protein, 9 aa, Entamoeba dispar
EERTPTRDY

SEQ ID NO: 2419810 - protein, 32 aa, Entamoeba dispar
EERTTTQEIRKKKGKVTKEQTERMKQRINNWY

SEQ ID NO: 2419811 - protein, 6 aa, Entamoeba dispar
EERYDG

SEQ ID NO: 2419812 - protein, 6 aa, Entamoeba dispar
EERYEA

SEQ ID NO: 2419813 - protein, 10 aa, Entamoeba dispar
EERYGSENTF

SEQ ID NO: 2419814 - protein, 15 aa, Entamoeba dispar
EERYKGKTLKQSTDI

SEQ ID NO: 2419815 - protein, 5 aa, Entamoeba dispar
EERYS

SEQ ID NO: 2419816 - protein, 10 aa, Entamoeba dispar
EESCQNQERA

SEQ ID NO: 2419817 - protein, 20 aa, Entamoeba dispar
EESDPVKVASEGVRTFRKEK

SEQ ID NO: 2419818 - protein, 8 aa, Entamoeba dispar
EESEEQNT

SEQ ID NO: 2419819 - protein, 10 aa, Entamoeba dispar
EESEEVIKGK

SEQ ID NO: 2419820 - protein, 10 aa, Entamoeba dispar
EESESQAGRK

SEQ ID NO: 2419821 - protein, 6 aa, Entamoeba dispar
EESEVN

SEQ ID NO: 2419822 - protein, 4 aa, Entamoeba dispar
EESF

SEQ ID NO: 2419823 - protein, 5 aa, Entamoeba dispar
EESFG

SEQ ID NO: 2419824 - protein, 4 aa, Entamoeba dispar
EESG

SEQ ID NO: 2419825 - protein, 6 aa, Entamoeba dispar
EESGEH

SEQ ID NO: 2419826 - protein, 5 aa, Entamoeba dispar
EESHI

SEQ ID NO: 2419827 - protein, 8 aa, Entamoeba dispar
EESHSREE

SEQ ID NO: 2419828 - protein, 6 aa, Entamoeba dispar
EESIDD

SEQ ID NO: 2419829 - protein, 6 aa, Entamoeba dispar
EESIES

SEQ ID NO: 2419830 - protein, 5 aa, Entamoeba dispar
EESIP

SEQ ID NO: 2419831 - protein, 5 aa, Entamoeba dispar
EESIT

SEQ ID NO: 2419832 - protein, 6 aa, Entamoeba dispar
EESITS

SEQ ID NO: 2419833 - protein, 21 aa, Entamoeba dispar
EESKEESVSSSETETTEEKKS

SEQ ID NO: 2419834 - protein, 5 aa, Entamoeba dispar
EESKK

SEQ ID NO: 2419835 - protein, 6 aa, Entamoeba dispar
EESKKD

SEQ ID NO: 2419836 - protein, 12 aa, Entamoeba dispar
EESKKPKMSKEV

SEQ ID NO: 2419837 - protein, 14 aa, Entamoeba dispar
EESKKSSEKSSEKF

SEQ ID NO: 2419838 - protein, 10 aa, Entamoeba dispar
EESKNKNIGA

SEQ ID NO: 2419839 - protein, 7 aa, Entamoeba dispar
EESKNVL

SEQ ID NO: 2419840 - protein, 23 aa, Entamoeba dispar
EESKQQIKEVETPQEHKVTNKEL

SEQ ID NO: 2419841 - protein, 20 aa, Entamoeba dispar
EESKTVEDINEENKENEESL

SEQ ID NO: 2419842 - protein, 13 aa, Entamoeba dispar
EESKYGSTSINND

SEQ ID NO: 2419843 - protein, 4 aa, Entamoeba dispar
EESL

SEQ ID NO: 2419844 - protein, 9 aa, Entamoeba dispar
EESLAGDKK

SEQ ID NO: 2419845 - protein, 5 aa, Entamoeba dispar
EESMN

SEQ ID NO: 2419846 - protein, 10 aa, Entamoeba dispar
EESMSRERTL

SEQ ID NO: 2419847 - protein, 18 aa, Entamoeba dispar
EESMTTARRSVSDQDVRK

SEQ ID NO: 2419848 - protein, 47 aa, Entamoeba dispar
EESNDSQKTNSITDEDEDETKQLEEEITQKRKELETLKEKKDKAEKF

SEQ ID NO: 2419849 - protein, 15 aa, Entamoeba dispar
EESNEIKSNENDNFS

SEQ ID NO: 2419850 - protein, 7 aa, Entamoeba dispar
EESNEQQ

SEQ ID NO: 2419851 - protein, 6 aa, Entamoeba dispar
EESNHT

SEQ ID NO: 2419852 - protein, 7 aa, Entamoeba dispar
EESNNDA

SEQ ID NO: 2419853 - protein, 8 aa, Entamoeba dispar
EESNPKRI

SEQ ID NO: 2419854 - protein, 9 aa, Entamoeba dispar
EESNSGYGV

SEQ ID NO: 2419855 - protein, 6 aa, Entamoeba dispar
EESPEI

SEQ ID NO: 2419856 - protein, 33 aa, Entamoeba dispar
EESQKEDTKDKLETSGKEEVSEQPEQKLDENIN

SEQ ID NO: 2419857 - protein, 8 aa, Entamoeba dispar
EESRQTES

SEQ ID NO: 2419858 - protein, 15 aa, Entamoeba dispar
EESSEEENQQNQKKM

SEQ ID NO: 2419859 - protein, 71 aa, Entamoeba dispar
EESSEESEENKEMSEDQEEETKDTKEEVKEEIKDNKEEIKEEIKEEVKDNKEEVKEEVKDSNEEIKERKNK

SEQ ID NO: 2419860 - protein, 59 aa, Entamoeba dispar
EESSEESEENKEMSEDQEEETKDTKEEVKEEIKDNKEETKDNKEEVKDNKEEIKERKNK

SEQ ID NO: 2419861 - protein, 16 aa, Entamoeba dispar
EESSESSEEDDDKFDD

SEQ ID NO: 2419862 - protein, 8 aa, Entamoeba dispar
EESSKYNS

SEQ ID NO: 2419863 - protein, 6 aa, Entamoeba dispar
EESSLD

SEQ ID NO: 2419864 - protein, 22 aa, Entamoeba dispar
EESSVTSKPSVDVKNKRKHEEN

SEQ ID NO: 2419865 - protein, 6 aa, Entamoeba dispar
EESSYD

SEQ ID NO: 2419866 - protein, 5 aa, Entamoeba dispar
EESTC

SEQ ID NO: 2419867 - protein, 5 aa, Entamoeba dispar
EESTE

SEQ ID NO: 2419868 - protein, 6 aa, Entamoeba dispar
EESTEL

SEQ ID NO: 2419869 - protein, 5 aa, Entamoeba dispar
EESTN

SEQ ID NO: 2419870 - protein, 9 aa, Entamoeba dispar
EESTNGKKC

SEQ ID NO: 2419871 - protein, 9 aa, Entamoeba dispar
EESTPFEDV

SEQ ID NO: 2419872 - protein, 5 aa, Entamoeba dispar
EESTR

SEQ ID NO: 2419873 - protein, 10 aa, Entamoeba dispar
EESTRTNLKE

SEQ ID NO: 2419874 - protein, 26 aa, Entamoeba dispar
EESTTLSRKKSDNYSLQSDDKTKKGF

SEQ ID NO: 2419875 - protein, 9 aa, Entamoeba dispar
EESVPANDL

SEQ ID NO: 2419876 - protein, 5 aa, Entamoeba dispar
EESYK

SEQ ID NO: 2419877 - protein, 7 aa, Entamoeba dispar
EESYKRY

SEQ ID NO: 2419878 - protein, 8 aa, Entamoeba dispar
EESYSNRM

SEQ ID NO: 2419879 - protein, 4 aa, Entamoeba dispar
EETC

SEQ ID NO: 2419880 - protein, 8 aa, Entamoeba dispar
EETDIKNN

SEQ ID NO: 2419881 - protein, 15 aa, Entamoeba dispar
EETDIKNNINTQTAL

SEQ ID NO: 2419882 - protein, 12 aa, Entamoeba dispar
EETDLEKITPEL

SEQ ID NO: 2419883 - protein, 5 aa, Entamoeba dispar
EETDP

SEQ ID NO: 2419884 - protein, 8 aa, Entamoeba dispar
EETEIDED

SEQ ID NO: 2419885 - protein, 11 aa, Entamoeba dispar
EETENKEIPSP

SEQ ID NO: 2419886 - protein, 6 aa, Entamoeba dispar
EETETI

SEQ ID NO: 2419887 - protein, 6 aa, Entamoeba dispar
EETEYR

SEQ ID NO: 2419888 - protein, 4 aa, Entamoeba dispar
EETF

SEQ ID NO: 2419889 - protein, 7 aa, Entamoeba dispar
EETFKKT

SEQ ID NO: 2419890 - protein, 8 aa, Entamoeba dispar
EETGFSEQ

SEQ ID NO: 2419891 - protein, 4 aa, Entamoeba dispar
EETI

SEQ ID NO: 2419892 - protein, 6 aa, Entamoeba dispar
EETIDE

SEQ ID NO: 2419893 - protein, 7 aa, Entamoeba dispar
EETIETR

SEQ ID NO: 2419894 - protein, 16 aa, Entamoeba dispar
EETIKEEKKKEKGKIE

SEQ ID NO: 2419895 - protein, 9 aa, Entamoeba dispar
EETKEEREK

SEQ ID NO: 2419896 - protein, 6 aa, Entamoeba dispar
EETKEI

SEQ ID NO: 2419897 - protein, 6 aa, Entamoeba dispar
EETKGG

SEQ ID NO: 2419898 - protein, 19 aa, Entamoeba dispar
EETKKNNEISTIEQKYSNI

SEQ ID NO: 2419899 - protein, 15 aa, Entamoeba dispar
EETKKSPETNKKEIM

SEQ ID NO: 2419900 - protein, 22 aa, Entamoeba dispar
EETKQEEHISKEETNNQMKEKE

SEQ ID NO: 2419901 - protein, 5 aa, Entamoeba dispar
EETKS

SEQ ID NO: 2419902 - protein, 9 aa, Entamoeba dispar
EETKTRTYD

SEQ ID NO: 2419903 - protein, 15 aa, Entamoeba dispar
EETLIDDSNETKTSV

SEQ ID NO: 2419904 - protein, 10 aa, Entamoeba dispar
EETLKGKGSI

SEQ ID NO: 2419905 - protein, 10 aa, Entamoeba dispar
EETLKGKGSM

SEQ ID NO: 2419906 - protein, 25 aa, Entamoeba dispar
EETLPKKQKRKERKPHNKKEVRSKD

SEQ ID NO: 2419907 - protein, 10 aa, Entamoeba dispar
EETMEDTQSS

SEQ ID NO: 2419908 - protein, 5 aa, Entamoeba dispar
EETMS

SEQ ID NO: 2419909 - protein, 9 aa, Entamoeba dispar
EETNNNNTK

SEQ ID NO: 2419910 - protein, 14 aa, Entamoeba dispar
EETNQDTPLHKTKY

SEQ ID NO: 2419911 - protein, 11 aa, Entamoeba dispar
EETNQQNPNII

SEQ ID NO: 2419912 - protein, 5 aa, Entamoeba dispar
EETNV

SEQ ID NO: 2419913 - protein, 10 aa, Entamoeba dispar
EETPDSEDIL

SEQ ID NO: 2419914 - protein, 5 aa, Entamoeba dispar
EETPH

SEQ ID NO: 2419915 - protein, 22 aa, Entamoeba dispar
EETPKTKIKTEKKKKEIDEDDL

SEQ ID NO: 2419916 - protein, 9 aa, Entamoeba dispar
EETRGKLDA

SEQ ID NO: 2419917 - protein, 7 aa, Entamoeba dispar
EETRNSD

SEQ ID NO: 2419918 - protein, 9 aa, Entamoeba dispar
EETRQITRK

SEQ ID NO: 2419919 - protein, 9 aa, Entamoeba dispar
EETRRKKRK

SEQ ID NO: 2419920 - protein, 10 aa, Entamoeba dispar
EETRSGNIQG

SEQ ID NO: 2419921 - protein, 9 aa, Entamoeba dispar
EETSAEEKV

SEQ ID NO: 2419922 - protein, 8 aa, Entamoeba dispar
EETSDEQQ

SEQ ID NO: 2419923 - protein, 7 aa, Entamoeba dispar
EETSDMK

SEQ ID NO: 2419924 - protein, 6 aa, Entamoeba dispar
EETSEI

SEQ ID NO: 2419925 - protein, 5 aa, Entamoeba dispar
EETSM

SEQ ID NO: 2419926 - protein, 12 aa, Entamoeba dispar
EETSNDDGSSIR

SEQ ID NO: 2419927 - protein, 5 aa, Entamoeba dispar
EETTA

SEQ ID NO: 2419928 - protein, 7 aa, Entamoeba dispar
EETTEEI

SEQ ID NO: 2419929 - protein, 8 aa, Entamoeba dispar
EETTGDSN

SEQ ID NO: 2419930 - protein, 12 aa, Entamoeba dispar
EETTKKIGKQTI

SEQ ID NO: 2419931 - protein, 5 aa, Entamoeba dispar
EETTN

SEQ ID NO: 2419932 - protein, 8 aa, Entamoeba dispar
EETTQSIL

SEQ ID NO: 2419933 - protein, 5 aa, Entamoeba dispar
EETTT

SEQ ID NO: 2419934 - protein, 6 aa, Entamoeba dispar
EETTYK

SEQ ID NO: 2419935 - protein, 4 aa, Entamoeba dispar
EETV

SEQ ID NO: 2419936 - protein, 73 aa, Entamoeba dispar
EEVDASDDNRVKKKEYQSEEERYSNFSDRYGDDEDDFNEKNDKTVSEESEDEEKKEAKSRKRLSSSSQPAPRK

SEQ ID NO: 2419937 - protein, 5 aa, Entamoeba dispar
EEVDS

SEQ ID NO: 2419938 - protein, 12 aa, Entamoeba dispar
EEVDSDEEENSN

SEQ ID NO: 2419939 - protein, 9 aa, Entamoeba dispar
EEVDSTAFS

SEQ ID NO: 2419940 - protein, 8 aa, Entamoeba dispar
EEVEEGDL

SEQ ID NO: 2419941 - protein, 7 aa, Entamoeba dispar
EEVEENS

SEQ ID NO: 2419942 - protein, 10 aa, Entamoeba dispar
EEVEGTKQEE

SEQ ID NO: 2419943 - protein, 12 aa, Entamoeba dispar
EEVEKEAKEQAE

SEQ ID NO: 2419944 - protein, 7 aa, Entamoeba dispar
EEVEPFP

SEQ ID NO: 2419945 - protein, 9 aa, Entamoeba dispar
EEVESGKYY

SEQ ID NO: 2419946 - protein, 11 aa, Entamoeba dispar
EEVGKGNELAN

SEQ ID NO: 2419947 - protein, 5 aa, Entamoeba dispar
EEVGN

SEQ ID NO: 2419948 - protein, 4 aa, Entamoeba dispar
EEVK

SEQ ID NO: 2419949 - protein, 57 aa, Entamoeba dispar
EEVKEEPKAPAQAETEKKEEPKKMEEEKPKEPAKAEEEKKEESKKMEEEKPKEEKKV

SEQ ID NO: 2419950 - protein, 127 aa, Entamoeba dispar
EEVKEEVEEVEKKEKKEKKDKKEKKEKKDKKEKKEKKHKKDKKDKKEKKEHKHHHHSKKEEEHEEEEKKEEEKKDESKMEEEQSEEEKKDESKMEEEKEENNEEEKEEEKEENNEEEEKKDNETKEF

SEQ ID NO: 2419951 - protein, 16 aa, Entamoeba dispar
EEVKKDDGRKPSKKDY

SEQ ID NO: 2419952 - protein, 13 aa, Entamoeba dispar
EEVKKKAKEVDNN

SEQ ID NO: 2419953 - protein, 9 aa, Entamoeba dispar
EEVKNGKKV

SEQ ID NO: 2419954 - protein, 12 aa, Entamoeba dispar
EEVKQKEKKGLL

SEQ ID NO: 2419955 - protein, 4 aa, Entamoeba dispar
EEVN

SEQ ID NO: 2419956 - protein, 4 aa, Entamoeba dispar
EEVP

SEQ ID NO: 2419957 - protein, 4 aa, Entamoeba dispar
EEVQ

SEQ ID NO: 2419958 - protein, 8 aa, Entamoeba dispar
EEVQGERH

SEQ ID NO: 2419959 - protein, 14 aa, Entamoeba dispar
EEVQRDENQAMEED

SEQ ID NO: 2419960 - protein, 10 aa, Entamoeba dispar
EEVSEDMGDV

SEQ ID NO: 2419961 - protein, 10 aa, Entamoeba dispar
EEVSKEHPVE

SEQ ID NO: 2419962 - protein, 4 aa, Entamoeba dispar
EEVT

SEQ ID NO: 2419963 - protein, 8 aa, Entamoeba dispar
EEVTGTPS

SEQ ID NO: 2419964 - protein, 5 aa, Entamoeba dispar
EEVTK

SEQ ID NO: 2419965 - protein, 14 aa, Entamoeba dispar
EEVTKDSEETRFDQ

SEQ ID NO: 2419966 - protein, 25 aa, Entamoeba dispar
EEVYEETKQDDTPKKSTGNNVEDFI

SEQ ID NO: 2419967 - protein, 7 aa, Entamoeba dispar
EEWSGYS

SEQ ID NO: 2419968 - protein, 4 aa, Entamoeba dispar
EEWT

SEQ ID NO: 2419969 - protein, 4 aa, Entamoeba dispar
EEWV

SEQ ID NO: 2419970 - protein, 10 aa, Entamoeba dispar
EEYAKYSNGI

SEQ ID NO: 2419971 - protein, 6 aa, Entamoeba dispar
EEYDND

SEQ ID NO: 2419972 - protein, 41 aa, Entamoeba dispar
EEYEEEGNDEKQESTIKEETNQNKSKSKEENEEKSKGTTST

SEQ ID NO: 2419973 - protein, 6 aa, Entamoeba dispar
EEYEEL

SEQ ID NO: 2419974 - protein, 12 aa, Entamoeba dispar
EEYEGGERKEFG

SEQ ID NO: 2419975 - protein, 9 aa, Entamoeba dispar
EEYENSGMK

SEQ ID NO: 2419976 - protein, 8 aa, Entamoeba dispar
EEYGEKIE

SEQ ID NO: 2419977 - protein, 6 aa, Entamoeba dispar
EEYGKG

SEQ ID NO: 2419978 - protein, 14 aa, Entamoeba dispar
EEYGTRTTLTPLNT

SEQ ID NO: 2419979 - protein, 18 aa, Entamoeba dispar
EEYHKKQQEISEKKEKIK

SEQ ID NO: 2419980 - protein, 6 aa, Entamoeba dispar
EEYHTN

SEQ ID NO: 2419981 - protein, 7 aa, Entamoeba dispar
EEYKETM

SEQ ID NO: 2419982 - protein, 9 aa, Entamoeba dispar
EEYLEYSSE

SEQ ID NO: 2419983 - protein, 14 aa, Entamoeba dispar
EEYNEEDEAEESNY

SEQ ID NO: 2419984 - protein, 6 aa, Entamoeba dispar
EEYNEK

SEQ ID NO: 2419985 - protein, 21 aa, Entamoeba dispar
EEYNKTKVTKATNLIVPLDNL

SEQ ID NO: 2419986 - protein, 9 aa, Entamoeba dispar
EEYNPRIDP

SEQ ID NO: 2419987 - protein, 8 aa, Entamoeba dispar
EEYNRKVK

SEQ ID NO: 2419988 - protein, 7 aa, Entamoeba dispar
EEYPTTG

SEQ ID NO: 2419989 - protein, 5 aa, Entamoeba dispar
EEYQE

SEQ ID NO: 2419990 - protein, 6 aa, Entamoeba dispar
EEYQEA

SEQ ID NO: 2419991 - protein, 12 aa, Entamoeba dispar
EEYQKTKTKAIE

SEQ ID NO: 2419992 - protein, 12 aa, Entamoeba dispar
EEYQQTEQENTV

SEQ ID NO: 2419993 - protein, 10 aa, Entamoeba dispar
EEYSEYSSER

SEQ ID NO: 2419994 - protein, 9 aa, Entamoeba dispar
EEYSEYSTE

SEQ ID NO: 2419995 - protein, 23 aa, Entamoeba dispar
EEYSVEERKARDLRHTFSNFDTI

SEQ ID NO: 2419996 - protein, 8 aa, Entamoeba dispar
EEYTNKDD

SEQ ID NO: 2419997 - protein, 8 aa, Entamoeba dispar
EEYTSSNR

SEQ ID NO: 2419998 - protein, 8 aa, Entamoeba dispar
EEYYNSGV

SEQ ID NO: 2419999 - protein, 13 aa, Entamoeba dispar
EFADITEEGVWLG

SEQ ID NO: 2420000 - protein, 5 aa, Entamoeba dispar
EFAEE

SEQ ID NO: 2420001 - protein, 13 aa, Entamoeba dispar
EFAEQTKATIGVG

SEQ ID NO: 2420002 - protein, 11 aa, Entamoeba dispar
EFAKKEEEQLE

SEQ ID NO: 2420003 - protein, 6 aa, Entamoeba dispar
EFAPKS

SEQ ID NO: 2420004 - protein, 7 aa, Entamoeba dispar
EFARYSK

SEQ ID NO: 2420005 - protein, 10 aa, Entamoeba dispar
EFASEKIGES

SEQ ID NO: 2420006 - protein, 13 aa, Entamoeba dispar
EFATKERKPIPGS

SEQ ID NO: 2420007 - protein, 5 aa, Entamoeba dispar
EFATT

SEQ ID NO: 2420008 - protein, 11 aa, Entamoeba dispar
EFDAEKRSTIG

SEQ ID NO: 2420009 - protein, 16 aa, Entamoeba dispar
EFDDGDENESVNEGEM

SEQ ID NO: 2420010 - protein, 10 aa, Entamoeba dispar
EFDNKRTEML

SEQ ID NO: 2420011 - protein, 11 aa, Entamoeba dispar
EFDPDKRSTIG

SEQ ID NO: 2420012 - protein, 12 aa, Entamoeba dispar
EFDPEKKSTIGV

SEQ ID NO: 2420013 - protein, 12 aa, Entamoeba dispar
EFDPENHADGCS

SEQ ID NO: 2420014 - protein, 11 aa, Entamoeba dispar
EFDTNDAVPGS

SEQ ID NO: 2420015 - protein, 11 aa, Entamoeba dispar
EFEDGKKQKRY

SEQ ID NO: 2420016 - protein, 14 aa, Entamoeba dispar
EFEDNESKNISDEV

SEQ ID NO: 2420017 - protein, 13 aa, Entamoeba dispar
EFEEAGKEDTPDA

SEQ ID NO: 2420018 - protein, 29 aa, Entamoeba dispar
EFEEESQQEIEQIQKEENSKNTDLSQEKM

SEQ ID NO: 2420019 - protein, 8 aa, Entamoeba dispar
EFEEETKK

SEQ ID NO: 2420020 - protein, 13 aa, Entamoeba dispar
EFEEGNNDENFDS

SEQ ID NO: 2420021 - protein, 8 aa, Entamoeba dispar
EFEENEDP

SEQ ID NO: 2420022 - protein, 17 aa, Entamoeba dispar
EFEENEGESLEKSLNED

SEQ ID NO: 2420023 - protein, 28 aa, Entamoeba dispar
EFEENRKHEAQKKTEELMKEQKEADEIK

SEQ ID NO: 2420024 - protein, 11 aa, Entamoeba dispar
EFEEQCKKDGL

SEQ ID NO: 2420025 - protein, 9 aa, Entamoeba dispar
EFEGKETEA

SEQ ID NO: 2420026 - protein, 13 aa, Entamoeba dispar
EFEIEKEKSKTFE

SEQ ID NO: 2420027 - protein, 4 aa, Entamoeba dispar
EFEK

SEQ ID NO: 2420028 - protein, 41 aa, Entamoeba dispar
EFEKQTGISADPFYTTDSLRNGNEDDSQQSQYTDYQTDITG

SEQ ID NO: 2420029 - protein, 4 aa, Entamoeba dispar
EFEP

SEQ ID NO: 2420030 - protein, 7 aa, Entamoeba dispar
EFEPTKE

SEQ ID NO: 2420031 - protein, 6 aa, Entamoeba dispar
EFEQTK

SEQ ID NO: 2420032 - protein, 10 aa, Entamoeba dispar
EFERKTKVPG

SEQ ID NO: 2420033 - protein, 10 aa, Entamoeba dispar
EFGAKAANQE

SEQ ID NO: 2420034 - protein, 4 aa, Entamoeba dispar
EFGG

SEQ ID NO: 2420035 - protein, 19 aa, Entamoeba dispar
EFGGSQGSKTTTIFFKKII

SEQ ID NO: 2420036 - protein, 4 aa, Entamoeba dispar
EFGK

SEQ ID NO: 2420037 - protein, 6 aa, Entamoeba dispar
EFGQKN

SEQ ID NO: 2420038 - protein, 8 aa, Entamoeba dispar
EFGQSDSC

SEQ ID NO: 2420039 - protein, 7 aa, Entamoeba dispar
EFGQTPA

SEQ ID NO: 2420040 - protein, 5 aa, Entamoeba dispar
EFGSP

SEQ ID NO: 2420041 - protein, 4 aa, Entamoeba dispar
EFGT

SEQ ID NO: 2420042 - protein, 8 aa, Entamoeba dispar
EFGTEEVE

SEQ ID NO: 2420043 - protein, 26 aa, Entamoeba dispar
EFHSQQTITKVKGESLHYPKAQTIST

SEQ ID NO: 2420044 - protein, 19 aa, Entamoeba dispar
EFIGDSSKQQQRRNRSMAW

SEQ ID NO: 2420045 - protein, 9 aa, Entamoeba dispar
EFKDTAADK

SEQ ID NO: 2420046 - protein, 18 aa, Entamoeba dispar
EFKKEESTSIEGKEITRK

SEQ ID NO: 2420047 - protein, 17 aa, Entamoeba dispar
EFKNADKPETRSKLGPL

SEQ ID NO: 2420048 - protein, 6 aa, Entamoeba dispar
EFKQKV

SEQ ID NO: 2420049 - protein, 5 aa, Entamoeba dispar
EFKQS

SEQ ID NO: 2420050 - protein, 13 aa, Entamoeba dispar
EFKQTENGVSELS

SEQ ID NO: 2420051 - protein, 7 aa, Entamoeba dispar
EFNDSEL

SEQ ID NO: 2420052 - protein, 6 aa, Entamoeba dispar
EFNENS

SEQ ID NO: 2420053 - protein, 10 aa, Entamoeba dispar
EFNEQEKKEF

SEQ ID NO: 2420054 - protein, 8 aa, Entamoeba dispar
EFNGPSED

SEQ ID NO: 2420055 - protein, 5 aa, Entamoeba dispar
EFNKE

SEQ ID NO: 2420056 - protein, 10 aa, Entamoeba dispar
EFNKETSPTV

SEQ ID NO: 2420057 - protein, 5 aa, Entamoeba dispar
EFNKT

SEQ ID NO: 2420058 - protein, 10 aa, Entamoeba dispar
EFNPNTASSI

SEQ ID NO: 2420059 - protein, 7 aa, Entamoeba dispar
EFNQETL

SEQ ID NO: 2420060 - protein, 19 aa, Entamoeba dispar
EFNSLSSNGFSSQSSNDFP

SEQ ID NO: 2420061 - protein, 5 aa, Entamoeba dispar
EFPEE

SEQ ID NO: 2420062 - protein, 5 aa, Entamoeba dispar
EFPEN

SEQ ID NO: 2420063 - protein, 7 aa, Entamoeba dispar
EFPKKGP

SEQ ID NO: 2420064 - protein, 9 aa, Entamoeba dispar
EFPKTKPNQ

SEQ ID NO: 2420065 - protein, 9 aa, Entamoeba dispar
EFPNEKKNI

SEQ ID NO: 2420066 - protein, 5 aa, Entamoeba dispar
EFPNN

SEQ ID NO: 2420067 - protein, 9 aa, Entamoeba dispar
EFPPSPKSK

SEQ ID NO: 2420068 - protein, 6 aa, Entamoeba dispar
EFQENP

SEQ ID NO: 2420069 - protein, 14 aa, Entamoeba dispar
EFQQPKKKGDARIT

SEQ ID NO: 2420070 - protein, 8 aa, Entamoeba dispar
EFREESGI

SEQ ID NO: 2420071 - protein, 14 aa, Entamoeba dispar
EFREKDSKEAREYE

SEQ ID NO: 2420072 - protein, 12 aa, Entamoeba dispar
EFRKDDPSSFNL

SEQ ID NO: 2420073 - protein, 10 aa, Entamoeba dispar
EFRPKPVDDD

SEQ ID NO: 2420074 - protein, 5 aa, Entamoeba dispar
EFRPR

SEQ ID NO: 2420075 - protein, 13 aa, Entamoeba dispar
EFSDGKTKAFGRS

SEQ ID NO: 2420076 - protein, 8 aa, Entamoeba dispar
EFSEKANT

SEQ ID NO: 2420077 - protein, 6 aa, Entamoeba dispar
EFSEKQ

SEQ ID NO: 2420078 - protein, 7 aa, Entamoeba dispar
EFSETKM

SEQ ID NO: 2420079 - protein, 5 aa, Entamoeba dispar
EFSPG

SEQ ID NO: 2420080 - protein, 6 aa, Entamoeba dispar
EFSPYD

SEQ ID NO: 2420081 - protein, 5 aa, Entamoeba dispar
EFSQE

SEQ ID NO: 2420082 - protein, 22 aa, Entamoeba dispar
EFSQRQNEYSRRVPNEQVGNEY

SEQ ID NO: 2420083 - protein, 10 aa, Entamoeba dispar
EFSSQRTSSD

SEQ ID NO: 2420084 - protein, 8 aa, Entamoeba dispar
EFTASGLT

SEQ ID NO: 2420085 - protein, 12 aa, Entamoeba dispar
EFTDDTSDSVDA

SEQ ID NO: 2420086 - protein, 20 aa, Entamoeba dispar
EFTGETKPSRSNKVGTGSTC

SEQ ID NO: 2420087 - protein, 8 aa, Entamoeba dispar
EFTGGSSI

SEQ ID NO: 2420088 - protein, 7 aa, Entamoeba dispar
EFTKTPS

SEQ ID NO: 2420089 - protein, 5 aa, Entamoeba dispar
EFTNN

SEQ ID NO: 2420090 - protein, 4 aa, Entamoeba dispar
EFTS

SEQ ID NO: 2420091 - protein, 5 aa, Entamoeba dispar
EFTSD

SEQ ID NO: 2420092 - protein, 9 aa, Entamoeba dispar
EFYEKRDQS

SEQ ID NO: 2420093 - protein, 12 aa, Entamoeba dispar
EGAEGSVNNFPG

SEQ ID NO: 2420094 - protein, 9 aa, Entamoeba dispar
EGAITATNE

SEQ ID NO: 2420095 - protein, 13 aa, Entamoeba dispar
EGAKQKRSSTLLT

SEQ ID NO: 2420096 - protein, 7 aa, Entamoeba dispar
EGAKTIG

SEQ ID NO: 2420097 - protein, 14 aa, Entamoeba dispar
EGALQNNTKNLGIN

SEQ ID NO: 2420098 - protein, 28 aa, Entamoeba dispar
EGALQQEIKENKEKNQKLQDEKEEFRKV

SEQ ID NO: 2420099 - protein, 5 aa, Entamoeba dispar
EGAPN

SEQ ID NO: 2420100 - protein, 7 aa, Entamoeba dispar
EGCENGT

SEQ ID NO: 2420101 - protein, 5 aa, Entamoeba dispar
EGCNE

SEQ ID NO: 2420102 - protein, 16 aa, Entamoeba dispar
EGCNIPEAENVRTEDT

SEQ ID NO: 2420103 - protein, 7 aa, Entamoeba dispar
EGCTSRP

SEQ ID NO: 2420104 - protein, 4 aa, Entamoeba dispar
EGDD

SEQ ID NO: 2420105 - protein, 18 aa, Entamoeba dispar
EGDDINKTHQNNEIEEYQ

SEQ ID NO: 2420106 - protein, 9 aa, Entamoeba dispar
EGDDSSYES

SEQ ID NO: 2420107 - protein, 4 aa, Entamoeba dispar
EGDE

SEQ ID NO: 2420108 - protein, 9 aa, Entamoeba dispar
EGDEDRQSI

SEQ ID NO: 2420109 - protein, 7 aa, Entamoeba dispar
EGDEVKR

SEQ ID NO: 2420110 - protein, 4 aa, Entamoeba dispar
EGDI

SEQ ID NO: 2420111 - protein, 5 aa, Entamoeba dispar
EGDIT

SEQ ID NO: 2420112 - protein, 11 aa, Entamoeba dispar
EGDKAVKEYTK

SEQ ID NO: 2420113 - protein, 12 aa, Entamoeba dispar
EGDLSNEKTEYN

SEQ ID NO: 2420114 - protein, 5 aa, Entamoeba dispar
EGDMR

SEQ ID NO: 2420115 - protein, 8 aa, Entamoeba dispar
EGDNRPDA

SEQ ID NO: 2420116 - protein, 6 aa, Entamoeba dispar
EGDPPY

SEQ ID NO: 2420117 - protein, 7 aa, Entamoeba dispar
EGDPPYM

SEQ ID NO: 2420118 - protein, 15 aa, Entamoeba dispar
EGDPQRKHGRKPHDD

SEQ ID NO: 2420119 - protein, 11 aa, Entamoeba dispar
EGDQESTAPID

SEQ ID NO: 2420120 - protein, 7 aa, Entamoeba dispar
EGDQKTS

SEQ ID NO: 2420121 - protein, 4 aa, Entamoeba dispar
EGDS

SEQ ID NO: 2420122 - protein, 9 aa, Entamoeba dispar
EGDSAKTLA

SEQ ID NO: 2420123 - protein, 12 aa, Entamoeba dispar
EGDSENYNRPSK

SEQ ID NO: 2420124 - protein, 9 aa, Entamoeba dispar
EGDSIKSYK

SEQ ID NO: 2420125 - protein, 9 aa, Entamoeba dispar
EGDYPDGQE

SEQ ID NO: 2420126 - protein, 6 aa, Entamoeba dispar
EGEELN

SEQ ID NO: 2420127 - protein, 14 aa, Entamoeba dispar
EGEEQAEKVEKEWN

SEQ ID NO: 2420128 - protein, 7 aa, Entamoeba dispar
EGEFNES

SEQ ID NO: 2420129 - protein, 5 aa, Entamoeba dispar
EGEGI

SEQ ID NO: 2420130 - protein, 15 aa, Entamoeba dispar
EGEGQIEDDNIQNNK

SEQ ID NO: 2420131 - protein, 6 aa, Entamoeba dispar
EGEHPD

SEQ ID NO: 2420132 - protein, 6 aa, Entamoeba dispar
EGEINE

SEQ ID NO: 2420133 - protein, 8 aa, Entamoeba dispar
EGEKEADA

SEQ ID NO: 2420134 - protein, 9 aa, Entamoeba dispar
EGEKEGVTS

SEQ ID NO: 2420135 - protein, 5 aa, Entamoeba dispar
EGEKG

SEQ ID NO: 2420136 - protein, 7 aa, Entamoeba dispar
EGEKKQL

SEQ ID NO: 2420137 - protein, 10 aa, Entamoeba dispar
EGEKPSEVKY

SEQ ID NO: 2420138 - protein, 8 aa, Entamoeba dispar
EGEKSKNI

SEQ ID NO: 2420139 - protein, 11 aa, Entamoeba dispar
EGEKTSNEGEL

SEQ ID NO: 2420140 - protein, 7 aa, Entamoeba dispar
EGELTSE

SEQ ID NO: 2420141 - protein, 8 aa, Entamoeba dispar
EGENDGNR

SEQ ID NO: 2420142 - protein, 9 aa, Entamoeba dispar
EGENKTYKF

SEQ ID NO: 2420143 - protein, 8 aa, Entamoeba dispar
EGENNEWK

SEQ ID NO: 2420144 - protein, 4 aa, Entamoeba dispar
EGES

SEQ ID NO: 2420145 - protein, 4 aa, Entamoeba dispar
EGET

SEQ ID NO: 2420146 - protein, 16 aa, Entamoeba dispar
EGETGACGVRKNTNGN

SEQ ID NO: 2420147 - protein, 10 aa, Entamoeba dispar
EGETNPPGIT

SEQ ID NO: 2420148 - protein, 15 aa, Entamoeba dispar
EGETTETTEGFNRYA

SEQ ID NO: 2420149 - protein, 8 aa, Entamoeba dispar
EGETTSVE

SEQ ID NO: 2420150 - protein, 4 aa, Entamoeba dispar
EGEV

SEQ ID NO: 2420151 - protein, 4 aa, Entamoeba dispar
EGEY

SEQ ID NO: 2420152 - protein, 19 aa, Entamoeba dispar
EGEYKSLNRSGMDHNPSPF

SEQ ID NO: 2420153 - protein, 6 aa, Entamoeba dispar
EGEYNY

SEQ ID NO: 2420154 - protein, 18 aa, Entamoeba dispar
EGFDPKRRLGQAHGAGEY

SEQ ID NO: 2420155 - protein, 11 aa, Entamoeba dispar
EGFKPQQKAEM

SEQ ID NO: 2420156 - protein, 8 aa, Entamoeba dispar
EGFSTEDD

SEQ ID NO: 2420157 - protein, 7 aa, Entamoeba dispar
EGGAKEI

SEQ ID NO: 2420158 - protein, 16 aa, Entamoeba dispar
EGGAQEKQSQTNKEIE

SEQ ID NO: 2420159 - protein, 26 aa, Entamoeba dispar
EGGEDEINEEEEKNNNQEMSEEQNYD

SEQ ID NO: 2420160 - protein, 4 aa, Entamoeba dispar
EGGF

SEQ ID NO: 2420161 - protein, 5 aa, Entamoeba dispar
EGGFD

SEQ ID NO: 2420162 - protein, 8 aa, Entamoeba dispar
EGGKQGKY

SEQ ID NO: 2420163 - protein, 5 aa, Entamoeba dispar
EGGNS

SEQ ID NO: 2420164 - protein, 6 aa, Entamoeba dispar
EGGNTV

SEQ ID NO: 2420165 - protein, 21 aa, Entamoeba dispar
EGGPILTNKKEELIDEEDESF

SEQ ID NO: 2420166 - protein, 4 aa, Entamoeba dispar
EGGS

SEQ ID NO: 2420167 - protein, 8 aa, Entamoeba dispar
EGGSGGAL

SEQ ID NO: 2420168 - protein, 7 aa, Entamoeba dispar
EGGSLRN

SEQ ID NO: 2420169 - protein, 5 aa, Entamoeba dispar
EGGTL

SEQ ID NO: 2420170 - protein, 6 aa, Entamoeba dispar
EGGTTY

SEQ ID NO: 2420171 - protein, 6 aa, Entamoeba dispar
EGHAAL

SEQ ID NO: 2420172 - protein, 6 aa, Entamoeba dispar
EGHESE

SEQ ID NO: 2420173 - protein, 8 aa, Entamoeba dispar
EGHQDDKT

SEQ ID NO: 2420174 - protein, 9 aa, Entamoeba dispar
EGHSAACKQ

SEQ ID NO: 2420175 - protein, 10 aa, Entamoeba dispar
EGHSGGRTAR

SEQ ID NO: 2420176 - protein, 12 aa, Entamoeba dispar
EGIAEESGDIIP

SEQ ID NO: 2420177 - protein, 6 aa, Entamoeba dispar
EGIASS

SEQ ID NO: 2420178 - protein, 5 aa, Entamoeba dispar
EGIDP

SEQ ID NO: 2420179 - protein, 4 aa, Entamoeba dispar
EGIE

SEQ ID NO: 2420180 - protein, 6 aa, Entamoeba dispar
EGIEAN

SEQ ID NO: 2420181 - protein, 4 aa, Entamoeba dispar
EGII

SEQ ID NO: 2420182 - protein, 6 aa, Entamoeba dispar
EGIKEA

SEQ ID NO: 2420183 - protein, 11 aa, Entamoeba dispar
EGIKEDNDYAP

SEQ ID NO: 2420184 - protein, 6 aa, Entamoeba dispar
EGINEE

SEQ ID NO: 2420185 - protein, 16 aa, Entamoeba dispar
EGIPEPKNSKSSKEFK

SEQ ID NO: 2420186 - protein, 13 aa, Entamoeba dispar
EGIPGSPEKPLSD

SEQ ID NO: 2420187 - protein, 4 aa, Entamoeba dispar
EGIQ

SEQ ID NO: 2420188 - protein, 5 aa, Entamoeba dispar
EGIQK

SEQ ID NO: 2420189 - protein, 5 aa, Entamoeba dispar
EGIQQ

SEQ ID NO: 2420190 - protein, 19 aa, Entamoeba dispar
EGIRSSSTSVINENEQCGS

SEQ ID NO: 2420191 - protein, 4 aa, Entamoeba dispar
EGIS

SEQ ID NO: 2420192 - protein, 12 aa, Entamoeba dispar
EGISGLKGKQAK

SEQ ID NO: 2420193 - protein, 5 aa, Entamoeba dispar
EGISK

SEQ ID NO: 2420194 - protein, 10 aa, Entamoeba dispar
EGISKYSSGR

SEQ ID NO: 2420195 - protein, 12 aa, Entamoeba dispar
EGKAKPIVTSPR

SEQ ID NO: 2420196 - protein, 11 aa, Entamoeba dispar
EGKDIKKKGSE

SEQ ID NO: 2420197 - protein, 5 aa, Entamoeba dispar
EGKDY

SEQ ID NO: 2420198 - protein, 12 aa, Entamoeba dispar
EGKEEIGKKRGD

SEQ ID NO: 2420199 - protein, 9 aa, Entamoeba dispar
EGKEFKEEG

SEQ ID NO: 2420200 - protein, 11 aa, Entamoeba dispar
EGKEISKSSLE

SEQ ID NO: 2420201 - protein, 25 aa, Entamoeba dispar
EGKELQEPKKSDKNKTTSFKTPDEI

SEQ ID NO: 2420202 - protein, 7 aa, Entamoeba dispar
EGKEPEA

SEQ ID NO: 2420203 - protein, 20 aa, Entamoeba dispar
EGKEVTEINEEEVQKRVEEE

SEQ ID NO: 2420204 - protein, 4 aa, Entamoeba dispar
EGKF

SEQ ID NO: 2420205 - protein, 9 aa, Entamoeba dispar
EGKGGRAMN

SEQ ID NO: 2420206 - protein, 9 aa, Entamoeba dispar
EGKGKGIDV

SEQ ID NO: 2420207 - protein, 7 aa, Entamoeba dispar
EGKGNGI

SEQ ID NO: 2420208 - protein, 5 aa, Entamoeba dispar
EGKGT

SEQ ID NO: 2420209 - protein, 4 aa, Entamoeba dispar
EGKH

SEQ ID NO: 2420210 - protein, 8 aa, Entamoeba dispar
EGKIGGTC

SEQ ID NO: 2420211 - protein, 11 aa, Entamoeba dispar
EGKKGENKYRI

SEQ ID NO: 2420212 - protein, 8 aa, Entamoeba dispar
EGKKGMAR

SEQ ID NO: 2420213 - protein, 7 aa, Entamoeba dispar
EGKKISP

SEQ ID NO: 2420214 - protein, 10 aa, Entamoeba dispar
EGKKKVTQDD

SEQ ID NO: 2420215 - protein, 7 aa, Entamoeba dispar
EGKKLKT

SEQ ID NO: 2420216 - protein, 9 aa, Entamoeba dispar
EGKKPVRDT

SEQ ID NO: 2420217 - protein, 4 aa, Entamoeba dispar
EGKL

SEQ ID NO: 2420218 - protein, 5 aa, Entamoeba dispar
EGKLG

SEQ ID NO: 2420219 - protein, 9 aa, Entamoeba dispar
EGKLKEENI

SEQ ID NO: 2420220 - protein, 9 aa, Entamoeba dispar
EGKLKTKIR

SEQ ID NO: 2420221 - protein, 8 aa, Entamoeba dispar
EGKLPSVQ

SEQ ID NO: 2420222 - protein, 5 aa, Entamoeba dispar
EGKMP

SEQ ID NO: 2420223 - protein, 5 aa, Entamoeba dispar
EGKMS

SEQ ID NO: 2420224 - protein, 5 aa, Entamoeba dispar
EGKNK

SEQ ID NO: 2420225 - protein, 14 aa, Entamoeba dispar
EGKNKQTTTRRLEK

SEQ ID NO: 2420226 - protein, 12 aa, Entamoeba dispar
EGKNTQKERMEW

SEQ ID NO: 2420227 - protein, 10 aa, Entamoeba dispar
EGKQRTQPNF

SEQ ID NO: 2420228 - protein, 27 aa, Entamoeba dispar
EGKQVQEKIQQERERRIEKIEKRKKQI

SEQ ID NO: 2420229 - protein, 7 aa, Entamoeba dispar
EGKRAGV

SEQ ID NO: 2420230 - protein, 9 aa, Entamoeba dispar
EGKRKGYKK

SEQ ID NO: 2420231 - protein, 4 aa, Entamoeba dispar
EGKS

SEQ ID NO: 2420232 - protein, 10 aa, Entamoeba dispar
EGKSKSEEWK

SEQ ID NO: 2420233 - protein, 7 aa, Entamoeba dispar
EGKSMEQ

SEQ ID NO: 2420234 - protein, 10 aa, Entamoeba dispar
EGKSQINQNE

SEQ ID NO: 2420235 - protein, 7 aa, Entamoeba dispar
EGKTIKE

SEQ ID NO: 2420236 - protein, 8 aa, Entamoeba dispar
EGKTKEQC

SEQ ID NO: 2420237 - protein, 9 aa, Entamoeba dispar
EGKTRSSFE

SEQ ID NO: 2420238 - protein, 7 aa, Entamoeba dispar
EGKTVEE

SEQ ID NO: 2420239 - protein, 11 aa, Entamoeba dispar
EGKTVTEKQRK

SEQ ID NO: 2420240 - protein, 7 aa, Entamoeba dispar
EGKYNTQ

SEQ ID NO: 2420241 - protein, 7 aa, Entamoeba dispar
EGKYPKT

SEQ ID NO: 2420242 - protein, 18 aa, Entamoeba dispar
EGLKKRSEMGMENESATK

SEQ ID NO: 2420243 - protein, 4 aa, Entamoeba dispar
EGLN

SEQ ID NO: 2420244 - protein, 9 aa, Entamoeba dispar
EGLNDTAEN

SEQ ID NO: 2420245 - protein, 11 aa, Entamoeba dispar
EGLNQGSEETE

SEQ ID NO: 2420246 - protein, 7 aa, Entamoeba dispar
EGLPDKN

SEQ ID NO: 2420247 - protein, 10 aa, Entamoeba dispar
EGLPKNQSEI

SEQ ID NO: 2420248 - protein, 10 aa, Entamoeba dispar
EGLPPSHSTP

SEQ ID NO: 2420249 - protein, 4 aa, Entamoeba dispar
EGLT

SEQ ID NO: 2420250 - protein, 8 aa, Entamoeba dispar
EGLTKSMK

SEQ ID NO: 2420251 - protein, 10 aa, Entamoeba dispar
EGLTPTTYTN

SEQ ID NO: 2420252 - protein, 12 aa, Entamoeba dispar
EGMEESEFEEAE

SEQ ID NO: 2420253 - protein, 13 aa, Entamoeba dispar
EGMEESEFSEATA

SEQ ID NO: 2420254 - protein, 7 aa, Entamoeba dispar
EGMEPEE

SEQ ID NO: 2420255 - protein, 15 aa, Entamoeba dispar
EGMKDEFERDKEGNV

SEQ ID NO: 2420256 - protein, 10 aa, Entamoeba dispar
EGMKENGKRF

SEQ ID NO: 2420257 - protein, 4 aa, Entamoeba dispar
EGMN

SEQ ID NO: 2420258 - protein, 7 aa, Entamoeba dispar
EGMTKKM

SEQ ID NO: 2420259 - protein, 8 aa, Entamoeba dispar
EGMTTSIE

SEQ ID NO: 2420260 - protein, 4 aa, Entamoeba dispar
EGMY

SEQ ID NO: 2420261 - protein, 4 aa, Entamoeba dispar
EGNA

SEQ ID NO: 2420262 - protein, 17 aa, Entamoeba dispar
EGNAKIPLPKKSSERLK

SEQ ID NO: 2420263 - protein, 11 aa, Entamoeba dispar
EGNDEEAISKG

SEQ ID NO: 2420264 - protein, 12 aa, Entamoeba dispar
EGNDKSTTSFNQ

SEQ ID NO: 2420265 - protein, 6 aa, Entamoeba dispar
EGNDRQ

SEQ ID NO: 2420266 - protein, 5 aa, Entamoeba dispar
EGNDT

SEQ ID NO: 2420267 - protein, 9 aa, Entamoeba dispar
EGNDTFSVA

SEQ ID NO: 2420268 - protein, 8 aa, Entamoeba dispar
EGNDWDKI

SEQ ID NO: 2420269 - protein, 12 aa, Entamoeba dispar
EGNEDKNENGDV

SEQ ID NO: 2420270 - protein, 7 aa, Entamoeba dispar
EGNEHSV

SEQ ID NO: 2420271 - protein, 6 aa, Entamoeba dispar
EGNEKL

SEQ ID NO: 2420272 - protein, 8 aa, Entamoeba dispar
EGNENGSA

SEQ ID NO: 2420273 - protein, 10 aa, Entamoeba dispar
EGNERTYDKD

SEQ ID NO: 2420274 - protein, 6 aa, Entamoeba dispar
EGNESE

SEQ ID NO: 2420275 - protein, 8 aa, Entamoeba dispar
EGNETNEL

SEQ ID NO: 2420276 - protein, 7 aa, Entamoeba dispar
EGNITTD

SEQ ID NO: 2420277 - protein, 17 aa, Entamoeba dispar
EGNKQTQFKLSTNKSSK

SEQ ID NO: 2420278 - protein, 9 aa, Entamoeba dispar
EGNKREAQV

SEQ ID NO: 2420279 - protein, 16 aa, Entamoeba dispar
EGNLTPPNLGSGKSGS

SEQ ID NO: 2420280 - protein, 7 aa, Entamoeba dispar
EGNNEGI

SEQ ID NO: 2420281 - protein, 5 aa, Entamoeba dispar
EGNNP

SEQ ID NO: 2420282 - protein, 8 aa, Entamoeba dispar
EGNNRNEA

SEQ ID NO: 2420283 - protein, 8 aa, Entamoeba dispar
EGNPPYKE

SEQ ID NO: 2420284 - protein, 29 aa, Entamoeba dispar
EGNQNNEPSSEQTNQSQVENKTDKINQEQ

SEQ ID NO: 2420285 - protein, 4 aa, Entamoeba dispar
EGNT

SEQ ID NO: 2420286 - protein, 7 aa, Entamoeba dispar
EGNTSYI

SEQ ID NO: 2420287 - protein, 5 aa, Entamoeba dispar
EGNTV

SEQ ID NO: 2420288 - protein, 5 aa, Entamoeba dispar
EGNVN

SEQ ID NO: 2420289 - protein, 20 aa, Entamoeba dispar
EGNYPIVPKPQQIQQPNITQ

SEQ ID NO: 2420290 - protein, 8 aa, Entamoeba dispar
EGNYSDDT

SEQ ID NO: 2420291 - protein, 4 aa, Entamoeba dispar
EGPC

SEQ ID NO: 2420292 - protein, 10 aa, Entamoeba dispar
EGPGVEGGCK

SEQ ID NO: 2420293 - protein, 6 aa, Entamoeba dispar
EGPKCK

SEQ ID NO: 2420294 - protein, 7 aa, Entamoeba dispar
EGPKSKK

SEQ ID NO: 2420295 - protein, 9 aa, Entamoeba dispar
EGPPTLNPE

SEQ ID NO: 2420296 - protein, 5 aa, Entamoeba dispar
EGPSP

SEQ ID NO: 2420297 - protein, 13 aa, Entamoeba dispar
EGPYKGYQGTIRN

SEQ ID NO: 2420298 - protein, 14 aa, Entamoeba dispar
EGPYREGTSDELKR

SEQ ID NO: 2420299 - protein, 8 aa, Entamoeba dispar
EGQDPHKI

SEQ ID NO: 2420300 - protein, 13 aa, Entamoeba dispar
EGQERKKEEVEEL

SEQ ID NO: 2420301 - protein, 9 aa, Entamoeba dispar
EGQKIKPTE

SEQ ID NO: 2420302 - protein, 4 aa, Entamoeba dispar
EGQL

SEQ ID NO: 2420303 - protein, 27 aa, Entamoeba dispar
EGQLPPIEEAEKACEDANIEDNEYTDV

SEQ ID NO: 2420304 - protein, 16 aa, Entamoeba dispar
EGQPHKRVNCGGSSYR

SEQ ID NO: 2420305 - protein, 8 aa, Entamoeba dispar
EGQPHNAE

SEQ ID NO: 2420306 - protein, 7 aa, Entamoeba dispar
EGQQGEF

SEQ ID NO: 2420307 - protein, 5 aa, Entamoeba dispar
EGQTI

SEQ ID NO: 2420308 - protein, 7 aa, Entamoeba dispar
EGRDEEM

SEQ ID NO: 2420309 - protein, 16 aa, Entamoeba dispar
EGRDPKLEQINDPSNP

SEQ ID NO: 2420310 - protein, 6 aa, Entamoeba dispar
EGRIET

SEQ ID NO: 2420311 - protein, 8 aa, Entamoeba dispar
EGRNMTAG

SEQ ID NO: 2420312 - protein, 9 aa, Entamoeba dispar
EGRRKRIPL

SEQ ID NO: 2420313 - protein, 9 aa, Entamoeba dispar
EGRSPNDVK

SEQ ID NO: 2420314 - protein, 4 aa, Entamoeba dispar
EGRT

SEQ ID NO: 2420315 - protein, 8 aa, Entamoeba dispar
EGRTVNQL

SEQ ID NO: 2420316 - protein, 6 aa, Entamoeba dispar
EGRWDT

SEQ ID NO: 2420317 - protein, 13 aa, Entamoeba dispar
EGSAREVKESDEL

SEQ ID NO: 2420318 - protein, 8 aa, Entamoeba dispar
EGSDNITQ

SEQ ID NO: 2420319 - protein, 9 aa, Entamoeba dispar
EGSERANEA

SEQ ID NO: 2420320 - protein, 15 aa, Entamoeba dispar
EGSFNKRSSSPCNNK

SEQ ID NO: 2420321 - protein, 10 aa, Entamoeba dispar
EGSGSIKPKI

SEQ ID NO: 2420322 - protein, 4 aa, Entamoeba dispar
EGSI

SEQ ID NO: 2420323 - protein, 6 aa, Entamoeba dispar
EGSINK

SEQ ID NO: 2420324 - protein, 11 aa, Entamoeba dispar
EGSKKSILKQS

SEQ ID NO: 2420325 - protein, 4 aa, Entamoeba dispar
EGSL

SEQ ID NO: 2420326 - protein, 8 aa, Entamoeba dispar
EGSNIEDS

SEQ ID NO: 2420327 - protein, 6 aa, Entamoeba dispar
EGSNTN

SEQ ID NO: 2420328 - protein, 7 aa, Entamoeba dispar
EGSNVKS

SEQ ID NO: 2420329 - protein, 5 aa, Entamoeba dispar
EGSPA

SEQ ID NO: 2420330 - protein, 8 aa, Entamoeba dispar
EGSPPYRE

SEQ ID NO: 2420331 - protein, 9 aa, Entamoeba dispar
EGSRNGFSY

SEQ ID NO: 2420332 - protein, 4 aa, Entamoeba dispar
EGSS

SEQ ID NO: 2420333 - protein, 9 aa, Entamoeba dispar
EGSSLKKLT

SEQ ID NO: 2420334 - protein, 12 aa, Entamoeba dispar
EGSSSVDDGAID

SEQ ID NO: 2420335 - protein, 6 aa, Entamoeba dispar
EGSSYD

SEQ ID NO: 2420336 - protein, 7 aa, Entamoeba dispar
EGSTEHD

SEQ ID NO: 2420337 - protein, 18 aa, Entamoeba dispar
EGSTENIRHKPDTRALTK

SEQ ID NO: 2420338 - protein, 5 aa, Entamoeba dispar
EGTAD

SEQ ID NO: 2420339 - protein, 4 aa, Entamoeba dispar
EGTE

SEQ ID NO: 2420340 - protein, 7 aa, Entamoeba dispar
EGTFNGC

SEQ ID NO: 2420341 - protein, 7 aa, Entamoeba dispar
EGTFRPE

SEQ ID NO: 2420342 - protein, 5 aa, Entamoeba dispar
EGTGG

SEQ ID NO: 2420343 - protein, 4 aa, Entamoeba dispar
EGTI

SEQ ID NO: 2420344 - protein, 9 aa, Entamoeba dispar
EGTKEELQS

SEQ ID NO: 2420345 - protein, 9 aa, Entamoeba dispar
EGTKHLSGL

SEQ ID NO: 2420346 - protein, 4 aa, Entamoeba dispar
EGTL

SEQ ID NO: 2420347 - protein, 8 aa, Entamoeba dispar
EGTLNNTT

SEQ ID NO: 2420348 - protein, 5 aa, Entamoeba dispar
EGTLQ

SEQ ID NO: 2420349 - protein, 5 aa, Entamoeba dispar
EGTLT

SEQ ID NO: 2420350 - protein, 5 aa, Entamoeba dispar
EGTNL

SEQ ID NO: 2420351 - protein, 8 aa, Entamoeba dispar
EGTNNSIP

SEQ ID NO: 2420352 - protein, 8 aa, Entamoeba dispar
EGTNTFPN

SEQ ID NO: 2420353 - protein, 4 aa, Entamoeba dispar
EGTT

SEQ ID NO: 2420354 - protein, 8 aa, Entamoeba dispar
EGTTDGTI

SEQ ID NO: 2420355 - protein, 5 aa, Entamoeba dispar
EGTTF

SEQ ID NO: 2420356 - protein, 6 aa, Entamoeba dispar
EGTTNM

SEQ ID NO: 2420357 - protein, 7 aa, Entamoeba dispar
EGTVSNE

SEQ ID NO: 2420358 - protein, 4 aa, Entamoeba dispar
EGTY

SEQ ID NO: 2420359 - protein, 5 aa, Entamoeba dispar
EGTYN

SEQ ID NO: 2420360 - protein, 9 aa, Entamoeba dispar
EGTYNTEDG

SEQ ID NO: 2420361 - protein, 7 aa, Entamoeba dispar
EGVGSAY

SEQ ID NO: 2420362 - protein, 9 aa, Entamoeba dispar
EGVNKPRQL

SEQ ID NO: 2420363 - protein, 12 aa, Entamoeba dispar
EGVNNKKEEEQS

SEQ ID NO: 2420364 - protein, 12 aa, Entamoeba dispar
EGVNYNDPPSKV

SEQ ID NO: 2420365 - protein, 30 aa, Entamoeba dispar
EGVPTPNNEVYSESDEQSKSEETSIDGSNA

SEQ ID NO: 2420366 - protein, 21 aa, Entamoeba dispar
EGVQVSDENLSQIASKAHGDV

SEQ ID NO: 2420367 - protein, 14 aa, Entamoeba dispar
EGVRSKAKSQIEES

SEQ ID NO: 2420368 - protein, 4 aa, Entamoeba dispar
EGVS

SEQ ID NO: 2420369 - protein, 4 aa, Entamoeba dispar
EGVT

SEQ ID NO: 2420370 - protein, 5 aa, Entamoeba dispar
EGVTD

SEQ ID NO: 2420371 - protein, 11 aa, Entamoeba dispar
EGWDEDPFRRP

SEQ ID NO: 2420372 - protein, 4 aa, Entamoeba dispar
EGYE

SEQ ID NO: 2420373 - protein, 12 aa, Entamoeba dispar
EGYGKENEEKGH

SEQ ID NO: 2420374 - protein, 14 aa, Entamoeba dispar
EGYGKIDETIEKNL

SEQ ID NO: 2420375 - protein, 10 aa, Entamoeba dispar
EGYIDSNAGE

SEQ ID NO: 2420376 - protein, 7 aa, Entamoeba dispar
EGYKNRR

SEQ ID NO: 2420377 - protein, 4 aa, Entamoeba dispar
EGYL

SEQ ID NO: 2420378 - protein, 7 aa, Entamoeba dispar
EGYNESS

SEQ ID NO: 2420379 - protein, 5 aa, Entamoeba dispar
EGYQQ

SEQ ID NO: 2420380 - protein, 4 aa, Entamoeba dispar
EGYT

SEQ ID NO: 2420381 - protein, 4 aa, Entamoeba dispar
EGYV

SEQ ID NO: 2420382 - protein, 6 aa, Entamoeba dispar
EGYYQG

SEQ ID NO: 2420383 - protein, 7 aa, Entamoeba dispar
EHANPTT

SEQ ID NO: 2420384 - protein, 6 aa, Entamoeba dispar
EHDGKP

SEQ ID NO: 2420385 - protein, 8 aa, Entamoeba dispar
EHDRDNTH

SEQ ID NO: 2420386 - protein, 12 aa, Entamoeba dispar
EHDSSYKQQEGW

SEQ ID NO: 2420387 - protein, 13 aa, Entamoeba dispar
EHEEDDDDDIFGD

SEQ ID NO: 2420388 - protein, 31 aa, Entamoeba dispar
EHEEQRKKKIEEENQRKKEEEEKEQQRKMEE

SEQ ID NO: 2420389 - protein, 5 aa, Entamoeba dispar
EHEFD

SEQ ID NO: 2420390 - protein, 5 aa, Entamoeba dispar
EHEFN

SEQ ID NO: 2420391 - protein, 7 aa, Entamoeba dispar
EHEIPQE

SEQ ID NO: 2420392 - protein, 9 aa, Entamoeba dispar
EHEKAPVEK

SEQ ID NO: 2420393 - protein, 5 aa, Entamoeba dispar
EHEMD

SEQ ID NO: 2420394 - protein, 5 aa, Entamoeba dispar
EHEQP

SEQ ID NO: 2420395 - protein, 8 aa, Entamoeba dispar
EHETGKIY

SEQ ID NO: 2420396 - protein, 5 aa, Entamoeba dispar
EHEYS

SEQ ID NO: 2420397 - protein, 5 aa, Entamoeba dispar
EHFGG

SEQ ID NO: 2420398 - protein, 15 aa, Entamoeba dispar
EHFNPSTNYSPSTSV

SEQ ID NO: 2420399 - protein, 8 aa, Entamoeba dispar
EHGDSESD

SEQ ID NO: 2420400 - protein, 5 aa, Entamoeba dispar
EHGEK

SEQ ID NO: 2420401 - protein, 12 aa, Entamoeba dispar
EHGLSSDGVFQG

SEQ ID NO: 2420402 - protein, 7 aa, Entamoeba dispar
EHGPYQK

SEQ ID NO: 2420403 - protein, 4 aa, Entamoeba dispar
EHGS

SEQ ID NO: 2420404 - protein, 5 aa, Entamoeba dispar
EHGYT

SEQ ID NO: 2420405 - protein, 9 aa, Entamoeba dispar
EHHEEEDDK

SEQ ID NO: 2420406 - protein, 6 aa, Entamoeba dispar
EHHQKA

SEQ ID NO: 2420407 - protein, 4 aa, Entamoeba dispar
EHKD

SEQ ID NO: 2420408 - protein, 21 aa, Entamoeba dispar
EHKEEDDNIKEKETQPNNSIE

SEQ ID NO: 2420409 - protein, 6 aa, Entamoeba dispar
EHKEKL

SEQ ID NO: 2420410 - protein, 18 aa, Entamoeba dispar
EHKTNFTASDEEKEKQEV

SEQ ID NO: 2420411 - protein, 4 aa, Entamoeba dispar
EHLK

SEQ ID NO: 2420412 - protein, 12 aa, Entamoeba dispar
EHNAKEDKSLQE

SEQ ID NO: 2420413 - protein, 10 aa, Entamoeba dispar
EHNEGSLEEF

SEQ ID NO: 2420414 - protein, 8 aa, Entamoeba dispar
EHNEQTKP

SEQ ID NO: 2420415 - protein, 11 aa, Entamoeba dispar
EHNGDESNIGV

SEQ ID NO: 2420416 - protein, 6 aa, Entamoeba dispar
EHNGKG

SEQ ID NO: 2420417 - protein, 24 aa, Entamoeba dispar
EHNNENSINSNDQSPSESGEEESV

SEQ ID NO: 2420418 - protein, 9 aa, Entamoeba dispar
EHNTVEYPK

SEQ ID NO: 2420419 - protein, 4 aa, Entamoeba dispar
EHNV

SEQ ID NO: 2420420 - protein, 5 aa, Entamoeba dispar
EHPAV

SEQ ID NO: 2420421 - protein, 15 aa, Entamoeba dispar
EHPDYPANSKEFTRA

SEQ ID NO: 2420422 - protein, 5 aa, Entamoeba dispar
EHPEF

SEQ ID NO: 2420423 - protein, 5 aa, Entamoeba dispar
EHPEK

SEQ ID NO: 2420424 - protein, 10 aa, Entamoeba dispar
EHPGKQSKVT

SEQ ID NO: 2420425 - protein, 5 aa, Entamoeba dispar
EHPKN

SEQ ID NO: 2420426 - protein, 5 aa, Entamoeba dispar
EHPNL

SEQ ID NO: 2420427 - protein, 6 aa, Entamoeba dispar
EHPNRK

SEQ ID NO: 2420428 - protein, 4 aa, Entamoeba dispar
EHPQ

SEQ ID NO: 2420429 - protein, 8 aa, Entamoeba dispar
EHPSQEGL

SEQ ID NO: 2420430 - protein, 6 aa, Entamoeba dispar
EHPTHM

SEQ ID NO: 2420431 - protein, 4 aa, Entamoeba dispar
EHQK

SEQ ID NO: 2420432 - protein, 5 aa, Entamoeba dispar
EHQLS

SEQ ID NO: 2420433 - protein, 44 aa, Entamoeba dispar
EHQPKENSALTENTSKGCRKEQSLQKGITPTERTFQTEKDTRPV

SEQ ID NO: 2420434 - protein, 8 aa, Entamoeba dispar
EHQQNKLQ

SEQ ID NO: 2420435 - protein, 11 aa, Entamoeba dispar
EHRDDDGLSQH

SEQ ID NO: 2420436 - protein, 5 aa, Entamoeba dispar
EHRDP

SEQ ID NO: 2420437 - protein, 16 aa, Entamoeba dispar
EHRSRRRTRKNHEEED

SEQ ID NO: 2420438 - protein, 8 aa, Entamoeba dispar
EHRTQTYK

SEQ ID NO: 2420439 - protein, 9 aa, Entamoeba dispar
EHSGDNTNR

SEQ ID NO: 2420440 - protein, 19 aa, Entamoeba dispar
EHSKKEEHKKQRRQTSDVF

SEQ ID NO: 2420441 - protein, 6 aa, Entamoeba dispar
EHSKPV

SEQ ID NO: 2420442 - protein, 5 aa, Entamoeba dispar
EHSLE

SEQ ID NO: 2420443 - protein, 7 aa, Entamoeba dispar
EHSQEET

SEQ ID NO: 2420444 - protein, 5 aa, Entamoeba dispar
EHSRD

SEQ ID NO: 2420445 - protein, 8 aa, Entamoeba dispar
EHSRDNYN

SEQ ID NO: 2420446 - protein, 8 aa, Entamoeba dispar
EHSRDNYQ

SEQ ID NO: 2420447 - protein, 9 aa, Entamoeba dispar
EHSRDTPNR

SEQ ID NO: 2420448 - protein, 8 aa, Entamoeba dispar
EHSRDTPY

SEQ ID NO: 2420449 - protein, 4 aa, Entamoeba dispar
EHTD

SEQ ID NO: 2420450 - protein, 24 aa, Entamoeba dispar
EHTEEKLQNQEGHNEKTVESQVKE

SEQ ID NO: 2420451 - protein, 6 aa, Entamoeba dispar
EHTGRC

SEQ ID NO: 2420452 - protein, 4 aa, Entamoeba dispar
EHTH

SEQ ID NO: 2420453 - protein, 20 aa, Entamoeba dispar
EHTLTDQTQIKNDKSPVTVG

SEQ ID NO: 2420454 - protein, 31 aa, Entamoeba dispar
EHTNPAQVAQSSQDRVQITTQKSTPEEKKSC

SEQ ID NO: 2420455 - protein, 8 aa, Entamoeba dispar
EHTNTERG

SEQ ID NO: 2420456 - protein, 10 aa, Entamoeba dispar
EHTPSNPQEF

SEQ ID NO: 2420457 - protein, 4 aa, Entamoeba dispar
EHTQ

SEQ ID NO: 2420458 - protein, 7 aa, Entamoeba dispar
EHTQHNV

SEQ ID NO: 2420459 - protein, 14 aa, Entamoeba dispar
EHTQNSLKTLTSSN

SEQ ID NO: 2420460 - protein, 9 aa, Entamoeba dispar
EHTTTEGIT

SEQ ID NO: 2420461 - protein, 9 aa, Entamoeba dispar
EHVDDSVTN

SEQ ID NO: 2420462 - protein, 9 aa, Entamoeba dispar
EHVESNIPQ

SEQ ID NO: 2420463 - protein, 6 aa, Entamoeba dispar
EHYAES

SEQ ID NO: 2420464 - protein, 6 aa, Entamoeba dispar
EHYEEE

SEQ ID NO: 2420465 - protein, 6 aa, Entamoeba dispar
EIAGET

SEQ ID NO: 2420466 - protein, 11 aa, Entamoeba dispar
EIAKEADKYGF

SEQ ID NO: 2420467 - protein, 8 aa, Entamoeba dispar
EIANSRPD

SEQ ID NO: 2420468 - protein, 4 aa, Entamoeba dispar
EIAQ

SEQ ID NO: 2420469 - protein, 4 aa, Entamoeba dispar
EIAS

SEQ ID NO: 2420470 - protein, 5 aa, Entamoeba dispar
EIATP

SEQ ID NO: 2420471 - protein, 18 aa, Entamoeba dispar
EICPTEESDTSSSSPTPL

SEQ ID NO: 2420472 - protein, 4 aa, Entamoeba dispar
EIDE

SEQ ID NO: 2420473 - protein, 13 aa, Entamoeba dispar
EIDEARKVGKTAI

SEQ ID NO: 2420474 - protein, 8 aa, Entamoeba dispar
EIDEYNKS

SEQ ID NO: 2420475 - protein, 12 aa, Entamoeba dispar
EIDKDEDKMKEF

SEQ ID NO: 2420476 - protein, 15 aa, Entamoeba dispar
EIDKEKAEESYKRNK

SEQ ID NO: 2420477 - protein, 39 aa, Entamoeba dispar
  misc_feature (21)..(22): Xaa can be any naturally occurring amino acid
EIDKEKAEESYKRNKYKIEMXXIKKGKKDIEEEEEEDII

SEQ ID NO: 2420478 - protein, 8 aa, Entamoeba dispar
EIDPGDTI

SEQ ID NO: 2420479 - protein, 7 aa, Entamoeba dispar
EIDQPQN

SEQ ID NO: 2420480 - protein, 7 aa, Entamoeba dispar
EIDQQKN

SEQ ID NO: 2420481 - protein, 11 aa, Entamoeba dispar
EIDQYTKSSAL

SEQ ID NO: 2420482 - protein, 5 aa, Entamoeba dispar
EIDRD

SEQ ID NO: 2420483 - protein, 6 aa, Entamoeba dispar
EIDRTQ

SEQ ID NO: 2420484 - protein, 4 aa, Entamoeba dispar
EIDS

SEQ ID NO: 2420485 - protein, 13 aa, Entamoeba dispar
EIDSHESNKQSTP

SEQ ID NO: 2420486 - protein, 16 aa, Entamoeba dispar
EIDSSSFTNTNCTFTY

SEQ ID NO: 2420487 - protein, 7 aa, Entamoeba dispar
EIDTESP

SEQ ID NO: 2420488 - protein, 11 aa, Entamoeba dispar
EIDTKQSLEEA

SEQ ID NO: 2420489 - protein, 9 aa, Entamoeba dispar
EIDTQKKKI

SEQ ID NO: 2420490 - protein, 5 aa, Entamoeba dispar
EIEDE

SEQ ID NO: 2420491 - protein, 10 aa, Entamoeba dispar
EIEDEKKKDL

SEQ ID NO: 2420492 - protein, 14 aa, Entamoeba dispar
EIEDELTEDENNYE

SEQ ID NO: 2420493 - protein, 5 aa, Entamoeba dispar
EIEDM

SEQ ID NO: 2420494 - protein, 6 aa, Entamoeba dispar
EIEDRN

SEQ ID NO: 2420495 - protein, 6 aa, Entamoeba dispar
EIEDSS

SEQ ID NO: 2420496 - protein, 13 aa, Entamoeba dispar
EIEEELDENDKTL

SEQ ID NO: 2420497 - protein, 9 aa, Entamoeba dispar
EIEEGTRRI

SEQ ID NO: 2420498 - protein, 5 aa, Entamoeba dispar
EIEEH

SEQ ID NO: 2420499 - protein, 5 aa, Entamoeba dispar
EIEEI

SEQ ID NO: 2420500 - protein, 7 aa, Entamoeba dispar
EIEEINK

SEQ ID NO: 2420501 - protein, 9 aa, Entamoeba dispar
EIEEKALSP

SEQ ID NO: 2420502 - protein, 10 aa, Entamoeba dispar
EIEEKGGIVT

SEQ ID NO: 2420503 - protein, 8 aa, Entamoeba dispar
EIEEKKEI

SEQ ID NO: 2420504 - protein, 12 aa, Entamoeba dispar
EIEEKKHGYTKR

SEQ ID NO: 2420505 - protein, 20 aa, Entamoeba dispar
EIEEKNERRRELESQNENIT

SEQ ID NO: 2420506 - protein, 17 aa, Entamoeba dispar
EIEEKQNEINNNDQVIS

SEQ ID NO: 2420507 - protein, 15 aa, Entamoeba dispar
EIEEKYKSYEDQITK

SEQ ID NO: 2420508 - protein, 21 aa, Entamoeba dispar
EIEENENKMKEFEKEVRRAKG

SEQ ID NO: 2420509 - protein, 15 aa, Entamoeba dispar
EIEERGKKEEETAAQ

SEQ ID NO: 2420510 - protein, 14 aa, Entamoeba dispar
EIEESEDKKKEFEK

SEQ ID NO: 2420511 - protein, 20 aa, Entamoeba dispar
EIEETKRKGEEGKKEIKEQQ

SEQ ID NO: 2420512 - protein, 23 aa, Entamoeba dispar
EIEETSKQLDQPIQNETFPRTSF

SEQ ID NO: 2420513 - protein, 6 aa, Entamoeba dispar
EIEGEK

SEQ ID NO: 2420514 - protein, 7 aa, Entamoeba dispar
EIEGERS

SEQ ID NO: 2420515 - protein, 10 aa, Entamoeba dispar
EIEGGREKRS

SEQ ID NO: 2420516 - protein, 5 aa, Entamoeba dispar
EIEGM

SEQ ID NO: 2420517 - protein, 5 aa, Entamoeba dispar
EIEIP

SEQ ID NO: 2420518 - protein, 11 aa, Entamoeba dispar
EIEKETRITGR

SEQ ID NO: 2420519 - protein, 5 aa, Entamoeba dispar
EIEKF

SEQ ID NO: 2420520 - protein, 16 aa, Entamoeba dispar
EIEKGRKKVELGKEIE

SEQ ID NO: 2420521 - protein, 13 aa, Entamoeba dispar
EIEKKKGKKGKRI

SEQ ID NO: 2420522 - protein, 13 aa, Entamoeba dispar
EIEKKPKQPQEKD

SEQ ID NO: 2420523 - protein, 13 aa, Entamoeba dispar
EIEKKPRKPKEEE

SEQ ID NO: 2420524 - protein, 13 aa, Entamoeba dispar
EIEKKPRQPKEED

SEQ ID NO: 2420525 - protein, 8 aa, Entamoeba dispar
EIEKNGFN

SEQ ID NO: 2420526 - protein, 5 aa, Entamoeba dispar
EIEKQ

SEQ ID NO: 2420527 - protein, 10 aa, Entamoeba dispar
EIEKTTNSFT

SEQ ID NO: 2420528 - protein, 22 aa, Entamoeba dispar
EIENEKAKEKTEEKRWNEKEYD

SEQ ID NO: 2420529 - protein, 7 aa, Entamoeba dispar
EIENETL

SEQ ID NO: 2420530 - protein, 12 aa, Entamoeba dispar
EIENSKKEVENM

SEQ ID NO: 2420531 - protein, 11 aa, Entamoeba dispar
EIENSTESKLM

SEQ ID NO: 2420532 - protein, 4 aa, Entamoeba dispar
EIEP

SEQ ID NO: 2420533 - protein, 8 aa, Entamoeba dispar
EIEPGASE

SEQ ID NO: 2420534 - protein, 5 aa, Entamoeba dispar
EIEQE

SEQ ID NO: 2420535 - protein, 11 aa, Entamoeba dispar
EIEQPNQNDFN

SEQ ID NO: 2420536 - protein, 5 aa, Entamoeba dispar
EIEQQ

SEQ ID NO: 2420537 - protein, 8 aa, Entamoeba dispar
EIERGSQY

SEQ ID NO: 2420538 - protein, 8 aa, Entamoeba dispar
EIERNTEE

SEQ ID NO: 2420539 - protein, 7 aa, Entamoeba dispar
EIERSRG

SEQ ID NO: 2420540 - protein, 13 aa, Entamoeba dispar
EIESDESDEESDI

SEQ ID NO: 2420541 - protein, 13 aa, Entamoeba dispar
EIESGGEENDIEK

SEQ ID NO: 2420542 - protein, 7 aa, Entamoeba dispar
EIESTPS

SEQ ID NO: 2420543 - protein, 5 aa, Entamoeba dispar
EIETG

SEQ ID NO: 2420544 - protein, 28 aa, Entamoeba dispar
EIETIKNDNEKERKTNEIEQKKKNEEFI

SEQ ID NO: 2420545 - protein, 7 aa, Entamoeba dispar
EIETTSQ

SEQ ID NO: 2420546 - protein, 4 aa, Entamoeba dispar
EIEV

SEQ ID NO: 2420547 - protein, 17 aa, Entamoeba dispar
EIFGEEGFGERIKSEEE

SEQ ID NO: 2420548 - protein, 4 aa, Entamoeba dispar
EIFN

SEQ ID NO: 2420549 - protein, 24 aa, Entamoeba dispar
EIGDIGNEADDCLDGDGAMTERKQ

SEQ ID NO: 2420550 - protein, 5 aa, Entamoeba dispar
EIGEG

SEQ ID NO: 2420551 - protein, 10 aa, Entamoeba dispar
EIGEGEEIEV

SEQ ID NO: 2420552 - protein, 5 aa, Entamoeba dispar
EIGES

SEQ ID NO: 2420553 - protein, 9 aa, Entamoeba dispar
EIGGQTIDE

SEQ ID NO: 2420554 - protein, 17 aa, Entamoeba dispar
EIGGSPSASSSPDIPPV

SEQ ID NO: 2420555 - protein, 10 aa, Entamoeba dispar
EIGKDAHEKA

SEQ ID NO: 2420556 - protein, 14 aa, Entamoeba dispar
EIGKEKLSKIEGKV

SEQ ID NO: 2420557 - protein, 5 aa, Entamoeba dispar
EIGKN

SEQ ID NO: 2420558 - protein, 8 aa, Entamoeba dispar
EIGKRVNE

SEQ ID NO: 2420559 - protein, 6 aa, Entamoeba dispar
EIGNIE

SEQ ID NO: 2420560 - protein, 5 aa, Entamoeba dispar
EIGNR

SEQ ID NO: 2420561 - protein, 7 aa, Entamoeba dispar
EIGQTLS

SEQ ID NO: 2420562 - protein, 10 aa, Entamoeba dispar
EIGRNGNINQ

SEQ ID NO: 2420563 - protein, 4 aa, Entamoeba dispar
EIGS

SEQ ID NO: 2420564 - protein, 4 aa, Entamoeba dispar
EIGV

SEQ ID NO: 2420565 - protein, 5 aa, Entamoeba dispar
EIHPN

SEQ ID NO: 2420566 - protein, 5 aa, Entamoeba dispar
EIHPT

SEQ ID NO: 2420567 - protein, 4 aa, Entamoeba dispar
EIID

SEQ ID NO: 2420568 - protein, 5 aa, Entamoeba dispar
EIIPD

SEQ ID NO: 2420569 - protein, 8 aa, Entamoeba dispar
EIKDAGQT

SEQ ID NO: 2420570 - protein, 8 aa, Entamoeba dispar
EIKDENKI

SEQ ID NO: 2420571 - protein, 4 aa, Entamoeba dispar
EIKE

SEQ ID NO: 2420572 - protein, 5 aa, Entamoeba dispar
EIKEE

SEQ ID NO: 2420573 - protein, 9 aa, Entamoeba dispar
EIKEEENER

SEQ ID NO: 2420574 - protein, 16 aa, Entamoeba dispar
EIKEEKKEKKEKKCNI

SEQ ID NO: 2420575 - protein, 15 aa, Entamoeba dispar
EIKEEQEITTTNNRK

SEQ ID NO: 2420576 - protein, 11 aa, Entamoeba dispar
EIKEEQKIESK

SEQ ID NO: 2420577 - protein, 41 aa, Entamoeba dispar
EIKEEVKERKRRKEELEQEREKKEKEIKELKAQKNITKSQI

SEQ ID NO: 2420578 - protein, 15 aa, Entamoeba dispar
EIKEKEFKKGKSNIG

SEQ ID NO: 2420579 - protein, 10 aa, Entamoeba dispar
EIKEKKKEII

SEQ ID NO: 2420580 - protein, 22 aa, Entamoeba dispar
EIKELENSKAPYYPDKYPQGTT

SEQ ID NO: 2420581 - protein, 20 aa, Entamoeba dispar
EIKENKERIEKMKKEEKYKE

SEQ ID NO: 2420582 - protein, 5 aa, Entamoeba dispar
EIKEV

SEQ ID NO: 2420583 - protein, 4 aa, Entamoeba dispar
EIKG

SEQ ID NO: 2420584 - protein, 5 aa, Entamoeba dispar
EIKHT

SEQ ID NO: 2420585 - protein, 4 aa, Entamoeba dispar
EIKK

SEQ ID NO: 2420586 - protein, 9 aa, Entamoeba dispar
EIKKENRPY

SEQ ID NO: 2420587 - protein, 17 aa, Entamoeba dispar
EIKKERKKKLEKRKEQI

SEQ ID NO: 2420588 - protein, 7 aa, Entamoeba dispar
EIKKGNT

SEQ ID NO: 2420589 - protein, 5 aa, Entamoeba dispar
EIKKN

SEQ ID NO: 2420590 - protein, 10 aa, Entamoeba dispar
EIKKSTGSTE

SEQ ID NO: 2420591 - protein, 10 aa, Entamoeba dispar
EIKKTPSRKI

SEQ ID NO: 2420592 - protein, 4 aa, Entamoeba dispar
EIKN

SEQ ID NO: 2420593 - protein, 9 aa, Entamoeba dispar
EIKNDKRKE

SEQ ID NO: 2420594 - protein, 5 aa, Entamoeba dispar
EIKNK

SEQ ID NO: 2420595 - protein, 10 aa, Entamoeba dispar
EIKNKEIKTK

SEQ ID NO: 2420596 - protein, 8 aa, Entamoeba dispar
EIKNLKED

SEQ ID NO: 2420597 - protein, 10 aa, Entamoeba dispar
EIKNQTKQQL

SEQ ID NO: 2420598 - protein, 5 aa, Entamoeba dispar
EIKNT

SEQ ID NO: 2420599 - protein, 11 aa, Entamoeba dispar
EIKPQKTKRYW

SEQ ID NO: 2420600 - protein, 6 aa, Entamoeba dispar
EIKPRS

SEQ ID NO: 2420601 - protein, 17 aa, Entamoeba dispar
EIKQEDEKEKEELKEDI

SEQ ID NO: 2420602 - protein, 17 aa, Entamoeba dispar
EIKQKRKEAQEEEKASR

SEQ ID NO: 2420603 - protein, 15 aa, Entamoeba dispar
EIKQNSVNKKEVEEL

SEQ ID NO: 2420604 - protein, 7 aa, Entamoeba dispar
EIKQTKE

SEQ ID NO: 2420605 - protein, 17 aa, Entamoeba dispar
EIKQTNKTNDKSIETKK

SEQ ID NO: 2420606 - protein, 10 aa, Entamoeba dispar
EIKRDNVNDI

SEQ ID NO: 2420607 - protein, 11 aa, Entamoeba dispar
EIKRESKSFEA

SEQ ID NO: 2420608 - protein, 12 aa, Entamoeba dispar
EIKSETQKEILL

SEQ ID NO: 2420609 - protein, 8 aa, Entamoeba dispar
EIKSRGID

SEQ ID NO: 2420610 - protein, 20 aa, Entamoeba dispar
EIKSTSGPKTNVKIWNIKNL

SEQ ID NO: 2420611 - protein, 11 aa, Entamoeba dispar
EIKTNERITEQ

SEQ ID NO: 2420612 - protein, 9 aa, Entamoeba dispar
EIKTRISDE

SEQ ID NO: 2420613 - protein, 6 aa, Entamoeba dispar
EIKTTN

SEQ ID NO: 2420614 - protein, 8 aa, Entamoeba dispar
EIKTTQKL

SEQ ID NO: 2420615 - protein, 8 aa, Entamoeba dispar
EIKTTQQK

SEQ ID NO: 2420616 - protein, 6 aa, Entamoeba dispar
EILDTQ

SEQ ID NO: 2420617 - protein, 5 aa, Entamoeba dispar
EILPK

SEQ ID NO: 2420618 - protein, 5 aa, Entamoeba dispar
EILPT

SEQ ID NO: 2420619 - protein, 11 aa, Entamoeba dispar
EIMSPRKNSVD

SEQ ID NO: 2420620 - protein, 4 aa, Entamoeba dispar
EINA

SEQ ID NO: 2420621 - protein, 16 aa, Entamoeba dispar
EINDRKEYYKKKNSET

SEQ ID NO: 2420622 - protein, 5 aa, Entamoeba dispar
EINDS

SEQ ID NO: 2420623 - protein, 31 aa, Entamoeba dispar
EINEELKKESEENETMRKKYQESWDRQPSNI

SEQ ID NO: 2420624 - protein, 12 aa, Entamoeba dispar
EINEENENIPPL

SEQ ID NO: 2420625 - protein, 15 aa, Entamoeba dispar
EINEEQEIKTTNNRR

SEQ ID NO: 2420626 - protein, 7 aa, Entamoeba dispar
EINEGEK

SEQ ID NO: 2420627 - protein, 12 aa, Entamoeba dispar
EINEGKPNMPYK

SEQ ID NO: 2420628 - protein, 15 aa, Entamoeba dispar
EINENESLENEKKEE

SEQ ID NO: 2420629 - protein, 6 aa, Entamoeba dispar
EINEQN

SEQ ID NO: 2420630 - protein, 6 aa, Entamoeba dispar
EINETK

SEQ ID NO: 2420631 - protein, 9 aa, Entamoeba dispar
EINETTSNK

SEQ ID NO: 2420632 - protein, 4 aa, Entamoeba dispar
EING

SEQ ID NO: 2420633 - protein, 10 aa, Entamoeba dispar
EINGGRKATV

SEQ ID NO: 2420634 - protein, 6 aa, Entamoeba dispar
EINGNE

SEQ ID NO: 2420635 - protein, 4 aa, Entamoeba dispar
EINK

SEQ ID NO: 2420636 - protein, 11 aa, Entamoeba dispar
EINKEKQEEEI

SEQ ID NO: 2420637 - protein, 10 aa, Entamoeba dispar
EINKGNIQGV

SEQ ID NO: 2420638 - protein, 11 aa, Entamoeba dispar
EINKKEIKQRN

SEQ ID NO: 2420639 - protein, 23 aa, Entamoeba dispar
EINKREEIKQKQKQDKKINKERD

SEQ ID NO: 2420640 - protein, 13 aa, Entamoeba dispar
EINPQRESENTID

SEQ ID NO: 2420641 - protein, 8 aa, Entamoeba dispar
EINQPDNT

SEQ ID NO: 2420642 - protein, 30 aa, Entamoeba dispar
EINQTQSRSVVNQEKQTSLITKNEQTKDEW

SEQ ID NO: 2420643 - protein, 4 aa, Entamoeba dispar
EINR

SEQ ID NO: 2420644 - protein, 18 aa, Entamoeba dispar
EINSDEDDIKLKKAQTKL

SEQ ID NO: 2420645 - protein, 5 aa, Entamoeba dispar
EINSR

SEQ ID NO: 2420646 - protein, 6 aa, Entamoeba dispar
EINSSH

SEQ ID NO: 2420647 - protein, 4 aa, Entamoeba dispar
EINT

SEQ ID NO: 2420648 - protein, 7 aa, Entamoeba dispar
EINTKDN

SEQ ID NO: 2420649 - protein, 8 aa, Entamoeba dispar
EINTQGKK

SEQ ID NO: 2420650 - protein, 13 aa, Entamoeba dispar
EINTTSKPMDTSP

SEQ ID NO: 2420651 - protein, 7 aa, Entamoeba dispar
EINVPGY

SEQ ID NO: 2420652 - protein, 5 aa, Entamoeba dispar
EIPDL

SEQ ID NO: 2420653 - protein, 4 aa, Entamoeba dispar
EIPE

SEQ ID NO: 2420654 - protein, 8 aa, Entamoeba dispar
EIPEAEKK

SEQ ID NO: 2420655 - protein, 14 aa, Entamoeba dispar
EIPETKKPQQPDVL

SEQ ID NO: 2420656 - protein, 8 aa, Entamoeba dispar
EIPGKGRG

SEQ ID NO: 2420657 - protein, 5 aa, Entamoeba dispar
EIPGS

SEQ ID NO: 2420658 - protein, 31 aa, Entamoeba dispar
EIPHSSSNKASPPIPLKQTNKSNHPPLPPKV

SEQ ID NO: 2420659 - protein, 9 aa, Entamoeba dispar
EIPKEEPEF

SEQ ID NO: 2420660 - protein, 5 aa, Entamoeba dispar
EIPKP

SEQ ID NO: 2420661 - protein, 13 aa, Entamoeba dispar
EIPKQQVTQTIQS

SEQ ID NO: 2420662 - protein, 6 aa, Entamoeba dispar
EIPKQS

SEQ ID NO: 2420663 - protein, 10 aa, Entamoeba dispar
EIPKSGKLTM

SEQ ID NO: 2420664 - protein, 5 aa, Entamoeba dispar
EIPKT

SEQ ID NO: 2420665 - protein, 4 aa, Entamoeba dispar
EIPN

SEQ ID NO: 2420666 - protein, 6 aa, Entamoeba dispar
EIPNDV

SEQ ID NO: 2420667 - protein, 9 aa, Entamoeba dispar
EIPNSEPSQ

SEQ ID NO: 2420668 - protein, 5 aa, Entamoeba dispar
EIPNT

SEQ ID NO: 2420669 - protein, 5 aa, Entamoeba dispar
EIPPK

SEQ ID NO: 2420670 - protein, 5 aa, Entamoeba dispar
EIPPQ

SEQ ID NO: 2420671 - protein, 6 aa, Entamoeba dispar
EIPPQF

SEQ ID NO: 2420672 - protein, 7 aa, Entamoeba dispar
EIPPQTR

SEQ ID NO: 2420673 - protein, 4 aa, Entamoeba dispar
EIPQ

SEQ ID NO: 2420674 - protein, 9 aa, Entamoeba dispar
EIPQKELSK

SEQ ID NO: 2420675 - protein, 14 aa, Entamoeba dispar
EIPQPKSEEETKFE

SEQ ID NO: 2420676 - protein, 28 aa, Entamoeba dispar
EIPQYNEKIKNKRTEETHNENDNSVIRE

SEQ ID NO: 2420677 - protein, 4 aa, Entamoeba dispar
EIPR

SEQ ID NO: 2420678 - protein, 6 aa, Entamoeba dispar
EIPSED

SEQ ID NO: 2420679 - protein, 5 aa, Entamoeba dispar
EIPSK

SEQ ID NO: 2420680 - protein, 5 aa, Entamoeba dispar
EIPSN

SEQ ID NO: 2420681 - protein, 7 aa, Entamoeba dispar
EIPSNTS

SEQ ID NO: 2420682 - protein, 12 aa, Entamoeba dispar
EIPSNTTNRHNS

SEQ ID NO: 2420683 - protein, 7 aa, Entamoeba dispar
EIPSPKH

SEQ ID NO: 2420684 - protein, 11 aa, Entamoeba dispar
EIPSSLKEYPS

SEQ ID NO: 2420685 - protein, 8 aa, Entamoeba dispar
EIPSSPSD

SEQ ID NO: 2420686 - protein, 4 aa, Entamoeba dispar
EIQD

SEQ ID NO: 2420687 - protein, 9 aa, Entamoeba dispar
EIQEPDSKY

SEQ ID NO: 2420688 - protein, 5 aa, Entamoeba dispar
EIQES

SEQ ID NO: 2420689 - protein, 5 aa, Entamoeba dispar
EIQGG

SEQ ID NO: 2420690 - protein, 12 aa, Entamoeba dispar
EIQGTQSEQTAF

SEQ ID NO: 2420691 - protein, 17 aa, Entamoeba dispar
EIQKENTENQEQESSDI

SEQ ID NO: 2420692 - protein, 10 aa, Entamoeba dispar
EIQKETSLDY

SEQ ID NO: 2420693 - protein, 6 aa, Entamoeba dispar
EIQKEV

SEQ ID NO: 2420694 - protein, 33 aa, Entamoeba dispar
EIQKKKKSKHRHYSAYEGSDIQSIQRQRRRSMS

SEQ ID NO: 2420695 - protein, 34 aa, Entamoeba dispar
EIQKLRNESKELDDEISRMEKQYKEDEERKYEIE

SEQ ID NO: 2420696 - protein, 38 aa, Entamoeba dispar
EIQKLRNESKELDDEISRMEKQYKEDEERKYETEREEL

SEQ ID NO: 2420697 - protein, 34 aa, Entamoeba dispar
EIQKLRNESKELDDEISRMEKQYKEDEERKYGIE

SEQ ID NO: 2420698 - protein, 16 aa, Entamoeba dispar
EIQNCTGSLGAANDYF

SEQ ID NO: 2420699 - protein, 7 aa, Entamoeba dispar
EIQNDID

SEQ ID NO: 2420700 - protein, 11 aa, Entamoeba dispar
EIQNGTLGENA

SEQ ID NO: 2420701 - protein, 8 aa, Entamoeba dispar
EIQPKETI

SEQ ID NO: 2420702 - protein, 29 aa, Entamoeba dispar
EIQQEYDELTSQESIDKRNKTKESITSLK

SEQ ID NO: 2420703 - protein, 10 aa, Entamoeba dispar
EIQQKEEAKA

SEQ ID NO: 2420704 - protein, 6 aa, Entamoeba dispar
EIQRQN

SEQ ID NO: 2420705 - protein, 5 aa, Entamoeba dispar
EIQRY

SEQ ID NO: 2420706 - protein, 10 aa, Entamoeba dispar
EIQSIGKEVN

SEQ ID NO: 2420707 - protein, 8 aa, Entamoeba dispar
EIQSPKDM

SEQ ID NO: 2420708 - protein, 5 aa, Entamoeba dispar
EIQSR

SEQ ID NO: 2420709 - protein, 10 aa, Entamoeba dispar
EIQSTSETFE

SEQ ID NO: 2420710 - protein, 5 aa, Entamoeba dispar
EIQSV

SEQ ID NO: 2420711 - protein, 4 aa, Entamoeba dispar
EIQT

SEQ ID NO: 2420712 - protein, 7 aa, Entamoeba dispar
EIQTNGI

SEQ ID NO: 2420713 - protein, 7 aa, Entamoeba dispar
EIRDEVK

SEQ ID NO: 2420714 - protein, 6 aa, Entamoeba dispar
EIREGY

SEQ ID NO: 2420715 - protein, 9 aa, Entamoeba dispar
EIRERAGKR

SEQ ID NO: 2420716 - protein, 13 aa, Entamoeba dispar
EIRKSREGIIEKR

SEQ ID NO: 2420717 - protein, 7 aa, Entamoeba dispar
EIRRRKS

SEQ ID NO: 2420718 - protein, 15 aa, Entamoeba dispar
EISASDHVPLIIHIK

SEQ ID NO: 2420719 - protein, 6 aa, Entamoeba dispar
EISASN

SEQ ID NO: 2420720 - protein, 4 aa, Entamoeba dispar
EISD

SEQ ID NO: 2420721 - protein, 16 aa, Entamoeba dispar
EISDEDAKKYAEEKEN

SEQ ID NO: 2420722 - protein, 15 aa, Entamoeba dispar
EISDTPTTNIAQEQE

SEQ ID NO: 2420723 - protein, 4 aa, Entamoeba dispar
EISE

SEQ ID NO: 2420724 - protein, 14 aa, Entamoeba dispar
EISEEQLSETNNTI

SEQ ID NO: 2420725 - protein, 7 aa, Entamoeba dispar
EISEGGK

SEQ ID NO: 2420726 - protein, 8 aa, Entamoeba dispar
EISEGKKI

SEQ ID NO: 2420727 - protein, 20 aa, Entamoeba dispar
EISELNNKQKKLWGDAATEV

SEQ ID NO: 2420728 - protein, 5 aa, Entamoeba dispar
EISGG

SEQ ID NO: 2420729 - protein, 8 aa, Entamoeba dispar
EISGSSKI

SEQ ID NO: 2420730 - protein, 19 aa, Entamoeba dispar
EISGYDCNESVDSLKKSKE

SEQ ID NO: 2420731 - protein, 7 aa, Entamoeba dispar
EISKELK

SEQ ID NO: 2420732 - protein, 14 aa, Entamoeba dispar
EISKNKYYEYTSSV

SEQ ID NO: 2420733 - protein, 8 aa, Entamoeba dispar
EISKPTKV

SEQ ID NO: 2420734 - protein, 7 aa, Entamoeba dispar
EISNDTI

SEQ ID NO: 2420735 - protein, 12 aa, Entamoeba dispar
EISNGTSVDKEI

SEQ ID NO: 2420736 - protein, 6 aa, Entamoeba dispar
EISNNK

SEQ ID NO: 2420737 - protein, 7 aa, Entamoeba dispar
EISNQRS

SEQ ID NO: 2420738 - protein, 28 aa, Entamoeba dispar
EISNSEPQGLQEEKEMKEEIKENKVMQE

SEQ ID NO: 2420739 - protein, 6 aa, Entamoeba dispar
EISPQE

SEQ ID NO: 2420740 - protein, 5 aa, Entamoeba dispar
EISQK

SEQ ID NO: 2420741 - protein, 7 aa, Entamoeba dispar
EISQSKR

SEQ ID NO: 2420742 - protein, 8 aa, Entamoeba dispar
EISRNTTI

SEQ ID NO: 2420743 - protein, 11 aa, Entamoeba dispar
EISRNTTITQS

SEQ ID NO: 2420744 - protein, 6 aa, Entamoeba dispar
EISRNW

SEQ ID NO: 2420745 - protein, 6 aa, Entamoeba dispar
EISSRQ

SEQ ID NO: 2420746 - protein, 21 aa, Entamoeba dispar
EISSSDSSYVSEDYSRIPEQD

SEQ ID NO: 2420747 - protein, 32 aa, Entamoeba dispar
EISSTEEIKQKTFTVSTNQQPTLSKSVPPLNQ

SEQ ID NO: 2420748 - protein, 6 aa, Entamoeba dispar
EISTPV

SEQ ID NO: 2420749 - protein, 5 aa, Entamoeba dispar
EISYE

SEQ ID NO: 2420750 - protein, 5 aa, Entamoeba dispar
EITED

SEQ ID NO: 2420751 - protein, 7 aa, Entamoeba dispar
EITEEER

SEQ ID NO: 2420752 - protein, 26 aa, Entamoeba dispar
EITEKESNNIIKKEEEKEEKIDEERN

SEQ ID NO: 2420753 - protein, 26 aa, Entamoeba dispar
EITEKESNNIIKKEEEKEEKIDEESN

SEQ ID NO: 2420754 - protein, 9 aa, Entamoeba dispar
EITELGNGA

SEQ ID NO: 2420755 - protein, 13 aa, Entamoeba dispar
EITENENEQEERK

SEQ ID NO: 2420756 - protein, 7 aa, Entamoeba dispar
EITENSQ

SEQ ID NO: 2420757 - protein, 7 aa, Entamoeba dispar
EITEQDE

SEQ ID NO: 2420758 - protein, 5 aa, Entamoeba dispar
EITES

SEQ ID NO: 2420759 - protein, 5 aa, Entamoeba dispar
EITEV

SEQ ID NO: 2420760 - protein, 10 aa, Entamoeba dispar
EITGDNGNKW

SEQ ID NO: 2420761 - protein, 11 aa, Entamoeba dispar
EITGETDDDLL

SEQ ID NO: 2420762 - protein, 14 aa, Entamoeba dispar
EITGGTPQKKKSPL

SEQ ID NO: 2420763 - protein, 9 aa, Entamoeba dispar
EITGTTTND

SEQ ID NO: 2420764 - protein, 7 aa, Entamoeba dispar
EITKAES

SEQ ID NO: 2420765 - protein, 5 aa, Entamoeba dispar
EITKD

SEQ ID NO: 2420766 - protein, 4 aa, Entamoeba dispar
EITN

SEQ ID NO: 2420767 - protein, 5 aa, Entamoeba dispar
EITNK

SEQ ID NO: 2420768 - protein, 22 aa, Entamoeba dispar
EITPIEKKPRQPKKIKEEKPKK

SEQ ID NO: 2420769 - protein, 5 aa, Entamoeba dispar
EITPQ

SEQ ID NO: 2420770 - protein, 8 aa, Entamoeba dispar
EITPRTTD

SEQ ID NO: 2420771 - protein, 15 aa, Entamoeba dispar
EITPSREKLKKDAEA

SEQ ID NO: 2420772 - protein, 14 aa, Entamoeba dispar
EITPSVQMSGPTNF

SEQ ID NO: 2420773 - protein, 4 aa, Entamoeba dispar
EITQ

SEQ ID NO: 2420774 - protein, 20 aa, Entamoeba dispar
EITQKDSSIEKSVKKAKEKF

SEQ ID NO: 2420775 - protein, 10 aa, Entamoeba dispar
EITQNSNNFK

SEQ ID NO: 2420776 - protein, 7 aa, Entamoeba dispar
EITQPLP

SEQ ID NO: 2420777 - protein, 15 aa, Entamoeba dispar
EITQPTDPQQPSLTP

SEQ ID NO: 2420778 - protein, 15 aa, Entamoeba dispar
EITRETERTCPGRNV

SEQ ID NO: 2420779 - protein, 5 aa, Entamoeba dispar
EITRQ

SEQ ID NO: 2420780 - protein, 11 aa, Entamoeba dispar
EITSDKTTLTQ

SEQ ID NO: 2420781 - protein, 10 aa, Entamoeba dispar
EITSTDDSNE

SEQ ID NO: 2420782 - protein, 5 aa, Entamoeba dispar
EITTS

SEQ ID NO: 2420783 - protein, 9 aa, Entamoeba dispar
EITTSEETY

SEQ ID NO: 2420784 - protein, 15 aa, Entamoeba dispar
EITVDTADKEGAPTL

SEQ ID NO: 2420785 - protein, 11 aa, Entamoeba dispar
EIVEEKTANNY

SEQ ID NO: 2420786 - protein, 9 aa, Entamoeba dispar
EIVEKGGSI

SEQ ID NO: 2420787 - protein, 4 aa, Entamoeba dispar
EIVK

SEQ ID NO: 2420788 - protein, 22 aa, Entamoeba dispar
EIVSSKDKETPHQTEGSNQTPV

SEQ ID NO: 2420789 - protein, 13 aa, Entamoeba dispar
EIYEDDKQNPWNS

SEQ ID NO: 2420790 - protein, 11 aa, Entamoeba dispar
EIYEEKDDTIC

SEQ ID NO: 2420791 - protein, 4 aa, Entamoeba dispar
EIYG

SEQ ID NO: 2420792 - protein, 30 aa, Entamoeba dispar
EIYKRGREGSIQRDELYNSDGSRTKETSFG

SEQ ID NO: 2420793 - protein, 6 aa, Entamoeba dispar
EIYSEE

SEQ ID NO: 2420794 - protein, 10 aa, Entamoeba dispar
EKADKTTFEE

SEQ ID NO: 2420795 - protein, 8 aa, Entamoeba dispar
EKAEDPTS

SEQ ID NO: 2420796 - protein, 18 aa, Entamoeba dispar
EKAEGSDERNEIKEQQMQ

SEQ ID NO: 2420797 - protein, 23 aa, Entamoeba dispar
EKAEKIRQANLKREKEELQHQEE

SEQ ID NO: 2420798 - protein, 7 aa, Entamoeba dispar
EKAGGYP

SEQ ID NO: 2420799 - protein, 84 aa, Entamoeba dispar
EKAGQVNKADKQSDKQEEIIKEDKSERRKHHQHRDYSRSERRHRSRERRGRSYSRSRTRSRSSSRRRRDGSKKNNRGYKEREYR

SEQ ID NO: 2420800 - protein, 18 aa, Entamoeba dispar
EKAGRAKAQKQKQAYEKK

SEQ ID NO: 2420801 - protein, 7 aa, Entamoeba dispar
EKAKDLL

SEQ ID NO: 2420802 - protein, 9 aa, Entamoeba dispar
EKAKKSTNW

SEQ ID NO: 2420803 - protein, 9 aa, Entamoeba dispar
EKAKLTPQQ

SEQ ID NO: 2420804 - protein, 5 aa, Entamoeba dispar
EKAKN

SEQ ID NO: 2420805 - protein, 10 aa, Entamoeba dispar
EKAKQRVAKS

SEQ ID NO: 2420806 - protein, 8 aa, Entamoeba dispar
EKAKQVSD

SEQ ID NO: 2420807 - protein, 12 aa, Entamoeba dispar
EKALTSTEIPAT

SEQ ID NO: 2420808 - protein, 18 aa, Entamoeba dispar
EKANKKMEQKLKKTTDWV

SEQ ID NO: 2420809 - protein, 8 aa, Entamoeba dispar
EKAPTKEA

SEQ ID NO: 2420810 - protein, 8 aa, Entamoeba dispar
EKAPTTGH

SEQ ID NO: 2420811 - protein, 4 aa, Entamoeba dispar
EKAQ

SEQ ID NO: 2420812 - protein, 6 aa, Entamoeba dispar
EKAQES

SEQ ID NO: 2420813 - protein, 5 aa, Entamoeba dispar
EKAQN

SEQ ID NO: 2420814 - protein, 5 aa, Entamoeba dispar
EKAQQ

SEQ ID NO: 2420815 - protein, 7 aa, Entamoeba dispar
EKAQVDA

SEQ ID NO: 2420816 - protein, 12 aa, Entamoeba dispar
EKAQYATPESLN

SEQ ID NO: 2420817 - protein, 5 aa, Entamoeba dispar
EKART

SEQ ID NO: 2420818 - protein, 8 aa, Entamoeba dispar
EKASAQKY

SEQ ID NO: 2420819 - protein, 7 aa, Entamoeba dispar
EKASEES

SEQ ID NO: 2420820 - protein, 11 aa, Entamoeba dispar
EKATSFPKGSD

SEQ ID NO: 2420821 - protein, 7 aa, Entamoeba dispar
EKAVKEC

SEQ ID NO: 2420822 - protein, 7 aa, Entamoeba dispar
EKCDDET

SEQ ID NO: 2420823 - protein, 8 aa, Entamoeba dispar
EKCGKTSL

SEQ ID NO: 2420824 - protein, 8 aa, Entamoeba dispar
EKCGTTES

SEQ ID NO: 2420825 - protein, 14 aa, Entamoeba dispar
EKCNGEKSKASLAM

SEQ ID NO: 2420826 - protein, 8 aa, Entamoeba dispar
EKCPSQNA

SEQ ID NO: 2420827 - protein, 7 aa, Entamoeba dispar
EKCSNCD

SEQ ID NO: 2420828 - protein, 9 aa, Entamoeba dispar
EKDAPEQEG

SEQ ID NO: 2420829 - protein, 7 aa, Entamoeba dispar
EKDEAVP

SEQ ID NO: 2420830 - protein, 15 aa, Entamoeba dispar
EKDEDEIKNKTFQQN

SEQ ID NO: 2420831 - protein, 9 aa, Entamoeba dispar
EKDENGFKN

SEQ ID NO: 2420832 - protein, 26 aa, Entamoeba dispar
EKDEQEAEAKRNAEEEERKRKEIEQK

SEQ ID NO: 2420833 - protein, 21 aa, Entamoeba dispar
EKDESKLQEAPTIECDEENEL

SEQ ID NO: 2420834 - protein, 21 aa, Entamoeba dispar
EKDESKLQEAPTIENNNNGPI

SEQ ID NO: 2420835 - protein, 10 aa, Entamoeba dispar
EKDETTTHYS

SEQ ID NO: 2420836 - protein, 5 aa, Entamoeba dispar
EKDFE

SEQ ID NO: 2420837 - protein, 5 aa, Entamoeba dispar
EKDFR

SEQ ID NO: 2420838 - protein, 19 aa, Entamoeba dispar
EKDFSGNLTEENYKTKISS

SEQ ID NO: 2420839 - protein, 5 aa, Entamoeba dispar
EKDGF

SEQ ID NO: 2420840 - protein, 32 aa, Entamoeba dispar
EKDGIEHERNKINEEYKTINEELEKNKKELND

SEQ ID NO: 2420841 - protein, 13 aa, Entamoeba dispar
EKDGQSFSCSQSE

SEQ ID NO: 2420842 - protein, 6 aa, Entamoeba dispar
EKDICP

SEQ ID NO: 2420843 - protein, 26 aa, Entamoeba dispar
EKDIEEGKDQEKDEKVEKKNKENEEM

SEQ ID NO: 2420844 - protein, 9 aa, Entamoeba dispar
EKDIEKGSI

SEQ ID NO: 2420845 - protein, 9 aa, Entamoeba dispar
EKDIKEIEE

SEQ ID NO: 2420846 - protein, 5 aa, Entamoeba dispar
EKDIM

SEQ ID NO: 2420847 - protein, 8 aa, Entamoeba dispar
EKDINKEE

SEQ ID NO: 2420848 - protein, 39 aa, Entamoeba dispar
EKDITSQSKKLEKQIPNEPKQIEDEKNITPNESKQLEKN

SEQ ID NO: 2420849 - protein, 5 aa, Entamoeba dispar
EKDKC

SEQ ID NO: 2420850 - protein, 9 aa, Entamoeba dispar
EKDKEKKKQ

SEQ ID NO: 2420851 - protein, 6 aa, Entamoeba dispar
EKDKFG

SEQ ID NO: 2420852 - protein, 7 aa, Entamoeba dispar
EKDKSEV

SEQ ID NO: 2420853 - protein, 16 aa, Entamoeba dispar
EKDLGKKDQQRNSRYG

SEQ ID NO: 2420854 - protein, 8 aa, Entamoeba dispar
EKDLKDIE

SEQ ID NO: 2420855 - protein, 8 aa, Entamoeba dispar
EKDNDQYW

SEQ ID NO: 2420856 - protein, 16 aa, Entamoeba dispar
EKDNESSTTTDTIKSQ

SEQ ID NO: 2420857 - protein, 12 aa, Entamoeba dispar
EKDNEYLYSICS

SEQ ID NO: 2420858 - protein, 6 aa, Entamoeba dispar
EKDNLK

SEQ ID NO: 2420859 - protein, 6 aa, Entamoeba dispar
EKDNNH

SEQ ID NO: 2420860 - protein, 13 aa, Entamoeba dispar
EKDPSLGYLLQHE

SEQ ID NO: 2420861 - protein, 6 aa, Entamoeba dispar
EKDQEI

SEQ ID NO: 2420862 - protein, 8 aa, Entamoeba dispar
EKDQSLTM

SEQ ID NO: 2420863 - protein, 8 aa, Entamoeba dispar
EKDRDGCP

SEQ ID NO: 2420864 - protein, 7 aa, Entamoeba dispar
EKDRMES

SEQ ID NO: 2420865 - protein, 9 aa, Entamoeba dispar
EKDRSTLKE

SEQ ID NO: 2420866 - protein, 8 aa, Entamoeba dispar
EKDSMRGE

SEQ ID NO: 2420867 - protein, 8 aa, Entamoeba dispar
EKDSQITQ

SEQ ID NO: 2420868 - protein, 5 aa, Entamoeba dispar
EKDSR

SEQ ID NO: 2420869 - protein, 9 aa, Entamoeba dispar
EKDSTETCK

SEQ ID NO: 2420870 - protein, 7 aa, Entamoeba dispar
EKDTEKQ

SEQ ID NO: 2420871 - protein, 5 aa, Entamoeba dispar
EKDTI

SEQ ID NO: 2420872 - protein, 15 aa, Entamoeba dispar
EKDTKLTENEQNINQ

SEQ ID NO: 2420873 - protein, 6 aa, Entamoeba dispar
EKDTMK

SEQ ID NO: 2420874 - protein, 29 aa, Entamoeba dispar
EKDTNDGLIDREETNERRSVKRSIPTMGK

SEQ ID NO: 2420875 - protein, 6 aa, Entamoeba dispar
EKDTSL

SEQ ID NO: 2420876 - protein, 4 aa, Entamoeba dispar
EKDY

SEQ ID NO: 2420877 - protein, 13 aa, Entamoeba dispar
EKDYSKPIHLLKT

SEQ ID NO: 2420878 - protein, 10 aa, Entamoeba dispar
EKEADPEEFK

SEQ ID NO: 2420879 - protein, 10 aa, Entamoeba dispar
EKEAEEERKR

SEQ ID NO: 2420880 - protein, 8 aa, Entamoeba dispar
EKEAHAET

SEQ ID NO: 2420881 - protein, 10 aa, Entamoeba dispar
EKEAKENQRE

SEQ ID NO: 2420882 - protein, 9 aa, Entamoeba dispar
EKEAPDTEG

SEQ ID NO: 2420883 - protein, 6 aa, Entamoeba dispar
EKEDGA

SEQ ID NO: 2420884 - protein, 5 aa, Entamoeba dispar
EKEDI

SEQ ID NO: 2420885 - protein, 14 aa, Entamoeba dispar
EKEDKENTHKINNS

SEQ ID NO: 2420886 - protein, 9 aa, Entamoeba dispar
EKEDNQQEL

SEQ ID NO: 2420887 - protein, 17 aa, Entamoeba dispar
EKEDNSDSIGSKNTPIT

SEQ ID NO: 2420888 - protein, 6 aa, Entamoeba dispar
EKEDQD

SEQ ID NO: 2420889 - protein, 9 aa, Entamoeba dispar
EKEDYKRGI

SEQ ID NO: 2420890 - protein, 8 aa, Entamoeba dispar
EKEEDITN

SEQ ID NO: 2420891 - protein, 6 aa, Entamoeba dispar
EKEEDK

SEQ ID NO: 2420892 - protein, 23 aa, Entamoeba dispar
EKEEDKTKEEDIIKKSEKPIDNS

SEQ ID NO: 2420893 - protein, 33 aa, Entamoeba dispar
EKEEEAIEEEDNDEDLGLKPVTKEIKTAQKAEV

SEQ ID NO: 2420894 - protein, 8 aa, Entamoeba dispar
EKEEEEEW

SEQ ID NO: 2420895 - protein, 7 aa, Entamoeba dispar
EKEEEIK

SEQ ID NO: 2420896 - protein, 9 aa, Entamoeba dispar
EKEEEIKEM

SEQ ID NO: 2420897 - protein, 11 aa, Entamoeba dispar
EKEEEKNELKE

SEQ ID NO: 2420898 - protein, 18 aa, Entamoeba dispar
EKEEESKNEKNKKRNQDI

SEQ ID NO: 2420899 - protein, 6 aa, Entamoeba dispar
EKEEFE

SEQ ID NO: 2420900 - protein, 5 aa, Entamoeba dispar
EKEEG

SEQ ID NO: 2420901 - protein, 11 aa, Entamoeba dispar
EKEEGIPEDFS

SEQ ID NO: 2420902 - protein, 14 aa, Entamoeba dispar
EKEEIGKGEEIEKS

SEQ ID NO: 2420903 - protein, 6 aa, Entamoeba dispar
EKEEIR

SEQ ID NO: 2420904 - protein, 15 aa, Entamoeba dispar
EKEEKLKKKENELMD

SEQ ID NO: 2420905 - protein, 9 aa, Entamoeba dispar
EKEEREEHK

SEQ ID NO: 2420906 - protein, 13 aa, Entamoeba dispar
EKEEREKIEETKY

SEQ ID NO: 2420907 - protein, 7 aa, Entamoeba dispar
EKEEWNE

SEQ ID NO: 2420908 - protein, 7 aa, Entamoeba dispar
EKEEWTE

SEQ ID NO: 2420909 - protein, 8 aa, Entamoeba dispar
EKEGHETI

SEQ ID NO: 2420910 - protein, 9 aa, Entamoeba dispar
EKEGKTDET

SEQ ID NO: 2420911 - protein, 5 aa, Entamoeba dispar
EKEGL

SEQ ID NO: 2420912 - protein, 6 aa, Entamoeba dispar
EKEGLE

SEQ ID NO: 2420913 - protein, 8 aa, Entamoeba dispar
EKEGRTQL

SEQ ID NO: 2420914 - protein, 7 aa, Entamoeba dispar
EKEGYNL

SEQ ID NO: 2420915 - protein, 5 aa, Entamoeba dispar
EKEHE

SEQ ID NO: 2420916 - protein, 19 aa, Entamoeba dispar
EKEHKEAKRGKEGNAEELA

SEQ ID NO: 2420917 - protein, 14 aa, Entamoeba dispar
EKEIANPEDPESYA

SEQ ID NO: 2420918 - protein, 13 aa, Entamoeba dispar
EKEIEEEINTTER

SEQ ID NO: 2420919 - protein, 7 aa, Entamoeba dispar
EKEIEEL

SEQ ID NO: 2420920 - protein, 11 aa, Entamoeba dispar
EKEIKEEEEEE

SEQ ID NO: 2420921 - protein, 13 aa, Entamoeba dispar
EKEIKEEEKTKLT

SEQ ID NO: 2420922 - protein, 12 aa, Entamoeba dispar
EKEIKKRHSATL

SEQ ID NO: 2420923 - protein, 7 aa, Entamoeba dispar
EKEIKTP

SEQ ID NO: 2420924 - protein, 5 aa, Entamoeba dispar
EKEIL

SEQ ID NO: 2420925 - protein, 6 aa, Entamoeba dispar
EKEINL

SEQ ID NO: 2420926 - protein, 11 aa, Entamoeba dispar
EKEINQSNPNM

SEQ ID NO: 2420927 - protein, 5 aa, Entamoeba dispar
EKEIP

SEQ ID NO: 2420928 - protein, 33 aa, Entamoeba dispar
EKEIQRSDSLTLSSEDKKESKINNLSECTSDKG

SEQ ID NO: 2420929 - protein, 47 aa, Entamoeba dispar
EKEIQSDFNEKEEIDKGNSKEVEIGSKDDNINESINENKTPEISEEE

SEQ ID NO: 2420930 - protein, 18 aa, Entamoeba dispar
EKEIREREAHINELKSHL

SEQ ID NO: 2420931 - protein, 7 aa, Entamoeba dispar
EKEISSA

SEQ ID NO: 2420932 - protein, 15 aa, Entamoeba dispar
EKEISSTKTGTPLLK

SEQ ID NO: 2420933 - protein, 5 aa, Entamoeba dispar
EKEIT

SEQ ID NO: 2420934 - protein, 6 aa, Entamoeba dispar
EKEITE

SEQ ID NO: 2420935 - protein, 4 aa, Entamoeba dispar
EKEK

SEQ ID NO: 2420936 - protein, 10 aa, Entamoeba dispar
EKEKAERDRE

SEQ ID NO: 2420937 - protein, 10 aa, Entamoeba dispar
EKEKEGKKEL

SEQ ID NO: 2420938 - protein, 29 aa, Entamoeba dispar
EKEKELADLTNRREEAINERKRIEVGQGE

SEQ ID NO: 2420939 - protein, 6 aa, Entamoeba dispar
EKEKFK

SEQ ID NO: 2420940 - protein, 7 aa, Entamoeba dispar
EKEKGDV

SEQ ID NO: 2420941 - protein, 9 aa, Entamoeba dispar
EKEKGKIEL

SEQ ID NO: 2420942 - protein, 7 aa, Entamoeba dispar
EKEKGNI

SEQ ID NO: 2420943 - protein, 7 aa, Entamoeba dispar
EKEKGRP

SEQ ID NO: 2420944 - protein, 7 aa, Entamoeba dispar
EKEKIQS

SEQ ID NO: 2420945 - protein, 26 aa, Entamoeba dispar
EKEKKDIQITQKERLSDLKPPKNRNN

SEQ ID NO: 2420946 - protein, 8 aa, Entamoeba dispar
EKEKKERP

SEQ ID NO: 2420947 - protein, 6 aa, Entamoeba dispar
EKEKKS

SEQ ID NO: 2420948 - protein, 33 aa, Entamoeba dispar
EKEKLEKKPKKENSKNLENRKKDGVVSKKLHFK

SEQ ID NO: 2420949 - protein, 8 aa, Entamoeba dispar
EKEKMDRD

SEQ ID NO: 2420950 - protein, 17 aa, Entamoeba dispar
EKEKQENNEKRKLKRKV

SEQ ID NO: 2420951 - protein, 8 aa, Entamoeba dispar
EKEKQTHK

SEQ ID NO: 2420952 - protein, 18 aa, Entamoeba dispar
EKEKSQKRIQRSKEAEVN

SEQ ID NO: 2420953 - protein, 16 aa, Entamoeba dispar
EKEKTAEEKAKEEQEN

SEQ ID NO: 2420954 - protein, 7 aa, Entamoeba dispar
EKEKTIP

SEQ ID NO: 2420955 - protein, 13 aa, Entamoeba dispar
EKEKTRAIGEDIE

SEQ ID NO: 2420956 - protein, 9 aa, Entamoeba dispar
EKEKVNEQY

SEQ ID NO: 2420957 - protein, 16 aa, Entamoeba dispar
EKEKVSQKKIEPFKTE

SEQ ID NO: 2420958 - protein, 4 aa, Entamoeba dispar
EKEL

SEQ ID NO: 2420959 - protein, 5 aa, Entamoeba dispar
EKELH

SEQ ID NO: 2420960 - protein, 16 aa, Entamoeba dispar
EKELKKNKRIPRNCFN

SEQ ID NO: 2420961 - protein, 11 aa, Entamoeba dispar
EKELQKKDKEI

SEQ ID NO: 2420962 - protein, 14 aa, Entamoeba dispar
EKELRPVQRHPRYK

SEQ ID NO: 2420963 - protein, 9 aa, Entamoeba dispar
EKELTFSDQ

SEQ ID NO: 2420964 - protein, 24 aa, Entamoeba dispar
EKEMKDMGNLSQSLQQVEKTGNNI

SEQ ID NO: 2420965 - protein, 9 aa, Entamoeba dispar
EKENAPEND

SEQ ID NO: 2420966 - protein, 24 aa, Entamoeba dispar
EKENEGLKKENEEIIQSQQRKEII

SEQ ID NO: 2420967 - protein, 7 aa, Entamoeba dispar
EKENEIE

SEQ ID NO: 2420968 - protein, 9 aa, Entamoeba dispar
EKENEITKL

SEQ ID NO: 2420969 - protein, 8 aa, Entamoeba dispar
EKENQEYQ

SEQ ID NO: 2420970 - protein, 11 aa, Entamoeba dispar
EKENSSSFYGG

SEQ ID NO: 2420971 - protein, 6 aa, Entamoeba dispar
EKEPLV

SEQ ID NO: 2420972 - protein, 10 aa, Entamoeba dispar
EKEPNKRATM

SEQ ID NO: 2420973 - protein, 8 aa, Entamoeba dispar
EKEPQIES

SEQ ID NO: 2420974 - protein, 7 aa, Entamoeba dispar
EKEQGRE

SEQ ID NO: 2420975 - protein, 15 aa, Entamoeba dispar
EKEQIARKKTEEIQK

SEQ ID NO: 2420976 - protein, 14 aa, Entamoeba dispar
EKEQQKQKVKEEEL

SEQ ID NO: 2420977 - protein, 7 aa, Entamoeba dispar
EKEQQTF

SEQ ID NO: 2420978 - protein, 12 aa, Entamoeba dispar
EKEQTENIAKQN

SEQ ID NO: 2420979 - protein, 11 aa, Entamoeba dispar
EKEQTKEENEF

SEQ ID NO: 2420980 - protein, 10 aa, Entamoeba dispar
EKEQTQLKED

SEQ ID NO: 2420981 - protein, 6 aa, Entamoeba dispar
EKERGY

SEQ ID NO: 2420982 - protein, 5 aa, Entamoeba dispar
EKERK

SEQ ID NO: 2420983 - protein, 6 aa, Entamoeba dispar
EKERKE

SEQ ID NO: 2420984 - protein, 11 aa, Entamoeba dispar
EKERKENRKRC

SEQ ID NO: 2420985 - protein, 6 aa, Entamoeba dispar
EKERKV

SEQ ID NO: 2420986 - protein, 6 aa, Entamoeba dispar
EKERRR

SEQ ID NO: 2420987 - protein, 9 aa, Entamoeba dispar
EKERRYAPY

SEQ ID NO: 2420988 - protein, 7 aa, Entamoeba dispar
EKERSAL

SEQ ID NO: 2420989 - protein, 18 aa, Entamoeba dispar
EKERTNKEINKGVGTGYG

SEQ ID NO: 2420990 - protein, 4 aa, Entamoeba dispar
EKES

SEQ ID NO: 2420991 - protein, 13 aa, Entamoeba dispar
EKESEEDLINEET

SEQ ID NO: 2420992 - protein, 7 aa, Entamoeba dispar
EKESKEQ

SEQ ID NO: 2420993 - protein, 8 aa, Entamoeba dispar
EKESKKEI

SEQ ID NO: 2420994 - protein, 5 aa, Entamoeba dispar
EKESL

SEQ ID NO: 2420995 - protein, 9 aa, Entamoeba dispar
EKESLTKHT

SEQ ID NO: 2420996 - protein, 11 aa, Entamoeba dispar
EKESNLNPQKI

SEQ ID NO: 2420997 - protein, 7 aa, Entamoeba dispar
EKESRKF

SEQ ID NO: 2420998 - protein, 10 aa, Entamoeba dispar
EKESYRKKYT

SEQ ID NO: 2420999 - protein, 9 aa, Entamoeba dispar
EKETFEPKG

SEQ ID NO: 2421000 - protein, 6 aa, Entamoeba dispar
EKETIT

SEQ ID NO: 2421001 - protein, 6 aa, Entamoeba dispar
EKETKW

SEQ ID NO: 2421002 - protein, 7 aa, Entamoeba dispar
EKETQEE

SEQ ID NO: 2421003 - protein, 6 aa, Entamoeba dispar
EKETSF

SEQ ID NO: 2421004 - protein, 19 aa, Entamoeba dispar
EKETSLKTISGKKFQPPIK

SEQ ID NO: 2421005 - protein, 9 aa, Entamoeba dispar
EKETSNYHE

SEQ ID NO: 2421006 - protein, 7 aa, Entamoeba dispar
EKETTES

SEQ ID NO: 2421007 - protein, 10 aa, Entamoeba dispar
EKETTKGENL

SEQ ID NO: 2421008 - protein, 7 aa, Entamoeba dispar
EKEVDKP

SEQ ID NO: 2421009 - protein, 8 aa, Entamoeba dispar
EKEWGKDD

SEQ ID NO: 2421010 - protein, 56 aa, Entamoeba dispar
EKEWKEQLEKSQKEKEESEENNNRMKKTIEKKEEEVKSLNQEIEKINKENETMKEK

SEQ ID NO: 2421011 - protein, 6 aa, Entamoeba dispar
EKEYET

SEQ ID NO: 2421012 - protein, 7 aa, Entamoeba dispar
EKEYGIG

SEQ ID NO: 2421013 - protein, 16 aa, Entamoeba dispar
EKEYNEEVKGYNPKEI

SEQ ID NO: 2421014 - protein, 9 aa, Entamoeba dispar
EKFEPKKEI

SEQ ID NO: 2421015 - protein, 5 aa, Entamoeba dispar
EKFGG

SEQ ID NO: 2421016 - protein, 7 aa, Entamoeba dispar
EKFGGNR

SEQ ID NO: 2421017 - protein, 8 aa, Entamoeba dispar
EKFGKPIA

SEQ ID NO: 2421018 - protein, 19 aa, Entamoeba dispar
EKFKAEDDKMKQRVEAKNK

SEQ ID NO: 2421019 - protein, 8 aa, Entamoeba dispar
EKFNPKDF

SEQ ID NO: 2421020 - protein, 6 aa, Entamoeba dispar
EKFPEK

SEQ ID NO: 2421021 - protein, 20 aa, Entamoeba dispar
EKFQKDLRKGINEKTAKRRL

SEQ ID NO: 2421022 - protein, 13 aa, Entamoeba dispar
EKFQKRKKTIISQ

SEQ ID NO: 2421023 - protein, 5 aa, Entamoeba dispar
EKFRK

SEQ ID NO: 2421024 - protein, 5 aa, Entamoeba dispar
EKFRQ

SEQ ID NO: 2421025 - protein, 10 aa, Entamoeba dispar
EKFSKEVTTT

SEQ ID NO: 2421026 - protein, 14 aa, Entamoeba dispar
EKFSSDEEINTNNK

SEQ ID NO: 2421027 - protein, 17 aa, Entamoeba dispar
EKGATEYFTGNKGREFA

SEQ ID NO: 2421028 - protein, 9 aa, Entamoeba dispar
EKGDESIEN

SEQ ID NO: 2421029 - protein, 10 aa, Entamoeba dispar
EKGDTDHSGM

SEQ ID NO: 2421030 - protein, 6 aa, Entamoeba dispar
EKGDTY

SEQ ID NO: 2421031 - protein, 15 aa, Entamoeba dispar
EKGDWNPCKSKDNAK

SEQ ID NO: 2421032 - protein, 12 aa, Entamoeba dispar
EKGEEARAKGSA

SEQ ID NO: 2421033 - protein, 9 aa, Entamoeba dispar
EKGEEKDKW

SEQ ID NO: 2421034 - protein, 5 aa, Entamoeba dispar
EKGEK

SEQ ID NO: 2421035 - protein, 9 aa, Entamoeba dispar
EKGEKNEIV

SEQ ID NO: 2421036 - protein, 16 aa, Entamoeba dispar
EKGELKKRDKARTERK

SEQ ID NO: 2421037 - protein, 9 aa, Entamoeba dispar
EKGENNINE

SEQ ID NO: 2421038 - protein, 7 aa, Entamoeba dispar
EKGFDYE

SEQ ID NO: 2421039 - protein, 8 aa, Entamoeba dispar
EKGGFTSE

SEQ ID NO: 2421040 - protein, 12 aa, Entamoeba dispar
EKGGMTNASPII

SEQ ID NO: 2421041 - protein, 33 aa, Entamoeba dispar
EKGIAEKEVPNNTQEEQDDDSDGMSEDLEEDDD

SEQ ID NO: 2421042 - protein, 5 aa, Entamoeba dispar
EKGIE

SEQ ID NO: 2421043 - protein, 5 aa, Entamoeba dispar
EKGIR

SEQ ID NO: 2421044 - protein, 6 aa, Entamoeba dispar
EKGISY

SEQ ID NO: 2421045 - protein, 24 aa, Entamoeba dispar
EKGKIKSDEMTNRNEQKNEESEEL

SEQ ID NO: 2421046 - protein, 11 aa, Entamoeba dispar
EKGKLKKGRWS

SEQ ID NO: 2421047 - protein, 16 aa, Entamoeba dispar
EKGKNELKQGEKSTLD

SEQ ID NO: 2421048 - protein, 12 aa, Entamoeba dispar
EKGKNSNKYQLE

SEQ ID NO: 2421049 - protein, 9 aa, Entamoeba dispar
EKGKRINTT

SEQ ID NO: 2421050 - protein, 7 aa, Entamoeba dispar
EKGLNEN

SEQ ID NO: 2421051 - protein, 12 aa, Entamoeba dispar
EKGLQNKSFEPK

SEQ ID NO: 2421052 - protein, 5 aa, Entamoeba dispar
EKGLR

SEQ ID NO: 2421053 - protein, 7 aa, Entamoeba dispar
EKGLYKG

SEQ ID NO: 2421054 - protein, 13 aa, Entamoeba dispar
EKGMEEEIKENEI

SEQ ID NO: 2421055 - protein, 11 aa, Entamoeba dispar
EKGNEFDQNRD

SEQ ID NO: 2421056 - protein, 7 aa, Entamoeba dispar
EKGNEKE

SEQ ID NO: 2421057 - protein, 7 aa, Entamoeba dispar
EKGNKEI

SEQ ID NO: 2421058 - protein, 7 aa, Entamoeba dispar
EKGNSDV

SEQ ID NO: 2421059 - protein, 37 aa, Entamoeba dispar
EKGNYDEGFGYTKRSTNWEKKEEEHHTEPKKEEHSVE

SEQ ID NO: 2421060 - protein, 13 aa, Entamoeba dispar
EKGPKIEKVSEEE

SEQ ID NO: 2421061 - protein, 8 aa, Entamoeba dispar
EKGPQLNG

SEQ ID NO: 2421062 - protein, 9 aa, Entamoeba dispar
EKGQENGVN

SEQ ID NO: 2421063 - protein, 6 aa, Entamoeba dispar
EKGQNI

SEQ ID NO: 2421064 - protein, 6 aa, Entamoeba dispar
EKGRTD

SEQ ID NO: 2421065 - protein, 4 aa, Entamoeba dispar
EKGS

SEQ ID NO: 2421066 - protein, 16 aa, Entamoeba dispar
EKGSFNQPNVGSNTSR

SEQ ID NO: 2421067 - protein, 7 aa, Entamoeba dispar
EKGSTIK

SEQ ID NO: 2421068 - protein, 7 aa, Entamoeba dispar
EKGTEGE

SEQ ID NO: 2421069 - protein, 7 aa, Entamoeba dispar
EKGTGNI

SEQ ID NO: 2421070 - protein, 10 aa, Entamoeba dispar
EKGTNQRKNI

SEQ ID NO: 2421071 - protein, 8 aa, Entamoeba dispar
EKGTYQGK

SEQ ID NO: 2421072 - protein, 9 aa, Entamoeba dispar
EKGVEQNVE

SEQ ID NO: 2421073 - protein, 6 aa, Entamoeba dispar
EKGVID

SEQ ID NO: 2421074 - protein, 8 aa, Entamoeba dispar
EKGVKQGD

SEQ ID NO: 2421075 - protein, 10 aa, Entamoeba dispar
EKGVREGEEN

SEQ ID NO: 2421076 - protein, 7 aa, Entamoeba dispar
EKGVSPS

SEQ ID NO: 2421077 - protein, 8 aa, Entamoeba dispar
EKGYGKRV

SEQ ID NO: 2421078 - protein, 9 aa, Entamoeba dispar
EKGYKDGTT

SEQ ID NO: 2421079 - protein, 8 aa, Entamoeba dispar
EKGYTVKS

SEQ ID NO: 2421080 - protein, 10 aa, Entamoeba dispar
EKHANDKTER

SEQ ID NO: 2421081 - protein, 9 aa, Entamoeba dispar
EKHDKPEEF

SEQ ID NO: 2421082 - protein, 5 aa, Entamoeba dispar
EKHER

SEQ ID NO: 2421083 - protein, 7 aa, Entamoeba dispar
EKHKITS

SEQ ID NO: 2421084 - protein, 21 aa, Entamoeba dispar
EKHKNQIKKHERETTKKQFYN

SEQ ID NO: 2421085 - protein, 13 aa, Entamoeba dispar
EKHNEREGLRQNR

SEQ ID NO: 2421086 - protein, 6 aa, Entamoeba dispar
EKHPKQ

SEQ ID NO: 2421087 - protein, 8 aa, Entamoeba dispar
EKHPQIEE

SEQ ID NO: 2421088 - protein, 18 aa, Entamoeba dispar
EKHPTKRRRGMAPLDEQE

SEQ ID NO: 2421089 - protein, 6 aa, Entamoeba dispar
EKHTSY

SEQ ID NO: 2421090 - protein, 6 aa, Entamoeba dispar
EKIDDG

SEQ ID NO: 2421091 - protein, 14 aa, Entamoeba dispar
EKIDDSCNKLTKSE

SEQ ID NO: 2421092 - protein, 77 aa, Entamoeba dispar
EKIDNKPKNDEHFPKAGYKRKSIDSKTSCINEAKKDKKENSEFSKTTTQQSRDKLTQLNERKTVDPFANPVTPQIPV

SEQ ID NO: 2421093 - protein, 6 aa, Entamoeba dispar
EKIEEE

SEQ ID NO: 2421094 - protein, 9 aa, Entamoeba dispar
EKIEEGEII

SEQ ID NO: 2421095 - protein, 7 aa, Entamoeba dispar
EKIEGYS

SEQ ID NO: 2421096 - protein, 7 aa, Entamoeba dispar
EKIESKI

SEQ ID NO: 2421097 - protein, 12 aa, Entamoeba dispar
EKIETSKSVESI

SEQ ID NO: 2421098 - protein, 4 aa, Entamoeba dispar
EKIG

SEQ ID NO: 2421099 - protein, 10 aa, Entamoeba dispar
EKIGEKNGHV

SEQ ID NO: 2421100 - protein, 9 aa, Entamoeba dispar
EKIGENDKC

SEQ ID NO: 2421101 - protein, 7 aa, Entamoeba dispar
EKIGKTS

SEQ ID NO: 2421102 - protein, 5 aa, Entamoeba dispar
EKIGR

SEQ ID NO: 2421103 - protein, 14 aa, Entamoeba dispar
EKIGYYDNAEDAKI

SEQ ID NO: 2421104 - protein, 14 aa, Entamoeba dispar
EKIKAGDIGGTSDA

SEQ ID NO: 2421105 - protein, 15 aa, Entamoeba dispar
EKIKDAKKNNAKLKK

SEQ ID NO: 2421106 - protein, 12 aa, Entamoeba dispar
EKIKDIEKEKIE

SEQ ID NO: 2421107 - protein, 31 aa, Entamoeba dispar
EKIKEKKKNNPRLEKTLRESQQDNESMQEEW

SEQ ID NO: 2421108 - protein, 17 aa, Entamoeba dispar
EKIKKLDEERDLAKTVE

SEQ ID NO: 2421109 - protein, 14 aa, Entamoeba dispar
EKIKKQNKETNPNI

SEQ ID NO: 2421110 - protein, 24 aa, Entamoeba dispar
EKIKQQEERAESKQHQEHKKQQHK

SEQ ID NO: 2421111 - protein, 6 aa, Entamoeba dispar
EKIKSG

SEQ ID NO: 2421112 - protein, 12 aa, Entamoeba dispar
EKIKSNNKDLEQ

SEQ ID NO: 2421113 - protein, 17 aa, Entamoeba dispar
EKIKSRKEMKKNRLNQC

SEQ ID NO: 2421114 - protein, 8 aa, Entamoeba dispar
EKIKTNDL

SEQ ID NO: 2421115 - protein, 10 aa, Entamoeba dispar
EKIKTQNESI

SEQ ID NO: 2421116 - protein, 9 aa, Entamoeba dispar
EKINDNQLN

SEQ ID NO: 2421117 - protein, 13 aa, Entamoeba dispar
EKINKDNNQVNEE

SEQ ID NO: 2421118 - protein, 12 aa, Entamoeba dispar
EKINPNTPNHQY

SEQ ID NO: 2421119 - protein, 9 aa, Entamoeba dispar
EKINVPTDN

SEQ ID NO: 2421120 - protein, 12 aa, Entamoeba dispar
EKIPEEKKEPIH

SEQ ID NO: 2421121 - protein, 7 aa, Entamoeba dispar
EKIPHDK

SEQ ID NO: 2421122 - protein, 45 aa, Entamoeba dispar
EKIPNAARTLHETKGKGFQKSKTKLKRTDFKGKIDPYAVQSIKFD

SEQ ID NO: 2421123 - protein, 6 aa, Entamoeba dispar
EKIPNE

SEQ ID NO: 2421124 - protein, 49 aa, Entamoeba dispar
EKIPTKKTNESSKKEDKIKTSQKEEEIKENLDTEHQEKDDTKKQEDEKS

SEQ ID NO: 2421125 - protein, 11 aa, Entamoeba dispar
EKIQADKPKAI

SEQ ID NO: 2421126 - protein, 11 aa, Entamoeba dispar
EKIQENGGIEK

SEQ ID NO: 2421127 - protein, 10 aa, Entamoeba dispar
EKIQPEETTP

SEQ ID NO: 2421128 - protein, 14 aa, Entamoeba dispar
EKIREAKKKDRTLK

SEQ ID NO: 2421129 - protein, 15 aa, Entamoeba dispar
EKIREAKKKDRTLKR

SEQ ID NO: 2421130 - protein, 4 aa, Entamoeba dispar
EKIS

SEQ ID NO: 2421131 - protein, 8 aa, Entamoeba dispar
EKISAHPD

SEQ ID NO: 2421132 - protein, 6 aa, Entamoeba dispar
EKISDE

SEQ ID NO: 2421133 - protein, 7 aa, Entamoeba dispar
EKISGSD

SEQ ID NO: 2421134 - protein, 5 aa, Entamoeba dispar
EKISP

SEQ ID NO: 2421135 - protein, 4 aa, Entamoeba dispar
EKIT

SEQ ID NO: 2421136 - protein, 19 aa, Entamoeba dispar
EKITDDNNKLNEEIDSLDR

SEQ ID NO: 2421137 - protein, 4 aa, Entamoeba dispar
EKKA

SEQ ID NO: 2421138 - protein, 9 aa, Entamoeba dispar
EKKAPEYQP

SEQ ID NO: 2421139 - protein, 25 aa, Entamoeba dispar
EKKDETTTLDQQKNDTTLVEDKDET

SEQ ID NO: 2421140 - protein, 10 aa, Entamoeba dispar
EKKDGTPDKV

SEQ ID NO: 2421141 - protein, 7 aa, Entamoeba dispar
EKKDKEW

SEQ ID NO: 2421142 - protein, 18 aa, Entamoeba dispar
EKKDKKHSDKKKEKRKSF

SEQ ID NO: 2421143 - protein, 8 aa, Entamoeba dispar
EKKDKMAK

SEQ ID NO: 2421144 - protein, 5 aa, Entamoeba dispar
EKKDL

SEQ ID NO: 2421145 - protein, 6 aa, Entamoeba dispar
EKKDRI

SEQ ID NO: 2421146 - protein, 7 aa, Entamoeba dispar
EKKDSHN

SEQ ID NO: 2421147 - protein, 10 aa, Entamoeba dispar
EKKDSKLKEI

SEQ ID NO: 2421148 - protein, 15 aa, Entamoeba dispar
EKKDTNKQKKEDDLD

SEQ ID NO: 2421149 - protein, 8 aa, Entamoeba dispar
EKKEDRRV

SEQ ID NO: 2421150 - protein, 13 aa, Entamoeba dispar
EKKEEAEKAEREM

SEQ ID NO: 2421151 - protein, 12 aa, Entamoeba dispar
EKKEEDIGAGDQ

SEQ ID NO: 2421152 - protein, 15 aa, Entamoeba dispar
EKKEEETNSNNKEEI

SEQ ID NO: 2421153 - protein, 21 aa, Entamoeba dispar
EKKEEKKPKGITTNSNQTTPS

SEQ ID NO: 2421154 - protein, 8 aa, Entamoeba dispar
EKKEEPIK

SEQ ID NO: 2421155 - protein, 8 aa, Entamoeba dispar
EKKEERRV

SEQ ID NO: 2421156 - protein, 12 aa, Entamoeba dispar
EKKEGGKTEDSK

SEQ ID NO: 2421157 - protein, 23 aa, Entamoeba dispar
EKKEGKEITEKIQKEDKECETNV

SEQ ID NO: 2421158 - protein, 6 aa, Entamoeba dispar
EKKEIR

SEQ ID NO: 2421159 - protein, 7 aa, Entamoeba dispar
EKKEKKI

SEQ ID NO: 2421160 - protein, 13 aa, Entamoeba dispar
EKKEKNKENPIGT

SEQ ID NO: 2421161 - protein, 9 aa, Entamoeba dispar
EKKEKSYSY

SEQ ID NO: 2421162 - protein, 9 aa, Entamoeba dispar
EKKEKYYNT

SEQ ID NO: 2421163 - protein, 7 aa, Entamoeba dispar
EKKELKE

SEQ ID NO: 2421164 - protein, 26 aa, Entamoeba dispar
EKKEMNKRKIKENMKKEWNERKESGD

SEQ ID NO: 2421165 - protein, 8 aa, Entamoeba dispar
EKKENEQK

SEQ ID NO: 2421166 - protein, 8 aa, Entamoeba dispar
EKKENIEK

SEQ ID NO: 2421167 - protein, 41 aa, Entamoeba dispar
EKKENTNTKQSMEEEVKTTDELKESDISEEKEEKQSDVDPN

SEQ ID NO: 2421168 - protein, 16 aa, Entamoeba dispar
EKKEQMRKEDERKNGI

SEQ ID NO: 2421169 - protein, 9 aa, Entamoeba dispar
EKKESDVVS

SEQ ID NO: 2421170 - protein, 62 aa, Entamoeba dispar
EKKESSDADMSEEEDDNSGQEEINNKKEDTNKEENDMNKEEEEGASDSGVDECSSNEEMGDD

SEQ ID NO: 2421171 - protein, 12 aa, Entamoeba dispar
EKKETTFSPEIK

SEQ ID NO: 2421172 - protein, 7 aa, Entamoeba dispar
EKKGEEY

SEQ ID NO: 2421173 - protein, 12 aa, Entamoeba dispar
EKKGKKNGNELF

SEQ ID NO: 2421174 - protein, 18 aa, Entamoeba dispar
EKKGKVEQRDKDKSYENI

SEQ ID NO: 2421175 - protein, 5 aa, Entamoeba dispar
EKKGQ

SEQ ID NO: 2421176 - protein, 8 aa, Entamoeba dispar
EKKGQIIK

SEQ ID NO: 2421177 - protein, 30 aa, Entamoeba dispar
EKKGSKDTTQNKEVSGSLLPESSEDEVFDT

SEQ ID NO: 2421178 - protein, 13 aa, Entamoeba dispar
EKKGVKPKESSDI

SEQ ID NO: 2421179 - protein, 8 aa, Entamoeba dispar
EKKHTSEY

SEQ ID NO: 2421180 - protein, 7 aa, Entamoeba dispar
EKKIEKN

SEQ ID NO: 2421181 - protein, 38 aa, Entamoeba dispar
EKKIEKPKPVEEKKPVEEKKPVEEKKPVEEKKPVEEIK

SEQ ID NO: 2421182 - protein, 13 aa, Entamoeba dispar
EKKIEKTKEEIKI

SEQ ID NO: 2421183 - protein, 15 aa, Entamoeba dispar
EKKITKKIEDIKKEE

SEQ ID NO: 2421184 - protein, 4 aa, Entamoeba dispar
EKKK

SEQ ID NO: 2421185 - protein, 9 aa, Entamoeba dispar
EKKKELELK

SEQ ID NO: 2421186 - protein, 9 aa, Entamoeba dispar
EKKKERTRD

SEQ ID NO: 2421187 - protein, 8 aa, Entamoeba dispar
EKKKGNIC

SEQ ID NO: 2421188 - protein, 8 aa, Entamoeba dispar
EKKKGYER

SEQ ID NO: 2421189 - protein, 7 aa, Entamoeba dispar
EKKKIEN

SEQ ID NO: 2421190 - protein, 25 aa, Entamoeba dispar
EKKKKEEEERLRREEEEKRSNESMI

SEQ ID NO: 2421191 - protein, 11 aa, Entamoeba dispar
EKKKKKATKAL

SEQ ID NO: 2421192 - protein, 41 aa, Entamoeba dispar
EKKKKKENQDAEKEEKQVKEPKEKKPRAKNQKKDEVKEIKT

SEQ ID NO: 2421193 - protein, 11 aa, Entamoeba dispar
EKKKKNGTKRI

SEQ ID NO: 2421194 - protein, 6 aa, Entamoeba dispar
EKKKQI

SEQ ID NO: 2421195 - protein, 16 aa, Entamoeba dispar
EKKKRELRAEHNGKMT

SEQ ID NO: 2421196 - protein, 32 aa, Entamoeba dispar
EKKKTDEIEKKKIDESKPKKNEEESDSPIEIK

SEQ ID NO: 2421197 - protein, 9 aa, Entamoeba dispar
EKKKTTPKM

SEQ ID NO: 2421198 - protein, 4 aa, Entamoeba dispar
EKKL

SEQ ID NO: 2421199 - protein, 9 aa, Entamoeba dispar
EKKLEELKR

SEQ ID NO: 2421200 - protein, 16 aa, Entamoeba dispar
EKKLKRYKVEEQQEKK

SEQ ID NO: 2421201 - protein, 7 aa, Entamoeba dispar
EKKLNDP

SEQ ID NO: 2421202 - protein, 8 aa, Entamoeba dispar
EKKLNSDD

SEQ ID NO: 2421203 - protein, 7 aa, Entamoeba dispar
EKKLTDL

SEQ ID NO: 2421204 - protein, 8 aa, Entamoeba dispar
EKKLYEST

SEQ ID NO: 2421205 - protein, 8 aa, Entamoeba dispar
EKKMEEEN

SEQ ID NO: 2421206 - protein, 6 aa, Entamoeba dispar
EKKMTV

SEQ ID NO: 2421207 - protein, 4 aa, Entamoeba dispar
EKKN

SEQ ID NO: 2421208 - protein, 8 aa, Entamoeba dispar
EKKNDNVQ

SEQ ID NO: 2421209 - protein, 9 aa, Entamoeba dispar
EKKNETKLI

SEQ ID NO: 2421210 - protein, 12 aa, Entamoeba dispar
EKKNKNDSPQIT

SEQ ID NO: 2421211 - protein, 21 aa, Entamoeba dispar
EKKNNEKKKKTKKNITKQIET

SEQ ID NO: 2421212 - protein, 36 aa, Entamoeba dispar
EKKNQQVISQDNNKIDDFDQSEKDKLEKSNEKLNSI

SEQ ID NO: 2421213 - protein, 9 aa, Entamoeba dispar
EKKNQTQNK

SEQ ID NO: 2421214 - protein, 11 aa, Entamoeba dispar
EKKPAQTDGEP

SEQ ID NO: 2421215 - protein, 11 aa, Entamoeba dispar
EKKPKKLNTKE

SEQ ID NO: 2421216 - protein, 9 aa, Entamoeba dispar
EKKPKKVNY

SEQ ID NO: 2421217 - protein, 12 aa, Entamoeba dispar
EKKPKQPKEEDK

SEQ ID NO: 2421218 - protein, 8 aa, Entamoeba dispar
EKKPKRIT

SEQ ID NO: 2421219 - protein, 7 aa, Entamoeba dispar
EKKPLKE

SEQ ID NO: 2421220 - protein, 8 aa, Entamoeba dispar
EKKPRISS

SEQ ID NO: 2421221 - protein, 4 aa, Entamoeba dispar
EKKQ

SEQ ID NO: 2421222 - protein, 14 aa, Entamoeba dispar
EKKQLDSKVGEGKD

SEQ ID NO: 2421223 - protein, 9 aa, Entamoeba dispar
EKKQNIQDE

SEQ ID NO: 2421224 - protein, 39 aa, Entamoeba dispar
EKKQTRKKKALSVSSHPSSETPKEESRPKLTRTKSGDPL

SEQ ID NO: 2421225 - protein, 13 aa, Entamoeba dispar
EKKQYKEWPPLPQ

SEQ ID NO: 2421226 - protein, 12 aa, Entamoeba dispar
EKKRENKSYEAF

SEQ ID NO: 2421227 - protein, 6 aa, Entamoeba dispar
EKKRIK

SEQ ID NO: 2421228 - protein, 16 aa, Entamoeba dispar
EKKRKHELDTKLNKRS

SEQ ID NO: 2421229 - protein, 21 aa, Entamoeba dispar
EKKRKKITVKEKNERREGELT

SEQ ID NO: 2421230 - protein, 7 aa, Entamoeba dispar
EKKRKNQ

SEQ ID NO: 2421231 - protein, 15 aa, Entamoeba dispar
EKKRKSRRKKGVMDD

SEQ ID NO: 2421232 - protein, 31 aa, Entamoeba dispar
EKKRLEEGEEIPIRKKREKKTKKSHSTFGEA

SEQ ID NO: 2421233 - protein, 21 aa, Entamoeba dispar
EKKRQMEKALKQGAATGGVKK

SEQ ID NO: 2421234 - protein, 21 aa, Entamoeba dispar
EKKRVAREQALKKKQSKRADL

SEQ ID NO: 2421235 - protein, 7 aa, Entamoeba dispar
EKKRYQK

SEQ ID NO: 2421236 - protein, 10 aa, Entamoeba dispar
EKKSDEAIQR

SEQ ID NO: 2421237 - protein, 14 aa, Entamoeba dispar
EKKSEIKDQDKLDE

SEQ ID NO: 2421238 - protein, 28 aa, Entamoeba dispar
EKKSESPTTNSSLNNSLNTQFKKQTGLN

SEQ ID NO: 2421239 - protein, 9 aa, Entamoeba dispar
EKKSIKKEM

SEQ ID NO: 2421240 - protein, 8 aa, Entamoeba dispar
EKKSIQDE

SEQ ID NO: 2421241 - protein, 9 aa, Entamoeba dispar
EKKSKKTEQ

SEQ ID NO: 2421242 - protein, 9 aa, Entamoeba dispar
EKKSNRKVP

SEQ ID NO: 2421243 - protein, 34 aa, Entamoeba dispar
EKKSPRNKHTPKGHISKSARGSPHDSLKEPIGDP

SEQ ID NO: 2421244 - protein, 15 aa, Entamoeba dispar
EKKTSRDVSGVEKSN

SEQ ID NO: 2421245 - protein, 8 aa, Entamoeba dispar
EKKVKNEM

SEQ ID NO: 2421246 - protein, 8 aa, Entamoeba dispar
EKKVTENP

SEQ ID NO: 2421247 - protein, 4 aa, Entamoeba dispar
EKKY

SEQ ID NO: 2421248 - protein, 8 aa, Entamoeba dispar
EKKYEDVE

SEQ ID NO: 2421249 - protein, 15 aa, Entamoeba dispar
EKKYKTSYETKQPQA

SEQ ID NO: 2421250 - protein, 9 aa, Entamoeba dispar
EKKYRTLTK

SEQ ID NO: 2421251 - protein, 18 aa, Entamoeba dispar
EKKYRTMTTVGNKPSFNE

SEQ ID NO: 2421252 - protein, 10 aa, Entamoeba dispar
EKKYVQGNSY

SEQ ID NO: 2421253 - protein, 23 aa, Entamoeba dispar
EKLDETEVEKEDAEKKKKDIEKE

SEQ ID NO: 2421254 - protein, 7 aa, Entamoeba dispar
EKLEGRN

SEQ ID NO: 2421255 - protein, 13 aa, Entamoeba dispar
EKLEKEKKERRIR

SEQ ID NO: 2421256 - protein, 10 aa, Entamoeba dispar
EKLETQSVDI

SEQ ID NO: 2421257 - protein, 5 aa, Entamoeba dispar
EKLGN

SEQ ID NO: 2421258 - protein, 7 aa, Entamoeba dispar
EKLGSEN

SEQ ID NO: 2421259 - protein, 18 aa, Entamoeba dispar
EKLKATMKQEANSIVQSQ

SEQ ID NO: 2421260 - protein, 10 aa, Entamoeba dispar
EKLKDNDPTV

SEQ ID NO: 2421261 - protein, 10 aa, Entamoeba dispar
EKLKEDKNSL

SEQ ID NO: 2421262 - protein, 16 aa, Entamoeba dispar
EKLKEKFDENETNKIS

SEQ ID NO: 2421263 - protein, 11 aa, Entamoeba dispar
EKLKESQKELE

SEQ ID NO: 2421264 - protein, 19 aa, Entamoeba dispar
EKLKGGKTKGSKKSSVADR

SEQ ID NO: 2421265 - protein, 10 aa, Entamoeba dispar
EKLKGKEKWD

SEQ ID NO: 2421266 - protein, 13 aa, Entamoeba dispar
EKLKPNKFNDSPI

SEQ ID NO: 2421267 - protein, 22 aa, Entamoeba dispar
EKLKQSVTKENDKNITIQRTPS

SEQ ID NO: 2421268 - protein, 9 aa, Entamoeba dispar
EKLKTENWN

SEQ ID NO: 2421269 - protein, 4 aa, Entamoeba dispar
EKLN

SEQ ID NO: 2421270 - protein, 9 aa, Entamoeba dispar
EKLNEEPEK

SEQ ID NO: 2421271 - protein, 6 aa, Entamoeba dispar
EKLNEY

SEQ ID NO: 2421272 - protein, 11 aa, Entamoeba dispar
EKLNKDNKQEI

SEQ ID NO: 2421273 - protein, 14 aa, Entamoeba dispar
EKLNSSKDDIRTEA

SEQ ID NO: 2421274 - protein, 9 aa, Entamoeba dispar
EKLPEYKEE

SEQ ID NO: 2421275 - protein, 16 aa, Entamoeba dispar
EKLPKYKEWKNKQNEK

SEQ ID NO: 2421276 - protein, 5 aa, Entamoeba dispar
EKLPL

SEQ ID NO: 2421277 - protein, 6 aa, Entamoeba dispar
EKLPSQ

SEQ ID NO: 2421278 - protein, 7 aa, Entamoeba dispar
EKLQDID

SEQ ID NO: 2421279 - protein, 8 aa, Entamoeba dispar
EKLQERVK

SEQ ID NO: 2421280 - protein, 13 aa, Entamoeba dispar
EKLQPTEDKTEEL

SEQ ID NO: 2421281 - protein, 7 aa, Entamoeba dispar
EKLQRQG

SEQ ID NO: 2421282 - protein, 7 aa, Entamoeba dispar
EKLRSGK

SEQ ID NO: 2421283 - protein, 11 aa, Entamoeba dispar
EKLSANAGTTA

SEQ ID NO: 2421284 - protein, 23 aa, Entamoeba dispar
EKLSEKVSEESNPILRKQPKRTS

SEQ ID NO: 2421285 - protein, 8 aa, Entamoeba dispar
EKLSPSFK

SEQ ID NO: 2421286 - protein, 22 aa, Entamoeba dispar
EKLTEETKRLTTTTSNEKEEDF

SEQ ID NO: 2421287 - protein, 11 aa, Entamoeba dispar
EKLTSSDVEQN

SEQ ID NO: 2421288 - protein, 6 aa, Entamoeba dispar
EKMAIK

SEQ ID NO: 2421289 - protein, 22 aa, Entamoeba dispar
EKMEKKQEKKLQKIEKKGEPRT

SEQ ID NO: 2421290 - protein, 7 aa, Entamoeba dispar
EKMKEIA

SEQ ID NO: 2421291 - protein, 11 aa, Entamoeba dispar
EKMNENELPEE

SEQ ID NO: 2421292 - protein, 7 aa, Entamoeba dispar
EKMNNQH

SEQ ID NO: 2421293 - protein, 7 aa, Entamoeba dispar
EKMNTTE

SEQ ID NO: 2421294 - protein, 4 aa, Entamoeba dispar
EKMT

SEQ ID NO: 2421295 - protein, 4 aa, Entamoeba dispar
EKNA

SEQ ID NO: 2421296 - protein, 5 aa, Entamoeba dispar
EKNAL

SEQ ID NO: 2421297 - protein, 14 aa, Entamoeba dispar
EKNDKSIVKYIVQF

SEQ ID NO: 2421298 - protein, 18 aa, Entamoeba dispar
EKNDKVLEKGEGGGIGNT

SEQ ID NO: 2421299 - protein, 9 aa, Entamoeba dispar
EKNDSEVNL

SEQ ID NO: 2421300 - protein, 5 aa, Entamoeba dispar
EKNEC

SEQ ID NO: 2421301 - protein, 6 aa, Entamoeba dispar
EKNEDI

SEQ ID NO: 2421302 - protein, 8 aa, Entamoeba dispar
EKNEENIS

SEQ ID NO: 2421303 - protein, 8 aa, Entamoeba dispar
EKNEHYHK

SEQ ID NO: 2421304 - protein, 7 aa, Entamoeba dispar
EKNEIDS

SEQ ID NO: 2421305 - protein, 6 aa, Entamoeba dispar
EKNEIN

SEQ ID NO: 2421306 - protein, 15 aa, Entamoeba dispar
EKNEIQKMTSAPSAV

SEQ ID NO: 2421307 - protein, 8 aa, Entamoeba dispar
EKNEKDKI

SEQ ID NO: 2421308 - protein, 17 aa, Entamoeba dispar
EKNEKVSEKGESSGIRD

SEQ ID NO: 2421309 - protein, 6 aa, Entamoeba dispar
EKNELE

SEQ ID NO: 2421310 - protein, 7 aa, Entamoeba dispar
EKNENGF

SEQ ID NO: 2421311 - protein, 9 aa, Entamoeba dispar
EKNEPTELS

SEQ ID NO: 2421312 - protein, 7 aa, Entamoeba dispar
EKNESIN

SEQ ID NO: 2421313 - protein, 8 aa, Entamoeba dispar
EKNESLDD

SEQ ID NO: 2421314 - protein, 28 aa, Entamoeba dispar
EKNESWSSFEKAKDVKVPKMNNKDPQAG

SEQ ID NO: 2421315 - protein, 9 aa, Entamoeba dispar
EKNEYKNMT

SEQ ID NO: 2421316 - protein, 10 aa, Entamoeba dispar
EKNEYTKFDS

SEQ ID NO: 2421317 - protein, 4 aa, Entamoeba dispar
EKNF

SEQ ID NO: 2421318 - protein, 7 aa, Entamoeba dispar
EKNGFSR

SEQ ID NO: 2421319 - protein, 10 aa, Entamoeba dispar
EKNGGPLSTP

SEQ ID NO: 2421320 - protein, 10 aa, Entamoeba dispar
EKNGLTSDQL

SEQ ID NO: 2421321 - protein, 10 aa, Entamoeba dispar
EKNGTSSLKA

SEQ ID NO: 2421322 - protein, 8 aa, Entamoeba dispar
EKNGYISA

SEQ ID NO: 2421323 - protein, 4 aa, Entamoeba dispar
EKNI

SEQ ID NO: 2421324 - protein, 24 aa, Entamoeba dispar
EKNIEKRKENNKEEEDNNNKITSI

SEQ ID NO: 2421325 - protein, 11 aa, Entamoeba dispar
EKNIERCSEQN

SEQ ID NO: 2421326 - protein, 19 aa, Entamoeba dispar
EKNIKKEEEKIERPIEGEK

SEQ ID NO: 2421327 - protein, 9 aa, Entamoeba dispar
EKNKCNKCS

SEQ ID NO: 2421328 - protein, 12 aa, Entamoeba dispar
EKNKESLNDNDK

SEQ ID NO: 2421329 - protein, 9 aa, Entamoeba dispar
EKNKIDKMK

SEQ ID NO: 2421330 - protein, 20 aa, Entamoeba dispar
EKNKNIRVSEVPSNPKEELN

SEQ ID NO: 2421331 - protein, 9 aa, Entamoeba dispar
EKNKNPETL

SEQ ID NO: 2421332 - protein, 19 aa, Entamoeba dispar
EKNKNRKENEMNARQASEN

SEQ ID NO: 2421333 - protein, 6 aa, Entamoeba dispar
EKNKPL

SEQ ID NO: 2421334 - protein, 10 aa, Entamoeba dispar
EKNKRLPVDS

SEQ ID NO: 2421335 - protein, 10 aa, Entamoeba dispar
EKNKSKTYDE

SEQ ID NO: 2421336 - protein, 10 aa, Entamoeba dispar
EKNKSSKSEF

SEQ ID NO: 2421337 - protein, 10 aa, Entamoeba dispar
EKNKVQQGDI

SEQ ID NO: 2421338 - protein, 7 aa, Entamoeba dispar
EKNKYKE

SEQ ID NO: 2421339 - protein, 9 aa, Entamoeba dispar
EKNLGKDEI

SEQ ID NO: 2421340 - protein, 8 aa, Entamoeba dispar
EKNNENFD

SEQ ID NO: 2421341 - protein, 6 aa, Entamoeba dispar
EKNNGL

SEQ ID NO: 2421342 - protein, 11 aa, Entamoeba dispar
EKNNKINEQEQ

SEQ ID NO: 2421343 - protein, 8 aa, Entamoeba dispar
EKNNKQKY

SEQ ID NO: 2421344 - protein, 9 aa, Entamoeba dispar
EKNNKTTNI

SEQ ID NO: 2421345 - protein, 9 aa, Entamoeba dispar
EKNNNQPLK

SEQ ID NO: 2421346 - protein, 6 aa, Entamoeba dispar
EKNNQT

SEQ ID NO: 2421347 - protein, 4 aa, Entamoeba dispar
EKNP

SEQ ID NO: 2421348 - protein, 6 aa, Entamoeba dispar
EKNPDY

SEQ ID NO: 2421349 - protein, 13 aa, Entamoeba dispar
EKNPPKTPRKCLI

SEQ ID NO: 2421350 - protein, 8 aa, Entamoeba dispar
EKNPSERW

SEQ ID NO: 2421351 - protein, 7 aa, Entamoeba dispar
EKNQIES

SEQ ID NO: 2421352 - protein, 16 aa, Entamoeba dispar
EKNQKKPKKIGTEYKE

SEQ ID NO: 2421353 - protein, 6 aa, Entamoeba dispar
EKNQSI

SEQ ID NO: 2421354 - protein, 19 aa, Entamoeba dispar
EKNRAAKSPVIVIDVDETK

SEQ ID NO: 2421355 - protein, 17 aa, Entamoeba dispar
EKNRKDKRKKISDEKEE

SEQ ID NO: 2421356 - protein, 10 aa, Entamoeba dispar
EKNRPPKPEM

SEQ ID NO: 2421357 - protein, 9 aa, Entamoeba dispar
EKNSGEIEE

SEQ ID NO: 2421358 - protein, 12 aa, Entamoeba dispar
EKNSMYSFKSQL

SEQ ID NO: 2421359 - protein, 4 aa, Entamoeba dispar
EKNT

SEQ ID NO: 2421360 - protein, 15 aa, Entamoeba dispar
EKNTALKNSKSVPLQ

SEQ ID NO: 2421361 - protein, 8 aa, Entamoeba dispar
EKNTKSNE

SEQ ID NO: 2421362 - protein, 6 aa, Entamoeba dispar
EKNTNF

SEQ ID NO: 2421363 - protein, 5 aa, Entamoeba dispar
EKNTV

SEQ ID NO: 2421364 - protein, 13 aa, Entamoeba dispar
EKNVANNDNKNVV

SEQ ID NO: 2421365 - protein, 8 aa, Entamoeba dispar
EKNYIEAK

SEQ ID NO: 2421366 - protein, 12 aa, Entamoeba dispar
EKNYSQPPVIQF

SEQ ID NO: 2421367 - protein, 4 aa, Entamoeba dispar
EKPA

SEQ ID NO: 2421368 - protein, 9 aa, Entamoeba dispar
EKPEAEEPL

SEQ ID NO: 2421369 - protein, 7 aa, Entamoeba dispar
EKPEELG

SEQ ID NO: 2421370 - protein, 6 aa, Entamoeba dispar
EKPEKI

SEQ ID NO: 2421371 - protein, 5 aa, Entamoeba dispar
EKPEL

SEQ ID NO: 2421372 - protein, 8 aa, Entamoeba dispar
EKPELQKA

SEQ ID NO: 2421373 - protein, 8 aa, Entamoeba dispar
EKPERAKQ

SEQ ID NO: 2421374 - protein, 7 aa, Entamoeba dispar
EKPESDG

SEQ ID NO: 2421375 - protein, 12 aa, Entamoeba dispar
EKPETPIAQPAE

SEQ ID NO: 2421376 - protein, 13 aa, Entamoeba dispar
EKPIDQPASTPLI

SEQ ID NO: 2421377 - protein, 12 aa, Entamoeba dispar
EKPIEKATQQDV

SEQ ID NO: 2421378 - protein, 7 aa, Entamoeba dispar
EKPIGST

SEQ ID NO: 2421379 - protein, 6 aa, Entamoeba dispar
EKPIKS

SEQ ID NO: 2421380 - protein, 18 aa, Entamoeba dispar
EKPIYDNYKDEDNEQWMN

SEQ ID NO: 2421381 - protein, 15 aa, Entamoeba dispar
EKPKESIQPPKDLEE

SEQ ID NO: 2421382 - protein, 10 aa, Entamoeba dispar
EKPKITHETD

SEQ ID NO: 2421383 - protein, 9 aa, Entamoeba dispar
EKPKLRNDM

SEQ ID NO: 2421384 - protein, 10 aa, Entamoeba dispar
EKPKNAEDAS

SEQ ID NO: 2421385 - protein, 11 aa, Entamoeba dispar
EKPKSFAKRDE

SEQ ID NO: 2421386 - protein, 30 aa, Entamoeba dispar
EKPKSNLTQESSTEKPKESNTNIETPLSNP

SEQ ID NO: 2421387 - protein, 7 aa, Entamoeba dispar
EKPKYVS

SEQ ID NO: 2421388 - protein, 28 aa, Entamoeba dispar
EKPLGQDSVDGNVSDSMQIEENSLKSPV

SEQ ID NO: 2421389 - protein, 6 aa, Entamoeba dispar
EKPNIE

SEQ ID NO: 2421390 - protein, 7 aa, Entamoeba dispar
EKPNIPK

SEQ ID NO: 2421391 - protein, 10 aa, Entamoeba dispar
EKPNTPRDES

SEQ ID NO: 2421392 - protein, 5 aa, Entamoeba dispar
EKPNV

SEQ ID NO: 2421393 - protein, 6 aa, Entamoeba dispar
EKPQIV

SEQ ID NO: 2421394 - protein, 4 aa, Entamoeba dispar
EKPR

SEQ ID NO: 2421395 - protein, 9 aa, Entamoeba dispar
EKPRRKTKT

SEQ ID NO: 2421396 - protein, 6 aa, Entamoeba dispar
EKPRYN

SEQ ID NO: 2421397 - protein, 8 aa, Entamoeba dispar
EKPSAIQQ

SEQ ID NO: 2421398 - protein, 8 aa, Entamoeba dispar
EKPSGDGE

SEQ ID NO: 2421399 - protein, 4 aa, Entamoeba dispar
EKPT

SEQ ID NO: 2421400 - protein, 10 aa, Entamoeba dispar
EKPYDGEHKI

SEQ ID NO: 2421401 - protein, 13 aa, Entamoeba dispar
EKPYDGEHKIKGE

SEQ ID NO: 2421402 - protein, 9 aa, Entamoeba dispar
EKQADSNTN

SEQ ID NO: 2421403 - protein, 5 aa, Entamoeba dispar
EKQAP

SEQ ID NO: 2421404 - protein, 7 aa, Entamoeba dispar
EKQAYVD

SEQ ID NO: 2421405 - protein, 4 aa, Entamoeba dispar
EKQE

SEQ ID NO: 2421406 - protein, 9 aa, Entamoeba dispar
EKQEAHTND

SEQ ID NO: 2421407 - protein, 48 aa, Entamoeba dispar
EKQEIEEVKENKEIQEETNIENEEKKPKSNSDDKKLKNTKKLSKPSIG

SEQ ID NO: 2421408 - protein, 6 aa, Entamoeba dispar
EKQEKI

SEQ ID NO: 2421409 - protein, 24 aa, Entamoeba dispar
EKQENIEKEKEKKEKIEKEREKKM

SEQ ID NO: 2421410 - protein, 6 aa, Entamoeba dispar
EKQEVC

SEQ ID NO: 2421411 - protein, 62 aa, Entamoeba dispar
EKQFDRSNSRERRDDRMNRRRQEDDFRYQKGGKRVNSFNNRRRTDYSKRDNWRGRRNSTEKF

SEQ ID NO: 2421412 - protein, 7 aa, Entamoeba dispar
EKQFNEN

SEQ ID NO: 2421413 - protein, 6 aa, Entamoeba dispar
EKQGGP

SEQ ID NO: 2421414 - protein, 13 aa, Entamoeba dispar
EKQIENEENEFKQ

SEQ ID NO: 2421415 - protein, 8 aa, Entamoeba dispar
EKQIGEKN

SEQ ID NO: 2421416 - protein, 7 aa, Entamoeba dispar
EKQIQTK

SEQ ID NO: 2421417 - protein, 13 aa, Entamoeba dispar
EKQIRSPTSNVGR

SEQ ID NO: 2421418 - protein, 12 aa, Entamoeba dispar
EKQITSSFSNTR

SEQ ID NO: 2421419 - protein, 7 aa, Entamoeba dispar
EKQKDYA

SEQ ID NO: 2421420 - protein, 9 aa, Entamoeba dispar
EKQKEEDRK

SEQ ID NO: 2421421 - protein, 6 aa, Entamoeba dispar
EKQKEI

SEQ ID NO: 2421422 - protein, 11 aa, Entamoeba dispar
EKQKKNYTTYT

SEQ ID NO: 2421423 - protein, 9 aa, Entamoeba dispar
EKQKQAAIQ

SEQ ID NO: 2421424 - protein, 5 aa, Entamoeba dispar
EKQLN

SEQ ID NO: 2421425 - protein, 8 aa, Entamoeba dispar
EKQNAELG

SEQ ID NO: 2421426 - protein, 7 aa, Entamoeba dispar
EKQNEMK

SEQ ID NO: 2421427 - protein, 9 aa, Entamoeba dispar
EKQNENTLE

SEQ ID NO: 2421428 - protein, 23 aa, Entamoeba dispar
EKQNGVEEQKHNKKTIQQNKEEP

SEQ ID NO: 2421429 - protein, 13 aa, Entamoeba dispar
EKQNKGNDHMNEI

SEQ ID NO: 2421430 - protein, 9 aa, Entamoeba dispar
EKQNNIERI

SEQ ID NO: 2421431 - protein, 18 aa, Entamoeba dispar
EKQNRIKVEEESQKTIAE

SEQ ID NO: 2421432 - protein, 9 aa, Entamoeba dispar
EKQPSQASI

SEQ ID NO: 2421433 - protein, 9 aa, Entamoeba dispar
EKQPSSGKI

SEQ ID NO: 2421434 - protein, 4 aa, Entamoeba dispar
EKQQ

SEQ ID NO: 2421435 - protein, 12 aa, Entamoeba dispar
EKQQGVDEFENN

SEQ ID NO: 2421436 - protein, 8 aa, Entamoeba dispar
EKQQPVDN

SEQ ID NO: 2421437 - protein, 9 aa, Entamoeba dispar
EKQQQTTIM

SEQ ID NO: 2421438 - protein, 5 aa, Entamoeba dispar
EKQRN

SEQ ID NO: 2421439 - protein, 8 aa, Entamoeba dispar
EKQRPKNL

SEQ ID NO: 2421440 - protein, 18 aa, Entamoeba dispar
EKQRRVESTQDSNRFKTL

SEQ ID NO: 2421441 - protein, 6 aa, Entamoeba dispar
EKQSPM

SEQ ID NO: 2421442 - protein, 8 aa, Entamoeba dispar
EKQSRIEA

SEQ ID NO: 2421443 - protein, 13 aa, Entamoeba dispar
EKQTGEQELKYTD

SEQ ID NO: 2421444 - protein, 6 aa, Entamoeba dispar
EKQTMN

SEQ ID NO: 2421445 - protein, 8 aa, Entamoeba dispar
EKQTSDKI

SEQ ID NO: 2421446 - protein, 25 aa, Entamoeba dispar
EKQTTGVKEDEEIKETNSQVPNQND

SEQ ID NO: 2421447 - protein, 9 aa, Entamoeba dispar
EKQTTLPKG

SEQ ID NO: 2421448 - protein, 36 aa, Entamoeba dispar
EKQVSQKPSDTYNNDNKKVFTRRRNSFGSSTSKTRV

SEQ ID NO: 2421449 - protein, 13 aa, Entamoeba dispar
EKQVSSSSDNAPL

SEQ ID NO: 2421450 - protein, 9 aa, Entamoeba dispar
EKQYHESQK

SEQ ID NO: 2421451 - protein, 7 aa, Entamoeba dispar
EKRCSAT

SEQ ID NO: 2421452 - protein, 11 aa, Entamoeba dispar
EKRDEITEKEK

SEQ ID NO: 2421453 - protein, 5 aa, Entamoeba dispar
EKRDG

SEQ ID NO: 2421454 - protein, 6 aa, Entamoeba dispar
EKRDKI

SEQ ID NO: 2421455 - protein, 11 aa, Entamoeba dispar
EKRDKIEKDPF

SEQ ID NO: 2421456 - protein, 7 aa, Entamoeba dispar
EKRDKII

SEQ ID NO: 2421457 - protein, 7 aa, Entamoeba dispar
EKRDNQL

SEQ ID NO: 2421458 - protein, 12 aa, Entamoeba dispar
EKRDWDISSSER

SEQ ID NO: 2421459 - protein, 19 aa, Entamoeba dispar
EKRDYSQPITNSSSKLKQT

SEQ ID NO: 2421460 - protein, 5 aa, Entamoeba dispar
EKRED

SEQ ID NO: 2421461 - protein, 12 aa, Entamoeba dispar
EKREEEKKSERI

SEQ ID NO: 2421462 - protein, 20 aa, Entamoeba dispar
EKREEVKAANPDLKPKEITS

SEQ ID NO: 2421463 - protein, 13 aa, Entamoeba dispar
EKREKKKEDNVSN

SEQ ID NO: 2421464 - protein, 6 aa, Entamoeba dispar
EKREQD

SEQ ID NO: 2421465 - protein, 7 aa, Entamoeba dispar
EKRFTSE

SEQ ID NO: 2421466 - protein, 8 aa, Entamoeba dispar
EKRGEAVK

SEQ ID NO: 2421467 - protein, 11 aa, Entamoeba dispar
EKRGGAATPEM

SEQ ID NO: 2421468 - protein, 9 aa, Entamoeba dispar
EKRGINPDN

SEQ ID NO: 2421469 - protein, 12 aa, Entamoeba dispar
EKRGKELKGRNS

SEQ ID NO: 2421470 - protein, 8 aa, Entamoeba dispar
EKRGNKLS

SEQ ID NO: 2421471 - protein, 12 aa, Entamoeba dispar
EKRGYSGKYQYE

SEQ ID NO: 2421472 - protein, 10 aa, Entamoeba dispar
EKRIETASDY

SEQ ID NO: 2421473 - protein, 13 aa, Entamoeba dispar
EKRIQQAKEEIKR

SEQ ID NO: 2421474 - protein, 9 aa, Entamoeba dispar
EKRISDSQK

SEQ ID NO: 2421475 - protein, 7 aa, Entamoeba dispar
EKRITKK

SEQ ID NO: 2421476 - protein, 6 aa, Entamoeba dispar
EKRKEL

SEQ ID NO: 2421477 - protein, 8 aa, Entamoeba dispar
EKRKELYK

SEQ ID NO: 2421478 - protein, 9 aa, Entamoeba dispar
EKRKLAKNW

SEQ ID NO: 2421479 - protein, 19 aa, Entamoeba dispar
EKRKSLEIKHNTNEQIKRT

SEQ ID NO: 2421480 - protein, 13 aa, Entamoeba dispar
EKRKTSKKMKQQR

SEQ ID NO: 2421481 - protein, 5 aa, Entamoeba dispar
EKRKV

SEQ ID NO: 2421482 - protein, 7 aa, Entamoeba dispar
EKRMEER

SEQ ID NO: 2421483 - protein, 8 aa, Entamoeba dispar
EKRNDVEP

SEQ ID NO: 2421484 - protein, 9 aa, Entamoeba dispar
EKRNLNKRD

SEQ ID NO: 2421485 - protein, 8 aa, Entamoeba dispar
EKRNPGLN

SEQ ID NO: 2421486 - protein, 17 aa, Entamoeba dispar
EKRNSDKRAKSTGDGIR

SEQ ID NO: 2421487 - protein, 11 aa, Entamoeba dispar
EKRPDKNIRTI

SEQ ID NO: 2421488 - protein, 10 aa, Entamoeba dispar
EKRQTEENPI

SEQ ID NO: 2421489 - protein, 18 aa, Entamoeba dispar
EKRREEKETPEEKERKRL

SEQ ID NO: 2421490 - protein, 7 aa, Entamoeba dispar
EKRSKEV

SEQ ID NO: 2421491 - protein, 9 aa, Entamoeba dispar
EKRSNDNYK

SEQ ID NO: 2421492 - protein, 5 aa, Entamoeba dispar
EKRSV

SEQ ID NO: 2421493 - protein, 7 aa, Entamoeba dispar
EKRTAKK

SEQ ID NO: 2421494 - protein, 29 aa, Entamoeba dispar
EKRTETTVQTRDNKKEEEKEIERLKEENK

SEQ ID NO: 2421495 - protein, 10 aa, Entamoeba dispar
EKRTGYDGEI

SEQ ID NO: 2421496 - protein, 5 aa, Entamoeba dispar
EKRTR

SEQ ID NO: 2421497 - protein, 9 aa, Entamoeba dispar
EKRTSKQLP

SEQ ID NO: 2421498 - protein, 4 aa, Entamoeba dispar
EKRY

SEQ ID NO: 2421499 - protein, 6 aa, Entamoeba dispar
EKRYCD

SEQ ID NO: 2421500 - protein, 7 aa, Entamoeba dispar
EKRYSEA

SEQ ID NO: 2421501 - protein, 5 aa, Entamoeba dispar
EKRYT

SEQ ID NO: 2421502 - protein, 9 aa, Entamoeba dispar
EKSAKPITT

SEQ ID NO: 2421503 - protein, 43 aa, Entamoeba dispar
EKSDEVSDEDSKSSDEDDKSSDEDDDSHSVDEEERIANQNKKY

SEQ ID NO: 2421504 - protein, 8 aa, Entamoeba dispar
EKSDGESP

SEQ ID NO: 2421505 - protein, 7 aa, Entamoeba dispar
EKSDLLS

SEQ ID NO: 2421506 - protein, 11 aa, Entamoeba dispar
EKSDLNKMNSR

SEQ ID NO: 2421507 - protein, 4 aa, Entamoeba dispar
EKSE

SEQ ID NO: 2421508 - protein, 20 aa, Entamoeba dispar
EKSEAKKLDDQTQRLKEENK

SEQ ID NO: 2421509 - protein, 10 aa, Entamoeba dispar
EKSEDIEQTA

SEQ ID NO: 2421510 - protein, 8 aa, Entamoeba dispar
EKSEELKK

SEQ ID NO: 2421511 - protein, 9 aa, Entamoeba dispar
EKSEVPYKT

SEQ ID NO: 2421512 - protein, 6 aa, Entamoeba dispar
EKSGAV

SEQ ID NO: 2421513 - protein, 4 aa, Entamoeba dispar
EKSI

SEQ ID NO: 2421514 - protein, 5 aa, Entamoeba dispar
EKSID

SEQ ID NO: 2421515 - protein, 7 aa, Entamoeba dispar
EKSIDTD

SEQ ID NO: 2421516 - protein, 5 aa, Entamoeba dispar
EKSIN

SEQ ID NO: 2421517 - protein, 5 aa, Entamoeba dispar
EKSIS

SEQ ID NO: 2421518 - protein, 9 aa, Entamoeba dispar
EKSISLEDL

SEQ ID NO: 2421519 - protein, 11 aa, Entamoeba dispar
EKSKDFDKTID

SEQ ID NO: 2421520 - protein, 8 aa, Entamoeba dispar
EKSKENYH

SEQ ID NO: 2421521 - protein, 5 aa, Entamoeba dispar
EKSKI

SEQ ID NO: 2421522 - protein, 5 aa, Entamoeba dispar
EKSKN

SEQ ID NO: 2421523 - protein, 6 aa, Entamoeba dispar
EKSKPL

SEQ ID NO: 2421524 - protein, 10 aa, Entamoeba dispar
EKSKQQAEQL

SEQ ID NO: 2421525 - protein, 9 aa, Entamoeba dispar
EKSKTEELQ

SEQ ID NO: 2421526 - protein, 8 aa, Entamoeba dispar
EKSKVGTK

SEQ ID NO: 2421527 - protein, 26 aa, Entamoeba dispar
EKSKVSKRKQEKKDEGKEEKKEKSVP

SEQ ID NO: 2421528 - protein, 7 aa, Entamoeba dispar
EKSLPSI

SEQ ID NO: 2421529 - protein, 11 aa, Entamoeba dispar
EKSNPNLYNQD

SEQ ID NO: 2421530 - protein, 7 aa, Entamoeba dispar
EKSPDSI

SEQ ID NO: 2421531 - protein, 8 aa, Entamoeba dispar
EKSPKKGV

SEQ ID NO: 2421532 - protein, 11 aa, Entamoeba dispar
EKSPSKQSREE

SEQ ID NO: 2421533 - protein, 9 aa, Entamoeba dispar
EKSPVSSAV

SEQ ID NO: 2421534 - protein, 10 aa, Entamoeba dispar
EKSQENATEI

SEQ ID NO: 2421535 - protein, 20 aa, Entamoeba dispar
EKSQSTTPSQLPTQIEEIEE

SEQ ID NO: 2421536 - protein, 6 aa, Entamoeba dispar
EKSRAK

SEQ ID NO: 2421537 - protein, 9 aa, Entamoeba dispar
EKSRDLTDI

SEQ ID NO: 2421538 - protein, 18 aa, Entamoeba dispar
EKSRVSDSEIIQNSKRNG

SEQ ID NO: 2421539 - protein, 7 aa, Entamoeba dispar
EKSRYGN

SEQ ID NO: 2421540 - protein, 4 aa, Entamoeba dispar
EKSS

SEQ ID NO: 2421541 - protein, 6 aa, Entamoeba dispar
EKSSEP

SEQ ID NO: 2421542 - protein, 10 aa, Entamoeba dispar
EKSSFSNDTY

SEQ ID NO: 2421543 - protein, 8 aa, Entamoeba dispar
EKSSGVSD

SEQ ID NO: 2421544 - protein, 6 aa, Entamoeba dispar
EKSSLL

SEQ ID NO: 2421545 - protein, 7 aa, Entamoeba dispar
EKSSSEI

SEQ ID NO: 2421546 - protein, 4 aa, Entamoeba dispar
EKST

SEQ ID NO: 2421547 - protein, 5 aa, Entamoeba dispar
EKSTA

SEQ ID NO: 2421548 - protein, 7 aa, Entamoeba dispar
EKSTIRK

SEQ ID NO: 2421549 - protein, 27 aa, Entamoeba dispar
EKSTKDINNNKDNNEIQIPPQPQQHQP

SEQ ID NO: 2421550 - protein, 6 aa, Entamoeba dispar
EKSTKP

SEQ ID NO: 2421551 - protein, 42 aa, Entamoeba dispar
EKSTKSKDIKDLEKSKENKSIKKPQSEEKTNKVDKKKKSKIN

SEQ ID NO: 2421552 - protein, 17 aa, Entamoeba dispar
EKSVHEKHEQERRQTRL

SEQ ID NO: 2421553 - protein, 8 aa, Entamoeba dispar
EKSVTIEK

SEQ ID NO: 2421554 - protein, 4 aa, Entamoeba dispar
EKSY

SEQ ID NO: 2421555 - protein, 11 aa, Entamoeba dispar
EKSYNETSGRG

SEQ ID NO: 2421556 - protein, 7 aa, Entamoeba dispar
EKSYNRD

SEQ ID NO: 2421557 - protein, 7 aa, Entamoeba dispar
EKSYSSL

SEQ ID NO: 2421558 - protein, 5 aa, Entamoeba dispar
EKSYV

SEQ ID NO: 2421559 - protein, 7 aa, Entamoeba dispar
EKSYVSS

SEQ ID NO: 2421560 - protein, 15 aa, Entamoeba dispar
EKTAERRKRSNSIRE

SEQ ID NO: 2421561 - protein, 6 aa, Entamoeba dispar
EKTAKE

SEQ ID NO: 2421562 - protein, 7 aa, Entamoeba dispar
EKTANDL

SEQ ID NO: 2421563 - protein, 11 aa, Entamoeba dispar
EKTANGDLSTF

SEQ ID NO: 2421564 - protein, 6 aa, Entamoeba dispar
EKTANK

SEQ ID NO: 2421565 - protein, 6 aa, Entamoeba dispar
EKTDLP

SEQ ID NO: 2421566 - protein, 8 aa, Entamoeba dispar
EKTDSNPD

SEQ ID NO: 2421567 - protein, 13 aa, Entamoeba dispar
EKTEEDQKTEEDL

SEQ ID NO: 2421568 - protein, 13 aa, Entamoeba dispar
EKTEEQEDGEKDD

SEQ ID NO: 2421569 - protein, 12 aa, Entamoeba dispar
EKTEKEYKEKKQ

SEQ ID NO: 2421570 - protein, 10 aa, Entamoeba dispar
EKTEKRINKP

SEQ ID NO: 2421571 - protein, 6 aa, Entamoeba dispar
EKTELS

SEQ ID NO: 2421572 - protein, 9 aa, Entamoeba dispar
EKTEQTTPS

SEQ ID NO: 2421573 - protein, 8 aa, Entamoeba dispar
EKTETLTC

SEQ ID NO: 2421574 - protein, 4 aa, Entamoeba dispar
EKTF

SEQ ID NO: 2421575 - protein, 10 aa, Entamoeba dispar
EKTFSPSTSF

SEQ ID NO: 2421576 - protein, 7 aa, Entamoeba dispar
EKTGDEK

SEQ ID NO: 2421577 - protein, 7 aa, Entamoeba dispar
EKTGDVV

SEQ ID NO: 2421578 - protein, 6 aa, Entamoeba dispar
EKTGEI

SEQ ID NO: 2421579 - protein, 7 aa, Entamoeba dispar
EKTGFEE

SEQ ID NO: 2421580 - protein, 39 aa, Entamoeba dispar
EKTGGEEYAEKYKELRNQLNDERKEWKEEKEELKQKEEQ

SEQ ID NO: 2421581 - protein, 11 aa, Entamoeba dispar
EKTGGFGGNIG

SEQ ID NO: 2421582 - protein, 12 aa, Entamoeba dispar
EKTGHSGTLDPA

SEQ ID NO: 2421583 - protein, 8 aa, Entamoeba dispar
EKTGINNE

SEQ ID NO: 2421584 - protein, 17 aa, Entamoeba dispar
EKTGLSPQFRESDKKIV

SEQ ID NO: 2421585 - protein, 9 aa, Entamoeba dispar
EKTGNDGTT

SEQ ID NO: 2421586 - protein, 10 aa, Entamoeba dispar
EKTGSHSQYY

SEQ ID NO: 2421587 - protein, 17 aa, Entamoeba dispar
EKTHDSDLKTAKEKVIQ

SEQ ID NO: 2421588 - protein, 8 aa, Entamoeba dispar
EKTIDSRN

SEQ ID NO: 2421589 - protein, 7 aa, Entamoeba dispar
EKTIEEK

SEQ ID NO: 2421590 - protein, 12 aa, Entamoeba dispar
EKTIQKNEEEIK

SEQ ID NO: 2421591 - protein, 11 aa, Entamoeba dispar
EKTIQPEGQKM

SEQ ID NO: 2421592 - protein, 9 aa, Entamoeba dispar
EKTISPTEV

SEQ ID NO: 2421593 - protein, 5 aa, Entamoeba dispar
EKTIT

SEQ ID NO: 2421594 - protein, 7 aa, Entamoeba dispar
EKTITET

SEQ ID NO: 2421595 - protein, 16 aa, Entamoeba dispar
EKTKEKMTKENDGNTV

SEQ ID NO: 2421596 - protein, 8 aa, Entamoeba dispar
EKTKNYNP

SEQ ID NO: 2421597 - protein, 15 aa, Entamoeba dispar
EKTKQKILEALQLLE

SEQ ID NO: 2421598 - protein, 4 aa, Entamoeba dispar
EKTL

SEQ ID NO: 2421599 - protein, 11 aa, Entamoeba dispar
EKTLKGKSNVK

SEQ ID NO: 2421600 - protein, 7 aa, Entamoeba dispar
EKTLNTT

SEQ ID NO: 2421601 - protein, 6 aa, Entamoeba dispar
EKTLTE

SEQ ID NO: 2421602 - protein, 5 aa, Entamoeba dispar
EKTNE

SEQ ID NO: 2421603 - protein, 9 aa, Entamoeba dispar
EKTNESEYQ

SEQ ID NO: 2421604 - protein, 9 aa, Entamoeba dispar
EKTNQFSQD

SEQ ID NO: 2421605 - protein, 13 aa, Entamoeba dispar
EKTNRIEKRNQKI

SEQ ID NO: 2421606 - protein, 7 aa, Entamoeba dispar
EKTNTTV

SEQ ID NO: 2421607 - protein, 6 aa, Entamoeba dispar
EKTPIV

SEQ ID NO: 2421608 - protein, 6 aa, Entamoeba dispar
EKTPQS

SEQ ID NO: 2421609 - protein, 7 aa, Entamoeba dispar
EKTPSEF

SEQ ID NO: 2421610 - protein, 4 aa, Entamoeba dispar
EKTR

SEQ ID NO: 2421611 - protein, 6 aa, Entamoeba dispar
EKTRDD

SEQ ID NO: 2421612 - protein, 8 aa, Entamoeba dispar
EKTRERMT

SEQ ID NO: 2421613 - protein, 18 aa, Entamoeba dispar
EKTRETQTDKEKEEIRRR

SEQ ID NO: 2421614 - protein, 8 aa, Entamoeba dispar
EKTSATIG

SEQ ID NO: 2421615 - protein, 7 aa, Entamoeba dispar
EKTSDKF

SEQ ID NO: 2421616 - protein, 8 aa, Entamoeba dispar
EKTSNDIE

SEQ ID NO: 2421617 - protein, 8 aa, Entamoeba dispar
EKTSPHSM

SEQ ID NO: 2421618 - protein, 4 aa, Entamoeba dispar
EKTT

SEQ ID NO: 2421619 - protein, 6 aa, Entamoeba dispar
EKTTEL

SEQ ID NO: 2421620 - protein, 16 aa, Entamoeba dispar
EKTTIMKGEPTPISPS

SEQ ID NO: 2421621 - protein, 10 aa, Entamoeba dispar
EKTTITQPEE

SEQ ID NO: 2421622 - protein, 6 aa, Entamoeba dispar
EKTTSF

SEQ ID NO: 2421623 - protein, 7 aa, Entamoeba dispar
EKTTTKV

SEQ ID NO: 2421624 - protein, 4 aa, Entamoeba dispar
EKTV

SEQ ID NO: 2421625 - protein, 14 aa, Entamoeba dispar
EKTWKEPKKDFRTV

SEQ ID NO: 2421626 - protein, 4 aa, Entamoeba dispar
EKTY

SEQ ID NO: 2421627 - protein, 7 aa, Entamoeba dispar
EKTYNSV

SEQ ID NO: 2421628 - protein, 6 aa, Entamoeba dispar
EKVAEI

SEQ ID NO: 2421629 - protein, 5 aa, Entamoeba dispar
EKVDK

SEQ ID NO: 2421630 - protein, 8 aa, Entamoeba dispar
EKVEEGIK

SEQ ID NO: 2421631 - protein, 9 aa, Entamoeba dispar
EKVEENLQE

SEQ ID NO: 2421632 - protein, 9 aa, Entamoeba dispar
EKVGIDTAG

SEQ ID NO: 2421633 - protein, 4 aa, Entamoeba dispar
EKVK

SEQ ID NO: 2421634 - protein, 15 aa, Entamoeba dispar
EKVKGAINDGDITGN

SEQ ID NO: 2421635 - protein, 12 aa, Entamoeba dispar
EKVKKKNFSDGC

SEQ ID NO: 2421636 - protein, 11 aa, Entamoeba dispar
EKVKKQRKAGI

SEQ ID NO: 2421637 - protein, 8 aa, Entamoeba dispar
EKVKPNDN

SEQ ID NO: 2421638 - protein, 7 aa, Entamoeba dispar
EKVNEIE

SEQ ID NO: 2421639 - protein, 13 aa, Entamoeba dispar
EKVNYQRNERKSI

SEQ ID NO: 2421640 - protein, 4 aa, Entamoeba dispar
EKVP

SEQ ID NO: 2421641 - protein, 10 aa, Entamoeba dispar
EKVQQQPTEP

SEQ ID NO: 2421642 - protein, 8 aa, Entamoeba dispar
EKVSDEIE

SEQ ID NO: 2421643 - protein, 24 aa, Entamoeba dispar
EKVTKLEEVPTGSDDAYVLYYRLI

SEQ ID NO: 2421644 - protein, 10 aa, Entamoeba dispar
EKVTPNSGNH

SEQ ID NO: 2421645 - protein, 12 aa, Entamoeba dispar
EKWKPSAGSHVI

SEQ ID NO: 2421646 - protein, 4 aa, Entamoeba dispar
EKYD

SEQ ID NO: 2421647 - protein, 7 aa, Entamoeba dispar
EKYDDEE

SEQ ID NO: 2421648 - protein, 7 aa, Entamoeba dispar
EKYDDTV

SEQ ID NO: 2421649 - protein, 6 aa, Entamoeba dispar
EKYDTK

SEQ ID NO: 2421650 - protein, 5 aa, Entamoeba dispar
EKYEQ

SEQ ID NO: 2421651 - protein, 9 aa, Entamoeba dispar
EKYERVSGS

SEQ ID NO: 2421652 - protein, 14 aa, Entamoeba dispar
EKYGKEHALEGARI

SEQ ID NO: 2421653 - protein, 7 aa, Entamoeba dispar
EKYGKEY

SEQ ID NO: 2421654 - protein, 8 aa, Entamoeba dispar
EKYGPDEH

SEQ ID NO: 2421655 - protein, 4 aa, Entamoeba dispar
EKYH

SEQ ID NO: 2421656 - protein, 14 aa, Entamoeba dispar
EKYIKRKKEERKQE

SEQ ID NO: 2421657 - protein, 5 aa, Entamoeba dispar
EKYKD

SEQ ID NO: 2421658 - protein, 12 aa, Entamoeba dispar
EKYKGNSQWDGN

SEQ ID NO: 2421659 - protein, 5 aa, Entamoeba dispar
EKYKI

SEQ ID NO: 2421660 - protein, 14 aa, Entamoeba dispar
EKYKNQIGIEEEKH

SEQ ID NO: 2421661 - protein, 6 aa, Entamoeba dispar
EKYKTK

SEQ ID NO: 2421662 - protein, 7 aa, Entamoeba dispar
EKYLRDD

SEQ ID NO: 2421663 - protein, 4 aa, Entamoeba dispar
EKYN

SEQ ID NO: 2421664 - protein, 12 aa, Entamoeba dispar
EKYNESVNEEKF

SEQ ID NO: 2421665 - protein, 7 aa, Entamoeba dispar
EKYNHNS

SEQ ID NO: 2421666 - protein, 12 aa, Entamoeba dispar
EKYNSPSAKKYK

SEQ ID NO: 2421667 - protein, 5 aa, Entamoeba dispar
EKYPE

SEQ ID NO: 2421668 - protein, 6 aa, Entamoeba dispar
EKYPEL

SEQ ID NO: 2421669 - protein, 14 aa, Entamoeba dispar
EKYPITKDKSKGEV

SEQ ID NO: 2421670 - protein, 11 aa, Entamoeba dispar
EKYPQYKKQFP

SEQ ID NO: 2421671 - protein, 4 aa, Entamoeba dispar
EKYQ

SEQ ID NO: 2421672 - protein, 10 aa, Entamoeba dispar
EKYQQSLSPS

SEQ ID NO: 2421673 - protein, 7 aa, Entamoeba dispar
EKYQTEI

SEQ ID NO: 2421674 - protein, 4 aa, Entamoeba dispar
EKYR

SEQ ID NO: 2421675 - protein, 13 aa, Entamoeba dispar
EKYRNKTGSLEEQ

SEQ ID NO: 2421676 - protein, 13 aa, Entamoeba dispar
EKYRQSLPESPGY

SEQ ID NO: 2421677 - protein, 6 aa, Entamoeba dispar
EKYRSL

SEQ ID NO: 2421678 - protein, 9 aa, Entamoeba dispar
EKYRTDPTN

SEQ ID NO: 2421679 - protein, 7 aa, Entamoeba dispar
EKYTGAG

SEQ ID NO: 2421680 - protein, 4 aa, Entamoeba dispar
EKYV

SEQ ID NO: 2421681 - protein, 12 aa, Entamoeba dispar
ELADKKGDYDPL

SEQ ID NO: 2421682 - protein, 8 aa, Entamoeba dispar
ELAEGKFD

SEQ ID NO: 2421683 - protein, 5 aa, Entamoeba dispar
ELAGP

SEQ ID NO: 2421684 - protein, 13 aa, Entamoeba dispar
ELAKQTKNFSGAE

SEQ ID NO: 2421685 - protein, 28 aa, Entamoeba dispar
ELAKSSQEEVQKNLRHSSSSQRVSKNFG

SEQ ID NO: 2421686 - protein, 8 aa, Entamoeba dispar
ELAPGSYS

SEQ ID NO: 2421687 - protein, 13 aa, Entamoeba dispar
ELAQNIKSNFKKT

SEQ ID NO: 2421688 - protein, 16 aa, Entamoeba dispar
ELAQQNNEKQSDKDDL

SEQ ID NO: 2421689 - protein, 7 aa, Entamoeba dispar
ELARQTA

SEQ ID NO: 2421690 - protein, 11 aa, Entamoeba dispar
ELDADTAESRI

SEQ ID NO: 2421691 - protein, 7 aa, Entamoeba dispar
ELDDDDV

SEQ ID NO: 2421692 - protein, 6 aa, Entamoeba dispar
ELDDKK

SEQ ID NO: 2421693 - protein, 5 aa, Entamoeba dispar
ELDEE

SEQ ID NO: 2421694 - protein, 9 aa, Entamoeba dispar
ELDESEREE

SEQ ID NO: 2421695 - protein, 8 aa, Entamoeba dispar
ELDETNEK

SEQ ID NO: 2421696 - protein, 5 aa, Entamoeba dispar
ELDEV

SEQ ID NO: 2421697 - protein, 6 aa, Entamoeba dispar
ELDGEG

SEQ ID NO: 2421698 - protein, 7 aa, Entamoeba dispar
ELDGNSV

SEQ ID NO: 2421699 - protein, 4 aa, Entamoeba dispar
ELDM

SEQ ID NO: 2421700 - protein, 6 aa, Entamoeba dispar
ELDNEI

SEQ ID NO: 2421701 - protein, 15 aa, Entamoeba dispar
ELDNHKTVSRYDKKE

SEQ ID NO: 2421702 - protein, 48 aa, Entamoeba dispar
ELDNSDSEEIITRKNDQEIEEERKKKQKIKEKYQRIKEQKEEEEKSEE

SEQ ID NO: 2421703 - protein, 16 aa, Entamoeba dispar
ELDPPIEIKGEGRATY

SEQ ID NO: 2421704 - protein, 6 aa, Entamoeba dispar
ELDPSD

SEQ ID NO: 2421705 - protein, 6 aa, Entamoeba dispar
ELDPST

SEQ ID NO: 2421706 - protein, 12 aa, Entamoeba dispar
ELDRLDDNTDIK

SEQ ID NO: 2421707 - protein, 30 aa, Entamoeba dispar
ELEDDNEEEILEDEEENELEEEEVSEKDIT

SEQ ID NO: 2421708 - protein, 13 aa, Entamoeba dispar
ELEDGEIQKQTMK

SEQ ID NO: 2421709 - protein, 9 aa, Entamoeba dispar
ELEDKSNVI

SEQ ID NO: 2421710 - protein, 20 aa, Entamoeba dispar
ELEDNDAEELEYHPNDPIDY

SEQ ID NO: 2421711 - protein, 6 aa, Entamoeba dispar
ELEEEG

SEQ ID NO: 2421712 - protein, 7 aa, Entamoeba dispar
ELEEEKR

SEQ ID NO: 2421713 - protein, 17 aa, Entamoeba dispar
ELEEENKELKNQISGSA

SEQ ID NO: 2421714 - protein, 14 aa, Entamoeba dispar
ELEEESKKEGFNKN

SEQ ID NO: 2421715 - protein, 11 aa, Entamoeba dispar
ELEEGDLSQKT

SEQ ID NO: 2421716 - protein, 10 aa, Entamoeba dispar
ELEEKNALNE

SEQ ID NO: 2421717 - protein, 9 aa, Entamoeba dispar
ELEEKYDEP

SEQ ID NO: 2421718 - protein, 5 aa, Entamoeba dispar
ELEEN

SEQ ID NO: 2421719 - protein, 32 aa, Entamoeba dispar
ELEEQKKELENWKKKEEEWNEYKKKKELENET

SEQ ID NO: 2421720 - protein, 12 aa, Entamoeba dispar
ELEERRKKMDKM

SEQ ID NO: 2421721 - protein, 6 aa, Entamoeba dispar
ELEESK

SEQ ID NO: 2421722 - protein, 6 aa, Entamoeba dispar
ELEKAQ

SEQ ID NO: 2421723 - protein, 5 aa, Entamoeba dispar
ELEKE

SEQ ID NO: 2421724 - protein, 13 aa, Entamoeba dispar
ELEKEQKQIQKEF

SEQ ID NO: 2421725 - protein, 9 aa, Entamoeba dispar
ELEKESKAV

SEQ ID NO: 2421726 - protein, 27 aa, Entamoeba dispar
ELEKQKEEEYKKREEMIESKKKSKTQK

SEQ ID NO: 2421727 - protein, 16 aa, Entamoeba dispar
ELEKQRPIEYQTNSID

SEQ ID NO: 2421728 - protein, 32 aa, Entamoeba dispar
ELEKQSKGLISDGNKMTKAIESQKDLLKKEKE

SEQ ID NO: 2421729 - protein, 11 aa, Entamoeba dispar
ELENDTQNTYQ

SEQ ID NO: 2421730 - protein, 7 aa, Entamoeba dispar
ELENEDL

SEQ ID NO: 2421731 - protein, 7 aa, Entamoeba dispar
ELENGPY

SEQ ID NO: 2421732 - protein, 15 aa, Entamoeba dispar
ELENKEKELDQNQTE

SEQ ID NO: 2421733 - protein, 7 aa, Entamoeba dispar
ELENKKT

SEQ ID NO: 2421734 - protein, 6 aa, Entamoeba dispar
ELENNG

SEQ ID NO: 2421735 - protein, 15 aa, Entamoeba dispar
ELENSQRKQMERDPY

SEQ ID NO: 2421736 - protein, 4 aa, Entamoeba dispar
ELEP

SEQ ID NO: 2421737 - protein, 6 aa, Entamoeba dispar
ELEPDK

SEQ ID NO: 2421738 - protein, 28 aa, Entamoeba dispar
ELEPTQVQSETSKEKKKFIEKSSKQYES

SEQ ID NO: 2421739 - protein, 28 aa, Entamoeba dispar
ELEQKENEESTEEFSSGDEYGGKDEFEA

SEQ ID NO: 2421740 - protein, 10 aa, Entamoeba dispar
ELERKEERRV

SEQ ID NO: 2421741 - protein, 14 aa, Entamoeba dispar
ELESEKENRKSQES

SEQ ID NO: 2421742 - protein, 19 aa, Entamoeba dispar
ELESIGEDETMQMEEEEPI

SEQ ID NO: 2421743 - protein, 6 aa, Entamoeba dispar
ELESNK

SEQ ID NO: 2421744 - protein, 32 aa, Entamoeba dispar
ELETEEDKIKEQIEEINGNNSELTEKRQHCEK

SEQ ID NO: 2421745 - protein, 15 aa, Entamoeba dispar
ELETHKQSKEKSYYP

SEQ ID NO: 2421746 - protein, 15 aa, Entamoeba dispar
ELETYTGEKNKAKIA

SEQ ID NO: 2421747 - protein, 8 aa, Entamoeba dispar
ELFGSTSA

SEQ ID NO: 2421748 - protein, 7 aa, Entamoeba dispar
ELGEDTH

SEQ ID NO: 2421749 - protein, 7 aa, Entamoeba dispar
ELGEKKR

SEQ ID NO: 2421750 - protein, 5 aa, Entamoeba dispar
ELGKQ

SEQ ID NO: 2421751 - protein, 8 aa, Entamoeba dispar
ELGKTNEF

SEQ ID NO: 2421752 - protein, 13 aa, Entamoeba dispar
ELGPLDKKELTNL

SEQ ID NO: 2421753 - protein, 32 aa, Entamoeba dispar
ELGQQKEVNQQKEVDQPISESATEPIKPFETK

SEQ ID NO: 2421754 - protein, 16 aa, Entamoeba dispar
ELGRYEKRVNASKRNN

SEQ ID NO: 2421755 - protein, 7 aa, Entamoeba dispar
ELGRYER

SEQ ID NO: 2421756 - protein, 10 aa, Entamoeba dispar
ELGSGEEDIG

SEQ ID NO: 2421757 - protein, 16 aa, Entamoeba dispar
ELGSNQKGIRNEIPKP

SEQ ID NO: 2421758 - protein, 14 aa, Entamoeba dispar
ELGSNSSSPDIHKG

SEQ ID NO: 2421759 - protein, 5 aa, Entamoeba dispar
ELGTR

SEQ ID NO: 2421760 - protein, 9 aa, Entamoeba dispar
ELGTSGNGH

SEQ ID NO: 2421761 - protein, 4 aa, Entamoeba dispar
ELHH

SEQ ID NO: 2421762 - protein, 10 aa, Entamoeba dispar
ELHQPGPFSV

SEQ ID NO: 2421763 - protein, 29 aa, Entamoeba dispar
ELHTTNKEIKKVPSASSSKQNKKETKVEK

SEQ ID NO: 2421764 - protein, 5 aa, Entamoeba dispar
ELIPT

SEQ ID NO: 2421765 - protein, 19 aa, Entamoeba dispar
ELKDDGKTTEVNETNKGTY

SEQ ID NO: 2421766 - protein, 7 aa, Entamoeba dispar
ELKDEKK

SEQ ID NO: 2421767 - protein, 18 aa, Entamoeba dispar
ELKDKGNDFDNSTTDTTM

SEQ ID NO: 2421768 - protein, 7 aa, Entamoeba dispar
ELKDSNI

SEQ ID NO: 2421769 - protein, 13 aa, Entamoeba dispar
ELKDTKQCGDEKL

SEQ ID NO: 2421770 - protein, 10 aa, Entamoeba dispar
ELKDTTEEHS

SEQ ID NO: 2421771 - protein, 11 aa, Entamoeba dispar
ELKEDKKDYNH

SEQ ID NO: 2421772 - protein, 17 aa, Entamoeba dispar
ELKEEKNNGIENEEKIK

SEQ ID NO: 2421773 - protein, 15 aa, Entamoeba dispar
ELKEEVDKQTYGDQL

SEQ ID NO: 2421774 - protein, 13 aa, Entamoeba dispar
ELKEKGELSTKLG

SEQ ID NO: 2421775 - protein, 9 aa, Entamoeba dispar
ELKEKQKEL

SEQ ID NO: 2421776 - protein, 8 aa, Entamoeba dispar
ELKETTGF

SEQ ID NO: 2421777 - protein, 5 aa, Entamoeba dispar
ELKGD

SEQ ID NO: 2421778 - protein, 7 aa, Entamoeba dispar
ELKGETV

SEQ ID NO: 2421779 - protein, 9 aa, Entamoeba dispar
ELKIEQSNI

SEQ ID NO: 2421780 - protein, 19 aa, Entamoeba dispar
ELKIREDKDSIEWEDDDDE

SEQ ID NO: 2421781 - protein, 12 aa, Entamoeba dispar
ELKKEFKKEEES

SEQ ID NO: 2421782 - protein, 12 aa, Entamoeba dispar
ELKKEFKKTMSK

SEQ ID NO: 2421783 - protein, 8 aa, Entamoeba dispar
ELKKENGI

SEQ ID NO: 2421784 - protein, 13 aa, Entamoeba dispar
ELKKGNQLNKSIE

SEQ ID NO: 2421785 - protein, 32 aa, Entamoeba dispar
ELKKNNNKKVDIKRPEIKKNEPIKSNGITTNS

SEQ ID NO: 2421786 - protein, 7 aa, Entamoeba dispar
ELKKQYD

SEQ ID NO: 2421787 - protein, 19 aa, Entamoeba dispar
ELKKTQSDILSSSTQKDKL

SEQ ID NO: 2421788 - protein, 9 aa, Entamoeba dispar
ELKNNTPIA

SEQ ID NO: 2421789 - protein, 12 aa, Entamoeba dispar
ELKNQAKKEKET

SEQ ID NO: 2421790 - protein, 9 aa, Entamoeba dispar
ELKNSNEEL

SEQ ID NO: 2421791 - protein, 8 aa, Entamoeba dispar
ELKPEKEF

SEQ ID NO: 2421792 - protein, 7 aa, Entamoeba dispar
ELKPGDL

SEQ ID NO: 2421793 - protein, 7 aa, Entamoeba dispar
ELKPGKY

SEQ ID NO: 2421794 - protein, 25 aa, Entamoeba dispar
ELKPKNLAAQLPTKADAFKEDTSDL

SEQ ID NO: 2421795 - protein, 9 aa, Entamoeba dispar
ELKPTKELE

SEQ ID NO: 2421796 - protein, 16 aa, Entamoeba dispar
ELKQGDESTLVESIQK

SEQ ID NO: 2421797 - protein, 23 aa, Entamoeba dispar
ELKQGEKSTLDKSIQKLSKICFS

SEQ ID NO: 2421798 - protein, 11 aa, Entamoeba dispar
ELKQGEKSTLG

SEQ ID NO: 2421799 - protein, 12 aa, Entamoeba dispar
ELKQKYKELAKQ

SEQ ID NO: 2421800 - protein, 9 aa, Entamoeba dispar
ELKQSNDIT

SEQ ID NO: 2421801 - protein, 10 aa, Entamoeba dispar
ELKRNEKRKE

SEQ ID NO: 2421802 - protein, 23 aa, Entamoeba dispar
ELKRREKERKAREEQRIKEEIAE

SEQ ID NO: 2421803 - protein, 20 aa, Entamoeba dispar
ELKRREKGIAELRKSRRERR

SEQ ID NO: 2421804 - protein, 17 aa, Entamoeba dispar
ELKRRQKNLNQLRTKRR

SEQ ID NO: 2421805 - protein, 8 aa, Entamoeba dispar
ELKRTSVT

SEQ ID NO: 2421806 - protein, 11 aa, Entamoeba dispar
ELKSTKEMKEG

SEQ ID NO: 2421807 - protein, 6 aa, Entamoeba dispar
ELKTSP

SEQ ID NO: 2421808 - protein, 23 aa, Entamoeba dispar
ELLPNKPSRVRKEKSTPPRIKRA

SEQ ID NO: 2421809 - protein, 12 aa, Entamoeba dispar
ELLSDKKRYEEL

SEQ ID NO: 2421810 - protein, 14 aa, Entamoeba dispar
ELLTEDEQKDNKAL

SEQ ID NO: 2421811 - protein, 9 aa, Entamoeba dispar
ELLTESSGM

SEQ ID NO: 2421812 - protein, 5 aa, Entamoeba dispar
ELNDE

SEQ ID NO: 2421813 - protein, 11 aa, Entamoeba dispar
ELNDKEKEELI

SEQ ID NO: 2421814 - protein, 6 aa, Entamoeba dispar
ELNDNK

SEQ ID NO: 2421815 - protein, 26 aa, Entamoeba dispar
ELNENYKKIKKENETLKKRGSGLSGL

SEQ ID NO: 2421816 - protein, 7 aa, Entamoeba dispar
ELNESTV

SEQ ID NO: 2421817 - protein, 16 aa, Entamoeba dispar
ELNETDRGSNGFGSTG

SEQ ID NO: 2421818 - protein, 5 aa, Entamoeba dispar
ELNKG

SEQ ID NO: 2421819 - protein, 11 aa, Entamoeba dispar
ELNKVKAERDY

SEQ ID NO: 2421820 - protein, 35 aa, Entamoeba dispar
ELNKYSSSFYKEESSDEDSTLEIPEELTSSKPMDI

SEQ ID NO: 2421821 - protein, 7 aa, Entamoeba dispar
ELNNDKC

SEQ ID NO: 2421822 - protein, 7 aa, Entamoeba dispar
ELNNETI

SEQ ID NO: 2421823 - protein, 5 aa, Entamoeba dispar
ELNNL

SEQ ID NO: 2421824 - protein, 4 aa, Entamoeba dispar
ELNQ

SEQ ID NO: 2421825 - protein, 8 aa, Entamoeba dispar
ELNQDNKI

SEQ ID NO: 2421826 - protein, 5 aa, Entamoeba dispar
ELNQQ

SEQ ID NO: 2421827 - protein, 13 aa, Entamoeba dispar
ELNQQGDFEPSGL

SEQ ID NO: 2421828 - protein, 20 aa, Entamoeba dispar
ELNSSKAKKNLAQEEYDERE

SEQ ID NO: 2421829 - protein, 6 aa, Entamoeba dispar
ELNTDN

SEQ ID NO: 2421830 - protein, 5 aa, Entamoeba dispar
ELNTK

SEQ ID NO: 2421831 - protein, 7 aa, Entamoeba dispar
ELNTSRN

SEQ ID NO: 2421832 - protein, 5 aa, Entamoeba dispar
ELPDT

SEQ ID NO: 2421833 - protein, 4 aa, Entamoeba dispar
ELPE

SEQ ID NO: 2421834 - protein, 6 aa, Entamoeba dispar
ELPEDT

SEQ ID NO: 2421835 - protein, 7 aa, Entamoeba dispar
ELPEEEF

SEQ ID NO: 2421836 - protein, 6 aa, Entamoeba dispar
ELPEGY

SEQ ID NO: 2421837 - protein, 4 aa, Entamoeba dispar
ELPG

SEQ ID NO: 2421838 - protein, 12 aa, Entamoeba dispar
ELPKAQTKTPEL

SEQ ID NO: 2421839 - protein, 48 aa, Entamoeba dispar
ELPKENSEVPIKDDSKVPSDRTDNKKEGDEGVEDISDENAMKSSHKLG

SEQ ID NO: 2421840 - protein, 10 aa, Entamoeba dispar
ELPKESATKL

SEQ ID NO: 2421841 - protein, 8 aa, Entamoeba dispar
ELPLSTKG

SEQ ID NO: 2421842 - protein, 12 aa, Entamoeba dispar
ELPNLKSSTKLG

SEQ ID NO: 2421843 - protein, 4 aa, Entamoeba dispar
ELPP

SEQ ID NO: 2421844 - protein, 20 aa, Entamoeba dispar
ELPPEEKKVIRKKEKKEIVT

SEQ ID NO: 2421845 - protein, 5 aa, Entamoeba dispar
ELPPF

SEQ ID NO: 2421846 - protein, 8 aa, Entamoeba dispar
ELPPNEDG

SEQ ID NO: 2421847 - protein, 18 aa, Entamoeba dispar
ELPQQEQSSTFSINSPKS

SEQ ID NO: 2421848 - protein, 7 aa, Entamoeba dispar
ELPTTKQ

SEQ ID NO: 2421849 - protein, 13 aa, Entamoeba dispar
ELQDQREKLDQMN

SEQ ID NO: 2421850 - protein, 4 aa, Entamoeba dispar
ELQE

SEQ ID NO: 2421851 - protein, 10 aa, Entamoeba dispar
ELQEDKKTRI

SEQ ID NO: 2421852 - protein, 4 aa, Entamoeba dispar
ELQG

SEQ ID NO: 2421853 - protein, 21 aa, Entamoeba dispar
ELQKEPTIERKEISKTMPAIP

SEQ ID NO: 2421854 - protein, 21 aa, Entamoeba dispar
ELQKQLDNLDTQQMEMVQAEV

SEQ ID NO: 2421855 - protein, 6 aa, Entamoeba dispar
ELQKST

SEQ ID NO: 2421856 - protein, 9 aa, Entamoeba dispar
ELQKSTKEE

SEQ ID NO: 2421857 - protein, 4 aa, Entamoeba dispar
ELQN

SEQ ID NO: 2421858 - protein, 4 aa, Entamoeba dispar
ELQP

SEQ ID NO: 2421859 - protein, 34 aa, Entamoeba dispar
ELQQPIDEKPIEEQPIQTLESSDTLTKSNEDESF

SEQ ID NO: 2421860 - protein, 7 aa, Entamoeba dispar
ELQQQKP

SEQ ID NO: 2421861 - protein, 10 aa, Entamoeba dispar
ELQREEDEQY

SEQ ID NO: 2421862 - protein, 13 aa, Entamoeba dispar
ELQSENEQLQREI

SEQ ID NO: 2421863 - protein, 7 aa, Entamoeba dispar
ELQSYQE

SEQ ID NO: 2421864 - protein, 16 aa, Entamoeba dispar
ELQTAKPIDYDNSSEL

SEQ ID NO: 2421865 - protein, 5 aa, Entamoeba dispar
ELQTI

SEQ ID NO: 2421866 - protein, 16 aa, Entamoeba dispar
ELQTIKPKRKIENSYI

SEQ ID NO: 2421867 - protein, 18 aa, Entamoeba dispar
ELRERERKEREERSQTLE

SEQ ID NO: 2421868 - protein, 11 aa, Entamoeba dispar
ELRGGNGEEAL

SEQ ID NO: 2421869 - protein, 7 aa, Entamoeba dispar
ELRKDSE

SEQ ID NO: 2421870 - protein, 11 aa, Entamoeba dispar
ELRKKKEEIGI

SEQ ID NO: 2421871 - protein, 15 aa, Entamoeba dispar
ELRNNKRFNNESAEV

SEQ ID NO: 2421872 - protein, 10 aa, Entamoeba dispar
ELRQRNRRYG

SEQ ID NO: 2421873 - protein, 7 aa, Entamoeba dispar
ELRTAPD

SEQ ID NO: 2421874 - protein, 14 aa, Entamoeba dispar
ELSATEKESTQGLT

SEQ ID NO: 2421875 - protein, 10 aa, Entamoeba dispar
ELSDMSEEEL

SEQ ID NO: 2421876 - protein, 8 aa, Entamoeba dispar
ELSDNKNW

SEQ ID NO: 2421877 - protein, 8 aa, Entamoeba dispar
ELSDSTNI

SEQ ID NO: 2421878 - protein, 4 aa, Entamoeba dispar
ELSE

SEQ ID NO: 2421879 - protein, 9 aa, Entamoeba dispar
ELSEEEKGL

SEQ ID NO: 2421880 - protein, 10 aa, Entamoeba dispar
ELSEKGLSSF

SEQ ID NO: 2421881 - protein, 5 aa, Entamoeba dispar
ELSER

SEQ ID NO: 2421882 - protein, 5 aa, Entamoeba dispar
ELSEY

SEQ ID NO: 2421883 - protein, 6 aa, Entamoeba dispar
ELSGQQ

SEQ ID NO: 2421884 - protein, 8 aa, Entamoeba dispar
ELSGYEKA

SEQ ID NO: 2421885 - protein, 5 aa, Entamoeba dispar
ELSIP

SEQ ID NO: 2421886 - protein, 9 aa, Entamoeba dispar
ELSISNTKT

SEQ ID NO: 2421887 - protein, 4 aa, Entamoeba dispar
ELSK

SEQ ID NO: 2421888 - protein, 11 aa, Entamoeba dispar
ELSKEGNEGGW

SEQ ID NO: 2421889 - protein, 13 aa, Entamoeba dispar
ELSKGYRTKRNEF

SEQ ID NO: 2421890 - protein, 16 aa, Entamoeba dispar
ELSKPETNKKDVPDFS

SEQ ID NO: 2421891 - protein, 11 aa, Entamoeba dispar
ELSKPGKNPKN

SEQ ID NO: 2421892 - protein, 13 aa, Entamoeba dispar
ELSKRDEKINDLE

SEQ ID NO: 2421893 - protein, 17 aa, Entamoeba dispar
ELSKSKVSKKDIENAKQ

SEQ ID NO: 2421894 - protein, 77 aa, Entamoeba dispar
ELSNGNDGISKLNGELTQIKKEKEEIKKELEEEKEKLERKEEELKEIKEAKQQLEEEKIKSIEEKTTLQQELEEKNK

SEQ ID NO: 2421895 - protein, 5 aa, Entamoeba dispar
ELSNL

SEQ ID NO: 2421896 - protein, 7 aa, Entamoeba dispar
ELSNQGE

SEQ ID NO: 2421897 - protein, 9 aa, Entamoeba dispar
ELSPEHPPR

SEQ ID NO: 2421898 - protein, 17 aa, Entamoeba dispar
ELSPEQKKRSYCQPGKA

SEQ ID NO: 2421899 - protein, 15 aa, Entamoeba dispar
ELSPKDEESKTLDNL

SEQ ID NO: 2421900 - protein, 5 aa, Entamoeba dispar
ELSPN

SEQ ID NO: 2421901 - protein, 7 aa, Entamoeba dispar
ELSPNGD

SEQ ID NO: 2421902 - protein, 8 aa, Entamoeba dispar
ELSPNNEN

SEQ ID NO: 2421903 - protein, 5 aa, Entamoeba dispar
ELSQE

SEQ ID NO: 2421904 - protein, 7 aa, Entamoeba dispar
ELSRQIP

SEQ ID NO: 2421905 - protein, 6 aa, Entamoeba dispar
ELSRTD

SEQ ID NO: 2421906 - protein, 9 aa, Entamoeba dispar
ELSSKENIS

SEQ ID NO: 2421907 - protein, 11 aa, Entamoeba dispar
ELSSKSVTASI

SEQ ID NO: 2421908 - protein, 11 aa, Entamoeba dispar
ELSTIRNENER

SEQ ID NO: 2421909 - protein, 12 aa, Entamoeba dispar
ELSTKQENDSKE

SEQ ID NO: 2421910 - protein, 7 aa, Entamoeba dispar
ELSTKSE

SEQ ID NO: 2421911 - protein, 20 aa, Entamoeba dispar
ELSTNKKDSTLDSLSQSTLL

SEQ ID NO: 2421912 - protein, 7 aa, Entamoeba dispar
ELSTSLN

SEQ ID NO: 2421913 - protein, 9 aa, Entamoeba dispar
ELSTSSWDK

SEQ ID NO: 2421914 - protein, 8 aa, Entamoeba dispar
ELSTTAVE

SEQ ID NO: 2421915 - protein, 5 aa, Entamoeba dispar
ELTAG

SEQ ID NO: 2421916 - protein, 9 aa, Entamoeba dispar
ELTDEEQVK

SEQ ID NO: 2421917 - protein, 8 aa, Entamoeba dispar
ELTDGNKS

SEQ ID NO: 2421918 - protein, 5 aa, Entamoeba dispar
ELTDQ

SEQ ID NO: 2421919 - protein, 8 aa, Entamoeba dispar
ELTENKEE

SEQ ID NO: 2421920 - protein, 10 aa, Entamoeba dispar
ELTESNDLNT

SEQ ID NO: 2421921 - protein, 9 aa, Entamoeba dispar
ELTKNPVDG

SEQ ID NO: 2421922 - protein, 9 aa, Entamoeba dispar
ELTNKTSKY

SEQ ID NO: 2421923 - protein, 4 aa, Entamoeba dispar
ELTP

SEQ ID NO: 2421924 - protein, 16 aa, Entamoeba dispar
ELTPEEGDCYRQRGSA

SEQ ID NO: 2421925 - protein, 8 aa, Entamoeba dispar
ELTPENVE

SEQ ID NO: 2421926 - protein, 6 aa, Entamoeba dispar
ELTPTG

SEQ ID NO: 2421927 - protein, 9 aa, Entamoeba dispar
ELTQTQHNI

SEQ ID NO: 2421928 - protein, 25 aa, Entamoeba dispar
ELTSGNPFSITSTAAPKKTGESRSL

SEQ ID NO: 2421929 - protein, 11 aa, Entamoeba dispar
ELTSKQSLVSS

SEQ ID NO: 2421930 - protein, 7 aa, Entamoeba dispar
ELTSRNE

SEQ ID NO: 2421931 - protein, 21 aa, Entamoeba dispar
ELTSSEPQTTQVTPQKSDKSI

SEQ ID NO: 2421932 - protein, 31 aa, Entamoeba dispar
ELTTEAEDALKAKMKAEKKAKTSQKKLDELQ

SEQ ID NO: 2421933 - protein, 9 aa, Entamoeba dispar
ELTTPRGNS

SEQ ID NO: 2421934 - protein, 5 aa, Entamoeba dispar
ELTVK

SEQ ID NO: 2421935 - protein, 10 aa, Entamoeba dispar
ELVKEEEKSE

SEQ ID NO: 2421936 - protein, 5 aa, Entamoeba dispar
ELVSG

SEQ ID NO: 2421937 - protein, 5 aa, Entamoeba dispar
EMAGE

SEQ ID NO: 2421938 - protein, 8 aa, Entamoeba dispar
EMDDKELD

SEQ ID NO: 2421939 - protein, 24 aa, Entamoeba dispar
EMDEDENEENITKKKKVKKEELSI

SEQ ID NO: 2421940 - protein, 23 aa, Entamoeba dispar
EMDNQKVDHKKPKLPMKESSDSW

SEQ ID NO: 2421941 - protein, 21 aa, Entamoeba dispar
EMEEESKADNDQKQMDTDEVE

SEQ ID NO: 2421942 - protein, 8 aa, Entamoeba dispar
EMEEPENQ

SEQ ID NO: 2421943 - protein, 13 aa, Entamoeba dispar
EMEESNKDGLHTP

SEQ ID NO: 2421944 - protein, 5 aa, Entamoeba dispar
EMEGY

SEQ ID NO: 2421945 - protein, 4 aa, Entamoeba dispar
EMEK

SEQ ID NO: 2421946 - protein, 5 aa, Entamoeba dispar
EMEKG

SEQ ID NO: 2421947 - protein, 22 aa, Entamoeba dispar
EMEKKEKQRQLEEEKRIKEEEL

SEQ ID NO: 2421948 - protein, 11 aa, Entamoeba dispar
EMEKNKTNPSI

SEQ ID NO: 2421949 - protein, 8 aa, Entamoeba dispar
EMEQSKMK

SEQ ID NO: 2421950 - protein, 8 aa, Entamoeba dispar
EMESRPTA

SEQ ID NO: 2421951 - protein, 8 aa, Entamoeba dispar
EMETNRKK

SEQ ID NO: 2421952 - protein, 7 aa, Entamoeba dispar
EMETSSQ

SEQ ID NO: 2421953 - protein, 5 aa, Entamoeba dispar
EMETT

SEQ ID NO: 2421954 - protein, 5 aa, Entamoeba dispar
EMFND

SEQ ID NO: 2421955 - protein, 7 aa, Entamoeba dispar
EMGGHQD

SEQ ID NO: 2421956 - protein, 6 aa, Entamoeba dispar
EMGQSD

SEQ ID NO: 2421957 - protein, 25 aa, Entamoeba dispar
EMGRNRHKEFESKRTKSFDENSINE

SEQ ID NO: 2421958 - protein, 5 aa, Entamoeba dispar
EMGTE

SEQ ID NO: 2421959 - protein, 10 aa, Entamoeba dispar
EMIPPSPQRS

SEQ ID NO: 2421960 - protein, 9 aa, Entamoeba dispar
EMKDQSSMT

SEQ ID NO: 2421961 - protein, 15 aa, Entamoeba dispar
EMKEEQENKTPNNRR

SEQ ID NO: 2421962 - protein, 6 aa, Entamoeba dispar
EMKEPN

SEQ ID NO: 2421963 - protein, 27 aa, Entamoeba dispar
EMKGDQNNQLQATNKELKAKNNDLTSK

SEQ ID NO: 2421964 - protein, 12 aa, Entamoeba dispar
EMKKKGRRNEAI

SEQ ID NO: 2421965 - protein, 5 aa, Entamoeba dispar
EMKQV

SEQ ID NO: 2421966 - protein, 11 aa, Entamoeba dispar
EMKSKELNINQ

SEQ ID NO: 2421967 - protein, 24 aa, Entamoeba dispar
EMMEESSRRVKTITTKYGNDVDQR

SEQ ID NO: 2421968 - protein, 13 aa, Entamoeba dispar
EMNAEEKSSTLRN

SEQ ID NO: 2421969 - protein, 4 aa, Entamoeba dispar
EMND

SEQ ID NO: 2421970 - protein, 8 aa, Entamoeba dispar
EMNDVQTK

SEQ ID NO: 2421971 - protein, 41 aa, Entamoeba dispar
EMNEEASIKETKIKQLEDELNKSQKTIEDISSTKDKNSGIL

SEQ ID NO: 2421972 - protein, 10 aa, Entamoeba dispar
EMNEKGTQEF

SEQ ID NO: 2421973 - protein, 8 aa, Entamoeba dispar
EMNGEEVQ

SEQ ID NO: 2421974 - protein, 4 aa, Entamoeba dispar
EMNK

SEQ ID NO: 2421975 - protein, 9 aa, Entamoeba dispar
EMNKGSQQQ

SEQ ID NO: 2421976 - protein, 21 aa, Entamoeba dispar
EMNNEQNENIKKLTKREVDNK

SEQ ID NO: 2421977 - protein, 21 aa, Entamoeba dispar
EMNNKQNENIKKLTKREVDDK

SEQ ID NO: 2421978 - protein, 21 aa, Entamoeba dispar
EMNNKQNENIKKLTKREVDNK

SEQ ID NO: 2421979 - protein, 4 aa, Entamoeba dispar
EMNQ

SEQ ID NO: 2421980 - protein, 8 aa, Entamoeba dispar
EMNRESEF

SEQ ID NO: 2421981 - protein, 13 aa, Entamoeba dispar
EMNTNEIKEYKEK

SEQ ID NO: 2421982 - protein, 10 aa, Entamoeba dispar
EMPADSGYPA

SEQ ID NO: 2421983 - protein, 7 aa, Entamoeba dispar
EMPQQER

SEQ ID NO: 2421984 - protein, 12 aa, Entamoeba dispar
EMPSQSSNKMEE

SEQ ID NO: 2421985 - protein, 9 aa, Entamoeba dispar
EMQDSEDPL

SEQ ID NO: 2421986 - protein, 4 aa, Entamoeba dispar
EMQR

SEQ ID NO: 2421987 - protein, 9 aa, Entamoeba dispar
EMRKYEKDH

SEQ ID NO: 2421988 - protein, 16 aa, Entamoeba dispar
EMSGDSSLTKKELEET

SEQ ID NO: 2421989 - protein, 7 aa, Entamoeba dispar
EMSPSSH

SEQ ID NO: 2421990 - protein, 5 aa, Entamoeba dispar
EMTET

SEQ ID NO: 2421991 - protein, 6 aa, Entamoeba dispar
EMTPDG

SEQ ID NO: 2421992 - protein, 5 aa, Entamoeba dispar
EMTST

SEQ ID NO: 2421993 - protein, 4 aa, Entamoeba dispar
EMTT

SEQ ID NO: 2421994 - protein, 16 aa, Entamoeba dispar
EMTTPGIAGAELLHNK

SEQ ID NO: 2421995 - protein, 6 aa, Entamoeba dispar
ENAARH

SEQ ID NO: 2421996 - protein, 21 aa, Entamoeba dispar
ENADAEELSPEHTNNEEIPTD

SEQ ID NO: 2421997 - protein, 6 aa, Entamoeba dispar
ENADKK

SEQ ID NO: 2421998 - protein, 6 aa, Entamoeba dispar
ENAGLN

SEQ ID NO: 2421999 - protein, 9 aa, Entamoeba dispar
ENAGTNESF

SEQ ID NO: 2422000 - protein, 14 aa, Entamoeba dispar
ENAGVKKAGALYGK

SEQ ID NO: 2422001 - protein, 5 aa, Entamoeba dispar
ENAIE

SEQ ID NO: 2422002 - protein, 10 aa, Entamoeba dispar
ENAKKGNDSA

SEQ ID NO: 2422003 - protein, 6 aa, Entamoeba dispar
ENALKS

SEQ ID NO: 2422004 - protein, 8 aa, Entamoeba dispar
ENANPNSF

SEQ ID NO: 2422005 - protein, 7 aa, Entamoeba dispar
ENAPIGS

SEQ ID NO: 2422006 - protein, 9 aa, Entamoeba dispar
ENAPSGKDI

SEQ ID NO: 2422007 - protein, 9 aa, Entamoeba dispar
ENAPTTGTP

SEQ ID NO: 2422008 - protein, 12 aa, Entamoeba dispar
ENAQSKVSLSSQ

SEQ ID NO: 2422009 - protein, 8 aa, Entamoeba dispar
ENASNKLS

SEQ ID NO: 2422010 - protein, 9 aa, Entamoeba dispar
ENASSQSLK

SEQ ID NO: 2422011 - protein, 8 aa, Entamoeba dispar
ENATYEIK

SEQ ID NO: 2422012 - protein, 9 aa, Entamoeba dispar
ENAVGPASV

SEQ ID NO: 2422013 - protein, 7 aa, Entamoeba dispar
ENCENSH

SEQ ID NO: 2422014 - protein, 6 aa, Entamoeba dispar
ENCQKQ

SEQ ID NO: 2422015 - protein, 4 aa, Entamoeba dispar
ENCS

SEQ ID NO: 2422016 - protein, 5 aa, Entamoeba dispar
ENDAY

SEQ ID NO: 2422017 - protein, 5 aa, Entamoeba dispar
ENDDD

SEQ ID NO: 2422018 - protein, 5 aa, Entamoeba dispar
ENDDF

SEQ ID NO: 2422019 - protein, 7 aa, Entamoeba dispar
ENDDNSF

SEQ ID NO: 2422020 - protein, 19 aa, Entamoeba dispar
ENDEESDNTLTDEEKKQHD

SEQ ID NO: 2422021 - protein, 5 aa, Entamoeba dispar
ENDEI

SEQ ID NO: 2422022 - protein, 9 aa, Entamoeba dispar
ENDELKDKI

SEQ ID NO: 2422023 - protein, 24 aa, Entamoeba dispar
ENDENSINEIGNTQIDNEEDEESV

SEQ ID NO: 2422024 - protein, 7 aa, Entamoeba dispar
ENDENYD

SEQ ID NO: 2422025 - protein, 25 aa, Entamoeba dispar
ENDEPTAYEKQKLSQYSNASAIGSE

SEQ ID NO: 2422026 - protein, 6 aa, Entamoeba dispar
ENDEYT

SEQ ID NO: 2422027 - protein, 8 aa, Entamoeba dispar
ENDGKEVL

SEQ ID NO: 2422028 - protein, 4 aa, Entamoeba dispar
ENDI

SEQ ID NO: 2422029 - protein, 25 aa, Entamoeba dispar
  misc_feature (21)..(22): Xaa can be any naturally occurring amino acid
ENDIRKRDGKRHNEEPKEKRXXIIM

SEQ ID NO: 2422030 - protein, 10 aa, Entamoeba dispar
ENDKNGQELL

SEQ ID NO: 2422031 - protein, 7 aa, Entamoeba dispar
ENDKTAF

SEQ ID NO: 2422032 - protein, 8 aa, Entamoeba dispar
ENDKTLGY

SEQ ID NO: 2422033 - protein, 8 aa, Entamoeba dispar
ENDLDTKN

SEQ ID NO: 2422034 - protein, 7 aa, Entamoeba dispar
ENDLSES

SEQ ID NO: 2422035 - protein, 4 aa, Entamoeba dispar
ENDM

SEQ ID NO: 2422036 - protein, 10 aa, Entamoeba dispar
ENDNERNDFK

SEQ ID NO: 2422037 - protein, 6 aa, Entamoeba dispar
ENDNKQ

SEQ ID NO: 2422038 - protein, 10 aa, Entamoeba dispar
ENDNQGKEDK

SEQ ID NO: 2422039 - protein, 4 aa, Entamoeba dispar
ENDQ

SEQ ID NO: 2422040 - protein, 6 aa, Entamoeba dispar
ENDQIA

SEQ ID NO: 2422041 - protein, 5 aa, Entamoeba dispar
ENDQK

SEQ ID NO: 2422042 - protein, 4 aa, Entamoeba dispar
ENDS

SEQ ID NO: 2422043 - protein, 9 aa, Entamoeba dispar
ENDSEFTKH

SEQ ID NO: 2422044 - protein, 13 aa, Entamoeba dispar
ENDSSYDENGDTF

SEQ ID NO: 2422045 - protein, 14 aa, Entamoeba dispar
ENDSSYDENGDTFI

SEQ ID NO: 2422046 - protein, 8 aa, Entamoeba dispar
ENDTASSL

SEQ ID NO: 2422047 - protein, 7 aa, Entamoeba dispar
ENDTDYS

SEQ ID NO: 2422048 - protein, 11 aa, Entamoeba dispar
ENDTEIDMTNN

SEQ ID NO: 2422049 - protein, 12 aa, Entamoeba dispar
ENDVPDIKEPEN

SEQ ID NO: 2422050 - protein, 4 aa, Entamoeba dispar
ENDY

SEQ ID NO: 2422051 - protein, 16 aa, Entamoeba dispar
ENEANQIKKEAEERLE

SEQ ID NO: 2422052 - protein, 5 aa, Entamoeba dispar
ENEEC

SEQ ID NO: 2422053 - protein, 8 aa, Entamoeba dispar
ENEEDEDG

SEQ ID NO: 2422054 - protein, 8 aa, Entamoeba dispar
ENEEEKKL

SEQ ID NO: 2422055 - protein, 7 aa, Entamoeba dispar
ENEEEYK

SEQ ID NO: 2422056 - protein, 34 aa, Entamoeba dispar
ENEEFDKVEEKIEEELEQEHEKIEEEKIKPEKEK

SEQ ID NO: 2422057 - protein, 8 aa, Entamoeba dispar
ENEEKANA

SEQ ID NO: 2422058 - protein, 9 aa, Entamoeba dispar
ENEEKDDMV

SEQ ID NO: 2422059 - protein, 6 aa, Entamoeba dispar
ENEEKK

SEQ ID NO: 2422060 - protein, 7 aa, Entamoeba dispar
ENEEKTK

SEQ ID NO: 2422061 - protein, 6 aa, Entamoeba dispar
ENEELE

SEQ ID NO: 2422062 - protein, 8 aa, Entamoeba dispar
ENEELTER

SEQ ID NO: 2422063 - protein, 10 aa, Entamoeba dispar
ENEEQSSDSL

SEQ ID NO: 2422064 - protein, 6 aa, Entamoeba dispar
ENEERI

SEQ ID NO: 2422065 - protein, 8 aa, Entamoeba dispar
ENEETKTK

SEQ ID NO: 2422066 - protein, 8 aa, Entamoeba dispar
ENEETNIQ

SEQ ID NO: 2422067 - protein, 5 aa, Entamoeba dispar
ENEEV

SEQ ID NO: 2422068 - protein, 13 aa, Entamoeba dispar
ENEFYNNKEASPY

SEQ ID NO: 2422069 - protein, 19 aa, Entamoeba dispar
ENEGGDEGSEQWIEKIFAP

SEQ ID NO: 2422070 - protein, 7 aa, Entamoeba dispar
ENEGINN

SEQ ID NO: 2422071 - protein, 4 aa, Entamoeba dispar
ENEH

SEQ ID NO: 2422072 - protein, 5 aa, Entamoeba dispar
ENEHD

SEQ ID NO: 2422073 - protein, 6 aa, Entamoeba dispar
ENEHGR

SEQ ID NO: 2422074 - protein, 4 aa, Entamoeba dispar
ENEI

SEQ ID NO: 2422075 - protein, 6 aa, Entamoeba dispar
ENEIDN

SEQ ID NO: 2422076 - protein, 5 aa, Entamoeba dispar
ENEII

SEQ ID NO: 2422077 - protein, 19 aa, Entamoeba dispar
ENEIKRKEEELKKQEEVRK

SEQ ID NO: 2422078 - protein, 5 aa, Entamoeba dispar
ENEIS

SEQ ID NO: 2422079 - protein, 7 aa, Entamoeba dispar
ENEISNE

SEQ ID NO: 2422080 - protein, 12 aa, Entamoeba dispar
ENEKDKLEMQKR

SEQ ID NO: 2422081 - protein, 7 aa, Entamoeba dispar
ENEKGND

SEQ ID NO: 2422082 - protein, 8 aa, Entamoeba dispar
ENEKIEKT

SEQ ID NO: 2422083 - protein, 7 aa, Entamoeba dispar
ENEKIPK

SEQ ID NO: 2422084 - protein, 12 aa, Entamoeba dispar
ENEKKRATTFQK

SEQ ID NO: 2422085 - protein, 10 aa, Entamoeba dispar
ENEKLDSISE

SEQ ID NO: 2422086 - protein, 7 aa, Entamoeba dispar
ENEKNKI

SEQ ID NO: 2422087 - protein, 9 aa, Entamoeba dispar
ENEKTKISL

SEQ ID NO: 2422088 - protein, 13 aa, Entamoeba dispar
ENELKQNQLQKEE

SEQ ID NO: 2422089 - protein, 7 aa, Entamoeba dispar
ENEMKEV

SEQ ID NO: 2422090 - protein, 11 aa, Entamoeba dispar
ENEMKGNTLDD

SEQ ID NO: 2422091 - protein, 10 aa, Entamoeba dispar
ENENDKTKEG

SEQ ID NO: 2422092 - protein, 9 aa, Entamoeba dispar
ENENGTPSQ

SEQ ID NO: 2422093 - protein, 5 aa, Entamoeba dispar
ENENI

SEQ ID NO: 2422094 - protein, 11 aa, Entamoeba dispar
ENENKKNQDIQ

SEQ ID NO: 2422095 - protein, 18 aa, Entamoeba dispar
ENENNELKRKLKELKIAF

SEQ ID NO: 2422096 - protein, 6 aa, Entamoeba dispar
ENEPEN

SEQ ID NO: 2422097 - protein, 6 aa, Entamoeba dispar
ENEPFN

SEQ ID NO: 2422098 - protein, 7 aa, Entamoeba dispar
ENEPIKP

SEQ ID NO: 2422099 - protein, 18 aa, Entamoeba dispar
ENEPIKPLSIEEEKMIDE

SEQ ID NO: 2422100 - protein, 5 aa, Entamoeba dispar
ENEPP

SEQ ID NO: 2422101 - protein, 6 aa, Entamoeba dispar
ENEQGI

SEQ ID NO: 2422102 - protein, 13 aa, Entamoeba dispar
ENEQKDKPTEIKE

SEQ ID NO: 2422103 - protein, 8 aa, Entamoeba dispar
ENEQQNQS

SEQ ID NO: 2422104 - protein, 20 aa, Entamoeba dispar
ENERERKTNEERDKNEKELE

SEQ ID NO: 2422105 - protein, 5 aa, Entamoeba dispar
ENERI

SEQ ID NO: 2422106 - protein, 6 aa, Entamoeba dispar
ENERIS

SEQ ID NO: 2422107 - protein, 10 aa, Entamoeba dispar
ENERKNNNKL

SEQ ID NO: 2422108 - protein, 15 aa, Entamoeba dispar
ENERKSFSKSQNSLK

SEQ ID NO: 2422109 - protein, 5 aa, Entamoeba dispar
ENERL

SEQ ID NO: 2422110 - protein, 16 aa, Entamoeba dispar
ENERNKKLKNSDEKGQ

SEQ ID NO: 2422111 - protein, 14 aa, Entamoeba dispar
ENESFSSDNSQLKD

SEQ ID NO: 2422112 - protein, 15 aa, Entamoeba dispar
ENESFSSDNSQLKDE

SEQ ID NO: 2422113 - protein, 5 aa, Entamoeba dispar
ENESI

SEQ ID NO: 2422114 - protein, 7 aa, Entamoeba dispar
ENESKAK

SEQ ID NO: 2422115 - protein, 9 aa, Entamoeba dispar
ENESRPTNV

SEQ ID NO: 2422116 - protein, 6 aa, Entamoeba dispar
ENETES

SEQ ID NO: 2422117 - protein, 11 aa, Entamoeba dispar
ENETGKLKKRE

SEQ ID NO: 2422118 - protein, 10 aa, Entamoeba dispar
ENETIKAERD

SEQ ID NO: 2422119 - protein, 5 aa, Entamoeba dispar
ENETK

SEQ ID NO: 2422120 - protein, 14 aa, Entamoeba dispar
ENETTLNIKKRKIN

SEQ ID NO: 2422121 - protein, 4 aa, Entamoeba dispar
ENEV

SEQ ID NO: 2422122 - protein, 5 aa, Entamoeba dispar
ENEWE

SEQ ID NO: 2422123 - protein, 11 aa, Entamoeba dispar
ENFENDKNDIG

SEQ ID NO: 2422124 - protein, 7 aa, Entamoeba dispar
ENFENSK

SEQ ID NO: 2422125 - protein, 21 aa, Entamoeba dispar
ENFKKEAGSYFGSSEKDPKPL

SEQ ID NO: 2422126 - protein, 6 aa, Entamoeba dispar
ENFNPT

SEQ ID NO: 2422127 - protein, 8 aa, Entamoeba dispar
ENFNTNTV

SEQ ID NO: 2422128 - protein, 4 aa, Entamoeba dispar
ENFP

SEQ ID NO: 2422129 - protein, 11 aa, Entamoeba dispar
ENFSRAGECYQ

SEQ ID NO: 2422130 - protein, 6 aa, Entamoeba dispar
ENFTPK

SEQ ID NO: 2422131 - protein, 14 aa, Entamoeba dispar
ENFYSTETANWFTI

SEQ ID NO: 2422132 - protein, 5 aa, Entamoeba dispar
ENGAK

SEQ ID NO: 2422133 - protein, 8 aa, Entamoeba dispar
ENGAVPEE

SEQ ID NO: 2422134 - protein, 4 aa, Entamoeba dispar
ENGC

SEQ ID NO: 2422135 - protein, 8 aa, Entamoeba dispar
ENGDGTFT

SEQ ID NO: 2422136 - protein, 7 aa, Entamoeba dispar
ENGDNEC

SEQ ID NO: 2422137 - protein, 9 aa, Entamoeba dispar
ENGEDNSLV

SEQ ID NO: 2422138 - protein, 13 aa, Entamoeba dispar
ENGEKVSQAIGKV

SEQ ID NO: 2422139 - protein, 8 aa, Entamoeba dispar
ENGENDDW

SEQ ID NO: 2422140 - protein, 5 aa, Entamoeba dispar
ENGEV

SEQ ID NO: 2422141 - protein, 11 aa, Entamoeba dispar
ENGEVKENKVG

SEQ ID NO: 2422142 - protein, 7 aa, Entamoeba dispar
ENGEYDE

SEQ ID NO: 2422143 - protein, 5 aa, Entamoeba dispar
ENGFT

SEQ ID NO: 2422144 - protein, 11 aa, Entamoeba dispar
ENGGSLDQETA

SEQ ID NO: 2422145 - protein, 9 aa, Entamoeba dispar
ENGGTEGRA

SEQ ID NO: 2422146 - protein, 16 aa, Entamoeba dispar
ENGHPQKQFGRRQHEE

SEQ ID NO: 2422147 - protein, 8 aa, Entamoeba dispar
ENGIEQKY

SEQ ID NO: 2422148 - protein, 13 aa, Entamoeba dispar
ENGIGKKVESTSK

SEQ ID NO: 2422149 - protein, 6 aa, Entamoeba dispar
ENGKEI

SEQ ID NO: 2422150 - protein, 9 aa, Entamoeba dispar
ENGKENDLE

SEQ ID NO: 2422151 - protein, 7 aa, Entamoeba dispar
ENGKGIG

SEQ ID NO: 2422152 - protein, 24 aa, Entamoeba dispar
ENGKKNPNVARRKIGKKNKRLQKD

SEQ ID NO: 2422153 - protein, 10 aa, Entamoeba dispar
ENGKTIESEY

SEQ ID NO: 2422154 - protein, 11 aa, Entamoeba dispar
ENGLQDKPSTL

SEQ ID NO: 2422155 - protein, 4 aa, Entamoeba dispar
ENGM

SEQ ID NO: 2422156 - protein, 6 aa, Entamoeba dispar
ENGMEE

SEQ ID NO: 2422157 - protein, 9 aa, Entamoeba dispar
ENGNDKIRA

SEQ ID NO: 2422158 - protein, 11 aa, Entamoeba dispar
ENGNETDPRDL

SEQ ID NO: 2422159 - protein, 7 aa, Entamoeba dispar
ENGNIKP

SEQ ID NO: 2422160 - protein, 6 aa, Entamoeba dispar
ENGNKV

SEQ ID NO: 2422161 - protein, 6 aa, Entamoeba dispar
ENGPAK

SEQ ID NO: 2422162 - protein, 8 aa, Entamoeba dispar
ENGPIREK

SEQ ID NO: 2422163 - protein, 10 aa, Entamoeba dispar
ENGPKEGASK

SEQ ID NO: 2422164 - protein, 7 aa, Entamoeba dispar
ENGPKVL

SEQ ID NO: 2422165 - protein, 7 aa, Entamoeba dispar
ENGQEPV

SEQ ID NO: 2422166 - protein, 7 aa, Entamoeba dispar
ENGSERR

SEQ ID NO: 2422167 - protein, 7 aa, Entamoeba dispar
ENGSHFG

SEQ ID NO: 2422168 - protein, 5 aa, Entamoeba dispar
ENGSI

SEQ ID NO: 2422169 - protein, 8 aa, Entamoeba dispar
ENGSNEVP

SEQ ID NO: 2422170 - protein, 14 aa, Entamoeba dispar
ENGSPLNGLNTPEQ

SEQ ID NO: 2422171 - protein, 6 aa, Entamoeba dispar
ENGSVE

SEQ ID NO: 2422172 - protein, 6 aa, Entamoeba dispar
ENGTCP

SEQ ID NO: 2422173 - protein, 8 aa, Entamoeba dispar
ENGTGKPY

SEQ ID NO: 2422174 - protein, 5 aa, Entamoeba dispar
ENGTK

SEQ ID NO: 2422175 - protein, 5 aa, Entamoeba dispar
ENGTM

SEQ ID NO: 2422176 - protein, 8 aa, Entamoeba dispar
ENGTSDSF

SEQ ID NO: 2422177 - protein, 5 aa, Entamoeba dispar
ENGVE

SEQ ID NO: 2422178 - protein, 5 aa, Entamoeba dispar
ENGVP

SEQ ID NO: 2422179 - protein, 4 aa, Entamoeba dispar
ENGY

SEQ ID NO: 2422180 - protein, 11 aa, Entamoeba dispar
ENGYQEDQLKQ

SEQ ID NO: 2422181 - protein, 11 aa, Entamoeba dispar
ENHCSIGSRKP

SEQ ID NO: 2422182 - protein, 7 aa, Entamoeba dispar
ENHETGK

SEQ ID NO: 2422183 - protein, 19 aa, Entamoeba dispar
ENHPGEKLPPDPHKFPGKL

SEQ ID NO: 2422184 - protein, 9 aa, Entamoeba dispar
ENHPLTGAS

SEQ ID NO: 2422185 - protein, 7 aa, Entamoeba dispar
ENHPNNP

SEQ ID NO: 2422186 - protein, 4 aa, Entamoeba dispar
ENID

SEQ ID NO: 2422187 - protein, 6 aa, Entamoeba dispar
ENIDRD

SEQ ID NO: 2422188 - protein, 18 aa, Entamoeba dispar
ENIEDNSVTMETHNKSGP

SEQ ID NO: 2422189 - protein, 5 aa, Entamoeba dispar
ENIEK

SEQ ID NO: 2422190 - protein, 7 aa, Entamoeba dispar
ENIEKKD

SEQ ID NO: 2422191 - protein, 9 aa, Entamoeba dispar
ENIEKKENI

SEQ ID NO: 2422192 - protein, 14 aa, Entamoeba dispar
ENIEKRGRPEEKDY

SEQ ID NO: 2422193 - protein, 27 aa, Entamoeba dispar
ENIEQPNDEEEQNIKNEEEDTQEEIEP

SEQ ID NO: 2422194 - protein, 14 aa, Entamoeba dispar
ENIETKKKECNNLN

SEQ ID NO: 2422195 - protein, 4 aa, Entamoeba dispar
ENIG

SEQ ID NO: 2422196 - protein, 7 aa, Entamoeba dispar
ENIHDDS

SEQ ID NO: 2422197 - protein, 5 aa, Entamoeba dispar
ENIKE

SEQ ID NO: 2422198 - protein, 8 aa, Entamoeba dispar
ENIKKSDV

SEQ ID NO: 2422199 - protein, 7 aa, Entamoeba dispar
ENIKNPF

SEQ ID NO: 2422200 - protein, 9 aa, Entamoeba dispar
ENIKQPDEQ

SEQ ID NO: 2422201 - protein, 5 aa, Entamoeba dispar
ENIPE

SEQ ID NO: 2422202 - protein, 13 aa, Entamoeba dispar
ENIPKGVKEVGDN

SEQ ID NO: 2422203 - protein, 10 aa, Entamoeba dispar
ENIPKTQATI

SEQ ID NO: 2422204 - protein, 14 aa, Entamoeba dispar
ENIPSKHKNDIKTS

SEQ ID NO: 2422205 - protein, 10 aa, Entamoeba dispar
ENIPTPQEQE

SEQ ID NO: 2422206 - protein, 10 aa, Entamoeba dispar
ENIQKQINEN

SEQ ID NO: 2422207 - protein, 5 aa, Entamoeba dispar
ENIST

SEQ ID NO: 2422208 - protein, 5 aa, Entamoeba dispar
ENITP

SEQ ID NO: 2422209 - protein, 9 aa, Entamoeba dispar
ENITTTQGH

SEQ ID NO: 2422210 - protein, 6 aa, Entamoeba dispar
ENITTV

SEQ ID NO: 2422211 - protein, 10 aa, Entamoeba dispar
ENKAIRPEKQ

SEQ ID NO: 2422212 - protein, 6 aa, Entamoeba dispar
ENKDGD

SEQ ID NO: 2422213 - protein, 8 aa, Entamoeba dispar
ENKDGNFQ

SEQ ID NO: 2422214 - protein, 5 aa, Entamoeba dispar
ENKDS

SEQ ID NO: 2422215 - protein, 4 aa, Entamoeba dispar
ENKE

SEQ ID NO: 2422216 - protein, 6 aa, Entamoeba dispar
ENKEDF

SEQ ID NO: 2422217 - protein, 12 aa, Entamoeba dispar
ENKEIKEGNETF

SEQ ID NO: 2422218 - protein, 11 aa, Entamoeba dispar
ENKEINGTEYP

SEQ ID NO: 2422219 - protein, 16 aa, Entamoeba dispar
ENKEKAQKSKGDIVTS

SEQ ID NO: 2422220 - protein, 8 aa, Entamoeba dispar
ENKEKSKE

SEQ ID NO: 2422221 - protein, 5 aa, Entamoeba dispar
ENKEN

SEQ ID NO: 2422222 - protein, 5 aa, Entamoeba dispar
ENKEP

SEQ ID NO: 2422223 - protein, 7 aa, Entamoeba dispar
ENKERIN

SEQ ID NO: 2422224 - protein, 6 aa, Entamoeba dispar
ENKESI

SEQ ID NO: 2422225 - protein, 6 aa, Entamoeba dispar
ENKESN

SEQ ID NO: 2422226 - protein, 6 aa, Entamoeba dispar
ENKEVV

SEQ ID NO: 2422227 - protein, 5 aa, Entamoeba dispar
ENKEY

SEQ ID NO: 2422228 - protein, 6 aa, Entamoeba dispar
ENKEYE

SEQ ID NO: 2422229 - protein, 6 aa, Entamoeba dispar
ENKGEL

SEQ ID NO: 2422230 - protein, 16 aa, Entamoeba dispar
ENKGKTGYFPSNYVRV

SEQ ID NO: 2422231 - protein, 5 aa, Entamoeba dispar
ENKGV

SEQ ID NO: 2422232 - protein, 6 aa, Entamoeba dispar
ENKHER

SEQ ID NO: 2422233 - protein, 4 aa, Entamoeba dispar
ENKI

SEQ ID NO: 2422234 - protein, 12 aa, Entamoeba dispar
ENKIEENKRREV

SEQ ID NO: 2422235 - protein, 12 aa, Entamoeba dispar
ENKIEKKANASF

SEQ ID NO: 2422236 - protein, 7 aa, Entamoeba dispar
ENKIKEG

SEQ ID NO: 2422237 - protein, 41 aa, Entamoeba dispar
ENKIKEIEKELEENTKERKEESHIKEEKEEEEIKEVKRKRR

SEQ ID NO: 2422238 - protein, 12 aa, Entamoeba dispar
ENKISQFNTSDL

SEQ ID NO: 2422239 - protein, 7 aa, Entamoeba dispar
ENKITSI

SEQ ID NO: 2422240 - protein, 7 aa, Entamoeba dispar
ENKKEKK

SEQ ID NO: 2422241 - protein, 9 aa, Entamoeba dispar
ENKKETGTL

SEQ ID NO: 2422242 - protein, 6 aa, Entamoeba dispar
ENKKEY

SEQ ID NO: 2422243 - protein, 5 aa, Entamoeba dispar
ENKKK

SEQ ID NO: 2422244 - protein, 5 aa, Entamoeba dispar
ENKKN

SEQ ID NO: 2422245 - protein, 10 aa, Entamoeba dispar
ENKKRENNKN

SEQ ID NO: 2422246 - protein, 26 aa, Entamoeba dispar
ENKLAEAAINKEEKVRKTRKRRGQQE

SEQ ID NO: 2422247 - protein, 25 aa, Entamoeba dispar
ENKLKENSDNKENIIKQKKNEDKYQ

SEQ ID NO: 2422248 - protein, 8 aa, Entamoeba dispar
ENKMNSRD

SEQ ID NO: 2422249 - protein, 8 aa, Entamoeba dispar
ENKMSTSN

SEQ ID NO: 2422250 - protein, 7 aa, Entamoeba dispar
ENKNDFL

SEQ ID NO: 2422251 - protein, 5 aa, Entamoeba dispar
ENKNE

SEQ ID NO: 2422252 - protein, 7 aa, Entamoeba dispar
ENKNENG

SEQ ID NO: 2422253 - protein, 13 aa, Entamoeba dispar
ENKNESNNKQIRD

SEQ ID NO: 2422254 - protein, 22 aa, Entamoeba dispar
ENKNFEDNTIRHEEKDDVDQQL

SEQ ID NO: 2422255 - protein, 22 aa, Entamoeba dispar
ENKNFEDSTIRHEEKDDVDQQL

SEQ ID NO: 2422256 - protein, 7 aa, Entamoeba dispar
ENKNNQI

SEQ ID NO: 2422257 - protein, 7 aa, Entamoeba dispar
ENKNQSE

SEQ ID NO: 2422258 - protein, 5 aa, Entamoeba dispar
ENKNV

SEQ ID NO: 2422259 - protein, 9 aa, Entamoeba dispar
ENKPIPKTI

SEQ ID NO: 2422260 - protein, 4 aa, Entamoeba dispar
ENKQ

SEQ ID NO: 2422261 - protein, 6 aa, Entamoeba dispar
ENKQLK

SEQ ID NO: 2422262 - protein, 7 aa, Entamoeba dispar
ENKQPSQ

SEQ ID NO: 2422263 - protein, 5 aa, Entamoeba dispar
ENKRM

SEQ ID NO: 2422264 - protein, 7 aa, Entamoeba dispar
ENKRPQE

SEQ ID NO: 2422265 - protein, 7 aa, Entamoeba dispar
ENKSYGK

SEQ ID NO: 2422266 - protein, 21 aa, Entamoeba dispar
ENKSYIPPKPEKAPPSPRKKT

SEQ ID NO: 2422267 - protein, 13 aa, Entamoeba dispar
ENKTEKNENQNDV

SEQ ID NO: 2422268 - protein, 8 aa, Entamoeba dispar
ENKTNRIQ

SEQ ID NO: 2422269 - protein, 10 aa, Entamoeba dispar
ENKTQTEERE

SEQ ID NO: 2422270 - protein, 7 aa, Entamoeba dispar
ENKTYTI

SEQ ID NO: 2422271 - protein, 14 aa, Entamoeba dispar
ENKVHEKVNQEPLK

SEQ ID NO: 2422272 - protein, 6 aa, Entamoeba dispar
ENKVQG

SEQ ID NO: 2422273 - protein, 10 aa, Entamoeba dispar
ENKVSGEEKR

SEQ ID NO: 2422274 - protein, 15 aa, Entamoeba dispar
ENKYDQNVSLSSPSL

SEQ ID NO: 2422275 - protein, 5 aa, Entamoeba dispar
ENKYG

SEQ ID NO: 2422276 - protein, 4 aa, Entamoeba dispar
ENLA

SEQ ID NO: 2422277 - protein, 11 aa, Entamoeba dispar
ENLEERKKGLT

SEQ ID NO: 2422278 - protein, 9 aa, Entamoeba dispar
ENLGEGTYG

SEQ ID NO: 2422279 - protein, 15 aa, Entamoeba dispar
ENLKEVNGKSIEKKD

SEQ ID NO: 2422280 - protein, 10 aa, Entamoeba dispar
ENLKKKKQGV

SEQ ID NO: 2422281 - protein, 4 aa, Entamoeba dispar
ENLL

SEQ ID NO: 2422282 - protein, 6 aa, Entamoeba dispar
ENLNTL

SEQ ID NO: 2422283 - protein, 7 aa, Entamoeba dispar
ENLPGDI

SEQ ID NO: 2422284 - protein, 8 aa, Entamoeba dispar
ENLPGGHN

SEQ ID NO: 2422285 - protein, 6 aa, Entamoeba dispar
ENLSDN

SEQ ID NO: 2422286 - protein, 29 aa, Entamoeba dispar
ENLSENSKQIKNDENNTEPTKELKENEEA

SEQ ID NO: 2422287 - protein, 9 aa, Entamoeba dispar
ENLSKVPSE

SEQ ID NO: 2422288 - protein, 5 aa, Entamoeba dispar
ENLSQ

SEQ ID NO: 2422289 - protein, 5 aa, Entamoeba dispar
ENLTN

SEQ ID NO: 2422290 - protein, 8 aa, Entamoeba dispar
ENLTTSLH

SEQ ID NO: 2422291 - protein, 10 aa, Entamoeba dispar
ENMADSESGY

SEQ ID NO: 2422292 - protein, 12 aa, Entamoeba dispar
ENMNSKLEAYMK

SEQ ID NO: 2422293 - protein, 5 aa, Entamoeba dispar
ENMPS

SEQ ID NO: 2422294 - protein, 4 aa, Entamoeba dispar
ENNA

SEQ ID NO: 2422295 - protein, 7 aa, Entamoeba dispar
ENNANNY

SEQ ID NO: 2422296 - protein, 4 aa, Entamoeba dispar
ENNC

SEQ ID NO: 2422297 - protein, 5 aa, Entamoeba dispar
ENNCR

SEQ ID NO: 2422298 - protein, 14 aa, Entamoeba dispar
ENNCSEENKRNITS

SEQ ID NO: 2422299 - protein, 5 aa, Entamoeba dispar
ENNDE

SEQ ID NO: 2422300 - protein, 10 aa, Entamoeba dispar
ENNDPPITEV

SEQ ID NO: 2422301 - protein, 4 aa, Entamoeba dispar
ENNE

SEQ ID NO: 2422302 - protein, 9 aa, Entamoeba dispar
ENNEKQEGI

SEQ ID NO: 2422303 - protein, 20 aa, Entamoeba dispar
ENNENERKNTRSSFNPRTAG

SEQ ID NO: 2422304 - protein, 21 aa, Entamoeba dispar
ENNENKLSTEGENKEVNKNEF

SEQ ID NO: 2422305 - protein, 9 aa, Entamoeba dispar
ENNENREEQ

SEQ ID NO: 2422306 - protein, 35 aa, Entamoeba dispar
  misc_feature (18)..(19): Xaa can be any naturally occurring amino acid
ENNERSKNKKKIRKRDIXXEKEIIELKAISKRYEE

SEQ ID NO: 2422307 - protein, 7 aa, Entamoeba dispar
ENNESEW

SEQ ID NO: 2422308 - protein, 18 aa, Entamoeba dispar
ENNESLGKALSSRKSSNE

SEQ ID NO: 2422309 - protein, 6 aa, Entamoeba dispar
ENNETF

SEQ ID NO: 2422310 - protein, 6 aa, Entamoeba dispar
ENNEVR

SEQ ID NO: 2422311 - protein, 5 aa, Entamoeba dispar
ENNFI

SEQ ID NO: 2422312 - protein, 6 aa, Entamoeba dispar
ENNGMK

SEQ ID NO: 2422313 - protein, 5 aa, Entamoeba dispar
ENNGN

SEQ ID NO: 2422314 - protein, 9 aa, Entamoeba dispar
ENNGTDSQL

SEQ ID NO: 2422315 - protein, 7 aa, Entamoeba dispar
ENNHNLA

SEQ ID NO: 2422316 - protein, 18 aa, Entamoeba dispar
ENNKGDKIERLTGTTTRN

SEQ ID NO: 2422317 - protein, 6 aa, Entamoeba dispar
ENNKHE

SEQ ID NO: 2422318 - protein, 5 aa, Entamoeba dispar
ENNKN

SEQ ID NO: 2422319 - protein, 56 aa, Entamoeba dispar
ENNKNSISIEEKHSSNSINSNTSKIINDKNKINQEDITNFENKQKELLTNSKGIEQ

SEQ ID NO: 2422320 - protein, 26 aa, Entamoeba dispar
ENNKQPEPKEENKKTTFDTITTTTDN

SEQ ID NO: 2422321 - protein, 17 aa, Entamoeba dispar
ENNKTKSCCKQSSFEYK

SEQ ID NO: 2422322 - protein, 15 aa, Entamoeba dispar
ENNKTQSSCKQRSFS

SEQ ID NO: 2422323 - protein, 8 aa, Entamoeba dispar
ENNKYAYN

SEQ ID NO: 2422324 - protein, 6 aa, Entamoeba dispar
ENNKYI

SEQ ID NO: 2422325 - protein, 4 aa, Entamoeba dispar
ENNL

SEQ ID NO: 2422326 - protein, 10 aa, Entamoeba dispar
ENNLGENEKK

SEQ ID NO: 2422327 - protein, 11 aa, Entamoeba dispar
ENNLKSLPPEI

SEQ ID NO: 2422328 - protein, 7 aa, Entamoeba dispar
ENNNDLL

SEQ ID NO: 2422329 - protein, 7 aa, Entamoeba dispar
ENNNETH

SEQ ID NO: 2422330 - protein, 6 aa, Entamoeba dispar
ENNNKM

SEQ ID NO: 2422331 - protein, 28 aa, Entamoeba dispar
ENNNQIKSVDQKGINKEFQTENNTNKQD

SEQ ID NO: 2422332 - protein, 5 aa, Entamoeba dispar
ENNPC

SEQ ID NO: 2422333 - protein, 13 aa, Entamoeba dispar
ENNPCPPSTEAGH

SEQ ID NO: 2422334 - protein, 10 aa, Entamoeba dispar
ENNPITDSKE

SEQ ID NO: 2422335 - protein, 7 aa, Entamoeba dispar
ENNPYDQ

SEQ ID NO: 2422336 - protein, 6 aa, Entamoeba dispar
ENNQDI

SEQ ID NO: 2422337 - protein, 12 aa, Entamoeba dispar
ENNQNNQVGQEE

SEQ ID NO: 2422338 - protein, 7 aa, Entamoeba dispar
ENNQRQA

SEQ ID NO: 2422339 - protein, 7 aa, Entamoeba dispar
ENNSIED

SEQ ID NO: 2422340 - protein, 35 aa, Entamoeba dispar
ENNSLTQSPSGTPERQQTLDQKKDQNKTDKPKKVR

SEQ ID NO: 2422341 - protein, 6 aa, Entamoeba dispar
ENNSNT

SEQ ID NO: 2422342 - protein, 8 aa, Entamoeba dispar
ENNSVEEI

SEQ ID NO: 2422343 - protein, 4 aa, Entamoeba dispar
ENNT

SEQ ID NO: 2422344 - protein, 8 aa, Entamoeba dispar
ENNTQNIS

SEQ ID NO: 2422345 - protein, 8 aa, Entamoeba dispar
ENNVSEKA

SEQ ID NO: 2422346 - protein, 25 aa, Entamoeba dispar
ENNYGELDENAQMNATFSASSAVTS

SEQ ID NO: 2422347 - protein, 7 aa, Entamoeba dispar
ENNYQTE

SEQ ID NO: 2422348 - protein, 6 aa, Entamoeba dispar
ENPAYK

SEQ ID NO: 2422349 - protein, 4 aa, Entamoeba dispar
ENPD

SEQ ID NO: 2422350 - protein, 5 aa, Entamoeba dispar
ENPEA

SEQ ID NO: 2422351 - protein, 26 aa, Entamoeba dispar
ENPEISPKYNKPQPMEEEKSEEEEDI

SEQ ID NO: 2422352 - protein, 9 aa, Entamoeba dispar
ENPEKQTTL

SEQ ID NO: 2422353 - protein, 5 aa, Entamoeba dispar
ENPEM

SEQ ID NO: 2422354 - protein, 4 aa, Entamoeba dispar
ENPF

SEQ ID NO: 2422355 - protein, 6 aa, Entamoeba dispar
ENPFGR

SEQ ID NO: 2422356 - protein, 6 aa, Entamoeba dispar
ENPGES

SEQ ID NO: 2422357 - protein, 6 aa, Entamoeba dispar
ENPISS

SEQ ID NO: 2422358 - protein, 27 aa, Entamoeba dispar
ENPITTKEETKESEDKNEIKSDETKKN

SEQ ID NO: 2422359 - protein, 9 aa, Entamoeba dispar
ENPNERPTS

SEQ ID NO: 2422360 - protein, 14 aa, Entamoeba dispar
ENPNHSNSKQNQEV

SEQ ID NO: 2422361 - protein, 8 aa, Entamoeba dispar
ENPNNPRQ

SEQ ID NO: 2422362 - protein, 10 aa, Entamoeba dispar
ENPPENPDRP

SEQ ID NO: 2422363 - protein, 9 aa, Entamoeba dispar
ENPPQNTPE

SEQ ID NO: 2422364 - protein, 5 aa, Entamoeba dispar
ENPQT

SEQ ID NO: 2422365 - protein, 4 aa, Entamoeba dispar
ENPR

SEQ ID NO: 2422366 - protein, 13 aa, Entamoeba dispar
ENPRLQSTLFKAF

SEQ ID NO: 2422367 - protein, 14 aa, Entamoeba dispar
ENPSDIEKKISSSI

SEQ ID NO: 2422368 - protein, 4 aa, Entamoeba dispar
ENPT

SEQ ID NO: 2422369 - protein, 7 aa, Entamoeba dispar
ENPVRGR

SEQ ID NO: 2422370 - protein, 20 aa, Entamoeba dispar
ENPYTQIQQKRQQRGDRNRL

SEQ ID NO: 2422371 - protein, 4 aa, Entamoeba dispar
ENQA

SEQ ID NO: 2422372 - protein, 13 aa, Entamoeba dispar
ENQAKNSSSQIDG

SEQ ID NO: 2422373 - protein, 11 aa, Entamoeba dispar
ENQDASKLASQ

SEQ ID NO: 2422374 - protein, 6 aa, Entamoeba dispar
ENQEDF

SEQ ID NO: 2422375 - protein, 8 aa, Entamoeba dispar
ENQELSTK

SEQ ID NO: 2422376 - protein, 5 aa, Entamoeba dispar
ENQET

SEQ ID NO: 2422377 - protein, 6 aa, Entamoeba dispar
ENQIQP

SEQ ID NO: 2422378 - protein, 6 aa, Entamoeba dispar
ENQKDV

SEQ ID NO: 2422379 - protein, 6 aa, Entamoeba dispar
ENQKEI

SEQ ID NO: 2422380 - protein, 7 aa, Entamoeba dispar
ENQKEIN

SEQ ID NO: 2422381 - protein, 10 aa, Entamoeba dispar
ENQKERAAQY

SEQ ID NO: 2422382 - protein, 20 aa, Entamoeba dispar
ENQKESDESQEEGGSDEDDL

SEQ ID NO: 2422383 - protein, 7 aa, Entamoeba dispar
ENQKIKE

SEQ ID NO: 2422384 - protein, 27 aa, Entamoeba dispar
ENQKKQFDKQNEKYQTECRDKETEFNE

SEQ ID NO: 2422385 - protein, 14 aa, Entamoeba dispar
ENQKQLTRGIPPMN

SEQ ID NO: 2422386 - protein, 31 aa, Entamoeba dispar
ENQKQQTSTKSAERVNVTKPTTPNTQEQAGC

SEQ ID NO: 2422387 - protein, 4 aa, Entamoeba dispar
ENQL

SEQ ID NO: 2422388 - protein, 8 aa, Entamoeba dispar
ENQNKIEQ

SEQ ID NO: 2422389 - protein, 6 aa, Entamoeba dispar
ENQNSL

SEQ ID NO: 2422390 - protein, 4 aa, Entamoeba dispar
ENQP

SEQ ID NO: 2422391 - protein, 4 aa, Entamoeba dispar
ENQQ

SEQ ID NO: 2422392 - protein, 5 aa, Entamoeba dispar
ENQQC

SEQ ID NO: 2422393 - protein, 8 aa, Entamoeba dispar
ENQQIEKD

SEQ ID NO: 2422394 - protein, 11 aa, Entamoeba dispar
ENQQQEQIERK

SEQ ID NO: 2422395 - protein, 7 aa, Entamoeba dispar
ENQQSVL

SEQ ID NO: 2422396 - protein, 5 aa, Entamoeba dispar
ENQQV

SEQ ID NO: 2422397 - protein, 4 aa, Entamoeba dispar
ENQR

SEQ ID NO: 2422398 - protein, 5 aa, Entamoeba dispar
ENQRR

SEQ ID NO: 2422399 - protein, 15 aa, Entamoeba dispar
ENQSEWNTASSVKQT

SEQ ID NO: 2422400 - protein, 9 aa, Entamoeba dispar
ENQSFEEKK

SEQ ID NO: 2422401 - protein, 8 aa, Entamoeba dispar
ENQSIGRT

SEQ ID NO: 2422402 - protein, 7 aa, Entamoeba dispar
ENQTENI

SEQ ID NO: 2422403 - protein, 5 aa, Entamoeba dispar
ENQTS

SEQ ID NO: 2422404 - protein, 6 aa, Entamoeba dispar
ENQVKE

SEQ ID NO: 2422405 - protein, 10 aa, Entamoeba dispar
ENRDYQSEQE

SEQ ID NO: 2422406 - protein, 9 aa, Entamoeba dispar
ENREEELQS

SEQ ID NO: 2422407 - protein, 6 aa, Entamoeba dispar
ENRESV

SEQ ID NO: 2422408 - protein, 6 aa, Entamoeba dispar
ENREVE

SEQ ID NO: 2422409 - protein, 9 aa, Entamoeba dispar
ENRIRREND

SEQ ID NO: 2422410 - protein, 6 aa, Entamoeba dispar
ENRISP

SEQ ID NO: 2422411 - protein, 29 aa, Entamoeba dispar
ENRKKRNEKQRERSKKRRPEHQTETYNGR

SEQ ID NO: 2422412 - protein, 6 aa, Entamoeba dispar
ENRQFD

SEQ ID NO: 2422413 - protein, 18 aa, Entamoeba dispar
ENRQKRLSSQNPVVPPVQ

SEQ ID NO: 2422414 - protein, 12 aa, Entamoeba dispar
ENRRDNETIGCT

SEQ ID NO: 2422415 - protein, 24 aa, Entamoeba dispar
ENRRLPSSIARNSRRLLSRRLLDL

SEQ ID NO: 2422416 - protein, 9 aa, Entamoeba dispar
ENRRSMSEK

SEQ ID NO: 2422417 - protein, 8 aa, Entamoeba dispar
ENRSLDPD

SEQ ID NO: 2422418 - protein, 4 aa, Entamoeba dispar
ENRV

SEQ ID NO: 2422419 - protein, 4 aa, Entamoeba dispar
ENRY

SEQ ID NO: 2422420 - protein, 6 aa, Entamoeba dispar
ENRYSP

SEQ ID NO: 2422421 - protein, 6 aa, Entamoeba dispar
ENSAPM

SEQ ID NO: 2422422 - protein, 12 aa, Entamoeba dispar
ENSDKYAISDSY

SEQ ID NO: 2422423 - protein, 14 aa, Entamoeba dispar
ENSDRVRKNEDESQ

SEQ ID NO: 2422424 - protein, 4 aa, Entamoeba dispar
ENSE

SEQ ID NO: 2422425 - protein, 10 aa, Entamoeba dispar
ENSEGEYSNI

SEQ ID NO: 2422426 - protein, 14 aa, Entamoeba dispar
ENSEHEETDRIQEN

SEQ ID NO: 2422427 - protein, 13 aa, Entamoeba dispar
ENSEKTDKIKEAK

SEQ ID NO: 2422428 - protein, 12 aa, Entamoeba dispar
ENSELSSVTGEE

SEQ ID NO: 2422429 - protein, 5 aa, Entamoeba dispar
ENSEN

SEQ ID NO: 2422430 - protein, 11 aa, Entamoeba dispar
ENSESSTTSSI

SEQ ID NO: 2422431 - protein, 18 aa, Entamoeba dispar
ENSETSDISDSIKSQTFK

SEQ ID NO: 2422432 - protein, 14 aa, Entamoeba dispar
ENSFSNDSSTPLSH

SEQ ID NO: 2422433 - protein, 9 aa, Entamoeba dispar
ENSGKTVSQ

SEQ ID NO: 2422434 - protein, 11 aa, Entamoeba dispar
ENSIKAEKELE

SEQ ID NO: 2422435 - protein, 11 aa, Entamoeba dispar
ENSKKENTELV

SEQ ID NO: 2422436 - protein, 10 aa, Entamoeba dispar
ENSKKNVPAT

SEQ ID NO: 2422437 - protein, 6 aa, Entamoeba dispar
ENSKRV

SEQ ID NO: 2422438 - protein, 4 aa, Entamoeba dispar
ENSL

SEQ ID NO: 2422439 - protein, 7 aa, Entamoeba dispar
ENSLKKQ

SEQ ID NO: 2422440 - protein, 14 aa, Entamoeba dispar
ENSLSKEERNKLKQ

SEQ ID NO: 2422441 - protein, 8 aa, Entamoeba dispar
ENSNAYGE

SEQ ID NO: 2422442 - protein, 5 aa, Entamoeba dispar
ENSNC

SEQ ID NO: 2422443 - protein, 17 aa, Entamoeba dispar
ENSNGEEKTKPLKELSA

SEQ ID NO: 2422444 - protein, 6 aa, Entamoeba dispar
ENSNIQ

SEQ ID NO: 2422445 - protein, 7 aa, Entamoeba dispar
ENSNVQD

SEQ ID NO: 2422446 - protein, 10 aa, Entamoeba dispar
ENSPFDLSSG

SEQ ID NO: 2422447 - protein, 8 aa, Entamoeba dispar
ENSPNKED

SEQ ID NO: 2422448 - protein, 5 aa, Entamoeba dispar
ENSPV

SEQ ID NO: 2422449 - protein, 5 aa, Entamoeba dispar
ENSPY

SEQ ID NO: 2422450 - protein, 6 aa, Entamoeba dispar
ENSQNI

SEQ ID NO: 2422451 - protein, 8 aa, Entamoeba dispar
ENSQSKKQ

SEQ ID NO: 2422452 - protein, 17 aa, Entamoeba dispar
ENSSGYAEITDRSALET

SEQ ID NO: 2422453 - protein, 6 aa, Entamoeba dispar
ENSSQL

SEQ ID NO: 2422454 - protein, 12 aa, Entamoeba dispar
ENSSSNCSNKVK

SEQ ID NO: 2422455 - protein, 5 aa, Entamoeba dispar
ENSSW

SEQ ID NO: 2422456 - protein, 9 aa, Entamoeba dispar
ENSTARHKK

SEQ ID NO: 2422457 - protein, 6 aa, Entamoeba dispar
ENSTLK

SEQ ID NO: 2422458 - protein, 12 aa, Entamoeba dispar
ENSTNERNKYQD

SEQ ID NO: 2422459 - protein, 7 aa, Entamoeba dispar
ENSVNKI

SEQ ID NO: 2422460 - protein, 4 aa, Entamoeba dispar
ENTA

SEQ ID NO: 2422461 - protein, 4 aa, Entamoeba dispar
ENTD

SEQ ID NO: 2422462 - protein, 19 aa, Entamoeba dispar
ENTDAAKNRSEHKYETTPS

SEQ ID NO: 2422463 - protein, 15 aa, Entamoeba dispar
ENTDSFIQTNMQKIF

SEQ ID NO: 2422464 - protein, 13 aa, Entamoeba dispar
ENTDSVKAISPPI

SEQ ID NO: 2422465 - protein, 13 aa, Entamoeba dispar
ENTEDAQKAVTAP

SEQ ID NO: 2422466 - protein, 8 aa, Entamoeba dispar
ENTEEINQ

SEQ ID NO: 2422467 - protein, 8 aa, Entamoeba dispar
ENTEEPYL

SEQ ID NO: 2422468 - protein, 5 aa, Entamoeba dispar
ENTFP

SEQ ID NO: 2422469 - protein, 8 aa, Entamoeba dispar
ENTGEYIG

SEQ ID NO: 2422470 - protein, 10 aa, Entamoeba dispar
ENTGVTNPDK

SEQ ID NO: 2422471 - protein, 4 aa, Entamoeba dispar
ENTH

SEQ ID NO: 2422472 - protein, 4 aa, Entamoeba dispar
ENTI

SEQ ID NO: 2422473 - protein, 6 aa, Entamoeba dispar
ENTIEK

SEQ ID NO: 2422474 - protein, 9 aa, Entamoeba dispar
ENTIPNKKD

SEQ ID NO: 2422475 - protein, 7 aa, Entamoeba dispar
ENTIQQQ

SEQ ID NO: 2422476 - protein, 7 aa, Entamoeba dispar
ENTKGYL

SEQ ID NO: 2422477 - protein, 4 aa, Entamoeba dispar
ENTL

SEQ ID NO: 2422478 - protein, 5 aa, Entamoeba dispar
ENTMK

SEQ ID NO: 2422479 - protein, 17 aa, Entamoeba dispar
ENTNDQPLKKPQKSRIF

SEQ ID NO: 2422480 - protein, 78 aa, Entamoeba dispar
ENTNKKQEELKPKKIEYKESSDKQKIKEEIKEEIKEEIKEEIKEEIESEDTEEALKKEYEEMEEEEEFEDSSDSQKYF

SEQ ID NO: 2422481 - protein, 10 aa, Entamoeba dispar
ENTPERKETI

SEQ ID NO: 2422482 - protein, 16 aa, Entamoeba dispar
ENTPLLNTNQKNQEEL

SEQ ID NO: 2422483 - protein, 9 aa, Entamoeba dispar
ENTPNGHSG

SEQ ID NO: 2422484 - protein, 8 aa, Entamoeba dispar
ENTPNYQK

SEQ ID NO: 2422485 - protein, 5 aa, Entamoeba dispar
ENTPS

SEQ ID NO: 2422486 - protein, 7 aa, Entamoeba dispar
ENTPYCD

SEQ ID NO: 2422487 - protein, 6 aa, Entamoeba dispar
ENTQIP

SEQ ID NO: 2422488 - protein, 15 aa, Entamoeba dispar
ENTQSNEQTKVKQES

SEQ ID NO: 2422489 - protein, 6 aa, Entamoeba dispar
ENTRLE

SEQ ID NO: 2422490 - protein, 9 aa, Entamoeba dispar
ENTRVKDDL

SEQ ID NO: 2422491 - protein, 6 aa, Entamoeba dispar
ENTSAR

SEQ ID NO: 2422492 - protein, 9 aa, Entamoeba dispar
ENTSATRVA

SEQ ID NO: 2422493 - protein, 9 aa, Entamoeba dispar
ENTSEFDYT

SEQ ID NO: 2422494 - protein, 6 aa, Entamoeba dispar
ENTTIN

SEQ ID NO: 2422495 - protein, 6 aa, Entamoeba dispar
ENTTLS

SEQ ID NO: 2422496 - protein, 13 aa, Entamoeba dispar
ENTTNKTNTTELV

SEQ ID NO: 2422497 - protein, 9 aa, Entamoeba dispar
ENTVGSEIS

SEQ ID NO: 2422498 - protein, 8 aa, Entamoeba dispar
ENTYEPKT

SEQ ID NO: 2422499 - protein, 7 aa, Entamoeba dispar
ENVDRNA

SEQ ID NO: 2422500 - protein, 19 aa, Entamoeba dispar
ENVDSEKVKEANNKLTKDF

SEQ ID NO: 2422501 - protein, 8 aa, Entamoeba dispar
ENVEDLKD

SEQ ID NO: 2422502 - protein, 9 aa, Entamoeba dispar
ENVEEVTEN

SEQ ID NO: 2422503 - protein, 13 aa, Entamoeba dispar
ENVEQQVKTTGKE

SEQ ID NO: 2422504 - protein, 25 aa, Entamoeba dispar
ENVGPTKENEEKKENETNNQREDVV

SEQ ID NO: 2422505 - protein, 8 aa, Entamoeba dispar
ENVKGGDV

SEQ ID NO: 2422506 - protein, 9 aa, Entamoeba dispar
ENVNQENVQ

SEQ ID NO: 2422507 - protein, 5 aa, Entamoeba dispar
ENVPQ

SEQ ID NO: 2422508 - protein, 8 aa, Entamoeba dispar
ENVPTSIS

SEQ ID NO: 2422509 - protein, 4 aa, Entamoeba dispar
ENVS

SEQ ID NO: 2422510 - protein, 5 aa, Entamoeba dispar
ENVSE

SEQ ID NO: 2422511 - protein, 4 aa, Entamoeba dispar
ENVT

SEQ ID NO: 2422512 - protein, 4 aa, Entamoeba dispar
ENVY

SEQ ID NO: 2422513 - protein, 6 aa, Entamoeba dispar
ENWNRT

SEQ ID NO: 2422514 - protein, 8 aa, Entamoeba dispar
ENWPESPL

SEQ ID NO: 2422515 - protein, 5 aa, Entamoeba dispar
ENWPI

SEQ ID NO: 2422516 - protein, 4 aa, Entamoeba dispar
ENYD

SEQ ID NO: 2422517 - protein, 6 aa, Entamoeba dispar
ENYDEK

SEQ ID NO: 2422518 - protein, 7 aa, Entamoeba dispar
ENYEDTE

SEQ ID NO: 2422519 - protein, 6 aa, Entamoeba dispar
ENYEYT

SEQ ID NO: 2422520 - protein, 7 aa, Entamoeba dispar
ENYGEPM

SEQ ID NO: 2422521 - protein, 17 aa, Entamoeba dispar
ENYKELKNQVKTSDSNI

SEQ ID NO: 2422522 - protein, 7 aa, Entamoeba dispar
ENYPETP

SEQ ID NO: 2422523 - protein, 6 aa, Entamoeba dispar
ENYPKE

SEQ ID NO: 2422524 - protein, 5 aa, Entamoeba dispar
ENYPQ

SEQ ID NO: 2422525 - protein, 5 aa, Entamoeba dispar
ENYPS

SEQ ID NO: 2422526 - protein, 10 aa, Entamoeba dispar
ENYPSTTSFK

SEQ ID NO: 2422527 - protein, 8 aa, Entamoeba dispar
ENYRNDPE

SEQ ID NO: 2422528 - protein, 14 aa, Entamoeba dispar
EPADKEKMKRTQRI

SEQ ID NO: 2422529 - protein, 7 aa, Entamoeba dispar
EPAGSHG

SEQ ID NO: 2422530 - protein, 6 aa, Entamoeba dispar
EPAKEI

SEQ ID NO: 2422531 - protein, 5 aa, Entamoeba dispar
EPAKR

SEQ ID NO: 2422532 - protein, 6 aa, Entamoeba dispar
EPAPPF

SEQ ID NO: 2422533 - protein, 6 aa, Entamoeba dispar
EPASEP

SEQ ID NO: 2422534 - protein, 8 aa, Entamoeba dispar
EPASSELT

SEQ ID NO: 2422535 - protein, 8 aa, Entamoeba dispar
EPATKDDL

SEQ ID NO: 2422536 - protein, 14 aa, Entamoeba dispar
EPATTSSADMNPDY

SEQ ID NO: 2422537 - protein, 9 aa, Entamoeba dispar
EPCGGCGKP

SEQ ID NO: 2422538 - protein, 15 aa, Entamoeba dispar
EPDGNIKKEGKALNS

SEQ ID NO: 2422539 - protein, 10 aa, Entamoeba dispar
EPDKRTKDLA

SEQ ID NO: 2422540 - protein, 10 aa, Entamoeba dispar
EPDPKDTITL

SEQ ID NO: 2422541 - protein, 9 aa, Entamoeba dispar
EPDPSIQTV

SEQ ID NO: 2422542 - protein, 5 aa, Entamoeba dispar
EPDRP

SEQ ID NO: 2422543 - protein, 5 aa, Entamoeba dispar
EPDSE

SEQ ID NO: 2422544 - protein, 20 aa, Entamoeba dispar
EPDTGDVINSADEPDTSHDN

SEQ ID NO: 2422545 - protein, 9 aa, Entamoeba dispar
EPDYESRGK

SEQ ID NO: 2422546 - protein, 8 aa, Entamoeba dispar
EPEAGDPL

SEQ ID NO: 2422547 - protein, 9 aa, Entamoeba dispar
EPEDIKETE

SEQ ID NO: 2422548 - protein, 19 aa, Entamoeba dispar
EPEESAVLEGKPKGPHGIQ

SEQ ID NO: 2422549 - protein, 4 aa, Entamoeba dispar
EPEG

SEQ ID NO: 2422550 - protein, 14 aa, Entamoeba dispar
EPEGFDKEDSEKVT

SEQ ID NO: 2422551 - protein, 6 aa, Entamoeba dispar
EPENGF

SEQ ID NO: 2422552 - protein, 5 aa, Entamoeba dispar
EPEPF

SEQ ID NO: 2422553 - protein, 5 aa, Entamoeba dispar
EPERT

SEQ ID NO: 2422554 - protein, 10 aa, Entamoeba dispar
EPETRPTLNE

SEQ ID NO: 2422555 - protein, 5 aa, Entamoeba dispar
EPETT

SEQ ID NO: 2422556 - protein, 5 aa, Entamoeba dispar
EPEVE

SEQ ID NO: 2422557 - protein, 4 aa, Entamoeba dispar
EPFD

SEQ ID NO: 2422558 - protein, 5 aa, Entamoeba dispar
EPFDD

SEQ ID NO: 2422559 - protein, 16 aa, Entamoeba dispar
EPFNPVASNTPYSPFP

SEQ ID NO: 2422560 - protein, 11 aa, Entamoeba dispar
EPFNQKDESDA

SEQ ID NO: 2422561 - protein, 11 aa, Entamoeba dispar
EPFNQKEENEA

SEQ ID NO: 2422562 - protein, 9 aa, Entamoeba dispar
EPFNSGETL

SEQ ID NO: 2422563 - protein, 11 aa, Entamoeba dispar
EPFNSKDESDA

SEQ ID NO: 2422564 - protein, 9 aa, Entamoeba dispar
EPFTETDGI

SEQ ID NO: 2422565 - protein, 7 aa, Entamoeba dispar
EPGCGKT

SEQ ID NO: 2422566 - protein, 5 aa, Entamoeba dispar
EPGFK

SEQ ID NO: 2422567 - protein, 4 aa, Entamoeba dispar
EPGH

SEQ ID NO: 2422568 - protein, 6 aa, Entamoeba dispar
EPGIAK

SEQ ID NO: 2422569 - protein, 15 aa, Entamoeba dispar
EPGSVETHIGNSKAL

SEQ ID NO: 2422570 - protein, 8 aa, Entamoeba dispar
EPGTNGQH

SEQ ID NO: 2422571 - protein, 9 aa, Entamoeba dispar
EPHNNISSD

SEQ ID NO: 2422572 - protein, 15 aa, Entamoeba dispar
EPHPIKKEDLPTEKI

SEQ ID NO: 2422573 - protein, 5 aa, Entamoeba dispar
EPHTN

SEQ ID NO: 2422574 - protein, 7 aa, Entamoeba dispar
EPIDPTS

SEQ ID NO: 2422575 - protein, 7 aa, Entamoeba dispar
EPIGDVK

SEQ ID NO: 2422576 - protein, 8 aa, Entamoeba dispar
EPIGESEN

SEQ ID NO: 2422577 - protein, 23 aa, Entamoeba dispar
EPIGTRKETKNEVKEIGRTPNYE

SEQ ID NO: 2422578 - protein, 23 aa, Entamoeba dispar
EPIGTRKETKNEVKEIGRTRNYQ

SEQ ID NO: 2422579 - protein, 14 aa, Entamoeba dispar
EPIKRKPDEDIPTK

SEQ ID NO: 2422580 - protein, 9 aa, Entamoeba dispar
EPIPDSSEL

SEQ ID NO: 2422581 - protein, 5 aa, Entamoeba dispar
EPIQL

SEQ ID NO: 2422582 - protein, 9 aa, Entamoeba dispar
EPIRDPQTL

SEQ ID NO: 2422583 - protein, 5 aa, Entamoeba dispar
EPISM

SEQ ID NO: 2422584 - protein, 40 aa, Entamoeba dispar
EPISTTTNKKNEENSLKITSEKTSHITKPLPTPKKSTELT

SEQ ID NO: 2422585 - protein, 6 aa, Entamoeba dispar
EPITTP

SEQ ID NO: 2422586 - protein, 10 aa, Entamoeba dispar
EPKAEAKPDM

SEQ ID NO: 2422587 - protein, 8 aa, Entamoeba dispar
EPKDDIKK

SEQ ID NO: 2422588 - protein, 20 aa, Entamoeba dispar
EPKEMTKGEYESHEKHGSPR

SEQ ID NO: 2422589 - protein, 22 aa, Entamoeba dispar
EPKEPIQENKESQENDTERIQS

SEQ ID NO: 2422590 - protein, 9 aa, Entamoeba dispar
EPKESNANK

SEQ ID NO: 2422591 - protein, 7 aa, Entamoeba dispar
EPKESRE

SEQ ID NO: 2422592 - protein, 6 aa, Entamoeba dispar
EPKEVK

SEQ ID NO: 2422593 - protein, 20 aa, Entamoeba dispar
EPKFVEGEETETSNEPSKIV

SEQ ID NO: 2422594 - protein, 8 aa, Entamoeba dispar
EPKKKGEL

SEQ ID NO: 2422595 - protein, 5 aa, Entamoeba dispar
EPKKV

SEQ ID NO: 2422596 - protein, 10 aa, Entamoeba dispar
EPKKWNEGKE

SEQ ID NO: 2422597 - protein, 9 aa, Entamoeba dispar
EPKLVEGPS

SEQ ID NO: 2422598 - protein, 5 aa, Entamoeba dispar
EPKMG

SEQ ID NO: 2422599 - protein, 4 aa, Entamoeba dispar
EPKN

SEQ ID NO: 2422600 - protein, 20 aa, Entamoeba dispar
EPKNQTLSNEEQLKKIESEL

SEQ ID NO: 2422601 - protein, 16 aa, Entamoeba dispar
EPKNTAVRSPESNGIA

SEQ ID NO: 2422602 - protein, 18 aa, Entamoeba dispar
EPKNYGFDSNPMYSPNGK

SEQ ID NO: 2422603 - protein, 7 aa, Entamoeba dispar
EPKPSSF

SEQ ID NO: 2422604 - protein, 4 aa, Entamoeba dispar
EPKQ

SEQ ID NO: 2422605 - protein, 9 aa, Entamoeba dispar
EPKQNNIDE

SEQ ID NO: 2422606 - protein, 12 aa, Entamoeba dispar
EPKQVEEEKGTV

SEQ ID NO: 2422607 - protein, 8 aa, Entamoeba dispar
EPKRPRED

SEQ ID NO: 2422608 - protein, 10 aa, Entamoeba dispar
EPKRVKKTKV

SEQ ID NO: 2422609 - protein, 5 aa, Entamoeba dispar
EPKSW

SEQ ID NO: 2422610 - protein, 14 aa, Entamoeba dispar
EPKWEDEQNKNGGR

SEQ ID NO: 2422611 - protein, 7 aa, Entamoeba dispar
EPKYDEQ

SEQ ID NO: 2422612 - protein, 24 aa, Entamoeba dispar
EPLAGDYHDQKDIPSENEYSISLR

SEQ ID NO: 2422613 - protein, 7 aa, Entamoeba dispar
EPLEDAM

SEQ ID NO: 2422614 - protein, 5 aa, Entamoeba dispar
EPLEE

SEQ ID NO: 2422615 - protein, 8 aa, Entamoeba dispar
EPLHPTQN

SEQ ID NO: 2422616 - protein, 10 aa, Entamoeba dispar
EPLKKGDNEA

SEQ ID NO: 2422617 - protein, 15 aa, Entamoeba dispar
EPLKSLKGKPQERNE

SEQ ID NO: 2422618 - protein, 9 aa, Entamoeba dispar
EPLNKTPTT

SEQ ID NO: 2422619 - protein, 10 aa, Entamoeba dispar
EPLNTQKPET

SEQ ID NO: 2422620 - protein, 9 aa, Entamoeba dispar
EPLPDEHTS

SEQ ID NO: 2422621 - protein, 8 aa, Entamoeba dispar
EPLPEDVE

SEQ ID NO: 2422622 - protein, 19 aa, Entamoeba dispar
EPLPEESLPQDEEDEEERV

SEQ ID NO: 2422623 - protein, 6 aa, Entamoeba dispar
EPLPEN

SEQ ID NO: 2422624 - protein, 5 aa, Entamoeba dispar
EPLPK

SEQ ID NO: 2422625 - protein, 9 aa, Entamoeba dispar
EPLPSSKDS

SEQ ID NO: 2422626 - protein, 19 aa, Entamoeba dispar
EPLPSTNSPRSENEPPGLP

SEQ ID NO: 2422627 - protein, 10 aa, Entamoeba dispar
EPLTEEYSSA

SEQ ID NO: 2422628 - protein, 11 aa, Entamoeba dispar
EPLTNQEVTIP

SEQ ID NO: 2422629 - protein, 6 aa, Entamoeba dispar
EPLTTE

SEQ ID NO: 2422630 - protein, 12 aa, Entamoeba dispar
EPMNTKNDTMIS

SEQ ID NO: 2422631 - protein, 10 aa, Entamoeba dispar
EPMQEGLSEE

SEQ ID NO: 2422632 - protein, 5 aa, Entamoeba dispar
EPNDK

SEQ ID NO: 2422633 - protein, 7 aa, Entamoeba dispar
EPNDQSG

SEQ ID NO: 2422634 - protein, 10 aa, Entamoeba dispar
EPNEESDRRI

SEQ ID NO: 2422635 - protein, 7 aa, Entamoeba dispar
EPNEPDV

SEQ ID NO: 2422636 - protein, 8 aa, Entamoeba dispar
EPNIPDTI

SEQ ID NO: 2422637 - protein, 5 aa, Entamoeba dispar
EPNIR

SEQ ID NO: 2422638 - protein, 5 aa, Entamoeba dispar
EPNIT

SEQ ID NO: 2422639 - protein, 6 aa, Entamoeba dispar
EPNLES

SEQ ID NO: 2422640 - protein, 7 aa, Entamoeba dispar
EPNLSSA

SEQ ID NO: 2422641 - protein, 49 aa, Entamoeba dispar
EPNMTSAETIRKEALKKEEEEKRIQEEKEKAEEIRRAEEEQKQYEEEQY

SEQ ID NO: 2422642 - protein, 22 aa, Entamoeba dispar
EPNNEKKTEGADSFAPTWTKSG

SEQ ID NO: 2422643 - protein, 4 aa, Entamoeba dispar
EPNP

SEQ ID NO: 2422644 - protein, 13 aa, Entamoeba dispar
EPNPSSPANGEAA

SEQ ID NO: 2422645 - protein, 10 aa, Entamoeba dispar
EPNQKNTEKL

SEQ ID NO: 2422646 - protein, 4 aa, Entamoeba dispar
EPNR

SEQ ID NO: 2422647 - protein, 5 aa, Entamoeba dispar
EPNRN

SEQ ID NO: 2422648 - protein, 9 aa, Entamoeba dispar
EPNSEKHTI

SEQ ID NO: 2422649 - protein, 16 aa, Entamoeba dispar
EPNSSNQSSFSTYENT

SEQ ID NO: 2422650 - protein, 5 aa, Entamoeba dispar
EPNVP

SEQ ID NO: 2422651 - protein, 7 aa, Entamoeba dispar
EPPEPND

SEQ ID NO: 2422652 - protein, 4 aa, Entamoeba dispar
EPPF

SEQ ID NO: 2422653 - protein, 5 aa, Entamoeba dispar
EPPFR

SEQ ID NO: 2422654 - protein, 8 aa, Entamoeba dispar
EPPGQGPL

SEQ ID NO: 2422655 - protein, 12 aa, Entamoeba dispar
EPPGYKKPKVSS

SEQ ID NO: 2422656 - protein, 11 aa, Entamoeba dispar
EPPKKLTKQQM

SEQ ID NO: 2422657 - protein, 9 aa, Entamoeba dispar
EPPKLVEES

SEQ ID NO: 2422658 - protein, 12 aa, Entamoeba dispar
EPPKTKTTTNMN

SEQ ID NO: 2422659 - protein, 11 aa, Entamoeba dispar
EPPLTGETPED

SEQ ID NO: 2422660 - protein, 12 aa, Entamoeba dispar
EPPMNPLQNRKK

SEQ ID NO: 2422661 - protein, 27 aa, Entamoeba dispar
EPPNLKKSSGWTTRSGRMRKSEEVKEM

SEQ ID NO: 2422662 - protein, 9 aa, Entamoeba dispar
EPPNNGPLS

SEQ ID NO: 2422663 - protein, 6 aa, Entamoeba dispar
EPPPGY

SEQ ID NO: 2422664 - protein, 10 aa, Entamoeba dispar
EPPSPKGQKF

SEQ ID NO: 2422665 - protein, 9 aa, Entamoeba dispar
EPPTSGPLS

SEQ ID NO: 2422666 - protein, 8 aa, Entamoeba dispar
EPQKNSNY

SEQ ID NO: 2422667 - protein, 7 aa, Entamoeba dispar
EPQQESQ

SEQ ID NO: 2422668 - protein, 6 aa, Entamoeba dispar
EPQSIN

SEQ ID NO: 2422669 - protein, 9 aa, Entamoeba dispar
EPQSNLGTK

SEQ ID NO: 2422670 - protein, 5 aa, Entamoeba dispar
EPQTI

SEQ ID NO: 2422671 - protein, 5 aa, Entamoeba dispar
EPRDG

SEQ ID NO: 2422672 - protein, 13 aa, Entamoeba dispar
EPRNEYMDEKTKR

SEQ ID NO: 2422673 - protein, 25 aa, Entamoeba dispar
EPRQVTSNQGHLTKPTSQAKVRGLG

SEQ ID NO: 2422674 - protein, 5 aa, Entamoeba dispar
EPRSF

SEQ ID NO: 2422675 - protein, 34 aa, Entamoeba dispar
EPSDIDGSSSIAQLASKYDSEKLKQIKRHKNANK

SEQ ID NO: 2422676 - protein, 12 aa, Entamoeba dispar
EPSFDTKTLSSI

SEQ ID NO: 2422677 - protein, 4 aa, Entamoeba dispar
EPSI

SEQ ID NO: 2422678 - protein, 4 aa, Entamoeba dispar
EPSK

SEQ ID NO: 2422679 - protein, 13 aa, Entamoeba dispar
EPSKRLTDPDQIK

SEQ ID NO: 2422680 - protein, 6 aa, Entamoeba dispar
EPSKSY

SEQ ID NO: 2422681 - protein, 4 aa, Entamoeba dispar
EPSM

SEQ ID NO: 2422682 - protein, 4 aa, Entamoeba dispar
EPSP

SEQ ID NO: 2422683 - protein, 6 aa, Entamoeba dispar
EPSPNL

SEQ ID NO: 2422684 - protein, 6 aa, Entamoeba dispar
EPSQQL

SEQ ID NO: 2422685 - protein, 5 aa, Entamoeba dispar
EPSQR

SEQ ID NO: 2422686 - protein, 13 aa, Entamoeba dispar
EPSQVQSLQTQNQ

SEQ ID NO: 2422687 - protein, 8 aa, Entamoeba dispar
EPSSARKA

SEQ ID NO: 2422688 - protein, 9 aa, Entamoeba dispar
EPSTANGRK

SEQ ID NO: 2422689 - protein, 5 aa, Entamoeba dispar
EPSTF

SEQ ID NO: 2422690 - protein, 7 aa, Entamoeba dispar
EPSTKVN

SEQ ID NO: 2422691 - protein, 8 aa, Entamoeba dispar
EPSTQTPA

SEQ ID NO: 2422692 - protein, 5 aa, Entamoeba dispar
EPSTT

SEQ ID NO: 2422693 - protein, 7 aa, Entamoeba dispar
EPSVGKT

SEQ ID NO: 2422694 - protein, 10 aa, Entamoeba dispar
EPSVGKTSTI

SEQ ID NO: 2422695 - protein, 7 aa, Entamoeba dispar
EPSYEEF

SEQ ID NO: 2422696 - protein, 6 aa, Entamoeba dispar
EPTAAA

SEQ ID NO: 2422697 - protein, 5 aa, Entamoeba dispar
EPTDE

SEQ ID NO: 2422698 - protein, 5 aa, Entamoeba dispar
EPTDF

SEQ ID NO: 2422699 - protein, 11 aa, Entamoeba dispar
EPTDTSSSSNL

SEQ ID NO: 2422700 - protein, 6 aa, Entamoeba dispar
EPTEIS

SEQ ID NO: 2422701 - protein, 6 aa, Entamoeba dispar
EPTENA

SEQ ID NO: 2422702 - protein, 8 aa, Entamoeba dispar
EPTEQKNE

SEQ ID NO: 2422703 - protein, 7 aa, Entamoeba dispar
EPTEQNT

SEQ ID NO: 2422704 - protein, 11 aa, Entamoeba dispar
EPTGDLDSYNT

SEQ ID NO: 2422705 - protein, 11 aa, Entamoeba dispar
EPTGDLDTKNT

SEQ ID NO: 2422706 - protein, 5 aa, Entamoeba dispar
EPTIE

SEQ ID NO: 2422707 - protein, 4 aa, Entamoeba dispar
EPTK

SEQ ID NO: 2422708 - protein, 9 aa, Entamoeba dispar
EPTKEKSSI

SEQ ID NO: 2422709 - protein, 5 aa, Entamoeba dispar
EPTKR

SEQ ID NO: 2422710 - protein, 20 aa, Entamoeba dispar
EPTKTEQSEYKKQEELNTQS

SEQ ID NO: 2422711 - protein, 8 aa, Entamoeba dispar
EPTLPQVP

SEQ ID NO: 2422712 - protein, 6 aa, Entamoeba dispar
EPTNTS

SEQ ID NO: 2422713 - protein, 6 aa, Entamoeba dispar
EPTNTT

SEQ ID NO: 2422714 - protein, 4 aa, Entamoeba dispar
EPTQ

SEQ ID NO: 2422715 - protein, 4 aa, Entamoeba dispar
EPTR

SEQ ID NO: 2422716 - protein, 34 aa, Entamoeba dispar
EPTRPQLPTVSNEQRSSTHKKEKSRDKRSSQNVK

SEQ ID NO: 2422717 - protein, 4 aa, Entamoeba dispar
EPTT

SEQ ID NO: 2422718 - protein, 8 aa, Entamoeba dispar
EPTTEDGC

SEQ ID NO: 2422719 - protein, 4 aa, Entamoeba dispar
EPTV

SEQ ID NO: 2422720 - protein, 4 aa, Entamoeba dispar
EPVE

SEQ ID NO: 2422721 - protein, 24 aa, Entamoeba dispar
EPVQKNDLTQGTFSYSREDSENKF

SEQ ID NO: 2422722 - protein, 4 aa, Entamoeba dispar
EPVT

SEQ ID NO: 2422723 - protein, 31 aa, Entamoeba dispar
EPVTDPSSSTSSNTNSLNSSVNATQNNTIPI

SEQ ID NO: 2422724 - protein, 8 aa, Entamoeba dispar
EPYFEDEN

SEQ ID NO: 2422725 - protein, 5 aa, Entamoeba dispar
EPYKE

SEQ ID NO: 2422726 - protein, 11 aa, Entamoeba dispar
EPYKSRKQYTY

SEQ ID NO: 2422727 - protein, 5 aa, Entamoeba dispar
EPYNQ

SEQ ID NO: 2422728 - protein, 6 aa, Entamoeba dispar
EPYQPE

SEQ ID NO: 2422729 - protein, 8 aa, Entamoeba dispar
EPYTDNGE

SEQ ID NO: 2422730 - protein, 5 aa, Entamoeba dispar
EPYYG

SEQ ID NO: 2422731 - protein, 4 aa, Entamoeba dispar
EQAA

SEQ ID NO: 2422732 - protein, 4 aa, Entamoeba dispar
EQAD

SEQ ID NO: 2422733 - protein, 9 aa, Entamoeba dispar
EQAINSPIA

SEQ ID NO: 2422734 - protein, 13 aa, Entamoeba dispar
EQAKERKKREKKD

SEQ ID NO: 2422735 - protein, 10 aa, Entamoeba dispar
EQAKPNSDTL

SEQ ID NO: 2422736 - protein, 15 aa, Entamoeba dispar
EQAKRQLQKEETKKL

SEQ ID NO: 2422737 - protein, 5 aa, Entamoeba dispar
EQALS

SEQ ID NO: 2422738 - protein, 4 aa, Entamoeba dispar
EQAN

SEQ ID NO: 2422739 - protein, 8 aa, Entamoeba dispar
EQAPIGSD

SEQ ID NO: 2422740 - protein, 10 aa, Entamoeba dispar
EQAQKAKQNY

SEQ ID NO: 2422741 - protein, 10 aa, Entamoeba dispar
EQAQKAKQSY

SEQ ID NO: 2422742 - protein, 6 aa, Entamoeba dispar
EQAQTL

SEQ ID NO: 2422743 - protein, 9 aa, Entamoeba dispar
EQARGDGTS

SEQ ID NO: 2422744 - protein, 12 aa, Entamoeba dispar
EQARKDQEEKQR

SEQ ID NO: 2422745 - protein, 4 aa, Entamoeba dispar
EQCN

SEQ ID NO: 2422746 - protein, 10 aa, Entamoeba dispar
EQDGRPSSTD

SEQ ID NO: 2422747 - protein, 13 aa, Entamoeba dispar
EQDGTYTVQRPND

SEQ ID NO: 2422748 - protein, 5 aa, Entamoeba dispar
EQDHP

SEQ ID NO: 2422749 - protein, 5 aa, Entamoeba dispar
EQDIR

SEQ ID NO: 2422750 - protein, 4 aa, Entamoeba dispar
EQDK

SEQ ID NO: 2422751 - protein, 4 aa, Entamoeba dispar
EQDN

SEQ ID NO: 2422752 - protein, 9 aa, Entamoeba dispar
EQDQSNLDE

SEQ ID NO: 2422753 - protein, 7 aa, Entamoeba dispar
EQDSEDL

SEQ ID NO: 2422754 - protein, 5 aa, Entamoeba dispar
EQDSL

SEQ ID NO: 2422755 - protein, 6 aa, Entamoeba dispar
EQDTKT

SEQ ID NO: 2422756 - protein, 6 aa, Entamoeba dispar
EQDVSS

SEQ ID NO: 2422757 - protein, 8 aa, Entamoeba dispar
EQDWRPSI

SEQ ID NO: 2422758 - protein, 5 aa, Entamoeba dispar
EQEDD

SEQ ID NO: 2422759 - protein, 6 aa, Entamoeba dispar
EQEDIN

SEQ ID NO: 2422760 - protein, 4 aa, Entamoeba dispar
EQEE

SEQ ID NO: 2422761 - protein, 6 aa, Entamoeba dispar
EQEEEI

SEQ ID NO: 2422762 - protein, 9 aa, Entamoeba dispar
EQEEYSSER

SEQ ID NO: 2422763 - protein, 4 aa, Entamoeba dispar
EQEG

SEQ ID NO: 2422764 - protein, 6 aa, Entamoeba dispar
EQEGKK

SEQ ID NO: 2422765 - protein, 6 aa, Entamoeba dispar
EQEGTK

SEQ ID NO: 2422766 - protein, 5 aa, Entamoeba dispar
EQEIQ

SEQ ID NO: 2422767 - protein, 4 aa, Entamoeba dispar
EQEK

SEQ ID NO: 2422768 - protein, 15 aa, Entamoeba dispar
EQEKDKEQKEENREV

SEQ ID NO: 2422769 - protein, 15 aa, Entamoeba dispar
EQEKKKEDDSFSYNK

SEQ ID NO: 2422770 - protein, 7 aa, Entamoeba dispar
EQEKQQV

SEQ ID NO: 2422771 - protein, 8 aa, Entamoeba dispar
EQEMKDGC

SEQ ID NO: 2422772 - protein, 5 aa, Entamoeba dispar
EQEMT

SEQ ID NO: 2422773 - protein, 8 aa, Entamoeba dispar
EQENEKDL

SEQ ID NO: 2422774 - protein, 9 aa, Entamoeba dispar
EQENRPKSG

SEQ ID NO: 2422775 - protein, 7 aa, Entamoeba dispar
EQEPFSK

SEQ ID NO: 2422776 - protein, 13 aa, Entamoeba dispar
EQEPIPSKYDLIE

SEQ ID NO: 2422777 - protein, 5 aa, Entamoeba dispar
EQEPK

SEQ ID NO: 2422778 - protein, 5 aa, Entamoeba dispar
EQEPM

SEQ ID NO: 2422779 - protein, 5 aa, Entamoeba dispar
EQEQI

SEQ ID NO: 2422780 - protein, 5 aa, Entamoeba dispar
EQEQL

SEQ ID NO: 2422781 - protein, 9 aa, Entamoeba dispar
EQEQNNKYS

SEQ ID NO: 2422782 - protein, 28 aa, Entamoeba dispar
EQERKSMAEKSQNDEETIDNLTKENQRL

SEQ ID NO: 2422783 - protein, 10 aa, Entamoeba dispar
EQERKTSHHH

SEQ ID NO: 2422784 - protein, 12 aa, Entamoeba dispar
EQESKPVETQKV

SEQ ID NO: 2422785 - protein, 9 aa, Entamoeba dispar
EQESLPPPL

SEQ ID NO: 2422786 - protein, 9 aa, Entamoeba dispar
EQETNGSDI

SEQ ID NO: 2422787 - protein, 4 aa, Entamoeba dispar
EQEV

SEQ ID NO: 2422788 - protein, 17 aa, Entamoeba dispar
EQEVVKDKTKKKKSSEI

SEQ ID NO: 2422789 - protein, 6 aa, Entamoeba dispar
EQEYDA

SEQ ID NO: 2422790 - protein, 5 aa, Entamoeba dispar
EQFER

SEQ ID NO: 2422791 - protein, 6 aa, Entamoeba dispar
EQFETG

SEQ ID NO: 2422792 - protein, 17 aa, Entamoeba dispar
EQFGENKQGNNEIVSYF

SEQ ID NO: 2422793 - protein, 5 aa, Entamoeba dispar
EQFGG

SEQ ID NO: 2422794 - protein, 13 aa, Entamoeba dispar
EQFKNFSKGEEEM

SEQ ID NO: 2422795 - protein, 13 aa, Entamoeba dispar
EQFRGHNQQDAQE

SEQ ID NO: 2422796 - protein, 19 aa, Entamoeba dispar
EQFYEEDGKPICAVCVDYD

SEQ ID NO: 2422797 - protein, 9 aa, Entamoeba dispar
EQGDDNGGL

SEQ ID NO: 2422798 - protein, 6 aa, Entamoeba dispar
EQGEYV

SEQ ID NO: 2422799 - protein, 4 aa, Entamoeba dispar
EQGF

SEQ ID NO: 2422800 - protein, 5 aa, Entamoeba dispar
EQGID

SEQ ID NO: 2422801 - protein, 6 aa, Entamoeba dispar
EQGKIN

SEQ ID NO: 2422802 - protein, 6 aa, Entamoeba dispar
EQGKNV

SEQ ID NO: 2422803 - protein, 10 aa, Entamoeba dispar
EQGKSRWSPV

SEQ ID NO: 2422804 - protein, 9 aa, Entamoeba dispar
EQGMPTDRP

SEQ ID NO: 2422805 - protein, 5 aa, Entamoeba dispar
EQGNE

SEQ ID NO: 2422806 - protein, 7 aa, Entamoeba dispar
EQGQAVD

SEQ ID NO: 2422807 - protein, 11 aa, Entamoeba dispar
EQGQSGAIPKD

SEQ ID NO: 2422808 - protein, 7 aa, Entamoeba dispar
EQGSTGA

SEQ ID NO: 2422809 - protein, 5 aa, Entamoeba dispar
EQGTV

SEQ ID NO: 2422810 - protein, 7 aa, Entamoeba dispar
EQGVPLQ

SEQ ID NO: 2422811 - protein, 7 aa, Entamoeba dispar
EQHDSHE

SEQ ID NO: 2422812 - protein, 9 aa, Entamoeba dispar
EQHQDDIKS

SEQ ID NO: 2422813 - protein, 5 aa, Entamoeba dispar
EQHQE

SEQ ID NO: 2422814 - protein, 12 aa, Entamoeba dispar
EQHQPGPLQNSL

SEQ ID NO: 2422815 - protein, 20 aa, Entamoeba dispar
EQIAKKKAEEEKKKIGNEKN

SEQ ID NO: 2422816 - protein, 4 aa, Entamoeba dispar
EQID

SEQ ID NO: 2422817 - protein, 12 aa, Entamoeba dispar
EQIENNNNNKKV

SEQ ID NO: 2422818 - protein, 8 aa, Entamoeba dispar
EQIGTPPK

SEQ ID NO: 2422819 - protein, 17 aa, Entamoeba dispar
EQIKNAKETIGDKGQDE

SEQ ID NO: 2422820 - protein, 6 aa, Entamoeba dispar
EQIKTQ

SEQ ID NO: 2422821 - protein, 13 aa, Entamoeba dispar
EQILESEETKESI

SEQ ID NO: 2422822 - protein, 4 aa, Entamoeba dispar
EQIN

SEQ ID NO: 2422823 - protein, 16 aa, Entamoeba dispar
EQINEKQDKGASLDTQ

SEQ ID NO: 2422824 - protein, 11 aa, Entamoeba dispar
EQINNKTNESI

SEQ ID NO: 2422825 - protein, 9 aa, Entamoeba dispar
EQINQKEMT

SEQ ID NO: 2422826 - protein, 10 aa, Entamoeba dispar
EQIPAKAGNL

SEQ ID NO: 2422827 - protein, 11 aa, Entamoeba dispar
EQIPRTQNQRM

SEQ ID NO: 2422828 - protein, 12 aa, Entamoeba dispar
EQITVSDEKENI

SEQ ID NO: 2422829 - protein, 7 aa, Entamoeba dispar
EQIVDNT

SEQ ID NO: 2422830 - protein, 12 aa, Entamoeba dispar
EQKAAAGGSGQG

SEQ ID NO: 2422831 - protein, 30 aa, Entamoeba dispar
EQKAAYKPKPRQVPQKKQVKKEEEIVEEKK

SEQ ID NO: 2422832 - protein, 5 aa, Entamoeba dispar
EQKDT

SEQ ID NO: 2422833 - protein, 18 aa, Entamoeba dispar
EQKEELVQKEDEIKQKEI

SEQ ID NO: 2422834 - protein, 5 aa, Entamoeba dispar
EQKEI

SEQ ID NO: 2422835 - protein, 17 aa, Entamoeba dispar
EQKEKEKETIKGLSNEE

SEQ ID NO: 2422836 - protein, 9 aa, Entamoeba dispar
EQKEMEEEI

SEQ ID NO: 2422837 - protein, 11 aa, Entamoeba dispar
EQKENDEKEYY

SEQ ID NO: 2422838 - protein, 8 aa, Entamoeba dispar
EQKEPTLE

SEQ ID NO: 2422839 - protein, 12 aa, Entamoeba dispar
EQKEQAKGNTQR

SEQ ID NO: 2422840 - protein, 43 aa, Entamoeba dispar
EQKEQDIKNKQEQKKRIEEERAAEKKRKEEEEKLRKEQEEMEK

SEQ ID NO: 2422841 - protein, 5 aa, Entamoeba dispar
EQKGI

SEQ ID NO: 2422842 - protein, 6 aa, Entamoeba dispar
EQKGVD

SEQ ID NO: 2422843 - protein, 16 aa, Entamoeba dispar
EQKKEKREGGPQNKYD

SEQ ID NO: 2422844 - protein, 18 aa, Entamoeba dispar
EQKNEDKKRKQQQDEQLK

SEQ ID NO: 2422845 - protein, 7 aa, Entamoeba dispar
EQKNEQL

SEQ ID NO: 2422846 - protein, 11 aa, Entamoeba dispar
EQKNTKLEELK

SEQ ID NO: 2422847 - protein, 6 aa, Entamoeba dispar
EQKNVH

SEQ ID NO: 2422848 - protein, 13 aa, Entamoeba dispar
EQKPPIVGESPED

SEQ ID NO: 2422849 - protein, 8 aa, Entamoeba dispar
EQKQEHKL

SEQ ID NO: 2422850 - protein, 7 aa, Entamoeba dispar
EQKQHQP

SEQ ID NO: 2422851 - protein, 15 aa, Entamoeba dispar
EQKQIEAKKQQLIER

SEQ ID NO: 2422852 - protein, 7 aa, Entamoeba dispar
EQKQKEN

SEQ ID NO: 2422853 - protein, 9 aa, Entamoeba dispar
EQKQPVIST

SEQ ID NO: 2422854 - protein, 6 aa, Entamoeba dispar
EQKREF

SEQ ID NO: 2422855 - protein, 11 aa, Entamoeba dispar
EQKRSPKKGDT

SEQ ID NO: 2422856 - protein, 12 aa, Entamoeba dispar
EQKSRSSRDFSS

SEQ ID NO: 2422857 - protein, 26 aa, Entamoeba dispar
EQKSTEHDTPVITQEEKKEVVSENKP

SEQ ID NO: 2422858 - protein, 5 aa, Entamoeba dispar
EQKSV

SEQ ID NO: 2422859 - protein, 5 aa, Entamoeba dispar
EQKSY

SEQ ID NO: 2422860 - protein, 7 aa, Entamoeba dispar
EQKYSGA

SEQ ID NO: 2422861 - protein, 12 aa, Entamoeba dispar
EQLADTSKEKLQ

SEQ ID NO: 2422862 - protein, 9 aa, Entamoeba dispar
EQLAPVKSA

SEQ ID NO: 2422863 - protein, 9 aa, Entamoeba dispar
EQLDKGTKG

SEQ ID NO: 2422864 - protein, 25 aa, Entamoeba dispar
EQLDNQQQDQKHEEQKHEVKETPHL

SEQ ID NO: 2422865 - protein, 7 aa, Entamoeba dispar
EQLEEIN

SEQ ID NO: 2422866 - protein, 22 aa, Entamoeba dispar
EQLEKTKAEKDENKSVADQEVV

SEQ ID NO: 2422867 - protein, 13 aa, Entamoeba dispar
EQLEKVSKNIEEK

SEQ ID NO: 2422868 - protein, 24 aa, Entamoeba dispar
EQLEQERTTAANAEAERKKIQAEL

SEQ ID NO: 2422869 - protein, 12 aa, Entamoeba dispar
EQLEYDEEKEVL

SEQ ID NO: 2422870 - protein, 7 aa, Entamoeba dispar
EQLKRGN

SEQ ID NO: 2422871 - protein, 8 aa, Entamoeba dispar
EQLNEEEK

SEQ ID NO: 2422872 - protein, 7 aa, Entamoeba dispar
EQLPENE

SEQ ID NO: 2422873 - protein, 7 aa, Entamoeba dispar
EQLQDGT

SEQ ID NO: 2422874 - protein, 19 aa, Entamoeba dispar
EQLQEEEEESEEESNPDTF

SEQ ID NO: 2422875 - protein, 24 aa, Entamoeba dispar
EQLQKEQKKTAKTGVKKPVVKKDK

SEQ ID NO: 2422876 - protein, 17 aa, Entamoeba dispar
EQLSDTPVFDNEGDKYS

SEQ ID NO: 2422877 - protein, 9 aa, Entamoeba dispar
EQLTKERDT

SEQ ID NO: 2422878 - protein, 13 aa, Entamoeba dispar
EQMEQQKIEHQKE

SEQ ID NO: 2422879 - protein, 4 aa, Entamoeba dispar
EQMN

SEQ ID NO: 2422880 - protein, 5 aa, Entamoeba dispar
EQMNE

SEQ ID NO: 2422881 - protein, 17 aa, Entamoeba dispar
EQMREKKKQIKKEWSSN

SEQ ID NO: 2422882 - protein, 7 aa, Entamoeba dispar
EQMRTPA

SEQ ID NO: 2422883 - protein, 5 aa, Entamoeba dispar
EQMSK

SEQ ID NO: 2422884 - protein, 27 aa, Entamoeba dispar
EQNAPVDNNKGKKGNKAKKEKKRGCLL

SEQ ID NO: 2422885 - protein, 5 aa, Entamoeba dispar
EQNCK

SEQ ID NO: 2422886 - protein, 4 aa, Entamoeba dispar
EQND

SEQ ID NO: 2422887 - protein, 15 aa, Entamoeba dispar
EQNELEEREKEEKEL

SEQ ID NO: 2422888 - protein, 6 aa, Entamoeba dispar
EQNENG

SEQ ID NO: 2422889 - protein, 11 aa, Entamoeba dispar
EQNGLNGQEKE

SEQ ID NO: 2422890 - protein, 6 aa, Entamoeba dispar
EQNGYT

SEQ ID NO: 2422891 - protein, 8 aa, Entamoeba dispar
EQNHSTEQ

SEQ ID NO: 2422892 - protein, 59 aa, Entamoeba dispar
EQNIQKENDLKDENNKIQQELEQKNNEISKLEEEKGNITNELSNTKQELEEKKEEITTI

SEQ ID NO: 2422893 - protein, 5 aa, Entamoeba dispar
EQNIR

SEQ ID NO: 2422894 - protein, 4 aa, Entamoeba dispar
EQNK

SEQ ID NO: 2422895 - protein, 25 aa, Entamoeba dispar
EQNKEHTQQSINTITDSKPVTQSPV

SEQ ID NO: 2422896 - protein, 9 aa, Entamoeba dispar
EQNKEKQIK

SEQ ID NO: 2422897 - protein, 6 aa, Entamoeba dispar
EQNKRV

SEQ ID NO: 2422898 - protein, 8 aa, Entamoeba dispar
EQNKTNAR

SEQ ID NO: 2422899 - protein, 4 aa, Entamoeba dispar
EQNL

SEQ ID NO: 2422900 - protein, 10 aa, Entamoeba dispar
EQNNDWKSKL

SEQ ID NO: 2422901 - protein, 5 aa, Entamoeba dispar
EQNNQ

SEQ ID NO: 2422902 - protein, 8 aa, Entamoeba dispar
EQNNTSLK

SEQ ID NO: 2422903 - protein, 6 aa, Entamoeba dispar
EQNRPG

SEQ ID NO: 2422904 - protein, 7 aa, Entamoeba dispar
EQNSSSL

SEQ ID NO: 2422905 - protein, 8 aa, Entamoeba dispar
EQNSTNEL

SEQ ID NO: 2422906 - protein, 7 aa, Entamoeba dispar
EQPERDG

SEQ ID NO: 2422907 - protein, 4 aa, Entamoeba dispar
EQPI

SEQ ID NO: 2422908 - protein, 8 aa, Entamoeba dispar
EQPIQENN

SEQ ID NO: 2422909 - protein, 7 aa, Entamoeba dispar
EQPISKQ

SEQ ID NO: 2422910 - protein, 6 aa, Entamoeba dispar
EQPISS

SEQ ID NO: 2422911 - protein, 6 aa, Entamoeba dispar
EQPLQE

SEQ ID NO: 2422912 - protein, 6 aa, Entamoeba dispar
EQPNFS

SEQ ID NO: 2422913 - protein, 4 aa, Entamoeba dispar
EQPP

SEQ ID NO: 2422914 - protein, 16 aa, Entamoeba dispar
EQPPEPPIEPTPNVNE

SEQ ID NO: 2422915 - protein, 8 aa, Entamoeba dispar
EQPPQVNV

SEQ ID NO: 2422916 - protein, 16 aa, Entamoeba dispar
EQPQTARTAENRNGIE

SEQ ID NO: 2422917 - protein, 5 aa, Entamoeba dispar
EQPRE

SEQ ID NO: 2422918 - protein, 6 aa, Entamoeba dispar
EQPSPL

SEQ ID NO: 2422919 - protein, 12 aa, Entamoeba dispar
EQPSVRETKDGQ

SEQ ID NO: 2422920 - protein, 14 aa, Entamoeba dispar
EQPTKENEEPLDQR

SEQ ID NO: 2422921 - protein, 8 aa, Entamoeba dispar
EQPTNEPL

SEQ ID NO: 2422922 - protein, 6 aa, Entamoeba dispar
EQPTNK

SEQ ID NO: 2422923 - protein, 8 aa, Entamoeba dispar
EQPTPFSE

SEQ ID NO: 2422924 - protein, 7 aa, Entamoeba dispar
EQPTPLL

SEQ ID NO: 2422925 - protein, 18 aa, Entamoeba dispar
EQQASKIEGDGEMNSKEQ

SEQ ID NO: 2422926 - protein, 13 aa, Entamoeba dispar
EQQDELHRSDLEK

SEQ ID NO: 2422927 - protein, 53 aa, Entamoeba dispar
EQQDLEAQKTSVTRSVAKPTPSFKKSPTQSNIVEEKQKEDMKQETNQQTEEVD

SEQ ID NO: 2422928 - protein, 7 aa, Entamoeba dispar
EQQDSIE

SEQ ID NO: 2422929 - protein, 6 aa, Entamoeba dispar
EQQEYK

SEQ ID NO: 2422930 - protein, 8 aa, Entamoeba dispar
EQQFKEEK

SEQ ID NO: 2422931 - protein, 14 aa, Entamoeba dispar
EQQGSVQKKVGCSI

SEQ ID NO: 2422932 - protein, 5 aa, Entamoeba dispar
EQQGV

SEQ ID NO: 2422933 - protein, 5 aa, Entamoeba dispar
EQQIQ

SEQ ID NO: 2422934 - protein, 25 aa, Entamoeba dispar
EQQKEYERQKKDLEDRKKENEERLK

SEQ ID NO: 2422935 - protein, 15 aa, Entamoeba dispar
EQQKKLEKSLEERRN

SEQ ID NO: 2422936 - protein, 10 aa, Entamoeba dispar
EQQKNSQTNT

SEQ ID NO: 2422937 - protein, 24 aa, Entamoeba dispar
EQQKQEKKELKNFKRREKRHTIQT

SEQ ID NO: 2422938 - protein, 7 aa, Entamoeba dispar
EQQKTTT

SEQ ID NO: 2422939 - protein, 4 aa, Entamoeba dispar
EQQL

SEQ ID NO: 2422940 - protein, 19 aa, Entamoeba dispar
EQQLEQNKNINDNQQKQLQ

SEQ ID NO: 2422941 - protein, 4 aa, Entamoeba dispar
EQQN

SEQ ID NO: 2422942 - protein, 5 aa, Entamoeba dispar
EQQNR

SEQ ID NO: 2422943 - protein, 12 aa, Entamoeba dispar
EQQNVNNHENDL

SEQ ID NO: 2422944 - protein, 4 aa, Entamoeba dispar
EQQP

SEQ ID NO: 2422945 - protein, 5 aa, Entamoeba dispar
EQQPA

SEQ ID NO: 2422946 - protein, 7 aa, Entamoeba dispar
EQQPESC

SEQ ID NO: 2422947 - protein, 8 aa, Entamoeba dispar
EQQPTTGS

SEQ ID NO: 2422948 - protein, 4 aa, Entamoeba dispar
EQQQ

SEQ ID NO: 2422949 - protein, 8 aa, Entamoeba dispar
EQQQPSNN

SEQ ID NO: 2422950 - protein, 5 aa, Entamoeba dispar
EQQQR

SEQ ID NO: 2422951 - protein, 11 aa, Entamoeba dispar
EQQRKEKAAMR

SEQ ID NO: 2422952 - protein, 5 aa, Entamoeba dispar
EQQRN

SEQ ID NO: 2422953 - protein, 5 aa, Entamoeba dispar
EQQSF

SEQ ID NO: 2422954 - protein, 8 aa, Entamoeba dispar
EQQSQDIA

SEQ ID NO: 2422955 - protein, 9 aa, Entamoeba dispar
EQQTTPITI

SEQ ID NO: 2422956 - protein, 7 aa, Entamoeba dispar
EQQYNDY

SEQ ID NO: 2422957 - protein, 12 aa, Entamoeba dispar
EQREAQRKEYAK

SEQ ID NO: 2422958 - protein, 100 aa, Entamoeba dispar
EQREREEAERRQREEQKRIAREEQEIKQREEAERLAKEEQERLAKEEQERLAKEEQERLAKEEAERLAKEEAERLAKEEQERKQREEQERLKQQQPTGQQ

SEQ ID NO: 2422959 - protein, 8 aa, Entamoeba dispar
EQREVSNE

SEQ ID NO: 2422960 - protein, 9 aa, Entamoeba dispar
EQRHKEKQY

SEQ ID NO: 2422961 - protein, 8 aa, Entamoeba dispar
EQRIQSSI

SEQ ID NO: 2422962 - protein, 6 aa, Entamoeba dispar
EQRKCS

SEQ ID NO: 2422963 - protein, 17 aa, Entamoeba dispar
EQRKTKTVTKNLNPTWG

SEQ ID NO: 2422964 - protein, 5 aa, Entamoeba dispar
EQRLQ

SEQ ID NO: 2422965 - protein, 5 aa, Entamoeba dispar
EQRMD

SEQ ID NO: 2422966 - protein, 5 aa, Entamoeba dispar
EQRNK

SEQ ID NO: 2422967 - protein, 5 aa, Entamoeba dispar
EQRNS

SEQ ID NO: 2422968 - protein, 6 aa, Entamoeba dispar
EQRNVV

SEQ ID NO: 2422969 - protein, 29 aa, Entamoeba dispar
EQRPSVQKIESEQKITQTNEGENKPKNEV

SEQ ID NO: 2422970 - protein, 7 aa, Entamoeba dispar
EQRQKGI

SEQ ID NO: 2422971 - protein, 27 aa, Entamoeba dispar
EQRRKEESVSTSQQQKAAKEKIQQERN

SEQ ID NO: 2422972 - protein, 16 aa, Entamoeba dispar
EQRRLDDRRDRRDDYH

SEQ ID NO: 2422973 - protein, 16 aa, Entamoeba dispar
EQRRLEEEAAAAAAAQ

SEQ ID NO: 2422974 - protein, 13 aa, Entamoeba dispar
EQRTDTEKEENDF

SEQ ID NO: 2422975 - protein, 8 aa, Entamoeba dispar
EQRTPNQL

SEQ ID NO: 2422976 - protein, 4 aa, Entamoeba dispar
EQRY

SEQ ID NO: 2422977 - protein, 8 aa, Entamoeba dispar
EQSDEDEI

SEQ ID NO: 2422978 - protein, 9 aa, Entamoeba dispar
EQSEAQRIE

SEQ ID NO: 2422979 - protein, 4 aa, Entamoeba dispar
EQSF

SEQ ID NO: 2422980 - protein, 5 aa, Entamoeba dispar
EQSFE

SEQ ID NO: 2422981 - protein, 5 aa, Entamoeba dispar
EQSFP

SEQ ID NO: 2422982 - protein, 8 aa, Entamoeba dispar
EQSIPSPL

SEQ ID NO: 2422983 - protein, 10 aa, Entamoeba dispar
EQSKPDTREI

SEQ ID NO: 2422984 - protein, 9 aa, Entamoeba dispar
EQSKYTLSS

SEQ ID NO: 2422985 - protein, 36 aa, Entamoeba dispar
EQSNEEEISQETKEEENQSDKDEVSKIKKGNQYGEM

SEQ ID NO: 2422986 - protein, 36 aa, Entamoeba dispar
EQSNEEEISQETKEEESQSDKDEVSKIKKGNQYGEM

SEQ ID NO: 2422987 - protein, 9 aa, Entamoeba dispar
EQSNEGTTL

SEQ ID NO: 2422988 - protein, 20 aa, Entamoeba dispar
EQSNEGTTSIKEVENNDKSI

SEQ ID NO: 2422989 - protein, 8 aa, Entamoeba dispar
EQSNEYQY

SEQ ID NO: 2422990 - protein, 5 aa, Entamoeba dispar
EQSNQ

SEQ ID NO: 2422991 - protein, 5 aa, Entamoeba dispar
EQSPI

SEQ ID NO: 2422992 - protein, 4 aa, Entamoeba dispar
EQSQ

SEQ ID NO: 2422993 - protein, 10 aa, Entamoeba dispar
EQSQSPQKNL

SEQ ID NO: 2422994 - protein, 10 aa, Entamoeba dispar
EQSSSSDRFD

SEQ ID NO: 2422995 - protein, 9 aa, Entamoeba dispar
EQSTSPRPG

SEQ ID NO: 2422996 - protein, 24 aa, Entamoeba dispar
EQSYDVERAEKKAERRWRKETADV

SEQ ID NO: 2422997 - protein, 5 aa, Entamoeba dispar
EQSYL

SEQ ID NO: 2422998 - protein, 12 aa, Entamoeba dispar
EQTAETKNDNME

SEQ ID NO: 2422999 - protein, 10 aa, Entamoeba dispar
EQTATKYTNK

SEQ ID NO: 2423000 - protein, 9 aa, Entamoeba dispar
EQTEKEKKE

SEQ ID NO: 2423001 - protein, 10 aa, Entamoeba dispar
EQTEKKIPNE

SEQ ID NO: 2423002 - protein, 5 aa, Entamoeba dispar
EQTEL

SEQ ID NO: 2423003 - protein, 8 aa, Entamoeba dispar
EQTENGIS

SEQ ID NO: 2423004 - protein, 7 aa, Entamoeba dispar
EQTEQAV

SEQ ID NO: 2423005 - protein, 9 aa, Entamoeba dispar
EQTESNTQE

SEQ ID NO: 2423006 - protein, 5 aa, Entamoeba dispar
EQTET

SEQ ID NO: 2423007 - protein, 8 aa, Entamoeba dispar
EQTETHEC

SEQ ID NO: 2423008 - protein, 5 aa, Entamoeba dispar
EQTGG

SEQ ID NO: 2423009 - protein, 5 aa, Entamoeba dispar
EQTGV

SEQ ID NO: 2423010 - protein, 4 aa, Entamoeba dispar
EQTH

SEQ ID NO: 2423011 - protein, 8 aa, Entamoeba dispar
EQTHTNQL

SEQ ID NO: 2423012 - protein, 5 aa, Entamoeba dispar
EQTIN

SEQ ID NO: 2423013 - protein, 11 aa, Entamoeba dispar
EQTINEKRTKF

SEQ ID NO: 2423014 - protein, 8 aa, Entamoeba dispar
EQTKPKRR

SEQ ID NO: 2423015 - protein, 13 aa, Entamoeba dispar
EQTLEDAKNKWNQ

SEQ ID NO: 2423016 - protein, 13 aa, Entamoeba dispar
EQTLSDENTEDEM

SEQ ID NO: 2423017 - protein, 6 aa, Entamoeba dispar
EQTMKS

SEQ ID NO: 2423018 - protein, 9 aa, Entamoeba dispar
EQTNNTQKI

SEQ ID NO: 2423019 - protein, 34 aa, Entamoeba dispar
EQTPCCQERTEEVKEKRKQQPNPLSKKSMKKRKK

SEQ ID NO: 2423020 - protein, 15 aa, Entamoeba dispar
EQTPFPEKKSGCCVI

SEQ ID NO: 2423021 - protein, 8 aa, Entamoeba dispar
EQTPSSNC

SEQ ID NO: 2423022 - protein, 6 aa, Entamoeba dispar
EQTQPE

SEQ ID NO: 2423023 - protein, 17 aa, Entamoeba dispar
EQTQPLKSTSLADVSSH

SEQ ID NO: 2423024 - protein, 12 aa, Entamoeba dispar
EQTQTVQPTETG

SEQ ID NO: 2423025 - protein, 40 aa, Entamoeba dispar
EQTRLRASETKPVIKPISDSKVDIDKTPEEQQTPKKNGCA

SEQ ID NO: 2423026 - protein, 7 aa, Entamoeba dispar
EQTTSIN

SEQ ID NO: 2423027 - protein, 13 aa, Entamoeba dispar
EQTVDDIENDVSK

SEQ ID NO: 2423028 - protein, 10 aa, Entamoeba dispar
EQTYDEEIQR

SEQ ID NO: 2423029 - protein, 7 aa, Entamoeba dispar
EQVAVSS

SEQ ID NO: 2423030 - protein, 32 aa, Entamoeba dispar
EQVDKAPKRIDASQEYSGGLNNSNQPNVNRNV

SEQ ID NO: 2423031 - protein, 23 aa, Entamoeba dispar
EQVEEDFGEESEDKPKRKQLNER

SEQ ID NO: 2423032 - protein, 9 aa, Entamoeba dispar
EQVEKDSGL

SEQ ID NO: 2423033 - protein, 6 aa, Entamoeba dispar
EQVEPN

SEQ ID NO: 2423034 - protein, 9 aa, Entamoeba dispar
EQVESNEKM

SEQ ID NO: 2423035 - protein, 13 aa, Entamoeba dispar
EQVKKSKEAANRW

SEQ ID NO: 2423036 - protein, 17 aa, Entamoeba dispar
EQVSSGVRSYEKYSKNK

SEQ ID NO: 2423037 - protein, 10 aa, Entamoeba dispar
EQWKNAQKTE

SEQ ID NO: 2423038 - protein, 6 aa, Entamoeba dispar
EQWKSD

SEQ ID NO: 2423039 - protein, 14 aa, Entamoeba dispar
EQWNSKKLTKESDI

SEQ ID NO: 2423040 - protein, 9 aa, Entamoeba dispar
EQWTKASDV

SEQ ID NO: 2423041 - protein, 6 aa, Entamoeba dispar
EQWTNT

SEQ ID NO: 2423042 - protein, 13 aa, Entamoeba dispar
EQYDEIAKKQAEL

SEQ ID NO: 2423043 - protein, 10 aa, Entamoeba dispar
EQYEKEKKEI

SEQ ID NO: 2423044 - protein, 8 aa, Entamoeba dispar
EQYEVGSS

SEQ ID NO: 2423045 - protein, 5 aa, Entamoeba dispar
EQYIE

SEQ ID NO: 2423046 - protein, 5 aa, Entamoeba dispar
EQYKT

SEQ ID NO: 2423047 - protein, 4 aa, Entamoeba dispar
EQYL

SEQ ID NO: 2423048 - protein, 6 aa, Entamoeba dispar
EQYLPN

SEQ ID NO: 2423049 - protein, 8 aa, Entamoeba dispar
EQYPAEVP

SEQ ID NO: 2423050 - protein, 5 aa, Entamoeba dispar
EQYSE

SEQ ID NO: 2423051 - protein, 5 aa, Entamoeba dispar
EQYTR

SEQ ID NO: 2423052 - protein, 7 aa, Entamoeba dispar
ERADTAA

SEQ ID NO: 2423053 - protein, 17 aa, Entamoeba dispar
ERAERKEQKKLKQESKI

SEQ ID NO: 2423054 - protein, 25 aa, Entamoeba dispar
ERAGITRDEHDQQTQKDYEESVKRV

SEQ ID NO: 2423055 - protein, 12 aa, Entamoeba dispar
ERAGRVNGRVGS

SEQ ID NO: 2423056 - protein, 6 aa, Entamoeba dispar
ERAGTS

SEQ ID NO: 2423057 - protein, 6 aa, Entamoeba dispar
ERAKEG

SEQ ID NO: 2423058 - protein, 5 aa, Entamoeba dispar
ERAKL

SEQ ID NO: 2423059 - protein, 15 aa, Entamoeba dispar
ERAKRTLSSAATANI

SEQ ID NO: 2423060 - protein, 25 aa, Entamoeba dispar
ERAQQRYDEMKRKQEPEKKRIEEQI

SEQ ID NO: 2423061 - protein, 8 aa, Entamoeba dispar
ERASSDFD

SEQ ID NO: 2423062 - protein, 14 aa, Entamoeba dispar
ERASTIDSFQGNES

SEQ ID NO: 2423063 - protein, 8 aa, Entamoeba dispar
ERCGKEVD

SEQ ID NO: 2423064 - protein, 10 aa, Entamoeba dispar
ERCKEENRDS

SEQ ID NO: 2423065 - protein, 8 aa, Entamoeba dispar
ERCPEEDR

SEQ ID NO: 2423066 - protein, 12 aa, Entamoeba dispar
ERCRTDTPQKDV

SEQ ID NO: 2423067 - protein, 9 aa, Entamoeba dispar
ERCSSCNKD

SEQ ID NO: 2423068 - protein, 17 aa, Entamoeba dispar
ERDCSNIRDDDPCIGSP

SEQ ID NO: 2423069 - protein, 6 aa, Entamoeba dispar
ERDELK

SEQ ID NO: 2423070 - protein, 7 aa, Entamoeba dispar
ERDFTKR

SEQ ID NO: 2423071 - protein, 53 aa, Entamoeba dispar
ERDKRKEMKTKLSEEESEELLNPEDEKQKIEEENEERKRKITDDGLTEEERKQ

SEQ ID NO: 2423072 - protein, 5 aa, Entamoeba dispar
ERDNI

SEQ ID NO: 2423073 - protein, 6 aa, Entamoeba dispar
ERDNPK

SEQ ID NO: 2423074 - protein, 7 aa, Entamoeba dispar
ERDQKGF

SEQ ID NO: 2423075 - protein, 9 aa, Entamoeba dispar
ERDRDSKMN

SEQ ID NO: 2423076 - protein, 9 aa, Entamoeba dispar
ERDRRDREL

SEQ ID NO: 2423077 - protein, 8 aa, Entamoeba dispar
ERDSTRYQ

SEQ ID NO: 2423078 - protein, 7 aa, Entamoeba dispar
ERDTSNY

SEQ ID NO: 2423079 - protein, 5 aa, Entamoeba dispar
EREAI

SEQ ID NO: 2423080 - protein, 14 aa, Entamoeba dispar
EREAKVTPMILMPM

SEQ ID NO: 2423081 - protein, 10 aa, Entamoeba dispar
EREANKTGRI

SEQ ID NO: 2423082 - protein, 4 aa, Entamoeba dispar
ERED

SEQ ID NO: 2423083 - protein, 13 aa, Entamoeba dispar
EREDKPKDTTKTV

SEQ ID NO: 2423084 - protein, 5 aa, Entamoeba dispar
EREDM

SEQ ID NO: 2423085 - protein, 4 aa, Entamoeba dispar
EREE

SEQ ID NO: 2423086 - protein, 51 aa, Entamoeba dispar
EREEKELEEKTIDSMKEKKKYQKKKPKAPKPQEEVVTEEPQEEEIKEEDME

SEQ ID NO: 2423087 - protein, 5 aa, Entamoeba dispar
EREGD

SEQ ID NO: 2423088 - protein, 9 aa, Entamoeba dispar
EREGNTTGI

SEQ ID NO: 2423089 - protein, 10 aa, Entamoeba dispar
EREGSIPSGI

SEQ ID NO: 2423090 - protein, 5 aa, Entamoeba dispar
EREGY

SEQ ID NO: 2423091 - protein, 4 aa, Entamoeba dispar
EREH

SEQ ID NO: 2423092 - protein, 12 aa, Entamoeba dispar
EREHNEKQLDAK

SEQ ID NO: 2423093 - protein, 5 aa, Entamoeba dispar
EREIM

SEQ ID NO: 2423094 - protein, 9 aa, Entamoeba dispar
EREKEIKEA

SEQ ID NO: 2423095 - protein, 11 aa, Entamoeba dispar
EREKEKQIEKS

SEQ ID NO: 2423096 - protein, 5 aa, Entamoeba dispar
EREKI

SEQ ID NO: 2423097 - protein, 13 aa, Entamoeba dispar
EREKIGDAPVYQD

SEQ ID NO: 2423098 - protein, 9 aa, Entamoeba dispar
EREKQEIKD

SEQ ID NO: 2423099 - protein, 12 aa, Entamoeba dispar
EREKQRKKREIN

SEQ ID NO: 2423100 - protein, 23 aa, Entamoeba dispar
EREKTEDSYSLSVGTEKSISESV

SEQ ID NO: 2423101 - protein, 4 aa, Entamoeba dispar
EREL

SEQ ID NO: 2423102 - protein, 8 aa, Entamoeba dispar
EREMPSEK

SEQ ID NO: 2423103 - protein, 9 aa, Entamoeba dispar
EREMTPEDE

SEQ ID NO: 2423104 - protein, 6 aa, Entamoeba dispar
ERENEI

SEQ ID NO: 2423105 - protein, 9 aa, Entamoeba dispar
ERENERDIN

SEQ ID NO: 2423106 - protein, 4 aa, Entamoeba dispar
ERER

SEQ ID NO: 2423107 - protein, 6 aa, Entamoeba dispar
ERERDN

SEQ ID NO: 2423108 - protein, 7 aa, Entamoeba dispar
ERERKKR

SEQ ID NO: 2423109 - protein, 8 aa, Entamoeba dispar
ERESKQSN

SEQ ID NO: 2423110 - protein, 7 aa, Entamoeba dispar
ERESNGL

SEQ ID NO: 2423111 - protein, 7 aa, Entamoeba dispar
ERETPLP

SEQ ID NO: 2423112 - protein, 8 aa, Entamoeba dispar
EREVDKDT

SEQ ID NO: 2423113 - protein, 13 aa, Entamoeba dispar
EREVTKRDKQQLK

SEQ ID NO: 2423114 - protein, 5 aa, Entamoeba dispar
EREYD

SEQ ID NO: 2423115 - protein, 6 aa, Entamoeba dispar
ERFGSG

SEQ ID NO: 2423116 - protein, 7 aa, Entamoeba dispar
ERFGSGR

SEQ ID NO: 2423117 - protein, 24 aa, Entamoeba dispar
ERFKEKKMKEEIKESNIPKEKQEM

SEQ ID NO: 2423118 - protein, 10 aa, Entamoeba dispar
ERFNSQKGET

SEQ ID NO: 2423119 - protein, 13 aa, Entamoeba dispar
ERGANLSGGQRQR

SEQ ID NO: 2423120 - protein, 10 aa, Entamoeba dispar
ERGDNNGTTK

SEQ ID NO: 2423121 - protein, 4 aa, Entamoeba dispar
ERGE

SEQ ID NO: 2423122 - protein, 5 aa, Entamoeba dispar
ERGEK

SEQ ID NO: 2423123 - protein, 4 aa, Entamoeba dispar
ERGG

SEQ ID NO: 2423124 - protein, 6 aa, Entamoeba dispar
ERGGDE

SEQ ID NO: 2423125 - protein, 5 aa, Entamoeba dispar
ERGGK

SEQ ID NO: 2423126 - protein, 6 aa, Entamoeba dispar
ERGGMD

SEQ ID NO: 2423127 - protein, 11 aa, Entamoeba dispar
ERGGNDYKNYV

SEQ ID NO: 2423128 - protein, 4 aa, Entamoeba dispar
ERGH

SEQ ID NO: 2423129 - protein, 10 aa, Entamoeba dispar
ERGISEEQEQ

SEQ ID NO: 2423130 - protein, 10 aa, Entamoeba dispar
ERGKAMEKAE

SEQ ID NO: 2423131 - protein, 5 aa, Entamoeba dispar
ERGKV

SEQ ID NO: 2423132 - protein, 4 aa, Entamoeba dispar
ERGT

SEQ ID NO: 2423133 - protein, 5 aa, Entamoeba dispar
ERGTL

SEQ ID NO: 2423134 - protein, 8 aa, Entamoeba dispar
ERGTPKYK

SEQ ID NO: 2423135 - protein, 9 aa, Entamoeba dispar
ERGVDNDDE

SEQ ID NO: 2423136 - protein, 9 aa, Entamoeba dispar
ERHEPASCK

SEQ ID NO: 2423137 - protein, 9 aa, Entamoeba dispar
ERHQERSYE

SEQ ID NO: 2423138 - protein, 4 aa, Entamoeba dispar
ERID

SEQ ID NO: 2423139 - protein, 14 aa, Entamoeba dispar
ERIDEEDNEENKKY

SEQ ID NO: 2423140 - protein, 17 aa, Entamoeba dispar
ERIEARSASFGKGGERI

SEQ ID NO: 2423141 - protein, 9 aa, Entamoeba dispar
ERIEPTNVN

SEQ ID NO: 2423142 - protein, 5 aa, Entamoeba dispar
ERIKE

SEQ ID NO: 2423143 - protein, 20 aa, Entamoeba dispar
ERIKEEIETQSSNTPNYQEN

SEQ ID NO: 2423144 - protein, 20 aa, Entamoeba dispar
ERIKEEIETQYSNTPNYQEN

SEQ ID NO: 2423145 - protein, 5 aa, Entamoeba dispar
ERIKN

SEQ ID NO: 2423146 - protein, 6 aa, Entamoeba dispar
ERIKYG

SEQ ID NO: 2423147 - protein, 7 aa, Entamoeba dispar
ERINNNK

SEQ ID NO: 2423148 - protein, 8 aa, Entamoeba dispar
ERIPQSNF

SEQ ID NO: 2423149 - protein, 9 aa, Entamoeba dispar
ERIRQEEID

SEQ ID NO: 2423150 - protein, 6 aa, Entamoeba dispar
ERIRTE

SEQ ID NO: 2423151 - protein, 6 aa, Entamoeba dispar
ERISES

SEQ ID NO: 2423152 - protein, 7 aa, Entamoeba dispar
ERISSEE

SEQ ID NO: 2423153 - protein, 9 aa, Entamoeba dispar
ERISSSIRG

SEQ ID NO: 2423154 - protein, 7 aa, Entamoeba dispar
ERKEELE

SEQ ID NO: 2423155 - protein, 10 aa, Entamoeba dispar
ERKEKGNGDD

SEQ ID NO: 2423156 - protein, 7 aa, Entamoeba dispar
ERKEREE

SEQ ID NO: 2423157 - protein, 13 aa, Entamoeba dispar
ERKEREKSSREIL

SEQ ID NO: 2423158 - protein, 5 aa, Entamoeba dispar
ERKEV

SEQ ID NO: 2423159 - protein, 4 aa, Entamoeba dispar
ERKF

SEQ ID NO: 2423160 - protein, 4 aa, Entamoeba dispar
ERKG

SEQ ID NO: 2423161 - protein, 7 aa, Entamoeba dispar
ERKGEEI

SEQ ID NO: 2423162 - protein, 117 aa, Entamoeba dispar
ERKGIDDATLAKNQEIKEITNRAKGVDAETDLERRKRERRERREREEREAAEKEKAGSSTSRAERVSTSAETAEEAREKRRLERQRQREEEKRRLAEEERKAQEEREARRKKREEEL

SEQ ID NO: 2423163 - protein, 7 aa, Entamoeba dispar
ERKGIET

SEQ ID NO: 2423164 - protein, 5 aa, Entamoeba dispar
ERKIN

SEQ ID NO: 2423165 - protein, 13 aa, Entamoeba dispar
ERKISKKREEYQK

SEQ ID NO: 2423166 - protein, 8 aa, Entamoeba dispar
ERKITQPG

SEQ ID NO: 2423167 - protein, 10 aa, Entamoeba dispar
ERKKEGEWRK

SEQ ID NO: 2423168 - protein, 9 aa, Entamoeba dispar
ERKKEIEEE

SEQ ID NO: 2423169 - protein, 16 aa, Entamoeba dispar
ERKKEKKEEENQRNNI

SEQ ID NO: 2423170 - protein, 11 aa, Entamoeba dispar
ERKKEKLSLES

SEQ ID NO: 2423171 - protein, 20 aa, Entamoeba dispar
ERKKKKKENKTKCNPNNKRI

SEQ ID NO: 2423172 - protein, 5 aa, Entamoeba dispar
ERKKM

SEQ ID NO: 2423173 - protein, 11 aa, Entamoeba dispar
ERKKRKQMKEQ

SEQ ID NO: 2423174 - protein, 4 aa, Entamoeba dispar
ERKN

SEQ ID NO: 2423175 - protein, 7 aa, Entamoeba dispar
ERKNELS

SEQ ID NO: 2423176 - protein, 8 aa, Entamoeba dispar
ERKNNDEN

SEQ ID NO: 2423177 - protein, 6 aa, Entamoeba dispar
ERKPPE

SEQ ID NO: 2423178 - protein, 9 aa, Entamoeba dispar
ERKPPYEDL

SEQ ID NO: 2423179 - protein, 7 aa, Entamoeba dispar
ERKQGDL

SEQ ID NO: 2423180 - protein, 14 aa, Entamoeba dispar
ERKQMTEPQGFDPT

SEQ ID NO: 2423181 - protein, 6 aa, Entamoeba dispar
ERKQST

SEQ ID NO: 2423182 - protein, 8 aa, Entamoeba dispar
ERKRAYGQ

SEQ ID NO: 2423183 - protein, 10 aa, Entamoeba dispar
ERKRSYERYR

SEQ ID NO: 2423184 - protein, 4 aa, Entamoeba dispar
ERKS

SEQ ID NO: 2423185 - protein, 19 aa, Entamoeba dispar
ERKTEGEEAQLLIEKWKTY

SEQ ID NO: 2423186 - protein, 7 aa, Entamoeba dispar
ERKTGSI

SEQ ID NO: 2423187 - protein, 18 aa, Entamoeba dispar
ERKTKKYWSTEQKKLAVE

SEQ ID NO: 2423188 - protein, 10 aa, Entamoeba dispar
ERKTNEKKSV

SEQ ID NO: 2423189 - protein, 13 aa, Entamoeba dispar
ERKTRNVDRDNKT

SEQ ID NO: 2423190 - protein, 41 aa, Entamoeba dispar
ERKTTTNSSSTTTESKEDKKKDETKEKDTKPPRSPRGPLLS

SEQ ID NO: 2423191 - protein, 7 aa, Entamoeba dispar
ERKYKTQ

SEQ ID NO: 2423192 - protein, 13 aa, Entamoeba dispar
ERKYNKKCQTEYQ

SEQ ID NO: 2423193 - protein, 5 aa, Entamoeba dispar
ERLDQ

SEQ ID NO: 2423194 - protein, 4 aa, Entamoeba dispar
ERLE

SEQ ID NO: 2423195 - protein, 13 aa, Entamoeba dispar
ERLEKEKEETERF

SEQ ID NO: 2423196 - protein, 7 aa, Entamoeba dispar
ERLEREK

SEQ ID NO: 2423197 - protein, 12 aa, Entamoeba dispar
ERLKEYSKQKNV

SEQ ID NO: 2423198 - protein, 8 aa, Entamoeba dispar
ERLNKSNS

SEQ ID NO: 2423199 - protein, 13 aa, Entamoeba dispar
ERLPNVKKPLSQE

SEQ ID NO: 2423200 - protein, 21 aa, Entamoeba dispar
ERLQRDTSNTSKTNINSEETL

SEQ ID NO: 2423201 - protein, 10 aa, Entamoeba dispar
ERLSDDDKDQ

SEQ ID NO: 2423202 - protein, 16 aa, Entamoeba dispar
ERLSENINSLSKETTW

SEQ ID NO: 2423203 - protein, 18 aa, Entamoeba dispar
ERLSQTKTVGRRKTTRKS

SEQ ID NO: 2423204 - protein, 19 aa, Entamoeba dispar
ERLTENEKGIDKTKELQRL

SEQ ID NO: 2423205 - protein, 6 aa, Entamoeba dispar
ERMIEN

SEQ ID NO: 2423206 - protein, 11 aa, Entamoeba dispar
ERMKDRKEGVR

SEQ ID NO: 2423207 - protein, 10 aa, Entamoeba dispar
ERMRQEQERM

SEQ ID NO: 2423208 - protein, 16 aa, Entamoeba dispar
ERNAKYKDYSPKSPQI

SEQ ID NO: 2423209 - protein, 5 aa, Entamoeba dispar
ERNDV

SEQ ID NO: 2423210 - protein, 8 aa, Entamoeba dispar
ERNENVNG

SEQ ID NO: 2423211 - protein, 15 aa, Entamoeba dispar
ERNGIKKGSVTAKEE

SEQ ID NO: 2423212 - protein, 13 aa, Entamoeba dispar
ERNGILKEKENAI

SEQ ID NO: 2423213 - protein, 9 aa, Entamoeba dispar
ERNKEDVKT

SEQ ID NO: 2423214 - protein, 17 aa, Entamoeba dispar
ERNKQTQFKLSTNKSSN

SEQ ID NO: 2423215 - protein, 5 aa, Entamoeba dispar
ERNLP

SEQ ID NO: 2423216 - protein, 7 aa, Entamoeba dispar
ERNNGEK

SEQ ID NO: 2423217 - protein, 18 aa, Entamoeba dispar
ERNNPSLFTNSSNNPQGY

SEQ ID NO: 2423218 - protein, 6 aa, Entamoeba dispar
ERNNTN

SEQ ID NO: 2423219 - protein, 9 aa, Entamoeba dispar
ERNPKRSYE

SEQ ID NO: 2423220 - protein, 21 aa, Entamoeba dispar
ERNQLKRNEGINELDSKRIII

SEQ ID NO: 2423221 - protein, 8 aa, Entamoeba dispar
ERNQQDPE

SEQ ID NO: 2423222 - protein, 4 aa, Entamoeba dispar
ERNS

SEQ ID NO: 2423223 - protein, 7 aa, Entamoeba dispar
ERNSEVV

SEQ ID NO: 2423224 - protein, 7 aa, Entamoeba dispar
ERNSMSE

SEQ ID NO: 2423225 - protein, 5 aa, Entamoeba dispar
ERNSV

SEQ ID NO: 2423226 - protein, 7 aa, Entamoeba dispar
ERNYEEM

SEQ ID NO: 2423227 - protein, 24 aa, Entamoeba dispar
ERPAGSDRNMSAEGNECKKRRGIA

SEQ ID NO: 2423228 - protein, 10 aa, Entamoeba dispar
ERPAKKGIKN

SEQ ID NO: 2423229 - protein, 6 aa, Entamoeba dispar
ERPAKL

SEQ ID NO: 2423230 - protein, 7 aa, Entamoeba dispar
ERPDPKS

SEQ ID NO: 2423231 - protein, 7 aa, Entamoeba dispar
ERPKYQI

SEQ ID NO: 2423232 - protein, 8 aa, Entamoeba dispar
ERPNSVPL

SEQ ID NO: 2423233 - protein, 6 aa, Entamoeba dispar
ERPPLT

SEQ ID NO: 2423234 - protein, 19 aa, Entamoeba dispar
ERPTAGARKGKLTIKTTDM

SEQ ID NO: 2423235 - protein, 6 aa, Entamoeba dispar
ERPTTQ

SEQ ID NO: 2423236 - protein, 10 aa, Entamoeba dispar
ERQDTPNLNE

SEQ ID NO: 2423237 - protein, 35 aa, Entamoeba dispar
ERQEEIKKERAEREETKKKEKREKQEKKEQEERLE

SEQ ID NO: 2423238 - protein, 5 aa, Entamoeba dispar
ERQKG

SEQ ID NO: 2423239 - protein, 7 aa, Entamoeba dispar
ERQKPEV

SEQ ID NO: 2423240 - protein, 17 aa, Entamoeba dispar
ERQNGVQRKRSQPLSPI

SEQ ID NO: 2423241 - protein, 11 aa, Entamoeba dispar
ERQQPKSMKGL

SEQ ID NO: 2423242 - protein, 7 aa, Entamoeba dispar
ERQRPKR

SEQ ID NO: 2423243 - protein, 5 aa, Entamoeba dispar
ERQRS

SEQ ID NO: 2423244 - protein, 22 aa, Entamoeba dispar
ERQTTATNDIKEFKERNAANRA

SEQ ID NO: 2423245 - protein, 33 aa, Entamoeba dispar
ERQVTEEKNKDIQDTQLTEEKKEESQVRYKKNK

SEQ ID NO: 2423246 - protein, 7 aa, Entamoeba dispar
ERRDNQR

SEQ ID NO: 2423247 - protein, 55 aa, Entamoeba dispar
ERRDRYNDRFERRERSYDNYNSHERRREERYEYRSRYEKREEKKGRKEEEINDKE

SEQ ID NO: 2423248 - protein, 27 aa, Entamoeba dispar
ERREAQLSAARSKQIAKEKSEEQKNIV

SEQ ID NO: 2423249 - protein, 9 aa, Entamoeba dispar
ERRKHSELP

SEQ ID NO: 2423250 - protein, 8 aa, Entamoeba dispar
ERRKKKYT

SEQ ID NO: 2423251 - protein, 8 aa, Entamoeba dispar
ERRKRAEL

SEQ ID NO: 2423252 - protein, 11 aa, Entamoeba dispar
ERRNEDCCEER

SEQ ID NO: 2423253 - protein, 5 aa, Entamoeba dispar
ERRNK

SEQ ID NO: 2423254 - protein, 5 aa, Entamoeba dispar
ERRQR

SEQ ID NO: 2423255 - protein, 7 aa, Entamoeba dispar
ERRQREL

SEQ ID NO: 2423256 - protein, 9 aa, Entamoeba dispar
ERRRESENK

SEQ ID NO: 2423257 - protein, 8 aa, Entamoeba dispar
ERRRPRAR

SEQ ID NO: 2423258 - protein, 6 aa, Entamoeba dispar
ERSAQV

SEQ ID NO: 2423259 - protein, 7 aa, Entamoeba dispar
ERSATKL

SEQ ID NO: 2423260 - protein, 10 aa, Entamoeba dispar
ERSDSKKKDL

SEQ ID NO: 2423261 - protein, 11 aa, Entamoeba dispar
ERSETENLAGM

SEQ ID NO: 2423262 - protein, 8 aa, Entamoeba dispar
ERSGEQAI

SEQ ID NO: 2423263 - protein, 8 aa, Entamoeba dispar
ERSHKGDT

SEQ ID NO: 2423264 - protein, 15 aa, Entamoeba dispar
ERSHSTVSRLPSPKS

SEQ ID NO: 2423265 - protein, 5 aa, Entamoeba dispar
ERSIP

SEQ ID NO: 2423266 - protein, 7 aa, Entamoeba dispar
ERSKMRD

SEQ ID NO: 2423267 - protein, 7 aa, Entamoeba dispar
ERSLPQL

SEQ ID NO: 2423268 - protein, 10 aa, Entamoeba dispar
ERSNTNENER

SEQ ID NO: 2423269 - protein, 12 aa, Entamoeba dispar
ERSSADEPIPIT

SEQ ID NO: 2423270 - protein, 7 aa, Entamoeba dispar
ERSSEFK

SEQ ID NO: 2423271 - protein, 8 aa, Entamoeba dispar
ERSTYNSL

SEQ ID NO: 2423272 - protein, 5 aa, Entamoeba dispar
ERSYR

SEQ ID NO: 2423273 - protein, 8 aa, Entamoeba dispar
ERTEEEDR

SEQ ID NO: 2423274 - protein, 28 aa, Entamoeba dispar
ERTEGLSDDEKNEMKEQEKNKQEESDDS

SEQ ID NO: 2423275 - protein, 7 aa, Entamoeba dispar
ERTEPSY

SEQ ID NO: 2423276 - protein, 10 aa, Entamoeba dispar
ERTETFNGKA

SEQ ID NO: 2423277 - protein, 6 aa, Entamoeba dispar
ERTGTY

SEQ ID NO: 2423278 - protein, 20 aa, Entamoeba dispar
ERTIKEKKGDKKEESKKRLE

SEQ ID NO: 2423279 - protein, 5 aa, Entamoeba dispar
ERTIN

SEQ ID NO: 2423280 - protein, 7 aa, Entamoeba dispar
ERTISPS

SEQ ID NO: 2423281 - protein, 6 aa, Entamoeba dispar
ERTKGC

SEQ ID NO: 2423282 - protein, 8 aa, Entamoeba dispar
ERTKMRDD

SEQ ID NO: 2423283 - protein, 7 aa, Entamoeba dispar
ERTKNAQ

SEQ ID NO: 2423284 - protein, 11 aa, Entamoeba dispar
ERTMTEKNNEH

SEQ ID NO: 2423285 - protein, 17 aa, Entamoeba dispar
ERTNEQNDDLGLNDMVV

SEQ ID NO: 2423286 - protein, 8 aa, Entamoeba dispar
ERTNGNIK

SEQ ID NO: 2423287 - protein, 9 aa, Entamoeba dispar
ERTNKTNLK

SEQ ID NO: 2423288 - protein, 5 aa, Entamoeba dispar
ERTQN

SEQ ID NO: 2423289 - protein, 24 aa, Entamoeba dispar
ERTRNKRNERILNEEEKKGIYSGK

SEQ ID NO: 2423290 - protein, 5 aa, Entamoeba dispar
ERTSL

SEQ ID NO: 2423291 - protein, 6 aa, Entamoeba dispar
ERTTKE

SEQ ID NO: 2423292 - protein, 4 aa, Entamoeba dispar
ERTY

SEQ ID NO: 2423293 - protein, 15 aa, Entamoeba dispar
ERTYPEDKQVGWENG

SEQ ID NO: 2423294 - protein, 4 aa, Entamoeba dispar
ERVG

SEQ ID NO: 2423295 - protein, 7 aa, Entamoeba dispar
ERVGEAQ

SEQ ID NO: 2423296 - protein, 6 aa, Entamoeba dispar
ERVGKT

SEQ ID NO: 2423297 - protein, 4 aa, Entamoeba dispar
ERVK

SEQ ID NO: 2423298 - protein, 5 aa, Entamoeba dispar
ERVKN

SEQ ID NO: 2423299 - protein, 4 aa, Entamoeba dispar
ERVP

SEQ ID NO: 2423300 - protein, 16 aa, Entamoeba dispar
ERVRKEEERCSNVEQN

SEQ ID NO: 2423301 - protein, 6 aa, Entamoeba dispar
ERWEEQ

SEQ ID NO: 2423302 - protein, 9 aa, Entamoeba dispar
ERWEGSPTL

SEQ ID NO: 2423303 - protein, 8 aa, Entamoeba dispar
ERYDDKKI

SEQ ID NO: 2423304 - protein, 6 aa, Entamoeba dispar
ERYDKT

SEQ ID NO: 2423305 - protein, 4 aa, Entamoeba dispar
ERYG

SEQ ID NO: 2423306 - protein, 8 aa, Entamoeba dispar
ERYGDEEA

SEQ ID NO: 2423307 - protein, 6 aa, Entamoeba dispar
ERYGES

SEQ ID NO: 2423308 - protein, 9 aa, Entamoeba dispar
ERYLGSSNE

SEQ ID NO: 2423309 - protein, 8 aa, Entamoeba dispar
ERYNNNGY

SEQ ID NO: 2423310 - protein, 15 aa, Entamoeba dispar
ERYNQANENSRQNIE

SEQ ID NO: 2423311 - protein, 7 aa, Entamoeba dispar
ERYSNGP

SEQ ID NO: 2423312 - protein, 12 aa, Entamoeba dispar
ERYYTNEEKYNE

SEQ ID NO: 2423313 - protein, 8 aa, Entamoeba dispar
ESAATLQP

SEQ ID NO: 2423314 - protein, 12 aa, Entamoeba dispar
ESADKENKENHI

SEQ ID NO: 2423315 - protein, 7 aa, Entamoeba dispar
ESAIPKE

SEQ ID NO: 2423316 - protein, 4 aa, Entamoeba dispar
ESAK

SEQ ID NO: 2423317 - protein, 11 aa, Entamoeba dispar
ESAKQEEELKN

SEQ ID NO: 2423318 - protein, 15 aa, Entamoeba dispar
ESAMKGLKEGDKIQI

SEQ ID NO: 2423319 - protein, 8 aa, Entamoeba dispar
ESAQDQKQ

SEQ ID NO: 2423320 - protein, 12 aa, Entamoeba dispar
ESASRKSGVLPE

SEQ ID NO: 2423321 - protein, 13 aa, Entamoeba dispar
ESASRKSGVLPES

SEQ ID NO: 2423322 - protein, 13 aa, Entamoeba dispar
ESASRKSGVLPET

SEQ ID NO: 2423323 - protein, 12 aa, Entamoeba dispar
ESASRKSRVLPE

SEQ ID NO: 2423324 - protein, 22 aa, Entamoeba dispar
ESASRNSKVLPESRKCFQKVGS

SEQ ID NO: 2423325 - protein, 13 aa, Entamoeba dispar
ESASRNSKVLPET

SEQ ID NO: 2423326 - protein, 11 aa, Entamoeba dispar
ESATKKVSNEI

SEQ ID NO: 2423327 - protein, 12 aa, Entamoeba dispar
ESAVSTEDTEIG

SEQ ID NO: 2423328 - protein, 10 aa, Entamoeba dispar
ESCAPPQTPH

SEQ ID NO: 2423329 - protein, 5 aa, Entamoeba dispar
ESCNG

SEQ ID NO: 2423330 - protein, 7 aa, Entamoeba dispar
ESCPTPE

SEQ ID NO: 2423331 - protein, 6 aa, Entamoeba dispar
ESCRKS

SEQ ID NO: 2423332 - protein, 8 aa, Entamoeba dispar
ESCYENNE

SEQ ID NO: 2423333 - protein, 5 aa, Entamoeba dispar
ESDCD

SEQ ID NO: 2423334 - protein, 8 aa, Entamoeba dispar
ESDDDLTN

SEQ ID NO: 2423335 - protein, 7 aa, Entamoeba dispar
ESDDDNE

SEQ ID NO: 2423336 - protein, 18 aa, Entamoeba dispar
ESDDFEDSEDDKDNEEYD

SEQ ID NO: 2423337 - protein, 5 aa, Entamoeba dispar
ESDDI

SEQ ID NO: 2423338 - protein, 5 aa, Entamoeba dispar
ESDDL

SEQ ID NO: 2423339 - protein, 33 aa, Entamoeba dispar
ESDDVEIDRDNWGKNTDVYYQKKRDKELKNDEF

SEQ ID NO: 2423340 - protein, 7 aa, Entamoeba dispar
ESDDYYK

SEQ ID NO: 2423341 - protein, 6 aa, Entamoeba dispar
ESDEKM

SEQ ID NO: 2423342 - protein, 19 aa, Entamoeba dispar
ESDETKTSKQIPLEPPQSL

SEQ ID NO: 2423343 - protein, 6 aa, Entamoeba dispar
ESDEYT

SEQ ID NO: 2423344 - protein, 4 aa, Entamoeba dispar
ESDF

SEQ ID NO: 2423345 - protein, 7 aa, Entamoeba dispar
ESDGEEL

SEQ ID NO: 2423346 - protein, 18 aa, Entamoeba dispar
ESDGFEDSEDDKDNEEYD

SEQ ID NO: 2423347 - protein, 5 aa, Entamoeba dispar
ESDGI

SEQ ID NO: 2423348 - protein, 6 aa, Entamoeba dispar
ESDGKR

SEQ ID NO: 2423349 - protein, 8 aa, Entamoeba dispar
ESDHEFED

SEQ ID NO: 2423350 - protein, 23 aa, Entamoeba dispar
ESDITVKNQGKEITREKKPKQIK

SEQ ID NO: 2423351 - protein, 43 aa, Entamoeba dispar
ESDKCKVETLPRRPTQSIPNKKKMSKEGFEKKKKMTRETKDRP

SEQ ID NO: 2423352 - protein, 5 aa, Entamoeba dispar
ESDKI

SEQ ID NO: 2423353 - protein, 5 aa, Entamoeba dispar
ESDKY

SEQ ID NO: 2423354 - protein, 7 aa, Entamoeba dispar
ESDNAGK

SEQ ID NO: 2423355 - protein, 8 aa, Entamoeba dispar
ESDNNTIK

SEQ ID NO: 2423356 - protein, 6 aa, Entamoeba dispar
ESDPGV

SEQ ID NO: 2423357 - protein, 7 aa, Entamoeba dispar
ESDPLPL

SEQ ID NO: 2423358 - protein, 10 aa, Entamoeba dispar
ESDQETTSSL

SEQ ID NO: 2423359 - protein, 6 aa, Entamoeba dispar
ESDREM

SEQ ID NO: 2423360 - protein, 6 aa, Entamoeba dispar
ESDRLK

SEQ ID NO: 2423361 - protein, 10 aa, Entamoeba dispar
ESDSELEEEI

SEQ ID NO: 2423362 - protein, 10 aa, Entamoeba dispar
ESDTTSESID

SEQ ID NO: 2423363 - protein, 6 aa, Entamoeba dispar
ESDVSR

SEQ ID NO: 2423364 - protein, 5 aa, Entamoeba dispar
ESDVY

SEQ ID NO: 2423365 - protein, 7 aa, Entamoeba dispar
ESDYVSE

SEQ ID NO: 2423366 - protein, 15 aa, Entamoeba dispar
ESEAGASGAVHGGCA

SEQ ID NO: 2423367 - protein, 5 aa, Entamoeba dispar
ESEAI

SEQ ID NO: 2423368 - protein, 20 aa, Entamoeba dispar
ESEDEKENKQPPSKTTQNGL

SEQ ID NO: 2423369 - protein, 6 aa, Entamoeba dispar
ESEEDK

SEQ ID NO: 2423370 - protein, 26 aa, Entamoeba dispar
ESEEQPKEENEGIDSEKRKGVKQQEI

SEQ ID NO: 2423371 - protein, 8 aa, Entamoeba dispar
ESEKCENQ

SEQ ID NO: 2423372 - protein, 5 aa, Entamoeba dispar
ESELS

SEQ ID NO: 2423373 - protein, 12 aa, Entamoeba dispar
ESELTPRHNKQM

SEQ ID NO: 2423374 - protein, 6 aa, Entamoeba dispar
ESENAV

SEQ ID NO: 2423375 - protein, 5 aa, Entamoeba dispar
ESENE

SEQ ID NO: 2423376 - protein, 25 aa, Entamoeba dispar
ESENEEQKSGYKERVKGYKELKETN

SEQ ID NO: 2423377 - protein, 7 aa, Entamoeba dispar
ESENPQL

SEQ ID NO: 2423378 - protein, 17 aa, Entamoeba dispar
ESENTKNQRSTAVSNTM

SEQ ID NO: 2423379 - protein, 10 aa, Entamoeba dispar
ESEPYKGNER

SEQ ID NO: 2423380 - protein, 4 aa, Entamoeba dispar
ESEQ

SEQ ID NO: 2423381 - protein, 10 aa, Entamoeba dispar
ESEQFPTPTP

SEQ ID NO: 2423382 - protein, 5 aa, Entamoeba dispar
ESEQK

SEQ ID NO: 2423383 - protein, 6 aa, Entamoeba dispar
ESEQVK

SEQ ID NO: 2423384 - protein, 10 aa, Entamoeba dispar
ESERIDQNEL

SEQ ID NO: 2423385 - protein, 15 aa, Entamoeba dispar
ESERKRTATYTKRSH

SEQ ID NO: 2423386 - protein, 6 aa, Entamoeba dispar
ESERPA

SEQ ID NO: 2423387 - protein, 19 aa, Entamoeba dispar
ESESGVEPSSYEEKASLDN

SEQ ID NO: 2423388 - protein, 10 aa, Entamoeba dispar
ESESSQTPHY

SEQ ID NO: 2423389 - protein, 27 aa, Entamoeba dispar
ESETIENKEEEEENETIENKEEEEENV

SEQ ID NO: 2423390 - protein, 7 aa, Entamoeba dispar
ESETLKN

SEQ ID NO: 2423391 - protein, 5 aa, Entamoeba dispar
ESETV

SEQ ID NO: 2423392 - protein, 4 aa, Entamoeba dispar
ESEV

SEQ ID NO: 2423393 - protein, 5 aa, Entamoeba dispar
ESEYS

SEQ ID NO: 2423394 - protein, 10 aa, Entamoeba dispar
ESFEQSQLKN

SEQ ID NO: 2423395 - protein, 18 aa, Entamoeba dispar
ESFESKEEKKEEEIKEQK

SEQ ID NO: 2423396 - protein, 4 aa, Entamoeba dispar
ESFG

SEQ ID NO: 2423397 - protein, 8 aa, Entamoeba dispar
ESFGPQNT

SEQ ID NO: 2423398 - protein, 17 aa, Entamoeba dispar
ESFIPKSQTYQSPQNSF

SEQ ID NO: 2423399 - protein, 4 aa, Entamoeba dispar
ESFK

SEQ ID NO: 2423400 - protein, 20 aa, Entamoeba dispar
ESFKEEDKKKKSSDPQTYRK

SEQ ID NO: 2423401 - protein, 5 aa, Entamoeba dispar
ESFKP

SEQ ID NO: 2423402 - protein, 4 aa, Entamoeba dispar
ESFN

SEQ ID NO: 2423403 - protein, 6 aa, Entamoeba dispar
ESFNER

SEQ ID NO: 2423404 - protein, 5 aa, Entamoeba dispar
ESFNP

SEQ ID NO: 2423405 - protein, 4 aa, Entamoeba dispar
ESFQ

SEQ ID NO: 2423406 - protein, 22 aa, Entamoeba dispar
ESFSSFRRNGSPINEDKNEDIP

SEQ ID NO: 2423407 - protein, 9 aa, Entamoeba dispar
ESFSSGRLT

SEQ ID NO: 2423408 - protein, 5 aa, Entamoeba dispar
ESFTD

SEQ ID NO: 2423409 - protein, 10 aa, Entamoeba dispar
ESGDDLEKEE

SEQ ID NO: 2423410 - protein, 8 aa, Entamoeba dispar
ESGDEHFS

SEQ ID NO: 2423411 - protein, 18 aa, Entamoeba dispar
ESGDQETFENRAAKSGLE

SEQ ID NO: 2423412 - protein, 11 aa, Entamoeba dispar
ESGDQLKNTPH

SEQ ID NO: 2423413 - protein, 14 aa, Entamoeba dispar
ESGDSIENENERVS

SEQ ID NO: 2423414 - protein, 4 aa, Entamoeba dispar
ESGE

SEQ ID NO: 2423415 - protein, 5 aa, Entamoeba dispar
ESGEF

SEQ ID NO: 2423416 - protein, 11 aa, Entamoeba dispar
ESGEIKFTENG

SEQ ID NO: 2423417 - protein, 8 aa, Entamoeba dispar
ESGEINDI

SEQ ID NO: 2423418 - protein, 6 aa, Entamoeba dispar
ESGENL

SEQ ID NO: 2423419 - protein, 7 aa, Entamoeba dispar
ESGFTPE

SEQ ID NO: 2423420 - protein, 8 aa, Entamoeba dispar
ESGGPLEG

SEQ ID NO: 2423421 - protein, 5 aa, Entamoeba dispar
ESGHI

SEQ ID NO: 2423422 - protein, 8 aa, Entamoeba dispar
ESGIPSTV

SEQ ID NO: 2423423 - protein, 7 aa, Entamoeba dispar
ESGISNV

SEQ ID NO: 2423424 - protein, 7 aa, Entamoeba dispar
ESGKGLS

SEQ ID NO: 2423425 - protein, 19 aa, Entamoeba dispar
ESGKNIEIDKSKGKSKGKL

SEQ ID NO: 2423426 - protein, 6 aa, Entamoeba dispar
ESGLNT

SEQ ID NO: 2423427 - protein, 11 aa, Entamoeba dispar
ESGMKGGTTKV

SEQ ID NO: 2423428 - protein, 4 aa, Entamoeba dispar
ESGN

SEQ ID NO: 2423429 - protein, 6 aa, Entamoeba dispar
ESGNEK

SEQ ID NO: 2423430 - protein, 5 aa, Entamoeba dispar
ESGNF

SEQ ID NO: 2423431 - protein, 4 aa, Entamoeba dispar
ESGQ

SEQ ID NO: 2423432 - protein, 12 aa, Entamoeba dispar
ESGQYKKQKKGF

SEQ ID NO: 2423433 - protein, 11 aa, Entamoeba dispar
ESGSGSKEDTM

SEQ ID NO: 2423434 - protein, 4 aa, Entamoeba dispar
ESGT

SEQ ID NO: 2423435 - protein, 5 aa, Entamoeba dispar
ESGTT

SEQ ID NO: 2423436 - protein, 4 aa, Entamoeba dispar
ESHA

SEQ ID NO: 2423437 - protein, 21 aa, Entamoeba dispar
ESHEIGKKEGEESKVISSSGP

SEQ ID NO: 2423438 - protein, 4 aa, Entamoeba dispar
ESHK

SEQ ID NO: 2423439 - protein, 9 aa, Entamoeba dispar
ESHKTNQTY

SEQ ID NO: 2423440 - protein, 14 aa, Entamoeba dispar
ESHNPSAKTKAMDT

SEQ ID NO: 2423441 - protein, 4 aa, Entamoeba dispar
ESHR

SEQ ID NO: 2423442 - protein, 27 aa, Entamoeba dispar
ESHSCSEKSDGAVEVTEGTNPFGEDNS

SEQ ID NO: 2423443 - protein, 9 aa, Entamoeba dispar
ESIDASKAV

SEQ ID NO: 2423444 - protein, 10 aa, Entamoeba dispar
ESIDNESSNM

SEQ ID NO: 2423445 - protein, 13 aa, Entamoeba dispar
ESIDNSNLSQPRL

SEQ ID NO: 2423446 - protein, 4 aa, Entamoeba dispar
ESIE

SEQ ID NO: 2423447 - protein, 13 aa, Entamoeba dispar
ESIEEKEDEITKL

SEQ ID NO: 2423448 - protein, 32 aa, Entamoeba dispar
ESIEENNGNKEESSIKDNEKRQTMRTGTKKKV

SEQ ID NO: 2423449 - protein, 11 aa, Entamoeba dispar
ESIEKNSELES

SEQ ID NO: 2423450 - protein, 10 aa, Entamoeba dispar
ESIEQTEREQ

SEQ ID NO: 2423451 - protein, 6 aa, Entamoeba dispar
ESIGFE

SEQ ID NO: 2423452 - protein, 10 aa, Entamoeba dispar
ESIGSTKKVN

SEQ ID NO: 2423453 - protein, 4 aa, Entamoeba dispar
ESII

SEQ ID NO: 2423454 - protein, 12 aa, Entamoeba dispar
ESIKKGNEEVDK

SEQ ID NO: 2423455 - protein, 30 aa, Entamoeba dispar
ESIKKQNEIKIEKTKKKIEENKKKNRDNTI

SEQ ID NO: 2423456 - protein, 7 aa, Entamoeba dispar
ESIKNKG

SEQ ID NO: 2423457 - protein, 121 aa, Entamoeba dispar
ESIKQESIKEDNNKEDIKEENTKEENSKIINKEDNKEEKIKDNTKKYDNKEENKDNVKKEESVKEEKIEDNNKEESNKEENKEIENTKENKEDDEKDKEKQIKEQEEEKKKELEDDPEAEA

SEQ ID NO: 2423458 - protein, 6 aa, Entamoeba dispar
ESIKRF

SEQ ID NO: 2423459 - protein, 9 aa, Entamoeba dispar
ESIKRSERL

SEQ ID NO: 2423460 - protein, 10 aa, Entamoeba dispar
ESIKRSERLS

SEQ ID NO: 2423461 - protein, 7 aa, Entamoeba dispar
ESINNES

SEQ ID NO: 2423462 - protein, 40 aa, Entamoeba dispar
ESINSFNGGIPNGYGNQPFYEDTQQNYENQQYRNNTNPMN

SEQ ID NO: 2423463 - protein, 4 aa, Entamoeba dispar
ESIP

SEQ ID NO: 2423464 - protein, 5 aa, Entamoeba dispar
ESIPE

SEQ ID NO: 2423465 - protein, 6 aa, Entamoeba dispar
ESIPST

SEQ ID NO: 2423466 - protein, 9 aa, Entamoeba dispar
ESIPTSQDK

SEQ ID NO: 2423467 - protein, 14 aa, Entamoeba dispar
ESIQPQIEELSNGA

SEQ ID NO: 2423468 - protein, 29 aa, Entamoeba dispar
ESISDDPSEEETYSDSTSNKDSESSDEEE

SEQ ID NO: 2423469 - protein, 16 aa, Entamoeba dispar
ESISGNDNLLSETEEL

SEQ ID NO: 2423470 - protein, 8 aa, Entamoeba dispar
ESISQQEY

SEQ ID NO: 2423471 - protein, 7 aa, Entamoeba dispar
ESISRKD

SEQ ID NO: 2423472 - protein, 6 aa, Entamoeba dispar
ESISSP

SEQ ID NO: 2423473 - protein, 4 aa, Entamoeba dispar
ESIT

SEQ ID NO: 2423474 - protein, 19 aa, Entamoeba dispar
ESITEEIDETSESENHDEF

SEQ ID NO: 2423475 - protein, 7 aa, Entamoeba dispar
ESITSIK

SEQ ID NO: 2423476 - protein, 19 aa, Entamoeba dispar
ESITSSQRINTKTSEQNQQ

SEQ ID NO: 2423477 - protein, 9 aa, Entamoeba dispar
ESKAERDSW

SEQ ID NO: 2423478 - protein, 9 aa, Entamoeba dispar
ESKAKEYSE

SEQ ID NO: 2423479 - protein, 13 aa, Entamoeba dispar
ESKANGGSRKEEC

SEQ ID NO: 2423480 - protein, 9 aa, Entamoeba dispar
ESKDEESKQ

SEQ ID NO: 2423481 - protein, 7 aa, Entamoeba dispar
ESKEAES

SEQ ID NO: 2423482 - protein, 7 aa, Entamoeba dispar
ESKEEMV

SEQ ID NO: 2423483 - protein, 15 aa, Entamoeba dispar
ESKEGNIPENESNAL

SEQ ID NO: 2423484 - protein, 7 aa, Entamoeba dispar
ESKEIRD

SEQ ID NO: 2423485 - protein, 5 aa, Entamoeba dispar
ESKEN

SEQ ID NO: 2423486 - protein, 7 aa, Entamoeba dispar
ESKENGR

SEQ ID NO: 2423487 - protein, 10 aa, Entamoeba dispar
ESKESNEKTI

SEQ ID NO: 2423488 - protein, 8 aa, Entamoeba dispar
ESKETISI

SEQ ID NO: 2423489 - protein, 5 aa, Entamoeba dispar
ESKFE

SEQ ID NO: 2423490 - protein, 9 aa, Entamoeba dispar
ESKGDEVKK

SEQ ID NO: 2423491 - protein, 7 aa, Entamoeba dispar
ESKGEIK

SEQ ID NO: 2423492 - protein, 4 aa, Entamoeba dispar
ESKI

SEQ ID NO: 2423493 - protein, 9 aa, Entamoeba dispar
ESKIGEDYS

SEQ ID NO: 2423494 - protein, 7 aa, Entamoeba dispar
ESKISKG

SEQ ID NO: 2423495 - protein, 40 aa, Entamoeba dispar
ESKITFSRTNKRNENITSQFKETSDGFDIPKTKTERQKTI

SEQ ID NO: 2423496 - protein, 10 aa, Entamoeba dispar
ESKKAVETSP

SEQ ID NO: 2423497 - protein, 22 aa, Entamoeba dispar
ESKKGLIEKSKQCTKTYRKRTS

SEQ ID NO: 2423498 - protein, 10 aa, Entamoeba dispar
ESKKGTQMTE

SEQ ID NO: 2423499 - protein, 6 aa, Entamoeba dispar
ESKKQM

SEQ ID NO: 2423500 - protein, 8 aa, Entamoeba dispar
ESKKRINE

SEQ ID NO: 2423501 - protein, 9 aa, Entamoeba dispar
ESKKSNCFE

SEQ ID NO: 2423502 - protein, 19 aa, Entamoeba dispar
ESKKTTGNKGNQKETARKI

SEQ ID NO: 2423503 - protein, 4 aa, Entamoeba dispar
ESKL

SEQ ID NO: 2423504 - protein, 18 aa, Entamoeba dispar
ESKLKENKRIPEECFKED

SEQ ID NO: 2423505 - protein, 11 aa, Entamoeba dispar
ESKLSSNGITG

SEQ ID NO: 2423506 - protein, 20 aa, Entamoeba dispar
ESKLSVPSQLTSLSSNTSNF

SEQ ID NO: 2423507 - protein, 10 aa, Entamoeba dispar
ESKNEPVKTI

SEQ ID NO: 2423508 - protein, 12 aa, Entamoeba dispar
ESKNGKGVSTNE

SEQ ID NO: 2423509 - protein, 6 aa, Entamoeba dispar
ESKNRE

SEQ ID NO: 2423510 - protein, 6 aa, Entamoeba dispar
ESKPKL

SEQ ID NO: 2423511 - protein, 9 aa, Entamoeba dispar
ESKQKLRGT

SEQ ID NO: 2423512 - protein, 19 aa, Entamoeba dispar
ESKQNAEQRKGRAGRTETG

SEQ ID NO: 2423513 - protein, 7 aa, Entamoeba dispar
ESKQNDV

SEQ ID NO: 2423514 - protein, 9 aa, Entamoeba dispar
ESKQQQQEL

SEQ ID NO: 2423515 - protein, 5 aa, Entamoeba dispar
ESKQV

SEQ ID NO: 2423516 - protein, 11 aa, Entamoeba dispar
ESKREEDSIEE

SEQ ID NO: 2423517 - protein, 5 aa, Entamoeba dispar
ESKRM

SEQ ID NO: 2423518 - protein, 6 aa, Entamoeba dispar
ESKRSV

SEQ ID NO: 2423519 - protein, 11 aa, Entamoeba dispar
ESKSAVEAESL

SEQ ID NO: 2423520 - protein, 10 aa, Entamoeba dispar
ESKSGDVKRM

SEQ ID NO: 2423521 - protein, 11 aa, Entamoeba dispar
ESKSPHRPDGN

SEQ ID NO: 2423522 - protein, 10 aa, Entamoeba dispar
ESKSQSSKLG

SEQ ID NO: 2423523 - protein, 17 aa, Entamoeba dispar
ESKTKDSTKKIQEPKQH

SEQ ID NO: 2423524 - protein, 9 aa, Entamoeba dispar
ESKTNQSAM

SEQ ID NO: 2423525 - protein, 10 aa, Entamoeba dispar
ESKTPNRHSA

SEQ ID NO: 2423526 - protein, 17 aa, Entamoeba dispar
ESKYAEGKAGINKQESI

SEQ ID NO: 2423527 - protein, 8 aa, Entamoeba dispar
ESKYDATT

SEQ ID NO: 2423528 - protein, 7 aa, Entamoeba dispar
ESLADDT

SEQ ID NO: 2423529 - protein, 12 aa, Entamoeba dispar
ESLAKDRKNELS

SEQ ID NO: 2423530 - protein, 5 aa, Entamoeba dispar
ESLEE

SEQ ID NO: 2423531 - protein, 9 aa, Entamoeba dispar
ESLEKKKQE

SEQ ID NO: 2423532 - protein, 8 aa, Entamoeba dispar
ESLENPSL

SEQ ID NO: 2423533 - protein, 21 aa, Entamoeba dispar
ESLETERKQRELIEKEKDENA

SEQ ID NO: 2423534 - protein, 4 aa, Entamoeba dispar
ESLH

SEQ ID NO: 2423535 - protein, 5 aa, Entamoeba dispar
ESLKE

SEQ ID NO: 2423536 - protein, 6 aa, Entamoeba dispar
ESLKNK

SEQ ID NO: 2423537 - protein, 16 aa, Entamoeba dispar
ESLKREKEKISNQKRS

SEQ ID NO: 2423538 - protein, 4 aa, Entamoeba dispar
ESLN

SEQ ID NO: 2423539 - protein, 8 aa, Entamoeba dispar
ESLNEKSR

SEQ ID NO: 2423540 - protein, 5 aa, Entamoeba dispar
ESLNG

SEQ ID NO: 2423541 - protein, 9 aa, Entamoeba dispar
ESLNNGLSK

SEQ ID NO: 2423542 - protein, 13 aa, Entamoeba dispar
ESLPITPTNEKGI

SEQ ID NO: 2423543 - protein, 6 aa, Entamoeba dispar
ESLPQP

SEQ ID NO: 2423544 - protein, 6 aa, Entamoeba dispar
ESLPST

SEQ ID NO: 2423545 - protein, 9 aa, Entamoeba dispar
ESLQEKQID

SEQ ID NO: 2423546 - protein, 7 aa, Entamoeba dispar
ESLQPTQ

SEQ ID NO: 2423547 - protein, 11 aa, Entamoeba dispar
ESLQSESITSG

SEQ ID NO: 2423548 - protein, 7 aa, Entamoeba dispar
ESLRNNK

SEQ ID NO: 2423549 - protein, 10 aa, Entamoeba dispar
ESLTSATVST

SEQ ID NO: 2423550 - protein, 15 aa, Entamoeba dispar
ESMQIGSENTPEESA

SEQ ID NO: 2423551 - protein, 8 aa, Entamoeba dispar
ESMTEQQV

SEQ ID NO: 2423552 - protein, 5 aa, Entamoeba dispar
ESMTP

SEQ ID NO: 2423553 - protein, 14 aa, Entamoeba dispar
ESNAQQNRNTITVT

SEQ ID NO: 2423554 - protein, 9 aa, Entamoeba dispar
ESNCSQPNE

SEQ ID NO: 2423555 - protein, 4 aa, Entamoeba dispar
ESND

SEQ ID NO: 2423556 - protein, 18 aa, Entamoeba dispar
ESNDESTWPKPPACLGDD

SEQ ID NO: 2423557 - protein, 7 aa, Entamoeba dispar
ESNDKLP

SEQ ID NO: 2423558 - protein, 9 aa, Entamoeba dispar
ESNDPQVAS

SEQ ID NO: 2423559 - protein, 6 aa, Entamoeba dispar
ESNDSK

SEQ ID NO: 2423560 - protein, 8 aa, Entamoeba dispar
ESNENSGQ

SEQ ID NO: 2423561 - protein, 7 aa, Entamoeba dispar
ESNEPFD

SEQ ID NO: 2423562 - protein, 13 aa, Entamoeba dispar
ESNGINSSTLQRE

SEQ ID NO: 2423563 - protein, 10 aa, Entamoeba dispar
ESNGSNKRQM

SEQ ID NO: 2423564 - protein, 8 aa, Entamoeba dispar
ESNIKQRA

SEQ ID NO: 2423565 - protein, 5 aa, Entamoeba dispar
ESNKE

SEQ ID NO: 2423566 - protein, 41 aa, Entamoeba dispar
ESNKEENNKEENGDKNMKEGGDTENKKEKKDEKEEKKKERK

SEQ ID NO: 2423567 - protein, 9 aa, Entamoeba dispar
ESNKINEIK

SEQ ID NO: 2423568 - protein, 9 aa, Entamoeba dispar
ESNKKKGLK

SEQ ID NO: 2423569 - protein, 10 aa, Entamoeba dispar
ESNKKKQEEV

SEQ ID NO: 2423570 - protein, 5 aa, Entamoeba dispar
ESNKN

SEQ ID NO: 2423571 - protein, 7 aa, Entamoeba dispar
ESNKNLV

SEQ ID NO: 2423572 - protein, 8 aa, Entamoeba dispar
ESNKPARH

SEQ ID NO: 2423573 - protein, 9 aa, Entamoeba dispar
ESNKSPAEY

SEQ ID NO: 2423574 - protein, 5 aa, Entamoeba dispar
ESNLE

SEQ ID NO: 2423575 - protein, 4 aa, Entamoeba dispar
ESNN

SEQ ID NO: 2423576 - protein, 6 aa, Entamoeba dispar
ESNNDC

SEQ ID NO: 2423577 - protein, 6 aa, Entamoeba dispar
ESNNEC

SEQ ID NO: 2423578 - protein, 7 aa, Entamoeba dispar
ESNNEDL

SEQ ID NO: 2423579 - protein, 9 aa, Entamoeba dispar
ESNNEQNIE

SEQ ID NO: 2423580 - protein, 5 aa, Entamoeba dispar
ESNNY

SEQ ID NO: 2423581 - protein, 8 aa, Entamoeba dispar
ESNPEQQQ

SEQ ID NO: 2423582 - protein, 6 aa, Entamoeba dispar
ESNPKE

SEQ ID NO: 2423583 - protein, 11 aa, Entamoeba dispar
ESNPLQKLTED

SEQ ID NO: 2423584 - protein, 6 aa, Entamoeba dispar
ESNPPM

SEQ ID NO: 2423585 - protein, 16 aa, Entamoeba dispar
ESNQIQNSNKEQIQNI

SEQ ID NO: 2423586 - protein, 9 aa, Entamoeba dispar
ESNQKQNNM

SEQ ID NO: 2423587 - protein, 10 aa, Entamoeba dispar
ESNQQQADKL

SEQ ID NO: 2423588 - protein, 7 aa, Entamoeba dispar
ESNQSDC

SEQ ID NO: 2423589 - protein, 13 aa, Entamoeba dispar
ESNRDKWLNLIES

SEQ ID NO: 2423590 - protein, 4 aa, Entamoeba dispar
ESNS

SEQ ID NO: 2423591 - protein, 16 aa, Entamoeba dispar
ESNSISMGRNSNTEFN

SEQ ID NO: 2423592 - protein, 15 aa, Entamoeba dispar
ESNSNSISNKTDLSQ

SEQ ID NO: 2423593 - protein, 9 aa, Entamoeba dispar
ESNSQTMKK

SEQ ID NO: 2423594 - protein, 5 aa, Entamoeba dispar
ESNTD

SEQ ID NO: 2423595 - protein, 9 aa, Entamoeba dispar
ESPAITTKR

SEQ ID NO: 2423596 - protein, 4 aa, Entamoeba dispar
ESPC

SEQ ID NO: 2423597 - protein, 5 aa, Entamoeba dispar
ESPDF

SEQ ID NO: 2423598 - protein, 14 aa, Entamoeba dispar
ESPEAIPAGETPQT

SEQ ID NO: 2423599 - protein, 7 aa, Entamoeba dispar
ESPEKVE

SEQ ID NO: 2423600 - protein, 19 aa, Entamoeba dispar
ESPENSQSETTPKKGVLDK

SEQ ID NO: 2423601 - protein, 8 aa, Entamoeba dispar
ESPERPLS

SEQ ID NO: 2423602 - protein, 8 aa, Entamoeba dispar
ESPESSNK

SEQ ID NO: 2423603 - protein, 4 aa, Entamoeba dispar
ESPF

SEQ ID NO: 2423604 - protein, 4 aa, Entamoeba dispar
ESPI

SEQ ID NO: 2423605 - protein, 25 aa, Entamoeba dispar
ESPINDNSIPPGRRYRQNELTQQIS

SEQ ID NO: 2423606 - protein, 30 aa, Entamoeba dispar
ESPISDGTTPKIKKDQKEKKGRKGSVEGNI

SEQ ID NO: 2423607 - protein, 8 aa, Entamoeba dispar
ESPLTGEP

SEQ ID NO: 2423608 - protein, 8 aa, Entamoeba dispar
ESPNKERI

SEQ ID NO: 2423609 - protein, 7 aa, Entamoeba dispar
ESPPIPQ

SEQ ID NO: 2423610 - protein, 4 aa, Entamoeba dispar
ESPQ

SEQ ID NO: 2423611 - protein, 6 aa, Entamoeba dispar
ESPRNR

SEQ ID NO: 2423612 - protein, 7 aa, Entamoeba dispar
ESPRTLS

SEQ ID NO: 2423613 - protein, 7 aa, Entamoeba dispar
ESPSFTE

SEQ ID NO: 2423614 - protein, 9 aa, Entamoeba dispar
ESPSKMSQI

SEQ ID NO: 2423615 - protein, 7 aa, Entamoeba dispar
ESPTFEA

SEQ ID NO: 2423616 - protein, 18 aa, Entamoeba dispar
ESPTLQSTSTHSSPARAR

SEQ ID NO: 2423617 - protein, 11 aa, Entamoeba dispar
ESPYVGSITPE

SEQ ID NO: 2423618 - protein, 6 aa, Entamoeba dispar
ESQADL

SEQ ID NO: 2423619 - protein, 4 aa, Entamoeba dispar
ESQC

SEQ ID NO: 2423620 - protein, 12 aa, Entamoeba dispar
ESQCPPSEEQMR

SEQ ID NO: 2423621 - protein, 5 aa, Entamoeba dispar
ESQDY

SEQ ID NO: 2423622 - protein, 10 aa, Entamoeba dispar
ESQEKPGKRY

SEQ ID NO: 2423623 - protein, 8 aa, Entamoeba dispar
ESQIEPSV

SEQ ID NO: 2423624 - protein, 24 aa, Entamoeba dispar
ESQIKDKTSTEEIQTKQNNKINEL

SEQ ID NO: 2423625 - protein, 6 aa, Entamoeba dispar
ESQIKP

SEQ ID NO: 2423626 - protein, 10 aa, Entamoeba dispar
ESQITSPGVE

SEQ ID NO: 2423627 - protein, 24 aa, Entamoeba dispar
ESQITTPNSQNDLSFNDSSIPEGR

SEQ ID NO: 2423628 - protein, 9 aa, Entamoeba dispar
ESQKEVIEG

SEQ ID NO: 2423629 - protein, 7 aa, Entamoeba dispar
ESQLKAA

SEQ ID NO: 2423630 - protein, 18 aa, Entamoeba dispar
ESQLNDIDSAIRNLILLK

SEQ ID NO: 2423631 - protein, 8 aa, Entamoeba dispar
ESQNASIR

SEQ ID NO: 2423632 - protein, 9 aa, Entamoeba dispar
ESQNKQQKV

SEQ ID NO: 2423633 - protein, 29 aa, Entamoeba dispar
ESQNQTVPKPQNITSSPSTNGNHSTSSQE

SEQ ID NO: 2423634 - protein, 8 aa, Entamoeba dispar
ESQNVPER

SEQ ID NO: 2423635 - protein, 17 aa, Entamoeba dispar
ESQPISLEKNNQENDMS

SEQ ID NO: 2423636 - protein, 5 aa, Entamoeba dispar
ESQPK

SEQ ID NO: 2423637 - protein, 9 aa, Entamoeba dispar
ESQPPYKEH

SEQ ID NO: 2423638 - protein, 6 aa, Entamoeba dispar
ESQRKE

SEQ ID NO: 2423639 - protein, 12 aa, Entamoeba dispar
ESQRKEWKTSLT

SEQ ID NO: 2423640 - protein, 7 aa, Entamoeba dispar
ESQRKTR

SEQ ID NO: 2423641 - protein, 7 aa, Entamoeba dispar
ESQSDEM

SEQ ID NO: 2423642 - protein, 17 aa, Entamoeba dispar
ESQSEWNTTSSVKQTNT

SEQ ID NO: 2423643 - protein, 12 aa, Entamoeba dispar
ESQSKEDSSDIE

SEQ ID NO: 2423644 - protein, 12 aa, Entamoeba dispar
ESQSRQKLPSFD

SEQ ID NO: 2423645 - protein, 12 aa, Entamoeba dispar
ESQSSARLRTST

SEQ ID NO: 2423646 - protein, 8 aa, Entamoeba dispar
ESQSSYSF

SEQ ID NO: 2423647 - protein, 5 aa, Entamoeba dispar
ESQST

SEQ ID NO: 2423648 - protein, 7 aa, Entamoeba dispar
ESQVKID

SEQ ID NO: 2423649 - protein, 20 aa, Entamoeba dispar
ESRAENDKFHRNRTGRTSKV

SEQ ID NO: 2423650 - protein, 6 aa, Entamoeba dispar
ESRASK

SEQ ID NO: 2423651 - protein, 7 aa, Entamoeba dispar
ESRELTQ

SEQ ID NO: 2423652 - protein, 12 aa, Entamoeba dispar
ESRGFDTKEVQS

SEQ ID NO: 2423653 - protein, 7 aa, Entamoeba dispar
ESRIDRE

SEQ ID NO: 2423654 - protein, 4 aa, Entamoeba dispar
ESRK

SEQ ID NO: 2423655 - protein, 7 aa, Entamoeba dispar
ESRKGID

SEQ ID NO: 2423656 - protein, 10 aa, Entamoeba dispar
ESRKKQEEAL

SEQ ID NO: 2423657 - protein, 11 aa, Entamoeba dispar
ESRKKYEENHQ

SEQ ID NO: 2423658 - protein, 6 aa, Entamoeba dispar
ESRLEN

SEQ ID NO: 2423659 - protein, 6 aa, Entamoeba dispar
ESRLSN

SEQ ID NO: 2423660 - protein, 8 aa, Entamoeba dispar
ESRNKCPA

SEQ ID NO: 2423661 - protein, 7 aa, Entamoeba dispar
ESRNKQN

SEQ ID NO: 2423662 - protein, 12 aa, Entamoeba dispar
ESRPKKVSKCNI

SEQ ID NO: 2423663 - protein, 5 aa, Entamoeba dispar
ESRQK

SEQ ID NO: 2423664 - protein, 7 aa, Entamoeba dispar
ESRQYSQ

SEQ ID NO: 2423665 - protein, 7 aa, Entamoeba dispar
ESRRERL

SEQ ID NO: 2423666 - protein, 20 aa, Entamoeba dispar
ESRSTSAPPQMDRIGSSGEV

SEQ ID NO: 2423667 - protein, 20 aa, Entamoeba dispar
ESRSTSAPPQMDRTGSSGEV

SEQ ID NO: 2423668 - protein, 17 aa, Entamoeba dispar
ESSAEETNKKDFPTRGK

SEQ ID NO: 2423669 - protein, 8 aa, Entamoeba dispar
ESSATTEG

SEQ ID NO: 2423670 - protein, 5 aa, Entamoeba dispar
ESSDE

SEQ ID NO: 2423671 - protein, 46 aa, Entamoeba dispar
ESSDLLPKKESKIESVEPKTEALQGKEPKQMDEQTKEIKPTKEIKA

SEQ ID NO: 2423672 - protein, 7 aa, Entamoeba dispar
ESSDNYE

SEQ ID NO: 2423673 - protein, 10 aa, Entamoeba dispar
ESSDYKDANI

SEQ ID NO: 2423674 - protein, 4 aa, Entamoeba dispar
ESSE

SEQ ID NO: 2423675 - protein, 9 aa, Entamoeba dispar
ESSEHEIRY

SEQ ID NO: 2423676 - protein, 10 aa, Entamoeba dispar
ESSEQPYVAS

SEQ ID NO: 2423677 - protein, 8 aa, Entamoeba dispar
ESSETQTL

SEQ ID NO: 2423678 - protein, 8 aa, Entamoeba dispar
ESSFEGCS

SEQ ID NO: 2423679 - protein, 5 aa, Entamoeba dispar
ESSFK

SEQ ID NO: 2423680 - protein, 11 aa, Entamoeba dispar
ESSGEVSAYSK

SEQ ID NO: 2423681 - protein, 13 aa, Entamoeba dispar
ESSGGDPNLGGND

SEQ ID NO: 2423682 - protein, 14 aa, Entamoeba dispar
ESSGGNQNLGGNNF

SEQ ID NO: 2423683 - protein, 49 aa, Entamoeba dispar
ESSGTTTTEGISSEENESESLSGRDQSTERFSSSEIKVEEKKLRPSLQG

SEQ ID NO: 2423684 - protein, 5 aa, Entamoeba dispar
ESSID

SEQ ID NO: 2423685 - protein, 5 aa, Entamoeba dispar
ESSIE

SEQ ID NO: 2423686 - protein, 10 aa, Entamoeba dispar
ESSIEQKTEL

SEQ ID NO: 2423687 - protein, 7 aa, Entamoeba dispar
ESSIQST

SEQ ID NO: 2423688 - protein, 5 aa, Entamoeba dispar
ESSKE

SEQ ID NO: 2423689 - protein, 10 aa, Entamoeba dispar
ESSKGKDDKI

SEQ ID NO: 2423690 - protein, 21 aa, Entamoeba dispar
ESSKTKLSNDLEEKNKTLNAL

SEQ ID NO: 2423691 - protein, 8 aa, Entamoeba dispar
ESSNASIR

SEQ ID NO: 2423692 - protein, 9 aa, Entamoeba dispar
ESSNGSYTL

SEQ ID NO: 2423693 - protein, 7 aa, Entamoeba dispar
ESSNQSI

SEQ ID NO: 2423694 - protein, 18 aa, Entamoeba dispar
ESSNSVVQGKYELKSGAS

SEQ ID NO: 2423695 - protein, 5 aa, Entamoeba dispar
ESSPI

SEQ ID NO: 2423696 - protein, 14 aa, Entamoeba dispar
ESSPIPLNEEGEEG

SEQ ID NO: 2423697 - protein, 21 aa, Entamoeba dispar
ESSQPEEKEKKSTKRGQRQSI

SEQ ID NO: 2423698 - protein, 8 aa, Entamoeba dispar
ESSQTIGN

SEQ ID NO: 2423699 - protein, 7 aa, Entamoeba dispar
ESSQYST

SEQ ID NO: 2423700 - protein, 26 aa, Entamoeba dispar
ESSSESSETSSDSINSINDNDDGSVV

SEQ ID NO: 2423701 - protein, 10 aa, Entamoeba dispar
ESSSFDNSVD

SEQ ID NO: 2423702 - protein, 6 aa, Entamoeba dispar
ESSTIN

SEQ ID NO: 2423703 - protein, 9 aa, Entamoeba dispar
ESSTKRYVP

SEQ ID NO: 2423704 - protein, 13 aa, Entamoeba dispar
ESSTNKTKELQQQ

SEQ ID NO: 2423705 - protein, 6 aa, Entamoeba dispar
ESSTSV

SEQ ID NO: 2423706 - protein, 4 aa, Entamoeba dispar
ESSV

SEQ ID NO: 2423707 - protein, 6 aa, Entamoeba dispar
ESSVGK

SEQ ID NO: 2423708 - protein, 7 aa, Entamoeba dispar
ESSVGKT

SEQ ID NO: 2423709 - protein, 8 aa, Entamoeba dispar
ESSVGKTS

SEQ ID NO: 2423710 - protein, 8 aa, Entamoeba dispar
ESSVGSIK

SEQ ID NO: 2423711 - protein, 32 aa, Entamoeba dispar
ESSVTAQKTTNTNPFSDSSESDDSKQQREESL

SEQ ID NO: 2423712 - protein, 7 aa, Entamoeba dispar
ESSYKDV

SEQ ID NO: 2423713 - protein, 6 aa, Entamoeba dispar
ESTAAA

SEQ ID NO: 2423714 - protein, 11 aa, Entamoeba dispar
ESTDSNSNAPT

SEQ ID NO: 2423715 - protein, 10 aa, Entamoeba dispar
ESTEANEAPV

SEQ ID NO: 2423716 - protein, 6 aa, Entamoeba dispar
ESTEFN

SEQ ID NO: 2423717 - protein, 13 aa, Entamoeba dispar
ESTEPDNHQENEM

SEQ ID NO: 2423718 - protein, 9 aa, Entamoeba dispar
ESTEREEIE

SEQ ID NO: 2423719 - protein, 14 aa, Entamoeba dispar
ESTGKYQNSKHDAI

SEQ ID NO: 2423720 - protein, 4 aa, Entamoeba dispar
ESTH

SEQ ID NO: 2423721 - protein, 8 aa, Entamoeba dispar
ESTHKQFQ

SEQ ID NO: 2423722 - protein, 12 aa, Entamoeba dispar
ESTIEGEQQSQI

SEQ ID NO: 2423723 - protein, 5 aa, Entamoeba dispar
ESTIQ

SEQ ID NO: 2423724 - protein, 8 aa, Entamoeba dispar
ESTKARCP

SEQ ID NO: 2423725 - protein, 7 aa, Entamoeba dispar
ESTKEIE

SEQ ID NO: 2423726 - protein, 7 aa, Entamoeba dispar
ESTKENS

SEQ ID NO: 2423727 - protein, 10 aa, Entamoeba dispar
ESTKETCKNV

SEQ ID NO: 2423728 - protein, 10 aa, Entamoeba dispar
ESTKSLNNYV

SEQ ID NO: 2423729 - protein, 11 aa, Entamoeba dispar
ESTKYNEMRER

SEQ ID NO: 2423730 - protein, 10 aa, Entamoeba dispar
ESTLPTDESY

SEQ ID NO: 2423731 - protein, 21 aa, Entamoeba dispar
ESTMGEFQSTPTTEQHSGIKK

SEQ ID NO: 2423732 - protein, 18 aa, Entamoeba dispar
ESTNENIKRDSAIVTGAT

SEQ ID NO: 2423733 - protein, 10 aa, Entamoeba dispar
ESTNPTKFGS

SEQ ID NO: 2423734 - protein, 6 aa, Entamoeba dispar
ESTNRR

SEQ ID NO: 2423735 - protein, 6 aa, Entamoeba dispar
ESTPPA

SEQ ID NO: 2423736 - protein, 8 aa, Entamoeba dispar
ESTQADEP

SEQ ID NO: 2423737 - protein, 9 aa, Entamoeba dispar
ESTQSSNKR

SEQ ID NO: 2423738 - protein, 8 aa, Entamoeba dispar
ESTREQRM

SEQ ID NO: 2423739 - protein, 15 aa, Entamoeba dispar
ESTRTMLKNSEEELL

SEQ ID NO: 2423740 - protein, 9 aa, Entamoeba dispar
ESTRTTGLY

SEQ ID NO: 2423741 - protein, 10 aa, Entamoeba dispar
ESTSENPLNI

SEQ ID NO: 2423742 - protein, 14 aa, Entamoeba dispar
ESTSMTESSSHDRV

SEQ ID NO: 2423743 - protein, 7 aa, Entamoeba dispar
ESTSNDI

SEQ ID NO: 2423744 - protein, 4 aa, Entamoeba dispar
ESTT

SEQ ID NO: 2423745 - protein, 7 aa, Entamoeba dispar
ESTTGIC

SEQ ID NO: 2423746 - protein, 10 aa, Entamoeba dispar
ESTTNEIDVK

SEQ ID NO: 2423747 - protein, 21 aa, Entamoeba dispar
ESTTSWDGTSLPSYPSGQPKI

SEQ ID NO: 2423748 - protein, 7 aa, Entamoeba dispar
ESTVESG

SEQ ID NO: 2423749 - protein, 33 aa, Entamoeba dispar
ESTVSSSNENKVDNVVSEDKKTQPAQQKKPSLA

SEQ ID NO: 2423750 - protein, 10 aa, Entamoeba dispar
ESTVVGGNDF

SEQ ID NO: 2423751 - protein, 29 aa, Entamoeba dispar
ESVDFKTKTIEKKKEDSQKKVKEKKKKVE

SEQ ID NO: 2423752 - protein, 6 aa, Entamoeba dispar
ESVDGH

SEQ ID NO: 2423753 - protein, 5 aa, Entamoeba dispar
ESVED

SEQ ID NO: 2423754 - protein, 7 aa, Entamoeba dispar
ESVEPLK

SEQ ID NO: 2423755 - protein, 6 aa, Entamoeba dispar
ESVETI

SEQ ID NO: 2423756 - protein, 4 aa, Entamoeba dispar
ESVF

SEQ ID NO: 2423757 - protein, 9 aa, Entamoeba dispar
ESVGKDKGI

SEQ ID NO: 2423758 - protein, 4 aa, Entamoeba dispar
ESVK

SEQ ID NO: 2423759 - protein, 32 aa, Entamoeba dispar
ESVKMQERAYERKKAISSGRRSVSNIQEEACD

SEQ ID NO: 2423760 - protein, 21 aa, Entamoeba dispar
ESVKSAREEAAKAQPTKKVGK

SEQ ID NO: 2423761 - protein, 24 aa, Entamoeba dispar
ESVNEVSQSDIHQKEAYIVIYKQI

SEQ ID NO: 2423762 - protein, 9 aa, Entamoeba dispar
ESVQNKTET

SEQ ID NO: 2423763 - protein, 7 aa, Entamoeba dispar
ESVQSSI

SEQ ID NO: 2423764 - protein, 5 aa, Entamoeba dispar
ESVTK

SEQ ID NO: 2423765 - protein, 27 aa, Entamoeba dispar
ESVVEEKNKDKAPKGNVSEKKRKSRNG

SEQ ID NO: 2423766 - protein, 25 aa, Entamoeba dispar
ESVYPISPNQTLSPMRKKRKQYTIT

SEQ ID NO: 2423767 - protein, 5 aa, Entamoeba dispar
ESWEK

SEQ ID NO: 2423768 - protein, 5 aa, Entamoeba dispar
ESWNN

SEQ ID NO: 2423769 - protein, 12 aa, Entamoeba dispar
ESYARQKYESYI

SEQ ID NO: 2423770 - protein, 17 aa, Entamoeba dispar
ESYDKNPVLSHKSESSI

SEQ ID NO: 2423771 - protein, 51 aa, Entamoeba dispar
ESYEKAEQMYQEDKAKAEKEAKKEAEKKRKMEEQERKAKEREAKKKQQEAM

SEQ ID NO: 2423772 - protein, 14 aa, Entamoeba dispar
ESYELKKSYKATNY

SEQ ID NO: 2423773 - protein, 7 aa, Entamoeba dispar
ESYISDP

SEQ ID NO: 2423774 - protein, 5 aa, Entamoeba dispar
ESYKN

SEQ ID NO: 2423775 - protein, 4 aa, Entamoeba dispar
ESYL

SEQ ID NO: 2423776 - protein, 6 aa, Entamoeba dispar
ESYRNN

SEQ ID NO: 2423777 - protein, 9 aa, Entamoeba dispar
ESYSKGSVK

SEQ ID NO: 2423778 - protein, 11 aa, Entamoeba dispar
ESYSQKEEELK

SEQ ID NO: 2423779 - protein, 12 aa, Entamoeba dispar
ESYTEYNGSHPK

SEQ ID NO: 2423780 - protein, 7 aa, Entamoeba dispar
ESYVDSD

SEQ ID NO: 2423781 - protein, 32 aa, Entamoeba dispar
ESYYESKSRNSKSRSDSKSLKRSGRKNSSIET

SEQ ID NO: 2423782 - protein, 4 aa, Entamoeba dispar
ETAF

SEQ ID NO: 2423783 - protein, 4 aa, Entamoeba dispar
ETAG

SEQ ID NO: 2423784 - protein, 9 aa, Entamoeba dispar
ETAHSRKRP

SEQ ID NO: 2423785 - protein, 6 aa, Entamoeba dispar
ETAKID

SEQ ID NO: 2423786 - protein, 7 aa, Entamoeba dispar
ETAKTIS

SEQ ID NO: 2423787 - protein, 5 aa, Entamoeba dispar
ETANE

SEQ ID NO: 2423788 - protein, 9 aa, Entamoeba dispar
ETANQEGTH

SEQ ID NO: 2423789 - protein, 20 aa, Entamoeba dispar
ETAPKKMRKIGETDFPVDAE

SEQ ID NO: 2423790 - protein, 5 aa, Entamoeba dispar
ETAQN

SEQ ID NO: 2423791 - protein, 9 aa, Entamoeba dispar
ETAQNTQTY

SEQ ID NO: 2423792 - protein, 7 aa, Entamoeba dispar
ETAQNVP

SEQ ID NO: 2423793 - protein, 16 aa, Entamoeba dispar
ETAQQQTIAPAKEEMN

SEQ ID NO: 2423794 - protein, 28 aa, Entamoeba dispar
ETATEEIKQKYQAAEKEAKKEKKARWTE

SEQ ID NO: 2423795 - protein, 10 aa, Entamoeba dispar
ETATKSTKYF

SEQ ID NO: 2423796 - protein, 6 aa, Entamoeba dispar
ETATKT

SEQ ID NO: 2423797 - protein, 8 aa, Entamoeba dispar
ETAYNTGE

SEQ ID NO: 2423798 - protein, 11 aa, Entamoeba dispar
ETCDGKKIYKQ

SEQ ID NO: 2423799 - protein, 6 aa, Entamoeba dispar
ETCETI

SEQ ID NO: 2423800 - protein, 8 aa, Entamoeba dispar
ETCEYTGE

SEQ ID NO: 2423801 - protein, 5 aa, Entamoeba dispar
ETCNS

SEQ ID NO: 2423802 - protein, 9 aa, Entamoeba dispar
ETCQSSKDI

SEQ ID NO: 2423803 - protein, 6 aa, Entamoeba dispar
ETCYGT

SEQ ID NO: 2423804 - protein, 15 aa, Entamoeba dispar
ETDEESEEDKEYDDY

SEQ ID NO: 2423805 - protein, 10 aa, Entamoeba dispar
ETDEGDDAME

SEQ ID NO: 2423806 - protein, 9 aa, Entamoeba dispar
ETDEIEPEM

SEQ ID NO: 2423807 - protein, 5 aa, Entamoeba dispar
ETDEK

SEQ ID NO: 2423808 - protein, 6 aa, Entamoeba dispar
ETDEVE

SEQ ID NO: 2423809 - protein, 5 aa, Entamoeba dispar
ETDKD

SEQ ID NO: 2423810 - protein, 40 aa, Entamoeba dispar
ETDKEEGWELSDGPVKAIKPKKKAKKQIDGIASTKNYFEG

SEQ ID NO: 2423811 - protein, 7 aa, Entamoeba dispar
ETDKGVE

SEQ ID NO: 2423812 - protein, 11 aa, Entamoeba dispar
ETDKSKGGVGK

SEQ ID NO: 2423813 - protein, 5 aa, Entamoeba dispar
ETDLK

SEQ ID NO: 2423814 - protein, 5 aa, Entamoeba dispar
ETDLP

SEQ ID NO: 2423815 - protein, 7 aa, Entamoeba dispar
ETDMDER

SEQ ID NO: 2423816 - protein, 7 aa, Entamoeba dispar
ETDNEFE

SEQ ID NO: 2423817 - protein, 11 aa, Entamoeba dispar
ETDNKEKGEEI

SEQ ID NO: 2423818 - protein, 5 aa, Entamoeba dispar
ETDNN

SEQ ID NO: 2423819 - protein, 6 aa, Entamoeba dispar
ETDPQT

SEQ ID NO: 2423820 - protein, 7 aa, Entamoeba dispar
ETDQGIE

SEQ ID NO: 2423821 - protein, 7 aa, Entamoeba dispar
ETDQPFK

SEQ ID NO: 2423822 - protein, 5 aa, Entamoeba dispar
ETDRE

SEQ ID NO: 2423823 - protein, 4 aa, Entamoeba dispar
ETDS

SEQ ID NO: 2423824 - protein, 8 aa, Entamoeba dispar
ETEAEIAG

SEQ ID NO: 2423825 - protein, 6 aa, Entamoeba dispar
ETEAPL

SEQ ID NO: 2423826 - protein, 14 aa, Entamoeba dispar
ETEAQRIANQTEEV

SEQ ID NO: 2423827 - protein, 5 aa, Entamoeba dispar
ETEDN

SEQ ID NO: 2423828 - protein, 10 aa, Entamoeba dispar
ETEDNQEKNK

SEQ ID NO: 2423829 - protein, 8 aa, Entamoeba dispar
ETEDQVSH

SEQ ID NO: 2423830 - protein, 20 aa, Entamoeba dispar
ETEECKNELTSNTNPKSLSE

SEQ ID NO: 2423831 - protein, 19 aa, Entamoeba dispar
ETEEDAKKAVAANGVEFEG

SEQ ID NO: 2423832 - protein, 7 aa, Entamoeba dispar
ETEEDTI

SEQ ID NO: 2423833 - protein, 7 aa, Entamoeba dispar
ETEEEKK

SEQ ID NO: 2423834 - protein, 9 aa, Entamoeba dispar
ETEEELSKS

SEQ ID NO: 2423835 - protein, 13 aa, Entamoeba dispar
ETEEETKKALAAN

SEQ ID NO: 2423836 - protein, 5 aa, Entamoeba dispar
ETEEV

SEQ ID NO: 2423837 - protein, 27 aa, Entamoeba dispar
ETEGAREFHSQNQNRIRKQGLKGKLDH

SEQ ID NO: 2423838 - protein, 5 aa, Entamoeba dispar
ETEGQ

SEQ ID NO: 2423839 - protein, 4 aa, Entamoeba dispar
ETEH

SEQ ID NO: 2423840 - protein, 20 aa, Entamoeba dispar
ETEHTDSIIGDNRKGTATYD

SEQ ID NO: 2423841 - protein, 7 aa, Entamoeba dispar
ETEIPPM

SEQ ID NO: 2423842 - protein, 4 aa, Entamoeba dispar
ETEK

SEQ ID NO: 2423843 - protein, 16 aa, Entamoeba dispar
ETEKATGTSDLEEKHD

SEQ ID NO: 2423844 - protein, 6 aa, Entamoeba dispar
ETEKCE

SEQ ID NO: 2423845 - protein, 9 aa, Entamoeba dispar
ETEKDSIQN

SEQ ID NO: 2423846 - protein, 10 aa, Entamoeba dispar
ETEKERTNKL

SEQ ID NO: 2423847 - protein, 5 aa, Entamoeba dispar
ETEKK

SEQ ID NO: 2423848 - protein, 20 aa, Entamoeba dispar
ETEKKSWNEDEVKRNNESIK

SEQ ID NO: 2423849 - protein, 9 aa, Entamoeba dispar
ETEKQTAKE

SEQ ID NO: 2423850 - protein, 4 aa, Entamoeba dispar
ETEL

SEQ ID NO: 2423851 - protein, 25 aa, Entamoeba dispar
ETELDKKKNELNEIKEKSEKELSEV

SEQ ID NO: 2423852 - protein, 10 aa, Entamoeba dispar
ETELEEDNDM

SEQ ID NO: 2423853 - protein, 18 aa, Entamoeba dispar
ETENEEKKSGYKKRIEGY

SEQ ID NO: 2423854 - protein, 6 aa, Entamoeba dispar
ETENEK

SEQ ID NO: 2423855 - protein, 9 aa, Entamoeba dispar
ETENGEQER

SEQ ID NO: 2423856 - protein, 8 aa, Entamoeba dispar
ETENLKAD

SEQ ID NO: 2423857 - protein, 5 aa, Entamoeba dispar
ETENQ

SEQ ID NO: 2423858 - protein, 8 aa, Entamoeba dispar
ETENSLKD

SEQ ID NO: 2423859 - protein, 11 aa, Entamoeba dispar
ETEPAQNDETT

SEQ ID NO: 2423860 - protein, 15 aa, Entamoeba dispar
ETEQATGVKSNLRNV

SEQ ID NO: 2423861 - protein, 8 aa, Entamoeba dispar
ETEQFEPT

SEQ ID NO: 2423862 - protein, 9 aa, Entamoeba dispar
ETEQKIPKQ

SEQ ID NO: 2423863 - protein, 7 aa, Entamoeba dispar
ETEQQMN

SEQ ID NO: 2423864 - protein, 4 aa, Entamoeba dispar
ETER

SEQ ID NO: 2423865 - protein, 10 aa, Entamoeba dispar
ETERTPAGSI

SEQ ID NO: 2423866 - protein, 10 aa, Entamoeba dispar
ETERTSGKNG

SEQ ID NO: 2423867 - protein, 4 aa, Entamoeba dispar
ETES

SEQ ID NO: 2423868 - protein, 6 aa, Entamoeba dispar
ETETAL

SEQ ID NO: 2423869 - protein, 7 aa, Entamoeba dispar
ETETDPE

SEQ ID NO: 2423870 - protein, 7 aa, Entamoeba dispar
ETETSKN

SEQ ID NO: 2423871 - protein, 7 aa, Entamoeba dispar
ETETTAV

SEQ ID NO: 2423872 - protein, 20 aa, Entamoeba dispar
ETETTKDKEEEEQQKNPEID

SEQ ID NO: 2423873 - protein, 5 aa, Entamoeba dispar
ETEWK

SEQ ID NO: 2423874 - protein, 12 aa, Entamoeba dispar
ETEWRDGDDIKT

SEQ ID NO: 2423875 - protein, 27 aa, Entamoeba dispar
ETEYSKKKKMSPKEYSEIEKPKGRKTS

SEQ ID NO: 2423876 - protein, 19 aa, Entamoeba dispar
ETFESNPSEIEKVQPPEFT

SEQ ID NO: 2423877 - protein, 4 aa, Entamoeba dispar
ETFK

SEQ ID NO: 2423878 - protein, 6 aa, Entamoeba dispar
ETFKSG

SEQ ID NO: 2423879 - protein, 5 aa, Entamoeba dispar
ETFNT

SEQ ID NO: 2423880 - protein, 5 aa, Entamoeba dispar
ETFQN

SEQ ID NO: 2423881 - protein, 5 aa, Entamoeba dispar
ETFSP

SEQ ID NO: 2423882 - protein, 5 aa, Entamoeba dispar
ETFSS

SEQ ID NO: 2423883 - protein, 12 aa, Entamoeba dispar
ETFVEQQEEESY

SEQ ID NO: 2423884 - protein, 10 aa, Entamoeba dispar
ETGAGTGQLS

SEQ ID NO: 2423885 - protein, 8 aa, Entamoeba dispar
ETGEKWNR

SEQ ID NO: 2423886 - protein, 13 aa, Entamoeba dispar
ETGEYEPLKIIDL

SEQ ID NO: 2423887 - protein, 9 aa, Entamoeba dispar
ETGGEVPDT

SEQ ID NO: 2423888 - protein, 4 aa, Entamoeba dispar
ETGI

SEQ ID NO: 2423889 - protein, 4 aa, Entamoeba dispar
ETGK

SEQ ID NO: 2423890 - protein, 11 aa, Entamoeba dispar
ETGKGEIDKNQ

SEQ ID NO: 2423891 - protein, 10 aa, Entamoeba dispar
ETGKPSMLTD

SEQ ID NO: 2423892 - protein, 10 aa, Entamoeba dispar
ETGPIDPNQK

SEQ ID NO: 2423893 - protein, 10 aa, Entamoeba dispar
ETGPKSDLSK

SEQ ID NO: 2423894 - protein, 8 aa, Entamoeba dispar
ETGSCKSS

SEQ ID NO: 2423895 - protein, 10 aa, Entamoeba dispar
ETGSGKSSLG

SEQ ID NO: 2423896 - protein, 5 aa, Entamoeba dispar
ETGSI

SEQ ID NO: 2423897 - protein, 10 aa, Entamoeba dispar
ETGSSEKTEF

SEQ ID NO: 2423898 - protein, 5 aa, Entamoeba dispar
ETGSY

SEQ ID NO: 2423899 - protein, 10 aa, Entamoeba dispar
ETGTGKSSLG

SEQ ID NO: 2423900 - protein, 11 aa, Entamoeba dispar
ETHDGSKRRIE

SEQ ID NO: 2423901 - protein, 8 aa, Entamoeba dispar
ETHEKSLY

SEQ ID NO: 2423902 - protein, 4 aa, Entamoeba dispar
ETHG

SEQ ID NO: 2423903 - protein, 5 aa, Entamoeba dispar
ETHGI

SEQ ID NO: 2423904 - protein, 7 aa, Entamoeba dispar
ETHGLEQ

SEQ ID NO: 2423905 - protein, 6 aa, Entamoeba dispar
ETHGYV

SEQ ID NO: 2423906 - protein, 9 aa, Entamoeba dispar
ETHKKTSEY

SEQ ID NO: 2423907 - protein, 14 aa, Entamoeba dispar
ETHNANVKTRTMDT

SEQ ID NO: 2423908 - protein, 8 aa, Entamoeba dispar
ETHNPSAK

SEQ ID NO: 2423909 - protein, 14 aa, Entamoeba dispar
ETHPQYKGKEQNDA

SEQ ID NO: 2423910 - protein, 20 aa, Entamoeba dispar
ETHSIQTKQNNKENEEDELN

SEQ ID NO: 2423911 - protein, 9 aa, Entamoeba dispar
ETIADDAEY

SEQ ID NO: 2423912 - protein, 4 aa, Entamoeba dispar
ETIC

SEQ ID NO: 2423913 - protein, 4 aa, Entamoeba dispar
ETID

SEQ ID NO: 2423914 - protein, 7 aa, Entamoeba dispar
ETIDGSR

SEQ ID NO: 2423915 - protein, 4 aa, Entamoeba dispar
ETIE

SEQ ID NO: 2423916 - protein, 10 aa, Entamoeba dispar
ETIEEESGKL

SEQ ID NO: 2423917 - protein, 8 aa, Entamoeba dispar
ETIEGDPK

SEQ ID NO: 2423918 - protein, 5 aa, Entamoeba dispar
ETIEK

SEQ ID NO: 2423919 - protein, 28 aa, Entamoeba dispar
ETIESPTESPIDNSSIKTQSPTIPQEKN

SEQ ID NO: 2423920 - protein, 7 aa, Entamoeba dispar
ETIGDGM

SEQ ID NO: 2423921 - protein, 5 aa, Entamoeba dispar
ETIGG

SEQ ID NO: 2423922 - protein, 4 aa, Entamoeba dispar
ETIH

SEQ ID NO: 2423923 - protein, 10 aa, Entamoeba dispar
ETIHPKTRRN

SEQ ID NO: 2423924 - protein, 13 aa, Entamoeba dispar
ETIKEEEKQIKES

SEQ ID NO: 2423925 - protein, 11 aa, Entamoeba dispar
ETIKEGSSYKS

SEQ ID NO: 2423926 - protein, 11 aa, Entamoeba dispar
ETIKERETENK

SEQ ID NO: 2423927 - protein, 42 aa, Entamoeba dispar
ETIKKNKMQKAGIQKASKKSKTTTEKKVTPKAAVEKKEEQVE

SEQ ID NO: 2423928 - protein, 4 aa, Entamoeba dispar
ETIN

SEQ ID NO: 2423929 - protein, 11 aa, Entamoeba dispar
ETINGQKLDKN

SEQ ID NO: 2423930 - protein, 4 aa, Entamoeba dispar
ETIP

SEQ ID NO: 2423931 - protein, 12 aa, Entamoeba dispar
ETIPEPKKKGKI

SEQ ID NO: 2423932 - protein, 6 aa, Entamoeba dispar
ETIPSP

SEQ ID NO: 2423933 - protein, 5 aa, Entamoeba dispar
ETIQR

SEQ ID NO: 2423934 - protein, 6 aa, Entamoeba dispar
ETIQSS

SEQ ID NO: 2423935 - protein, 4 aa, Entamoeba dispar
ETIS

SEQ ID NO: 2423936 - protein, 15 aa, Entamoeba dispar
ETISKSTELKSKSHQ

SEQ ID NO: 2423937 - protein, 16 aa, Entamoeba dispar
ETITAPTPEVKISESE

SEQ ID NO: 2423938 - protein, 10 aa, Entamoeba dispar
ETITNTETDF

SEQ ID NO: 2423939 - protein, 6 aa, Entamoeba dispar
ETIYPP

SEQ ID NO: 2423940 - protein, 5 aa, Entamoeba dispar
ETKAE

SEQ ID NO: 2423941 - protein, 11 aa, Entamoeba dispar
ETKASGDESGV

SEQ ID NO: 2423942 - protein, 4 aa, Entamoeba dispar
ETKD

SEQ ID NO: 2423943 - protein, 6 aa, Entamoeba dispar
ETKDEE

SEQ ID NO: 2423944 - protein, 6 aa, Entamoeba dispar
ETKDGM

SEQ ID NO: 2423945 - protein, 7 aa, Entamoeba dispar
ETKEECE

SEQ ID NO: 2423946 - protein, 8 aa, Entamoeba dispar
ETKEELYE

SEQ ID NO: 2423947 - protein, 7 aa, Entamoeba dispar
ETKEEMN

SEQ ID NO: 2423948 - protein, 8 aa, Entamoeba dispar
ETKEETGI

SEQ ID NO: 2423949 - protein, 13 aa, Entamoeba dispar
ETKEGKKGYGGNG

SEQ ID NO: 2423950 - protein, 6 aa, Entamoeba dispar
ETKEIV

SEQ ID NO: 2423951 - protein, 8 aa, Entamoeba dispar
ETKENDSI

SEQ ID NO: 2423952 - protein, 6 aa, Entamoeba dispar
ETKEQK

SEQ ID NO: 2423953 - protein, 8 aa, Entamoeba dispar
ETKEQTVE

SEQ ID NO: 2423954 - protein, 7 aa, Entamoeba dispar
ETKEYAS

SEQ ID NO: 2423955 - protein, 5 aa, Entamoeba dispar
ETKFT

SEQ ID NO: 2423956 - protein, 13 aa, Entamoeba dispar
ETKGTVQFGEKKT

SEQ ID NO: 2423957 - protein, 10 aa, Entamoeba dispar
ETKKKKEQIA

SEQ ID NO: 2423958 - protein, 7 aa, Entamoeba dispar
ETKKLNP

SEQ ID NO: 2423959 - protein, 6 aa, Entamoeba dispar
ETKKMD

SEQ ID NO: 2423960 - protein, 6 aa, Entamoeba dispar
ETKKQL

SEQ ID NO: 2423961 - protein, 8 aa, Entamoeba dispar
ETKKSKGC

SEQ ID NO: 2423962 - protein, 14 aa, Entamoeba dispar
ETKKYFNKQEEPFI

SEQ ID NO: 2423963 - protein, 4 aa, Entamoeba dispar
ETKL

SEQ ID NO: 2423964 - protein, 22 aa, Entamoeba dispar
ETKLDPEALNSPELENHKESMD

SEQ ID NO: 2423965 - protein, 7 aa, Entamoeba dispar
ETKLGQD

SEQ ID NO: 2423966 - protein, 4 aa, Entamoeba dispar
ETKM

SEQ ID NO: 2423967 - protein, 7 aa, Entamoeba dispar
ETKMPQL

SEQ ID NO: 2423968 - protein, 36 aa, Entamoeba dispar
ETKMVEDEEEGDTDDSQIKEIQNTETDKQQDEINEL

SEQ ID NO: 2423969 - protein, 13 aa, Entamoeba dispar
ETKNFKEIKPIHF

SEQ ID NO: 2423970 - protein, 5 aa, Entamoeba dispar
ETKNI

SEQ ID NO: 2423971 - protein, 6 aa, Entamoeba dispar
ETKNNE

SEQ ID NO: 2423972 - protein, 7 aa, Entamoeba dispar
ETKNTEF

SEQ ID NO: 2423973 - protein, 6 aa, Entamoeba dispar
ETKPTE

SEQ ID NO: 2423974 - protein, 4 aa, Entamoeba dispar
ETKQ

SEQ ID NO: 2423975 - protein, 8 aa, Entamoeba dispar
ETKQETKI

SEQ ID NO: 2423976 - protein, 7 aa, Entamoeba dispar
ETKQGTI

SEQ ID NO: 2423977 - protein, 20 aa, Entamoeba dispar
ETKQSEAKGTIPQLKKPENQ

SEQ ID NO: 2423978 - protein, 11 aa, Entamoeba dispar
ETKRGEINNEL

SEQ ID NO: 2423979 - protein, 13 aa, Entamoeba dispar
ETKRGQTKDDPID

SEQ ID NO: 2423980 - protein, 6 aa, Entamoeba dispar
ETKRQE

SEQ ID NO: 2423981 - protein, 4 aa, Entamoeba dispar
ETKS

SEQ ID NO: 2423982 - protein, 8 aa, Entamoeba dispar
ETKSAQQI

SEQ ID NO: 2423983 - protein, 8 aa, Entamoeba dispar
ETKSSGEI

SEQ ID NO: 2423984 - protein, 8 aa, Entamoeba dispar
ETKTFKGS

SEQ ID NO: 2423985 - protein, 9 aa, Entamoeba dispar
ETKTGYRGT

SEQ ID NO: 2423986 - protein, 5 aa, Entamoeba dispar
ETKTI

SEQ ID NO: 2423987 - protein, 13 aa, Entamoeba dispar
ETLDEDIKKELEE

SEQ ID NO: 2423988 - protein, 14 aa, Entamoeba dispar
ETLEEEQNNDDFTP

SEQ ID NO: 2423989 - protein, 35 aa, Entamoeba dispar
ETLEKDPSFKTLTPKEKEKRAKEEIEKQSKNTEIE

SEQ ID NO: 2423990 - protein, 11 aa, Entamoeba dispar
ETLESKKSRRL

SEQ ID NO: 2423991 - protein, 18 aa, Entamoeba dispar
ETLGQQKRNYKYEKVRMK

SEQ ID NO: 2423992 - protein, 4 aa, Entamoeba dispar
ETLK

SEQ ID NO: 2423993 - protein, 24 aa, Entamoeba dispar
ETLKAEKDKEIEDAVKEKETQIEE

SEQ ID NO: 2423994 - protein, 6 aa, Entamoeba dispar
ETLKGE

SEQ ID NO: 2423995 - protein, 17 aa, Entamoeba dispar
ETLKSYSSKFEKSDISN

SEQ ID NO: 2423996 - protein, 12 aa, Entamoeba dispar
ETLKVSKENMVR

SEQ ID NO: 2423997 - protein, 13 aa, Entamoeba dispar
ETLNARDGCGRTP

SEQ ID NO: 2423998 - protein, 48 aa, Entamoeba dispar
ETLQNTERRMEEEDDDSGDNDEEYHAEEEESGDDDIMSESDDDDEEEQ

SEQ ID NO: 2423999 - protein, 20 aa, Entamoeba dispar
ETLRGSDDSMNTFDSEERSI

SEQ ID NO: 2424000 - protein, 12 aa, Entamoeba dispar
ETLRKNKRIPTV

SEQ ID NO: 2424001 - protein, 5 aa, Entamoeba dispar
ETLSE

SEQ ID NO: 2424002 - protein, 11 aa, Entamoeba dispar
ETLSGKVDERD

SEQ ID NO: 2424003 - protein, 29 aa, Entamoeba dispar
ETLTADSDNSLIESDEEEKKQQRKPNCSK

SEQ ID NO: 2424004 - protein, 11 aa, Entamoeba dispar
ETLTKQNLHKK

SEQ ID NO: 2424005 - protein, 7 aa, Entamoeba dispar
ETLTSTT

SEQ ID NO: 2424006 - protein, 4 aa, Entamoeba dispar
ETMN

SEQ ID NO: 2424007 - protein, 10 aa, Entamoeba dispar
ETMQTPQESI

SEQ ID NO: 2424008 - protein, 14 aa, Entamoeba dispar
ETMSQYEKQRSNYF

SEQ ID NO: 2424009 - protein, 22 aa, Entamoeba dispar
ETMSQYEKQRSSYFNKQTTNTW

SEQ ID NO: 2424010 - protein, 4 aa, Entamoeba dispar
ETND

SEQ ID NO: 2424011 - protein, 6 aa, Entamoeba dispar
ETNDAF

SEQ ID NO: 2424012 - protein, 12 aa, Entamoeba dispar
ETNDDLSFNDAN

SEQ ID NO: 2424013 - protein, 7 aa, Entamoeba dispar
ETNDDTK

SEQ ID NO: 2424014 - protein, 20 aa, Entamoeba dispar
ETNDKDSEIITTEQGHKMAE

SEQ ID NO: 2424015 - protein, 20 aa, Entamoeba dispar
ETNDNQTHKPKEEQEKKEIT

SEQ ID NO: 2424016 - protein, 5 aa, Entamoeba dispar
ETNEF

SEQ ID NO: 2424017 - protein, 12 aa, Entamoeba dispar
ETNEGSFQPRSS

SEQ ID NO: 2424018 - protein, 10 aa, Entamoeba dispar
ETNEKKNEKI

SEQ ID NO: 2424019 - protein, 8 aa, Entamoeba dispar
ETNENNPM

SEQ ID NO: 2424020 - protein, 5 aa, Entamoeba dispar
ETNGK

SEQ ID NO: 2424021 - protein, 6 aa, Entamoeba dispar
ETNKEE

SEQ ID NO: 2424022 - protein, 10 aa, Entamoeba dispar
ETNNENNVKH

SEQ ID NO: 2424023 - protein, 9 aa, Entamoeba dispar
ETNNEQQNE

SEQ ID NO: 2424024 - protein, 5 aa, Entamoeba dispar
ETNNG

SEQ ID NO: 2424025 - protein, 5 aa, Entamoeba dispar
ETNPG

SEQ ID NO: 2424026 - protein, 5 aa, Entamoeba dispar
ETNPQ

SEQ ID NO: 2424027 - protein, 6 aa, Entamoeba dispar
ETNPVN

SEQ ID NO: 2424028 - protein, 10 aa, Entamoeba dispar
ETNQNEENKK

SEQ ID NO: 2424029 - protein, 7 aa, Entamoeba dispar
ETNQPLS

SEQ ID NO: 2424030 - protein, 4 aa, Entamoeba dispar
ETNR

SEQ ID NO: 2424031 - protein, 5 aa, Entamoeba dispar
ETNRG

SEQ ID NO: 2424032 - protein, 5 aa, Entamoeba dispar
ETNRM

SEQ ID NO: 2424033 - protein, 5 aa, Entamoeba dispar
ETNSL

SEQ ID NO: 2424034 - protein, 8 aa, Entamoeba dispar
ETNTKALR

SEQ ID NO: 2424035 - protein, 5 aa, Entamoeba dispar
ETNTR

SEQ ID NO: 2424036 - protein, 5 aa, Entamoeba dispar
ETNTT

SEQ ID NO: 2424037 - protein, 9 aa, Entamoeba dispar
ETNTTSNQL

SEQ ID NO: 2424038 - protein, 4 aa, Entamoeba dispar
ETNV

SEQ ID NO: 2424039 - protein, 4 aa, Entamoeba dispar
ETNW

SEQ ID NO: 2424040 - protein, 7 aa, Entamoeba dispar
ETNYKRE

SEQ ID NO: 2424041 - protein, 9 aa, Entamoeba dispar
ETNYSSENA

SEQ ID NO: 2424042 - protein, 18 aa, Entamoeba dispar
ETPENLKQINGKNIEKRD

SEQ ID NO: 2424043 - protein, 13 aa, Entamoeba dispar
ETPENVAPGEVPR

SEQ ID NO: 2424044 - protein, 24 aa, Entamoeba dispar
ETPETPIIQPRNRQSSIGRRNQAS

SEQ ID NO: 2424045 - protein, 5 aa, Entamoeba dispar
ETPFL

SEQ ID NO: 2424046 - protein, 7 aa, Entamoeba dispar
ETPGSHT

SEQ ID NO: 2424047 - protein, 5 aa, Entamoeba dispar
ETPHR

SEQ ID NO: 2424048 - protein, 6 aa, Entamoeba dispar
ETPIKQ

SEQ ID NO: 2424049 - protein, 4 aa, Entamoeba dispar
ETPK

SEQ ID NO: 2424050 - protein, 6 aa, Entamoeba dispar
ETPKAT

SEQ ID NO: 2424051 - protein, 5 aa, Entamoeba dispar
ETPKI

SEQ ID NO: 2424052 - protein, 8 aa, Entamoeba dispar
ETPKKNDT

SEQ ID NO: 2424053 - protein, 5 aa, Entamoeba dispar
ETPKR

SEQ ID NO: 2424054 - protein, 12 aa, Entamoeba dispar
ETPKVNSDSKTL

SEQ ID NO: 2424055 - protein, 12 aa, Entamoeba dispar
ETPPRKSDATIA

SEQ ID NO: 2424056 - protein, 26 aa, Entamoeba dispar
ETPQVQPIQNEEPETVKEEKPKEIEE

SEQ ID NO: 2424057 - protein, 4 aa, Entamoeba dispar
ETPR

SEQ ID NO: 2424058 - protein, 6 aa, Entamoeba dispar
ETPRKK

SEQ ID NO: 2424059 - protein, 23 aa, Entamoeba dispar
ETPRNKQRRQTEGGTIKTPRGME

SEQ ID NO: 2424060 - protein, 10 aa, Entamoeba dispar
ETPSEEPRTI

SEQ ID NO: 2424061 - protein, 5 aa, Entamoeba dispar
ETPSF

SEQ ID NO: 2424062 - protein, 10 aa, Entamoeba dispar
ETPSPTTSND

SEQ ID NO: 2424063 - protein, 4 aa, Entamoeba dispar
ETPT

SEQ ID NO: 2424064 - protein, 10 aa, Entamoeba dispar
ETPTHKLTEE

SEQ ID NO: 2424065 - protein, 5 aa, Entamoeba dispar
ETPTI

SEQ ID NO: 2424066 - protein, 23 aa, Entamoeba dispar
ETPTKPSDNEKVTPQHQQNSKKI

SEQ ID NO: 2424067 - protein, 9 aa, Entamoeba dispar
ETPTLNHQQ

SEQ ID NO: 2424068 - protein, 5 aa, Entamoeba dispar
ETPVD

SEQ ID NO: 2424069 - protein, 7 aa, Entamoeba dispar
ETPVEIT

SEQ ID NO: 2424070 - protein, 7 aa, Entamoeba dispar
ETQDFKK

SEQ ID NO: 2424071 - protein, 28 aa, Entamoeba dispar
ETQEAIDEEKQYVPRNGGVDFSGFTYVG

SEQ ID NO: 2424072 - protein, 12 aa, Entamoeba dispar
ETQEAMRKSPEH

SEQ ID NO: 2424073 - protein, 12 aa, Entamoeba dispar
ETQEDAESNRDS

SEQ ID NO: 2424074 - protein, 5 aa, Entamoeba dispar
ETQEE

SEQ ID NO: 2424075 - protein, 9 aa, Entamoeba dispar
ETQETIKPH

SEQ ID NO: 2424076 - protein, 8 aa, Entamoeba dispar
ETQEVPEK

SEQ ID NO: 2424077 - protein, 6 aa, Entamoeba dispar
ETQGRK

SEQ ID NO: 2424078 - protein, 7 aa, Entamoeba dispar
ETQHQKE

SEQ ID NO: 2424079 - protein, 4 aa, Entamoeba dispar
ETQI

SEQ ID NO: 2424080 - protein, 15 aa, Entamoeba dispar
ETQISSKEGYESVHH

SEQ ID NO: 2424081 - protein, 6 aa, Entamoeba dispar
ETQKMN

SEQ ID NO: 2424082 - protein, 6 aa, Entamoeba dispar
ETQKNA

SEQ ID NO: 2424083 - protein, 10 aa, Entamoeba dispar
ETQKPNKINQ

SEQ ID NO: 2424084 - protein, 15 aa, Entamoeba dispar
ETQKVRDDDKNGMGP

SEQ ID NO: 2424085 - protein, 12 aa, Entamoeba dispar
ETQLEKSDLLEA

SEQ ID NO: 2424086 - protein, 11 aa, Entamoeba dispar
ETQLNSLKGSF

SEQ ID NO: 2424087 - protein, 10 aa, Entamoeba dispar
ETQNNDPYTN

SEQ ID NO: 2424088 - protein, 17 aa, Entamoeba dispar
ETQNNTDEQQINQNGIK

SEQ ID NO: 2424089 - protein, 24 aa, Entamoeba dispar
ETQPLTPKTNKIENKETESNKEIE

SEQ ID NO: 2424090 - protein, 11 aa, Entamoeba dispar
ETQQEYNEYEN

SEQ ID NO: 2424091 - protein, 8 aa, Entamoeba dispar
ETQQQRNK

SEQ ID NO: 2424092 - protein, 8 aa, Entamoeba dispar
ETQSEREV

SEQ ID NO: 2424093 - protein, 9 aa, Entamoeba dispar
ETQSRTQDR

SEQ ID NO: 2424094 - protein, 10 aa, Entamoeba dispar
ETQTKVEELN

SEQ ID NO: 2424095 - protein, 7 aa, Entamoeba dispar
ETRDGRI

SEQ ID NO: 2424096 - protein, 16 aa, Entamoeba dispar
ETREQQLTEKDRTIKE

SEQ ID NO: 2424097 - protein, 5 aa, Entamoeba dispar
ETRES

SEQ ID NO: 2424098 - protein, 5 aa, Entamoeba dispar
ETRGI

SEQ ID NO: 2424099 - protein, 5 aa, Entamoeba dispar
ETRKG

SEQ ID NO: 2424100 - protein, 5 aa, Entamoeba dispar
ETRKQ

SEQ ID NO: 2424101 - protein, 7 aa, Entamoeba dispar
ETRMNGI

SEQ ID NO: 2424102 - protein, 9 aa, Entamoeba dispar
ETRNEEEKG

SEQ ID NO: 2424103 - protein, 7 aa, Entamoeba dispar
ETRNIEG

SEQ ID NO: 2424104 - protein, 18 aa, Entamoeba dispar
ETRNKKEKNYAKRRLDNQ

SEQ ID NO: 2424105 - protein, 12 aa, Entamoeba dispar
ETRRKQLDMDCD

SEQ ID NO: 2424106 - protein, 12 aa, Entamoeba dispar
ETRRKQQDMDCD

SEQ ID NO: 2424107 - protein, 10 aa, Entamoeba dispar
ETSAATAQGV

SEQ ID NO: 2424108 - protein, 9 aa, Entamoeba dispar
ETSAKANIN

SEQ ID NO: 2424109 - protein, 10 aa, Entamoeba dispar
ETSAKNKLNI

SEQ ID NO: 2424110 - protein, 10 aa, Entamoeba dispar
ETSAKTFEGV

SEQ ID NO: 2424111 - protein, 11 aa, Entamoeba dispar
ETSAKTGAQVD

SEQ ID NO: 2424112 - protein, 9 aa, Entamoeba dispar
ETSASENIG

SEQ ID NO: 2424113 - protein, 8 aa, Entamoeba dispar
ETSCGGLT

SEQ ID NO: 2424114 - protein, 22 aa, Entamoeba dispar
ETSEAKKLDDATEQTKEESERY

SEQ ID NO: 2424115 - protein, 9 aa, Entamoeba dispar
ETSEEAIRN

SEQ ID NO: 2424116 - protein, 5 aa, Entamoeba dispar
ETSGK

SEQ ID NO: 2424117 - protein, 9 aa, Entamoeba dispar
ETSGTVDTS

SEQ ID NO: 2424118 - protein, 5 aa, Entamoeba dispar
ETSHL

SEQ ID NO: 2424119 - protein, 5 aa, Entamoeba dispar
ETSIP

SEQ ID NO: 2424120 - protein, 5 aa, Entamoeba dispar
ETSIT

SEQ ID NO: 2424121 - protein, 5 aa, Entamoeba dispar
ETSKE

SEQ ID NO: 2424122 - protein, 6 aa, Entamoeba dispar
ETSKKI

SEQ ID NO: 2424123 - protein, 8 aa, Entamoeba dispar
ETSKNSRM

SEQ ID NO: 2424124 - protein, 4 aa, Entamoeba dispar
ETSL

SEQ ID NO: 2424125 - protein, 5 aa, Entamoeba dispar
ETSLK

SEQ ID NO: 2424126 - protein, 4 aa, Entamoeba dispar
ETSN

SEQ ID NO: 2424127 - protein, 5 aa, Entamoeba dispar
ETSNG

SEQ ID NO: 2424128 - protein, 10 aa, Entamoeba dispar
ETSNGLEEQE

SEQ ID NO: 2424129 - protein, 8 aa, Entamoeba dispar
ETSNSNIP

SEQ ID NO: 2424130 - protein, 9 aa, Entamoeba dispar
ETSPDVEKP

SEQ ID NO: 2424131 - protein, 7 aa, Entamoeba dispar
ETSPFHA

SEQ ID NO: 2424132 - protein, 10 aa, Entamoeba dispar
ETSPQEHKGV

SEQ ID NO: 2424133 - protein, 7 aa, Entamoeba dispar
ETSPTFR

SEQ ID NO: 2424134 - protein, 7 aa, Entamoeba dispar
ETSPTID

SEQ ID NO: 2424135 - protein, 10 aa, Entamoeba dispar
ETSPTKEDKK

SEQ ID NO: 2424136 - protein, 9 aa, Entamoeba dispar
ETSQEEKEE

SEQ ID NO: 2424137 - protein, 6 aa, Entamoeba dispar
ETSQKI

SEQ ID NO: 2424138 - protein, 7 aa, Entamoeba dispar
ETSSFHS

SEQ ID NO: 2424139 - protein, 8 aa, Entamoeba dispar
ETSSKHGL

SEQ ID NO: 2424140 - protein, 4 aa, Entamoeba dispar
ETST

SEQ ID NO: 2424141 - protein, 9 aa, Entamoeba dispar
ETSTSQSEF

SEQ ID NO: 2424142 - protein, 4 aa, Entamoeba dispar
ETSV

SEQ ID NO: 2424143 - protein, 7 aa, Entamoeba dispar
ETSVEPV

SEQ ID NO: 2424144 - protein, 4 aa, Entamoeba dispar
ETSY

SEQ ID NO: 2424145 - protein, 11 aa, Entamoeba dispar
ETTANKKKTLA

SEQ ID NO: 2424146 - protein, 6 aa, Entamoeba dispar
ETTDCA

SEQ ID NO: 2424147 - protein, 5 aa, Entamoeba dispar
ETTDE

SEQ ID NO: 2424148 - protein, 7 aa, Entamoeba dispar
ETTDGSR

SEQ ID NO: 2424149 - protein, 6 aa, Entamoeba dispar
ETTDSL

SEQ ID NO: 2424150 - protein, 17 aa, Entamoeba dispar
ETTDSNSNSRRGSLDVQ

SEQ ID NO: 2424151 - protein, 9 aa, Entamoeba dispar
ETTEDTVDQ

SEQ ID NO: 2424152 - protein, 11 aa, Entamoeba dispar
ETTEEDEISLK

SEQ ID NO: 2424153 - protein, 7 aa, Entamoeba dispar
ETTEHND

SEQ ID NO: 2424154 - protein, 5 aa, Entamoeba dispar
ETTEK

SEQ ID NO: 2424155 - protein, 6 aa, Entamoeba dispar
ETTENK

SEQ ID NO: 2424156 - protein, 4 aa, Entamoeba dispar
ETTG

SEQ ID NO: 2424157 - protein, 8 aa, Entamoeba dispar
ETTGKEKS

SEQ ID NO: 2424158 - protein, 7 aa, Entamoeba dispar
ETTGNEQ

SEQ ID NO: 2424159 - protein, 6 aa, Entamoeba dispar
ETTGQP

SEQ ID NO: 2424160 - protein, 10 aa, Entamoeba dispar
ETTKKGLTQA

SEQ ID NO: 2424161 - protein, 12 aa, Entamoeba dispar
ETTKMTKIEEEY

SEQ ID NO: 2424162 - protein, 31 aa, Entamoeba dispar
ETTKNNSRPETPSSSQTENTKETTDQSSPIG

SEQ ID NO: 2424163 - protein, 8 aa, Entamoeba dispar
ETTKQPVN

SEQ ID NO: 2424164 - protein, 9 aa, Entamoeba dispar
ETTKTTENI

SEQ ID NO: 2424165 - protein, 5 aa, Entamoeba dispar
ETTLK

SEQ ID NO: 2424166 - protein, 8 aa, Entamoeba dispar
ETTLTTKK

SEQ ID NO: 2424167 - protein, 9 aa, Entamoeba dispar
ETTNASIRD

SEQ ID NO: 2424168 - protein, 11 aa, Entamoeba dispar
ETTNASTKGVE

SEQ ID NO: 2424169 - protein, 10 aa, Entamoeba dispar
ETTNNNTKNR

SEQ ID NO: 2424170 - protein, 9 aa, Entamoeba dispar
ETTNSSVVE

SEQ ID NO: 2424171 - protein, 6 aa, Entamoeba dispar
ETTNYS

SEQ ID NO: 2424172 - protein, 29 aa, Entamoeba dispar
ETTPKEEKKEEVKEEKKEEVKEEKKEEVS

SEQ ID NO: 2424173 - protein, 35 aa, Entamoeba dispar
ETTPKEEKKEEVKEEKKEEVKEEKKEEVVQIPIEQ

SEQ ID NO: 2424174 - protein, 18 aa, Entamoeba dispar
ETTPLQKPSNPYGQTKAM

SEQ ID NO: 2424175 - protein, 5 aa, Entamoeba dispar
ETTPY

SEQ ID NO: 2424176 - protein, 8 aa, Entamoeba dispar
ETTQLTKD

SEQ ID NO: 2424177 - protein, 7 aa, Entamoeba dispar
ETTQQYY

SEQ ID NO: 2424178 - protein, 10 aa, Entamoeba dispar
ETTQSEGTSI

SEQ ID NO: 2424179 - protein, 9 aa, Entamoeba dispar
ETTQSHMEK

SEQ ID NO: 2424180 - protein, 9 aa, Entamoeba dispar
ETTQTQPER

SEQ ID NO: 2424181 - protein, 9 aa, Entamoeba dispar
ETTRDEEDI

SEQ ID NO: 2424182 - protein, 6 aa, Entamoeba dispar
ETTRGA

SEQ ID NO: 2424183 - protein, 8 aa, Entamoeba dispar
ETTRKPPH

SEQ ID NO: 2424184 - protein, 4 aa, Entamoeba dispar
ETTS

SEQ ID NO: 2424185 - protein, 8 aa, Entamoeba dispar
ETTSTKKS

SEQ ID NO: 2424186 - protein, 9 aa, Entamoeba dispar
ETTTEGKKF

SEQ ID NO: 2424187 - protein, 8 aa, Entamoeba dispar
ETTTKKEM

SEQ ID NO: 2424188 - protein, 32 aa, Entamoeba dispar
ETTTTTSKRENDKNTPNQGMSRRRKLFKKELI

SEQ ID NO: 2424189 - protein, 32 aa, Entamoeba dispar
ETTTTTSKRENDKSTPNQGMSRRRKLFKKELI

SEQ ID NO: 2424190 - protein, 35 aa, Entamoeba dispar
  misc_feature (32)..(33): Xaa can be any naturally occurring amino acid
ETTTTTSKRENDKSTPNQGMSRRRKLFKKELXXSS

SEQ ID NO: 2424191 - protein, 8 aa, Entamoeba dispar
ETTVSQQT

SEQ ID NO: 2424192 - protein, 7 aa, Entamoeba dispar
ETVDGEQ

SEQ ID NO: 2424193 - protein, 6 aa, Entamoeba dispar
ETVDQT

SEQ ID NO: 2424194 - protein, 5 aa, Entamoeba dispar
ETVES

SEQ ID NO: 2424195 - protein, 6 aa, Entamoeba dispar
ETVGDK

SEQ ID NO: 2424196 - protein, 25 aa, Entamoeba dispar
ETVGEGIKEPSTPKHGKKKRRDKQG

SEQ ID NO: 2424197 - protein, 6 aa, Entamoeba dispar
ETVKPL

SEQ ID NO: 2424198 - protein, 12 aa, Entamoeba dispar
ETVKQPINTKKK

SEQ ID NO: 2424199 - protein, 7 aa, Entamoeba dispar
ETVNGFE

SEQ ID NO: 2424200 - protein, 6 aa, Entamoeba dispar
ETVRSA

SEQ ID NO: 2424201 - protein, 11 aa, Entamoeba dispar
ETVSPPSSVNI

SEQ ID NO: 2424202 - protein, 4 aa, Entamoeba dispar
ETVT

SEQ ID NO: 2424203 - protein, 13 aa, Entamoeba dispar
ETVTSPMMNNSDN

SEQ ID NO: 2424204 - protein, 6 aa, Entamoeba dispar
ETYDKD

SEQ ID NO: 2424205 - protein, 10 aa, Entamoeba dispar
ETYISKDSES

SEQ ID NO: 2424206 - protein, 12 aa, Entamoeba dispar
ETYPSSFILLKV

SEQ ID NO: 2424207 - protein, 4 aa, Entamoeba dispar
ETYQ

SEQ ID NO: 2424208 - protein, 11 aa, Entamoeba dispar
ETYRNMKNEKC

SEQ ID NO: 2424209 - protein, 7 aa, Entamoeba dispar
ETYSYRK

SEQ ID NO: 2424210 - protein, 14 aa, Entamoeba dispar
ETYTQTEEVPDPNV

SEQ ID NO: 2424211 - protein, 11 aa, Entamoeba dispar
EVANGSSLKTA

SEQ ID NO: 2424212 - protein, 6 aa, Entamoeba dispar
EVAQKQ

SEQ ID NO: 2424213 - protein, 18 aa, Entamoeba dispar
EVCSDQPNIPEVEFPLKM

SEQ ID NO: 2424214 - protein, 9 aa, Entamoeba dispar
EVDEEGNTA

SEQ ID NO: 2424215 - protein, 13 aa, Entamoeba dispar
EVDEEGYPNPDGD

SEQ ID NO: 2424216 - protein, 9 aa, Entamoeba dispar
EVDEGMNKE

SEQ ID NO: 2424217 - protein, 6 aa, Entamoeba dispar
EVDGAS

SEQ ID NO: 2424218 - protein, 10 aa, Entamoeba dispar
EVDGDDRSVY

SEQ ID NO: 2424219 - protein, 6 aa, Entamoeba dispar
EVDGTT

SEQ ID NO: 2424220 - protein, 5 aa, Entamoeba dispar
EVDGY

SEQ ID NO: 2424221 - protein, 9 aa, Entamoeba dispar
EVDKKAAED

SEQ ID NO: 2424222 - protein, 13 aa, Entamoeba dispar
EVDKLTTNDVDRG

SEQ ID NO: 2424223 - protein, 8 aa, Entamoeba dispar
EVDMTEDE

SEQ ID NO: 2424224 - protein, 10 aa, Entamoeba dispar
EVDPNGDRTI

SEQ ID NO: 2424225 - protein, 11 aa, Entamoeba dispar
EVDRYAENSIP

SEQ ID NO: 2424226 - protein, 10 aa, Entamoeba dispar
EVDSHRCSPH

SEQ ID NO: 2424227 - protein, 6 aa, Entamoeba dispar
EVDSNS

SEQ ID NO: 2424228 - protein, 38 aa, Entamoeba dispar
EVEDAERREFKRSQQTPQREFNENPRFTDGYSEEINRR

SEQ ID NO: 2424229 - protein, 8 aa, Entamoeba dispar
EVEEKEKK

SEQ ID NO: 2424230 - protein, 6 aa, Entamoeba dispar
EVEESY

SEQ ID NO: 2424231 - protein, 7 aa, Entamoeba dispar
EVEEVKE

SEQ ID NO: 2424232 - protein, 28 aa, Entamoeba dispar
EVEEWKGKSEETEELKKELAKKEDEIKE

SEQ ID NO: 2424233 - protein, 5 aa, Entamoeba dispar
EVEGQ

SEQ ID NO: 2424234 - protein, 41 aa, Entamoeba dispar
EVEKKENEMTEQKKKDEEEKEELKKRIEEIEKNAAAGSEQI

SEQ ID NO: 2424235 - protein, 13 aa, Entamoeba dispar
EVEKKPKHPKEED

SEQ ID NO: 2424236 - protein, 13 aa, Entamoeba dispar
EVEKKPRKPKEED

SEQ ID NO: 2424237 - protein, 5 aa, Entamoeba dispar
EVEKQ

SEQ ID NO: 2424238 - protein, 9 aa, Entamoeba dispar
EVEKRGTIE

SEQ ID NO: 2424239 - protein, 12 aa, Entamoeba dispar
EVEKSIPPKEET

SEQ ID NO: 2424240 - protein, 12 aa, Entamoeba dispar
EVENKQTNHNST

SEQ ID NO: 2424241 - protein, 6 aa, Entamoeba dispar
EVENKR

SEQ ID NO: 2424242 - protein, 18 aa, Entamoeba dispar
EVENNNENNQNNNKEREN

SEQ ID NO: 2424243 - protein, 21 aa, Entamoeba dispar
EVENPDKSYNEDKEWKNEDTS

SEQ ID NO: 2424244 - protein, 5 aa, Entamoeba dispar
EVEPA

SEQ ID NO: 2424245 - protein, 11 aa, Entamoeba dispar
EVEQPKTSSPV

SEQ ID NO: 2424246 - protein, 7 aa, Entamoeba dispar
EVERRLN

SEQ ID NO: 2424247 - protein, 8 aa, Entamoeba dispar
EVESGREV

SEQ ID NO: 2424248 - protein, 9 aa, Entamoeba dispar
EVESKNSRL

SEQ ID NO: 2424249 - protein, 27 aa, Entamoeba dispar
EVESTDNSSQSPPFDDFEESDKEIEDD

SEQ ID NO: 2424250 - protein, 6 aa, Entamoeba dispar
EVESTF

SEQ ID NO: 2424251 - protein, 38 aa, Entamoeba dispar
EVFKKNNKHHKEKNNDEKKPKKNKQLKSPKINDISREE

SEQ ID NO: 2424252 - protein, 4 aa, Entamoeba dispar
EVGD

SEQ ID NO: 2424253 - protein, 7 aa, Entamoeba dispar
EVGEADD

SEQ ID NO: 2424254 - protein, 7 aa, Entamoeba dispar
EVGELTK

SEQ ID NO: 2424255 - protein, 14 aa, Entamoeba dispar
EVGEYQSENPLGMS

SEQ ID NO: 2424256 - protein, 5 aa, Entamoeba dispar
EVGGL

SEQ ID NO: 2424257 - protein, 6 aa, Entamoeba dispar
EVGPDG

SEQ ID NO: 2424258 - protein, 5 aa, Entamoeba dispar
EVGPN

SEQ ID NO: 2424259 - protein, 9 aa, Entamoeba dispar
EVGSIKKED

SEQ ID NO: 2424260 - protein, 5 aa, Entamoeba dispar
EVHDG

SEQ ID NO: 2424261 - protein, 16 aa, Entamoeba dispar
EVHEDSTESKKPRKEN

SEQ ID NO: 2424262 - protein, 24 aa, Entamoeba dispar
EVHKGKTKNLNTKVEKTELPESKK

SEQ ID NO: 2424263 - protein, 6 aa, Entamoeba dispar
EVIGTE

SEQ ID NO: 2424264 - protein, 6 aa, Entamoeba dispar
EVINQQ

SEQ ID NO: 2424265 - protein, 8 aa, Entamoeba dispar
EVKATGDF

SEQ ID NO: 2424266 - protein, 22 aa, Entamoeba dispar
EVKDTKEGLQTEIQQEEVAKEN

SEQ ID NO: 2424267 - protein, 5 aa, Entamoeba dispar
EVKEG

SEQ ID NO: 2424268 - protein, 12 aa, Entamoeba dispar
EVKEKDEGSKVT

SEQ ID NO: 2424269 - protein, 10 aa, Entamoeba dispar
EVKEKKIRNI

SEQ ID NO: 2424270 - protein, 10 aa, Entamoeba dispar
EVKEQSQQQN

SEQ ID NO: 2424271 - protein, 9 aa, Entamoeba dispar
EVKERNEYN

SEQ ID NO: 2424272 - protein, 13 aa, Entamoeba dispar
EVKESRNKRDIPK

SEQ ID NO: 2424273 - protein, 10 aa, Entamoeba dispar
EVKGQKKDMN

SEQ ID NO: 2424274 - protein, 8 aa, Entamoeba dispar
EVKGRKEM

SEQ ID NO: 2424275 - protein, 11 aa, Entamoeba dispar
EVKHNQPQQPR

SEQ ID NO: 2424276 - protein, 19 aa, Entamoeba dispar
EVKKEEVKEKIKETTTSET

SEQ ID NO: 2424277 - protein, 30 aa, Entamoeba dispar
EVKKGDPVYQSITEEKDKQEKVIKQEKNIK

SEQ ID NO: 2424278 - protein, 19 aa, Entamoeba dispar
EVKKNNTTTHKKTKNKRTF

SEQ ID NO: 2424279 - protein, 7 aa, Entamoeba dispar
EVKPIPQ

SEQ ID NO: 2424280 - protein, 5 aa, Entamoeba dispar
EVKPV

SEQ ID NO: 2424281 - protein, 5 aa, Entamoeba dispar
EVKQK

SEQ ID NO: 2424282 - protein, 13 aa, Entamoeba dispar
EVKREKKGKKINE

SEQ ID NO: 2424283 - protein, 13 aa, Entamoeba dispar
EVKRESKSFEGVQ

SEQ ID NO: 2424284 - protein, 7 aa, Entamoeba dispar
EVKRNTK

SEQ ID NO: 2424285 - protein, 9 aa, Entamoeba dispar
EVKSFTSKS

SEQ ID NO: 2424286 - protein, 14 aa, Entamoeba dispar
EVKTGKCKEYEIEN

SEQ ID NO: 2424287 - protein, 4 aa, Entamoeba dispar
EVLE

SEQ ID NO: 2424288 - protein, 27 aa, Entamoeba dispar
EVLGKKEKKIKEKLTNEIDKEKPVKEN

SEQ ID NO: 2424289 - protein, 5 aa, Entamoeba dispar
EVLSE

SEQ ID NO: 2424290 - protein, 8 aa, Entamoeba dispar
EVLSKEPN

SEQ ID NO: 2424291 - protein, 4 aa, Entamoeba dispar
EVLT

SEQ ID NO: 2424292 - protein, 6 aa, Entamoeba dispar
EVNDEV

SEQ ID NO: 2424293 - protein, 19 aa, Entamoeba dispar
EVNDNNNEPNTENELTPHD

SEQ ID NO: 2424294 - protein, 13 aa, Entamoeba dispar
EVNDVSGAKIAKH

SEQ ID NO: 2424295 - protein, 13 aa, Entamoeba dispar
EVNDYKEKEIQRI

SEQ ID NO: 2424296 - protein, 7 aa, Entamoeba dispar
EVNEKVS

SEQ ID NO: 2424297 - protein, 13 aa, Entamoeba dispar
EVNEKVSQIIKEK

SEQ ID NO: 2424298 - protein, 8 aa, Entamoeba dispar
EVNEKYNT

SEQ ID NO: 2424299 - protein, 11 aa, Entamoeba dispar
EVNEQKSKRAL

SEQ ID NO: 2424300 - protein, 27 aa, Entamoeba dispar
EVNETAKRIKETTENESLKKKRINPQI

SEQ ID NO: 2424301 - protein, 5 aa, Entamoeba dispar
EVNGK

SEQ ID NO: 2424302 - protein, 8 aa, Entamoeba dispar
EVNHRTQE

SEQ ID NO: 2424303 - protein, 11 aa, Entamoeba dispar
EVNITGNEKCN

SEQ ID NO: 2424304 - protein, 12 aa, Entamoeba dispar
EVNITGNEKCNT

SEQ ID NO: 2424305 - protein, 5 aa, Entamoeba dispar
EVNKP

SEQ ID NO: 2424306 - protein, 20 aa, Entamoeba dispar
EVNKTKEMAESEKSNTKNKL

SEQ ID NO: 2424307 - protein, 180 aa, Entamoeba dispar
EVNKTKKEKVIEGDKERKHKEKEDKDKIENTKDNITGEPAQKQDENKSNETEEKENGSKQEESMQNINKQEESKQTIEESKQEEPKQEEPKQEEPKQEESKQEESKQEESKQEESKQEEQKQEEQKQEEQKQEEQKQEEQKQKEQKQKEQKQKEQKQEEQKQTIEEETKDESKKSESSVA

SEQ ID NO: 2424308 - protein, 9 aa, Entamoeba dispar
EVNKTSPSL

SEQ ID NO: 2424309 - protein, 14 aa, Entamoeba dispar
EVNNENVNQPPEQL

SEQ ID NO: 2424310 - protein, 24 aa, Entamoeba dispar
EVNNTPSGSINIETTSPEKKEGGC

SEQ ID NO: 2424311 - protein, 4 aa, Entamoeba dispar
EVNP

SEQ ID NO: 2424312 - protein, 9 aa, Entamoeba dispar
EVNPNTALQ

SEQ ID NO: 2424313 - protein, 5 aa, Entamoeba dispar
EVNQI

SEQ ID NO: 2424314 - protein, 6 aa, Entamoeba dispar
EVNRAK

SEQ ID NO: 2424315 - protein, 9 aa, Entamoeba dispar
EVNSDNEKL

SEQ ID NO: 2424316 - protein, 7 aa, Entamoeba dispar
EVNSKRM

SEQ ID NO: 2424317 - protein, 9 aa, Entamoeba dispar
EVNSQDVDE

SEQ ID NO: 2424318 - protein, 6 aa, Entamoeba dispar
EVNTQE

SEQ ID NO: 2424319 - protein, 8 aa, Entamoeba dispar
EVNTRDSL

SEQ ID NO: 2424320 - protein, 5 aa, Entamoeba dispar
EVPEK

SEQ ID NO: 2424321 - protein, 8 aa, Entamoeba dispar
EVPENGNE

SEQ ID NO: 2424322 - protein, 11 aa, Entamoeba dispar
EVPESKKDSLL

SEQ ID NO: 2424323 - protein, 5 aa, Entamoeba dispar
EVPGK

SEQ ID NO: 2424324 - protein, 9 aa, Entamoeba dispar
EVPGNELTP

SEQ ID NO: 2424325 - protein, 4 aa, Entamoeba dispar
EVPK

SEQ ID NO: 2424326 - protein, 9 aa, Entamoeba dispar
EVPKNKEEF

SEQ ID NO: 2424327 - protein, 12 aa, Entamoeba dispar
EVPNAEQSTVDA

SEQ ID NO: 2424328 - protein, 8 aa, Entamoeba dispar
EVPNESTN

SEQ ID NO: 2424329 - protein, 4 aa, Entamoeba dispar
EVPP

SEQ ID NO: 2424330 - protein, 6 aa, Entamoeba dispar
EVPQLS

SEQ ID NO: 2424331 - protein, 10 aa, Entamoeba dispar
EVPRSSRDWS

SEQ ID NO: 2424332 - protein, 4 aa, Entamoeba dispar
EVPS

SEQ ID NO: 2424333 - protein, 5 aa, Entamoeba dispar
EVPSR

SEQ ID NO: 2424334 - protein, 5 aa, Entamoeba dispar
EVPSV

SEQ ID NO: 2424335 - protein, 17 aa, Entamoeba dispar
EVPVTSEYKQPSESYRK

SEQ ID NO: 2424336 - protein, 14 aa, Entamoeba dispar
EVQDENIEVTEEQT

SEQ ID NO: 2424337 - protein, 15 aa, Entamoeba dispar
EVQDNHEKAVADAEV

SEQ ID NO: 2424338 - protein, 12 aa, Entamoeba dispar
EVQGPSQLSNES

SEQ ID NO: 2424339 - protein, 9 aa, Entamoeba dispar
EVQKEEKKV

SEQ ID NO: 2424340 - protein, 11 aa, Entamoeba dispar
EVQNASREYAK

SEQ ID NO: 2424341 - protein, 68 aa, Entamoeba dispar
EVQSSRATQTKSSQQTVKSSTQQIKTSPSLVQKQPSPHQTTTQSLKVENKNQTLQRTSNTTTKQTTEC

SEQ ID NO: 2424342 - protein, 4 aa, Entamoeba dispar
EVQV

SEQ ID NO: 2424343 - protein, 8 aa, Entamoeba dispar
EVREKGHQ

SEQ ID NO: 2424344 - protein, 10 aa, Entamoeba dispar
EVREQEHREL

SEQ ID NO: 2424345 - protein, 15 aa, Entamoeba dispar
EVRKNPEKLNSLAER

SEQ ID NO: 2424346 - protein, 4 aa, Entamoeba dispar
EVRP

SEQ ID NO: 2424347 - protein, 23 aa, Entamoeba dispar
EVRPPEETGMGNDKKKKKKEKVL

SEQ ID NO: 2424348 - protein, 4 aa, Entamoeba dispar
EVRQ

SEQ ID NO: 2424349 - protein, 6 aa, Entamoeba dispar
EVRTRR

SEQ ID NO: 2424350 - protein, 8 aa, Entamoeba dispar
EVRTTPAY

SEQ ID NO: 2424351 - protein, 17 aa, Entamoeba dispar
EVSAAREEVPGRRGYPG

SEQ ID NO: 2424352 - protein, 18 aa, Entamoeba dispar
EVSAAREEVPGRRGYPGY

SEQ ID NO: 2424353 - protein, 14 aa, Entamoeba dispar
EVSDKTEKEQEIEE

SEQ ID NO: 2424354 - protein, 19 aa, Entamoeba dispar
EVSDYGDKNKTASSVPQSI

SEQ ID NO: 2424355 - protein, 87 aa, Entamoeba dispar
EVSEADKTEIFSTSKSTNPFGEESDEEISDEVPNPKKKSKELDKNNKSTSTLGKSRMPQKQVNSNNPFDDTGLPKKNLNNKKSMGSQ

SEQ ID NO: 2424356 - protein, 9 aa, Entamoeba dispar
EVSEDDQIK

SEQ ID NO: 2424357 - protein, 13 aa, Entamoeba dispar
EVSEEEQSSEDSV

SEQ ID NO: 2424358 - protein, 6 aa, Entamoeba dispar
EVSGGA

SEQ ID NO: 2424359 - protein, 7 aa, Entamoeba dispar
EVSGKQV

SEQ ID NO: 2424360 - protein, 17 aa, Entamoeba dispar
EVSGSRHTRRDHIVTCL

SEQ ID NO: 2424361 - protein, 4 aa, Entamoeba dispar
EVSH

SEQ ID NO: 2424362 - protein, 6 aa, Entamoeba dispar
EVSIQT

SEQ ID NO: 2424363 - protein, 11 aa, Entamoeba dispar
EVSKASGLTGM

SEQ ID NO: 2424364 - protein, 8 aa, Entamoeba dispar
EVSKDETL

SEQ ID NO: 2424365 - protein, 13 aa, Entamoeba dispar
EVSKEVKKVEEEK

SEQ ID NO: 2424366 - protein, 7 aa, Entamoeba dispar
EVSKNTA

SEQ ID NO: 2424367 - protein, 8 aa, Entamoeba dispar
EVSKPNVN

SEQ ID NO: 2424368 - protein, 8 aa, Entamoeba dispar
EVSNQTQF

SEQ ID NO: 2424369 - protein, 4 aa, Entamoeba dispar
EVSP

SEQ ID NO: 2424370 - protein, 10 aa, Entamoeba dispar
EVSPLPPEKF

SEQ ID NO: 2424371 - protein, 13 aa, Entamoeba dispar
EVSRYSNPKQSQI

SEQ ID NO: 2424372 - protein, 20 aa, Entamoeba dispar
EVSSKQQQTIEILKKQLSLS

SEQ ID NO: 2424373 - protein, 24 aa, Entamoeba dispar
EVSSPSSIISSNTISPHLKSSRKK

SEQ ID NO: 2424374 - protein, 22 aa, Entamoeba dispar
EVSSSNTSSQLLQPTPGFNQNL

SEQ ID NO: 2424375 - protein, 11 aa, Entamoeba dispar
EVSTAQRRQTE

SEQ ID NO: 2424376 - protein, 8 aa, Entamoeba dispar
EVSTKTDI

SEQ ID NO: 2424377 - protein, 52 aa, Entamoeba dispar
EVSTTQPPLQNASKIPGLDSDINKSSLPSTNSNEIRTENQLNKSGNENQSKI

SEQ ID NO: 2424378 - protein, 6 aa, Entamoeba dispar
EVTDSI

SEQ ID NO: 2424379 - protein, 14 aa, Entamoeba dispar
EVTGDTNISKAAIA

SEQ ID NO: 2424380 - protein, 14 aa, Entamoeba dispar
EVTGGPLGAGMSTG

SEQ ID NO: 2424381 - protein, 14 aa, Entamoeba dispar
EVTGSTPKSGEGKL

SEQ ID NO: 2424382 - protein, 7 aa, Entamoeba dispar
EVTKDKE

SEQ ID NO: 2424383 - protein, 21 aa, Entamoeba dispar
EVTKKSTNEVIEKQTGEKEST

SEQ ID NO: 2424384 - protein, 7 aa, Entamoeba dispar
EVTLTTK

SEQ ID NO: 2424385 - protein, 4 aa, Entamoeba dispar
EVTN

SEQ ID NO: 2424386 - protein, 14 aa, Entamoeba dispar
EVTPENVRKGASYL

SEQ ID NO: 2424387 - protein, 47 aa, Entamoeba dispar
EVTPQEIKPNQTEKPILPTTNKNQIQQQTTVDSTFNNSQPNSTNPII

SEQ ID NO: 2424388 - protein, 11 aa, Entamoeba dispar
EVTPRTRPTGK

SEQ ID NO: 2424389 - protein, 8 aa, Entamoeba dispar
EVTPSQQE

SEQ ID NO: 2424390 - protein, 5 aa, Entamoeba dispar
EVTQL

SEQ ID NO: 2424391 - protein, 12 aa, Entamoeba dispar
EVTQRKGYKSGG

SEQ ID NO: 2424392 - protein, 10 aa, Entamoeba dispar
EVTREEMSRE

SEQ ID NO: 2424393 - protein, 9 aa, Entamoeba dispar
EVTSEGVNN

SEQ ID NO: 2424394 - protein, 4 aa, Entamoeba dispar
EVTV

SEQ ID NO: 2424395 - protein, 10 aa, Entamoeba dispar
EVVASGPKGL

SEQ ID NO: 2424396 - protein, 15 aa, Entamoeba dispar
EVVGDSYEQETPEDN

SEQ ID NO: 2424397 - protein, 4 aa, Entamoeba dispar
EVVR

SEQ ID NO: 2424398 - protein, 5 aa, Entamoeba dispar
EVWTD

SEQ ID NO: 2424399 - protein, 5 aa, Entamoeba dispar
EVYKE

SEQ ID NO: 2424400 - protein, 21 aa, Entamoeba dispar
EVYPDGTLKPGEGEKLNKSAT

SEQ ID NO: 2424401 - protein, 7 aa, Entamoeba dispar
EWEEHGT

SEQ ID NO: 2424402 - protein, 11 aa, Entamoeba dispar
EWEEKKRSIPI

SEQ ID NO: 2424403 - protein, 4 aa, Entamoeba dispar
EWEP

SEQ ID NO: 2424404 - protein, 6 aa, Entamoeba dispar
EWEPKK

SEQ ID NO: 2424405 - protein, 6 aa, Entamoeba dispar
EWKNPR

SEQ ID NO: 2424406 - protein, 14 aa, Entamoeba dispar
EWNNRNNGGRIKRN

SEQ ID NO: 2424407 - protein, 29 aa, Entamoeba dispar
EWNSDSSIKYTDVSTLQKGTAPTEQTPNA

SEQ ID NO: 2424408 - protein, 16 aa, Entamoeba dispar
EWSEKIKKSLSSFSQN

SEQ ID NO: 2424409 - protein, 6 aa, Entamoeba dispar
EWSEPQ

SEQ ID NO: 2424410 - protein, 28 aa, Entamoeba dispar
EWSKTKEKKENKEKGAKMNTSVKTKEQV

SEQ ID NO: 2424411 - protein, 13 aa, Entamoeba dispar
EWSTTKKKPKFEE

SEQ ID NO: 2424412 - protein, 19 aa, Entamoeba dispar
EWTKSNKHFDTERIIVVEM

SEQ ID NO: 2424413 - protein, 6 aa, Entamoeba dispar
EWTNKT

SEQ ID NO: 2424414 - protein, 5 aa, Entamoeba dispar
EWTNR

SEQ ID NO: 2424415 - protein, 5 aa, Entamoeba dispar
EWTSR

SEQ ID NO: 2424416 - protein, 6 aa, Entamoeba dispar
EYAGQT

SEQ ID NO: 2424417 - protein, 8 aa, Entamoeba dispar
EYAKQKGA

SEQ ID NO: 2424418 - protein, 9 aa, Entamoeba dispar
EYANGAKFT

SEQ ID NO: 2424419 - protein, 5 aa, Entamoeba dispar
EYATD

SEQ ID NO: 2424420 - protein, 7 aa, Entamoeba dispar
EYDAKTT

SEQ ID NO: 2424421 - protein, 22 aa, Entamoeba dispar
EYDDENNEEFYDSSETKYDMEE

SEQ ID NO: 2424422 - protein, 7 aa, Entamoeba dispar
EYDDIDD

SEQ ID NO: 2424423 - protein, 6 aa, Entamoeba dispar
EYDETE

SEQ ID NO: 2424424 - protein, 45 aa, Entamoeba dispar
EYDETLSKDQVESKTKLEKTTGIDTSIQSNDIKLTEEKQISLNKN

SEQ ID NO: 2424425 - protein, 4 aa, Entamoeba dispar
EYDF

SEQ ID NO: 2424426 - protein, 17 aa, Entamoeba dispar
EYDNESKKEKVLPNRNN

SEQ ID NO: 2424427 - protein, 12 aa, Entamoeba dispar
EYDNKNNKGSVE

SEQ ID NO: 2424428 - protein, 58 aa, Entamoeba dispar
EYDNTQPQNNTEQKIKEPSEIYTSNHEQLTPFNQNENQEIIKEEEKKKELEDDPEAEA

SEQ ID NO: 2424429 - protein, 10 aa, Entamoeba dispar
EYDQSKSKEI

SEQ ID NO: 2424430 - protein, 5 aa, Entamoeba dispar
EYDSE

SEQ ID NO: 2424431 - protein, 9 aa, Entamoeba dispar
EYEDGKADV

SEQ ID NO: 2424432 - protein, 20 aa, Entamoeba dispar
EYEEKEEEDEIIEETKDTIT

SEQ ID NO: 2424433 - protein, 7 aa, Entamoeba dispar
EYEETKL

SEQ ID NO: 2424434 - protein, 4 aa, Entamoeba dispar
EYEG

SEQ ID NO: 2424435 - protein, 5 aa, Entamoeba dispar
EYEGI

SEQ ID NO: 2424436 - protein, 6 aa, Entamoeba dispar
EYEGKT

SEQ ID NO: 2424437 - protein, 18 aa, Entamoeba dispar
EYEHEKKEEVNRKDYGDV

SEQ ID NO: 2424438 - protein, 5 aa, Entamoeba dispar
EYEHG

SEQ ID NO: 2424439 - protein, 4 aa, Entamoeba dispar
EYEI

SEQ ID NO: 2424440 - protein, 8 aa, Entamoeba dispar
EYEKEAKS

SEQ ID NO: 2424441 - protein, 27 aa, Entamoeba dispar
EYEKEEKKEDKKLRKSQTKKDEEERKK

SEQ ID NO: 2424442 - protein, 10 aa, Entamoeba dispar
EYEKKQKKDI

SEQ ID NO: 2424443 - protein, 11 aa, Entamoeba dispar
EYEKNNSNQIG

SEQ ID NO: 2424444 - protein, 9 aa, Entamoeba dispar
EYEKSTGKE

SEQ ID NO: 2424445 - protein, 5 aa, Entamoeba dispar
EYEKT

SEQ ID NO: 2424446 - protein, 14 aa, Entamoeba dispar
EYENGQFEVTSSAQ

SEQ ID NO: 2424447 - protein, 7 aa, Entamoeba dispar
EYENSAD

SEQ ID NO: 2424448 - protein, 4 aa, Entamoeba dispar
EYEP

SEQ ID NO: 2424449 - protein, 5 aa, Entamoeba dispar
EYERN

SEQ ID NO: 2424450 - protein, 5 aa, Entamoeba dispar
EYERQ

SEQ ID NO: 2424451 - protein, 14 aa, Entamoeba dispar
EYESKGKISPDRDG

SEQ ID NO: 2424452 - protein, 5 aa, Entamoeba dispar
EYFDG

SEQ ID NO: 2424453 - protein, 5 aa, Entamoeba dispar
EYGED

SEQ ID NO: 2424454 - protein, 16 aa, Entamoeba dispar
EYGNNNKLPQINPRTQ

SEQ ID NO: 2424455 - protein, 15 aa, Entamoeba dispar
EYGTATNIKSRVNRQ

SEQ ID NO: 2424456 - protein, 4 aa, Entamoeba dispar
EYGV

SEQ ID NO: 2424457 - protein, 5 aa, Entamoeba dispar
EYHEG

SEQ ID NO: 2424458 - protein, 4 aa, Entamoeba dispar
EYID

SEQ ID NO: 2424459 - protein, 4 aa, Entamoeba dispar
EYIE

SEQ ID NO: 2424460 - protein, 7 aa, Entamoeba dispar
EYIENTP

SEQ ID NO: 2424461 - protein, 6 aa, Entamoeba dispar
EYIGDK

SEQ ID NO: 2424462 - protein, 11 aa, Entamoeba dispar
EYIQEQQSNLL

SEQ ID NO: 2424463 - protein, 8 aa, Entamoeba dispar
EYISNGAS

SEQ ID NO: 2424464 - protein, 5 aa, Entamoeba dispar
EYISP

SEQ ID NO: 2424465 - protein, 5 aa, Entamoeba dispar
EYISQ

SEQ ID NO: 2424466 - protein, 11 aa, Entamoeba dispar
EYKDGKININE

SEQ ID NO: 2424467 - protein, 10 aa, Entamoeba dispar
EYKDKNFKSP

SEQ ID NO: 2424468 - protein, 19 aa, Entamoeba dispar
EYKDTTKKGTKLFTGENEF

SEQ ID NO: 2424469 - protein, 10 aa, Entamoeba dispar
EYKEKSTVAI

SEQ ID NO: 2424470 - protein, 12 aa, Entamoeba dispar
EYKERNKETELD

SEQ ID NO: 2424471 - protein, 11 aa, Entamoeba dispar
EYKGDIKQTEL

SEQ ID NO: 2424472 - protein, 9 aa, Entamoeba dispar
EYKKFEEDA

SEQ ID NO: 2424473 - protein, 10 aa, Entamoeba dispar
EYKKFEEDTM

SEQ ID NO: 2424474 - protein, 10 aa, Entamoeba dispar
EYKKYGSGKD

SEQ ID NO: 2424475 - protein, 12 aa, Entamoeba dispar
EYKNKKKKPKGY

SEQ ID NO: 2424476 - protein, 9 aa, Entamoeba dispar
EYKNSTGFK

SEQ ID NO: 2424477 - protein, 4 aa, Entamoeba dispar
EYKP

SEQ ID NO: 2424478 - protein, 4 aa, Entamoeba dispar
EYLN

SEQ ID NO: 2424479 - protein, 13 aa, Entamoeba dispar
EYLSNKTVQRRFS

SEQ ID NO: 2424480 - protein, 8 aa, Entamoeba dispar
EYNENENG

SEQ ID NO: 2424481 - protein, 6 aa, Entamoeba dispar
EYNENW

SEQ ID NO: 2424482 - protein, 12 aa, Entamoeba dispar
EYNGMTRESKEF

SEQ ID NO: 2424483 - protein, 8 aa, Entamoeba dispar
EYNGPNGY

SEQ ID NO: 2424484 - protein, 4 aa, Entamoeba dispar
EYNK

SEQ ID NO: 2424485 - protein, 11 aa, Entamoeba dispar
EYNKETKNFEQ

SEQ ID NO: 2424486 - protein, 9 aa, Entamoeba dispar
EYNLESENE

SEQ ID NO: 2424487 - protein, 6 aa, Entamoeba dispar
EYNNSF

SEQ ID NO: 2424488 - protein, 5 aa, Entamoeba dispar
EYNPI

SEQ ID NO: 2424489 - protein, 13 aa, Entamoeba dispar
EYNSKKTKARQIT

SEQ ID NO: 2424490 - protein, 7 aa, Entamoeba dispar
EYNSNDN

SEQ ID NO: 2424491 - protein, 9 aa, Entamoeba dispar
EYNSQDNVL

SEQ ID NO: 2424492 - protein, 9 aa, Entamoeba dispar
EYNSRTGME

SEQ ID NO: 2424493 - protein, 7 aa, Entamoeba dispar
EYNSSDD

SEQ ID NO: 2424494 - protein, 5 aa, Entamoeba dispar
EYNTR

SEQ ID NO: 2424495 - protein, 8 aa, Entamoeba dispar
EYPDGSAQ

SEQ ID NO: 2424496 - protein, 14 aa, Entamoeba dispar
EYPDWTPDQRDVPL

SEQ ID NO: 2424497 - protein, 4 aa, Entamoeba dispar
EYPE

SEQ ID NO: 2424498 - protein, 4 aa, Entamoeba dispar
EYPF

SEQ ID NO: 2424499 - protein, 10 aa, Entamoeba dispar
EYPFSTNKAT

SEQ ID NO: 2424500 - protein, 7 aa, Entamoeba dispar
EYPGGEE

SEQ ID NO: 2424501 - protein, 8 aa, Entamoeba dispar
EYPIEKGN

SEQ ID NO: 2424502 - protein, 10 aa, Entamoeba dispar
EYPKDENEDP

SEQ ID NO: 2424503 - protein, 10 aa, Entamoeba dispar
EYPKNSKGVS

SEQ ID NO: 2424504 - protein, 9 aa, Entamoeba dispar
EYPKPENGI

SEQ ID NO: 2424505 - protein, 7 aa, Entamoeba dispar
EYPNIKN

SEQ ID NO: 2424506 - protein, 4 aa, Entamoeba dispar
EYPP

SEQ ID NO: 2424507 - protein, 5 aa, Entamoeba dispar
EYPPN

SEQ ID NO: 2424508 - protein, 6 aa, Entamoeba dispar
EYPPSN

SEQ ID NO: 2424509 - protein, 9 aa, Entamoeba dispar
EYPQGKEGI

SEQ ID NO: 2424510 - protein, 4 aa, Entamoeba dispar
EYPS

SEQ ID NO: 2424511 - protein, 7 aa, Entamoeba dispar
EYPSKKL

SEQ ID NO: 2424512 - protein, 6 aa, Entamoeba dispar
EYPSTA

SEQ ID NO: 2424513 - protein, 7 aa, Entamoeba dispar
EYPTGAN

SEQ ID NO: 2424514 - protein, 9 aa, Entamoeba dispar
EYPTRPPKC

SEQ ID NO: 2424515 - protein, 5 aa, Entamoeba dispar
EYQIP

SEQ ID NO: 2424516 - protein, 10 aa, Entamoeba dispar
EYQKNVPYDI

SEQ ID NO: 2424517 - protein, 11 aa, Entamoeba dispar
EYQNDSDEEKM

SEQ ID NO: 2424518 - protein, 9 aa, Entamoeba dispar
EYQNKFDTS

SEQ ID NO: 2424519 - protein, 8 aa, Entamoeba dispar
EYQPSKRY

SEQ ID NO: 2424520 - protein, 26 aa, Entamoeba dispar
EYQQMQQKKRPIQKTKEVDYQKEREY

SEQ ID NO: 2424521 - protein, 12 aa, Entamoeba dispar
EYQQQIQKNFVK

SEQ ID NO: 2424522 - protein, 6 aa, Entamoeba dispar
EYQTPS

SEQ ID NO: 2424523 - protein, 75 aa, Entamoeba dispar
EYRDDYRASDRRDDYRTSDYRDDYRPSDRRDDYKLSDRRDDYKSSDRRDDYRPNERSDRFERRGNGNIGYREERK

SEQ ID NO: 2424524 - protein, 12 aa, Entamoeba dispar
EYRDSEEDSSEF

SEQ ID NO: 2424525 - protein, 7 aa, Entamoeba dispar
EYRGGAA

SEQ ID NO: 2424526 - protein, 4 aa, Entamoeba dispar
EYRK

SEQ ID NO: 2424527 - protein, 11 aa, Entamoeba dispar
EYRKDIDEELK

SEQ ID NO: 2424528 - protein, 6 aa, Entamoeba dispar
EYRPTQ

SEQ ID NO: 2424529 - protein, 8 aa, Entamoeba dispar
EYRRQGIG

SEQ ID NO: 2424530 - protein, 6 aa, Entamoeba dispar
EYRTTK

SEQ ID NO: 2424531 - protein, 10 aa, Entamoeba dispar
EYSAGRGVNE

SEQ ID NO: 2424532 - protein, 9 aa, Entamoeba dispar
EYSEADKNA

SEQ ID NO: 2424533 - protein, 6 aa, Entamoeba dispar
EYSERG

SEQ ID NO: 2424534 - protein, 11 aa, Entamoeba dispar
EYSESGSPFYG

SEQ ID NO: 2424535 - protein, 5 aa, Entamoeba dispar
EYSKE

SEQ ID NO: 2424536 - protein, 9 aa, Entamoeba dispar
EYSKTSGID

SEQ ID NO: 2424537 - protein, 8 aa, Entamoeba dispar
EYSNEGQR

SEQ ID NO: 2424538 - protein, 21 aa, Entamoeba dispar
EYSNGTEDMSDSVNSPVTTNI

SEQ ID NO: 2424539 - protein, 4 aa, Entamoeba dispar
EYSQ

SEQ ID NO: 2424540 - protein, 8 aa, Entamoeba dispar
EYSQATEY

SEQ ID NO: 2424541 - protein, 18 aa, Entamoeba dispar
EYSQGRDGAELANPETFA

SEQ ID NO: 2424542 - protein, 19 aa, Entamoeba dispar
EYSQSDRKKYGNTIPPEVK

SEQ ID NO: 2424543 - protein, 18 aa, Entamoeba dispar
EYSRDNEVRYTPPPKNNH

SEQ ID NO: 2424544 - protein, 8 aa, Entamoeba dispar
EYSSDEHT

SEQ ID NO: 2424545 - protein, 11 aa, Entamoeba dispar
EYSSEEKSIPE

SEQ ID NO: 2424546 - protein, 5 aa, Entamoeba dispar
EYSSF

SEQ ID NO: 2424547 - protein, 42 aa, Entamoeba dispar
EYSSKEEIKKSEEKEKTKDQSQTSSTSIEEDISTNKEDFEED

SEQ ID NO: 2424548 - protein, 42 aa, Entamoeba dispar
EYSSKEEIKKSEEKEKTKNQSQTSSTSIEEDISTDKEDFEED

SEQ ID NO: 2424549 - protein, 19 aa, Entamoeba dispar
EYSSKKENGIVNTKGKTTF

SEQ ID NO: 2424550 - protein, 4 aa, Entamoeba dispar
EYST

SEQ ID NO: 2424551 - protein, 17 aa, Entamoeba dispar
EYSTDYKSTIGSDISQK

SEQ ID NO: 2424552 - protein, 8 aa, Entamoeba dispar
EYSTPISM

SEQ ID NO: 2424553 - protein, 10 aa, Entamoeba dispar
EYSTTKDDLE

SEQ ID NO: 2424554 - protein, 5 aa, Entamoeba dispar
EYSYQ

SEQ ID NO: 2424555 - protein, 5 aa, Entamoeba dispar
EYTAE

SEQ ID NO: 2424556 - protein, 8 aa, Entamoeba dispar
EYTDDNPE

SEQ ID NO: 2424557 - protein, 5 aa, Entamoeba dispar
EYTDG

SEQ ID NO: 2424558 - protein, 8 aa, Entamoeba dispar
EYTDGLAR

SEQ ID NO: 2424559 - protein, 17 aa, Entamoeba dispar
EYTEEDESNEEDENEEP

SEQ ID NO: 2424560 - protein, 7 aa, Entamoeba dispar
EYTEEDR

SEQ ID NO: 2424561 - protein, 21 aa, Entamoeba dispar
EYTEEDRKKYGNTIPSEVKSL

SEQ ID NO: 2424562 - protein, 20 aa, Entamoeba dispar
EYTEEDRKSYGNTIPPEVKS

SEQ ID NO: 2424563 - protein, 21 aa, Entamoeba dispar
EYTEEDRKSYGNTIPPEVKSL

SEQ ID NO: 2424564 - protein, 19 aa, Entamoeba dispar
EYTEEDRKSYGTTIPPEVK

SEQ ID NO: 2424565 - protein, 13 aa, Entamoeba dispar
EYTEEDRNKYGNI

SEQ ID NO: 2424566 - protein, 20 aa, Entamoeba dispar
EYTEEDRNTYGNTIPSEVKS

SEQ ID NO: 2424567 - protein, 27 aa, Entamoeba dispar
EYTEKDRKKYGTTIPSEIKSLREYSFK

SEQ ID NO: 2424568 - protein, 21 aa, Entamoeba dispar
EYTESDRKSYGTTIPTEVKSL

SEQ ID NO: 2424569 - protein, 17 aa, Entamoeba dispar
EYTEYDRKSYGNTIPSE

SEQ ID NO: 2424570 - protein, 16 aa, Entamoeba dispar
EYTGDDRYKYGTTMPP

SEQ ID NO: 2424571 - protein, 10 aa, Entamoeba dispar
EYTGEREFET

SEQ ID NO: 2424572 - protein, 9 aa, Entamoeba dispar
EYTGGDNAV

SEQ ID NO: 2424573 - protein, 11 aa, Entamoeba dispar
EYTKEDREEYG

SEQ ID NO: 2424574 - protein, 24 aa, Entamoeba dispar
EYTKEDRKKYGNTIPSEVKSLGNG

SEQ ID NO: 2424575 - protein, 19 aa, Entamoeba dispar
EYTKEDRKLYGTTIPPEVN

SEQ ID NO: 2424576 - protein, 13 aa, Entamoeba dispar
EYTKEDRKSYGNI

SEQ ID NO: 2424577 - protein, 18 aa, Entamoeba dispar
EYTKEDRNKYGNTIPSEV

SEQ ID NO: 2424578 - protein, 19 aa, Entamoeba dispar
EYTKEDRNKYGNTIPSEVK

SEQ ID NO: 2424579 - protein, 13 aa, Entamoeba dispar
EYTKEDRNKYGTI

SEQ ID NO: 2424580 - protein, 10 aa, Entamoeba dispar
EYTKEDRWKY

SEQ ID NO: 2424581 - protein, 19 aa, Entamoeba dispar
EYTKEDRYKYGNTIPPEIK

SEQ ID NO: 2424582 - protein, 21 aa, Entamoeba dispar
EYTKKDRKSYGNTIPSEITTL

SEQ ID NO: 2424583 - protein, 11 aa, Entamoeba dispar
EYTKSDREEYG

SEQ ID NO: 2424584 - protein, 21 aa, Entamoeba dispar
EYTKSDRKSYGNTIPPEVKSL

SEQ ID NO: 2424585 - protein, 18 aa, Entamoeba dispar
EYTKSDRKSYGNTIPSEV

SEQ ID NO: 2424586 - protein, 6 aa, Entamoeba dispar
EYTLPP

SEQ ID NO: 2424587 - protein, 13 aa, Entamoeba dispar
EYTNEDREKDIGN

SEQ ID NO: 2424588 - protein, 15 aa, Entamoeba dispar
EYTNEDREKYGYEIP

SEQ ID NO: 2424589 - protein, 11 aa, Entamoeba dispar
EYTNTVDSNKK

SEQ ID NO: 2424590 - protein, 4 aa, Entamoeba dispar
EYTQ

SEQ ID NO: 2424591 - protein, 11 aa, Entamoeba dispar
EYTQSDREEHG

SEQ ID NO: 2424592 - protein, 19 aa, Entamoeba dispar
EYTQSDRNKYGNTIPPEVK

SEQ ID NO: 2424593 - protein, 15 aa, Entamoeba dispar
EYTSESDEDDDDEEE

SEQ ID NO: 2424594 - protein, 6 aa, Entamoeba dispar
EYTSNP

SEQ ID NO: 2424595 - protein, 4 aa, Entamoeba dispar
EYTT

SEQ ID NO: 2424596 - protein, 8 aa, Entamoeba dispar
EYTTSASV

SEQ ID NO: 2424597 - protein, 18 aa, Entamoeba dispar
EYTTTGSEKVDSSNEMKE

SEQ ID NO: 2424598 - protein, 4 aa, Entamoeba dispar
EYVD

SEQ ID NO: 2424599 - protein, 4 aa, Entamoeba dispar
EYYE

SEQ ID NO: 2424600 - protein, 6 aa, Entamoeba dispar
EYYGDD

SEQ ID NO: 2424601 - protein, 10 aa, Entamoeba dispar
EYYGKPGKKF

SEQ ID NO: 2424602 - protein, 11 aa, Entamoeba dispar
EYYGKPGKKFK

SEQ ID NO: 2424603 - protein, 13 aa, Entamoeba dispar
EYYGKPGKKVQKE

SEQ ID NO: 2424604 - protein, 15 aa, Entamoeba dispar
EYYTNTNKINIDKND

SEQ ID NO: 2424605 - protein, 6 aa, Entamoeba dispar
EYYTPS

SEQ ID NO: 2424606 - protein, 15 aa, Entamoeba dispar
FAAAGGYIASDKSTI

SEQ ID NO: 2424607 - protein, 12 aa, Entamoeba dispar
FADDDNNVTSYN

SEQ ID NO: 2424608 - protein, 4 aa, Entamoeba dispar
FAEE

SEQ ID NO: 2424609 - protein, 8 aa, Entamoeba dispar
FAENSNNI

SEQ ID NO: 2424610 - protein, 14 aa, Entamoeba dispar
FAEPANATDAKINE

SEQ ID NO: 2424611 - protein, 10 aa, Entamoeba dispar
FAEQTKTTVG

SEQ ID NO: 2424612 - protein, 9 aa, Entamoeba dispar
FAGRDIPEN

SEQ ID NO: 2424613 - protein, 11 aa, Entamoeba dispar
FAKEKNGTILE

SEQ ID NO: 2424614 - protein, 7 aa, Entamoeba dispar
FAKGGER

SEQ ID NO: 2424615 - protein, 14 aa, Entamoeba dispar
FAKKRSKAVVNGTI

SEQ ID NO: 2424616 - protein, 8 aa, Entamoeba dispar
FAKKSNKR

SEQ ID NO: 2424617 - protein, 14 aa, Entamoeba dispar
FAKKTNKKMIDQST

SEQ ID NO: 2424618 - protein, 4 aa, Entamoeba dispar
FAKQ

SEQ ID NO: 2424619 - protein, 11 aa, Entamoeba dispar
FAKQTSTPKDI

SEQ ID NO: 2424620 - protein, 4 aa, Entamoeba dispar
FAKS

SEQ ID NO: 2424621 - protein, 12 aa, Entamoeba dispar
FALQSNNAIIHL

SEQ ID NO: 2424622 - protein, 9 aa, Entamoeba dispar
FAPKGKKLP

SEQ ID NO: 2424623 - protein, 26 aa, Entamoeba dispar
FAPKKTNHSYGRRFTGSDKMKKENEI

SEQ ID NO: 2424624 - protein, 7 aa, Entamoeba dispar
FAPQKTF

SEQ ID NO: 2424625 - protein, 10 aa, Entamoeba dispar
FAPTQATQLN

SEQ ID NO: 2424626 - protein, 15 aa, Entamoeba dispar
FAPTTLKEAAKEAKE

SEQ ID NO: 2424627 - protein, 18 aa, Entamoeba dispar
FAQEDPRDITGQDKDLTE

SEQ ID NO: 2424628 - protein, 8 aa, Entamoeba dispar
FAQNSKNE

SEQ ID NO: 2424629 - protein, 4 aa, Entamoeba dispar
FAQS

SEQ ID NO: 2424630 - protein, 7 aa, Entamoeba dispar
FARSGSI

SEQ ID NO: 2424631 - protein, 12 aa, Entamoeba dispar
FASETKDKLRNG

SEQ ID NO: 2424632 - protein, 17 aa, Entamoeba dispar
FASPTGTRGDYWLHIEL

SEQ ID NO: 2424633 - protein, 5 aa, Entamoeba dispar
FATEE

SEQ ID NO: 2424634 - protein, 4 aa, Entamoeba dispar
FATG

SEQ ID NO: 2424635 - protein, 6 aa, Entamoeba dispar
FATGGE

SEQ ID NO: 2424636 - protein, 9 aa, Entamoeba dispar
FCESEGQNV

SEQ ID NO: 2424637 - protein, 10 aa, Entamoeba dispar
FCNEKPNNDI

SEQ ID NO: 2424638 - protein, 10 aa, Entamoeba dispar
FCSQESKIEA

SEQ ID NO: 2424639 - protein, 7 aa, Entamoeba dispar
FCTPQEG

SEQ ID NO: 2424640 - protein, 10 aa, Entamoeba dispar
FDAKSGFDRN

SEQ ID NO: 2424641 - protein, 11 aa, Entamoeba dispar
FDASDKAIANM

SEQ ID NO: 2424642 - protein, 10 aa, Entamoeba dispar
FDDDGNNGSD

SEQ ID NO: 2424643 - protein, 11 aa, Entamoeba dispar
FDDEALKDQDG

SEQ ID NO: 2424644 - protein, 9 aa, Entamoeba dispar
FDDEPNPVI

SEQ ID NO: 2424645 - protein, 9 aa, Entamoeba dispar
FDDFDNASA

SEQ ID NO: 2424646 - protein, 7 aa, Entamoeba dispar
FDDKKAD

SEQ ID NO: 2424647 - protein, 20 aa, Entamoeba dispar
FDDPKTAGFRKTRNYQTEQQ

SEQ ID NO: 2424648 - protein, 9 aa, Entamoeba dispar
FDDQTGAEE

SEQ ID NO: 2424649 - protein, 15 aa, Entamoeba dispar
FDDYDDSTDSSEEEF

SEQ ID NO: 2424650 - protein, 12 aa, Entamoeba dispar
FDDYVPGSPIYS

SEQ ID NO: 2424651 - protein, 8 aa, Entamoeba dispar
FDEDEKDN

SEQ ID NO: 2424652 - protein, 6 aa, Entamoeba dispar
FDEDGD

SEQ ID NO: 2424653 - protein, 10 aa, Entamoeba dispar
FDEDVSGALQ

SEQ ID NO: 2424654 - protein, 29 aa, Entamoeba dispar
FDEEDETSCTNNKTSERTQPINEGEIEID

SEQ ID NO: 2424655 - protein, 9 aa, Entamoeba dispar
FDEENDDSE

SEQ ID NO: 2424656 - protein, 6 aa, Entamoeba dispar
FDEEPK

SEQ ID NO: 2424657 - protein, 20 aa, Entamoeba dispar
FDEFGSGDEDSYDNDDYFMF

SEQ ID NO: 2424658 - protein, 4 aa, Entamoeba dispar
FDEK

SEQ ID NO: 2424659 - protein, 21 aa, Entamoeba dispar
FDELSQDKKQLHTSHGSCQQS

SEQ ID NO: 2424660 - protein, 5 aa, Entamoeba dispar
FDEND

SEQ ID NO: 2424661 - protein, 24 aa, Entamoeba dispar
FDENEQEEIEKENLQHNSPIKGVS

SEQ ID NO: 2424662 - protein, 10 aa, Entamoeba dispar
FDEQRKQDAL

SEQ ID NO: 2424663 - protein, 9 aa, Entamoeba dispar
FDESGGKKI

SEQ ID NO: 2424664 - protein, 10 aa, Entamoeba dispar
FDESGYTSEF

SEQ ID NO: 2424665 - protein, 8 aa, Entamoeba dispar
FDESKYDE

SEQ ID NO: 2424666 - protein, 5 aa, Entamoeba dispar
FDEST

SEQ ID NO: 2424667 - protein, 5 aa, Entamoeba dispar
FDEYS

SEQ ID NO: 2424668 - protein, 15 aa, Entamoeba dispar
FDEYSKSQIQANMSQ

SEQ ID NO: 2424669 - protein, 6 aa, Entamoeba dispar
FDGCSS

SEQ ID NO: 2424670 - protein, 11 aa, Entamoeba dispar
FDGDDKIGVDD

SEQ ID NO: 2424671 - protein, 5 aa, Entamoeba dispar
FDGDE

SEQ ID NO: 2424672 - protein, 5 aa, Entamoeba dispar
FDGKK

SEQ ID NO: 2424673 - protein, 10 aa, Entamoeba dispar
FDGKYSTNDI

SEQ ID NO: 2424674 - protein, 14 aa, Entamoeba dispar
FDGPKPDKNGETQI

SEQ ID NO: 2424675 - protein, 4 aa, Entamoeba dispar
FDGS

SEQ ID NO: 2424676 - protein, 10 aa, Entamoeba dispar
FDGSGADNFY

SEQ ID NO: 2424677 - protein, 10 aa, Entamoeba dispar
FDGSTRPGLA

SEQ ID NO: 2424678 - protein, 35 aa, Entamoeba dispar
FDGTVESNQNDVLPEGEEFGSEELESAKKKLLGTS

SEQ ID NO: 2424679 - protein, 6 aa, Entamoeba dispar
FDIEDD

SEQ ID NO: 2424680 - protein, 22 aa, Entamoeba dispar
FDIKKDSVKKSVKELDSNGDGV

SEQ ID NO: 2424681 - protein, 11 aa, Entamoeba dispar
FDKDQTNKEKA

SEQ ID NO: 2424682 - protein, 21 aa, Entamoeba dispar
FDKEEKSKEKEPKCNKSERMK

SEQ ID NO: 2424683 - protein, 29 aa, Entamoeba dispar
FDKENPNSINEMNQKSKGFGSNEEEGDDY

SEQ ID NO: 2424684 - protein, 8 aa, Entamoeba dispar
FDKESKCS

SEQ ID NO: 2424685 - protein, 6 aa, Entamoeba dispar
FDKGSL

SEQ ID NO: 2424686 - protein, 4 aa, Entamoeba dispar
FDKN

SEQ ID NO: 2424687 - protein, 7 aa, Entamoeba dispar
FDKNTEK

SEQ ID NO: 2424688 - protein, 5 aa, Entamoeba dispar
FDKPD

SEQ ID NO: 2424689 - protein, 5 aa, Entamoeba dispar
FDKPR

SEQ ID NO: 2424690 - protein, 10 aa, Entamoeba dispar
FDKSNSEGTL

SEQ ID NO: 2424691 - protein, 6 aa, Entamoeba dispar
FDKTDI

SEQ ID NO: 2424692 - protein, 10 aa, Entamoeba dispar
FDNENEKQSF

SEQ ID NO: 2424693 - protein, 28 aa, Entamoeba dispar
FDNEQKRKKEKSIKNEEKVTEENNELSD

SEQ ID NO: 2424694 - protein, 4 aa, Entamoeba dispar
FDNG

SEQ ID NO: 2424695 - protein, 4 aa, Entamoeba dispar
FDNN

SEQ ID NO: 2424696 - protein, 5 aa, Entamoeba dispar
FDNNE

SEQ ID NO: 2424697 - protein, 12 aa, Entamoeba dispar
FDNQPIDDVSKE

SEQ ID NO: 2424698 - protein, 9 aa, Entamoeba dispar
FDNQRSITN

SEQ ID NO: 2424699 - protein, 19 aa, Entamoeba dispar
FDNSDLKKKAIELLELINS

SEQ ID NO: 2424700 - protein, 9 aa, Entamoeba dispar
FDNTSSENG

SEQ ID NO: 2424701 - protein, 9 aa, Entamoeba dispar
FDNTSSPTF

SEQ ID NO: 2424702 - protein, 10 aa, Entamoeba dispar
FDPDDSSTYI

SEQ ID NO: 2424703 - protein, 7 aa, Entamoeba dispar
FDPDNER

SEQ ID NO: 2424704 - protein, 4 aa, Entamoeba dispar
FDPE

SEQ ID NO: 2424705 - protein, 4 aa, Entamoeba dispar
FDPK

SEQ ID NO: 2424706 - protein, 9 aa, Entamoeba dispar
FDPKDTHPL

SEQ ID NO: 2424707 - protein, 13 aa, Entamoeba dispar
FDPNDSKYIDNNR

SEQ ID NO: 2424708 - protein, 9 aa, Entamoeba dispar
FDPQSGKYF

SEQ ID NO: 2424709 - protein, 5 aa, Entamoeba dispar
FDPST

SEQ ID NO: 2424710 - protein, 7 aa, Entamoeba dispar
FDPSTGM

SEQ ID NO: 2424711 - protein, 15 aa, Entamoeba dispar
FDQNKTALKQLTNEE

SEQ ID NO: 2424712 - protein, 9 aa, Entamoeba dispar
FDQNTPCKP

SEQ ID NO: 2424713 - protein, 10 aa, Entamoeba dispar
FDQPERKSDQ

SEQ ID NO: 2424714 - protein, 4 aa, Entamoeba dispar
FDQQ

SEQ ID NO: 2424715 - protein, 12 aa, Entamoeba dispar
FDQQLGSSSPEV

SEQ ID NO: 2424716 - protein, 6 aa, Entamoeba dispar
FDQTPD

SEQ ID NO: 2424717 - protein, 6 aa, Entamoeba dispar
FDQTTN

SEQ ID NO: 2424718 - protein, 8 aa, Entamoeba dispar
FDQVDESD

SEQ ID NO: 2424719 - protein, 5 aa, Entamoeba dispar
FDRPE

SEQ ID NO: 2424720 - protein, 11 aa, Entamoeba dispar
FDRTKGIGDFN

SEQ ID NO: 2424721 - protein, 9 aa, Entamoeba dispar
FDRTTKYPE

SEQ ID NO: 2424722 - protein, 15 aa, Entamoeba dispar
FDSDETEENEHPREN

SEQ ID NO: 2424723 - protein, 15 aa, Entamoeba dispar
FDSKDKLYSKISRES

SEQ ID NO: 2424724 - protein, 22 aa, Entamoeba dispar
FDSNKQKEEELQKKRDAMAQED

SEQ ID NO: 2424725 - protein, 6 aa, Entamoeba dispar
FDSRPC

SEQ ID NO: 2424726 - protein, 13 aa, Entamoeba dispar
FDSSNMKNDITKE

SEQ ID NO: 2424727 - protein, 7 aa, Entamoeba dispar
FDSSSDD

SEQ ID NO: 2424728 - protein, 11 aa, Entamoeba dispar
FDSSSTTKLVQ

SEQ ID NO: 2424729 - protein, 17 aa, Entamoeba dispar
FDSSTIKEIKKRKSEQT

SEQ ID NO: 2424730 - protein, 11 aa, Entamoeba dispar
FDSTKPQREKY

SEQ ID NO: 2424731 - protein, 12 aa, Entamoeba dispar
FDSTKSNFEEGI

SEQ ID NO: 2424732 - protein, 22 aa, Entamoeba dispar
FDSTTDDESMVNNKPMEDTSNH

SEQ ID NO: 2424733 - protein, 11 aa, Entamoeba dispar
FDSYRGTNYPG

SEQ ID NO: 2424734 - protein, 10 aa, Entamoeba dispar
FDTIKNEKEI

SEQ ID NO: 2424735 - protein, 11 aa, Entamoeba dispar
FDTQGDPFFSN

SEQ ID NO: 2424736 - protein, 4 aa, Entamoeba dispar
FDTR

SEQ ID NO: 2424737 - protein, 15 aa, Entamoeba dispar
FDTRKAAKEQAESVG

SEQ ID NO: 2424738 - protein, 7 aa, Entamoeba dispar
FDTSDKV

SEQ ID NO: 2424739 - protein, 6 aa, Entamoeba dispar
FDTTNP

SEQ ID NO: 2424740 - protein, 12 aa, Entamoeba dispar
FDVDEANEKAER

SEQ ID NO: 2424741 - protein, 6 aa, Entamoeba dispar
FDVRDD

SEQ ID NO: 2424742 - protein, 5 aa, Entamoeba dispar
FDYGD

SEQ ID NO: 2424743 - protein, 9 aa, Entamoeba dispar
FDYSQSKEI

SEQ ID NO: 2424744 - protein, 5 aa, Entamoeba dispar
FEAPP

SEQ ID NO: 2424745 - protein, 6 aa, Entamoeba dispar
FEAPPG

SEQ ID NO: 2424746 - protein, 8 aa, Entamoeba dispar
FEASNENK

SEQ ID NO: 2424747 - protein, 8 aa, Entamoeba dispar
FEASPDGV

SEQ ID NO: 2424748 - protein, 4 aa, Entamoeba dispar
FEAY

SEQ ID NO: 2424749 - protein, 4 aa, Entamoeba dispar
FEDE

SEQ ID NO: 2424750 - protein, 13 aa, Entamoeba dispar
FEDEQKELYSESL

SEQ ID NO: 2424751 - protein, 10 aa, Entamoeba dispar
FEDKIQKKVE

SEQ ID NO: 2424752 - protein, 4 aa, Entamoeba dispar
FEDN

SEQ ID NO: 2424753 - protein, 5 aa, Entamoeba dispar
FEDND

SEQ ID NO: 2424754 - protein, 16 aa, Entamoeba dispar
FEDNSISSLSGNKQIQ

SEQ ID NO: 2424755 - protein, 12 aa, Entamoeba dispar
FEDNTNEEEVSE

SEQ ID NO: 2424756 - protein, 4 aa, Entamoeba dispar
FEDQ

SEQ ID NO: 2424757 - protein, 11 aa, Entamoeba dispar
FEDREVEREKV

SEQ ID NO: 2424758 - protein, 10 aa, Entamoeba dispar
FEDSSKVIED

SEQ ID NO: 2424759 - protein, 6 aa, Entamoeba dispar
FEDTDD

SEQ ID NO: 2424760 - protein, 12 aa, Entamoeba dispar
FEEAKRAKNQLN

SEQ ID NO: 2424761 - protein, 9 aa, Entamoeba dispar
FEEARERLQ

SEQ ID NO: 2424762 - protein, 16 aa, Entamoeba dispar
FEEDGKMNNNRGRLGD

SEQ ID NO: 2424763 - protein, 12 aa, Entamoeba dispar
FEEDSVSLTVYL

SEQ ID NO: 2424764 - protein, 19 aa, Entamoeba dispar
FEEEEDEDDEDEDDYDEDD

SEQ ID NO: 2424765 - protein, 36 aa, Entamoeba dispar
FEEEEEDEEPKPKRRKRALKKEKSDDSFIVDDDDEI

SEQ ID NO: 2424766 - protein, 5 aa, Entamoeba dispar
FEEEK

SEQ ID NO: 2424767 - protein, 11 aa, Entamoeba dispar
FEEEKKEEQEV

SEQ ID NO: 2424768 - protein, 15 aa, Entamoeba dispar
FEEELSDNEAAPTWI

SEQ ID NO: 2424769 - protein, 6 aa, Entamoeba dispar
FEEEPD

SEQ ID NO: 2424770 - protein, 6 aa, Entamoeba dispar
FEEEPK

SEQ ID NO: 2424771 - protein, 6 aa, Entamoeba dispar
FEEERK

SEQ ID NO: 2424772 - protein, 7 aa, Entamoeba dispar
FEEETKK

SEQ ID NO: 2424773 - protein, 5 aa, Entamoeba dispar
FEEEY

SEQ ID NO: 2424774 - protein, 5 aa, Entamoeba dispar
FEEGE

SEQ ID NO: 2424775 - protein, 16 aa, Entamoeba dispar
FEEGEDELKELNKTKE

SEQ ID NO: 2424776 - protein, 9 aa, Entamoeba dispar
FEEGKEIGK

SEQ ID NO: 2424777 - protein, 6 aa, Entamoeba dispar
FEEGNK

SEQ ID NO: 2424778 - protein, 4 aa, Entamoeba dispar
FEEK

SEQ ID NO: 2424779 - protein, 9 aa, Entamoeba dispar
FEEKDGKEV

SEQ ID NO: 2424780 - protein, 21 aa, Entamoeba dispar
FEELPSRDDIQKFNKNEVNES

SEQ ID NO: 2424781 - protein, 5 aa, Entamoeba dispar
FEENL

SEQ ID NO: 2424782 - protein, 9 aa, Entamoeba dispar
FEENTESVK

SEQ ID NO: 2424783 - protein, 15 aa, Entamoeba dispar
FEENYNERSVGISRT

SEQ ID NO: 2424784 - protein, 5 aa, Entamoeba dispar
FEEPN

SEQ ID NO: 2424785 - protein, 7 aa, Entamoeba dispar
FEEQRAN

SEQ ID NO: 2424786 - protein, 7 aa, Entamoeba dispar
FEESEYN

SEQ ID NO: 2424787 - protein, 5 aa, Entamoeba dispar
FEESP

SEQ ID NO: 2424788 - protein, 8 aa, Entamoeba dispar
FEETKSKE

SEQ ID NO: 2424789 - protein, 5 aa, Entamoeba dispar
FEETN

SEQ ID NO: 2424790 - protein, 7 aa, Entamoeba dispar
FEETSTI

SEQ ID NO: 2424791 - protein, 15 aa, Entamoeba dispar
FEGENVKEKVNEYYK

SEQ ID NO: 2424792 - protein, 17 aa, Entamoeba dispar
FEGGDRKIDKNIRILNL

SEQ ID NO: 2424793 - protein, 4 aa, Entamoeba dispar
FEGK

SEQ ID NO: 2424794 - protein, 6 aa, Entamoeba dispar
FEGNES

SEQ ID NO: 2424795 - protein, 9 aa, Entamoeba dispar
FEGRDKDVD

SEQ ID NO: 2424796 - protein, 21 aa, Entamoeba dispar
FEGRKAKAIAKTITKQRVESG

SEQ ID NO: 2424797 - protein, 19 aa, Entamoeba dispar
FEGSLKVSKKKKITTPVKA

SEQ ID NO: 2424798 - protein, 5 aa, Entamoeba dispar
FEGTP

SEQ ID NO: 2424799 - protein, 4 aa, Entamoeba dispar
FEHD

SEQ ID NO: 2424800 - protein, 8 aa, Entamoeba dispar
FEHEDGSP

SEQ ID NO: 2424801 - protein, 6 aa, Entamoeba dispar
FEIGKG

SEQ ID NO: 2424802 - protein, 19 aa, Entamoeba dispar
FEINNQRNKTKAGDENEKL

SEQ ID NO: 2424803 - protein, 4 aa, Entamoeba dispar
FEKE

SEQ ID NO: 2424804 - protein, 8 aa, Entamoeba dispar
FEKEEETV

SEQ ID NO: 2424805 - protein, 13 aa, Entamoeba dispar
FEKEGDPSFNDNG

SEQ ID NO: 2424806 - protein, 10 aa, Entamoeba dispar
FEKEGEKNEM

SEQ ID NO: 2424807 - protein, 19 aa, Entamoeba dispar
FEKEKKEWAEKEKKYNEQI

SEQ ID NO: 2424808 - protein, 9 aa, Entamoeba dispar
FEKERRKQQ

SEQ ID NO: 2424809 - protein, 17 aa, Entamoeba dispar
FEKETMSQYEKQRSNYF

SEQ ID NO: 2424810 - protein, 4 aa, Entamoeba dispar
FEKG

SEQ ID NO: 2424811 - protein, 27 aa, Entamoeba dispar
FEKKDEKKKRKYKKSFSDIEKQQKQIE

SEQ ID NO: 2424812 - protein, 9 aa, Entamoeba dispar
FEKKSRGYM

SEQ ID NO: 2424813 - protein, 11 aa, Entamoeba dispar
FEKQKEESYEE

SEQ ID NO: 2424814 - protein, 42 aa, Entamoeba dispar
FEKQTKSKQPQIAYGGYTSTPINQPKPATKPKPAPKKSNNDW

SEQ ID NO: 2424815 - protein, 5 aa, Entamoeba dispar
FEKRE

SEQ ID NO: 2424816 - protein, 6 aa, Entamoeba dispar
FEKSTK

SEQ ID NO: 2424817 - protein, 16 aa, Entamoeba dispar
FEKTRKVSGPRSLQGS

SEQ ID NO: 2424818 - protein, 4 aa, Entamoeba dispar
FEKY

SEQ ID NO: 2424819 - protein, 22 aa, Entamoeba dispar
FELQKENKDSQVLQEKTLTKED

SEQ ID NO: 2424820 - protein, 9 aa, Entamoeba dispar
FENGKAKKV

SEQ ID NO: 2424821 - protein, 5 aa, Entamoeba dispar
FENKT

SEQ ID NO: 2424822 - protein, 14 aa, Entamoeba dispar
FENKTGLEESMTDN

SEQ ID NO: 2424823 - protein, 13 aa, Entamoeba dispar
FENKVAESNFDRN

SEQ ID NO: 2424824 - protein, 5 aa, Entamoeba dispar
FENMK

SEQ ID NO: 2424825 - protein, 10 aa, Entamoeba dispar
FENNTNDIEQ

SEQ ID NO: 2424826 - protein, 6 aa, Entamoeba dispar
FENPSV

SEQ ID NO: 2424827 - protein, 15 aa, Entamoeba dispar
FENRTEALPQRKTEI

SEQ ID NO: 2424828 - protein, 5 aa, Entamoeba dispar
FENSK

SEQ ID NO: 2424829 - protein, 5 aa, Entamoeba dispar
FENTI

SEQ ID NO: 2424830 - protein, 23 aa, Entamoeba dispar
FENTKQTQSVSNTLNKESNGDPI

SEQ ID NO: 2424831 - protein, 23 aa, Entamoeba dispar
FEPEGELKTEVQQEETLPTNIES

SEQ ID NO: 2424832 - protein, 6 aa, Entamoeba dispar
FEPEVS

SEQ ID NO: 2424833 - protein, 5 aa, Entamoeba dispar
FEPKE

SEQ ID NO: 2424834 - protein, 5 aa, Entamoeba dispar
FEPSG

SEQ ID NO: 2424835 - protein, 13 aa, Entamoeba dispar
FEPSPNKTPLSTD

SEQ ID NO: 2424836 - protein, 5 aa, Entamoeba dispar
FEPTR

SEQ ID NO: 2424837 - protein, 6 aa, Entamoeba dispar
FEQEAN

SEQ ID NO: 2424838 - protein, 8 aa, Entamoeba dispar
FEQEEGDV

SEQ ID NO: 2424839 - protein, 12 aa, Entamoeba dispar
FEQEQEPNGKDT

SEQ ID NO: 2424840 - protein, 5 aa, Entamoeba dispar
FEQKP

SEQ ID NO: 2424841 - protein, 7 aa, Entamoeba dispar
FEQNERK

SEQ ID NO: 2424842 - protein, 5 aa, Entamoeba dispar
FEQNG

SEQ ID NO: 2424843 - protein, 5 aa, Entamoeba dispar
FEQQP

SEQ ID NO: 2424844 - protein, 44 aa, Entamoeba dispar
FEQSQKLSQKLQEHSSQQHSPIEPTISPPPQQNQIPNQPTQPVT

SEQ ID NO: 2424845 - protein, 6 aa, Entamoeba dispar
FERDEN

SEQ ID NO: 2424846 - protein, 5 aa, Entamoeba dispar
FERPG

SEQ ID NO: 2424847 - protein, 14 aa, Entamoeba dispar
FERTRSSQSVIRSI

SEQ ID NO: 2424848 - protein, 4 aa, Entamoeba dispar
FESC

SEQ ID NO: 2424849 - protein, 10 aa, Entamoeba dispar
FESDNCDANC

SEQ ID NO: 2424850 - protein, 7 aa, Entamoeba dispar
FESDPMP

SEQ ID NO: 2424851 - protein, 10 aa, Entamoeba dispar
FESDQKQLPV

SEQ ID NO: 2424852 - protein, 6 aa, Entamoeba dispar
FESEKK

SEQ ID NO: 2424853 - protein, 5 aa, Entamoeba dispar
FESGN

SEQ ID NO: 2424854 - protein, 4 aa, Entamoeba dispar
FESK

SEQ ID NO: 2424855 - protein, 10 aa, Entamoeba dispar
FESKQQDSMM

SEQ ID NO: 2424856 - protein, 5 aa, Entamoeba dispar
FESNK

SEQ ID NO: 2424857 - protein, 35 aa, Entamoeba dispar
FESSEFDETGENEDLSSSDNSEDSDSDVDIIFDEI

SEQ ID NO: 2424858 - protein, 13 aa, Entamoeba dispar
FESTEEQESFISS

SEQ ID NO: 2424859 - protein, 8 aa, Entamoeba dispar
FESTGNRE

SEQ ID NO: 2424860 - protein, 5 aa, Entamoeba dispar
FESTR

SEQ ID NO: 2424861 - protein, 6 aa, Entamoeba dispar
FETGTF

SEQ ID NO: 2424862 - protein, 7 aa, Entamoeba dispar
FETHTDS

SEQ ID NO: 2424863 - protein, 11 aa, Entamoeba dispar
FETPQNNEPID

SEQ ID NO: 2424864 - protein, 5 aa, Entamoeba dispar
FETTL

SEQ ID NO: 2424865 - protein, 19 aa, Entamoeba dispar
FETTSNPMSNSIPSTPTQI

SEQ ID NO: 2424866 - protein, 5 aa, Entamoeba dispar
FETVG

SEQ ID NO: 2424867 - protein, 8 aa, Entamoeba dispar
FEYTQGPE

SEQ ID NO: 2424868 - protein, 5 aa, Entamoeba dispar
FGAGQ

SEQ ID NO: 2424869 - protein, 7 aa, Entamoeba dispar
FGATNRN

SEQ ID NO: 2424870 - protein, 12 aa, Entamoeba dispar
FGDAKTADGVKA

SEQ ID NO: 2424871 - protein, 5 aa, Entamoeba dispar
FGDDE

SEQ ID NO: 2424872 - protein, 17 aa, Entamoeba dispar
FGDDTQSQQDAKDIYEE

SEQ ID NO: 2424873 - protein, 12 aa, Entamoeba dispar
FGDEERRATERA

SEQ ID NO: 2424874 - protein, 10 aa, Entamoeba dispar
FGDESEQCNR

SEQ ID NO: 2424875 - protein, 8 aa, Entamoeba dispar
FGDNELSP

SEQ ID NO: 2424876 - protein, 4 aa, Entamoeba dispar
FGDQ

SEQ ID NO: 2424877 - protein, 8 aa, Entamoeba dispar
FGEDANTQ

SEQ ID NO: 2424878 - protein, 8 aa, Entamoeba dispar
FGEDDRSD

SEQ ID NO: 2424879 - protein, 7 aa, Entamoeba dispar
FGEDGRA

SEQ ID NO: 2424880 - protein, 4 aa, Entamoeba dispar
FGEE

SEQ ID NO: 2424881 - protein, 9 aa, Entamoeba dispar
FGEERKEVV

SEQ ID NO: 2424882 - protein, 10 aa, Entamoeba dispar
FGEERNVEQI

SEQ ID NO: 2424883 - protein, 7 aa, Entamoeba dispar
FGEESPK

SEQ ID NO: 2424884 - protein, 5 aa, Entamoeba dispar
FGEGK

SEQ ID NO: 2424885 - protein, 8 aa, Entamoeba dispar
FGEKPPKK

SEQ ID NO: 2424886 - protein, 16 aa, Entamoeba dispar
FGELSPSTLQYWIQKC

SEQ ID NO: 2424887 - protein, 5 aa, Entamoeba dispar
FGELT

SEQ ID NO: 2424888 - protein, 22 aa, Entamoeba dispar
FGENEEEDDDSNEDDDSNADAL

SEQ ID NO: 2424889 - protein, 8 aa, Entamoeba dispar
FGENQGPQ

SEQ ID NO: 2424890 - protein, 24 aa, Entamoeba dispar
FGESDYTKLKTKETVGSYGEGDRQ

SEQ ID NO: 2424891 - protein, 6 aa, Entamoeba dispar
FGETTS

SEQ ID NO: 2424892 - protein, 4 aa, Entamoeba dispar
FGFA

SEQ ID NO: 2424893 - protein, 5 aa, Entamoeba dispar
FGGCQ

SEQ ID NO: 2424894 - protein, 9 aa, Entamoeba dispar
FGGEENTLN

SEQ ID NO: 2424895 - protein, 10 aa, Entamoeba dispar
FGGEPNYEID

SEQ ID NO: 2424896 - protein, 9 aa, Entamoeba dispar
FGGGQYSKH

SEQ ID NO: 2424897 - protein, 13 aa, Entamoeba dispar
FGGISKNQEAMPD

SEQ ID NO: 2424898 - protein, 12 aa, Entamoeba dispar
FGGRKDFDGKVF

SEQ ID NO: 2424899 - protein, 11 aa, Entamoeba dispar
FGGSAEDIFKN

SEQ ID NO: 2424900 - protein, 9 aa, Entamoeba dispar
FGHDNSNIS

SEQ ID NO: 2424901 - protein, 21 aa, Entamoeba dispar
FGKDDSLGPNISYPSTSPKGK

SEQ ID NO: 2424902 - protein, 20 aa, Entamoeba dispar
FGKESSKTKKFEEFNEEEKS

SEQ ID NO: 2424903 - protein, 4 aa, Entamoeba dispar
FGKF

SEQ ID NO: 2424904 - protein, 11 aa, Entamoeba dispar
FGKKDKKEYIS

SEQ ID NO: 2424905 - protein, 22 aa, Entamoeba dispar
FGKKTNGSRINKKEKKEVPTEF

SEQ ID NO: 2424906 - protein, 7 aa, Entamoeba dispar
FGKNGRQ

SEQ ID NO: 2424907 - protein, 19 aa, Entamoeba dispar
FGKNPSFSFTRKDGSSVSI

SEQ ID NO: 2424908 - protein, 13 aa, Entamoeba dispar
FGKNTSKYGEYEE

SEQ ID NO: 2424909 - protein, 5 aa, Entamoeba dispar
FGKPI

SEQ ID NO: 2424910 - protein, 6 aa, Entamoeba dispar
FGKPID

SEQ ID NO: 2424911 - protein, 8 aa, Entamoeba dispar
FGKPSNKE

SEQ ID NO: 2424912 - protein, 4 aa, Entamoeba dispar
FGKQ

SEQ ID NO: 2424913 - protein, 10 aa, Entamoeba dispar
FGKRNEGDSA

SEQ ID NO: 2424914 - protein, 5 aa, Entamoeba dispar
FGKRT

SEQ ID NO: 2424915 - protein, 6 aa, Entamoeba dispar
FGKSDN

SEQ ID NO: 2424916 - protein, 8 aa, Entamoeba dispar
FGKTETIK

SEQ ID NO: 2424917 - protein, 15 aa, Entamoeba dispar
FGKTNSLSELKRERK

SEQ ID NO: 2424918 - protein, 4 aa, Entamoeba dispar
FGND

SEQ ID NO: 2424919 - protein, 4 aa, Entamoeba dispar
FGNK

SEQ ID NO: 2424920 - protein, 8 aa, Entamoeba dispar
FGNKKGTI

SEQ ID NO: 2424921 - protein, 8 aa, Entamoeba dispar
FGNKQTLT

SEQ ID NO: 2424922 - protein, 10 aa, Entamoeba dispar
FGNKSTAVTG

SEQ ID NO: 2424923 - protein, 11 aa, Entamoeba dispar
FGNPDNTTSHY

SEQ ID NO: 2424924 - protein, 9 aa, Entamoeba dispar
FGNSPTELI

SEQ ID NO: 2424925 - protein, 8 aa, Entamoeba dispar
FGNSSEIK

SEQ ID NO: 2424926 - protein, 5 aa, Entamoeba dispar
FGNSV

SEQ ID NO: 2424927 - protein, 4 aa, Entamoeba dispar
FGPG

SEQ ID NO: 2424928 - protein, 11 aa, Entamoeba dispar
FGPGVEGGVTI

SEQ ID NO: 2424929 - protein, 5 aa, Entamoeba dispar
FGPKT

SEQ ID NO: 2424930 - protein, 53 aa, Entamoeba dispar
FGPPTSTTKRGRTEIKPPMTNSSSLNSVSQQQVQAQPPENQKTEEVPQPIQTQ

SEQ ID NO: 2424931 - protein, 4 aa, Entamoeba dispar
FGPR

SEQ ID NO: 2424932 - protein, 10 aa, Entamoeba dispar
FGPSGEEPRT

SEQ ID NO: 2424933 - protein, 8 aa, Entamoeba dispar
FGPSNKQQ

SEQ ID NO: 2424934 - protein, 5 aa, Entamoeba dispar
FGQGT

SEQ ID NO: 2424935 - protein, 10 aa, Entamoeba dispar
FGQPTQVTQQ

SEQ ID NO: 2424936 - protein, 12 aa, Entamoeba dispar
FGQQQNNGMNSF

SEQ ID NO: 2424937 - protein, 5 aa, Entamoeba dispar
FGQSW

SEQ ID NO: 2424938 - protein, 4 aa, Entamoeba dispar
FGQV

SEQ ID NO: 2424939 - protein, 18 aa, Entamoeba dispar
FGQYPTQRNFRSSSGFPL

SEQ ID NO: 2424940 - protein, 12 aa, Entamoeba dispar
FGRKENGKNNTC

SEQ ID NO: 2424941 - protein, 4 aa, Entamoeba dispar
FGRN

SEQ ID NO: 2424942 - protein, 9 aa, Entamoeba dispar
FGSDNSKYL

SEQ ID NO: 2424943 - protein, 8 aa, Entamoeba dispar
FGSDTLSQ

SEQ ID NO: 2424944 - protein, 9 aa, Entamoeba dispar
FGSKSPNKG

SEQ ID NO: 2424945 - protein, 24 aa, Entamoeba dispar
FGSNKEKKNPQRIKTLNENNKGAI

SEQ ID NO: 2424946 - protein, 6 aa, Entamoeba dispar
FGSNQG

SEQ ID NO: 2424947 - protein, 8 aa, Entamoeba dispar
FGSQNGIA

SEQ ID NO: 2424948 - protein, 18 aa, Entamoeba dispar
FGSTPTITKTQSSDTLHP

SEQ ID NO: 2424949 - protein, 12 aa, Entamoeba dispar
FGTAQKHKVENP

SEQ ID NO: 2424950 - protein, 10 aa, Entamoeba dispar
FGTATKIGEV

SEQ ID NO: 2424951 - protein, 16 aa, Entamoeba dispar
FGTDDEEYDYTDDDDD

SEQ ID NO: 2424952 - protein, 9 aa, Entamoeba dispar
FGTEDSTET

SEQ ID NO: 2424953 - protein, 6 aa, Entamoeba dispar
FGTGMS

SEQ ID NO: 2424954 - protein, 6 aa, Entamoeba dispar
FGTKET

SEQ ID NO: 2424955 - protein, 7 aa, Entamoeba dispar
FGTPYAQ

SEQ ID NO: 2424956 - protein, 10 aa, Entamoeba dispar
FGTSKSTIEE

SEQ ID NO: 2424957 - protein, 13 aa, Entamoeba dispar
FGVDSDDQIPTLP

SEQ ID NO: 2424958 - protein, 16 aa, Entamoeba dispar
FGVPGNKFKTSTVDPH

SEQ ID NO: 2424959 - protein, 4 aa, Entamoeba dispar
FHDP

SEQ ID NO: 2424960 - protein, 7 aa, Entamoeba dispar
FHGEADS

SEQ ID NO: 2424961 - protein, 10 aa, Entamoeba dispar
FHGNETTEEK

SEQ ID NO: 2424962 - protein, 9 aa, Entamoeba dispar
FHPGPGNFS

SEQ ID NO: 2424963 - protein, 6 aa, Entamoeba dispar
FHSDDG

SEQ ID NO: 2424964 - protein, 5 aa, Entamoeba dispar
FHTTG

SEQ ID NO: 2424965 - protein, 6 aa, Entamoeba dispar
FIESSQ

SEQ ID NO: 2424966 - protein, 8 aa, Entamoeba dispar
FIGNEASS

SEQ ID NO: 2424967 - protein, 11 aa, Entamoeba dispar
FIKKSNELKIP

SEQ ID NO: 2424968 - protein, 5 aa, Entamoeba dispar
FINKP

SEQ ID NO: 2424969 - protein, 5 aa, Entamoeba dispar
FIPEN

SEQ ID NO: 2424970 - protein, 5 aa, Entamoeba dispar
FIPET

SEQ ID NO: 2424971 - protein, 5 aa, Entamoeba dispar
FIPPK

SEQ ID NO: 2424972 - protein, 11 aa, Entamoeba dispar
FIQQNSDFSQL

SEQ ID NO: 2424973 - protein, 10 aa, Entamoeba dispar
FISNKTSISS

SEQ ID NO: 2424974 - protein, 7 aa, Entamoeba dispar
FISSGYE

SEQ ID NO: 2424975 - protein, 7 aa, Entamoeba dispar
FITGSDD

SEQ ID NO: 2424976 - protein, 11 aa, Entamoeba dispar
FITPNDELKQE

SEQ ID NO: 2424977 - protein, 12 aa, Entamoeba dispar
FITSSNDNETAE

SEQ ID NO: 2424978 - protein, 5 aa, Entamoeba dispar
FKADI

SEQ ID NO: 2424979 - protein, 8 aa, Entamoeba dispar
FKAEKEVR

SEQ ID NO: 2424980 - protein, 10 aa, Entamoeba dispar
FKAEKKNARY

SEQ ID NO: 2424981 - protein, 7 aa, Entamoeba dispar
FKAGNYQ

SEQ ID NO: 2424982 - protein, 7 aa, Entamoeba dispar
FKAGRVR

SEQ ID NO: 2424983 - protein, 22 aa, Entamoeba dispar
FKAKDSYKKNLEKISNGAKTLS

SEQ ID NO: 2424984 - protein, 11 aa, Entamoeba dispar
FKAKGGNDYSE

SEQ ID NO: 2424985 - protein, 9 aa, Entamoeba dispar
FKAKKAGKK

SEQ ID NO: 2424986 - protein, 5 aa, Entamoeba dispar
FKASE

SEQ ID NO: 2424987 - protein, 11 aa, Entamoeba dispar
FKDDKKKKQNV

SEQ ID NO: 2424988 - protein, 8 aa, Entamoeba dispar
FKDEKDET

SEQ ID NO: 2424989 - protein, 19 aa, Entamoeba dispar
FKDFEKETMSSYEKQRNSY

SEQ ID NO: 2424990 - protein, 9 aa, Entamoeba dispar
FKDQKKSIQ

SEQ ID NO: 2424991 - protein, 8 aa, Entamoeba dispar
FKDQSTNL

SEQ ID NO: 2424992 - protein, 4 aa, Entamoeba dispar
FKDS

SEQ ID NO: 2424993 - protein, 9 aa, Entamoeba dispar
FKDSKTRIT

SEQ ID NO: 2424994 - protein, 6 aa, Entamoeba dispar
FKDSND

SEQ ID NO: 2424995 - protein, 9 aa, Entamoeba dispar
FKEDGNDGV

SEQ ID NO: 2424996 - protein, 12 aa, Entamoeba dispar
FKEDTTNGPLKN

SEQ ID NO: 2424997 - protein, 9 aa, Entamoeba dispar
FKEEEPQIE

SEQ ID NO: 2424998 - protein, 9 aa, Entamoeba dispar
FKEEESPTL

SEQ ID NO: 2424999 - protein, 14 aa, Entamoeba dispar
FKEEKKVGVKQNEN

SEQ ID NO: 2425000 - protein, 60 aa, Entamoeba dispar
FKEENDEVDVKGVENEEEEEEDSETIDTNKEDIIGEEEDFEETRKKAEERKGRRENPYTS

SEQ ID NO: 2425001 - protein, 5 aa, Entamoeba dispar
FKEEV

SEQ ID NO: 2425002 - protein, 11 aa, Entamoeba dispar
FKEGEGIPQKM

SEQ ID NO: 2425003 - protein, 19 aa, Entamoeba dispar
FKEGEKSEEHLPGKKGSTF

SEQ ID NO: 2425004 - protein, 7 aa, Entamoeba dispar
FKEGERI

SEQ ID NO: 2425005 - protein, 12 aa, Entamoeba dispar
FKEGKGRELKDK

SEQ ID NO: 2425006 - protein, 12 aa, Entamoeba dispar
FKEKEDKRIEEA

SEQ ID NO: 2425007 - protein, 8 aa, Entamoeba dispar
FKEKKSEY

SEQ ID NO: 2425008 - protein, 15 aa, Entamoeba dispar
FKEKPVDSNCITPGT

SEQ ID NO: 2425009 - protein, 10 aa, Entamoeba dispar
FKEKSAKLSK

SEQ ID NO: 2425010 - protein, 10 aa, Entamoeba dispar
FKEKTSIKES

SEQ ID NO: 2425011 - protein, 9 aa, Entamoeba dispar
FKELRNSKT

SEQ ID NO: 2425012 - protein, 6 aa, Entamoeba dispar
FKENIN

SEQ ID NO: 2425013 - protein, 7 aa, Entamoeba dispar
FKENQDK

SEQ ID NO: 2425014 - protein, 7 aa, Entamoeba dispar
FKEPESR

SEQ ID NO: 2425015 - protein, 22 aa, Entamoeba dispar
FKEPPPKEQIEQNKNKYDGLDP

SEQ ID NO: 2425016 - protein, 22 aa, Entamoeba dispar
FKEPPPKPQIEQDKSKYAGLDP

SEQ ID NO: 2425017 - protein, 22 aa, Entamoeba dispar
FKEPPPKPQVEQDKNKYDGLDP

SEQ ID NO: 2425018 - protein, 22 aa, Entamoeba dispar
FKEPPPKPQVEQDKSKYDGLDP

SEQ ID NO: 2425019 - protein, 11 aa, Entamoeba dispar
FKEPPPNPELM

SEQ ID NO: 2425020 - protein, 6 aa, Entamoeba dispar
FKESEE

SEQ ID NO: 2425021 - protein, 17 aa, Entamoeba dispar
FKESETTRALKRVKRAM

SEQ ID NO: 2425022 - protein, 11 aa, Entamoeba dispar
FKESLDEAETY

SEQ ID NO: 2425023 - protein, 14 aa, Entamoeba dispar
FKETNEQKKINQKT

SEQ ID NO: 2425024 - protein, 8 aa, Entamoeba dispar
FKETPEDN

SEQ ID NO: 2425025 - protein, 6 aa, Entamoeba dispar
FKGDKS

SEQ ID NO: 2425026 - protein, 4 aa, Entamoeba dispar
FKGE

SEQ ID NO: 2425027 - protein, 11 aa, Entamoeba dispar
FKGESPNELSI

SEQ ID NO: 2425028 - protein, 6 aa, Entamoeba dispar
FKGRRI

SEQ ID NO: 2425029 - protein, 9 aa, Entamoeba dispar
FKGSNNKDQ

SEQ ID NO: 2425030 - protein, 5 aa, Entamoeba dispar
FKGTN

SEQ ID NO: 2425031 - protein, 12 aa, Entamoeba dispar
FKIERDKEQSLK

SEQ ID NO: 2425032 - protein, 11 aa, Entamoeba dispar
FKIQKGEEQSL

SEQ ID NO: 2425033 - protein, 8 aa, Entamoeba dispar
FKKAEEKD

SEQ ID NO: 2425034 - protein, 4 aa, Entamoeba dispar
FKKD

SEQ ID NO: 2425035 - protein, 8 aa, Entamoeba dispar
FKKDEEDD

SEQ ID NO: 2425036 - protein, 9 aa, Entamoeba dispar
FKKDQKSKF

SEQ ID NO: 2425037 - protein, 15 aa, Entamoeba dispar
FKKEEVKESPKGYKK

SEQ ID NO: 2425038 - protein, 12 aa, Entamoeba dispar
FKKEGRRDYDDY

SEQ ID NO: 2425039 - protein, 15 aa, Entamoeba dispar
FKKELQSSVGMSKEV

SEQ ID NO: 2425040 - protein, 11 aa, Entamoeba dispar
FKKENKERLRE

SEQ ID NO: 2425041 - protein, 8 aa, Entamoeba dispar
FKKGPYKT

SEQ ID NO: 2425042 - protein, 13 aa, Entamoeba dispar
FKKKTTKVLKTMD

SEQ ID NO: 2425043 - protein, 13 aa, Entamoeba dispar
FKKPTLSKPPECK

SEQ ID NO: 2425044 - protein, 11 aa, Entamoeba dispar
FKKQAQELAEK

SEQ ID NO: 2425045 - protein, 13 aa, Entamoeba dispar
FKKRGTLYTNTGG

SEQ ID NO: 2425046 - protein, 10 aa, Entamoeba dispar
FKKSEQRYPK

SEQ ID NO: 2425047 - protein, 10 aa, Entamoeba dispar
FKKTGKEAWK

SEQ ID NO: 2425048 - protein, 12 aa, Entamoeba dispar
FKNDDEVEQAPC

SEQ ID NO: 2425049 - protein, 6 aa, Entamoeba dispar
FKNEQV

SEQ ID NO: 2425050 - protein, 16 aa, Entamoeba dispar
FKNFSKGKKTKLDPRF

SEQ ID NO: 2425051 - protein, 12 aa, Entamoeba dispar
FKNKQKQLEQQQ

SEQ ID NO: 2425052 - protein, 25 aa, Entamoeba dispar
FKNLEEKGLGTPTHAAPEGSQDRCT

SEQ ID NO: 2425053 - protein, 17 aa, Entamoeba dispar
FKNNNQINNDSEDEEIH

SEQ ID NO: 2425054 - protein, 12 aa, Entamoeba dispar
FKPEDNPNGLLE

SEQ ID NO: 2425055 - protein, 6 aa, Entamoeba dispar
FKPETM

SEQ ID NO: 2425056 - protein, 13 aa, Entamoeba dispar
FKPGNSNPNSIPK

SEQ ID NO: 2425057 - protein, 12 aa, Entamoeba dispar
FKPKENSREGLK

SEQ ID NO: 2425058 - protein, 4 aa, Entamoeba dispar
FKPL

SEQ ID NO: 2425059 - protein, 12 aa, Entamoeba dispar
FKPNAPPPSKEI

SEQ ID NO: 2425060 - protein, 20 aa, Entamoeba dispar
FKPQATEENSQEKKPKLLQE

SEQ ID NO: 2425061 - protein, 43 aa, Entamoeba dispar
FKPQEQEHTNTPMEEEKPKDIPKTEEKKMEEEVPKKEETQPMD

SEQ ID NO: 2425062 - protein, 14 aa, Entamoeba dispar
FKPSESSTVLNEKG

SEQ ID NO: 2425063 - protein, 10 aa, Entamoeba dispar
FKPSPTTKIN

SEQ ID NO: 2425064 - protein, 24 aa, Entamoeba dispar
FKPSSQQQTGFTGFGQQTQNTGFG

SEQ ID NO: 2425065 - protein, 9 aa, Entamoeba dispar
FKPSTGKKM

SEQ ID NO: 2425066 - protein, 8 aa, Entamoeba dispar
FKPTADSE

SEQ ID NO: 2425067 - protein, 7 aa, Entamoeba dispar
FKPTDSE

SEQ ID NO: 2425068 - protein, 12 aa, Entamoeba dispar
FKPTVQQFGNKT

SEQ ID NO: 2425069 - protein, 7 aa, Entamoeba dispar
FKQEDIE

SEQ ID NO: 2425070 - protein, 7 aa, Entamoeba dispar
FKQENEI

SEQ ID NO: 2425071 - protein, 5 aa, Entamoeba dispar
FKQEP

SEQ ID NO: 2425072 - protein, 14 aa, Entamoeba dispar
FKQKSSKEDQDLVF

SEQ ID NO: 2425073 - protein, 12 aa, Entamoeba dispar
FKQQNRSRRGLQ

SEQ ID NO: 2425074 - protein, 11 aa, Entamoeba dispar
FKQTKSSKKTV

SEQ ID NO: 2425075 - protein, 4 aa, Entamoeba dispar
FKQV

SEQ ID NO: 2425076 - protein, 22 aa, Entamoeba dispar
FKREPSFDTKNKDSLMTGMNPW

SEQ ID NO: 2425077 - protein, 15 aa, Entamoeba dispar
FKRGNLTEINEETNH

SEQ ID NO: 2425078 - protein, 7 aa, Entamoeba dispar
FKRNEFK

SEQ ID NO: 2425079 - protein, 10 aa, Entamoeba dispar
FKRNTDTIHK

SEQ ID NO: 2425080 - protein, 4 aa, Entamoeba dispar
FKRR

SEQ ID NO: 2425081 - protein, 6 aa, Entamoeba dispar
FKRSAK

SEQ ID NO: 2425082 - protein, 9 aa, Entamoeba dispar
FKRSDNKDL

SEQ ID NO: 2425083 - protein, 14 aa, Entamoeba dispar
FKRSDSDREVLEYL

SEQ ID NO: 2425084 - protein, 12 aa, Entamoeba dispar
FKRTRDGKEKIV

SEQ ID NO: 2425085 - protein, 16 aa, Entamoeba dispar
FKSAGYSQKSKQGDIV

SEQ ID NO: 2425086 - protein, 37 aa, Entamoeba dispar
FKSDNTETSTQPQPKIPIKNERSVGTIPQWNEEENQL

SEQ ID NO: 2425087 - protein, 6 aa, Entamoeba dispar
FKSEEI

SEQ ID NO: 2425088 - protein, 17 aa, Entamoeba dispar
FKSENQLKSHENSKKHK

SEQ ID NO: 2425089 - protein, 10 aa, Entamoeba dispar
FKSESNESSV

SEQ ID NO: 2425090 - protein, 31 aa, Entamoeba dispar
FKSETNLDETDRITETKRRSSSLNSEGDVEV

SEQ ID NO: 2425091 - protein, 12 aa, Entamoeba dispar
FKSKPSGKSVKA

SEQ ID NO: 2425092 - protein, 9 aa, Entamoeba dispar
FKSLKRNDA

SEQ ID NO: 2425093 - protein, 28 aa, Entamoeba dispar
FKSPETSETPGKGSVETPRSSPQMEKRV

SEQ ID NO: 2425094 - protein, 10 aa, Entamoeba dispar
FKSQDNKDEI

SEQ ID NO: 2425095 - protein, 8 aa, Entamoeba dispar
FKSSHNSF

SEQ ID NO: 2425096 - protein, 27 aa, Entamoeba dispar
FKSTITKKTEKQTKKEASKVTDKIVSK

SEQ ID NO: 2425097 - protein, 10 aa, Entamoeba dispar
FKSTKKDEPM

SEQ ID NO: 2425098 - protein, 5 aa, Entamoeba dispar
FKTDD

SEQ ID NO: 2425099 - protein, 7 aa, Entamoeba dispar
FKTENQK

SEQ ID NO: 2425100 - protein, 14 aa, Entamoeba dispar
FKTKERERSQLPSH

SEQ ID NO: 2425101 - protein, 8 aa, Entamoeba dispar
FKTNPNRW

SEQ ID NO: 2425102 - protein, 16 aa, Entamoeba dispar
FKTNSGEFKRISVWVC

SEQ ID NO: 2425103 - protein, 30 aa, Entamoeba dispar
FKTNTTSSQQQNPFLSQTSGSFSIQQQSTP

SEQ ID NO: 2425104 - protein, 7 aa, Entamoeba dispar
FKTPSQK

SEQ ID NO: 2425105 - protein, 34 aa, Entamoeba dispar
FKTPTEKSTTNLSTQPATTNPDKLTNSPFSLGGT

SEQ ID NO: 2425106 - protein, 4 aa, Entamoeba dispar
FKTS

SEQ ID NO: 2425107 - protein, 8 aa, Entamoeba dispar
FKTSPNRW

SEQ ID NO: 2425108 - protein, 9 aa, Entamoeba dispar
FKTSPSKWK

SEQ ID NO: 2425109 - protein, 25 aa, Entamoeba dispar
FKVSDGAKSVTQKTKGCYGKGDRSD

SEQ ID NO: 2425110 - protein, 24 aa, Entamoeba dispar
FKVSHSPNPETKTTNGTNGEGDRS

SEQ ID NO: 2425111 - protein, 4 aa, Entamoeba dispar
FKYE

SEQ ID NO: 2425112 - protein, 9 aa, Entamoeba dispar
FKYNPAKAK

SEQ ID NO: 2425113 - protein, 9 aa, Entamoeba dispar
FKYQKAKAQ

SEQ ID NO: 2425114 - protein, 14 aa, Entamoeba dispar
FKYSTRRKSADMTP

SEQ ID NO: 2425115 - protein, 7 aa, Entamoeba dispar
FKYTGTL

SEQ ID NO: 2425116 - protein, 19 aa, Entamoeba dispar
FLEGKDKSSRIQSVGKGGA

SEQ ID NO: 2425117 - protein, 10 aa, Entamoeba dispar
FLEGKKPNTV

SEQ ID NO: 2425118 - protein, 6 aa, Entamoeba dispar
FLGKSD

SEQ ID NO: 2425119 - protein, 16 aa, Entamoeba dispar
FLKGKSVEELKPGNYQ

SEQ ID NO: 2425120 - protein, 12 aa, Entamoeba dispar
FLNEENKCKYSE

SEQ ID NO: 2425121 - protein, 11 aa, Entamoeba dispar
FLQPNSDGTNI

SEQ ID NO: 2425122 - protein, 8 aa, Entamoeba dispar
FLSEPKRS

SEQ ID NO: 2425123 - protein, 16 aa, Entamoeba dispar
FLSSEEKKAKATKPKK

SEQ ID NO: 2425124 - protein, 6 aa, Entamoeba dispar
FMGNPD

SEQ ID NO: 2425125 - protein, 11 aa, Entamoeba dispar
FMQKSGKTEAY

SEQ ID NO: 2425126 - protein, 11 aa, Entamoeba dispar
FMSTPAESATI

SEQ ID NO: 2425127 - protein, 19 aa, Entamoeba dispar
FNAGSMKTRRWKDRGASVA

SEQ ID NO: 2425128 - protein, 7 aa, Entamoeba dispar
FNARGTK

SEQ ID NO: 2425129 - protein, 13 aa, Entamoeba dispar
FNASDNSKQRTIG

SEQ ID NO: 2425130 - protein, 6 aa, Entamoeba dispar
FNDDEA

SEQ ID NO: 2425131 - protein, 13 aa, Entamoeba dispar
FNDDSSEELDNSF

SEQ ID NO: 2425132 - protein, 4 aa, Entamoeba dispar
FNDE

SEQ ID NO: 2425133 - protein, 22 aa, Entamoeba dispar
FNDEENEIKEKITEKPSPHKKK

SEQ ID NO: 2425134 - protein, 6 aa, Entamoeba dispar
FNDEQI

SEQ ID NO: 2425135 - protein, 16 aa, Entamoeba dispar
FNDEQRNQTKKAALSA

SEQ ID NO: 2425136 - protein, 8 aa, Entamoeba dispar
FNDGRSNL

SEQ ID NO: 2425137 - protein, 7 aa, Entamoeba dispar
FNDGTAA

SEQ ID NO: 2425138 - protein, 9 aa, Entamoeba dispar
FNDKDQHDA

SEQ ID NO: 2425139 - protein, 7 aa, Entamoeba dispar
FNDKGQR

SEQ ID NO: 2425140 - protein, 4 aa, Entamoeba dispar
FNDN

SEQ ID NO: 2425141 - protein, 12 aa, Entamoeba dispar
FNDNTKIEFKEE

SEQ ID NO: 2425142 - protein, 7 aa, Entamoeba dispar
FNDPNGK

SEQ ID NO: 2425143 - protein, 8 aa, Entamoeba dispar
FNDQDPSV

SEQ ID NO: 2425144 - protein, 9 aa, Entamoeba dispar
FNDSDDPKI

SEQ ID NO: 2425145 - protein, 14 aa, Entamoeba dispar
FNDSGDNISCIVVR

SEQ ID NO: 2425146 - protein, 15 aa, Entamoeba dispar
FNDSRSAKEQFRQPS

SEQ ID NO: 2425147 - protein, 11 aa, Entamoeba dispar
FNDSSSSPQQK

SEQ ID NO: 2425148 - protein, 4 aa, Entamoeba dispar
FNDY

SEQ ID NO: 2425149 - protein, 4 aa, Entamoeba dispar
FNEA

SEQ ID NO: 2425150 - protein, 8 aa, Entamoeba dispar
FNEEASKI

SEQ ID NO: 2425151 - protein, 5 aa, Entamoeba dispar
FNEED

SEQ ID NO: 2425152 - protein, 6 aa, Entamoeba dispar
FNEEEE

SEQ ID NO: 2425153 - protein, 14 aa, Entamoeba dispar
FNEESQEEKKYEKP

SEQ ID NO: 2425154 - protein, 14 aa, Entamoeba dispar
FNEETKGSNTNTLF

SEQ ID NO: 2425155 - protein, 11 aa, Entamoeba dispar
FNEKNSNKTRL

SEQ ID NO: 2425156 - protein, 9 aa, Entamoeba dispar
FNEKPDYTA

SEQ ID NO: 2425157 - protein, 11 aa, Entamoeba dispar
FNENGDDSEIS

SEQ ID NO: 2425158 - protein, 5 aa, Entamoeba dispar
FNENT

SEQ ID NO: 2425159 - protein, 10 aa, Entamoeba dispar
FNEPGSPITS

SEQ ID NO: 2425160 - protein, 5 aa, Entamoeba dispar
FNEPS

SEQ ID NO: 2425161 - protein, 12 aa, Entamoeba dispar
FNEPTEDEIRGA

SEQ ID NO: 2425162 - protein, 4 aa, Entamoeba dispar
FNEQ

SEQ ID NO: 2425163 - protein, 5 aa, Entamoeba dispar
FNEQS

SEQ ID NO: 2425164 - protein, 4 aa, Entamoeba dispar
FNES

SEQ ID NO: 2425165 - protein, 24 aa, Entamoeba dispar
FNESDNPQSVAKETNGTCGEGDRQ

SEQ ID NO: 2425166 - protein, 24 aa, Entamoeba dispar
FNESNDPQSVTKETIGSYGEGDRQ

SEQ ID NO: 2425167 - protein, 5 aa, Entamoeba dispar
FNETT

SEQ ID NO: 2425168 - protein, 6 aa, Entamoeba dispar
FNEYPK

SEQ ID NO: 2425169 - protein, 5 aa, Entamoeba dispar
FNEYQ

SEQ ID NO: 2425170 - protein, 11 aa, Entamoeba dispar
FNEYQSKNFDE

SEQ ID NO: 2425171 - protein, 4 aa, Entamoeba dispar
FNGK

SEQ ID NO: 2425172 - protein, 9 aa, Entamoeba dispar
FNGKLGTKI

SEQ ID NO: 2425173 - protein, 6 aa, Entamoeba dispar
FNGKSE

SEQ ID NO: 2425174 - protein, 4 aa, Entamoeba dispar
FNGN

SEQ ID NO: 2425175 - protein, 5 aa, Entamoeba dispar
FNGNE

SEQ ID NO: 2425176 - protein, 9 aa, Entamoeba dispar
FNGNESTTV

SEQ ID NO: 2425177 - protein, 15 aa, Entamoeba dispar
FNGNNDTSFYPDSSN

SEQ ID NO: 2425178 - protein, 6 aa, Entamoeba dispar
FNGNSD

SEQ ID NO: 2425179 - protein, 8 aa, Entamoeba dispar
FNGNSGYI

SEQ ID NO: 2425180 - protein, 9 aa, Entamoeba dispar
FNGPEVGEK

SEQ ID NO: 2425181 - protein, 8 aa, Entamoeba dispar
FNGQNTTE

SEQ ID NO: 2425182 - protein, 6 aa, Entamoeba dispar
FNGTEV

SEQ ID NO: 2425183 - protein, 4 aa, Entamoeba dispar
FNIS

SEQ ID NO: 2425184 - protein, 10 aa, Entamoeba dispar
FNITTRGGYR

SEQ ID NO: 2425185 - protein, 7 aa, Entamoeba dispar
FNKDDKY

SEQ ID NO: 2425186 - protein, 4 aa, Entamoeba dispar
FNKE

SEQ ID NO: 2425187 - protein, 17 aa, Entamoeba dispar
FNKEKNRHNDIDDEQEV

SEQ ID NO: 2425188 - protein, 14 aa, Entamoeba dispar
FNKESKLTINTTSA

SEQ ID NO: 2425189 - protein, 6 aa, Entamoeba dispar
FNKEYS

SEQ ID NO: 2425190 - protein, 4 aa, Entamoeba dispar
FNKG

SEQ ID NO: 2425191 - protein, 8 aa, Entamoeba dispar
FNKGFDEK

SEQ ID NO: 2425192 - protein, 11 aa, Entamoeba dispar
FNKKPQPLKHS

SEQ ID NO: 2425193 - protein, 7 aa, Entamoeba dispar
FNKKQKA

SEQ ID NO: 2425194 - protein, 5 aa, Entamoeba dispar
FNKPI

SEQ ID NO: 2425195 - protein, 7 aa, Entamoeba dispar
FNKPTQQ

SEQ ID NO: 2425196 - protein, 4 aa, Entamoeba dispar
FNKS

SEQ ID NO: 2425197 - protein, 9 aa, Entamoeba dispar
FNKSSNGKI

SEQ ID NO: 2425198 - protein, 12 aa, Entamoeba dispar
FNKTKDGKHGHA

SEQ ID NO: 2425199 - protein, 17 aa, Entamoeba dispar
FNKTNNTGSLPKNKEYI

SEQ ID NO: 2425200 - protein, 6 aa, Entamoeba dispar
FNLPNS

SEQ ID NO: 2425201 - protein, 4 aa, Entamoeba dispar
FNND

SEQ ID NO: 2425202 - protein, 65 aa, Entamoeba dispar
FNNDITNTIPEKKDHIQTQRKAVNNTNKINGLSSEISSKTKERVTRSSVYGKKIEKQEKKIEENE

SEQ ID NO: 2425203 - protein, 10 aa, Entamoeba dispar
FNNEKNASVI

SEQ ID NO: 2425204 - protein, 5 aa, Entamoeba dispar
FNNFE

SEQ ID NO: 2425205 - protein, 14 aa, Entamoeba dispar
FNNKYGATRRAQDV

SEQ ID NO: 2425206 - protein, 10 aa, Entamoeba dispar
FNNNESPSTV

SEQ ID NO: 2425207 - protein, 11 aa, Entamoeba dispar
FNNNSSPTSTL

SEQ ID NO: 2425208 - protein, 9 aa, Entamoeba dispar
FNNPTHDDF

SEQ ID NO: 2425209 - protein, 9 aa, Entamoeba dispar
FNNPTRQKK

SEQ ID NO: 2425210 - protein, 10 aa, Entamoeba dispar
FNNQSTDSEL

SEQ ID NO: 2425211 - protein, 12 aa, Entamoeba dispar
FNNSEKSTIGSN

SEQ ID NO: 2425212 - protein, 9 aa, Entamoeba dispar
FNPEGMGVG

SEQ ID NO: 2425213 - protein, 10 aa, Entamoeba dispar
FNPEGNCTQA

SEQ ID NO: 2425214 - protein, 9 aa, Entamoeba dispar
FNPEGTPQI

SEQ ID NO: 2425215 - protein, 16 aa, Entamoeba dispar
FNPNTQNYSEKRKPAY

SEQ ID NO: 2425216 - protein, 6 aa, Entamoeba dispar
FNPPGN

SEQ ID NO: 2425217 - protein, 23 aa, Entamoeba dispar
FNPQPDTTTVVASSQEKDEGSVT

SEQ ID NO: 2425218 - protein, 5 aa, Entamoeba dispar
FNPQS

SEQ ID NO: 2425219 - protein, 29 aa, Entamoeba dispar
FNPQSPESTQTQNQNTNANTVGYGEAPGT

SEQ ID NO: 2425220 - protein, 5 aa, Entamoeba dispar
FNPTQ

SEQ ID NO: 2425221 - protein, 16 aa, Entamoeba dispar
FNPTTQIKEIEEGLEE

SEQ ID NO: 2425222 - protein, 5 aa, Entamoeba dispar
FNPTV

SEQ ID NO: 2425223 - protein, 5 aa, Entamoeba dispar
FNPYE

SEQ ID NO: 2425224 - protein, 5 aa, Entamoeba dispar
FNQDK

SEQ ID NO: 2425225 - protein, 51 aa, Entamoeba dispar
FNQEKRKKGRGTNRKKKDVEEKKEEKEEKKRSGQKRKENIKRGTKRKKTIR

SEQ ID NO: 2425226 - protein, 19 aa, Entamoeba dispar
FNQEQTNAKTSTESIIFTA

SEQ ID NO: 2425227 - protein, 9 aa, Entamoeba dispar
FNQESNDAN

SEQ ID NO: 2425228 - protein, 11 aa, Entamoeba dispar
FNQKQRKTISQ

SEQ ID NO: 2425229 - protein, 4 aa, Entamoeba dispar
FNQL

SEQ ID NO: 2425230 - protein, 14 aa, Entamoeba dispar
FNQNVDNDDSDLPD

SEQ ID NO: 2425231 - protein, 7 aa, Entamoeba dispar
FNQSTSE

SEQ ID NO: 2425232 - protein, 6 aa, Entamoeba dispar
FNQTNN

SEQ ID NO: 2425233 - protein, 9 aa, Entamoeba dispar
FNQVDENDA

SEQ ID NO: 2425234 - protein, 8 aa, Entamoeba dispar
FNQVDESD

SEQ ID NO: 2425235 - protein, 4 aa, Entamoeba dispar
FNRF

SEQ ID NO: 2425236 - protein, 11 aa, Entamoeba dispar
FNRGERNWDSK

SEQ ID NO: 2425237 - protein, 13 aa, Entamoeba dispar
FNRKGNDSGGSWE

SEQ ID NO: 2425238 - protein, 11 aa, Entamoeba dispar
FNRTPSNTREQ

SEQ ID NO: 2425239 - protein, 4 aa, Entamoeba dispar
FNSA

SEQ ID NO: 2425240 - protein, 10 aa, Entamoeba dispar
FNSEGHSTKE

SEQ ID NO: 2425241 - protein, 16 aa, Entamoeba dispar
FNSEQNNITTNESERI

SEQ ID NO: 2425242 - protein, 4 aa, Entamoeba dispar
FNSF

SEQ ID NO: 2425243 - protein, 22 aa, Entamoeba dispar
FNSFTTSNSQNQDTNSNEEEEE

SEQ ID NO: 2425244 - protein, 11 aa, Entamoeba dispar
FNSGDQTYSNG

SEQ ID NO: 2425245 - protein, 8 aa, Entamoeba dispar
FNSGGIPT

SEQ ID NO: 2425246 - protein, 8 aa, Entamoeba dispar
FNSPRETW

SEQ ID NO: 2425247 - protein, 8 aa, Entamoeba dispar
FNSPYRGN

SEQ ID NO: 2425248 - protein, 8 aa, Entamoeba dispar
FNSRGKRL

SEQ ID NO: 2425249 - protein, 13 aa, Entamoeba dispar
FNSRYGNTLSGED

SEQ ID NO: 2425250 - protein, 10 aa, Entamoeba dispar
FNSSDETVLE

SEQ ID NO: 2425251 - protein, 10 aa, Entamoeba dispar
FNSSKEEKLK

SEQ ID NO: 2425252 - protein, 14 aa, Entamoeba dispar
FNSSLTTMKSLFPL

SEQ ID NO: 2425253 - protein, 5 aa, Entamoeba dispar
FNSSN

SEQ ID NO: 2425254 - protein, 8 aa, Entamoeba dispar
FNSSSVSA

SEQ ID NO: 2425255 - protein, 22 aa, Entamoeba dispar
FNSTDETKNNEKPKEDNQPNNI

SEQ ID NO: 2425256 - protein, 9 aa, Entamoeba dispar
FNSTDNLNT

SEQ ID NO: 2425257 - protein, 9 aa, Entamoeba dispar
FNSTNESNS

SEQ ID NO: 2425258 - protein, 14 aa, Entamoeba dispar
FNSYDKSEFVRLAS

SEQ ID NO: 2425259 - protein, 8 aa, Entamoeba dispar
FNTAPNGY

SEQ ID NO: 2425260 - protein, 4 aa, Entamoeba dispar
FNTD

SEQ ID NO: 2425261 - protein, 22 aa, Entamoeba dispar
FNTDDSEKKESDSKNKKKPEGN

SEQ ID NO: 2425262 - protein, 7 aa, Entamoeba dispar
FNTEEEI

SEQ ID NO: 2425263 - protein, 16 aa, Entamoeba dispar
FNTNNDNIAIKLSSLY

SEQ ID NO: 2425264 - protein, 11 aa, Entamoeba dispar
FNTPQEFKTTP

SEQ ID NO: 2425265 - protein, 7 aa, Entamoeba dispar
FNTSEMK

SEQ ID NO: 2425266 - protein, 10 aa, Entamoeba dispar
FNTSNTLDTD

SEQ ID NO: 2425267 - protein, 8 aa, Entamoeba dispar
FNTSSSIN

SEQ ID NO: 2425268 - protein, 12 aa, Entamoeba dispar
FNTSTPTPVIEP

SEQ ID NO: 2425269 - protein, 14 aa, Entamoeba dispar
FNTTPIKSSVPAEV

SEQ ID NO: 2425270 - protein, 7 aa, Entamoeba dispar
FNVPPTR

SEQ ID NO: 2425271 - protein, 6 aa, Entamoeba dispar
FNVPTQ

SEQ ID NO: 2425272 - protein, 14 aa, Entamoeba dispar
FNVSNAKKISTPDY

SEQ ID NO: 2425273 - protein, 13 aa, Entamoeba dispar
FNYTSSSINPRYQ

SEQ ID NO: 2425274 - protein, 5 aa, Entamoeba dispar
FPDGE

SEQ ID NO: 2425275 - protein, 5 aa, Entamoeba dispar
FPDGS

SEQ ID NO: 2425276 - protein, 13 aa, Entamoeba dispar
FPDPSKSIEEKKE

SEQ ID NO: 2425277 - protein, 10 aa, Entamoeba dispar
FPDSNKYTKD

SEQ ID NO: 2425278 - protein, 12 aa, Entamoeba dispar
FPDSPHHPEFPS

SEQ ID NO: 2425279 - protein, 10 aa, Entamoeba dispar
FPEDDDENEF

SEQ ID NO: 2425280 - protein, 7 aa, Entamoeba dispar
FPEDQSE

SEQ ID NO: 2425281 - protein, 5 aa, Entamoeba dispar
FPEFT

SEQ ID NO: 2425282 - protein, 4 aa, Entamoeba dispar
FPEG

SEQ ID NO: 2425283 - protein, 9 aa, Entamoeba dispar
FPEKKQLNS

SEQ ID NO: 2425284 - protein, 13 aa, Entamoeba dispar
FPEQERATHKSSI

SEQ ID NO: 2425285 - protein, 6 aa, Entamoeba dispar
FPESAI

SEQ ID NO: 2425286 - protein, 29 aa, Entamoeba dispar
FPESLSDPHSARSSPDIVNKRERDSKSVD

SEQ ID NO: 2425287 - protein, 5 aa, Entamoeba dispar
FPFSD

SEQ ID NO: 2425288 - protein, 5 aa, Entamoeba dispar
FPGEK

SEQ ID NO: 2425289 - protein, 21 aa, Entamoeba dispar
FPGFSSRTSCNMQDSTEPEEH

SEQ ID NO: 2425290 - protein, 6 aa, Entamoeba dispar
FPGNYD

SEQ ID NO: 2425291 - protein, 9 aa, Entamoeba dispar
FPGSSTSDQ

SEQ ID NO: 2425292 - protein, 26 aa, Entamoeba dispar
FPITPRSQNKQSEFKPLQTTKIDEQN

SEQ ID NO: 2425293 - protein, 7 aa, Entamoeba dispar
FPKEIQP

SEQ ID NO: 2425294 - protein, 6 aa, Entamoeba dispar
FPKETN

SEQ ID NO: 2425295 - protein, 20 aa, Entamoeba dispar
FPKPEKQEKKIEEKDKKEEE

SEQ ID NO: 2425296 - protein, 11 aa, Entamoeba dispar
FPKPNKVENGP

SEQ ID NO: 2425297 - protein, 9 aa, Entamoeba dispar
FPKTGTNTL

SEQ ID NO: 2425298 - protein, 7 aa, Entamoeba dispar
FPLGPAG

SEQ ID NO: 2425299 - protein, 5 aa, Entamoeba dispar
FPLPS

SEQ ID NO: 2425300 - protein, 17 aa, Entamoeba dispar
FPLQEKKKRSKPKTFDK

SEQ ID NO: 2425301 - protein, 7 aa, Entamoeba dispar
FPNAASD

SEQ ID NO: 2425302 - protein, 5 aa, Entamoeba dispar
FPNED

SEQ ID NO: 2425303 - protein, 13 aa, Entamoeba dispar
FPNEEAKEECIDE

SEQ ID NO: 2425304 - protein, 8 aa, Entamoeba dispar
FPNGIDGN

SEQ ID NO: 2425305 - protein, 11 aa, Entamoeba dispar
FPNKFQERPEP

SEQ ID NO: 2425306 - protein, 9 aa, Entamoeba dispar
FPNKSSQQI

SEQ ID NO: 2425307 - protein, 15 aa, Entamoeba dispar
FPNPEDKEDEVEYPI

SEQ ID NO: 2425308 - protein, 11 aa, Entamoeba dispar
FPNPEEGKGAL

SEQ ID NO: 2425309 - protein, 17 aa, Entamoeba dispar
FPNQSQSSSEDNNTQGI

SEQ ID NO: 2425310 - protein, 4 aa, Entamoeba dispar
FPNR

SEQ ID NO: 2425311 - protein, 12 aa, Entamoeba dispar
FPNTSDPGNLEN

SEQ ID NO: 2425312 - protein, 4 aa, Entamoeba dispar
FPNY

SEQ ID NO: 2425313 - protein, 7 aa, Entamoeba dispar
FPPEPNG

SEQ ID NO: 2425314 - protein, 7 aa, Entamoeba dispar
FPPEPSG

SEQ ID NO: 2425315 - protein, 12 aa, Entamoeba dispar
FPPFDGDISTKI

SEQ ID NO: 2425316 - protein, 9 aa, Entamoeba dispar
FPPKPEEAA

SEQ ID NO: 2425317 - protein, 20 aa, Entamoeba dispar
FPPKQTTNTFDSDEFNPMEI

SEQ ID NO: 2425318 - protein, 6 aa, Entamoeba dispar
FPPKTV

SEQ ID NO: 2425319 - protein, 17 aa, Entamoeba dispar
FPPNEYPENGEIPCNDE

SEQ ID NO: 2425320 - protein, 5 aa, Entamoeba dispar
FPPPI

SEQ ID NO: 2425321 - protein, 18 aa, Entamoeba dispar
FPPRPKTGFSTPTKKKSR

SEQ ID NO: 2425322 - protein, 5 aa, Entamoeba dispar
FPPSR

SEQ ID NO: 2425323 - protein, 10 aa, Entamoeba dispar
FPPTEEEAKR

SEQ ID NO: 2425324 - protein, 7 aa, Entamoeba dispar
FPPTGGW

SEQ ID NO: 2425325 - protein, 11 aa, Entamoeba dispar
FPQEEDQNNKK

SEQ ID NO: 2425326 - protein, 11 aa, Entamoeba dispar
FPQNDTPASFS

SEQ ID NO: 2425327 - protein, 9 aa, Entamoeba dispar
FPQPHQKAG

SEQ ID NO: 2425328 - protein, 22 aa, Entamoeba dispar
FPQQAPPQFPTTQYPDQTYTPL

SEQ ID NO: 2425329 - protein, 10 aa, Entamoeba dispar
FPQQPTQQNE

SEQ ID NO: 2425330 - protein, 6 aa, Entamoeba dispar
FPQSEP

SEQ ID NO: 2425331 - protein, 6 aa, Entamoeba dispar
FPQSIK

SEQ ID NO: 2425332 - protein, 4 aa, Entamoeba dispar
FPQT

SEQ ID NO: 2425333 - protein, 6 aa, Entamoeba dispar
FPQTGD

SEQ ID NO: 2425334 - protein, 9 aa, Entamoeba dispar
FPQTKKQYQ

SEQ ID NO: 2425335 - protein, 4 aa, Entamoeba dispar
FPRD

SEQ ID NO: 2425336 - protein, 7 aa, Entamoeba dispar
FPRSEDK

SEQ ID NO: 2425337 - protein, 5 aa, Entamoeba dispar
FPSAQ

SEQ ID NO: 2425338 - protein, 11 aa, Entamoeba dispar
FPSASYPSADC

SEQ ID NO: 2425339 - protein, 4 aa, Entamoeba dispar
FPSK

SEQ ID NO: 2425340 - protein, 4 aa, Entamoeba dispar
FPSL

SEQ ID NO: 2425341 - protein, 8 aa, Entamoeba dispar
FPSNKRPN

SEQ ID NO: 2425342 - protein, 7 aa, Entamoeba dispar
FPSNPPK

SEQ ID NO: 2425343 - protein, 6 aa, Entamoeba dispar
FPSRIS

SEQ ID NO: 2425344 - protein, 4 aa, Entamoeba dispar
FPSS

SEQ ID NO: 2425345 - protein, 8 aa, Entamoeba dispar
FPSSGNDV

SEQ ID NO: 2425346 - protein, 12 aa, Entamoeba dispar
FPSSKSKIPSPI

SEQ ID NO: 2425347 - protein, 7 aa, Entamoeba dispar
FPSSSSI

SEQ ID NO: 2425348 - protein, 7 aa, Entamoeba dispar
FPSTNDE

SEQ ID NO: 2425349 - protein, 5 aa, Entamoeba dispar
FPSYQ

SEQ ID NO: 2425350 - protein, 6 aa, Entamoeba dispar
FPTEDK

SEQ ID NO: 2425351 - protein, 31 aa, Entamoeba dispar
FPTESKTSKLTQSSSGKTNNSKDISGDDWGD

SEQ ID NO: 2425352 - protein, 6 aa, Entamoeba dispar
FPTESR

SEQ ID NO: 2425353 - protein, 4 aa, Entamoeba dispar
FPTG

SEQ ID NO: 2425354 - protein, 7 aa, Entamoeba dispar
FPTNSNG

SEQ ID NO: 2425355 - protein, 4 aa, Entamoeba dispar
FPTP

SEQ ID NO: 2425356 - protein, 8 aa, Entamoeba dispar
FPTPNEEA

SEQ ID NO: 2425357 - protein, 9 aa, Entamoeba dispar
FPTPNGIGD

SEQ ID NO: 2425358 - protein, 5 aa, Entamoeba dispar
FPTPR

SEQ ID NO: 2425359 - protein, 5 aa, Entamoeba dispar
FPTPS

SEQ ID NO: 2425360 - protein, 20 aa, Entamoeba dispar
FPTPSQQNLFPTPSQQTQQL

SEQ ID NO: 2425361 - protein, 5 aa, Entamoeba dispar
FPTSE

SEQ ID NO: 2425362 - protein, 6 aa, Entamoeba dispar
FPTSSI

SEQ ID NO: 2425363 - protein, 4 aa, Entamoeba dispar
FPTT

SEQ ID NO: 2425364 - protein, 5 aa, Entamoeba dispar
FPVEP

SEQ ID NO: 2425365 - protein, 5 aa, Entamoeba dispar
FPVNS

SEQ ID NO: 2425366 - protein, 4 aa, Entamoeba dispar
FPVP

SEQ ID NO: 2425367 - protein, 14 aa, Entamoeba dispar
FQAPNKSSITSSQF

SEQ ID NO: 2425368 - protein, 4 aa, Entamoeba dispar
FQAT

SEQ ID NO: 2425369 - protein, 15 aa, Entamoeba dispar
FQDCDGVKKQEEHTK

SEQ ID NO: 2425370 - protein, 8 aa, Entamoeba dispar
FQDGKLSK

SEQ ID NO: 2425371 - protein, 13 aa, Entamoeba dispar
FQEISKPNDKCSL

SEQ ID NO: 2425372 - protein, 11 aa, Entamoeba dispar
FQENENSITYG

SEQ ID NO: 2425373 - protein, 9 aa, Entamoeba dispar
FQEPPTSGA

SEQ ID NO: 2425374 - protein, 16 aa, Entamoeba dispar
FQERRDARCRDRNRNY

SEQ ID NO: 2425375 - protein, 8 aa, Entamoeba dispar
FQGIETPE

SEQ ID NO: 2425376 - protein, 4 aa, Entamoeba dispar
FQGN

SEQ ID NO: 2425377 - protein, 8 aa, Entamoeba dispar
FQINTEKE

SEQ ID NO: 2425378 - protein, 14 aa, Entamoeba dispar
FQKETEENKIPPWE

SEQ ID NO: 2425379 - protein, 12 aa, Entamoeba dispar
FQKIKGKTQHLS

SEQ ID NO: 2425380 - protein, 9 aa, Entamoeba dispar
FQKNEKTNE

SEQ ID NO: 2425381 - protein, 10 aa, Entamoeba dispar
FQNEPSPITV

SEQ ID NO: 2425382 - protein, 13 aa, Entamoeba dispar
FQNSGYPQSIPPN

SEQ ID NO: 2425383 - protein, 7 aa, Entamoeba dispar
FQNTPEV

SEQ ID NO: 2425384 - protein, 10 aa, Entamoeba dispar
FQPEKKTPNI

SEQ ID NO: 2425385 - protein, 16 aa, Entamoeba dispar
FQPNSHKFDEDSLTSF

SEQ ID NO: 2425386 - protein, 6 aa, Entamoeba dispar
FQPQTV

SEQ ID NO: 2425387 - protein, 4 aa, Entamoeba dispar
FQPT

SEQ ID NO: 2425388 - protein, 8 aa, Entamoeba dispar
FQPTDNKT

SEQ ID NO: 2425389 - protein, 11 aa, Entamoeba dispar
FQPTDPKIKEK

SEQ ID NO: 2425390 - protein, 5 aa, Entamoeba dispar
FQPTN

SEQ ID NO: 2425391 - protein, 5 aa, Entamoeba dispar
FQQQP

SEQ ID NO: 2425392 - protein, 9 aa, Entamoeba dispar
FQRGSSPAE

SEQ ID NO: 2425393 - protein, 7 aa, Entamoeba dispar
FQRRKSG

SEQ ID NO: 2425394 - protein, 7 aa, Entamoeba dispar
FQRTGTP

SEQ ID NO: 2425395 - protein, 10 aa, Entamoeba dispar
FQSASSPIKE

SEQ ID NO: 2425396 - protein, 16 aa, Entamoeba dispar
FQSDSQLKRKTLQRRM

SEQ ID NO: 2425397 - protein, 8 aa, Entamoeba dispar
FQSDTPSS

SEQ ID NO: 2425398 - protein, 16 aa, Entamoeba dispar
FQSENNSTNKLNDQTE

SEQ ID NO: 2425399 - protein, 9 aa, Entamoeba dispar
FQSKQQRNE

SEQ ID NO: 2425400 - protein, 6 aa, Entamoeba dispar
FQSNTL

SEQ ID NO: 2425401 - protein, 15 aa, Entamoeba dispar
FQSPQQQGLTQQQTS

SEQ ID NO: 2425402 - protein, 35 aa, Entamoeba dispar
FQTAASSIKKSTLSISNNSNVSINTSSSNKNEGGC

SEQ ID NO: 2425403 - protein, 5 aa, Entamoeba dispar
FQTDN

SEQ ID NO: 2425404 - protein, 9 aa, Entamoeba dispar
FQTEPKQCQ

SEQ ID NO: 2425405 - protein, 17 aa, Entamoeba dispar
FQTKESKEEKEKVDEKI

SEQ ID NO: 2425406 - protein, 20 aa, Entamoeba dispar
FQTPIQTPQRIDSSEQLTPN

SEQ ID NO: 2425407 - protein, 6 aa, Entamoeba dispar
FQTSKE

SEQ ID NO: 2425408 - protein, 12 aa, Entamoeba dispar
FQYDKSGEDHYN

SEQ ID NO: 2425409 - protein, 5 aa, Entamoeba dispar
FRAGA

SEQ ID NO: 2425410 - protein, 11 aa, Entamoeba dispar
FRDKGNSSSSL

SEQ ID NO: 2425411 - protein, 8 aa, Entamoeba dispar
FREDNREK

SEQ ID NO: 2425412 - protein, 5 aa, Entamoeba dispar
FREEG

SEQ ID NO: 2425413 - protein, 7 aa, Entamoeba dispar
FREPPGA

SEQ ID NO: 2425414 - protein, 15 aa, Entamoeba dispar
FRETLDSYTSNPIPL

SEQ ID NO: 2425415 - protein, 8 aa, Entamoeba dispar
FRGNPEEA

SEQ ID NO: 2425416 - protein, 7 aa, Entamoeba dispar
FRGSNEN

SEQ ID NO: 2425417 - protein, 7 aa, Entamoeba dispar
FRGSTTA

SEQ ID NO: 2425418 - protein, 11 aa, Entamoeba dispar
FRKDNKQTITE

SEQ ID NO: 2425419 - protein, 9 aa, Entamoeba dispar
FRKDTGSLM

SEQ ID NO: 2425420 - protein, 10 aa, Entamoeba dispar
FRKKPKMKKY

SEQ ID NO: 2425421 - protein, 7 aa, Entamoeba dispar
FRKRKSK

SEQ ID NO: 2425422 - protein, 6 aa, Entamoeba dispar
FRNGSL

SEQ ID NO: 2425423 - protein, 10 aa, Entamoeba dispar
FRNPEGDIRT

SEQ ID NO: 2425424 - protein, 4 aa, Entamoeba dispar
FRNT

SEQ ID NO: 2425425 - protein, 9 aa, Entamoeba dispar
FRPGNTNPK

SEQ ID NO: 2425426 - protein, 43 aa, Entamoeba dispar
FRPKTKKDKQEKINKHKEAKVEIKEDPSKKNRFNQIESSTDVI

SEQ ID NO: 2425427 - protein, 10 aa, Entamoeba dispar
FRPPGAPALK

SEQ ID NO: 2425428 - protein, 5 aa, Entamoeba dispar
FRQQT

SEQ ID NO: 2425429 - protein, 5 aa, Entamoeba dispar
FRRRR

SEQ ID NO: 2425430 - protein, 9 aa, Entamoeba dispar
FRRTPAQDE

SEQ ID NO: 2425431 - protein, 4 aa, Entamoeba dispar
FRSK

SEQ ID NO: 2425432 - protein, 5 aa, Entamoeba dispar
FRSKD

SEQ ID NO: 2425433 - protein, 8 aa, Entamoeba dispar
FRTNPNKW

SEQ ID NO: 2425434 - protein, 21 aa, Entamoeba dispar
FRVEEKGNQERQTTPSQELYE

SEQ ID NO: 2425435 - protein, 5 aa, Entamoeba dispar
FSADE

SEQ ID NO: 2425436 - protein, 6 aa, Entamoeba dispar
FSAEGY

SEQ ID NO: 2425437 - protein, 6 aa, Entamoeba dispar
FSAGTK

SEQ ID NO: 2425438 - protein, 4 aa, Entamoeba dispar
FSCN

SEQ ID NO: 2425439 - protein, 4 aa, Entamoeba dispar
FSDE

SEQ ID NO: 2425440 - protein, 6 aa, Entamoeba dispar
FSDEER

SEQ ID NO: 2425441 - protein, 5 aa, Entamoeba dispar
FSDGD

SEQ ID NO: 2425442 - protein, 5 aa, Entamoeba dispar
FSDGE

SEQ ID NO: 2425443 - protein, 11 aa, Entamoeba dispar
FSDGEEKLEGK

SEQ ID NO: 2425444 - protein, 9 aa, Entamoeba dispar
FSDGSEVYP

SEQ ID NO: 2425445 - protein, 13 aa, Entamoeba dispar
FSDPDDSTNRERD

SEQ ID NO: 2425446 - protein, 4 aa, Entamoeba dispar
FSDS

SEQ ID NO: 2425447 - protein, 6 aa, Entamoeba dispar
FSDSKV

SEQ ID NO: 2425448 - protein, 10 aa, Entamoeba dispar
FSDTQSLTLP

SEQ ID NO: 2425449 - protein, 29 aa, Entamoeba dispar
FSDTYGKLKEVPSSFNVSTEKKKKKKKFG

SEQ ID NO: 2425450 - protein, 4 aa, Entamoeba dispar
FSEA

SEQ ID NO: 2425451 - protein, 12 aa, Entamoeba dispar
FSEDAKKSETTE

SEQ ID NO: 2425452 - protein, 8 aa, Entamoeba dispar
FSEDNPTI

SEQ ID NO: 2425453 - protein, 6 aa, Entamoeba dispar
FSEEEK

SEQ ID NO: 2425454 - protein, 9 aa, Entamoeba dispar
FSEEKKQLN

SEQ ID NO: 2425455 - protein, 7 aa, Entamoeba dispar
FSEGDHS

SEQ ID NO: 2425456 - protein, 14 aa, Entamoeba dispar
FSEGDSNNSVTKDT

SEQ ID NO: 2425457 - protein, 19 aa, Entamoeba dispar
FSEGGEKDLGHPPMDESDQ

SEQ ID NO: 2425458 - protein, 11 aa, Entamoeba dispar
FSEGSKRISPE

SEQ ID NO: 2425459 - protein, 9 aa, Entamoeba dispar
FSEHDSKQI

SEQ ID NO: 2425460 - protein, 24 aa, Entamoeba dispar
FSENDGAKSVTQKTMGDSGEGDRK

SEQ ID NO: 2425461 - protein, 14 aa, Entamoeba dispar
FSENSTDDYQKYSV

SEQ ID NO: 2425462 - protein, 7 aa, Entamoeba dispar
FSENTDS

SEQ ID NO: 2425463 - protein, 8 aa, Entamoeba dispar
FSEQGTPT

SEQ ID NO: 2425464 - protein, 5 aa, Entamoeba dispar
FSETD

SEQ ID NO: 2425465 - protein, 9 aa, Entamoeba dispar
FSETNTEDM

SEQ ID NO: 2425466 - protein, 10 aa, Entamoeba dispar
FSEVTKSTVG

SEQ ID NO: 2425467 - protein, 10 aa, Entamoeba dispar
FSGFSTKTES

SEQ ID NO: 2425468 - protein, 18 aa, Entamoeba dispar
FSGGRNTTEEHRKLGGQC

SEQ ID NO: 2425469 - protein, 10 aa, Entamoeba dispar
FSGKGNKVPI

SEQ ID NO: 2425470 - protein, 5 aa, Entamoeba dispar
FSGKV

SEQ ID NO: 2425471 - protein, 6 aa, Entamoeba dispar
FSGNGA

SEQ ID NO: 2425472 - protein, 6 aa, Entamoeba dispar
FSGNTK

SEQ ID NO: 2425473 - protein, 6 aa, Entamoeba dispar
FSGPVK

SEQ ID NO: 2425474 - protein, 9 aa, Entamoeba dispar
FSGSRGLKE

SEQ ID NO: 2425475 - protein, 6 aa, Entamoeba dispar
FSGTKG

SEQ ID NO: 2425476 - protein, 6 aa, Entamoeba dispar
FSGVST

SEQ ID NO: 2425477 - protein, 4 aa, Entamoeba dispar
FSHD

SEQ ID NO: 2425478 - protein, 34 aa, Entamoeba dispar
FSHSENSIHEDTPTKSPVIATSPTRREKHTLDTR

SEQ ID NO: 2425479 - protein, 6 aa, Entamoeba dispar
FSIEKQ

SEQ ID NO: 2425480 - protein, 11 aa, Entamoeba dispar
FSISTEKDPEL

SEQ ID NO: 2425481 - protein, 4 aa, Entamoeba dispar
FSKA

SEQ ID NO: 2425482 - protein, 16 aa, Entamoeba dispar
FSKDEDDIKPPTEEDI

SEQ ID NO: 2425483 - protein, 7 aa, Entamoeba dispar
FSKDGKK

SEQ ID NO: 2425484 - protein, 12 aa, Entamoeba dispar
FSKEPQPDDKTK

SEQ ID NO: 2425485 - protein, 5 aa, Entamoeba dispar
FSKET

SEQ ID NO: 2425486 - protein, 8 aa, Entamoeba dispar
FSKKNPSI

SEQ ID NO: 2425487 - protein, 16 aa, Entamoeba dispar
FSKPQNHSRPPKTAQA

SEQ ID NO: 2425488 - protein, 5 aa, Entamoeba dispar
FSKPT

SEQ ID NO: 2425489 - protein, 13 aa, Entamoeba dispar
FSKQTNEEKKELE

SEQ ID NO: 2425490 - protein, 13 aa, Entamoeba dispar
FSKQTSNGYNSKT

SEQ ID NO: 2425491 - protein, 4 aa, Entamoeba dispar
FSKS

SEQ ID NO: 2425492 - protein, 15 aa, Entamoeba dispar
FSKSELNGLKKNSQY

SEQ ID NO: 2425493 - protein, 9 aa, Entamoeba dispar
FSKSSGLTV

SEQ ID NO: 2425494 - protein, 4 aa, Entamoeba dispar
FSLT

SEQ ID NO: 2425495 - protein, 9 aa, Entamoeba dispar
FSNAQSEGE

SEQ ID NO: 2425496 - protein, 4 aa, Entamoeba dispar
FSNE

SEQ ID NO: 2425497 - protein, 9 aa, Entamoeba dispar
FSNENESAV

SEQ ID NO: 2425498 - protein, 6 aa, Entamoeba dispar
FSNGKW

SEQ ID NO: 2425499 - protein, 11 aa, Entamoeba dispar
FSNKKKQQKLK

SEQ ID NO: 2425500 - protein, 15 aa, Entamoeba dispar
FSNNEEIKKIQDDKK

SEQ ID NO: 2425501 - protein, 5 aa, Entamoeba dispar
FSNPN

SEQ ID NO: 2425502 - protein, 6 aa, Entamoeba dispar
FSNPRK

SEQ ID NO: 2425503 - protein, 4 aa, Entamoeba dispar
FSNQ

SEQ ID NO: 2425504 - protein, 5 aa, Entamoeba dispar
FSNQT

SEQ ID NO: 2425505 - protein, 13 aa, Entamoeba dispar
FSNRYSTGSEGFY

SEQ ID NO: 2425506 - protein, 5 aa, Entamoeba dispar
FSNSD

SEQ ID NO: 2425507 - protein, 10 aa, Entamoeba dispar
FSNSLGETST

SEQ ID NO: 2425508 - protein, 13 aa, Entamoeba dispar
FSNSNNKNTDSCR

SEQ ID NO: 2425509 - protein, 56 aa, Entamoeba dispar
FSNSTEKQKDTFTGKTSLSDKPKSTETNTEKQTTTTLTTNTDKTTSTTVEQTNTNM

SEQ ID NO: 2425510 - protein, 55 aa, Entamoeba dispar
FSNTKQSSTYQSKRRSNGGDSYIDERKREFKDDYQQKRKTEQHPTEYHNQQPETY

SEQ ID NO: 2425511 - protein, 53 aa, Entamoeba dispar
FSNTKQSSTYQSKRRSNGGDSYIDERKRELKDDYQQKRKNKFSSNPSYQQRSF

SEQ ID NO: 2425512 - protein, 7 aa, Entamoeba dispar
FSNTTEN

SEQ ID NO: 2425513 - protein, 9 aa, Entamoeba dispar
FSPAAPTEF

SEQ ID NO: 2425514 - protein, 21 aa, Entamoeba dispar
FSPAPSQDEFPNTKHVPSFLF

SEQ ID NO: 2425515 - protein, 7 aa, Entamoeba dispar
FSPDGSY

SEQ ID NO: 2425516 - protein, 16 aa, Entamoeba dispar
FSPDSRSLVTASAQGT

SEQ ID NO: 2425517 - protein, 4 aa, Entamoeba dispar
FSPE

SEQ ID NO: 2425518 - protein, 5 aa, Entamoeba dispar
FSPEI

SEQ ID NO: 2425519 - protein, 6 aa, Entamoeba dispar
FSPEVN

SEQ ID NO: 2425520 - protein, 7 aa, Entamoeba dispar
FSPKELN

SEQ ID NO: 2425521 - protein, 9 aa, Entamoeba dispar
FSPKPISNN

SEQ ID NO: 2425522 - protein, 9 aa, Entamoeba dispar
FSPKTYEKY

SEQ ID NO: 2425523 - protein, 4 aa, Entamoeba dispar
FSPN

SEQ ID NO: 2425524 - protein, 5 aa, Entamoeba dispar
FSPND

SEQ ID NO: 2425525 - protein, 7 aa, Entamoeba dispar
FSPNGDY

SEQ ID NO: 2425526 - protein, 7 aa, Entamoeba dispar
FSPNGKM

SEQ ID NO: 2425527 - protein, 7 aa, Entamoeba dispar
FSPNNQK

SEQ ID NO: 2425528 - protein, 5 aa, Entamoeba dispar
FSPNS

SEQ ID NO: 2425529 - protein, 8 aa, Entamoeba dispar
FSPPRTAL

SEQ ID NO: 2425530 - protein, 6 aa, Entamoeba dispar
FSPRTM

SEQ ID NO: 2425531 - protein, 20 aa, Entamoeba dispar
FSPRTPKSLRSSGTSSPIEL

SEQ ID NO: 2425532 - protein, 10 aa, Entamoeba dispar
FSPTTESTVG

SEQ ID NO: 2425533 - protein, 11 aa, Entamoeba dispar
FSQDSGSIGVT

SEQ ID NO: 2425534 - protein, 5 aa, Entamoeba dispar
FSQEH

SEQ ID NO: 2425535 - protein, 8 aa, Entamoeba dispar
FSQELSES

SEQ ID NO: 2425536 - protein, 9 aa, Entamoeba dispar
FSQGNKDNV

SEQ ID NO: 2425537 - protein, 19 aa, Entamoeba dispar
FSQNNPQPKIQQSTQEPKS

SEQ ID NO: 2425538 - protein, 10 aa, Entamoeba dispar
FSQPQDPEIN

SEQ ID NO: 2425539 - protein, 7 aa, Entamoeba dispar
FSQQQQP

SEQ ID NO: 2425540 - protein, 19 aa, Entamoeba dispar
FSQSKYKSYLTQKEAEDAF

SEQ ID NO: 2425541 - protein, 8 aa, Entamoeba dispar
FSQTKNLN

SEQ ID NO: 2425542 - protein, 6 aa, Entamoeba dispar
FSRESH

SEQ ID NO: 2425543 - protein, 10 aa, Entamoeba dispar
FSRKGNKVPI

SEQ ID NO: 2425544 - protein, 11 aa, Entamoeba dispar
FSRPGGRETGF

SEQ ID NO: 2425545 - protein, 9 aa, Entamoeba dispar
FSRRSSLTS

SEQ ID NO: 2425546 - protein, 10 aa, Entamoeba dispar
FSRTDDPGWT

SEQ ID NO: 2425547 - protein, 12 aa, Entamoeba dispar
FSRTPGSPMPDF

SEQ ID NO: 2425548 - protein, 6 aa, Entamoeba dispar
FSSDNY

SEQ ID NO: 2425549 - protein, 6 aa, Entamoeba dispar
FSSEQT

SEQ ID NO: 2425550 - protein, 6 aa, Entamoeba dispar
FSSGIT

SEQ ID NO: 2425551 - protein, 9 aa, Entamoeba dispar
FSSGSFNDI

SEQ ID NO: 2425552 - protein, 9 aa, Entamoeba dispar
FSSHPPNLE

SEQ ID NO: 2425553 - protein, 4 aa, Entamoeba dispar
FSSK

SEQ ID NO: 2425554 - protein, 7 aa, Entamoeba dispar
FSSKEHE

SEQ ID NO: 2425555 - protein, 53 aa, Entamoeba dispar
FSSKKEEEEARLQQKLEKKKRIEKRKEIEDKKKKDEEEKKKNKTVRGKAGKMK

SEQ ID NO: 2425556 - protein, 9 aa, Entamoeba dispar
FSSKNDKLR

SEQ ID NO: 2425557 - protein, 4 aa, Entamoeba dispar
FSSN

SEQ ID NO: 2425558 - protein, 8 aa, Entamoeba dispar
FSSNEKRV

SEQ ID NO: 2425559 - protein, 24 aa, Entamoeba dispar
FSSNFASSHPFESTTLTGKVNPNK

SEQ ID NO: 2425560 - protein, 9 aa, Entamoeba dispar
FSSNRSENG

SEQ ID NO: 2425561 - protein, 4 aa, Entamoeba dispar
FSSP

SEQ ID NO: 2425562 - protein, 5 aa, Entamoeba dispar
FSSPD

SEQ ID NO: 2425563 - protein, 5 aa, Entamoeba dispar
FSSPS

SEQ ID NO: 2425564 - protein, 4 aa, Entamoeba dispar
FSSQ

SEQ ID NO: 2425565 - protein, 11 aa, Entamoeba dispar
FSSRGGDINGN

SEQ ID NO: 2425566 - protein, 10 aa, Entamoeba dispar
FSSRHGQKGT

SEQ ID NO: 2425567 - protein, 9 aa, Entamoeba dispar
FSSSEYLQQ

SEQ ID NO: 2425568 - protein, 12 aa, Entamoeba dispar
FSSSNESNIPER

SEQ ID NO: 2425569 - protein, 14 aa, Entamoeba dispar
FSSSPINQEDKKRT

SEQ ID NO: 2425570 - protein, 9 aa, Entamoeba dispar
FSSSPNTSI

SEQ ID NO: 2425571 - protein, 33 aa, Entamoeba dispar
FSSSPSYSPNLSPKYTEESKQVTTSSNSPTDQY

SEQ ID NO: 2425572 - protein, 14 aa, Entamoeba dispar
FSSSQEKPNQSPDD

SEQ ID NO: 2425573 - protein, 8 aa, Entamoeba dispar
FSSTGKDS

SEQ ID NO: 2425574 - protein, 19 aa, Entamoeba dispar
FSSTSSNDEKKNEPSKSFL

SEQ ID NO: 2425575 - protein, 27 aa, Entamoeba dispar
FSSTTSSKKNERFTNPLKTTGSSPSFL

SEQ ID NO: 2425576 - protein, 11 aa, Entamoeba dispar
FSSVEQEDQIV

SEQ ID NO: 2425577 - protein, 9 aa, Entamoeba dispar
FSTDNEQYD

SEQ ID NO: 2425578 - protein, 7 aa, Entamoeba dispar
FSTEKVK

SEQ ID NO: 2425579 - protein, 41 aa, Entamoeba dispar
FSTGTKNQKNITSTTEKSGTCTPQKQVNSSIEKTISKPTTM

SEQ ID NO: 2425580 - protein, 12 aa, Entamoeba dispar
FSTNKRGKKVNQ

SEQ ID NO: 2425581 - protein, 11 aa, Entamoeba dispar
FSTPSERHINE

SEQ ID NO: 2425582 - protein, 5 aa, Entamoeba dispar
FSTQN

SEQ ID NO: 2425583 - protein, 5 aa, Entamoeba dispar
FSTSG

SEQ ID NO: 2425584 - protein, 57 aa, Entamoeba dispar
FSTSPKQRYSTSLNTPTVPIGSPNNTVIPRGSRSNTTTRNTSVNNTTPVSEKNIPIK

SEQ ID NO: 2425585 - protein, 9 aa, Entamoeba dispar
FSTTTNEPY

SEQ ID NO: 2425586 - protein, 4 aa, Entamoeba dispar
FTAP

SEQ ID NO: 2425587 - protein, 4 aa, Entamoeba dispar
FTDE

SEQ ID NO: 2425588 - protein, 10 aa, Entamoeba dispar
FTDEAYSTNM

SEQ ID NO: 2425589 - protein, 6 aa, Entamoeba dispar
FTDEQL

SEQ ID NO: 2425590 - protein, 6 aa, Entamoeba dispar
FTDQKR

SEQ ID NO: 2425591 - protein, 9 aa, Entamoeba dispar
FTDQQKDAT

SEQ ID NO: 2425592 - protein, 7 aa, Entamoeba dispar
FTDSKTV

SEQ ID NO: 2425593 - protein, 5 aa, Entamoeba dispar
FTDSN

SEQ ID NO: 2425594 - protein, 5 aa, Entamoeba dispar
FTDTN

SEQ ID NO: 2425595 - protein, 5 aa, Entamoeba dispar
FTEEE

SEQ ID NO: 2425596 - protein, 6 aa, Entamoeba dispar
FTEEED

SEQ ID NO: 2425597 - protein, 5 aa, Entamoeba dispar
FTEEL

SEQ ID NO: 2425598 - protein, 16 aa, Entamoeba dispar
FTEITGEGKSEKEKME

SEQ ID NO: 2425599 - protein, 5 aa, Entamoeba dispar
FTENS

SEQ ID NO: 2425600 - protein, 9 aa, Entamoeba dispar
FTEPPSEGS

SEQ ID NO: 2425601 - protein, 4 aa, Entamoeba dispar
FTER

SEQ ID NO: 2425602 - protein, 21 aa, Entamoeba dispar
FTESQPNGYRRDSINNNSYTN

SEQ ID NO: 2425603 - protein, 12 aa, Entamoeba dispar
FTESTLPSEKSL

SEQ ID NO: 2425604 - protein, 12 aa, Entamoeba dispar
FTGAEEDVDDDL

SEQ ID NO: 2425605 - protein, 15 aa, Entamoeba dispar
FTGANPSHLKYEFSH

SEQ ID NO: 2425606 - protein, 5 aa, Entamoeba dispar
FTGKK

SEQ ID NO: 2425607 - protein, 10 aa, Entamoeba dispar
FTGKKGTLRI

SEQ ID NO: 2425608 - protein, 10 aa, Entamoeba dispar
FTGKRPIDDF

SEQ ID NO: 2425609 - protein, 9 aa, Entamoeba dispar
FTGKYADDV

SEQ ID NO: 2425610 - protein, 12 aa, Entamoeba dispar
FTGNETTKLIQE

SEQ ID NO: 2425611 - protein, 7 aa, Entamoeba dispar
FTGNKEN

SEQ ID NO: 2425612 - protein, 14 aa, Entamoeba dispar
FTGPETKIYTNAEN

SEQ ID NO: 2425613 - protein, 6 aa, Entamoeba dispar
FTGSAN

SEQ ID NO: 2425614 - protein, 34 aa, Entamoeba dispar
FTGTGNSIGKSNATNFKVTGSAPSLDVSKPTTNI

SEQ ID NO: 2425615 - protein, 6 aa, Entamoeba dispar
FTHPGG

SEQ ID NO: 2425616 - protein, 11 aa, Entamoeba dispar
FTKDKREEDVS

SEQ ID NO: 2425617 - protein, 13 aa, Entamoeba dispar
FTKELPESTPPEI

SEQ ID NO: 2425618 - protein, 10 aa, Entamoeba dispar
FTKEQEESIF

SEQ ID NO: 2425619 - protein, 5 aa, Entamoeba dispar
FTKGN

SEQ ID NO: 2425620 - protein, 8 aa, Entamoeba dispar
FTKGTSIK

SEQ ID NO: 2425621 - protein, 12 aa, Entamoeba dispar
FTKGVNEEIKDN

SEQ ID NO: 2425622 - protein, 4 aa, Entamoeba dispar
FTKK

SEQ ID NO: 2425623 - protein, 14 aa, Entamoeba dispar
FTKKDRENLGNKIP

SEQ ID NO: 2425624 - protein, 8 aa, Entamoeba dispar
FTKKESNI

SEQ ID NO: 2425625 - protein, 8 aa, Entamoeba dispar
FTKKESNV

SEQ ID NO: 2425626 - protein, 10 aa, Entamoeba dispar
FTKKKPNSTG

SEQ ID NO: 2425627 - protein, 16 aa, Entamoeba dispar
FTKKSNKKSLDQSSIP

SEQ ID NO: 2425628 - protein, 6 aa, Entamoeba dispar
FTKNNQ

SEQ ID NO: 2425629 - protein, 4 aa, Entamoeba dispar
FTKP

SEQ ID NO: 2425630 - protein, 12 aa, Entamoeba dispar
FTKPGDVETGIG

SEQ ID NO: 2425631 - protein, 7 aa, Entamoeba dispar
FTKPSSI

SEQ ID NO: 2425632 - protein, 6 aa, Entamoeba dispar
FTKTQK

SEQ ID NO: 2425633 - protein, 14 aa, Entamoeba dispar
FTLPQNQPLYSPLG

SEQ ID NO: 2425634 - protein, 4 aa, Entamoeba dispar
FTNE

SEQ ID NO: 2425635 - protein, 12 aa, Entamoeba dispar
FTNEVTKDKTDV

SEQ ID NO: 2425636 - protein, 8 aa, Entamoeba dispar
FTNKKDGI

SEQ ID NO: 2425637 - protein, 11 aa, Entamoeba dispar
FTNNGNEKTVR

SEQ ID NO: 2425638 - protein, 12 aa, Entamoeba dispar
FTNNSNKGFKGE

SEQ ID NO: 2425639 - protein, 8 aa, Entamoeba dispar
FTNPNKEN

SEQ ID NO: 2425640 - protein, 7 aa, Entamoeba dispar
FTNQTAT

SEQ ID NO: 2425641 - protein, 9 aa, Entamoeba dispar
FTNSYKATI

SEQ ID NO: 2425642 - protein, 12 aa, Entamoeba dispar
FTNVNRSKFKNG

SEQ ID NO: 2425643 - protein, 4 aa, Entamoeba dispar
FTPD

SEQ ID NO: 2425644 - protein, 19 aa, Entamoeba dispar
FTPEEEEQIRKENLWCEEL

SEQ ID NO: 2425645 - protein, 18 aa, Entamoeba dispar
FTPEKGSLASKSKKKIKA

SEQ ID NO: 2425646 - protein, 6 aa, Entamoeba dispar
FTPETR

SEQ ID NO: 2425647 - protein, 22 aa, Entamoeba dispar
FTPHDKHKRPAIPDKKLTKSRS

SEQ ID NO: 2425648 - protein, 4 aa, Entamoeba dispar
FTPI

SEQ ID NO: 2425649 - protein, 4 aa, Entamoeba dispar
FTPK

SEQ ID NO: 2425650 - protein, 10 aa, Entamoeba dispar
FTPKTNEFQP

SEQ ID NO: 2425651 - protein, 10 aa, Entamoeba dispar
FTPNPNDPLS

SEQ ID NO: 2425652 - protein, 10 aa, Entamoeba dispar
FTPNPTTSYQ

SEQ ID NO: 2425653 - protein, 13 aa, Entamoeba dispar
FTPPNLSKAVGER

SEQ ID NO: 2425654 - protein, 7 aa, Entamoeba dispar
FTPPTKN

SEQ ID NO: 2425655 - protein, 4 aa, Entamoeba dispar
FTPQ

SEQ ID NO: 2425656 - protein, 13 aa, Entamoeba dispar
FTPQIPSQPMPQE

SEQ ID NO: 2425657 - protein, 11 aa, Entamoeba dispar
FTPRQKKETIQ

SEQ ID NO: 2425658 - protein, 4 aa, Entamoeba dispar
FTPV

SEQ ID NO: 2425659 - protein, 4 aa, Entamoeba dispar
FTQD

SEQ ID NO: 2425660 - protein, 16 aa, Entamoeba dispar
FTQDDPRETSDQDLTE

SEQ ID NO: 2425661 - protein, 17 aa, Entamoeba dispar
FTQEREDTLSKTEDGQC

SEQ ID NO: 2425662 - protein, 6 aa, Entamoeba dispar
FTQKAN

SEQ ID NO: 2425663 - protein, 7 aa, Entamoeba dispar
FTQNGDK

SEQ ID NO: 2425664 - protein, 6 aa, Entamoeba dispar
FTQNPT

SEQ ID NO: 2425665 - protein, 11 aa, Entamoeba dispar
FTQPEQKTQAD

SEQ ID NO: 2425666 - protein, 22 aa, Entamoeba dispar
FTQQPQQSVPQQKPLKKDTTND

SEQ ID NO: 2425667 - protein, 11 aa, Entamoeba dispar
FTQSELSEFSQ

SEQ ID NO: 2425668 - protein, 13 aa, Entamoeba dispar
FTQTKDDNKGKIV

SEQ ID NO: 2425669 - protein, 7 aa, Entamoeba dispar
FTRARND

SEQ ID NO: 2425670 - protein, 9 aa, Entamoeba dispar
FTRGPRNEQ

SEQ ID NO: 2425671 - protein, 5 aa, Entamoeba dispar
FTRKQ

SEQ ID NO: 2425672 - protein, 7 aa, Entamoeba dispar
FTRKTNG

SEQ ID NO: 2425673 - protein, 7 aa, Entamoeba dispar
FTRQQAT

SEQ ID NO: 2425674 - protein, 17 aa, Entamoeba dispar
FTRQQRPKADAQQDEKI

SEQ ID NO: 2425675 - protein, 7 aa, Entamoeba dispar
FTRRTGG

SEQ ID NO: 2425676 - protein, 7 aa, Entamoeba dispar
FTRSPYT

SEQ ID NO: 2425677 - protein, 7 aa, Entamoeba dispar
FTSEEEM

SEQ ID NO: 2425678 - protein, 19 aa, Entamoeba dispar
FTSEEQKEFGASIPSECTS

SEQ ID NO: 2425679 - protein, 20 aa, Entamoeba dispar
FTSGPSPYNPATGALSKPAF

SEQ ID NO: 2425680 - protein, 7 aa, Entamoeba dispar
FTSNSQL

SEQ ID NO: 2425681 - protein, 14 aa, Entamoeba dispar
FTSPMKKKSTNFIG

SEQ ID NO: 2425682 - protein, 6 aa, Entamoeba dispar
FTSSEE

SEQ ID NO: 2425683 - protein, 6 aa, Entamoeba dispar
FTSSNE

SEQ ID NO: 2425684 - protein, 8 aa, Entamoeba dispar
FTSSNNPI

SEQ ID NO: 2425685 - protein, 7 aa, Entamoeba dispar
FTSSNPE

SEQ ID NO: 2425686 - protein, 19 aa, Entamoeba dispar
FTSTSNGIEVNADTTKRIQ

SEQ ID NO: 2425687 - protein, 5 aa, Entamoeba dispar
FTTAE

SEQ ID NO: 2425688 - protein, 14 aa, Entamoeba dispar
FTTEDEASKISNEL

SEQ ID NO: 2425689 - protein, 5 aa, Entamoeba dispar
FTTEK

SEQ ID NO: 2425690 - protein, 9 aa, Entamoeba dispar
FTTENQEDK

SEQ ID NO: 2425691 - protein, 9 aa, Entamoeba dispar
FTTEPQKYI

SEQ ID NO: 2425692 - protein, 4 aa, Entamoeba dispar
FTTK

SEQ ID NO: 2425693 - protein, 4 aa, Entamoeba dispar
FTTQ

SEQ ID NO: 2425694 - protein, 15 aa, Entamoeba dispar
FTTQRNKEENQTTIT

SEQ ID NO: 2425695 - protein, 27 aa, Entamoeba dispar
FTTQTKPVEPTTTTPVMTTTQPTNQFS

SEQ ID NO: 2425696 - protein, 11 aa, Entamoeba dispar
FTTRTGAGKYD

SEQ ID NO: 2425697 - protein, 15 aa, Entamoeba dispar
FTVNATDGDTHLGGK

SEQ ID NO: 2425698 - protein, 4 aa, Entamoeba dispar
FTYD

SEQ ID NO: 2425699 - protein, 12 aa, Entamoeba dispar
FTYDQKEAIEKE

SEQ ID NO: 2425700 - protein, 4 aa, Entamoeba dispar
FTYP

SEQ ID NO: 2425701 - protein, 20 aa, Entamoeba dispar
FTYSNKSPNAPKRSPGSIQS

SEQ ID NO: 2425702 - protein, 7 aa, Entamoeba dispar
FTYSSDQ

SEQ ID NO: 2425703 - protein, 10 aa, Entamoeba dispar
FVEQQEEESY

SEQ ID NO: 2425704 - protein, 10 aa, Entamoeba dispar
FVKPHTKPKN

SEQ ID NO: 2425705 - protein, 12 aa, Entamoeba dispar
FVPKRKKQQIEF

SEQ ID NO: 2425706 - protein, 12 aa, Entamoeba dispar
FVPPEKPAASFN

SEQ ID NO: 2425707 - protein, 27 aa, Entamoeba dispar
FVPPPPPLSEDAYTTETKSPNSAPNVS

SEQ ID NO: 2425708 - protein, 27 aa, Entamoeba dispar
  misc_feature (26)..(27): Xaa can be any naturally occurring amino acid
FVPPQNAPSDPSQETPYAPPIIAQPXX

SEQ ID NO: 2425709 - protein, 33 aa, Entamoeba dispar
FVPRKKKVEQQNAAAQTATPNGPVISEDEVKQE

SEQ ID NO: 2425710 - protein, 4 aa, Entamoeba dispar
FVSG

SEQ ID NO: 2425711 - protein, 5 aa, Entamoeba dispar
FYDDD

SEQ ID NO: 2425712 - protein, 13 aa, Entamoeba dispar
FYDRTKKKTQCPE

SEQ ID NO: 2425713 - protein, 9 aa, Entamoeba dispar
FYDSRGPRD

SEQ ID NO: 2425714 - protein, 9 aa, Entamoeba dispar
FYDTNPSTV

SEQ ID NO: 2425715 - protein, 16 aa, Entamoeba dispar
FYDTSKTIELNTSDGK

SEQ ID NO: 2425716 - protein, 12 aa, Entamoeba dispar
FYGDYDTADDKS

SEQ ID NO: 2425717 - protein, 5 aa, Entamoeba dispar
FYGNS

SEQ ID NO: 2425718 - protein, 25 aa, Entamoeba dispar
FYNEETKKYDLGKKIPADKKDPSLV

SEQ ID NO: 2425719 - protein, 10 aa, Entamoeba dispar
FYNRTKGDCP

SEQ ID NO: 2425720 - protein, 5 aa, Entamoeba dispar
FYPEE

SEQ ID NO: 2425721 - protein, 4 aa, Entamoeba dispar
FYQS

SEQ ID NO: 2425722 - protein, 10 aa, Entamoeba dispar
FYSDSSDITE

SEQ ID NO: 2425723 - protein, 11 aa, Entamoeba dispar
FYSEADESFKE

SEQ ID NO: 2425724 - protein, 8 aa, Entamoeba dispar
FYTEQNKQ

SEQ ID NO: 2425725 - protein, 11 aa, Entamoeba dispar
FYTPDGPTSEE

SEQ ID NO: 2425726 - protein, 9 aa, Entamoeba dispar
GAAAGEGLG

SEQ ID NO: 2425727 - protein, 19 aa, Entamoeba dispar
GACKTCKEAYDENCSDCDG

SEQ ID NO: 2425728 - protein, 4 aa, Entamoeba dispar
GACN

SEQ ID NO: 2425729 - protein, 9 aa, Entamoeba dispar
GACTQNTDL

SEQ ID NO: 2425730 - protein, 9 aa, Entamoeba dispar
GACTTNTDL

SEQ ID NO: 2425731 - protein, 10 aa, Entamoeba dispar
GADAKEIVNG

SEQ ID NO: 2425732 - protein, 11 aa, Entamoeba dispar
GADESNIDTLE

SEQ ID NO: 2425733 - protein, 4 aa, Entamoeba dispar
GADI

SEQ ID NO: 2425734 - protein, 15 aa, Entamoeba dispar
GADKTILNAQNKTAI

SEQ ID NO: 2425735 - protein, 4 aa, Entamoeba dispar
GADP

SEQ ID NO: 2425736 - protein, 13 aa, Entamoeba dispar
GADPTALNNDGIS

SEQ ID NO: 2425737 - protein, 6 aa, Entamoeba dispar
GADSEY

SEQ ID NO: 2425738 - protein, 5 aa, Entamoeba dispar
GADYI

SEQ ID NO: 2425739 - protein, 6 aa, Entamoeba dispar
GAEAPT

SEQ ID NO: 2425740 - protein, 12 aa, Entamoeba dispar
GAEASEEQQQEM

SEQ ID NO: 2425741 - protein, 13 aa, Entamoeba dispar
GAEEGNPSITTSI

SEQ ID NO: 2425742 - protein, 5 aa, Entamoeba dispar
GAEGL

SEQ ID NO: 2425743 - protein, 7 aa, Entamoeba dispar
GAEIDEA

SEQ ID NO: 2425744 - protein, 8 aa, Entamoeba dispar
GAEIDESK

SEQ ID NO: 2425745 - protein, 11 aa, Entamoeba dispar
GAELDTKEKKI

SEQ ID NO: 2425746 - protein, 8 aa, Entamoeba dispar
GAENDDSF

SEQ ID NO: 2425747 - protein, 8 aa, Entamoeba dispar
GAEPEPYV

SEQ ID NO: 2425748 - protein, 5 aa, Entamoeba dispar
GAEQR

SEQ ID NO: 2425749 - protein, 13 aa, Entamoeba dispar
GAERMKQEEVEGM

SEQ ID NO: 2425750 - protein, 9 aa, Entamoeba dispar
GAESHAGQT

SEQ ID NO: 2425751 - protein, 11 aa, Entamoeba dispar
GAETGSGKTAA

SEQ ID NO: 2425752 - protein, 14 aa, Entamoeba dispar
GAEVDARTKNGSTA

SEQ ID NO: 2425753 - protein, 6 aa, Entamoeba dispar
GAFEEI

SEQ ID NO: 2425754 - protein, 7 aa, Entamoeba dispar
GAGAAPT

SEQ ID NO: 2425755 - protein, 9 aa, Entamoeba dispar
GAGAGGTVL

SEQ ID NO: 2425756 - protein, 6 aa, Entamoeba dispar
GAGCGP

SEQ ID NO: 2425757 - protein, 7 aa, Entamoeba dispar
GAGCGPT

SEQ ID NO: 2425758 - protein, 9 aa, Entamoeba dispar
GAGGRFDPT

SEQ ID NO: 2425759 - protein, 5 aa, Entamoeba dispar
GAGKT

SEQ ID NO: 2425760 - protein, 6 aa, Entamoeba dispar
GAGKTH

SEQ ID NO: 2425761 - protein, 7 aa, Entamoeba dispar
GAGKTSI

SEQ ID NO: 2425762 - protein, 8 aa, Entamoeba dispar
GAGKTTTI

SEQ ID NO: 2425763 - protein, 10 aa, Entamoeba dispar
GAGNGPDKEN

SEQ ID NO: 2425764 - protein, 16 aa, Entamoeba dispar
GAGNNWAKGHYTEGTE

SEQ ID NO: 2425765 - protein, 22 aa, Entamoeba dispar
GAGQIQQLGSGLRAKQTDTTTH

SEQ ID NO: 2425766 - protein, 7 aa, Entamoeba dispar
GAGREVG

SEQ ID NO: 2425767 - protein, 9 aa, Entamoeba dispar
GAGSRQSIN

SEQ ID NO: 2425768 - protein, 7 aa, Entamoeba dispar
GAGTDDE

SEQ ID NO: 2425769 - protein, 5 aa, Entamoeba dispar
GAHDT

SEQ ID NO: 2425770 - protein, 7 aa, Entamoeba dispar
GAHGKDT

SEQ ID NO: 2425771 - protein, 9 aa, Entamoeba dispar
GAHGTQPVC

SEQ ID NO: 2425772 - protein, 16 aa, Entamoeba dispar
GAHTDIETRNGKTPSM

SEQ ID NO: 2425773 - protein, 7 aa, Entamoeba dispar
GAIDGGI

SEQ ID NO: 2425774 - protein, 12 aa, Entamoeba dispar
GAIDKEKETHIS

SEQ ID NO: 2425775 - protein, 4 aa, Entamoeba dispar
GAIE

SEQ ID NO: 2425776 - protein, 12 aa, Entamoeba dispar
GAIGTARQQINN

SEQ ID NO: 2425777 - protein, 7 aa, Entamoeba dispar
GAIPNEE

SEQ ID NO: 2425778 - protein, 11 aa, Entamoeba dispar
GAKDGKGRGKQ

SEQ ID NO: 2425779 - protein, 4 aa, Entamoeba dispar
GAKG

SEQ ID NO: 2425780 - protein, 14 aa, Entamoeba dispar
GAKHWKKRKSSHCE

SEQ ID NO: 2425781 - protein, 10 aa, Entamoeba dispar
GAKKESERKK

SEQ ID NO: 2425782 - protein, 13 aa, Entamoeba dispar
GAKKIRGGREKNS

SEQ ID NO: 2425783 - protein, 9 aa, Entamoeba dispar
GAKKTVEEA

SEQ ID NO: 2425784 - protein, 4 aa, Entamoeba dispar
GAKL

SEQ ID NO: 2425785 - protein, 8 aa, Entamoeba dispar
GAKMGNES

SEQ ID NO: 2425786 - protein, 5 aa, Entamoeba dispar
GAKNL

SEQ ID NO: 2425787 - protein, 16 aa, Entamoeba dispar
GAKNNGGKFCSECGNK

SEQ ID NO: 2425788 - protein, 4 aa, Entamoeba dispar
GAKR

SEQ ID NO: 2425789 - protein, 8 aa, Entamoeba dispar
GAKSSEEI

SEQ ID NO: 2425790 - protein, 8 aa, Entamoeba dispar
GAKVRSGK

SEQ ID NO: 2425791 - protein, 10 aa, Entamoeba dispar
GALANKGGVA

SEQ ID NO: 2425792 - protein, 10 aa, Entamoeba dispar
GALDKPEKLQ

SEQ ID NO: 2425793 - protein, 19 aa, Entamoeba dispar
GALERTPEELGKGGKAGIT

SEQ ID NO: 2425794 - protein, 10 aa, Entamoeba dispar
GALGQNPTVI

SEQ ID NO: 2425795 - protein, 7 aa, Entamoeba dispar
GALKKDS

SEQ ID NO: 2425796 - protein, 14 aa, Entamoeba dispar
GALNARRSDDPKGM

SEQ ID NO: 2425797 - protein, 5 aa, Entamoeba dispar
GAMKK

SEQ ID NO: 2425798 - protein, 5 aa, Entamoeba dispar
GAMKQ

SEQ ID NO: 2425799 - protein, 6 aa, Entamoeba dispar
GAMKRR

SEQ ID NO: 2425800 - protein, 4 aa, Entamoeba dispar
GAND

SEQ ID NO: 2425801 - protein, 14 aa, Entamoeba dispar
GANENESPRRRNTI

SEQ ID NO: 2425802 - protein, 6 aa, Entamoeba dispar
GANERF

SEQ ID NO: 2425803 - protein, 6 aa, Entamoeba dispar
GANINS

SEQ ID NO: 2425804 - protein, 6 aa, Entamoeba dispar
GANKEQ

SEQ ID NO: 2425805 - protein, 10 aa, Entamoeba dispar
GANPTKQKIS

SEQ ID NO: 2425806 - protein, 10 aa, Entamoeba dispar
GANQLTKQLK

SEQ ID NO: 2425807 - protein, 9 aa, Entamoeba dispar
GANSRPSMG

SEQ ID NO: 2425808 - protein, 10 aa, Entamoeba dispar
GANVNHQTNN

SEQ ID NO: 2425809 - protein, 4 aa, Entamoeba dispar
GAPA

SEQ ID NO: 2425810 - protein, 8 aa, Entamoeba dispar
GAPAPGMV

SEQ ID NO: 2425811 - protein, 6 aa, Entamoeba dispar
GAPEEY

SEQ ID NO: 2425812 - protein, 8 aa, Entamoeba dispar
GAPGIGKS

SEQ ID NO: 2425813 - protein, 12 aa, Entamoeba dispar
GAPGTGKTALAQ

SEQ ID NO: 2425814 - protein, 12 aa, Entamoeba dispar
GAPGVGKTTVSK

SEQ ID NO: 2425815 - protein, 6 aa, Entamoeba dispar
GAPKDC

SEQ ID NO: 2425816 - protein, 6 aa, Entamoeba dispar
GAPLNE

SEQ ID NO: 2425817 - protein, 12 aa, Entamoeba dispar
GAPLNQTTNDNQ

SEQ ID NO: 2425818 - protein, 6 aa, Entamoeba dispar
GAPLTE

SEQ ID NO: 2425819 - protein, 26 aa, Entamoeba dispar
GAPNNESDIPSKENDVPLTIIFENLS

SEQ ID NO: 2425820 - protein, 5 aa, Entamoeba dispar
GAPTE

SEQ ID NO: 2425821 - protein, 11 aa, Entamoeba dispar
GAPTGSGKTVA

SEQ ID NO: 2425822 - protein, 4 aa, Entamoeba dispar
GAPY

SEQ ID NO: 2425823 - protein, 5 aa, Entamoeba dispar
GAPYQ

SEQ ID NO: 2425824 - protein, 32 aa, Entamoeba dispar
GAQASSHISQPSHTQNKPHQYSVKSTSDDEIL

SEQ ID NO: 2425825 - protein, 11 aa, Entamoeba dispar
GAQEGSALSRT

SEQ ID NO: 2425826 - protein, 5 aa, Entamoeba dispar
GAQER

SEQ ID NO: 2425827 - protein, 8 aa, Entamoeba dispar
GAQPAGLG

SEQ ID NO: 2425828 - protein, 14 aa, Entamoeba dispar
GAQPGLGGLPPIGG

SEQ ID NO: 2425829 - protein, 5 aa, Entamoeba dispar
GAQTL

SEQ ID NO: 2425830 - protein, 7 aa, Entamoeba dispar
GARGKIQ

SEQ ID NO: 2425831 - protein, 9 aa, Entamoeba dispar
GARIKEETN

SEQ ID NO: 2425832 - protein, 4 aa, Entamoeba dispar
GARQ

SEQ ID NO: 2425833 - protein, 7 aa, Entamoeba dispar
GARRGRG

SEQ ID NO: 2425834 - protein, 7 aa, Entamoeba dispar
GARRWTS

SEQ ID NO: 2425835 - protein, 4 aa, Entamoeba dispar
GASA

SEQ ID NO: 2425836 - protein, 5 aa, Entamoeba dispar
GASAF

SEQ ID NO: 2425837 - protein, 15 aa, Entamoeba dispar
GASASLKYTKGAQKT

SEQ ID NO: 2425838 - protein, 6 aa, Entamoeba dispar
GASDRK

SEQ ID NO: 2425839 - protein, 10 aa, Entamoeba dispar
GASDRKESVG

SEQ ID NO: 2425840 - protein, 11 aa, Entamoeba dispar
GASKRKKEQVK

SEQ ID NO: 2425841 - protein, 42 aa, Entamoeba dispar
GASNSGTTQTYTTQNTQFTSSATETTTTNAEDNSQPAQDGLE

SEQ ID NO: 2425842 - protein, 4 aa, Entamoeba dispar
GASQ

SEQ ID NO: 2425843 - protein, 6 aa, Entamoeba dispar
GASSIG

SEQ ID NO: 2425844 - protein, 4 aa, Entamoeba dispar
GAST

SEQ ID NO: 2425845 - protein, 5 aa, Entamoeba dispar
GATDG

SEQ ID NO: 2425846 - protein, 9 aa, Entamoeba dispar
GATEYNREA

SEQ ID NO: 2425847 - protein, 7 aa, Entamoeba dispar
GATGQKM

SEQ ID NO: 2425848 - protein, 11 aa, Entamoeba dispar
GATGSGKTTQI

SEQ ID NO: 2425849 - protein, 5 aa, Entamoeba dispar
GATPM

SEQ ID NO: 2425850 - protein, 13 aa, Entamoeba dispar
GATPSDVKAYETK

SEQ ID NO: 2425851 - protein, 24 aa, Entamoeba dispar
GATRAFPPQHPDISEDYKEIGQPA

SEQ ID NO: 2425852 - protein, 10 aa, Entamoeba dispar
GATSEGEEIY

SEQ ID NO: 2425853 - protein, 11 aa, Entamoeba dispar
GATSSDKPYIS

SEQ ID NO: 2425854 - protein, 5 aa, Entamoeba dispar
GATTH

SEQ ID NO: 2425855 - protein, 8 aa, Entamoeba dispar
GATTPKWS

SEQ ID NO: 2425856 - protein, 7 aa, Entamoeba dispar
GATYPNQ

SEQ ID NO: 2425857 - protein, 15 aa, Entamoeba dispar
GATYSAYKKGENAIG

SEQ ID NO: 2425858 - protein, 8 aa, Entamoeba dispar
GAVGKSAV

SEQ ID NO: 2425859 - protein, 7 aa, Entamoeba dispar
GAVGKTS

SEQ ID NO: 2425860 - protein, 11 aa, Entamoeba dispar
GAVGKTSISTQ

SEQ ID NO: 2425861 - protein, 5 aa, Entamoeba dispar
GAVKE

SEQ ID NO: 2425862 - protein, 9 aa, Entamoeba dispar
GAVPDVTNF

SEQ ID NO: 2425863 - protein, 17 aa, Entamoeba dispar
GAYGAFKDDEESSSKFC

SEQ ID NO: 2425864 - protein, 7 aa, Entamoeba dispar
GAYKRNS

SEQ ID NO: 2425865 - protein, 16 aa, Entamoeba dispar
GAYSGGLDTKFNETGE

SEQ ID NO: 2425866 - protein, 13 aa, Entamoeba dispar
GCAEGEKLSRGFE

SEQ ID NO: 2425867 - protein, 5 aa, Entamoeba dispar
GCANN

SEQ ID NO: 2425868 - protein, 13 aa, Entamoeba dispar
GCAPGKKEDPSVV

SEQ ID NO: 2425869 - protein, 5 aa, Entamoeba dispar
GCAQR

SEQ ID NO: 2425870 - protein, 6 aa, Entamoeba dispar
GCDGSK

SEQ ID NO: 2425871 - protein, 8 aa, Entamoeba dispar
GCDPLPQT

SEQ ID NO: 2425872 - protein, 21 aa, Entamoeba dispar
GCEEEHDEEAMEEEVEERFPK

SEQ ID NO: 2425873 - protein, 21 aa, Entamoeba dispar
GCEEGHDEEAMEEEVEERFPK

SEQ ID NO: 2425874 - protein, 14 aa, Entamoeba dispar
GCEESEMPAAANTE

SEQ ID NO: 2425875 - protein, 12 aa, Entamoeba dispar
GCEGTEKEKKTA

SEQ ID NO: 2425876 - protein, 9 aa, Entamoeba dispar
GCEKGCEKA

SEQ ID NO: 2425877 - protein, 5 aa, Entamoeba dispar
GCEKS

SEQ ID NO: 2425878 - protein, 7 aa, Entamoeba dispar
GCENEYP

SEQ ID NO: 2425879 - protein, 7 aa, Entamoeba dispar
GCEPTQL

SEQ ID NO: 2425880 - protein, 11 aa, Entamoeba dispar
GCGGGRAPEGY

SEQ ID NO: 2425881 - protein, 5 aa, Entamoeba dispar
GCGKS

SEQ ID NO: 2425882 - protein, 11 aa, Entamoeba dispar
GCGRGTFNEGS

SEQ ID NO: 2425883 - protein, 8 aa, Entamoeba dispar
GCGYNGKT

SEQ ID NO: 2425884 - protein, 8 aa, Entamoeba dispar
GCGYPSDI

SEQ ID NO: 2425885 - protein, 12 aa, Entamoeba dispar
GCHGDKKRKHLG

SEQ ID NO: 2425886 - protein, 5 aa, Entamoeba dispar
GCLKD

SEQ ID NO: 2425887 - protein, 12 aa, Entamoeba dispar
GCNERATYRKGR

SEQ ID NO: 2425888 - protein, 5 aa, Entamoeba dispar
GCNPG

SEQ ID NO: 2425889 - protein, 4 aa, Entamoeba dispar
GCNQ

SEQ ID NO: 2425890 - protein, 10 aa, Entamoeba dispar
GCNSKIPTSE

SEQ ID NO: 2425891 - protein, 14 aa, Entamoeba dispar
GCPKEDRAKVTSAA

SEQ ID NO: 2425892 - protein, 18 aa, Entamoeba dispar
GCPNIDESSLKGIVNVRE

SEQ ID NO: 2425893 - protein, 6 aa, Entamoeba dispar
GCPNSN

SEQ ID NO: 2425894 - protein, 6 aa, Entamoeba dispar
GCPPPM

SEQ ID NO: 2425895 - protein, 22 aa, Entamoeba dispar
GCPPPMGAYPPPPMGGCPPPPM

SEQ ID NO: 2425896 - protein, 24 aa, Entamoeba dispar
GCPPPMPGPGGYPMGGCPPPYYNP

SEQ ID NO: 2425897 - protein, 16 aa, Entamoeba dispar
GCPPPSGCACPPPPPV

SEQ ID NO: 2425898 - protein, 5 aa, Entamoeba dispar
GCRDE

SEQ ID NO: 2425899 - protein, 5 aa, Entamoeba dispar
GCSDD

SEQ ID NO: 2425900 - protein, 7 aa, Entamoeba dispar
GCSESKL

SEQ ID NO: 2425901 - protein, 14 aa, Entamoeba dispar
GCSNIDESSLKPQS

SEQ ID NO: 2425902 - protein, 6 aa, Entamoeba dispar
GCSSDE

SEQ ID NO: 2425903 - protein, 4 aa, Entamoeba dispar
GCTG

SEQ ID NO: 2425904 - protein, 6 aa, Entamoeba dispar
GCTNTS

SEQ ID NO: 2425905 - protein, 13 aa, Entamoeba dispar
GCTSGEKLPNTLR

SEQ ID NO: 2425906 - protein, 8 aa, Entamoeba dispar
GDAAKNQI

SEQ ID NO: 2425907 - protein, 6 aa, Entamoeba dispar
GDAAME

SEQ ID NO: 2425908 - protein, 10 aa, Entamoeba dispar
GDAEASVRDT

SEQ ID NO: 2425909 - protein, 9 aa, Entamoeba dispar
GDAEKYASK

SEQ ID NO: 2425910 - protein, 10 aa, Entamoeba dispar
GDAFEKQNDR

SEQ ID NO: 2425911 - protein, 15 aa, Entamoeba dispar
GDAKTIQQLSGGQKT

SEQ ID NO: 2425912 - protein, 8 aa, Entamoeba dispar
GDANSNLM

SEQ ID NO: 2425913 - protein, 12 aa, Entamoeba dispar
GDASRLPTSSTC

SEQ ID NO: 2425914 - protein, 12 aa, Entamoeba dispar
GDATKNAYSPCS

SEQ ID NO: 2425915 - protein, 5 aa, Entamoeba dispar
GDDCN

SEQ ID NO: 2425916 - protein, 8 aa, Entamoeba dispar
GDDDMPAH

SEQ ID NO: 2425917 - protein, 10 aa, Entamoeba dispar
GDDEDEKAKA

SEQ ID NO: 2425918 - protein, 5 aa, Entamoeba dispar
GDDGK

SEQ ID NO: 2425919 - protein, 17 aa, Entamoeba dispar
GDDGLDPLKVESDKYPI

SEQ ID NO: 2425920 - protein, 9 aa, Entamoeba dispar
GDDHSSRSC

SEQ ID NO: 2425921 - protein, 4 aa, Entamoeba dispar
GDDI

SEQ ID NO: 2425922 - protein, 40 aa, Entamoeba dispar
GDDISDDEINEEEDSYEEEEEEEEDSYEVPAQNRVYTLDD

SEQ ID NO: 2425923 - protein, 6 aa, Entamoeba dispar
GDDMKN

SEQ ID NO: 2425924 - protein, 5 aa, Entamoeba dispar
GDDNA

SEQ ID NO: 2425925 - protein, 15 aa, Entamoeba dispar
GDDNKEEKVTDTKKL

SEQ ID NO: 2425926 - protein, 7 aa, Entamoeba dispar
GDDNKLR

SEQ ID NO: 2425927 - protein, 4 aa, Entamoeba dispar
GDDP

SEQ ID NO: 2425928 - protein, 5 aa, Entamoeba dispar
GDDQF

SEQ ID NO: 2425929 - protein, 9 aa, Entamoeba dispar
GDDSNTNAA

SEQ ID NO: 2425930 - protein, 6 aa, Entamoeba dispar
GDDSPL

SEQ ID NO: 2425931 - protein, 8 aa, Entamoeba dispar
GDDTGTDK

SEQ ID NO: 2425932 - protein, 9 aa, Entamoeba dispar
GDDTIDELD

SEQ ID NO: 2425933 - protein, 23 aa, Entamoeba dispar
GDDVELNQTSLSKNKLDIEKEEV

SEQ ID NO: 2425934 - protein, 13 aa, Entamoeba dispar
GDEAMTKASFTDD

SEQ ID NO: 2425935 - protein, 10 aa, Entamoeba dispar
GDEAYGRNQG

SEQ ID NO: 2425936 - protein, 5 aa, Entamoeba dispar
GDEDY

SEQ ID NO: 2425937 - protein, 4 aa, Entamoeba dispar
GDEE

SEQ ID NO: 2425938 - protein, 21 aa, Entamoeba dispar
GDEEELKKGKRLKKADMPEEI

SEQ ID NO: 2425939 - protein, 6 aa, Entamoeba dispar
GDEELT

SEQ ID NO: 2425940 - protein, 19 aa, Entamoeba dispar
GDEESLGRKKKKEAKIKED

SEQ ID NO: 2425941 - protein, 5 aa, Entamoeba dispar
GDEET

SEQ ID NO: 2425942 - protein, 18 aa, Entamoeba dispar
GDEFKNTRGTVDSYVSNG

SEQ ID NO: 2425943 - protein, 9 aa, Entamoeba dispar
GDEFTDEEK

SEQ ID NO: 2425944 - protein, 9 aa, Entamoeba dispar
GDEGKDIPK

SEQ ID NO: 2425945 - protein, 7 aa, Entamoeba dispar
GDEGVGK

SEQ ID NO: 2425946 - protein, 13 aa, Entamoeba dispar
GDEIEKERPKEYQ

SEQ ID NO: 2425947 - protein, 8 aa, Entamoeba dispar
GDEINLDG

SEQ ID NO: 2425948 - protein, 6 aa, Entamoeba dispar
GDEITC

SEQ ID NO: 2425949 - protein, 10 aa, Entamoeba dispar
GDEKQRDYNQ

SEQ ID NO: 2425950 - protein, 8 aa, Entamoeba dispar
GDELTGEN

SEQ ID NO: 2425951 - protein, 8 aa, Entamoeba dispar
GDEMNEEE

SEQ ID NO: 2425952 - protein, 9 aa, Entamoeba dispar
GDENDDLEI

SEQ ID NO: 2425953 - protein, 8 aa, Entamoeba dispar
GDENDIQE

SEQ ID NO: 2425954 - protein, 16 aa, Entamoeba dispar
GDENTRGMLTTGGTES

SEQ ID NO: 2425955 - protein, 7 aa, Entamoeba dispar
GDENTTG

SEQ ID NO: 2425956 - protein, 5 aa, Entamoeba dispar
GDENY

SEQ ID NO: 2425957 - protein, 7 aa, Entamoeba dispar
GDEPNWK

SEQ ID NO: 2425958 - protein, 6 aa, Entamoeba dispar
GDEPTR

SEQ ID NO: 2425959 - protein, 5 aa, Entamoeba dispar
GDEQE

SEQ ID NO: 2425960 - protein, 10 aa, Entamoeba dispar
GDEQTERDTI

SEQ ID NO: 2425961 - protein, 4 aa, Entamoeba dispar
GDER

SEQ ID NO: 2425962 - protein, 5 aa, Entamoeba dispar
GDERC

SEQ ID NO: 2425963 - protein, 8 aa, Entamoeba dispar
GDERRSRE

SEQ ID NO: 2425964 - protein, 5 aa, Entamoeba dispar
GDERY

SEQ ID NO: 2425965 - protein, 7 aa, Entamoeba dispar
GDERYHA

SEQ ID NO: 2425966 - protein, 6 aa, Entamoeba dispar
GDESCK

SEQ ID NO: 2425967 - protein, 8 aa, Entamoeba dispar
GDESEISN

SEQ ID NO: 2425968 - protein, 4 aa, Entamoeba dispar
GDET

SEQ ID NO: 2425969 - protein, 6 aa, Entamoeba dispar
GDETEI

SEQ ID NO: 2425970 - protein, 8 aa, Entamoeba dispar
GDETQWKE

SEQ ID NO: 2425971 - protein, 4 aa, Entamoeba dispar
GDEV

SEQ ID NO: 2425972 - protein, 5 aa, Entamoeba dispar
GDEVD

SEQ ID NO: 2425973 - protein, 12 aa, Entamoeba dispar
GDEVKKQSDKKC

SEQ ID NO: 2425974 - protein, 6 aa, Entamoeba dispar
GDEVVK

SEQ ID NO: 2425975 - protein, 10 aa, Entamoeba dispar
GDFPDDGYDY

SEQ ID NO: 2425976 - protein, 5 aa, Entamoeba dispar
GDFPP

SEQ ID NO: 2425977 - protein, 6 aa, Entamoeba dispar
GDFPPI

SEQ ID NO: 2425978 - protein, 19 aa, Entamoeba dispar
GDFTANQTQKRRSKKHKKL

SEQ ID NO: 2425979 - protein, 7 aa, Entamoeba dispar
GDGAFYG

SEQ ID NO: 2425980 - protein, 9 aa, Entamoeba dispar
GDGETGKTA

SEQ ID NO: 2425981 - protein, 9 aa, Entamoeba dispar
GDGGHNEDV

SEQ ID NO: 2425982 - protein, 17 aa, Entamoeba dispar
GDGGPIKPATQTAKGKP

SEQ ID NO: 2425983 - protein, 5 aa, Entamoeba dispar
GDGGS

SEQ ID NO: 2425984 - protein, 9 aa, Entamoeba dispar
GDGGTGKTT

SEQ ID NO: 2425985 - protein, 6 aa, Entamoeba dispar
GDGHDD

SEQ ID NO: 2425986 - protein, 7 aa, Entamoeba dispar
GDGHDDC

SEQ ID NO: 2425987 - protein, 8 aa, Entamoeba dispar
GDGKGARP

SEQ ID NO: 2425988 - protein, 10 aa, Entamoeba dispar
GDGKQGADKC

SEQ ID NO: 2425989 - protein, 9 aa, Entamoeba dispar
GDGKSSLGN

SEQ ID NO: 2425990 - protein, 7 aa, Entamoeba dispar
GDGMIGG

SEQ ID NO: 2425991 - protein, 4 aa, Entamoeba dispar
GDGN

SEQ ID NO: 2425992 - protein, 9 aa, Entamoeba dispar
GDGNPIGEE

SEQ ID NO: 2425993 - protein, 7 aa, Entamoeba dispar
GDGPFDK

SEQ ID NO: 2425994 - protein, 19 aa, Entamoeba dispar
GDGPFDKMENYDDNLTESK

SEQ ID NO: 2425995 - protein, 5 aa, Entamoeba dispar
GDGPK

SEQ ID NO: 2425996 - protein, 9 aa, Entamoeba dispar
GDGQHSKNY

SEQ ID NO: 2425997 - protein, 7 aa, Entamoeba dispar
GDGQYSK

SEQ ID NO: 2425998 - protein, 8 aa, Entamoeba dispar
GDGREEHP

SEQ ID NO: 2425999 - protein, 10 aa, Entamoeba dispar
GDGSFETSTI

SEQ ID NO: 2426000 - protein, 6 aa, Entamoeba dispar
GDGSTI

SEQ ID NO: 2426001 - protein, 5 aa, Entamoeba dispar
GDGTL

SEQ ID NO: 2426002 - protein, 16 aa, Entamoeba dispar
GDGTLRGANRINKELR

SEQ ID NO: 2426003 - protein, 20 aa, Entamoeba dispar
GDGTLRGANRINKELRRRGS

SEQ ID NO: 2426004 - protein, 21 aa, Entamoeba dispar
GDGTLRGANRINKELRRRGSP

SEQ ID NO: 2426005 - protein, 8 aa, Entamoeba dispar
GDGTQRNI

SEQ ID NO: 2426006 - protein, 6 aa, Entamoeba dispar
GDGTSF

SEQ ID NO: 2426007 - protein, 5 aa, Entamoeba dispar
GDGTV

SEQ ID NO: 2426008 - protein, 4 aa, Entamoeba dispar
GDGV

SEQ ID NO: 2426009 - protein, 5 aa, Entamoeba dispar
GDHCG

SEQ ID NO: 2426010 - protein, 8 aa, Entamoeba dispar
GDHVSGGD

SEQ ID NO: 2426011 - protein, 14 aa, Entamoeba dispar
GDHYGGYSGVGNDE

SEQ ID NO: 2426012 - protein, 4 aa, Entamoeba dispar
GDIE

SEQ ID NO: 2426013 - protein, 5 aa, Entamoeba dispar
GDIHT

SEQ ID NO: 2426014 - protein, 10 aa, Entamoeba dispar
GDIKQTTALG

SEQ ID NO: 2426015 - protein, 7 aa, Entamoeba dispar
GDINDKD

SEQ ID NO: 2426016 - protein, 8 aa, Entamoeba dispar
GDIQNSPI

SEQ ID NO: 2426017 - protein, 5 aa, Entamoeba dispar
GDISG

SEQ ID NO: 2426018 - protein, 16 aa, Entamoeba dispar
GDISSALNDADKHGLK

SEQ ID NO: 2426019 - protein, 4 aa, Entamoeba dispar
GDIT

SEQ ID NO: 2426020 - protein, 11 aa, Entamoeba dispar
GDITKGSTAKE

SEQ ID NO: 2426021 - protein, 4 aa, Entamoeba dispar
GDKC

SEQ ID NO: 2426022 - protein, 7 aa, Entamoeba dispar
GDKDDNI

SEQ ID NO: 2426023 - protein, 9 aa, Entamoeba dispar
GDKEAIEKE

SEQ ID NO: 2426024 - protein, 43 aa, Entamoeba dispar
GDKEKEEELQQQIKEEPQQEKEEEISQSPSSSSDKTDKDSAEL

SEQ ID NO: 2426025 - protein, 17 aa, Entamoeba dispar
GDKEKQQELDEKNKTIY

SEQ ID NO: 2426026 - protein, 17 aa, Entamoeba dispar
GDKETDSGCIEKDHCTY

SEQ ID NO: 2426027 - protein, 10 aa, Entamoeba dispar
GDKETNDMDD

SEQ ID NO: 2426028 - protein, 7 aa, Entamoeba dispar
GDKIGYV

SEQ ID NO: 2426029 - protein, 17 aa, Entamoeba dispar
GDKKEKNKEEIKEENKI

SEQ ID NO: 2426030 - protein, 12 aa, Entamoeba dispar
GDKKNSKKIKEY

SEQ ID NO: 2426031 - protein, 7 aa, Entamoeba dispar
GDKLSTI

SEQ ID NO: 2426032 - protein, 5 aa, Entamoeba dispar
GDKNT

SEQ ID NO: 2426033 - protein, 7 aa, Entamoeba dispar
GDKPIRS

SEQ ID NO: 2426034 - protein, 12 aa, Entamoeba dispar
GDKRENAKERKK

SEQ ID NO: 2426035 - protein, 7 aa, Entamoeba dispar
GDKRKEV

SEQ ID NO: 2426036 - protein, 8 aa, Entamoeba dispar
GDKTKRDY

SEQ ID NO: 2426037 - protein, 8 aa, Entamoeba dispar
GDKTMSKA

SEQ ID NO: 2426038 - protein, 10 aa, Entamoeba dispar
GDKTPQDTMP

SEQ ID NO: 2426039 - protein, 7 aa, Entamoeba dispar
GDKTPVA

SEQ ID NO: 2426040 - protein, 6 aa, Entamoeba dispar
GDKYNR

SEQ ID NO: 2426041 - protein, 9 aa, Entamoeba dispar
GDLKDERHA

SEQ ID NO: 2426042 - protein, 9 aa, Entamoeba dispar
GDLKPTNGI

SEQ ID NO: 2426043 - protein, 11 aa, Entamoeba dispar
GDLNGKVANKT

SEQ ID NO: 2426044 - protein, 11 aa, Entamoeba dispar
GDLNSKEDNLT

SEQ ID NO: 2426045 - protein, 6 aa, Entamoeba dispar
GDLPAD

SEQ ID NO: 2426046 - protein, 4 aa, Entamoeba dispar
GDLS

SEQ ID NO: 2426047 - protein, 4 aa, Entamoeba dispar
GDLT

SEQ ID NO: 2426048 - protein, 11 aa, Entamoeba dispar
GDLTEADKAND

SEQ ID NO: 2426049 - protein, 11 aa, Entamoeba dispar
GDLTEAEQSNN

SEQ ID NO: 2426050 - protein, 11 aa, Entamoeba dispar
GDLTKADKAND

SEQ ID NO: 2426051 - protein, 11 aa, Entamoeba dispar
GDLTSKERNTI

SEQ ID NO: 2426052 - protein, 9 aa, Entamoeba dispar
GDLYTDDSP

SEQ ID NO: 2426053 - protein, 15 aa, Entamoeba dispar
GDMESNGKRITKDGE

SEQ ID NO: 2426054 - protein, 12 aa, Entamoeba dispar
GDMPLPDTSETV

SEQ ID NO: 2426055 - protein, 23 aa, Entamoeba dispar
GDNAQLHEPEFQEPYKSSYTEQK

SEQ ID NO: 2426056 - protein, 7 aa, Entamoeba dispar
GDNDKTQ

SEQ ID NO: 2426057 - protein, 6 aa, Entamoeba dispar
GDNEAR

SEQ ID NO: 2426058 - protein, 10 aa, Entamoeba dispar
GDNEKEEEEI

SEQ ID NO: 2426059 - protein, 10 aa, Entamoeba dispar
GDNEKKPRIY

SEQ ID NO: 2426060 - protein, 7 aa, Entamoeba dispar
GDNEREA

SEQ ID NO: 2426061 - protein, 6 aa, Entamoeba dispar
GDNGKW

SEQ ID NO: 2426062 - protein, 9 aa, Entamoeba dispar
GDNIDSGLQ

SEQ ID NO: 2426063 - protein, 8 aa, Entamoeba dispar
GDNMEQKE

SEQ ID NO: 2426064 - protein, 30 aa, Entamoeba dispar
GDNSVDPITVSKTPTLLESKEGSTSNLNSQ

SEQ ID NO: 2426065 - protein, 18 aa, Entamoeba dispar
GDNTSNSDEVEQKPELCQ

SEQ ID NO: 2426066 - protein, 6 aa, Entamoeba dispar
GDNYAS

SEQ ID NO: 2426067 - protein, 13 aa, Entamoeba dispar
GDPDTPGYIKALL

SEQ ID NO: 2426068 - protein, 10 aa, Entamoeba dispar
GDPEKFPTAS

SEQ ID NO: 2426069 - protein, 12 aa, Entamoeba dispar
GDPGENSNELNG

SEQ ID NO: 2426070 - protein, 4 aa, Entamoeba dispar
GDPI

SEQ ID NO: 2426071 - protein, 22 aa, Entamoeba dispar
GDPPTQNESKGRKESEKDNKVI

SEQ ID NO: 2426072 - protein, 5 aa, Entamoeba dispar
GDPRE

SEQ ID NO: 2426073 - protein, 7 aa, Entamoeba dispar
GDPRTLP

SEQ ID NO: 2426074 - protein, 6 aa, Entamoeba dispar
GDQCAA

SEQ ID NO: 2426075 - protein, 7 aa, Entamoeba dispar
GDQETRF

SEQ ID NO: 2426076 - protein, 12 aa, Entamoeba dispar
GDQIVEKQKGFD

SEQ ID NO: 2426077 - protein, 6 aa, Entamoeba dispar
GDQNEG

SEQ ID NO: 2426078 - protein, 6 aa, Entamoeba dispar
GDQSTS

SEQ ID NO: 2426079 - protein, 10 aa, Entamoeba dispar
GDRATNDPYH

SEQ ID NO: 2426080 - protein, 5 aa, Entamoeba dispar
GDRLK

SEQ ID NO: 2426081 - protein, 7 aa, Entamoeba dispar
GDRLKDA

SEQ ID NO: 2426082 - protein, 9 aa, Entamoeba dispar
GDRRKNSTA

SEQ ID NO: 2426083 - protein, 16 aa, Entamoeba dispar
GDRSIQDDISDQDTVS

SEQ ID NO: 2426084 - protein, 5 aa, Entamoeba dispar
GDRTA

SEQ ID NO: 2426085 - protein, 6 aa, Entamoeba dispar
GDRYKG

SEQ ID NO: 2426086 - protein, 10 aa, Entamoeba dispar
GDSDDDLWSG

SEQ ID NO: 2426087 - protein, 5 aa, Entamoeba dispar
GDSDK

SEQ ID NO: 2426088 - protein, 13 aa, Entamoeba dispar
GDSEDTTELEEFV

SEQ ID NO: 2426089 - protein, 11 aa, Entamoeba dispar
GDSGLTGFPPE

SEQ ID NO: 2426090 - protein, 9 aa, Entamoeba dispar
GDSGVGKTG

SEQ ID NO: 2426091 - protein, 7 aa, Entamoeba dispar
GDSIPQT

SEQ ID NO: 2426092 - protein, 6 aa, Entamoeba dispar
GDSKES

SEQ ID NO: 2426093 - protein, 10 aa, Entamoeba dispar
GDSKRAMDEY

SEQ ID NO: 2426094 - protein, 9 aa, Entamoeba dispar
GDSQEEASE

SEQ ID NO: 2426095 - protein, 4 aa, Entamoeba dispar
GDSR

SEQ ID NO: 2426096 - protein, 20 aa, Entamoeba dispar
GDSRSRFENNLKKKSPPSYQ

SEQ ID NO: 2426097 - protein, 12 aa, Entamoeba dispar
GDSSFKKTNPIF

SEQ ID NO: 2426098 - protein, 11 aa, Entamoeba dispar
GDSSLDKEHKP

SEQ ID NO: 2426099 - protein, 20 aa, Entamoeba dispar
GDSTEINKQQTGANDSGNVD

SEQ ID NO: 2426100 - protein, 9 aa, Entamoeba dispar
GDSTNGPSI

SEQ ID NO: 2426101 - protein, 12 aa, Entamoeba dispar
GDSTPTASFTLP

SEQ ID NO: 2426102 - protein, 5 aa, Entamoeba dispar
GDSVD

SEQ ID NO: 2426103 - protein, 10 aa, Entamoeba dispar
GDSYGKDDEF

SEQ ID NO: 2426104 - protein, 5 aa, Entamoeba dispar
GDTCG

SEQ ID NO: 2426105 - protein, 14 aa, Entamoeba dispar
GDTDGSYVKEPEKK

SEQ ID NO: 2426106 - protein, 13 aa, Entamoeba dispar
GDTEFTKKKAEKC

SEQ ID NO: 2426107 - protein, 11 aa, Entamoeba dispar
GDTEKELNRGV

SEQ ID NO: 2426108 - protein, 11 aa, Entamoeba dispar
GDTGCGKSTQV

SEQ ID NO: 2426109 - protein, 9 aa, Entamoeba dispar
GDTGEISAE

SEQ ID NO: 2426110 - protein, 5 aa, Entamoeba dispar
GDTGL

SEQ ID NO: 2426111 - protein, 4 aa, Entamoeba dispar
GDTI

SEQ ID NO: 2426112 - protein, 14 aa, Entamoeba dispar
GDTIAENVEQMQSG

SEQ ID NO: 2426113 - protein, 5 aa, Entamoeba dispar
GDTKE

SEQ ID NO: 2426114 - protein, 7 aa, Entamoeba dispar
GDTKTAR

SEQ ID NO: 2426115 - protein, 10 aa, Entamoeba dispar
GDTLPSEDER

SEQ ID NO: 2426116 - protein, 4 aa, Entamoeba dispar
GDTP

SEQ ID NO: 2426117 - protein, 5 aa, Entamoeba dispar
GDTPD

SEQ ID NO: 2426118 - protein, 21 aa, Entamoeba dispar
GDTPITKESNIKEEPKEKSLS

SEQ ID NO: 2426119 - protein, 7 aa, Entamoeba dispar
GDTSDID

SEQ ID NO: 2426120 - protein, 5 aa, Entamoeba dispar
GDTTP

SEQ ID NO: 2426121 - protein, 5 aa, Entamoeba dispar
GDTTY

SEQ ID NO: 2426122 - protein, 4 aa, Entamoeba dispar
GDVE

SEQ ID NO: 2426123 - protein, 20 aa, Entamoeba dispar
GDVESIEKKTRNASKGNKKY

SEQ ID NO: 2426124 - protein, 21 aa, Entamoeba dispar
GDVETVENKSRNINKGNKKYD

SEQ ID NO: 2426125 - protein, 12 aa, Entamoeba dispar
GDVKSKNSNGIT

SEQ ID NO: 2426126 - protein, 5 aa, Entamoeba dispar
GDVNE

SEQ ID NO: 2426127 - protein, 9 aa, Entamoeba dispar
GDVPESEIQ

SEQ ID NO: 2426128 - protein, 6 aa, Entamoeba dispar
GDVRTA

SEQ ID NO: 2426129 - protein, 4 aa, Entamoeba dispar
GDWW

SEQ ID NO: 2426130 - protein, 5 aa, Entamoeba dispar
GDYDD

SEQ ID NO: 2426131 - protein, 17 aa, Entamoeba dispar
GDYDNQEDDGLFSSPRR

SEQ ID NO: 2426132 - protein, 4 aa, Entamoeba dispar
GDYQ

SEQ ID NO: 2426133 - protein, 6 aa, Entamoeba dispar
GDYTLS

SEQ ID NO: 2426134 - protein, 20 aa, Entamoeba dispar
GEAAGYESVDDAIKNHAERI

SEQ ID NO: 2426135 - protein, 10 aa, Entamoeba dispar
GEAEIEEGKK

SEQ ID NO: 2426136 - protein, 6 aa, Entamoeba dispar
GEAERA

SEQ ID NO: 2426137 - protein, 9 aa, Entamoeba dispar
GEAGAGKSQ

SEQ ID NO: 2426138 - protein, 11 aa, Entamoeba dispar
GEAGGSSDETE

SEQ ID NO: 2426139 - protein, 12 aa, Entamoeba dispar
GEAGGSSDETEV

SEQ ID NO: 2426140 - protein, 13 aa, Entamoeba dispar
GEAKSVEDGKEDL

SEQ ID NO: 2426141 - protein, 10 aa, Entamoeba dispar
GEANGHDSIG

SEQ ID NO: 2426142 - protein, 6 aa, Entamoeba dispar
GEAQLN

SEQ ID NO: 2426143 - protein, 6 aa, Entamoeba dispar
GEARSF

SEQ ID NO: 2426144 - protein, 10 aa, Entamoeba dispar
GEASLEITSS

SEQ ID NO: 2426145 - protein, 12 aa, Entamoeba dispar
GECDYEEANERA

SEQ ID NO: 2426146 - protein, 4 aa, Entamoeba dispar
GEDD

SEQ ID NO: 2426147 - protein, 19 aa, Entamoeba dispar
GEDDEQSHEDDNEKKNNIE

SEQ ID NO: 2426148 - protein, 5 aa, Entamoeba dispar
GEDDR

SEQ ID NO: 2426149 - protein, 9 aa, Entamoeba dispar
GEDEDIKST

SEQ ID NO: 2426150 - protein, 12 aa, Entamoeba dispar
GEDEDNEKDVES

SEQ ID NO: 2426151 - protein, 7 aa, Entamoeba dispar
GEDEEEK

SEQ ID NO: 2426152 - protein, 4 aa, Entamoeba dispar
GEDG

SEQ ID NO: 2426153 - protein, 5 aa, Entamoeba dispar
GEDGK

SEQ ID NO: 2426154 - protein, 6 aa, Entamoeba dispar
GEDGNR

SEQ ID NO: 2426155 - protein, 10 aa, Entamoeba dispar
GEDGQGEGGL

SEQ ID NO: 2426156 - protein, 5 aa, Entamoeba dispar
GEDIG

SEQ ID NO: 2426157 - protein, 8 aa, Entamoeba dispar
GEDKKEAC

SEQ ID NO: 2426158 - protein, 7 aa, Entamoeba dispar
GEDKKEN

SEQ ID NO: 2426159 - protein, 6 aa, Entamoeba dispar
GEDKRM

SEQ ID NO: 2426160 - protein, 4 aa, Entamoeba dispar
GEDL

SEQ ID NO: 2426161 - protein, 22 aa, Entamoeba dispar
GEDLPNRSIPELPKEHTKTSVA

SEQ ID NO: 2426162 - protein, 8 aa, Entamoeba dispar
GEDNDGKI

SEQ ID NO: 2426163 - protein, 19 aa, Entamoeba dispar
GEDNEPDKLNELNTLLKDM

SEQ ID NO: 2426164 - protein, 11 aa, Entamoeba dispar
GEDPQITNTLQ

SEQ ID NO: 2426165 - protein, 6 aa, Entamoeba dispar
GEDQQI

SEQ ID NO: 2426166 - protein, 6 aa, Entamoeba dispar
GEDSFT

SEQ ID NO: 2426167 - protein, 5 aa, Entamoeba dispar
GEDSV

SEQ ID NO: 2426168 - protein, 15 aa, Entamoeba dispar
GEDTFTVQSLHIIEW

SEQ ID NO: 2426169 - protein, 7 aa, Entamoeba dispar
GEDTLNN

SEQ ID NO: 2426170 - protein, 12 aa, Entamoeba dispar
GEDTSKLPKSED

SEQ ID NO: 2426171 - protein, 7 aa, Entamoeba dispar
GEDTTQY

SEQ ID NO: 2426172 - protein, 9 aa, Entamoeba dispar
GEDTVEEGV

SEQ ID NO: 2426173 - protein, 4 aa, Entamoeba dispar
GEDV

SEQ ID NO: 2426174 - protein, 4 aa, Entamoeba dispar
GEDY

SEQ ID NO: 2426175 - protein, 6 aa, Entamoeba dispar
GEEAMR

SEQ ID NO: 2426176 - protein, 6 aa, Entamoeba dispar
GEEATG

SEQ ID NO: 2426177 - protein, 7 aa, Entamoeba dispar
GEEDETL

SEQ ID NO: 2426178 - protein, 8 aa, Entamoeba dispar
GEEDGEYW

SEQ ID NO: 2426179 - protein, 9 aa, Entamoeba dispar
GEEDIGGEG

SEQ ID NO: 2426180 - protein, 7 aa, Entamoeba dispar
GEEEDIE

SEQ ID NO: 2426181 - protein, 32 aa, Entamoeba dispar
GEEEEGTKEKIEGESVTEEVKEEKYKEDTVED

SEQ ID NO: 2426182 - protein, 34 aa, Entamoeba dispar
GEEENKNTFVSNNPPEQNNEKKYSASDKRKDIAD

SEQ ID NO: 2426183 - protein, 4 aa, Entamoeba dispar
GEEF

SEQ ID NO: 2426184 - protein, 5 aa, Entamoeba dispar
GEEFP

SEQ ID NO: 2426185 - protein, 14 aa, Entamoeba dispar
GEEIEEKEMKNEEK

SEQ ID NO: 2426186 - protein, 11 aa, Entamoeba dispar
GEEIKEPMTSM

SEQ ID NO: 2426187 - protein, 5 aa, Entamoeba dispar
GEEIN

SEQ ID NO: 2426188 - protein, 18 aa, Entamoeba dispar
GEEKKEEDSSPKKSAFQT

SEQ ID NO: 2426189 - protein, 10 aa, Entamoeba dispar
GEEKKIKREQ

SEQ ID NO: 2426190 - protein, 10 aa, Entamoeba dispar
GEEKRNILEE

SEQ ID NO: 2426191 - protein, 11 aa, Entamoeba dispar
GEEKRNILEEK

SEQ ID NO: 2426192 - protein, 4 aa, Entamoeba dispar
GEEL

SEQ ID NO: 2426193 - protein, 11 aa, Entamoeba dispar
GEELGESERSM

SEQ ID NO: 2426194 - protein, 4 aa, Entamoeba dispar
GEEN

SEQ ID NO: 2426195 - protein, 18 aa, Entamoeba dispar
GEENETENEEDSYSSDYS

SEQ ID NO: 2426196 - protein, 11 aa, Entamoeba dispar
GEENKKKEQIN

SEQ ID NO: 2426197 - protein, 15 aa, Entamoeba dispar
GEENNNNDNNNTGIC

SEQ ID NO: 2426198 - protein, 45 aa, Entamoeba dispar
GEENQNNKEPSVVNQQDEYQHEEITTKTSDDQLTKDQIDKNHSNV

SEQ ID NO: 2426199 - protein, 9 aa, Entamoeba dispar
GEENYGGTS

SEQ ID NO: 2426200 - protein, 15 aa, Entamoeba dispar
GEENYPGNRKKLYEG

SEQ ID NO: 2426201 - protein, 17 aa, Entamoeba dispar
GEEPGPSKIEKAKEKGI

SEQ ID NO: 2426202 - protein, 5 aa, Entamoeba dispar
GEEPL

SEQ ID NO: 2426203 - protein, 4 aa, Entamoeba dispar
GEEQ

SEQ ID NO: 2426204 - protein, 6 aa, Entamoeba dispar
GEEQLE

SEQ ID NO: 2426205 - protein, 7 aa, Entamoeba dispar
GEEQLRE

SEQ ID NO: 2426206 - protein, 4 aa, Entamoeba dispar
GEES

SEQ ID NO: 2426207 - protein, 6 aa, Entamoeba dispar
GEESEK

SEQ ID NO: 2426208 - protein, 15 aa, Entamoeba dispar
GEETLNEDEETTRNE

SEQ ID NO: 2426209 - protein, 15 aa, Entamoeba dispar
GEETNDTHKELTDEP

SEQ ID NO: 2426210 - protein, 13 aa, Entamoeba dispar
GEEVNAKVSSKKF

SEQ ID NO: 2426211 - protein, 4 aa, Entamoeba dispar
GEEY

SEQ ID NO: 2426212 - protein, 6 aa, Entamoeba dispar
GEFKDK

SEQ ID NO: 2426213 - protein, 4 aa, Entamoeba dispar
GEFP

SEQ ID NO: 2426214 - protein, 6 aa, Entamoeba dispar
GEGDEQ

SEQ ID NO: 2426215 - protein, 6 aa, Entamoeba dispar
GEGDMK

SEQ ID NO: 2426216 - protein, 6 aa, Entamoeba dispar
GEGDNE

SEQ ID NO: 2426217 - protein, 6 aa, Entamoeba dispar
GEGDRN

SEQ ID NO: 2426218 - protein, 8 aa, Entamoeba dispar
GEGEEDTI

SEQ ID NO: 2426219 - protein, 12 aa, Entamoeba dispar
GEGEKYTKEASK

SEQ ID NO: 2426220 - protein, 5 aa, Entamoeba dispar
GEGEM

SEQ ID NO: 2426221 - protein, 9 aa, Entamoeba dispar
GEGEQNNGL

SEQ ID NO: 2426222 - protein, 6 aa, Entamoeba dispar
GEGGFG

SEQ ID NO: 2426223 - protein, 6 aa, Entamoeba dispar
GEGGMK

SEQ ID NO: 2426224 - protein, 17 aa, Entamoeba dispar
GEGGVYSKTPGPGAQAA

SEQ ID NO: 2426225 - protein, 13 aa, Entamoeba dispar
GEGIERPNDQEDN

SEQ ID NO: 2426226 - protein, 4 aa, Entamoeba dispar
GEGL

SEQ ID NO: 2426227 - protein, 4 aa, Entamoeba dispar
GEGN

SEQ ID NO: 2426228 - protein, 13 aa, Entamoeba dispar
GEGNPIEGDCPER

SEQ ID NO: 2426229 - protein, 5 aa, Entamoeba dispar
GEGPR

SEQ ID NO: 2426230 - protein, 8 aa, Entamoeba dispar
GEGQTSQK

SEQ ID NO: 2426231 - protein, 7 aa, Entamoeba dispar
GEGRLED

SEQ ID NO: 2426232 - protein, 5 aa, Entamoeba dispar
GEGVF

SEQ ID NO: 2426233 - protein, 8 aa, Entamoeba dispar
GEHGSGKT

SEQ ID NO: 2426234 - protein, 4 aa, Entamoeba dispar
GEHP

SEQ ID NO: 2426235 - protein, 6 aa, Entamoeba dispar
GEIEEQ

SEQ ID NO: 2426236 - protein, 5 aa, Entamoeba dispar
GEIEG

SEQ ID NO: 2426237 - protein, 7 aa, Entamoeba dispar
GEIIENA

SEQ ID NO: 2426238 - protein, 4 aa, Entamoeba dispar
GEIK

SEQ ID NO: 2426239 - protein, 7 aa, Entamoeba dispar
GEINGYR

SEQ ID NO: 2426240 - protein, 6 aa, Entamoeba dispar
GEINSF

SEQ ID NO: 2426241 - protein, 12 aa, Entamoeba dispar
GEIPEDGIPYSK

SEQ ID NO: 2426242 - protein, 7 aa, Entamoeba dispar
GEIPEKG

SEQ ID NO: 2426243 - protein, 14 aa, Entamoeba dispar
GEIQKGEKERKVQL

SEQ ID NO: 2426244 - protein, 17 aa, Entamoeba dispar
GEIQNSNYSISYGKPAI

SEQ ID NO: 2426245 - protein, 31 aa, Entamoeba dispar
GEIRQEGRKEIKEMKEEIKRAKKRSEEIKEE

SEQ ID NO: 2426246 - protein, 8 aa, Entamoeba dispar
GEISNNKK

SEQ ID NO: 2426247 - protein, 8 aa, Entamoeba dispar
GEISPTKY

SEQ ID NO: 2426248 - protein, 12 aa, Entamoeba dispar
GEITNKEIEERK

SEQ ID NO: 2426249 - protein, 5 aa, Entamoeba dispar
GEKAV

SEQ ID NO: 2426250 - protein, 5 aa, Entamoeba dispar
GEKDM

SEQ ID NO: 2426251 - protein, 16 aa, Entamoeba dispar
GEKEGKIKSAEDGGDD

SEQ ID NO: 2426252 - protein, 6 aa, Entamoeba dispar
GEKEKV

SEQ ID NO: 2426253 - protein, 8 aa, Entamoeba dispar
GEKELNPV

SEQ ID NO: 2426254 - protein, 11 aa, Entamoeba dispar
GEKEMKKQTPL

SEQ ID NO: 2426255 - protein, 16 aa, Entamoeba dispar
GEKFTEDKDHGFVNVE

SEQ ID NO: 2426256 - protein, 7 aa, Entamoeba dispar
GEKGNFK

SEQ ID NO: 2426257 - protein, 9 aa, Entamoeba dispar
GEKGNGLTY

SEQ ID NO: 2426258 - protein, 9 aa, Entamoeba dispar
GEKGSYVYD

SEQ ID NO: 2426259 - protein, 10 aa, Entamoeba dispar
GEKKEKEEID

SEQ ID NO: 2426260 - protein, 5 aa, Entamoeba dispar
GEKLI

SEQ ID NO: 2426261 - protein, 8 aa, Entamoeba dispar
GEKLPTHE

SEQ ID NO: 2426262 - protein, 7 aa, Entamoeba dispar
GEKLPTN

SEQ ID NO: 2426263 - protein, 12 aa, Entamoeba dispar
GEKNTRKAQKTV

SEQ ID NO: 2426264 - protein, 5 aa, Entamoeba dispar
GEKQS

SEQ ID NO: 2426265 - protein, 10 aa, Entamoeba dispar
GEKRTSDEER

SEQ ID NO: 2426266 - protein, 4 aa, Entamoeba dispar
GEKS

SEQ ID NO: 2426267 - protein, 6 aa, Entamoeba dispar
GEKSEL

SEQ ID NO: 2426268 - protein, 10 aa, Entamoeba dispar
GEKSKDGIPE

SEQ ID NO: 2426269 - protein, 9 aa, Entamoeba dispar
GEKSYKENA

SEQ ID NO: 2426270 - protein, 8 aa, Entamoeba dispar
GEKTDCDI

SEQ ID NO: 2426271 - protein, 6 aa, Entamoeba dispar
GEKTKQ

SEQ ID NO: 2426272 - protein, 6 aa, Entamoeba dispar
GEKTLT

SEQ ID NO: 2426273 - protein, 4 aa, Entamoeba dispar
GEKV

SEQ ID NO: 2426274 - protein, 5 aa, Entamoeba dispar
GEKVD

SEQ ID NO: 2426275 - protein, 13 aa, Entamoeba dispar
GELDDEMEEENNI

SEQ ID NO: 2426276 - protein, 14 aa, Entamoeba dispar
GELDKKHDQVEEAK

SEQ ID NO: 2426277 - protein, 19 aa, Entamoeba dispar
GELEEVNGKLTKKVNGMER

SEQ ID NO: 2426278 - protein, 6 aa, Entamoeba dispar
GELEKE

SEQ ID NO: 2426279 - protein, 11 aa, Entamoeba dispar
GELEKKKGNLP

SEQ ID NO: 2426280 - protein, 15 aa, Entamoeba dispar
GELESKEQEVNKAGD

SEQ ID NO: 2426281 - protein, 12 aa, Entamoeba dispar
GELIKKSPGTYQ

SEQ ID NO: 2426282 - protein, 14 aa, Entamoeba dispar
GELISDSDKCKTCH

SEQ ID NO: 2426283 - protein, 12 aa, Entamoeba dispar
GELKDKKKQQVT

SEQ ID NO: 2426284 - protein, 11 aa, Entamoeba dispar
GELKKSKKITG

SEQ ID NO: 2426285 - protein, 5 aa, Entamoeba dispar
GELKQ

SEQ ID NO: 2426286 - protein, 5 aa, Entamoeba dispar
GELKS

SEQ ID NO: 2426287 - protein, 8 aa, Entamoeba dispar
GELNKNIE

SEQ ID NO: 2426288 - protein, 7 aa, Entamoeba dispar
GELPPEI

SEQ ID NO: 2426289 - protein, 4 aa, Entamoeba dispar
GELS

SEQ ID NO: 2426290 - protein, 6 aa, Entamoeba dispar
GELSER

SEQ ID NO: 2426291 - protein, 11 aa, Entamoeba dispar
GELTEADQSNN

SEQ ID NO: 2426292 - protein, 5 aa, Entamoeba dispar
GELTG

SEQ ID NO: 2426293 - protein, 13 aa, Entamoeba dispar
GELVEDDTGTTVG

SEQ ID NO: 2426294 - protein, 18 aa, Entamoeba dispar
GEMDLNKSGGKKTARITG

SEQ ID NO: 2426295 - protein, 4 aa, Entamoeba dispar
GEME

SEQ ID NO: 2426296 - protein, 4 aa, Entamoeba dispar
GEMG

SEQ ID NO: 2426297 - protein, 4 aa, Entamoeba dispar
GEMK

SEQ ID NO: 2426298 - protein, 4 aa, Entamoeba dispar
GEMN

SEQ ID NO: 2426299 - protein, 5 aa, Entamoeba dispar
GEMRE

SEQ ID NO: 2426300 - protein, 11 aa, Entamoeba dispar
GEMRSREKIEE

SEQ ID NO: 2426301 - protein, 6 aa, Entamoeba dispar
GEMTRN

SEQ ID NO: 2426302 - protein, 6 aa, Entamoeba dispar
GENEDI

SEQ ID NO: 2426303 - protein, 6 aa, Entamoeba dispar
GENEYN

SEQ ID NO: 2426304 - protein, 7 aa, Entamoeba dispar
GENEYNQ

SEQ ID NO: 2426305 - protein, 4 aa, Entamoeba dispar
GENF

SEQ ID NO: 2426306 - protein, 8 aa, Entamoeba dispar
GENGETAA

SEQ ID NO: 2426307 - protein, 7 aa, Entamoeba dispar
GENGLGQ

SEQ ID NO: 2426308 - protein, 8 aa, Entamoeba dispar
GENGNLKQ

SEQ ID NO: 2426309 - protein, 7 aa, Entamoeba dispar
GENGSIK

SEQ ID NO: 2426310 - protein, 4 aa, Entamoeba dispar
GENH

SEQ ID NO: 2426311 - protein, 4 aa, Entamoeba dispar
GENI

SEQ ID NO: 2426312 - protein, 8 aa, Entamoeba dispar
GENIDKKN

SEQ ID NO: 2426313 - protein, 9 aa, Entamoeba dispar
GENKTYASD

SEQ ID NO: 2426314 - protein, 7 aa, Entamoeba dispar
GENLEHG

SEQ ID NO: 2426315 - protein, 12 aa, Entamoeba dispar
GENNEYKENRIP

SEQ ID NO: 2426316 - protein, 12 aa, Entamoeba dispar
GENNPIKSPRPI

SEQ ID NO: 2426317 - protein, 5 aa, Entamoeba dispar
GENPK

SEQ ID NO: 2426318 - protein, 7 aa, Entamoeba dispar
GENPKYV

SEQ ID NO: 2426319 - protein, 5 aa, Entamoeba dispar
GENQV

SEQ ID NO: 2426320 - protein, 4 aa, Entamoeba dispar
GENR

SEQ ID NO: 2426321 - protein, 16 aa, Entamoeba dispar
GEPDASGRAAPVPIPG

SEQ ID NO: 2426322 - protein, 5 aa, Entamoeba dispar
GEPET

SEQ ID NO: 2426323 - protein, 8 aa, Entamoeba dispar
GEPFTQKS

SEQ ID NO: 2426324 - protein, 5 aa, Entamoeba dispar
GEPIT

SEQ ID NO: 2426325 - protein, 9 aa, Entamoeba dispar
GEPKTFQDT

SEQ ID NO: 2426326 - protein, 15 aa, Entamoeba dispar
GEPLEKEQVELKNGE

SEQ ID NO: 2426327 - protein, 18 aa, Entamoeba dispar
GEPLEREEEGGPNDIGYD

SEQ ID NO: 2426328 - protein, 12 aa, Entamoeba dispar
GEPLESPQSLDS

SEQ ID NO: 2426329 - protein, 5 aa, Entamoeba dispar
GEPNR

SEQ ID NO: 2426330 - protein, 13 aa, Entamoeba dispar
GEPPFQSATRDEV

SEQ ID NO: 2426331 - protein, 8 aa, Entamoeba dispar
GEPPGTEL

SEQ ID NO: 2426332 - protein, 10 aa, Entamoeba dispar
GEPPSAISQT

SEQ ID NO: 2426333 - protein, 7 aa, Entamoeba dispar
GEPSPVS

SEQ ID NO: 2426334 - protein, 6 aa, Entamoeba dispar
GEPTVR

SEQ ID NO: 2426335 - protein, 8 aa, Entamoeba dispar
GEPVTTRD

SEQ ID NO: 2426336 - protein, 6 aa, Entamoeba dispar
GEPYET

SEQ ID NO: 2426337 - protein, 4 aa, Entamoeba dispar
GEQA

SEQ ID NO: 2426338 - protein, 6 aa, Entamoeba dispar
GEQEGD

SEQ ID NO: 2426339 - protein, 25 aa, Entamoeba dispar
GEQEQEINGVGYGEVKGTQLQGENR

SEQ ID NO: 2426340 - protein, 5 aa, Entamoeba dispar
GEQER

SEQ ID NO: 2426341 - protein, 7 aa, Entamoeba dispar
GEQERQF

SEQ ID NO: 2426342 - protein, 6 aa, Entamoeba dispar
GEQFGD

SEQ ID NO: 2426343 - protein, 8 aa, Entamoeba dispar
GEQGKHPL

SEQ ID NO: 2426344 - protein, 6 aa, Entamoeba dispar
GEQKTE

SEQ ID NO: 2426345 - protein, 16 aa, Entamoeba dispar
GEQMGGLRSGTIDTPS

SEQ ID NO: 2426346 - protein, 7 aa, Entamoeba dispar
GEQNTQL

SEQ ID NO: 2426347 - protein, 13 aa, Entamoeba dispar
GEQPLPAPKLDPI

SEQ ID NO: 2426348 - protein, 29 aa, Entamoeba dispar
GEQSKPVPPIPQKKPAPPTPSKCAPPLPT

SEQ ID NO: 2426349 - protein, 9 aa, Entamoeba dispar
GEQSSEEVE

SEQ ID NO: 2426350 - protein, 11 aa, Entamoeba dispar
GEQTQVPTQAL

SEQ ID NO: 2426351 - protein, 4 aa, Entamoeba dispar
GEQV

SEQ ID NO: 2426352 - protein, 4 aa, Entamoeba dispar
GEQY

SEQ ID NO: 2426353 - protein, 12 aa, Entamoeba dispar
GERESGADVRTQ

SEQ ID NO: 2426354 - protein, 7 aa, Entamoeba dispar
GERGNEM

SEQ ID NO: 2426355 - protein, 4 aa, Entamoeba dispar
GERI

SEQ ID NO: 2426356 - protein, 30 aa, Entamoeba dispar
GERKPQQINRNTLTQSPSTETPIQAPNSNT

SEQ ID NO: 2426357 - protein, 10 aa, Entamoeba dispar
GERKRNLKRI

SEQ ID NO: 2426358 - protein, 4 aa, Entamoeba dispar
GERM

SEQ ID NO: 2426359 - protein, 8 aa, Entamoeba dispar
GERNSTIE

SEQ ID NO: 2426360 - protein, 4 aa, Entamoeba dispar
GERP

SEQ ID NO: 2426361 - protein, 7 aa, Entamoeba dispar
GERPPLN

SEQ ID NO: 2426362 - protein, 11 aa, Entamoeba dispar
GERQKLSDNCD

SEQ ID NO: 2426363 - protein, 4 aa, Entamoeba dispar
GERR

SEQ ID NO: 2426364 - protein, 4 aa, Entamoeba dispar
GERT

SEQ ID NO: 2426365 - protein, 23 aa, Entamoeba dispar
GERTEESPKTQETVGFNGEADRK

SEQ ID NO: 2426366 - protein, 8 aa, Entamoeba dispar
GERTGREI

SEQ ID NO: 2426367 - protein, 6 aa, Entamoeba dispar
GERTNH

SEQ ID NO: 2426368 - protein, 26 aa, Entamoeba dispar
GERVKSDDPDKEEDAENKARSDAVGN

SEQ ID NO: 2426369 - protein, 10 aa, Entamoeba dispar
GESDQAPNLI

SEQ ID NO: 2426370 - protein, 6 aa, Entamoeba dispar
GESEAN

SEQ ID NO: 2426371 - protein, 7 aa, Entamoeba dispar
GESEDYT

SEQ ID NO: 2426372 - protein, 7 aa, Entamoeba dispar
GESEGFS

SEQ ID NO: 2426373 - protein, 13 aa, Entamoeba dispar
GESGAGKTENTKR

SEQ ID NO: 2426374 - protein, 10 aa, Entamoeba dispar
GESGAGKTVA

SEQ ID NO: 2426375 - protein, 8 aa, Entamoeba dispar
GESGYTQR

SEQ ID NO: 2426376 - protein, 10 aa, Entamoeba dispar
GESIAGITND

SEQ ID NO: 2426377 - protein, 5 aa, Entamoeba dispar
GESIG

SEQ ID NO: 2426378 - protein, 8 aa, Entamoeba dispar
GESIRNQT

SEQ ID NO: 2426379 - protein, 4 aa, Entamoeba dispar
GESK

SEQ ID NO: 2426380 - protein, 6 aa, Entamoeba dispar
GESNKI

SEQ ID NO: 2426381 - protein, 6 aa, Entamoeba dispar
GESNND

SEQ ID NO: 2426382 - protein, 8 aa, Entamoeba dispar
GESNSGMT

SEQ ID NO: 2426383 - protein, 5 aa, Entamoeba dispar
GESPF

SEQ ID NO: 2426384 - protein, 5 aa, Entamoeba dispar
GESPI

SEQ ID NO: 2426385 - protein, 9 aa, Entamoeba dispar
GESPTSPIS

SEQ ID NO: 2426386 - protein, 6 aa, Entamoeba dispar
GESQKL

SEQ ID NO: 2426387 - protein, 11 aa, Entamoeba dispar
GESQNSQESEV

SEQ ID NO: 2426388 - protein, 8 aa, Entamoeba dispar
GESSISKE

SEQ ID NO: 2426389 - protein, 8 aa, Entamoeba dispar
GESSVGKS

SEQ ID NO: 2426390 - protein, 5 aa, Entamoeba dispar
GESTD

SEQ ID NO: 2426391 - protein, 5 aa, Entamoeba dispar
GESTI

SEQ ID NO: 2426392 - protein, 6 aa, Entamoeba dispar
GESTRA

SEQ ID NO: 2426393 - protein, 4 aa, Entamoeba dispar
GESY

SEQ ID NO: 2426394 - protein, 8 aa, Entamoeba dispar
GESYSTNN

SEQ ID NO: 2426395 - protein, 5 aa, Entamoeba dispar
GETEA

SEQ ID NO: 2426396 - protein, 8 aa, Entamoeba dispar
GETEDKEE

SEQ ID NO: 2426397 - protein, 7 aa, Entamoeba dispar
GETEITT

SEQ ID NO: 2426398 - protein, 12 aa, Entamoeba dispar
GETGSGKTTQLP

SEQ ID NO: 2426399 - protein, 19 aa, Entamoeba dispar
GETGVNPFADEPSANALKP

SEQ ID NO: 2426400 - protein, 9 aa, Entamoeba dispar
GETHGITRK

SEQ ID NO: 2426401 - protein, 6 aa, Entamoeba dispar
GETHRQ

SEQ ID NO: 2426402 - protein, 7 aa, Entamoeba dispar
GETIGDY

SEQ ID NO: 2426403 - protein, 5 aa, Entamoeba dispar
GETKF

SEQ ID NO: 2426404 - protein, 13 aa, Entamoeba dispar
GETKIFSSSQLKL

SEQ ID NO: 2426405 - protein, 8 aa, Entamoeba dispar
GETKRLSE

SEQ ID NO: 2426406 - protein, 10 aa, Entamoeba dispar
GETKSENKKE

SEQ ID NO: 2426407 - protein, 24 aa, Entamoeba dispar
GETLAPPPKQKKEKKYIGENGEEV

SEQ ID NO: 2426408 - protein, 11 aa, Entamoeba dispar
GETLEVTQPDG

SEQ ID NO: 2426409 - protein, 7 aa, Entamoeba dispar
GETLNEV

SEQ ID NO: 2426410 - protein, 9 aa, Entamoeba dispar
GETLPTKGI

SEQ ID NO: 2426411 - protein, 10 aa, Entamoeba dispar
GETLPTKGIT

SEQ ID NO: 2426412 - protein, 24 aa, Entamoeba dispar
GETLPTKGITKRYSTTKLNQTSAK

SEQ ID NO: 2426413 - protein, 24 aa, Entamoeba dispar
GETLPTTGATKQYYTTKDNQTSAK

SEQ ID NO: 2426414 - protein, 4 aa, Entamoeba dispar
GETP

SEQ ID NO: 2426415 - protein, 8 aa, Entamoeba dispar
GETPEIKR

SEQ ID NO: 2426416 - protein, 5 aa, Entamoeba dispar
GETPL

SEQ ID NO: 2426417 - protein, 23 aa, Entamoeba dispar
GETQHKIENQRLKTKQQEDPSEI

SEQ ID NO: 2426418 - protein, 7 aa, Entamoeba dispar
GETSTLE

SEQ ID NO: 2426419 - protein, 10 aa, Entamoeba dispar
GETTPEEEEK

SEQ ID NO: 2426420 - protein, 9 aa, Entamoeba dispar
GETTQIDEL

SEQ ID NO: 2426421 - protein, 13 aa, Entamoeba dispar
GETVSKKTVKAIA

SEQ ID NO: 2426422 - protein, 7 aa, Entamoeba dispar
GETVYSK

SEQ ID NO: 2426423 - protein, 4 aa, Entamoeba dispar
GETY

SEQ ID NO: 2426424 - protein, 6 aa, Entamoeba dispar
GETYEH

SEQ ID NO: 2426425 - protein, 8 aa, Entamoeba dispar
GEVEKESL

SEQ ID NO: 2426426 - protein, 8 aa, Entamoeba dispar
GEVERKRI

SEQ ID NO: 2426427 - protein, 5 aa, Entamoeba dispar
GEVGQ

SEQ ID NO: 2426428 - protein, 10 aa, Entamoeba dispar
GEVIDDEEVG

SEQ ID NO: 2426429 - protein, 13 aa, Entamoeba dispar
GEVNEKEKTEFNE

SEQ ID NO: 2426430 - protein, 9 aa, Entamoeba dispar
GEVNKEEDQ

SEQ ID NO: 2426431 - protein, 5 aa, Entamoeba dispar
GEVPR

SEQ ID NO: 2426432 - protein, 6 aa, Entamoeba dispar
GEVPSR

SEQ ID NO: 2426433 - protein, 6 aa, Entamoeba dispar
GEVQTG

SEQ ID NO: 2426434 - protein, 17 aa, Entamoeba dispar
GEVTDENEYILQEFKKW

SEQ ID NO: 2426435 - protein, 18 aa, Entamoeba dispar
GEVYGNKKKSVFGIQWNS

SEQ ID NO: 2426436 - protein, 4 aa, Entamoeba dispar
GEWK

SEQ ID NO: 2426437 - protein, 18 aa, Entamoeba dispar
GEWNEGTAGGSVDDPDSF

SEQ ID NO: 2426438 - protein, 7 aa, Entamoeba dispar
GEYATNC

SEQ ID NO: 2426439 - protein, 9 aa, Entamoeba dispar
GEYATNCKK

SEQ ID NO: 2426440 - protein, 8 aa, Entamoeba dispar
GEYDDTTP

SEQ ID NO: 2426441 - protein, 4 aa, Entamoeba dispar
GEYE

SEQ ID NO: 2426442 - protein, 10 aa, Entamoeba dispar
GEYEDSNNSC

SEQ ID NO: 2426443 - protein, 9 aa, Entamoeba dispar
GEYEEASTI

SEQ ID NO: 2426444 - protein, 6 aa, Entamoeba dispar
GEYEEY

SEQ ID NO: 2426445 - protein, 5 aa, Entamoeba dispar
GEYEK

SEQ ID NO: 2426446 - protein, 4 aa, Entamoeba dispar
GEYG

SEQ ID NO: 2426447 - protein, 9 aa, Entamoeba dispar
GEYGEGDRS

SEQ ID NO: 2426448 - protein, 6 aa, Entamoeba dispar
GEYIST

SEQ ID NO: 2426449 - protein, 7 aa, Entamoeba dispar
GEYPPQQ

SEQ ID NO: 2426450 - protein, 6 aa, Entamoeba dispar
GEYPPR

SEQ ID NO: 2426451 - protein, 5 aa, Entamoeba dispar
GEYTN

SEQ ID NO: 2426452 - protein, 7 aa, Entamoeba dispar
GFARPEQ

SEQ ID NO: 2426453 - protein, 5 aa, Entamoeba dispar
GFASA

SEQ ID NO: 2426454 - protein, 4 aa, Entamoeba dispar
GFDD

SEQ ID NO: 2426455 - protein, 6 aa, Entamoeba dispar
GFDKRG

SEQ ID NO: 2426456 - protein, 10 aa, Entamoeba dispar
GFDKTKPEIF

SEQ ID NO: 2426457 - protein, 10 aa, Entamoeba dispar
GFDNNKAKEY

SEQ ID NO: 2426458 - protein, 9 aa, Entamoeba dispar
GFDPSSLDS

SEQ ID NO: 2426459 - protein, 8 aa, Entamoeba dispar
GFDQEAAT

SEQ ID NO: 2426460 - protein, 6 aa, Entamoeba dispar
GFDQET

SEQ ID NO: 2426461 - protein, 11 aa, Entamoeba dispar
GFDSERGNTPI

SEQ ID NO: 2426462 - protein, 32 aa, Entamoeba dispar
GFDSVDDESALEQTVGNLPSAGEWKSKENPPY

SEQ ID NO: 2426463 - protein, 6 aa, Entamoeba dispar
GFDTRG

SEQ ID NO: 2426464 - protein, 13 aa, Entamoeba dispar
GFEDKKGKKKMIE

SEQ ID NO: 2426465 - protein, 6 aa, Entamoeba dispar
GFEEEK

SEQ ID NO: 2426466 - protein, 14 aa, Entamoeba dispar
GFEEKQNDLKQKET

SEQ ID NO: 2426467 - protein, 5 aa, Entamoeba dispar
GFEEM

SEQ ID NO: 2426468 - protein, 6 aa, Entamoeba dispar
GFEGEM

SEQ ID NO: 2426469 - protein, 11 aa, Entamoeba dispar
GFEGKDNREAY

SEQ ID NO: 2426470 - protein, 12 aa, Entamoeba dispar
GFEHSEDGEGYS

SEQ ID NO: 2426471 - protein, 14 aa, Entamoeba dispar
GFEQMEERQRGENY

SEQ ID NO: 2426472 - protein, 14 aa, Entamoeba dispar
GFESKQTRGDRGNM

SEQ ID NO: 2426473 - protein, 8 aa, Entamoeba dispar
GFGESKPA

SEQ ID NO: 2426474 - protein, 27 aa, Entamoeba dispar
GFGGGFGGGFGGFERKSSGPRKGKSIQ

SEQ ID NO: 2426475 - protein, 9 aa, Entamoeba dispar
GFGGGNNIP

SEQ ID NO: 2426476 - protein, 10 aa, Entamoeba dispar
GFGNGPLKSE

SEQ ID NO: 2426477 - protein, 21 aa, Entamoeba dispar
GFGTTEKKQDEPSKEEQSSKN

SEQ ID NO: 2426478 - protein, 27 aa, Entamoeba dispar
GFHSDDGKLFNEDGNGVRFDEPYKEGD

SEQ ID NO: 2426479 - protein, 21 aa, Entamoeba dispar
GFHSDSGDLFNEGKVSQYANP

SEQ ID NO: 2426480 - protein, 6 aa, Entamoeba dispar
GFKEEK

SEQ ID NO: 2426481 - protein, 13 aa, Entamoeba dispar
GFKEREKKEIEKS

SEQ ID NO: 2426482 - protein, 7 aa, Entamoeba dispar
GFKGYKT

SEQ ID NO: 2426483 - protein, 12 aa, Entamoeba dispar
GFKKDGVSLGSP

SEQ ID NO: 2426484 - protein, 5 aa, Entamoeba dispar
GFKNQ

SEQ ID NO: 2426485 - protein, 10 aa, Entamoeba dispar
GFKNTVEKTT

SEQ ID NO: 2426486 - protein, 10 aa, Entamoeba dispar
GFKQEGGIET

SEQ ID NO: 2426487 - protein, 9 aa, Entamoeba dispar
GFLPPHASE

SEQ ID NO: 2426488 - protein, 11 aa, Entamoeba dispar
GFNESLPKQTI

SEQ ID NO: 2426489 - protein, 8 aa, Entamoeba dispar
GFNGNGNE

SEQ ID NO: 2426490 - protein, 7 aa, Entamoeba dispar
GFNGSHS

SEQ ID NO: 2426491 - protein, 8 aa, Entamoeba dispar
GFNKDERK

SEQ ID NO: 2426492 - protein, 5 aa, Entamoeba dispar
GFNNE

SEQ ID NO: 2426493 - protein, 15 aa, Entamoeba dispar
GFNNSSPSQASPHKR

SEQ ID NO: 2426494 - protein, 6 aa, Entamoeba dispar
GFPDNA

SEQ ID NO: 2426495 - protein, 20 aa, Entamoeba dispar
GFPEDQKDGKTNTTKGIDDW

SEQ ID NO: 2426496 - protein, 6 aa, Entamoeba dispar
GFPTPI

SEQ ID NO: 2426497 - protein, 5 aa, Entamoeba dispar
GFQGR

SEQ ID NO: 2426498 - protein, 9 aa, Entamoeba dispar
GFQRGRTIG

SEQ ID NO: 2426499 - protein, 4 aa, Entamoeba dispar
GFRG

SEQ ID NO: 2426500 - protein, 4 aa, Entamoeba dispar
GFSG

SEQ ID NO: 2426501 - protein, 7 aa, Entamoeba dispar
GFSKTDD

SEQ ID NO: 2426502 - protein, 4 aa, Entamoeba dispar
GFSP

SEQ ID NO: 2426503 - protein, 6 aa, Entamoeba dispar
GFSVTN

SEQ ID NO: 2426504 - protein, 12 aa, Entamoeba dispar
GFTEEEKESMLG

SEQ ID NO: 2426505 - protein, 7 aa, Entamoeba dispar
GFTEGHA

SEQ ID NO: 2426506 - protein, 5 aa, Entamoeba dispar
GFTKQ

SEQ ID NO: 2426507 - protein, 6 aa, Entamoeba dispar
GFTPKG

SEQ ID NO: 2426508 - protein, 7 aa, Entamoeba dispar
GGAGELN

SEQ ID NO: 2426509 - protein, 10 aa, Entamoeba dispar
GGAGTAADLT

SEQ ID NO: 2426510 - protein, 8 aa, Entamoeba dispar
GGAHAGNA

SEQ ID NO: 2426511 - protein, 7 aa, Entamoeba dispar
GGAHGGH

SEQ ID NO: 2426512 - protein, 14 aa, Entamoeba dispar
GGAHPWGETSELDR

SEQ ID NO: 2426513 - protein, 5 aa, Entamoeba dispar
GGAPI

SEQ ID NO: 2426514 - protein, 4 aa, Entamoeba dispar
GGAQ

SEQ ID NO: 2426515 - protein, 6 aa, Entamoeba dispar
GGAQNQ

SEQ ID NO: 2426516 - protein, 7 aa, Entamoeba dispar
GGATSNI

SEQ ID NO: 2426517 - protein, 5 aa, Entamoeba dispar
GGATV

SEQ ID NO: 2426518 - protein, 13 aa, Entamoeba dispar
GGAVPGKSRNVSG

SEQ ID NO: 2426519 - protein, 41 aa, Entamoeba dispar
GGCCGGQGGCCGGQGGCCGGQGGCCGGQGGCCGGQGCYGGM

SEQ ID NO: 2426520 - protein, 6 aa, Entamoeba dispar
GGCKEQ

SEQ ID NO: 2426521 - protein, 13 aa, Entamoeba dispar
GGCNEAKKQIKQE

SEQ ID NO: 2426522 - protein, 5 aa, Entamoeba dispar
GGCRQ

SEQ ID NO: 2426523 - protein, 11 aa, Entamoeba dispar
GGDADIVDEDG

SEQ ID NO: 2426524 - protein, 4 aa, Entamoeba dispar
GGDD

SEQ ID NO: 2426525 - protein, 7 aa, Entamoeba dispar
GGDDGEL

SEQ ID NO: 2426526 - protein, 10 aa, Entamoeba dispar
GGDEWKPTSK

SEQ ID NO: 2426527 - protein, 4 aa, Entamoeba dispar
GGDG

SEQ ID NO: 2426528 - protein, 7 aa, Entamoeba dispar
GGDGEQI

SEQ ID NO: 2426529 - protein, 5 aa, Entamoeba dispar
GGDGF

SEQ ID NO: 2426530 - protein, 6 aa, Entamoeba dispar
GGDGTM

SEQ ID NO: 2426531 - protein, 4 aa, Entamoeba dispar
GGDI

SEQ ID NO: 2426532 - protein, 5 aa, Entamoeba dispar
GGDIL

SEQ ID NO: 2426533 - protein, 9 aa, Entamoeba dispar
GGDLVPEGC

SEQ ID NO: 2426534 - protein, 13 aa, Entamoeba dispar
GGDSKKSEKARIR

SEQ ID NO: 2426535 - protein, 6 aa, Entamoeba dispar
GGDVKI

SEQ ID NO: 2426536 - protein, 5 aa, Entamoeba dispar
GGDVL

SEQ ID NO: 2426537 - protein, 6 aa, Entamoeba dispar
GGEAFN

SEQ ID NO: 2426538 - protein, 5 aa, Entamoeba dispar
GGEDT

SEQ ID NO: 2426539 - protein, 8 aa, Entamoeba dispar
GGEEKTKS

SEQ ID NO: 2426540 - protein, 8 aa, Entamoeba dispar
GGEENTLK

SEQ ID NO: 2426541 - protein, 4 aa, Entamoeba dispar
GGEF

SEQ ID NO: 2426542 - protein, 15 aa, Entamoeba dispar
GGEIKERIETSKITN

SEQ ID NO: 2426543 - protein, 6 aa, Entamoeba dispar
GGEKAG

SEQ ID NO: 2426544 - protein, 14 aa, Entamoeba dispar
GGEKKEEEEDTSKI

SEQ ID NO: 2426545 - protein, 17 aa, Entamoeba dispar
GGEKKPGCDGHGGCHRQ

SEQ ID NO: 2426546 - protein, 10 aa, Entamoeba dispar
GGELKPGKGF

SEQ ID NO: 2426547 - protein, 18 aa, Entamoeba dispar
GGEPNKPPFIQQSSSNDI

SEQ ID NO: 2426548 - protein, 4 aa, Entamoeba dispar
GGER

SEQ ID NO: 2426549 - protein, 6 aa, Entamoeba dispar
GGERID

SEQ ID NO: 2426550 - protein, 9 aa, Entamoeba dispar
GGESENSDD

SEQ ID NO: 2426551 - protein, 5 aa, Entamoeba dispar
GGESG

SEQ ID NO: 2426552 - protein, 14 aa, Entamoeba dispar
GGESQTEESIQKTK

SEQ ID NO: 2426553 - protein, 6 aa, Entamoeba dispar
GGETAR

SEQ ID NO: 2426554 - protein, 4 aa, Entamoeba dispar
GGEW

SEQ ID NO: 2426555 - protein, 20 aa, Entamoeba dispar
GGEWRGSPESYMGHKSSVED

SEQ ID NO: 2426556 - protein, 6 aa, Entamoeba dispar
GGEYRR

SEQ ID NO: 2426557 - protein, 5 aa, Entamoeba dispar
GGFDT

SEQ ID NO: 2426558 - protein, 15 aa, Entamoeba dispar
GGFGKNNGQFKLPTG

SEQ ID NO: 2426559 - protein, 8 aa, Entamoeba dispar
GGFNSETV

SEQ ID NO: 2426560 - protein, 20 aa, Entamoeba dispar
GGFNTSTSGGFNTSTSGGFN

SEQ ID NO: 2426561 - protein, 15 aa, Entamoeba dispar
GGFTQSSPRKNVENK

SEQ ID NO: 2426562 - protein, 8 aa, Entamoeba dispar
GGGATDVG

SEQ ID NO: 2426563 - protein, 9 aa, Entamoeba dispar
GGGDTPTAL

SEQ ID NO: 2426564 - protein, 8 aa, Entamoeba dispar
GGGEGPAL

SEQ ID NO: 2426565 - protein, 4 aa, Entamoeba dispar
GGGI

SEQ ID NO: 2426566 - protein, 12 aa, Entamoeba dispar
GGGIGEERRGKF

SEQ ID NO: 2426567 - protein, 6 aa, Entamoeba dispar
GGGIGQ

SEQ ID NO: 2426568 - protein, 5 aa, Entamoeba dispar
GGGIK

SEQ ID NO: 2426569 - protein, 6 aa, Entamoeba dispar
GGGILS

SEQ ID NO: 2426570 - protein, 8 aa, Entamoeba dispar
GGGIRDRT

SEQ ID NO: 2426571 - protein, 13 aa, Entamoeba dispar
GGGLGQPQGLGLG

SEQ ID NO: 2426572 - protein, 4 aa, Entamoeba dispar
GGGQ

SEQ ID NO: 2426573 - protein, 8 aa, Entamoeba dispar
GGGSANKS

SEQ ID NO: 2426574 - protein, 6 aa, Entamoeba dispar
GGGSFG

SEQ ID NO: 2426575 - protein, 7 aa, Entamoeba dispar
GGGSGSV

SEQ ID NO: 2426576 - protein, 5 aa, Entamoeba dispar
GGGSR

SEQ ID NO: 2426577 - protein, 11 aa, Entamoeba dispar
GGGTNPAYEPN

SEQ ID NO: 2426578 - protein, 4 aa, Entamoeba dispar
GGGV

SEQ ID NO: 2426579 - protein, 11 aa, Entamoeba dispar
GGGYETEEDYP

SEQ ID NO: 2426580 - protein, 13 aa, Entamoeba dispar
GGHEKKGQLGGTD

SEQ ID NO: 2426581 - protein, 13 aa, Entamoeba dispar
GGHGGPQQLHPDG

SEQ ID NO: 2426582 - protein, 11 aa, Entamoeba dispar
GGIAKGTKAVG

SEQ ID NO: 2426583 - protein, 8 aa, Entamoeba dispar
GGIARKRV

SEQ ID NO: 2426584 - protein, 4 aa, Entamoeba dispar
GGID

SEQ ID NO: 2426585 - protein, 7 aa, Entamoeba dispar
GGIDSSV

SEQ ID NO: 2426586 - protein, 4 aa, Entamoeba dispar
GGIE

SEQ ID NO: 2426587 - protein, 5 aa, Entamoeba dispar
GGIEA

SEQ ID NO: 2426588 - protein, 21 aa, Entamoeba dispar
GGIENQKINNKEIEHKPQKKI

SEQ ID NO: 2426589 - protein, 13 aa, Entamoeba dispar
GGIGAARETRRTL

SEQ ID NO: 2426590 - protein, 9 aa, Entamoeba dispar
GGIGKTIPQ

SEQ ID NO: 2426591 - protein, 30 aa, Entamoeba dispar
GGIKRKKEENKDNNGKKIKQEENELDILNP

SEQ ID NO: 2426592 - protein, 6 aa, Entamoeba dispar
GGINKD

SEQ ID NO: 2426593 - protein, 6 aa, Entamoeba dispar
GGIPEY

SEQ ID NO: 2426594 - protein, 6 aa, Entamoeba dispar
GGIPGI

SEQ ID NO: 2426595 - protein, 7 aa, Entamoeba dispar
GGIPKDI

SEQ ID NO: 2426596 - protein, 8 aa, Entamoeba dispar
GGIPSRES

SEQ ID NO: 2426597 - protein, 5 aa, Entamoeba dispar
GGIRN

SEQ ID NO: 2426598 - protein, 14 aa, Entamoeba dispar
GGIRPDVEAPKNKI

SEQ ID NO: 2426599 - protein, 5 aa, Entamoeba dispar
GGISP

SEQ ID NO: 2426600 - protein, 7 aa, Entamoeba dispar
GGITLGK

SEQ ID NO: 2426601 - protein, 15 aa, Entamoeba dispar
GGITTDEYKKNKDVV

SEQ ID NO: 2426602 - protein, 6 aa, Entamoeba dispar
GGITTE

SEQ ID NO: 2426603 - protein, 14 aa, Entamoeba dispar
GGKALVDEKQSPNC

SEQ ID NO: 2426604 - protein, 9 aa, Entamoeba dispar
GGKDSSPAE

SEQ ID NO: 2426605 - protein, 10 aa, Entamoeba dispar
GGKEIKNLTG

SEQ ID NO: 2426606 - protein, 13 aa, Entamoeba dispar
GGKELAKDASGRR

SEQ ID NO: 2426607 - protein, 7 aa, Entamoeba dispar
GGKFDRA

SEQ ID NO: 2426608 - protein, 8 aa, Entamoeba dispar
GGKGAPQF

SEQ ID NO: 2426609 - protein, 7 aa, Entamoeba dispar
GGKGGFG

SEQ ID NO: 2426610 - protein, 10 aa, Entamoeba dispar
GGKGSTQYQD

SEQ ID NO: 2426611 - protein, 9 aa, Entamoeba dispar
GGKGVGKST

SEQ ID NO: 2426612 - protein, 39 aa, Entamoeba dispar
GGKGVTLGKGSKGAKASKGGKRIRTKTQQDALKGITKPA

SEQ ID NO: 2426613 - protein, 39 aa, Entamoeba dispar
GGKGVTLGKGSKGAKASNGGKRIRTKTQQDALKGITKPA

SEQ ID NO: 2426614 - protein, 6 aa, Entamoeba dispar
GGKHGW

SEQ ID NO: 2426615 - protein, 10 aa, Entamoeba dispar
GGKHPDPNLT

SEQ ID NO: 2426616 - protein, 9 aa, Entamoeba dispar
GGKIEERKG

SEQ ID NO: 2426617 - protein, 15 aa, Entamoeba dispar
GGKIRKSGTKMSQRD

SEQ ID NO: 2426618 - protein, 4 aa, Entamoeba dispar
GGKK

SEQ ID NO: 2426619 - protein, 9 aa, Entamoeba dispar
GGKKESQKL

SEQ ID NO: 2426620 - protein, 10 aa, Entamoeba dispar
GGKKKKELKG

SEQ ID NO: 2426621 - protein, 7 aa, Entamoeba dispar
GGKKQNW

SEQ ID NO: 2426622 - protein, 24 aa, Entamoeba dispar
GGKNDNIVKAEPNQDDLEDKDCTD

SEQ ID NO: 2426623 - protein, 8 aa, Entamoeba dispar
GGKNIQQG

SEQ ID NO: 2426624 - protein, 7 aa, Entamoeba dispar
GGKREGH

SEQ ID NO: 2426625 - protein, 26 aa, Entamoeba dispar
GGKSEEEASEILDKSGGDITFNQIKL

SEQ ID NO: 2426626 - protein, 7 aa, Entamoeba dispar
GGKSSSA

SEQ ID NO: 2426627 - protein, 6 aa, Entamoeba dispar
GGKTNV

SEQ ID NO: 2426628 - protein, 6 aa, Entamoeba dispar
GGKVKT

SEQ ID NO: 2426629 - protein, 10 aa, Entamoeba dispar
GGKWDVSKGN

SEQ ID NO: 2426630 - protein, 6 aa, Entamoeba dispar
GGKWKS

SEQ ID NO: 2426631 - protein, 10 aa, Entamoeba dispar
GGLEQTKSEL

SEQ ID NO: 2426632 - protein, 9 aa, Entamoeba dispar
GGLERNTTR

SEQ ID NO: 2426633 - protein, 27 aa, Entamoeba dispar
GGLGLGGGLGQPQGLGLGGGLGQPQGL

SEQ ID NO: 2426634 - protein, 51 aa, Entamoeba dispar
GGLGLGGGLGQPQGLGLGGGLGQSSGLPSLGQPSMPTISGQGGAGINGGEL

SEQ ID NO: 2426635 - protein, 7 aa, Entamoeba dispar
GGLGSGC

SEQ ID NO: 2426636 - protein, 4 aa, Entamoeba dispar
GGLK

SEQ ID NO: 2426637 - protein, 10 aa, Entamoeba dispar
GGLKQTQQLG

SEQ ID NO: 2426638 - protein, 11 aa, Entamoeba dispar
GGLPGADNLAG

SEQ ID NO: 2426639 - protein, 10 aa, Entamoeba dispar
GGLRDGKKVP

SEQ ID NO: 2426640 - protein, 7 aa, Entamoeba dispar
GGLTKNQ

SEQ ID NO: 2426641 - protein, 4 aa, Entamoeba dispar
GGMN

SEQ ID NO: 2426642 - protein, 4 aa, Entamoeba dispar
GGMP

SEQ ID NO: 2426643 - protein, 26 aa, Entamoeba dispar
GGMPSYGTQPYPGYNQMGGMPSYGSG

SEQ ID NO: 2426644 - protein, 6 aa, Entamoeba dispar
GGMTQG

SEQ ID NO: 2426645 - protein, 7 aa, Entamoeba dispar
GGMTSSQ

SEQ ID NO: 2426646 - protein, 5 aa, Entamoeba dispar
GGNAS

SEQ ID NO: 2426647 - protein, 10 aa, Entamoeba dispar
GGNDSTNSGC

SEQ ID NO: 2426648 - protein, 13 aa, Entamoeba dispar
GGNESEKKGQLTS

SEQ ID NO: 2426649 - protein, 7 aa, Entamoeba dispar
GGNGKKI

SEQ ID NO: 2426650 - protein, 131 aa, Entamoeba dispar
GGNGLGTNTFGGNGLGTSSFGGNTFGTNSLGGSGLGTNTLGTNTLGTNTLGTNAFGGNTLGTNTFGGNTLGTNTFGGNTLGTNSLGTNTLGTNSLGGNGVGTNTGPVIGTTTPQDFTKSRFPTESIKNRES

SEQ ID NO: 2426651 - protein, 11 aa, Entamoeba dispar
GGNHSRYNSRD

SEQ ID NO: 2426652 - protein, 9 aa, Entamoeba dispar
GGNKTDQQL

SEQ ID NO: 2426653 - protein, 4 aa, Entamoeba dispar
GGNL

SEQ ID NO: 2426654 - protein, 5 aa, Entamoeba dispar
GGNLD

SEQ ID NO: 2426655 - protein, 5 aa, Entamoeba dispar
GGNLG

SEQ ID NO: 2426656 - protein, 7 aa, Entamoeba dispar
GGNLGPS

SEQ ID NO: 2426657 - protein, 5 aa, Entamoeba dispar
GGNNM

SEQ ID NO: 2426658 - protein, 15 aa, Entamoeba dispar
GGNRPGRGDDGNDKV

SEQ ID NO: 2426659 - protein, 11 aa, Entamoeba dispar
GGNSQQEPDLN

SEQ ID NO: 2426660 - protein, 5 aa, Entamoeba dispar
GGNTP

SEQ ID NO: 2426661 - protein, 12 aa, Entamoeba dispar
GGNTTNKEYMKE

SEQ ID NO: 2426662 - protein, 8 aa, Entamoeba dispar
GGNVGDSV

SEQ ID NO: 2426663 - protein, 5 aa, Entamoeba dispar
GGNVN

SEQ ID NO: 2426664 - protein, 9 aa, Entamoeba dispar
GGNVQQTVQ

SEQ ID NO: 2426665 - protein, 9 aa, Entamoeba dispar
GGPAAGGHN

SEQ ID NO: 2426666 - protein, 5 aa, Entamoeba dispar
GGPFY

SEQ ID NO: 2426667 - protein, 10 aa, Entamoeba dispar
GGPNPFESPT

SEQ ID NO: 2426668 - protein, 5 aa, Entamoeba dispar
GGPQC

SEQ ID NO: 2426669 - protein, 6 aa, Entamoeba dispar
GGPVTI

SEQ ID NO: 2426670 - protein, 7 aa, Entamoeba dispar
GGQASQL

SEQ ID NO: 2426671 - protein, 9 aa, Entamoeba dispar
GGQIPEGIT

SEQ ID NO: 2426672 - protein, 10 aa, Entamoeba dispar
GGQQSTINSS

SEQ ID NO: 2426673 - protein, 8 aa, Entamoeba dispar
GGQRSERK

SEQ ID NO: 2426674 - protein, 6 aa, Entamoeba dispar
GGQSHF

SEQ ID NO: 2426675 - protein, 16 aa, Entamoeba dispar
GGQSISSAKLRASRPK

SEQ ID NO: 2426676 - protein, 7 aa, Entamoeba dispar
GGQSSLR

SEQ ID NO: 2426677 - protein, 4 aa, Entamoeba dispar
GGQT

SEQ ID NO: 2426678 - protein, 10 aa, Entamoeba dispar
GGQTPYAPKN

SEQ ID NO: 2426679 - protein, 9 aa, Entamoeba dispar
GGRDSSSTE

SEQ ID NO: 2426680 - protein, 8 aa, Entamoeba dispar
GGRKLKGK

SEQ ID NO: 2426681 - protein, 6 aa, Entamoeba dispar
GGRNND

SEQ ID NO: 2426682 - protein, 13 aa, Entamoeba dispar
GGRSLNSSKNTSK

SEQ ID NO: 2426683 - protein, 12 aa, Entamoeba dispar
GGRVASDSSTTT

SEQ ID NO: 2426684 - protein, 6 aa, Entamoeba dispar
GGRVEQ

SEQ ID NO: 2426685 - protein, 9 aa, Entamoeba dispar
GGSAIDAAK

SEQ ID NO: 2426686 - protein, 7 aa, Entamoeba dispar
GGSAMDA

SEQ ID NO: 2426687 - protein, 10 aa, Entamoeba dispar
GGSGEEITEK

SEQ ID NO: 2426688 - protein, 10 aa, Entamoeba dispar
GGSGTNDGGI

SEQ ID NO: 2426689 - protein, 4 aa, Entamoeba dispar
GGSI

SEQ ID NO: 2426690 - protein, 10 aa, Entamoeba dispar
GGSIKKNGIY

SEQ ID NO: 2426691 - protein, 7 aa, Entamoeba dispar
GGSIPTQ

SEQ ID NO: 2426692 - protein, 5 aa, Entamoeba dispar
GGSIR

SEQ ID NO: 2426693 - protein, 8 aa, Entamoeba dispar
GGSKPANE

SEQ ID NO: 2426694 - protein, 18 aa, Entamoeba dispar
GGSKSSEQKEKESSKTVQ

SEQ ID NO: 2426695 - protein, 4 aa, Entamoeba dispar
GGSN

SEQ ID NO: 2426696 - protein, 9 aa, Entamoeba dispar
GGSNSGVTG

SEQ ID NO: 2426697 - protein, 7 aa, Entamoeba dispar
GGSPGQV

SEQ ID NO: 2426698 - protein, 7 aa, Entamoeba dispar
GGSPSAE

SEQ ID NO: 2426699 - protein, 5 aa, Entamoeba dispar
GGSRA

SEQ ID NO: 2426700 - protein, 12 aa, Entamoeba dispar
GGSSNLIGTTSK

SEQ ID NO: 2426701 - protein, 7 aa, Entamoeba dispar
GGSSSLT

SEQ ID NO: 2426702 - protein, 7 aa, Entamoeba dispar
GGSTNQR

SEQ ID NO: 2426703 - protein, 25 aa, Entamoeba dispar
GGSVADENKRVEEEKKKEENTKKPV

SEQ ID NO: 2426704 - protein, 8 aa, Entamoeba dispar
GGSVDESE

SEQ ID NO: 2426705 - protein, 8 aa, Entamoeba dispar
GGSVTIRP

SEQ ID NO: 2426706 - protein, 8 aa, Entamoeba dispar
GGSVVDGT

SEQ ID NO: 2426707 - protein, 6 aa, Entamoeba dispar
GGSWKT

SEQ ID NO: 2426708 - protein, 4 aa, Entamoeba dispar
GGSY

SEQ ID NO: 2426709 - protein, 12 aa, Entamoeba dispar
GGTAAQAKYSQA

SEQ ID NO: 2426710 - protein, 7 aa, Entamoeba dispar
GGTEGFQ

SEQ ID NO: 2426711 - protein, 8 aa, Entamoeba dispar
GGTGRAPN

SEQ ID NO: 2426712 - protein, 9 aa, Entamoeba dispar
GGTGSGLGS

SEQ ID NO: 2426713 - protein, 9 aa, Entamoeba dispar
GGTHSTDPV

SEQ ID NO: 2426714 - protein, 12 aa, Entamoeba dispar
GGTIDNGRVNGN

SEQ ID NO: 2426715 - protein, 4 aa, Entamoeba dispar
GGTL

SEQ ID NO: 2426716 - protein, 6 aa, Entamoeba dispar
GGTLDT

SEQ ID NO: 2426717 - protein, 7 aa, Entamoeba dispar
GGTPPQT

SEQ ID NO: 2426718 - protein, 20 aa, Entamoeba dispar
GGTRESREDCRKENFDKDRL

SEQ ID NO: 2426719 - protein, 5 aa, Entamoeba dispar
GGTTH

SEQ ID NO: 2426720 - protein, 14 aa, Entamoeba dispar
GGTTMGTTGSMNPY

SEQ ID NO: 2426721 - protein, 9 aa, Entamoeba dispar
GGTTRTGDL

SEQ ID NO: 2426722 - protein, 6 aa, Entamoeba dispar
GGVGDE

SEQ ID NO: 2426723 - protein, 6 aa, Entamoeba dispar
GGVGGV

SEQ ID NO: 2426724 - protein, 7 aa, Entamoeba dispar
GGVGRVT

SEQ ID NO: 2426725 - protein, 4 aa, Entamoeba dispar
GGVI

SEQ ID NO: 2426726 - protein, 4 aa, Entamoeba dispar
GGVN

SEQ ID NO: 2426727 - protein, 10 aa, Entamoeba dispar
GGVRENGVNG

SEQ ID NO: 2426728 - protein, 4 aa, Entamoeba dispar
GGWK

SEQ ID NO: 2426729 - protein, 4 aa, Entamoeba dispar
GGYE

SEQ ID NO: 2426730 - protein, 11 aa, Entamoeba dispar
GGYECRDKGVQ

SEQ ID NO: 2426731 - protein, 4 aa, Entamoeba dispar
GGYK

SEQ ID NO: 2426732 - protein, 9 aa, Entamoeba dispar
GGYKTEEDT

SEQ ID NO: 2426733 - protein, 7 aa, Entamoeba dispar
GGYNTNG

SEQ ID NO: 2426734 - protein, 4 aa, Entamoeba dispar
GGYP

SEQ ID NO: 2426735 - protein, 7 aa, Entamoeba dispar
GGYQQGM

SEQ ID NO: 2426736 - protein, 11 aa, Entamoeba dispar
GGYSDGEIGEY

SEQ ID NO: 2426737 - protein, 6 aa, Entamoeba dispar
GHASPV

SEQ ID NO: 2426738 - protein, 17 aa, Entamoeba dispar
GHATHPNYPDRTDDKHP

SEQ ID NO: 2426739 - protein, 5 aa, Entamoeba dispar
GHDAD

SEQ ID NO: 2426740 - protein, 14 aa, Entamoeba dispar
GHDDQQRRDIQPDD

SEQ ID NO: 2426741 - protein, 7 aa, Entamoeba dispar
GHDHKDS

SEQ ID NO: 2426742 - protein, 8 aa, Entamoeba dispar
GHDHKDSR

SEQ ID NO: 2426743 - protein, 35 aa, Entamoeba dispar
GHEEKKEKERERNKKRQIPKLQASRRAREYETQQQ

SEQ ID NO: 2426744 - protein, 5 aa, Entamoeba dispar
GHEKF

SEQ ID NO: 2426745 - protein, 12 aa, Entamoeba dispar
GHEPEDTLDDQD

SEQ ID NO: 2426746 - protein, 5 aa, Entamoeba dispar
GHERA

SEQ ID NO: 2426747 - protein, 5 aa, Entamoeba dispar
GHETP

SEQ ID NO: 2426748 - protein, 7 aa, Entamoeba dispar
GHEVKRT

SEQ ID NO: 2426749 - protein, 13 aa, Entamoeba dispar
GHEYPTDDLTQQG

SEQ ID NO: 2426750 - protein, 13 aa, Entamoeba dispar
GHEYVGSDPITKN

SEQ ID NO: 2426751 - protein, 9 aa, Entamoeba dispar
GHGGAESSN

SEQ ID NO: 2426752 - protein, 8 aa, Entamoeba dispar
GHGGDQVA

SEQ ID NO: 2426753 - protein, 9 aa, Entamoeba dispar
GHGGRTAAQ

SEQ ID NO: 2426754 - protein, 11 aa, Entamoeba dispar
GHGGSGTSQAA

SEQ ID NO: 2426755 - protein, 14 aa, Entamoeba dispar
GHGGYECGDNGEWS

SEQ ID NO: 2426756 - protein, 9 aa, Entamoeba dispar
GHGNAQYKA

SEQ ID NO: 2426757 - protein, 7 aa, Entamoeba dispar
GHGNEPN

SEQ ID NO: 2426758 - protein, 19 aa, Entamoeba dispar
GHGSNTTIREAKKSNMICF

SEQ ID NO: 2426759 - protein, 11 aa, Entamoeba dispar
GHISKDCPNAE

SEQ ID NO: 2426760 - protein, 4 aa, Entamoeba dispar
GHIT

SEQ ID NO: 2426761 - protein, 23 aa, Entamoeba dispar
GHLSEEEDDDSTTLKNSVNAQRK

SEQ ID NO: 2426762 - protein, 7 aa, Entamoeba dispar
GHMNPSP

SEQ ID NO: 2426763 - protein, 15 aa, Entamoeba dispar
GHMVSGEQGSNGSSS

SEQ ID NO: 2426764 - protein, 16 aa, Entamoeba dispar
GHNEKREDISRREINQ

SEQ ID NO: 2426765 - protein, 10 aa, Entamoeba dispar
GHNGDSAARI

SEQ ID NO: 2426766 - protein, 6 aa, Entamoeba dispar
GHNGDV

SEQ ID NO: 2426767 - protein, 8 aa, Entamoeba dispar
GHNGKDAA

SEQ ID NO: 2426768 - protein, 12 aa, Entamoeba dispar
GHNGKDAAKKAM

SEQ ID NO: 2426769 - protein, 10 aa, Entamoeba dispar
GHNGKGAAVK

SEQ ID NO: 2426770 - protein, 6 aa, Entamoeba dispar
GHNGMG

SEQ ID NO: 2426771 - protein, 11 aa, Entamoeba dispar
GHNGSDAAKLA

SEQ ID NO: 2426772 - protein, 6 aa, Entamoeba dispar
GHNGSI

SEQ ID NO: 2426773 - protein, 9 aa, Entamoeba dispar
GHNNQYGKE

SEQ ID NO: 2426774 - protein, 14 aa, Entamoeba dispar
GHPIGEKEIEPTKK

SEQ ID NO: 2426775 - protein, 5 aa, Entamoeba dispar
GHPTK

SEQ ID NO: 2426776 - protein, 5 aa, Entamoeba dispar
GHPWP

SEQ ID NO: 2426777 - protein, 15 aa, Entamoeba dispar
GHQEDKNEEETEEEN

SEQ ID NO: 2426778 - protein, 9 aa, Entamoeba dispar
GHQKNCGKF

SEQ ID NO: 2426779 - protein, 4 aa, Entamoeba dispar
GHQR

SEQ ID NO: 2426780 - protein, 13 aa, Entamoeba dispar
GHRTTKENEGDDD

SEQ ID NO: 2426781 - protein, 11 aa, Entamoeba dispar
GHSFEENQRYN

SEQ ID NO: 2426782 - protein, 6 aa, Entamoeba dispar
GHSGQV

SEQ ID NO: 2426783 - protein, 5 aa, Entamoeba dispar
GHSGS

SEQ ID NO: 2426784 - protein, 6 aa, Entamoeba dispar
GHSIPK

SEQ ID NO: 2426785 - protein, 8 aa, Entamoeba dispar
GHSKGVED

SEQ ID NO: 2426786 - protein, 5 aa, Entamoeba dispar
GHSKY

SEQ ID NO: 2426787 - protein, 7 aa, Entamoeba dispar
GHSNAVK

SEQ ID NO: 2426788 - protein, 11 aa, Entamoeba dispar
GHSNELNDLPK

SEQ ID NO: 2426789 - protein, 6 aa, Entamoeba dispar
GHSNTT

SEQ ID NO: 2426790 - protein, 5 aa, Entamoeba dispar
GHSSE

SEQ ID NO: 2426791 - protein, 10 aa, Entamoeba dispar
GHSVAPADKV

SEQ ID NO: 2426792 - protein, 7 aa, Entamoeba dispar
GHTGRKL

SEQ ID NO: 2426793 - protein, 5 aa, Entamoeba dispar
GHTKD

SEQ ID NO: 2426794 - protein, 4 aa, Entamoeba dispar
GHTN

SEQ ID NO: 2426795 - protein, 17 aa, Entamoeba dispar
GHTNEGKEIEKSIKKKI

SEQ ID NO: 2426796 - protein, 21 aa, Entamoeba dispar
GIAASTGSACASESLQANPTF

SEQ ID NO: 2426797 - protein, 21 aa, Entamoeba dispar
GIAGSSGDDMGTGKGSSKAAK

SEQ ID NO: 2426798 - protein, 13 aa, Entamoeba dispar
GIAPAPGFFKALL

SEQ ID NO: 2426799 - protein, 13 aa, Entamoeba dispar
GIAPSANINPERT

SEQ ID NO: 2426800 - protein, 5 aa, Entamoeba dispar
GIASG

SEQ ID NO: 2426801 - protein, 4 aa, Entamoeba dispar
GIDD

SEQ ID NO: 2426802 - protein, 9 aa, Entamoeba dispar
GIDDDAERE

SEQ ID NO: 2426803 - protein, 5 aa, Entamoeba dispar
GIDEA

SEQ ID NO: 2426804 - protein, 15 aa, Entamoeba dispar
GIDENDSKKSKRQLE

SEQ ID NO: 2426805 - protein, 9 aa, Entamoeba dispar
GIDESGNTY

SEQ ID NO: 2426806 - protein, 7 aa, Entamoeba dispar
GIDETSK

SEQ ID NO: 2426807 - protein, 21 aa, Entamoeba dispar
GIDGGSLANRSEDVFISRRSM

SEQ ID NO: 2426808 - protein, 20 aa, Entamoeba dispar
GIDKATANVVTNPEGGQNIT

SEQ ID NO: 2426809 - protein, 9 aa, Entamoeba dispar
GIDKQTEEE

SEQ ID NO: 2426810 - protein, 4 aa, Entamoeba dispar
GIDP

SEQ ID NO: 2426811 - protein, 9 aa, Entamoeba dispar
GIDPNDGRI

SEQ ID NO: 2426812 - protein, 6 aa, Entamoeba dispar
GIDPPK

SEQ ID NO: 2426813 - protein, 10 aa, Entamoeba dispar
GIDQTHNPEF

SEQ ID NO: 2426814 - protein, 12 aa, Entamoeba dispar
GIDSETRHCKSE

SEQ ID NO: 2426815 - protein, 9 aa, Entamoeba dispar
GIDSKSNEL

SEQ ID NO: 2426816 - protein, 8 aa, Entamoeba dispar
GIDTKSGK

SEQ ID NO: 2426817 - protein, 9 aa, Entamoeba dispar
GIDTSSKEV

SEQ ID NO: 2426818 - protein, 10 aa, Entamoeba dispar
GIDYNDPPST

SEQ ID NO: 2426819 - protein, 5 aa, Entamoeba dispar
GIDYT

SEQ ID NO: 2426820 - protein, 6 aa, Entamoeba dispar
GIECNK

SEQ ID NO: 2426821 - protein, 4 aa, Entamoeba dispar
GIED

SEQ ID NO: 2426822 - protein, 10 aa, Entamoeba dispar
GIEDDISNGH

SEQ ID NO: 2426823 - protein, 9 aa, Entamoeba dispar
GIEDEKDGS

SEQ ID NO: 2426824 - protein, 6 aa, Entamoeba dispar
GIEDGC

SEQ ID NO: 2426825 - protein, 4 aa, Entamoeba dispar
GIEE

SEQ ID NO: 2426826 - protein, 9 aa, Entamoeba dispar
GIEEDTDEE

SEQ ID NO: 2426827 - protein, 6 aa, Entamoeba dispar
GIEEND

SEQ ID NO: 2426828 - protein, 10 aa, Entamoeba dispar
GIEGHSSQNG

SEQ ID NO: 2426829 - protein, 12 aa, Entamoeba dispar
GIEKDSKNVNVS

SEQ ID NO: 2426830 - protein, 9 aa, Entamoeba dispar
GIEKKECGG

SEQ ID NO: 2426831 - protein, 10 aa, Entamoeba dispar
GIEKKGGEEL

SEQ ID NO: 2426832 - protein, 7 aa, Entamoeba dispar
GIEMTDE

SEQ ID NO: 2426833 - protein, 10 aa, Entamoeba dispar
GIENDDETIQ

SEQ ID NO: 2426834 - protein, 5 aa, Entamoeba dispar
GIENE

SEQ ID NO: 2426835 - protein, 5 aa, Entamoeba dispar
GIENN

SEQ ID NO: 2426836 - protein, 4 aa, Entamoeba dispar
GIEQ

SEQ ID NO: 2426837 - protein, 16 aa, Entamoeba dispar
GIEQEEAVSSQTPKEA

SEQ ID NO: 2426838 - protein, 23 aa, Entamoeba dispar
GIERSDDDDFVEETEEQKEERER

SEQ ID NO: 2426839 - protein, 8 aa, Entamoeba dispar
GIESKDRK

SEQ ID NO: 2426840 - protein, 6 aa, Entamoeba dispar
GIESRK

SEQ ID NO: 2426841 - protein, 4 aa, Entamoeba dispar
GIFN

SEQ ID NO: 2426842 - protein, 17 aa, Entamoeba dispar
GIFPKSYGKNTFQLTSK

SEQ ID NO: 2426843 - protein, 5 aa, Entamoeba dispar
GIGEW

SEQ ID NO: 2426844 - protein, 7 aa, Entamoeba dispar
GIGGTSF

SEQ ID NO: 2426845 - protein, 15 aa, Entamoeba dispar
GIGKNGKIGCTQPRR

SEQ ID NO: 2426846 - protein, 5 aa, Entamoeba dispar
GIGKQ

SEQ ID NO: 2426847 - protein, 92 aa, Entamoeba dispar
GIGNSKDPNEERGRKDSGSLRKDGGDRKGYGNDRRDGGDRKKYGNDRRDGGERRRDGNDRKRTENDKKSGRDRKRFGNNKNEGNSSRKGHIT

SEQ ID NO: 2426848 - protein, 6 aa, Entamoeba dispar
GIGPYT

SEQ ID NO: 2426849 - protein, 17 aa, Entamoeba dispar
GIGSETQISQNQIPSIR

SEQ ID NO: 2426850 - protein, 7 aa, Entamoeba dispar
GIGSPTY

SEQ ID NO: 2426851 - protein, 4 aa, Entamoeba dispar
GIGT

SEQ ID NO: 2426852 - protein, 7 aa, Entamoeba dispar
GIGTPTY

SEQ ID NO: 2426853 - protein, 14 aa, Entamoeba dispar
GIHEEENKPETQTN

SEQ ID NO: 2426854 - protein, 15 aa, Entamoeba dispar
GIHKKDLKDEKTRTE

SEQ ID NO: 2426855 - protein, 5 aa, Entamoeba dispar
GIHPD

SEQ ID NO: 2426856 - protein, 10 aa, Entamoeba dispar
GIHRDVRPEN

SEQ ID NO: 2426857 - protein, 15 aa, Entamoeba dispar
GIHSDDGKVFNENGK

SEQ ID NO: 2426858 - protein, 12 aa, Entamoeba dispar
GIITSKDEEVNK

SEQ ID NO: 2426859 - protein, 4 aa, Entamoeba dispar
GIKD

SEQ ID NO: 2426860 - protein, 4 aa, Entamoeba dispar
GIKE

SEQ ID NO: 2426861 - protein, 32 aa, Entamoeba dispar
GIKEDKKTSEDEELEKDISQMEKELESNGQYI

SEQ ID NO: 2426862 - protein, 32 aa, Entamoeba dispar
GIKEEVKEKPKEQIPEPQNQPKQEQNQQQGGF

SEQ ID NO: 2426863 - protein, 16 aa, Entamoeba dispar
GIKEYEESKKKIKELE

SEQ ID NO: 2426864 - protein, 8 aa, Entamoeba dispar
GIKKETSL

SEQ ID NO: 2426865 - protein, 15 aa, Entamoeba dispar
GIKKKDLSDKETRDK

SEQ ID NO: 2426866 - protein, 9 aa, Entamoeba dispar
GIKKKRKIE

SEQ ID NO: 2426867 - protein, 7 aa, Entamoeba dispar
GIKKNKK

SEQ ID NO: 2426868 - protein, 10 aa, Entamoeba dispar
GIKKRTGKLR

SEQ ID NO: 2426869 - protein, 9 aa, Entamoeba dispar
GIKNENQEL

SEQ ID NO: 2426870 - protein, 25 aa, Entamoeba dispar
GIKNENSGQQQNQMGTQQATMMPQV

SEQ ID NO: 2426871 - protein, 7 aa, Entamoeba dispar
GIKPDLY

SEQ ID NO: 2426872 - protein, 10 aa, Entamoeba dispar
GIKPSLKDNF

SEQ ID NO: 2426873 - protein, 7 aa, Entamoeba dispar
GIKSGDL

SEQ ID NO: 2426874 - protein, 10 aa, Entamoeba dispar
GIKSNKAKTI

SEQ ID NO: 2426875 - protein, 13 aa, Entamoeba dispar
GIKSVGKKITGIG

SEQ ID NO: 2426876 - protein, 12 aa, Entamoeba dispar
GIKSYQNKDSWG

SEQ ID NO: 2426877 - protein, 9 aa, Entamoeba dispar
GIKTPKHNL

SEQ ID NO: 2426878 - protein, 8 aa, Entamoeba dispar
GIKTSDSD

SEQ ID NO: 2426879 - protein, 21 aa, Entamoeba dispar
GILKEEKEEKIKKEIEKKGVN

SEQ ID NO: 2426880 - protein, 5 aa, Entamoeba dispar
GILNE

SEQ ID NO: 2426881 - protein, 6 aa, Entamoeba dispar
GILPDG

SEQ ID NO: 2426882 - protein, 5 aa, Entamoeba dispar
GILPQ

SEQ ID NO: 2426883 - protein, 4 aa, Entamoeba dispar
GIND

SEQ ID NO: 2426884 - protein, 24 aa, Entamoeba dispar
GINEEFKKSHNDGEENNLSPSLAD

SEQ ID NO: 2426885 - protein, 6 aa, Entamoeba dispar
GINEGD

SEQ ID NO: 2426886 - protein, 4 aa, Entamoeba dispar
GINF

SEQ ID NO: 2426887 - protein, 4 aa, Entamoeba dispar
GINK

SEQ ID NO: 2426888 - protein, 10 aa, Entamoeba dispar
GINKSDRADI

SEQ ID NO: 2426889 - protein, 18 aa, Entamoeba dispar
GINPDNDETQTQINEQPT

SEQ ID NO: 2426890 - protein, 8 aa, Entamoeba dispar
GINPPNYP

SEQ ID NO: 2426891 - protein, 6 aa, Entamoeba dispar
GINSSI

SEQ ID NO: 2426892 - protein, 13 aa, Entamoeba dispar
GINSSSTKNLGPI

SEQ ID NO: 2426893 - protein, 5 aa, Entamoeba dispar
GINYN

SEQ ID NO: 2426894 - protein, 9 aa, Entamoeba dispar
GIPDDERKE

SEQ ID NO: 2426895 - protein, 6 aa, Entamoeba dispar
GIPDQA

SEQ ID NO: 2426896 - protein, 4 aa, Entamoeba dispar
GIPE

SEQ ID NO: 2426897 - protein, 5 aa, Entamoeba dispar
GIPEE

SEQ ID NO: 2426898 - protein, 6 aa, Entamoeba dispar
GIPEGW

SEQ ID NO: 2426899 - protein, 6 aa, Entamoeba dispar
GIPFAK

SEQ ID NO: 2426900 - protein, 16 aa, Entamoeba dispar
GIPFDKKEKREEGSEN

SEQ ID NO: 2426901 - protein, 9 aa, Entamoeba dispar
GIPGDNDPI

SEQ ID NO: 2426902 - protein, 7 aa, Entamoeba dispar
GIPGEIS

SEQ ID NO: 2426903 - protein, 30 aa, Entamoeba dispar
GIPIEDKREDKEENKRRRNSNENEGKGIKP

SEQ ID NO: 2426904 - protein, 7 aa, Entamoeba dispar
GIPIEKG

SEQ ID NO: 2426905 - protein, 13 aa, Entamoeba dispar
GIPKGGRSKRSFN

SEQ ID NO: 2426906 - protein, 9 aa, Entamoeba dispar
GIPKRKTGK

SEQ ID NO: 2426907 - protein, 9 aa, Entamoeba dispar
GIPNDTSIR

SEQ ID NO: 2426908 - protein, 10 aa, Entamoeba dispar
GIPNGKAGEQ

SEQ ID NO: 2426909 - protein, 12 aa, Entamoeba dispar
GIPNGKAGEQSF

SEQ ID NO: 2426910 - protein, 6 aa, Entamoeba dispar
GIPPDK

SEQ ID NO: 2426911 - protein, 6 aa, Entamoeba dispar
GIPPEW

SEQ ID NO: 2426912 - protein, 14 aa, Entamoeba dispar
GIPPLKDKEKWSTQ

SEQ ID NO: 2426913 - protein, 13 aa, Entamoeba dispar
GIPPLKERDSWSP

SEQ ID NO: 2426914 - protein, 14 aa, Entamoeba dispar
GIPPLKNAEKWSRD

SEQ ID NO: 2426915 - protein, 7 aa, Entamoeba dispar
GIPPTIT

SEQ ID NO: 2426916 - protein, 5 aa, Entamoeba dispar
GIPQP

SEQ ID NO: 2426917 - protein, 12 aa, Entamoeba dispar
GIPSGKAGEQSF

SEQ ID NO: 2426918 - protein, 35 aa, Entamoeba dispar
GIPSKPFRQNEINTTTMKQMTSSKEIKKEQQKPPI

SEQ ID NO: 2426919 - protein, 8 aa, Entamoeba dispar
GIPTEKGK

SEQ ID NO: 2426920 - protein, 5 aa, Entamoeba dispar
GIPVN

SEQ ID NO: 2426921 - protein, 10 aa, Entamoeba dispar
GIQATYEESA

SEQ ID NO: 2426922 - protein, 5 aa, Entamoeba dispar
GIQER

SEQ ID NO: 2426923 - protein, 10 aa, Entamoeba dispar
GIQKGGNGCF

SEQ ID NO: 2426924 - protein, 9 aa, Entamoeba dispar
GIQKQEESL

SEQ ID NO: 2426925 - protein, 5 aa, Entamoeba dispar
GIQNQ

SEQ ID NO: 2426926 - protein, 11 aa, Entamoeba dispar
GIQSDNSYYTY

SEQ ID NO: 2426927 - protein, 5 aa, Entamoeba dispar
GIQSI

SEQ ID NO: 2426928 - protein, 13 aa, Entamoeba dispar
GIREESKDGEEEK

SEQ ID NO: 2426929 - protein, 13 aa, Entamoeba dispar
GIREESKEGEEEK

SEQ ID NO: 2426930 - protein, 5 aa, Entamoeba dispar
GIRSI

SEQ ID NO: 2426931 - protein, 9 aa, Entamoeba dispar
GIRTANDER

SEQ ID NO: 2426932 - protein, 10 aa, Entamoeba dispar
GIRVGKTGKC

SEQ ID NO: 2426933 - protein, 4 aa, Entamoeba dispar
GISD

SEQ ID NO: 2426934 - protein, 8 aa, Entamoeba dispar
GISDSRPY

SEQ ID NO: 2426935 - protein, 59 aa, Entamoeba dispar
GISEESDTSLQEYEGDDDNESKEENEEDDNEEEDDNDEESDDDKISDDSSSESNTKRKK

SEQ ID NO: 2426936 - protein, 10 aa, Entamoeba dispar
GISKKTVDKD

SEQ ID NO: 2426937 - protein, 5 aa, Entamoeba dispar
GISKP

SEQ ID NO: 2426938 - protein, 5 aa, Entamoeba dispar
GISLG

SEQ ID NO: 2426939 - protein, 7 aa, Entamoeba dispar
GISPKLN

SEQ ID NO: 2426940 - protein, 6 aa, Entamoeba dispar
GISPQL

SEQ ID NO: 2426941 - protein, 16 aa, Entamoeba dispar
GISRIDKESKTKTRGT

SEQ ID NO: 2426942 - protein, 4 aa, Entamoeba dispar
GISS

SEQ ID NO: 2426943 - protein, 7 aa, Entamoeba dispar
GISSDKI

SEQ ID NO: 2426944 - protein, 5 aa, Entamoeba dispar
GISSE

SEQ ID NO: 2426945 - protein, 5 aa, Entamoeba dispar
GISSI

SEQ ID NO: 2426946 - protein, 15 aa, Entamoeba dispar
GISSTRNQLKESVGS

SEQ ID NO: 2426947 - protein, 7 aa, Entamoeba dispar
GISTRKE

SEQ ID NO: 2426948 - protein, 19 aa, Entamoeba dispar
GISTSAGIPDFRTPGTGLY

SEQ ID NO: 2426949 - protein, 5 aa, Entamoeba dispar
GISVS

SEQ ID NO: 2426950 - protein, 8 aa, Entamoeba dispar
GITDEEHG

SEQ ID NO: 2426951 - protein, 7 aa, Entamoeba dispar
GITDQNS

SEQ ID NO: 2426952 - protein, 5 aa, Entamoeba dispar
GITEE

SEQ ID NO: 2426953 - protein, 12 aa, Entamoeba dispar
GITEFDSEEHDD

SEQ ID NO: 2426954 - protein, 12 aa, Entamoeba dispar
GITETNQERLNE

SEQ ID NO: 2426955 - protein, 10 aa, Entamoeba dispar
GITGSDDAYI

SEQ ID NO: 2426956 - protein, 5 aa, Entamoeba dispar
GITGT

SEQ ID NO: 2426957 - protein, 5 aa, Entamoeba dispar
GITKI

SEQ ID NO: 2426958 - protein, 9 aa, Entamoeba dispar
GITKRQSSI

SEQ ID NO: 2426959 - protein, 13 aa, Entamoeba dispar
GITKSAQDINGNN

SEQ ID NO: 2426960 - protein, 5 aa, Entamoeba dispar
GITNF

SEQ ID NO: 2426961 - protein, 9 aa, Entamoeba dispar
GITNGNDDL

SEQ ID NO: 2426962 - protein, 16 aa, Entamoeba dispar
GITPSNEKKKRNEEFD

SEQ ID NO: 2426963 - protein, 6 aa, Entamoeba dispar
GITPTM

SEQ ID NO: 2426964 - protein, 19 aa, Entamoeba dispar
GITSASITKTQRPKPGKRC

SEQ ID NO: 2426965 - protein, 10 aa, Entamoeba dispar
GITSEEIKKH

SEQ ID NO: 2426966 - protein, 5 aa, Entamoeba dispar
GITSI

SEQ ID NO: 2426967 - protein, 6 aa, Entamoeba dispar
GITSKR

SEQ ID NO: 2426968 - protein, 5 aa, Entamoeba dispar
GITSN

SEQ ID NO: 2426969 - protein, 9 aa, Entamoeba dispar
GITSSEPVV

SEQ ID NO: 2426970 - protein, 6 aa, Entamoeba dispar
GITSSG

SEQ ID NO: 2426971 - protein, 6 aa, Entamoeba dispar
GIVPGG

SEQ ID NO: 2426972 - protein, 10 aa, Entamoeba dispar
GIYEEETQIQ

SEQ ID NO: 2426973 - protein, 4 aa, Entamoeba dispar
GIYG

SEQ ID NO: 2426974 - protein, 5 aa, Entamoeba dispar
GIYGK

SEQ ID NO: 2426975 - protein, 16 aa, Entamoeba dispar
GKAEEKEKTSKEGCVV

SEQ ID NO: 2426976 - protein, 7 aa, Entamoeba dispar
GKAGAHS

SEQ ID NO: 2426977 - protein, 7 aa, Entamoeba dispar
GKAGRKT

SEQ ID NO: 2426978 - protein, 27 aa, Entamoeba dispar
GKAGTDNLKSIQQDVEEENQKDLNERQ

SEQ ID NO: 2426979 - protein, 7 aa, Entamoeba dispar
GKAKKLA

SEQ ID NO: 2426980 - protein, 11 aa, Entamoeba dispar
GKAQTGSGKTI

SEQ ID NO: 2426981 - protein, 8 aa, Entamoeba dispar
GKARRPVE

SEQ ID NO: 2426982 - protein, 4 aa, Entamoeba dispar
GKAS

SEQ ID NO: 2426983 - protein, 7 aa, Entamoeba dispar
GKASLGE

SEQ ID NO: 2426984 - protein, 8 aa, Entamoeba dispar
GKASRTEV

SEQ ID NO: 2426985 - protein, 8 aa, Entamoeba dispar
GKATGAKV

SEQ ID NO: 2426986 - protein, 11 aa, Entamoeba dispar
GKATKLENAED

SEQ ID NO: 2426987 - protein, 10 aa, Entamoeba dispar
GKATTTQSGL

SEQ ID NO: 2426988 - protein, 9 aa, Entamoeba dispar
GKAVAEATK

SEQ ID NO: 2426989 - protein, 9 aa, Entamoeba dispar
GKCERENCK

SEQ ID NO: 2426990 - protein, 6 aa, Entamoeba dispar
GKCKEC

SEQ ID NO: 2426991 - protein, 8 aa, Entamoeba dispar
GKCPGGNV

SEQ ID NO: 2426992 - protein, 4 aa, Entamoeba dispar
GKCS

SEQ ID NO: 2426993 - protein, 8 aa, Entamoeba dispar
GKCSDDQL

SEQ ID NO: 2426994 - protein, 8 aa, Entamoeba dispar
GKDAQSIK

SEQ ID NO: 2426995 - protein, 8 aa, Entamoeba dispar
GKDATRQE

SEQ ID NO: 2426996 - protein, 10 aa, Entamoeba dispar
GKDDNLGEAK

SEQ ID NO: 2426997 - protein, 9 aa, Entamoeba dispar
GKDDRESDM

SEQ ID NO: 2426998 - protein, 15 aa, Entamoeba dispar
GKDEKASLGMGNILI

SEQ ID NO: 2426999 - protein, 8 aa, Entamoeba dispar
GKDENEDI

SEQ ID NO: 2427000 - protein, 9 aa, Entamoeba dispar
GKDGSEDII

SEQ ID NO: 2427001 - protein, 14 aa, Entamoeba dispar
GKDIEQAQKLASKV

SEQ ID NO: 2427002 - protein, 24 aa, Entamoeba dispar
GKDIKKENKDINLKESNLSNSFEN

SEQ ID NO: 2427003 - protein, 28 aa, Entamoeba dispar
GKDIQTASYIGGNPESNDVDDLKNRKPT

SEQ ID NO: 2427004 - protein, 7 aa, Entamoeba dispar
GKDITPL

SEQ ID NO: 2427005 - protein, 6 aa, Entamoeba dispar
GKDKQI

SEQ ID NO: 2427006 - protein, 12 aa, Entamoeba dispar
GKDPEPTSITTP

SEQ ID NO: 2427007 - protein, 7 aa, Entamoeba dispar
GKDPKHL

SEQ ID NO: 2427008 - protein, 7 aa, Entamoeba dispar
GKDPRFK

SEQ ID NO: 2427009 - protein, 7 aa, Entamoeba dispar
GKDREDY

SEQ ID NO: 2427010 - protein, 7 aa, Entamoeba dispar
GKDRQNI

SEQ ID NO: 2427011 - protein, 21 aa, Entamoeba dispar
GKDRTEQTPILSQENQSNENQ

SEQ ID NO: 2427012 - protein, 13 aa, Entamoeba dispar
GKDSDRSTSITSF

SEQ ID NO: 2427013 - protein, 5 aa, Entamoeba dispar
GKDSF

SEQ ID NO: 2427014 - protein, 6 aa, Entamoeba dispar
GKDSNF

SEQ ID NO: 2427015 - protein, 9 aa, Entamoeba dispar
GKDSSGRQV

SEQ ID NO: 2427016 - protein, 16 aa, Entamoeba dispar
GKDTITDDNEETETFS

SEQ ID NO: 2427017 - protein, 19 aa, Entamoeba dispar
GKDVQKKERKEREEDREFE

SEQ ID NO: 2427018 - protein, 8 aa, Entamoeba dispar
GKDYEQSV

SEQ ID NO: 2427019 - protein, 7 aa, Entamoeba dispar
GKDYGTN

SEQ ID NO: 2427020 - protein, 11 aa, Entamoeba dispar
GKEAFAGSNQL

SEQ ID NO: 2427021 - protein, 5 aa, Entamoeba dispar
GKEAR

SEQ ID NO: 2427022 - protein, 5 aa, Entamoeba dispar
GKECP

SEQ ID NO: 2427023 - protein, 8 aa, Entamoeba dispar
GKEDEYSY

SEQ ID NO: 2427024 - protein, 10 aa, Entamoeba dispar
GKEDQGDLNR

SEQ ID NO: 2427025 - protein, 6 aa, Entamoeba dispar
GKEDRI

SEQ ID NO: 2427026 - protein, 8 aa, Entamoeba dispar
GKEDRTMT

SEQ ID NO: 2427027 - protein, 9 aa, Entamoeba dispar
GKEEENKKD

SEQ ID NO: 2427028 - protein, 24 aa, Entamoeba dispar
GKEEKKSYSKIDTDDEWGNDELSR

SEQ ID NO: 2427029 - protein, 7 aa, Entamoeba dispar
GKEEPAI

SEQ ID NO: 2427030 - protein, 7 aa, Entamoeba dispar
GKEFEGR

SEQ ID NO: 2427031 - protein, 5 aa, Entamoeba dispar
GKEGT

SEQ ID NO: 2427032 - protein, 7 aa, Entamoeba dispar
GKEGTED

SEQ ID NO: 2427033 - protein, 8 aa, Entamoeba dispar
GKEGTHDG

SEQ ID NO: 2427034 - protein, 5 aa, Entamoeba dispar
GKEIE

SEQ ID NO: 2427035 - protein, 10 aa, Entamoeba dispar
GKEIEPNRKI

SEQ ID NO: 2427036 - protein, 12 aa, Entamoeba dispar
GKEIGKHKNNHN

SEQ ID NO: 2427037 - protein, 8 aa, Entamoeba dispar
GKEIKRRS

SEQ ID NO: 2427038 - protein, 23 aa, Entamoeba dispar
GKEIKSCKSYKTCKKSETCLQGD

SEQ ID NO: 2427039 - protein, 15 aa, Entamoeba dispar
GKEIKSKKKENLPED

SEQ ID NO: 2427040 - protein, 9 aa, Entamoeba dispar
GKEINDEYE

SEQ ID NO: 2427041 - protein, 16 aa, Entamoeba dispar
GKEIPKSSVEYEGENK

SEQ ID NO: 2427042 - protein, 12 aa, Entamoeba dispar
GKEITENDKRKH

SEQ ID NO: 2427043 - protein, 7 aa, Entamoeba dispar
GKEKAPY

SEQ ID NO: 2427044 - protein, 9 aa, Entamoeba dispar
GKEKKRNPM

SEQ ID NO: 2427045 - protein, 5 aa, Entamoeba dispar
GKEKL

SEQ ID NO: 2427046 - protein, 9 aa, Entamoeba dispar
GKEKPLRSP

SEQ ID NO: 2427047 - protein, 20 aa, Entamoeba dispar
GKEKQQKETLEGAHGSLQPF

SEQ ID NO: 2427048 - protein, 4 aa, Entamoeba dispar
GKEL

SEQ ID NO: 2427049 - protein, 6 aa, Entamoeba dispar
GKELSV

SEQ ID NO: 2427050 - protein, 4 aa, Entamoeba dispar
GKEN

SEQ ID NO: 2427051 - protein, 10 aa, Entamoeba dispar
GKENIEKQKS

SEQ ID NO: 2427052 - protein, 9 aa, Entamoeba dispar
GKENITKDI

SEQ ID NO: 2427053 - protein, 5 aa, Entamoeba dispar
GKENM

SEQ ID NO: 2427054 - protein, 9 aa, Entamoeba dispar
GKENTEEIK

SEQ ID NO: 2427055 - protein, 8 aa, Entamoeba dispar
GKEPENLT

SEQ ID NO: 2427056 - protein, 23 aa, Entamoeba dispar
GKEPTKTYDLKGTLKKRTLEDDE

SEQ ID NO: 2427057 - protein, 6 aa, Entamoeba dispar
GKEPTL

SEQ ID NO: 2427058 - protein, 10 aa, Entamoeba dispar
GKEPTREEIS

SEQ ID NO: 2427059 - protein, 4 aa, Entamoeba dispar
GKEQ

SEQ ID NO: 2427060 - protein, 9 aa, Entamoeba dispar
GKEQKEQEI

SEQ ID NO: 2427061 - protein, 16 aa, Entamoeba dispar
GKEQNLDKVIEWIKST

SEQ ID NO: 2427062 - protein, 8 aa, Entamoeba dispar
GKEQVFSE

SEQ ID NO: 2427063 - protein, 20 aa, Entamoeba dispar
GKERGGVKTETIDEDNEPKE

SEQ ID NO: 2427064 - protein, 6 aa, Entamoeba dispar
GKESHD

SEQ ID NO: 2427065 - protein, 7 aa, Entamoeba dispar
GKESNYN

SEQ ID NO: 2427066 - protein, 14 aa, Entamoeba dispar
GKESYGSNGTSYLN

SEQ ID NO: 2427067 - protein, 4 aa, Entamoeba dispar
GKET

SEQ ID NO: 2427068 - protein, 8 aa, Entamoeba dispar
GKETLKRK

SEQ ID NO: 2427069 - protein, 7 aa, Entamoeba dispar
GKETNLS

SEQ ID NO: 2427070 - protein, 12 aa, Entamoeba dispar
GKEVGKHIGGYS

SEQ ID NO: 2427071 - protein, 5 aa, Entamoeba dispar
GKEVP

SEQ ID NO: 2427072 - protein, 13 aa, Entamoeba dispar
GKEVPKYSHLVIQ

SEQ ID NO: 2427073 - protein, 4 aa, Entamoeba dispar
GKEY

SEQ ID NO: 2427074 - protein, 10 aa, Entamoeba dispar
GKEYKAKSIP

SEQ ID NO: 2427075 - protein, 7 aa, Entamoeba dispar
GKEYSDI

SEQ ID NO: 2427076 - protein, 8 aa, Entamoeba dispar
GKFATTAS

SEQ ID NO: 2427077 - protein, 7 aa, Entamoeba dispar
GKFEGER

SEQ ID NO: 2427078 - protein, 15 aa, Entamoeba dispar
GKFEGNDKEKIKIEI

SEQ ID NO: 2427079 - protein, 7 aa, Entamoeba dispar
GKFNDGK

SEQ ID NO: 2427080 - protein, 10 aa, Entamoeba dispar
GKFNSKEEMT

SEQ ID NO: 2427081 - protein, 6 aa, Entamoeba dispar
GKFNTR

SEQ ID NO: 2427082 - protein, 4 aa, Entamoeba dispar
GKFS

SEQ ID NO: 2427083 - protein, 4 aa, Entamoeba dispar
GKFT

SEQ ID NO: 2427084 - protein, 5 aa, Entamoeba dispar
GKFTK

SEQ ID NO: 2427085 - protein, 4 aa, Entamoeba dispar
GKGA

SEQ ID NO: 2427086 - protein, 17 aa, Entamoeba dispar
GKGAMNRTELADYRKQS

SEQ ID NO: 2427087 - protein, 5 aa, Entamoeba dispar
GKGAY

SEQ ID NO: 2427088 - protein, 7 aa, Entamoeba dispar
GKGDSGI

SEQ ID NO: 2427089 - protein, 4 aa, Entamoeba dispar
GKGE

SEQ ID NO: 2427090 - protein, 6 aa, Entamoeba dispar
GKGEFS

SEQ ID NO: 2427091 - protein, 15 aa, Entamoeba dispar
GKGEMNKEKGKEIEG

SEQ ID NO: 2427092 - protein, 8 aa, Entamoeba dispar
GKGENRYN

SEQ ID NO: 2427093 - protein, 20 aa, Entamoeba dispar
GKGFKTPSHVTDKDTNISGT

SEQ ID NO: 2427094 - protein, 6 aa, Entamoeba dispar
GKGGDY

SEQ ID NO: 2427095 - protein, 6 aa, Entamoeba dispar
GKGGFG

SEQ ID NO: 2427096 - protein, 11 aa, Entamoeba dispar
GKGGSRLTQSH

SEQ ID NO: 2427097 - protein, 11 aa, Entamoeba dispar
GKGGVGKSTFA

SEQ ID NO: 2427098 - protein, 12 aa, Entamoeba dispar
GKGGVGKSTIAT

SEQ ID NO: 2427099 - protein, 12 aa, Entamoeba dispar
GKGGVGKTTTSC

SEQ ID NO: 2427100 - protein, 7 aa, Entamoeba dispar
GKGHYEN

SEQ ID NO: 2427101 - protein, 6 aa, Entamoeba dispar
GKGIEE

SEQ ID NO: 2427102 - protein, 9 aa, Entamoeba dispar
GKGKGENKD

SEQ ID NO: 2427103 - protein, 9 aa, Entamoeba dispar
GKGKNKISA

SEQ ID NO: 2427104 - protein, 9 aa, Entamoeba dispar
GKGKQHEIS

SEQ ID NO: 2427105 - protein, 7 aa, Entamoeba dispar
GKGKVKK

SEQ ID NO: 2427106 - protein, 6 aa, Entamoeba dispar
GKGMGG

SEQ ID NO: 2427107 - protein, 16 aa, Entamoeba dispar
GKGMNQTDNDVPVTDE

SEQ ID NO: 2427108 - protein, 5 aa, Entamoeba dispar
GKGNE

SEQ ID NO: 2427109 - protein, 8 aa, Entamoeba dispar
GKGNEKDN

SEQ ID NO: 2427110 - protein, 5 aa, Entamoeba dispar
GKGPY

SEQ ID NO: 2427111 - protein, 43 aa, Entamoeba dispar
GKGQNQKSAARPVKKPNAGMNSTTSGSDIRTIERKADEGETPL

SEQ ID NO: 2427112 - protein, 27 aa, Entamoeba dispar
GKGRNPLKSPAPSQSTSPNIPTSSTPV

SEQ ID NO: 2427113 - protein, 6 aa, Entamoeba dispar
GKGSFG

SEQ ID NO: 2427114 - protein, 7 aa, Entamoeba dispar
GKGSFGS

SEQ ID NO: 2427115 - protein, 6 aa, Entamoeba dispar
GKGSHG

SEQ ID NO: 2427116 - protein, 6 aa, Entamoeba dispar
GKGSMR

SEQ ID NO: 2427117 - protein, 8 aa, Entamoeba dispar
GKGSRSSL

SEQ ID NO: 2427118 - protein, 9 aa, Entamoeba dispar
GKGSSVGGY

SEQ ID NO: 2427119 - protein, 7 aa, Entamoeba dispar
GKGSTQF

SEQ ID NO: 2427120 - protein, 7 aa, Entamoeba dispar
GKGSYGT

SEQ ID NO: 2427121 - protein, 4 aa, Entamoeba dispar
GKGT

SEQ ID NO: 2427122 - protein, 6 aa, Entamoeba dispar
GKGTFG

SEQ ID NO: 2427123 - protein, 7 aa, Entamoeba dispar
GKGTGHW

SEQ ID NO: 2427124 - protein, 9 aa, Entamoeba dispar
GKGTHPSDG

SEQ ID NO: 2427125 - protein, 5 aa, Entamoeba dispar
GKGVQ

SEQ ID NO: 2427126 - protein, 5 aa, Entamoeba dispar
GKGVY

SEQ ID NO: 2427127 - protein, 7 aa, Entamoeba dispar
GKHDHDK

SEQ ID NO: 2427128 - protein, 6 aa, Entamoeba dispar
GKHDSI

SEQ ID NO: 2427129 - protein, 54 aa, Entamoeba dispar
GKHDSNENSEDRSEEHMSSSKQDRKVPPTPETPSSSSQSPSSTKPQSPCTSNQN

SEQ ID NO: 2427130 - protein, 6 aa, Entamoeba dispar
GKHGRF

SEQ ID NO: 2427131 - protein, 20 aa, Entamoeba dispar
GKHGSGKTALAVEAAKQSGF

SEQ ID NO: 2427132 - protein, 8 aa, Entamoeba dispar
GKHKETLA

SEQ ID NO: 2427133 - protein, 8 aa, Entamoeba dispar
GKHLGDEK

SEQ ID NO: 2427134 - protein, 5 aa, Entamoeba dispar
GKHRG

SEQ ID NO: 2427135 - protein, 4 aa, Entamoeba dispar
GKIA

SEQ ID NO: 2427136 - protein, 30 aa, Entamoeba dispar
GKIANADPSLVSKSAKSRGYKQVGTLGSGN

SEQ ID NO: 2427137 - protein, 13 aa, Entamoeba dispar
GKIDEKTKSNQKI

SEQ ID NO: 2427138 - protein, 8 aa, Entamoeba dispar
GKIDPKKH

SEQ ID NO: 2427139 - protein, 13 aa, Entamoeba dispar
GKIDPNTLEPFNN

SEQ ID NO: 2427140 - protein, 10 aa, Entamoeba dispar
GKIEELSGNE

SEQ ID NO: 2427141 - protein, 9 aa, Entamoeba dispar
GKIEKNAVD

SEQ ID NO: 2427142 - protein, 6 aa, Entamoeba dispar
GKIEPM

SEQ ID NO: 2427143 - protein, 14 aa, Entamoeba dispar
GKIETKQTERNEKI

SEQ ID NO: 2427144 - protein, 12 aa, Entamoeba dispar
GKIGKSSKALVQ

SEQ ID NO: 2427145 - protein, 4 aa, Entamoeba dispar
GKII

SEQ ID NO: 2427146 - protein, 6 aa, Entamoeba dispar
GKIKEN

SEQ ID NO: 2427147 - protein, 9 aa, Entamoeba dispar
GKIKGNECE

SEQ ID NO: 2427148 - protein, 11 aa, Entamoeba dispar
GKIKKPEEIKE

SEQ ID NO: 2427149 - protein, 19 aa, Entamoeba dispar
GKIKPQQPQTLESKRIKDD

SEQ ID NO: 2427150 - protein, 5 aa, Entamoeba dispar
GKINK

SEQ ID NO: 2427151 - protein, 15 aa, Entamoeba dispar
GKINQDRFFMKIKKI

SEQ ID NO: 2427152 - protein, 4 aa, Entamoeba dispar
GKIP

SEQ ID NO: 2427153 - protein, 10 aa, Entamoeba dispar
GKIPEDGSKF

SEQ ID NO: 2427154 - protein, 36 aa, Entamoeba dispar
GKIPETKKEEPKSEEKPMEEEKKEDETTKEKPMEEE

SEQ ID NO: 2427155 - protein, 8 aa, Entamoeba dispar
GKIPKKLK

SEQ ID NO: 2427156 - protein, 5 aa, Entamoeba dispar
GKIPV

SEQ ID NO: 2427157 - protein, 9 aa, Entamoeba dispar
GKIQDRDRF

SEQ ID NO: 2427158 - protein, 5 aa, Entamoeba dispar
GKIQS

SEQ ID NO: 2427159 - protein, 4 aa, Entamoeba dispar
GKIS

SEQ ID NO: 2427160 - protein, 6 aa, Entamoeba dispar
GKISEN

SEQ ID NO: 2427161 - protein, 5 aa, Entamoeba dispar
GKISG

SEQ ID NO: 2427162 - protein, 19 aa, Entamoeba dispar
GKISRRTVSGPKGRRRPTM

SEQ ID NO: 2427163 - protein, 8 aa, Entamoeba dispar
GKITEEEF

SEQ ID NO: 2427164 - protein, 11 aa, Entamoeba dispar
GKITKAKMTSV

SEQ ID NO: 2427165 - protein, 13 aa, Entamoeba dispar
GKITNTKRIDATI

SEQ ID NO: 2427166 - protein, 10 aa, Entamoeba dispar
GKITSKINNS

SEQ ID NO: 2427167 - protein, 9 aa, Entamoeba dispar
GKKCEVKAD

SEQ ID NO: 2427168 - protein, 7 aa, Entamoeba dispar
GKKCQAD

SEQ ID NO: 2427169 - protein, 7 aa, Entamoeba dispar
GKKDFRQ

SEQ ID NO: 2427170 - protein, 9 aa, Entamoeba dispar
GKKDPEKSI

SEQ ID NO: 2427171 - protein, 7 aa, Entamoeba dispar
GKKDSGL

SEQ ID NO: 2427172 - protein, 30 aa, Entamoeba dispar
GKKDSSSPRPYSSVNSSGPIGTRASPATLE

SEQ ID NO: 2427173 - protein, 8 aa, Entamoeba dispar
GKKEAGDL

SEQ ID NO: 2427174 - protein, 5 aa, Entamoeba dispar
GKKEI

SEQ ID NO: 2427175 - protein, 13 aa, Entamoeba dispar
GKKEIKKEETFEE

SEQ ID NO: 2427176 - protein, 7 aa, Entamoeba dispar
GKKELKE

SEQ ID NO: 2427177 - protein, 14 aa, Entamoeba dispar
GKKEQISKAFSTIL

SEQ ID NO: 2427178 - protein, 10 aa, Entamoeba dispar
GKKESNKGKF

SEQ ID NO: 2427179 - protein, 17 aa, Entamoeba dispar
GKKFEGDASQLLPSSYQ

SEQ ID NO: 2427180 - protein, 9 aa, Entamoeba dispar
GKKFKSKTK

SEQ ID NO: 2427181 - protein, 9 aa, Entamoeba dispar
GKKFSDKSI

SEQ ID NO: 2427182 - protein, 4 aa, Entamoeba dispar
GKKG

SEQ ID NO: 2427183 - protein, 8 aa, Entamoeba dispar
GKKGEKEI

SEQ ID NO: 2427184 - protein, 9 aa, Entamoeba dispar
GKKGITGAI

SEQ ID NO: 2427185 - protein, 10 aa, Entamoeba dispar
GKKGKFNEGS

SEQ ID NO: 2427186 - protein, 9 aa, Entamoeba dispar
GKKGNRKTI

SEQ ID NO: 2427187 - protein, 5 aa, Entamoeba dispar
GKKGQ

SEQ ID NO: 2427188 - protein, 6 aa, Entamoeba dispar
GKKGTI

SEQ ID NO: 2427189 - protein, 10 aa, Entamoeba dispar
GKKIEKKDIN

SEQ ID NO: 2427190 - protein, 5 aa, Entamoeba dispar
GKKIG

SEQ ID NO: 2427191 - protein, 32 aa, Entamoeba dispar
GKKIRIADKDSTEEESEDDPDALVNNWNTGNF

SEQ ID NO: 2427192 - protein, 13 aa, Entamoeba dispar
GKKKDFSCSDRKF

SEQ ID NO: 2427193 - protein, 20 aa, Entamoeba dispar
GKKKEEPISKQTKQKGGIQN

SEQ ID NO: 2427194 - protein, 17 aa, Entamoeba dispar
GKKKESKKEIHDSKEEV

SEQ ID NO: 2427195 - protein, 18 aa, Entamoeba dispar
GKKKNTKKEFKKTSKRIN

SEQ ID NO: 2427196 - protein, 16 aa, Entamoeba dispar
GKKKRNASLIETSRTE

SEQ ID NO: 2427197 - protein, 22 aa, Entamoeba dispar
GKKLQRVQENTVSTEEKSVPEV

SEQ ID NO: 2427198 - protein, 5 aa, Entamoeba dispar
GKKMN

SEQ ID NO: 2427199 - protein, 7 aa, Entamoeba dispar
GKKMNEE

SEQ ID NO: 2427200 - protein, 7 aa, Entamoeba dispar
GKKNKKK

SEQ ID NO: 2427201 - protein, 9 aa, Entamoeba dispar
GKKNTGKTY

SEQ ID NO: 2427202 - protein, 7 aa, Entamoeba dispar
GKKPETL

SEQ ID NO: 2427203 - protein, 8 aa, Entamoeba dispar
GKKPLEDD

SEQ ID NO: 2427204 - protein, 7 aa, Entamoeba dispar
GKKPNTI

SEQ ID NO: 2427205 - protein, 9 aa, Entamoeba dispar
GKKPQAINA

SEQ ID NO: 2427206 - protein, 11 aa, Entamoeba dispar
GKKQGEPNADS

SEQ ID NO: 2427207 - protein, 10 aa, Entamoeba dispar
GKKQKLISTA

SEQ ID NO: 2427208 - protein, 6 aa, Entamoeba dispar
GKKQRI

SEQ ID NO: 2427209 - protein, 8 aa, Entamoeba dispar
GKKRGNPI

SEQ ID NO: 2427210 - protein, 58 aa, Entamoeba dispar
GKKRNSSNPDDPTLTSGSQKADESSSSLEKSEKSHNSKDLSKKTQEKEDKEKKGVFAS

SEQ ID NO: 2427211 - protein, 18 aa, Entamoeba dispar
GKKRRQGKSEYAQNRAEY

SEQ ID NO: 2427212 - protein, 6 aa, Entamoeba dispar
GKKSFD

SEQ ID NO: 2427213 - protein, 9 aa, Entamoeba dispar
GKKSGKTFS

SEQ ID NO: 2427214 - protein, 11 aa, Entamoeba dispar
GKKSKGETFPG

SEQ ID NO: 2427215 - protein, 11 aa, Entamoeba dispar
GKKSPVDPYSL

SEQ ID NO: 2427216 - protein, 7 aa, Entamoeba dispar
GKKSQNI

SEQ ID NO: 2427217 - protein, 8 aa, Entamoeba dispar
GKKSTKYY

SEQ ID NO: 2427218 - protein, 6 aa, Entamoeba dispar
GKKSTV

SEQ ID NO: 2427219 - protein, 7 aa, Entamoeba dispar
GKKVNAR

SEQ ID NO: 2427220 - protein, 7 aa, Entamoeba dispar
GKKYGVN

SEQ ID NO: 2427221 - protein, 5 aa, Entamoeba dispar
GKKYH

SEQ ID NO: 2427222 - protein, 10 aa, Entamoeba dispar
GKKYKKDSQK

SEQ ID NO: 2427223 - protein, 7 aa, Entamoeba dispar
GKKYRKE

SEQ ID NO: 2427224 - protein, 9 aa, Entamoeba dispar
GKLANKGGV

SEQ ID NO: 2427225 - protein, 6 aa, Entamoeba dispar
GKLEKD

SEQ ID NO: 2427226 - protein, 7 aa, Entamoeba dispar
GKLEPID

SEQ ID NO: 2427227 - protein, 8 aa, Entamoeba dispar
GKLERKPM

SEQ ID NO: 2427228 - protein, 7 aa, Entamoeba dispar
GKLERRK

SEQ ID NO: 2427229 - protein, 14 aa, Entamoeba dispar
GKLESIRDNSMTKD

SEQ ID NO: 2427230 - protein, 6 aa, Entamoeba dispar
GKLGRF

SEQ ID NO: 2427231 - protein, 7 aa, Entamoeba dispar
GKLNGTY

SEQ ID NO: 2427232 - protein, 26 aa, Entamoeba dispar
GKLPPQTNSTTPQQPTTSFPKSKNTC

SEQ ID NO: 2427233 - protein, 7 aa, Entamoeba dispar
GKLQNRR

SEQ ID NO: 2427234 - protein, 21 aa, Entamoeba dispar
GKLQRQTQTIESPSARRQHTR

SEQ ID NO: 2427235 - protein, 17 aa, Entamoeba dispar
GKLQSPSADTQSQEIQK

SEQ ID NO: 2427236 - protein, 8 aa, Entamoeba dispar
GKLRGEPI

SEQ ID NO: 2427237 - protein, 9 aa, Entamoeba dispar
GKLSRSIGE

SEQ ID NO: 2427238 - protein, 8 aa, Entamoeba dispar
GKLSSSHF

SEQ ID NO: 2427239 - protein, 7 aa, Entamoeba dispar
GKLTSRS

SEQ ID NO: 2427240 - protein, 7 aa, Entamoeba dispar
GKMDEHE

SEQ ID NO: 2427241 - protein, 9 aa, Entamoeba dispar
GKMKQKHRE

SEQ ID NO: 2427242 - protein, 17 aa, Entamoeba dispar
GKMNEEIEKSYKTMNAR

SEQ ID NO: 2427243 - protein, 12 aa, Entamoeba dispar
GKMSQQKRLIAL

SEQ ID NO: 2427244 - protein, 4 aa, Entamoeba dispar
GKND

SEQ ID NO: 2427245 - protein, 4 aa, Entamoeba dispar
GKNE

SEQ ID NO: 2427246 - protein, 6 aa, Entamoeba dispar
GKNEEI

SEQ ID NO: 2427247 - protein, 13 aa, Entamoeba dispar
GKNETAKPENTSN

SEQ ID NO: 2427248 - protein, 7 aa, Entamoeba dispar
GKNGIGK

SEQ ID NO: 2427249 - protein, 4 aa, Entamoeba dispar
GKNI

SEQ ID NO: 2427250 - protein, 9 aa, Entamoeba dispar
GKNIEKKDI

SEQ ID NO: 2427251 - protein, 8 aa, Entamoeba dispar
GKNIQRKY

SEQ ID NO: 2427252 - protein, 18 aa, Entamoeba dispar
GKNIQTKQSRDKKTKEVA

SEQ ID NO: 2427253 - protein, 4 aa, Entamoeba dispar
GKNL

SEQ ID NO: 2427254 - protein, 7 aa, Entamoeba dispar
GKNLGEK

SEQ ID NO: 2427255 - protein, 7 aa, Entamoeba dispar
GKNLNSP

SEQ ID NO: 2427256 - protein, 10 aa, Entamoeba dispar
GKNNEHTIKR

SEQ ID NO: 2427257 - protein, 9 aa, Entamoeba dispar
GKNNKTGEV

SEQ ID NO: 2427258 - protein, 8 aa, Entamoeba dispar
GKNNNNTI

SEQ ID NO: 2427259 - protein, 7 aa, Entamoeba dispar
GKNNPTW

SEQ ID NO: 2427260 - protein, 7 aa, Entamoeba dispar
GKNPPGM

SEQ ID NO: 2427261 - protein, 17 aa, Entamoeba dispar
GKNPSKNKIKRTNKLRA

SEQ ID NO: 2427262 - protein, 5 aa, Entamoeba dispar
GKNPT

SEQ ID NO: 2427263 - protein, 54 aa, Entamoeba dispar
GKNPYDNMTTQKQENKRKKGSDIIKEEENEHIKEKKSEEEKETQEEKNKENREF

SEQ ID NO: 2427264 - protein, 4 aa, Entamoeba dispar
GKNR

SEQ ID NO: 2427265 - protein, 10 aa, Entamoeba dispar
GKNSNEESRR

SEQ ID NO: 2427266 - protein, 9 aa, Entamoeba dispar
GKNSSGKTS

SEQ ID NO: 2427267 - protein, 17 aa, Entamoeba dispar
GKNSSSEGIEAEKKRFG

SEQ ID NO: 2427268 - protein, 8 aa, Entamoeba dispar
GKNTASKI

SEQ ID NO: 2427269 - protein, 11 aa, Entamoeba dispar
GKNVAKIGKGL

SEQ ID NO: 2427270 - protein, 4 aa, Entamoeba dispar
GKPC

SEQ ID NO: 2427271 - protein, 35 aa, Entamoeba dispar
GKPFNKDKEKTKRNKKNEVSIKRKESPIPDGGEFG

SEQ ID NO: 2427272 - protein, 6 aa, Entamoeba dispar
GKPFPK

SEQ ID NO: 2427273 - protein, 6 aa, Entamoeba dispar
GKPGEG

SEQ ID NO: 2427274 - protein, 9 aa, Entamoeba dispar
GKPGTGKTA

SEQ ID NO: 2427275 - protein, 5 aa, Entamoeba dispar
GKPGY

SEQ ID NO: 2427276 - protein, 4 aa, Entamoeba dispar
GKPH

SEQ ID NO: 2427277 - protein, 5 aa, Entamoeba dispar
GKPIF

SEQ ID NO: 2427278 - protein, 9 aa, Entamoeba dispar
GKPKNHKEY

SEQ ID NO: 2427279 - protein, 4 aa, Entamoeba dispar
GKPL

SEQ ID NO: 2427280 - protein, 6 aa, Entamoeba dispar
GKPLDI

SEQ ID NO: 2427281 - protein, 21 aa, Entamoeba dispar
GKPLNAREIAPSKVKENQEFE

SEQ ID NO: 2427282 - protein, 8 aa, Entamoeba dispar
GKPMTSHT

SEQ ID NO: 2427283 - protein, 11 aa, Entamoeba dispar
GKPNKVTKEQQ

SEQ ID NO: 2427284 - protein, 7 aa, Entamoeba dispar
GKPNQKM

SEQ ID NO: 2427285 - protein, 7 aa, Entamoeba dispar
GKPNSMR

SEQ ID NO: 2427286 - protein, 26 aa, Entamoeba dispar
GKPPEMKDGELNKRKENAQKAQEQLD

SEQ ID NO: 2427287 - protein, 7 aa, Entamoeba dispar
GKPPSTK

SEQ ID NO: 2427288 - protein, 7 aa, Entamoeba dispar
GKPSEIV

SEQ ID NO: 2427289 - protein, 18 aa, Entamoeba dispar
GKPSGERQLNKNSSLSDI

SEQ ID NO: 2427290 - protein, 19 aa, Entamoeba dispar
GKPSIFQGRKGNEDISEVK

SEQ ID NO: 2427291 - protein, 8 aa, Entamoeba dispar
GKPTGYKG

SEQ ID NO: 2427292 - protein, 6 aa, Entamoeba dispar
GKPVFS

SEQ ID NO: 2427293 - protein, 9 aa, Entamoeba dispar
GKPVSRTDD

SEQ ID NO: 2427294 - protein, 8 aa, Entamoeba dispar
GKPYSSDQ

SEQ ID NO: 2427295 - protein, 8 aa, Entamoeba dispar
GKQDEDGL

SEQ ID NO: 2427296 - protein, 8 aa, Entamoeba dispar
GKQDSLSD

SEQ ID NO: 2427297 - protein, 9 aa, Entamoeba dispar
GKQEEVDGY

SEQ ID NO: 2427298 - protein, 36 aa, Entamoeba dispar
GKQEFSSSTESPNSGSKSSSPQLDNEKEKRKSKVGK

SEQ ID NO: 2427299 - protein, 6 aa, Entamoeba dispar
GKQEKL

SEQ ID NO: 2427300 - protein, 35 aa, Entamoeba dispar
  misc_feature (20)..(21): Xaa can be any naturally occurring amino acid
GKQEVDNSANMEFATDELKXXKNPFFLKKVERDCN

SEQ ID NO: 2427301 - protein, 11 aa, Entamoeba dispar
GKQEVDTSTNM

SEQ ID NO: 2427302 - protein, 10 aa, Entamoeba dispar
GKQGEESKAW

SEQ ID NO: 2427303 - protein, 9 aa, Entamoeba dispar
GKQIAGGAY

SEQ ID NO: 2427304 - protein, 8 aa, Entamoeba dispar
GKQLDPSE

SEQ ID NO: 2427305 - protein, 5 aa, Entamoeba dispar
GKQLK

SEQ ID NO: 2427306 - protein, 18 aa, Entamoeba dispar
GKQNPERFTPQRIIVIEM

SEQ ID NO: 2427307 - protein, 7 aa, Entamoeba dispar
GKQNQTL

SEQ ID NO: 2427308 - protein, 6 aa, Entamoeba dispar
GKQPIT

SEQ ID NO: 2427309 - protein, 6 aa, Entamoeba dispar
GKQQER

SEQ ID NO: 2427310 - protein, 7 aa, Entamoeba dispar
GKQQHEP

SEQ ID NO: 2427311 - protein, 5 aa, Entamoeba dispar
GKQRS

SEQ ID NO: 2427312 - protein, 34 aa, Entamoeba dispar
GKQSGLNKNIKTKGGITAADLQSAKLSALPPTNY

SEQ ID NO: 2427313 - protein, 4 aa, Entamoeba dispar
GKQV

SEQ ID NO: 2427314 - protein, 13 aa, Entamoeba dispar
GKQVTLSGAVSSS

SEQ ID NO: 2427315 - protein, 18 aa, Entamoeba dispar
GKRAEKKDINKFIIPSSI

SEQ ID NO: 2427316 - protein, 7 aa, Entamoeba dispar
GKREPNI

SEQ ID NO: 2427317 - protein, 8 aa, Entamoeba dispar
GKRFSGNR

SEQ ID NO: 2427318 - protein, 6 aa, Entamoeba dispar
GKRGSI

SEQ ID NO: 2427319 - protein, 6 aa, Entamoeba dispar
GKRIKE

SEQ ID NO: 2427320 - protein, 27 aa, Entamoeba dispar
GKRKGAATLQQDIKDEETFMTENQNSK

SEQ ID NO: 2427321 - protein, 23 aa, Entamoeba dispar
GKRKGGTTKENGTFSATTSPVNL

SEQ ID NO: 2427322 - protein, 5 aa, Entamoeba dispar
GKRLR

SEQ ID NO: 2427323 - protein, 11 aa, Entamoeba dispar
GKRNGDDRDHL

SEQ ID NO: 2427324 - protein, 9 aa, Entamoeba dispar
GKRPKQTTV

SEQ ID NO: 2427325 - protein, 10 aa, Entamoeba dispar
GKRPSRTQQM

SEQ ID NO: 2427326 - protein, 11 aa, Entamoeba dispar
GKRPTNEDTEI

SEQ ID NO: 2427327 - protein, 8 aa, Entamoeba dispar
GKRQEEKL

SEQ ID NO: 2427328 - protein, 15 aa, Entamoeba dispar
GKRQIERTDALEGFK

SEQ ID NO: 2427329 - protein, 6 aa, Entamoeba dispar
GKRQKT

SEQ ID NO: 2427330 - protein, 7 aa, Entamoeba dispar
GKRRKET

SEQ ID NO: 2427331 - protein, 6 aa, Entamoeba dispar
GKRRYS

SEQ ID NO: 2427332 - protein, 6 aa, Entamoeba dispar
GKRSDL

SEQ ID NO: 2427333 - protein, 10 aa, Entamoeba dispar
GKRSEAAESH

SEQ ID NO: 2427334 - protein, 9 aa, Entamoeba dispar
GKRSGDYDQ

SEQ ID NO: 2427335 - protein, 11 aa, Entamoeba dispar
GKRSSSEHEAV

SEQ ID NO: 2427336 - protein, 7 aa, Entamoeba dispar
GKRTEGI

SEQ ID NO: 2427337 - protein, 7 aa, Entamoeba dispar
GKRTLNS

SEQ ID NO: 2427338 - protein, 13 aa, Entamoeba dispar
GKRTSQNENETLR

SEQ ID NO: 2427339 - protein, 7 aa, Entamoeba dispar
GKSADEM

SEQ ID NO: 2427340 - protein, 9 aa, Entamoeba dispar
GKSAKNDFN

SEQ ID NO: 2427341 - protein, 5 aa, Entamoeba dispar
GKSDK

SEQ ID NO: 2427342 - protein, 10 aa, Entamoeba dispar
GKSEEGGTVL

SEQ ID NO: 2427343 - protein, 6 aa, Entamoeba dispar
GKSEKK

SEQ ID NO: 2427344 - protein, 6 aa, Entamoeba dispar
GKSELE

SEQ ID NO: 2427345 - protein, 9 aa, Entamoeba dispar
GKSELPNEY

SEQ ID NO: 2427346 - protein, 7 aa, Entamoeba dispar
GKSEREQ

SEQ ID NO: 2427347 - protein, 8 aa, Entamoeba dispar
GKSESRGF

SEQ ID NO: 2427348 - protein, 4 aa, Entamoeba dispar
GKSF

SEQ ID NO: 2427349 - protein, 12 aa, Entamoeba dispar
GKSFSKKQTKRK

SEQ ID NO: 2427350 - protein, 9 aa, Entamoeba dispar
GKSHEGKER

SEQ ID NO: 2427351 - protein, 9 aa, Entamoeba dispar
GKSHSPKVD

SEQ ID NO: 2427352 - protein, 5 aa, Entamoeba dispar
GKSIE

SEQ ID NO: 2427353 - protein, 10 aa, Entamoeba dispar
GKSIKDRTET

SEQ ID NO: 2427354 - protein, 7 aa, Entamoeba dispar
GKSINGL

SEQ ID NO: 2427355 - protein, 8 aa, Entamoeba dispar
GKSLAEKR

SEQ ID NO: 2427356 - protein, 15 aa, Entamoeba dispar
GKSLEGPAQEKNNIK

SEQ ID NO: 2427357 - protein, 62 aa, Entamoeba dispar
GKSLKEGEKKEETKVTTSTKPITPPKNKTIGSPAQPSESKHSTKPPLPKKEKEFKKEEEPIT

SEQ ID NO: 2427358 - protein, 92 aa, Entamoeba dispar
GKSLKEGEVTESKPPTQPPVTSSSKKEIPTPIPSKTNTNHYNCSSKDKELPQTIKENAKQEIPKKRTSSGSKTPILPTNQSQTISSEKPISQ

SEQ ID NO: 2427359 - protein, 9 aa, Entamoeba dispar
GKSLKKSVG

SEQ ID NO: 2427360 - protein, 11 aa, Entamoeba dispar
GKSLYSPTSHY

SEQ ID NO: 2427361 - protein, 7 aa, Entamoeba dispar
GKSMEER

SEQ ID NO: 2427362 - protein, 8 aa, Entamoeba dispar
GKSPAEMR

SEQ ID NO: 2427363 - protein, 7 aa, Entamoeba dispar
GKSPDEL

SEQ ID NO: 2427364 - protein, 7 aa, Entamoeba dispar
GKSPQVI

SEQ ID NO: 2427365 - protein, 7 aa, Entamoeba dispar
GKSQSQD

SEQ ID NO: 2427366 - protein, 6 aa, Entamoeba dispar
GKSRCE

SEQ ID NO: 2427367 - protein, 7 aa, Entamoeba dispar
GKSRSAS

SEQ ID NO: 2427368 - protein, 13 aa, Entamoeba dispar
GKSSDRSTSITTF

SEQ ID NO: 2427369 - protein, 22 aa, Entamoeba dispar
GKSSEGAAAAMSHTGSLAGNDA

SEQ ID NO: 2427370 - protein, 5 aa, Entamoeba dispar
GKSSL

SEQ ID NO: 2427371 - protein, 6 aa, Entamoeba dispar
GKSSWN

SEQ ID NO: 2427372 - protein, 7 aa, Entamoeba dispar
GKSTTFD

SEQ ID NO: 2427373 - protein, 9 aa, Entamoeba dispar
GKSTTHPEA

SEQ ID NO: 2427374 - protein, 13 aa, Entamoeba dispar
GKSVSKPISPDGI

SEQ ID NO: 2427375 - protein, 4 aa, Entamoeba dispar
GKTA

SEQ ID NO: 2427376 - protein, 7 aa, Entamoeba dispar
GKTAGEV

SEQ ID NO: 2427377 - protein, 11 aa, Entamoeba dispar
GKTAKENIEKY

SEQ ID NO: 2427378 - protein, 6 aa, Entamoeba dispar
GKTAQL

SEQ ID NO: 2427379 - protein, 7 aa, Entamoeba dispar
GKTDAEL

SEQ ID NO: 2427380 - protein, 5 aa, Entamoeba dispar
GKTDH

SEQ ID NO: 2427381 - protein, 8 aa, Entamoeba dispar
GKTENEQL

SEQ ID NO: 2427382 - protein, 7 aa, Entamoeba dispar
GKTETEK

SEQ ID NO: 2427383 - protein, 7 aa, Entamoeba dispar
GKTETEL

SEQ ID NO: 2427384 - protein, 4 aa, Entamoeba dispar
GKTF

SEQ ID NO: 2427385 - protein, 13 aa, Entamoeba dispar
GKTFKTQIDGTTK

SEQ ID NO: 2427386 - protein, 4 aa, Entamoeba dispar
GKTG

SEQ ID NO: 2427387 - protein, 10 aa, Entamoeba dispar
GKTGNVAENV

SEQ ID NO: 2427388 - protein, 4 aa, Entamoeba dispar
GKTI

SEQ ID NO: 2427389 - protein, 6 aa, Entamoeba dispar
GKTKEK

SEQ ID NO: 2427390 - protein, 7 aa, Entamoeba dispar
GKTKESD

SEQ ID NO: 2427391 - protein, 7 aa, Entamoeba dispar
GKTKRVG

SEQ ID NO: 2427392 - protein, 8 aa, Entamoeba dispar
GKTNEEFN

SEQ ID NO: 2427393 - protein, 8 aa, Entamoeba dispar
GKTNTNAS

SEQ ID NO: 2427394 - protein, 8 aa, Entamoeba dispar
GKTPEEIR

SEQ ID NO: 2427395 - protein, 7 aa, Entamoeba dispar
GKTPHQT

SEQ ID NO: 2427396 - protein, 8 aa, Entamoeba dispar
GKTPNYED

SEQ ID NO: 2427397 - protein, 10 aa, Entamoeba dispar
GKTPQTVNAL

SEQ ID NO: 2427398 - protein, 15 aa, Entamoeba dispar
GKTSEIKAEESSKAI

SEQ ID NO: 2427399 - protein, 12 aa, Entamoeba dispar
GKTSFTAEETQS

SEQ ID NO: 2427400 - protein, 10 aa, Entamoeba dispar
GKTSFTPEEV

SEQ ID NO: 2427401 - protein, 5 aa, Entamoeba dispar
GKTSI

SEQ ID NO: 2427402 - protein, 7 aa, Entamoeba dispar
GKTSPVS

SEQ ID NO: 2427403 - protein, 12 aa, Entamoeba dispar
GKTTKKPSKHST

SEQ ID NO: 2427404 - protein, 8 aa, Entamoeba dispar
GKTTPNYI

SEQ ID NO: 2427405 - protein, 9 aa, Entamoeba dispar
GKTTQGSNK

SEQ ID NO: 2427406 - protein, 4 aa, Entamoeba dispar
GKTY

SEQ ID NO: 2427407 - protein, 10 aa, Entamoeba dispar
GKTYEETDTL

SEQ ID NO: 2427408 - protein, 6 aa, Entamoeba dispar
GKVFSN

SEQ ID NO: 2427409 - protein, 9 aa, Entamoeba dispar
GKVGEAEQA

SEQ ID NO: 2427410 - protein, 6 aa, Entamoeba dispar
GKVGKT

SEQ ID NO: 2427411 - protein, 8 aa, Entamoeba dispar
GKVKKDNT

SEQ ID NO: 2427412 - protein, 9 aa, Entamoeba dispar
GKVLSEPGP

SEQ ID NO: 2427413 - protein, 8 aa, Entamoeba dispar
GKVNSSNE

SEQ ID NO: 2427414 - protein, 7 aa, Entamoeba dispar
GKVPATV

SEQ ID NO: 2427415 - protein, 10 aa, Entamoeba dispar
GKVPKTNTDV

SEQ ID NO: 2427416 - protein, 10 aa, Entamoeba dispar
GKVQEYPNPI

SEQ ID NO: 2427417 - protein, 10 aa, Entamoeba dispar
GKVRSKTSEY

SEQ ID NO: 2427418 - protein, 23 aa, Entamoeba dispar
GKVSSRRTVTRGNSSSRTTERTY

SEQ ID NO: 2427419 - protein, 13 aa, Entamoeba dispar
GKVTSRPRNVRTV

SEQ ID NO: 2427420 - protein, 9 aa, Entamoeba dispar
GKWKEKKEV

SEQ ID NO: 2427421 - protein, 15 aa, Entamoeba dispar
GKYANQQIKREEEKF

SEQ ID NO: 2427422 - protein, 4 aa, Entamoeba dispar
GKYD

SEQ ID NO: 2427423 - protein, 5 aa, Entamoeba dispar
GKYEI

SEQ ID NO: 2427424 - protein, 29 aa, Entamoeba dispar
GKYGKDKKKGNKTFGNSSFNKKGSKKHKK

SEQ ID NO: 2427425 - protein, 6 aa, Entamoeba dispar
GKYGRN

SEQ ID NO: 2427426 - protein, 5 aa, Entamoeba dispar
GKYGS

SEQ ID NO: 2427427 - protein, 19 aa, Entamoeba dispar
GKYHPDPLKDDTTKYLIIN

SEQ ID NO: 2427428 - protein, 5 aa, Entamoeba dispar
GKYIR

SEQ ID NO: 2427429 - protein, 5 aa, Entamoeba dispar
GKYKN

SEQ ID NO: 2427430 - protein, 10 aa, Entamoeba dispar
GKYKNELEKE

SEQ ID NO: 2427431 - protein, 8 aa, Entamoeba dispar
GKYLPEND

SEQ ID NO: 2427432 - protein, 6 aa, Entamoeba dispar
GKYNED

SEQ ID NO: 2427433 - protein, 12 aa, Entamoeba dispar
GKYQMNKERVDR

SEQ ID NO: 2427434 - protein, 16 aa, Entamoeba dispar
GKYSWPSSINPSNELK

SEQ ID NO: 2427435 - protein, 4 aa, Entamoeba dispar
GKYV

SEQ ID NO: 2427436 - protein, 4 aa, Entamoeba dispar
GKYY

SEQ ID NO: 2427437 - protein, 4 aa, Entamoeba dispar
GLAD

SEQ ID NO: 2427438 - protein, 6 aa, Entamoeba dispar
GLAPTA

SEQ ID NO: 2427439 - protein, 6 aa, Entamoeba dispar
GLASPK

SEQ ID NO: 2427440 - protein, 6 aa, Entamoeba dispar
GLATED

SEQ ID NO: 2427441 - protein, 17 aa, Entamoeba dispar
GLDEDDENNDDEEQTVI

SEQ ID NO: 2427442 - protein, 17 aa, Entamoeba dispar
GLDEDEEISEEEGKRKI

SEQ ID NO: 2427443 - protein, 8 aa, Entamoeba dispar
GLDHGGVS

SEQ ID NO: 2427444 - protein, 5 aa, Entamoeba dispar
GLDKE

SEQ ID NO: 2427445 - protein, 10 aa, Entamoeba dispar
GLDKKDNKKV

SEQ ID NO: 2427446 - protein, 4 aa, Entamoeba dispar
GLDN

SEQ ID NO: 2427447 - protein, 7 aa, Entamoeba dispar
GLDNERN

SEQ ID NO: 2427448 - protein, 9 aa, Entamoeba dispar
GLDQHRREM

SEQ ID NO: 2427449 - protein, 10 aa, Entamoeba dispar
GLEEDIKQEE

SEQ ID NO: 2427450 - protein, 12 aa, Entamoeba dispar
GLEEEDKIADGN

SEQ ID NO: 2427451 - protein, 15 aa, Entamoeba dispar
GLEENKRKKFPRKQL

SEQ ID NO: 2427452 - protein, 11 aa, Entamoeba dispar
GLEERVGQTLA

SEQ ID NO: 2427453 - protein, 5 aa, Entamoeba dispar
GLEHK

SEQ ID NO: 2427454 - protein, 7 aa, Entamoeba dispar
GLEKEGI

SEQ ID NO: 2427455 - protein, 8 aa, Entamoeba dispar
GLEKEGIN

SEQ ID NO: 2427456 - protein, 7 aa, Entamoeba dispar
GLEKENE

SEQ ID NO: 2427457 - protein, 9 aa, Entamoeba dispar
GLEKNQQFT

SEQ ID NO: 2427458 - protein, 4 aa, Entamoeba dispar
GLEN

SEQ ID NO: 2427459 - protein, 7 aa, Entamoeba dispar
GLEQGTN

SEQ ID NO: 2427460 - protein, 7 aa, Entamoeba dispar
GLEQSDY

SEQ ID NO: 2427461 - protein, 4 aa, Entamoeba dispar
GLES

SEQ ID NO: 2427462 - protein, 11 aa, Entamoeba dispar
GLFNSRDNKIT

SEQ ID NO: 2427463 - protein, 8 aa, Entamoeba dispar
GLGDYNDE

SEQ ID NO: 2427464 - protein, 27 aa, Entamoeba dispar
GLGESTKEALTFSNEKSNEEKAREEQE

SEQ ID NO: 2427465 - protein, 9 aa, Entamoeba dispar
GLGGISNSP

SEQ ID NO: 2427466 - protein, 7 aa, Entamoeba dispar
GLGPNGA

SEQ ID NO: 2427467 - protein, 8 aa, Entamoeba dispar
GLGPQDTM

SEQ ID NO: 2427468 - protein, 6 aa, Entamoeba dispar
GLGRSG

SEQ ID NO: 2427469 - protein, 7 aa, Entamoeba dispar
GLGTGKT

SEQ ID NO: 2427470 - protein, 13 aa, Entamoeba dispar
GLGTSKDSDAKAY

SEQ ID NO: 2427471 - protein, 13 aa, Entamoeba dispar
GLGTSMGCTGPKS

SEQ ID NO: 2427472 - protein, 7 aa, Entamoeba dispar
GLIRAND

SEQ ID NO: 2427473 - protein, 9 aa, Entamoeba dispar
GLKAAQATH

SEQ ID NO: 2427474 - protein, 7 aa, Entamoeba dispar
GLKEQEA

SEQ ID NO: 2427475 - protein, 12 aa, Entamoeba dispar
GLKEQKELSKED

SEQ ID NO: 2427476 - protein, 22 aa, Entamoeba dispar
GLKGSENKEDKKVKENNYTNTS

SEQ ID NO: 2427477 - protein, 11 aa, Entamoeba dispar
GLKKSSSEEKV

SEQ ID NO: 2427478 - protein, 10 aa, Entamoeba dispar
GLKKTAKSFL

SEQ ID NO: 2427479 - protein, 7 aa, Entamoeba dispar
GLKPSQR

SEQ ID NO: 2427480 - protein, 8 aa, Entamoeba dispar
GLKSTTQS

SEQ ID NO: 2427481 - protein, 11 aa, Entamoeba dispar
GLLQPGEEQNV

SEQ ID NO: 2427482 - protein, 5 aa, Entamoeba dispar
GLNDA

SEQ ID NO: 2427483 - protein, 5 aa, Entamoeba dispar
GLNDP

SEQ ID NO: 2427484 - protein, 12 aa, Entamoeba dispar
GLNDSSGFDNKN

SEQ ID NO: 2427485 - protein, 10 aa, Entamoeba dispar
GLNEEEAVDA

SEQ ID NO: 2427486 - protein, 5 aa, Entamoeba dispar
GLNEK

SEQ ID NO: 2427487 - protein, 6 aa, Entamoeba dispar
GLNESK

SEQ ID NO: 2427488 - protein, 5 aa, Entamoeba dispar
GLNET

SEQ ID NO: 2427489 - protein, 10 aa, Entamoeba dispar
GLNGSGKSNI

SEQ ID NO: 2427490 - protein, 6 aa, Entamoeba dispar
GLNIPK

SEQ ID NO: 2427491 - protein, 5 aa, Entamoeba dispar
GLNRN

SEQ ID NO: 2427492 - protein, 16 aa, Entamoeba dispar
GLNRTTQKENGKEVEG

SEQ ID NO: 2427493 - protein, 5 aa, Entamoeba dispar
GLPAK

SEQ ID NO: 2427494 - protein, 5 aa, Entamoeba dispar
GLPEF

SEQ ID NO: 2427495 - protein, 5 aa, Entamoeba dispar
GLPEP

SEQ ID NO: 2427496 - protein, 57 aa, Entamoeba dispar
GLPKETDTTPGSYNSSVSSYAAPAASSSNNYSAPPMKSAPPAPKAVAPPPPKPKLPQ

SEQ ID NO: 2427497 - protein, 12 aa, Entamoeba dispar
GLPKKGGEVGEY

SEQ ID NO: 2427498 - protein, 6 aa, Entamoeba dispar
GLPNTL

SEQ ID NO: 2427499 - protein, 9 aa, Entamoeba dispar
GLPPGLKEG

SEQ ID NO: 2427500 - protein, 10 aa, Entamoeba dispar
GLPPSSYPFP

SEQ ID NO: 2427501 - protein, 10 aa, Entamoeba dispar
GLPPVGGLPP

SEQ ID NO: 2427502 - protein, 5 aa, Entamoeba dispar
GLPSE

SEQ ID NO: 2427503 - protein, 6 aa, Entamoeba dispar
GLPSED

SEQ ID NO: 2427504 - protein, 9 aa, Entamoeba dispar
GLPSESGYS

SEQ ID NO: 2427505 - protein, 12 aa, Entamoeba dispar
GLPTQSYQTPSH

SEQ ID NO: 2427506 - protein, 4 aa, Entamoeba dispar
GLQG

SEQ ID NO: 2427507 - protein, 7 aa, Entamoeba dispar
GLQKSEK

SEQ ID NO: 2427508 - protein, 4 aa, Entamoeba dispar
GLQP

SEQ ID NO: 2427509 - protein, 6 aa, Entamoeba dispar
GLQPNT

SEQ ID NO: 2427510 - protein, 20 aa, Entamoeba dispar
GLQQKEIKEANDKEECHEKN

SEQ ID NO: 2427511 - protein, 9 aa, Entamoeba dispar
GLQRNEQQM

SEQ ID NO: 2427512 - protein, 13 aa, Entamoeba dispar
GLQSSRPEENWNN

SEQ ID NO: 2427513 - protein, 36 aa, Entamoeba dispar
GLRDEEETVQFGKENKVGLEEEREVQKENDKKMEEE

SEQ ID NO: 2427514 - protein, 4 aa, Entamoeba dispar
GLRH

SEQ ID NO: 2427515 - protein, 11 aa, Entamoeba dispar
GLRNNGGSDID

SEQ ID NO: 2427516 - protein, 21 aa, Entamoeba dispar
GLRSKRNERIDDRRKKREQLM

SEQ ID NO: 2427517 - protein, 11 aa, Entamoeba dispar
GLSDNPFEGID

SEQ ID NO: 2427518 - protein, 10 aa, Entamoeba dispar
GLSEEESKKT

SEQ ID NO: 2427519 - protein, 13 aa, Entamoeba dispar
GLSESLKNGLSKL

SEQ ID NO: 2427520 - protein, 10 aa, Entamoeba dispar
GLSGGEAKDD

SEQ ID NO: 2427521 - protein, 5 aa, Entamoeba dispar
GLSIP

SEQ ID NO: 2427522 - protein, 6 aa, Entamoeba dispar
GLSIPK

SEQ ID NO: 2427523 - protein, 13 aa, Entamoeba dispar
GLSKCDSKTELSD

SEQ ID NO: 2427524 - protein, 15 aa, Entamoeba dispar
GLSKGGQSVANARQQ

SEQ ID NO: 2427525 - protein, 5 aa, Entamoeba dispar
GLSKR

SEQ ID NO: 2427526 - protein, 5 aa, Entamoeba dispar
GLSNK

SEQ ID NO: 2427527 - protein, 6 aa, Entamoeba dispar
GLSNNA

SEQ ID NO: 2427528 - protein, 9 aa, Entamoeba dispar
GLSPDKINE

SEQ ID NO: 2427529 - protein, 7 aa, Entamoeba dispar
GLSPNEQ

SEQ ID NO: 2427530 - protein, 6 aa, Entamoeba dispar
GLSREI

SEQ ID NO: 2427531 - protein, 7 aa, Entamoeba dispar
GLSRGSL

SEQ ID NO: 2427532 - protein, 6 aa, Entamoeba dispar
GLSTDV

SEQ ID NO: 2427533 - protein, 10 aa, Entamoeba dispar
GLTDEKRNAV

SEQ ID NO: 2427534 - protein, 12 aa, Entamoeba dispar
GLTEKDQTNTFC

SEQ ID NO: 2427535 - protein, 20 aa, Entamoeba dispar
GLTEKRRARYDSSPGSFTEK

SEQ ID NO: 2427536 - protein, 7 aa, Entamoeba dispar
GLTHSNT

SEQ ID NO: 2427537 - protein, 9 aa, Entamoeba dispar
GLTKRDNYI

SEQ ID NO: 2427538 - protein, 4 aa, Entamoeba dispar
GLTN

SEQ ID NO: 2427539 - protein, 11 aa, Entamoeba dispar
GLTPRDVTNSG

SEQ ID NO: 2427540 - protein, 6 aa, Entamoeba dispar
GLTSAE

SEQ ID NO: 2427541 - protein, 12 aa, Entamoeba dispar
GLTSDKARHAKR

SEQ ID NO: 2427542 - protein, 10 aa, Entamoeba dispar
GLTSDKASHA

SEQ ID NO: 2427543 - protein, 8 aa, Entamoeba dispar
GLTSPNDG

SEQ ID NO: 2427544 - protein, 6 aa, Entamoeba dispar
GLVESR

SEQ ID NO: 2427545 - protein, 12 aa, Entamoeba dispar
GLVGRSKTKERT

SEQ ID NO: 2427546 - protein, 6 aa, Entamoeba dispar
GLYPPS

SEQ ID NO: 2427547 - protein, 5 aa, Entamoeba dispar
GMAAS

SEQ ID NO: 2427548 - protein, 19 aa, Entamoeba dispar
GMAEQKTNEKIKEDRSAWG

SEQ ID NO: 2427549 - protein, 7 aa, Entamoeba dispar
GMAPPSY

SEQ ID NO: 2427550 - protein, 11 aa, Entamoeba dispar
GMASPAGYRTA

SEQ ID NO: 2427551 - protein, 10 aa, Entamoeba dispar
GMDTKGDGEG

SEQ ID NO: 2427552 - protein, 8 aa, Entamoeba dispar
GMEETQRK

SEQ ID NO: 2427553 - protein, 5 aa, Entamoeba dispar
GMEPS

SEQ ID NO: 2427554 - protein, 6 aa, Entamoeba dispar
GMETGE

SEQ ID NO: 2427555 - protein, 9 aa, Entamoeba dispar
GMGKRPAVS

SEQ ID NO: 2427556 - protein, 6 aa, Entamoeba dispar
GMISTK

SEQ ID NO: 2427557 - protein, 9 aa, Entamoeba dispar
GMKEKRSNN

SEQ ID NO: 2427558 - protein, 11 aa, Entamoeba dispar
GMKSEERETIQ

SEQ ID NO: 2427559 - protein, 5 aa, Entamoeba dispar
GMNDY

SEQ ID NO: 2427560 - protein, 13 aa, Entamoeba dispar
GMNEAQKRSVQQV

SEQ ID NO: 2427561 - protein, 12 aa, Entamoeba dispar
GMNEENKVKEEE

SEQ ID NO: 2427562 - protein, 15 aa, Entamoeba dispar
GMNGFGQQPNNGMGG

SEQ ID NO: 2427563 - protein, 6 aa, Entamoeba dispar
GMNPQA

SEQ ID NO: 2427564 - protein, 7 aa, Entamoeba dispar
GMPDEVR

SEQ ID NO: 2427565 - protein, 5 aa, Entamoeba dispar
GMPGG

SEQ ID NO: 2427566 - protein, 12 aa, Entamoeba dispar
GMPIRKSPGNYG

SEQ ID NO: 2427567 - protein, 30 aa, Entamoeba dispar
GMPQGGRYTFNTGDDSSMNEDFGKQKGEDV

SEQ ID NO: 2427568 - protein, 7 aa, Entamoeba dispar
GMQPPTM

SEQ ID NO: 2427569 - protein, 6 aa, Entamoeba dispar
GMRSYT

SEQ ID NO: 2427570 - protein, 100 aa, Entamoeba dispar
GMSEEEDDDNGEFAEEGDDDEEDEDEKPVEAPKKVEPKKEEKKPQQPKKEEKKPQQPPKKETKPQQHQQPKKEEKKPQQPPKKEFNKKEGKKMNKKNNKK

SEQ ID NO: 2427571 - protein, 10 aa, Entamoeba dispar
GMSGESESKI

SEQ ID NO: 2427572 - protein, 9 aa, Entamoeba dispar
GMSTETNEL

SEQ ID NO: 2427573 - protein, 17 aa, Entamoeba dispar
GMSTTAGIPDFRSPGTG

SEQ ID NO: 2427574 - protein, 15 aa, Entamoeba dispar
GMTTNCSSITPSLND

SEQ ID NO: 2427575 - protein, 7 aa, Entamoeba dispar
GMTTNNN

SEQ ID NO: 2427576 - protein, 20 aa, Entamoeba dispar
GNAAAGGTSSGMGETGLTRV

SEQ ID NO: 2427577 - protein, 10 aa, Entamoeba dispar
GNADPRSTVL

SEQ ID NO: 2427578 - protein, 18 aa, Entamoeba dispar
GNAEVTNNKRGKGTYEKA

SEQ ID NO: 2427579 - protein, 9 aa, Entamoeba dispar
GNAGDSRSV

SEQ ID NO: 2427580 - protein, 6 aa, Entamoeba dispar
GNAGYG

SEQ ID NO: 2427581 - protein, 18 aa, Entamoeba dispar
GNAIKTRREHLRMLFSQL

SEQ ID NO: 2427582 - protein, 8 aa, Entamoeba dispar
GNAKDIDR

SEQ ID NO: 2427583 - protein, 6 aa, Entamoeba dispar
GNAPLS

SEQ ID NO: 2427584 - protein, 9 aa, Entamoeba dispar
GNAPTGDPF

SEQ ID NO: 2427585 - protein, 13 aa, Entamoeba dispar
GNAQPTEDELEGY

SEQ ID NO: 2427586 - protein, 9 aa, Entamoeba dispar
GNASDDKIQ

SEQ ID NO: 2427587 - protein, 13 aa, Entamoeba dispar
GNATNMNLEETED

SEQ ID NO: 2427588 - protein, 4 aa, Entamoeba dispar
GNCD

SEQ ID NO: 2427589 - protein, 4 aa, Entamoeba dispar
GNCE

SEQ ID NO: 2427590 - protein, 6 aa, Entamoeba dispar
GNCGGT

SEQ ID NO: 2427591 - protein, 7 aa, Entamoeba dispar
GNCNNEN

SEQ ID NO: 2427592 - protein, 5 aa, Entamoeba dispar
GNCPG

SEQ ID NO: 2427593 - protein, 8 aa, Entamoeba dispar
GNCTGGHY

SEQ ID NO: 2427594 - protein, 4 aa, Entamoeba dispar
GNDA

SEQ ID NO: 2427595 - protein, 4 aa, Entamoeba dispar
GNDD

SEQ ID NO: 2427596 - protein, 24 aa, Entamoeba dispar
GNDEIKKASGTTETKEKVEVKKER

SEQ ID NO: 2427597 - protein, 6 aa, Entamoeba dispar
GNDEKE

SEQ ID NO: 2427598 - protein, 14 aa, Entamoeba dispar
GNDEKNVKIRKENI

SEQ ID NO: 2427599 - protein, 5 aa, Entamoeba dispar
GNDGT

SEQ ID NO: 2427600 - protein, 9 aa, Entamoeba dispar
GNDGTKQYN

SEQ ID NO: 2427601 - protein, 4 aa, Entamoeba dispar
GNDI

SEQ ID NO: 2427602 - protein, 9 aa, Entamoeba dispar
GNDLPSSPV

SEQ ID NO: 2427603 - protein, 13 aa, Entamoeba dispar
GNDLVNKDKHGNT

SEQ ID NO: 2427604 - protein, 7 aa, Entamoeba dispar
GNDMEET

SEQ ID NO: 2427605 - protein, 6 aa, Entamoeba dispar
GNDNYS

SEQ ID NO: 2427606 - protein, 10 aa, Entamoeba dispar
GNDPDPDVIR

SEQ ID NO: 2427607 - protein, 22 aa, Entamoeba dispar
GNDQEQEEEETIKKKTVSEWDD

SEQ ID NO: 2427608 - protein, 5 aa, Entamoeba dispar
GNDQI

SEQ ID NO: 2427609 - protein, 21 aa, Entamoeba dispar
GNDRNNQLNQQQITEEQQERL

SEQ ID NO: 2427610 - protein, 5 aa, Entamoeba dispar
GNDRQ

SEQ ID NO: 2427611 - protein, 32 aa, Entamoeba dispar
GNDSQTQKKQRNNEDINEKKLKKARIELSSTS

SEQ ID NO: 2427612 - protein, 17 aa, Entamoeba dispar
GNDSRTQKKAKKQRRYK

SEQ ID NO: 2427613 - protein, 8 aa, Entamoeba dispar
GNDSSSTD

SEQ ID NO: 2427614 - protein, 8 aa, Entamoeba dispar
GNDSVTQY

SEQ ID NO: 2427615 - protein, 4 aa, Entamoeba dispar
GNDV

SEQ ID NO: 2427616 - protein, 7 aa, Entamoeba dispar
GNDVPEF

SEQ ID NO: 2427617 - protein, 6 aa, Entamoeba dispar
GNEEEI

SEQ ID NO: 2427618 - protein, 10 aa, Entamoeba dispar
GNEEELESPE

SEQ ID NO: 2427619 - protein, 7 aa, Entamoeba dispar
GNEELSD

SEQ ID NO: 2427620 - protein, 17 aa, Entamoeba dispar
GNEELVATGTVDNVDPS

SEQ ID NO: 2427621 - protein, 5 aa, Entamoeba dispar
GNEEM

SEQ ID NO: 2427622 - protein, 17 aa, Entamoeba dispar
GNEEPQQIQKELTGSIT

SEQ ID NO: 2427623 - protein, 5 aa, Entamoeba dispar
GNEEV

SEQ ID NO: 2427624 - protein, 4 aa, Entamoeba dispar
GNEI

SEQ ID NO: 2427625 - protein, 7 aa, Entamoeba dispar
GNEIDST

SEQ ID NO: 2427626 - protein, 5 aa, Entamoeba dispar
GNEIE

SEQ ID NO: 2427627 - protein, 6 aa, Entamoeba dispar
GNEINP

SEQ ID NO: 2427628 - protein, 20 aa, Entamoeba dispar
GNEISSTPFSSQNIKSTPEF

SEQ ID NO: 2427629 - protein, 4 aa, Entamoeba dispar
GNEK

SEQ ID NO: 2427630 - protein, 9 aa, Entamoeba dispar
GNEKSLQEG

SEQ ID NO: 2427631 - protein, 6 aa, Entamoeba dispar
GNEKVN

SEQ ID NO: 2427632 - protein, 4 aa, Entamoeba dispar
GNEL

SEQ ID NO: 2427633 - protein, 9 aa, Entamoeba dispar
GNELNKSIT

SEQ ID NO: 2427634 - protein, 5 aa, Entamoeba dispar
GNELP

SEQ ID NO: 2427635 - protein, 8 aa, Entamoeba dispar
GNELPHQK

SEQ ID NO: 2427636 - protein, 5 aa, Entamoeba dispar
GNEMN

SEQ ID NO: 2427637 - protein, 4 aa, Entamoeba dispar
GNEN

SEQ ID NO: 2427638 - protein, 20 aa, Entamoeba dispar
GNENDGDGEVGMPELSKSGK

SEQ ID NO: 2427639 - protein, 10 aa, Entamoeba dispar
GNENTNNEYY

SEQ ID NO: 2427640 - protein, 4 aa, Entamoeba dispar
GNEQ

SEQ ID NO: 2427641 - protein, 5 aa, Entamoeba dispar
GNEQY

SEQ ID NO: 2427642 - protein, 4 aa, Entamoeba dispar
GNER

SEQ ID NO: 2427643 - protein, 16 aa, Entamoeba dispar
GNESTPLKKTVSNNTH

SEQ ID NO: 2427644 - protein, 6 aa, Entamoeba dispar
GNESVD

SEQ ID NO: 2427645 - protein, 10 aa, Entamoeba dispar
GNETNPSDKL

SEQ ID NO: 2427646 - protein, 15 aa, Entamoeba dispar
GNETYDEIVQLIKNE

SEQ ID NO: 2427647 - protein, 5 aa, Entamoeba dispar
GNEVD

SEQ ID NO: 2427648 - protein, 6 aa, Entamoeba dispar
GNFDED

SEQ ID NO: 2427649 - protein, 17 aa, Entamoeba dispar
GNFETSSTTDLQQTNGF

SEQ ID NO: 2427650 - protein, 5 aa, Entamoeba dispar
GNFPK

SEQ ID NO: 2427651 - protein, 4 aa, Entamoeba dispar
GNFT

SEQ ID NO: 2427652 - protein, 9 aa, Entamoeba dispar
GNGAGGKGR

SEQ ID NO: 2427653 - protein, 9 aa, Entamoeba dispar
GNGAKNETF

SEQ ID NO: 2427654 - protein, 12 aa, Entamoeba dispar
GNGCKGKTPKKF

SEQ ID NO: 2427655 - protein, 7 aa, Entamoeba dispar
GNGDHPI

SEQ ID NO: 2427656 - protein, 6 aa, Entamoeba dispar
GNGEEI

SEQ ID NO: 2427657 - protein, 8 aa, Entamoeba dispar
GNGEGGND

SEQ ID NO: 2427658 - protein, 7 aa, Entamoeba dispar
GNGESVV

SEQ ID NO: 2427659 - protein, 32 aa, Entamoeba dispar
GNGHTKTSTPTPDKDKLKKKNKTSKEGKCCVL

SEQ ID NO: 2427660 - protein, 7 aa, Entamoeba dispar
GNGHYEN

SEQ ID NO: 2427661 - protein, 7 aa, Entamoeba dispar
GNGIKTY

SEQ ID NO: 2427662 - protein, 6 aa, Entamoeba dispar
GNGLTK

SEQ ID NO: 2427663 - protein, 18 aa, Entamoeba dispar
GNGNVNSNQPSSKSESNV

SEQ ID NO: 2427664 - protein, 9 aa, Entamoeba dispar
GNGPNEKKL

SEQ ID NO: 2427665 - protein, 9 aa, Entamoeba dispar
GNGVEKNDQ

SEQ ID NO: 2427666 - protein, 7 aa, Entamoeba dispar
GNGYERV

SEQ ID NO: 2427667 - protein, 6 aa, Entamoeba dispar
GNHDGL

SEQ ID NO: 2427668 - protein, 7 aa, Entamoeba dispar
GNHDPTT

SEQ ID NO: 2427669 - protein, 4 aa, Entamoeba dispar
GNHE

SEQ ID NO: 2427670 - protein, 10 aa, Entamoeba dispar
GNHEDKELNT

SEQ ID NO: 2427671 - protein, 8 aa, Entamoeba dispar
GNHESRQV

SEQ ID NO: 2427672 - protein, 7 aa, Entamoeba dispar
GNHETRA

SEQ ID NO: 2427673 - protein, 5 aa, Entamoeba dispar
GNHGR

SEQ ID NO: 2427674 - protein, 8 aa, Entamoeba dispar
GNHRTRGD

SEQ ID NO: 2427675 - protein, 4 aa, Entamoeba dispar
GNID

SEQ ID NO: 2427676 - protein, 12 aa, Entamoeba dispar
GNIDRSIDPEEE

SEQ ID NO: 2427677 - protein, 4 aa, Entamoeba dispar
GNIE

SEQ ID NO: 2427678 - protein, 27 aa, Entamoeba dispar
GNIEQPNDEEEQNIKNEEEDTQEEIEP

SEQ ID NO: 2427679 - protein, 27 aa, Entamoeba dispar
GNIEQPNDEEEQTIENEEEDTQEEIEP

SEQ ID NO: 2427680 - protein, 29 aa, Entamoeba dispar
GNIEQPNEEEEQYTENQEEDIQEENEPTY

SEQ ID NO: 2427681 - protein, 10 aa, Entamoeba dispar
GNIERKRASS

SEQ ID NO: 2427682 - protein, 20 aa, Entamoeba dispar
GNIESTKSSLKESLESQKTT

SEQ ID NO: 2427683 - protein, 4 aa, Entamoeba dispar
GNIG

SEQ ID NO: 2427684 - protein, 10 aa, Entamoeba dispar
GNIPKVSSAI

SEQ ID NO: 2427685 - protein, 4 aa, Entamoeba dispar
GNIQ

SEQ ID NO: 2427686 - protein, 4 aa, Entamoeba dispar
GNIS

SEQ ID NO: 2427687 - protein, 12 aa, Entamoeba dispar
GNITGGIPDNDI

SEQ ID NO: 2427688 - protein, 13 aa, Entamoeba dispar
GNKAFKQAGFESV

SEQ ID NO: 2427689 - protein, 12 aa, Entamoeba dispar
GNKCKNREYTRE

SEQ ID NO: 2427690 - protein, 5 aa, Entamoeba dispar
GNKDL

SEQ ID NO: 2427691 - protein, 7 aa, Entamoeba dispar
GNKEEMK

SEQ ID NO: 2427692 - protein, 9 aa, Entamoeba dispar
GNKEERTNM

SEQ ID NO: 2427693 - protein, 7 aa, Entamoeba dispar
GNKEEYT

SEQ ID NO: 2427694 - protein, 7 aa, Entamoeba dispar
GNKEGNE

SEQ ID NO: 2427695 - protein, 7 aa, Entamoeba dispar
GNKENIK

SEQ ID NO: 2427696 - protein, 7 aa, Entamoeba dispar
GNKERVD

SEQ ID NO: 2427697 - protein, 8 aa, Entamoeba dispar
GNKEVKER

SEQ ID NO: 2427698 - protein, 12 aa, Entamoeba dispar
GNKFDNVPTPVP

SEQ ID NO: 2427699 - protein, 9 aa, Entamoeba dispar
GNKGEEPMD

SEQ ID NO: 2427700 - protein, 4 aa, Entamoeba dispar
GNKH

SEQ ID NO: 2427701 - protein, 8 aa, Entamoeba dispar
GNKIDERH

SEQ ID NO: 2427702 - protein, 10 aa, Entamoeba dispar
GNKIPQEVKS

SEQ ID NO: 2427703 - protein, 18 aa, Entamoeba dispar
GNKITSTVKESADDITTS

SEQ ID NO: 2427704 - protein, 9 aa, Entamoeba dispar
GNKKRGQLT

SEQ ID NO: 2427705 - protein, 6 aa, Entamoeba dispar
GNKKRI

SEQ ID NO: 2427706 - protein, 13 aa, Entamoeba dispar
GNKKSVKSTPQNT

SEQ ID NO: 2427707 - protein, 6 aa, Entamoeba dispar
GNKNEN

SEQ ID NO: 2427708 - protein, 5 aa, Entamoeba dispar
GNKPI

SEQ ID NO: 2427709 - protein, 7 aa, Entamoeba dispar
GNKRAKE

SEQ ID NO: 2427710 - protein, 9 aa, Entamoeba dispar
GNKRNEAKE

SEQ ID NO: 2427711 - protein, 10 aa, Entamoeba dispar
GNKSDSFDNE

SEQ ID NO: 2427712 - protein, 7 aa, Entamoeba dispar
GNKSISG

SEQ ID NO: 2427713 - protein, 10 aa, Entamoeba dispar
GNKSYEKDGK

SEQ ID NO: 2427714 - protein, 4 aa, Entamoeba dispar
GNKT

SEQ ID NO: 2427715 - protein, 6 aa, Entamoeba dispar
GNKVEC

SEQ ID NO: 2427716 - protein, 4 aa, Entamoeba dispar
GNLE

SEQ ID NO: 2427717 - protein, 12 aa, Entamoeba dispar
GNLEQSALDPRN

SEQ ID NO: 2427718 - protein, 8 aa, Entamoeba dispar
GNLIPSEN

SEQ ID NO: 2427719 - protein, 8 aa, Entamoeba dispar
GNLPPQEI

SEQ ID NO: 2427720 - protein, 8 aa, Entamoeba dispar
GNLQNKYV

SEQ ID NO: 2427721 - protein, 7 aa, Entamoeba dispar
GNLRASD

SEQ ID NO: 2427722 - protein, 13 aa, Entamoeba dispar
GNLSSYDSTMSKD

SEQ ID NO: 2427723 - protein, 10 aa, Entamoeba dispar
GNLSTDSDNY

SEQ ID NO: 2427724 - protein, 6 aa, Entamoeba dispar
GNLTEI

SEQ ID NO: 2427725 - protein, 10 aa, Entamoeba dispar
GNLTTLKPRP

SEQ ID NO: 2427726 - protein, 4 aa, Entamoeba dispar
GNLY

SEQ ID NO: 2427727 - protein, 6 aa, Entamoeba dispar
GNLYNK

SEQ ID NO: 2427728 - protein, 4 aa, Entamoeba dispar
GNND

SEQ ID NO: 2427729 - protein, 8 aa, Entamoeba dispar
GNNDINTI

SEQ ID NO: 2427730 - protein, 34 aa, Entamoeba dispar
GNNEKPKEETQNTTSPFNNSSSTTNAFSFGSSSN

SEQ ID NO: 2427731 - protein, 9 aa, Entamoeba dispar
GNNETEKSQ

SEQ ID NO: 2427732 - protein, 5 aa, Entamoeba dispar
GNNEY

SEQ ID NO: 2427733 - protein, 8 aa, Entamoeba dispar
GNNGTTVT

SEQ ID NO: 2427734 - protein, 6 aa, Entamoeba dispar
GNNIEK

SEQ ID NO: 2427735 - protein, 10 aa, Entamoeba dispar
GNNITTETKL

SEQ ID NO: 2427736 - protein, 11 aa, Entamoeba dispar
GNNKLESKALA

SEQ ID NO: 2427737 - protein, 6 aa, Entamoeba dispar
GNNKSE

SEQ ID NO: 2427738 - protein, 29 aa, Entamoeba dispar
GNNLERKRNISNKENTKNISNKENAKSIS

SEQ ID NO: 2427739 - protein, 7 aa, Entamoeba dispar
GNNLSRQ

SEQ ID NO: 2427740 - protein, 7 aa, Entamoeba dispar
GNNNAAK

SEQ ID NO: 2427741 - protein, 25 aa, Entamoeba dispar
GNNNNSLLSSSDINEDSLPSIPEKS

SEQ ID NO: 2427742 - protein, 7 aa, Entamoeba dispar
GNNPEID

SEQ ID NO: 2427743 - protein, 11 aa, Entamoeba dispar
GNNPKTKSKKK

SEQ ID NO: 2427744 - protein, 5 aa, Entamoeba dispar
GNNPP

SEQ ID NO: 2427745 - protein, 16 aa, Entamoeba dispar
GNNPYDENNINSNQTI

SEQ ID NO: 2427746 - protein, 34 aa, Entamoeba dispar
GNNPYVENNINSNQTINGITTQSLDNPSKNSSLH

SEQ ID NO: 2427747 - protein, 8 aa, Entamoeba dispar
GNNQNDAS

SEQ ID NO: 2427748 - protein, 4 aa, Entamoeba dispar
GNNR

SEQ ID NO: 2427749 - protein, 6 aa, Entamoeba dispar
GNNSDI

SEQ ID NO: 2427750 - protein, 5 aa, Entamoeba dispar
GNNSI

SEQ ID NO: 2427751 - protein, 6 aa, Entamoeba dispar
GNNTKE

SEQ ID NO: 2427752 - protein, 5 aa, Entamoeba dispar
GNNTL

SEQ ID NO: 2427753 - protein, 7 aa, Entamoeba dispar
GNNVGYV

SEQ ID NO: 2427754 - protein, 5 aa, Entamoeba dispar
GNNYE

SEQ ID NO: 2427755 - protein, 12 aa, Entamoeba dispar
GNNYSKINEEVY

SEQ ID NO: 2427756 - protein, 25 aa, Entamoeba dispar
GNPAKVRRRVSEHPGWTIENRDIAL

SEQ ID NO: 2427757 - protein, 25 aa, Entamoeba dispar
GNPARVKRRVSEHPGWTIENRDVPL

SEQ ID NO: 2427758 - protein, 4 aa, Entamoeba dispar
GNPD

SEQ ID NO: 2427759 - protein, 6 aa, Entamoeba dispar
GNPDLE

SEQ ID NO: 2427760 - protein, 11 aa, Entamoeba dispar
GNPDLHANESV

SEQ ID NO: 2427761 - protein, 8 aa, Entamoeba dispar
GNPDYERT

SEQ ID NO: 2427762 - protein, 20 aa, Entamoeba dispar
GNPGEDSYQRKISLLCVDAP

SEQ ID NO: 2427763 - protein, 19 aa, Entamoeba dispar
GNPIQSQTGQQPNTQTQKD

SEQ ID NO: 2427764 - protein, 20 aa, Entamoeba dispar
GNPIQSQTGQQPNTQTQKDV

SEQ ID NO: 2427765 - protein, 9 aa, Entamoeba dispar
GNPKNELPS

SEQ ID NO: 2427766 - protein, 15 aa, Entamoeba dispar
GNPKTKRKLNKNSYL

SEQ ID NO: 2427767 - protein, 5 aa, Entamoeba dispar
GNPLV

SEQ ID NO: 2427768 - protein, 7 aa, Entamoeba dispar
GNPNGPI

SEQ ID NO: 2427769 - protein, 12 aa, Entamoeba dispar
GNPNIRNGSAFY

SEQ ID NO: 2427770 - protein, 5 aa, Entamoeba dispar
GNPNS

SEQ ID NO: 2427771 - protein, 7 aa, Entamoeba dispar
GNPNWQA

SEQ ID NO: 2427772 - protein, 6 aa, Entamoeba dispar
GNPPLR

SEQ ID NO: 2427773 - protein, 6 aa, Entamoeba dispar
GNPPSA

SEQ ID NO: 2427774 - protein, 7 aa, Entamoeba dispar
GNPPYYD

SEQ ID NO: 2427775 - protein, 4 aa, Entamoeba dispar
GNPQ

SEQ ID NO: 2427776 - protein, 7 aa, Entamoeba dispar
GNPSAEQ

SEQ ID NO: 2427777 - protein, 6 aa, Entamoeba dispar
GNPSVP

SEQ ID NO: 2427778 - protein, 4 aa, Entamoeba dispar
GNPT

SEQ ID NO: 2427779 - protein, 7 aa, Entamoeba dispar
GNPTAEM

SEQ ID NO: 2427780 - protein, 4 aa, Entamoeba dispar
GNPV

SEQ ID NO: 2427781 - protein, 22 aa, Entamoeba dispar
GNPVQPQSKAQQNTQPQPQKDV

SEQ ID NO: 2427782 - protein, 22 aa, Entamoeba dispar
GNPVQSQNKTPQIGQTQPQKDV

SEQ ID NO: 2427783 - protein, 4 aa, Entamoeba dispar
GNPY

SEQ ID NO: 2427784 - protein, 9 aa, Entamoeba dispar
GNQIQQEDQ

SEQ ID NO: 2427785 - protein, 6 aa, Entamoeba dispar
GNQIRR

SEQ ID NO: 2427786 - protein, 10 aa, Entamoeba dispar
GNQKTVQEMR

SEQ ID NO: 2427787 - protein, 12 aa, Entamoeba dispar
GNQNQIDNLQSQ

SEQ ID NO: 2427788 - protein, 5 aa, Entamoeba dispar
GNQPV

SEQ ID NO: 2427789 - protein, 4 aa, Entamoeba dispar
GNQT

SEQ ID NO: 2427790 - protein, 11 aa, Entamoeba dispar
GNQTNVKSKCP

SEQ ID NO: 2427791 - protein, 8 aa, Entamoeba dispar
GNQVKSNP

SEQ ID NO: 2427792 - protein, 14 aa, Entamoeba dispar
GNRGFPDDFDTDKV

SEQ ID NO: 2427793 - protein, 5 aa, Entamoeba dispar
GNRID

SEQ ID NO: 2427794 - protein, 4 aa, Entamoeba dispar
GNRL

SEQ ID NO: 2427795 - protein, 22 aa, Entamoeba dispar
GNRNGNLGRFTDQERKEFSGTA

SEQ ID NO: 2427796 - protein, 4 aa, Entamoeba dispar
GNRP

SEQ ID NO: 2427797 - protein, 10 aa, Entamoeba dispar
GNRQESSTYN

SEQ ID NO: 2427798 - protein, 7 aa, Entamoeba dispar
GNRREKG

SEQ ID NO: 2427799 - protein, 5 aa, Entamoeba dispar
GNRSH

SEQ ID NO: 2427800 - protein, 7 aa, Entamoeba dispar
GNSAQDV

SEQ ID NO: 2427801 - protein, 11 aa, Entamoeba dispar
GNSDFTKKKAE

SEQ ID NO: 2427802 - protein, 7 aa, Entamoeba dispar
GNSEGKE

SEQ ID NO: 2427803 - protein, 5 aa, Entamoeba dispar
GNSHL

SEQ ID NO: 2427804 - protein, 4 aa, Entamoeba dispar
GNSI

SEQ ID NO: 2427805 - protein, 12 aa, Entamoeba dispar
GNSIRYAKDGCS

SEQ ID NO: 2427806 - protein, 5 aa, Entamoeba dispar
GNSIS

SEQ ID NO: 2427807 - protein, 6 aa, Entamoeba dispar
GNSIYQ

SEQ ID NO: 2427808 - protein, 7 aa, Entamoeba dispar
GNSKTPE

SEQ ID NO: 2427809 - protein, 4 aa, Entamoeba dispar
GNSL

SEQ ID NO: 2427810 - protein, 19 aa, Entamoeba dispar
GNSLAENIEQMQSGDINFD

SEQ ID NO: 2427811 - protein, 4 aa, Entamoeba dispar
GNSM

SEQ ID NO: 2427812 - protein, 5 aa, Entamoeba dispar
GNSPL

SEQ ID NO: 2427813 - protein, 8 aa, Entamoeba dispar
GNSQDVKQ

SEQ ID NO: 2427814 - protein, 6 aa, Entamoeba dispar
GNSQTI

SEQ ID NO: 2427815 - protein, 18 aa, Entamoeba dispar
GNSRGGESTSGSVESTET

SEQ ID NO: 2427816 - protein, 12 aa, Entamoeba dispar
GNSRTSYSIPPS

SEQ ID NO: 2427817 - protein, 5 aa, Entamoeba dispar
GNSSD

SEQ ID NO: 2427818 - protein, 12 aa, Entamoeba dispar
GNSSDSTNQEQT

SEQ ID NO: 2427819 - protein, 7 aa, Entamoeba dispar
GNSSGIS

SEQ ID NO: 2427820 - protein, 8 aa, Entamoeba dispar
GNSTELSS

SEQ ID NO: 2427821 - protein, 11 aa, Entamoeba dispar
GNSVSGCSNTD

SEQ ID NO: 2427822 - protein, 10 aa, Entamoeba dispar
GNTANKSYEI

SEQ ID NO: 2427823 - protein, 6 aa, Entamoeba dispar
GNTEGC

SEQ ID NO: 2427824 - protein, 11 aa, Entamoeba dispar
GNTFGETEATK

SEQ ID NO: 2427825 - protein, 10 aa, Entamoeba dispar
GNTFTQKSDV

SEQ ID NO: 2427826 - protein, 4 aa, Entamoeba dispar
GNTG

SEQ ID NO: 2427827 - protein, 13 aa, Entamoeba dispar
GNTGDPGVEKSLD

SEQ ID NO: 2427828 - protein, 11 aa, Entamoeba dispar
GNTIDDREFQT

SEQ ID NO: 2427829 - protein, 10 aa, Entamoeba dispar
GNTIPSEVKS

SEQ ID NO: 2427830 - protein, 14 aa, Entamoeba dispar
GNTIPSEVKSIGNG

SEQ ID NO: 2427831 - protein, 11 aa, Entamoeba dispar
GNTIPSEVKSL

SEQ ID NO: 2427832 - protein, 4 aa, Entamoeba dispar
GNTL

SEQ ID NO: 2427833 - protein, 10 aa, Entamoeba dispar
GNTMDIASDP

SEQ ID NO: 2427834 - protein, 10 aa, Entamoeba dispar
GNTPEPNDFD

SEQ ID NO: 2427835 - protein, 7 aa, Entamoeba dispar
GNTPVQY

SEQ ID NO: 2427836 - protein, 10 aa, Entamoeba dispar
GNTQVPKNAK

SEQ ID NO: 2427837 - protein, 6 aa, Entamoeba dispar
GNTREA

SEQ ID NO: 2427838 - protein, 8 aa, Entamoeba dispar
GNTRKKTL

SEQ ID NO: 2427839 - protein, 19 aa, Entamoeba dispar
GNTTKKTAKRRIQPTKRRE

SEQ ID NO: 2427840 - protein, 13 aa, Entamoeba dispar
GNTTQPKLNQTLK

SEQ ID NO: 2427841 - protein, 5 aa, Entamoeba dispar
GNTVI

SEQ ID NO: 2427842 - protein, 12 aa, Entamoeba dispar
GNTYNEGDATKM

SEQ ID NO: 2427843 - protein, 4 aa, Entamoeba dispar
GNVD

SEQ ID NO: 2427844 - protein, 11 aa, Entamoeba dispar
GNVEKSIPPKE

SEQ ID NO: 2427845 - protein, 7 aa, Entamoeba dispar
GNVENPE

SEQ ID NO: 2427846 - protein, 12 aa, Entamoeba dispar
GNVGDKASETEA

SEQ ID NO: 2427847 - protein, 6 aa, Entamoeba dispar
GNVGKV

SEQ ID NO: 2427848 - protein, 8 aa, Entamoeba dispar
GNVHSNTT

SEQ ID NO: 2427849 - protein, 7 aa, Entamoeba dispar
GNVKKDI

SEQ ID NO: 2427850 - protein, 13 aa, Entamoeba dispar
GNVPAQPESDGFD

SEQ ID NO: 2427851 - protein, 9 aa, Entamoeba dispar
GNVSGNKQK

SEQ ID NO: 2427852 - protein, 6 aa, Entamoeba dispar
GNYERV

SEQ ID NO: 2427853 - protein, 7 aa, Entamoeba dispar
GNYGDDY

SEQ ID NO: 2427854 - protein, 24 aa, Entamoeba dispar
GNYIESDDDEWYDQTKKEDEVEEL

SEQ ID NO: 2427855 - protein, 5 aa, Entamoeba dispar
GNYKD

SEQ ID NO: 2427856 - protein, 10 aa, Entamoeba dispar
GNYKGAAEAL

SEQ ID NO: 2427857 - protein, 17 aa, Entamoeba dispar
GNYNKTTKIILNKLEPK

SEQ ID NO: 2427858 - protein, 22 aa, Entamoeba dispar
GNYPPKDIQSPRVQQRDPTTRY

SEQ ID NO: 2427859 - protein, 14 aa, Entamoeba dispar
GNYPSYQSQPSVGI

SEQ ID NO: 2427860 - protein, 4 aa, Entamoeba dispar
GNYQ

SEQ ID NO: 2427861 - protein, 7 aa, Entamoeba dispar
GNYQSMD

SEQ ID NO: 2427862 - protein, 4 aa, Entamoeba dispar
GNYR

SEQ ID NO: 2427863 - protein, 10 aa, Entamoeba dispar
GNYSDSHNPF

SEQ ID NO: 2427864 - protein, 5 aa, Entamoeba dispar
GNYSQ

SEQ ID NO: 2427865 - protein, 7 aa, Entamoeba dispar
GNYTEYS

SEQ ID NO: 2427866 - protein, 5 aa, Entamoeba dispar
GNYTL

SEQ ID NO: 2427867 - protein, 4 aa, Entamoeba dispar
GPAG

SEQ ID NO: 2427868 - protein, 7 aa, Entamoeba dispar
GPAHPTN

SEQ ID NO: 2427869 - protein, 4 aa, Entamoeba dispar
GPAL

SEQ ID NO: 2427870 - protein, 9 aa, Entamoeba dispar
GPARSGKTT

SEQ ID NO: 2427871 - protein, 6 aa, Entamoeba dispar
GPAVND

SEQ ID NO: 2427872 - protein, 11 aa, Entamoeba dispar
GPDANEKTKSR

SEQ ID NO: 2427873 - protein, 8 aa, Entamoeba dispar
GPDHSFND

SEQ ID NO: 2427874 - protein, 5 aa, Entamoeba dispar
GPDIN

SEQ ID NO: 2427875 - protein, 5 aa, Entamoeba dispar
GPDIP

SEQ ID NO: 2427876 - protein, 11 aa, Entamoeba dispar
GPDSSAPSPIY

SEQ ID NO: 2427877 - protein, 18 aa, Entamoeba dispar
GPDTVSKINKITGHLKLL

SEQ ID NO: 2427878 - protein, 5 aa, Entamoeba dispar
GPECD

SEQ ID NO: 2427879 - protein, 5 aa, Entamoeba dispar
GPEFH

SEQ ID NO: 2427880 - protein, 14 aa, Entamoeba dispar
GPEGIDKKKENQVD

SEQ ID NO: 2427881 - protein, 9 aa, Entamoeba dispar
GPEGQNSFV

SEQ ID NO: 2427882 - protein, 9 aa, Entamoeba dispar
GPEGSGKYT

SEQ ID NO: 2427883 - protein, 10 aa, Entamoeba dispar
GPEGTEYEGG

SEQ ID NO: 2427884 - protein, 8 aa, Entamoeba dispar
GPEKSGKS

SEQ ID NO: 2427885 - protein, 4 aa, Entamoeba dispar
GPEM

SEQ ID NO: 2427886 - protein, 9 aa, Entamoeba dispar
GPESPENEF

SEQ ID NO: 2427887 - protein, 7 aa, Entamoeba dispar
GPEVGKT

SEQ ID NO: 2427888 - protein, 8 aa, Entamoeba dispar
GPEVKNKL

SEQ ID NO: 2427889 - protein, 5 aa, Entamoeba dispar
GPFNK

SEQ ID NO: 2427890 - protein, 8 aa, Entamoeba dispar
GPFPNNEG

SEQ ID NO: 2427891 - protein, 11 aa, Entamoeba dispar
GPGAGKGTQCD

SEQ ID NO: 2427892 - protein, 11 aa, Entamoeba dispar
GPGAGKGTQCQ

SEQ ID NO: 2427893 - protein, 8 aa, Entamoeba dispar
GPGDVTGI

SEQ ID NO: 2427894 - protein, 12 aa, Entamoeba dispar
GPGLDEESSGYL

SEQ ID NO: 2427895 - protein, 6 aa, Entamoeba dispar
GPGNVT

SEQ ID NO: 2427896 - protein, 30 aa, Entamoeba dispar
GPHAQQKKKLVAEGKLEKYGKPNDKTPADY

SEQ ID NO: 2427897 - protein, 7 aa, Entamoeba dispar
GPHVENP

SEQ ID NO: 2427898 - protein, 4 aa, Entamoeba dispar
GPID

SEQ ID NO: 2427899 - protein, 4 aa, Entamoeba dispar
GPIE

SEQ ID NO: 2427900 - protein, 5 aa, Entamoeba dispar
GPIEN

SEQ ID NO: 2427901 - protein, 6 aa, Entamoeba dispar
GPIGEN

SEQ ID NO: 2427902 - protein, 8 aa, Entamoeba dispar
GPIGGNGI

SEQ ID NO: 2427903 - protein, 4 aa, Entamoeba dispar
GPIR

SEQ ID NO: 2427904 - protein, 14 aa, Entamoeba dispar
GPKEKMSVVSFLNN

SEQ ID NO: 2427905 - protein, 6 aa, Entamoeba dispar
GPKGYI

SEQ ID NO: 2427906 - protein, 8 aa, Entamoeba dispar
GPKKGAAI

SEQ ID NO: 2427907 - protein, 6 aa, Entamoeba dispar
GPKSTW

SEQ ID NO: 2427908 - protein, 8 aa, Entamoeba dispar
GPKTIKKA

SEQ ID NO: 2427909 - protein, 5 aa, Entamoeba dispar
GPKTK

SEQ ID NO: 2427910 - protein, 7 aa, Entamoeba dispar
GPKTKVK

SEQ ID NO: 2427911 - protein, 12 aa, Entamoeba dispar
GPLPDQGTNNVS

SEQ ID NO: 2427912 - protein, 11 aa, Entamoeba dispar
GPLPPPPENYE

SEQ ID NO: 2427913 - protein, 14 aa, Entamoeba dispar
GPLRNYEDQNNKQF

SEQ ID NO: 2427914 - protein, 6 aa, Entamoeba dispar
GPLSSK

SEQ ID NO: 2427915 - protein, 15 aa, Entamoeba dispar
GPLTRTPGERMERDE

SEQ ID NO: 2427916 - protein, 23 aa, Entamoeba dispar
GPLTSGNKKTSSVSPTSVAIGGT

SEQ ID NO: 2427917 - protein, 6 aa, Entamoeba dispar
GPLTSS

SEQ ID NO: 2427918 - protein, 7 aa, Entamoeba dispar
GPNDKMS

SEQ ID NO: 2427919 - protein, 5 aa, Entamoeba dispar
GPNDS

SEQ ID NO: 2427920 - protein, 4 aa, Entamoeba dispar
GPNG

SEQ ID NO: 2427921 - protein, 9 aa, Entamoeba dispar
GPNGAGKSS

SEQ ID NO: 2427922 - protein, 8 aa, Entamoeba dispar
GPNGKPNL

SEQ ID NO: 2427923 - protein, 9 aa, Entamoeba dispar
GPNGSGKTT

SEQ ID NO: 2427924 - protein, 4 aa, Entamoeba dispar
GPNK

SEQ ID NO: 2427925 - protein, 6 aa, Entamoeba dispar
GPNKTD

SEQ ID NO: 2427926 - protein, 4 aa, Entamoeba dispar
GPNQ

SEQ ID NO: 2427927 - protein, 8 aa, Entamoeba dispar
GPNSLTNQ

SEQ ID NO: 2427928 - protein, 5 aa, Entamoeba dispar
GPNSS

SEQ ID NO: 2427929 - protein, 10 aa, Entamoeba dispar
GPNSTNIPGN

SEQ ID NO: 2427930 - protein, 9 aa, Entamoeba dispar
GPPGCGKTT

SEQ ID NO: 2427931 - protein, 18 aa, Entamoeba dispar
GPPGNSKTMQAKALASEA

SEQ ID NO: 2427932 - protein, 10 aa, Entamoeba dispar
GPPGSGKTTI

SEQ ID NO: 2427933 - protein, 8 aa, Entamoeba dispar
GPPGTGKS

SEQ ID NO: 2427934 - protein, 9 aa, Entamoeba dispar
GPPGTGKSR

SEQ ID NO: 2427935 - protein, 9 aa, Entamoeba dispar
GPPGTGKTM

SEQ ID NO: 2427936 - protein, 9 aa, Entamoeba dispar
GPPGTGKTT

SEQ ID NO: 2427937 - protein, 11 aa, Entamoeba dispar
GPPGTGKTTTA

SEQ ID NO: 2427938 - protein, 7 aa, Entamoeba dispar
GPPPTEL

SEQ ID NO: 2427939 - protein, 4 aa, Entamoeba dispar
GPQA

SEQ ID NO: 2427940 - protein, 7 aa, Entamoeba dispar
GPQGSVR

SEQ ID NO: 2427941 - protein, 4 aa, Entamoeba dispar
GPQL

SEQ ID NO: 2427942 - protein, 9 aa, Entamoeba dispar
GPQQACTTK

SEQ ID NO: 2427943 - protein, 4 aa, Entamoeba dispar
GPQT

SEQ ID NO: 2427944 - protein, 20 aa, Entamoeba dispar
GPQTQQSTQITHSTSQIPSF

SEQ ID NO: 2427945 - protein, 8 aa, Entamoeba dispar
GPRDYEGK

SEQ ID NO: 2427946 - protein, 4 aa, Entamoeba dispar
GPRQ

SEQ ID NO: 2427947 - protein, 4 aa, Entamoeba dispar
GPRV

SEQ ID NO: 2427948 - protein, 8 aa, Entamoeba dispar
GPRVENPD

SEQ ID NO: 2427949 - protein, 5 aa, Entamoeba dispar
GPSAD

SEQ ID NO: 2427950 - protein, 9 aa, Entamoeba dispar
GPSERPGKV

SEQ ID NO: 2427951 - protein, 7 aa, Entamoeba dispar
GPSFNTI

SEQ ID NO: 2427952 - protein, 7 aa, Entamoeba dispar
GPSFQRK

SEQ ID NO: 2427953 - protein, 9 aa, Entamoeba dispar
GPSGGGKTT

SEQ ID NO: 2427954 - protein, 8 aa, Entamoeba dispar
GPSGTGKS

SEQ ID NO: 2427955 - protein, 13 aa, Entamoeba dispar
GPSGTGMEETYQV

SEQ ID NO: 2427956 - protein, 6 aa, Entamoeba dispar
GPSKQL

SEQ ID NO: 2427957 - protein, 11 aa, Entamoeba dispar
GPSKYYDATPD

SEQ ID NO: 2427958 - protein, 5 aa, Entamoeba dispar
GPSNK

SEQ ID NO: 2427959 - protein, 10 aa, Entamoeba dispar
GPSSSGKTTF

SEQ ID NO: 2427960 - protein, 105 aa, Entamoeba dispar
GPSSSTSSGYRKGGNAAGPMASKGTWAATTDIGKTAAVGADTYEAGYRKGGNAAGPMASKGTWAATTDIGKTAAVGADTYEAGYRKGGNAAGPMASKGTWAATTD

SEQ ID NO: 2427961 - protein, 34 aa, Entamoeba dispar
GPSSSTSSGYRRQGSDATGPMASKGTWAATTDIG

SEQ ID NO: 2427962 - protein, 13 aa, Entamoeba dispar
GPSYSLPPKSATV

SEQ ID NO: 2427963 - protein, 4 aa, Entamoeba dispar
GPTA

SEQ ID NO: 2427964 - protein, 8 aa, Entamoeba dispar
GPTEEADI

SEQ ID NO: 2427965 - protein, 8 aa, Entamoeba dispar
GPTGANEI

SEQ ID NO: 2427966 - protein, 10 aa, Entamoeba dispar
GPTNGNVPGN

SEQ ID NO: 2427967 - protein, 8 aa, Entamoeba dispar
GPTPFEPI

SEQ ID NO: 2427968 - protein, 9 aa, Entamoeba dispar
GPTQTPYEG

SEQ ID NO: 2427969 - protein, 9 aa, Entamoeba dispar
GPTSAGKTS

SEQ ID NO: 2427970 - protein, 9 aa, Entamoeba dispar
GPTSDPTRF

SEQ ID NO: 2427971 - protein, 9 aa, Entamoeba dispar
GPTSFSTSI

SEQ ID NO: 2427972 - protein, 16 aa, Entamoeba dispar
GPTSQRVKEIAYRFTE

SEQ ID NO: 2427973 - protein, 7 aa, Entamoeba dispar
GPTTEAN

SEQ ID NO: 2427974 - protein, 4 aa, Entamoeba dispar
GPTV

SEQ ID NO: 2427975 - protein, 4 aa, Entamoeba dispar
GPTY

SEQ ID NO: 2427976 - protein, 5 aa, Entamoeba dispar
GPVDS

SEQ ID NO: 2427977 - protein, 11 aa, Entamoeba dispar
GPVEEKRAQYT

SEQ ID NO: 2427978 - protein, 16 aa, Entamoeba dispar
GPVPPQLPLGTENNGY

SEQ ID NO: 2427979 - protein, 6 aa, Entamoeba dispar
GPYEEG

SEQ ID NO: 2427980 - protein, 8 aa, Entamoeba dispar
GPYLTSEE

SEQ ID NO: 2427981 - protein, 10 aa, Entamoeba dispar
GPYSTNFTGN

SEQ ID NO: 2427982 - protein, 10 aa, Entamoeba dispar
GQAAFGQAKA

SEQ ID NO: 2427983 - protein, 7 aa, Entamoeba dispar
GQCGVTK

SEQ ID NO: 2427984 - protein, 22 aa, Entamoeba dispar
GQDGFGNAEVPNTKLKPASNRH

SEQ ID NO: 2427985 - protein, 7 aa, Entamoeba dispar
GQDGKID

SEQ ID NO: 2427986 - protein, 5 aa, Entamoeba dispar
GQDHA

SEQ ID NO: 2427987 - protein, 8 aa, Entamoeba dispar
GQDLDPRD

SEQ ID NO: 2427988 - protein, 13 aa, Entamoeba dispar
GQDPKTIQTKPTI

SEQ ID NO: 2427989 - protein, 6 aa, Entamoeba dispar
GQDPQI

SEQ ID NO: 2427990 - protein, 7 aa, Entamoeba dispar
GQDRTKS

SEQ ID NO: 2427991 - protein, 24 aa, Entamoeba dispar
GQDSEEKEERQESELVKKEEEINK

SEQ ID NO: 2427992 - protein, 6 aa, Entamoeba dispar
GQEAKP

SEQ ID NO: 2427993 - protein, 68 aa, Entamoeba dispar
GQEEVKETPKPAPQPQKETPKPTPANQPTTPAKTPVAAAPSTPNKTEHAPSTPNKTEPAPASPSKPKF

SEQ ID NO: 2427994 - protein, 4 aa, Entamoeba dispar
GQEF

SEQ ID NO: 2427995 - protein, 10 aa, Entamoeba dispar
GQENIEKTKE

SEQ ID NO: 2427996 - protein, 4 aa, Entamoeba dispar
GQER

SEQ ID NO: 2427997 - protein, 6 aa, Entamoeba dispar
GQERFR

SEQ ID NO: 2427998 - protein, 27 aa, Entamoeba dispar
GQERTCQQENSSTTPIQPNNSHTEEKI

SEQ ID NO: 2427999 - protein, 5 aa, Entamoeba dispar
GQESF

SEQ ID NO: 2428000 - protein, 8 aa, Entamoeba dispar
GQESKTAF

SEQ ID NO: 2428001 - protein, 8 aa, Entamoeba dispar
GQESQEAK

SEQ ID NO: 2428002 - protein, 9 aa, Entamoeba dispar
GQETGITPR

SEQ ID NO: 2428003 - protein, 4 aa, Entamoeba dispar
GQFE

SEQ ID NO: 2428004 - protein, 5 aa, Entamoeba dispar
GQFED

SEQ ID NO: 2428005 - protein, 16 aa, Entamoeba dispar
GQFGSRLGGGKDQAAA

SEQ ID NO: 2428006 - protein, 7 aa, Entamoeba dispar
GQGIKSG

SEQ ID NO: 2428007 - protein, 4 aa, Entamoeba dispar
GQGM

SEQ ID NO: 2428008 - protein, 24 aa, Entamoeba dispar
GQGSDEQLGGYGRHRNAKKWNKLS

SEQ ID NO: 2428009 - protein, 6 aa, Entamoeba dispar
GQGSFG

SEQ ID NO: 2428010 - protein, 4 aa, Entamoeba dispar
GQGV

SEQ ID NO: 2428011 - protein, 5 aa, Entamoeba dispar
GQHET

SEQ ID NO: 2428012 - protein, 5 aa, Entamoeba dispar
GQHIG

SEQ ID NO: 2428013 - protein, 4 aa, Entamoeba dispar
GQHN

SEQ ID NO: 2428014 - protein, 13 aa, Entamoeba dispar
GQHPDNIGIVLCR

SEQ ID NO: 2428015 - protein, 5 aa, Entamoeba dispar
GQHYT

SEQ ID NO: 2428016 - protein, 5 aa, Entamoeba dispar
GQIDD

SEQ ID NO: 2428017 - protein, 19 aa, Entamoeba dispar
GQIEPKQTAVSDHSSYKYE

SEQ ID NO: 2428018 - protein, 10 aa, Entamoeba dispar
GQIGNKQVRN

SEQ ID NO: 2428019 - protein, 5 aa, Entamoeba dispar
GQIIQ

SEQ ID NO: 2428020 - protein, 5 aa, Entamoeba dispar
GQIKQ

SEQ ID NO: 2428021 - protein, 21 aa, Entamoeba dispar
GQINKNQPKPQQQYAQKEKVT

SEQ ID NO: 2428022 - protein, 9 aa, Entamoeba dispar
GQIYSQGTK

SEQ ID NO: 2428023 - protein, 7 aa, Entamoeba dispar
GQKEEEW

SEQ ID NO: 2428024 - protein, 8 aa, Entamoeba dispar
GQKEESQK

SEQ ID NO: 2428025 - protein, 11 aa, Entamoeba dispar
GQKEKMKGKKG

SEQ ID NO: 2428026 - protein, 7 aa, Entamoeba dispar
GQKGEEF

SEQ ID NO: 2428027 - protein, 7 aa, Entamoeba dispar
GQKGIKE

SEQ ID NO: 2428028 - protein, 5 aa, Entamoeba dispar
GQKGL

SEQ ID NO: 2428029 - protein, 8 aa, Entamoeba dispar
GQKHQNVT

SEQ ID NO: 2428030 - protein, 8 aa, Entamoeba dispar
GQKLEGQK

SEQ ID NO: 2428031 - protein, 9 aa, Entamoeba dispar
GQKLSPQAA

SEQ ID NO: 2428032 - protein, 23 aa, Entamoeba dispar
GQKPESRSVPQQLSERAMTATDI

SEQ ID NO: 2428033 - protein, 10 aa, Entamoeba dispar
GQKSEQIKKS

SEQ ID NO: 2428034 - protein, 10 aa, Entamoeba dispar
GQKSKVNGEL

SEQ ID NO: 2428035 - protein, 10 aa, Entamoeba dispar
GQKSNNNPTF

SEQ ID NO: 2428036 - protein, 8 aa, Entamoeba dispar
GQKTGEPI

SEQ ID NO: 2428037 - protein, 5 aa, Entamoeba dispar
GQKTL

SEQ ID NO: 2428038 - protein, 9 aa, Entamoeba dispar
GQLDQDKRT

SEQ ID NO: 2428039 - protein, 11 aa, Entamoeba dispar
GQLEKADEINN

SEQ ID NO: 2428040 - protein, 4 aa, Entamoeba dispar
GQLN

SEQ ID NO: 2428041 - protein, 12 aa, Entamoeba dispar
GQLNKYAGRIPK

SEQ ID NO: 2428042 - protein, 5 aa, Entamoeba dispar
GQLPN

SEQ ID NO: 2428043 - protein, 26 aa, Entamoeba dispar
GQLPPIEEAEKACEDANIEDNEYTDV

SEQ ID NO: 2428044 - protein, 22 aa, Entamoeba dispar
GQLQQQKEETFNSIKSEGEKVT

SEQ ID NO: 2428045 - protein, 7 aa, Entamoeba dispar
GQLRQKS

SEQ ID NO: 2428046 - protein, 7 aa, Entamoeba dispar
GQMKEYS

SEQ ID NO: 2428047 - protein, 4 aa, Entamoeba dispar
GQND

SEQ ID NO: 2428048 - protein, 12 aa, Entamoeba dispar
GQNDNLEDLERY

SEQ ID NO: 2428049 - protein, 6 aa, Entamoeba dispar
GQNEIN

SEQ ID NO: 2428050 - protein, 9 aa, Entamoeba dispar
GQNENSVKN

SEQ ID NO: 2428051 - protein, 5 aa, Entamoeba dispar
GQNKL

SEQ ID NO: 2428052 - protein, 8 aa, Entamoeba dispar
GQNNIQND

SEQ ID NO: 2428053 - protein, 10 aa, Entamoeba dispar
GQNPDRVEEF

SEQ ID NO: 2428054 - protein, 6 aa, Entamoeba dispar
GQNPPL

SEQ ID NO: 2428055 - protein, 5 aa, Entamoeba dispar
GQNPQ

SEQ ID NO: 2428056 - protein, 9 aa, Entamoeba dispar
GQNTSDISP

SEQ ID NO: 2428057 - protein, 11 aa, Entamoeba dispar
GQPAKKSTVTQ

SEQ ID NO: 2428058 - protein, 17 aa, Entamoeba dispar
GQPCKPDEHDRRVAAGP

SEQ ID NO: 2428059 - protein, 10 aa, Entamoeba dispar
GQPFSSEQEA

SEQ ID NO: 2428060 - protein, 8 aa, Entamoeba dispar
GQPHSEPA

SEQ ID NO: 2428061 - protein, 6 aa, Entamoeba dispar
GQPIYQ

SEQ ID NO: 2428062 - protein, 9 aa, Entamoeba dispar
GQPLGPQRI

SEQ ID NO: 2428063 - protein, 13 aa, Entamoeba dispar
GQPLGQPTGGKLK

SEQ ID NO: 2428064 - protein, 23 aa, Entamoeba dispar
GQPLGQPTGGKLKLTQQCKFRIK

SEQ ID NO: 2428065 - protein, 23 aa, Entamoeba dispar
GQPLGQPTGGKLKLTQQCKFRVK

SEQ ID NO: 2428066 - protein, 5 aa, Entamoeba dispar
GQPPD

SEQ ID NO: 2428067 - protein, 22 aa, Entamoeba dispar
GQPRYEDGKYTINGTDKQYENC

SEQ ID NO: 2428068 - protein, 7 aa, Entamoeba dispar
GQQADSV

SEQ ID NO: 2428069 - protein, 5 aa, Entamoeba dispar
GQQLP

SEQ ID NO: 2428070 - protein, 35 aa, Entamoeba dispar
GQQRVEVSPSHSIKSPRATPTDREEEPKRERRTPL

SEQ ID NO: 2428071 - protein, 11 aa, Entamoeba dispar
GQRGKNPEELK

SEQ ID NO: 2428072 - protein, 4 aa, Entamoeba dispar
GQRI

SEQ ID NO: 2428073 - protein, 7 aa, Entamoeba dispar
GQRKRQY

SEQ ID NO: 2428074 - protein, 6 aa, Entamoeba dispar
GQSAHQ

SEQ ID NO: 2428075 - protein, 11 aa, Entamoeba dispar
GQSAMERTNAL

SEQ ID NO: 2428076 - protein, 7 aa, Entamoeba dispar
GQSDGKE

SEQ ID NO: 2428077 - protein, 6 aa, Entamoeba dispar
GQSGIN

SEQ ID NO: 2428078 - protein, 6 aa, Entamoeba dispar
GQSNEI

SEQ ID NO: 2428079 - protein, 11 aa, Entamoeba dispar
GQSTIYRNTTS

SEQ ID NO: 2428080 - protein, 21 aa, Entamoeba dispar
GQTASQKPYVEEKERQDIKKN

SEQ ID NO: 2428081 - protein, 11 aa, Entamoeba dispar
GQTGSGKTFTT

SEQ ID NO: 2428082 - protein, 9 aa, Entamoeba dispar
GQTGSGKTY

SEQ ID NO: 2428083 - protein, 20 aa, Entamoeba dispar
GQTGTGKTYTMEGEEENEGV

SEQ ID NO: 2428084 - protein, 8 aa, Entamoeba dispar
GQTISKKN

SEQ ID NO: 2428085 - protein, 5 aa, Entamoeba dispar
GQTKE

SEQ ID NO: 2428086 - protein, 6 aa, Entamoeba dispar
GQTKEV

SEQ ID NO: 2428087 - protein, 6 aa, Entamoeba dispar
GQTLNG

SEQ ID NO: 2428088 - protein, 4 aa, Entamoeba dispar
GQTN

SEQ ID NO: 2428089 - protein, 35 aa, Entamoeba dispar
GQTNNNRVPSESQPIPQQPNHAPSQPQLSPEDNAA

SEQ ID NO: 2428090 - protein, 9 aa, Entamoeba dispar
GQTPEVNET

SEQ ID NO: 2428091 - protein, 6 aa, Entamoeba dispar
GQTPKI

SEQ ID NO: 2428092 - protein, 14 aa, Entamoeba dispar
GQTPKILSSLQSKD

SEQ ID NO: 2428093 - protein, 18 aa, Entamoeba dispar
GQTPLTTTMYSDDDSSIV

SEQ ID NO: 2428094 - protein, 5 aa, Entamoeba dispar
GQTQL

SEQ ID NO: 2428095 - protein, 9 aa, Entamoeba dispar
GQTQSALED

SEQ ID NO: 2428096 - protein, 5 aa, Entamoeba dispar
GQTRL

SEQ ID NO: 2428097 - protein, 11 aa, Entamoeba dispar
GQTSGAAFTQT

SEQ ID NO: 2428098 - protein, 7 aa, Entamoeba dispar
GQTSHHK

SEQ ID NO: 2428099 - protein, 11 aa, Entamoeba dispar
GQTSPDDESIQ

SEQ ID NO: 2428100 - protein, 7 aa, Entamoeba dispar
GQTTGNG

SEQ ID NO: 2428101 - protein, 6 aa, Entamoeba dispar
GQTTNK

SEQ ID NO: 2428102 - protein, 6 aa, Entamoeba dispar
GQTVPV

SEQ ID NO: 2428103 - protein, 19 aa, Entamoeba dispar
GQVDNEKATKAAIEQASNY

SEQ ID NO: 2428104 - protein, 8 aa, Entamoeba dispar
GQVEEKDR

SEQ ID NO: 2428105 - protein, 4 aa, Entamoeba dispar
GQVI

SEQ ID NO: 2428106 - protein, 5 aa, Entamoeba dispar
GQVIS

SEQ ID NO: 2428107 - protein, 4 aa, Entamoeba dispar
GQYD

SEQ ID NO: 2428108 - protein, 5 aa, Entamoeba dispar
GQYDT

SEQ ID NO: 2428109 - protein, 9 aa, Entamoeba dispar
GQYEPKEEE

SEQ ID NO: 2428110 - protein, 6 aa, Entamoeba dispar
GQYESF

SEQ ID NO: 2428111 - protein, 13 aa, Entamoeba dispar
GQYTASNKADGLV

SEQ ID NO: 2428112 - protein, 13 aa, Entamoeba dispar
GQYTGTEKASVSC

SEQ ID NO: 2428113 - protein, 13 aa, Entamoeba dispar
GRAGRRGKDEQGT

SEQ ID NO: 2428114 - protein, 12 aa, Entamoeba dispar
GRAGRTSQARRN

SEQ ID NO: 2428115 - protein, 5 aa, Entamoeba dispar
GRAGV

SEQ ID NO: 2428116 - protein, 7 aa, Entamoeba dispar
GRANKEC

SEQ ID NO: 2428117 - protein, 5 aa, Entamoeba dispar
GRAPT

SEQ ID NO: 2428118 - protein, 13 aa, Entamoeba dispar
GRDEEIKRVIRIL

SEQ ID NO: 2428119 - protein, 11 aa, Entamoeba dispar
GRDEKDALSTS

SEQ ID NO: 2428120 - protein, 24 aa, Entamoeba dispar
GRDSTPFCSRNERKYSPPRSTSRH

SEQ ID NO: 2428121 - protein, 9 aa, Entamoeba dispar
GRDYQEKVR

SEQ ID NO: 2428122 - protein, 5 aa, Entamoeba dispar
GREDV

SEQ ID NO: 2428123 - protein, 16 aa, Entamoeba dispar
GREECGSSGTSYNNEG

SEQ ID NO: 2428124 - protein, 15 aa, Entamoeba dispar
GREEEQDKVIETESN

SEQ ID NO: 2428125 - protein, 6 aa, Entamoeba dispar
GREEQT

SEQ ID NO: 2428126 - protein, 6 aa, Entamoeba dispar
GREGLV

SEQ ID NO: 2428127 - protein, 6 aa, Entamoeba dispar
GRENEA

SEQ ID NO: 2428128 - protein, 5 aa, Entamoeba dispar
GRENN

SEQ ID NO: 2428129 - protein, 9 aa, Entamoeba dispar
GREQKVRAE

SEQ ID NO: 2428130 - protein, 10 aa, Entamoeba dispar
GRESGTPFAN

SEQ ID NO: 2428131 - protein, 7 aa, Entamoeba dispar
GRESKLS

SEQ ID NO: 2428132 - protein, 5 aa, Entamoeba dispar
GRETE

SEQ ID NO: 2428133 - protein, 9 aa, Entamoeba dispar
GREYDRRTH

SEQ ID NO: 2428134 - protein, 9 aa, Entamoeba dispar
GRFGKYEED

SEQ ID NO: 2428135 - protein, 10 aa, Entamoeba dispar
GRFTEYPPGV

SEQ ID NO: 2428136 - protein, 4 aa, Entamoeba dispar
GRGA

SEQ ID NO: 2428137 - protein, 13 aa, Entamoeba dispar
GRGANTALRATQT

SEQ ID NO: 2428138 - protein, 6 aa, Entamoeba dispar
GRGDEV

SEQ ID NO: 2428139 - protein, 11 aa, Entamoeba dispar
GRGDFPNQVNN

SEQ ID NO: 2428140 - protein, 15 aa, Entamoeba dispar
GRGHSAAIHSNDKAV

SEQ ID NO: 2428141 - protein, 9 aa, Entamoeba dispar
GRGITEKGT

SEQ ID NO: 2428142 - protein, 7 aa, Entamoeba dispar
GRGKNEL

SEQ ID NO: 2428143 - protein, 6 aa, Entamoeba dispar
GRGKYS

SEQ ID NO: 2428144 - protein, 5 aa, Entamoeba dispar
GRGQF

SEQ ID NO: 2428145 - protein, 7 aa, Entamoeba dispar
GRGRDSE

SEQ ID NO: 2428146 - protein, 19 aa, Entamoeba dispar
GRGRPSFGGRDQQPSGELV

SEQ ID NO: 2428147 - protein, 8 aa, Entamoeba dispar
GRGRTGTV

SEQ ID NO: 2428148 - protein, 6 aa, Entamoeba dispar
GRGRYS

SEQ ID NO: 2428149 - protein, 6 aa, Entamoeba dispar
GRGTGI

SEQ ID NO: 2428150 - protein, 9 aa, Entamoeba dispar
GRGTSTHDG

SEQ ID NO: 2428151 - protein, 9 aa, Entamoeba dispar
GRHEEENNY

SEQ ID NO: 2428152 - protein, 4 aa, Entamoeba dispar
GRIG

SEQ ID NO: 2428153 - protein, 9 aa, Entamoeba dispar
GRINNSNEY

SEQ ID NO: 2428154 - protein, 9 aa, Entamoeba dispar
GRINSNNEY

SEQ ID NO: 2428155 - protein, 8 aa, Entamoeba dispar
GRINSSNE

SEQ ID NO: 2428156 - protein, 10 aa, Entamoeba dispar
GRIPITPQST

SEQ ID NO: 2428157 - protein, 6 aa, Entamoeba dispar
GRIPTT

SEQ ID NO: 2428158 - protein, 19 aa, Entamoeba dispar
GRKAKYSNDEEYKEAIEKE

SEQ ID NO: 2428159 - protein, 11 aa, Entamoeba dispar
GRKESLKGITP

SEQ ID NO: 2428160 - protein, 5 aa, Entamoeba dispar
GRKFD

SEQ ID NO: 2428161 - protein, 17 aa, Entamoeba dispar
GRKFEGSKYLKSIEENT

SEQ ID NO: 2428162 - protein, 5 aa, Entamoeba dispar
GRKGE

SEQ ID NO: 2428163 - protein, 8 aa, Entamoeba dispar
GRKGSPWE

SEQ ID NO: 2428164 - protein, 4 aa, Entamoeba dispar
GRKH

SEQ ID NO: 2428165 - protein, 7 aa, Entamoeba dispar
GRKLRKE

SEQ ID NO: 2428166 - protein, 11 aa, Entamoeba dispar
GRKMKEDQEKI

SEQ ID NO: 2428167 - protein, 15 aa, Entamoeba dispar
GRKRKRSNEDEINEQ

SEQ ID NO: 2428168 - protein, 5 aa, Entamoeba dispar
GRLAE

SEQ ID NO: 2428169 - protein, 15 aa, Entamoeba dispar
GRLGPAELDKPDLGN

SEQ ID NO: 2428170 - protein, 19 aa, Entamoeba dispar
GRLQQQQFDEQKKKYGKGN

SEQ ID NO: 2428171 - protein, 11 aa, Entamoeba dispar
GRNAPTACDEQ

SEQ ID NO: 2428172 - protein, 9 aa, Entamoeba dispar
GRNDKGEID

SEQ ID NO: 2428173 - protein, 20 aa, Entamoeba dispar
GRNEIKGERTREYKEEAEKL

SEQ ID NO: 2428174 - protein, 12 aa, Entamoeba dispar
GRNENNSLKNKI

SEQ ID NO: 2428175 - protein, 5 aa, Entamoeba dispar
GRNEP

SEQ ID NO: 2428176 - protein, 7 aa, Entamoeba dispar
GRNKEGQ

SEQ ID NO: 2428177 - protein, 7 aa, Entamoeba dispar
GRNMTNQ

SEQ ID NO: 2428178 - protein, 7 aa, Entamoeba dispar
GRNNTTM

SEQ ID NO: 2428179 - protein, 7 aa, Entamoeba dispar
GRNYDEA

SEQ ID NO: 2428180 - protein, 7 aa, Entamoeba dispar
GRPAANA

SEQ ID NO: 2428181 - protein, 6 aa, Entamoeba dispar
GRPDSI

SEQ ID NO: 2428182 - protein, 5 aa, Entamoeba dispar
GRPIE

SEQ ID NO: 2428183 - protein, 4 aa, Entamoeba dispar
GRPL

SEQ ID NO: 2428184 - protein, 6 aa, Entamoeba dispar
GRPLKG

SEQ ID NO: 2428185 - protein, 5 aa, Entamoeba dispar
GRPLN

SEQ ID NO: 2428186 - protein, 7 aa, Entamoeba dispar
GRPPHSE

SEQ ID NO: 2428187 - protein, 12 aa, Entamoeba dispar
GRPSINQLNTNT

SEQ ID NO: 2428188 - protein, 6 aa, Entamoeba dispar
GRPTQR

SEQ ID NO: 2428189 - protein, 7 aa, Entamoeba dispar
GRPYNYG

SEQ ID NO: 2428190 - protein, 6 aa, Entamoeba dispar
GRPYPT

SEQ ID NO: 2428191 - protein, 6 aa, Entamoeba dispar
GRQAQS

SEQ ID NO: 2428192 - protein, 4 aa, Entamoeba dispar
GRQE

SEQ ID NO: 2428193 - protein, 11 aa, Entamoeba dispar
GRQETISERQL

SEQ ID NO: 2428194 - protein, 5 aa, Entamoeba dispar
GRQGD

SEQ ID NO: 2428195 - protein, 4 aa, Entamoeba dispar
GRQI

SEQ ID NO: 2428196 - protein, 7 aa, Entamoeba dispar
GRQKKTL

SEQ ID NO: 2428197 - protein, 10 aa, Entamoeba dispar
GRQTSINQGT

SEQ ID NO: 2428198 - protein, 8 aa, Entamoeba dispar
GRRAAETA

SEQ ID NO: 2428199 - protein, 4 aa, Entamoeba dispar
GRRC

SEQ ID NO: 2428200 - protein, 7 aa, Entamoeba dispar
GRRGKME

SEQ ID NO: 2428201 - protein, 6 aa, Entamoeba dispar
GRRGSL

SEQ ID NO: 2428202 - protein, 4 aa, Entamoeba dispar
GRRN

SEQ ID NO: 2428203 - protein, 8 aa, Entamoeba dispar
GRRPIGNG

SEQ ID NO: 2428204 - protein, 8 aa, Entamoeba dispar
GRRPSMQD

SEQ ID NO: 2428205 - protein, 14 aa, Entamoeba dispar
GRSADELKEFVDSI

SEQ ID NO: 2428206 - protein, 7 aa, Entamoeba dispar
GRSEHDI

SEQ ID NO: 2428207 - protein, 4 aa, Entamoeba dispar
GRSI

SEQ ID NO: 2428208 - protein, 17 aa, Entamoeba dispar
GRSKYTGKDYNRADRTC

SEQ ID NO: 2428209 - protein, 6 aa, Entamoeba dispar
GRSNRK

SEQ ID NO: 2428210 - protein, 8 aa, Entamoeba dispar
GRSPNDVK

SEQ ID NO: 2428211 - protein, 6 aa, Entamoeba dispar
GRSQLK

SEQ ID NO: 2428212 - protein, 7 aa, Entamoeba dispar
GRSRSGT

SEQ ID NO: 2428213 - protein, 9 aa, Entamoeba dispar
GRSSNKNEL

SEQ ID NO: 2428214 - protein, 8 aa, Entamoeba dispar
GRSSSFSK

SEQ ID NO: 2428215 - protein, 11 aa, Entamoeba dispar
GRTAVEETLKN

SEQ ID NO: 2428216 - protein, 8 aa, Entamoeba dispar
GRTDNQNI

SEQ ID NO: 2428217 - protein, 6 aa, Entamoeba dispar
GRTEET

SEQ ID NO: 2428218 - protein, 10 aa, Entamoeba dispar
GRTEQDEIKP

SEQ ID NO: 2428219 - protein, 4 aa, Entamoeba dispar
GRTF

SEQ ID NO: 2428220 - protein, 12 aa, Entamoeba dispar
GRTGRAGKRGKA

SEQ ID NO: 2428221 - protein, 5 aa, Entamoeba dispar
GRTGY

SEQ ID NO: 2428222 - protein, 8 aa, Entamoeba dispar
GRTIEDKK

SEQ ID NO: 2428223 - protein, 12 aa, Entamoeba dispar
GRTNSKKSNDVE

SEQ ID NO: 2428224 - protein, 5 aa, Entamoeba dispar
GRTPL

SEQ ID NO: 2428225 - protein, 12 aa, Entamoeba dispar
GRTRDQRYTKSA

SEQ ID NO: 2428226 - protein, 7 aa, Entamoeba dispar
GRTSTHF

SEQ ID NO: 2428227 - protein, 4 aa, Entamoeba dispar
GRVE

SEQ ID NO: 2428228 - protein, 9 aa, Entamoeba dispar
GRVKGKTNE

SEQ ID NO: 2428229 - protein, 4 aa, Entamoeba dispar
GRVP

SEQ ID NO: 2428230 - protein, 6 aa, Entamoeba dispar
GRVPET

SEQ ID NO: 2428231 - protein, 8 aa, Entamoeba dispar
GRVSNNSF

SEQ ID NO: 2428232 - protein, 4 aa, Entamoeba dispar
GRYE

SEQ ID NO: 2428233 - protein, 5 aa, Entamoeba dispar
GRYHS

SEQ ID NO: 2428234 - protein, 15 aa, Entamoeba dispar
GRYQSSSDSSTKQTI

SEQ ID NO: 2428235 - protein, 12 aa, Entamoeba dispar
GRYSEPEIQRSP

SEQ ID NO: 2428236 - protein, 19 aa, Entamoeba dispar
GRYTTSKSIEGDTYGYRGE

SEQ ID NO: 2428237 - protein, 32 aa, Entamoeba dispar
GSAATKTLSQTTDSNSTINSIDSDSSVTSNVS

SEQ ID NO: 2428238 - protein, 10 aa, Entamoeba dispar
GSADKSAKLW

SEQ ID NO: 2428239 - protein, 7 aa, Entamoeba dispar
GSADKSI

SEQ ID NO: 2428240 - protein, 7 aa, Entamoeba dispar
GSADKTI

SEQ ID NO: 2428241 - protein, 6 aa, Entamoeba dispar
GSADRT

SEQ ID NO: 2428242 - protein, 4 aa, Entamoeba dispar
GSAE

SEQ ID NO: 2428243 - protein, 7 aa, Entamoeba dispar
GSAEKDV

SEQ ID NO: 2428244 - protein, 8 aa, Entamoeba dispar
GSAEKKGC

SEQ ID NO: 2428245 - protein, 4 aa, Entamoeba dispar
GSAH

SEQ ID NO: 2428246 - protein, 6 aa, Entamoeba dispar
GSAISE

SEQ ID NO: 2428247 - protein, 11 aa, Entamoeba dispar
GSALTSGTYID

SEQ ID NO: 2428248 - protein, 6 aa, Entamoeba dispar
GSANKL

SEQ ID NO: 2428249 - protein, 15 aa, Entamoeba dispar
GSANTGDLKNIQQGE

SEQ ID NO: 2428250 - protein, 7 aa, Entamoeba dispar
GSANVNN

SEQ ID NO: 2428251 - protein, 8 aa, Entamoeba dispar
GSAPPRLR

SEQ ID NO: 2428252 - protein, 10 aa, Entamoeba dispar
GSAPTGSGKT

SEQ ID NO: 2428253 - protein, 45 aa, Entamoeba dispar
GSAPVAAAPAAGAAPTAENEATEEKKEDKKEEEEAEEDFGGFGDL

SEQ ID NO: 2428254 - protein, 19 aa, Entamoeba dispar
GSAQQPNQSTNTQKPMYNP

SEQ ID NO: 2428255 - protein, 4 aa, Entamoeba dispar
GSAT

SEQ ID NO: 2428256 - protein, 81 aa, Entamoeba dispar
GSATGFGQTNQQQNGFGGFGNTTGFGQTSNTQTSGFGGFGQNNQQGGGFSSFGQNNNQQLGFGNTTGFGQTNSLTGSGTFG

SEQ ID NO: 2428257 - protein, 20 aa, Entamoeba dispar
GSATSFEGPYYSANPDTVSR

SEQ ID NO: 2428258 - protein, 8 aa, Entamoeba dispar
GSATYTTS

SEQ ID NO: 2428259 - protein, 6 aa, Entamoeba dispar
GSCDPE

SEQ ID NO: 2428260 - protein, 5 aa, Entamoeba dispar
GSCEE

SEQ ID NO: 2428261 - protein, 15 aa, Entamoeba dispar
GSCGPRAFYGTTTEH

SEQ ID NO: 2428262 - protein, 12 aa, Entamoeba dispar
GSCRGNASISDN

SEQ ID NO: 2428263 - protein, 4 aa, Entamoeba dispar
GSCS

SEQ ID NO: 2428264 - protein, 4 aa, Entamoeba dispar
GSCY

SEQ ID NO: 2428265 - protein, 11 aa, Entamoeba dispar
GSCYRANETRQ

SEQ ID NO: 2428266 - protein, 10 aa, Entamoeba dispar
GSDAQGISKT

SEQ ID NO: 2428267 - protein, 15 aa, Entamoeba dispar
GSDDEVSCSPPSNFK

SEQ ID NO: 2428268 - protein, 17 aa, Entamoeba dispar
GSDEHQNDNLKDSGFGE

SEQ ID NO: 2428269 - protein, 8 aa, Entamoeba dispar
GSDEKDKV

SEQ ID NO: 2428270 - protein, 5 aa, Entamoeba dispar
GSDEP

SEQ ID NO: 2428271 - protein, 7 aa, Entamoeba dispar
GSDESFP

SEQ ID NO: 2428272 - protein, 10 aa, Entamoeba dispar
GSDESYSLSI

SEQ ID NO: 2428273 - protein, 9 aa, Entamoeba dispar
GSDEVYDTE

SEQ ID NO: 2428274 - protein, 27 aa, Entamoeba dispar
GSDINQIQQQPKEEINIKPSENTEKYD

SEQ ID NO: 2428275 - protein, 12 aa, Entamoeba dispar
GSDKSTGTINER

SEQ ID NO: 2428276 - protein, 7 aa, Entamoeba dispar
GSDNKKY

SEQ ID NO: 2428277 - protein, 6 aa, Entamoeba dispar
GSDQGT

SEQ ID NO: 2428278 - protein, 5 aa, Entamoeba dispar
GSDRG

SEQ ID NO: 2428279 - protein, 17 aa, Entamoeba dispar
GSDSRTQKKAKKQRRYK

SEQ ID NO: 2428280 - protein, 4 aa, Entamoeba dispar
GSDV

SEQ ID NO: 2428281 - protein, 6 aa, Entamoeba dispar
GSEAIE

SEQ ID NO: 2428282 - protein, 5 aa, Entamoeba dispar
GSEAK

SEQ ID NO: 2428283 - protein, 10 aa, Entamoeba dispar
GSECKGDEGL

SEQ ID NO: 2428284 - protein, 4 aa, Entamoeba dispar
GSED

SEQ ID NO: 2428285 - protein, 5 aa, Entamoeba dispar
GSEDF

SEQ ID NO: 2428286 - protein, 20 aa, Entamoeba dispar
GSEDTNPSKSNNSKHQINDE

SEQ ID NO: 2428287 - protein, 9 aa, Entamoeba dispar
GSEDTTPIT

SEQ ID NO: 2428288 - protein, 5 aa, Entamoeba dispar
GSEDV

SEQ ID NO: 2428289 - protein, 21 aa, Entamoeba dispar
GSEEIGETLNEDTQLKPKSIE

SEQ ID NO: 2428290 - protein, 6 aa, Entamoeba dispar
GSEETI

SEQ ID NO: 2428291 - protein, 4 aa, Entamoeba dispar
GSEF

SEQ ID NO: 2428292 - protein, 5 aa, Entamoeba dispar
GSEGE

SEQ ID NO: 2428293 - protein, 5 aa, Entamoeba dispar
GSEIK

SEQ ID NO: 2428294 - protein, 11 aa, Entamoeba dispar
GSEKEISITQP

SEQ ID NO: 2428295 - protein, 8 aa, Entamoeba dispar
GSEKSNLA

SEQ ID NO: 2428296 - protein, 6 aa, Entamoeba dispar
GSEMAN

SEQ ID NO: 2428297 - protein, 8 aa, Entamoeba dispar
GSENGTIN

SEQ ID NO: 2428298 - protein, 4 aa, Entamoeba dispar
GSEP

SEQ ID NO: 2428299 - protein, 5 aa, Entamoeba dispar
GSEPL

SEQ ID NO: 2428300 - protein, 19 aa, Entamoeba dispar
GSEPTTQETIGYNGRYDKS

SEQ ID NO: 2428301 - protein, 9 aa, Entamoeba dispar
GSERAPQIN

SEQ ID NO: 2428302 - protein, 9 aa, Entamoeba dispar
GSERIERSV

SEQ ID NO: 2428303 - protein, 14 aa, Entamoeba dispar
GSERQSNTGAKGKL

SEQ ID NO: 2428304 - protein, 9 aa, Entamoeba dispar
GSESDEITV

SEQ ID NO: 2428305 - protein, 6 aa, Entamoeba dispar
GSETDF

SEQ ID NO: 2428306 - protein, 7 aa, Entamoeba dispar
GSEVSKK

SEQ ID NO: 2428307 - protein, 6 aa, Entamoeba dispar
GSFEER

SEQ ID NO: 2428308 - protein, 5 aa, Entamoeba dispar
GSFGH

SEQ ID NO: 2428309 - protein, 5 aa, Entamoeba dispar
GSFGQ

SEQ ID NO: 2428310 - protein, 17 aa, Entamoeba dispar
GSFGRTTKKQSDTSTEV

SEQ ID NO: 2428311 - protein, 7 aa, Entamoeba dispar
GSFHGNL

SEQ ID NO: 2428312 - protein, 13 aa, Entamoeba dispar
GSFKPDEKSTIGA

SEQ ID NO: 2428313 - protein, 13 aa, Entamoeba dispar
GSFKQEMKSGEES

SEQ ID NO: 2428314 - protein, 5 aa, Entamoeba dispar
GSFLR

SEQ ID NO: 2428315 - protein, 5 aa, Entamoeba dispar
GSFPN

SEQ ID NO: 2428316 - protein, 4 aa, Entamoeba dispar
GSFR

SEQ ID NO: 2428317 - protein, 9 aa, Entamoeba dispar
GSFTEADAS

SEQ ID NO: 2428318 - protein, 6 aa, Entamoeba dispar
GSFYGS

SEQ ID NO: 2428319 - protein, 7 aa, Entamoeba dispar
GSGASGI

SEQ ID NO: 2428320 - protein, 9 aa, Entamoeba dispar
GSGDGVEDY

SEQ ID NO: 2428321 - protein, 14 aa, Entamoeba dispar
GSGEKMTAEERRTK

SEQ ID NO: 2428322 - protein, 6 aa, Entamoeba dispar
GSGEQF

SEQ ID NO: 2428323 - protein, 13 aa, Entamoeba dispar
GSGEQKYVTRTRR

SEQ ID NO: 2428324 - protein, 8 aa, Entamoeba dispar
GSGFDNKN

SEQ ID NO: 2428325 - protein, 11 aa, Entamoeba dispar
GSGFGQKDNTY

SEQ ID NO: 2428326 - protein, 10 aa, Entamoeba dispar
GSGFGQRKGT

SEQ ID NO: 2428327 - protein, 10 aa, Entamoeba dispar
GSGFSDSTIK

SEQ ID NO: 2428328 - protein, 4 aa, Entamoeba dispar
GSGG

SEQ ID NO: 2428329 - protein, 9 aa, Entamoeba dispar
GSGGTKKYN

SEQ ID NO: 2428330 - protein, 4 aa, Entamoeba dispar
GSGI

SEQ ID NO: 2428331 - protein, 5 aa, Entamoeba dispar
GSGIE

SEQ ID NO: 2428332 - protein, 6 aa, Entamoeba dispar
GSGKTT

SEQ ID NO: 2428333 - protein, 11 aa, Entamoeba dispar
GSGKYTNSPGV

SEQ ID NO: 2428334 - protein, 9 aa, Entamoeba dispar
GSGNCYSSM

SEQ ID NO: 2428335 - protein, 5 aa, Entamoeba dispar
GSGNF

SEQ ID NO: 2428336 - protein, 8 aa, Entamoeba dispar
GSGNGKYH

SEQ ID NO: 2428337 - protein, 6 aa, Entamoeba dispar
GSGNIP

SEQ ID NO: 2428338 - protein, 14 aa, Entamoeba dispar
GSGQIYATGSEDRT

SEQ ID NO: 2428339 - protein, 7 aa, Entamoeba dispar
GSGQNGH

SEQ ID NO: 2428340 - protein, 10 aa, Entamoeba dispar
GSGQSNPSRV

SEQ ID NO: 2428341 - protein, 13 aa, Entamoeba dispar
GSGRTKIETEEQF

SEQ ID NO: 2428342 - protein, 10 aa, Entamoeba dispar
GSGSEEVYND

SEQ ID NO: 2428343 - protein, 7 aa, Entamoeba dispar
GSGSPYA

SEQ ID NO: 2428344 - protein, 13 aa, Entamoeba dispar
GSGSVTKEIQDPN

SEQ ID NO: 2428345 - protein, 5 aa, Entamoeba dispar
GSGTF

SEQ ID NO: 2428346 - protein, 15 aa, Entamoeba dispar
GSGTYIGTGANDNSV

SEQ ID NO: 2428347 - protein, 7 aa, Entamoeba dispar
GSGTYST

SEQ ID NO: 2428348 - protein, 8 aa, Entamoeba dispar
GSGVGKTT

SEQ ID NO: 2428349 - protein, 6 aa, Entamoeba dispar
GSGYDN

SEQ ID NO: 2428350 - protein, 13 aa, Entamoeba dispar
GSGYSGETIEENG

SEQ ID NO: 2428351 - protein, 7 aa, Entamoeba dispar
GSHKTQS

SEQ ID NO: 2428352 - protein, 16 aa, Entamoeba dispar
GSHPTKGEGKLNPLTS

SEQ ID NO: 2428353 - protein, 12 aa, Entamoeba dispar
GSIEERKEYGKS

SEQ ID NO: 2428354 - protein, 11 aa, Entamoeba dispar
GSIESNEEDFE

SEQ ID NO: 2428355 - protein, 23 aa, Entamoeba dispar
GSIEVNESSSLESSSLDEEEEEE

SEQ ID NO: 2428356 - protein, 7 aa, Entamoeba dispar
GSIGKDS

SEQ ID NO: 2428357 - protein, 6 aa, Entamoeba dispar
GSIKKY

SEQ ID NO: 2428358 - protein, 11 aa, Entamoeba dispar
GSIKSEDRQNA

SEQ ID NO: 2428359 - protein, 10 aa, Entamoeba dispar
GSIKYTSSQG

SEQ ID NO: 2428360 - protein, 12 aa, Entamoeba dispar
GSINQKEIKPIK

SEQ ID NO: 2428361 - protein, 6 aa, Entamoeba dispar
GSIRED

SEQ ID NO: 2428362 - protein, 4 aa, Entamoeba dispar
GSIS

SEQ ID NO: 2428363 - protein, 7 aa, Entamoeba dispar
GSISDNS

SEQ ID NO: 2428364 - protein, 10 aa, Entamoeba dispar
GSITDKPEEI

SEQ ID NO: 2428365 - protein, 9 aa, Entamoeba dispar
GSITSSITN

SEQ ID NO: 2428366 - protein, 6 aa, Entamoeba dispar
GSKAEF

SEQ ID NO: 2428367 - protein, 10 aa, Entamoeba dispar
GSKANDDEWM

SEQ ID NO: 2428368 - protein, 8 aa, Entamoeba dispar
GSKDINRN

SEQ ID NO: 2428369 - protein, 7 aa, Entamoeba dispar
GSKDVLN

SEQ ID NO: 2428370 - protein, 9 aa, Entamoeba dispar
GSKECTGNG

SEQ ID NO: 2428371 - protein, 11 aa, Entamoeba dispar
GSKEFGTEGES

SEQ ID NO: 2428372 - protein, 8 aa, Entamoeba dispar
GSKELEVD

SEQ ID NO: 2428373 - protein, 12 aa, Entamoeba dispar
GSKESSLTQIPT

SEQ ID NO: 2428374 - protein, 9 aa, Entamoeba dispar
GSKGKEMKE

SEQ ID NO: 2428375 - protein, 10 aa, Entamoeba dispar
GSKGSQFTNN

SEQ ID NO: 2428376 - protein, 13 aa, Entamoeba dispar
GSKIEPDQEKVKE

SEQ ID NO: 2428377 - protein, 5 aa, Entamoeba dispar
GSKKI

SEQ ID NO: 2428378 - protein, 9 aa, Entamoeba dispar
GSKKSYSTI

SEQ ID NO: 2428379 - protein, 11 aa, Entamoeba dispar
GSKKTAEKWKE

SEQ ID NO: 2428380 - protein, 18 aa, Entamoeba dispar
GSKKVTKKDVHETKKTKK

SEQ ID NO: 2428381 - protein, 5 aa, Entamoeba dispar
GSKKY

SEQ ID NO: 2428382 - protein, 6 aa, Entamoeba dispar
GSKLDQ

SEQ ID NO: 2428383 - protein, 7 aa, Entamoeba dispar
GSKPEEF

SEQ ID NO: 2428384 - protein, 7 aa, Entamoeba dispar
GSKREEE

SEQ ID NO: 2428385 - protein, 9 aa, Entamoeba dispar
GSKSHENAP

SEQ ID NO: 2428386 - protein, 8 aa, Entamoeba dispar
GSKSYTAV

SEQ ID NO: 2428387 - protein, 12 aa, Entamoeba dispar
GSKTMESESRKN

SEQ ID NO: 2428388 - protein, 7 aa, Entamoeba dispar
GSKTNNY

SEQ ID NO: 2428389 - protein, 7 aa, Entamoeba dispar
GSKTQNK

SEQ ID NO: 2428390 - protein, 4 aa, Entamoeba dispar
GSLG

SEQ ID NO: 2428391 - protein, 7 aa, Entamoeba dispar
GSLGGGH

SEQ ID NO: 2428392 - protein, 7 aa, Entamoeba dispar
GSLGHRA

SEQ ID NO: 2428393 - protein, 15 aa, Entamoeba dispar
GSLHKEREDIKKDTR

SEQ ID NO: 2428394 - protein, 11 aa, Entamoeba dispar
GSLKPTPKSSK

SEQ ID NO: 2428395 - protein, 21 aa, Entamoeba dispar
GSLLSQTRNRLDKGKDIDPSE

SEQ ID NO: 2428396 - protein, 8 aa, Entamoeba dispar
GSLNDRDI

SEQ ID NO: 2428397 - protein, 6 aa, Entamoeba dispar
GSLPEN

SEQ ID NO: 2428398 - protein, 9 aa, Entamoeba dispar
GSLPHQGSL

SEQ ID NO: 2428399 - protein, 12 aa, Entamoeba dispar
GSLQKSKDGEVE

SEQ ID NO: 2428400 - protein, 9 aa, Entamoeba dispar
GSLREDTGF

SEQ ID NO: 2428401 - protein, 4 aa, Entamoeba dispar
GSLS

SEQ ID NO: 2428402 - protein, 6 aa, Entamoeba dispar
GSLSDR

SEQ ID NO: 2428403 - protein, 6 aa, Entamoeba dispar
GSLSTG

SEQ ID NO: 2428404 - protein, 8 aa, Entamoeba dispar
GSLTESEA

SEQ ID NO: 2428405 - protein, 8 aa, Entamoeba dispar
GSLTKRSK

SEQ ID NO: 2428406 - protein, 5 aa, Entamoeba dispar
GSMDC

SEQ ID NO: 2428407 - protein, 6 aa, Entamoeba dispar
GSMEGN

SEQ ID NO: 2428408 - protein, 6 aa, Entamoeba dispar
GSMGET

SEQ ID NO: 2428409 - protein, 13 aa, Entamoeba dispar
GSMNQIEESSGDI

SEQ ID NO: 2428410 - protein, 18 aa, Entamoeba dispar
GSMPPTPLPQTPALQTPG

SEQ ID NO: 2428411 - protein, 19 aa, Entamoeba dispar
GSMYGRKANEKERSKKSPC

SEQ ID NO: 2428412 - protein, 4 aa, Entamoeba dispar
GSNA

SEQ ID NO: 2428413 - protein, 10 aa, Entamoeba dispar
GSNAKSDINT

SEQ ID NO: 2428414 - protein, 8 aa, Entamoeba dispar
GSNGKEYQ

SEQ ID NO: 2428415 - protein, 5 aa, Entamoeba dispar
GSNHL

SEQ ID NO: 2428416 - protein, 6 aa, Entamoeba dispar
GSNIGE

SEQ ID NO: 2428417 - protein, 7 aa, Entamoeba dispar
GSNKMEY

SEQ ID NO: 2428418 - protein, 8 aa, Entamoeba dispar
GSNKQNVA

SEQ ID NO: 2428419 - protein, 7 aa, Entamoeba dispar
GSNKYQA

SEQ ID NO: 2428420 - protein, 4 aa, Entamoeba dispar
GSNL

SEQ ID NO: 2428421 - protein, 5 aa, Entamoeba dispar
GSNLM

SEQ ID NO: 2428422 - protein, 5 aa, Entamoeba dispar
GSNMA

SEQ ID NO: 2428423 - protein, 6 aa, Entamoeba dispar
GSNPPM

SEQ ID NO: 2428424 - protein, 17 aa, Entamoeba dispar
GSNRDTVGVYNEKSKDH

SEQ ID NO: 2428425 - protein, 9 aa, Entamoeba dispar
GSNSEFGKW

SEQ ID NO: 2428426 - protein, 6 aa, Entamoeba dispar
GSNSIE

SEQ ID NO: 2428427 - protein, 5 aa, Entamoeba dispar
GSNSS

SEQ ID NO: 2428428 - protein, 5 aa, Entamoeba dispar
GSNTQ

SEQ ID NO: 2428429 - protein, 7 aa, Entamoeba dispar
GSNVDLG

SEQ ID NO: 2428430 - protein, 6 aa, Entamoeba dispar
GSNVPN

SEQ ID NO: 2428431 - protein, 4 aa, Entamoeba dispar
GSNY

SEQ ID NO: 2428432 - protein, 6 aa, Entamoeba dispar
GSNYET

SEQ ID NO: 2428433 - protein, 9 aa, Entamoeba dispar
GSPAEPPTC

SEQ ID NO: 2428434 - protein, 9 aa, Entamoeba dispar
GSPARPIRK

SEQ ID NO: 2428435 - protein, 9 aa, Entamoeba dispar
GSPDSGKTA

SEQ ID NO: 2428436 - protein, 6 aa, Entamoeba dispar
GSPEDN

SEQ ID NO: 2428437 - protein, 7 aa, Entamoeba dispar
GSPEEQI

SEQ ID NO: 2428438 - protein, 5 aa, Entamoeba dispar
GSPEI

SEQ ID NO: 2428439 - protein, 6 aa, Entamoeba dispar
GSPFTP

SEQ ID NO: 2428440 - protein, 8 aa, Entamoeba dispar
GSPGVGKT

SEQ ID NO: 2428441 - protein, 4 aa, Entamoeba dispar
GSPI

SEQ ID NO: 2428442 - protein, 13 aa, Entamoeba dispar
GSPIGGCKSTYGT

SEQ ID NO: 2428443 - protein, 7 aa, Entamoeba dispar
GSPIQNN

SEQ ID NO: 2428444 - protein, 6 aa, Entamoeba dispar
GSPIYS

SEQ ID NO: 2428445 - protein, 9 aa, Entamoeba dispar
GSPKRNGSV

SEQ ID NO: 2428446 - protein, 12 aa, Entamoeba dispar
GSPKSSSTSEIK

SEQ ID NO: 2428447 - protein, 8 aa, Entamoeba dispar
GSPLTTPL

SEQ ID NO: 2428448 - protein, 5 aa, Entamoeba dispar
GSPMN

SEQ ID NO: 2428449 - protein, 7 aa, Entamoeba dispar
GSPNKTQ

SEQ ID NO: 2428450 - protein, 9 aa, Entamoeba dispar
GSPNPNIAS

SEQ ID NO: 2428451 - protein, 4 aa, Entamoeba dispar
GSPQ

SEQ ID NO: 2428452 - protein, 17 aa, Entamoeba dispar
GSPRAEEYKDNSRIPEI

SEQ ID NO: 2428453 - protein, 9 aa, Entamoeba dispar
GSPREKGNT

SEQ ID NO: 2428454 - protein, 9 aa, Entamoeba dispar
GSPRENGNT

SEQ ID NO: 2428455 - protein, 6 aa, Entamoeba dispar
GSPSYV

SEQ ID NO: 2428456 - protein, 6 aa, Entamoeba dispar
GSPTEH

SEQ ID NO: 2428457 - protein, 7 aa, Entamoeba dispar
GSPYGNE

SEQ ID NO: 2428458 - protein, 6 aa, Entamoeba dispar
GSPYKP

SEQ ID NO: 2428459 - protein, 7 aa, Entamoeba dispar
GSQDTEV

SEQ ID NO: 2428460 - protein, 17 aa, Entamoeba dispar
GSQEDHPTGKTKNSNFK

SEQ ID NO: 2428461 - protein, 5 aa, Entamoeba dispar
GSQEM

SEQ ID NO: 2428462 - protein, 5 aa, Entamoeba dispar
GSQGR

SEQ ID NO: 2428463 - protein, 9 aa, Entamoeba dispar
GSQIDKSIT

SEQ ID NO: 2428464 - protein, 6 aa, Entamoeba dispar
GSQKDK

SEQ ID NO: 2428465 - protein, 8 aa, Entamoeba dispar
GSQKGNYA

SEQ ID NO: 2428466 - protein, 84 aa, Entamoeba dispar
GSQPVKSTPEWEEKPIDKWKKTTTQEISEPKEKKGRKSSRAESEKKFKTQEDTSTSKLKSTFSPYNPSQTQKEKHTQKGRKEKK

SEQ ID NO: 2428467 - protein, 10 aa, Entamoeba dispar
GSQSSGKSSV

SEQ ID NO: 2428468 - protein, 4 aa, Entamoeba dispar
GSRD

SEQ ID NO: 2428469 - protein, 5 aa, Entamoeba dispar
GSRDG

SEQ ID NO: 2428470 - protein, 8 aa, Entamoeba dispar
GSREASNK

SEQ ID NO: 2428471 - protein, 8 aa, Entamoeba dispar
GSRISHSH

SEQ ID NO: 2428472 - protein, 55 aa, Entamoeba dispar
GSRKKALEQGEEDDDEEDDEDQDEEEDTEEDDTEEEEEDDEEEDSDDGDDTMVIR

SEQ ID NO: 2428473 - protein, 7 aa, Entamoeba dispar
GSRLSEK

SEQ ID NO: 2428474 - protein, 10 aa, Entamoeba dispar
GSRRGKSATL

SEQ ID NO: 2428475 - protein, 10 aa, Entamoeba dispar
GSRSRKQCRE

SEQ ID NO: 2428476 - protein, 8 aa, Entamoeba dispar
GSRYKIED

SEQ ID NO: 2428477 - protein, 8 aa, Entamoeba dispar
GSSEHNQL

SEQ ID NO: 2428478 - protein, 15 aa, Entamoeba dispar
GSSEYEEKKKNRLSR

SEQ ID NO: 2428479 - protein, 7 aa, Entamoeba dispar
GSSEYHQ

SEQ ID NO: 2428480 - protein, 4 aa, Entamoeba dispar
GSSF

SEQ ID NO: 2428481 - protein, 6 aa, Entamoeba dispar
GSSFTN

SEQ ID NO: 2428482 - protein, 18 aa, Entamoeba dispar
GSSHQEPKEVQPEPTLEP

SEQ ID NO: 2428483 - protein, 7 aa, Entamoeba dispar
GSSIEKK

SEQ ID NO: 2428484 - protein, 10 aa, Entamoeba dispar
GSSINTKMTK

SEQ ID NO: 2428485 - protein, 9 aa, Entamoeba dispar
GSSKDSDVA

SEQ ID NO: 2428486 - protein, 8 aa, Entamoeba dispar
GSSKIPST

SEQ ID NO: 2428487 - protein, 15 aa, Entamoeba dispar
GSSKKKEEEALKKGA

SEQ ID NO: 2428488 - protein, 14 aa, Entamoeba dispar
GSSKKLAKELTPIK

SEQ ID NO: 2428489 - protein, 81 aa, Entamoeba dispar
GSSKVKDIDEVHSQSPRNVKPPPLDKSDSDKIVSQKSSKEVKTRPHESSPETTSPRTSVFEKSPEKSIEKSDLSKQAERLD

SEQ ID NO: 2428490 - protein, 4 aa, Entamoeba dispar
GSSL

SEQ ID NO: 2428491 - protein, 13 aa, Entamoeba dispar
GSSLDKIRSQNWA

SEQ ID NO: 2428492 - protein, 14 aa, Entamoeba dispar
GSSLGSKKVSKSQF

SEQ ID NO: 2428493 - protein, 7 aa, Entamoeba dispar
GSSLKEQ

SEQ ID NO: 2428494 - protein, 8 aa, Entamoeba dispar
GSSNEKNK

SEQ ID NO: 2428495 - protein, 5 aa, Entamoeba dispar
GSSNG

SEQ ID NO: 2428496 - protein, 42 aa, Entamoeba dispar
GSSNSDSEDPSRARSASSLQSPNTSQSPRLSLRPPPNDPRRL

SEQ ID NO: 2428497 - protein, 6 aa, Entamoeba dispar
GSSNTT

SEQ ID NO: 2428498 - protein, 16 aa, Entamoeba dispar
GSSQADNITVTNDGAT

SEQ ID NO: 2428499 - protein, 7 aa, Entamoeba dispar
GSSQDNI

SEQ ID NO: 2428500 - protein, 9 aa, Entamoeba dispar
GSSQSTPSF

SEQ ID NO: 2428501 - protein, 4 aa, Entamoeba dispar
GSSR

SEQ ID NO: 2428502 - protein, 8 aa, Entamoeba dispar
GSSRAPIG

SEQ ID NO: 2428503 - protein, 8 aa, Entamoeba dispar
GSSSCEAV

SEQ ID NO: 2428504 - protein, 5 aa, Entamoeba dispar
GSSSG

SEQ ID NO: 2428505 - protein, 11 aa, Entamoeba dispar
GSSSGSYSKSG

SEQ ID NO: 2428506 - protein, 12 aa, Entamoeba dispar
GSSSPSTRKNAT

SEQ ID NO: 2428507 - protein, 11 aa, Entamoeba dispar
GSSTDNPTSLL

SEQ ID NO: 2428508 - protein, 7 aa, Entamoeba dispar
GSSTIQQ

SEQ ID NO: 2428509 - protein, 15 aa, Entamoeba dispar
GSTADFNDKISGKQN

SEQ ID NO: 2428510 - protein, 11 aa, Entamoeba dispar
GSTAPGIPNDT

SEQ ID NO: 2428511 - protein, 7 aa, Entamoeba dispar
GSTCEQY

SEQ ID NO: 2428512 - protein, 8 aa, Entamoeba dispar
GSTDPTTI

SEQ ID NO: 2428513 - protein, 9 aa, Entamoeba dispar
GSTEQAEQG

SEQ ID NO: 2428514 - protein, 6 aa, Entamoeba dispar
GSTITN

SEQ ID NO: 2428515 - protein, 8 aa, Entamoeba dispar
GSTKIPKI

SEQ ID NO: 2428516 - protein, 5 aa, Entamoeba dispar
GSTKM

SEQ ID NO: 2428517 - protein, 33 aa, Entamoeba dispar
GSTKQEEETKESIKEEEENNNFTSSIIQKQKGN

SEQ ID NO: 2428518 - protein, 24 aa, Entamoeba dispar
GSTKQEEETKESIKEEEENNNSLP

SEQ ID NO: 2428519 - protein, 13 aa, Entamoeba dispar
GSTLESTDGDVSP

SEQ ID NO: 2428520 - protein, 8 aa, Entamoeba dispar
GSTNASLR

SEQ ID NO: 2428521 - protein, 4 aa, Entamoeba dispar
GSTP

SEQ ID NO: 2428522 - protein, 6 aa, Entamoeba dispar
GSTPEA

SEQ ID NO: 2428523 - protein, 4 aa, Entamoeba dispar
GSTQ

SEQ ID NO: 2428524 - protein, 14 aa, Entamoeba dispar
GSTQGGQGINPGAV

SEQ ID NO: 2428525 - protein, 6 aa, Entamoeba dispar
GSTQNI

SEQ ID NO: 2428526 - protein, 4 aa, Entamoeba dispar
GSTV

SEQ ID NO: 2428527 - protein, 6 aa, Entamoeba dispar
GSTYSK

SEQ ID NO: 2428528 - protein, 13 aa, Entamoeba dispar
GSVDGTDIKKEKH

SEQ ID NO: 2428529 - protein, 5 aa, Entamoeba dispar
GSVFG

SEQ ID NO: 2428530 - protein, 4 aa, Entamoeba dispar
GSVI

SEQ ID NO: 2428531 - protein, 4 aa, Entamoeba dispar
GSVN

SEQ ID NO: 2428532 - protein, 14 aa, Entamoeba dispar
GSVPDINKAPFFCD

SEQ ID NO: 2428533 - protein, 6 aa, Entamoeba dispar
GSVPQY

SEQ ID NO: 2428534 - protein, 8 aa, Entamoeba dispar
GSVQRSKK

SEQ ID NO: 2428535 - protein, 8 aa, Entamoeba dispar
GSVRGNLE

SEQ ID NO: 2428536 - protein, 17 aa, Entamoeba dispar
GSVRTSSIEKVKSVNSD

SEQ ID NO: 2428537 - protein, 10 aa, Entamoeba dispar
GSVSSSLENT

SEQ ID NO: 2428538 - protein, 8 aa, Entamoeba dispar
GSVTPNNC

SEQ ID NO: 2428539 - protein, 17 aa, Entamoeba dispar
GSVVTRTEKDLNSRQYT

SEQ ID NO: 2428540 - protein, 14 aa, Entamoeba dispar
GSWKAPQQTAKEYE

SEQ ID NO: 2428541 - protein, 13 aa, Entamoeba dispar
GSWKSLQNTAKEF

SEQ ID NO: 2428542 - protein, 6 aa, Entamoeba dispar
GSWNYS

SEQ ID NO: 2428543 - protein, 8 aa, Entamoeba dispar
GSYDGSVK

SEQ ID NO: 2428544 - protein, 7 aa, Entamoeba dispar
GSYEFTS

SEQ ID NO: 2428545 - protein, 11 aa, Entamoeba dispar
GSYGGNSVSAN

SEQ ID NO: 2428546 - protein, 8 aa, Entamoeba dispar
GSYGRTDL

SEQ ID NO: 2428547 - protein, 10 aa, Entamoeba dispar
GSYKKEATYQ

SEQ ID NO: 2428548 - protein, 12 aa, Entamoeba dispar
GSYKNKKGKEQH

SEQ ID NO: 2428549 - protein, 8 aa, Entamoeba dispar
GSYPPDIE

SEQ ID NO: 2428550 - protein, 5 aa, Entamoeba dispar
GSYQN

SEQ ID NO: 2428551 - protein, 16 aa, Entamoeba dispar
GSYSFKKGEIQLVKAF

SEQ ID NO: 2428552 - protein, 10 aa, Entamoeba dispar
GSYTNHTDSV

SEQ ID NO: 2428553 - protein, 6 aa, Entamoeba dispar
GSYTSA

SEQ ID NO: 2428554 - protein, 6 aa, Entamoeba dispar
GTAEAH

SEQ ID NO: 2428555 - protein, 13 aa, Entamoeba dispar
GTAEKGNEKKKLG

SEQ ID NO: 2428556 - protein, 5 aa, Entamoeba dispar
GTAEQ

SEQ ID NO: 2428557 - protein, 7 aa, Entamoeba dispar
GTAEQDN

SEQ ID NO: 2428558 - protein, 8 aa, Entamoeba dispar
GTAETYTE

SEQ ID NO: 2428559 - protein, 11 aa, Entamoeba dispar
GTAFGGDKLDD

SEQ ID NO: 2428560 - protein, 8 aa, Entamoeba dispar
GTAFRGNA

SEQ ID NO: 2428561 - protein, 7 aa, Entamoeba dispar
GTAFSDD

SEQ ID NO: 2428562 - protein, 5 aa, Entamoeba dispar
GTAGT

SEQ ID NO: 2428563 - protein, 10 aa, Entamoeba dispar
GTAKKDDAGR

SEQ ID NO: 2428564 - protein, 13 aa, Entamoeba dispar
GTAPKVLGRSKDL

SEQ ID NO: 2428565 - protein, 5 aa, Entamoeba dispar
GTAQR

SEQ ID NO: 2428566 - protein, 8 aa, Entamoeba dispar
GTASEEIK

SEQ ID NO: 2428567 - protein, 5 aa, Entamoeba dispar
GTASF

SEQ ID NO: 2428568 - protein, 8 aa, Entamoeba dispar
GTASPHAM

SEQ ID NO: 2428569 - protein, 6 aa, Entamoeba dispar
GTCKYG

SEQ ID NO: 2428570 - protein, 7 aa, Entamoeba dispar
GTCNEKK

SEQ ID NO: 2428571 - protein, 5 aa, Entamoeba dispar
GTCRY

SEQ ID NO: 2428572 - protein, 5 aa, Entamoeba dispar
GTCTR

SEQ ID NO: 2428573 - protein, 5 aa, Entamoeba dispar
GTDEI

SEQ ID NO: 2428574 - protein, 7 aa, Entamoeba dispar
GTDETKV

SEQ ID NO: 2428575 - protein, 5 aa, Entamoeba dispar
GTDIT

SEQ ID NO: 2428576 - protein, 8 aa, Entamoeba dispar
GTDLSRDD

SEQ ID NO: 2428577 - protein, 6 aa, Entamoeba dispar
GTDPQT

SEQ ID NO: 2428578 - protein, 21 aa, Entamoeba dispar
GTDQSKWLNETSTIKERNEAL

SEQ ID NO: 2428579 - protein, 7 aa, Entamoeba dispar
GTDSIND

SEQ ID NO: 2428580 - protein, 17 aa, Entamoeba dispar
GTDSPDQIKQKDSASKE

SEQ ID NO: 2428581 - protein, 6 aa, Entamoeba dispar
GTDSYK

SEQ ID NO: 2428582 - protein, 10 aa, Entamoeba dispar
GTDVSTTATF

SEQ ID NO: 2428583 - protein, 4 aa, Entamoeba dispar
GTDY

SEQ ID NO: 2428584 - protein, 5 aa, Entamoeba dispar
GTEAK

SEQ ID NO: 2428585 - protein, 8 aa, Entamoeba dispar
GTEDFAPH

SEQ ID NO: 2428586 - protein, 9 aa, Entamoeba dispar
GTEDGFSAE

SEQ ID NO: 2428587 - protein, 43 aa, Entamoeba dispar
GTEEEIKEFNEAKEKEMKRIEEKKNKENKTKKIERKKRKIDDV

SEQ ID NO: 2428588 - protein, 6 aa, Entamoeba dispar
GTEEEM

SEQ ID NO: 2428589 - protein, 13 aa, Entamoeba dispar
GTEFPEKELSHEG

SEQ ID NO: 2428590 - protein, 9 aa, Entamoeba dispar
GTEFRNEQG

SEQ ID NO: 2428591 - protein, 6 aa, Entamoeba dispar
GTEGDY

SEQ ID NO: 2428592 - protein, 4 aa, Entamoeba dispar
GTEH

SEQ ID NO: 2428593 - protein, 5 aa, Entamoeba dispar
GTEII

SEQ ID NO: 2428594 - protein, 6 aa, Entamoeba dispar
GTEINH

SEQ ID NO: 2428595 - protein, 5 aa, Entamoeba dispar
GTEIV

SEQ ID NO: 2428596 - protein, 6 aa, Entamoeba dispar
GTEKIV

SEQ ID NO: 2428597 - protein, 10 aa, Entamoeba dispar
GTENGEVPQT

SEQ ID NO: 2428598 - protein, 5 aa, Entamoeba dispar
GTEPM

SEQ ID NO: 2428599 - protein, 6 aa, Entamoeba dispar
GTEQRP

SEQ ID NO: 2428600 - protein, 12 aa, Entamoeba dispar
GTERLEKSRHYT

SEQ ID NO: 2428601 - protein, 8 aa, Entamoeba dispar
GTESATGF

SEQ ID NO: 2428602 - protein, 7 aa, Entamoeba dispar
GTESGDT

SEQ ID NO: 2428603 - protein, 42 aa, Entamoeba dispar
GTESSSSLIGGPITPITSAPIQSVQEQKPKVPKQSTTASRTA

SEQ ID NO: 2428604 - protein, 16 aa, Entamoeba dispar
GTETNDATRKISDTGV

SEQ ID NO: 2428605 - protein, 5 aa, Entamoeba dispar
GTEYE

SEQ ID NO: 2428606 - protein, 13 aa, Entamoeba dispar
GTFKSDEKSTIGA

SEQ ID NO: 2428607 - protein, 12 aa, Entamoeba dispar
GTFNEEQAATVG

SEQ ID NO: 2428608 - protein, 6 aa, Entamoeba dispar
GTFRNS

SEQ ID NO: 2428609 - protein, 10 aa, Entamoeba dispar
GTGDGKSSFG

SEQ ID NO: 2428610 - protein, 10 aa, Entamoeba dispar
GTGDGKSSLG

SEQ ID NO: 2428611 - protein, 5 aa, Entamoeba dispar
GTGDS

SEQ ID NO: 2428612 - protein, 7 aa, Entamoeba dispar
GTGGSSC

SEQ ID NO: 2428613 - protein, 20 aa, Entamoeba dispar
GTGGTWPLKPNESIELPPPM

SEQ ID NO: 2428614 - protein, 8 aa, Entamoeba dispar
GTGHPDIS

SEQ ID NO: 2428615 - protein, 8 aa, Entamoeba dispar
GTGISNQI

SEQ ID NO: 2428616 - protein, 9 aa, Entamoeba dispar
GTGLTTNEI

SEQ ID NO: 2428617 - protein, 6 aa, Entamoeba dispar
GTGNDL

SEQ ID NO: 2428618 - protein, 7 aa, Entamoeba dispar
GTGPQGK

SEQ ID NO: 2428619 - protein, 5 aa, Entamoeba dispar
GTGSF

SEQ ID NO: 2428620 - protein, 7 aa, Entamoeba dispar
GTGSVGA

SEQ ID NO: 2428621 - protein, 8 aa, Entamoeba dispar
GTGTSGYV

SEQ ID NO: 2428622 - protein, 4 aa, Entamoeba dispar
GTGV

SEQ ID NO: 2428623 - protein, 7 aa, Entamoeba dispar
GTGYTKI

SEQ ID NO: 2428624 - protein, 19 aa, Entamoeba dispar
GTHQTEEDVNKQLNDKERI

SEQ ID NO: 2428625 - protein, 5 aa, Entamoeba dispar
GTHSP

SEQ ID NO: 2428626 - protein, 5 aa, Entamoeba dispar
GTHST

SEQ ID NO: 2428627 - protein, 8 aa, Entamoeba dispar
GTHTNHDG

SEQ ID NO: 2428628 - protein, 7 aa, Entamoeba dispar
GTHTRYE

SEQ ID NO: 2428629 - protein, 6 aa, Entamoeba dispar
GTIARS

SEQ ID NO: 2428630 - protein, 5 aa, Entamoeba dispar
GTIES

SEQ ID NO: 2428631 - protein, 15 aa, Entamoeba dispar
GTIITDEKKRWFECC

SEQ ID NO: 2428632 - protein, 10 aa, Entamoeba dispar
GTIKRNTATL

SEQ ID NO: 2428633 - protein, 5 aa, Entamoeba dispar
GTIQK

SEQ ID NO: 2428634 - protein, 30 aa, Entamoeba dispar
GTISQSGKYQPGQRQPDSSITKKVSESGVT

SEQ ID NO: 2428635 - protein, 21 aa, Entamoeba dispar
GTITKDNRNLQDSNSNQQLTD

SEQ ID NO: 2428636 - protein, 12 aa, Entamoeba dispar
GTITQQYPKDER

SEQ ID NO: 2428637 - protein, 6 aa, Entamoeba dispar
GTKEFE

SEQ ID NO: 2428638 - protein, 8 aa, Entamoeba dispar
GTKESFGK

SEQ ID NO: 2428639 - protein, 10 aa, Entamoeba dispar
GTKFDNNDKL

SEQ ID NO: 2428640 - protein, 7 aa, Entamoeba dispar
GTKIGKN

SEQ ID NO: 2428641 - protein, 8 aa, Entamoeba dispar
GTKKAYQT

SEQ ID NO: 2428642 - protein, 13 aa, Entamoeba dispar
GTKMPERDPPKGK

SEQ ID NO: 2428643 - protein, 7 aa, Entamoeba dispar
GTKPDFH

SEQ ID NO: 2428644 - protein, 14 aa, Entamoeba dispar
GTKQRAQKKQEEFT

SEQ ID NO: 2428645 - protein, 4 aa, Entamoeba dispar
GTKR

SEQ ID NO: 2428646 - protein, 24 aa, Entamoeba dispar
GTKSRKEINEECEEVDGKDEGELT

SEQ ID NO: 2428647 - protein, 9 aa, Entamoeba dispar
GTKTALNTD

SEQ ID NO: 2428648 - protein, 6 aa, Entamoeba dispar
GTKTTA

SEQ ID NO: 2428649 - protein, 7 aa, Entamoeba dispar
GTKTVSS

SEQ ID NO: 2428650 - protein, 8 aa, Entamoeba dispar
GTKTYSAK

SEQ ID NO: 2428651 - protein, 7 aa, Entamoeba dispar
GTKVGKN

SEQ ID NO: 2428652 - protein, 4 aa, Entamoeba dispar
GTLE

SEQ ID NO: 2428653 - protein, 9 aa, Entamoeba dispar
GTLENKGEA

SEQ ID NO: 2428654 - protein, 6 aa, Entamoeba dispar
GTLNPS

SEQ ID NO: 2428655 - protein, 6 aa, Entamoeba dispar
GTLPEN

SEQ ID NO: 2428656 - protein, 33 aa, Entamoeba dispar
GTLPPVPPKPRSGLMNESAPSSEDNEDSPVKRR

SEQ ID NO: 2428657 - protein, 8 aa, Entamoeba dispar
GTLQDTST

SEQ ID NO: 2428658 - protein, 13 aa, Entamoeba dispar
GTLQRLDQTTSTT

SEQ ID NO: 2428659 - protein, 6 aa, Entamoeba dispar
GTLSKP

SEQ ID NO: 2428660 - protein, 10 aa, Entamoeba dispar
GTLSPTYHQQ

SEQ ID NO: 2428661 - protein, 21 aa, Entamoeba dispar
GTLTISSSSISDSVSTHYSQN

SEQ ID NO: 2428662 - protein, 8 aa, Entamoeba dispar
GTMSDAQP

SEQ ID NO: 2428663 - protein, 7 aa, Entamoeba dispar
GTMTSRD

SEQ ID NO: 2428664 - protein, 14 aa, Entamoeba dispar
GTNAASGKKNKVYT

SEQ ID NO: 2428665 - protein, 4 aa, Entamoeba dispar
GTNE

SEQ ID NO: 2428666 - protein, 6 aa, Entamoeba dispar
GTNEEC

SEQ ID NO: 2428667 - protein, 17 aa, Entamoeba dispar
GTNEKTTPSFNQSNPGM

SEQ ID NO: 2428668 - protein, 6 aa, Entamoeba dispar
GTNEQR

SEQ ID NO: 2428669 - protein, 14 aa, Entamoeba dispar
GTNIDQYKPDLKNS

SEQ ID NO: 2428670 - protein, 7 aa, Entamoeba dispar
GTNKEEL

SEQ ID NO: 2428671 - protein, 9 aa, Entamoeba dispar
GTNKHTPTV

SEQ ID NO: 2428672 - protein, 12 aa, Entamoeba dispar
GTNKNNPDGISG

SEQ ID NO: 2428673 - protein, 15 aa, Entamoeba dispar
GTNLKTINPNGNTAL

SEQ ID NO: 2428674 - protein, 18 aa, Entamoeba dispar
GTNNETNEDETKQTTDNF

SEQ ID NO: 2428675 - protein, 10 aa, Entamoeba dispar
GTNPGYHREH

SEQ ID NO: 2428676 - protein, 17 aa, Entamoeba dispar
GTNPYTVDGEGRGPAWG

SEQ ID NO: 2428677 - protein, 5 aa, Entamoeba dispar
GTNSG

SEQ ID NO: 2428678 - protein, 5 aa, Entamoeba dispar
GTNSI

SEQ ID NO: 2428679 - protein, 7 aa, Entamoeba dispar
GTNSVSD

SEQ ID NO: 2428680 - protein, 10 aa, Entamoeba dispar
GTNTASSAYP

SEQ ID NO: 2428681 - protein, 7 aa, Entamoeba dispar
GTPEAVE

SEQ ID NO: 2428682 - protein, 6 aa, Entamoeba dispar
GTPGFS

SEQ ID NO: 2428683 - protein, 5 aa, Entamoeba dispar
GTPGR

SEQ ID NO: 2428684 - protein, 6 aa, Entamoeba dispar
GTPGRV

SEQ ID NO: 2428685 - protein, 8 aa, Entamoeba dispar
GTPGTGKT

SEQ ID NO: 2428686 - protein, 18 aa, Entamoeba dispar
GTPGYTAPEVSSGNYDTS

SEQ ID NO: 2428687 - protein, 6 aa, Entamoeba dispar
GTPHPV

SEQ ID NO: 2428688 - protein, 7 aa, Entamoeba dispar
GTPIPYE

SEQ ID NO: 2428689 - protein, 7 aa, Entamoeba dispar
GTPIQNN

SEQ ID NO: 2428690 - protein, 8 aa, Entamoeba dispar
GTPKNITN

SEQ ID NO: 2428691 - protein, 7 aa, Entamoeba dispar
GTPKNSF

SEQ ID NO: 2428692 - protein, 12 aa, Entamoeba dispar
GTPLENKTDEEL

SEQ ID NO: 2428693 - protein, 5 aa, Entamoeba dispar
GTPLI

SEQ ID NO: 2428694 - protein, 9 aa, Entamoeba dispar
GTPNPSWAS

SEQ ID NO: 2428695 - protein, 6 aa, Entamoeba dispar
GTPPLS

SEQ ID NO: 2428696 - protein, 8 aa, Entamoeba dispar
GTPPSEIE

SEQ ID NO: 2428697 - protein, 8 aa, Entamoeba dispar
GTPQKAQI

SEQ ID NO: 2428698 - protein, 7 aa, Entamoeba dispar
GTPRPIN

SEQ ID NO: 2428699 - protein, 5 aa, Entamoeba dispar
GTPSG

SEQ ID NO: 2428700 - protein, 9 aa, Entamoeba dispar
GTPSTKQTT

SEQ ID NO: 2428701 - protein, 6 aa, Entamoeba dispar
GTPSYV

SEQ ID NO: 2428702 - protein, 8 aa, Entamoeba dispar
GTPTDINR

SEQ ID NO: 2428703 - protein, 9 aa, Entamoeba dispar
GTPTDSQWP

SEQ ID NO: 2428704 - protein, 9 aa, Entamoeba dispar
GTPTEEEMK

SEQ ID NO: 2428705 - protein, 7 aa, Entamoeba dispar
GTPTQKE

SEQ ID NO: 2428706 - protein, 6 aa, Entamoeba dispar
GTPTSY

SEQ ID NO: 2428707 - protein, 5 aa, Entamoeba dispar
GTPTY

SEQ ID NO: 2428708 - protein, 5 aa, Entamoeba dispar
GTPYW

SEQ ID NO: 2428709 - protein, 6 aa, Entamoeba dispar
GTQDKI

SEQ ID NO: 2428710 - protein, 4 aa, Entamoeba dispar
GTQF

SEQ ID NO: 2428711 - protein, 11 aa, Entamoeba dispar
GTQGEKEMDEL

SEQ ID NO: 2428712 - protein, 4 aa, Entamoeba dispar
GTQI

SEQ ID NO: 2428713 - protein, 6 aa, Entamoeba dispar
GTQKEL

SEQ ID NO: 2428714 - protein, 12 aa, Entamoeba dispar
GTQNISNKLGQA

SEQ ID NO: 2428715 - protein, 159 aa, Entamoeba dispar
GTQQPSNTMQQPSNTMQQPSNTMQQPSNTTTNQQGTNVSPNSSVSQQTTTAAPQQKGCQQPEYNTQQPIPQQPIQQQQYPQYNVQERDGQQPIQQQQQYPGYSIEQPNEQQHKQTNGQNSQPIVSPSNPYTQQQTNTVPQQQTNTVPQQQTNTHSNSGV

SEQ ID NO: 2428716 - protein, 12 aa, Entamoeba dispar
GTQTNSHRPDTL

SEQ ID NO: 2428717 - protein, 4 aa, Entamoeba dispar
GTQW

SEQ ID NO: 2428718 - protein, 7 aa, Entamoeba dispar
GTRGGEY

SEQ ID NO: 2428719 - protein, 8 aa, Entamoeba dispar
GTRINDSN

SEQ ID NO: 2428720 - protein, 4 aa, Entamoeba dispar
GTRQ

SEQ ID NO: 2428721 - protein, 24 aa, Entamoeba dispar
GTRQPKKETLPQEEPEGDEEPIEP

SEQ ID NO: 2428722 - protein, 24 aa, Entamoeba dispar
GTRQPKKEVRQQEEPEGDEEPIEP

SEQ ID NO: 2428723 - protein, 7 aa, Entamoeba dispar
GTRSAKY

SEQ ID NO: 2428724 - protein, 9 aa, Entamoeba dispar
GTRSRKQCR

SEQ ID NO: 2428725 - protein, 6 aa, Entamoeba dispar
GTRSSI

SEQ ID NO: 2428726 - protein, 5 aa, Entamoeba dispar
GTRST

SEQ ID NO: 2428727 - protein, 9 aa, Entamoeba dispar
GTSAEKNLE

SEQ ID NO: 2428728 - protein, 5 aa, Entamoeba dispar
GTSAG

SEQ ID NO: 2428729 - protein, 20 aa, Entamoeba dispar
GTSDVKPTINVSSTPLAEGT

SEQ ID NO: 2428730 - protein, 5 aa, Entamoeba dispar
GTSEI

SEQ ID NO: 2428731 - protein, 9 aa, Entamoeba dispar
GTSGIPKGA

SEQ ID NO: 2428732 - protein, 6 aa, Entamoeba dispar
GTSHGA

SEQ ID NO: 2428733 - protein, 4 aa, Entamoeba dispar
GTSI

SEQ ID NO: 2428734 - protein, 15 aa, Entamoeba dispar
GTSIKTKENRHTTMA

SEQ ID NO: 2428735 - protein, 7 aa, Entamoeba dispar
GTSINGS

SEQ ID NO: 2428736 - protein, 11 aa, Entamoeba dispar
GTSNAETDEER

SEQ ID NO: 2428737 - protein, 8 aa, Entamoeba dispar
GTSNEKAI

SEQ ID NO: 2428738 - protein, 6 aa, Entamoeba dispar
GTSNEL

SEQ ID NO: 2428739 - protein, 10 aa, Entamoeba dispar
GTSNNEIKSM

SEQ ID NO: 2428740 - protein, 10 aa, Entamoeba dispar
GTSNTPKPED

SEQ ID NO: 2428741 - protein, 14 aa, Entamoeba dispar
GTSPSQGGMSQQTK

SEQ ID NO: 2428742 - protein, 21 aa, Entamoeba dispar
GTSRFTKKNNTNSDDKGLGTP

SEQ ID NO: 2428743 - protein, 5 aa, Entamoeba dispar
GTSSS

SEQ ID NO: 2428744 - protein, 14 aa, Entamoeba dispar
GTSSTARLQTIGET

SEQ ID NO: 2428745 - protein, 8 aa, Entamoeba dispar
GTSSYIEN

SEQ ID NO: 2428746 - protein, 6 aa, Entamoeba dispar
GTSTAN

SEQ ID NO: 2428747 - protein, 16 aa, Entamoeba dispar
GTSTGVKTDPQEVRDV

SEQ ID NO: 2428748 - protein, 6 aa, Entamoeba dispar
GTSVPH

SEQ ID NO: 2428749 - protein, 5 aa, Entamoeba dispar
GTTAD

SEQ ID NO: 2428750 - protein, 14 aa, Entamoeba dispar
GTTADTIDEDFDSS

SEQ ID NO: 2428751 - protein, 5 aa, Entamoeba dispar
GTTAT

SEQ ID NO: 2428752 - protein, 4 aa, Entamoeba dispar
GTTD

SEQ ID NO: 2428753 - protein, 7 aa, Entamoeba dispar
GTTDENN

SEQ ID NO: 2428754 - protein, 9 aa, Entamoeba dispar
GTTEFSEDS

SEQ ID NO: 2428755 - protein, 6 aa, Entamoeba dispar
GTTEMG

SEQ ID NO: 2428756 - protein, 7 aa, Entamoeba dispar
GTTENSG

SEQ ID NO: 2428757 - protein, 9 aa, Entamoeba dispar
GTTGKDGKA

SEQ ID NO: 2428758 - protein, 12 aa, Entamoeba dispar
GTTGSGKSTQLP

SEQ ID NO: 2428759 - protein, 6 aa, Entamoeba dispar
GTTHTN

SEQ ID NO: 2428760 - protein, 5 aa, Entamoeba dispar
GTTIK

SEQ ID NO: 2428761 - protein, 8 aa, Entamoeba dispar
GTTKEAVT

SEQ ID NO: 2428762 - protein, 12 aa, Entamoeba dispar
GTTLPAEGSSCY

SEQ ID NO: 2428763 - protein, 11 aa, Entamoeba dispar
GTTQADKTVDC

SEQ ID NO: 2428764 - protein, 7 aa, Entamoeba dispar
GTTQTSL

SEQ ID NO: 2428765 - protein, 6 aa, Entamoeba dispar
GTTRTK

SEQ ID NO: 2428766 - protein, 4 aa, Entamoeba dispar
GTTS

SEQ ID NO: 2428767 - protein, 5 aa, Entamoeba dispar
GTTTP

SEQ ID NO: 2428768 - protein, 8 aa, Entamoeba dispar
GTTTREEV

SEQ ID NO: 2428769 - protein, 12 aa, Entamoeba dispar
GTTTYKKLGEQI

SEQ ID NO: 2428770 - protein, 7 aa, Entamoeba dispar
GTTVGEG

SEQ ID NO: 2428771 - protein, 15 aa, Entamoeba dispar
GTTVTNQPDQKTNNC

SEQ ID NO: 2428772 - protein, 6 aa, Entamoeba dispar
GTTYAS

SEQ ID NO: 2428773 - protein, 5 aa, Entamoeba dispar
GTVGI

SEQ ID NO: 2428774 - protein, 4 aa, Entamoeba dispar
GTVP

SEQ ID NO: 2428775 - protein, 30 aa, Entamoeba dispar
GTVPPPLSPYGTVPAPVTPYNSPYPYGYNP

SEQ ID NO: 2428776 - protein, 8 aa, Entamoeba dispar
GTVPSSEE

SEQ ID NO: 2428777 - protein, 6 aa, Entamoeba dispar
GTVQPS

SEQ ID NO: 2428778 - protein, 9 aa, Entamoeba dispar
GTVRGQPVK

SEQ ID NO: 2428779 - protein, 17 aa, Entamoeba dispar
GTVRNTFPDMNETDIPQ

SEQ ID NO: 2428780 - protein, 6 aa, Entamoeba dispar
GTVRSA

SEQ ID NO: 2428781 - protein, 10 aa, Entamoeba dispar
GTVSTGKEAN

SEQ ID NO: 2428782 - protein, 4 aa, Entamoeba dispar
GTVT

SEQ ID NO: 2428783 - protein, 8 aa, Entamoeba dispar
GTYEETEP

SEQ ID NO: 2428784 - protein, 4 aa, Entamoeba dispar
GTYG

SEQ ID NO: 2428785 - protein, 5 aa, Entamoeba dispar
GTYSI

SEQ ID NO: 2428786 - protein, 5 aa, Entamoeba dispar
GTYYP

SEQ ID NO: 2428787 - protein, 9 aa, Entamoeba dispar
GVADDTDVR

SEQ ID NO: 2428788 - protein, 9 aa, Entamoeba dispar
GVANPNDRR

SEQ ID NO: 2428789 - protein, 10 aa, Entamoeba dispar
GVARKQGEIY

SEQ ID NO: 2428790 - protein, 5 aa, Entamoeba dispar
GVASA

SEQ ID NO: 2428791 - protein, 4 aa, Entamoeba dispar
GVCN

SEQ ID NO: 2428792 - protein, 8 aa, Entamoeba dispar
GVDASTRP

SEQ ID NO: 2428793 - protein, 6 aa, Entamoeba dispar
GVDDGA

SEQ ID NO: 2428794 - protein, 9 aa, Entamoeba dispar
GVDDTGRSI

SEQ ID NO: 2428795 - protein, 5 aa, Entamoeba dispar
GVDGE

SEQ ID NO: 2428796 - protein, 4 aa, Entamoeba dispar
GVDI

SEQ ID NO: 2428797 - protein, 17 aa, Entamoeba dispar
GVDNTQFGNKKEKKNIG

SEQ ID NO: 2428798 - protein, 7 aa, Entamoeba dispar
GVDPATL

SEQ ID NO: 2428799 - protein, 8 aa, Entamoeba dispar
GVDPSRTT

SEQ ID NO: 2428800 - protein, 12 aa, Entamoeba dispar
GVDRGSSKQVKR

SEQ ID NO: 2428801 - protein, 4 aa, Entamoeba dispar
GVDY

SEQ ID NO: 2428802 - protein, 9 aa, Entamoeba dispar
GVEAGLASG

SEQ ID NO: 2428803 - protein, 12 aa, Entamoeba dispar
GVEAKKQYMRGG

SEQ ID NO: 2428804 - protein, 5 aa, Entamoeba dispar
GVEDT

SEQ ID NO: 2428805 - protein, 12 aa, Entamoeba dispar
GVEEKTDALSQS

SEQ ID NO: 2428806 - protein, 9 aa, Entamoeba dispar
GVEEPDAAR

SEQ ID NO: 2428807 - protein, 8 aa, Entamoeba dispar
GVEGLNDE

SEQ ID NO: 2428808 - protein, 9 aa, Entamoeba dispar
GVEKDDPNN

SEQ ID NO: 2428809 - protein, 5 aa, Entamoeba dispar
GVENG

SEQ ID NO: 2428810 - protein, 9 aa, Entamoeba dispar
GVEPKIADE

SEQ ID NO: 2428811 - protein, 4 aa, Entamoeba dispar
GVEQ

SEQ ID NO: 2428812 - protein, 9 aa, Entamoeba dispar
GVERTDYDK

SEQ ID NO: 2428813 - protein, 8 aa, Entamoeba dispar
GVESQETH

SEQ ID NO: 2428814 - protein, 10 aa, Entamoeba dispar
GVGEDEKQER

SEQ ID NO: 2428815 - protein, 5 aa, Entamoeba dispar
GVGEY

SEQ ID NO: 2428816 - protein, 4 aa, Entamoeba dispar
GVGK

SEQ ID NO: 2428817 - protein, 8 aa, Entamoeba dispar
GVGKDSKE

SEQ ID NO: 2428818 - protein, 10 aa, Entamoeba dispar
GVGKSSVATR

SEQ ID NO: 2428819 - protein, 5 aa, Entamoeba dispar
GVGKT

SEQ ID NO: 2428820 - protein, 5 aa, Entamoeba dispar
GVGRT

SEQ ID NO: 2428821 - protein, 7 aa, Entamoeba dispar
GVGVGKS

SEQ ID NO: 2428822 - protein, 8 aa, Entamoeba dispar
GVGVPEGT

SEQ ID NO: 2428823 - protein, 13 aa, Entamoeba dispar
GVHQEGSKVQQEV

SEQ ID NO: 2428824 - protein, 12 aa, Entamoeba dispar
GVHQKPVDVKLK

SEQ ID NO: 2428825 - protein, 9 aa, Entamoeba dispar
GVIGDPNIP

SEQ ID NO: 2428826 - protein, 7 aa, Entamoeba dispar
GVIGQTE

SEQ ID NO: 2428827 - protein, 5 aa, Entamoeba dispar
GVIQS

SEQ ID NO: 2428828 - protein, 6 aa, Entamoeba dispar
GVKDEK

SEQ ID NO: 2428829 - protein, 6 aa, Entamoeba dispar
GVKEGE

SEQ ID NO: 2428830 - protein, 12 aa, Entamoeba dispar
GVKGKPLQETPE

SEQ ID NO: 2428831 - protein, 12 aa, Entamoeba dispar
GVKHRDGDPVAD

SEQ ID NO: 2428832 - protein, 17 aa, Entamoeba dispar
GVKKDSDIKIRDETANK

SEQ ID NO: 2428833 - protein, 14 aa, Entamoeba dispar
GVKKKDLQNPETRK

SEQ ID NO: 2428834 - protein, 11 aa, Entamoeba dispar
GVKKRFAKKEV

SEQ ID NO: 2428835 - protein, 6 aa, Entamoeba dispar
GVKKSD

SEQ ID NO: 2428836 - protein, 51 aa, Entamoeba dispar
GVKKTNEKLENEQNEIQKKYECSEKEKREINKRNEENEEKVQHLSSEKEVI

SEQ ID NO: 2428837 - protein, 4 aa, Entamoeba dispar
GVKN

SEQ ID NO: 2428838 - protein, 9 aa, Entamoeba dispar
GVKQDERHL

SEQ ID NO: 2428839 - protein, 9 aa, Entamoeba dispar
GVKRERTPF

SEQ ID NO: 2428840 - protein, 4 aa, Entamoeba dispar
GVKS

SEQ ID NO: 2428841 - protein, 8 aa, Entamoeba dispar
GVKSPDEL

SEQ ID NO: 2428842 - protein, 17 aa, Entamoeba dispar
GVKVEERKTRKVIKPNS

SEQ ID NO: 2428843 - protein, 14 aa, Entamoeba dispar
GVLKRGTKRHPTVG

SEQ ID NO: 2428844 - protein, 13 aa, Entamoeba dispar
GVLSGEKQRIGRS

SEQ ID NO: 2428845 - protein, 13 aa, Entamoeba dispar
GVMSRGEVNTKKC

SEQ ID NO: 2428846 - protein, 10 aa, Entamoeba dispar
GVNDEDATGR

SEQ ID NO: 2428847 - protein, 12 aa, Entamoeba dispar
GVNDSTKTLKEQ

SEQ ID NO: 2428848 - protein, 5 aa, Entamoeba dispar
GVNEI

SEQ ID NO: 2428849 - protein, 11 aa, Entamoeba dispar
GVNGAEPARAE

SEQ ID NO: 2428850 - protein, 6 aa, Entamoeba dispar
GVNGSF

SEQ ID NO: 2428851 - protein, 4 aa, Entamoeba dispar
GVNK

SEQ ID NO: 2428852 - protein, 11 aa, Entamoeba dispar
GVNKNKIKTTK

SEQ ID NO: 2428853 - protein, 11 aa, Entamoeba dispar
GVNKRRKDPFN

SEQ ID NO: 2428854 - protein, 4 aa, Entamoeba dispar
GVNL

SEQ ID NO: 2428855 - protein, 14 aa, Entamoeba dispar
GVNPSLNENNYYNH

SEQ ID NO: 2428856 - protein, 6 aa, Entamoeba dispar
GVNQAQ

SEQ ID NO: 2428857 - protein, 15 aa, Entamoeba dispar
GVNSDSGSQPAPIRT

SEQ ID NO: 2428858 - protein, 13 aa, Entamoeba dispar
GVNSNDGHALLEN

SEQ ID NO: 2428859 - protein, 12 aa, Entamoeba dispar
GVNSQQKKDSMV

SEQ ID NO: 2428860 - protein, 13 aa, Entamoeba dispar
GVNSQSTWEETKK

SEQ ID NO: 2428861 - protein, 8 aa, Entamoeba dispar
GVNTSDIT

SEQ ID NO: 2428862 - protein, 8 aa, Entamoeba dispar
GVNTTERG

SEQ ID NO: 2428863 - protein, 14 aa, Entamoeba dispar
GVPADASDDQIKKA

SEQ ID NO: 2428864 - protein, 6 aa, Entamoeba dispar
GVPAQE

SEQ ID NO: 2428865 - protein, 7 aa, Entamoeba dispar
GVPESDE

SEQ ID NO: 2428866 - protein, 9 aa, Entamoeba dispar
GVPKTAAYA

SEQ ID NO: 2428867 - protein, 6 aa, Entamoeba dispar
GVPLDD

SEQ ID NO: 2428868 - protein, 4 aa, Entamoeba dispar
GVPP

SEQ ID NO: 2428869 - protein, 47 aa, Entamoeba dispar
GVPPPPPPGMPGAPPPPPPGMPGAPPPPPMGKGMPPPPGLAPAQTKL

SEQ ID NO: 2428870 - protein, 7 aa, Entamoeba dispar
GVPRQSK

SEQ ID NO: 2428871 - protein, 5 aa, Entamoeba dispar
GVPTG

SEQ ID NO: 2428872 - protein, 4 aa, Entamoeba dispar
GVQT

SEQ ID NO: 2428873 - protein, 13 aa, Entamoeba dispar
GVRDKEKKVDEER

SEQ ID NO: 2428874 - protein, 9 aa, Entamoeba dispar
GVRGGKSKM

SEQ ID NO: 2428875 - protein, 4 aa, Entamoeba dispar
GVRI

SEQ ID NO: 2428876 - protein, 5 aa, Entamoeba dispar
GVSAK

SEQ ID NO: 2428877 - protein, 15 aa, Entamoeba dispar
GVSAKLDEEEGGSEM

SEQ ID NO: 2428878 - protein, 10 aa, Entamoeba dispar
GVSDDKTSVT

SEQ ID NO: 2428879 - protein, 8 aa, Entamoeba dispar
GVSEEAKD

SEQ ID NO: 2428880 - protein, 4 aa, Entamoeba dispar
GVSG

SEQ ID NO: 2428881 - protein, 27 aa, Entamoeba dispar
GVSGEEAEEKVKEEDEDVQEKINKGKV

SEQ ID NO: 2428882 - protein, 5 aa, Entamoeba dispar
GVSKE

SEQ ID NO: 2428883 - protein, 4 aa, Entamoeba dispar
GVSQ

SEQ ID NO: 2428884 - protein, 11 aa, Entamoeba dispar
GVSTPTPLAQG

SEQ ID NO: 2428885 - protein, 8 aa, Entamoeba dispar
GVTEGYQL

SEQ ID NO: 2428886 - protein, 5 aa, Entamoeba dispar
GVTET

SEQ ID NO: 2428887 - protein, 7 aa, Entamoeba dispar
GVTGMGN

SEQ ID NO: 2428888 - protein, 8 aa, Entamoeba dispar
GVTNEEEI

SEQ ID NO: 2428889 - protein, 13 aa, Entamoeba dispar
GVTPENVNEYSSA

SEQ ID NO: 2428890 - protein, 11 aa, Entamoeba dispar
GVTPPPVPPLT

SEQ ID NO: 2428891 - protein, 14 aa, Entamoeba dispar
GVTQKRLNVPSKSI

SEQ ID NO: 2428892 - protein, 11 aa, Entamoeba dispar
GVTSTPGKTKH

SEQ ID NO: 2428893 - protein, 4 aa, Entamoeba dispar
GVVE

SEQ ID NO: 2428894 - protein, 8 aa, Entamoeba dispar
GVVQTKEQ

SEQ ID NO: 2428895 - protein, 7 aa, Entamoeba dispar
GVVSSDN

SEQ ID NO: 2428896 - protein, 7 aa, Entamoeba dispar
GWDRTAQ

SEQ ID NO: 2428897 - protein, 9 aa, Entamoeba dispar
GWDRTPQIS

SEQ ID NO: 2428898 - protein, 6 aa, Entamoeba dispar
GWDRTS

SEQ ID NO: 2428899 - protein, 5 aa, Entamoeba dispar
GWGTA

SEQ ID NO: 2428900 - protein, 6 aa, Entamoeba dispar
GWNEEQ

SEQ ID NO: 2428901 - protein, 5 aa, Entamoeba dispar
GWNPK

SEQ ID NO: 2428902 - protein, 8 aa, Entamoeba dispar
GWPAEPNN

SEQ ID NO: 2428903 - protein, 10 aa, Entamoeba dispar
GWSGEGVGNL

SEQ ID NO: 2428904 - protein, 12 aa, Entamoeba dispar
GWTETTKGEVTV

SEQ ID NO: 2428905 - protein, 14 aa, Entamoeba dispar
GWVPPEGVRGPVQT

SEQ ID NO: 2428906 - protein, 10 aa, Entamoeba dispar
GYAGNTEPSY

SEQ ID NO: 2428907 - protein, 8 aa, Entamoeba dispar
GYANTPKD

SEQ ID NO: 2428908 - protein, 9 aa, Entamoeba dispar
GYAYESNGS

SEQ ID NO: 2428909 - protein, 4 aa, Entamoeba dispar
GYDD

SEQ ID NO: 2428910 - protein, 4 aa, Entamoeba dispar
GYDE

SEQ ID NO: 2428911 - protein, 6 aa, Entamoeba dispar
GYDEDP

SEQ ID NO: 2428912 - protein, 4 aa, Entamoeba dispar
GYDI

SEQ ID NO: 2428913 - protein, 5 aa, Entamoeba dispar
GYDRT

SEQ ID NO: 2428914 - protein, 9 aa, Entamoeba dispar
GYDSKHPEY

SEQ ID NO: 2428915 - protein, 5 aa, Entamoeba dispar
GYDTE

SEQ ID NO: 2428916 - protein, 7 aa, Entamoeba dispar
GYEEKEE

SEQ ID NO: 2428917 - protein, 19 aa, Entamoeba dispar
GYEEKEEDEIIEKTKDTIT

SEQ ID NO: 2428918 - protein, 6 aa, Entamoeba dispar
GYEERK

SEQ ID NO: 2428919 - protein, 6 aa, Entamoeba dispar
GYEKDP

SEQ ID NO: 2428920 - protein, 13 aa, Entamoeba dispar
GYEKLPNSSLTTD

SEQ ID NO: 2428921 - protein, 12 aa, Entamoeba dispar
GYESAQKDGGLV

SEQ ID NO: 2428922 - protein, 20 aa, Entamoeba dispar
GYESEDENEEKDERKRMIES

SEQ ID NO: 2428923 - protein, 5 aa, Entamoeba dispar
GYESN

SEQ ID NO: 2428924 - protein, 6 aa, Entamoeba dispar
GYETIT

SEQ ID NO: 2428925 - protein, 4 aa, Entamoeba dispar
GYEY

SEQ ID NO: 2428926 - protein, 4 aa, Entamoeba dispar
GYFG

SEQ ID NO: 2428927 - protein, 12 aa, Entamoeba dispar
GYGDESPNVEPG

SEQ ID NO: 2428928 - protein, 13 aa, Entamoeba dispar
GYGEEMGGHKGYG

SEQ ID NO: 2428929 - protein, 9 aa, Entamoeba dispar
GYGLKEDKT

SEQ ID NO: 2428930 - protein, 13 aa, Entamoeba dispar
GYGLNEEGKCTNV

SEQ ID NO: 2428931 - protein, 10 aa, Entamoeba dispar
GYGLNKNKKD

SEQ ID NO: 2428932 - protein, 13 aa, Entamoeba dispar
GYGLNKNKKDVSM

SEQ ID NO: 2428933 - protein, 10 aa, Entamoeba dispar
GYGNEPGKFN

SEQ ID NO: 2428934 - protein, 18 aa, Entamoeba dispar
GYGPTTQTYQQPPQQQYY

SEQ ID NO: 2428935 - protein, 4 aa, Entamoeba dispar
GYGR

SEQ ID NO: 2428936 - protein, 8 aa, Entamoeba dispar
GYGTNNRA

SEQ ID NO: 2428937 - protein, 6 aa, Entamoeba dispar
GYHDNF

SEQ ID NO: 2428938 - protein, 6 aa, Entamoeba dispar
GYHSDD

SEQ ID NO: 2428939 - protein, 8 aa, Entamoeba dispar
GYITENGT

SEQ ID NO: 2428940 - protein, 6 aa, Entamoeba dispar
GYKDYN

SEQ ID NO: 2428941 - protein, 11 aa, Entamoeba dispar
GYKGKSKSIKF

SEQ ID NO: 2428942 - protein, 8 aa, Entamoeba dispar
GYKPSQKM

SEQ ID NO: 2428943 - protein, 4 aa, Entamoeba dispar
GYKT

SEQ ID NO: 2428944 - protein, 9 aa, Entamoeba dispar
GYNEISQSP

SEQ ID NO: 2428945 - protein, 6 aa, Entamoeba dispar
GYNESR

SEQ ID NO: 2428946 - protein, 11 aa, Entamoeba dispar
GYNGKTLSPIH

SEQ ID NO: 2428947 - protein, 5 aa, Entamoeba dispar
GYNIK

SEQ ID NO: 2428948 - protein, 7 aa, Entamoeba dispar
GYNQEDS

SEQ ID NO: 2428949 - protein, 12 aa, Entamoeba dispar
GYNSNQFQSKSS

SEQ ID NO: 2428950 - protein, 5 aa, Entamoeba dispar
GYNTE

SEQ ID NO: 2428951 - protein, 7 aa, Entamoeba dispar
GYNTGYL

SEQ ID NO: 2428952 - protein, 7 aa, Entamoeba dispar
GYPEADT

SEQ ID NO: 2428953 - protein, 46 aa, Entamoeba dispar
GYPEKKPKAPSIDGSSFDPSTTQPTETNPADDPKYKRRPEVRRYQL

SEQ ID NO: 2428954 - protein, 7 aa, Entamoeba dispar
GYPIKKD

SEQ ID NO: 2428955 - protein, 4 aa, Entamoeba dispar
GYPK

SEQ ID NO: 2428956 - protein, 9 aa, Entamoeba dispar
GYPKGTKPI

SEQ ID NO: 2428957 - protein, 8 aa, Entamoeba dispar
GYPKTQKR

SEQ ID NO: 2428958 - protein, 5 aa, Entamoeba dispar
GYPMG

SEQ ID NO: 2428959 - protein, 5 aa, Entamoeba dispar
GYPNL

SEQ ID NO: 2428960 - protein, 5 aa, Entamoeba dispar
GYPPT

SEQ ID NO: 2428961 - protein, 25 aa, Entamoeba dispar
GYPQYPPAQYPPQPYHSQAPGIPPK

SEQ ID NO: 2428962 - protein, 6 aa, Entamoeba dispar
GYPSDL

SEQ ID NO: 2428963 - protein, 6 aa, Entamoeba dispar
GYPSFP

SEQ ID NO: 2428964 - protein, 6 aa, Entamoeba dispar
GYPSSM

SEQ ID NO: 2428965 - protein, 5 aa, Entamoeba dispar
GYPTE

SEQ ID NO: 2428966 - protein, 5 aa, Entamoeba dispar
GYPYT

SEQ ID NO: 2428967 - protein, 10 aa, Entamoeba dispar
GYQGKGAEYM

SEQ ID NO: 2428968 - protein, 9 aa, Entamoeba dispar
GYQKANTLR

SEQ ID NO: 2428969 - protein, 7 aa, Entamoeba dispar
GYQNYRD

SEQ ID NO: 2428970 - protein, 7 aa, Entamoeba dispar
GYQPNGR

SEQ ID NO: 2428971 - protein, 5 aa, Entamoeba dispar
GYRAR

SEQ ID NO: 2428972 - protein, 5 aa, Entamoeba dispar
GYRDA

SEQ ID NO: 2428973 - protein, 5 aa, Entamoeba dispar
GYRED

SEQ ID NO: 2428974 - protein, 17 aa, Entamoeba dispar
GYRGGLDVKSGSTGTHS

SEQ ID NO: 2428975 - protein, 8 aa, Entamoeba dispar
GYRNSPAF

SEQ ID NO: 2428976 - protein, 18 aa, Entamoeba dispar
GYRSNEVKCGGPVSPKAK

SEQ ID NO: 2428977 - protein, 8 aa, Entamoeba dispar
GYRSPREY

SEQ ID NO: 2428978 - protein, 4 aa, Entamoeba dispar
GYRT

SEQ ID NO: 2428979 - protein, 11 aa, Entamoeba dispar
GYSEATGNRKE

SEQ ID NO: 2428980 - protein, 7 aa, Entamoeba dispar
GYSGTKS

SEQ ID NO: 2428981 - protein, 9 aa, Entamoeba dispar
GYSNGQGIV

SEQ ID NO: 2428982 - protein, 14 aa, Entamoeba dispar
GYSNIDESSLKSQS

SEQ ID NO: 2428983 - protein, 7 aa, Entamoeba dispar
GYSNNNP

SEQ ID NO: 2428984 - protein, 7 aa, Entamoeba dispar
GYSPNEI

SEQ ID NO: 2428985 - protein, 8 aa, Entamoeba dispar
GYSPQQTI

SEQ ID NO: 2428986 - protein, 4 aa, Entamoeba dispar
GYSQ

SEQ ID NO: 2428987 - protein, 5 aa, Entamoeba dispar
GYSRL

SEQ ID NO: 2428988 - protein, 8 aa, Entamoeba dispar
GYSTEKEL

SEQ ID NO: 2428989 - protein, 14 aa, Entamoeba dispar
GYSVSEEYEKEKQI

SEQ ID NO: 2428990 - protein, 5 aa, Entamoeba dispar
GYTDS

SEQ ID NO: 2428991 - protein, 5 aa, Entamoeba dispar
GYTEK

SEQ ID NO: 2428992 - protein, 16 aa, Entamoeba dispar
GYTKGSHYSDEKTANH

SEQ ID NO: 2428993 - protein, 6 aa, Entamoeba dispar
GYTNGK

SEQ ID NO: 2428994 - protein, 12 aa, Entamoeba dispar
GYTNSKLTIITI

SEQ ID NO: 2428995 - protein, 7 aa, Entamoeba dispar
GYTPLSG

SEQ ID NO: 2428996 - protein, 14 aa, Entamoeba dispar
GYVPTTKATKEEHA

SEQ ID NO: 2428997 - protein, 4 aa, Entamoeba dispar
GYYN

SEQ ID NO: 2428998 - protein, 9 aa, Entamoeba dispar
GYYTSKSDL

SEQ ID NO: 2428999 - protein, 10 aa, Entamoeba dispar
HADEAVDSLT

SEQ ID NO: 2429000 - protein, 8 aa, Entamoeba dispar
HADPVGGT

SEQ ID NO: 2429001 - protein, 7 aa, Entamoeba dispar
HADSELG

SEQ ID NO: 2429002 - protein, 10 aa, Entamoeba dispar
HAEENGTLSE

SEQ ID NO: 2429003 - protein, 5 aa, Entamoeba dispar
HAEKI

SEQ ID NO: 2429004 - protein, 4 aa, Entamoeba dispar
HAEN

SEQ ID NO: 2429005 - protein, 5 aa, Entamoeba dispar
HAEPL

SEQ ID NO: 2429006 - protein, 8 aa, Entamoeba dispar
HAEQYSRG

SEQ ID NO: 2429007 - protein, 10 aa, Entamoeba dispar
HAESLGAYKP

SEQ ID NO: 2429008 - protein, 4 aa, Entamoeba dispar
HAGP

SEQ ID NO: 2429009 - protein, 8 aa, Entamoeba dispar
HAKDIKRH

SEQ ID NO: 2429010 - protein, 4 aa, Entamoeba dispar
HAKE

SEQ ID NO: 2429011 - protein, 13 aa, Entamoeba dispar
HAKEKIKQASGPI

SEQ ID NO: 2429012 - protein, 7 aa, Entamoeba dispar
HAKKAWK

SEQ ID NO: 2429013 - protein, 16 aa, Entamoeba dispar
HAKKQKKTIKEKEENK

SEQ ID NO: 2429014 - protein, 16 aa, Entamoeba dispar
HAKKQRKTIKEKEENK

SEQ ID NO: 2429015 - protein, 10 aa, Entamoeba dispar
HAKNKDEIDV

SEQ ID NO: 2429016 - protein, 5 aa, Entamoeba dispar
HAKNN

SEQ ID NO: 2429017 - protein, 7 aa, Entamoeba dispar
HAKTESA

SEQ ID NO: 2429018 - protein, 10 aa, Entamoeba dispar
HALKDERGKW

SEQ ID NO: 2429019 - protein, 5 aa, Entamoeba dispar
HANGK

SEQ ID NO: 2429020 - protein, 6 aa, Entamoeba dispar
HANGKY

SEQ ID NO: 2429021 - protein, 8 aa, Entamoeba dispar
HANNNELK

SEQ ID NO: 2429022 - protein, 10 aa, Entamoeba dispar
HANNSIQNAG

SEQ ID NO: 2429023 - protein, 21 aa, Entamoeba dispar
HANSEYRYEYREKTKEQTAQE

SEQ ID NO: 2429024 - protein, 5 aa, Entamoeba dispar
HANSR

SEQ ID NO: 2429025 - protein, 6 aa, Entamoeba dispar
HANSSY

SEQ ID NO: 2429026 - protein, 6 aa, Entamoeba dispar
HANSTY

SEQ ID NO: 2429027 - protein, 9 aa, Entamoeba dispar
HANSYEELA

SEQ ID NO: 2429028 - protein, 7 aa, Entamoeba dispar
HAPATCK

SEQ ID NO: 2429029 - protein, 7 aa, Entamoeba dispar
HAPSQDV

SEQ ID NO: 2429030 - protein, 9 aa, Entamoeba dispar
HAQMPKAVK

SEQ ID NO: 2429031 - protein, 5 aa, Entamoeba dispar
HAQPI

SEQ ID NO: 2429032 - protein, 9 aa, Entamoeba dispar
HAQQESSEI

SEQ ID NO: 2429033 - protein, 10 aa, Entamoeba dispar
HAQRTDPKEI

SEQ ID NO: 2429034 - protein, 24 aa, Entamoeba dispar
HAQVEEKIRNAEAEISQLHARMDN

SEQ ID NO: 2429035 - protein, 44 aa, Entamoeba dispar
HASQDKKKSQRPQEPITSNQDSQRQHSQKEPKSPKEPKLSSRHS

SEQ ID NO: 2429036 - protein, 6 aa, Entamoeba dispar
HASSKV

SEQ ID NO: 2429037 - protein, 8 aa, Entamoeba dispar
HATTSERM

SEQ ID NO: 2429038 - protein, 5 aa, Entamoeba dispar
HCDKN

SEQ ID NO: 2429039 - protein, 5 aa, Entamoeba dispar
HCDNE

SEQ ID NO: 2429040 - protein, 10 aa, Entamoeba dispar
HCGETGDPMH

SEQ ID NO: 2429041 - protein, 6 aa, Entamoeba dispar
HCSGEI

SEQ ID NO: 2429042 - protein, 4 aa, Entamoeba dispar
HDAH

SEQ ID NO: 2429043 - protein, 8 aa, Entamoeba dispar
HDAKRDKE

SEQ ID NO: 2429044 - protein, 7 aa, Entamoeba dispar
HDASKAA

SEQ ID NO: 2429045 - protein, 11 aa, Entamoeba dispar
HDDEIKVQAGN

SEQ ID NO: 2429046 - protein, 22 aa, Entamoeba dispar
HDDHSDEDNDGNEDEGKKPLDS

SEQ ID NO: 2429047 - protein, 25 aa, Entamoeba dispar
HDDRRDRDSHRDERRDSHRDNDKNY

SEQ ID NO: 2429048 - protein, 7 aa, Entamoeba dispar
HDDSKAV

SEQ ID NO: 2429049 - protein, 9 aa, Entamoeba dispar
HDDVNPRPH

SEQ ID NO: 2429050 - protein, 6 aa, Entamoeba dispar
HDEASR

SEQ ID NO: 2429051 - protein, 9 aa, Entamoeba dispar
HDEQNNKEV

SEQ ID NO: 2429052 - protein, 25 aa, Entamoeba dispar
HDETGISESDNTKTWDDPIRTGEIN

SEQ ID NO: 2429053 - protein, 10 aa, Entamoeba dispar
HDGGIEDGTY

SEQ ID NO: 2429054 - protein, 5 aa, Entamoeba dispar
HDGKS

SEQ ID NO: 2429055 - protein, 26 aa, Entamoeba dispar
HDGTPSKNTYNNTALTTKKGKKKEIR

SEQ ID NO: 2429056 - protein, 4 aa, Entamoeba dispar
HDGY

SEQ ID NO: 2429057 - protein, 9 aa, Entamoeba dispar
HDHEEFGNQ

SEQ ID NO: 2429058 - protein, 7 aa, Entamoeba dispar
HDIGPEQ

SEQ ID NO: 2429059 - protein, 6 aa, Entamoeba dispar
HDIPSG

SEQ ID NO: 2429060 - protein, 15 aa, Entamoeba dispar
HDKKNEKKLSLQSDI

SEQ ID NO: 2429061 - protein, 12 aa, Entamoeba dispar
HDKKNKKNHLNK

SEQ ID NO: 2429062 - protein, 6 aa, Entamoeba dispar
HDKQQE

SEQ ID NO: 2429063 - protein, 6 aa, Entamoeba dispar
HDKVPV

SEQ ID NO: 2429064 - protein, 16 aa, Entamoeba dispar
HDLSSSSDEVLPRPDV

SEQ ID NO: 2429065 - protein, 11 aa, Entamoeba dispar
HDMEQKKAELT

SEQ ID NO: 2429066 - protein, 18 aa, Entamoeba dispar
HDNEPKEGNRNNNEALST

SEQ ID NO: 2429067 - protein, 15 aa, Entamoeba dispar
HDNHVNEKKLNGKYQ

SEQ ID NO: 2429068 - protein, 4 aa, Entamoeba dispar
HDNK

SEQ ID NO: 2429069 - protein, 21 aa, Entamoeba dispar
HDNNNKESTKDDTQQQQPVVQ

SEQ ID NO: 2429070 - protein, 16 aa, Entamoeba dispar
HDNQNEKVDESSDELP

SEQ ID NO: 2429071 - protein, 7 aa, Entamoeba dispar
HDNRVTE

SEQ ID NO: 2429072 - protein, 9 aa, Entamoeba dispar
HDNSHRNKV

SEQ ID NO: 2429073 - protein, 8 aa, Entamoeba dispar
HDPETSKM

SEQ ID NO: 2429074 - protein, 13 aa, Entamoeba dispar
HDPNDEPSAPGKI

SEQ ID NO: 2429075 - protein, 4 aa, Entamoeba dispar
HDPT

SEQ ID NO: 2429076 - protein, 8 aa, Entamoeba dispar
HDPVDPET

SEQ ID NO: 2429077 - protein, 6 aa, Entamoeba dispar
HDQKDA

SEQ ID NO: 2429078 - protein, 41 aa, Entamoeba dispar
HDQSSKKIPISNQSIPPSSHQQSNLSQMKRQTSKTFKPHPK

SEQ ID NO: 2429079 - protein, 6 aa, Entamoeba dispar
HDQTTK

SEQ ID NO: 2429080 - protein, 51 aa, Entamoeba dispar
HDSDANDNISMDEDSYYDEEDEEEDEPRKRTKDSSQDCQPKRKATDQECKH

SEQ ID NO: 2429081 - protein, 6 aa, Entamoeba dispar
HDSQSI

SEQ ID NO: 2429082 - protein, 10 aa, Entamoeba dispar
HDSYGTQATQ

SEQ ID NO: 2429083 - protein, 17 aa, Entamoeba dispar
HDTEELKEESTPTPSRH

SEQ ID NO: 2429084 - protein, 5 aa, Entamoeba dispar
HDTEK

SEQ ID NO: 2429085 - protein, 6 aa, Entamoeba dispar
HDTFQN

SEQ ID NO: 2429086 - protein, 19 aa, Entamoeba dispar
HDTPNKPKGKSKRDQKRQH

SEQ ID NO: 2429087 - protein, 8 aa, Entamoeba dispar
HDTPQHPK

SEQ ID NO: 2429088 - protein, 5 aa, Entamoeba dispar
HDTPY

SEQ ID NO: 2429089 - protein, 5 aa, Entamoeba dispar
HDTSA

SEQ ID NO: 2429090 - protein, 15 aa, Entamoeba dispar
HDTTAKNKGSKIVPR

SEQ ID NO: 2429091 - protein, 13 aa, Entamoeba dispar
HDVQDRSDNPHWN

SEQ ID NO: 2429092 - protein, 4 aa, Entamoeba dispar
HEAA

SEQ ID NO: 2429093 - protein, 5 aa, Entamoeba dispar
HEAAK

SEQ ID NO: 2429094 - protein, 5 aa, Entamoeba dispar
HEAKN

SEQ ID NO: 2429095 - protein, 13 aa, Entamoeba dispar
HEAKSQLNQKSRQ

SEQ ID NO: 2429096 - protein, 50 aa, Entamoeba dispar
HEAPPIPEHKHEAPPIPEHSLDDTSQRNKEIKPNKSKENKELAKNIAGDV

SEQ ID NO: 2429097 - protein, 16 aa, Entamoeba dispar
HEAPTKKQQRIKEQHS

SEQ ID NO: 2429098 - protein, 9 aa, Entamoeba dispar
HEASDEQHL

SEQ ID NO: 2429099 - protein, 7 aa, Entamoeba dispar
HECLPPS

SEQ ID NO: 2429100 - protein, 4 aa, Entamoeba dispar
HEDD

SEQ ID NO: 2429101 - protein, 5 aa, Entamoeba dispar
HEDDC

SEQ ID NO: 2429102 - protein, 10 aa, Entamoeba dispar
HEDKEQLKKA

SEQ ID NO: 2429103 - protein, 10 aa, Entamoeba dispar
HEDPEGSYRE

SEQ ID NO: 2429104 - protein, 8 aa, Entamoeba dispar
HEDPQKAI

SEQ ID NO: 2429105 - protein, 10 aa, Entamoeba dispar
HEDSTNRDKI

SEQ ID NO: 2429106 - protein, 10 aa, Entamoeba dispar
HEEANPVEDK

SEQ ID NO: 2429107 - protein, 8 aa, Entamoeba dispar
HEEATPIE

SEQ ID NO: 2429108 - protein, 4 aa, Entamoeba dispar
HEEE

SEQ ID NO: 2429109 - protein, 11 aa, Entamoeba dispar
HEEEDGEYSQV

SEQ ID NO: 2429110 - protein, 12 aa, Entamoeba dispar
HEEEKQLSSTYQ

SEQ ID NO: 2429111 - protein, 5 aa, Entamoeba dispar
HEEEM

SEQ ID NO: 2429112 - protein, 5 aa, Entamoeba dispar
HEEEQ

SEQ ID NO: 2429113 - protein, 15 aa, Entamoeba dispar
HEEKEKTGKQLNNAN

SEQ ID NO: 2429114 - protein, 6 aa, Entamoeba dispar
HEEKHQ

SEQ ID NO: 2429115 - protein, 6 aa, Entamoeba dispar
HEELPS

SEQ ID NO: 2429116 - protein, 4 aa, Entamoeba dispar
HEEQ

SEQ ID NO: 2429117 - protein, 30 aa, Entamoeba dispar
HEEQEREQRIAEEERKTEEIKQKRREEEKK

SEQ ID NO: 2429118 - protein, 22 aa, Entamoeba dispar
HEEQEYEEDEEQQEQDIPEEET

SEQ ID NO: 2429119 - protein, 22 aa, Entamoeba dispar
HEEQKKAADIRRKKNEKRYGKK

SEQ ID NO: 2429120 - protein, 6 aa, Entamoeba dispar
HEEQSA

SEQ ID NO: 2429121 - protein, 9 aa, Entamoeba dispar
HEERIKENG

SEQ ID NO: 2429122 - protein, 28 aa, Entamoeba dispar
HEESEAKLRDISTKCKELDSQLSEKSIQ

SEQ ID NO: 2429123 - protein, 6 aa, Entamoeba dispar
HEETPD

SEQ ID NO: 2429124 - protein, 8 aa, Entamoeba dispar
HEEYKNNT

SEQ ID NO: 2429125 - protein, 5 aa, Entamoeba dispar
HEGIP

SEQ ID NO: 2429126 - protein, 12 aa, Entamoeba dispar
HEGNKNQQQRRS

SEQ ID NO: 2429127 - protein, 6 aa, Entamoeba dispar
HEGNSI

SEQ ID NO: 2429128 - protein, 9 aa, Entamoeba dispar
HEGSMDDRN

SEQ ID NO: 2429129 - protein, 4 aa, Entamoeba dispar
HEIE

SEQ ID NO: 2429130 - protein, 6 aa, Entamoeba dispar
HEIHQD

SEQ ID NO: 2429131 - protein, 12 aa, Entamoeba dispar
HEITPYEKELTA

SEQ ID NO: 2429132 - protein, 23 aa, Entamoeba dispar
HEKEERENELKEQVKKVEEEKSK

SEQ ID NO: 2429133 - protein, 14 aa, Entamoeba dispar
HEKEYQAKKNWNQQ

SEQ ID NO: 2429134 - protein, 13 aa, Entamoeba dispar
HEKKQSKRRTLQC

SEQ ID NO: 2429135 - protein, 6 aa, Entamoeba dispar
HEKPIT

SEQ ID NO: 2429136 - protein, 11 aa, Entamoeba dispar
HEKRKKKEETV

SEQ ID NO: 2429137 - protein, 15 aa, Entamoeba dispar
HEKSCETSKSGTTST

SEQ ID NO: 2429138 - protein, 9 aa, Entamoeba dispar
HEKSPSNNI

SEQ ID NO: 2429139 - protein, 4 aa, Entamoeba dispar
HEKT

SEQ ID NO: 2429140 - protein, 8 aa, Entamoeba dispar
HEKYEEEG

SEQ ID NO: 2429141 - protein, 6 aa, Entamoeba dispar
HELADA

SEQ ID NO: 2429142 - protein, 11 aa, Entamoeba dispar
HELDPKNPTYR

SEQ ID NO: 2429143 - protein, 5 aa, Entamoeba dispar
HEMTG

SEQ ID NO: 2429144 - protein, 9 aa, Entamoeba dispar
HENEEKANA

SEQ ID NO: 2429145 - protein, 5 aa, Entamoeba dispar
HENEY

SEQ ID NO: 2429146 - protein, 6 aa, Entamoeba dispar
HENFPE

SEQ ID NO: 2429147 - protein, 12 aa, Entamoeba dispar
HENGEVSAVETC

SEQ ID NO: 2429148 - protein, 16 aa, Entamoeba dispar
HENPPLPSRTFVHKTM

SEQ ID NO: 2429149 - protein, 7 aa, Entamoeba dispar
HENREEA

SEQ ID NO: 2429150 - protein, 13 aa, Entamoeba dispar
HENRNETDDSSQI

SEQ ID NO: 2429151 - protein, 11 aa, Entamoeba dispar
HENRRKNTSYF

SEQ ID NO: 2429152 - protein, 4 aa, Entamoeba dispar
HENS

SEQ ID NO: 2429153 - protein, 36 aa, Entamoeba dispar
HENSISSFSGHSIPSTLRSTQSVTPQPNKNNTKSCS

SEQ ID NO: 2429154 - protein, 6 aa, Entamoeba dispar
HEPNIS

SEQ ID NO: 2429155 - protein, 8 aa, Entamoeba dispar
HEPNKDDI

SEQ ID NO: 2429156 - protein, 20 aa, Entamoeba dispar
HEPNQKTDEILQGKSRYADV

SEQ ID NO: 2429157 - protein, 4 aa, Entamoeba dispar
HEPS

SEQ ID NO: 2429158 - protein, 4 aa, Entamoeba dispar
HEQE

SEQ ID NO: 2429159 - protein, 10 aa, Entamoeba dispar
HEQGNDNGGL

SEQ ID NO: 2429160 - protein, 5 aa, Entamoeba dispar
HEQKT

SEQ ID NO: 2429161 - protein, 8 aa, Entamoeba dispar
HEQLASAE

SEQ ID NO: 2429162 - protein, 6 aa, Entamoeba dispar
HERDLD

SEQ ID NO: 2429163 - protein, 16 aa, Entamoeba dispar
HEREKYGNTIPPEVTS

SEQ ID NO: 2429164 - protein, 9 aa, Entamoeba dispar
HERGDSGRV

SEQ ID NO: 2429165 - protein, 17 aa, Entamoeba dispar
HERGKSDTTSDQTQQKV

SEQ ID NO: 2429166 - protein, 35 aa, Entamoeba dispar
HERGKSDTTSDQTQQKVKTNSPFQHATLKPKFNFF

SEQ ID NO: 2429167 - protein, 6 aa, Entamoeba dispar
HERTIS

SEQ ID NO: 2429168 - protein, 5 aa, Entamoeba dispar
HERTV

SEQ ID NO: 2429169 - protein, 6 aa, Entamoeba dispar
HERTVS

SEQ ID NO: 2429170 - protein, 5 aa, Entamoeba dispar
HESFS

SEQ ID NO: 2429171 - protein, 9 aa, Entamoeba dispar
HESIESNEI

SEQ ID NO: 2429172 - protein, 7 aa, Entamoeba dispar
HESKDDI

SEQ ID NO: 2429173 - protein, 5 aa, Entamoeba dispar
HESKM

SEQ ID NO: 2429174 - protein, 59 aa, Entamoeba dispar
HESQQSNQHSEKHKNEKKPQKGGEEKKRKKTKTRSRMKNVKKDKRPDHLKPSYLQNTNS

SEQ ID NO: 2429175 - protein, 5 aa, Entamoeba dispar
HESRI

SEQ ID NO: 2429176 - protein, 5 aa, Entamoeba dispar
HESRM

SEQ ID NO: 2429177 - protein, 5 aa, Entamoeba dispar
HESRV

SEQ ID NO: 2429178 - protein, 4 aa, Entamoeba dispar
HESV

SEQ ID NO: 2429179 - protein, 6 aa, Entamoeba dispar
HESVAK

SEQ ID NO: 2429180 - protein, 7 aa, Entamoeba dispar
HETEAAK

SEQ ID NO: 2429181 - protein, 7 aa, Entamoeba dispar
HETESKH

SEQ ID NO: 2429182 - protein, 7 aa, Entamoeba dispar
HETIPTQ

SEQ ID NO: 2429183 - protein, 14 aa, Entamoeba dispar
HETKEQLAQHNIFL

SEQ ID NO: 2429184 - protein, 9 aa, Entamoeba dispar
HETKFSADQ

SEQ ID NO: 2429185 - protein, 9 aa, Entamoeba dispar
HETKKKYCD

SEQ ID NO: 2429186 - protein, 7 aa, Entamoeba dispar
HETNERL

SEQ ID NO: 2429187 - protein, 7 aa, Entamoeba dispar
HETNTYS

SEQ ID NO: 2429188 - protein, 9 aa, Entamoeba dispar
HETQTARPL

SEQ ID NO: 2429189 - protein, 12 aa, Entamoeba dispar
HETRSITTQNQF

SEQ ID NO: 2429190 - protein, 19 aa, Entamoeba dispar
HETTTPIQNGWSSISVIEL

SEQ ID NO: 2429191 - protein, 8 aa, Entamoeba dispar
HFDKSKSS

SEQ ID NO: 2429192 - protein, 41 aa, Entamoeba dispar
HFDTPTKKVQVQTKQSSPNIQNPSEFQPKSFNTPIKRRSEY

SEQ ID NO: 2429193 - protein, 6 aa, Entamoeba dispar
HFEDSK

SEQ ID NO: 2429194 - protein, 14 aa, Entamoeba dispar
HFSDKREKLKKSMT

SEQ ID NO: 2429195 - protein, 10 aa, Entamoeba dispar
HFTDPTEEDT

SEQ ID NO: 2429196 - protein, 13 aa, Entamoeba dispar
HGCSEKTATRRQE

SEQ ID NO: 2429197 - protein, 16 aa, Entamoeba dispar
HGDACNKTHIKPESSQ

SEQ ID NO: 2429198 - protein, 5 aa, Entamoeba dispar
HGDES

SEQ ID NO: 2429199 - protein, 8 aa, Entamoeba dispar
HGDGDGLC

SEQ ID NO: 2429200 - protein, 10 aa, Entamoeba dispar
HGDGVEEAFK

SEQ ID NO: 2429201 - protein, 14 aa, Entamoeba dispar
HGDMSSRKFSKDKR

SEQ ID NO: 2429202 - protein, 8 aa, Entamoeba dispar
HGDSCTRN

SEQ ID NO: 2429203 - protein, 6 aa, Entamoeba dispar
HGEAKK

SEQ ID NO: 2429204 - protein, 4 aa, Entamoeba dispar
HGEC

SEQ ID NO: 2429205 - protein, 11 aa, Entamoeba dispar
HGECKRKSCSK

SEQ ID NO: 2429206 - protein, 10 aa, Entamoeba dispar
HGEDEKNIGY

SEQ ID NO: 2429207 - protein, 12 aa, Entamoeba dispar
HGEDEKNSGYSI

SEQ ID NO: 2429208 - protein, 6 aa, Entamoeba dispar
HGEDQW

SEQ ID NO: 2429209 - protein, 6 aa, Entamoeba dispar
HGEKVD

SEQ ID NO: 2429210 - protein, 6 aa, Entamoeba dispar
HGEPRT

SEQ ID NO: 2429211 - protein, 42 aa, Entamoeba dispar
HGEPTYEETPSQNPEIEENIETEEQPKEEVYSEAQQEVEDYQ

SEQ ID NO: 2429212 - protein, 4 aa, Entamoeba dispar
HGET

SEQ ID NO: 2429213 - protein, 10 aa, Entamoeba dispar
HGGDEDSVNS

SEQ ID NO: 2429214 - protein, 9 aa, Entamoeba dispar
HGGDTVSKL

SEQ ID NO: 2429215 - protein, 6 aa, Entamoeba dispar
HGGDYG

SEQ ID NO: 2429216 - protein, 6 aa, Entamoeba dispar
HGGGPI

SEQ ID NO: 2429217 - protein, 7 aa, Entamoeba dispar
HGGIQAS

SEQ ID NO: 2429218 - protein, 5 aa, Entamoeba dispar
HGGIS

SEQ ID NO: 2429219 - protein, 13 aa, Entamoeba dispar
HGGKEVNGKKNEL

SEQ ID NO: 2429220 - protein, 8 aa, Entamoeba dispar
HGGNNADV

SEQ ID NO: 2429221 - protein, 7 aa, Entamoeba dispar
HGGPSNK

SEQ ID NO: 2429222 - protein, 7 aa, Entamoeba dispar
HGGSETS

SEQ ID NO: 2429223 - protein, 15 aa, Entamoeba dispar
HGGVDDGIKEDDEID

SEQ ID NO: 2429224 - protein, 16 aa, Entamoeba dispar
HGHGGYECGDKGEWST

SEQ ID NO: 2429225 - protein, 6 aa, Entamoeba dispar
HGIGKK

SEQ ID NO: 2429226 - protein, 5 aa, Entamoeba dispar
HGINE

SEQ ID NO: 2429227 - protein, 6 aa, Entamoeba dispar
HGKEEE

SEQ ID NO: 2429228 - protein, 8 aa, Entamoeba dispar
HGKETPYS

SEQ ID NO: 2429229 - protein, 10 aa, Entamoeba dispar
HGKEVRDEKV

SEQ ID NO: 2429230 - protein, 7 aa, Entamoeba dispar
HGKKQQP

SEQ ID NO: 2429231 - protein, 8 aa, Entamoeba dispar
HGKPTNKM

SEQ ID NO: 2429232 - protein, 9 aa, Entamoeba dispar
HGKRRTRGV

SEQ ID NO: 2429233 - protein, 5 aa, Entamoeba dispar
HGKSA

SEQ ID NO: 2429234 - protein, 6 aa, Entamoeba dispar
HGKSTV

SEQ ID NO: 2429235 - protein, 5 aa, Entamoeba dispar
HGKTS

SEQ ID NO: 2429236 - protein, 12 aa, Entamoeba dispar
HGKVDPKTLDPE

SEQ ID NO: 2429237 - protein, 6 aa, Entamoeba dispar
HGLENG

SEQ ID NO: 2429238 - protein, 8 aa, Entamoeba dispar
HGLSPDGI

SEQ ID NO: 2429239 - protein, 5 aa, Entamoeba dispar
HGNMS

SEQ ID NO: 2429240 - protein, 10 aa, Entamoeba dispar
HGNPINNQNT

SEQ ID NO: 2429241 - protein, 8 aa, Entamoeba dispar
HGNSIPKH

SEQ ID NO: 2429242 - protein, 6 aa, Entamoeba dispar
HGNSQD

SEQ ID NO: 2429243 - protein, 5 aa, Entamoeba dispar
HGNVE

SEQ ID NO: 2429244 - protein, 8 aa, Entamoeba dispar
HGPAVNDS

SEQ ID NO: 2429245 - protein, 5 aa, Entamoeba dispar
HGPKG

SEQ ID NO: 2429246 - protein, 7 aa, Entamoeba dispar
HGPTKDG

SEQ ID NO: 2429247 - protein, 6 aa, Entamoeba dispar
HGQPIT

SEQ ID NO: 2429248 - protein, 7 aa, Entamoeba dispar
HGQRTAE

SEQ ID NO: 2429249 - protein, 58 aa, Entamoeba dispar
HGRGLTRGRKPQNSRTKMRAKYEKRTKKIKQTNTESHSFNYKGEKKIEDGKKLSRKLD

SEQ ID NO: 2429250 - protein, 6 aa, Entamoeba dispar
HGSDEK

SEQ ID NO: 2429251 - protein, 10 aa, Entamoeba dispar
HGSDPELSTV

SEQ ID NO: 2429252 - protein, 8 aa, Entamoeba dispar
HGSEEDIH

SEQ ID NO: 2429253 - protein, 5 aa, Entamoeba dispar
HGSGK

SEQ ID NO: 2429254 - protein, 6 aa, Entamoeba dispar
HGSNDY

SEQ ID NO: 2429255 - protein, 8 aa, Entamoeba dispar
HGSTTDNI

SEQ ID NO: 2429256 - protein, 6 aa, Entamoeba dispar
HGTGHG

SEQ ID NO: 2429257 - protein, 4 aa, Entamoeba dispar
HGTK

SEQ ID NO: 2429258 - protein, 18 aa, Entamoeba dispar
HGTKDRTIAGNETEYQSR

SEQ ID NO: 2429259 - protein, 12 aa, Entamoeba dispar
HGTQQMLPPANE

SEQ ID NO: 2429260 - protein, 5 aa, Entamoeba dispar
HGTRS

SEQ ID NO: 2429261 - protein, 6 aa, Entamoeba dispar
HGTSDG

SEQ ID NO: 2429262 - protein, 6 aa, Entamoeba dispar
HGYGTG

SEQ ID NO: 2429263 - protein, 6 aa, Entamoeba dispar
HGYKEA

SEQ ID NO: 2429264 - protein, 7 aa, Entamoeba dispar
HHGQDAA

SEQ ID NO: 2429265 - protein, 9 aa, Entamoeba dispar
HHKRKVPEN

SEQ ID NO: 2429266 - protein, 5 aa, Entamoeba dispar
HHPGA

SEQ ID NO: 2429267 - protein, 5 aa, Entamoeba dispar
HHQRG

SEQ ID NO: 2429268 - protein, 7 aa, Entamoeba dispar
HHRNSVN

SEQ ID NO: 2429269 - protein, 12 aa, Entamoeba dispar
HHSTSPKQFETP

SEQ ID NO: 2429270 - protein, 10 aa, Entamoeba dispar
HHTQEQHKTT

SEQ ID NO: 2429271 - protein, 4 aa, Entamoeba dispar
HHTS

SEQ ID NO: 2429272 - protein, 10 aa, Entamoeba dispar
HHYPDTETIK

SEQ ID NO: 2429273 - protein, 16 aa, Entamoeba dispar
HIDNESINERKEEIKK

SEQ ID NO: 2429274 - protein, 30 aa, Entamoeba dispar
HIEEEQEEAEQNEQEINQKGNSNDTSNDEF

SEQ ID NO: 2429275 - protein, 5 aa, Entamoeba dispar
HIEPQ

SEQ ID NO: 2429276 - protein, 8 aa, Entamoeba dispar
HIGNKKSD

SEQ ID NO: 2429277 - protein, 6 aa, Entamoeba dispar
HIGNPN

SEQ ID NO: 2429278 - protein, 7 aa, Entamoeba dispar
HIGQPKS

SEQ ID NO: 2429279 - protein, 6 aa, Entamoeba dispar
HIGSTN

SEQ ID NO: 2429280 - protein, 38 aa, Entamoeba dispar
HIGTGETARKRPEPKTNKEKMEAAEKAKEKGTKAFKDT

SEQ ID NO: 2429281 - protein, 6 aa, Entamoeba dispar
HIIGSE

SEQ ID NO: 2429282 - protein, 9 aa, Entamoeba dispar
HIKDKNVQK

SEQ ID NO: 2429283 - protein, 9 aa, Entamoeba dispar
HIKKSGKLE

SEQ ID NO: 2429284 - protein, 17 aa, Entamoeba dispar
HIKNQKEDVKKEKGNLV

SEQ ID NO: 2429285 - protein, 15 aa, Entamoeba dispar
HIKSESNAKKVASEN

SEQ ID NO: 2429286 - protein, 9 aa, Entamoeba dispar
HINPPSPLT

SEQ ID NO: 2429287 - protein, 7 aa, Entamoeba dispar
HINPQEK

SEQ ID NO: 2429288 - protein, 15 aa, Entamoeba dispar
HINQESSNKKSKEIS

SEQ ID NO: 2429289 - protein, 4 aa, Entamoeba dispar
HIPQ

SEQ ID NO: 2429290 - protein, 5 aa, Entamoeba dispar
HIPQG

SEQ ID NO: 2429291 - protein, 15 aa, Entamoeba dispar
HIQDPETPGYIKALL

SEQ ID NO: 2429292 - protein, 13 aa, Entamoeba dispar
HIQTPSKKSCCFL

SEQ ID NO: 2429293 - protein, 6 aa, Entamoeba dispar
HISNEA

SEQ ID NO: 2429294 - protein, 12 aa, Entamoeba dispar
HISNKENSTFGI

SEQ ID NO: 2429295 - protein, 9 aa, Entamoeba dispar
HISNNGNKQ

SEQ ID NO: 2429296 - protein, 5 aa, Entamoeba dispar
HITDG

SEQ ID NO: 2429297 - protein, 7 aa, Entamoeba dispar
HKAEKKE

SEQ ID NO: 2429298 - protein, 10 aa, Entamoeba dispar
HKATDPKEEE

SEQ ID NO: 2429299 - protein, 12 aa, Entamoeba dispar
HKDCERAADSLF

SEQ ID NO: 2429300 - protein, 6 aa, Entamoeba dispar
HKDGSI

SEQ ID NO: 2429301 - protein, 8 aa, Entamoeba dispar
HKDGTKQK

SEQ ID NO: 2429302 - protein, 8 aa, Entamoeba dispar
HKDIEAAK

SEQ ID NO: 2429303 - protein, 22 aa, Entamoeba dispar
HKDIEAAKKAVYTAKKNAEING

SEQ ID NO: 2429304 - protein, 8 aa, Entamoeba dispar
HKDIEATK

SEQ ID NO: 2429305 - protein, 9 aa, Entamoeba dispar
HKDKNYQQG

SEQ ID NO: 2429306 - protein, 8 aa, Entamoeba dispar
HKDKRSQV

SEQ ID NO: 2429307 - protein, 5 aa, Entamoeba dispar
HKDNL

SEQ ID NO: 2429308 - protein, 30 aa, Entamoeba dispar
HKDQKTNNLKPKKIKKEEIKQKKNYEKGTI

SEQ ID NO: 2429309 - protein, 6 aa, Entamoeba dispar
HKDQRN

SEQ ID NO: 2429310 - protein, 7 aa, Entamoeba dispar
HKDQYHS

SEQ ID NO: 2429311 - protein, 4 aa, Entamoeba dispar
HKDS

SEQ ID NO: 2429312 - protein, 45 aa, Entamoeba dispar
HKDTYEETKKQREKQEQKRKKQEEKARFEKSSQVKSSSTSLPTSI

SEQ ID NO: 2429313 - protein, 9 aa, Entamoeba dispar
HKECSENGL

SEQ ID NO: 2429314 - protein, 8 aa, Entamoeba dispar
HKEEETLE

SEQ ID NO: 2429315 - protein, 9 aa, Entamoeba dispar
HKEEETVER

SEQ ID NO: 2429316 - protein, 6 aa, Entamoeba dispar
HKEENT

SEQ ID NO: 2429317 - protein, 6 aa, Entamoeba dispar
HKEEQI

SEQ ID NO: 2429318 - protein, 16 aa, Entamoeba dispar
HKEKKLSKKEISNGIE

SEQ ID NO: 2429319 - protein, 4 aa, Entamoeba dispar
HKEL

SEQ ID NO: 2429320 - protein, 7 aa, Entamoeba dispar
HKENNDK

SEQ ID NO: 2429321 - protein, 10 aa, Entamoeba dispar
HKEQEDKLSY

SEQ ID NO: 2429322 - protein, 8 aa, Entamoeba dispar
HKESGLSE

SEQ ID NO: 2429323 - protein, 139 aa, Entamoeba dispar
HKESTNPPSEVSTTQNCEEKKEEIKTPKSSKEIKEEKKKAEELKKEEEKKKKEALKEEERRKKEEKKRAEELRKEEERKKKEEKKEEERRKKEEKKNKKSQKEIKEESHPEEHLNEDKDEHKSDENEEIKKEETSTKQE

SEQ ID NO: 2429324 - protein, 11 aa, Entamoeba dispar
HKFGNESNRVL

SEQ ID NO: 2429325 - protein, 8 aa, Entamoeba dispar
HKFKTNDS

SEQ ID NO: 2429326 - protein, 37 aa, Entamoeba dispar
HKGEDAPKTSSPSNEKKSEKNEKPKKEKGKKKGGCVM

SEQ ID NO: 2429327 - protein, 13 aa, Entamoeba dispar
HKGEITDIQSDAN

SEQ ID NO: 2429328 - protein, 5 aa, Entamoeba dispar
HKGGS

SEQ ID NO: 2429329 - protein, 6 aa, Entamoeba dispar
HKGHYG

SEQ ID NO: 2429330 - protein, 28 aa, Entamoeba dispar
HKGKSLDFSSSKALSESLDKCGTNEDPV

SEQ ID NO: 2429331 - protein, 15 aa, Entamoeba dispar
HKGLSGNKTAKDMKQ

SEQ ID NO: 2429332 - protein, 10 aa, Entamoeba dispar
HKGNDLNKYG

SEQ ID NO: 2429333 - protein, 14 aa, Entamoeba dispar
HKGPTVMKEEERNI

SEQ ID NO: 2429334 - protein, 6 aa, Entamoeba dispar
HKGPVR

SEQ ID NO: 2429335 - protein, 11 aa, Entamoeba dispar
HKIKNPNAEIS

SEQ ID NO: 2429336 - protein, 9 aa, Entamoeba dispar
HKINNEEYI

SEQ ID NO: 2429337 - protein, 18 aa, Entamoeba dispar
HKISNSSLSKTHLTTTPK

SEQ ID NO: 2429338 - protein, 6 aa, Entamoeba dispar
HKITQP

SEQ ID NO: 2429339 - protein, 7 aa, Entamoeba dispar
HKKAPIG

SEQ ID NO: 2429340 - protein, 14 aa, Entamoeba dispar
HKKINQQKERNRKW

SEQ ID NO: 2429341 - protein, 9 aa, Entamoeba dispar
HKKISTTQT

SEQ ID NO: 2429342 - protein, 13 aa, Entamoeba dispar
HKKKESDTKPPKI

SEQ ID NO: 2429343 - protein, 7 aa, Entamoeba dispar
HKKNCDG

SEQ ID NO: 2429344 - protein, 8 aa, Entamoeba dispar
HKKQEINN

SEQ ID NO: 2429345 - protein, 9 aa, Entamoeba dispar
HKKQSSIKK

SEQ ID NO: 2429346 - protein, 7 aa, Entamoeba dispar
HKKRSTK

SEQ ID NO: 2429347 - protein, 15 aa, Entamoeba dispar
HKKTKKEREEEKKPI

SEQ ID NO: 2429348 - protein, 8 aa, Entamoeba dispar
HKKTTTIF

SEQ ID NO: 2429349 - protein, 4 aa, Entamoeba dispar
HKKY

SEQ ID NO: 2429350 - protein, 4 aa, Entamoeba dispar
HKME

SEQ ID NO: 2429351 - protein, 11 aa, Entamoeba dispar
HKNERIRSEGL

SEQ ID NO: 2429352 - protein, 6 aa, Entamoeba dispar
HKNGQY

SEQ ID NO: 2429353 - protein, 6 aa, Entamoeba dispar
HKNGTA

SEQ ID NO: 2429354 - protein, 5 aa, Entamoeba dispar
HKNIN

SEQ ID NO: 2429355 - protein, 7 aa, Entamoeba dispar
HKNKKNG

SEQ ID NO: 2429356 - protein, 6 aa, Entamoeba dispar
HKPINK

SEQ ID NO: 2429357 - protein, 7 aa, Entamoeba dispar
HKPKHNA

SEQ ID NO: 2429358 - protein, 4 aa, Entamoeba dispar
HKPL

SEQ ID NO: 2429359 - protein, 6 aa, Entamoeba dispar
HKPLID

SEQ ID NO: 2429360 - protein, 7 aa, Entamoeba dispar
HKPNEEG

SEQ ID NO: 2429361 - protein, 8 aa, Entamoeba dispar
HKPSLQSE

SEQ ID NO: 2429362 - protein, 12 aa, Entamoeba dispar
HKPTSKKGYCKN

SEQ ID NO: 2429363 - protein, 5 aa, Entamoeba dispar
HKQDD

SEQ ID NO: 2429364 - protein, 10 aa, Entamoeba dispar
HKQEKKERKL

SEQ ID NO: 2429365 - protein, 15 aa, Entamoeba dispar
HKQEKTGNYPTTSEH

SEQ ID NO: 2429366 - protein, 9 aa, Entamoeba dispar
HKQKELEKQ

SEQ ID NO: 2429367 - protein, 6 aa, Entamoeba dispar
HKQPTF

SEQ ID NO: 2429368 - protein, 8 aa, Entamoeba dispar
HKQQEQED

SEQ ID NO: 2429369 - protein, 38 aa, Entamoeba dispar
HKQQKSSSRRRGRSYSRHRSSHRREHSSRSRSDSYERR

SEQ ID NO: 2429370 - protein, 38 aa, Entamoeba dispar
HKQQKSSSRRRGRSYSRHRSSHRRGHSSRSRSDSYERR

SEQ ID NO: 2429371 - protein, 9 aa, Entamoeba dispar
HKQSIKPNA

SEQ ID NO: 2429372 - protein, 4 aa, Entamoeba dispar
HKRE

SEQ ID NO: 2429373 - protein, 6 aa, Entamoeba dispar
HKRLSA

SEQ ID NO: 2429374 - protein, 6 aa, Entamoeba dispar
HKRPIT

SEQ ID NO: 2429375 - protein, 10 aa, Entamoeba dispar
HKRRALKGNI

SEQ ID NO: 2429376 - protein, 23 aa, Entamoeba dispar
HKRTTTSISFEKNGNRFLSGGND

SEQ ID NO: 2429377 - protein, 5 aa, Entamoeba dispar
HKSEI

SEQ ID NO: 2429378 - protein, 14 aa, Entamoeba dispar
HKSGLLGENPLGIP

SEQ ID NO: 2429379 - protein, 29 aa, Entamoeba dispar
HKSQCKEEIKRSEPILPKRKDKKTNYLSD

SEQ ID NO: 2429380 - protein, 8 aa, Entamoeba dispar
HKSSRGAG

SEQ ID NO: 2429381 - protein, 5 aa, Entamoeba dispar
HKSYD

SEQ ID NO: 2429382 - protein, 5 aa, Entamoeba dispar
HKTEI

SEQ ID NO: 2429383 - protein, 4 aa, Entamoeba dispar
HKTI

SEQ ID NO: 2429384 - protein, 8 aa, Entamoeba dispar
HKTIADTQ

SEQ ID NO: 2429385 - protein, 6 aa, Entamoeba dispar
HKTKDF

SEQ ID NO: 2429386 - protein, 13 aa, Entamoeba dispar
HKTTGAESQRYKQ

SEQ ID NO: 2429387 - protein, 9 aa, Entamoeba dispar
HKTTKEGIA

SEQ ID NO: 2429388 - protein, 7 aa, Entamoeba dispar
HKVEEAQ

SEQ ID NO: 2429389 - protein, 13 aa, Entamoeba dispar
HKVTSACEQKRMK

SEQ ID NO: 2429390 - protein, 10 aa, Entamoeba dispar
HKYAEAQKAI

SEQ ID NO: 2429391 - protein, 17 aa, Entamoeba dispar
HLAEKKGNSTSIGEPKK

SEQ ID NO: 2429392 - protein, 9 aa, Entamoeba dispar
HLEDDNESL

SEQ ID NO: 2429393 - protein, 10 aa, Entamoeba dispar
HLGAGEKSHC

SEQ ID NO: 2429394 - protein, 4 aa, Entamoeba dispar
HLGE

SEQ ID NO: 2429395 - protein, 4 aa, Entamoeba dispar
HLGT

SEQ ID NO: 2429396 - protein, 9 aa, Entamoeba dispar
HLGTTTEDI

SEQ ID NO: 2429397 - protein, 5 aa, Entamoeba dispar
HLKDE

SEQ ID NO: 2429398 - protein, 10 aa, Entamoeba dispar
HLKEKEAGNI

SEQ ID NO: 2429399 - protein, 11 aa, Entamoeba dispar
HLKEKEQGNEC

SEQ ID NO: 2429400 - protein, 5 aa, Entamoeba dispar
HLKGK

SEQ ID NO: 2429401 - protein, 9 aa, Entamoeba dispar
HLKKSGKLE

SEQ ID NO: 2429402 - protein, 5 aa, Entamoeba dispar
HLKNN

SEQ ID NO: 2429403 - protein, 10 aa, Entamoeba dispar
HLNETSQIEN

SEQ ID NO: 2429404 - protein, 13 aa, Entamoeba dispar
HLNGTNPQHTSAS

SEQ ID NO: 2429405 - protein, 5 aa, Entamoeba dispar
HLPES

SEQ ID NO: 2429406 - protein, 15 aa, Entamoeba dispar
HLPKPKEENEKKKPK

SEQ ID NO: 2429407 - protein, 13 aa, Entamoeba dispar
HLPNKQKQSPPSL

SEQ ID NO: 2429408 - protein, 12 aa, Entamoeba dispar
HLPQGDNKEIGE

SEQ ID NO: 2429409 - protein, 7 aa, Entamoeba dispar
HLPTDTV

SEQ ID NO: 2429410 - protein, 15 aa, Entamoeba dispar
HLRQEVKSESTTEEL

SEQ ID NO: 2429411 - protein, 7 aa, Entamoeba dispar
HLSENTK

SEQ ID NO: 2429412 - protein, 12 aa, Entamoeba dispar
HLSTGKKGTLKA

SEQ ID NO: 2429413 - protein, 7 aa, Entamoeba dispar
HLTEDSQ

SEQ ID NO: 2429414 - protein, 13 aa, Entamoeba dispar
HLTPEEARNKTIK

SEQ ID NO: 2429415 - protein, 15 aa, Entamoeba dispar
HLTSGNNIPEAKKTL

SEQ ID NO: 2429416 - protein, 6 aa, Entamoeba dispar
HLTSKS

SEQ ID NO: 2429417 - protein, 6 aa, Entamoeba dispar
HMNSNT

SEQ ID NO: 2429418 - protein, 5 aa, Entamoeba dispar
HNAAE

SEQ ID NO: 2429419 - protein, 7 aa, Entamoeba dispar
HNAIPSH

SEQ ID NO: 2429420 - protein, 6 aa, Entamoeba dispar
HNAPEY

SEQ ID NO: 2429421 - protein, 15 aa, Entamoeba dispar
HNAQQDKWKSQPVDS

SEQ ID NO: 2429422 - protein, 7 aa, Entamoeba dispar
HNCTDQE

SEQ ID NO: 2429423 - protein, 5 aa, Entamoeba dispar
HNDDM

SEQ ID NO: 2429424 - protein, 21 aa, Entamoeba dispar
HNDEDEDDYDWENGNEDSKKI

SEQ ID NO: 2429425 - protein, 8 aa, Entamoeba dispar
HNDGNGRL

SEQ ID NO: 2429426 - protein, 4 aa, Entamoeba dispar
HNDK

SEQ ID NO: 2429427 - protein, 9 aa, Entamoeba dispar
HNDKANSSL

SEQ ID NO: 2429428 - protein, 10 aa, Entamoeba dispar
HNDNTITPTP

SEQ ID NO: 2429429 - protein, 10 aa, Entamoeba dispar
HNDRNGPAEI

SEQ ID NO: 2429430 - protein, 62 aa, Entamoeba dispar
HNDSVRSENELHTYSNSLSPKDEPLNSSSKIEDLNDEPLENVKDNNSQSDDWKISAKDSQIM

SEQ ID NO: 2429431 - protein, 8 aa, Entamoeba dispar
HNDTEVKQ

SEQ ID NO: 2429432 - protein, 10 aa, Entamoeba dispar
HNEEEDGDDL

SEQ ID NO: 2429433 - protein, 4 aa, Entamoeba dispar
HNEH

SEQ ID NO: 2429434 - protein, 6 aa, Entamoeba dispar
HNEIPQ

SEQ ID NO: 2429435 - protein, 5 aa, Entamoeba dispar
HNEKS

SEQ ID NO: 2429436 - protein, 11 aa, Entamoeba dispar
HNETDNQMDEE

SEQ ID NO: 2429437 - protein, 7 aa, Entamoeba dispar
HNETPIK

SEQ ID NO: 2429438 - protein, 7 aa, Entamoeba dispar
HNFDPSP

SEQ ID NO: 2429439 - protein, 9 aa, Entamoeba dispar
HNFGNKGAF

SEQ ID NO: 2429440 - protein, 4 aa, Entamoeba dispar
HNGA

SEQ ID NO: 2429441 - protein, 7 aa, Entamoeba dispar
HNGEEAA

SEQ ID NO: 2429442 - protein, 11 aa, Entamoeba dispar
HNGEHSAENEL

SEQ ID NO: 2429443 - protein, 10 aa, Entamoeba dispar
HNGGKDNANY

SEQ ID NO: 2429444 - protein, 7 aa, Entamoeba dispar
HNGHEAA

SEQ ID NO: 2429445 - protein, 5 aa, Entamoeba dispar
HNGIN

SEQ ID NO: 2429446 - protein, 6 aa, Entamoeba dispar
HNGLEA

SEQ ID NO: 2429447 - protein, 12 aa, Entamoeba dispar
HNGNKNIEIDGT

SEQ ID NO: 2429448 - protein, 7 aa, Entamoeba dispar
HNGPNGQ

SEQ ID NO: 2429449 - protein, 7 aa, Entamoeba dispar
HNHSKKT

SEQ ID NO: 2429450 - protein, 16 aa, Entamoeba dispar
HNIKPSKYEPNKNNND

SEQ ID NO: 2429451 - protein, 10 aa, Entamoeba dispar
HNIKSRQVNE

SEQ ID NO: 2429452 - protein, 6 aa, Entamoeba dispar
HNINDS

SEQ ID NO: 2429453 - protein, 5 aa, Entamoeba dispar
HNKEY

SEQ ID NO: 2429454 - protein, 9 aa, Entamoeba dispar
HNKGEAENA

SEQ ID NO: 2429455 - protein, 4 aa, Entamoeba dispar
HNKK

SEQ ID NO: 2429456 - protein, 7 aa, Entamoeba dispar
HNKLEES

SEQ ID NO: 2429457 - protein, 8 aa, Entamoeba dispar
HNKPITAL

SEQ ID NO: 2429458 - protein, 6 aa, Entamoeba dispar
HNKPSE

SEQ ID NO: 2429459 - protein, 9 aa, Entamoeba dispar
HNKTNENSP

SEQ ID NO: 2429460 - protein, 13 aa, Entamoeba dispar
HNLATKKRYGNYN

SEQ ID NO: 2429461 - protein, 27 aa, Entamoeba dispar
HNLQSERKLPSQKKIKNKKVKTKKCIL

SEQ ID NO: 2429462 - protein, 6 aa, Entamoeba dispar
HNLYDK

SEQ ID NO: 2429463 - protein, 30 aa, Entamoeba dispar
HNNDQPVTGIPSQRNKHINSSSHTAVASSI

SEQ ID NO: 2429464 - protein, 6 aa, Entamoeba dispar
HNNELS

SEQ ID NO: 2429465 - protein, 6 aa, Entamoeba dispar
HNNERM

SEQ ID NO: 2429466 - protein, 7 aa, Entamoeba dispar
HNNKKQR

SEQ ID NO: 2429467 - protein, 6 aa, Entamoeba dispar
HNNSSD

SEQ ID NO: 2429468 - protein, 4 aa, Entamoeba dispar
HNNT

SEQ ID NO: 2429469 - protein, 10 aa, Entamoeba dispar
HNNTSGTKTV

SEQ ID NO: 2429470 - protein, 5 aa, Entamoeba dispar
HNPKL

SEQ ID NO: 2429471 - protein, 6 aa, Entamoeba dispar
HNPPEG

SEQ ID NO: 2429472 - protein, 7 aa, Entamoeba dispar
HNPQEDD

SEQ ID NO: 2429473 - protein, 7 aa, Entamoeba dispar
HNPSNLE

SEQ ID NO: 2429474 - protein, 5 aa, Entamoeba dispar
HNPSS

SEQ ID NO: 2429475 - protein, 8 aa, Entamoeba dispar
HNPTGTNF

SEQ ID NO: 2429476 - protein, 14 aa, Entamoeba dispar
HNQIKGTINPTQTD

SEQ ID NO: 2429477 - protein, 7 aa, Entamoeba dispar
HNQNNDK

SEQ ID NO: 2429478 - protein, 8 aa, Entamoeba dispar
HNQQKDEN

SEQ ID NO: 2429479 - protein, 9 aa, Entamoeba dispar
HNQSNTHST

SEQ ID NO: 2429480 - protein, 9 aa, Entamoeba dispar
HNQSPRNTY

SEQ ID NO: 2429481 - protein, 15 aa, Entamoeba dispar
HNQTKEKTIEESNTT

SEQ ID NO: 2429482 - protein, 10 aa, Entamoeba dispar
HNSEKNKMNA

SEQ ID NO: 2429483 - protein, 4 aa, Entamoeba dispar
HNSI

SEQ ID NO: 2429484 - protein, 6 aa, Entamoeba dispar
HNSKTY

SEQ ID NO: 2429485 - protein, 10 aa, Entamoeba dispar
HNSPTEQTYS

SEQ ID NO: 2429486 - protein, 4 aa, Entamoeba dispar
HNST

SEQ ID NO: 2429487 - protein, 8 aa, Entamoeba dispar
HNSYGTNV

SEQ ID NO: 2429488 - protein, 19 aa, Entamoeba dispar
HNTDLDAQTQTLKEETQKK

SEQ ID NO: 2429489 - protein, 7 aa, Entamoeba dispar
HNTEIKK

SEQ ID NO: 2429490 - protein, 5 aa, Entamoeba dispar
HNTGI

SEQ ID NO: 2429491 - protein, 5 aa, Entamoeba dispar
HNTMK

SEQ ID NO: 2429492 - protein, 12 aa, Entamoeba dispar
HNTNKTSRATQT

SEQ ID NO: 2429493 - protein, 34 aa, Entamoeba dispar
  misc_feature (13)..(14): Xaa can be any naturally occurring amino acid
HNTNVHQMNKVDXXTDGFSMKISIKLFKLSNMFS

SEQ ID NO: 2429494 - protein, 5 aa, Entamoeba dispar
HNTTI

SEQ ID NO: 2429495 - protein, 9 aa, Entamoeba dispar
HNVDGSKGF

SEQ ID NO: 2429496 - protein, 9 aa, Entamoeba dispar
HNVSDSEVM

SEQ ID NO: 2429497 - protein, 6 aa, Entamoeba dispar
HNYEPT

SEQ ID NO: 2429498 - protein, 38 aa, Entamoeba dispar
HNYSVKETSLKREGGEEQKTETSKTCPQDSKEENKTLV

SEQ ID NO: 2429499 - protein, 4 aa, Entamoeba dispar
HNYW

SEQ ID NO: 2429500 - protein, 5 aa, Entamoeba dispar
HNYYP

SEQ ID NO: 2429501 - protein, 12 aa, Entamoeba dispar
HPAAPYEKVTEE

SEQ ID NO: 2429502 - protein, 11 aa, Entamoeba dispar
HPAKLSNQKKV

SEQ ID NO: 2429503 - protein, 6 aa, Entamoeba dispar
HPASGY

SEQ ID NO: 2429504 - protein, 9 aa, Entamoeba dispar
HPASQRGIT

SEQ ID NO: 2429505 - protein, 6 aa, Entamoeba dispar
HPDDVN

SEQ ID NO: 2429506 - protein, 8 aa, Entamoeba dispar
HPDHENVK

SEQ ID NO: 2429507 - protein, 13 aa, Entamoeba dispar
HPDKHPDDKESLE

SEQ ID NO: 2429508 - protein, 17 aa, Entamoeba dispar
HPDKNPGDKNAEEKFKE

SEQ ID NO: 2429509 - protein, 19 aa, Entamoeba dispar
HPDKNPGDKNAEEKFKEVS

SEQ ID NO: 2429510 - protein, 10 aa, Entamoeba dispar
HPDKRVSADA

SEQ ID NO: 2429511 - protein, 13 aa, Entamoeba dispar
HPDPNNENSINYN

SEQ ID NO: 2429512 - protein, 7 aa, Entamoeba dispar
HPDQSDE

SEQ ID NO: 2429513 - protein, 17 aa, Entamoeba dispar
HPDSNIRKLTNAAFDSL

SEQ ID NO: 2429514 - protein, 22 aa, Entamoeba dispar
HPEDIKKKEAQQQKAKGNELYK

SEQ ID NO: 2429515 - protein, 8 aa, Entamoeba dispar
HPEDSELD

SEQ ID NO: 2429516 - protein, 4 aa, Entamoeba dispar
HPEE

SEQ ID NO: 2429517 - protein, 25 aa, Entamoeba dispar
HPEEEGSSIVDGKKVKADPEKVKEF

SEQ ID NO: 2429518 - protein, 8 aa, Entamoeba dispar
HPEETKEN

SEQ ID NO: 2429519 - protein, 12 aa, Entamoeba dispar
HPEFSKPNTYPI

SEQ ID NO: 2429520 - protein, 4 aa, Entamoeba dispar
HPEI

SEQ ID NO: 2429521 - protein, 11 aa, Entamoeba dispar
HPEKKDENGEY

SEQ ID NO: 2429522 - protein, 9 aa, Entamoeba dispar
HPENSNSAY

SEQ ID NO: 2429523 - protein, 4 aa, Entamoeba dispar
HPEQ

SEQ ID NO: 2429524 - protein, 8 aa, Entamoeba dispar
HPEQYEPV

SEQ ID NO: 2429525 - protein, 6 aa, Entamoeba dispar
HPETAE

SEQ ID NO: 2429526 - protein, 8 aa, Entamoeba dispar
HPEVDENG

SEQ ID NO: 2429527 - protein, 11 aa, Entamoeba dispar
HPEYNKKKSFI

SEQ ID NO: 2429528 - protein, 6 aa, Entamoeba dispar
HPFDPN

SEQ ID NO: 2429529 - protein, 10 aa, Entamoeba dispar
HPFNEEAEQN

SEQ ID NO: 2429530 - protein, 6 aa, Entamoeba dispar
HPGASA

SEQ ID NO: 2429531 - protein, 4 aa, Entamoeba dispar
HPGG

SEQ ID NO: 2429532 - protein, 4 aa, Entamoeba dispar
HPGI

SEQ ID NO: 2429533 - protein, 6 aa, Entamoeba dispar
HPGLES

SEQ ID NO: 2429534 - protein, 4 aa, Entamoeba dispar
HPIG

SEQ ID NO: 2429535 - protein, 21 aa, Entamoeba dispar
HPKAQPQFYDAENGEISIETE

SEQ ID NO: 2429536 - protein, 10 aa, Entamoeba dispar
HPKDFDPRQY

SEQ ID NO: 2429537 - protein, 31 aa, Entamoeba dispar
  misc_feature (13)..(14): Xaa can be any naturally occurring amino acid
HPKELQQKDLKRXXGELLQFRSYWIEKGIIP

SEQ ID NO: 2429538 - protein, 15 aa, Entamoeba dispar
HPKEPLVATGGGDGK

SEQ ID NO: 2429539 - protein, 19 aa, Entamoeba dispar
HPKPKKGQKAIVNEPPKEA

SEQ ID NO: 2429540 - protein, 7 aa, Entamoeba dispar
HPKPSTD

SEQ ID NO: 2429541 - protein, 4 aa, Entamoeba dispar
HPKS

SEQ ID NO: 2429542 - protein, 23 aa, Entamoeba dispar
HPKSPTPPPKEPTPPPKQEPQQP

SEQ ID NO: 2429543 - protein, 12 aa, Entamoeba dispar
HPKSSPPSPKKQ

SEQ ID NO: 2429544 - protein, 12 aa, Entamoeba dispar
HPKTKLPESMAG

SEQ ID NO: 2429545 - protein, 5 aa, Entamoeba dispar
HPKTY

SEQ ID NO: 2429546 - protein, 11 aa, Entamoeba dispar
HPKYNDQFEET

SEQ ID NO: 2429547 - protein, 7 aa, Entamoeba dispar
HPKYPES

SEQ ID NO: 2429548 - protein, 14 aa, Entamoeba dispar
HPLPPTPTPKVPFR

SEQ ID NO: 2429549 - protein, 6 aa, Entamoeba dispar
HPNCTE

SEQ ID NO: 2429550 - protein, 24 aa, Entamoeba dispar
HPNDEENKRSRSHSRERNPHEKKR

SEQ ID NO: 2429551 - protein, 14 aa, Entamoeba dispar
HPNIGKKGELPPAS

SEQ ID NO: 2429552 - protein, 19 aa, Entamoeba dispar
HPNKTEEQLTEEANNNLQK

SEQ ID NO: 2429553 - protein, 5 aa, Entamoeba dispar
HPNKY

SEQ ID NO: 2429554 - protein, 5 aa, Entamoeba dispar
HPNNI

SEQ ID NO: 2429555 - protein, 5 aa, Entamoeba dispar
HPNSD

SEQ ID NO: 2429556 - protein, 6 aa, Entamoeba dispar
HPNSSF

SEQ ID NO: 2429557 - protein, 7 aa, Entamoeba dispar
HPNSSVS

SEQ ID NO: 2429558 - protein, 5 aa, Entamoeba dispar
HPNYA

SEQ ID NO: 2429559 - protein, 26 aa, Entamoeba dispar
HPNYQPPHLPEPCRSYPGDSALSADD

SEQ ID NO: 2429560 - protein, 11 aa, Entamoeba dispar
HPPDKCPHRKE

SEQ ID NO: 2429561 - protein, 17 aa, Entamoeba dispar
HPPEDISQSDTSQIKKE

SEQ ID NO: 2429562 - protein, 5 aa, Entamoeba dispar
HPPFI

SEQ ID NO: 2429563 - protein, 4 aa, Entamoeba dispar
HPPG

SEQ ID NO: 2429564 - protein, 7 aa, Entamoeba dispar
HPPGQKC

SEQ ID NO: 2429565 - protein, 9 aa, Entamoeba dispar
HPPKKEKRK

SEQ ID NO: 2429566 - protein, 7 aa, Entamoeba dispar
HPPPDEH

SEQ ID NO: 2429567 - protein, 15 aa, Entamoeba dispar
HPPPTFKNKEENSEE

SEQ ID NO: 2429568 - protein, 9 aa, Entamoeba dispar
HPPSKNNAP

SEQ ID NO: 2429569 - protein, 6 aa, Entamoeba dispar
HPPSTL

SEQ ID NO: 2429570 - protein, 13 aa, Entamoeba dispar
HPQEGYTSGGTHV

SEQ ID NO: 2429571 - protein, 9 aa, Entamoeba dispar
HPQEKQKAT

SEQ ID NO: 2429572 - protein, 4 aa, Entamoeba dispar
HPQM

SEQ ID NO: 2429573 - protein, 4 aa, Entamoeba dispar
HPQS

SEQ ID NO: 2429574 - protein, 7 aa, Entamoeba dispar
HPQTDER

SEQ ID NO: 2429575 - protein, 17 aa, Entamoeba dispar
HPQVSPSKVLPNEQQGI

SEQ ID NO: 2429576 - protein, 34 aa, Entamoeba dispar
HPRRGLRGAAPCARPHAGQSHRRRPRPGQSRLPH

SEQ ID NO: 2429577 - protein, 4 aa, Entamoeba dispar
HPSC

SEQ ID NO: 2429578 - protein, 8 aa, Entamoeba dispar
HPSEVQSQ

SEQ ID NO: 2429579 - protein, 10 aa, Entamoeba dispar
HPSFGKRNGM

SEQ ID NO: 2429580 - protein, 4 aa, Entamoeba dispar
HPSI

SEQ ID NO: 2429581 - protein, 14 aa, Entamoeba dispar
HPSISESEKYLKER

SEQ ID NO: 2429582 - protein, 4 aa, Entamoeba dispar
HPSK

SEQ ID NO: 2429583 - protein, 8 aa, Entamoeba dispar
HPSKNDLN

SEQ ID NO: 2429584 - protein, 9 aa, Entamoeba dispar
HPSNYYKED

SEQ ID NO: 2429585 - protein, 5 aa, Entamoeba dispar
HPSSH

SEQ ID NO: 2429586 - protein, 15 aa, Entamoeba dispar
HPSSNSIELPDSPTC

SEQ ID NO: 2429587 - protein, 5 aa, Entamoeba dispar
HPSTN

SEQ ID NO: 2429588 - protein, 8 aa, Entamoeba dispar
HPSVEGHH

SEQ ID NO: 2429589 - protein, 15 aa, Entamoeba dispar
HPTEASLSAPNLPPL

SEQ ID NO: 2429590 - protein, 7 aa, Entamoeba dispar
HPTEATV

SEQ ID NO: 2429591 - protein, 5 aa, Entamoeba dispar
HPTES

SEQ ID NO: 2429592 - protein, 6 aa, Entamoeba dispar
HPTHSV

SEQ ID NO: 2429593 - protein, 5 aa, Entamoeba dispar
HPTID

SEQ ID NO: 2429594 - protein, 13 aa, Entamoeba dispar
HPTRTNELKQEGY

SEQ ID NO: 2429595 - protein, 7 aa, Entamoeba dispar
HPTSTTK

SEQ ID NO: 2429596 - protein, 7 aa, Entamoeba dispar
HPTTRNE

SEQ ID NO: 2429597 - protein, 30 aa, Entamoeba dispar
HPTVNPTGKKRTPMRKKTKKSTSSDTGLSL

SEQ ID NO: 2429598 - protein, 5 aa, Entamoeba dispar
HQAEN

SEQ ID NO: 2429599 - protein, 9 aa, Entamoeba dispar
HQAPNDIES

SEQ ID NO: 2429600 - protein, 18 aa, Entamoeba dispar
HQCDKAKKELQKEKGSVQ

SEQ ID NO: 2429601 - protein, 9 aa, Entamoeba dispar
HQDESSQVV

SEQ ID NO: 2429602 - protein, 11 aa, Entamoeba dispar
HQDRKTNDTIT

SEQ ID NO: 2429603 - protein, 9 aa, Entamoeba dispar
HQEAQNSNL

SEQ ID NO: 2429604 - protein, 6 aa, Entamoeba dispar
HQEDGN

SEQ ID NO: 2429605 - protein, 4 aa, Entamoeba dispar
HQEG

SEQ ID NO: 2429606 - protein, 8 aa, Entamoeba dispar
HQEGKEKD

SEQ ID NO: 2429607 - protein, 25 aa, Entamoeba dispar
HQEKTKPKTKPKNKPKMVKAPIKKK

SEQ ID NO: 2429608 - protein, 6 aa, Entamoeba dispar
HQERAA

SEQ ID NO: 2429609 - protein, 12 aa, Entamoeba dispar
HQESIRKIDETN

SEQ ID NO: 2429610 - protein, 4 aa, Entamoeba dispar
HQEV

SEQ ID NO: 2429611 - protein, 17 aa, Entamoeba dispar
HQEYADKAYQKTQDVTR

SEQ ID NO: 2429612 - protein, 10 aa, Entamoeba dispar
HQFDSKSDAV

SEQ ID NO: 2429613 - protein, 10 aa, Entamoeba dispar
HQFSNENEKH

SEQ ID NO: 2429614 - protein, 7 aa, Entamoeba dispar
HQGGSYQ

SEQ ID NO: 2429615 - protein, 6 aa, Entamoeba dispar
HQGSKG

SEQ ID NO: 2429616 - protein, 21 aa, Entamoeba dispar
HQGYDHSGKPLPKPTQGKLDS

SEQ ID NO: 2429617 - protein, 6 aa, Entamoeba dispar
HQGYPN

SEQ ID NO: 2429618 - protein, 6 aa, Entamoeba dispar
HQHKIG

SEQ ID NO: 2429619 - protein, 21 aa, Entamoeba dispar
HQIPKQRKGIKTKIEKKELTT

SEQ ID NO: 2429620 - protein, 9 aa, Entamoeba dispar
HQISKSESF

SEQ ID NO: 2429621 - protein, 8 aa, Entamoeba dispar
HQKDDKVA

SEQ ID NO: 2429622 - protein, 5 aa, Entamoeba dispar
HQKDV

SEQ ID NO: 2429623 - protein, 17 aa, Entamoeba dispar
HQKELEAKIQSEDGFKE

SEQ ID NO: 2429624 - protein, 8 aa, Entamoeba dispar
HQKEYDNI

SEQ ID NO: 2429625 - protein, 18 aa, Entamoeba dispar
HQKGGSILGTSRGAQSPE

SEQ ID NO: 2429626 - protein, 18 aa, Entamoeba dispar
HQKQSSLSTTKLRRQTVD

SEQ ID NO: 2429627 - protein, 22 aa, Entamoeba dispar
HQKREMYDKYGKKGLEEGGMGG

SEQ ID NO: 2429628 - protein, 7 aa, Entamoeba dispar
HQKRYQG

SEQ ID NO: 2429629 - protein, 4 aa, Entamoeba dispar
HQLN

SEQ ID NO: 2429630 - protein, 4 aa, Entamoeba dispar
HQMK

SEQ ID NO: 2429631 - protein, 10 aa, Entamoeba dispar
HQNEEKGNEK

SEQ ID NO: 2429632 - protein, 5 aa, Entamoeba dispar
HQNEF

SEQ ID NO: 2429633 - protein, 18 aa, Entamoeba dispar
HQNEINEGIHQNEINEGI

SEQ ID NO: 2429634 - protein, 10 aa, Entamoeba dispar
HQNGSGVNFT

SEQ ID NO: 2429635 - protein, 7 aa, Entamoeba dispar
HQNIIGN

SEQ ID NO: 2429636 - protein, 27 aa, Entamoeba dispar
HQNKENEDSNELVSEEEESKLDSQPIS

SEQ ID NO: 2429637 - protein, 8 aa, Entamoeba dispar
HQNNEEKE

SEQ ID NO: 2429638 - protein, 18 aa, Entamoeba dispar
HQNNPTKRRRDGLPGKLD

SEQ ID NO: 2429639 - protein, 5 aa, Entamoeba dispar
HQNQS

SEQ ID NO: 2429640 - protein, 4 aa, Entamoeba dispar
HQNY

SEQ ID NO: 2429641 - protein, 5 aa, Entamoeba dispar
HQPEG

SEQ ID NO: 2429642 - protein, 12 aa, Entamoeba dispar
HQPEINKRNRNF

SEQ ID NO: 2429643 - protein, 7 aa, Entamoeba dispar
HQPHSKS

SEQ ID NO: 2429644 - protein, 5 aa, Entamoeba dispar
HQPTA

SEQ ID NO: 2429645 - protein, 22 aa, Entamoeba dispar
HQPTDRNGEEVNDSYENESNEK

SEQ ID NO: 2429646 - protein, 5 aa, Entamoeba dispar
HQQEG

SEQ ID NO: 2429647 - protein, 19 aa, Entamoeba dispar
HQQESEKPVAQQQVKGNVA

SEQ ID NO: 2429648 - protein, 7 aa, Entamoeba dispar
HQQGTEI

SEQ ID NO: 2429649 - protein, 6 aa, Entamoeba dispar
HQQTKQ

SEQ ID NO: 2429650 - protein, 11 aa, Entamoeba dispar
HQRESKTMSKI

SEQ ID NO: 2429651 - protein, 4 aa, Entamoeba dispar
HQRK

SEQ ID NO: 2429652 - protein, 15 aa, Entamoeba dispar
HQRKTTINPNQQPSI

SEQ ID NO: 2429653 - protein, 4 aa, Entamoeba dispar
HQRT

SEQ ID NO: 2429654 - protein, 15 aa, Entamoeba dispar
HQSAPPVVEIATTPV

SEQ ID NO: 2429655 - protein, 6 aa, Entamoeba dispar
HQSHQN

SEQ ID NO: 2429656 - protein, 60 aa, Entamoeba dispar
HQSNNSQAPPSPQRGSQSTVHKPYSPIQQNQTITPVKSNTEIKERQQMRVSSTKGTNQIS

SEQ ID NO: 2429657 - protein, 6 aa, Entamoeba dispar
HQSQKD

SEQ ID NO: 2429658 - protein, 16 aa, Entamoeba dispar
HQSSNSNSPTASQGGC

SEQ ID NO: 2429659 - protein, 5 aa, Entamoeba dispar
HQSVT

SEQ ID NO: 2429660 - protein, 15 aa, Entamoeba dispar
HQTDEDEMFGNTDGC

SEQ ID NO: 2429661 - protein, 11 aa, Entamoeba dispar
HQTISNNNPEW

SEQ ID NO: 2429662 - protein, 7 aa, Entamoeba dispar
HQTRVEK

SEQ ID NO: 2429663 - protein, 8 aa, Entamoeba dispar
HQTTPTLV

SEQ ID NO: 2429664 - protein, 27 aa, Entamoeba dispar
HQTTSNSSFDFGQSSFKSTQKQKKEFN

SEQ ID NO: 2429665 - protein, 13 aa, Entamoeba dispar
HQTTTPTTCPPQH

SEQ ID NO: 2429666 - protein, 5 aa, Entamoeba dispar
HQTVN

SEQ ID NO: 2429667 - protein, 8 aa, Entamoeba dispar
HQVTSQND

SEQ ID NO: 2429668 - protein, 11 aa, Entamoeba dispar
HQWPTYSDDEW

SEQ ID NO: 2429669 - protein, 9 aa, Entamoeba dispar
HQYTEGSRS

SEQ ID NO: 2429670 - protein, 17 aa, Entamoeba dispar
HRDDGGSRTIVVTLNGI

SEQ ID NO: 2429671 - protein, 5 aa, Entamoeba dispar
HRDLK

SEQ ID NO: 2429672 - protein, 15 aa, Entamoeba dispar
HRGEDDAPLNTSEYG

SEQ ID NO: 2429673 - protein, 10 aa, Entamoeba dispar
HRGEVGESKA

SEQ ID NO: 2429674 - protein, 10 aa, Entamoeba dispar
HRGNVRSKGY

SEQ ID NO: 2429675 - protein, 20 aa, Entamoeba dispar
HRGSKTDPIKIDDFDIENHE

SEQ ID NO: 2429676 - protein, 8 aa, Entamoeba dispar
HRGTLNNG

SEQ ID NO: 2429677 - protein, 38 aa, Entamoeba dispar
HRGTSNNNSANSSGSPHEDSTTGTTNTSKRGSKDNRRD

SEQ ID NO: 2429678 - protein, 12 aa, Entamoeba dispar
HRHTTTTNAPLA

SEQ ID NO: 2429679 - protein, 9 aa, Entamoeba dispar
HRIPPESDK

SEQ ID NO: 2429680 - protein, 5 aa, Entamoeba dispar
HRISE

SEQ ID NO: 2429681 - protein, 11 aa, Entamoeba dispar
HRISTGPGTQT

SEQ ID NO: 2429682 - protein, 4 aa, Entamoeba dispar
HRKK

SEQ ID NO: 2429683 - protein, 10 aa, Entamoeba dispar
HRKNAQGDPF

SEQ ID NO: 2429684 - protein, 15 aa, Entamoeba dispar
HRKRKNEDVSQEEEH

SEQ ID NO: 2429685 - protein, 11 aa, Entamoeba dispar
HRKTDKLERKK

SEQ ID NO: 2429686 - protein, 20 aa, Entamoeba dispar
HRLKNADIKSSQAVNRVPTK

SEQ ID NO: 2429687 - protein, 10 aa, Entamoeba dispar
HRLKNKDSKL

SEQ ID NO: 2429688 - protein, 9 aa, Entamoeba dispar
HRNEEKNVQ

SEQ ID NO: 2429689 - protein, 5 aa, Entamoeba dispar
HRNGL

SEQ ID NO: 2429690 - protein, 5 aa, Entamoeba dispar
HRPAT

SEQ ID NO: 2429691 - protein, 5 aa, Entamoeba dispar
HRPMT

SEQ ID NO: 2429692 - protein, 15 aa, Entamoeba dispar
HRPSNKTEYKRIREN

SEQ ID NO: 2429693 - protein, 17 aa, Entamoeba dispar
HRQNELKRNEKTLEEIE

SEQ ID NO: 2429694 - protein, 7 aa, Entamoeba dispar
HRQNPNA

SEQ ID NO: 2429695 - protein, 4 aa, Entamoeba dispar
HRQS

SEQ ID NO: 2429696 - protein, 7 aa, Entamoeba dispar
HRQTGQK

SEQ ID NO: 2429697 - protein, 14 aa, Entamoeba dispar
HRQTREQKKKTMGE

SEQ ID NO: 2429698 - protein, 12 aa, Entamoeba dispar
HRRKEKTRRIRE

SEQ ID NO: 2429699 - protein, 7 aa, Entamoeba dispar
HRRKGMG

SEQ ID NO: 2429700 - protein, 12 aa, Entamoeba dispar
HRRYNADDSLVD

SEQ ID NO: 2429701 - protein, 12 aa, Entamoeba dispar
HRSEAERACRRA

SEQ ID NO: 2429702 - protein, 8 aa, Entamoeba dispar
HRSEPELT

SEQ ID NO: 2429703 - protein, 12 aa, Entamoeba dispar
HRSGCNAVDGRD

SEQ ID NO: 2429704 - protein, 9 aa, Entamoeba dispar
HRSGETEDT

SEQ ID NO: 2429705 - protein, 4 aa, Entamoeba dispar
HRTE

SEQ ID NO: 2429706 - protein, 4 aa, Entamoeba dispar
HRTL

SEQ ID NO: 2429707 - protein, 6 aa, Entamoeba dispar
HRTNED

SEQ ID NO: 2429708 - protein, 5 aa, Entamoeba dispar
HRTPE

SEQ ID NO: 2429709 - protein, 5 aa, Entamoeba dispar
HRTQT

SEQ ID NO: 2429710 - protein, 10 aa, Entamoeba dispar
HSAGKHLETA

SEQ ID NO: 2429711 - protein, 10 aa, Entamoeba dispar
HSAKNENTRF

SEQ ID NO: 2429712 - protein, 5 aa, Entamoeba dispar
HSAPG

SEQ ID NO: 2429713 - protein, 11 aa, Entamoeba dispar
HSDENDDDNVV

SEQ ID NO: 2429714 - protein, 8 aa, Entamoeba dispar
HSDGTKQK

SEQ ID NO: 2429715 - protein, 8 aa, Entamoeba dispar
HSDGTKQT

SEQ ID NO: 2429716 - protein, 10 aa, Entamoeba dispar
HSDHENESYK

SEQ ID NO: 2429717 - protein, 11 aa, Entamoeba dispar
HSDHENESYKW

SEQ ID NO: 2429718 - protein, 7 aa, Entamoeba dispar
HSDKGNE

SEQ ID NO: 2429719 - protein, 9 aa, Entamoeba dispar
HSDNYRNER

SEQ ID NO: 2429720 - protein, 5 aa, Entamoeba dispar
HSDPS

SEQ ID NO: 2429721 - protein, 10 aa, Entamoeba dispar
HSDPSNAESY

SEQ ID NO: 2429722 - protein, 11 aa, Entamoeba dispar
HSDSEHQQSEK

SEQ ID NO: 2429723 - protein, 15 aa, Entamoeba dispar
HSDTYEGKTAFSQEK

SEQ ID NO: 2429724 - protein, 4 aa, Entamoeba dispar
HSDY

SEQ ID NO: 2429725 - protein, 11 aa, Entamoeba dispar
HSEAKSAKNGI

SEQ ID NO: 2429726 - protein, 7 aa, Entamoeba dispar
HSEEITN

SEQ ID NO: 2429727 - protein, 6 aa, Entamoeba dispar
HSEESI

SEQ ID NO: 2429728 - protein, 4 aa, Entamoeba dispar
HSEH

SEQ ID NO: 2429729 - protein, 4 aa, Entamoeba dispar
HSEI

SEQ ID NO: 2429730 - protein, 6 aa, Entamoeba dispar
HSEIKT

SEQ ID NO: 2429731 - protein, 5 aa, Entamoeba dispar
HSEKC

SEQ ID NO: 2429732 - protein, 5 aa, Entamoeba dispar
HSEKE

SEQ ID NO: 2429733 - protein, 23 aa, Entamoeba dispar
HSEKEREKQNEEEDNQENDKNIE

SEQ ID NO: 2429734 - protein, 7 aa, Entamoeba dispar
HSELKGK

SEQ ID NO: 2429735 - protein, 5 aa, Entamoeba dispar
HSERT

SEQ ID NO: 2429736 - protein, 14 aa, Entamoeba dispar
HSESRGSFSTPQSI

SEQ ID NO: 2429737 - protein, 8 aa, Entamoeba dispar
HSFKDPNN

SEQ ID NO: 2429738 - protein, 6 aa, Entamoeba dispar
HSFPDE

SEQ ID NO: 2429739 - protein, 6 aa, Entamoeba dispar
HSGGED

SEQ ID NO: 2429740 - protein, 7 aa, Entamoeba dispar
HSGHSTH

SEQ ID NO: 2429741 - protein, 8 aa, Entamoeba dispar
HSGSPEDI

SEQ ID NO: 2429742 - protein, 16 aa, Entamoeba dispar
HSGSSENILSTDNIDS

SEQ ID NO: 2429743 - protein, 5 aa, Entamoeba dispar
HSGTM

SEQ ID NO: 2429744 - protein, 11 aa, Entamoeba dispar
HSHQQIENTTL

SEQ ID NO: 2429745 - protein, 5 aa, Entamoeba dispar
HSHSR

SEQ ID NO: 2429746 - protein, 9 aa, Entamoeba dispar
HSHSSVERD

SEQ ID NO: 2429747 - protein, 4 aa, Entamoeba dispar
HSHT

SEQ ID NO: 2429748 - protein, 4 aa, Entamoeba dispar
HSIA

SEQ ID NO: 2429749 - protein, 7 aa, Entamoeba dispar
HSIDETK

SEQ ID NO: 2429750 - protein, 11 aa, Entamoeba dispar
HSINDKKKEEI

SEQ ID NO: 2429751 - protein, 9 aa, Entamoeba dispar
HSINDPSLS

SEQ ID NO: 2429752 - protein, 20 aa, Entamoeba dispar
HSITQTPNTQQDKSNPTQIK

SEQ ID NO: 2429753 - protein, 7 aa, Entamoeba dispar
HSKEQNN

SEQ ID NO: 2429754 - protein, 10 aa, Entamoeba dispar
HSKETNKLEN

SEQ ID NO: 2429755 - protein, 7 aa, Entamoeba dispar
HSKFNTR

SEQ ID NO: 2429756 - protein, 5 aa, Entamoeba dispar
HSKGE

SEQ ID NO: 2429757 - protein, 5 aa, Entamoeba dispar
HSKGK

SEQ ID NO: 2429758 - protein, 10 aa, Entamoeba dispar
HSKKTNKEGV

SEQ ID NO: 2429759 - protein, 5 aa, Entamoeba dispar
HSKNM

SEQ ID NO: 2429760 - protein, 7 aa, Entamoeba dispar
HSKPIGE

SEQ ID NO: 2429761 - protein, 7 aa, Entamoeba dispar
HSKPSSP

SEQ ID NO: 2429762 - protein, 8 aa, Entamoeba dispar
HSKTGQHG

SEQ ID NO: 2429763 - protein, 7 aa, Entamoeba dispar
HSKVTSK

SEQ ID NO: 2429764 - protein, 6 aa, Entamoeba dispar
HSLSTN

SEQ ID NO: 2429765 - protein, 5 aa, Entamoeba dispar
HSMND

SEQ ID NO: 2429766 - protein, 13 aa, Entamoeba dispar
HSNELTSQEGSHF

SEQ ID NO: 2429767 - protein, 5 aa, Entamoeba dispar
HSNEP

SEQ ID NO: 2429768 - protein, 9 aa, Entamoeba dispar
HSNETDSDT

SEQ ID NO: 2429769 - protein, 5 aa, Entamoeba dispar
HSNGG

SEQ ID NO: 2429770 - protein, 5 aa, Entamoeba dispar
HSNIK

SEQ ID NO: 2429771 - protein, 8 aa, Entamoeba dispar
HSNKEENQ

SEQ ID NO: 2429772 - protein, 8 aa, Entamoeba dispar
HSNKNGEL

SEQ ID NO: 2429773 - protein, 9 aa, Entamoeba dispar
HSNNSLPSF

SEQ ID NO: 2429774 - protein, 5 aa, Entamoeba dispar
HSNNT

SEQ ID NO: 2429775 - protein, 11 aa, Entamoeba dispar
HSNPNTANENQ

SEQ ID NO: 2429776 - protein, 7 aa, Entamoeba dispar
HSNPQRV

SEQ ID NO: 2429777 - protein, 14 aa, Entamoeba dispar
HSNPTTSVSSDFNS

SEQ ID NO: 2429778 - protein, 23 aa, Entamoeba dispar
HSNRRNDNRIKRNTNERRQPRMS

SEQ ID NO: 2429779 - protein, 11 aa, Entamoeba dispar
HSNSQNNLPSI

SEQ ID NO: 2429780 - protein, 7 aa, Entamoeba dispar
HSNSTKA

SEQ ID NO: 2429781 - protein, 12 aa, Entamoeba dispar
HSNTHKKWSAGE

SEQ ID NO: 2429782 - protein, 8 aa, Entamoeba dispar
HSNVSSPS

SEQ ID NO: 2429783 - protein, 10 aa, Entamoeba dispar
HSPAGGKEPI

SEQ ID NO: 2429784 - protein, 13 aa, Entamoeba dispar
HSPDASQSKLRNA

SEQ ID NO: 2429785 - protein, 6 aa, Entamoeba dispar
HSPDHC

SEQ ID NO: 2429786 - protein, 5 aa, Entamoeba dispar
HSPDK

SEQ ID NO: 2429787 - protein, 4 aa, Entamoeba dispar
HSPE

SEQ ID NO: 2429788 - protein, 7 aa, Entamoeba dispar
HSPEVTQ

SEQ ID NO: 2429789 - protein, 7 aa, Entamoeba dispar
HSPITSN

SEQ ID NO: 2429790 - protein, 10 aa, Entamoeba dispar
HSPKDIGNDR

SEQ ID NO: 2429791 - protein, 4 aa, Entamoeba dispar
HSPL

SEQ ID NO: 2429792 - protein, 20 aa, Entamoeba dispar
HSPLSKTSSNQQPLVQNTSS

SEQ ID NO: 2429793 - protein, 8 aa, Entamoeba dispar
HSPNSKFL

SEQ ID NO: 2429794 - protein, 8 aa, Entamoeba dispar
HSPRNSSG

SEQ ID NO: 2429795 - protein, 9 aa, Entamoeba dispar
HSPRSLQSP

SEQ ID NO: 2429796 - protein, 13 aa, Entamoeba dispar
HSPSNLDDNDDVP

SEQ ID NO: 2429797 - protein, 6 aa, Entamoeba dispar
HSPSTN

SEQ ID NO: 2429798 - protein, 9 aa, Entamoeba dispar
HSPTSESIK

SEQ ID NO: 2429799 - protein, 4 aa, Entamoeba dispar
HSQE

SEQ ID NO: 2429800 - protein, 17 aa, Entamoeba dispar
HSQEINNKKEDFIEQSQ

SEQ ID NO: 2429801 - protein, 5 aa, Entamoeba dispar
HSQER

SEQ ID NO: 2429802 - protein, 101 aa, Entamoeba dispar
HSQKAKENEKTESKVTEKDSRGREIERKSSEGRSDNKRSSENKSPHRSKRSNSRSARRHSHSQKTKEEDSKKKLPERNLSEDARTLKHKGDKLNNDERTDD

SEQ ID NO: 2429803 - protein, 101 aa, Entamoeba dispar
HSQKAKENEKTESKVTEKDSRGREVERKSSEGRSDNKRSSENKSPHRSKRSNSRSARRHSHSQKTKEEDSKKKLPERNLSEDARTLKHKGDKLNNDERTDD

SEQ ID NO: 2429804 - protein, 5 aa, Entamoeba dispar
HSQNG

SEQ ID NO: 2429805 - protein, 12 aa, Entamoeba dispar
HSQNGIDETTFT

SEQ ID NO: 2429806 - protein, 10 aa, Entamoeba dispar
HSQNNTKAFG

SEQ ID NO: 2429807 - protein, 12 aa, Entamoeba dispar
HSQSKNQQEIES

SEQ ID NO: 2429808 - protein, 11 aa, Entamoeba dispar
HSRKDEIKGVS

SEQ ID NO: 2429809 - protein, 12 aa, Entamoeba dispar
HSRKRSKSSPID

SEQ ID NO: 2429810 - protein, 4 aa, Entamoeba dispar
HSRR

SEQ ID NO: 2429811 - protein, 16 aa, Entamoeba dispar
HSRSQSKKRRNSFNTA

SEQ ID NO: 2429812 - protein, 24 aa, Entamoeba dispar
HSSAYTGSQFENADSQNDPFYSAL

SEQ ID NO: 2429813 - protein, 47 aa, Entamoeba dispar
  misc_feature (34)..(35): Xaa can be any naturally occurring amino acid
HSSESPSSRSTSRDDRHHSHRYSDSRKAHLKEMXXISVYTLIMKLYF

SEQ ID NO: 2429814 - protein, 49 aa, Entamoeba dispar
HSSESPSSRSTSRDDRHHSHRYSDSRKSSSKRDESIREKSPEKNEEEHS

SEQ ID NO: 2429815 - protein, 5 aa, Entamoeba dispar
HSSHC

SEQ ID NO: 2429816 - protein, 7 aa, Entamoeba dispar
HSSHSSP

SEQ ID NO: 2429817 - protein, 4 aa, Entamoeba dispar
HSSI

SEQ ID NO: 2429818 - protein, 9 aa, Entamoeba dispar
HSSKLNSKI

SEQ ID NO: 2429819 - protein, 5 aa, Entamoeba dispar
HSSND

SEQ ID NO: 2429820 - protein, 14 aa, Entamoeba dispar
HSSNDKRAAEDDSC

SEQ ID NO: 2429821 - protein, 8 aa, Entamoeba dispar
HSSQDSSF

SEQ ID NO: 2429822 - protein, 16 aa, Entamoeba dispar
HSSQHNAKISEEPIQK

SEQ ID NO: 2429823 - protein, 5 aa, Entamoeba dispar
HSSQL

SEQ ID NO: 2429824 - protein, 4 aa, Entamoeba dispar
HSST

SEQ ID NO: 2429825 - protein, 13 aa, Entamoeba dispar
HSSVPTPEVTNGI

SEQ ID NO: 2429826 - protein, 7 aa, Entamoeba dispar
HSTASIQ

SEQ ID NO: 2429827 - protein, 12 aa, Entamoeba dispar
HSTDPRRARAAT

SEQ ID NO: 2429828 - protein, 8 aa, Entamoeba dispar
HSTEENNT

SEQ ID NO: 2429829 - protein, 7 aa, Entamoeba dispar
HSTGLPE

SEQ ID NO: 2429830 - protein, 10 aa, Entamoeba dispar
HSTGSGKSLT

SEQ ID NO: 2429831 - protein, 5 aa, Entamoeba dispar
HSTKQ

SEQ ID NO: 2429832 - protein, 4 aa, Entamoeba dispar
HSTN

SEQ ID NO: 2429833 - protein, 5 aa, Entamoeba dispar
HSTNK

SEQ ID NO: 2429834 - protein, 11 aa, Entamoeba dispar
HSTNSESPRTI

SEQ ID NO: 2429835 - protein, 8 aa, Entamoeba dispar
HSTPTNAE

SEQ ID NO: 2429836 - protein, 4 aa, Entamoeba dispar
HSTS

SEQ ID NO: 2429837 - protein, 8 aa, Entamoeba dispar
HSTSTEEN

SEQ ID NO: 2429838 - protein, 20 aa, Entamoeba dispar
HSTTHHSATRKHFLQGKTLS

SEQ ID NO: 2429839 - protein, 7 aa, Entamoeba dispar
HSVDDKG

SEQ ID NO: 2429840 - protein, 13 aa, Entamoeba dispar
HSVDRKYYNDGED

SEQ ID NO: 2429841 - protein, 12 aa, Entamoeba dispar
HSVESSDPLPPR

SEQ ID NO: 2429842 - protein, 12 aa, Entamoeba dispar
HSVGSTPTPVPG

SEQ ID NO: 2429843 - protein, 9 aa, Entamoeba dispar
HSVTPQDIS

SEQ ID NO: 2429844 - protein, 103 aa, Entamoeba dispar
HSYHGRSYDRSRSHSSRRRSRSRSSRRRYRSRSNRRHNRSRSRSSRRRYSRSRSVSPYSKSRRDKSSRSRSGSSSPKRSERKSFRVNDSSLPSKNEIPKGSDD

SEQ ID NO: 2429845 - protein, 11 aa, Entamoeba dispar
HSYKNEDYNDL

SEQ ID NO: 2429846 - protein, 9 aa, Entamoeba dispar
HSYTSEETI

SEQ ID NO: 2429847 - protein, 7 aa, Entamoeba dispar
HTDEDIE

SEQ ID NO: 2429848 - protein, 8 aa, Entamoeba dispar
HTDEDIEK

SEQ ID NO: 2429849 - protein, 6 aa, Entamoeba dispar
HTDEKL

SEQ ID NO: 2429850 - protein, 8 aa, Entamoeba dispar
HTDGTKQS

SEQ ID NO: 2429851 - protein, 13 aa, Entamoeba dispar
HTDKEKSLETYQN

SEQ ID NO: 2429852 - protein, 9 aa, Entamoeba dispar
HTDRNDPLF

SEQ ID NO: 2429853 - protein, 6 aa, Entamoeba dispar
HTDYND

SEQ ID NO: 2429854 - protein, 41 aa, Entamoeba dispar
HTEESTLESNQPNNINKNYVDDKSKEKDKSTHEEEQTIPNI

SEQ ID NO: 2429855 - protein, 14 aa, Entamoeba dispar
HTEPTKSGSRKHSA

SEQ ID NO: 2429856 - protein, 5 aa, Entamoeba dispar
HTETA

SEQ ID NO: 2429857 - protein, 7 aa, Entamoeba dispar
HTEYDQQ

SEQ ID NO: 2429858 - protein, 10 aa, Entamoeba dispar
HTGEREYAGQ

SEQ ID NO: 2429859 - protein, 4 aa, Entamoeba dispar
HTGK

SEQ ID NO: 2429860 - protein, 8 aa, Entamoeba dispar
HTGNIQSG

SEQ ID NO: 2429861 - protein, 7 aa, Entamoeba dispar
HTGQVTA

SEQ ID NO: 2429862 - protein, 16 aa, Entamoeba dispar
HTGSPRRCGGQGDVLS

SEQ ID NO: 2429863 - protein, 5 aa, Entamoeba dispar
HTGSR

SEQ ID NO: 2429864 - protein, 4 aa, Entamoeba dispar
HTHD

SEQ ID NO: 2429865 - protein, 7 aa, Entamoeba dispar
HTHSTKT

SEQ ID NO: 2429866 - protein, 6 aa, Entamoeba dispar
HTIDET

SEQ ID NO: 2429867 - protein, 10 aa, Entamoeba dispar
HTINNPDEIQ

SEQ ID NO: 2429868 - protein, 43 aa, Entamoeba dispar
HTIPSKKTSKKSIKKSIKKASKKSIKKASKKSINSSSNGIQPM

SEQ ID NO: 2429869 - protein, 4 aa, Entamoeba dispar
HTKD

SEQ ID NO: 2429870 - protein, 23 aa, Entamoeba dispar
HTKKTGQSGKTDYKPRSRTSKAV

SEQ ID NO: 2429871 - protein, 6 aa, Entamoeba dispar
HTKPGM

SEQ ID NO: 2429872 - protein, 14 aa, Entamoeba dispar
HTKPGSVAITASTG

SEQ ID NO: 2429873 - protein, 5 aa, Entamoeba dispar
HTKSS

SEQ ID NO: 2429874 - protein, 9 aa, Entamoeba dispar
HTKSSVQSY

SEQ ID NO: 2429875 - protein, 21 aa, Entamoeba dispar
HTKTIEKTNKMHERNFNSKTK

SEQ ID NO: 2429876 - protein, 4 aa, Entamoeba dispar
HTLA

SEQ ID NO: 2429877 - protein, 10 aa, Entamoeba dispar
HTLAESDSEI

SEQ ID NO: 2429878 - protein, 8 aa, Entamoeba dispar
HTNKGENI

SEQ ID NO: 2429879 - protein, 13 aa, Entamoeba dispar
HTNNEENEEENVV

SEQ ID NO: 2429880 - protein, 5 aa, Entamoeba dispar
HTPEE

SEQ ID NO: 2429881 - protein, 6 aa, Entamoeba dispar
HTPQDT

SEQ ID NO: 2429882 - protein, 10 aa, Entamoeba dispar
HTPQNHPDFK

SEQ ID NO: 2429883 - protein, 10 aa, Entamoeba dispar
HTPQPSTPII

SEQ ID NO: 2429884 - protein, 10 aa, Entamoeba dispar
HTPTDHPDYN

SEQ ID NO: 2429885 - protein, 12 aa, Entamoeba dispar
HTQGKRHQQNLR

SEQ ID NO: 2429886 - protein, 8 aa, Entamoeba dispar
HTQQNHVD

SEQ ID NO: 2429887 - protein, 4 aa, Entamoeba dispar
HTRK

SEQ ID NO: 2429888 - protein, 5 aa, Entamoeba dispar
HTRKR

SEQ ID NO: 2429889 - protein, 8 aa, Entamoeba dispar
HTRKRPFA

SEQ ID NO: 2429890 - protein, 5 aa, Entamoeba dispar
HTRRG

SEQ ID NO: 2429891 - protein, 34 aa, Entamoeba dispar
HTRSRSNSRERTRGTYSKEEYENYKRRNDREGSK

SEQ ID NO: 2429892 - protein, 9 aa, Entamoeba dispar
HTSAEEASA

SEQ ID NO: 2429893 - protein, 10 aa, Entamoeba dispar
HTSAGKTAVA

SEQ ID NO: 2429894 - protein, 6 aa, Entamoeba dispar
HTSANV

SEQ ID NO: 2429895 - protein, 5 aa, Entamoeba dispar
HTSDV

SEQ ID NO: 2429896 - protein, 8 aa, Entamoeba dispar
HTSERSYH

SEQ ID NO: 2429897 - protein, 12 aa, Entamoeba dispar
HTSETPQYHSNS

SEQ ID NO: 2429898 - protein, 12 aa, Entamoeba dispar
HTSIKSKGKTSM

SEQ ID NO: 2429899 - protein, 15 aa, Entamoeba dispar
HTSKGCPQNENKGTD

SEQ ID NO: 2429900 - protein, 7 aa, Entamoeba dispar
HTSNPDL

SEQ ID NO: 2429901 - protein, 8 aa, Entamoeba dispar
HTSPIDSD

SEQ ID NO: 2429902 - protein, 20 aa, Entamoeba dispar
HTSPQSNSPHTLSPHTRYKK

SEQ ID NO: 2429903 - protein, 16 aa, Entamoeba dispar
HTSQQKGGAKSKQSTM

SEQ ID NO: 2429904 - protein, 9 aa, Entamoeba dispar
HTSQTFDDS

SEQ ID NO: 2429905 - protein, 21 aa, Entamoeba dispar
HTSSPTPKIPTLSQNKENQLI

SEQ ID NO: 2429906 - protein, 14 aa, Entamoeba dispar
HTSTNGISAKIISQ

SEQ ID NO: 2429907 - protein, 13 aa, Entamoeba dispar
HTSTTHPTSVDDS

SEQ ID NO: 2429908 - protein, 17 aa, Entamoeba dispar
HTSTTWQSPVHTPKGHP

SEQ ID NO: 2429909 - protein, 5 aa, Entamoeba dispar
HTSYD

SEQ ID NO: 2429910 - protein, 7 aa, Entamoeba dispar
HTTDNSL

SEQ ID NO: 2429911 - protein, 6 aa, Entamoeba dispar
HTTIDE

SEQ ID NO: 2429912 - protein, 12 aa, Entamoeba dispar
HTTLPNTANSIN

SEQ ID NO: 2429913 - protein, 56 aa, Entamoeba dispar
HTTNEEKKEKKEKKEKEKKEKEEAKEKKKGHGKNDSQNIKTPPIAANPKLSGYATG

SEQ ID NO: 2429914 - protein, 4 aa, Entamoeba dispar
HTTP

SEQ ID NO: 2429915 - protein, 7 aa, Entamoeba dispar
HTTQNAI

SEQ ID NO: 2429916 - protein, 6 aa, Entamoeba dispar
HTTQNG

SEQ ID NO: 2429917 - protein, 14 aa, Entamoeba dispar
HTTRKPRGKEQNGV

SEQ ID NO: 2429918 - protein, 40 aa, Entamoeba dispar
HTTSEEKKEKKEKKEKSKKEKKEAKEKKLTNEENSKLPPV

SEQ ID NO: 2429919 - protein, 13 aa, Entamoeba dispar
HTTSETSTPRKGF

SEQ ID NO: 2429920 - protein, 5 aa, Entamoeba dispar
HTTSL

SEQ ID NO: 2429921 - protein, 8 aa, Entamoeba dispar
HTVDGGSL

SEQ ID NO: 2429922 - protein, 5 aa, Entamoeba dispar
HTVNQ

SEQ ID NO: 2429923 - protein, 6 aa, Entamoeba dispar
HTWEET

SEQ ID NO: 2429924 - protein, 5 aa, Entamoeba dispar
HTYEG

SEQ ID NO: 2429925 - protein, 7 aa, Entamoeba dispar
HTYTPSI

SEQ ID NO: 2429926 - protein, 8 aa, Entamoeba dispar
HVEEENNV

SEQ ID NO: 2429927 - protein, 6 aa, Entamoeba dispar
HVENPD

SEQ ID NO: 2429928 - protein, 4 aa, Entamoeba dispar
HVGN

SEQ ID NO: 2429929 - protein, 7 aa, Entamoeba dispar
HVGQERY

SEQ ID NO: 2429930 - protein, 12 aa, Entamoeba dispar
HVNKKAKDQYKG

SEQ ID NO: 2429931 - protein, 5 aa, Entamoeba dispar
HVNST

SEQ ID NO: 2429932 - protein, 24 aa, Entamoeba dispar
HVPKEENEKKRIEEAGGKVYNNNG

SEQ ID NO: 2429933 - protein, 7 aa, Entamoeba dispar
HVSSTVE

SEQ ID NO: 2429934 - protein, 6 aa, Entamoeba dispar
HVSTNP

SEQ ID NO: 2429935 - protein, 7 aa, Entamoeba dispar
HVTSGNV

SEQ ID NO: 2429936 - protein, 11 aa, Entamoeba dispar
HVTSTGGAPSA

SEQ ID NO: 2429937 - protein, 4 aa, Entamoeba dispar
HWAN

SEQ ID NO: 2429938 - protein, 11 aa, Entamoeba dispar
HWDGKGPQADY

SEQ ID NO: 2429939 - protein, 11 aa, Entamoeba dispar
HWKDDEVKTNL

SEQ ID NO: 2429940 - protein, 12 aa, Entamoeba dispar
HWKNNKTGCTQY

SEQ ID NO: 2429941 - protein, 5 aa, Entamoeba dispar
HYDNE

SEQ ID NO: 2429942 - protein, 4 aa, Entamoeba dispar
HYDP

SEQ ID NO: 2429943 - protein, 4 aa, Entamoeba dispar
HYDS

SEQ ID NO: 2429944 - protein, 6 aa, Entamoeba dispar
HYGAQK

SEQ ID NO: 2429945 - protein, 7 aa, Entamoeba dispar
HYGENSK

SEQ ID NO: 2429946 - protein, 11 aa, Entamoeba dispar
HYGEPDSKVKE

SEQ ID NO: 2429947 - protein, 5 aa, Entamoeba dispar
HYHEE

SEQ ID NO: 2429948 - protein, 8 aa, Entamoeba dispar
HYKEKEDL

SEQ ID NO: 2429949 - protein, 5 aa, Entamoeba dispar
HYNEE

SEQ ID NO: 2429950 - protein, 5 aa, Entamoeba dispar
HYNEQ

SEQ ID NO: 2429951 - protein, 5 aa, Entamoeba dispar
HYPNE

SEQ ID NO: 2429952 - protein, 14 aa, Entamoeba dispar
HYQNGIKNKGIAAE

SEQ ID NO: 2429953 - protein, 5 aa, Entamoeba dispar
HYRSP

SEQ ID NO: 2429954 - protein, 6 aa, Entamoeba dispar
HYRTGT

SEQ ID NO: 2429955 - protein, 5 aa, Entamoeba dispar
HYSDK

SEQ ID NO: 2429956 - protein, 4 aa, Entamoeba dispar
HYSL

SEQ ID NO: 2429957 - protein, 9 aa, Entamoeba dispar
HYSNIQPKH

SEQ ID NO: 2429958 - protein, 11 aa, Entamoeba dispar
HYSSQEGKNKV

SEQ ID NO: 2429959 - protein, 8 aa, Entamoeba dispar
HYSYDDER

SEQ ID NO: 2429960 - protein, 7 aa, Entamoeba dispar
HYTPNDT

SEQ ID NO: 2429961 - protein, 5 aa, Entamoeba dispar
HYTQK

SEQ ID NO: 2429962 - protein, 8 aa, Entamoeba dispar
HYTSNQSK

SEQ ID NO: 2429963 - protein, 11 aa, Entamoeba dispar
IAADPKTLQTE

SEQ ID NO: 2429964 - protein, 79 aa, Entamoeba dispar
IAAPPPPPVTNYSKPIQQEPEQPQEEQTDQQEKQYNQEEEQYGQQEEQYEQDEQYDQEEEGEYSDEEYDEDDDIAPEEI

SEQ ID NO: 2429965 - protein, 23 aa, Entamoeba dispar
IAAPPPSMNKPSVTIAAPPPSMN

SEQ ID NO: 2429966 - protein, 4 aa, Entamoeba dispar
IAAR

SEQ ID NO: 2429967 - protein, 10 aa, Entamoeba dispar
IADKIRKGNL

SEQ ID NO: 2429968 - protein, 18 aa, Entamoeba dispar
IADKSQEEVVNKEDLDRL

SEQ ID NO: 2429969 - protein, 15 aa, Entamoeba dispar
IADRKKKWEFSHNVI

SEQ ID NO: 2429970 - protein, 13 aa, Entamoeba dispar
IADRKRSKEEKEI

SEQ ID NO: 2429971 - protein, 7 aa, Entamoeba dispar
IADSTSS

SEQ ID NO: 2429972 - protein, 54 aa, Entamoeba dispar
IADYETKEASFNSQIGKTQAELKKYQQQVRDDETRMSSLEDEIKKGTDALANKQ

SEQ ID NO: 2429973 - protein, 9 aa, Entamoeba dispar
IAEDDGPVH

SEQ ID NO: 2429974 - protein, 28 aa, Entamoeba dispar
IAEEKGKKKSIKKKASKKTSSKKKKTQQ

SEQ ID NO: 2429975 - protein, 6 aa, Entamoeba dispar
IAEFNG

SEQ ID NO: 2429976 - protein, 11 aa, Entamoeba dispar
IAEGKLSNELK

SEQ ID NO: 2429977 - protein, 7 aa, Entamoeba dispar
IAEGNEY

SEQ ID NO: 2429978 - protein, 9 aa, Entamoeba dispar
IAEKEDPKQ

SEQ ID NO: 2429979 - protein, 10 aa, Entamoeba dispar
IAEKPRLAET

SEQ ID NO: 2429980 - protein, 10 aa, Entamoeba dispar
IAEKTPGYSG

SEQ ID NO: 2429981 - protein, 4 aa, Entamoeba dispar
IAEN

SEQ ID NO: 2429982 - protein, 4 aa, Entamoeba dispar
IAEP

SEQ ID NO: 2429983 - protein, 7 aa, Entamoeba dispar
IAEPTSE

SEQ ID NO: 2429984 - protein, 9 aa, Entamoeba dispar
IAEPTSEAL

SEQ ID NO: 2429985 - protein, 9 aa, Entamoeba dispar
IAERKAQLA

SEQ ID NO: 2429986 - protein, 7 aa, Entamoeba dispar
IAERREQ

SEQ ID NO: 2429987 - protein, 4 aa, Entamoeba dispar
IAES

SEQ ID NO: 2429988 - protein, 13 aa, Entamoeba dispar
IAESLKHDNNQDL

SEQ ID NO: 2429989 - protein, 9 aa, Entamoeba dispar
IAESSITVP

SEQ ID NO: 2429990 - protein, 8 aa, Entamoeba dispar
IAETGMGD

SEQ ID NO: 2429991 - protein, 9 aa, Entamoeba dispar
IAETGSGKT

SEQ ID NO: 2429992 - protein, 9 aa, Entamoeba dispar
IAETSITIP

SEQ ID NO: 2429993 - protein, 5 aa, Entamoeba dispar
IAEYD

SEQ ID NO: 2429994 - protein, 4 aa, Entamoeba dispar
IAGE

SEQ ID NO: 2429995 - protein, 5 aa, Entamoeba dispar
IAGGA

SEQ ID NO: 2429996 - protein, 5 aa, Entamoeba dispar
IAGGF

SEQ ID NO: 2429997 - protein, 17 aa, Entamoeba dispar
IAGKDGKTKFSIENTTH

SEQ ID NO: 2429998 - protein, 8 aa, Entamoeba dispar
IAGKEREE

SEQ ID NO: 2429999 - protein, 8 aa, Entamoeba dispar
IAGNEREE

SEQ ID NO: 2430000 - protein, 8 aa, Entamoeba dispar
IAGPTSNV

SEQ ID NO: 2430001 - protein, 5 aa, Entamoeba dispar
IAHSK

SEQ ID NO: 2430002 - protein, 8 aa, Entamoeba dispar
IAHTQQPK

SEQ ID NO: 2430003 - protein, 10 aa, Entamoeba dispar
IAKDAGATSF

SEQ ID NO: 2430004 - protein, 12 aa, Entamoeba dispar
IAKDGTEKAEID

SEQ ID NO: 2430005 - protein, 12 aa, Entamoeba dispar
IAKDNNKDKTLT

SEQ ID NO: 2430006 - protein, 7 aa, Entamoeba dispar
IAKDPSQ

SEQ ID NO: 2430007 - protein, 15 aa, Entamoeba dispar
IAKEDGLSSSKLHGK

SEQ ID NO: 2430008 - protein, 5 aa, Entamoeba dispar
IAKET

SEQ ID NO: 2430009 - protein, 8 aa, Entamoeba dispar
IAKGENKE

SEQ ID NO: 2430010 - protein, 5 aa, Entamoeba dispar
IAKGL

SEQ ID NO: 2430011 - protein, 11 aa, Entamoeba dispar
IAKKPWSKEED

SEQ ID NO: 2430012 - protein, 7 aa, Entamoeba dispar
IAKNSGV

SEQ ID NO: 2430013 - protein, 9 aa, Entamoeba dispar
IAKSGNALA

SEQ ID NO: 2430014 - protein, 10 aa, Entamoeba dispar
IAKTANRRRT

SEQ ID NO: 2430015 - protein, 9 aa, Entamoeba dispar
IAKTSKNSD

SEQ ID NO: 2430016 - protein, 6 aa, Entamoeba dispar
IANEAA

SEQ ID NO: 2430017 - protein, 34 aa, Entamoeba dispar
IANERRPKLDDGKKKKTDSEDDQNNQQMEEDEEM

SEQ ID NO: 2430018 - protein, 33 aa, Entamoeba dispar
IANESNDSLNDSVQIDNAESPPHPPSRSANKSI

SEQ ID NO: 2430019 - protein, 8 aa, Entamoeba dispar
IANEYRGG

SEQ ID NO: 2430020 - protein, 6 aa, Entamoeba dispar
IANGEE

SEQ ID NO: 2430021 - protein, 6 aa, Entamoeba dispar
IANNNE

SEQ ID NO: 2430022 - protein, 25 aa, Entamoeba dispar
IANSEEALKSMPKDKLDKLKNTYKQ

SEQ ID NO: 2430023 - protein, 9 aa, Entamoeba dispar
IANSEKVRR

SEQ ID NO: 2430024 - protein, 6 aa, Entamoeba dispar
IANTPR

SEQ ID NO: 2430025 - protein, 14 aa, Entamoeba dispar
IAPDPNESIGIDTE

SEQ ID NO: 2430026 - protein, 13 aa, Entamoeba dispar
IAPDQQRKGYGSQ

SEQ ID NO: 2430027 - protein, 7 aa, Entamoeba dispar
IAPEGSV

SEQ ID NO: 2430028 - protein, 5 aa, Entamoeba dispar
IAPET

SEQ ID NO: 2430029 - protein, 10 aa, Entamoeba dispar
IAPGNETQYH

SEQ ID NO: 2430030 - protein, 31 aa, Entamoeba dispar
IAPKPISKPKEESDSSSDGYENSDGEYVEKP

SEQ ID NO: 2430031 - protein, 11 aa, Entamoeba dispar
IAPNPAAAQKL

SEQ ID NO: 2430032 - protein, 12 aa, Entamoeba dispar
IAPPEAPCNGYR

SEQ ID NO: 2430033 - protein, 8 aa, Entamoeba dispar
IAPQTPKY

SEQ ID NO: 2430034 - protein, 6 aa, Entamoeba dispar
IAPRNG

SEQ ID NO: 2430035 - protein, 5 aa, Entamoeba dispar
IAPSI

SEQ ID NO: 2430036 - protein, 6 aa, Entamoeba dispar
IAPVSS

SEQ ID NO: 2430037 - protein, 4 aa, Entamoeba dispar
IAQE

SEQ ID NO: 2430038 - protein, 7 aa, Entamoeba dispar
IAQEQKE

SEQ ID NO: 2430039 - protein, 9 aa, Entamoeba dispar
IAQGQNQIN

SEQ ID NO: 2430040 - protein, 8 aa, Entamoeba dispar
IAQKGNYG

SEQ ID NO: 2430041 - protein, 8 aa, Entamoeba dispar
IAQNNAKI

SEQ ID NO: 2430042 - protein, 18 aa, Entamoeba dispar
IAQSRGANNGDSGASDRV

SEQ ID NO: 2430043 - protein, 7 aa, Entamoeba dispar
IAQTPPF

SEQ ID NO: 2430044 - protein, 40 aa, Entamoeba dispar
IARDLSREKKAEERSKRILNKDKKKAREKSKQLRKEKDAI

SEQ ID NO: 2430045 - protein, 9 aa, Entamoeba dispar
IAREEENTL

SEQ ID NO: 2430046 - protein, 9 aa, Entamoeba dispar
IAREEHGSD

SEQ ID NO: 2430047 - protein, 13 aa, Entamoeba dispar
IARENNLNSFRSG

SEQ ID NO: 2430048 - protein, 5 aa, Entamoeba dispar
IARSD

SEQ ID NO: 2430049 - protein, 8 aa, Entamoeba dispar
IARSGTKT

SEQ ID NO: 2430050 - protein, 8 aa, Entamoeba dispar
IARSKKLD

SEQ ID NO: 2430051 - protein, 12 aa, Entamoeba dispar
IASGEEEVSPST

SEQ ID NO: 2430052 - protein, 11 aa, Entamoeba dispar
IASGENVIGTT

SEQ ID NO: 2430053 - protein, 5 aa, Entamoeba dispar
IASGG

SEQ ID NO: 2430054 - protein, 10 aa, Entamoeba dispar
IASKRKGGSV

SEQ ID NO: 2430055 - protein, 5 aa, Entamoeba dispar
IASKT

SEQ ID NO: 2430056 - protein, 22 aa, Entamoeba dispar
IASKTEQPKRSYDEINNETSIQ

SEQ ID NO: 2430057 - protein, 11 aa, Entamoeba dispar
IASLQAASNEL

SEQ ID NO: 2430058 - protein, 6 aa, Entamoeba dispar
IASPNI

SEQ ID NO: 2430059 - protein, 7 aa, Entamoeba dispar
IASQSNA

SEQ ID NO: 2430060 - protein, 7 aa, Entamoeba dispar
IASSDVT

SEQ ID NO: 2430061 - protein, 7 aa, Entamoeba dispar
IASSGGI

SEQ ID NO: 2430062 - protein, 19 aa, Entamoeba dispar
IASSKQVVGGDKSTLDTSG

SEQ ID NO: 2430063 - protein, 8 aa, Entamoeba dispar
IASSSKAF

SEQ ID NO: 2430064 - protein, 7 aa, Entamoeba dispar
IASTEEP

SEQ ID NO: 2430065 - protein, 19 aa, Entamoeba dispar
IASTPEEVKEAYETCRKNG

SEQ ID NO: 2430066 - protein, 10 aa, Entamoeba dispar
IASTTSAVRK

SEQ ID NO: 2430067 - protein, 11 aa, Entamoeba dispar
IASVPTKTLKD

SEQ ID NO: 2430068 - protein, 10 aa, Entamoeba dispar
IATASDDKTV

SEQ ID NO: 2430069 - protein, 10 aa, Entamoeba dispar
IATGKSTLGS

SEQ ID NO: 2430070 - protein, 8 aa, Entamoeba dispar
IATGSNDK

SEQ ID NO: 2430071 - protein, 16 aa, Entamoeba dispar
IATKRHDAQNGADREV

SEQ ID NO: 2430072 - protein, 6 aa, Entamoeba dispar
IATLGD

SEQ ID NO: 2430073 - protein, 13 aa, Entamoeba dispar
IATNKPSEEEKKE

SEQ ID NO: 2430074 - protein, 6 aa, Entamoeba dispar
IATNPY

SEQ ID NO: 2430075 - protein, 10 aa, Entamoeba dispar
IATPNTSLNN

SEQ ID NO: 2430076 - protein, 17 aa, Entamoeba dispar
IATQEPSLYETKDTTKL

SEQ ID NO: 2430077 - protein, 5 aa, Entamoeba dispar
IATRK

SEQ ID NO: 2430078 - protein, 13 aa, Entamoeba dispar
IATRTEDKIKQLQ

SEQ ID NO: 2430079 - protein, 20 aa, Entamoeba dispar
IATTRSTSIQSLNASSKEPC

SEQ ID NO: 2430080 - protein, 4 aa, Entamoeba dispar
IAYE

SEQ ID NO: 2430081 - protein, 13 aa, Entamoeba dispar
ICASGDENFSKTM

SEQ ID NO: 2430082 - protein, 6 aa, Entamoeba dispar
ICNNEH

SEQ ID NO: 2430083 - protein, 6 aa, Entamoeba dispar
IDAEGV

SEQ ID NO: 2430084 - protein, 8 aa, Entamoeba dispar
IDAESKDQ

SEQ ID NO: 2430085 - protein, 11 aa, Entamoeba dispar
IDAKDKKVTKE

SEQ ID NO: 2430086 - protein, 6 aa, Entamoeba dispar
IDAVPS

SEQ ID NO: 2430087 - protein, 29 aa, Entamoeba dispar
IDCPENTDGGFKRKSNYNTEDTGKHIRFD

SEQ ID NO: 2430088 - protein, 15 aa, Entamoeba dispar
IDCSVEKSALDTFNE

SEQ ID NO: 2430089 - protein, 9 aa, Entamoeba dispar
IDDDEDELV

SEQ ID NO: 2430090 - protein, 18 aa, Entamoeba dispar
IDDDENQLPITQQQLQSK

SEQ ID NO: 2430091 - protein, 12 aa, Entamoeba dispar
IDDDSDTAEELK

SEQ ID NO: 2430092 - protein, 11 aa, Entamoeba dispar
IDDENSRKNSS

SEQ ID NO: 2430093 - protein, 5 aa, Entamoeba dispar
IDDEQ

SEQ ID NO: 2430094 - protein, 9 aa, Entamoeba dispar
IDDESHEVR

SEQ ID NO: 2430095 - protein, 8 aa, Entamoeba dispar
IDDETDEQ

SEQ ID NO: 2430096 - protein, 7 aa, Entamoeba dispar
IDDEYSN

SEQ ID NO: 2430097 - protein, 13 aa, Entamoeba dispar
IDDITKGTAYISS

SEQ ID NO: 2430098 - protein, 7 aa, Entamoeba dispar
IDDKKDY

SEQ ID NO: 2430099 - protein, 12 aa, Entamoeba dispar
IDDKSNQSEYAQ

SEQ ID NO: 2430100 - protein, 6 aa, Entamoeba dispar
IDDKVG

SEQ ID NO: 2430101 - protein, 8 aa, Entamoeba dispar
IDDNGNSY

SEQ ID NO: 2430102 - protein, 9 aa, Entamoeba dispar
IDDNNEYDD

SEQ ID NO: 2430103 - protein, 8 aa, Entamoeba dispar
IDDPEQEL

SEQ ID NO: 2430104 - protein, 4 aa, Entamoeba dispar
IDDQ

SEQ ID NO: 2430105 - protein, 13 aa, Entamoeba dispar
IDDRIEKKEEEPV

SEQ ID NO: 2430106 - protein, 16 aa, Entamoeba dispar
IDDSDDDSKDKDKKKI

SEQ ID NO: 2430107 - protein, 6 aa, Entamoeba dispar
IDDSEL

SEQ ID NO: 2430108 - protein, 8 aa, Entamoeba dispar
IDDSSKIV

SEQ ID NO: 2430109 - protein, 8 aa, Entamoeba dispar
IDDTNNPI

SEQ ID NO: 2430110 - protein, 17 aa, Entamoeba dispar
IDEAEDDVSYQETKELA

SEQ ID NO: 2430111 - protein, 4 aa, Entamoeba dispar
IDED

SEQ ID NO: 2430112 - protein, 5 aa, Entamoeba dispar
IDEDE

SEQ ID NO: 2430113 - protein, 19 aa, Entamoeba dispar
IDEDGDGKISLQEFMLLYD

SEQ ID NO: 2430114 - protein, 4 aa, Entamoeba dispar
IDEE

SEQ ID NO: 2430115 - protein, 13 aa, Entamoeba dispar
IDEEDEVDEVDDY

SEQ ID NO: 2430116 - protein, 7 aa, Entamoeba dispar
IDEEDSI

SEQ ID NO: 2430117 - protein, 5 aa, Entamoeba dispar
IDEEE

SEQ ID NO: 2430118 - protein, 11 aa, Entamoeba dispar
IDEEGVDTPMS

SEQ ID NO: 2430119 - protein, 6 aa, Entamoeba dispar
IDEENY

SEQ ID NO: 2430120 - protein, 8 aa, Entamoeba dispar
IDEERKDK

SEQ ID NO: 2430121 - protein, 29 aa, Entamoeba dispar
IDEIKKNYEEYKTINNTQCELTKEGDWRN

SEQ ID NO: 2430122 - protein, 12 aa, Entamoeba dispar
IDEITSSMNELD

SEQ ID NO: 2430123 - protein, 5 aa, Entamoeba dispar
IDEKE

SEQ ID NO: 2430124 - protein, 9 aa, Entamoeba dispar
IDEKEDEKN

SEQ ID NO: 2430125 - protein, 5 aa, Entamoeba dispar
IDEKS

SEQ ID NO: 2430126 - protein, 22 aa, Entamoeba dispar
IDELKKEDKQITKEVEKAEKDV

SEQ ID NO: 2430127 - protein, 16 aa, Entamoeba dispar
IDELKQKQHKKEIKQN

SEQ ID NO: 2430128 - protein, 4 aa, Entamoeba dispar
IDEN

SEQ ID NO: 2430129 - protein, 8 aa, Entamoeba dispar
IDENNSPI

SEQ ID NO: 2430130 - protein, 7 aa, Entamoeba dispar
IDEPEKE

SEQ ID NO: 2430131 - protein, 5 aa, Entamoeba dispar
IDEPP

SEQ ID NO: 2430132 - protein, 10 aa, Entamoeba dispar
IDEPQTVKDA

SEQ ID NO: 2430133 - protein, 4 aa, Entamoeba dispar
IDEQ

SEQ ID NO: 2430134 - protein, 5 aa, Entamoeba dispar
IDEQA

SEQ ID NO: 2430135 - protein, 7 aa, Entamoeba dispar
IDEQGSI

SEQ ID NO: 2430136 - protein, 7 aa, Entamoeba dispar
IDEQSGL

SEQ ID NO: 2430137 - protein, 9 aa, Entamoeba dispar
IDERGSNKF

SEQ ID NO: 2430138 - protein, 12 aa, Entamoeba dispar
IDERSKIDDGSF

SEQ ID NO: 2430139 - protein, 4 aa, Entamoeba dispar
IDES

SEQ ID NO: 2430140 - protein, 8 aa, Entamoeba dispar
IDESNSHT

SEQ ID NO: 2430141 - protein, 8 aa, Entamoeba dispar
IDESSSKY

SEQ ID NO: 2430142 - protein, 5 aa, Entamoeba dispar
IDESY

SEQ ID NO: 2430143 - protein, 13 aa, Entamoeba dispar
IDETCTKLESGGI

SEQ ID NO: 2430144 - protein, 30 aa, Entamoeba dispar
IDETLTHNNSSNPSTNNSTCTSRSSTPPLN

SEQ ID NO: 2430145 - protein, 9 aa, Entamoeba dispar
IDETNPKPH

SEQ ID NO: 2430146 - protein, 9 aa, Entamoeba dispar
IDETNSRPH

SEQ ID NO: 2430147 - protein, 5 aa, Entamoeba dispar
IDETS

SEQ ID NO: 2430148 - protein, 10 aa, Entamoeba dispar
IDETSQEGKL

SEQ ID NO: 2430149 - protein, 8 aa, Entamoeba dispar
IDETTDIL

SEQ ID NO: 2430150 - protein, 7 aa, Entamoeba dispar
IDEVSTQ

SEQ ID NO: 2430151 - protein, 4 aa, Entamoeba dispar
IDFE

SEQ ID NO: 2430152 - protein, 8 aa, Entamoeba dispar
IDFEPRKD

SEQ ID NO: 2430153 - protein, 5 aa, Entamoeba dispar
IDGDA

SEQ ID NO: 2430154 - protein, 9 aa, Entamoeba dispar
IDGDTTDVE

SEQ ID NO: 2430155 - protein, 29 aa, Entamoeba dispar
IDGEGIKQEITQEQNLQKNDLNHKVKQED

SEQ ID NO: 2430156 - protein, 18 aa, Entamoeba dispar
IDGGAGVWDSATASLEYP

SEQ ID NO: 2430157 - protein, 10 aa, Entamoeba dispar
IDGGTSGFIG

SEQ ID NO: 2430158 - protein, 5 aa, Entamoeba dispar
IDGKA

SEQ ID NO: 2430159 - protein, 7 aa, Entamoeba dispar
IDGKEFK

SEQ ID NO: 2430160 - protein, 7 aa, Entamoeba dispar
IDGKSGV

SEQ ID NO: 2430161 - protein, 6 aa, Entamoeba dispar
IDGLNG

SEQ ID NO: 2430162 - protein, 7 aa, Entamoeba dispar
IDGNGEI

SEQ ID NO: 2430163 - protein, 40 aa, Entamoeba dispar
IDGSDQIIENTNKLKDNENQIKTSTLDDSINREEIKGKDN

SEQ ID NO: 2430164 - protein, 4 aa, Entamoeba dispar
IDGT

SEQ ID NO: 2430165 - protein, 12 aa, Entamoeba dispar
IDGTDQNEELYL

SEQ ID NO: 2430166 - protein, 4 aa, Entamoeba dispar
IDHE

SEQ ID NO: 2430167 - protein, 16 aa, Entamoeba dispar
IDHKKNSVDKEISDTE

SEQ ID NO: 2430168 - protein, 11 aa, Entamoeba dispar
IDHNTSNEEEV

SEQ ID NO: 2430169 - protein, 15 aa, Entamoeba dispar
IDHTEYDSDDEDLNC

SEQ ID NO: 2430170 - protein, 10 aa, Entamoeba dispar
IDIANSDALQ

SEQ ID NO: 2430171 - protein, 25 aa, Entamoeba dispar
IDIEQPEKQIDIPKSNSEMSKPVTQ

SEQ ID NO: 2430172 - protein, 10 aa, Entamoeba dispar
IDIPSSVSKI

SEQ ID NO: 2430173 - protein, 7 aa, Entamoeba dispar
IDIPSTI

SEQ ID NO: 2430174 - protein, 10 aa, Entamoeba dispar
IDIPTSVKEI

SEQ ID NO: 2430175 - protein, 10 aa, Entamoeba dispar
IDIPTSVSKI

SEQ ID NO: 2430176 - protein, 10 aa, Entamoeba dispar
IDKDMSRNKQ

SEQ ID NO: 2430177 - protein, 7 aa, Entamoeba dispar
IDKDSVK

SEQ ID NO: 2430178 - protein, 9 aa, Entamoeba dispar
IDKEGPGNC

SEQ ID NO: 2430179 - protein, 4 aa, Entamoeba dispar
IDKG

SEQ ID NO: 2430180 - protein, 10 aa, Entamoeba dispar
IDKGSVISKE

SEQ ID NO: 2430181 - protein, 9 aa, Entamoeba dispar
IDKKGRDFS

SEQ ID NO: 2430182 - protein, 8 aa, Entamoeba dispar
IDKNGTTF

SEQ ID NO: 2430183 - protein, 7 aa, Entamoeba dispar
IDKNKSE

SEQ ID NO: 2430184 - protein, 9 aa, Entamoeba dispar
IDKNSKPFY

SEQ ID NO: 2430185 - protein, 9 aa, Entamoeba dispar
IDKPQRDED

SEQ ID NO: 2430186 - protein, 8 aa, Entamoeba dispar
IDKPSKGD

SEQ ID NO: 2430187 - protein, 18 aa, Entamoeba dispar
IDKQTKIISTKEAERFAN

SEQ ID NO: 2430188 - protein, 4 aa, Entamoeba dispar
IDKS

SEQ ID NO: 2430189 - protein, 5 aa, Entamoeba dispar
IDKSH

SEQ ID NO: 2430190 - protein, 5 aa, Entamoeba dispar
IDKTA

SEQ ID NO: 2430191 - protein, 6 aa, Entamoeba dispar
IDKTAR

SEQ ID NO: 2430192 - protein, 6 aa, Entamoeba dispar
IDKTDG

SEQ ID NO: 2430193 - protein, 9 aa, Entamoeba dispar
IDKTKDMEN

SEQ ID NO: 2430194 - protein, 11 aa, Entamoeba dispar
IDKTKKTSRAK

SEQ ID NO: 2430195 - protein, 8 aa, Entamoeba dispar
IDKTNLGK

SEQ ID NO: 2430196 - protein, 4 aa, Entamoeba dispar
IDLP

SEQ ID NO: 2430197 - protein, 5 aa, Entamoeba dispar
IDLTE

SEQ ID NO: 2430198 - protein, 6 aa, Entamoeba dispar
IDNDGA

SEQ ID NO: 2430199 - protein, 20 aa, Entamoeba dispar
IDNDSERSAKTLSGGERSYS

SEQ ID NO: 2430200 - protein, 7 aa, Entamoeba dispar
IDNDSSR

SEQ ID NO: 2430201 - protein, 4 aa, Entamoeba dispar
IDNE

SEQ ID NO: 2430202 - protein, 15 aa, Entamoeba dispar
IDNEEPLKTPQLSHK

SEQ ID NO: 2430203 - protein, 9 aa, Entamoeba dispar
IDNEGKTPL

SEQ ID NO: 2430204 - protein, 9 aa, Entamoeba dispar
IDNENPHTF

SEQ ID NO: 2430205 - protein, 7 aa, Entamoeba dispar
IDNEPEG

SEQ ID NO: 2430206 - protein, 8 aa, Entamoeba dispar
IDNGDEEE

SEQ ID NO: 2430207 - protein, 16 aa, Entamoeba dispar
IDNGQLNQQSDDEEEL

SEQ ID NO: 2430208 - protein, 8 aa, Entamoeba dispar
IDNGTVSV

SEQ ID NO: 2430209 - protein, 17 aa, Entamoeba dispar
IDNKKNSNKEKKPKKNL

SEQ ID NO: 2430210 - protein, 6 aa, Entamoeba dispar
IDNKNT

SEQ ID NO: 2430211 - protein, 14 aa, Entamoeba dispar
IDNKTQTKLTKNNV

SEQ ID NO: 2430212 - protein, 17 aa, Entamoeba dispar
IDNLQQEKKQTKKSFDE

SEQ ID NO: 2430213 - protein, 9 aa, Entamoeba dispar
IDNNTQNRE

SEQ ID NO: 2430214 - protein, 62 aa, Entamoeba dispar
IDNNTSQKENEEKSKRKEGIKERPKSLKEKLSPRKENKEEKKELKIEKEKKVKDIKNKKEVI

SEQ ID NO: 2430215 - protein, 63 aa, Entamoeba dispar
IDNNTSQKENEEKSKRKEGIKERPKSLKEKLSPRKENKEEKKELKIEKEKKVKDIKNKKEVID

SEQ ID NO: 2430216 - protein, 10 aa, Entamoeba dispar
IDNQGNFSNN

SEQ ID NO: 2430217 - protein, 9 aa, Entamoeba dispar
IDNQRESVS

SEQ ID NO: 2430218 - protein, 4 aa, Entamoeba dispar
IDNS

SEQ ID NO: 2430219 - protein, 6 aa, Entamoeba dispar
IDNSGE

SEQ ID NO: 2430220 - protein, 13 aa, Entamoeba dispar
IDNSPRINPPSSA

SEQ ID NO: 2430221 - protein, 8 aa, Entamoeba dispar
IDNSSDTV

SEQ ID NO: 2430222 - protein, 7 aa, Entamoeba dispar
IDNSSEY

SEQ ID NO: 2430223 - protein, 8 aa, Entamoeba dispar
IDNSTGVD

SEQ ID NO: 2430224 - protein, 4 aa, Entamoeba dispar
IDNT

SEQ ID NO: 2430225 - protein, 9 aa, Entamoeba dispar
IDPANPNPY

SEQ ID NO: 2430226 - protein, 15 aa, Entamoeba dispar
IDPAPYSFDAIIDSM

SEQ ID NO: 2430227 - protein, 13 aa, Entamoeba dispar
IDPEDKTKEGPVK

SEQ ID NO: 2430228 - protein, 14 aa, Entamoeba dispar
IDPEKAIKEMPSKR

SEQ ID NO: 2430229 - protein, 8 aa, Entamoeba dispar
IDPERRKL

SEQ ID NO: 2430230 - protein, 10 aa, Entamoeba dispar
IDPESDKFET

SEQ ID NO: 2430231 - protein, 7 aa, Entamoeba dispar
IDPETSI

SEQ ID NO: 2430232 - protein, 14 aa, Entamoeba dispar
IDPGEGNENQREAL

SEQ ID NO: 2430233 - protein, 6 aa, Entamoeba dispar
IDPHAI

SEQ ID NO: 2430234 - protein, 14 aa, Entamoeba dispar
IDPNNAEATSGITT

SEQ ID NO: 2430235 - protein, 4 aa, Entamoeba dispar
IDPP

SEQ ID NO: 2430236 - protein, 9 aa, Entamoeba dispar
IDPPGCTDI

SEQ ID NO: 2430237 - protein, 7 aa, Entamoeba dispar
IDPPQSM

SEQ ID NO: 2430238 - protein, 5 aa, Entamoeba dispar
IDPPR

SEQ ID NO: 2430239 - protein, 4 aa, Entamoeba dispar
IDPQ

SEQ ID NO: 2430240 - protein, 8 aa, Entamoeba dispar
IDPSNPKA

SEQ ID NO: 2430241 - protein, 5 aa, Entamoeba dispar
IDPSV

SEQ ID NO: 2430242 - protein, 5 aa, Entamoeba dispar
IDPTK

SEQ ID NO: 2430243 - protein, 6 aa, Entamoeba dispar
IDPTQR

SEQ ID NO: 2430244 - protein, 9 aa, Entamoeba dispar
IDQAESTGE

SEQ ID NO: 2430245 - protein, 7 aa, Entamoeba dispar
IDQANGS

SEQ ID NO: 2430246 - protein, 24 aa, Entamoeba dispar
IDQEEQKITQQQEKQLKEAEEEKI

SEQ ID NO: 2430247 - protein, 7 aa, Entamoeba dispar
IDQEHKN

SEQ ID NO: 2430248 - protein, 7 aa, Entamoeba dispar
IDQIDEE

SEQ ID NO: 2430249 - protein, 4 aa, Entamoeba dispar
IDQL

SEQ ID NO: 2430250 - protein, 6 aa, Entamoeba dispar
IDQMNG

SEQ ID NO: 2430251 - protein, 11 aa, Entamoeba dispar
IDQNEDNQRTE

SEQ ID NO: 2430252 - protein, 7 aa, Entamoeba dispar
IDQNTGD

SEQ ID NO: 2430253 - protein, 16 aa, Entamoeba dispar
IDQQHQQSSNTTMPSI

SEQ ID NO: 2430254 - protein, 33 aa, Entamoeba dispar
IDQQQATSYAGTNITLPGSTSDGSMAGSWSTQT

SEQ ID NO: 2430255 - protein, 6 aa, Entamoeba dispar
IDQQSI

SEQ ID NO: 2430256 - protein, 12 aa, Entamoeba dispar
IDQRGDLDSLFH

SEQ ID NO: 2430257 - protein, 12 aa, Entamoeba dispar
IDQSQQSKSIYF

SEQ ID NO: 2430258 - protein, 5 aa, Entamoeba dispar
IDQSY

SEQ ID NO: 2430259 - protein, 6 aa, Entamoeba dispar
IDRDSQ

SEQ ID NO: 2430260 - protein, 4 aa, Entamoeba dispar
IDRM

SEQ ID NO: 2430261 - protein, 29 aa, Entamoeba dispar
IDRNRNQRRENSNNLNSSSSTTNQKYNNL

SEQ ID NO: 2430262 - protein, 10 aa, Entamoeba dispar
IDRPNSGDLN

SEQ ID NO: 2430263 - protein, 7 aa, Entamoeba dispar
IDRQPNT

SEQ ID NO: 2430264 - protein, 8 aa, Entamoeba dispar
IDSDGRLA

SEQ ID NO: 2430265 - protein, 9 aa, Entamoeba dispar
IDSDNEDIN

SEQ ID NO: 2430266 - protein, 8 aa, Entamoeba dispar
IDSEGNNY

SEQ ID NO: 2430267 - protein, 7 aa, Entamoeba dispar
IDSEHPE

SEQ ID NO: 2430268 - protein, 14 aa, Entamoeba dispar
IDSEQQERNQVKNT

SEQ ID NO: 2430269 - protein, 7 aa, Entamoeba dispar
IDSGDGV

SEQ ID NO: 2430270 - protein, 8 aa, Entamoeba dispar
IDSGFSDG

SEQ ID NO: 2430271 - protein, 17 aa, Entamoeba dispar
IDSGQTSIKESLNQKYQ

SEQ ID NO: 2430272 - protein, 19 aa, Entamoeba dispar
IDSGSMAAQQIQGTESSSH

SEQ ID NO: 2430273 - protein, 10 aa, Entamoeba dispar
IDSKAGGKNI

SEQ ID NO: 2430274 - protein, 6 aa, Entamoeba dispar
IDSKNT

SEQ ID NO: 2430275 - protein, 7 aa, Entamoeba dispar
IDSKPKR

SEQ ID NO: 2430276 - protein, 22 aa, Entamoeba dispar
IDSKPLNLGTLEGKSAKDVGLE

SEQ ID NO: 2430277 - protein, 7 aa, Entamoeba dispar
IDSNAAD

SEQ ID NO: 2430278 - protein, 9 aa, Entamoeba dispar
IDSQERQKR

SEQ ID NO: 2430279 - protein, 7 aa, Entamoeba dispar
IDSQPTC

SEQ ID NO: 2430280 - protein, 7 aa, Entamoeba dispar
IDSQRNP

SEQ ID NO: 2430281 - protein, 5 aa, Entamoeba dispar
IDSSE

SEQ ID NO: 2430282 - protein, 7 aa, Entamoeba dispar
IDSSGNT

SEQ ID NO: 2430283 - protein, 12 aa, Entamoeba dispar
IDSSIKPTKPLP

SEQ ID NO: 2430284 - protein, 8 aa, Entamoeba dispar
IDSSRANE

SEQ ID NO: 2430285 - protein, 9 aa, Entamoeba dispar
IDSSSEYYN

SEQ ID NO: 2430286 - protein, 7 aa, Entamoeba dispar
IDSSSQE

SEQ ID NO: 2430287 - protein, 10 aa, Entamoeba dispar
IDSSSQWKSQ

SEQ ID NO: 2430288 - protein, 8 aa, Entamoeba dispar
IDSSYKDL

SEQ ID NO: 2430289 - protein, 4 aa, Entamoeba dispar
IDST

SEQ ID NO: 2430290 - protein, 6 aa, Entamoeba dispar
IDSTNT

SEQ ID NO: 2430291 - protein, 8 aa, Entamoeba dispar
IDSTPIKK

SEQ ID NO: 2430292 - protein, 13 aa, Entamoeba dispar
IDSTPIVDENEPY

SEQ ID NO: 2430293 - protein, 19 aa, Entamoeba dispar
IDSTQRDVTDSMSESYAHS

SEQ ID NO: 2430294 - protein, 15 aa, Entamoeba dispar
IDSTTPKRQSNAPVP

SEQ ID NO: 2430295 - protein, 4 aa, Entamoeba dispar
IDSY

SEQ ID NO: 2430296 - protein, 8 aa, Entamoeba dispar
IDTARKEQ

SEQ ID NO: 2430297 - protein, 29 aa, Entamoeba dispar
IDTETAHQTSKLAKSKSRSRTKSVKRGRD

SEQ ID NO: 2430298 - protein, 17 aa, Entamoeba dispar
IDTGDKETEKSINQQEE

SEQ ID NO: 2430299 - protein, 11 aa, Entamoeba dispar
IDTKKERQEID

SEQ ID NO: 2430300 - protein, 6 aa, Entamoeba dispar
IDTNKI

SEQ ID NO: 2430301 - protein, 6 aa, Entamoeba dispar
IDTNQK

SEQ ID NO: 2430302 - protein, 6 aa, Entamoeba dispar
IDTNSK

SEQ ID NO: 2430303 - protein, 6 aa, Entamoeba dispar
IDTNSN

SEQ ID NO: 2430304 - protein, 7 aa, Entamoeba dispar
IDTQPSQ

SEQ ID NO: 2430305 - protein, 26 aa, Entamoeba dispar
IDTQTGNYGASCKGHSINEQQVKEIT

SEQ ID NO: 2430306 - protein, 16 aa, Entamoeba dispar
IDTRKENEERILQFMI

SEQ ID NO: 2430307 - protein, 6 aa, Entamoeba dispar
IDTSGD

SEQ ID NO: 2430308 - protein, 11 aa, Entamoeba dispar
IDTSKKEISGY

SEQ ID NO: 2430309 - protein, 14 aa, Entamoeba dispar
IDTSNTNHSTTATL

SEQ ID NO: 2430310 - protein, 14 aa, Entamoeba dispar
IDTSSSEITIPSES

SEQ ID NO: 2430311 - protein, 10 aa, Entamoeba dispar
IDTTGAGDAF

SEQ ID NO: 2430312 - protein, 6 aa, Entamoeba dispar
IDTTSH

SEQ ID NO: 2430313 - protein, 6 aa, Entamoeba dispar
IDVDEN

SEQ ID NO: 2430314 - protein, 5 aa, Entamoeba dispar
IDVPS

SEQ ID NO: 2430315 - protein, 5 aa, Entamoeba dispar
IDVSK

SEQ ID NO: 2430316 - protein, 4 aa, Entamoeba dispar
IEAA

SEQ ID NO: 2430317 - protein, 6 aa, Entamoeba dispar
IEAEKE

SEQ ID NO: 2430318 - protein, 6 aa, Entamoeba dispar
IEANNE

SEQ ID NO: 2430319 - protein, 11 aa, Entamoeba dispar
IEARKKDGKKI

SEQ ID NO: 2430320 - protein, 10 aa, Entamoeba dispar
IEASKAEPRA

SEQ ID NO: 2430321 - protein, 4 aa, Entamoeba dispar
IEAT

SEQ ID NO: 2430322 - protein, 5 aa, Entamoeba dispar
IEDDA

SEQ ID NO: 2430323 - protein, 12 aa, Entamoeba dispar
IEDDEKENKESS

SEQ ID NO: 2430324 - protein, 6 aa, Entamoeba dispar
IEDDPI

SEQ ID NO: 2430325 - protein, 6 aa, Entamoeba dispar
IEDDSI

SEQ ID NO: 2430326 - protein, 13 aa, Entamoeba dispar
IEDDTLKHSKISS

SEQ ID NO: 2430327 - protein, 13 aa, Entamoeba dispar
IEDEKNSSTEKME

SEQ ID NO: 2430328 - protein, 14 aa, Entamoeba dispar
IEDFGDDEKERDAL

SEQ ID NO: 2430329 - protein, 12 aa, Entamoeba dispar
IEDFGKDEISSN

SEQ ID NO: 2430330 - protein, 7 aa, Entamoeba dispar
IEDGNNG

SEQ ID NO: 2430331 - protein, 4 aa, Entamoeba dispar
IEDH

SEQ ID NO: 2430332 - protein, 4 aa, Entamoeba dispar
IEDI

SEQ ID NO: 2430333 - protein, 17 aa, Entamoeba dispar
IEDIEQKEIKEKEEEME

SEQ ID NO: 2430334 - protein, 12 aa, Entamoeba dispar
IEDIGEDEEMTS

SEQ ID NO: 2430335 - protein, 5 aa, Entamoeba dispar
IEDKD

SEQ ID NO: 2430336 - protein, 8 aa, Entamoeba dispar
IEDKKSQL

SEQ ID NO: 2430337 - protein, 9 aa, Entamoeba dispar
IEDKSKKKI

SEQ ID NO: 2430338 - protein, 15 aa, Entamoeba dispar
IEDNKNKIKKQQNEE

SEQ ID NO: 2430339 - protein, 12 aa, Entamoeba dispar
IEDPDTDVNGAA

SEQ ID NO: 2430340 - protein, 10 aa, Entamoeba dispar
IEDPEDNVKV

SEQ ID NO: 2430341 - protein, 15 aa, Entamoeba dispar
IEDPKKPSENNEETS

SEQ ID NO: 2430342 - protein, 57 aa, Entamoeba dispar
IEDPKTTERYLEEERKRKELEKEKEEKAKIKKGKELGWTGQSIKKNQEDKASFLSKE

SEQ ID NO: 2430343 - protein, 19 aa, Entamoeba dispar
IEDQRSNKRRGKEDNKKWG

SEQ ID NO: 2430344 - protein, 5 aa, Entamoeba dispar
IEDRL

SEQ ID NO: 2430345 - protein, 6 aa, Entamoeba dispar
IEDRTD

SEQ ID NO: 2430346 - protein, 11 aa, Entamoeba dispar
IEDSKNTKRKF

SEQ ID NO: 2430347 - protein, 8 aa, Entamoeba dispar
IEDSQKKG

SEQ ID NO: 2430348 - protein, 6 aa, Entamoeba dispar
IEDSVN

SEQ ID NO: 2430349 - protein, 32 aa, Entamoeba dispar
IEDTKNNNVNEKSKKTEATKPKKTLTENNQQV

SEQ ID NO: 2430350 - protein, 5 aa, Entamoeba dispar
IEDTY

SEQ ID NO: 2430351 - protein, 8 aa, Entamoeba dispar
IEDTYNQF

SEQ ID NO: 2430352 - protein, 9 aa, Entamoeba dispar
IEEADREKI

SEQ ID NO: 2430353 - protein, 6 aa, Entamoeba dispar
IEEATD

SEQ ID NO: 2430354 - protein, 4 aa, Entamoeba dispar
IEEC

SEQ ID NO: 2430355 - protein, 4 aa, Entamoeba dispar
IEED

SEQ ID NO: 2430356 - protein, 7 aa, Entamoeba dispar
IEEDDMN

SEQ ID NO: 2430357 - protein, 12 aa, Entamoeba dispar
IEEDEDSDYDLE

SEQ ID NO: 2430358 - protein, 9 aa, Entamoeba dispar
IEEDIPGYY

SEQ ID NO: 2430359 - protein, 10 aa, Entamoeba dispar
IEEDKSEEGD

SEQ ID NO: 2430360 - protein, 7 aa, Entamoeba dispar
IEEDQDK

SEQ ID NO: 2430361 - protein, 19 aa, Entamoeba dispar
IEEDQQAIEDAITREEDEV

SEQ ID NO: 2430362 - protein, 10 aa, Entamoeba dispar
IEEDSDNINN

SEQ ID NO: 2430363 - protein, 21 aa, Entamoeba dispar
IEEDSEDEEIHRGPTPSAYKG

SEQ ID NO: 2430364 - protein, 11 aa, Entamoeba dispar
IEEDSKEQLSS

SEQ ID NO: 2430365 - protein, 16 aa, Entamoeba dispar
IEEEDDDDESEDDEND

SEQ ID NO: 2430366 - protein, 23 aa, Entamoeba dispar
IEEEDKQETNSQINTETKDKQIQ

SEQ ID NO: 2430367 - protein, 10 aa, Entamoeba dispar
IEEEECSIDT

SEQ ID NO: 2430368 - protein, 10 aa, Entamoeba dispar
IEEEEEKKKY

SEQ ID NO: 2430369 - protein, 9 aa, Entamoeba dispar
IEEEEHDPP

SEQ ID NO: 2430370 - protein, 20 aa, Entamoeba dispar
IEEEEKKFYKEKEEFKRKTE

SEQ ID NO: 2430371 - protein, 6 aa, Entamoeba dispar
IEEEEP

SEQ ID NO: 2430372 - protein, 9 aa, Entamoeba dispar
IEEEEPTNG

SEQ ID NO: 2430373 - protein, 5 aa, Entamoeba dispar
IEEEI

SEQ ID NO: 2430374 - protein, 38 aa, Entamoeba dispar
IEEEKDTLSQPKKIEGEMPTNKPKRVRKEKDIKPERSI

SEQ ID NO: 2430375 - protein, 11 aa, Entamoeba dispar
IEEEKSKGITI

SEQ ID NO: 2430376 - protein, 39 aa, Entamoeba dispar
IEEENERIKEEEKQTNKKKRVDSSRDTTIKESKNTIEGL

SEQ ID NO: 2430377 - protein, 13 aa, Entamoeba dispar
IEEENKCYGQGNL

SEQ ID NO: 2430378 - protein, 17 aa, Entamoeba dispar
IEEENSEDEFETVSDPQ

SEQ ID NO: 2430379 - protein, 11 aa, Entamoeba dispar
IEEERKNHAET

SEQ ID NO: 2430380 - protein, 7 aa, Entamoeba dispar
IEEESKN

SEQ ID NO: 2430381 - protein, 5 aa, Entamoeba dispar
IEEET

SEQ ID NO: 2430382 - protein, 6 aa, Entamoeba dispar
IEEETG

SEQ ID NO: 2430383 - protein, 8 aa, Entamoeba dispar
IEEETPNI

SEQ ID NO: 2430384 - protein, 6 aa, Entamoeba dispar
IEEEVN

SEQ ID NO: 2430385 - protein, 16 aa, Entamoeba dispar
IEEGAKTQSAVDQKEL

SEQ ID NO: 2430386 - protein, 9 aa, Entamoeba dispar
IEEGAVDRK

SEQ ID NO: 2430387 - protein, 11 aa, Entamoeba dispar
IEEGDENKYEM

SEQ ID NO: 2430388 - protein, 5 aa, Entamoeba dispar
IEEGE

SEQ ID NO: 2430389 - protein, 9 aa, Entamoeba dispar
IEEGELEEK

SEQ ID NO: 2430390 - protein, 21 aa, Entamoeba dispar
IEEGIPGYYEQKQGMTQEEKI

SEQ ID NO: 2430391 - protein, 10 aa, Entamoeba dispar
IEEGLKEEEY

SEQ ID NO: 2430392 - protein, 11 aa, Entamoeba dispar
IEEGNENKRKE

SEQ ID NO: 2430393 - protein, 9 aa, Entamoeba dispar
IEEGSESEE

SEQ ID NO: 2430394 - protein, 16 aa, Entamoeba dispar
IEEGSNEKGISKLKGE

SEQ ID NO: 2430395 - protein, 14 aa, Entamoeba dispar
IEEGYRKKESKEIG

SEQ ID NO: 2430396 - protein, 7 aa, Entamoeba dispar
IEEHNKQ

SEQ ID NO: 2430397 - protein, 5 aa, Entamoeba dispar
IEEIK

SEQ ID NO: 2430398 - protein, 4 aa, Entamoeba dispar
IEEK

SEQ ID NO: 2430399 - protein, 16 aa, Entamoeba dispar
IEEKDKKKRGKVNKKN

SEQ ID NO: 2430400 - protein, 12 aa, Entamoeba dispar
IEEKGFKGVEEN

SEQ ID NO: 2430401 - protein, 8 aa, Entamoeba dispar
IEEKKDEN

SEQ ID NO: 2430402 - protein, 14 aa, Entamoeba dispar
IEEKKRKKLGKYQE

SEQ ID NO: 2430403 - protein, 13 aa, Entamoeba dispar
IEEKKRNKIGKYQ

SEQ ID NO: 2430404 - protein, 15 aa, Entamoeba dispar
IEEKKRQEELERKNE

SEQ ID NO: 2430405 - protein, 8 aa, Entamoeba dispar
IEEKNQEF

SEQ ID NO: 2430406 - protein, 8 aa, Entamoeba dispar
IEEKRKTS

SEQ ID NO: 2430407 - protein, 15 aa, Entamoeba dispar
IEEKYTKARQRSINY

SEQ ID NO: 2430408 - protein, 4 aa, Entamoeba dispar
IEEL

SEQ ID NO: 2430409 - protein, 6 aa, Entamoeba dispar
IEELNK

SEQ ID NO: 2430410 - protein, 4 aa, Entamoeba dispar
IEEM

SEQ ID NO: 2430411 - protein, 15 aa, Entamoeba dispar
IEEMKEEDEKKEKMI

SEQ ID NO: 2430412 - protein, 13 aa, Entamoeba dispar
IEEMKKENTQLED

SEQ ID NO: 2430413 - protein, 11 aa, Entamoeba dispar
IEENADTKIND

SEQ ID NO: 2430414 - protein, 23 aa, Entamoeba dispar
IEENARGALEKQREKNKRELEDF

SEQ ID NO: 2430415 - protein, 17 aa, Entamoeba dispar
IEENEDKKVVTRDMDGN

SEQ ID NO: 2430416 - protein, 7 aa, Entamoeba dispar
IEENENG

SEQ ID NO: 2430417 - protein, 7 aa, Entamoeba dispar
IEENGKY

SEQ ID NO: 2430418 - protein, 10 aa, Entamoeba dispar
IEENNQSEYH

SEQ ID NO: 2430419 - protein, 8 aa, Entamoeba dispar
IEENPDEI

SEQ ID NO: 2430420 - protein, 5 aa, Entamoeba dispar
IEENQ

SEQ ID NO: 2430421 - protein, 6 aa, Entamoeba dispar
IEENRI

SEQ ID NO: 2430422 - protein, 5 aa, Entamoeba dispar
IEENS

SEQ ID NO: 2430423 - protein, 24 aa, Entamoeba dispar
IEENTTEKKKKEDRKEKKERKRKI

SEQ ID NO: 2430424 - protein, 10 aa, Entamoeba dispar
IEEPKNPENI

SEQ ID NO: 2430425 - protein, 20 aa, Entamoeba dispar
IEEPQSTVQRKDGFHEETEI

SEQ ID NO: 2430426 - protein, 5 aa, Entamoeba dispar
IEEPY

SEQ ID NO: 2430427 - protein, 11 aa, Entamoeba dispar
IEEQEKSIPDL

SEQ ID NO: 2430428 - protein, 11 aa, Entamoeba dispar
IEEQESKQRQL

SEQ ID NO: 2430429 - protein, 7 aa, Entamoeba dispar
IEEQKER

SEQ ID NO: 2430430 - protein, 5 aa, Entamoeba dispar
IEEQN

SEQ ID NO: 2430431 - protein, 6 aa, Entamoeba dispar
IEEQPK

SEQ ID NO: 2430432 - protein, 16 aa, Entamoeba dispar
IEEQRPKSILPRNRFF

SEQ ID NO: 2430433 - protein, 7 aa, Entamoeba dispar
IEEQSIA

SEQ ID NO: 2430434 - protein, 17 aa, Entamoeba dispar
IEEQTQEIKDEQIQEEI

SEQ ID NO: 2430435 - protein, 4 aa, Entamoeba dispar
IEER

SEQ ID NO: 2430436 - protein, 6 aa, Entamoeba dispar
IEEREE

SEQ ID NO: 2430437 - protein, 24 aa, Entamoeba dispar
IEERNEKMEECDENELERKKEAER

SEQ ID NO: 2430438 - protein, 10 aa, Entamoeba dispar
IEESDKKSIM

SEQ ID NO: 2430439 - protein, 9 aa, Entamoeba dispar
IEESIRRET

SEQ ID NO: 2430440 - protein, 8 aa, Entamoeba dispar
IEESKPSE

SEQ ID NO: 2430441 - protein, 6 aa, Entamoeba dispar
IEESQR

SEQ ID NO: 2430442 - protein, 10 aa, Entamoeba dispar
IEESRMPKQV

SEQ ID NO: 2430443 - protein, 7 aa, Entamoeba dispar
IEESSPS

SEQ ID NO: 2430444 - protein, 6 aa, Entamoeba dispar
IEETQT

SEQ ID NO: 2430445 - protein, 7 aa, Entamoeba dispar
IEGADKG

SEQ ID NO: 2430446 - protein, 6 aa, Entamoeba dispar
IEGAEE

SEQ ID NO: 2430447 - protein, 6 aa, Entamoeba dispar
IEGAGG

SEQ ID NO: 2430448 - protein, 11 aa, Entamoeba dispar
IEGDAEEAQRI

SEQ ID NO: 2430449 - protein, 5 aa, Entamoeba dispar
IEGDE

SEQ ID NO: 2430450 - protein, 10 aa, Entamoeba dispar
IEGDGDQNSW

SEQ ID NO: 2430451 - protein, 7 aa, Entamoeba dispar
IEGDQQK

SEQ ID NO: 2430452 - protein, 8 aa, Entamoeba dispar
IEGDVKSN

SEQ ID NO: 2430453 - protein, 4 aa, Entamoeba dispar
IEGE

SEQ ID NO: 2430454 - protein, 5 aa, Entamoeba dispar
IEGEA

SEQ ID NO: 2430455 - protein, 18 aa, Entamoeba dispar
IEGEAPKSIKSDLKKKQI

SEQ ID NO: 2430456 - protein, 15 aa, Entamoeba dispar
IEGEFEEPKINTTTP

SEQ ID NO: 2430457 - protein, 9 aa, Entamoeba dispar
IEGEGEKYH

SEQ ID NO: 2430458 - protein, 14 aa, Entamoeba dispar
IEGEGKIETIFGCE

SEQ ID NO: 2430459 - protein, 20 aa, Entamoeba dispar
IEGEKEEETTNDKKSTESDL

SEQ ID NO: 2430460 - protein, 7 aa, Entamoeba dispar
IEGENLA

SEQ ID NO: 2430461 - protein, 11 aa, Entamoeba dispar
IEGESPAGEIQ

SEQ ID NO: 2430462 - protein, 7 aa, Entamoeba dispar
IEGESTE

SEQ ID NO: 2430463 - protein, 17 aa, Entamoeba dispar
IEGGGNDLEKTHSDELT

SEQ ID NO: 2430464 - protein, 12 aa, Entamoeba dispar
IEGGQSYSVEGQ

SEQ ID NO: 2430465 - protein, 12 aa, Entamoeba dispar
IEGKKSESCDKE

SEQ ID NO: 2430466 - protein, 10 aa, Entamoeba dispar
IEGKQPKFIS

SEQ ID NO: 2430467 - protein, 9 aa, Entamoeba dispar
IEGKTKGVP

SEQ ID NO: 2430468 - protein, 5 aa, Entamoeba dispar
IEGKW

SEQ ID NO: 2430469 - protein, 12 aa, Entamoeba dispar
IEGNKNASKENV

SEQ ID NO: 2430470 - protein, 7 aa, Entamoeba dispar
IEGNRNG

SEQ ID NO: 2430471 - protein, 10 aa, Entamoeba dispar
IEGNSRIDPD

SEQ ID NO: 2430472 - protein, 5 aa, Entamoeba dispar
IEGRN

SEQ ID NO: 2430473 - protein, 11 aa, Entamoeba dispar
IEGSESTPQVS

SEQ ID NO: 2430474 - protein, 6 aa, Entamoeba dispar
IEGSNK

SEQ ID NO: 2430475 - protein, 23 aa, Entamoeba dispar
IEHNEGVDEFEARRKADEEIDKR

SEQ ID NO: 2430476 - protein, 7 aa, Entamoeba dispar
IEHPAKQ

SEQ ID NO: 2430477 - protein, 17 aa, Entamoeba dispar
IEHPNDRKFKNPDFKGF

SEQ ID NO: 2430478 - protein, 12 aa, Entamoeba dispar
IEHSDVKEKYDS

SEQ ID NO: 2430479 - protein, 10 aa, Entamoeba dispar
IEHSSQVDSD

SEQ ID NO: 2430480 - protein, 4 aa, Entamoeba dispar
IEIE

SEQ ID NO: 2430481 - protein, 9 aa, Entamoeba dispar
IEIKGETSI

SEQ ID NO: 2430482 - protein, 10 aa, Entamoeba dispar
IEIKGNKPIN

SEQ ID NO: 2430483 - protein, 12 aa, Entamoeba dispar
IEIPNSKEKGYG

SEQ ID NO: 2430484 - protein, 4 aa, Entamoeba dispar
IEIT

SEQ ID NO: 2430485 - protein, 15 aa, Entamoeba dispar
IEKDDAPFPSALDLI

SEQ ID NO: 2430486 - protein, 5 aa, Entamoeba dispar
IEKDE

SEQ ID NO: 2430487 - protein, 14 aa, Entamoeba dispar
IEKDESKLQKLPKK

SEQ ID NO: 2430488 - protein, 7 aa, Entamoeba dispar
IEKDKKD

SEQ ID NO: 2430489 - protein, 13 aa, Entamoeba dispar
IEKDSEGKEVEKQ

SEQ ID NO: 2430490 - protein, 50 aa, Entamoeba dispar
IEKEADKKKKKGGKKNLAKPATTGKKYTERVEDQLEDDYYDDEDEDDYDF

SEQ ID NO: 2430491 - protein, 8 aa, Entamoeba dispar
IEKEDEES

SEQ ID NO: 2430492 - protein, 8 aa, Entamoeba dispar
IEKEDEET

SEQ ID NO: 2430493 - protein, 6 aa, Entamoeba dispar
IEKEDK

SEQ ID NO: 2430494 - protein, 6 aa, Entamoeba dispar
IEKEEE

SEQ ID NO: 2430495 - protein, 13 aa, Entamoeba dispar
IEKEEKEKKIKEE

SEQ ID NO: 2430496 - protein, 16 aa, Entamoeba dispar
IEKEEPELAEEIRDNP

SEQ ID NO: 2430497 - protein, 8 aa, Entamoeba dispar
IEKEIEQS

SEQ ID NO: 2430498 - protein, 23 aa, Entamoeba dispar
IEKEKIKQQQFEARAKTAAMEKA

SEQ ID NO: 2430499 - protein, 8 aa, Entamoeba dispar
IEKENEEQ

SEQ ID NO: 2430500 - protein, 9 aa, Entamoeba dispar
IEKENEESM

SEQ ID NO: 2430501 - protein, 21 aa, Entamoeba dispar
IEKEQKSSKKNKKGKSKKIHE

SEQ ID NO: 2430502 - protein, 8 aa, Entamoeba dispar
IEKESEKE

SEQ ID NO: 2430503 - protein, 8 aa, Entamoeba dispar
IEKETGQK

SEQ ID NO: 2430504 - protein, 6 aa, Entamoeba dispar
IEKEVK

SEQ ID NO: 2430505 - protein, 8 aa, Entamoeba dispar
IEKGDEKQ

SEQ ID NO: 2430506 - protein, 5 aa, Entamoeba dispar
IEKGK

SEQ ID NO: 2430507 - protein, 11 aa, Entamoeba dispar
IEKGTSELEKL

SEQ ID NO: 2430508 - protein, 11 aa, Entamoeba dispar
IEKHKKKDFDA

SEQ ID NO: 2430509 - protein, 22 aa, Entamoeba dispar
  misc_feature (19)..(20): Xaa can be any naturally occurring amino acid
IEKHKKKDFDAVATEMITXXII

SEQ ID NO: 2430510 - protein, 8 aa, Entamoeba dispar
IEKIGKGG

SEQ ID NO: 2430511 - protein, 11 aa, Entamoeba dispar
IEKKKKKENLF

SEQ ID NO: 2430512 - protein, 15 aa, Entamoeba dispar
IEKKKNYSPFPPERD

SEQ ID NO: 2430513 - protein, 12 aa, Entamoeba dispar
IEKKPRKPKEED

SEQ ID NO: 2430514 - protein, 12 aa, Entamoeba dispar
IEKKPRQPKEED

SEQ ID NO: 2430515 - protein, 15 aa, Entamoeba dispar
IEKKRENDQRIIEEN

SEQ ID NO: 2430516 - protein, 11 aa, Entamoeba dispar
IEKKSTKNNYR

SEQ ID NO: 2430517 - protein, 10 aa, Entamoeba dispar
IEKNEKTGKN

SEQ ID NO: 2430518 - protein, 16 aa, Entamoeba dispar
IEKNGDKKKKEKDKKK

SEQ ID NO: 2430519 - protein, 8 aa, Entamoeba dispar
IEKNPEKG

SEQ ID NO: 2430520 - protein, 5 aa, Entamoeba dispar
IEKNQ

SEQ ID NO: 2430521 - protein, 10 aa, Entamoeba dispar
IEKPRTISKP

SEQ ID NO: 2430522 - protein, 5 aa, Entamoeba dispar
IEKPS

SEQ ID NO: 2430523 - protein, 10 aa, Entamoeba dispar
IEKPTTKPKI

SEQ ID NO: 2430524 - protein, 6 aa, Entamoeba dispar
IEKQQG

SEQ ID NO: 2430525 - protein, 21 aa, Entamoeba dispar
IEKQRKQDEEKKRKEGEKKEE

SEQ ID NO: 2430526 - protein, 12 aa, Entamoeba dispar
IEKQTKSISQNK

SEQ ID NO: 2430527 - protein, 12 aa, Entamoeba dispar
IEKRKTSEAELE

SEQ ID NO: 2430528 - protein, 7 aa, Entamoeba dispar
IEKRRKK

SEQ ID NO: 2430529 - protein, 4 aa, Entamoeba dispar
IEKS

SEQ ID NO: 2430530 - protein, 6 aa, Entamoeba dispar
IEKSKR

SEQ ID NO: 2430531 - protein, 11 aa, Entamoeba dispar
IEKSKTLTKEA

SEQ ID NO: 2430532 - protein, 10 aa, Entamoeba dispar
IEKSPQGART

SEQ ID NO: 2430533 - protein, 8 aa, Entamoeba dispar
IEKTKKNE

SEQ ID NO: 2430534 - protein, 5 aa, Entamoeba dispar
IEKTP

SEQ ID NO: 2430535 - protein, 24 aa, Entamoeba dispar
IEKTQENSDEIKPGNKEEQRQESI

SEQ ID NO: 2430536 - protein, 9 aa, Entamoeba dispar
IEKYNSNDP

SEQ ID NO: 2430537 - protein, 5 aa, Entamoeba dispar
IEKYS

SEQ ID NO: 2430538 - protein, 8 aa, Entamoeba dispar
IEKYSGHG

SEQ ID NO: 2430539 - protein, 11 aa, Entamoeba dispar
IELKKQNESIT

SEQ ID NO: 2430540 - protein, 15 aa, Entamoeba dispar
IELKRSQEHQSSGVS

SEQ ID NO: 2430541 - protein, 7 aa, Entamoeba dispar
IELPENQ

SEQ ID NO: 2430542 - protein, 10 aa, Entamoeba dispar
IELSSKEETD

SEQ ID NO: 2430543 - protein, 6 aa, Entamoeba dispar
IELSTE

SEQ ID NO: 2430544 - protein, 11 aa, Entamoeba dispar
IENDEEIKSPF

SEQ ID NO: 2430545 - protein, 10 aa, Entamoeba dispar
IENDKSEETI

SEQ ID NO: 2430546 - protein, 29 aa, Entamoeba dispar
IENEDVLSSEKTISMGSSLDRDDDIEQFN

SEQ ID NO: 2430547 - protein, 5 aa, Entamoeba dispar
IENEE

SEQ ID NO: 2430548 - protein, 9 aa, Entamoeba dispar
IENEGKDKM

SEQ ID NO: 2430549 - protein, 8 aa, Entamoeba dispar
IENEKEEI

SEQ ID NO: 2430550 - protein, 5 aa, Entamoeba dispar
IENEL

SEQ ID NO: 2430551 - protein, 9 aa, Entamoeba dispar
IENEQEEKH

SEQ ID NO: 2430552 - protein, 14 aa, Entamoeba dispar
IENEQKEKELNEQF

SEQ ID NO: 2430553 - protein, 9 aa, Entamoeba dispar
IENERTEKL

SEQ ID NO: 2430554 - protein, 10 aa, Entamoeba dispar
IENGRKPTTL

SEQ ID NO: 2430555 - protein, 10 aa, Entamoeba dispar
IENGSTNQTF

SEQ ID NO: 2430556 - protein, 51 aa, Entamoeba dispar
IENIKKKEEEIEKINKEKKEKKEEIKKKEEKYKELENKTKKEEKEQKIKEQ

SEQ ID NO: 2430557 - protein, 4 aa, Entamoeba dispar
IENK

SEQ ID NO: 2430558 - protein, 8 aa, Entamoeba dispar
IENKDKAK

SEQ ID NO: 2430559 - protein, 10 aa, Entamoeba dispar
IENKEKEING

SEQ ID NO: 2430560 - protein, 15 aa, Entamoeba dispar
IENKKINKEIYQNQS

SEQ ID NO: 2430561 - protein, 6 aa, Entamoeba dispar
IENKMK

SEQ ID NO: 2430562 - protein, 5 aa, Entamoeba dispar
IENKP

SEQ ID NO: 2430563 - protein, 4 aa, Entamoeba dispar
IENL

SEQ ID NO: 2430564 - protein, 8 aa, Entamoeba dispar
IENLPSNG

SEQ ID NO: 2430565 - protein, 6 aa, Entamoeba dispar
IENNGG

SEQ ID NO: 2430566 - protein, 9 aa, Entamoeba dispar
IENNGGRKF

SEQ ID NO: 2430567 - protein, 6 aa, Entamoeba dispar
IENNHP

SEQ ID NO: 2430568 - protein, 11 aa, Entamoeba dispar
IENNKQNEDIN

SEQ ID NO: 2430569 - protein, 11 aa, Entamoeba dispar
IENNQKQLGNE

SEQ ID NO: 2430570 - protein, 7 aa, Entamoeba dispar
IENNQND

SEQ ID NO: 2430571 - protein, 10 aa, Entamoeba dispar
IENNTAEINP

SEQ ID NO: 2430572 - protein, 7 aa, Entamoeba dispar
IENPQQH

SEQ ID NO: 2430573 - protein, 7 aa, Entamoeba dispar
IENPRKR

SEQ ID NO: 2430574 - protein, 9 aa, Entamoeba dispar
IENPTNSME

SEQ ID NO: 2430575 - protein, 4 aa, Entamoeba dispar
IENS

SEQ ID NO: 2430576 - protein, 20 aa, Entamoeba dispar
IENSNTDSSIDTSTISSSDS

SEQ ID NO: 2430577 - protein, 7 aa, Entamoeba dispar
IENSTRT

SEQ ID NO: 2430578 - protein, 9 aa, Entamoeba dispar
IENTSSEEV

SEQ ID NO: 2430579 - protein, 7 aa, Entamoeba dispar
IENVNDE

SEQ ID NO: 2430580 - protein, 9 aa, Entamoeba dispar
IENYEDKID

SEQ ID NO: 2430581 - protein, 10 aa, Entamoeba dispar
IEPDESEDID

SEQ ID NO: 2430582 - protein, 5 aa, Entamoeba dispar
IEPEF

SEQ ID NO: 2430583 - protein, 5 aa, Entamoeba dispar
IEPEN

SEQ ID NO: 2430584 - protein, 10 aa, Entamoeba dispar
IEPETTTVGE

SEQ ID NO: 2430585 - protein, 6 aa, Entamoeba dispar
IEPGSN

SEQ ID NO: 2430586 - protein, 11 aa, Entamoeba dispar
IEPIESKKNIV

SEQ ID NO: 2430587 - protein, 16 aa, Entamoeba dispar
IEPITPEQGEAKCKDI

SEQ ID NO: 2430588 - protein, 15 aa, Entamoeba dispar
IEPKISKTKHNPHHH

SEQ ID NO: 2430589 - protein, 12 aa, Entamoeba dispar
IEPKTTENGGKL

SEQ ID NO: 2430590 - protein, 4 aa, Entamoeba dispar
IEPN

SEQ ID NO: 2430591 - protein, 22 aa, Entamoeba dispar
IEPNENEEIIKGDNESEEHESI

SEQ ID NO: 2430592 - protein, 9 aa, Entamoeba dispar
IEPNEQNTM

SEQ ID NO: 2430593 - protein, 19 aa, Entamoeba dispar
IEPNKQKKTPKPIESKKTH

SEQ ID NO: 2430594 - protein, 11 aa, Entamoeba dispar
IEPNPSHETCT

SEQ ID NO: 2430595 - protein, 6 aa, Entamoeba dispar
IEPNQE

SEQ ID NO: 2430596 - protein, 6 aa, Entamoeba dispar
IEPNQK

SEQ ID NO: 2430597 - protein, 22 aa, Entamoeba dispar
IEPNSFNEKEYKKSKSALPYTS

SEQ ID NO: 2430598 - protein, 12 aa, Entamoeba dispar
IEPPHQEPQESV

SEQ ID NO: 2430599 - protein, 5 aa, Entamoeba dispar
IEPPR

SEQ ID NO: 2430600 - protein, 10 aa, Entamoeba dispar
IEPPWKSHEE

SEQ ID NO: 2430601 - protein, 4 aa, Entamoeba dispar
IEPQ

SEQ ID NO: 2430602 - protein, 5 aa, Entamoeba dispar
IEPQD

SEQ ID NO: 2430603 - protein, 6 aa, Entamoeba dispar
IEPQSN

SEQ ID NO: 2430604 - protein, 6 aa, Entamoeba dispar
IEPSEL

SEQ ID NO: 2430605 - protein, 18 aa, Entamoeba dispar
IEPSKTEIKDDKISISED

SEQ ID NO: 2430606 - protein, 12 aa, Entamoeba dispar
IEPSPKESKGGC

SEQ ID NO: 2430607 - protein, 4 aa, Entamoeba dispar
IEPT

SEQ ID NO: 2430608 - protein, 6 aa, Entamoeba dispar
IEPTQP

SEQ ID NO: 2430609 - protein, 9 aa, Entamoeba dispar
IEPTTKAIT

SEQ ID NO: 2430610 - protein, 10 aa, Entamoeba dispar
IEQDEVNPHP

SEQ ID NO: 2430611 - protein, 6 aa, Entamoeba dispar
IEQDGK

SEQ ID NO: 2430612 - protein, 5 aa, Entamoeba dispar
IEQEE

SEQ ID NO: 2430613 - protein, 10 aa, Entamoeba dispar
IEQEKENKEN

SEQ ID NO: 2430614 - protein, 11 aa, Entamoeba dispar
IEQEKTEEEIQ

SEQ ID NO: 2430615 - protein, 38 aa, Entamoeba dispar
IEQENKIIESKEKEAKQRYQEKEAKQKNYNKRNEERIK

SEQ ID NO: 2430616 - protein, 10 aa, Entamoeba dispar
IEQESEVKIP

SEQ ID NO: 2430617 - protein, 6 aa, Entamoeba dispar
IEQGSN

SEQ ID NO: 2430618 - protein, 4 aa, Entamoeba dispar
IEQI

SEQ ID NO: 2430619 - protein, 16 aa, Entamoeba dispar
IEQKKAKGKELGRAEG

SEQ ID NO: 2430620 - protein, 20 aa, Entamoeba dispar
IEQKRFSGADRNALKQMIET

SEQ ID NO: 2430621 - protein, 4 aa, Entamoeba dispar
IEQL

SEQ ID NO: 2430622 - protein, 4 aa, Entamoeba dispar
IEQN

SEQ ID NO: 2430623 - protein, 12 aa, Entamoeba dispar
IEQNDDSLPDYL

SEQ ID NO: 2430624 - protein, 9 aa, Entamoeba dispar
IEQNEPNQE

SEQ ID NO: 2430625 - protein, 10 aa, Entamoeba dispar
IEQNKEAIER

SEQ ID NO: 2430626 - protein, 17 aa, Entamoeba dispar
IEQPNSVDFRTSKEKER

SEQ ID NO: 2430627 - protein, 9 aa, Entamoeba dispar
IEQPSSSYN

SEQ ID NO: 2430628 - protein, 4 aa, Entamoeba dispar
IEQQ

SEQ ID NO: 2430629 - protein, 11 aa, Entamoeba dispar
IEQQKKSDHIN

SEQ ID NO: 2430630 - protein, 23 aa, Entamoeba dispar
IEQQPDPCPFGDEAKRLKARTQT

SEQ ID NO: 2430631 - protein, 8 aa, Entamoeba dispar
IEQQTNSV

SEQ ID NO: 2430632 - protein, 7 aa, Entamoeba dispar
IEQRPNI

SEQ ID NO: 2430633 - protein, 5 aa, Entamoeba dispar
IEQSI

SEQ ID NO: 2430634 - protein, 10 aa, Entamoeba dispar
IEQSRRDDME

SEQ ID NO: 2430635 - protein, 11 aa, Entamoeba dispar
IEQSSKNNDPI

SEQ ID NO: 2430636 - protein, 18 aa, Entamoeba dispar
IEQSSNENAMSDESHKPC

SEQ ID NO: 2430637 - protein, 5 aa, Entamoeba dispar
IEQTE

SEQ ID NO: 2430638 - protein, 17 aa, Entamoeba dispar
IEQTENLDEEVKASGFD

SEQ ID NO: 2430639 - protein, 8 aa, Entamoeba dispar
IEQTQKEM

SEQ ID NO: 2430640 - protein, 19 aa, Entamoeba dispar
IEQTSSQENSISSFSSFSY

SEQ ID NO: 2430641 - protein, 17 aa, Entamoeba dispar
IEQYNQEEGIKNTPISK

SEQ ID NO: 2430642 - protein, 7 aa, Entamoeba dispar
IEQYNTQ

SEQ ID NO: 2430643 - protein, 4 aa, Entamoeba dispar
IERA

SEQ ID NO: 2430644 - protein, 21 aa, Entamoeba dispar
IERAEGISKIKSEKINVGSQE

SEQ ID NO: 2430645 - protein, 10 aa, Entamoeba dispar
IERAKKGFDQ

SEQ ID NO: 2430646 - protein, 5 aa, Entamoeba dispar
IERDE

SEQ ID NO: 2430647 - protein, 10 aa, Entamoeba dispar
IERDKEEEKY

SEQ ID NO: 2430648 - protein, 28 aa, Entamoeba dispar
IEREAKKKLAKGQLQRKQQLSKLNEECN

SEQ ID NO: 2430649 - protein, 12 aa, Entamoeba dispar
IERGFGHGSQYK

SEQ ID NO: 2430650 - protein, 12 aa, Entamoeba dispar
IERGQTGHVKAE

SEQ ID NO: 2430651 - protein, 4 aa, Entamoeba dispar
IERI

SEQ ID NO: 2430652 - protein, 4 aa, Entamoeba dispar
IERK

SEQ ID NO: 2430653 - protein, 6 aa, Entamoeba dispar
IERKKE

SEQ ID NO: 2430654 - protein, 10 aa, Entamoeba dispar
IERKKREHSQ

SEQ ID NO: 2430655 - protein, 12 aa, Entamoeba dispar
IERKQNEVSLLS

SEQ ID NO: 2430656 - protein, 11 aa, Entamoeba dispar
IERKRETTEWQ

SEQ ID NO: 2430657 - protein, 28 aa, Entamoeba dispar
IERKRQKDKLKQIEKKTIKDENQDGRLE

SEQ ID NO: 2430658 - protein, 6 aa, Entamoeba dispar
IERNDE

SEQ ID NO: 2430659 - protein, 8 aa, Entamoeba dispar
IERPISAQ

SEQ ID NO: 2430660 - protein, 30 aa, Entamoeba dispar
IERQKEIDRLEEEETKAKIEREKKRAEIER

SEQ ID NO: 2430661 - protein, 35 aa, Entamoeba dispar
IERTKEKMENENQEEKEKVDEKIKDGIEDNSIEDE

SEQ ID NO: 2430662 - protein, 7 aa, Entamoeba dispar
IESCNGN

SEQ ID NO: 2430663 - protein, 10 aa, Entamoeba dispar
IESDDPDGMV

SEQ ID NO: 2430664 - protein, 12 aa, Entamoeba dispar
IESEEKSTKIEP

SEQ ID NO: 2430665 - protein, 8 aa, Entamoeba dispar
IESEEKTK

SEQ ID NO: 2430666 - protein, 11 aa, Entamoeba dispar
IESEGLSPYSD

SEQ ID NO: 2430667 - protein, 5 aa, Entamoeba dispar
IESEN

SEQ ID NO: 2430668 - protein, 7 aa, Entamoeba dispar
IESEYGT

SEQ ID NO: 2430669 - protein, 6 aa, Entamoeba dispar
IESGCT

SEQ ID NO: 2430670 - protein, 5 aa, Entamoeba dispar
IESGI

SEQ ID NO: 2430671 - protein, 9 aa, Entamoeba dispar
IESGNQNKY

SEQ ID NO: 2430672 - protein, 4 aa, Entamoeba dispar
IESH

SEQ ID NO: 2430673 - protein, 10 aa, Entamoeba dispar
IESHSSSEIV

SEQ ID NO: 2430674 - protein, 11 aa, Entamoeba dispar
IESKEKDRNNI

SEQ ID NO: 2430675 - protein, 6 aa, Entamoeba dispar
IESKER

SEQ ID NO: 2430676 - protein, 108 aa, Entamoeba dispar
IESKGLVNSNPDINQTKGRLQTTDSTKPHKDQKVHTKEDVVNPSSPYSTEQYSDSGSVGSSGGVGSSGGVGSGYDSDIGSNQSSINQKGMSEEDGEGKIDEQDSSIEE

SEQ ID NO: 2430677 - protein, 11 aa, Entamoeba dispar
IESKTKDNELS

SEQ ID NO: 2430678 - protein, 20 aa, Entamoeba dispar
IESKTSVDESFSDESIENSV

SEQ ID NO: 2430679 - protein, 4 aa, Entamoeba dispar
IESL

SEQ ID NO: 2430680 - protein, 11 aa, Entamoeba dispar
IESLKSTNNVL

SEQ ID NO: 2430681 - protein, 10 aa, Entamoeba dispar
IESNEKENII

SEQ ID NO: 2430682 - protein, 20 aa, Entamoeba dispar
IESNRSAGHLPNDSSSEYVD

SEQ ID NO: 2430683 - protein, 6 aa, Entamoeba dispar
IESPSV

SEQ ID NO: 2430684 - protein, 7 aa, Entamoeba dispar
IESPYSY

SEQ ID NO: 2430685 - protein, 22 aa, Entamoeba dispar
IESQDKPKVITKKDSKSINAGS

SEQ ID NO: 2430686 - protein, 6 aa, Entamoeba dispar
IESQPY

SEQ ID NO: 2430687 - protein, 10 aa, Entamoeba dispar
IESQRDKDSV

SEQ ID NO: 2430688 - protein, 6 aa, Entamoeba dispar
IESRNG

SEQ ID NO: 2430689 - protein, 8 aa, Entamoeba dispar
IESSDGWT

SEQ ID NO: 2430690 - protein, 5 aa, Entamoeba dispar
IESSP

SEQ ID NO: 2430691 - protein, 26 aa, Entamoeba dispar
IESSQKEEELNKIKEEKQQVEDEKAK

SEQ ID NO: 2430692 - protein, 19 aa, Entamoeba dispar
IESTESSREVSRENSPHLE

SEQ ID NO: 2430693 - protein, 8 aa, Entamoeba dispar
IESTETDE

SEQ ID NO: 2430694 - protein, 5 aa, Entamoeba dispar
IESTT

SEQ ID NO: 2430695 - protein, 4 aa, Entamoeba dispar
IESY

SEQ ID NO: 2430696 - protein, 10 aa, Entamoeba dispar
IESYNKSENV

SEQ ID NO: 2430697 - protein, 7 aa, Entamoeba dispar
IETAPTE

SEQ ID NO: 2430698 - protein, 6 aa, Entamoeba dispar
IETASS

SEQ ID NO: 2430699 - protein, 7 aa, Entamoeba dispar
IETCEND

SEQ ID NO: 2430700 - protein, 9 aa, Entamoeba dispar
IETDEQNGF

SEQ ID NO: 2430701 - protein, 16 aa, Entamoeba dispar
IETDKNKEKKPKKIHD

SEQ ID NO: 2430702 - protein, 4 aa, Entamoeba dispar
IETE

SEQ ID NO: 2430703 - protein, 7 aa, Entamoeba dispar
IETEGNG

SEQ ID NO: 2430704 - protein, 5 aa, Entamoeba dispar
IETEN

SEQ ID NO: 2430705 - protein, 16 aa, Entamoeba dispar
IETGLNKKNATRRLEN

SEQ ID NO: 2430706 - protein, 4 aa, Entamoeba dispar
IETK

SEQ ID NO: 2430707 - protein, 35 aa, Entamoeba dispar
IETKDVKSIEEANKKEVKFKTEHKEREKRTGFDGE

SEQ ID NO: 2430708 - protein, 19 aa, Entamoeba dispar
IETKKKQERDGLDEEDERE

SEQ ID NO: 2430709 - protein, 6 aa, Entamoeba dispar
IETKNV

SEQ ID NO: 2430710 - protein, 8 aa, Entamoeba dispar
IETLGEGT

SEQ ID NO: 2430711 - protein, 8 aa, Entamoeba dispar
IETLPKDN

SEQ ID NO: 2430712 - protein, 11 aa, Entamoeba dispar
IETNKGNFEYE

SEQ ID NO: 2430713 - protein, 8 aa, Entamoeba dispar
IETNQNSV

SEQ ID NO: 2430714 - protein, 6 aa, Entamoeba dispar
IETPKN

SEQ ID NO: 2430715 - protein, 15 aa, Entamoeba dispar
IETPLEVNSSERIVQ

SEQ ID NO: 2430716 - protein, 8 aa, Entamoeba dispar
IETPPSVD

SEQ ID NO: 2430717 - protein, 5 aa, Entamoeba dispar
IETPQ

SEQ ID NO: 2430718 - protein, 9 aa, Entamoeba dispar
IETPSTSRY

SEQ ID NO: 2430719 - protein, 6 aa, Entamoeba dispar
IETPSW

SEQ ID NO: 2430720 - protein, 6 aa, Entamoeba dispar
IETQIS

SEQ ID NO: 2430721 - protein, 13 aa, Entamoeba dispar
IETQKEERVQDKE

SEQ ID NO: 2430722 - protein, 7 aa, Entamoeba dispar
IETSKKE

SEQ ID NO: 2430723 - protein, 9 aa, Entamoeba dispar
IETSKKYAR

SEQ ID NO: 2430724 - protein, 10 aa, Entamoeba dispar
IETSQPNNVL

SEQ ID NO: 2430725 - protein, 13 aa, Entamoeba dispar
IETSSKENTNVQE

SEQ ID NO: 2430726 - protein, 4 aa, Entamoeba dispar
IETT

SEQ ID NO: 2430727 - protein, 8 aa, Entamoeba dispar
IETTDEPI

SEQ ID NO: 2430728 - protein, 9 aa, Entamoeba dispar
IETTRGKQT

SEQ ID NO: 2430729 - protein, 12 aa, Entamoeba dispar
IETTSAIEKYGD

SEQ ID NO: 2430730 - protein, 11 aa, Entamoeba dispar
IEYDPDEHEVS

SEQ ID NO: 2430731 - protein, 4 aa, Entamoeba dispar
IEYN

SEQ ID NO: 2430732 - protein, 8 aa, Entamoeba dispar
IEYNQGGR

SEQ ID NO: 2430733 - protein, 7 aa, Entamoeba dispar
IEYPPTK

SEQ ID NO: 2430734 - protein, 20 aa, Entamoeba dispar
IEYTEEDRKSYGNTIPPEVK

SEQ ID NO: 2430735 - protein, 21 aa, Entamoeba dispar
IEYTEEDRKSYGNTIPSEVKS

SEQ ID NO: 2430736 - protein, 13 aa, Entamoeba dispar
IEYTKEDRKKYGN

SEQ ID NO: 2430737 - protein, 13 aa, Entamoeba dispar
IFEQTKKNEITAK

SEQ ID NO: 2430738 - protein, 17 aa, Entamoeba dispar
IFESSEETEIDENNATL

SEQ ID NO: 2430739 - protein, 8 aa, Entamoeba dispar
IFNDEEST

SEQ ID NO: 2430740 - protein, 6 aa, Entamoeba dispar
IFNGEK

SEQ ID NO: 2430741 - protein, 4 aa, Entamoeba dispar
IFPP

SEQ ID NO: 2430742 - protein, 9 aa, Entamoeba dispar
IFPSSSKTF

SEQ ID NO: 2430743 - protein, 6 aa, Entamoeba dispar
IFSNDS

SEQ ID NO: 2430744 - protein, 5 aa, Entamoeba dispar
IFSQQ

SEQ ID NO: 2430745 - protein, 21 aa, Entamoeba dispar
IFTQSQYEDEESNKNMEEEPS

SEQ ID NO: 2430746 - protein, 8 aa, Entamoeba dispar
IGADTGKK

SEQ ID NO: 2430747 - protein, 4 aa, Entamoeba dispar
IGAH

SEQ ID NO: 2430748 - protein, 6 aa, Entamoeba dispar
IGAKGH

SEQ ID NO: 2430749 - protein, 14 aa, Entamoeba dispar
IGAQKGTNQIEDNY

SEQ ID NO: 2430750 - protein, 14 aa, Entamoeba dispar
IGAVKNDKLDEERF

SEQ ID NO: 2430751 - protein, 10 aa, Entamoeba dispar
IGDADPKNII

SEQ ID NO: 2430752 - protein, 21 aa, Entamoeba dispar
IGDDKTCSKSLSKFSKFQFEK

SEQ ID NO: 2430753 - protein, 7 aa, Entamoeba dispar
IGDDSYP

SEQ ID NO: 2430754 - protein, 26 aa, Entamoeba dispar
IGDDTTNDNQSSMDPISAHTKKATFT

SEQ ID NO: 2430755 - protein, 10 aa, Entamoeba dispar
IGDENGKVKG

SEQ ID NO: 2430756 - protein, 11 aa, Entamoeba dispar
IGDENQIEKEL

SEQ ID NO: 2430757 - protein, 7 aa, Entamoeba dispar
IGDETQQ

SEQ ID NO: 2430758 - protein, 6 aa, Entamoeba dispar
IGDEYK

SEQ ID NO: 2430759 - protein, 4 aa, Entamoeba dispar
IGDF

SEQ ID NO: 2430760 - protein, 4 aa, Entamoeba dispar
IGDG

SEQ ID NO: 2430761 - protein, 10 aa, Entamoeba dispar
IGDGKKSVHA

SEQ ID NO: 2430762 - protein, 9 aa, Entamoeba dispar
IGDGKSSLG

SEQ ID NO: 2430763 - protein, 4 aa, Entamoeba dispar
IGDI

SEQ ID NO: 2430764 - protein, 7 aa, Entamoeba dispar
IGDISNN

SEQ ID NO: 2430765 - protein, 6 aa, Entamoeba dispar
IGDKNE

SEQ ID NO: 2430766 - protein, 8 aa, Entamoeba dispar
IGDNKDDI

SEQ ID NO: 2430767 - protein, 5 aa, Entamoeba dispar
IGDNP

SEQ ID NO: 2430768 - protein, 14 aa, Entamoeba dispar
IGDPSLHPPLTTEP

SEQ ID NO: 2430769 - protein, 5 aa, Entamoeba dispar
IGDQG

SEQ ID NO: 2430770 - protein, 6 aa, Entamoeba dispar
IGDRIA

SEQ ID NO: 2430771 - protein, 18 aa, Entamoeba dispar
IGDRSLHPPMTSIPTTKV

SEQ ID NO: 2430772 - protein, 59 aa, Entamoeba dispar
IGDSGRGEETEQLDESKEEDRAKIEEARAKRKEEKKEHQRSLAEEAHSKKKGGATETKY

SEQ ID NO: 2430773 - protein, 9 aa, Entamoeba dispar
IGDTSVKNT

SEQ ID NO: 2430774 - protein, 6 aa, Entamoeba dispar
IGEDDF

SEQ ID NO: 2430775 - protein, 5 aa, Entamoeba dispar
IGEDK

SEQ ID NO: 2430776 - protein, 4 aa, Entamoeba dispar
IGEG

SEQ ID NO: 2430777 - protein, 9 aa, Entamoeba dispar
IGEGKEGKI

SEQ ID NO: 2430778 - protein, 15 aa, Entamoeba dispar
IGEGMTREDHSEVSN

SEQ ID NO: 2430779 - protein, 7 aa, Entamoeba dispar
IGEGTSA

SEQ ID NO: 2430780 - protein, 7 aa, Entamoeba dispar
IGEGTSG

SEQ ID NO: 2430781 - protein, 5 aa, Entamoeba dispar
IGEGV

SEQ ID NO: 2430782 - protein, 4 aa, Entamoeba dispar
IGEH

SEQ ID NO: 2430783 - protein, 10 aa, Entamoeba dispar
IGEKEKEKGL

SEQ ID NO: 2430784 - protein, 30 aa, Entamoeba dispar
IGEKKEPMFGTGSGTGNVPQQTWYEWFKSM

SEQ ID NO: 2430785 - protein, 4 aa, Entamoeba dispar
IGEL

SEQ ID NO: 2430786 - protein, 10 aa, Entamoeba dispar
IGENKGKMES

SEQ ID NO: 2430787 - protein, 5 aa, Entamoeba dispar
IGENL

SEQ ID NO: 2430788 - protein, 6 aa, Entamoeba dispar
IGENNK

SEQ ID NO: 2430789 - protein, 5 aa, Entamoeba dispar
IGEPI

SEQ ID NO: 2430790 - protein, 6 aa, Entamoeba dispar
IGEPNE

SEQ ID NO: 2430791 - protein, 7 aa, Entamoeba dispar
IGERDTE

SEQ ID NO: 2430792 - protein, 33 aa, Entamoeba dispar
IGERTEKQEEKKDKTPFTSSYHTTQQNPSNTQS

SEQ ID NO: 2430793 - protein, 4 aa, Entamoeba dispar
IGES

SEQ ID NO: 2430794 - protein, 6 aa, Entamoeba dispar
IGESGK

SEQ ID NO: 2430795 - protein, 7 aa, Entamoeba dispar
IGESGLS

SEQ ID NO: 2430796 - protein, 5 aa, Entamoeba dispar
IGESL

SEQ ID NO: 2430797 - protein, 6 aa, Entamoeba dispar
IGESRI

SEQ ID NO: 2430798 - protein, 27 aa, Entamoeba dispar
IGESSQSAQPGIVDPTQQTQPTESTGC

SEQ ID NO: 2430799 - protein, 12 aa, Entamoeba dispar
IGETKEEPKRTI

SEQ ID NO: 2430800 - protein, 5 aa, Entamoeba dispar
IGETP

SEQ ID NO: 2430801 - protein, 9 aa, Entamoeba dispar
IGETQPRSV

SEQ ID NO: 2430802 - protein, 18 aa, Entamoeba dispar
IGETRNCGGKLGSTENYI

SEQ ID NO: 2430803 - protein, 11 aa, Entamoeba dispar
IGEYAKKNGQW

SEQ ID NO: 2430804 - protein, 6 aa, Entamoeba dispar
IGEYPK

SEQ ID NO: 2430805 - protein, 6 aa, Entamoeba dispar
IGEYPT

SEQ ID NO: 2430806 - protein, 14 aa, Entamoeba dispar
IGFNETSAKKRINV

SEQ ID NO: 2430807 - protein, 9 aa, Entamoeba dispar
IGGEGNGGV

SEQ ID NO: 2430808 - protein, 14 aa, Entamoeba dispar
IGGEKEENQNEKYR

SEQ ID NO: 2430809 - protein, 16 aa, Entamoeba dispar
IGGFETKEKNKKGEEY

SEQ ID NO: 2430810 - protein, 10 aa, Entamoeba dispar
IGGKNRHSPF

SEQ ID NO: 2430811 - protein, 12 aa, Entamoeba dispar
IGGKSEKEDIKA

SEQ ID NO: 2430812 - protein, 10 aa, Entamoeba dispar
IGGNEEIKQR

SEQ ID NO: 2430813 - protein, 10 aa, Entamoeba dispar
IGGNERTQTA

SEQ ID NO: 2430814 - protein, 5 aa, Entamoeba dispar
IGGPS

SEQ ID NO: 2430815 - protein, 10 aa, Entamoeba dispar
IGGQGFGGGV

SEQ ID NO: 2430816 - protein, 8 aa, Entamoeba dispar
IGGQGKCQ

SEQ ID NO: 2430817 - protein, 7 aa, Entamoeba dispar
IGGQGYD

SEQ ID NO: 2430818 - protein, 15 aa, Entamoeba dispar
IGGSCGVPEKGKYPL

SEQ ID NO: 2430819 - protein, 9 aa, Entamoeba dispar
IGGTAKSLE

SEQ ID NO: 2430820 - protein, 8 aa, Entamoeba dispar
IGGTDGLR

SEQ ID NO: 2430821 - protein, 11 aa, Entamoeba dispar
IGGTKTTNEVG

SEQ ID NO: 2430822 - protein, 16 aa, Entamoeba dispar
IGGTRFQDDTGESEVQ

SEQ ID NO: 2430823 - protein, 4 aa, Entamoeba dispar
IGGV

SEQ ID NO: 2430824 - protein, 8 aa, Entamoeba dispar
IGHRDLKP

SEQ ID NO: 2430825 - protein, 8 aa, Entamoeba dispar
IGHSTEPL

SEQ ID NO: 2430826 - protein, 4 aa, Entamoeba dispar
IGHT

SEQ ID NO: 2430827 - protein, 5 aa, Entamoeba dispar
IGIDP

SEQ ID NO: 2430828 - protein, 8 aa, Entamoeba dispar
IGISEGKK

SEQ ID NO: 2430829 - protein, 5 aa, Entamoeba dispar
IGITQ

SEQ ID NO: 2430830 - protein, 7 aa, Entamoeba dispar
IGITSNP

SEQ ID NO: 2430831 - protein, 9 aa, Entamoeba dispar
IGKCRTTRE

SEQ ID NO: 2430832 - protein, 6 aa, Entamoeba dispar
IGKDGL

SEQ ID NO: 2430833 - protein, 10 aa, Entamoeba dispar
IGKEEDYQDN

SEQ ID NO: 2430834 - protein, 8 aa, Entamoeba dispar
IGKEGTSL

SEQ ID NO: 2430835 - protein, 6 aa, Entamoeba dispar
IGKEQF

SEQ ID NO: 2430836 - protein, 6 aa, Entamoeba dispar
IGKERS

SEQ ID NO: 2430837 - protein, 11 aa, Entamoeba dispar
IGKGEGSSSEL

SEQ ID NO: 2430838 - protein, 12 aa, Entamoeba dispar
IGKGESEEEKMA

SEQ ID NO: 2430839 - protein, 10 aa, Entamoeba dispar
IGKGKQCTKA

SEQ ID NO: 2430840 - protein, 14 aa, Entamoeba dispar
IGKGKYSNEEQLGK

SEQ ID NO: 2430841 - protein, 6 aa, Entamoeba dispar
IGKGLG

SEQ ID NO: 2430842 - protein, 6 aa, Entamoeba dispar
IGKGNE

SEQ ID NO: 2430843 - protein, 8 aa, Entamoeba dispar
IGKGSFRS

SEQ ID NO: 2430844 - protein, 9 aa, Entamoeba dispar
IGKKGKELC

SEQ ID NO: 2430845 - protein, 57 aa, Entamoeba dispar
IGKKKKRTIKRKTAIKEEPKVETKVVDEDDEIKRLEEEQRKLEEEMKKEEEEQEAEL

SEQ ID NO: 2430846 - protein, 11 aa, Entamoeba dispar
IGKKLNNGKGR

SEQ ID NO: 2430847 - protein, 9 aa, Entamoeba dispar
IGKKPTMED

SEQ ID NO: 2430848 - protein, 14 aa, Entamoeba dispar
IGKNESDVNYEDRE

SEQ ID NO: 2430849 - protein, 4 aa, Entamoeba dispar
IGKP

SEQ ID NO: 2430850 - protein, 7 aa, Entamoeba dispar
IGKPEEL

SEQ ID NO: 2430851 - protein, 11 aa, Entamoeba dispar
IGKPYGPPYGI

SEQ ID NO: 2430852 - protein, 5 aa, Entamoeba dispar
IGKQI

SEQ ID NO: 2430853 - protein, 18 aa, Entamoeba dispar
IGKRTNPINLTKSSADVL

SEQ ID NO: 2430854 - protein, 4 aa, Entamoeba dispar
IGKS

SEQ ID NO: 2430855 - protein, 6 aa, Entamoeba dispar
IGKSEE

SEQ ID NO: 2430856 - protein, 8 aa, Entamoeba dispar
IGKSSKQT

SEQ ID NO: 2430857 - protein, 4 aa, Entamoeba dispar
IGKT

SEQ ID NO: 2430858 - protein, 8 aa, Entamoeba dispar
IGKTNEEK

SEQ ID NO: 2430859 - protein, 7 aa, Entamoeba dispar
IGLGSKG

SEQ ID NO: 2430860 - protein, 12 aa, Entamoeba dispar
IGLSNDTRLFQG

SEQ ID NO: 2430861 - protein, 11 aa, Entamoeba dispar
IGMADTSATTV

SEQ ID NO: 2430862 - protein, 4 aa, Entamoeba dispar
IGMT

SEQ ID NO: 2430863 - protein, 15 aa, Entamoeba dispar
IGNDDSMKQIPVTSG

SEQ ID NO: 2430864 - protein, 6 aa, Entamoeba dispar
IGNDKI

SEQ ID NO: 2430865 - protein, 7 aa, Entamoeba dispar
IGNDSSV

SEQ ID NO: 2430866 - protein, 5 aa, Entamoeba dispar
IGNEE

SEQ ID NO: 2430867 - protein, 8 aa, Entamoeba dispar
IGNESKDI

SEQ ID NO: 2430868 - protein, 6 aa, Entamoeba dispar
IGNESL

SEQ ID NO: 2430869 - protein, 10 aa, Entamoeba dispar
IGNEYDHDSD

SEQ ID NO: 2430870 - protein, 18 aa, Entamoeba dispar
IGNKETKSINTQSDSLKT

SEQ ID NO: 2430871 - protein, 6 aa, Entamoeba dispar
IGNKKI

SEQ ID NO: 2430872 - protein, 20 aa, Entamoeba dispar
IGNKRKRQVRSEFGKNRAEC

SEQ ID NO: 2430873 - protein, 4 aa, Entamoeba dispar
IGNN

SEQ ID NO: 2430874 - protein, 5 aa, Entamoeba dispar
IGNNE

SEQ ID NO: 2430875 - protein, 5 aa, Entamoeba dispar
IGNNK

SEQ ID NO: 2430876 - protein, 5 aa, Entamoeba dispar
IGNNN

SEQ ID NO: 2430877 - protein, 19 aa, Entamoeba dispar
IGNSDKSITEYNSLLEILE

SEQ ID NO: 2430878 - protein, 5 aa, Entamoeba dispar
IGNSE

SEQ ID NO: 2430879 - protein, 69 aa, Entamoeba dispar
IGNSLTSGFGQTNTQQNGFGGFGQNNQQPNGFGSFGKTSFGGFGNNNTQTNTFGGFGQTNNQQSNGFGG

SEQ ID NO: 2430880 - protein, 8 aa, Entamoeba dispar
IGNSVSTI

SEQ ID NO: 2430881 - protein, 20 aa, Entamoeba dispar
IGNTEEIEEIPESEFSEMPG

SEQ ID NO: 2430882 - protein, 11 aa, Entamoeba dispar
IGNTPSENINI

SEQ ID NO: 2430883 - protein, 8 aa, Entamoeba dispar
IGNTTPVG

SEQ ID NO: 2430884 - protein, 10 aa, Entamoeba dispar
IGNVKGSELL

SEQ ID NO: 2430885 - protein, 12 aa, Entamoeba dispar
IGPAEGKNPSLR

SEQ ID NO: 2430886 - protein, 6 aa, Entamoeba dispar
IGPAGD

SEQ ID NO: 2430887 - protein, 11 aa, Entamoeba dispar
IGPERNGITDH

SEQ ID NO: 2430888 - protein, 10 aa, Entamoeba dispar
IGPGPSPIEK

SEQ ID NO: 2430889 - protein, 12 aa, Entamoeba dispar
IGPSATNSAQTY

SEQ ID NO: 2430890 - protein, 6 aa, Entamoeba dispar
IGPSSD

SEQ ID NO: 2430891 - protein, 11 aa, Entamoeba dispar
IGPSTLKDGLE

SEQ ID NO: 2430892 - protein, 7 aa, Entamoeba dispar
IGPTAPA

SEQ ID NO: 2430893 - protein, 5 aa, Entamoeba dispar
IGPTE

SEQ ID NO: 2430894 - protein, 6 aa, Entamoeba dispar
IGQEKT

SEQ ID NO: 2430895 - protein, 17 aa, Entamoeba dispar
IGQGKSILKGEEDEEDE

SEQ ID NO: 2430896 - protein, 9 aa, Entamoeba dispar
IGQGYSGCN

SEQ ID NO: 2430897 - protein, 9 aa, Entamoeba dispar
IGQKELDNF

SEQ ID NO: 2430898 - protein, 31 aa, Entamoeba dispar
IGQNEKDIVEQESTKNGSDQEHESPSDEDTF

SEQ ID NO: 2430899 - protein, 7 aa, Entamoeba dispar
IGQNKNY

SEQ ID NO: 2430900 - protein, 13 aa, Entamoeba dispar
IGRDERDVSYEDR

SEQ ID NO: 2430901 - protein, 13 aa, Entamoeba dispar
IGRDESDVSYEDR

SEQ ID NO: 2430902 - protein, 18 aa, Entamoeba dispar
IGRDGAVDIETGKGTKDI

SEQ ID NO: 2430903 - protein, 4 aa, Entamoeba dispar
IGRE

SEQ ID NO: 2430904 - protein, 6 aa, Entamoeba dispar
IGRGQE

SEQ ID NO: 2430905 - protein, 11 aa, Entamoeba dispar
IGRGSKTLITN

SEQ ID NO: 2430906 - protein, 15 aa, Entamoeba dispar
IGRKGGRNSFSRRGR

SEQ ID NO: 2430907 - protein, 4 aa, Entamoeba dispar
IGRN

SEQ ID NO: 2430908 - protein, 9 aa, Entamoeba dispar
IGRNPTVPD

SEQ ID NO: 2430909 - protein, 10 aa, Entamoeba dispar
IGRNRAKSGL

SEQ ID NO: 2430910 - protein, 7 aa, Entamoeba dispar
IGRPESI

SEQ ID NO: 2430911 - protein, 4 aa, Entamoeba dispar
IGRQ

SEQ ID NO: 2430912 - protein, 6 aa, Entamoeba dispar
IGRRAN

SEQ ID NO: 2430913 - protein, 23 aa, Entamoeba dispar
IGRTEGEDGYIKKTQKEETKKEG

SEQ ID NO: 2430914 - protein, 13 aa, Entamoeba dispar
IGRTGRASKKGTA

SEQ ID NO: 2430915 - protein, 8 aa, Entamoeba dispar
IGRYNQPD

SEQ ID NO: 2430916 - protein, 13 aa, Entamoeba dispar
IGSAAAIESNEDI

SEQ ID NO: 2430917 - protein, 9 aa, Entamoeba dispar
IGSAAKTEH

SEQ ID NO: 2430918 - protein, 11 aa, Entamoeba dispar
IGSASDKGIDQ

SEQ ID NO: 2430919 - protein, 37 aa, Entamoeba dispar
IGSEEEVKPKLTRSKEKKMKEEKELKKYKEQTSSNKL

SEQ ID NO: 2430920 - protein, 12 aa, Entamoeba dispar
IGSEGNNYLGGK

SEQ ID NO: 2430921 - protein, 6 aa, Entamoeba dispar
IGSEKD

SEQ ID NO: 2430922 - protein, 17 aa, Entamoeba dispar
IGSENKTHKTISATTRQ

SEQ ID NO: 2430923 - protein, 8 aa, Entamoeba dispar
IGSESSSL

SEQ ID NO: 2430924 - protein, 6 aa, Entamoeba dispar
IGSGAS

SEQ ID NO: 2430925 - protein, 6 aa, Entamoeba dispar
IGSGNL

SEQ ID NO: 2430926 - protein, 5 aa, Entamoeba dispar
IGSGS

SEQ ID NO: 2430927 - protein, 11 aa, Entamoeba dispar
IGSGWTKEPLK

SEQ ID NO: 2430928 - protein, 5 aa, Entamoeba dispar
IGSKG

SEQ ID NO: 2430929 - protein, 13 aa, Entamoeba dispar
IGSLNQENQEPLS

SEQ ID NO: 2430930 - protein, 5 aa, Entamoeba dispar
IGSLS

SEQ ID NO: 2430931 - protein, 4 aa, Entamoeba dispar
IGSN

SEQ ID NO: 2430932 - protein, 20 aa, Entamoeba dispar
IGSNDPGGRIGIQGTNKRMD

SEQ ID NO: 2430933 - protein, 8 aa, Entamoeba dispar
IGSNNQEI

SEQ ID NO: 2430934 - protein, 5 aa, Entamoeba dispar
IGSNT

SEQ ID NO: 2430935 - protein, 12 aa, Entamoeba dispar
IGSPHHSTSSLL

SEQ ID NO: 2430936 - protein, 12 aa, Entamoeba dispar
IGSPKYMAPKIL

SEQ ID NO: 2430937 - protein, 6 aa, Entamoeba dispar
IGSRNR

SEQ ID NO: 2430938 - protein, 5 aa, Entamoeba dispar
IGSRR

SEQ ID NO: 2430939 - protein, 18 aa, Entamoeba dispar
IGSSPQTLYNNNGTPIQN

SEQ ID NO: 2430940 - protein, 4 aa, Entamoeba dispar
IGST

SEQ ID NO: 2430941 - protein, 4 aa, Entamoeba dispar
IGSV

SEQ ID NO: 2430942 - protein, 10 aa, Entamoeba dispar
IGTATSFDSG

SEQ ID NO: 2430943 - protein, 18 aa, Entamoeba dispar
IGTDIDPYGVGNKAEHSF

SEQ ID NO: 2430944 - protein, 4 aa, Entamoeba dispar
IGTE

SEQ ID NO: 2430945 - protein, 6 aa, Entamoeba dispar
IGTEIA

SEQ ID NO: 2430946 - protein, 5 aa, Entamoeba dispar
IGTEQ

SEQ ID NO: 2430947 - protein, 11 aa, Entamoeba dispar
IGTGDQEEIKG

SEQ ID NO: 2430948 - protein, 9 aa, Entamoeba dispar
IGTGSNSTI

SEQ ID NO: 2430949 - protein, 9 aa, Entamoeba dispar
IGTGTSGKV

SEQ ID NO: 2430950 - protein, 5 aa, Entamoeba dispar
IGTIK

SEQ ID NO: 2430951 - protein, 36 aa, Entamoeba dispar
IGTKETKVEERSLEKKEEIKTDSTLEYKKEEITGRK

SEQ ID NO: 2430952 - protein, 17 aa, Entamoeba dispar
IGTKRTESEHSGDREIQ

SEQ ID NO: 2430953 - protein, 4 aa, Entamoeba dispar
IGTL

SEQ ID NO: 2430954 - protein, 6 aa, Entamoeba dispar
IGTLQS

SEQ ID NO: 2430955 - protein, 6 aa, Entamoeba dispar
IGTPIS

SEQ ID NO: 2430956 - protein, 6 aa, Entamoeba dispar
IGTQQP

SEQ ID NO: 2430957 - protein, 7 aa, Entamoeba dispar
IGTQQTT

SEQ ID NO: 2430958 - protein, 8 aa, Entamoeba dispar
IGTQSEYA

SEQ ID NO: 2430959 - protein, 4 aa, Entamoeba dispar
IGTR

SEQ ID NO: 2430960 - protein, 6 aa, Entamoeba dispar
IGTSDA

SEQ ID NO: 2430961 - protein, 6 aa, Entamoeba dispar
IGTSYE

SEQ ID NO: 2430962 - protein, 16 aa, Entamoeba dispar
IGTTGKRGDLYLDVKF

SEQ ID NO: 2430963 - protein, 7 aa, Entamoeba dispar
IGTTSMD

SEQ ID NO: 2430964 - protein, 37 aa, Entamoeba dispar
IGTYTGEKKAPPPQTEKPVVKKEEAKTTTTSKEPELI

SEQ ID NO: 2430965 - protein, 12 aa, Entamoeba dispar
IGTYTKSNPIFK

SEQ ID NO: 2430966 - protein, 6 aa, Entamoeba dispar
IGVGKE

SEQ ID NO: 2430967 - protein, 8 aa, Entamoeba dispar
IGVHSDDG

SEQ ID NO: 2430968 - protein, 12 aa, Entamoeba dispar
IGYDDTNKGFDY

SEQ ID NO: 2430969 - protein, 7 aa, Entamoeba dispar
IGYGQGM

SEQ ID NO: 2430970 - protein, 8 aa, Entamoeba dispar
IGYHSDDG

SEQ ID NO: 2430971 - protein, 9 aa, Entamoeba dispar
IGYNTNPKN

SEQ ID NO: 2430972 - protein, 22 aa, Entamoeba dispar
IGYTQSDRNTYGTKIPKEIKSI

SEQ ID NO: 2430973 - protein, 6 aa, Entamoeba dispar
IHDDAK

SEQ ID NO: 2430974 - protein, 6 aa, Entamoeba dispar
IHDDNQ

SEQ ID NO: 2430975 - protein, 13 aa, Entamoeba dispar
IHDPNSKKYSCPE

SEQ ID NO: 2430976 - protein, 5 aa, Entamoeba dispar
IHDPQ

SEQ ID NO: 2430977 - protein, 5 aa, Entamoeba dispar
IHEEN

SEQ ID NO: 2430978 - protein, 4 aa, Entamoeba dispar
IHEN

SEQ ID NO: 2430979 - protein, 5 aa, Entamoeba dispar
IHERA

SEQ ID NO: 2430980 - protein, 7 aa, Entamoeba dispar
IHESESR

SEQ ID NO: 2430981 - protein, 7 aa, Entamoeba dispar
IHESRKN

SEQ ID NO: 2430982 - protein, 17 aa, Entamoeba dispar
IHETKPRKNKYQQRQRI

SEQ ID NO: 2430983 - protein, 12 aa, Entamoeba dispar
IHGDRSQADRDF

SEQ ID NO: 2430984 - protein, 4 aa, Entamoeba dispar
IHND

SEQ ID NO: 2430985 - protein, 9 aa, Entamoeba dispar
IHPDPTSPR

SEQ ID NO: 2430986 - protein, 7 aa, Entamoeba dispar
IHPDQPR

SEQ ID NO: 2430987 - protein, 8 aa, Entamoeba dispar
IHPPPVQE

SEQ ID NO: 2430988 - protein, 6 aa, Entamoeba dispar
IHPTDD

SEQ ID NO: 2430989 - protein, 9 aa, Entamoeba dispar
IHQGNADDY

SEQ ID NO: 2430990 - protein, 15 aa, Entamoeba dispar
IHRGSRGNQKAKKIR

SEQ ID NO: 2430991 - protein, 5 aa, Entamoeba dispar
IHSDN

SEQ ID NO: 2430992 - protein, 5 aa, Entamoeba dispar
IHSER

SEQ ID NO: 2430993 - protein, 11 aa, Entamoeba dispar
IHSKNESNQPI

SEQ ID NO: 2430994 - protein, 4 aa, Entamoeba dispar
IHSP

SEQ ID NO: 2430995 - protein, 4 aa, Entamoeba dispar
IHSV

SEQ ID NO: 2430996 - protein, 4 aa, Entamoeba dispar
IHTD

SEQ ID NO: 2430997 - protein, 36 aa, Entamoeba dispar
IHTDGTSLIGSTSSSSESINYESQSPTEEEKKKRHS

SEQ ID NO: 2430998 - protein, 4 aa, Entamoeba dispar
IHTP

SEQ ID NO: 2430999 - protein, 6 aa, Entamoeba dispar
IHTSSV

SEQ ID NO: 2431000 - protein, 22 aa, Entamoeba dispar
IHTSTQPTQQVQQQPQQIQNTH

SEQ ID NO: 2431001 - protein, 15 aa, Entamoeba dispar
IHTTTQQKKNNNNNV

SEQ ID NO: 2431002 - protein, 28 aa, Entamoeba dispar
IIDNQEQITGESTSSNSVNASYIFDEPF

SEQ ID NO: 2431003 - protein, 11 aa, Entamoeba dispar
IIEEDNVEERM

SEQ ID NO: 2431004 - protein, 29 aa, Entamoeba dispar
IIGEESEEEEEDNQIQEQQKTKEQTEIEK

SEQ ID NO: 2431005 - protein, 5 aa, Entamoeba dispar
IIGRD

SEQ ID NO: 2431006 - protein, 13 aa, Entamoeba dispar
IIGRNEDDVSYED

SEQ ID NO: 2431007 - protein, 8 aa, Entamoeba dispar
IIGSGNKT

SEQ ID NO: 2431008 - protein, 5 aa, Entamoeba dispar
IIGSN

SEQ ID NO: 2431009 - protein, 7 aa, Entamoeba dispar
IIKGDKT

SEQ ID NO: 2431010 - protein, 8 aa, Entamoeba dispar
IIKSEDDS

SEQ ID NO: 2431011 - protein, 8 aa, Entamoeba dispar
IINGSAPI

SEQ ID NO: 2431012 - protein, 9 aa, Entamoeba dispar
IINPEEEEQ

SEQ ID NO: 2431013 - protein, 6 aa, Entamoeba dispar
IIPPEV

SEQ ID NO: 2431014 - protein, 5 aa, Entamoeba dispar
IIPPK

SEQ ID NO: 2431015 - protein, 5 aa, Entamoeba dispar
IIPSN

SEQ ID NO: 2431016 - protein, 13 aa, Entamoeba dispar
IIPSSAKNPIHAE

SEQ ID NO: 2431017 - protein, 5 aa, Entamoeba dispar
IIPTD

SEQ ID NO: 2431018 - protein, 10 aa, Entamoeba dispar
IIPTKDGSIS

SEQ ID NO: 2431019 - protein, 19 aa, Entamoeba dispar
IIPTNTLTNDSSGNPNQIE

SEQ ID NO: 2431020 - protein, 11 aa, Entamoeba dispar
IIQGSSKISLN

SEQ ID NO: 2431021 - protein, 11 aa, Entamoeba dispar
IIQPTNTEGVP

SEQ ID NO: 2431022 - protein, 11 aa, Entamoeba dispar
IISGGTKEHAD

SEQ ID NO: 2431023 - protein, 4 aa, Entamoeba dispar
IISK

SEQ ID NO: 2431024 - protein, 6 aa, Entamoeba dispar
IISKGS

SEQ ID NO: 2431025 - protein, 21 aa, Entamoeba dispar
IISKPELKKVSPSTSPGLADD

SEQ ID NO: 2431026 - protein, 12 aa, Entamoeba dispar
IISNDGRSVIGN

SEQ ID NO: 2431027 - protein, 11 aa, Entamoeba dispar
IISQPKPVRQS

SEQ ID NO: 2431028 - protein, 7 aa, Entamoeba dispar
IITGSQD

SEQ ID NO: 2431029 - protein, 11 aa, Entamoeba dispar
IITPPKRKSLL

SEQ ID NO: 2431030 - protein, 36 aa, Entamoeba dispar
IKADKLEDLEDNNSPKDIQDNLQEEPDEDVDESNKF

SEQ ID NO: 2431031 - protein, 10 aa, Entamoeba dispar
IKADRNGALS

SEQ ID NO: 2431032 - protein, 17 aa, Entamoeba dispar
IKAEEPQENKEENKEEV

SEQ ID NO: 2431033 - protein, 11 aa, Entamoeba dispar
IKAGLSTEELP

SEQ ID NO: 2431034 - protein, 8 aa, Entamoeba dispar
IKAKELRE

SEQ ID NO: 2431035 - protein, 8 aa, Entamoeba dispar
IKAKPDDM

SEQ ID NO: 2431036 - protein, 41 aa, Entamoeba dispar
IKAKQNSIRSKKSIKREEQITQIEEKEKKVDNKSVITEQSI

SEQ ID NO: 2431037 - protein, 19 aa, Entamoeba dispar
IKANNKKQKKIVKKKNTKA

SEQ ID NO: 2431038 - protein, 7 aa, Entamoeba dispar
IKAPDNL

SEQ ID NO: 2431039 - protein, 15 aa, Entamoeba dispar
IKAPPASYLSFLEKL

SEQ ID NO: 2431040 - protein, 13 aa, Entamoeba dispar
IKARDEENTYKVE

SEQ ID NO: 2431041 - protein, 10 aa, Entamoeba dispar
IKASTATNSM

SEQ ID NO: 2431042 - protein, 20 aa, Entamoeba dispar
IKATKELQELTQQEKSISKK

SEQ ID NO: 2431043 - protein, 9 aa, Entamoeba dispar
IKDATVEEA

SEQ ID NO: 2431044 - protein, 10 aa, Entamoeba dispar
IKDDKTTNLA

SEQ ID NO: 2431045 - protein, 10 aa, Entamoeba dispar
IKDDSDYPME

SEQ ID NO: 2431046 - protein, 13 aa, Entamoeba dispar
IKDEEDKKKPIDI

SEQ ID NO: 2431047 - protein, 6 aa, Entamoeba dispar
IKDEEE

SEQ ID NO: 2431048 - protein, 26 aa, Entamoeba dispar
IKDEEEERAFEKREKEEKQKKENWKS

SEQ ID NO: 2431049 - protein, 7 aa, Entamoeba dispar
IKDGERI

SEQ ID NO: 2431050 - protein, 5 aa, Entamoeba dispar
IKDGP

SEQ ID NO: 2431051 - protein, 9 aa, Entamoeba dispar
IKDKDEEMK

SEQ ID NO: 2431052 - protein, 8 aa, Entamoeba dispar
IKDKERVG

SEQ ID NO: 2431053 - protein, 10 aa, Entamoeba dispar
IKDKKKKSLS

SEQ ID NO: 2431054 - protein, 4 aa, Entamoeba dispar
IKDN

SEQ ID NO: 2431055 - protein, 19 aa, Entamoeba dispar
IKDNENKTKKGLSGTKQMR

SEQ ID NO: 2431056 - protein, 7 aa, Entamoeba dispar
IKDNSEL

SEQ ID NO: 2431057 - protein, 11 aa, Entamoeba dispar
IKDPKKSKYSD

SEQ ID NO: 2431058 - protein, 9 aa, Entamoeba dispar
IKDPQPSDF

SEQ ID NO: 2431059 - protein, 7 aa, Entamoeba dispar
IKDPQQQ

SEQ ID NO: 2431060 - protein, 11 aa, Entamoeba dispar
IKDQNGKCNNN

SEQ ID NO: 2431061 - protein, 13 aa, Entamoeba dispar
IKDQPRMAVVNMN

SEQ ID NO: 2431062 - protein, 7 aa, Entamoeba dispar
IKDQTKN

SEQ ID NO: 2431063 - protein, 8 aa, Entamoeba dispar
IKDSKSNR

SEQ ID NO: 2431064 - protein, 10 aa, Entamoeba dispar
IKDSQEQNNL

SEQ ID NO: 2431065 - protein, 9 aa, Entamoeba dispar
IKDTDKKTN

SEQ ID NO: 2431066 - protein, 10 aa, Entamoeba dispar
IKEARESAQL

SEQ ID NO: 2431067 - protein, 9 aa, Entamoeba dispar
IKEDKGEMN

SEQ ID NO: 2431068 - protein, 10 aa, Entamoeba dispar
IKEDNVNSDE

SEQ ID NO: 2431069 - protein, 7 aa, Entamoeba dispar
IKEDQID

SEQ ID NO: 2431070 - protein, 10 aa, Entamoeba dispar
IKEDSPENKE

SEQ ID NO: 2431071 - protein, 10 aa, Entamoeba dispar
IKEEDDGLPK

SEQ ID NO: 2431072 - protein, 6 aa, Entamoeba dispar
IKEEEA

SEQ ID NO: 2431073 - protein, 8 aa, Entamoeba dispar
IKEEEECE

SEQ ID NO: 2431074 - protein, 16 aa, Entamoeba dispar
IKEEEEKQKSCQPQEM

SEQ ID NO: 2431075 - protein, 8 aa, Entamoeba dispar
IKEEENNL

SEQ ID NO: 2431076 - protein, 36 aa, Entamoeba dispar
IKEEEQQEQIQKETKEEISLSEKETKVVSEENYEQI

SEQ ID NO: 2431077 - protein, 10 aa, Entamoeba dispar
IKEEKDKQMK

SEQ ID NO: 2431078 - protein, 26 aa, Entamoeba dispar
IKEEKEKEEQENKKLRTKPKKAFEEK

SEQ ID NO: 2431079 - protein, 8 aa, Entamoeba dispar
IKEEKIEE

SEQ ID NO: 2431080 - protein, 8 aa, Entamoeba dispar
IKEEKKEE

SEQ ID NO: 2431081 - protein, 9 aa, Entamoeba dispar
IKEEKQVGM

SEQ ID NO: 2431082 - protein, 5 aa, Entamoeba dispar
IKEEN

SEQ ID NO: 2431083 - protein, 13 aa, Entamoeba dispar
IKEENDCKKKEVG

SEQ ID NO: 2431084 - protein, 24 aa, Entamoeba dispar
IKEENDSQKSSSESEYTPNQQDSL

SEQ ID NO: 2431085 - protein, 6 aa, Entamoeba dispar
IKEENK

SEQ ID NO: 2431086 - protein, 12 aa, Entamoeba dispar
IKEENNEYKNQI

SEQ ID NO: 2431087 - protein, 11 aa, Entamoeba dispar
IKEEPKENKNV

SEQ ID NO: 2431088 - protein, 7 aa, Entamoeba dispar
IKEEQGV

SEQ ID NO: 2431089 - protein, 7 aa, Entamoeba dispar
IKEEREK

SEQ ID NO: 2431090 - protein, 8 aa, Entamoeba dispar
IKEETQTI

SEQ ID NO: 2431091 - protein, 5 aa, Entamoeba dispar
IKEEY

SEQ ID NO: 2431092 - protein, 7 aa, Entamoeba dispar
IKEEYQN

SEQ ID NO: 2431093 - protein, 4 aa, Entamoeba dispar
IKEG

SEQ ID NO: 2431094 - protein, 7 aa, Entamoeba dispar
IKEGDEE

SEQ ID NO: 2431095 - protein, 7 aa, Entamoeba dispar
IKEGDQL

SEQ ID NO: 2431096 - protein, 9 aa, Entamoeba dispar
IKEGDRNKH

SEQ ID NO: 2431097 - protein, 9 aa, Entamoeba dispar
IKEGEDMAK

SEQ ID NO: 2431098 - protein, 7 aa, Entamoeba dispar
IKEGEEK

SEQ ID NO: 2431099 - protein, 11 aa, Entamoeba dispar
IKEGISDSNEY

SEQ ID NO: 2431100 - protein, 24 aa, Entamoeba dispar
IKEGISKGTLKDSVKCPANGNQNE

SEQ ID NO: 2431101 - protein, 6 aa, Entamoeba dispar
IKEGQA

SEQ ID NO: 2431102 - protein, 5 aa, Entamoeba dispar
IKEGR

SEQ ID NO: 2431103 - protein, 19 aa, Entamoeba dispar
IKEGSEFNSPIKGEEKTGK

SEQ ID NO: 2431104 - protein, 12 aa, Entamoeba dispar
IKEGSRNMTSSS

SEQ ID NO: 2431105 - protein, 41 aa, Entamoeba dispar
IKEIKEQQEDEKKKYEDEIEEQKKNIKIQEENVKEKEDEIE

SEQ ID NO: 2431106 - protein, 12 aa, Entamoeba dispar
IKEKDLNKEYQK

SEQ ID NO: 2431107 - protein, 7 aa, Entamoeba dispar
IKEKEDT

SEQ ID NO: 2431108 - protein, 8 aa, Entamoeba dispar
IKEKEMKD

SEQ ID NO: 2431109 - protein, 11 aa, Entamoeba dispar
IKEKENQIDEL

SEQ ID NO: 2431110 - protein, 8 aa, Entamoeba dispar
IKEKEVEQ

SEQ ID NO: 2431111 - protein, 11 aa, Entamoeba dispar
IKEKGTDNLGS

SEQ ID NO: 2431112 - protein, 9 aa, Entamoeba dispar
IKEKIPPIE

SEQ ID NO: 2431113 - protein, 25 aa, Entamoeba dispar
IKEKKRNFKTTKKRKTTIQINWNRV

SEQ ID NO: 2431114 - protein, 6 aa, Entamoeba dispar
IKEKSD

SEQ ID NO: 2431115 - protein, 7 aa, Entamoeba dispar
IKELQKK

SEQ ID NO: 2431116 - protein, 14 aa, Entamoeba dispar
IKELSSKRFSSRKA

SEQ ID NO: 2431117 - protein, 13 aa, Entamoeba dispar
IKENDSKISSSSF

SEQ ID NO: 2431118 - protein, 10 aa, Entamoeba dispar
IKENEETNEI

SEQ ID NO: 2431119 - protein, 12 aa, Entamoeba dispar
IKENEKKKEELN

SEQ ID NO: 2431120 - protein, 23 aa, Entamoeba dispar
IKENENLKKVKEEIEKKTEKEIN

SEQ ID NO: 2431121 - protein, 11 aa, Entamoeba dispar
IKENEQESGNA

SEQ ID NO: 2431122 - protein, 9 aa, Entamoeba dispar
IKENEQKAN

SEQ ID NO: 2431123 - protein, 10 aa, Entamoeba dispar
IKENESKVQP

SEQ ID NO: 2431124 - protein, 5 aa, Entamoeba dispar
IKENI

SEQ ID NO: 2431125 - protein, 10 aa, Entamoeba dispar
IKENKKIDSN

SEQ ID NO: 2431126 - protein, 9 aa, Entamoeba dispar
IKENKRSVK

SEQ ID NO: 2431127 - protein, 7 aa, Entamoeba dispar
IKENNKI

SEQ ID NO: 2431128 - protein, 7 aa, Entamoeba dispar
IKENPKG

SEQ ID NO: 2431129 - protein, 7 aa, Entamoeba dispar
IKENQNN

SEQ ID NO: 2431130 - protein, 9 aa, Entamoeba dispar
IKENTEFPE

SEQ ID NO: 2431131 - protein, 5 aa, Entamoeba dispar
IKENY

SEQ ID NO: 2431132 - protein, 6 aa, Entamoeba dispar
IKENYE

SEQ ID NO: 2431133 - protein, 11 aa, Entamoeba dispar
IKEPQSQPQKY

SEQ ID NO: 2431134 - protein, 4 aa, Entamoeba dispar
IKEQ

SEQ ID NO: 2431135 - protein, 13 aa, Entamoeba dispar
IKEQGSQLSQEKR

SEQ ID NO: 2431136 - protein, 6 aa, Entamoeba dispar
IKEQKQ

SEQ ID NO: 2431137 - protein, 31 aa, Entamoeba dispar
IKEQNEVNNIKEQNEIIQEEKQKQNNQEEGN

SEQ ID NO: 2431138 - protein, 13 aa, Entamoeba dispar
IKEQYEKYQNQGI

SEQ ID NO: 2431139 - protein, 19 aa, Entamoeba dispar
IKERERKKKPFSASEGIAQ

SEQ ID NO: 2431140 - protein, 21 aa, Entamoeba dispar
IKERKEGNGASPESATELTVT

SEQ ID NO: 2431141 - protein, 14 aa, Entamoeba dispar
IKERQEEKIRKRKK

SEQ ID NO: 2431142 - protein, 5 aa, Entamoeba dispar
IKERS

SEQ ID NO: 2431143 - protein, 11 aa, Entamoeba dispar
IKERTRGYGTK

SEQ ID NO: 2431144 - protein, 4 aa, Entamoeba dispar
IKES

SEQ ID NO: 2431145 - protein, 12 aa, Entamoeba dispar
IKESNNSEEELI

SEQ ID NO: 2431146 - protein, 6 aa, Entamoeba dispar
IKESSL

SEQ ID NO: 2431147 - protein, 9 aa, Entamoeba dispar
IKESTGQDV

SEQ ID NO: 2431148 - protein, 10 aa, Entamoeba dispar
IKETEPPKQM

SEQ ID NO: 2431149 - protein, 10 aa, Entamoeba dispar
IKETGDKKRI

SEQ ID NO: 2431150 - protein, 10 aa, Entamoeba dispar
IKETIEKEKE

SEQ ID NO: 2431151 - protein, 6 aa, Entamoeba dispar
IKETLE

SEQ ID NO: 2431152 - protein, 10 aa, Entamoeba dispar
IKETNEQPKK

SEQ ID NO: 2431153 - protein, 13 aa, Entamoeba dispar
IKETSIEKEKEYL

SEQ ID NO: 2431154 - protein, 7 aa, Entamoeba dispar
IKEWESR

SEQ ID NO: 2431155 - protein, 18 aa, Entamoeba dispar
IKEYDDVKQGYHLEQPQN

SEQ ID NO: 2431156 - protein, 14 aa, Entamoeba dispar
IKEYEEDKKYIENK

SEQ ID NO: 2431157 - protein, 7 aa, Entamoeba dispar
IKEYKDG

SEQ ID NO: 2431158 - protein, 4 aa, Entamoeba dispar
IKGC

SEQ ID NO: 2431159 - protein, 17 aa, Entamoeba dispar
IKGDGQDAADKKYEVEE

SEQ ID NO: 2431160 - protein, 8 aa, Entamoeba dispar
IKGDTHSE

SEQ ID NO: 2431161 - protein, 6 aa, Entamoeba dispar
IKGEGI

SEQ ID NO: 2431162 - protein, 28 aa, Entamoeba dispar
IKGEKEKKEEKKEEKKKEDKDKKENDKE

SEQ ID NO: 2431163 - protein, 24 aa, Entamoeba dispar
IKGEKEKKEEKKKEDKDKKENDKE

SEQ ID NO: 2431164 - protein, 10 aa, Entamoeba dispar
IKGEKERKNH

SEQ ID NO: 2431165 - protein, 24 aa, Entamoeba dispar
IKGEPDGSSFPNGGLRQTYQARGY

SEQ ID NO: 2431166 - protein, 25 aa, Entamoeba dispar
IKGETQISTRLDPDEIKEEHKIGEE

SEQ ID NO: 2431167 - protein, 26 aa, Entamoeba dispar
IKGETQISTRLDPDEIKEEHKIGEGT

SEQ ID NO: 2431168 - protein, 25 aa, Entamoeba dispar
IKGETQISTRLDPDEIKEEHKIGER

SEQ ID NO: 2431169 - protein, 26 aa, Entamoeba dispar
IKGETQISTRLDPDEIKEEKKIGEGS

SEQ ID NO: 2431170 - protein, 26 aa, Entamoeba dispar
IKGETQISTRLDPDEIKEENKIGEGT

SEQ ID NO: 2431171 - protein, 11 aa, Entamoeba dispar
IKGGNDKSETN

SEQ ID NO: 2431172 - protein, 8 aa, Entamoeba dispar
IKGHKSGI

SEQ ID NO: 2431173 - protein, 4 aa, Entamoeba dispar
IKGI

SEQ ID NO: 2431174 - protein, 22 aa, Entamoeba dispar
IKGIKSADDIKRKNRKSNRNVF

SEQ ID NO: 2431175 - protein, 21 aa, Entamoeba dispar
IKGKDEKQNQNKEDKKLNEMK

SEQ ID NO: 2431176 - protein, 20 aa, Entamoeba dispar
IKGKTTKQLITEENKRQNCG

SEQ ID NO: 2431177 - protein, 4 aa, Entamoeba dispar
IKGN

SEQ ID NO: 2431178 - protein, 15 aa, Entamoeba dispar
IKGNETGFSGDGTFT

SEQ ID NO: 2431179 - protein, 9 aa, Entamoeba dispar
IKGNKEELE

SEQ ID NO: 2431180 - protein, 6 aa, Entamoeba dispar
IKGNPY

SEQ ID NO: 2431181 - protein, 9 aa, Entamoeba dispar
IKGPDYNSE

SEQ ID NO: 2431182 - protein, 9 aa, Entamoeba dispar
IKGQQHGRS

SEQ ID NO: 2431183 - protein, 12 aa, Entamoeba dispar
IKGRAGDKSVYH

SEQ ID NO: 2431184 - protein, 14 aa, Entamoeba dispar
IKGREEKKKKAQIQ

SEQ ID NO: 2431185 - protein, 16 aa, Entamoeba dispar
IKGRKSLKFEKKELRS

SEQ ID NO: 2431186 - protein, 8 aa, Entamoeba dispar
IKGRPEMK

SEQ ID NO: 2431187 - protein, 6 aa, Entamoeba dispar
IKGRQI

SEQ ID NO: 2431188 - protein, 4 aa, Entamoeba dispar
IKGS

SEQ ID NO: 2431189 - protein, 6 aa, Entamoeba dispar
IKGSLN

SEQ ID NO: 2431190 - protein, 7 aa, Entamoeba dispar
IKGSRNR

SEQ ID NO: 2431191 - protein, 8 aa, Entamoeba dispar
IKGTNGIH

SEQ ID NO: 2431192 - protein, 8 aa, Entamoeba dispar
IKGTRSAQ

SEQ ID NO: 2431193 - protein, 9 aa, Entamoeba dispar
IKGTTKKDK

SEQ ID NO: 2431194 - protein, 4 aa, Entamoeba dispar
IKGY

SEQ ID NO: 2431195 - protein, 18 aa, Entamoeba dispar
IKHAQDLPDYVNRTESNY

SEQ ID NO: 2431196 - protein, 4 aa, Entamoeba dispar
IKHR

SEQ ID NO: 2431197 - protein, 7 aa, Entamoeba dispar
IKIDETQ

SEQ ID NO: 2431198 - protein, 4 aa, Entamoeba dispar
IKIE

SEQ ID NO: 2431199 - protein, 12 aa, Entamoeba dispar
IKIEKDEQFNPI

SEQ ID NO: 2431200 - protein, 11 aa, Entamoeba dispar
IKIESQNLSQI

SEQ ID NO: 2431201 - protein, 12 aa, Entamoeba dispar
IKIKSDDGSQFN

SEQ ID NO: 2431202 - protein, 11 aa, Entamoeba dispar
IKISNNNDDII

SEQ ID NO: 2431203 - protein, 12 aa, Entamoeba dispar
IKISTSSSLPSC

SEQ ID NO: 2431204 - protein, 13 aa, Entamoeba dispar
IKITENGKVNNNG

SEQ ID NO: 2431205 - protein, 9 aa, Entamoeba dispar
IKKADKFKP

SEQ ID NO: 2431206 - protein, 15 aa, Entamoeba dispar
IKKAGGADYSFNTTS

SEQ ID NO: 2431207 - protein, 10 aa, Entamoeba dispar
IKKDNKKDLL

SEQ ID NO: 2431208 - protein, 21 aa, Entamoeba dispar
IKKEDESKKIKRKNGTNEIQK

SEQ ID NO: 2431209 - protein, 8 aa, Entamoeba dispar
IKKEDKGS

SEQ ID NO: 2431210 - protein, 13 aa, Entamoeba dispar
IKKEEDKCEDKQS

SEQ ID NO: 2431211 - protein, 11 aa, Entamoeba dispar
IKKEEEKKYAK

SEQ ID NO: 2431212 - protein, 14 aa, Entamoeba dispar
IKKEEFEKTNKQLQ

SEQ ID NO: 2431213 - protein, 13 aa, Entamoeba dispar
IKKEEKSDYAKTA

SEQ ID NO: 2431214 - protein, 10 aa, Entamoeba dispar
IKKEENKIND

SEQ ID NO: 2431215 - protein, 7 aa, Entamoeba dispar
IKKEGDK

SEQ ID NO: 2431216 - protein, 14 aa, Entamoeba dispar
IKKEGEYNESINEE

SEQ ID NO: 2431217 - protein, 12 aa, Entamoeba dispar
IKKEKEDVTNEL

SEQ ID NO: 2431218 - protein, 8 aa, Entamoeba dispar
IKKEKEGK

SEQ ID NO: 2431219 - protein, 11 aa, Entamoeba dispar
IKKEKEKNSIK

SEQ ID NO: 2431220 - protein, 8 aa, Entamoeba dispar
IKKEKGKI

SEQ ID NO: 2431221 - protein, 12 aa, Entamoeba dispar
IKKEKNEFYTKN

SEQ ID NO: 2431222 - protein, 13 aa, Entamoeba dispar
IKKEKQKKAEEIH

SEQ ID NO: 2431223 - protein, 8 aa, Entamoeba dispar
IKKENDKI

SEQ ID NO: 2431224 - protein, 11 aa, Entamoeba dispar
IKKENDSLKEN

SEQ ID NO: 2431225 - protein, 5 aa, Entamoeba dispar
IKKEQ

SEQ ID NO: 2431226 - protein, 9 aa, Entamoeba dispar
IKKEQGKTY

SEQ ID NO: 2431227 - protein, 22 aa, Entamoeba dispar
IKKESKKSKKDEGNDDDDKKKL

SEQ ID NO: 2431228 - protein, 8 aa, Entamoeba dispar
IKKESPEI

SEQ ID NO: 2431229 - protein, 8 aa, Entamoeba dispar
IKKESQNL

SEQ ID NO: 2431230 - protein, 4 aa, Entamoeba dispar
IKKG

SEQ ID NO: 2431231 - protein, 9 aa, Entamoeba dispar
IKKGEEKAM

SEQ ID NO: 2431232 - protein, 9 aa, Entamoeba dispar
IKKGENDFY

SEQ ID NO: 2431233 - protein, 11 aa, Entamoeba dispar
IKKGNKEEIKI

SEQ ID NO: 2431234 - protein, 15 aa, Entamoeba dispar
IKKGNKEENKINTKR

SEQ ID NO: 2431235 - protein, 23 aa, Entamoeba dispar
IKKGQSQVDEEIESSIEGRAENT

SEQ ID NO: 2431236 - protein, 6 aa, Entamoeba dispar
IKKGSP

SEQ ID NO: 2431237 - protein, 23 aa, Entamoeba dispar
IKKGTQEESDIAKSREETNPPLI

SEQ ID NO: 2431238 - protein, 9 aa, Entamoeba dispar
IKKHGNTLS

SEQ ID NO: 2431239 - protein, 17 aa, Entamoeba dispar
IKKIGGKLKGYEENIEN

SEQ ID NO: 2431240 - protein, 17 aa, Entamoeba dispar
IKKITKEHKATNSAEVE

SEQ ID NO: 2431241 - protein, 9 aa, Entamoeba dispar
IKKKEDESI

SEQ ID NO: 2431242 - protein, 10 aa, Entamoeba dispar
IKKKEKSKID

SEQ ID NO: 2431243 - protein, 9 aa, Entamoeba dispar
IKKKGKVEE

SEQ ID NO: 2431244 - protein, 25 aa, Entamoeba dispar
IKKKGLKKQNGLNEAEAKYKASKES

SEQ ID NO: 2431245 - protein, 25 aa, Entamoeba dispar
IKKKGLKKQNGLNEAEAKYNASKES

SEQ ID NO: 2431246 - protein, 13 aa, Entamoeba dispar
IKKKKTEAIKSKS

SEQ ID NO: 2431247 - protein, 7 aa, Entamoeba dispar
IKKKQKA

SEQ ID NO: 2431248 - protein, 26 aa, Entamoeba dispar
IKKKSKTESQITQEARSSLLSFLKQV

SEQ ID NO: 2431249 - protein, 6 aa, Entamoeba dispar
IKKKTW

SEQ ID NO: 2431250 - protein, 21 aa, Entamoeba dispar
IKKNNEVRRNEYKKRYKREEK

SEQ ID NO: 2431251 - protein, 22 aa, Entamoeba dispar
IKKPGKTKQEKMEEKELKEKQK

SEQ ID NO: 2431252 - protein, 18 aa, Entamoeba dispar
IKKPKKDSRIETEDEKRR

SEQ ID NO: 2431253 - protein, 46 aa, Entamoeba dispar
IKKPYSKSIKEEDSQSKTGSVGSGGRKKKKENKKVMESPQKPSLID

SEQ ID NO: 2431254 - protein, 30 aa, Entamoeba dispar
IKKQEKKIDELNKEQKEEISRIRNNQREEE

SEQ ID NO: 2431255 - protein, 21 aa, Entamoeba dispar
IKKQKKNKRRNGKQISPLKEE

SEQ ID NO: 2431256 - protein, 9 aa, Entamoeba dispar
IKKQPASDH

SEQ ID NO: 2431257 - protein, 10 aa, Entamoeba dispar
IKKQSGCDTE

SEQ ID NO: 2431258 - protein, 9 aa, Entamoeba dispar
IKKQTDQML

SEQ ID NO: 2431259 - protein, 10 aa, Entamoeba dispar
IKKRGSELEA

SEQ ID NO: 2431260 - protein, 8 aa, Entamoeba dispar
IKKSEELK

SEQ ID NO: 2431261 - protein, 11 aa, Entamoeba dispar
IKKSGNSEAKK

SEQ ID NO: 2431262 - protein, 12 aa, Entamoeba dispar
IKKSIERQGEIT

SEQ ID NO: 2431263 - protein, 8 aa, Entamoeba dispar
IKKSKEKH

SEQ ID NO: 2431264 - protein, 15 aa, Entamoeba dispar
IKKSLSKKKIDPENY

SEQ ID NO: 2431265 - protein, 12 aa, Entamoeba dispar
IKKSQLQNTETT

SEQ ID NO: 2431266 - protein, 13 aa, Entamoeba dispar
IKKSRKEKKPRKD

SEQ ID NO: 2431267 - protein, 45 aa, Entamoeba dispar
IKKSRKKTKKTKSKKGIEDKKKIERQKEREKRINEFKKKEEKNED

SEQ ID NO: 2431268 - protein, 12 aa, Entamoeba dispar
IKKTEWTSTEEE

SEQ ID NO: 2431269 - protein, 9 aa, Entamoeba dispar
IKKTGDDPY

SEQ ID NO: 2431270 - protein, 5 aa, Entamoeba dispar
IKKTI

SEQ ID NO: 2431271 - protein, 7 aa, Entamoeba dispar
IKKVGKD

SEQ ID NO: 2431272 - protein, 4 aa, Entamoeba dispar
IKLP

SEQ ID NO: 2431273 - protein, 15 aa, Entamoeba dispar
IKLPQTPADKINNNQ

SEQ ID NO: 2431274 - protein, 6 aa, Entamoeba dispar
IKMDEG

SEQ ID NO: 2431275 - protein, 20 aa, Entamoeba dispar
IKMEEEKPKKHSVDERKRRT

SEQ ID NO: 2431276 - protein, 5 aa, Entamoeba dispar
IKMTQ

SEQ ID NO: 2431277 - protein, 4 aa, Entamoeba dispar
IKNA

SEQ ID NO: 2431278 - protein, 8 aa, Entamoeba dispar
IKNAEEVM

SEQ ID NO: 2431279 - protein, 4 aa, Entamoeba dispar
IKND

SEQ ID NO: 2431280 - protein, 7 aa, Entamoeba dispar
IKNDEEV

SEQ ID NO: 2431281 - protein, 8 aa, Entamoeba dispar
IKNDEQTL

SEQ ID NO: 2431282 - protein, 10 aa, Entamoeba dispar
IKNDKGETPF

SEQ ID NO: 2431283 - protein, 4 aa, Entamoeba dispar
IKNE

SEQ ID NO: 2431284 - protein, 5 aa, Entamoeba dispar
IKNED

SEQ ID NO: 2431285 - protein, 7 aa, Entamoeba dispar
IKNEEDN

SEQ ID NO: 2431286 - protein, 11 aa, Entamoeba dispar
IKNEEQAKEEY

SEQ ID NO: 2431287 - protein, 9 aa, Entamoeba dispar
IKNEKEVLK

SEQ ID NO: 2431288 - protein, 10 aa, Entamoeba dispar
IKNEKTSYEE

SEQ ID NO: 2431289 - protein, 6 aa, Entamoeba dispar
IKNENY

SEQ ID NO: 2431290 - protein, 9 aa, Entamoeba dispar
IKNEPLNSF

SEQ ID NO: 2431291 - protein, 7 aa, Entamoeba dispar
IKNEQKR

SEQ ID NO: 2431292 - protein, 15 aa, Entamoeba dispar
IKNEQTKKKMEEELN

SEQ ID NO: 2431293 - protein, 13 aa, Entamoeba dispar
IKNFGDNGLDSIQ

SEQ ID NO: 2431294 - protein, 6 aa, Entamoeba dispar
IKNGEE

SEQ ID NO: 2431295 - protein, 7 aa, Entamoeba dispar
IKNGKNI

SEQ ID NO: 2431296 - protein, 9 aa, Entamoeba dispar
IKNGSESER

SEQ ID NO: 2431297 - protein, 11 aa, Entamoeba dispar
IKNGTEQVTNG

SEQ ID NO: 2431298 - protein, 12 aa, Entamoeba dispar
IKNHHGLDTTSS

SEQ ID NO: 2431299 - protein, 5 aa, Entamoeba dispar
IKNIG

SEQ ID NO: 2431300 - protein, 5 aa, Entamoeba dispar
IKNKC

SEQ ID NO: 2431301 - protein, 8 aa, Entamoeba dispar
IKNKDQSL

SEQ ID NO: 2431302 - protein, 20 aa, Entamoeba dispar
IKNKEESIIKDNNGNSRYEL

SEQ ID NO: 2431303 - protein, 9 aa, Entamoeba dispar
IKNKGGESL

SEQ ID NO: 2431304 - protein, 6 aa, Entamoeba dispar
IKNKNE

SEQ ID NO: 2431305 - protein, 17 aa, Entamoeba dispar
IKNKNQLTEAKKQIEER

SEQ ID NO: 2431306 - protein, 8 aa, Entamoeba dispar
IKNKSKLV

SEQ ID NO: 2431307 - protein, 4 aa, Entamoeba dispar
IKNM

SEQ ID NO: 2431308 - protein, 6 aa, Entamoeba dispar
IKNNDK

SEQ ID NO: 2431309 - protein, 9 aa, Entamoeba dispar
IKNNEEYNR

SEQ ID NO: 2431310 - protein, 7 aa, Entamoeba dispar
IKNNEQA

SEQ ID NO: 2431311 - protein, 14 aa, Entamoeba dispar
IKNNERSKRKLPPV

SEQ ID NO: 2431312 - protein, 9 aa, Entamoeba dispar
IKNNKERIK

SEQ ID NO: 2431313 - protein, 9 aa, Entamoeba dispar
IKNNNINEA

SEQ ID NO: 2431314 - protein, 9 aa, Entamoeba dispar
IKNNPAAKL

SEQ ID NO: 2431315 - protein, 7 aa, Entamoeba dispar
IKNNPNA

SEQ ID NO: 2431316 - protein, 11 aa, Entamoeba dispar
IKNNSDEEKFK

SEQ ID NO: 2431317 - protein, 11 aa, Entamoeba dispar
IKNNSNVEDKD

SEQ ID NO: 2431318 - protein, 5 aa, Entamoeba dispar
IKNNV

SEQ ID NO: 2431319 - protein, 4 aa, Entamoeba dispar
IKNP

SEQ ID NO: 2431320 - protein, 7 aa, Entamoeba dispar
IKNPGAV

SEQ ID NO: 2431321 - protein, 13 aa, Entamoeba dispar
IKNPKDKQAQEDL

SEQ ID NO: 2431322 - protein, 34 aa, Entamoeba dispar
IKNPRNGKATDKSHPPIHPTRNANLNDLSEKERK

SEQ ID NO: 2431323 - protein, 5 aa, Entamoeba dispar
IKNQE

SEQ ID NO: 2431324 - protein, 6 aa, Entamoeba dispar
IKNQEI

SEQ ID NO: 2431325 - protein, 14 aa, Entamoeba dispar
IKNQSIKESSETRI

SEQ ID NO: 2431326 - protein, 7 aa, Entamoeba dispar
IKNRKGI

SEQ ID NO: 2431327 - protein, 10 aa, Entamoeba dispar
IKNSDNDTYG

SEQ ID NO: 2431328 - protein, 6 aa, Entamoeba dispar
IKNSGE

SEQ ID NO: 2431329 - protein, 16 aa, Entamoeba dispar
IKNSRVATHKDGASKG

SEQ ID NO: 2431330 - protein, 8 aa, Entamoeba dispar
IKNSTKDI

SEQ ID NO: 2431331 - protein, 6 aa, Entamoeba dispar
IKNTSS

SEQ ID NO: 2431332 - protein, 11 aa, Entamoeba dispar
IKNVNNENEKE

SEQ ID NO: 2431333 - protein, 11 aa, Entamoeba dispar
IKNVSSQEPQK

SEQ ID NO: 2431334 - protein, 8 aa, Entamoeba dispar
IKPADISQ

SEQ ID NO: 2431335 - protein, 6 aa, Entamoeba dispar
IKPAEK

SEQ ID NO: 2431336 - protein, 6 aa, Entamoeba dispar
IKPEEK

SEQ ID NO: 2431337 - protein, 7 aa, Entamoeba dispar
IKPEGRN

SEQ ID NO: 2431338 - protein, 6 aa, Entamoeba dispar
IKPGEA

SEQ ID NO: 2431339 - protein, 14 aa, Entamoeba dispar
IKPGPNKAKDSFEL

SEQ ID NO: 2431340 - protein, 7 aa, Entamoeba dispar
IKPHKSG

SEQ ID NO: 2431341 - protein, 6 aa, Entamoeba dispar
IKPIKK

SEQ ID NO: 2431342 - protein, 9 aa, Entamoeba dispar
IKPINKKDI

SEQ ID NO: 2431343 - protein, 9 aa, Entamoeba dispar
IKPIPPNSV

SEQ ID NO: 2431344 - protein, 19 aa, Entamoeba dispar
IKPISSKQVETKPVETNPV

SEQ ID NO: 2431345 - protein, 11 aa, Entamoeba dispar
IKPKPKQPRIE

SEQ ID NO: 2431346 - protein, 7 aa, Entamoeba dispar
IKPKSEK

SEQ ID NO: 2431347 - protein, 7 aa, Entamoeba dispar
IKPKTQV

SEQ ID NO: 2431348 - protein, 7 aa, Entamoeba dispar
IKPKYRS

SEQ ID NO: 2431349 - protein, 11 aa, Entamoeba dispar
IKPLSSLSNPL

SEQ ID NO: 2431350 - protein, 5 aa, Entamoeba dispar
IKPPK

SEQ ID NO: 2431351 - protein, 6 aa, Entamoeba dispar
IKPPKG

SEQ ID NO: 2431352 - protein, 5 aa, Entamoeba dispar
IKPPR

SEQ ID NO: 2431353 - protein, 27 aa, Entamoeba dispar
IKPRKHKGTDKKRRFEAQSKKEQKKPL

SEQ ID NO: 2431354 - protein, 6 aa, Entamoeba dispar
IKPRRS

SEQ ID NO: 2431355 - protein, 19 aa, Entamoeba dispar
IKPRTLDSISKNEIETDSI

SEQ ID NO: 2431356 - protein, 4 aa, Entamoeba dispar
IKPS

SEQ ID NO: 2431357 - protein, 11 aa, Entamoeba dispar
IKPSENTEKYD

SEQ ID NO: 2431358 - protein, 8 aa, Entamoeba dispar
IKPSTEPI

SEQ ID NO: 2431359 - protein, 7 aa, Entamoeba dispar
IKPSYRT

SEQ ID NO: 2431360 - protein, 13 aa, Entamoeba dispar
IKPTASDEEIKKA

SEQ ID NO: 2431361 - protein, 18 aa, Entamoeba dispar
IKPTSENQSSKQLPNKIE

SEQ ID NO: 2431362 - protein, 16 aa, Entamoeba dispar
IKQAENKQERVAKEKK

SEQ ID NO: 2431363 - protein, 12 aa, Entamoeba dispar
IKQATVPISNQS

SEQ ID NO: 2431364 - protein, 8 aa, Entamoeba dispar
IKQDDKTN

SEQ ID NO: 2431365 - protein, 39 aa, Entamoeba dispar
IKQDEFEKTLKEATDRYTEQGKKKKKEKKKKKIEEERKK

SEQ ID NO: 2431366 - protein, 7 aa, Entamoeba dispar
IKQEEPN

SEQ ID NO: 2431367 - protein, 31 aa, Entamoeba dispar
IKQEISKKEEEIKQELERNNTEIEKKSGELA

SEQ ID NO: 2431368 - protein, 11 aa, Entamoeba dispar
IKQEKENKINT

SEQ ID NO: 2431369 - protein, 35 aa, Entamoeba dispar
IKQEKRDKKKKDKERKEKMNKKRKQKEEKKPKKVL

SEQ ID NO: 2431370 - protein, 11 aa, Entamoeba dispar
IKQENNNDEII

SEQ ID NO: 2431371 - protein, 13 aa, Entamoeba dispar
IKQEREDDGIPVT

SEQ ID NO: 2431372 - protein, 19 aa, Entamoeba dispar
IKQGEKSTLGKFIQKMRSM

SEQ ID NO: 2431373 - protein, 64 aa, Entamoeba dispar
IKQHEKEMKEYNENKEKQEADKREKNLKTKKEHRERNKQYHQGIKKRERSDSRHRSYTDQYHTK

SEQ ID NO: 2431374 - protein, 6 aa, Entamoeba dispar
IKQIET

SEQ ID NO: 2431375 - protein, 10 aa, Entamoeba dispar
IKQKEAISYN

SEQ ID NO: 2431376 - protein, 12 aa, Entamoeba dispar
IKQKSDKEAEEL

SEQ ID NO: 2431377 - protein, 4 aa, Entamoeba dispar
IKQN

SEQ ID NO: 2431378 - protein, 7 aa, Entamoeba dispar
IKQNEDY

SEQ ID NO: 2431379 - protein, 15 aa, Entamoeba dispar
IKQNNQNLSNQKDSC

SEQ ID NO: 2431380 - protein, 4 aa, Entamoeba dispar
IKQP

SEQ ID NO: 2431381 - protein, 7 aa, Entamoeba dispar
IKQPKIE

SEQ ID NO: 2431382 - protein, 15 aa, Entamoeba dispar
IKQPPTQHSINKGQE

SEQ ID NO: 2431383 - protein, 19 aa, Entamoeba dispar
IKQQQQAQYEALEKERSAR

SEQ ID NO: 2431384 - protein, 6 aa, Entamoeba dispar
IKQREA

SEQ ID NO: 2431385 - protein, 11 aa, Entamoeba dispar
IKQSGDEKNEL

SEQ ID NO: 2431386 - protein, 9 aa, Entamoeba dispar
IKQSNNSSF

SEQ ID NO: 2431387 - protein, 37 aa, Entamoeba dispar
IKQTEATKAAEIAKADEEAAIARQKEAQAAEEEVTKA

SEQ ID NO: 2431388 - protein, 8 aa, Entamoeba dispar
IKQTPENF

SEQ ID NO: 2431389 - protein, 4 aa, Entamoeba dispar
IKRE

SEQ ID NO: 2431390 - protein, 13 aa, Entamoeba dispar
IKREETDKTEVTS

SEQ ID NO: 2431391 - protein, 15 aa, Entamoeba dispar
IKREIKEKEIKKEEI

SEQ ID NO: 2431392 - protein, 7 aa, Entamoeba dispar
IKRERDK

SEQ ID NO: 2431393 - protein, 15 aa, Entamoeba dispar
IKRESCKSNKLEPRE

SEQ ID NO: 2431394 - protein, 40 aa, Entamoeba dispar
IKRESEEPDQKELPLKKRSNDNSDTITDDTITTEYQNGTI

SEQ ID NO: 2431395 - protein, 9 aa, Entamoeba dispar
IKRKDKQNF

SEQ ID NO: 2431396 - protein, 8 aa, Entamoeba dispar
IKRKGSEY

SEQ ID NO: 2431397 - protein, 27 aa, Entamoeba dispar
IKRKPSQQNVQVRKSDDHHESQSIQDT

SEQ ID NO: 2431398 - protein, 9 aa, Entamoeba dispar
IKRKSTKSV

SEQ ID NO: 2431399 - protein, 9 aa, Entamoeba dispar
IKRNERTEF

SEQ ID NO: 2431400 - protein, 9 aa, Entamoeba dispar
IKRNPNDHL

SEQ ID NO: 2431401 - protein, 10 aa, Entamoeba dispar
IKRQSQETNK

SEQ ID NO: 2431402 - protein, 13 aa, Entamoeba dispar
IKRRNETTYLFPH

SEQ ID NO: 2431403 - protein, 7 aa, Entamoeba dispar
IKRSNVA

SEQ ID NO: 2431404 - protein, 12 aa, Entamoeba dispar
IKRTSRSSSPLC

SEQ ID NO: 2431405 - protein, 5 aa, Entamoeba dispar
IKRYG

SEQ ID NO: 2431406 - protein, 5 aa, Entamoeba dispar
IKSAE

SEQ ID NO: 2431407 - protein, 16 aa, Entamoeba dispar
IKSDRYSKSSFSSLSR

SEQ ID NO: 2431408 - protein, 9 aa, Entamoeba dispar
IKSDSIGSI

SEQ ID NO: 2431409 - protein, 4 aa, Entamoeba dispar
IKSE

SEQ ID NO: 2431410 - protein, 7 aa, Entamoeba dispar
IKSEEKE

SEQ ID NO: 2431411 - protein, 8 aa, Entamoeba dispar
IKSEEKEV

SEQ ID NO: 2431412 - protein, 8 aa, Entamoeba dispar
IKSENSRI

SEQ ID NO: 2431413 - protein, 10 aa, Entamoeba dispar
IKSETPMKKG

SEQ ID NO: 2431414 - protein, 9 aa, Entamoeba dispar
IKSGNSGKS

SEQ ID NO: 2431415 - protein, 7 aa, Entamoeba dispar
IKSHQER

SEQ ID NO: 2431416 - protein, 16 aa, Entamoeba dispar
IKSKDNEKKPKKNETD

SEQ ID NO: 2431417 - protein, 16 aa, Entamoeba dispar
IKSKDSEKKPKKAETD

SEQ ID NO: 2431418 - protein, 16 aa, Entamoeba dispar
IKSKKSTKKVSEFQSN

SEQ ID NO: 2431419 - protein, 18 aa, Entamoeba dispar
IKSKNESKPIVTKKESAL

SEQ ID NO: 2431420 - protein, 15 aa, Entamoeba dispar
IKSKPGKRKQITKQG

SEQ ID NO: 2431421 - protein, 14 aa, Entamoeba dispar
IKSKVNDLPKSEED

SEQ ID NO: 2431422 - protein, 8 aa, Entamoeba dispar
IKSLEEKV

SEQ ID NO: 2431423 - protein, 7 aa, Entamoeba dispar
IKSLPKN

SEQ ID NO: 2431424 - protein, 8 aa, Entamoeba dispar
IKSNDEDD

SEQ ID NO: 2431425 - protein, 10 aa, Entamoeba dispar
IKSNEQEDKL

SEQ ID NO: 2431426 - protein, 20 aa, Entamoeba dispar
IKSNKKEENEIQKSNEEHKS

SEQ ID NO: 2431427 - protein, 7 aa, Entamoeba dispar
IKSNTSQ

SEQ ID NO: 2431428 - protein, 5 aa, Entamoeba dispar
IKSPE

SEQ ID NO: 2431429 - protein, 18 aa, Entamoeba dispar
IKSPFDKYNGDVISKQPS

SEQ ID NO: 2431430 - protein, 10 aa, Entamoeba dispar
IKSPNDRKLL

SEQ ID NO: 2431431 - protein, 31 aa, Entamoeba dispar
IKSPPNEEVNNEIKEETKPEIQDQSKNQPQK

SEQ ID NO: 2431432 - protein, 11 aa, Entamoeba dispar
IKSPSESTNKF

SEQ ID NO: 2431433 - protein, 9 aa, Entamoeba dispar
IKSPSKNIR

SEQ ID NO: 2431434 - protein, 12 aa, Entamoeba dispar
IKSQEISYNGTI

SEQ ID NO: 2431435 - protein, 6 aa, Entamoeba dispar
IKSQEK

SEQ ID NO: 2431436 - protein, 19 aa, Entamoeba dispar
IKSQENKVEKKTPTTDDPL

SEQ ID NO: 2431437 - protein, 12 aa, Entamoeba dispar
IKSQIPKAIGNQ

SEQ ID NO: 2431438 - protein, 5 aa, Entamoeba dispar
IKSRE

SEQ ID NO: 2431439 - protein, 7 aa, Entamoeba dispar
IKSRESD

SEQ ID NO: 2431440 - protein, 8 aa, Entamoeba dispar
IKSRGGLN

SEQ ID NO: 2431441 - protein, 11 aa, Entamoeba dispar
IKSRISKASSV

SEQ ID NO: 2431442 - protein, 8 aa, Entamoeba dispar
IKSRNELR

SEQ ID NO: 2431443 - protein, 5 aa, Entamoeba dispar
IKSRQ

SEQ ID NO: 2431444 - protein, 11 aa, Entamoeba dispar
IKSSARPISIG

SEQ ID NO: 2431445 - protein, 14 aa, Entamoeba dispar
IKSSEIDSLIKLIH

SEQ ID NO: 2431446 - protein, 10 aa, Entamoeba dispar
IKSSKKNRFS

SEQ ID NO: 2431447 - protein, 7 aa, Entamoeba dispar
IKSSSTE

SEQ ID NO: 2431448 - protein, 11 aa, Entamoeba dispar
IKSSTIGEKDE

SEQ ID NO: 2431449 - protein, 9 aa, Entamoeba dispar
IKSTNKCGE

SEQ ID NO: 2431450 - protein, 12 aa, Entamoeba dispar
IKSTNSSIILIH

SEQ ID NO: 2431451 - protein, 7 aa, Entamoeba dispar
IKSTQER

SEQ ID NO: 2431452 - protein, 10 aa, Entamoeba dispar
IKSTQESNYP

SEQ ID NO: 2431453 - protein, 17 aa, Entamoeba dispar
IKSVQEQLKGLGENPLS

SEQ ID NO: 2431454 - protein, 10 aa, Entamoeba dispar
IKSYEENTKT

SEQ ID NO: 2431455 - protein, 7 aa, Entamoeba dispar
IKTADAT

SEQ ID NO: 2431456 - protein, 17 aa, Entamoeba dispar
IKTASENENQSKKELAK

SEQ ID NO: 2431457 - protein, 8 aa, Entamoeba dispar
IKTDDGKY

SEQ ID NO: 2431458 - protein, 15 aa, Entamoeba dispar
IKTDQDISKRKETEL

SEQ ID NO: 2431459 - protein, 5 aa, Entamoeba dispar
IKTDS

SEQ ID NO: 2431460 - protein, 7 aa, Entamoeba dispar
IKTFKKK

SEQ ID NO: 2431461 - protein, 10 aa, Entamoeba dispar
IKTGAPCRSE

SEQ ID NO: 2431462 - protein, 6 aa, Entamoeba dispar
IKTGAY

SEQ ID NO: 2431463 - protein, 6 aa, Entamoeba dispar
IKTGEI

SEQ ID NO: 2431464 - protein, 9 aa, Entamoeba dispar
IKTGGNGNN

SEQ ID NO: 2431465 - protein, 9 aa, Entamoeba dispar
IKTGNNVDN

SEQ ID NO: 2431466 - protein, 9 aa, Entamoeba dispar
IKTGRSNKQ

SEQ ID NO: 2431467 - protein, 17 aa, Entamoeba dispar
IKTIEKEEENSKYEEEI

SEQ ID NO: 2431468 - protein, 9 aa, Entamoeba dispar
IKTKDGRKI

SEQ ID NO: 2431469 - protein, 10 aa, Entamoeba dispar
IKTKEGEDEK

SEQ ID NO: 2431470 - protein, 11 aa, Entamoeba dispar
IKTKNNIKSIQ

SEQ ID NO: 2431471 - protein, 6 aa, Entamoeba dispar
IKTMET

SEQ ID NO: 2431472 - protein, 7 aa, Entamoeba dispar
IKTNPTH

SEQ ID NO: 2431473 - protein, 13 aa, Entamoeba dispar
IKTNTQSNSLDPV

SEQ ID NO: 2431474 - protein, 4 aa, Entamoeba dispar
IKTP

SEQ ID NO: 2431475 - protein, 18 aa, Entamoeba dispar
IKTPDEKLIPGEPVMTNF

SEQ ID NO: 2431476 - protein, 6 aa, Entamoeba dispar
IKTPIK

SEQ ID NO: 2431477 - protein, 6 aa, Entamoeba dispar
IKTPPL

SEQ ID NO: 2431478 - protein, 9 aa, Entamoeba dispar
IKTPRSIAE

SEQ ID NO: 2431479 - protein, 8 aa, Entamoeba dispar
IKTRGRKV

SEQ ID NO: 2431480 - protein, 50 aa, Entamoeba dispar
IKTRKTDNHKIGKKSYEHIKEDKRSTQRSDDDTIEEDEYERNEKKRIKRR

SEQ ID NO: 2431481 - protein, 50 aa, Entamoeba dispar
IKTRKTDNHKIGKKSYEHIKEDKRTNQRSDDDTIEEDEYERNEKKRIKRR

SEQ ID NO: 2431482 - protein, 23 aa, Entamoeba dispar
IKTSEEIKKSIEVENKGKEEKSQ

SEQ ID NO: 2431483 - protein, 12 aa, Entamoeba dispar
IKTSKNPTTTQK

SEQ ID NO: 2431484 - protein, 16 aa, Entamoeba dispar
IKTSSTKDKTVNSKEL

SEQ ID NO: 2431485 - protein, 13 aa, Entamoeba dispar
IKTTRKQMNNKPD

SEQ ID NO: 2431486 - protein, 5 aa, Entamoeba dispar
IKTTT

SEQ ID NO: 2431487 - protein, 11 aa, Entamoeba dispar
IKTTTEKEDEL

SEQ ID NO: 2431488 - protein, 7 aa, Entamoeba dispar
IKTTVKS

SEQ ID NO: 2431489 - protein, 6 aa, Entamoeba dispar
IKTVNE

SEQ ID NO: 2431490 - protein, 7 aa, Entamoeba dispar
IKVDNND

SEQ ID NO: 2431491 - protein, 9 aa, Entamoeba dispar
IKVEGNTIQ

SEQ ID NO: 2431492 - protein, 10 aa, Entamoeba dispar
IKVGEKENKT

SEQ ID NO: 2431493 - protein, 6 aa, Entamoeba dispar
IKVTTT

SEQ ID NO: 2431494 - protein, 6 aa, Entamoeba dispar
IKYPQR

SEQ ID NO: 2431495 - protein, 6 aa, Entamoeba dispar
ILAGDR

SEQ ID NO: 2431496 - protein, 9 aa, Entamoeba dispar
ILDETSTIG

SEQ ID NO: 2431497 - protein, 9 aa, Entamoeba dispar
ILDSSEPNV

SEQ ID NO: 2431498 - protein, 7 aa, Entamoeba dispar
ILKEQND

SEQ ID NO: 2431499 - protein, 7 aa, Entamoeba dispar
ILNETDD

SEQ ID NO: 2431500 - protein, 11 aa, Entamoeba dispar
ILNGNGKKQKV

SEQ ID NO: 2431501 - protein, 8 aa, Entamoeba dispar
ILNKETSK

SEQ ID NO: 2431502 - protein, 7 aa, Entamoeba dispar
ILNNNEE

SEQ ID NO: 2431503 - protein, 4 aa, Entamoeba dispar
ILPE

SEQ ID NO: 2431504 - protein, 5 aa, Entamoeba dispar
ILPET

SEQ ID NO: 2431505 - protein, 9 aa, Entamoeba dispar
ILPGKDTLN

SEQ ID NO: 2431506 - protein, 10 aa, Entamoeba dispar
ILPNTTINNQ

SEQ ID NO: 2431507 - protein, 12 aa, Entamoeba dispar
ILPSPGGNTQHA

SEQ ID NO: 2431508 - protein, 10 aa, Entamoeba dispar
ILQPKSPSKL

SEQ ID NO: 2431509 - protein, 10 aa, Entamoeba dispar
ILSDNEARTN

SEQ ID NO: 2431510 - protein, 13 aa, Entamoeba dispar
ILSPQRGSQMNTE

SEQ ID NO: 2431511 - protein, 7 aa, Entamoeba dispar
ILTGGDN

SEQ ID NO: 2431512 - protein, 10 aa, Entamoeba dispar
ILTKDKQEIQ

SEQ ID NO: 2431513 - protein, 14 aa, Entamoeba dispar
ILTTSKNLKNELSK

SEQ ID NO: 2431514 - protein, 4 aa, Entamoeba dispar
IMEE

SEQ ID NO: 2431515 - protein, 26 aa, Entamoeba dispar
IMGGPTPIRPKPVEQKIEEDNEETIE

SEQ ID NO: 2431516 - protein, 12 aa, Entamoeba dispar
IMNGSKQVDTIQ

SEQ ID NO: 2431517 - protein, 19 aa, Entamoeba dispar
INAETVSLNPTEEETGKTY

SEQ ID NO: 2431518 - protein, 14 aa, Entamoeba dispar
INAGQDAQEIHEAE

SEQ ID NO: 2431519 - protein, 13 aa, Entamoeba dispar
INAKHELSKCDET

SEQ ID NO: 2431520 - protein, 5 aa, Entamoeba dispar
INAQQ

SEQ ID NO: 2431521 - protein, 10 aa, Entamoeba dispar
INAQSKEQGI

SEQ ID NO: 2431522 - protein, 9 aa, Entamoeba dispar
INAQTAPKI

SEQ ID NO: 2431523 - protein, 15 aa, Entamoeba dispar
INASSLSFNSLIDLL

SEQ ID NO: 2431524 - protein, 5 aa, Entamoeba dispar
INDDE

SEQ ID NO: 2431525 - protein, 9 aa, Entamoeba dispar
INDEDANGK

SEQ ID NO: 2431526 - protein, 6 aa, Entamoeba dispar
INDEEK

SEQ ID NO: 2431527 - protein, 5 aa, Entamoeba dispar
INDEN

SEQ ID NO: 2431528 - protein, 9 aa, Entamoeba dispar
INDESRNNI

SEQ ID NO: 2431529 - protein, 13 aa, Entamoeba dispar
INDFSASDSARNI

SEQ ID NO: 2431530 - protein, 6 aa, Entamoeba dispar
INDKDA

SEQ ID NO: 2431531 - protein, 20 aa, Entamoeba dispar
INDKEVNEKRKRVKKSDDKI

SEQ ID NO: 2431532 - protein, 11 aa, Entamoeba dispar
INDKGKLKTQE

SEQ ID NO: 2431533 - protein, 6 aa, Entamoeba dispar
INDKNV

SEQ ID NO: 2431534 - protein, 14 aa, Entamoeba dispar
INDKPKKKKARNWI

SEQ ID NO: 2431535 - protein, 9 aa, Entamoeba dispar
INDKSADPV

SEQ ID NO: 2431536 - protein, 5 aa, Entamoeba dispar
INDKT

SEQ ID NO: 2431537 - protein, 4 aa, Entamoeba dispar
INDN

SEQ ID NO: 2431538 - protein, 5 aa, Entamoeba dispar
INDNE

SEQ ID NO: 2431539 - protein, 6 aa, Entamoeba dispar
INDNFD

SEQ ID NO: 2431540 - protein, 8 aa, Entamoeba dispar
INDPNIPM

SEQ ID NO: 2431541 - protein, 8 aa, Entamoeba dispar
INDPSKQS

SEQ ID NO: 2431542 - protein, 8 aa, Entamoeba dispar
INDQQHQE

SEQ ID NO: 2431543 - protein, 24 aa, Entamoeba dispar
INDSNTFIKDSKDEKKAEQANKAI

SEQ ID NO: 2431544 - protein, 7 aa, Entamoeba dispar
INDSSNL

SEQ ID NO: 2431545 - protein, 10 aa, Entamoeba dispar
INDTTPERLD

SEQ ID NO: 2431546 - protein, 7 aa, Entamoeba dispar
INDTTTV

SEQ ID NO: 2431547 - protein, 4 aa, Entamoeba dispar
INDY

SEQ ID NO: 2431548 - protein, 4 aa, Entamoeba dispar
INEA

SEQ ID NO: 2431549 - protein, 14 aa, Entamoeba dispar
INEATPANEQNPTV

SEQ ID NO: 2431550 - protein, 9 aa, Entamoeba dispar
INEDHKNSS

SEQ ID NO: 2431551 - protein, 16 aa, Entamoeba dispar
INEDLNKQIKSTENIK

SEQ ID NO: 2431552 - protein, 7 aa, Entamoeba dispar
INEDPIR

SEQ ID NO: 2431553 - protein, 11 aa, Entamoeba dispar
INEDPKNKSKG

SEQ ID NO: 2431554 - protein, 6 aa, Entamoeba dispar
INEDSI

SEQ ID NO: 2431555 - protein, 23 aa, Entamoeba dispar
INEDSNRNEKEISQKNTNETIQD

SEQ ID NO: 2431556 - protein, 14 aa, Entamoeba dispar
INEDTEEEENEEEM

SEQ ID NO: 2431557 - protein, 6 aa, Entamoeba dispar
INEEAT

SEQ ID NO: 2431558 - protein, 25 aa, Entamoeba dispar
INEEEKKALTKESNGINKREDVKGS

SEQ ID NO: 2431559 - protein, 16 aa, Entamoeba dispar
INEEGNNKYITVQSER

SEQ ID NO: 2431560 - protein, 13 aa, Entamoeba dispar
INEEIEKKIQEER

SEQ ID NO: 2431561 - protein, 31 aa, Entamoeba dispar
INEEIKKKEEDNNKKEIESKPKKERPQVGVS

SEQ ID NO: 2431562 - protein, 18 aa, Entamoeba dispar
INEEKSGGHKRKNKNLEE

SEQ ID NO: 2431563 - protein, 7 aa, Entamoeba dispar
INEENYK

SEQ ID NO: 2431564 - protein, 6 aa, Entamoeba dispar
INEEPY

SEQ ID NO: 2431565 - protein, 15 aa, Entamoeba dispar
INEEQEKRQQKINKL

SEQ ID NO: 2431566 - protein, 9 aa, Entamoeba dispar
INEESSNKF

SEQ ID NO: 2431567 - protein, 12 aa, Entamoeba dispar
INEESVNNITNV

SEQ ID NO: 2431568 - protein, 5 aa, Entamoeba dispar
INEET

SEQ ID NO: 2431569 - protein, 11 aa, Entamoeba dispar
INEEYYKNKGN

SEQ ID NO: 2431570 - protein, 8 aa, Entamoeba dispar
INEGGYSE

SEQ ID NO: 2431571 - protein, 5 aa, Entamoeba dispar
INEGK

SEQ ID NO: 2431572 - protein, 14 aa, Entamoeba dispar
INEGNESNNGLSGI

SEQ ID NO: 2431573 - protein, 13 aa, Entamoeba dispar
INEHPKDDSYENG

SEQ ID NO: 2431574 - protein, 4 aa, Entamoeba dispar
INEI

SEQ ID NO: 2431575 - protein, 10 aa, Entamoeba dispar
INEIEKSTNL

SEQ ID NO: 2431576 - protein, 7 aa, Entamoeba dispar
INEKETN

SEQ ID NO: 2431577 - protein, 8 aa, Entamoeba dispar
INEKGKEH

SEQ ID NO: 2431578 - protein, 8 aa, Entamoeba dispar
INEKGSYY

SEQ ID NO: 2431579 - protein, 12 aa, Entamoeba dispar
INEKKEKKIDEF

SEQ ID NO: 2431580 - protein, 9 aa, Entamoeba dispar
INEKQYYSA

SEQ ID NO: 2431581 - protein, 8 aa, Entamoeba dispar
INEKTRES

SEQ ID NO: 2431582 - protein, 5 aa, Entamoeba dispar
INELR

SEQ ID NO: 2431583 - protein, 4 aa, Entamoeba dispar
INEN

SEQ ID NO: 2431584 - protein, 15 aa, Entamoeba dispar
INENDENEYQVKRKL

SEQ ID NO: 2431585 - protein, 7 aa, Entamoeba dispar
INENGQE

SEQ ID NO: 2431586 - protein, 10 aa, Entamoeba dispar
INENGTGEYQ

SEQ ID NO: 2431587 - protein, 7 aa, Entamoeba dispar
INENKDY

SEQ ID NO: 2431588 - protein, 9 aa, Entamoeba dispar
INENKEAKE

SEQ ID NO: 2431589 - protein, 11 aa, Entamoeba dispar
INENKSSKFNV

SEQ ID NO: 2431590 - protein, 9 aa, Entamoeba dispar
INENKVSLP

SEQ ID NO: 2431591 - protein, 8 aa, Entamoeba dispar
INENPPVQ

SEQ ID NO: 2431592 - protein, 13 aa, Entamoeba dispar
INENSQPSFGQNQ

SEQ ID NO: 2431593 - protein, 14 aa, Entamoeba dispar
INENTEKGNEINEL

SEQ ID NO: 2431594 - protein, 14 aa, Entamoeba dispar
INENTQPRSGQNQD

SEQ ID NO: 2431595 - protein, 4 aa, Entamoeba dispar
INEP

SEQ ID NO: 2431596 - protein, 6 aa, Entamoeba dispar
INEPKF

SEQ ID NO: 2431597 - protein, 10 aa, Entamoeba dispar
INEPYKDPIP

SEQ ID NO: 2431598 - protein, 12 aa, Entamoeba dispar
INEQEHQKSMDE

SEQ ID NO: 2431599 - protein, 5 aa, Entamoeba dispar
INEQN

SEQ ID NO: 2431600 - protein, 8 aa, Entamoeba dispar
INEQTTSF

SEQ ID NO: 2431601 - protein, 5 aa, Entamoeba dispar
INEQW

SEQ ID NO: 2431602 - protein, 4 aa, Entamoeba dispar
INES

SEQ ID NO: 2431603 - protein, 7 aa, Entamoeba dispar
INESKAK

SEQ ID NO: 2431604 - protein, 11 aa, Entamoeba dispar
INESKKIKTEK

SEQ ID NO: 2431605 - protein, 15 aa, Entamoeba dispar
INESNDDKTIEERAV

SEQ ID NO: 2431606 - protein, 9 aa, Entamoeba dispar
INESPSRLK

SEQ ID NO: 2431607 - protein, 12 aa, Entamoeba dispar
INETNDSKLVPK

SEQ ID NO: 2431608 - protein, 12 aa, Entamoeba dispar
INETNKNEIQGK

SEQ ID NO: 2431609 - protein, 20 aa, Entamoeba dispar
INETQGQRCTLQPADKKNIT

SEQ ID NO: 2431610 - protein, 14 aa, Entamoeba dispar
INETSYKTPTKYQF

SEQ ID NO: 2431611 - protein, 9 aa, Entamoeba dispar
INETTNKYN

SEQ ID NO: 2431612 - protein, 9 aa, Entamoeba dispar
INEYKYDTN

SEQ ID NO: 2431613 - protein, 6 aa, Entamoeba dispar
INEYSE

SEQ ID NO: 2431614 - protein, 10 aa, Entamoeba dispar
INFGKSQRNN

SEQ ID NO: 2431615 - protein, 12 aa, Entamoeba dispar
INFNKTKQEVND

SEQ ID NO: 2431616 - protein, 9 aa, Entamoeba dispar
INGADSHSS

SEQ ID NO: 2431617 - protein, 11 aa, Entamoeba dispar
INGAKIKKKDI

SEQ ID NO: 2431618 - protein, 8 aa, Entamoeba dispar
INGDENRV

SEQ ID NO: 2431619 - protein, 5 aa, Entamoeba dispar
INGDG

SEQ ID NO: 2431620 - protein, 4 aa, Entamoeba dispar
INGE

SEQ ID NO: 2431621 - protein, 10 aa, Entamoeba dispar
INGENIEKKD

SEQ ID NO: 2431622 - protein, 11 aa, Entamoeba dispar
INGERIEKRDI

SEQ ID NO: 2431623 - protein, 6 aa, Entamoeba dispar
INGERT

SEQ ID NO: 2431624 - protein, 7 aa, Entamoeba dispar
INGESGY

SEQ ID NO: 2431625 - protein, 17 aa, Entamoeba dispar
INGEYNKEEMKKKDYED

SEQ ID NO: 2431626 - protein, 7 aa, Entamoeba dispar
INGFNKD

SEQ ID NO: 2431627 - protein, 8 aa, Entamoeba dispar
INGGNDKF

SEQ ID NO: 2431628 - protein, 4 aa, Entamoeba dispar
INGH

SEQ ID NO: 2431629 - protein, 7 aa, Entamoeba dispar
INGIEKD

SEQ ID NO: 2431630 - protein, 4 aa, Entamoeba dispar
INGK

SEQ ID NO: 2431631 - protein, 7 aa, Entamoeba dispar
INGKDRV

SEQ ID NO: 2431632 - protein, 5 aa, Entamoeba dispar
INGKE

SEQ ID NO: 2431633 - protein, 9 aa, Entamoeba dispar
INGKEGHEL

SEQ ID NO: 2431634 - protein, 11 aa, Entamoeba dispar
INGKKIKKKDI

SEQ ID NO: 2431635 - protein, 15 aa, Entamoeba dispar
INGKRGFVPSNFLQP

SEQ ID NO: 2431636 - protein, 10 aa, Entamoeba dispar
INGKSIEKKD

SEQ ID NO: 2431637 - protein, 6 aa, Entamoeba dispar
INGKTY

SEQ ID NO: 2431638 - protein, 13 aa, Entamoeba dispar
INGKWSGKRTLER

SEQ ID NO: 2431639 - protein, 6 aa, Entamoeba dispar
INGNDP

SEQ ID NO: 2431640 - protein, 8 aa, Entamoeba dispar
INGNENRV

SEQ ID NO: 2431641 - protein, 5 aa, Entamoeba dispar
INGPE

SEQ ID NO: 2431642 - protein, 4 aa, Entamoeba dispar
INGQ

SEQ ID NO: 2431643 - protein, 4 aa, Entamoeba dispar
INGS

SEQ ID NO: 2431644 - protein, 12 aa, Entamoeba dispar
INGSQKINNEEQ

SEQ ID NO: 2431645 - protein, 4 aa, Entamoeba dispar
INGT

SEQ ID NO: 2431646 - protein, 6 aa, Entamoeba dispar
INGTAT

SEQ ID NO: 2431647 - protein, 8 aa, Entamoeba dispar
INGTKEKP

SEQ ID NO: 2431648 - protein, 5 aa, Entamoeba dispar
INGTP

SEQ ID NO: 2431649 - protein, 13 aa, Entamoeba dispar
INHNKEKSTLVDT

SEQ ID NO: 2431650 - protein, 6 aa, Entamoeba dispar
INIGGR

SEQ ID NO: 2431651 - protein, 11 aa, Entamoeba dispar
ININKQTKEII

SEQ ID NO: 2431652 - protein, 10 aa, Entamoeba dispar
INIPAGSTTQ

SEQ ID NO: 2431653 - protein, 9 aa, Entamoeba dispar
INIPNSVTK

SEQ ID NO: 2431654 - protein, 18 aa, Entamoeba dispar
INIPRNGEDKGDHPPITP

SEQ ID NO: 2431655 - protein, 5 aa, Entamoeba dispar
INIPS

SEQ ID NO: 2431656 - protein, 10 aa, Entamoeba dispar
INIPSSIKSF

SEQ ID NO: 2431657 - protein, 8 aa, Entamoeba dispar
INIPSSIN

SEQ ID NO: 2431658 - protein, 10 aa, Entamoeba dispar
INIPSSINEI

SEQ ID NO: 2431659 - protein, 10 aa, Entamoeba dispar
INIPSSITKL

SEQ ID NO: 2431660 - protein, 13 aa, Entamoeba dispar
INIPSSVKEIGNE

SEQ ID NO: 2431661 - protein, 9 aa, Entamoeba dispar
INIPSSVNK

SEQ ID NO: 2431662 - protein, 10 aa, Entamoeba dispar
INIPSSVNKI

SEQ ID NO: 2431663 - protein, 8 aa, Entamoeba dispar
INIPSSVS

SEQ ID NO: 2431664 - protein, 11 aa, Entamoeba dispar
INIPSSVSEIG

SEQ ID NO: 2431665 - protein, 14 aa, Entamoeba dispar
INIPSSVSEIGSDS

SEQ ID NO: 2431666 - protein, 13 aa, Entamoeba dispar
INIPSSVSKIGGG

SEQ ID NO: 2431667 - protein, 11 aa, Entamoeba dispar
INIPSSVSKLG

SEQ ID NO: 2431668 - protein, 13 aa, Entamoeba dispar
INIPSSVSKLGDN

SEQ ID NO: 2431669 - protein, 10 aa, Entamoeba dispar
INIPSSVSTL

SEQ ID NO: 2431670 - protein, 7 aa, Entamoeba dispar
INIPSTI

SEQ ID NO: 2431671 - protein, 6 aa, Entamoeba dispar
INIPTS

SEQ ID NO: 2431672 - protein, 13 aa, Entamoeba dispar
INIPTSVKTLGDG

SEQ ID NO: 2431673 - protein, 10 aa, Entamoeba dispar
INIPTSVNKI

SEQ ID NO: 2431674 - protein, 8 aa, Entamoeba dispar
INIPTSVS

SEQ ID NO: 2431675 - protein, 10 aa, Entamoeba dispar
INIPTSVSEI

SEQ ID NO: 2431676 - protein, 10 aa, Entamoeba dispar
INIPTSVSKI

SEQ ID NO: 2431677 - protein, 10 aa, Entamoeba dispar
INIPTSVTDI

SEQ ID NO: 2431678 - protein, 7 aa, Entamoeba dispar
INIPTTV

SEQ ID NO: 2431679 - protein, 11 aa, Entamoeba dispar
INKDGKLQPDI

SEQ ID NO: 2431680 - protein, 5 aa, Entamoeba dispar
INKDK

SEQ ID NO: 2431681 - protein, 10 aa, Entamoeba dispar
INKEDKRKKN

SEQ ID NO: 2431682 - protein, 9 aa, Entamoeba dispar
INKEDSEVE

SEQ ID NO: 2431683 - protein, 10 aa, Entamoeba dispar
INKENKNNLS

SEQ ID NO: 2431684 - protein, 23 aa, Entamoeba dispar
INKENNNLSPEEVEQKMKEMKEK

SEQ ID NO: 2431685 - protein, 11 aa, Entamoeba dispar
INKEPNQAIKN

SEQ ID NO: 2431686 - protein, 30 aa, Entamoeba dispar
INKERQKSRDNSLTSDSNNDSSTKTSNESD

SEQ ID NO: 2431687 - protein, 7 aa, Entamoeba dispar
INKETLT

SEQ ID NO: 2431688 - protein, 12 aa, Entamoeba dispar
INKETQQEMEES

SEQ ID NO: 2431689 - protein, 6 aa, Entamoeba dispar
INKEYT

SEQ ID NO: 2431690 - protein, 14 aa, Entamoeba dispar
INKGEKYQKIDYQN

SEQ ID NO: 2431691 - protein, 5 aa, Entamoeba dispar
INKID

SEQ ID NO: 2431692 - protein, 86 aa, Entamoeba dispar
  misc_feature (17)..(18): Xaa can be any naturally occurring amino acid
INKKDESVKVEVEEINXXKPEETDEENVNAHSTEEEQVKKRQRYSIPKKTKRRITNKTLKSKIQEIDQSNSQKSEEEEKSKRKSSK

SEQ ID NO: 2431693 - protein, 9 aa, Entamoeba dispar
INKKITDEK

SEQ ID NO: 2431694 - protein, 12 aa, Entamoeba dispar
INKKKENKHQRK

SEQ ID NO: 2431695 - protein, 6 aa, Entamoeba dispar
INKKPR

SEQ ID NO: 2431696 - protein, 10 aa, Entamoeba dispar
INKKRNEKPL

SEQ ID NO: 2431697 - protein, 11 aa, Entamoeba dispar
INKLAESTVKE

SEQ ID NO: 2431698 - protein, 4 aa, Entamoeba dispar
INKM

SEQ ID NO: 2431699 - protein, 10 aa, Entamoeba dispar
INKNALKETR

SEQ ID NO: 2431700 - protein, 12 aa, Entamoeba dispar
INKNKRLREREA

SEQ ID NO: 2431701 - protein, 7 aa, Entamoeba dispar
INKNKTP

SEQ ID NO: 2431702 - protein, 4 aa, Entamoeba dispar
INKP

SEQ ID NO: 2431703 - protein, 5 aa, Entamoeba dispar
INKPD

SEQ ID NO: 2431704 - protein, 16 aa, Entamoeba dispar
INKPPSDQKEELNLSP

SEQ ID NO: 2431705 - protein, 6 aa, Entamoeba dispar
INKPTA

SEQ ID NO: 2431706 - protein, 5 aa, Entamoeba dispar
INKQD

SEQ ID NO: 2431707 - protein, 12 aa, Entamoeba dispar
INKQEEKNSKIM

SEQ ID NO: 2431708 - protein, 24 aa, Entamoeba dispar
INKRDNKQQIIKDEKEGQNENKNI

SEQ ID NO: 2431709 - protein, 7 aa, Entamoeba dispar
INKRNGN

SEQ ID NO: 2431710 - protein, 21 aa, Entamoeba dispar
INKTEKMRTTPMSDHGQHVRM

SEQ ID NO: 2431711 - protein, 8 aa, Entamoeba dispar
INKTSPKM

SEQ ID NO: 2431712 - protein, 9 aa, Entamoeba dispar
INKYSAEDV

SEQ ID NO: 2431713 - protein, 4 aa, Entamoeba dispar
INLP

SEQ ID NO: 2431714 - protein, 8 aa, Entamoeba dispar
INLPPEES

SEQ ID NO: 2431715 - protein, 5 aa, Entamoeba dispar
INLQS

SEQ ID NO: 2431716 - protein, 14 aa, Entamoeba dispar
INLTKGESQNGLNT

SEQ ID NO: 2431717 - protein, 7 aa, Entamoeba dispar
INNDKKS

SEQ ID NO: 2431718 - protein, 9 aa, Entamoeba dispar
INNDPTNEL

SEQ ID NO: 2431719 - protein, 10 aa, Entamoeba dispar
INNDRNYNIN

SEQ ID NO: 2431720 - protein, 9 aa, Entamoeba dispar
INNEKYDYY

SEQ ID NO: 2431721 - protein, 9 aa, Entamoeba dispar
INNGSRELL

SEQ ID NO: 2431722 - protein, 20 aa, Entamoeba dispar
INNHEKKDSKFDSNSNTNHI

SEQ ID NO: 2431723 - protein, 8 aa, Entamoeba dispar
INNHEQQI

SEQ ID NO: 2431724 - protein, 11 aa, Entamoeba dispar
INNIKESLNEY

SEQ ID NO: 2431725 - protein, 8 aa, Entamoeba dispar
INNKDEQK

SEQ ID NO: 2431726 - protein, 6 aa, Entamoeba dispar
INNKDS

SEQ ID NO: 2431727 - protein, 6 aa, Entamoeba dispar
INNKSI

SEQ ID NO: 2431728 - protein, 5 aa, Entamoeba dispar
INNLP

SEQ ID NO: 2431729 - protein, 12 aa, Entamoeba dispar
INNMGKKLSEED

SEQ ID NO: 2431730 - protein, 15 aa, Entamoeba dispar
INNNGGDNDGKSQYP

SEQ ID NO: 2431731 - protein, 6 aa, Entamoeba dispar
INNNQF

SEQ ID NO: 2431732 - protein, 13 aa, Entamoeba dispar
INNNTNNQNITKL

SEQ ID NO: 2431733 - protein, 9 aa, Entamoeba dispar
INNPEEMTS

SEQ ID NO: 2431734 - protein, 7 aa, Entamoeba dispar
INNPSLK

SEQ ID NO: 2431735 - protein, 9 aa, Entamoeba dispar
INNPTQRQS

SEQ ID NO: 2431736 - protein, 5 aa, Entamoeba dispar
INNQN

SEQ ID NO: 2431737 - protein, 17 aa, Entamoeba dispar
INNQSTVKIKQENHPIG

SEQ ID NO: 2431738 - protein, 9 aa, Entamoeba dispar
INNQYNDDI

SEQ ID NO: 2431739 - protein, 10 aa, Entamoeba dispar
INNRGTVSSY

SEQ ID NO: 2431740 - protein, 8 aa, Entamoeba dispar
INNSLKNT

SEQ ID NO: 2431741 - protein, 10 aa, Entamoeba dispar
INNSNNNNYY

SEQ ID NO: 2431742 - protein, 10 aa, Entamoeba dispar
INNSTGSHQS

SEQ ID NO: 2431743 - protein, 4 aa, Entamoeba dispar
INNT

SEQ ID NO: 2431744 - protein, 15 aa, Entamoeba dispar
INNTETIGDDHPKIK

SEQ ID NO: 2431745 - protein, 8 aa, Entamoeba dispar
INNTKQKV

SEQ ID NO: 2431746 - protein, 20 aa, Entamoeba dispar
INNTPGEVNKENEKLSKEDI

SEQ ID NO: 2431747 - protein, 4 aa, Entamoeba dispar
INNV

SEQ ID NO: 2431748 - protein, 8 aa, Entamoeba dispar
INPDANEE

SEQ ID NO: 2431749 - protein, 16 aa, Entamoeba dispar
INPDELSQNYKKKRTL

SEQ ID NO: 2431750 - protein, 6 aa, Entamoeba dispar
INPDKP

SEQ ID NO: 2431751 - protein, 8 aa, Entamoeba dispar
INPEEQSI

SEQ ID NO: 2431752 - protein, 15 aa, Entamoeba dispar
INPEFQPNAVGGYGK

SEQ ID NO: 2431753 - protein, 8 aa, Entamoeba dispar
INPFKGKP

SEQ ID NO: 2431754 - protein, 4 aa, Entamoeba dispar
INPG

SEQ ID NO: 2431755 - protein, 17 aa, Entamoeba dispar
INPGSRIGISADKSYMT

SEQ ID NO: 2431756 - protein, 5 aa, Entamoeba dispar
INPIA

SEQ ID NO: 2431757 - protein, 4 aa, Entamoeba dispar
INPK

SEQ ID NO: 2431758 - protein, 10 aa, Entamoeba dispar
INPKDRPTID

SEQ ID NO: 2431759 - protein, 18 aa, Entamoeba dispar
INPKGLNERRKPRRTRMP

SEQ ID NO: 2431760 - protein, 7 aa, Entamoeba dispar
INPKSSH

SEQ ID NO: 2431761 - protein, 9 aa, Entamoeba dispar
INPKTGEIE

SEQ ID NO: 2431762 - protein, 6 aa, Entamoeba dispar
INPMTN

SEQ ID NO: 2431763 - protein, 5 aa, Entamoeba dispar
INPNF

SEQ ID NO: 2431764 - protein, 6 aa, Entamoeba dispar
INPNSS

SEQ ID NO: 2431765 - protein, 11 aa, Entamoeba dispar
INPNVSDTTIY

SEQ ID NO: 2431766 - protein, 5 aa, Entamoeba dispar
INPPL

SEQ ID NO: 2431767 - protein, 5 aa, Entamoeba dispar
INPQE

SEQ ID NO: 2431768 - protein, 7 aa, Entamoeba dispar
INPRPES

SEQ ID NO: 2431769 - protein, 4 aa, Entamoeba dispar
INPS

SEQ ID NO: 2431770 - protein, 7 aa, Entamoeba dispar
INPSKKE

SEQ ID NO: 2431771 - protein, 14 aa, Entamoeba dispar
INPSRGDGGSGTAS

SEQ ID NO: 2431772 - protein, 14 aa, Entamoeba dispar
INPSRGNGGSGTAS

SEQ ID NO: 2431773 - protein, 9 aa, Entamoeba dispar
INPSTVKQR

SEQ ID NO: 2431774 - protein, 14 aa, Entamoeba dispar
INPSVSKDSSSLNE

SEQ ID NO: 2431775 - protein, 5 aa, Entamoeba dispar
INPTD

SEQ ID NO: 2431776 - protein, 9 aa, Entamoeba dispar
INPTVTDDW

SEQ ID NO: 2431777 - protein, 22 aa, Entamoeba dispar
INQDNPNCNTYSKITRLLAVQF

SEQ ID NO: 2431778 - protein, 8 aa, Entamoeba dispar
INQEDRNI

SEQ ID NO: 2431779 - protein, 20 aa, Entamoeba dispar
INQEDYEKSIKEEEEETRKS

SEQ ID NO: 2431780 - protein, 11 aa, Entamoeba dispar
INQGSMEYNSE

SEQ ID NO: 2431781 - protein, 5 aa, Entamoeba dispar
INQHT

SEQ ID NO: 2431782 - protein, 17 aa, Entamoeba dispar
INQIDKSSDDKNLNGLE

SEQ ID NO: 2431783 - protein, 9 aa, Entamoeba dispar
INQNENSYE

SEQ ID NO: 2431784 - protein, 20 aa, Entamoeba dispar
INQNGYRNNLETISDKATSP

SEQ ID NO: 2431785 - protein, 7 aa, Entamoeba dispar
INQNTEH

SEQ ID NO: 2431786 - protein, 10 aa, Entamoeba dispar
INQNTTESII

SEQ ID NO: 2431787 - protein, 19 aa, Entamoeba dispar
INQPEESRKDKEDNSNKEM

SEQ ID NO: 2431788 - protein, 4 aa, Entamoeba dispar
INQQ

SEQ ID NO: 2431789 - protein, 7 aa, Entamoeba dispar
INQQETT

SEQ ID NO: 2431790 - protein, 12 aa, Entamoeba dispar
INQQKSSEISSE

SEQ ID NO: 2431791 - protein, 6 aa, Entamoeba dispar
INQRQQ

SEQ ID NO: 2431792 - protein, 11 aa, Entamoeba dispar
INQSEKLSQTK

SEQ ID NO: 2431793 - protein, 9 aa, Entamoeba dispar
INQSNERCG

SEQ ID NO: 2431794 - protein, 11 aa, Entamoeba dispar
INQSNNINYNP

SEQ ID NO: 2431795 - protein, 31 aa, Entamoeba dispar
INQSNNSLTPRSKKDHELKEKEEELKQREEI

SEQ ID NO: 2431796 - protein, 11 aa, Entamoeba dispar
INQSSKKKVFK

SEQ ID NO: 2431797 - protein, 26 aa, Entamoeba dispar
INQTEQSIKSPLKNKDNSLSKHSTSL

SEQ ID NO: 2431798 - protein, 6 aa, Entamoeba dispar
INQTNS

SEQ ID NO: 2431799 - protein, 56 aa, Entamoeba dispar
INQTTPKKIKQPKSLVEENRIEKKKTNQPIEEKEQKLDQETQNQIEKKESNTNQEI

SEQ ID NO: 2431800 - protein, 19 aa, Entamoeba dispar
INQVSPDTVPNALNWKDLC

SEQ ID NO: 2431801 - protein, 7 aa, Entamoeba dispar
INQYGPF

SEQ ID NO: 2431802 - protein, 18 aa, Entamoeba dispar
INQYTEVKESNEKTEEAL

SEQ ID NO: 2431803 - protein, 4 aa, Entamoeba dispar
INRG

SEQ ID NO: 2431804 - protein, 4 aa, Entamoeba dispar
INRN

SEQ ID NO: 2431805 - protein, 6 aa, Entamoeba dispar
INRNES

SEQ ID NO: 2431806 - protein, 41 aa, Entamoeba dispar
INRQPKPGNKQPRNVSASQNAKKKSKVDNNIKKQPKSIEKA

SEQ ID NO: 2431807 - protein, 6 aa, Entamoeba dispar
INRRTS

SEQ ID NO: 2431808 - protein, 7 aa, Entamoeba dispar
INRYSSD

SEQ ID NO: 2431809 - protein, 10 aa, Entamoeba dispar
INSATQTKEF

SEQ ID NO: 2431810 - protein, 8 aa, Entamoeba dispar
INSDEEGA

SEQ ID NO: 2431811 - protein, 6 aa, Entamoeba dispar
INSDKS

SEQ ID NO: 2431812 - protein, 4 aa, Entamoeba dispar
INSE

SEQ ID NO: 2431813 - protein, 26 aa, Entamoeba dispar
INSEEDKKPITKSTRTKKDNKMEEEN

SEQ ID NO: 2431814 - protein, 7 aa, Entamoeba dispar
INSEEKY

SEQ ID NO: 2431815 - protein, 9 aa, Entamoeba dispar
INSENEKAY

SEQ ID NO: 2431816 - protein, 24 aa, Entamoeba dispar
INSERNESKKPRDTIVEKEEKQNI

SEQ ID NO: 2431817 - protein, 6 aa, Entamoeba dispar
INSERT

SEQ ID NO: 2431818 - protein, 16 aa, Entamoeba dispar
INSESEKIGQKHLETA

SEQ ID NO: 2431819 - protein, 4 aa, Entamoeba dispar
INSG

SEQ ID NO: 2431820 - protein, 10 aa, Entamoeba dispar
INSGEENTVA

SEQ ID NO: 2431821 - protein, 8 aa, Entamoeba dispar
INSGKEEV

SEQ ID NO: 2431822 - protein, 12 aa, Entamoeba dispar
INSINNKNLSDS

SEQ ID NO: 2431823 - protein, 4 aa, Entamoeba dispar
INSK

SEQ ID NO: 2431824 - protein, 6 aa, Entamoeba dispar
INSKEN

SEQ ID NO: 2431825 - protein, 7 aa, Entamoeba dispar
INSKGEK

SEQ ID NO: 2431826 - protein, 11 aa, Entamoeba dispar
INSKGKAVTYN

SEQ ID NO: 2431827 - protein, 9 aa, Entamoeba dispar
INSKPKKDI

SEQ ID NO: 2431828 - protein, 17 aa, Entamoeba dispar
INSKRKELKEWTDKAKE

SEQ ID NO: 2431829 - protein, 8 aa, Entamoeba dispar
INSKSKRV

SEQ ID NO: 2431830 - protein, 8 aa, Entamoeba dispar
INSLEDNE

SEQ ID NO: 2431831 - protein, 11 aa, Entamoeba dispar
INSLNKERMQY

SEQ ID NO: 2431832 - protein, 4 aa, Entamoeba dispar
INSN

SEQ ID NO: 2431833 - protein, 15 aa, Entamoeba dispar
INSNDTAVVAAGKDN

SEQ ID NO: 2431834 - protein, 8 aa, Entamoeba dispar
INSNENRV

SEQ ID NO: 2431835 - protein, 9 aa, Entamoeba dispar
INSNGKPEI

SEQ ID NO: 2431836 - protein, 5 aa, Entamoeba dispar
INSPF

SEQ ID NO: 2431837 - protein, 8 aa, Entamoeba dispar
INSPHHSS

SEQ ID NO: 2431838 - protein, 11 aa, Entamoeba dispar
INSPKDLSVNE

SEQ ID NO: 2431839 - protein, 14 aa, Entamoeba dispar
INSPPISSASSQLT

SEQ ID NO: 2431840 - protein, 20 aa, Entamoeba dispar
INSQHNTTPIPSVKSSHSIR

SEQ ID NO: 2431841 - protein, 16 aa, Entamoeba dispar
INSQKKISSFGKKEDT

SEQ ID NO: 2431842 - protein, 10 aa, Entamoeba dispar
INSREKDKKK

SEQ ID NO: 2431843 - protein, 11 aa, Entamoeba dispar
INSRKEECADL

SEQ ID NO: 2431844 - protein, 4 aa, Entamoeba dispar
INSS

SEQ ID NO: 2431845 - protein, 8 aa, Entamoeba dispar
INSSEYQK

SEQ ID NO: 2431846 - protein, 7 aa, Entamoeba dispar
INSSLRN

SEQ ID NO: 2431847 - protein, 22 aa, Entamoeba dispar
INSSNDSKKPDHGPDHRSHCSL

SEQ ID NO: 2431848 - protein, 18 aa, Entamoeba dispar
INSSNGNKKPDHPHHCSL

SEQ ID NO: 2431849 - protein, 9 aa, Entamoeba dispar
INSSPSSET

SEQ ID NO: 2431850 - protein, 17 aa, Entamoeba dispar
INSSRKEKKQHTTEGST

SEQ ID NO: 2431851 - protein, 7 aa, Entamoeba dispar
INSSSHE

SEQ ID NO: 2431852 - protein, 7 aa, Entamoeba dispar
INSSSKD

SEQ ID NO: 2431853 - protein, 10 aa, Entamoeba dispar
INSSTQLSKY

SEQ ID NO: 2431854 - protein, 10 aa, Entamoeba dispar
INSSTSEKDI

SEQ ID NO: 2431855 - protein, 11 aa, Entamoeba dispar
INSTKKLEIGE

SEQ ID NO: 2431856 - protein, 6 aa, Entamoeba dispar
INSTNK

SEQ ID NO: 2431857 - protein, 11 aa, Entamoeba dispar
INSTTNSTNTV

SEQ ID NO: 2431858 - protein, 10 aa, Entamoeba dispar
INTDVEKSVN

SEQ ID NO: 2431859 - protein, 4 aa, Entamoeba dispar
INTE

SEQ ID NO: 2431860 - protein, 11 aa, Entamoeba dispar
INTENNNGYSI

SEQ ID NO: 2431861 - protein, 10 aa, Entamoeba dispar
INTETGEMDP

SEQ ID NO: 2431862 - protein, 9 aa, Entamoeba dispar
INTGEREPF

SEQ ID NO: 2431863 - protein, 11 aa, Entamoeba dispar
INTIPKGIGKC

SEQ ID NO: 2431864 - protein, 4 aa, Entamoeba dispar
INTK

SEQ ID NO: 2431865 - protein, 8 aa, Entamoeba dispar
INTKEDYV

SEQ ID NO: 2431866 - protein, 16 aa, Entamoeba dispar
INTKEGETVEGKTHEE

SEQ ID NO: 2431867 - protein, 26 aa, Entamoeba dispar
INTKNGVIKKSESIKEKSSIQSSRNN

SEQ ID NO: 2431868 - protein, 9 aa, Entamoeba dispar
INTKNNQNV

SEQ ID NO: 2431869 - protein, 5 aa, Entamoeba dispar
INTKR

SEQ ID NO: 2431870 - protein, 9 aa, Entamoeba dispar
INTKRYEYK

SEQ ID NO: 2431871 - protein, 18 aa, Entamoeba dispar
INTLQSEGPELTEIDKEN

SEQ ID NO: 2431872 - protein, 16 aa, Entamoeba dispar
INTNNRNQQSHSPRSL

SEQ ID NO: 2431873 - protein, 7 aa, Entamoeba dispar
INTNSNQ

SEQ ID NO: 2431874 - protein, 5 aa, Entamoeba dispar
INTPS

SEQ ID NO: 2431875 - protein, 31 aa, Entamoeba dispar
INTQSQQQTTKQQSISNPNQNTFQTINNSGQ

SEQ ID NO: 2431876 - protein, 8 aa, Entamoeba dispar
INTSKKCN

SEQ ID NO: 2431877 - protein, 7 aa, Entamoeba dispar
INTSNIP

SEQ ID NO: 2431878 - protein, 23 aa, Entamoeba dispar
INTSNQLQRSNQIGQVTPGNQPI

SEQ ID NO: 2431879 - protein, 11 aa, Entamoeba dispar
INTSQKLDLND

SEQ ID NO: 2431880 - protein, 10 aa, Entamoeba dispar
INTSYEKIEN

SEQ ID NO: 2431881 - protein, 30 aa, Entamoeba dispar
INTTNNNSQIRQNNDQNGLREEQQRREINQ

SEQ ID NO: 2431882 - protein, 10 aa, Entamoeba dispar
INTTNSLQST

SEQ ID NO: 2431883 - protein, 4 aa, Entamoeba dispar
INTV

SEQ ID NO: 2431884 - protein, 5 aa, Entamoeba dispar
INTVK

SEQ ID NO: 2431885 - protein, 4 aa, Entamoeba dispar
INTY

SEQ ID NO: 2431886 - protein, 12 aa, Entamoeba dispar
INVDSKNKLGAT

SEQ ID NO: 2431887 - protein, 5 aa, Entamoeba dispar
INVPS

SEQ ID NO: 2431888 - protein, 9 aa, Entamoeba dispar
INVPSSVSE

SEQ ID NO: 2431889 - protein, 7 aa, Entamoeba dispar
INVPTSI

SEQ ID NO: 2431890 - protein, 14 aa, Entamoeba dispar
INVQSITGSCDNTE

SEQ ID NO: 2431891 - protein, 6 aa, Entamoeba dispar
INYDGY

SEQ ID NO: 2431892 - protein, 8 aa, Entamoeba dispar
INYGPERL

SEQ ID NO: 2431893 - protein, 32 aa, Entamoeba dispar
INYKTKDNNSIELSQSVSNGISNINEKDKQID

SEQ ID NO: 2431894 - protein, 4 aa, Entamoeba dispar
INYN

SEQ ID NO: 2431895 - protein, 7 aa, Entamoeba dispar
INYNSTK

SEQ ID NO: 2431896 - protein, 12 aa, Entamoeba dispar
IPAKEIQNKSNS

SEQ ID NO: 2431897 - protein, 8 aa, Entamoeba dispar
IPANPSTF

SEQ ID NO: 2431898 - protein, 19 aa, Entamoeba dispar
IPAPFKPDMSQDGKTNFGE

SEQ ID NO: 2431899 - protein, 5 aa, Entamoeba dispar
IPASV

SEQ ID NO: 2431900 - protein, 4 aa, Entamoeba dispar
IPCD

SEQ ID NO: 2431901 - protein, 12 aa, Entamoeba dispar
IPDDENDENDDV

SEQ ID NO: 2431902 - protein, 7 aa, Entamoeba dispar
IPDDGNF

SEQ ID NO: 2431903 - protein, 14 aa, Entamoeba dispar
IPDDKTQKISNTKR

SEQ ID NO: 2431904 - protein, 10 aa, Entamoeba dispar
IPDDQKEDVS

SEQ ID NO: 2431905 - protein, 7 aa, Entamoeba dispar
IPDDVDP

SEQ ID NO: 2431906 - protein, 5 aa, Entamoeba dispar
IPDEL

SEQ ID NO: 2431907 - protein, 10 aa, Entamoeba dispar
IPDENGESRI

SEQ ID NO: 2431908 - protein, 7 aa, Entamoeba dispar
IPDEYRP

SEQ ID NO: 2431909 - protein, 4 aa, Entamoeba dispar
IPDG

SEQ ID NO: 2431910 - protein, 19 aa, Entamoeba dispar
IPDGDDIMNEEENEPRGYI

SEQ ID NO: 2431911 - protein, 25 aa, Entamoeba dispar
IPDGQTATEQTLNPQYPREPAKTYP

SEQ ID NO: 2431912 - protein, 6 aa, Entamoeba dispar
IPDGSL

SEQ ID NO: 2431913 - protein, 10 aa, Entamoeba dispar
IPDGTLPTDK

SEQ ID NO: 2431914 - protein, 8 aa, Entamoeba dispar
IPDGYGTS

SEQ ID NO: 2431915 - protein, 9 aa, Entamoeba dispar
IPDKRTDTW

SEQ ID NO: 2431916 - protein, 12 aa, Entamoeba dispar
IPDKSLTQSKYA

SEQ ID NO: 2431917 - protein, 22 aa, Entamoeba dispar
IPDNKSKSQIQEEIKRKESAIK

SEQ ID NO: 2431918 - protein, 10 aa, Entamoeba dispar
IPDNRADSEE

SEQ ID NO: 2431919 - protein, 10 aa, Entamoeba dispar
IPDNSKQTQN

SEQ ID NO: 2431920 - protein, 6 aa, Entamoeba dispar
IPDNTQ

SEQ ID NO: 2431921 - protein, 5 aa, Entamoeba dispar
IPDPG

SEQ ID NO: 2431922 - protein, 14 aa, Entamoeba dispar
IPDPKPLERHHLNL

SEQ ID NO: 2431923 - protein, 11 aa, Entamoeba dispar
IPDPKVDQRHG

SEQ ID NO: 2431924 - protein, 6 aa, Entamoeba dispar
IPDPNS

SEQ ID NO: 2431925 - protein, 7 aa, Entamoeba dispar
IPDSVTE

SEQ ID NO: 2431926 - protein, 8 aa, Entamoeba dispar
IPDTEGRR

SEQ ID NO: 2431927 - protein, 13 aa, Entamoeba dispar
IPDTSSPSESSLS

SEQ ID NO: 2431928 - protein, 11 aa, Entamoeba dispar
IPDVSTKSKQV

SEQ ID NO: 2431929 - protein, 19 aa, Entamoeba dispar
IPEAEKRMKELKGTNKETT

SEQ ID NO: 2431930 - protein, 5 aa, Entamoeba dispar
IPECG

SEQ ID NO: 2431931 - protein, 14 aa, Entamoeba dispar
IPECSSSNGGSTYL

SEQ ID NO: 2431932 - protein, 6 aa, Entamoeba dispar
IPEDRK

SEQ ID NO: 2431933 - protein, 5 aa, Entamoeba dispar
IPEEK

SEQ ID NO: 2431934 - protein, 6 aa, Entamoeba dispar
IPEENT

SEQ ID NO: 2431935 - protein, 6 aa, Entamoeba dispar
IPEEPF

SEQ ID NO: 2431936 - protein, 5 aa, Entamoeba dispar
IPEET

SEQ ID NO: 2431937 - protein, 9 aa, Entamoeba dispar
IPEGEYDAF

SEQ ID NO: 2431938 - protein, 9 aa, Entamoeba dispar
IPEHRKKRN

SEQ ID NO: 2431939 - protein, 11 aa, Entamoeba dispar
IPEKDLEDVQQ

SEQ ID NO: 2431940 - protein, 5 aa, Entamoeba dispar
IPEND

SEQ ID NO: 2431941 - protein, 7 aa, Entamoeba dispar
IPEQTQI

SEQ ID NO: 2431942 - protein, 5 aa, Entamoeba dispar
IPERY

SEQ ID NO: 2431943 - protein, 4 aa, Entamoeba dispar
IPES

SEQ ID NO: 2431944 - protein, 5 aa, Entamoeba dispar
IPESD

SEQ ID NO: 2431945 - protein, 27 aa, Entamoeba dispar
IPESERKKIIEEDQTKLKRKKKQEKEL

SEQ ID NO: 2431946 - protein, 7 aa, Entamoeba dispar
IPESTKM

SEQ ID NO: 2431947 - protein, 4 aa, Entamoeba dispar
IPET

SEQ ID NO: 2431948 - protein, 7 aa, Entamoeba dispar
IPETRSQ

SEQ ID NO: 2431949 - protein, 11 aa, Entamoeba dispar
IPETVKSGNWY

SEQ ID NO: 2431950 - protein, 6 aa, Entamoeba dispar
IPFEPK

SEQ ID NO: 2431951 - protein, 12 aa, Entamoeba dispar
IPFSSSKRNETI

SEQ ID NO: 2431952 - protein, 16 aa, Entamoeba dispar
IPFTTKASQCKTSSSL

SEQ ID NO: 2431953 - protein, 4 aa, Entamoeba dispar
IPGA

SEQ ID NO: 2431954 - protein, 10 aa, Entamoeba dispar
IPGAVSEAQL

SEQ ID NO: 2431955 - protein, 14 aa, Entamoeba dispar
IPGAVSEAQLREAM

SEQ ID NO: 2431956 - protein, 8 aa, Entamoeba dispar
IPGGATAR

SEQ ID NO: 2431957 - protein, 6 aa, Entamoeba dispar
IPGKGR

SEQ ID NO: 2431958 - protein, 9 aa, Entamoeba dispar
IPGKNQQPL

SEQ ID NO: 2431959 - protein, 7 aa, Entamoeba dispar
IPGNISR

SEQ ID NO: 2431960 - protein, 6 aa, Entamoeba dispar
IPGSMD

SEQ ID NO: 2431961 - protein, 6 aa, Entamoeba dispar
IPGTNQ

SEQ ID NO: 2431962 - protein, 12 aa, Entamoeba dispar
IPGYDKNSEPIY

SEQ ID NO: 2431963 - protein, 17 aa, Entamoeba dispar
IPHKKESITRISDGSRF

SEQ ID NO: 2431964 - protein, 8 aa, Entamoeba dispar
IPHQPSTH

SEQ ID NO: 2431965 - protein, 5 aa, Entamoeba dispar
IPIEH

SEQ ID NO: 2431966 - protein, 6 aa, Entamoeba dispar
IPINSK

SEQ ID NO: 2431967 - protein, 9 aa, Entamoeba dispar
IPIPGSGSA

SEQ ID NO: 2431968 - protein, 8 aa, Entamoeba dispar
IPITPNEQ

SEQ ID NO: 2431969 - protein, 12 aa, Entamoeba dispar
IPITPSEDNVDS

SEQ ID NO: 2431970 - protein, 4 aa, Entamoeba dispar
IPKD

SEQ ID NO: 2431971 - protein, 5 aa, Entamoeba dispar
IPKDK

SEQ ID NO: 2431972 - protein, 4 aa, Entamoeba dispar
IPKE

SEQ ID NO: 2431973 - protein, 11 aa, Entamoeba dispar
IPKEGKVTISA

SEQ ID NO: 2431974 - protein, 6 aa, Entamoeba dispar
IPKEKQ

SEQ ID NO: 2431975 - protein, 23 aa, Entamoeba dispar
IPKEKRAKGLIEREKGYKHRQNL

SEQ ID NO: 2431976 - protein, 5 aa, Entamoeba dispar
IPKGD

SEQ ID NO: 2431977 - protein, 7 aa, Entamoeba dispar
IPKGDHD

SEQ ID NO: 2431978 - protein, 8 aa, Entamoeba dispar
IPKGKSVT

SEQ ID NO: 2431979 - protein, 10 aa, Entamoeba dispar
IPKGSKTGDI

SEQ ID NO: 2431980 - protein, 9 aa, Entamoeba dispar
IPKGTTQVS

SEQ ID NO: 2431981 - protein, 4 aa, Entamoeba dispar
IPKI

SEQ ID NO: 2431982 - protein, 13 aa, Entamoeba dispar
IPKKKGGKGSVDD

SEQ ID NO: 2431983 - protein, 12 aa, Entamoeba dispar
IPKKKKKKTNFV

SEQ ID NO: 2431984 - protein, 62 aa, Entamoeba dispar
IPKKRQPKTSGGTNGSTNKSIGETRARTNVSTNLSQQSSTGVSQHSSSTSTNPSHPQQNAQT

SEQ ID NO: 2431985 - protein, 9 aa, Entamoeba dispar
IPKNGSSSH

SEQ ID NO: 2431986 - protein, 5 aa, Entamoeba dispar
IPKNT

SEQ ID NO: 2431987 - protein, 4 aa, Entamoeba dispar
IPKP

SEQ ID NO: 2431988 - protein, 8 aa, Entamoeba dispar
IPKPTEYS

SEQ ID NO: 2431989 - protein, 10 aa, Entamoeba dispar
IPKPTTEEEM

SEQ ID NO: 2431990 - protein, 11 aa, Entamoeba dispar
IPKSKSPLDIE

SEQ ID NO: 2431991 - protein, 9 aa, Entamoeba dispar
IPKSVSSTK

SEQ ID NO: 2431992 - protein, 7 aa, Entamoeba dispar
IPKSVTS

SEQ ID NO: 2431993 - protein, 10 aa, Entamoeba dispar
IPKTKSGSGI

SEQ ID NO: 2431994 - protein, 5 aa, Entamoeba dispar
IPLDS

SEQ ID NO: 2431995 - protein, 13 aa, Entamoeba dispar
IPLGSSKRIKEGI

SEQ ID NO: 2431996 - protein, 11 aa, Entamoeba dispar
IPLKTAQRRLE

SEQ ID NO: 2431997 - protein, 5 aa, Entamoeba dispar
IPLPS

SEQ ID NO: 2431998 - protein, 5 aa, Entamoeba dispar
IPLRD

SEQ ID NO: 2431999 - protein, 13 aa, Entamoeba dispar
IPMKQKTKMDYGG

SEQ ID NO: 2432000 - protein, 12 aa, Entamoeba dispar
IPMPQSNQTTVR

SEQ ID NO: 2432001 - protein, 7 aa, Entamoeba dispar
IPNDKGK

SEQ ID NO: 2432002 - protein, 8 aa, Entamoeba dispar
IPNDPTNA

SEQ ID NO: 2432003 - protein, 5 aa, Entamoeba dispar
IPNEG

SEQ ID NO: 2432004 - protein, 12 aa, Entamoeba dispar
IPNEGNNEHPDF

SEQ ID NO: 2432005 - protein, 6 aa, Entamoeba dispar
IPNENV

SEQ ID NO: 2432006 - protein, 20 aa, Entamoeba dispar
IPNEQVEQEVKEESEEDNGY

SEQ ID NO: 2432007 - protein, 10 aa, Entamoeba dispar
IPNEVENEEA

SEQ ID NO: 2432008 - protein, 19 aa, Entamoeba dispar
IPNEVENEEPIIEDDGQEL

SEQ ID NO: 2432009 - protein, 10 aa, Entamoeba dispar
IPNFETPERA

SEQ ID NO: 2432010 - protein, 20 aa, Entamoeba dispar
IPNHTSKKPVKNINTEKKPL

SEQ ID NO: 2432011 - protein, 4 aa, Entamoeba dispar
IPNI

SEQ ID NO: 2432012 - protein, 15 aa, Entamoeba dispar
IPNKGLNHTTQFSSQ

SEQ ID NO: 2432013 - protein, 15 aa, Entamoeba dispar
IPNKNESFKRLDSPG

SEQ ID NO: 2432014 - protein, 5 aa, Entamoeba dispar
IPNLP

SEQ ID NO: 2432015 - protein, 10 aa, Entamoeba dispar
IPNNDSKLNP

SEQ ID NO: 2432016 - protein, 10 aa, Entamoeba dispar
IPNNNTTSQL

SEQ ID NO: 2432017 - protein, 13 aa, Entamoeba dispar
IPNPKPEDAITAT

SEQ ID NO: 2432018 - protein, 13 aa, Entamoeba dispar
IPNPSLKNSCKNT

SEQ ID NO: 2432019 - protein, 9 aa, Entamoeba dispar
IPNRAHPED

SEQ ID NO: 2432020 - protein, 10 aa, Entamoeba dispar
IPNRKAREQT

SEQ ID NO: 2432021 - protein, 11 aa, Entamoeba dispar
IPNRTRKQCRE

SEQ ID NO: 2432022 - protein, 4 aa, Entamoeba dispar
IPNS

SEQ ID NO: 2432023 - protein, 17 aa, Entamoeba dispar
IPNSLQPKCDGRKNINK

SEQ ID NO: 2432024 - protein, 6 aa, Entamoeba dispar
IPNSRT

SEQ ID NO: 2432025 - protein, 7 aa, Entamoeba dispar
IPNSTKS

SEQ ID NO: 2432026 - protein, 5 aa, Entamoeba dispar
IPNSV

SEQ ID NO: 2432027 - protein, 7 aa, Entamoeba dispar
IPNSVTE

SEQ ID NO: 2432028 - protein, 7 aa, Entamoeba dispar
IPNSVTK

SEQ ID NO: 2432029 - protein, 10 aa, Entamoeba dispar
IPNTDNSITT

SEQ ID NO: 2432030 - protein, 5 aa, Entamoeba dispar
IPNTE

SEQ ID NO: 2432031 - protein, 6 aa, Entamoeba dispar
IPNTEC

SEQ ID NO: 2432032 - protein, 8 aa, Entamoeba dispar
IPNTREQL

SEQ ID NO: 2432033 - protein, 7 aa, Entamoeba dispar
IPNTRNL

SEQ ID NO: 2432034 - protein, 13 aa, Entamoeba dispar
IPPAQKKDYESYL

SEQ ID NO: 2432035 - protein, 10 aa, Entamoeba dispar
IPPDKQPLPY

SEQ ID NO: 2432036 - protein, 13 aa, Entamoeba dispar
IPPDPSTIEPPLP

SEQ ID NO: 2432037 - protein, 6 aa, Entamoeba dispar
IPPDRS

SEQ ID NO: 2432038 - protein, 9 aa, Entamoeba dispar
IPPESSDGD

SEQ ID NO: 2432039 - protein, 5 aa, Entamoeba dispar
IPPEV

SEQ ID NO: 2432040 - protein, 16 aa, Entamoeba dispar
IPPGENPPGAVEDQKV

SEQ ID NO: 2432041 - protein, 5 aa, Entamoeba dispar
IPPGI

SEQ ID NO: 2432042 - protein, 7 aa, Entamoeba dispar
IPPITGN

SEQ ID NO: 2432043 - protein, 7 aa, Entamoeba dispar
IPPITGP

SEQ ID NO: 2432044 - protein, 9 aa, Entamoeba dispar
IPPKEDTEK

SEQ ID NO: 2432045 - protein, 5 aa, Entamoeba dispar
IPPKI

SEQ ID NO: 2432046 - protein, 7 aa, Entamoeba dispar
IPPKPSQ

SEQ ID NO: 2432047 - protein, 7 aa, Entamoeba dispar
IPPLPGD

SEQ ID NO: 2432048 - protein, 4 aa, Entamoeba dispar
IPPN

SEQ ID NO: 2432049 - protein, 7 aa, Entamoeba dispar
IPPNNTL

SEQ ID NO: 2432050 - protein, 11 aa, Entamoeba dispar
IPPNRTEDGNT

SEQ ID NO: 2432051 - protein, 5 aa, Entamoeba dispar
IPPPI

SEQ ID NO: 2432052 - protein, 6 aa, Entamoeba dispar
IPPPIK

SEQ ID NO: 2432053 - protein, 12 aa, Entamoeba dispar
IPPPPNANLSDA

SEQ ID NO: 2432054 - protein, 21 aa, Entamoeba dispar
IPPPPPPASHSSTNNSKFSNK

SEQ ID NO: 2432055 - protein, 60 aa, Entamoeba dispar
IPPPPVAPAIGNPPPPPPIAPAKQAGNPPPPPIRSTNSAGNPPPPPPARQTAAPAPANGN

SEQ ID NO: 2432056 - protein, 10 aa, Entamoeba dispar
IPPPQPDAAQ

SEQ ID NO: 2432057 - protein, 8 aa, Entamoeba dispar
IPPPTDEL

SEQ ID NO: 2432058 - protein, 4 aa, Entamoeba dispar
IPPQ

SEQ ID NO: 2432059 - protein, 5 aa, Entamoeba dispar
IPPQE

SEQ ID NO: 2432060 - protein, 21 aa, Entamoeba dispar
IPPQEEIQPQKEEQKKKVKVV

SEQ ID NO: 2432061 - protein, 5 aa, Entamoeba dispar
IPPQN

SEQ ID NO: 2432062 - protein, 9 aa, Entamoeba dispar
IPPQPNTSY

SEQ ID NO: 2432063 - protein, 19 aa, Entamoeba dispar
IPPQQIKGGESGSDSRESI

SEQ ID NO: 2432064 - protein, 5 aa, Entamoeba dispar
IPPQT

SEQ ID NO: 2432065 - protein, 6 aa, Entamoeba dispar
IPPRST

SEQ ID NO: 2432066 - protein, 8 aa, Entamoeba dispar
IPPSDPSR

SEQ ID NO: 2432067 - protein, 5 aa, Entamoeba dispar
IPPSE

SEQ ID NO: 2432068 - protein, 5 aa, Entamoeba dispar
IPPSF

SEQ ID NO: 2432069 - protein, 7 aa, Entamoeba dispar
IPPSHNS

SEQ ID NO: 2432070 - protein, 7 aa, Entamoeba dispar
IPPSISK

SEQ ID NO: 2432071 - protein, 12 aa, Entamoeba dispar
IPPSISSIGDSY

SEQ ID NO: 2432072 - protein, 9 aa, Entamoeba dispar
IPPSNDTSM

SEQ ID NO: 2432073 - protein, 9 aa, Entamoeba dispar
IPPSPYPEF

SEQ ID NO: 2432074 - protein, 4 aa, Entamoeba dispar
IPPT

SEQ ID NO: 2432075 - protein, 10 aa, Entamoeba dispar
IPPTASEKQK

SEQ ID NO: 2432076 - protein, 7 aa, Entamoeba dispar
IPPTENN

SEQ ID NO: 2432077 - protein, 6 aa, Entamoeba dispar
IPPTEP

SEQ ID NO: 2432078 - protein, 5 aa, Entamoeba dispar
IPPTI

SEQ ID NO: 2432079 - protein, 6 aa, Entamoeba dispar
IPPTVS

SEQ ID NO: 2432080 - protein, 4 aa, Entamoeba dispar
IPPV

SEQ ID NO: 2432081 - protein, 6 aa, Entamoeba dispar
IPPWDY

SEQ ID NO: 2432082 - protein, 6 aa, Entamoeba dispar
IPQDES

SEQ ID NO: 2432083 - protein, 18 aa, Entamoeba dispar
IPQDKKSLLDGEEDEEGL

SEQ ID NO: 2432084 - protein, 6 aa, Entamoeba dispar
IPQENQ

SEQ ID NO: 2432085 - protein, 4 aa, Entamoeba dispar
IPQG

SEQ ID NO: 2432086 - protein, 4 aa, Entamoeba dispar
IPQI

SEQ ID NO: 2432087 - protein, 9 aa, Entamoeba dispar
IPQITPDDI

SEQ ID NO: 2432088 - protein, 12 aa, Entamoeba dispar
IPQKRTQQTAID

SEQ ID NO: 2432089 - protein, 4 aa, Entamoeba dispar
IPQL

SEQ ID NO: 2432090 - protein, 11 aa, Entamoeba dispar
IPQLNKEKKYV

SEQ ID NO: 2432091 - protein, 5 aa, Entamoeba dispar
IPQNP

SEQ ID NO: 2432092 - protein, 5 aa, Entamoeba dispar
IPQNT

SEQ ID NO: 2432093 - protein, 11 aa, Entamoeba dispar
IPQPDPKKYSS

SEQ ID NO: 2432094 - protein, 11 aa, Entamoeba dispar
IPQPGSLEGEK

SEQ ID NO: 2432095 - protein, 13 aa, Entamoeba dispar
IPQPPGSPAKKDK

SEQ ID NO: 2432096 - protein, 7 aa, Entamoeba dispar
IPQPPNT

SEQ ID NO: 2432097 - protein, 20 aa, Entamoeba dispar
IPQPQVLPTTSKVNPPIPQP

SEQ ID NO: 2432098 - protein, 5 aa, Entamoeba dispar
IPQPT

SEQ ID NO: 2432099 - protein, 4 aa, Entamoeba dispar
IPQQ

SEQ ID NO: 2432100 - protein, 9 aa, Entamoeba dispar
IPQQPIQNN

SEQ ID NO: 2432101 - protein, 13 aa, Entamoeba dispar
IPQQQTNIRYQPQ

SEQ ID NO: 2432102 - protein, 4 aa, Entamoeba dispar
IPQR

SEQ ID NO: 2432103 - protein, 11 aa, Entamoeba dispar
IPQRGYGYGEG

SEQ ID NO: 2432104 - protein, 17 aa, Entamoeba dispar
IPQSDIETSLQTKKDHP

SEQ ID NO: 2432105 - protein, 7 aa, Entamoeba dispar
IPQSFSQ

SEQ ID NO: 2432106 - protein, 5 aa, Entamoeba dispar
IPQSV

SEQ ID NO: 2432107 - protein, 6 aa, Entamoeba dispar
IPQSVS

SEQ ID NO: 2432108 - protein, 5 aa, Entamoeba dispar
IPQTG

SEQ ID NO: 2432109 - protein, 8 aa, Entamoeba dispar
IPQTKPTN

SEQ ID NO: 2432110 - protein, 8 aa, Entamoeba dispar
IPQYDPNE

SEQ ID NO: 2432111 - protein, 6 aa, Entamoeba dispar
IPRANE

SEQ ID NO: 2432112 - protein, 4 aa, Entamoeba dispar
IPRE

SEQ ID NO: 2432113 - protein, 37 aa, Entamoeba dispar
IPREENSVKKPSLPKELKTNQAGDLKQTTKINKEDSL

SEQ ID NO: 2432114 - protein, 7 aa, Entamoeba dispar
IPRGEQT

SEQ ID NO: 2432115 - protein, 5 aa, Entamoeba dispar
IPRGT

SEQ ID NO: 2432116 - protein, 7 aa, Entamoeba dispar
IPRNSNE

SEQ ID NO: 2432117 - protein, 6 aa, Entamoeba dispar
IPRPAI

SEQ ID NO: 2432118 - protein, 5 aa, Entamoeba dispar
IPRPF

SEQ ID NO: 2432119 - protein, 5 aa, Entamoeba dispar
IPRPS

SEQ ID NO: 2432120 - protein, 15 aa, Entamoeba dispar
IPRPTEENKKPSGLG

SEQ ID NO: 2432121 - protein, 12 aa, Entamoeba dispar
IPRRSGAREAPS

SEQ ID NO: 2432122 - protein, 4 aa, Entamoeba dispar
IPRS

SEQ ID NO: 2432123 - protein, 5 aa, Entamoeba dispar
IPRSG

SEQ ID NO: 2432124 - protein, 5 aa, Entamoeba dispar
IPRSS

SEQ ID NO: 2432125 - protein, 5 aa, Entamoeba dispar
IPRTE

SEQ ID NO: 2432126 - protein, 8 aa, Entamoeba dispar
IPRTNGGT

SEQ ID NO: 2432127 - protein, 9 aa, Entamoeba dispar
IPRVGNKRR

SEQ ID NO: 2432128 - protein, 12 aa, Entamoeba dispar
IPRYGATRISEG

SEQ ID NO: 2432129 - protein, 6 aa, Entamoeba dispar
IPSDEP

SEQ ID NO: 2432130 - protein, 6 aa, Entamoeba dispar
IPSDKL

SEQ ID NO: 2432131 - protein, 5 aa, Entamoeba dispar
IPSDN

SEQ ID NO: 2432132 - protein, 7 aa, Entamoeba dispar
IPSDSVP

SEQ ID NO: 2432133 - protein, 9 aa, Entamoeba dispar
IPSEAQRKQ

SEQ ID NO: 2432134 - protein, 10 aa, Entamoeba dispar
IPSEDKEISK

SEQ ID NO: 2432135 - protein, 6 aa, Entamoeba dispar
IPSELS

SEQ ID NO: 2432136 - protein, 13 aa, Entamoeba dispar
IPSETAKQRVSKN

SEQ ID NO: 2432137 - protein, 4 aa, Entamoeba dispar
IPSG

SEQ ID NO: 2432138 - protein, 10 aa, Entamoeba dispar
IPSGKGKIGD

SEQ ID NO: 2432139 - protein, 11 aa, Entamoeba dispar
IPSGYYRSGDD

SEQ ID NO: 2432140 - protein, 7 aa, Entamoeba dispar
IPSHERP

SEQ ID NO: 2432141 - protein, 4 aa, Entamoeba dispar
IPSI

SEQ ID NO: 2432142 - protein, 17 aa, Entamoeba dispar
IPSIEEDEKNDPQIRSG

SEQ ID NO: 2432143 - protein, 8 aa, Entamoeba dispar
IPSITSNS

SEQ ID NO: 2432144 - protein, 6 aa, Entamoeba dispar
IPSKKL

SEQ ID NO: 2432145 - protein, 12 aa, Entamoeba dispar
IPSKNKEIFPHN

SEQ ID NO: 2432146 - protein, 5 aa, Entamoeba dispar
IPSKY

SEQ ID NO: 2432147 - protein, 4 aa, Entamoeba dispar
IPSL

SEQ ID NO: 2432148 - protein, 7 aa, Entamoeba dispar
IPSMENT

SEQ ID NO: 2432149 - protein, 9 aa, Entamoeba dispar
IPSNETKSK

SEQ ID NO: 2432150 - protein, 17 aa, Entamoeba dispar
IPSNSQIKNKLGQHEDS

SEQ ID NO: 2432151 - protein, 15 aa, Entamoeba dispar
IPSNSQRVQMTSQQP

SEQ ID NO: 2432152 - protein, 5 aa, Entamoeba dispar
IPSNV

SEQ ID NO: 2432153 - protein, 10 aa, Entamoeba dispar
IPSNVKGKEV

SEQ ID NO: 2432154 - protein, 9 aa, Entamoeba dispar
IPSPNFKDT

SEQ ID NO: 2432155 - protein, 12 aa, Entamoeba dispar
IPSPPEHSSPSY

SEQ ID NO: 2432156 - protein, 8 aa, Entamoeba dispar
IPSPTKSS

SEQ ID NO: 2432157 - protein, 5 aa, Entamoeba dispar
IPSQG

SEQ ID NO: 2432158 - protein, 9 aa, Entamoeba dispar
IPSQGDFNG

SEQ ID NO: 2432159 - protein, 24 aa, Entamoeba dispar
IPSQPISKTTSFNVNEQKNKTKND

SEQ ID NO: 2432160 - protein, 14 aa, Entamoeba dispar
IPSRPQPDNYPTFE

SEQ ID NO: 2432161 - protein, 11 aa, Entamoeba dispar
IPSRTKELSDN

SEQ ID NO: 2432162 - protein, 11 aa, Entamoeba dispar
IPSRTKELSGN

SEQ ID NO: 2432163 - protein, 11 aa, Entamoeba dispar
IPSRTKELSSN

SEQ ID NO: 2432164 - protein, 5 aa, Entamoeba dispar
IPSRV

SEQ ID NO: 2432165 - protein, 8 aa, Entamoeba dispar
IPSSINKL

SEQ ID NO: 2432166 - protein, 7 aa, Entamoeba dispar
IPSSISD

SEQ ID NO: 2432167 - protein, 7 aa, Entamoeba dispar
IPSSISE

SEQ ID NO: 2432168 - protein, 10 aa, Entamoeba dispar
IPSSISEINS

SEQ ID NO: 2432169 - protein, 7 aa, Entamoeba dispar
IPSSISG

SEQ ID NO: 2432170 - protein, 12 aa, Entamoeba dispar
IPSSISKIKSST

SEQ ID NO: 2432171 - protein, 8 aa, Entamoeba dispar
IPSSISKL

SEQ ID NO: 2432172 - protein, 8 aa, Entamoeba dispar
IPSSITSI

SEQ ID NO: 2432173 - protein, 5 aa, Entamoeba dispar
IPSSN

SEQ ID NO: 2432174 - protein, 16 aa, Entamoeba dispar
IPSSPIIQTQSDTLDS

SEQ ID NO: 2432175 - protein, 5 aa, Entamoeba dispar
IPSSQ

SEQ ID NO: 2432176 - protein, 7 aa, Entamoeba dispar
IPSSQIP

SEQ ID NO: 2432177 - protein, 26 aa, Entamoeba dispar
IPSSQTKTVTITENTTTAITPDNNIP

SEQ ID NO: 2432178 - protein, 12 aa, Entamoeba dispar
IPSSSQEAERIT

SEQ ID NO: 2432179 - protein, 5 aa, Entamoeba dispar
IPSST

SEQ ID NO: 2432180 - protein, 8 aa, Entamoeba dispar
IPSSVNKI

SEQ ID NO: 2432181 - protein, 8 aa, Entamoeba dispar
IPSSVRKI

SEQ ID NO: 2432182 - protein, 9 aa, Entamoeba dispar
IPSSVSKIS

SEQ ID NO: 2432183 - protein, 10 aa, Entamoeba dispar
IPSSVSKLGN

SEQ ID NO: 2432184 - protein, 7 aa, Entamoeba dispar
IPSSVSQ

SEQ ID NO: 2432185 - protein, 7 aa, Entamoeba dispar
IPSSVSR

SEQ ID NO: 2432186 - protein, 11 aa, Entamoeba dispar
IPSSVSSIGNS

SEQ ID NO: 2432187 - protein, 10 aa, Entamoeba dispar
IPSSVSTLGD

SEQ ID NO: 2432188 - protein, 8 aa, Entamoeba dispar
IPSSVTKI

SEQ ID NO: 2432189 - protein, 13 aa, Entamoeba dispar
IPSSVTSIGNTQF

SEQ ID NO: 2432190 - protein, 9 aa, Entamoeba dispar
IPSSVTSLG

SEQ ID NO: 2432191 - protein, 9 aa, Entamoeba dispar
IPSTDESPQ

SEQ ID NO: 2432192 - protein, 5 aa, Entamoeba dispar
IPSTI

SEQ ID NO: 2432193 - protein, 7 aa, Entamoeba dispar
IPSTISK

SEQ ID NO: 2432194 - protein, 6 aa, Entamoeba dispar
IPSTKI

SEQ ID NO: 2432195 - protein, 9 aa, Entamoeba dispar
IPSTKKEIK

SEQ ID NO: 2432196 - protein, 8 aa, Entamoeba dispar
IPSTVSEL

SEQ ID NO: 2432197 - protein, 11 aa, Entamoeba dispar
IPSTVTEIGKE

SEQ ID NO: 2432198 - protein, 6 aa, Entamoeba dispar
IPTDDI

SEQ ID NO: 2432199 - protein, 27 aa, Entamoeba dispar
IPTDSNVQEIKEEQKIEEDNDKTDEEI

SEQ ID NO: 2432200 - protein, 13 aa, Entamoeba dispar
IPTDVPKKRGRKK

SEQ ID NO: 2432201 - protein, 5 aa, Entamoeba dispar
IPTED

SEQ ID NO: 2432202 - protein, 7 aa, Entamoeba dispar
IPTEKSY

SEQ ID NO: 2432203 - protein, 5 aa, Entamoeba dispar
IPTEY

SEQ ID NO: 2432204 - protein, 6 aa, Entamoeba dispar
IPTFDN

SEQ ID NO: 2432205 - protein, 5 aa, Entamoeba dispar
IPTGI

SEQ ID NO: 2432206 - protein, 9 aa, Entamoeba dispar
IPTGSYQAY

SEQ ID NO: 2432207 - protein, 6 aa, Entamoeba dispar
IPTGVS

SEQ ID NO: 2432208 - protein, 4 aa, Entamoeba dispar
IPTH

SEQ ID NO: 2432209 - protein, 9 aa, Entamoeba dispar
IPTKAGSLK

SEQ ID NO: 2432210 - protein, 5 aa, Entamoeba dispar
IPTKP

SEQ ID NO: 2432211 - protein, 39 aa, Entamoeba dispar
IPTKPSIEQQLKAKEENSIPIEEKKEQLKKEMKQEANTI

SEQ ID NO: 2432212 - protein, 6 aa, Entamoeba dispar
IPTNGL

SEQ ID NO: 2432213 - protein, 5 aa, Entamoeba dispar
IPTNI

SEQ ID NO: 2432214 - protein, 10 aa, Entamoeba dispar
IPTNKQEDQQ

SEQ ID NO: 2432215 - protein, 5 aa, Entamoeba dispar
IPTNV

SEQ ID NO: 2432216 - protein, 5 aa, Entamoeba dispar
IPTPI

SEQ ID NO: 2432217 - protein, 7 aa, Entamoeba dispar
IPTPIKE

SEQ ID NO: 2432218 - protein, 6 aa, Entamoeba dispar
IPTPIS

SEQ ID NO: 2432219 - protein, 12 aa, Entamoeba dispar
IPTPLSNTSTTN

SEQ ID NO: 2432220 - protein, 5 aa, Entamoeba dispar
IPTPN

SEQ ID NO: 2432221 - protein, 8 aa, Entamoeba dispar
IPTQCDSD

SEQ ID NO: 2432222 - protein, 11 aa, Entamoeba dispar
IPTQPTDPSTV

SEQ ID NO: 2432223 - protein, 9 aa, Entamoeba dispar
IPTRDNAKE

SEQ ID NO: 2432224 - protein, 11 aa, Entamoeba dispar
IPTRKTSLSMK

SEQ ID NO: 2432225 - protein, 17 aa, Entamoeba dispar
IPTRQRDFSEDSSINEG

SEQ ID NO: 2432226 - protein, 10 aa, Entamoeba dispar
IPTSNGRTIA

SEQ ID NO: 2432227 - protein, 42 aa, Entamoeba dispar
IPTSTSNQTNQQSVSRNSQPPLSDNATSQPHFQTSSPHSFSP

SEQ ID NO: 2432228 - protein, 9 aa, Entamoeba dispar
IPTSTTSFG

SEQ ID NO: 2432229 - protein, 6 aa, Entamoeba dispar
IPTSVN

SEQ ID NO: 2432230 - protein, 9 aa, Entamoeba dispar
IPTSVNEIG

SEQ ID NO: 2432231 - protein, 9 aa, Entamoeba dispar
IPTSVSEIG

SEQ ID NO: 2432232 - protein, 8 aa, Entamoeba dispar
IPTSVSKI

SEQ ID NO: 2432233 - protein, 11 aa, Entamoeba dispar
IPTSVSKIGDS

SEQ ID NO: 2432234 - protein, 9 aa, Entamoeba dispar
IPTSVSKLG

SEQ ID NO: 2432235 - protein, 7 aa, Entamoeba dispar
IPTTISK

SEQ ID NO: 2432236 - protein, 6 aa, Entamoeba dispar
IPTTKR

SEQ ID NO: 2432237 - protein, 6 aa, Entamoeba dispar
IPTTNS

SEQ ID NO: 2432238 - protein, 10 aa, Entamoeba dispar
IPTTTSEIGN

SEQ ID NO: 2432239 - protein, 6 aa, Entamoeba dispar
IPTTVS

SEQ ID NO: 2432240 - protein, 7 aa, Entamoeba dispar
IPTTVSE

SEQ ID NO: 2432241 - protein, 8 aa, Entamoeba dispar
IPTTVSEL

SEQ ID NO: 2432242 - protein, 6 aa, Entamoeba dispar
IPTTYG

SEQ ID NO: 2432243 - protein, 5 aa, Entamoeba dispar
IPTWE

SEQ ID NO: 2432244 - protein, 6 aa, Entamoeba dispar
IPVEEK

SEQ ID NO: 2432245 - protein, 6 aa, Entamoeba dispar
IPVNTK

SEQ ID NO: 2432246 - protein, 14 aa, Entamoeba dispar
IPVSSDRKPNTQLT

SEQ ID NO: 2432247 - protein, 4 aa, Entamoeba dispar
IPYD

SEQ ID NO: 2432248 - protein, 4 aa, Entamoeba dispar
IPYK

SEQ ID NO: 2432249 - protein, 4 aa, Entamoeba dispar
IPYL

SEQ ID NO: 2432250 - protein, 6 aa, Entamoeba dispar
IPYPKK

SEQ ID NO: 2432251 - protein, 5 aa, Entamoeba dispar
IQAAQ

SEQ ID NO: 2432252 - protein, 8 aa, Entamoeba dispar
IQAKPTDL

SEQ ID NO: 2432253 - protein, 29 aa, Entamoeba dispar
IQASTEKEKYYKEANEKLEKTLKEKEETF

SEQ ID NO: 2432254 - protein, 9 aa, Entamoeba dispar
IQATDAGEL

SEQ ID NO: 2432255 - protein, 8 aa, Entamoeba dispar
IQDASDLL

SEQ ID NO: 2432256 - protein, 7 aa, Entamoeba dispar
IQDEPEI

SEQ ID NO: 2432257 - protein, 11 aa, Entamoeba dispar
IQDEPKSQEII

SEQ ID NO: 2432258 - protein, 8 aa, Entamoeba dispar
IQDGTTKK

SEQ ID NO: 2432259 - protein, 14 aa, Entamoeba dispar
IQDKEKGQNRKTKC

SEQ ID NO: 2432260 - protein, 5 aa, Entamoeba dispar
IQDKR

SEQ ID NO: 2432261 - protein, 7 aa, Entamoeba dispar
IQDNQSE

SEQ ID NO: 2432262 - protein, 6 aa, Entamoeba dispar
IQDSGE

SEQ ID NO: 2432263 - protein, 8 aa, Entamoeba dispar
IQDSNGKI

SEQ ID NO: 2432264 - protein, 17 aa, Entamoeba dispar
IQDSTNESKNTTNYSQS

SEQ ID NO: 2432265 - protein, 24 aa, Entamoeba dispar
IQEAQTDSSQIKSQDYNTTNNEPI

SEQ ID NO: 2432266 - protein, 5 aa, Entamoeba dispar
IQEDE

SEQ ID NO: 2432267 - protein, 12 aa, Entamoeba dispar
IQEDNSSGKQEI

SEQ ID NO: 2432268 - protein, 30 aa, Entamoeba dispar
IQEEEIKKEEEIEKQEEEKKKKENEHRNYP

SEQ ID NO: 2432269 - protein, 28 aa, Entamoeba dispar
IQEEEQKKQIQQEKQITPKEENKPSQNV

SEQ ID NO: 2432270 - protein, 50 aa, Entamoeba dispar
IQEEEVKEEVVEQPKEVKEEEVKKEESINEIEEKVKEEESPKVEEKVTNK

SEQ ID NO: 2432271 - protein, 8 aa, Entamoeba dispar
IQEEKEKM

SEQ ID NO: 2432272 - protein, 11 aa, Entamoeba dispar
IQEEKESYLKQ

SEQ ID NO: 2432273 - protein, 6 aa, Entamoeba dispar
IQEERK

SEQ ID NO: 2432274 - protein, 29 aa, Entamoeba dispar
IQEESKDDKINQNKENNCTVEEDENTDDD

SEQ ID NO: 2432275 - protein, 4 aa, Entamoeba dispar
IQEG

SEQ ID NO: 2432276 - protein, 11 aa, Entamoeba dispar
IQEGKPKEENI

SEQ ID NO: 2432277 - protein, 21 aa, Entamoeba dispar
IQEGSSSTKRRTLPNNGTKPL

SEQ ID NO: 2432278 - protein, 9 aa, Entamoeba dispar
IQEKEQGNI

SEQ ID NO: 2432279 - protein, 9 aa, Entamoeba dispar
IQENGNNIE

SEQ ID NO: 2432280 - protein, 5 aa, Entamoeba dispar
IQENK

SEQ ID NO: 2432281 - protein, 7 aa, Entamoeba dispar
IQENPLD

SEQ ID NO: 2432282 - protein, 37 aa, Entamoeba dispar
IQENTTTKKPSTPKEVNTSDGKKPLVAKGEDTTTKNL

SEQ ID NO: 2432283 - protein, 17 aa, Entamoeba dispar
IQEPPNSVSAGNVPRTK

SEQ ID NO: 2432284 - protein, 4 aa, Entamoeba dispar
IQEQ

SEQ ID NO: 2432285 - protein, 5 aa, Entamoeba dispar
IQEQK

SEQ ID NO: 2432286 - protein, 7 aa, Entamoeba dispar
IQEQRLA

SEQ ID NO: 2432287 - protein, 4 aa, Entamoeba dispar
IQER

SEQ ID NO: 2432288 - protein, 7 aa, Entamoeba dispar
IQERKKE

SEQ ID NO: 2432289 - protein, 8 aa, Entamoeba dispar
IQERYPTF

SEQ ID NO: 2432290 - protein, 8 aa, Entamoeba dispar
IQETDGYG

SEQ ID NO: 2432291 - protein, 26 aa, Entamoeba dispar
IQETVDSEESTEEEETNEQKHRSSQE

SEQ ID NO: 2432292 - protein, 8 aa, Entamoeba dispar
IQEYPEQL

SEQ ID NO: 2432293 - protein, 11 aa, Entamoeba dispar
IQFTGSSLEDS

SEQ ID NO: 2432294 - protein, 10 aa, Entamoeba dispar
IQGDEELPPI

SEQ ID NO: 2432295 - protein, 25 aa, Entamoeba dispar
IQGEPDGSSFPNGGLRNTSQARGYS

SEQ ID NO: 2432296 - protein, 7 aa, Entamoeba dispar
IQGEPIK

SEQ ID NO: 2432297 - protein, 10 aa, Entamoeba dispar
IQGNKEIEVR

SEQ ID NO: 2432298 - protein, 9 aa, Entamoeba dispar
IQGNKNALN

SEQ ID NO: 2432299 - protein, 4 aa, Entamoeba dispar
IQGQ

SEQ ID NO: 2432300 - protein, 16 aa, Entamoeba dispar
IQGRHQTFSYIKQYFP

SEQ ID NO: 2432301 - protein, 11 aa, Entamoeba dispar
IQGTNSLPDIP

SEQ ID NO: 2432302 - protein, 5 aa, Entamoeba dispar
IQGTP

SEQ ID NO: 2432303 - protein, 4 aa, Entamoeba dispar
IQHE

SEQ ID NO: 2432304 - protein, 21 aa, Entamoeba dispar
IQHEQETTESFGLETSQEGEF

SEQ ID NO: 2432305 - protein, 4 aa, Entamoeba dispar
IQHT

SEQ ID NO: 2432306 - protein, 13 aa, Entamoeba dispar
IQIESKELDYISQ

SEQ ID NO: 2432307 - protein, 6 aa, Entamoeba dispar
IQISGN

SEQ ID NO: 2432308 - protein, 9 aa, Entamoeba dispar
IQKDEPGLK

SEQ ID NO: 2432309 - protein, 7 aa, Entamoeba dispar
IQKDSRQ

SEQ ID NO: 2432310 - protein, 10 aa, Entamoeba dispar
IQKEEAEGCE

SEQ ID NO: 2432311 - protein, 23 aa, Entamoeba dispar
IQKEEDKKKINELSTQREEDKKK

SEQ ID NO: 2432312 - protein, 19 aa, Entamoeba dispar
IQKEIEEAKKKGKTNPYPF

SEQ ID NO: 2432313 - protein, 13 aa, Entamoeba dispar
IQKENEEIKKQNE

SEQ ID NO: 2432314 - protein, 12 aa, Entamoeba dispar
IQKETKRNTQHN

SEQ ID NO: 2432315 - protein, 36 aa, Entamoeba dispar
IQKGKKLNKCETIDKSKPMIEQPKGGMGGGMPMGGN

SEQ ID NO: 2432316 - protein, 21 aa, Entamoeba dispar
IQKIEDKKKDLEKKAAQGTGV

SEQ ID NO: 2432317 - protein, 10 aa, Entamoeba dispar
IQKKAEESNM

SEQ ID NO: 2432318 - protein, 12 aa, Entamoeba dispar
IQKKEDQSTLRT

SEQ ID NO: 2432319 - protein, 15 aa, Entamoeba dispar
IQKKEETISTTDNLS

SEQ ID NO: 2432320 - protein, 7 aa, Entamoeba dispar
IQKKERV

SEQ ID NO: 2432321 - protein, 12 aa, Entamoeba dispar
IQKKRENNMEKR

SEQ ID NO: 2432322 - protein, 10 aa, Entamoeba dispar
IQKPKQTTGI

SEQ ID NO: 2432323 - protein, 13 aa, Entamoeba dispar
IQKQKNKKVSQRV

SEQ ID NO: 2432324 - protein, 8 aa, Entamoeba dispar
IQKQKNYK

SEQ ID NO: 2432325 - protein, 7 aa, Entamoeba dispar
IQKREGF

SEQ ID NO: 2432326 - protein, 21 aa, Entamoeba dispar
IQKRKKEHIENNNTNNNNNEE

SEQ ID NO: 2432327 - protein, 5 aa, Entamoeba dispar
IQKSH

SEQ ID NO: 2432328 - protein, 9 aa, Entamoeba dispar
IQKSSPNEN

SEQ ID NO: 2432329 - protein, 4 aa, Entamoeba dispar
IQLS

SEQ ID NO: 2432330 - protein, 12 aa, Entamoeba dispar
IQLSRDNKKSIQ

SEQ ID NO: 2432331 - protein, 21 aa, Entamoeba dispar
IQLSRDNKKSIQSCPEKETSF

SEQ ID NO: 2432332 - protein, 9 aa, Entamoeba dispar
IQNAQTKKY

SEQ ID NO: 2432333 - protein, 5 aa, Entamoeba dispar
IQNDE

SEQ ID NO: 2432334 - protein, 5 aa, Entamoeba dispar
IQNDN

SEQ ID NO: 2432335 - protein, 25 aa, Entamoeba dispar
IQNEPKEEVNQPLTNEEQPKQEEKK

SEQ ID NO: 2432336 - protein, 5 aa, Entamoeba dispar
IQNES

SEQ ID NO: 2432337 - protein, 6 aa, Entamoeba dispar
IQNGNH

SEQ ID NO: 2432338 - protein, 18 aa, Entamoeba dispar
IQNIKEEKRKRDEETSRL

SEQ ID NO: 2432339 - protein, 8 aa, Entamoeba dispar
IQNKTRDN

SEQ ID NO: 2432340 - protein, 7 aa, Entamoeba dispar
IQNNETE

SEQ ID NO: 2432341 - protein, 9 aa, Entamoeba dispar
IQNNPKESD

SEQ ID NO: 2432342 - protein, 6 aa, Entamoeba dispar
IQNPPT

SEQ ID NO: 2432343 - protein, 11 aa, Entamoeba dispar
IQNPPTGLSAN

SEQ ID NO: 2432344 - protein, 9 aa, Entamoeba dispar
IQNPVNSTQ

SEQ ID NO: 2432345 - protein, 10 aa, Entamoeba dispar
IQNQTKQEKA

SEQ ID NO: 2432346 - protein, 10 aa, Entamoeba dispar
IQNSPPFQTE

SEQ ID NO: 2432347 - protein, 10 aa, Entamoeba dispar
IQNSPRSFVK

SEQ ID NO: 2432348 - protein, 7 aa, Entamoeba dispar
IQNSRAQ

SEQ ID NO: 2432349 - protein, 8 aa, Entamoeba dispar
IQNTPPSS

SEQ ID NO: 2432350 - protein, 11 aa, Entamoeba dispar
IQNTQEQPYVP

SEQ ID NO: 2432351 - protein, 10 aa, Entamoeba dispar
IQNTTQDTTI

SEQ ID NO: 2432352 - protein, 18 aa, Entamoeba dispar
IQPANSDKKTNVNDDDWG

SEQ ID NO: 2432353 - protein, 5 aa, Entamoeba dispar
IQPAR

SEQ ID NO: 2432354 - protein, 33 aa, Entamoeba dispar
IQPASTSKPSEQADLKKGGSDGKKGGKKGFCSL

SEQ ID NO: 2432355 - protein, 26 aa, Entamoeba dispar
IQPDGTAIGNTNEKRSVITSEGDTAY

SEQ ID NO: 2432356 - protein, 4 aa, Entamoeba dispar
IQPF

SEQ ID NO: 2432357 - protein, 5 aa, Entamoeba dispar
IQPGK

SEQ ID NO: 2432358 - protein, 4 aa, Entamoeba dispar
IQPH

SEQ ID NO: 2432359 - protein, 12 aa, Entamoeba dispar
IQPHEPNSNEVS

SEQ ID NO: 2432360 - protein, 4 aa, Entamoeba dispar
IQPI

SEQ ID NO: 2432361 - protein, 8 aa, Entamoeba dispar
IQPKKGSM

SEQ ID NO: 2432362 - protein, 6 aa, Entamoeba dispar
IQPKPK

SEQ ID NO: 2432363 - protein, 5 aa, Entamoeba dispar
IQPKQ

SEQ ID NO: 2432364 - protein, 10 aa, Entamoeba dispar
IQPKSVEQVE

SEQ ID NO: 2432365 - protein, 7 aa, Entamoeba dispar
IQPNDND

SEQ ID NO: 2432366 - protein, 7 aa, Entamoeba dispar
IQPNRSV

SEQ ID NO: 2432367 - protein, 6 aa, Entamoeba dispar
IQPPKE

SEQ ID NO: 2432368 - protein, 14 aa, Entamoeba dispar
IQPPNNHSSPSVPQ

SEQ ID NO: 2432369 - protein, 6 aa, Entamoeba dispar
IQPPQT

SEQ ID NO: 2432370 - protein, 52 aa, Entamoeba dispar
IQPPQTIKKDESVIQNNNIQTNPFLDPSSNQEVTNTTPSLPRQKNKVETNPF

SEQ ID NO: 2432371 - protein, 12 aa, Entamoeba dispar
IQPPSDSNIERS

SEQ ID NO: 2432372 - protein, 9 aa, Entamoeba dispar
IQPPSPEMA

SEQ ID NO: 2432373 - protein, 6 aa, Entamoeba dispar
IQPPTE

SEQ ID NO: 2432374 - protein, 6 aa, Entamoeba dispar
IQPPTI

SEQ ID NO: 2432375 - protein, 9 aa, Entamoeba dispar
IQPQDSIGS

SEQ ID NO: 2432376 - protein, 7 aa, Entamoeba dispar
IQPQQQA

SEQ ID NO: 2432377 - protein, 6 aa, Entamoeba dispar
IQPSGF

SEQ ID NO: 2432378 - protein, 6 aa, Entamoeba dispar
IQPSKN

SEQ ID NO: 2432379 - protein, 7 aa, Entamoeba dispar
IQPSPSW

SEQ ID NO: 2432380 - protein, 10 aa, Entamoeba dispar
IQPSSTYKPQ

SEQ ID NO: 2432381 - protein, 5 aa, Entamoeba dispar
IQPTN

SEQ ID NO: 2432382 - protein, 6 aa, Entamoeba dispar
IQPTST

SEQ ID NO: 2432383 - protein, 20 aa, Entamoeba dispar
IQPTTSKEESSWQQNSWDFS

SEQ ID NO: 2432384 - protein, 16 aa, Entamoeba dispar
IQQDNISTPKPDSLTI

SEQ ID NO: 2432385 - protein, 19 aa, Entamoeba dispar
IQQEKPSRTLPLKKGDTVR

SEQ ID NO: 2432386 - protein, 21 aa, Entamoeba dispar
IQQEYQRKSEDEEKRKSEEAR

SEQ ID NO: 2432387 - protein, 7 aa, Entamoeba dispar
IQQGQKE

SEQ ID NO: 2432388 - protein, 5 aa, Entamoeba dispar
IQQKE

SEQ ID NO: 2432389 - protein, 15 aa, Entamoeba dispar
IQQKGNETQTEVSTL

SEQ ID NO: 2432390 - protein, 16 aa, Entamoeba dispar
IQQNEHQQKQLSQDPI

SEQ ID NO: 2432391 - protein, 9 aa, Entamoeba dispar
IQQNKSKGY

SEQ ID NO: 2432392 - protein, 6 aa, Entamoeba dispar
IQQNSS

SEQ ID NO: 2432393 - protein, 8 aa, Entamoeba dispar
IQQPQIGQ

SEQ ID NO: 2432394 - protein, 15 aa, Entamoeba dispar
IQQPTLQTQNRTQPV

SEQ ID NO: 2432395 - protein, 4 aa, Entamoeba dispar
IQQQ

SEQ ID NO: 2432396 - protein, 12 aa, Entamoeba dispar
IQQQNQNNTYSQ

SEQ ID NO: 2432397 - protein, 8 aa, Entamoeba dispar
IQQQPPQI

SEQ ID NO: 2432398 - protein, 12 aa, Entamoeba dispar
IQQQPQQNQFPT

SEQ ID NO: 2432399 - protein, 9 aa, Entamoeba dispar
IQQQPQQQI

SEQ ID NO: 2432400 - protein, 6 aa, Entamoeba dispar
IQQRYD

SEQ ID NO: 2432401 - protein, 5 aa, Entamoeba dispar
IQQSI

SEQ ID NO: 2432402 - protein, 9 aa, Entamoeba dispar
IQQSNGDGI

SEQ ID NO: 2432403 - protein, 10 aa, Entamoeba dispar
IQQSTDERLE

SEQ ID NO: 2432404 - protein, 7 aa, Entamoeba dispar
IQQSTSH

SEQ ID NO: 2432405 - protein, 26 aa, Entamoeba dispar
IQQTEEIKQEETYPNDLEPLKDTKVN

SEQ ID NO: 2432406 - protein, 17 aa, Entamoeba dispar
IQQTSEGITLNDNTSQV

SEQ ID NO: 2432407 - protein, 26 aa, Entamoeba dispar
IQRANEEKIRNLNTTTEQIKKEIDEL

SEQ ID NO: 2432408 - protein, 8 aa, Entamoeba dispar
IQRDGDSS

SEQ ID NO: 2432409 - protein, 25 aa, Entamoeba dispar
IQRDTNEEDGAELEEGIKEQKRIES

SEQ ID NO: 2432410 - protein, 9 aa, Entamoeba dispar
IQREKDLTK

SEQ ID NO: 2432411 - protein, 35 aa, Entamoeba dispar
IQRGKKLKKTIVNDRSKPMVSKEQQNSTTSHYPTN

SEQ ID NO: 2432412 - protein, 40 aa, Entamoeba dispar
IQRGTKLKKTTTVDKSAPAIGKSSSSSSSGMGGGMPMGGN

SEQ ID NO: 2432413 - protein, 4 aa, Entamoeba dispar
IQRI

SEQ ID NO: 2432414 - protein, 15 aa, Entamoeba dispar
IQRNEKNMNESIEEL

SEQ ID NO: 2432415 - protein, 6 aa, Entamoeba dispar
IQRQKA

SEQ ID NO: 2432416 - protein, 5 aa, Entamoeba dispar
IQRRA

SEQ ID NO: 2432417 - protein, 11 aa, Entamoeba dispar
IQRSQSPSLSF

SEQ ID NO: 2432418 - protein, 7 aa, Entamoeba dispar
IQRTQTA

SEQ ID NO: 2432419 - protein, 9 aa, Entamoeba dispar
IQSAQRTKG

SEQ ID NO: 2432420 - protein, 19 aa, Entamoeba dispar
IQSDGTAIANTNEKRSVIT

SEQ ID NO: 2432421 - protein, 6 aa, Entamoeba dispar
IQSDRL

SEQ ID NO: 2432422 - protein, 10 aa, Entamoeba dispar
IQSEESEVVH

SEQ ID NO: 2432423 - protein, 39 aa, Entamoeba dispar
IQSEGINDNTNNETSPITHSNKIQNNSSFHSEENEISNS

SEQ ID NO: 2432424 - protein, 6 aa, Entamoeba dispar
IQSENE

SEQ ID NO: 2432425 - protein, 5 aa, Entamoeba dispar
IQSKE

SEQ ID NO: 2432426 - protein, 8 aa, Entamoeba dispar
IQSKSKND

SEQ ID NO: 2432427 - protein, 30 aa, Entamoeba dispar
IQSKSPRSKPTSSNPFIDSEPSLENNNPFL

SEQ ID NO: 2432428 - protein, 6 aa, Entamoeba dispar
IQSKTI

SEQ ID NO: 2432429 - protein, 4 aa, Entamoeba dispar
IQSL

SEQ ID NO: 2432430 - protein, 9 aa, Entamoeba dispar
IQSNESTSH

SEQ ID NO: 2432431 - protein, 8 aa, Entamoeba dispar
IQSNNIDN

SEQ ID NO: 2432432 - protein, 6 aa, Entamoeba dispar
IQSPEY

SEQ ID NO: 2432433 - protein, 5 aa, Entamoeba dispar
IQSPF

SEQ ID NO: 2432434 - protein, 16 aa, Entamoeba dispar
IQSQKTSKSERFYFNY

SEQ ID NO: 2432435 - protein, 8 aa, Entamoeba dispar
IQSREKEI

SEQ ID NO: 2432436 - protein, 6 aa, Entamoeba dispar
IQSSLT

SEQ ID NO: 2432437 - protein, 6 aa, Entamoeba dispar
IQSSPE

SEQ ID NO: 2432438 - protein, 9 aa, Entamoeba dispar
IQSSQEDEF

SEQ ID NO: 2432439 - protein, 9 aa, Entamoeba dispar
IQSSSEDVD

SEQ ID NO: 2432440 - protein, 6 aa, Entamoeba dispar
IQSSYK

SEQ ID NO: 2432441 - protein, 7 aa, Entamoeba dispar
IQSTNTD

SEQ ID NO: 2432442 - protein, 8 aa, Entamoeba dispar
IQSTPSPI

SEQ ID NO: 2432443 - protein, 32 aa, Entamoeba dispar
IQSTPVNNIPSKLSSTSTLKGNGTLPTRSSVA

SEQ ID NO: 2432444 - protein, 11 aa, Entamoeba dispar
IQSTYGDEEKA

SEQ ID NO: 2432445 - protein, 8 aa, Entamoeba dispar
IQSVDTNK

SEQ ID NO: 2432446 - protein, 4 aa, Entamoeba dispar
IQTK

SEQ ID NO: 2432447 - protein, 6 aa, Entamoeba dispar
IQTKAI

SEQ ID NO: 2432448 - protein, 11 aa, Entamoeba dispar
IQTKEEEPKEI

SEQ ID NO: 2432449 - protein, 15 aa, Entamoeba dispar
IQTKGRVAAELSAGN

SEQ ID NO: 2432450 - protein, 6 aa, Entamoeba dispar
IQTKKY

SEQ ID NO: 2432451 - protein, 10 aa, Entamoeba dispar
IQTKNGNKEI

SEQ ID NO: 2432452 - protein, 10 aa, Entamoeba dispar
IQTKSENEVI

SEQ ID NO: 2432453 - protein, 4 aa, Entamoeba dispar
IQTL

SEQ ID NO: 2432454 - protein, 4 aa, Entamoeba dispar
IQTN

SEQ ID NO: 2432455 - protein, 10 aa, Entamoeba dispar
IQTNESEVGQ

SEQ ID NO: 2432456 - protein, 35 aa, Entamoeba dispar
IQTNPSITQQPQGNNSSTQSYLSNTNTSSSQVNGM

SEQ ID NO: 2432457 - protein, 5 aa, Entamoeba dispar
IQTPF

SEQ ID NO: 2432458 - protein, 5 aa, Entamoeba dispar
IQTPK

SEQ ID NO: 2432459 - protein, 9 aa, Entamoeba dispar
IQTPSDIDT

SEQ ID NO: 2432460 - protein, 10 aa, Entamoeba dispar
IQTPTGEEAR

SEQ ID NO: 2432461 - protein, 8 aa, Entamoeba dispar
IQTSDECE

SEQ ID NO: 2432462 - protein, 5 aa, Entamoeba dispar
IQTSF

SEQ ID NO: 2432463 - protein, 8 aa, Entamoeba dispar
IQTSQDEF

SEQ ID NO: 2432464 - protein, 8 aa, Entamoeba dispar
IQYAGDAS

SEQ ID NO: 2432465 - protein, 6 aa, Entamoeba dispar
IQYNED

SEQ ID NO: 2432466 - protein, 8 aa, Entamoeba dispar
IQYPPSDC

SEQ ID NO: 2432467 - protein, 4 aa, Entamoeba dispar
IQYQ

SEQ ID NO: 2432468 - protein, 11 aa, Entamoeba dispar
IQYQGSIPDGV

SEQ ID NO: 2432469 - protein, 4 aa, Entamoeba dispar
IRAP

SEQ ID NO: 2432470 - protein, 4 aa, Entamoeba dispar
IRAV

SEQ ID NO: 2432471 - protein, 10 aa, Entamoeba dispar
IRDDPEQVKR

SEQ ID NO: 2432472 - protein, 8 aa, Entamoeba dispar
IRDEQKQI

SEQ ID NO: 2432473 - protein, 5 aa, Entamoeba dispar
IRDGG

SEQ ID NO: 2432474 - protein, 32 aa, Entamoeba dispar
IRDPKKANKSKPIGESEDAEIKEEDDDDEVGG

SEQ ID NO: 2432475 - protein, 7 aa, Entamoeba dispar
IRDPTGS

SEQ ID NO: 2432476 - protein, 6 aa, Entamoeba dispar
IRDSSQ

SEQ ID NO: 2432477 - protein, 4 aa, Entamoeba dispar
IRDT

SEQ ID NO: 2432478 - protein, 10 aa, Entamoeba dispar
IRDTNKYGEF

SEQ ID NO: 2432479 - protein, 20 aa, Entamoeba dispar
IREAERETRMAQSKKRDAEN

SEQ ID NO: 2432480 - protein, 12 aa, Entamoeba dispar
IREDSSDDDASI

SEQ ID NO: 2432481 - protein, 37 aa, Entamoeba dispar
IREEEKRKKELKKALKKEKREEKKRKKEFGDLTSEIS

SEQ ID NO: 2432482 - protein, 63 aa, Entamoeba dispar
IREEESKKRESVNPTSNNTKIVETTNEEPQSSASSDKPKDTKVKEETKKEITPPARKKRPPPL

SEQ ID NO: 2432483 - protein, 22 aa, Entamoeba dispar
IREENKKEINLKPTSKKNTFSL

SEQ ID NO: 2432484 - protein, 5 aa, Entamoeba dispar
IREKT

SEQ ID NO: 2432485 - protein, 6 aa, Entamoeba dispar
IRERED

SEQ ID NO: 2432486 - protein, 6 aa, Entamoeba dispar
IRERNA

SEQ ID NO: 2432487 - protein, 11 aa, Entamoeba dispar
IRERNEINTSI

SEQ ID NO: 2432488 - protein, 6 aa, Entamoeba dispar
IRESNL

SEQ ID NO: 2432489 - protein, 10 aa, Entamoeba dispar
IRETKETKGL

SEQ ID NO: 2432490 - protein, 7 aa, Entamoeba dispar
IRETPLE

SEQ ID NO: 2432491 - protein, 9 aa, Entamoeba dispar
IRETSELAK

SEQ ID NO: 2432492 - protein, 13 aa, Entamoeba dispar
IRGDDGKILPSGY

SEQ ID NO: 2432493 - protein, 6 aa, Entamoeba dispar
IRGDGE

SEQ ID NO: 2432494 - protein, 10 aa, Entamoeba dispar
IRGGANEGST

SEQ ID NO: 2432495 - protein, 9 aa, Entamoeba dispar
IRGGNAPNV

SEQ ID NO: 2432496 - protein, 6 aa, Entamoeba dispar
IRGSEQ

SEQ ID NO: 2432497 - protein, 9 aa, Entamoeba dispar
IRGSPLSED

SEQ ID NO: 2432498 - protein, 12 aa, Entamoeba dispar
IRGTPGYCSPES

SEQ ID NO: 2432499 - protein, 8 aa, Entamoeba dispar
IRGYSGEL

SEQ ID NO: 2432500 - protein, 9 aa, Entamoeba dispar
IRKDPEPTV

SEQ ID NO: 2432501 - protein, 6 aa, Entamoeba dispar
IRKGEY

SEQ ID NO: 2432502 - protein, 45 aa, Entamoeba dispar
IRKGNNPQKPKKKFQPPYKKDNTQENKEKQTKVNKQKKGDETEDW

SEQ ID NO: 2432503 - protein, 14 aa, Entamoeba dispar
IRKKDYTELAKNDQ

SEQ ID NO: 2432504 - protein, 8 aa, Entamoeba dispar
IRKLPTEI

SEQ ID NO: 2432505 - protein, 10 aa, Entamoeba dispar
IRKQSEERNK

SEQ ID NO: 2432506 - protein, 5 aa, Entamoeba dispar
IRKRN

SEQ ID NO: 2432507 - protein, 8 aa, Entamoeba dispar
IRKSSKQL

SEQ ID NO: 2432508 - protein, 30 aa, Entamoeba dispar
IRKSTTGKDEEENTKPTTDISLSSKESQQL

SEQ ID NO: 2432509 - protein, 18 aa, Entamoeba dispar
IRKTLSRKQEDADDTEEI

SEQ ID NO: 2432510 - protein, 8 aa, Entamoeba dispar
IRKYTNST

SEQ ID NO: 2432511 - protein, 4 aa, Entamoeba dispar
IRLT

SEQ ID NO: 2432512 - protein, 8 aa, Entamoeba dispar
IRNDTQQE

SEQ ID NO: 2432513 - protein, 18 aa, Entamoeba dispar
IRNEKKKEGGEKSYVKTT

SEQ ID NO: 2432514 - protein, 10 aa, Entamoeba dispar
IRNERNQPQM

SEQ ID NO: 2432515 - protein, 48 aa, Entamoeba dispar
IRNGQKGVEEETVPKSKGVKEENDTIQNKPKKMEEEENDTSTKQIEEE

SEQ ID NO: 2432516 - protein, 5 aa, Entamoeba dispar
IRNGY

SEQ ID NO: 2432517 - protein, 6 aa, Entamoeba dispar
IRNKEQ

SEQ ID NO: 2432518 - protein, 12 aa, Entamoeba dispar
IRNKKRSIETQD

SEQ ID NO: 2432519 - protein, 7 aa, Entamoeba dispar
IRNPGDC

SEQ ID NO: 2432520 - protein, 20 aa, Entamoeba dispar
IRNQAYKEGSKDNICVVVVD

SEQ ID NO: 2432521 - protein, 4 aa, Entamoeba dispar
IRPD

SEQ ID NO: 2432522 - protein, 5 aa, Entamoeba dispar
IRPDG

SEQ ID NO: 2432523 - protein, 6 aa, Entamoeba dispar
IRPDRQ

SEQ ID NO: 2432524 - protein, 15 aa, Entamoeba dispar
IRPNRKTGRQAPTKN

SEQ ID NO: 2432525 - protein, 5 aa, Entamoeba dispar
IRPRA

SEQ ID NO: 2432526 - protein, 5 aa, Entamoeba dispar
IRPRL

SEQ ID NO: 2432527 - protein, 4 aa, Entamoeba dispar
IRPS

SEQ ID NO: 2432528 - protein, 10 aa, Entamoeba dispar
IRPSVSQDDL

SEQ ID NO: 2432529 - protein, 15 aa, Entamoeba dispar
IRPTQGDDENKNGGR

SEQ ID NO: 2432530 - protein, 9 aa, Entamoeba dispar
IRQDPTRAK

SEQ ID NO: 2432531 - protein, 10 aa, Entamoeba dispar
IRQEKGNVSI

SEQ ID NO: 2432532 - protein, 10 aa, Entamoeba dispar
IRQKESTESK

SEQ ID NO: 2432533 - protein, 12 aa, Entamoeba dispar
IRQSENVKSNKV

SEQ ID NO: 2432534 - protein, 9 aa, Entamoeba dispar
IRQSKDPQG

SEQ ID NO: 2432535 - protein, 9 aa, Entamoeba dispar
IRQTPNKKH

SEQ ID NO: 2432536 - protein, 11 aa, Entamoeba dispar
IRQTRRHKDIN

SEQ ID NO: 2432537 - protein, 5 aa, Entamoeba dispar
IRREH

SEQ ID NO: 2432538 - protein, 23 aa, Entamoeba dispar
IRRKQREDEGISSSEEEEMERDT

SEQ ID NO: 2432539 - protein, 27 aa, Entamoeba dispar
IRRRKGSFSRPHEDGTTKMKTGDVNTG

SEQ ID NO: 2432540 - protein, 6 aa, Entamoeba dispar
IRRTKL

SEQ ID NO: 2432541 - protein, 8 aa, Entamoeba dispar
IRRTRDSS

SEQ ID NO: 2432542 - protein, 12 aa, Entamoeba dispar
IRSEPSDISSSI

SEQ ID NO: 2432543 - protein, 6 aa, Entamoeba dispar
IRSEVP

SEQ ID NO: 2432544 - protein, 5 aa, Entamoeba dispar
IRSGG

SEQ ID NO: 2432545 - protein, 7 aa, Entamoeba dispar
IRSGTNE

SEQ ID NO: 2432546 - protein, 12 aa, Entamoeba dispar
IRSKDQDTIKKE

SEQ ID NO: 2432547 - protein, 10 aa, Entamoeba dispar
IRSKRSKENN

SEQ ID NO: 2432548 - protein, 5 aa, Entamoeba dispar
IRSLG

SEQ ID NO: 2432549 - protein, 4 aa, Entamoeba dispar
IRSN

SEQ ID NO: 2432550 - protein, 12 aa, Entamoeba dispar
IRSNNQSELNDD

SEQ ID NO: 2432551 - protein, 32 aa, Entamoeba dispar
IRSQNNPSDNVISSTPSFQRKSPKKTRWRKSL

SEQ ID NO: 2432552 - protein, 32 aa, Entamoeba dispar
IRSQSNPSDNVISSTSSFQRKSPKKTRWRKSL

SEQ ID NO: 2432553 - protein, 21 aa, Entamoeba dispar
IRSQSQNDEITKLTDTKGNKE

SEQ ID NO: 2432554 - protein, 7 aa, Entamoeba dispar
IRSSKEI

SEQ ID NO: 2432555 - protein, 9 aa, Entamoeba dispar
IRSSTGQIN

SEQ ID NO: 2432556 - protein, 16 aa, Entamoeba dispar
IRSTDESIDSLKSSDE

SEQ ID NO: 2432557 - protein, 5 aa, Entamoeba dispar
IRSYS

SEQ ID NO: 2432558 - protein, 6 aa, Entamoeba dispar
IRTEQL

SEQ ID NO: 2432559 - protein, 5 aa, Entamoeba dispar
IRTKS

SEQ ID NO: 2432560 - protein, 12 aa, Entamoeba dispar
IRTNEKELYKRS

SEQ ID NO: 2432561 - protein, 6 aa, Entamoeba dispar
IRTPDN

SEQ ID NO: 2432562 - protein, 7 aa, Entamoeba dispar
IRTPKSS

SEQ ID NO: 2432563 - protein, 9 aa, Entamoeba dispar
IRTQNSGLR

SEQ ID NO: 2432564 - protein, 24 aa, Entamoeba dispar
IRTSGGYGITKSYAEEQKRSVSER

SEQ ID NO: 2432565 - protein, 8 aa, Entamoeba dispar
IRTSNNVD

SEQ ID NO: 2432566 - protein, 6 aa, Entamoeba dispar
IRTTLT

SEQ ID NO: 2432567 - protein, 10 aa, Entamoeba dispar
IRYSSNDQVE

SEQ ID NO: 2432568 - protein, 6 aa, Entamoeba dispar
ISADDV

SEQ ID NO: 2432569 - protein, 13 aa, Entamoeba dispar
ISAGSTSVGIKAK

SEQ ID NO: 2432570 - protein, 4 aa, Entamoeba dispar
ISAK

SEQ ID NO: 2432571 - protein, 13 aa, Entamoeba dispar
ISAQDLDGAIAGS

SEQ ID NO: 2432572 - protein, 9 aa, Entamoeba dispar
ISASPDATP

SEQ ID NO: 2432573 - protein, 4 aa, Entamoeba dispar
ISAT

SEQ ID NO: 2432574 - protein, 8 aa, Entamoeba dispar
ISCNPKED

SEQ ID NO: 2432575 - protein, 4 aa, Entamoeba dispar
ISDA

SEQ ID NO: 2432576 - protein, 5 aa, Entamoeba dispar
ISDAE

SEQ ID NO: 2432577 - protein, 14 aa, Entamoeba dispar
ISDAKADKLLAESS

SEQ ID NO: 2432578 - protein, 9 aa, Entamoeba dispar
ISDDKSNQI

SEQ ID NO: 2432579 - protein, 17 aa, Entamoeba dispar
ISDDPELQVSNPSIGLE

SEQ ID NO: 2432580 - protein, 7 aa, Entamoeba dispar
ISDDTEI

SEQ ID NO: 2432581 - protein, 11 aa, Entamoeba dispar
ISDEQKLKDEI

SEQ ID NO: 2432582 - protein, 7 aa, Entamoeba dispar
ISDEQQV

SEQ ID NO: 2432583 - protein, 6 aa, Entamoeba dispar
ISDGKS

SEQ ID NO: 2432584 - protein, 22 aa, Entamoeba dispar
ISDHSSYTSDNKSHNSSKVSEM

SEQ ID NO: 2432585 - protein, 7 aa, Entamoeba dispar
ISDIGKK

SEQ ID NO: 2432586 - protein, 8 aa, Entamoeba dispar
ISDITKKD

SEQ ID NO: 2432587 - protein, 17 aa, Entamoeba dispar
ISDKDIKTAMKNTEGVN

SEQ ID NO: 2432588 - protein, 8 aa, Entamoeba dispar
ISDKKGIK

SEQ ID NO: 2432589 - protein, 23 aa, Entamoeba dispar
ISDNESENKSINDDDECVDYSSH

SEQ ID NO: 2432590 - protein, 10 aa, Entamoeba dispar
ISDNSTTATF

SEQ ID NO: 2432591 - protein, 8 aa, Entamoeba dispar
ISDPEGIK

SEQ ID NO: 2432592 - protein, 6 aa, Entamoeba dispar
ISDPNE

SEQ ID NO: 2432593 - protein, 12 aa, Entamoeba dispar
ISDPQKDHNKTP

SEQ ID NO: 2432594 - protein, 9 aa, Entamoeba dispar
ISDPSEIDS

SEQ ID NO: 2432595 - protein, 7 aa, Entamoeba dispar
ISDQPIR

SEQ ID NO: 2432596 - protein, 7 aa, Entamoeba dispar
ISDSKSM

SEQ ID NO: 2432597 - protein, 10 aa, Entamoeba dispar
ISDSLSSISR

SEQ ID NO: 2432598 - protein, 10 aa, Entamoeba dispar
ISDSSSPLIT

SEQ ID NO: 2432599 - protein, 7 aa, Entamoeba dispar
ISDSSYA

SEQ ID NO: 2432600 - protein, 9 aa, Entamoeba dispar
ISEAKRRNC

SEQ ID NO: 2432601 - protein, 8 aa, Entamoeba dispar
ISEASNAY

SEQ ID NO: 2432602 - protein, 10 aa, Entamoeba dispar
ISECNPNGQC

SEQ ID NO: 2432603 - protein, 9 aa, Entamoeba dispar
ISEDANKKK

SEQ ID NO: 2432604 - protein, 23 aa, Entamoeba dispar
ISEDDSDESQSEISDNEEDDGFT

SEQ ID NO: 2432605 - protein, 35 aa, Entamoeba dispar
ISEDNDDERDEKIDTISEDDTERNNPLSSKGISYE

SEQ ID NO: 2432606 - protein, 10 aa, Entamoeba dispar
ISEDNKHDLK

SEQ ID NO: 2432607 - protein, 5 aa, Entamoeba dispar
ISEDS

SEQ ID NO: 2432608 - protein, 7 aa, Entamoeba dispar
ISEDSDP

SEQ ID NO: 2432609 - protein, 24 aa, Entamoeba dispar
ISEDSISEDSISEDSISEDSISED

SEQ ID NO: 2432610 - protein, 10 aa, Entamoeba dispar
ISEEDSYSLG

SEQ ID NO: 2432611 - protein, 7 aa, Entamoeba dispar
ISEESSE

SEQ ID NO: 2432612 - protein, 23 aa, Entamoeba dispar
ISEETKKRKSTSSISSKSPRPKA

SEQ ID NO: 2432613 - protein, 9 aa, Entamoeba dispar
ISEGENGQY

SEQ ID NO: 2432614 - protein, 13 aa, Entamoeba dispar
ISEGGKSKIQEKL

SEQ ID NO: 2432615 - protein, 7 aa, Entamoeba dispar
ISEGNYD

SEQ ID NO: 2432616 - protein, 5 aa, Entamoeba dispar
ISEGV

SEQ ID NO: 2432617 - protein, 9 aa, Entamoeba dispar
ISEHEEKTI

SEQ ID NO: 2432618 - protein, 15 aa, Entamoeba dispar
ISEHTEEFTEHEEPQ

SEQ ID NO: 2432619 - protein, 4 aa, Entamoeba dispar
ISEK

SEQ ID NO: 2432620 - protein, 12 aa, Entamoeba dispar
ISEKEEKSDEQI

SEQ ID NO: 2432621 - protein, 6 aa, Entamoeba dispar
ISEKGC

SEQ ID NO: 2432622 - protein, 7 aa, Entamoeba dispar
ISEKGEL

SEQ ID NO: 2432623 - protein, 12 aa, Entamoeba dispar
ISEKKFEEQPGF

SEQ ID NO: 2432624 - protein, 6 aa, Entamoeba dispar
ISEKKK

SEQ ID NO: 2432625 - protein, 16 aa, Entamoeba dispar
ISEKKKQEAIKESGII

SEQ ID NO: 2432626 - protein, 21 aa, Entamoeba dispar
ISEKRDVNLSTAAAKEVLENQ

SEQ ID NO: 2432627 - protein, 7 aa, Entamoeba dispar
ISELGEN

SEQ ID NO: 2432628 - protein, 10 aa, Entamoeba dispar
ISELKGKTVH

SEQ ID NO: 2432629 - protein, 23 aa, Entamoeba dispar
ISEMERKKGVKEKTSLRRYENNK

SEQ ID NO: 2432630 - protein, 4 aa, Entamoeba dispar
ISEN

SEQ ID NO: 2432631 - protein, 8 aa, Entamoeba dispar
ISENERRC

SEQ ID NO: 2432632 - protein, 16 aa, Entamoeba dispar
ISENGNNVNNEISEKL

SEQ ID NO: 2432633 - protein, 5 aa, Entamoeba dispar
ISENN

SEQ ID NO: 2432634 - protein, 7 aa, Entamoeba dispar
ISENNSY

SEQ ID NO: 2432635 - protein, 10 aa, Entamoeba dispar
ISENQNSKPY

SEQ ID NO: 2432636 - protein, 11 aa, Entamoeba dispar
ISEPDGFGSVP

SEQ ID NO: 2432637 - protein, 14 aa, Entamoeba dispar
ISEPNAQNKERPRK

SEQ ID NO: 2432638 - protein, 11 aa, Entamoeba dispar
ISEPSAPISPF

SEQ ID NO: 2432639 - protein, 6 aa, Entamoeba dispar
ISEPTD

SEQ ID NO: 2432640 - protein, 6 aa, Entamoeba dispar
ISEQNK

SEQ ID NO: 2432641 - protein, 20 aa, Entamoeba dispar
ISEQNQIPKIQQQKKVEERS

SEQ ID NO: 2432642 - protein, 22 aa, Entamoeba dispar
ISEQQDRSETVERSIETPNKFD

SEQ ID NO: 2432643 - protein, 12 aa, Entamoeba dispar
ISEREEKNGSVP

SEQ ID NO: 2432644 - protein, 26 aa, Entamoeba dispar
ISERGQKAMTKKVKKQLEKEEKEKLK

SEQ ID NO: 2432645 - protein, 4 aa, Entamoeba dispar
ISES

SEQ ID NO: 2432646 - protein, 7 aa, Entamoeba dispar
ISESCST

SEQ ID NO: 2432647 - protein, 9 aa, Entamoeba dispar
ISESPKARS

SEQ ID NO: 2432648 - protein, 7 aa, Entamoeba dispar
ISESPYR

SEQ ID NO: 2432649 - protein, 6 aa, Entamoeba dispar
ISESSD

SEQ ID NO: 2432650 - protein, 5 aa, Entamoeba dispar
ISESV

SEQ ID NO: 2432651 - protein, 8 aa, Entamoeba dispar
ISETEQKY

SEQ ID NO: 2432652 - protein, 13 aa, Entamoeba dispar
ISETPEQARNTRI

SEQ ID NO: 2432653 - protein, 11 aa, Entamoeba dispar
ISETPMEEDYS

SEQ ID NO: 2432654 - protein, 8 aa, Entamoeba dispar
ISETPTHN

SEQ ID NO: 2432655 - protein, 10 aa, Entamoeba dispar
ISETSPENTE

SEQ ID NO: 2432656 - protein, 13 aa, Entamoeba dispar
ISEVGDKCDGLKQ

SEQ ID NO: 2432657 - protein, 11 aa, Entamoeba dispar
ISEYQQKEKAI

SEQ ID NO: 2432658 - protein, 6 aa, Entamoeba dispar
ISEYTK

SEQ ID NO: 2432659 - protein, 14 aa, Entamoeba dispar
ISGADGTANIEGAV

SEQ ID NO: 2432660 - protein, 6 aa, Entamoeba dispar
ISGAKK

SEQ ID NO: 2432661 - protein, 7 aa, Entamoeba dispar
ISGAPNN

SEQ ID NO: 2432662 - protein, 19 aa, Entamoeba dispar
ISGATVRSTVRRLRDAKNS

SEQ ID NO: 2432663 - protein, 12 aa, Entamoeba dispar
ISGAYQGDQSMG

SEQ ID NO: 2432664 - protein, 9 aa, Entamoeba dispar
ISGDEESRR

SEQ ID NO: 2432665 - protein, 4 aa, Entamoeba dispar
ISGF

SEQ ID NO: 2432666 - protein, 6 aa, Entamoeba dispar
ISGFNR

SEQ ID NO: 2432667 - protein, 9 aa, Entamoeba dispar
ISGGLNDQE

SEQ ID NO: 2432668 - protein, 4 aa, Entamoeba dispar
ISGI

SEQ ID NO: 2432669 - protein, 5 aa, Entamoeba dispar
ISGKE

SEQ ID NO: 2432670 - protein, 11 aa, Entamoeba dispar
ISGKEETGINH

SEQ ID NO: 2432671 - protein, 17 aa, Entamoeba dispar
ISGLGKSGIHGNNNDIV

SEQ ID NO: 2432672 - protein, 13 aa, Entamoeba dispar
ISGLKEEKDESVD

SEQ ID NO: 2432673 - protein, 33 aa, Entamoeba dispar
ISGLNESDEVKSSDDSDEDLSEESKRKIEEELE

SEQ ID NO: 2432674 - protein, 52 aa, Entamoeba dispar
ISGLQKSDEEKDTSIQQQNEPKQEGLTEINENRPNETKKLEKRINEKKTEEA

SEQ ID NO: 2432675 - protein, 12 aa, Entamoeba dispar
ISGNDLKNFPKS

SEQ ID NO: 2432676 - protein, 8 aa, Entamoeba dispar
ISGPTEEN

SEQ ID NO: 2432677 - protein, 4 aa, Entamoeba dispar
ISGS

SEQ ID NO: 2432678 - protein, 9 aa, Entamoeba dispar
ISGSSPIET

SEQ ID NO: 2432679 - protein, 10 aa, Entamoeba dispar
ISGSTSKIDE

SEQ ID NO: 2432680 - protein, 7 aa, Entamoeba dispar
ISGTPGR

SEQ ID NO: 2432681 - protein, 6 aa, Entamoeba dispar
ISGTSW

SEQ ID NO: 2432682 - protein, 7 aa, Entamoeba dispar
ISGTTKG

SEQ ID NO: 2432683 - protein, 9 aa, Entamoeba dispar
ISGVSSADQ

SEQ ID NO: 2432684 - protein, 10 aa, Entamoeba dispar
ISGVTNDNES

SEQ ID NO: 2432685 - protein, 16 aa, Entamoeba dispar
ISIKGESNESNSFKED

SEQ ID NO: 2432686 - protein, 12 aa, Entamoeba dispar
ISIKPNNKYLEE

SEQ ID NO: 2432687 - protein, 4 aa, Entamoeba dispar
ISIN

SEQ ID NO: 2432688 - protein, 4 aa, Entamoeba dispar
ISIP

SEQ ID NO: 2432689 - protein, 5 aa, Entamoeba dispar
ISIPD

SEQ ID NO: 2432690 - protein, 8 aa, Entamoeba dispar
ISIPSSVS

SEQ ID NO: 2432691 - protein, 15 aa, Entamoeba dispar
ISIPTPDVGGWPAKP

SEQ ID NO: 2432692 - protein, 12 aa, Entamoeba dispar
ISKARAKGEDKM

SEQ ID NO: 2432693 - protein, 7 aa, Entamoeba dispar
ISKDDEY

SEQ ID NO: 2432694 - protein, 5 aa, Entamoeba dispar
ISKDR

SEQ ID NO: 2432695 - protein, 4 aa, Entamoeba dispar
ISKE

SEQ ID NO: 2432696 - protein, 7 aa, Entamoeba dispar
ISKEDGE

SEQ ID NO: 2432697 - protein, 31 aa, Entamoeba dispar
ISKEDIKKYGGDEIITSSGDTLLGADDKSGV

SEQ ID NO: 2432698 - protein, 5 aa, Entamoeba dispar
ISKEE

SEQ ID NO: 2432699 - protein, 11 aa, Entamoeba dispar
ISKEENEESVM

SEQ ID NO: 2432700 - protein, 9 aa, Entamoeba dispar
ISKEESQQL

SEQ ID NO: 2432701 - protein, 10 aa, Entamoeba dispar
ISKEGGSSYK

SEQ ID NO: 2432702 - protein, 12 aa, Entamoeba dispar
ISKEGPKKLPNK

SEQ ID NO: 2432703 - protein, 10 aa, Entamoeba dispar
ISKEINNNKE

SEQ ID NO: 2432704 - protein, 24 aa, Entamoeba dispar
ISKENEELKNSIETIKKERNKSEE

SEQ ID NO: 2432705 - protein, 30 aa, Entamoeba dispar
ISKESCKETKPKKTTHLKSKQKGDAKSDID

SEQ ID NO: 2432706 - protein, 6 aa, Entamoeba dispar
ISKEYD

SEQ ID NO: 2432707 - protein, 4 aa, Entamoeba dispar
ISKI

SEQ ID NO: 2432708 - protein, 4 aa, Entamoeba dispar
ISKK

SEQ ID NO: 2432709 - protein, 11 aa, Entamoeba dispar
ISKKQKSSYLT

SEQ ID NO: 2432710 - protein, 5 aa, Entamoeba dispar
ISKLG

SEQ ID NO: 2432711 - protein, 4 aa, Entamoeba dispar
ISKM

SEQ ID NO: 2432712 - protein, 9 aa, Entamoeba dispar
ISKNEKKKK

SEQ ID NO: 2432713 - protein, 9 aa, Entamoeba dispar
ISKNGPHGD

SEQ ID NO: 2432714 - protein, 9 aa, Entamoeba dispar
ISKNNIPDD

SEQ ID NO: 2432715 - protein, 14 aa, Entamoeba dispar
ISKNPTITVESTKQ

SEQ ID NO: 2432716 - protein, 12 aa, Entamoeba dispar
ISKPNTPSQYTS

SEQ ID NO: 2432717 - protein, 7 aa, Entamoeba dispar
ISKPSKK

SEQ ID NO: 2432718 - protein, 9 aa, Entamoeba dispar
ISKPTPSQF

SEQ ID NO: 2432719 - protein, 8 aa, Entamoeba dispar
ISKPTSIC

SEQ ID NO: 2432720 - protein, 9 aa, Entamoeba dispar
ISKQRKEGI

SEQ ID NO: 2432721 - protein, 12 aa, Entamoeba dispar
ISKRGKKGSLKG

SEQ ID NO: 2432722 - protein, 7 aa, Entamoeba dispar
ISKRRAS

SEQ ID NO: 2432723 - protein, 8 aa, Entamoeba dispar
ISKRRGSH

SEQ ID NO: 2432724 - protein, 4 aa, Entamoeba dispar
ISKS

SEQ ID NO: 2432725 - protein, 8 aa, Entamoeba dispar
ISKSKSSF

SEQ ID NO: 2432726 - protein, 7 aa, Entamoeba dispar
ISKSNEK

SEQ ID NO: 2432727 - protein, 10 aa, Entamoeba dispar
ISKSQEIQNT

SEQ ID NO: 2432728 - protein, 8 aa, Entamoeba dispar
ISKTKIKR

SEQ ID NO: 2432729 - protein, 8 aa, Entamoeba dispar
ISKTTTVS

SEQ ID NO: 2432730 - protein, 8 aa, Entamoeba dispar
ISLPSGEI

SEQ ID NO: 2432731 - protein, 4 aa, Entamoeba dispar
ISLS

SEQ ID NO: 2432732 - protein, 17 aa, Entamoeba dispar
ISLTSKKAEDYKNSHQN

SEQ ID NO: 2432733 - protein, 8 aa, Entamoeba dispar
ISLTSPTP

SEQ ID NO: 2432734 - protein, 9 aa, Entamoeba dispar
ISMPPGNDI

SEQ ID NO: 2432735 - protein, 15 aa, Entamoeba dispar
ISMTEGKASVNDQDG

SEQ ID NO: 2432736 - protein, 17 aa, Entamoeba dispar
ISNDEEKDTTSSQQQRV

SEQ ID NO: 2432737 - protein, 10 aa, Entamoeba dispar
ISNDKIQKKY

SEQ ID NO: 2432738 - protein, 4 aa, Entamoeba dispar
ISNE

SEQ ID NO: 2432739 - protein, 11 aa, Entamoeba dispar
ISNEDDDNGIE

SEQ ID NO: 2432740 - protein, 9 aa, Entamoeba dispar
ISNEENRKK

SEQ ID NO: 2432741 - protein, 34 aa, Entamoeba dispar
ISNEKSGEENGTEHNSIKKSNLLKPKKSKKWDKE

SEQ ID NO: 2432742 - protein, 8 aa, Entamoeba dispar
ISNENEEL

SEQ ID NO: 2432743 - protein, 10 aa, Entamoeba dispar
ISNENNTIHE

SEQ ID NO: 2432744 - protein, 11 aa, Entamoeba dispar
ISNENQEKVKQ

SEQ ID NO: 2432745 - protein, 12 aa, Entamoeba dispar
ISNENSYQENSL

SEQ ID NO: 2432746 - protein, 8 aa, Entamoeba dispar
ISNEPQKC

SEQ ID NO: 2432747 - protein, 6 aa, Entamoeba dispar
ISNEQH

SEQ ID NO: 2432748 - protein, 7 aa, Entamoeba dispar
ISNEQNA

SEQ ID NO: 2432749 - protein, 17 aa, Entamoeba dispar
ISNEQSKEKKSFSSQEL

SEQ ID NO: 2432750 - protein, 7 aa, Entamoeba dispar
ISNETQF

SEQ ID NO: 2432751 - protein, 9 aa, Entamoeba dispar
ISNIETSIS

SEQ ID NO: 2432752 - protein, 7 aa, Entamoeba dispar
ISNKEEF

SEQ ID NO: 2432753 - protein, 9 aa, Entamoeba dispar
ISNNGKNED

SEQ ID NO: 2432754 - protein, 10 aa, Entamoeba dispar
ISNPEEKKEA

SEQ ID NO: 2432755 - protein, 6 aa, Entamoeba dispar
ISNPLT

SEQ ID NO: 2432756 - protein, 29 aa, Entamoeba dispar
ISNPPPVPPRRGNLKQKQSIYPNSSNLDI

SEQ ID NO: 2432757 - protein, 8 aa, Entamoeba dispar
ISNPRDAI

SEQ ID NO: 2432758 - protein, 26 aa, Entamoeba dispar
ISNQNSKNIINQKEKELIDKNTEIKR

SEQ ID NO: 2432759 - protein, 6 aa, Entamoeba dispar
ISNQTQ

SEQ ID NO: 2432760 - protein, 9 aa, Entamoeba dispar
ISNSIEQEK

SEQ ID NO: 2432761 - protein, 5 aa, Entamoeba dispar
ISNSL

SEQ ID NO: 2432762 - protein, 16 aa, Entamoeba dispar
ISNSQPTKETKSSTTF

SEQ ID NO: 2432763 - protein, 24 aa, Entamoeba dispar
ISNSSNKTSNSSNRTSMNGIPPGI

SEQ ID NO: 2432764 - protein, 12 aa, Entamoeba dispar
ISNSSSPTDESN

SEQ ID NO: 2432765 - protein, 9 aa, Entamoeba dispar
ISNTGNKII

SEQ ID NO: 2432766 - protein, 20 aa, Entamoeba dispar
ISNTNQQHKKISNDKALKKA

SEQ ID NO: 2432767 - protein, 9 aa, Entamoeba dispar
ISNTRTETF

SEQ ID NO: 2432768 - protein, 7 aa, Entamoeba dispar
ISNTSEE

SEQ ID NO: 2432769 - protein, 12 aa, Entamoeba dispar
ISNTSLKKSFQE

SEQ ID NO: 2432770 - protein, 13 aa, Entamoeba dispar
ISNTSQLKEVEDK

SEQ ID NO: 2432771 - protein, 6 aa, Entamoeba dispar
ISNTVN

SEQ ID NO: 2432772 - protein, 12 aa, Entamoeba dispar
ISPAQEDLEETL

SEQ ID NO: 2432773 - protein, 4 aa, Entamoeba dispar
ISPD

SEQ ID NO: 2432774 - protein, 6 aa, Entamoeba dispar
ISPDMT

SEQ ID NO: 2432775 - protein, 8 aa, Entamoeba dispar
ISPDNNFS

SEQ ID NO: 2432776 - protein, 6 aa, Entamoeba dispar
ISPDNS

SEQ ID NO: 2432777 - protein, 7 aa, Entamoeba dispar
ISPDPNL

SEQ ID NO: 2432778 - protein, 8 aa, Entamoeba dispar
ISPDPNLS

SEQ ID NO: 2432779 - protein, 13 aa, Entamoeba dispar
ISPEEKKIITDPS

SEQ ID NO: 2432780 - protein, 4 aa, Entamoeba dispar
ISPF

SEQ ID NO: 2432781 - protein, 9 aa, Entamoeba dispar
ISPGTSNEV

SEQ ID NO: 2432782 - protein, 10 aa, Entamoeba dispar
ISPIESRKEL

SEQ ID NO: 2432783 - protein, 11 aa, Entamoeba dispar
ISPKDTIKNTK

SEQ ID NO: 2432784 - protein, 7 aa, Entamoeba dispar
ISPKEIA

SEQ ID NO: 2432785 - protein, 5 aa, Entamoeba dispar
ISPKG

SEQ ID NO: 2432786 - protein, 6 aa, Entamoeba dispar
ISPKKM

SEQ ID NO: 2432787 - protein, 15 aa, Entamoeba dispar
ISPKKSDGTINNTQE

SEQ ID NO: 2432788 - protein, 5 aa, Entamoeba dispar
ISPKT

SEQ ID NO: 2432789 - protein, 6 aa, Entamoeba dispar
ISPLPS

SEQ ID NO: 2432790 - protein, 7 aa, Entamoeba dispar
ISPNLNS

SEQ ID NO: 2432791 - protein, 9 aa, Entamoeba dispar
ISPNYLPPP

SEQ ID NO: 2432792 - protein, 5 aa, Entamoeba dispar
ISPPF

SEQ ID NO: 2432793 - protein, 6 aa, Entamoeba dispar
ISPPGI

SEQ ID NO: 2432794 - protein, 8 aa, Entamoeba dispar
ISPPGTYL

SEQ ID NO: 2432795 - protein, 8 aa, Entamoeba dispar
ISPPNNTN

SEQ ID NO: 2432796 - protein, 6 aa, Entamoeba dispar
ISPPNQ

SEQ ID NO: 2432797 - protein, 6 aa, Entamoeba dispar
ISPPNY

SEQ ID NO: 2432798 - protein, 4 aa, Entamoeba dispar
ISPQ

SEQ ID NO: 2432799 - protein, 9 aa, Entamoeba dispar
ISPQKQTFL

SEQ ID NO: 2432800 - protein, 24 aa, Entamoeba dispar
ISPQPRSPIKIRDDREEHDRQREE

SEQ ID NO: 2432801 - protein, 8 aa, Entamoeba dispar
ISPQSTPY

SEQ ID NO: 2432802 - protein, 6 aa, Entamoeba dispar
ISPQTE

SEQ ID NO: 2432803 - protein, 18 aa, Entamoeba dispar
ISPRKKTLKKDENSLSLN

SEQ ID NO: 2432804 - protein, 18 aa, Entamoeba dispar
ISPRNKQEQNENRYNEEN

SEQ ID NO: 2432805 - protein, 6 aa, Entamoeba dispar
ISPRNT

SEQ ID NO: 2432806 - protein, 7 aa, Entamoeba dispar
ISPRSPR

SEQ ID NO: 2432807 - protein, 9 aa, Entamoeba dispar
ISPSGVKKD

SEQ ID NO: 2432808 - protein, 6 aa, Entamoeba dispar
ISPSLQ

SEQ ID NO: 2432809 - protein, 7 aa, Entamoeba dispar
ISPSNLQ

SEQ ID NO: 2432810 - protein, 7 aa, Entamoeba dispar
ISPSNSI

SEQ ID NO: 2432811 - protein, 7 aa, Entamoeba dispar
ISPSPTG

SEQ ID NO: 2432812 - protein, 16 aa, Entamoeba dispar
ISPSQNNQQLAKPEPK

SEQ ID NO: 2432813 - protein, 7 aa, Entamoeba dispar
ISPSTLN

SEQ ID NO: 2432814 - protein, 5 aa, Entamoeba dispar
ISPSV

SEQ ID NO: 2432815 - protein, 10 aa, Entamoeba dispar
ISPTEQPIQQ

SEQ ID NO: 2432816 - protein, 20 aa, Entamoeba dispar
ISPTKRDKEVTDNKKPKILD

SEQ ID NO: 2432817 - protein, 5 aa, Entamoeba dispar
ISPTP

SEQ ID NO: 2432818 - protein, 9 aa, Entamoeba dispar
ISPVNAKPI

SEQ ID NO: 2432819 - protein, 5 aa, Entamoeba dispar
ISPVP

SEQ ID NO: 2432820 - protein, 8 aa, Entamoeba dispar
ISQAERTY

SEQ ID NO: 2432821 - protein, 10 aa, Entamoeba dispar
ISQENKDSLM

SEQ ID NO: 2432822 - protein, 11 aa, Entamoeba dispar
ISQENNPVPQT

SEQ ID NO: 2432823 - protein, 40 aa, Entamoeba dispar
ISQHHEKEEDISTISDKDNENEKKPIIKSKNKKLKKKEVK

SEQ ID NO: 2432824 - protein, 11 aa, Entamoeba dispar
ISQKHKSLEHK

SEQ ID NO: 2432825 - protein, 7 aa, Entamoeba dispar
ISQKSIQ

SEQ ID NO: 2432826 - protein, 9 aa, Entamoeba dispar
ISQNSAYIS

SEQ ID NO: 2432827 - protein, 11 aa, Entamoeba dispar
ISQNSSKQEIE

SEQ ID NO: 2432828 - protein, 16 aa, Entamoeba dispar
ISQNTQIQLPNEENIS

SEQ ID NO: 2432829 - protein, 8 aa, Entamoeba dispar
ISQPASPK

SEQ ID NO: 2432830 - protein, 28 aa, Entamoeba dispar
ISQPPNPSYPRPNAFPQNSYLPSSIGRT

SEQ ID NO: 2432831 - protein, 14 aa, Entamoeba dispar
ISQPPNPSYPRPNV

SEQ ID NO: 2432832 - protein, 6 aa, Entamoeba dispar
ISQPSY

SEQ ID NO: 2432833 - protein, 9 aa, Entamoeba dispar
ISQPTITNS

SEQ ID NO: 2432834 - protein, 7 aa, Entamoeba dispar
ISQPTTM

SEQ ID NO: 2432835 - protein, 7 aa, Entamoeba dispar
ISQQPSY

SEQ ID NO: 2432836 - protein, 7 aa, Entamoeba dispar
ISQQPYP

SEQ ID NO: 2432837 - protein, 16 aa, Entamoeba dispar
ISQQRGHNEKRQYRDR

SEQ ID NO: 2432838 - protein, 9 aa, Entamoeba dispar
ISQSDKSIS

SEQ ID NO: 2432839 - protein, 14 aa, Entamoeba dispar
ISQSDLKISNEQSF

SEQ ID NO: 2432840 - protein, 9 aa, Entamoeba dispar
ISQSEKEIA

SEQ ID NO: 2432841 - protein, 11 aa, Entamoeba dispar
ISQSSEPINYN

SEQ ID NO: 2432842 - protein, 8 aa, Entamoeba dispar
ISQSSSDL

SEQ ID NO: 2432843 - protein, 8 aa, Entamoeba dispar
ISQTNKIN

SEQ ID NO: 2432844 - protein, 9 aa, Entamoeba dispar
ISQTTSEAT

SEQ ID NO: 2432845 - protein, 9 aa, Entamoeba dispar
ISREEREKN

SEQ ID NO: 2432846 - protein, 11 aa, Entamoeba dispar
ISRKNELKNDR

SEQ ID NO: 2432847 - protein, 4 aa, Entamoeba dispar
ISRL

SEQ ID NO: 2432848 - protein, 7 aa, Entamoeba dispar
ISRNAGQ

SEQ ID NO: 2432849 - protein, 8 aa, Entamoeba dispar
ISRPTDIP

SEQ ID NO: 2432850 - protein, 4 aa, Entamoeba dispar
ISRS

SEQ ID NO: 2432851 - protein, 5 aa, Entamoeba dispar
ISRSA

SEQ ID NO: 2432852 - protein, 5 aa, Entamoeba dispar
ISRSS

SEQ ID NO: 2432853 - protein, 34 aa, Entamoeba dispar
ISRTEEEKRRQDSITRIREDSNTETKSRKDKEVL

SEQ ID NO: 2432854 - protein, 6 aa, Entamoeba dispar
ISRTTE

SEQ ID NO: 2432855 - protein, 8 aa, Entamoeba dispar
ISSAGTAF

SEQ ID NO: 2432856 - protein, 5 aa, Entamoeba dispar
ISSDE

SEQ ID NO: 2432857 - protein, 7 aa, Entamoeba dispar
ISSDKAK

SEQ ID NO: 2432858 - protein, 11 aa, Entamoeba dispar
ISSDNQTSLNQ

SEQ ID NO: 2432859 - protein, 7 aa, Entamoeba dispar
ISSDSEI

SEQ ID NO: 2432860 - protein, 11 aa, Entamoeba dispar
ISSEEEEEEEN

SEQ ID NO: 2432861 - protein, 13 aa, Entamoeba dispar
ISSEEEKRGQKEY

SEQ ID NO: 2432862 - protein, 7 aa, Entamoeba dispar
ISSEEKL

SEQ ID NO: 2432863 - protein, 10 aa, Entamoeba dispar
ISSETSSNEK

SEQ ID NO: 2432864 - protein, 10 aa, Entamoeba dispar
ISSFEEEGNQ

SEQ ID NO: 2432865 - protein, 9 aa, Entamoeba dispar
ISSGSPKAI

SEQ ID NO: 2432866 - protein, 7 aa, Entamoeba dispar
ISSHHPL

SEQ ID NO: 2432867 - protein, 10 aa, Entamoeba dispar
ISSHSQRTSI

SEQ ID NO: 2432868 - protein, 8 aa, Entamoeba dispar
ISSKDNNI

SEQ ID NO: 2432869 - protein, 11 aa, Entamoeba dispar
ISSKELSSIEK

SEQ ID NO: 2432870 - protein, 8 aa, Entamoeba dispar
ISSKEQND

SEQ ID NO: 2432871 - protein, 5 aa, Entamoeba dispar
ISSKR

SEQ ID NO: 2432872 - protein, 10 aa, Entamoeba dispar
ISSKTGDGIQ

SEQ ID NO: 2432873 - protein, 8 aa, Entamoeba dispar
ISSKTKEI

SEQ ID NO: 2432874 - protein, 10 aa, Entamoeba dispar
ISSKTTSANC

SEQ ID NO: 2432875 - protein, 9 aa, Entamoeba dispar
ISSLNEGHL

SEQ ID NO: 2432876 - protein, 11 aa, Entamoeba dispar
ISSNIKQVDRR

SEQ ID NO: 2432877 - protein, 30 aa, Entamoeba dispar
ISSNNERKDEEIKEEITSHNQTETKEIKNT

SEQ ID NO: 2432878 - protein, 9 aa, Entamoeba dispar
ISSNPSKTN

SEQ ID NO: 2432879 - protein, 11 aa, Entamoeba dispar
ISSNSSYPTLN

SEQ ID NO: 2432880 - protein, 7 aa, Entamoeba dispar
ISSPDEM

SEQ ID NO: 2432881 - protein, 13 aa, Entamoeba dispar
ISSPHSSRKESLR

SEQ ID NO: 2432882 - protein, 10 aa, Entamoeba dispar
ISSPSSPGLE

SEQ ID NO: 2432883 - protein, 7 aa, Entamoeba dispar
ISSPTDS

SEQ ID NO: 2432884 - protein, 10 aa, Entamoeba dispar
ISSPTPSPSI

SEQ ID NO: 2432885 - protein, 4 aa, Entamoeba dispar
ISSQ

SEQ ID NO: 2432886 - protein, 10 aa, Entamoeba dispar
ISSQPESKKN

SEQ ID NO: 2432887 - protein, 7 aa, Entamoeba dispar
ISSQPPL

SEQ ID NO: 2432888 - protein, 9 aa, Entamoeba dispar
ISSQSTTQI

SEQ ID NO: 2432889 - protein, 6 aa, Entamoeba dispar
ISSQTD

SEQ ID NO: 2432890 - protein, 10 aa, Entamoeba dispar
ISSQTISGTT

SEQ ID NO: 2432891 - protein, 6 aa, Entamoeba dispar
ISSRIT

SEQ ID NO: 2432892 - protein, 8 aa, Entamoeba dispar
ISSSEIRS

SEQ ID NO: 2432893 - protein, 5 aa, Entamoeba dispar
ISSSI

SEQ ID NO: 2432894 - protein, 8 aa, Entamoeba dispar
ISSSNEWG

SEQ ID NO: 2432895 - protein, 6 aa, Entamoeba dispar
ISSSPD

SEQ ID NO: 2432896 - protein, 21 aa, Entamoeba dispar
ISSSSDPSIKTSGHKSGSSNS

SEQ ID NO: 2432897 - protein, 17 aa, Entamoeba dispar
ISSSSYSGSDEIKDNIT

SEQ ID NO: 2432898 - protein, 12 aa, Entamoeba dispar
ISSSTKPKPKNE

SEQ ID NO: 2432899 - protein, 4 aa, Entamoeba dispar
ISST

SEQ ID NO: 2432900 - protein, 17 aa, Entamoeba dispar
ISSTKPIESQATQLSQD

SEQ ID NO: 2432901 - protein, 5 aa, Entamoeba dispar
ISSTQ

SEQ ID NO: 2432902 - protein, 8 aa, Entamoeba dispar
ISSVQTKE

SEQ ID NO: 2432903 - protein, 4 aa, Entamoeba dispar
ISSY

SEQ ID NO: 2432904 - protein, 9 aa, Entamoeba dispar
ISSYSDDSI

SEQ ID NO: 2432905 - protein, 10 aa, Entamoeba dispar
ISSYSKEPTF

SEQ ID NO: 2432906 - protein, 11 aa, Entamoeba dispar
ISTAEDGVSVT

SEQ ID NO: 2432907 - protein, 10 aa, Entamoeba dispar
ISTAKALGAQ

SEQ ID NO: 2432908 - protein, 8 aa, Entamoeba dispar
ISTAKENE

SEQ ID NO: 2432909 - protein, 4 aa, Entamoeba dispar
ISTD

SEQ ID NO: 2432910 - protein, 12 aa, Entamoeba dispar
ISTDKQKDTLIN

SEQ ID NO: 2432911 - protein, 8 aa, Entamoeba dispar
ISTEDQNI

SEQ ID NO: 2432912 - protein, 10 aa, Entamoeba dispar
ISTEQGQELA

SEQ ID NO: 2432913 - protein, 14 aa, Entamoeba dispar
ISTETVRSYRESIN

SEQ ID NO: 2432914 - protein, 8 aa, Entamoeba dispar
ISTFGPDQ

SEQ ID NO: 2432915 - protein, 7 aa, Entamoeba dispar
ISTGSYP

SEQ ID NO: 2432916 - protein, 4 aa, Entamoeba dispar
ISTI

SEQ ID NO: 2432917 - protein, 6 aa, Entamoeba dispar
ISTIKE

SEQ ID NO: 2432918 - protein, 4 aa, Entamoeba dispar
ISTK

SEQ ID NO: 2432919 - protein, 8 aa, Entamoeba dispar
ISTKFNRE

SEQ ID NO: 2432920 - protein, 10 aa, Entamoeba dispar
ISTKNKKTRL

SEQ ID NO: 2432921 - protein, 18 aa, Entamoeba dispar
ISTNDTTDVSEQNVPIDG

SEQ ID NO: 2432922 - protein, 16 aa, Entamoeba dispar
ISTNEINRGGYQTKKE

SEQ ID NO: 2432923 - protein, 5 aa, Entamoeba dispar
ISTNF

SEQ ID NO: 2432924 - protein, 12 aa, Entamoeba dispar
ISTNIRDNNDSS

SEQ ID NO: 2432925 - protein, 5 aa, Entamoeba dispar
ISTNP

SEQ ID NO: 2432926 - protein, 7 aa, Entamoeba dispar
ISTNPEK

SEQ ID NO: 2432927 - protein, 7 aa, Entamoeba dispar
ISTNQNL

SEQ ID NO: 2432928 - protein, 14 aa, Entamoeba dispar
ISTNTKPKSSLSVP

SEQ ID NO: 2432929 - protein, 6 aa, Entamoeba dispar
ISTNTS

SEQ ID NO: 2432930 - protein, 15 aa, Entamoeba dispar
ISTPKTTGGTESPIS

SEQ ID NO: 2432931 - protein, 6 aa, Entamoeba dispar
ISTPNN

SEQ ID NO: 2432932 - protein, 7 aa, Entamoeba dispar
ISTQDYS

SEQ ID NO: 2432933 - protein, 50 aa, Entamoeba dispar
ISTQEESDSIGSELSPRSPRMSKSEKKEKQDKKKGKKSDSDDNDYSQQTK

SEQ ID NO: 2432934 - protein, 9 aa, Entamoeba dispar
ISTQQSFEK

SEQ ID NO: 2432935 - protein, 32 aa, Entamoeba dispar
  misc_feature (19)..(20): Xaa can be any naturally occurring amino acid
ISTQQSNDSIIQKVLMKKXXLASSYENNEHTL

SEQ ID NO: 2432936 - protein, 10 aa, Entamoeba dispar
ISTQSGEDVQ

SEQ ID NO: 2432937 - protein, 8 aa, Entamoeba dispar
ISTRETDV

SEQ ID NO: 2432938 - protein, 4 aa, Entamoeba dispar
ISTS

SEQ ID NO: 2432939 - protein, 12 aa, Entamoeba dispar
ISTSDEKNQFET

SEQ ID NO: 2432940 - protein, 5 aa, Entamoeba dispar
ISTSK

SEQ ID NO: 2432941 - protein, 7 aa, Entamoeba dispar
ISTSTTQ

SEQ ID NO: 2432942 - protein, 10 aa, Entamoeba dispar
ISTTEQSLKS

SEQ ID NO: 2432943 - protein, 7 aa, Entamoeba dispar
ISTTETE

SEQ ID NO: 2432944 - protein, 7 aa, Entamoeba dispar
ISTTKGI

SEQ ID NO: 2432945 - protein, 7 aa, Entamoeba dispar
ISTTKNK

SEQ ID NO: 2432946 - protein, 28 aa, Entamoeba dispar
ISTTSKQVIPDSISQKSSLEDLSSTTKD

SEQ ID NO: 2432947 - protein, 9 aa, Entamoeba dispar
ISTTTDDVL

SEQ ID NO: 2432948 - protein, 8 aa, Entamoeba dispar
ISTTTEEV

SEQ ID NO: 2432949 - protein, 11 aa, Entamoeba dispar
ISTVTNAREKF

SEQ ID NO: 2432950 - protein, 5 aa, Entamoeba dispar
ISTYG

SEQ ID NO: 2432951 - protein, 40 aa, Entamoeba dispar
ISVEEDGTEEDEKEERKKKRSRGTKTPKSRGRKDKGKSLT

SEQ ID NO: 2432952 - protein, 15 aa, Entamoeba dispar
ISVGDDNMLKIWKIV

SEQ ID NO: 2432953 - protein, 11 aa, Entamoeba dispar
ISVKPKKSPYI

SEQ ID NO: 2432954 - protein, 16 aa, Entamoeba dispar
ISVPPKMSIGDSNEFT

SEQ ID NO: 2432955 - protein, 7 aa, Entamoeba dispar
ISWSPKS

SEQ ID NO: 2432956 - protein, 5 aa, Entamoeba dispar
ISYPD

SEQ ID NO: 2432957 - protein, 7 aa, Entamoeba dispar
ISYPDAK

SEQ ID NO: 2432958 - protein, 9 aa, Entamoeba dispar
ISYSPPQEF

SEQ ID NO: 2432959 - protein, 4 aa, Entamoeba dispar
ISYY

SEQ ID NO: 2432960 - protein, 5 aa, Entamoeba dispar
ITAEY

SEQ ID NO: 2432961 - protein, 5 aa, Entamoeba dispar
ITAKQ

SEQ ID NO: 2432962 - protein, 6 aa, Entamoeba dispar
ITAPDL

SEQ ID NO: 2432963 - protein, 8 aa, Entamoeba dispar
ITASADKT

SEQ ID NO: 2432964 - protein, 5 aa, Entamoeba dispar
ITASE

SEQ ID NO: 2432965 - protein, 6 aa, Entamoeba dispar
ITATKE

SEQ ID NO: 2432966 - protein, 8 aa, Entamoeba dispar
ITATKGKS

SEQ ID NO: 2432967 - protein, 6 aa, Entamoeba dispar
ITAVSR

SEQ ID NO: 2432968 - protein, 10 aa, Entamoeba dispar
ITDDDKPSQT

SEQ ID NO: 2432969 - protein, 8 aa, Entamoeba dispar
ITDDEQNQ

SEQ ID NO: 2432970 - protein, 5 aa, Entamoeba dispar
ITDEY

SEQ ID NO: 2432971 - protein, 11 aa, Entamoeba dispar
ITDGPLSFTEE

SEQ ID NO: 2432972 - protein, 6 aa, Entamoeba dispar
ITDGSI

SEQ ID NO: 2432973 - protein, 10 aa, Entamoeba dispar
ITDGVTEKEL

SEQ ID NO: 2432974 - protein, 4 aa, Entamoeba dispar
ITDK

SEQ ID NO: 2432975 - protein, 4 aa, Entamoeba dispar
ITDL

SEQ ID NO: 2432976 - protein, 9 aa, Entamoeba dispar
ITDNDRNTR

SEQ ID NO: 2432977 - protein, 7 aa, Entamoeba dispar
ITDPDEM

SEQ ID NO: 2432978 - protein, 5 aa, Entamoeba dispar
ITDPK

SEQ ID NO: 2432979 - protein, 10 aa, Entamoeba dispar
ITDRDNKGRN

SEQ ID NO: 2432980 - protein, 20 aa, Entamoeba dispar
ITDRNNSERGYCKKVIVIKM

SEQ ID NO: 2432981 - protein, 30 aa, Entamoeba dispar
ITDSENEYSREDKEEESDDETEEVEKGFIE

SEQ ID NO: 2432982 - protein, 7 aa, Entamoeba dispar
ITDTEAK

SEQ ID NO: 2432983 - protein, 6 aa, Entamoeba dispar
ITDTSN

SEQ ID NO: 2432984 - protein, 11 aa, Entamoeba dispar
ITDTTTSQGTT

SEQ ID NO: 2432985 - protein, 5 aa, Entamoeba dispar
ITDYP

SEQ ID NO: 2432986 - protein, 6 aa, Entamoeba dispar
ITEDDQ

SEQ ID NO: 2432987 - protein, 4 aa, Entamoeba dispar
ITEE

SEQ ID NO: 2432988 - protein, 7 aa, Entamoeba dispar
ITEEEKE

SEQ ID NO: 2432989 - protein, 5 aa, Entamoeba dispar
ITEEG

SEQ ID NO: 2432990 - protein, 6 aa, Entamoeba dispar
ITEEGK

SEQ ID NO: 2432991 - protein, 6 aa, Entamoeba dispar
ITEENI

SEQ ID NO: 2432992 - protein, 8 aa, Entamoeba dispar
ITEENTNE

SEQ ID NO: 2432993 - protein, 5 aa, Entamoeba dispar
ITEES

SEQ ID NO: 2432994 - protein, 7 aa, Entamoeba dispar
ITEETKD

SEQ ID NO: 2432995 - protein, 10 aa, Entamoeba dispar
ITEGDCKKLE

SEQ ID NO: 2432996 - protein, 17 aa, Entamoeba dispar
ITEGRGFTNDLNSSKGR

SEQ ID NO: 2432997 - protein, 11 aa, Entamoeba dispar
ITEGTKKFTEK

SEQ ID NO: 2432998 - protein, 12 aa, Entamoeba dispar
ITEIEKEEEIKR

SEQ ID NO: 2432999 - protein, 4 aa, Entamoeba dispar
ITEK

SEQ ID NO: 2433000 - protein, 9 aa, Entamoeba dispar
ITEKAQRQF

SEQ ID NO: 2433001 - protein, 9 aa, Entamoeba dispar
ITEKKGPIN

SEQ ID NO: 2433002 - protein, 14 aa, Entamoeba dispar
ITEKKKEAKEQQEY

SEQ ID NO: 2433003 - protein, 19 aa, Entamoeba dispar
ITEKSKKKVNVKKGEEEYM

SEQ ID NO: 2433004 - protein, 7 aa, Entamoeba dispar
ITELPSE

SEQ ID NO: 2433005 - protein, 23 aa, Entamoeba dispar
ITEMRKGQSVETKEAESQYETLK

SEQ ID NO: 2433006 - protein, 10 aa, Entamoeba dispar
ITENKNYDGS

SEQ ID NO: 2433007 - protein, 7 aa, Entamoeba dispar
ITEPKPV

SEQ ID NO: 2433008 - protein, 5 aa, Entamoeba dispar
ITEPS

SEQ ID NO: 2433009 - protein, 7 aa, Entamoeba dispar
ITESDIT

SEQ ID NO: 2433010 - protein, 7 aa, Entamoeba dispar
ITESTNL

SEQ ID NO: 2433011 - protein, 40 aa, Entamoeba dispar
ITETKDKVEKKMSKKKTNTKKPRRVVKKPKTTKKAKKPLS

SEQ ID NO: 2433012 - protein, 7 aa, Entamoeba dispar
ITETPTG

SEQ ID NO: 2433013 - protein, 5 aa, Entamoeba dispar
ITETQ

SEQ ID NO: 2433014 - protein, 11 aa, Entamoeba dispar
ITEVKESAARE

SEQ ID NO: 2433015 - protein, 8 aa, Entamoeba dispar
ITGDSSTI

SEQ ID NO: 2433016 - protein, 7 aa, Entamoeba dispar
ITGEDGE

SEQ ID NO: 2433017 - protein, 9 aa, Entamoeba dispar
ITGETEAEF

SEQ ID NO: 2433018 - protein, 8 aa, Entamoeba dispar
ITGETPSI

SEQ ID NO: 2433019 - protein, 5 aa, Entamoeba dispar
ITGGD

SEQ ID NO: 2433020 - protein, 7 aa, Entamoeba dispar
ITGGNNV

SEQ ID NO: 2433021 - protein, 10 aa, Entamoeba dispar
ITGGPNGDVA

SEQ ID NO: 2433022 - protein, 6 aa, Entamoeba dispar
ITGKNH

SEQ ID NO: 2433023 - protein, 5 aa, Entamoeba dispar
ITGKT

SEQ ID NO: 2433024 - protein, 5 aa, Entamoeba dispar
ITGNH

SEQ ID NO: 2433025 - protein, 22 aa, Entamoeba dispar
ITGNNQSQQQPYSYGTGPMFPS

SEQ ID NO: 2433026 - protein, 10 aa, Entamoeba dispar
ITGSGTRLNT

SEQ ID NO: 2433027 - protein, 6 aa, Entamoeba dispar
ITGTGK

SEQ ID NO: 2433028 - protein, 13 aa, Entamoeba dispar
ITGTTPAPGFFKH

SEQ ID NO: 2433029 - protein, 9 aa, Entamoeba dispar
ITHEEEQEI

SEQ ID NO: 2433030 - protein, 9 aa, Entamoeba dispar
ITHGSSSQI

SEQ ID NO: 2433031 - protein, 27 aa, Entamoeba dispar
ITIDDSVPNPPQPKRIQTKNETGFQTA

SEQ ID NO: 2433032 - protein, 8 aa, Entamoeba dispar
ITIDNKGH

SEQ ID NO: 2433033 - protein, 11 aa, Entamoeba dispar
ITIDPKEKAKL

SEQ ID NO: 2433034 - protein, 29 aa, Entamoeba dispar
ITIEQQDKQKTYDLSTESLNSKVTTESFG

SEQ ID NO: 2433035 - protein, 8 aa, Entamoeba dispar
ITIPPEVK

SEQ ID NO: 2433036 - protein, 5 aa, Entamoeba dispar
ITIPS

SEQ ID NO: 2433037 - protein, 10 aa, Entamoeba dispar
ITIPSSISEI

SEQ ID NO: 2433038 - protein, 11 aa, Entamoeba dispar
ITIPSSVSEID

SEQ ID NO: 2433039 - protein, 6 aa, Entamoeba dispar
ITIPST

SEQ ID NO: 2433040 - protein, 7 aa, Entamoeba dispar
ITIPSTV

SEQ ID NO: 2433041 - protein, 6 aa, Entamoeba dispar
ITIPTS

SEQ ID NO: 2433042 - protein, 26 aa, Entamoeba dispar
ITISEPKPIETEKPIEEKKKTENRTI

SEQ ID NO: 2433043 - protein, 9 aa, Entamoeba dispar
ITISKDKKA

SEQ ID NO: 2433044 - protein, 12 aa, Entamoeba dispar
ITITTKDQTGKA

SEQ ID NO: 2433045 - protein, 10 aa, Entamoeba dispar
ITKASTNGVS

SEQ ID NO: 2433046 - protein, 31 aa, Entamoeba dispar
ITKDKQRELKKEMNEKGIDVNNDKNESSQEV

SEQ ID NO: 2433047 - protein, 12 aa, Entamoeba dispar
ITKDNSKIKQKP

SEQ ID NO: 2433048 - protein, 7 aa, Entamoeba dispar
ITKDSRQ

SEQ ID NO: 2433049 - protein, 7 aa, Entamoeba dispar
ITKDTIS

SEQ ID NO: 2433050 - protein, 4 aa, Entamoeba dispar
ITKE

SEQ ID NO: 2433051 - protein, 11 aa, Entamoeba dispar
ITKEEAEGYAR

SEQ ID NO: 2433052 - protein, 9 aa, Entamoeba dispar
ITKEENLNK

SEQ ID NO: 2433053 - protein, 8 aa, Entamoeba dispar
ITKEGESG

SEQ ID NO: 2433054 - protein, 9 aa, Entamoeba dispar
ITKEGGNTY

SEQ ID NO: 2433055 - protein, 7 aa, Entamoeba dispar
ITKEKDK

SEQ ID NO: 2433056 - protein, 5 aa, Entamoeba dispar
ITKEN

SEQ ID NO: 2433057 - protein, 17 aa, Entamoeba dispar
ITKESQVNKELAQSRKV

SEQ ID NO: 2433058 - protein, 13 aa, Entamoeba dispar
ITKESSKNAEKCK

SEQ ID NO: 2433059 - protein, 7 aa, Entamoeba dispar
ITKETPH

SEQ ID NO: 2433060 - protein, 9 aa, Entamoeba dispar
ITKGPQTEL

SEQ ID NO: 2433061 - protein, 6 aa, Entamoeba dispar
ITKGTS

SEQ ID NO: 2433062 - protein, 6 aa, Entamoeba dispar
ITKISQ

SEQ ID NO: 2433063 - protein, 8 aa, Entamoeba dispar
ITKKSKGF

SEQ ID NO: 2433064 - protein, 6 aa, Entamoeba dispar
ITKNEE

SEQ ID NO: 2433065 - protein, 10 aa, Entamoeba dispar
ITKNENKEKY

SEQ ID NO: 2433066 - protein, 8 aa, Entamoeba dispar
ITKNNRFK

SEQ ID NO: 2433067 - protein, 4 aa, Entamoeba dispar
ITKQ

SEQ ID NO: 2433068 - protein, 5 aa, Entamoeba dispar
ITKQV

SEQ ID NO: 2433069 - protein, 11 aa, Entamoeba dispar
ITKRASDPGLI

SEQ ID NO: 2433070 - protein, 23 aa, Entamoeba dispar
ITKRKKKVTKKDNQECKEQDNNH

SEQ ID NO: 2433071 - protein, 10 aa, Entamoeba dispar
ITKSKTEPTL

SEQ ID NO: 2433072 - protein, 8 aa, Entamoeba dispar
ITKSRDNR

SEQ ID NO: 2433073 - protein, 10 aa, Entamoeba dispar
ITKTDDVVTS

SEQ ID NO: 2433074 - protein, 20 aa, Entamoeba dispar
ITKTEDNGKKKKKEKIDEEN

SEQ ID NO: 2433075 - protein, 5 aa, Entamoeba dispar
ITKYE

SEQ ID NO: 2433076 - protein, 6 aa, Entamoeba dispar
ITKYSE

SEQ ID NO: 2433077 - protein, 6 aa, Entamoeba dispar
ITLNEP

SEQ ID NO: 2433078 - protein, 12 aa, Entamoeba dispar
ITLQPKKLEEEI

SEQ ID NO: 2433079 - protein, 6 aa, Entamoeba dispar
ITLSEP

SEQ ID NO: 2433080 - protein, 6 aa, Entamoeba dispar
ITMPKN

SEQ ID NO: 2433081 - protein, 10 aa, Entamoeba dispar
ITNASYSNND

SEQ ID NO: 2433082 - protein, 9 aa, Entamoeba dispar
ITNDDANTV

SEQ ID NO: 2433083 - protein, 9 aa, Entamoeba dispar
ITNDRKKKA

SEQ ID NO: 2433084 - protein, 6 aa, Entamoeba dispar
ITNEDI

SEQ ID NO: 2433085 - protein, 27 aa, Entamoeba dispar
ITNEENKNIKEEDNKNSTKESTQPIEM

SEQ ID NO: 2433086 - protein, 6 aa, Entamoeba dispar
ITNEER

SEQ ID NO: 2433087 - protein, 12 aa, Entamoeba dispar
ITNESGYTFSDG

SEQ ID NO: 2433088 - protein, 9 aa, Entamoeba dispar
ITNGETKVG

SEQ ID NO: 2433089 - protein, 9 aa, Entamoeba dispar
ITNISGAPS

SEQ ID NO: 2433090 - protein, 15 aa, Entamoeba dispar
ITNKDSRKKRILDLL

SEQ ID NO: 2433091 - protein, 10 aa, Entamoeba dispar
ITNKEKKMPI

SEQ ID NO: 2433092 - protein, 20 aa, Entamoeba dispar
ITNKKNETAYDIAQTKGNGL

SEQ ID NO: 2433093 - protein, 5 aa, Entamoeba dispar
ITNLK

SEQ ID NO: 2433094 - protein, 6 aa, Entamoeba dispar
ITNNSI

SEQ ID NO: 2433095 - protein, 11 aa, Entamoeba dispar
ITNNTNETIEK

SEQ ID NO: 2433096 - protein, 26 aa, Entamoeba dispar
ITNPCDDSKSSPYENHSNKRDEDEII

SEQ ID NO: 2433097 - protein, 9 aa, Entamoeba dispar
ITNPQVKTE

SEQ ID NO: 2433098 - protein, 6 aa, Entamoeba dispar
ITNPTK

SEQ ID NO: 2433099 - protein, 10 aa, Entamoeba dispar
ITNQAKDVPT

SEQ ID NO: 2433100 - protein, 9 aa, Entamoeba dispar
ITNQPSWNE

SEQ ID NO: 2433101 - protein, 10 aa, Entamoeba dispar
ITNQQEYPNQ

SEQ ID NO: 2433102 - protein, 10 aa, Entamoeba dispar
ITNRGKQSIE

SEQ ID NO: 2433103 - protein, 4 aa, Entamoeba dispar
ITNS

SEQ ID NO: 2433104 - protein, 10 aa, Entamoeba dispar
ITNSNKERLG

SEQ ID NO: 2433105 - protein, 12 aa, Entamoeba dispar
ITNSQRDENYQN

SEQ ID NO: 2433106 - protein, 10 aa, Entamoeba dispar
ITNSSNVDYS

SEQ ID NO: 2433107 - protein, 4 aa, Entamoeba dispar
ITNT

SEQ ID NO: 2433108 - protein, 18 aa, Entamoeba dispar
ITNTAKRHFNEETQTPKV

SEQ ID NO: 2433109 - protein, 5 aa, Entamoeba dispar
ITNTI

SEQ ID NO: 2433110 - protein, 14 aa, Entamoeba dispar
ITNTPSKSDPKKFN

SEQ ID NO: 2433111 - protein, 6 aa, Entamoeba dispar
ITNYSP

SEQ ID NO: 2433112 - protein, 28 aa, Entamoeba dispar
ITNYSQQGGNDNHPTNNTNKQNNSSKIS

SEQ ID NO: 2433113 - protein, 25 aa, Entamoeba dispar
ITPANGSNTNKCVNENKSHKNGKLK

SEQ ID NO: 2433114 - protein, 32 aa, Entamoeba dispar
ITPAYTPYSNPGQPQQQPKKPSSGGYGGFFNY

SEQ ID NO: 2433115 - protein, 5 aa, Entamoeba dispar
ITPDD

SEQ ID NO: 2433116 - protein, 5 aa, Entamoeba dispar
ITPEA

SEQ ID NO: 2433117 - protein, 5 aa, Entamoeba dispar
ITPEE

SEQ ID NO: 2433118 - protein, 7 aa, Entamoeba dispar
ITPEEQE

SEQ ID NO: 2433119 - protein, 14 aa, Entamoeba dispar
ITPEKEKVQDERTF

SEQ ID NO: 2433120 - protein, 9 aa, Entamoeba dispar
ITPEMPKSI

SEQ ID NO: 2433121 - protein, 7 aa, Entamoeba dispar
ITPENDS

SEQ ID NO: 2433122 - protein, 11 aa, Entamoeba dispar
ITPENNPSDPT

SEQ ID NO: 2433123 - protein, 11 aa, Entamoeba dispar
ITPEQADGTAV

SEQ ID NO: 2433124 - protein, 10 aa, Entamoeba dispar
ITPETEQNKL

SEQ ID NO: 2433125 - protein, 5 aa, Entamoeba dispar
ITPGT

SEQ ID NO: 2433126 - protein, 9 aa, Entamoeba dispar
ITPGTTAAQ

SEQ ID NO: 2433127 - protein, 4 aa, Entamoeba dispar
ITPI

SEQ ID NO: 2433128 - protein, 16 aa, Entamoeba dispar
ITPKEKKSNTSKTERR

SEQ ID NO: 2433129 - protein, 9 aa, Entamoeba dispar
ITPKISGSF

SEQ ID NO: 2433130 - protein, 13 aa, Entamoeba dispar
ITPKRDNAQREME

SEQ ID NO: 2433131 - protein, 13 aa, Entamoeba dispar
ITPLDEEKNKEIV

SEQ ID NO: 2433132 - protein, 23 aa, Entamoeba dispar
  misc_feature (21)..(22): Xaa can be any naturally occurring amino acid
ITPNDPVTPEEKHKRELVCYXXM

SEQ ID NO: 2433133 - protein, 11 aa, Entamoeba dispar
ITPNGKTDCTN

SEQ ID NO: 2433134 - protein, 10 aa, Entamoeba dispar
ITPPHAPGPV

SEQ ID NO: 2433135 - protein, 12 aa, Entamoeba dispar
ITPPSSKTPQVI

SEQ ID NO: 2433136 - protein, 9 aa, Entamoeba dispar
ITPQDQEQY

SEQ ID NO: 2433137 - protein, 10 aa, Entamoeba dispar
ITPQKTKKEI

SEQ ID NO: 2433138 - protein, 6 aa, Entamoeba dispar
ITPQNT

SEQ ID NO: 2433139 - protein, 30 aa, Entamoeba dispar
ITPSFSRQTQQHTQSDLDKQKDKQKREELL

SEQ ID NO: 2433140 - protein, 5 aa, Entamoeba dispar
ITPSI

SEQ ID NO: 2433141 - protein, 8 aa, Entamoeba dispar
ITPSNPDQ

SEQ ID NO: 2433142 - protein, 9 aa, Entamoeba dispar
ITPSNSPVI

SEQ ID NO: 2433143 - protein, 13 aa, Entamoeba dispar
ITPSVQMSGPTNF

SEQ ID NO: 2433144 - protein, 4 aa, Entamoeba dispar
ITPT

SEQ ID NO: 2433145 - protein, 6 aa, Entamoeba dispar
ITPTNS

SEQ ID NO: 2433146 - protein, 15 aa, Entamoeba dispar
ITPTPIKRETQTTDV

SEQ ID NO: 2433147 - protein, 17 aa, Entamoeba dispar
ITPTSFASQSDNNPSQI

SEQ ID NO: 2433148 - protein, 9 aa, Entamoeba dispar
ITPTTHQSV

SEQ ID NO: 2433149 - protein, 7 aa, Entamoeba dispar
ITQDGND

SEQ ID NO: 2433150 - protein, 9 aa, Entamoeba dispar
ITQDSQRNF

SEQ ID NO: 2433151 - protein, 8 aa, Entamoeba dispar
ITQEASIK

SEQ ID NO: 2433152 - protein, 18 aa, Entamoeba dispar
ITQEEKKPKTDNVSKERV

SEQ ID NO: 2433153 - protein, 5 aa, Entamoeba dispar
ITQGK

SEQ ID NO: 2433154 - protein, 4 aa, Entamoeba dispar
ITQI

SEQ ID NO: 2433155 - protein, 6 aa, Entamoeba dispar
ITQKET

SEQ ID NO: 2433156 - protein, 13 aa, Entamoeba dispar
ITQLNEKEKQMNE

SEQ ID NO: 2433157 - protein, 18 aa, Entamoeba dispar
ITQNGNYTIKTPPNYDGI

SEQ ID NO: 2433158 - protein, 6 aa, Entamoeba dispar
ITQPEA

SEQ ID NO: 2433159 - protein, 9 aa, Entamoeba dispar
ITQPQQSRK

SEQ ID NO: 2433160 - protein, 23 aa, Entamoeba dispar
ITQPTQKEEKSSTNQKQENPIKE

SEQ ID NO: 2433161 - protein, 10 aa, Entamoeba dispar
ITQRGEPSTV

SEQ ID NO: 2433162 - protein, 13 aa, Entamoeba dispar
ITQRHKNSNWARQ

SEQ ID NO: 2433163 - protein, 17 aa, Entamoeba dispar
ITQRTRQQSSSNRKIDS

SEQ ID NO: 2433164 - protein, 8 aa, Entamoeba dispar
ITQSDISD

SEQ ID NO: 2433165 - protein, 5 aa, Entamoeba dispar
ITQSG

SEQ ID NO: 2433166 - protein, 5 aa, Entamoeba dispar
ITQSK

SEQ ID NO: 2433167 - protein, 8 aa, Entamoeba dispar
ITQTEENE

SEQ ID NO: 2433168 - protein, 6 aa, Entamoeba dispar
ITQTQA

SEQ ID NO: 2433169 - protein, 5 aa, Entamoeba dispar
ITREE

SEQ ID NO: 2433170 - protein, 10 aa, Entamoeba dispar
ITREEENAIE

SEQ ID NO: 2433171 - protein, 8 aa, Entamoeba dispar
ITREKSRT

SEQ ID NO: 2433172 - protein, 9 aa, Entamoeba dispar
ITRGETDKY

SEQ ID NO: 2433173 - protein, 6 aa, Entamoeba dispar
ITRGSS

SEQ ID NO: 2433174 - protein, 12 aa, Entamoeba dispar
ITRNNNKQVKEK

SEQ ID NO: 2433175 - protein, 14 aa, Entamoeba dispar
ITRPASKSSNDRLT

SEQ ID NO: 2433176 - protein, 22 aa, Entamoeba dispar
ITRTSPRMSPATPGYAQLEPEL

SEQ ID NO: 2433177 - protein, 14 aa, Entamoeba dispar
ITSCPTTSLPFPPT

SEQ ID NO: 2433178 - protein, 6 aa, Entamoeba dispar
ITSDDS

SEQ ID NO: 2433179 - protein, 8 aa, Entamoeba dispar
ITSDENKD

SEQ ID NO: 2433180 - protein, 25 aa, Entamoeba dispar
ITSDETNNEEEKERKIENKEKEEVN

SEQ ID NO: 2433181 - protein, 10 aa, Entamoeba dispar
ITSDSLTGSH

SEQ ID NO: 2433182 - protein, 10 aa, Entamoeba dispar
ITSDTTKIEI

SEQ ID NO: 2433183 - protein, 12 aa, Entamoeba dispar
ITSEEQCFKKFF

SEQ ID NO: 2433184 - protein, 10 aa, Entamoeba dispar
ITSEGTNKTM

SEQ ID NO: 2433185 - protein, 8 aa, Entamoeba dispar
ITSETENI

SEQ ID NO: 2433186 - protein, 8 aa, Entamoeba dispar
ITSGNEKI

SEQ ID NO: 2433187 - protein, 14 aa, Entamoeba dispar
ITSGNRNRSSNDLM

SEQ ID NO: 2433188 - protein, 18 aa, Entamoeba dispar
ITSIASTESINRVNQEKR

SEQ ID NO: 2433189 - protein, 5 aa, Entamoeba dispar
ITSIP

SEQ ID NO: 2433190 - protein, 11 aa, Entamoeba dispar
ITSKDNKINEL

SEQ ID NO: 2433191 - protein, 8 aa, Entamoeba dispar
ITSKENKM

SEQ ID NO: 2433192 - protein, 8 aa, Entamoeba dispar
ITSKGITQ

SEQ ID NO: 2433193 - protein, 9 aa, Entamoeba dispar
ITSKPEESL

SEQ ID NO: 2433194 - protein, 21 aa, Entamoeba dispar
ITSNEKLKNERFEDVPQEESA

SEQ ID NO: 2433195 - protein, 9 aa, Entamoeba dispar
ITSNGGIQE

SEQ ID NO: 2433196 - protein, 12 aa, Entamoeba dispar
ITSNNIKQETSN

SEQ ID NO: 2433197 - protein, 11 aa, Entamoeba dispar
ITSNNSDPSLR

SEQ ID NO: 2433198 - protein, 7 aa, Entamoeba dispar
ITSNQPQ

SEQ ID NO: 2433199 - protein, 10 aa, Entamoeba dispar
ITSNRNGNLN

SEQ ID NO: 2433200 - protein, 5 aa, Entamoeba dispar
ITSNT

SEQ ID NO: 2433201 - protein, 8 aa, Entamoeba dispar
ITSNTLEA

SEQ ID NO: 2433202 - protein, 4 aa, Entamoeba dispar
ITSP

SEQ ID NO: 2433203 - protein, 6 aa, Entamoeba dispar
ITSPFT

SEQ ID NO: 2433204 - protein, 29 aa, Entamoeba dispar
ITSPKQKHIPSEPVHRTSKSYTNSLSPQQ

SEQ ID NO: 2433205 - protein, 6 aa, Entamoeba dispar
ITSPSS

SEQ ID NO: 2433206 - protein, 7 aa, Entamoeba dispar
ITSPSTV

SEQ ID NO: 2433207 - protein, 6 aa, Entamoeba dispar
ITSQNT

SEQ ID NO: 2433208 - protein, 12 aa, Entamoeba dispar
ITSSCTSNQPLT

SEQ ID NO: 2433209 - protein, 13 aa, Entamoeba dispar
ITSSDISDKVSSS

SEQ ID NO: 2433210 - protein, 6 aa, Entamoeba dispar
ITSSIE

SEQ ID NO: 2433211 - protein, 10 aa, Entamoeba dispar
ITSSKTNHFS

SEQ ID NO: 2433212 - protein, 6 aa, Entamoeba dispar
ITSSNG

SEQ ID NO: 2433213 - protein, 17 aa, Entamoeba dispar
ITSSPTNTMKPGSGAAL

SEQ ID NO: 2433214 - protein, 7 aa, Entamoeba dispar
ITSSSLT

SEQ ID NO: 2433215 - protein, 7 aa, Entamoeba dispar
ITSSSPV

SEQ ID NO: 2433216 - protein, 6 aa, Entamoeba dispar
ITSSST

SEQ ID NO: 2433217 - protein, 61 aa, Entamoeba dispar
ITSSTGVKLEEEPKRKKLHQKKSISKTMKDLSTNGSFSSLSRHKTSNDIHGTVSPRGDNDK

SEQ ID NO: 2433218 - protein, 4 aa, Entamoeba dispar
ITST

SEQ ID NO: 2433219 - protein, 8 aa, Entamoeba dispar
ITSTNETE

SEQ ID NO: 2433220 - protein, 7 aa, Entamoeba dispar
ITSTQNR

SEQ ID NO: 2433221 - protein, 14 aa, Entamoeba dispar
ITSVPKPETIHTTT

SEQ ID NO: 2433222 - protein, 12 aa, Entamoeba dispar
ITTCESEKYGKL

SEQ ID NO: 2433223 - protein, 4 aa, Entamoeba dispar
ITTE

SEQ ID NO: 2433224 - protein, 55 aa, Entamoeba dispar
ITTEMSDTSSNNNTTSVGSPCNTTTHNTSSNNTTTISRKNVPIKGSKRFESHEKG

SEQ ID NO: 2433225 - protein, 16 aa, Entamoeba dispar
ITTENEETAKRSEEIA

SEQ ID NO: 2433226 - protein, 10 aa, Entamoeba dispar
ITTESSKDLT

SEQ ID NO: 2433227 - protein, 9 aa, Entamoeba dispar
ITTGKRPTI

SEQ ID NO: 2433228 - protein, 8 aa, Entamoeba dispar
ITTGQYDY

SEQ ID NO: 2433229 - protein, 5 aa, Entamoeba dispar
ITTGY

SEQ ID NO: 2433230 - protein, 5 aa, Entamoeba dispar
ITTIN

SEQ ID NO: 2433231 - protein, 17 aa, Entamoeba dispar
ITTKEGMEIDDDAKKSI

SEQ ID NO: 2433232 - protein, 5 aa, Entamoeba dispar
ITTKP

SEQ ID NO: 2433233 - protein, 13 aa, Entamoeba dispar
ITTKTQNKLQETM

SEQ ID NO: 2433234 - protein, 4 aa, Entamoeba dispar
ITTM

SEQ ID NO: 2433235 - protein, 4 aa, Entamoeba dispar
ITTN

SEQ ID NO: 2433236 - protein, 5 aa, Entamoeba dispar
ITTNP

SEQ ID NO: 2433237 - protein, 11 aa, Entamoeba dispar
ITTNPNNDELK

SEQ ID NO: 2433238 - protein, 12 aa, Entamoeba dispar
ITTPARPIPSKK

SEQ ID NO: 2433239 - protein, 5 aa, Entamoeba dispar
ITTPE

SEQ ID NO: 2433240 - protein, 8 aa, Entamoeba dispar
ITTPNEVQ

SEQ ID NO: 2433241 - protein, 11 aa, Entamoeba dispar
ITTPPKPGFSQ

SEQ ID NO: 2433242 - protein, 10 aa, Entamoeba dispar
ITTPSSQINN

SEQ ID NO: 2433243 - protein, 13 aa, Entamoeba dispar
ITTPTTNPKLSQS

SEQ ID NO: 2433244 - protein, 10 aa, Entamoeba dispar
ITTQGGKSKS

SEQ ID NO: 2433245 - protein, 12 aa, Entamoeba dispar
ITTRKEKIGKSF

SEQ ID NO: 2433246 - protein, 10 aa, Entamoeba dispar
ITTSENGDDT

SEQ ID NO: 2433247 - protein, 16 aa, Entamoeba dispar
ITTSSDPKDKQQPSKE

SEQ ID NO: 2433248 - protein, 16 aa, Entamoeba dispar
ITTSSTQTTTEKKPTL

SEQ ID NO: 2433249 - protein, 13 aa, Entamoeba dispar
ITTSTSKVATRNN

SEQ ID NO: 2433250 - protein, 18 aa, Entamoeba dispar
ITTTDDDIKTLDKKEGEF

SEQ ID NO: 2433251 - protein, 5 aa, Entamoeba dispar
ITTTN

SEQ ID NO: 2433252 - protein, 6 aa, Entamoeba dispar
ITTTNK

SEQ ID NO: 2433253 - protein, 11 aa, Entamoeba dispar
ITTTTEHPFES

SEQ ID NO: 2433254 - protein, 16 aa, Entamoeba dispar
ITVPPNNNEVYKKPDP

SEQ ID NO: 2433255 - protein, 31 aa, Entamoeba dispar
ITVQSGKKIRIADEDSEDDPEVLANNWNTGN

SEQ ID NO: 2433256 - protein, 36 aa, Entamoeba dispar
ITVQSGKKIRIADEDSEEEESEDDPDALANNWNTGN

SEQ ID NO: 2433257 - protein, 36 aa, Entamoeba dispar
ITVQSGKKIRIADEDSEIEESEDDPDALANNWNTGN

SEQ ID NO: 2433258 - protein, 37 aa, Entamoeba dispar
ITVQSGKKIRIADEDSSEIEESEDDPDALVNNWNTGN

SEQ ID NO: 2433259 - protein, 37 aa, Entamoeba dispar
ITVQSGKKIRIADEDSSEVEESEDDPDALVNNWNTGN

SEQ ID NO: 2433260 - protein, 11 aa, Entamoeba dispar
ITVSKEPSDVP

SEQ ID NO: 2433261 - protein, 5 aa, Entamoeba dispar
ITYEG

SEQ ID NO: 2433262 - protein, 5 aa, Entamoeba dispar
ITYGN

SEQ ID NO: 2433263 - protein, 5 aa, Entamoeba dispar
ITYSI

SEQ ID NO: 2433264 - protein, 8 aa, Entamoeba dispar
ITYSTEED

SEQ ID NO: 2433265 - protein, 6 aa, Entamoeba dispar
IVATKN

SEQ ID NO: 2433266 - protein, 12 aa, Entamoeba dispar
IVDDPKEISMSG

SEQ ID NO: 2433267 - protein, 8 aa, Entamoeba dispar
IVDGSSNG

SEQ ID NO: 2433268 - protein, 5 aa, Entamoeba dispar
IVEGT

SEQ ID NO: 2433269 - protein, 8 aa, Entamoeba dispar
IVGESNGK

SEQ ID NO: 2433270 - protein, 10 aa, Entamoeba dispar
IVGGKGDEEE

SEQ ID NO: 2433271 - protein, 39 aa, Entamoeba dispar
IVGPNASHQSSISKAERRNERREDRREDRNNFEDPSSVN

SEQ ID NO: 2433272 - protein, 12 aa, Entamoeba dispar
IVHKEGTSIVLN

SEQ ID NO: 2433273 - protein, 25 aa, Entamoeba dispar
IVKEKKREETSRNNGISQSTSIQPP

SEQ ID NO: 2433274 - protein, 6 aa, Entamoeba dispar
IVNDTD

SEQ ID NO: 2433275 - protein, 11 aa, Entamoeba dispar
IVNGNGSGSIS

SEQ ID NO: 2433276 - protein, 7 aa, Entamoeba dispar
IVNGNSD

SEQ ID NO: 2433277 - protein, 10 aa, Entamoeba dispar
IVNGTDDDMT

SEQ ID NO: 2433278 - protein, 8 aa, Entamoeba dispar
IVPENGRK

SEQ ID NO: 2433279 - protein, 77 aa, Entamoeba dispar
IVPKPVSSTNSIQPPTKSSSYKTSYGSDTNSSPRTKSSTDSPYSSQTNEQKKEEPKPVIKKEEPKPVIKKEEPKTII

SEQ ID NO: 2433280 - protein, 9 aa, Entamoeba dispar
IVPPNPVPQ

SEQ ID NO: 2433281 - protein, 15 aa, Entamoeba dispar
IVPPSLPNIPPPQRK

SEQ ID NO: 2433282 - protein, 6 aa, Entamoeba dispar
IVPRAS

SEQ ID NO: 2433283 - protein, 20 aa, Entamoeba dispar
IVQPPPTKVSLKTNSSENEE

SEQ ID NO: 2433284 - protein, 7 aa, Entamoeba dispar
IVSENDL

SEQ ID NO: 2433285 - protein, 17 aa, Entamoeba dispar
IVSGNNFGGKFTESSEG

SEQ ID NO: 2433286 - protein, 10 aa, Entamoeba dispar
IVSKEKEKME

SEQ ID NO: 2433287 - protein, 6 aa, Entamoeba dispar
IVSKTK

SEQ ID NO: 2433288 - protein, 13 aa, Entamoeba dispar
IVSQSSRESPKKT

SEQ ID NO: 2433289 - protein, 34 aa, Entamoeba dispar
IVSSSSKDASSTSFFNSSDQDEEVNPFNSFNPQW

SEQ ID NO: 2433290 - protein, 6 aa, Entamoeba dispar
IVSSST

SEQ ID NO: 2433291 - protein, 9 aa, Entamoeba dispar
IVTGSSDRK

SEQ ID NO: 2433292 - protein, 4 aa, Entamoeba dispar
IVTR

SEQ ID NO: 2433293 - protein, 20 aa, Entamoeba dispar
IVTRNKSNDSLRKVGREERM

SEQ ID NO: 2433294 - protein, 6 aa, Entamoeba dispar
IVTSDM

SEQ ID NO: 2433295 - protein, 10 aa, Entamoeba dispar
IVTSNTNDLS

SEQ ID NO: 2433296 - protein, 22 aa, Entamoeba dispar
IVTSRKTRSPRKRVNKNERSTG

SEQ ID NO: 2433297 - protein, 4 aa, Entamoeba dispar
IWTD

SEQ ID NO: 2433298 - protein, 8 aa, Entamoeba dispar
IYADNTED

SEQ ID NO: 2433299 - protein, 10 aa, Entamoeba dispar
IYADNTEDEF

SEQ ID NO: 2433300 - protein, 10 aa, Entamoeba dispar
IYDEPGNNFK

SEQ ID NO: 2433301 - protein, 11 aa, Entamoeba dispar
IYDPDQQITNI

SEQ ID NO: 2433302 - protein, 11 aa, Entamoeba dispar
IYEEKNEQDSC

SEQ ID NO: 2433303 - protein, 18 aa, Entamoeba dispar
IYGAPTQTQEINDDDHKK

SEQ ID NO: 2433304 - protein, 11 aa, Entamoeba dispar
IYGDEKNGDVV

SEQ ID NO: 2433305 - protein, 9 aa, Entamoeba dispar
IYGGQNIED

SEQ ID NO: 2433306 - protein, 4 aa, Entamoeba dispar
IYGP

SEQ ID NO: 2433307 - protein, 13 aa, Entamoeba dispar
IYKGEGKRINEEG

SEQ ID NO: 2433308 - protein, 23 aa, Entamoeba dispar
IYNGDGKGKPYGPAYGTKKNGHN

SEQ ID NO: 2433309 - protein, 18 aa, Entamoeba dispar
IYNGNVGSSVLPGGDTAK

SEQ ID NO: 2433310 - protein, 4 aa, Entamoeba dispar
IYNN

SEQ ID NO: 2433311 - protein, 12 aa, Entamoeba dispar
IYPTSYPSDPSM

SEQ ID NO: 2433312 - protein, 4 aa, Entamoeba dispar
IYQE

SEQ ID NO: 2433313 - protein, 8 aa, Entamoeba dispar
IYQKRENE

SEQ ID NO: 2433314 - protein, 10 aa, Entamoeba dispar
IYSDDDKPLE

SEQ ID NO: 2433315 - protein, 9 aa, Entamoeba dispar
IYSDSPKVQ

SEQ ID NO: 2433316 - protein, 8 aa, Entamoeba dispar
IYSKNNRD

SEQ ID NO: 2433317 - protein, 9 aa, Entamoeba dispar
IYSPPTGRW

SEQ ID NO: 2433318 - protein, 12 aa, Entamoeba dispar
IYSPSNNLAAVS

SEQ ID NO: 2433319 - protein, 7 aa, Entamoeba dispar
IYSTGDS

SEQ ID NO: 2433320 - protein, 4 aa, Entamoeba dispar
IYTG

SEQ ID NO: 2433321 - protein, 11 aa, Entamoeba dispar
KAADPTRSYAS

SEQ ID NO: 2433322 - protein, 10 aa, Entamoeba dispar
KAAELSKNKR

SEQ ID NO: 2433323 - protein, 13 aa, Entamoeba dispar
KAAETRISPGEGL

SEQ ID NO: 2433324 - protein, 5 aa, Entamoeba dispar
KAAGE

SEQ ID NO: 2433325 - protein, 11 aa, Entamoeba dispar
KAAKANETEHT

SEQ ID NO: 2433326 - protein, 16 aa, Entamoeba dispar
KAAKRTAKKHNKITDG

SEQ ID NO: 2433327 - protein, 11 aa, Entamoeba dispar
KAAKRYIKRAS

SEQ ID NO: 2433328 - protein, 13 aa, Entamoeba dispar
KAALSPEEQKLYD

SEQ ID NO: 2433329 - protein, 6 aa, Entamoeba dispar
KAAPNR

SEQ ID NO: 2433330 - protein, 12 aa, Entamoeba dispar
KAAQEENEKRVE

SEQ ID NO: 2433331 - protein, 10 aa, Entamoeba dispar
KADAESGRDA

SEQ ID NO: 2433332 - protein, 6 aa, Entamoeba dispar
KADECN

SEQ ID NO: 2433333 - protein, 9 aa, Entamoeba dispar
KADEMSEDD

SEQ ID NO: 2433334 - protein, 6 aa, Entamoeba dispar
KADFQN

SEQ ID NO: 2433335 - protein, 13 aa, Entamoeba dispar
KADGGKKKIRINK

SEQ ID NO: 2433336 - protein, 28 aa, Entamoeba dispar
KADGKKKVPSSKPPKLPSSIKPEQKNKV

SEQ ID NO: 2433337 - protein, 26 aa, Entamoeba dispar
KADKKEAKISSKAIKDVKQNAKKADL

SEQ ID NO: 2433338 - protein, 15 aa, Entamoeba dispar
KADKKEKIVQRSEGI

SEQ ID NO: 2433339 - protein, 4 aa, Entamoeba dispar
KADL

SEQ ID NO: 2433340 - protein, 20 aa, Entamoeba dispar
KADLEQKISDETIQAKAKEL

SEQ ID NO: 2433341 - protein, 4 aa, Entamoeba dispar
KADM

SEQ ID NO: 2433342 - protein, 12 aa, Entamoeba dispar
KADMEKKVEESV

SEQ ID NO: 2433343 - protein, 8 aa, Entamoeba dispar
KADNNQER

SEQ ID NO: 2433344 - protein, 6 aa, Entamoeba dispar
KADPER

SEQ ID NO: 2433345 - protein, 7 aa, Entamoeba dispar
KADPKRI

SEQ ID NO: 2433346 - protein, 32 aa, Entamoeba dispar
KADPYSSQQTGESKNYKEKKQNELKAKAGNQF

SEQ ID NO: 2433347 - protein, 5 aa, Entamoeba dispar
KADQK

SEQ ID NO: 2433348 - protein, 12 aa, Entamoeba dispar
KADRALKNERMN

SEQ ID NO: 2433349 - protein, 12 aa, Entamoeba dispar
KADRDESSPYAA

SEQ ID NO: 2433350 - protein, 8 aa, Entamoeba dispar
KADSAAEM

SEQ ID NO: 2433351 - protein, 14 aa, Entamoeba dispar
KADSKLLSNQPSLM

SEQ ID NO: 2433352 - protein, 9 aa, Entamoeba dispar
KADSKSPMN

SEQ ID NO: 2433353 - protein, 6 aa, Entamoeba dispar
KADSPF

SEQ ID NO: 2433354 - protein, 15 aa, Entamoeba dispar
KADSSQKSFKEETET

SEQ ID NO: 2433355 - protein, 23 aa, Entamoeba dispar
KAEAARIAKQKAEEIREEKELKE

SEQ ID NO: 2433356 - protein, 12 aa, Entamoeba dispar
KAEADDKMAKYK

SEQ ID NO: 2433357 - protein, 6 aa, Entamoeba dispar
KAEAKK

SEQ ID NO: 2433358 - protein, 4 aa, Entamoeba dispar
KAEC

SEQ ID NO: 2433359 - protein, 5 aa, Entamoeba dispar
KAEDI

SEQ ID NO: 2433360 - protein, 5 aa, Entamoeba dispar
KAEDS

SEQ ID NO: 2433361 - protein, 7 aa, Entamoeba dispar
KAEERIR

SEQ ID NO: 2433362 - protein, 5 aa, Entamoeba dispar
KAEFP

SEQ ID NO: 2433363 - protein, 6 aa, Entamoeba dispar
KAEIRA

SEQ ID NO: 2433364 - protein, 10 aa, Entamoeba dispar
KAEKEDPTNI

SEQ ID NO: 2433365 - protein, 9 aa, Entamoeba dispar
KAEKTIESK

SEQ ID NO: 2433366 - protein, 5 aa, Entamoeba dispar
KAELK

SEQ ID NO: 2433367 - protein, 9 aa, Entamoeba dispar
KAENDKADE

SEQ ID NO: 2433368 - protein, 9 aa, Entamoeba dispar
KAENKPDEV

SEQ ID NO: 2433369 - protein, 10 aa, Entamoeba dispar
KAENKPDEVQ

SEQ ID NO: 2433370 - protein, 5 aa, Entamoeba dispar
KAEPI

SEQ ID NO: 2433371 - protein, 7 aa, Entamoeba dispar
KAEQEQI

SEQ ID NO: 2433372 - protein, 6 aa, Entamoeba dispar
KAEQNK

SEQ ID NO: 2433373 - protein, 14 aa, Entamoeba dispar
KAESWEVRSGENEI

SEQ ID NO: 2433374 - protein, 9 aa, Entamoeba dispar
KAETNPKDL

SEQ ID NO: 2433375 - protein, 7 aa, Entamoeba dispar
KAETVDE

SEQ ID NO: 2433376 - protein, 20 aa, Entamoeba dispar
KAEYEEKGPSICRYNHVFVA

SEQ ID NO: 2433377 - protein, 8 aa, Entamoeba dispar
KAFDGKED

SEQ ID NO: 2433378 - protein, 8 aa, Entamoeba dispar
KAFDNQEA

SEQ ID NO: 2433379 - protein, 5 aa, Entamoeba dispar
KAFGK

SEQ ID NO: 2433380 - protein, 11 aa, Entamoeba dispar
KAFKQPADSIK

SEQ ID NO: 2433381 - protein, 6 aa, Entamoeba dispar
KAFKYE

SEQ ID NO: 2433382 - protein, 5 aa, Entamoeba dispar
KAFNA

SEQ ID NO: 2433383 - protein, 4 aa, Entamoeba dispar
KAFT

SEQ ID NO: 2433384 - protein, 4 aa, Entamoeba dispar
KAGF

SEQ ID NO: 2433385 - protein, 6 aa, Entamoeba dispar
KAGGCG

SEQ ID NO: 2433386 - protein, 9 aa, Entamoeba dispar
KAGGLSEEL

SEQ ID NO: 2433387 - protein, 9 aa, Entamoeba dispar
KAGGRMEDT

SEQ ID NO: 2433388 - protein, 6 aa, Entamoeba dispar
KAGGVG

SEQ ID NO: 2433389 - protein, 7 aa, Entamoeba dispar
KAGISRS

SEQ ID NO: 2433390 - protein, 10 aa, Entamoeba dispar
KAGKSNSSQN

SEQ ID NO: 2433391 - protein, 5 aa, Entamoeba dispar
KAGLM

SEQ ID NO: 2433392 - protein, 5 aa, Entamoeba dispar
KAGNN

SEQ ID NO: 2433393 - protein, 7 aa, Entamoeba dispar
KAGPKQY

SEQ ID NO: 2433394 - protein, 6 aa, Entamoeba dispar
KAGPNM

SEQ ID NO: 2433395 - protein, 7 aa, Entamoeba dispar
KAGPPVT

SEQ ID NO: 2433396 - protein, 22 aa, Entamoeba dispar
KAGQFQIDETRKTNDEIEEIST

SEQ ID NO: 2433397 - protein, 9 aa, Entamoeba dispar
KAGQPIQSL

SEQ ID NO: 2433398 - protein, 8 aa, Entamoeba dispar
KAGRTFND

SEQ ID NO: 2433399 - protein, 4 aa, Entamoeba dispar
KAGS

SEQ ID NO: 2433400 - protein, 5 aa, Entamoeba dispar
KAGSL

SEQ ID NO: 2433401 - protein, 7 aa, Entamoeba dispar
KAGSLTN

SEQ ID NO: 2433402 - protein, 6 aa, Entamoeba dispar
KAGYLA

SEQ ID NO: 2433403 - protein, 7 aa, Entamoeba dispar
KAGYTGK

SEQ ID NO: 2433404 - protein, 6 aa, Entamoeba dispar
KAGYYE

SEQ ID NO: 2433405 - protein, 20 aa, Entamoeba dispar
KAHDVRDATLRNDPSMALPP

SEQ ID NO: 2433406 - protein, 4 aa, Entamoeba dispar
KAHG

SEQ ID NO: 2433407 - protein, 13 aa, Entamoeba dispar
KAHHRASVGSRNE

SEQ ID NO: 2433408 - protein, 6 aa, Entamoeba dispar
KAHKEA

SEQ ID NO: 2433409 - protein, 6 aa, Entamoeba dispar
KAHTEK

SEQ ID NO: 2433410 - protein, 10 aa, Entamoeba dispar
KAIANRPKRC

SEQ ID NO: 2433411 - protein, 7 aa, Entamoeba dispar
KAIDETV

SEQ ID NO: 2433412 - protein, 13 aa, Entamoeba dispar
KAIEASKQKAEVA

SEQ ID NO: 2433413 - protein, 13 aa, Entamoeba dispar
KAIEDEDELTAKL

SEQ ID NO: 2433414 - protein, 12 aa, Entamoeba dispar
KAIELDPNYAKA

SEQ ID NO: 2433415 - protein, 5 aa, Entamoeba dispar
KAIGS

SEQ ID NO: 2433416 - protein, 37 aa, Entamoeba dispar
KAIKAGVKEATKEGIKESTKEIKKDIKKEVKANIKEE

SEQ ID NO: 2433417 - protein, 14 aa, Entamoeba dispar
KAIKTNDFSEGINK

SEQ ID NO: 2433418 - protein, 9 aa, Entamoeba dispar
KAINGEYSE

SEQ ID NO: 2433419 - protein, 10 aa, Entamoeba dispar
KAIPSKEEME

SEQ ID NO: 2433420 - protein, 11 aa, Entamoeba dispar
KAIQEAPRNPH

SEQ ID NO: 2433421 - protein, 6 aa, Entamoeba dispar
KAIQQD

SEQ ID NO: 2433422 - protein, 4 aa, Entamoeba dispar
KAIS

SEQ ID NO: 2433423 - protein, 6 aa, Entamoeba dispar
KAISTG

SEQ ID NO: 2433424 - protein, 9 aa, Entamoeba dispar
KAITKTPST

SEQ ID NO: 2433425 - protein, 45 aa, Entamoeba dispar
KAKAKKDAATEKAKKSSAEVEEEKKRKKRAEAELTREVSNKEYEE

SEQ ID NO: 2433426 - protein, 7 aa, Entamoeba dispar
KAKDSLQ

SEQ ID NO: 2433427 - protein, 6 aa, Entamoeba dispar
KAKDVS

SEQ ID NO: 2433428 - protein, 7 aa, Entamoeba dispar
KAKEALQ

SEQ ID NO: 2433429 - protein, 13 aa, Entamoeba dispar
KAKEDNLTQGEEA

SEQ ID NO: 2433430 - protein, 6 aa, Entamoeba dispar
KAKEEH

SEQ ID NO: 2433431 - protein, 18 aa, Entamoeba dispar
KAKEELKEKCPSKENIRS

SEQ ID NO: 2433432 - protein, 8 aa, Entamoeba dispar
KAKEIGLT

SEQ ID NO: 2433433 - protein, 6 aa, Entamoeba dispar
KAKEIN

SEQ ID NO: 2433434 - protein, 18 aa, Entamoeba dispar
KAKEISDSNYEKEKLEGR

SEQ ID NO: 2433435 - protein, 9 aa, Entamoeba dispar
KAKEIVDTQ

SEQ ID NO: 2433436 - protein, 18 aa, Entamoeba dispar
KAKEKKERELNAKKVREE

SEQ ID NO: 2433437 - protein, 22 aa, Entamoeba dispar
KAKEKKKEKKSKMSPLQNQGSI

SEQ ID NO: 2433438 - protein, 17 aa, Entamoeba dispar
KAKEKYPGFDSNPSKKI

SEQ ID NO: 2433439 - protein, 12 aa, Entamoeba dispar
KAKELSQGDDDI

SEQ ID NO: 2433440 - protein, 7 aa, Entamoeba dispar
KAKEQGF

SEQ ID NO: 2433441 - protein, 7 aa, Entamoeba dispar
KAKETHE

SEQ ID NO: 2433442 - protein, 13 aa, Entamoeba dispar
KAKGKEDIDTKRY

SEQ ID NO: 2433443 - protein, 11 aa, Entamoeba dispar
KAKIDEGNQEQ

SEQ ID NO: 2433444 - protein, 13 aa, Entamoeba dispar
KAKIDNKKERMEE

SEQ ID NO: 2433445 - protein, 20 aa, Entamoeba dispar
KAKIEKEKRELRKKRIETEM

SEQ ID NO: 2433446 - protein, 6 aa, Entamoeba dispar
KAKITK

SEQ ID NO: 2433447 - protein, 13 aa, Entamoeba dispar
KAKKEKKKARFRD

SEQ ID NO: 2433448 - protein, 5 aa, Entamoeba dispar
KAKKF

SEQ ID NO: 2433449 - protein, 9 aa, Entamoeba dispar
KAKKGNEKV

SEQ ID NO: 2433450 - protein, 8 aa, Entamoeba dispar
KAKKGTEV

SEQ ID NO: 2433451 - protein, 8 aa, Entamoeba dispar
KAKKLNKK

SEQ ID NO: 2433452 - protein, 6 aa, Entamoeba dispar
KAKLNK

SEQ ID NO: 2433453 - protein, 7 aa, Entamoeba dispar
KAKNERV

SEQ ID NO: 2433454 - protein, 8 aa, Entamoeba dispar
KAKNTEES

SEQ ID NO: 2433455 - protein, 12 aa, Entamoeba dispar
KAKPKAKKECSD

SEQ ID NO: 2433456 - protein, 8 aa, Entamoeba dispar
KAKPPHID

SEQ ID NO: 2433457 - protein, 5 aa, Entamoeba dispar
KAKPT

SEQ ID NO: 2433458 - protein, 21 aa, Entamoeba dispar
KAKQRQESYDIEKDRNIKGEA

SEQ ID NO: 2433459 - protein, 6 aa, Entamoeba dispar
KAKQVP

SEQ ID NO: 2433460 - protein, 5 aa, Entamoeba dispar
KAKSA

SEQ ID NO: 2433461 - protein, 13 aa, Entamoeba dispar
KAKSGHPGVPTGC

SEQ ID NO: 2433462 - protein, 8 aa, Entamoeba dispar
KAKSVNGY

SEQ ID NO: 2433463 - protein, 9 aa, Entamoeba dispar
KAKSYEKKA

SEQ ID NO: 2433464 - protein, 12 aa, Entamoeba dispar
KAKTPKPNEEIG

SEQ ID NO: 2433465 - protein, 16 aa, Entamoeba dispar
KAKTPNTTTISDDEWA

SEQ ID NO: 2433466 - protein, 7 aa, Entamoeba dispar
KAKTYDD

SEQ ID NO: 2433467 - protein, 17 aa, Entamoeba dispar
KAKVDSNCKDVKQDNIS

SEQ ID NO: 2433468 - protein, 8 aa, Entamoeba dispar
KAKVTKPL

SEQ ID NO: 2433469 - protein, 8 aa, Entamoeba dispar
KALATKDE

SEQ ID NO: 2433470 - protein, 14 aa, Entamoeba dispar
KALDDEKKLHQEEM

SEQ ID NO: 2433471 - protein, 14 aa, Entamoeba dispar
KALDGNTTVNTSKC

SEQ ID NO: 2433472 - protein, 14 aa, Entamoeba dispar
KALEEGDKEQAKKL

SEQ ID NO: 2433473 - protein, 38 aa, Entamoeba dispar
KALEEKQKKEKEEFERKQREEKEKGKRRWLRKKKEKMK

SEQ ID NO: 2433474 - protein, 7 aa, Entamoeba dispar
KALESEP

SEQ ID NO: 2433475 - protein, 15 aa, Entamoeba dispar
KALESSNNAQWNEGT

SEQ ID NO: 2433476 - protein, 6 aa, Entamoeba dispar
KALGPM

SEQ ID NO: 2433477 - protein, 20 aa, Entamoeba dispar
KALGTGNWPQPGGKESRHGV

SEQ ID NO: 2433478 - protein, 8 aa, Entamoeba dispar
KALNKDKK

SEQ ID NO: 2433479 - protein, 7 aa, Entamoeba dispar
KALPNDE

SEQ ID NO: 2433480 - protein, 6 aa, Entamoeba dispar
KALPRT

SEQ ID NO: 2433481 - protein, 7 aa, Entamoeba dispar
KALSDPS

SEQ ID NO: 2433482 - protein, 6 aa, Entamoeba dispar
KALSKK

SEQ ID NO: 2433483 - protein, 8 aa, Entamoeba dispar
KALSNQKY

SEQ ID NO: 2433484 - protein, 7 aa, Entamoeba dispar
KAMEDVQ

SEQ ID NO: 2433485 - protein, 10 aa, Entamoeba dispar
KANAEGKTMD

SEQ ID NO: 2433486 - protein, 5 aa, Entamoeba dispar
KANEF

SEQ ID NO: 2433487 - protein, 8 aa, Entamoeba dispar
KANENTLE

SEQ ID NO: 2433488 - protein, 8 aa, Entamoeba dispar
KANESRIL

SEQ ID NO: 2433489 - protein, 6 aa, Entamoeba dispar
KANGEF

SEQ ID NO: 2433490 - protein, 8 aa, Entamoeba dispar
KANGKADR

SEQ ID NO: 2433491 - protein, 8 aa, Entamoeba dispar
KANHPEEK

SEQ ID NO: 2433492 - protein, 20 aa, Entamoeba dispar
KANHPSFEISPSEQQPNGSI

SEQ ID NO: 2433493 - protein, 4 aa, Entamoeba dispar
KANI

SEQ ID NO: 2433494 - protein, 13 aa, Entamoeba dispar
KANISEKVSGLDK

SEQ ID NO: 2433495 - protein, 8 aa, Entamoeba dispar
KANKEVTF

SEQ ID NO: 2433496 - protein, 6 aa, Entamoeba dispar
KANKPL

SEQ ID NO: 2433497 - protein, 23 aa, Entamoeba dispar
KANMGKLEKQKQEKKPTKKVHSK

SEQ ID NO: 2433498 - protein, 8 aa, Entamoeba dispar
KANNEEEF

SEQ ID NO: 2433499 - protein, 6 aa, Entamoeba dispar
KANNID

SEQ ID NO: 2433500 - protein, 10 aa, Entamoeba dispar
KANPKPSEIQ

SEQ ID NO: 2433501 - protein, 5 aa, Entamoeba dispar
KANPN

SEQ ID NO: 2433502 - protein, 7 aa, Entamoeba dispar
KANPSIS

SEQ ID NO: 2433503 - protein, 18 aa, Entamoeba dispar
KANQTNKIQRKREYPAPN

SEQ ID NO: 2433504 - protein, 35 aa, Entamoeba dispar
KANRAATEPTATTAEANDSKGKKDKKEKKEKKCIM

SEQ ID NO: 2433505 - protein, 33 aa, Entamoeba dispar
KANRVSSESTTSTEPTETKGKKEGKPSRSKCEL

SEQ ID NO: 2433506 - protein, 5 aa, Entamoeba dispar
KANVN

SEQ ID NO: 2433507 - protein, 19 aa, Entamoeba dispar
KAPALSEKELENKKSELSL

SEQ ID NO: 2433508 - protein, 17 aa, Entamoeba dispar
KAPEEEDKKKKKGKKRL

SEQ ID NO: 2433509 - protein, 6 aa, Entamoeba dispar
KAPELK

SEQ ID NO: 2433510 - protein, 9 aa, Entamoeba dispar
KAPEVSNEF

SEQ ID NO: 2433511 - protein, 7 aa, Entamoeba dispar
KAPGSTI

SEQ ID NO: 2433512 - protein, 35 aa, Entamoeba dispar
KAPIKTSGLKEESQLCTEQKSHDQQPLTQSQPSVI

SEQ ID NO: 2433513 - protein, 9 aa, Entamoeba dispar
KAPKVSSIE

SEQ ID NO: 2433514 - protein, 23 aa, Entamoeba dispar
KAPKYSPKTSPNTYKNSPNIELS

SEQ ID NO: 2433515 - protein, 17 aa, Entamoeba dispar
KAPLESYADVGGLEKQI

SEQ ID NO: 2433516 - protein, 13 aa, Entamoeba dispar
KAPNDKKKRAPTH

SEQ ID NO: 2433517 - protein, 8 aa, Entamoeba dispar
KAPNGSEM

SEQ ID NO: 2433518 - protein, 12 aa, Entamoeba dispar
KAPPKDETTDSF

SEQ ID NO: 2433519 - protein, 7 aa, Entamoeba dispar
KAPPSAE

SEQ ID NO: 2433520 - protein, 12 aa, Entamoeba dispar
KAPQRPSNESSV

SEQ ID NO: 2433521 - protein, 6 aa, Entamoeba dispar
KAPRFP

SEQ ID NO: 2433522 - protein, 6 aa, Entamoeba dispar
KAPSES

SEQ ID NO: 2433523 - protein, 5 aa, Entamoeba dispar
KAPSL

SEQ ID NO: 2433524 - protein, 15 aa, Entamoeba dispar
KAPSRRRSKDSKTSS

SEQ ID NO: 2433525 - protein, 34 aa, Entamoeba dispar
KAPTEFREHEQREPRQQTGPSEADTADSWRRKEG

SEQ ID NO: 2433526 - protein, 34 aa, Entamoeba dispar
KAPTEFREHEQREPRQQTGPTEADTADSWRRKEG

SEQ ID NO: 2433527 - protein, 9 aa, Entamoeba dispar
KAPTKIESL

SEQ ID NO: 2433528 - protein, 10 aa, Entamoeba dispar
KAPVEGQSQL

SEQ ID NO: 2433529 - protein, 4 aa, Entamoeba dispar
KAPY

SEQ ID NO: 2433530 - protein, 10 aa, Entamoeba dispar
KAQCAKQSGI

SEQ ID NO: 2433531 - protein, 10 aa, Entamoeba dispar
KAQDGNASIE

SEQ ID NO: 2433532 - protein, 7 aa, Entamoeba dispar
KAQEEVN

SEQ ID NO: 2433533 - protein, 8 aa, Entamoeba dispar
KAQEKKHD

SEQ ID NO: 2433534 - protein, 8 aa, Entamoeba dispar
KAQFPDPL

SEQ ID NO: 2433535 - protein, 11 aa, Entamoeba dispar
KAQGVSKRENA

SEQ ID NO: 2433536 - protein, 8 aa, Entamoeba dispar
KAQIAQNI

SEQ ID NO: 2433537 - protein, 5 aa, Entamoeba dispar
KAQIT

SEQ ID NO: 2433538 - protein, 4 aa, Entamoeba dispar
KAQL

SEQ ID NO: 2433539 - protein, 21 aa, Entamoeba dispar
KAQLERVEKASEIASKIRNTE

SEQ ID NO: 2433540 - protein, 22 aa, Entamoeba dispar
KAQMKEKRKTSQLDHEINEEEI

SEQ ID NO: 2433541 - protein, 8 aa, Entamoeba dispar
KAQPGEEI

SEQ ID NO: 2433542 - protein, 16 aa, Entamoeba dispar
KAQPICKDPRTADDMA

SEQ ID NO: 2433543 - protein, 5 aa, Entamoeba dispar
KAQQL

SEQ ID NO: 2433544 - protein, 11 aa, Entamoeba dispar
KAQQQNPSQDL

SEQ ID NO: 2433545 - protein, 8 aa, Entamoeba dispar
KAQQSTFE

SEQ ID NO: 2433546 - protein, 7 aa, Entamoeba dispar
KAQSDTI

SEQ ID NO: 2433547 - protein, 16 aa, Entamoeba dispar
KAQSGRTLTKEGRKDM

SEQ ID NO: 2433548 - protein, 29 aa, Entamoeba dispar
KAREEKEEEELRQKQMKERDESVKNEEPE

SEQ ID NO: 2433549 - protein, 6 aa, Entamoeba dispar
KAREEM

SEQ ID NO: 2433550 - protein, 7 aa, Entamoeba dispar
KARLEGA

SEQ ID NO: 2433551 - protein, 7 aa, Entamoeba dispar
KARNEYP

SEQ ID NO: 2433552 - protein, 7 aa, Entamoeba dispar
KARNNNL

SEQ ID NO: 2433553 - protein, 6 aa, Entamoeba dispar
KARPSF

SEQ ID NO: 2433554 - protein, 6 aa, Entamoeba dispar
KARQAA

SEQ ID NO: 2433555 - protein, 7 aa, Entamoeba dispar
KARRGGE

SEQ ID NO: 2433556 - protein, 12 aa, Entamoeba dispar
KARSDVQQGSIG

SEQ ID NO: 2433557 - protein, 12 aa, Entamoeba dispar
KARSSSTSSSLT

SEQ ID NO: 2433558 - protein, 9 aa, Entamoeba dispar
KARTGSGKT

SEQ ID NO: 2433559 - protein, 9 aa, Entamoeba dispar
KARTKTTGK

SEQ ID NO: 2433560 - protein, 11 aa, Entamoeba dispar
KARTQKQKTHE

SEQ ID NO: 2433561 - protein, 8 aa, Entamoeba dispar
KASAKNGS

SEQ ID NO: 2433562 - protein, 43 aa, Entamoeba dispar
KASDEDDDNEIQKQTTPSIQVQPKQQLKTQPIEINTTDTREQR

SEQ ID NO: 2433563 - protein, 9 aa, Entamoeba dispar
KASDKPHTC

SEQ ID NO: 2433564 - protein, 7 aa, Entamoeba dispar
KASDKPT

SEQ ID NO: 2433565 - protein, 6 aa, Entamoeba dispar
KASDTI

SEQ ID NO: 2433566 - protein, 6 aa, Entamoeba dispar
KASEMA

SEQ ID NO: 2433567 - protein, 13 aa, Entamoeba dispar
KASENFSKTLDGN

SEQ ID NO: 2433568 - protein, 7 aa, Entamoeba dispar
KASFSSI

SEQ ID NO: 2433569 - protein, 6 aa, Entamoeba dispar
KASGDE

SEQ ID NO: 2433570 - protein, 8 aa, Entamoeba dispar
KASKLSSK

SEQ ID NO: 2433571 - protein, 11 aa, Entamoeba dispar
KASKNGNADAM

SEQ ID NO: 2433572 - protein, 12 aa, Entamoeba dispar
KASKSLVNKYGQ

SEQ ID NO: 2433573 - protein, 4 aa, Entamoeba dispar
KASL

SEQ ID NO: 2433574 - protein, 4 aa, Entamoeba dispar
KASM

SEQ ID NO: 2433575 - protein, 7 aa, Entamoeba dispar
KASMNQN

SEQ ID NO: 2433576 - protein, 8 aa, Entamoeba dispar
KASNEQRR

SEQ ID NO: 2433577 - protein, 19 aa, Entamoeba dispar
KASNIDENSFSEEEADKKA

SEQ ID NO: 2433578 - protein, 7 aa, Entamoeba dispar
KASPNRH

SEQ ID NO: 2433579 - protein, 41 aa, Entamoeba dispar
KASPRLSDDLEDEYTEEDEYSSSSDYTSSTDDDEEKEMEAS

SEQ ID NO: 2433580 - protein, 8 aa, Entamoeba dispar
KASPTVGY

SEQ ID NO: 2433581 - protein, 9 aa, Entamoeba dispar
KASQSPEIF

SEQ ID NO: 2433582 - protein, 7 aa, Entamoeba dispar
KASQVQL

SEQ ID NO: 2433583 - protein, 40 aa, Entamoeba dispar
KASRKERKREWKKRQQQTKEKDPENQNNKRSRSNSRTRTE

SEQ ID NO: 2433584 - protein, 7 aa, Entamoeba dispar
KASRRVA

SEQ ID NO: 2433585 - protein, 5 aa, Entamoeba dispar
KASSI

SEQ ID NO: 2433586 - protein, 6 aa, Entamoeba dispar
KASSLT

SEQ ID NO: 2433587 - protein, 11 aa, Entamoeba dispar
KASSTLRKSAK

SEQ ID NO: 2433588 - protein, 14 aa, Entamoeba dispar
KASTELKSKRKNKI

SEQ ID NO: 2433589 - protein, 17 aa, Entamoeba dispar
KASTPVAPVVNKPSFIT

SEQ ID NO: 2433590 - protein, 13 aa, Entamoeba dispar
KASTQKSKEEIKA

SEQ ID NO: 2433591 - protein, 5 aa, Entamoeba dispar
KASTS

SEQ ID NO: 2433592 - protein, 5 aa, Entamoeba dispar
KASYM

SEQ ID NO: 2433593 - protein, 8 aa, Entamoeba dispar
KATDDTPY

SEQ ID NO: 2433594 - protein, 5 aa, Entamoeba dispar
KATDI

SEQ ID NO: 2433595 - protein, 10 aa, Entamoeba dispar
KATEETRRNR

SEQ ID NO: 2433596 - protein, 6 aa, Entamoeba dispar
KATELE

SEQ ID NO: 2433597 - protein, 8 aa, Entamoeba dispar
KATEQPKN

SEQ ID NO: 2433598 - protein, 5 aa, Entamoeba dispar
KATFD

SEQ ID NO: 2433599 - protein, 8 aa, Entamoeba dispar
KATGSDVH

SEQ ID NO: 2433600 - protein, 7 aa, Entamoeba dispar
KATHSKT

SEQ ID NO: 2433601 - protein, 13 aa, Entamoeba dispar
KATLRGSGTEPKL

SEQ ID NO: 2433602 - protein, 16 aa, Entamoeba dispar
  misc_feature (16)..(16): Xaa can be any naturally occurring amino acid
KATNGDTHLGRRRFLX

SEQ ID NO: 2433603 - protein, 15 aa, Entamoeba dispar
KATNKSSSTNLQTST

SEQ ID NO: 2433604 - protein, 6 aa, Entamoeba dispar
KATNME

SEQ ID NO: 2433605 - protein, 9 aa, Entamoeba dispar
KATNSKSPL

SEQ ID NO: 2433606 - protein, 7 aa, Entamoeba dispar
KATNVSL

SEQ ID NO: 2433607 - protein, 11 aa, Entamoeba dispar
KATPRSMEVSK

SEQ ID NO: 2433608 - protein, 8 aa, Entamoeba dispar
KATQKDIE

SEQ ID NO: 2433609 - protein, 6 aa, Entamoeba dispar
KATSIT

SEQ ID NO: 2433610 - protein, 8 aa, Entamoeba dispar
KATSLPAQ

SEQ ID NO: 2433611 - protein, 4 aa, Entamoeba dispar
KATT

SEQ ID NO: 2433612 - protein, 6 aa, Entamoeba dispar
KATTEA

SEQ ID NO: 2433613 - protein, 7 aa, Entamoeba dispar
KATTEFV

SEQ ID NO: 2433614 - protein, 7 aa, Entamoeba dispar
KATTENF

SEQ ID NO: 2433615 - protein, 33 aa, Entamoeba dispar
KATTNNNDNQTFKETTPCTERSSEQQSNEGCYV

SEQ ID NO: 2433616 - protein, 4 aa, Entamoeba dispar
KATV

SEQ ID NO: 2433617 - protein, 8 aa, Entamoeba dispar
KATYPGDS

SEQ ID NO: 2433618 - protein, 7 aa, Entamoeba dispar
KAVDSIK

SEQ ID NO: 2433619 - protein, 16 aa, Entamoeba dispar
KAVEDEDDNEEEEEEA

SEQ ID NO: 2433620 - protein, 7 aa, Entamoeba dispar
KAVERKK

SEQ ID NO: 2433621 - protein, 13 aa, Entamoeba dispar
KAVKECENMIKNG

SEQ ID NO: 2433622 - protein, 18 aa, Entamoeba dispar
KAVNRQKGLADAQTDFTY

SEQ ID NO: 2433623 - protein, 9 aa, Entamoeba dispar
KAVPKDPGV

SEQ ID NO: 2433624 - protein, 7 aa, Entamoeba dispar
KAVQRDT

SEQ ID NO: 2433625 - protein, 16 aa, Entamoeba dispar
KAVSAGAYDSADDTKV

SEQ ID NO: 2433626 - protein, 6 aa, Entamoeba dispar
KAVSDD

SEQ ID NO: 2433627 - protein, 4 aa, Entamoeba dispar
KAVT

SEQ ID NO: 2433628 - protein, 12 aa, Entamoeba dispar
KAVTEHKNAVEI

SEQ ID NO: 2433629 - protein, 6 aa, Entamoeba dispar
KAYDSA

SEQ ID NO: 2433630 - protein, 18 aa, Entamoeba dispar
KAYEETKAEREKLRNENN

SEQ ID NO: 2433631 - protein, 4 aa, Entamoeba dispar
KAYL

SEQ ID NO: 2433632 - protein, 6 aa, Entamoeba dispar
KAYPEI

SEQ ID NO: 2433633 - protein, 13 aa, Entamoeba dispar
KAYPSSTSVVTES

SEQ ID NO: 2433634 - protein, 5 aa, Entamoeba dispar
KAYTP

SEQ ID NO: 2433635 - protein, 31 aa, Entamoeba dispar
KCAPPVPQKKVAPPIPGHSTISEEKHVPSIP

SEQ ID NO: 2433636 - protein, 13 aa, Entamoeba dispar
KCCNDEPNTFADK

SEQ ID NO: 2433637 - protein, 9 aa, Entamoeba dispar
KCDAEDKRV

SEQ ID NO: 2433638 - protein, 5 aa, Entamoeba dispar
KCDED

SEQ ID NO: 2433639 - protein, 13 aa, Entamoeba dispar
KCDGLTRSDVAET

SEQ ID NO: 2433640 - protein, 6 aa, Entamoeba dispar
KCDKEI

SEQ ID NO: 2433641 - protein, 10 aa, Entamoeba dispar
KCDSTCNECE

SEQ ID NO: 2433642 - protein, 6 aa, Entamoeba dispar
KCEEAN

SEQ ID NO: 2433643 - protein, 10 aa, Entamoeba dispar
KCEEDDLDEI

SEQ ID NO: 2433644 - protein, 62 aa, Entamoeba dispar
KCEEKYSKKRGNCTGTKSFGSTNSTPTSSTKLNSNSSKGSMTHSIPSKSSTTSITPEEREKY

SEQ ID NO: 2433645 - protein, 9 aa, Entamoeba dispar
KCEGATSNL

SEQ ID NO: 2433646 - protein, 7 aa, Entamoeba dispar
KCEKPEC

SEQ ID NO: 2433647 - protein, 5 aa, Entamoeba dispar
KCFDE

SEQ ID NO: 2433648 - protein, 14 aa, Entamoeba dispar
KCGECDKTKIDELR

SEQ ID NO: 2433649 - protein, 5 aa, Entamoeba dispar
KCGKI

SEQ ID NO: 2433650 - protein, 11 aa, Entamoeba dispar
KCGKPVEGGVK

SEQ ID NO: 2433651 - protein, 6 aa, Entamoeba dispar
KCGNPI

SEQ ID NO: 2433652 - protein, 4 aa, Entamoeba dispar
KCHG

SEQ ID NO: 2433653 - protein, 6 aa, Entamoeba dispar
KCKHGH

SEQ ID NO: 2433654 - protein, 8 aa, Entamoeba dispar
KCKKKKVR

SEQ ID NO: 2433655 - protein, 7 aa, Entamoeba dispar
KCKNSVH

SEQ ID NO: 2433656 - protein, 8 aa, Entamoeba dispar
KCKPKNDK

SEQ ID NO: 2433657 - protein, 8 aa, Entamoeba dispar
KCKSEKGI

SEQ ID NO: 2433658 - protein, 8 aa, Entamoeba dispar
KCKSSLED

SEQ ID NO: 2433659 - protein, 6 aa, Entamoeba dispar
KCNDQQ

SEQ ID NO: 2433660 - protein, 7 aa, Entamoeba dispar
KCNENDE

SEQ ID NO: 2433661 - protein, 7 aa, Entamoeba dispar
KCNESNE

SEQ ID NO: 2433662 - protein, 6 aa, Entamoeba dispar
KCNGGK

SEQ ID NO: 2433663 - protein, 8 aa, Entamoeba dispar
KCNKDQMK

SEQ ID NO: 2433664 - protein, 6 aa, Entamoeba dispar
KCNPET

SEQ ID NO: 2433665 - protein, 5 aa, Entamoeba dispar
KCNSP

SEQ ID NO: 2433666 - protein, 11 aa, Entamoeba dispar
KCNTQEEKKEE

SEQ ID NO: 2433667 - protein, 8 aa, Entamoeba dispar
KCPDTVNP

SEQ ID NO: 2433668 - protein, 6 aa, Entamoeba dispar
KCPGMS

SEQ ID NO: 2433669 - protein, 4 aa, Entamoeba dispar
KCPS

SEQ ID NO: 2433670 - protein, 8 aa, Entamoeba dispar
KCQDPSQR

SEQ ID NO: 2433671 - protein, 6 aa, Entamoeba dispar
KCQEKG

SEQ ID NO: 2433672 - protein, 7 aa, Entamoeba dispar
KCQESGL

SEQ ID NO: 2433673 - protein, 7 aa, Entamoeba dispar
KCQSCDD

SEQ ID NO: 2433674 - protein, 6 aa, Entamoeba dispar
KCRSKD

SEQ ID NO: 2433675 - protein, 8 aa, Entamoeba dispar
KCSEWSNS

SEQ ID NO: 2433676 - protein, 13 aa, Entamoeba dispar
KCSKEEEKTGNQI

SEQ ID NO: 2433677 - protein, 10 aa, Entamoeba dispar
KCSNCGKPII

SEQ ID NO: 2433678 - protein, 15 aa, Entamoeba dispar
KCSNEPIPTRYTFVA

SEQ ID NO: 2433679 - protein, 11 aa, Entamoeba dispar
KCSPKEKDERV

SEQ ID NO: 2433680 - protein, 5 aa, Entamoeba dispar
KCSPV

SEQ ID NO: 2433681 - protein, 6 aa, Entamoeba dispar
KCSRKE

SEQ ID NO: 2433682 - protein, 6 aa, Entamoeba dispar
KCSSDS

SEQ ID NO: 2433683 - protein, 8 aa, Entamoeba dispar
KCSSTDLP

SEQ ID NO: 2433684 - protein, 6 aa, Entamoeba dispar
KCTEPS

SEQ ID NO: 2433685 - protein, 13 aa, Entamoeba dispar
KCTNDPIPTRFSV

SEQ ID NO: 2433686 - protein, 6 aa, Entamoeba dispar
KCTPND

SEQ ID NO: 2433687 - protein, 7 aa, Entamoeba dispar
KCTSSTP

SEQ ID NO: 2433688 - protein, 10 aa, Entamoeba dispar
KDAEEVTLSP

SEQ ID NO: 2433689 - protein, 5 aa, Entamoeba dispar
KDAGY

SEQ ID NO: 2433690 - protein, 15 aa, Entamoeba dispar
KDALETEKKNHAETM

SEQ ID NO: 2433691 - protein, 4 aa, Entamoeba dispar
KDAN

SEQ ID NO: 2433692 - protein, 8 aa, Entamoeba dispar
KDANLSNE

SEQ ID NO: 2433693 - protein, 16 aa, Entamoeba dispar
KDAQQQIERSASHVNK

SEQ ID NO: 2433694 - protein, 7 aa, Entamoeba dispar
KDASNVE

SEQ ID NO: 2433695 - protein, 9 aa, Entamoeba dispar
KDATNTGIK

SEQ ID NO: 2433696 - protein, 8 aa, Entamoeba dispar
KDATNYEI

SEQ ID NO: 2433697 - protein, 5 aa, Entamoeba dispar
KDCEH

SEQ ID NO: 2433698 - protein, 7 aa, Entamoeba dispar
KDCGEDS

SEQ ID NO: 2433699 - protein, 7 aa, Entamoeba dispar
KDCGKTS

SEQ ID NO: 2433700 - protein, 7 aa, Entamoeba dispar
KDCKNYN

SEQ ID NO: 2433701 - protein, 6 aa, Entamoeba dispar
KDCKTC

SEQ ID NO: 2433702 - protein, 60 aa, Entamoeba dispar
KDCPNKRKKQTGDDDQDDYISKRDVEEKGFKSGDGDEEKSIKITKSEQDEVPKKKKKVIK

SEQ ID NO: 2433703 - protein, 9 aa, Entamoeba dispar
KDCSSDSTE

SEQ ID NO: 2433704 - protein, 4 aa, Entamoeba dispar
KDDA

SEQ ID NO: 2433705 - protein, 6 aa, Entamoeba dispar
KDDAAK

SEQ ID NO: 2433706 - protein, 5 aa, Entamoeba dispar
KDDAK

SEQ ID NO: 2433707 - protein, 4 aa, Entamoeba dispar
KDDD

SEQ ID NO: 2433708 - protein, 11 aa, Entamoeba dispar
KDDDDKDNNFC

SEQ ID NO: 2433709 - protein, 10 aa, Entamoeba dispar
KDDDKEDGTG

SEQ ID NO: 2433710 - protein, 8 aa, Entamoeba dispar
KDDDPNEI

SEQ ID NO: 2433711 - protein, 5 aa, Entamoeba dispar
KDDDQ

SEQ ID NO: 2433712 - protein, 8 aa, Entamoeba dispar
KDDDSQKY

SEQ ID NO: 2433713 - protein, 7 aa, Entamoeba dispar
KDDDVVK

SEQ ID NO: 2433714 - protein, 8 aa, Entamoeba dispar
KDDEAKEA

SEQ ID NO: 2433715 - protein, 6 aa, Entamoeba dispar
KDDENV

SEQ ID NO: 2433716 - protein, 8 aa, Entamoeba dispar
KDDERRNR

SEQ ID NO: 2433717 - protein, 6 aa, Entamoeba dispar
KDDEYQ

SEQ ID NO: 2433718 - protein, 8 aa, Entamoeba dispar
KDDGEIEK

SEQ ID NO: 2433719 - protein, 6 aa, Entamoeba dispar
KDDGNN

SEQ ID NO: 2433720 - protein, 16 aa, Entamoeba dispar
KDDGPKTLPVEEQKSF

SEQ ID NO: 2433721 - protein, 5 aa, Entamoeba dispar
KDDGR

SEQ ID NO: 2433722 - protein, 9 aa, Entamoeba dispar
KDDGSGIPV

SEQ ID NO: 2433723 - protein, 8 aa, Entamoeba dispar
KDDGSIEA

SEQ ID NO: 2433724 - protein, 9 aa, Entamoeba dispar
KDDISKTQV

SEQ ID NO: 2433725 - protein, 4 aa, Entamoeba dispar
KDDK

SEQ ID NO: 2433726 - protein, 28 aa, Entamoeba dispar
KDDKKKEEDNKIFPNEEKERRKKENEII

SEQ ID NO: 2433727 - protein, 6 aa, Entamoeba dispar
KDDKRT

SEQ ID NO: 2433728 - protein, 7 aa, Entamoeba dispar
KDDNEYN

SEQ ID NO: 2433729 - protein, 5 aa, Entamoeba dispar
KDDNQ

SEQ ID NO: 2433730 - protein, 7 aa, Entamoeba dispar
KDDNSFS

SEQ ID NO: 2433731 - protein, 6 aa, Entamoeba dispar
KDDQSH

SEQ ID NO: 2433732 - protein, 15 aa, Entamoeba dispar
KDDQTNVRGATKELE

SEQ ID NO: 2433733 - protein, 9 aa, Entamoeba dispar
KDDSSDVKI

SEQ ID NO: 2433734 - protein, 8 aa, Entamoeba dispar
KDDSSKKT

SEQ ID NO: 2433735 - protein, 5 aa, Entamoeba dispar
KDDVE

SEQ ID NO: 2433736 - protein, 9 aa, Entamoeba dispar
KDDVKGKEV

SEQ ID NO: 2433737 - protein, 5 aa, Entamoeba dispar
KDDVQ

SEQ ID NO: 2433738 - protein, 4 aa, Entamoeba dispar
KDDW

SEQ ID NO: 2433739 - protein, 4 aa, Entamoeba dispar
KDDY

SEQ ID NO: 2433740 - protein, 6 aa, Entamoeba dispar
KDDYEI

SEQ ID NO: 2433741 - protein, 16 aa, Entamoeba dispar
KDEAAKTSKVKQHRRE

SEQ ID NO: 2433742 - protein, 7 aa, Entamoeba dispar
KDEAGAF

SEQ ID NO: 2433743 - protein, 19 aa, Entamoeba dispar
KDEAHENMDGLSDQAKAAL

SEQ ID NO: 2433744 - protein, 9 aa, Entamoeba dispar
KDEAKDEIN

SEQ ID NO: 2433745 - protein, 15 aa, Entamoeba dispar
KDEAQEKKDEPDKRV

SEQ ID NO: 2433746 - protein, 21 aa, Entamoeba dispar
KDEDAKKAIEEMNEQELEGRR

SEQ ID NO: 2433747 - protein, 8 aa, Entamoeba dispar
KDEDDKEV

SEQ ID NO: 2433748 - protein, 5 aa, Entamoeba dispar
KDEDI

SEQ ID NO: 2433749 - protein, 14 aa, Entamoeba dispar
KDEDISKKRIDTME

SEQ ID NO: 2433750 - protein, 7 aa, Entamoeba dispar
KDEDLYR

SEQ ID NO: 2433751 - protein, 13 aa, Entamoeba dispar
KDEDSKNQPIEER

SEQ ID NO: 2433752 - protein, 8 aa, Entamoeba dispar
KDEDTDEV

SEQ ID NO: 2433753 - protein, 22 aa, Entamoeba dispar
KDEDTDIESLPDEDKECKEVTT

SEQ ID NO: 2433754 - protein, 10 aa, Entamoeba dispar
KDEENDPSLL

SEQ ID NO: 2433755 - protein, 22 aa, Entamoeba dispar
KDEESDEQPQHNLNNSSSQNIC

SEQ ID NO: 2433756 - protein, 22 aa, Entamoeba dispar
KDEESDEQSQHNLNNSSSQNIC

SEQ ID NO: 2433757 - protein, 8 aa, Entamoeba dispar
KDEETMKE

SEQ ID NO: 2433758 - protein, 18 aa, Entamoeba dispar
KDEEVVPHEGETIEQAKE

SEQ ID NO: 2433759 - protein, 13 aa, Entamoeba dispar
KDEFTEKWNGAND

SEQ ID NO: 2433760 - protein, 6 aa, Entamoeba dispar
KDEGHD

SEQ ID NO: 2433761 - protein, 6 aa, Entamoeba dispar
KDEGSK

SEQ ID NO: 2433762 - protein, 6 aa, Entamoeba dispar
KDEGTI

SEQ ID NO: 2433763 - protein, 14 aa, Entamoeba dispar
KDEGTKTQILDSLL

SEQ ID NO: 2433764 - protein, 7 aa, Entamoeba dispar
KDEHNEL

SEQ ID NO: 2433765 - protein, 6 aa, Entamoeba dispar
KDEINI

SEQ ID NO: 2433766 - protein, 7 aa, Entamoeba dispar
KDEKEYS

SEQ ID NO: 2433767 - protein, 6 aa, Entamoeba dispar
KDEKGT

SEQ ID NO: 2433768 - protein, 5 aa, Entamoeba dispar
KDEKI

SEQ ID NO: 2433769 - protein, 9 aa, Entamoeba dispar
KDEKLREDL

SEQ ID NO: 2433770 - protein, 4 aa, Entamoeba dispar
KDEL

SEQ ID NO: 2433771 - protein, 15 aa, Entamoeba dispar
KDELKQNKRIPIECF

SEQ ID NO: 2433772 - protein, 5 aa, Entamoeba dispar
KDELQ

SEQ ID NO: 2433773 - protein, 6 aa, Entamoeba dispar
KDEMNE

SEQ ID NO: 2433774 - protein, 11 aa, Entamoeba dispar
KDENAFPENQR

SEQ ID NO: 2433775 - protein, 5 aa, Entamoeba dispar
KDENC

SEQ ID NO: 2433776 - protein, 9 aa, Entamoeba dispar
KDENGVGIT

SEQ ID NO: 2433777 - protein, 5 aa, Entamoeba dispar
KDENK

SEQ ID NO: 2433778 - protein, 7 aa, Entamoeba dispar
KDENKYV

SEQ ID NO: 2433779 - protein, 6 aa, Entamoeba dispar
KDENRL

SEQ ID NO: 2433780 - protein, 8 aa, Entamoeba dispar
KDENTNNT

SEQ ID NO: 2433781 - protein, 15 aa, Entamoeba dispar
KDENTQKDSSSEHQI

SEQ ID NO: 2433782 - protein, 7 aa, Entamoeba dispar
KDEPHKT

SEQ ID NO: 2433783 - protein, 5 aa, Entamoeba dispar
KDEPS

SEQ ID NO: 2433784 - protein, 9 aa, Entamoeba dispar
KDEQIEKLE

SEQ ID NO: 2433785 - protein, 5 aa, Entamoeba dispar
KDEQT

SEQ ID NO: 2433786 - protein, 8 aa, Entamoeba dispar
KDERYKKY

SEQ ID NO: 2433787 - protein, 10 aa, Entamoeba dispar
KDESDKQKNK

SEQ ID NO: 2433788 - protein, 6 aa, Entamoeba dispar
KDESFQ

SEQ ID NO: 2433789 - protein, 10 aa, Entamoeba dispar
KDESNENDVL

SEQ ID NO: 2433790 - protein, 16 aa, Entamoeba dispar
KDETIITGGAGSKKEV

SEQ ID NO: 2433791 - protein, 5 aa, Entamoeba dispar
KDEVE

SEQ ID NO: 2433792 - protein, 8 aa, Entamoeba dispar
KDEVQEKD

SEQ ID NO: 2433793 - protein, 5 aa, Entamoeba dispar
KDEYT

SEQ ID NO: 2433794 - protein, 6 aa, Entamoeba dispar
KDFDNV

SEQ ID NO: 2433795 - protein, 6 aa, Entamoeba dispar
KDFDSD

SEQ ID NO: 2433796 - protein, 6 aa, Entamoeba dispar
KDFEGD

SEQ ID NO: 2433797 - protein, 5 aa, Entamoeba dispar
KDFER

SEQ ID NO: 2433798 - protein, 13 aa, Entamoeba dispar
KDFERPTKEFSGG

SEQ ID NO: 2433799 - protein, 17 aa, Entamoeba dispar
KDFKSNPQLWNASIIQQ

SEQ ID NO: 2433800 - protein, 4 aa, Entamoeba dispar
KDFM

SEQ ID NO: 2433801 - protein, 6 aa, Entamoeba dispar
KDFMTK

SEQ ID NO: 2433802 - protein, 21 aa, Entamoeba dispar
KDFSSESNEVRPEPKEEIKEE

SEQ ID NO: 2433803 - protein, 14 aa, Entamoeba dispar
KDFTKSSISNKTEV

SEQ ID NO: 2433804 - protein, 7 aa, Entamoeba dispar
KDGAEIK

SEQ ID NO: 2433805 - protein, 7 aa, Entamoeba dispar
KDGASYI

SEQ ID NO: 2433806 - protein, 5 aa, Entamoeba dispar
KDGCQ

SEQ ID NO: 2433807 - protein, 12 aa, Entamoeba dispar
KDGDLIDTNDEE

SEQ ID NO: 2433808 - protein, 9 aa, Entamoeba dispar
KDGDNELSG

SEQ ID NO: 2433809 - protein, 4 aa, Entamoeba dispar
KDGE

SEQ ID NO: 2433810 - protein, 8 aa, Entamoeba dispar
KDGEGEKI

SEQ ID NO: 2433811 - protein, 6 aa, Entamoeba dispar
KDGGLQ

SEQ ID NO: 2433812 - protein, 17 aa, Entamoeba dispar
KDGGLQIEEGADGKTYR

SEQ ID NO: 2433813 - protein, 7 aa, Entamoeba dispar
KDGHSAS

SEQ ID NO: 2433814 - protein, 14 aa, Entamoeba dispar
KDGIEKSTKPNDQL

SEQ ID NO: 2433815 - protein, 5 aa, Entamoeba dispar
KDGIS

SEQ ID NO: 2433816 - protein, 11 aa, Entamoeba dispar
KDGKDLLGEGS

SEQ ID NO: 2433817 - protein, 9 aa, Entamoeba dispar
KDGKESEDF

SEQ ID NO: 2433818 - protein, 8 aa, Entamoeba dispar
KDGKGNSV

SEQ ID NO: 2433819 - protein, 13 aa, Entamoeba dispar
KDGKVEQGSSSEY

SEQ ID NO: 2433820 - protein, 4 aa, Entamoeba dispar
KDGL

SEQ ID NO: 2433821 - protein, 8 aa, Entamoeba dispar
KDGNAKLA

SEQ ID NO: 2433822 - protein, 7 aa, Entamoeba dispar
KDGNGVE

SEQ ID NO: 2433823 - protein, 6 aa, Entamoeba dispar
KDGNNF

SEQ ID NO: 2433824 - protein, 7 aa, Entamoeba dispar
KDGNPYC

SEQ ID NO: 2433825 - protein, 9 aa, Entamoeba dispar
KDGNRYRVD

SEQ ID NO: 2433826 - protein, 6 aa, Entamoeba dispar
KDGQIT

SEQ ID NO: 2433827 - protein, 14 aa, Entamoeba dispar
KDGQVKKNAADWQQ

SEQ ID NO: 2433828 - protein, 10 aa, Entamoeba dispar
KDGSRLTQSH

SEQ ID NO: 2433829 - protein, 8 aa, Entamoeba dispar
KDGSSKIE

SEQ ID NO: 2433830 - protein, 6 aa, Entamoeba dispar
KDGSTQ

SEQ ID NO: 2433831 - protein, 7 aa, Entamoeba dispar
KDGTIKE

SEQ ID NO: 2433832 - protein, 9 aa, Entamoeba dispar
KDGTSHEDI

SEQ ID NO: 2433833 - protein, 6 aa, Entamoeba dispar
KDGVDA

SEQ ID NO: 2433834 - protein, 9 aa, Entamoeba dispar
KDGVESKDF

SEQ ID NO: 2433835 - protein, 4 aa, Entamoeba dispar
KDHE

SEQ ID NO: 2433836 - protein, 6 aa, Entamoeba dispar
KDHEGS

SEQ ID NO: 2433837 - protein, 26 aa, Entamoeba dispar
KDHKKIGKKNKKGERKSGKHAKKFGK

SEQ ID NO: 2433838 - protein, 6 aa, Entamoeba dispar
KDHSKS

SEQ ID NO: 2433839 - protein, 25 aa, Entamoeba dispar
KDHTGWNPQQTTNSVCQRELKSLYK

SEQ ID NO: 2433840 - protein, 6 aa, Entamoeba dispar
KDIAEE

SEQ ID NO: 2433841 - protein, 9 aa, Entamoeba dispar
KDIAPPESK

SEQ ID NO: 2433842 - protein, 13 aa, Entamoeba dispar
KDIEDSDISQNGF

SEQ ID NO: 2433843 - protein, 15 aa, Entamoeba dispar
KDIENGGTDGNARIG

SEQ ID NO: 2433844 - protein, 6 aa, Entamoeba dispar
KDIERV

SEQ ID NO: 2433845 - protein, 6 aa, Entamoeba dispar
KDIEVP

SEQ ID NO: 2433846 - protein, 20 aa, Entamoeba dispar
KDIGAKTELEEKKKEQPKQI

SEQ ID NO: 2433847 - protein, 6 aa, Entamoeba dispar
KDIGGS

SEQ ID NO: 2433848 - protein, 5 aa, Entamoeba dispar
KDIGL

SEQ ID NO: 2433849 - protein, 6 aa, Entamoeba dispar
KDIGST

SEQ ID NO: 2433850 - protein, 4 aa, Entamoeba dispar
KDIK

SEQ ID NO: 2433851 - protein, 26 aa, Entamoeba dispar
KDIKDGETIREKRMKEKESKNQERKK

SEQ ID NO: 2433852 - protein, 16 aa, Entamoeba dispar
KDIKEEDIEKTENGGP

SEQ ID NO: 2433853 - protein, 6 aa, Entamoeba dispar
KDIKGH

SEQ ID NO: 2433854 - protein, 7 aa, Entamoeba dispar
KDIKKEI

SEQ ID NO: 2433855 - protein, 7 aa, Entamoeba dispar
KDIKNYT

SEQ ID NO: 2433856 - protein, 5 aa, Entamoeba dispar
KDIKT

SEQ ID NO: 2433857 - protein, 9 aa, Entamoeba dispar
KDINDPRAK

SEQ ID NO: 2433858 - protein, 10 aa, Entamoeba dispar
KDINGNEDGM

SEQ ID NO: 2433859 - protein, 5 aa, Entamoeba dispar
KDINK

SEQ ID NO: 2433860 - protein, 6 aa, Entamoeba dispar
KDINVT

SEQ ID NO: 2433861 - protein, 6 aa, Entamoeba dispar
KDIPIS

SEQ ID NO: 2433862 - protein, 10 aa, Entamoeba dispar
KDIPKRYSYN

SEQ ID NO: 2433863 - protein, 7 aa, Entamoeba dispar
KDIPQKC

SEQ ID NO: 2433864 - protein, 4 aa, Entamoeba dispar
KDIQ

SEQ ID NO: 2433865 - protein, 19 aa, Entamoeba dispar
KDIQAKKESAEASEDPKQI

SEQ ID NO: 2433866 - protein, 5 aa, Entamoeba dispar
KDIQS

SEQ ID NO: 2433867 - protein, 9 aa, Entamoeba dispar
KDISDKSIA

SEQ ID NO: 2433868 - protein, 5 aa, Entamoeba dispar
KDISF

SEQ ID NO: 2433869 - protein, 11 aa, Entamoeba dispar
KDISSNSVVEE

SEQ ID NO: 2433870 - protein, 6 aa, Entamoeba dispar
KDITKY

SEQ ID NO: 2433871 - protein, 7 aa, Entamoeba dispar
KDITNPL

SEQ ID NO: 2433872 - protein, 33 aa, Entamoeba dispar
KDITPQSKKYEKQIEEAKDTAPKSKRPKKEMMP

SEQ ID NO: 2433873 - protein, 16 aa, Entamoeba dispar
KDITSQSKKPEKQMTN

SEQ ID NO: 2433874 - protein, 6 aa, Entamoeba dispar
KDIVDS

SEQ ID NO: 2433875 - protein, 14 aa, Entamoeba dispar
KDIVDSSIETTEED

SEQ ID NO: 2433876 - protein, 11 aa, Entamoeba dispar
KDIVQSDNKHL

SEQ ID NO: 2433877 - protein, 8 aa, Entamoeba dispar
KDKAAKGY

SEQ ID NO: 2433878 - protein, 11 aa, Entamoeba dispar
KDKARETVGAN

SEQ ID NO: 2433879 - protein, 9 aa, Entamoeba dispar
KDKDELQKH

SEQ ID NO: 2433880 - protein, 6 aa, Entamoeba dispar
KDKDGT

SEQ ID NO: 2433881 - protein, 8 aa, Entamoeba dispar
KDKDISET

SEQ ID NO: 2433882 - protein, 8 aa, Entamoeba dispar
KDKDKLVR

SEQ ID NO: 2433883 - protein, 8 aa, Entamoeba dispar
KDKDPYVR

SEQ ID NO: 2433884 - protein, 6 aa, Entamoeba dispar
KDKDSD

SEQ ID NO: 2433885 - protein, 8 aa, Entamoeba dispar
KDKDTLTP

SEQ ID NO: 2433886 - protein, 6 aa, Entamoeba dispar
KDKEGL

SEQ ID NO: 2433887 - protein, 7 aa, Entamoeba dispar
KDKEHEL

SEQ ID NO: 2433888 - protein, 8 aa, Entamoeba dispar
KDKEINSP

SEQ ID NO: 2433889 - protein, 32 aa, Entamoeba dispar
KDKEKGPKPNKNEDKTETEKRQWKTKYDDSTI

SEQ ID NO: 2433890 - protein, 10 aa, Entamoeba dispar
KDKENNGDLS

SEQ ID NO: 2433891 - protein, 17 aa, Entamoeba dispar
KDKERIKKILDNVKGIK

SEQ ID NO: 2433892 - protein, 14 aa, Entamoeba dispar
KDKFENYKGNDGHT

SEQ ID NO: 2433893 - protein, 7 aa, Entamoeba dispar
KDKGEKL

SEQ ID NO: 2433894 - protein, 6 aa, Entamoeba dispar
KDKGLN

SEQ ID NO: 2433895 - protein, 8 aa, Entamoeba dispar
KDKGTVSL

SEQ ID NO: 2433896 - protein, 7 aa, Entamoeba dispar
KDKISKE

SEQ ID NO: 2433897 - protein, 6 aa, Entamoeba dispar
KDKKDL

SEQ ID NO: 2433898 - protein, 15 aa, Entamoeba dispar
KDKKELPKSLTPELP

SEQ ID NO: 2433899 - protein, 9 aa, Entamoeba dispar
KDKKGYGAK

SEQ ID NO: 2433900 - protein, 6 aa, Entamoeba dispar
KDKKII

SEQ ID NO: 2433901 - protein, 7 aa, Entamoeba dispar
KDKKKKT

SEQ ID NO: 2433902 - protein, 8 aa, Entamoeba dispar
KDKKNERV

SEQ ID NO: 2433903 - protein, 8 aa, Entamoeba dispar
KDKKSLEK

SEQ ID NO: 2433904 - protein, 10 aa, Entamoeba dispar
KDKKTMSREE

SEQ ID NO: 2433905 - protein, 9 aa, Entamoeba dispar
KDKLGSCKS

SEQ ID NO: 2433906 - protein, 9 aa, Entamoeba dispar
KDKLSQGAE

SEQ ID NO: 2433907 - protein, 9 aa, Entamoeba dispar
KDKNEFKKD

SEQ ID NO: 2433908 - protein, 9 aa, Entamoeba dispar
KDKNEKKHH

SEQ ID NO: 2433909 - protein, 9 aa, Entamoeba dispar
KDKNGNAAL

SEQ ID NO: 2433910 - protein, 9 aa, Entamoeba dispar
KDKNNDDRI

SEQ ID NO: 2433911 - protein, 6 aa, Entamoeba dispar
KDKPKD

SEQ ID NO: 2433912 - protein, 8 aa, Entamoeba dispar
KDKPNDGI

SEQ ID NO: 2433913 - protein, 7 aa, Entamoeba dispar
KDKPNVE

SEQ ID NO: 2433914 - protein, 6 aa, Entamoeba dispar
KDKQIH

SEQ ID NO: 2433915 - protein, 11 aa, Entamoeba dispar
KDKQNRKTTPF

SEQ ID NO: 2433916 - protein, 7 aa, Entamoeba dispar
KDKRNIK

SEQ ID NO: 2433917 - protein, 5 aa, Entamoeba dispar
KDKRV

SEQ ID NO: 2433918 - protein, 8 aa, Entamoeba dispar
KDKSAAAD

SEQ ID NO: 2433919 - protein, 19 aa, Entamoeba dispar
KDKSEEPHEKELKSEVVYI

SEQ ID NO: 2433920 - protein, 13 aa, Entamoeba dispar
KDKSFSVATSYGK

SEQ ID NO: 2433921 - protein, 9 aa, Entamoeba dispar
KDKSGYLDR

SEQ ID NO: 2433922 - protein, 9 aa, Entamoeba dispar
KDKSKSAGW

SEQ ID NO: 2433923 - protein, 6 aa, Entamoeba dispar
KDKSLI

SEQ ID NO: 2433924 - protein, 9 aa, Entamoeba dispar
KDKSLTRRT

SEQ ID NO: 2433925 - protein, 7 aa, Entamoeba dispar
KDKSNLQ

SEQ ID NO: 2433926 - protein, 8 aa, Entamoeba dispar
KDKTFNDG

SEQ ID NO: 2433927 - protein, 9 aa, Entamoeba dispar
KDKTNDPRM

SEQ ID NO: 2433928 - protein, 10 aa, Entamoeba dispar
KDKTNNEQIK

SEQ ID NO: 2433929 - protein, 15 aa, Entamoeba dispar
KDKTSHVQFIGAGKK

SEQ ID NO: 2433930 - protein, 14 aa, Entamoeba dispar
KDKTTEIVKPQNQT

SEQ ID NO: 2433931 - protein, 7 aa, Entamoeba dispar
KDKVSVP

SEQ ID NO: 2433932 - protein, 4 aa, Entamoeba dispar
KDKY

SEQ ID NO: 2433933 - protein, 7 aa, Entamoeba dispar
KDKYNES

SEQ ID NO: 2433934 - protein, 20 aa, Entamoeba dispar
KDKYQEQKNYQESLEEGNLT

SEQ ID NO: 2433935 - protein, 9 aa, Entamoeba dispar
KDLDGVQPY

SEQ ID NO: 2433936 - protein, 14 aa, Entamoeba dispar
KDLDNARGLKQKRQ

SEQ ID NO: 2433937 - protein, 4 aa, Entamoeba dispar
KDLE

SEQ ID NO: 2433938 - protein, 29 aa, Entamoeba dispar
KDLEKETEKTRAKQRRSKEWKKTQKLLGR

SEQ ID NO: 2433939 - protein, 37 aa, Entamoeba dispar
KDLEKQRKEKKEKKIKTQKNKEKEGRKKRNINNTNAK

SEQ ID NO: 2433940 - protein, 6 aa, Entamoeba dispar
KDLGEI

SEQ ID NO: 2433941 - protein, 6 aa, Entamoeba dispar
KDLKEE

SEQ ID NO: 2433942 - protein, 16 aa, Entamoeba dispar
KDLKTPVKQKEIGIET

SEQ ID NO: 2433943 - protein, 8 aa, Entamoeba dispar
KDLKYSDE

SEQ ID NO: 2433944 - protein, 10 aa, Entamoeba dispar
KDLLRTSEHC

SEQ ID NO: 2433945 - protein, 8 aa, Entamoeba dispar
KDLNDNPR

SEQ ID NO: 2433946 - protein, 13 aa, Entamoeba dispar
KDLNESDDTKKYY

SEQ ID NO: 2433947 - protein, 15 aa, Entamoeba dispar
KDLPEEQESEDQIPT

SEQ ID NO: 2433948 - protein, 12 aa, Entamoeba dispar
KDLPFDSNEWEF

SEQ ID NO: 2433949 - protein, 8 aa, Entamoeba dispar
KDLPKEGS

SEQ ID NO: 2433950 - protein, 10 aa, Entamoeba dispar
KDLQGTAYES

SEQ ID NO: 2433951 - protein, 6 aa, Entamoeba dispar
KDLQIE

SEQ ID NO: 2433952 - protein, 17 aa, Entamoeba dispar
KDLRDNPNNHVPPISPN

SEQ ID NO: 2433953 - protein, 8 aa, Entamoeba dispar
KDLSKERE

SEQ ID NO: 2433954 - protein, 19 aa, Entamoeba dispar
KDLSSTTTFPKQRNQKETI

SEQ ID NO: 2433955 - protein, 8 aa, Entamoeba dispar
KDLTSEIT

SEQ ID NO: 2433956 - protein, 7 aa, Entamoeba dispar
KDLTSNL

SEQ ID NO: 2433957 - protein, 17 aa, Entamoeba dispar
KDLTSPQPKYPTPQQPV

SEQ ID NO: 2433958 - protein, 6 aa, Entamoeba dispar
KDLTTS

SEQ ID NO: 2433959 - protein, 9 aa, Entamoeba dispar
KDMSSVGPQ

SEQ ID NO: 2433960 - protein, 6 aa, Entamoeba dispar
KDMTQE

SEQ ID NO: 2433961 - protein, 7 aa, Entamoeba dispar
KDNADPK

SEQ ID NO: 2433962 - protein, 5 aa, Entamoeba dispar
KDNAH

SEQ ID NO: 2433963 - protein, 4 aa, Entamoeba dispar
KDND

SEQ ID NO: 2433964 - protein, 7 aa, Entamoeba dispar
KDNDDYI

SEQ ID NO: 2433965 - protein, 10 aa, Entamoeba dispar
KDNDINKDKD

SEQ ID NO: 2433966 - protein, 12 aa, Entamoeba dispar
KDNDNKLTAEEL

SEQ ID NO: 2433967 - protein, 9 aa, Entamoeba dispar
KDNEDEEIY

SEQ ID NO: 2433968 - protein, 16 aa, Entamoeba dispar
KDNEGKDLTKRPLKDE

SEQ ID NO: 2433969 - protein, 7 aa, Entamoeba dispar
KDNEIEE

SEQ ID NO: 2433970 - protein, 8 aa, Entamoeba dispar
KDNEKENE

SEQ ID NO: 2433971 - protein, 12 aa, Entamoeba dispar
KDNEKKTQSTKI

SEQ ID NO: 2433972 - protein, 12 aa, Entamoeba dispar
KDNERQRKQRTF

SEQ ID NO: 2433973 - protein, 9 aa, Entamoeba dispar
KDNGKNEPI

SEQ ID NO: 2433974 - protein, 4 aa, Entamoeba dispar
KDNI

SEQ ID NO: 2433975 - protein, 14 aa, Entamoeba dispar
KDNKCGDAYKRRGQ

SEQ ID NO: 2433976 - protein, 10 aa, Entamoeba dispar
KDNKDTDKIQ

SEQ ID NO: 2433977 - protein, 7 aa, Entamoeba dispar
KDNKELP

SEQ ID NO: 2433978 - protein, 6 aa, Entamoeba dispar
KDNKER

SEQ ID NO: 2433979 - protein, 11 aa, Entamoeba dispar
KDNKKKKNYTE

SEQ ID NO: 2433980 - protein, 5 aa, Entamoeba dispar
KDNKP

SEQ ID NO: 2433981 - protein, 15 aa, Entamoeba dispar
KDNNFDPRKYTEEYP

SEQ ID NO: 2433982 - protein, 6 aa, Entamoeba dispar
KDNNGK

SEQ ID NO: 2433983 - protein, 12 aa, Entamoeba dispar
KDNQEQKKVDEI

SEQ ID NO: 2433984 - protein, 15 aa, Entamoeba dispar
KDNQIYSDNENEQRY

SEQ ID NO: 2433985 - protein, 5 aa, Entamoeba dispar
KDNRK

SEQ ID NO: 2433986 - protein, 5 aa, Entamoeba dispar
KDNSQ

SEQ ID NO: 2433987 - protein, 8 aa, Entamoeba dispar
KDNTGKIP

SEQ ID NO: 2433988 - protein, 12 aa, Entamoeba dispar
KDNTKSITKSNF

SEQ ID NO: 2433989 - protein, 6 aa, Entamoeba dispar
KDNTNN

SEQ ID NO: 2433990 - protein, 8 aa, Entamoeba dispar
KDNTPIIT

SEQ ID NO: 2433991 - protein, 11 aa, Entamoeba dispar
KDNTTKLEEDL

SEQ ID NO: 2433992 - protein, 4 aa, Entamoeba dispar
KDNV

SEQ ID NO: 2433993 - protein, 10 aa, Entamoeba dispar
KDPAERLGGE

SEQ ID NO: 2433994 - protein, 7 aa, Entamoeba dispar
KDPAQFS

SEQ ID NO: 2433995 - protein, 5 aa, Entamoeba dispar
KDPAV

SEQ ID NO: 2433996 - protein, 4 aa, Entamoeba dispar
KDPE

SEQ ID NO: 2433997 - protein, 8 aa, Entamoeba dispar
KDPEDPKR

SEQ ID NO: 2433998 - protein, 8 aa, Entamoeba dispar
KDPEHPSV

SEQ ID NO: 2433999 - protein, 14 aa, Entamoeba dispar
KDPEKRLTDPNRIK

SEQ ID NO: 2434000 - protein, 6 aa, Entamoeba dispar
KDPENG

SEQ ID NO: 2434001 - protein, 9 aa, Entamoeba dispar
KDPETGDFN

SEQ ID NO: 2434002 - protein, 22 aa, Entamoeba dispar
KDPIESEKESEDMAQQEENYNA

SEQ ID NO: 2434003 - protein, 8 aa, Entamoeba dispar
KDPINKEA

SEQ ID NO: 2434004 - protein, 6 aa, Entamoeba dispar
KDPKEE

SEQ ID NO: 2434005 - protein, 16 aa, Entamoeba dispar
KDPMRKRRASTATYED

SEQ ID NO: 2434006 - protein, 8 aa, Entamoeba dispar
KDPNEEDI

SEQ ID NO: 2434007 - protein, 8 aa, Entamoeba dispar
KDPNERQW

SEQ ID NO: 2434008 - protein, 16 aa, Entamoeba dispar
KDPNNLKKLRKEPKYR

SEQ ID NO: 2434009 - protein, 4 aa, Entamoeba dispar
KDPQ

SEQ ID NO: 2434010 - protein, 8 aa, Entamoeba dispar
KDPRGNTP

SEQ ID NO: 2434011 - protein, 25 aa, Entamoeba dispar
KDPRVSRPFKKRNRIEGIASQQQKV

SEQ ID NO: 2434012 - protein, 7 aa, Entamoeba dispar
KDPSALV

SEQ ID NO: 2434013 - protein, 7 aa, Entamoeba dispar
KDPSSDI

SEQ ID NO: 2434014 - protein, 6 aa, Entamoeba dispar
KDPTNV

SEQ ID NO: 2434015 - protein, 6 aa, Entamoeba dispar
KDPTQH

SEQ ID NO: 2434016 - protein, 13 aa, Entamoeba dispar
KDPTQRIKDGQIK

SEQ ID NO: 2434017 - protein, 4 aa, Entamoeba dispar
KDPY

SEQ ID NO: 2434018 - protein, 7 aa, Entamoeba dispar
KDPYNSI

SEQ ID NO: 2434019 - protein, 9 aa, Entamoeba dispar
KDPYYDDQY

SEQ ID NO: 2434020 - protein, 6 aa, Entamoeba dispar
KDQAER

SEQ ID NO: 2434021 - protein, 42 aa, Entamoeba dispar
KDQAKEEKLKGEVKNEIDDKYEEEVQGEDQVMKEESDEEENE

SEQ ID NO: 2434022 - protein, 19 aa, Entamoeba dispar
KDQCDNITQENNDNNSDKG

SEQ ID NO: 2434023 - protein, 21 aa, Entamoeba dispar
KDQCDNITQENNDNNSDKGIR

SEQ ID NO: 2434024 - protein, 6 aa, Entamoeba dispar
KDQDGF

SEQ ID NO: 2434025 - protein, 4 aa, Entamoeba dispar
KDQE

SEQ ID NO: 2434026 - protein, 9 aa, Entamoeba dispar
KDQGNNAQV

SEQ ID NO: 2434027 - protein, 4 aa, Entamoeba dispar
KDQH

SEQ ID NO: 2434028 - protein, 4 aa, Entamoeba dispar
KDQI

SEQ ID NO: 2434029 - protein, 10 aa, Entamoeba dispar
KDQITQEQKL

SEQ ID NO: 2434030 - protein, 6 aa, Entamoeba dispar
KDQKNE

SEQ ID NO: 2434031 - protein, 7 aa, Entamoeba dispar
KDQKPWK

SEQ ID NO: 2434032 - protein, 17 aa, Entamoeba dispar
KDQKTFDKYATETSRTI

SEQ ID NO: 2434033 - protein, 5 aa, Entamoeba dispar
KDQLE

SEQ ID NO: 2434034 - protein, 11 aa, Entamoeba dispar
KDQLKVQQKHN

SEQ ID NO: 2434035 - protein, 6 aa, Entamoeba dispar
KDQNNI

SEQ ID NO: 2434036 - protein, 8 aa, Entamoeba dispar
KDQPLTEN

SEQ ID NO: 2434037 - protein, 58 aa, Entamoeba dispar
KDQPPRISITPKPTSNNPFGEPNSSINSNNPFGQPETAPAIKGTRPSFPKPKAVGNQI

SEQ ID NO: 2434038 - protein, 8 aa, Entamoeba dispar
KDQQEESL

SEQ ID NO: 2434039 - protein, 9 aa, Entamoeba dispar
KDQQGSRKI

SEQ ID NO: 2434040 - protein, 8 aa, Entamoeba dispar
KDQQGSRR

SEQ ID NO: 2434041 - protein, 14 aa, Entamoeba dispar
KDQQSQVETIKSQL

SEQ ID NO: 2434042 - protein, 6 aa, Entamoeba dispar
KDQSIH

SEQ ID NO: 2434043 - protein, 5 aa, Entamoeba dispar
KDQSN

SEQ ID NO: 2434044 - protein, 12 aa, Entamoeba dispar
KDQSQAQLEGRV

SEQ ID NO: 2434045 - protein, 6 aa, Entamoeba dispar
KDQSTG

SEQ ID NO: 2434046 - protein, 8 aa, Entamoeba dispar
KDQYKDDD

SEQ ID NO: 2434047 - protein, 5 aa, Entamoeba dispar
KDRDG

SEQ ID NO: 2434048 - protein, 13 aa, Entamoeba dispar
KDRDNKTKDFQGT

SEQ ID NO: 2434049 - protein, 8 aa, Entamoeba dispar
KDRENGSV

SEQ ID NO: 2434050 - protein, 7 aa, Entamoeba dispar
KDRETRI

SEQ ID NO: 2434051 - protein, 24 aa, Entamoeba dispar
KDRGRTNEKSYDKKRISSEERNEM

SEQ ID NO: 2434052 - protein, 14 aa, Entamoeba dispar
KDRIKRGRISNTTE

SEQ ID NO: 2434053 - protein, 9 aa, Entamoeba dispar
KDRITKERE

SEQ ID NO: 2434054 - protein, 8 aa, Entamoeba dispar
KDRKEIKA

SEQ ID NO: 2434055 - protein, 8 aa, Entamoeba dispar
KDRKIPGM

SEQ ID NO: 2434056 - protein, 7 aa, Entamoeba dispar
KDRKKSQ

SEQ ID NO: 2434057 - protein, 9 aa, Entamoeba dispar
KDRLTPDQA

SEQ ID NO: 2434058 - protein, 23 aa, Entamoeba dispar
KDRNEKDTGITKKNENKKSKCYI

SEQ ID NO: 2434059 - protein, 7 aa, Entamoeba dispar
KDRNPFS

SEQ ID NO: 2434060 - protein, 8 aa, Entamoeba dispar
KDRPQTKK

SEQ ID NO: 2434061 - protein, 7 aa, Entamoeba dispar
KDRQDDC

SEQ ID NO: 2434062 - protein, 34 aa, Entamoeba dispar
KDRQKKEKETQDKSRIPKESVSQRFKKSQNEREE

SEQ ID NO: 2434063 - protein, 16 aa, Entamoeba dispar
KDRRTITKSEKATLNK

SEQ ID NO: 2434064 - protein, 16 aa, Entamoeba dispar
KDRRTITKTEKATLNK

SEQ ID NO: 2434065 - protein, 8 aa, Entamoeba dispar
KDRRTQPL

SEQ ID NO: 2434066 - protein, 5 aa, Entamoeba dispar
KDRTF

SEQ ID NO: 2434067 - protein, 14 aa, Entamoeba dispar
KDSCHSLENDSLEY

SEQ ID NO: 2434068 - protein, 8 aa, Entamoeba dispar
KDSCRQTM

SEQ ID NO: 2434069 - protein, 10 aa, Entamoeba dispar
KDSDAKEEVN

SEQ ID NO: 2434070 - protein, 6 aa, Entamoeba dispar
KDSDDN

SEQ ID NO: 2434071 - protein, 10 aa, Entamoeba dispar
KDSDKEISQK

SEQ ID NO: 2434072 - protein, 9 aa, Entamoeba dispar
KDSDVNDNN

SEQ ID NO: 2434073 - protein, 15 aa, Entamoeba dispar
KDSEINDKIGTQENE

SEQ ID NO: 2434074 - protein, 4 aa, Entamoeba dispar
KDSF

SEQ ID NO: 2434075 - protein, 11 aa, Entamoeba dispar
KDSFNGGDSFG

SEQ ID NO: 2434076 - protein, 9 aa, Entamoeba dispar
KDSGENLDI

SEQ ID NO: 2434077 - protein, 13 aa, Entamoeba dispar
KDSHDQKDGINRV

SEQ ID NO: 2434078 - protein, 4 aa, Entamoeba dispar
KDSI

SEQ ID NO: 2434079 - protein, 6 aa, Entamoeba dispar
KDSIQN

SEQ ID NO: 2434080 - protein, 12 aa, Entamoeba dispar
KDSIQSVTNPKY

SEQ ID NO: 2434081 - protein, 8 aa, Entamoeba dispar
KDSKGETV

SEQ ID NO: 2434082 - protein, 6 aa, Entamoeba dispar
KDSKGI

SEQ ID NO: 2434083 - protein, 6 aa, Entamoeba dispar
KDSKNK

SEQ ID NO: 2434084 - protein, 8 aa, Entamoeba dispar
KDSKRAEL

SEQ ID NO: 2434085 - protein, 11 aa, Entamoeba dispar
KDSKRKKGIKV

SEQ ID NO: 2434086 - protein, 6 aa, Entamoeba dispar
KDSLAK

SEQ ID NO: 2434087 - protein, 7 aa, Entamoeba dispar
KDSLENT

SEQ ID NO: 2434088 - protein, 8 aa, Entamoeba dispar
KDSLKKEN

SEQ ID NO: 2434089 - protein, 7 aa, Entamoeba dispar
KDSMRGE

SEQ ID NO: 2434090 - protein, 8 aa, Entamoeba dispar
KDSNEHSI

SEQ ID NO: 2434091 - protein, 6 aa, Entamoeba dispar
KDSNGH

SEQ ID NO: 2434092 - protein, 7 aa, Entamoeba dispar
KDSNHPL

SEQ ID NO: 2434093 - protein, 6 aa, Entamoeba dispar
KDSNQL

SEQ ID NO: 2434094 - protein, 7 aa, Entamoeba dispar
KDSNTSV

SEQ ID NO: 2434095 - protein, 8 aa, Entamoeba dispar
KDSPMKEQ

SEQ ID NO: 2434096 - protein, 6 aa, Entamoeba dispar
KDSPNS

SEQ ID NO: 2434097 - protein, 6 aa, Entamoeba dispar
KDSQKN

SEQ ID NO: 2434098 - protein, 11 aa, Entamoeba dispar
KDSQVDQKPTI

SEQ ID NO: 2434099 - protein, 10 aa, Entamoeba dispar
KDSRSNSPNL

SEQ ID NO: 2434100 - protein, 4 aa, Entamoeba dispar
KDSS

SEQ ID NO: 2434101 - protein, 9 aa, Entamoeba dispar
KDSSDPNPL

SEQ ID NO: 2434102 - protein, 11 aa, Entamoeba dispar
KDSSEKSDESL

SEQ ID NO: 2434103 - protein, 9 aa, Entamoeba dispar
KDSSIPQKM

SEQ ID NO: 2434104 - protein, 9 aa, Entamoeba dispar
KDSSISSSF

SEQ ID NO: 2434105 - protein, 11 aa, Entamoeba dispar
KDSSLRPSASE

SEQ ID NO: 2434106 - protein, 7 aa, Entamoeba dispar
KDSSLSL

SEQ ID NO: 2434107 - protein, 6 aa, Entamoeba dispar
KDSSSA

SEQ ID NO: 2434108 - protein, 6 aa, Entamoeba dispar
KDSSSL

SEQ ID NO: 2434109 - protein, 6 aa, Entamoeba dispar
KDSTAF

SEQ ID NO: 2434110 - protein, 4 aa, Entamoeba dispar
KDSV

SEQ ID NO: 2434111 - protein, 15 aa, Entamoeba dispar
KDSVKIESKSGTKTM

SEQ ID NO: 2434112 - protein, 8 aa, Entamoeba dispar
KDSVSAKG

SEQ ID NO: 2434113 - protein, 7 aa, Entamoeba dispar
KDSVTTP

SEQ ID NO: 2434114 - protein, 7 aa, Entamoeba dispar
KDSYDLS

SEQ ID NO: 2434115 - protein, 9 aa, Entamoeba dispar
KDSYGITKK

SEQ ID NO: 2434116 - protein, 7 aa, Entamoeba dispar
KDSYLPP

SEQ ID NO: 2434117 - protein, 6 aa, Entamoeba dispar
KDSYYN

SEQ ID NO: 2434118 - protein, 5 aa, Entamoeba dispar
KDTDI

SEQ ID NO: 2434119 - protein, 7 aa, Entamoeba dispar
KDTDKNI

SEQ ID NO: 2434120 - protein, 5 aa, Entamoeba dispar
KDTDQ

SEQ ID NO: 2434121 - protein, 6 aa, Entamoeba dispar
KDTEEW

SEQ ID NO: 2434122 - protein, 9 aa, Entamoeba dispar
KDTERFQES

SEQ ID NO: 2434123 - protein, 4 aa, Entamoeba dispar
KDTF

SEQ ID NO: 2434124 - protein, 5 aa, Entamoeba dispar
KDTFE

SEQ ID NO: 2434125 - protein, 7 aa, Entamoeba dispar
KDTFKGI

SEQ ID NO: 2434126 - protein, 6 aa, Entamoeba dispar
KDTGKL

SEQ ID NO: 2434127 - protein, 6 aa, Entamoeba dispar
KDTHSF

SEQ ID NO: 2434128 - protein, 4 aa, Entamoeba dispar
KDTI

SEQ ID NO: 2434129 - protein, 12 aa, Entamoeba dispar
KDTIQKDIGTDN

SEQ ID NO: 2434130 - protein, 6 aa, Entamoeba dispar
KDTITE

SEQ ID NO: 2434131 - protein, 6 aa, Entamoeba dispar
KDTKEM

SEQ ID NO: 2434132 - protein, 5 aa, Entamoeba dispar
KDTKI

SEQ ID NO: 2434133 - protein, 7 aa, Entamoeba dispar
KDTKPGM

SEQ ID NO: 2434134 - protein, 7 aa, Entamoeba dispar
KDTLETA

SEQ ID NO: 2434135 - protein, 11 aa, Entamoeba dispar
KDTLEVSKTKK

SEQ ID NO: 2434136 - protein, 7 aa, Entamoeba dispar
KDTNDRI

SEQ ID NO: 2434137 - protein, 10 aa, Entamoeba dispar
KDTNKTKRTV

SEQ ID NO: 2434138 - protein, 6 aa, Entamoeba dispar
KDTPTY

SEQ ID NO: 2434139 - protein, 7 aa, Entamoeba dispar
KDTPVDS

SEQ ID NO: 2434140 - protein, 7 aa, Entamoeba dispar
KDTPYEG

SEQ ID NO: 2434141 - protein, 9 aa, Entamoeba dispar
KDTQPLQKR

SEQ ID NO: 2434142 - protein, 6 aa, Entamoeba dispar
KDTQSD

SEQ ID NO: 2434143 - protein, 9 aa, Entamoeba dispar
KDTQTAEKC

SEQ ID NO: 2434144 - protein, 8 aa, Entamoeba dispar
KDTRGKTL

SEQ ID NO: 2434145 - protein, 24 aa, Entamoeba dispar
KDTRKLKNSVVKSAGNRQESSTYN

SEQ ID NO: 2434146 - protein, 13 aa, Entamoeba dispar
KDTRSSRSASTDF

SEQ ID NO: 2434147 - protein, 21 aa, Entamoeba dispar
KDTRYGSEDETMSHDKESWKA

SEQ ID NO: 2434148 - protein, 8 aa, Entamoeba dispar
KDTSDGYI

SEQ ID NO: 2434149 - protein, 10 aa, Entamoeba dispar
KDTSNTKTEI

SEQ ID NO: 2434150 - protein, 6 aa, Entamoeba dispar
KDTSPC

SEQ ID NO: 2434151 - protein, 8 aa, Entamoeba dispar
KDTTIEEK

SEQ ID NO: 2434152 - protein, 11 aa, Entamoeba dispar
KDTYKEERKRR

SEQ ID NO: 2434153 - protein, 5 aa, Entamoeba dispar
KDVAS

SEQ ID NO: 2434154 - protein, 19 aa, Entamoeba dispar
KDVDDDDDKMNKENQGENY

SEQ ID NO: 2434155 - protein, 7 aa, Entamoeba dispar
KDVDDLS

SEQ ID NO: 2434156 - protein, 9 aa, Entamoeba dispar
KDVDEEDDD

SEQ ID NO: 2434157 - protein, 10 aa, Entamoeba dispar
KDVDPEGERT

SEQ ID NO: 2434158 - protein, 6 aa, Entamoeba dispar
KDVEEF

SEQ ID NO: 2434159 - protein, 6 aa, Entamoeba dispar
KDVEGK

SEQ ID NO: 2434160 - protein, 18 aa, Entamoeba dispar
KDVESRIDGDSRLTIPST

SEQ ID NO: 2434161 - protein, 4 aa, Entamoeba dispar
KDVK

SEQ ID NO: 2434162 - protein, 13 aa, Entamoeba dispar
KDVNEKDGQQINN

SEQ ID NO: 2434163 - protein, 8 aa, Entamoeba dispar
KDVPSQKN

SEQ ID NO: 2434164 - protein, 4 aa, Entamoeba dispar
KDVR

SEQ ID NO: 2434165 - protein, 22 aa, Entamoeba dispar
KDVRKTPLKLSTSTNTSNSKDI

SEQ ID NO: 2434166 - protein, 8 aa, Entamoeba dispar
KDVRNKAR

SEQ ID NO: 2434167 - protein, 13 aa, Entamoeba dispar
KDVRRTDNKHEKF

SEQ ID NO: 2434168 - protein, 6 aa, Entamoeba dispar
KDVSDQ

SEQ ID NO: 2434169 - protein, 6 aa, Entamoeba dispar
KDVSEV

SEQ ID NO: 2434170 - protein, 18 aa, Entamoeba dispar
KDVTEEEKEEKVNKAKKY

SEQ ID NO: 2434171 - protein, 14 aa, Entamoeba dispar
KDVTQFEETMKQNG

SEQ ID NO: 2434172 - protein, 21 aa, Entamoeba dispar
KDVVKAQNKAKQEYSKSHNNC

SEQ ID NO: 2434173 - protein, 21 aa, Entamoeba dispar
KDVVPKSQLEIKEKELEKQNQ

SEQ ID NO: 2434174 - protein, 4 aa, Entamoeba dispar
KDVY

SEQ ID NO: 2434175 - protein, 24 aa, Entamoeba dispar
KDWGKKGRSKHTNLKEEDTTYRNY

SEQ ID NO: 2434176 - protein, 12 aa, Entamoeba dispar
KDWSQKKYNEQE

SEQ ID NO: 2434177 - protein, 7 aa, Entamoeba dispar
KDYAAQG

SEQ ID NO: 2434178 - protein, 4 aa, Entamoeba dispar
KDYE

SEQ ID NO: 2434179 - protein, 22 aa, Entamoeba dispar
KDYEELERKETDSRRSSGFETI

SEQ ID NO: 2434180 - protein, 15 aa, Entamoeba dispar
KDYEENGIGIVDRKC

SEQ ID NO: 2434181 - protein, 10 aa, Entamoeba dispar
KDYETQEING

SEQ ID NO: 2434182 - protein, 19 aa, Entamoeba dispar
KDYIDQSNSQEEEAKNVTT

SEQ ID NO: 2434183 - protein, 20 aa, Entamoeba dispar
KDYITKEELGAGKNRIDDDI

SEQ ID NO: 2434184 - protein, 6 aa, Entamoeba dispar
KDYITS

SEQ ID NO: 2434185 - protein, 13 aa, Entamoeba dispar
KDYKINENGFRKG

SEQ ID NO: 2434186 - protein, 6 aa, Entamoeba dispar
KDYKQT

SEQ ID NO: 2434187 - protein, 22 aa, Entamoeba dispar
KDYNIESSTLNSEIKTSLRKRA

SEQ ID NO: 2434188 - protein, 13 aa, Entamoeba dispar
KDYNKEDEEMCNE

SEQ ID NO: 2434189 - protein, 10 aa, Entamoeba dispar
KDYNKEEEKK

SEQ ID NO: 2434190 - protein, 4 aa, Entamoeba dispar
KDYP

SEQ ID NO: 2434191 - protein, 10 aa, Entamoeba dispar
KDYPNNPPKM

SEQ ID NO: 2434192 - protein, 5 aa, Entamoeba dispar
KDYQP

SEQ ID NO: 2434193 - protein, 8 aa, Entamoeba dispar
KDYRPKST

SEQ ID NO: 2434194 - protein, 8 aa, Entamoeba dispar
KDYRRRTK

SEQ ID NO: 2434195 - protein, 6 aa, Entamoeba dispar
KDYSEP

SEQ ID NO: 2434196 - protein, 8 aa, Entamoeba dispar
KDYSNEEF

SEQ ID NO: 2434197 - protein, 7 aa, Entamoeba dispar
KDYTDTE

SEQ ID NO: 2434198 - protein, 6 aa, Entamoeba dispar
KDYTIP

SEQ ID NO: 2434199 - protein, 7 aa, Entamoeba dispar
KDYTSEE

SEQ ID NO: 2434200 - protein, 34 aa, Entamoeba dispar
KDYYNQVSQEEQAKQNGQITKVDNTVKSNEDYAK

SEQ ID NO: 2434201 - protein, 31 aa, Entamoeba dispar
KEAATQAKTMQSESERSQLSSIRSKEPQLRY

SEQ ID NO: 2434202 - protein, 12 aa, Entamoeba dispar
KEACPREEKLSE

SEQ ID NO: 2434203 - protein, 11 aa, Entamoeba dispar
KEADADGDKKI

SEQ ID NO: 2434204 - protein, 14 aa, Entamoeba dispar
KEADEAMKTPEDGI

SEQ ID NO: 2434205 - protein, 5 aa, Entamoeba dispar
KEADK

SEQ ID NO: 2434206 - protein, 10 aa, Entamoeba dispar
KEAEAIGKRL

SEQ ID NO: 2434207 - protein, 9 aa, Entamoeba dispar
KEAEEELDK

SEQ ID NO: 2434208 - protein, 13 aa, Entamoeba dispar
KEAEKCTDNLNDE

SEQ ID NO: 2434209 - protein, 7 aa, Entamoeba dispar
KEAEQFA

SEQ ID NO: 2434210 - protein, 8 aa, Entamoeba dispar
KEAESYNG

SEQ ID NO: 2434211 - protein, 8 aa, Entamoeba dispar
KEAFDNGE

SEQ ID NO: 2434212 - protein, 14 aa, Entamoeba dispar
KEAFTRGSNTSHSE

SEQ ID NO: 2434213 - protein, 11 aa, Entamoeba dispar
KEAGKAENEGK

SEQ ID NO: 2434214 - protein, 11 aa, Entamoeba dispar
KEAGKSENEGK

SEQ ID NO: 2434215 - protein, 11 aa, Entamoeba dispar
KEAIKRSNTPV

SEQ ID NO: 2434216 - protein, 10 aa, Entamoeba dispar
KEAIKSKNTN

SEQ ID NO: 2434217 - protein, 8 aa, Entamoeba dispar
KEAINKEF

SEQ ID NO: 2434218 - protein, 5 aa, Entamoeba dispar
KEAKK

SEQ ID NO: 2434219 - protein, 8 aa, Entamoeba dispar
KEAKPGVE

SEQ ID NO: 2434220 - protein, 6 aa, Entamoeba dispar
KEAKRD

SEQ ID NO: 2434221 - protein, 19 aa, Entamoeba dispar
KEALEAKKLQQEIQNQRYT

SEQ ID NO: 2434222 - protein, 6 aa, Entamoeba dispar
KEANEY

SEQ ID NO: 2434223 - protein, 8 aa, Entamoeba dispar
KEAPEKCK

SEQ ID NO: 2434224 - protein, 7 aa, Entamoeba dispar
KEAPHDG

SEQ ID NO: 2434225 - protein, 4 aa, Entamoeba dispar
KEAQ

SEQ ID NO: 2434226 - protein, 14 aa, Entamoeba dispar
KEAREEIKEIRKSK

SEQ ID NO: 2434227 - protein, 13 aa, Entamoeba dispar
KEARKVSKEDKLG

SEQ ID NO: 2434228 - protein, 6 aa, Entamoeba dispar
KEASDE

SEQ ID NO: 2434229 - protein, 17 aa, Entamoeba dispar
KEATENGKKKMNVSQEV

SEQ ID NO: 2434230 - protein, 5 aa, Entamoeba dispar
KEATM

SEQ ID NO: 2434231 - protein, 10 aa, Entamoeba dispar
KEATNTSMEE

SEQ ID NO: 2434232 - protein, 10 aa, Entamoeba dispar
KEAVSDGRKR

SEQ ID NO: 2434233 - protein, 5 aa, Entamoeba dispar
KEAWN

SEQ ID NO: 2434234 - protein, 6 aa, Entamoeba dispar
KEAYDG

SEQ ID NO: 2434235 - protein, 16 aa, Entamoeba dispar
KEAYKSENKKGEETIT

SEQ ID NO: 2434236 - protein, 8 aa, Entamoeba dispar
KEAYTKSG

SEQ ID NO: 2434237 - protein, 6 aa, Entamoeba dispar
KECDEM

SEQ ID NO: 2434238 - protein, 16 aa, Entamoeba dispar
KECDSITTKSLKKDNN

SEQ ID NO: 2434239 - protein, 6 aa, Entamoeba dispar
KECEGS

SEQ ID NO: 2434240 - protein, 16 aa, Entamoeba dispar
KECGGSLPTQQQPTSL

SEQ ID NO: 2434241 - protein, 18 aa, Entamoeba dispar
KECKEPNRKSYAQGGSVN

SEQ ID NO: 2434242 - protein, 10 aa, Entamoeba dispar
KECKNEPKFK

SEQ ID NO: 2434243 - protein, 6 aa, Entamoeba dispar
KECKQQ

SEQ ID NO: 2434244 - protein, 9 aa, Entamoeba dispar
KECNEEEKK

SEQ ID NO: 2434245 - protein, 8 aa, Entamoeba dispar
KECQEKEC

SEQ ID NO: 2434246 - protein, 30 aa, Entamoeba dispar
KECQERTKQEKANKKMRKFEETEKGAEKAM

SEQ ID NO: 2434247 - protein, 6 aa, Entamoeba dispar
KECQTR

SEQ ID NO: 2434248 - protein, 8 aa, Entamoeba dispar
KECRKETI

SEQ ID NO: 2434249 - protein, 8 aa, Entamoeba dispar
KECRPEKL

SEQ ID NO: 2434250 - protein, 11 aa, Entamoeba dispar
KECSDDKNIRL

SEQ ID NO: 2434251 - protein, 10 aa, Entamoeba dispar
KEDATESEKI

SEQ ID NO: 2434252 - protein, 5 aa, Entamoeba dispar
KEDDD

SEQ ID NO: 2434253 - protein, 7 aa, Entamoeba dispar
KEDDGQF

SEQ ID NO: 2434254 - protein, 5 aa, Entamoeba dispar
KEDDH

SEQ ID NO: 2434255 - protein, 8 aa, Entamoeba dispar
KEDDKSHI

SEQ ID NO: 2434256 - protein, 14 aa, Entamoeba dispar
KEDDTGKLTVDYLG

SEQ ID NO: 2434257 - protein, 5 aa, Entamoeba dispar
KEDEE

SEQ ID NO: 2434258 - protein, 9 aa, Entamoeba dispar
KEDEERVKK

SEQ ID NO: 2434259 - protein, 9 aa, Entamoeba dispar
KEDEQNLGV

SEQ ID NO: 2434260 - protein, 7 aa, Entamoeba dispar
KEDETPL

SEQ ID NO: 2434261 - protein, 6 aa, Entamoeba dispar
KEDGER

SEQ ID NO: 2434262 - protein, 9 aa, Entamoeba dispar
KEDGFAEQN

SEQ ID NO: 2434263 - protein, 16 aa, Entamoeba dispar
KEDGVPSNCTNYTNGD

SEQ ID NO: 2434264 - protein, 31 aa, Entamoeba dispar
KEDIEEELSSVKEEMTKMEGEYRKKAAEIEK

SEQ ID NO: 2434265 - protein, 12 aa, Entamoeba dispar
KEDIENKKMEEG

SEQ ID NO: 2434266 - protein, 36 aa, Entamoeba dispar
KEDIERSVDEIQSRKEVSEEEMKGIKQKEDTNNNIF

SEQ ID NO: 2434267 - protein, 6 aa, Entamoeba dispar
KEDISP

SEQ ID NO: 2434268 - protein, 5 aa, Entamoeba dispar
KEDIT

SEQ ID NO: 2434269 - protein, 6 aa, Entamoeba dispar
KEDKAK

SEQ ID NO: 2434270 - protein, 13 aa, Entamoeba dispar
KEDKGINSITPKD

SEQ ID NO: 2434271 - protein, 9 aa, Entamoeba dispar
KEDKKETIS

SEQ ID NO: 2434272 - protein, 8 aa, Entamoeba dispar
KEDKKKFG

SEQ ID NO: 2434273 - protein, 17 aa, Entamoeba dispar
KEDKRGEFKSGKLDPET

SEQ ID NO: 2434274 - protein, 14 aa, Entamoeba dispar
KEDKTPPMSDDTKY

SEQ ID NO: 2434275 - protein, 4 aa, Entamoeba dispar
KEDL

SEQ ID NO: 2434276 - protein, 7 aa, Entamoeba dispar
KEDLNNL

SEQ ID NO: 2434277 - protein, 22 aa, Entamoeba dispar
KEDMKTEYIEPETKPTQPEVGK

SEQ ID NO: 2434278 - protein, 7 aa, Entamoeba dispar
KEDNDFN

SEQ ID NO: 2434279 - protein, 13 aa, Entamoeba dispar
KEDNEGLEGGASD

SEQ ID NO: 2434280 - protein, 6 aa, Entamoeba dispar
KEDNNV

SEQ ID NO: 2434281 - protein, 11 aa, Entamoeba dispar
KEDNTKKEYEW

SEQ ID NO: 2434282 - protein, 6 aa, Entamoeba dispar
KEDPAQ

SEQ ID NO: 2434283 - protein, 9 aa, Entamoeba dispar
KEDPKRAER

SEQ ID NO: 2434284 - protein, 6 aa, Entamoeba dispar
KEDPQI

SEQ ID NO: 2434285 - protein, 10 aa, Entamoeba dispar
KEDPTTIRKD

SEQ ID NO: 2434286 - protein, 15 aa, Entamoeba dispar
KEDRKSYGNTIPSEI

SEQ ID NO: 2434287 - protein, 13 aa, Entamoeba dispar
KEDSEPKTNQFNK

SEQ ID NO: 2434288 - protein, 20 aa, Entamoeba dispar
KEDSEVTKKAEKTKECTKKA

SEQ ID NO: 2434289 - protein, 5 aa, Entamoeba dispar
KEDSI

SEQ ID NO: 2434290 - protein, 4 aa, Entamoeba dispar
KEDT

SEQ ID NO: 2434291 - protein, 7 aa, Entamoeba dispar
KEDTETN

SEQ ID NO: 2434292 - protein, 12 aa, Entamoeba dispar
KEDTIAQTIPSE

SEQ ID NO: 2434293 - protein, 8 aa, Entamoeba dispar
KEDTQKKN

SEQ ID NO: 2434294 - protein, 7 aa, Entamoeba dispar
KEDTTRS

SEQ ID NO: 2434295 - protein, 8 aa, Entamoeba dispar
KEDTVTTG

SEQ ID NO: 2434296 - protein, 11 aa, Entamoeba dispar
KEDVKQTPSTI

SEQ ID NO: 2434297 - protein, 5 aa, Entamoeba dispar
KEDVN

SEQ ID NO: 2434298 - protein, 17 aa, Entamoeba dispar
KEDVQEEGKDGTEQPNN

SEQ ID NO: 2434299 - protein, 6 aa, Entamoeba dispar
KEDVSL

SEQ ID NO: 2434300 - protein, 6 aa, Entamoeba dispar
KEDYNT

SEQ ID NO: 2434301 - protein, 5 aa, Entamoeba dispar
KEDYP

SEQ ID NO: 2434302 - protein, 8 aa, Entamoeba dispar
KEEAEKRY

SEQ ID NO: 2434303 - protein, 26 aa, Entamoeba dispar
KEEAQKLQQKLQTTTEPLKSNRESLY

SEQ ID NO: 2434304 - protein, 8 aa, Entamoeba dispar
KEEAQTYL

SEQ ID NO: 2434305 - protein, 15 aa, Entamoeba dispar
KEECNEENETKEGSG

SEQ ID NO: 2434306 - protein, 6 aa, Entamoeba dispar
KEECRT

SEQ ID NO: 2434307 - protein, 5 aa, Entamoeba dispar
KEEDD

SEQ ID NO: 2434308 - protein, 6 aa, Entamoeba dispar
KEEDDL

SEQ ID NO: 2434309 - protein, 9 aa, Entamoeba dispar
KEEDEESDS

SEQ ID NO: 2434310 - protein, 20 aa, Entamoeba dispar
KEEDESMLTPEERKSDEELK

SEQ ID NO: 2434311 - protein, 25 aa, Entamoeba dispar
KEEDEVEDLNQNSDTEAAKGDESLN

SEQ ID NO: 2434312 - protein, 16 aa, Entamoeba dispar
KEEDFESEGVDEGECA

SEQ ID NO: 2434313 - protein, 5 aa, Entamoeba dispar
KEEDI

SEQ ID NO: 2434314 - protein, 7 aa, Entamoeba dispar
KEEDKDF

SEQ ID NO: 2434315 - protein, 9 aa, Entamoeba dispar
KEEDKDSNG

SEQ ID NO: 2434316 - protein, 7 aa, Entamoeba dispar
KEEDNEL

SEQ ID NO: 2434317 - protein, 16 aa, Entamoeba dispar
KEEDQSVKIPSTDYSK

SEQ ID NO: 2434318 - protein, 18 aa, Entamoeba dispar
KEEDSDEFQESEQADPLD

SEQ ID NO: 2434319 - protein, 11 aa, Entamoeba dispar
KEEDSEYSSER

SEQ ID NO: 2434320 - protein, 44 aa, Entamoeba dispar
KEEDSRSKTGSIVSSTTGKRKKKENKKVMESPQKPSLADEHRNE

SEQ ID NO: 2434321 - protein, 6 aa, Entamoeba dispar
KEEDVE

SEQ ID NO: 2434322 - protein, 5 aa, Entamoeba dispar
KEEEC

SEQ ID NO: 2434323 - protein, 18 aa, Entamoeba dispar
KEEEDHSEEVVQFFESLK

SEQ ID NO: 2434324 - protein, 8 aa, Entamoeba dispar
KEEEDKIN

SEQ ID NO: 2434325 - protein, 12 aa, Entamoeba dispar
KEEEDSEYSEER

SEQ ID NO: 2434326 - protein, 10 aa, Entamoeba dispar
KEEEDTTTDL

SEQ ID NO: 2434327 - protein, 9 aa, Entamoeba dispar
KEEEEDITQ

SEQ ID NO: 2434328 - protein, 45 aa, Entamoeba dispar
KEEEEKIKKEQEEKAKREEEKEIERKRKEAEDERKRIEEEHKKMQ

SEQ ID NO: 2434329 - protein, 25 aa, Entamoeba dispar
KEEEENKKEIKIKEETKPQRRKTEL

SEQ ID NO: 2434330 - protein, 43 aa, Entamoeba dispar
KEEEERAKRHRHSETSSRRRKTEEPTEDIKTDKSTNEEKTGDV

SEQ ID NO: 2434331 - protein, 8 aa, Entamoeba dispar
KEEEESNN

SEQ ID NO: 2434332 - protein, 20 aa, Entamoeba dispar
KEEEETDIKPEEKQADAELK

SEQ ID NO: 2434333 - protein, 6 aa, Entamoeba dispar
KEEEIE

SEQ ID NO: 2434334 - protein, 22 aa, Entamoeba dispar
KEEEIEENEDTTEDANSQDAED

SEQ ID NO: 2434335 - protein, 9 aa, Entamoeba dispar
KEEEITEIE

SEQ ID NO: 2434336 - protein, 5 aa, Entamoeba dispar
KEEEK

SEQ ID NO: 2434337 - protein, 8 aa, Entamoeba dispar
KEEEKEFA

SEQ ID NO: 2434338 - protein, 22 aa, Entamoeba dispar
KEEEKETTELELKENKKNIQEL

SEQ ID NO: 2434339 - protein, 6 aa, Entamoeba dispar
KEEEKF

SEQ ID NO: 2434340 - protein, 27 aa, Entamoeba dispar
KEEENKGKELEKKVKQETKPKRRKTQL

SEQ ID NO: 2434341 - protein, 12 aa, Entamoeba dispar
KEEEPQSKPILS

SEQ ID NO: 2434342 - protein, 16 aa, Entamoeba dispar
KEEEQKEIKKEKDSSL

SEQ ID NO: 2434343 - protein, 13 aa, Entamoeba dispar
KEEEQKKQPVAIE

SEQ ID NO: 2434344 - protein, 32 aa, Entamoeba dispar
KEEEQPKQKNKVKKEKFEKKKIEATKINEGTD

SEQ ID NO: 2434345 - protein, 7 aa, Entamoeba dispar
KEEEQQK

SEQ ID NO: 2434346 - protein, 5 aa, Entamoeba dispar
KEEER

SEQ ID NO: 2434347 - protein, 7 aa, Entamoeba dispar
KEEESEI

SEQ ID NO: 2434348 - protein, 7 aa, Entamoeba dispar
KEEESGL

SEQ ID NO: 2434349 - protein, 27 aa, Entamoeba dispar
KEEESIKEENEEEEKEEKKKMEEEEID

SEQ ID NO: 2434350 - protein, 7 aa, Entamoeba dispar
KEEETFE

SEQ ID NO: 2434351 - protein, 9 aa, Entamoeba dispar
KEEETGENM

SEQ ID NO: 2434352 - protein, 8 aa, Entamoeba dispar
KEEETNKK

SEQ ID NO: 2434353 - protein, 9 aa, Entamoeba dispar
KEEETNPVT

SEQ ID NO: 2434354 - protein, 9 aa, Entamoeba dispar
KEEEVSENC

SEQ ID NO: 2434355 - protein, 9 aa, Entamoeba dispar
KEEEWTDDA

SEQ ID NO: 2434356 - protein, 12 aa, Entamoeba dispar
KEEEYSEYSSER

SEQ ID NO: 2434357 - protein, 7 aa, Entamoeba dispar
KEEFDNI

SEQ ID NO: 2434358 - protein, 15 aa, Entamoeba dispar
KEEFEKVEDQSPENI

SEQ ID NO: 2434359 - protein, 5 aa, Entamoeba dispar
KEEFQ

SEQ ID NO: 2434360 - protein, 7 aa, Entamoeba dispar
KEEGESH

SEQ ID NO: 2434361 - protein, 5 aa, Entamoeba dispar
KEEGK

SEQ ID NO: 2434362 - protein, 10 aa, Entamoeba dispar
KEEGNNGERK

SEQ ID NO: 2434363 - protein, 24 aa, Entamoeba dispar
KEEHENNVKNLQNEINEKINQNNE

SEQ ID NO: 2434364 - protein, 39 aa, Entamoeba dispar
KEEHHSESKKEEHHSEPKKEERNVEVKKEEATISPETKT

SEQ ID NO: 2434365 - protein, 6 aa, Entamoeba dispar
KEEHYE

SEQ ID NO: 2434366 - protein, 5 aa, Entamoeba dispar
KEEID

SEQ ID NO: 2434367 - protein, 12 aa, Entamoeba dispar
KEEIDQETKNKI

SEQ ID NO: 2434368 - protein, 21 aa, Entamoeba dispar
KEEIKEDHTEDQLSEQLSEKP

SEQ ID NO: 2434369 - protein, 6 aa, Entamoeba dispar
KEEIKL

SEQ ID NO: 2434370 - protein, 14 aa, Entamoeba dispar
KEEIKPKSISQISR

SEQ ID NO: 2434371 - protein, 11 aa, Entamoeba dispar
KEEIKSNEKEA

SEQ ID NO: 2434372 - protein, 7 aa, Entamoeba dispar
KEEIQRQ

SEQ ID NO: 2434373 - protein, 6 aa, Entamoeba dispar
KEEIQS

SEQ ID NO: 2434374 - protein, 7 aa, Entamoeba dispar
KEEIRNE

SEQ ID NO: 2434375 - protein, 9 aa, Entamoeba dispar
KEEISKEPI

SEQ ID NO: 2434376 - protein, 6 aa, Entamoeba dispar
KEEITE

SEQ ID NO: 2434377 - protein, 4 aa, Entamoeba dispar
KEEK

SEQ ID NO: 2434378 - protein, 8 aa, Entamoeba dispar
KEEKAPLR

SEQ ID NO: 2434379 - protein, 5 aa, Entamoeba dispar
KEEKE

SEQ ID NO: 2434380 - protein, 9 aa, Entamoeba dispar
KEEKEEKMG

SEQ ID NO: 2434381 - protein, 7 aa, Entamoeba dispar
KEEKEIN

SEQ ID NO: 2434382 - protein, 7 aa, Entamoeba dispar
KEEKEKL

SEQ ID NO: 2434383 - protein, 20 aa, Entamoeba dispar
KEEKENKIQQQQEEQQQREL

SEQ ID NO: 2434384 - protein, 10 aa, Entamoeba dispar
KEEKEQPQEL

SEQ ID NO: 2434385 - protein, 7 aa, Entamoeba dispar
KEEKERI

SEQ ID NO: 2434386 - protein, 7 aa, Entamoeba dispar
KEEKGYQ

SEQ ID NO: 2434387 - protein, 6 aa, Entamoeba dispar
KEEKIP

SEQ ID NO: 2434388 - protein, 24 aa, Entamoeba dispar
KEEKKEKEQKVKEETKPQRRKTEL

SEQ ID NO: 2434389 - protein, 9 aa, Entamoeba dispar
KEEKKEKQK

SEQ ID NO: 2434390 - protein, 7 aa, Entamoeba dispar
KEEKKLN

SEQ ID NO: 2434391 - protein, 24 aa, Entamoeba dispar
KEEKKQKEEKIKEETKPQRRKTEL

SEQ ID NO: 2434392 - protein, 5 aa, Entamoeba dispar
KEEKL

SEQ ID NO: 2434393 - protein, 11 aa, Entamoeba dispar
KEEKLKQDIQT

SEQ ID NO: 2434394 - protein, 9 aa, Entamoeba dispar
KEEKNDERY

SEQ ID NO: 2434395 - protein, 12 aa, Entamoeba dispar
KEEKNNKRIKEI

SEQ ID NO: 2434396 - protein, 12 aa, Entamoeba dispar
KEEKNNRKSSDD

SEQ ID NO: 2434397 - protein, 10 aa, Entamoeba dispar
KEEKNTQLKE

SEQ ID NO: 2434398 - protein, 23 aa, Entamoeba dispar
KEEKQKRKKVPKPIKTRKGDSRL

SEQ ID NO: 2434399 - protein, 7 aa, Entamoeba dispar
KEEKQSF

SEQ ID NO: 2434400 - protein, 9 aa, Entamoeba dispar
KEEKSSTLP

SEQ ID NO: 2434401 - protein, 15 aa, Entamoeba dispar
KEEKSVKQGKSKSGY

SEQ ID NO: 2434402 - protein, 6 aa, Entamoeba dispar
KEEKYE

SEQ ID NO: 2434403 - protein, 5 aa, Entamoeba dispar
KEELE

SEQ ID NO: 2434404 - protein, 5 aa, Entamoeba dispar
KEELK

SEQ ID NO: 2434405 - protein, 30 aa, Entamoeba dispar
KEELKKSKEEIKAEFEQRKNELKQGEKSTL

SEQ ID NO: 2434406 - protein, 15 aa, Entamoeba dispar
KEELKKSKNIGPKKV

SEQ ID NO: 2434407 - protein, 7 aa, Entamoeba dispar
KEELKQS

SEQ ID NO: 2434408 - protein, 6 aa, Entamoeba dispar
KEELND

SEQ ID NO: 2434409 - protein, 8 aa, Entamoeba dispar
KEELPTSR

SEQ ID NO: 2434410 - protein, 4 aa, Entamoeba dispar
KEEM

SEQ ID NO: 2434411 - protein, 19 aa, Entamoeba dispar
KEEMPGGEKRELTAHNEGD

SEQ ID NO: 2434412 - protein, 6 aa, Entamoeba dispar
KEEMWN

SEQ ID NO: 2434413 - protein, 4 aa, Entamoeba dispar
KEEN

SEQ ID NO: 2434414 - protein, 19 aa, Entamoeba dispar
KEENERIKKALKSKQNECV

SEQ ID NO: 2434415 - protein, 14 aa, Entamoeba dispar
KEENERTSKELKDH

SEQ ID NO: 2434416 - protein, 19 aa, Entamoeba dispar
KEENIEEDKIEDKEEINKI

SEQ ID NO: 2434417 - protein, 6 aa, Entamoeba dispar
KEENIN

SEQ ID NO: 2434418 - protein, 12 aa, Entamoeba dispar
KEENKQPKPSIK

SEQ ID NO: 2434419 - protein, 8 aa, Entamoeba dispar
KEENQEKI

SEQ ID NO: 2434420 - protein, 7 aa, Entamoeba dispar
KEENSKE

SEQ ID NO: 2434421 - protein, 4 aa, Entamoeba dispar
KEEP

SEQ ID NO: 2434422 - protein, 33 aa, Entamoeba dispar
KEEPNNQKINEEELSNTKTLEEQQNTNQTESHK

SEQ ID NO: 2434423 - protein, 7 aa, Entamoeba dispar
KEEPRSA

SEQ ID NO: 2434424 - protein, 8 aa, Entamoeba dispar
KEEPSYEE

SEQ ID NO: 2434425 - protein, 4 aa, Entamoeba dispar
KEEQ

SEQ ID NO: 2434426 - protein, 6 aa, Entamoeba dispar
KEEQEI

SEQ ID NO: 2434427 - protein, 15 aa, Entamoeba dispar
KEEQHKFKQEDKNYQ

SEQ ID NO: 2434428 - protein, 6 aa, Entamoeba dispar
KEEQKF

SEQ ID NO: 2434429 - protein, 12 aa, Entamoeba dispar
KEEQNKRKNETS

SEQ ID NO: 2434430 - protein, 8 aa, Entamoeba dispar
KEEQNQVK

SEQ ID NO: 2434431 - protein, 6 aa, Entamoeba dispar
KEEQPF

SEQ ID NO: 2434432 - protein, 7 aa, Entamoeba dispar
KEEQRLL

SEQ ID NO: 2434433 - protein, 12 aa, Entamoeba dispar
KEEQTKYENELQ

SEQ ID NO: 2434434 - protein, 7 aa, Entamoeba dispar
KEERERT

SEQ ID NO: 2434435 - protein, 17 aa, Entamoeba dispar
KEERIIKEKEENKIKGT

SEQ ID NO: 2434436 - protein, 20 aa, Entamoeba dispar
KEERISTKKNALERAEKYQT

SEQ ID NO: 2434437 - protein, 5 aa, Entamoeba dispar
KEERK

SEQ ID NO: 2434438 - protein, 7 aa, Entamoeba dispar
KEERNKI

SEQ ID NO: 2434439 - protein, 5 aa, Entamoeba dispar
KEERQ

SEQ ID NO: 2434440 - protein, 14 aa, Entamoeba dispar
KEERSKNEKRNEYS

SEQ ID NO: 2434441 - protein, 10 aa, Entamoeba dispar
KEERTNFEEQ

SEQ ID NO: 2434442 - protein, 8 aa, Entamoeba dispar
KEESDGSL

SEQ ID NO: 2434443 - protein, 9 aa, Entamoeba dispar
KEESEKPQC

SEQ ID NO: 2434444 - protein, 11 aa, Entamoeba dispar
KEESEKPQNYT

SEQ ID NO: 2434445 - protein, 7 aa, Entamoeba dispar
KEESERI

SEQ ID NO: 2434446 - protein, 9 aa, Entamoeba dispar
KEESERYGR

SEQ ID NO: 2434447 - protein, 12 aa, Entamoeba dispar
KEESEYTPRENP

SEQ ID NO: 2434448 - protein, 10 aa, Entamoeba dispar
KEESKELTEI

SEQ ID NO: 2434449 - protein, 27 aa, Entamoeba dispar
KEESKKEKIQVSTKLSKKGKNINKSPN

SEQ ID NO: 2434450 - protein, 14 aa, Entamoeba dispar
KEESKSVSIPLPSE

SEQ ID NO: 2434451 - protein, 14 aa, Entamoeba dispar
KEESLNNNNNTIPK

SEQ ID NO: 2434452 - protein, 6 aa, Entamoeba dispar
KEESLP

SEQ ID NO: 2434453 - protein, 13 aa, Entamoeba dispar
KEESLSIKTEEIP

SEQ ID NO: 2434454 - protein, 11 aa, Entamoeba dispar
KEESSCKEAQN

SEQ ID NO: 2434455 - protein, 9 aa, Entamoeba dispar
KEESSSKKY

SEQ ID NO: 2434456 - protein, 19 aa, Entamoeba dispar
KEESSTPIEIKGEDSQTLE

SEQ ID NO: 2434457 - protein, 60 aa, Entamoeba dispar
KEESVKDSQEKEELVQPSNKENGLQDTTPLSKSAIKTKDETETNQRQEDKIAQEEEDEEL

SEQ ID NO: 2434458 - protein, 11 aa, Entamoeba dispar
KEETETKTAQE

SEQ ID NO: 2434459 - protein, 5 aa, Entamoeba dispar
KEETI

SEQ ID NO: 2434460 - protein, 8 aa, Entamoeba dispar
KEETINNS

SEQ ID NO: 2434461 - protein, 24 aa, Entamoeba dispar
KEETIQEKEINKDKIKKEEPQEDV

SEQ ID NO: 2434462 - protein, 16 aa, Entamoeba dispar
KEETKEVSQTVPEKPK

SEQ ID NO: 2434463 - protein, 20 aa, Entamoeba dispar
KEETNSDLNEVEKINKNNQI

SEQ ID NO: 2434464 - protein, 19 aa, Entamoeba dispar
KEETQELNKQLPEEIKKNE

SEQ ID NO: 2434465 - protein, 10 aa, Entamoeba dispar
KEETTPYDHK

SEQ ID NO: 2434466 - protein, 6 aa, Entamoeba dispar
KEETYN

SEQ ID NO: 2434467 - protein, 4 aa, Entamoeba dispar
KEEV

SEQ ID NO: 2434468 - protein, 5 aa, Entamoeba dispar
KEEVE

SEQ ID NO: 2434469 - protein, 9 aa, Entamoeba dispar
KEEVEKTLK

SEQ ID NO: 2434470 - protein, 12 aa, Entamoeba dispar
KEEVKEEKNIQE

SEQ ID NO: 2434471 - protein, 9 aa, Entamoeba dispar
KEEVKKTYQ

SEQ ID NO: 2434472 - protein, 15 aa, Entamoeba dispar
KEEVPKKRGRTRKTT

SEQ ID NO: 2434473 - protein, 6 aa, Entamoeba dispar
KEEVSK

SEQ ID NO: 2434474 - protein, 23 aa, Entamoeba dispar
KEEVSQGKEVNKAEVEEEDDPFE

SEQ ID NO: 2434475 - protein, 28 aa, Entamoeba dispar
KEEYEEMNNKNKEKGKIRKENNKNYLEE

SEQ ID NO: 2434476 - protein, 7 aa, Entamoeba dispar
KEEYEGT

SEQ ID NO: 2434477 - protein, 6 aa, Entamoeba dispar
KEEYKQ

SEQ ID NO: 2434478 - protein, 8 aa, Entamoeba dispar
KEEYPQES

SEQ ID NO: 2434479 - protein, 27 aa, Entamoeba dispar
KEFDFSDDDEKDDQLEMDPSTTEIPKR

SEQ ID NO: 2434480 - protein, 5 aa, Entamoeba dispar
KEFDK

SEQ ID NO: 2434481 - protein, 20 aa, Entamoeba dispar
KEFDKKKTDTIEEQKNLQTQ

SEQ ID NO: 2434482 - protein, 5 aa, Entamoeba dispar
KEFEE

SEQ ID NO: 2434483 - protein, 11 aa, Entamoeba dispar
KEFEEECKSRG

SEQ ID NO: 2434484 - protein, 5 aa, Entamoeba dispar
KEFEQ

SEQ ID NO: 2434485 - protein, 11 aa, Entamoeba dispar
KEFEQGSPLET

SEQ ID NO: 2434486 - protein, 16 aa, Entamoeba dispar
KEFERKKREGASEEEL

SEQ ID NO: 2434487 - protein, 6 aa, Entamoeba dispar
KEFERN

SEQ ID NO: 2434488 - protein, 11 aa, Entamoeba dispar
KEFGKQNSDSL

SEQ ID NO: 2434489 - protein, 18 aa, Entamoeba dispar
KEFGSNADQVKAERDRNY

SEQ ID NO: 2434490 - protein, 12 aa, Entamoeba dispar
KEFHTPKPRYIE

SEQ ID NO: 2434491 - protein, 25 aa, Entamoeba dispar
KEFKEENEKLKRERGGDEGREIKEK

SEQ ID NO: 2434492 - protein, 13 aa, Entamoeba dispar
KEFKEGKISSYDR

SEQ ID NO: 2434493 - protein, 10 aa, Entamoeba dispar
KEFKEKINKT

SEQ ID NO: 2434494 - protein, 7 aa, Entamoeba dispar
KEFKNAK

SEQ ID NO: 2434495 - protein, 17 aa, Entamoeba dispar
KEFKNPQEEKEVNENTN

SEQ ID NO: 2434496 - protein, 5 aa, Entamoeba dispar
KEFKQ

SEQ ID NO: 2434497 - protein, 8 aa, Entamoeba dispar
KEFKSNGY

SEQ ID NO: 2434498 - protein, 7 aa, Entamoeba dispar
KEFLSGS

SEQ ID NO: 2434499 - protein, 6 aa, Entamoeba dispar
KEFNGP

SEQ ID NO: 2434500 - protein, 9 aa, Entamoeba dispar
KEFNNPPKL

SEQ ID NO: 2434501 - protein, 5 aa, Entamoeba dispar
KEFPG

SEQ ID NO: 2434502 - protein, 14 aa, Entamoeba dispar
KEFPSNKDLDKQAK

SEQ ID NO: 2434503 - protein, 4 aa, Entamoeba dispar
KEFQ

SEQ ID NO: 2434504 - protein, 15 aa, Entamoeba dispar
KEFQGSNDSITKTTS

SEQ ID NO: 2434505 - protein, 5 aa, Entamoeba dispar
KEFQR

SEQ ID NO: 2434506 - protein, 42 aa, Entamoeba dispar
KEFQSQGINEPKEEIKSVKQEEVSKETVTPPTLPKPENMTPL

SEQ ID NO: 2434507 - protein, 6 aa, Entamoeba dispar
KEFRTN

SEQ ID NO: 2434508 - protein, 4 aa, Entamoeba dispar
KEFS

SEQ ID NO: 2434509 - protein, 15 aa, Entamoeba dispar
KEFSLTKEKTPKQQQ

SEQ ID NO: 2434510 - protein, 6 aa, Entamoeba dispar
KEFSTA

SEQ ID NO: 2434511 - protein, 4 aa, Entamoeba dispar
KEFT

SEQ ID NO: 2434512 - protein, 39 aa, Entamoeba dispar
KEFVEDDSVDEEMKDDIEEDANGNDENSDNDELEENEEQ

SEQ ID NO: 2434513 - protein, 15 aa, Entamoeba dispar
KEGASARDKYGNTPL

SEQ ID NO: 2434514 - protein, 5 aa, Entamoeba dispar
KEGDW

SEQ ID NO: 2434515 - protein, 6 aa, Entamoeba dispar
KEGECK

SEQ ID NO: 2434516 - protein, 5 aa, Entamoeba dispar
KEGEE

SEQ ID NO: 2434517 - protein, 14 aa, Entamoeba dispar
KEGEEHATEDNRKE

SEQ ID NO: 2434518 - protein, 23 aa, Entamoeba dispar
KEGEELTIKPDSKEDGSSKIPST

SEQ ID NO: 2434519 - protein, 9 aa, Entamoeba dispar
KEGEIQPEG

SEQ ID NO: 2434520 - protein, 14 aa, Entamoeba dispar
KEGEKIKNKGKKQI

SEQ ID NO: 2434521 - protein, 23 aa, Entamoeba dispar
KEGELVKKRKKTETIKESLSPTW

SEQ ID NO: 2434522 - protein, 7 aa, Entamoeba dispar
KEGFDDD

SEQ ID NO: 2434523 - protein, 8 aa, Entamoeba dispar
KEGFNKKE

SEQ ID NO: 2434524 - protein, 15 aa, Entamoeba dispar
KEGFTGVKRNTGLQF

SEQ ID NO: 2434525 - protein, 5 aa, Entamoeba dispar
KEGGL

SEQ ID NO: 2434526 - protein, 10 aa, Entamoeba dispar
KEGIDEDKSY

SEQ ID NO: 2434527 - protein, 34 aa, Entamoeba dispar
KEGIKEAEKVVKDATKFASENPNDARKRLQPDYV

SEQ ID NO: 2434528 - protein, 8 aa, Entamoeba dispar
KEGIKESE

SEQ ID NO: 2434529 - protein, 7 aa, Entamoeba dispar
KEGIKNI

SEQ ID NO: 2434530 - protein, 8 aa, Entamoeba dispar
KEGINNEI

SEQ ID NO: 2434531 - protein, 9 aa, Entamoeba dispar
KEGKELKQE

SEQ ID NO: 2434532 - protein, 7 aa, Entamoeba dispar
KEGKEMK

SEQ ID NO: 2434533 - protein, 7 aa, Entamoeba dispar
KEGKEVL

SEQ ID NO: 2434534 - protein, 8 aa, Entamoeba dispar
KEGKEYKG

SEQ ID NO: 2434535 - protein, 11 aa, Entamoeba dispar
KEGKKEKETLK

SEQ ID NO: 2434536 - protein, 6 aa, Entamoeba dispar
KEGKMS

SEQ ID NO: 2434537 - protein, 6 aa, Entamoeba dispar
KEGKNK

SEQ ID NO: 2434538 - protein, 33 aa, Entamoeba dispar
KEGKRREEREKRIDEAEKKIKQETKPERRKTRP

SEQ ID NO: 2434539 - protein, 6 aa, Entamoeba dispar
KEGKRS

SEQ ID NO: 2434540 - protein, 6 aa, Entamoeba dispar
KEGKSI

SEQ ID NO: 2434541 - protein, 4 aa, Entamoeba dispar
KEGL

SEQ ID NO: 2434542 - protein, 8 aa, Entamoeba dispar
KEGLEGTL

SEQ ID NO: 2434543 - protein, 4 aa, Entamoeba dispar
KEGN

SEQ ID NO: 2434544 - protein, 29 aa, Entamoeba dispar
KEGNENKEIEIKENGNEEEGIKKEDKVDI

SEQ ID NO: 2434545 - protein, 13 aa, Entamoeba dispar
KEGNGGIDETSKR

SEQ ID NO: 2434546 - protein, 11 aa, Entamoeba dispar
KEGNGNNTDCK

SEQ ID NO: 2434547 - protein, 6 aa, Entamoeba dispar
KEGNGV

SEQ ID NO: 2434548 - protein, 5 aa, Entamoeba dispar
KEGNS

SEQ ID NO: 2434549 - protein, 9 aa, Entamoeba dispar
KEGNTSYSM

SEQ ID NO: 2434550 - protein, 7 aa, Entamoeba dispar
KEGNVNT

SEQ ID NO: 2434551 - protein, 13 aa, Entamoeba dispar
KEGPQGRVHEYDN

SEQ ID NO: 2434552 - protein, 14 aa, Entamoeba dispar
KEGRKLPWRETTDK

SEQ ID NO: 2434553 - protein, 6 aa, Entamoeba dispar
KEGRLH

SEQ ID NO: 2434554 - protein, 7 aa, Entamoeba dispar
KEGRRKL

SEQ ID NO: 2434555 - protein, 7 aa, Entamoeba dispar
KEGSDKL

SEQ ID NO: 2434556 - protein, 7 aa, Entamoeba dispar
KEGSLQQ

SEQ ID NO: 2434557 - protein, 6 aa, Entamoeba dispar
KEGSPQ

SEQ ID NO: 2434558 - protein, 25 aa, Entamoeba dispar
KEGSSSSSSNSYDSPSPRKEDQDFF

SEQ ID NO: 2434559 - protein, 6 aa, Entamoeba dispar
KEGSVR

SEQ ID NO: 2434560 - protein, 5 aa, Entamoeba dispar
KEGTF

SEQ ID NO: 2434561 - protein, 8 aa, Entamoeba dispar
KEGTGSFG

SEQ ID NO: 2434562 - protein, 11 aa, Entamoeba dispar
KEGTKEKEAKK

SEQ ID NO: 2434563 - protein, 9 aa, Entamoeba dispar
KEGTPKAEV

SEQ ID NO: 2434564 - protein, 13 aa, Entamoeba dispar
KEGVEGKASAENM

SEQ ID NO: 2434565 - protein, 29 aa, Entamoeba dispar
KEGVNETEKKELGKKLEEYENSREEGRTK

SEQ ID NO: 2434566 - protein, 6 aa, Entamoeba dispar
KEGWNG

SEQ ID NO: 2434567 - protein, 4 aa, Entamoeba dispar
KEGY

SEQ ID NO: 2434568 - protein, 14 aa, Entamoeba dispar
KEGYDKNSKSFNEI

SEQ ID NO: 2434569 - protein, 14 aa, Entamoeba dispar
KEGYEIQKDEEQSL

SEQ ID NO: 2434570 - protein, 6 aa, Entamoeba dispar
KEGYFN

SEQ ID NO: 2434571 - protein, 7 aa, Entamoeba dispar
KEHDSNN

SEQ ID NO: 2434572 - protein, 8 aa, Entamoeba dispar
KEHEENEQ

SEQ ID NO: 2434573 - protein, 6 aa, Entamoeba dispar
KEHGRN

SEQ ID NO: 2434574 - protein, 7 aa, Entamoeba dispar
KEHKGEV

SEQ ID NO: 2434575 - protein, 9 aa, Entamoeba dispar
KEHKKREIG

SEQ ID NO: 2434576 - protein, 23 aa, Entamoeba dispar
KEHPNSRKAKRKAKEEQRDTKLK

SEQ ID NO: 2434577 - protein, 8 aa, Entamoeba dispar
KEHQENEL

SEQ ID NO: 2434578 - protein, 14 aa, Entamoeba dispar
KEHQKDDSKKSILQ

SEQ ID NO: 2434579 - protein, 13 aa, Entamoeba dispar
KEHQRSYGLTAVV

SEQ ID NO: 2434580 - protein, 7 aa, Entamoeba dispar
KEHRYTD

SEQ ID NO: 2434581 - protein, 8 aa, Entamoeba dispar
KEHSKENK

SEQ ID NO: 2434582 - protein, 6 aa, Entamoeba dispar
KEHSRC

SEQ ID NO: 2434583 - protein, 23 aa, Entamoeba dispar
KEHSSKKPKKRSEKKNEKKPELS

SEQ ID NO: 2434584 - protein, 5 aa, Entamoeba dispar
KEHSV

SEQ ID NO: 2434585 - protein, 18 aa, Entamoeba dispar
KEHTGSSRQSQVQSPTKL

SEQ ID NO: 2434586 - protein, 6 aa, Entamoeba dispar
KEHYDQ

SEQ ID NO: 2434587 - protein, 6 aa, Entamoeba dispar
KEIAEG

SEQ ID NO: 2434588 - protein, 8 aa, Entamoeba dispar
KEIATTKG

SEQ ID NO: 2434589 - protein, 4 aa, Entamoeba dispar
KEID

SEQ ID NO: 2434590 - protein, 11 aa, Entamoeba dispar
KEIDKKKEIEF

SEQ ID NO: 2434591 - protein, 9 aa, Entamoeba dispar
KEIDNRRQK

SEQ ID NO: 2434592 - protein, 13 aa, Entamoeba dispar
KEIDTFTGNHYPS

SEQ ID NO: 2434593 - protein, 5 aa, Entamoeba dispar
KEIEA

SEQ ID NO: 2434594 - protein, 10 aa, Entamoeba dispar
KEIEDKTDKL

SEQ ID NO: 2434595 - protein, 9 aa, Entamoeba dispar
KEIEEASKD

SEQ ID NO: 2434596 - protein, 10 aa, Entamoeba dispar
KEIEEKKETR

SEQ ID NO: 2434597 - protein, 7 aa, Entamoeba dispar
KEIEEKT

SEQ ID NO: 2434598 - protein, 7 aa, Entamoeba dispar
KEIEENK

SEQ ID NO: 2434599 - protein, 11 aa, Entamoeba dispar
KEIEKELDKSS

SEQ ID NO: 2434600 - protein, 10 aa, Entamoeba dispar
KEIEKENKKI

SEQ ID NO: 2434601 - protein, 8 aa, Entamoeba dispar
KEIEKGEE

SEQ ID NO: 2434602 - protein, 14 aa, Entamoeba dispar
KEIEKKKEKYVPNK

SEQ ID NO: 2434603 - protein, 13 aa, Entamoeba dispar
KEIEKQQSDVQNV

SEQ ID NO: 2434604 - protein, 10 aa, Entamoeba dispar
KEIENEADVP

SEQ ID NO: 2434605 - protein, 7 aa, Entamoeba dispar
KEIENET

SEQ ID NO: 2434606 - protein, 10 aa, Entamoeba dispar
KEIENKEFSS

SEQ ID NO: 2434607 - protein, 6 aa, Entamoeba dispar
KEIEQI

SEQ ID NO: 2434608 - protein, 12 aa, Entamoeba dispar
KEIEQSNQEMQK

SEQ ID NO: 2434609 - protein, 16 aa, Entamoeba dispar
KEIERLKEESENIQKE

SEQ ID NO: 2434610 - protein, 13 aa, Entamoeba dispar
KEIESTNCSTPGR

SEQ ID NO: 2434611 - protein, 6 aa, Entamoeba dispar
KEIGEN

SEQ ID NO: 2434612 - protein, 12 aa, Entamoeba dispar
KEIGISDDSSYG

SEQ ID NO: 2434613 - protein, 6 aa, Entamoeba dispar
KEIGNE

SEQ ID NO: 2434614 - protein, 8 aa, Entamoeba dispar
KEIGSKGF

SEQ ID NO: 2434615 - protein, 18 aa, Entamoeba dispar
KEIKEEEIKEEEDKDIGK

SEQ ID NO: 2434616 - protein, 44 aa, Entamoeba dispar
KEIKEEIKEEIKEELKEELKEETIDNIDNSECSEIYDPEEEDHQ

SEQ ID NO: 2434617 - protein, 21 aa, Entamoeba dispar
KEIKENNEKIEKEKKELQKEI

SEQ ID NO: 2434618 - protein, 10 aa, Entamoeba dispar
KEIKENYKTE

SEQ ID NO: 2434619 - protein, 11 aa, Entamoeba dispar
KEIKETEKNYP

SEQ ID NO: 2434620 - protein, 15 aa, Entamoeba dispar
KEIKKDSDDFQEVGE

SEQ ID NO: 2434621 - protein, 9 aa, Entamoeba dispar
KEIKKPKAF

SEQ ID NO: 2434622 - protein, 7 aa, Entamoeba dispar
KEIKNIS

SEQ ID NO: 2434623 - protein, 19 aa, Entamoeba dispar
KEIKPMDDDEEDEKNRKRF

SEQ ID NO: 2434624 - protein, 7 aa, Entamoeba dispar
KEIKTCE

SEQ ID NO: 2434625 - protein, 7 aa, Entamoeba dispar
KEIKVGR

SEQ ID NO: 2434626 - protein, 4 aa, Entamoeba dispar
KEIN

SEQ ID NO: 2434627 - protein, 5 aa, Entamoeba dispar
KEIND

SEQ ID NO: 2434628 - protein, 24 aa, Entamoeba dispar
KEINDEDEAMSEDDELEDKNKKQD

SEQ ID NO: 2434629 - protein, 10 aa, Entamoeba dispar
KEINDNGKDE

SEQ ID NO: 2434630 - protein, 9 aa, Entamoeba dispar
KEINDPGER

SEQ ID NO: 2434631 - protein, 23 aa, Entamoeba dispar
KEINELTEEQKTLEEKKKGITQM

SEQ ID NO: 2434632 - protein, 10 aa, Entamoeba dispar
KEINKKKKKF

SEQ ID NO: 2434633 - protein, 10 aa, Entamoeba dispar
KEINKKPPKQ

SEQ ID NO: 2434634 - protein, 10 aa, Entamoeba dispar
KEINKMDETN

SEQ ID NO: 2434635 - protein, 19 aa, Entamoeba dispar
KEINNSKIKEVEKQPEGHL

SEQ ID NO: 2434636 - protein, 20 aa, Entamoeba dispar
KEINNSKIKEVEKQPEGHLQ

SEQ ID NO: 2434637 - protein, 18 aa, Entamoeba dispar
KEINPLRKKEEKKMEEEP

SEQ ID NO: 2434638 - protein, 20 aa, Entamoeba dispar
KEINSKRKKLAEAKGKRKFA

SEQ ID NO: 2434639 - protein, 6 aa, Entamoeba dispar
KEINSS

SEQ ID NO: 2434640 - protein, 44 aa, Entamoeba dispar
KEINTKEEEDNNNTKEEDKKEINTKEEEDNNNKEEEEEDKKEEL

SEQ ID NO: 2434641 - protein, 58 aa, Entamoeba dispar
KEIPAHNNTEKKEERQQLPPREGRRYGERKEHTHGRREGGDQRRGGRGGKKQFHASEP

SEQ ID NO: 2434642 - protein, 5 aa, Entamoeba dispar
KEIPD

SEQ ID NO: 2434643 - protein, 6 aa, Entamoeba dispar
KEIPDG

SEQ ID NO: 2434644 - protein, 18 aa, Entamoeba dispar
KEIPDRLPAEDVEEKKDV

SEQ ID NO: 2434645 - protein, 5 aa, Entamoeba dispar
KEIPE

SEQ ID NO: 2434646 - protein, 16 aa, Entamoeba dispar
KEIPENTTIPKETLTK

SEQ ID NO: 2434647 - protein, 5 aa, Entamoeba dispar
KEIPG

SEQ ID NO: 2434648 - protein, 9 aa, Entamoeba dispar
KEIPPTNRL

SEQ ID NO: 2434649 - protein, 40 aa, Entamoeba dispar
KEIPSNGLSQPTEESVRPKEISKQINELQNDVSRNSASEE

SEQ ID NO: 2434650 - protein, 4 aa, Entamoeba dispar
KEIQ

SEQ ID NO: 2434651 - protein, 13 aa, Entamoeba dispar
KEIQESSQDIKEI

SEQ ID NO: 2434652 - protein, 15 aa, Entamoeba dispar
KEIQNNSNKLVEPTT

SEQ ID NO: 2434653 - protein, 20 aa, Entamoeba dispar
KEIQQIEEENIKEEENVPKE

SEQ ID NO: 2434654 - protein, 6 aa, Entamoeba dispar
KEIQSI

SEQ ID NO: 2434655 - protein, 6 aa, Entamoeba dispar
KEIQST

SEQ ID NO: 2434656 - protein, 6 aa, Entamoeba dispar
KEIREM

SEQ ID NO: 2434657 - protein, 6 aa, Entamoeba dispar
KEIRGS

SEQ ID NO: 2434658 - protein, 6 aa, Entamoeba dispar
KEIRKG

SEQ ID NO: 2434659 - protein, 12 aa, Entamoeba dispar
KEISEKKANGDV

SEQ ID NO: 2434660 - protein, 8 aa, Entamoeba dispar
KEISGGMS

SEQ ID NO: 2434661 - protein, 11 aa, Entamoeba dispar
KEISGISTGTF

SEQ ID NO: 2434662 - protein, 6 aa, Entamoeba dispar
KEISQA

SEQ ID NO: 2434663 - protein, 6 aa, Entamoeba dispar
KEISQK

SEQ ID NO: 2434664 - protein, 11 aa, Entamoeba dispar
KEISQTPQNSV

SEQ ID NO: 2434665 - protein, 13 aa, Entamoeba dispar
KEISTKNRTTKKL

SEQ ID NO: 2434666 - protein, 5 aa, Entamoeba dispar
KEITA

SEQ ID NO: 2434667 - protein, 8 aa, Entamoeba dispar
KEITDAGQ

SEQ ID NO: 2434668 - protein, 9 aa, Entamoeba dispar
KEITDAGQT

SEQ ID NO: 2434669 - protein, 9 aa, Entamoeba dispar
KEITGSPKA

SEQ ID NO: 2434670 - protein, 7 aa, Entamoeba dispar
KEITKEE

SEQ ID NO: 2434671 - protein, 19 aa, Entamoeba dispar
KEITKKLKKDKKGKLKRKS

SEQ ID NO: 2434672 - protein, 6 aa, Entamoeba dispar
KEITKM

SEQ ID NO: 2434673 - protein, 5 aa, Entamoeba dispar
KEITL

SEQ ID NO: 2434674 - protein, 6 aa, Entamoeba dispar
KEITNQ

SEQ ID NO: 2434675 - protein, 7 aa, Entamoeba dispar
KEITNQI

SEQ ID NO: 2434676 - protein, 13 aa, Entamoeba dispar
KEITNTDKNDKIK

SEQ ID NO: 2434677 - protein, 15 aa, Entamoeba dispar
KEITNTNTSKESQKL

SEQ ID NO: 2434678 - protein, 7 aa, Entamoeba dispar
KEITSDK

SEQ ID NO: 2434679 - protein, 6 aa, Entamoeba dispar
KEITSH

SEQ ID NO: 2434680 - protein, 7 aa, Entamoeba dispar
KEITSST

SEQ ID NO: 2434681 - protein, 7 aa, Entamoeba dispar
KEITTGR

SEQ ID NO: 2434682 - protein, 6 aa, Entamoeba dispar
KEITYA

SEQ ID NO: 2434683 - protein, 6 aa, Entamoeba dispar
KEKADY

SEQ ID NO: 2434684 - protein, 14 aa, Entamoeba dispar
KEKAFETNSYNNTI

SEQ ID NO: 2434685 - protein, 10 aa, Entamoeba dispar
KEKASPDGYN

SEQ ID NO: 2434686 - protein, 9 aa, Entamoeba dispar
KEKDCGEGI

SEQ ID NO: 2434687 - protein, 107 aa, Entamoeba dispar
KEKDEEEYNKRIKQEAEENEKKQATEEEKSQKKKEEEEEEKQKQKQKQLLNEEREKKALERQQKKEERRKRKEEEREQAQKIKEEEEKRLEEERKKKQEMESKAASF

SEQ ID NO: 2434688 - protein, 8 aa, Entamoeba dispar
KEKDGIRK

SEQ ID NO: 2434689 - protein, 6 aa, Entamoeba dispar
KEKDIP

SEQ ID NO: 2434690 - protein, 13 aa, Entamoeba dispar
KEKDLRTKEGERW

SEQ ID NO: 2434691 - protein, 10 aa, Entamoeba dispar
KEKDSNHQKQ

SEQ ID NO: 2434692 - protein, 4 aa, Entamoeba dispar
KEKE

SEQ ID NO: 2434693 - protein, 14 aa, Entamoeba dispar
KEKEARNICKKDIH

SEQ ID NO: 2434694 - protein, 8 aa, Entamoeba dispar
KEKEAWNE

SEQ ID NO: 2434695 - protein, 21 aa, Entamoeba dispar
KEKEEEADRRKRQLSNSAGDH

SEQ ID NO: 2434696 - protein, 10 aa, Entamoeba dispar
KEKEEEKPIS

SEQ ID NO: 2434697 - protein, 7 aa, Entamoeba dispar
KEKEEEM

SEQ ID NO: 2434698 - protein, 8 aa, Entamoeba dispar
KEKEEENI

SEQ ID NO: 2434699 - protein, 41 aa, Entamoeba dispar
KEKEEENNQQQEHKEVEHKETPNKADSNNTHDVGDGNTIEH

SEQ ID NO: 2434700 - protein, 8 aa, Entamoeba dispar
KEKEEGNI

SEQ ID NO: 2434701 - protein, 9 aa, Entamoeba dispar
KEKEEGSVY

SEQ ID NO: 2434702 - protein, 9 aa, Entamoeba dispar
KEKEEIKEK

SEQ ID NO: 2434703 - protein, 9 aa, Entamoeba dispar
KEKEEISNE

SEQ ID NO: 2434704 - protein, 11 aa, Entamoeba dispar
KEKEEKEIFKE

SEQ ID NO: 2434705 - protein, 15 aa, Entamoeba dispar
KEKEELKKKVSDYET

SEQ ID NO: 2434706 - protein, 6 aa, Entamoeba dispar
KEKEEN

SEQ ID NO: 2434707 - protein, 8 aa, Entamoeba dispar
KEKEENTK

SEQ ID NO: 2434708 - protein, 18 aa, Entamoeba dispar
KEKEETKPRRSSFSNKKS

SEQ ID NO: 2434709 - protein, 16 aa, Entamoeba dispar
KEKEEWERKSNKEKLM

SEQ ID NO: 2434710 - protein, 5 aa, Entamoeba dispar
KEKEI

SEQ ID NO: 2434711 - protein, 22 aa, Entamoeba dispar
KEKEIANKVPEGTKNDTKRESD

SEQ ID NO: 2434712 - protein, 6 aa, Entamoeba dispar
KEKEIK

SEQ ID NO: 2434713 - protein, 9 aa, Entamoeba dispar
KEKEINKEK

SEQ ID NO: 2434714 - protein, 13 aa, Entamoeba dispar
KEKEINKNEDRYD

SEQ ID NO: 2434715 - protein, 6 aa, Entamoeba dispar
KEKEIR

SEQ ID NO: 2434716 - protein, 10 aa, Entamoeba dispar
KEKEKAEEIA

SEQ ID NO: 2434717 - protein, 10 aa, Entamoeba dispar
KEKEKEENNK

SEQ ID NO: 2434718 - protein, 8 aa, Entamoeba dispar
KEKEKREG

SEQ ID NO: 2434719 - protein, 12 aa, Entamoeba dispar
KEKELKEHCLIT

SEQ ID NO: 2434720 - protein, 17 aa, Entamoeba dispar
KEKENEMKEKKLKNTCL

SEQ ID NO: 2434721 - protein, 21 aa, Entamoeba dispar
KEKENEMKEKKLKNTCSPQRR

SEQ ID NO: 2434722 - protein, 14 aa, Entamoeba dispar
KEKENENDIESITS

SEQ ID NO: 2434723 - protein, 8 aa, Entamoeba dispar
KEKENKGI

SEQ ID NO: 2434724 - protein, 8 aa, Entamoeba dispar
KEKENLTP

SEQ ID NO: 2434725 - protein, 9 aa, Entamoeba dispar
KEKENNKES

SEQ ID NO: 2434726 - protein, 8 aa, Entamoeba dispar
KEKENPIK

SEQ ID NO: 2434727 - protein, 9 aa, Entamoeba dispar
KEKENTPAM

SEQ ID NO: 2434728 - protein, 8 aa, Entamoeba dispar
KEKEPNKR

SEQ ID NO: 2434729 - protein, 9 aa, Entamoeba dispar
KEKERTKYY

SEQ ID NO: 2434730 - protein, 8 aa, Entamoeba dispar
KEKETGNI

SEQ ID NO: 2434731 - protein, 49 aa, Entamoeba dispar
KEKEYNEKTKKIQKNIEEIKKEEEKIKTLQEEINKREKEKEEKENQITR

SEQ ID NO: 2434732 - protein, 7 aa, Entamoeba dispar
KEKGMNN

SEQ ID NO: 2434733 - protein, 10 aa, Entamoeba dispar
KEKGNDKDMS

SEQ ID NO: 2434734 - protein, 7 aa, Entamoeba dispar
KEKGNEK

SEQ ID NO: 2434735 - protein, 17 aa, Entamoeba dispar
KEKGNIEEKIKEGEEIE

SEQ ID NO: 2434736 - protein, 7 aa, Entamoeba dispar
KEKGQLD

SEQ ID NO: 2434737 - protein, 7 aa, Entamoeba dispar
KEKGYGG

SEQ ID NO: 2434738 - protein, 18 aa, Entamoeba dispar
KEKHNPDVKPWRNIVEPT

SEQ ID NO: 2434739 - protein, 7 aa, Entamoeba dispar
KEKHQKK

SEQ ID NO: 2434740 - protein, 14 aa, Entamoeba dispar
KEKHQMQETQVTQN

SEQ ID NO: 2434741 - protein, 13 aa, Entamoeba dispar
KEKIDVEGSKENY

SEQ ID NO: 2434742 - protein, 15 aa, Entamoeba dispar
KEKIEEKDKEKDKLA

SEQ ID NO: 2434743 - protein, 11 aa, Entamoeba dispar
KEKIEQKVEEY

SEQ ID NO: 2434744 - protein, 7 aa, Entamoeba dispar
KEKIERI

SEQ ID NO: 2434745 - protein, 6 aa, Entamoeba dispar
KEKIGQ

SEQ ID NO: 2434746 - protein, 16 aa, Entamoeba dispar
KEKIQEKLTTRTDDVE

SEQ ID NO: 2434747 - protein, 5 aa, Entamoeba dispar
KEKIR

SEQ ID NO: 2434748 - protein, 57 aa, Entamoeba dispar
KEKISEDDSNRNSSDSEGSEDEELEESTGEDTDEDTDEGLDEGLDEGLDEDISSIFS

SEQ ID NO: 2434749 - protein, 6 aa, Entamoeba dispar
KEKISV

SEQ ID NO: 2434750 - protein, 23 aa, Entamoeba dispar
KEKITSSSEGSDSSVNCSGESGS

SEQ ID NO: 2434751 - protein, 10 aa, Entamoeba dispar
KEKKAEYDEA

SEQ ID NO: 2434752 - protein, 8 aa, Entamoeba dispar
KEKKDRKF

SEQ ID NO: 2434753 - protein, 9 aa, Entamoeba dispar
KEKKEDQNL

SEQ ID NO: 2434754 - protein, 7 aa, Entamoeba dispar
KEKKEMK

SEQ ID NO: 2434755 - protein, 7 aa, Entamoeba dispar
KEKKENY

SEQ ID NO: 2434756 - protein, 6 aa, Entamoeba dispar
KEKKFN

SEQ ID NO: 2434757 - protein, 9 aa, Entamoeba dispar
KEKKGSTVI

SEQ ID NO: 2434758 - protein, 12 aa, Entamoeba dispar
KEKKIKRKKRRL

SEQ ID NO: 2434759 - protein, 11 aa, Entamoeba dispar
KEKKKAERVKT

SEQ ID NO: 2434760 - protein, 8 aa, Entamoeba dispar
KEKKKEIG

SEQ ID NO: 2434761 - protein, 6 aa, Entamoeba dispar
KEKKLN

SEQ ID NO: 2434762 - protein, 54 aa, Entamoeba dispar
KEKKNRKQKSVKTPKPIKTPKTKRNKTDTPKKRQTKTQIEKGTSLSHKRKKQFY

SEQ ID NO: 2434763 - protein, 6 aa, Entamoeba dispar
KEKKNV

SEQ ID NO: 2434764 - protein, 8 aa, Entamoeba dispar
KEKKQGNI

SEQ ID NO: 2434765 - protein, 16 aa, Entamoeba dispar
KEKKREKKIMKKNNKY

SEQ ID NO: 2434766 - protein, 165 aa, Entamoeba dispar
KEKKRIEEERIKENKLKKEEEERKRQEEEEKLKKEEEKKRLEEEQKRLEEQKKKVEEELRQKEEEQKKKEEEIQRKEEERAKAAEEEKRQVEGERIKRETEEKKRKLLEEEELKKKEEEEKQRREEFERRRKEVEEERVKKAKEDLERYQKEKAERLKRKQKVSV

SEQ ID NO: 2434767 - protein, 11 aa, Entamoeba dispar
KEKKRQKTDGR

SEQ ID NO: 2434768 - protein, 7 aa, Entamoeba dispar
KEKKSAI

SEQ ID NO: 2434769 - protein, 11 aa, Entamoeba dispar
KEKKSTEDECP

SEQ ID NO: 2434770 - protein, 51 aa, Entamoeba dispar
KEKKTGDTKTSTTSHNDTLNKVEEKKSEVSNSKKTRASSRKKNTNKPLTKE

SEQ ID NO: 2434771 - protein, 26 aa, Entamoeba dispar
KEKKVAKPTEGIKGKKSTHQKIAYVL

SEQ ID NO: 2434772 - protein, 26 aa, Entamoeba dispar
KEKKVAKPTEGIKGKKSVHQTVSYVL

SEQ ID NO: 2434773 - protein, 24 aa, Entamoeba dispar
KEKKVAKPTEGLRRKKITKVSQML

SEQ ID NO: 2434774 - protein, 7 aa, Entamoeba dispar
KEKKVKE

SEQ ID NO: 2434775 - protein, 7 aa, Entamoeba dispar
KEKLEPK

SEQ ID NO: 2434776 - protein, 8 aa, Entamoeba dispar
KEKLPNIQ

SEQ ID NO: 2434777 - protein, 8 aa, Entamoeba dispar
KEKLQEEL

SEQ ID NO: 2434778 - protein, 22 aa, Entamoeba dispar
KEKLYAENSTLKTVNKDQGVEL

SEQ ID NO: 2434779 - protein, 10 aa, Entamoeba dispar
KEKNAKKLAQ

SEQ ID NO: 2434780 - protein, 7 aa, Entamoeba dispar
KEKNEID

SEQ ID NO: 2434781 - protein, 16 aa, Entamoeba dispar
KEKNKMEVEEKKIDSY

SEQ ID NO: 2434782 - protein, 10 aa, Entamoeba dispar
KEKNKPSIEN

SEQ ID NO: 2434783 - protein, 30 aa, Entamoeba dispar
KEKNNNEPKEKNEIKQKMNGETDSDDEQDI

SEQ ID NO: 2434784 - protein, 13 aa, Entamoeba dispar
KEKNNQKGFTQPL

SEQ ID NO: 2434785 - protein, 9 aa, Entamoeba dispar
KEKNPQCIS

SEQ ID NO: 2434786 - protein, 7 aa, Entamoeba dispar
KEKNRQK

SEQ ID NO: 2434787 - protein, 6 aa, Entamoeba dispar
KEKNSI

SEQ ID NO: 2434788 - protein, 14 aa, Entamoeba dispar
KEKNWKRTENEIKE

SEQ ID NO: 2434789 - protein, 22 aa, Entamoeba dispar
KEKPIQEPPSSSSQSLDKQPSL

SEQ ID NO: 2434790 - protein, 7 aa, Entamoeba dispar
KEKPIRV

SEQ ID NO: 2434791 - protein, 8 aa, Entamoeba dispar
KEKPKKEV

SEQ ID NO: 2434792 - protein, 7 aa, Entamoeba dispar
KEKPLQE

SEQ ID NO: 2434793 - protein, 14 aa, Entamoeba dispar
KEKPSIIPKTQYKK

SEQ ID NO: 2434794 - protein, 5 aa, Entamoeba dispar
KEKQE

SEQ ID NO: 2434795 - protein, 7 aa, Entamoeba dispar
KEKQEME

SEQ ID NO: 2434796 - protein, 8 aa, Entamoeba dispar
KEKQENQR

SEQ ID NO: 2434797 - protein, 7 aa, Entamoeba dispar
KEKQETL

SEQ ID NO: 2434798 - protein, 7 aa, Entamoeba dispar
KEKQGDQ

SEQ ID NO: 2434799 - protein, 8 aa, Entamoeba dispar
KEKQHDNY

SEQ ID NO: 2434800 - protein, 5 aa, Entamoeba dispar
KEKQI

SEQ ID NO: 2434801 - protein, 9 aa, Entamoeba dispar
KEKQLGKDI

SEQ ID NO: 2434802 - protein, 17 aa, Entamoeba dispar
KEKQMEEEEKKKEKMRN

SEQ ID NO: 2434803 - protein, 7 aa, Entamoeba dispar
KEKQQGI

SEQ ID NO: 2434804 - protein, 4 aa, Entamoeba dispar
KEKR

SEQ ID NO: 2434805 - protein, 7 aa, Entamoeba dispar
KEKREQF

SEQ ID NO: 2434806 - protein, 5 aa, Entamoeba dispar
KEKRM

SEQ ID NO: 2434807 - protein, 9 aa, Entamoeba dispar
KEKRMSETK

SEQ ID NO: 2434808 - protein, 14 aa, Entamoeba dispar
KEKRNGSDCKNITY

SEQ ID NO: 2434809 - protein, 7 aa, Entamoeba dispar
KEKRTTM

SEQ ID NO: 2434810 - protein, 10 aa, Entamoeba dispar
KEKRVKVNRN

SEQ ID NO: 2434811 - protein, 14 aa, Entamoeba dispar
KEKSGSSSLFISKY

SEQ ID NO: 2434812 - protein, 10 aa, Entamoeba dispar
KEKSKNPIKE

SEQ ID NO: 2434813 - protein, 6 aa, Entamoeba dispar
KEKSLL

SEQ ID NO: 2434814 - protein, 7 aa, Entamoeba dispar
KEKSPSV

SEQ ID NO: 2434815 - protein, 6 aa, Entamoeba dispar
KEKSQD

SEQ ID NO: 2434816 - protein, 13 aa, Entamoeba dispar
KEKSSNSSSGALT

SEQ ID NO: 2434817 - protein, 8 aa, Entamoeba dispar
KEKSTGQI

SEQ ID NO: 2434818 - protein, 8 aa, Entamoeba dispar
KEKSYCEN

SEQ ID NO: 2434819 - protein, 19 aa, Entamoeba dispar
KEKTEESNQLIRQILQILS

SEQ ID NO: 2434820 - protein, 8 aa, Entamoeba dispar
KEKTKELT

SEQ ID NO: 2434821 - protein, 7 aa, Entamoeba dispar
KEKTLNN

SEQ ID NO: 2434822 - protein, 12 aa, Entamoeba dispar
KEKTRTKATPYW

SEQ ID NO: 2434823 - protein, 16 aa, Entamoeba dispar
KEKTTEPNDMKKQIEQ

SEQ ID NO: 2434824 - protein, 20 aa, Entamoeba dispar
KEKTYAISKNEEYDDIATSS

SEQ ID NO: 2434825 - protein, 11 aa, Entamoeba dispar
KEKVDQSNNIL

SEQ ID NO: 2434826 - protein, 17 aa, Entamoeba dispar
KEKVDRVDETTSSLQKK

SEQ ID NO: 2434827 - protein, 15 aa, Entamoeba dispar
KEKVKEGLKEIPEER

SEQ ID NO: 2434828 - protein, 5 aa, Entamoeba dispar
KEKVP

SEQ ID NO: 2434829 - protein, 7 aa, Entamoeba dispar
KEKVPNA

SEQ ID NO: 2434830 - protein, 7 aa, Entamoeba dispar
KEKVSSL

SEQ ID NO: 2434831 - protein, 80 aa, Entamoeba dispar
KEKVVDSQEDISQQPEELIPPKVPPKRKSQKTVLTQEESVKQEQQPLKINNSKTLQQDIPPSIETQQTEQNSSNKQEPMS

SEQ ID NO: 2434832 - protein, 9 aa, Entamoeba dispar
KEKWRNESQ

SEQ ID NO: 2434833 - protein, 5 aa, Entamoeba dispar
KEKWS

SEQ ID NO: 2434834 - protein, 5 aa, Entamoeba dispar
KEKWT

SEQ ID NO: 2434835 - protein, 5 aa, Entamoeba dispar
KEKYA

SEQ ID NO: 2434836 - protein, 9 aa, Entamoeba dispar
KEKYGFKPC

SEQ ID NO: 2434837 - protein, 7 aa, Entamoeba dispar
KEKYHKI

SEQ ID NO: 2434838 - protein, 5 aa, Entamoeba dispar
KEKYP

SEQ ID NO: 2434839 - protein, 7 aa, Entamoeba dispar
KEKYPEV

SEQ ID NO: 2434840 - protein, 6 aa, Entamoeba dispar
KEKYTE

SEQ ID NO: 2434841 - protein, 5 aa, Entamoeba dispar
KELDD

SEQ ID NO: 2434842 - protein, 8 aa, Entamoeba dispar
KELDNEKI

SEQ ID NO: 2434843 - protein, 7 aa, Entamoeba dispar
KELDSRS

SEQ ID NO: 2434844 - protein, 5 aa, Entamoeba dispar
KELEE

SEQ ID NO: 2434845 - protein, 20 aa, Entamoeba dispar
KELEEAKQEIESLKKTSNIN

SEQ ID NO: 2434846 - protein, 19 aa, Entamoeba dispar
KELEEEIKSIKEKSNDIPS

SEQ ID NO: 2434847 - protein, 38 aa, Entamoeba dispar
KELEEERQKNQQTQQPGPKEIPEIEPPEYSEEKKEIEE

SEQ ID NO: 2434848 - protein, 8 aa, Entamoeba dispar
KELEEKEK

SEQ ID NO: 2434849 - protein, 8 aa, Entamoeba dispar
KELEEKQN

SEQ ID NO: 2434850 - protein, 17 aa, Entamoeba dispar
KELEELKKKYELNTFEQ

SEQ ID NO: 2434851 - protein, 9 aa, Entamoeba dispar
KELEEQTHQ

SEQ ID NO: 2434852 - protein, 7 aa, Entamoeba dispar
KELEQIE

SEQ ID NO: 2434853 - protein, 8 aa, Entamoeba dispar
KELEQTVT

SEQ ID NO: 2434854 - protein, 5 aa, Entamoeba dispar
KELER

SEQ ID NO: 2434855 - protein, 7 aa, Entamoeba dispar
KELERKE

SEQ ID NO: 2434856 - protein, 7 aa, Entamoeba dispar
KELESSM

SEQ ID NO: 2434857 - protein, 4 aa, Entamoeba dispar
KELG

SEQ ID NO: 2434858 - protein, 10 aa, Entamoeba dispar
KELGEEDLKE

SEQ ID NO: 2434859 - protein, 9 aa, Entamoeba dispar
KELGGRNRM

SEQ ID NO: 2434860 - protein, 6 aa, Entamoeba dispar
KELGIE

SEQ ID NO: 2434861 - protein, 9 aa, Entamoeba dispar
KELGKEKAI

SEQ ID NO: 2434862 - protein, 4 aa, Entamoeba dispar
KELK

SEQ ID NO: 2434863 - protein, 11 aa, Entamoeba dispar
KELKEKRIESH

SEQ ID NO: 2434864 - protein, 7 aa, Entamoeba dispar
KELKGDE

SEQ ID NO: 2434865 - protein, 5 aa, Entamoeba dispar
KELKK

SEQ ID NO: 2434866 - protein, 14 aa, Entamoeba dispar
KELKKNERIPIDCF

SEQ ID NO: 2434867 - protein, 14 aa, Entamoeba dispar
KELKKNERIPIDFF

SEQ ID NO: 2434868 - protein, 15 aa, Entamoeba dispar
KELKKNKRIPRNCFN

SEQ ID NO: 2434869 - protein, 19 aa, Entamoeba dispar
KELKKNKTIPRNCFKWWLM

SEQ ID NO: 2434870 - protein, 10 aa, Entamoeba dispar
KELKKRKDMA

SEQ ID NO: 2434871 - protein, 11 aa, Entamoeba dispar
KELKKRKNKYG

SEQ ID NO: 2434872 - protein, 7 aa, Entamoeba dispar
KELKNRI

SEQ ID NO: 2434873 - protein, 7 aa, Entamoeba dispar
KELKQEN

SEQ ID NO: 2434874 - protein, 9 aa, Entamoeba dispar
KELKQKEMS

SEQ ID NO: 2434875 - protein, 8 aa, Entamoeba dispar
KELKQTNQ

SEQ ID NO: 2434876 - protein, 5 aa, Entamoeba dispar
KELKT

SEQ ID NO: 2434877 - protein, 13 aa, Entamoeba dispar
KELNDTGKTYEKV

SEQ ID NO: 2434878 - protein, 8 aa, Entamoeba dispar
KELNKPSE

SEQ ID NO: 2434879 - protein, 10 aa, Entamoeba dispar
KELNNGNVRE

SEQ ID NO: 2434880 - protein, 6 aa, Entamoeba dispar
KELNNN

SEQ ID NO: 2434881 - protein, 6 aa, Entamoeba dispar
KELNPW

SEQ ID NO: 2434882 - protein, 12 aa, Entamoeba dispar
KELNTQNQQISK

SEQ ID NO: 2434883 - protein, 8 aa, Entamoeba dispar
KELPENQA

SEQ ID NO: 2434884 - protein, 5 aa, Entamoeba dispar
KELPK

SEQ ID NO: 2434885 - protein, 16 aa, Entamoeba dispar
KELPKIPTKAIPPLPE

SEQ ID NO: 2434886 - protein, 60 aa, Entamoeba dispar
KELPPTKPNQLQQTSRITSLPKSTTQQQSPKTEDKTSSSKTRSDLNIKKDEPKQRCQTQK

SEQ ID NO: 2434887 - protein, 6 aa, Entamoeba dispar
KELPQD

SEQ ID NO: 2434888 - protein, 4 aa, Entamoeba dispar
KELQ

SEQ ID NO: 2434889 - protein, 8 aa, Entamoeba dispar
KELQQAQE

SEQ ID NO: 2434890 - protein, 27 aa, Entamoeba dispar
KELRAKKRIEKGKTKKGGKGKKSFAKR

SEQ ID NO: 2434891 - protein, 6 aa, Entamoeba dispar
KELRDI

SEQ ID NO: 2434892 - protein, 5 aa, Entamoeba dispar
KELRE

SEQ ID NO: 2434893 - protein, 6 aa, Entamoeba dispar
KELRNR

SEQ ID NO: 2434894 - protein, 11 aa, Entamoeba dispar
KELRTGDNDEY

SEQ ID NO: 2434895 - protein, 13 aa, Entamoeba dispar
KELSMDDPSFSPE

SEQ ID NO: 2434896 - protein, 6 aa, Entamoeba dispar
KELSPG

SEQ ID NO: 2434897 - protein, 29 aa, Entamoeba dispar
KELSQKSSNEKKGIKEEEYRLKQNKEEIK

SEQ ID NO: 2434898 - protein, 9 aa, Entamoeba dispar
KELSSKDGK

SEQ ID NO: 2434899 - protein, 6 aa, Entamoeba dispar
KELTAN

SEQ ID NO: 2434900 - protein, 5 aa, Entamoeba dispar
KELTD

SEQ ID NO: 2434901 - protein, 6 aa, Entamoeba dispar
KELTEK

SEQ ID NO: 2434902 - protein, 10 aa, Entamoeba dispar
KELTESEKEN

SEQ ID NO: 2434903 - protein, 16 aa, Entamoeba dispar
KELTNAEKWRDKHQEE

SEQ ID NO: 2434904 - protein, 5 aa, Entamoeba dispar
KELTQ

SEQ ID NO: 2434905 - protein, 6 aa, Entamoeba dispar
KELTQD

SEQ ID NO: 2434906 - protein, 19 aa, Entamoeba dispar
KEMAERDKSQIKARDEYRK

SEQ ID NO: 2434907 - protein, 4 aa, Entamoeba dispar
KEMD

SEQ ID NO: 2434908 - protein, 10 aa, Entamoeba dispar
KEMEEQKQQM

SEQ ID NO: 2434909 - protein, 12 aa, Entamoeba dispar
KEMEESNKEATY

SEQ ID NO: 2434910 - protein, 5 aa, Entamoeba dispar
KEMEG

SEQ ID NO: 2434911 - protein, 15 aa, Entamoeba dispar
KEMEKKKKETKEQRQ

SEQ ID NO: 2434912 - protein, 15 aa, Entamoeba dispar
KEMEQNITESLENSN

SEQ ID NO: 2434913 - protein, 4 aa, Entamoeba dispar
KEMG

SEQ ID NO: 2434914 - protein, 9 aa, Entamoeba dispar
KEMGERETT

SEQ ID NO: 2434915 - protein, 17 aa, Entamoeba dispar
KEMKEKESKNNDNKINT

SEQ ID NO: 2434916 - protein, 11 aa, Entamoeba dispar
KEMKGKENKER

SEQ ID NO: 2434917 - protein, 17 aa, Entamoeba dispar
KEMKNKVQENESNEELK

SEQ ID NO: 2434918 - protein, 6 aa, Entamoeba dispar
KEMNDE

SEQ ID NO: 2434919 - protein, 33 aa, Entamoeba dispar
KEMNEPSEDYETKKPRRGVERKRKDKKEKPKNL

SEQ ID NO: 2434920 - protein, 37 aa, Entamoeba dispar
KEMNEQKQLKGKKIGEKENELKRITKEKEKKDEEIKH

SEQ ID NO: 2434921 - protein, 9 aa, Entamoeba dispar
KEMNNKRDA

SEQ ID NO: 2434922 - protein, 5 aa, Entamoeba dispar
KEMPV

SEQ ID NO: 2434923 - protein, 4 aa, Entamoeba dispar
KEMR

SEQ ID NO: 2434924 - protein, 23 aa, Entamoeba dispar
KEMREKRKAEKAASKEKKGNVSE

SEQ ID NO: 2434925 - protein, 13 aa, Entamoeba dispar
KEMRGTRSGIPIS

SEQ ID NO: 2434926 - protein, 11 aa, Entamoeba dispar
KEMSNNGMNGQ

SEQ ID NO: 2434927 - protein, 11 aa, Entamoeba dispar
KEMSQTQQTMS

SEQ ID NO: 2434928 - protein, 11 aa, Entamoeba dispar
KEMSSKSTSII

SEQ ID NO: 2434929 - protein, 9 aa, Entamoeba dispar
KEMTKEDEV

SEQ ID NO: 2434930 - protein, 14 aa, Entamoeba dispar
KEMTNENKKQIEEV

SEQ ID NO: 2434931 - protein, 13 aa, Entamoeba dispar
KENASGNPSTRTT

SEQ ID NO: 2434932 - protein, 4 aa, Entamoeba dispar
KEND

SEQ ID NO: 2434933 - protein, 7 aa, Entamoeba dispar
KENDATD

SEQ ID NO: 2434934 - protein, 16 aa, Entamoeba dispar
KENDEKINEINKEKEV

SEQ ID NO: 2434935 - protein, 7 aa, Entamoeba dispar
KENDEMT

SEQ ID NO: 2434936 - protein, 6 aa, Entamoeba dispar
KENDIN

SEQ ID NO: 2434937 - protein, 5 aa, Entamoeba dispar
KENDN

SEQ ID NO: 2434938 - protein, 8 aa, Entamoeba dispar
KENDNVME

SEQ ID NO: 2434939 - protein, 9 aa, Entamoeba dispar
KENDPNLSN

SEQ ID NO: 2434940 - protein, 7 aa, Entamoeba dispar
KENDPNM

SEQ ID NO: 2434941 - protein, 9 aa, Entamoeba dispar
KENDPTSIA

SEQ ID NO: 2434942 - protein, 5 aa, Entamoeba dispar
KENED

SEQ ID NO: 2434943 - protein, 9 aa, Entamoeba dispar
KENEEENLE

SEQ ID NO: 2434944 - protein, 8 aa, Entamoeba dispar
KENEEEYK

SEQ ID NO: 2434945 - protein, 8 aa, Entamoeba dispar
KENEEYQR

SEQ ID NO: 2434946 - protein, 7 aa, Entamoeba dispar
KENEGNK

SEQ ID NO: 2434947 - protein, 8 aa, Entamoeba dispar
KENEGTFK

SEQ ID NO: 2434948 - protein, 5 aa, Entamoeba dispar
KENEH

SEQ ID NO: 2434949 - protein, 9 aa, Entamoeba dispar
KENEIEAKG

SEQ ID NO: 2434950 - protein, 8 aa, Entamoeba dispar
KENEIKEK

SEQ ID NO: 2434951 - protein, 7 aa, Entamoeba dispar
KENEKER

SEQ ID NO: 2434952 - protein, 12 aa, Entamoeba dispar
KENEKIQSEKEE

SEQ ID NO: 2434953 - protein, 13 aa, Entamoeba dispar
KENEKKRKEDEEY

SEQ ID NO: 2434954 - protein, 11 aa, Entamoeba dispar
KENEKSENGQL

SEQ ID NO: 2434955 - protein, 13 aa, Entamoeba dispar
KENENKLKEEINT

SEQ ID NO: 2434956 - protein, 42 aa, Entamoeba dispar
KENEQLKQQISSAEENSSSLIENEKKEKEDLKHQNEELKQQI

SEQ ID NO: 2434957 - protein, 7 aa, Entamoeba dispar
KENETIK

SEQ ID NO: 2434958 - protein, 14 aa, Entamoeba dispar
KENETSKTIEVDGG

SEQ ID NO: 2434959 - protein, 19 aa, Entamoeba dispar
KENEVQKAFGPGDVRRNSE

SEQ ID NO: 2434960 - protein, 19 aa, Entamoeba dispar
KENGECKEIDNKCNKSERN

SEQ ID NO: 2434961 - protein, 19 aa, Entamoeba dispar
KENGECKKIDNKCNKSERN

SEQ ID NO: 2434962 - protein, 14 aa, Entamoeba dispar
KENGNSQEKTEKLI

SEQ ID NO: 2434963 - protein, 6 aa, Entamoeba dispar
KENGSH

SEQ ID NO: 2434964 - protein, 11 aa, Entamoeba dispar
KENIAKEKGEL

SEQ ID NO: 2434965 - protein, 13 aa, Entamoeba dispar
KENIDLKRNQQQF

SEQ ID NO: 2434966 - protein, 5 aa, Entamoeba dispar
KENIE

SEQ ID NO: 2434967 - protein, 6 aa, Entamoeba dispar
KENIKE

SEQ ID NO: 2434968 - protein, 8 aa, Entamoeba dispar
KENINEDK

SEQ ID NO: 2434969 - protein, 18 aa, Entamoeba dispar
KENINNEQEKNEEDEYDY

SEQ ID NO: 2434970 - protein, 8 aa, Entamoeba dispar
KENIPTYG

SEQ ID NO: 2434971 - protein, 8 aa, Entamoeba dispar
KENIQKSR

SEQ ID NO: 2434972 - protein, 6 aa, Entamoeba dispar
KENISE

SEQ ID NO: 2434973 - protein, 7 aa, Entamoeba dispar
KENISET

SEQ ID NO: 2434974 - protein, 15 aa, Entamoeba dispar
KENISEVEKREETKV

SEQ ID NO: 2434975 - protein, 7 aa, Entamoeba dispar
KENKAED

SEQ ID NO: 2434976 - protein, 9 aa, Entamoeba dispar
KENKAKELS

SEQ ID NO: 2434977 - protein, 37 aa, Entamoeba dispar
KENKASKKGFFTQRRRKAKPEVDNTKHVYEEKKQNIM

SEQ ID NO: 2434978 - protein, 5 aa, Entamoeba dispar
KENKD

SEQ ID NO: 2434979 - protein, 24 aa, Entamoeba dispar
KENKEIKDKCTKEEEIKEGLDQEI

SEQ ID NO: 2434980 - protein, 12 aa, Entamoeba dispar
KENKEQKENNFE

SEQ ID NO: 2434981 - protein, 26 aa, Entamoeba dispar
KENKLPEAAEAMDAARQLDKSDRYLA

SEQ ID NO: 2434982 - protein, 6 aa, Entamoeba dispar
KENKMN

SEQ ID NO: 2434983 - protein, 7 aa, Entamoeba dispar
KENKNCP

SEQ ID NO: 2434984 - protein, 30 aa, Entamoeba dispar
KENKPIESKKQQEVITNEKKEDSDDENWDF

SEQ ID NO: 2434985 - protein, 20 aa, Entamoeba dispar
KENKPKGQGFFNGGDKGGVE

SEQ ID NO: 2434986 - protein, 22 aa, Entamoeba dispar
KENKPQKIKTEDEIKPKKIPKK

SEQ ID NO: 2434987 - protein, 7 aa, Entamoeba dispar
KENKPQL

SEQ ID NO: 2434988 - protein, 11 aa, Entamoeba dispar
KENKQSDTTFQ

SEQ ID NO: 2434989 - protein, 13 aa, Entamoeba dispar
KENKTLKDKEHQN

SEQ ID NO: 2434990 - protein, 5 aa, Entamoeba dispar
KENKV

SEQ ID NO: 2434991 - protein, 4 aa, Entamoeba dispar
KENL

SEQ ID NO: 2434992 - protein, 5 aa, Entamoeba dispar
KENLD

SEQ ID NO: 2434993 - protein, 7 aa, Entamoeba dispar
KENLPPY

SEQ ID NO: 2434994 - protein, 13 aa, Entamoeba dispar
KENMSSYEKQRSK

SEQ ID NO: 2434995 - protein, 6 aa, Entamoeba dispar
KENNEH

SEQ ID NO: 2434996 - protein, 7 aa, Entamoeba dispar
KENNEID

SEQ ID NO: 2434997 - protein, 12 aa, Entamoeba dispar
KENNEMKSQINE

SEQ ID NO: 2434998 - protein, 7 aa, Entamoeba dispar
KENNESF

SEQ ID NO: 2434999 - protein, 8 aa, Entamoeba dispar
KENNIKQE

SEQ ID NO: 2435000 - protein, 7 aa, Entamoeba dispar
KENNISL

SEQ ID NO: 2435001 - protein, 23 aa, Entamoeba dispar
KENNKEQTKEDETIRKDNEYQNK

SEQ ID NO: 2435002 - protein, 10 aa, Entamoeba dispar
KENNKTKSSC

SEQ ID NO: 2435003 - protein, 5 aa, Entamoeba dispar
KENNQ

SEQ ID NO: 2435004 - protein, 7 aa, Entamoeba dispar
KENNRIE

SEQ ID NO: 2435005 - protein, 12 aa, Entamoeba dispar
KENNRKTREESF

SEQ ID NO: 2435006 - protein, 9 aa, Entamoeba dispar
KENNSINEE

SEQ ID NO: 2435007 - protein, 7 aa, Entamoeba dispar
KENNSNQ

SEQ ID NO: 2435008 - protein, 11 aa, Entamoeba dispar
KENNSNSSMSF

SEQ ID NO: 2435009 - protein, 5 aa, Entamoeba dispar
KENNT

SEQ ID NO: 2435010 - protein, 5 aa, Entamoeba dispar
KENPH

SEQ ID NO: 2435011 - protein, 8 aa, Entamoeba dispar
KENPIDSY

SEQ ID NO: 2435012 - protein, 6 aa, Entamoeba dispar
KENPQN

SEQ ID NO: 2435013 - protein, 5 aa, Entamoeba dispar
KENPV

SEQ ID NO: 2435014 - protein, 4 aa, Entamoeba dispar
KENQ

SEQ ID NO: 2435015 - protein, 16 aa, Entamoeba dispar
KENQINIQEKQENFKG

SEQ ID NO: 2435016 - protein, 5 aa, Entamoeba dispar
KENQK

SEQ ID NO: 2435017 - protein, 9 aa, Entamoeba dispar
KENQKIGEN

SEQ ID NO: 2435018 - protein, 9 aa, Entamoeba dispar
KENQKSEFE

SEQ ID NO: 2435019 - protein, 10 aa, Entamoeba dispar
KENRSMSPGI

SEQ ID NO: 2435020 - protein, 7 aa, Entamoeba dispar
KENSDKI

SEQ ID NO: 2435021 - protein, 18 aa, Entamoeba dispar
KENSEEKEKLKKEFQNDL

SEQ ID NO: 2435022 - protein, 7 aa, Entamoeba dispar
KENSIDE

SEQ ID NO: 2435023 - protein, 6 aa, Entamoeba dispar
KENSIT

SEQ ID NO: 2435024 - protein, 6 aa, Entamoeba dispar
KENSKK

SEQ ID NO: 2435025 - protein, 8 aa, Entamoeba dispar
KENSMGDD

SEQ ID NO: 2435026 - protein, 5 aa, Entamoeba dispar
KENSQ

SEQ ID NO: 2435027 - protein, 29 aa, Entamoeba dispar
KENSTNFEITNTTDPETHTDTQKTISYTG

SEQ ID NO: 2435028 - protein, 14 aa, Entamoeba dispar
KENSVSPENSTGRN

SEQ ID NO: 2435029 - protein, 7 aa, Entamoeba dispar
KENTDLY

SEQ ID NO: 2435030 - protein, 49 aa, Entamoeba dispar
KENTEKVKQADQQRSENIQKLKEEQKKKKEQRMKMEKEEDDDEDDADDQ

SEQ ID NO: 2435031 - protein, 6 aa, Entamoeba dispar
KENTFK

SEQ ID NO: 2435032 - protein, 7 aa, Entamoeba dispar
KENTNDK

SEQ ID NO: 2435033 - protein, 6 aa, Entamoeba dispar
KENTPH

SEQ ID NO: 2435034 - protein, 11 aa, Entamoeba dispar
KENTPTPSLKT

SEQ ID NO: 2435035 - protein, 6 aa, Entamoeba dispar
KENTRI

SEQ ID NO: 2435036 - protein, 7 aa, Entamoeba dispar
KENTRKC

SEQ ID NO: 2435037 - protein, 6 aa, Entamoeba dispar
KENTTI

SEQ ID NO: 2435038 - protein, 17 aa, Entamoeba dispar
KENTTIAKEDLDKNNTI

SEQ ID NO: 2435039 - protein, 4 aa, Entamoeba dispar
KENV

SEQ ID NO: 2435040 - protein, 8 aa, Entamoeba dispar
KENVEQSV

SEQ ID NO: 2435041 - protein, 5 aa, Entamoeba dispar
KENYA

SEQ ID NO: 2435042 - protein, 18 aa, Entamoeba dispar
KENYEKLKNEKERMNTKI

SEQ ID NO: 2435043 - protein, 27 aa, Entamoeba dispar
KENYQQIEGSLNKKTKQVKKLKNEKAV

SEQ ID NO: 2435044 - protein, 5 aa, Entamoeba dispar
KEPDE

SEQ ID NO: 2435045 - protein, 6 aa, Entamoeba dispar
KEPDEY

SEQ ID NO: 2435046 - protein, 8 aa, Entamoeba dispar
KEPDSINV

SEQ ID NO: 2435047 - protein, 4 aa, Entamoeba dispar
KEPE

SEQ ID NO: 2435048 - protein, 7 aa, Entamoeba dispar
KEPEDIS

SEQ ID NO: 2435049 - protein, 7 aa, Entamoeba dispar
KEPEGRI

SEQ ID NO: 2435050 - protein, 7 aa, Entamoeba dispar
KEPFSSP

SEQ ID NO: 2435051 - protein, 4 aa, Entamoeba dispar
KEPI

SEQ ID NO: 2435052 - protein, 8 aa, Entamoeba dispar
KEPIQNKQ

SEQ ID NO: 2435053 - protein, 5 aa, Entamoeba dispar
KEPKD

SEQ ID NO: 2435054 - protein, 6 aa, Entamoeba dispar
KEPKEL

SEQ ID NO: 2435055 - protein, 6 aa, Entamoeba dispar
KEPKQM

SEQ ID NO: 2435056 - protein, 4 aa, Entamoeba dispar
KEPL

SEQ ID NO: 2435057 - protein, 7 aa, Entamoeba dispar
KEPNAIN

SEQ ID NO: 2435058 - protein, 15 aa, Entamoeba dispar
KEPNEQQAMSNNKRR

SEQ ID NO: 2435059 - protein, 8 aa, Entamoeba dispar
KEPNIQKL

SEQ ID NO: 2435060 - protein, 21 aa, Entamoeba dispar
KEPNSSNISGKEDKKDEEVSC

SEQ ID NO: 2435061 - protein, 5 aa, Entamoeba dispar
KEPQS

SEQ ID NO: 2435062 - protein, 8 aa, Entamoeba dispar
KEPRQGIT

SEQ ID NO: 2435063 - protein, 10 aa, Entamoeba dispar
KEPSKDIVTQ

SEQ ID NO: 2435064 - protein, 9 aa, Entamoeba dispar
KEPSLKPKY

SEQ ID NO: 2435065 - protein, 4 aa, Entamoeba dispar
KEPT

SEQ ID NO: 2435066 - protein, 8 aa, Entamoeba dispar
KEPTEKNN

SEQ ID NO: 2435067 - protein, 10 aa, Entamoeba dispar
KEPTKKFKNQ

SEQ ID NO: 2435068 - protein, 7 aa, Entamoeba dispar
KEPTTEK

SEQ ID NO: 2435069 - protein, 7 aa, Entamoeba dispar
KEPTVSP

SEQ ID NO: 2435070 - protein, 7 aa, Entamoeba dispar
KEPYTIT

SEQ ID NO: 2435071 - protein, 7 aa, Entamoeba dispar
KEQDADE

SEQ ID NO: 2435072 - protein, 7 aa, Entamoeba dispar
KEQDDEV

SEQ ID NO: 2435073 - protein, 58 aa, Entamoeba dispar
KEQDEIERKRREEQDKINKVEEEKRAKEEEERKKQQELEQQQKKIKEAKEKEEKEYNS

SEQ ID NO: 2435074 - protein, 8 aa, Entamoeba dispar
KEQEDSKT

SEQ ID NO: 2435075 - protein, 7 aa, Entamoeba dispar
KEQENIK

SEQ ID NO: 2435076 - protein, 9 aa, Entamoeba dispar
KEQENKYKN

SEQ ID NO: 2435077 - protein, 6 aa, Entamoeba dispar
KEQERL

SEQ ID NO: 2435078 - protein, 7 aa, Entamoeba dispar
KEQERLK

SEQ ID NO: 2435079 - protein, 14 aa, Entamoeba dispar
KEQEVQSIKNEYES

SEQ ID NO: 2435080 - protein, 12 aa, Entamoeba dispar
KEQFDGLKKGKK

SEQ ID NO: 2435081 - protein, 5 aa, Entamoeba dispar
KEQGD

SEQ ID NO: 2435082 - protein, 11 aa, Entamoeba dispar
KEQGETEELGK

SEQ ID NO: 2435083 - protein, 5 aa, Entamoeba dispar
KEQGG

SEQ ID NO: 2435084 - protein, 10 aa, Entamoeba dispar
KEQGGSLEDS

SEQ ID NO: 2435085 - protein, 5 aa, Entamoeba dispar
KEQGT

SEQ ID NO: 2435086 - protein, 6 aa, Entamoeba dispar
KEQHGS

SEQ ID NO: 2435087 - protein, 5 aa, Entamoeba dispar
KEQIA

SEQ ID NO: 2435088 - protein, 40 aa, Entamoeba dispar
KEQINNNLSKKEEKQGQYSKKVDQLNGQHIKQSKEITEQE

SEQ ID NO: 2435089 - protein, 4 aa, Entamoeba dispar
KEQK

SEQ ID NO: 2435090 - protein, 23 aa, Entamoeba dispar
KEQKEEEKRRKEEQENKEKAIRE

SEQ ID NO: 2435091 - protein, 9 aa, Entamoeba dispar
KEQKEKGKL

SEQ ID NO: 2435092 - protein, 7 aa, Entamoeba dispar
KEQKQDL

SEQ ID NO: 2435093 - protein, 16 aa, Entamoeba dispar
KEQKQFEKDKENIKKY

SEQ ID NO: 2435094 - protein, 7 aa, Entamoeba dispar
KEQKQRA

SEQ ID NO: 2435095 - protein, 7 aa, Entamoeba dispar
KEQKTKL

SEQ ID NO: 2435096 - protein, 7 aa, Entamoeba dispar
KEQKVIS

SEQ ID NO: 2435097 - protein, 41 aa, Entamoeba dispar
KEQKVKEENENKENQVEEEKVQEKEIEEIEEEEESEEDKKT

SEQ ID NO: 2435098 - protein, 12 aa, Entamoeba dispar
KEQLAQQKPIQK

SEQ ID NO: 2435099 - protein, 10 aa, Entamoeba dispar
KEQLRKGYEN

SEQ ID NO: 2435100 - protein, 17 aa, Entamoeba dispar
KEQMDGKIRNNNDLEAT

SEQ ID NO: 2435101 - protein, 5 aa, Entamoeba dispar
KEQMR

SEQ ID NO: 2435102 - protein, 7 aa, Entamoeba dispar
KEQMTIT

SEQ ID NO: 2435103 - protein, 13 aa, Entamoeba dispar
KEQNGSTTPQHAL

SEQ ID NO: 2435104 - protein, 10 aa, Entamoeba dispar
KEQNKENEQM

SEQ ID NO: 2435105 - protein, 7 aa, Entamoeba dispar
KEQNPGY

SEQ ID NO: 2435106 - protein, 7 aa, Entamoeba dispar
KEQNPNY

SEQ ID NO: 2435107 - protein, 12 aa, Entamoeba dispar
KEQPKKRKKSVK

SEQ ID NO: 2435108 - protein, 5 aa, Entamoeba dispar
KEQPN

SEQ ID NO: 2435109 - protein, 15 aa, Entamoeba dispar
KEQQEMKEKQEQEKL

SEQ ID NO: 2435110 - protein, 8 aa, Entamoeba dispar
KEQQKRLN

SEQ ID NO: 2435111 - protein, 20 aa, Entamoeba dispar
KEQQLGEITTQPNSAKGSSI

SEQ ID NO: 2435112 - protein, 12 aa, Entamoeba dispar
KEQQQDEETTKK

SEQ ID NO: 2435113 - protein, 27 aa, Entamoeba dispar
KEQREIKKKKRKENEESTEEEENERRY

SEQ ID NO: 2435114 - protein, 12 aa, Entamoeba dispar
KEQRKKYSFNKS

SEQ ID NO: 2435115 - protein, 20 aa, Entamoeba dispar
KEQRKQKSKQKKKPIQNDFD

SEQ ID NO: 2435116 - protein, 4 aa, Entamoeba dispar
KEQS

SEQ ID NO: 2435117 - protein, 7 aa, Entamoeba dispar
KEQSNYS

SEQ ID NO: 2435118 - protein, 7 aa, Entamoeba dispar
KEQTNDR

SEQ ID NO: 2435119 - protein, 9 aa, Entamoeba dispar
KEQVEEKDI

SEQ ID NO: 2435120 - protein, 13 aa, Entamoeba dispar
KEQVEKATKSIPF

SEQ ID NO: 2435121 - protein, 7 aa, Entamoeba dispar
KEQVKMK

SEQ ID NO: 2435122 - protein, 15 aa, Entamoeba dispar
KEQVYQRNDLPSADN

SEQ ID NO: 2435123 - protein, 4 aa, Entamoeba dispar
KEQY

SEQ ID NO: 2435124 - protein, 27 aa, Entamoeba dispar
KEQYAEQPVVQTQNSDSTLKRQDAGTL

SEQ ID NO: 2435125 - protein, 8 aa, Entamoeba dispar
KEQYDENG

SEQ ID NO: 2435126 - protein, 17 aa, Entamoeba dispar
KEQYIEKTTSKGETKTK

SEQ ID NO: 2435127 - protein, 8 aa, Entamoeba dispar
KEQYPNYQ

SEQ ID NO: 2435128 - protein, 5 aa, Entamoeba dispar
KEQYS

SEQ ID NO: 2435129 - protein, 13 aa, Entamoeba dispar
KERADQRKQRELE

SEQ ID NO: 2435130 - protein, 13 aa, Entamoeba dispar
KERAKGSCSEEEI

SEQ ID NO: 2435131 - protein, 8 aa, Entamoeba dispar
KERAKTSK

SEQ ID NO: 2435132 - protein, 8 aa, Entamoeba dispar
KERATNYR

SEQ ID NO: 2435133 - protein, 4 aa, Entamoeba dispar
KERC

SEQ ID NO: 2435134 - protein, 17 aa, Entamoeba dispar
KERDPQRKHGRKPHDES

SEQ ID NO: 2435135 - protein, 4 aa, Entamoeba dispar
KERE

SEQ ID NO: 2435136 - protein, 6 aa, Entamoeba dispar
KEREED

SEQ ID NO: 2435137 - protein, 8 aa, Entamoeba dispar
KEREESQH

SEQ ID NO: 2435138 - protein, 6 aa, Entamoeba dispar
KEREIN

SEQ ID NO: 2435139 - protein, 22 aa, Entamoeba dispar
KEREKDHTRTRSDSRDRNYPYS

SEQ ID NO: 2435140 - protein, 11 aa, Entamoeba dispar
KEREKEADISR

SEQ ID NO: 2435141 - protein, 8 aa, Entamoeba dispar
KEREQNEL

SEQ ID NO: 2435142 - protein, 5 aa, Entamoeba dispar
KERFE

SEQ ID NO: 2435143 - protein, 6 aa, Entamoeba dispar
KERFTR

SEQ ID NO: 2435144 - protein, 5 aa, Entamoeba dispar
KERGE

SEQ ID NO: 2435145 - protein, 8 aa, Entamoeba dispar
KERGNGIA

SEQ ID NO: 2435146 - protein, 7 aa, Entamoeba dispar
KERGTEG

SEQ ID NO: 2435147 - protein, 4 aa, Entamoeba dispar
KERI

SEQ ID NO: 2435148 - protein, 5 aa, Entamoeba dispar
KERID

SEQ ID NO: 2435149 - protein, 11 aa, Entamoeba dispar
KERIEKGEDIK

SEQ ID NO: 2435150 - protein, 6 aa, Entamoeba dispar
KERIKN

SEQ ID NO: 2435151 - protein, 7 aa, Entamoeba dispar
KERKEED

SEQ ID NO: 2435152 - protein, 9 aa, Entamoeba dispar
KERKEEKQE

SEQ ID NO: 2435153 - protein, 38 aa, Entamoeba dispar
KERKEKEEYKERKRLEREQKEKEEAEKRRLQEEEMEKE

SEQ ID NO: 2435154 - protein, 5 aa, Entamoeba dispar
KERKG

SEQ ID NO: 2435155 - protein, 19 aa, Entamoeba dispar
KERKGLMQTSSIKESSSFN

SEQ ID NO: 2435156 - protein, 18 aa, Entamoeba dispar
KERKGSIFEDTDRAKDKK

SEQ ID NO: 2435157 - protein, 5 aa, Entamoeba dispar
KERKK

SEQ ID NO: 2435158 - protein, 5 aa, Entamoeba dispar
KERKN

SEQ ID NO: 2435159 - protein, 13 aa, Entamoeba dispar
KERKQVDHTKAEK

SEQ ID NO: 2435160 - protein, 13 aa, Entamoeba dispar
KERKRTSRNDETI

SEQ ID NO: 2435161 - protein, 12 aa, Entamoeba dispar
KERLMNKDSVKG

SEQ ID NO: 2435162 - protein, 11 aa, Entamoeba dispar
KERLNKSNGII

SEQ ID NO: 2435163 - protein, 13 aa, Entamoeba dispar
KERLSDKTEDSNI

SEQ ID NO: 2435164 - protein, 9 aa, Entamoeba dispar
KERLTPNQA

SEQ ID NO: 2435165 - protein, 4 aa, Entamoeba dispar
KERM

SEQ ID NO: 2435166 - protein, 7 aa, Entamoeba dispar
KERNKSL

SEQ ID NO: 2435167 - protein, 8 aa, Entamoeba dispar
KERNNTRT

SEQ ID NO: 2435168 - protein, 7 aa, Entamoeba dispar
KERNQKV

SEQ ID NO: 2435169 - protein, 9 aa, Entamoeba dispar
KERNSDIPY

SEQ ID NO: 2435170 - protein, 11 aa, Entamoeba dispar
KERPRWNAPKI

SEQ ID NO: 2435171 - protein, 10 aa, Entamoeba dispar
KERPSKSTAL

SEQ ID NO: 2435172 - protein, 10 aa, Entamoeba dispar
KERQIKRPRT

SEQ ID NO: 2435173 - protein, 26 aa, Entamoeba dispar
KERQREKGMEVRPDSKYTGRRRSGKK

SEQ ID NO: 2435174 - protein, 4 aa, Entamoeba dispar
KERR

SEQ ID NO: 2435175 - protein, 10 aa, Entamoeba dispar
KERRDEYSIR

SEQ ID NO: 2435176 - protein, 5 aa, Entamoeba dispar
KERRI

SEQ ID NO: 2435177 - protein, 7 aa, Entamoeba dispar
KERRKNR

SEQ ID NO: 2435178 - protein, 5 aa, Entamoeba dispar
KERRL

SEQ ID NO: 2435179 - protein, 8 aa, Entamoeba dispar
KERRNSKM

SEQ ID NO: 2435180 - protein, 5 aa, Entamoeba dispar
KERRR

SEQ ID NO: 2435181 - protein, 9 aa, Entamoeba dispar
KERSEENII

SEQ ID NO: 2435182 - protein, 6 aa, Entamoeba dispar
KERSRN

SEQ ID NO: 2435183 - protein, 8 aa, Entamoeba dispar
KERSRNQK

SEQ ID NO: 2435184 - protein, 9 aa, Entamoeba dispar
KERTGANPP

SEQ ID NO: 2435185 - protein, 9 aa, Entamoeba dispar
KERTSSHSH

SEQ ID NO: 2435186 - protein, 6 aa, Entamoeba dispar
KERTTF

SEQ ID NO: 2435187 - protein, 15 aa, Entamoeba dispar
KERTTPSLRKSLDSL

SEQ ID NO: 2435188 - protein, 5 aa, Entamoeba dispar
KERTV

SEQ ID NO: 2435189 - protein, 10 aa, Entamoeba dispar
KERVGTPDYV

SEQ ID NO: 2435190 - protein, 7 aa, Entamoeba dispar
KERYCDG

SEQ ID NO: 2435191 - protein, 10 aa, Entamoeba dispar
KERYSKLGQE

SEQ ID NO: 2435192 - protein, 6 aa, Entamoeba dispar
KESADL

SEQ ID NO: 2435193 - protein, 13 aa, Entamoeba dispar
KESAKEKLESGTN

SEQ ID NO: 2435194 - protein, 5 aa, Entamoeba dispar
KESAP

SEQ ID NO: 2435195 - protein, 6 aa, Entamoeba dispar
KESAQF

SEQ ID NO: 2435196 - protein, 24 aa, Entamoeba dispar
KESATPRDKYNRTSRSVDVTPSFK

SEQ ID NO: 2435197 - protein, 5 aa, Entamoeba dispar
KESDE

SEQ ID NO: 2435198 - protein, 13 aa, Entamoeba dispar
KESDGIQKIQTSN

SEQ ID NO: 2435199 - protein, 15 aa, Entamoeba dispar
KESDIVTSGKSQKKL

SEQ ID NO: 2435200 - protein, 7 aa, Entamoeba dispar
KESDKKA

SEQ ID NO: 2435201 - protein, 13 aa, Entamoeba dispar
KESDNNNVKKETL

SEQ ID NO: 2435202 - protein, 10 aa, Entamoeba dispar
KESDRGELTT

SEQ ID NO: 2435203 - protein, 20 aa, Entamoeba dispar
KESDSLSSNPVNSTQSDEAL

SEQ ID NO: 2435204 - protein, 4 aa, Entamoeba dispar
KESE

SEQ ID NO: 2435205 - protein, 18 aa, Entamoeba dispar
KESEAAENGVIKDPETGV

SEQ ID NO: 2435206 - protein, 10 aa, Entamoeba dispar
KESEDNIHRT

SEQ ID NO: 2435207 - protein, 64 aa, Entamoeba dispar
KESEKESDEVRSECEKKEEMSESEIEENIKEEKMSENESLEDDIQENKSNEKSHISSNDMSEEN

SEQ ID NO: 2435208 - protein, 8 aa, Entamoeba dispar
KESEKPRV

SEQ ID NO: 2435209 - protein, 16 aa, Entamoeba dispar
KESEQKLLNYIIEAQR

SEQ ID NO: 2435210 - protein, 12 aa, Entamoeba dispar
KESFKTKDYDGT

SEQ ID NO: 2435211 - protein, 18 aa, Entamoeba dispar
KESFSTKTRINQSQREEL

SEQ ID NO: 2435212 - protein, 10 aa, Entamoeba dispar
KESGDSNEYE

SEQ ID NO: 2435213 - protein, 6 aa, Entamoeba dispar
KESGHV

SEQ ID NO: 2435214 - protein, 6 aa, Entamoeba dispar
KESGIL

SEQ ID NO: 2435215 - protein, 8 aa, Entamoeba dispar
KESGQYKH

SEQ ID NO: 2435216 - protein, 7 aa, Entamoeba dispar
KESGRYK

SEQ ID NO: 2435217 - protein, 6 aa, Entamoeba dispar
KESGYT

SEQ ID NO: 2435218 - protein, 7 aa, Entamoeba dispar
KESINKR

SEQ ID NO: 2435219 - protein, 6 aa, Entamoeba dispar
KESINT

SEQ ID NO: 2435220 - protein, 8 aa, Entamoeba dispar
KESIPGYY

SEQ ID NO: 2435221 - protein, 16 aa, Entamoeba dispar
KESIQWTTSRRKLTEV

SEQ ID NO: 2435222 - protein, 25 aa, Entamoeba dispar
KESITNSDFPLPQTQQPIKKEEPQF

SEQ ID NO: 2435223 - protein, 8 aa, Entamoeba dispar
KESITPQE

SEQ ID NO: 2435224 - protein, 12 aa, Entamoeba dispar
KESKNEGGKRYN

SEQ ID NO: 2435225 - protein, 12 aa, Entamoeba dispar
KESKQKDKKFQQ

SEQ ID NO: 2435226 - protein, 11 aa, Entamoeba dispar
KESKTKNIPFQ

SEQ ID NO: 2435227 - protein, 11 aa, Entamoeba dispar
KESKTKSEAIA

SEQ ID NO: 2435228 - protein, 7 aa, Entamoeba dispar
KESKTPV

SEQ ID NO: 2435229 - protein, 7 aa, Entamoeba dispar
KESKYQC

SEQ ID NO: 2435230 - protein, 6 aa, Entamoeba dispar
KESKYY

SEQ ID NO: 2435231 - protein, 5 aa, Entamoeba dispar
KESLE

SEQ ID NO: 2435232 - protein, 11 aa, Entamoeba dispar
KESLKTEGNLN

SEQ ID NO: 2435233 - protein, 4 aa, Entamoeba dispar
KESN

SEQ ID NO: 2435234 - protein, 7 aa, Entamoeba dispar
KESNEMT

SEQ ID NO: 2435235 - protein, 12 aa, Entamoeba dispar
KESNKENTECVL

SEQ ID NO: 2435236 - protein, 18 aa, Entamoeba dispar
KESNNFQPKQSVSTKVSS

SEQ ID NO: 2435237 - protein, 23 aa, Entamoeba dispar
KESNNPQSVTKETIGSYGEGDRQ

SEQ ID NO: 2435238 - protein, 10 aa, Entamoeba dispar
KESNSGVDKY

SEQ ID NO: 2435239 - protein, 7 aa, Entamoeba dispar
KESNTTL

SEQ ID NO: 2435240 - protein, 6 aa, Entamoeba dispar
KESPKK

SEQ ID NO: 2435241 - protein, 20 aa, Entamoeba dispar
KESPNVSSIARSEPSTPISC

SEQ ID NO: 2435242 - protein, 11 aa, Entamoeba dispar
KESPRRKRDRE

SEQ ID NO: 2435243 - protein, 6 aa, Entamoeba dispar
KESPYY

SEQ ID NO: 2435244 - protein, 7 aa, Entamoeba dispar
KESQKDG

SEQ ID NO: 2435245 - protein, 22 aa, Entamoeba dispar
KESQPPEEKSLKESQPIEKQQI

SEQ ID NO: 2435246 - protein, 8 aa, Entamoeba dispar
KESQQAKN

SEQ ID NO: 2435247 - protein, 14 aa, Entamoeba dispar
KESQQDNESIQEEW

SEQ ID NO: 2435248 - protein, 7 aa, Entamoeba dispar
KESQSNY

SEQ ID NO: 2435249 - protein, 5 aa, Entamoeba dispar
KESQV

SEQ ID NO: 2435250 - protein, 5 aa, Entamoeba dispar
KESRE

SEQ ID NO: 2435251 - protein, 10 aa, Entamoeba dispar
KESREIKEEV

SEQ ID NO: 2435252 - protein, 5 aa, Entamoeba dispar
KESRL

SEQ ID NO: 2435253 - protein, 8 aa, Entamoeba dispar
KESRRKEN

SEQ ID NO: 2435254 - protein, 9 aa, Entamoeba dispar
KESSESAIA

SEQ ID NO: 2435255 - protein, 8 aa, Entamoeba dispar
KESSKERM

SEQ ID NO: 2435256 - protein, 10 aa, Entamoeba dispar
KESSNGCTKC

SEQ ID NO: 2435257 - protein, 14 aa, Entamoeba dispar
KESSSKKIIEENER

SEQ ID NO: 2435258 - protein, 5 aa, Entamoeba dispar
KESTK

SEQ ID NO: 2435259 - protein, 6 aa, Entamoeba dispar
KESTRL

SEQ ID NO: 2435260 - protein, 12 aa, Entamoeba dispar
KESTSTRYTSKE

SEQ ID NO: 2435261 - protein, 8 aa, Entamoeba dispar
KESVDDST

SEQ ID NO: 2435262 - protein, 4 aa, Entamoeba dispar
KESW

SEQ ID NO: 2435263 - protein, 10 aa, Entamoeba dispar
KESYQKEGKC

SEQ ID NO: 2435264 - protein, 10 aa, Entamoeba dispar
KETADKKELK

SEQ ID NO: 2435265 - protein, 8 aa, Entamoeba dispar
KETADKKR

SEQ ID NO: 2435266 - protein, 7 aa, Entamoeba dispar
KETAESF

SEQ ID NO: 2435267 - protein, 7 aa, Entamoeba dispar
KETAETF

SEQ ID NO: 2435268 - protein, 6 aa, Entamoeba dispar
KETAQE

SEQ ID NO: 2435269 - protein, 26 aa, Entamoeba dispar
KETDDDMGSIQSLGTKTPSSLSQYSK

SEQ ID NO: 2435270 - protein, 7 aa, Entamoeba dispar
KETDEYH

SEQ ID NO: 2435271 - protein, 5 aa, Entamoeba dispar
KETDM

SEQ ID NO: 2435272 - protein, 7 aa, Entamoeba dispar
KETDNTL

SEQ ID NO: 2435273 - protein, 20 aa, Entamoeba dispar
KETDRRKRNDEKKENNINEE

SEQ ID NO: 2435274 - protein, 6 aa, Entamoeba dispar
KETDYC

SEQ ID NO: 2435275 - protein, 12 aa, Entamoeba dispar
KETDYETRKQAN

SEQ ID NO: 2435276 - protein, 63 aa, Entamoeba dispar
KETEEEVTDDEAEEKKEEETKEEEKKEEEKKEEEKKEEEEVKIEDDKKEEKKEKKTKKVKKVT

SEQ ID NO: 2435277 - protein, 40 aa, Entamoeba dispar
KETEEIAKKEVEEEKAKQEAEERLRKETEEKARLEAEERL

SEQ ID NO: 2435278 - protein, 7 aa, Entamoeba dispar
KETEESG

SEQ ID NO: 2435279 - protein, 5 aa, Entamoeba dispar
KETEQ

SEQ ID NO: 2435280 - protein, 6 aa, Entamoeba dispar
KETEQY

SEQ ID NO: 2435281 - protein, 7 aa, Entamoeba dispar
KETESTF

SEQ ID NO: 2435282 - protein, 7 aa, Entamoeba dispar
KETETEV

SEQ ID NO: 2435283 - protein, 11 aa, Entamoeba dispar
KETETNNKSKV

SEQ ID NO: 2435284 - protein, 5 aa, Entamoeba dispar
KETFE

SEQ ID NO: 2435285 - protein, 4 aa, Entamoeba dispar
KETG

SEQ ID NO: 2435286 - protein, 7 aa, Entamoeba dispar
KETGCSD

SEQ ID NO: 2435287 - protein, 20 aa, Entamoeba dispar
KETGDKKEAKIKLNDETIST

SEQ ID NO: 2435288 - protein, 10 aa, Entamoeba dispar
KETGDKKEVK

SEQ ID NO: 2435289 - protein, 9 aa, Entamoeba dispar
KETGDKKRI

SEQ ID NO: 2435290 - protein, 7 aa, Entamoeba dispar
KETGDKM

SEQ ID NO: 2435291 - protein, 8 aa, Entamoeba dispar
KETGDYRN

SEQ ID NO: 2435292 - protein, 8 aa, Entamoeba dispar
KETGNNTN

SEQ ID NO: 2435293 - protein, 13 aa, Entamoeba dispar
KETGNTIPQQQSG

SEQ ID NO: 2435294 - protein, 8 aa, Entamoeba dispar
KETGYKRK

SEQ ID NO: 2435295 - protein, 5 aa, Entamoeba dispar
KETID

SEQ ID NO: 2435296 - protein, 5 aa, Entamoeba dispar
KETIE

SEQ ID NO: 2435297 - protein, 5 aa, Entamoeba dispar
KETIT

SEQ ID NO: 2435298 - protein, 6 aa, Entamoeba dispar
KETITN

SEQ ID NO: 2435299 - protein, 10 aa, Entamoeba dispar
KETKADGSII

SEQ ID NO: 2435300 - protein, 8 aa, Entamoeba dispar
KETKEAKN

SEQ ID NO: 2435301 - protein, 8 aa, Entamoeba dispar
KETKEGYE

SEQ ID NO: 2435302 - protein, 9 aa, Entamoeba dispar
KETKESELK

SEQ ID NO: 2435303 - protein, 6 aa, Entamoeba dispar
KETKKE

SEQ ID NO: 2435304 - protein, 6 aa, Entamoeba dispar
KETKKI

SEQ ID NO: 2435305 - protein, 8 aa, Entamoeba dispar
KETKKPIS

SEQ ID NO: 2435306 - protein, 6 aa, Entamoeba dispar
KETKNE

SEQ ID NO: 2435307 - protein, 7 aa, Entamoeba dispar
KETKPQK

SEQ ID NO: 2435308 - protein, 5 aa, Entamoeba dispar
KETKS

SEQ ID NO: 2435309 - protein, 6 aa, Entamoeba dispar
KETLGG

SEQ ID NO: 2435310 - protein, 20 aa, Entamoeba dispar
KETLRNRKRISRNGESTVTN

SEQ ID NO: 2435311 - protein, 4 aa, Entamoeba dispar
KETM

SEQ ID NO: 2435312 - protein, 15 aa, Entamoeba dispar
KETMSQYEKQRSSYF

SEQ ID NO: 2435313 - protein, 4 aa, Entamoeba dispar
KETN

SEQ ID NO: 2435314 - protein, 7 aa, Entamoeba dispar
KETNDGG

SEQ ID NO: 2435315 - protein, 6 aa, Entamoeba dispar
KETNEP

SEQ ID NO: 2435316 - protein, 5 aa, Entamoeba dispar
KETNG

SEQ ID NO: 2435317 - protein, 5 aa, Entamoeba dispar
KETNI

SEQ ID NO: 2435318 - protein, 7 aa, Entamoeba dispar
KETNLKT

SEQ ID NO: 2435319 - protein, 7 aa, Entamoeba dispar
KETNNKS

SEQ ID NO: 2435320 - protein, 7 aa, Entamoeba dispar
KETNNKT

SEQ ID NO: 2435321 - protein, 21 aa, Entamoeba dispar
KETNPNLTSPSIHTNQNTFII

SEQ ID NO: 2435322 - protein, 6 aa, Entamoeba dispar
KETNQI

SEQ ID NO: 2435323 - protein, 7 aa, Entamoeba dispar
KETNTNE

SEQ ID NO: 2435324 - protein, 6 aa, Entamoeba dispar
KETPII

SEQ ID NO: 2435325 - protein, 6 aa, Entamoeba dispar
KETPKQ

SEQ ID NO: 2435326 - protein, 21 aa, Entamoeba dispar
KETPKRKTKRSETIKTKPKMS

SEQ ID NO: 2435327 - protein, 6 aa, Entamoeba dispar
KETPKV

SEQ ID NO: 2435328 - protein, 7 aa, Entamoeba dispar
KETPNTF

SEQ ID NO: 2435329 - protein, 9 aa, Entamoeba dispar
KETPPRGVN

SEQ ID NO: 2435330 - protein, 8 aa, Entamoeba dispar
KETPPSPL

SEQ ID NO: 2435331 - protein, 7 aa, Entamoeba dispar
KETPPVP

SEQ ID NO: 2435332 - protein, 16 aa, Entamoeba dispar
KETQEVKENKEVKELK

SEQ ID NO: 2435333 - protein, 9 aa, Entamoeba dispar
KETQKTNPR

SEQ ID NO: 2435334 - protein, 6 aa, Entamoeba dispar
KETQKV

SEQ ID NO: 2435335 - protein, 8 aa, Entamoeba dispar
KETQLKEE

SEQ ID NO: 2435336 - protein, 8 aa, Entamoeba dispar
KETQQQEL

SEQ ID NO: 2435337 - protein, 11 aa, Entamoeba dispar
KETRDQKLKEI

SEQ ID NO: 2435338 - protein, 13 aa, Entamoeba dispar
KETRKLEKKPEIE

SEQ ID NO: 2435339 - protein, 8 aa, Entamoeba dispar
KETRNPSY

SEQ ID NO: 2435340 - protein, 13 aa, Entamoeba dispar
KETRQNKEKGTSL

SEQ ID NO: 2435341 - protein, 10 aa, Entamoeba dispar
KETSEEFYQT

SEQ ID NO: 2435342 - protein, 8 aa, Entamoeba dispar
KETSKIDS

SEQ ID NO: 2435343 - protein, 38 aa, Entamoeba dispar
KETSNPQSPSNHNKTQIDENTQQKTELHKPNEANENKL

SEQ ID NO: 2435344 - protein, 9 aa, Entamoeba dispar
KETSNYQEN

SEQ ID NO: 2435345 - protein, 9 aa, Entamoeba dispar
KETSPTERT

SEQ ID NO: 2435346 - protein, 7 aa, Entamoeba dispar
KETSQEH

SEQ ID NO: 2435347 - protein, 10 aa, Entamoeba dispar
KETTDKKGIK

SEQ ID NO: 2435348 - protein, 9 aa, Entamoeba dispar
KETTDKTEV

SEQ ID NO: 2435349 - protein, 5 aa, Entamoeba dispar
KETTE

SEQ ID NO: 2435350 - protein, 9 aa, Entamoeba dispar
KETTEKLNQ

SEQ ID NO: 2435351 - protein, 7 aa, Entamoeba dispar
KETTGDE

SEQ ID NO: 2435352 - protein, 8 aa, Entamoeba dispar
KETTGDER

SEQ ID NO: 2435353 - protein, 10 aa, Entamoeba dispar
KETTKEDTLL

SEQ ID NO: 2435354 - protein, 5 aa, Entamoeba dispar
KETTL

SEQ ID NO: 2435355 - protein, 8 aa, Entamoeba dispar
KETTRDGE

SEQ ID NO: 2435356 - protein, 7 aa, Entamoeba dispar
KETTVGC

SEQ ID NO: 2435357 - protein, 6 aa, Entamoeba dispar
KETTYQ

SEQ ID NO: 2435358 - protein, 9 aa, Entamoeba dispar
KETVEGTIN

SEQ ID NO: 2435359 - protein, 6 aa, Entamoeba dispar
KETWNE

SEQ ID NO: 2435360 - protein, 57 aa, Entamoeba dispar
KEVADSFNDSTEVPQEQPQQEDNKTTSKIQQKQQSTDENNEKNQSQPVTDPTTAGVQ

SEQ ID NO: 2435361 - protein, 24 aa, Entamoeba dispar
KEVAEAKAEKAKEMKKKINKKGYS

SEQ ID NO: 2435362 - protein, 5 aa, Entamoeba dispar
KEVDD

SEQ ID NO: 2435363 - protein, 29 aa, Entamoeba dispar
KEVDEVQENKAEPQPKETKESEEKQLSPC

SEQ ID NO: 2435364 - protein, 7 aa, Entamoeba dispar
KEVDKDT

SEQ ID NO: 2435365 - protein, 20 aa, Entamoeba dispar
KEVDTKKLEDIKKGEISSSS

SEQ ID NO: 2435366 - protein, 8 aa, Entamoeba dispar
KEVEETKK

SEQ ID NO: 2435367 - protein, 19 aa, Entamoeba dispar
KEVEKEEKENKKKYEEPRF

SEQ ID NO: 2435368 - protein, 10 aa, Entamoeba dispar
KEVEKKGEIE

SEQ ID NO: 2435369 - protein, 5 aa, Entamoeba dispar
KEVET

SEQ ID NO: 2435370 - protein, 5 aa, Entamoeba dispar
KEVHN

SEQ ID NO: 2435371 - protein, 4 aa, Entamoeba dispar
KEVI

SEQ ID NO: 2435372 - protein, 20 aa, Entamoeba dispar
KEVIPTTIPTEKSNISSSVF

SEQ ID NO: 2435373 - protein, 6 aa, Entamoeba dispar
KEVKDE

SEQ ID NO: 2435374 - protein, 10 aa, Entamoeba dispar
KEVKENEKLV

SEQ ID NO: 2435375 - protein, 19 aa, Entamoeba dispar
KEVKGKEEWTKSQSNSFSR

SEQ ID NO: 2435376 - protein, 6 aa, Entamoeba dispar
KEVKLN

SEQ ID NO: 2435377 - protein, 6 aa, Entamoeba dispar
KEVKPI

SEQ ID NO: 2435378 - protein, 13 aa, Entamoeba dispar
KEVNNNPNTARAL

SEQ ID NO: 2435379 - protein, 30 aa, Entamoeba dispar
KEVPAENSPQSITHQSSNTPLKRTSSTRSS

SEQ ID NO: 2435380 - protein, 8 aa, Entamoeba dispar
KEVPESIS

SEQ ID NO: 2435381 - protein, 5 aa, Entamoeba dispar
KEVPK

SEQ ID NO: 2435382 - protein, 6 aa, Entamoeba dispar
KEVPLP

SEQ ID NO: 2435383 - protein, 11 aa, Entamoeba dispar
KEVPQPEPLPS

SEQ ID NO: 2435384 - protein, 27 aa, Entamoeba dispar
KEVQEKPYIQESQKVPEKTSVKDKEEL

SEQ ID NO: 2435385 - protein, 6 aa, Entamoeba dispar
KEVREM

SEQ ID NO: 2435386 - protein, 5 aa, Entamoeba dispar
KEVSD

SEQ ID NO: 2435387 - protein, 13 aa, Entamoeba dispar
KEVSQDPRYYNSQ

SEQ ID NO: 2435388 - protein, 7 aa, Entamoeba dispar
KEVTEKI

SEQ ID NO: 2435389 - protein, 17 aa, Entamoeba dispar
KEVTKTDTISTTHISQE

SEQ ID NO: 2435390 - protein, 18 aa, Entamoeba dispar
KEVTNIKDKPQASTDENE

SEQ ID NO: 2435391 - protein, 20 aa, Entamoeba dispar
KEVTQQNTPKQPKKETKKEQ

SEQ ID NO: 2435392 - protein, 5 aa, Entamoeba dispar
KEVTS

SEQ ID NO: 2435393 - protein, 4 aa, Entamoeba dispar
KEWD

SEQ ID NO: 2435394 - protein, 6 aa, Entamoeba dispar
KEWEGK

SEQ ID NO: 2435395 - protein, 7 aa, Entamoeba dispar
KEWKEAK

SEQ ID NO: 2435396 - protein, 5 aa, Entamoeba dispar
KEWKS

SEQ ID NO: 2435397 - protein, 7 aa, Entamoeba dispar
KEYDENE

SEQ ID NO: 2435398 - protein, 16 aa, Entamoeba dispar
KEYECNPSAWDTCIIS

SEQ ID NO: 2435399 - protein, 7 aa, Entamoeba dispar
KEYEEKS

SEQ ID NO: 2435400 - protein, 6 aa, Entamoeba dispar
KEYEPY

SEQ ID NO: 2435401 - protein, 13 aa, Entamoeba dispar
KEYESKKYSQALN

SEQ ID NO: 2435402 - protein, 4 aa, Entamoeba dispar
KEYF

SEQ ID NO: 2435403 - protein, 16 aa, Entamoeba dispar
KEYHQQLSSCSEQFIP

SEQ ID NO: 2435404 - protein, 9 aa, Entamoeba dispar
KEYKEGEEI

SEQ ID NO: 2435405 - protein, 5 aa, Entamoeba dispar
KEYKG

SEQ ID NO: 2435406 - protein, 6 aa, Entamoeba dispar
KEYNGI

SEQ ID NO: 2435407 - protein, 12 aa, Entamoeba dispar
KEYNGLAELNDN

SEQ ID NO: 2435408 - protein, 7 aa, Entamoeba dispar
KEYNIGD

SEQ ID NO: 2435409 - protein, 12 aa, Entamoeba dispar
KEYNKIKQETNG

SEQ ID NO: 2435410 - protein, 18 aa, Entamoeba dispar
KEYNNNSSLWDASIEVKS

SEQ ID NO: 2435411 - protein, 5 aa, Entamoeba dispar
KEYPF

SEQ ID NO: 2435412 - protein, 11 aa, Entamoeba dispar
KEYPNSLKNGD

SEQ ID NO: 2435413 - protein, 8 aa, Entamoeba dispar
KEYPSKQL

SEQ ID NO: 2435414 - protein, 4 aa, Entamoeba dispar
KEYQ

SEQ ID NO: 2435415 - protein, 5 aa, Entamoeba dispar
KEYQE

SEQ ID NO: 2435416 - protein, 8 aa, Entamoeba dispar
KEYQETQE

SEQ ID NO: 2435417 - protein, 10 aa, Entamoeba dispar
KEYQKAFENA

SEQ ID NO: 2435418 - protein, 6 aa, Entamoeba dispar
KEYQNS

SEQ ID NO: 2435419 - protein, 47 aa, Entamoeba dispar
KEYRGNKLKGDIVDDNDSINSEEIESQGSDDNSDQSGIDDEEIDSDE

SEQ ID NO: 2435420 - protein, 10 aa, Entamoeba dispar
KEYRKRKEEI

SEQ ID NO: 2435421 - protein, 7 aa, Entamoeba dispar
KEYSGTS

SEQ ID NO: 2435422 - protein, 12 aa, Entamoeba dispar
KEYTKESEMDEQ

SEQ ID NO: 2435423 - protein, 12 aa, Entamoeba dispar
KEYTKPNRIQRT

SEQ ID NO: 2435424 - protein, 8 aa, Entamoeba dispar
KEYTQQEL

SEQ ID NO: 2435425 - protein, 7 aa, Entamoeba dispar
KEYTSHE

SEQ ID NO: 2435426 - protein, 8 aa, Entamoeba dispar
KEYTSIGT

SEQ ID NO: 2435427 - protein, 44 aa, Entamoeba dispar
KEYTSRSKEVQQLSTSTIKERKKFDQDLSNAEKKTASTSNFKEA

SEQ ID NO: 2435428 - protein, 23 aa, Entamoeba dispar
KEYVEKEQQKKNDAESEQLEETR

SEQ ID NO: 2435429 - protein, 6 aa, Entamoeba dispar
KEYYDK

SEQ ID NO: 2435430 - protein, 9 aa, Entamoeba dispar
KFAEKTKNS

SEQ ID NO: 2435431 - protein, 5 aa, Entamoeba dispar
KFASS

SEQ ID NO: 2435432 - protein, 16 aa, Entamoeba dispar
KFDEEWKKNTEAYKKN

SEQ ID NO: 2435433 - protein, 15 aa, Entamoeba dispar
KFDGKEMNEKIKGKK

SEQ ID NO: 2435434 - protein, 7 aa, Entamoeba dispar
KFDGKEN

SEQ ID NO: 2435435 - protein, 5 aa, Entamoeba dispar
KFDIE

SEQ ID NO: 2435436 - protein, 16 aa, Entamoeba dispar
KFDKKKGKQNYKKKVR

SEQ ID NO: 2435437 - protein, 6 aa, Entamoeba dispar
KFDNKA

SEQ ID NO: 2435438 - protein, 5 aa, Entamoeba dispar
KFDNS

SEQ ID NO: 2435439 - protein, 11 aa, Entamoeba dispar
KFEDDDDDDMT

SEQ ID NO: 2435440 - protein, 13 aa, Entamoeba dispar
KFEDENPKTTKMG

SEQ ID NO: 2435441 - protein, 7 aa, Entamoeba dispar
KFEDEQH

SEQ ID NO: 2435442 - protein, 14 aa, Entamoeba dispar
KFEEKDKYHSSEEL

SEQ ID NO: 2435443 - protein, 14 aa, Entamoeba dispar
KFEERKTKLRSEGI

SEQ ID NO: 2435444 - protein, 4 aa, Entamoeba dispar
KFEG

SEQ ID NO: 2435445 - protein, 6 aa, Entamoeba dispar
KFEGVR

SEQ ID NO: 2435446 - protein, 13 aa, Entamoeba dispar
KFEKEQLKKQHKL

SEQ ID NO: 2435447 - protein, 12 aa, Entamoeba dispar
KFEKTQSRVEEL

SEQ ID NO: 2435448 - protein, 15 aa, Entamoeba dispar
KFEKTQSRVEELGYT

SEQ ID NO: 2435449 - protein, 5 aa, Entamoeba dispar
KFENQ

SEQ ID NO: 2435450 - protein, 4 aa, Entamoeba dispar
KFEP

SEQ ID NO: 2435451 - protein, 6 aa, Entamoeba dispar
KFEPDY

SEQ ID NO: 2435452 - protein, 10 aa, Entamoeba dispar
KFEPNQTQRC

SEQ ID NO: 2435453 - protein, 4 aa, Entamoeba dispar
KFEQ

SEQ ID NO: 2435454 - protein, 12 aa, Entamoeba dispar
KFEQKENTMEIT

SEQ ID NO: 2435455 - protein, 11 aa, Entamoeba dispar
KFERPKLQKYE

SEQ ID NO: 2435456 - protein, 4 aa, Entamoeba dispar
KFET

SEQ ID NO: 2435457 - protein, 10 aa, Entamoeba dispar
KFETAAQDEL

SEQ ID NO: 2435458 - protein, 5 aa, Entamoeba dispar
KFETK

SEQ ID NO: 2435459 - protein, 10 aa, Entamoeba dispar
KFETKNTTYQ

SEQ ID NO: 2435460 - protein, 6 aa, Entamoeba dispar
KFETPT

SEQ ID NO: 2435461 - protein, 7 aa, Entamoeba dispar
KFEYPNE

SEQ ID NO: 2435462 - protein, 15 aa, Entamoeba dispar
KFGAGKKVVDSQRSR

SEQ ID NO: 2435463 - protein, 6 aa, Entamoeba dispar
KFGDDH

SEQ ID NO: 2435464 - protein, 5 aa, Entamoeba dispar
KFGDK

SEQ ID NO: 2435465 - protein, 8 aa, Entamoeba dispar
KFGDTIEQ

SEQ ID NO: 2435466 - protein, 12 aa, Entamoeba dispar
KFGEGSQHKKYA

SEQ ID NO: 2435467 - protein, 14 aa, Entamoeba dispar
KFGEKIPRPLDGPE

SEQ ID NO: 2435468 - protein, 6 aa, Entamoeba dispar
KFGERD

SEQ ID NO: 2435469 - protein, 17 aa, Entamoeba dispar
KFGLRGQKKLCPDCVTK

SEQ ID NO: 2435470 - protein, 5 aa, Entamoeba dispar
KFGNS

SEQ ID NO: 2435471 - protein, 7 aa, Entamoeba dispar
KFGNSGL

SEQ ID NO: 2435472 - protein, 6 aa, Entamoeba dispar
KFHSNE

SEQ ID NO: 2435473 - protein, 6 aa, Entamoeba dispar
KFHSTK

SEQ ID NO: 2435474 - protein, 15 aa, Entamoeba dispar
KFIDEQSEISERDQA

SEQ ID NO: 2435475 - protein, 6 aa, Entamoeba dispar
KFIEKG

SEQ ID NO: 2435476 - protein, 5 aa, Entamoeba dispar
KFIGG

SEQ ID NO: 2435477 - protein, 17 aa, Entamoeba dispar
KFISPEPSLTTPSNLTD

SEQ ID NO: 2435478 - protein, 7 aa, Entamoeba dispar
KFKDELR

SEQ ID NO: 2435479 - protein, 12 aa, Entamoeba dispar
KFKEAKKDKGLK

SEQ ID NO: 2435480 - protein, 8 aa, Entamoeba dispar
KFKGKPEK

SEQ ID NO: 2435481 - protein, 5 aa, Entamoeba dispar
KFKNN

SEQ ID NO: 2435482 - protein, 8 aa, Entamoeba dispar
KFKNTEKY

SEQ ID NO: 2435483 - protein, 4 aa, Entamoeba dispar
KFKQ

SEQ ID NO: 2435484 - protein, 11 aa, Entamoeba dispar
KFKSTQSNISI

SEQ ID NO: 2435485 - protein, 17 aa, Entamoeba dispar
KFLEDSKTCIKSKNEFD

SEQ ID NO: 2435486 - protein, 5 aa, Entamoeba dispar
KFNDT

SEQ ID NO: 2435487 - protein, 13 aa, Entamoeba dispar
KFNEGDDDRDDLN

SEQ ID NO: 2435488 - protein, 6 aa, Entamoeba dispar
KFNKGG

SEQ ID NO: 2435489 - protein, 10 aa, Entamoeba dispar
KFNPEVSNEQ

SEQ ID NO: 2435490 - protein, 10 aa, Entamoeba dispar
KFNPQKEQVD

SEQ ID NO: 2435491 - protein, 13 aa, Entamoeba dispar
KFNRKDRTNTGDM

SEQ ID NO: 2435492 - protein, 8 aa, Entamoeba dispar
KFNTNTER

SEQ ID NO: 2435493 - protein, 18 aa, Entamoeba dispar
KFNTSDEVSSVNNAYEKC

SEQ ID NO: 2435494 - protein, 6 aa, Entamoeba dispar
KFPENK

SEQ ID NO: 2435495 - protein, 7 aa, Entamoeba dispar
KFPETTK

SEQ ID NO: 2435496 - protein, 10 aa, Entamoeba dispar
KFPIGTEGRY

SEQ ID NO: 2435497 - protein, 9 aa, Entamoeba dispar
KFPKGIDEQ

SEQ ID NO: 2435498 - protein, 7 aa, Entamoeba dispar
KFPKGMR

SEQ ID NO: 2435499 - protein, 11 aa, Entamoeba dispar
KFPKNNQARQY

SEQ ID NO: 2435500 - protein, 16 aa, Entamoeba dispar
KFPKQSRNEVKFSPNN

SEQ ID NO: 2435501 - protein, 6 aa, Entamoeba dispar
KFPNED

SEQ ID NO: 2435502 - protein, 8 aa, Entamoeba dispar
KFPNEPTS

SEQ ID NO: 2435503 - protein, 6 aa, Entamoeba dispar
KFPPLT

SEQ ID NO: 2435504 - protein, 7 aa, Entamoeba dispar
KFPPNPK

SEQ ID NO: 2435505 - protein, 5 aa, Entamoeba dispar
KFPPV

SEQ ID NO: 2435506 - protein, 6 aa, Entamoeba dispar
KFPQNE

SEQ ID NO: 2435507 - protein, 15 aa, Entamoeba dispar
KFQAKTFKGSIDTTK

SEQ ID NO: 2435508 - protein, 6 aa, Entamoeba dispar
KFQDEL

SEQ ID NO: 2435509 - protein, 8 aa, Entamoeba dispar
KFQSDNNE

SEQ ID NO: 2435510 - protein, 7 aa, Entamoeba dispar
KFQTCEN

SEQ ID NO: 2435511 - protein, 6 aa, Entamoeba dispar
KFQTNV

SEQ ID NO: 2435512 - protein, 9 aa, Entamoeba dispar
KFRNHADTV

SEQ ID NO: 2435513 - protein, 10 aa, Entamoeba dispar
KFRNSVKNSM

SEQ ID NO: 2435514 - protein, 11 aa, Entamoeba dispar
KFSEDVSSTIG

SEQ ID NO: 2435515 - protein, 8 aa, Entamoeba dispar
KFSKENRT

SEQ ID NO: 2435516 - protein, 12 aa, Entamoeba dispar
KFSNASTKTEQL

SEQ ID NO: 2435517 - protein, 27 aa, Entamoeba dispar
KFSNSKNTLLPNTNDNLTRNTCHKRNK

SEQ ID NO: 2435518 - protein, 8 aa, Entamoeba dispar
KFSNYETD

SEQ ID NO: 2435519 - protein, 5 aa, Entamoeba dispar
KFSQE

SEQ ID NO: 2435520 - protein, 5 aa, Entamoeba dispar
KFSQI

SEQ ID NO: 2435521 - protein, 7 aa, Entamoeba dispar
KFSQNPQ

SEQ ID NO: 2435522 - protein, 14 aa, Entamoeba dispar
KFSSRHGQKGTVGM

SEQ ID NO: 2435523 - protein, 5 aa, Entamoeba dispar
KFTDN

SEQ ID NO: 2435524 - protein, 6 aa, Entamoeba dispar
KFTEKA

SEQ ID NO: 2435525 - protein, 8 aa, Entamoeba dispar
KFTEQQKT

SEQ ID NO: 2435526 - protein, 10 aa, Entamoeba dispar
KFTKKGRKIA

SEQ ID NO: 2435527 - protein, 6 aa, Entamoeba dispar
KFTKTD

SEQ ID NO: 2435528 - protein, 7 aa, Entamoeba dispar
KFTNPNA

SEQ ID NO: 2435529 - protein, 6 aa, Entamoeba dispar
KFTQQE

SEQ ID NO: 2435530 - protein, 5 aa, Entamoeba dispar
KFTRE

SEQ ID NO: 2435531 - protein, 9 aa, Entamoeba dispar
KFTRRSAGL

SEQ ID NO: 2435532 - protein, 5 aa, Entamoeba dispar
KFTST

SEQ ID NO: 2435533 - protein, 5 aa, Entamoeba dispar
KFTTE

SEQ ID NO: 2435534 - protein, 8 aa, Entamoeba dispar
KFYQPDSD

SEQ ID NO: 2435535 - protein, 11 aa, Entamoeba dispar
KFYTPKKNQMK

SEQ ID NO: 2435536 - protein, 5 aa, Entamoeba dispar
KFYYN

SEQ ID NO: 2435537 - protein, 16 aa, Entamoeba dispar
KGAANVKRQCNHPPTM

SEQ ID NO: 2435538 - protein, 7 aa, Entamoeba dispar
KGADFPP

SEQ ID NO: 2435539 - protein, 8 aa, Entamoeba dispar
KGAEKAVE

SEQ ID NO: 2435540 - protein, 6 aa, Entamoeba dispar
KGAFTN

SEQ ID NO: 2435541 - protein, 18 aa, Entamoeba dispar
KGAGMFKGDPSNKEDLKQ

SEQ ID NO: 2435542 - protein, 6 aa, Entamoeba dispar
KGAITE

SEQ ID NO: 2435543 - protein, 48 aa, Entamoeba dispar
KGALDAAYEPEDVKEQKRIEKEKKEKEEREKKEKEEELKRVEEEKNRV

SEQ ID NO: 2435544 - protein, 6 aa, Entamoeba dispar
KGALLS

SEQ ID NO: 2435545 - protein, 14 aa, Entamoeba dispar
KGAPYPPECLDPKD

SEQ ID NO: 2435546 - protein, 6 aa, Entamoeba dispar
KGASLD

SEQ ID NO: 2435547 - protein, 8 aa, Entamoeba dispar
KGATPKHS

SEQ ID NO: 2435548 - protein, 7 aa, Entamoeba dispar
KGATRAF

SEQ ID NO: 2435549 - protein, 6 aa, Entamoeba dispar
KGAYPF

SEQ ID NO: 2435550 - protein, 4 aa, Entamoeba dispar
KGCD

SEQ ID NO: 2435551 - protein, 22 aa, Entamoeba dispar
KGCEIPNKKKEFKKEEKFEERQ

SEQ ID NO: 2435552 - protein, 5 aa, Entamoeba dispar
KGCNT

SEQ ID NO: 2435553 - protein, 9 aa, Entamoeba dispar
KGCVNNEKN

SEQ ID NO: 2435554 - protein, 19 aa, Entamoeba dispar
KGDAPLKTENGNILDQSEE

SEQ ID NO: 2435555 - protein, 7 aa, Entamoeba dispar
KGDDDKY

SEQ ID NO: 2435556 - protein, 13 aa, Entamoeba dispar
KGDDELDDINIDD

SEQ ID NO: 2435557 - protein, 6 aa, Entamoeba dispar
KGDDLR

SEQ ID NO: 2435558 - protein, 17 aa, Entamoeba dispar
KGDDVGFGPNKRGKGTY

SEQ ID NO: 2435559 - protein, 7 aa, Entamoeba dispar
KGDEIKS

SEQ ID NO: 2435560 - protein, 18 aa, Entamoeba dispar
KGDESDVTLNNTNKDKTN

SEQ ID NO: 2435561 - protein, 7 aa, Entamoeba dispar
KGDGKGT

SEQ ID NO: 2435562 - protein, 6 aa, Entamoeba dispar
KGDHDF

SEQ ID NO: 2435563 - protein, 7 aa, Entamoeba dispar
KGDIKRI

SEQ ID NO: 2435564 - protein, 7 aa, Entamoeba dispar
KGDKKKE

SEQ ID NO: 2435565 - protein, 8 aa, Entamoeba dispar
KGDKSTKR

SEQ ID NO: 2435566 - protein, 5 aa, Entamoeba dispar
KGDNE

SEQ ID NO: 2435567 - protein, 5 aa, Entamoeba dispar
KGDNG

SEQ ID NO: 2435568 - protein, 9 aa, Entamoeba dispar
KGDNNVSNK

SEQ ID NO: 2435569 - protein, 14 aa, Entamoeba dispar
KGDNTKSSSDRSIP

SEQ ID NO: 2435570 - protein, 12 aa, Entamoeba dispar
KGDPSNKEDLKQ

SEQ ID NO: 2435571 - protein, 9 aa, Entamoeba dispar
KGDQADSIQ

SEQ ID NO: 2435572 - protein, 9 aa, Entamoeba dispar
KGDTQRDRS

SEQ ID NO: 2435573 - protein, 6 aa, Entamoeba dispar
KGDTYI

SEQ ID NO: 2435574 - protein, 16 aa, Entamoeba dispar
KGDVQQVKENTNNTYY

SEQ ID NO: 2435575 - protein, 5 aa, Entamoeba dispar
KGEAI

SEQ ID NO: 2435576 - protein, 16 aa, Entamoeba dispar
KGEDAIEYQKENQNKC

SEQ ID NO: 2435577 - protein, 5 aa, Entamoeba dispar
KGEDN

SEQ ID NO: 2435578 - protein, 14 aa, Entamoeba dispar
KGEDNRPKASKEDM

SEQ ID NO: 2435579 - protein, 4 aa, Entamoeba dispar
KGEE

SEQ ID NO: 2435580 - protein, 10 aa, Entamoeba dispar
KGEEDKESSL

SEQ ID NO: 2435581 - protein, 12 aa, Entamoeba dispar
KGEEEISSEERL

SEQ ID NO: 2435582 - protein, 7 aa, Entamoeba dispar
KGEEEKK

SEQ ID NO: 2435583 - protein, 29 aa, Entamoeba dispar
KGEEEKNNGEGIEKGIEETKESNNKSNEI

SEQ ID NO: 2435584 - protein, 9 aa, Entamoeba dispar
KGEEETEWS

SEQ ID NO: 2435585 - protein, 5 aa, Entamoeba dispar
KGEEG

SEQ ID NO: 2435586 - protein, 6 aa, Entamoeba dispar
KGEEIN

SEQ ID NO: 2435587 - protein, 5 aa, Entamoeba dispar
KGEEK

SEQ ID NO: 2435588 - protein, 6 aa, Entamoeba dispar
KGEEKR

SEQ ID NO: 2435589 - protein, 14 aa, Entamoeba dispar
KGEESDYDDDGCVV

SEQ ID NO: 2435590 - protein, 9 aa, Entamoeba dispar
KGEEVDNIQ

SEQ ID NO: 2435591 - protein, 16 aa, Entamoeba dispar
KGEGGIKRKKNDFEEP

SEQ ID NO: 2435592 - protein, 12 aa, Entamoeba dispar
KGEGKKTNEEGM

SEQ ID NO: 2435593 - protein, 7 aa, Entamoeba dispar
KGEIEKQ

SEQ ID NO: 2435594 - protein, 5 aa, Entamoeba dispar
KGEIN

SEQ ID NO: 2435595 - protein, 9 aa, Entamoeba dispar
KGEITKENP

SEQ ID NO: 2435596 - protein, 21 aa, Entamoeba dispar
KGEIVAKGRNHTKEFQDGTQH

SEQ ID NO: 2435597 - protein, 13 aa, Entamoeba dispar
KGEIVGREKEYEE

SEQ ID NO: 2435598 - protein, 8 aa, Entamoeba dispar
KGEKEETI

SEQ ID NO: 2435599 - protein, 7 aa, Entamoeba dispar
KGEKEIK

SEQ ID NO: 2435600 - protein, 6 aa, Entamoeba dispar
KGEKTE

SEQ ID NO: 2435601 - protein, 20 aa, Entamoeba dispar
KGELPPIDLPNPKRKDMKTT

SEQ ID NO: 2435602 - protein, 6 aa, Entamoeba dispar
KGELSG

SEQ ID NO: 2435603 - protein, 8 aa, Entamoeba dispar
KGEMKPSL

SEQ ID NO: 2435604 - protein, 16 aa, Entamoeba dispar
KGENDSDGISSTSLRE

SEQ ID NO: 2435605 - protein, 8 aa, Entamoeba dispar
KGENEKKE

SEQ ID NO: 2435606 - protein, 10 aa, Entamoeba dispar
KGENKKPKEI

SEQ ID NO: 2435607 - protein, 18 aa, Entamoeba dispar
KGENLGNGESRNEGENEW

SEQ ID NO: 2435608 - protein, 19 aa, Entamoeba dispar
KGENPTTNIDSTSDFLTST

SEQ ID NO: 2435609 - protein, 5 aa, Entamoeba dispar
KGENS

SEQ ID NO: 2435610 - protein, 9 aa, Entamoeba dispar
KGENTTENI

SEQ ID NO: 2435611 - protein, 4 aa, Entamoeba dispar
KGEP

SEQ ID NO: 2435612 - protein, 5 aa, Entamoeba dispar
KGEPI

SEQ ID NO: 2435613 - protein, 10 aa, Entamoeba dispar
KGEPKSSEVR

SEQ ID NO: 2435614 - protein, 14 aa, Entamoeba dispar
KGEQLSYKEPTEIE

SEQ ID NO: 2435615 - protein, 10 aa, Entamoeba dispar
KGEQSGLVPT

SEQ ID NO: 2435616 - protein, 5 aa, Entamoeba dispar
KGERV

SEQ ID NO: 2435617 - protein, 6 aa, Entamoeba dispar
KGERYY

SEQ ID NO: 2435618 - protein, 19 aa, Entamoeba dispar
KGESLQSKAECSRFLVLSC

SEQ ID NO: 2435619 - protein, 8 aa, Entamoeba dispar
KGESTTVG

SEQ ID NO: 2435620 - protein, 8 aa, Entamoeba dispar
KGETPNVT

SEQ ID NO: 2435621 - protein, 7 aa, Entamoeba dispar
KGETTEG

SEQ ID NO: 2435622 - protein, 5 aa, Entamoeba dispar
KGEVT

SEQ ID NO: 2435623 - protein, 7 aa, Entamoeba dispar
KGEWYEE

SEQ ID NO: 2435624 - protein, 8 aa, Entamoeba dispar
KGEYQLSA

SEQ ID NO: 2435625 - protein, 7 aa, Entamoeba dispar
KGEYSGI

SEQ ID NO: 2435626 - protein, 8 aa, Entamoeba dispar
KGFDSGNI

SEQ ID NO: 2435627 - protein, 7 aa, Entamoeba dispar
KGFEELN

SEQ ID NO: 2435628 - protein, 12 aa, Entamoeba dispar
KGFENEESDEHS

SEQ ID NO: 2435629 - protein, 7 aa, Entamoeba dispar
KGFINEK

SEQ ID NO: 2435630 - protein, 4 aa, Entamoeba dispar
KGFN

SEQ ID NO: 2435631 - protein, 6 aa, Entamoeba dispar
KGFNEK

SEQ ID NO: 2435632 - protein, 7 aa, Entamoeba dispar
KGFNEKV

SEQ ID NO: 2435633 - protein, 13 aa, Entamoeba dispar
KGFNENKIEEETN

SEQ ID NO: 2435634 - protein, 9 aa, Entamoeba dispar
KGFPEKEAK

SEQ ID NO: 2435635 - protein, 22 aa, Entamoeba dispar
KGFPSPQKKYQSTKKPEIASKE

SEQ ID NO: 2435636 - protein, 6 aa, Entamoeba dispar
KGFPVE

SEQ ID NO: 2435637 - protein, 5 aa, Entamoeba dispar
KGFRA

SEQ ID NO: 2435638 - protein, 30 aa, Entamoeba dispar
KGFRSSYKKPSSGFSSPIAYSPRGEDIQGE

SEQ ID NO: 2435639 - protein, 4 aa, Entamoeba dispar
KGFS

SEQ ID NO: 2435640 - protein, 7 aa, Entamoeba dispar
KGFSGIE

SEQ ID NO: 2435641 - protein, 31 aa, Entamoeba dispar
KGFSTTVPSIKNYEGRLETPSLIQKNHANDG

SEQ ID NO: 2435642 - protein, 5 aa, Entamoeba dispar
KGFTP

SEQ ID NO: 2435643 - protein, 5 aa, Entamoeba dispar
KGGAT

SEQ ID NO: 2435644 - protein, 5 aa, Entamoeba dispar
KGGCG

SEQ ID NO: 2435645 - protein, 7 aa, Entamoeba dispar
KGGDDGV

SEQ ID NO: 2435646 - protein, 12 aa, Entamoeba dispar
KGGEGKAKSFQE

SEQ ID NO: 2435647 - protein, 25 aa, Entamoeba dispar
KGGENSLSGSFSTATFQSETGETID

SEQ ID NO: 2435648 - protein, 6 aa, Entamoeba dispar
KGGFGD

SEQ ID NO: 2435649 - protein, 4 aa, Entamoeba dispar
KGGG

SEQ ID NO: 2435650 - protein, 13 aa, Entamoeba dispar
KGGGQIVDPPEPN

SEQ ID NO: 2435651 - protein, 14 aa, Entamoeba dispar
KGGHSGAEIQHQRA

SEQ ID NO: 2435652 - protein, 7 aa, Entamoeba dispar
KGGHSLS

SEQ ID NO: 2435653 - protein, 5 aa, Entamoeba dispar
KGGKG

SEQ ID NO: 2435654 - protein, 11 aa, Entamoeba dispar
KGGKMTIPKPS

SEQ ID NO: 2435655 - protein, 4 aa, Entamoeba dispar
KGGL

SEQ ID NO: 2435656 - protein, 5 aa, Entamoeba dispar
KGGLE

SEQ ID NO: 2435657 - protein, 4 aa, Entamoeba dispar
KGGN

SEQ ID NO: 2435658 - protein, 6 aa, Entamoeba dispar
KGGNEW

SEQ ID NO: 2435659 - protein, 8 aa, Entamoeba dispar
KGGNGNSQ

SEQ ID NO: 2435660 - protein, 12 aa, Entamoeba dispar
KGGNPEKTGLKT

SEQ ID NO: 2435661 - protein, 12 aa, Entamoeba dispar
KGGPQTKMEEGE

SEQ ID NO: 2435662 - protein, 5 aa, Entamoeba dispar
KGGRS

SEQ ID NO: 2435663 - protein, 5 aa, Entamoeba dispar
KGGSI

SEQ ID NO: 2435664 - protein, 12 aa, Entamoeba dispar
KGGSIGFPVFQA

SEQ ID NO: 2435665 - protein, 8 aa, Entamoeba dispar
KGGSQDCY

SEQ ID NO: 2435666 - protein, 7 aa, Entamoeba dispar
KGGSVRL

SEQ ID NO: 2435667 - protein, 10 aa, Entamoeba dispar
KGGTKEDGYV

SEQ ID NO: 2435668 - protein, 6 aa, Entamoeba dispar
KGGVVP

SEQ ID NO: 2435669 - protein, 6 aa, Entamoeba dispar
KGHLKP

SEQ ID NO: 2435670 - protein, 8 aa, Entamoeba dispar
KGHNPEKA

SEQ ID NO: 2435671 - protein, 4 aa, Entamoeba dispar
KGHY

SEQ ID NO: 2435672 - protein, 8 aa, Entamoeba dispar
KGIAPTKK

SEQ ID NO: 2435673 - protein, 11 aa, Entamoeba dispar
KGIDKERKGSE

SEQ ID NO: 2435674 - protein, 14 aa, Entamoeba dispar
KGIDPVNPAQSSSI

SEQ ID NO: 2435675 - protein, 6 aa, Entamoeba dispar
KGIDTK

SEQ ID NO: 2435676 - protein, 4 aa, Entamoeba dispar
KGIE

SEQ ID NO: 2435677 - protein, 9 aa, Entamoeba dispar
KGIEEKREA

SEQ ID NO: 2435678 - protein, 6 aa, Entamoeba dispar
KGIENT

SEQ ID NO: 2435679 - protein, 10 aa, Entamoeba dispar
KGIETDNSPI

SEQ ID NO: 2435680 - protein, 13 aa, Entamoeba dispar
KGIETKYGKKYPE

SEQ ID NO: 2435681 - protein, 8 aa, Entamoeba dispar
KGIGEGRK

SEQ ID NO: 2435682 - protein, 6 aa, Entamoeba dispar
KGIGKG

SEQ ID NO: 2435683 - protein, 8 aa, Entamoeba dispar
KGIGSPKY

SEQ ID NO: 2435684 - protein, 4 aa, Entamoeba dispar
KGII

SEQ ID NO: 2435685 - protein, 8 aa, Entamoeba dispar
KGIKENYQ

SEQ ID NO: 2435686 - protein, 8 aa, Entamoeba dispar
KGIKKASD

SEQ ID NO: 2435687 - protein, 16 aa, Entamoeba dispar
KGIKKTKKSGKVWNQE

SEQ ID NO: 2435688 - protein, 31 aa, Entamoeba dispar
KGIKSESKQESSKKSGKKDTSKKEKKGACVL

SEQ ID NO: 2435689 - protein, 6 aa, Entamoeba dispar
KGIKTI

SEQ ID NO: 2435690 - protein, 25 aa, Entamoeba dispar
KGIKTTIKTPISGKVSATYQSYNNT

SEQ ID NO: 2435691 - protein, 6 aa, Entamoeba dispar
KGILTD

SEQ ID NO: 2435692 - protein, 4 aa, Entamoeba dispar
KGIN

SEQ ID NO: 2435693 - protein, 6 aa, Entamoeba dispar
KGINEI

SEQ ID NO: 2435694 - protein, 13 aa, Entamoeba dispar
KGINENKEKEIEE

SEQ ID NO: 2435695 - protein, 5 aa, Entamoeba dispar
KGINI

SEQ ID NO: 2435696 - protein, 10 aa, Entamoeba dispar
KGINKENEKI

SEQ ID NO: 2435697 - protein, 12 aa, Entamoeba dispar
KGINTKASTRLP

SEQ ID NO: 2435698 - protein, 4 aa, Entamoeba dispar
KGIP

SEQ ID NO: 2435699 - protein, 7 aa, Entamoeba dispar
KGIPDKV

SEQ ID NO: 2435700 - protein, 6 aa, Entamoeba dispar
KGIPED

SEQ ID NO: 2435701 - protein, 6 aa, Entamoeba dispar
KGIPIE

SEQ ID NO: 2435702 - protein, 22 aa, Entamoeba dispar
KGIPIKKTSIEDKIENKKKLNY

SEQ ID NO: 2435703 - protein, 10 aa, Entamoeba dispar
KGIPPLEGTW

SEQ ID NO: 2435704 - protein, 7 aa, Entamoeba dispar
KGIQSSD

SEQ ID NO: 2435705 - protein, 8 aa, Entamoeba dispar
KGISEEEI

SEQ ID NO: 2435706 - protein, 8 aa, Entamoeba dispar
KGISEEEK

SEQ ID NO: 2435707 - protein, 6 aa, Entamoeba dispar
KGISGN

SEQ ID NO: 2435708 - protein, 9 aa, Entamoeba dispar
KGISKDATT

SEQ ID NO: 2435709 - protein, 6 aa, Entamoeba dispar
KGISKG

SEQ ID NO: 2435710 - protein, 7 aa, Entamoeba dispar
KGISNSE

SEQ ID NO: 2435711 - protein, 6 aa, Entamoeba dispar
KGISST

SEQ ID NO: 2435712 - protein, 8 aa, Entamoeba dispar
KGISVSSG

SEQ ID NO: 2435713 - protein, 5 aa, Entamoeba dispar
KGITG

SEQ ID NO: 2435714 - protein, 5 aa, Entamoeba dispar
KGITT

SEQ ID NO: 2435715 - protein, 7 aa, Entamoeba dispar
KGITVQK

SEQ ID NO: 2435716 - protein, 6 aa, Entamoeba dispar
KGKCKN

SEQ ID NO: 2435717 - protein, 4 aa, Entamoeba dispar
KGKD

SEQ ID NO: 2435718 - protein, 8 aa, Entamoeba dispar
KGKDDISE

SEQ ID NO: 2435719 - protein, 8 aa, Entamoeba dispar
KGKDNGSA

SEQ ID NO: 2435720 - protein, 9 aa, Entamoeba dispar
KGKDNGSAY

SEQ ID NO: 2435721 - protein, 8 aa, Entamoeba dispar
KGKDQETF

SEQ ID NO: 2435722 - protein, 8 aa, Entamoeba dispar
KGKDTCEE

SEQ ID NO: 2435723 - protein, 7 aa, Entamoeba dispar
KGKDYEV

SEQ ID NO: 2435724 - protein, 11 aa, Entamoeba dispar
KGKEAGTSPGY

SEQ ID NO: 2435725 - protein, 7 aa, Entamoeba dispar
KGKEGIF

SEQ ID NO: 2435726 - protein, 13 aa, Entamoeba dispar
KGKEIEEEEIKGK

SEQ ID NO: 2435727 - protein, 15 aa, Entamoeba dispar
KGKEKREKGSEPFGD

SEQ ID NO: 2435728 - protein, 11 aa, Entamoeba dispar
KGKEPTKSSDI

SEQ ID NO: 2435729 - protein, 8 aa, Entamoeba dispar
KGKESNRI

SEQ ID NO: 2435730 - protein, 8 aa, Entamoeba dispar
KGKESQLR

SEQ ID NO: 2435731 - protein, 28 aa, Entamoeba dispar
KGKEYKKEIEEYTNKIEELNKKNEELNE

SEQ ID NO: 2435732 - protein, 7 aa, Entamoeba dispar
KGKGEAR

SEQ ID NO: 2435733 - protein, 7 aa, Entamoeba dispar
KGKGEQR

SEQ ID NO: 2435734 - protein, 12 aa, Entamoeba dispar
KGKGESKDDPIE

SEQ ID NO: 2435735 - protein, 45 aa, Entamoeba dispar
KGKGKEIDEYTNAENKAKRDKKGVYCDTPEKVSIKKPTDPKLTTK

SEQ ID NO: 2435736 - protein, 5 aa, Entamoeba dispar
KGKGL

SEQ ID NO: 2435737 - protein, 15 aa, Entamoeba dispar
KGKGMFKGDPTLKED

SEQ ID NO: 2435738 - protein, 22 aa, Entamoeba dispar
KGKGRKDGDYDGKTYEEKMQQS

SEQ ID NO: 2435739 - protein, 7 aa, Entamoeba dispar
KGKHTNK

SEQ ID NO: 2435740 - protein, 5 aa, Entamoeba dispar
KGKIE

SEQ ID NO: 2435741 - protein, 6 aa, Entamoeba dispar
KGKIEN

SEQ ID NO: 2435742 - protein, 21 aa, Entamoeba dispar
KGKIYSSSTTYPRKYSTEKCD

SEQ ID NO: 2435743 - protein, 18 aa, Entamoeba dispar
KGKKERRRESVDYTNNKW

SEQ ID NO: 2435744 - protein, 15 aa, Entamoeba dispar
KGKKMADLTGHDASI

SEQ ID NO: 2435745 - protein, 11 aa, Entamoeba dispar
KGKKVDKNTQI

SEQ ID NO: 2435746 - protein, 5 aa, Entamoeba dispar
KGKKY

SEQ ID NO: 2435747 - protein, 4 aa, Entamoeba dispar
KGKM

SEQ ID NO: 2435748 - protein, 6 aa, Entamoeba dispar
KGKMEE

SEQ ID NO: 2435749 - protein, 6 aa, Entamoeba dispar
KGKNPV

SEQ ID NO: 2435750 - protein, 4 aa, Entamoeba dispar
KGKP

SEQ ID NO: 2435751 - protein, 8 aa, Entamoeba dispar
KGKPAPDI

SEQ ID NO: 2435752 - protein, 13 aa, Entamoeba dispar
KGKPKEINLRSSP

SEQ ID NO: 2435753 - protein, 10 aa, Entamoeba dispar
KGKPLEVNDD

SEQ ID NO: 2435754 - protein, 15 aa, Entamoeba dispar
KGKPLSQVAEEKGQM

SEQ ID NO: 2435755 - protein, 16 aa, Entamoeba dispar
KGKPLSQVAEEKGQME

SEQ ID NO: 2435756 - protein, 6 aa, Entamoeba dispar
KGKPQV

SEQ ID NO: 2435757 - protein, 7 aa, Entamoeba dispar
KGKPSVV

SEQ ID NO: 2435758 - protein, 6 aa, Entamoeba dispar
KGKQTI

SEQ ID NO: 2435759 - protein, 8 aa, Entamoeba dispar
KGKRQRDF

SEQ ID NO: 2435760 - protein, 4 aa, Entamoeba dispar
KGKS

SEQ ID NO: 2435761 - protein, 8 aa, Entamoeba dispar
KGKSKEEA

SEQ ID NO: 2435762 - protein, 5 aa, Entamoeba dispar
KGKSN

SEQ ID NO: 2435763 - protein, 9 aa, Entamoeba dispar
KGKSYDSKE

SEQ ID NO: 2435764 - protein, 9 aa, Entamoeba dispar
KGKTAKGMV

SEQ ID NO: 2435765 - protein, 6 aa, Entamoeba dispar
KGKTLK

SEQ ID NO: 2435766 - protein, 8 aa, Entamoeba dispar
KGKTPELQ

SEQ ID NO: 2435767 - protein, 7 aa, Entamoeba dispar
KGKTPMD

SEQ ID NO: 2435768 - protein, 8 aa, Entamoeba dispar
KGKTSLGD

SEQ ID NO: 2435769 - protein, 6 aa, Entamoeba dispar
KGKTVG

SEQ ID NO: 2435770 - protein, 7 aa, Entamoeba dispar
KGKTYQL

SEQ ID NO: 2435771 - protein, 14 aa, Entamoeba dispar
KGLADRQTSSKFSS

SEQ ID NO: 2435772 - protein, 8 aa, Entamoeba dispar
KGLDSKEI

SEQ ID NO: 2435773 - protein, 25 aa, Entamoeba dispar
KGLDTFDDTTKTEKRQKSRKTMTPA

SEQ ID NO: 2435774 - protein, 19 aa, Entamoeba dispar
KGLEDKKGKKYKEKIATSK

SEQ ID NO: 2435775 - protein, 5 aa, Entamoeba dispar
KGLEH

SEQ ID NO: 2435776 - protein, 11 aa, Entamoeba dispar
KGLEKSEEELN

SEQ ID NO: 2435777 - protein, 19 aa, Entamoeba dispar
KGLEPNTNTHNNSDKPLQE

SEQ ID NO: 2435778 - protein, 4 aa, Entamoeba dispar
KGLL

SEQ ID NO: 2435779 - protein, 4 aa, Entamoeba dispar
KGLP

SEQ ID NO: 2435780 - protein, 7 aa, Entamoeba dispar
KGLPPQQ

SEQ ID NO: 2435781 - protein, 32 aa, Entamoeba dispar
KGLPRSPRIANTHSSRLPKETPKLNENHQPHD

SEQ ID NO: 2435782 - protein, 6 aa, Entamoeba dispar
KGLPTV

SEQ ID NO: 2435783 - protein, 7 aa, Entamoeba dispar
KGLQESL

SEQ ID NO: 2435784 - protein, 12 aa, Entamoeba dispar
KGLSSAGTNSTK

SEQ ID NO: 2435785 - protein, 7 aa, Entamoeba dispar
KGLTEDT

SEQ ID NO: 2435786 - protein, 33 aa, Entamoeba dispar
KGLTEKWEKESQERHAEMSKDFDEKTIKEIENT

SEQ ID NO: 2435787 - protein, 7 aa, Entamoeba dispar
KGLTENT

SEQ ID NO: 2435788 - protein, 5 aa, Entamoeba dispar
KGMEA

SEQ ID NO: 2435789 - protein, 14 aa, Entamoeba dispar
KGMGSENMKNYGNA

SEQ ID NO: 2435790 - protein, 7 aa, Entamoeba dispar
KGMKEEE

SEQ ID NO: 2435791 - protein, 17 aa, Entamoeba dispar
KGMKRDSAIRRYEKNRR

SEQ ID NO: 2435792 - protein, 6 aa, Entamoeba dispar
KGMKRN

SEQ ID NO: 2435793 - protein, 9 aa, Entamoeba dispar
KGNAEHSGV

SEQ ID NO: 2435794 - protein, 10 aa, Entamoeba dispar
KGNAKKDSTI

SEQ ID NO: 2435795 - protein, 20 aa, Entamoeba dispar
KGNATKTRKKQLSLLFESLE

SEQ ID NO: 2435796 - protein, 14 aa, Entamoeba dispar
KGNCNQQPNPSTCS

SEQ ID NO: 2435797 - protein, 5 aa, Entamoeba dispar
KGNDD

SEQ ID NO: 2435798 - protein, 5 aa, Entamoeba dispar
KGNDI

SEQ ID NO: 2435799 - protein, 11 aa, Entamoeba dispar
KGNDVKNEDLD

SEQ ID NO: 2435800 - protein, 4 aa, Entamoeba dispar
KGNE

SEQ ID NO: 2435801 - protein, 8 aa, Entamoeba dispar
KGNEEEAL

SEQ ID NO: 2435802 - protein, 8 aa, Entamoeba dispar
KGNEEIKI

SEQ ID NO: 2435803 - protein, 18 aa, Entamoeba dispar
KGNETIEKEGVSEPSGQI

SEQ ID NO: 2435804 - protein, 7 aa, Entamoeba dispar
KGNGIGE

SEQ ID NO: 2435805 - protein, 9 aa, Entamoeba dispar
KGNINQERE

SEQ ID NO: 2435806 - protein, 5 aa, Entamoeba dispar
KGNKE

SEQ ID NO: 2435807 - protein, 8 aa, Entamoeba dispar
KGNKENKL

SEQ ID NO: 2435808 - protein, 8 aa, Entamoeba dispar
KGNKEYSS

SEQ ID NO: 2435809 - protein, 7 aa, Entamoeba dispar
KGNKIGE

SEQ ID NO: 2435810 - protein, 8 aa, Entamoeba dispar
KGNKPSSV

SEQ ID NO: 2435811 - protein, 17 aa, Entamoeba dispar
KGNKSRYKQDNRRAKEW

SEQ ID NO: 2435812 - protein, 4 aa, Entamoeba dispar
KGNL

SEQ ID NO: 2435813 - protein, 7 aa, Entamoeba dispar
KGNNEDY

SEQ ID NO: 2435814 - protein, 8 aa, Entamoeba dispar
KGNNLNDS

SEQ ID NO: 2435815 - protein, 8 aa, Entamoeba dispar
KGNNQEYA

SEQ ID NO: 2435816 - protein, 8 aa, Entamoeba dispar
KGNPEITK

SEQ ID NO: 2435817 - protein, 10 aa, Entamoeba dispar
KGNPIATHPE

SEQ ID NO: 2435818 - protein, 7 aa, Entamoeba dispar
KGNPNAE

SEQ ID NO: 2435819 - protein, 7 aa, Entamoeba dispar
KGNQINV

SEQ ID NO: 2435820 - protein, 7 aa, Entamoeba dispar
KGNQSTI

SEQ ID NO: 2435821 - protein, 4 aa, Entamoeba dispar
KGNR

SEQ ID NO: 2435822 - protein, 7 aa, Entamoeba dispar
KGNRETM

SEQ ID NO: 2435823 - protein, 7 aa, Entamoeba dispar
KGNSKIV

SEQ ID NO: 2435824 - protein, 6 aa, Entamoeba dispar
KGNSNI

SEQ ID NO: 2435825 - protein, 4 aa, Entamoeba dispar
KGNT

SEQ ID NO: 2435826 - protein, 5 aa, Entamoeba dispar
KGNTD

SEQ ID NO: 2435827 - protein, 4 aa, Entamoeba dispar
KGNV

SEQ ID NO: 2435828 - protein, 5 aa, Entamoeba dispar
KGNVF

SEQ ID NO: 2435829 - protein, 15 aa, Entamoeba dispar
KGNVRDISIDGRRDI

SEQ ID NO: 2435830 - protein, 14 aa, Entamoeba dispar
KGNYDARIEGGQSL

SEQ ID NO: 2435831 - protein, 27 aa, Entamoeba dispar
KGNYDEGFGYSKHSADWEKKDEEHHVE

SEQ ID NO: 2435832 - protein, 7 aa, Entamoeba dispar
KGNYKDI

SEQ ID NO: 2435833 - protein, 11 aa, Entamoeba dispar
KGNYSTNPNIK

SEQ ID NO: 2435834 - protein, 13 aa, Entamoeba dispar
KGPEQTYKNEKAK

SEQ ID NO: 2435835 - protein, 4 aa, Entamoeba dispar
KGPH

SEQ ID NO: 2435836 - protein, 5 aa, Entamoeba dispar
KGPIN

SEQ ID NO: 2435837 - protein, 7 aa, Entamoeba dispar
KGPIQQM

SEQ ID NO: 2435838 - protein, 8 aa, Entamoeba dispar
KGPKAKTC

SEQ ID NO: 2435839 - protein, 8 aa, Entamoeba dispar
KGPKKNSL

SEQ ID NO: 2435840 - protein, 4 aa, Entamoeba dispar
KGPL

SEQ ID NO: 2435841 - protein, 4 aa, Entamoeba dispar
KGPM

SEQ ID NO: 2435842 - protein, 6 aa, Entamoeba dispar
KGPSRL

SEQ ID NO: 2435843 - protein, 8 aa, Entamoeba dispar
KGPTKNYR

SEQ ID NO: 2435844 - protein, 8 aa, Entamoeba dispar
KGPTMNSD

SEQ ID NO: 2435845 - protein, 7 aa, Entamoeba dispar
KGPVPSY

SEQ ID NO: 2435846 - protein, 9 aa, Entamoeba dispar
KGQADRAYA

SEQ ID NO: 2435847 - protein, 6 aa, Entamoeba dispar
KGQAKA

SEQ ID NO: 2435848 - protein, 6 aa, Entamoeba dispar
KGQESI

SEQ ID NO: 2435849 - protein, 9 aa, Entamoeba dispar
KGQHYANRS

SEQ ID NO: 2435850 - protein, 10 aa, Entamoeba dispar
KGQKKRFGYS

SEQ ID NO: 2435851 - protein, 7 aa, Entamoeba dispar
KGQKKTV

SEQ ID NO: 2435852 - protein, 14 aa, Entamoeba dispar
KGQMEREKEIREYE

SEQ ID NO: 2435853 - protein, 7 aa, Entamoeba dispar
KGQPESV

SEQ ID NO: 2435854 - protein, 16 aa, Entamoeba dispar
KGQPNEEEEKTNDGHI

SEQ ID NO: 2435855 - protein, 6 aa, Entamoeba dispar
KGQPPY

SEQ ID NO: 2435856 - protein, 7 aa, Entamoeba dispar
KGQQIEG

SEQ ID NO: 2435857 - protein, 20 aa, Entamoeba dispar
KGQSIKHENEPKDKRSTKNR

SEQ ID NO: 2435858 - protein, 8 aa, Entamoeba dispar
KGQTPTLQ

SEQ ID NO: 2435859 - protein, 22 aa, Entamoeba dispar
KGQTTEQEMYDNTEDNNISNEY

SEQ ID NO: 2435860 - protein, 8 aa, Entamoeba dispar
KGRDNGSA

SEQ ID NO: 2435861 - protein, 6 aa, Entamoeba dispar
KGRGCI

SEQ ID NO: 2435862 - protein, 6 aa, Entamoeba dispar
KGRGRC

SEQ ID NO: 2435863 - protein, 6 aa, Entamoeba dispar
KGRIPA

SEQ ID NO: 2435864 - protein, 6 aa, Entamoeba dispar
KGRIQG

SEQ ID NO: 2435865 - protein, 8 aa, Entamoeba dispar
KGRKEGQK

SEQ ID NO: 2435866 - protein, 13 aa, Entamoeba dispar
KGRKKDKKQEIER

SEQ ID NO: 2435867 - protein, 7 aa, Entamoeba dispar
KGRKKEI

SEQ ID NO: 2435868 - protein, 7 aa, Entamoeba dispar
KGRKRTY

SEQ ID NO: 2435869 - protein, 16 aa, Entamoeba dispar
KGRNQEEQNNENKQNN

SEQ ID NO: 2435870 - protein, 7 aa, Entamoeba dispar
KGRPILP

SEQ ID NO: 2435871 - protein, 4 aa, Entamoeba dispar
KGRS

SEQ ID NO: 2435872 - protein, 9 aa, Entamoeba dispar
KGRSPNDVK

SEQ ID NO: 2435873 - protein, 10 aa, Entamoeba dispar
KGRTANAVRN

SEQ ID NO: 2435874 - protein, 42 aa, Entamoeba dispar
KGRTEESFKPKRLGGTIERRRGEDKRRNESPIRRDRGYSPFE

SEQ ID NO: 2435875 - protein, 5 aa, Entamoeba dispar
KGRTI

SEQ ID NO: 2435876 - protein, 7 aa, Entamoeba dispar
KGRVNEK

SEQ ID NO: 2435877 - protein, 9 aa, Entamoeba dispar
KGRYKGKTK

SEQ ID NO: 2435878 - protein, 4 aa, Entamoeba dispar
KGSA

SEQ ID NO: 2435879 - protein, 4 aa, Entamoeba dispar
KGSD

SEQ ID NO: 2435880 - protein, 8 aa, Entamoeba dispar
KGSDDLDE

SEQ ID NO: 2435881 - protein, 5 aa, Entamoeba dispar
KGSDI

SEQ ID NO: 2435882 - protein, 6 aa, Entamoeba dispar
KGSDNS

SEQ ID NO: 2435883 - protein, 6 aa, Entamoeba dispar
KGSDQS

SEQ ID NO: 2435884 - protein, 6 aa, Entamoeba dispar
KGSETK

SEQ ID NO: 2435885 - protein, 4 aa, Entamoeba dispar
KGSF

SEQ ID NO: 2435886 - protein, 9 aa, Entamoeba dispar
KGSGGVENV

SEQ ID NO: 2435887 - protein, 15 aa, Entamoeba dispar
KGSGNNKTLKDGTKK

SEQ ID NO: 2435888 - protein, 5 aa, Entamoeba dispar
KGSHV

SEQ ID NO: 2435889 - protein, 10 aa, Entamoeba dispar
KGSISSKEIN

SEQ ID NO: 2435890 - protein, 8 aa, Entamoeba dispar
KGSKDITK

SEQ ID NO: 2435891 - protein, 11 aa, Entamoeba dispar
KGSKDNRKHFD

SEQ ID NO: 2435892 - protein, 9 aa, Entamoeba dispar
KGSKEENAN

SEQ ID NO: 2435893 - protein, 11 aa, Entamoeba dispar
KGSKIGKQNEY

SEQ ID NO: 2435894 - protein, 8 aa, Entamoeba dispar
KGSKSDFD

SEQ ID NO: 2435895 - protein, 9 aa, Entamoeba dispar
KGSNEENKL

SEQ ID NO: 2435896 - protein, 6 aa, Entamoeba dispar
KGSNEV

SEQ ID NO: 2435897 - protein, 7 aa, Entamoeba dispar
KGSPFTS

SEQ ID NO: 2435898 - protein, 15 aa, Entamoeba dispar
KGSPNDEMDAKAEEL

SEQ ID NO: 2435899 - protein, 7 aa, Entamoeba dispar
KGSPTID

SEQ ID NO: 2435900 - protein, 8 aa, Entamoeba dispar
KGSQGPLP

SEQ ID NO: 2435901 - protein, 9 aa, Entamoeba dispar
KGSRDLANK

SEQ ID NO: 2435902 - protein, 5 aa, Entamoeba dispar
KGSRI

SEQ ID NO: 2435903 - protein, 7 aa, Entamoeba dispar
KGSSPLN

SEQ ID NO: 2435904 - protein, 17 aa, Entamoeba dispar
KGSTPKHEEEVKENTQL

SEQ ID NO: 2435905 - protein, 7 aa, Entamoeba dispar
KGSTTVT

SEQ ID NO: 2435906 - protein, 17 aa, Entamoeba dispar
KGSTVSQNNDWYSKEKK

SEQ ID NO: 2435907 - protein, 13 aa, Entamoeba dispar
KGSVRKDGISDHS

SEQ ID NO: 2435908 - protein, 8 aa, Entamoeba dispar
KGSVTNEG

SEQ ID NO: 2435909 - protein, 10 aa, Entamoeba dispar
KGSYKKGSGK

SEQ ID NO: 2435910 - protein, 4 aa, Entamoeba dispar
KGTA

SEQ ID NO: 2435911 - protein, 14 aa, Entamoeba dispar
KGTAEPSKESNENC

SEQ ID NO: 2435912 - protein, 5 aa, Entamoeba dispar
KGTAG

SEQ ID NO: 2435913 - protein, 8 aa, Entamoeba dispar
KGTAISGG

SEQ ID NO: 2435914 - protein, 8 aa, Entamoeba dispar
KGTAKNEF

SEQ ID NO: 2435915 - protein, 4 aa, Entamoeba dispar
KGTD

SEQ ID NO: 2435916 - protein, 14 aa, Entamoeba dispar
KGTDPFPKTTTESM

SEQ ID NO: 2435917 - protein, 5 aa, Entamoeba dispar
KGTEE

SEQ ID NO: 2435918 - protein, 6 aa, Entamoeba dispar
KGTEEV

SEQ ID NO: 2435919 - protein, 6 aa, Entamoeba dispar
KGTEEY

SEQ ID NO: 2435920 - protein, 8 aa, Entamoeba dispar
KGTENEQR

SEQ ID NO: 2435921 - protein, 7 aa, Entamoeba dispar
KGTFEDN

SEQ ID NO: 2435922 - protein, 40 aa, Entamoeba dispar
KGTFEQKTEIEEQGKTKQLNMDEENNDCAKNEVVKENGPK

SEQ ID NO: 2435923 - protein, 4 aa, Entamoeba dispar
KGTG

SEQ ID NO: 2435924 - protein, 7 aa, Entamoeba dispar
KGTGENI

SEQ ID NO: 2435925 - protein, 6 aa, Entamoeba dispar
KGTGKF

SEQ ID NO: 2435926 - protein, 13 aa, Entamoeba dispar
KGTGPLYTSYCDA

SEQ ID NO: 2435927 - protein, 17 aa, Entamoeba dispar
KGTGRGLDEIRGGTIGK

SEQ ID NO: 2435928 - protein, 19 aa, Entamoeba dispar
KGTIRYEEEERKVISKDGR

SEQ ID NO: 2435929 - protein, 5 aa, Entamoeba dispar
KGTIT

SEQ ID NO: 2435930 - protein, 13 aa, Entamoeba dispar
KGTKAPQAAGTIH

SEQ ID NO: 2435931 - protein, 17 aa, Entamoeba dispar
KGTKEITNIGKEYLDFQ

SEQ ID NO: 2435932 - protein, 6 aa, Entamoeba dispar
KGTKEY

SEQ ID NO: 2435933 - protein, 20 aa, Entamoeba dispar
KGTKSEQNTKDTNESKEDLH

SEQ ID NO: 2435934 - protein, 8 aa, Entamoeba dispar
KGTKSNPI

SEQ ID NO: 2435935 - protein, 7 aa, Entamoeba dispar
KGTKTEK

SEQ ID NO: 2435936 - protein, 7 aa, Entamoeba dispar
KGTKTPM

SEQ ID NO: 2435937 - protein, 14 aa, Entamoeba dispar
KGTNGDTMLGGEDF

SEQ ID NO: 2435938 - protein, 7 aa, Entamoeba dispar
KGTNGYT

SEQ ID NO: 2435939 - protein, 7 aa, Entamoeba dispar
KGTNKEY

SEQ ID NO: 2435940 - protein, 10 aa, Entamoeba dispar
KGTNNYINDG

SEQ ID NO: 2435941 - protein, 5 aa, Entamoeba dispar
KGTPI

SEQ ID NO: 2435942 - protein, 13 aa, Entamoeba dispar
KGTPSPSSTPQIQ

SEQ ID NO: 2435943 - protein, 4 aa, Entamoeba dispar
KGTQ

SEQ ID NO: 2435944 - protein, 5 aa, Entamoeba dispar
KGTRK

SEQ ID NO: 2435945 - protein, 6 aa, Entamoeba dispar
KGTSSI

SEQ ID NO: 2435946 - protein, 8 aa, Entamoeba dispar
KGTTEINN

SEQ ID NO: 2435947 - protein, 5 aa, Entamoeba dispar
KGTTH

SEQ ID NO: 2435948 - protein, 7 aa, Entamoeba dispar
KGTTPSQ

SEQ ID NO: 2435949 - protein, 5 aa, Entamoeba dispar
KGTTR

SEQ ID NO: 2435950 - protein, 7 aa, Entamoeba dispar
KGTTTAV

SEQ ID NO: 2435951 - protein, 7 aa, Entamoeba dispar
KGTVEYQ

SEQ ID NO: 2435952 - protein, 5 aa, Entamoeba dispar
KGTYF

SEQ ID NO: 2435953 - protein, 5 aa, Entamoeba dispar
KGTYK

SEQ ID NO: 2435954 - protein, 11 aa, Entamoeba dispar
KGVAASVDAEL

SEQ ID NO: 2435955 - protein, 8 aa, Entamoeba dispar
KGVAHSKI

SEQ ID NO: 2435956 - protein, 8 aa, Entamoeba dispar
KGVANHST

SEQ ID NO: 2435957 - protein, 4 aa, Entamoeba dispar
KGVE

SEQ ID NO: 2435958 - protein, 9 aa, Entamoeba dispar
KGVEYESKE

SEQ ID NO: 2435959 - protein, 16 aa, Entamoeba dispar
KGVKFTKSKSERKGNA

SEQ ID NO: 2435960 - protein, 42 aa, Entamoeba dispar
KGVKSLKGKSVSQLAKGARSAVKSFTKKATSNDVKNNVAKEV

SEQ ID NO: 2435961 - protein, 9 aa, Entamoeba dispar
KGVNKSDHH

SEQ ID NO: 2435962 - protein, 9 aa, Entamoeba dispar
KGVNPESKH

SEQ ID NO: 2435963 - protein, 5 aa, Entamoeba dispar
KGVPD

SEQ ID NO: 2435964 - protein, 14 aa, Entamoeba dispar
KGVPEETSNFNESN

SEQ ID NO: 2435965 - protein, 6 aa, Entamoeba dispar
KGVPEG

SEQ ID NO: 2435966 - protein, 6 aa, Entamoeba dispar
KGVPKD

SEQ ID NO: 2435967 - protein, 27 aa, Entamoeba dispar
KGVPKTELNRKVRNEADKKTEPKEPSS

SEQ ID NO: 2435968 - protein, 8 aa, Entamoeba dispar
KGVPPEAN

SEQ ID NO: 2435969 - protein, 11 aa, Entamoeba dispar
KGVPPITTGSW

SEQ ID NO: 2435970 - protein, 5 aa, Entamoeba dispar
KGVQG

SEQ ID NO: 2435971 - protein, 7 aa, Entamoeba dispar
KGVSDVK

SEQ ID NO: 2435972 - protein, 8 aa, Entamoeba dispar
KGVTSSLQ

SEQ ID NO: 2435973 - protein, 4 aa, Entamoeba dispar
KGVV

SEQ ID NO: 2435974 - protein, 5 aa, Entamoeba dispar
KGWYP

SEQ ID NO: 2435975 - protein, 13 aa, Entamoeba dispar
KGYAQSLKRKEIH

SEQ ID NO: 2435976 - protein, 13 aa, Entamoeba dispar
KGYDTDPSAIARN

SEQ ID NO: 2435977 - protein, 6 aa, Entamoeba dispar
KGYEEE

SEQ ID NO: 2435978 - protein, 10 aa, Entamoeba dispar
KGYEKLKQAN

SEQ ID NO: 2435979 - protein, 5 aa, Entamoeba dispar
KGYEV

SEQ ID NO: 2435980 - protein, 14 aa, Entamoeba dispar
KGYGETKTIKESYE

SEQ ID NO: 2435981 - protein, 4 aa, Entamoeba dispar
KGYH

SEQ ID NO: 2435982 - protein, 16 aa, Entamoeba dispar
KGYIKDNTTNNYSSLT

SEQ ID NO: 2435983 - protein, 4 aa, Entamoeba dispar
KGYK

SEQ ID NO: 2435984 - protein, 11 aa, Entamoeba dispar
KGYKGDINGAI

SEQ ID NO: 2435985 - protein, 7 aa, Entamoeba dispar
KGYKKRE

SEQ ID NO: 2435986 - protein, 7 aa, Entamoeba dispar
KGYKKRT

SEQ ID NO: 2435987 - protein, 11 aa, Entamoeba dispar
KGYKPNKIENN

SEQ ID NO: 2435988 - protein, 6 aa, Entamoeba dispar
KGYNED

SEQ ID NO: 2435989 - protein, 5 aa, Entamoeba dispar
KGYPN

SEQ ID NO: 2435990 - protein, 10 aa, Entamoeba dispar
KGYQESTKLT

SEQ ID NO: 2435991 - protein, 7 aa, Entamoeba dispar
KGYQQGM

SEQ ID NO: 2435992 - protein, 19 aa, Entamoeba dispar
KGYRNRKRALSQRAEAASI

SEQ ID NO: 2435993 - protein, 4 aa, Entamoeba dispar
KGYS

SEQ ID NO: 2435994 - protein, 7 aa, Entamoeba dispar
KGYSADA

SEQ ID NO: 2435995 - protein, 7 aa, Entamoeba dispar
KGYSGAE

SEQ ID NO: 2435996 - protein, 5 aa, Entamoeba dispar
KGYTK

SEQ ID NO: 2435997 - protein, 13 aa, Entamoeba dispar
KGYTKQGDNSGDD

SEQ ID NO: 2435998 - protein, 8 aa, Entamoeba dispar
KGYYNKGG

SEQ ID NO: 2435999 - protein, 21 aa, Entamoeba dispar
KHAGKEMTLSRNDPELSQIFR

SEQ ID NO: 2436000 - protein, 6 aa, Entamoeba dispar
KHANRT

SEQ ID NO: 2436001 - protein, 8 aa, Entamoeba dispar
KHAPITKE

SEQ ID NO: 2436002 - protein, 9 aa, Entamoeba dispar
KHARGGLRS

SEQ ID NO: 2436003 - protein, 17 aa, Entamoeba dispar
KHASEEKKEKKTEKTNR

SEQ ID NO: 2436004 - protein, 18 aa, Entamoeba dispar
KHDGSTSGLINLIKDMRK

SEQ ID NO: 2436005 - protein, 16 aa, Entamoeba dispar
KHDIKEDIKQWLEMPL

SEQ ID NO: 2436006 - protein, 10 aa, Entamoeba dispar
KHDLRDVNNA

SEQ ID NO: 2436007 - protein, 9 aa, Entamoeba dispar
KHDNQTEKF

SEQ ID NO: 2436008 - protein, 12 aa, Entamoeba dispar
KHDPTKDFTDAE

SEQ ID NO: 2436009 - protein, 10 aa, Entamoeba dispar
KHDSVAAPPG

SEQ ID NO: 2436010 - protein, 15 aa, Entamoeba dispar
KHEASSPLIELSKPA

SEQ ID NO: 2436011 - protein, 13 aa, Entamoeba dispar
KHEEERRRKKEEI

SEQ ID NO: 2436012 - protein, 7 aa, Entamoeba dispar
KHEIGRG

SEQ ID NO: 2436013 - protein, 28 aa, Entamoeba dispar
KHEKEEEEDDEQTNEGVVETKENPFDKR

SEQ ID NO: 2436014 - protein, 5 aa, Entamoeba dispar
KHENN

SEQ ID NO: 2436015 - protein, 8 aa, Entamoeba dispar
KHEQEERE

SEQ ID NO: 2436016 - protein, 7 aa, Entamoeba dispar
KHEQPDD

SEQ ID NO: 2436017 - protein, 7 aa, Entamoeba dispar
KHESATS

SEQ ID NO: 2436018 - protein, 5 aa, Entamoeba dispar
KHFTA

SEQ ID NO: 2436019 - protein, 9 aa, Entamoeba dispar
KHGETEESV

SEQ ID NO: 2436020 - protein, 5 aa, Entamoeba dispar
KHGEV

SEQ ID NO: 2436021 - protein, 5 aa, Entamoeba dispar
KHGGY

SEQ ID NO: 2436022 - protein, 4 aa, Entamoeba dispar
KHGK

SEQ ID NO: 2436023 - protein, 8 aa, Entamoeba dispar
KHGKYKED

SEQ ID NO: 2436024 - protein, 7 aa, Entamoeba dispar
KHGLDEL

SEQ ID NO: 2436025 - protein, 7 aa, Entamoeba dispar
KHGNEMK

SEQ ID NO: 2436026 - protein, 11 aa, Entamoeba dispar
KHGPNSGSSIK

SEQ ID NO: 2436027 - protein, 11 aa, Entamoeba dispar
KHGSEVPEYVP

SEQ ID NO: 2436028 - protein, 14 aa, Entamoeba dispar
KHGYDVKKRGTRGS

SEQ ID NO: 2436029 - protein, 7 aa, Entamoeba dispar
KHHGDEV

SEQ ID NO: 2436030 - protein, 8 aa, Entamoeba dispar
KHHHKDKK

SEQ ID NO: 2436031 - protein, 22 aa, Entamoeba dispar
KHHNDNKQKHQSKKEKQEGKVE

SEQ ID NO: 2436032 - protein, 8 aa, Entamoeba dispar
KHHSQNKS

SEQ ID NO: 2436033 - protein, 7 aa, Entamoeba dispar
KHIEAKD

SEQ ID NO: 2436034 - protein, 14 aa, Entamoeba dispar
KHIEKHNKYGKTIE

SEQ ID NO: 2436035 - protein, 10 aa, Entamoeba dispar
KHINEESTEA

SEQ ID NO: 2436036 - protein, 18 aa, Entamoeba dispar
KHKDGMSDEVSSEEKRRV

SEQ ID NO: 2436037 - protein, 6 aa, Entamoeba dispar
KHKEEY

SEQ ID NO: 2436038 - protein, 15 aa, Entamoeba dispar
KHKENREKKDSYATD

SEQ ID NO: 2436039 - protein, 5 aa, Entamoeba dispar
KHKES

SEQ ID NO: 2436040 - protein, 5 aa, Entamoeba dispar
KHKGK

SEQ ID NO: 2436041 - protein, 20 aa, Entamoeba dispar
KHKKKRQEIGARKDVDLEEG

SEQ ID NO: 2436042 - protein, 11 aa, Entamoeba dispar
KHKRETTSNKL

SEQ ID NO: 2436043 - protein, 19 aa, Entamoeba dispar
KHKSSETLIDEEEDSTTTV

SEQ ID NO: 2436044 - protein, 7 aa, Entamoeba dispar
KHKTNGK

SEQ ID NO: 2436045 - protein, 20 aa, Entamoeba dispar
KHLENDTKDKPKEMQKKEMN

SEQ ID NO: 2436046 - protein, 7 aa, Entamoeba dispar
KHNDDEQ

SEQ ID NO: 2436047 - protein, 7 aa, Entamoeba dispar
KHNRGSA

SEQ ID NO: 2436048 - protein, 7 aa, Entamoeba dispar
KHNSTLP

SEQ ID NO: 2436049 - protein, 7 aa, Entamoeba dispar
KHNVSPQ

SEQ ID NO: 2436050 - protein, 4 aa, Entamoeba dispar
KHPE

SEQ ID NO: 2436051 - protein, 15 aa, Entamoeba dispar
KHPGDSRKVMNEQER

SEQ ID NO: 2436052 - protein, 7 aa, Entamoeba dispar
KHPLPEQ

SEQ ID NO: 2436053 - protein, 7 aa, Entamoeba dispar
KHPNDNN

SEQ ID NO: 2436054 - protein, 16 aa, Entamoeba dispar
KHPNTLLSKSDKAEFH

SEQ ID NO: 2436055 - protein, 7 aa, Entamoeba dispar
KHPPSGL

SEQ ID NO: 2436056 - protein, 7 aa, Entamoeba dispar
KHPQLKA

SEQ ID NO: 2436057 - protein, 6 aa, Entamoeba dispar
KHPQSQ

SEQ ID NO: 2436058 - protein, 7 aa, Entamoeba dispar
KHPRTHE

SEQ ID NO: 2436059 - protein, 8 aa, Entamoeba dispar
KHPSPKIP

SEQ ID NO: 2436060 - protein, 6 aa, Entamoeba dispar
KHPYKQ

SEQ ID NO: 2436061 - protein, 5 aa, Entamoeba dispar
KHQGL

SEQ ID NO: 2436062 - protein, 7 aa, Entamoeba dispar
KHQKKNT

SEQ ID NO: 2436063 - protein, 13 aa, Entamoeba dispar
KHQQTENINQKEE

SEQ ID NO: 2436064 - protein, 4 aa, Entamoeba dispar
KHQS

SEQ ID NO: 2436065 - protein, 4 aa, Entamoeba dispar
KHQT

SEQ ID NO: 2436066 - protein, 5 aa, Entamoeba dispar
KHRDQ

SEQ ID NO: 2436067 - protein, 8 aa, Entamoeba dispar
KHRNTGGF

SEQ ID NO: 2436068 - protein, 9 aa, Entamoeba dispar
KHRSSDKIE

SEQ ID NO: 2436069 - protein, 10 aa, Entamoeba dispar
KHSDVEDHAR

SEQ ID NO: 2436070 - protein, 15 aa, Entamoeba dispar
KHSEEFGNKKNGKYF

SEQ ID NO: 2436071 - protein, 11 aa, Entamoeba dispar
KHSPNNEVEKQ

SEQ ID NO: 2436072 - protein, 25 aa, Entamoeba dispar
KHSPQRVGKDHHLDDEDVLQVMKVG

SEQ ID NO: 2436073 - protein, 7 aa, Entamoeba dispar
KHSSGSK

SEQ ID NO: 2436074 - protein, 8 aa, Entamoeba dispar
KHSSRQGF

SEQ ID NO: 2436075 - protein, 6 aa, Entamoeba dispar
KHTERM

SEQ ID NO: 2436076 - protein, 5 aa, Entamoeba dispar
KHTES

SEQ ID NO: 2436077 - protein, 6 aa, Entamoeba dispar
KHTHPI

SEQ ID NO: 2436078 - protein, 8 aa, Entamoeba dispar
KHTKQTYN

SEQ ID NO: 2436079 - protein, 6 aa, Entamoeba dispar
KHTNES

SEQ ID NO: 2436080 - protein, 9 aa, Entamoeba dispar
KHTNSQNES

SEQ ID NO: 2436081 - protein, 5 aa, Entamoeba dispar
KHTQK

SEQ ID NO: 2436082 - protein, 5 aa, Entamoeba dispar
KHTTE

SEQ ID NO: 2436083 - protein, 40 aa, Entamoeba dispar
KHTTHKVSQYKKGKDSLHVQGKRRYDRKQQGFGGQTKPVF

SEQ ID NO: 2436084 - protein, 7 aa, Entamoeba dispar
KHVSEKK

SEQ ID NO: 2436085 - protein, 7 aa, Entamoeba dispar
KHYEEAA

SEQ ID NO: 2436086 - protein, 8 aa, Entamoeba dispar
KHYKKEAD

SEQ ID NO: 2436087 - protein, 6 aa, Entamoeba dispar
KHYNDE

SEQ ID NO: 2436088 - protein, 11 aa, Entamoeba dispar
KIAADDKTTIE

SEQ ID NO: 2436089 - protein, 6 aa, Entamoeba dispar
KIAAEK

SEQ ID NO: 2436090 - protein, 9 aa, Entamoeba dispar
KIAATGTPM

SEQ ID NO: 2436091 - protein, 6 aa, Entamoeba dispar
KIAATK

SEQ ID NO: 2436092 - protein, 8 aa, Entamoeba dispar
KIADNKGS

SEQ ID NO: 2436093 - protein, 47 aa, Entamoeba dispar
KIAEPNPTTAPTTQKKEENKQEEQKKEENKQEKPKEDIKKEEPKEEH

SEQ ID NO: 2436094 - protein, 9 aa, Entamoeba dispar
KIAGKSVKT

SEQ ID NO: 2436095 - protein, 6 aa, Entamoeba dispar
KIAKPF

SEQ ID NO: 2436096 - protein, 5 aa, Entamoeba dispar
KIAPG

SEQ ID NO: 2436097 - protein, 13 aa, Entamoeba dispar
KIAPKEKGIVSKT

SEQ ID NO: 2436098 - protein, 7 aa, Entamoeba dispar
KIASEKG

SEQ ID NO: 2436099 - protein, 4 aa, Entamoeba dispar
KIAT

SEQ ID NO: 2436100 - protein, 35 aa, Entamoeba dispar
KIATQQKKEQLKQENEIKKEENKVEEELESASDPR

SEQ ID NO: 2436101 - protein, 8 aa, Entamoeba dispar
KIATRAKY

SEQ ID NO: 2436102 - protein, 5 aa, Entamoeba dispar
KIAYN

SEQ ID NO: 2436103 - protein, 9 aa, Entamoeba dispar
KICEEKKEN

SEQ ID NO: 2436104 - protein, 16 aa, Entamoeba dispar
KICGNSKYNRKGSPEL

SEQ ID NO: 2436105 - protein, 8 aa, Entamoeba dispar
KICGPSDA

SEQ ID NO: 2436106 - protein, 12 aa, Entamoeba dispar
KIDAPPTITKVP

SEQ ID NO: 2436107 - protein, 5 aa, Entamoeba dispar
KIDDK

SEQ ID NO: 2436108 - protein, 4 aa, Entamoeba dispar
KIDE

SEQ ID NO: 2436109 - protein, 13 aa, Entamoeba dispar
KIDEDENSVTTDE

SEQ ID NO: 2436110 - protein, 10 aa, Entamoeba dispar
KIDEDGKDVG

SEQ ID NO: 2436111 - protein, 14 aa, Entamoeba dispar
KIDEEKKPRKPETD

SEQ ID NO: 2436112 - protein, 5 aa, Entamoeba dispar
KIDKN

SEQ ID NO: 2436113 - protein, 4 aa, Entamoeba dispar
KIDN

SEQ ID NO: 2436114 - protein, 7 aa, Entamoeba dispar
KIDNNGT

SEQ ID NO: 2436115 - protein, 5 aa, Entamoeba dispar
KIDNQ

SEQ ID NO: 2436116 - protein, 5 aa, Entamoeba dispar
KIDNT

SEQ ID NO: 2436117 - protein, 4 aa, Entamoeba dispar
KIDQ

SEQ ID NO: 2436118 - protein, 12 aa, Entamoeba dispar
KIDSEDAVVTSE

SEQ ID NO: 2436119 - protein, 14 aa, Entamoeba dispar
KIDSENRTVTTDEM

SEQ ID NO: 2436120 - protein, 7 aa, Entamoeba dispar
KIDSGNC

SEQ ID NO: 2436121 - protein, 12 aa, Entamoeba dispar
KIDSPSKTKIDE

SEQ ID NO: 2436122 - protein, 12 aa, Entamoeba dispar
KIDSSETPISSK

SEQ ID NO: 2436123 - protein, 4 aa, Entamoeba dispar
KIDT

SEQ ID NO: 2436124 - protein, 8 aa, Entamoeba dispar
KIDTNKVN

SEQ ID NO: 2436125 - protein, 15 aa, Entamoeba dispar
KIEAKYDSNLKEENE

SEQ ID NO: 2436126 - protein, 6 aa, Entamoeba dispar
KIEDDA

SEQ ID NO: 2436127 - protein, 14 aa, Entamoeba dispar
KIEDDKPLIDETSS

SEQ ID NO: 2436128 - protein, 5 aa, Entamoeba dispar
KIEDE

SEQ ID NO: 2436129 - protein, 6 aa, Entamoeba dispar
KIEDHR

SEQ ID NO: 2436130 - protein, 6 aa, Entamoeba dispar
KIEDKK

SEQ ID NO: 2436131 - protein, 10 aa, Entamoeba dispar
KIEDKSEPLY

SEQ ID NO: 2436132 - protein, 7 aa, Entamoeba dispar
KIEDTYE

SEQ ID NO: 2436133 - protein, 4 aa, Entamoeba dispar
KIEE

SEQ ID NO: 2436134 - protein, 6 aa, Entamoeba dispar
KIEEDE

SEQ ID NO: 2436135 - protein, 10 aa, Entamoeba dispar
KIEEDGKECC

SEQ ID NO: 2436136 - protein, 21 aa, Entamoeba dispar
KIEEEENEAERKELERQEKEF

SEQ ID NO: 2436137 - protein, 9 aa, Entamoeba dispar
KIEEEKGKE

SEQ ID NO: 2436138 - protein, 11 aa, Entamoeba dispar
KIEEESTNQEA

SEQ ID NO: 2436139 - protein, 14 aa, Entamoeba dispar
KIEEETKEKEAVKA

SEQ ID NO: 2436140 - protein, 6 aa, Entamoeba dispar
KIEEIN

SEQ ID NO: 2436141 - protein, 9 aa, Entamoeba dispar
KIEEKESIE

SEQ ID NO: 2436142 - protein, 15 aa, Entamoeba dispar
KIEENNDSGDDEEEL

SEQ ID NO: 2436143 - protein, 4 aa, Entamoeba dispar
KIEG

SEQ ID NO: 2436144 - protein, 7 aa, Entamoeba dispar
KIEGKEE

SEQ ID NO: 2436145 - protein, 7 aa, Entamoeba dispar
KIEGNNF

SEQ ID NO: 2436146 - protein, 18 aa, Entamoeba dispar
KIEGSNQINDKQQESICQ

SEQ ID NO: 2436147 - protein, 5 aa, Entamoeba dispar
KIEIE

SEQ ID NO: 2436148 - protein, 8 aa, Entamoeba dispar
KIEIEETS

SEQ ID NO: 2436149 - protein, 26 aa, Entamoeba dispar
KIEKARKEKEEAERIAREKAEAERKA

SEQ ID NO: 2436150 - protein, 8 aa, Entamoeba dispar
KIEKERRL

SEQ ID NO: 2436151 - protein, 16 aa, Entamoeba dispar
KIEKPSNDKGPIGTQE

SEQ ID NO: 2436152 - protein, 18 aa, Entamoeba dispar
KIEKSQKKNYIESSLPQY

SEQ ID NO: 2436153 - protein, 10 aa, Entamoeba dispar
KIEKSTLQTI

SEQ ID NO: 2436154 - protein, 8 aa, Entamoeba dispar
KIELTSSS

SEQ ID NO: 2436155 - protein, 7 aa, Entamoeba dispar
KIEMQKK

SEQ ID NO: 2436156 - protein, 9 aa, Entamoeba dispar
KIENDNPSI

SEQ ID NO: 2436157 - protein, 14 aa, Entamoeba dispar
KIEPPLPSIPPPRR

SEQ ID NO: 2436158 - protein, 20 aa, Entamoeba dispar
KIEQENELLPNEPKPIEEEN

SEQ ID NO: 2436159 - protein, 6 aa, Entamoeba dispar
KIEQIQ

SEQ ID NO: 2436160 - protein, 12 aa, Entamoeba dispar
KIEQKKKNLIEQ

SEQ ID NO: 2436161 - protein, 18 aa, Entamoeba dispar
KIEREKDKRKKIEIKDEY

SEQ ID NO: 2436162 - protein, 29 aa, Entamoeba dispar
KIESDSDSENDEKEKKGKKIDKKKKVSNP

SEQ ID NO: 2436163 - protein, 7 aa, Entamoeba dispar
KIESEGF

SEQ ID NO: 2436164 - protein, 9 aa, Entamoeba dispar
KIESERQQL

SEQ ID NO: 2436165 - protein, 13 aa, Entamoeba dispar
KIESGGGTAYAIS

SEQ ID NO: 2436166 - protein, 5 aa, Entamoeba dispar
KIESQ

SEQ ID NO: 2436167 - protein, 9 aa, Entamoeba dispar
KIESQEVNN

SEQ ID NO: 2436168 - protein, 9 aa, Entamoeba dispar
KIESQEVNS

SEQ ID NO: 2436169 - protein, 12 aa, Entamoeba dispar
KIETEENEVVKE

SEQ ID NO: 2436170 - protein, 14 aa, Entamoeba dispar
KIETKGIKTSLSGF

SEQ ID NO: 2436171 - protein, 6 aa, Entamoeba dispar
KIETPN

SEQ ID NO: 2436172 - protein, 12 aa, Entamoeba dispar
KIETPRKRASVS

SEQ ID NO: 2436173 - protein, 4 aa, Entamoeba dispar
KIFD

SEQ ID NO: 2436174 - protein, 11 aa, Entamoeba dispar
KIFESEKTKQI

SEQ ID NO: 2436175 - protein, 4 aa, Entamoeba dispar
KIFK

SEQ ID NO: 2436176 - protein, 19 aa, Entamoeba dispar
KIFPPKPTLGYNSPSFKSN

SEQ ID NO: 2436177 - protein, 6 aa, Entamoeba dispar
KIGDAD

SEQ ID NO: 2436178 - protein, 11 aa, Entamoeba dispar
KIGDSSSNINN

SEQ ID NO: 2436179 - protein, 11 aa, Entamoeba dispar
KIGEDDPVEGL

SEQ ID NO: 2436180 - protein, 16 aa, Entamoeba dispar
KIGEETEHQIKKPVPA

SEQ ID NO: 2436181 - protein, 8 aa, Entamoeba dispar
KIGEGAAG

SEQ ID NO: 2436182 - protein, 19 aa, Entamoeba dispar
KIGEGASGEVFSAKRKADG

SEQ ID NO: 2436183 - protein, 7 aa, Entamoeba dispar
KIGEGGF

SEQ ID NO: 2436184 - protein, 8 aa, Entamoeba dispar
KIGEGGVG

SEQ ID NO: 2436185 - protein, 6 aa, Entamoeba dispar
KIGEMG

SEQ ID NO: 2436186 - protein, 6 aa, Entamoeba dispar
KIGIET

SEQ ID NO: 2436187 - protein, 14 aa, Entamoeba dispar
KIGKGKDKKYSNVE

SEQ ID NO: 2436188 - protein, 5 aa, Entamoeba dispar
KIGLT

SEQ ID NO: 2436189 - protein, 17 aa, Entamoeba dispar
KIGNADEKIRRESREQR

SEQ ID NO: 2436190 - protein, 6 aa, Entamoeba dispar
KIGNEC

SEQ ID NO: 2436191 - protein, 7 aa, Entamoeba dispar
KIGNKKI

SEQ ID NO: 2436192 - protein, 9 aa, Entamoeba dispar
KIGNTTTEG

SEQ ID NO: 2436193 - protein, 11 aa, Entamoeba dispar
KIGPSGSAYSI

SEQ ID NO: 2436194 - protein, 12 aa, Entamoeba dispar
KIGRKTFNENTQ

SEQ ID NO: 2436195 - protein, 4 aa, Entamoeba dispar
KIGS

SEQ ID NO: 2436196 - protein, 59 aa, Entamoeba dispar
KIGSASYNASYKKSIPHLPQTSFGSNASSERITTPEGSYTGSYDGSSHYSSHTKTPGIY

SEQ ID NO: 2436197 - protein, 11 aa, Entamoeba dispar
KIGSNSHDNAE

SEQ ID NO: 2436198 - protein, 6 aa, Entamoeba dispar
KIGSQE

SEQ ID NO: 2436199 - protein, 9 aa, Entamoeba dispar
KIGSRHNSS

SEQ ID NO: 2436200 - protein, 6 aa, Entamoeba dispar
KIGTLK

SEQ ID NO: 2436201 - protein, 4 aa, Entamoeba dispar
KIHH

SEQ ID NO: 2436202 - protein, 8 aa, Entamoeba dispar
KIHQEDEY

SEQ ID NO: 2436203 - protein, 12 aa, Entamoeba dispar
KIIDSGNDISFT

SEQ ID NO: 2436204 - protein, 10 aa, Entamoeba dispar
KIIGGSQQQT

SEQ ID NO: 2436205 - protein, 5 aa, Entamoeba dispar
KIIGN

SEQ ID NO: 2436206 - protein, 6 aa, Entamoeba dispar
KIIPGD

SEQ ID NO: 2436207 - protein, 12 aa, Entamoeba dispar
KIIQPEDRGVDK

SEQ ID NO: 2436208 - protein, 4 aa, Entamoeba dispar
KIKA

SEQ ID NO: 2436209 - protein, 9 aa, Entamoeba dispar
KIKANNQSI

SEQ ID NO: 2436210 - protein, 7 aa, Entamoeba dispar
KIKDEMN

SEQ ID NO: 2436211 - protein, 8 aa, Entamoeba dispar
KIKDEMSN

SEQ ID NO: 2436212 - protein, 6 aa, Entamoeba dispar
KIKDNK

SEQ ID NO: 2436213 - protein, 11 aa, Entamoeba dispar
KIKDTNQQQSL

SEQ ID NO: 2436214 - protein, 12 aa, Entamoeba dispar
KIKEAKKDKRMN

SEQ ID NO: 2436215 - protein, 5 aa, Entamoeba dispar
KIKED

SEQ ID NO: 2436216 - protein, 20 aa, Entamoeba dispar
KIKEEKQCINEESQSIKEEV

SEQ ID NO: 2436217 - protein, 6 aa, Entamoeba dispar
KIKEEN

SEQ ID NO: 2436218 - protein, 10 aa, Entamoeba dispar
KIKEGKEKIK

SEQ ID NO: 2436219 - protein, 12 aa, Entamoeba dispar
KIKEKRRNNPKL

SEQ ID NO: 2436220 - protein, 12 aa, Entamoeba dispar
KIKEKRRNNPQL

SEQ ID NO: 2436221 - protein, 19 aa, Entamoeba dispar
KIKELNEKETSKRKVKKPK

SEQ ID NO: 2436222 - protein, 12 aa, Entamoeba dispar
KIKENEAKSRAE

SEQ ID NO: 2436223 - protein, 12 aa, Entamoeba dispar
KIKESRKDKKMK

SEQ ID NO: 2436224 - protein, 12 aa, Entamoeba dispar
KIKESTRDPDAY

SEQ ID NO: 2436225 - protein, 4 aa, Entamoeba dispar
KIKG

SEQ ID NO: 2436226 - protein, 5 aa, Entamoeba dispar
KIKGK

SEQ ID NO: 2436227 - protein, 37 aa, Entamoeba dispar
KIKGKKDKDKKKFKQEDIDKAVEQALAEKKQKHHKKV

SEQ ID NO: 2436228 - protein, 9 aa, Entamoeba dispar
KIKGNEKRT

SEQ ID NO: 2436229 - protein, 7 aa, Entamoeba dispar
KIKGQIN

SEQ ID NO: 2436230 - protein, 13 aa, Entamoeba dispar
KIKKESNRYDSQK

SEQ ID NO: 2436231 - protein, 12 aa, Entamoeba dispar
KIKKGGIGTPEY

SEQ ID NO: 2436232 - protein, 9 aa, Entamoeba dispar
KIKKGMKEV

SEQ ID NO: 2436233 - protein, 10 aa, Entamoeba dispar
KIKKPKNEIS

SEQ ID NO: 2436234 - protein, 20 aa, Entamoeba dispar
KIKKSKKIDNSSSFQPPPIN

SEQ ID NO: 2436235 - protein, 31 aa, Entamoeba dispar
  misc_feature (30)..(31): Xaa can be any naturally occurring amino acid
KIKKSKKIDNSSSFQPPPINSALLDTTDEXX

SEQ ID NO: 2436236 - protein, 7 aa, Entamoeba dispar
KIKNGDD

SEQ ID NO: 2436237 - protein, 9 aa, Entamoeba dispar
KIKNPTNQD

SEQ ID NO: 2436238 - protein, 6 aa, Entamoeba dispar
KIKNQQ

SEQ ID NO: 2436239 - protein, 26 aa, Entamoeba dispar
KIKNQQSIIRSDGNQISNDKDKEDIE

SEQ ID NO: 2436240 - protein, 8 aa, Entamoeba dispar
KIKNTPPQ

SEQ ID NO: 2436241 - protein, 13 aa, Entamoeba dispar
KIKPLSNSAPQFQ

SEQ ID NO: 2436242 - protein, 12 aa, Entamoeba dispar
KIKPNSSSIEEK

SEQ ID NO: 2436243 - protein, 7 aa, Entamoeba dispar
KIKPPFV

SEQ ID NO: 2436244 - protein, 51 aa, Entamoeba dispar
KIKQEKEERSIKKKSLNSKNQEATKPKMEDDEHSKLKKKKRRFSEEETQNL

SEQ ID NO: 2436245 - protein, 8 aa, Entamoeba dispar
KIKQEPEF

SEQ ID NO: 2436246 - protein, 13 aa, Entamoeba dispar
KIKQGDSSLLKEN

SEQ ID NO: 2436247 - protein, 10 aa, Entamoeba dispar
KIKQKNSKSL

SEQ ID NO: 2436248 - protein, 10 aa, Entamoeba dispar
KIKQPEKQET

SEQ ID NO: 2436249 - protein, 9 aa, Entamoeba dispar
KIKRSNSAC

SEQ ID NO: 2436250 - protein, 18 aa, Entamoeba dispar
KIKRSTRKRKKTVTQTEK

SEQ ID NO: 2436251 - protein, 9 aa, Entamoeba dispar
KIKSDGIGK

SEQ ID NO: 2436252 - protein, 8 aa, Entamoeba dispar
KIKSEARL

SEQ ID NO: 2436253 - protein, 14 aa, Entamoeba dispar
KIKSEKDDIQKEKE

SEQ ID NO: 2436254 - protein, 10 aa, Entamoeba dispar
KIKSKNGKTF

SEQ ID NO: 2436255 - protein, 7 aa, Entamoeba dispar
KIKSLPK

SEQ ID NO: 2436256 - protein, 6 aa, Entamoeba dispar
KIKSSF

SEQ ID NO: 2436257 - protein, 35 aa, Entamoeba dispar
KIKSSQPQKPQGGLSSSDNVNVATASTQPTKKKGF

SEQ ID NO: 2436258 - protein, 12 aa, Entamoeba dispar
KIKSSSEDHRDP

SEQ ID NO: 2436259 - protein, 5 aa, Entamoeba dispar
KIKTE

SEQ ID NO: 2436260 - protein, 9 aa, Entamoeba dispar
KIKTETYSG

SEQ ID NO: 2436261 - protein, 29 aa, Entamoeba dispar
KIKTKLKKGTKEEIKKNIEPIRSSREKRL

SEQ ID NO: 2436262 - protein, 6 aa, Entamoeba dispar
KIKTNG

SEQ ID NO: 2436263 - protein, 6 aa, Entamoeba dispar
KIKTPT

SEQ ID NO: 2436264 - protein, 13 aa, Entamoeba dispar
KIKTQKQIESTSN

SEQ ID NO: 2436265 - protein, 5 aa, Entamoeba dispar
KIKTR

SEQ ID NO: 2436266 - protein, 9 aa, Entamoeba dispar
KILNQQTGV

SEQ ID NO: 2436267 - protein, 5 aa, Entamoeba dispar
KILSN

SEQ ID NO: 2436268 - protein, 17 aa, Entamoeba dispar
KILSNSSLSNDQKEETI

SEQ ID NO: 2436269 - protein, 4 aa, Entamoeba dispar
KINA

SEQ ID NO: 2436270 - protein, 11 aa, Entamoeba dispar
KINDKEKSSSW

SEQ ID NO: 2436271 - protein, 4 aa, Entamoeba dispar
KINE

SEQ ID NO: 2436272 - protein, 30 aa, Entamoeba dispar
KINEDENKKYKEETIKRREKKKEEAKKRKK

SEQ ID NO: 2436273 - protein, 11 aa, Entamoeba dispar
KINEDNKWIND

SEQ ID NO: 2436274 - protein, 17 aa, Entamoeba dispar
KINEKNKEQGITTTNKR

SEQ ID NO: 2436275 - protein, 5 aa, Entamoeba dispar
KINEP

SEQ ID NO: 2436276 - protein, 5 aa, Entamoeba dispar
KINEQ

SEQ ID NO: 2436277 - protein, 6 aa, Entamoeba dispar
KINESK

SEQ ID NO: 2436278 - protein, 10 aa, Entamoeba dispar
KINESQETSY

SEQ ID NO: 2436279 - protein, 5 aa, Entamoeba dispar
KINET

SEQ ID NO: 2436280 - protein, 6 aa, Entamoeba dispar
KINETR

SEQ ID NO: 2436281 - protein, 6 aa, Entamoeba dispar
KINGEM

SEQ ID NO: 2436282 - protein, 7 aa, Entamoeba dispar
KINGRSN

SEQ ID NO: 2436283 - protein, 8 aa, Entamoeba dispar
KINGTSDV

SEQ ID NO: 2436284 - protein, 7 aa, Entamoeba dispar
KINISQN

SEQ ID NO: 2436285 - protein, 9 aa, Entamoeba dispar
KINKEDNNY

SEQ ID NO: 2436286 - protein, 6 aa, Entamoeba dispar
KINKEE

SEQ ID NO: 2436287 - protein, 28 aa, Entamoeba dispar
KINKEENEIKQEEISYNNKNEEKDFSSK

SEQ ID NO: 2436288 - protein, 14 aa, Entamoeba dispar
KINKNKKEKKPRKD

SEQ ID NO: 2436289 - protein, 5 aa, Entamoeba dispar
KINNE

SEQ ID NO: 2436290 - protein, 11 aa, Entamoeba dispar
KINNEKNKKVI

SEQ ID NO: 2436291 - protein, 10 aa, Entamoeba dispar
KINNESNKSL

SEQ ID NO: 2436292 - protein, 11 aa, Entamoeba dispar
KINNKGKSQER

SEQ ID NO: 2436293 - protein, 12 aa, Entamoeba dispar
KINNKSQESDYL

SEQ ID NO: 2436294 - protein, 8 aa, Entamoeba dispar
KINNNQDF

SEQ ID NO: 2436295 - protein, 7 aa, Entamoeba dispar
KINNNQN

SEQ ID NO: 2436296 - protein, 5 aa, Entamoeba dispar
KINNQ

SEQ ID NO: 2436297 - protein, 10 aa, Entamoeba dispar
KINNQKKSIT

SEQ ID NO: 2436298 - protein, 7 aa, Entamoeba dispar
KINNSDF

SEQ ID NO: 2436299 - protein, 7 aa, Entamoeba dispar
KINPYTY

SEQ ID NO: 2436300 - protein, 5 aa, Entamoeba dispar
KINQD

SEQ ID NO: 2436301 - protein, 28 aa, Entamoeba dispar
KINQEEKENNDKIKEKRIEEAEAQAKVE

SEQ ID NO: 2436302 - protein, 17 aa, Entamoeba dispar
KINQEVSSTSPLPTPLP

SEQ ID NO: 2436303 - protein, 5 aa, Entamoeba dispar
KINRN

SEQ ID NO: 2436304 - protein, 6 aa, Entamoeba dispar
KINSER

SEQ ID NO: 2436305 - protein, 6 aa, Entamoeba dispar
KINSNI

SEQ ID NO: 2436306 - protein, 11 aa, Entamoeba dispar
KINSPDSRSCG

SEQ ID NO: 2436307 - protein, 19 aa, Entamoeba dispar
KINSTNNEQPQQQENQEDQ

SEQ ID NO: 2436308 - protein, 15 aa, Entamoeba dispar
KINSVDTKTNMKKDF

SEQ ID NO: 2436309 - protein, 9 aa, Entamoeba dispar
KINTKFQDE

SEQ ID NO: 2436310 - protein, 13 aa, Entamoeba dispar
KINTNNKQLKTET

SEQ ID NO: 2436311 - protein, 8 aa, Entamoeba dispar
KIPDSNEF

SEQ ID NO: 2436312 - protein, 18 aa, Entamoeba dispar
KIPEAGENGAEVKNDSKS

SEQ ID NO: 2436313 - protein, 11 aa, Entamoeba dispar
KIPEKRSRAAT

SEQ ID NO: 2436314 - protein, 12 aa, Entamoeba dispar
KIPEKTKTSFDS

SEQ ID NO: 2436315 - protein, 11 aa, Entamoeba dispar
KIPENTSVNPE

SEQ ID NO: 2436316 - protein, 11 aa, Entamoeba dispar
KIPGRAPPSVI

SEQ ID NO: 2436317 - protein, 4 aa, Entamoeba dispar
KIPI

SEQ ID NO: 2436318 - protein, 7 aa, Entamoeba dispar
KIPINET

SEQ ID NO: 2436319 - protein, 4 aa, Entamoeba dispar
KIPK

SEQ ID NO: 2436320 - protein, 20 aa, Entamoeba dispar
KIPKDEQESVEDQPETPDQQ

SEQ ID NO: 2436321 - protein, 22 aa, Entamoeba dispar
KIPKDEQESVEDQPETPDQQPT

SEQ ID NO: 2436322 - protein, 5 aa, Entamoeba dispar
KIPKE

SEQ ID NO: 2436323 - protein, 9 aa, Entamoeba dispar
KIPKLTNQN

SEQ ID NO: 2436324 - protein, 10 aa, Entamoeba dispar
KIPKSSYEQL

SEQ ID NO: 2436325 - protein, 6 aa, Entamoeba dispar
KIPKTN

SEQ ID NO: 2436326 - protein, 5 aa, Entamoeba dispar
KIPLP

SEQ ID NO: 2436327 - protein, 8 aa, Entamoeba dispar
KIPNNKDD

SEQ ID NO: 2436328 - protein, 6 aa, Entamoeba dispar
KIPNNQ

SEQ ID NO: 2436329 - protein, 5 aa, Entamoeba dispar
KIPNS

SEQ ID NO: 2436330 - protein, 7 aa, Entamoeba dispar
KIPPANS

SEQ ID NO: 2436331 - protein, 7 aa, Entamoeba dispar
KIPPKSI

SEQ ID NO: 2436332 - protein, 25 aa, Entamoeba dispar
KIPPSPDKNSSISFSKPLTESKNSC

SEQ ID NO: 2436333 - protein, 7 aa, Entamoeba dispar
KIPPTEI

SEQ ID NO: 2436334 - protein, 4 aa, Entamoeba dispar
KIPQ

SEQ ID NO: 2436335 - protein, 9 aa, Entamoeba dispar
KIPQQSALY

SEQ ID NO: 2436336 - protein, 4 aa, Entamoeba dispar
KIPS

SEQ ID NO: 2436337 - protein, 9 aa, Entamoeba dispar
KIPSALTGD

SEQ ID NO: 2436338 - protein, 10 aa, Entamoeba dispar
KIPSDSSFEG

SEQ ID NO: 2436339 - protein, 5 aa, Entamoeba dispar
KIPSI

SEQ ID NO: 2436340 - protein, 9 aa, Entamoeba dispar
KIPSKEEKE

SEQ ID NO: 2436341 - protein, 13 aa, Entamoeba dispar
KIPSQHSSSSVSI

SEQ ID NO: 2436342 - protein, 13 aa, Entamoeba dispar
KIPSRKISSKIKT

SEQ ID NO: 2436343 - protein, 8 aa, Entamoeba dispar
KIPSSVSK

SEQ ID NO: 2436344 - protein, 4 aa, Entamoeba dispar
KIPT

SEQ ID NO: 2436345 - protein, 12 aa, Entamoeba dispar
KIPTKITKKDKV

SEQ ID NO: 2436346 - protein, 6 aa, Entamoeba dispar
KIPTND

SEQ ID NO: 2436347 - protein, 5 aa, Entamoeba dispar
KIPTT

SEQ ID NO: 2436348 - protein, 6 aa, Entamoeba dispar
KIPVSG

SEQ ID NO: 2436349 - protein, 5 aa, Entamoeba dispar
KIPVT

SEQ ID NO: 2436350 - protein, 20 aa, Entamoeba dispar
KIQEEERQKNEEMKKQIEKE

SEQ ID NO: 2436351 - protein, 22 aa, Entamoeba dispar
KIQEQRKRERGDGVTVTPPETK

SEQ ID NO: 2436352 - protein, 7 aa, Entamoeba dispar
KIQGEEY

SEQ ID NO: 2436353 - protein, 4 aa, Entamoeba dispar
KIQK

SEQ ID NO: 2436354 - protein, 6 aa, Entamoeba dispar
KIQKNQ

SEQ ID NO: 2436355 - protein, 17 aa, Entamoeba dispar
KIQKREKRSNKKIDDDE

SEQ ID NO: 2436356 - protein, 6 aa, Entamoeba dispar
KIQNDE

SEQ ID NO: 2436357 - protein, 6 aa, Entamoeba dispar
KIQNRN

SEQ ID NO: 2436358 - protein, 5 aa, Entamoeba dispar
KIQSD

SEQ ID NO: 2436359 - protein, 42 aa, Entamoeba dispar
KIQSQDSQSQKTKKLKAPQHSDDIETKTKIPKLSGKTIRPPV

SEQ ID NO: 2436360 - protein, 5 aa, Entamoeba dispar
KIQSS

SEQ ID NO: 2436361 - protein, 8 aa, Entamoeba dispar
KIQSTKME

SEQ ID NO: 2436362 - protein, 11 aa, Entamoeba dispar
KIQSTKMENVP

SEQ ID NO: 2436363 - protein, 17 aa, Entamoeba dispar
KIQTRSPVKSFEGDEIP

SEQ ID NO: 2436364 - protein, 18 aa, Entamoeba dispar
KIQTSLKQKETNLEHNKV

SEQ ID NO: 2436365 - protein, 8 aa, Entamoeba dispar
KIRDNTEL

SEQ ID NO: 2436366 - protein, 21 aa, Entamoeba dispar
KIRDPNERARRKTKPLSEEDQ

SEQ ID NO: 2436367 - protein, 4 aa, Entamoeba dispar
KIRE

SEQ ID NO: 2436368 - protein, 30 aa, Entamoeba dispar
KIRENPAAEKKEKKEHKKYPTSKKLTLEQR

SEQ ID NO: 2436369 - protein, 10 aa, Entamoeba dispar
KIRKDGKGVE

SEQ ID NO: 2436370 - protein, 12 aa, Entamoeba dispar
KIRKSDENYKSR

SEQ ID NO: 2436371 - protein, 10 aa, Entamoeba dispar
KIRNQQPDVG

SEQ ID NO: 2436372 - protein, 7 aa, Entamoeba dispar
KIRRQKR

SEQ ID NO: 2436373 - protein, 6 aa, Entamoeba dispar
KIRTNS

SEQ ID NO: 2436374 - protein, 5 aa, Entamoeba dispar
KISAD

SEQ ID NO: 2436375 - protein, 5 aa, Entamoeba dispar
KISDE

SEQ ID NO: 2436376 - protein, 10 aa, Entamoeba dispar
KISDEEKKKI

SEQ ID NO: 2436377 - protein, 8 aa, Entamoeba dispar
KISDNPKY

SEQ ID NO: 2436378 - protein, 6 aa, Entamoeba dispar
KISDNT

SEQ ID NO: 2436379 - protein, 7 aa, Entamoeba dispar
KISEATN

SEQ ID NO: 2436380 - protein, 5 aa, Entamoeba dispar
KISEE

SEQ ID NO: 2436381 - protein, 6 aa, Entamoeba dispar
KISEGE

SEQ ID NO: 2436382 - protein, 5 aa, Entamoeba dispar
KISEH

SEQ ID NO: 2436383 - protein, 13 aa, Entamoeba dispar
KISENETEKLTMG

SEQ ID NO: 2436384 - protein, 12 aa, Entamoeba dispar
KISEPYKRPFDN

SEQ ID NO: 2436385 - protein, 6 aa, Entamoeba dispar
KISEQT

SEQ ID NO: 2436386 - protein, 9 aa, Entamoeba dispar
KISETERSQ

SEQ ID NO: 2436387 - protein, 5 aa, Entamoeba dispar
KISEY

SEQ ID NO: 2436388 - protein, 19 aa, Entamoeba dispar
KISGETLDGKEVGHDTKKV

SEQ ID NO: 2436389 - protein, 10 aa, Entamoeba dispar
KISGGKKNTV

SEQ ID NO: 2436390 - protein, 13 aa, Entamoeba dispar
KISKEEADKYAES

SEQ ID NO: 2436391 - protein, 10 aa, Entamoeba dispar
KISKRGGNQT

SEQ ID NO: 2436392 - protein, 8 aa, Entamoeba dispar
KISLSDET

SEQ ID NO: 2436393 - protein, 10 aa, Entamoeba dispar
KISLSSSNDM

SEQ ID NO: 2436394 - protein, 14 aa, Entamoeba dispar
KISNQNSSSQFTTA

SEQ ID NO: 2436395 - protein, 11 aa, Entamoeba dispar
KISNQSEEELN

SEQ ID NO: 2436396 - protein, 6 aa, Entamoeba dispar
KISNRT

SEQ ID NO: 2436397 - protein, 5 aa, Entamoeba dispar
KISPI

SEQ ID NO: 2436398 - protein, 7 aa, Entamoeba dispar
KISPNQN

SEQ ID NO: 2436399 - protein, 6 aa, Entamoeba dispar
KISPTL

SEQ ID NO: 2436400 - protein, 7 aa, Entamoeba dispar
KISQDTL

SEQ ID NO: 2436401 - protein, 7 aa, Entamoeba dispar
KISQEDD

SEQ ID NO: 2436402 - protein, 10 aa, Entamoeba dispar
KISQEKESRE

SEQ ID NO: 2436403 - protein, 4 aa, Entamoeba dispar
KISS

SEQ ID NO: 2436404 - protein, 9 aa, Entamoeba dispar
KISSKARCG

SEQ ID NO: 2436405 - protein, 15 aa, Entamoeba dispar
KISSLEEEVKEKETL

SEQ ID NO: 2436406 - protein, 6 aa, Entamoeba dispar
KISSNF

SEQ ID NO: 2436407 - protein, 12 aa, Entamoeba dispar
KISSNQQQNNYP

SEQ ID NO: 2436408 - protein, 12 aa, Entamoeba dispar
KISSSCPNSPRS

SEQ ID NO: 2436409 - protein, 9 aa, Entamoeba dispar
KISSTKMNN

SEQ ID NO: 2436410 - protein, 16 aa, Entamoeba dispar
KISTDSSSSQKKNLLS

SEQ ID NO: 2436411 - protein, 7 aa, Entamoeba dispar
KISTKGY

SEQ ID NO: 2436412 - protein, 8 aa, Entamoeba dispar
KISTTNTP

SEQ ID NO: 2436413 - protein, 16 aa, Entamoeba dispar
KITAESLKTLEKGNSM

SEQ ID NO: 2436414 - protein, 6 aa, Entamoeba dispar
KITAQT

SEQ ID NO: 2436415 - protein, 6 aa, Entamoeba dispar
KITDED

SEQ ID NO: 2436416 - protein, 12 aa, Entamoeba dispar
KITDEGDEKQTE

SEQ ID NO: 2436417 - protein, 11 aa, Entamoeba dispar
KITDEIKSCQT

SEQ ID NO: 2436418 - protein, 5 aa, Entamoeba dispar
KITDG

SEQ ID NO: 2436419 - protein, 13 aa, Entamoeba dispar
KITDTNKSIKTPF

SEQ ID NO: 2436420 - protein, 16 aa, Entamoeba dispar
KITESDKKEKELQKEI

SEQ ID NO: 2436421 - protein, 5 aa, Entamoeba dispar
KITET

SEQ ID NO: 2436422 - protein, 19 aa, Entamoeba dispar
KITGQIKKTEAKKIRSDEF

SEQ ID NO: 2436423 - protein, 6 aa, Entamoeba dispar
KITKEL

SEQ ID NO: 2436424 - protein, 57 aa, Entamoeba dispar
KITKENETIKKDETIKKDETIKKDETIKKDETIKKDETITSQDKIKKDELKKPPKKD

SEQ ID NO: 2436425 - protein, 7 aa, Entamoeba dispar
KITNESK

SEQ ID NO: 2436426 - protein, 12 aa, Entamoeba dispar
KITNGQNNTPLG

SEQ ID NO: 2436427 - protein, 6 aa, Entamoeba dispar
KITNNG

SEQ ID NO: 2436428 - protein, 14 aa, Entamoeba dispar
KITNPITQTPSTLE

SEQ ID NO: 2436429 - protein, 12 aa, Entamoeba dispar
KITNSKEVNSSV

SEQ ID NO: 2436430 - protein, 17 aa, Entamoeba dispar
KITPTNPFSRSAIDDSS

SEQ ID NO: 2436431 - protein, 13 aa, Entamoeba dispar
KITQALKSQHGST

SEQ ID NO: 2436432 - protein, 5 aa, Entamoeba dispar
KITQG

SEQ ID NO: 2436433 - protein, 7 aa, Entamoeba dispar
KITQPVE

SEQ ID NO: 2436434 - protein, 5 aa, Entamoeba dispar
KITSK

SEQ ID NO: 2436435 - protein, 7 aa, Entamoeba dispar
KITSSLS

SEQ ID NO: 2436436 - protein, 17 aa, Entamoeba dispar
KITSSPRSNSPSPSELT

SEQ ID NO: 2436437 - protein, 8 aa, Entamoeba dispar
KITTANIG

SEQ ID NO: 2436438 - protein, 5 aa, Entamoeba dispar
KITTE

SEQ ID NO: 2436439 - protein, 23 aa, Entamoeba dispar
KITTPNDQRDKEKRENKNEEEIN

SEQ ID NO: 2436440 - protein, 13 aa, Entamoeba dispar
KIVPSKVSTGEKC

SEQ ID NO: 2436441 - protein, 7 aa, Entamoeba dispar
KIVRGSA

SEQ ID NO: 2436442 - protein, 4 aa, Entamoeba dispar
KIVT

SEQ ID NO: 2436443 - protein, 16 aa, Entamoeba dispar
KIYEKKISDKAIPSIK

SEQ ID NO: 2436444 - protein, 9 aa, Entamoeba dispar
KKACETKIT

SEQ ID NO: 2436445 - protein, 16 aa, Entamoeba dispar
KKADEATKRDKELETA

SEQ ID NO: 2436446 - protein, 11 aa, Entamoeba dispar
KKAEEEEGGSL

SEQ ID NO: 2436447 - protein, 11 aa, Entamoeba dispar
KKAEKRQLASD

SEQ ID NO: 2436448 - protein, 43 aa, Entamoeba dispar
KKAENKSSKPSDRIIEQDQERQQRNGYQALDQQENPQENVPKN

SEQ ID NO: 2436449 - protein, 8 aa, Entamoeba dispar
KKAESNPL

SEQ ID NO: 2436450 - protein, 15 aa, Entamoeba dispar
KKAGEDAVKGNEPTE

SEQ ID NO: 2436451 - protein, 9 aa, Entamoeba dispar
KKAGGKEVA

SEQ ID NO: 2436452 - protein, 8 aa, Entamoeba dispar
KKAGKNGS

SEQ ID NO: 2436453 - protein, 5 aa, Entamoeba dispar
KKAHS

SEQ ID NO: 2436454 - protein, 10 aa, Entamoeba dispar
KKAIKQKPVK

SEQ ID NO: 2436455 - protein, 11 aa, Entamoeba dispar
KKAKDDSESIQ

SEQ ID NO: 2436456 - protein, 6 aa, Entamoeba dispar
KKAKEI

SEQ ID NO: 2436457 - protein, 10 aa, Entamoeba dispar
KKAKEYQEKE

SEQ ID NO: 2436458 - protein, 14 aa, Entamoeba dispar
KKAKGESKKKEETI

SEQ ID NO: 2436459 - protein, 27 aa, Entamoeba dispar
KKAKKSSDKQIITNKTKKRENKKPFSI

SEQ ID NO: 2436460 - protein, 8 aa, Entamoeba dispar
KKAKPDGI

SEQ ID NO: 2436461 - protein, 5 aa, Entamoeba dispar
KKAKR

SEQ ID NO: 2436462 - protein, 8 aa, Entamoeba dispar
KKAKTTKK

SEQ ID NO: 2436463 - protein, 4 aa, Entamoeba dispar
KKAL

SEQ ID NO: 2436464 - protein, 7 aa, Entamoeba dispar
KKALDKE

SEQ ID NO: 2436465 - protein, 7 aa, Entamoeba dispar
KKALNEI

SEQ ID NO: 2436466 - protein, 7 aa, Entamoeba dispar
KKANECR

SEQ ID NO: 2436467 - protein, 6 aa, Entamoeba dispar
KKANEM

SEQ ID NO: 2436468 - protein, 15 aa, Entamoeba dispar
KKANFEKVKEQAHRA

SEQ ID NO: 2436469 - protein, 9 aa, Entamoeba dispar
KKANKNATD

SEQ ID NO: 2436470 - protein, 20 aa, Entamoeba dispar
KKAPREFDEEDFSHQRGCII

SEQ ID NO: 2436471 - protein, 22 aa, Entamoeba dispar
KKAQEKFEKLGKDAKEQYDEHK

SEQ ID NO: 2436472 - protein, 7 aa, Entamoeba dispar
KKAQTQI

SEQ ID NO: 2436473 - protein, 4 aa, Entamoeba dispar
KKAR

SEQ ID NO: 2436474 - protein, 21 aa, Entamoeba dispar
KKASETTYRPSKKEINNNETL

SEQ ID NO: 2436475 - protein, 6 aa, Entamoeba dispar
KKASHA

SEQ ID NO: 2436476 - protein, 5 aa, Entamoeba dispar
KKASI

SEQ ID NO: 2436477 - protein, 9 aa, Entamoeba dispar
KKASIKTSI

SEQ ID NO: 2436478 - protein, 21 aa, Entamoeba dispar
KKASKEVGKTLNSEDTEKIEI

SEQ ID NO: 2436479 - protein, 7 aa, Entamoeba dispar
KKASSFA

SEQ ID NO: 2436480 - protein, 12 aa, Entamoeba dispar
KKATEDMKPNKP

SEQ ID NO: 2436481 - protein, 8 aa, Entamoeba dispar
KKATTKEV

SEQ ID NO: 2436482 - protein, 12 aa, Entamoeba dispar
KKATTYGCFGRS

SEQ ID NO: 2436483 - protein, 11 aa, Entamoeba dispar
KKAVANDDWNQ

SEQ ID NO: 2436484 - protein, 8 aa, Entamoeba dispar
KKAYGPYV

SEQ ID NO: 2436485 - protein, 7 aa, Entamoeba dispar
KKAYNKY

SEQ ID NO: 2436486 - protein, 9 aa, Entamoeba dispar
KKCDAQDSL

SEQ ID NO: 2436487 - protein, 10 aa, Entamoeba dispar
KKCDTKEADL

SEQ ID NO: 2436488 - protein, 6 aa, Entamoeba dispar
KKCEGH

SEQ ID NO: 2436489 - protein, 7 aa, Entamoeba dispar
KKCEHNG

SEQ ID NO: 2436490 - protein, 11 aa, Entamoeba dispar
KKCGDNLKSGW

SEQ ID NO: 2436491 - protein, 6 aa, Entamoeba dispar
KKCKNS

SEQ ID NO: 2436492 - protein, 14 aa, Entamoeba dispar
KKCNGSGKVSETKE

SEQ ID NO: 2436493 - protein, 12 aa, Entamoeba dispar
KKCPKDKNENVR

SEQ ID NO: 2436494 - protein, 8 aa, Entamoeba dispar
KKCRKKKK

SEQ ID NO: 2436495 - protein, 13 aa, Entamoeba dispar
KKCSRDSDKIEES

SEQ ID NO: 2436496 - protein, 6 aa, Entamoeba dispar
KKCVSN

SEQ ID NO: 2436497 - protein, 7 aa, Entamoeba dispar
KKDACSS

SEQ ID NO: 2436498 - protein, 10 aa, Entamoeba dispar
KKDANESLKK

SEQ ID NO: 2436499 - protein, 43 aa, Entamoeba dispar
KKDDDDLSMSSNSNQVSSVNSSTINVRDANSMSISSNAPPPLV

SEQ ID NO: 2436500 - protein, 8 aa, Entamoeba dispar
KKDDKINK

SEQ ID NO: 2436501 - protein, 8 aa, Entamoeba dispar
KKDDNQKE

SEQ ID NO: 2436502 - protein, 8 aa, Entamoeba dispar
KKDEDKIK

SEQ ID NO: 2436503 - protein, 7 aa, Entamoeba dispar
KKDEEEL

SEQ ID NO: 2436504 - protein, 7 aa, Entamoeba dispar
KKDEGQS

SEQ ID NO: 2436505 - protein, 9 aa, Entamoeba dispar
KKDEKGVKE

SEQ ID NO: 2436506 - protein, 11 aa, Entamoeba dispar
KKDENNDINEM

SEQ ID NO: 2436507 - protein, 9 aa, Entamoeba dispar
KKDENSDSL

SEQ ID NO: 2436508 - protein, 9 aa, Entamoeba dispar
KKDENSGID

SEQ ID NO: 2436509 - protein, 15 aa, Entamoeba dispar
KKDEPEEKKNISKAM

SEQ ID NO: 2436510 - protein, 7 aa, Entamoeba dispar
KKDEVKE

SEQ ID NO: 2436511 - protein, 13 aa, Entamoeba dispar
KKDFRSEKKLEKH

SEQ ID NO: 2436512 - protein, 5 aa, Entamoeba dispar
KKDGA

SEQ ID NO: 2436513 - protein, 5 aa, Entamoeba dispar
KKDGC

SEQ ID NO: 2436514 - protein, 24 aa, Entamoeba dispar
KKDGEEENNDMSEEPKELNEEELA

SEQ ID NO: 2436515 - protein, 8 aa, Entamoeba dispar
KKDGGNVE

SEQ ID NO: 2436516 - protein, 8 aa, Entamoeba dispar
KKDGIKPT

SEQ ID NO: 2436517 - protein, 25 aa, Entamoeba dispar
KKDGKQQKKLDIAGKPIKERKGIET

SEQ ID NO: 2436518 - protein, 8 aa, Entamoeba dispar
KKDGQYKI

SEQ ID NO: 2436519 - protein, 7 aa, Entamoeba dispar
KKDGRNC

SEQ ID NO: 2436520 - protein, 10 aa, Entamoeba dispar
KKDGTKLSST

SEQ ID NO: 2436521 - protein, 6 aa, Entamoeba dispar
KKDGTL

SEQ ID NO: 2436522 - protein, 4 aa, Entamoeba dispar
KKDH

SEQ ID NO: 2436523 - protein, 6 aa, Entamoeba dispar
KKDIAE

SEQ ID NO: 2436524 - protein, 20 aa, Entamoeba dispar
KKDIKDQNRDLAKQAYSAYE

SEQ ID NO: 2436525 - protein, 13 aa, Entamoeba dispar
KKDIKGAVNEDEL

SEQ ID NO: 2436526 - protein, 14 aa, Entamoeba dispar
KKDIKSYSEPKKTI

SEQ ID NO: 2436527 - protein, 41 aa, Entamoeba dispar
KKDKDRNNRKSMIEKSSSYPQKIEDSQTIEKLNKKDTSLND

SEQ ID NO: 2436528 - protein, 9 aa, Entamoeba dispar
KKDKEIEGN

SEQ ID NO: 2436529 - protein, 8 aa, Entamoeba dispar
KKDKERKW

SEQ ID NO: 2436530 - protein, 11 aa, Entamoeba dispar
KKDKETETRRR

SEQ ID NO: 2436531 - protein, 100 aa, Entamoeba dispar
KKDKKDEIINQEDEQKSVSGKENEIEYTSSQEQDSESQLISSPSDEDEKGYTSSQNDEYENRLTSNQEFEVENRGLSSPTFYDSDEQRQEEKENEAQNLD

SEQ ID NO: 2436532 - protein, 7 aa, Entamoeba dispar
KKDKLSP

SEQ ID NO: 2436533 - protein, 9 aa, Entamoeba dispar
KKDKQTNSI

SEQ ID NO: 2436534 - protein, 14 aa, Entamoeba dispar
KKDKRKTKSPSLQQ

SEQ ID NO: 2436535 - protein, 31 aa, Entamoeba dispar
KKDKSNAFRVSSEPNSQTQETIGSYGENDRE

SEQ ID NO: 2436536 - protein, 5 aa, Entamoeba dispar
KKDNE

SEQ ID NO: 2436537 - protein, 7 aa, Entamoeba dispar
KKDNEYT

SEQ ID NO: 2436538 - protein, 6 aa, Entamoeba dispar
KKDNIK

SEQ ID NO: 2436539 - protein, 9 aa, Entamoeba dispar
KKDNKKDLL

SEQ ID NO: 2436540 - protein, 9 aa, Entamoeba dispar
KKDNKNIQN

SEQ ID NO: 2436541 - protein, 9 aa, Entamoeba dispar
KKDNKTLTP

SEQ ID NO: 2436542 - protein, 18 aa, Entamoeba dispar
KKDNKYIKPTIEQEADSF

SEQ ID NO: 2436543 - protein, 8 aa, Entamoeba dispar
KKDNWDEA

SEQ ID NO: 2436544 - protein, 10 aa, Entamoeba dispar
KKDPKAKLEA

SEQ ID NO: 2436545 - protein, 8 aa, Entamoeba dispar
KKDPQTNQ

SEQ ID NO: 2436546 - protein, 5 aa, Entamoeba dispar
KKDPY

SEQ ID NO: 2436547 - protein, 9 aa, Entamoeba dispar
KKDQEEGEI

SEQ ID NO: 2436548 - protein, 9 aa, Entamoeba dispar
KKDQEEGEV

SEQ ID NO: 2436549 - protein, 22 aa, Entamoeba dispar
KKDQEENTSSNAGVSDQIKEEK

SEQ ID NO: 2436550 - protein, 7 aa, Entamoeba dispar
KKDQEID

SEQ ID NO: 2436551 - protein, 50 aa, Entamoeba dispar
KKDQESNSQPSDDSSSQEKKKHHKHHKHHEKKSKEYQETKPKVNDEDQPK

SEQ ID NO: 2436552 - protein, 13 aa, Entamoeba dispar
KKDRKEEDTARGL

SEQ ID NO: 2436553 - protein, 9 aa, Entamoeba dispar
KKDRTKEGF

SEQ ID NO: 2436554 - protein, 9 aa, Entamoeba dispar
KKDSETEQN

SEQ ID NO: 2436555 - protein, 10 aa, Entamoeba dispar
KKDSETEQNL

SEQ ID NO: 2436556 - protein, 6 aa, Entamoeba dispar
KKDSFD

SEQ ID NO: 2436557 - protein, 8 aa, Entamoeba dispar
KKDSMNGE

SEQ ID NO: 2436558 - protein, 8 aa, Entamoeba dispar
KKDSQEVK

SEQ ID NO: 2436559 - protein, 11 aa, Entamoeba dispar
KKDSSPLPKNI

SEQ ID NO: 2436560 - protein, 7 aa, Entamoeba dispar
KKDSTEL

SEQ ID NO: 2436561 - protein, 6 aa, Entamoeba dispar
KKDSVS

SEQ ID NO: 2436562 - protein, 8 aa, Entamoeba dispar
KKDTEGKY

SEQ ID NO: 2436563 - protein, 22 aa, Entamoeba dispar
KKDTEPKEFPNKSEKKEGELTE

SEQ ID NO: 2436564 - protein, 8 aa, Entamoeba dispar
KKDTGERL

SEQ ID NO: 2436565 - protein, 16 aa, Entamoeba dispar
KKDTKTTVDGKPKLTE

SEQ ID NO: 2436566 - protein, 14 aa, Entamoeba dispar
KKDTVNELTSQGKQ

SEQ ID NO: 2436567 - protein, 33 aa, Entamoeba dispar
KKDVFGDDRPTTTLTPHPQEKDDEEGKNSENSK

SEQ ID NO: 2436568 - protein, 9 aa, Entamoeba dispar
KKDVNSKGC

SEQ ID NO: 2436569 - protein, 6 aa, Entamoeba dispar
KKDVQQ

SEQ ID NO: 2436570 - protein, 6 aa, Entamoeba dispar
KKDYEN

SEQ ID NO: 2436571 - protein, 12 aa, Entamoeba dispar
KKEAEAKMQQEM

SEQ ID NO: 2436572 - protein, 11 aa, Entamoeba dispar
KKEAEDTVDKL

SEQ ID NO: 2436573 - protein, 7 aa, Entamoeba dispar
KKEAERI

SEQ ID NO: 2436574 - protein, 8 aa, Entamoeba dispar
KKEAKKRC

SEQ ID NO: 2436575 - protein, 9 aa, Entamoeba dispar
KKEAKKRCK

SEQ ID NO: 2436576 - protein, 10 aa, Entamoeba dispar
KKEAPPEEDD

SEQ ID NO: 2436577 - protein, 10 aa, Entamoeba dispar
KKEAQNGERI

SEQ ID NO: 2436578 - protein, 8 aa, Entamoeba dispar
KKEATYIT

SEQ ID NO: 2436579 - protein, 7 aa, Entamoeba dispar
KKECPEG

SEQ ID NO: 2436580 - protein, 43 aa, Entamoeba dispar
KKEDDDLSMSSNSNQVSSVNSSTINVRDANSMSISSNAPPPLV

SEQ ID NO: 2436581 - protein, 30 aa, Entamoeba dispar
KKEDDKEKELEKKIKEETKPAGRKTELLYF

SEQ ID NO: 2436582 - protein, 21 aa, Entamoeba dispar
KKEDESAMSIEKKSKHSEERD

SEQ ID NO: 2436583 - protein, 6 aa, Entamoeba dispar
KKEDIT

SEQ ID NO: 2436584 - protein, 7 aa, Entamoeba dispar
KKEDLSK

SEQ ID NO: 2436585 - protein, 25 aa, Entamoeba dispar
KKEDNTTQTNEVEEQPILINEKTYK

SEQ ID NO: 2436586 - protein, 7 aa, Entamoeba dispar
KKEDPHK

SEQ ID NO: 2436587 - protein, 14 aa, Entamoeba dispar
KKEDSLKKEKLTTQ

SEQ ID NO: 2436588 - protein, 11 aa, Entamoeba dispar
KKEDTSKSNKI

SEQ ID NO: 2436589 - protein, 13 aa, Entamoeba dispar
KKEDYIESETGGP

SEQ ID NO: 2436590 - protein, 8 aa, Entamoeba dispar
KKEEANRL

SEQ ID NO: 2436591 - protein, 6 aa, Entamoeba dispar
KKEEDE

SEQ ID NO: 2436592 - protein, 34 aa, Entamoeba dispar
KKEEDEFNKKTEQLKAQIEKETGVVKKNRAQAEL

SEQ ID NO: 2436593 - protein, 14 aa, Entamoeba dispar
KKEEDGKTIGDIDN

SEQ ID NO: 2436594 - protein, 14 aa, Entamoeba dispar
KKEEDKEKQERDEI

SEQ ID NO: 2436595 - protein, 7 aa, Entamoeba dispar
KKEEDSI

SEQ ID NO: 2436596 - protein, 13 aa, Entamoeba dispar
KKEEEEKRTLEDQ

SEQ ID NO: 2436597 - protein, 7 aa, Entamoeba dispar
KKEEEIM

SEQ ID NO: 2436598 - protein, 8 aa, Entamoeba dispar
KKEEELKQ

SEQ ID NO: 2436599 - protein, 14 aa, Entamoeba dispar
KKEEELSKEEELNK

SEQ ID NO: 2436600 - protein, 11 aa, Entamoeba dispar
KKEEEPEEGNL

SEQ ID NO: 2436601 - protein, 49 aa, Entamoeba dispar
KKEEETAAYVPPSLRGKPSCVEDDNDPMPGQHAKKVSRKPKKKTTKSQK

SEQ ID NO: 2436602 - protein, 8 aa, Entamoeba dispar
KKEEGKWT

SEQ ID NO: 2436603 - protein, 8 aa, Entamoeba dispar
KKEEIKEK

SEQ ID NO: 2436604 - protein, 16 aa, Entamoeba dispar
KKEEISVPKASIKYSS

SEQ ID NO: 2436605 - protein, 6 aa, Entamoeba dispar
KKEEKE

SEQ ID NO: 2436606 - protein, 81 aa, Entamoeba dispar
KKEEKERKIAEEKRKKEEEERKRKEEEEKKKKAEEEAKKKAEEEAKKKAEEEKKKNEEKPKEESKKMEEEKTGAAEPPPVP

SEQ ID NO: 2436607 - protein, 16 aa, Entamoeba dispar
KKEEKNEQKISKSPTL

SEQ ID NO: 2436608 - protein, 10 aa, Entamoeba dispar
KKEEKRPNTR

SEQ ID NO: 2436609 - protein, 8 aa, Entamoeba dispar
KKEELQRK

SEQ ID NO: 2436610 - protein, 9 aa, Entamoeba dispar
KKEEMSADT

SEQ ID NO: 2436611 - protein, 20 aa, Entamoeba dispar
KKEEPKPVVKKEELKSEITE

SEQ ID NO: 2436612 - protein, 8 aa, Entamoeba dispar
KKEEQELN

SEQ ID NO: 2436613 - protein, 15 aa, Entamoeba dispar
KKEEQIESTQQTDFN

SEQ ID NO: 2436614 - protein, 8 aa, Entamoeba dispar
KKEEQRLR

SEQ ID NO: 2436615 - protein, 8 aa, Entamoeba dispar
KKEERDNW

SEQ ID NO: 2436616 - protein, 6 aa, Entamoeba dispar
KKEESF

SEQ ID NO: 2436617 - protein, 17 aa, Entamoeba dispar
KKEETFKHAASGSTMTN

SEQ ID NO: 2436618 - protein, 6 aa, Entamoeba dispar
KKEEVI

SEQ ID NO: 2436619 - protein, 9 aa, Entamoeba dispar
KKEEWNRKK

SEQ ID NO: 2436620 - protein, 8 aa, Entamoeba dispar
KKEEYPGR

SEQ ID NO: 2436621 - protein, 7 aa, Entamoeba dispar
KKEEYQE

SEQ ID NO: 2436622 - protein, 8 aa, Entamoeba dispar
KKEEYSKI

SEQ ID NO: 2436623 - protein, 4 aa, Entamoeba dispar
KKEF

SEQ ID NO: 2436624 - protein, 8 aa, Entamoeba dispar
KKEFQVGD

SEQ ID NO: 2436625 - protein, 19 aa, Entamoeba dispar
KKEGDPQKEHGRKEKRDED

SEQ ID NO: 2436626 - protein, 7 aa, Entamoeba dispar
KKEGEGL

SEQ ID NO: 2436627 - protein, 7 aa, Entamoeba dispar
KKEGENI

SEQ ID NO: 2436628 - protein, 8 aa, Entamoeba dispar
KKEGESEV

SEQ ID NO: 2436629 - protein, 14 aa, Entamoeba dispar
KKEGFQKTQNENQK

SEQ ID NO: 2436630 - protein, 7 aa, Entamoeba dispar
KKEGKKT

SEQ ID NO: 2436631 - protein, 11 aa, Entamoeba dispar
KKEGKLEKKAV

SEQ ID NO: 2436632 - protein, 7 aa, Entamoeba dispar
KKEGLEM

SEQ ID NO: 2436633 - protein, 15 aa, Entamoeba dispar
KKEGLTSSSENSIAQ

SEQ ID NO: 2436634 - protein, 5 aa, Entamoeba dispar
KKEGN

SEQ ID NO: 2436635 - protein, 6 aa, Entamoeba dispar
KKEGPE

SEQ ID NO: 2436636 - protein, 12 aa, Entamoeba dispar
KKEGQETPKIET

SEQ ID NO: 2436637 - protein, 9 aa, Entamoeba dispar
KKEGREMND

SEQ ID NO: 2436638 - protein, 6 aa, Entamoeba dispar
KKEGSE

SEQ ID NO: 2436639 - protein, 6 aa, Entamoeba dispar
KKEGSL

SEQ ID NO: 2436640 - protein, 6 aa, Entamoeba dispar
KKEGTL

SEQ ID NO: 2436641 - protein, 8 aa, Entamoeba dispar
KKEHDTVS

SEQ ID NO: 2436642 - protein, 4 aa, Entamoeba dispar
KKEI

SEQ ID NO: 2436643 - protein, 8 aa, Entamoeba dispar
KKEIDNKN

SEQ ID NO: 2436644 - protein, 6 aa, Entamoeba dispar
KKEIES

SEQ ID NO: 2436645 - protein, 19 aa, Entamoeba dispar
KKEIETHPITQNTEVGYST

SEQ ID NO: 2436646 - protein, 6 aa, Entamoeba dispar
KKEIGV

SEQ ID NO: 2436647 - protein, 5 aa, Entamoeba dispar
KKEIK

SEQ ID NO: 2436648 - protein, 8 aa, Entamoeba dispar
KKEIKEKT

SEQ ID NO: 2436649 - protein, 30 aa, Entamoeba dispar
KKEIKPVVQSPNQQKRDINTLAKQKGMTEE

SEQ ID NO: 2436650 - protein, 6 aa, Entamoeba dispar
KKEIPK

SEQ ID NO: 2436651 - protein, 20 aa, Entamoeba dispar
KKEIQQPKKKYSKKSSPQLI

SEQ ID NO: 2436652 - protein, 9 aa, Entamoeba dispar
KKEISDENE

SEQ ID NO: 2436653 - protein, 8 aa, Entamoeba dispar
KKEISKEG

SEQ ID NO: 2436654 - protein, 9 aa, Entamoeba dispar
KKEISKEKL

SEQ ID NO: 2436655 - protein, 18 aa, Entamoeba dispar
KKEISKNEFKKLILHICS

SEQ ID NO: 2436656 - protein, 8 aa, Entamoeba dispar
KKEISQQR

SEQ ID NO: 2436657 - protein, 6 aa, Entamoeba dispar
KKEITR

SEQ ID NO: 2436658 - protein, 4 aa, Entamoeba dispar
KKEK

SEQ ID NO: 2436659 - protein, 14 aa, Entamoeba dispar
KKEKDAEKAKRAKE

SEQ ID NO: 2436660 - protein, 29 aa, Entamoeba dispar
KKEKDDKKKGVEEKKPKKQSLKTIKKEPA

SEQ ID NO: 2436661 - protein, 8 aa, Entamoeba dispar
KKEKDEKV

SEQ ID NO: 2436662 - protein, 13 aa, Entamoeba dispar
KKEKDETTPEFKE

SEQ ID NO: 2436663 - protein, 7 aa, Entamoeba dispar
KKEKDKI

SEQ ID NO: 2436664 - protein, 27 aa, Entamoeba dispar
KKEKDLLKAQEKAKEQYMKEHPETKSI

SEQ ID NO: 2436665 - protein, 45 aa, Entamoeba dispar
KKEKEETLKEEDNEKILKEEDNENNTNENEQSEEIDTVERRKERT

SEQ ID NO: 2436666 - protein, 15 aa, Entamoeba dispar
KKEKEMEEEYNLKKE

SEQ ID NO: 2436667 - protein, 9 aa, Entamoeba dispar
KKEKERQHQ

SEQ ID NO: 2436668 - protein, 9 aa, Entamoeba dispar
KKEKETELT

SEQ ID NO: 2436669 - protein, 9 aa, Entamoeba dispar
KKEKETNEF

SEQ ID NO: 2436670 - protein, 12 aa, Entamoeba dispar
KKEKGKKNDKEI

SEQ ID NO: 2436671 - protein, 26 aa, Entamoeba dispar
KKEKKEKHHKHSHNTTEKKEQKKEEK

SEQ ID NO: 2436672 - protein, 9 aa, Entamoeba dispar
KKEKKNKIP

SEQ ID NO: 2436673 - protein, 10 aa, Entamoeba dispar
KKEKKRQMEL

SEQ ID NO: 2436674 - protein, 16 aa, Entamoeba dispar
KKEKKVKEEKEEVIPT

SEQ ID NO: 2436675 - protein, 6 aa, Entamoeba dispar
KKEKMN

SEQ ID NO: 2436676 - protein, 23 aa, Entamoeba dispar
KKEKNKEAQTVQKEDEEKKQENI

SEQ ID NO: 2436677 - protein, 10 aa, Entamoeba dispar
KKEKPLPPIP

SEQ ID NO: 2436678 - protein, 25 aa, Entamoeba dispar
KKEKQSKDFNEKGETSIQSINPPLQ

SEQ ID NO: 2436679 - protein, 5 aa, Entamoeba dispar
KKEKR

SEQ ID NO: 2436680 - protein, 16 aa, Entamoeba dispar
KKEKSVNVTEQSSEIE

SEQ ID NO: 2436681 - protein, 12 aa, Entamoeba dispar
KKEKTKIKSCLI

SEQ ID NO: 2436682 - protein, 6 aa, Entamoeba dispar
KKEKWS

SEQ ID NO: 2436683 - protein, 16 aa, Entamoeba dispar
KKELDETKKEVENYKK

SEQ ID NO: 2436684 - protein, 7 aa, Entamoeba dispar
KKELERI

SEQ ID NO: 2436685 - protein, 14 aa, Entamoeba dispar
KKELIKRKEEIGKN

SEQ ID NO: 2436686 - protein, 17 aa, Entamoeba dispar
KKELNEKTDELKKIEEE

SEQ ID NO: 2436687 - protein, 10 aa, Entamoeba dispar
KKELSEQEKD

SEQ ID NO: 2436688 - protein, 4 aa, Entamoeba dispar
KKEM

SEQ ID NO: 2436689 - protein, 8 aa, Entamoeba dispar
KKEMKSNS

SEQ ID NO: 2436690 - protein, 5 aa, Entamoeba dispar
KKEMQ

SEQ ID NO: 2436691 - protein, 20 aa, Entamoeba dispar
KKENEELKNENNKINEELSQ

SEQ ID NO: 2436692 - protein, 8 aa, Entamoeba dispar
KKENEEMI

SEQ ID NO: 2436693 - protein, 8 aa, Entamoeba dispar
KKENEKPF

SEQ ID NO: 2436694 - protein, 22 aa, Entamoeba dispar
KKENETKPKRTQPTPIVIIRRK

SEQ ID NO: 2436695 - protein, 10 aa, Entamoeba dispar
KKENGDRNKI

SEQ ID NO: 2436696 - protein, 17 aa, Entamoeba dispar
KKENKERKPKKKTTRKN

SEQ ID NO: 2436697 - protein, 9 aa, Entamoeba dispar
KKENKHYTN

SEQ ID NO: 2436698 - protein, 7 aa, Entamoeba dispar
KKENKIF

SEQ ID NO: 2436699 - protein, 38 aa, Entamoeba dispar
KKENKITSTPLTDEESQQKEKKVIEEKNNPQNEQPTIE

SEQ ID NO: 2436700 - protein, 27 aa, Entamoeba dispar
KKENKNKQNTLKTKITKTQEEDITPEC

SEQ ID NO: 2436701 - protein, 7 aa, Entamoeba dispar
KKENKQL

SEQ ID NO: 2436702 - protein, 14 aa, Entamoeba dispar
KKENKTKEEENKEM

SEQ ID NO: 2436703 - protein, 10 aa, Entamoeba dispar
KKENPKINQP

SEQ ID NO: 2436704 - protein, 7 aa, Entamoeba dispar
KKENSNT

SEQ ID NO: 2436705 - protein, 10 aa, Entamoeba dispar
KKENSTGRLA

SEQ ID NO: 2436706 - protein, 9 aa, Entamoeba dispar
KKENVTDNY

SEQ ID NO: 2436707 - protein, 7 aa, Entamoeba dispar
KKENYQR

SEQ ID NO: 2436708 - protein, 12 aa, Entamoeba dispar
KKEPIKKEDIET

SEQ ID NO: 2436709 - protein, 7 aa, Entamoeba dispar
KKEPNEV

SEQ ID NO: 2436710 - protein, 6 aa, Entamoeba dispar
KKEPNN

SEQ ID NO: 2436711 - protein, 10 aa, Entamoeba dispar
KKEPRKTTDI

SEQ ID NO: 2436712 - protein, 8 aa, Entamoeba dispar
KKEPSSSY

SEQ ID NO: 2436713 - protein, 13 aa, Entamoeba dispar
KKEPSTKRSLKET

SEQ ID NO: 2436714 - protein, 7 aa, Entamoeba dispar
KKEPYQK

SEQ ID NO: 2436715 - protein, 7 aa, Entamoeba dispar
KKEPYQR

SEQ ID NO: 2436716 - protein, 10 aa, Entamoeba dispar
KKEQCSTLGD

SEQ ID NO: 2436717 - protein, 18 aa, Entamoeba dispar
KKEQEEADKIKAEEEKMK

SEQ ID NO: 2436718 - protein, 7 aa, Entamoeba dispar
KKEQGTL

SEQ ID NO: 2436719 - protein, 15 aa, Entamoeba dispar
KKEQKEREKEIENKE

SEQ ID NO: 2436720 - protein, 10 aa, Entamoeba dispar
KKEQRKHSRR

SEQ ID NO: 2436721 - protein, 54 aa, Entamoeba dispar
KKEQRKSEKQEIKEAKKQMKAEEKAIKKQMKAEEKEHKKQMKQEKRNSNHQGKV

SEQ ID NO: 2436722 - protein, 11 aa, Entamoeba dispar
KKEQTATLGDE

SEQ ID NO: 2436723 - protein, 12 aa, Entamoeba dispar
KKEQTGNSKLKP

SEQ ID NO: 2436724 - protein, 13 aa, Entamoeba dispar
KKEQTNKKLFENK

SEQ ID NO: 2436725 - protein, 7 aa, Entamoeba dispar
KKEQTQI

SEQ ID NO: 2436726 - protein, 11 aa, Entamoeba dispar
KKEQTSTLGDE

SEQ ID NO: 2436727 - protein, 9 aa, Entamoeba dispar
KKEQTTYSF

SEQ ID NO: 2436728 - protein, 10 aa, Entamoeba dispar
KKERDDKNYE

SEQ ID NO: 2436729 - protein, 32 aa, Entamoeba dispar
KKEREANGEEDLEDDEKEKERNSRKRVPPKAL

SEQ ID NO: 2436730 - protein, 9 aa, Entamoeba dispar
KKERESQNK

SEQ ID NO: 2436731 - protein, 18 aa, Entamoeba dispar
KKERKKRKGDHKSDRREE

SEQ ID NO: 2436732 - protein, 14 aa, Entamoeba dispar
KKERKREIKDNKKM

SEQ ID NO: 2436733 - protein, 7 aa, Entamoeba dispar
KKERNNV

SEQ ID NO: 2436734 - protein, 7 aa, Entamoeba dispar
KKERNSM

SEQ ID NO: 2436735 - protein, 17 aa, Entamoeba dispar
KKERTNSLGKVTEPMTD

SEQ ID NO: 2436736 - protein, 8 aa, Entamoeba dispar
KKERTPQD

SEQ ID NO: 2436737 - protein, 5 aa, Entamoeba dispar
KKERW

SEQ ID NO: 2436738 - protein, 7 aa, Entamoeba dispar
KKESDED

SEQ ID NO: 2436739 - protein, 6 aa, Entamoeba dispar
KKESEK

SEQ ID NO: 2436740 - protein, 7 aa, Entamoeba dispar
KKESEKI

SEQ ID NO: 2436741 - protein, 7 aa, Entamoeba dispar
KKESERV

SEQ ID NO: 2436742 - protein, 18 aa, Entamoeba dispar
KKESETKELEKKTKDEEI

SEQ ID NO: 2436743 - protein, 13 aa, Entamoeba dispar
KKESFEKNKPISG

SEQ ID NO: 2436744 - protein, 7 aa, Entamoeba dispar
KKESGHL

SEQ ID NO: 2436745 - protein, 20 aa, Entamoeba dispar
KKESIKKLENSGLDNEEINK

SEQ ID NO: 2436746 - protein, 6 aa, Entamoeba dispar
KKESNL

SEQ ID NO: 2436747 - protein, 17 aa, Entamoeba dispar
KKESREDDSSSKYKYGK

SEQ ID NO: 2436748 - protein, 12 aa, Entamoeba dispar
KKESTLGGPQNR

SEQ ID NO: 2436749 - protein, 7 aa, Entamoeba dispar
KKESTLN

SEQ ID NO: 2436750 - protein, 8 aa, Entamoeba dispar
KKESTPLS

SEQ ID NO: 2436751 - protein, 9 aa, Entamoeba dispar
KKESVNRKQ

SEQ ID NO: 2436752 - protein, 12 aa, Entamoeba dispar
KKESVRQRRNKK

SEQ ID NO: 2436753 - protein, 6 aa, Entamoeba dispar
KKESWK

SEQ ID NO: 2436754 - protein, 7 aa, Entamoeba dispar
KKETEEE

SEQ ID NO: 2436755 - protein, 10 aa, Entamoeba dispar
KKETKGELSE

SEQ ID NO: 2436756 - protein, 5 aa, Entamoeba dispar
KKETL

SEQ ID NO: 2436757 - protein, 7 aa, Entamoeba dispar
KKETPPH

SEQ ID NO: 2436758 - protein, 6 aa, Entamoeba dispar
KKEVEE

SEQ ID NO: 2436759 - protein, 8 aa, Entamoeba dispar
KKEVEEEE

SEQ ID NO: 2436760 - protein, 9 aa, Entamoeba dispar
KKEVEGTWE

SEQ ID NO: 2436761 - protein, 5 aa, Entamoeba dispar
KKEVR

SEQ ID NO: 2436762 - protein, 15 aa, Entamoeba dispar
KKEVSDEDAQNYSKR

SEQ ID NO: 2436763 - protein, 15 aa, Entamoeba dispar
KKEVSTDHNTHPSII

SEQ ID NO: 2436764 - protein, 7 aa, Entamoeba dispar
KKEVTNK

SEQ ID NO: 2436765 - protein, 7 aa, Entamoeba dispar
KKEYDEV

SEQ ID NO: 2436766 - protein, 8 aa, Entamoeba dispar
KKEYEEKI

SEQ ID NO: 2436767 - protein, 6 aa, Entamoeba dispar
KKEYPE

SEQ ID NO: 2436768 - protein, 8 aa, Entamoeba dispar
KKEYQSRK

SEQ ID NO: 2436769 - protein, 9 aa, Entamoeba dispar
KKFCTPDDI

SEQ ID NO: 2436770 - protein, 7 aa, Entamoeba dispar
KKFDNEE

SEQ ID NO: 2436771 - protein, 8 aa, Entamoeba dispar
KKFDQKTL

SEQ ID NO: 2436772 - protein, 4 aa, Entamoeba dispar
KKFE

SEQ ID NO: 2436773 - protein, 12 aa, Entamoeba dispar
KKFEKKPRRPGL

SEQ ID NO: 2436774 - protein, 8 aa, Entamoeba dispar
KKFEKRND

SEQ ID NO: 2436775 - protein, 5 aa, Entamoeba dispar
KKFGL

SEQ ID NO: 2436776 - protein, 7 aa, Entamoeba dispar
KKFGNKS

SEQ ID NO: 2436777 - protein, 7 aa, Entamoeba dispar
KKFKDLN

SEQ ID NO: 2436778 - protein, 7 aa, Entamoeba dispar
KKFKDNK

SEQ ID NO: 2436779 - protein, 27 aa, Entamoeba dispar
KKFKPNYKTDEDDDLYEYEDSEEELTK

SEQ ID NO: 2436780 - protein, 10 aa, Entamoeba dispar
KKFKPSKDIQ

SEQ ID NO: 2436781 - protein, 4 aa, Entamoeba dispar
KKFN

SEQ ID NO: 2436782 - protein, 6 aa, Entamoeba dispar
KKFNKE

SEQ ID NO: 2436783 - protein, 6 aa, Entamoeba dispar
KKFNPL

SEQ ID NO: 2436784 - protein, 7 aa, Entamoeba dispar
KKFNPLN

SEQ ID NO: 2436785 - protein, 14 aa, Entamoeba dispar
KKFNSKKETVEGET

SEQ ID NO: 2436786 - protein, 13 aa, Entamoeba dispar
KKFPKKLKKSEKH

SEQ ID NO: 2436787 - protein, 6 aa, Entamoeba dispar
KKFRDA

SEQ ID NO: 2436788 - protein, 8 aa, Entamoeba dispar
KKFSDKSI

SEQ ID NO: 2436789 - protein, 6 aa, Entamoeba dispar
KKFSEA

SEQ ID NO: 2436790 - protein, 8 aa, Entamoeba dispar
KKFSNKRH

SEQ ID NO: 2436791 - protein, 8 aa, Entamoeba dispar
KKFSNNKN

SEQ ID NO: 2436792 - protein, 14 aa, Entamoeba dispar
KKFSRYRNSNYQDY

SEQ ID NO: 2436793 - protein, 8 aa, Entamoeba dispar
KKFTPEEI

SEQ ID NO: 2436794 - protein, 11 aa, Entamoeba dispar
KKFTPPKSYTW

SEQ ID NO: 2436795 - protein, 10 aa, Entamoeba dispar
KKGAMKPAVG

SEQ ID NO: 2436796 - protein, 15 aa, Entamoeba dispar
KKGANEATKALNRGK

SEQ ID NO: 2436797 - protein, 16 aa, Entamoeba dispar
KKGANETTKALNRGKA

SEQ ID NO: 2436798 - protein, 19 aa, Entamoeba dispar
KKGCEIKQQKECEHAGERY

SEQ ID NO: 2436799 - protein, 8 aa, Entamoeba dispar
KKGDDGDF

SEQ ID NO: 2436800 - protein, 17 aa, Entamoeba dispar
KKGDKFKVRATGGDAHL

SEQ ID NO: 2436801 - protein, 6 aa, Entamoeba dispar
KKGDNL

SEQ ID NO: 2436802 - protein, 7 aa, Entamoeba dispar
KKGDPFW

SEQ ID NO: 2436803 - protein, 9 aa, Entamoeba dispar
KKGDPNNEN

SEQ ID NO: 2436804 - protein, 15 aa, Entamoeba dispar
KKGEEGSKCHQRTYQ

SEQ ID NO: 2436805 - protein, 6 aa, Entamoeba dispar
KKGEEI

SEQ ID NO: 2436806 - protein, 19 aa, Entamoeba dispar
KKGEGLHQGDPNKKEELKQ

SEQ ID NO: 2436807 - protein, 19 aa, Entamoeba dispar
KKGEGMHKGDPDKKEDIKQ

SEQ ID NO: 2436808 - protein, 19 aa, Entamoeba dispar
KKGEGMHQGDPNKKEELKQ

SEQ ID NO: 2436809 - protein, 7 aa, Entamoeba dispar
KKGEKRC

SEQ ID NO: 2436810 - protein, 9 aa, Entamoeba dispar
KKGEKYEKD

SEQ ID NO: 2436811 - protein, 8 aa, Entamoeba dispar
KKGENGAI

SEQ ID NO: 2436812 - protein, 9 aa, Entamoeba dispar
KKGEREKRK

SEQ ID NO: 2436813 - protein, 8 aa, Entamoeba dispar
KKGGNVTQ

SEQ ID NO: 2436814 - protein, 6 aa, Entamoeba dispar
KKGGPW

SEQ ID NO: 2436815 - protein, 7 aa, Entamoeba dispar
KKGGRTI

SEQ ID NO: 2436816 - protein, 9 aa, Entamoeba dispar
KKGHLGASE

SEQ ID NO: 2436817 - protein, 7 aa, Entamoeba dispar
KKGICNT

SEQ ID NO: 2436818 - protein, 8 aa, Entamoeba dispar
KKGIDDNN

SEQ ID NO: 2436819 - protein, 6 aa, Entamoeba dispar
KKGIEK

SEQ ID NO: 2436820 - protein, 10 aa, Entamoeba dispar
KKGKDLSTKQ

SEQ ID NO: 2436821 - protein, 8 aa, Entamoeba dispar
KKGKEELE

SEQ ID NO: 2436822 - protein, 18 aa, Entamoeba dispar
KKGKGIFQGDPDKKEELK

SEQ ID NO: 2436823 - protein, 16 aa, Entamoeba dispar
KKGKKDIEEEEEEDII

SEQ ID NO: 2436824 - protein, 22 aa, Entamoeba dispar
KKGKNKKSSKKKGQQESTSPAE

SEQ ID NO: 2436825 - protein, 12 aa, Entamoeba dispar
KKGKQTSKAALS

SEQ ID NO: 2436826 - protein, 14 aa, Entamoeba dispar
KKGKSTKKTSRKVA

SEQ ID NO: 2436827 - protein, 7 aa, Entamoeba dispar
KKGMKKG

SEQ ID NO: 2436828 - protein, 7 aa, Entamoeba dispar
KKGNDFK

SEQ ID NO: 2436829 - protein, 7 aa, Entamoeba dispar
KKGNDKL

SEQ ID NO: 2436830 - protein, 7 aa, Entamoeba dispar
KKGNDVN

SEQ ID NO: 2436831 - protein, 14 aa, Entamoeba dispar
KKGNEFSNTTSEGY

SEQ ID NO: 2436832 - protein, 18 aa, Entamoeba dispar
KKGNGMSKGTPDNREELK

SEQ ID NO: 2436833 - protein, 8 aa, Entamoeba dispar
KKGNIEKC

SEQ ID NO: 2436834 - protein, 5 aa, Entamoeba dispar
KKGNL

SEQ ID NO: 2436835 - protein, 7 aa, Entamoeba dispar
KKGNLTP

SEQ ID NO: 2436836 - protein, 5 aa, Entamoeba dispar
KKGNQ

SEQ ID NO: 2436837 - protein, 18 aa, Entamoeba dispar
KKGNVCKNLSSSRATSKV

SEQ ID NO: 2436838 - protein, 11 aa, Entamoeba dispar
KKGNVSKSIDK

SEQ ID NO: 2436839 - protein, 5 aa, Entamoeba dispar
KKGNY

SEQ ID NO: 2436840 - protein, 8 aa, Entamoeba dispar
KKGPFKIT

SEQ ID NO: 2436841 - protein, 16 aa, Entamoeba dispar
KKGPGMYKGDPTLKED

SEQ ID NO: 2436842 - protein, 10 aa, Entamoeba dispar
KKGPKKKENI

SEQ ID NO: 2436843 - protein, 7 aa, Entamoeba dispar
KKGPTCR

SEQ ID NO: 2436844 - protein, 4 aa, Entamoeba dispar
KKGQ

SEQ ID NO: 2436845 - protein, 16 aa, Entamoeba dispar
KKGQGMYKGDPTLKED

SEQ ID NO: 2436846 - protein, 7 aa, Entamoeba dispar
KKGQPDL

SEQ ID NO: 2436847 - protein, 12 aa, Entamoeba dispar
KKGQQESTSPAE

SEQ ID NO: 2436848 - protein, 8 aa, Entamoeba dispar
KKGRPNQK

SEQ ID NO: 2436849 - protein, 7 aa, Entamoeba dispar
KKGRRTR

SEQ ID NO: 2436850 - protein, 7 aa, Entamoeba dispar
KKGRSFT

SEQ ID NO: 2436851 - protein, 14 aa, Entamoeba dispar
KKGSAILTKKQGGL

SEQ ID NO: 2436852 - protein, 8 aa, Entamoeba dispar
KKGSDGVY

SEQ ID NO: 2436853 - protein, 7 aa, Entamoeba dispar
KKGSIKG

SEQ ID NO: 2436854 - protein, 5 aa, Entamoeba dispar
KKGSL

SEQ ID NO: 2436855 - protein, 9 aa, Entamoeba dispar
KKGSNINKT

SEQ ID NO: 2436856 - protein, 5 aa, Entamoeba dispar
KKGSQ

SEQ ID NO: 2436857 - protein, 7 aa, Entamoeba dispar
KKGSRTD

SEQ ID NO: 2436858 - protein, 7 aa, Entamoeba dispar
KKGSTLE

SEQ ID NO: 2436859 - protein, 7 aa, Entamoeba dispar
KKGTFGY

SEQ ID NO: 2436860 - protein, 7 aa, Entamoeba dispar
KKGTNLS

SEQ ID NO: 2436861 - protein, 8 aa, Entamoeba dispar
KKGTPVTQ

SEQ ID NO: 2436862 - protein, 6 aa, Entamoeba dispar
KKGTYE

SEQ ID NO: 2436863 - protein, 4 aa, Entamoeba dispar
KKGV

SEQ ID NO: 2436864 - protein, 8 aa, Entamoeba dispar
KKGVDAAM

SEQ ID NO: 2436865 - protein, 13 aa, Entamoeba dispar
KKGVDRKNRSASV

SEQ ID NO: 2436866 - protein, 14 aa, Entamoeba dispar
KKGVELDQTLAEKK

SEQ ID NO: 2436867 - protein, 13 aa, Entamoeba dispar
KKGVTRSAVPITA

SEQ ID NO: 2436868 - protein, 17 aa, Entamoeba dispar
KKGVVEKESTSDRSTYC

SEQ ID NO: 2436869 - protein, 4 aa, Entamoeba dispar
KKGY

SEQ ID NO: 2436870 - protein, 6 aa, Entamoeba dispar
KKGYIP

SEQ ID NO: 2436871 - protein, 12 aa, Entamoeba dispar
KKHEGSRAHTYL

SEQ ID NO: 2436872 - protein, 18 aa, Entamoeba dispar
KKHGLSPRSSSSTVVDTG

SEQ ID NO: 2436873 - protein, 6 aa, Entamoeba dispar
KKHITD

SEQ ID NO: 2436874 - protein, 8 aa, Entamoeba dispar
KKHKERIE

SEQ ID NO: 2436875 - protein, 5 aa, Entamoeba dispar
KKHPD

SEQ ID NO: 2436876 - protein, 7 aa, Entamoeba dispar
KKHQKYS

SEQ ID NO: 2436877 - protein, 10 aa, Entamoeba dispar
KKHSAHSITS

SEQ ID NO: 2436878 - protein, 6 aa, Entamoeba dispar
KKHSQL

SEQ ID NO: 2436879 - protein, 7 aa, Entamoeba dispar
KKHSSSK

SEQ ID NO: 2436880 - protein, 7 aa, Entamoeba dispar
KKHTEAL

SEQ ID NO: 2436881 - protein, 8 aa, Entamoeba dispar
KKIADGST

SEQ ID NO: 2436882 - protein, 9 aa, Entamoeba dispar
KKIAESDGI

SEQ ID NO: 2436883 - protein, 7 aa, Entamoeba dispar
KKIAGDK

SEQ ID NO: 2436884 - protein, 13 aa, Entamoeba dispar
KKIANKEVKQNSI

SEQ ID NO: 2436885 - protein, 7 aa, Entamoeba dispar
KKIANSK

SEQ ID NO: 2436886 - protein, 5 aa, Entamoeba dispar
KKIDE

SEQ ID NO: 2436887 - protein, 9 aa, Entamoeba dispar
KKIDEEEQE

SEQ ID NO: 2436888 - protein, 5 aa, Entamoeba dispar
KKIDG

SEQ ID NO: 2436889 - protein, 49 aa, Entamoeba dispar
KKIDKEKAHESSTNTSLKSPVRRSKTSKKKISRSESVSDMTSTNESQVD

SEQ ID NO: 2436890 - protein, 7 aa, Entamoeba dispar
KKIDPDQ

SEQ ID NO: 2436891 - protein, 6 aa, Entamoeba dispar
KKIDSK

SEQ ID NO: 2436892 - protein, 9 aa, Entamoeba dispar
KKIDTKSPE

SEQ ID NO: 2436893 - protein, 10 aa, Entamoeba dispar
KKIDTTKKNK

SEQ ID NO: 2436894 - protein, 20 aa, Entamoeba dispar
KKIEEENSHQKKTTSSKEQK

SEQ ID NO: 2436895 - protein, 8 aa, Entamoeba dispar
KKIEEKPA

SEQ ID NO: 2436896 - protein, 8 aa, Entamoeba dispar
KKIEEKQE

SEQ ID NO: 2436897 - protein, 7 aa, Entamoeba dispar
KKIEEQY

SEQ ID NO: 2436898 - protein, 15 aa, Entamoeba dispar
KKIENEKVAKEKKEL

SEQ ID NO: 2436899 - protein, 11 aa, Entamoeba dispar
KKIENKKNSYL

SEQ ID NO: 2436900 - protein, 9 aa, Entamoeba dispar
KKIEQDNCK

SEQ ID NO: 2436901 - protein, 17 aa, Entamoeba dispar
KKIEQSQVSDTTSPQQL

SEQ ID NO: 2436902 - protein, 136 aa, Entamoeba dispar
KKIEQTKKELASKPKGISVSDTSLAPPPPPGVSSVPPPPPPPGVSSVPPPPPPPGVSSVPPPPPPPGMPGMPPPPPPPPGMPGMPPPPPPPGMPGMPPPPPPPGMPGMPPPPPGMPGMPPPPPGMPGMPPPPPGGF

SEQ ID NO: 2436903 - protein, 12 aa, Entamoeba dispar
KKIERDDKVDEF

SEQ ID NO: 2436904 - protein, 16 aa, Entamoeba dispar
KKIERRDPRFTEEGGK

SEQ ID NO: 2436905 - protein, 17 aa, Entamoeba dispar
KKIESDFSTKKENAIHD

SEQ ID NO: 2436906 - protein, 8 aa, Entamoeba dispar
KKIESLQR

SEQ ID NO: 2436907 - protein, 4 aa, Entamoeba dispar
KKIG

SEQ ID NO: 2436908 - protein, 6 aa, Entamoeba dispar
KKIGEK

SEQ ID NO: 2436909 - protein, 6 aa, Entamoeba dispar
KKIGKL

SEQ ID NO: 2436910 - protein, 6 aa, Entamoeba dispar
KKIGND

SEQ ID NO: 2436911 - protein, 6 aa, Entamoeba dispar
KKIGNE

SEQ ID NO: 2436912 - protein, 6 aa, Entamoeba dispar
KKIGNP

SEQ ID NO: 2436913 - protein, 12 aa, Entamoeba dispar
KKIGNSKQIEYN

SEQ ID NO: 2436914 - protein, 12 aa, Entamoeba dispar
KKIGNTTIETTE

SEQ ID NO: 2436915 - protein, 6 aa, Entamoeba dispar
KKIGQT

SEQ ID NO: 2436916 - protein, 5 aa, Entamoeba dispar
KKIIS

SEQ ID NO: 2436917 - protein, 20 aa, Entamoeba dispar
KKIKDEKEKIESKQRRYNQL

SEQ ID NO: 2436918 - protein, 20 aa, Entamoeba dispar
KKIKEEARKASKIEEGITQN

SEQ ID NO: 2436919 - protein, 19 aa, Entamoeba dispar
KKIKEKKKDIQKTVSDLQN

SEQ ID NO: 2436920 - protein, 30 aa, Entamoeba dispar
KKIKKTKKARKTVKRNGLKSDSSTYASFHF

SEQ ID NO: 2436921 - protein, 12 aa, Entamoeba dispar
KKIKNEQLPENE

SEQ ID NO: 2436922 - protein, 7 aa, Entamoeba dispar
KKILDER

SEQ ID NO: 2436923 - protein, 6 aa, Entamoeba dispar
KKINGK

SEQ ID NO: 2436924 - protein, 6 aa, Entamoeba dispar
KKINKN

SEQ ID NO: 2436925 - protein, 11 aa, Entamoeba dispar
KKINKTEEKTF

SEQ ID NO: 2436926 - protein, 8 aa, Entamoeba dispar
KKINNDDC

SEQ ID NO: 2436927 - protein, 11 aa, Entamoeba dispar
KKINNNNKEII

SEQ ID NO: 2436928 - protein, 11 aa, Entamoeba dispar
KKINRKEEIDV

SEQ ID NO: 2436929 - protein, 5 aa, Entamoeba dispar
KKINS

SEQ ID NO: 2436930 - protein, 13 aa, Entamoeba dispar
KKINSEDIPDGID

SEQ ID NO: 2436931 - protein, 37 aa, Entamoeba dispar
  misc_feature (24)..(25): Xaa can be any naturally occurring amino acid
KKINSEDIPDGIDKRKLIKDSVFXXKLIKLSKIYEKR

SEQ ID NO: 2436932 - protein, 7 aa, Entamoeba dispar
KKINSEQ

SEQ ID NO: 2436933 - protein, 8 aa, Entamoeba dispar
KKINSNYT

SEQ ID NO: 2436934 - protein, 53 aa, Entamoeba dispar
KKINTHHEEIKNNTNESNEEIEESTEESSSQTKDDIGKEEITTTLDDTSDSEQ

SEQ ID NO: 2436935 - protein, 7 aa, Entamoeba dispar
KKIPEEF

SEQ ID NO: 2436936 - protein, 6 aa, Entamoeba dispar
KKIPPE

SEQ ID NO: 2436937 - protein, 8 aa, Entamoeba dispar
KKIPSNGF

SEQ ID NO: 2436938 - protein, 16 aa, Entamoeba dispar
KKIQEENKKNEKIKRR

SEQ ID NO: 2436939 - protein, 8 aa, Entamoeba dispar
KKIQEGMQ

SEQ ID NO: 2436940 - protein, 7 aa, Entamoeba dispar
KKIQNQM

SEQ ID NO: 2436941 - protein, 7 aa, Entamoeba dispar
KKIQQTD

SEQ ID NO: 2436942 - protein, 10 aa, Entamoeba dispar
KKIQSQRDNL

SEQ ID NO: 2436943 - protein, 7 aa, Entamoeba dispar
KKIQTKI

SEQ ID NO: 2436944 - protein, 6 aa, Entamoeba dispar
KKIQVN

SEQ ID NO: 2436945 - protein, 11 aa, Entamoeba dispar
KKIRRSRRSLR

SEQ ID NO: 2436946 - protein, 4 aa, Entamoeba dispar
KKIS

SEQ ID NO: 2436947 - protein, 8 aa, Entamoeba dispar
KKISELTE

SEQ ID NO: 2436948 - protein, 7 aa, Entamoeba dispar
KKITNTN

SEQ ID NO: 2436949 - protein, 6 aa, Entamoeba dispar
KKITPN

SEQ ID NO: 2436950 - protein, 7 aa, Entamoeba dispar
KKITPNN

SEQ ID NO: 2436951 - protein, 11 aa, Entamoeba dispar
KKITSQEREKK

SEQ ID NO: 2436952 - protein, 58 aa, Entamoeba dispar
KKKATKTKVIDKQPPKMKTPVPITKSPLPKNKSSTHKTPSPLPSPSPRSMPTVQHSQK

SEQ ID NO: 2436953 - protein, 17 aa, Entamoeba dispar
KKKATTDKKILSQSGHP

SEQ ID NO: 2436954 - protein, 10 aa, Entamoeba dispar
KKKCKASNFS

SEQ ID NO: 2436955 - protein, 10 aa, Entamoeba dispar
KKKDDETKVK

SEQ ID NO: 2436956 - protein, 7 aa, Entamoeba dispar
KKKDDGK

SEQ ID NO: 2436957 - protein, 7 aa, Entamoeba dispar
KKKDGSL

SEQ ID NO: 2436958 - protein, 10 aa, Entamoeba dispar
KKKDISPIKL

SEQ ID NO: 2436959 - protein, 8 aa, Entamoeba dispar
KKKDKNDV

SEQ ID NO: 2436960 - protein, 110 aa, Entamoeba dispar
KKKDNEIKKKEEEVKKKEEEVENKESIIQEKDKEIEKKEEEIKKRDEEIKKKEEEIKNKEVEIKKKESTIQEKDEEIKNKEDEIKKKDEEIKNKEDEIKKKEEEVENKEN

SEQ ID NO: 2436961 - protein, 14 aa, Entamoeba dispar
KKKDPNNPNQPEEV

SEQ ID NO: 2436962 - protein, 9 aa, Entamoeba dispar
KKKDQEKLN

SEQ ID NO: 2436963 - protein, 5 aa, Entamoeba dispar
KKKDR

SEQ ID NO: 2436964 - protein, 9 aa, Entamoeba dispar
KKKDSQEEI

SEQ ID NO: 2436965 - protein, 7 aa, Entamoeba dispar
KKKDVTN

SEQ ID NO: 2436966 - protein, 4 aa, Entamoeba dispar
KKKE

SEQ ID NO: 2436967 - protein, 8 aa, Entamoeba dispar
KKKEAGNI

SEQ ID NO: 2436968 - protein, 7 aa, Entamoeba dispar
KKKECTN

SEQ ID NO: 2436969 - protein, 10 aa, Entamoeba dispar
KKKEDKKGKV

SEQ ID NO: 2436970 - protein, 13 aa, Entamoeba dispar
KKKEEEKIYNKTK

SEQ ID NO: 2436971 - protein, 20 aa, Entamoeba dispar
KKKEEENNLLEEEKKKVNTF

SEQ ID NO: 2436972 - protein, 12 aa, Entamoeba dispar
KKKEEEVNQKEK

SEQ ID NO: 2436973 - protein, 7 aa, Entamoeba dispar
KKKEEGL

SEQ ID NO: 2436974 - protein, 6 aa, Entamoeba dispar
KKKEEI

SEQ ID NO: 2436975 - protein, 14 aa, Entamoeba dispar
KKKEEKMKKGSVQK

SEQ ID NO: 2436976 - protein, 24 aa, Entamoeba dispar
KKKEELKGSIEKIKKEREEQEKKA

SEQ ID NO: 2436977 - protein, 13 aa, Entamoeba dispar
KKKEERAKRDAEF

SEQ ID NO: 2436978 - protein, 8 aa, Entamoeba dispar
KKKEETTV

SEQ ID NO: 2436979 - protein, 8 aa, Entamoeba dispar
KKKEFTPT

SEQ ID NO: 2436980 - protein, 42 aa, Entamoeba dispar
KKKEGISLKKKKEKKLVTPKKRGRKPKPKYSLSNEKKDRVKQ

SEQ ID NO: 2436981 - protein, 8 aa, Entamoeba dispar
KKKEINHL

SEQ ID NO: 2436982 - protein, 18 aa, Entamoeba dispar
KKKEINKEEKEEKKPYKN

SEQ ID NO: 2436983 - protein, 38 aa, Entamoeba dispar
KKKEKEKEKNELEKKKEEELKKTVETKEFEIGKENEVI

SEQ ID NO: 2436984 - protein, 25 aa, Entamoeba dispar
KKKEKKSGDESGCDSSVLDSSETVY

SEQ ID NO: 2436985 - protein, 9 aa, Entamoeba dispar
KKKEKNNNI

SEQ ID NO: 2436986 - protein, 6 aa, Entamoeba dispar
KKKEKW

SEQ ID NO: 2436987 - protein, 11 aa, Entamoeba dispar
KKKELNGMSSK

SEQ ID NO: 2436988 - protein, 7 aa, Entamoeba dispar
KKKELTP

SEQ ID NO: 2436989 - protein, 13 aa, Entamoeba dispar
KKKENEIEECSKQ

SEQ ID NO: 2436990 - protein, 9 aa, Entamoeba dispar
KKKENKSHG

SEQ ID NO: 2436991 - protein, 9 aa, Entamoeba dispar
KKKENYKKG

SEQ ID NO: 2436992 - protein, 5 aa, Entamoeba dispar
KKKER

SEQ ID NO: 2436993 - protein, 29 aa, Entamoeba dispar
KKKESQHKEESAKEEESVKEEESENTDKL

SEQ ID NO: 2436994 - protein, 9 aa, Entamoeba dispar
KKKEVEKTR

SEQ ID NO: 2436995 - protein, 6 aa, Entamoeba dispar
KKKEYQ

SEQ ID NO: 2436996 - protein, 7 aa, Entamoeba dispar
KKKEYTE

SEQ ID NO: 2436997 - protein, 5 aa, Entamoeba dispar
KKKGD

SEQ ID NO: 2436998 - protein, 14 aa, Entamoeba dispar
KKKGEKTPRTRRRT

SEQ ID NO: 2436999 - protein, 8 aa, Entamoeba dispar
KKKGFNSN

SEQ ID NO: 2437000 - protein, 10 aa, Entamoeba dispar
KKKGIENEKM

SEQ ID NO: 2437001 - protein, 6 aa, Entamoeba dispar
KKKGIF

SEQ ID NO: 2437002 - protein, 10 aa, Entamoeba dispar
KKKGIKKNEY

SEQ ID NO: 2437003 - protein, 7 aa, Entamoeba dispar
KKKGKKL

SEQ ID NO: 2437004 - protein, 8 aa, Entamoeba dispar
KKKGTEEV

SEQ ID NO: 2437005 - protein, 9 aa, Entamoeba dispar
KKKGTTKGS

SEQ ID NO: 2437006 - protein, 25 aa, Entamoeba dispar
KKKHKNTQLTGSKYDGIHLDYPLGW

SEQ ID NO: 2437007 - protein, 7 aa, Entamoeba dispar
KKKHTKV

SEQ ID NO: 2437008 - protein, 4 aa, Entamoeba dispar
KKKI

SEQ ID NO: 2437009 - protein, 13 aa, Entamoeba dispar
KKKIEEEKGVLDE

SEQ ID NO: 2437010 - protein, 8 aa, Entamoeba dispar
KKKISNEL

SEQ ID NO: 2437011 - protein, 16 aa, Entamoeba dispar
KKKKDEELKKSTESLD

SEQ ID NO: 2437012 - protein, 27 aa, Entamoeba dispar
KKKKEDKEKDKTDKKERKEKELERSAI

SEQ ID NO: 2437013 - protein, 55 aa, Entamoeba dispar
KKKKEEEMKRKSGIGKQQNQRYVRPKKTQSEREEESKEEEEKAIELEKKSNSERI

SEQ ID NO: 2437014 - protein, 9 aa, Entamoeba dispar
KKKKEGKEI

SEQ ID NO: 2437015 - protein, 8 aa, Entamoeba dispar
KKKKEKKS

SEQ ID NO: 2437016 - protein, 9 aa, Entamoeba dispar
KKKKEKNVS

SEQ ID NO: 2437017 - protein, 5 aa, Entamoeba dispar
KKKKF

SEQ ID NO: 2437018 - protein, 9 aa, Entamoeba dispar
KKKKGYYAT

SEQ ID NO: 2437019 - protein, 8 aa, Entamoeba dispar
KKKKISSA

SEQ ID NO: 2437020 - protein, 8 aa, Entamoeba dispar
KKKKITKT

SEQ ID NO: 2437021 - protein, 5 aa, Entamoeba dispar
KKKKK

SEQ ID NO: 2437022 - protein, 10 aa, Entamoeba dispar
KKKKKESQEF

SEQ ID NO: 2437023 - protein, 9 aa, Entamoeba dispar
KKKKKGNIY

SEQ ID NO: 2437024 - protein, 9 aa, Entamoeba dispar
KKKKMGWNE

SEQ ID NO: 2437025 - protein, 7 aa, Entamoeba dispar
KKKKPVR

SEQ ID NO: 2437026 - protein, 8 aa, Entamoeba dispar
KKKKQVKI

SEQ ID NO: 2437027 - protein, 24 aa, Entamoeba dispar
KKKKRINNKKIKEEEKEEEKEEEW

SEQ ID NO: 2437028 - protein, 7 aa, Entamoeba dispar
KKKKSEA

SEQ ID NO: 2437029 - protein, 35 aa, Entamoeba dispar
KKKKSFNKQQHNEKCRTSKLEEITSESVDDKSNEQ

SEQ ID NO: 2437030 - protein, 74 aa, Entamoeba dispar
KKKKSHKKTKDIEEEEEINKTEGEEKKKRKKKVKKEKELEKFEKTGKNKYIEYSSGEDCNREGLRRAKKKPVGI

SEQ ID NO: 2437031 - protein, 10 aa, Entamoeba dispar
KKKKSNSSHI

SEQ ID NO: 2437032 - protein, 7 aa, Entamoeba dispar
KKKKTLS

SEQ ID NO: 2437033 - protein, 21 aa, Entamoeba dispar
KKKKTRKKEMGNTHSSPTNRS

SEQ ID NO: 2437034 - protein, 13 aa, Entamoeba dispar
KKKLAKDVENYEN

SEQ ID NO: 2437035 - protein, 24 aa, Entamoeba dispar
KKKLDGSPNLDKKNSPMQTPRKVA

SEQ ID NO: 2437036 - protein, 7 aa, Entamoeba dispar
KKKLDQC

SEQ ID NO: 2437037 - protein, 14 aa, Entamoeba dispar
KKKMEEKEKVKQQF

SEQ ID NO: 2437038 - protein, 7 aa, Entamoeba dispar
KKKMSKE

SEQ ID NO: 2437039 - protein, 8 aa, Entamoeba dispar
KKKNGLKG

SEQ ID NO: 2437040 - protein, 11 aa, Entamoeba dispar
KKKNGNRQDKL

SEQ ID NO: 2437041 - protein, 9 aa, Entamoeba dispar
KKKNGYRES

SEQ ID NO: 2437042 - protein, 6 aa, Entamoeba dispar
KKKNKI

SEQ ID NO: 2437043 - protein, 15 aa, Entamoeba dispar
KKKNLHKRLPPNFKE

SEQ ID NO: 2437044 - protein, 9 aa, Entamoeba dispar
KKKNQRIQK

SEQ ID NO: 2437045 - protein, 7 aa, Entamoeba dispar
KKKNWKK

SEQ ID NO: 2437046 - protein, 9 aa, Entamoeba dispar
KKKPEKKFM

SEQ ID NO: 2437047 - protein, 7 aa, Entamoeba dispar
KKKPITT

SEQ ID NO: 2437048 - protein, 8 aa, Entamoeba dispar
KKKPKRKL

SEQ ID NO: 2437049 - protein, 6 aa, Entamoeba dispar
KKKPNF

SEQ ID NO: 2437050 - protein, 7 aa, Entamoeba dispar
KKKPNNI

SEQ ID NO: 2437051 - protein, 9 aa, Entamoeba dispar
KKKQEAQME

SEQ ID NO: 2437052 - protein, 39 aa, Entamoeba dispar
KKKQEEEEKKKEEAKKMEEEKPKEESKKENIPMEEEKKE

SEQ ID NO: 2437053 - protein, 24 aa, Entamoeba dispar
KKKQEKQEKEEKEERIEKQEQPLQ

SEQ ID NO: 2437054 - protein, 11 aa, Entamoeba dispar
KKKQENHEIQK

SEQ ID NO: 2437055 - protein, 12 aa, Entamoeba dispar
KKKQRNQSKMKS

SEQ ID NO: 2437056 - protein, 6 aa, Entamoeba dispar
KKKREE

SEQ ID NO: 2437057 - protein, 8 aa, Entamoeba dispar
KKKRHRGV

SEQ ID NO: 2437058 - protein, 14 aa, Entamoeba dispar
KKKRKADTSRRKED

SEQ ID NO: 2437059 - protein, 8 aa, Entamoeba dispar
KKKRKALE

SEQ ID NO: 2437060 - protein, 8 aa, Entamoeba dispar
KKKRSEQI

SEQ ID NO: 2437061 - protein, 10 aa, Entamoeba dispar
KKKSEKGTLR

SEQ ID NO: 2437062 - protein, 5 aa, Entamoeba dispar
KKKSF

SEQ ID NO: 2437063 - protein, 9 aa, Entamoeba dispar
KKKSITQED

SEQ ID NO: 2437064 - protein, 36 aa, Entamoeba dispar
KKKTEEIKKEEPKEEKEETDQSNNKEKSRISLEPNI

SEQ ID NO: 2437065 - protein, 10 aa, Entamoeba dispar
KKKTGINKEG

SEQ ID NO: 2437066 - protein, 5 aa, Entamoeba dispar
KKKTK

SEQ ID NO: 2437067 - protein, 10 aa, Entamoeba dispar
KKKTKKPEGM

SEQ ID NO: 2437068 - protein, 7 aa, Entamoeba dispar
KKKTKQE

SEQ ID NO: 2437069 - protein, 8 aa, Entamoeba dispar
KKKTPTQY

SEQ ID NO: 2437070 - protein, 8 aa, Entamoeba dispar
KKKTREKV

SEQ ID NO: 2437071 - protein, 10 aa, Entamoeba dispar
KKKTSEGDVD

SEQ ID NO: 2437072 - protein, 16 aa, Entamoeba dispar
KKKTTEMEEKINKNDQ

SEQ ID NO: 2437073 - protein, 7 aa, Entamoeba dispar
KKKTTSF

SEQ ID NO: 2437074 - protein, 4 aa, Entamoeba dispar
KKKV

SEQ ID NO: 2437075 - protein, 5 aa, Entamoeba dispar
KKKVH

SEQ ID NO: 2437076 - protein, 23 aa, Entamoeba dispar
KKKVPPPLPKQSHPKLTHSTQNE

SEQ ID NO: 2437077 - protein, 4 aa, Entamoeba dispar
KKKY

SEQ ID NO: 2437078 - protein, 7 aa, Entamoeba dispar
KKKYEDL

SEQ ID NO: 2437079 - protein, 9 aa, Entamoeba dispar
KKKYEGLDP

SEQ ID NO: 2437080 - protein, 6 aa, Entamoeba dispar
KKKYPD

SEQ ID NO: 2437081 - protein, 5 aa, Entamoeba dispar
KKLDQ

SEQ ID NO: 2437082 - protein, 4 aa, Entamoeba dispar
KKLE

SEQ ID NO: 2437083 - protein, 17 aa, Entamoeba dispar
KKLEETEKNAAAGSEEL

SEQ ID NO: 2437084 - protein, 5 aa, Entamoeba dispar
KKLEG

SEQ ID NO: 2437085 - protein, 35 aa, Entamoeba dispar
KKLENAKKRLEQDKDEADKAVSEQTIKRKGLEEEV

SEQ ID NO: 2437086 - protein, 6 aa, Entamoeba dispar
KKLENG

SEQ ID NO: 2437087 - protein, 9 aa, Entamoeba dispar
KKLESENEI

SEQ ID NO: 2437088 - protein, 13 aa, Entamoeba dispar
KKLESESYEDNLE

SEQ ID NO: 2437089 - protein, 7 aa, Entamoeba dispar
KKLESSS

SEQ ID NO: 2437090 - protein, 5 aa, Entamoeba dispar
KKLET

SEQ ID NO: 2437091 - protein, 10 aa, Entamoeba dispar
KKLETGKNVP

SEQ ID NO: 2437092 - protein, 7 aa, Entamoeba dispar
KKLETQQ

SEQ ID NO: 2437093 - protein, 8 aa, Entamoeba dispar
KKLGGGSF

SEQ ID NO: 2437094 - protein, 6 aa, Entamoeba dispar
KKLGNI

SEQ ID NO: 2437095 - protein, 10 aa, Entamoeba dispar
KKLGNSSIQN

SEQ ID NO: 2437096 - protein, 12 aa, Entamoeba dispar
KKLIGEAETQWN

SEQ ID NO: 2437097 - protein, 4 aa, Entamoeba dispar
KKLK

SEQ ID NO: 2437098 - protein, 8 aa, Entamoeba dispar
KKLKAEQQ

SEQ ID NO: 2437099 - protein, 10 aa, Entamoeba dispar
KKLKAQPTEL

SEQ ID NO: 2437100 - protein, 8 aa, Entamoeba dispar
KKLKEEEL

SEQ ID NO: 2437101 - protein, 8 aa, Entamoeba dispar
KKLKEELE

SEQ ID NO: 2437102 - protein, 20 aa, Entamoeba dispar
KKLKEETKPSRSGKKIKKSL

SEQ ID NO: 2437103 - protein, 11 aa, Entamoeba dispar
KKLKEGENYTI

SEQ ID NO: 2437104 - protein, 9 aa, Entamoeba dispar
KKLKENPGK

SEQ ID NO: 2437105 - protein, 16 aa, Entamoeba dispar
KKLKENPGKYFVANQF

SEQ ID NO: 2437106 - protein, 15 aa, Entamoeba dispar
KKLKGDAKRRNRRYG

SEQ ID NO: 2437107 - protein, 8 aa, Entamoeba dispar
KKLKGGEG

SEQ ID NO: 2437108 - protein, 8 aa, Entamoeba dispar
KKLKSKYK

SEQ ID NO: 2437109 - protein, 6 aa, Entamoeba dispar
KKLNKE

SEQ ID NO: 2437110 - protein, 7 aa, Entamoeba dispar
KKLNRVD

SEQ ID NO: 2437111 - protein, 6 aa, Entamoeba dispar
KKLPDY

SEQ ID NO: 2437112 - protein, 8 aa, Entamoeba dispar
KKLPEENK

SEQ ID NO: 2437113 - protein, 18 aa, Entamoeba dispar
KKLPKSGKNNTLTGSASL

SEQ ID NO: 2437114 - protein, 7 aa, Entamoeba dispar
KKLPNQY

SEQ ID NO: 2437115 - protein, 9 aa, Entamoeba dispar
KKLPPSINT

SEQ ID NO: 2437116 - protein, 8 aa, Entamoeba dispar
KKLPQPIQ

SEQ ID NO: 2437117 - protein, 14 aa, Entamoeba dispar
KKLPTKFEETIQTK

SEQ ID NO: 2437118 - protein, 6 aa, Entamoeba dispar
KKLQSQ

SEQ ID NO: 2437119 - protein, 11 aa, Entamoeba dispar
KKLRDEKETAI

SEQ ID NO: 2437120 - protein, 12 aa, Entamoeba dispar
KKLRKSNEAVGL

SEQ ID NO: 2437121 - protein, 9 aa, Entamoeba dispar
KKLSDISNE

SEQ ID NO: 2437122 - protein, 7 aa, Entamoeba dispar
KKLSEIN

SEQ ID NO: 2437123 - protein, 6 aa, Entamoeba dispar
KKLSGK

SEQ ID NO: 2437124 - protein, 7 aa, Entamoeba dispar
KKLSLEE

SEQ ID NO: 2437125 - protein, 13 aa, Entamoeba dispar
KKLSQQTNQPVSN

SEQ ID NO: 2437126 - protein, 5 aa, Entamoeba dispar
KKLSS

SEQ ID NO: 2437127 - protein, 28 aa, Entamoeba dispar
KKLSTESIEESQEKRKQKEEGPSPNKSI

SEQ ID NO: 2437128 - protein, 7 aa, Entamoeba dispar
KKLTEEK

SEQ ID NO: 2437129 - protein, 14 aa, Entamoeba dispar
KKLTEESDTIPDPL

SEQ ID NO: 2437130 - protein, 11 aa, Entamoeba dispar
KKLTHDQNTSC

SEQ ID NO: 2437131 - protein, 38 aa, Entamoeba dispar; identical to SEQ ID NO: 2367609

SEQ ID NO: 2437132 - protein, 8 aa, Entamoeba dispar
KKLTNNKS

SEQ ID NO: 2437133 - protein, 7 aa, Entamoeba dispar
KKLTPGS

SEQ ID NO: 2437134 - protein, 8 aa, Entamoeba dispar
KKLTPTQE

SEQ ID NO: 2437135 - protein, 6 aa, Entamoeba dispar
KKLTSS

SEQ ID NO: 2437136 - protein, 9 aa, Entamoeba dispar
KKLTTESKE

SEQ ID NO: 2437137 - protein, 9 aa, Entamoeba dispar
KKMDGERKY

SEQ ID NO: 2437138 - protein, 7 aa, Entamoeba dispar
KKMEDSR

SEQ ID NO: 2437139 - protein, 18 aa, Entamoeba dispar
KKMEECSSIDNSKTDTID

SEQ ID NO: 2437140 - protein, 5 aa, Entamoeba dispar
KKMGD

SEQ ID NO: 2437141 - protein, 5 aa, Entamoeba dispar
KKMGM

SEQ ID NO: 2437142 - protein, 13 aa, Entamoeba dispar
KKMKEAKKDKKLN

SEQ ID NO: 2437143 - protein, 7 aa, Entamoeba dispar
KKMKERM

SEQ ID NO: 2437144 - protein, 13 aa, Entamoeba dispar
KKMKQPTESPKTL

SEQ ID NO: 2437145 - protein, 7 aa, Entamoeba dispar
KKMQTKK

SEQ ID NO: 2437146 - protein, 5 aa, Entamoeba dispar
KKNAV

SEQ ID NO: 2437147 - protein, 5 aa, Entamoeba dispar
KKNDK

SEQ ID NO: 2437148 - protein, 6 aa, Entamoeba dispar
KKNDKS

SEQ ID NO: 2437149 - protein, 7 aa, Entamoeba dispar
KKNDPEF

SEQ ID NO: 2437150 - protein, 8 aa, Entamoeba dispar
KKNDPIKK

SEQ ID NO: 2437151 - protein, 8 aa, Entamoeba dispar
KKNDRKSY

SEQ ID NO: 2437152 - protein, 9 aa, Entamoeba dispar
KKNDRPSSI

SEQ ID NO: 2437153 - protein, 8 aa, Entamoeba dispar
KKNDSNCI

SEQ ID NO: 2437154 - protein, 7 aa, Entamoeba dispar
KKNEEAI

SEQ ID NO: 2437155 - protein, 7 aa, Entamoeba dispar
KKNEEIE

SEQ ID NO: 2437156 - protein, 6 aa, Entamoeba dispar
KKNEEM

SEQ ID NO: 2437157 - protein, 7 aa, Entamoeba dispar
KKNEEMN

SEQ ID NO: 2437158 - protein, 6 aa, Entamoeba dispar
KKNEGI

SEQ ID NO: 2437159 - protein, 17 aa, Entamoeba dispar
KKNEGNSIAKHKKKCIL

SEQ ID NO: 2437160 - protein, 17 aa, Entamoeba dispar
KKNEGNSIAKHKKKCTL

SEQ ID NO: 2437161 - protein, 6 aa, Entamoeba dispar
KKNEIG

SEQ ID NO: 2437162 - protein, 9 aa, Entamoeba dispar
KKNEIHNKM

SEQ ID NO: 2437163 - protein, 8 aa, Entamoeba dispar
KKNEKKPV

SEQ ID NO: 2437164 - protein, 7 aa, Entamoeba dispar
KKNEKQN

SEQ ID NO: 2437165 - protein, 7 aa, Entamoeba dispar
KKNEKTI

SEQ ID NO: 2437166 - protein, 6 aa, Entamoeba dispar
KKNELD

SEQ ID NO: 2437167 - protein, 7 aa, Entamoeba dispar
KKNEMQG

SEQ ID NO: 2437168 - protein, 10 aa, Entamoeba dispar
KKNEMRPRSV

SEQ ID NO: 2437169 - protein, 7 aa, Entamoeba dispar
KKNEQTN

SEQ ID NO: 2437170 - protein, 14 aa, Entamoeba dispar
KKNERIPRNCFDEC

SEQ ID NO: 2437171 - protein, 8 aa, Entamoeba dispar
KKNESDHF

SEQ ID NO: 2437172 - protein, 12 aa, Entamoeba dispar
KKNESHNKMNQD

SEQ ID NO: 2437173 - protein, 6 aa, Entamoeba dispar
KKNESP

SEQ ID NO: 2437174 - protein, 6 aa, Entamoeba dispar
KKNETI

SEQ ID NO: 2437175 - protein, 7 aa, Entamoeba dispar
KKNEVKS

SEQ ID NO: 2437176 - protein, 4 aa, Entamoeba dispar
KKNG

SEQ ID NO: 2437177 - protein, 8 aa, Entamoeba dispar
KKNGSEMV

SEQ ID NO: 2437178 - protein, 8 aa, Entamoeba dispar
KKNGTKIY

SEQ ID NO: 2437179 - protein, 5 aa, Entamoeba dispar
KKNGV

SEQ ID NO: 2437180 - protein, 6 aa, Entamoeba dispar
KKNGYN

SEQ ID NO: 2437181 - protein, 8 aa, Entamoeba dispar
KKNGYRES

SEQ ID NO: 2437182 - protein, 8 aa, Entamoeba dispar
KKNGYSQK

SEQ ID NO: 2437183 - protein, 9 aa, Entamoeba dispar
KKNIAPNKG

SEQ ID NO: 2437184 - protein, 13 aa, Entamoeba dispar
KKNIKKKQRNVGG

SEQ ID NO: 2437185 - protein, 7 aa, Entamoeba dispar
KKNIPKE

SEQ ID NO: 2437186 - protein, 9 aa, Entamoeba dispar
KKNKAISEE

SEQ ID NO: 2437187 - protein, 11 aa, Entamoeba dispar
KKNKEDGKSNI

SEQ ID NO: 2437188 - protein, 9 aa, Entamoeba dispar
KKNKEEEVL

SEQ ID NO: 2437189 - protein, 15 aa, Entamoeba dispar
KKNKEKNKEMISESK

SEQ ID NO: 2437190 - protein, 10 aa, Entamoeba dispar
KKNKENSNAI

SEQ ID NO: 2437191 - protein, 6 aa, Entamoeba dispar
KKNKES

SEQ ID NO: 2437192 - protein, 10 aa, Entamoeba dispar
KKNKETTHSQ

SEQ ID NO: 2437193 - protein, 7 aa, Entamoeba dispar
KKNKEVY

SEQ ID NO: 2437194 - protein, 7 aa, Entamoeba dispar
KKNKILN

SEQ ID NO: 2437195 - protein, 8 aa, Entamoeba dispar
KKNKLGEY

SEQ ID NO: 2437196 - protein, 5 aa, Entamoeba dispar
KKNKN

SEQ ID NO: 2437197 - protein, 12 aa, Entamoeba dispar
KKNKNIPEDSFK

SEQ ID NO: 2437198 - protein, 13 aa, Entamoeba dispar
KKNKRIPRDCFNK

SEQ ID NO: 2437199 - protein, 29 aa, Entamoeba dispar
KKNKRKLMRSESERNMLSPSEPKTDGKKL

SEQ ID NO: 2437200 - protein, 22 aa, Entamoeba dispar
KKNKSLNSNEHKPIKPPKTTLM

SEQ ID NO: 2437201 - protein, 18 aa, Entamoeba dispar
KKNKTGYTKFDPERYQRT

SEQ ID NO: 2437202 - protein, 8 aa, Entamoeba dispar
KKNMEPSH

SEQ ID NO: 2437203 - protein, 9 aa, Entamoeba dispar
KKNNDEEKD

SEQ ID NO: 2437204 - protein, 9 aa, Entamoeba dispar
KKNNEKSFS

SEQ ID NO: 2437205 - protein, 14 aa, Entamoeba dispar
KKNNISASSLTQNE

SEQ ID NO: 2437206 - protein, 5 aa, Entamoeba dispar
KKNNK

SEQ ID NO: 2437207 - protein, 7 aa, Entamoeba dispar
KKNNNEF

SEQ ID NO: 2437208 - protein, 8 aa, Entamoeba dispar
KKNNNKID

SEQ ID NO: 2437209 - protein, 9 aa, Entamoeba dispar
KKNNQESGI

SEQ ID NO: 2437210 - protein, 12 aa, Entamoeba dispar
KKNNREGGTTDF

SEQ ID NO: 2437211 - protein, 8 aa, Entamoeba dispar
KKNNSAMD

SEQ ID NO: 2437212 - protein, 8 aa, Entamoeba dispar
KKNNSELA

SEQ ID NO: 2437213 - protein, 9 aa, Entamoeba dispar
KKNNSISNE

SEQ ID NO: 2437214 - protein, 6 aa, Entamoeba dispar
KKNNSK

SEQ ID NO: 2437215 - protein, 5 aa, Entamoeba dispar
KKNNV

SEQ ID NO: 2437216 - protein, 6 aa, Entamoeba dispar
KKNPFA

SEQ ID NO: 2437217 - protein, 8 aa, Entamoeba dispar
KKNPKEIK

SEQ ID NO: 2437218 - protein, 6 aa, Entamoeba dispar
KKNPLQ

SEQ ID NO: 2437219 - protein, 9 aa, Entamoeba dispar
KKNPQSPLY

SEQ ID NO: 2437220 - protein, 8 aa, Entamoeba dispar
KKNQDDQI

SEQ ID NO: 2437221 - protein, 6 aa, Entamoeba dispar
KKNQEC

SEQ ID NO: 2437222 - protein, 10 aa, Entamoeba dispar
KKNQEEQKSC

SEQ ID NO: 2437223 - protein, 17 aa, Entamoeba dispar
KKNQEITTNKNTPPIPQ

SEQ ID NO: 2437224 - protein, 9 aa, Entamoeba dispar
KKNREEEEV

SEQ ID NO: 2437225 - protein, 9 aa, Entamoeba dispar
KKNRGKEPF

SEQ ID NO: 2437226 - protein, 7 aa, Entamoeba dispar
KKNRSNF

SEQ ID NO: 2437227 - protein, 7 aa, Entamoeba dispar
KKNRYTD

SEQ ID NO: 2437228 - protein, 7 aa, Entamoeba dispar
KKNRYTM

SEQ ID NO: 2437229 - protein, 29 aa, Entamoeba dispar
KKNSDEKKKRIEKAEQQKAKKKGEEKKKV

SEQ ID NO: 2437230 - protein, 5 aa, Entamoeba dispar
KKNSF

SEQ ID NO: 2437231 - protein, 15 aa, Entamoeba dispar
KKNSHDIDITSEGIS

SEQ ID NO: 2437232 - protein, 4 aa, Entamoeba dispar
KKNT

SEQ ID NO: 2437233 - protein, 10 aa, Entamoeba dispar
KKNTDQKAVN

SEQ ID NO: 2437234 - protein, 11 aa, Entamoeba dispar
KKNTERMKEKN

SEQ ID NO: 2437235 - protein, 7 aa, Entamoeba dispar
KKNTGNV

SEQ ID NO: 2437236 - protein, 29 aa, Entamoeba dispar
KKNTTSHIGNNDENKNIGGNNKNKKEYTR

SEQ ID NO: 2437237 - protein, 7 aa, Entamoeba dispar
KKNTTTL

SEQ ID NO: 2437238 - protein, 6 aa, Entamoeba dispar
KKNYIE

SEQ ID NO: 2437239 - protein, 20 aa, Entamoeba dispar
KKNYKESNEYKRKRRALRQE

SEQ ID NO: 2437240 - protein, 16 aa, Entamoeba dispar
KKNYKKPLPNNLEEDL

SEQ ID NO: 2437241 - protein, 15 aa, Entamoeba dispar
KKNYSESRKTQLENL

SEQ ID NO: 2437242 - protein, 9 aa, Entamoeba dispar
KKNYVKQPN

SEQ ID NO: 2437243 - protein, 4 aa, Entamoeba dispar
KKPD

SEQ ID NO: 2437244 - protein, 10 aa, Entamoeba dispar
KKPDNDSVSL

SEQ ID NO: 2437245 - protein, 18 aa, Entamoeba dispar
KKPEEDAKEIAKERIPSP

SEQ ID NO: 2437246 - protein, 21 aa, Entamoeba dispar
KKPEINSCDEKKVEKSQSKIK

SEQ ID NO: 2437247 - protein, 8 aa, Entamoeba dispar
KKPENECL

SEQ ID NO: 2437248 - protein, 10 aa, Entamoeba dispar
KKPENKQVGL

SEQ ID NO: 2437249 - protein, 20 aa, Entamoeba dispar
KKPENVNGQLQNTSQNNNTN

SEQ ID NO: 2437250 - protein, 9 aa, Entamoeba dispar
KKPERRSQK

SEQ ID NO: 2437251 - protein, 10 aa, Entamoeba dispar
KKPERRSQKT

SEQ ID NO: 2437252 - protein, 8 aa, Entamoeba dispar
KKPETKIH

SEQ ID NO: 2437253 - protein, 6 aa, Entamoeba dispar
KKPFED

SEQ ID NO: 2437254 - protein, 13 aa, Entamoeba dispar
KKPFKQENGSQFT

SEQ ID NO: 2437255 - protein, 8 aa, Entamoeba dispar
KKPFPPAR

SEQ ID NO: 2437256 - protein, 8 aa, Entamoeba dispar
KKPFVKPK

SEQ ID NO: 2437257 - protein, 8 aa, Entamoeba dispar
KKPGCKGK

SEQ ID NO: 2437258 - protein, 8 aa, Entamoeba dispar
KKPGCSGK

SEQ ID NO: 2437259 - protein, 6 aa, Entamoeba dispar
KKPGRG

SEQ ID NO: 2437260 - protein, 12 aa, Entamoeba dispar
KKPHKKSKTTSQ

SEQ ID NO: 2437261 - protein, 4 aa, Entamoeba dispar
KKPI

SEQ ID NO: 2437262 - protein, 5 aa, Entamoeba dispar
KKPIE

SEQ ID NO: 2437263 - protein, 6 aa, Entamoeba dispar
KKPIEE

SEQ ID NO: 2437264 - protein, 6 aa, Entamoeba dispar
KKPIGG

SEQ ID NO: 2437265 - protein, 6 aa, Entamoeba dispar
KKPIHE

SEQ ID NO: 2437266 - protein, 9 aa, Entamoeba dispar
KKPISGRSV

SEQ ID NO: 2437267 - protein, 5 aa, Entamoeba dispar
KKPIT

SEQ ID NO: 2437268 - protein, 9 aa, Entamoeba dispar
KKPITTSDM

SEQ ID NO: 2437269 - protein, 7 aa, Entamoeba dispar
KKPKCLP

SEQ ID NO: 2437270 - protein, 9 aa, Entamoeba dispar
KKPKHSKNL

SEQ ID NO: 2437271 - protein, 10 aa, Entamoeba dispar
KKPKINIPTY

SEQ ID NO: 2437272 - protein, 9 aa, Entamoeba dispar
KKPKNILEP

SEQ ID NO: 2437273 - protein, 6 aa, Entamoeba dispar
KKPKRI

SEQ ID NO: 2437274 - protein, 122 aa, Entamoeba dispar
KKPKTEETKEKKSKKKETKIAEEEKEEVEKEEVSVKENEEEETKEDTKAIKKFKGESDEKKEKKEAKKDEGHKKLSKEEKKALKKQKRAEKKAKKQVDEENEEKTSEEKEKHTELKQQTKEF

SEQ ID NO: 2437275 - protein, 8 aa, Entamoeba dispar
KKPKTITE

SEQ ID NO: 2437276 - protein, 15 aa, Entamoeba dispar
KKPKVDLNVEDTDYD

SEQ ID NO: 2437277 - protein, 17 aa, Entamoeba dispar
KKPLAKPELLTKKENDI

SEQ ID NO: 2437278 - protein, 9 aa, Entamoeba dispar
KKPLGTNPF

SEQ ID NO: 2437279 - protein, 9 aa, Entamoeba dispar
KKPLKDRNA

SEQ ID NO: 2437280 - protein, 6 aa, Entamoeba dispar
KKPLKQ

SEQ ID NO: 2437281 - protein, 12 aa, Entamoeba dispar
KKPLRKSMKTLS

SEQ ID NO: 2437282 - protein, 5 aa, Entamoeba dispar
KKPLT

SEQ ID NO: 2437283 - protein, 4 aa, Entamoeba dispar
KKPN

SEQ ID NO: 2437284 - protein, 22 aa, Entamoeba dispar
KKPNERKKHLSKGTQQQTPHKE

SEQ ID NO: 2437285 - protein, 8 aa, Entamoeba dispar
KKPNETNC

SEQ ID NO: 2437286 - protein, 7 aa, Entamoeba dispar
KKPNGNG

SEQ ID NO: 2437287 - protein, 5 aa, Entamoeba dispar
KKPNI

SEQ ID NO: 2437288 - protein, 7 aa, Entamoeba dispar
KKPNIIS

SEQ ID NO: 2437289 - protein, 7 aa, Entamoeba dispar
KKPNPSL

SEQ ID NO: 2437290 - protein, 6 aa, Entamoeba dispar
KKPNSE

SEQ ID NO: 2437291 - protein, 9 aa, Entamoeba dispar
KKPNSSPSF

SEQ ID NO: 2437292 - protein, 6 aa, Entamoeba dispar
KKPPTF

SEQ ID NO: 2437293 - protein, 15 aa, Entamoeba dispar
KKPPTPTKKRITETT

SEQ ID NO: 2437294 - protein, 8 aa, Entamoeba dispar
KKPPTVSL

SEQ ID NO: 2437295 - protein, 5 aa, Entamoeba dispar
KKPQI

SEQ ID NO: 2437296 - protein, 5 aa, Entamoeba dispar
KKPQV

SEQ ID NO: 2437297 - protein, 8 aa, Entamoeba dispar
KKPRKVEK

SEQ ID NO: 2437298 - protein, 138 aa, Entamoeba dispar
  misc_feature (19)..(20): Xaa can be any naturally occurring amino acid
KKPSEIKKESSSKTTPTQXXRSVLFNGGKSLKEKEKKEDSKPQPTEKKQSRIESVETTTQKNGRQPLPPNPEKKEQHKPTLPTRNTSSITQPSKLSTPSKQNSLATSKQEKENKPTPLPKKGCVKPKVPEKKEEPITD

SEQ ID NO: 2437299 - protein, 6 aa, Entamoeba dispar
KKPSYY

SEQ ID NO: 2437300 - protein, 4 aa, Entamoeba dispar
KKPT

SEQ ID NO: 2437301 - protein, 6 aa, Entamoeba dispar
KKPTFK

SEQ ID NO: 2437302 - protein, 5 aa, Entamoeba dispar
KKPTI

SEQ ID NO: 2437303 - protein, 11 aa, Entamoeba dispar
KKPTNKPTKPY

SEQ ID NO: 2437304 - protein, 6 aa, Entamoeba dispar
KKPTNM

SEQ ID NO: 2437305 - protein, 7 aa, Entamoeba dispar
KKPTQKL

SEQ ID NO: 2437306 - protein, 7 aa, Entamoeba dispar
KKPTSVC

SEQ ID NO: 2437307 - protein, 29 aa, Entamoeba dispar
KKPVEEPQTTSPQVASPRESNQSKRSGGW

SEQ ID NO: 2437308 - protein, 6 aa, Entamoeba dispar
KKPYDQ

SEQ ID NO: 2437309 - protein, 7 aa, Entamoeba dispar
KKPYGEM

SEQ ID NO: 2437310 - protein, 14 aa, Entamoeba dispar
KKPYKHDSKEAKEL

SEQ ID NO: 2437311 - protein, 9 aa, Entamoeba dispar
KKPYRGMNK

SEQ ID NO: 2437312 - protein, 6 aa, Entamoeba dispar
KKQAIA

SEQ ID NO: 2437313 - protein, 7 aa, Entamoeba dispar
KKQAPKL

SEQ ID NO: 2437314 - protein, 7 aa, Entamoeba dispar
KKQAVGT

SEQ ID NO: 2437315 - protein, 7 aa, Entamoeba dispar
KKQDDTT

SEQ ID NO: 2437316 - protein, 6 aa, Entamoeba dispar
KKQDEL

SEQ ID NO: 2437317 - protein, 7 aa, Entamoeba dispar
KKQDIQG

SEQ ID NO: 2437318 - protein, 6 aa, Entamoeba dispar
KKQDYY

SEQ ID NO: 2437319 - protein, 15 aa, Entamoeba dispar
KKQEAVRKHREETVD

SEQ ID NO: 2437320 - protein, 11 aa, Entamoeba dispar
KKQEDCKSTLE

SEQ ID NO: 2437321 - protein, 10 aa, Entamoeba dispar
KKQEDIESTK

SEQ ID NO: 2437322 - protein, 21 aa, Entamoeba dispar
KKQEDKYKTPLEEDIPQPKYD

SEQ ID NO: 2437323 - protein, 11 aa, Entamoeba dispar
KKQEEDIAKVD

SEQ ID NO: 2437324 - protein, 34 aa, Entamoeba dispar
KKQEERKRKKPKRTTSSTEKSNKASSKQKRVRDS

SEQ ID NO: 2437325 - protein, 7 aa, Entamoeba dispar
KKQEETK

SEQ ID NO: 2437326 - protein, 17 aa, Entamoeba dispar
KKQEKEQKQTEKEQEEL

SEQ ID NO: 2437327 - protein, 7 aa, Entamoeba dispar
KKQEKIK

SEQ ID NO: 2437328 - protein, 8 aa, Entamoeba dispar
KKQENERR

SEQ ID NO: 2437329 - protein, 17 aa, Entamoeba dispar
KKQEQDDSELQNQIKEG

SEQ ID NO: 2437330 - protein, 13 aa, Entamoeba dispar
KKQEQKEETPVTK

SEQ ID NO: 2437331 - protein, 8 aa, Entamoeba dispar
KKQESVAA

SEQ ID NO: 2437332 - protein, 5 aa, Entamoeba dispar
KKQEV

SEQ ID NO: 2437333 - protein, 9 aa, Entamoeba dispar
KKQEYHGGP

SEQ ID NO: 2437334 - protein, 17 aa, Entamoeba dispar
KKQFEDTAREWTRMYAK

SEQ ID NO: 2437335 - protein, 17 aa, Entamoeba dispar
KKQFEDTAREWTRMYAR

SEQ ID NO: 2437336 - protein, 8 aa, Entamoeba dispar
KKQGGAPC

SEQ ID NO: 2437337 - protein, 9 aa, Entamoeba dispar
KKQGGSVKN

SEQ ID NO: 2437338 - protein, 19 aa, Entamoeba dispar
KKQGIGEREKKEMKEKEIE

SEQ ID NO: 2437339 - protein, 10 aa, Entamoeba dispar
KKQGMTQKEK

SEQ ID NO: 2437340 - protein, 15 aa, Entamoeba dispar
KKQHEQHRDITERNQ

SEQ ID NO: 2437341 - protein, 5 aa, Entamoeba dispar
KKQIE

SEQ ID NO: 2437342 - protein, 12 aa, Entamoeba dispar
KKQIEEKTDSFK

SEQ ID NO: 2437343 - protein, 31 aa, Entamoeba dispar
KKQIPSDGIGSPKSPRSNHIPNTSVSTLPAG

SEQ ID NO: 2437344 - protein, 10 aa, Entamoeba dispar
KKQKEEDENN

SEQ ID NO: 2437345 - protein, 15 aa, Entamoeba dispar
KKQKEEEDQKSIPGW

SEQ ID NO: 2437346 - protein, 9 aa, Entamoeba dispar
KKQKEEETF

SEQ ID NO: 2437347 - protein, 26 aa, Entamoeba dispar
KKQKEKKPKKTKTSSTLKKLKEKEVI

SEQ ID NO: 2437348 - protein, 13 aa, Entamoeba dispar
KKQKKEHANDEEQ

SEQ ID NO: 2437349 - protein, 14 aa, Entamoeba dispar
KKQKKSAEKTYQIQ

SEQ ID NO: 2437350 - protein, 6 aa, Entamoeba dispar
KKQKTI

SEQ ID NO: 2437351 - protein, 4 aa, Entamoeba dispar
KKQL

SEQ ID NO: 2437352 - protein, 12 aa, Entamoeba dispar
KKQLKGWQNYSG

SEQ ID NO: 2437353 - protein, 8 aa, Entamoeba dispar
KKQLNAEQ

SEQ ID NO: 2437354 - protein, 9 aa, Entamoeba dispar
KKQLPSNPM

SEQ ID NO: 2437355 - protein, 9 aa, Entamoeba dispar
KKQLYSKNE

SEQ ID NO: 2437356 - protein, 26 aa, Entamoeba dispar
KKQMKKEEDRITGGKKRVPRKQFSGK

SEQ ID NO: 2437357 - protein, 13 aa, Entamoeba dispar
KKQNDQSIKKQLS

SEQ ID NO: 2437358 - protein, 16 aa, Entamoeba dispar
KKQNELRKKKKMRENP

SEQ ID NO: 2437359 - protein, 11 aa, Entamoeba dispar
KKQNETNQQNL

SEQ ID NO: 2437360 - protein, 9 aa, Entamoeba dispar
KKQNKKGGE

SEQ ID NO: 2437361 - protein, 10 aa, Entamoeba dispar
KKQNKQTEME

SEQ ID NO: 2437362 - protein, 8 aa, Entamoeba dispar
KKQNKTKI

SEQ ID NO: 2437363 - protein, 9 aa, Entamoeba dispar
KKQPEIPQQ

SEQ ID NO: 2437364 - protein, 6 aa, Entamoeba dispar
KKQPEL

SEQ ID NO: 2437365 - protein, 7 aa, Entamoeba dispar
KKQPNRC

SEQ ID NO: 2437366 - protein, 5 aa, Entamoeba dispar
KKQPT

SEQ ID NO: 2437367 - protein, 8 aa, Entamoeba dispar
KKQPTAAV

SEQ ID NO: 2437368 - protein, 4 aa, Entamoeba dispar
KKQQ

SEQ ID NO: 2437369 - protein, 11 aa, Entamoeba dispar
KKQQDESEKEI

SEQ ID NO: 2437370 - protein, 38 aa, Entamoeba dispar
KKQQEALNEQTAAQNASIDEKIKNSKPIVPKEEQVKTG

SEQ ID NO: 2437371 - protein, 20 aa, Entamoeba dispar
KKQQIDQQQNQLNSQKLLPD

SEQ ID NO: 2437372 - protein, 17 aa, Entamoeba dispar
KKQQIEEKRKKKEQEQL

SEQ ID NO: 2437373 - protein, 11 aa, Entamoeba dispar
KKQQNDEEIKL

SEQ ID NO: 2437374 - protein, 6 aa, Entamoeba dispar
KKQRKE

SEQ ID NO: 2437375 - protein, 10 aa, Entamoeba dispar
KKQRKQYTIT

SEQ ID NO: 2437376 - protein, 7 aa, Entamoeba dispar
KKQRSPI

SEQ ID NO: 2437377 - protein, 9 aa, Entamoeba dispar
KKQSEDTHK

SEQ ID NO: 2437378 - protein, 7 aa, Entamoeba dispar
KKQSEIS

SEQ ID NO: 2437379 - protein, 7 aa, Entamoeba dispar
KKQSEKM

SEQ ID NO: 2437380 - protein, 36 aa, Entamoeba dispar
KKQSIVDSVDNDKERAASRVREEVEKYTKRFGDEGL

SEQ ID NO: 2437381 - protein, 5 aa, Entamoeba dispar
KKQSK

SEQ ID NO: 2437382 - protein, 15 aa, Entamoeba dispar
KKQSKKCTITSPTPL

SEQ ID NO: 2437383 - protein, 6 aa, Entamoeba dispar
KKQSLP

SEQ ID NO: 2437384 - protein, 7 aa, Entamoeba dispar
KKQSQEL

SEQ ID NO: 2437385 - protein, 6 aa, Entamoeba dispar
KKQTPG

SEQ ID NO: 2437386 - protein, 15 aa, Entamoeba dispar
KKQTSEEEIQKIEEQ

SEQ ID NO: 2437387 - protein, 17 aa, Entamoeba dispar
KKQTTQEKEQSKEEEVL

SEQ ID NO: 2437388 - protein, 10 aa, Entamoeba dispar
KKQTTTRDDD

SEQ ID NO: 2437389 - protein, 6 aa, Entamoeba dispar
KKQVNR

SEQ ID NO: 2437390 - protein, 7 aa, Entamoeba dispar
KKQWKKE

SEQ ID NO: 2437391 - protein, 7 aa, Entamoeba dispar
KKQYLEK

SEQ ID NO: 2437392 - protein, 11 aa, Entamoeba dispar
KKRAKKNETIA

SEQ ID NO: 2437393 - protein, 9 aa, Entamoeba dispar
KKRARDAKL

SEQ ID NO: 2437394 - protein, 5 aa, Entamoeba dispar
KKRAV

SEQ ID NO: 2437395 - protein, 5 aa, Entamoeba dispar
KKRDC

SEQ ID NO: 2437396 - protein, 16 aa, Entamoeba dispar
KKRDPEKDKKRRAGYR

SEQ ID NO: 2437397 - protein, 10 aa, Entamoeba dispar
KKRDQTLNNA

SEQ ID NO: 2437398 - protein, 11 aa, Entamoeba dispar
KKRDYTKGRVT

SEQ ID NO: 2437399 - protein, 10 aa, Entamoeba dispar
KKREDDASKI

SEQ ID NO: 2437400 - protein, 16 aa, Entamoeba dispar
KKREEIEKLKEHFSKF

SEQ ID NO: 2437401 - protein, 27 aa, Entamoeba dispar
KKREENKPKKKEKDIKKKKQLTKLLSK

SEQ ID NO: 2437402 - protein, 8 aa, Entamoeba dispar
KKREKQIE

SEQ ID NO: 2437403 - protein, 8 aa, Entamoeba dispar
KKRENGEF

SEQ ID NO: 2437404 - protein, 10 aa, Entamoeba dispar
KKREQEKNQL

SEQ ID NO: 2437405 - protein, 8 aa, Entamoeba dispar
KKRERNRM

SEQ ID NO: 2437406 - protein, 6 aa, Entamoeba dispar
KKRETL

SEQ ID NO: 2437407 - protein, 11 aa, Entamoeba dispar
KKRFDTNESEV

SEQ ID NO: 2437408 - protein, 10 aa, Entamoeba dispar
KKRFPTKAKR

SEQ ID NO: 2437409 - protein, 8 aa, Entamoeba dispar
KKRGAEEV

SEQ ID NO: 2437410 - protein, 6 aa, Entamoeba dispar
KKRGSS

SEQ ID NO: 2437411 - protein, 6 aa, Entamoeba dispar
KKRHIG

SEQ ID NO: 2437412 - protein, 6 aa, Entamoeba dispar
KKRHQL

SEQ ID NO: 2437413 - protein, 7 aa, Entamoeba dispar
KKRIDKN

SEQ ID NO: 2437414 - protein, 17 aa, Entamoeba dispar
KKRKDKKEKKEEEKIEG

SEQ ID NO: 2437415 - protein, 10 aa, Entamoeba dispar
KKRKESAPDI

SEQ ID NO: 2437416 - protein, 17 aa, Entamoeba dispar
KKRKGSISTGSPYSLEN

SEQ ID NO: 2437417 - protein, 9 aa, Entamoeba dispar
KKRKKNEIS

SEQ ID NO: 2437418 - protein, 19 aa, Entamoeba dispar
KKRKLKQSDFVKGGDKAKN

SEQ ID NO: 2437419 - protein, 18 aa, Entamoeba dispar
KKRKLSDIRKSNQNIPES

SEQ ID NO: 2437420 - protein, 18 aa, Entamoeba dispar
KKRKLSDIRKSNQSIPES

SEQ ID NO: 2437421 - protein, 6 aa, Entamoeba dispar
KKRKNG

SEQ ID NO: 2437422 - protein, 10 aa, Entamoeba dispar
KKRKSTINQN

SEQ ID NO: 2437423 - protein, 5 aa, Entamoeba dispar
KKRKV

SEQ ID NO: 2437424 - protein, 7 aa, Entamoeba dispar
KKRKVGS

SEQ ID NO: 2437425 - protein, 6 aa, Entamoeba dispar
KKRKYY

SEQ ID NO: 2437426 - protein, 47 aa, Entamoeba dispar
KKRLEAENEQLKKEQEQLKDVKEKKIKEKRTEKKKDMKIKESPIIST

SEQ ID NO: 2437427 - protein, 61 aa, Entamoeba dispar
  misc_feature (51)..(52): Xaa can be any naturally occurring amino acid
KKRLEAENEQLKKEQEQLKDVKEKKIKEKRTEKKKDMKIKESPIISTTYSXXKHVEVIGIS

SEQ ID NO: 2437428 - protein, 6 aa, Entamoeba dispar
KKRLNA

SEQ ID NO: 2437429 - protein, 10 aa, Entamoeba dispar
KKRLSKTTYK

SEQ ID NO: 2437430 - protein, 13 aa, Entamoeba dispar
KKRMNEENKGIRE

SEQ ID NO: 2437431 - protein, 4 aa, Entamoeba dispar
KKRN

SEQ ID NO: 2437432 - protein, 6 aa, Entamoeba dispar
KKRNEL

SEQ ID NO: 2437433 - protein, 9 aa, Entamoeba dispar
KKRNERRNK

SEQ ID NO: 2437434 - protein, 6 aa, Entamoeba dispar
KKRNIN

SEQ ID NO: 2437435 - protein, 10 aa, Entamoeba dispar
KKRNNQENIK

SEQ ID NO: 2437436 - protein, 8 aa, Entamoeba dispar
KKRNNTIT

SEQ ID NO: 2437437 - protein, 16 aa, Entamoeba dispar
KKRNVAQGIEPPQYPA

SEQ ID NO: 2437438 - protein, 7 aa, Entamoeba dispar
KKRNYHQ

SEQ ID NO: 2437439 - protein, 8 aa, Entamoeba dispar
KKRPIKNE

SEQ ID NO: 2437440 - protein, 10 aa, Entamoeba dispar
KKRPPTTQKI

SEQ ID NO: 2437441 - protein, 6 aa, Entamoeba dispar
KKRPSI

SEQ ID NO: 2437442 - protein, 17 aa, Entamoeba dispar
KKRPSISIEKKERGGIK

SEQ ID NO: 2437443 - protein, 37 aa, Entamoeba dispar
KKRPSKKHRTKGTKTVAQAERDAVGNTKQTTEKATAR

SEQ ID NO: 2437444 - protein, 14 aa, Entamoeba dispar
KKRQADAERINAEY

SEQ ID NO: 2437445 - protein, 7 aa, Entamoeba dispar
KKRQNGD

SEQ ID NO: 2437446 - protein, 6 aa, Entamoeba dispar
KKRQYN

SEQ ID NO: 2437447 - protein, 17 aa, Entamoeba dispar
KKRRNSVSSCSSITSSI

SEQ ID NO: 2437448 - protein, 10 aa, Entamoeba dispar
KKRRPSASVS

SEQ ID NO: 2437449 - protein, 5 aa, Entamoeba dispar
KKRRS

SEQ ID NO: 2437450 - protein, 9 aa, Entamoeba dispar
KKRSEIPTK

SEQ ID NO: 2437451 - protein, 7 aa, Entamoeba dispar
KKRSETV

SEQ ID NO: 2437452 - protein, 7 aa, Entamoeba dispar
KKRSHNK

SEQ ID NO: 2437453 - protein, 10 aa, Entamoeba dispar
KKRSKPKNKL

SEQ ID NO: 2437454 - protein, 6 aa, Entamoeba dispar
KKRSSL

SEQ ID NO: 2437455 - protein, 11 aa, Entamoeba dispar
KKRSVTQGNKK

SEQ ID NO: 2437456 - protein, 7 aa, Entamoeba dispar
KKRTADI

SEQ ID NO: 2437457 - protein, 8 aa, Entamoeba dispar
KKRTESLG

SEQ ID NO: 2437458 - protein, 9 aa, Entamoeba dispar
KKRTRSDTD

SEQ ID NO: 2437459 - protein, 16 aa, Entamoeba dispar
KKRTVACKKRGQTAWA

SEQ ID NO: 2437460 - protein, 6 aa, Entamoeba dispar
KKRVGE

SEQ ID NO: 2437461 - protein, 7 aa, Entamoeba dispar
KKRVQPE

SEQ ID NO: 2437462 - protein, 7 aa, Entamoeba dispar
KKRYKEE

SEQ ID NO: 2437463 - protein, 7 aa, Entamoeba dispar
KKSAAAA

SEQ ID NO: 2437464 - protein, 6 aa, Entamoeba dispar
KKSAGN

SEQ ID NO: 2437465 - protein, 10 aa, Entamoeba dispar
KKSCSENEEF

SEQ ID NO: 2437466 - protein, 25 aa, Entamoeba dispar
KKSDASQWENLTKTQQNHHQQSATN

SEQ ID NO: 2437467 - protein, 7 aa, Entamoeba dispar
KKSDIDK

SEQ ID NO: 2437468 - protein, 6 aa, Entamoeba dispar
KKSDYQ

SEQ ID NO: 2437469 - protein, 5 aa, Entamoeba dispar
KKSEC

SEQ ID NO: 2437470 - protein, 19 aa, Entamoeba dispar
KKSEEKSKKSKEKIQYKNN

SEQ ID NO: 2437471 - protein, 9 aa, Entamoeba dispar
KKSELENKV

SEQ ID NO: 2437472 - protein, 8 aa, Entamoeba dispar
KKSENNKL

SEQ ID NO: 2437473 - protein, 8 aa, Entamoeba dispar
KKSEQVPK

SEQ ID NO: 2437474 - protein, 22 aa, Entamoeba dispar
KKSETNSQISSTTSSKKSKVSL

SEQ ID NO: 2437475 - protein, 6 aa, Entamoeba dispar
KKSFHN

SEQ ID NO: 2437476 - protein, 6 aa, Entamoeba dispar
KKSFIS

SEQ ID NO: 2437477 - protein, 10 aa, Entamoeba dispar
KKSFSGNSHC

SEQ ID NO: 2437478 - protein, 10 aa, Entamoeba dispar
KKSGKEVDGR

SEQ ID NO: 2437479 - protein, 6 aa, Entamoeba dispar
KKSGLK

SEQ ID NO: 2437480 - protein, 40 aa, Entamoeba dispar
KKSGSKKSKEEIKKELERKKEDLVQGQKSTLDKNCESCVI

SEQ ID NO: 2437481 - protein, 35 aa, Entamoeba dispar
  misc_feature (23)..(24): Xaa can be any naturally occurring amino acid
KKSGSKKSKEKIKKELERKKKDXXTLDKNCESCVI

SEQ ID NO: 2437482 - protein, 40 aa, Entamoeba dispar
KKSGSKKSKQEIKKELERKKEDLVQGEKSTLDKNCESCVI

SEQ ID NO: 2437483 - protein, 4 aa, Entamoeba dispar
KKSI

SEQ ID NO: 2437484 - protein, 29 aa, Entamoeba dispar
KKSIDEANNKDFQNTEAKQNEKEETITTY

SEQ ID NO: 2437485 - protein, 6 aa, Entamoeba dispar
KKSIGP

SEQ ID NO: 2437486 - protein, 23 aa, Entamoeba dispar
KKSINKSQEVKETSSQVPSSVTE

SEQ ID NO: 2437487 - protein, 14 aa, Entamoeba dispar
KKSITGKTQNNDLK

SEQ ID NO: 2437488 - protein, 13 aa, Entamoeba dispar
KKSITNSYTEAKY

SEQ ID NO: 2437489 - protein, 20 aa, Entamoeba dispar
KKSITTPSDGVPIKKSFSFS

SEQ ID NO: 2437490 - protein, 9 aa, Entamoeba dispar
KKSKEEMEV

SEQ ID NO: 2437491 - protein, 7 aa, Entamoeba dispar
KKSKEWK

SEQ ID NO: 2437492 - protein, 12 aa, Entamoeba dispar
KKSKIIPTNPIP

SEQ ID NO: 2437493 - protein, 8 aa, Entamoeba dispar
KKSKKCPT

SEQ ID NO: 2437494 - protein, 14 aa, Entamoeba dispar
KKSKKGNEDTETSF

SEQ ID NO: 2437495 - protein, 8 aa, Entamoeba dispar
KKSKNLLP

SEQ ID NO: 2437496 - protein, 9 aa, Entamoeba dispar
KKSKPTNTS

SEQ ID NO: 2437497 - protein, 8 aa, Entamoeba dispar
KKSKRSLM

SEQ ID NO: 2437498 - protein, 39 aa, Entamoeba dispar
KKSKSAKFEEEGYEKEDKKEKKEKKRKEEKENDKKRHSV

SEQ ID NO: 2437499 - protein, 43 aa, Entamoeba dispar
KKSKSKEDVSNSTPTTPGKKGVDKENNHDNNNTKDHGRQTTKD

SEQ ID NO: 2437500 - protein, 8 aa, Entamoeba dispar
KKSKTLPK

SEQ ID NO: 2437501 - protein, 7 aa, Entamoeba dispar
KKSKTQI

SEQ ID NO: 2437502 - protein, 12 aa, Entamoeba dispar
KKSKTSSKINGN

SEQ ID NO: 2437503 - protein, 11 aa, Entamoeba dispar
KKSKTTRPTYV

SEQ ID NO: 2437504 - protein, 5 aa, Entamoeba dispar
KKSKV

SEQ ID NO: 2437505 - protein, 5 aa, Entamoeba dispar
KKSLD

SEQ ID NO: 2437506 - protein, 22 aa, Entamoeba dispar
KKSLEETKRKRSHSRHSTETQL

SEQ ID NO: 2437507 - protein, 6 aa, Entamoeba dispar
KKSLEN

SEQ ID NO: 2437508 - protein, 5 aa, Entamoeba dispar
KKSLT

SEQ ID NO: 2437509 - protein, 6 aa, Entamoeba dispar
KKSLVN

SEQ ID NO: 2437510 - protein, 7 aa, Entamoeba dispar
KKSNEIS

SEQ ID NO: 2437511 - protein, 21 aa, Entamoeba dispar
KKSNEKSTDDKKDKDKRCCNL

SEQ ID NO: 2437512 - protein, 7 aa, Entamoeba dispar
KKSNESA

SEQ ID NO: 2437513 - protein, 10 aa, Entamoeba dispar
KKSNGSNENK

SEQ ID NO: 2437514 - protein, 12 aa, Entamoeba dispar
KKSNRMEKGKAM

SEQ ID NO: 2437515 - protein, 7 aa, Entamoeba dispar
KKSNSMI

SEQ ID NO: 2437516 - protein, 6 aa, Entamoeba dispar
KKSNVF

SEQ ID NO: 2437517 - protein, 19 aa, Entamoeba dispar
KKSPIIRKKTTKKMVRIAE

SEQ ID NO: 2437518 - protein, 6 aa, Entamoeba dispar
KKSPIK

SEQ ID NO: 2437519 - protein, 6 aa, Entamoeba dispar
KKSPIP

SEQ ID NO: 2437520 - protein, 21 aa, Entamoeba dispar
KKSPKLSERSSRSKMSKTPDL

SEQ ID NO: 2437521 - protein, 7 aa, Entamoeba dispar
KKSPLVT

SEQ ID NO: 2437522 - protein, 12 aa, Entamoeba dispar
KKSPMGWVKVDI

SEQ ID NO: 2437523 - protein, 12 aa, Entamoeba dispar
KKSQKDNREQSD

SEQ ID NO: 2437524 - protein, 10 aa, Entamoeba dispar
KKSRGYTESL

SEQ ID NO: 2437525 - protein, 8 aa, Entamoeba dispar
KKSRRMSA

SEQ ID NO: 2437526 - protein, 9 aa, Entamoeba dispar
KKSRRTPEL

SEQ ID NO: 2437527 - protein, 14 aa, Entamoeba dispar
KKSSDWKKGVNPDE

SEQ ID NO: 2437528 - protein, 10 aa, Entamoeba dispar
KKSSEDPAKV

SEQ ID NO: 2437529 - protein, 11 aa, Entamoeba dispar
KKSSEEVEDEI

SEQ ID NO: 2437530 - protein, 7 aa, Entamoeba dispar
KKSSFES

SEQ ID NO: 2437531 - protein, 7 aa, Entamoeba dispar
KKSSFGT

SEQ ID NO: 2437532 - protein, 9 aa, Entamoeba dispar
KKSSGKKGA

SEQ ID NO: 2437533 - protein, 24 aa, Entamoeba dispar
KKSSLVEENDDQGIKEAKEEIQQQ

SEQ ID NO: 2437534 - protein, 8 aa, Entamoeba dispar
KKSSNGIY

SEQ ID NO: 2437535 - protein, 14 aa, Entamoeba dispar
KKSSSFKKHGRTPR

SEQ ID NO: 2437536 - protein, 26 aa, Entamoeba dispar
KKSSSTIKSGIPSGGFAPSAPSISAS

SEQ ID NO: 2437537 - protein, 23 aa, Entamoeba dispar
KKSSVIQKRKETPSNHSQEQRYD

SEQ ID NO: 2437538 - protein, 13 aa, Entamoeba dispar
KKSSVNEELTENE

SEQ ID NO: 2437539 - protein, 7 aa, Entamoeba dispar
KKSSYIE

SEQ ID NO: 2437540 - protein, 7 aa, Entamoeba dispar
KKSTGDV

SEQ ID NO: 2437541 - protein, 9 aa, Entamoeba dispar
KKSTKTSPL

SEQ ID NO: 2437542 - protein, 8 aa, Entamoeba dispar
KKSTNNLE

SEQ ID NO: 2437543 - protein, 9 aa, Entamoeba dispar
KKSTRGYGY

SEQ ID NO: 2437544 - protein, 8 aa, Entamoeba dispar
KKSTSFET

SEQ ID NO: 2437545 - protein, 4 aa, Entamoeba dispar
KKSV

SEQ ID NO: 2437546 - protein, 17 aa, Entamoeba dispar
KKSVASENDQSESEESI

SEQ ID NO: 2437547 - protein, 6 aa, Entamoeba dispar
KKSVEP

SEQ ID NO: 2437548 - protein, 18 aa, Entamoeba dispar
KKSVIGQKNAPKSQTPIV

SEQ ID NO: 2437549 - protein, 8 aa, Entamoeba dispar
KKSVITVP

SEQ ID NO: 2437550 - protein, 5 aa, Entamoeba dispar
KKSVK

SEQ ID NO: 2437551 - protein, 7 aa, Entamoeba dispar
KKSVKAE

SEQ ID NO: 2437552 - protein, 16 aa, Entamoeba dispar
KKSVSTKEESTFSKHD

SEQ ID NO: 2437553 - protein, 4 aa, Entamoeba dispar
KKSY

SEQ ID NO: 2437554 - protein, 5 aa, Entamoeba dispar
KKSYL

SEQ ID NO: 2437555 - protein, 8 aa, Entamoeba dispar
KKTAKERE

SEQ ID NO: 2437556 - protein, 20 aa, Entamoeba dispar
KKTAQKKENTPEKKSQEEVP

SEQ ID NO: 2437557 - protein, 7 aa, Entamoeba dispar
KKTDESI

SEQ ID NO: 2437558 - protein, 6 aa, Entamoeba dispar
KKTDRS

SEQ ID NO: 2437559 - protein, 7 aa, Entamoeba dispar
KKTDSFD

SEQ ID NO: 2437560 - protein, 8 aa, Entamoeba dispar
KKTEDQQL

SEQ ID NO: 2437561 - protein, 9 aa, Entamoeba dispar
KKTEETQTL

SEQ ID NO: 2437562 - protein, 8 aa, Entamoeba dispar
KKTEKNEK

SEQ ID NO: 2437563 - protein, 7 aa, Entamoeba dispar
KKTEKQI

SEQ ID NO: 2437564 - protein, 7 aa, Entamoeba dispar
KKTEKSH

SEQ ID NO: 2437565 - protein, 18 aa, Entamoeba dispar
KKTEMRKQKGGNHKKGGK

SEQ ID NO: 2437566 - protein, 6 aa, Entamoeba dispar
KKTERF

SEQ ID NO: 2437567 - protein, 29 aa, Entamoeba dispar
KKTERITSRISQDLSSQHNQEVKKNPEVV

SEQ ID NO: 2437568 - protein, 8 aa, Entamoeba dispar
KKTEYDEQ

SEQ ID NO: 2437569 - protein, 8 aa, Entamoeba dispar
KKTEYDKQ

SEQ ID NO: 2437570 - protein, 12 aa, Entamoeba dispar
KKTGEKSRSFTA

SEQ ID NO: 2437571 - protein, 11 aa, Entamoeba dispar
KKTGKEGKINE

SEQ ID NO: 2437572 - protein, 9 aa, Entamoeba dispar
KKTGKINKI

SEQ ID NO: 2437573 - protein, 7 aa, Entamoeba dispar
KKTGNDL

SEQ ID NO: 2437574 - protein, 10 aa, Entamoeba dispar
KKTHNPEEKP

SEQ ID NO: 2437575 - protein, 8 aa, Entamoeba dispar
KKTHPNFS

SEQ ID NO: 2437576 - protein, 16 aa, Entamoeba dispar
KKTHQISEHNGRTESS

SEQ ID NO: 2437577 - protein, 11 aa, Entamoeba dispar
KKTIDTEYESM

SEQ ID NO: 2437578 - protein, 8 aa, Entamoeba dispar
KKTIERKG

SEQ ID NO: 2437579 - protein, 14 aa, Entamoeba dispar
KKTIGAPDASVPIG

SEQ ID NO: 2437580 - protein, 9 aa, Entamoeba dispar
KKTINQQKY

SEQ ID NO: 2437581 - protein, 24 aa, Entamoeba dispar
KKTIPKPLHRTTNSLNISTSTINS

SEQ ID NO: 2437582 - protein, 20 aa, Entamoeba dispar
KKTIRGESKRSNSVGNPEEI

SEQ ID NO: 2437583 - protein, 38 aa, Entamoeba dispar
KKTKALQSSKKVEVPEGTFNNNEIEMDSESNGGDNISE

SEQ ID NO: 2437584 - protein, 8 aa, Entamoeba dispar
KKTKEDCY

SEQ ID NO: 2437585 - protein, 9 aa, Entamoeba dispar
KKTKEERAV

SEQ ID NO: 2437586 - protein, 8 aa, Entamoeba dispar
KKTKEIQS

SEQ ID NO: 2437587 - protein, 9 aa, Entamoeba dispar
KKTKEQLKA

SEQ ID NO: 2437588 - protein, 7 aa, Entamoeba dispar
KKTKIIQ

SEQ ID NO: 2437589 - protein, 7 aa, Entamoeba dispar
KKTKISD

SEQ ID NO: 2437590 - protein, 8 aa, Entamoeba dispar
KKTKLSDI

SEQ ID NO: 2437591 - protein, 7 aa, Entamoeba dispar
KKTKNPM

SEQ ID NO: 2437592 - protein, 9 aa, Entamoeba dispar
KKTKPKNLS

SEQ ID NO: 2437593 - protein, 22 aa, Entamoeba dispar
KKTKPTKQEEKDKQNKDETKKY

SEQ ID NO: 2437594 - protein, 12 aa, Entamoeba dispar
KKTKQPSISLPR

SEQ ID NO: 2437595 - protein, 7 aa, Entamoeba dispar
KKTKRAV

SEQ ID NO: 2437596 - protein, 12 aa, Entamoeba dispar
KKTKRNKLNSQQ

SEQ ID NO: 2437597 - protein, 8 aa, Entamoeba dispar
KKTKSTFE

SEQ ID NO: 2437598 - protein, 15 aa, Entamoeba dispar
KKTKTIDSTKNKQFK

SEQ ID NO: 2437599 - protein, 5 aa, Entamoeba dispar
KKTKY

SEQ ID NO: 2437600 - protein, 8 aa, Entamoeba dispar
KKTLSKDD

SEQ ID NO: 2437601 - protein, 16 aa, Entamoeba dispar
KKTLSNTHSNENEPTF

SEQ ID NO: 2437602 - protein, 8 aa, Entamoeba dispar
KKTLTTPI

SEQ ID NO: 2437603 - protein, 4 aa, Entamoeba dispar
KKTN

SEQ ID NO: 2437604 - protein, 14 aa, Entamoeba dispar
KKTNGMTDGTEKRK

SEQ ID NO: 2437605 - protein, 15 aa, Entamoeba dispar
KKTNGMTDGTEKRKD

SEQ ID NO: 2437606 - protein, 5 aa, Entamoeba dispar
KKTNL

SEQ ID NO: 2437607 - protein, 6 aa, Entamoeba dispar
KKTNMK

SEQ ID NO: 2437608 - protein, 20 aa, Entamoeba dispar
KKTNNDKEKALSELKGNPLE

SEQ ID NO: 2437609 - protein, 7 aa, Entamoeba dispar
KKTNSRL

SEQ ID NO: 2437610 - protein, 7 aa, Entamoeba dispar
KKTNYED

SEQ ID NO: 2437611 - protein, 8 aa, Entamoeba dispar
KKTPTLDN

SEQ ID NO: 2437612 - protein, 8 aa, Entamoeba dispar
KKTQEIKQ

SEQ ID NO: 2437613 - protein, 5 aa, Entamoeba dispar
KKTQF

SEQ ID NO: 2437614 - protein, 8 aa, Entamoeba dispar
KKTQFTPS

SEQ ID NO: 2437615 - protein, 10 aa, Entamoeba dispar
KKTQNEKKAL

SEQ ID NO: 2437616 - protein, 9 aa, Entamoeba dispar
KKTQVELEG

SEQ ID NO: 2437617 - protein, 8 aa, Entamoeba dispar
KKTREEVQ

SEQ ID NO: 2437618 - protein, 6 aa, Entamoeba dispar
KKTRSV

SEQ ID NO: 2437619 - protein, 10 aa, Entamoeba dispar
KKTSDEKTKS

SEQ ID NO: 2437620 - protein, 7 aa, Entamoeba dispar
KKTSNNI

SEQ ID NO: 2437621 - protein, 6 aa, Entamoeba dispar
KKTSPI

SEQ ID NO: 2437622 - protein, 10 aa, Entamoeba dispar
KKTSQDNEMI

SEQ ID NO: 2437623 - protein, 18 aa, Entamoeba dispar
KKTSTQLRDKINNTRSSY

SEQ ID NO: 2437624 - protein, 10 aa, Entamoeba dispar
KKTSTTKPNE

SEQ ID NO: 2437625 - protein, 41 aa, Entamoeba dispar
KKTSYPKEEKESSTQDSESNPPLRNVPEKTRPPGVPGGQPL

SEQ ID NO: 2437626 - protein, 4 aa, Entamoeba dispar
KKTT

SEQ ID NO: 2437627 - protein, 7 aa, Entamoeba dispar
KKTTDKV

SEQ ID NO: 2437628 - protein, 6 aa, Entamoeba dispar
KKTTEH

SEQ ID NO: 2437629 - protein, 10 aa, Entamoeba dispar
KKTTFEKKTI

SEQ ID NO: 2437630 - protein, 7 aa, Entamoeba dispar
KKTTGDV

SEQ ID NO: 2437631 - protein, 8 aa, Entamoeba dispar
KKTTLGRC

SEQ ID NO: 2437632 - protein, 8 aa, Entamoeba dispar
KKTTPYDT

SEQ ID NO: 2437633 - protein, 24 aa, Entamoeba dispar
KKTTSIIDKESSTTTKKTNKKKVI

SEQ ID NO: 2437634 - protein, 6 aa, Entamoeba dispar
KKTTTV

SEQ ID NO: 2437635 - protein, 8 aa, Entamoeba dispar
KKTYENTI

SEQ ID NO: 2437636 - protein, 5 aa, Entamoeba dispar
KKTYN

SEQ ID NO: 2437637 - protein, 7 aa, Entamoeba dispar
KKVARGE

SEQ ID NO: 2437638 - protein, 10 aa, Entamoeba dispar
KKVATSFTGG

SEQ ID NO: 2437639 - protein, 14 aa, Entamoeba dispar
KKVCESKTNEGNRI

SEQ ID NO: 2437640 - protein, 8 aa, Entamoeba dispar
KKVDASDK

SEQ ID NO: 2437641 - protein, 9 aa, Entamoeba dispar
KKVDGQNKG

SEQ ID NO: 2437642 - protein, 4 aa, Entamoeba dispar
KKVE

SEQ ID NO: 2437643 - protein, 8 aa, Entamoeba dispar
KKVEDNEV

SEQ ID NO: 2437644 - protein, 31 aa, Entamoeba dispar
KKVEDNNTKGLSQRKLPSPYSLGNSQMSKGT

SEQ ID NO: 2437645 - protein, 9 aa, Entamoeba dispar
KKVEEEKTK

SEQ ID NO: 2437646 - protein, 14 aa, Entamoeba dispar
KKVEEKRIKRESGK

SEQ ID NO: 2437647 - protein, 21 aa, Entamoeba dispar
KKVEELKEKGNKIEKDVQERF

SEQ ID NO: 2437648 - protein, 12 aa, Entamoeba dispar
KKVEETKPKKED

SEQ ID NO: 2437649 - protein, 11 aa, Entamoeba dispar
KKVEQEAGRRK

SEQ ID NO: 2437650 - protein, 9 aa, Entamoeba dispar
KKVEQEKRK

SEQ ID NO: 2437651 - protein, 7 aa, Entamoeba dispar
KKVERSI

SEQ ID NO: 2437652 - protein, 19 aa, Entamoeba dispar
KKVGAHEGRVHKNNKYTQR

SEQ ID NO: 2437653 - protein, 18 aa, Entamoeba dispar
KKVGAHNGRVHKNNAYTQ

SEQ ID NO: 2437654 - protein, 11 aa, Entamoeba dispar
KKVGKHLPGKS

SEQ ID NO: 2437655 - protein, 6 aa, Entamoeba dispar
KKVGKL

SEQ ID NO: 2437656 - protein, 9 aa, Entamoeba dispar
KKVGNDIEV

SEQ ID NO: 2437657 - protein, 29 aa, Entamoeba dispar
KKVHEEEEDNDDDDNEDDMNNNIKENQNN

SEQ ID NO: 2437658 - protein, 9 aa, Entamoeba dispar
KKVKEEEGC

SEQ ID NO: 2437659 - protein, 7 aa, Entamoeba dispar
KKVKEEL

SEQ ID NO: 2437660 - protein, 26 aa, Entamoeba dispar
KKVKETKASLEQKKQENQKLKNERDE

SEQ ID NO: 2437661 - protein, 41 aa, Entamoeba dispar
KKVKKQTNNGWKGGKFGDYSCNGEKIDRNNVERKAAAAYGD

SEQ ID NO: 2437662 - protein, 12 aa, Entamoeba dispar
KKVKKSRKETME

SEQ ID NO: 2437663 - protein, 133 aa, Entamoeba dispar
KKVKKVKKVKKTTNEDGTQSNVKKVKKVKKVKKVKKVKKAVEQPKPEETPKEEVKEETKPVETTPKEETVEEAPKQQATESREERERKLKEQQEALQKKKEERERLRAERAAELERKKKELEELKAKRAAAAN

SEQ ID NO: 2437664 - protein, 10 aa, Entamoeba dispar
KKVNEEKTIQ

SEQ ID NO: 2437665 - protein, 6 aa, Entamoeba dispar
KKVNVN

SEQ ID NO: 2437666 - protein, 4 aa, Entamoeba dispar
KKVP

SEQ ID NO: 2437667 - protein, 7 aa, Entamoeba dispar
KKVPEEV

SEQ ID NO: 2437668 - protein, 6 aa, Entamoeba dispar
KKVPIG

SEQ ID NO: 2437669 - protein, 4 aa, Entamoeba dispar
KKVS

SEQ ID NO: 2437670 - protein, 8 aa, Entamoeba dispar
KKVSDKKN

SEQ ID NO: 2437671 - protein, 42 aa, Entamoeba dispar
KKVSPAELARKKALEKLKKDKEEEERLQKEEEEREKAEAEAL

SEQ ID NO: 2437672 - protein, 9 aa, Entamoeba dispar
KKVSTQNVL

SEQ ID NO: 2437673 - protein, 8 aa, Entamoeba dispar
KKVSYSSF

SEQ ID NO: 2437674 - protein, 9 aa, Entamoeba dispar
KKVTNPGIQ

SEQ ID NO: 2437675 - protein, 16 aa, Entamoeba dispar
KKVTPLLPSSYQNKEK

SEQ ID NO: 2437676 - protein, 8 aa, Entamoeba dispar
KKVTRSTH

SEQ ID NO: 2437677 - protein, 6 aa, Entamoeba dispar
KKVYGD

SEQ ID NO: 2437678 - protein, 4 aa, Entamoeba dispar
KKWD

SEQ ID NO: 2437679 - protein, 4 aa, Entamoeba dispar
KKWE

SEQ ID NO: 2437680 - protein, 7 aa, Entamoeba dispar
KKWENGE

SEQ ID NO: 2437681 - protein, 8 aa, Entamoeba dispar
KKWKKRTL

SEQ ID NO: 2437682 - protein, 9 aa, Entamoeba dispar
KKWNEEEKI

SEQ ID NO: 2437683 - protein, 6 aa, Entamoeba dispar
KKWRKG

SEQ ID NO: 2437684 - protein, 5 aa, Entamoeba dispar
KKWSQ

SEQ ID NO: 2437685 - protein, 21 aa, Entamoeba dispar
KKWTDSLEVESSQRKDSNIQT

SEQ ID NO: 2437686 - protein, 17 aa, Entamoeba dispar
KKWTQTSNGGADRGSPY

SEQ ID NO: 2437687 - protein, 4 aa, Entamoeba dispar
KKYA

SEQ ID NO: 2437688 - protein, 5 aa, Entamoeba dispar
KKYAE

SEQ ID NO: 2437689 - protein, 11 aa, Entamoeba dispar
KKYATKQQKID

SEQ ID NO: 2437690 - protein, 4 aa, Entamoeba dispar
KKYD

SEQ ID NO: 2437691 - protein, 9 aa, Entamoeba dispar
KKYDDVEKD

SEQ ID NO: 2437692 - protein, 9 aa, Entamoeba dispar
KKYDEDINT

SEQ ID NO: 2437693 - protein, 9 aa, Entamoeba dispar
KKYDEGEEK

SEQ ID NO: 2437694 - protein, 5 aa, Entamoeba dispar
KKYDK

SEQ ID NO: 2437695 - protein, 4 aa, Entamoeba dispar
KKYE

SEQ ID NO: 2437696 - protein, 10 aa, Entamoeba dispar
KKYEEGYNQS

SEQ ID NO: 2437697 - protein, 6 aa, Entamoeba dispar
KKYEEQ

SEQ ID NO: 2437698 - protein, 17 aa, Entamoeba dispar
KKYEEQDEEDRKKMEER

SEQ ID NO: 2437699 - protein, 7 aa, Entamoeba dispar
KKYEHQG

SEQ ID NO: 2437700 - protein, 7 aa, Entamoeba dispar
KKYEKYN

SEQ ID NO: 2437701 - protein, 8 aa, Entamoeba dispar
KKYEPESF

SEQ ID NO: 2437702 - protein, 15 aa, Entamoeba dispar
KKYETNNDKESRRGI

SEQ ID NO: 2437703 - protein, 7 aa, Entamoeba dispar
KKYGDKS

SEQ ID NO: 2437704 - protein, 30 aa, Entamoeba dispar
KKYGESYPSIRTELNTPKFCQTEKDIEQHN

SEQ ID NO: 2437705 - protein, 10 aa, Entamoeba dispar
KKYGNKGKIP

SEQ ID NO: 2437706 - protein, 8 aa, Entamoeba dispar
KKYGQDDT

SEQ ID NO: 2437707 - protein, 7 aa, Entamoeba dispar
KKYGSWS

SEQ ID NO: 2437708 - protein, 7 aa, Entamoeba dispar
KKYGYEK

SEQ ID NO: 2437709 - protein, 5 aa, Entamoeba dispar
KKYHN

SEQ ID NO: 2437710 - protein, 17 aa, Entamoeba dispar
KKYKAEKYKEKVNYETN

SEQ ID NO: 2437711 - protein, 5 aa, Entamoeba dispar
KKYKD

SEQ ID NO: 2437712 - protein, 11 aa, Entamoeba dispar
KKYKDNNDVTI

SEQ ID NO: 2437713 - protein, 15 aa, Entamoeba dispar
KKYKEEELKKSKEIT

SEQ ID NO: 2437714 - protein, 27 aa, Entamoeba dispar
KKYLGRKHNKTKPGTKVTQTNGIESVE

SEQ ID NO: 2437715 - protein, 9 aa, Entamoeba dispar
KKYNEEKTP

SEQ ID NO: 2437716 - protein, 8 aa, Entamoeba dispar
KKYNKTTA

SEQ ID NO: 2437717 - protein, 8 aa, Entamoeba dispar
KKYNPLDE

SEQ ID NO: 2437718 - protein, 7 aa, Entamoeba dispar
KKYNSDE

SEQ ID NO: 2437719 - protein, 8 aa, Entamoeba dispar
KKYNSTIQ

SEQ ID NO: 2437720 - protein, 8 aa, Entamoeba dispar
KKYNSYYG

SEQ ID NO: 2437721 - protein, 7 aa, Entamoeba dispar
KKYPASY

SEQ ID NO: 2437722 - protein, 16 aa, Entamoeba dispar
KKYPIDNYESRVGGGI

SEQ ID NO: 2437723 - protein, 8 aa, Entamoeba dispar
KKYPPGNV

SEQ ID NO: 2437724 - protein, 12 aa, Entamoeba dispar
KKYQKDNQENKT

SEQ ID NO: 2437725 - protein, 5 aa, Entamoeba dispar
KKYQL

SEQ ID NO: 2437726 - protein, 29 aa, Entamoeba dispar
KKYQSEIQEQQQKQKQMEEEFNNKTQKWK

SEQ ID NO: 2437727 - protein, 7 aa, Entamoeba dispar
KKYQSNE

SEQ ID NO: 2437728 - protein, 7 aa, Entamoeba dispar
KKYQTTH

SEQ ID NO: 2437729 - protein, 8 aa, Entamoeba dispar
KKYRDNKT

SEQ ID NO: 2437730 - protein, 6 aa, Entamoeba dispar
KKYSTE

SEQ ID NO: 2437731 - protein, 13 aa, Entamoeba dispar
KKYTGKSFGKYKA

SEQ ID NO: 2437732 - protein, 7 aa, Entamoeba dispar
KKYVPSV

SEQ ID NO: 2437733 - protein, 17 aa, Entamoeba dispar
KLAEEIKKERLNQSSYH

SEQ ID NO: 2437734 - protein, 26 aa, Entamoeba dispar
KLAEEIKKREAAENALASATAKIGEL

SEQ ID NO: 2437735 - protein, 7 aa, Entamoeba dispar
KLAEHNG

SEQ ID NO: 2437736 - protein, 12 aa, Entamoeba dispar
KLAKEPNERLAK

SEQ ID NO: 2437737 - protein, 21 aa, Entamoeba dispar
KLAKEVASKVNDRSGDGTTTA

SEQ ID NO: 2437738 - protein, 8 aa, Entamoeba dispar
KLANPGLQ

SEQ ID NO: 2437739 - protein, 6 aa, Entamoeba dispar
KLASTL

SEQ ID NO: 2437740 - protein, 7 aa, Entamoeba dispar
KLATAST

SEQ ID NO: 2437741 - protein, 12 aa, Entamoeba dispar
KLATKAKSLFDD

SEQ ID NO: 2437742 - protein, 14 aa, Entamoeba dispar
KLATPTKPYAPNQV

SEQ ID NO: 2437743 - protein, 9 aa, Entamoeba dispar
KLATTTRLS

SEQ ID NO: 2437744 - protein, 4 aa, Entamoeba dispar
KLDD

SEQ ID NO: 2437745 - protein, 8 aa, Entamoeba dispar
KLDDGLNE

SEQ ID NO: 2437746 - protein, 8 aa, Entamoeba dispar
KLDDTERA

SEQ ID NO: 2437747 - protein, 7 aa, Entamoeba dispar
KLDEASQ

SEQ ID NO: 2437748 - protein, 9 aa, Entamoeba dispar
KLDEEEKKI

SEQ ID NO: 2437749 - protein, 8 aa, Entamoeba dispar
KLDEESQL

SEQ ID NO: 2437750 - protein, 5 aa, Entamoeba dispar
KLDEL

SEQ ID NO: 2437751 - protein, 10 aa, Entamoeba dispar
KLDESTRQKH

SEQ ID NO: 2437752 - protein, 24 aa, Entamoeba dispar
KLDETEGGHQHEKVEADLKKSLKK

SEQ ID NO: 2437753 - protein, 5 aa, Entamoeba dispar
KLDGC

SEQ ID NO: 2437754 - protein, 6 aa, Entamoeba dispar
KLDHST

SEQ ID NO: 2437755 - protein, 9 aa, Entamoeba dispar
KLDKKYKKL

SEQ ID NO: 2437756 - protein, 5 aa, Entamoeba dispar
KLDKP

SEQ ID NO: 2437757 - protein, 6 aa, Entamoeba dispar
KLDKRY

SEQ ID NO: 2437758 - protein, 6 aa, Entamoeba dispar
KLDKSR

SEQ ID NO: 2437759 - protein, 8 aa, Entamoeba dispar
KLDPHKKE

SEQ ID NO: 2437760 - protein, 18 aa, Entamoeba dispar
KLDRNTDENTIPPEVKSL

SEQ ID NO: 2437761 - protein, 17 aa, Entamoeba dispar
KLDSNDKKVTEEECEEV

SEQ ID NO: 2437762 - protein, 10 aa, Entamoeba dispar
KLDTNKSFKS

SEQ ID NO: 2437763 - protein, 6 aa, Entamoeba dispar
KLEADY

SEQ ID NO: 2437764 - protein, 9 aa, Entamoeba dispar
KLEADYRAA

SEQ ID NO: 2437765 - protein, 6 aa, Entamoeba dispar
KLEAEY

SEQ ID NO: 2437766 - protein, 10 aa, Entamoeba dispar
KLEDDVGKEI

SEQ ID NO: 2437767 - protein, 18 aa, Entamoeba dispar
KLEDEKVVEEKKIEVTKD

SEQ ID NO: 2437768 - protein, 16 aa, Entamoeba dispar
KLEDKTEQTPKQESIC

SEQ ID NO: 2437769 - protein, 6 aa, Entamoeba dispar
KLEDQE

SEQ ID NO: 2437770 - protein, 4 aa, Entamoeba dispar
KLEE

SEQ ID NO: 2437771 - protein, 25 aa, Entamoeba dispar
KLEEDSEDESRYHDDNESSDEENDE

SEQ ID NO: 2437772 - protein, 23 aa, Entamoeba dispar
KLEEEKKKEWKGNNEGEERENEQ

SEQ ID NO: 2437773 - protein, 11 aa, Entamoeba dispar
KLEEESKNEEV

SEQ ID NO: 2437774 - protein, 5 aa, Entamoeba dispar
KLEEK

SEQ ID NO: 2437775 - protein, 6 aa, Entamoeba dispar
KLEEKD

SEQ ID NO: 2437776 - protein, 5 aa, Entamoeba dispar
KLEEL

SEQ ID NO: 2437777 - protein, 6 aa, Entamoeba dispar
KLEESN

SEQ ID NO: 2437778 - protein, 6 aa, Entamoeba dispar
KLEETV

SEQ ID NO: 2437779 - protein, 7 aa, Entamoeba dispar
KLEGEKK

SEQ ID NO: 2437780 - protein, 9 aa, Entamoeba dispar
KLEGKEGDV

SEQ ID NO: 2437781 - protein, 28 aa, Entamoeba dispar
KLEGKNTSNTNSCTSNSPSESGDVPKAV

SEQ ID NO: 2437782 - protein, 29 aa, Entamoeba dispar
KLEGSSKQSSGKANVNIKESKKTKSKCFL

SEQ ID NO: 2437783 - protein, 5 aa, Entamoeba dispar
KLEIG

SEQ ID NO: 2437784 - protein, 9 aa, Entamoeba dispar
KLEKAKSQI

SEQ ID NO: 2437785 - protein, 12 aa, Entamoeba dispar
KLENDRKHLTTE

SEQ ID NO: 2437786 - protein, 32 aa, Entamoeba dispar
KLENEGKAKWEMKPKKEIEKQRTSEGKRVTSE

SEQ ID NO: 2437787 - protein, 35 aa, Entamoeba dispar
KLENKKKPKISKLEKDDKTKKQSSRKRKTKEIEKN

SEQ ID NO: 2437788 - protein, 20 aa, Entamoeba dispar
KLENTTTQAEKLAKDSKEQL

SEQ ID NO: 2437789 - protein, 8 aa, Entamoeba dispar
KLENVQDE

SEQ ID NO: 2437790 - protein, 6 aa, Entamoeba dispar
KLEPNT

SEQ ID NO: 2437791 - protein, 7 aa, Entamoeba dispar
KLEPPKP

SEQ ID NO: 2437792 - protein, 32 aa, Entamoeba dispar
KLEPQNNNQTYSLNETQTTKPNKPLTPYYNYS

SEQ ID NO: 2437793 - protein, 24 aa, Entamoeba dispar
KLEQAEKDRQNAKKEPQLAQQDTP

SEQ ID NO: 2437794 - protein, 29 aa, Entamoeba dispar
KLEQSERKKKINDEVGKRFKAKKAQGDVM

SEQ ID NO: 2437795 - protein, 14 aa, Entamoeba dispar
KLERNKKNITYQSN

SEQ ID NO: 2437796 - protein, 29 aa, Entamoeba dispar
KLESDAAKGGVKGMAAQNELAQMKSEDQL

SEQ ID NO: 2437797 - protein, 10 aa, Entamoeba dispar
KLESKGGNVR

SEQ ID NO: 2437798 - protein, 5 aa, Entamoeba dispar
KLESL

SEQ ID NO: 2437799 - protein, 10 aa, Entamoeba dispar
KLESTNSQYI

SEQ ID NO: 2437800 - protein, 4 aa, Entamoeba dispar
KLET

SEQ ID NO: 2437801 - protein, 6 aa, Entamoeba dispar
KLETEA

SEQ ID NO: 2437802 - protein, 8 aa, Entamoeba dispar
KLETTEQT

SEQ ID NO: 2437803 - protein, 6 aa, Entamoeba dispar
KLEYPD

SEQ ID NO: 2437804 - protein, 4 aa, Entamoeba dispar
KLFG

SEQ ID NO: 2437805 - protein, 4 aa, Entamoeba dispar
KLGD

SEQ ID NO: 2437806 - protein, 17 aa, Entamoeba dispar
KLGDKDEIKKAQLNTQQ

SEQ ID NO: 2437807 - protein, 12 aa, Entamoeba dispar
KLGDKGKSDEQV

SEQ ID NO: 2437808 - protein, 20 aa, Entamoeba dispar
KLGEALQQKEECKMNQQPVN

SEQ ID NO: 2437809 - protein, 7 aa, Entamoeba dispar
KLGEGGI

SEQ ID NO: 2437810 - protein, 9 aa, Entamoeba dispar
KLGEGKNQY

SEQ ID NO: 2437811 - protein, 8 aa, Entamoeba dispar
KLGEGSEG

SEQ ID NO: 2437812 - protein, 7 aa, Entamoeba dispar
KLGEPGY

SEQ ID NO: 2437813 - protein, 95 aa, Entamoeba dispar
KLGETEKSLAAQVAATKKASDERDSLSQNLENEKLTTKNLTKTKADLEKKISGLKQDYEDLEDDKNKIEGDLRNAQRKIKELDDEITKGADVSQY

SEQ ID NO: 2437814 - protein, 5 aa, Entamoeba dispar
KLGEV

SEQ ID NO: 2437815 - protein, 17 aa, Entamoeba dispar
KLGGERNKAKPQKSASE

SEQ ID NO: 2437816 - protein, 7 aa, Entamoeba dispar
KLGGQLK

SEQ ID NO: 2437817 - protein, 8 aa, Entamoeba dispar
KLGKDGGL

SEQ ID NO: 2437818 - protein, 7 aa, Entamoeba dispar
KLGNHPI

SEQ ID NO: 2437819 - protein, 7 aa, Entamoeba dispar
KLGNRPI

SEQ ID NO: 2437820 - protein, 19 aa, Entamoeba dispar
KLGPRHIQTTGGGTTSAGL

SEQ ID NO: 2437821 - protein, 10 aa, Entamoeba dispar
KLGQPLSSED

SEQ ID NO: 2437822 - protein, 5 aa, Entamoeba dispar
KLGRD

SEQ ID NO: 2437823 - protein, 6 aa, Entamoeba dispar
KLGSGN

SEQ ID NO: 2437824 - protein, 23 aa, Entamoeba dispar
KLGSNCTGTSDKFESLEVSSGSL

SEQ ID NO: 2437825 - protein, 11 aa, Entamoeba dispar
KLGYEAKDNAS

SEQ ID NO: 2437826 - protein, 5 aa, Entamoeba dispar
KLHDD

SEQ ID NO: 2437827 - protein, 5 aa, Entamoeba dispar
KLHEP

SEQ ID NO: 2437828 - protein, 12 aa, Entamoeba dispar
KLHGESIKKMDS

SEQ ID NO: 2437829 - protein, 4 aa, Entamoeba dispar
KLHS

SEQ ID NO: 2437830 - protein, 8 aa, Entamoeba dispar
KLKASQPN

SEQ ID NO: 2437831 - protein, 4 aa, Entamoeba dispar
KLKE

SEQ ID NO: 2437832 - protein, 10 aa, Entamoeba dispar
KLKEDNGKPI

SEQ ID NO: 2437833 - protein, 19 aa, Entamoeba dispar
KLKEDPIKRCGEKDIEQLL

SEQ ID NO: 2437834 - protein, 5 aa, Entamoeba dispar
KLKEE

SEQ ID NO: 2437835 - protein, 8 aa, Entamoeba dispar
KLKEQNEV

SEQ ID NO: 2437836 - protein, 9 aa, Entamoeba dispar
KLKETNSFP

SEQ ID NO: 2437837 - protein, 8 aa, Entamoeba dispar
KLKGDGEY

SEQ ID NO: 2437838 - protein, 22 aa, Entamoeba dispar
KLKGDLKDSKLKGEDLEDEITE

SEQ ID NO: 2437839 - protein, 9 aa, Entamoeba dispar
KLKGNEKQF

SEQ ID NO: 2437840 - protein, 8 aa, Entamoeba dispar
KLKGNSVT

SEQ ID NO: 2437841 - protein, 8 aa, Entamoeba dispar
KLKGVEGR

SEQ ID NO: 2437842 - protein, 18 aa, Entamoeba dispar
KLKKEGNARIKKYIKYIS

SEQ ID NO: 2437843 - protein, 18 aa, Entamoeba dispar
KLKKEGNTKIKKYIKYLS

SEQ ID NO: 2437844 - protein, 14 aa, Entamoeba dispar
KLKKNKRIPRDCFE

SEQ ID NO: 2437845 - protein, 9 aa, Entamoeba dispar
KLKNELRES

SEQ ID NO: 2437846 - protein, 19 aa, Entamoeba dispar
KLKNPIKTQTQSKNPETKL

SEQ ID NO: 2437847 - protein, 6 aa, Entamoeba dispar
KLKNTV

SEQ ID NO: 2437848 - protein, 13 aa, Entamoeba dispar
KLKPLKEEEEKIE

SEQ ID NO: 2437849 - protein, 8 aa, Entamoeba dispar
KLKPNEDY

SEQ ID NO: 2437850 - protein, 6 aa, Entamoeba dispar
KLKQEN

SEQ ID NO: 2437851 - protein, 17 aa, Entamoeba dispar
KLKQNLDKKTKKTIQTK

SEQ ID NO: 2437852 - protein, 4 aa, Entamoeba dispar
KLKS

SEQ ID NO: 2437853 - protein, 11 aa, Entamoeba dispar
KLKSDYKNSVM

SEQ ID NO: 2437854 - protein, 9 aa, Entamoeba dispar
KLKSEGNNI

SEQ ID NO: 2437855 - protein, 12 aa, Entamoeba dispar
KLKSENEELTNN

SEQ ID NO: 2437856 - protein, 28 aa, Entamoeba dispar
KLKSENKLEIRRKNGIKTNEENDFKPRD

SEQ ID NO: 2437857 - protein, 15 aa, Entamoeba dispar
KLKSSVAKGVDAEFD

SEQ ID NO: 2437858 - protein, 8 aa, Entamoeba dispar
KLKTEIEK

SEQ ID NO: 2437859 - protein, 14 aa, Entamoeba dispar
KLKTLKRDKKVEDE

SEQ ID NO: 2437860 - protein, 9 aa, Entamoeba dispar
KLKTPEGSK

SEQ ID NO: 2437861 - protein, 14 aa, Entamoeba dispar
KLLDQESNVRSREA

SEQ ID NO: 2437862 - protein, 4 aa, Entamoeba dispar
KLLG

SEQ ID NO: 2437863 - protein, 5 aa, Entamoeba dispar
KLLNA

SEQ ID NO: 2437864 - protein, 26 aa, Entamoeba dispar
KLLNSEDKNIDSNSFNPTGSNCERLN

SEQ ID NO: 2437865 - protein, 14 aa, Entamoeba dispar
KLLPEEESNVQSSI

SEQ ID NO: 2437866 - protein, 8 aa, Entamoeba dispar
KLLSKTNF

SEQ ID NO: 2437867 - protein, 5 aa, Entamoeba dispar
KLMEE

SEQ ID NO: 2437868 - protein, 6 aa, Entamoeba dispar
KLNASA

SEQ ID NO: 2437869 - protein, 5 aa, Entamoeba dispar
KLNED

SEQ ID NO: 2437870 - protein, 6 aa, Entamoeba dispar
KLNEDD

SEQ ID NO: 2437871 - protein, 7 aa, Entamoeba dispar
KLNEEKF

SEQ ID NO: 2437872 - protein, 8 aa, Entamoeba dispar
KLNEEQLK

SEQ ID NO: 2437873 - protein, 7 aa, Entamoeba dispar
KLNELSP

SEQ ID NO: 2437874 - protein, 5 aa, Entamoeba dispar
KLNER

SEQ ID NO: 2437875 - protein, 10 aa, Entamoeba dispar
KLNETINKNE

SEQ ID NO: 2437876 - protein, 4 aa, Entamoeba dispar
KLNG

SEQ ID NO: 2437877 - protein, 19 aa, Entamoeba dispar
KLNGGVKKTKIDDEEKEKL

SEQ ID NO: 2437878 - protein, 5 aa, Entamoeba dispar
KLNGP

SEQ ID NO: 2437879 - protein, 11 aa, Entamoeba dispar
KLNKGKESIRS

SEQ ID NO: 2437880 - protein, 8 aa, Entamoeba dispar
KLNKKDMK

SEQ ID NO: 2437881 - protein, 11 aa, Entamoeba dispar
KLNKKGAEIKP

SEQ ID NO: 2437882 - protein, 10 aa, Entamoeba dispar
KLNKQEEIIT

SEQ ID NO: 2437883 - protein, 8 aa, Entamoeba dispar
KLNPEQKN

SEQ ID NO: 2437884 - protein, 11 aa, Entamoeba dispar
KLNPKEIPSGT

SEQ ID NO: 2437885 - protein, 17 aa, Entamoeba dispar
KLNPSSVDNDAEQATIQ

SEQ ID NO: 2437886 - protein, 9 aa, Entamoeba dispar
KLNSEESLK

SEQ ID NO: 2437887 - protein, 13 aa, Entamoeba dispar
KLNSKTQKVVLIP

SEQ ID NO: 2437888 - protein, 5 aa, Entamoeba dispar
KLNSR

SEQ ID NO: 2437889 - protein, 6 aa, Entamoeba dispar
KLNTDG

SEQ ID NO: 2437890 - protein, 6 aa, Entamoeba dispar
KLNTKT

SEQ ID NO: 2437891 - protein, 6 aa, Entamoeba dispar
KLNTNG

SEQ ID NO: 2437892 - protein, 15 aa, Entamoeba dispar
KLNTSVSAENIVDGN

SEQ ID NO: 2437893 - protein, 6 aa, Entamoeba dispar
KLNYND

SEQ ID NO: 2437894 - protein, 5 aa, Entamoeba dispar
KLPDG

SEQ ID NO: 2437895 - protein, 13 aa, Entamoeba dispar
KLPDGNTTGEGNG

SEQ ID NO: 2437896 - protein, 6 aa, Entamoeba dispar
KLPDRL

SEQ ID NO: 2437897 - protein, 5 aa, Entamoeba dispar
KLPDT

SEQ ID NO: 2437898 - protein, 4 aa, Entamoeba dispar
KLPE

SEQ ID NO: 2437899 - protein, 9 aa, Entamoeba dispar
KLPEDRAVP

SEQ ID NO: 2437900 - protein, 10 aa, Entamoeba dispar
KLPEIESKNV

SEQ ID NO: 2437901 - protein, 5 aa, Entamoeba dispar
KLPFT

SEQ ID NO: 2437902 - protein, 12 aa, Entamoeba dispar
KLPGEDELNATE

SEQ ID NO: 2437903 - protein, 24 aa, Entamoeba dispar
KLPGNSASYHPAPEYKNENNTNYD

SEQ ID NO: 2437904 - protein, 6 aa, Entamoeba dispar
KLPHGT

SEQ ID NO: 2437905 - protein, 8 aa, Entamoeba dispar
KLPHTNND

SEQ ID NO: 2437906 - protein, 20 aa, Entamoeba dispar
KLPKISKEVRPQNSPSVEYD

SEQ ID NO: 2437907 - protein, 12 aa, Entamoeba dispar
KLPKKSLEQSRE

SEQ ID NO: 2437908 - protein, 13 aa, Entamoeba dispar
KLPKSELNGVEDV

SEQ ID NO: 2437909 - protein, 9 aa, Entamoeba dispar
KLPLPPKDL

SEQ ID NO: 2437910 - protein, 8 aa, Entamoeba dispar
KLPLTKDS

SEQ ID NO: 2437911 - protein, 9 aa, Entamoeba dispar
KLPNGNNID

SEQ ID NO: 2437912 - protein, 13 aa, Entamoeba dispar
KLPNKKLPVPPQK

SEQ ID NO: 2437913 - protein, 6 aa, Entamoeba dispar
KLPNKY

SEQ ID NO: 2437914 - protein, 6 aa, Entamoeba dispar
KLPNPL

SEQ ID NO: 2437915 - protein, 6 aa, Entamoeba dispar
KLPPAP

SEQ ID NO: 2437916 - protein, 5 aa, Entamoeba dispar
KLPPH

SEQ ID NO: 2437917 - protein, 6 aa, Entamoeba dispar
KLPPIQ

SEQ ID NO: 2437918 - protein, 5 aa, Entamoeba dispar
KLPPK

SEQ ID NO: 2437919 - protein, 23 aa, Entamoeba dispar
KLPPKRKNELVKESAQQKQQSDV

SEQ ID NO: 2437920 - protein, 5 aa, Entamoeba dispar
KLPPS

SEQ ID NO: 2437921 - protein, 30 aa, Entamoeba dispar
  misc_feature (15)..(16): Xaa can be any naturally occurring amino acid
KLPPSQEVWVKMMIXXHLEDLPFKKDGGKR

SEQ ID NO: 2437922 - protein, 6 aa, Entamoeba dispar
KLPPYL

SEQ ID NO: 2437923 - protein, 8 aa, Entamoeba dispar
KLPQSTLN

SEQ ID NO: 2437924 - protein, 12 aa, Entamoeba dispar
KLPRKSLETSRE

SEQ ID NO: 2437925 - protein, 7 aa, Entamoeba dispar
KLPRMSN

SEQ ID NO: 2437926 - protein, 12 aa, Entamoeba dispar
KLPRNEKGLIDP

SEQ ID NO: 2437927 - protein, 24 aa, Entamoeba dispar
KLPRTSLEKSRDVLKSREQIKTEI

SEQ ID NO: 2437928 - protein, 7 aa, Entamoeba dispar
KLPSDQI

SEQ ID NO: 2437929 - protein, 12 aa, Entamoeba dispar
KLPSKKSKNTLA

SEQ ID NO: 2437930 - protein, 7 aa, Entamoeba dispar
KLPSPDR

SEQ ID NO: 2437931 - protein, 6 aa, Entamoeba dispar
KLPSSV

SEQ ID NO: 2437932 - protein, 20 aa, Entamoeba dispar
KLPTDDISDELNGTLEDDPI

SEQ ID NO: 2437933 - protein, 8 aa, Entamoeba dispar
KLPTENLV

SEQ ID NO: 2437934 - protein, 8 aa, Entamoeba dispar
KLPTGGDM

SEQ ID NO: 2437935 - protein, 9 aa, Entamoeba dispar
KLPTKKSID

SEQ ID NO: 2437936 - protein, 12 aa, Entamoeba dispar
KLPTKPENAEAI

SEQ ID NO: 2437937 - protein, 7 aa, Entamoeba dispar
KLPYSAL

SEQ ID NO: 2437938 - protein, 6 aa, Entamoeba dispar
KLQDNN

SEQ ID NO: 2437939 - protein, 6 aa, Entamoeba dispar
KLQDNR

SEQ ID NO: 2437940 - protein, 6 aa, Entamoeba dispar
KLQEHT

SEQ ID NO: 2437941 - protein, 7 aa, Entamoeba dispar
KLQETAE

SEQ ID NO: 2437942 - protein, 8 aa, Entamoeba dispar
KLQGDEKH

SEQ ID NO: 2437943 - protein, 11 aa, Entamoeba dispar
KLQGNSALRPK

SEQ ID NO: 2437944 - protein, 7 aa, Entamoeba dispar
KLQHVDS

SEQ ID NO: 2437945 - protein, 10 aa, Entamoeba dispar
KLQKDDNAQL

SEQ ID NO: 2437946 - protein, 9 aa, Entamoeba dispar
KLQKEDKEL

SEQ ID NO: 2437947 - protein, 19 aa, Entamoeba dispar
KLQKEKKQEASNEDNTEKI

SEQ ID NO: 2437948 - protein, 4 aa, Entamoeba dispar
KLQL

SEQ ID NO: 2437949 - protein, 14 aa, Entamoeba dispar
KLQNKINKTKKAIN

SEQ ID NO: 2437950 - protein, 9 aa, Entamoeba dispar
KLQNQNKHE

SEQ ID NO: 2437951 - protein, 13 aa, Entamoeba dispar
KLQQGKKKKIDIE

SEQ ID NO: 2437952 - protein, 5 aa, Entamoeba dispar
KLQQQ

SEQ ID NO: 2437953 - protein, 11 aa, Entamoeba dispar
KLQRDGTEKLK

SEQ ID NO: 2437954 - protein, 16 aa, Entamoeba dispar
KLQSAISSRNIDETKS

SEQ ID NO: 2437955 - protein, 5 aa, Entamoeba dispar
KLQSG

SEQ ID NO: 2437956 - protein, 5 aa, Entamoeba dispar
KLQTP

SEQ ID NO: 2437957 - protein, 4 aa, Entamoeba dispar
KLRE

SEQ ID NO: 2437958 - protein, 31 aa, Entamoeba dispar
KLRENKINRTPDDKSEKNETKPPKSPSQKSA

SEQ ID NO: 2437959 - protein, 5 aa, Entamoeba dispar
KLRES

SEQ ID NO: 2437960 - protein, 5 aa, Entamoeba dispar
KLRGD

SEQ ID NO: 2437961 - protein, 6 aa, Entamoeba dispar
KLRGRA

SEQ ID NO: 2437962 - protein, 21 aa, Entamoeba dispar
KLRIQKKENKNVVSIIIQIND

SEQ ID NO: 2437963 - protein, 25 aa, Entamoeba dispar
KLRKGNNFSETTSCISPPRKSPDVH

SEQ ID NO: 2437964 - protein, 9 aa, Entamoeba dispar
KLRKQGKTL

SEQ ID NO: 2437965 - protein, 13 aa, Entamoeba dispar
KLRKQRKGKGPKL

SEQ ID NO: 2437966 - protein, 5 aa, Entamoeba dispar
KLRNN

SEQ ID NO: 2437967 - protein, 21 aa, Entamoeba dispar
KLRNPEKLAEEARQRDEEQRL

SEQ ID NO: 2437968 - protein, 4 aa, Entamoeba dispar
KLRS

SEQ ID NO: 2437969 - protein, 7 aa, Entamoeba dispar
KLRTPGQ

SEQ ID NO: 2437970 - protein, 6 aa, Entamoeba dispar
KLSDAQ

SEQ ID NO: 2437971 - protein, 42 aa, Entamoeba dispar
KLSDDQKNVRGTRDTENQSLKRRYKEEQNEDKQHQKELVPNN

SEQ ID NO: 2437972 - protein, 11 aa, Entamoeba dispar
KLSDEELKEES

SEQ ID NO: 2437973 - protein, 9 aa, Entamoeba dispar
KLSDKTELT

SEQ ID NO: 2437974 - protein, 5 aa, Entamoeba dispar
KLSDY

SEQ ID NO: 2437975 - protein, 7 aa, Entamoeba dispar
KLSEADK

SEQ ID NO: 2437976 - protein, 33 aa, Entamoeba dispar
KLSEAPAENERAKYSYEQERKRIEKEEEEKRNA

SEQ ID NO: 2437977 - protein, 5 aa, Entamoeba dispar
KLSEE

SEQ ID NO: 2437978 - protein, 9 aa, Entamoeba dispar
KLSEEDQKL

SEQ ID NO: 2437979 - protein, 12 aa, Entamoeba dispar
KLSEQLKQDEDV

SEQ ID NO: 2437980 - protein, 8 aa, Entamoeba dispar
KLSKEIKK

SEQ ID NO: 2437981 - protein, 11 aa, Entamoeba dispar
KLSKENKQPFN

SEQ ID NO: 2437982 - protein, 6 aa, Entamoeba dispar
KLSKKN

SEQ ID NO: 2437983 - protein, 9 aa, Entamoeba dispar
KLSKKTLSI

SEQ ID NO: 2437984 - protein, 27 aa, Entamoeba dispar
KLSKRNEPKKETENKKALVKPKRSRPL

SEQ ID NO: 2437985 - protein, 14 aa, Entamoeba dispar
KLSKSEQDIKDCTR

SEQ ID NO: 2437986 - protein, 13 aa, Entamoeba dispar
KLSKTDCRNRESA

SEQ ID NO: 2437987 - protein, 16 aa, Entamoeba dispar
KLSNEEPSIRDAGWKE

SEQ ID NO: 2437988 - protein, 7 aa, Entamoeba dispar
KLSNSSS

SEQ ID NO: 2437989 - protein, 8 aa, Entamoeba dispar
KLSNTFKN

SEQ ID NO: 2437990 - protein, 8 aa, Entamoeba dispar
KLSPKTWG

SEQ ID NO: 2437991 - protein, 6 aa, Entamoeba dispar
KLSPYR

SEQ ID NO: 2437992 - protein, 18 aa, Entamoeba dispar
KLSQEKEHKRNEPTELTD

SEQ ID NO: 2437993 - protein, 9 aa, Entamoeba dispar
KLSQKYGGY

SEQ ID NO: 2437994 - protein, 5 aa, Entamoeba dispar
KLSRE

SEQ ID NO: 2437995 - protein, 20 aa, Entamoeba dispar
KLSRPTLKRTIPGAFSSTRN

SEQ ID NO: 2437996 - protein, 14 aa, Entamoeba dispar
KLSSDHDKKEYPMT

SEQ ID NO: 2437997 - protein, 12 aa, Entamoeba dispar
KLSSINGNSFDY

SEQ ID NO: 2437998 - protein, 15 aa, Entamoeba dispar
KLSSKTSSLSANQNK

SEQ ID NO: 2437999 - protein, 10 aa, Entamoeba dispar
KLSSNSNGLS

SEQ ID NO: 2438000 - protein, 7 aa, Entamoeba dispar
KLSSPPF

SEQ ID NO: 2438001 - protein, 15 aa, Entamoeba dispar
KLSSSLQRYQQEDAT

SEQ ID NO: 2438002 - protein, 11 aa, Entamoeba dispar
KLSTGNSTLED

SEQ ID NO: 2438003 - protein, 24 aa, Entamoeba dispar
KLSTQPVIKTTPNKNQSSNTQESL

SEQ ID NO: 2438004 - protein, 13 aa, Entamoeba dispar
KLSVKGSNIAQPT

SEQ ID NO: 2438005 - protein, 12 aa, Entamoeba dispar
KLSVKGSNVAQP

SEQ ID NO: 2438006 - protein, 37 aa, Entamoeba dispar
KLSVSDTKKVISKNETDSVLEKTQQEIQKEVEQNKRI

SEQ ID NO: 2438007 - protein, 10 aa, Entamoeba dispar
KLTDKQKEEW

SEQ ID NO: 2438008 - protein, 13 aa, Entamoeba dispar
KLTDNEKERPNDI

SEQ ID NO: 2438009 - protein, 6 aa, Entamoeba dispar
KLTDPN

SEQ ID NO: 2438010 - protein, 8 aa, Entamoeba dispar
KLTDSANK

SEQ ID NO: 2438011 - protein, 7 aa, Entamoeba dispar
KLTDSQQ

SEQ ID NO: 2438012 - protein, 10 aa, Entamoeba dispar
KLTEDEINQQ

SEQ ID NO: 2438013 - protein, 13 aa, Entamoeba dispar
KLTEEQQEETEDV

SEQ ID NO: 2438014 - protein, 16 aa, Entamoeba dispar
KLTEEQQKRLVNNNET

SEQ ID NO: 2438015 - protein, 11 aa, Entamoeba dispar
KLTEGKSGTIK

SEQ ID NO: 2438016 - protein, 8 aa, Entamoeba dispar
KLTEIGEK

SEQ ID NO: 2438017 - protein, 7 aa, Entamoeba dispar
KLTEQEV

SEQ ID NO: 2438018 - protein, 5 aa, Entamoeba dispar
KLTES

SEQ ID NO: 2438019 - protein, 7 aa, Entamoeba dispar
KLTESDL

SEQ ID NO: 2438020 - protein, 77 aa, Entamoeba dispar
KLTGGDVDNKVKEAIAKKDQKVSSSESDSEEEKKDTHVVDSEEEEKKEEEADKKAMEEQKKKDEEFKKKHEKEDPVM

SEQ ID NO: 2438021 - protein, 6 aa, Entamoeba dispar
KLTGTA

SEQ ID NO: 2438022 - protein, 7 aa, Entamoeba dispar
KLTGTEA

SEQ ID NO: 2438023 - protein, 13 aa, Entamoeba dispar
KLTKEEVKEIRRT

SEQ ID NO: 2438024 - protein, 9 aa, Entamoeba dispar
KLTKQSSKM

SEQ ID NO: 2438025 - protein, 15 aa, Entamoeba dispar
KLTNAQRSGLNQIPN

SEQ ID NO: 2438026 - protein, 6 aa, Entamoeba dispar
KLTNEE

SEQ ID NO: 2438027 - protein, 12 aa, Entamoeba dispar
KLTPDQQKEIPN

SEQ ID NO: 2438028 - protein, 5 aa, Entamoeba dispar
KLTPI

SEQ ID NO: 2438029 - protein, 4 aa, Entamoeba dispar
KLTQ

SEQ ID NO: 2438030 - protein, 17 aa, Entamoeba dispar
KLTQDPPPGITAGPISE

SEQ ID NO: 2438031 - protein, 6 aa, Entamoeba dispar
KLTQEA

SEQ ID NO: 2438032 - protein, 7 aa, Entamoeba dispar
KLTQEQD

SEQ ID NO: 2438033 - protein, 5 aa, Entamoeba dispar
KLTQK

SEQ ID NO: 2438034 - protein, 7 aa, Entamoeba dispar
KLTQLPD

SEQ ID NO: 2438035 - protein, 9 aa, Entamoeba dispar
KLTQPTKAG

SEQ ID NO: 2438036 - protein, 17 aa, Entamoeba dispar
KLTQQHKERDEKLETQS

SEQ ID NO: 2438037 - protein, 5 aa, Entamoeba dispar
KLTSK

SEQ ID NO: 2438038 - protein, 5 aa, Entamoeba dispar
KLTTK

SEQ ID NO: 2438039 - protein, 5 aa, Entamoeba dispar
KLTYE

SEQ ID NO: 2438040 - protein, 4 aa, Entamoeba dispar
KLVN

SEQ ID NO: 2438041 - protein, 11 aa, Entamoeba dispar
KLYEKGQSKRI

SEQ ID NO: 2438042 - protein, 5 aa, Entamoeba dispar
KLYGG

SEQ ID NO: 2438043 - protein, 14 aa, Entamoeba dispar
KLYKSSSRKEYANK

SEQ ID NO: 2438044 - protein, 4 aa, Entamoeba dispar
KLYS

SEQ ID NO: 2438045 - protein, 12 aa, Entamoeba dispar
KMAEDDEDLDAI

SEQ ID NO: 2438046 - protein, 8 aa, Entamoeba dispar
KMAKSTGN

SEQ ID NO: 2438047 - protein, 5 aa, Entamoeba dispar
KMAPN

SEQ ID NO: 2438048 - protein, 12 aa, Entamoeba dispar
KMATSSTNFGEE

SEQ ID NO: 2438049 - protein, 10 aa, Entamoeba dispar
KMDDQDRTSI

SEQ ID NO: 2438050 - protein, 12 aa, Entamoeba dispar
KMDEDSDNYSKD

SEQ ID NO: 2438051 - protein, 8 aa, Entamoeba dispar
KMDETDRT

SEQ ID NO: 2438052 - protein, 8 aa, Entamoeba dispar
KMDKGELR

SEQ ID NO: 2438053 - protein, 11 aa, Entamoeba dispar
KMDKNYSNSVV

SEQ ID NO: 2438054 - protein, 10 aa, Entamoeba dispar
KMDNNTTNEE

SEQ ID NO: 2438055 - protein, 9 aa, Entamoeba dispar
KMEDGFGEL

SEQ ID NO: 2438056 - protein, 15 aa, Entamoeba dispar
KMEDPATSAEQKAVY

SEQ ID NO: 2438057 - protein, 14 aa, Entamoeba dispar
KMEEEGTNKNDDEI

SEQ ID NO: 2438058 - protein, 14 aa, Entamoeba dispar
KMEEESNKQQERVD

SEQ ID NO: 2438059 - protein, 11 aa, Entamoeba dispar
KMEETGDSLET

SEQ ID NO: 2438060 - protein, 15 aa, Entamoeba dispar
KMEKENEQNQANTNE

SEQ ID NO: 2438061 - protein, 20 aa, Entamoeba dispar
KMEQPKEETKQKKGTQSPQI

SEQ ID NO: 2438062 - protein, 14 aa, Entamoeba dispar
KMETENSNIAIDEE

SEQ ID NO: 2438063 - protein, 5 aa, Entamoeba dispar
KMGEE

SEQ ID NO: 2438064 - protein, 15 aa, Entamoeba dispar
KMIQTTQQESQVQPP

SEQ ID NO: 2438065 - protein, 38 aa, Entamoeba dispar
KMKDERIQELEKENVSKEEENNTLKKQIEENQSIQQQT

SEQ ID NO: 2438066 - protein, 14 aa, Entamoeba dispar
KMKEEQQIISTNKR

SEQ ID NO: 2438067 - protein, 14 aa, Entamoeba dispar
KMKGVSNVDSIADQ

SEQ ID NO: 2438068 - protein, 6 aa, Entamoeba dispar
KMKKDK

SEQ ID NO: 2438069 - protein, 10 aa, Entamoeba dispar
KMKKKYKKQE

SEQ ID NO: 2438070 - protein, 26 aa, Entamoeba dispar
KMKKPKKLMESKPKKRLSKKRKGGNK

SEQ ID NO: 2438071 - protein, 7 aa, Entamoeba dispar
KMKKVKD

SEQ ID NO: 2438072 - protein, 12 aa, Entamoeba dispar
KMKPKSSEECNY

SEQ ID NO: 2438073 - protein, 6 aa, Entamoeba dispar
KMKQPN

SEQ ID NO: 2438074 - protein, 4 aa, Entamoeba dispar
KMKS

SEQ ID NO: 2438075 - protein, 7 aa, Entamoeba dispar
KMNDNEL

SEQ ID NO: 2438076 - protein, 18 aa, Entamoeba dispar
KMNEKNEELGITTTNKRR

SEQ ID NO: 2438077 - protein, 9 aa, Entamoeba dispar
KMNESESNA

SEQ ID NO: 2438078 - protein, 15 aa, Entamoeba dispar
KMNKETERNNKTLQE

SEQ ID NO: 2438079 - protein, 5 aa, Entamoeba dispar
KMNPD

SEQ ID NO: 2438080 - protein, 6 aa, Entamoeba dispar
KMNPMK

SEQ ID NO: 2438081 - protein, 4 aa, Entamoeba dispar
KMNQ

SEQ ID NO: 2438082 - protein, 5 aa, Entamoeba dispar
KMNQQ

SEQ ID NO: 2438083 - protein, 9 aa, Entamoeba dispar
KMNTSNPLD

SEQ ID NO: 2438084 - protein, 13 aa, Entamoeba dispar
KMPDKQNDWISED

SEQ ID NO: 2438085 - protein, 23 aa, Entamoeba dispar
KMPGEEEEEAEEDCKMKEESEEE

SEQ ID NO: 2438086 - protein, 6 aa, Entamoeba dispar
KMPHDP

SEQ ID NO: 2438087 - protein, 9 aa, Entamoeba dispar
KMPNAPQKK

SEQ ID NO: 2438088 - protein, 5 aa, Entamoeba dispar
KMPNN

SEQ ID NO: 2438089 - protein, 6 aa, Entamoeba dispar
KMPNRF

SEQ ID NO: 2438090 - protein, 7 aa, Entamoeba dispar
KMPNSPI

SEQ ID NO: 2438091 - protein, 6 aa, Entamoeba dispar
KMPNVP

SEQ ID NO: 2438092 - protein, 7 aa, Entamoeba dispar
KMPPQYD

SEQ ID NO: 2438093 - protein, 24 aa, Entamoeba dispar
KMQEEKEAIGNDVKNKEKTIKEKE

SEQ ID NO: 2438094 - protein, 6 aa, Entamoeba dispar
KMQEEY

SEQ ID NO: 2438095 - protein, 18 aa, Entamoeba dispar
KMQPKPEPEPEPSEDNKY

SEQ ID NO: 2438096 - protein, 9 aa, Entamoeba dispar
KMQQTQSKN

SEQ ID NO: 2438097 - protein, 20 aa, Entamoeba dispar
KMRDSNDQLTKSCAQSQTNA

SEQ ID NO: 2438098 - protein, 13 aa, Entamoeba dispar
KMRDYSKKRISEG

SEQ ID NO: 2438099 - protein, 12 aa, Entamoeba dispar
KMREEEKQEMET

SEQ ID NO: 2438100 - protein, 6 aa, Entamoeba dispar
KMRQGQ

SEQ ID NO: 2438101 - protein, 10 aa, Entamoeba dispar
KMSDGKLTVG

SEQ ID NO: 2438102 - protein, 25 aa, Entamoeba dispar
KMSDLKSKKVIDQKPIEQISQSDVN

SEQ ID NO: 2438103 - protein, 5 aa, Entamoeba dispar
KMSDW

SEQ ID NO: 2438104 - protein, 5 aa, Entamoeba dispar
KMSSF

SEQ ID NO: 2438105 - protein, 6 aa, Entamoeba dispar
KMSSGY

SEQ ID NO: 2438106 - protein, 9 aa, Entamoeba dispar
KMSTQSQQA

SEQ ID NO: 2438107 - protein, 7 aa, Entamoeba dispar
KMTEDLA

SEQ ID NO: 2438108 - protein, 11 aa, Entamoeba dispar
KMTEKMKDKTK

SEQ ID NO: 2438109 - protein, 5 aa, Entamoeba dispar
KMTPT

SEQ ID NO: 2438110 - protein, 11 aa, Entamoeba dispar
KMTTGLSRERL

SEQ ID NO: 2438111 - protein, 6 aa, Entamoeba dispar
KMTTSD

SEQ ID NO: 2438112 - protein, 9 aa, Entamoeba dispar
KNADPSKLD

SEQ ID NO: 2438113 - protein, 4 aa, Entamoeba dispar
KNAE

SEQ ID NO: 2438114 - protein, 13 aa, Entamoeba dispar
KNAEAKTKKAAEI

SEQ ID NO: 2438115 - protein, 13 aa, Entamoeba dispar
KNAEHKRKSRENQ

SEQ ID NO: 2438116 - protein, 6 aa, Entamoeba dispar
KNAEPE

SEQ ID NO: 2438117 - protein, 9 aa, Entamoeba dispar
KNAGLEKDI

SEQ ID NO: 2438118 - protein, 5 aa, Entamoeba dispar
KNAGV

SEQ ID NO: 2438119 - protein, 4 aa, Entamoeba dispar
KNAI

SEQ ID NO: 2438120 - protein, 10 aa, Entamoeba dispar
KNAKSISSDQ

SEQ ID NO: 2438121 - protein, 12 aa, Entamoeba dispar
KNAKSVSSVPKT

SEQ ID NO: 2438122 - protein, 8 aa, Entamoeba dispar
KNAKTTAN

SEQ ID NO: 2438123 - protein, 4 aa, Entamoeba dispar
KNAL

SEQ ID NO: 2438124 - protein, 5 aa, Entamoeba dispar
KNALP

SEQ ID NO: 2438125 - protein, 9 aa, Entamoeba dispar
KNAQPSIQS

SEQ ID NO: 2438126 - protein, 8 aa, Entamoeba dispar
KNASGTRP

SEQ ID NO: 2438127 - protein, 7 aa, Entamoeba dispar
KNASQII

SEQ ID NO: 2438128 - protein, 7 aa, Entamoeba dispar
KNASSQV

SEQ ID NO: 2438129 - protein, 39 aa, Entamoeba dispar
KNATLKNDSVPSDNSKPKTEEKVDISQTQSAQTQGGKKC

SEQ ID NO: 2438130 - protein, 9 aa, Entamoeba dispar
KNATTKEQK

SEQ ID NO: 2438131 - protein, 8 aa, Entamoeba dispar
KNAYGFKG

SEQ ID NO: 2438132 - protein, 4 aa, Entamoeba dispar
KNCK

SEQ ID NO: 2438133 - protein, 8 aa, Entamoeba dispar
KNCKEKDI

SEQ ID NO: 2438134 - protein, 8 aa, Entamoeba dispar
KNCKLSKE

SEQ ID NO: 2438135 - protein, 7 aa, Entamoeba dispar
KNCNSDL

SEQ ID NO: 2438136 - protein, 8 aa, Entamoeba dispar
KNCPKPIK

SEQ ID NO: 2438137 - protein, 9 aa, Entamoeba dispar
KNCREVSQD

SEQ ID NO: 2438138 - protein, 13 aa, Entamoeba dispar
KNCSDAELKKAYK

SEQ ID NO: 2438139 - protein, 9 aa, Entamoeba dispar
KNCSNEKMT

SEQ ID NO: 2438140 - protein, 15 aa, Entamoeba dispar
KNDCEPANRAVSSDQ

SEQ ID NO: 2438141 - protein, 20 aa, Entamoeba dispar
KNDEDKKKSTEDKKNLNQEI

SEQ ID NO: 2438142 - protein, 7 aa, Entamoeba dispar
KNDEEGY

SEQ ID NO: 2438143 - protein, 16 aa, Entamoeba dispar
KNDEIQLGEPGYEERY

SEQ ID NO: 2438144 - protein, 11 aa, Entamoeba dispar
KNDESRTLPLS

SEQ ID NO: 2438145 - protein, 13 aa, Entamoeba dispar
KNDESSKGRLREI

SEQ ID NO: 2438146 - protein, 8 aa, Entamoeba dispar
KNDFDNTE

SEQ ID NO: 2438147 - protein, 7 aa, Entamoeba dispar
KNDFEPK

SEQ ID NO: 2438148 - protein, 12 aa, Entamoeba dispar
KNDFSPTTQSQL

SEQ ID NO: 2438149 - protein, 6 aa, Entamoeba dispar
KNDGDG

SEQ ID NO: 2438150 - protein, 5 aa, Entamoeba dispar
KNDGK

SEQ ID NO: 2438151 - protein, 12 aa, Entamoeba dispar
KNDGKVNLENYS

SEQ ID NO: 2438152 - protein, 7 aa, Entamoeba dispar
KNDGLRA

SEQ ID NO: 2438153 - protein, 19 aa, Entamoeba dispar
KNDGNICSSDDTLDLSDSF

SEQ ID NO: 2438154 - protein, 5 aa, Entamoeba dispar
KNDGP

SEQ ID NO: 2438155 - protein, 7 aa, Entamoeba dispar
KNDGSEY

SEQ ID NO: 2438156 - protein, 6 aa, Entamoeba dispar
KNDHVN

SEQ ID NO: 2438157 - protein, 6 aa, Entamoeba dispar
KNDIEG

SEQ ID NO: 2438158 - protein, 11 aa, Entamoeba dispar
KNDIGKSLTQM

SEQ ID NO: 2438159 - protein, 12 aa, Entamoeba dispar
KNDIMEEESREK

SEQ ID NO: 2438160 - protein, 6 aa, Entamoeba dispar
KNDIPS

SEQ ID NO: 2438161 - protein, 5 aa, Entamoeba dispar
KNDIT

SEQ ID NO: 2438162 - protein, 67 aa, Entamoeba dispar
KNDKRAPSSTHGTLPPPPPGRKPPTSSSGKQVPSHKPPAPPNKKLPTPPQGKGKPIPPPRPGNRDAL

SEQ ID NO: 2438163 - protein, 15 aa, Entamoeba dispar
KNDKVKTNKKYVTAY

SEQ ID NO: 2438164 - protein, 6 aa, Entamoeba dispar
KNDLGD

SEQ ID NO: 2438165 - protein, 7 aa, Entamoeba dispar
KNDLPEI

SEQ ID NO: 2438166 - protein, 13 aa, Entamoeba dispar
KNDLPETSITEQE

SEQ ID NO: 2438167 - protein, 11 aa, Entamoeba dispar
KNDNERKDSIS

SEQ ID NO: 2438168 - protein, 5 aa, Entamoeba dispar
KNDNQ

SEQ ID NO: 2438169 - protein, 4 aa, Entamoeba dispar
KNDP

SEQ ID NO: 2438170 - protein, 5 aa, Entamoeba dispar
KNDPI

SEQ ID NO: 2438171 - protein, 10 aa, Entamoeba dispar
KNDPKIVPTI

SEQ ID NO: 2438172 - protein, 7 aa, Entamoeba dispar
KNDPKKC

SEQ ID NO: 2438173 - protein, 6 aa, Entamoeba dispar
KNDPKS

SEQ ID NO: 2438174 - protein, 5 aa, Entamoeba dispar
KNDPN

SEQ ID NO: 2438175 - protein, 8 aa, Entamoeba dispar
KNDPQLQE

SEQ ID NO: 2438176 - protein, 5 aa, Entamoeba dispar
KNDQE

SEQ ID NO: 2438177 - protein, 5 aa, Entamoeba dispar
KNDRY

SEQ ID NO: 2438178 - protein, 4 aa, Entamoeba dispar
KNDS

SEQ ID NO: 2438179 - protein, 9 aa, Entamoeba dispar
KNDSEKKIP

SEQ ID NO: 2438180 - protein, 16 aa, Entamoeba dispar
KNDSPQIAEQQNGGVC

SEQ ID NO: 2438181 - protein, 7 aa, Entamoeba dispar
KNDSTDH

SEQ ID NO: 2438182 - protein, 7 aa, Entamoeba dispar
KNDSTRT

SEQ ID NO: 2438183 - protein, 9 aa, Entamoeba dispar
KNDSYGKEI

SEQ ID NO: 2438184 - protein, 8 aa, Entamoeba dispar
KNDTEAKG

SEQ ID NO: 2438185 - protein, 9 aa, Entamoeba dispar
KNDTNQKKI

SEQ ID NO: 2438186 - protein, 5 aa, Entamoeba dispar
KNDVF

SEQ ID NO: 2438187 - protein, 12 aa, Entamoeba dispar
KNDVSNPPYDTR

SEQ ID NO: 2438188 - protein, 7 aa, Entamoeba dispar
KNDYDVK

SEQ ID NO: 2438189 - protein, 5 aa, Entamoeba dispar
KNDYE

SEQ ID NO: 2438190 - protein, 7 aa, Entamoeba dispar
KNEADEY

SEQ ID NO: 2438191 - protein, 14 aa, Entamoeba dispar
KNEDGIYKPTTIAG

SEQ ID NO: 2438192 - protein, 10 aa, Entamoeba dispar
KNEDRTENIQ

SEQ ID NO: 2438193 - protein, 7 aa, Entamoeba dispar
KNEEDII

SEQ ID NO: 2438194 - protein, 9 aa, Entamoeba dispar
KNEEEEVEN

SEQ ID NO: 2438195 - protein, 7 aa, Entamoeba dispar
KNEEEFT

SEQ ID NO: 2438196 - protein, 7 aa, Entamoeba dispar
KNEEEIR

SEQ ID NO: 2438197 - protein, 16 aa, Entamoeba dispar
KNEEFENIRNKNKELR

SEQ ID NO: 2438198 - protein, 34 aa, Entamoeba dispar
KNEEIKKEEEEEENAWEDEEDQNKTNIPSSKRYE

SEQ ID NO: 2438199 - protein, 7 aa, Entamoeba dispar
KNEEKAE

SEQ ID NO: 2438200 - protein, 10 aa, Entamoeba dispar
KNEEKRQKLL

SEQ ID NO: 2438201 - protein, 8 aa, Entamoeba dispar
KNEEKTKC

SEQ ID NO: 2438202 - protein, 10 aa, Entamoeba dispar
KNEEKYPKKY

SEQ ID NO: 2438203 - protein, 14 aa, Entamoeba dispar
KNEELVDGGPQDKY

SEQ ID NO: 2438204 - protein, 8 aa, Entamoeba dispar
KNEENKRE

SEQ ID NO: 2438205 - protein, 5 aa, Entamoeba dispar
KNEET

SEQ ID NO: 2438206 - protein, 7 aa, Entamoeba dispar
KNEFTDL

SEQ ID NO: 2438207 - protein, 7 aa, Entamoeba dispar
KNEGATE

SEQ ID NO: 2438208 - protein, 10 aa, Entamoeba dispar
KNEGDDSDFE

SEQ ID NO: 2438209 - protein, 8 aa, Entamoeba dispar
KNEGNTEL

SEQ ID NO: 2438210 - protein, 6 aa, Entamoeba dispar
KNEGVS

SEQ ID NO: 2438211 - protein, 6 aa, Entamoeba dispar
KNEIER

SEQ ID NO: 2438212 - protein, 12 aa, Entamoeba dispar
KNEIKREQGTRE

SEQ ID NO: 2438213 - protein, 7 aa, Entamoeba dispar
KNEIKTL

SEQ ID NO: 2438214 - protein, 6 aa, Entamoeba dispar
KNEKDK

SEQ ID NO: 2438215 - protein, 11 aa, Entamoeba dispar
KNEKDPNQRSE

SEQ ID NO: 2438216 - protein, 5 aa, Entamoeba dispar
KNEKE

SEQ ID NO: 2438217 - protein, 10 aa, Entamoeba dispar
KNEKENTSKM

SEQ ID NO: 2438218 - protein, 7 aa, Entamoeba dispar
KNEKGEN

SEQ ID NO: 2438219 - protein, 6 aa, Entamoeba dispar
KNEKIT

SEQ ID NO: 2438220 - protein, 7 aa, Entamoeba dispar
KNEKLSN

SEQ ID NO: 2438221 - protein, 6 aa, Entamoeba dispar
KNEKTY

SEQ ID NO: 2438222 - protein, 7 aa, Entamoeba dispar
KNEKYNK

SEQ ID NO: 2438223 - protein, 6 aa, Entamoeba dispar
KNELEK

SEQ ID NO: 2438224 - protein, 5 aa, Entamoeba dispar
KNELG

SEQ ID NO: 2438225 - protein, 18 aa, Entamoeba dispar
KNELHEDSDSEKKEKKDE

SEQ ID NO: 2438226 - protein, 5 aa, Entamoeba dispar
KNELK

SEQ ID NO: 2438227 - protein, 21 aa, Entamoeba dispar
KNELSKRKKQYKTKDSSKSYN

SEQ ID NO: 2438228 - protein, 11 aa, Entamoeba dispar
KNELSNKTNQV

SEQ ID NO: 2438229 - protein, 12 aa, Entamoeba dispar
KNEMDKGLKDGY

SEQ ID NO: 2438230 - protein, 13 aa, Entamoeba dispar
KNEMNSLKKKNAF

SEQ ID NO: 2438231 - protein, 4 aa, Entamoeba dispar
KNEN

SEQ ID NO: 2438232 - protein, 6 aa, Entamoeba dispar
KNENDI

SEQ ID NO: 2438233 - protein, 9 aa, Entamoeba dispar
KNENDKQKI

SEQ ID NO: 2438234 - protein, 17 aa, Entamoeba dispar
KNENEALRSEEEKLLQP

SEQ ID NO: 2438235 - protein, 8 aa, Entamoeba dispar
KNENEEVP

SEQ ID NO: 2438236 - protein, 7 aa, Entamoeba dispar
KNENEIG

SEQ ID NO: 2438237 - protein, 14 aa, Entamoeba dispar
KNENEKLKTEKEEL

SEQ ID NO: 2438238 - protein, 7 aa, Entamoeba dispar
KNENGIP

SEQ ID NO: 2438239 - protein, 18 aa, Entamoeba dispar
KNENIKEESKEEVGGKKM

SEQ ID NO: 2438240 - protein, 9 aa, Entamoeba dispar
KNENKGKFV

SEQ ID NO: 2438241 - protein, 10 aa, Entamoeba dispar
KNENMKNEDW

SEQ ID NO: 2438242 - protein, 15 aa, Entamoeba dispar
KNENVQQITQKSKKV

SEQ ID NO: 2438243 - protein, 7 aa, Entamoeba dispar
KNEPYSN

SEQ ID NO: 2438244 - protein, 7 aa, Entamoeba dispar
KNEQIRE

SEQ ID NO: 2438245 - protein, 14 aa, Entamoeba dispar
KNEQLAANFLLDGF

SEQ ID NO: 2438246 - protein, 5 aa, Entamoeba dispar
KNEQN

SEQ ID NO: 2438247 - protein, 5 aa, Entamoeba dispar
KNEQR

SEQ ID NO: 2438248 - protein, 6 aa, Entamoeba dispar
KNEQRY

SEQ ID NO: 2438249 - protein, 5 aa, Entamoeba dispar
KNESH

SEQ ID NO: 2438250 - protein, 5 aa, Entamoeba dispar
KNESL

SEQ ID NO: 2438251 - protein, 8 aa, Entamoeba dispar
KNESNEKR

SEQ ID NO: 2438252 - protein, 15 aa, Entamoeba dispar
KNESPLSLAKEKGSM

SEQ ID NO: 2438253 - protein, 10 aa, Entamoeba dispar
KNESRQTKGM

SEQ ID NO: 2438254 - protein, 9 aa, Entamoeba dispar
KNESTLQPI

SEQ ID NO: 2438255 - protein, 5 aa, Entamoeba dispar
KNETI

SEQ ID NO: 2438256 - protein, 6 aa, Entamoeba dispar
KNETIE

SEQ ID NO: 2438257 - protein, 12 aa, Entamoeba dispar
KNETIPRDCFDE

SEQ ID NO: 2438258 - protein, 16 aa, Entamoeba dispar
KNETIPRNCFEWWIRM

SEQ ID NO: 2438259 - protein, 12 aa, Entamoeba dispar
KNETIPRNCFKF

SEQ ID NO: 2438260 - protein, 12 aa, Entamoeba dispar
KNETKARDCFDE

SEQ ID NO: 2438261 - protein, 5 aa, Entamoeba dispar
KNETM

SEQ ID NO: 2438262 - protein, 7 aa, Entamoeba dispar
KNETNEK

SEQ ID NO: 2438263 - protein, 8 aa, Entamoeba dispar
KNETSTGI

SEQ ID NO: 2438264 - protein, 24 aa, Entamoeba dispar
KNETTLETHPTNDVQKKPEQPNIQ

SEQ ID NO: 2438265 - protein, 5 aa, Entamoeba dispar
KNETV

SEQ ID NO: 2438266 - protein, 4 aa, Entamoeba dispar
KNEV

SEQ ID NO: 2438267 - protein, 8 aa, Entamoeba dispar
KNEVKSNV

SEQ ID NO: 2438268 - protein, 9 aa, Entamoeba dispar
KNEVLKKEN

SEQ ID NO: 2438269 - protein, 25 aa, Entamoeba dispar
KNEVSEEDIRSIGEKTDGYSGSDMK

SEQ ID NO: 2438270 - protein, 4 aa, Entamoeba dispar
KNEW

SEQ ID NO: 2438271 - protein, 27 aa, Entamoeba dispar
KNFAAKKGVDGQMKQGVGESKPKGYGI

SEQ ID NO: 2438272 - protein, 6 aa, Entamoeba dispar
KNFGNQ

SEQ ID NO: 2438273 - protein, 6 aa, Entamoeba dispar
KNFGSD

SEQ ID NO: 2438274 - protein, 7 aa, Entamoeba dispar
KNFGTNC

SEQ ID NO: 2438275 - protein, 5 aa, Entamoeba dispar
KNFNN

SEQ ID NO: 2438276 - protein, 10 aa, Entamoeba dispar
KNFPEEDYSE

SEQ ID NO: 2438277 - protein, 7 aa, Entamoeba dispar
KNFSKDI

SEQ ID NO: 2438278 - protein, 5 aa, Entamoeba dispar
KNFSN

SEQ ID NO: 2438279 - protein, 6 aa, Entamoeba dispar
KNFYEQ

SEQ ID NO: 2438280 - protein, 5 aa, Entamoeba dispar
KNGAC

SEQ ID NO: 2438281 - protein, 9 aa, Entamoeba dispar
KNGASNKVS

SEQ ID NO: 2438282 - protein, 6 aa, Entamoeba dispar
KNGDEC

SEQ ID NO: 2438283 - protein, 9 aa, Entamoeba dispar
KNGEKEELS

SEQ ID NO: 2438284 - protein, 10 aa, Entamoeba dispar
KNGEMNVNGE

SEQ ID NO: 2438285 - protein, 6 aa, Entamoeba dispar
KNGETH

SEQ ID NO: 2438286 - protein, 7 aa, Entamoeba dispar
KNGFDRE

SEQ ID NO: 2438287 - protein, 6 aa, Entamoeba dispar
KNGFEN

SEQ ID NO: 2438288 - protein, 5 aa, Entamoeba dispar
KNGGG

SEQ ID NO: 2438289 - protein, 10 aa, Entamoeba dispar
KNGGGNGSVF

SEQ ID NO: 2438290 - protein, 6 aa, Entamoeba dispar
KNGGPT

SEQ ID NO: 2438291 - protein, 7 aa, Entamoeba dispar
KNGGSLH

SEQ ID NO: 2438292 - protein, 7 aa, Entamoeba dispar
KNGGTVN

SEQ ID NO: 2438293 - protein, 12 aa, Entamoeba dispar
KNGGYPDDLPPV

SEQ ID NO: 2438294 - protein, 5 aa, Entamoeba dispar
KNGHA

SEQ ID NO: 2438295 - protein, 7 aa, Entamoeba dispar
KNGIPTN

SEQ ID NO: 2438296 - protein, 15 aa, Entamoeba dispar
KNGISRISKQNDEGI

SEQ ID NO: 2438297 - protein, 12 aa, Entamoeba dispar
KNGKGKKRLINE

SEQ ID NO: 2438298 - protein, 6 aa, Entamoeba dispar
KNGKKK

SEQ ID NO: 2438299 - protein, 7 aa, Entamoeba dispar
KNGKRDP

SEQ ID NO: 2438300 - protein, 7 aa, Entamoeba dispar
KNGKSWK

SEQ ID NO: 2438301 - protein, 17 aa, Entamoeba dispar
KNGKTKEIIEKIQKAIK

SEQ ID NO: 2438302 - protein, 10 aa, Entamoeba dispar
KNGKTWSETE

SEQ ID NO: 2438303 - protein, 13 aa, Entamoeba dispar
KNGKWKSESLKEY

SEQ ID NO: 2438304 - protein, 5 aa, Entamoeba dispar
KNGLI

SEQ ID NO: 2438305 - protein, 7 aa, Entamoeba dispar
KNGLTKT

SEQ ID NO: 2438306 - protein, 9 aa, Entamoeba dispar
KNGNEKVAE

SEQ ID NO: 2438307 - protein, 7 aa, Entamoeba dispar
KNGNENI

SEQ ID NO: 2438308 - protein, 7 aa, Entamoeba dispar
KNGNLSI

SEQ ID NO: 2438309 - protein, 5 aa, Entamoeba dispar
KNGNN

SEQ ID NO: 2438310 - protein, 18 aa, Entamoeba dispar
KNGNSKYNQQITKKCNEE

SEQ ID NO: 2438311 - protein, 7 aa, Entamoeba dispar
KNGNTNK

SEQ ID NO: 2438312 - protein, 12 aa, Entamoeba dispar
KNGQTYRLNGSE

SEQ ID NO: 2438313 - protein, 10 aa, Entamoeba dispar
KNGRNAGRGY

SEQ ID NO: 2438314 - protein, 4 aa, Entamoeba dispar
KNGS

SEQ ID NO: 2438315 - protein, 8 aa, Entamoeba dispar
KNGSEEAV

SEQ ID NO: 2438316 - protein, 10 aa, Entamoeba dispar
KNGSKTRSNG

SEQ ID NO: 2438317 - protein, 11 aa, Entamoeba dispar
KNGSNAKFKEI

SEQ ID NO: 2438318 - protein, 8 aa, Entamoeba dispar
KNGSTDQS

SEQ ID NO: 2438319 - protein, 8 aa, Entamoeba dispar
KNGSTEQS

SEQ ID NO: 2438320 - protein, 7 aa, Entamoeba dispar
KNGSTLD

SEQ ID NO: 2438321 - protein, 8 aa, Entamoeba dispar
KNGTEYGK

SEQ ID NO: 2438322 - protein, 9 aa, Entamoeba dispar
KNGTGVKKD

SEQ ID NO: 2438323 - protein, 8 aa, Entamoeba dispar
KNGTRTKE

SEQ ID NO: 2438324 - protein, 5 aa, Entamoeba dispar
KNGTV

SEQ ID NO: 2438325 - protein, 9 aa, Entamoeba dispar
KNGVDIGKP

SEQ ID NO: 2438326 - protein, 11 aa, Entamoeba dispar
KNGVPTMPESD

SEQ ID NO: 2438327 - protein, 7 aa, Entamoeba dispar
KNGYQSE

SEQ ID NO: 2438328 - protein, 6 aa, Entamoeba dispar
KNHCPE

SEQ ID NO: 2438329 - protein, 7 aa, Entamoeba dispar
KNHEKGK

SEQ ID NO: 2438330 - protein, 8 aa, Entamoeba dispar
KNHENDGS

SEQ ID NO: 2438331 - protein, 7 aa, Entamoeba dispar
KNHETGK

SEQ ID NO: 2438332 - protein, 4 aa, Entamoeba dispar
KNHI

SEQ ID NO: 2438333 - protein, 11 aa, Entamoeba dispar
KNHKDIEATKK

SEQ ID NO: 2438334 - protein, 7 aa, Entamoeba dispar
KNHKYEI

SEQ ID NO: 2438335 - protein, 5 aa, Entamoeba dispar
KNHLQ

SEQ ID NO: 2438336 - protein, 18 aa, Entamoeba dispar
KNHRPKQRQALLQWSHFC

SEQ ID NO: 2438337 - protein, 8 aa, Entamoeba dispar
KNHTTKVE

SEQ ID NO: 2438338 - protein, 8 aa, Entamoeba dispar
KNHVPRTS

SEQ ID NO: 2438339 - protein, 6 aa, Entamoeba dispar
KNIAST

SEQ ID NO: 2438340 - protein, 6 aa, Entamoeba dispar
KNIDEM

SEQ ID NO: 2438341 - protein, 5 aa, Entamoeba dispar
KNIDN

SEQ ID NO: 2438342 - protein, 15 aa, Entamoeba dispar
KNIDSGKYKHDKRRK

SEQ ID NO: 2438343 - protein, 7 aa, Entamoeba dispar
KNIEKKI

SEQ ID NO: 2438344 - protein, 11 aa, Entamoeba dispar
KNIEKKQLEQR

SEQ ID NO: 2438345 - protein, 7 aa, Entamoeba dispar
KNIEKKS

SEQ ID NO: 2438346 - protein, 12 aa, Entamoeba dispar
KNIENKDINEFI

SEQ ID NO: 2438347 - protein, 7 aa, Entamoeba dispar
KNIETSL

SEQ ID NO: 2438348 - protein, 16 aa, Entamoeba dispar
KNIKNEKEKIKETARE

SEQ ID NO: 2438349 - protein, 5 aa, Entamoeba dispar
KNIKS

SEQ ID NO: 2438350 - protein, 11 aa, Entamoeba dispar
KNIKSTGEERL

SEQ ID NO: 2438351 - protein, 14 aa, Entamoeba dispar
KNIKTQEKCHENQK

SEQ ID NO: 2438352 - protein, 23 aa, Entamoeba dispar
KNILKKEELKQKEPSSFKKEEEL

SEQ ID NO: 2438353 - protein, 10 aa, Entamoeba dispar
KNINEVGKDG

SEQ ID NO: 2438354 - protein, 26 aa, Entamoeba dispar
KNINGKRLSPRESSKKEVKPKSPFKK

SEQ ID NO: 2438355 - protein, 11 aa, Entamoeba dispar
KNINKEKGENK

SEQ ID NO: 2438356 - protein, 19 aa, Entamoeba dispar
KNINKKKDDTIKQLPTDNT

SEQ ID NO: 2438357 - protein, 27 aa, Entamoeba dispar
KNINKKTITEPKTPQELGVTSARNLNE

SEQ ID NO: 2438358 - protein, 18 aa, Entamoeba dispar
KNIPIKGSKQLKNQGGGK

SEQ ID NO: 2438359 - protein, 14 aa, Entamoeba dispar
KNIPSAQEAESIKE

SEQ ID NO: 2438360 - protein, 38 aa, Entamoeba dispar
KNIPSKDQISDPKVKRKRSEPDAVSLKDDLKKSTSLQY

SEQ ID NO: 2438361 - protein, 4 aa, Entamoeba dispar
KNIQ

SEQ ID NO: 2438362 - protein, 7 aa, Entamoeba dispar
KNIRDDE

SEQ ID NO: 2438363 - protein, 18 aa, Entamoeba dispar
KNIRDDNKHSFEPSYSGG

SEQ ID NO: 2438364 - protein, 4 aa, Entamoeba dispar
KNIS

SEQ ID NO: 2438365 - protein, 17 aa, Entamoeba dispar
KNISEVSEDETTQINES

SEQ ID NO: 2438366 - protein, 6 aa, Entamoeba dispar
KNISKE

SEQ ID NO: 2438367 - protein, 6 aa, Entamoeba dispar
KNISKK

SEQ ID NO: 2438368 - protein, 9 aa, Entamoeba dispar
KNISNPKAV

SEQ ID NO: 2438369 - protein, 5 aa, Entamoeba dispar
KNITD

SEQ ID NO: 2438370 - protein, 5 aa, Entamoeba dispar
KNITG

SEQ ID NO: 2438371 - protein, 6 aa, Entamoeba dispar
KNITQT

SEQ ID NO: 2438372 - protein, 7 aa, Entamoeba dispar
KNIYGDG

SEQ ID NO: 2438373 - protein, 12 aa, Entamoeba dispar
KNKADEYGGIDE

SEQ ID NO: 2438374 - protein, 9 aa, Entamoeba dispar
KNKAITTDE

SEQ ID NO: 2438375 - protein, 8 aa, Entamoeba dispar
KNKALRDP

SEQ ID NO: 2438376 - protein, 4 aa, Entamoeba dispar
KNKC

SEQ ID NO: 2438377 - protein, 8 aa, Entamoeba dispar
KNKDDNTP

SEQ ID NO: 2438378 - protein, 9 aa, Entamoeba dispar
KNKDGQDHM

SEQ ID NO: 2438379 - protein, 16 aa, Entamoeba dispar
KNKDKSITISSNNLPQ

SEQ ID NO: 2438380 - protein, 5 aa, Entamoeba dispar
KNKDM

SEQ ID NO: 2438381 - protein, 8 aa, Entamoeba dispar
KNKDNTVS

SEQ ID NO: 2438382 - protein, 9 aa, Entamoeba dispar
KNKDPKPGI

SEQ ID NO: 2438383 - protein, 9 aa, Entamoeba dispar
KNKDSTISE

SEQ ID NO: 2438384 - protein, 5 aa, Entamoeba dispar
KNKDV

SEQ ID NO: 2438385 - protein, 5 aa, Entamoeba dispar
KNKDY

SEQ ID NO: 2438386 - protein, 7 aa, Entamoeba dispar
KNKEADQ

SEQ ID NO: 2438387 - protein, 6 aa, Entamoeba dispar
KNKEEF

SEQ ID NO: 2438388 - protein, 20 aa, Entamoeba dispar
KNKEIEDKDAESSLEEGEMN

SEQ ID NO: 2438389 - protein, 6 aa, Entamoeba dispar
KNKEIS

SEQ ID NO: 2438390 - protein, 14 aa, Entamoeba dispar
KNKEKEINDIKTNQ

SEQ ID NO: 2438391 - protein, 15 aa, Entamoeba dispar
KNKENELKQKNKQYH

SEQ ID NO: 2438392 - protein, 8 aa, Entamoeba dispar
KNKEQKYI

SEQ ID NO: 2438393 - protein, 7 aa, Entamoeba dispar
KNKEQWN

SEQ ID NO: 2438394 - protein, 8 aa, Entamoeba dispar
KNKERDNI

SEQ ID NO: 2438395 - protein, 9 aa, Entamoeba dispar
KNKETDEKY

SEQ ID NO: 2438396 - protein, 7 aa, Entamoeba dispar
KNKETLE

SEQ ID NO: 2438397 - protein, 7 aa, Entamoeba dispar
KNKFERT

SEQ ID NO: 2438398 - protein, 18 aa, Entamoeba dispar
KNKFGGNTPLCPFDCDCC

SEQ ID NO: 2438399 - protein, 17 aa, Entamoeba dispar
KNKGELSKINTKSDEYR

SEQ ID NO: 2438400 - protein, 8 aa, Entamoeba dispar
KNKGSEVE

SEQ ID NO: 2438401 - protein, 8 aa, Entamoeba dispar
KNKGVSMP

SEQ ID NO: 2438402 - protein, 4 aa, Entamoeba dispar
KNKI

SEQ ID NO: 2438403 - protein, 15 aa, Entamoeba dispar
KNKIQGKYEADSNNH

SEQ ID NO: 2438404 - protein, 8 aa, Entamoeba dispar
KNKKAKEI

SEQ ID NO: 2438405 - protein, 5 aa, Entamoeba dispar
KNKKE

SEQ ID NO: 2438406 - protein, 19 aa, Entamoeba dispar
KNKKGERYGDASERLLARG

SEQ ID NO: 2438407 - protein, 13 aa, Entamoeba dispar
KNKKISDDKVTPI

SEQ ID NO: 2438408 - protein, 20 aa, Entamoeba dispar
KNKKLSESTLTEQNSSESKD

SEQ ID NO: 2438409 - protein, 5 aa, Entamoeba dispar
KNKKM

SEQ ID NO: 2438410 - protein, 14 aa, Entamoeba dispar
KNKKTGEIVNEQPE

SEQ ID NO: 2438411 - protein, 5 aa, Entamoeba dispar
KNKKY

SEQ ID NO: 2438412 - protein, 4 aa, Entamoeba dispar
KNKL

SEQ ID NO: 2438413 - protein, 6 aa, Entamoeba dispar
KNKLDK

SEQ ID NO: 2438414 - protein, 9 aa, Entamoeba dispar
KNKLKDKVY

SEQ ID NO: 2438415 - protein, 11 aa, Entamoeba dispar
KNKLKKAFQGK

SEQ ID NO: 2438416 - protein, 8 aa, Entamoeba dispar
KNKLPEKE

SEQ ID NO: 2438417 - protein, 4 aa, Entamoeba dispar
KNKM

SEQ ID NO: 2438418 - protein, 6 aa, Entamoeba dispar
KNKNEN

SEQ ID NO: 2438419 - protein, 7 aa, Entamoeba dispar
KNKNIAP

SEQ ID NO: 2438420 - protein, 12 aa, Entamoeba dispar
KNKNKEKKGVMR

SEQ ID NO: 2438421 - protein, 6 aa, Entamoeba dispar
KNKNNE

SEQ ID NO: 2438422 - protein, 5 aa, Entamoeba dispar
KNKNQ

SEQ ID NO: 2438423 - protein, 13 aa, Entamoeba dispar
KNKNSWDENISSV

SEQ ID NO: 2438424 - protein, 5 aa, Entamoeba dispar
KNKNV

SEQ ID NO: 2438425 - protein, 4 aa, Entamoeba dispar
KNKP

SEQ ID NO: 2438426 - protein, 27 aa, Entamoeba dispar
KNKPFKRRTGSKRQQKIKGKKKTETVS

SEQ ID NO: 2438427 - protein, 13 aa, Entamoeba dispar
KNKPKGKDEKKSC

SEQ ID NO: 2438428 - protein, 18 aa, Entamoeba dispar
KNKPQQIITNTKTKYEQA

SEQ ID NO: 2438429 - protein, 10 aa, Entamoeba dispar
KNKPSKYGSV

SEQ ID NO: 2438430 - protein, 8 aa, Entamoeba dispar
KNKPTKRV

SEQ ID NO: 2438431 - protein, 7 aa, Entamoeba dispar
KNKQERF

SEQ ID NO: 2438432 - protein, 8 aa, Entamoeba dispar
KNKQKDTI

SEQ ID NO: 2438433 - protein, 8 aa, Entamoeba dispar
KNKQLSKT

SEQ ID NO: 2438434 - protein, 12 aa, Entamoeba dispar
KNKRIPRDCFDK

SEQ ID NO: 2438435 - protein, 12 aa, Entamoeba dispar
KNKRIPRDCFNK

SEQ ID NO: 2438436 - protein, 13 aa, Entamoeba dispar
KNKRIPRKCFDKW

SEQ ID NO: 2438437 - protein, 9 aa, Entamoeba dispar
KNKRKEEQV

SEQ ID NO: 2438438 - protein, 7 aa, Entamoeba dispar
KNKRNQL

SEQ ID NO: 2438439 - protein, 8 aa, Entamoeba dispar
KNKRRDKE

SEQ ID NO: 2438440 - protein, 9 aa, Entamoeba dispar
KNKRTKKQI

SEQ ID NO: 2438441 - protein, 8 aa, Entamoeba dispar
KNKSDCDG

SEQ ID NO: 2438442 - protein, 7 aa, Entamoeba dispar
KNKSGVN

SEQ ID NO: 2438443 - protein, 8 aa, Entamoeba dispar
KNKSGVNV

SEQ ID NO: 2438444 - protein, 7 aa, Entamoeba dispar
KNKSKRV

SEQ ID NO: 2438445 - protein, 9 aa, Entamoeba dispar
KNKSTKCGQ

SEQ ID NO: 2438446 - protein, 9 aa, Entamoeba dispar
KNKSTTYKQ

SEQ ID NO: 2438447 - protein, 4 aa, Entamoeba dispar
KNKT

SEQ ID NO: 2438448 - protein, 5 aa, Entamoeba dispar
KNKTI

SEQ ID NO: 2438449 - protein, 12 aa, Entamoeba dispar
KNKTIPRNCFNK

SEQ ID NO: 2438450 - protein, 9 aa, Entamoeba dispar
KNKTKAFNE

SEQ ID NO: 2438451 - protein, 8 aa, Entamoeba dispar
KNKTPEEV

SEQ ID NO: 2438452 - protein, 11 aa, Entamoeba dispar
KNKTSEGIQED

SEQ ID NO: 2438453 - protein, 9 aa, Entamoeba dispar
KNKTSLAES

SEQ ID NO: 2438454 - protein, 6 aa, Entamoeba dispar
KNKTTM

SEQ ID NO: 2438455 - protein, 9 aa, Entamoeba dispar
KNKVDEYNA

SEQ ID NO: 2438456 - protein, 20 aa, Entamoeba dispar
KNKWGSRSLTDKEKENTIDT

SEQ ID NO: 2438457 - protein, 8 aa, Entamoeba dispar
KNLEEEDL

SEQ ID NO: 2438458 - protein, 5 aa, Entamoeba dispar
KNLGE

SEQ ID NO: 2438459 - protein, 6 aa, Entamoeba dispar
KNLKAE

SEQ ID NO: 2438460 - protein, 9 aa, Entamoeba dispar
KNLKATNKH

SEQ ID NO: 2438461 - protein, 14 aa, Entamoeba dispar
KNLKGHKKHSKGTV

SEQ ID NO: 2438462 - protein, 16 aa, Entamoeba dispar
KNLKGLPKEAFSSSTT

SEQ ID NO: 2438463 - protein, 7 aa, Entamoeba dispar
KNLKGSD

SEQ ID NO: 2438464 - protein, 5 aa, Entamoeba dispar
KNLKN

SEQ ID NO: 2438465 - protein, 19 aa, Entamoeba dispar
KNLKNDKSTLKENEITEGS

SEQ ID NO: 2438466 - protein, 5 aa, Entamoeba dispar
KNLKS

SEQ ID NO: 2438467 - protein, 12 aa, Entamoeba dispar
KNLNDENRNEQK

SEQ ID NO: 2438468 - protein, 5 aa, Entamoeba dispar
KNLPK

SEQ ID NO: 2438469 - protein, 6 aa, Entamoeba dispar
KNLPSV

SEQ ID NO: 2438470 - protein, 5 aa, Entamoeba dispar
KNLQN

SEQ ID NO: 2438471 - protein, 5 aa, Entamoeba dispar
KNLQR

SEQ ID NO: 2438472 - protein, 9 aa, Entamoeba dispar
KNLRERSSD

SEQ ID NO: 2438473 - protein, 4 aa, Entamoeba dispar
KNLS

SEQ ID NO: 2438474 - protein, 9 aa, Entamoeba dispar
KNLSEEKRD

SEQ ID NO: 2438475 - protein, 4 aa, Entamoeba dispar
KNLT

SEQ ID NO: 2438476 - protein, 13 aa, Entamoeba dispar
KNMGNWEEQYTQD

SEQ ID NO: 2438477 - protein, 5 aa, Entamoeba dispar
KNMKI

SEQ ID NO: 2438478 - protein, 6 aa, Entamoeba dispar
KNMPID

SEQ ID NO: 2438479 - protein, 6 aa, Entamoeba dispar
KNMPMT

SEQ ID NO: 2438480 - protein, 4 aa, Entamoeba dispar
KNMR

SEQ ID NO: 2438481 - protein, 9 aa, Entamoeba dispar
KNNASENAS

SEQ ID NO: 2438482 - protein, 6 aa, Entamoeba dispar
KNNDLK

SEQ ID NO: 2438483 - protein, 24 aa, Entamoeba dispar
KNNEEDNIVESQSVDTTKKGDEVA

SEQ ID NO: 2438484 - protein, 8 aa, Entamoeba dispar
KNNEITSD

SEQ ID NO: 2438485 - protein, 9 aa, Entamoeba dispar
KNNEKAQDL

SEQ ID NO: 2438486 - protein, 7 aa, Entamoeba dispar
KNNEKQS

SEQ ID NO: 2438487 - protein, 5 aa, Entamoeba dispar
KNNEL

SEQ ID NO: 2438488 - protein, 8 aa, Entamoeba dispar
KNNELTKA

SEQ ID NO: 2438489 - protein, 10 aa, Entamoeba dispar
KNNESTIKEL

SEQ ID NO: 2438490 - protein, 6 aa, Entamoeba dispar
KNNFTE

SEQ ID NO: 2438491 - protein, 7 aa, Entamoeba dispar
KNNGGGS

SEQ ID NO: 2438492 - protein, 16 aa, Entamoeba dispar
KNNGIERDNGEVELAG

SEQ ID NO: 2438493 - protein, 6 aa, Entamoeba dispar
KNNGIG

SEQ ID NO: 2438494 - protein, 7 aa, Entamoeba dispar
KNNGLDG

SEQ ID NO: 2438495 - protein, 8 aa, Entamoeba dispar
KNNKATRM

SEQ ID NO: 2438496 - protein, 11 aa, Entamoeba dispar
KNNKEKEKKIQ

SEQ ID NO: 2438497 - protein, 8 aa, Entamoeba dispar
KNNKGLKA

SEQ ID NO: 2438498 - protein, 7 aa, Entamoeba dispar
KNNKNEL

SEQ ID NO: 2438499 - protein, 7 aa, Entamoeba dispar
KNNKREC

SEQ ID NO: 2438500 - protein, 10 aa, Entamoeba dispar
KNNKSSEFAQ

SEQ ID NO: 2438501 - protein, 7 aa, Entamoeba dispar
KNNLPGI

SEQ ID NO: 2438502 - protein, 14 aa, Entamoeba dispar
KNNMSDKEEPEIES

SEQ ID NO: 2438503 - protein, 5 aa, Entamoeba dispar
KNNNE

SEQ ID NO: 2438504 - protein, 8 aa, Entamoeba dispar
KNNNNTLE

SEQ ID NO: 2438505 - protein, 6 aa, Entamoeba dispar
KNNPHG

SEQ ID NO: 2438506 - protein, 17 aa, Entamoeba dispar
KNNPLFEQEKSGLKDQT

SEQ ID NO: 2438507 - protein, 5 aa, Entamoeba dispar
KNNQE

SEQ ID NO: 2438508 - protein, 14 aa, Entamoeba dispar
KNNQGIKIDKSKSY

SEQ ID NO: 2438509 - protein, 7 aa, Entamoeba dispar
KNNQPDF

SEQ ID NO: 2438510 - protein, 5 aa, Entamoeba dispar
KNNQT

SEQ ID NO: 2438511 - protein, 8 aa, Entamoeba dispar
KNNRGYTI

SEQ ID NO: 2438512 - protein, 8 aa, Entamoeba dispar
KNNSKSTF

SEQ ID NO: 2438513 - protein, 16 aa, Entamoeba dispar
KNNSKTVSKRMKLFWL

SEQ ID NO: 2438514 - protein, 11 aa, Entamoeba dispar
KNNSLTTPRQT

SEQ ID NO: 2438515 - protein, 6 aa, Entamoeba dispar
KNNSMN

SEQ ID NO: 2438516 - protein, 9 aa, Entamoeba dispar
KNNSNYSQQ

SEQ ID NO: 2438517 - protein, 7 aa, Entamoeba dispar
KNNTEDI

SEQ ID NO: 2438518 - protein, 6 aa, Entamoeba dispar
KNNTLE

SEQ ID NO: 2438519 - protein, 5 aa, Entamoeba dispar
KNNYQ

SEQ ID NO: 2438520 - protein, 6 aa, Entamoeba dispar
KNNYSP

SEQ ID NO: 2438521 - protein, 9 aa, Entamoeba dispar
KNPDAPLPS

SEQ ID NO: 2438522 - protein, 8 aa, Entamoeba dispar
KNPDCDQQ

SEQ ID NO: 2438523 - protein, 11 aa, Entamoeba dispar
KNPDGKYYTSY

SEQ ID NO: 2438524 - protein, 9 aa, Entamoeba dispar
KNPEDIRQE

SEQ ID NO: 2438525 - protein, 6 aa, Entamoeba dispar
KNPEIS

SEQ ID NO: 2438526 - protein, 16 aa, Entamoeba dispar
KNPENMKKPTQLDPKV

SEQ ID NO: 2438527 - protein, 11 aa, Entamoeba dispar
KNPGSSASIQG

SEQ ID NO: 2438528 - protein, 18 aa, Entamoeba dispar
KNPGVQKYKEKKDKRVNG

SEQ ID NO: 2438529 - protein, 7 aa, Entamoeba dispar
KNPHQSI

SEQ ID NO: 2438530 - protein, 6 aa, Entamoeba dispar
KNPIPQ

SEQ ID NO: 2438531 - protein, 13 aa, Entamoeba dispar
KNPKHQKEYEYLL

SEQ ID NO: 2438532 - protein, 10 aa, Entamoeba dispar
KNPKIEPNSG

SEQ ID NO: 2438533 - protein, 7 aa, Entamoeba dispar
KNPKKKK

SEQ ID NO: 2438534 - protein, 6 aa, Entamoeba dispar
KNPKVS

SEQ ID NO: 2438535 - protein, 5 aa, Entamoeba dispar
KNPLF

SEQ ID NO: 2438536 - protein, 16 aa, Entamoeba dispar
KNPLKSTKKFIKNMNP

SEQ ID NO: 2438537 - protein, 5 aa, Entamoeba dispar
KNPMK

SEQ ID NO: 2438538 - protein, 15 aa, Entamoeba dispar
KNPMKVGSSEVDEVK

SEQ ID NO: 2438539 - protein, 4 aa, Entamoeba dispar
KNPN

SEQ ID NO: 2438540 - protein, 7 aa, Entamoeba dispar
KNPNAIT

SEQ ID NO: 2438541 - protein, 10 aa, Entamoeba dispar
KNPNAPLEEK

SEQ ID NO: 2438542 - protein, 6 aa, Entamoeba dispar
KNPNAT

SEQ ID NO: 2438543 - protein, 6 aa, Entamoeba dispar
KNPNKE

SEQ ID NO: 2438544 - protein, 66 aa, Entamoeba dispar
KNPPAPVKRGGAKGGAKGGSNNRGSRGGNRGGSRGGFNNRGSRGGNRGGSFGGNRGGFGGNKGPRN

SEQ ID NO: 2438545 - protein, 9 aa, Entamoeba dispar
KNPPSRKPV

SEQ ID NO: 2438546 - protein, 8 aa, Entamoeba dispar
KNPQGNEG

SEQ ID NO: 2438547 - protein, 17 aa, Entamoeba dispar
KNPQKKEIREKNITRSQ

SEQ ID NO: 2438548 - protein, 6 aa, Entamoeba dispar
KNPQTL

SEQ ID NO: 2438549 - protein, 4 aa, Entamoeba dispar
KNPS

SEQ ID NO: 2438550 - protein, 7 aa, Entamoeba dispar
KNPSIGE

SEQ ID NO: 2438551 - protein, 8 aa, Entamoeba dispar
KNPSKSLL

SEQ ID NO: 2438552 - protein, 6 aa, Entamoeba dispar
KNPSLK

SEQ ID NO: 2438553 - protein, 5 aa, Entamoeba dispar
KNPSN

SEQ ID NO: 2438554 - protein, 6 aa, Entamoeba dispar
KNPSQK

SEQ ID NO: 2438555 - protein, 10 aa, Entamoeba dispar
KNPSTPITPP

SEQ ID NO: 2438556 - protein, 5 aa, Entamoeba dispar
KNPTD

SEQ ID NO: 2438557 - protein, 7 aa, Entamoeba dispar
KNPTIVQ

SEQ ID NO: 2438558 - protein, 5 aa, Entamoeba dispar
KNPTL

SEQ ID NO: 2438559 - protein, 7 aa, Entamoeba dispar
KNPVEGI

SEQ ID NO: 2438560 - protein, 4 aa, Entamoeba dispar
KNPY

SEQ ID NO: 2438561 - protein, 9 aa, Entamoeba dispar
KNQEEEIRG

SEQ ID NO: 2438562 - protein, 9 aa, Entamoeba dispar
KNQEPKNEI

SEQ ID NO: 2438563 - protein, 12 aa, Entamoeba dispar
KNQFDDKPQVIN

SEQ ID NO: 2438564 - protein, 6 aa, Entamoeba dispar
KNQFKK

SEQ ID NO: 2438565 - protein, 8 aa, Entamoeba dispar
KNQFRSAD

SEQ ID NO: 2438566 - protein, 10 aa, Entamoeba dispar
KNQGEEEDED

SEQ ID NO: 2438567 - protein, 36 aa, Entamoeba dispar
KNQGNQLPKIPQNKKPIPFPSQPTNPLLVIKSWPTV

SEQ ID NO: 2438568 - protein, 9 aa, Entamoeba dispar
KNQGRGSWN

SEQ ID NO: 2438569 - protein, 7 aa, Entamoeba dispar
KNQHPDL

SEQ ID NO: 2438570 - protein, 6 aa, Entamoeba dispar
KNQIRK

SEQ ID NO: 2438571 - protein, 8 aa, Entamoeba dispar
KNQKGSIR

SEQ ID NO: 2438572 - protein, 36 aa, Entamoeba dispar
KNQKKSISSWSSNDISSCNTENKVQKKEDDLAKEKE

SEQ ID NO: 2438573 - protein, 9 aa, Entamoeba dispar
KNQKSQKRA

SEQ ID NO: 2438574 - protein, 18 aa, Entamoeba dispar
KNQKTTQMISQKTEKYGK

SEQ ID NO: 2438575 - protein, 11 aa, Entamoeba dispar
KNQLNSKLKEE

SEQ ID NO: 2438576 - protein, 7 aa, Entamoeba dispar
KNQLTRD

SEQ ID NO: 2438577 - protein, 6 aa, Entamoeba dispar
KNQNLK

SEQ ID NO: 2438578 - protein, 11 aa, Entamoeba dispar
KNQNNGKDEIY

SEQ ID NO: 2438579 - protein, 6 aa, Entamoeba dispar
KNQPAK

SEQ ID NO: 2438580 - protein, 5 aa, Entamoeba dispar
KNQPF

SEQ ID NO: 2438581 - protein, 7 aa, Entamoeba dispar
KNQPIET

SEQ ID NO: 2438582 - protein, 14 aa, Entamoeba dispar
KNQPQKSSHKMCTL

SEQ ID NO: 2438583 - protein, 6 aa, Entamoeba dispar
KNQPQY

SEQ ID NO: 2438584 - protein, 18 aa, Entamoeba dispar
KNQPRYDLSNDKIDKSYP

SEQ ID NO: 2438585 - protein, 17 aa, Entamoeba dispar
KNQPRYDLSNDKIDKTY

SEQ ID NO: 2438586 - protein, 5 aa, Entamoeba dispar
KNQQP

SEQ ID NO: 2438587 - protein, 6 aa, Entamoeba dispar
KNQRKI

SEQ ID NO: 2438588 - protein, 7 aa, Entamoeba dispar
KNQRLAN

SEQ ID NO: 2438589 - protein, 16 aa, Entamoeba dispar
KNQRSEEEAYENNECS

SEQ ID NO: 2438590 - protein, 7 aa, Entamoeba dispar
KNQSNNK

SEQ ID NO: 2438591 - protein, 14 aa, Entamoeba dispar
KNQSSKKSSKKCAL

SEQ ID NO: 2438592 - protein, 7 aa, Entamoeba dispar
KNQSVSP

SEQ ID NO: 2438593 - protein, 26 aa, Entamoeba dispar
KNQTENLPIKQTNSLVTSNTASMPEI

SEQ ID NO: 2438594 - protein, 7 aa, Entamoeba dispar
KNQTNLN

SEQ ID NO: 2438595 - protein, 7 aa, Entamoeba dispar
KNQTQQL

SEQ ID NO: 2438596 - protein, 5 aa, Entamoeba dispar
KNQTT

SEQ ID NO: 2438597 - protein, 8 aa, Entamoeba dispar
KNQTTQEV

SEQ ID NO: 2438598 - protein, 18 aa, Entamoeba dispar
KNQTTTFVSSQDSAEPLR

SEQ ID NO: 2438599 - protein, 8 aa, Entamoeba dispar
KNRDPLER

SEQ ID NO: 2438600 - protein, 9 aa, Entamoeba dispar
KNREREVRS

SEQ ID NO: 2438601 - protein, 8 aa, Entamoeba dispar
KNRETNKM

SEQ ID NO: 2438602 - protein, 6 aa, Entamoeba dispar
KNRGIT

SEQ ID NO: 2438603 - protein, 14 aa, Entamoeba dispar
KNRLTKEERDKLKQ

SEQ ID NO: 2438604 - protein, 7 aa, Entamoeba dispar
KNRNDNL

SEQ ID NO: 2438605 - protein, 5 aa, Entamoeba dispar
KNRNK

SEQ ID NO: 2438606 - protein, 15 aa, Entamoeba dispar
KNRPKRDSKKEQLGT

SEQ ID NO: 2438607 - protein, 15 aa, Entamoeba dispar
KNRRGQVQADGKAKF

SEQ ID NO: 2438608 - protein, 6 aa, Entamoeba dispar
KNRRRI

SEQ ID NO: 2438609 - protein, 6 aa, Entamoeba dispar
KNRTKL

SEQ ID NO: 2438610 - protein, 8 aa, Entamoeba dispar
KNRTKNPY

SEQ ID NO: 2438611 - protein, 5 aa, Entamoeba dispar
KNRTS

SEQ ID NO: 2438612 - protein, 7 aa, Entamoeba dispar
KNRVSNK

SEQ ID NO: 2438613 - protein, 5 aa, Entamoeba dispar
KNSAT

SEQ ID NO: 2438614 - protein, 6 aa, Entamoeba dispar
KNSDVL

SEQ ID NO: 2438615 - protein, 5 aa, Entamoeba dispar
KNSEE

SEQ ID NO: 2438616 - protein, 8 aa, Entamoeba dispar
KNSEEELI

SEQ ID NO: 2438617 - protein, 5 aa, Entamoeba dispar
KNSEI

SEQ ID NO: 2438618 - protein, 15 aa, Entamoeba dispar
KNSELESEEEVRLNL

SEQ ID NO: 2438619 - protein, 6 aa, Entamoeba dispar
KNSENF

SEQ ID NO: 2438620 - protein, 6 aa, Entamoeba dispar
KNSETY

SEQ ID NO: 2438621 - protein, 7 aa, Entamoeba dispar
KNSFPKK

SEQ ID NO: 2438622 - protein, 6 aa, Entamoeba dispar
KNSGNI

SEQ ID NO: 2438623 - protein, 7 aa, Entamoeba dispar
KNSGTID

SEQ ID NO: 2438624 - protein, 11 aa, Entamoeba dispar
KNSGVNKMTAD

SEQ ID NO: 2438625 - protein, 18 aa, Entamoeba dispar
KNSIEETKEVPKKEMSTI

SEQ ID NO: 2438626 - protein, 8 aa, Entamoeba dispar
KNSIEPTI

SEQ ID NO: 2438627 - protein, 7 aa, Entamoeba dispar
KNSIGRE

SEQ ID NO: 2438628 - protein, 7 aa, Entamoeba dispar
KNSKKAM

SEQ ID NO: 2438629 - protein, 6 aa, Entamoeba dispar
KNSKKI

SEQ ID NO: 2438630 - protein, 5 aa, Entamoeba dispar
KNSKP

SEQ ID NO: 2438631 - protein, 4 aa, Entamoeba dispar
KNSL

SEQ ID NO: 2438632 - protein, 9 aa, Entamoeba dispar
KNSLPKDEV

SEQ ID NO: 2438633 - protein, 12 aa, Entamoeba dispar
KNSLRQGIDKKV

SEQ ID NO: 2438634 - protein, 6 aa, Entamoeba dispar
KNSMAN

SEQ ID NO: 2438635 - protein, 5 aa, Entamoeba dispar
KNSME

SEQ ID NO: 2438636 - protein, 8 aa, Entamoeba dispar
KNSNEPQT

SEQ ID NO: 2438637 - protein, 10 aa, Entamoeba dispar
KNSNESIDGK

SEQ ID NO: 2438638 - protein, 7 aa, Entamoeba dispar
KNSNGLT

SEQ ID NO: 2438639 - protein, 6 aa, Entamoeba dispar
KNSNSI

SEQ ID NO: 2438640 - protein, 8 aa, Entamoeba dispar
KNSNTTIT

SEQ ID NO: 2438641 - protein, 9 aa, Entamoeba dispar
KNSPKKQKI

SEQ ID NO: 2438642 - protein, 9 aa, Entamoeba dispar
KNSPNTTEL

SEQ ID NO: 2438643 - protein, 12 aa, Entamoeba dispar
KNSPPLSPDTDK

SEQ ID NO: 2438644 - protein, 12 aa, Entamoeba dispar
KNSQLSSFPGQT

SEQ ID NO: 2438645 - protein, 6 aa, Entamoeba dispar
KNSQNA

SEQ ID NO: 2438646 - protein, 7 aa, Entamoeba dispar
KNSQNCV

SEQ ID NO: 2438647 - protein, 14 aa, Entamoeba dispar
KNSQRKKPKLPALE

SEQ ID NO: 2438648 - protein, 8 aa, Entamoeba dispar
KNSQSKRC

SEQ ID NO: 2438649 - protein, 7 aa, Entamoeba dispar
KNSQTSM

SEQ ID NO: 2438650 - protein, 9 aa, Entamoeba dispar
KNSRSSISI

SEQ ID NO: 2438651 - protein, 9 aa, Entamoeba dispar
KNSSNHQQQ

SEQ ID NO: 2438652 - protein, 8 aa, Entamoeba dispar
KNSSSSLL

SEQ ID NO: 2438653 - protein, 7 aa, Entamoeba dispar
KNSSTSI

SEQ ID NO: 2438654 - protein, 10 aa, Entamoeba dispar
KNSTKKEEKI

SEQ ID NO: 2438655 - protein, 9 aa, Entamoeba dispar
KNSTSAQGY

SEQ ID NO: 2438656 - protein, 7 aa, Entamoeba dispar
KNSTSEL

SEQ ID NO: 2438657 - protein, 6 aa, Entamoeba dispar
KNSTYK

SEQ ID NO: 2438658 - protein, 10 aa, Entamoeba dispar
KNSVKLQEDL

SEQ ID NO: 2438659 - protein, 7 aa, Entamoeba dispar
KNSVNDT

SEQ ID NO: 2438660 - protein, 6 aa, Entamoeba dispar
KNSYDN

SEQ ID NO: 2438661 - protein, 7 aa, Entamoeba dispar
KNSYSFD

SEQ ID NO: 2438662 - protein, 8 aa, Entamoeba dispar
KNTAKQGV

SEQ ID NO: 2438663 - protein, 8 aa, Entamoeba dispar
KNTAQDED

SEQ ID NO: 2438664 - protein, 10 aa, Entamoeba dispar
KNTDEELQNC

SEQ ID NO: 2438665 - protein, 8 aa, Entamoeba dispar
KNTDGTAE

SEQ ID NO: 2438666 - protein, 4 aa, Entamoeba dispar
KNTE

SEQ ID NO: 2438667 - protein, 6 aa, Entamoeba dispar
KNTEEI

SEQ ID NO: 2438668 - protein, 5 aa, Entamoeba dispar
KNTEI

SEQ ID NO: 2438669 - protein, 6 aa, Entamoeba dispar
KNTEKD

SEQ ID NO: 2438670 - protein, 10 aa, Entamoeba dispar
KNTEKDHPDA

SEQ ID NO: 2438671 - protein, 16 aa, Entamoeba dispar
KNTEKESTKETGESIK

SEQ ID NO: 2438672 - protein, 6 aa, Entamoeba dispar
KNTEMK

SEQ ID NO: 2438673 - protein, 6 aa, Entamoeba dispar
KNTEQL

SEQ ID NO: 2438674 - protein, 13 aa, Entamoeba dispar
KNTETSRDVTNGV

SEQ ID NO: 2438675 - protein, 4 aa, Entamoeba dispar
KNTG

SEQ ID NO: 2438676 - protein, 6 aa, Entamoeba dispar
KNTGDL

SEQ ID NO: 2438677 - protein, 8 aa, Entamoeba dispar
KNTGEERN

SEQ ID NO: 2438678 - protein, 5 aa, Entamoeba dispar
KNTGR

SEQ ID NO: 2438679 - protein, 5 aa, Entamoeba dispar
KNTIP

SEQ ID NO: 2438680 - protein, 21 aa, Entamoeba dispar
KNTKDKKAKKDPNRPKKPQSA

SEQ ID NO: 2438681 - protein, 21 aa, Entamoeba dispar
KNTKDKKAKKDPNRPKRPQTP

SEQ ID NO: 2438682 - protein, 10 aa, Entamoeba dispar
KNTKPDHPDY

SEQ ID NO: 2438683 - protein, 10 aa, Entamoeba dispar
KNTKQKTRLT

SEQ ID NO: 2438684 - protein, 4 aa, Entamoeba dispar
KNTM

SEQ ID NO: 2438685 - protein, 6 aa, Entamoeba dispar
KNTMDV

SEQ ID NO: 2438686 - protein, 23 aa, Entamoeba dispar
KNTMEQSRANGMNEMSGDEDSWF

SEQ ID NO: 2438687 - protein, 11 aa, Entamoeba dispar
KNTPDETLGKS

SEQ ID NO: 2438688 - protein, 6 aa, Entamoeba dispar
KNTPLK

SEQ ID NO: 2438689 - protein, 13 aa, Entamoeba dispar
KNTPLKNKSDCSQ

SEQ ID NO: 2438690 - protein, 8 aa, Entamoeba dispar
KNTPPQLV

SEQ ID NO: 2438691 - protein, 8 aa, Entamoeba dispar
KNTPTNHC

SEQ ID NO: 2438692 - protein, 5 aa, Entamoeba dispar
KNTQE

SEQ ID NO: 2438693 - protein, 26 aa, Entamoeba dispar
KNTQIIEKQKEEIEELKQENKELQKS

SEQ ID NO: 2438694 - protein, 8 aa, Entamoeba dispar
KNTQKSFD

SEQ ID NO: 2438695 - protein, 9 aa, Entamoeba dispar
KNTRGNGLD

SEQ ID NO: 2438696 - protein, 8 aa, Entamoeba dispar
KNTRKCPK

SEQ ID NO: 2438697 - protein, 10 aa, Entamoeba dispar
KNTRKPIDSV

SEQ ID NO: 2438698 - protein, 7 aa, Entamoeba dispar
KNTRSNT

SEQ ID NO: 2438699 - protein, 7 aa, Entamoeba dispar
KNTSITN

SEQ ID NO: 2438700 - protein, 7 aa, Entamoeba dispar
KNTSSFV

SEQ ID NO: 2438701 - protein, 32 aa, Entamoeba dispar
  misc_feature (15)..(16): Xaa can be any naturally occurring amino acid
KNTSSLPPNFPFICXXQILHPLNCIKRFSTTG

SEQ ID NO: 2438702 - protein, 8 aa, Entamoeba dispar
KNTSTAAL

SEQ ID NO: 2438703 - protein, 17 aa, Entamoeba dispar
KNTSTLDEARTYCKYYL

SEQ ID NO: 2438704 - protein, 6 aa, Entamoeba dispar
KNTTIN

SEQ ID NO: 2438705 - protein, 5 aa, Entamoeba dispar
KNTVP

SEQ ID NO: 2438706 - protein, 10 aa, Entamoeba dispar
KNTYASPEPF

SEQ ID NO: 2438707 - protein, 22 aa, Entamoeba dispar
KNTYSNAHLPPSLFSNRWKALN

SEQ ID NO: 2438708 - protein, 8 aa, Entamoeba dispar
KNVEEIPK

SEQ ID NO: 2438709 - protein, 7 aa, Entamoeba dispar
KNVEKKD

SEQ ID NO: 2438710 - protein, 4 aa, Entamoeba dispar
KNVF

SEQ ID NO: 2438711 - protein, 4 aa, Entamoeba dispar
KNVG

SEQ ID NO: 2438712 - protein, 8 aa, Entamoeba dispar
KNVKRKNV

SEQ ID NO: 2438713 - protein, 12 aa, Entamoeba dispar
KNVKSKKAQGRL

SEQ ID NO: 2438714 - protein, 7 aa, Entamoeba dispar
KNVLSGN

SEQ ID NO: 2438715 - protein, 8 aa, Entamoeba dispar
KNVNETIS

SEQ ID NO: 2438716 - protein, 6 aa, Entamoeba dispar
KNVPGT

SEQ ID NO: 2438717 - protein, 5 aa, Entamoeba dispar
KNVPY

SEQ ID NO: 2438718 - protein, 9 aa, Entamoeba dispar
KNVRDEQEV

SEQ ID NO: 2438719 - protein, 12 aa, Entamoeba dispar
KNVREEENNDIL

SEQ ID NO: 2438720 - protein, 6 aa, Entamoeba dispar
KNVRPG

SEQ ID NO: 2438721 - protein, 7 aa, Entamoeba dispar
KNVSPIT

SEQ ID NO: 2438722 - protein, 6 aa, Entamoeba dispar
KNVTAS

SEQ ID NO: 2438723 - protein, 39 aa, Entamoeba dispar
KNVTESKEKTIEDLRKEEKKKEDLEKKQRNKAVDKKNAY

SEQ ID NO: 2438724 - protein, 5 aa, Entamoeba dispar
KNVTN

SEQ ID NO: 2438725 - protein, 4 aa, Entamoeba dispar
KNWE

SEQ ID NO: 2438726 - protein, 14 aa, Entamoeba dispar
KNWNEKKYTEQDIT

SEQ ID NO: 2438727 - protein, 6 aa, Entamoeba dispar
KNWQEQ

SEQ ID NO: 2438728 - protein, 16 aa, Entamoeba dispar
KNWQPKPRKVKPVKPS

SEQ ID NO: 2438729 - protein, 8 aa, Entamoeba dispar
KNYAERRE

SEQ ID NO: 2438730 - protein, 4 aa, Entamoeba dispar
KNYE

SEQ ID NO: 2438731 - protein, 4 aa, Entamoeba dispar
KNYH

SEQ ID NO: 2438732 - protein, 12 aa, Entamoeba dispar
KNYHKRDGTKGT

SEQ ID NO: 2438733 - protein, 6 aa, Entamoeba dispar
KNYIGG

SEQ ID NO: 2438734 - protein, 8 aa, Entamoeba dispar
KNYNEALE

SEQ ID NO: 2438735 - protein, 30 aa, Entamoeba dispar
KNYNEQKTLPVNDTLTTSVDIEKEDNEIVE

SEQ ID NO: 2438736 - protein, 7 aa, Entamoeba dispar
KNYNLSK

SEQ ID NO: 2438737 - protein, 9 aa, Entamoeba dispar
KNYNTKSKL

SEQ ID NO: 2438738 - protein, 6 aa, Entamoeba dispar
KNYPGG

SEQ ID NO: 2438739 - protein, 15 aa, Entamoeba dispar
KNYQEEQSRDQVGED

SEQ ID NO: 2438740 - protein, 9 aa, Entamoeba dispar
KNYRNTDDY

SEQ ID NO: 2438741 - protein, 9 aa, Entamoeba dispar
KNYSDQGLV

SEQ ID NO: 2438742 - protein, 9 aa, Entamoeba dispar
KNYSNEEKE

SEQ ID NO: 2438743 - protein, 5 aa, Entamoeba dispar
KNYSS

SEQ ID NO: 2438744 - protein, 7 aa, Entamoeba dispar
KNYSSEV

SEQ ID NO: 2438745 - protein, 11 aa, Entamoeba dispar
KNYTYKNESDL

SEQ ID NO: 2438746 - protein, 7 aa, Entamoeba dispar
KPADEDA

SEQ ID NO: 2438747 - protein, 6 aa, Entamoeba dispar
KPADVV

SEQ ID NO: 2438748 - protein, 7 aa, Entamoeba dispar
KPAISEE

SEQ ID NO: 2438749 - protein, 6 aa, Entamoeba dispar
KPAKVI

SEQ ID NO: 2438750 - protein, 8 aa, Entamoeba dispar
KPANPSSH

SEQ ID NO: 2438751 - protein, 5 aa, Entamoeba dispar
KPAQL

SEQ ID NO: 2438752 - protein, 5 aa, Entamoeba dispar
KPAQM

SEQ ID NO: 2438753 - protein, 22 aa, Entamoeba dispar
KPASAPQTTSDYQTLTQSLQDN

SEQ ID NO: 2438754 - protein, 8 aa, Entamoeba dispar
KPASKVAA

SEQ ID NO: 2438755 - protein, 15 aa, Entamoeba dispar
KPAVPPSKRAHTGRV

SEQ ID NO: 2438756 - protein, 7 aa, Entamoeba dispar
KPCNEKT

SEQ ID NO: 2438757 - protein, 4 aa, Entamoeba dispar
KPCP

SEQ ID NO: 2438758 - protein, 6 aa, Entamoeba dispar
KPCSSH

SEQ ID NO: 2438759 - protein, 6 aa, Entamoeba dispar
KPDASR

SEQ ID NO: 2438760 - protein, 4 aa, Entamoeba dispar
KPDD

SEQ ID NO: 2438761 - protein, 6 aa, Entamoeba dispar
KPDEFN

SEQ ID NO: 2438762 - protein, 11 aa, Entamoeba dispar
KPDGLTAAKNL

SEQ ID NO: 2438763 - protein, 12 aa, Entamoeba dispar
KPDIEQQTSKQC

SEQ ID NO: 2438764 - protein, 7 aa, Entamoeba dispar
KPDNEAL

SEQ ID NO: 2438765 - protein, 7 aa, Entamoeba dispar
KPDNIPL

SEQ ID NO: 2438766 - protein, 10 aa, Entamoeba dispar
KPDNKSALST

SEQ ID NO: 2438767 - protein, 13 aa, Entamoeba dispar
KPDNTSAASCYEK

SEQ ID NO: 2438768 - protein, 7 aa, Entamoeba dispar
KPDPELS

SEQ ID NO: 2438769 - protein, 17 aa, Entamoeba dispar
KPDRMDPYDEAVAKNEL

SEQ ID NO: 2438770 - protein, 7 aa, Entamoeba dispar
KPDRSIK

SEQ ID NO: 2438771 - protein, 11 aa, Entamoeba dispar
KPDSKSTEGDI

SEQ ID NO: 2438772 - protein, 7 aa, Entamoeba dispar
KPDTKSV

SEQ ID NO: 2438773 - protein, 8 aa, Entamoeba dispar
KPDVEEIK

SEQ ID NO: 2438774 - protein, 9 aa, Entamoeba dispar
KPDVTKQRK

SEQ ID NO: 2438775 - protein, 7 aa, Entamoeba dispar
KPDYDYN

SEQ ID NO: 2438776 - protein, 6 aa, Entamoeba dispar
KPEAGI

SEQ ID NO: 2438777 - protein, 8 aa, Entamoeba dispar
KPEDDHWE

SEQ ID NO: 2438778 - protein, 14 aa, Entamoeba dispar
KPEDFNKRDEDSKI

SEQ ID NO: 2438779 - protein, 17 aa, Entamoeba dispar
KPEDVGEVEMKDEEETI

SEQ ID NO: 2438780 - protein, 12 aa, Entamoeba dispar
KPEEFTSDRGAR

SEQ ID NO: 2438781 - protein, 6 aa, Entamoeba dispar
KPEEIT

SEQ ID NO: 2438782 - protein, 7 aa, Entamoeba dispar
KPEEVCS

SEQ ID NO: 2438783 - protein, 8 aa, Entamoeba dispar
KPEFQSEG

SEQ ID NO: 2438784 - protein, 6 aa, Entamoeba dispar
KPEHGV

SEQ ID NO: 2438785 - protein, 8 aa, Entamoeba dispar
KPEKLSAY

SEQ ID NO: 2438786 - protein, 7 aa, Entamoeba dispar
KPEMNKK

SEQ ID NO: 2438787 - protein, 11 aa, Entamoeba dispar
KPENEIQNDEI

SEQ ID NO: 2438788 - protein, 7 aa, Entamoeba dispar
KPENGKA

SEQ ID NO: 2438789 - protein, 6 aa, Entamoeba dispar
KPENLR

SEQ ID NO: 2438790 - protein, 6 aa, Entamoeba dispar
KPENQP

SEQ ID NO: 2438791 - protein, 5 aa, Entamoeba dispar
KPENV

SEQ ID NO: 2438792 - protein, 10 aa, Entamoeba dispar
KPEQKSYSID

SEQ ID NO: 2438793 - protein, 7 aa, Entamoeba dispar
KPESQLN

SEQ ID NO: 2438794 - protein, 10 aa, Entamoeba dispar
KPESSRSSSY

SEQ ID NO: 2438795 - protein, 5 aa, Entamoeba dispar
KPESV

SEQ ID NO: 2438796 - protein, 8 aa, Entamoeba dispar
KPETTEAI

SEQ ID NO: 2438797 - protein, 4 aa, Entamoeba dispar
KPEV

SEQ ID NO: 2438798 - protein, 11 aa, Entamoeba dispar
KPEYSSKSGKK

SEQ ID NO: 2438799 - protein, 6 aa, Entamoeba dispar
KPFADE

SEQ ID NO: 2438800 - protein, 6 aa, Entamoeba dispar
KPFDPF

SEQ ID NO: 2438801 - protein, 14 aa, Entamoeba dispar
KPFEISSESTEYKE

SEQ ID NO: 2438802 - protein, 27 aa, Entamoeba dispar
KPFKGGFPQQPTEELSGSKNEIRTEAK

SEQ ID NO: 2438803 - protein, 5 aa, Entamoeba dispar
KPFKN

SEQ ID NO: 2438804 - protein, 23 aa, Entamoeba dispar
KPFKTREDERDKIYREKQRFGDP

SEQ ID NO: 2438805 - protein, 6 aa, Entamoeba dispar
KPFKTS

SEQ ID NO: 2438806 - protein, 8 aa, Entamoeba dispar
KPFNEEKV

SEQ ID NO: 2438807 - protein, 5 aa, Entamoeba dispar
KPFNG

SEQ ID NO: 2438808 - protein, 6 aa, Entamoeba dispar
KPFPPP

SEQ ID NO: 2438809 - protein, 4 aa, Entamoeba dispar
KPFQ

SEQ ID NO: 2438810 - protein, 5 aa, Entamoeba dispar
KPFQQ

SEQ ID NO: 2438811 - protein, 6 aa, Entamoeba dispar
KPFRGG

SEQ ID NO: 2438812 - protein, 12 aa, Entamoeba dispar
KPFSEEDDMDYD

SEQ ID NO: 2438813 - protein, 6 aa, Entamoeba dispar
KPFTFN

SEQ ID NO: 2438814 - protein, 6 aa, Entamoeba dispar
KPFTSQ

SEQ ID NO: 2438815 - protein, 18 aa, Entamoeba dispar
KPFTSSNSPSSSSSTIQT

SEQ ID NO: 2438816 - protein, 43 aa, Entamoeba dispar
KPGDQQNDSDEYTDDSIGFQEDDGDFDGGDYEEDEDGVIDSSK

SEQ ID NO: 2438817 - protein, 5 aa, Entamoeba dispar
KPGDV

SEQ ID NO: 2438818 - protein, 6 aa, Entamoeba dispar
KPGEKM

SEQ ID NO: 2438819 - protein, 5 aa, Entamoeba dispar
KPGFE

SEQ ID NO: 2438820 - protein, 14 aa, Entamoeba dispar
KPGHIGRDCPQPDD

SEQ ID NO: 2438821 - protein, 41 aa, Entamoeba dispar
KPGHMSRECPEPRKDNRKGGFKRSFNENKTETKNDPKHIRF

SEQ ID NO: 2438822 - protein, 6 aa, Entamoeba dispar
KPGIIK

SEQ ID NO: 2438823 - protein, 8 aa, Entamoeba dispar
KPGKDESF

SEQ ID NO: 2438824 - protein, 10 aa, Entamoeba dispar
KPGKNWGPAC

SEQ ID NO: 2438825 - protein, 6 aa, Entamoeba dispar
KPGNIL

SEQ ID NO: 2438826 - protein, 6 aa, Entamoeba dispar
KPGNYK

SEQ ID NO: 2438827 - protein, 8 aa, Entamoeba dispar
KPGQDENA

SEQ ID NO: 2438828 - protein, 13 aa, Entamoeba dispar
KPGTSVAHHKQSN

SEQ ID NO: 2438829 - protein, 8 aa, Entamoeba dispar
KPHDDYSG

SEQ ID NO: 2438830 - protein, 9 aa, Entamoeba dispar
KPHKRSTTT

SEQ ID NO: 2438831 - protein, 15 aa, Entamoeba dispar
KPHSSNNEPQEAGGC

SEQ ID NO: 2438832 - protein, 5 aa, Entamoeba dispar
KPIAD

SEQ ID NO: 2438833 - protein, 6 aa, Entamoeba dispar
KPIAES

SEQ ID NO: 2438834 - protein, 7 aa, Entamoeba dispar
KPIEEFP

SEQ ID NO: 2438835 - protein, 5 aa, Entamoeba dispar
KPIEN

SEQ ID NO: 2438836 - protein, 21 aa, Entamoeba dispar
KPIEQKTKKRTLKPINSDDEE

SEQ ID NO: 2438837 - protein, 8 aa, Entamoeba dispar
KPIEQPRK

SEQ ID NO: 2438838 - protein, 15 aa, Entamoeba dispar
KPIERLDNTRSDNEI

SEQ ID NO: 2438839 - protein, 8 aa, Entamoeba dispar
KPIETKPS

SEQ ID NO: 2438840 - protein, 17 aa, Entamoeba dispar
KPIGALTPERAENTLER

SEQ ID NO: 2438841 - protein, 8 aa, Entamoeba dispar
KPIKEESE

SEQ ID NO: 2438842 - protein, 14 aa, Entamoeba dispar
KPIKEQKKVEVPKT

SEQ ID NO: 2438843 - protein, 30 aa, Entamoeba dispar
KPIKNIQKDDLTPSKLNKTISPIPLPPSIH

SEQ ID NO: 2438844 - protein, 7 aa, Entamoeba dispar
KPIKSKV

SEQ ID NO: 2438845 - protein, 6 aa, Entamoeba dispar
KPIKSY

SEQ ID NO: 2438846 - protein, 6 aa, Entamoeba dispar
KPIKTN

SEQ ID NO: 2438847 - protein, 5 aa, Entamoeba dispar
KPIKV

SEQ ID NO: 2438848 - protein, 16 aa, Entamoeba dispar
KPINKETIQPSTPKLF

SEQ ID NO: 2438849 - protein, 8 aa, Entamoeba dispar
KPIPPCPS

SEQ ID NO: 2438850 - protein, 40 aa, Entamoeba dispar
KPIPQKKLPPLPPPKPNTNSTNPFDEVSSNSSSITSSNTY

SEQ ID NO: 2438851 - protein, 23 aa, Entamoeba dispar
KPIPSLQSNKQISTSSSSLNTTP

SEQ ID NO: 2438852 - protein, 11 aa, Entamoeba dispar
KPIQTTDSLIT

SEQ ID NO: 2438853 - protein, 11 aa, Entamoeba dispar
KPIRKGRDREK

SEQ ID NO: 2438854 - protein, 5 aa, Entamoeba dispar
KPISY

SEQ ID NO: 2438855 - protein, 5 aa, Entamoeba dispar
KPITP

SEQ ID NO: 2438856 - protein, 13 aa, Entamoeba dispar
KPIYNGAKGLETG

SEQ ID NO: 2438857 - protein, 19 aa, Entamoeba dispar
KPKDFQKQEQNDNESSPIY

SEQ ID NO: 2438858 - protein, 8 aa, Entamoeba dispar
KPKDGISE

SEQ ID NO: 2438859 - protein, 7 aa, Entamoeba dispar
KPKEDID

SEQ ID NO: 2438860 - protein, 8 aa, Entamoeba dispar
KPKEDNKN

SEQ ID NO: 2438861 - protein, 15 aa, Entamoeba dispar
KPKEEKEKSERKKRK

SEQ ID NO: 2438862 - protein, 40 aa, Entamoeba dispar
KPKEQKKDEENKKEQETRIEKEETKEVSKELEKKEEEKEA

SEQ ID NO: 2438863 - protein, 8 aa, Entamoeba dispar
KPKEYSYN

SEQ ID NO: 2438864 - protein, 32 aa, Entamoeba dispar
KPKFSAKEAKLELDGQRHEINDGTLTSTIETS

SEQ ID NO: 2438865 - protein, 22 aa, Entamoeba dispar
KPKGVQPEKQKDFGVPTADPIS

SEQ ID NO: 2438866 - protein, 11 aa, Entamoeba dispar
KPKHPDQCKTI

SEQ ID NO: 2438867 - protein, 4 aa, Entamoeba dispar
KPKI

SEQ ID NO: 2438868 - protein, 11 aa, Entamoeba dispar
KPKIEDKSSDL

SEQ ID NO: 2438869 - protein, 93 aa, Entamoeba dispar
KPKIKDGAKVLSSSSHEKMGSPPTSIQLSSEKKEKKVQSNDNEVKKPKMPSSKISKKKINKQIKSVKKEQESNEQLDNIEEQLDTGIETKSSI

SEQ ID NO: 2438870 - protein, 6 aa, Entamoeba dispar
KPKKKW

SEQ ID NO: 2438871 - protein, 12 aa, Entamoeba dispar
KPKKNKPGYKPS

SEQ ID NO: 2438872 - protein, 7 aa, Entamoeba dispar
KPKKRST

SEQ ID NO: 2438873 - protein, 9 aa, Entamoeba dispar
KPKKSQSVH

SEQ ID NO: 2438874 - protein, 10 aa, Entamoeba dispar
KPKKSVTDIT

SEQ ID NO: 2438875 - protein, 6 aa, Entamoeba dispar
KPKLNK

SEQ ID NO: 2438876 - protein, 4 aa, Entamoeba dispar
KPKN

SEQ ID NO: 2438877 - protein, 14 aa, Entamoeba dispar
KPKQANKKEMVKDK

SEQ ID NO: 2438878 - protein, 9 aa, Entamoeba dispar
KPKQGKTFT

SEQ ID NO: 2438879 - protein, 10 aa, Entamoeba dispar
KPKQKQGKIK

SEQ ID NO: 2438880 - protein, 7 aa, Entamoeba dispar
KPKQLSY

SEQ ID NO: 2438881 - protein, 6 aa, Entamoeba dispar
KPKRSF

SEQ ID NO: 2438882 - protein, 8 aa, Entamoeba dispar
KPKSEKLS

SEQ ID NO: 2438883 - protein, 10 aa, Entamoeba dispar
KPKSKSTTTL

SEQ ID NO: 2438884 - protein, 17 aa, Entamoeba dispar
KPKSTLLSRSQSAQPDD

SEQ ID NO: 2438885 - protein, 7 aa, Entamoeba dispar
KPKSVTE

SEQ ID NO: 2438886 - protein, 24 aa, Entamoeba dispar
KPKTEPKDSTIVPDENNVQVNEED

SEQ ID NO: 2438887 - protein, 8 aa, Entamoeba dispar
KPKTTTQI

SEQ ID NO: 2438888 - protein, 5 aa, Entamoeba dispar
KPKVK

SEQ ID NO: 2438889 - protein, 17 aa, Entamoeba dispar
KPLAEKGKEFDSQTKYA

SEQ ID NO: 2438890 - protein, 5 aa, Entamoeba dispar
KPLDG

SEQ ID NO: 2438891 - protein, 5 aa, Entamoeba dispar
KPLDQ

SEQ ID NO: 2438892 - protein, 5 aa, Entamoeba dispar
KPLDV

SEQ ID NO: 2438893 - protein, 7 aa, Entamoeba dispar
KPLEEKE

SEQ ID NO: 2438894 - protein, 5 aa, Entamoeba dispar
KPLEN

SEQ ID NO: 2438895 - protein, 7 aa, Entamoeba dispar
KPLESNN

SEQ ID NO: 2438896 - protein, 6 aa, Entamoeba dispar
KPLESQ

SEQ ID NO: 2438897 - protein, 8 aa, Entamoeba dispar
KPLETTSD

SEQ ID NO: 2438898 - protein, 8 aa, Entamoeba dispar
KPLGQGKF

SEQ ID NO: 2438899 - protein, 4 aa, Entamoeba dispar
KPLK

SEQ ID NO: 2438900 - protein, 5 aa, Entamoeba dispar
KPLKI

SEQ ID NO: 2438901 - protein, 16 aa, Entamoeba dispar
KPLKKSPKAQKKLRPF

SEQ ID NO: 2438902 - protein, 8 aa, Entamoeba dispar
KPLNNGSF

SEQ ID NO: 2438903 - protein, 5 aa, Entamoeba dispar
KPLNS

SEQ ID NO: 2438904 - protein, 7 aa, Entamoeba dispar
KPLPEDV

SEQ ID NO: 2438905 - protein, 5 aa, Entamoeba dispar
KPLPG

SEQ ID NO: 2438906 - protein, 6 aa, Entamoeba dispar
KPLPGY

SEQ ID NO: 2438907 - protein, 8 aa, Entamoeba dispar
KPLPKAST

SEQ ID NO: 2438908 - protein, 9 aa, Entamoeba dispar
KPLPQDEHS

SEQ ID NO: 2438909 - protein, 6 aa, Entamoeba dispar
KPLPQQ

SEQ ID NO: 2438910 - protein, 19 aa, Entamoeba dispar
KPLPRSDNGETLDKESSKE

SEQ ID NO: 2438911 - protein, 7 aa, Entamoeba dispar
KPLPSRE

SEQ ID NO: 2438912 - protein, 35 aa, Entamoeba dispar
KPLPVPPKLSGLSKTDPRKKPLPPSPGNKKNVAPI

SEQ ID NO: 2438913 - protein, 7 aa, Entamoeba dispar
KPLRSNK

SEQ ID NO: 2438914 - protein, 4 aa, Entamoeba dispar
KPLS

SEQ ID NO: 2438915 - protein, 6 aa, Entamoeba dispar
KPLSRE

SEQ ID NO: 2438916 - protein, 6 aa, Entamoeba dispar
KPLSSN

SEQ ID NO: 2438917 - protein, 4 aa, Entamoeba dispar
KPLT

SEQ ID NO: 2438918 - protein, 8 aa, Entamoeba dispar
KPLTEQQA

SEQ ID NO: 2438919 - protein, 5 aa, Entamoeba dispar
KPLTL

SEQ ID NO: 2438920 - protein, 4 aa, Entamoeba dispar
KPLY

SEQ ID NO: 2438921 - protein, 6 aa, Entamoeba dispar
KPLYEK

SEQ ID NO: 2438922 - protein, 21 aa, Entamoeba dispar
KPMEEERKENDNKENKSEDEL

SEQ ID NO: 2438923 - protein, 13 aa, Entamoeba dispar
KPNAKTSELQGVE

SEQ ID NO: 2438924 - protein, 4 aa, Entamoeba dispar
KPND

SEQ ID NO: 2438925 - protein, 11 aa, Entamoeba dispar
KPNDCDYGDPC

SEQ ID NO: 2438926 - protein, 7 aa, Entamoeba dispar
KPNDHQT

SEQ ID NO: 2438927 - protein, 4 aa, Entamoeba dispar
KPNE

SEQ ID NO: 2438928 - protein, 7 aa, Entamoeba dispar
KPNEAHD

SEQ ID NO: 2438929 - protein, 8 aa, Entamoeba dispar
KPNEEISE

SEQ ID NO: 2438930 - protein, 16 aa, Entamoeba dispar
KPNEEISEKIVEAVQK

SEQ ID NO: 2438931 - protein, 7 aa, Entamoeba dispar
KPNEKWS

SEQ ID NO: 2438932 - protein, 7 aa, Entamoeba dispar
KPNENPI

SEQ ID NO: 2438933 - protein, 8 aa, Entamoeba dispar
KPNENWNN

SEQ ID NO: 2438934 - protein, 6 aa, Entamoeba dispar
KPNESE

SEQ ID NO: 2438935 - protein, 8 aa, Entamoeba dispar
KPNESTNL

SEQ ID NO: 2438936 - protein, 9 aa, Entamoeba dispar
KPNESWNSA

SEQ ID NO: 2438937 - protein, 6 aa, Entamoeba dispar
KPNEVN

SEQ ID NO: 2438938 - protein, 7 aa, Entamoeba dispar
KPNGDRF

SEQ ID NO: 2438939 - protein, 16 aa, Entamoeba dispar
KPNGGSIPVTKENKRE

SEQ ID NO: 2438940 - protein, 11 aa, Entamoeba dispar
KPNGIQPHPNS

SEQ ID NO: 2438941 - protein, 15 aa, Entamoeba dispar
KPNGKNTSPKKEVPP

SEQ ID NO: 2438942 - protein, 7 aa, Entamoeba dispar
KPNGNEI

SEQ ID NO: 2438943 - protein, 9 aa, Entamoeba dispar
KPNGNRKRI

SEQ ID NO: 2438944 - protein, 35 aa, Entamoeba dispar
KPNGSYYKTETRPTPKPEIKEPQKPEVNDSSDCHI

SEQ ID NO: 2438945 - protein, 16 aa, Entamoeba dispar
KPNKKKVKERNGTTKL

SEQ ID NO: 2438946 - protein, 22 aa, Entamoeba dispar
KPNKQIAQDIANGTVDPDTHKP

SEQ ID NO: 2438947 - protein, 11 aa, Entamoeba dispar
KPNKQRKTSYL

SEQ ID NO: 2438948 - protein, 12 aa, Entamoeba dispar
KPNKTIPENCFQ

SEQ ID NO: 2438949 - protein, 5 aa, Entamoeba dispar
KPNKY

SEQ ID NO: 2438950 - protein, 13 aa, Entamoeba dispar
KPNNICKGEGLEK

SEQ ID NO: 2438951 - protein, 6 aa, Entamoeba dispar
KPNNMP

SEQ ID NO: 2438952 - protein, 10 aa, Entamoeba dispar
KPNNTLTTPI

SEQ ID NO: 2438953 - protein, 11 aa, Entamoeba dispar
KPNQTQTNQTE

SEQ ID NO: 2438954 - protein, 6 aa, Entamoeba dispar
KPNQTV

SEQ ID NO: 2438955 - protein, 6 aa, Entamoeba dispar
KPNRNG

SEQ ID NO: 2438956 - protein, 8 aa, Entamoeba dispar
KPNRYSSL

SEQ ID NO: 2438957 - protein, 19 aa, Entamoeba dispar
KPNSKEKGSSETKQQNSLN

SEQ ID NO: 2438958 - protein, 10 aa, Entamoeba dispar
KPNSNENIPE

SEQ ID NO: 2438959 - protein, 9 aa, Entamoeba dispar
KPNTEQEAN

SEQ ID NO: 2438960 - protein, 6 aa, Entamoeba dispar
KPNTLT

SEQ ID NO: 2438961 - protein, 56 aa, Entamoeba dispar
KPNVEEDKKETNQEGKTTKDKKEKDETEAKLKKEKRHKKNKKYEEVEEEEGDDPMV

SEQ ID NO: 2438962 - protein, 5 aa, Entamoeba dispar
KPPEL

SEQ ID NO: 2438963 - protein, 17 aa, Entamoeba dispar
KPPEQFEKENNCKLQEN

SEQ ID NO: 2438964 - protein, 6 aa, Entamoeba dispar
KPPEYE

SEQ ID NO: 2438965 - protein, 32 aa, Entamoeba dispar
KPPKIEKKEKKKDNKDKDFKGLDKTPEKKRKK

SEQ ID NO: 2438966 - protein, 7 aa, Entamoeba dispar
KPPMEND

SEQ ID NO: 2438967 - protein, 9 aa, Entamoeba dispar
KPPNQKEQI

SEQ ID NO: 2438968 - protein, 5 aa, Entamoeba dispar
KPPPF

SEQ ID NO: 2438969 - protein, 22 aa, Entamoeba dispar
KPPPGITDEEFKASRINESDLI

SEQ ID NO: 2438970 - protein, 12 aa, Entamoeba dispar
KPPPKSSPSDII

SEQ ID NO: 2438971 - protein, 6 aa, Entamoeba dispar
KPPSID

SEQ ID NO: 2438972 - protein, 8 aa, Entamoeba dispar
KPPTEEEC

SEQ ID NO: 2438973 - protein, 18 aa, Entamoeba dispar
KPPTFNSEQKDEKRLQNG

SEQ ID NO: 2438974 - protein, 8 aa, Entamoeba dispar
KPPTNQLT

SEQ ID NO: 2438975 - protein, 7 aa, Entamoeba dispar
KPQDDEY

SEQ ID NO: 2438976 - protein, 6 aa, Entamoeba dispar
KPQEEG

SEQ ID NO: 2438977 - protein, 7 aa, Entamoeba dispar
KPQEPIK

SEQ ID NO: 2438978 - protein, 8 aa, Entamoeba dispar
KPQETTLE

SEQ ID NO: 2438979 - protein, 10 aa, Entamoeba dispar
KPQKKTKTSL

SEQ ID NO: 2438980 - protein, 13 aa, Entamoeba dispar
KPQPTKREKQLKE

SEQ ID NO: 2438981 - protein, 5 aa, Entamoeba dispar
KPQQF

SEQ ID NO: 2438982 - protein, 8 aa, Entamoeba dispar
KPQRLQEQ

SEQ ID NO: 2438983 - protein, 4 aa, Entamoeba dispar
KPQS

SEQ ID NO: 2438984 - protein, 8 aa, Entamoeba dispar
KPQSRRIS

SEQ ID NO: 2438985 - protein, 18 aa, Entamoeba dispar
KPQSSQKINQPQQQAECK

SEQ ID NO: 2438986 - protein, 7 aa, Entamoeba dispar
KPQTNEC

SEQ ID NO: 2438987 - protein, 11 aa, Entamoeba dispar
KPQTVADLQDD

SEQ ID NO: 2438988 - protein, 9 aa, Entamoeba dispar
KPRDFQETS

SEQ ID NO: 2438989 - protein, 7 aa, Entamoeba dispar
KPRDISD

SEQ ID NO: 2438990 - protein, 8 aa, Entamoeba dispar
KPRGRTEC

SEQ ID NO: 2438991 - protein, 8 aa, Entamoeba dispar
KPRIGGDG

SEQ ID NO: 2438992 - protein, 12 aa, Entamoeba dispar
KPRKKGFGSRDG

SEQ ID NO: 2438993 - protein, 7 aa, Entamoeba dispar
KPRKPTE

SEQ ID NO: 2438994 - protein, 8 aa, Entamoeba dispar
KPRNQGLS

SEQ ID NO: 2438995 - protein, 7 aa, Entamoeba dispar
KPRNTLE

SEQ ID NO: 2438996 - protein, 7 aa, Entamoeba dispar
KPRPFGV

SEQ ID NO: 2438997 - protein, 16 aa, Entamoeba dispar
KPRPTAEKITSTTPLV

SEQ ID NO: 2438998 - protein, 5 aa, Entamoeba dispar
KPRQC

SEQ ID NO: 2438999 - protein, 5 aa, Entamoeba dispar
KPRTE

SEQ ID NO: 2439000 - protein, 8 aa, Entamoeba dispar
KPRTNHEV

SEQ ID NO: 2439001 - protein, 11 aa, Entamoeba dispar
KPSALSPRFTR

SEQ ID NO: 2439002 - protein, 10 aa, Entamoeba dispar
KPSEIENDKS

SEQ ID NO: 2439003 - protein, 6 aa, Entamoeba dispar
KPSEIN

SEQ ID NO: 2439004 - protein, 10 aa, Entamoeba dispar
KPSEKIEDQH

SEQ ID NO: 2439005 - protein, 7 aa, Entamoeba dispar
KPSEYIS

SEQ ID NO: 2439006 - protein, 16 aa, Entamoeba dispar
KPSGIPTHSGGRYTEN

SEQ ID NO: 2439007 - protein, 4 aa, Entamoeba dispar
KPSH

SEQ ID NO: 2439008 - protein, 6 aa, Entamoeba dispar
KPSHGK

SEQ ID NO: 2439009 - protein, 8 aa, Entamoeba dispar
KPSHGPHG

SEQ ID NO: 2439010 - protein, 6 aa, Entamoeba dispar
KPSIDK

SEQ ID NO: 2439011 - protein, 9 aa, Entamoeba dispar
KPSISPFPP

SEQ ID NO: 2439012 - protein, 12 aa, Entamoeba dispar
KPSKAGDETSRI

SEQ ID NO: 2439013 - protein, 5 aa, Entamoeba dispar
KPSKK

SEQ ID NO: 2439014 - protein, 8 aa, Entamoeba dispar
KPSKKTTV

SEQ ID NO: 2439015 - protein, 8 aa, Entamoeba dispar
KPSKPFTH

SEQ ID NO: 2439016 - protein, 4 aa, Entamoeba dispar
KPSL

SEQ ID NO: 2439017 - protein, 5 aa, Entamoeba dispar
KPSLE

SEQ ID NO: 2439018 - protein, 5 aa, Entamoeba dispar
KPSNA

SEQ ID NO: 2439019 - protein, 9 aa, Entamoeba dispar
KPSNAARLD

SEQ ID NO: 2439020 - protein, 11 aa, Entamoeba dispar
KPSNAARLDPG

SEQ ID NO: 2439021 - protein, 7 aa, Entamoeba dispar
KPSNNQI

SEQ ID NO: 2439022 - protein, 10 aa, Entamoeba dispar
KPSNNTPNEM

SEQ ID NO: 2439023 - protein, 6 aa, Entamoeba dispar
KPSPVD

SEQ ID NO: 2439024 - protein, 6 aa, Entamoeba dispar
KPSQIN

SEQ ID NO: 2439025 - protein, 9 aa, Entamoeba dispar
KPSQISYDE

SEQ ID NO: 2439026 - protein, 14 aa, Entamoeba dispar
KPSRDKSYSLGTTT

SEQ ID NO: 2439027 - protein, 7 aa, Entamoeba dispar
KPSSALS

SEQ ID NO: 2439028 - protein, 6 aa, Entamoeba dispar
KPSSFE

SEQ ID NO: 2439029 - protein, 6 aa, Entamoeba dispar
KPSSII

SEQ ID NO: 2439030 - protein, 20 aa, Entamoeba dispar
KPSSPKPLQEPSKRRSYRRS

SEQ ID NO: 2439031 - protein, 11 aa, Entamoeba dispar
KPSSQEQKSYE

SEQ ID NO: 2439032 - protein, 7 aa, Entamoeba dispar
KPSSVPV

SEQ ID NO: 2439033 - protein, 6 aa, Entamoeba dispar
KPSSYY

SEQ ID NO: 2439034 - protein, 6 aa, Entamoeba dispar
KPSTEI

SEQ ID NO: 2439035 - protein, 15 aa, Entamoeba dispar
KPSTILPESPSDDQF

SEQ ID NO: 2439036 - protein, 41 aa, Entamoeba dispar
KPSVEENDTKTKKTENNIKPKQTVEKEITPKESRKMEEENN

SEQ ID NO: 2439037 - protein, 5 aa, Entamoeba dispar
KPSYP

SEQ ID NO: 2439038 - protein, 7 aa, Entamoeba dispar
KPTASDL

SEQ ID NO: 2439039 - protein, 12 aa, Entamoeba dispar
KPTDCRRRLFQD

SEQ ID NO: 2439040 - protein, 7 aa, Entamoeba dispar
KPTDDDF

SEQ ID NO: 2439041 - protein, 4 aa, Entamoeba dispar
KPTE

SEQ ID NO: 2439042 - protein, 7 aa, Entamoeba dispar
KPTEENL

SEQ ID NO: 2439043 - protein, 5 aa, Entamoeba dispar
KPTFV

SEQ ID NO: 2439044 - protein, 7 aa, Entamoeba dispar
KPTGDFP

SEQ ID NO: 2439045 - protein, 8 aa, Entamoeba dispar
KPTGEKSL

SEQ ID NO: 2439046 - protein, 8 aa, Entamoeba dispar
KPTGTHAA

SEQ ID NO: 2439047 - protein, 4 aa, Entamoeba dispar
KPTI

SEQ ID NO: 2439048 - protein, 5 aa, Entamoeba dispar
KPTIG

SEQ ID NO: 2439049 - protein, 5 aa, Entamoeba dispar
KPTIV

SEQ ID NO: 2439050 - protein, 15 aa, Entamoeba dispar
KPTIVTDENGKKKFG

SEQ ID NO: 2439051 - protein, 5 aa, Entamoeba dispar
KPTLE

SEQ ID NO: 2439052 - protein, 5 aa, Entamoeba dispar
KPTML

SEQ ID NO: 2439053 - protein, 7 aa, Entamoeba dispar
KPTPLSN

SEQ ID NO: 2439054 - protein, 7 aa, Entamoeba dispar
KPTSEIS

SEQ ID NO: 2439055 - protein, 5 aa, Entamoeba dispar
KPTSF

SEQ ID NO: 2439056 - protein, 6 aa, Entamoeba dispar
KPTSLN

SEQ ID NO: 2439057 - protein, 7 aa, Entamoeba dispar
KPTSLNR

SEQ ID NO: 2439058 - protein, 8 aa, Entamoeba dispar
KPTTKREE

SEQ ID NO: 2439059 - protein, 6 aa, Entamoeba dispar
KPTTMT

SEQ ID NO: 2439060 - protein, 7 aa, Entamoeba dispar
KPTTTPN

SEQ ID NO: 2439061 - protein, 4 aa, Entamoeba dispar
KPTV

SEQ ID NO: 2439062 - protein, 11 aa, Entamoeba dispar
KPTVPKAYPNK

SEQ ID NO: 2439063 - protein, 8 aa, Entamoeba dispar
KPVATPQQ

SEQ ID NO: 2439064 - protein, 18 aa, Entamoeba dispar
  misc_feature (17)..(18): Xaa can be any naturally occurring amino acid
KPVEELSSEIEKIIEDXX

SEQ ID NO: 2439065 - protein, 7 aa, Entamoeba dispar
KPVIDKR

SEQ ID NO: 2439066 - protein, 6 aa, Entamoeba dispar
KPVIND

SEQ ID NO: 2439067 - protein, 10 aa, Entamoeba dispar
KPVKTESNYK

SEQ ID NO: 2439068 - protein, 4 aa, Entamoeba dispar
KPVL

SEQ ID NO: 2439069 - protein, 28 aa, Entamoeba dispar
KPVPKVSATTQPKSQESTQQKKKSKCLL

SEQ ID NO: 2439070 - protein, 8 aa, Entamoeba dispar
KPVPQSSF

SEQ ID NO: 2439071 - protein, 7 aa, Entamoeba dispar
KPVPTGK

SEQ ID NO: 2439072 - protein, 14 aa, Entamoeba dispar
KPVRKRSNSTRSGI

SEQ ID NO: 2439073 - protein, 4 aa, Entamoeba dispar
KPWN

SEQ ID NO: 2439074 - protein, 6 aa, Entamoeba dispar
KPYASG

SEQ ID NO: 2439075 - protein, 8 aa, Entamoeba dispar
KPYDPSFA

SEQ ID NO: 2439076 - protein, 6 aa, Entamoeba dispar
KPYEVQ

SEQ ID NO: 2439077 - protein, 7 aa, Entamoeba dispar
KPYGDVS

SEQ ID NO: 2439078 - protein, 4 aa, Entamoeba dispar
KPYH

SEQ ID NO: 2439079 - protein, 6 aa, Entamoeba dispar
KPYHHK

SEQ ID NO: 2439080 - protein, 11 aa, Entamoeba dispar
KPYIPKRNKKV

SEQ ID NO: 2439081 - protein, 5 aa, Entamoeba dispar
KPYNF

SEQ ID NO: 2439082 - protein, 7 aa, Entamoeba dispar
KPYNKGD

SEQ ID NO: 2439083 - protein, 5 aa, Entamoeba dispar
KPYSL

SEQ ID NO: 2439084 - protein, 7 aa, Entamoeba dispar
KPYYSPK

SEQ ID NO: 2439085 - protein, 19 aa, Entamoeba dispar
KQAAMDDETKEELKQAEEE

SEQ ID NO: 2439086 - protein, 7 aa, Entamoeba dispar
KQADPYV

SEQ ID NO: 2439087 - protein, 15 aa, Entamoeba dispar
KQAEEKRKKEEEQKI

SEQ ID NO: 2439088 - protein, 6 aa, Entamoeba dispar
KQAESI

SEQ ID NO: 2439089 - protein, 5 aa, Entamoeba dispar
KQAFP

SEQ ID NO: 2439090 - protein, 7 aa, Entamoeba dispar
KQAGVEN

SEQ ID NO: 2439091 - protein, 7 aa, Entamoeba dispar
KQAKEDS

SEQ ID NO: 2439092 - protein, 6 aa, Entamoeba dispar
KQAKQH

SEQ ID NO: 2439093 - protein, 4 aa, Entamoeba dispar
KQAN

SEQ ID NO: 2439094 - protein, 5 aa, Entamoeba dispar
KQANE

SEQ ID NO: 2439095 - protein, 10 aa, Entamoeba dispar
KQANHPDKSI

SEQ ID NO: 2439096 - protein, 9 aa, Entamoeba dispar
KQAQGDFNR

SEQ ID NO: 2439097 - protein, 9 aa, Entamoeba dispar
KQAQRTQCS

SEQ ID NO: 2439098 - protein, 4 aa, Entamoeba dispar
KQAR

SEQ ID NO: 2439099 - protein, 8 aa, Entamoeba dispar
KQARLEKP

SEQ ID NO: 2439100 - protein, 10 aa, Entamoeba dispar
KQASDKNTYI

SEQ ID NO: 2439101 - protein, 6 aa, Entamoeba dispar
KQCDGN

SEQ ID NO: 2439102 - protein, 4 aa, Entamoeba dispar
KQCF

SEQ ID NO: 2439103 - protein, 8 aa, Entamoeba dispar
KQDADQIT

SEQ ID NO: 2439104 - protein, 7 aa, Entamoeba dispar
KQDAEVF

SEQ ID NO: 2439105 - protein, 7 aa, Entamoeba dispar
KQDDESD

SEQ ID NO: 2439106 - protein, 11 aa, Entamoeba dispar
KQDDSEENKYP

SEQ ID NO: 2439107 - protein, 5 aa, Entamoeba dispar
KQDDW

SEQ ID NO: 2439108 - protein, 7 aa, Entamoeba dispar
KQDENDL

SEQ ID NO: 2439109 - protein, 6 aa, Entamoeba dispar
KQDGNV

SEQ ID NO: 2439110 - protein, 22 aa, Entamoeba dispar
KQDGQKQSCSTCDSKKLNNNSL

SEQ ID NO: 2439111 - protein, 6 aa, Entamoeba dispar
KQDIFK

SEQ ID NO: 2439112 - protein, 10 aa, Entamoeba dispar
KQDKKALKKW

SEQ ID NO: 2439113 - protein, 14 aa, Entamoeba dispar
KQDMEGALSSAQIS

SEQ ID NO: 2439114 - protein, 6 aa, Entamoeba dispar
KQDPDV

SEQ ID NO: 2439115 - protein, 5 aa, Entamoeba dispar
KQDQN

SEQ ID NO: 2439116 - protein, 6 aa, Entamoeba dispar
KQDQVV

SEQ ID NO: 2439117 - protein, 8 aa, Entamoeba dispar
KQDSKNQC

SEQ ID NO: 2439118 - protein, 8 aa, Entamoeba dispar
KQDTKNYT

SEQ ID NO: 2439119 - protein, 24 aa, Entamoeba dispar
KQEAERKEKERKAEEERLQKEHEE

SEQ ID NO: 2439120 - protein, 6 aa, Entamoeba dispar
KQEAVE

SEQ ID NO: 2439121 - protein, 72 aa, Entamoeba dispar
KQEDEGITKEQRKQEKEIEDKKEENELTRTQQRDDIIDKTEDKIEDIKEEEIKRKTLNGRKGIKRKKKQIEE

SEQ ID NO: 2439122 - protein, 6 aa, Entamoeba dispar
KQEDEM

SEQ ID NO: 2439123 - protein, 7 aa, Entamoeba dispar
KQEDGKQ

SEQ ID NO: 2439124 - protein, 6 aa, Entamoeba dispar
KQEDVE

SEQ ID NO: 2439125 - protein, 8 aa, Entamoeba dispar
KQEEEMKT

SEQ ID NO: 2439126 - protein, 19 aa, Entamoeba dispar
KQEEKKLTMEEEAEQKAIN

SEQ ID NO: 2439127 - protein, 6 aa, Entamoeba dispar
KQEEPA

SEQ ID NO: 2439128 - protein, 4 aa, Entamoeba dispar
KQEF

SEQ ID NO: 2439129 - protein, 14 aa, Entamoeba dispar
KQEGDSKKPHIPKS

SEQ ID NO: 2439130 - protein, 9 aa, Entamoeba dispar
KQEGDVGED

SEQ ID NO: 2439131 - protein, 6 aa, Entamoeba dispar
KQEGKT

SEQ ID NO: 2439132 - protein, 6 aa, Entamoeba dispar
KQEGLQ

SEQ ID NO: 2439133 - protein, 7 aa, Entamoeba dispar
KQEGPDK

SEQ ID NO: 2439134 - protein, 4 aa, Entamoeba dispar
KQEH

SEQ ID NO: 2439135 - protein, 32 aa, Entamoeba dispar
KQEHERQNHERMKTPAEKKKIKKEKNEKAIET

SEQ ID NO: 2439136 - protein, 10 aa, Entamoeba dispar
KQEHEVSRDR

SEQ ID NO: 2439137 - protein, 4 aa, Entamoeba dispar
KQEI

SEQ ID NO: 2439138 - protein, 19 aa, Entamoeba dispar
KQEIAPFKEGDRIQSKNHE

SEQ ID NO: 2439139 - protein, 6 aa, Entamoeba dispar
KQEIEE

SEQ ID NO: 2439140 - protein, 22 aa, Entamoeba dispar
KQEIKDESREQQLQRERAERLE

SEQ ID NO: 2439141 - protein, 17 aa, Entamoeba dispar
KQEIKPENNNVNQTTEI

SEQ ID NO: 2439142 - protein, 15 aa, Entamoeba dispar
KQEINERVSVFYGEE

SEQ ID NO: 2439143 - protein, 5 aa, Entamoeba dispar
KQEIR

SEQ ID NO: 2439144 - protein, 9 aa, Entamoeba dispar
KQEKEKYET

SEQ ID NO: 2439145 - protein, 18 aa, Entamoeba dispar
KQEKIKPSDLSSLSSSKL

SEQ ID NO: 2439146 - protein, 8 aa, Entamoeba dispar
KQEKKLFP

SEQ ID NO: 2439147 - protein, 8 aa, Entamoeba dispar
KQEKVGDN

SEQ ID NO: 2439148 - protein, 11 aa, Entamoeba dispar
KQEKWSSKEVQ

SEQ ID NO: 2439149 - protein, 6 aa, Entamoeba dispar
KQELSR

SEQ ID NO: 2439150 - protein, 12 aa, Entamoeba dispar
KQEMSESEEMGE

SEQ ID NO: 2439151 - protein, 5 aa, Entamoeba dispar
KQENE

SEQ ID NO: 2439152 - protein, 5 aa, Entamoeba dispar
KQENK

SEQ ID NO: 2439153 - protein, 22 aa, Entamoeba dispar
KQENKALKSGKKFDKKQKITKD

SEQ ID NO: 2439154 - protein, 12 aa, Entamoeba dispar
KQENKITHPKME

SEQ ID NO: 2439155 - protein, 9 aa, Entamoeba dispar
KQENKLPTG

SEQ ID NO: 2439156 - protein, 10 aa, Entamoeba dispar
KQENKVNSSI

SEQ ID NO: 2439157 - protein, 8 aa, Entamoeba dispar
KQENNNVS

SEQ ID NO: 2439158 - protein, 44 aa, Entamoeba dispar
KQEPKGDDLDEIKEQNEESQNEEKTVTEEIESDKTEKKKIRINR

SEQ ID NO: 2439159 - protein, 87 aa, Entamoeba dispar
KQEQRAQEEQALYEKEQKELQERKKAMREAREKQKKLREEKERKRQEEERAAFEAEQEAEKRRKESINNSIAAAKAQRQKEEEEERA

SEQ ID NO: 2439160 - protein, 13 aa, Entamoeba dispar
KQEREANNQRENA

SEQ ID NO: 2439161 - protein, 5 aa, Entamoeba dispar
KQERI

SEQ ID NO: 2439162 - protein, 16 aa, Entamoeba dispar
KQERLEEEATKSLRIA

SEQ ID NO: 2439163 - protein, 10 aa, Entamoeba dispar
KQESSGNYST

SEQ ID NO: 2439164 - protein, 4 aa, Entamoeba dispar
KQET

SEQ ID NO: 2439165 - protein, 8 aa, Entamoeba dispar
KQETNNSK

SEQ ID NO: 2439166 - protein, 11 aa, Entamoeba dispar
KQETTSKKPEE

SEQ ID NO: 2439167 - protein, 6 aa, Entamoeba dispar
KQEVKD

SEQ ID NO: 2439168 - protein, 4 aa, Entamoeba dispar
KQEY

SEQ ID NO: 2439169 - protein, 9 aa, Entamoeba dispar
KQEYEAEVE

SEQ ID NO: 2439170 - protein, 12 aa, Entamoeba dispar
KQEYIQETPSKR

SEQ ID NO: 2439171 - protein, 7 aa, Entamoeba dispar
KQFEEEE

SEQ ID NO: 2439172 - protein, 6 aa, Entamoeba dispar
KQFENE

SEQ ID NO: 2439173 - protein, 5 aa, Entamoeba dispar
KQFNN

SEQ ID NO: 2439174 - protein, 7 aa, Entamoeba dispar
KQFPNSK

SEQ ID NO: 2439175 - protein, 6 aa, Entamoeba dispar
KQFQDS

SEQ ID NO: 2439176 - protein, 4 aa, Entamoeba dispar
KQFS

SEQ ID NO: 2439177 - protein, 6 aa, Entamoeba dispar
KQGADL

SEQ ID NO: 2439178 - protein, 5 aa, Entamoeba dispar
KQGDF

SEQ ID NO: 2439179 - protein, 6 aa, Entamoeba dispar
KQGDFG

SEQ ID NO: 2439180 - protein, 11 aa, Entamoeba dispar
KQGDKHPDSGA

SEQ ID NO: 2439181 - protein, 9 aa, Entamoeba dispar
KQGEDSERL

SEQ ID NO: 2439182 - protein, 16 aa, Entamoeba dispar
KQGEEENKKKEEEINE

SEQ ID NO: 2439183 - protein, 9 aa, Entamoeba dispar
KQGEEIDNR

SEQ ID NO: 2439184 - protein, 6 aa, Entamoeba dispar
KQGEPL

SEQ ID NO: 2439185 - protein, 8 aa, Entamoeba dispar
KQGEPNCD

SEQ ID NO: 2439186 - protein, 10 aa, Entamoeba dispar
KQGERHPESE

SEQ ID NO: 2439187 - protein, 4 aa, Entamoeba dispar
KQGF

SEQ ID NO: 2439188 - protein, 9 aa, Entamoeba dispar
KQGFDPDLK

SEQ ID NO: 2439189 - protein, 6 aa, Entamoeba dispar
KQGGGM

SEQ ID NO: 2439190 - protein, 8 aa, Entamoeba dispar
KQGGNAKF

SEQ ID NO: 2439191 - protein, 7 aa, Entamoeba dispar
KQGIYEE

SEQ ID NO: 2439192 - protein, 4 aa, Entamoeba dispar
KQGK

SEQ ID NO: 2439193 - protein, 9 aa, Entamoeba dispar
KQGKDLVKK

SEQ ID NO: 2439194 - protein, 7 aa, Entamoeba dispar
KQGKKGC

SEQ ID NO: 2439195 - protein, 11 aa, Entamoeba dispar
KQGKLKATEIE

SEQ ID NO: 2439196 - protein, 8 aa, Entamoeba dispar
KQGKRPVV

SEQ ID NO: 2439197 - protein, 4 aa, Entamoeba dispar
KQGN

SEQ ID NO: 2439198 - protein, 7 aa, Entamoeba dispar
KQGNAAS

SEQ ID NO: 2439199 - protein, 5 aa, Entamoeba dispar
KQGNI

SEQ ID NO: 2439200 - protein, 6 aa, Entamoeba dispar
KQGNIY

SEQ ID NO: 2439201 - protein, 8 aa, Entamoeba dispar
KQGNLSQS

SEQ ID NO: 2439202 - protein, 5 aa, Entamoeba dispar
KQGQE

SEQ ID NO: 2439203 - protein, 15 aa, Entamoeba dispar
KQGRIEIESEGIIEM

SEQ ID NO: 2439204 - protein, 6 aa, Entamoeba dispar
KQGRSD

SEQ ID NO: 2439205 - protein, 25 aa, Entamoeba dispar
KQGSTPKGKVSKRERYRSNSSFNKH

SEQ ID NO: 2439206 - protein, 12 aa, Entamoeba dispar
KQHKPVTSKDLE

SEQ ID NO: 2439207 - protein, 7 aa, Entamoeba dispar
KQHNENL

SEQ ID NO: 2439208 - protein, 44 aa, Entamoeba dispar
KQHPIEKKEPKPTKTNRGKKVRRKVSEEDEYEEKRTKKRKHTKA

SEQ ID NO: 2439209 - protein, 8 aa, Entamoeba dispar
KQHRPDVS

SEQ ID NO: 2439210 - protein, 6 aa, Entamoeba dispar
KQHSQV

SEQ ID NO: 2439211 - protein, 5 aa, Entamoeba dispar
KQHYN

SEQ ID NO: 2439212 - protein, 6 aa, Entamoeba dispar
KQIDDG

SEQ ID NO: 2439213 - protein, 6 aa, Entamoeba dispar
KQIDEL

SEQ ID NO: 2439214 - protein, 13 aa, Entamoeba dispar
KQIDKDEDKMKEF

SEQ ID NO: 2439215 - protein, 16 aa, Entamoeba dispar
KQIEERDKGMKENSDK

SEQ ID NO: 2439216 - protein, 12 aa, Entamoeba dispar
KQIEKEPNQTVP

SEQ ID NO: 2439217 - protein, 43 aa, Entamoeba dispar
KQIEKKKNDDDLEIESDSDDWSKKSLINKDNTKRNEKREDDDI

SEQ ID NO: 2439218 - protein, 9 aa, Entamoeba dispar
KQIEKNKDK

SEQ ID NO: 2439219 - protein, 15 aa, Entamoeba dispar
KQIENEWKQTNQEHQ

SEQ ID NO: 2439220 - protein, 13 aa, Entamoeba dispar
KQIEYTSGDGLHG

SEQ ID NO: 2439221 - protein, 13 aa, Entamoeba dispar
KQIKHSKEFRDKT

SEQ ID NO: 2439222 - protein, 9 aa, Entamoeba dispar
KQIKNTGPF

SEQ ID NO: 2439223 - protein, 7 aa, Entamoeba dispar
KQIKRDT

SEQ ID NO: 2439224 - protein, 31 aa, Entamoeba dispar
KQINDKTKKATRVSEDKIRKVPRRGRIGFSL

SEQ ID NO: 2439225 - protein, 12 aa, Entamoeba dispar
KQINGKDIEKKD

SEQ ID NO: 2439226 - protein, 6 aa, Entamoeba dispar
KQINRD

SEQ ID NO: 2439227 - protein, 4 aa, Entamoeba dispar
KQIP

SEQ ID NO: 2439228 - protein, 14 aa, Entamoeba dispar
KQIPKAPKKGYKYI

SEQ ID NO: 2439229 - protein, 10 aa, Entamoeba dispar
KQIPKEKKDG

SEQ ID NO: 2439230 - protein, 8 aa, Entamoeba dispar
KQIPPTGA

SEQ ID NO: 2439231 - protein, 8 aa, Entamoeba dispar
KQIPQKTE

SEQ ID NO: 2439232 - protein, 5 aa, Entamoeba dispar
KQIPS

SEQ ID NO: 2439233 - protein, 10 aa, Entamoeba dispar
KQIPSKRSPH

SEQ ID NO: 2439234 - protein, 9 aa, Entamoeba dispar
KQIQQGGIN

SEQ ID NO: 2439235 - protein, 7 aa, Entamoeba dispar
KQIRERY

SEQ ID NO: 2439236 - protein, 6 aa, Entamoeba dispar
KQIRQQ

SEQ ID NO: 2439237 - protein, 11 aa, Entamoeba dispar
KQIRYNDETVR

SEQ ID NO: 2439238 - protein, 8 aa, Entamoeba dispar
KQISSKGY

SEQ ID NO: 2439239 - protein, 10 aa, Entamoeba dispar
KQKAIAEAKE

SEQ ID NO: 2439240 - protein, 13 aa, Entamoeba dispar
KQKAKTSSTEVAT

SEQ ID NO: 2439241 - protein, 6 aa, Entamoeba dispar
KQKATH

SEQ ID NO: 2439242 - protein, 9 aa, Entamoeba dispar
KQKAVPTTI

SEQ ID NO: 2439243 - protein, 9 aa, Entamoeba dispar
KQKDEDINQ

SEQ ID NO: 2439244 - protein, 16 aa, Entamoeba dispar
KQKDETITELTETNEK

SEQ ID NO: 2439245 - protein, 5 aa, Entamoeba dispar
KQKDI

SEQ ID NO: 2439246 - protein, 10 aa, Entamoeba dispar
KQKDKTNKEI

SEQ ID NO: 2439247 - protein, 10 aa, Entamoeba dispar
KQKDPSLTPQ

SEQ ID NO: 2439248 - protein, 14 aa, Entamoeba dispar
KQKDRSSLSQNETH

SEQ ID NO: 2439249 - protein, 53 aa, Entamoeba dispar
KQKEEEDKFKKEEEERKKKVEEERKQKEEEERIKREEEYKKQQEEVTRKINEE

SEQ ID NO: 2439250 - protein, 10 aa, Entamoeba dispar
KQKEENTNKI

SEQ ID NO: 2439251 - protein, 38 aa, Entamoeba dispar
KQKEESNVSSHKYGRSSDTSQYSRRNIRPSKIHTEPVK

SEQ ID NO: 2439252 - protein, 9 aa, Entamoeba dispar
KQKEEYESQ

SEQ ID NO: 2439253 - protein, 10 aa, Entamoeba dispar
KQKEIEEGGP

SEQ ID NO: 2439254 - protein, 6 aa, Entamoeba dispar
KQKEKL

SEQ ID NO: 2439255 - protein, 11 aa, Entamoeba dispar
KQKENLNNKRK

SEQ ID NO: 2439256 - protein, 8 aa, Entamoeba dispar
KQKEPFNN

SEQ ID NO: 2439257 - protein, 24 aa, Entamoeba dispar
KQKEQIKSQNSKELQKSSLIKSGN

SEQ ID NO: 2439258 - protein, 9 aa, Entamoeba dispar
KQKEQKPIH

SEQ ID NO: 2439259 - protein, 30 aa, Entamoeba dispar
KQKEQQIGRGKKKEGIDSYQRKGENIVSDT

SEQ ID NO: 2439260 - protein, 6 aa, Entamoeba dispar
KQKESF

SEQ ID NO: 2439261 - protein, 34 aa, Entamoeba dispar
KQKEVQNKAQTTKETEIHQTVNQEKNSQNSCDYQ

SEQ ID NO: 2439262 - protein, 8 aa, Entamoeba dispar
KQKGENDL

SEQ ID NO: 2439263 - protein, 5 aa, Entamoeba dispar
KQKGI

SEQ ID NO: 2439264 - protein, 10 aa, Entamoeba dispar
KQKGSDNDNF

SEQ ID NO: 2439265 - protein, 10 aa, Entamoeba dispar
KQKGSEDEPI

SEQ ID NO: 2439266 - protein, 5 aa, Entamoeba dispar
KQKIE

SEQ ID NO: 2439267 - protein, 10 aa, Entamoeba dispar
KQKIGERPDP

SEQ ID NO: 2439268 - protein, 7 aa, Entamoeba dispar
KQKIGTK

SEQ ID NO: 2439269 - protein, 27 aa, Entamoeba dispar
KQKISKLASQAAINEEEIERKNKEINL

SEQ ID NO: 2439270 - protein, 8 aa, Entamoeba dispar
KQKKAGYV

SEQ ID NO: 2439271 - protein, 20 aa, Entamoeba dispar
KQKKDRYNINEESEEEEEFT

SEQ ID NO: 2439272 - protein, 28 aa, Entamoeba dispar
KQKKEPTFAKPEGGEGIKDGQQENGMGD

SEQ ID NO: 2439273 - protein, 6 aa, Entamoeba dispar
KQKKEY

SEQ ID NO: 2439274 - protein, 15 aa, Entamoeba dispar
KQKKFKLKSGEHATN

SEQ ID NO: 2439275 - protein, 26 aa, Entamoeba dispar
KQKKIKEEQNEQKTHEQNETSKNENN

SEQ ID NO: 2439276 - protein, 41 aa, Entamoeba dispar
KQKKQQLSERRERKRGIVETQTKKNVQTEEELVSETKTKLK

SEQ ID NO: 2439277 - protein, 4 aa, Entamoeba dispar
KQKL

SEQ ID NO: 2439278 - protein, 12 aa, Entamoeba dispar
KQKLRDYVLGIN

SEQ ID NO: 2439279 - protein, 7 aa, Entamoeba dispar
KQKLTKI

SEQ ID NO: 2439280 - protein, 4 aa, Entamoeba dispar
KQKN

SEQ ID NO: 2439281 - protein, 17 aa, Entamoeba dispar
KQKNEEIDNIKKEKEAL

SEQ ID NO: 2439282 - protein, 22 aa, Entamoeba dispar
KQKNLQKKMKEIKKKENESDSI

SEQ ID NO: 2439283 - protein, 22 aa, Entamoeba dispar
KQKNMDEDGNESGSEDEMEPME

SEQ ID NO: 2439284 - protein, 15 aa, Entamoeba dispar
KQKNPGKINPSTSFT

SEQ ID NO: 2439285 - protein, 7 aa, Entamoeba dispar
KQKNPSL

SEQ ID NO: 2439286 - protein, 6 aa, Entamoeba dispar
KQKNYE

SEQ ID NO: 2439287 - protein, 9 aa, Entamoeba dispar
KQKPEPINV

SEQ ID NO: 2439288 - protein, 18 aa, Entamoeba dispar
KQKPIPAKVSKEETESTI

SEQ ID NO: 2439289 - protein, 18 aa, Entamoeba dispar
KQKPIWTRNPSEITKEEY

SEQ ID NO: 2439290 - protein, 14 aa, Entamoeba dispar
KQKQSNEDDLSSLE

SEQ ID NO: 2439291 - protein, 6 aa, Entamoeba dispar
KQKQTI

SEQ ID NO: 2439292 - protein, 6 aa, Entamoeba dispar
KQKRDG

SEQ ID NO: 2439293 - protein, 13 aa, Entamoeba dispar
KQKRDTSKRDYTS

SEQ ID NO: 2439294 - protein, 9 aa, Entamoeba dispar
KQKREEESL

SEQ ID NO: 2439295 - protein, 13 aa, Entamoeba dispar
KQKREQWRKERKE

SEQ ID NO: 2439296 - protein, 6 aa, Entamoeba dispar
KQKRID

SEQ ID NO: 2439297 - protein, 33 aa, Entamoeba dispar
KQKRREARGLTSAAKKSRGFTGKGRRYNKIGAG

SEQ ID NO: 2439298 - protein, 5 aa, Entamoeba dispar
KQKRS

SEQ ID NO: 2439299 - protein, 8 aa, Entamoeba dispar
KQKRTSYI

SEQ ID NO: 2439300 - protein, 11 aa, Entamoeba dispar
KQKSKEKKYTD

SEQ ID NO: 2439301 - protein, 5 aa, Entamoeba dispar
KQKSL

SEQ ID NO: 2439302 - protein, 10 aa, Entamoeba dispar
KQKSLTETYN

SEQ ID NO: 2439303 - protein, 10 aa, Entamoeba dispar
KQKSSVTHQK

SEQ ID NO: 2439304 - protein, 20 aa, Entamoeba dispar
KQKTEKDKELSEEDDTNYFS

SEQ ID NO: 2439305 - protein, 8 aa, Entamoeba dispar
KQKTESIY

SEQ ID NO: 2439306 - protein, 5 aa, Entamoeba dispar
KQKTF

SEQ ID NO: 2439307 - protein, 13 aa, Entamoeba dispar
KQKTTDKMKEKAD

SEQ ID NO: 2439308 - protein, 9 aa, Entamoeba dispar
KQKVGKSPY

SEQ ID NO: 2439309 - protein, 6 aa, Entamoeba dispar
KQKYKK

SEQ ID NO: 2439310 - protein, 6 aa, Entamoeba dispar
KQLADK

SEQ ID NO: 2439311 - protein, 5 aa, Entamoeba dispar
KQLDK

SEQ ID NO: 2439312 - protein, 4 aa, Entamoeba dispar
KQLE

SEQ ID NO: 2439313 - protein, 8 aa, Entamoeba dispar
KQLEDKNT

SEQ ID NO: 2439314 - protein, 8 aa, Entamoeba dispar
KQLEDKST

SEQ ID NO: 2439315 - protein, 9 aa, Entamoeba dispar
KQLEEENPN

SEQ ID NO: 2439316 - protein, 18 aa, Entamoeba dispar
KQLEENKLKQQETTDSIR

SEQ ID NO: 2439317 - protein, 16 aa, Entamoeba dispar
KQLEEQTKLQTKEHPK

SEQ ID NO: 2439318 - protein, 6 aa, Entamoeba dispar
KQLESV

SEQ ID NO: 2439319 - protein, 10 aa, Entamoeba dispar
KQLETTNSDT

SEQ ID NO: 2439320 - protein, 15 aa, Entamoeba dispar
KQLGTKDEQKAHLKS

SEQ ID NO: 2439321 - protein, 11 aa, Entamoeba dispar
KQLINNQKKEK

SEQ ID NO: 2439322 - protein, 10 aa, Entamoeba dispar
KQLKKKPNNQ

SEQ ID NO: 2439323 - protein, 8 aa, Entamoeba dispar
KQLKQSNK

SEQ ID NO: 2439324 - protein, 6 aa, Entamoeba dispar
KQLNEE

SEQ ID NO: 2439325 - protein, 26 aa, Entamoeba dispar
KQLNEKQKKEDKEKKEKTKVKHPEVH

SEQ ID NO: 2439326 - protein, 10 aa, Entamoeba dispar
KQLNETARSN

SEQ ID NO: 2439327 - protein, 6 aa, Entamoeba dispar
KQLNQK

SEQ ID NO: 2439328 - protein, 18 aa, Entamoeba dispar
KQLNQPHQGVTEQPPKEV

SEQ ID NO: 2439329 - protein, 9 aa, Entamoeba dispar
KQLNSESIT

SEQ ID NO: 2439330 - protein, 13 aa, Entamoeba dispar
KQLNTPVTSPSQF

SEQ ID NO: 2439331 - protein, 4 aa, Entamoeba dispar
KQLP

SEQ ID NO: 2439332 - protein, 7 aa, Entamoeba dispar
KQLPDDS

SEQ ID NO: 2439333 - protein, 16 aa, Entamoeba dispar
KQLPLNSSTQSNSTIL

SEQ ID NO: 2439334 - protein, 17 aa, Entamoeba dispar
KQLPTDITTEEQEESYA

SEQ ID NO: 2439335 - protein, 6 aa, Entamoeba dispar
KQLQNN

SEQ ID NO: 2439336 - protein, 24 aa, Entamoeba dispar
KQLRKQNNELEDHADDAENADDDY

SEQ ID NO: 2439337 - protein, 20 aa, Entamoeba dispar
KQLSEEVSKLEEKYKQFKDQ

SEQ ID NO: 2439338 - protein, 11 aa, Entamoeba dispar
KQLSKSIEAYQ

SEQ ID NO: 2439339 - protein, 11 aa, Entamoeba dispar
KQLSQQHTTSI

SEQ ID NO: 2439340 - protein, 14 aa, Entamoeba dispar
KQLSSGDDQTSTFC

SEQ ID NO: 2439341 - protein, 16 aa, Entamoeba dispar
KQLSSQNSTQPQLQTK

SEQ ID NO: 2439342 - protein, 4 aa, Entamoeba dispar
KQLT

SEQ ID NO: 2439343 - protein, 22 aa, Entamoeba dispar
KQLTDKRKDKLARITGRRNSLE

SEQ ID NO: 2439344 - protein, 16 aa, Entamoeba dispar
KQLTEEMKEKMEEEEE

SEQ ID NO: 2439345 - protein, 11 aa, Entamoeba dispar
KQLTESNFERG

SEQ ID NO: 2439346 - protein, 8 aa, Entamoeba dispar
KQLTGKIE

SEQ ID NO: 2439347 - protein, 5 aa, Entamoeba dispar
KQMDK

SEQ ID NO: 2439348 - protein, 7 aa, Entamoeba dispar
KQMERQE

SEQ ID NO: 2439349 - protein, 13 aa, Entamoeba dispar
KQMKEQQNQIENL

SEQ ID NO: 2439350 - protein, 10 aa, Entamoeba dispar
KQMQEQNKMN

SEQ ID NO: 2439351 - protein, 9 aa, Entamoeba dispar
KQMTGKRPM
